United States Patent 7,323,308 (METHODS OF GENETIC ANALYSIS OF E. COLI) - sequence listing, part 2

SEQ ID NO: 40611 - DNA, 25 bp, E. coli
gatgccgcttactcaagaagaaaga

SEQ ID NO: 40612 - DNA, 25 bp, E. coli
gatgccgcttacacaagaagaaaga

SEQ ID NO: 40613 - DNA, 25 bp, E. coli
caggcggagtcgttgctattgccaa

SEQ ID NO: 40614 - DNA, 25 bp, E. coli
caggcggagtcgatgctattgccaa

SEQ ID NO: 40615 - DNA, 25 bp, E. coli
tagaacaggcggagtcgttgctatt

SEQ ID NO: 40616 - DNA, 25 bp, E. coli
tagaacaggcggtgtcgttgctatt

SEQ ID NO: 40617 - DNA, 25 bp, E. coli
attgccaagcccctttgattacagc

SEQ ID NO: 40618 - DNA, 25 bp, E. coli
attgccaagcccgtttgattacagc

SEQ ID NO: 40619 - DNA, 25 bp, E. coli
tgctattgccaaccccgtttgatta

SEQ ID NO: 40620 - DNA, 25 bp, E. coli
tgctattgccaagcccgtttgatta

SEQ ID NO: 40621 - DNA, 25 bp, E. coli
tcgcggcttgggatagaacaggcgg

SEQ ID NO: 40622 - DNA, 25 bp, E. coli
tcgcggcttgggttagaacaggcgg

SEQ ID NO: 40623 - DNA, 25 bp, E. coli
gcggagtcgttggtattgccaagcc

SEQ ID NO: 40624 - DNA, 25 bp, E. coli
gcggagtcgttgctattgccaagcc

SEQ ID NO: 40625 - DNA, 25 bp, E. coli
cgttgctattgccaagcccgtttga

SEQ ID NO: 40626 - DNA, 25 bp, E. coli
cgttgctattgcgaagcccgtttga

SEQ ID NO: 40627 - DNA, 25 bp, E. coli
ctctcaagcaggcagtcgggcgact

SEQ ID NO: 40628 - DNA, 25 bp, E. coli
ctctcaagcagggagtcgggcgact

SEQ ID NO: 40629 - DNA, 25 bp, E. coli
ggttttggtaatatgtgacaatcgg

SEQ ID NO: 40630 - DNA, 25 bp, E. coli
ggttttggtaatttgtgacaatcgg

SEQ ID NO: 40631 - DNA, 25 bp, E. coli
tcaagcagggagacgggcgactgat

SEQ ID NO: 40632 - DNA, 25 bp, E. coli
tcaagcagggagtcgggcgactgat

SEQ ID NO: 40633 - DNA, 25 bp, E. coli
gagtcgttgctattgccaagcccgt

SEQ ID NO: 40634 - DNA, 25 bp, E. coli
gagtcgttgctaatgccaagcccgt

SEQ ID NO: 40635 - DNA, 25 bp, E. coli
caattatggcgtgaggtcaggcgat

SEQ ID NO: 40636 - DNA, 25 bp, E. coli
caattatggcgtcaggtcaggcgat

SEQ ID NO: 40637 - DNA, 25 bp, E. coli
caaagcagggtggtttgagtaccgc

SEQ ID NO: 40638 - DNA, 25 bp, E. coli
caaagcagggtgctttgagtaccgc

SEQ ID NO: 40639 - DNA, 25 bp, E. coli
catagcgcgtcagggttaaaactca

SEQ ID NO: 40640 - DNA, 25 bp, E. coli
catagcgcgtcacggttaaaactca

SEQ ID NO: 40641 - DNA, 25 bp, E. coli
tatttgccggataccaacgaactgg

SEQ ID NO: 40642 - DNA, 25 bp, E. coli
tatttgccggattccaacgaactgg

SEQ ID NO: 40643 - DNA, 25 bp, E. coli
ttctcattgaacttcagggccagcg

SEQ ID NO: 40644 - DNA, 25 bp, E. coli
ttctcattgaacatcagggccagcg

SEQ ID NO: 40645 - DNA, 25 bp, E. coli
tgttaaaacgtcagcgcaaagcgcg

SEQ ID NO: 40646 - DNA, 25 bp, E. coli
tgttaaaacgtctgcgcaaagcgcg

SEQ ID NO: 40647 - DNA, 25 bp, E. coli
tgcatatggatgtccacgccggaaa

SEQ ID NO: 40648 - DNA, 25 bp, E. coli
tgcatatggatgaccacgccggaaa

SEQ ID NO: 40649 - DNA, 25 bp, E. coli
gccggaaatttagtgcatagcgcgt

SEQ ID NO: 40650 - DNA, 25 bp, E. coli
gccggaaatttactgcatagcgcgt

SEQ ID NO: 40651 - DNA, 25 bp, E. coli
ctgtactggcaggaaagcgatccgg

SEQ ID NO: 40652 - DNA, 25 bp, E. coli
ctgtactggcagcaaagcgatccgg

SEQ ID NO: 40653 - DNA, 25 bp, E. coli
gatcaacaatttttcaggctggccg

SEQ ID NO: 40654 - DNA, 25 bp, E. coli
gatcaacaatttatcaggctggccg

SEQ ID NO: 40655 - DNA, 25 bp, E. coli
ggtcaatgactaagccactcgcgcg

SEQ ID NO: 40656 - DNA, 25 bp, E. coli
ggtcaatgactatgccactcgcgcg

SEQ ID NO: 40657 - DNA, 25 bp, E. coli
taaagccgaaggtatactgctgcaa

SEQ ID NO: 40658 - DNA, 25 bp, E. coli
taaagccgaaggaatactgctgcaa

SEQ ID NO: 40659 - DNA, 25 bp, E. coli
tcgccgtagtataagcatttccatt

SEQ ID NO: 40660 - DNA, 25 bp, E. coli
tcgccgtagtattagcatttccatt

SEQ ID NO: 40661 - DNA, 25 bp, E. coli
tcagcgcagccctgtactcagtgct

SEQ ID NO: 40662 - DNA, 25 bp, E. coli
tcagcgcagcccagtactcagtgct

SEQ ID NO: 40663 - DNA, 25 bp, E. coli
tcaggcgggcagacagcgcagccct

SEQ ID NO: 40664 - DNA, 25 bp, E. coli
tcaggcgggcagtcagcgcagccct

SEQ ID NO: 40665 - DNA, 25 bp, E. coli
gccctgtactcactgctgcgtttat

SEQ ID NO: 40666 - DNA, 25 bp, E. coli
gccgtagtattaccatttccattaa

SEQ ID NO: 40667 - DNA, 25 bp, E. coli
gccctgtactcagtgctgcgtttat

SEQ ID NO: 40668 - DNA, 25 bp, E. coli
gccgtagtattagcatttccattaa

SEQ ID NO: 40669 - DNA, 25 bp, E. coli
gacgtggaggtaaacgtaccgccag

SEQ ID NO: 40670 - DNA, 25 bp, E. coli
gacgtggaggtatacgtaccgccag

SEQ ID NO: 40671 - DNA, 25 bp, E. coli
ccgaaggaatactgctgcaatgcca

SEQ ID NO: 40672 - DNA, 25 bp, E. coli
ccgaaggaatacagctgcaatgcca

SEQ ID NO: 40673 - DNA, 25 bp, E. coli
ctgtactcagtgctgcgtttatcag

SEQ ID NO: 40674 - DNA, 25 bp, E. coli
ctgtactcagtggtgcgtttatcag

SEQ ID NO: 40675 - DNA, 25 bp, E. coli
ggaggtaaacgttccgccagaagtg

SEQ ID NO: 40676 - DNA, 25 bp, E. coli
ggaggtaaacgtaccgccagaagtg

SEQ ID NO: 40677 - DNA, 25 bp, E. coli
gtaattaaagccgaaggaatactgc

SEQ ID NO: 40678 - DNA, 25 bp, E. coli
gtaattaaagcccaaggaatactgc

SEQ ID NO: 40679 - DNA, 25 bp, E. coli
tgttcgcaacctaaccaaacagtca

SEQ ID NO: 40680 - DNA, 25 bp, E. coli
tgttcgcaaccttaccaaacagtca

SEQ ID NO: 40681 - DNA, 25 bp, E. coli
tgatatgcagtaaggaaatgttccg

SEQ ID NO: 40682 - DNA, 25 bp, E. coli
tgatatgcagtatggaaatgttccg

SEQ ID NO: 40683 - DNA, 25 bp, E. coli
tgacaactcatctctgtaggccagt

SEQ ID NO: 40684 - DNA, 25 bp, E. coli
tgacaactcatcactgtaggccagt

SEQ ID NO: 40685 - DNA, 25 bp, E. coli
tccttgaaaaagaggttgacgctgc

SEQ ID NO: 40686 - DNA, 25 bp, E. coli
tccttgaaaaagtggttgacgctgc

SEQ ID NO: 40687 - DNA, 25 bp, E. coli
cctgtatgacaatagaatggctgta

SEQ ID NO: 40688 - DNA, 25 bp, E. coli
cctgtatgacaaaagaatggctgta

SEQ ID NO: 40689 - DNA, 25 bp, E. coli
gcaacgccgatatggtatcgcgaaa

SEQ ID NO: 40690 - DNA, 25 bp, E. coli
gcaacgccgataaggtatcgcgaaa

SEQ ID NO: 40691 - DNA, 25 bp, E. coli
gaaatgcgaaactgccccggtgaaa

SEQ ID NO: 40692 - DNA, 25 bp, E. coli
gaaatgcgaaacagccccggtgaaa

SEQ ID NO: 40693 - DNA, 25 bp, E. coli
gggtttgccacaacactgtttgaca

SEQ ID NO: 40694 - DNA, 25 bp, E. coli
gggtttgccacatcactgtttgaca

SEQ ID NO: 40695 - DNA, 25 bp, E. coli
tggctgtagggtgggaaaaaacaca

SEQ ID NO: 40696 - DNA, 25 bp, E. coli
tggctgtagggtcggaaaaaacaca

SEQ ID NO: 40697 - DNA, 25 bp, E. coli
taattgacgaatttagcgccacgct

SEQ ID NO: 40698 - DNA, 25 bp, E. coli
taattgacgaatatagcgccacgct

SEQ ID NO: 40699 - DNA, 25 bp, E. coli
gacgctgcaagggtctatacgcata

SEQ ID NO: 40700 - DNA, 25 bp, E. coli
gacgctgcaaggctctatacgcata

SEQ ID NO: 40701 - DNA, 25 bp, E. coli
tacccgcttttgatcaggcagtgga

SEQ ID NO: 40702 - DNA, 25 bp, E. coli
tacccgcttttgttcaggcagtgga

SEQ ID NO: 40703 - DNA, 25 bp, E. coli
tatttttgaactagtcgccagcgac

SEQ ID NO: 40704 - DNA, 25 bp, E. coli
tatcagaatcagagtattgccgcgc

SEQ ID NO: 40705 - DNA, 25 bp, E. coli
tatttttgaacttgtcgccagcgac

SEQ ID NO: 40706 - DNA, 25 bp, E. coli
tatcagaatcagtgtattgccgcgc

SEQ ID NO: 40707 - DNA, 25 bp, E. coli
ttacgtccatgagttaccgggcggc

SEQ ID NO: 40708 - DNA, 25 bp, E. coli
ttttaacccctgtactggagcagcg

SEQ ID NO: 40709 - DNA, 25 bp, E. coli
ttacgtccatgacttaccgggcggc

SEQ ID NO: 40710 - DNA, 25 bp, E. coli
ttttaacccctgaactggagcagcg

SEQ ID NO: 40711 - DNA, 25 bp, E. coli
gcacaactgcctcaacgtatcgaaa

SEQ ID NO: 40712 - DNA, 25 bp, E. coli
gcacaactgcctgaacgtatcgaaa

SEQ ID NO: 40713 - DNA, 25 bp, E. coli
gacacaattgtggaagctgcagcac

SEQ ID NO: 40714 - DNA, 25 bp, E. coli
gacattatcatcaaccagagcgaag

SEQ ID NO: 40715 - DNA, 25 bp, E. coli
gacacaattgtgcaagctgcagcac

SEQ ID NO: 40716 - DNA, 25 bp, E. coli
gaaaaacgtctggaacatatcgcgc

SEQ ID NO: 40717 - DNA, 25 bp, E. coli
gaaaaacgtctgcaacatatcgcgc

SEQ ID NO: 40718 - DNA, 25 bp, E. coli
gacattatcatctaccagagcgaag

SEQ ID NO: 40719 - DNA, 25 bp, E. coli
gaaattgcaccaaagaatgctccgg

SEQ ID NO: 40720 - DNA, 25 bp, E. coli
gaaattgcaccatagaatgctccgg

SEQ ID NO: 40721 - DNA, 25 bp, E. coli
gtgattatgccaaccgactcggtgg

SEQ ID NO: 40722 - DNA, 25 bp, E. coli
gtgattatgccatccgactcggtgg

SEQ ID NO: 40723 - DNA, 25 bp, E. coli
cagggagaaagcacgcgccaatatt

SEQ ID NO: 40724 - DNA, 25 bp, E. coli
cagggagaaagctcgcgccaatatt

SEQ ID NO: 40725 - DNA, 25 bp, E. coli
taaaccaaccaggagggagaaagca

SEQ ID NO: 40726 - DNA, 25 bp, E. coli
taaatatcctgggttaactgacagc

SEQ ID NO: 40727 - DNA, 25 bp, E. coli
taaatatcctggcttaactgacagc

SEQ ID NO: 40728 - DNA, 25 bp, E. coli
aaaaagatgcttaacgtattcaggg

SEQ ID NO: 40729 - DNA, 25 bp, E. coli
aaaaagatgctttacgtattcaggg

SEQ ID NO: 40730 - DNA, 25 bp, E. coli
ttttctctggtacaggcagcgcccc

SEQ ID NO: 40731 - DNA, 25 bp, E. coli
ttttctctggtagaggcagcgcccc

SEQ ID NO: 40732 - DNA, 25 bp, E. coli
tctggtacaggctgcgccccgcagt

SEQ ID NO: 40733 - DNA, 25 bp, E. coli
tctggtacaggcagcgccccgcagt

SEQ ID NO: 40734 - DNA, 25 bp, E. coli
cctggcttaactcacagcggcaaaa

SEQ ID NO: 40735 - DNA, 25 bp, E. coli
cctggcttaactgacagcggcaaaa

SEQ ID NO: 40736 - DNA, 25 bp, E. coli
gcacgcgccaatattcaggaaataa

SEQ ID NO: 40737 - DNA, 25 bp, E. coli
gcacgcgccaattttcaggaaataa

SEQ ID NO: 40738 - DNA, 25 bp, E. coli
cgcagtaaaccatccagcagggaga

SEQ ID NO: 40739 - DNA, 25 bp, E. coli
cgccaatattcacgaaataaaaaag

SEQ ID NO: 40740 - DNA, 25 bp, E. coli
cgccaatattcaggaaataaaaaag

SEQ ID NO: 40741 - DNA, 25 bp, E. coli
cgcagtaaaccaaccagcagggaga

SEQ ID NO: 40742 - DNA, 25 bp, E. coli
gggatatttaccgcgaccagtacgg

SEQ ID NO: 40743 - DNA, 25 bp, E. coli
gggatatttaccccgaccagtacgg

SEQ ID NO: 40744 - DNA, 25 bp, E. coli
taaaccaaccagcagggagaaagca

SEQ ID NO: 40745 - DNA, 25 bp, E. coli
caaagtcatcaggaagttaagcccc

SEQ ID NO: 40746 - DNA, 25 bp, E. coli
caaagtcatcagcaagttaagcccc

SEQ ID NO: 40747 - DNA, 25 bp, E. coli
taaagctgaccaaccctggcttacg

SEQ ID NO: 40748 - DNA, 25 bp, E. coli
tactatgttaaacctaaagctgacc

SEQ ID NO: 40749 - DNA, 25 bp, E. coli
taaacctaaagcagaccatccctgg

SEQ ID NO: 40750 - DNA, 25 bp, E. coli
taaacctaaagctgaccatccctgg

SEQ ID NO: 40751 - DNA, 25 bp, E. coli
taaagctgaccatccctggcttacg

SEQ ID NO: 40752 - DNA, 25 bp, E. coli
tactatgttaaagctaaagctgacc

SEQ ID NO: 40753 - DNA, 25 bp, E. coli
agcctgatcccgttaaaaaagattg

SEQ ID NO: 40754 - DNA, 25 bp, E. coli
agcctgatcccgataaaaaagattg

SEQ ID NO: 40755 - DNA, 25 bp, E. coli
tacctaaaaagaagcctgatcccga

SEQ ID NO: 40756 - DNA, 25 bp, E. coli
tacctaaaaagatgcctgatcccga

SEQ ID NO: 40757 - DNA, 25 bp, E. coli
gccgaacgcaaactcatcagcaagt

SEQ ID NO: 40758 - DNA, 25 bp, E. coli
gccgaacgcaaagtcatcagcaagt

SEQ ID NO: 40759 - DNA, 25 bp, E. coli
gaagttacctaataagaagcctgat

SEQ ID NO: 40760 - DNA, 25 bp, E. coli
gaagttacctaaaaagaagcctgat

SEQ ID NO: 40761 - DNA, 25 bp, E. coli
gatttacgctcaaaatactatgtta

SEQ ID NO: 40762 - DNA, 25 bp, E. coli
gataatgcccgtattgatttacgct

SEQ ID NO: 40763 - DNA, 25 bp, E. coli
gataatgcccgttttgatttacgct

SEQ ID NO: 40764 - DNA, 25 bp, E. coli
gatttacgctcataatactatgtta

SEQ ID NO: 40765 - DNA, 25 bp, E. coli
ggcttacgcgccgaacgcaaagtca

SEQ ID NO: 40766 - DNA, 25 bp, E. coli
ggcttacgcgcccaacgcaaagtca

SEQ ID NO: 40767 - DNA, 25 bp, E. coli
caacaggctttcgatctggctaacg

SEQ ID NO: 40768 - DNA, 25 bp, E. coli
caacaggctttccatctggctaacg

SEQ ID NO: 40769 - DNA, 25 bp, E. coli
cagcggcttaggacgaaacgcggta

SEQ ID NO: 40770 - DNA, 25 bp, E. coli
cacaaagtctgttcggaccgcacga

SEQ ID NO: 40771 - DNA, 25 bp, E. coli
cacaaagtctgtacggaccgcacga

SEQ ID NO: 40772 - DNA, 25 bp, E. coli
cagcggcttaggtcgaaacgcggta

SEQ ID NO: 40773 - DNA, 25 bp, E. coli
taaagaagatttacgccctcaccgc

SEQ ID NO: 40774 - DNA, 25 bp, E. coli
taaagaagattttcgccctcaccgc

SEQ ID NO: 40775 - DNA, 25 bp, E. coli
aaatgggcgcagagtttgttccggc

SEQ ID NO: 40776 - DNA, 25 bp, E. coli
aaatgggcgcagtgtttgttccggc

SEQ ID NO: 40777 - DNA, 25 bp, E. coli
tatgacctactaagaaaatgccgtg

SEQ ID NO: 40778 - DNA, 25 bp, E. coli
tatgacctactatgaaaatgccgtg

SEQ ID NO: 40779 - DNA, 25 bp, E. coli
ttaggccgcaagtcagcaaaagagc

SEQ ID NO: 40780 - DNA, 25 bp, E. coli
ttaggccgcaagacagcaaaagagc

SEQ ID NO: 40781 - DNA, 25 bp, E. coli
tgtgtacaacatgaccaacggcgag

SEQ ID NO: 40782 - DNA, 25 bp, E. coli
tgtgtacaacatcaccaacggcgag

SEQ ID NO: 40783 - DNA, 25 bp, E. coli
tgcgataagctaccttccgggcgtg

SEQ ID NO: 40784 - DNA, 25 bp, E. coli
tgcgataagctagcttccgggcgtg

SEQ ID NO: 40785 - DNA, 25 bp, E. coli
gcagcatggagcctttaggccgcaa

SEQ ID NO: 40786 - DNA, 25 bp, E. coli
gcagcatggagcgtttaggccgcaa

SEQ ID NO: 40787 - DNA, 25 bp, E. coli
gatcaatatgctatcgcaggcgaat

SEQ ID NO: 40788 - DNA, 25 bp, E. coli
gatcaatatgctttcgcaggcgaat

SEQ ID NO: 40789 - DNA, 25 bp, E. coli
catggcgtatggctgtgtacccgac

SEQ ID NO: 40790 - DNA, 25 bp, E. coli
catgacctggcaaaatgggtatacc

SEQ ID NO: 40791 - DNA, 25 bp, E. coli
catgacctggcataatgggtatacc

SEQ ID NO: 40792 - DNA, 25 bp, E. coli
catggcgtatgggtgtgtacccgac

SEQ ID NO: 40793 - DNA, 25 bp, E. coli
aataaagtccgctcccgcataaaag

SEQ ID NO: 40794 - DNA, 25 bp, E. coli
aataaagtccgcacccgcataaaag

SEQ ID NO: 40795 - DNA, 25 bp, E. coli
tgctgacgcctgataacgtattcct

SEQ ID NO: 40796 - DNA, 25 bp, E. coli
tgctgacgcctgttaacgtattcct

SEQ ID NO: 40797 - DNA, 25 bp, E. coli
tcgtaaaacccgacgatatgcgccg

SEQ ID NO: 40798 - DNA, 25 bp, E. coli
tgccacatggcaactcacacaggat

SEQ ID NO: 40799 - DNA, 25 bp, E. coli
tgccacatggcatctcacacaggat

SEQ ID NO: 40800 - DNA, 25 bp, E. coli
tcgtaaaacccgtcgatatgcgccg

SEQ ID NO: 40801 - DNA, 25 bp, E. coli
tctccggtgggagaaacatggcgta

SEQ ID NO: 40802 - DNA, 25 bp, E. coli
tctccggtgggacaaacatggcgta

SEQ ID NO: 40803 - DNA, 25 bp, E. coli
gccccggaaaggagatgccacatgg

SEQ ID NO: 40804 - DNA, 25 bp, E. coli
gccccggaaaggtgatgccacatgg

SEQ ID NO: 40805 - DNA, 25 bp, E. coli
gaacttaacgctccatggcatgacg

SEQ ID NO: 40806 - DNA, 25 bp, E. coli
gaacttaacgctgcatggcatgacg

SEQ ID NO: 40807 - DNA, 25 bp, E. coli
ctggcaacaggtcaaagggcatgac

SEQ ID NO: 40808 - DNA, 25 bp, E. coli
ctggcaacaggtgaaagggcatgac

SEQ ID NO: 40809 - DNA, 25 bp, E. coli
gggtatcgacacactgacacagtac

SEQ ID NO: 40810 - DNA, 25 bp, E. coli
gggtatcgacactctgacacagtac

SEQ ID NO: 40811 - DNA, 25 bp, E. coli
tatggtatgaaaaggcggctgcgca

SEQ ID NO: 40812 - DNA, 25 bp, E. coli
tatggtatgaaatggcggctgcgca

SEQ ID NO: 40813 - DNA, 25 bp, E. coli
tgttgaacaggattatcgacaggcc

SEQ ID NO: 40814 - DNA, 25 bp, E. coli
tgttgaacaggaatatcgacaggcc

SEQ ID NO: 40815 - DNA, 25 bp, E. coli
tgtagagcaggagtatcagcaggca

SEQ ID NO: 40816 - DNA, 25 bp, E. coli
tgtagagcaggactatcagcaggca

SEQ ID NO: 40817 - DNA, 25 bp, E. coli
tgactcagagctatcgacaggcgaa

SEQ ID NO: 40818 - DNA, 25 bp, E. coli
tgactcagagctttcgacaggcgaa

SEQ ID NO: 40819 - DNA, 25 bp, E. coli
ccaaactcggtgtgatgtatgcaaa

SEQ ID NO: 40820 - DNA, 25 bp, E. coli
ccaaactcggtgagatgtatgcaaa

SEQ ID NO: 40821 - DNA, 25 bp, E. coli
gcttggtatgaataggcagcctcac

SEQ ID NO: 40822 - DNA, 25 bp, E. coli
gcttggtatgaaaaggcagcctcac

SEQ ID NO: 40823 - DNA, 25 bp, E. coli
gaactatcaacaggcaaaggcttgg

SEQ ID NO: 40824 - DNA, 25 bp, E. coli
gaactatcaacacgcaaaggcttgg

SEQ ID NO: 40825 - DNA, 25 bp, E. coli
ctcacaaaatgaagcgcaggcgcag

SEQ ID NO: 40826 - DNA, 25 bp, E. coli
ctcacaaaatgatgcgcaggcgcag

SEQ ID NO: 40827 - DNA, 25 bp, E. coli
ctgaccaaaatgttccgcgtgcgca

SEQ ID NO: 40828 - DNA, 25 bp, E. coli
ctgaccaaaatgatccgcgtgcgca

SEQ ID NO: 40829 - DNA, 25 bp, E. coli
gatttggtatgataaagccgctgac

SEQ ID NO: 40830 - DNA, 25 bp, E. coli
gatttggtatgaaaaagccgctgac

SEQ ID NO: 40831 - DNA, 25 bp, E. coli
gatgtggtatgataaagcggctgct

SEQ ID NO: 40832 - DNA, 25 bp, E. coli
gatgtggtatgaaaaagcggctgct

SEQ ID NO: 40833 - DNA, 25 bp, E. coli
cagagcgggcctagagataagcaga

SEQ ID NO: 40834 - DNA, 25 bp, E. coli
cagagcgggccttgagataagcaga

SEQ ID NO: 40835 - DNA, 25 bp, E. coli
aaaaagacccgcagagcgggccttg

SEQ ID NO: 40836 - DNA, 25 bp, E. coli
aaatggagaaattcactccgccgcc

SEQ ID NO: 40837 - DNA, 25 bp, E. coli
aaaaagacccgctgagcgggccttg

SEQ ID NO: 40838 - DNA, 25 bp, E. coli
aaatggagaaatacactccgccgcc

SEQ ID NO: 40839 - DNA, 25 bp, E. coli
tccgccgccttaagacgggcagtct

SEQ ID NO: 40840 - DNA, 25 bp, E. coli
tccgccgccttatgacgggcagtct

SEQ ID NO: 40841 - DNA, 25 bp, E. coli
gccaaatagatctcagatttctcat

SEQ ID NO: 40842 - DNA, 25 bp, E. coli
gccaaatagatcacagatttctcat

SEQ ID NO: 40843 - DNA, 25 bp, E. coli
gaatcaccttgcatttggcgaaaaa

SEQ ID NO: 40844 - DNA, 25 bp, E. coli
gaatcaccttgcttttggcgaaaaa

SEQ ID NO: 40845 - DNA, 25 bp, E. coli
ccttttcaactgactcaaaatggag

SEQ ID NO: 40846 - DNA, 25 bp, E. coli
ccttttcaactgtctcaaaatggag

SEQ ID NO: 40847 - DNA, 25 bp, E. coli
cgggcagtctgagaagggtaaacaa

SEQ ID NO: 40848 - DNA, 25 bp, E. coli
cgggcagtctgacaagggtaaacaa

SEQ ID NO: 40849 - DNA, 25 bp, E. coli
gggctcagacagttatcaatgtgcg

SEQ ID NO: 40850 - DNA, 25 bp, E. coli
gggctcagacagatatcaatgtgcg

SEQ ID NO: 40851 - DNA, 25 bp, E. coli
tggcgaaaaaatccccgcagagcgg

SEQ ID NO: 40852 - DNA, 25 bp, E. coli
tggcgaaaaaatgcccgcagagcgg

SEQ ID NO: 40853 - DNA, 25 bp, E. coli
tcaatgtgcgctttgtcatgccgga

SEQ ID NO: 40854 - DNA, 25 bp, E. coli
tcaatgtgcgctatgtcatgccgga

SEQ ID NO: 40855 - DNA, 25 bp, E. coli
aatgagttatagtaatgctaagggc

SEQ ID NO: 40856 - DNA, 25 bp, E. coli
aatgagttatagaaatgctaagggc

SEQ ID NO: 40857 - DNA, 25 bp, E. coli
cacgcccgttgtattatttatgtgg

SEQ ID NO: 40858 - DNA, 25 bp, E. coli
cacgcccgttgttttatttatgtgg

SEQ ID NO: 40859 - DNA, 25 bp, E. coli
catgtgttaaattttgaaacgggcg

SEQ ID NO: 40860 - DNA, 25 bp, E. coli
catttaagacgttataccctacagg

SEQ ID NO: 40861 - DNA, 25 bp, E. coli
catgtgttaaatattgaaacgggcg

SEQ ID NO: 40862 - DNA, 25 bp, E. coli
catttaagacgtaataccctacagg

SEQ ID NO: 40863 - DNA, 25 bp, E. coli
tagtcatctaacaaatgctgcgcca

SEQ ID NO: 40864 - DNA, 25 bp, E. coli
tatgttgctatgacagatagttacg

SEQ ID NO: 40865 - DNA, 25 bp, E. coli
tagtcatctaactaatgctgcgcca

SEQ ID NO: 40866 - DNA, 25 bp, E. coli
tatgttgctatgtcagatagttacg

SEQ ID NO: 40867 - DNA, 25 bp, E. coli
tatcgagcatatttatatgaagccc

SEQ ID NO: 40868 - DNA, 25 bp, E. coli
tatcgagcatatatatatgaagccc

SEQ ID NO: 40869 - DNA, 25 bp, E. coli
ttgaaacgggcgaataacacgcccg

SEQ ID NO: 40870 - DNA, 25 bp, E. coli
ttgaaacgggcgtataacacgcccg

SEQ ID NO: 40871 - DNA, 25 bp, E. coli
tctctgatcttatcttctgcaaatg

SEQ ID NO: 40872 - DNA, 25 bp, E. coli
tctctgatcttaacttctgcaaatg

SEQ ID NO: 40873 - DNA, 25 bp, E. coli
gctaagggctaatgagttatatgca

SEQ ID NO: 40874 - DNA, 25 bp, E. coli
gctaagggctaaagagttatatgca

SEQ ID NO: 40875 - DNA, 25 bp, E. coli
ggttatcaaaacacaaaaacacatg

SEQ ID NO: 40876 - DNA, 25 bp, E. coli
ggttatcaaaactcaaaaacacatg

SEQ ID NO: 40877 - DNA, 25 bp, E. coli
aatgtgcggtggtcaggcattagat

SEQ ID NO: 40878 - DNA, 25 bp, E. coli
aatgtgcggtggacaggcattagat

SEQ ID NO: 40879 - DNA, 25 bp, E. coli
cactcgatacctgggcactggaagc

SEQ ID NO: 40880 - DNA, 25 bp, E. coli
cactcgatacctcggcactggaagc

SEQ ID NO: 40881 - DNA, 25 bp, E. coli
cagtcactcgatacctcggcactgg

SEQ ID NO: 40882 - DNA, 25 bp, E. coli
cagtcactcgattcctcggcactgg

SEQ ID NO: 40883 - DNA, 25 bp, E. coli
agtcactcgatacctcggcactgga

SEQ ID NO: 40884 - DNA, 25 bp, E. coli
agtcactcgatagctcggcactgga

SEQ ID NO: 40885 - DNA, 25 bp, E. coli
aacagtcactcgatacctcggcact

SEQ ID NO: 40886 - DNA, 25 bp, E. coli
aacagtcactcgttacctcggcact

SEQ ID NO: 40887 - DNA, 25 bp, E. coli
tgaacagtcactcgatacctcggca

SEQ ID NO: 40888 - DNA, 25 bp, E. coli
tgaacagtcactggatacctcggca

SEQ ID NO: 40889 - DNA, 25 bp, E. coli
cggtggtcaggcattagatttagac

SEQ ID NO: 40890 - DNA, 25 bp, E. coli
cggtggtcaggctttagatttagac

SEQ ID NO: 40891 - DNA, 25 bp, E. coli
ctgaacagtcacacgatacctcggc

SEQ ID NO: 40892 - DNA, 25 bp, E. coli
ctgaacagtcactcgatacctcggc

SEQ ID NO: 40893 - DNA, 25 bp, E. coli
gtgcggtggtcacgcattagattta

SEQ ID NO: 40894 - DNA, 25 bp, E. coli
gtcactcgatacctcggcactggaa

SEQ ID NO: 40895 - DNA, 25 bp, E. coli
gtcactcgatacgtcggcactggaa

SEQ ID NO: 40896 - DNA, 25 bp, E. coli
gtgcggtggtcaggcattagattta

SEQ ID NO: 40897 - DNA, 25 bp, E. coli
tcactcgataccacggcactggaag

SEQ ID NO: 40898 - DNA, 25 bp, E. coli
tcactcgatacctcggcactggaag

SEQ ID NO: 40899 - DNA, 25 bp, E. coli
tacgaacgtatgcaggcttccggct

SEQ ID NO: 40900 - DNA, 25 bp, E. coli
tacgaacgtatggaggcttccggct

SEQ ID NO: 40901 - DNA, 25 bp, E. coli
actaataaacgcgacctggcgcgcg

SEQ ID NO: 40902 - DNA, 25 bp, E. coli
actaataaacgccacctggcgcgcg

SEQ ID NO: 40903 - DNA, 25 bp, E. coli
tatccttgcgatcgagcgttctaag

SEQ ID NO: 40904 - DNA, 25 bp, E. coli
tatgttcgtttaagcaccacgctgg

SEQ ID NO: 40905 - DNA, 25 bp, E. coli
tatccttgcgatggagcgttctaag

SEQ ID NO: 40906 - DNA, 25 bp, E. coli
tatgttcgtttatgcaccacgctgg

SEQ ID NO: 40907 - DNA, 25 bp, E. coli
tgttctggctaacgctactgccgat

SEQ ID NO: 40908 - DNA, 25 bp, E. coli
tgttctggctaaggctactgccgat

SEQ ID NO: 40909 - DNA, 25 bp, E. coli
tgtatgaagatctgagcattggcgc

SEQ ID NO: 40910 - DNA, 25 bp, E. coli
tgtatgaagatcagagcattggcgc

SEQ ID NO: 40911 - DNA, 25 bp, E. coli
tgctgactggcgtcaatgaaaacgt

SEQ ID NO: 40912 - DNA, 25 bp, E. coli
tgctgactggcgacaatgaaaacgt

SEQ ID NO: 40913 - DNA, 25 bp, E. coli
tcagagcaccaatattgccgtcggt

SEQ ID NO: 40914 - DNA, 25 bp, E. coli
tcagagcaccaaaattgccgtcggt

SEQ ID NO: 40915 - DNA, 25 bp, E. coli
gcgacgcagtggttaagttacaggc

SEQ ID NO: 40916 - DNA, 25 bp, E. coli
gcattatgcttagcgcatgggcgtg

SEQ ID NO: 40917 - DNA, 25 bp, E. coli
gcgacgcagtggataagttacaggc

SEQ ID NO: 40918 - DNA, 25 bp, E. coli
gcattatgcttaccgcatgggcgtg

SEQ ID NO: 40919 - DNA, 25 bp, E. coli
gcaggacgttaacagtattcagagc

SEQ ID NO: 40920 - DNA, 25 bp, E. coli
gcaggacgttaagagtattcagagc

SEQ ID NO: 40921 - DNA, 25 bp, E. coli
catgctgtgaaaaaagcggctctca

SEQ ID NO: 40922 - DNA, 25 bp, E. coli
catgctgtgaaataagcggctctca

SEQ ID NO: 40923 - DNA, 25 bp, E. coli
catattacttcacagcatgctgtga

SEQ ID NO: 40924 - DNA, 25 bp, E. coli
catattacttcagagcatgctgtga

SEQ ID NO: 40925 - DNA, 25 bp, E. coli
taaaacaacggctggaagattcgca

SEQ ID NO: 40926 - DNA, 25 bp, E. coli
taaaacaacggcaggaagattcgca

SEQ ID NO: 40927 - DNA, 25 bp, E. coli
tagaggtattaatgcacgctaccgc

SEQ ID NO: 40928 - DNA, 25 bp, E. coli
tagaggtattaaagcacgctaccgc

SEQ ID NO: 40929 - DNA, 25 bp, E. coli
ttatcaaccgtttcatccggtcaga

SEQ ID NO: 40930 - DNA, 25 bp, E. coli
ttatcaaccgttacatccggtcaga

SEQ ID NO: 40931 - DNA, 25 bp, E. coli
tgaataaaacccaactgctaactcg

SEQ ID NO: 40932 - DNA, 25 bp, E. coli
tgaataaaaccctactgctaactcg

SEQ ID NO: 40933 - DNA, 25 bp, E. coli
tgcctatgatgtcacgagcgttacc

SEQ ID NO: 40934 - DNA, 25 bp, E. coli
tccgctctggaatcaaggaaaatcc

SEQ ID NO: 40935 - DNA, 25 bp, E. coli
tccgctctggaaacaaggaaaatcc

SEQ ID NO: 40936 - DNA, 25 bp, E. coli
tgcctatgatgtgacgagcgttacc

SEQ ID NO: 40937 - DNA, 25 bp, E. coli
gctttacagctagcagagcactgca

SEQ ID NO: 40938 - DNA, 25 bp, E. coli
gctttacagctaccagagcactgca

SEQ ID NO: 40939 - DNA, 25 bp, E. coli
gctgcgaattttgactgccgttata

SEQ ID NO: 40940 - DNA, 25 bp, E. coli
gctgcgaattttcactgccgttata

SEQ ID NO: 40941 - DNA, 25 bp, E. coli
taattgtcttacgaatccgctctgg

SEQ ID NO: 40942 - DNA, 25 bp, E. coli
taattgtcttaccaatccgctctgg

SEQ ID NO: 40943 - DNA, 25 bp, E. coli
cagtggcaaattcgtgacagcttcc

SEQ ID NO: 40944 - DNA, 25 bp, E. coli
cagtggcaaattggtgacagcttcc

SEQ ID NO: 40945 - DNA, 25 bp, E. coli
tacaccaacccgaacgatggtgatg

SEQ ID NO: 40946 - DNA, 25 bp, E. coli
taaaaatggcaatcgtgataacgcc

SEQ ID NO: 40947 - DNA, 25 bp, E. coli
taaaaatggcaaacgtgataacgcc

SEQ ID NO: 40948 - DNA, 25 bp, E. coli
tacaccaacccgtacgatggtgatg

SEQ ID NO: 40949 - DNA, 25 bp, E. coli
aacctggcaggttaaaatggcaatc

SEQ ID NO: 40950 - DNA, 25 bp, E. coli
aacctggcaggtaaaaatggcaatc

SEQ ID NO: 40951 - DNA, 25 bp, E. coli
tgataacgccatagctgatggtccg

SEQ ID NO: 40952 - DNA, 25 bp, E. coli
tgataacgccattgctgatggtccg

SEQ ID NO: 40953 - DNA, 25 bp, E. coli
tgaggctggctagcgttacctgaac

SEQ ID NO: 40954 - DNA, 25 bp, E. coli
tgaggctggctaccgttacctgaac

SEQ ID NO: 40955 - DNA, 25 bp, E. coli
tgatgaaggttatgcagcggcagtt

SEQ ID NO: 40956 - DNA, 25 bp, E. coli
tgatgaaggttaagcagcggcagtt

SEQ ID NO: 40957 - DNA, 25 bp, E. coli
gacagcttccgcttgtttggtgagt

SEQ ID NO: 40958 - DNA, 25 bp, E. coli
gacagcttccgcatgtttggtgagt

SEQ ID NO: 40959 - DNA, 25 bp, E. coli
cccgaacgatggtgatgaaggttat

SEQ ID NO: 40960 - DNA, 25 bp, E. coli
cccgaacgatggagatgaaggttat

SEQ ID NO: 40961 - DNA, 25 bp, E. coli
cgtccagtcagcattgaggctggct

SEQ ID NO: 40962 - DNA, 25 bp, E. coli
cgtccagtcagctttgaggctggct

SEQ ID NO: 40963 - DNA, 25 bp, E. coli
cattgctgatggtccgtatgttggg

SEQ ID NO: 40964 - DNA, 25 bp, E. coli
cattgctgatggaccgtatgttggg

SEQ ID NO: 40965 - DNA, 25 bp, E. coli
tatcagcccgtgtatatgacgcggt

SEQ ID NO: 40966 - DNA, 25 bp, E. coli
tatcagcccgtgaatatgacgcggt

SEQ ID NO: 40967 - DNA, 25 bp, E. coli
tgattgcccctgtgcagaaacgcga

SEQ ID NO: 40968 - DNA, 25 bp, E. coli
tgttccataaaagatggccgctggc

SEQ ID NO: 40969 - DNA, 25 bp, E. coli
tgattgcccctgagcagaaacgcga

SEQ ID NO: 40970 - DNA, 25 bp, E. coli
tgttccataaaacatggccgctggc

SEQ ID NO: 40971 - DNA, 25 bp, E. coli
tctgatccggatctgcgcatgcgtc

SEQ ID NO: 40972 - DNA, 25 bp, E. coli
tctgatccggatgtgcgcatgcgtc

SEQ ID NO: 40973 - DNA, 25 bp, E. coli
ccaaatggcgttctggtggcgcaca

SEQ ID NO: 40974 - DNA, 25 bp, E. coli
gcgctgcagtcccaacggtgaaagt

SEQ ID NO: 40975 - DNA, 25 bp, E. coli
gcgctgcagtccgaacggtgaaagt

SEQ ID NO: 40976 - DNA, 25 bp, E. coli
ccttcctgaagattggctggccgtc

SEQ ID NO: 40977 - DNA, 25 bp, E. coli
ccaaatggcgttgtggtggcgcaca

SEQ ID NO: 40978 - DNA, 25 bp, E. coli
ccttcctgaagaatggctggccgtc

SEQ ID NO: 40979 - DNA, 25 bp, E. coli
gaactgcttgaacagcgtgccgagc

SEQ ID NO: 40980 - DNA, 25 bp, E. coli
gaactgcttgaagagcgtgccgagc

SEQ ID NO: 40981 - DNA, 25 bp, E. coli
gggatcctgtcactgtataaccggg

SEQ ID NO: 40982 - DNA, 25 bp, E. coli
gggatcctgtcagtgtataaccggg

SEQ ID NO: 40983 - DNA, 25 bp, E. coli
gatggataacatgaccggataccgg

SEQ ID NO: 40984 - DNA, 25 bp, E. coli
gagccaatacttgcggtccgtggga

SEQ ID NO: 40985 - DNA, 25 bp, E. coli
gagccaatacttccggtccgtggga

SEQ ID NO: 40986 - DNA, 25 bp, E. coli
gatggataacatcaccggataccgg

SEQ ID NO: 40987 - DNA, 25 bp, E. coli
catggtgtatcgtcttgcttggcgc

SEQ ID NO: 40988 - DNA, 25 bp, E. coli
catggtgtatcgacttgcttggcgc

SEQ ID NO: 40989 - DNA, 25 bp, E. coli
taaaaaccattctggacaaagccag

SEQ ID NO: 40990 - DNA, 25 bp, E. coli
tatgggcctggctaaaactactctg

SEQ ID NO: 40991 - DNA, 25 bp, E. coli
tatgggcctggcaaaaactactctg

SEQ ID NO: 40992 - DNA, 25 bp, E. coli
tgtactggatgattttaacgctggg

SEQ ID NO: 40993 - DNA, 25 bp, E. coli
tgtactggatgaatttaacgctggg

SEQ ID NO: 40994 - DNA, 25 bp, E. coli
tgcttggcgcggtaattactgtcac

SEQ ID NO: 40995 - DNA, 25 bp, E. coli
tgcttggcgcggaaattactgtcac

SEQ ID NO: 40996 - DNA, 25 bp, E. coli
tcgttgctctcaatagtgccgctgg

SEQ ID NO: 40997 - DNA, 25 bp, E. coli
tcgttgctctcattagtgccgctgg

SEQ ID NO: 40998 - DNA, 25 bp, E. coli
tctggcaacgcattgatgaggacaa

SEQ ID NO: 40999 - DNA, 25 bp, E. coli
tctggcaacgcaatgatgaggacaa

SEQ ID NO: 41000 - DNA, 25 bp, E. coli
gctgggcgagcgatctcaatactgt

SEQ ID NO: 41001 - DNA, 25 bp, E. coli
gctgggcgagcgttctcaatactgt

SEQ ID NO: 41002 - DNA, 25 bp, E. coli
gaacaagaagaacacgacgaaccat

SEQ ID NO: 41003 - DNA, 25 bp, E. coli
gaacaagaagaagacgacgaaccat

SEQ ID NO: 41004 - DNA, 25 bp, E. coli
gatagcgcgttgaataccatctggc

SEQ ID NO: 41005 - DNA, 25 bp, E. coli
gatagcgcgttgtataccatctggc

SEQ ID NO: 41006 - DNA, 25 bp, E. coli
taaaaaccattcaggacaaagccag

SEQ ID NO: 41007 - DNA, 25 bp, E. coli
gatgtactccatggatagcgcgttg

SEQ ID NO: 41008 - DNA, 25 bp, E. coli
gatgtactccatcgatagcgcgttg

SEQ ID NO: 41009 - DNA, 25 bp, E. coli
caatatgaaattgttgggtggtggt

SEQ ID NO: 41010 - DNA, 25 bp, E. coli
caatatgaaattcttgggtggtggt

SEQ ID NO: 41011 - DNA, 25 bp, E. coli
aatcctaatgttttttatcgtgaga

SEQ ID NO: 41012 - DNA, 25 bp, E. coli
aatcctaatgttatttatcgtgaga

SEQ ID NO: 41013 - DNA, 25 bp, E. coli
taaaatccccgcgaacgatgtgttg

SEQ ID NO: 41014 - DNA, 25 bp, E. coli
taaaatccccgccaacgatgtgttg

SEQ ID NO: 41015 - DNA, 25 bp, E. coli
agtaagcaagtggaaaggactcgtg

SEQ ID NO: 41016 - DNA, 25 bp, E. coli
agtaagcaagtgcaaaggactcgtg

SEQ ID NO: 41017 - DNA, 25 bp, E. coli
tagcgaatattggtaaaatccccgc

SEQ ID NO: 41018 - DNA, 25 bp, E. coli
tatcgtgagatattacgcgaataat

SEQ ID NO: 41019 - DNA, 25 bp, E. coli
tagcgaatattgctaaaatccccgc

SEQ ID NO: 41020 - DNA, 25 bp, E. coli
tatcgtgagataatacgcgaataat

SEQ ID NO: 41021 - DNA, 25 bp, E. coli
tttatgcgcattgtgtgtctcctga

SEQ ID NO: 41022 - DNA, 25 bp, E. coli
tttatgcgcattctgtgtctcctga

SEQ ID NO: 41023 - DNA, 25 bp, E. coli
gcaaaggactcgagtttaaataaca

SEQ ID NO: 41024 - DNA, 25 bp, E. coli
gaattatcacgtaaaaatcagacct

SEQ ID NO: 41025 - DNA, 25 bp, E. coli
gcaaaggactcgtgtttaaataaca

SEQ ID NO: 41026 - DNA, 25 bp, E. coli
gaattatcacgttaaaatcagacct

SEQ ID NO: 41027 - DNA, 25 bp, E. coli
ctgtgtctcctgtattatcacgtaa

SEQ ID NO: 41028 - DNA, 25 bp, E. coli
ctgtgtctcctgaattatcacgtaa

SEQ ID NO: 41029 - DNA, 25 bp, E. coli
gtacttgattattattttgaacgca

SEQ ID NO: 41030 - DNA, 25 bp, E. coli
gtacttgattataattttgaacgca

SEQ ID NO: 41031 - DNA, 25 bp, E. coli
tacgggaactcccaagaggattcac

SEQ ID NO: 41032 - DNA, 25 bp, E. coli
tacgggaactccgaagaggattcac

SEQ ID NO: 41033 - DNA, 25 bp, E. coli
aaaacgctgcgtgaacaggcacagg

SEQ ID NO: 41034 - DNA, 25 bp, E. coli
aaaacgctgcgtcaacaggcacagg

SEQ ID NO: 41035 - DNA, 25 bp, E. coli
taccgcagagttgcaggatgccacg

SEQ ID NO: 41036 - DNA, 25 bp, E. coli
taccgcagagttccaggatgccacg

SEQ ID NO: 41037 - DNA, 25 bp, E. coli
ttcacaagaacataccggcagtcag

SEQ ID NO: 41038 - DNA, 25 bp, E. coli
ttcacaagaacaaaccggcagtcag

SEQ ID NO: 41039 - DNA, 25 bp, E. coli
tgtcaaaacctataacggcgcgctg

SEQ ID NO: 41040 - DNA, 25 bp, E. coli
tgtcaaaacctaaaacggcgcgctg

SEQ ID NO: 41041 - DNA, 25 bp, E. coli
tgtgacctcgcggaaatgctacggt

SEQ ID NO: 41042 - DNA, 25 bp, E. coli
tgtgacctcgcgcaaatgctacggt

SEQ ID NO: 41043 - DNA, 25 bp, E. coli
tccttgtgggcatattggcgagacg

SEQ ID NO: 41044 - DNA, 25 bp, E. coli
tccttgtgggcaaattggcgagacg

SEQ ID NO: 41045 - DNA, 25 bp, E. coli
gaaatgcctgttgtggaaaaccggg

SEQ ID NO: 41046 - DNA, 25 bp, E. coli
gaaatgcctgttctggaaaaccggg

SEQ ID NO: 41047 - DNA, 25 bp, E. coli
cgattctggaaatggcaaaagccgc

SEQ ID NO: 41048 - DNA, 25 bp, E. coli
cgattctggaaaaggcaaaagccgc

SEQ ID NO: 41049 - DNA, 25 bp, E. coli
tgtttacccctgagacaaaagcccg

SEQ ID NO: 41050 - DNA, 25 bp, E. coli
tgtttacccctgtgacaaaagcccg

SEQ ID NO: 41051 - DNA, 25 bp, E. coli
gatctcgatgaagccgtacaacggg

SEQ ID NO: 41052 - DNA, 25 bp, E. coli
gatctcgatgaacccgtacaacggg

SEQ ID NO: 41053 - DNA, 25 bp, E. coli
tataccttgctgtgcgtgccgaaag

SEQ ID NO: 41054 - DNA, 25 bp, E. coli
aacaacttcgtcaacattgagcggg

SEQ ID NO: 41055 - DNA, 25 bp, E. coli
aacaacttcgtctacattgagcggg

SEQ ID NO: 41056 - DNA, 25 bp, E. coli
ttttacccgtatccaggtggcgctg

SEQ ID NO: 41057 - DNA, 25 bp, E. coli
ttgacccggaacataaagtctggcg

SEQ ID NO: 41058 - DNA, 25 bp, E. coli
ttgacccggaacttaaagtctggcg

SEQ ID NO: 41059 - DNA, 25 bp, E. coli
ttttacccgtatgcaggtggcgctg

SEQ ID NO: 41060 - DNA, 25 bp, E. coli
tgtcgttcatctttggcccactgcg

SEQ ID NO: 41061 - DNA, 25 bp, E. coli
tgatgcaggcttgtggttttacccg

SEQ ID NO: 41062 - DNA, 25 bp, E. coli
tgtcgttcatctatggcccactgcg

SEQ ID NO: 41063 - DNA, 25 bp, E. coli
cgcgttaggcgctggaatgtatacc

SEQ ID NO: 41064 - DNA, 25 bp, E. coli
cgcgttaggcgcaggaatgtatacc

SEQ ID NO: 41065 - DNA, 25 bp, E. coli
tcttcggcccgcagacgttggttta

SEQ ID NO: 41066 - DNA, 25 bp, E. coli
tcttcggcccgctgacgttggttta

SEQ ID NO: 41067 - DNA, 25 bp, E. coli
ggatgcactctcaatcagcggtttg

SEQ ID NO: 41068 - DNA, 25 bp, E. coli
ggatgcactctctatcagcggtttg

SEQ ID NO: 41069 - DNA, 25 bp, E. coli
tgatgcaggcttctggttttacccg

SEQ ID NO: 41070 - DNA, 25 bp, E. coli
tataccttgctgagcgtgccgaaag

SEQ ID NO: 41071 - DNA, 25 bp, E. coli
gagaatcgtcgtctgcaatccgtac

SEQ ID NO: 41072 - DNA, 25 bp, E. coli
gagaatcgtcgtgtgcaatccgtac

SEQ ID NO: 41073 - DNA, 25 bp, E. coli
gatgaaaaccgccattccgctggtc

SEQ ID NO: 41074 - DNA, 25 bp, E. coli
gatgaaaaccgcgattccgctggtc

SEQ ID NO: 41075 - DNA, 25 bp, E. coli
tattgacattaccaattccggctgg

SEQ ID NO: 41076 - DNA, 25 bp, E. coli
tattgacattacgaattccggctgg

SEQ ID NO: 41077 - DNA, 25 bp, E. coli
ccaattccggctcgcgtggcaggaa

SEQ ID NO: 41078 - DNA, 25 bp, E. coli
ccaattccggctggcgtggcaggaa

SEQ ID NO: 41079 - DNA, 25 bp, E. coli
gctaaatatgatgcgcccttttgaa

SEQ ID NO: 41080 - DNA, 25 bp, E. coli
gctaaatatgatccgcccttttgaa

SEQ ID NO: 41081 - DNA, 25 bp, E. coli
cggtggatgatatagacgtgtcgct

SEQ ID NO: 41082 - DNA, 25 bp, E. coli
cggtggatgataaagacgtgtcgct

SEQ ID NO: 41083 - DNA, 25 bp, E. coli
cgtggcaggaaaatcgctcgtttgg

SEQ ID NO: 41084 - DNA, 25 bp, E. coli
cgtggcaggaaattcgctcgtttgg

SEQ ID NO: 41085 - DNA, 25 bp, E. coli
gattacggtgcaattagtcaaccac

SEQ ID NO: 41086 - DNA, 25 bp, E. coli
gattacggtgcatttagtcaaccac

SEQ ID NO: 41087 - DNA, 25 bp, E. coli
ggtgcaattagtcaaccactaaaga

SEQ ID NO: 41088 - DNA, 25 bp, E. coli
ggaaaatcgctcgtttggcgcttta

SEQ ID NO: 41089 - DNA, 25 bp, E. coli
ggtgcaattagtgaaccactaaaga

SEQ ID NO: 41090 - DNA, 25 bp, E. coli
ggaaaatcgctcctttggcgcttta

SEQ ID NO: 41091 - DNA, 25 bp, E. coli
ggcgctttattaatgattacggtgc

SEQ ID NO: 41092 - DNA, 25 bp, E. coli
ggcgctttattattgattacggtgc

SEQ ID NO: 41093 - DNA, 25 bp, E. coli
gatccgcccttttgaaatattgaca

SEQ ID NO: 41094 - DNA, 25 bp, E. coli
gacgtgtcgctatatatgatccgcc

SEQ ID NO: 41095 - DNA, 25 bp, E. coli
gacgtgtcgctaaatatgatccgcc

SEQ ID NO: 41096 - DNA, 25 bp, E. coli
gatccgccctttagaaatattgaca

SEQ ID NO: 41097 - DNA, 25 bp, E. coli
tacaagtgtgaactccgtcaggcat

SEQ ID NO: 41098 - DNA, 25 bp, E. coli
tacaagtgtgaagtccgtcaggcat

SEQ ID NO: 41099 - DNA, 25 bp, E. coli
tagtcacgactgtaagcattggctg

SEQ ID NO: 41100 - DNA, 25 bp, E. coli
tagtcacgactgaaagcattggctg

SEQ ID NO: 41101 - DNA, 25 bp, E. coli
tttgtcagcgactatttacagaaga

SEQ ID NO: 41102 - DNA, 25 bp, E. coli
tttgtcagcgacaatttacagaaga

SEQ ID NO: 41103 - DNA, 25 bp, E. coli
tgggcgacaaaataagttccaggat

SEQ ID NO: 41104 - DNA, 25 bp, E. coli
tgggcgacaaaaaaagttccaggat

SEQ ID NO: 41105 - DNA, 25 bp, E. coli
tgaaaacttacatgtgtgaactccg

SEQ ID NO: 41106 - DNA, 25 bp, E. coli
tgaaaacttacaagtgtgaactccg

SEQ ID NO: 41107 - DNA, 25 bp, E. coli
tcgcggaaaccgcttcagacaagcc

SEQ ID NO: 41108 - DNA, 25 bp, E. coli
tcgcggaaaccggttcagacaagcc

SEQ ID NO: 41109 - DNA, 25 bp, E. coli
tccgcaaggaaatttagtcacgact

SEQ ID NO: 41110 - DNA, 25 bp, E. coli
tccgcaaggaaaattagtcacgact

SEQ ID NO: 41111 - DNA, 25 bp, E. coli
gaaagcattggctgggcgacaaaaa

SEQ ID NO: 41112 - DNA, 25 bp, E. coli
gaaagcattggcagggcgacaaaaa

SEQ ID NO: 41113 - DNA, 25 bp, E. coli
ccgtcaggcataagaaaaaaaagtc

SEQ ID NO: 41114 - DNA, 25 bp, E. coli
ccgtcaggcatatgaaaaaaaagtc

SEQ ID NO: 41115 - DNA, 25 bp, E. coli
gtttaatcttttttgtcagcgacaa

SEQ ID NO: 41116 - DNA, 25 bp, E. coli
gtttaatcttttatgtcagcgacaa

SEQ ID NO: 41117 - DNA, 25 bp, E. coli
tcagacaagcctgcgcaaggaaaat

SEQ ID NO: 41118 - DNA, 25 bp, E. coli
tcagacaagcctccgcaaggaaaat

SEQ ID NO: 41119 - DNA, 25 bp, E. coli
catggtattactcagatcggattaa

SEQ ID NO: 41120 - DNA, 25 bp, E. coli
catttgcattcacgcatgtaaccct

SEQ ID NO: 41121 - DNA, 25 bp, E. coli
catggtattactgagatcggattaa

SEQ ID NO: 41122 - DNA, 25 bp, E. coli
catttgcattcaggcatgtaaccct

SEQ ID NO: 41123 - DNA, 25 bp, E. coli
tacgggcaggcgacatttcattata

SEQ ID NO: 41124 - DNA, 25 bp, E. coli
aaaaggaaagagttcttgctcatgg

SEQ ID NO: 41125 - DNA, 25 bp, E. coli
aaaaggaaagagatcttgctcatgg

SEQ ID NO: 41126 - DNA, 25 bp, E. coli
tacgggcaggcgtcatttcattata

SEQ ID NO: 41127 - DNA, 25 bp, E. coli
tatataaaaaggtaagagttcttgc

SEQ ID NO: 41128 - DNA, 25 bp, E. coli
tatataaaaaggaaagagttcttgc

SEQ ID NO: 41129 - DNA, 25 bp, E. coli
ttatattaccatttgcattcacgca

SEQ ID NO: 41130 - DNA, 25 bp, E. coli
ttatattaccatatgcattcacgca

SEQ ID NO: 41131 - DNA, 25 bp, E. coli
gcaggcgacatttcattatattacc

SEQ ID NO: 41132 - DNA, 25 bp, E. coli
gcaggcgacattacattatattacc

SEQ ID NO: 41133 - DNA, 25 bp, E. coli
cgcatgtaacccttaagagttatat

SEQ ID NO: 41134 - DNA, 25 bp, E. coli
cgcatgtaacccataagagttatat

SEQ ID NO: 41135 - DNA, 25 bp, E. coli
cattcacgcatgtaacccttaagag

SEQ ID NO: 41136 - DNA, 25 bp, E. coli
cattcacgcatgaaacccttaagag

SEQ ID NO: 41137 - DNA, 25 bp, E. coli
gtcattacgggcaggcgacatttca

SEQ ID NO: 41138 - DNA, 25 bp, E. coli
gtcattacgggctggcgacatttca

SEQ ID NO: 41139 - DNA, 25 bp, E. coli
gagttcttgctcttggtattactga

SEQ ID NO: 41140 - DNA, 25 bp, E. coli
gagttcttgctcatggtattactga

SEQ ID NO: 41141 - DNA, 25 bp, E. coli
caccgcgtttttccagatgattcag

SEQ ID NO: 41142 - DNA, 25 bp, E. coli
caccgcgtttttgcagatgattcag

SEQ ID NO: 41143 - DNA, 25 bp, E. coli
catggattgtgtggcgtaaaaagcc

SEQ ID NO: 41144 - DNA, 25 bp, E. coli
catggattgtgtcgcgtaaaaagcc

SEQ ID NO: 41145 - DNA, 25 bp, E. coli
attaagcgattgaggcattcaggcg

SEQ ID NO: 41146 - DNA, 25 bp, E. coli
attaagcgattgtggcattcaggcg

SEQ ID NO: 41147 - DNA, 25 bp, E. coli
tgatacggcaaccatcaccgcgttt

SEQ ID NO: 41148 - DNA, 25 bp, E. coli
tgatacggcaacgatcaccgcgttt

SEQ ID NO: 41149 - DNA, 25 bp, E. coli
tgacaagtggcgcatttcaccatgg

SEQ ID NO: 41150 - DNA, 25 bp, E. coli
tgctggattatgcaaactggcggat

SEQ ID NO: 41151 - DNA, 25 bp, E. coli
tgaactggaactcatgaacgcaaca

SEQ ID NO: 41152 - DNA, 25 bp, E. coli
tgctggattatggaaactggcggat

SEQ ID NO: 41153 - DNA, 25 bp, E. coli
tgaactggaactgatgaacgcaaca

SEQ ID NO: 41154 - DNA, 25 bp, E. coli
tgacaagtggcggatttcaccatgg

SEQ ID NO: 41155 - DNA, 25 bp, E. coli
gcccacgttgtggatcacccgttaa

SEQ ID NO: 41156 - DNA, 25 bp, E. coli
gcccacgttgtgcatcacccgttaa

SEQ ID NO: 41157 - DNA, 25 bp, E. coli
gataactggcatcggccagacgcct

SEQ ID NO: 41158 - DNA, 25 bp, E. coli
gataactggcatgggccagacgcct

SEQ ID NO: 41159 - DNA, 25 bp, E. coli
taatggactggtgatgaccctgagc

SEQ ID NO: 41160 - DNA, 25 bp, E. coli
taatggactggtcatgaccctgagc

SEQ ID NO: 41161 - DNA, 25 bp, E. coli
gatgccgttttacgtattgagcgcg

SEQ ID NO: 41162 - DNA, 25 bp, E. coli
gatgccgttttaggtattgagcgcg

SEQ ID NO: 41163 - DNA, 25 bp, E. coli
aacgtgattttttctggcgtgccag

SEQ ID NO: 41164 - DNA, 25 bp, E. coli
taaaagcgaaactgacggcagggca

SEQ ID NO: 41165 - DNA, 25 bp, E. coli
taaaagcgaaacagacggcagggca

SEQ ID NO: 41166 - DNA, 25 bp, E. coli
aaccgcaaggtaaactgttgttcag

SEQ ID NO: 41167 - DNA, 25 bp, E. coli
aacgtgatttttactggcgtgccag

SEQ ID NO: 41168 - DNA, 25 bp, E. coli
aaccgcaaggtatactgttgttcag

SEQ ID NO: 41169 - DNA, 25 bp, E. coli
tgttgttcagtgaaatcaactggct

SEQ ID NO: 41170 - DNA, 25 bp, E. coli
tgttgttcagtgtaatcaactggct

SEQ ID NO: 41171 - DNA, 25 bp, E. coli
tggttcgatggctggcacaccctgc

SEQ ID NO: 41172 - DNA, 25 bp, E. coli
gaaagtcagaatagccgaacgtacg

SEQ ID NO: 41173 - DNA, 25 bp, E. coli
gaaagtcagaattgccgaacgtacg

SEQ ID NO: 41174 - DNA, 25 bp, E. coli
ctgccggtgaaacgcgcgaaatttg

SEQ ID NO: 41175 - DNA, 25 bp, E. coli
ctttgatatgcgtaaaatgtcggtg

SEQ ID NO: 41176 - DNA, 25 bp, E. coli
ctgccggtgaaaggcgcgaaatttg

SEQ ID NO: 41177 - DNA, 25 bp, E. coli
ctttgatatgcgaaaaatgtcggtg

SEQ ID NO: 41178 - DNA, 25 bp, E. coli
gataacaatgaaaagaacgggccgg

SEQ ID NO: 41179 - DNA, 25 bp, E. coli
gataacaatgaatagaacgggccgg

SEQ ID NO: 41180 - DNA, 25 bp, E. coli
ggatgtctgtaaggcgaaagtcaga

SEQ ID NO: 41181 - DNA, 25 bp, E. coli
ggatgtctgtaacgcgaaagtcaga

SEQ ID NO: 41182 - DNA, 25 bp, E. coli
tggttcgatggcaggcacaccctgc

SEQ ID NO: 41183 - DNA, 25 bp, E. coli
tccacggttaccagaacgataacaa

SEQ ID NO: 41184 - DNA, 25 bp, E. coli
tccacggttacctgaacgataacaa

SEQ ID NO: 41185 - DNA, 25 bp, E. coli
atcctgctgtgggttctgggtacca

SEQ ID NO: 41186 - DNA, 25 bp, E. coli
atcctgctgtggcttctgggtacca

SEQ ID NO: 41187 - DNA, 25 bp, E. coli
ttcttcgtcaaaattatcatgtggg

SEQ ID NO: 41188 - DNA, 25 bp, E. coli
ttcttcgtcaaatttatcatgtggg

SEQ ID NO: 41189 - DNA, 25 bp, E. coli
tgaaggtttcgagcaagcttccgcg

SEQ ID NO: 41190 - DNA, 25 bp, E. coli
tgaaggtttcgaccaagcttccgcg

SEQ ID NO: 41191 - DNA, 25 bp, E. coli
tcgagcaagcttgcgcgattatggg

SEQ ID NO: 41192 - DNA, 25 bp, E. coli
tccatcgcgtttccggtgtgatcac

SEQ ID NO: 41193 - DNA, 25 bp, E. coli
tcgagcaagcttccgcgattatggg

SEQ ID NO: 41194 - DNA, 25 bp, E. coli
tccatcgcgtttgcggtgtgatcac

SEQ ID NO: 41195 - DNA, 25 bp, E. coli
tcacgtcgtcgtaggtattcgccac

SEQ ID NO: 41196 - DNA, 25 bp, E. coli
gcctctcttcccctgaaggtttcga

SEQ ID NO: 41197 - DNA, 25 bp, E. coli
gcctctcttcccgtgaaggtttcga

SEQ ID NO: 41198 - DNA, 25 bp, E. coli
gattatgggcagcttcttcgtcaaa

SEQ ID NO: 41199 - DNA, 25 bp, E. coli
gatagcgtccattctccatcgcgtt

SEQ ID NO: 41200 - DNA, 25 bp, E. coli
gattatgggcaggttcttcgtcaaa

SEQ ID NO: 41201 - DNA, 25 bp, E. coli
gatagcgtccatactccatcgcgtt

SEQ ID NO: 41202 - DNA, 25 bp, E. coli
ggcttctgggtaccagcctctcttc

SEQ ID NO: 41203 - DNA, 25 bp, E. coli
ggcttctgggtagcagcctctcttc

SEQ ID NO: 41204 - DNA, 25 bp, E. coli
gtgtgatcacctttgttgcagtggg

SEQ ID NO: 41205 - DNA, 25 bp, E. coli
gtgtgatcacctatgttgcagtggg

SEQ ID NO: 41206 - DNA, 25 bp, E. coli
tcacgtcgtcgttggtattcgccac

SEQ ID NO: 41207 - DNA, 25 bp, E. coli
cacccgcttatcagttttacatgga

SEQ ID NO: 41208 - DNA, 25 bp, E. coli
cacccgcttatctgttttacatgga

SEQ ID NO: 41209 - DNA, 25 bp, E. coli
ataaattgaatgctgcagggagcgc

SEQ ID NO: 41210 - DNA, 25 bp, E. coli
ataaattgaatggtgcagggagcgc

SEQ ID NO: 41211 - DNA, 25 bp, E. coli
tagatttgataatcgcggatggacg

SEQ ID NO: 41212 - DNA, 25 bp, E. coli
tagatttgataaacgcggatggacg

SEQ ID NO: 41213 - DNA, 25 bp, E. coli
tttggcttcagcagcgggttgcgct

SEQ ID NO: 41214 - DNA, 25 bp, E. coli
tttggcttcagctgcgggttgcgct

SEQ ID NO: 41215 - DNA, 25 bp, E. coli
cctgcggcggttttgtttggcttca

SEQ ID NO: 41216 - DNA, 25 bp, E. coli
cctgcggcggttatgtttggcttca

SEQ ID NO: 41217 - DNA, 25 bp, E. coli
gcggcatccggcaagaacacatggt

SEQ ID NO: 41218 - DNA, 25 bp, E. coli
gcggcatccggctagaacacatggt

SEQ ID NO: 41219 - DNA, 25 bp, E. coli
gaagctctgatgcattgagtctgga

SEQ ID NO: 41220 - DNA, 25 bp, E. coli
gaagctctgatggattgagtctgga

SEQ ID NO: 41221 - DNA, 25 bp, E. coli
gaataatcgtttatatcccttggca

SEQ ID NO: 41222 - DNA, 25 bp, E. coli
gaataatcgtttttatcccttggca

SEQ ID NO: 41223 - DNA, 25 bp, E. coli
ggttgcgctcccttaatgtgcctcg

SEQ ID NO: 41224 - DNA, 25 bp, E. coli
ggttgcgctcccataatgtgcctcg

SEQ ID NO: 41225 - DNA, 25 bp, E. coli
tggacgaaattgcttgatacacccg

SEQ ID NO: 41226 - DNA, 25 bp, E. coli
tggacgaaattggttgatacacccg

SEQ ID NO: 41227 - DNA, 25 bp, E. coli
gagctgttattaagttccgggcaaa

SEQ ID NO: 41228 - DNA, 25 bp, E. coli
gagctgttattatgttccgggcaaa

SEQ ID NO: 41229 - DNA, 25 bp, E. coli
aactggccgcagtttgttcaaagtg

SEQ ID NO: 41230 - DNA, 25 bp, E. coli
aactggccgcagattgttcaaagtg

SEQ ID NO: 41231 - DNA, 25 bp, E. coli
tatacgcgcgtattatcgattcaca

SEQ ID NO: 41232 - DNA, 25 bp, E. coli
tatacgcgcgtaatatcgattcaca

SEQ ID NO: 41233 - DNA, 25 bp, E. coli
ttgttcaaagtgaagaggacacgcg

SEQ ID NO: 41234 - DNA, 25 bp, E. coli
ttgttcaaagtgtagaggacacgcg

SEQ ID NO: 41235 - DNA, 25 bp, E. coli
tctggtgaacttagacgcttcgtga

SEQ ID NO: 41236 - DNA, 25 bp, E. coli
tctggtgaactttgacgcttcgtga

SEQ ID NO: 41237 - DNA, 25 bp, E. coli
gcgctgcaggcattgattcatcatt

SEQ ID NO: 41238 - DNA, 25 bp, E. coli
gctgagttcctgtatgatgcctatg

SEQ ID NO: 41239 - DNA, 25 bp, E. coli
gctgagttcctgaatgatgcctatg

SEQ ID NO: 41240 - DNA, 25 bp, E. coli
gctactggctggacgaatctcatca

SEQ ID NO: 41241 - DNA, 25 bp, E. coli
gcttcgtgatcaaatgtcgggtgga

SEQ ID NO: 41242 - DNA, 25 bp, E. coli
gcttcgtgatcatatgtcgggtgga

SEQ ID NO: 41243 - DNA, 25 bp, E. coli
gcgctgcaggcaatgattcatcatt

SEQ ID NO: 41244 - DNA, 25 bp, E. coli
gctactggctggtcgaatctcatca

SEQ ID NO: 41245 - DNA, 25 bp, E. coli
gcaaccaggtcgctttgcgcaatgg

SEQ ID NO: 41246 - DNA, 25 bp, E. coli
gcaaccaggtcggtttgcgcaatgg

SEQ ID NO: 41247 - DNA, 25 bp, E. coli
gatcatttctcaggcgctgcaggca

SEQ ID NO: 41248 - DNA, 25 bp, E. coli
gatcatttctcacgcgctgcaggca

SEQ ID NO: 41249 - DNA, 25 bp, E. coli
gatgatgtgaacatatacgcgcgta

SEQ ID NO: 41250 - DNA, 25 bp, E. coli
gatgatgtgaacttatacgcgcgta

SEQ ID NO: 41251 - DNA, 25 bp, E. coli
cagctggcgcaggaaaagcgcacga

SEQ ID NO: 41252 - DNA, 25 bp, E. coli
cacgaaatgagctttgcccgggatg

SEQ ID NO: 41253 - DNA, 25 bp, E. coli
cagctggcgcagcaaaagcgcacga

SEQ ID NO: 41254 - DNA, 25 bp, E. coli
cacgaaatgagcattgcccgggatg

SEQ ID NO: 41255 - DNA, 25 bp, E. coli
tatcggtccgagaggttccggcaaa

SEQ ID NO: 41256 - DNA, 25 bp, E. coli
tatcggtccgagtggttccggcaaa

SEQ ID NO: 41257 - DNA, 25 bp, E. coli
agcacgtcgggtatgtcttccagaa

SEQ ID NO: 41258 - DNA, 25 bp, E. coli
agcacgtcgggtttgtcttccagaa

SEQ ID NO: 41259 - DNA, 25 bp, E. coli
aacattattgaacggccggtgatcg

SEQ ID NO: 41260 - DNA, 25 bp, E. coli
aacattattgaagggccggtgatcg

SEQ ID NO: 41261 - DNA, 25 bp, E. coli
tgtttccgcatcgtacggtgctgga

SEQ ID NO: 41262 - DNA, 25 bp, E. coli
tgtttccgcatcctacggtgctgga

SEQ ID NO: 41263 - DNA, 25 bp, E. coli
tgagtgccattgtagttaagaacct

SEQ ID NO: 41264 - DNA, 25 bp, E. coli
tgagtgccattgaagttaagaacct

SEQ ID NO: 41265 - DNA, 25 bp, E. coli
ccacgtcgtttgactggcggtcaac

SEQ ID NO: 41266 - DNA, 25 bp, E. coli
ccacgtcgtttgtctggcggtcaac

SEQ ID NO: 41267 - DNA, 25 bp, E. coli
gaaaaaattccacggtcagacggtg

SEQ ID NO: 41268 - DNA, 25 bp, E. coli
gaaaaaattccagggtcagacggtg

SEQ ID NO: 41269 - DNA, 25 bp, E. coli
gatactgcacgtacattaagtcagc

SEQ ID NO: 41270 - DNA, 25 bp, E. coli
gatactgcacgttcattaagtcagc

SEQ ID NO: 41271 - DNA, 25 bp, E. coli
tcaccgttggcgttatcactattga

SEQ ID NO: 41272 - DNA, 25 bp, E. coli
tcaccgttggcgatatcactattga

SEQ ID NO: 41273 - DNA, 25 bp, E. coli
caaaactgcgcaattacgaaaacgc

SEQ ID NO: 41274 - DNA, 25 bp, E. coli
caaaactgcgcatttacgaaaacgc

SEQ ID NO: 41275 - DNA, 25 bp, E. coli
cagtatcgtgcaccaaaactgcgca

SEQ ID NO: 41276 - DNA, 25 bp, E. coli
cagtatcgtgcagcaaaactgcgca

SEQ ID NO: 41277 - DNA, 25 bp, E. coli
tacaacagtatcgtgcagcaaaact

SEQ ID NO: 41278 - DNA, 25 bp, E. coli
tacaacagtatcctgcagcaaaact

SEQ ID NO: 41279 - DNA, 25 bp, E. coli
tatcgtgcagcaaaactgcgcattt

SEQ ID NO: 41280 - DNA, 25 bp, E. coli
tatcgtgcagcataactgcgcattt

SEQ ID NO: 41281 - DNA, 25 bp, E. coli
ttggtttacaactgtatcgtgcagc

SEQ ID NO: 41282 - DNA, 25 bp, E. coli
ttggtttacaacagtatcgtgcagc

SEQ ID NO: 41283 - DNA, 25 bp, E. coli
ttgcgtggttaaagctgatgatgcc

SEQ ID NO: 41284 - DNA, 25 bp, E. coli
ttgcgtggttaatgctgatgatgcc

SEQ ID NO: 41285 - DNA, 25 bp, E. coli
tccgtttggtttacaacagtatcgt

SEQ ID NO: 41286 - DNA, 25 bp, E. coli
tccgtttggttttcaacagtatcgt

SEQ ID NO: 41287 - DNA, 25 bp, E. coli
gcaaaactgcgcatttacgaaaacg

SEQ ID NO: 41288 - DNA, 25 bp, E. coli
gcaaaactgcgcttttacgaaaacg

SEQ ID NO: 41289 - DNA, 25 bp, E. coli
cgtttggtttactacagtatcgtgc

SEQ ID NO: 41290 - DNA, 25 bp, E. coli
cgtttggtttacaacagtatcgtgc

SEQ ID NO: 41291 - DNA, 25 bp, E. coli
cgtgcagcaaaagtgcgcatttacg

SEQ ID NO: 41292 - DNA, 25 bp, E. coli
cgtgcagcaaaactgcgcatttacg

SEQ ID NO: 41293 - DNA, 25 bp, E. coli
ggtttacaacagtatcgtgcagcaa

SEQ ID NO: 41294 - DNA, 25 bp, E. coli
ggtttacaacagaatcgtgcagcaa

SEQ ID NO: 41295 - DNA, 25 bp, E. coli
caaaagagagtgaagttctgcgcct

SEQ ID NO: 41296 - DNA, 25 bp, E. coli
caaaagagagtgtagttctgcgcct

SEQ ID NO: 41297 - DNA, 25 bp, E. coli
caacaacccggccattcttagtgcg

SEQ ID NO: 41298 - DNA, 25 bp, E. coli
caacaacccggcgattcttagtgcg

SEQ ID NO: 41299 - DNA, 25 bp, E. coli
tattaaaaccatgagtagccagaag

SEQ ID NO: 41300 - DNA, 25 bp, E. coli
tattaaaaccatcagtagccagaag

SEQ ID NO: 41301 - DNA, 25 bp, E. coli
tcgaagggatcgagctgaaacaagg

SEQ ID NO: 41302 - DNA, 25 bp, E. coli
tcgaagggatcgtgctgaaacaagg

SEQ ID NO: 41303 - DNA, 25 bp, E. coli
tcggcgaatttgaagactctacagc

SEQ ID NO: 41304 - DNA, 25 bp, E. coli
tcggcgaatttgtagactctacagc

SEQ ID NO: 41305 - DNA, 25 bp, E. coli
tctcgcctgttgcaaaaaatcagtg

SEQ ID NO: 41306 - DNA, 25 bp, E. coli
tctcgcctgttggaaaaaatcagtg

SEQ ID NO: 41307 - DNA, 25 bp, E. coli
cctggcgataagtacggcgatggca

SEQ ID NO: 41308 - DNA, 25 bp, E. coli
cctggcgataagaacggcgatggca

SEQ ID NO: 41309 - DNA, 25 bp, E. coli
gctgaaacaaggagcaccgaccgat

SEQ ID NO: 41310 - DNA, 25 bp, E. coli
gctgaaacaaggtgcaccgaccgat

SEQ ID NO: 41311 - DNA, 25 bp, E. coli
gaaggcttcctggtgaccgagatcg

SEQ ID NO: 41312 - DNA, 25 bp, E. coli
gaaggcttcctgctgaccgagatcg

SEQ ID NO: 41313 - DNA, 25 bp, E. coli
taccgatctctccatgcctggcgat

SEQ ID NO: 41314 - DNA, 25 bp, E. coli
taccgatctctcgatgcctggcgat

SEQ ID NO: 41315 - DNA, 25 bp, E. coli
gatcgctaaaaacctgaaccgcagt

SEQ ID NO: 41316 - DNA, 25 bp, E. coli
gatcgctaaaaagctgaaccgcagt

SEQ ID NO: 41317 - DNA, 25 bp, E. coli
taccgactagccgaaatggcgcagt

SEQ ID NO: 41318 - DNA, 25 bp, E. coli
tatgcgttatttgatcggccaaccg

SEQ ID NO: 41319 - DNA, 25 bp, E. coli
tatgcgttatttcatcggccaaccg

SEQ ID NO: 41320 - DNA, 25 bp, E. coli
taccgactagcccaaatggcgcagt

SEQ ID NO: 41321 - DNA, 25 bp, E. coli
tttatatggcctcgctgggctaccg

SEQ ID NO: 41322 - DNA, 25 bp, E. coli
tttatatggcctggctgggctaccg

SEQ ID NO: 41323 - DNA, 25 bp, E. coli
tgcttccaggcatactcaggcgtgt

SEQ ID NO: 41324 - DNA, 25 bp, E. coli
tgcttccaggcaaactcaggcgtgt

SEQ ID NO: 41325 - DNA, 25 bp, E. coli
tcggcgcactgggaacggctattta

SEQ ID NO: 41326 - DNA, 25 bp, E. coli
tcggcgcactggcaacggctattta

SEQ ID NO: 41327 - DNA, 25 bp, E. coli
tccgatagcggacacaaaatgcaat

SEQ ID NO: 41328 - DNA, 25 bp, E. coli
tccgatagcggagacaaaatgcaat

SEQ ID NO: 41329 - DNA, 25 bp, E. coli
tctggatcgatcaggcggtccctgt

SEQ ID NO: 41330 - DNA, 25 bp, E. coli
tctggatcgatctggcggtccctgt

SEQ ID NO: 41331 - DNA, 25 bp, E. coli
gctattcgttctggttgtggtgaca

SEQ ID NO: 41332 - DNA, 25 bp, E. coli
gcgtctttttgggaaagtggcagaa

SEQ ID NO: 41333 - DNA, 25 bp, E. coli
gcgtctttttggcaaagtggcagaa

SEQ ID NO: 41334 - DNA, 25 bp, E. coli
gctattcgttctcgttgtggtgaca

SEQ ID NO: 41335 - DNA, 25 bp, E. coli
cccttcctgatggagatgcttccag

SEQ ID NO: 41336 - DNA, 25 bp, E. coli
cccttcctgatgcagatgcttccag

SEQ ID NO: 41337 - DNA, 25 bp, E. coli
ggccaaccgcttgaatggacagaag

SEQ ID NO: 41338 - DNA, 25 bp, E. coli
ggccaaccgcttcaatggacagaag

SEQ ID NO: 41339 - DNA, 25 bp, E. coli
aatgcggtgtcccatctcgggcaaa

SEQ ID NO: 41340 - DNA, 25 bp, E. coli
aatgcggtgtccgatctcgggcaaa

SEQ ID NO: 41341 - DNA, 25 bp, E. coli
caaatgcggtgtgcgatctcgggca

SEQ ID NO: 41342 - DNA, 25 bp, E. coli
cacaaatgcggtgtccgatctcggg

SEQ ID NO: 41343 - DNA, 25 bp, E. coli
caaatgcggtgtccgatctcgggca

SEQ ID NO: 41344 - DNA, 25 bp, E. coli
cacaaatgcggtctccgatctcggg

SEQ ID NO: 41345 - DNA, 25 bp, E. coli
tgtccgatctcgcgcaaaaacttgg

SEQ ID NO: 41346 - DNA, 25 bp, E. coli
tgtccgatctcgggcaaaaacttgg

SEQ ID NO: 41347 - DNA, 25 bp, E. coli
tcggcgctcggcacaaatgcggtgt

SEQ ID NO: 41348 - DNA, 25 bp, E. coli
tcggcgctcggctcaaatgcggtgt

SEQ ID NO: 41349 - DNA, 25 bp, E. coli
gcgctcggcacaaatgcggtgtccg

SEQ ID NO: 41350 - DNA, 25 bp, E. coli
gcgctcggcacatatgcggtgtccg

SEQ ID NO: 41351 - DNA, 25 bp, E. coli
gctcggcacaaatgcggtgtccgat

SEQ ID NO: 41352 - DNA, 25 bp, E. coli
gctcggcacaaaagcggtgtccgat

SEQ ID NO: 41353 - DNA, 25 bp, E. coli
cggtgtccgatctcgggcaaaaact

SEQ ID NO: 41354 - DNA, 25 bp, E. coli
ctggaatcggcgctcggcacaaatg

SEQ ID NO: 41355 - DNA, 25 bp, E. coli
cggtgtccgatcacgggcaaaaact

SEQ ID NO: 41356 - DNA, 25 bp, E. coli
ctggaatcggcggtcggcacaaatg

SEQ ID NO: 41357 - DNA, 25 bp, E. coli
ggcacaaatgcggtgtccgatctcg

SEQ ID NO: 41358 - DNA, 25 bp, E. coli
tgcggtgtccgaactcgggcaaaaa

SEQ ID NO: 41359 - DNA, 25 bp, E. coli
tgcggtgtccgatctcgggcaaaaa

SEQ ID NO: 41360 - DNA, 25 bp, E. coli
ggcacaaatgcgctgtccgatctcg

SEQ ID NO: 41361 - DNA, 25 bp, E. coli
cagctccgggttcgttcactcgaaa

SEQ ID NO: 41362 - DNA, 25 bp, E. coli
cagctccgggttggttcactcgaaa

SEQ ID NO: 41363 - DNA, 25 bp, E. coli
agaagcatgggccttctccagcgaa

SEQ ID NO: 41364 - DNA, 25 bp, E. coli
agaagcatgggcgttctccagcgaa

SEQ ID NO: 41365 - DNA, 25 bp, E. coli
tacgccaggccgcatttccagttat

SEQ ID NO: 41366 - DNA, 25 bp, E. coli
tacgccaggccggatttccagttat

SEQ ID NO: 41367 - DNA, 25 bp, E. coli
tatcattgccgcaatcctggcgatg

SEQ ID NO: 41368 - DNA, 25 bp, E. coli
tatcattgccgctatcctggcgatg

SEQ ID NO: 41369 - DNA, 25 bp, E. coli
gaaactggcgcaactgcctgaggga

SEQ ID NO: 41370 - DNA, 25 bp, E. coli
gaaactggcgcatctgcctgaggga

SEQ ID NO: 41371 - DNA, 25 bp, E. coli
gaactgatgcaaggatcgctagcca

SEQ ID NO: 41372 - DNA, 25 bp, E. coli
gactggagcatgtgttgcacccgtg

SEQ ID NO: 41373 - DNA, 25 bp, E. coli
gactggagcatgagttgcacccgtg

SEQ ID NO: 41374 - DNA, 25 bp, E. coli
gaactgatgcaacgatcgctagcca

SEQ ID NO: 41375 - DNA, 25 bp, E. coli
ctgttatggataaatgacgcgctga

SEQ ID NO: 41376 - DNA, 25 bp, E. coli
ctgttatggatatatgacgcgctga

SEQ ID NO: 41377 - DNA, 25 bp, E. coli
ggcttgctgattcgcaaaccgctgg

SEQ ID NO: 41378 - DNA, 25 bp, E. coli
ggcttgctgattggcaaaccgctgg

SEQ ID NO: 41379 - DNA, 25 bp, E. coli
tggtcggttctatctcttcggcggt

SEQ ID NO: 41380 - DNA, 25 bp, E. coli
tggtcggttctaactcttcggcggt

SEQ ID NO: 41381 - DNA, 25 bp, E. coli
taactgggcgaatctcggtatcctg

SEQ ID NO: 41382 - DNA, 25 bp, E. coli
taactgggcgaaactcggtatcctg

SEQ ID NO: 41383 - DNA, 25 bp, E. coli
gaaggtccgcgttttacctcgccag

SEQ ID NO: 41384 - DNA, 25 bp, E. coli
gaaggtccgcgtattacctcgccag

SEQ ID NO: 41385 - DNA, 25 bp, E. coli
acctacatggtggaaggcggcagca

SEQ ID NO: 41386 - DNA, 25 bp, E. coli
acctacatggtgcaaggcggcagca

SEQ ID NO: 41387 - DNA, 25 bp, E. coli
aaaccggttgcgttgcgctgggcct

SEQ ID NO: 41388 - DNA, 25 bp, E. coli
aaaccggttgcgatgcgctgggcct

SEQ ID NO: 41389 - DNA, 25 bp, E. coli
aaaaacgatcgtaatctgcgggcgc

SEQ ID NO: 41390 - DNA, 25 bp, E. coli
aaaaacgatcgttatctgcgggcgc

SEQ ID NO: 41391 - DNA, 25 bp, E. coli
taccgggcgcgattatcaacagttc

SEQ ID NO: 41392 - DNA, 25 bp, E. coli
taccggaatataaagccacgcgcgc

SEQ ID NO: 41393 - DNA, 25 bp, E. coli
taccgggcgcgaatatcaacagttc

SEQ ID NO: 41394 - DNA, 25 bp, E. coli
taccggaatatatagccacgcgcgc

SEQ ID NO: 41395 - DNA, 25 bp, E. coli
ttactgcgtgaatacgacggtcgcc

SEQ ID NO: 41396 - DNA, 25 bp, E. coli
ttactgcgtgaaaacgacggtcgcc

SEQ ID NO: 41397 - DNA, 25 bp, E. coli
tgaatgcgcagaataaagccggtgc

SEQ ID NO: 41398 - DNA, 25 bp, E. coli
tgaatgcgcagattaaagccggtgc

SEQ ID NO: 41399 - DNA, 25 bp, E. coli
gactggacaacggacatcgccgatg

SEQ ID NO: 41400 - DNA, 25 bp, E. coli
cgcctgcccgcattgaagaagaagt

SEQ ID NO: 41401 - DNA, 25 bp, E. coli
cgcctgcccgcaatgaagaagaagt

SEQ ID NO: 41402 - DNA, 25 bp, E. coli
taaccttggtcagggcattcatcag

SEQ ID NO: 41403 - DNA, 25 bp, E. coli
taaccttggtcacggcattcatcag

SEQ ID NO: 41404 - DNA, 25 bp, E. coli
gactggacaacgcacatcgccgatg

SEQ ID NO: 41405 - DNA, 25 bp, E. coli
catgcaggcatgaatcgatcgcggg

SEQ ID NO: 41406 - DNA, 25 bp, E. coli
catgcaggcatgtatcgatcgcggg

SEQ ID NO: 41407 - DNA, 25 bp, E. coli
catgaagtggatatcccgcgcgaca

SEQ ID NO: 41408 - DNA, 25 bp, E. coli
catgaagtggatttcccgcgcgaca

SEQ ID NO: 41409 - DNA, 25 bp, E. coli
taacggcgatgatgtcgtctacagc

SEQ ID NO: 41410 - DNA, 25 bp, E. coli
taacggcgatgaagtcgtctacagc

SEQ ID NO: 41411 - DNA, 25 bp, E. coli
aaacttattattgcatcggcggcgg

SEQ ID NO: 41412 - DNA, 25 bp, E. coli
aaacttattattccatcggcggcgg

SEQ ID NO: 41413 - DNA, 25 bp, E. coli
tgaaaacggtatccaaatccacgcc

SEQ ID NO: 41414 - DNA, 25 bp, E. coli
tgaaaacggtatgcaaatccacgcc

SEQ ID NO: 41415 - DNA, 25 bp, E. coli
gctgcacagcaagaaagagatcgac

SEQ ID NO: 41416 - DNA, 25 bp, E. coli
gctgcacagcaacaaagagatcgac

SEQ ID NO: 41417 - DNA, 25 bp, E. coli
gcagttaacgaacaaaacgccgccg

SEQ ID NO: 41418 - DNA, 25 bp, E. coli
ctcacgcggtggactggcaatcaaa

SEQ ID NO: 41419 - DNA, 25 bp, E. coli
gcagttaacgaagaaaacgccgccg

SEQ ID NO: 41420 - DNA, 25 bp, E. coli
ctcacgcggtggtctggcaatcaaa

SEQ ID NO: 41421 - DNA, 25 bp, E. coli
tcactgtcgctgtcgggtaaaggcc

SEQ ID NO: 41422 - DNA, 25 bp, E. coli
tcactgtcgctgacgggtaaaggcc

SEQ ID NO: 41423 - DNA, 25 bp, E. coli
gatctggtcgaaaaaggcttactgg

SEQ ID NO: 41424 - DNA, 25 bp, E. coli
gagtatttcgcggatgtctggcaaa

SEQ ID NO: 41425 - DNA, 25 bp, E. coli
gatctggtcgaataaggcttactgg

SEQ ID NO: 41426 - DNA, 25 bp, E. coli
gagtatttcgcgcatgtctggcaaa

SEQ ID NO: 41427 - DNA, 25 bp, E. coli
agatggcaaatacattgttcgccgc

SEQ ID NO: 41428 - DNA, 25 bp, E. coli
agatggcaaatagattgttcgccgc

SEQ ID NO: 41429 - DNA, 25 bp, E. coli
tgtgcctgcattagcctggcaacca

SEQ ID NO: 41430 - DNA, 25 bp, E. coli
tgtgcctgcatttgcctggcaacca

SEQ ID NO: 41431 - DNA, 25 bp, E. coli
tgaaagagttcgttcttagtaaccc

SEQ ID NO: 41432 - DNA, 25 bp, E. coli
tgaaagagttcgatcttagtaaccc

SEQ ID NO: 41433 - DNA, 25 bp, E. coli
tgcgcgtaggtgtacagcagaagtt

SEQ ID NO: 41434 - DNA, 25 bp, E. coli
tgcgcgtaggtgaacagcagaagtt

SEQ ID NO: 41435 - DNA, 25 bp, E. coli
gccgcgttgaaggtggactgaatac

SEQ ID NO: 41436 - DNA, 25 bp, E. coli
gccgcgttgaagctggactgaatac

SEQ ID NO: 41437 - DNA, 25 bp, E. coli
gactgaataccgtacaacagcaaaa

SEQ ID NO: 41438 - DNA, 25 bp, E. coli
gactgaataccgaacaacagcaaaa

SEQ ID NO: 41439 - DNA, 25 bp, E. coli
cccacggtgaagttggcaaatacat

SEQ ID NO: 41440 - DNA, 25 bp, E. coli
cccacggtgaagatggcaaatacat

SEQ ID NO: 41441 - DNA, 25 bp, E. coli
ggtggactgaataccgaacaacagc

SEQ ID NO: 41442 - DNA, 25 bp, E. coli
ggtggactgaattccgaacaacagc

SEQ ID NO: 41443 - DNA, 25 bp, E. coli
ggatcgcccacggtgaagatggcaa

SEQ ID NO: 41444 - DNA, 25 bp, E. coli
ggatcgcccacgctgaagatggcaa

SEQ ID NO: 41445 - DNA, 25 bp, E. coli
taacccgctggttcaggcgaaactc

SEQ ID NO: 41446 - DNA, 25 bp, E. coli
taacccgctggtacaggcgaaactc

SEQ ID NO: 41447 - DNA, 25 bp, E. coli
gagttcgatcttagtaacccgctgg

SEQ ID NO: 41448 - DNA, 25 bp, E. coli
gagttcgatctttgtaacccgctgg

SEQ ID NO: 41449 - DNA, 25 bp, E. coli
tacgacgtcaggatgtttcgcccgc

SEQ ID NO: 41450 - DNA, 25 bp, E. coli
actcaggcgatgaaagaggtactgc

SEQ ID NO: 41451 - DNA, 25 bp, E. coli
actcaggcgatgtaagaggtactgc

SEQ ID NO: 41452 - DNA, 25 bp, E. coli
tacgacgtcaggttgtttcgcccgc

SEQ ID NO: 41453 - DNA, 25 bp, E. coli
tgaacatgaactggtgactcaggcg

SEQ ID NO: 41454 - DNA, 25 bp, E. coli
tgaggaagtacagcagaccatggca

SEQ ID NO: 41455 - DNA, 25 bp, E. coli
tgaggaagtacaccagaccatggca

SEQ ID NO: 41456 - DNA, 25 bp, E. coli
tgaacatgaactcgtgactcaggcg

SEQ ID NO: 41457 - DNA, 25 bp, E. coli
tctgctggcgtctgaaaaagatcgc

SEQ ID NO: 41458 - DNA, 25 bp, E. coli
tctgctggcgtcagaaaaagatcgc

SEQ ID NO: 41459 - DNA, 25 bp, E. coli
gcccggaactgcagctacgtaaaga

SEQ ID NO: 41460 - DNA, 25 bp, E. coli
gcccggaactgctgctacgtaaaga

SEQ ID NO: 41461 - DNA, 25 bp, E. coli
gcgcagggcatcaaaaatccggtga

SEQ ID NO: 41462 - DNA, 25 bp, E. coli
gcgcagggcatctaaaatccggtga

SEQ ID NO: 41463 - DNA, 25 bp, E. coli
cccgcttcgatgtaccggctgtgaa

SEQ ID NO: 41464 - DNA, 25 bp, E. coli
cgccgcaggtcgacaaagtggtgtt

SEQ ID NO: 41465 - DNA, 25 bp, E. coli
cccgcttcgatgaaccggctgtgaa

SEQ ID NO: 41466 - DNA, 25 bp, E. coli
cgccgcaggtcgtcaaagtggtgtt

SEQ ID NO: 41467 - DNA, 25 bp, E. coli
gttgattgcgcaaaacccggttagt

SEQ ID NO: 41468 - DNA, 25 bp, E. coli
gttgattgcgcataacccggttagt

SEQ ID NO: 41469 - DNA, 25 bp, E. coli
tggcagtcgttcacccgtcaggaaa

SEQ ID NO: 41470 - DNA, 25 bp, E. coli
tggcagtcgttctcccgtcaggaaa

SEQ ID NO: 41471 - DNA, 25 bp, E. coli
cactgactgacattctgactcgcca

SEQ ID NO: 41472 - DNA, 25 bp, E. coli
cactgactgacaatctgactcgcca

SEQ ID NO: 41473 - DNA, 25 bp, E. coli
tttgccactgactgacattctgact

SEQ ID NO: 41474 - DNA, 25 bp, E. coli
tttgccactgacagacattctgact

SEQ ID NO: 41475 - DNA, 25 bp, E. coli
ttctgactcgcctcgctgcgagtga

SEQ ID NO: 41476 - DNA, 25 bp, E. coli
ttctgactcgccacgctgcgagtga

SEQ ID NO: 41477 - DNA, 25 bp, E. coli
taaccatccggcagacggttttact

SEQ ID NO: 41478 - DNA, 25 bp, E. coli
taaccatccggctgacggttttact

SEQ ID NO: 41479 - DNA, 25 bp, E. coli
tgactgacattcagactcgccacgc

SEQ ID NO: 41480 - DNA, 25 bp, E. coli
tgactgacattctgactcgccacgc

SEQ ID NO: 41481 - DNA, 25 bp, E. coli
tgccactgactgacattctgactcg

SEQ ID NO: 41482 - DNA, 25 bp, E. coli
tgccactgactgtcattctgactcg

SEQ ID NO: 41483 - DNA, 25 bp, E. coli
ccatccggcagacggttttactgct

SEQ ID NO: 41484 - DNA, 25 bp, E. coli
ccatccggcagagggttttactgct

SEQ ID NO: 41485 - DNA, 25 bp, E. coli
gactcgccacgcagcgagtgacagc

SEQ ID NO: 41486 - DNA, 25 bp, E. coli
gactcgccacgctgcgagtgacagc

SEQ ID NO: 41487 - DNA, 25 bp, E. coli
gacattctgactggccacgctgcga

SEQ ID NO: 41488 - DNA, 25 bp, E. coli
gacattctgactcgccacgctgcga

SEQ ID NO: 41489 - DNA, 25 bp, E. coli
cggcaccaccggaacaccgaagctg

SEQ ID NO: 41490 - DNA, 25 bp, E. coli
cggcagacggttatactgctacgcc

SEQ ID NO: 41491 - DNA, 25 bp, E. coli
cggcaccaccggtacaccgaagctg

SEQ ID NO: 41492 - DNA, 25 bp, E. coli
cggcagacggttttactgctacgcc

SEQ ID NO: 41493 - DNA, 25 bp, E. coli
caatgctggtcgttgactacggcca

SEQ ID NO: 41494 - DNA, 25 bp, E. coli
caatgctggtcgatgactacggcca

SEQ ID NO: 41495 - DNA, 25 bp, E. coli
aaatgcgtcgcgatcggcacataca

SEQ ID NO: 41496 - DNA, 25 bp, E. coli
aactgaagccgcaaactccggagga

SEQ ID NO: 41497 - DNA, 25 bp, E. coli
aactgaagccgctaactccggagga

SEQ ID NO: 41498 - DNA, 25 bp, E. coli
aaatgcgtcgcgttcggcacataca

SEQ ID NO: 41499 - DNA, 25 bp, E. coli
tccggaggaagatcaacatgactga

SEQ ID NO: 41500 - DNA, 25 bp, E. coli
tccggaggaagaacaacatgactga

SEQ ID NO: 41501 - DNA, 25 bp, E. coli
gaaaacgtacgtcatgccagcgtgg

SEQ ID NO: 41502 - DNA, 25 bp, E. coli
gaaaacgtacgtgatgccagcgtgg

SEQ ID NO: 41503 - DNA, 25 bp, E. coli
ccgacgtgcgtgaagaagattatca

SEQ ID NO: 41504 - DNA, 25 bp, E. coli
ccgacgtgcgtgtagaagattatca

SEQ ID NO: 41505 - DNA, 25 bp, E. coli
gatttagcgccaaatccggtcacgc

SEQ ID NO: 41506 - DNA, 25 bp, E. coli
gatttatttcaagcatcgcccggaa

SEQ ID NO: 41507 - DNA, 25 bp, E. coli
gatttcgccaatgtgctgacgcagg

SEQ ID NO: 41508 - DNA, 25 bp, E. coli
gatttagcgccatatccggtcacgc

SEQ ID NO: 41509 - DNA, 25 bp, E. coli
gatttcgccaatctgctgacgcagg

SEQ ID NO: 41510 - DNA, 25 bp, E. coli
gatttatttcaaccatcgcccggaa

SEQ ID NO: 41511 - DNA, 25 bp, E. coli
ggatacctaccagggcgactttgag

SEQ ID NO: 41512 - DNA, 25 bp, E. coli
ggatacctaccacggcgactttgag

SEQ ID NO: 41513 - DNA, 25 bp, E. coli
gagatgctggcagcggtattaaccg

SEQ ID NO: 41514 - DNA, 25 bp, E. coli
gagatgctggcaccggtattaaccg

SEQ ID NO: 41515 - DNA, 25 bp, E. coli
aagatatggcggtagacatgacccc

SEQ ID NO: 41516 - DNA, 25 bp, E. coli
aagatatggcggaagacatgacccc

SEQ ID NO: 41517 - DNA, 25 bp, E. coli
catgaatccagacggtaaaggccgc

SEQ ID NO: 41518 - DNA, 25 bp, E. coli
catgaatccagagggtaaaggccgc

SEQ ID NO: 41519 - DNA, 25 bp, E. coli
tagacaagctgctccaacaatccgg

SEQ ID NO: 41520 - DNA, 25 bp, E. coli
tagacaagctgcaccaacaatccgg

SEQ ID NO: 41521 - DNA, 25 bp, E. coli
tgacggtccgttccagatgcagatt

SEQ ID NO: 41522 - DNA, 25 bp, E. coli
tgacggtccgttgcagatgcagatt

SEQ ID NO: 41523 - DNA, 25 bp, E. coli
tgcgctgcgcgtagaagaaaccgaa

SEQ ID NO: 41524 - DNA, 25 bp, E. coli
tgcgctgcgcgttgaagaaaccgaa

SEQ ID NO: 41525 - DNA, 25 bp, E. coli
tcatcgatagcgtaggcaaaacccg

SEQ ID NO: 41526 - DNA, 25 bp, E. coli
tcatcgatagcgaaggcaaaacccg

SEQ ID NO: 41527 - DNA, 25 bp, E. coli
gcatgactctggtacaagctctgga

SEQ ID NO: 41528 - DNA, 25 bp, E. coli
gcatgactctggaacaagctctgga

SEQ ID NO: 41529 - DNA, 25 bp, E. coli
gaactggtacacaacgttgcgctgc

SEQ ID NO: 41530 - DNA, 25 bp, E. coli
gaactggtacactacgttgcgctgc

SEQ ID NO: 41531 - DNA, 25 bp, E. coli
taagaaactgacgaacatgcgtgct

SEQ ID NO: 41532 - DNA, 25 bp, E. coli
taagctgttcctcggtcacggtgca

SEQ ID NO: 41533 - DNA, 25 bp, E. coli
taacgacctgacagtaaactgcctg

SEQ ID NO: 41534 - DNA, 25 bp, E. coli
taacgacctgactgtaaactgcctg

SEQ ID NO: 41535 - DNA, 25 bp, E. coli
taagaaactgaccaacatgcgtgct

SEQ ID NO: 41536 - DNA, 25 bp, E. coli
taagctgttcctgggtcacggtgca

SEQ ID NO: 41537 - DNA, 25 bp, E. coli
cataaactggctgatgacgggacgc

SEQ ID NO: 41538 - DNA, 25 bp, E. coli
cataaactggctcatgacgggacgc

SEQ ID NO: 41539 - DNA, 25 bp, E. coli
actcgggctggtcgaaaatctggac

SEQ ID NO: 41540 - DNA, 25 bp, E. coli
actcgggctggtggaaaatctggac

SEQ ID NO: 41541 - DNA, 25 bp, E. coli
tatgcacgccggttctggttaacca

SEQ ID NO: 41542 - DNA, 25 bp, E. coli
tatgcacgccggatctggttaacca

SEQ ID NO: 41543 - DNA, 25 bp, E. coli
tgaaccggattacctctgggcagcg

SEQ ID NO: 41544 - DNA, 25 bp, E. coli
tgaaccggattagctctgggcagcg

SEQ ID NO: 41545 - DNA, 25 bp, E. coli
tgcgtctcaggctacagaactctgg

SEQ ID NO: 41546 - DNA, 25 bp, E. coli
tgcgtctcaggcaacagaactctgg

SEQ ID NO: 41547 - DNA, 25 bp, E. coli
gaatgctccgttcatgatgtgcgcc

SEQ ID NO: 41548 - DNA, 25 bp, E. coli
gaatgctccgttgatgatgtgcgcc

SEQ ID NO: 41549 - DNA, 25 bp, E. coli
ccccggaaggaaaacaggtcgctat

SEQ ID NO: 41550 - DNA, 25 bp, E. coli
ccccggaaggaatacaggtcgctat

SEQ ID NO: 41551 - DNA, 25 bp, E. coli
cgtcaggtgaccttgtatcgccaga

SEQ ID NO: 41552 - DNA, 25 bp, E. coli
cgtgtacggcgatagtgatcccagc

SEQ ID NO: 41553 - DNA, 25 bp, E. coli
cgtcaggtgaccatgtatcgccaga

SEQ ID NO: 41554 - DNA, 25 bp, E. coli
cgtgtacggcgaaagtgatcccagc

SEQ ID NO: 41555 - DNA, 25 bp, E. coli
taataactccatggctgtcaccggc

SEQ ID NO: 41556 - DNA, 25 bp, E. coli
taataactccatcgctgtcaccggc

SEQ ID NO: 41557 - DNA, 25 bp, E. coli
gacgccggagatcatgaagcttcag

SEQ ID NO: 41558 - DNA, 25 bp, E. coli
gacgccggagatgatgaagcttcag

SEQ ID NO: 41559 - DNA, 25 bp, E. coli
aatcgctggacgtaatgggatcgcc

SEQ ID NO: 41560 - DNA, 25 bp, E. coli
aatcgctggacgaaatgggatcgcc

SEQ ID NO: 41561 - DNA, 25 bp, E. coli
tactgtttatggtggatgcgcgcgc

SEQ ID NO: 41562 - DNA, 25 bp, E. coli
taaacatggtacctgtggtcgcgct

SEQ ID NO: 41563 - DNA, 25 bp, E. coli
taaacatggtacgtgtggtcgcgct

SEQ ID NO: 41564 - DNA, 25 bp, E. coli
tacggtcgtgcgcaaattgaaggcc

SEQ ID NO: 41565 - DNA, 25 bp, E. coli
tactgtttatggaggatgcgcgcgc

SEQ ID NO: 41566 - DNA, 25 bp, E. coli
tacggtcgtgcggaaattgaaggcc

SEQ ID NO: 41567 - DNA, 25 bp, E. coli
tatgacagctcctcccgtcgtgtgg

SEQ ID NO: 41568 - DNA, 25 bp, E. coli
tatgtgctcattgacaccgctggcg

SEQ ID NO: 41569 - DNA, 25 bp, E. coli
taggtgaaatcttcccgatcgccgc

SEQ ID NO: 41570 - DNA, 25 bp, E. coli
taggtgaaatctacccgatcgccgc

SEQ ID NO: 41571 - DNA, 25 bp, E. coli
tatgacagctccacccgtcgtgtgg

SEQ ID NO: 41572 - DNA, 25 bp, E. coli
tatgtgctcattcacaccgctggcg

SEQ ID NO: 41573 - DNA, 25 bp, E. coli
tttattctcaatagtgggcgctcac

SEQ ID NO: 41574 - DNA, 25 bp, E. coli
tttattctcaattgtgggcgctcac

SEQ ID NO: 41575 - DNA, 25 bp, E. coli
tgataccggcggcattgatggcaca

SEQ ID NO: 41576 - DNA, 25 bp, E. coli
tgataccggcgggattgatggcaca

SEQ ID NO: 41577 - DNA, 25 bp, E. coli
tcctggtggcaatcaaaactgacgg

SEQ ID NO: 41578 - DNA, 25 bp, E. coli
tcctggtggcaaacaaaactgacgg

SEQ ID NO: 41579 - DNA, 25 bp, E. coli
tcaaactggcgattgtgggtcgtcc

SEQ ID NO: 41580 - DNA, 25 bp, E. coli
tcaaactggcgaatgtgggtcgtcc

SEQ ID NO: 41581 - DNA, 25 bp, E. coli
taccgtaaaagagggtattcgccat

SEQ ID NO: 41582 - DNA, 25 bp, E. coli
taccgtaaaagacggtattcgccat

SEQ ID NO: 41583 - DNA, 25 bp, E. coli
gcttgattccatgggtgaagccgtg

SEQ ID NO: 41584 - DNA, 25 bp, E. coli
gcttgattccatcggtgaagccgtg

SEQ ID NO: 41585 - DNA, 25 bp, E. coli
gcatcaatatggttatgaccgaagt

SEQ ID NO: 41586 - DNA, 25 bp, E. coli
gcatcaatatggatatgaccgaagt

SEQ ID NO: 41587 - DNA, 25 bp, E. coli
gaagtcgaacgtctcctcggcatca

SEQ ID NO: 41588 - DNA, 25 bp, E. coli
gacggcagcaatattggttcggttc

SEQ ID NO: 41589 - DNA, 25 bp, E. coli
gaatttcgcatttccgtaaaagacg

SEQ ID NO: 41590 - DNA, 25 bp, E. coli
gaagtcgaacgtgtcctcggcatca

SEQ ID NO: 41591 - DNA, 25 bp, E. coli
gacggcagcaattttggttcggttc

SEQ ID NO: 41592 - DNA, 25 bp, E. coli
gaatttcgcattaccgtaaaagacg

SEQ ID NO: 41593 - DNA, 25 bp, E. coli
gaccgaagtgaaacagcttaacgag

SEQ ID NO: 41594 - DNA, 25 bp, E. coli
cgtctcctcggcatcaatatggata

SEQ ID NO: 41595 - DNA, 25 bp, E. coli
cgtctcctcggcttcaatatggata

SEQ ID NO: 41596 - DNA, 25 bp, E. coli
tggatatgaccgtagtgaaacagct

SEQ ID NO: 41597 - DNA, 25 bp, E. coli
tggttcggttctggtgattcaggac

SEQ ID NO: 41598 - DNA, 25 bp, E. coli
tggttcggttctcgtgattcaggac

SEQ ID NO: 41599 - DNA, 25 bp, E. coli
tggatatgaccgaagtgaaacagct

SEQ ID NO: 41600 - DNA, 25 bp, E. coli
gatgtcggatagtgctcagccaggt

SEQ ID NO: 41601 - DNA, 25 bp, E. coli
gatgtcggatagagctcagccaggt

SEQ ID NO: 41602 - DNA, 25 bp, E. coli
gaccgaagtgaatcagcttaacgag

SEQ ID NO: 41603 - DNA, 25 bp, E. coli
tactgataacggtagccgggtggca

SEQ ID NO: 41604 - DNA, 25 bp, E. coli
tactgataacggaagccgggtggca

SEQ ID NO: 41605 - DNA, 25 bp, E. coli
tagcgtctgagtaatcgcatttggt

SEQ ID NO: 41606 - DNA, 25 bp, E. coli
tagcgtctgagttatcgcatttggt

SEQ ID NO: 41607 - DNA, 25 bp, E. coli
tattgtctctgctactgataacggt

SEQ ID NO: 41608 - DNA, 25 bp, E. coli
tattgtctctgcaactgataacggt

SEQ ID NO: 41609 - DNA, 25 bp, E. coli
ttgcttaccgtcacattcttgatgg

SEQ ID NO: 41610 - DNA, 25 bp, E. coli
ttgcttaccgtctcattcttgatgg

SEQ ID NO: 41611 - DNA, 25 bp, E. coli
tcgaaaactgcaaaagcacatgaca

SEQ ID NO: 41612 - DNA, 25 bp, E. coli
tcgaaaactgcataagcacatgaca

SEQ ID NO: 41613 - DNA, 25 bp, E. coli
tcttgatggtattgtcgaaaactgc

SEQ ID NO: 41614 - DNA, 25 bp, E. coli
tcttgatggtatagtcgaaaactgc

SEQ ID NO: 41615 - DNA, 25 bp, E. coli
ccgggtggcaaatctttagcgtctg

SEQ ID NO: 41616 - DNA, 25 bp, E. coli
gcatttggttatcagattactctcg

SEQ ID NO: 41617 - DNA, 25 bp, E. coli
gcatttggttatgagattactctcg

SEQ ID NO: 41618 - DNA, 25 bp, E. coli
gacataaacaacttaagcacaatcg

SEQ ID NO: 41619 - DNA, 25 bp, E. coli
gacataaacaacataagcacaatcg

SEQ ID NO: 41620 - DNA, 25 bp, E. coli
ccgggtggcaaaactttagcgtctg

SEQ ID NO: 41621 - DNA, 25 bp, E. coli
gttattaatttgctttcctgggtca

SEQ ID NO: 41622 - DNA, 25 bp, E. coli
gttattaatttggtttcctgggtca

SEQ ID NO: 41623 - DNA, 25 bp, E. coli
ggaactccttaacgttattgtctct

SEQ ID NO: 41624 - DNA, 25 bp, E. coli
ggaactccttaaggttattgtctct

SEQ ID NO: 41625 - DNA, 25 bp, E. coli
aaccctggctaatgttattcttgcg

SEQ ID NO: 41626 - DNA, 25 bp, E. coli
taccgttttttaatccgagctatag

SEQ ID NO: 41627 - DNA, 25 bp, E. coli
aaccctggctaaagttattcttgcg

SEQ ID NO: 41628 - DNA, 25 bp, E. coli
taccgttttttattccgagctatag

SEQ ID NO: 41629 - DNA, 25 bp, E. coli
tcgagcacgcagacgctggtgcagt

SEQ ID NO: 41630 - DNA, 25 bp, E. coli
tcgagcacgcagtcgctggtgcagt

SEQ ID NO: 41631 - DNA, 25 bp, E. coli
gctttatcacattgagcaaatatgc

SEQ ID NO: 41632 - DNA, 25 bp, E. coli
gctttatcacatagagcaaatatgc

SEQ ID NO: 41633 - DNA, 25 bp, E. coli
cgatttggctttatcacatagagca

SEQ ID NO: 41634 - DNA, 25 bp, E. coli
cgatttggctttttcacatagagca

SEQ ID NO: 41635 - DNA, 25 bp, E. coli
cttgcgatgcttatatatagcgagc

SEQ ID NO: 41636 - DNA, 25 bp, E. coli
cttgcgatgcttttatatagcgagc

SEQ ID NO: 41637 - DNA, 25 bp, E. coli
gattatttcacttctcttgtgtcga

SEQ ID NO: 41638 - DNA, 25 bp, E. coli
gattatttcactactcttgtgtcga

SEQ ID NO: 41639 - DNA, 25 bp, E. coli
tggctgcgcgctgcaaaattatctg

SEQ ID NO: 41640 - DNA, 25 bp, E. coli
tggctgcgcgctccaaaattatctg

SEQ ID NO: 41641 - DNA, 25 bp, E. coli
taactcctttcgagcacgcagtcgc

SEQ ID NO: 41642 - DNA, 25 bp, E. coli
tcacttctcttgtgtcgatttggct

SEQ ID NO: 41643 - DNA, 25 bp, E. coli
tcacttctcttgagtcgatttggct

SEQ ID NO: 41644 - DNA, 25 bp, E. coli
taactcctttcgtgcacgcagtcgc

SEQ ID NO: 41645 - DNA, 25 bp, E. coli
gagctatagtctgaaaccctggcta

SEQ ID NO: 41646 - DNA, 25 bp, E. coli
gagctatagtctcaaaccctggcta

SEQ ID NO: 41647 - DNA, 25 bp, E. coli
aacgcaggcagatcaagctgcccgg

SEQ ID NO: 41648 - DNA, 25 bp, E. coli
aacgcaggcagaacaagctgcccgg

SEQ ID NO: 41649 - DNA, 25 bp, E. coli
tagcgtactataaagatggtgttcc

SEQ ID NO: 41650 - DNA, 25 bp, E. coli
tagcgtactatatagatggtgttcc

SEQ ID NO: 41651 - DNA, 25 bp, E. coli
tcttttgaatgataatccagacggg

SEQ ID NO: 41652 - DNA, 25 bp, E. coli
tcttttgaatgaaaatccagacggg

SEQ ID NO: 41653 - DNA, 25 bp, E. coli
gctaaatggtctactgctcaattga

SEQ ID NO: 41654 - DNA, 25 bp, E. coli
gctaaatggtcttctgctcaattga

SEQ ID NO: 41655 - DNA, 25 bp, E. coli
gctcaattgaagaaaacgcaggcag

SEQ ID NO: 41656 - DNA, 25 bp, E. coli
gctcaattgaagtaaacgcaggcag

SEQ ID NO: 41657 - DNA, 25 bp, E. coli
gaaagttctgcacccattcatgcca

SEQ ID NO: 41658 - DNA, 25 bp, E. coli
gaaagttctgcagccattcatgcca

SEQ ID NO: 41659 - DNA, 25 bp, E. coli
ccggccgtgcttgctggaactacat

SEQ ID NO: 41660 - DNA, 25 bp, E. coli
ccggccgtgcttcctggaactacat

SEQ ID NO: 41661 - DNA, 25 bp, E. coli
cattcatgccactgctaaatggtct

SEQ ID NO: 41662 - DNA, 25 bp, E. coli
cattcatgccacagctaaatggtct

SEQ ID NO: 41663 - DNA, 25 bp, E. coli
tggaggtagcaagagtgaaagttct

SEQ ID NO: 41664 - DNA, 25 bp, E. coli
tggaaacagctgtagcgtactataa

SEQ ID NO: 41665 - DNA, 25 bp, E. coli
tggaaacagctgaagcgtactataa

SEQ ID NO: 41666 - DNA, 25 bp, E. coli
tggaggtagcaacagtgaaagttct

SEQ ID NO: 41667 - DNA, 25 bp, E. coli
taatccagacggcagtggctctggc

SEQ ID NO: 41668 - DNA, 25 bp, E. coli
taatccagacgggagtggctctggc

SEQ ID NO: 41669 - DNA, 25 bp, E. coli
cgaccgttcgtcctcttaacctgag

SEQ ID NO: 41670 - DNA, 25 bp, E. coli
cgaccgttcgtcgtcttaacctgag

SEQ ID NO: 41671 - DNA, 25 bp, E. coli
catgcgaccgttggtcgtcttaacc

SEQ ID NO: 41672 - DNA, 25 bp, E. coli
catgcgaccgttcgtcgtcttaacc

SEQ ID NO: 41673 - DNA, 25 bp, E. coli
accgttcgtcgtgttaacctgagcg

SEQ ID NO: 41674 - DNA, 25 bp, E. coli
accgttcgtcgtcttaacctgagcg

SEQ ID NO: 41675 - DNA, 25 bp, E. coli
ttcgtcgtcttaacctgagcgtgga

SEQ ID NO: 41676 - DNA, 25 bp, E. coli
ttcgtcgtcttatcctgagcgtgga

SEQ ID NO: 41677 - DNA, 25 bp, E. coli
tgcgaccgttcgtcgtcttaacctg

SEQ ID NO: 41678 - DNA, 25 bp, E. coli
tcgtcttaacctgagcgtggatggc

SEQ ID NO: 41679 - DNA, 25 bp, E. coli
tgcgaccgttcgacgtcttaacctg

SEQ ID NO: 41680 - DNA, 25 bp, E. coli
tcgtcttaacctcagcgtggatggc

SEQ ID NO: 41681 - DNA, 25 bp, E. coli
tctgctcatgcgtccgttcgtcgtc

SEQ ID NO: 41682 - DNA, 25 bp, E. coli
tctgctcatgcgaccgttcgtcgtc

SEQ ID NO: 41683 - DNA, 25 bp, E. coli
gctttctgctcaagcgaccgttcgt

SEQ ID NO: 41684 - DNA, 25 bp, E. coli
gctcatgcgaccgttcgtcgtctta

SEQ ID NO: 41685 - DNA, 25 bp, E. coli
gctttctgctcatgcgaccgttcgt

SEQ ID NO: 41686 - DNA, 25 bp, E. coli
gctcatgcgacccttcgtcgtctta

SEQ ID NO: 41687 - DNA, 25 bp, E. coli
cgttcgtcgtcttaacctgagcgtg

SEQ ID NO: 41688 - DNA, 25 bp, E. coli
cgttcgtcgtctaaacctgagcgtg

SEQ ID NO: 41689 - DNA, 25 bp, E. coli
cgtcgtcttaacctgagcgtggatg

SEQ ID NO: 41690 - DNA, 25 bp, E. coli
cgtcgtcttaacgtgagcgtggatg

SEQ ID NO: 41691 - DNA, 25 bp, E. coli
gaactggccggtcttgctcaagtcg

SEQ ID NO: 41692 - DNA, 25 bp, E. coli
gaactggccggtgttgctcaagtcg

SEQ ID NO: 41693 - DNA, 25 bp, E. coli
tacttgcgacatgatgaactggccg

SEQ ID NO: 41694 - DNA, 25 bp, E. coli
tacttgcgacatcatgaactggccg

SEQ ID NO: 41695 - DNA, 25 bp, E. coli
tatgctgccgcacgaaagtatgccg

SEQ ID NO: 41696 - DNA, 25 bp, E. coli
tatgctgccgcaggaaagtatgccg

SEQ ID NO: 41697 - DNA, 25 bp, E. coli
tattttttgcacgtatcggcgaagc

SEQ ID NO: 41698 - DNA, 25 bp, E. coli
tattttgccgattaactaccgcgca

SEQ ID NO: 41699 - DNA, 25 bp, E. coli
tattttgccgataaactaccgcgca

SEQ ID NO: 41700 - DNA, 25 bp, E. coli
tattttttgcacctatcggcgaagc

SEQ ID NO: 41701 - DNA, 25 bp, E. coli
tgggcaatagcgaacaacaaggtcg

SEQ ID NO: 41702 - DNA, 25 bp, E. coli
tgggcaatagcgtacaacaaggtcg

SEQ ID NO: 41703 - DNA, 25 bp, E. coli
tgaatgacaaagtagaggcaccgtc

SEQ ID NO: 41704 - DNA, 25 bp, E. coli
tgaatgacaaagaagaggcaccgtc

SEQ ID NO: 41705 - DNA, 25 bp, E. coli
gctcgtactgttcattatgctgccg

SEQ ID NO: 41706 - DNA, 25 bp, E. coli
gctcgtactgttgattatgctgccg

SEQ ID NO: 41707 - DNA, 25 bp, E. coli
gcttcttcgaaagagggcgtggcat

SEQ ID NO: 41708 - DNA, 25 bp, E. coli
gcttcttcgaaacagggcgtggcat

SEQ ID NO: 41709 - DNA, 25 bp, E. coli
tggcattgtcgaaaccgtggtggca

SEQ ID NO: 41710 - DNA, 25 bp, E. coli
tggcattgtcgataccgtggtggca

SEQ ID NO: 41711 - DNA, 25 bp, E. coli
tcactcattgcgacaggattactgg

SEQ ID NO: 41712 - DNA, 25 bp, E. coli
tcactcattgcgtcaggattactgg

SEQ ID NO: 41713 - DNA, 25 bp, E. coli
cacctttgaggatcgcaatggcgac

SEQ ID NO: 41714 - DNA, 25 bp, E. coli
caaaaaatccggtagtgcaggcgct

SEQ ID NO: 41715 - DNA, 25 bp, E. coli
cacctttgaggaacgcaatggcgac

SEQ ID NO: 41716 - DNA, 25 bp, E. coli
caaaaaatccggaagtgcaggcgct

SEQ ID NO: 41717 - DNA, 25 bp, E. coli
caaacgtgcgattggtgaagtcacc

SEQ ID NO: 41718 - DNA, 25 bp, E. coli
caaacgtgcgataggtgaagtcacc

SEQ ID NO: 41719 - DNA, 25 bp, E. coli
catctggcagcgcattgaaggcaca

SEQ ID NO: 41720 - DNA, 25 bp, E. coli
catctggcagcggattgaaggcaca

SEQ ID NO: 41721 - DNA, 25 bp, E. coli
aacagcgtctgtggtatatcgggcc

SEQ ID NO: 41722 - DNA, 25 bp, E. coli
aacagcgtctgtcgtatatcgggcc

SEQ ID NO: 41723 - DNA, 25 bp, E. coli
tgagtctgaagtcgctaacggcaca

SEQ ID NO: 41724 - DNA, 25 bp, E. coli
tgagtctgaagtggctaacggcaca

SEQ ID NO: 41725 - DNA, 25 bp, E. coli
tgaaaaacgtgctcggcagctacgg

SEQ ID NO: 41726 - DNA, 25 bp, E. coli
tgaacgattaccagcctggcgaaac

SEQ ID NO: 41727 - DNA, 25 bp, E. coli
tgaacgattacctgcctggcgaaac

SEQ ID NO: 41728 - DNA, 25 bp, E. coli
tgaaaaacgtgcacggcagctacgg

SEQ ID NO: 41729 - DNA, 25 bp, E. coli
ggttacagtgaaatccgcttgccga

SEQ ID NO: 41730 - DNA, 25 bp, E. coli
ggtggcattccttgagcagcataaa

SEQ ID NO: 41731 - DNA, 25 bp, E. coli
ggttacagtgaattccgcttgccga

SEQ ID NO: 41732 - DNA, 25 bp, E. coli
ggtggcattcctagagcagcataaa

SEQ ID NO: 41733 - DNA, 25 bp, E. coli
tggacgaagactgcaaacgccgcat

SEQ ID NO: 41734 - DNA, 25 bp, E. coli
tggacgaagactccaaacgccgcat

SEQ ID NO: 41735 - DNA, 25 bp, E. coli
cagcgctctaggaaggaactttgtc

SEQ ID NO: 41736 - DNA, 25 bp, E. coli
cagcgctctaggtaggaactttgtc

SEQ ID NO: 41737 - DNA, 25 bp, E. coli
catcaacactgtatcgagtaatgaa

SEQ ID NO: 41738 - DNA, 25 bp, E. coli
catcaacactgtttcgagtaatgaa

SEQ ID NO: 41739 - DNA, 25 bp, E. coli
taaaggctttatacatggatttgct

SEQ ID NO: 41740 - DNA, 25 bp, E. coli
taaaggctttattcatggatttgct

SEQ ID NO: 41741 - DNA, 25 bp, E. coli
agcggcaccgaggaagactttccag

SEQ ID NO: 41742 - DNA, 25 bp, E. coli
agcggcaccgagcaagactttccag

SEQ ID NO: 41743 - DNA, 25 bp, E. coli
taggaactttgtcgttgatagagtc

SEQ ID NO: 41744 - DNA, 25 bp, E. coli
taggaactttgtggttgatagagtc

SEQ ID NO: 41745 - DNA, 25 bp, E. coli
gaaattggttgcaagaaagtcgatg

SEQ ID NO: 41746 - DNA, 25 bp, E. coli
gactttccaggtgaacagcgctcta

SEQ ID NO: 41747 - DNA, 25 bp, E. coli
gaaattggttgctagaaagtcgatg

SEQ ID NO: 41748 - DNA, 25 bp, E. coli
gaaagtcgatgatttgttgcgtatg

SEQ ID NO: 41749 - DNA, 25 bp, E. coli
gaaagtcgatgaattgttgcgtatg

SEQ ID NO: 41750 - DNA, 25 bp, E. coli
gactttccaggtcaacagcgctcta

SEQ ID NO: 41751 - DNA, 25 bp, E. coli
cgcggcgccgtcattggcaaacaac

SEQ ID NO: 41752 - DNA, 25 bp, E. coli
cgcggcgccgtctttggcaaacaac

SEQ ID NO: 41753 - DNA, 25 bp, E. coli
gatagagtcttctgccatcaacact

SEQ ID NO: 41754 - DNA, 25 bp, E. coli
gatagagtcttcagccatcaacact

SEQ ID NO: 41755 - DNA, 25 bp, E. coli
ggcaaacaacgcttcaacagcggca

SEQ ID NO: 41756 - DNA, 25 bp, E. coli
ggcaaacaacgcatcaacagcggca

SEQ ID NO: 41757 - DNA, 25 bp, E. coli
cacttgcatcaacacttttagagag

SEQ ID NO: 41758 - DNA, 25 bp, E. coli
cacttgcatcaagacttttagagag

SEQ ID NO: 41759 - DNA, 25 bp, E. coli
cagtggttgtcagttttatcgagaa

SEQ ID NO: 41760 - DNA, 25 bp, E. coli
cagtggttgtcacttttatcgagaa

SEQ ID NO: 41761 - DNA, 25 bp, E. coli
tacaaacccggcttcgctaactatc

SEQ ID NO: 41762 - DNA, 25 bp, E. coli
tacaaacccggcatcgctaactatc

SEQ ID NO: 41763 - DNA, 25 bp, E. coli
tataaggcaacaaccattggcaatg

SEQ ID NO: 41764 - DNA, 25 bp, E. coli
tataaggcaacatccattggcaatg

SEQ ID NO: 41765 - DNA, 25 bp, E. coli
tatcgagaaaggattgcagaacgcg

SEQ ID NO: 41766 - DNA, 25 bp, E. coli
tatcgagaaaggtttgcagaacgcg

SEQ ID NO: 41767 - DNA, 25 bp, E. coli
tgaaaaggcacgttacaaacccggc

SEQ ID NO: 41768 - DNA, 25 bp, E. coli
tgaaaaggcacgatacaaacccggc

SEQ ID NO: 41769 - DNA, 25 bp, E. coli
ccgctggaaatatatgaaaaggcac

SEQ ID NO: 41770 - DNA, 25 bp, E. coli
ccgctggaaataaatgaaaaggcac

SEQ ID NO: 41771 - DNA, 25 bp, E. coli
cattggcaatgctgcaacgatttaa

SEQ ID NO: 41772 - DNA, 25 bp, E. coli
cattggcaatgcagcaacgatttaa

SEQ ID NO: 41773 - DNA, 25 bp, E. coli
gattatttatcagctataccgctgg

SEQ ID NO: 41774 - DNA, 25 bp, E. coli
gattatttatcacctataccgctgg

SEQ ID NO: 41775 - DNA, 25 bp, E. coli
taaggttcctgatgtactaagggat

SEQ ID NO: 41776 - DNA, 25 bp, E. coli
tcaacgttgttagcctatataaggc

SEQ ID NO: 41777 - DNA, 25 bp, E. coli
taaggttcctgaagtactaagggat

SEQ ID NO: 41778 - DNA, 25 bp, E. coli
tcaacgttgttaccctatataaggc

SEQ ID NO: 41779 - DNA, 25 bp, E. coli
caggcccagcttttcgtctgaatga

SEQ ID NO: 41780 - DNA, 25 bp, E. coli
caggcccagcttatcgtctgaatga

SEQ ID NO: 41781 - DNA, 25 bp, E. coli
taaaggagtgaaactgcaatatcga

SEQ ID NO: 41782 - DNA, 25 bp, E. coli
taaaggagtgaatctgcaatatcga

SEQ ID NO: 41783 - DNA, 25 bp, E. coli
tatcgatatgagtgggattctccgg

SEQ ID NO: 41784 - DNA, 25 bp, E. coli
tatcgatatgagagggattctccgg

SEQ ID NO: 41785 - DNA, 25 bp, E. coli
tatatgaaaggtgattgggcggaca

SEQ ID NO: 41786 - DNA, 25 bp, E. coli
tattattcatttgtcgcaggcccag

SEQ ID NO: 41787 - DNA, 25 bp, E. coli
tatatgaaaggtcattgggcggaca

SEQ ID NO: 41788 - DNA, 25 bp, E. coli
tattattcatttctcgcaggcccag

SEQ ID NO: 41789 - DNA, 25 bp, E. coli
ttatgctcagagaaaggtacaggac

SEQ ID NO: 41790 - DNA, 25 bp, E. coli
ttatgctcagagtaaggtacaggac

SEQ ID NO: 41791 - DNA, 25 bp, E. coli
cgcgatgaagctgacgatttttaca

SEQ ID NO: 41792 - DNA, 25 bp, E. coli
cgatttttacagtcatcaggctgat

SEQ ID NO: 41793 - DNA, 25 bp, E. coli
cgcgatgaagctcacgatttttaca

SEQ ID NO: 41794 - DNA, 25 bp, E. coli
cgatttttacagacatcaggctgat

SEQ ID NO: 41795 - DNA, 25 bp, E. coli
ctgataatcataggctatcggctgg

SEQ ID NO: 41796 - DNA, 25 bp, E. coli
ctgataatcatacgctatcggctgg

SEQ ID NO: 41797 - DNA, 25 bp, E. coli
gattctccggtcagtgtcgtcggga

SEQ ID NO: 41798 - DNA, 25 bp, E. coli
gatatctcatacaaaagcgaaggga

SEQ ID NO: 41799 - DNA, 25 bp, E. coli
gattctccggtctgtgtcgtcggga

SEQ ID NO: 41800 - DNA, 25 bp, E. coli
gatatctcatactaaagcgaaggga

SEQ ID NO: 41801 - DNA, 25 bp, E. coli
aattgctgaccgcacgctgcgtgct

SEQ ID NO: 41802 - DNA, 25 bp, E. coli
aattgctgaccggacgctgcgtgct

SEQ ID NO: 41803 - DNA, 25 bp, E. coli
cagaaggaccgtatggtgaccacac

SEQ ID NO: 41804 - DNA, 25 bp, E. coli
catttctgaaagaaccagagccgcc

SEQ ID NO: 41805 - DNA, 25 bp, E. coli
cagaaggaccgtttggtgaccacac

SEQ ID NO: 41806 - DNA, 25 bp, E. coli
tacacgtggccctcataaagagcga

SEQ ID NO: 41807 - DNA, 25 bp, E. coli
tactttgtcggattacgcctttgcc

SEQ ID NO: 41808 - DNA, 25 bp, E. coli
tacacgtggcccacataaagagcga

SEQ ID NO: 41809 - DNA, 25 bp, E. coli
tactttgtcggaatacgcctttgcc

SEQ ID NO: 41810 - DNA, 25 bp, E. coli
tatgggccaggaagatgtttcagca

SEQ ID NO: 41811 - DNA, 25 bp, E. coli
tatgggccaggatgatgtttcagca

SEQ ID NO: 41812 - DNA, 25 bp, E. coli
tctctgtggcgttgggcgctgatcc

SEQ ID NO: 41813 - DNA, 25 bp, E. coli
tctctgtggcgtagggcgctgatcc

SEQ ID NO: 41814 - DNA, 25 bp, E. coli
cgcatccaggtgaacgtttcccgat

SEQ ID NO: 41815 - DNA, 25 bp, E. coli
catttctgaaagtaccagagccgcc

SEQ ID NO: 41816 - DNA, 25 bp, E. coli
cgcatccaggtgtacgtttcccgat

SEQ ID NO: 41817 - DNA, 25 bp, E. coli
gatccggcaacctttctcggtgcag

SEQ ID NO: 41818 - DNA, 25 bp, E. coli
ggtgcagtcacaccagtaccagata

SEQ ID NO: 41819 - DNA, 25 bp, E. coli
ggtgcagtcacagcagtaccagata

SEQ ID NO: 41820 - DNA, 25 bp, E. coli
taagcaggtgtttaacatgccgaca

SEQ ID NO: 41821 - DNA, 25 bp, E. coli
taagcaggtgttaaacatgccgaca

SEQ ID NO: 41822 - DNA, 25 bp, E. coli
gatccggcaaccattctcggtgcag

SEQ ID NO: 41823 - DNA, 25 bp, E. coli
aggccagtcgccgtcttgaaggcgt

SEQ ID NO: 41824 - DNA, 25 bp, E. coli
aggccagtcgccctcttgaaggcgt

SEQ ID NO: 41825 - DNA, 25 bp, E. coli
aaaagtcccgtcactgggagcttca

SEQ ID NO: 41826 - DNA, 25 bp, E. coli
aaaagtcccgtctctgggagcttca

SEQ ID NO: 41827 - DNA, 25 bp, E. coli
ttactgccgcagaggctttagcgcg

SEQ ID NO: 41828 - DNA, 25 bp, E. coli
ttagtcactctttctgccgcagagg

SEQ ID NO: 41829 - DNA, 25 bp, E. coli
ttagtcactcttactgccgcagagg

SEQ ID NO: 41830 - DNA, 25 bp, E. coli
ttactgccgcagtggctttagcgcg

SEQ ID NO: 41831 - DNA, 25 bp, E. coli
gcgtcgagatgcctttagtcactct

SEQ ID NO: 41832 - DNA, 25 bp, E. coli
gcgtcgagatgcgtttagtcactct

SEQ ID NO: 41833 - DNA, 25 bp, E. coli
gaaactcaccgataagcaaaagtcc

SEQ ID NO: 41834 - DNA, 25 bp, E. coli
gaaactcaccgaaaagcaaaagtcc

SEQ ID NO: 41835 - DNA, 25 bp, E. coli
cccgtctctgggtgcttcagcgtaa

SEQ ID NO: 41836 - DNA, 25 bp, E. coli
cccgtctctgggagcttcagcgtaa

SEQ ID NO: 41837 - DNA, 25 bp, E. coli
cgtcttgaaggcgtcgagatgcctt

SEQ ID NO: 41838 - DNA, 25 bp, E. coli
cgtcttgaaggcctcgagatgcctt

SEQ ID NO: 41839 - DNA, 25 bp, E. coli
ctctgggagcttcagcgtaatcgta

SEQ ID NO: 41840 - DNA, 25 bp, E. coli
ctctgggagcttgagcgtaatcgta

SEQ ID NO: 41841 - DNA, 25 bp, E. coli
tcaccgataagctaaagtcccgtct

SEQ ID NO: 41842 - DNA, 25 bp, E. coli
tcaccgataagcaaaagtcccgtct

SEQ ID NO: 41843 - DNA, 25 bp, E. coli
gataagcaaaagacccgtctctggg

SEQ ID NO: 41844 - DNA, 25 bp, E. coli
gataagcaaaagtcccgtctctggg

SEQ ID NO: 41845 - DNA, 25 bp, E. coli
agcggctggcgcattactattgtga

SEQ ID NO: 41846 - DNA, 25 bp, E. coli
agcggctggcgctttactattgtga

SEQ ID NO: 41847 - DNA, 25 bp, E. coli
tatcgaaaaagaggcctggaatcag

SEQ ID NO: 41848 - DNA, 25 bp, E. coli
tatcgaaaaagagggcaatgccctg

SEQ ID NO: 41849 - DNA, 25 bp, E. coli
tatcgaaaaagacgcctggaatcag

SEQ ID NO: 41850 - DNA, 25 bp, E. coli
tatcgaaaaagacggcaatgccctg

SEQ ID NO: 41851 - DNA, 25 bp, E. coli
tatcaactgagcaggcagggtatcg

SEQ ID NO: 41852 - DNA, 25 bp, E. coli
tatcaactgagctggcagggtatcg

SEQ ID NO: 41853 - DNA, 25 bp, E. coli
ttagcaaagtggtaagcgaagccgg

SEQ ID NO: 41854 - DNA, 25 bp, E. coli
ttagcaaagtggaaagcgaagccgg

SEQ ID NO: 41855 - DNA, 25 bp, E. coli
tgtgaaatcaacctgctgcatccct

SEQ ID NO: 41856 - DNA, 25 bp, E. coli
tgtgaaatcaacgtgctgcatccct

SEQ ID NO: 41857 - DNA, 25 bp, E. coli
ccttgatatcatccgtaaccggctg

SEQ ID NO: 41858 - DNA, 25 bp, E. coli
gcgaagggcgcgttccgtatcttta

SEQ ID NO: 41859 - DNA, 25 bp, E. coli
gcgaagggcgcgatccgtatcttta

SEQ ID NO: 41860 - DNA, 25 bp, E. coli
ccttgatatcatgcgtaaccggctg

SEQ ID NO: 41861 - DNA, 25 bp, E. coli
ggaacaggccgcatacgaaatgacg

SEQ ID NO: 41862 - DNA, 25 bp, E. coli
ggaacaggccgcttacgaaatgacg

SEQ ID NO: 41863 - DNA, 25 bp, E. coli
ggcacagcggatgttcttcgagcaa

SEQ ID NO: 41864 - DNA, 25 bp, E. coli
ggcacagcggatcttcttcgagcaa

SEQ ID NO: 41865 - DNA, 25 bp, E. coli
gagcaactggcgtttcatgccggat

SEQ ID NO: 41866 - DNA, 25 bp, E. coli
gagcaactggcgattcatgccggat

SEQ ID NO: 41867 - DNA, 25 bp, E. coli
aaccgaatttaaccacattgatgag

SEQ ID NO: 41868 - DNA, 25 bp, E. coli
aaccgaatttaagcacattgatgag

SEQ ID NO: 41869 - DNA, 25 bp, E. coli
cacattgatgagatcatccgccgca

SEQ ID NO: 41870 - DNA, 25 bp, E. coli
cacattgatgagttcatccgccgca

SEQ ID NO: 41871 - DNA, 25 bp, E. coli
accacattgatgtgatcatccgccg

SEQ ID NO: 41872 - DNA, 25 bp, E. coli
accacattgatgagatcatccgccg

SEQ ID NO: 41873 - DNA, 25 bp, E. coli
tttaaccacattgatgagatcatcc

SEQ ID NO: 41874 - DNA, 25 bp, E. coli
tttaaccacattcatgagatcatcc

SEQ ID NO: 41875 - DNA, 25 bp, E. coli
ttgatgagatcatccgccgcattgc

SEQ ID NO: 41876 - DNA, 25 bp, E. coli
ttgatgagatcaaccgccgcattgc

SEQ ID NO: 41877 - DNA, 25 bp, E. coli
tgagatcatccgccgcattgcgctg

SEQ ID NO: 41878 - DNA, 25 bp, E. coli
tgatgagatcatccgccgcattgcg

SEQ ID NO: 41879 - DNA, 25 bp, E. coli
tgagatcatccggcgcattgcgctg

SEQ ID NO: 41880 - DNA, 25 bp, E. coli
tgatgagatcatgcgccgcattgcg

SEQ ID NO: 41881 - DNA, 25 bp, E. coli
gaatttaaccactttgatgagatca

SEQ ID NO: 41882 - DNA, 25 bp, E. coli
gaatttaaccacattgatgagatca

SEQ ID NO: 41883 - DNA, 25 bp, E. coli
ccgaatttaaccacattgatgagat

SEQ ID NO: 41884 - DNA, 25 bp, E. coli
ccgaatttaacctcattgatgagat

SEQ ID NO: 41885 - DNA, 25 bp, E. coli
cattgatgagatcatccgccgcatt

SEQ ID NO: 41886 - DNA, 25 bp, E. coli
cattgatgagatgatccgccgcatt

SEQ ID NO: 41887 - DNA, 25 bp, E. coli
taaccacattgatgagatcatccgc

SEQ ID NO: 41888 - DNA, 25 bp, E. coli
taaccacattgaagagatcatccgc

SEQ ID NO: 41889 - DNA, 25 bp, E. coli
caatttaattcgaaatctgctgaaa

SEQ ID NO: 41890 - DNA, 25 bp, E. coli
caatttaattcgtaatctgctgaaa

SEQ ID NO: 41891 - DNA, 25 bp, E. coli
taccgttttggtggcaatggcgaac

SEQ ID NO: 41892 - DNA, 25 bp, E. coli
taccgttttggtcgcaatggcgaac

SEQ ID NO: 41893 - DNA, 25 bp, E. coli
ttagcgtgcggcgtctggaagccat

SEQ ID NO: 41894 - DNA, 25 bp, E. coli
ttagcgtgcggcctctggaagccat

SEQ ID NO: 41895 - DNA, 25 bp, E. coli
tcgcctccgcgatgtttgaataccg

SEQ ID NO: 41896 - DNA, 25 bp, E. coli
tcgcctccgcgaagtttgaataccg

SEQ ID NO: 41897 - DNA, 25 bp, E. coli
tctgctgaaagtggatacgcatttg

SEQ ID NO: 41898 - DNA, 25 bp, E. coli
tctgctgaaagtcgatacgcatttg

SEQ ID NO: 41899 - DNA, 25 bp, E. coli
ccggtcataatctcggaaacttgat

SEQ ID NO: 41900 - DNA, 25 bp, E. coli
ccggtcataatcacggaaacttgat

SEQ ID NO: 41901 - DNA, 25 bp, E. coli
gaaacttgatgtaaaaggcgctgga

SEQ ID NO: 41902 - DNA, 25 bp, E. coli
gaaacttgatgttaaaggcgctgga

SEQ ID NO: 41903 - DNA, 25 bp, E. coli
cgcatttgattcgaatgtcagagca

SEQ ID NO: 41904 - DNA, 25 bp, E. coli
cgcatttgattccaatgtcagagca

SEQ ID NO: 41905 - DNA, 25 bp, E. coli
gcgaactttccgctcataatctcgg

SEQ ID NO: 41906 - DNA, 25 bp, E. coli
gcgaactttccggtcataatctcgg

SEQ ID NO: 41907 - DNA, 25 bp, E. coli
ctgataacggaaccgagcgtcgcct

SEQ ID NO: 41908 - DNA, 25 bp, E. coli
ctgataacggaagcgagcgtcgcct

SEQ ID NO: 41909 - DNA, 25 bp, E. coli
cggcctctggaagccatcaatttaa

SEQ ID NO: 41910 - DNA, 25 bp, E. coli
cggcctctggaacccatcaatttaa

SEQ ID NO: 41911 - DNA, 25 bp, E. coli
taaaggcaatgctactgcgctggtg

SEQ ID NO: 41912 - DNA, 25 bp, E. coli
taaaggcaatgcaactgcgctggtg

SEQ ID NO: 41913 - DNA, 25 bp, E. coli
tattaccgggaaagtttgttcgcgc

SEQ ID NO: 41914 - DNA, 25 bp, E. coli
tattaccgggaatgtttgttcgcgc

SEQ ID NO: 41915 - DNA, 25 bp, E. coli
ttggcatttcgtcggtaacccctgg

SEQ ID NO: 41916 - DNA, 25 bp, E. coli
tgatggaagacggtattctcgcgcc

SEQ ID NO: 41917 - DNA, 25 bp, E. coli
ttggcatttcgtgggtaacccctgg

SEQ ID NO: 41918 - DNA, 25 bp, E. coli
tgatggaagacgctattctcgcgcc

SEQ ID NO: 41919 - DNA, 25 bp, E. coli
tctaccagattgatgcggccagtta

SEQ ID NO: 41920 - DNA, 25 bp, E. coli
tctaccagattgttgcggccagtta

SEQ ID NO: 41921 - DNA, 25 bp, E. coli
tcatccccgtcacaaacagaagtcg

SEQ ID NO: 41922 - DNA, 25 bp, E. coli
tcatccccgtcagaaacagaagtcg

SEQ ID NO: 41923 - DNA, 25 bp, E. coli
gcattaatcttgactggaccacggt

SEQ ID NO: 41924 - DNA, 25 bp, E. coli
gcattacaacaaccacaggcactgg

SEQ ID NO: 41925 - DNA, 25 bp, E. coli
gcattaatcttgtctggaccacggt

SEQ ID NO: 41926 - DNA, 25 bp, E. coli
gcgaaaaagggcgtctggaactcac

SEQ ID NO: 41927 - DNA, 25 bp, E. coli
gcgaaaaagggcctctggaactcac

SEQ ID NO: 41928 - DNA, 25 bp, E. coli
gcattacaacaagcacaggcactgg

SEQ ID NO: 41929 - DNA, 25 bp, E. coli
gaagatggcacaacctacagcgaaa

SEQ ID NO: 41930 - DNA, 25 bp, E. coli
gaagatggcacatcctacagcgaaa

SEQ ID NO: 41931 - DNA, 25 bp, E. coli
ggtaaaagccgattgccagaaagcg

SEQ ID NO: 41932 - DNA, 25 bp, E. coli
ggtaaaagccgaatgccagaaagcg

SEQ ID NO: 41933 - DNA, 25 bp, E. coli
cactgcattatctttgccgctgtag

SEQ ID NO: 41934 - DNA, 25 bp, E. coli
cactgcattatcattgccgctgtag

SEQ ID NO: 41935 - DNA, 25 bp, E. coli
agaaagctattcactgtcttcgtgt

SEQ ID NO: 41936 - DNA, 25 bp, E. coli
tacagtccatttatcgccattcccg

SEQ ID NO: 41937 - DNA, 25 bp, E. coli
tacagtccatttttcgccattcccg

SEQ ID NO: 41938 - DNA, 25 bp, E. coli
agaaagctattctctgtcttcgtgt

SEQ ID NO: 41939 - DNA, 25 bp, E. coli
tatcattgccgctgtagcaacgaga

SEQ ID NO: 41940 - DNA, 25 bp, E. coli
tatcattgccgcagtagcaacgaga

SEQ ID NO: 41941 - DNA, 25 bp, E. coli
tgtagcaacgagtagcatcactccg

SEQ ID NO: 41942 - DNA, 25 bp, E. coli
tgtagcaacgagaagcatcactccg

SEQ ID NO: 41943 - DNA, 25 bp, E. coli
tgctccccttttttcactgcattat

SEQ ID NO: 41944 - DNA, 25 bp, E. coli
tgctccccttttatcactgcattat

SEQ ID NO: 41945 - DNA, 25 bp, E. coli
tcccgtatacagaaagctattcact

SEQ ID NO: 41946 - DNA, 25 bp, E. coli
tcgccattcccgaatacagaaagct

SEQ ID NO: 41947 - DNA, 25 bp, E. coli
tcgccattcccgtatacagaaagct

SEQ ID NO: 41948 - DNA, 25 bp, E. coli
tcccgtatacagtaagctattcact

SEQ ID NO: 41949 - DNA, 25 bp, E. coli
gcatcactccgcacacgcaagatgt

SEQ ID NO: 41950 - DNA, 25 bp, E. coli
gcatcactccgctcacgcaagatgt

SEQ ID NO: 41951 - DNA, 25 bp, E. coli
gcacacgcaagatgtttcacactca

SEQ ID NO: 41952 - DNA, 25 bp, E. coli
gcacacgcaagaagtttcacactca

SEQ ID NO: 41953 - DNA, 25 bp, E. coli
gatgtttcacacacacaccatacag

SEQ ID NO: 41954 - DNA, 25 bp, E. coli
gatgtttcacactcacaccatacag

SEQ ID NO: 41955 - DNA, 25 bp, E. coli
aacagcaccgcggtatcgcggagcg

SEQ ID NO: 41956 - DNA, 25 bp, E. coli
aacagcaccgcgctatcgcggagcg

SEQ ID NO: 41957 - DNA, 25 bp, E. coli
tatgctgcatgaccgcagccacgca

SEQ ID NO: 41958 - DNA, 25 bp, E. coli
tatgctgcatgagcgcagccacgca

SEQ ID NO: 41959 - DNA, 25 bp, E. coli
tgcacatcaataagctgcatgagcg

SEQ ID NO: 41960 - DNA, 25 bp, E. coli
tgcacatcaatatgctgcatgagcg

SEQ ID NO: 41961 - DNA, 25 bp, E. coli
tccagcagcaaaacaaactccatta

SEQ ID NO: 41962 - DNA, 25 bp, E. coli
tccagcagcaaatcaaactccatta

SEQ ID NO: 41963 - DNA, 25 bp, E. coli
gcctctgttttctgctatctggcgg

SEQ ID NO: 41964 - DNA, 25 bp, E. coli
gcctctgttttcagctatctggcgg

SEQ ID NO: 41965 - DNA, 25 bp, E. coli
gcagccacgcacaatcaaacattta

SEQ ID NO: 41966 - DNA, 25 bp, E. coli
gcagccacgcactatcaaacattta

SEQ ID NO: 41967 - DNA, 25 bp, E. coli
gaaatcaaccgctgactttcccgcg

SEQ ID NO: 41968 - DNA, 25 bp, E. coli
gaaatcaaccgcagactttcccgcg

SEQ ID NO: 41969 - DNA, 25 bp, E. coli
ggagcgtcgtcacatccagactgaa

SEQ ID NO: 41970 - DNA, 25 bp, E. coli
ggcggatgatctgcacgagtttcaa

SEQ ID NO: 41971 - DNA, 25 bp, E. coli
ggagcgtcgtcagatccagactgaa

SEQ ID NO: 41972 - DNA, 25 bp, E. coli
ggcggatgatctccacgagtttcaa

SEQ ID NO: 41973 - DNA, 25 bp, E. coli
tcacgcgtcgcgcaaatcatgcaca

SEQ ID NO: 41974 - DNA, 25 bp, E. coli
tcacgcgtcgcggaaatcatgcaca

SEQ ID NO: 41975 - DNA, 25 bp, E. coli
gagtttcaacagctcatccagcagc

SEQ ID NO: 41976 - DNA, 25 bp, E. coli
gagtttcaacaggtcatccagcagc

SEQ ID NO: 41977 - DNA, 25 bp, E. coli
caatatcagagccaaagcctcacag

SEQ ID NO: 41978 - DNA, 25 bp, E. coli
caatatcagagcgaaagcctcacag

SEQ ID NO: 41979 - DNA, 25 bp, E. coli
caatcaatatcagagcgaaagcctc

SEQ ID NO: 41980 - DNA, 25 bp, E. coli
caatcaatatcacagcgaaagcctc

SEQ ID NO: 41981 - DNA, 25 bp, E. coli
accggaaagcaaagaagcgccaatc

SEQ ID NO: 41982 - DNA, 25 bp, E. coli
atcagagcgaaagcctcacagcgtg

SEQ ID NO: 41983 - DNA, 25 bp, E. coli
atgaatatgaaaccggaaagcaaag

SEQ ID NO: 41984 - DNA, 25 bp, E. coli
atgaatatgaaagcggaaagcaaag

SEQ ID NO: 41985 - DNA, 25 bp, E. coli
atcagagcgaaaccctcacagcgtg

SEQ ID NO: 41986 - DNA, 25 bp, E. coli
accggaaagcaatgaagcgccaatc

SEQ ID NO: 41987 - DNA, 25 bp, E. coli
tatcagagcgaaagcctcacagcgt

SEQ ID NO: 41988 - DNA, 25 bp, E. coli
tatcagagcgaatgcctcacagcgt

SEQ ID NO: 41989 - DNA, 25 bp, E. coli
tgaaaccggaaaccaaagaagcgcc

SEQ ID NO: 41990 - DNA, 25 bp, E. coli
tgaaaccggaaagcaaagaagcgcc

SEQ ID NO: 41991 - DNA, 25 bp, E. coli
gccaatcaatatcagagcgaaagcc

SEQ ID NO: 41992 - DNA, 25 bp, E. coli
gccaatcaatatgagagcgaaagcc

SEQ ID NO: 41993 - DNA, 25 bp, E. coli
gcaaagaagcgcgaatcaatatcag

SEQ ID NO: 41994 - DNA, 25 bp, E. coli
gaagcgccaatcaatatcagagcga

SEQ ID NO: 41995 - DNA, 25 bp, E. coli
gcaaagaagcgccaatcaatatcag

SEQ ID NO: 41996 - DNA, 25 bp, E. coli
gaagcgccaatctatatcagagcga

SEQ ID NO: 41997 - DNA, 25 bp, E. coli
ggaaagcaaagaagcgccaatcaat

SEQ ID NO: 41998 - DNA, 25 bp, E. coli
ggaaagcaaagatgcgccaatcaat

SEQ ID NO: 41999 - DNA, 25 bp, E. coli
aatactgtcttgtcggttcgcgctg

SEQ ID NO: 42000 - DNA, 25 bp, E. coli
aagtcatcagccacataaatcagca

SEQ ID NO: 42001 - DNA, 25 bp, E. coli
aatactgtcttgacggttcgcgctg

SEQ ID NO: 42002 - DNA, 25 bp, E. coli
aagtcatcagcctcataaatcagca

SEQ ID NO: 42003 - DNA, 25 bp, E. coli
attgcgacaccagcgtcactgctga

SEQ ID NO: 42004 - DNA, 25 bp, E. coli
attgcgacaccaccgtcactgctga

SEQ ID NO: 42005 - DNA, 25 bp, E. coli
tgtcttgacggtacgcgctggtcag

SEQ ID NO: 42006 - DNA, 25 bp, E. coli
tgtcttgacggttcgcgctggtcag

SEQ ID NO: 42007 - DNA, 25 bp, E. coli
tgctcaatactgacttgacggttcg

SEQ ID NO: 42008 - DNA, 25 bp, E. coli
tgctcaatactgtcttgacggttcg

SEQ ID NO: 42009 - DNA, 25 bp, E. coli
tcagcctcataaatcagcatcgcga

SEQ ID NO: 42010 - DNA, 25 bp, E. coli
gcctcggctgggtgacgtttactga

SEQ ID NO: 42011 - DNA, 25 bp, E. coli
gcctcggctgggagacgtttactga

SEQ ID NO: 42012 - DNA, 25 bp, E. coli
cctcataaatcagcatcgcgaaggc

SEQ ID NO: 42013 - DNA, 25 bp, E. coli
cctcataaatcaccatcgcgaaggc

SEQ ID NO: 42014 - DNA, 25 bp, E. coli
gacgtttactgataaagtcatcagc

SEQ ID NO: 42015 - DNA, 25 bp, E. coli
gacgtttactgaaaaagtcatcagc

SEQ ID NO: 42016 - DNA, 25 bp, E. coli
cggctgggagacctttactgataaa

SEQ ID NO: 42017 - DNA, 25 bp, E. coli
cggctgggagacgtttactgataaa

SEQ ID NO: 42018 - DNA, 25 bp, E. coli
ggtgttctgctggtcaatactgtct

SEQ ID NO: 42019 - DNA, 25 bp, E. coli
ggtgttctgctgctcaatactgtct

SEQ ID NO: 42020 - DNA, 25 bp, E. coli
tcagcctcataattcagcatcgcga

SEQ ID NO: 42021 - DNA, 25 bp, E. coli
cagacacttctgtagggaaaacggt

SEQ ID NO: 42022 - DNA, 25 bp, E. coli
catgcactgctatcagctcaggcga

SEQ ID NO: 42023 - DNA, 25 bp, E. coli
cagacacttctgaagggaaaacggt

SEQ ID NO: 42024 - DNA, 25 bp, E. coli
catgcactgctaacagctcaggcga

SEQ ID NO: 42025 - DNA, 25 bp, E. coli
tacaccctcattacaaacggcctgg

SEQ ID NO: 42026 - DNA, 25 bp, E. coli
tacaccctcatttcaaacggcctgg

SEQ ID NO: 42027 - DNA, 25 bp, E. coli
gctaaccgaatctacccaggactgg

SEQ ID NO: 42028 - DNA, 25 bp, E. coli
gctacaagcgtttgcctcccaggga

SEQ ID NO: 42029 - DNA, 25 bp, E. coli
gctgcgtaataatgatgccctggtg

SEQ ID NO: 42030 - DNA, 25 bp, E. coli
gctgcgtaataaagatgccctggtg

SEQ ID NO: 42031 - DNA, 25 bp, E. coli
gctaaccgaatcaacccaggactgg

SEQ ID NO: 42032 - DNA, 25 bp, E. coli
gctacaagcgttagcctcccaggga

SEQ ID NO: 42033 - DNA, 25 bp, E. coli
gaaaacggtggtttcccgcgcattg

SEQ ID NO: 42034 - DNA, 25 bp, E. coli
gaaaacggtggtatcccgcgcattg

SEQ ID NO: 42035 - DNA, 25 bp, E. coli
cgctcattggctcggtggctaaccg

SEQ ID NO: 42036 - DNA, 25 bp, E. coli
cgaagaagaaagtagcgtggcgcac

SEQ ID NO: 42037 - DNA, 25 bp, E. coli
cgaagaagaaagaagcgtggcgcac

SEQ ID NO: 42038 - DNA, 25 bp, E. coli
cgctcattggctgggtggctaaccg

SEQ ID NO: 42039 - DNA, 25 bp, E. coli
cattggtgaactcccttatctgccg

SEQ ID NO: 42040 - DNA, 25 bp, E. coli
cattggtgaactgccttatctgccg

SEQ ID NO: 42041 - DNA, 25 bp, E. coli
gagtgtttcaaccatcgaactgcct

SEQ ID NO: 42042 - DNA, 25 bp, E. coli
gagtgtttcaacgatcgaactgcct

SEQ ID NO: 42043 - DNA, 25 bp, E. coli
tacaaacagcaagaacccgctgagc

SEQ ID NO: 42044 - DNA, 25 bp, E. coli
tacaaacagcaacaacccgctgagc

SEQ ID NO: 42045 - DNA, 25 bp, E. coli
tatcacatacaattcatcaccgcag

SEQ ID NO: 42046 - DNA, 25 bp, E. coli
tatcacatacaaatcatcaccgcag

SEQ ID NO: 42047 - DNA, 25 bp, E. coli
tgaaaaaggcgacacattggcatgt

SEQ ID NO: 42048 - DNA, 25 bp, E. coli
tgaaaaaggcgagacattggcatgt

SEQ ID NO: 42049 - DNA, 25 bp, E. coli
tctcgaaatgttcctgtgtatcaca

SEQ ID NO: 42050 - DNA, 25 bp, E. coli
tcaccgcaggaccatagtatttaca

SEQ ID NO: 42051 - DNA, 25 bp, E. coli
tctcgaaatgttgctgtgtatcaca

SEQ ID NO: 42052 - DNA, 25 bp, E. coli
gcttcgtaagtatttcctgagacaa

SEQ ID NO: 42053 - DNA, 25 bp, E. coli
gcttcgtaagtaattcctgagacaa

SEQ ID NO: 42054 - DNA, 25 bp, E. coli
cgctgagcaggtacttaatcggaaa

SEQ ID NO: 42055 - DNA, 25 bp, E. coli
cccggaggtagtgatcgcagcaatc

SEQ ID NO: 42056 - DNA, 25 bp, E. coli
cccggaggtagtcatcgcagcaatc

SEQ ID NO: 42057 - DNA, 25 bp, E. coli
cgctgagcaggttcttaatcggaaa

SEQ ID NO: 42058 - DNA, 25 bp, E. coli
gatgccgtatgattatctcgaaatg

SEQ ID NO: 42059 - DNA, 25 bp, E. coli
tcaccgcaggacgatagtatttaca

SEQ ID NO: 42060 - DNA, 25 bp, E. coli
taagggtgaaaagattttgcctgca

SEQ ID NO: 42061 - DNA, 25 bp, E. coli
taagggtgaaaacattttgcctgca

SEQ ID NO: 42062 - DNA, 25 bp, E. coli
gatgccgtatgaatatctcgaaatg

SEQ ID NO: 42063 - DNA, 25 bp, E. coli
gagtaaattagcttcaccacggtat

SEQ ID NO: 42064 - DNA, 25 bp, E. coli
gagtaaattagcatcaccacggtat

SEQ ID NO: 42065 - DNA, 25 bp, E. coli
atcgtggtgtgtttgatccggaagc

SEQ ID NO: 42066 - DNA, 25 bp, E. coli
atcgtggtgtgtatgatccggaagc

SEQ ID NO: 42067 - DNA, 25 bp, E. coli
ttttgtccgcgaaaatcgtggtgtg

SEQ ID NO: 42068 - DNA, 25 bp, E. coli
ttttgtccgcgataatcgtggtgtg

SEQ ID NO: 42069 - DNA, 25 bp, E. coli
tggtgtgtatgatccggaagcccgt

SEQ ID NO: 42070 - DNA, 25 bp, E. coli
tggtgtgtatgaaccggaagcccgt

SEQ ID NO: 42071 - DNA, 25 bp, E. coli
tccgcgataatcctggtgtgtatga

SEQ ID NO: 42072 - DNA, 25 bp, E. coli
tccgcgataatcgtggtgtgtatga

SEQ ID NO: 42073 - DNA, 25 bp, E. coli
tcagtgattttgtccgcgataatcg

SEQ ID NO: 42074 - DNA, 25 bp, E. coli
tcagtgattttgaccgcgataatcg

SEQ ID NO: 42075 - DNA, 25 bp, E. coli
cgttcagtgattttgtccgcgataa

SEQ ID NO: 42076 - DNA, 25 bp, E. coli
cctggtatcccgaaacaggccagtt

SEQ ID NO: 42077 - DNA, 25 bp, E. coli
cctggtatcccgtaacaggccagtt

SEQ ID NO: 42078 - DNA, 25 bp, E. coli
cgttcagtgattatgtccgcgataa

SEQ ID NO: 42079 - DNA, 25 bp, E. coli
cgataatcgtggagtgtatgatccg

SEQ ID NO: 42080 - DNA, 25 bp, E. coli
cgataatcgtggtgtgtatgatccg

SEQ ID NO: 42081 - DNA, 25 bp, E. coli
gtatcccgtaactggccagttctga

SEQ ID NO: 42082 - DNA, 25 bp, E. coli
gattttgtccgcgataatcgtggtg

SEQ ID NO: 42083 - DNA, 25 bp, E. coli
gtatcccgtaacaggccagttctga

SEQ ID NO: 42084 - DNA, 25 bp, E. coli
gattttgtccgccataatcgtggtg

SEQ ID NO: 42085 - DNA, 25 bp, E. coli
taatcgtggtgtctatgatccggaa

SEQ ID NO: 42086 - DNA, 25 bp, E. coli
taatcgtggtgtgtatgatccggaa

SEQ ID NO: 42087 - DNA, 25 bp, E. coli
cacgagccgggcgattttcatgcca

SEQ ID NO: 42088 - DNA, 25 bp, E. coli
cacgagccgggccattttcatgcca

SEQ ID NO: 42089 - DNA, 25 bp, E. coli
cagtatattttctacactgatgcag

SEQ ID NO: 42090 - DNA, 25 bp, E. coli
cagtatattttcaacactgatgcag

SEQ ID NO: 42091 - DNA, 25 bp, E. coli
agaatatgtcaacgccacgagccgg

SEQ ID NO: 42092 - DNA, 25 bp, E. coli
agaatatgtcaaggccacgagccgg

SEQ ID NO: 42093 - DNA, 25 bp, E. coli
tattttctacacagatgcagtctga

SEQ ID NO: 42094 - DNA, 25 bp, E. coli
tattttctacactgatgcagtctga

SEQ ID NO: 42095 - DNA, 25 bp, E. coli
ttcaggatgctcaggagagaatatg

SEQ ID NO: 42096 - DNA, 25 bp, E. coli
ttcaggatgctctggagagaatatg

SEQ ID NO: 42097 - DNA, 25 bp, E. coli
tgctcaggagagaatatgtcaacgc

SEQ ID NO: 42098 - DNA, 25 bp, E. coli
tgctcaggagagtatatgtcaacgc

SEQ ID NO: 42099 - DNA, 25 bp, E. coli
tcatgccagccactatattttctac

SEQ ID NO: 42100 - DNA, 25 bp, E. coli
tcatgccagccagtatattttctac

SEQ ID NO: 42101 - DNA, 25 bp, E. coli
tcaggagagaatttgtcaacgccac

SEQ ID NO: 42102 - DNA, 25 bp, E. coli
tcaggagagaatatgtcaacgccac

SEQ ID NO: 42103 - DNA, 25 bp, E. coli
gccgggccatttacatgccagccag

SEQ ID NO: 42104 - DNA, 25 bp, E. coli
gccgggccattttcatgccagccag

SEQ ID NO: 42105 - DNA, 25 bp, E. coli
ggccattttcatgccagccagtata

SEQ ID NO: 42106 - DNA, 25 bp, E. coli
ggccattttcatcccagccagtata

SEQ ID NO: 42107 - DNA, 25 bp, E. coli
gagagaatatgtgaacgccacgagc

SEQ ID NO: 42108 - DNA, 25 bp, E. coli
gagagaatatgtcaacgccacgagc

SEQ ID NO: 42109 - DNA, 25 bp, E. coli
cactggagcttagggaactggttaa

SEQ ID NO: 42110 - DNA, 25 bp, E. coli
cactggagcttacggaactggttaa

SEQ ID NO: 42111 - DNA, 25 bp, E. coli
cataccggtccgctaaaagatgctc

SEQ ID NO: 42112 - DNA, 25 bp, E. coli
cataccggtccggtaaaagatgctc

SEQ ID NO: 42113 - DNA, 25 bp, E. coli
aaagatgctcctccctacgatacca

SEQ ID NO: 42114 - DNA, 25 bp, E. coli
aaagatgctcctgcctacgatacca

SEQ ID NO: 42115 - DNA, 25 bp, E. coli
tatgcttcatcgtcaggtttcggac

SEQ ID NO: 42116 - DNA, 25 bp, E. coli
tagtgagtgcacattatggccgcga

SEQ ID NO: 42117 - DNA, 25 bp, E. coli
tagtgagtgcactttatggccgcga

SEQ ID NO: 42118 - DNA, 25 bp, E. coli
tatgcttcatcgacaggtttcggac

SEQ ID NO: 42119 - DNA, 25 bp, E. coli
taccatcattcaggcaatgagcggg

SEQ ID NO: 42120 - DNA, 25 bp, E. coli
taccatcattcacgcaatgagcggg

SEQ ID NO: 42121 - DNA, 25 bp, E. coli
tgttatgccgggagcggcaacgctc

SEQ ID NO: 42122 - DNA, 25 bp, E. coli
tgttatgccgggtgcggcaacgctc

SEQ ID NO: 42123 - DNA, 25 bp, E. coli
tcgatatagcgatgtttgatgccac

SEQ ID NO: 42124 - DNA, 25 bp, E. coli
tcgatatagcgaagtttgatgccac

SEQ ID NO: 42125 - DNA, 25 bp, E. coli
tctgcgttatgccaggcactggagc

SEQ ID NO: 42126 - DNA, 25 bp, E. coli
tctgcgttatgcgaggcactggagc

SEQ ID NO: 42127 - DNA, 25 bp, E. coli
gaattttcgcccaggtacaatggaa

SEQ ID NO: 42128 - DNA, 25 bp, E. coli
gaattttcgccctggtacaatggaa

SEQ ID NO: 42129 - DNA, 25 bp, E. coli
ccgttattaagtgtggctgaggcca

SEQ ID NO: 42130 - DNA, 25 bp, E. coli
ccgttattaagtctggctgaggcca

SEQ ID NO: 42131 - DNA, 25 bp, E. coli
tatggccccagaatagtgatgctcg

SEQ ID NO: 42132 - DNA, 25 bp, E. coli
taccagtgaggtcaatgtttcccgg

SEQ ID NO: 42133 - DNA, 25 bp, E. coli
tatggccccagattagtgatgctcg

SEQ ID NO: 42134 - DNA, 25 bp, E. coli
taccagtgaggtgaatgtttcccgg

SEQ ID NO: 42135 - DNA, 25 bp, E. coli
ttacggcaatatcgcgaggaaggct

SEQ ID NO: 42136 - DNA, 25 bp, E. coli
ttacggcaatatggcgaggaaggct

SEQ ID NO: 42137 - DNA, 25 bp, E. coli
tgatgctcgcccgatgatggatcct

SEQ ID NO: 42138 - DNA, 25 bp, E. coli
tgatgctcgccccatgatggatcct

SEQ ID NO: 42139 - DNA, 25 bp, E. coli
tcgtttgttccatgtgcagcgtgcg

SEQ ID NO: 42140 - DNA, 25 bp, E. coli
tcgtttgttccaagtgcagcgtgcg

SEQ ID NO: 42141 - DNA, 25 bp, E. coli
gaaggctggtctgtggtatctccac

SEQ ID NO: 42142 - DNA, 25 bp, E. coli
gcagcgtgcggaagttcagatgaca

SEQ ID NO: 42143 - DNA, 25 bp, E. coli
gaattgacgattgtaccggcaaaaa

SEQ ID NO: 42144 - DNA, 25 bp, E. coli
gaaggctggtctctggtatctccac

SEQ ID NO: 42145 - DNA, 25 bp, E. coli
gcaacaggtcttatcgcttaacgaa

SEQ ID NO: 42146 - DNA, 25 bp, E. coli
gcaacaggtcttttcgcttaacgaa

SEQ ID NO: 42147 - DNA, 25 bp, E. coli
gaattgacgattctaccggcaaaaa

SEQ ID NO: 42148 - DNA, 25 bp, E. coli
gcagcgtgcggatgttcagatgaca

SEQ ID NO: 42149 - DNA, 25 bp, E. coli
gatggatcctcaaaagtgtcagctt

SEQ ID NO: 42150 - DNA, 25 bp, E. coli
gatggatcctcataagtgtcagctt

SEQ ID NO: 42151 - DNA, 25 bp, E. coli
gatgccttgtgtaacggatgccaaa

SEQ ID NO: 42152 - DNA, 25 bp, E. coli
gatgccttgtgttacggatgccaaa

SEQ ID NO: 42153 - DNA, 25 bp, E. coli
cactgttaaaatactctgggccgat

SEQ ID NO: 42154 - DNA, 25 bp, E. coli
cactgttaaaattctctgggccgat

SEQ ID NO: 42155 - DNA, 25 bp, E. coli
actgttaaaatactctgggccgatg

SEQ ID NO: 42156 - DNA, 25 bp, E. coli
actgttaaaatagtctgggccgatg

SEQ ID NO: 42157 - DNA, 25 bp, E. coli
acactgttaaaaaactctgggccga

SEQ ID NO: 42158 - DNA, 25 bp, E. coli
acactgttaaaatactctgggccga

SEQ ID NO: 42159 - DNA, 25 bp, E. coli
tgttaaaatactctgggccgatgct

SEQ ID NO: 42160 - DNA, 25 bp, E. coli
tgttaaaatactgtgggccgatgct

SEQ ID NO: 42161 - DNA, 25 bp, E. coli
tgacactgttaatatactctgggcc

SEQ ID NO: 42162 - DNA, 25 bp, E. coli
tgacactgttaaaatactctgggcc

SEQ ID NO: 42163 - DNA, 25 bp, E. coli
gacactgttaaaatactctgggccg

SEQ ID NO: 42164 - DNA, 25 bp, E. coli
gacactgttaaattactctgggccg

SEQ ID NO: 42165 - DNA, 25 bp, E. coli
ctgttaaaatacactgggccgatgc

SEQ ID NO: 42166 - DNA, 25 bp, E. coli
ctgttaaaatactctgggccgatgc

SEQ ID NO: 42167 - DNA, 25 bp, E. coli
gttaaaatactcagggccgatgctg

SEQ ID NO: 42168 - DNA, 25 bp, E. coli
gttaaaatactctgggccgatgctg

SEQ ID NO: 42169 - DNA, 25 bp, E. coli
gggtgacactgttaaaatactctgg

SEQ ID NO: 42170 - DNA, 25 bp, E. coli
gtgacactgttaaaatactctgggc

SEQ ID NO: 42171 - DNA, 25 bp, E. coli
gggtgacactgtaaaaatactctgg

SEQ ID NO: 42172 - DNA, 25 bp, E. coli
gtgacactgttataatactctgggc

SEQ ID NO: 42173 - DNA, 25 bp, E. coli
ggtgacactgttaaaatactctggg

SEQ ID NO: 42174 - DNA, 25 bp, E. coli
ggtgacactgtttaaatactctggg

SEQ ID NO: 42175 - DNA, 25 bp, E. coli
caatctgatggtttgcctggcgctg

SEQ ID NO: 42176 - DNA, 25 bp, E. coli
caatctgatggtatgcctggcgctg

SEQ ID NO: 42177 - DNA, 25 bp, E. coli
cattaacccatctggtgggcggcct

SEQ ID NO: 42178 - DNA, 25 bp, E. coli
tattgcgggcgttcgttatgcgaca

SEQ ID NO: 42179 - DNA, 25 bp, E. coli
tattgcgggcgtacgttatgcgaca

SEQ ID NO: 42180 - DNA, 25 bp, E. coli
taaaattgcccggagtaaagtgtcg

SEQ ID NO: 42181 - DNA, 25 bp, E. coli
taaaattgcccgcagtaaagtgtcg

SEQ ID NO: 42182 - DNA, 25 bp, E. coli
tcgacttgcagtagagcgccagaaa

SEQ ID NO: 42183 - DNA, 25 bp, E. coli
tcgacttgcagttgagcgccagaaa

SEQ ID NO: 42184 - DNA, 25 bp, E. coli
tgcgccgagggcaaaatgcatcata

SEQ ID NO: 42185 - DNA, 25 bp, E. coli
tgcgccgagggctaaatgcatcata

SEQ ID NO: 42186 - DNA, 25 bp, E. coli
cgcacagtagcgcagacaattttcc

SEQ ID NO: 42187 - DNA, 25 bp, E. coli
cgcacagtagcggagacaattttcc

SEQ ID NO: 42188 - DNA, 25 bp, E. coli
cattaacccatcaggtgggcggcct

SEQ ID NO: 42189 - DNA, 25 bp, E. coli
gattaacgcacttctggtggcctgc

SEQ ID NO: 42190 - DNA, 25 bp, E. coli
gattaacgcactactggtggcctgc

SEQ ID NO: 42191 - DNA, 25 bp, E. coli
ggattgccgcccataaaattgcccg

SEQ ID NO: 42192 - DNA, 25 bp, E. coli
ggattgccgcccttaaaattgcccg

SEQ ID NO: 42193 - DNA, 25 bp, E. coli
tgggcggcctttcctttacactcgg

SEQ ID NO: 42194 - DNA, 25 bp, E. coli
tgggcggcctttgctttacactcgg

SEQ ID NO: 42195 - DNA, 25 bp, E. coli
gagtcgcggtttaacactgcgccga

SEQ ID NO: 42196 - DNA, 25 bp, E. coli
gagtcgcggttttacactgcgccga

SEQ ID NO: 42197 - DNA, 25 bp, E. coli
caatattaaacccgctcaggcgggt

SEQ ID NO: 42198 - DNA, 25 bp, E. coli
caatattaaaccggctcaggcgggt

SEQ ID NO: 42199 - DNA, 25 bp, E. coli
cacaatattaaacccgctcaggcgg

SEQ ID NO: 42200 - DNA, 25 bp, E. coli
cacaatattaaagccgctcaggcgg

SEQ ID NO: 42201 - DNA, 25 bp, E. coli
tacttgttacgaataaaatcaatca

SEQ ID NO: 42202 - DNA, 25 bp, E. coli
tacttgttacgattaaaatcaatca

SEQ ID NO: 42203 - DNA, 25 bp, E. coli
agtaccacaatattaaacccgctca

SEQ ID NO: 42204 - DNA, 25 bp, E. coli
atgactcccacaaaaagtaccacaa

SEQ ID NO: 42205 - DNA, 25 bp, E. coli
agtaccacaataataaacccgctca

SEQ ID NO: 42206 - DNA, 25 bp, E. coli
atgactcccacataaagtaccacaa

SEQ ID NO: 42207 - DNA, 25 bp, E. coli
taccacaatattaaacccgctcagg

SEQ ID NO: 42208 - DNA, 25 bp, E. coli
taccacaatatttaacccgctcagg

SEQ ID NO: 42209 - DNA, 25 bp, E. coli
tgttacgaataaaatcaatcaagct

SEQ ID NO: 42210 - DNA, 25 bp, E. coli
tgttacgaataatatcaatcaagct

SEQ ID NO: 42211 - DNA, 25 bp, E. coli
gaataaaatcaatcaagctacagct

SEQ ID NO: 42212 - DNA, 25 bp, E. coli
gaataaaatcaaacaagctacagct

SEQ ID NO: 42213 - DNA, 25 bp, E. coli
ggatgactcccacaaaaagtaccac

SEQ ID NO: 42214 - DNA, 25 bp, E. coli
gtggatgactccgacaaaaagtacc

SEQ ID NO: 42215 - DNA, 25 bp, E. coli
ggatgactcccagaaaaagtaccac

SEQ ID NO: 42216 - DNA, 25 bp, E. coli
gtggatgactcccacaaaaagtacc

SEQ ID NO: 42217 - DNA, 25 bp, E. coli
taaaatcaatcatgctacagcttta

SEQ ID NO: 42218 - DNA, 25 bp, E. coli
taaaatcaatcaagctacagcttta

SEQ ID NO: 42219 - DNA, 25 bp, E. coli
caaaggtcaacgttgttcgttatca

SEQ ID NO: 42220 - DNA, 25 bp, E. coli
caaaggtcaacgatgttcgttatca

SEQ ID NO: 42221 - DNA, 25 bp, E. coli
taccgacgagactaacaggcgcatt

SEQ ID NO: 42222 - DNA, 25 bp, E. coli
taccgacgagacaaacaggcgcatt

SEQ ID NO: 42223 - DNA, 25 bp, E. coli
tatacttttcgcttaccgacgagac

SEQ ID NO: 42224 - DNA, 25 bp, E. coli
tatacttttcgcataccgacgagac

SEQ ID NO: 42225 - DNA, 25 bp, E. coli
tgttctgcgggtttgatacatcaac

SEQ ID NO: 42226 - DNA, 25 bp, E. coli
tggtgaatcggttaacgccacgctg

SEQ ID NO: 42227 - DNA, 25 bp, E. coli
tgttctgcgggtatgatacatcaac

SEQ ID NO: 42228 - DNA, 25 bp, E. coli
tggtgaatcggtaaacgccacgctg

SEQ ID NO: 42229 - DNA, 25 bp, E. coli
gccacgctggttttaaaagatgcac

SEQ ID NO: 42230 - DNA, 25 bp, E. coli
gccacgctggttataaaagatgcac

SEQ ID NO: 42231 - DNA, 25 bp, E. coli
gaactattccctcttaaatcgtgag

SEQ ID NO: 42232 - DNA, 25 bp, E. coli
gaactattccctgttaaatcgtgag

SEQ ID NO: 42233 - DNA, 25 bp, E. coli
cgtggagtctgaatttgctgaatgc

SEQ ID NO: 42234 - DNA, 25 bp, E. coli
cgtggagtctgattttgctgaatgc

SEQ ID NO: 42235 - DNA, 25 bp, E. coli
cattgcagcgcctgtcggacaggaa

SEQ ID NO: 42236 - DNA, 25 bp, E. coli
cattgcagcgccagtcggacaggaa

SEQ ID NO: 42237 - DNA, 25 bp, E. coli
tcaaaattacatctccgtggagtct

SEQ ID NO: 42238 - DNA, 25 bp, E. coli
tcaaaattacatgtccgtggagtct

SEQ ID NO: 42239 - DNA, 25 bp, E. coli
gagaggatttactcaggctgacact

SEQ ID NO: 42240 - DNA, 25 bp, E. coli
gagaggatttacacaggctgacact

SEQ ID NO: 42241 - DNA, 25 bp, E. coli
atgcgcggcaaactgatgctgtttg

SEQ ID NO: 42242 - DNA, 25 bp, E. coli
attacttgaacgctctgcccgccag

SEQ ID NO: 42243 - DNA, 25 bp, E. coli
atgcgcggcaaagtgatgctgtttg

SEQ ID NO: 42244 - DNA, 25 bp, E. coli
attacttgaacggtctgcccgccag

SEQ ID NO: 42245 - DNA, 25 bp, E. coli
tgattttgaccatggaaaagcgcca

SEQ ID NO: 42246 - DNA, 25 bp, E. coli
tgattttgaccaaggaaaagcgcca

SEQ ID NO: 42247 - DNA, 25 bp, E. coli
tcgaacgcttatccgagatggcacc

SEQ ID NO: 42248 - DNA, 25 bp, E. coli
tcgaacgcttatgcgagatggcacc

SEQ ID NO: 42249 - DNA, 25 bp, E. coli
tccgtatcgcaaaagccgggaaacg

SEQ ID NO: 42250 - DNA, 25 bp, E. coli
tccgtatcgcaatagccgggaaacg

SEQ ID NO: 42251 - DNA, 25 bp, E. coli
gcagcggtgtacacattacttgaac

SEQ ID NO: 42252 - DNA, 25 bp, E. coli
gctgtttggtcactgggataacgaa

SEQ ID NO: 42253 - DNA, 25 bp, E. coli
gctgtttggtcagtgggataacgaa

SEQ ID NO: 42254 - DNA, 25 bp, E. coli
gcagcggtgtactcattacttgaac

SEQ ID NO: 42255 - DNA, 25 bp, E. coli
gaaatccccgatgcgtatcgcaaaa

SEQ ID NO: 42256 - DNA, 25 bp, E. coli
gaaatccccgatccgtatcgcaaaa

SEQ ID NO: 42257 - DNA, 25 bp, E. coli
cgggaaacgtttgcagcggtgtaca

SEQ ID NO: 42258 - DNA, 25 bp, E. coli
cgggaaacgtttccagcggtgtaca

SEQ ID NO: 42259 - DNA, 25 bp, E. coli
tggaaaagcgccatatcgaacgctt

SEQ ID NO: 42260 - DNA, 25 bp, E. coli
tggaaaagcgccttatcgaacgctt

SEQ ID NO: 42261 - DNA, 25 bp, E. coli
taacgaatgtgaaatccccgatccg

SEQ ID NO: 42262 - DNA, 25 bp, E. coli
taacgaatgtgatatccccgatccg

SEQ ID NO: 42263 - DNA, 25 bp, E. coli
aacgtcttgcccgacagctgatgaa

SEQ ID NO: 42264 - DNA, 25 bp, E. coli
cattttctcggccagaagtgcagat

SEQ ID NO: 42265 - DNA, 25 bp, E. coli
aacgtcttgccccacagctgatgaa

SEQ ID NO: 42266 - DNA, 25 bp, E. coli
tattcttcaggtggcaaaacgtctt

SEQ ID NO: 42267 - DNA, 25 bp, E. coli
tattcttcaggtcgcaaaacgtctt

SEQ ID NO: 42268 - DNA, 25 bp, E. coli
tgcagattctgaagatttttctcgg

SEQ ID NO: 42269 - DNA, 25 bp, E. coli
tgcagattctgatgatttttctcgg

SEQ ID NO: 42270 - DNA, 25 bp, E. coli
tgcgcgcgatcggtaaattgcctaa

SEQ ID NO: 42271 - DNA, 25 bp, E. coli
tgcgcgcgatcgctaaattgcctaa

SEQ ID NO: 42272 - DNA, 25 bp, E. coli
tctcggccagaagtgcagattctga

SEQ ID NO: 42273 - DNA, 25 bp, E. coli
tctcggccagaactgcagattctga

SEQ ID NO: 42274 - DNA, 25 bp, E. coli
gctgctgtcggttagcgactccctg

SEQ ID NO: 42275 - DNA, 25 bp, E. coli
gctgctgtcggtaagcgactccctg

SEQ ID NO: 42276 - DNA, 25 bp, E. coli
ccgctgcggtggaggttattcttca

SEQ ID NO: 42277 - DNA, 25 bp, E. coli
ccgctgcggtggtggttattcttca

SEQ ID NO: 42278 - DNA, 25 bp, E. coli
cgtgttgatactggaatttatcgga

SEQ ID NO: 42279 - DNA, 25 bp, E. coli
cgtgttgatactcgaatttatcgga

SEQ ID NO: 42280 - DNA, 25 bp, E. coli
cattttctcggcgagaagtgcagat

SEQ ID NO: 42281 - DNA, 25 bp, E. coli
gatttttctcggtgttttgctcatg

SEQ ID NO: 42282 - DNA, 25 bp, E. coli
gatttttctcggagttttgctcatg

SEQ ID NO: 42283 - DNA, 25 bp, E. coli
gagaaaaagatattgacgccaacca

SEQ ID NO: 42284 - DNA, 25 bp, E. coli
gagaaaaagataatgacgccaacca

SEQ ID NO: 42285 - DNA, 25 bp, E. coli
caccattttatgtcatcatttcggc

SEQ ID NO: 42286 - DNA, 25 bp, E. coli
caccattttatgacatcatttcggc

SEQ ID NO: 42287 - DNA, 25 bp, E. coli
cagaacaatcatgaaccgccaacga

SEQ ID NO: 42288 - DNA, 25 bp, E. coli
cagaacaatcatcaaccgccaacga

SEQ ID NO: 42289 - DNA, 25 bp, E. coli
agttatcggctcacaccattttatg

SEQ ID NO: 42290 - DNA, 25 bp, E. coli
agttatcggctctcaccattttatg

SEQ ID NO: 42291 - DNA, 25 bp, E. coli
tatcaaattgccgattggcgaaatc

SEQ ID NO: 42292 - DNA, 25 bp, E. coli
tatcaaattgcccattggcgaaatc

SEQ ID NO: 42293 - DNA, 25 bp, E. coli
gccaacgacgcagattatcaaattg

SEQ ID NO: 42294 - DNA, 25 bp, E. coli
gccaacgacgcacattatcaaattg

SEQ ID NO: 42295 - DNA, 25 bp, E. coli
cgcgcaaattatcgcttttttgatg

SEQ ID NO: 42296 - DNA, 25 bp, E. coli
cgcgcaaattatggcttttttgatg

SEQ ID NO: 42297 - DNA, 25 bp, E. coli
gggaataacgccaacgacgcacatt

SEQ ID NO: 42298 - DNA, 25 bp, E. coli
ggtaatgcctaatctagtcacttgg

SEQ ID NO: 42299 - DNA, 25 bp, E. coli
gggaataacgcctacgacgcacatt

SEQ ID NO: 42300 - DNA, 25 bp, E. coli
ggttttggtcgttgttaatgagcag

SEQ ID NO: 42301 - DNA, 25 bp, E. coli
ggttttggtcgtagttaatgagcag

SEQ ID NO: 42302 - DNA, 25 bp, E. coli
ggtaatgcctaaactagtcacttgg

SEQ ID NO: 42303 - DNA, 25 bp, E. coli
taatgagcagaacaatcatgaaccg

SEQ ID NO: 42304 - DNA, 25 bp, E. coli
taatgagcagaagaatcatgaaccg

SEQ ID NO: 42305 - DNA, 25 bp, E. coli
gaggccccggtatcgcgcaaattat

SEQ ID NO: 42306 - DNA, 25 bp, E. coli
gaggccccggtaacgcgcaaattat

SEQ ID NO: 42307 - DNA, 25 bp, E. coli
caggaaacatgtatctcacgggcgc

SEQ ID NO: 42308 - DNA, 25 bp, E. coli
catccgccgataagtgagttttaca

SEQ ID NO: 42309 - DNA, 25 bp, E. coli
caggaaacatgtttctcacgggcgc

SEQ ID NO: 42310 - DNA, 25 bp, E. coli
catccgccgatatgtgagttttaca

SEQ ID NO: 42311 - DNA, 25 bp, E. coli
catacaagaaattccgtgataccgt

SEQ ID NO: 42312 - DNA, 25 bp, E. coli
catacaagaaataccgtgataccgt

SEQ ID NO: 42313 - DNA, 25 bp, E. coli
tacgtattctcttcaggcaggacac

SEQ ID NO: 42314 - DNA, 25 bp, E. coli
tacgtattctctacaggcaggacac

SEQ ID NO: 42315 - DNA, 25 bp, E. coli
aaaaaagataggcttcatccgccga

SEQ ID NO: 42316 - DNA, 25 bp, E. coli
aaaaaagatagggttcatccgccga

SEQ ID NO: 42317 - DNA, 25 bp, E. coli
tcatgccaatgaaccagcagagcaa

SEQ ID NO: 42318 - DNA, 25 bp, E. coli
tcatgccaatgatccagcagagcaa

SEQ ID NO: 42319 - DNA, 25 bp, E. coli
ccagcagagcaatacatatcatgta

SEQ ID NO: 42320 - DNA, 25 bp, E. coli
gccatattgcgtatcatcatgccaa

SEQ ID NO: 42321 - DNA, 25 bp, E. coli
ccagcagagcaaaacatatcatgta

SEQ ID NO: 42322 - DNA, 25 bp, E. coli
gccatattgcgtttcatcatgccaa

SEQ ID NO: 42323 - DNA, 25 bp, E. coli
gataccgtttacttcaccactgtta

SEQ ID NO: 42324 - DNA, 25 bp, E. coli
gataccgtttacatcaccactgtta

SEQ ID NO: 42325 - DNA, 25 bp, E. coli
ggcaggacaccacgcttcatatgta

SEQ ID NO: 42326 - DNA, 25 bp, E. coli
ggcaggacaccaggcttcatatgta

SEQ ID NO: 42327 - DNA, 25 bp, E. coli
tcacgggcgcattcacggtagatgg

SEQ ID NO: 42328 - DNA, 25 bp, E. coli
tcacgggcgcatacacggtagatgg

SEQ ID NO: 42329 - DNA, 25 bp, E. coli
agttgtttgccctaagcggtgccca

SEQ ID NO: 42330 - DNA, 25 bp, E. coli
agttgtttgcccaaagcggtgccca

SEQ ID NO: 42331 - DNA, 25 bp, E. coli
tgctttaccggacggttacgcgcca

SEQ ID NO: 42332 - DNA, 25 bp, E. coli
tgctttaccggagggttacgcgcca

SEQ ID NO: 42333 - DNA, 25 bp, E. coli
gcgaagtggatctaatgctgctgca

SEQ ID NO: 42334 - DNA, 25 bp, E. coli
gcgaagtggatcaaatgctgctgca

SEQ ID NO: 42335 - DNA, 25 bp, E. coli
gcatggtcatctttttggcccggaa

SEQ ID NO: 42336 - DNA, 25 bp, E. coli
gcatggtcatctatttggcccggaa

SEQ ID NO: 42337 - DNA, 25 bp, E. coli
gacattcatgggacgttaccggcga

SEQ ID NO: 42338 - DNA, 25 bp, E. coli
gacattcatgggtcgttaccggcga

SEQ ID NO: 42339 - DNA, 25 bp, E. coli
ccgcgccgtggcaacaggtattact

SEQ ID NO: 42340 - DNA, 25 bp, E. coli
ccgcgccgtggctacaggtattact

SEQ ID NO: 42341 - DNA, 25 bp, E. coli
cgctgaacggctaaatgaagtggca

SEQ ID NO: 42342 - DNA, 25 bp, E. coli
cgctgaacggcttaatgaagtggca

SEQ ID NO: 42343 - DNA, 25 bp, E. coli
taatccggcgagttatggcatgctg

SEQ ID NO: 42344 - DNA, 25 bp, E. coli
taaggttatcgctgtgcgcggcaac

SEQ ID NO: 42345 - DNA, 25 bp, E. coli
tcaaagtatcattgcgcaggtcgcg

SEQ ID NO: 42346 - DNA, 25 bp, E. coli
tcaaagtatcatagcgcaggtcgcg

SEQ ID NO: 42347 - DNA, 25 bp, E. coli
taatccggcgagatatggcatgctg

SEQ ID NO: 42348 - DNA, 25 bp, E. coli
taaggttatcgcagtgcgcggcaac

SEQ ID NO: 42349 - DNA, 25 bp, E. coli
gagattttccacttcaaccccggct

SEQ ID NO: 42350 - DNA, 25 bp, E. coli
gagattttccacatcaaccccggct

SEQ ID NO: 42351 - DNA, 25 bp, E. coli
cagttgcagtagcaggagatcatcc

SEQ ID NO: 42352 - DNA, 25 bp, E. coli
cagttgcagtaggaggagatcatcc

SEQ ID NO: 42353 - DNA, 25 bp, E. coli
aacagactacctgaagggagccgcg

SEQ ID NO: 42354 - DNA, 25 bp, E. coli
aacagactacctcaagggagccgcg

SEQ ID NO: 42355 - DNA, 25 bp, E. coli
tattgttgtgactgggaggctgcca

SEQ ID NO: 42356 - DNA, 25 bp, E. coli
tattgttgtgacagggaggctgcca

SEQ ID NO: 42357 - DNA, 25 bp, E. coli
ttccggctctatcgctgaatcatgg

SEQ ID NO: 42358 - DNA, 25 bp, E. coli
ttccggctctatggctgaatcatgg

SEQ ID NO: 42359 - DNA, 25 bp, E. coli
tgggttaccacctaacgaatcagaa

SEQ ID NO: 42360 - DNA, 25 bp, E. coli
tgaatcatggcgtcagcagccgtgc

SEQ ID NO: 42361 - DNA, 25 bp, E. coli
tgaatcatggcgacagcagccgtgc

SEQ ID NO: 42362 - DNA, 25 bp, E. coli
tgccttcactttttgccagcttcgg

SEQ ID NO: 42363 - DNA, 25 bp, E. coli
tgccttcactttatgccagcttcgg

SEQ ID NO: 42364 - DNA, 25 bp, E. coli
gcttcggtaagcagggtgagacacc

SEQ ID NO: 42365 - DNA, 25 bp, E. coli
gcttcggtaagctgggtgagacacc

SEQ ID NO: 42366 - DNA, 25 bp, E. coli
cggaggccagttttagttgaccaca

SEQ ID NO: 42367 - DNA, 25 bp, E. coli
cggaggccagttatagttgaccaca

SEQ ID NO: 42368 - DNA, 25 bp, E. coli
gatactggaaaatctctaacgcgga

SEQ ID NO: 42369 - DNA, 25 bp, E. coli
gatactggaaaaactctaacgcgga

SEQ ID NO: 42370 - DNA, 25 bp, E. coli
tgggttaccaccaaacgaatcagaa

SEQ ID NO: 42371 - DNA, 25 bp, E. coli
taatgataccggctttgaccccgta

SEQ ID NO: 42372 - DNA, 25 bp, E. coli
taatgataccgggtttgaccccgta

SEQ ID NO: 42373 - DNA, 25 bp, E. coli
caaactgcacgttcgcgacgctaaa

SEQ ID NO: 42374 - DNA, 25 bp, E. coli
caaactgcacgtacgcgacgctaaa

SEQ ID NO: 42375 - DNA, 25 bp, E. coli
cagactaccaatcaaagcgcagggc

SEQ ID NO: 42376 - DNA, 25 bp, E. coli
cagactaccaatgaaagcgcagggc

SEQ ID NO: 42377 - DNA, 25 bp, E. coli
tgtaatgttgacgtctgccgtcgcg

SEQ ID NO: 42378 - DNA, 25 bp, E. coli
tgtaatgttgacctctgccgtcgcg

SEQ ID NO: 42379 - DNA, 25 bp, E. coli
tgagcggtttcgttgaaagccaggc

SEQ ID NO: 42380 - DNA, 25 bp, E. coli
tgaaagtatcgcgaaagcggtagat

SEQ ID NO: 42381 - DNA, 25 bp, E. coli
tgaaagtatcgccaaagcggtagat

SEQ ID NO: 42382 - DNA, 25 bp, E. coli
tgagcggtttcgatgaaagccaggc

SEQ ID NO: 42383 - DNA, 25 bp, E. coli
ccgtcatgtgaatgttgaaaccacc

SEQ ID NO: 42384 - DNA, 25 bp, E. coli
ccgtcatgtgaaagttgaaaccacc

SEQ ID NO: 42385 - DNA, 25 bp, E. coli
cgcagggcaaaatgtcgatagctct

SEQ ID NO: 42386 - DNA, 25 bp, E. coli
cgcagggcaaaaagtcgatagctct

SEQ ID NO: 42387 - DNA, 25 bp, E. coli
gatcatgacaacttcaagagcaccg

SEQ ID NO: 42388 - DNA, 25 bp, E. coli
gatttcgaaaacactgctggctgta

SEQ ID NO: 42389 - DNA, 25 bp, E. coli
gatttcgaaaactctgctggctgta

SEQ ID NO: 42390 - DNA, 25 bp, E. coli
ggtaatttcatgcatgacagcgcca

SEQ ID NO: 42391 - DNA, 25 bp, E. coli
ggtaatttcatggatgacagcgcca

SEQ ID NO: 42392 - DNA, 25 bp, E. coli
tcaaaaagtcgtcaccctgagcggt

SEQ ID NO: 42393 - DNA, 25 bp, E. coli
tcaaaaagtcgtgaccctgagcggt

SEQ ID NO: 42394 - DNA, 25 bp, E. coli
gatcatgacaacatcaagagcaccg

SEQ ID NO: 42395 - DNA, 25 bp, E. coli
ccgcatcgctaatcacaatcactat

SEQ ID NO: 42396 - DNA, 25 bp, E. coli
ccgcatcgctaaacacaatcactat

SEQ ID NO: 42397 - DNA, 25 bp, E. coli
cagttatgactgacacgcattctat

SEQ ID NO: 42398 - DNA, 25 bp, E. coli
cagttatgactgtcacgcattctat

SEQ ID NO: 42399 - DNA, 25 bp, E. coli
aaagcaggtgcaggcgtttattgga

SEQ ID NO: 42400 - DNA, 25 bp, E. coli
aaagcaggtgcacgcgtttattgga

SEQ ID NO: 42401 - DNA, 25 bp, E. coli
ttcctggagaatagcagttatgact

SEQ ID NO: 42402 - DNA, 25 bp, E. coli
ttcctggagaattgcagttatgact

SEQ ID NO: 42403 - DNA, 25 bp, E. coli
tgtcaccgtcggatatgcgagtcgc

SEQ ID NO: 42404 - DNA, 25 bp, E. coli
tgtcaccgtcggttatgcgagtcgc

SEQ ID NO: 42405 - DNA, 25 bp, E. coli
gtcggttatgcgagtcgctacccgg

SEQ ID NO: 42406 - DNA, 25 bp, E. coli
gtcggttatgcgtgtcgctacccgg

SEQ ID NO: 42407 - DNA, 25 bp, E. coli
gcaaataaccgtcatgtcaccgtcg

SEQ ID NO: 42408 - DNA, 25 bp, E. coli
gcaggcgtttattggagtgattgcc

SEQ ID NO: 42409 - DNA, 25 bp, E. coli
gcaaataaccgtgatgtcaccgtcg

SEQ ID NO: 42410 - DNA, 25 bp, E. coli
gaatagcagttatgactgacacgca

SEQ ID NO: 42411 - DNA, 25 bp, E. coli
gcaggcgtttataggagtgattgcc

SEQ ID NO: 42412 - DNA, 25 bp, E. coli
gaatagcagttaagactgacacgca

SEQ ID NO: 42413 - DNA, 25 bp, E. coli
cgtttattggagagattgccggtaa

SEQ ID NO: 42414 - DNA, 25 bp, E. coli
cgtttattggagtgattgccggtaa

SEQ ID NO: 42415 - DNA, 25 bp, E. coli
taatcacaatcactattcctggaga

SEQ ID NO: 42416 - DNA, 25 bp, E. coli
taatcacaatcagtattcctggaga

SEQ ID NO: 42417 - DNA, 25 bp, E. coli
taaaccgtttcgatacacgctgacg

SEQ ID NO: 42418 - DNA, 25 bp, E. coli
taaaccgtttcgttacacgctgacg

SEQ ID NO: 42419 - DNA, 25 bp, E. coli
aaaatcatgcttaccgactggtacg

SEQ ID NO: 42420 - DNA, 25 bp, E. coli
aaaatcatgctttccgactggtacg

SEQ ID NO: 42421 - DNA, 25 bp, E. coli
tatggttttacaggccggaactgcg

SEQ ID NO: 42422 - DNA, 25 bp, E. coli
tatggttttacacgccggaactgcg

SEQ ID NO: 42423 - DNA, 25 bp, E. coli
tatcaggatttcgagccggtgttgg

SEQ ID NO: 42424 - DNA, 25 bp, E. coli
tatcaggatttccagccggtgttgg

SEQ ID NO: 42425 - DNA, 25 bp, E. coli
ccaaagagtataatcagcgaggtgc

SEQ ID NO: 42426 - DNA, 25 bp, E. coli
gccggagtttcaattcaccaaagag

SEQ ID NO: 42427 - DNA, 25 bp, E. coli
ccaaagagtatattcagcgaggtgc

SEQ ID NO: 42428 - DNA, 25 bp, E. coli
gccggagtttcatttcaccaaagag

SEQ ID NO: 42429 - DNA, 25 bp, E. coli
gaatatgcctatgactcgaccctga

SEQ ID NO: 42430 - DNA, 25 bp, E. coli
gaatatgcctatcactcgaccctga

SEQ ID NO: 42431 - DNA, 25 bp, E. coli
gtaaatcggcggttatcacctggcc

SEQ ID NO: 42432 - DNA, 25 bp, E. coli
gtaaatcggcggatatcacctggcc

SEQ ID NO: 42433 - DNA, 25 bp, E. coli
taacggaatataaagcgggcgcaac

SEQ ID NO: 42434 - DNA, 25 bp, E. coli
taacggaatatatagcgggcgcaac

SEQ ID NO: 42435 - DNA, 25 bp, E. coli
gataatcgcccgtggaaggcggcct

SEQ ID NO: 42436 - DNA, 25 bp, E. coli
gatgttcgtctgcaatcgctgccgg

SEQ ID NO: 42437 - DNA, 25 bp, E. coli
gatgttcgtctggaatcgctgccgg

SEQ ID NO: 42438 - DNA, 25 bp, E. coli
gataatcgcccgaggaaggcggcct

SEQ ID NO: 42439 - DNA, 25 bp, E. coli
caacaatccgtctttatacagatcg

SEQ ID NO: 42440 - DNA, 25 bp, E. coli
caacaatccgtcattatacagatcg

SEQ ID NO: 42441 - DNA, 25 bp, E. coli
tacagatcgtaaagattgatgcctc

SEQ ID NO: 42442 - DNA, 25 bp, E. coli
tacagatcgtaatgattgatgcctc

SEQ ID NO: 42443 - DNA, 25 bp, E. coli
attttccccggatgcacattcactt

SEQ ID NO: 42444 - DNA, 25 bp, E. coli
attttccccggaagcacattcactt

SEQ ID NO: 42445 - DNA, 25 bp, E. coli
aaagattgatgcctcgcctgcgtgg

SEQ ID NO: 42446 - DNA, 25 bp, E. coli
aaagattgatgcgtcgcctgcgtgg

SEQ ID NO: 42447 - DNA, 25 bp, E. coli
tatctgcgggcgtggtcacgtttgc

SEQ ID NO: 42448 - DNA, 25 bp, E. coli
tatctgcgggcgaggtcacgtttgc

SEQ ID NO: 42449 - DNA, 25 bp, E. coli
tgacatgcatcatcaaaggaagcct

SEQ ID NO: 42450 - DNA, 25 bp, E. coli
tgacatgcatcaacaaaggaagcct

SEQ ID NO: 42451 - DNA, 25 bp, E. coli
tctgatttaagttatatctgcgggc

SEQ ID NO: 42452 - DNA, 25 bp, E. coli
tctgatttaagtaatatctgcgggc

SEQ ID NO: 42453 - DNA, 25 bp, E. coli
gcctgcgtggcctctatggctctga

SEQ ID NO: 42454 - DNA, 25 bp, E. coli
gcctgcgtggccactatggctctga

SEQ ID NO: 42455 - DNA, 25 bp, E. coli
gccttttagcttgctcgttgtgcaa

SEQ ID NO: 42456 - DNA, 25 bp, E. coli
gccttttagcttcctcgttgtgcaa

SEQ ID NO: 42457 - DNA, 25 bp, E. coli
cgtttctgcgatctaactcaacctt

SEQ ID NO: 42458 - DNA, 25 bp, E. coli
cgtttctgcgatgtaactcaacctt

SEQ ID NO: 42459 - DNA, 25 bp, E. coli
gggctatatgtagccgtttctgcga

SEQ ID NO: 42460 - DNA, 25 bp, E. coli
gggctatatgtacccgtttctgcga

SEQ ID NO: 42461 - DNA, 25 bp, E. coli
aattggtgggtaaccgtcactgttg

SEQ ID NO: 42462 - DNA, 25 bp, E. coli
aattggtgggtatccgtcactgttg

SEQ ID NO: 42463 - DNA, 25 bp, E. coli
cactgttgttgccagatgtggcgat

SEQ ID NO: 42464 - DNA, 25 bp, E. coli
cactgttgttgcgagatgtggcgat

SEQ ID NO: 42465 - DNA, 25 bp, E. coli
actgttgttgccagatgtggcgatt

SEQ ID NO: 42466 - DNA, 25 bp, E. coli
actgttgttgcctgatgtggcgatt

SEQ ID NO: 42467 - DNA, 25 bp, E. coli
tatccgtcactgttgttgccagatg

SEQ ID NO: 42468 - DNA, 25 bp, E. coli
tatccgtcactgatgttgccagatg

SEQ ID NO: 42469 - DNA, 25 bp, E. coli
tccgtcactgttgttgccagatgtg

SEQ ID NO: 42470 - DNA, 25 bp, E. coli
tccgtcactgttcttgccagatgtg

SEQ ID NO: 42471 - DNA, 25 bp, E. coli
gaaattggtgggaatccgtcactgt

SEQ ID NO: 42472 - DNA, 25 bp, E. coli
gaaattggtgggtatccgtcactgt

SEQ ID NO: 42473 - DNA, 25 bp, E. coli
cgtcactgttgttgccagatgtggc

SEQ ID NO: 42474 - DNA, 25 bp, E. coli
cgtcactgttgtagccagatgtggc

SEQ ID NO: 42475 - DNA, 25 bp, E. coli
ggaaattggtgggtatccgtcactg

SEQ ID NO: 42476 - DNA, 25 bp, E. coli
ggtatccgtcactgttgttgccaga

SEQ ID NO: 42477 - DNA, 25 bp, E. coli
ggtgggtatccgacactgttgttgc

SEQ ID NO: 42478 - DNA, 25 bp, E. coli
ggtgggtatccgtcactgttgttgc

SEQ ID NO: 42479 - DNA, 25 bp, E. coli
ggaaattggtggctatccgtcactg

SEQ ID NO: 42480 - DNA, 25 bp, E. coli
ggtatccgtcacagttgttgccaga

SEQ ID NO: 42481 - DNA, 25 bp, E. coli
tgggtatccgtcactgttgttgcca

SEQ ID NO: 42482 - DNA, 25 bp, E. coli
tgggtatccgtctctgttgttgcca

SEQ ID NO: 42483 - DNA, 25 bp, E. coli
cacggagagaaaccaggcagacgtt

SEQ ID NO: 42484 - DNA, 25 bp, E. coli
cacggagagaaagcaggcagacgtt

SEQ ID NO: 42485 - DNA, 25 bp, E. coli
taaagacacggacagaaaccaggca

SEQ ID NO: 42486 - DNA, 25 bp, E. coli
taaagacacggagagaaaccaggca

SEQ ID NO: 42487 - DNA, 25 bp, E. coli
caggcggttagacaggaggtaagtc

SEQ ID NO: 42488 - DNA, 25 bp, E. coli
agaaaccaggcacacgttggcgcag

SEQ ID NO: 42489 - DNA, 25 bp, E. coli
caggcggttagagaggaggtaagtc

SEQ ID NO: 42490 - DNA, 25 bp, E. coli
agaaaccaggcagacgttggcgcag

SEQ ID NO: 42491 - DNA, 25 bp, E. coli
ttgaagagaagggaaggcaggcggt

SEQ ID NO: 42492 - DNA, 25 bp, E. coli
ttgaagagaaggcaaggcaggcggt

SEQ ID NO: 42493 - DNA, 25 bp, E. coli
tctcttgcagagtttgataagctaa

SEQ ID NO: 42494 - DNA, 25 bp, E. coli
tctcttgcagagattgataagctaa

SEQ ID NO: 42495 - DNA, 25 bp, E. coli
gaagacgttgcagaggtgacagctt

SEQ ID NO: 42496 - DNA, 25 bp, E. coli
gaagacgttgcacaggtgacagctt

SEQ ID NO: 42497 - DNA, 25 bp, E. coli
gattgataagcttattaactctaac

SEQ ID NO: 42498 - DNA, 25 bp, E. coli
gattgataagctaattaactctaac

SEQ ID NO: 42499 - DNA, 25 bp, E. coli
ggtgacagctttttctcttgcagag

SEQ ID NO: 42500 - DNA, 25 bp, E. coli
ggtgacagctttatctcttgcagag

SEQ ID NO: 42501 - DNA, 25 bp, E. coli
ggaattcgcccaacgttttctgaat

SEQ ID NO: 42502 - DNA, 25 bp, E. coli
tggaaataaagacacggagagaaac

SEQ ID NO: 42503 - DNA, 25 bp, E. coli
ggaattcgcccatcgttttctgaat

SEQ ID NO: 42504 - DNA, 25 bp, E. coli
tggaaataaagagacggagagaaac

SEQ ID NO: 42505 - DNA, 25 bp, E. coli
aagttggcatctcggtaacgacggc

SEQ ID NO: 42506 - DNA, 25 bp, E. coli
aagttggcatctgggtaacgacggc

SEQ ID NO: 42507 - DNA, 25 bp, E. coli
aaatctgtaactttgacgccccaag

SEQ ID NO: 42508 - DNA, 25 bp, E. coli
aaatctgtaactatgacgccccaag

SEQ ID NO: 42509 - DNA, 25 bp, E. coli
tatccggtactggtgcaaagttggg

SEQ ID NO: 42510 - DNA, 25 bp, E. coli
ttaaatctttatgaaatgccgccag

SEQ ID NO: 42511 - DNA, 25 bp, E. coli
ttaaatctttatcaaatgccgccag

SEQ ID NO: 42512 - DNA, 25 bp, E. coli
tatccggtactgctgcaaagttggg

SEQ ID NO: 42513 - DNA, 25 bp, E. coli
tggttgcggcgagatatctcgatga

SEQ ID NO: 42514 - DNA, 25 bp, E. coli
gataaaacccttgagtcaacgacgg

SEQ ID NO: 42515 - DNA, 25 bp, E. coli
ggttttccgcctggctgcgagacga

SEQ ID NO: 42516 - DNA, 25 bp, E. coli
ggttttccgcctcgctgcgagacga

SEQ ID NO: 42517 - DNA, 25 bp, E. coli
tggttgcggcgacatatctcgatga

SEQ ID NO: 42518 - DNA, 25 bp, E. coli
taacgctggcaaagaatacgcaact

SEQ ID NO: 42519 - DNA, 25 bp, E. coli
tcaacgacggtactggttagcaagt

SEQ ID NO: 42520 - DNA, 25 bp, E. coli
taacgctggcaatgaatacgcaact

SEQ ID NO: 42521 - DNA, 25 bp, E. coli
tcaacgacggtagtggttagcaagt

SEQ ID NO: 42522 - DNA, 25 bp, E. coli
taatggtgaaggttccccagaagct

SEQ ID NO: 42523 - DNA, 25 bp, E. coli
taatggtgaaggatccccagaagct

SEQ ID NO: 42524 - DNA, 25 bp, E. coli
gataaaacccttcagtcaacgacgg

SEQ ID NO: 42525 - DNA, 25 bp, E. coli
gatggcgatcgggaaaagacactga

SEQ ID NO: 42526 - DNA, 25 bp, E. coli
gatggcgatcggcaaaagacactga

SEQ ID NO: 42527 - DNA, 25 bp, E. coli
caggagctaaccctggcgcaggttc

SEQ ID NO: 42528 - DNA, 25 bp, E. coli
caggagctaaccgtggcgcaggttc

SEQ ID NO: 42529 - DNA, 25 bp, E. coli
acgggcgatacgcacattaccgtgc

SEQ ID NO: 42530 - DNA, 25 bp, E. coli
acgtgcatctgcgactcaacctgaa

SEQ ID NO: 42531 - DNA, 25 bp, E. coli
acgggcgatacggacattaccgtgc

SEQ ID NO: 42532 - DNA, 25 bp, E. coli
acgtgcatctgccactcaacctgaa

SEQ ID NO: 42533 - DNA, 25 bp, E. coli
accgatcagattgcgggtaaactcg

SEQ ID NO: 42534 - DNA, 25 bp, E. coli
accgatcagattccgggtaaactcg

SEQ ID NO: 42535 - DNA, 25 bp, E. coli
tccaccgatcagtttgcgggtaaac

SEQ ID NO: 42536 - DNA, 25 bp, E. coli
tccaccgatcagattgcgggtaaac

SEQ ID NO: 42537 - DNA, 25 bp, E. coli
tcagattgcgggtaaactcgacgtg

SEQ ID NO: 42538 - DNA, 25 bp, E. coli
tctgccactcaagctgaacattgaa

SEQ ID NO: 42539 - DNA, 25 bp, E. coli
tctgccactcaacctgaacattgaa

SEQ ID NO: 42540 - DNA, 25 bp, E. coli
cctgcgctggcacgagctaaccgtg

SEQ ID NO: 42541 - DNA, 25 bp, E. coli
cctgcgctggcaggagctaaccgtg

SEQ ID NO: 42542 - DNA, 25 bp, E. coli
cgggtaaactcgtcgtgcgcgttga

SEQ ID NO: 42543 - DNA, 25 bp, E. coli
cgggtaaactcgacgtgcgcgttga

SEQ ID NO: 42544 - DNA, 25 bp, E. coli
gatacggacatttccgtgcgcacca

SEQ ID NO: 42545 - DNA, 25 bp, E. coli
gatacggacattaccgtgcgcacca

SEQ ID NO: 42546 - DNA, 25 bp, E. coli
gattgcgggtaaactcgacgtgcgc

SEQ ID NO: 42547 - DNA, 25 bp, E. coli
gattgcgggtaatctcgacgtgcgc

SEQ ID NO: 42548 - DNA, 25 bp, E. coli
tcagattgcgggaaaactcgacgtg

SEQ ID NO: 42549 - DNA, 25 bp, E. coli
tacgttggctgcaaaaactggccgc

SEQ ID NO: 42550 - DNA, 25 bp, E. coli
aaaaccgcgcgtcatgaagtgatcc

SEQ ID NO: 42551 - DNA, 25 bp, E. coli
aaaaccgcgcgtgatgaagtgatcc

SEQ ID NO: 42552 - DNA, 25 bp, E. coli
tacgttggctgctaaaactggccgc

SEQ ID NO: 42553 - DNA, 25 bp, E. coli
gcgttgccagaacaagagaaagccc

SEQ ID NO: 42554 - DNA, 25 bp, E. coli
gctatggcatcgtaaaaccgtacga

SEQ ID NO: 42555 - DNA, 25 bp, E. coli
gctatggcatcgaaaaaccgtacga

SEQ ID NO: 42556 - DNA, 25 bp, E. coli
gcgttgccagaagaagagaaagccc

SEQ ID NO: 42557 - DNA, 25 bp, E. coli
gaagagttcgtcacctcgctgggta

SEQ ID NO: 42558 - DNA, 25 bp, E. coli
gaagagttcgtctcctcgctgggta

SEQ ID NO: 42559 - DNA, 25 bp, E. coli
gcacgcagcgatcaaggaagttcct

SEQ ID NO: 42560 - DNA, 25 bp, E. coli
gcacgcagcgatgaaggaagttcct

SEQ ID NO: 42561 - DNA, 25 bp, E. coli
gaaagcccgcctcaaagcgatgacg

SEQ ID NO: 42562 - DNA, 25 bp, E. coli
gaaagagctgacacgcggtaagcgc

SEQ ID NO: 42563 - DNA, 25 bp, E. coli
gaaagcccgcctgaaagcgatgacg

SEQ ID NO: 42564 - DNA, 25 bp, E. coli
gaaagagctgactcgcggtaagcgc

SEQ ID NO: 42565 - DNA, 25 bp, E. coli
cgcttacccggatgttgactggcat

SEQ ID NO: 42566 - DNA, 25 bp, E. coli
cgcttacccggaagttgactggcat

SEQ ID NO: 42567 - DNA, 25 bp, E. coli
tggaattatcctgactgaccgccgt

SEQ ID NO: 42568 - DNA, 25 bp, E. coli
tggaattatcctcactgaccgccgt

SEQ ID NO: 42569 - DNA, 25 bp, E. coli
taaccaggtggacatcctcggcaaa

SEQ ID NO: 42570 - DNA, 25 bp, E. coli
taaccaggtggagatcctcggcaaa

SEQ ID NO: 42571 - DNA, 25 bp, E. coli
cacatcaggtgcaattacgaaatct

SEQ ID NO: 42572 - DNA, 25 bp, E. coli
cacatcaggtgctattacgaaatct

SEQ ID NO: 42573 - DNA, 25 bp, E. coli
catgtaatatgttcaccggaggtac

SEQ ID NO: 42574 - DNA, 25 bp, E. coli
ctttaaccaaagaacagcagggcga

SEQ ID NO: 42575 - DNA, 25 bp, E. coli
ctttaaccaaagtacagcagggcga

SEQ ID NO: 42576 - DNA, 25 bp, E. coli
catgtaatatgtacaccggaggtac

SEQ ID NO: 42577 - DNA, 25 bp, E. coli
taccgttaaggtacaagtatcttga

SEQ ID NO: 42578 - DNA, 25 bp, E. coli
tacgaaatctgacttaagaccggat

SEQ ID NO: 42579 - DNA, 25 bp, E. coli
taccgttaaggttcaagtatcttga

SEQ ID NO: 42580 - DNA, 25 bp, E. coli
tacggctggttttcaatggctataa

SEQ ID NO: 42581 - DNA, 25 bp, E. coli
tacggctggtttacaatggctataa

SEQ ID NO: 42582 - DNA, 25 bp, E. coli
aaacttgagcaaaacacatcaggtg

SEQ ID NO: 42583 - DNA, 25 bp, E. coli
aaacttgagcaatacacatcaggtg

SEQ ID NO: 42584 - DNA, 25 bp, E. coli
tacgaaatctgagttaagaccggat

SEQ ID NO: 42585 - DNA, 25 bp, E. coli
tttgtgctggctaaaaaacttgagc

SEQ ID NO: 42586 - DNA, 25 bp, E. coli
tttgtgctggcttaaaaacttgagc

SEQ ID NO: 42587 - DNA, 25 bp, E. coli
ttgtatgaaagcgtattgggactct

SEQ ID NO: 42588 - DNA, 25 bp, E. coli
ttgtatgaaagcctattgggactct

SEQ ID NO: 42589 - DNA, 25 bp, E. coli
cgagttggccggaaaagttggctca

SEQ ID NO: 42590 - DNA, 25 bp, E. coli
cgagttggccggtaaagttggctca

SEQ ID NO: 42591 - DNA, 25 bp, E. coli
tcaacacctggctacttacggctgg

SEQ ID NO: 42592 - DNA, 25 bp, E. coli
tcaacacctggcaacttacggctgg

SEQ ID NO: 42593 - DNA, 25 bp, E. coli
taaagcctctcattagccgcgcgaa

SEQ ID NO: 42594 - DNA, 25 bp, E. coli
taaagcctctcaatagccgcgcgaa

SEQ ID NO: 42595 - DNA, 25 bp, E. coli
gcgactaatgacaaccctaacccag

SEQ ID NO: 42596 - DNA, 25 bp, E. coli
gcgactaatgactaccctaacccag

SEQ ID NO: 42597 - DNA, 25 bp, E. coli
atgacaaccctaacccagctctatg

SEQ ID NO: 42598 - DNA, 25 bp, E. coli
atgacaaccctatcccagctctatg

SEQ ID NO: 42599 - DNA, 25 bp, E. coli
tagtttccagtgtattgctgccgtc

SEQ ID NO: 42600 - DNA, 25 bp, E. coli
tagtttccagtgaattgctgccgtc

SEQ ID NO: 42601 - DNA, 25 bp, E. coli
tgtgggtaaagcctctcattagccg

SEQ ID NO: 42602 - DNA, 25 bp, E. coli
tgtgggtaaagcgtctcattagccg

SEQ ID NO: 42603 - DNA, 25 bp, E. coli
tgctgccgtcagcttgaaaaaaggg

SEQ ID NO: 42604 - DNA, 25 bp, E. coli
tgctgccgtcaggttgaaaaaaggg

SEQ ID NO: 42605 - DNA, 25 bp, E. coli
tctgcaacggaacatcattcatagc

SEQ ID NO: 42606 - DNA, 25 bp, E. coli
tctgcaacggaagatcattcatagc

SEQ ID NO: 42607 - DNA, 25 bp, E. coli
ccagctctatgtgggtaaagcctct

SEQ ID NO: 42608 - DNA, 25 bp, E. coli
ccagctctatgtcggtaaagcctct

SEQ ID NO: 42609 - DNA, 25 bp, E. coli
gcgcgaacctctccaacggaagatc

SEQ ID NO: 42610 - DNA, 25 bp, E. coli
gcgcgaacctctgcaacggaagatc

SEQ ID NO: 42611 - DNA, 25 bp, E. coli
gcaacaatacataagtttccagtga

SEQ ID NO: 42612 - DNA, 25 bp, E. coli
gcaacaatacattagtttccagtga

SEQ ID NO: 42613 - DNA, 25 bp, E. coli
cggaagatcattcatagcaacaata

SEQ ID NO: 42614 - DNA, 25 bp, E. coli
cggaagatcattgatagcaacaata

SEQ ID NO: 42615 - DNA, 25 bp, E. coli
actgtggtgatctggtatatgcttt

SEQ ID NO: 42616 - DNA, 25 bp, E. coli
actgtggtgatcaggtatatgcttt

SEQ ID NO: 42617 - DNA, 25 bp, E. coli
tggtgatctggtttatgctttcggc

SEQ ID NO: 42618 - DNA, 25 bp, E. coli
tgatctggtatatgctttcggcgat

SEQ ID NO: 42619 - DNA, 25 bp, E. coli
tgtggtgatctggtatatgctttcg

SEQ ID NO: 42620 - DNA, 25 bp, E. coli
tggtgatctggtatatgctttcggc

SEQ ID NO: 42621 - DNA, 25 bp, E. coli
tgtggtgatctgctatatgctttcg

SEQ ID NO: 42622 - DNA, 25 bp, E. coli
tgatctggtataagctttcggcgat

SEQ ID NO: 42623 - DNA, 25 bp, E. coli
gactgtggtgatctggtatatgctt

SEQ ID NO: 42624 - DNA, 25 bp, E. coli
ctgcctggatcctgcatttgcgccg

SEQ ID NO: 42625 - DNA, 25 bp, E. coli
ctgtggtgatctggtatatgctttc

SEQ ID NO: 42626 - DNA, 25 bp, E. coli
ctgtggtgatctcgtatatgctttc

SEQ ID NO: 42627 - DNA, 25 bp, E. coli
ctgcctggatccagcatttgcgccg

SEQ ID NO: 42628 - DNA, 25 bp, E. coli
ggtgatctggtaaatgctttcggcg

SEQ ID NO: 42629 - DNA, 25 bp, E. coli
gtgatctggtatatgctttcggcga

SEQ ID NO: 42630 - DNA, 25 bp, E. coli
gtggtgatctggaatatgctttcgg

SEQ ID NO: 42631 - DNA, 25 bp, E. coli
ggtgatctggtatatgctttcggcg

SEQ ID NO: 42632 - DNA, 25 bp, E. coli
ggactgtggtgatctggtatatgct

SEQ ID NO: 42633 - DNA, 25 bp, E. coli
gtggtgatctggtatatgctttcgg

SEQ ID NO: 42634 - DNA, 25 bp, E. coli
gtgatctggtatttgctttcggcga

SEQ ID NO: 42635 - DNA, 25 bp, E. coli
ggactgtggtgaactggtatatgct

SEQ ID NO: 42636 - DNA, 25 bp, E. coli
gactgtggtgatgtggtatatgctt

SEQ ID NO: 42637 - DNA, 25 bp, E. coli
tgaggagggcgcactaaaaggtcct

SEQ ID NO: 42638 - DNA, 25 bp, E. coli
tgaggagggcgctctaaaaggtcct

SEQ ID NO: 42639 - DNA, 25 bp, E. coli
acaagcgcagcctgctggcgacaag

SEQ ID NO: 42640 - DNA, 25 bp, E. coli
acaagcgcagccagctggcgacaag

SEQ ID NO: 42641 - DNA, 25 bp, E. coli
ttatgacagctaccgcgccgctgtt

SEQ ID NO: 42642 - DNA, 25 bp, E. coli
ttatgacagctagcgcgccgctgtt

SEQ ID NO: 42643 - DNA, 25 bp, E. coli
tgcctattatgagagctaccgcgcc

SEQ ID NO: 42644 - DNA, 25 bp, E. coli
tgcctattatgacagctaccgcgcc

SEQ ID NO: 42645 - DNA, 25 bp, E. coli
tctgaaagatcagcgcgttgctgcg

SEQ ID NO: 42646 - DNA, 25 bp, E. coli
tctgaaagatcaccgcgttgctgcg

SEQ ID NO: 42647 - DNA, 25 bp, E. coli
gcgatgtcgtcgcttatgcggtaca

SEQ ID NO: 42648 - DNA, 25 bp, E. coli
gcgttgctgcgtgtaaagttctctc

SEQ ID NO: 42649 - DNA, 25 bp, E. coli
gcgatgtcgtcggttatgcggtaca

SEQ ID NO: 42650 - DNA, 25 bp, E. coli
gcgttgctgcgtctaaagttctctc

SEQ ID NO: 42651 - DNA, 25 bp, E. coli
gacattaccaaacacatcttcacta

SEQ ID NO: 42652 - DNA, 25 bp, E. coli
gacattaccaaagacatcttcacta

SEQ ID NO: 42653 - DNA, 25 bp, E. coli
gatcagcgcgttcctgcgtctaaag

SEQ ID NO: 42654 - DNA, 25 bp, E. coli
gatcagcgcgttgctgcgtctaaag

SEQ ID NO: 42655 - DNA, 25 bp, E. coli
ggttctctcaacagcgtgcggcgtc

SEQ ID NO: 42656 - DNA, 25 bp, E. coli
gggcgcactaaaaggtccttccatt

SEQ ID NO: 42657 - DNA, 25 bp, E. coli
gggcgcactaaatggtccttccatt

SEQ ID NO: 42658 - DNA, 25 bp, E. coli
ggttctctcaactgcgtgcggcgtc

SEQ ID NO: 42659 - DNA, 25 bp, E. coli
aattcgcccaggaacataaacgccg

SEQ ID NO: 42660 - DNA, 25 bp, E. coli
aattcgcccaggtacataaacgccg

SEQ ID NO: 42661 - DNA, 25 bp, E. coli
cagatcgtccgtcttgctgaactca

SEQ ID NO: 42662 - DNA, 25 bp, E. coli
cagatcgtccgtgttgctgaactca

SEQ ID NO: 42663 - DNA, 25 bp, E. coli
taaacgccgtgtcgtcggaacaacg

SEQ ID NO: 42664 - DNA, 25 bp, E. coli
taaacgccgtgtggtcggaacaacg

SEQ ID NO: 42665 - DNA, 25 bp, E. coli
ttccgggcgaatggcgataccacgc

SEQ ID NO: 42666 - DNA, 25 bp, E. coli
ttccgggcgaatcgcgataccacgc

SEQ ID NO: 42667 - DNA, 25 bp, E. coli
tgaccaccagagagagagtaaccgc

SEQ ID NO: 42668 - DNA, 25 bp, E. coli
tgaccaccagagtgagagtaaccgc

SEQ ID NO: 42669 - DNA, 25 bp, E. coli
cctgctgcatgttgtgggtgacgat

SEQ ID NO: 42670 - DNA, 25 bp, E. coli
cctgctgcatgtagtgggtgacgat

SEQ ID NO: 42671 - DNA, 25 bp, E. coli
cgctggcttggtcaacagatcgtcc

SEQ ID NO: 42672 - DNA, 25 bp, E. coli
cgctggcttggtgaacagatcgtcc

SEQ ID NO: 42673 - DNA, 25 bp, E. coli
cattttgttgaacgtacgcagcagc

SEQ ID NO: 42674 - DNA, 25 bp, E. coli
cattttgttgaaggtacgcagcagc

SEQ ID NO: 42675 - DNA, 25 bp, E. coli
ggtttctggaactccatgcccactt

SEQ ID NO: 42676 - DNA, 25 bp, E. coli
ggtttcgttccagaatgcggctttg

SEQ ID NO: 42677 - DNA, 25 bp, E. coli
ggtttctggaacaccatgcccactt

SEQ ID NO: 42678 - DNA, 25 bp, E. coli
ggtttcgttccacaatgcggctttg

SEQ ID NO: 42679 - DNA, 25 bp, E. coli
tcaccacggtgttatcctgcttcag

SEQ ID NO: 42680 - DNA, 25 bp, E. coli
tcaccacggtgtaatcctgcttcag

SEQ ID NO: 42681 - DNA, 25 bp, E. coli
caacagcgtcagacacggcattggg

SEQ ID NO: 42682 - DNA, 25 bp, E. coli
cagcgttacctttctggcggtaggc

SEQ ID NO: 42683 - DNA, 25 bp, E. coli
caacagcgtcagtcacggcattggg

SEQ ID NO: 42684 - DNA, 25 bp, E. coli
cagcgttaccttactggcggtaggc

SEQ ID NO: 42685 - DNA, 25 bp, E. coli
tacagcctctatggcggcagtatga

SEQ ID NO: 42686 - DNA, 25 bp, E. coli
tacagcctctatcgcggcagtatga

SEQ ID NO: 42687 - DNA, 25 bp, E. coli
tagtgtgtgccactttctggcgatc

SEQ ID NO: 42688 - DNA, 25 bp, E. coli
tatgatcctgctcttcctcgcttcg

SEQ ID NO: 42689 - DNA, 25 bp, E. coli
tatgatcctgctgttcctcgcttcg

SEQ ID NO: 42690 - DNA, 25 bp, E. coli
tagtgtgtgccagtttctggcgatc

SEQ ID NO: 42691 - DNA, 25 bp, E. coli
ttcagaagccccacattaagcaggg

SEQ ID NO: 42692 - DNA, 25 bp, E. coli
ttcagaagcccctcattaagcaggg

SEQ ID NO: 42693 - DNA, 25 bp, E. coli
tgattgccggaagctacacgccgtt

SEQ ID NO: 42694 - DNA, 25 bp, E. coli
tgattgccggaacctacacgccgtt

SEQ ID NO: 42695 - DNA, 25 bp, E. coli
tgctactggttcaggcggtggatct

SEQ ID NO: 42696 - DNA, 25 bp, E. coli
tgaaatggcagtaaagctcgcggcg

SEQ ID NO: 42697 - DNA, 25 bp, E. coli
tgctactggttctggcggtggatct

SEQ ID NO: 42698 - DNA, 25 bp, E. coli
tgaaatggcagttaagctcgcggcg

SEQ ID NO: 42699 - DNA, 25 bp, E. coli
tctatttgtataatgggcaggcgta

SEQ ID NO: 42700 - DNA, 25 bp, E. coli
tctatttgtatattgggcaggcgta

SEQ ID NO: 42701 - DNA, 25 bp, E. coli
gatgattgttatgtggagcctggca

SEQ ID NO: 42702 - DNA, 25 bp, E. coli
gatgattgttatctggagcctggca

SEQ ID NO: 42703 - DNA, 25 bp, E. coli
cacgcctgaatgagggtatccgttt

SEQ ID NO: 42704 - DNA, 25 bp, E. coli
cacgcctgaatgtgggtatccgttt

SEQ ID NO: 42705 - DNA, 25 bp, E. coli
atgagggtatccctttatggcgcga

SEQ ID NO: 42706 - DNA, 25 bp, E. coli
acgcctgaatgacggtatccgttta

SEQ ID NO: 42707 - DNA, 25 bp, E. coli
acgcctgaatgagggtatccgttta

SEQ ID NO: 42708 - DNA, 25 bp, E. coli
atgagggtatccgtttatggcgcga

SEQ ID NO: 42709 - DNA, 25 bp, E. coli
tgagggtatccgtttatggcgcgaa

SEQ ID NO: 42710 - DNA, 25 bp, E. coli
tgaatgagggtatccgtttatggcg

SEQ ID NO: 42711 - DNA, 25 bp, E. coli
tgagggtatccgattatggcgcgaa

SEQ ID NO: 42712 - DNA, 25 bp, E. coli
tgaatgagggtaaccgtttatggcg

SEQ ID NO: 42713 - DNA, 25 bp, E. coli
cctgaatgagggtatccgtttatgg

SEQ ID NO: 42714 - DNA, 25 bp, E. coli
gcctgaatgaggctatccgtttatg

SEQ ID NO: 42715 - DNA, 25 bp, E. coli
gcctgaatgagggtatccgtttatg

SEQ ID NO: 42716 - DNA, 25 bp, E. coli
cctgaatgagggaatccgtttatgg

SEQ ID NO: 42717 - DNA, 25 bp, E. coli
gaatgagggtatgcgtttatggcgc

SEQ ID NO: 42718 - DNA, 25 bp, E. coli
gaatgagggtatccgtttatggcgc

SEQ ID NO: 42719 - DNA, 25 bp, E. coli
ctgaatgagggtatccgtttatggc

SEQ ID NO: 42720 - DNA, 25 bp, E. coli
ctgaatgagggtttccgtttatggc

SEQ ID NO: 42721 - DNA, 25 bp, E. coli
gggtatccgtttttggcgcgaaaat

SEQ ID NO: 42722 - DNA, 25 bp, E. coli
gggtatccgtttatggcgcgaaaat

SEQ ID NO: 42723 - DNA, 25 bp, E. coli
gagggtatccgtttatggcgcgaaa

SEQ ID NO: 42724 - DNA, 25 bp, E. coli
gagggtatccgtatatggcgcgaaa

SEQ ID NO: 42725 - DNA, 25 bp, E. coli
catttcttcatgattgagccgattt

SEQ ID NO: 42726 - DNA, 25 bp, E. coli
catgtttgagccgattttttctccc

SEQ ID NO: 42727 - DNA, 25 bp, E. coli
catttcttcatgtttgagccgattt

SEQ ID NO: 42728 - DNA, 25 bp, E. coli
catgtttgagcccattttttctccc

SEQ ID NO: 42729 - DNA, 25 bp, E. coli
cagtcatttcatttcttcatgtttg

SEQ ID NO: 42730 - DNA, 25 bp, E. coli
cagtcatttcatatcttcatgtttg

SEQ ID NO: 42731 - DNA, 25 bp, E. coli
taaatgccttgaatcagcctattta

SEQ ID NO: 42732 - DNA, 25 bp, E. coli
taaatgccttgattcagcctattta

SEQ ID NO: 42733 - DNA, 25 bp, E. coli
gagccgattttttctcccgtaaatg

SEQ ID NO: 42734 - DNA, 25 bp, E. coli
gagccgatttttactcccgtaaatg

SEQ ID NO: 42735 - DNA, 25 bp, E. coli
tttcatttcttcatgtttgagccga

SEQ ID NO: 42736 - DNA, 25 bp, E. coli
ttttctcccgtaaatgccttgaatc

SEQ ID NO: 42737 - DNA, 25 bp, E. coli
tttcatttcttcttgtttgagccga

SEQ ID NO: 42738 - DNA, 25 bp, E. coli
ttttctcccgtatatgccttgaatc

SEQ ID NO: 42739 - DNA, 25 bp, E. coli
tgtttgagccgattttttctcccgt

SEQ ID NO: 42740 - DNA, 25 bp, E. coli
tgtttgagccgaatttttctcccgt

SEQ ID NO: 42741 - DNA, 25 bp, E. coli
tctcccgtaaatcccttgaatcagc

SEQ ID NO: 42742 - DNA, 25 bp, E. coli
tctcccgtaaatgccttgaatcagc

SEQ ID NO: 42743 - DNA, 25 bp, E. coli
cccgtaaatgccatgaatcagccta

SEQ ID NO: 42744 - DNA, 25 bp, E. coli
cgtaaatgccttcaatcagcctatt

SEQ ID NO: 42745 - DNA, 25 bp, E. coli
cccgtaaatgccttgaatcagccta

SEQ ID NO: 42746 - DNA, 25 bp, E. coli
cgtaaatgccttgaatcagcctatt

SEQ ID NO: 42747 - DNA, 25 bp, E. coli
caggcgacaaatggcgaagccagaa

SEQ ID NO: 42748 - DNA, 25 bp, E. coli
caggcgacaaatcgcgaagccagaa

SEQ ID NO: 42749 - DNA, 25 bp, E. coli
aaacgattatctccatttacccagc

SEQ ID NO: 42750 - DNA, 25 bp, E. coli
aaacgattatctgcatttacccagc

SEQ ID NO: 42751 - DNA, 25 bp, E. coli
tatctgcatttagccagcttaaata

SEQ ID NO: 42752 - DNA, 25 bp, E. coli
tatctgcatttacccagcttaaata

SEQ ID NO: 42753 - DNA, 25 bp, E. coli
tgatgcaggcgacaaatcgcgaagc

SEQ ID NO: 42754 - DNA, 25 bp, E. coli
tgcaggcgacaattcgcgaagccag

SEQ ID NO: 42755 - DNA, 25 bp, E. coli
tgatgcaggcgagaaatcgcgaagc

SEQ ID NO: 42756 - DNA, 25 bp, E. coli
tgcaggcgacaaatcgcgaagccag

SEQ ID NO: 42757 - DNA, 25 bp, E. coli
gccagaaaacgattatctgcattta

SEQ ID NO: 42758 - DNA, 25 bp, E. coli
gccagaaaacgaatatctgcattta

SEQ ID NO: 42759 - DNA, 25 bp, E. coli
cgaagccagaaaacgattatctgca

SEQ ID NO: 42760 - DNA, 25 bp, E. coli
cgaagccagaaatcgattatctgca

SEQ ID NO: 42761 - DNA, 25 bp, E. coli
gattatctgcatttacccagcttaa

SEQ ID NO: 42762 - DNA, 25 bp, E. coli
gattatctgcatatacccagcttaa

SEQ ID NO: 42763 - DNA, 25 bp, E. coli
ggtgatgcaggccacaaatcgcgaa

SEQ ID NO: 42764 - DNA, 25 bp, E. coli
ggtgatgcaggcgacaaatcgcgaa

SEQ ID NO: 42765 - DNA, 25 bp, E. coli
gatgcaggcgacaaatcgcgaagcc

SEQ ID NO: 42766 - DNA, 25 bp, E. coli
gatgcaggcgactaatcgcgaagcc

SEQ ID NO: 42767 - DNA, 25 bp, E. coli
gatggtgatgcacgcgacaaatcgc

SEQ ID NO: 42768 - DNA, 25 bp, E. coli
gatggtgatgcaggcgacaaatcgc

SEQ ID NO: 42769 - DNA, 25 bp, E. coli
caattggagcgcttcaggctggtga

SEQ ID NO: 42770 - DNA, 25 bp, E. coli
caattggagcgcatcaggctggtga

SEQ ID NO: 42771 - DNA, 25 bp, E. coli
tacattttaagtcggcaacgcgcag

SEQ ID NO: 42772 - DNA, 25 bp, E. coli
tacattttaagtgggcaacgcgcag

SEQ ID NO: 42773 - DNA, 25 bp, E. coli
actttttcctctggtgggcgcaccg

SEQ ID NO: 42774 - DNA, 25 bp, E. coli
actttttcctctcgtgggcgcaccg

SEQ ID NO: 42775 - DNA, 25 bp, E. coli
tacgctgacagttcgcaaagagagc

SEQ ID NO: 42776 - DNA, 25 bp, E. coli
tacgctgacagtacgcaaagagagc

SEQ ID NO: 42777 - DNA, 25 bp, E. coli
tcatattgctcgatgccatggcgtc

SEQ ID NO: 42778 - DNA, 25 bp, E. coli
tcatattgctcgttgccatggcgtc

SEQ ID NO: 42779 - DNA, 25 bp, E. coli
gctggaaatgattgccctcacccgt

SEQ ID NO: 42780 - DNA, 25 bp, E. coli
gctggaaatgatagccctcacccgt

SEQ ID NO: 42781 - DNA, 25 bp, E. coli
gaagcactctgggactggtcggtta

SEQ ID NO: 42782 - DNA, 25 bp, E. coli
gaagcactctggcactggtcggtta

SEQ ID NO: 42783 - DNA, 25 bp, E. coli
cgttctttaagcgatggcgactgcg

SEQ ID NO: 42784 - DNA, 25 bp, E. coli
cgatttaaccggctgtgcgctggca

SEQ ID NO: 42785 - DNA, 25 bp, E. coli
cgttctttaagccatggcgactgcg

SEQ ID NO: 42786 - DNA, 25 bp, E. coli
cgatttaaccgggtgtgcgctggca

SEQ ID NO: 42787 - DNA, 25 bp, E. coli
tggagttcaccggaccactggcggt

SEQ ID NO: 42788 - DNA, 25 bp, E. coli
tggagttcaccgcaccactggcggt

SEQ ID NO: 42789 - DNA, 25 bp, E. coli
gaccgctctgccttattcgctggaa

SEQ ID NO: 42790 - DNA, 25 bp, E. coli
gaccgctctgccatattcgctggaa

SEQ ID NO: 42791 - DNA, 25 bp, E. coli
tattaaagcttacagcactgggagc

SEQ ID NO: 42792 - DNA, 25 bp, E. coli
tattaaagcttagagcactgggagc

SEQ ID NO: 42793 - DNA, 25 bp, E. coli
ttatcgagagttcaaaaaagccgtc

SEQ ID NO: 42794 - DNA, 25 bp, E. coli
ttatcgagagttgaaaaaagccgtc

SEQ ID NO: 42795 - DNA, 25 bp, E. coli
tgggcgcagcaatgaaattaaacct

SEQ ID NO: 42796 - DNA, 25 bp, E. coli
tgggcgcagcaaagaaattaaacct

SEQ ID NO: 42797 - DNA, 25 bp, E. coli
tcgttccggaagttgacacgctgga

SEQ ID NO: 42798 - DNA, 25 bp, E. coli
tcgttccggaagatgacacgctgga

SEQ ID NO: 42799 - DNA, 25 bp, E. coli
ccaggctggaactaactcggtatca

SEQ ID NO: 42800 - DNA, 25 bp, E. coli
ccaggctggaacaaactcggtatca

SEQ ID NO: 42801 - DNA, 25 bp, E. coli
gaagaatatcaggttgtcacgcagc

SEQ ID NO: 42802 - DNA, 25 bp, E. coli
gaattaattgaatcgccggtatcca

SEQ ID NO: 42803 - DNA, 25 bp, E. coli
gaagaatatcagcttgtcacgcagc

SEQ ID NO: 42804 - DNA, 25 bp, E. coli
gaattaattgaaacgccggtatcca

SEQ ID NO: 42805 - DNA, 25 bp, E. coli
taagctcgggtaaggctgtcactgc

SEQ ID NO: 42806 - DNA, 25 bp, E. coli
taagctcgggtatggctgtcactgc

SEQ ID NO: 42807 - DNA, 25 bp, E. coli
tcaacaggcttctgtaatcagggcc

SEQ ID NO: 42808 - DNA, 25 bp, E. coli
tcaacaggcttcagtaatcagggcc

SEQ ID NO: 42809 - DNA, 25 bp, E. coli
gaggcctttccttacacccgatatg

SEQ ID NO: 42810 - DNA, 25 bp, E. coli
gatactccggtaggtgaaaaggacg

SEQ ID NO: 42811 - DNA, 25 bp, E. coli
gaggcctttcctaacacccgatatg

SEQ ID NO: 42812 - DNA, 25 bp, E. coli
gatactccggtacgtgaaaaggacg

SEQ ID NO: 42813 - DNA, 25 bp, E. coli
gaatacgacccgctccgagtttgat

SEQ ID NO: 42814 - DNA, 25 bp, E. coli
gaatacgacccggtccgagtttgat

SEQ ID NO: 42815 - DNA, 25 bp, E. coli
tatcctgagattactggtggcgaag

SEQ ID NO: 42816 - DNA, 25 bp, E. coli
tatcctgagatttctggtggcgaag

SEQ ID NO: 42817 - DNA, 25 bp, E. coli
tatatcggtgcaggtgatgatcgca

SEQ ID NO: 42818 - DNA, 25 bp, E. coli
tatatcggtgcacgtgatgatcgca

SEQ ID NO: 42819 - DNA, 25 bp, E. coli
tgtttttgagctccgcacgttgccg

SEQ ID NO: 42820 - DNA, 25 bp, E. coli
tgtttttgagctgcgcacgttgccg

SEQ ID NO: 42821 - DNA, 25 bp, E. coli
tgaccacgcagggatatacaggacg

SEQ ID NO: 42822 - DNA, 25 bp, E. coli
tgacatcatcccttaatagcgcggc

SEQ ID NO: 42823 - DNA, 25 bp, E. coli
tgacatcatcccataatagcgcggc

SEQ ID NO: 42824 - DNA, 25 bp, E. coli
tgaccacgcaggcatatacaggacg

SEQ ID NO: 42825 - DNA, 25 bp, E. coli
tgctgtccggctacaaagataaggt

SEQ ID NO: 42826 - DNA, 25 bp, E. coli
tgctgtccggcttcaaagataaggt

SEQ ID NO: 42827 - DNA, 25 bp, E. coli
cctttgattgatggcgtcgggcaga

SEQ ID NO: 42828 - DNA, 25 bp, E. coli
cctttgattgatcgcgtcgggcaga

SEQ ID NO: 42829 - DNA, 25 bp, E. coli
gcgttaaccgttcagcaagctggca

SEQ ID NO: 42830 - DNA, 25 bp, E. coli
gcatgtatgtcctgaccggaacgaa

SEQ ID NO: 42831 - DNA, 25 bp, E. coli
gcatgtatgtccagaccggaacgaa

SEQ ID NO: 42832 - DNA, 25 bp, E. coli
gcgttaaccgttgagcaagctggca

SEQ ID NO: 42833 - DNA, 25 bp, E. coli
gaagtgtcgctgacgttgttgacca

SEQ ID NO: 42834 - DNA, 25 bp, E. coli
gaagtgtcgctgtcgttgttgacca

SEQ ID NO: 42835 - DNA, 25 bp, E. coli
actattgatcaaacgccgtagcgcc

SEQ ID NO: 42836 - DNA, 25 bp, E. coli
actattgatcaatcgccgtagcgcc

SEQ ID NO: 42837 - DNA, 25 bp, E. coli
aaaacatcctgcgtgcgggtatgcg

SEQ ID NO: 42838 - DNA, 25 bp, E. coli
aactgcaaaacaacctgcgtgcggg

SEQ ID NO: 42839 - DNA, 25 bp, E. coli
aactgcaaaacatcctgcgtgcggg

SEQ ID NO: 42840 - DNA, 25 bp, E. coli
aaaacatcctgcctgcgggtatgcg

SEQ ID NO: 42841 - DNA, 25 bp, E. coli
tgaagcattcggttgccgtgagcag

SEQ ID NO: 42842 - DNA, 25 bp, E. coli
tgaagcattcggatgccgtgagcag

SEQ ID NO: 42843 - DNA, 25 bp, E. coli
tgccgtgagcagcataaaattgtcg

SEQ ID NO: 42844 - DNA, 25 bp, E. coli
tgccgtgagcaggataaaattgtcg

SEQ ID NO: 42845 - DNA, 25 bp, E. coli
ccaacgggtgaacaactgcaaaaca

SEQ ID NO: 42846 - DNA, 25 bp, E. coli
ccaacgggtgaagaactgcaaaaca

SEQ ID NO: 42847 - DNA, 25 bp, E. coli
gcaggataaaatagtcggttttctc

SEQ ID NO: 42848 - DNA, 25 bp, E. coli
gcaggataaaattgtcggttttctc

SEQ ID NO: 42849 - DNA, 25 bp, E. coli
cggtcatggcgaagcaaatggcagc

SEQ ID NO: 42850 - DNA, 25 bp, E. coli
cggtcatggcgatgcaaatggcagc

SEQ ID NO: 42851 - DNA, 25 bp, E. coli
tggatgcactcgaactattgatcaa

SEQ ID NO: 42852 - DNA, 25 bp, E. coli
ggaccataagtccatgcaaccgtgg

SEQ ID NO: 42853 - DNA, 25 bp, E. coli
tggatgcactcgtactattgatcaa

SEQ ID NO: 42854 - DNA, 25 bp, E. coli
ggaccataagtcgatgcaaccgtgg

SEQ ID NO: 42855 - DNA, 25 bp, E. coli
gatgcgcggtcatggcgatgcaaat

SEQ ID NO: 42856 - DNA, 25 bp, E. coli
gatgcgcggtcaaggcgatgcaaat

SEQ ID NO: 42857 - DNA, 25 bp, E. coli
aatactaggtgtaagagcggcgccc

SEQ ID NO: 42858 - DNA, 25 bp, E. coli
aatgttgaattacctgccatacgcg

SEQ ID NO: 42859 - DNA, 25 bp, E. coli
caagaagcattttcaagcagtgatg

SEQ ID NO: 42860 - DNA, 25 bp, E. coli
aatactaggtgttagagcggcgccc

SEQ ID NO: 42861 - DNA, 25 bp, E. coli
aatgttgaattagctgccatacgcg

SEQ ID NO: 42862 - DNA, 25 bp, E. coli
caagaagcatttacaagcagtgatg

SEQ ID NO: 42863 - DNA, 25 bp, E. coli
taccttcgacctaagacacaccaga

SEQ ID NO: 42864 - DNA, 25 bp, E. coli
taccttcgaccttagacacaccaga

SEQ ID NO: 42865 - DNA, 25 bp, E. coli
ttttggctgcactatctgcggaggt

SEQ ID NO: 42866 - DNA, 25 bp, E. coli
ttttggctgcacaatctgcggaggt

SEQ ID NO: 42867 - DNA, 25 bp, E. coli
tctgataatctttgcattgaccgcc

SEQ ID NO: 42868 - DNA, 25 bp, E. coli
tcattgaacctaacagagatcgagt

SEQ ID NO: 42869 - DNA, 25 bp, E. coli
tctgataatcttagcattgaccgcc

SEQ ID NO: 42870 - DNA, 25 bp, E. coli
tcattgaacctatcagagatcgagt

SEQ ID NO: 42871 - DNA, 25 bp, E. coli
gccatacgcgtttctgaatcaaact

SEQ ID NO: 42872 - DNA, 25 bp, E. coli
gccatacgcgttactgaatcaaact

SEQ ID NO: 42873 - DNA, 25 bp, E. coli
gaagtcacaccggaatataaatgga

SEQ ID NO: 42874 - DNA, 25 bp, E. coli
gaagtcacaccgcaatataaatgga

SEQ ID NO: 42875 - DNA, 25 bp, E. coli
cattgaccgcctttatatagaagct

SEQ ID NO: 42876 - DNA, 25 bp, E. coli
cattgaccgcctatatatagaagct

SEQ ID NO: 42877 - DNA, 25 bp, E. coli
gagcggcgcccatagttacatcttt

SEQ ID NO: 42878 - DNA, 25 bp, E. coli
gagcggcgcccaaagttacatcttt

SEQ ID NO: 42879 - DNA, 25 bp, E. coli
catcttcgtgcacgcattcagcaag

SEQ ID NO: 42880 - DNA, 25 bp, E. coli
catcttcgtgcaggcattcagcaag

SEQ ID NO: 42881 - DNA, 25 bp, E. coli
tacatcttcgtgcaggcattcagca

SEQ ID NO: 42882 - DNA, 25 bp, E. coli
tacatcttcgtggaggcattcagca

SEQ ID NO: 42883 - DNA, 25 bp, E. coli
ttggctcgacgagcataacctgcaa

SEQ ID NO: 42884 - DNA, 25 bp, E. coli
ttggctcgacgaccataacctgcaa

SEQ ID NO: 42885 - DNA, 25 bp, E. coli
tcttcgtgcagggattcagcaaggg

SEQ ID NO: 42886 - DNA, 25 bp, E. coli
tcgtgcaggcattcagcaaggggct

SEQ ID NO: 42887 - DNA, 25 bp, E. coli
tcgtgcaggcatacagcaaggggct

SEQ ID NO: 42888 - DNA, 25 bp, E. coli
tcggcggttggcacgacgagcataa

SEQ ID NO: 42889 - DNA, 25 bp, E. coli
tcggcggttggctcgacgagcataa

SEQ ID NO: 42890 - DNA, 25 bp, E. coli
tcttcgtgcaggcattcagcaaggg

SEQ ID NO: 42891 - DNA, 25 bp, E. coli
gcggttggctcgacgagcataacct

SEQ ID NO: 42892 - DNA, 25 bp, E. coli
gctcgacgagcataacctgcaaatt

SEQ ID NO: 42893 - DNA, 25 bp, E. coli
gctcgacgagcaaaacctgcaaatt

SEQ ID NO: 42894 - DNA, 25 bp, E. coli
gcggttggctcgtcgagcataacct

SEQ ID NO: 42895 - DNA, 25 bp, E. coli
gatttacatcttggtgcaggcattc

SEQ ID NO: 42896 - DNA, 25 bp, E. coli
gatttacatcttcgtgcaggcattc

SEQ ID NO: 42897 - DNA, 25 bp, E. coli
ggctcgacgagcttaacctgcaaat

SEQ ID NO: 42898 - DNA, 25 bp, E. coli
ggctcgacgagcataacctgcaaat

SEQ ID NO: 42899 - DNA, 25 bp, E. coli
gatgatttacatgttcgtgcaggca

SEQ ID NO: 42900 - DNA, 25 bp, E. coli
gatgatttacatcttcgtgcaggca

SEQ ID NO: 42901 - DNA, 25 bp, E. coli
tgtcccttgaagaacaggcggcacg

SEQ ID NO: 42902 - DNA, 25 bp, E. coli
tgtcccttgaagtacaggcggcacg

SEQ ID NO: 42903 - DNA, 25 bp, E. coli
tgatgccgtcgcgagtgtcacacat

SEQ ID NO: 42904 - DNA, 25 bp, E. coli
tgcttctctggtagaagaggcctca

SEQ ID NO: 42905 - DNA, 25 bp, E. coli
tgcttctctggttgaagaggcctca

SEQ ID NO: 42906 - DNA, 25 bp, E. coli
tgatgccgtcgccagtgtcacacat

SEQ ID NO: 42907 - DNA, 25 bp, E. coli
tctgaaatggattaggtgacgcaac

SEQ ID NO: 42908 - DNA, 25 bp, E. coli
tctgaaatggataaggtgacgcaac

SEQ ID NO: 42909 - DNA, 25 bp, E. coli
gccagcgaagtagggacactcgcaa

SEQ ID NO: 42910 - DNA, 25 bp, E. coli
gccagcgaagtacggacactcgcaa

SEQ ID NO: 42911 - DNA, 25 bp, E. coli
gcataacgcaggttagccaggcgat

SEQ ID NO: 42912 - DNA, 25 bp, E. coli
gcataacgcaggatagccaggcgat

SEQ ID NO: 42913 - DNA, 25 bp, E. coli
gaaggcttgatctgtgaatcagtca

SEQ ID NO: 42914 - DNA, 25 bp, E. coli
gaaggcttgatcagtgaatcagtca

SEQ ID NO: 42915 - DNA, 25 bp, E. coli
gatttgccgttgtcgccagcgaagt

SEQ ID NO: 42916 - DNA, 25 bp, E. coli
gatttgccgttgacgccagcgaagt

SEQ ID NO: 42917 - DNA, 25 bp, E. coli
ggtgacgcaacagaatgcttctctg

SEQ ID NO: 42918 - DNA, 25 bp, E. coli
ggtgacgcaacacaatgcttctctg

SEQ ID NO: 42919 - DNA, 25 bp, E. coli
ggccgggaaaacgatgagcactatt

SEQ ID NO: 42920 - DNA, 25 bp, E. coli
ggccgggaaaaccatgagcactatt

SEQ ID NO: 42921 - DNA, 25 bp, E. coli
gagtgtcacacaaatcatgcaggaa

SEQ ID NO: 42922 - DNA, 25 bp, E. coli
gagtgtcacacatatcatgcaggaa

SEQ ID NO: 42923 - DNA, 25 bp, E. coli
taaagctgacgcagatcggatagct

SEQ ID NO: 42924 - DNA, 25 bp, E. coli
taaagctgacgctgatcggatagct

SEQ ID NO: 42925 - DNA, 25 bp, E. coli
aagttcactacatccgaaaaggcag

SEQ ID NO: 42926 - DNA, 25 bp, E. coli
aagttcactacaaccgaaaaggcag

SEQ ID NO: 42927 - DNA, 25 bp, E. coli
ttgaacctgtgaataaagctgacgc

SEQ ID NO: 42928 - DNA, 25 bp, E. coli
ttgaacctgtgattaaagctgacgc

SEQ ID NO: 42929 - DNA, 25 bp, E. coli
tgcgttccactcacaacaaagttca

SEQ ID NO: 42930 - DNA, 25 bp, E. coli
tgcgttccactctcaacaaagttca

SEQ ID NO: 42931 - DNA, 25 bp, E. coli
tcggatagctgaagagatcgaaaca

SEQ ID NO: 42932 - DNA, 25 bp, E. coli
tcggatagctgatgagatcgaaaca

SEQ ID NO: 42933 - DNA, 25 bp, E. coli
gaaaaggcagaagatgtatcgccag

SEQ ID NO: 42934 - DNA, 25 bp, E. coli
gaaaaggcagaacatgtatcgccag

SEQ ID NO: 42935 - DNA, 25 bp, E. coli
gtatcgccagcaagttccgctttaa

SEQ ID NO: 42936 - DNA, 25 bp, E. coli
gtatcgccagcatgttccgctttaa

SEQ ID NO: 42937 - DNA, 25 bp, E. coli
ggcactccctgcaaaatcctgcgtt

SEQ ID NO: 42938 - DNA, 25 bp, E. coli
ggcactccctgctaaatcctgcgtt

SEQ ID NO: 42939 - DNA, 25 bp, E. coli
taagaagttacgagccatacgcagg

SEQ ID NO: 42940 - DNA, 25 bp, E. coli
taagaagttacgtgccatacgcagg

SEQ ID NO: 42941 - DNA, 25 bp, E. coli
gagtgatttaccctaacacctggta

SEQ ID NO: 42942 - DNA, 25 bp, E. coli
gagtgatttaccgtaacacctggta

SEQ ID NO: 42943 - DNA, 25 bp, E. coli
gagatcgaaacaccagaacacatta

SEQ ID NO: 42944 - DNA, 25 bp, E. coli
gagatcgaaacagcagaacacatta

SEQ ID NO: 42945 - DNA, 25 bp, E. coli
caactacagaatggtgaacgacatc

SEQ ID NO: 42946 - DNA, 25 bp, E. coli
cagcaactacagaatggtgaacgac

SEQ ID NO: 42947 - DNA, 25 bp, E. coli
caactacagaatcgtgaacgacatc

SEQ ID NO: 42948 - DNA, 25 bp, E. coli
caggattcagcggttgtacccgttc

SEQ ID NO: 42949 - DNA, 25 bp, E. coli
caggattcagcgcttgtacccgttc

SEQ ID NO: 42950 - DNA, 25 bp, E. coli
cagcaactacagtatggtgaacgac

SEQ ID NO: 42951 - DNA, 25 bp, E. coli
tacagaatggtgaacgacatcatcc

SEQ ID NO: 42952 - DNA, 25 bp, E. coli
tacagaatggtgtacgacatcatcc

SEQ ID NO: 42953 - DNA, 25 bp, E. coli
aggattcagcgcatgtacccgttct

SEQ ID NO: 42954 - DNA, 25 bp, E. coli
aggattcagcgcttgtacccgttct

SEQ ID NO: 42955 - DNA, 25 bp, E. coli
agaatggtgaaccacatcatccggg

SEQ ID NO: 42956 - DNA, 25 bp, E. coli
agaatggtgaacgacatcatccggg

SEQ ID NO: 42957 - DNA, 25 bp, E. coli
tgatgacccgcaccaactacagaat

SEQ ID NO: 42958 - DNA, 25 bp, E. coli
tgatgacccgcagcaactacagaat

SEQ ID NO: 42959 - DNA, 25 bp, E. coli
tgacccgcagcaactacagaatggt

SEQ ID NO: 42960 - DNA, 25 bp, E. coli
tgacccgcagcatctacagaatggt

SEQ ID NO: 42961 - DNA, 25 bp, E. coli
cccgcagcaacttcagaatggtgaa

SEQ ID NO: 42962 - DNA, 25 bp, E. coli
cgcagcaactactgaatggtgaacg

SEQ ID NO: 42963 - DNA, 25 bp, E. coli
cgcagcaactacagaatggtgaacg

SEQ ID NO: 42964 - DNA, 25 bp, E. coli
cccgcagcaactacagaatggtgaa

SEQ ID NO: 42965 - DNA, 25 bp, E. coli
ggtgaacattcgcaggcgaaacgat

SEQ ID NO: 42966 - DNA, 25 bp, E. coli
ggtgaacattcggaggcgaaacgat

SEQ ID NO: 42967 - DNA, 25 bp, E. coli
cagcaagaaattggtcgatttgttg

SEQ ID NO: 42968 - DNA, 25 bp, E. coli
cagcaagaaattcgtcgatttgttg

SEQ ID NO: 42969 - DNA, 25 bp, E. coli
tgtttatgtacaggcccataccctg

SEQ ID NO: 42970 - DNA, 25 bp, E. coli
tgtttatgtacacgcccataccctg

SEQ ID NO: 42971 - DNA, 25 bp, E. coli
tgtcgccggagctgccgctgccggg

SEQ ID NO: 42972 - DNA, 25 bp, E. coli
tgtcgccggagcagccgctgccggg

SEQ ID NO: 42973 - DNA, 25 bp, E. coli
tgcaaacgcagcagcaagaaattcg

SEQ ID NO: 42974 - DNA, 25 bp, E. coli
tgcaaacgcagctgcaagaaattcg

SEQ ID NO: 42975 - DNA, 25 bp, E. coli
tcatggctgaatatctgcaaacgca

SEQ ID NO: 42976 - DNA, 25 bp, E. coli
tcatggctgaatttctgcaaacgca

SEQ ID NO: 42977 - DNA, 25 bp, E. coli
gcatactgccagaaaggagtgttaa

SEQ ID NO: 42978 - DNA, 25 bp, E. coli
gcatactgccagtaaggagtgttaa

SEQ ID NO: 42979 - DNA, 25 bp, E. coli
gaatatctgcaaacgcagcagcaag

SEQ ID NO: 42980 - DNA, 25 bp, E. coli
gaatatctgcaatcgcagcagcaag

SEQ ID NO: 42981 - DNA, 25 bp, E. coli
cgcagcagcaagaaattcgtcgatt

SEQ ID NO: 42982 - DNA, 25 bp, E. coli
cgcagcagcaagtaattcgtcgatt

SEQ ID NO: 42983 - DNA, 25 bp, E. coli
cgggcggcctgcttactgccagtaa

SEQ ID NO: 42984 - DNA, 25 bp, E. coli
cgggcggcctgcatactgccagtaa

SEQ ID NO: 42985 - DNA, 25 bp, E. coli
gatttgttgtttttgtacacgccca

SEQ ID NO: 42986 - DNA, 25 bp, E. coli
gatttgttgtttatgtacacgccca

SEQ ID NO: 42987 - DNA, 25 bp, E. coli
ggctgaatatctgcaaacgcagcag

SEQ ID NO: 42988 - DNA, 25 bp, E. coli
ggctgaatatctccaaacgcagcag

SEQ ID NO: 42989 - DNA, 25 bp, E. coli
caatatgattcaggtgcaacgcgct

SEQ ID NO: 42990 - DNA, 25 bp, E. coli
caatatgattcacgtgcaacgcgct

SEQ ID NO: 42991 - DNA, 25 bp, E. coli
ctttccaggtggatcagaacgggca

SEQ ID NO: 42992 - DNA, 25 bp, E. coli
ctttccaggtggttcagaacgggca

SEQ ID NO: 42993 - DNA, 25 bp, E. coli
tatggacgtcattgccaacaacctg

SEQ ID NO: 42994 - DNA, 25 bp, E. coli
tatggatcgccaaaacgggccttga

SEQ ID NO: 42995 - DNA, 25 bp, E. coli
tatggatcgccataacgggccttga

SEQ ID NO: 42996 - DNA, 25 bp, E. coli
tatggacgtcatagccaacaacctg

SEQ ID NO: 42997 - DNA, 25 bp, E. coli
ttgacgcccagctaaccaatatgga

SEQ ID NO: 42998 - DNA, 25 bp, E. coli
ttgacgcccagcaaaccaatatgga

SEQ ID NO: 42999 - DNA, 25 bp, E. coli
tgcgttaagtatcaccatcggtcgt

SEQ ID NO: 43000 - DNA, 25 bp, E. coli
tgcgttaagtatgaccatcggtcgt

SEQ ID NO: 43001 - DNA, 25 bp, E. coli
tccggttcaggtagggcagctcaat

SEQ ID NO: 43002 - DNA, 25 bp, E. coli
tccggttcaggttgggcagctcaat

SEQ ID NO: 43003 - DNA, 25 bp, E. coli
gcattggcgaaaacctctacaccga

SEQ ID NO: 43004 - DNA, 25 bp, E. coli
gcattggcgaaatcctctacaccga

SEQ ID NO: 43005 - DNA, 25 bp, E. coli
gaaacgtctaacctcaacgtggcgg

SEQ ID NO: 43006 - DNA, 25 bp, E. coli
gaaacgtctaacgtcaacgtggcgg

SEQ ID NO: 43007 - DNA, 25 bp, E. coli
cgcgggactgctgtatcaagggtat

SEQ ID NO: 43008 - DNA, 25 bp, E. coli
cgcgggactgctctatcaagggtat

SEQ ID NO: 43009 - DNA, 25 bp, E. coli
tgatggcgtggtcagcgtaacccaa

SEQ ID NO: 43010 - DNA, 25 bp, E. coli
tgatggcgtggtgagcgtaacccaa

SEQ ID NO: 43011 - DNA, 25 bp, E. coli
tgaacatagtgatcaccggagggac

SEQ ID NO: 43012 - DNA, 25 bp, E. coli
tgaacatagtgaacaccggagggac

SEQ ID NO: 43013 - DNA, 25 bp, E. coli
tgacaaaacgcgtgtgtgcctgctg

SEQ ID NO: 43014 - DNA, 25 bp, E. coli
tgacaaaacgcgagtgtgcctgctg

SEQ ID NO: 43015 - DNA, 25 bp, E. coli
tcggtactcattaccggctcggcaa

SEQ ID NO: 43016 - DNA, 25 bp, E. coli
tcggtactcatttccggctcggcaa

SEQ ID NO: 43017 - DNA, 25 bp, E. coli
gctggtacgatttagaagaggcgct

SEQ ID NO: 43018 - DNA, 25 bp, E. coli
gctggtacgattaagaagaggcgct

SEQ ID NO: 43019 - DNA, 25 bp, E. coli
gcgtctctgccaaagccgctggaat

SEQ ID NO: 43020 - DNA, 25 bp, E. coli
gcgtctctgccatagccgctggaat

SEQ ID NO: 43021 - DNA, 25 bp, E. coli
gctggaatatcacgcaaaaactggt

SEQ ID NO: 43022 - DNA, 25 bp, E. coli
gctggaatatcaggcaaaaactggt

SEQ ID NO: 43023 - DNA, 25 bp, E. coli
ctcgggtgacacaatggcaagggct

SEQ ID NO: 43024 - DNA, 25 bp, E. coli
ctcgggtgacactatggcaagggct

SEQ ID NO: 43025 - DNA, 25 bp, E. coli
gatttgattaatcccagcgacacgc

SEQ ID NO: 43026 - DNA, 25 bp, E. coli
gatttgattaatgccagcgacacgc

SEQ ID NO: 43027 - DNA, 25 bp, E. coli
gtattctcggtaaaatgctgccgcc

SEQ ID NO: 43028 - DNA, 25 bp, E. coli
gtattctcggtataatgctgccgcc

SEQ ID NO: 43029 - DNA, 25 bp, E. coli
tggactcacgaggaaaaagagcgtc

SEQ ID NO: 43030 - DNA, 25 bp, E. coli
tggactcacgagcaaaaagagcgtc

SEQ ID NO: 43031 - DNA, 25 bp, E. coli
gatgcggtaatctacctggccggag

SEQ ID NO: 43032 - DNA, 25 bp, E. coli
gatgcggtaatcaacctggccggag

SEQ ID NO: 43033 - DNA, 25 bp, E. coli
aagtgtggaagatgttgcccgtcgc

SEQ ID NO: 43034 - DNA, 25 bp, E. coli
aagtgtggaagaagttgcccgtcgc

SEQ ID NO: 43035 - DNA, 25 bp, E. coli
cacggtctggctcatgaaaacgaag

SEQ ID NO: 43036 - DNA, 25 bp, E. coli
cacggtctggctgatgaaaacgaag

SEQ ID NO: 43037 - DNA, 25 bp, E. coli
taccctttgaccgagtgcgtgatga

SEQ ID NO: 43038 - DNA, 25 bp, E. coli
taccctttgacccagtgcgtgatga

SEQ ID NO: 43039 - DNA, 25 bp, E. coli
tattcgcgttcaagtggtaagccgg

SEQ ID NO: 43040 - DNA, 25 bp, E. coli
tattcgcgttcatgtggtaagccgg

SEQ ID NO: 43041 - DNA, 25 bp, E. coli
tgttaagtttcctggcaagcccggg

SEQ ID NO: 43042 - DNA, 25 bp, E. coli
tgttaagtttccaggcaagcccggg

SEQ ID NO: 43043 - DNA, 25 bp, E. coli
cggtcatcgctttgcaatggctgca

SEQ ID NO: 43044 - DNA, 25 bp, E. coli
cggtcatcgcttagcaatggctgca

SEQ ID NO: 43045 - DNA, 25 bp, E. coli
gatagtcaaacggaccaaaccggtg

SEQ ID NO: 43046 - DNA, 25 bp, E. coli
gatagtcaaacgcaccaaaccggtg

SEQ ID NO: 43047 - DNA, 25 bp, E. coli
ggaaatttttgaccgcggtcacgcc

SEQ ID NO: 43048 - DNA, 25 bp, E. coli
ggctgcagctgcatcatcaagcgtt

SEQ ID NO: 43049 - DNA, 25 bp, E. coli
ggaaatttttgagcgcggtcacgcc

SEQ ID NO: 43050 - DNA, 25 bp, E. coli
ggaaaatcgacaacgcagcgtcggt

SEQ ID NO: 43051 - DNA, 25 bp, E. coli
ggaaaatcgacatcgcagcgtcggt

SEQ ID NO: 43052 - DNA, 25 bp, E. coli
ggctgcagctgcttcatcaagcgtt

SEQ ID NO: 43053 - DNA, 25 bp, E. coli
taagccgggaactggcataccagtg

SEQ ID NO: 43054 - DNA, 25 bp, E. coli
taagccgggaacaggcataccagtg

SEQ ID NO: 43055 - DNA, 25 bp, E. coli
caatatggtcgtggtgcggttacgc

SEQ ID NO: 43056 - DNA, 25 bp, E. coli
caatatggtcgtcgtgcggttacgc

SEQ ID NO: 43057 - DNA, 25 bp, E. coli
tatcgatgaattacagttggtgggc

SEQ ID NO: 43058 - DNA, 25 bp, E. coli
tatcgatgaatttcagttggtgggc

SEQ ID NO: 43059 - DNA, 25 bp, E. coli
tatcgacgcaaacaatgagaattac

SEQ ID NO: 43060 - DNA, 25 bp, E. coli
tatcgacgcaaagaatgagaattac

SEQ ID NO: 43061 - DNA, 25 bp, E. coli
tgatgactgcagaaggcccaacgtt

SEQ ID NO: 43062 - DNA, 25 bp, E. coli
tgatgactgcagtaggcccaacgtt

SEQ ID NO: 43063 - DNA, 25 bp, E. coli
ccaaaaaagcggactgcgccatgct

SEQ ID NO: 43064 - DNA, 25 bp, E. coli
ccaaaaaagcggtctgcgccatgct

SEQ ID NO: 43065 - DNA, 25 bp, E. coli
gcttacagaacgacatcaaccagcg

SEQ ID NO: 43066 - DNA, 25 bp, E. coli
gcttacagaacgtcatcaaccagcg

SEQ ID NO: 43067 - DNA, 25 bp, E. coli
gaaaatcagatagcggacatggcct

SEQ ID NO: 43068 - DNA, 25 bp, E. coli
gaaaatcagataccggacatggcct

SEQ ID NO: 43069 - DNA, 25 bp, E. coli
gacatggcctcttttgccagtggta

SEQ ID NO: 43070 - DNA, 25 bp, E. coli
gacatggcctctattgccagtggta

SEQ ID NO: 43071 - DNA, 25 bp, E. coli
cggttacgccgacattatcgacgca

SEQ ID NO: 43072 - DNA, 25 bp, E. coli
cggttacgccgagattatcgacgca

SEQ ID NO: 43073 - DNA, 25 bp, E. coli
tggatggatgaatttacccaacggg

SEQ ID NO: 43074 - DNA, 25 bp, E. coli
tggatggatgaaattacccaacggg

SEQ ID NO: 43075 - DNA, 25 bp, E. coli
tcaaccagcgactcggtatcgatga

SEQ ID NO: 43076 - DNA, 25 bp, E. coli
tcaaccagcgacacggtatcgatga

SEQ ID NO: 43077 - DNA, 25 bp, E. coli
aatagcgtcagtcgtgttaggcacg

SEQ ID NO: 43078 - DNA, 25 bp, E. coli
aatagcgtcagtggtgttaggcacg

SEQ ID NO: 43079 - DNA, 25 bp, E. coli
caattgaccgcacccggaaaacggt

SEQ ID NO: 43080 - DNA, 25 bp, E. coli
caattgaccgcagccggaaaacggt

SEQ ID NO: 43081 - DNA, 25 bp, E. coli
caaacggtcagagactaacgtactc

SEQ ID NO: 43082 - DNA, 25 bp, E. coli
caaacggtcagacactaacgtactc

SEQ ID NO: 43083 - DNA, 25 bp, E. coli
aacgtactcgtcttctctacgctag

SEQ ID NO: 43084 - DNA, 25 bp, E. coli
aacgtactcgtcatctctacgctag

SEQ ID NO: 43085 - DNA, 25 bp, E. coli
taggcgatgtccgacaattgaccgc

SEQ ID NO: 43086 - DNA, 25 bp, E. coli
taggcgatgtcccacaattgaccgc

SEQ ID NO: 43087 - DNA, 25 bp, E. coli
ttgttccatcatcggtaacgttgcg

SEQ ID NO: 43088 - DNA, 25 bp, E. coli
ttgttccatcatgggtaacgttgcg

SEQ ID NO: 43089 - DNA, 25 bp, E. coli
tgttaggcacggcattgaatgacag

SEQ ID NO: 43090 - DNA, 25 bp, E. coli
tgttaggcacgggattgaatgacag

SEQ ID NO: 43091 - DNA, 25 bp, E. coli
tctacgctagtgttaatcctgtccg

SEQ ID NO: 43092 - DNA, 25 bp, E. coli
tctacgctagtgataatcctgtccg

SEQ ID NO: 43093 - DNA, 25 bp, E. coli
taacgttgcgcgagacaaacggtca

SEQ ID NO: 43094 - DNA, 25 bp, E. coli
taacgttgcgcgtgacaaacggtca

SEQ ID NO: 43095 - DNA, 25 bp, E. coli
taatgcaaattataggcgatgtccc

SEQ ID NO: 43096 - DNA, 25 bp, E. coli
taatgcaaattaaaggcgatgtccc

SEQ ID NO: 43097 - DNA, 25 bp, E. coli
taatcctgtccgaatagcgtcagtg

SEQ ID NO: 43098 - DNA, 25 bp, E. coli
taatcctgtccgtatagcgtcagtg

SEQ ID NO: 43099 - DNA, 25 bp, E. coli
aattgctggtcgcttcgctggcgca

SEQ ID NO: 43100 - DNA, 25 bp, E. coli
aattgctggtcggttcgctggcgca

SEQ ID NO: 43101 - DNA, 25 bp, E. coli
tacgtgaccagcgagttgaaaaccg

SEQ ID NO: 43102 - DNA, 25 bp, E. coli
accgcatttcagataggcttcacga

SEQ ID NO: 43103 - DNA, 25 bp, E. coli
accgcatttcagttaggcttcacga

SEQ ID NO: 43104 - DNA, 25 bp, E. coli
tacgtgaccagccagttgaaaaccg

SEQ ID NO: 43105 - DNA, 25 bp, E. coli
tttagggttgtttgccagactggcg

SEQ ID NO: 43106 - DNA, 25 bp, E. coli
tttagggttgttagccagactggcg

SEQ ID NO: 43107 - DNA, 25 bp, E. coli
tgatgatgaccagtttcacccgcat

SEQ ID NO: 43108 - DNA, 25 bp, E. coli
tgctctgccctttaaactgatgctg

SEQ ID NO: 43109 - DNA, 25 bp, E. coli
tgctctgcccttaaaactgatgctg

SEQ ID NO: 43110 - DNA, 25 bp, E. coli
tgatgatgaccactttcacccgcat

SEQ ID NO: 43111 - DNA, 25 bp, E. coli
tgcgtaccagccattcagcgaagag

SEQ ID NO: 43112 - DNA, 25 bp, E. coli
tgcgtaccagcctttcagcgaagag

SEQ ID NO: 43113 - DNA, 25 bp, E. coli
gcggtggacaaagctggtcgctccc

SEQ ID NO: 43114 - DNA, 25 bp, E. coli
gcggtggacaaacctggtcgctccc

SEQ ID NO: 43115 - DNA, 25 bp, E. coli
gctggcgcagaggttttacagctag

SEQ ID NO: 43116 - DNA, 25 bp, E. coli
gctggcgcagagcttttacagctag

SEQ ID NO: 43117 - DNA, 25 bp, E. coli
gcgtgagtttatgctgcgtcagacc

SEQ ID NO: 43118 - DNA, 25 bp, E. coli
gcgtgagtttatcctgcgtcagacc

SEQ ID NO: 43119 - DNA, 25 bp, E. coli
tggtttattgcgaaacgcgctggga

SEQ ID NO: 43120 - DNA, 25 bp, E. coli
tggtttattgcgtaacgcgctggga

SEQ ID NO: 43121 - DNA, 25 bp, E. coli
aagtatatcatccttggagtgcccc

SEQ ID NO: 43122 - DNA, 25 bp, E. coli
aagtatatcatcgttggagtgcccc

SEQ ID NO: 43123 - DNA, 25 bp, E. coli
tatgatcctgatcactttgaacccg

SEQ ID NO: 43124 - DNA, 25 bp, E. coli
tatgatcctgatgactttgaacccg

SEQ ID NO: 43125 - DNA, 25 bp, E. coli
tttattagtcaatgaggctgcggga

SEQ ID NO: 43126 - DNA, 25 bp, E. coli
tttattagtcaaagaggctgcggga

SEQ ID NO: 43127 - DNA, 25 bp, E. coli
tgttgaaatgaatccacctgagctt

SEQ ID NO: 43128 - DNA, 25 bp, E. coli
tgttgaaatgaaaccacctgagctt

SEQ ID NO: 43129 - DNA, 25 bp, E. coli
tgaaggtgatactgaacatgcggca

SEQ ID NO: 43130 - DNA, 25 bp, E. coli
tgatgcagcgactacagaagagaca

SEQ ID NO: 43131 - DNA, 25 bp, E. coli
tgatgcagcgacaacagaagagaca

SEQ ID NO: 43132 - DNA, 25 bp, E. coli
tgaaggtgatacagaacatgcggca

SEQ ID NO: 43133 - DNA, 25 bp, E. coli
tcagagccagaggtaaggcggttct

SEQ ID NO: 43134 - DNA, 25 bp, E. coli
gctgtaaatgagatcgctgaacctc

SEQ ID NO: 43135 - DNA, 25 bp, E. coli
gctgtaaatgagttcgctgaacctc

SEQ ID NO: 43136 - DNA, 25 bp, E. coli
gaaactctcgcattgggcaacaggg

SEQ ID NO: 43137 - DNA, 25 bp, E. coli
gaaactctcgcaatgggcaacaggg

SEQ ID NO: 43138 - DNA, 25 bp, E. coli
cgtatgcaacgttcaacagatggga

SEQ ID NO: 43139 - DNA, 25 bp, E. coli
cgtatgcaacgtacaacagatggga

SEQ ID NO: 43140 - DNA, 25 bp, E. coli
tcagagccagagctaaggcggttct

SEQ ID NO: 43141 - DNA, 25 bp, E. coli
gagacattgctcactcttgcgttga

SEQ ID NO: 43142 - DNA, 25 bp, E. coli
gagacattgctctctcttgcgttga

SEQ ID NO: 43143 - DNA, 25 bp, E. coli
cactcagtgattggatcatcgtgta

SEQ ID NO: 43144 - DNA, 25 bp, E. coli
cactcagtgattcgatcatcgtgta

SEQ ID NO: 43145 - DNA, 25 bp, E. coli
tgtataggcgcaacggtcatcggcg

SEQ ID NO: 43146 - DNA, 25 bp, E. coli
tgattggatcatcgtgtataggcgc

SEQ ID NO: 43147 - DNA, 25 bp, E. coli
tgattggatcatggtgtataggcgc

SEQ ID NO: 43148 - DNA, 25 bp, E. coli
tgtataggcgcatcggtcatcggcg

SEQ ID NO: 43149 - DNA, 25 bp, E. coli
tcatcggcggtaattgtaacaactc

SEQ ID NO: 43150 - DNA, 25 bp, E. coli
tcatcggcggtatttgtaacaactc

SEQ ID NO: 43151 - DNA, 25 bp, E. coli
tcatcgtgtataggcgcatcggtca

SEQ ID NO: 43152 - DNA, 25 bp, E. coli
tcatcgtgtatacgcgcatcggtca

SEQ ID NO: 43153 - DNA, 25 bp, E. coli
gcactcagtgataggatcatcgtgt

SEQ ID NO: 43154 - DNA, 25 bp, E. coli
gcactcagtgattggatcatcgtgt

SEQ ID NO: 43155 - DNA, 25 bp, E. coli
cggtcatcggcggtatttgtaacaa

SEQ ID NO: 43156 - DNA, 25 bp, E. coli
cggtcatcggcgctatttgtaacaa

SEQ ID NO: 43157 - DNA, 25 bp, E. coli
gattggatcatcctgtataggcgca

SEQ ID NO: 43158 - DNA, 25 bp, E. coli
gatcatcgtgtaaaggcgcatcggt

SEQ ID NO: 43159 - DNA, 25 bp, E. coli
gattggatcatcgtgtataggcgca

SEQ ID NO: 43160 - DNA, 25 bp, E. coli
gatcatcgtgtataggcgcatcggt

SEQ ID NO: 43161 - DNA, 25 bp, E. coli
gtgtataggcgcatcggtcatcggc

SEQ ID NO: 43162 - DNA, 25 bp, E. coli
gtgtataggcgcttcggtcatcggc

SEQ ID NO: 43163 - DNA, 25 bp, E. coli
tggatcatcgtgaataggcgcatcg

SEQ ID NO: 43164 - DNA, 25 bp, E. coli
tggatcatcgtgtataggcgcatcg

SEQ ID NO: 43165 - DNA, 25 bp, E. coli
catcgtgctctctgcggaaagcgaa

SEQ ID NO: 43166 - DNA, 25 bp, E. coli
catcgtgctctcagcggaaagcgaa

SEQ ID NO: 43167 - DNA, 25 bp, E. coli
tacggcatcgtggtctctgcggaaa

SEQ ID NO: 43168 - DNA, 25 bp, E. coli
tacggcatcgtgctctctgcggaaa

SEQ ID NO: 43169 - DNA, 25 bp, E. coli
atgcgtcagcacattttctccgtcg

SEQ ID NO: 43170 - DNA, 25 bp, E. coli
acggtttagggcaggactctatcga

SEQ ID NO: 43171 - DNA, 25 bp, E. coli
acggtttagggctggactctatcga

SEQ ID NO: 43172 - DNA, 25 bp, E. coli
atgcgtcagcactttttctccgtcg

SEQ ID NO: 43173 - DNA, 25 bp, E. coli
ttatctggaaattaaaaacctcatc

SEQ ID NO: 43174 - DNA, 25 bp, E. coli
ttatctggaaataaaaaacctcatc

SEQ ID NO: 43175 - DNA, 25 bp, E. coli
tcatcagcacccacaatctggacga

SEQ ID NO: 43176 - DNA, 25 bp, E. coli
tctttcattgctgcgcaacgtgcct

SEQ ID NO: 43177 - DNA, 25 bp, E. coli
tcatcagcaccctcaatctggacga

SEQ ID NO: 43178 - DNA, 25 bp, E. coli
tctttcattgctccgcaacgtgcct

SEQ ID NO: 43179 - DNA, 25 bp, E. coli
gccactctggccactttcattgctg

SEQ ID NO: 43180 - DNA, 25 bp, E. coli
gccactctggcctctttcattgctg

SEQ ID NO: 43181 - DNA, 25 bp, E. coli
gcagtaaaaaatgagtacggcatcg

SEQ ID NO: 43182 - DNA, 25 bp, E. coli
gcagtaaaaaatcagtacggcatcg

SEQ ID NO: 43183 - DNA, 25 bp, E. coli
gaaattaaaaacgtcatcatcagca

SEQ ID NO: 43184 - DNA, 25 bp, E. coli
gaaattaaaaacctcatcatcagca

SEQ ID NO: 43185 - DNA, 25 bp, E. coli
ctggaactgggactggcagtaaaaa

SEQ ID NO: 43186 - DNA, 25 bp, E. coli
ctggaactgggagtggcagtaaaaa

SEQ ID NO: 43187 - DNA, 25 bp, E. coli
caattggtgattacggcagtgcggc

SEQ ID NO: 43188 - DNA, 25 bp, E. coli
caattggtgatttcggcagtgcggc

SEQ ID NO: 43189 - DNA, 25 bp, E. coli
caccgttctgtttaggcgttggagc

SEQ ID NO: 43190 - DNA, 25 bp, E. coli
caccgttctgttaaggcgttggagc

SEQ ID NO: 43191 - DNA, 25 bp, E. coli
catgaagagcggcatcgatcttgcc

SEQ ID NO: 43192 - DNA, 25 bp, E. coli
catgaagagcgggatcgatcttgcc

SEQ ID NO: 43193 - DNA, 25 bp, E. coli
tactgtatgcagctggaccacgggt

SEQ ID NO: 43194 - DNA, 25 bp, E. coli
tactgtatgcaggtggaccacgggt

SEQ ID NO: 43195 - DNA, 25 bp, E. coli
ttattaccgcccaatcccggagtgg

SEQ ID NO: 43196 - DNA, 25 bp, E. coli
ttattaccgccctatcccggagtgg

SEQ ID NO: 43197 - DNA, 25 bp, E. coli
tgtttgcgccagttcactacaacgg

SEQ ID NO: 43198 - DNA, 25 bp, E. coli
tgtttgcgccagatcactacaacgg

SEQ ID NO: 43199 - DNA, 25 bp, E. coli
tgaaatcaaaacgtgggtcgccgct

SEQ ID NO: 43200 - DNA, 25 bp, E. coli
tgaaatcaaaacctgggtcgccgct

SEQ ID NO: 43201 - DNA, 25 bp, E. coli
gaagccattggacgtttcaccagca

SEQ ID NO: 43202 - DNA, 25 bp, E. coli
gaagccattggaggtttcaccagca

SEQ ID NO: 43203 - DNA, 25 bp, E. coli
ctttgctggagctgggacgcataca

SEQ ID NO: 43204 - DNA, 25 bp, E. coli
ctttgctggagcagggacgcataca

SEQ ID NO: 43205 - DNA, 25 bp, E. coli
tggcgaaagccgatgcccatatgcg

SEQ ID NO: 43206 - DNA, 25 bp, E. coli
tggcgaaagccgttgcccatatgcg

SEQ ID NO: 43207 - DNA, 25 bp, E. coli
taacgaagagctttccgccattgcc

SEQ ID NO: 43208 - DNA, 25 bp, E. coli
taacgaagagctatccgccattgcc

SEQ ID NO: 43209 - DNA, 25 bp, E. coli
aagaagatgctgaaggactgcgcgc

SEQ ID NO: 43210 - DNA, 25 bp, E. coli
aagaagatgctgtaggactgcgcgc

SEQ ID NO: 43211 - DNA, 25 bp, E. coli
caaaaattacctcggcattgacggc

SEQ ID NO: 43212 - DNA, 25 bp, E. coli
caaaaattacctgggcattgacggc

SEQ ID NO: 43213 - DNA, 25 bp, E. coli
aaaactttggcctgtacaacgagcg

SEQ ID NO: 43214 - DNA, 25 bp, E. coli
aaaactttggccagtacaacgagcg

SEQ ID NO: 43215 - DNA, 25 bp, E. coli
aaaagaacaagtgctgcgtctgcgc

SEQ ID NO: 43216 - DNA, 25 bp, E. coli
aaaagaacaagtcctgcgtctgcgc

SEQ ID NO: 43217 - DNA, 25 bp, E. coli
tttgagaacattaccgccgctcctg

SEQ ID NO: 43218 - DNA, 25 bp, E. coli
tttgagaacatttccgccgctcctg

SEQ ID NO: 43219 - DNA, 25 bp, E. coli
tgtttcgtgccgatgaacgtcccgg

SEQ ID NO: 43220 - DNA, 25 bp, E. coli
tgtttcgtgccgttgaacgtcccgg

SEQ ID NO: 43221 - DNA, 25 bp, E. coli
tcgaccctacgcaggaacaatggca

SEQ ID NO: 43222 - DNA, 25 bp, E. coli
tcgaccctacgctggaacaatggca

SEQ ID NO: 43223 - DNA, 25 bp, E. coli
tctccgttgagaaaggctggttacc

SEQ ID NO: 43224 - DNA, 25 bp, E. coli
tctccgttgagataggctggttacc

SEQ ID NO: 43225 - DNA, 25 bp, E. coli
ccagcgtattcaccgtatgcgtcag

SEQ ID NO: 43226 - DNA, 25 bp, E. coli
ccagcgtattcagcgtatgcgtcag

SEQ ID NO: 43227 - DNA, 25 bp, E. coli
gctggccgaaccttaagagcgtctt

SEQ ID NO: 43228 - DNA, 25 bp, E. coli
gctggccgaaccataagagcgtctt

SEQ ID NO: 43229 - DNA, 25 bp, E. coli
gatcaatgacaaacgtgctcgcacg

SEQ ID NO: 43230 - DNA, 25 bp, E. coli
gatcaatgacaatcgtgctcgcacg

SEQ ID NO: 43231 - DNA, 25 bp, E. coli
catctccatttaatgtcatcagttt

SEQ ID NO: 43232 - DNA, 25 bp, E. coli
catctccatttattgtcatcagttt

SEQ ID NO: 43233 - DNA, 25 bp, E. coli
taccatctccatatattgtcatcag

SEQ ID NO: 43234 - DNA, 25 bp, E. coli
tattaatctctgattgccagatatc

SEQ ID NO: 43235 - DNA, 25 bp, E. coli
tattaatctctgtttgccagatatc

SEQ ID NO: 43236 - DNA, 25 bp, E. coli
ttttctcatgactataccatctcca

SEQ ID NO: 43237 - DNA, 25 bp, E. coli
ttttctcatgacaataccatctcca

SEQ ID NO: 43238 - DNA, 25 bp, E. coli
tgtcatcagttttataaaatttcca

SEQ ID NO: 43239 - DNA, 25 bp, E. coli
tgtcatcagtttaataaaatttcca

SEQ ID NO: 43240 - DNA, 25 bp, E. coli
tgcgttatctgaatgagacaaaaga

SEQ ID NO: 43241 - DNA, 25 bp, E. coli
tccatattaatctctgattgccaga

SEQ ID NO: 43242 - DNA, 25 bp, E. coli
tccatattaatcactgattgccaga

SEQ ID NO: 43243 - DNA, 25 bp, E. coli
tgcgttatctgattgagacaaaaga

SEQ ID NO: 43244 - DNA, 25 bp, E. coli
tctgattgccagttatcttataaat

SEQ ID NO: 43245 - DNA, 25 bp, E. coli
tctgattgagactaaagatatccat

SEQ ID NO: 43246 - DNA, 25 bp, E. coli
tctgattgagacaaaagatatccat

SEQ ID NO: 43247 - DNA, 25 bp, E. coli
tctgattgccagatatcttataaat

SEQ ID NO: 43248 - DNA, 25 bp, E. coli
gacaaaagatatgcatttttctcat

SEQ ID NO: 43249 - DNA, 25 bp, E. coli
gacaaaagatatccatttttctcat

SEQ ID NO: 43250 - DNA, 25 bp, E. coli
gattgagacaaatgatatccatttt

SEQ ID NO: 43251 - DNA, 25 bp, E. coli
gattgagacaaaagatatccatttt

SEQ ID NO: 43252 - DNA, 25 bp, E. coli
taccatctccatttattgtcatcag

SEQ ID NO: 43253 - DNA, 25 bp, E. coli
atatggccgatagcgcagagcgtct

SEQ ID NO: 43254 - DNA, 25 bp, E. coli
atatggccgataccgcagagcgtct

SEQ ID NO: 43255 - DNA, 25 bp, E. coli
aaagctgttcagcaaccgatcaaag

SEQ ID NO: 43256 - DNA, 25 bp, E. coli
aaagctgttcaggaaccgatcaaag

SEQ ID NO: 43257 - DNA, 25 bp, E. coli
tattgacggcggtgttgagttctcc

SEQ ID NO: 43258 - DNA, 25 bp, E. coli
tattgacggcggagttgagttctcc

SEQ ID NO: 43259 - DNA, 25 bp, E. coli
gccagaagcgtttgaagagagcgta

SEQ ID NO: 43260 - DNA, 25 bp, E. coli
gccagaagcgttagaagagagcgta

SEQ ID NO: 43261 - DNA, 25 bp, E. coli
gctgcacggtacagaggaaaacttc

SEQ ID NO: 43262 - DNA, 25 bp, E. coli
gctgcacggtactgaggaaaacttc

SEQ ID NO: 43263 - DNA, 25 bp, E. coli
gaattcccggagcagtttgagccgt

SEQ ID NO: 43264 - DNA, 25 bp, E. coli
gaatggctggaccatattctgacca

SEQ ID NO: 43265 - DNA, 25 bp, E. coli
gaatggctggacgatattctgacca

SEQ ID NO: 43266 - DNA, 25 bp, E. coli
gaattcccggaggagtttgagccgt

SEQ ID NO: 43267 - DNA, 25 bp, E. coli
cgatcaaagcagtagagaaaccggg

SEQ ID NO: 43268 - DNA, 25 bp, E. coli
cgatcaaagcagaagagaaaccggg

SEQ ID NO: 43269 - DNA, 25 bp, E. coli
gattcgttaaaagcagcgctggagg

SEQ ID NO: 43270 - DNA, 25 bp, E. coli
gattcgttaaaaccagcgctggagg

SEQ ID NO: 43271 - DNA, 25 bp, E. coli
ggcgtggcacttactgactggtcaa

SEQ ID NO: 43272 - DNA, 25 bp, E. coli
ggcgtggcactttctgactggtcaa

SEQ ID NO: 43273 - DNA, 25 bp, E. coli
tggcgcatccgcaggaaaaagctgt

SEQ ID NO: 43274 - DNA, 25 bp, E. coli
tggcgcatccgctggaaaaagctgt

SEQ ID NO: 43275 - DNA, 25 bp, E. coli
cagcaagcctgcgaagatgtcttcc

SEQ ID NO: 43276 - DNA, 25 bp, E. coli
cagcaagcctgccaagatgtcttcc

SEQ ID NO: 43277 - DNA, 25 bp, E. coli
tacctgcgacggtggcagcaatggc

SEQ ID NO: 43278 - DNA, 25 bp, E. coli
tacctgcgacggaggcagcaatggc

SEQ ID NO: 43279 - DNA, 25 bp, E. coli
tatcaaaactacctgcgcaaagccg

SEQ ID NO: 43280 - DNA, 25 bp, E. coli
tattcaaagtgagagcgcattgcag

SEQ ID NO: 43281 - DNA, 25 bp, E. coli
tatcaaaactacgtgcgcaaagccg

SEQ ID NO: 43282 - DNA, 25 bp, E. coli
tattcaaagtgacagcgcattgcag

SEQ ID NO: 43283 - DNA, 25 bp, E. coli
ttttaagcgccattggtattcccgc

SEQ ID NO: 43284 - DNA, 25 bp, E. coli
ttttaagcgccaatggtattcccgc

SEQ ID NO: 43285 - DNA, 25 bp, E. coli
tgggataacgcaaacggcgtcaccg

SEQ ID NO: 43286 - DNA, 25 bp, E. coli
tgggataacgcatacggcgtcaccg

SEQ ID NO: 43287 - DNA, 25 bp, E. coli
tgccttaccgtagcgccgtagagtt

SEQ ID NO: 43288 - DNA, 25 bp, E. coli
ccgtagagttgtccgcgctggaaca

SEQ ID NO: 43289 - DNA, 25 bp, E. coli
gaaagtctcaatcggctaagcgtcg

SEQ ID NO: 43290 - DNA, 25 bp, E. coli
gaaagtctcaatgggctaagcgtcg

SEQ ID NO: 43291 - DNA, 25 bp, E. coli
cgctatgtttcacccatgagtgtgg

SEQ ID NO: 43292 - DNA, 25 bp, E. coli
ccgtagagttgtgcgcgctggaaca

SEQ ID NO: 43293 - DNA, 25 bp, E. coli
cgctgaccgggcaagaaagtctcaa

SEQ ID NO: 43294 - DNA, 25 bp, E. coli
cgctgaccgggctagaaagtctcaa

SEQ ID NO: 43295 - DNA, 25 bp, E. coli
cgctatgtttcagccatgagtgtgg

SEQ ID NO: 43296 - DNA, 25 bp, E. coli
tgccttaccgtaccgccgtagagtt

SEQ ID NO: 43297 - DNA, 25 bp, E. coli
cactcgggagggttctactgttata

SEQ ID NO: 43298 - DNA, 25 bp, E. coli
cactcgggagggatctactgttata

SEQ ID NO: 43299 - DNA, 25 bp, E. coli
cttacaccggtcagaattttgctca

SEQ ID NO: 43300 - DNA, 25 bp, E. coli
cttacaccggtctgaattttgctca

SEQ ID NO: 43301 - DNA, 25 bp, E. coli
tactgttataggcattttagctcac

SEQ ID NO: 43302 - DNA, 25 bp, E. coli
tactgttatagggattttagctcac

SEQ ID NO: 43303 - DNA, 25 bp, E. coli
tcaacccttccgcactcgggagggt

SEQ ID NO: 43304 - DNA, 25 bp, E. coli
tcaacccttccggactcgggagggt

SEQ ID NO: 43305 - DNA, 25 bp, E. coli
tatggagaacattaaatcgcatgac

SEQ ID NO: 43306 - DNA, 25 bp, E. coli
tatggagaacataaaatcgcatgac

SEQ ID NO: 43307 - DNA, 25 bp, E. coli
tgaaacctctataacgtcaaccctt

SEQ ID NO: 43308 - DNA, 25 bp, E. coli
tgaaacctctattacgtcaaccctt

SEQ ID NO: 43309 - DNA, 25 bp, E. coli
tcgcatgacataacacgcatcctga

SEQ ID NO: 43310 - DNA, 25 bp, E. coli
tcgcatgacatatcacgcatcctga

SEQ ID NO: 43311 - DNA, 25 bp, E. coli
tctcttctattttgcaacaggagca

SEQ ID NO: 43312 - DNA, 25 bp, E. coli
tctcttctatttagcaacaggagca

SEQ ID NO: 43313 - DNA, 25 bp, E. coli
cgcatcctgatgctttaatgacaaa

SEQ ID NO: 43314 - DNA, 25 bp, E. coli
cgcatcctgatggtttaatgacaaa

SEQ ID NO: 43315 - DNA, 25 bp, E. coli
gattttagctcactctttcaacgag

SEQ ID NO: 43316 - DNA, 25 bp, E. coli
gattttagctcagtctttcaacgag

SEQ ID NO: 43317 - DNA, 25 bp, E. coli
taagcaagtgcttacaccggtcaga

SEQ ID NO: 43318 - DNA, 25 bp, E. coli
taagcaagtgctaacaccggtcaga

SEQ ID NO: 43319 - DNA, 25 bp, E. coli
aatttttgtcgatccgttaggcaag

SEQ ID NO: 43320 - DNA, 25 bp, E. coli
aatggtgcatttgccgcgagtagaa

SEQ ID NO: 43321 - DNA, 25 bp, E. coli
aatttttgtcgaaccgttaggcaag

SEQ ID NO: 43322 - DNA, 25 bp, E. coli
aatggtgcatttcccgcgagtagaa

SEQ ID NO: 43323 - DNA, 25 bp, E. coli
cacaatggtgcaattgccgcgagta

SEQ ID NO: 43324 - DNA, 25 bp, E. coli
cacaatggtgcatttgccgcgagta

SEQ ID NO: 43325 - DNA, 25 bp, E. coli
catttgccgcgactagaagcgacgc

SEQ ID NO: 43326 - DNA, 25 bp, E. coli
catttgccgcgagtagaagcgacgc

SEQ ID NO: 43327 - DNA, 25 bp, E. coli
agtcacaatggtgcatttgccgcga

SEQ ID NO: 43328 - DNA, 25 bp, E. coli
agtcacaatggtccatttgccgcga

SEQ ID NO: 43329 - DNA, 25 bp, E. coli
tttgccgcgagttgaagcgacgctg

SEQ ID NO: 43330 - DNA, 25 bp, E. coli
tttgccgcgagtagaagcgacgctg

SEQ ID NO: 43331 - DNA, 25 bp, E. coli
tcgcggagccgtagcggcggcactg

SEQ ID NO: 43332 - DNA, 25 bp, E. coli
tcgcggagccgttgcggcggcactg

SEQ ID NO: 43333 - DNA, 25 bp, E. coli
gaaatttttgtcgatccgttaggca

SEQ ID NO: 43334 - DNA, 25 bp, E. coli
gaaatttttgtccatccgttaggca

SEQ ID NO: 43335 - DNA, 25 bp, E. coli
cgttgattgctcgcggagccgttgc

SEQ ID NO: 43336 - DNA, 25 bp, E. coli
cgttgattgctcccggagccgttgc

SEQ ID NO: 43337 - DNA, 25 bp, E. coli
gatctggaaattattgtcgatccgt

SEQ ID NO: 43338 - DNA, 25 bp, E. coli
gatctggaaatttttgtcgatccgt

SEQ ID NO: 43339 - DNA, 25 bp, E. coli
tgtggcgcgtccgcaggtttttgct

SEQ ID NO: 43340 - DNA, 25 bp, E. coli
tgtggcgcgtccccaggtttttgct

SEQ ID NO: 43341 - DNA, 25 bp, E. coli
caactggcgcttcctggaacgggat

SEQ ID NO: 43342 - DNA, 25 bp, E. coli
caaagttcgccgactggaagatgac

SEQ ID NO: 43343 - DNA, 25 bp, E. coli
caaagttcgccgtctggaagatgac

SEQ ID NO: 43344 - DNA, 25 bp, E. coli
caactggcgcttgctggaacgggat

SEQ ID NO: 43345 - DNA, 25 bp, E. coli
actggaaatttcgtgactggctggc

SEQ ID NO: 43346 - DNA, 25 bp, E. coli
agagttacatcaccgcattagccag

SEQ ID NO: 43347 - DNA, 25 bp, E. coli
agagttacatcagcgcattagccag

SEQ ID NO: 43348 - DNA, 25 bp, E. coli
actggaaatttcctgactggctggc

SEQ ID NO: 43349 - DNA, 25 bp, E. coli
gccagtttctctttcacgaagccag

SEQ ID NO: 43350 - DNA, 25 bp, E. coli
gccagtttctctatcacgaagccag

SEQ ID NO: 43351 - DNA, 25 bp, E. coli
gaagccagcttactggacgactgga

SEQ ID NO: 43352 - DNA, 25 bp, E. coli
gcaactgccagaaaagcgaaaccga

SEQ ID NO: 43353 - DNA, 25 bp, E. coli
gcaactgccagataagcgaaaccga

SEQ ID NO: 43354 - DNA, 25 bp, E. coli
gaagccagcttagtggacgactgga

SEQ ID NO: 43355 - DNA, 25 bp, E. coli
gacaacctggatatttaatgacacc

SEQ ID NO: 43356 - DNA, 25 bp, E. coli
gaacgggatatcctcctggatcaag

SEQ ID NO: 43357 - DNA, 25 bp, E. coli
gaacgggatatcgtcctggatcaag

SEQ ID NO: 43358 - DNA, 25 bp, E. coli
gacaacctggatttttaatgacacc

SEQ ID NO: 43359 - DNA, 25 bp, E. coli
tggatcaagcggaaatcacttccca

SEQ ID NO: 43360 - DNA, 25 bp, E. coli
tggatcaagcggtaatcacttccca

SEQ ID NO: 43361 - DNA, 25 bp, E. coli
taatgacaccaatgaccagctggag

SEQ ID NO: 43362 - DNA, 25 bp, E. coli
taatgacaccaaagaccagctggag

SEQ ID NO: 43363 - DNA, 25 bp, E. coli
ttgttcgcctacaacctggctgttg

SEQ ID NO: 43364 - DNA, 25 bp, E. coli
ttgttcgcctactacctggctgttg

SEQ ID NO: 43365 - DNA, 25 bp, E. coli
tgatcgccgcgcacggcagctattt

SEQ ID NO: 43366 - DNA, 25 bp, E. coli
tgatcgccgcgctcggcagctattt

SEQ ID NO: 43367 - DNA, 25 bp, E. coli
tcgccgtgatggcttgttcgcctac

SEQ ID NO: 43368 - DNA, 25 bp, E. coli
tcgccgtgatgggttgttcgcctac

SEQ ID NO: 43369 - DNA, 25 bp, E. coli
tcattttggctcactgatcgccgcg

SEQ ID NO: 43370 - DNA, 25 bp, E. coli
tcattttggctctctgatcgccgcg

SEQ ID NO: 43371 - DNA, 25 bp, E. coli
ccagggcgttacagaaatagtgcgt

SEQ ID NO: 43372 - DNA, 25 bp, E. coli
cctggctgttgtcgttgatgatcat

SEQ ID NO: 43373 - DNA, 25 bp, E. coli
ccaacagtaaggcaaatctcgctgt

SEQ ID NO: 43374 - DNA, 25 bp, E. coli
cctggctgttgtggttgatgatcat

SEQ ID NO: 43375 - DNA, 25 bp, E. coli
ccaacagtaagggaaatctcgctgt

SEQ ID NO: 43376 - DNA, 25 bp, E. coli
ccagggcgttactgaaatagtgcgt

SEQ ID NO: 43377 - DNA, 25 bp, E. coli
gaaccaacagtaaggcaaatctcgc

SEQ ID NO: 43378 - DNA, 25 bp, E. coli
gaaccaacagtatggcaaatctcgc

SEQ ID NO: 43379 - DNA, 25 bp, E. coli
cgccgcgctcgggagctatttgcag

SEQ ID NO: 43380 - DNA, 25 bp, E. coli
cgccgcgctcggcagctatttgcag

SEQ ID NO: 43381 - DNA, 25 bp, E. coli
gggctgatctgaatgaaccaacagt

SEQ ID NO: 43382 - DNA, 25 bp, E. coli
gggctgatctgattgaaccaacagt

SEQ ID NO: 43383 - DNA, 25 bp, E. coli
gatgatcatttcgagggcgttacag

SEQ ID NO: 43384 - DNA, 25 bp, E. coli
gatgatcatttccagggcgttacag

SEQ ID NO: 43385 - DNA, 25 bp, E. coli
cacagaagtcgtggtgaacgttggc

SEQ ID NO: 43386 - DNA, 25 bp, E. coli
cagccgcagggtggcaatcagttca

SEQ ID NO: 43387 - DNA, 25 bp, E. coli
cagccgcagggtcgcaatcagttca

SEQ ID NO: 43388 - DNA, 25 bp, E. coli
cacagaagtcgtcgtgaacgttggc

SEQ ID NO: 43389 - DNA, 25 bp, E. coli
catgccaaatggaggcgcagttgcc

SEQ ID NO: 43390 - DNA, 25 bp, E. coli
catgccaaatggtggcgcagttgcc

SEQ ID NO: 43391 - DNA, 25 bp, E. coli
tgtgctgttcggcaaactggcagaa

SEQ ID NO: 43392 - DNA, 25 bp, E. coli
tgtgctgttcgggaaactggcagaa

SEQ ID NO: 43393 - DNA, 25 bp, E. coli
tcaggacccggaagtacgctacatg

SEQ ID NO: 43394 - DNA, 25 bp, E. coli
tctcgttggtaatctgggtcaggac

SEQ ID NO: 43395 - DNA, 25 bp, E. coli
tctcgttggtaaactgggtcaggac

SEQ ID NO: 43396 - DNA, 25 bp, E. coli
tcaggacccggatgtacgctacatg

SEQ ID NO: 43397 - DNA, 25 bp, E. coli
gccagcagaggcctaaacaaggtta

SEQ ID NO: 43398 - DNA, 25 bp, E. coli
gccagcagaggcgtaaacaaggtta

SEQ ID NO: 43399 - DNA, 25 bp, E. coli
gcgaatatctgcgtaaaggttctca

SEQ ID NO: 43400 - DNA, 25 bp, E. coli
gcgaatatctgcctaaaggttctca

SEQ ID NO: 43401 - DNA, 25 bp, E. coli
gcaatatcggtgctggtcagccgca

SEQ ID NO: 43402 - DNA, 25 bp, E. coli
gcaatatcggtggtggtcagccgca

SEQ ID NO: 43403 - DNA, 25 bp, E. coli
ggctacttccgattcctggcgtgat

SEQ ID NO: 43404 - DNA, 25 bp, E. coli
ggctacttccgaatcctggcgtgat

SEQ ID NO: 43405 - DNA, 25 bp, E. coli
taacgagccgccgatggactttgat

SEQ ID NO: 43406 - DNA, 25 bp, E. coli
taacgagccgcccatggactttgat

SEQ ID NO: 43407 - DNA, 25 bp, E. coli
aatggttgccatcccgattatgccg

SEQ ID NO: 43408 - DNA, 25 bp, E. coli
aagaaatggatctcgctagggcaga

SEQ ID NO: 43409 - DNA, 25 bp, E. coli
aagtatgtcgcttccaaagctgcgg

SEQ ID NO: 43410 - DNA, 25 bp, E. coli
aagaaatggatcacgctagggcaga

SEQ ID NO: 43411 - DNA, 25 bp, E. coli
aagtatgtcgctaccaaagctgcgg

SEQ ID NO: 43412 - DNA, 25 bp, E. coli
aatggttgccatgccgattatgccg

SEQ ID NO: 43413 - DNA, 25 bp, E. coli
cagaattacagcaggatggcgacgg

SEQ ID NO: 43414 - DNA, 25 bp, E. coli
cattttaatgactgccgcctgaagg

SEQ ID NO: 43415 - DNA, 25 bp, E. coli
caggccgggtacataggtgcgtcaa

SEQ ID NO: 43416 - DNA, 25 bp, E. coli
cagaattacagctggatggcgacgg

SEQ ID NO: 43417 - DNA, 25 bp, E. coli
cattttaatgacagccgcctgaagg

SEQ ID NO: 43418 - DNA, 25 bp, E. coli
caggccgggtacttaggtgcgtcaa

SEQ ID NO: 43419 - DNA, 25 bp, E. coli
tacgcggcaatatgttggcagagct

SEQ ID NO: 43420 - DNA, 25 bp, E. coli
tatgccgtcgaaggttactaccgcg

SEQ ID NO: 43421 - DNA, 25 bp, E. coli
tacgcggcaataagttggcagagct

SEQ ID NO: 43422 - DNA, 25 bp, E. coli
tatgccgtcgaacgttactaccgcg

SEQ ID NO: 43423 - DNA, 25 bp, E. coli
gcaactaatgtgcttcagcgcggcg

SEQ ID NO: 43424 - DNA, 25 bp, E. coli
gcaactaatgtggttcagcgcggcg

SEQ ID NO: 43425 - DNA, 25 bp, E. coli
gacattatttcttgcgtggcgcagg

SEQ ID NO: 43426 - DNA, 25 bp, E. coli
gacattatttctagcgtggcgcagg

SEQ ID NO: 43427 - DNA, 25 bp, E. coli
tcaagcggcggttattttctcatgg

SEQ ID NO: 43428 - DNA, 25 bp, E. coli
tcaagcggcggtaattttctcatgg

SEQ ID NO: 43429 - DNA, 25 bp, E. coli
aaaccgcggctcatgatgttcgtga

SEQ ID NO: 43430 - DNA, 25 bp, E. coli
aaaccgcggctcttgatgttcgtga

SEQ ID NO: 43431 - DNA, 25 bp, E. coli
tatgaatatggatatccgggagcgg

SEQ ID NO: 43432 - DNA, 25 bp, E. coli
tatggcaacgaatgagcaaaatctg

SEQ ID NO: 43433 - DNA, 25 bp, E. coli
tatggcaacgaaagagcaaaatctg

SEQ ID NO: 43434 - DNA, 25 bp, E. coli
tatgaatatggaaatccgggagcgg

SEQ ID NO: 43435 - DNA, 25 bp, E. coli
ttctgacctgcctccatctctgtgg

SEQ ID NO: 43436 - DNA, 25 bp, E. coli
ttctgacctgccaccatctctgtgg

SEQ ID NO: 43437 - DNA, 25 bp, E. coli
tgttcgtgaggatacatccggcgcg

SEQ ID NO: 43438 - DNA, 25 bp, E. coli
tgttcgtgaggaaacatccggcgcg

SEQ ID NO: 43439 - DNA, 25 bp, E. coli
ccggcgatgatgtacaggttatgaa

SEQ ID NO: 43440 - DNA, 25 bp, E. coli
ccggcgatgatgaacaggttatgaa

SEQ ID NO: 43441 - DNA, 25 bp, E. coli
gcgttaacgcgcatcagagttctga

SEQ ID NO: 43442 - DNA, 25 bp, E. coli
gcgttaacgcgcttcagagttctga

SEQ ID NO: 43443 - DNA, 25 bp, E. coli
gaaacggcttgaagaactggccctg

SEQ ID NO: 43444 - DNA, 25 bp, E. coli
gaaacggcttgatgaactggccctg

SEQ ID NO: 43445 - DNA, 25 bp, E. coli
gatatatccgggagtgccgcagaga

SEQ ID NO: 43446 - DNA, 25 bp, E. coli
gatatatccgggtgtgccgcagaga

SEQ ID NO: 43447 - DNA, 25 bp, E. coli
gtcctcagatgcaaaaacacacgtt

SEQ ID NO: 43448 - DNA, 25 bp, E. coli
gtcctcagatgctaaaacacacgtt

SEQ ID NO: 43449 - DNA, 25 bp, E. coli
gaggaaatgcagacatccggcgatg

SEQ ID NO: 43450 - DNA, 25 bp, E. coli
gaggaaatgcagtcatccggcgatg

SEQ ID NO: 43451 - DNA, 25 bp, E. coli
cagataattttgcagcgcgcagcca

SEQ ID NO: 43452 - DNA, 25 bp, E. coli
catatttgctctttgtgataaagcc

SEQ ID NO: 43453 - DNA, 25 bp, E. coli
cagataattttggagcgcgcagcca

SEQ ID NO: 43454 - DNA, 25 bp, E. coli
catatttgctctatgtgataaagcc

SEQ ID NO: 43455 - DNA, 25 bp, E. coli
actgcaccagcgtctgcgtgctcga

SEQ ID NO: 43456 - DNA, 25 bp, E. coli
actgcaccagcgactgcgtgctcga

SEQ ID NO: 43457 - DNA, 25 bp, E. coli
tagccagggtttcagactatagctc

SEQ ID NO: 43458 - DNA, 25 bp, E. coli
tagccagggtttgagactatagctc

SEQ ID NO: 43459 - DNA, 25 bp, E. coli
tgataaagccaaatcgacacaagag

SEQ ID NO: 43460 - DNA, 25 bp, E. coli
tgataaagccaattcgacacaagag

SEQ ID NO: 43461 - DNA, 25 bp, E. coli
tcgacacaagagaagtgaaataatc

SEQ ID NO: 43462 - DNA, 25 bp, E. coli
tcgacacaagagtagtgaaataatc

SEQ ID NO: 43463 - DNA, 25 bp, E. coli
gctcgctatatataagcatcgcaag

SEQ ID NO: 43464 - DNA, 25 bp, E. coli
gctcgctatataaaagcatcgcaag

SEQ ID NO: 43465 - DNA, 25 bp, E. coli
gactatagctcggattaaaaaacgg

SEQ ID NO: 43466 - DNA, 25 bp, E. coli
gactatagctcgcattaaaaaacgg

SEQ ID NO: 43467 - DNA, 25 bp, E. coli
cgcaagaataactttagccagggtt

SEQ ID NO: 43468 - DNA, 25 bp, E. coli
cgcaagaataacattagccagggtt

SEQ ID NO: 43469 - DNA, 25 bp, E. coli
gcgactgcgtgctcgaaaggagtta

SEQ ID NO: 43470 - DNA, 25 bp, E. coli
gcgactgcgtgcacgaaaggagtta

SEQ ID NO: 43471 - DNA, 25 bp, E. coli
taagaaaaggttaaaaacagcagat

SEQ ID NO: 43472 - DNA, 25 bp, E. coli
taagaaaaggtttaaaacagcagat

SEQ ID NO: 43473 - DNA, 25 bp, E. coli
aatgcatccgtgagggacgatccgc

SEQ ID NO: 43474 - DNA, 25 bp, E. coli
aatgcatccgtgtgggacgatccgc

SEQ ID NO: 43475 - DNA, 25 bp, E. coli
caacgatctggaactggtggctgtc

SEQ ID NO: 43476 - DNA, 25 bp, E. coli
caacagctgcgtgaacaggtgacca

SEQ ID NO: 43477 - DNA, 25 bp, E. coli
caacagctgcgtcaacaggtgacca

SEQ ID NO: 43478 - DNA, 25 bp, E. coli
caacgatctggatctggtggctgtc

SEQ ID NO: 43479 - DNA, 25 bp, E. coli
catgtgatgtgccaaaaaccgcccg

SEQ ID NO: 43480 - DNA, 25 bp, E. coli
catgtgatgtgcgaaaaaccgcccg

SEQ ID NO: 43481 - DNA, 25 bp, E. coli
tagctttcaaaagatcggcacgcaa

SEQ ID NO: 43482 - DNA, 25 bp, E. coli
tagctttcaaaacatcggcacgcaa

SEQ ID NO: 43483 - DNA, 25 bp, E. coli
tatcaatccgcagaaacagggacgc

SEQ ID NO: 43484 - DNA, 25 bp, E. coli
tatcaatccgcacaaacagggacgc

SEQ ID NO: 43485 - DNA, 25 bp, E. coli
tgggagagattttcgttaccaccgc

SEQ ID NO: 43486 - DNA, 25 bp, E. coli
gaagattcgctgattggcaccattg

SEQ ID NO: 43487 - DNA, 25 bp, E. coli
gaattaatgacgctgatgcaacggg

SEQ ID NO: 43488 - DNA, 25 bp, E. coli
gaagattcgctgtttggcaccattg

SEQ ID NO: 43489 - DNA, 25 bp, E. coli
gaattaatgacggtgatgcaacggg

SEQ ID NO: 43490 - DNA, 25 bp, E. coli
gggaaatgtgcgttaccgcgcgcaa

SEQ ID NO: 43491 - DNA, 25 bp, E. coli
gggaaatgtgcgataccgcgcgcaa

SEQ ID NO: 43492 - DNA, 25 bp, E. coli
tgggagagatttacgttaccaccgc

SEQ ID NO: 43493 - DNA, 25 bp, E. coli
taacggcggcatactgtggctggaa

SEQ ID NO: 43494 - DNA, 25 bp, E. coli
taacggcggcattctgtggctggaa

SEQ ID NO: 43495 - DNA, 25 bp, E. coli
acgccgccctcttaagtcaaattga

SEQ ID NO: 43496 - DNA, 25 bp, E. coli
acgccgccctctaaagtcaaattga

SEQ ID NO: 43497 - DNA, 25 bp, E. coli
aaacgaagcgggagaacaggatgat

SEQ ID NO: 43498 - DNA, 25 bp, E. coli
aaacgaagcgggtgaacaggatgat

SEQ ID NO: 43499 - DNA, 25 bp, E. coli
tattattgcgattaataagcaaccg

SEQ ID NO: 43500 - DNA, 25 bp, E. coli
tattattgcgataaataagcaaccg

SEQ ID NO: 43501 - DNA, 25 bp, E. coli
tgtttattaatgtagcacgccgccc

SEQ ID NO: 43502 - DNA, 25 bp, E. coli
tgtttattaatgaagcacgccgccc

SEQ ID NO: 43503 - DNA, 25 bp, E. coli
tcgtgacattaatggtaatcgctac

SEQ ID NO: 43504 - DNA, 25 bp, E. coli
tcgtgacattaaaggtaatcgctac

SEQ ID NO: 43505 - DNA, 25 bp, E. coli
tctacgggcaggatgactggattta

SEQ ID NO: 43506 - DNA, 25 bp, E. coli
tctacgggcaggttgactggattta

SEQ ID NO: 43507 - DNA, 25 bp, E. coli
gctgggcattcgctttttacaacgt

SEQ ID NO: 43508 - DNA, 25 bp, E. coli
gctgggcattcggtttttacaacgt

SEQ ID NO: 43509 - DNA, 25 bp, E. coli
gataatgtgtgatgttctacgggca

SEQ ID NO: 43510 - DNA, 25 bp, E. coli
gataatgtgtgaagttctacgggca

SEQ ID NO: 43511 - DNA, 25 bp, E. coli
taagcaaccgaaagcccagctgttt

SEQ ID NO: 43512 - DNA, 25 bp, E. coli
tcaacacgatgattagacagccaat

SEQ ID NO: 43513 - DNA, 25 bp, E. coli
tcaacacgatgaatagacagccaat

SEQ ID NO: 43514 - DNA, 25 bp, E. coli
taagcaaccgaatgcccagctgttt

SEQ ID NO: 43515 - DNA, 25 bp, E. coli
taagcaaataatgccttttcgtgac

SEQ ID NO: 43516 - DNA, 25 bp, E. coli
taagcaaataatcccttttcgtgac

SEQ ID NO: 43517 - DNA, 25 bp, E. coli
catttcaataagtttcaagaggtta

SEQ ID NO: 43518 - DNA, 25 bp, E. coli
tgggcaattttcgacccccatttca

SEQ ID NO: 43519 - DNA, 25 bp, E. coli
tgtgcagtcctggtcgtttgctgat

SEQ ID NO: 43520 - DNA, 25 bp, E. coli
tgctgattccgcaagactgcctgtt

SEQ ID NO: 43521 - DNA, 25 bp, E. coli
tgctgattccgctagactgcctgtt

SEQ ID NO: 43522 - DNA, 25 bp, E. coli
tgctatgattgcgtttatccgtggg

SEQ ID NO: 43523 - DNA, 25 bp, E. coli
tgctatgattgcctttatccgtggg

SEQ ID NO: 43524 - DNA, 25 bp, E. coli
gcctttatccgtgggcaattttcca

SEQ ID NO: 43525 - DNA, 25 bp, E. coli
gcctttatccgtcggcaattttcca

SEQ ID NO: 43526 - DNA, 25 bp, E. coli
gcaagactgcctcttctgctatgat

SEQ ID NO: 43527 - DNA, 25 bp, E. coli
gcaagactgcctgttctgctatgat

SEQ ID NO: 43528 - DNA, 25 bp, E. coli
gactgcctgttcagctatgattgcc

SEQ ID NO: 43529 - DNA, 25 bp, E. coli
gactgcctgttctgctatgattgcc

SEQ ID NO: 43530 - DNA, 25 bp, E. coli
ccccatttcaattagtttcaagagg

SEQ ID NO: 43531 - DNA, 25 bp, E. coli
ccccatttcaataagtttcaagagg

SEQ ID NO: 43532 - DNA, 25 bp, E. coli
catttcaataagattcaagaggtta

SEQ ID NO: 43533 - DNA, 25 bp, E. coli
gattccgcaagactgcctgttctgc

SEQ ID NO: 43534 - DNA, 25 bp, E. coli
gattccgcaagagtgcctgttctgc

SEQ ID NO: 43535 - DNA, 25 bp, E. coli
gtcctgctcgtttgctgattccgca

SEQ ID NO: 43536 - DNA, 25 bp, E. coli
gtcctgctcgttagctgattccgca

SEQ ID NO: 43537 - DNA, 25 bp, E. coli
tgggcaattttccacccccatttca

SEQ ID NO: 43538 - DNA, 25 bp, E. coli
tgtgcagtcctgctcgtttgctgat

SEQ ID NO: 43539 - DNA, 25 bp, E. coli
aatattactaatctgcatggtcggg

SEQ ID NO: 43540 - DNA, 25 bp, E. coli
aatattactaatgtgcatggtcggg

SEQ ID NO: 43541 - DNA, 25 bp, E. coli
tactctgttaccttgcgaaaggtgc

SEQ ID NO: 43542 - DNA, 25 bp, E. coli
tactctgttaccatgcgaaaggtgc

SEQ ID NO: 43543 - DNA, 25 bp, E. coli
cacatgttcatttgttgccgtttta

SEQ ID NO: 43544 - DNA, 25 bp, E. coli
cacatgttcattagttgccgtttta

SEQ ID NO: 43545 - DNA, 25 bp, E. coli
tgctgagtatgtccgcctggatgcc

SEQ ID NO: 43546 - DNA, 25 bp, E. coli
tgctgagtatgtgcgcctggatgcc

SEQ ID NO: 43547 - DNA, 25 bp, E. coli
ccttgcgaaaggagctgagtatgtc

SEQ ID NO: 43548 - DNA, 25 bp, E. coli
ccttgcgaaaggtgctgagtatgtc

SEQ ID NO: 43549 - DNA, 25 bp, E. coli
gctgatggtaatagtctgactggat

SEQ ID NO: 43550 - DNA, 25 bp, E. coli
gctgatggtaattgtctgactggat

SEQ ID NO: 43551 - DNA, 25 bp, E. coli
cgtattccaagaagtaacgctgatg

SEQ ID NO: 43552 - DNA, 25 bp, E. coli
cgtattccaagatgtaacgctgatg

SEQ ID NO: 43553 - DNA, 25 bp, E. coli
ctaatctgcatggtcgggatctgat

SEQ ID NO: 43554 - DNA, 25 bp, E. coli
ctaatctgcatgctcgggatctgat

SEQ ID NO: 43555 - DNA, 25 bp, E. coli
tggcatcgggctaaacccgctacgg

SEQ ID NO: 43556 - DNA, 25 bp, E. coli
tggcatcgggcttaacccgctacgg

SEQ ID NO: 43557 - DNA, 25 bp, E. coli
taacgctgatggaaattgtctgact

SEQ ID NO: 43558 - DNA, 25 bp, E. coli
taacgctgatggtaattgtctgact

SEQ ID NO: 43559 - DNA, 25 bp, E. coli
gatgttttactctgttaccttgcga

SEQ ID NO: 43560 - DNA, 25 bp, E. coli
gatgttttactcagttaccttgcga

SEQ ID NO: 43561 - DNA, 25 bp, E. coli
attggtgacgtggtgaacaacccgg

SEQ ID NO: 43562 - DNA, 25 bp, E. coli
attggtgacgtgctgaacaacccgg

SEQ ID NO: 43563 - DNA, 25 bp, E. coli
taccgctggtatttggcgaaaagtg

SEQ ID NO: 43564 - DNA, 25 bp, E. coli
taccgctggtatatggcgaaaagtg

SEQ ID NO: 43565 - DNA, 25 bp, E. coli
tatttggcgaaatgtggaacagcat

SEQ ID NO: 43566 - DNA, 25 bp, E. coli
tatttggcgaaaagtggaacagcat

SEQ ID NO: 43567 - DNA, 25 bp, E. coli
ttctcgctggcgactgttgcgccga

SEQ ID NO: 43568 - DNA, 25 bp, E. coli
ttctcgctggcgtctgttgcgccga

SEQ ID NO: 43569 - DNA, 25 bp, E. coli
tggtgacgtgctcaacaacccggac

SEQ ID NO: 43570 - DNA, 25 bp, E. coli
tggtgacgtgctgaacaacccggac

SEQ ID NO: 43571 - DNA, 25 bp, E. coli
tgtaccgctggtttttggcgaaaag

SEQ ID NO: 43572 - DNA, 25 bp, E. coli
tgatctcattggtgacgtgctgaac

SEQ ID NO: 43573 - DNA, 25 bp, E. coli
tgtaccgctggtatttggcgaaaag

SEQ ID NO: 43574 - DNA, 25 bp, E. coli
tgatctcattggagacgtgctgaac

SEQ ID NO: 43575 - DNA, 25 bp, E. coli
tcattggtgacgagctgaacaaccc

SEQ ID NO: 43576 - DNA, 25 bp, E. coli
tcattggtgacgtgctgaacaaccc

SEQ ID NO: 43577 - DNA, 25 bp, E. coli
gctggcgtctgttgcgccgaactta

SEQ ID NO: 43578 - DNA, 25 bp, E. coli
gctggcgtctgtagcgccgaactta

SEQ ID NO: 43579 - DNA, 25 bp, E. coli
ctttgtaccgctggtatttggcgaa

SEQ ID NO: 43580 - DNA, 25 bp, E. coli
ctttgtaccgctcgtatttggcgaa

SEQ ID NO: 43581 - DNA, 25 bp, E. coli
gtctgttgcgccgaacttacgcttt

SEQ ID NO: 43582 - DNA, 25 bp, E. coli
gtctgttgcgcccaacttacgcttt

SEQ ID NO: 43583 - DNA, 25 bp, E. coli
aatggttctttaatctcatcgcagg

SEQ ID NO: 43584 - DNA, 25 bp, E. coli
aatggttctttattctcatcgcagg

SEQ ID NO: 43585 - DNA, 25 bp, E. coli
ttcgctacatcgtcgccctgagatt

SEQ ID NO: 43586 - DNA, 25 bp, E. coli
ttcgctacatcgacgccctgagatt

SEQ ID NO: 43587 - DNA, 25 bp, E. coli
tggttgctgccaatcgctacatcga

SEQ ID NO: 43588 - DNA, 25 bp, E. coli
tgcgcctcccatcaaacctgagttt

SEQ ID NO: 43589 - DNA, 25 bp, E. coli
tgcgcctcccatgaaacctgagttt

SEQ ID NO: 43590 - DNA, 25 bp, E. coli
tcaggattgctttacgcaatggttc

SEQ ID NO: 43591 - DNA, 25 bp, E. coli
tcaggattgcttaacgcaatggttc

SEQ ID NO: 43592 - DNA, 25 bp, E. coli
cctgagattcgagccaacgtctgaa

SEQ ID NO: 43593 - DNA, 25 bp, E. coli
cctgagtttcaaatggttgctgcca

SEQ ID NO: 43594 - DNA, 25 bp, E. coli
cctgagattcgacccaacgtctgaa

SEQ ID NO: 43595 - DNA, 25 bp, E. coli
cctgagtttcaattggttgctgcca

SEQ ID NO: 43596 - DNA, 25 bp, E. coli
gagccaacgtctcaactcgctttgt

SEQ ID NO: 43597 - DNA, 25 bp, E. coli
gagccaacgtctgaactcgctttgt

SEQ ID NO: 43598 - DNA, 25 bp, E. coli
gaactcgctttgattcacatcgcct

SEQ ID NO: 43599 - DNA, 25 bp, E. coli
gaactcgctttgtttcacatcgcct

SEQ ID NO: 43600 - DNA, 25 bp, E. coli
ggtgacgcggcatgacactgcgcct

SEQ ID NO: 43601 - DNA, 25 bp, E. coli
ggtgacgcggcaagacactgcgcct

SEQ ID NO: 43602 - DNA, 25 bp, E. coli
tggttgctgccattcgctacatcga

SEQ ID NO: 43603 - DNA, 25 bp, E. coli
gacgccctgagattcgagccaacgt

SEQ ID NO: 43604 - DNA, 25 bp, E. coli
gacgccctgagaatcgagccaacgt

SEQ ID NO: 43605 - DNA, 25 bp, E. coli
tacggatgtcacttattctaacggc

SEQ ID NO: 43606 - DNA, 25 bp, E. coli
tacggatgtcacatattctaacggc

SEQ ID NO: 43607 - DNA, 25 bp, E. coli
taaacatgcgcgcaaagaaaccgat

SEQ ID NO: 43608 - DNA, 25 bp, E. coli
taaacatgcgcggaaagaaaccgat

SEQ ID NO: 43609 - DNA, 25 bp, E. coli
tatccaaaagaacaagccgacgagc

SEQ ID NO: 43610 - DNA, 25 bp, E. coli
taccgcgggcttaagtgaagtttcg

SEQ ID NO: 43611 - DNA, 25 bp, E. coli
taccgcgggctttagtgaagtttcg

SEQ ID NO: 43612 - DNA, 25 bp, E. coli
tatccaaaagaagaagccgacgagc

SEQ ID NO: 43613 - DNA, 25 bp, E. coli
ttcagactggatctatacgcgcggg

SEQ ID NO: 43614 - DNA, 25 bp, E. coli
ttcagactggatgtatacgcgcggg

SEQ ID NO: 43615 - DNA, 25 bp, E. coli
ttggcgtaatcagcaatgaccctgg

SEQ ID NO: 43616 - DNA, 25 bp, E. coli
ttggcgtaatcaccaatgaccctgg

SEQ ID NO: 43617 - DNA, 25 bp, E. coli
tgataaacaagccatgtctgacgcg

SEQ ID NO: 43618 - DNA, 25 bp, E. coli
tgataaacaagcgatgtctgacgcg

SEQ ID NO: 43619 - DNA, 25 bp, E. coli
gaaccgagcattactggcttacgga

SEQ ID NO: 43620 - DNA, 25 bp, E. coli
gaaccgagcatttctggcttacgga

SEQ ID NO: 43621 - DNA, 25 bp, E. coli
gataaccgatcagggaagaaccgag

SEQ ID NO: 43622 - DNA, 25 bp, E. coli
gataaccgatcacggaagaaccgag

SEQ ID NO: 43623 - DNA, 25 bp, E. coli
gttacaaacgtagaatatggccagg

SEQ ID NO: 43624 - DNA, 25 bp, E. coli
gatactttcgcagtcaaagccccga

SEQ ID NO: 43625 - DNA, 25 bp, E. coli
gttacaaacgtacaatatggccagg

SEQ ID NO: 43626 - DNA, 25 bp, E. coli
gatactttcgcactcaaagccccga

SEQ ID NO: 43627 - DNA, 25 bp, E. coli
aatttatgagtttttgtaggctgga

SEQ ID NO: 43628 - DNA, 25 bp, E. coli
aatttatgagttattgtaggctgga

SEQ ID NO: 43629 - DNA, 25 bp, E. coli
caaaccagagatagcctgatgcgct

SEQ ID NO: 43630 - DNA, 25 bp, E. coli
caaaccagagattgcctgatgcgct

SEQ ID NO: 43631 - DNA, 25 bp, E. coli
catctgaaaacaaaccagagattgc

SEQ ID NO: 43632 - DNA, 25 bp, E. coli
catctgaaaacataccagagattgc

SEQ ID NO: 43633 - DNA, 25 bp, E. coli
atcaggcctaccatttcctgcaaca

SEQ ID NO: 43634 - DNA, 25 bp, E. coli
atcaggcctaccttttcctgcaaca

SEQ ID NO: 43635 - DNA, 25 bp, E. coli
ttgtcaacaatcagaaacgccggag

SEQ ID NO: 43636 - DNA, 25 bp, E. coli
ttgtcaacaatctgaaacgccggag

SEQ ID NO: 43637 - DNA, 25 bp, E. coli
tctgaaacgccggagatttttctct

SEQ ID NO: 43638 - DNA, 25 bp, E. coli
tctgaaacgccgcagatttttctct

SEQ ID NO: 43639 - DNA, 25 bp, E. coli
gccaaaacgccgcagaattttcact

SEQ ID NO: 43640 - DNA, 25 bp, E. coli
gccaaaacgccggagaattttcact

SEQ ID NO: 43641 - DNA, 25 bp, E. coli
tcctgcaacactttgaatttatgag

SEQ ID NO: 43642 - DNA, 25 bp, E. coli
tcctgcaacactatgaatttatgag

SEQ ID NO: 43643 - DNA, 25 bp, E. coli
tcactccggcgttttcatctgaaaa

SEQ ID NO: 43644 - DNA, 25 bp, E. coli
tcactccggcgtattcatctgaaaa

SEQ ID NO: 43645 - DNA, 25 bp, E. coli
gagatttttctctccggcgttattt

SEQ ID NO: 43646 - DNA, 25 bp, E. coli
gagatttttctcaccggcgttattt

SEQ ID NO: 43647 - DNA, 25 bp, E. coli
gagaattttcacaccggcgttttca

SEQ ID NO: 43648 - DNA, 25 bp, E. coli
gagaattttcactccggcgttttca

SEQ ID NO: 43649 - DNA, 25 bp, E. coli
cagataacctgatgaagtccggtgc

SEQ ID NO: 43650 - DNA, 25 bp, E. coli
cagataacctgaagaagtccggtgc

SEQ ID NO: 43651 - DNA, 25 bp, E. coli
catttgtaccagcaattcgtccggg

SEQ ID NO: 43652 - DNA, 25 bp, E. coli
catttgtaccaggaattcgtccggg

SEQ ID NO: 43653 - DNA, 25 bp, E. coli
tacgcgaaacgtgagcaaggtcgtc

SEQ ID NO: 43654 - DNA, 25 bp, E. coli
tacgcgaaacgtcagcaaggtcgtc

SEQ ID NO: 43655 - DNA, 25 bp, E. coli
tatgcaaggcctcgtgattaacccg

SEQ ID NO: 43656 - DNA, 25 bp, E. coli
tatcttcgccggtattgtcgcggga

SEQ ID NO: 43657 - DNA, 25 bp, E. coli
tatgcaaggcctggtgattaacccg

SEQ ID NO: 43658 - DNA, 25 bp, E. coli
tatcttcgccggaattgtcgcggga

SEQ ID NO: 43659 - DNA, 25 bp, E. coli
tatcgataaagtaatgacccgcctg

SEQ ID NO: 43660 - DNA, 25 bp, E. coli
tatcgataaagttatgacccgcctg

SEQ ID NO: 43661 - DNA, 25 bp, E. coli
tgtatttgcagcctgggcaaccgct

SEQ ID NO: 43662 - DNA, 25 bp, E. coli
tgtatttgcagcgtgggcaaccgct

SEQ ID NO: 43663 - DNA, 25 bp, E. coli
tgatgccgctgttcttgccaaactg

SEQ ID NO: 43664 - DNA, 25 bp, E. coli
tgatgccgctgtacttgccaaactg

SEQ ID NO: 43665 - DNA, 25 bp, E. coli
tgcccatactatcgagcaagcgcgt

SEQ ID NO: 43666 - DNA, 25 bp, E. coli
tgcccatactatggagcaagcgcgt

SEQ ID NO: 43667 - DNA, 25 bp, E. coli
tctgcattgaagaaggcgaacctga

SEQ ID NO: 43668 - DNA, 25 bp, E. coli
tctgcattgaagtaggcgaacctga

SEQ ID NO: 43669 - DNA, 25 bp, E. coli
ctgcttgagcaagagcgaggcacca

SEQ ID NO: 43670 - DNA, 25 bp, E. coli
ctgcttgagcaacagcgaggcacca

SEQ ID NO: 43671 - DNA, 25 bp, E. coli
caacgcgtgcgctggacattaccat

SEQ ID NO: 43672 - DNA, 25 bp, E. coli
caacgcgtgcgcaggacattaccat

SEQ ID NO: 43673 - DNA, 25 bp, E. coli
tatcatcgcaacgaaacgactcggg

SEQ ID NO: 43674 - DNA, 25 bp, E. coli
tattaacgcgatagtaaaactgccg

SEQ ID NO: 43675 - DNA, 25 bp, E. coli
tattaacgcgattgtaaaactgccg

SEQ ID NO: 43676 - DNA, 25 bp, E. coli
tatcatcgcaaccaaacgactcggg

SEQ ID NO: 43677 - DNA, 25 bp, E. coli
tttttcctcgttaacaacgcgtgcg

SEQ ID NO: 43678 - DNA, 25 bp, E. coli
tttttcctcgtttacaacgcgtgcg

SEQ ID NO: 43679 - DNA, 25 bp, E. coli
tctgcgtgaagggtgagaaataccc

SEQ ID NO: 43680 - DNA, 25 bp, E. coli
tcttcacgttatcgcaggagcaaac

SEQ ID NO: 43681 - DNA, 25 bp, E. coli
tctgcgtgaaggctgagaaataccc

SEQ ID NO: 43682 - DNA, 25 bp, E. coli
tcacctgatctgcataatgccagcg

SEQ ID NO: 43683 - DNA, 25 bp, E. coli
tcacctgatctggataatgccagcg

SEQ ID NO: 43684 - DNA, 25 bp, E. coli
tcttcacgttatggcaggagcaaac

SEQ ID NO: 43685 - DNA, 25 bp, E. coli
gaagtcacggaccaccaggtcattg

SEQ ID NO: 43686 - DNA, 25 bp, E. coli
gaagtcacggacgaccaggtcattg

SEQ ID NO: 43687 - DNA, 25 bp, E. coli
gaaatacccgtatcacctgatctgg

SEQ ID NO: 43688 - DNA, 25 bp, E. coli
gaaatacccgtaacacctgatctgg

SEQ ID NO: 43689 - DNA, 25 bp, E. coli
ggacattaccatgctcctctgcgat

SEQ ID NO: 43690 - DNA, 25 bp, E. coli
ggacattaccatcctcctctgcgat

SEQ ID NO: 43691 - DNA, 25 bp, E. coli
taatgccagcgtagggaagtcacgg

SEQ ID NO: 43692 - DNA, 25 bp, E. coli
taatgccagcgttgggaagtcacgg

SEQ ID NO: 43693 - DNA, 25 bp, E. coli
caacgtcgtctgagggatgctcaaa

SEQ ID NO: 43694 - DNA, 25 bp, E. coli
caacgtcgtctgtgggatgctcaaa

SEQ ID NO: 43695 - DNA, 25 bp, E. coli
caggcaccgcatgtgtttcggagaa

SEQ ID NO: 43696 - DNA, 25 bp, E. coli
catttttcattctggtacagcggga

SEQ ID NO: 43697 - DNA, 25 bp, E. coli
caggcaccgcatctgtttcggagaa

SEQ ID NO: 43698 - DNA, 25 bp, E. coli
catttttcattcaggtacagcggga

SEQ ID NO: 43699 - DNA, 25 bp, E. coli
tacagcgggacattaagcgtctgct

SEQ ID NO: 43700 - DNA, 25 bp, E. coli
tacagcgggacaataagcgtctgct

SEQ ID NO: 43701 - DNA, 25 bp, E. coli
tattcgctgcgggactgtggcttca

SEQ ID NO: 43702 - DNA, 25 bp, E. coli
tattcgctgcggcactgtggcttca

SEQ ID NO: 43703 - DNA, 25 bp, E. coli
ttacatagcttagggatcacactgc

SEQ ID NO: 43704 - DNA, 25 bp, E. coli
ttacatagcttacggatcacactgc

SEQ ID NO: 43705 - DNA, 25 bp, E. coli
tgttaatggcgaaaccgccgcaggc

SEQ ID NO: 43706 - DNA, 25 bp, E. coli
tgttaatggcgataccgccgcaggc

SEQ ID NO: 43707 - DNA, 25 bp, E. coli
tctggagcgaggttcttaagcaatc

SEQ ID NO: 43708 - DNA, 25 bp, E. coli
tctggagcgaggatcttaagcaatc

SEQ ID NO: 43709 - DNA, 25 bp, E. coli
cgctgctctgttatgcctgccggaa

SEQ ID NO: 43710 - DNA, 25 bp, E. coli
cgctgctctgttttgcctgccggaa

SEQ ID NO: 43711 - DNA, 25 bp, E. coli
ggtggtccaaacagccgctgatgca

SEQ ID NO: 43712 - DNA, 25 bp, E. coli
ggtggtccaaactgccgctgatgca

SEQ ID NO: 43713 - DNA, 25 bp, E. coli
taagctcggcgtatctggtaggcat

SEQ ID NO: 43714 - DNA, 25 bp, E. coli
taagctcggcgtttctggtaggcat

SEQ ID NO: 43715 - DNA, 25 bp, E. coli
aattgcggccttattcggcaatctg

SEQ ID NO: 43716 - DNA, 25 bp, E. coli
aattgcggcctttttcggcaatctg

SEQ ID NO: 43717 - DNA, 25 bp, E. coli
cagggattttgtctataattgcggc

SEQ ID NO: 43718 - DNA, 25 bp, E. coli
cgtcgtctaaaatcagcagtacccc

SEQ ID NO: 43719 - DNA, 25 bp, E. coli
cgtcgtctaaaaacagcagtacccc

SEQ ID NO: 43720 - DNA, 25 bp, E. coli
cagggattttgtgtataattgcggc

SEQ ID NO: 43721 - DNA, 25 bp, E. coli
ccccgacaaactcagggattttgtg

SEQ ID NO: 43722 - DNA, 25 bp, E. coli
ccccgacaaactgagggattttgtg

SEQ ID NO: 43723 - DNA, 25 bp, E. coli
aacgatcgtcgtgtaaaatcagcag

SEQ ID NO: 43724 - DNA, 25 bp, E. coli
aacgatcgtcgtctaaaatcagcag

SEQ ID NO: 43725 - DNA, 25 bp, E. coli
tttttggcgcttatgccctgctgac

SEQ ID NO: 43726 - DNA, 25 bp, E. coli
tttttggcgcttttgccctgctgac

SEQ ID NO: 43727 - DNA, 25 bp, E. coli
tgccctgctgacttttgaggaaatc

SEQ ID NO: 43728 - DNA, 25 bp, E. coli
tgccctgctgacatttgaggaaatc

SEQ ID NO: 43729 - DNA, 25 bp, E. coli
cctttcaaatgaaaacgatcgtcgt

SEQ ID NO: 43730 - DNA, 25 bp, E. coli
cctttcaaatgataacgatcgtcgt

SEQ ID NO: 43731 - DNA, 25 bp, E. coli
gacttttgaggaaatccacatgtca

SEQ ID NO: 43732 - DNA, 25 bp, E. coli
gacttttgaggatatccacatgtca

SEQ ID NO: 43733 - DNA, 25 bp, E. coli
cggcaatctgccgttttttggcgct

SEQ ID NO: 43734 - DNA, 25 bp, E. coli
cggcaatctgcccttttttggcgct

SEQ ID NO: 43735 - DNA, 25 bp, E. coli
ggaaatccacatctcattaccacac

SEQ ID NO: 43736 - DNA, 25 bp, E. coli
ggaaatccacatgtcattaccacac

SEQ ID NO: 43737 - DNA, 25 bp, E. coli
agtgttgctggaaacggaagcccgc

SEQ ID NO: 43738 - DNA, 25 bp, E. coli
agtgttgctggatacggaagcccgc

SEQ ID NO: 43739 - DNA, 25 bp, E. coli
atggatcatcgtctgcttgaaatca

SEQ ID NO: 43740 - DNA, 25 bp, E. coli
atggatcatcgtgtgcttgaaatca

SEQ ID NO: 43741 - DNA, 25 bp, E. coli
aaatcattgcctccccggtttgcaa

SEQ ID NO: 43742 - DNA, 25 bp, E. coli
aaatcattgcctgcccggtttgcaa

SEQ ID NO: 43743 - DNA, 25 bp, E. coli
tgactgctgatgtgagtaaatcatg

SEQ ID NO: 43744 - DNA, 25 bp, E. coli
tgaaatcattgcctgcccggtttgc

SEQ ID NO: 43745 - DNA, 25 bp, E. coli
tgactgctgatgagagtaaatcatg

SEQ ID NO: 43746 - DNA, 25 bp, E. coli
tgcttgaaatcattgcctgcccggt

SEQ ID NO: 43747 - DNA, 25 bp, E. coli
tgcttgaaatcaatgcctgcccggt

SEQ ID NO: 43748 - DNA, 25 bp, E. coli
tgaaatcattgcgtgcccggtttgc

SEQ ID NO: 43749 - DNA, 25 bp, E. coli
tgcctgcccggtttgcaacggaaaa

SEQ ID NO: 43750 - DNA, 25 bp, E. coli
tgcctgcccggtatgcaacggaaaa

SEQ ID NO: 43751 - DNA, 25 bp, E. coli
tcatcgtctgcttgaaatcattgcc

SEQ ID NO: 43752 - DNA, 25 bp, E. coli
tcatcgtctgctagaaatcattgcc

SEQ ID NO: 43753 - DNA, 25 bp, E. coli
ccagtgttgctggaaacggaagccc

SEQ ID NO: 43754 - DNA, 25 bp, E. coli
ccagtgttgctgcaaacggaagccc

SEQ ID NO: 43755 - DNA, 25 bp, E. coli
cgtctgcttgaattcattgcctgcc

SEQ ID NO: 43756 - DNA, 25 bp, E. coli
cgtctgcttgaaatcattgcctgcc

SEQ ID NO: 43757 - DNA, 25 bp, E. coli
gatggcattccactgttgctggaaa

SEQ ID NO: 43758 - DNA, 25 bp, E. coli
gatggcattccagtgttgctggaaa

SEQ ID NO: 43759 - DNA, 25 bp, E. coli
catcacctgattgttaacggcatgg

SEQ ID NO: 43760 - DNA, 25 bp, E. coli
catcacctgattcttaacggcatgg

SEQ ID NO: 43761 - DNA, 25 bp, E. coli
ttaacggcatggctccggatcgcag

SEQ ID NO: 43762 - DNA, 25 bp, E. coli
ttaacggcatgggtccggatcgcag

SEQ ID NO: 43763 - DNA, 25 bp, E. coli
ttgtttgctaccaatgccgttctgg

SEQ ID NO: 43764 - DNA, 25 bp, E. coli
ttgtttgctacctatgccgttctgg

SEQ ID NO: 43765 - DNA, 25 bp, E. coli
tgagcctgttctcgcacttcctgga

SEQ ID NO: 43766 - DNA, 25 bp, E. coli
tgagcctgttctggcacttcctgga

SEQ ID NO: 43767 - DNA, 25 bp, E. coli
tcgcagcggcttcctgtcagcgttc

SEQ ID NO: 43768 - DNA, 25 bp, E. coli
tcgcagcggcttgctgtcagcgttc

SEQ ID NO: 43769 - DNA, 25 bp, E. coli
gcggctatcgccatgtacaaaaaca

SEQ ID NO: 43770 - DNA, 25 bp, E. coli
gcggcccgacaggtaaggacatttt

SEQ ID NO: 43771 - DNA, 25 bp, E. coli
gcggctatcgccttgtacaaaaaca

SEQ ID NO: 43772 - DNA, 25 bp, E. coli
gcggcccgacagctaaggacatttt

SEQ ID NO: 43773 - DNA, 25 bp, E. coli
gcactaaccgtagccgcatcatgtg

SEQ ID NO: 43774 - DNA, 25 bp, E. coli
gcaactgatactttgacgcacgcga

SEQ ID NO: 43775 - DNA, 25 bp, E. coli
gcactaaccgtacccgcatcatgtg

SEQ ID NO: 43776 - DNA, 25 bp, E. coli
gcaactgatactatgacgcacgcga

SEQ ID NO: 43777 - DNA, 25 bp, E. coli
gaactgccgttcgttctggttgaaa

SEQ ID NO: 43778 - DNA, 25 bp, E. coli
gaactgccgttccttctggttgaaa

SEQ ID NO: 43779 - DNA, 25 bp, E. coli
ggatctacctgatgagcgactgcat

SEQ ID NO: 43780 - DNA, 25 bp, E. coli
ggatctacctgaagagcgactgcat

SEQ ID NO: 43781 - DNA, 25 bp, E. coli
cctcgtacggaggtattacgggaag

SEQ ID NO: 43782 - DNA, 25 bp, E. coli
tcctcgtacggagctattacgggaa

SEQ ID NO: 43783 - DNA, 25 bp, E. coli
tcctcgtacggacctattacgggaa

SEQ ID NO: 43784 - DNA, 25 bp, E. coli
cctcgtacggagctattacgggaag

SEQ ID NO: 43785 - DNA, 25 bp, E. coli
cagtaagaaccactgcttttggcat

SEQ ID NO: 43786 - DNA, 25 bp, E. coli
cagtaagaaccagtgcttttggcat

SEQ ID NO: 43787 - DNA, 25 bp, E. coli
tacggagctattacgggaagcggta

SEQ ID NO: 43788 - DNA, 25 bp, E. coli
tacggagctatttcgggaagcggta

SEQ ID NO: 43789 - DNA, 25 bp, E. coli
agaaccagtgcttttggcatatggc

SEQ ID NO: 43790 - DNA, 25 bp, E. coli
cttcctcgtacgcagctattacggg

SEQ ID NO: 43791 - DNA, 25 bp, E. coli
agaaccagtgctattggcatatggc

SEQ ID NO: 43792 - DNA, 25 bp, E. coli
cttcctcgtacggagctattacggg

SEQ ID NO: 43793 - DNA, 25 bp, E. coli
aacagtaagaaccagtgcttttggc

SEQ ID NO: 43794 - DNA, 25 bp, E. coli
aacagtaagaacgagtgcttttggc

SEQ ID NO: 43795 - DNA, 25 bp, E. coli
tcgtacggagctattacgggaagcg

SEQ ID NO: 43796 - DNA, 25 bp, E. coli
tcgcaaacagtatgaaccagtgctt

SEQ ID NO: 43797 - DNA, 25 bp, E. coli
tcgcaaacagtaagaaccagtgctt

SEQ ID NO: 43798 - DNA, 25 bp, E. coli
tcgtacggagcttttacgggaagcg

SEQ ID NO: 43799 - DNA, 25 bp, E. coli
gcaaacagtaagtaccagtgctttt

SEQ ID NO: 43800 - DNA, 25 bp, E. coli
gcaaacagtaagaaccagtgctttt

SEQ ID NO: 43801 - DNA, 25 bp, E. coli
taagaaccagtggttttggcatatg

SEQ ID NO: 43802 - DNA, 25 bp, E. coli
taagaaccagtgcttttggcatatg

SEQ ID NO: 43803 - DNA, 25 bp, E. coli
caggtttccaccctcattaagaaag

SEQ ID NO: 43804 - DNA, 25 bp, E. coli
caggtttccaccgtcattaagaaag

SEQ ID NO: 43805 - DNA, 25 bp, E. coli
tatcgctcagtttgttaagtgctct

SEQ ID NO: 43806 - DNA, 25 bp, E. coli
tatcgctcagttagttaagtgctct

SEQ ID NO: 43807 - DNA, 25 bp, E. coli
tgcctgacgctcaggtttccaccgt

SEQ ID NO: 43808 - DNA, 25 bp, E. coli
tgcctgacgctctggtttccaccgt

SEQ ID NO: 43809 - DNA, 25 bp, E. coli
tccaccgtcattaagaaaggctgtt

SEQ ID NO: 43810 - DNA, 25 bp, E. coli
tccaccgtcatttagaaaggctgtt

SEQ ID NO: 43811 - DNA, 25 bp, E. coli
tcagtttgttaagtgctctgctcat

SEQ ID NO: 43812 - DNA, 25 bp, E. coli
gccgttgattttgctcagctgtgta

SEQ ID NO: 43813 - DNA, 25 bp, E. coli
cctcagctgtgtttcgctcagtttg

SEQ ID NO: 43814 - DNA, 25 bp, E. coli
cctcagctgtgtatcgctcagtttg

SEQ ID NO: 43815 - DNA, 25 bp, E. coli
gccgttgattttcctcagctgtgta

SEQ ID NO: 43816 - DNA, 25 bp, E. coli
gcgggtgtgccgatgattttcctca

SEQ ID NO: 43817 - DNA, 25 bp, E. coli
gcgggtgtgccgttgattttcctca

SEQ ID NO: 43818 - DNA, 25 bp, E. coli
cgctcaggtttcgaccgtcattaag

SEQ ID NO: 43819 - DNA, 25 bp, E. coli
cgctcaggtttccaccgtcattaag

SEQ ID NO: 43820 - DNA, 25 bp, E. coli
cgtcattaagaatggctgttttttg

SEQ ID NO: 43821 - DNA, 25 bp, E. coli
cgtcattaagaaaggctgttttttg

SEQ ID NO: 43822 - DNA, 25 bp, E. coli
gattttcctcaggtgtgtatcgctc

SEQ ID NO: 43823 - DNA, 25 bp, E. coli
gattttcctcagctgtgtatcgctc

SEQ ID NO: 43824 - DNA, 25 bp, E. coli
tcagtttgttaactgctctgctcat

SEQ ID NO: 43825 - DNA, 25 bp, E. coli
tttcacggcttaggaatccgagtaa

SEQ ID NO: 43826 - DNA, 25 bp, E. coli
tatcaccgccgttgtggcggcgctg

SEQ ID NO: 43827 - DNA, 25 bp, E. coli
tatcaccgccgtagtggcggcgctg

SEQ ID NO: 43828 - DNA, 25 bp, E. coli
tttcacggcttacgaatccgagtaa

SEQ ID NO: 43829 - DNA, 25 bp, E. coli
ttcacatccgaagtggccagacgga

SEQ ID NO: 43830 - DNA, 25 bp, E. coli
ttcacatccgaactggccagacgga

SEQ ID NO: 43831 - DNA, 25 bp, E. coli
tgttttcacggcatacgaatccgag

SEQ ID NO: 43832 - DNA, 25 bp, E. coli
tgttttcacggcttacgaatccgag

SEQ ID NO: 43833 - DNA, 25 bp, E. coli
tgaggttcacatccgaactggccag

SEQ ID NO: 43834 - DNA, 25 bp, E. coli
tgaggttcacatgcgaactggccag

SEQ ID NO: 43835 - DNA, 25 bp, E. coli
ccagacggaggttgctgttttcacg

SEQ ID NO: 43836 - DNA, 25 bp, E. coli
ccagacggaggtagctgttttcacg

SEQ ID NO: 43837 - DNA, 25 bp, E. coli
gcggcgctggtaacgagaaaagacc

SEQ ID NO: 43838 - DNA, 25 bp, E. coli
gctggtaacgagtaaagacctctgt

SEQ ID NO: 43839 - DNA, 25 bp, E. coli
gcggcgctggtatcgagaaaagacc

SEQ ID NO: 43840 - DNA, 25 bp, E. coli
gctggtaacgagaaaagacctctgt

SEQ ID NO: 43841 - DNA, 25 bp, E. coli
cgagaaaagaccactgtgaggttca

SEQ ID NO: 43842 - DNA, 25 bp, E. coli
cgagaaaagacctctgtgaggttca

SEQ ID NO: 43843 - DNA, 25 bp, E. coli
gaggttgctgttttcacggcttacg

SEQ ID NO: 43844 - DNA, 25 bp, E. coli
gaggttgctgttatcacggcttacg

SEQ ID NO: 43845 - DNA, 25 bp, E. coli
gacctctgtgagcttcacatccgaa

SEQ ID NO: 43846 - DNA, 25 bp, E. coli
gacctctgtgaggttcacatccgaa

SEQ ID NO: 43847 - DNA, 25 bp, E. coli
cacgcaacaacaccatgaatggatt

SEQ ID NO: 43848 - DNA, 25 bp, E. coli
cacgcaacaacagcatgaatggatt

SEQ ID NO: 43849 - DNA, 25 bp, E. coli
catcccggaacgaaaagataatcct

SEQ ID NO: 43850 - DNA, 25 bp, E. coli
catcccggaacgtaaagataatcct

SEQ ID NO: 43851 - DNA, 25 bp, E. coli
cattcgaacaaaacaccagaaacgc

SEQ ID NO: 43852 - DNA, 25 bp, E. coli
cattcgaacaaatcaccagaaacgc

SEQ ID NO: 43853 - DNA, 25 bp, E. coli
aagcctgaagggtaaaggatccaca

SEQ ID NO: 43854 - DNA, 25 bp, E. coli
aagcctgaagggaaaaggatccaca

SEQ ID NO: 43855 - DNA, 25 bp, E. coli
aaaaggatccacagaacattcgaac

SEQ ID NO: 43856 - DNA, 25 bp, E. coli
aaaaggatccactgaacattcgaac

SEQ ID NO: 43857 - DNA, 25 bp, E. coli
tgcacacagcaggaaaacacgcaac

SEQ ID NO: 43858 - DNA, 25 bp, E. coli
tgcacacagcagcaaaacacgcaac

SEQ ID NO: 43859 - DNA, 25 bp, E. coli
gcttcctggcaaagcaaatcaacaa

SEQ ID NO: 43860 - DNA, 25 bp, E. coli
gcttcctggcaatgcaaatcaacaa

SEQ ID NO: 43861 - DNA, 25 bp, E. coli
gaatggatttaaaaacgacatggac

SEQ ID NO: 43862 - DNA, 25 bp, E. coli
gaatggatttaataacgacatggac

SEQ ID NO: 43863 - DNA, 25 bp, E. coli
gaaacgcaaccacaacgcttcctgg

SEQ ID NO: 43864 - DNA, 25 bp, E. coli
gaaaagataatcctgcacacagcag

SEQ ID NO: 43865 - DNA, 25 bp, E. coli
gaaaagataatcgtgcacacagcag

SEQ ID NO: 43866 - DNA, 25 bp, E. coli
gaaacgcaaccagaacgcttcctgg

SEQ ID NO: 43867 - DNA, 25 bp, E. coli
gattgaaacggaacaaaccatcccg

SEQ ID NO: 43868 - DNA, 25 bp, E. coli
gattgaaacggatcaaaccatcccg

SEQ ID NO: 43869 - DNA, 25 bp, E. coli
cccgcaccggttcctgtgtccaggg

SEQ ID NO: 43870 - DNA, 25 bp, E. coli
cccgcaccggttgctgtgtccaggg

SEQ ID NO: 43871 - DNA, 25 bp, E. coli
aaactggcaaccctacttagcgatg

SEQ ID NO: 43872 - DNA, 25 bp, E. coli
aaactggcaaccgtacttagcgatg

SEQ ID NO: 43873 - DNA, 25 bp, E. coli
tatttgagtgacaaactggcaaccc

SEQ ID NO: 43874 - DNA, 25 bp, E. coli
tatttgagtgactaactggcaaccc

SEQ ID NO: 43875 - DNA, 25 bp, E. coli
ttagcgatgccacccgcgataatag

SEQ ID NO: 43876 - DNA, 25 bp, E. coli
ttagcgatgccagccgcgataatag

SEQ ID NO: 43877 - DNA, 25 bp, E. coli
tgtaccaccgtctcgccagcttata

SEQ ID NO: 43878 - DNA, 25 bp, E. coli
tgtaccaccgtcacgccagcttata

SEQ ID NO: 43879 - DNA, 25 bp, E. coli
tgagtgacaaactggcaaccctact

SEQ ID NO: 43880 - DNA, 25 bp, E. coli
tgcgcccctatttgagtgacaaact

SEQ ID NO: 43881 - DNA, 25 bp, E. coli
tgcgcccctattagagtgacaaact

SEQ ID NO: 43882 - DNA, 25 bp, E. coli
tgagtgacaaacaggcaaccctact

SEQ ID NO: 43883 - DNA, 25 bp, E. coli
gacaaactggcaaccctacttagcg

SEQ ID NO: 43884 - DNA, 25 bp, E. coli
gacaaactggcatccctacttagcg

SEQ ID NO: 43885 - DNA, 25 bp, E. coli
ctacttagcgatcccagccgcgata

SEQ ID NO: 43886 - DNA, 25 bp, E. coli
ctacttagcgatgccagccgcgata

SEQ ID NO: 43887 - DNA, 25 bp, E. coli
taatagtcatcgtgaattgttaagc

SEQ ID NO: 43888 - DNA, 25 bp, E. coli
taatagtcatcgagaattgttaagc

SEQ ID NO: 43889 - DNA, 25 bp, E. coli
gatgccagccgccataatagtcatc

SEQ ID NO: 43890 - DNA, 25 bp, E. coli
gatgccagccgcgataatagtcatc

SEQ ID NO: 43891 - DNA, 25 bp, E. coli
caatggattgaggaagcgttgacgc

SEQ ID NO: 43892 - DNA, 25 bp, E. coli
caatggattgagcaagcgttgacgc

SEQ ID NO: 43893 - DNA, 25 bp, E. coli
catgtgcggtacgtgttctatggca

SEQ ID NO: 43894 - DNA, 25 bp, E. coli
catgtgcggtacctgttctatggca

SEQ ID NO: 43895 - DNA, 25 bp, E. coli
taaagccaatgctgcaggccttgcg

SEQ ID NO: 43896 - DNA, 25 bp, E. coli
taaagccaatgcagcaggccttgcg

SEQ ID NO: 43897 - DNA, 25 bp, E. coli
tatgctcaacgtgggcaatggattg

SEQ ID NO: 43898 - DNA, 25 bp, E. coli
tatgctcaacgtcggcaatggattg

SEQ ID NO: 43899 - DNA, 25 bp, E. coli
tattgttaacgaaggtatggcgcga

SEQ ID NO: 43900 - DNA, 25 bp, E. coli
tattgttaacgatggtatggcgcga

SEQ ID NO: 43901 - DNA, 25 bp, E. coli
tctctttccgcgagagctgtgggcg

SEQ ID NO: 43902 - DNA, 25 bp, E. coli
tctctttccgcgtgagctgtgggcg

SEQ ID NO: 43903 - DNA, 25 bp, E. coli
gccttcaagtcgtacctggtcgcag

SEQ ID NO: 43904 - DNA, 25 bp, E. coli
gccatttcaaatgggattacccgca

SEQ ID NO: 43905 - DNA, 25 bp, E. coli
gccatttcaaatcggattacccgca

SEQ ID NO: 43906 - DNA, 25 bp, E. coli
gccttcaagtcgaacctggtcgcag

SEQ ID NO: 43907 - DNA, 25 bp, E. coli
cgttgacgcagctaggatttcaggt

SEQ ID NO: 43908 - DNA, 25 bp, E. coli
cgttgacgcagcaaggatttcaggt

SEQ ID NO: 43909 - DNA, 25 bp, E. coli
gatattgcccatccgcgtaaagcca

SEQ ID NO: 43910 - DNA, 25 bp, E. coli
gatattgcccatgcgcgtaaagcca

SEQ ID NO: 43911 - DNA, 25 bp, E. coli
ggtgaaagtcaggaaccgttgccat

SEQ ID NO: 43912 - DNA, 25 bp, E. coli
ggtgaaagtcagcaaccgttgccat

SEQ ID NO: 43913 - DNA, 25 bp, E. coli
catgcccgaggcagacagcctcaag

SEQ ID NO: 43914 - DNA, 25 bp, E. coli
catgcccgaggctgacagcctcaag

SEQ ID NO: 43915 - DNA, 25 bp, E. coli
taactctcgcttaaccgcaaaccgt

SEQ ID NO: 43916 - DNA, 25 bp, E. coli
tatcgtaatgaaatcagttccctag

SEQ ID NO: 43917 - DNA, 25 bp, E. coli
tatcgtaatgaattcagttccctag

SEQ ID NO: 43918 - DNA, 25 bp, E. coli
ttacggtggcatgcccgaggcagac

SEQ ID NO: 43919 - DNA, 25 bp, E. coli
ttacggtggcatccccgaggcagac

SEQ ID NO: 43920 - DNA, 25 bp, E. coli
tcccatatcgtattgaattcagttc

SEQ ID NO: 43921 - DNA, 25 bp, E. coli
tcccatatcgtaatgaattcagttc

SEQ ID NO: 43922 - DNA, 25 bp, E. coli
tctctgtctgccttacggtggcatg

SEQ ID NO: 43923 - DNA, 25 bp, E. coli
tctctgtctgccatacggtggcatg

SEQ ID NO: 43924 - DNA, 25 bp, E. coli
tctgccttacggtggcatgcccgag

SEQ ID NO: 43925 - DNA, 25 bp, E. coli
tctgccttacggaggcatgcccgag

SEQ ID NO: 43926 - DNA, 25 bp, E. coli
cgcagcaattcttcttaactctcgc

SEQ ID NO: 43927 - DNA, 25 bp, E. coli
cgcagcaattctacttaactctcgc

SEQ ID NO: 43928 - DNA, 25 bp, E. coli
gggcttttctctgtctgccttacgg

SEQ ID NO: 43929 - DNA, 25 bp, E. coli
gtggcatgcccgaggcagacagcct

SEQ ID NO: 43930 - DNA, 25 bp, E. coli
gggcttttctctctctgccttacgg

SEQ ID NO: 43931 - DNA, 25 bp, E. coli
gtggcatgcccgtggcagacagcct

SEQ ID NO: 43932 - DNA, 25 bp, E. coli
tcaagcacccgcagcaattctactt

SEQ ID NO: 43933 - DNA, 25 bp, E. coli
taactctcgctttaccgcaaaccgt

SEQ ID NO: 43934 - DNA, 25 bp, E. coli
tcaagcacccgctgcaattctactt

SEQ ID NO: 43935 - DNA, 25 bp, E. coli
acggcttacgggagcgggtctgacg

SEQ ID NO: 43936 - DNA, 25 bp, E. coli
acggcttacgggtgcgggtctgacg

SEQ ID NO: 43937 - DNA, 25 bp, E. coli
taccagtcagcgaatcgctctcttt

SEQ ID NO: 43938 - DNA, 25 bp, E. coli
tagtgattcagggaacggcttacgg

SEQ ID NO: 43939 - DNA, 25 bp, E. coli
tatcgctctctttctgaagccggtt

SEQ ID NO: 43940 - DNA, 25 bp, E. coli
tagtgattcaggcaacggcttacgg

SEQ ID NO: 43941 - DNA, 25 bp, E. coli
taccagtcagcgtatcgctctcttt

SEQ ID NO: 43942 - DNA, 25 bp, E. coli
tttcggaacgactgccgaagttcat

SEQ ID NO: 43943 - DNA, 25 bp, E. coli
tatcgctctcttactgaagccggtt

SEQ ID NO: 43944 - DNA, 25 bp, E. coli
tttcggaacgacagccgaagttcat

SEQ ID NO: 43945 - DNA, 25 bp, E. coli
gccggttcagatcggcttccatttg

SEQ ID NO: 43946 - DNA, 25 bp, E. coli
gccggttcagatgggcttccatttg

SEQ ID NO: 43947 - DNA, 25 bp, E. coli
gggtcatacaccctaccagtcagcg

SEQ ID NO: 43948 - DNA, 25 bp, E. coli
ggacgctgtactcccgggtcataca

SEQ ID NO: 43949 - DNA, 25 bp, E. coli
ggtctgacgcaagggacgctgtact

SEQ ID NO: 43950 - DNA, 25 bp, E. coli
ggacgctgtactgccgggtcataca

SEQ ID NO: 43951 - DNA, 25 bp, E. coli
gggtcatacaccgtaccagtcagcg

SEQ ID NO: 43952 - DNA, 25 bp, E. coli
ggtctgacgcaacggacgctgtact

SEQ ID NO: 43953 - DNA, 25 bp, E. coli
ggcttccatttgagcgatacggcgg

SEQ ID NO: 43954 - DNA, 25 bp, E. coli
ggcttccatttgtgcgatacggcgg

SEQ ID NO: 43955 - DNA, 25 bp, E. coli
gagactttttcgcaacgactgccga

SEQ ID NO: 43956 - DNA, 25 bp, E. coli
gagactttttcggaacgactgccga

SEQ ID NO: 43957 - DNA, 25 bp, E. coli
agtggggaatcgacagtagcctgca

SEQ ID NO: 43958 - DNA, 25 bp, E. coli
agtggggaatcgtcagtagcctgca

SEQ ID NO: 43959 - DNA, 25 bp, E. coli
accctgctctcacgcggcgtgaaaa

SEQ ID NO: 43960 - DNA, 25 bp, E. coli
acattgtttgatccgcacagcgaga

SEQ ID NO: 43961 - DNA, 25 bp, E. coli
acattgtttgatgcgcacagcgaga

SEQ ID NO: 43962 - DNA, 25 bp, E. coli
aacaggccggaggtttgagtccgca

SEQ ID NO: 43963 - DNA, 25 bp, E. coli
accctgctctcaggcggcgtgaaaa

SEQ ID NO: 43964 - DNA, 25 bp, E. coli
aacaggccggagctttgagtccgca

SEQ ID NO: 43965 - DNA, 25 bp, E. coli
ttgagtccgcaacgcatgcagatcc

SEQ ID NO: 43966 - DNA, 25 bp, E. coli
ttgagtccgcaaggcatgcagatcc

SEQ ID NO: 43967 - DNA, 25 bp, E. coli
ccggaggtttgagtccgcaaggcat

SEQ ID NO: 43968 - DNA, 25 bp, E. coli
ccggaggtttgactccgcaaggcat

SEQ ID NO: 43969 - DNA, 25 bp, E. coli
gcgcgttccgcctatcgacgggatc

SEQ ID NO: 43970 - DNA, 25 bp, E. coli
gcgcgttccgccaatcgacgggatc

SEQ ID NO: 43971 - DNA, 25 bp, E. coli
cgttccgcctatggacgggatcgat

SEQ ID NO: 43972 - DNA, 25 bp, E. coli
cgttccgcctatcgacgggatcgat

SEQ ID NO: 43973 - DNA, 25 bp, E. coli
ctcacgcggcgtgaaaatgatccca

SEQ ID NO: 43974 - DNA, 25 bp, E. coli
ctcacgcggcgtcaaaatgatccca

SEQ ID NO: 43975 - DNA, 25 bp, E. coli
ggtaacattgttagatgcgcacagc

SEQ ID NO: 43976 - DNA, 25 bp, E. coli
ggtaacattgtttgatgcgcacagc

SEQ ID NO: 43977 - DNA, 25 bp, E. coli
tgcaacaggccgcaggtttgagtcc

SEQ ID NO: 43978 - DNA, 25 bp, E. coli
tgcaacaggccggaggtttgagtcc

SEQ ID NO: 43979 - DNA, 25 bp, E. coli
caaaaaatggaggtgacggcttcgc

SEQ ID NO: 43980 - DNA, 25 bp, E. coli
caaaaaatggagctgacggcttcgc

SEQ ID NO: 43981 - DNA, 25 bp, E. coli
tacctgctgaaagctgaaagcctga

SEQ ID NO: 43982 - DNA, 25 bp, E. coli
tacctgctgaaacctgaaagcctga

SEQ ID NO: 43983 - DNA, 25 bp, E. coli
tgctgaaagacgatgcgaccatgct

SEQ ID NO: 43984 - DNA, 25 bp, E. coli
tgctgaaagacgttgcgaccatgct

SEQ ID NO: 43985 - DNA, 25 bp, E. coli
gccgtcccggtgcaggaatttatca

SEQ ID NO: 43986 - DNA, 25 bp, E. coli
gccgtcccggtggaggaatttatca

SEQ ID NO: 43987 - DNA, 25 bp, E. coli
gcactggtgaacatccgggcaaaac

SEQ ID NO: 43988 - DNA, 25 bp, E. coli
gaagttcaggtagcaacatccacag

SEQ ID NO: 43989 - DNA, 25 bp, E. coli
gaagttcaggtaccaacatccacag

SEQ ID NO: 43990 - DNA, 25 bp, E. coli
gcactggtgaacttccgggcaaaac

SEQ ID NO: 43991 - DNA, 25 bp, E. coli
gaaagacggctcgacaaaagtgctg

SEQ ID NO: 43992 - DNA, 25 bp, E. coli
gaaagacggctccacaaaagtgctg

SEQ ID NO: 43993 - DNA, 25 bp, E. coli
cgttgccggaaagagcgagttcacc

SEQ ID NO: 43994 - DNA, 25 bp, E. coli
cgttgccggaaacagcgagttcacc

SEQ ID NO: 43995 - DNA, 25 bp, E. coli
ggatataccgatgccaccggcgatg

SEQ ID NO: 43996 - DNA, 25 bp, E. coli
ggatataccgatcccaccggcgatg

SEQ ID NO: 43997 - DNA, 25 bp, E. coli
tggcgtccgcctcaacaaaaaatgg

SEQ ID NO: 43998 - DNA, 25 bp, E. coli
tggcgtccgcctgaacaaaaaatgg

SEQ ID NO: 43999 - DNA, 25 bp, E. coli
tcaaccggcgtgtcgaaatcagtct

SEQ ID NO: 44000 - DNA, 25 bp, E. coli
tcaaccggcgtgacgaaatcagtct

SEQ ID NO: 44001 - DNA, 25 bp, E. coli
aatatgccttctcgatggacggtgc

SEQ ID NO: 44002 - DNA, 25 bp, E. coli
aatatgccttctggatggacggtgc

SEQ ID NO: 44003 - DNA, 25 bp, E. coli
catgaacaggccgatcgtctggcaa

SEQ ID NO: 44004 - DNA, 25 bp, E. coli
catgaacaggcccatcgtctggcaa

SEQ ID NO: 44005 - DNA, 25 bp, E. coli
agtcatatattgacccgggcggccg

SEQ ID NO: 44006 - DNA, 25 bp, E. coli
agtcatatattgtcccgggcggccg

SEQ ID NO: 44007 - DNA, 25 bp, E. coli
tatcgccatgttgtgcggatgccgg

SEQ ID NO: 44008 - DNA, 25 bp, E. coli
tatcgccatgttctgcggatgccgg

SEQ ID NO: 44009 - DNA, 25 bp, E. coli
ttactgacacctcgcgggattctgg

SEQ ID NO: 44010 - DNA, 25 bp, E. coli
ttactgacacctggcgggattctgg

SEQ ID NO: 44011 - DNA, 25 bp, E. coli
tttaaactggagagcgccatcgcca

SEQ ID NO: 44012 - DNA, 25 bp, E. coli
tttaaactggagtgcgccatcgcca

SEQ ID NO: 44013 - DNA, 25 bp, E. coli
tctggcaagcgagtacgaaaccggt

SEQ ID NO: 44014 - DNA, 25 bp, E. coli
tctggcaagcgactacgaaaccggt

SEQ ID NO: 44015 - DNA, 25 bp, E. coli
cctggcttgaggtcgttgaaaccgc

SEQ ID NO: 44016 - DNA, 25 bp, E. coli
cctggcttgaggacgttgaaaccgc

SEQ ID NO: 44017 - DNA, 25 bp, E. coli
gaaagagcatatcgaccagctgtgg

SEQ ID NO: 44018 - DNA, 25 bp, E. coli
gaaagagcatatggaccagctgtgg

SEQ ID NO: 44019 - DNA, 25 bp, E. coli
gggattcctatttcaccatgctggg

SEQ ID NO: 44020 - DNA, 25 bp, E. coli
gggattcctattacaccatgctggg

SEQ ID NO: 44021 - DNA, 25 bp, E. coli
taatccgctaccgtaaagtgcgccg

SEQ ID NO: 44022 - DNA, 25 bp, E. coli
taatccgctaccctaaagtgcgccg

SEQ ID NO: 44023 - DNA, 25 bp, E. coli
cactgaaggagctggagataacacc

SEQ ID NO: 44024 - DNA, 25 bp, E. coli
cactgaaggagcaggagataacacc

SEQ ID NO: 44025 - DNA, 25 bp, E. coli
catttgcagcgtgttgatttgacca

SEQ ID NO: 44026 - DNA, 25 bp, E. coli
catttgcagcgtcttgatttgacca

SEQ ID NO: 44027 - DNA, 25 bp, E. coli
tatggatttggttactcagacagcg

SEQ ID NO: 44028 - DNA, 25 bp, E. coli
tatggatttggtaactcagacagcg

SEQ ID NO: 44029 - DNA, 25 bp, E. coli
tatatgaaaggacagcaacagcgtt

SEQ ID NO: 44030 - DNA, 25 bp, E. coli
tatatgaaaggagagcaacagcgtt

SEQ ID NO: 44031 - DNA, 25 bp, E. coli
ttgatctggaaaccggaaacgctga

SEQ ID NO: 44032 - DNA, 25 bp, E. coli
ttgatctggaaagcggaaacgctga

SEQ ID NO: 44033 - DNA, 25 bp, E. coli
tgtacacacgagttctggatccctg

SEQ ID NO: 44034 - DNA, 25 bp, E. coli
tgtacacacgagatctggatccctg

SEQ ID NO: 44035 - DNA, 25 bp, E. coli
ccccgcttagcgactggaaaatatt

SEQ ID NO: 44036 - DNA, 25 bp, E. coli
ccccgcttagcgtctggaaaatatt

SEQ ID NO: 44037 - DNA, 25 bp, E. coli
gtaaaactgactcgaccccgcttag

SEQ ID NO: 44038 - DNA, 25 bp, E. coli
gatactatcgccttttgccacgaag

SEQ ID NO: 44039 - DNA, 25 bp, E. coli
gtaaaactgactggaccccgcttag

SEQ ID NO: 44040 - DNA, 25 bp, E. coli
gatactatcgccatttgccacgaag

SEQ ID NO: 44041 - DNA, 25 bp, E. coli
ggtggcttcctgtcccctgatgata

SEQ ID NO: 44042 - DNA, 25 bp, E. coli
ggtggcttcctgacccctgatgata

SEQ ID NO: 44043 - DNA, 25 bp, E. coli
taaccgtgatggcacaaatgagcgt

SEQ ID NO: 44044 - DNA, 25 bp, E. coli
taaccgtgatgggacaaatgagcgt

SEQ ID NO: 44045 - DNA, 25 bp, E. coli
caagacaatagccatgtaaagcact

SEQ ID NO: 44046 - DNA, 25 bp, E. coli
caagacaatagcgatgtaaagcact

SEQ ID NO: 44047 - DNA, 25 bp, E. coli
taaattcgacatttcatttggcgca

SEQ ID NO: 44048 - DNA, 25 bp, E. coli
taaattcgacatatcatttggcgca

SEQ ID NO: 44049 - DNA, 25 bp, E. coli
aaacaacgggtataaaatgccatcg

SEQ ID NO: 44050 - DNA, 25 bp, E. coli
aaacaacgggtaaaaaatgccatcg

SEQ ID NO: 44051 - DNA, 25 bp, E. coli
ttggcgcaacccgaacagaagttgg

SEQ ID NO: 44052 - DNA, 25 bp, E. coli
ttggcgcaaccccaacagaagttgg

SEQ ID NO: 44053 - DNA, 25 bp, E. coli
tgatttcggaagtgccattaagcca

SEQ ID NO: 44054 - DNA, 25 bp, E. coli
tgatttcggaagagccattaagcca

SEQ ID NO: 44055 - DNA, 25 bp, E. coli
gccattaattgaagacataccagca

SEQ ID NO: 44056 - DNA, 25 bp, E. coli
gccattaattgatgacataccagca

SEQ ID NO: 44057 - DNA, 25 bp, E. coli
ggttagcaaacctagcaccatcttc

SEQ ID NO: 44058 - DNA, 25 bp, E. coli
ggttagcaaaccaagcaccatcttc

SEQ ID NO: 44059 - DNA, 25 bp, E. coli
tggagaatcaaagatactaacgact

SEQ ID NO: 44060 - DNA, 25 bp, E. coli
tggagaatcaaacatactaacgact

SEQ ID NO: 44061 - DNA, 25 bp, E. coli
taatatgcgtggagtgcttgcttgc

SEQ ID NO: 44062 - DNA, 25 bp, E. coli
taatatgcgtggtgtgcttgcttgc

SEQ ID NO: 44063 - DNA, 25 bp, E. coli
taagtaccatgctacatacttcggt

SEQ ID NO: 44064 - DNA, 25 bp, E. coli
taagtaccatgcaacatacttcggt

SEQ ID NO: 44065 - DNA, 25 bp, E. coli
gatgaaacgttttcgaatgcactct

SEQ ID NO: 44066 - DNA, 25 bp, E. coli
gatgaaacgtttacgaatgcactct

SEQ ID NO: 44067 - DNA, 25 bp, E. coli
attacgatgtgcatgtcgcggcgga

SEQ ID NO: 44068 - DNA, 25 bp, E. coli
attacgatgtgcttgtcgcggcgga

SEQ ID NO: 44069 - DNA, 25 bp, E. coli
tataagttgcatatgcagcaagccg

SEQ ID NO: 44070 - DNA, 25 bp, E. coli
tataagttgcatttgcagcaagccg

SEQ ID NO: 44071 - DNA, 25 bp, E. coli
tgaacaggttcaggcgatgcagcac

SEQ ID NO: 44072 - DNA, 25 bp, E. coli
tgctgcctggctcgaagagtatccc

SEQ ID NO: 44073 - DNA, 25 bp, E. coli
tgaacaggttcacgcgatgcagcac

SEQ ID NO: 44074 - DNA, 25 bp, E. coli
tgctgcctggctggaagagtatccc

SEQ ID NO: 44075 - DNA, 25 bp, E. coli
tccatctgatggtttttggcacccg

SEQ ID NO: 44076 - DNA, 25 bp, E. coli
tgcgcctgcaggatgatgaatatca

SEQ ID NO: 44077 - DNA, 25 bp, E. coli
tgcgcctgcaggttgatgaatatca

SEQ ID NO: 44078 - DNA, 25 bp, E. coli
tccatctgatggattttggcacccg

SEQ ID NO: 44079 - DNA, 25 bp, E. coli
gaagagtatcccgaccaacttggca

SEQ ID NO: 44080 - DNA, 25 bp, E. coli
gaagagtatccccaccaacttggca

SEQ ID NO: 44081 - DNA, 25 bp, E. coli
gaaatggtacatggctatcgctcac

SEQ ID NO: 44082 - DNA, 25 bp, E. coli
gacaatctggatatacgcaaagcgg

SEQ ID NO: 44083 - DNA, 25 bp, E. coli
gacaatctggatttacgcaaagcgg

SEQ ID NO: 44084 - DNA, 25 bp, E. coli
gaaatggtacatcgctatcgctcac

SEQ ID NO: 44085 - DNA, 25 bp, E. coli
cgtggcgtgaagacatcctctggga

SEQ ID NO: 44086 - DNA, 25 bp, E. coli
cgtggcgtgaagtcatcctctggga

SEQ ID NO: 44087 - DNA, 25 bp, E. coli
gatattcgtttaagcggcccgtggc

SEQ ID NO: 44088 - DNA, 25 bp, E. coli
gatattcgtttatgcggcccgtggc

SEQ ID NO: 44089 - DNA, 25 bp, E. coli
cagagatctcctggcgtgtgggtta

SEQ ID NO: 44090 - DNA, 25 bp, E. coli
cagagatctcctcgcgtgtgggtta

SEQ ID NO: 44091 - DNA, 25 bp, E. coli
aaatgtcgatcactttgccaaactg

SEQ ID NO: 44092 - DNA, 25 bp, E. coli
aaatgtcgatcagtttgccaaactg

SEQ ID NO: 44093 - DNA, 25 bp, E. coli
aaaatgcttatcgttcggagcaggg

SEQ ID NO: 44094 - DNA, 25 bp, E. coli
aaaatgcttatccttcggagcaggg

SEQ ID NO: 44095 - DNA, 25 bp, E. coli
ttaacgatccggcaacgacgtgtac

SEQ ID NO: 44096 - DNA, 25 bp, E. coli
ttaacgatccgggaacgacgtgtac

SEQ ID NO: 44097 - DNA, 25 bp, E. coli
ttagcgatgatccaaaatgggagtc

SEQ ID NO: 44098 - DNA, 25 bp, E. coli
ttagcgatgatcgaaaatgggagtc

SEQ ID NO: 44099 - DNA, 25 bp, E. coli
ttattcaacggcctatgacggaagc

SEQ ID NO: 44100 - DNA, 25 bp, E. coli
ttattcaacggcgtatgacggaagc

SEQ ID NO: 44101 - DNA, 25 bp, E. coli
gccaaactgtttatgcgccatgtcg

SEQ ID NO: 44102 - DNA, 25 bp, E. coli
gccaaactgtttttgcgccatgtcg

SEQ ID NO: 44103 - DNA, 25 bp, E. coli
gaatttcctcaaccggtaagtcttg

SEQ ID NO: 44104 - DNA, 25 bp, E. coli
gaatttcctcaagcggtaagtcttg

SEQ ID NO: 44105 - DNA, 25 bp, E. coli
gaaaaaatttcgagccagcgtcagt

SEQ ID NO: 44106 - DNA, 25 bp, E. coli
gaaaaaatttcgtgccagcgtcagt

SEQ ID NO: 44107 - DNA, 25 bp, E. coli
tgcggtggcctctgacgttaacgat

SEQ ID NO: 44108 - DNA, 25 bp, E. coli
tgcggtggcctcagacgttaacgat

SEQ ID NO: 44109 - DNA, 25 bp, E. coli
gagctaagtgtgattttgccgcaaa

SEQ ID NO: 44110 - DNA, 25 bp, E. coli
gagctaagtgtgtttttgccgcaaa

SEQ ID NO: 44111 - DNA, 25 bp, E. coli
aatcagaatggcttcctttatgcaa

SEQ ID NO: 44112 - DNA, 25 bp, E. coli
aatcagaatggcatcctttatgcaa

SEQ ID NO: 44113 - DNA, 25 bp, E. coli
aagatcacattcacgctttcccctg

SEQ ID NO: 44114 - DNA, 25 bp, E. coli
aagatcacattctcgctttcccctg

SEQ ID NO: 44115 - DNA, 25 bp, E. coli
taccgttcagaatccagttaataca

SEQ ID NO: 44116 - DNA, 25 bp, E. coli
cacgggtgtcgaatccattttttgc

SEQ ID NO: 44117 - DNA, 25 bp, E. coli
cacgggtgtcgattccattttttgc

SEQ ID NO: 44118 - DNA, 25 bp, E. coli
taccgttcagaaaccagttaataca

SEQ ID NO: 44119 - DNA, 25 bp, E. coli
tattgagttaatgagaatggcatcc

SEQ ID NO: 44120 - DNA, 25 bp, E. coli
tattgagttaatcagaatggcatcc

SEQ ID NO: 44121 - DNA, 25 bp, E. coli
tttttgctgaaccttaatgaccatc

SEQ ID NO: 44122 - DNA, 25 bp, E. coli
ttactttgctcctttccgtgctggc

SEQ ID NO: 44123 - DNA, 25 bp, E. coli
ttactttgctccattccgtgctggc

SEQ ID NO: 44124 - DNA, 25 bp, E. coli
ttccgtgctggcagcgcttgcggcc

SEQ ID NO: 44125 - DNA, 25 bp, E. coli
tttttgctgaacgttaatgaccatc

SEQ ID NO: 44126 - DNA, 25 bp, E. coli
ttccgtgctggctgcgcttgcggcc

SEQ ID NO: 44127 - DNA, 25 bp, E. coli
gaccatcattttagtaccgttcaga

SEQ ID NO: 44128 - DNA, 25 bp, E. coli
gaccatcatttttgtaccgttcaga

SEQ ID NO: 44129 - DNA, 25 bp, E. coli
ctttcccctgcgacacgggtgtcga

SEQ ID NO: 44130 - DNA, 25 bp, E. coli
ctttcccctgcgtcacgggtgtcga

SEQ ID NO: 44131 - DNA, 25 bp, E. coli
ggccagcataccacacttctcgtga

SEQ ID NO: 44132 - DNA, 25 bp, E. coli
ggccagcatacctcacttctcgtga

SEQ ID NO: 44133 - DNA, 25 bp, E. coli
cagccaactggaaaacggttacaac

SEQ ID NO: 44134 - DNA, 25 bp, E. coli
cagccaactggataacggttacaac

SEQ ID NO: 44135 - DNA, 25 bp, E. coli
caccgccagtaagtcgtgtagcagg

SEQ ID NO: 44136 - DNA, 25 bp, E. coli
caccgccagtaactcgtgtagcagg

SEQ ID NO: 44137 - DNA, 25 bp, E. coli
caggcatggatcgatgatgggaaca

SEQ ID NO: 44138 - DNA, 25 bp, E. coli
caggcatggatccatgatgggaaca

SEQ ID NO: 44139 - DNA, 25 bp, E. coli
catgccggtgtgctcatctatggta

SEQ ID NO: 44140 - DNA, 25 bp, E. coli
catgccggtgtggtcatctatggta

SEQ ID NO: 44141 - DNA, 25 bp, E. coli
tatggtacgcgcattatttatccgg

SEQ ID NO: 44142 - DNA, 25 bp, E. coli
tatggtacgcgctttatttatccgg

SEQ ID NO: 44143 - DNA, 25 bp, E. coli
tagcaggtggttgtggccaacaact

SEQ ID NO: 44144 - DNA, 25 bp, E. coli
tagcaggtggttctggccaacaact

SEQ ID NO: 44145 - DNA, 25 bp, E. coli
tgatgggaacacgactatcgcgcca

SEQ ID NO: 44146 - DNA, 25 bp, E. coli
tgatgggaacaccactatcgcgcca

SEQ ID NO: 44147 - DNA, 25 bp, E. coli
tccaaacaatcctcaaaatgcaggg

SEQ ID NO: 44148 - DNA, 25 bp, E. coli
tccaagcggaatagctccggtagat

SEQ ID NO: 44149 - DNA, 25 bp, E. coli
tccaaacaatccacaaaatgcaggg

SEQ ID NO: 44150 - DNA, 25 bp, E. coli
tccaagcggaattgctccggtagat

SEQ ID NO: 44151 - DNA, 25 bp, E. coli
taaagttactttcgcgtccaagcgg

SEQ ID NO: 44152 - DNA, 25 bp, E. coli
taaagttactttggcgtccaagcgg

SEQ ID NO: 44153 - DNA, 25 bp, E. coli
taacatccatagtaaaatcgccgcg

SEQ ID NO: 44154 - DNA, 25 bp, E. coli
taacatccatagaaaaatcgccgcg

SEQ ID NO: 44155 - DNA, 25 bp, E. coli
aatggctgcgacagcatatggccgc

SEQ ID NO: 44156 - DNA, 25 bp, E. coli
aatggctgcgactgcatatggccgc

SEQ ID NO: 44157 - DNA, 25 bp, E. coli
cacgattaaccggaccgaggtgcat

SEQ ID NO: 44158 - DNA, 25 bp, E. coli
cacgattaaccgcaccgaggtgcat

SEQ ID NO: 44159 - DNA, 25 bp, E. coli
acaggaccggcgactcattcagcgg

SEQ ID NO: 44160 - DNA, 25 bp, E. coli
acaggaccggcgtctcattcagcgg

SEQ ID NO: 44161 - DNA, 25 bp, E. coli
tttttacccggccagatgacgccac

SEQ ID NO: 44162 - DNA, 25 bp, E. coli
tttttacccggcgagatgacgccac

SEQ ID NO: 44163 - DNA, 25 bp, E. coli
tgcttcagctggaggatatccgtgt

SEQ ID NO: 44164 - DNA, 25 bp, E. coli
tgaaacgctcttgaccggcacgatt

SEQ ID NO: 44165 - DNA, 25 bp, E. coli
tgcttcagctggtggatatccgtgt

SEQ ID NO: 44166 - DNA, 25 bp, E. coli
tgaaacgctcttcaccggcacgatt

SEQ ID NO: 44167 - DNA, 25 bp, E. coli
gcgcataaccatgcttccggcgaga

SEQ ID NO: 44168 - DNA, 25 bp, E. coli
gcgcataaccatccttccggcgaga

SEQ ID NO: 44169 - DNA, 25 bp, E. coli
gcggcggtgatactcgcgcataacc

SEQ ID NO: 44170 - DNA, 25 bp, E. coli
gcggcggtgatagtcgcgcataacc

SEQ ID NO: 44171 - DNA, 25 bp, E. coli
gaatcagttgatagcccatgaaacg

SEQ ID NO: 44172 - DNA, 25 bp, E. coli
gaatcagttgattgcccatgaaacg

SEQ ID NO: 44173 - DNA, 25 bp, E. coli
cccgggaggtggtcaaacgtgctct

SEQ ID NO: 44174 - DNA, 25 bp, E. coli
cccgggaggtggacaaacgtgctct

SEQ ID NO: 44175 - DNA, 25 bp, E. coli
tcacgcagcgactggttcaggtgct

SEQ ID NO: 44176 - DNA, 25 bp, E. coli
tcacgcagcgacaggttcaggtgct

SEQ ID NO: 44177 - DNA, 25 bp, E. coli
cagctggatatgtaccgccggtgaa

SEQ ID NO: 44178 - DNA, 25 bp, E. coli
cagctggatatgaaccgccggtgaa

SEQ ID NO: 44179 - DNA, 25 bp, E. coli
agctggatatgtaccgccggtgaaa

SEQ ID NO: 44180 - DNA, 25 bp, E. coli
atcagctggataagtaccgccggtg

SEQ ID NO: 44181 - DNA, 25 bp, E. coli
agctggatatgttccgccggtgaaa

SEQ ID NO: 44182 - DNA, 25 bp, E. coli
atcagctggatatgtaccgccggtg

SEQ ID NO: 44183 - DNA, 25 bp, E. coli
tatgtaccgccgctgaaatcggcgc

SEQ ID NO: 44184 - DNA, 25 bp, E. coli
tatgtaccgccggtgaaatcggcgc

SEQ ID NO: 44185 - DNA, 25 bp, E. coli
taccgccggtgaaatcggcgctctg

SEQ ID NO: 44186 - DNA, 25 bp, E. coli
taccgccggtgatatcggcgctctg

SEQ ID NO: 44187 - DNA, 25 bp, E. coli
tgtaccgccggtcaaatcggcgctc

SEQ ID NO: 44188 - DNA, 25 bp, E. coli
tgtaccgccggtgaaatcggcgctc

SEQ ID NO: 44189 - DNA, 25 bp, E. coli
tcagctggatatctaccgccggtga

SEQ ID NO: 44190 - DNA, 25 bp, E. coli
tcagctggatatgtaccgccggtga

SEQ ID NO: 44191 - DNA, 25 bp, E. coli
ttaacatccgcagccgcgtcctttc

SEQ ID NO: 44192 - DNA, 25 bp, E. coli
ttaacatccgcacccgcgtcctttc

SEQ ID NO: 44193 - DNA, 25 bp, E. coli
gccgcgtcctttgtcatttacgtac

SEQ ID NO: 44194 - DNA, 25 bp, E. coli
gccgcgtcctttctcatttacgtac

SEQ ID NO: 44195 - DNA, 25 bp, E. coli
gctggatatgtaccgccggtgaaat

SEQ ID NO: 44196 - DNA, 25 bp, E. coli
gctggatatgtagcgccggtgaaat

SEQ ID NO: 44197 - DNA, 25 bp, E. coli
gcagccgcgtcctttctcatttacg

SEQ ID NO: 44198 - DNA, 25 bp, E. coli
gcagccgcgtccattctcatttacg

SEQ ID NO: 44199 - DNA, 25 bp, E. coli
caaagtgagcatatcaggcgttatg

SEQ ID NO: 44200 - DNA, 25 bp, E. coli
caaagtgagcatttcaggcgttatg

SEQ ID NO: 44201 - DNA, 25 bp, E. coli
caggtgtcaagaatggagagttctc

SEQ ID NO: 44202 - DNA, 25 bp, E. coli
caggtgtcaagattggagagttctc

SEQ ID NO: 44203 - DNA, 25 bp, E. coli
taaacatcagctctatcaccatgct

SEQ ID NO: 44204 - DNA, 25 bp, E. coli
taaacatcagctgtatcaccatgct

SEQ ID NO: 44205 - DNA, 25 bp, E. coli
taccatgctctctgtagatgccagc

SEQ ID NO: 44206 - DNA, 25 bp, E. coli
tatgtccgcaatttcaggtgtcaag

SEQ ID NO: 44207 - DNA, 25 bp, E. coli
taccatgctctcagtagatgccagc

SEQ ID NO: 44208 - DNA, 25 bp, E. coli
tatgtccgcaatatcaggtgtcaag

SEQ ID NO: 44209 - DNA, 25 bp, E. coli
tgacgcctgataacccgcctaactt

SEQ ID NO: 44210 - DNA, 25 bp, E. coli
tgacgcctgatatcccgcctaactt

SEQ ID NO: 44211 - DNA, 25 bp, E. coli
tcttcggcgtggttatttcttatgc

SEQ ID NO: 44212 - DNA, 25 bp, E. coli
tcttcggcgtggatatttcttatgc

SEQ ID NO: 44213 - DNA, 25 bp, E. coli
tcaccatgctgatgcaaagtgagca

SEQ ID NO: 44214 - DNA, 25 bp, E. coli
gcctaacttattatgtactgcctac

SEQ ID NO: 44215 - DNA, 25 bp, E. coli
gcctaacttattttgtactgcctac

SEQ ID NO: 44216 - DNA, 25 bp, E. coli
tcaccatgctgaagcaaagtgagca

SEQ ID NO: 44217 - DNA, 25 bp, E. coli
gagttctcgctctccattcttgacg

SEQ ID NO: 44218 - DNA, 25 bp, E. coli
gagttctcgctcaccattcttgacg

SEQ ID NO: 44219 - DNA, 25 bp, E. coli
gatggagaaaattttatcttcggcg

SEQ ID NO: 44220 - DNA, 25 bp, E. coli
gatggagaaaatattatcttcggcg

SEQ ID NO: 44221 - DNA, 25 bp, E. coli
caaattcatcaccatgcctggcggg

SEQ ID NO: 44222 - DNA, 25 bp, E. coli
caaattcatcacgatgcctggcggg

SEQ ID NO: 44223 - DNA, 25 bp, E. coli
catgacatgggaactaaaaccggga

SEQ ID NO: 44224 - DNA, 25 bp, E. coli
catgacatgggatctaaaaccggga

SEQ ID NO: 44225 - DNA, 25 bp, E. coli
tactggcccgttgaatggatctgga

SEQ ID NO: 44226 - DNA, 25 bp, E. coli
tactggcccgttcaatggatctgga

SEQ ID NO: 44227 - DNA, 25 bp, E. coli
aaatcgtggatattgcctgcggtcg

SEQ ID NO: 44228 - DNA, 25 bp, E. coli
aaatcgtggataatgcctgcggtcg

SEQ ID NO: 44229 - DNA, 25 bp, E. coli
tgactacaccgaacgaggactgctg

SEQ ID NO: 44230 - DNA, 25 bp, E. coli
tgactacaccgatcgaggactgctg

SEQ ID NO: 44231 - DNA, 25 bp, E. coli
tcgaatgagaataaccacgcgggtc

SEQ ID NO: 44232 - DNA, 25 bp, E. coli
tcgaatgagaattaccacgcgggtc

SEQ ID NO: 44233 - DNA, 25 bp, E. coli
gaagtcgcagatcccgtaatcgtag

SEQ ID NO: 44234 - DNA, 25 bp, E. coli
gaagtcgcagatgccgtaatcgtag

SEQ ID NO: 44235 - DNA, 25 bp, E. coli
ccccgctgggcttaggaatatgcaa

SEQ ID NO: 44236 - DNA, 25 bp, E. coli
ccccgctgggctaaggaatatgcaa

SEQ ID NO: 44237 - DNA, 25 bp, E. coli
gattgtgtgtaccagaaccagccag

SEQ ID NO: 44238 - DNA, 25 bp, E. coli
gattgtgtgtacgagaaccagccag

SEQ ID NO: 44239 - DNA, 25 bp, E. coli
ggataactgccctgactgtggtgcg

SEQ ID NO: 44240 - DNA, 25 bp, E. coli
ggataactgcccagactgtggtgcg

SEQ ID NO: 44241 - DNA, 25 bp, E. coli
taatcgtagaagacatagagccagg

SEQ ID NO: 44242 - DNA, 25 bp, E. coli
taatcgtagaagtcatagagccagg

SEQ ID NO: 44243 - DNA, 25 bp, E. coli
aaggcgttgagcgtgtcttccagac

SEQ ID NO: 44244 - DNA, 25 bp, E. coli
aaggcgttgagcctgtcttccagac

SEQ ID NO: 44245 - DNA, 25 bp, E. coli
caagagcagatgtagcaggacgtac

SEQ ID NO: 44246 - DNA, 25 bp, E. coli
caagagcagatgaagcaggacgtac

SEQ ID NO: 44247 - DNA, 25 bp, E. coli
caaacgtcgtggagctgttcgtaaa

SEQ ID NO: 44248 - DNA, 25 bp, E. coli
caaacgtcgtggtgctgttcgtaaa

SEQ ID NO: 44249 - DNA, 25 bp, E. coli
taaactgtactacctgcgtgagcgt

SEQ ID NO: 44250 - DNA, 25 bp, E. coli
taaactgtactagctgcgtgagcgt

SEQ ID NO: 44251 - DNA, 25 bp, E. coli
aaaacgtctgcacgcattcgagggc

SEQ ID NO: 44252 - DNA, 25 bp, E. coli
aaaacgtctgcaggcattcgagggc

SEQ ID NO: 44253 - DNA, 25 bp, E. coli
tatcgctattcgaaaccgcggtctg

SEQ ID NO: 44254 - DNA, 25 bp, E. coli
tatcgctattcgtaaccgcggtctg

SEQ ID NO: 44255 - DNA, 25 bp, E. coli
tgttgaaggttcgaaaaaacgtctg

SEQ ID NO: 44256 - DNA, 25 bp, E. coli
tgttgaaggttccaaaaaacgtctg

SEQ ID NO: 44257 - DNA, 25 bp, E. coli
tctccggtagttgacagcatttctg

SEQ ID NO: 44258 - DNA, 25 bp, E. coli
tctccggtagttcacagcatttctg

SEQ ID NO: 44259 - DNA, 25 bp, E. coli
tccgtccgggtgttaccgtggaagt

SEQ ID NO: 44260 - DNA, 25 bp, E. coli
tccgtccgggtgataccgtggaagt

SEQ ID NO: 44261 - DNA, 25 bp, E. coli
gcactctgcattgactgttcgtaaa

SEQ ID NO: 44262 - DNA, 25 bp, E. coli
gcactctgcattcactgttcgtaaa

SEQ ID NO: 44263 - DNA, 25 bp, E. coli
gtaaggctgctcgtatcaaagagcg

SEQ ID NO: 44264 - DNA, 25 bp, E. coli
gtaaggctgctcctatcaaagagcg

SEQ ID NO: 44265 - DNA, 25 bp, E. coli
ctttattgccgatacatatgttaat

SEQ ID NO: 44266 - DNA, 25 bp, E. coli
ctttattgccgaaacatatgttaat

SEQ ID NO: 44267 - DNA, 25 bp, E. coli
atcgctcctgcggtcgctaaagccg

SEQ ID NO: 44268 - DNA, 25 bp, E. coli
atcgctcctgcgctcgctaaagccg

SEQ ID NO: 44269 - DNA, 25 bp, E. coli
tttgcaccggtccttctgactatcc

SEQ ID NO: 44270 - DNA, 25 bp, E. coli
tttgcaccggtcgttctgactatcc

SEQ ID NO: 44271 - DNA, 25 bp, E. coli
tgaagttgtcgcggcgctcgaacca

SEQ ID NO: 44272 - DNA, 25 bp, E. coli
tgaagttgtcgccgcgctcgaacca

SEQ ID NO: 44273 - DNA, 25 bp, E. coli
tcgttctgactaaccgaaccaggtg

SEQ ID NO: 44274 - DNA, 25 bp, E. coli
tcgttctgactatccgaaccaggtg

SEQ ID NO: 44275 - DNA, 25 bp, E. coli
tcatttgcaccgctcgttctgacta

SEQ ID NO: 44276 - DNA, 25 bp, E. coli
tcatttgcaccggtcgttctgacta

SEQ ID NO: 44277 - DNA, 25 bp, E. coli
gcaccggtcgttctgactatccgaa

SEQ ID NO: 44278 - DNA, 25 bp, E. coli
gccatcatttgcaccggtcgttctg

SEQ ID NO: 44279 - DNA, 25 bp, E. coli
gcaccggtcgttgtgactatccgaa

SEQ ID NO: 44280 - DNA, 25 bp, E. coli
gccatcatttgctccggtcgttctg

SEQ ID NO: 44281 - DNA, 25 bp, E. coli
gatacatatgtttatgatgaaccgg

SEQ ID NO: 44282 - DNA, 25 bp, E. coli
gatacatatgttaatgatgaaccgg

SEQ ID NO: 44283 - DNA, 25 bp, E. coli
ggtcgttctgacaatccgaaccagg

SEQ ID NO: 44284 - DNA, 25 bp, E. coli
ggtcgttctgactatccgaaccagg

SEQ ID NO: 44285 - DNA, 25 bp, E. coli
ggatgccatcatttgcaccggtcgt

SEQ ID NO: 44286 - DNA, 25 bp, E. coli
ggatgccatcatatgcaccggtcgt

SEQ ID NO: 44287 - DNA, 25 bp, E. coli
aattaaaaccgctcagggcaacacg

SEQ ID NO: 44288 - DNA, 25 bp, E. coli
aattaaaaccgcacagggcaacacg

SEQ ID NO: 44289 - DNA, 25 bp, E. coli
tacacggcgacgatagtgatgaccg

SEQ ID NO: 44290 - DNA, 25 bp, E. coli
tacacggcgacgttagtgatgaccg

SEQ ID NO: 44291 - DNA, 25 bp, E. coli
tatgacctggaaaggcctgaaaacc

SEQ ID NO: 44292 - DNA, 25 bp, E. coli
tagcgacggcgaaaagatacacggc

SEQ ID NO: 44293 - DNA, 25 bp, E. coli
tatgacctggaatggcctgaaaacc

SEQ ID NO: 44294 - DNA, 25 bp, E. coli
tagcgacggcgataagatacacggc

SEQ ID NO: 44295 - DNA, 25 bp, E. coli
tcgagctgggttatatctatgcaca

SEQ ID NO: 44296 - DNA, 25 bp, E. coli
tcgagctgggttttatctatgcaca

SEQ ID NO: 44297 - DNA, 25 bp, E. coli
gaaaaagatttctcggcagggatta

SEQ ID NO: 44298 - DNA, 25 bp, E. coli
gaaaaagatttcacggcagggatta

SEQ ID NO: 44299 - DNA, 25 bp, E. coli
cgatcgtaccggttatggcatgagt

SEQ ID NO: 44300 - DNA, 25 bp, E. coli
cgatcgtaccggatatggcatgagt

SEQ ID NO: 44301 - DNA, 25 bp, E. coli
taacgctggaacaacgcctggaagc

SEQ ID NO: 44302 - DNA, 25 bp, E. coli
taatggctatttcgctgggttctcc

SEQ ID NO: 44303 - DNA, 25 bp, E. coli
taaacggtcaatcaacgacggagtc

SEQ ID NO: 44304 - DNA, 25 bp, E. coli
taacgctggaactacgcctggaagc

SEQ ID NO: 44305 - DNA, 25 bp, E. coli
taaacggtcaatgaacgacggagtc

SEQ ID NO: 44306 - DNA, 25 bp, E. coli
taatggctatttggctgggttctcc

SEQ ID NO: 44307 - DNA, 25 bp, E. coli
gagtcagagaagtaaaacgccaccc

SEQ ID NO: 44308 - DNA, 25 bp, E. coli
gagtcagagaagaaaaacgccaccc

SEQ ID NO: 44309 - DNA, 25 bp, E. coli
cactcagtcagggaacgtgggtgat

SEQ ID NO: 44310 - DNA, 25 bp, E. coli
cactcagtcaggcaacgtgggtgat

SEQ ID NO: 44311 - DNA, 25 bp, E. coli
catgctcagttgaccgaatcggtga

SEQ ID NO: 44312 - DNA, 25 bp, E. coli
catgctcagttgtccgaatcggtga

SEQ ID NO: 44313 - DNA, 25 bp, E. coli
tacgtccataacgacgacgatgtgg

SEQ ID NO: 44314 - DNA, 25 bp, E. coli
acctgccaaacgttctatcgcgctg

SEQ ID NO: 44315 - DNA, 25 bp, E. coli
acagtttatccacggcttcgcggtg

SEQ ID NO: 44316 - DNA, 25 bp, E. coli
acctgccaaacgatctatcgcgctg

SEQ ID NO: 44317 - DNA, 25 bp, E. coli
acagtttatccagggcttcgcggtg

SEQ ID NO: 44318 - DNA, 25 bp, E. coli
tacgtccataaccacgacgatgtgg

SEQ ID NO: 44319 - DNA, 25 bp, E. coli
tgaccgaatcggagaacccgtataa

SEQ ID NO: 44320 - DNA, 25 bp, E. coli
tgaccgaatcggtgaacccgtataa

SEQ ID NO: 44321 - DNA, 25 bp, E. coli
tgcaccatgctcagttgaccgaatc

SEQ ID NO: 44322 - DNA, 25 bp, E. coli
tgcaccatgctctgttgaccgaatc

SEQ ID NO: 44323 - DNA, 25 bp, E. coli
gggtctatcggtacgtccataacga

SEQ ID NO: 44324 - DNA, 25 bp, E. coli
gggtctatcggttcgtccataacga

SEQ ID NO: 44325 - DNA, 25 bp, E. coli
tggccacagtttttccagggcttcg

SEQ ID NO: 44326 - DNA, 25 bp, E. coli
tggccacagtttatccagggcttcg

SEQ ID NO: 44327 - DNA, 25 bp, E. coli
taacgacgacgatgtggactaaccg

SEQ ID NO: 44328 - DNA, 25 bp, E. coli
taacgacgacgaagtggactaaccg

SEQ ID NO: 44329 - DNA, 25 bp, E. coli
gacgacgatgtggactaaccgcgag

SEQ ID NO: 44330 - DNA, 25 bp, E. coli
gacgacgatgtgcactaaccgcgag

SEQ ID NO: 44331 - DNA, 25 bp, E. coli
caagtatacactaattattgagcta

SEQ ID NO: 44332 - DNA, 25 bp, E. coli
aatgacatgtcggagtaaaacgcac

SEQ ID NO: 44333 - DNA, 25 bp, E. coli
aataccgcgctaactgtttcagttg

SEQ ID NO: 44334 - DNA, 25 bp, E. coli
aatgacatgtcgcagtaaaacgcac

SEQ ID NO: 44335 - DNA, 25 bp, E. coli
caagtatacacttattattgagcta

SEQ ID NO: 44336 - DNA, 25 bp, E. coli
aataccgcgctatctgtttcagttg

SEQ ID NO: 44337 - DNA, 25 bp, E. coli
cagttgatactatgtgttaaaaatg

SEQ ID NO: 44338 - DNA, 25 bp, E. coli
cagttgatactaagtgttaaaaatg

SEQ ID NO: 44339 - DNA, 25 bp, E. coli
tattgagctaattaataccgcgcta

SEQ ID NO: 44340 - DNA, 25 bp, E. coli
tattgagctaataaataccgcgcta

SEQ ID NO: 44341 - DNA, 25 bp, E. coli
ttgagagggatatgcaacattttcc

SEQ ID NO: 44342 - DNA, 25 bp, E. coli
ttcattgtgtgattgacatgtcgca

SEQ ID NO: 44343 - DNA, 25 bp, E. coli
ttgagagggataagcaacattttcc

SEQ ID NO: 44344 - DNA, 25 bp, E. coli
ttcattgtgtgaatgacatgtcgca

SEQ ID NO: 44345 - DNA, 25 bp, E. coli
gcagtaaaacgctctattcgttaaa

SEQ ID NO: 44346 - DNA, 25 bp, E. coli
gcagtaaaacgcactattcgttaaa

SEQ ID NO: 44347 - DNA, 25 bp, E. coli
gataatgaattttgcataatgtgct

SEQ ID NO: 44348 - DNA, 25 bp, E. coli
gataatgaatttagcataatgtgct

SEQ ID NO: 44349 - DNA, 25 bp, E. coli
gataagcaacatattccccgccgtc

SEQ ID NO: 44350 - DNA, 25 bp, E. coli
gataagcaacattttccccgccgtc

SEQ ID NO: 44351 - DNA, 25 bp, E. coli
tacggttatttatcgttaattctag

SEQ ID NO: 44352 - DNA, 25 bp, E. coli
tacggttatttaacgttaattctag

SEQ ID NO: 44353 - DNA, 25 bp, E. coli
tacgaagagttaccacgaaagaaaa

SEQ ID NO: 44354 - DNA, 25 bp, E. coli
tacgaagagttagcacgaaagaaaa

SEQ ID NO: 44355 - DNA, 25 bp, E. coli
aaaatcatcattgaccttctggacg

SEQ ID NO: 44356 - DNA, 25 bp, E. coli
aaaatcatcattcaccttctggacg

SEQ ID NO: 44357 - DNA, 25 bp, E. coli
tgaacttttaaatactcttgaggag

SEQ ID NO: 44358 - DNA, 25 bp, E. coli
tgaacttttaaaaactcttgaggag

SEQ ID NO: 44359 - DNA, 25 bp, E. coli
tccctgacagtgagacagatgaact

SEQ ID NO: 44360 - DNA, 25 bp, E. coli
tccctgacagtgtgacagatgaact

SEQ ID NO: 44361 - DNA, 25 bp, E. coli
tcattgaccttctggacgagctccc

SEQ ID NO: 44362 - DNA, 25 bp, E. coli
tctggacgagctccctgacagtgag

SEQ ID NO: 44363 - DNA, 25 bp, E. coli
tctggacgagctgcctgacagtgag

SEQ ID NO: 44364 - DNA, 25 bp, E. coli
tcattgaccttcaggacgagctccc

SEQ ID NO: 44365 - DNA, 25 bp, E. coli
gcaatttacgaacagttagcacgaa

SEQ ID NO: 44366 - DNA, 25 bp, E. coli
gaagtacaatgctatttacgaagag

SEQ ID NO: 44367 - DNA, 25 bp, E. coli
gcaatttacgaagagttagcacgaa

SEQ ID NO: 44368 - DNA, 25 bp, E. coli
gaagtacaatgcaatttacgaagag

SEQ ID NO: 44369 - DNA, 25 bp, E. coli
gacagtgagacagatgaacttttaa

SEQ ID NO: 44370 - DNA, 25 bp, E. coli
gaaaaaacagaagtacaatgcaatt

SEQ ID NO: 44371 - DNA, 25 bp, E. coli
gacagtgagacacatgaacttttaa

SEQ ID NO: 44372 - DNA, 25 bp, E. coli
gaaaaaacagaactacaatgcaatt

SEQ ID NO: 44373 - DNA, 25 bp, E. coli
gacgagctccctgacagtgagacag

SEQ ID NO: 44374 - DNA, 25 bp, E. coli
gacgagctccctcacagtgagacag

SEQ ID NO: 44375 - DNA, 25 bp, E. coli
acaccggcaactcggtacagcctga

SEQ ID NO: 44376 - DNA, 25 bp, E. coli
acaccggcaactgggtacagcctga

SEQ ID NO: 44377 - DNA, 25 bp, E. coli
tatgacgctggatagtgagatcgcg

SEQ ID NO: 44378 - DNA, 25 bp, E. coli
tatgacgctggaaagtgagatcgcg

SEQ ID NO: 44379 - DNA, 25 bp, E. coli
tattaccgggcggttagcgacgtac

SEQ ID NO: 44380 - DNA, 25 bp, E. coli
tattaccgggcgcttagcgacgtac

SEQ ID NO: 44381 - DNA, 25 bp, E. coli
ttaatgtcaccgactgggatcaccc

SEQ ID NO: 44382 - DNA, 25 bp, E. coli
ttaatgtcaccgtctgggatcaccc

SEQ ID NO: 44383 - DNA, 25 bp, E. coli
gaaatccgcagtgatattaccgggc

SEQ ID NO: 44384 - DNA, 25 bp, E. coli
gaaatccgcagtcatattaccgggc

SEQ ID NO: 44385 - DNA, 25 bp, E. coli
cgaattaccagtatcgcgtcgggcc

SEQ ID NO: 44386 - DNA, 25 bp, E. coli
cgaattaccagtttcgcgtcgggcc

SEQ ID NO: 44387 - DNA, 25 bp, E. coli
gtagcgcgccccaatatgacgctgg

SEQ ID NO: 44388 - DNA, 25 bp, E. coli
ggaaaacgctcgctgaaatccgcag

SEQ ID NO: 44389 - DNA, 25 bp, E. coli
gtagcgcgcccctatatgacgctgg

SEQ ID NO: 44390 - DNA, 25 bp, E. coli
ggaaaacgctcggtgaaatccgcag

SEQ ID NO: 44391 - DNA, 25 bp, E. coli
taagcggttgcacagtacttccggg

SEQ ID NO: 44392 - DNA, 25 bp, E. coli
taagcggttgcagagtacttccggg

SEQ ID NO: 44393 - DNA, 25 bp, E. coli
gacccgcaggtgcacgttaatatcg

SEQ ID NO: 44394 - DNA, 25 bp, E. coli
gacgtcatcaaacagcaggacgctg

SEQ ID NO: 44395 - DNA, 25 bp, E. coli
gacccgcaggtggacgttaatatcg

SEQ ID NO: 44396 - DNA, 25 bp, E. coli
gacgtcatcaaagagcaggacgctg

SEQ ID NO: 44397 - DNA, 25 bp, E. coli
aatcgttcctcgaactgatcgccct

SEQ ID NO: 44398 - DNA, 25 bp, E. coli
aatcgttcctcgtactgatcgccct

SEQ ID NO: 44399 - DNA, 25 bp, E. coli
accaacctggactgctggcgcgagt

SEQ ID NO: 44400 - DNA, 25 bp, E. coli
accaacctggacagctggcgcgagt

SEQ ID NO: 44401 - DNA, 25 bp, E. coli
aactgatcgccctcgaccaacctgg

SEQ ID NO: 44402 - DNA, 25 bp, E. coli
aactgatcgcccacgaccaacctgg

SEQ ID NO: 44403 - DNA, 25 bp, E. coli
ttagaccgccgctatttaagtgttc

SEQ ID NO: 44404 - DNA, 25 bp, E. coli
ttagaccgccgcaatttaagtgttc

SEQ ID NO: 44405 - DNA, 25 bp, E. coli
tctgtgccgaataagaccgccgcaa

SEQ ID NO: 44406 - DNA, 25 bp, E. coli
tctgtgccgaattagaccgccgcaa

SEQ ID NO: 44407 - DNA, 25 bp, E. coli
ccgtctgtgccgaattagaccgccg

SEQ ID NO: 44408 - DNA, 25 bp, E. coli
cgcaaatcgttcgtcgaactgatcg

SEQ ID NO: 44409 - DNA, 25 bp, E. coli
ccgccgcaattttagtgttcacgac

SEQ ID NO: 44410 - DNA, 25 bp, E. coli
ccgcaatttaagtgttcacgacgca

SEQ ID NO: 44411 - DNA, 25 bp, E. coli
ccgccgcaatttaagtgttcacgac

SEQ ID NO: 44412 - DNA, 25 bp, E. coli
cgcaaatcgttcctcgaactgatcg

SEQ ID NO: 44413 - DNA, 25 bp, E. coli
ccgtctgtgccgtattagaccgccg

SEQ ID NO: 44414 - DNA, 25 bp, E. coli
ccgcaatttaagagttcacgacgca

SEQ ID NO: 44415 - DNA, 25 bp, E. coli
gtgccgaattagtccgccgcaattt

SEQ ID NO: 44416 - DNA, 25 bp, E. coli
gtgccgaattagaccgccgcaattt

SEQ ID NO: 44417 - DNA, 25 bp, E. coli
gaccgccgcaatttaagtgttcacg

SEQ ID NO: 44418 - DNA, 25 bp, E. coli
gaccgccgcaatataagtgttcacg

SEQ ID NO: 44419 - DNA, 25 bp, E. coli
taaaagaaaatgtcccgctggcctg

SEQ ID NO: 44420 - DNA, 25 bp, E. coli
taaaagaaaatgacccgctggcctg

SEQ ID NO: 44421 - DNA, 25 bp, E. coli
atgaaagtcgcggaacaacccggtt

SEQ ID NO: 44422 - DNA, 25 bp, E. coli
atgaaagtcgcgcaacaacccggtt

SEQ ID NO: 44423 - DNA, 25 bp, E. coli
tatttcgggaaacgtgcagatcgcg

SEQ ID NO: 44424 - DNA, 25 bp, E. coli
tatttcgggaaaggtgcagatcgcg

SEQ ID NO: 44425 - DNA, 25 bp, E. coli
tttcagctgcgccaaggctatccgg

SEQ ID NO: 44426 - DNA, 25 bp, E. coli
tttcagctgcgcgaaggctatccgg

SEQ ID NO: 44427 - DNA, 25 bp, E. coli
tgaaaatgttttcgccgtagccggt

SEQ ID NO: 44428 - DNA, 25 bp, E. coli
tgaaaatgttttggccgtagccggt

SEQ ID NO: 44429 - DNA, 25 bp, E. coli
gctggaaaacatctatcgcccggta

SEQ ID NO: 44430 - DNA, 25 bp, E. coli
gctggaaaacatgtatcgcccggta

SEQ ID NO: 44431 - DNA, 25 bp, E. coli
gaacgccctgtatgacgctgtgaaa

SEQ ID NO: 44432 - DNA, 25 bp, E. coli
gaaaagctgttgatcccgtcgtcgc

SEQ ID NO: 44433 - DNA, 25 bp, E. coli
gaaaagctgttgttcccgtcgtcgc

SEQ ID NO: 44434 - DNA, 25 bp, E. coli
gaaaccgccgacttcctggataagg

SEQ ID NO: 44435 - DNA, 25 bp, E. coli
gaaaccgccgacatcctggataagg

SEQ ID NO: 44436 - DNA, 25 bp, E. coli
gaacgccctgtaagacgctgtgaaa

SEQ ID NO: 44437 - DNA, 25 bp, E. coli
ctttgttatcgacggtggcacgcgc

SEQ ID NO: 44438 - DNA, 25 bp, E. coli
ctttgttatcgagggtggcacgcgc

SEQ ID NO: 44439 - DNA, 25 bp, E. coli
taatatttactacgcgcccgagctg

SEQ ID NO: 44440 - DNA, 25 bp, E. coli
taatatttactaggcgcccgagctg

SEQ ID NO: 44441 - DNA, 25 bp, E. coli
aattcatgtgctcaacccgaagttg

SEQ ID NO: 44442 - DNA, 25 bp, E. coli
aattcatgtgctgaacccgaagttg

SEQ ID NO: 44443 - DNA, 25 bp, E. coli
catctgcgcaggctggtgtaattca

SEQ ID NO: 44444 - DNA, 25 bp, E. coli
catctgcgcagggtggtgtaattca

SEQ ID NO: 44445 - DNA, 25 bp, E. coli
caggctggtgtatttcatgtgctca

SEQ ID NO: 44446 - DNA, 25 bp, E. coli
caggctggtgtaattcatgtgctca

SEQ ID NO: 44447 - DNA, 25 bp, E. coli
tgtaattcatgtgctcaacccgaag

SEQ ID NO: 44448 - DNA, 25 bp, E. coli
tggtgtaattcatgtgctcaacccg

SEQ ID NO: 44449 - DNA, 25 bp, E. coli
tgtaattcatgtcctcaacccgaag

SEQ ID NO: 44450 - DNA, 25 bp, E. coli
tggtgtaattcaagtgctcaacccg

SEQ ID NO: 44451 - DNA, 25 bp, E. coli
tgcgcaggctggagtaattcatgtg

SEQ ID NO: 44452 - DNA, 25 bp, E. coli
tgcgcaggctggtgtaattcatgtg

SEQ ID NO: 44453 - DNA, 25 bp, E. coli
tcatgtgctcaagccgaagttgact

SEQ ID NO: 44454 - DNA, 25 bp, E. coli
tcatgtgctcaacccgaagttgact

SEQ ID NO: 44455 - DNA, 25 bp, E. coli
gcgcatctgcgctggctggtgtaat

SEQ ID NO: 44456 - DNA, 25 bp, E. coli
gcgcatctgcgcaggctggtgtaat

SEQ ID NO: 44457 - DNA, 25 bp, E. coli
gacttcacctatgaatacctctggg

SEQ ID NO: 44458 - DNA, 25 bp, E. coli
gacttcacctatcaatacctctggg

SEQ ID NO: 44459 - DNA, 25 bp, E. coli
tgtgctcaacccgaagttgacttca

SEQ ID NO: 44460 - DNA, 25 bp, E. coli
tgtgctcaaccccaagttgacttca

SEQ ID NO: 44461 - DNA, 25 bp, E. coli
tcaacccgaagttgacttcacctat

SEQ ID NO: 44462 - DNA, 25 bp, E. coli
tcaacccgaagtagacttcacctat

SEQ ID NO: 44463 - DNA, 25 bp, E. coli
aacggggagttagttacagcacagc

SEQ ID NO: 44464 - DNA, 25 bp, E. coli
agttacttacagcacagctgcgact

SEQ ID NO: 44465 - DNA, 25 bp, E. coli
agttacttacaggacagctgcgact

SEQ ID NO: 44466 - DNA, 25 bp, E. coli
aacggggagttacttacagcacagc

SEQ ID NO: 44467 - DNA, 25 bp, E. coli
aaacggggagttacttacagcacag

SEQ ID NO: 44468 - DNA, 25 bp, E. coli
aaacggggagtttcttacagcacag

SEQ ID NO: 44469 - DNA, 25 bp, E. coli
tgatgaccgtgaaaacggggagtta

SEQ ID NO: 44470 - DNA, 25 bp, E. coli
tgatgaccgtgataacggggagtta

SEQ ID NO: 44471 - DNA, 25 bp, E. coli
tgaaaacggggacttacttacagca

SEQ ID NO: 44472 - DNA, 25 bp, E. coli
tgaaaacggggagttacttacagca

SEQ ID NO: 44473 - DNA, 25 bp, E. coli
gctgcgactgggaccggcagacatt

SEQ ID NO: 44474 - DNA, 25 bp, E. coli
gctgcgactgggtccggcagacatt

SEQ ID NO: 44475 - DNA, 25 bp, E. coli
ggagttacttactgcacagctgcga

SEQ ID NO: 44476 - DNA, 25 bp, E. coli
gtccgatgagaatggtattatcccg

SEQ ID NO: 44477 - DNA, 25 bp, E. coli
ggagttacttacagcacagctgcga

SEQ ID NO: 44478 - DNA, 25 bp, E. coli
gggagttacttacagcacagctgcg

SEQ ID NO: 44479 - DNA, 25 bp, E. coli
gggagttacttagagcacagctgcg

SEQ ID NO: 44480 - DNA, 25 bp, E. coli
gtccgatgagaaaggtattatcccg

SEQ ID NO: 44481 - DNA, 25 bp, E. coli
gaccggcagacaatctggagtccga

SEQ ID NO: 44482 - DNA, 25 bp, E. coli
gaccggcagacattctggagtccga

SEQ ID NO: 44483 - DNA, 25 bp, E. coli
gagttacttacagcacagctgcgac

SEQ ID NO: 44484 - DNA, 25 bp, E. coli
gagttacttacaccacagctgcgac

SEQ ID NO: 44485 - DNA, 25 bp, E. coli
accatgaaacatccttaaaagcgag

SEQ ID NO: 44486 - DNA, 25 bp, E. coli
accatgaaacatgcttaaaagcgag

SEQ ID NO: 44487 - DNA, 25 bp, E. coli
acagcttgcggataggtcgtgcaac

SEQ ID NO: 44488 - DNA, 25 bp, E. coli
acagcttgcggaaaggtcgtgcaac

SEQ ID NO: 44489 - DNA, 25 bp, E. coli
tatccttaattcaactaattggagg

SEQ ID NO: 44490 - DNA, 25 bp, E. coli
tatccttaattctactaattggagg

SEQ ID NO: 44491 - DNA, 25 bp, E. coli
tgaaggttaactgtgaccatgaaac

SEQ ID NO: 44492 - DNA, 25 bp, E. coli
tgaaggttaactctgaccatgaaac

SEQ ID NO: 44493 - DNA, 25 bp, E. coli
tcatcatccattaccacgaaaacag

SEQ ID NO: 44494 - DNA, 25 bp, E. coli
tcatcatccatttccacgaaaacag

SEQ ID NO: 44495 - DNA, 25 bp, E. coli
gcaacaaacagactacggcgggaat

SEQ ID NO: 44496 - DNA, 25 bp, E. coli
gcaacaaacagagtacggcgggaat

SEQ ID NO: 44497 - DNA, 25 bp, E. coli
ccgtttaccggagcgacagcttgcg

SEQ ID NO: 44498 - DNA, 25 bp, E. coli
ccgtttaccggaccgacagcttgcg

SEQ ID NO: 44499 - DNA, 25 bp, E. coli
gttctgcccgcgtcggtaaacctga

SEQ ID NO: 44500 - DNA, 25 bp, E. coli
gttctgcccgcgacggtaaacctga

SEQ ID NO: 44501 - DNA, 25 bp, E. coli
ggtaaacctgaagggactggcaacg

SEQ ID NO: 44502 - DNA, 25 bp, E. coli
ggtaaacctgaacggactggcaacg

SEQ ID NO: 44503 - DNA, 25 bp, E. coli
ggtcgtgcaactacaaagcaacaaa

SEQ ID NO: 44504 - DNA, 25 bp, E. coli
ggtcgtgcaacttcaaagcaacaaa

SEQ ID NO: 44505 - DNA, 25 bp, E. coli
taattggaggcaacaccgtttaccg

SEQ ID NO: 44506 - DNA, 25 bp, E. coli
taattggaggcatcaccgtttaccg

SEQ ID NO: 44507 - DNA, 25 bp, E. coli
caacaaaacggaatgattgccagcc

SEQ ID NO: 44508 - DNA, 25 bp, E. coli
caacaaaacggattgattgccagcc

SEQ ID NO: 44509 - DNA, 25 bp, E. coli
tagaaaacaccgcacactctcgtgt

SEQ ID NO: 44510 - DNA, 25 bp, E. coli
tagaaaacaccggacactctcgtgt

SEQ ID NO: 44511 - DNA, 25 bp, E. coli
tatcgactcatctagcgtggactga

SEQ ID NO: 44512 - DNA, 25 bp, E. coli
tatagcgatatccactcatcaagcg

SEQ ID NO: 44513 - DNA, 25 bp, E. coli
tatcgactcatcaagcgtggactga

SEQ ID NO: 44514 - DNA, 25 bp, E. coli
tatagcgatatcgactcatcaagcg

SEQ ID NO: 44515 - DNA, 25 bp, E. coli
ttgccagcccgttagaaaacaccgg

SEQ ID NO: 44516 - DNA, 25 bp, E. coli
ttgccagcccgtaagaaaacaccgg

SEQ ID NO: 44517 - DNA, 25 bp, E. coli
tgtaaaaagctaccctgtctatgga

SEQ ID NO: 44518 - DNA, 25 bp, E. coli
tgtaaaaagctagcctgtctatgga

SEQ ID NO: 44519 - DNA, 25 bp, E. coli
gcagtgatacgatacaacaaaacgg

SEQ ID NO: 44520 - DNA, 25 bp, E. coli
gcagtgatacgaaacaacaaaacgg

SEQ ID NO: 44521 - DNA, 25 bp, E. coli
gacactctcgtgtaaaaagctaccc

SEQ ID NO: 44522 - DNA, 25 bp, E. coli
gacactctcgtgaaaaaagctaccc

SEQ ID NO: 44523 - DNA, 25 bp, E. coli
ccctgtctatggatatagcgatatc

SEQ ID NO: 44524 - DNA, 25 bp, E. coli
ccctgtctatggttatagcgatatc

SEQ ID NO: 44525 - DNA, 25 bp, E. coli
ggaatgattgcctgcccgttagaaa

SEQ ID NO: 44526 - DNA, 25 bp, E. coli
ggaatgattgccagcccgttagaaa

SEQ ID NO: 44527 - DNA, 25 bp, E. coli
gagaaattgttaaagcagtgatacg

SEQ ID NO: 44528 - DNA, 25 bp, E. coli
gagaaattgttatagcagtgatacg

SEQ ID NO: 44529 - DNA, 25 bp, E. coli
catcagttgcttgcaccggtggaca

SEQ ID NO: 44530 - DNA, 25 bp, E. coli
catcagttgcttccaccggtggaca

SEQ ID NO: 44531 - DNA, 25 bp, E. coli
tactgaagagctggaaacgtggcgc

SEQ ID NO: 44532 - DNA, 25 bp, E. coli
tactgaagagctcgaaacgtggcgc

SEQ ID NO: 44533 - DNA, 25 bp, E. coli
tattcagcgcgatgacctggtgcag

SEQ ID NO: 44534 - DNA, 25 bp, E. coli
tattcagcgcgaagacctggtgcag

SEQ ID NO: 44535 - DNA, 25 bp, E. coli
tccgcagggagatctcaaggtatcg

SEQ ID NO: 44536 - DNA, 25 bp, E. coli
tccgcagggagaactcaaggtatcg

SEQ ID NO: 44537 - DNA, 25 bp, E. coli
gcattaatcctgctcacgccggtga

SEQ ID NO: 44538 - DNA, 25 bp, E. coli
gcattaatcctggtcacgccggtga

SEQ ID NO: 44539 - DNA, 25 bp, E. coli
gaagaatcaacgcaaacggcggcaa

SEQ ID NO: 44540 - DNA, 25 bp, E. coli
gcaagacaacatatcgggccactgg

SEQ ID NO: 44541 - DNA, 25 bp, E. coli
gaagaatcaacggaaacggcggcaa

SEQ ID NO: 44542 - DNA, 25 bp, E. coli
gcaagacaacatttcgggccactgg

SEQ ID NO: 44543 - DNA, 25 bp, E. coli
gaaatacgggctcccattaccgcgg

SEQ ID NO: 44544 - DNA, 25 bp, E. coli
gaaatacgggctgccattaccgcgg

SEQ ID NO: 44545 - DNA, 25 bp, E. coli
cattgcgaaaaaggaactggcggta

SEQ ID NO: 44546 - DNA, 25 bp, E. coli
cattgcgaaaaacgaactggcggta

SEQ ID NO: 44547 - DNA, 25 bp, E. coli
tcacttgatgggaacgggaactgtc

SEQ ID NO: 44548 - DNA, 25 bp, E. coli
taacgctgacgacggtacggcatta

SEQ ID NO: 44549 - DNA, 25 bp, E. coli
taacgctgacgagggtacggcatta

SEQ ID NO: 44550 - DNA, 25 bp, E. coli
tcacttgatgggtacgggaactgtc

SEQ ID NO: 44551 - DNA, 25 bp, E. coli
caaataatagtgttggacaacgggc

SEQ ID NO: 44552 - DNA, 25 bp, E. coli
caaataatagtgatggacaacgggc

SEQ ID NO: 44553 - DNA, 25 bp, E. coli
cagcgagtgcatctgtttagcgcca

SEQ ID NO: 44554 - DNA, 25 bp, E. coli
cagcgagtgcatgtgtttagcgcca

SEQ ID NO: 44555 - DNA, 25 bp, E. coli
tatcgtgcgggataaagcaccgggc

SEQ ID NO: 44556 - DNA, 25 bp, E. coli
tatcgtgcgggaaaaagcaccgggc

SEQ ID NO: 44557 - DNA, 25 bp, E. coli
ccggatgcggcaaatcaacactgtt

SEQ ID NO: 44558 - DNA, 25 bp, E. coli
ccggatgcggcatatcaacactgtt

SEQ ID NO: 44559 - DNA, 25 bp, E. coli
gctgcaagggcatgctgagctgacc

SEQ ID NO: 44560 - DNA, 25 bp, E. coli
gctgcaagggcaagctgagctgacc

SEQ ID NO: 44561 - DNA, 25 bp, E. coli
gaatgaagcggcactacgacagacc

SEQ ID NO: 44562 - DNA, 25 bp, E. coli
gaatgaagcggctctacgacagacc

SEQ ID NO: 44563 - DNA, 25 bp, E. coli
gactttccgcgtgttgcagcatctg

SEQ ID NO: 44564 - DNA, 25 bp, E. coli
gactttccgcgtcttgcagcatctg

SEQ ID NO: 44565 - DNA, 25 bp, E. coli
taatggtcacccatcgacttcgcgg

SEQ ID NO: 44566 - DNA, 25 bp, E. coli
tcaactatatgctacccgctgcggg

SEQ ID NO: 44567 - DNA, 25 bp, E. coli
tcaactatatgcaacccgctgcggg

SEQ ID NO: 44568 - DNA, 25 bp, E. coli
taacgggtgcatttcagcatctggg

SEQ ID NO: 44569 - DNA, 25 bp, E. coli
taacgggtgcatatcagcatctggg

SEQ ID NO: 44570 - DNA, 25 bp, E. coli
taatggtcacccttcgacttcgcgg

SEQ ID NO: 44571 - DNA, 25 bp, E. coli
gatgttcagttctcttatccggagc

SEQ ID NO: 44572 - DNA, 25 bp, E. coli
gatgttcagttcacttatccggagc

SEQ ID NO: 44573 - DNA, 25 bp, E. coli
agtcataaagtagactggcagcgcg

SEQ ID NO: 44574 - DNA, 25 bp, E. coli
agtcataaagtacactggcagcgcg

SEQ ID NO: 44575 - DNA, 25 bp, E. coli
tatcgccccaggctgattgaaatgc

SEQ ID NO: 44576 - DNA, 25 bp, E. coli
tatcgccccagggtgattgaaatgc

SEQ ID NO: 44577 - DNA, 25 bp, E. coli
gcccttctgtttgaggcataaagcc

SEQ ID NO: 44578 - DNA, 25 bp, E. coli
gcccttctgtttcaggcataaagcc

SEQ ID NO: 44579 - DNA, 25 bp, E. coli
gcagcgaaagtaagacaaagtatcc

SEQ ID NO: 44580 - DNA, 25 bp, E. coli
gcagcgaaagtatgacaaagtatcc

SEQ ID NO: 44581 - DNA, 25 bp, E. coli
gcatgttaagccgtctcgcagagat

SEQ ID NO: 44582 - DNA, 25 bp, E. coli
gcatgttaagccctctcgcagagat

SEQ ID NO: 44583 - DNA, 25 bp, E. coli
cgcagagatgttattgcagcgaaag

SEQ ID NO: 44584 - DNA, 25 bp, E. coli
cgcagagatgtttttgcagcgaaag

SEQ ID NO: 44585 - DNA, 25 bp, E. coli
cattttgcggtgttatcgccccagg

SEQ ID NO: 44586 - DNA, 25 bp, E. coli
cattttgcggtgatatcgccccagg

SEQ ID NO: 44587 - DNA, 25 bp, E. coli
ggttaaacaacggtttggctcacag

SEQ ID NO: 44588 - DNA, 25 bp, E. coli
ggttaaacaacgctttggctcacag

SEQ ID NO: 44589 - DNA, 25 bp, E. coli
tggcagcgcgacagacaacgtcgtt

SEQ ID NO: 44590 - DNA, 25 bp, E. coli
tggctcacagtttacaacaggcatg

SEQ ID NO: 44591 - DNA, 25 bp, E. coli
tggcagcgcgactgacaacgtcgtt

SEQ ID NO: 44592 - DNA, 25 bp, E. coli
ggcataaagcccgaaagtcataaag

SEQ ID NO: 44593 - DNA, 25 bp, E. coli
tggctcacagttaacaacaggcatg

SEQ ID NO: 44594 - DNA, 25 bp, E. coli
ggcataaagccccaaagtcataaag

SEQ ID NO: 44595 - DNA, 25 bp, E. coli
caggccgccctgcttgggtagttat

SEQ ID NO: 44596 - DNA, 25 bp, E. coli
catggtggttatcaaggcgtttatc

SEQ ID NO: 44597 - DNA, 25 bp, E. coli
catggtggttatgaaggcgtttatc

SEQ ID NO: 44598 - DNA, 25 bp, E. coli
caggccgccctggttgggtagttat

SEQ ID NO: 44599 - DNA, 25 bp, E. coli
cacaggccgcccaggttgggtagtt

SEQ ID NO: 44600 - DNA, 25 bp, E. coli
atatggttgaggcttatccggtgat

SEQ ID NO: 44601 - DNA, 25 bp, E. coli
atatggttgagggttatccggtgat

SEQ ID NO: 44602 - DNA, 25 bp, E. coli
cacaggccgccctggttgggtagtt

SEQ ID NO: 44603 - DNA, 25 bp, E. coli
aaacagcttccgtcacagacgccga

SEQ ID NO: 44604 - DNA, 25 bp, E. coli
aaacagcttccgacacagacgccga

SEQ ID NO: 44605 - DNA, 25 bp, E. coli
tttatcgcggtacggatgctgggcc

SEQ ID NO: 44606 - DNA, 25 bp, E. coli
tttatcgcggtagggatgctgggcc

SEQ ID NO: 44607 - DNA, 25 bp, E. coli
gccgacactgaattgggcctgtctg

SEQ ID NO: 44608 - DNA, 25 bp, E. coli
gccgacactgaaatgggcctgtctg

SEQ ID NO: 44609 - DNA, 25 bp, E. coli
gaaggaaaacagcttccgtcacaga

SEQ ID NO: 44610 - DNA, 25 bp, E. coli
gaaggaaaacaggttccgtcacaga

SEQ ID NO: 44611 - DNA, 25 bp, E. coli
cttcaggatatggttgagggttatc

SEQ ID NO: 44612 - DNA, 25 bp, E. coli
cttcaggatatgcttgagggttatc

SEQ ID NO: 44613 - DNA, 25 bp, E. coli
tcacagacgccgacactgaaatggg

SEQ ID NO: 44614 - DNA, 25 bp, E. coli
tcaaggcgtttaacgcggtacggat

SEQ ID NO: 44615 - DNA, 25 bp, E. coli
tcaaggcgtttatcgcggtacggat

SEQ ID NO: 44616 - DNA, 25 bp, E. coli
tcacagacgccgtcactgaaatggg

SEQ ID NO: 44617 - DNA, 25 bp, E. coli
caacccgaatcgctcatgatgctgt

SEQ ID NO: 44618 - DNA, 25 bp, E. coli
caacccgaatcggtcatgatgctgt

SEQ ID NO: 44619 - DNA, 25 bp, E. coli
aactgcttggtgaacaggcagagcc

SEQ ID NO: 44620 - DNA, 25 bp, E. coli
aactgcttggtgtacaggcagagcc

SEQ ID NO: 44621 - DNA, 25 bp, E. coli
tggtgtacaggctgagccaccgact

SEQ ID NO: 44622 - DNA, 25 bp, E. coli
tgaatcaccggtcgccgatgcgact

SEQ ID NO: 44623 - DNA, 25 bp, E. coli
tgaatcaccggtggccgatgcgact

SEQ ID NO: 44624 - DNA, 25 bp, E. coli
tgccattctggaagaactgcttggt

SEQ ID NO: 44625 - DNA, 25 bp, E. coli
tgccattctggatgaactgcttggt

SEQ ID NO: 44626 - DNA, 25 bp, E. coli
gaagcgggagataccaccgcagaga

SEQ ID NO: 44627 - DNA, 25 bp, E. coli
gaagttcagcctgaatcaccggtcg

SEQ ID NO: 44628 - DNA, 25 bp, E. coli
gaagcgggagattccaccgcagaga

SEQ ID NO: 44629 - DNA, 25 bp, E. coli
gaagttcagcctcaatcaccggtcg

SEQ ID NO: 44630 - DNA, 25 bp, E. coli
gactgaacctcatcccgaatcggtc

SEQ ID NO: 44631 - DNA, 25 bp, E. coli
gactgaacctcaacccgaatcggtc

SEQ ID NO: 44632 - DNA, 25 bp, E. coli
cgcagagagcggagaagttcagcct

SEQ ID NO: 44633 - DNA, 25 bp, E. coli
cgcagagagcggtgaagttcagcct

SEQ ID NO: 44634 - DNA, 25 bp, E. coli
ggtcgccgatgcgactgaacctcaa

SEQ ID NO: 44635 - DNA, 25 bp, E. coli
ggtcgccgatgccactgaacctcaa

SEQ ID NO: 44636 - DNA, 25 bp, E. coli
tggtgtacaggcagagccaccgact

SEQ ID NO: 44637 - DNA, 25 bp, E. coli
gagccaccgactgaagcgggagata

SEQ ID NO: 44638 - DNA, 25 bp, E. coli
gagccaccgactcaagcgggagata

SEQ ID NO: 44639 - DNA, 25 bp, E. coli
catcggtgattagtttgggcggcgc

SEQ ID NO: 44640 - DNA, 25 bp, E. coli
cttaccggtgggttcatcggtgatt

SEQ ID NO: 44641 - DNA, 25 bp, E. coli
catcggtgattactttgggcggcgc

SEQ ID NO: 44642 - DNA, 25 bp, E. coli
cttaccggtgggatcatcggtgatt

SEQ ID NO: 44643 - DNA, 25 bp, E. coli
accggtgggttcttcggtgattact

SEQ ID NO: 44644 - DNA, 25 bp, E. coli
cggtgggttcatgggtgattacttt

SEQ ID NO: 44645 - DNA, 25 bp, E. coli
accggtgggttcatcggtgattact

SEQ ID NO: 44646 - DNA, 25 bp, E. coli
cggtgggttcatcggtgattacttt

SEQ ID NO: 44647 - DNA, 25 bp, E. coli
taccggtgggttcatcggtgattac

SEQ ID NO: 44648 - DNA, 25 bp, E. coli
taccggtgggttgatcggtgattac

SEQ ID NO: 44649 - DNA, 25 bp, E. coli
tcttaccggtggcttcatcggtgat

SEQ ID NO: 44650 - DNA, 25 bp, E. coli
tcatcggtgattactttgggcggcg

SEQ ID NO: 44651 - DNA, 25 bp, E. coli
tcatcggtgatttctttgggcggcg

SEQ ID NO: 44652 - DNA, 25 bp, E. coli
tcttaccggtgggttcatcggtgat

SEQ ID NO: 44653 - DNA, 25 bp, E. coli
ccggtgggttcatcggtgattactt

SEQ ID NO: 44654 - DNA, 25 bp, E. coli
ccggtgggttcaacggtgattactt

SEQ ID NO: 44655 - DNA, 25 bp, E. coli
gggttcatcggtcattactttgggc

SEQ ID NO: 44656 - DNA, 25 bp, E. coli
gggttcatcggtgattactttgggc

SEQ ID NO: 44657 - DNA, 25 bp, E. coli
ggttcatcggtgtttactttgggcg

SEQ ID NO: 44658 - DNA, 25 bp, E. coli
ggttcatcggtgattactttgggcg

SEQ ID NO: 44659 - DNA, 25 bp, E. coli
tgggttcatcggtgattactttggg

SEQ ID NO: 44660 - DNA, 25 bp, E. coli
tgggttcatcggagattactttggg

SEQ ID NO: 44661 - DNA, 25 bp, E. coli
caatttgctaaaggcgtgcagctgc

SEQ ID NO: 44662 - DNA, 25 bp, E. coli
aagtgattaccccaacgcaggttcg

SEQ ID NO: 44663 - DNA, 25 bp, E. coli
caatttgctaaacgcgtgcagctgc

SEQ ID NO: 44664 - DNA, 25 bp, E. coli
aagtgattacccgaacgcaggttcg

SEQ ID NO: 44665 - DNA, 25 bp, E. coli
catcattgcgagaagacctatctgg

SEQ ID NO: 44666 - DNA, 25 bp, E. coli
catcaggtgaaaggcatgttcgccg

SEQ ID NO: 44667 - DNA, 25 bp, E. coli
catcattgcgagtagacctatctgg

SEQ ID NO: 44668 - DNA, 25 bp, E. coli
catcaggtgaaacgcatgttcgccg

SEQ ID NO: 44669 - DNA, 25 bp, E. coli
taaatttatcgctcagcaactcggc

SEQ ID NO: 44670 - DNA, 25 bp, E. coli
taaatttatcgcacagcaactcggc

SEQ ID NO: 44671 - DNA, 25 bp, E. coli
agggctatgtttgctccacggacga

SEQ ID NO: 44672 - DNA, 25 bp, E. coli
agggctatgtttcctccacggacga

SEQ ID NO: 44673 - DNA, 25 bp, E. coli
tgaagaagaaattgccagcgtcgtc

SEQ ID NO: 44674 - DNA, 25 bp, E. coli
tgatgtcgcttaggatggcaacccg

SEQ ID NO: 44675 - DNA, 25 bp, E. coli
tgaagaagaaatagccagcgtcgtc

SEQ ID NO: 44676 - DNA, 25 bp, E. coli
tgatgtcgcttacgatggcaacccg

SEQ ID NO: 44677 - DNA, 25 bp, E. coli
gaaatccgcggctatcgtgtcaccg

SEQ ID NO: 44678 - DNA, 25 bp, E. coli
gaaatccgcggcaatcgtgtcaccg

SEQ ID NO: 44679 - DNA, 25 bp, E. coli
tggcgaaatcgtgcgtaatgcagcg

SEQ ID NO: 44680 - DNA, 25 bp, E. coli
tggcgaaatcgtccgtaatgcagcg

SEQ ID NO: 44681 - DNA, 25 bp, E. coli
tcagcgaagggcgttatcatcaggt

SEQ ID NO: 44682 - DNA, 25 bp, E. coli
tcagcgaagggccttatcatcaggt

SEQ ID NO: 44683 - DNA, 25 bp, E. coli
taaccttttcctgtgacgccggacg

SEQ ID NO: 44684 - DNA, 25 bp, E. coli
aaccttgatctcctgttacaggcgg

SEQ ID NO: 44685 - DNA, 25 bp, E. coli
aaccttgatctcgtgttacaggcgg

SEQ ID NO: 44686 - DNA, 25 bp, E. coli
taaccttttcctctgacgccggacg

SEQ ID NO: 44687 - DNA, 25 bp, E. coli
caggcggtgctgaataacgtttccc

SEQ ID NO: 44688 - DNA, 25 bp, E. coli
caggcggtgctgtataacgtttccc

SEQ ID NO: 44689 - DNA, 25 bp, E. coli
caacggacaaatggtcgaaacccag

SEQ ID NO: 44690 - DNA, 25 bp, E. coli
caacggacaaatcgtcgaaacccag

SEQ ID NO: 44691 - DNA, 25 bp, E. coli
ttcaggactccatcagcgccgtgaa

SEQ ID NO: 44692 - DNA, 25 bp, E. coli
ttcaggactccaacagcgccgtgaa

SEQ ID NO: 44693 - DNA, 25 bp, E. coli
tctgacgccggacgtgtgctacaaa

SEQ ID NO: 44694 - DNA, 25 bp, E. coli
tctgacgccggaggtgtgctacaaa

SEQ ID NO: 44695 - DNA, 25 bp, E. coli
cgccggacgtgtgctacaaaacgcg

SEQ ID NO: 44696 - DNA, 25 bp, E. coli
cgcaaaaccgtgggcgagatcctgc

SEQ ID NO: 44697 - DNA, 25 bp, E. coli
cgcaaaaccgtgcgcgagatcctgc

SEQ ID NO: 44698 - DNA, 25 bp, E. coli
cgccggacgtgtcctacaaaacgcg

SEQ ID NO: 44699 - DNA, 25 bp, E. coli
tggacaacggactaatcgtcgaaac

SEQ ID NO: 44700 - DNA, 25 bp, E. coli
tggacaacggacaaatcgtcgaaac

SEQ ID NO: 44701 - DNA, 25 bp, E. coli
taagcggcggcctgctccagcgcgt

SEQ ID NO: 44702 - DNA, 25 bp, E. coli
tcagcgccgtgaatccgcgcaaaac

SEQ ID NO: 44703 - DNA, 25 bp, E. coli
taagcggcggccagctccagcgcgt

SEQ ID NO: 44704 - DNA, 25 bp, E. coli
tcagcgccgtgattccgcgcaaaac

SEQ ID NO: 44705 - DNA, 25 bp, E. coli
taccggctgttaactgccaacctgg

SEQ ID NO: 44706 - DNA, 25 bp, E. coli
tatcgactgccagaagagacgctgg

SEQ ID NO: 44707 - DNA, 25 bp, E. coli
taccggctgttatctgccaacctgg

SEQ ID NO: 44708 - DNA, 25 bp, E. coli
tatcgactgccacaagagacgctgg

SEQ ID NO: 44709 - DNA, 25 bp, E. coli
ttatggtcagcacaacaacgggcgg

SEQ ID NO: 44710 - DNA, 25 bp, E. coli
ttatggtcagcagaacaacgggcgg

SEQ ID NO: 44711 - DNA, 25 bp, E. coli
tgatgatggacgcacagtaaacgcc

SEQ ID NO: 44712 - DNA, 25 bp, E. coli
tgatgatggacggacagtaaacgcc

SEQ ID NO: 44713 - DNA, 25 bp, E. coli
cgttgatgtggaatccggcactgga

SEQ ID NO: 44714 - DNA, 25 bp, E. coli
cgttgatgtggattccggcactgga

SEQ ID NO: 44715 - DNA, 25 bp, E. coli
cattgtgtttataatggacccgcga

SEQ ID NO: 44716 - DNA, 25 bp, E. coli
cattgtgtttattatggacccgcga

SEQ ID NO: 44717 - DNA, 25 bp, E. coli
gtacactggttggatggcatcgcgc

SEQ ID NO: 44718 - DNA, 25 bp, E. coli
ggagcttatcaaactgggaatgcag

SEQ ID NO: 44719 - DNA, 25 bp, E. coli
ggagcttatcaatctgggaatgcag

SEQ ID NO: 44720 - DNA, 25 bp, E. coli
gtacactggttgcatggcatcgcgc

SEQ ID NO: 44721 - DNA, 25 bp, E. coli
ggacccgcgacatccagaatatgaa

SEQ ID NO: 44722 - DNA, 25 bp, E. coli
ggacccgcgacaaccagaatatgaa

SEQ ID NO: 44723 - DNA, 25 bp, E. coli
gacgctggcttgacgacctgatgag

SEQ ID NO: 44724 - DNA, 25 bp, E. coli
gagacgctggaggaggaactaaccc

SEQ ID NO: 44725 - DNA, 25 bp, E. coli
gacgctggcttgtcgacctgatgag

SEQ ID NO: 44726 - DNA, 25 bp, E. coli
gagacgctggagcaggaactaaccc

SEQ ID NO: 44727 - DNA, 25 bp, E. coli
cattagggcaatttcactgtatgac

SEQ ID NO: 44728 - DNA, 25 bp, E. coli
taaaagatcgcagtaaatagctacg

SEQ ID NO: 44729 - DNA, 25 bp, E. coli
aaagtgtagatgaattaggcgcagc

SEQ ID NO: 44730 - DNA, 25 bp, E. coli
actgcgcagtcaacgagtctgtggg

SEQ ID NO: 44731 - DNA, 25 bp, E. coli
aaagtgtagatgtattaggcgcagc

SEQ ID NO: 44732 - DNA, 25 bp, E. coli
actgcgcagtcatcgagtctgtggg

SEQ ID NO: 44733 - DNA, 25 bp, E. coli
tagctacgcggaatagtgctctact

SEQ ID NO: 44734 - DNA, 25 bp, E. coli
tagctacgcggattagtgctctact

SEQ ID NO: 44735 - DNA, 25 bp, E. coli
taggcgcagctatttagtctatatg

SEQ ID NO: 44736 - DNA, 25 bp, E. coli
taggcgcagctaattagtctatatg

SEQ ID NO: 44737 - DNA, 25 bp, E. coli
tatttatcagcccagctctctgggc

SEQ ID NO: 44738 - DNA, 25 bp, E. coli
tatttatcagccgagctctctgggc

SEQ ID NO: 44739 - DNA, 25 bp, E. coli
tactttcgtttacccctttcagagg

SEQ ID NO: 44740 - DNA, 25 bp, E. coli
tactttcgtttagccctttcagagg

SEQ ID NO: 44741 - DNA, 25 bp, E. coli
gctccttttgcatcgtatcacttgt

SEQ ID NO: 44742 - DNA, 25 bp, E. coli
gctctctgggctgatatttctaaaa

SEQ ID NO: 44743 - DNA, 25 bp, E. coli
gctccttttgcaacgtatcacttgt

SEQ ID NO: 44744 - DNA, 25 bp, E. coli
gctctctgggctcatatttctaaaa

SEQ ID NO: 44745 - DNA, 25 bp, E. coli
ctttcagaggtatgacattagggca

SEQ ID NO: 44746 - DNA, 25 bp, E. coli
ctttcagaggtaagacattagggca

SEQ ID NO: 44747 - DNA, 25 bp, E. coli
cattagggcaatatcactgtatgac

SEQ ID NO: 44748 - DNA, 25 bp, E. coli
taaaagatcgcactaaatagctacg

SEQ ID NO: 44749 - DNA, 25 bp, E. coli
aagtcatttatgtagccgcggatcg

SEQ ID NO: 44750 - DNA, 25 bp, E. coli
aagtcatttatgaagccgcggatcg

SEQ ID NO: 44751 - DNA, 25 bp, E. coli
caccttactgtattggccgcagggt

SEQ ID NO: 44752 - DNA, 25 bp, E. coli
caccttactgtaatggccgcagggt

SEQ ID NO: 44753 - DNA, 25 bp, E. coli
catgcgtgaataaccaaatggcgaa

SEQ ID NO: 44754 - DNA, 25 bp, E. coli
catgcgtgaatatccaaatggcgaa

SEQ ID NO: 44755 - DNA, 25 bp, E. coli
aatggcgaaaaaacacaccttactg

SEQ ID NO: 44756 - DNA, 25 bp, E. coli
aatggcgaaaaatcacaccttactg

SEQ ID NO: 44757 - DNA, 25 bp, E. coli
tagtgccagcgaagactggagttaa

SEQ ID NO: 44758 - DNA, 25 bp, E. coli
tagtgccagcgatgactggagttaa

SEQ ID NO: 44759 - DNA, 25 bp, E. coli
ttcagaagaaatactggaagcagca

SEQ ID NO: 44760 - DNA, 25 bp, E. coli
ttcagaagaaattctggaagcagca

SEQ ID NO: 44761 - DNA, 25 bp, E. coli
tctgaccggagatcataaagtcatt

SEQ ID NO: 44762 - DNA, 25 bp, E. coli
tctgaccggagaacataaagtcatt

SEQ ID NO: 44763 - DNA, 25 bp, E. coli
gcagggtttccaactctgaccggag

SEQ ID NO: 44764 - DNA, 25 bp, E. coli
gcagggtttccatctctgaccggag

SEQ ID NO: 44765 - DNA, 25 bp, E. coli
ccgcggatcgacatgttacttcaga

SEQ ID NO: 44766 - DNA, 25 bp, E. coli
ccgcggatcgacttgttacttcaga

SEQ ID NO: 44767 - DNA, 25 bp, E. coli
ctggagttaacaccatcatgcgtga

SEQ ID NO: 44768 - DNA, 25 bp, E. coli
ctggagttaacagcatcatgcgtga

SEQ ID NO: 44769 - DNA, 25 bp, E. coli
ggaagcagcaattaggctcttgagt

SEQ ID NO: 44770 - DNA, 25 bp, E. coli
ggaagcagcaataaggctcttgagt

SEQ ID NO: 44771 - DNA, 25 bp, E. coli
atttcagtctgcttgtcccccggca

SEQ ID NO: 44772 - DNA, 25 bp, E. coli
agaggccggatgaggacaaaatgct

SEQ ID NO: 44773 - DNA, 25 bp, E. coli
agaggccggatgtggacaaaatgct

SEQ ID NO: 44774 - DNA, 25 bp, E. coli
atttcagtctgcatgtcccccggca

SEQ ID NO: 44775 - DNA, 25 bp, E. coli
tattttatcgtcagcggatgtggcg

SEQ ID NO: 44776 - DNA, 25 bp, E. coli
tattttatcgtctgcggatgtggcg

SEQ ID NO: 44777 - DNA, 25 bp, E. coli
tccggatatgcatccctctgatttc

SEQ ID NO: 44778 - DNA, 25 bp, E. coli
tccggatatgcaaccctctgatttc

SEQ ID NO: 44779 - DNA, 25 bp, E. coli
tcatggtggatgttgccgcattaat

SEQ ID NO: 44780 - DNA, 25 bp, E. coli
tcatggtggatgatgccgcattaat

SEQ ID NO: 44781 - DNA, 25 bp, E. coli
ccggatgaggactaaatgctgatgc

SEQ ID NO: 44782 - DNA, 25 bp, E. coli
ccggatgaggacaaaatgctgatgc

SEQ ID NO: 44783 - DNA, 25 bp, E. coli
gcatccctctgatttcagtctgctt

SEQ ID NO: 44784 - DNA, 25 bp, E. coli
gcatccctctgaattcagtctgctt

SEQ ID NO: 44785 - DNA, 25 bp, E. coli
gatatgcatcccactgatttcagtc

SEQ ID NO: 44786 - DNA, 25 bp, E. coli
gatgtcatggtggatgatgccgcat

SEQ ID NO: 44787 - DNA, 25 bp, E. coli
gatgaggacaaaatgctgatgcaga

SEQ ID NO: 44788 - DNA, 25 bp, E. coli
gatgtcatggtgcatgatgccgcat

SEQ ID NO: 44789 - DNA, 25 bp, E. coli
gagggcgcgataatttatcgtctgc

SEQ ID NO: 44790 - DNA, 25 bp, E. coli
gatatgcatccctctgatttcagtc

SEQ ID NO: 44791 - DNA, 25 bp, E. coli
gatgaggacaaattgctgatgcaga

SEQ ID NO: 44792 - DNA, 25 bp, E. coli
gagggcgcgatattttatcgtctgc

SEQ ID NO: 44793 - DNA, 25 bp, E. coli
aattgatgatgataccgggctggtg

SEQ ID NO: 44794 - DNA, 25 bp, E. coli
aattgatgatgaaaccgggctggtg

SEQ ID NO: 44795 - DNA, 25 bp, E. coli
tacgtcatggcgaccaaagatggcc

SEQ ID NO: 44796 - DNA, 25 bp, E. coli
aaattaaccgtgttgatgtttcgca

SEQ ID NO: 44797 - DNA, 25 bp, E. coli
aaattaaccgtgatgatgtttcgca

SEQ ID NO: 44798 - DNA, 25 bp, E. coli
tacgtcatggcgtccaaagatggcc

SEQ ID NO: 44799 - DNA, 25 bp, E. coli
tatcacgatcaggaaggtaacgcga

SEQ ID NO: 44800 - DNA, 25 bp, E. coli
tatcacgatcagcaaggtaacgcga

SEQ ID NO: 44801 - DNA, 25 bp, E. coli
ccgggctggtgacttatcacgatca

SEQ ID NO: 44802 - DNA, 25 bp, E. coli
ccgggctggtgagttatcacgatca

SEQ ID NO: 44803 - DNA, 25 bp, E. coli
ccgggtgttccagtgattacgtcat

SEQ ID NO: 44804 - DNA, 25 bp, E. coli
ccgggtgttccactgattacgtcat

SEQ ID NO: 44805 - DNA, 25 bp, E. coli
gcgtttgctgttaccgggtgttcca

SEQ ID NO: 44806 - DNA, 25 bp, E. coli
gcgtttgctgtttccgggtgttcca

SEQ ID NO: 44807 - DNA, 25 bp, E. coli
ccgatggaaaacctgaaattgatga

SEQ ID NO: 44808 - DNA, 25 bp, E. coli
ccgatggaaaacgtgaaattgatga

SEQ ID NO: 44809 - DNA, 25 bp, E. coli
ggtaacgcgatggaaattaaccgtg

SEQ ID NO: 44810 - DNA, 25 bp, E. coli
ggtaacgcgatgcaaattaaccgtg

SEQ ID NO: 44811 - DNA, 25 bp, E. coli
ggccgtatgattatgaccgatggaa

SEQ ID NO: 44812 - DNA, 25 bp, E. coli
ggccgtatgattttgaccgatggaa

SEQ ID NO: 44813 - DNA, 25 bp, E. coli
taataatttctgcagtcggactggc

SEQ ID NO: 44814 - DNA, 25 bp, E. coli
taataatttctggagtcggactggc

SEQ ID NO: 44815 - DNA, 25 bp, E. coli
cactggctgaaccacgcatgatgca

SEQ ID NO: 44816 - DNA, 25 bp, E. coli
cactggctgaacgacgcatgatgca

SEQ ID NO: 44817 - DNA, 25 bp, E. coli
caggtcgcggaagttgaatttaatg

SEQ ID NO: 44818 - DNA, 25 bp, E. coli
caggtcgcggaacttgaatttaatg

SEQ ID NO: 44819 - DNA, 25 bp, E. coli
catcatcaatggaacgctggcgctt

SEQ ID NO: 44820 - DNA, 25 bp, E. coli
catcatcaatggtacgctggcgctt

SEQ ID NO: 44821 - DNA, 25 bp, E. coli
aaaatctggcgtcatcaggtcgcgg

SEQ ID NO: 44822 - DNA, 25 bp, E. coli
aaaatctggcgtgatcaggtcgcgg

SEQ ID NO: 44823 - DNA, 25 bp, E. coli
tagttgaagtgctggacgttgagcc

SEQ ID NO: 44824 - DNA, 25 bp, E. coli
tagttgaagtgcaggacgttgagcc

SEQ ID NO: 44825 - DNA, 25 bp, E. coli
tttgcgctgccagcattgcgacagt

SEQ ID NO: 44826 - DNA, 25 bp, E. coli
tttgcgctgccaccattgcgacagt

SEQ ID NO: 44827 - DNA, 25 bp, E. coli
ttcaagtcaggaagatgctatgccc

SEQ ID NO: 44828 - DNA, 25 bp, E. coli
ttcaagtcaggatgatgctatgccc

SEQ ID NO: 44829 - DNA, 25 bp, E. coli
tgatccgcactcatctacggcaatg

SEQ ID NO: 44830 - DNA, 25 bp, E. coli
tgatccgcactcttctacggcaatg

SEQ ID NO: 44831 - DNA, 25 bp, E. coli
cgcgcatagcgaccaaatcccaatt

SEQ ID NO: 44832 - DNA, 25 bp, E. coli
cgcgcatagcgagcaaatcccaatt

SEQ ID NO: 44833 - DNA, 25 bp, E. coli
tggcaaacaacaggagcgtatcggt

SEQ ID NO: 44834 - DNA, 25 bp, E. coli
tggcaaacaacacgagcgtatcggt

SEQ ID NO: 44835 - DNA, 25 bp, E. coli
ggcaatgtgtattctaacccaccga

SEQ ID NO: 44836 - DNA, 25 bp, E. coli
ggcaatgtgtatactaacccaccga

SEQ ID NO: 44837 - DNA, 25 bp, E. coli
aaattgggatctgggcaccgctcat

SEQ ID NO: 44838 - DNA, 25 bp, E. coli
aaagtacgctcaacatctggtgcag

SEQ ID NO: 44839 - DNA, 25 bp, E. coli
aaagtacgctcatcatctggtgcag

SEQ ID NO: 44840 - DNA, 25 bp, E. coli
aaattgggatctcggcaccgctcat

SEQ ID NO: 44841 - DNA, 25 bp, E. coli
tttatttttggcacggcagcaggac

SEQ ID NO: 44842 - DNA, 25 bp, E. coli
tttatttttggctcggcagcaggac

SEQ ID NO: 44843 - DNA, 25 bp, E. coli
ttgatgaccatagaatcagcgcccg

SEQ ID NO: 44844 - DNA, 25 bp, E. coli
ttgatgaccatacaatcagcgcccg

SEQ ID NO: 44845 - DNA, 25 bp, E. coli
tcgttatgggcactttcgcaggcgc

SEQ ID NO: 44846 - DNA, 25 bp, E. coli
tccggtaaagccttgagacgtgtcg

SEQ ID NO: 44847 - DNA, 25 bp, E. coli
tccggtaaagccatgagacgtgtcg

SEQ ID NO: 44848 - DNA, 25 bp, E. coli
tcgttatgggcagtttcgcaggcgc

SEQ ID NO: 44849 - DNA, 25 bp, E. coli
tctggtgcagtatgatcctcggcta

SEQ ID NO: 44850 - DNA, 25 bp, E. coli
tctggtgcagtaagatcctcggcta

SEQ ID NO: 44851 - DNA, 25 bp, E. coli
gcctgcataccgtagaaacgctgga

SEQ ID NO: 44852 - DNA, 25 bp, E. coli
gcctgcataccgaagaaacgctgga

SEQ ID NO: 44853 - DNA, 25 bp, E. coli
gcattgtcgcgacatattcccctga

SEQ ID NO: 44854 - DNA, 25 bp, E. coli
gcattgtcgcgagatattcccctga

SEQ ID NO: 44855 - DNA, 25 bp, E. coli
gaaaagtccgttgctccgttgattg

SEQ ID NO: 44856 - DNA, 25 bp, E. coli
gaaaagtccgttcctccgttgattg

SEQ ID NO: 44857 - DNA, 25 bp, E. coli
ggctacaacttaggtccgacgatga

SEQ ID NO: 44858 - DNA, 25 bp, E. coli
ggctacaacttacgtccgacgatga

SEQ ID NO: 44859 - DNA, 25 bp, E. coli
aatattatcctgaaagcgcgccagc

SEQ ID NO: 44860 - DNA, 25 bp, E. coli
aatattatcctgtaagcgcgccagc

SEQ ID NO: 44861 - DNA, 25 bp, E. coli
taaaaacgagttgcagcggacgctg

SEQ ID NO: 44862 - DNA, 25 bp, E. coli
taaactgagcaatccctggtggcgg

SEQ ID NO: 44863 - DNA, 25 bp, E. coli
taaactgagcaaaccctggtggcgg

SEQ ID NO: 44864 - DNA, 25 bp, E. coli
taaaaacgagttccagcggacgctg

SEQ ID NO: 44865 - DNA, 25 bp, E. coli
tatctgctggtatgggaactgccgg

SEQ ID NO: 44866 - DNA, 25 bp, E. coli
tatctgctggtaagggaactgccgg

SEQ ID NO: 44867 - DNA, 25 bp, E. coli
tatatcctgtttggtcacggctcga

SEQ ID NO: 44868 - DNA, 25 bp, E. coli
tatatcctgtttcgtcacggctcga

SEQ ID NO: 44869 - DNA, 25 bp, E. coli
tccatgaatgcagaggaaggctgct

SEQ ID NO: 44870 - DNA, 25 bp, E. coli
tccatgaatgcacaggaaggctgct

SEQ ID NO: 44871 - DNA, 25 bp, E. coli
tcttgaccaggcttatgacgacgat

SEQ ID NO: 44872 - DNA, 25 bp, E. coli
tcttgaccaggcatatgacgacgat

SEQ ID NO: 44873 - DNA, 25 bp, E. coli
cctacgtttatgtcgcgaaaggctc

SEQ ID NO: 44874 - DNA, 25 bp, E. coli
cctacgtttatgacgcgaaaggctc

SEQ ID NO: 44875 - DNA, 25 bp, E. coli
cgctggtcaggcacattatcggaaa

SEQ ID NO: 44876 - DNA, 25 bp, E. coli
cgctggtcaggctcattatcggaaa

SEQ ID NO: 44877 - DNA, 25 bp, E. coli
gatcgtcgctcacgataaacaggct

SEQ ID NO: 44878 - DNA, 25 bp, E. coli
ggatcctaaatacagcgccagagtg

SEQ ID NO: 44879 - DNA, 25 bp, E. coli
ggatcctaaatagagcgccagagtg

SEQ ID NO: 44880 - DNA, 25 bp, E. coli
gatcgtcgctcaggataaacaggct

SEQ ID NO: 44881 - DNA, 25 bp, E. coli
caagctggtggccattgatattgcg

SEQ ID NO: 44882 - DNA, 25 bp, E. coli
caagctggtggcgattgatattgcg

SEQ ID NO: 44883 - DNA, 25 bp, E. coli
agtcagtgaatctgacgcacaaaca

SEQ ID NO: 44884 - DNA, 25 bp, E. coli
agtcagtgaatcagacgcacaaaca

SEQ ID NO: 44885 - DNA, 25 bp, E. coli
tattgcgccggtggattatcacgtt

SEQ ID NO: 44886 - DNA, 25 bp, E. coli
tattgcgccggtcgattatcacgtt

SEQ ID NO: 44887 - DNA, 25 bp, E. coli
ttcgcggccatcaacgcagtcagtg

SEQ ID NO: 44888 - DNA, 25 bp, E. coli
ttcgcggccatctacgcagtcagtg

SEQ ID NO: 44889 - DNA, 25 bp, E. coli
tgcgccggtcgaatatcacgttcgc

SEQ ID NO: 44890 - DNA, 25 bp, E. coli
tgcgccggtcgattatcacgttcgc

SEQ ID NO: 44891 - DNA, 25 bp, E. coli
ccatcaacgcagtcagtgaatcaga

SEQ ID NO: 44892 - DNA, 25 bp, E. coli
ccatcaacgcagacagtgaatcaga

SEQ ID NO: 44893 - DNA, 25 bp, E. coli
ccggcatgggatcatcctaccctat

SEQ ID NO: 44894 - DNA, 25 bp, E. coli
ccccgatcgcatagacaagctggtg

SEQ ID NO: 44895 - DNA, 25 bp, E. coli
ccccgatcgcattgacaagctggtg

SEQ ID NO: 44896 - DNA, 25 bp, E. coli
ccggcatgggatgatcctaccctat

SEQ ID NO: 44897 - DNA, 25 bp, E. coli
cattgacaagctggtggcgattgat

SEQ ID NO: 44898 - DNA, 25 bp, E. coli
cattgacaagctcgtggcgattgat

SEQ ID NO: 44899 - DNA, 25 bp, E. coli
gattttcgcggccatcaacgcagtc

SEQ ID NO: 44900 - DNA, 25 bp, E. coli
gattttcgcggcgatcaacgcagtc

SEQ ID NO: 44901 - DNA, 25 bp, E. coli
tgggatcatcctaccctatttatcc

SEQ ID NO: 44902 - DNA, 25 bp, E. coli
tgggatcatccttccctatttatcc

SEQ ID NO: 44903 - DNA, 25 bp, E. coli
taaagacggtatgaccattacggtg

SEQ ID NO: 44904 - DNA, 25 bp, E. coli
taaagacggtatcaccattacggtg

SEQ ID NO: 44905 - DNA, 25 bp, E. coli
atgataggcagcataaccgcgcgca

SEQ ID NO: 44906 - DNA, 25 bp, E. coli
agttgcccagggaaacttacgccag

SEQ ID NO: 44907 - DNA, 25 bp, E. coli
agttgcccagggtaacttacgccag

SEQ ID NO: 44908 - DNA, 25 bp, E. coli
atgataggcagcttaaccgcgcgca

SEQ ID NO: 44909 - DNA, 25 bp, E. coli
aaaacgctgccgatgaagttgccca

SEQ ID NO: 44910 - DNA, 25 bp, E. coli
aaaacgctgccgttgaagttgccca

SEQ ID NO: 44911 - DNA, 25 bp, E. coli
tttatctgattcgtccggccagcag

SEQ ID NO: 44912 - DNA, 25 bp, E. coli
tttatctgattcctccggccagcag

SEQ ID NO: 44913 - DNA, 25 bp, E. coli
ttttaaccagatcgtcaccgcgctg

SEQ ID NO: 44914 - DNA, 25 bp, E. coli
ttattggtgacctccgaaggccgcg

SEQ ID NO: 44915 - DNA, 25 bp, E. coli
ttttaaccagatggtcaccgcgctg

SEQ ID NO: 44916 - DNA, 25 bp, E. coli
ttattggtgaccaccgaaggccgcg

SEQ ID NO: 44917 - DNA, 25 bp, E. coli
tccgcagaagaataagtatggccgc

SEQ ID NO: 44918 - DNA, 25 bp, E. coli
tccgcagaagaaaaagtatggccgc

SEQ ID NO: 44919 - DNA, 25 bp, E. coli
cgattgataagtgggcaccgccagg

SEQ ID NO: 44920 - DNA, 25 bp, E. coli
cgttcgaagccgtgcaaatgggcaa

SEQ ID NO: 44921 - DNA, 25 bp, E. coli
cgttcgaagccgagcaaatgggcaa

SEQ ID NO: 44922 - DNA, 25 bp, E. coli
cgattgataagtcggcaccgccagg

SEQ ID NO: 44923 - DNA, 25 bp, E. coli
gatgttacccaagctcgattcacgc

SEQ ID NO: 44924 - DNA, 25 bp, E. coli
gatgttacccaacctcgattcacgc

SEQ ID NO: 44925 - DNA, 25 bp, E. coli
caatctgacgttccgcgtgctggtg

SEQ ID NO: 44926 - DNA, 25 bp, E. coli
aatactcagccacacttcgaagccg

SEQ ID NO: 44927 - DNA, 25 bp, E. coli
aatactcagccagacttcgaagccg

SEQ ID NO: 44928 - DNA, 25 bp, E. coli
caatctgacgttgcgcgtgctggtg

SEQ ID NO: 44929 - DNA, 25 bp, E. coli
cagtgggtaacagtagctggctgcc

SEQ ID NO: 44930 - DNA, 25 bp, E. coli
cagtgggtaacactagctggctgcc

SEQ ID NO: 44931 - DNA, 25 bp, E. coli
aaagcgttctttctgaccggatctg

SEQ ID NO: 44932 - DNA, 25 bp, E. coli
aaagcgttctttgtgaccggatctg

SEQ ID NO: 44933 - DNA, 25 bp, E. coli
aaagcattgatgctgccaactaccg

SEQ ID NO: 44934 - DNA, 25 bp, E. coli
aaagcattgatggtgccaactaccg

SEQ ID NO: 44935 - DNA, 25 bp, E. coli
tgggctacacccagaactgctcaaa

SEQ ID NO: 44936 - DNA, 25 bp, E. coli
tgggctacaccctgaactgctcaaa

SEQ ID NO: 44937 - DNA, 25 bp, E. coli
ccaactaccgtctggcagtgggcta

SEQ ID NO: 44938 - DNA, 25 bp, E. coli
ccaactaccgtcaggcagtgggcta

SEQ ID NO: 44939 - DNA, 25 bp, E. coli
tggcgggcggcataatcgtcaatct

SEQ ID NO: 44940 - DNA, 25 bp, E. coli
tggcgggcggcaaaatcgtcaatct

SEQ ID NO: 44941 - DNA, 25 bp, E. coli
tcaaacagtgtcagcgacgacctgc

SEQ ID NO: 44942 - DNA, 25 bp, E. coli
tcaacggcgaaacggtgctgagtac

SEQ ID NO: 44943 - DNA, 25 bp, E. coli
tcaacggcgaaagggtgctgagtac

SEQ ID NO: 44944 - DNA, 25 bp, E. coli
tcaaacagtgtctgcgacgacctgc

SEQ ID NO: 44945 - DNA, 25 bp, E. coli
gagtttaatgcgaccatgaccatgg

SEQ ID NO: 44946 - DNA, 25 bp, E. coli
gagtttaatgcgtccatgaccatgg

SEQ ID NO: 44947 - DNA, 25 bp, E. coli
aatcggactggtaccagcatccacc

SEQ ID NO: 44948 - DNA, 25 bp, E. coli
aatcggactggttccagcatccacc

SEQ ID NO: 44949 - DNA, 25 bp, E. coli
cagcaggtgcggacggcgttttcat

SEQ ID NO: 44950 - DNA, 25 bp, E. coli
caaatcggactgcttccagcatcca

SEQ ID NO: 44951 - DNA, 25 bp, E. coli
caaatcggactggttccagcatcca

SEQ ID NO: 44952 - DNA, 25 bp, E. coli
cactgaagagcaggctgaatggata

SEQ ID NO: 44953 - DNA, 25 bp, E. coli
cactgaagagcacgctgaatggata

SEQ ID NO: 44954 - DNA, 25 bp, E. coli
cagcaggtgcggtcggcgttttcat

SEQ ID NO: 44955 - DNA, 25 bp, E. coli
accatgcactgatgagcaggctgaa

SEQ ID NO: 44956 - DNA, 25 bp, E. coli
accatgcactgaagagcaggctgaa

SEQ ID NO: 44957 - DNA, 25 bp, E. coli
tgcggacggcgttttcatgcattca

SEQ ID NO: 44958 - DNA, 25 bp, E. coli
tccaccatgcactgaagagcaggct

SEQ ID NO: 44959 - DNA, 25 bp, E. coli
tgcggacggcgtattcatgcattca

SEQ ID NO: 44960 - DNA, 25 bp, E. coli
tccaccatgcacagaagagcaggct

SEQ ID NO: 44961 - DNA, 25 bp, E. coli
gaagagcaggctgaatggataattc

SEQ ID NO: 44962 - DNA, 25 bp, E. coli
gaagagcaggctcaatggataattc

SEQ ID NO: 44963 - DNA, 25 bp, E. coli
gcactgaagagcaggctgaatggat

SEQ ID NO: 44964 - DNA, 25 bp, E. coli
gcactgaagagctggctgaatggat

SEQ ID NO: 44965 - DNA, 25 bp, E. coli
cggactggttccagcatccaccatg

SEQ ID NO: 44966 - DNA, 25 bp, E. coli
cggactggttcctgcatccaccatg

SEQ ID NO: 44967 - DNA, 25 bp, E. coli
gagcaggctgaaaggataattcagt

SEQ ID NO: 44968 - DNA, 25 bp, E. coli
gagcaggctgaatggataattcagt

SEQ ID NO: 44969 - DNA, 25 bp, E. coli
cagccagccgcttattcactacgag

SEQ ID NO: 44970 - DNA, 25 bp, E. coli
cagccagccgctaattcactacgag

SEQ ID NO: 44971 - DNA, 25 bp, E. coli
aaagaagaagagaggcagcctgcaa

SEQ ID NO: 44972 - DNA, 25 bp, E. coli
aaagaagaagagtggcagcctgcaa

SEQ ID NO: 44973 - DNA, 25 bp, E. coli
aaactgcgcctgtggtggcatcact

SEQ ID NO: 44974 - DNA, 25 bp, E. coli
aaactgcgcctgaggtggcatcact

SEQ ID NO: 44975 - DNA, 25 bp, E. coli
tggtggcatcacaaccttctgccag

SEQ ID NO: 44976 - DNA, 25 bp, E. coli
tggtggcatcactaccttctgccag

SEQ ID NO: 44977 - DNA, 25 bp, E. coli
tgccacccgcaaacgtgcacaggtg

SEQ ID NO: 44978 - DNA, 25 bp, E. coli
tgccacccgcaatcgtgcacaggtg

SEQ ID NO: 44979 - DNA, 25 bp, E. coli
tcagcaacaaggattgaaccgcccc

SEQ ID NO: 44980 - DNA, 25 bp, E. coli
tcagcaacaaggtttgaaccgcccc

SEQ ID NO: 44981 - DNA, 25 bp, E. coli
gcttattcactaggaggccgctttc

SEQ ID NO: 44982 - DNA, 25 bp, E. coli
gcttattcactacgaggccgctttc

SEQ ID NO: 44983 - DNA, 25 bp, E. coli
ggaaccacaggtaatgatgacaaag

SEQ ID NO: 44984 - DNA, 25 bp, E. coli
tggcgaaattccctcagcccgctta

SEQ ID NO: 44985 - DNA, 25 bp, E. coli
ggaaccacaggttatgatgacaaag

SEQ ID NO: 44986 - DNA, 25 bp, E. coli
tggcgaaattccgtcagcccgctta

SEQ ID NO: 44987 - DNA, 25 bp, E. coli
taatctgctgaccttatcactgcca

SEQ ID NO: 44988 - DNA, 25 bp, E. coli
taatgatgacaatgactcgtgcctg

SEQ ID NO: 44989 - DNA, 25 bp, E. coli
taatgatgacaaagactcgtgcctg

SEQ ID NO: 44990 - DNA, 25 bp, E. coli
taatctgctgacgttatcactgcca

SEQ ID NO: 44991 - DNA, 25 bp, E. coli
aagataacttcgacgctgggcgtcc

SEQ ID NO: 44992 - DNA, 25 bp, E. coli
aagataacttcgtcgctgggcgtcc

SEQ ID NO: 44993 - DNA, 25 bp, E. coli
cagtgattgcatccaggatcgcgca

SEQ ID NO: 44994 - DNA, 25 bp, E. coli
cagtgattgcatgcaggatcgcgca

SEQ ID NO: 44995 - DNA, 25 bp, E. coli
tgaccgatcgtgagctgaatgccca

SEQ ID NO: 44996 - DNA, 25 bp, E. coli
tgaccgatcgtgtgctgaatgccca

SEQ ID NO: 44997 - DNA, 25 bp, E. coli
tgccatgggaagtgatgaaactgcg

SEQ ID NO: 44998 - DNA, 25 bp, E. coli
tgccatgggaagagatgaaactgcg

SEQ ID NO: 44999 - DNA, 25 bp, E. coli
gaaattaccgcaacgcatgctggca

SEQ ID NO: 45000 - DNA, 25 bp, E. coli
gaaccatttatataccgtgctggag

SEQ ID NO: 45001 - DNA, 25 bp, E. coli
gaaattaccgcatcgcatgctggca

SEQ ID NO: 45002 - DNA, 25 bp, E. coli
gaaattttgcgagccacaggtggca

SEQ ID NO: 45003 - DNA, 25 bp, E. coli
gaaccatttataaaccgtgctggag

SEQ ID NO: 45004 - DNA, 25 bp, E. coli
gaaattttgcgacccacaggtggca

SEQ ID NO: 45005 - DNA, 25 bp, E. coli
gatcaactgatgagccagctccgcg

SEQ ID NO: 45006 - DNA, 25 bp, E. coli
gatcaactgatgtgccagctccgcg

SEQ ID NO: 45007 - DNA, 25 bp, E. coli
gataacccgcatattgtgcaggcca

SEQ ID NO: 45008 - DNA, 25 bp, E. coli
gataacccgcattttgtgcaggcca

SEQ ID NO: 45009 - DNA, 25 bp, E. coli
ggctattgtattgacccggccaccg

SEQ ID NO: 45010 - DNA, 25 bp, E. coli
ggctattgtattcacccggccaccg

SEQ ID NO: 45011 - DNA, 25 bp, E. coli
taatgctggatgagcaagcgccgac

SEQ ID NO: 45012 - DNA, 25 bp, E. coli
taatgctggatgtgcaagcgccgac

SEQ ID NO: 45013 - DNA, 25 bp, E. coli
taaacgagacagcagagttgcccga

SEQ ID NO: 45014 - DNA, 25 bp, E. coli
tactgcgggctgcagaacttacccc

SEQ ID NO: 45015 - DNA, 25 bp, E. coli
tacgattaacaacgaagcccaggct

SEQ ID NO: 45016 - DNA, 25 bp, E. coli
taaacgagacaggagagttgcccga

SEQ ID NO: 45017 - DNA, 25 bp, E. coli
tactgcgggctggagaacttacccc

SEQ ID NO: 45018 - DNA, 25 bp, E. coli
tacgattaacaaggaagcccaggct

SEQ ID NO: 45019 - DNA, 25 bp, E. coli
aaaatattgcgggttacgtcgggct

SEQ ID NO: 45020 - DNA, 25 bp, E. coli
aaaatattgcggcttacgtcgggct

SEQ ID NO: 45021 - DNA, 25 bp, E. coli
tattgctgcaccagaacggcttggc

SEQ ID NO: 45022 - DNA, 25 bp, E. coli
tattgctgcacctgaacggcttggc

SEQ ID NO: 45023 - DNA, 25 bp, E. coli
tttcctgctatgtggctggcccctg

SEQ ID NO: 45024 - DNA, 25 bp, E. coli
tttcctgctatgaggctggcccctg

SEQ ID NO: 45025 - DNA, 25 bp, E. coli
tgcatggaaagcacaacaacgattg

SEQ ID NO: 45026 - DNA, 25 bp, E. coli
tgcatggaaagctcaacaacgattg

SEQ ID NO: 45027 - DNA, 25 bp, E. coli
gaagccgcctggacttatcgtacac

SEQ ID NO: 45028 - DNA, 25 bp, E. coli
gaagccgcctggtcttatcgtacac

SEQ ID NO: 45029 - DNA, 25 bp, E. coli
ggatctaatcagtgcccgtgcagca

SEQ ID NO: 45030 - DNA, 25 bp, E. coli
ggatctaatcagagcccgtgcagca

SEQ ID NO: 45031 - DNA, 25 bp, E. coli
tcacaagtagcctttacggcggtgg

SEQ ID NO: 45032 - DNA, 25 bp, E. coli
tcacaagtagccattacggcggtgg

SEQ ID NO: 45033 - DNA, 25 bp, E. coli
gacctgactcatgaagctatgcggg

SEQ ID NO: 45034 - DNA, 25 bp, E. coli
gacctgactcatcaagctatgcggg

SEQ ID NO: 45035 - DNA, 25 bp, E. coli
aatgcgcagttacccgcgttgtttc

SEQ ID NO: 45036 - DNA, 25 bp, E. coli
caacagcaagatgcggtgaatgcgc

SEQ ID NO: 45037 - DNA, 25 bp, E. coli
caacagcaagatccggtgaatgcgc

SEQ ID NO: 45038 - DNA, 25 bp, E. coli
agcaaaatatccttcaggtcgaaga

SEQ ID NO: 45039 - DNA, 25 bp, E. coli
agcaaaatatccatcaggtcgaaga

SEQ ID NO: 45040 - DNA, 25 bp, E. coli
aatgcgcagttagccgcgttgtttc

SEQ ID NO: 45041 - DNA, 25 bp, E. coli
ttgcagcaaaatatccatcaggtcg

SEQ ID NO: 45042 - DNA, 25 bp, E. coli
ttgcagcaaaatttccatcaggtcg

SEQ ID NO: 45043 - DNA, 25 bp, E. coli
tgtcgcgccaatggaccatttaatt

SEQ ID NO: 45044 - DNA, 25 bp, E. coli
tgtcgcgccaatcgaccatttaatt

SEQ ID NO: 45045 - DNA, 25 bp, E. coli
tgagatgcgtacctgctgtgagaca

SEQ ID NO: 45046 - DNA, 25 bp, E. coli
tgagatgcgtacgtgctgtgagaca

SEQ ID NO: 45047 - DNA, 25 bp, E. coli
tcgttaagtgagatgcgtacctgct

SEQ ID NO: 45048 - DNA, 25 bp, E. coli
tcgttaagtgagttgcgtacctgct

SEQ ID NO: 45049 - DNA, 25 bp, E. coli
gcgccaatcgacgatttaattcaac

SEQ ID NO: 45050 - DNA, 25 bp, E. coli
gcgccaatcgaccatttaattcaac

SEQ ID NO: 45051 - DNA, 25 bp, E. coli
gactcggagtcgataagtgagatgc

SEQ ID NO: 45052 - DNA, 25 bp, E. coli
gactcggagtcgttaagtgagatgc

SEQ ID NO: 45053 - DNA, 25 bp, E. coli
cgttgtttcaggttgactcggagtc

SEQ ID NO: 45054 - DNA, 25 bp, E. coli
cgttgtttcaggatgactcggagtc

SEQ ID NO: 45055 - DNA, 25 bp, E. coli
cggtgaatgcgctgttagccgcgtt

SEQ ID NO: 45056 - DNA, 25 bp, E. coli
cggtgaatgcgcagttagccgcgtt

SEQ ID NO: 45057 - DNA, 25 bp, E. coli
aataataggttcatcctcaggacta

SEQ ID NO: 45058 - DNA, 25 bp, E. coli
caggactaagttgttttcaaccaca

SEQ ID NO: 45059 - DNA, 25 bp, E. coli
catggctgctggtacgtaactgaac

SEQ ID NO: 45060 - DNA, 25 bp, E. coli
caggactaagttcttttcaaccaca

SEQ ID NO: 45061 - DNA, 25 bp, E. coli
catggctgctggaacgtaactgaac

SEQ ID NO: 45062 - DNA, 25 bp, E. coli
aataataggttcttcctcaggacta

SEQ ID NO: 45063 - DNA, 25 bp, E. coli
tagaagcaatactatggcacccaca

SEQ ID NO: 45064 - DNA, 25 bp, E. coli
tagaagcaatacaatggcacccaca

SEQ ID NO: 45065 - DNA, 25 bp, E. coli
tttaaaaggcgaagcgattacccct

SEQ ID NO: 45066 - DNA, 25 bp, E. coli
tttaaaaggcgatgcgattacccct

SEQ ID NO: 45067 - DNA, 25 bp, E. coli
tttattgaaacaggaagacatggct

SEQ ID NO: 45068 - DNA, 25 bp, E. coli
tttattgaaacacgaagacatggct

SEQ ID NO: 45069 - DNA, 25 bp, E. coli
tcccattaccgttacgattgagcgt

SEQ ID NO: 45070 - DNA, 25 bp, E. coli
tcccattaccgtaacgattgagcgt

SEQ ID NO: 45071 - DNA, 25 bp, E. coli
tcttcaaatgtgcacagacgctcga

SEQ ID NO: 45072 - DNA, 25 bp, E. coli
tcttcaaatgtggacagacgctcga

SEQ ID NO: 45073 - DNA, 25 bp, E. coli
ccaggatggcagagtttgatgaaaa

SEQ ID NO: 45074 - DNA, 25 bp, E. coli
ccaggatggcagtgtttgatgaaaa

SEQ ID NO: 45075 - DNA, 25 bp, E. coli
gacagacgctcgaatgtggcgaccc

SEQ ID NO: 45076 - DNA, 25 bp, E. coli
gacagacgctcgtatgtggcgaccc

SEQ ID NO: 45077 - DNA, 25 bp, E. coli
gataagctggataaacattcgcaaa

SEQ ID NO: 45078 - DNA, 25 bp, E. coli
gataagctggattaacattcgcaaa

SEQ ID NO: 45079 - DNA, 25 bp, E. coli
acgtggcgcgcaccgtgaaatcgat

SEQ ID NO: 45080 - DNA, 25 bp, E. coli
atgtgctgaccgtcattcgccgtat

SEQ ID NO: 45081 - DNA, 25 bp, E. coli
atgtgctgaccgacattcgccgtat

SEQ ID NO: 45082 - DNA, 25 bp, E. coli
acccttgatgatgtgctgaccgaca

SEQ ID NO: 45083 - DNA, 25 bp, E. coli
acccttgatgatctgctgaccgaca

SEQ ID NO: 45084 - DNA, 25 bp, E. coli
acaacctgtttgcccgtagccaggt

SEQ ID NO: 45085 - DNA, 25 bp, E. coli
acgtggcgcgcagcgtgaaatcgat

SEQ ID NO: 45086 - DNA, 25 bp, E. coli
acaacctgtttggccgtagccaggt

SEQ ID NO: 45087 - DNA, 25 bp, E. coli
tacccttgatgatgtgctgaccgac

SEQ ID NO: 45088 - DNA, 25 bp, E. coli
tacccttgatgaagtgctgaccgac

SEQ ID NO: 45089 - DNA, 25 bp, E. coli
tctacccttgatgatgtgctgaccg

SEQ ID NO: 45090 - DNA, 25 bp, E. coli
tctacccttgatcatgtgctgaccg

SEQ ID NO: 45091 - DNA, 25 bp, E. coli
ccttgatgatgtcctgaccgacatt

SEQ ID NO: 45092 - DNA, 25 bp, E. coli
ccttgatgatgtgctgaccgacatt

SEQ ID NO: 45093 - DNA, 25 bp, E. coli
gtggcgcgcaccgtgaaatcgatga

SEQ ID NO: 45094 - DNA, 25 bp, E. coli
gtggcgcgcaccctgaaatcgatga

SEQ ID NO: 45095 - DNA, 25 bp, E. coli
ggcgcgcaccgtgaaatcgatgatt

SEQ ID NO: 45096 - DNA, 25 bp, E. coli
ggcgcgcaccgtcaaatcgatgatt

SEQ ID NO: 45097 - DNA, 25 bp, E. coli
gatgtgctgacccacattcgccgta

SEQ ID NO: 45098 - DNA, 25 bp, E. coli
gatgatgtgctgtccgacattcgcc

SEQ ID NO: 45099 - DNA, 25 bp, E. coli
gatgtgctgaccgacattcgccgta

SEQ ID NO: 45100 - DNA, 25 bp, E. coli
gatgatgtgctgaccgacattcgcc

SEQ ID NO: 45101 - DNA, 25 bp, E. coli
caaataccgctctatcaacaagtgg

SEQ ID NO: 45102 - DNA, 25 bp, E. coli
caaataccgctcaatcaacaagtgg

SEQ ID NO: 45103 - DNA, 25 bp, E. coli
aaagcgatgctgatagagaaccgta

SEQ ID NO: 45104 - DNA, 25 bp, E. coli
aaagcgatgctgttagagaaccgta

SEQ ID NO: 45105 - DNA, 25 bp, E. coli
ttcgcggaatcgctggaaagccaga

SEQ ID NO: 45106 - DNA, 25 bp, E. coli
ttcgcggaatcggtggaaagccaga

SEQ ID NO: 45107 - DNA, 25 bp, E. coli
tcgttactcggatagtcgctatgcc

SEQ ID NO: 45108 - DNA, 25 bp, E. coli
tcgttactcggaaagtcgctatgcc

SEQ ID NO: 45109 - DNA, 25 bp, E. coli
gctatgccgcgccattaattggtaa

SEQ ID NO: 45110 - DNA, 25 bp, E. coli
gctatgccgcgcgattaattggtaa

SEQ ID NO: 45111 - DNA, 25 bp, E. coli
gaaattaagaattacgcccggtcag

SEQ ID NO: 45112 - DNA, 25 bp, E. coli
gaaattaagaataacgcccggtcag

SEQ ID NO: 45113 - DNA, 25 bp, E. coli
gcccaactggtataagaaggcgtgt

SEQ ID NO: 45114 - DNA, 25 bp, E. coli
gcccaactggtaaaagaaggcgtgt

SEQ ID NO: 45115 - DNA, 25 bp, E. coli
cggctaatcgttatgtggcagagaa

SEQ ID NO: 45116 - DNA, 25 bp, E. coli
cggctaatcgttttgtggcagagaa

SEQ ID NO: 45117 - DNA, 25 bp, E. coli
gtatcaatattgagctatgccccgg

SEQ ID NO: 45118 - DNA, 25 bp, E. coli
gtatcaatattgtgctatgccccgg

SEQ ID NO: 45119 - DNA, 25 bp, E. coli
ggaagacgatcggattccttcggaa

SEQ ID NO: 45120 - DNA, 25 bp, E. coli
ggaagacgatcgcattccttcggaa

SEQ ID NO: 45121 - DNA, 25 bp, E. coli
tcaaaaaagagaacgtggcatatcc

SEQ ID NO: 45122 - DNA, 25 bp, E. coli
tcaaaaaagagatcgtggcatatcc

SEQ ID NO: 45123 - DNA, 25 bp, E. coli
catatggcgatgtccacggagcctg

SEQ ID NO: 45124 - DNA, 25 bp, E. coli
catcctgttctcacggcaattggcg

SEQ ID NO: 45125 - DNA, 25 bp, E. coli
catcctgttctctcggcaattggcg

SEQ ID NO: 45126 - DNA, 25 bp, E. coli
catatggcgatgaccacggagcctg

SEQ ID NO: 45127 - DNA, 25 bp, E. coli
tacttgattcaccagccatatggcg

SEQ ID NO: 45128 - DNA, 25 bp, E. coli
tacttgattcacgagccatatggcg

SEQ ID NO: 45129 - DNA, 25 bp, E. coli
tcgattttgaacacagccctgaaga

SEQ ID NO: 45130 - DNA, 25 bp, E. coli
tcgattttgaactcagccctgaaga

SEQ ID NO: 45131 - DNA, 25 bp, E. coli
gctggatctacctacgaggcattgt

SEQ ID NO: 45132 - DNA, 25 bp, E. coli
gctgactggccgcaaacttgatgtt

SEQ ID NO: 45133 - DNA, 25 bp, E. coli
gctgactggccggaaacttgatgtt

SEQ ID NO: 45134 - DNA, 25 bp, E. coli
gctggatctaccaacgaggcattgt

SEQ ID NO: 45135 - DNA, 25 bp, E. coli
gaaaaatggtctgttccagcatcct

SEQ ID NO: 45136 - DNA, 25 bp, E. coli
gaaaaatggtctcttccagcatcct

SEQ ID NO: 45137 - DNA, 25 bp, E. coli
cccgcaatggtgcaatggctgactg

SEQ ID NO: 45138 - DNA, 25 bp, E. coli
cccgcaatggtggaatggctgactg

SEQ ID NO: 45139 - DNA, 25 bp, E. coli
cgttccctggatgcaaagtcgtggc

SEQ ID NO: 45140 - DNA, 25 bp, E. coli
cgttccctggatccaaagtcgtggc

SEQ ID NO: 45141 - DNA, 25 bp, E. coli
gatatgctgcaaattaccgccctgg

SEQ ID NO: 45142 - DNA, 25 bp, E. coli
gatatgctgcaatttaccgccctgg

SEQ ID NO: 45143 - DNA, 25 bp, E. coli
tggataccgcaaccagcgcgttctt

SEQ ID NO: 45144 - DNA, 25 bp, E. coli
tggataccgcaagcagcgcgttctt

SEQ ID NO: 45145 - DNA, 25 bp, E. coli
cactgagctgtgcatcgaggtcgaa

SEQ ID NO: 45146 - DNA, 25 bp, E. coli
caactgctgtggaaaaaggctgccg

SEQ ID NO: 45147 - DNA, 25 bp, E. coli
caactgctgtggtaaaaggctgccg

SEQ ID NO: 45148 - DNA, 25 bp, E. coli
cactgagctgtggatcgaggtcgaa

SEQ ID NO: 45149 - DNA, 25 bp, E. coli
catggcgccgatgggtgatatcaac

SEQ ID NO: 45150 - DNA, 25 bp, E. coli
catggcgccgatcggtgatatcaac

SEQ ID NO: 45151 - DNA, 25 bp, E. coli
tatcgccgaggacgtagcctttgcc

SEQ ID NO: 45152 - DNA, 25 bp, E. coli
tattcactggatgtgcccacagcag

SEQ ID NO: 45153 - DNA, 25 bp, E. coli
tatcgccgaggaggtagcctttgcc

SEQ ID NO: 45154 - DNA, 25 bp, E. coli
tattcactggatctgcccacagcag

SEQ ID NO: 45155 - DNA, 25 bp, E. coli
tggtgataacgacaacgtccgcgtg

SEQ ID NO: 45156 - DNA, 25 bp, E. coli
tggtgataacgagaacgtccgcgtg

SEQ ID NO: 45157 - DNA, 25 bp, E. coli
tgaagaagcgctgacatccggcatt

SEQ ID NO: 45158 - DNA, 25 bp, E. coli
tgaagaagcgctcacatccggcatt

SEQ ID NO: 45159 - DNA, 25 bp, E. coli
tctttggcgtaataccggcgactat

SEQ ID NO: 45160 - DNA, 25 bp, E. coli
tctttggcgtaaaaccggcgactat

SEQ ID NO: 45161 - DNA, 25 bp, E. coli
gataaccagtgatccggcggacatt

SEQ ID NO: 45162 - DNA, 25 bp, E. coli
gataaccagtgaaccggcggacatt

SEQ ID NO: 45163 - DNA, 25 bp, E. coli
gatgatttaactacctacggcgaag

SEQ ID NO: 45164 - DNA, 25 bp, E. coli
gaggatactctgactgccatcggcg

SEQ ID NO: 45165 - DNA, 25 bp, E. coli
gaggatactctgtctgccatcggcg

SEQ ID NO: 45166 - DNA, 25 bp, E. coli
gatgatttaacttcctacggcgaag

SEQ ID NO: 45167 - DNA, 25 bp, E. coli
taaagcttattagtgagtttgcgaa

SEQ ID NO: 45168 - DNA, 25 bp, E. coli
taaagcttattactgagtttgcgaa

SEQ ID NO: 45169 - DNA, 25 bp, E. coli
tttttaactctcacgcttaccctga

SEQ ID NO: 45170 - DNA, 25 bp, E. coli
tttttaactctctcgcttaccctga

SEQ ID NO: 45171 - DNA, 25 bp, E. coli
aaaaagcagtctttataatatctcg

SEQ ID NO: 45172 - DNA, 25 bp, E. coli
aaaaagcagtctatataatatctcg

SEQ ID NO: 45173 - DNA, 25 bp, E. coli
tatgaaagtttatgcaccacagcga

SEQ ID NO: 45174 - DNA, 25 bp, E. coli
tatgaaagtttaagcaccacagcga

SEQ ID NO: 45175 - DNA, 25 bp, E. coli
tatattcatgcgttgcatatgaaag

SEQ ID NO: 45176 - DNA, 25 bp, E. coli
tattcagggtaagcagtttagctgc

SEQ ID NO: 45177 - DNA, 25 bp, E. coli
ttatgcaccacaccgaatatctctc

SEQ ID NO: 45178 - DNA, 25 bp, E. coli
tatattcatgcgatgcatatgaaag

SEQ ID NO: 45179 - DNA, 25 bp, E. coli
ttatgcaccacagcgaatatctctc

SEQ ID NO: 45180 - DNA, 25 bp, E. coli
tattcagggtaaccagtttagctgc

SEQ ID NO: 45181 - DNA, 25 bp, E. coli
tgatctacctcaccttttaaacgcg

SEQ ID NO: 45182 - DNA, 25 bp, E. coli
tgatctacctcagcttttaaacgcg

SEQ ID NO: 45183 - DNA, 25 bp, E. coli
tctccattcttagtgatctacctca

SEQ ID NO: 45184 - DNA, 25 bp, E. coli
tctccattcttactgatctacctca

SEQ ID NO: 45185 - DNA, 25 bp, E. coli
gcgaatatctctgcattcttagtga

SEQ ID NO: 45186 - DNA, 25 bp, E. coli
gctgcaatatataagtaaagcttat

SEQ ID NO: 45187 - DNA, 25 bp, E. coli
gctgcaatatattagtaaagcttat

SEQ ID NO: 45188 - DNA, 25 bp, E. coli
gcgaatatctctccattcttagtga

SEQ ID NO: 45189 - DNA, 25 bp, E. coli
agcggtatatccgttgtgtgaatat

SEQ ID NO: 45190 - DNA, 25 bp, E. coli
agcggtatatcccttgtgtgaatat

SEQ ID NO: 45191 - DNA, 25 bp, E. coli
tatcccttgtgtgaatatctctgca

SEQ ID NO: 45192 - DNA, 25 bp, E. coli
tatcccttgtgtcaatatctctgca

SEQ ID NO: 45193 - DNA, 25 bp, E. coli
tatatcccttgtgtgaatatctctg

SEQ ID NO: 45194 - DNA, 25 bp, E. coli
tatatcccttgtctgaatatctctg

SEQ ID NO: 45195 - DNA, 25 bp, E. coli
ttgtgtgaatatctctgcagagccg

SEQ ID NO: 45196 - DNA, 25 bp, E. coli
ttgtgtgaatatgtctgcagagccg

SEQ ID NO: 45197 - DNA, 25 bp, E. coli
gcggtatatcccatgtgtgaatatc

SEQ ID NO: 45198 - DNA, 25 bp, E. coli
gcggtatatcccttgtgtgaatatc

SEQ ID NO: 45199 - DNA, 25 bp, E. coli
cggtatatccctagtgtgaatatct

SEQ ID NO: 45200 - DNA, 25 bp, E. coli
cggtatatcccttgtgtgaatatct

SEQ ID NO: 45201 - DNA, 25 bp, E. coli
gggagcggtataacccttgtgtgaa

SEQ ID NO: 45202 - DNA, 25 bp, E. coli
gggagcggtatatcccttgtgtgaa

SEQ ID NO: 45203 - DNA, 25 bp, E. coli
ggtatatcccttctgtgaatatctc

SEQ ID NO: 45204 - DNA, 25 bp, E. coli
ggagcggtatatcccttgtgtgaat

SEQ ID NO: 45205 - DNA, 25 bp, E. coli
ggagcggtatatgccttgtgtgaat

SEQ ID NO: 45206 - DNA, 25 bp, E. coli
ggtatatcccttgtgtgaatatctc

SEQ ID NO: 45207 - DNA, 25 bp, E. coli
gagaacgccggacggggagcggtat

SEQ ID NO: 45208 - DNA, 25 bp, E. coli
gagaacgccggagggggagcggtat

SEQ ID NO: 45209 - DNA, 25 bp, E. coli
tgagaacgccggagggggagcggta

SEQ ID NO: 45210 - DNA, 25 bp, E. coli
tgagaacgccggtgggggagcggta

SEQ ID NO: 45211 - DNA, 25 bp, E. coli
atcatctccgccagccggtacgtat

SEQ ID NO: 45212 - DNA, 25 bp, E. coli
atgcaggacccgtacccgcaggtcg

SEQ ID NO: 45213 - DNA, 25 bp, E. coli
atgcaggacccgaacccgcaggtcg

SEQ ID NO: 45214 - DNA, 25 bp, E. coli
atcatctccgcctgccggtacgtat

SEQ ID NO: 45215 - DNA, 25 bp, E. coli
tagcgcgcgtggtcgctgcgatgca

SEQ ID NO: 45216 - DNA, 25 bp, E. coli
tagcgcgcgtggacgctgcgatgca

SEQ ID NO: 45217 - DNA, 25 bp, E. coli
tggtcgctgcgatgcaggacccgaa

SEQ ID NO: 45218 - DNA, 25 bp, E. coli
tggtcgctgcgaagcaggacccgaa

SEQ ID NO: 45219 - DNA, 25 bp, E. coli
tgcgatgcaggagccgaacccgcag

SEQ ID NO: 45220 - DNA, 25 bp, E. coli
tgcgatgcaggacccgaacccgcag

SEQ ID NO: 45221 - DNA, 25 bp, E. coli
tcatctccgccacccggtacgtatt

SEQ ID NO: 45222 - DNA, 25 bp, E. coli
tcatctccgccagccggtacgtatt

SEQ ID NO: 45223 - DNA, 25 bp, E. coli
gcgctctacccgcaacatcatctcc

SEQ ID NO: 45224 - DNA, 25 bp, E. coli
gcaggacccgaacccgcaggtcgct

SEQ ID NO: 45225 - DNA, 25 bp, E. coli
gcaggacccgaagccgcaggtcgct

SEQ ID NO: 45226 - DNA, 25 bp, E. coli
gcgctctacccggaacatcatctcc

SEQ ID NO: 45227 - DNA, 25 bp, E. coli
cgtagcgcgcgtggtcgctgcgatg

SEQ ID NO: 45228 - DNA, 25 bp, E. coli
cgtagcgcgcgtcgtcgctgcgatg

SEQ ID NO: 45229 - DNA, 25 bp, E. coli
ggtcgctgcgatgcaggacccgaac

SEQ ID NO: 45230 - DNA, 25 bp, E. coli
ggtcgctgcgatccaggacccgaac

SEQ ID NO: 45231 - DNA, 25 bp, E. coli
gtcgctgcgatgcaggacccgaacc

SEQ ID NO: 45232 - DNA, 25 bp, E. coli
gtcgctgcgatggaggacccgaacc

SEQ ID NO: 45233 - DNA, 25 bp, E. coli
cagcaccgttataacttagcgcgca

SEQ ID NO: 45234 - DNA, 25 bp, E. coli
cagcaccgttattacttagcgcgca

SEQ ID NO: 45235 - DNA, 25 bp, E. coli
taaagaatctcgacccttctgccag

SEQ ID NO: 45236 - DNA, 25 bp, E. coli
taaagaatctcgtcccttctgccag

SEQ ID NO: 45237 - DNA, 25 bp, E. coli
aaagaactatttaggcgctgccaga

SEQ ID NO: 45238 - DNA, 25 bp, E. coli
aaagaactattttggcgctgccaga

SEQ ID NO: 45239 - DNA, 25 bp, E. coli
tagctatgccgtgattgaggtggac

SEQ ID NO: 45240 - DNA, 25 bp, E. coli
tagcgcgcacacacttaaaaagaac

SEQ ID NO: 45241 - DNA, 25 bp, E. coli
tagcgcgcacactcttaaaaagaac

SEQ ID NO: 45242 - DNA, 25 bp, E. coli
tagctatgccgtcattgaggtggac

SEQ ID NO: 45243 - DNA, 25 bp, E. coli
tgggttacctactctcttcactgct

SEQ ID NO: 45244 - DNA, 25 bp, E. coli
tgtaccacgcgcctaaagaatctcg

SEQ ID NO: 45245 - DNA, 25 bp, E. coli
tgggttacctacactcttcactgct

SEQ ID NO: 45246 - DNA, 25 bp, E. coli
tgtaccacgcgcgtaaagaatctcg

SEQ ID NO: 45247 - DNA, 25 bp, E. coli
tcatgccgggtaaggtagctatgcc

SEQ ID NO: 45248 - DNA, 25 bp, E. coli
tcatgccgggtatggtagctatgcc

SEQ ID NO: 45249 - DNA, 25 bp, E. coli
gaaagcaacgttattcatgccgggt

SEQ ID NO: 45250 - DNA, 25 bp, E. coli
gaaagcaacgtttttcatgccgggt

SEQ ID NO: 45251 - DNA, 25 bp, E. coli
gattatgaacatgagacgaacgaag

SEQ ID NO: 45252 - DNA, 25 bp, E. coli
gattatgaacatcagacgaacgaag

SEQ ID NO: 45253 - DNA, 25 bp, E. coli
gagcctttagagtatcgcttttggg

SEQ ID NO: 45254 - DNA, 25 bp, E. coli
gagcctttagagaatcgcttttggg

SEQ ID NO: 45255 - DNA, 25 bp, E. coli
agatctggccggagtattccccttc

SEQ ID NO: 45256 - DNA, 25 bp, E. coli
agatctggccggtgtattccccttc

SEQ ID NO: 45257 - DNA, 25 bp, E. coli
tgacctgcaaaagatctggccggag

SEQ ID NO: 45258 - DNA, 25 bp, E. coli
tgcaaaagatctcgccggagtattc

SEQ ID NO: 45259 - DNA, 25 bp, E. coli
tgacctgcaaaacatctggccggag

SEQ ID NO: 45260 - DNA, 25 bp, E. coli
tgcaaaagatctggccggagtattc

SEQ ID NO: 45261 - DNA, 25 bp, E. coli
tctacgccgcgccttttaacgagcg

SEQ ID NO: 45262 - DNA, 25 bp, E. coli
tctacgccgcgcgttttaacgagcg

SEQ ID NO: 45263 - DNA, 25 bp, E. coli
gctgccgtgcgggtaaccttaagcg

SEQ ID NO: 45264 - DNA, 25 bp, E. coli
gctgccgtgcggctaaccttaagcg

SEQ ID NO: 45265 - DNA, 25 bp, E. coli
gaagctgaccatcattcgattagaa

SEQ ID NO: 45266 - DNA, 25 bp, E. coli
gaagctgaccatgattcgattagaa

SEQ ID NO: 45267 - DNA, 25 bp, E. coli
ccgcgcgttttaacgagcgcctgct

SEQ ID NO: 45268 - DNA, 25 bp, E. coli
ccgcgcgttttatcgagcgcctgct

SEQ ID NO: 45269 - DNA, 25 bp, E. coli
gattgacctgcataagatctggccg

SEQ ID NO: 45270 - DNA, 25 bp, E. coli
gattgacctgcaaaagatctggccg

SEQ ID NO: 45271 - DNA, 25 bp, E. coli
tggaagaggttttgcgtaacaatcc

SEQ ID NO: 45272 - DNA, 25 bp, E. coli
tggaagaggtttagcgtaacaatcc

SEQ ID NO: 45273 - DNA, 25 bp, E. coli
tgcgggtaaccttaagcggcaccga

SEQ ID NO: 45274 - DNA, 25 bp, E. coli
tgcgggtaacctaaagcggcaccga

SEQ ID NO: 45275 - DNA, 25 bp, E. coli
gaccggattgacgtgcaaaagatct

SEQ ID NO: 45276 - DNA, 25 bp, E. coli
gaccggattgacctgcaaaagatct

SEQ ID NO: 45277 - DNA, 25 bp, E. coli
caatccccgccccaatgtgtgtaaa

SEQ ID NO: 45278 - DNA, 25 bp, E. coli
aatatttagaaaggcaatttgcgcc

SEQ ID NO: 45279 - DNA, 25 bp, E. coli
caatccccgcccgaatgtgtgtaaa

SEQ ID NO: 45280 - DNA, 25 bp, E. coli
aatatttagaaacgcaatttgcgcc

SEQ ID NO: 45281 - DNA, 25 bp, E. coli
catcacctggatagatagtaaaagt

SEQ ID NO: 45282 - DNA, 25 bp, E. coli
catcacctggattgatagtaaaagt

SEQ ID NO: 45283 - DNA, 25 bp, E. coli
aaatgatagaactgtgaaacgaaac

SEQ ID NO: 45284 - DNA, 25 bp, E. coli
aaatgatagaacagtgaaacgaaac

SEQ ID NO: 45285 - DNA, 25 bp, E. coli
acaagggcgaaagtcagtacaatcc

SEQ ID NO: 45286 - DNA, 25 bp, E. coli
acaagggcgaaactcagtacaatcc

SEQ ID NO: 45287 - DNA, 25 bp, E. coli
tagtaaaagtttgcaacaagggcga

SEQ ID NO: 45288 - DNA, 25 bp, E. coli
tagtaaaagtttccaacaagggcga

SEQ ID NO: 45289 - DNA, 25 bp, E. coli
gaacgcaatcgattacgtaaatgat

SEQ ID NO: 45290 - DNA, 25 bp, E. coli
gaacgcaatcgaatacgtaaatgat

SEQ ID NO: 45291 - DNA, 25 bp, E. coli
ccgaatgtgtgttaacgtgaacgca

SEQ ID NO: 45292 - DNA, 25 bp, E. coli
ccgaatgtgtgtaaacgtgaacgca

SEQ ID NO: 45293 - DNA, 25 bp, E. coli
gttactctgctttcatcacctggat

SEQ ID NO: 45294 - DNA, 25 bp, E. coli
gttactctgcttacatcacctggat

SEQ ID NO: 45295 - DNA, 25 bp, E. coli
ggacgattttgtgcgtcccgcaaca

SEQ ID NO: 45296 - DNA, 25 bp, E. coli
ggacgattttgtccgtcccgcaaca

SEQ ID NO: 45297 - DNA, 25 bp, E. coli
taataggctcctgtgtatacgaaat

SEQ ID NO: 45298 - DNA, 25 bp, E. coli
taataggctcctctgtatacgaaat

SEQ ID NO: 45299 - DNA, 25 bp, E. coli
aagagaagttatgaagcggttaggc

SEQ ID NO: 45300 - DNA, 25 bp, E. coli
aagagaagttatcaagcggttaggc

SEQ ID NO: 45301 - DNA, 25 bp, E. coli
aacagtagggagacgggatcagttc

SEQ ID NO: 45302 - DNA, 25 bp, E. coli
aacagtagggagtcgggatcagttc

SEQ ID NO: 45303 - DNA, 25 bp, E. coli
tagcgataacttggccagcggtaag

SEQ ID NO: 45304 - DNA, 25 bp, E. coli
taggcattaataccgataacttcgc

SEQ ID NO: 45305 - DNA, 25 bp, E. coli
taggcattaatagcgataacttcgc

SEQ ID NO: 45306 - DNA, 25 bp, E. coli
tagcgataacttcgccagcggtaag

SEQ ID NO: 45307 - DNA, 25 bp, E. coli
ttgatgataatcaacccttaccggg

SEQ ID NO: 45308 - DNA, 25 bp, E. coli
tttatcaagagatgttatcaagcgg

SEQ ID NO: 45309 - DNA, 25 bp, E. coli
tttatcaagagaagttatcaagcgg

SEQ ID NO: 45310 - DNA, 25 bp, E. coli
ttgatgataatctacccttaccggg

SEQ ID NO: 45311 - DNA, 25 bp, E. coli
tgtcaacctgagacatcaacatcag

SEQ ID NO: 45312 - DNA, 25 bp, E. coli
tgtcaacctgagtcatcaacatcag

SEQ ID NO: 45313 - DNA, 25 bp, E. coli
gactataaagcgacgggtaataaca

SEQ ID NO: 45314 - DNA, 25 bp, E. coli
gactataaagcgtcgggtaataaca

SEQ ID NO: 45315 - DNA, 25 bp, E. coli
cgggatcagttctattatggtgtca

SEQ ID NO: 45316 - DNA, 25 bp, E. coli
cgggatcagttcaattatggtgtca

SEQ ID NO: 45317 - DNA, 25 bp, E. coli
ggattatcaggatcagtagggagtc

SEQ ID NO: 45318 - DNA, 25 bp, E. coli
ggattatcaggaacagtagggagtc

SEQ ID NO: 45319 - DNA, 25 bp, E. coli
tcaattatggtgacaacctgagtca

SEQ ID NO: 45320 - DNA, 25 bp, E. coli
tcaattatggtgtcaacctgagtca

SEQ ID NO: 45321 - DNA, 25 bp, E. coli
cacggcgatttcgagacagtcgtcg

SEQ ID NO: 45322 - DNA, 25 bp, E. coli
cacctttcaacacggcgatttccag

SEQ ID NO: 45323 - DNA, 25 bp, E. coli
cacctttcaacagggcgatttccag

SEQ ID NO: 45324 - DNA, 25 bp, E. coli
cacggcgatttccagacagtcgtcg

SEQ ID NO: 45325 - DNA, 25 bp, E. coli
caacacggcgatttccagacagtcg

SEQ ID NO: 45326 - DNA, 25 bp, E. coli
caacacggcgatatccagacagtcg

SEQ ID NO: 45327 - DNA, 25 bp, E. coli
catgtcacctttgaacacggcgatt

SEQ ID NO: 45328 - DNA, 25 bp, E. coli
catgtcacctttcaacacggcgatt

SEQ ID NO: 45329 - DNA, 25 bp, E. coli
aacacggcgattaccagacagtcgt

SEQ ID NO: 45330 - DNA, 25 bp, E. coli
aacacggcgatttccagacagtcgt

SEQ ID NO: 45331 - DNA, 25 bp, E. coli
tttcaacacggcgatttccagacag

SEQ ID NO: 45332 - DNA, 25 bp, E. coli
tttcaacacggccatttccagacag

SEQ ID NO: 45333 - DNA, 25 bp, E. coli
tgtcacctttcaacacggcgatttc

SEQ ID NO: 45334 - DNA, 25 bp, E. coli
tgtcacctttcatcacggcgatttc

SEQ ID NO: 45335 - DNA, 25 bp, E. coli
ccatgtcaccttacaacacggcgat

SEQ ID NO: 45336 - DNA, 25 bp, E. coli
ccatgtcacctttcaacacggcgat

SEQ ID NO: 45337 - DNA, 25 bp, E. coli
cggcgatttccacacagtcgtcgtg

SEQ ID NO: 45338 - DNA, 25 bp, E. coli
cgtcatcggcaaaatgctgcacgtc

SEQ ID NO: 45339 - DNA, 25 bp, E. coli
cggcgatttccagacagtcgtcgtg

SEQ ID NO: 45340 - DNA, 25 bp, E. coli
cgtcatcggcaatatgctgcacgtc

SEQ ID NO: 45341 - DNA, 25 bp, E. coli
tcaacacggcgatttccagacagtc

SEQ ID NO: 45342 - DNA, 25 bp, E. coli
tcaacacggcgaattccagacagtc

SEQ ID NO: 45343 - DNA, 25 bp, E. coli
cagattatggtgtagaaggtccgcc

SEQ ID NO: 45344 - DNA, 25 bp, E. coli
cagattatggtgaagaaggtccgcc

SEQ ID NO: 45345 - DNA, 25 bp, E. coli
tacttgtggctgtactggatgcatc

SEQ ID NO: 45346 - DNA, 25 bp, E. coli
tacttgtggctgaactggatgcatc

SEQ ID NO: 45347 - DNA, 25 bp, E. coli
agtacaccgtttcactgcgcatggg

SEQ ID NO: 45348 - DNA, 25 bp, E. coli
agtacaccgtttgactgcgcatggg

SEQ ID NO: 45349 - DNA, 25 bp, E. coli
tatgcatggccggaagtgaatcgtc

SEQ ID NO: 45350 - DNA, 25 bp, E. coli
tatgcatggccgcaagtgaatcgtc

SEQ ID NO: 45351 - DNA, 25 bp, E. coli
tatcagggtgaaatctccggcgcct

SEQ ID NO: 45352 - DNA, 25 bp, E. coli
tatcagggtgaattctccggcgcct

SEQ ID NO: 45353 - DNA, 25 bp, E. coli
tactccgggaacagcggtacaactg

SEQ ID NO: 45354 - DNA, 25 bp, E. coli
tgccgccgccagagaatatgacagg

SEQ ID NO: 45355 - DNA, 25 bp, E. coli
tgccgccgccagtgaatatgacagg

SEQ ID NO: 45356 - DNA, 25 bp, E. coli
tactccgggaactgcggtacaactg

SEQ ID NO: 45357 - DNA, 25 bp, E. coli
gaatgccagtataaaacgtcgccgg

SEQ ID NO: 45358 - DNA, 25 bp, E. coli
gaatgccagtattaaacgtcgccgg

SEQ ID NO: 45359 - DNA, 25 bp, E. coli
tcaatgcaggcgagtctgagcaggc

SEQ ID NO: 45360 - DNA, 25 bp, E. coli
tcaatgcaggcgtgtctgagcaggc

SEQ ID NO: 45361 - DNA, 25 bp, E. coli
gacgatttctggattgcatggccgg

SEQ ID NO: 45362 - DNA, 25 bp, E. coli
gatgcaaacggttatgtcgcgctgg

SEQ ID NO: 45363 - DNA, 25 bp, E. coli
gacgatttctggtttgcatggccgg

SEQ ID NO: 45364 - DNA, 25 bp, E. coli
gatgcaaacggtaatgtcgcgctgg

SEQ ID NO: 45365 - DNA, 25 bp, E. coli
caatgggaaatgacgatagaatcac

SEQ ID NO: 45366 - DNA, 25 bp, E. coli
caatgggaaatgtcgatagaatcac

SEQ ID NO: 45367 - DNA, 25 bp, E. coli
caaagctctaagtaagttagcccag

SEQ ID NO: 45368 - DNA, 25 bp, E. coli
caaagctctaagaaagttagcccag

SEQ ID NO: 45369 - DNA, 25 bp, E. coli
caggatcaccgactatcccagttgg

SEQ ID NO: 45370 - DNA, 25 bp, E. coli
caggatcaccgagtatcccagttgg

SEQ ID NO: 45371 - DNA, 25 bp, E. coli
aactgggtaagctttcaggcgtgac

SEQ ID NO: 45372 - DNA, 25 bp, E. coli
aactgggtaagcattcaggcgtgac

SEQ ID NO: 45373 - DNA, 25 bp, E. coli
tagcccaggcattaggaactactga

SEQ ID NO: 45374 - DNA, 25 bp, E. coli
tagcccaggcataaggaactactga

SEQ ID NO: 45375 - DNA, 25 bp, E. coli
tgtacaaagtacgtcaggcaccaag

SEQ ID NO: 45376 - DNA, 25 bp, E. coli
tgtacaaagtacctcaggcaccaag

SEQ ID NO: 45377 - DNA, 25 bp, E. coli
tccggatccgcttaaaaatgaacca

SEQ ID NO: 45378 - DNA, 25 bp, E. coli
tccggatccgctaaaaaatgaacca

SEQ ID NO: 45379 - DNA, 25 bp, E. coli
gcatcgtcgctgaaatagttccgga

SEQ ID NO: 45380 - DNA, 25 bp, E. coli
gcatcgtcgctgtaatagttccgga

SEQ ID NO: 45381 - DNA, 25 bp, E. coli
gaaagatctaaacgaaccaggtagc

SEQ ID NO: 45382 - DNA, 25 bp, E. coli
gaaagatctaaaggaaccaggtagc

SEQ ID NO: 45383 - DNA, 25 bp, E. coli
gattttgccgtttcaatgcctgatg

SEQ ID NO: 45384 - DNA, 25 bp, E. coli
gattttgccgttacaatgcctgatg

SEQ ID NO: 45385 - DNA, 25 bp, E. coli
ggtgctactgtgttcctaaggccag

SEQ ID NO: 45386 - DNA, 25 bp, E. coli
ggtgctactgtgatcctaaggccag

SEQ ID NO: 45387 - DNA, 25 bp, E. coli
aatcactgggcgttcattcctgtca

SEQ ID NO: 45388 - DNA, 25 bp, E. coli
aatcactgggcgatcattcctgtca

SEQ ID NO: 45389 - DNA, 25 bp, E. coli
catcaaaatgaaaggcatcggcggc

SEQ ID NO: 45390 - DNA, 25 bp, E. coli
catgtaccatgggaaaagcaagctg

SEQ ID NO: 45391 - DNA, 25 bp, E. coli
catgtaccatggcaaaagcaagctg

SEQ ID NO: 45392 - DNA, 25 bp, E. coli
catcaaaatgaatggcatcggcggc

SEQ ID NO: 45393 - DNA, 25 bp, E. coli
tgaataaccttctgctggacctgcg

SEQ ID NO: 45394 - DNA, 25 bp, E. coli
tgaataaccttcagctggacctgcg

SEQ ID NO: 45395 - DNA, 25 bp, E. coli
tgaacatgtactgggtctgcctgca

SEQ ID NO: 45396 - DNA, 25 bp, E. coli
tgaacatgtactcggtctgcctgca

SEQ ID NO: 45397 - DNA, 25 bp, E. coli
tgacgccgcaggtttacataggaca

SEQ ID NO: 45398 - DNA, 25 bp, E. coli
tgacgccgcaggattacataggaca

SEQ ID NO: 45399 - DNA, 25 bp, E. coli
gaacgtaacgctctctatggcactg

SEQ ID NO: 45400 - DNA, 25 bp, E. coli
gaacgtaacgctgtctatggcactg

SEQ ID NO: 45401 - DNA, 25 bp, E. coli
cgtacattctcgctggtggatccac

SEQ ID NO: 45402 - DNA, 25 bp, E. coli
cgtacattctcggtggtggatccac

SEQ ID NO: 45403 - DNA, 25 bp, E. coli
ggatcctgaatgagccgtgggccat

SEQ ID NO: 45404 - DNA, 25 bp, E. coli
ggatcctgaatgtgccgtgggccat

SEQ ID NO: 45405 - DNA, 25 bp, E. coli
tcacgaaagagtagacgctgcagcc

SEQ ID NO: 45406 - DNA, 25 bp, E. coli
tcacgaaagagttgacgctgcagcc

SEQ ID NO: 45407 - DNA, 25 bp, E. coli
gacctgctgccgaacattgctgaac

SEQ ID NO: 45408 - DNA, 25 bp, E. coli
gacctgctgccgtacattgctgaac

SEQ ID NO: 45409 - DNA, 25 bp, E. coli
tagttcccggcgatgtgctgtacgt

SEQ ID NO: 45410 - DNA, 25 bp, E. coli
tatcaggtcgatattccacggctgg

SEQ ID NO: 45411 - DNA, 25 bp, E. coli
tatcaggtcgattttccacggctgg

SEQ ID NO: 45412 - DNA, 25 bp, E. coli
tagttcccggcgttgtgctgtacgt

SEQ ID NO: 45413 - DNA, 25 bp, E. coli
ttatatcgacgatcgctatgcctcc

SEQ ID NO: 45414 - DNA, 25 bp, E. coli
ttatatcgacgaacgctatgcctcc

SEQ ID NO: 45415 - DNA, 25 bp, E. coli
tgtttggcaaactgcaactcggctt

SEQ ID NO: 45416 - DNA, 25 bp, E. coli
tgtttggcaaacagcaactcggctt

SEQ ID NO: 45417 - DNA, 25 bp, E. coli
tgcggctttgtccacagcaactact

SEQ ID NO: 45418 - DNA, 25 bp, E. coli
tgcggctttgtcgacagcaactact

SEQ ID NO: 45419 - DNA, 25 bp, E. coli
tctcgcacctgtttcaaaaaacggg

SEQ ID NO: 45420 - DNA, 25 bp, E. coli
tctcgcacctgtatcaaaaaacggg

SEQ ID NO: 45421 - DNA, 25 bp, E. coli
cctgaaggtaaatgaagtggcgcac

SEQ ID NO: 45422 - DNA, 25 bp, E. coli
cctgaaggtaaaagaagtggcgcac

SEQ ID NO: 45423 - DNA, 25 bp, E. coli
gaatacctgaatcacacgcgactgg

SEQ ID NO: 45424 - DNA, 25 bp, E. coli
gaatacctgaatgacacgcgactgg

SEQ ID NO: 45425 - DNA, 25 bp, E. coli
cggtgcccgatcttgcgtatcaggt

SEQ ID NO: 45426 - DNA, 25 bp, E. coli
cggtgcccgatcatgcgtatcaggt

SEQ ID NO: 45427 - DNA, 25 bp, E. coli
ggaattttccactatggcaagcccc

SEQ ID NO: 45428 - DNA, 25 bp, E. coli
ggaattttccacaatggcaagcccc

SEQ ID NO: 45429 - DNA, 25 bp, E. coli
tcaaaatctggccaagcaacacgtc

SEQ ID NO: 45430 - DNA, 25 bp, E. coli
tcaaaatctggcgaagcaacacgtc

SEQ ID NO: 45431 - DNA, 25 bp, E. coli
cagccgttattctgcccatcactgg

SEQ ID NO: 45432 - DNA, 25 bp, E. coli
cactggcatgatcttggtgcagcac

SEQ ID NO: 45433 - DNA, 25 bp, E. coli
caacagagcgcatcgacagaggtga

SEQ ID NO: 45434 - DNA, 25 bp, E. coli
cagccgttattcagcccatcactgg

SEQ ID NO: 45435 - DNA, 25 bp, E. coli
caacagagcgcaacgacagaggtga

SEQ ID NO: 45436 - DNA, 25 bp, E. coli
cactggcatgatgttggtgcagcac

SEQ ID NO: 45437 - DNA, 25 bp, E. coli
cagtgcgcgacatctggttacagac

SEQ ID NO: 45438 - DNA, 25 bp, E. coli
cagtgcgcgacaactggttacagac

SEQ ID NO: 45439 - DNA, 25 bp, E. coli
tgctggatgtcgaggcacaagctgc

SEQ ID NO: 45440 - DNA, 25 bp, E. coli
tgctggatgtcgtggcacaagctgc

SEQ ID NO: 45441 - DNA, 25 bp, E. coli
gcgagaatgcgtacgccagaagcgt

SEQ ID NO: 45442 - DNA, 25 bp, E. coli
gcgagaatgcgttcgccagaagcgt

SEQ ID NO: 45443 - DNA, 25 bp, E. coli
cggtggtggcgtatgacttatctgc

SEQ ID NO: 45444 - DNA, 25 bp, E. coli
ctgaaaaatatcaccacccgccagg

SEQ ID NO: 45445 - DNA, 25 bp, E. coli
cggtggtggcgtttgacttatctgc

SEQ ID NO: 45446 - DNA, 25 bp, E. coli
ctgaaaaatatctccacccgccagg

SEQ ID NO: 45447 - DNA, 25 bp, E. coli
gattgtgatggaggtaatgtctccg

SEQ ID NO: 45448 - DNA, 25 bp, E. coli
gattgtgatggacgtaatgtctccg

SEQ ID NO: 45449 - DNA, 25 bp, E. coli
taattacagatatgttaccgctgga

SEQ ID NO: 45450 - DNA, 25 bp, E. coli
taattacagataagttaccgctgga

SEQ ID NO: 45451 - DNA, 25 bp, E. coli
gacgctattcgcatttaccaacaga

SEQ ID NO: 45452 - DNA, 25 bp, E. coli
gacgctattcgcttttaccaacaga

SEQ ID NO: 45453 - DNA, 25 bp, E. coli
aagtccgtttctacaagtctaacag

SEQ ID NO: 45454 - DNA, 25 bp, E. coli
caggtttccaacctagcaatcttca

SEQ ID NO: 45455 - DNA, 25 bp, E. coli
caggtttccaacgtagcaatcttca

SEQ ID NO: 45456 - DNA, 25 bp, E. coli
aagtccgtttcttcaagtctaacag

SEQ ID NO: 45457 - DNA, 25 bp, E. coli
tatcaacctggtaaagaaacatcag

SEQ ID NO: 45458 - DNA, 25 bp, E. coli
tatcaacctggttaagaaacatcag

SEQ ID NO: 45459 - DNA, 25 bp, E. coli
taagaaacatcagaagccggttccg

SEQ ID NO: 45460 - DNA, 25 bp, E. coli
taagaaacatcacaagccggttccg

SEQ ID NO: 45461 - DNA, 25 bp, E. coli
gctgaccgtgtaggctttagattcg

SEQ ID NO: 45462 - DNA, 25 bp, E. coli
gcatcgttgaaaaagaagccgctat

SEQ ID NO: 45463 - DNA, 25 bp, E. coli
gctgaccgtgtacgctttagattcg

SEQ ID NO: 45464 - DNA, 25 bp, E. coli
tcagaagccggtaccggccctgaac

SEQ ID NO: 45465 - DNA, 25 bp, E. coli
gaaccaaccgggtggcatcgttgaa

SEQ ID NO: 45466 - DNA, 25 bp, E. coli
gaagccgctattgaggtttccaacg

SEQ ID NO: 45467 - DNA, 25 bp, E. coli
gaagccgctattcaggtttccaacg

SEQ ID NO: 45468 - DNA, 25 bp, E. coli
tcagaagccggttccggccctgaac

SEQ ID NO: 45469 - DNA, 25 bp, E. coli
gcatcgttgaaatagaagccgctat

SEQ ID NO: 45470 - DNA, 25 bp, E. coli
gaaccaaccgggaggcatcgttgaa

SEQ ID NO: 45471 - DNA, 25 bp, E. coli
ccgtgtaggcttaagattcgaagac

SEQ ID NO: 45472 - DNA, 25 bp, E. coli
ccgtgtaggctttagattcgaagac

SEQ ID NO: 45473 - DNA, 25 bp, E. coli
gtctaacagcgaaactatcaagtaa

SEQ ID NO: 45474 - DNA, 25 bp, E. coli
gtctaacagcgatactatcaagtaa

SEQ ID NO: 45475 - DNA, 25 bp, E. coli
aatttctcgctagttttcctctaca

SEQ ID NO: 45476 - DNA, 25 bp, E. coli
aatttctcgctacttttcctctaca

SEQ ID NO: 45477 - DNA, 25 bp, E. coli
cacgcttgttacgactattagtgtg

SEQ ID NO: 45478 - DNA, 25 bp, E. coli
cacgcttgttaccactattagtgtg

SEQ ID NO: 45479 - DNA, 25 bp, E. coli
cactattagtgtgataggaacagcc

SEQ ID NO: 45480 - DNA, 25 bp, E. coli
cactattagtgtcataggaacagcc

SEQ ID NO: 45481 - DNA, 25 bp, E. coli
cataaccatgcacaatttctcgcta

SEQ ID NO: 45482 - DNA, 25 bp, E. coli
cataaccatgcagaatttctcgcta

SEQ ID NO: 45483 - DNA, 25 bp, E. coli
tattccgaaaattcctggcgagcag

SEQ ID NO: 45484 - DNA, 25 bp, E. coli
tatatatcgaattatgcaaaagcat

SEQ ID NO: 45485 - DNA, 25 bp, E. coli
ttgtttttcacgcttgttaccacta

SEQ ID NO: 45486 - DNA, 25 bp, E. coli
ttgtttttcacggttgttaccacta

SEQ ID NO: 45487 - DNA, 25 bp, E. coli
tatatatcgaataatgcaaaagcat

SEQ ID NO: 45488 - DNA, 25 bp, E. coli
tattccgaaaatacctggcgagcag

SEQ ID NO: 45489 - DNA, 25 bp, E. coli
tgttcttatcaatatatctaactca

SEQ ID NO: 45490 - DNA, 25 bp, E. coli
tgttcttatcaaaatatctaactca

SEQ ID NO: 45491 - DNA, 25 bp, E. coli
tgcaaaagcatatttattccgaaaa

SEQ ID NO: 45492 - DNA, 25 bp, E. coli
tgcaaaagcataattattccgaaaa

SEQ ID NO: 45493 - DNA, 25 bp, E. coli
cctctacaccgtgtttatatatcga

SEQ ID NO: 45494 - DNA, 25 bp, E. coli
cctggcgagcagttaaataagaatt

SEQ ID NO: 45495 - DNA, 25 bp, E. coli
cctggcgagcagataaataagaatt

SEQ ID NO: 45496 - DNA, 25 bp, E. coli
cctctacaccgtctttatatatcga

SEQ ID NO: 45497 - DNA, 25 bp, E. coli
caatggagctgatggaacaactggc

SEQ ID NO: 45498 - DNA, 25 bp, E. coli
caatggagctgaaggaacaactggc

SEQ ID NO: 45499 - DNA, 25 bp, E. coli
tactggtggcgtagatcctgactcc

SEQ ID NO: 45500 - DNA, 25 bp, E. coli
tactggtggcgttgatcctgactcc

SEQ ID NO: 45501 - DNA, 25 bp, E. coli
aaacggtctggatgataccccgcag

SEQ ID NO: 45502 - DNA, 25 bp, E. coli
aaacggtctggaagataccccgcag

SEQ ID NO: 45503 - DNA, 25 bp, E. coli
tatgtgaacgactttatcgaccgcg

SEQ ID NO: 45504 - DNA, 25 bp, E. coli
tatgtgaacgacattatcgaccgcg

SEQ ID NO: 45505 - DNA, 25 bp, E. coli
tgtgccaccatgctgaaaccgattg

SEQ ID NO: 45506 - DNA, 25 bp, E. coli
tgtgccaccatggtgaaaccgattg

SEQ ID NO: 45507 - DNA, 25 bp, E. coli
tgaacaaattccagctaacgccggt

SEQ ID NO: 45508 - DNA, 25 bp, E. coli
tgaacaaattcctgctaacgccggt

SEQ ID NO: 45509 - DNA, 25 bp, E. coli
tgctgaactggcgaagatggaaccg

SEQ ID NO: 45510 - DNA, 25 bp, E. coli
tgctgaactggccaagatggaaccg

SEQ ID NO: 45511 - DNA, 25 bp, E. coli
gacattaacaccactctgggcgctg

SEQ ID NO: 45512 - DNA, 25 bp, E. coli
gacatcatcgcagagtttaacggcc

SEQ ID NO: 45513 - DNA, 25 bp, E. coli
gacatcatcgcacagtttaacggcc

SEQ ID NO: 45514 - DNA, 25 bp, E. coli
gacattaacacctctctgggcgctg

SEQ ID NO: 45515 - DNA, 25 bp, E. coli
gaacaaactgcagctggcgatgccg

SEQ ID NO: 45516 - DNA, 25 bp, E. coli
gaacaaactgcacctggcgatgccg

SEQ ID NO: 45517 - DNA, 25 bp, E. coli
taaccgcatgttggagaagagcacg

SEQ ID NO: 45518 - DNA, 25 bp, E. coli
taaccgcatgttcgagaagagcacg

SEQ ID NO: 45519 - DNA, 25 bp, E. coli
aatcggcctcgtggcagcgattcct

SEQ ID NO: 45520 - DNA, 25 bp, E. coli
aatcggcctcgtcgcagcgattcct

SEQ ID NO: 45521 - DNA, 25 bp, E. coli
atcggcctcgtgccagcgattcctg

SEQ ID NO: 45522 - DNA, 25 bp, E. coli
atctataacgtatttgcacgccaga

SEQ ID NO: 45523 - DNA, 25 bp, E. coli
atcggcctcgtggcagcgattcctg

SEQ ID NO: 45524 - DNA, 25 bp, E. coli
atctataacgtaattgcacgccaga

SEQ ID NO: 45525 - DNA, 25 bp, E. coli
tatctataacgtttttgcacgccag

SEQ ID NO: 45526 - DNA, 25 bp, E. coli
tatctataacgtatttgcacgccag

SEQ ID NO: 45527 - DNA, 25 bp, E. coli
tataacgtatttgcacgccagattg

SEQ ID NO: 45528 - DNA, 25 bp, E. coli
tataacgtatttccacgccagattg

SEQ ID NO: 45529 - DNA, 25 bp, E. coli
tcggcctcgtggcagcgattcctgc

SEQ ID NO: 45530 - DNA, 25 bp, E. coli
tcggcctcgtgggagcgattcctgc

SEQ ID NO: 45531 - DNA, 25 bp, E. coli
tctataacgtatttgcacgccagat

SEQ ID NO: 45532 - DNA, 25 bp, E. coli
tctataacgtatatgcacgccagat

SEQ ID NO: 45533 - DNA, 25 bp, E. coli
cctcgtggcagcgattcctgcggtc

SEQ ID NO: 45534 - DNA, 25 bp, E. coli
cctcgtggcagccattcctgcggtc

SEQ ID NO: 45535 - DNA, 25 bp, E. coli
ctataacgtatttgcacgccagatt

SEQ ID NO: 45536 - DNA, 25 bp, E. coli
cggcctcgtggcagcgattcctgcg

SEQ ID NO: 45537 - DNA, 25 bp, E. coli
ctataacgtattagcacgccagatt

SEQ ID NO: 45538 - DNA, 25 bp, E. coli
cggcctcgtggctgcgattcctgcg

SEQ ID NO: 45539 - DNA, 25 bp, E. coli
ggcctcgtggcagcgattcctgcgg

SEQ ID NO: 45540 - DNA, 25 bp, E. coli
ggcctcgtggcaccgattcctgcgg

SEQ ID NO: 45541 - DNA, 25 bp, E. coli
cactgtctgcggtggcttcttctga

SEQ ID NO: 45542 - DNA, 25 bp, E. coli
cactgtctgcggaggcttcttctga

SEQ ID NO: 45543 - DNA, 25 bp, E. coli
ttttgaagaagcagccgctttcgcg

SEQ ID NO: 45544 - DNA, 25 bp, E. coli
ttttgaagaagctgccgctttcgcg

SEQ ID NO: 45545 - DNA, 25 bp, E. coli
tgttttcgccgctttcctggacgat

SEQ ID NO: 45546 - DNA, 25 bp, E. coli
tgttttcgccgcattcctggacgat

SEQ ID NO: 45547 - DNA, 25 bp, E. coli
gctttcgcgctgatacctgcattcg

SEQ ID NO: 45548 - DNA, 25 bp, E. coli
gctttcgcgctgttacctgcattcg

SEQ ID NO: 45549 - DNA, 25 bp, E. coli
gactccggcattttcagcggctgac

SEQ ID NO: 45550 - DNA, 25 bp, E. coli
gactccggcattatcagcggctgac

SEQ ID NO: 45551 - DNA, 25 bp, E. coli
cgctgttgctgcgttttgtgcggct

SEQ ID NO: 45552 - DNA, 25 bp, E. coli
cgctgttgctgccttttgtgcggct

SEQ ID NO: 45553 - DNA, 25 bp, E. coli
gtctctgaacgttctgccgctgttg

SEQ ID NO: 45554 - DNA, 25 bp, E. coli
gggaagcctcttcactgtctgcgga

SEQ ID NO: 45555 - DNA, 25 bp, E. coli
gggaagcctcttgactgtctgcgga

SEQ ID NO: 45556 - DNA, 25 bp, E. coli
gtctctgaacgtactgccgctgttg

SEQ ID NO: 45557 - DNA, 25 bp, E. coli
ggacgatgccgctgctgtttctgat

SEQ ID NO: 45558 - DNA, 25 bp, E. coli
ggacgatgccgcagctgtttctgat

SEQ ID NO: 45559 - DNA, 25 bp, E. coli
ggctgactctgctttacggcgggaa

SEQ ID NO: 45560 - DNA, 25 bp, E. coli
ggctgactctgcattacggcgggaa

SEQ ID NO: 45561 - DNA, 25 bp, E. coli
gacgcacgggcaattgtctctgaac

SEQ ID NO: 45562 - DNA, 25 bp, E. coli
gacgcacgggcatttgtctctgaac

SEQ ID NO: 45563 - DNA, 25 bp, E. coli
attacttggtaatgccccggctcca

SEQ ID NO: 45564 - DNA, 25 bp, E. coli
attacttggtaaagccccggctcca

SEQ ID NO: 45565 - DNA, 25 bp, E. coli
atgatggcagggttatatcgctgca

SEQ ID NO: 45566 - DNA, 25 bp, E. coli
atgatggcagggatatatcgctgca

SEQ ID NO: 45567 - DNA, 25 bp, E. coli
ttgatgcgaaacaggtttacgacga

SEQ ID NO: 45568 - DNA, 25 bp, E. coli
ttgatgcgaaactggtttacgacga

SEQ ID NO: 45569 - DNA, 25 bp, E. coli
ttgctttccgagactgttcctggcg

SEQ ID NO: 45570 - DNA, 25 bp, E. coli
ttccgagtctgttcctggcgtgtgg

SEQ ID NO: 45571 - DNA, 25 bp, E. coli
ttgctttccgagtctgttcctggcg

SEQ ID NO: 45572 - DNA, 25 bp, E. coli
ttccgagtctgtacctggcgtgtgg

SEQ ID NO: 45573 - DNA, 25 bp, E. coli
tgttacgtcttgttgcgaaactggt

SEQ ID NO: 45574 - DNA, 25 bp, E. coli
ttttaccgacctcatgcgtttttgc

SEQ ID NO: 45575 - DNA, 25 bp, E. coli
ttttaccgacctgatgcgtttttgc

SEQ ID NO: 45576 - DNA, 25 bp, E. coli
tgttacgtcttgatgcgaaactggt

SEQ ID NO: 45577 - DNA, 25 bp, E. coli
gctggcctcacggattacttggtaa

SEQ ID NO: 45578 - DNA, 25 bp, E. coli
gctggcctcacgcattacttggtaa

SEQ ID NO: 45579 - DNA, 25 bp, E. coli
gcagggatatatggctgcattttgc

SEQ ID NO: 45580 - DNA, 25 bp, E. coli
gcagggatatatcgctgcattttgc

SEQ ID NO: 45581 - DNA, 25 bp, E. coli
gtcttcgttttaccgacctgatgcg

SEQ ID NO: 45582 - DNA, 25 bp, E. coli
gtcttcgttttagcgacctgatgcg

SEQ ID NO: 45583 - DNA, 25 bp, E. coli
tggtggtggttcaggcgctggtggc

SEQ ID NO: 45584 - DNA, 25 bp, E. coli
tggtggtggttctggcgctggtggc

SEQ ID NO: 45585 - DNA, 25 bp, E. coli
caaaactggacgtgcgcgatgtgct

SEQ ID NO: 45586 - DNA, 25 bp, E. coli
caaaactggacgagcgcgatgtgct

SEQ ID NO: 45587 - DNA, 25 bp, E. coli
agattcccttctaacctggcaccag

SEQ ID NO: 45588 - DNA, 25 bp, E. coli
agattcccttcttacctggcaccag

SEQ ID NO: 45589 - DNA, 25 bp, E. coli
tgatgaatacggacaacgcttggga

SEQ ID NO: 45590 - DNA, 25 bp, E. coli
tgatgaatacggtcaacgcttggga

SEQ ID NO: 45591 - DNA, 25 bp, E. coli
cctttcccggtttgatgtattgatc

SEQ ID NO: 45592 - DNA, 25 bp, E. coli
gccgctggtggcatttgatgaatac

SEQ ID NO: 45593 - DNA, 25 bp, E. coli
cctttcccggttagatgtattgatc

SEQ ID NO: 45594 - DNA, 25 bp, E. coli
gccgctggtggcttttgatgaatac

SEQ ID NO: 45595 - DNA, 25 bp, E. coli
gcgcatgattgccagttagtagaaa

SEQ ID NO: 45596 - DNA, 25 bp, E. coli
gcgcatgattgcgagttagtagaaa

SEQ ID NO: 45597 - DNA, 25 bp, E. coli
gaagatccacgacccaaaactggac

SEQ ID NO: 45598 - DNA, 25 bp, E. coli
gaagatccacgagccaaaactggac

SEQ ID NO: 45599 - DNA, 25 bp, E. coli
gaaatgggatataccactgcctgcg

SEQ ID NO: 45600 - DNA, 25 bp, E. coli
gaaatgggatattccactgcctgcg

SEQ ID NO: 45601 - DNA, 25 bp, E. coli
gttagtagaaaaactcccagtggag

SEQ ID NO: 45602 - DNA, 25 bp, E. coli
gttagtagaaaatctcccagtggag

SEQ ID NO: 45603 - DNA, 25 bp, E. coli
gatgtattgatcacgccgctggtgg

SEQ ID NO: 45604 - DNA, 25 bp, E. coli
gatgtattgatctcgccgctggtgg

SEQ ID NO: 45605 - DNA, 25 bp, E. coli
gatgtgcttcccgtttcccggttag

SEQ ID NO: 45606 - DNA, 25 bp, E. coli
gatgtgcttcccctttcccggttag

SEQ ID NO: 45607 - DNA, 25 bp, E. coli
aattttacatttgtcacctgtctca

SEQ ID NO: 45608 - DNA, 25 bp, E. coli
aattttacatttctcacctgtctca

SEQ ID NO: 45609 - DNA, 25 bp, E. coli
cacctgtctcaaaggagtcttttga

SEQ ID NO: 45610 - DNA, 25 bp, E. coli
cacctgtctcaatggagtcttttga

SEQ ID NO: 45611 - DNA, 25 bp, E. coli
catttgtcacctctctcaaaggagt

SEQ ID NO: 45612 - DNA, 25 bp, E. coli
catttgtcacctgtctcaaaggagt

SEQ ID NO: 45613 - DNA, 25 bp, E. coli
acatttgtcacctgtctcaaaggag

SEQ ID NO: 45614 - DNA, 25 bp, E. coli
acatttgtcaccagtctcaaaggag

SEQ ID NO: 45615 - DNA, 25 bp, E. coli
ttacatttgtcacctgtctcaaagg

SEQ ID NO: 45616 - DNA, 25 bp, E. coli
ttacatttgtcagctgtctcaaagg

SEQ ID NO: 45617 - DNA, 25 bp, E. coli
tttgtcacctgtctcaaaggagtct

SEQ ID NO: 45618 - DNA, 25 bp, E. coli
tttgtcacctgtgtcaaaggagtct

SEQ ID NO: 45619 - DNA, 25 bp, E. coli
tgtcacctgtctcaaaggagtcttt

SEQ ID NO: 45620 - DNA, 25 bp, E. coli
tgtcacctgtctgaaaggagtcttt

SEQ ID NO: 45621 - DNA, 25 bp, E. coli
tcacctgtctcataggagtcttttg

SEQ ID NO: 45622 - DNA, 25 bp, E. coli
tcacctgtctcaaaggagtcttttg

SEQ ID NO: 45623 - DNA, 25 bp, E. coli
cctgtctcaaagcagtcttttgact

SEQ ID NO: 45624 - DNA, 25 bp, E. coli
cctgtctcaaaggagtcttttgact

SEQ ID NO: 45625 - DNA, 25 bp, E. coli
tgtctcaaaggactcttttgactcc

SEQ ID NO: 45626 - DNA, 25 bp, E. coli
tgtctcaaaggagtcttttgactcc

SEQ ID NO: 45627 - DNA, 25 bp, E. coli
ggcaattttacaattgtcacctgtc

SEQ ID NO: 45628 - DNA, 25 bp, E. coli
ggcaattttacatttgtcacctgtc

SEQ ID NO: 45629 - DNA, 25 bp, E. coli
caagaagccttgtaacagttcgtcg

SEQ ID NO: 45630 - DNA, 25 bp, E. coli
caagaagccttgaaacagttcgtcg

SEQ ID NO: 45631 - DNA, 25 bp, E. coli
cacgaatcagcggtaaaggttgact

SEQ ID NO: 45632 - DNA, 25 bp, E. coli
cacgaatcagcgctaaaggttgact

SEQ ID NO: 45633 - DNA, 25 bp, E. coli
tacttgacacttgaggagtggaacg

SEQ ID NO: 45634 - DNA, 25 bp, E. coli
taaaggttgactaaaatcgaccagt

SEQ ID NO: 45635 - DNA, 25 bp, E. coli
taaaggttgacttaaatcgaccagt

SEQ ID NO: 45636 - DNA, 25 bp, E. coli
tacttgacacttcaggagtggaacg

SEQ ID NO: 45637 - DNA, 25 bp, E. coli
acacttcaggagaggaacgcacgcc

SEQ ID NO: 45638 - DNA, 25 bp, E. coli
acacttcaggagtggaacgcacgcc

SEQ ID NO: 45639 - DNA, 25 bp, E. coli
ttcaggagtggatcgcacgccagcg

SEQ ID NO: 45640 - DNA, 25 bp, E. coli
ttcaggagtggaacgcacgccagcg

SEQ ID NO: 45641 - DNA, 25 bp, E. coli
gccttttgaagacgatcagaaatgg

SEQ ID NO: 45642 - DNA, 25 bp, E. coli
gccttttgaagaggatcagaaatgg

SEQ ID NO: 45643 - DNA, 25 bp, E. coli
cctccggttaagcatggaagagagt

SEQ ID NO: 45644 - DNA, 25 bp, E. coli
cctccggttaaggatggaagagagt

SEQ ID NO: 45645 - DNA, 25 bp, E. coli
gaagagagtatcagttccacgaatc

SEQ ID NO: 45646 - DNA, 25 bp, E. coli
gaagagagtatctgttccacgaatc

SEQ ID NO: 45647 - DNA, 25 bp, E. coli
tcagaaatgggatgaaggcgaagtc

SEQ ID NO: 45648 - DNA, 25 bp, E. coli
tcagaaatgggaagaaggcgaagtc

SEQ ID NO: 45649 - DNA, 25 bp, E. coli
gagtatctgttccacgaatcagcgg

SEQ ID NO: 45650 - DNA, 25 bp, E. coli
gagtatctgttcgacgaatcagcgg

SEQ ID NO: 45651 - DNA, 25 bp, E. coli
gaattgacggcgtaccgggtactgc

SEQ ID NO: 45652 - DNA, 25 bp, E. coli
gaattgacggcgaaccgggtactgc

SEQ ID NO: 45653 - DNA, 25 bp, E. coli
tattgatggcaaatatgggttccgg

SEQ ID NO: 45654 - DNA, 25 bp, E. coli
tattgatggcaattatgggttccgg

SEQ ID NO: 45655 - DNA, 25 bp, E. coli
tatcaatattgatcaccccagtggt

SEQ ID NO: 45656 - DNA, 25 bp, E. coli
tatcaatattgaacaccccagtggt

SEQ ID NO: 45657 - DNA, 25 bp, E. coli
ttattttgacgaagtcccggtgacc

SEQ ID NO: 45658 - DNA, 25 bp, E. coli
ttattttgacgatgtcccggtgacc

SEQ ID NO: 45659 - DNA, 25 bp, E. coli
tctacaagcgggtaaagcaatgggc

SEQ ID NO: 45660 - DNA, 25 bp, E. coli
tctacaagcgggaaaagcaatgggc

SEQ ID NO: 45661 - DNA, 25 bp, E. coli
ccggtgacctgtatcgatatggcga

SEQ ID NO: 45662 - DNA, 25 bp, E. coli
ccggtgacctgtttcgatatggcga

SEQ ID NO: 45663 - DNA, 25 bp, E. coli
gctgatgtgcaaacgccaaatggtg

SEQ ID NO: 45664 - DNA, 25 bp, E. coli
gctgatgtgcaatcgccaaatggtg

SEQ ID NO: 45665 - DNA, 25 bp, E. coli
cgagtacgagggaagcgccagaatt

SEQ ID NO: 45666 - DNA, 25 bp, E. coli
cgagtacgagggtagcgccagaatt

SEQ ID NO: 45667 - DNA, 25 bp, E. coli
gtgtcgataccacgcctaactgcgg

SEQ ID NO: 45668 - DNA, 25 bp, E. coli
gtgtcgataccaggcctaactgcgg

SEQ ID NO: 45669 - DNA, 25 bp, E. coli
taatgaaggtcacgatgccacgacg

SEQ ID NO: 45670 - DNA, 25 bp, E. coli
taatgaaggtcaggatgccacgacg

SEQ ID NO: 45671 - DNA, 25 bp, E. coli
gacgttacgcgcttctgttattcgg

SEQ ID NO: 45672 - DNA, 25 bp, E. coli
gacgttacgcgcatctgttattcgg

SEQ ID NO: 45673 - DNA, 25 bp, E. coli
caaatggtattgagcttactgcggc

SEQ ID NO: 45674 - DNA, 25 bp, E. coli
cacaaccggagaaaaccattcaggt

SEQ ID NO: 45675 - DNA, 25 bp, E. coli
cagccgccgctgtcggcaaatggta

SEQ ID NO: 45676 - DNA, 25 bp, E. coli
caaatggtattgtgcttactgcggc

SEQ ID NO: 45677 - DNA, 25 bp, E. coli
cagccgccgctgacggcaaatggta

SEQ ID NO: 45678 - DNA, 25 bp, E. coli
cacaaccggagataaccattcaggt

SEQ ID NO: 45679 - DNA, 25 bp, E. coli
tgttaaccactaacgtgacgccgac

SEQ ID NO: 45680 - DNA, 25 bp, E. coli
tgttaaccactatcgtgacgccgac

SEQ ID NO: 45681 - DNA, 25 bp, E. coli
tgaaatgggacgtaggccagcttct

SEQ ID NO: 45682 - DNA, 25 bp, E. coli
tgaaatgggacgaaggccagcttct

SEQ ID NO: 45683 - DNA, 25 bp, E. coli
tcagccgtgggcgatatatccagcc

SEQ ID NO: 45684 - DNA, 25 bp, E. coli
tcagccgtgggccatatatccagcc

SEQ ID NO: 45685 - DNA, 25 bp, E. coli
gctgctgtgttgttgagtctgcgtc

SEQ ID NO: 45686 - DNA, 25 bp, E. coli
gctgctgtgttgatgagtctgcgtc

SEQ ID NO: 45687 - DNA, 25 bp, E. coli
gcttactgcggctatttgctacgag

SEQ ID NO: 45688 - DNA, 25 bp, E. coli
gcttactgcggcaatttgctacgag

SEQ ID NO: 45689 - DNA, 25 bp, E. coli
gaaggccagcttgttaatacgctga

SEQ ID NO: 45690 - DNA, 25 bp, E. coli
gaaggccagcttcttaatacgctga

SEQ ID NO: 45691 - DNA, 25 bp, E. coli
gatctgccgatgacgtcgttcagcc

SEQ ID NO: 45692 - DNA, 25 bp, E. coli
gatctgccgatgtcgtcgttcagcc

SEQ ID NO: 45693 - DNA, 25 bp, E. coli
gagtctgcgtcaccgacgtaaataa

SEQ ID NO: 45694 - DNA, 25 bp, E. coli
gagtctgcgtcagcgacgtaaataa

SEQ ID NO: 45695 - DNA, 25 bp, E. coli
caagagcacgctaattcaccagggt

SEQ ID NO: 45696 - DNA, 25 bp, E. coli
caagagcacgcttattcaccagggt

SEQ ID NO: 45697 - DNA, 25 bp, E. coli
cacccggacggtttgcaaatcaaaa

SEQ ID NO: 45698 - DNA, 25 bp, E. coli
cacccggacggtatgcaaatcaaaa

SEQ ID NO: 45699 - DNA, 25 bp, E. coli
tagcgcatgggttcgtgcgaaaacc

SEQ ID NO: 45700 - DNA, 25 bp, E. coli
tagcgcatgggtacgtgcgaaaacc

SEQ ID NO: 45701 - DNA, 25 bp, E. coli
ttcagagaaagtcggcaacctggcg

SEQ ID NO: 45702 - DNA, 25 bp, E. coli
ttcagagaaagtgggcaacctggcg

SEQ ID NO: 45703 - DNA, 25 bp, E. coli
tgttctcgtgaaaccgtgggacgca

SEQ ID NO: 45704 - DNA, 25 bp, E. coli
tgtctgcacagaaggcgcgtcgtct

SEQ ID NO: 45705 - DNA, 25 bp, E. coli
tgttctcgtgaatccgtgggacgca

SEQ ID NO: 45706 - DNA, 25 bp, E. coli
tgtctgcacagatggcgcgtcgtct

SEQ ID NO: 45707 - DNA, 25 bp, E. coli
tcaccagggtgaaaaagcggaaacg

SEQ ID NO: 45708 - DNA, 25 bp, E. coli
tcataagtacccttccaagagcacg

SEQ ID NO: 45709 - DNA, 25 bp, E. coli
tcataagtacccatccaagagcacg

SEQ ID NO: 45710 - DNA, 25 bp, E. coli
gccaattgattcaggtaaacccgga

SEQ ID NO: 45711 - DNA, 25 bp, E. coli
gccaattgattctggtaaacccgga

SEQ ID NO: 45712 - DNA, 25 bp, E. coli
gaaaaccgcctgagaagtggctgaa

SEQ ID NO: 45713 - DNA, 25 bp, E. coli
gaaaaccgcctgtgaagtggctgaa

SEQ ID NO: 45714 - DNA, 25 bp, E. coli
ggtgcttggcaatccgcaaacagac

SEQ ID NO: 45715 - DNA, 25 bp, E. coli
ggtgcttggcaaaccgcaaacagac

SEQ ID NO: 45716 - DNA, 25 bp, E. coli
tcaccagggtgataaagcggaaacg

SEQ ID NO: 45717 - DNA, 25 bp, E. coli
cactgtggcatttgttgtcagaacc

SEQ ID NO: 45718 - DNA, 25 bp, E. coli
cactgtggcattagttgtcagaacc

SEQ ID NO: 45719 - DNA, 25 bp, E. coli
cagaaccgtggttatgtgcgctgat

SEQ ID NO: 45720 - DNA, 25 bp, E. coli
cagaaccgtggtaatgtgcgctgat

SEQ ID NO: 45721 - DNA, 25 bp, E. coli
aacggcctgctgacgctgatgatgc

SEQ ID NO: 45722 - DNA, 25 bp, E. coli
aaaagatacgctcgcgatcctgctg

SEQ ID NO: 45723 - DNA, 25 bp, E. coli
aacggcctgctgtcgctgatgatgc

SEQ ID NO: 45724 - DNA, 25 bp, E. coli
aaaagatacgctggcgatcctgctg

SEQ ID NO: 45725 - DNA, 25 bp, E. coli
tcttattccaacgaagtggtgctgg

SEQ ID NO: 45726 - DNA, 25 bp, E. coli
tcttattccaaccaagtggtgctgg

SEQ ID NO: 45727 - DNA, 25 bp, E. coli
tcatcctgacgcagaaaacgccggt

SEQ ID NO: 45728 - DNA, 25 bp, E. coli
tcatcctgacgctgaaaacgccggt

SEQ ID NO: 45729 - DNA, 25 bp, E. coli
ccgctgctggtgcagatcttcctga

SEQ ID NO: 45730 - DNA, 25 bp, E. coli
ccctgggaatgagcaaaaaagatac

SEQ ID NO: 45731 - DNA, 25 bp, E. coli
ccgctgctggtggagatcttcctga

SEQ ID NO: 45732 - DNA, 25 bp, E. coli
ccctgggaatgaccaaaaaagatac

SEQ ID NO: 45733 - DNA, 25 bp, E. coli
ggcagtcctgtagcgccctgggaat

SEQ ID NO: 45734 - DNA, 25 bp, E. coli
ggcagtcctgtaccgccctgggaat

SEQ ID NO: 45735 - DNA, 25 bp, E. coli
taaccgttgcctggctgattgtggc

SEQ ID NO: 45736 - DNA, 25 bp, E. coli
taaccgttgcctcgctgattgtggc

SEQ ID NO: 45737 - DNA, 25 bp, E. coli
gagtatttacccgaactgatgaaag

SEQ ID NO: 45738 - DNA, 25 bp, E. coli
gagtatttaccccaactgatgaaag

SEQ ID NO: 45739 - DNA, 25 bp, E. coli
aattactgttaggttacctgatagg

SEQ ID NO: 45740 - DNA, 25 bp, E. coli
aagtctcatgatacgtaaatccgac

SEQ ID NO: 45741 - DNA, 25 bp, E. coli
aagtctcatgattcgtaaatccgac

SEQ ID NO: 45742 - DNA, 25 bp, E. coli
aattactgttagcttacctgatagg

SEQ ID NO: 45743 - DNA, 25 bp, E. coli
caggtttaacctcgccgcttagtct

SEQ ID NO: 45744 - DNA, 25 bp, E. coli
caggtttaacctggccgcttagtct

SEQ ID NO: 45745 - DNA, 25 bp, E. coli
ggccgcttagtcacattccttccat

SEQ ID NO: 45746 - DNA, 25 bp, E. coli
acctgataggtcaggttgtgacatc

SEQ ID NO: 45747 - DNA, 25 bp, E. coli
ggccgcttagtctcattccttccat

SEQ ID NO: 45748 - DNA, 25 bp, E. coli
acctgataggtctggttgtgacatc

SEQ ID NO: 45749 - DNA, 25 bp, E. coli
acatatcggttgattgctgcaataa

SEQ ID NO: 45750 - DNA, 25 bp, E. coli
acatatcggttgtttgctgcaataa

SEQ ID NO: 45751 - DNA, 25 bp, E. coli
tgctgcaataattacaggtttaacc

SEQ ID NO: 45752 - DNA, 25 bp, E. coli
tgctgcaataataacaggtttaacc

SEQ ID NO: 45753 - DNA, 25 bp, E. coli
tctggttgtgacatcgactttaata

SEQ ID NO: 45754 - DNA, 25 bp, E. coli
tctggttgtgacttcgactttaata

SEQ ID NO: 45755 - DNA, 25 bp, E. coli
tctcggaagaaatagtaacatatcg

SEQ ID NO: 45756 - DNA, 25 bp, E. coli
tctcggaagaaaaagtaacatatcg

SEQ ID NO: 45757 - DNA, 25 bp, E. coli
gactttaatatttatcttctcggaa

SEQ ID NO: 45758 - DNA, 25 bp, E. coli
gactttaatattaatcttctcggaa

SEQ ID NO: 45759 - DNA, 25 bp, E. coli
cattccttccataataagtctcatg

SEQ ID NO: 45760 - DNA, 25 bp, E. coli
cattccttccattataagtctcatg

SEQ ID NO: 45761 - DNA, 25 bp, E. coli
caatgaacagagtatggaaacccgc

SEQ ID NO: 45762 - DNA, 25 bp, E. coli
caatgaacagagaatggaaacccgc

SEQ ID NO: 45763 - DNA, 25 bp, E. coli
cacggtgccggattctttatgggac

SEQ ID NO: 45764 - DNA, 25 bp, E. coli
cacggtgccggaatctttatgggac

SEQ ID NO: 45765 - DNA, 25 bp, E. coli
taacgatgttcgtaaaaggccagga

SEQ ID NO: 45766 - DNA, 25 bp, E. coli
tacggaattacagtacctggagcca

SEQ ID NO: 45767 - DNA, 25 bp, E. coli
tacggaattacactacctggagcca

SEQ ID NO: 45768 - DNA, 25 bp, E. coli
tacctcaacttacgcagcgggctga

SEQ ID NO: 45769 - DNA, 25 bp, E. coli
tacctcaacttaggcagcgggctga

SEQ ID NO: 45770 - DNA, 25 bp, E. coli
ttaaagaggccagagaagcacagcg

SEQ ID NO: 45771 - DNA, 25 bp, E. coli
ttaaagaggccacagaagcacagcg

SEQ ID NO: 45772 - DNA, 25 bp, E. coli
tgtgggccagcatgtcgatttaacg

SEQ ID NO: 45773 - DNA, 25 bp, E. coli
tgtgggccagcaagtcgatttaacg

SEQ ID NO: 45774 - DNA, 25 bp, E. coli
tctgatgaagagatgctgcccgaca

SEQ ID NO: 45775 - DNA, 25 bp, E. coli
tctgatgaagagttgctgcccgaca

SEQ ID NO: 45776 - DNA, 25 bp, E. coli
gaagcctgcgtagcgtttgacgaaa

SEQ ID NO: 45777 - DNA, 25 bp, E. coli
gaagcctgcgtaccgtttgacgaaa

SEQ ID NO: 45778 - DNA, 25 bp, E. coli
gaaggtatccctccgttgctgctgg

SEQ ID NO: 45779 - DNA, 25 bp, E. coli
gaaggtatccctgcgttgctgctgg

SEQ ID NO: 45780 - DNA, 25 bp, E. coli
ggtattaagtttgcctcaggcggcg

SEQ ID NO: 45781 - DNA, 25 bp, E. coli
ggtattaagtttccctcaggcggcg

SEQ ID NO: 45782 - DNA, 25 bp, E. coli
taacgatgttcgaaaaaggccagga

SEQ ID NO: 45783 - DNA, 25 bp, E. coli
caggaagacctgaacgctgaagtgc

SEQ ID NO: 45784 - DNA, 25 bp, E. coli
caggaagacctgtacgctgaagtgc

SEQ ID NO: 45785 - DNA, 25 bp, E. coli
cactgcggaatagaggcatatgcct

SEQ ID NO: 45786 - DNA, 25 bp, E. coli
cactgcggaatacaggcatatgcct

SEQ ID NO: 45787 - DNA, 25 bp, E. coli
caagggttaacagagaatgagcact

SEQ ID NO: 45788 - DNA, 25 bp, E. coli
caagggttaacacagaatgagcact

SEQ ID NO: 45789 - DNA, 25 bp, E. coli
tgtaatacagagagtcaggaagacc

SEQ ID NO: 45790 - DNA, 25 bp, E. coli
tgtaatacagagtgtcaggaagacc

SEQ ID NO: 45791 - DNA, 25 bp, E. coli
tcaggtggctgaaaatacaagggtt

SEQ ID NO: 45792 - DNA, 25 bp, E. coli
tctatccaggaattacggttgaact

SEQ ID NO: 45793 - DNA, 25 bp, E. coli
tcaggtggctgataatacaagggtt

SEQ ID NO: 45794 - DNA, 25 bp, E. coli
tctatccaggaaatacggttgaact

SEQ ID NO: 45795 - DNA, 25 bp, E. coli
gctgaagtgcccttagtcggtagac

SEQ ID NO: 45796 - DNA, 25 bp, E. coli
gctgaagtgcccatagtcggtagac

SEQ ID NO: 45797 - DNA, 25 bp, E. coli
gaaacccttaccagtcaggtggctg

SEQ ID NO: 45798 - DNA, 25 bp, E. coli
gaaatcgatcgtcccggaaaaaagc

SEQ ID NO: 45799 - DNA, 25 bp, E. coli
gaaagtcgaagctattgcgatgagc

SEQ ID NO: 45800 - DNA, 25 bp, E. coli
gaaacccttacctgtcaggtggctg

SEQ ID NO: 45801 - DNA, 25 bp, E. coli
gaaagtcgaagcaattgcgatgagc

SEQ ID NO: 45802 - DNA, 25 bp, E. coli
gaaatcgatcgtgccggaaaaaagc

SEQ ID NO: 45803 - DNA, 25 bp, E. coli
gtcggtagactaacgggcattgaag

SEQ ID NO: 45804 - DNA, 25 bp, E. coli
gtcggtagactatcgggcattgaag

SEQ ID NO: 45805 - DNA, 25 bp, E. coli
caaaactcatctgcctgcggcgggt

SEQ ID NO: 45806 - DNA, 25 bp, E. coli
caaaactcatctccctgcggcgggt

SEQ ID NO: 45807 - DNA, 25 bp, E. coli
atagcgttggttaatgagcatagcc

SEQ ID NO: 45808 - DNA, 25 bp, E. coli
atagcgttggtttatgagcatagcc

SEQ ID NO: 45809 - DNA, 25 bp, E. coli
actcatctgcctgcggcgggtgttc

SEQ ID NO: 45810 - DNA, 25 bp, E. coli
actcatctgcctccggcgggtgttc

SEQ ID NO: 45811 - DNA, 25 bp, E. coli
tggttaatgagcttagccacgctcc

SEQ ID NO: 45812 - DNA, 25 bp, E. coli
tgtaacgctcactaaactcatctgc

SEQ ID NO: 45813 - DNA, 25 bp, E. coli
tgttctggtcagtagtagatgttta

SEQ ID NO: 45814 - DNA, 25 bp, E. coli
tgttctggtcagaagtagatgttta

SEQ ID NO: 45815 - DNA, 25 bp, E. coli
tgtaacgctcacaaaactcatctgc

SEQ ID NO: 45816 - DNA, 25 bp, E. coli
tgaaaatcgtttatcaagtgttaga

SEQ ID NO: 45817 - DNA, 25 bp, E. coli
tgagcatagccaggctcctgtaacg

SEQ ID NO: 45818 - DNA, 25 bp, E. coli
tgagcatagccacgctcctgtaacg

SEQ ID NO: 45819 - DNA, 25 bp, E. coli
tgaaaatcgtttttcaagtgttaga

SEQ ID NO: 45820 - DNA, 25 bp, E. coli
gctcctgtaacggtcacaaaactca

SEQ ID NO: 45821 - DNA, 25 bp, E. coli
gctcacaaaactcatctgcctgcgg

SEQ ID NO: 45822 - DNA, 25 bp, E. coli
gctcctgtaacgctcacaaaactca

SEQ ID NO: 45823 - DNA, 25 bp, E. coli
gctcacaaaactgatctgcctgcgg

SEQ ID NO: 45824 - DNA, 25 bp, E. coli
gaaatttatatcacaatagcgttgg

SEQ ID NO: 45825 - DNA, 25 bp, E. coli
gaaatttatatctcaatagcgttgg

SEQ ID NO: 45826 - DNA, 25 bp, E. coli
tggttaatgagcatagccacgctcc

SEQ ID NO: 45827 - DNA, 25 bp, E. coli
aattgaagcactccaccgtcaggtc

SEQ ID NO: 45828 - DNA, 25 bp, E. coli
aattggcgcatcgagcgcaattgaa

SEQ ID NO: 45829 - DNA, 25 bp, E. coli
aattggcgcatccagcgcaattgaa

SEQ ID NO: 45830 - DNA, 25 bp, E. coli
aattgaagcactgcaccgtcaggtc

SEQ ID NO: 45831 - DNA, 25 bp, E. coli
caccgtcaggtcgtcagtggtctga

SEQ ID NO: 45832 - DNA, 25 bp, E. coli
caccgtcaggtcctcagtggtctga

SEQ ID NO: 45833 - DNA, 25 bp, E. coli
catactggcgatcgtcggtcactaa

SEQ ID NO: 45834 - DNA, 25 bp, E. coli
catactggcgatggtcggtcactaa

SEQ ID NO: 45835 - DNA, 25 bp, E. coli
tgcaccgtcaggtcgtcagtggtct

SEQ ID NO: 45836 - DNA, 25 bp, E. coli
tgcaccgtcaggacgtcagtggtct

SEQ ID NO: 45837 - DNA, 25 bp, E. coli
tcgtcggtcactaacggaagccacc

SEQ ID NO: 45838 - DNA, 25 bp, E. coli
tcgtcggtcacttacggaagccacc

SEQ ID NO: 45839 - DNA, 25 bp, E. coli
gcaattgaagcagtgcaccgtcagg

SEQ ID NO: 45840 - DNA, 25 bp, E. coli
gcaattgaagcactgcaccgtcagg

SEQ ID NO: 45841 - DNA, 25 bp, E. coli
cgcatcgagcgctattgaagcactg

SEQ ID NO: 45842 - DNA, 25 bp, E. coli
cgcatcgagcgcaattgaagcactg

SEQ ID NO: 45843 - DNA, 25 bp, E. coli
gatccgcatactcgcgatcgtcggt

SEQ ID NO: 45844 - DNA, 25 bp, E. coli
ggaagccaccttgcgtttactggaa

SEQ ID NO: 45845 - DNA, 25 bp, E. coli
ggaagccaccttccgtttactggaa

SEQ ID NO: 45846 - DNA, 25 bp, E. coli
gagcgcaattgatgcactgcaccgt

SEQ ID NO: 45847 - DNA, 25 bp, E. coli
gatccgcatactggcgatcgtcggt

SEQ ID NO: 45848 - DNA, 25 bp, E. coli
gagcgcaattgaagcactgcaccgt

SEQ ID NO: 45849 - DNA, 25 bp, E. coli
aatcaccaaagacggcgtccgcgtc

SEQ ID NO: 45850 - DNA, 25 bp, E. coli
aatcaccaaagagggcgtccgcgtc

SEQ ID NO: 45851 - DNA, 25 bp, E. coli
gccaccgtattagaaatcaccaaag

SEQ ID NO: 45852 - DNA, 25 bp, E. coli
gccaccgtattacaaatcaccaaag

SEQ ID NO: 45853 - DNA, 25 bp, E. coli
tgtgcgcgcagaacacctggtgttc

SEQ ID NO: 45854 - DNA, 25 bp, E. coli
tgtgcgcgcagatcacctggtgttc

SEQ ID NO: 45855 - DNA, 25 bp, E. coli
tgattgtgcgcgcagaacacctggt

SEQ ID NO: 45856 - DNA, 25 bp, E. coli
tgattgtgcgcggagaacacctggt

SEQ ID NO: 45857 - DNA, 25 bp, E. coli
tgaaagcgggtctaaacgcgatgga

SEQ ID NO: 45858 - DNA, 25 bp, E. coli
tgaaagcgggtcaaaacgcgatgga

SEQ ID NO: 45859 - DNA, 25 bp, E. coli
cgcgatggatgcgaccgtattagaa

SEQ ID NO: 45860 - DNA, 25 bp, E. coli
cgcgatggatgccaccgtattagaa

SEQ ID NO: 45861 - DNA, 25 bp, E. coli
gcgtccgcgtccagctgaattcggg

SEQ ID NO: 45862 - DNA, 25 bp, E. coli
gcgtccgcgtcctgctgaattcggg

SEQ ID NO: 45863 - DNA, 25 bp, E. coli
cgtccagctgaattcgggtatgtct

SEQ ID NO: 45864 - DNA, 25 bp, E. coli
cgtccagctgaaatcgggtatgtct

SEQ ID NO: 45865 - DNA, 25 bp, E. coli
ggtatgtctttgtttgtgcgcgcag

SEQ ID NO: 45866 - DNA, 25 bp, E. coli
ggtatgtctttgattgtgcgcgcag

SEQ ID NO: 45867 - DNA, 25 bp, E. coli
ggtcaaaacgcgttggatgccaccg

SEQ ID NO: 45868 - DNA, 25 bp, E. coli
ggtcaaaacgcgatggatgccaccg

SEQ ID NO: 45869 - DNA, 25 bp, E. coli
tggatgccaccgtattagaaatcac

SEQ ID NO: 45870 - DNA, 25 bp, E. coli
tggatgccaccgaattagaaatcac

SEQ ID NO: 45871 - DNA, 25 bp, E. coli
aattcctgtcggctgtttcgtcatc

SEQ ID NO: 45872 - DNA, 25 bp, E. coli
caatagcataaccataaccactgaa

SEQ ID NO: 45873 - DNA, 25 bp, E. coli
caatagcataacgataaccactgaa

SEQ ID NO: 45874 - DNA, 25 bp, E. coli
aattcctgtcgggtgtttcgtcatc

SEQ ID NO: 45875 - DNA, 25 bp, E. coli
caaggcacccgacataaattcctgt

SEQ ID NO: 45876 - DNA, 25 bp, E. coli
caaggcacccgagataaattcctgt

SEQ ID NO: 45877 - DNA, 25 bp, E. coli
catcagggcatttgcaatatccttg

SEQ ID NO: 45878 - DNA, 25 bp, E. coli
catagataatcaatggatggcacaa

SEQ ID NO: 45879 - DNA, 25 bp, E. coli
catagataatcattggatggcacaa

SEQ ID NO: 45880 - DNA, 25 bp, E. coli
catcagggcattagcaatatccttg

SEQ ID NO: 45881 - DNA, 25 bp, E. coli
tttcatcagtaattcattgccatag

SEQ ID NO: 45882 - DNA, 25 bp, E. coli
tcttatgaccttaacaaggcacccg

SEQ ID NO: 45883 - DNA, 25 bp, E. coli
tcttatgacctttacaaggcacccg

SEQ ID NO: 45884 - DNA, 25 bp, E. coli
tttcatcagtaaatcattgccatag

SEQ ID NO: 45885 - DNA, 25 bp, E. coli
ccttgcgaaaatgctggcttacgtg

SEQ ID NO: 45886 - DNA, 25 bp, E. coli
ccttgcgaaaatcctggcttacgtg

SEQ ID NO: 45887 - DNA, 25 bp, E. coli
gtcatcatcatcttcccttgcgaaa

SEQ ID NO: 45888 - DNA, 25 bp, E. coli
gtcatcatcatcatcccttgcgaaa

SEQ ID NO: 45889 - DNA, 25 bp, E. coli
tggatggcacaaacaattttcgcta

SEQ ID NO: 45890 - DNA, 25 bp, E. coli
ggcttacgtggtatgcatcagggca

SEQ ID NO: 45891 - DNA, 25 bp, E. coli
tggatggcacaatcaattttcgcta

SEQ ID NO: 45892 - DNA, 25 bp, E. coli
ggcttacgtggtttgcatcagggca

SEQ ID NO: 45893 - DNA, 25 bp, E. coli
catgctaccgctatttcacttgaag

SEQ ID NO: 45894 - DNA, 25 bp, E. coli
catgctaccgctttttcacttgaag

SEQ ID NO: 45895 - DNA, 25 bp, E. coli
ttatcgagatgaaagactatggcac

SEQ ID NO: 45896 - DNA, 25 bp, E. coli
ttatcgagatgatagactatggcac

SEQ ID NO: 45897 - DNA, 25 bp, E. coli
tcagaaaccagagattgaagccgtt

SEQ ID NO: 45898 - DNA, 25 bp, E. coli
tcagaaaccagacattgaagccgtt

SEQ ID NO: 45899 - DNA, 25 bp, E. coli
gcgctgcgggcatgtcaaccagtat

SEQ ID NO: 45900 - DNA, 25 bp, E. coli
gcgctgcgggcaagtcaaccagtat

SEQ ID NO: 45901 - DNA, 25 bp, E. coli
gacgttgttttagttggtccgcaag

SEQ ID NO: 45902 - DNA, 25 bp, E. coli
gaaaatgcctgttgccgttatcgag

SEQ ID NO: 45903 - DNA, 25 bp, E. coli
gacgttgttttacttggtccgcaag

SEQ ID NO: 45904 - DNA, 25 bp, E. coli
gaaaatgcctgtagccgttatcgag

SEQ ID NO: 45905 - DNA, 25 bp, E. coli
ccgcattggcgaatgcagaggctaa

SEQ ID NO: 45906 - DNA, 25 bp, E. coli
ccgcattggcgattgcagaggctaa

SEQ ID NO: 45907 - DNA, 25 bp, E. coli
ctatggcacaatcaacggacaggca

SEQ ID NO: 45908 - DNA, 25 bp, E. coli
ctatggcacaatgaacggacaggca

SEQ ID NO: 45909 - DNA, 25 bp, E. coli
cttgaatttgcgttgaaactactgc

SEQ ID NO: 45910 - DNA, 25 bp, E. coli
cttgaatttgcgatgaaactactgc

SEQ ID NO: 45911 - DNA, 25 bp, E. coli
gatattgttagtttgcgctgcgggc

SEQ ID NO: 45912 - DNA, 25 bp, E. coli
gatattgttagtatgcgctgcgggc

SEQ ID NO: 45913 - DNA, 25 bp, E. coli
ggtccgcaagttcgctttcagaaac

SEQ ID NO: 45914 - DNA, 25 bp, E. coli
ggtccgcaagttggctttcagaaac

SEQ ID NO: 45915 - DNA, 25 bp, E. coli
cagatgcggtgaccgcactcgttca

SEQ ID NO: 45916 - DNA, 25 bp, E. coli
cagatgcggtgagcgcactcgttca

SEQ ID NO: 45917 - DNA, 25 bp, E. coli
catttcgggcgggatcgagtataca

SEQ ID NO: 45918 - DNA, 25 bp, E. coli
catttcgggcggcatcgagtataca

SEQ ID NO: 45919 - DNA, 25 bp, E. coli
taaagcatgcgatttacggcgcggg

SEQ ID NO: 45920 - DNA, 25 bp, E. coli
taaagcatgcgaattacggcgcggg

SEQ ID NO: 45921 - DNA, 25 bp, E. coli
ttcaagctgcagttgcggtgaccgc

SEQ ID NO: 45922 - DNA, 25 bp, E. coli
ttcaagctgcagatgcggtgaccgc

SEQ ID NO: 45923 - DNA, 25 bp, E. coli
tcatacttcaagctgcagatgcggt

SEQ ID NO: 45924 - DNA, 25 bp, E. coli
tcatacttcaaggtgcagatgcggt

SEQ ID NO: 45925 - DNA, 25 bp, E. coli
cattgaatgaatcgagatttaccca

SEQ ID NO: 45926 - DNA, 25 bp, E. coli
cattgaatgaatggagatttaccca

SEQ ID NO: 45927 - DNA, 25 bp, E. coli
gtgtggttatggttaatccccttca

SEQ ID NO: 45928 - DNA, 25 bp, E. coli
ggttaatcccctacatacttcaagc

SEQ ID NO: 45929 - DNA, 25 bp, E. coli
ggttaatccccttcatacttcaagc

SEQ ID NO: 45930 - DNA, 25 bp, E. coli
gtgtggttatggataatccccttca

SEQ ID NO: 45931 - DNA, 25 bp, E. coli
ggcgggatcgagaatacacaactaa

SEQ ID NO: 45932 - DNA, 25 bp, E. coli
ggcgggatcgagtatacacaactaa

SEQ ID NO: 45933 - DNA, 25 bp, E. coli
tggagatttacccaaaacatttcgg

SEQ ID NO: 45934 - DNA, 25 bp, E. coli
tggagatttaccgaaaacatttcgg

SEQ ID NO: 45935 - DNA, 25 bp, E. coli
gagtatacacaactaaagcatgcga

SEQ ID NO: 45936 - DNA, 25 bp, E. coli
gagtatacacaagtaaagcatgcga

SEQ ID NO: 45937 - DNA, 25 bp, E. coli
ataccggttgaacgcgagcgcagca

SEQ ID NO: 45938 - DNA, 25 bp, E. coli
ataccggttgaaggcgagcgcagca

SEQ ID NO: 45939 - DNA, 25 bp, E. coli
ttatacattgggtgaactggcggca

SEQ ID NO: 45940 - DNA, 25 bp, E. coli
tttacagatacgaccgaaagcagcg

SEQ ID NO: 45941 - DNA, 25 bp, E. coli
ttactggagatcaggctaggtgcca

SEQ ID NO: 45942 - DNA, 25 bp, E. coli
tttacagatacgtccgaaagcagcg

SEQ ID NO: 45943 - DNA, 25 bp, E. coli
ttactggagatctggctaggtgcca

SEQ ID NO: 45944 - DNA, 25 bp, E. coli
ttatacattgggagaactggcggca

SEQ ID NO: 45945 - DNA, 25 bp, E. coli
tccctgtggatagtcttggtcgtcc

SEQ ID NO: 45946 - DNA, 25 bp, E. coli
tccctgtggatactcttggtcgtcc

SEQ ID NO: 45947 - DNA, 25 bp, E. coli
tcaccgttgctgtggagcccgaatg

SEQ ID NO: 45948 - DNA, 25 bp, E. coli
tcaccgttgctgaggagcccgaatg

SEQ ID NO: 45949 - DNA, 25 bp, E. coli
gctgctctgggcctggaacttaaaa

SEQ ID NO: 45950 - DNA, 25 bp, E. coli
gctacgcgaagagtgggaagaatta

SEQ ID NO: 45951 - DNA, 25 bp, E. coli
gctgctctgggcgtggaacttaaaa

SEQ ID NO: 45952 - DNA, 25 bp, E. coli
gctacgcgaagactgggaagaatta

SEQ ID NO: 45953 - DNA, 25 bp, E. coli
cgaatgaagaggtagaccggcagct

SEQ ID NO: 45954 - DNA, 25 bp, E. coli
cgaatgaagaggaagaccggcagct

SEQ ID NO: 45955 - DNA, 25 bp, E. coli
gtgacctgggaaaccagccacgtgc

SEQ ID NO: 45956 - DNA, 25 bp, E. coli
gtgacctgggaatccagccacgtgc

SEQ ID NO: 45957 - DNA, 25 bp, E. coli
ggcccgtcatttactgatccagtag

SEQ ID NO: 45958 - DNA, 25 bp, E. coli
ggcccgtcattttctgatccagtag

SEQ ID NO: 45959 - DNA, 25 bp, E. coli
catattaaggatgtggcgaatgcgc

SEQ ID NO: 45960 - DNA, 25 bp, E. coli
catattaaggatctggcgaatgcgc

SEQ ID NO: 45961 - DNA, 25 bp, E. coli
taaagcgatcgctgaacagtgcgac

SEQ ID NO: 45962 - DNA, 25 bp, E. coli
taaagcgatcgcagaacagtgcgac

SEQ ID NO: 45963 - DNA, 25 bp, E. coli
tatgagttctatcgcaccgctggca

SEQ ID NO: 45964 - DNA, 25 bp, E. coli
tatgagttctatggcaccgctggca

SEQ ID NO: 45965 - DNA, 25 bp, E. coli
tattgaaggcgcgaagccaggtacg

SEQ ID NO: 45966 - DNA, 25 bp, E. coli
tattgaaggcgccaagccaggtacg

SEQ ID NO: 45967 - DNA, 25 bp, E. coli
tgaccgtaaccctgaagctattgct

SEQ ID NO: 45968 - DNA, 25 bp, E. coli
tgaccgtaacccagaagctattgct

SEQ ID NO: 45969 - DNA, 25 bp, E. coli
tgctggatgccatagcgccgatggt

SEQ ID NO: 45970 - DNA, 25 bp, E. coli
tgctggatgccaaagcgccgatggt

SEQ ID NO: 45971 - DNA, 25 bp, E. coli
gaatgcgctggatacttctcacggc

SEQ ID NO: 45972 - DNA, 25 bp, E. coli
gaatgcgctggaaacttctcacggc

SEQ ID NO: 45973 - DNA, 25 bp, E. coli
gaaagccatcgacggtacgctgtca

SEQ ID NO: 45974 - DNA, 25 bp, E. coli
gaaagccatcgagggtacgctgtca

SEQ ID NO: 45975 - DNA, 25 bp, E. coli
cgatggtgatggaccgcaacttcaa

SEQ ID NO: 45976 - DNA, 25 bp, E. coli
cgatggtgatggtccgcaacttcaa

SEQ ID NO: 45977 - DNA, 25 bp, E. coli
cgtgctactacgtaaaactggcgaa

SEQ ID NO: 45978 - DNA, 25 bp, E. coli
cgtgctactacgaaaaactggcgaa

SEQ ID NO: 45979 - DNA, 25 bp, E. coli
tggcaagccgtgaaatcagcgaagc

SEQ ID NO: 45980 - DNA, 25 bp, E. coli
tggcaagccgtgtaatcagcgaagc

SEQ ID NO: 45981 - DNA, 25 bp, E. coli
aaagtttatgtttgagtggtgcgca

SEQ ID NO: 45982 - DNA, 25 bp, E. coli
aaagtttatgttagagtggtgcgca

SEQ ID NO: 45983 - DNA, 25 bp, E. coli
tgttcaccatgatacgccacgcaag

SEQ ID NO: 45984 - DNA, 25 bp, E. coli
tgttcaccatgaaacgccacgcaag

SEQ ID NO: 45985 - DNA, 25 bp, E. coli
tccgcatggtatacacgaaaagttt

SEQ ID NO: 45986 - DNA, 25 bp, E. coli
tccgcatggtattcacgaaaagttt

SEQ ID NO: 45987 - DNA, 25 bp, E. coli
tcataatgaaagaaggatcaaccaa

SEQ ID NO: 45988 - DNA, 25 bp, E. coli
tcataatgaaagtaggatcaaccaa

SEQ ID NO: 45989 - DNA, 25 bp, E. coli
gcaagcatccctcatggtcaaagta

SEQ ID NO: 45990 - DNA, 25 bp, E. coli
gaagataatgttatactaccaacgg

SEQ ID NO: 45991 - DNA, 25 bp, E. coli
gaagataatgttttactaccaacgg

SEQ ID NO: 45992 - DNA, 25 bp, E. coli
gcaagcatccctgatggtcaaagta

SEQ ID NO: 45993 - DNA, 25 bp, E. coli
gaaaaatctcctcttcaccatgaaa

SEQ ID NO: 45994 - DNA, 25 bp, E. coli
gaaaaatctcctgttcaccatgaaa

SEQ ID NO: 45995 - DNA, 25 bp, E. coli
ggtaaaaatcggtcattccgcatgg

SEQ ID NO: 45996 - DNA, 25 bp, E. coli
ggttacatgttcaaccaaatatgag

SEQ ID NO: 45997 - DNA, 25 bp, E. coli
ggtaaaaatcggacattccgcatgg

SEQ ID NO: 45998 - DNA, 25 bp, E. coli
ggttacatgttctaccaaatatgag

SEQ ID NO: 45999 - DNA, 25 bp, E. coli
tggcatatgtgattccatggttaca

SEQ ID NO: 46000 - DNA, 25 bp, E. coli
tggcatatgtgaatccatggttaca

SEQ ID NO: 46001 - DNA, 25 bp, E. coli
gagtggtgcgcaaacgtcagattga

SEQ ID NO: 46002 - DNA, 25 bp, E. coli
gagtggtgcgcatacgtcagattga

SEQ ID NO: 46003 - DNA, 25 bp, E. coli
cagcggttgttttgtatgaccagat

SEQ ID NO: 46004 - DNA, 25 bp, E. coli
cagcggttgtttagtatgaccagat

SEQ ID NO: 46005 - DNA, 25 bp, E. coli
ttttgttgcgtctgcggttgttttg

SEQ ID NO: 46006 - DNA, 25 bp, E. coli
ttttgttgcgtcagcggttgttttg

SEQ ID NO: 46007 - DNA, 25 bp, E. coli
tgttttgtatgaccagatgaatcgc

SEQ ID NO: 46008 - DNA, 25 bp, E. coli
tgttttgtatgagcagatgaatcgc

SEQ ID NO: 46009 - DNA, 25 bp, E. coli
gcggcggcccgggagggaatgctgt

SEQ ID NO: 46010 - DNA, 25 bp, E. coli
gcggttgttttgtatgaccagatga

SEQ ID NO: 46011 - DNA, 25 bp, E. coli
gcggttgttttgaatgaccagatga

SEQ ID NO: 46012 - DNA, 25 bp, E. coli
gcggcggcccggcagggaatgctgt

SEQ ID NO: 46013 - DNA, 25 bp, E. coli
cggttgttttgtatgaccagatgaa

SEQ ID NO: 46014 - DNA, 25 bp, E. coli
cggttgttttgtttgaccagatgaa

SEQ ID NO: 46015 - DNA, 25 bp, E. coli
cgtcagcggttgttttgtatgacca

SEQ ID NO: 46016 - DNA, 25 bp, E. coli
cggcccggcaggcaatgctgtggtg

SEQ ID NO: 46017 - DNA, 25 bp, E. coli
cggcccggcagggaatgctgtggtg

SEQ ID NO: 46018 - DNA, 25 bp, E. coli
cgtcagcggttgatttgtatgacca

SEQ ID NO: 46019 - DNA, 25 bp, E. coli
gttttgtatgaccagatgaatcgcg

SEQ ID NO: 46020 - DNA, 25 bp, E. coli
gttttgtatgacgagatgaatcgcg

SEQ ID NO: 46021 - DNA, 25 bp, E. coli
gttgcgtcagcgcttgttttgtatg

SEQ ID NO: 46022 - DNA, 25 bp, E. coli
gttgcgtcagcggttgttttgtatg

SEQ ID NO: 46023 - DNA, 25 bp, E. coli
tcagcggttgttttgtatgaccaga

SEQ ID NO: 46024 - DNA, 25 bp, E. coli
tcagcggttgttatgtatgaccaga

SEQ ID NO: 46025 - DNA, 25 bp, E. coli
cagtttgcccgggatgtgatggaca

SEQ ID NO: 46026 - DNA, 25 bp, E. coli
catgcttcaggaacagggtgccgtg

SEQ ID NO: 46027 - DNA, 25 bp, E. coli
caggcacatatcagggacgagggca

SEQ ID NO: 46028 - DNA, 25 bp, E. coli
catgcttcaggatcagggtgccgtg

SEQ ID NO: 46029 - DNA, 25 bp, E. coli
cagtttgcccggcatgtgatggaca

SEQ ID NO: 46030 - DNA, 25 bp, E. coli
caggcacatatctgggacgagggca

SEQ ID NO: 46031 - DNA, 25 bp, E. coli
tacttgtaacaatctggcccacagg

SEQ ID NO: 46032 - DNA, 25 bp, E. coli
tacaaaaagcctctgcccgtgtgga

SEQ ID NO: 46033 - DNA, 25 bp, E. coli
tacaaaaagcctgtgcccgtgtgga

SEQ ID NO: 46034 - DNA, 25 bp, E. coli
tacttgtaacaaactggcccacagg

SEQ ID NO: 46035 - DNA, 25 bp, E. coli
tgaattcctggagtggcctgacggc

SEQ ID NO: 46036 - DNA, 25 bp, E. coli
tgaattcctggactggcctgacggc

SEQ ID NO: 46037 - DNA, 25 bp, E. coli
tgccgggcaggaaacagatgtactc

SEQ ID NO: 46038 - DNA, 25 bp, E. coli
tgccgggcaggatacagatgtactc

SEQ ID NO: 46039 - DNA, 25 bp, E. coli
gatgtactcggatgcaggatgcagc

SEQ ID NO: 46040 - DNA, 25 bp, E. coli
gatgtactcggaagcaggatgcagc

SEQ ID NO: 46041 - DNA, 25 bp, E. coli
cgtcttcagggctgtattaccggca

SEQ ID NO: 46042 - DNA, 25 bp, E. coli
cgtcttcagggcagtattaccggca

SEQ ID NO: 46043 - DNA, 25 bp, E. coli
gatacggattatcagcggcggcctt

SEQ ID NO: 46044 - DNA, 25 bp, E. coli
gatacggattatgagcggcggcctt

SEQ ID NO: 46045 - DNA, 25 bp, E. coli
tggcagttaccaatccctggcggaa

SEQ ID NO: 46046 - DNA, 25 bp, E. coli
tggcagttaccattccctggcggaa

SEQ ID NO: 46047 - DNA, 25 bp, E. coli
caagtttatgcgtagccggatatgc

SEQ ID NO: 46048 - DNA, 25 bp, E. coli
caagtttatgcgaagccggatatgc

SEQ ID NO: 46049 - DNA, 25 bp, E. coli
caaacacctggcgataatggaaggc

SEQ ID NO: 46050 - DNA, 25 bp, E. coli
cagcaggttgtcttgagttaagcca

SEQ ID NO: 46051 - DNA, 25 bp, E. coli
caaacacctggccataatggaaggc

SEQ ID NO: 46052 - DNA, 25 bp, E. coli
cagcaggttgtcatgagttaagcca

SEQ ID NO: 46053 - DNA, 25 bp, E. coli
tatggaccgcctggatgacgaactg

SEQ ID NO: 46054 - DNA, 25 bp, E. coli
tatggaccgcctcgatgacgaactg

SEQ ID NO: 46055 - DNA, 25 bp, E. coli
tattgccccaaaagtggaacaggga

SEQ ID NO: 46056 - DNA, 25 bp, E. coli
tattgccccaaatgtggaacaggga

SEQ ID NO: 46057 - DNA, 25 bp, E. coli
tttcgatctcaagagcagggcttac

SEQ ID NO: 46058 - DNA, 25 bp, E. coli
tttcgatctcaacagcagggcttac

SEQ ID NO: 46059 - DNA, 25 bp, E. coli
gaaaaacagatctccactcagggcg

SEQ ID NO: 46060 - DNA, 25 bp, E. coli
gactgaatatcgatcggcaacgccg

SEQ ID NO: 46061 - DNA, 25 bp, E. coli
gactgaatatcgttcggcaacgccg

SEQ ID NO: 46062 - DNA, 25 bp, E. coli
gaaaaacagatcaccactcagggcg

SEQ ID NO: 46063 - DNA, 25 bp, E. coli
ccgtaagagtggtggcagcaacaac

SEQ ID NO: 46064 - DNA, 25 bp, E. coli
ccgtaagagtggaggcagcaacaac

SEQ ID NO: 46065 - DNA, 25 bp, E. coli
cattatcgggtaaggacggccgtgc

SEQ ID NO: 46066 - DNA, 25 bp, E. coli
cattatcgggtatggacggccgtgc

SEQ ID NO: 46067 - DNA, 25 bp, E. coli
gataaccgggaaacgcatgctgtcg

SEQ ID NO: 46068 - DNA, 25 bp, E. coli
gataaccgggaatcgcatgctgtcg

SEQ ID NO: 46069 - DNA, 25 bp, E. coli
gacgaaactttctgccctactgggt

SEQ ID NO: 46070 - DNA, 25 bp, E. coli
gacgaaactttcagccctactgggt

SEQ ID NO: 46071 - DNA, 25 bp, E. coli
ttattgatgagcaggacgttccgac

SEQ ID NO: 46072 - DNA, 25 bp, E. coli
ttattgatgagctggacgttccgac

SEQ ID NO: 46073 - DNA, 25 bp, E. coli
tcccgatgatgtacgccaagtcctg

SEQ ID NO: 46074 - DNA, 25 bp, E. coli
tcccgatgatgttcgccaagtcctg

SEQ ID NO: 46075 - DNA, 25 bp, E. coli
tcttgtgcgctatcggtccagagtg

SEQ ID NO: 46076 - DNA, 25 bp, E. coli
tcttgtgcgctaacggtccagagtg

SEQ ID NO: 46077 - DNA, 25 bp, E. coli
tccagagtggaaccgcttcgttacg

SEQ ID NO: 46078 - DNA, 25 bp, E. coli
tccagagtggaagcgcttcgttacg

SEQ ID NO: 46079 - DNA, 25 bp, E. coli
gctggaaatgaaatatggccggatc

SEQ ID NO: 46080 - DNA, 25 bp, E. coli
gctggaaatgaattatggccggatc

SEQ ID NO: 46081 - DNA, 25 bp, E. coli
gaagcctctgttttgtctcccgatg

SEQ ID NO: 46082 - DNA, 25 bp, E. coli
gaagcctctgttatgtctcccgatg

SEQ ID NO: 46083 - DNA, 25 bp, E. coli
gaaatcctttttcacctcttgtgcg

SEQ ID NO: 46084 - DNA, 25 bp, E. coli
gaaatcctttttgacctcttgtgcg

SEQ ID NO: 46085 - DNA, 25 bp, E. coli
cggatcatgctgcatacggccaaaa

SEQ ID NO: 46086 - DNA, 25 bp, E. coli
cggatcatgctggatacggccaaaa

SEQ ID NO: 46087 - DNA, 25 bp, E. coli
taatcatcctgagtacctagaagcc

SEQ ID NO: 46088 - DNA, 25 bp, E. coli
taatcatcctgactacctagaagcc

SEQ ID NO: 46089 - DNA, 25 bp, E. coli
gacgttccgacacatatcctgagca

SEQ ID NO: 46090 - DNA, 25 bp, E. coli
gacgttccgacagatatcctgagca

SEQ ID NO: 46091 - DNA, 25 bp, E. coli
caaaggaaggcatacaagcgcagac

SEQ ID NO: 46092 - DNA, 25 bp, E. coli
caaaggaaggcaaacaagcgcagac

SEQ ID NO: 46093 - DNA, 25 bp, E. coli
tatagcccggtaagtacacctgctg

SEQ ID NO: 46094 - DNA, 25 bp, E. coli
tatcaatgagttgttggacgccatc

SEQ ID NO: 46095 - DNA, 25 bp, E. coli
tatcaatgagttcttggacgccatc

SEQ ID NO: 46096 - DNA, 25 bp, E. coli
tatagcccggtatgtacacctgctg

SEQ ID NO: 46097 - DNA, 25 bp, E. coli
tgagttgcagataccccaagcggca

SEQ ID NO: 46098 - DNA, 25 bp, E. coli
tgagttgcagattccccaagcggca

SEQ ID NO: 46099 - DNA, 25 bp, E. coli
tcaggctggcctagcaacagtcagg

SEQ ID NO: 46100 - DNA, 25 bp, E. coli
tcaggctggccttgcaacagtcagg

SEQ ID NO: 46101 - DNA, 25 bp, E. coli
gaatacattgtggattgaagacccg

SEQ ID NO: 46102 - DNA, 25 bp, E. coli
gaatacattgtgcattgaagacccg

SEQ ID NO: 46103 - DNA, 25 bp, E. coli
gattattcagatcgaagtgccgccc

SEQ ID NO: 46104 - DNA, 25 bp, E. coli
gattattcagatggaagtgccgccc

SEQ ID NO: 46105 - DNA, 25 bp, E. coli
gataaatgttgaagaagtgggcgcc

SEQ ID NO: 46106 - DNA, 25 bp, E. coli
gataaatgttgatgaagtgggcgcc

SEQ ID NO: 46107 - DNA, 25 bp, E. coli
tggcaaaagccatagtctatccggt

SEQ ID NO: 46108 - DNA, 25 bp, E. coli
tggcaaaagccaaagtctatccggt

SEQ ID NO: 46109 - DNA, 25 bp, E. coli
taagatagagcatgaccccaaagga

SEQ ID NO: 46110 - DNA, 25 bp, E. coli
tcaataagattgaccgagccggtgt

SEQ ID NO: 46111 - DNA, 25 bp, E. coli
taagatagagcaagaccccaaagga

SEQ ID NO: 46112 - DNA, 25 bp, E. coli
tcaataagattgtccgagccggtgt

SEQ ID NO: 46113 - DNA, 25 bp, E. coli
tgtagacgtgcagatcagcctgggt

SEQ ID NO: 46114 - DNA, 25 bp, E. coli
tgtagacgtgcacatcagcctgggt

SEQ ID NO: 46115 - DNA, 25 bp, E. coli
tcgttgagccaagcgagaaaaccgt

SEQ ID NO: 46116 - DNA, 25 bp, E. coli
tcgttgagccaaccgagaaaaccgt

SEQ ID NO: 46117 - DNA, 25 bp, E. coli
tctgatcgatcaagcaaccgcggaa

SEQ ID NO: 46118 - DNA, 25 bp, E. coli
tctgatcgatcatgcaaccgcggaa

SEQ ID NO: 46119 - DNA, 25 bp, E. coli
tctgatgcgtctggatctggctgcc

SEQ ID NO: 46120 - DNA, 25 bp, E. coli
tctgatgcgtctcgatctggctgcc

SEQ ID NO: 46121 - DNA, 25 bp, E. coli
gcgcgcgatcagaacgaaatccgta

SEQ ID NO: 46122 - DNA, 25 bp, E. coli
gcgcgcgatcagtacgaaatccgta

SEQ ID NO: 46123 - DNA, 25 bp, E. coli
gcaaagagcgctacactgttctgat

SEQ ID NO: 46124 - DNA, 25 bp, E. coli
gcaaagagcgcttcactgttctgat

SEQ ID NO: 46125 - DNA, 25 bp, E. coli
gcacgtcaacaaagacgcgcgcgat

SEQ ID NO: 46126 - DNA, 25 bp, E. coli
gcacgtcaacaatgacgcgcgcgat

SEQ ID NO: 46127 - DNA, 25 bp, E. coli
gaaaaccgttgatgctctgatgcgt

SEQ ID NO: 46128 - DNA, 25 bp, E. coli
gaaccaaagaatccgtatccgcctg

SEQ ID NO: 46129 - DNA, 25 bp, E. coli
gaaatccgtactgacttgcgtctgg

SEQ ID NO: 46130 - DNA, 25 bp, E. coli
gaaatccgtactcacttgcgtctgg

SEQ ID NO: 46131 - DNA, 25 bp, E. coli
gaaaaccgttgaagctctgatgcgt

SEQ ID NO: 46132 - DNA, 25 bp, E. coli
gaaccaaagaatgcgtatccgcctg

SEQ ID NO: 46133 - DNA, 25 bp, E. coli
ggaaatcgtcgagactgccaagcgc

SEQ ID NO: 46134 - DNA, 25 bp, E. coli
ggaaatcgtcgacactgccaagcgc

SEQ ID NO: 46135 - DNA, 25 bp, E. coli
cacgctctgcaggtgagcatgcagg

SEQ ID NO: 46136 - DNA, 25 bp, E. coli
cacgctctgcagctgagcatgcagg

SEQ ID NO: 46137 - DNA, 25 bp, E. coli
catcatttccgtattttgccgcacc

SEQ ID NO: 46138 - DNA, 25 bp, E. coli
catcatttccgttttttgccgcacc

SEQ ID NO: 46139 - DNA, 25 bp, E. coli
cagggccgggggaatcatcatttcc

SEQ ID NO: 46140 - DNA, 25 bp, E. coli
cagggccgggggtatcatcatttcc

SEQ ID NO: 46141 - DNA, 25 bp, E. coli
aacacgctctgcaggtgagcatgca

SEQ ID NO: 46142 - DNA, 25 bp, E. coli
aacacgctctgctggtgagcatgca

SEQ ID NO: 46143 - DNA, 25 bp, E. coli
ttccggaaacaagcggcatcagtta

SEQ ID NO: 46144 - DNA, 25 bp, E. coli
ttccggaaacaaccggcatcagtta

SEQ ID NO: 46145 - DNA, 25 bp, E. coli
tattttgccgcagcttccggaaaca

SEQ ID NO: 46146 - DNA, 25 bp, E. coli
tattttgccgcaccttccggaaaca

SEQ ID NO: 46147 - DNA, 25 bp, E. coli
tgacgacgaacacgctctgcaggtg

SEQ ID NO: 46148 - DNA, 25 bp, E. coli
tgacgacgaacaggctctgcaggtg

SEQ ID NO: 46149 - DNA, 25 bp, E. coli
tctgcaggtgaggatgcagggccgg

SEQ ID NO: 46150 - DNA, 25 bp, E. coli
tctgcaggtgagcatgcagggccgg

SEQ ID NO: 46151 - DNA, 25 bp, E. coli
gaaacaaccggcatcagttacggtt

SEQ ID NO: 46152 - DNA, 25 bp, E. coli
gaaacaaccggcttcagttacggtt

SEQ ID NO: 46153 - DNA, 25 bp, E. coli
gggtatcatcatatccgtattttgc

SEQ ID NO: 46154 - DNA, 25 bp, E. coli
gggtatcatcatttccgtattttgc

SEQ ID NO: 46155 - DNA, 25 bp, E. coli
gacgaacacgctctgcaggtgagca

SEQ ID NO: 46156 - DNA, 25 bp, E. coli
gacgaacacgctgtgcaggtgagca

SEQ ID NO: 46157 - DNA, 25 bp, E. coli
ttatgtggttgaagcccaggctccg

SEQ ID NO: 46158 - DNA, 25 bp, E. coli
ttatgtggttgatgcccaggctccg

SEQ ID NO: 46159 - DNA, 25 bp, E. coli
tgcgctggtatctcgaaggtctgga

SEQ ID NO: 46160 - DNA, 25 bp, E. coli
tgcgctggtatcacgaaggtctgga

SEQ ID NO: 46161 - DNA, 25 bp, E. coli
tctctggcgctgctgaacgtgtgct

SEQ ID NO: 46162 - DNA, 25 bp, E. coli
tctctggcgctggtgaacgtgtgct

SEQ ID NO: 46163 - DNA, 25 bp, E. coli
gaaaaccgtctgaacgcacgcagtg

SEQ ID NO: 46164 - DNA, 25 bp, E. coli
gaacagttccgtttgccgtacagcg

SEQ ID NO: 46165 - DNA, 25 bp, E. coli
gaaaaccgtctgtacgcacgcagtg

SEQ ID NO: 46166 - DNA, 25 bp, E. coli
gacaacatgatcgtgctgacgccgt

SEQ ID NO: 46167 - DNA, 25 bp, E. coli
gaacagttccgtatgccgtacagcg

SEQ ID NO: 46168 - DNA, 25 bp, E. coli
gacaacatgatcctgctgacgccgt

SEQ ID NO: 46169 - DNA, 25 bp, E. coli
gatctgatcaaaaactgccgcgagc

SEQ ID NO: 46170 - DNA, 25 bp, E. coli
gatctgatcaaatactgccgcgagc

SEQ ID NO: 46171 - DNA, 25 bp, E. coli
gatcatatgctggtgccggacttcc

SEQ ID NO: 46172 - DNA, 25 bp, E. coli
gatcatatgctgctgccggacttcc

SEQ ID NO: 46173 - DNA, 25 bp, E. coli
gtgacgacgaactgaccgccattga

SEQ ID NO: 46174 - DNA, 25 bp, E. coli
gtatcaatcaggacgatcgcggcga

SEQ ID NO: 46175 - DNA, 25 bp, E. coli
gattgaccgtatcgaccgctttgcg

SEQ ID NO: 46176 - DNA, 25 bp, E. coli
gattgaccgtatggaccgctttgcg

SEQ ID NO: 46177 - DNA, 25 bp, E. coli
gtatcaatcaggtcgatcgcggcga

SEQ ID NO: 46178 - DNA, 25 bp, E. coli
gtgacgacgaacagaccgccattga

SEQ ID NO: 46179 - DNA, 25 bp, E. coli
aatgggatatcgacacgctctggca

SEQ ID NO: 46180 - DNA, 25 bp, E. coli
aatgggatatcgtcacgctctggca

SEQ ID NO: 46181 - DNA, 25 bp, E. coli
caactgctggaggaaaaaccggacg

SEQ ID NO: 46182 - DNA, 25 bp, E. coli
caactgctggagcaaaaaccggacg

SEQ ID NO: 46183 - DNA, 25 bp, E. coli
aaacagtattttgagcgcgacgccg

SEQ ID NO: 46184 - DNA, 25 bp, E. coli
aaacagtattttcagcgcgacgccg

SEQ ID NO: 46185 - DNA, 25 bp, E. coli
tatcagcaggaataggcactggcgc

SEQ ID NO: 46186 - DNA, 25 bp, E. coli
tattcgggcgcgacacggaaattcg

SEQ ID NO: 46187 - DNA, 25 bp, E. coli
tattcgggcgcgtcacggaaattcg

SEQ ID NO: 46188 - DNA, 25 bp, E. coli
tatcagcaggaaaaggcactggcgc

SEQ ID NO: 46189 - DNA, 25 bp, E. coli
tgaaaaccgcgtagtcgggcaaagc

SEQ ID NO: 46190 - DNA, 25 bp, E. coli
tgcagtgcagaaatcaccggagccg

SEQ ID NO: 46191 - DNA, 25 bp, E. coli
tgaaaaccgcgttgtcgggcaaagc

SEQ ID NO: 46192 - DNA, 25 bp, E. coli
tgcagtgcagaattcaccggagccg

SEQ ID NO: 46193 - DNA, 25 bp, E. coli
gaagacgtgacgcaaaaagcccgca

SEQ ID NO: 46194 - DNA, 25 bp, E. coli
gaagacgtgacggaaaaagcccgca

SEQ ID NO: 46195 - DNA, 25 bp, E. coli
gacagcgtattttatcccgaagcca

SEQ ID NO: 46196 - DNA, 25 bp, E. coli
gacagcgtatttaatcccgaagcca

SEQ ID NO: 46197 - DNA, 25 bp, E. coli
cgcgtaatatcgacagcctgctgaa

SEQ ID NO: 46198 - DNA, 25 bp, E. coli
cgcgtaatatcgtcagcctgctgaa

SEQ ID NO: 46199 - DNA, 25 bp, E. coli
taacccatactgtgcacgggcgctg

SEQ ID NO: 46200 - DNA, 25 bp, E. coli
taacccatactgagcacgggcgctg

SEQ ID NO: 46201 - DNA, 25 bp, E. coli
taaaggcccagcttccacatggtgt

SEQ ID NO: 46202 - DNA, 25 bp, E. coli
taaaggcccagcatccacatggtgt

SEQ ID NO: 46203 - DNA, 25 bp, E. coli
taccagacagtacgaagcgagtcag

SEQ ID NO: 46204 - DNA, 25 bp, E. coli
taccagacagtaggaagcgagtcag

SEQ ID NO: 46205 - DNA, 25 bp, E. coli
tgcgccaggcacaacgagagtcttt

SEQ ID NO: 46206 - DNA, 25 bp, E. coli
tgcgccaggcactacgagagtcttt

SEQ ID NO: 46207 - DNA, 25 bp, E. coli
tcatcgggaacgcaaggatagccat

SEQ ID NO: 46208 - DNA, 25 bp, E. coli
tcaggccgcggtcagcaaaaaacgt

SEQ ID NO: 46209 - DNA, 25 bp, E. coli
tcagggtggcaacaatccaggtcgt

SEQ ID NO: 46210 - DNA, 25 bp, E. coli
tcagggtggcaagaatccaggtcgt

SEQ ID NO: 46211 - DNA, 25 bp, E. coli
tcaggccgcggtgagcaaaaaacgt

SEQ ID NO: 46212 - DNA, 25 bp, E. coli
tcatcgggaacggaaggatagccat

SEQ ID NO: 46213 - DNA, 25 bp, E. coli
ccatcatgatgtgtgcgaatgccag

SEQ ID NO: 46214 - DNA, 25 bp, E. coli
ccatcatgatgtctgcgaatgccag

SEQ ID NO: 46215 - DNA, 25 bp, E. coli
gcgtacatcggcttcaggaacagga

SEQ ID NO: 46216 - DNA, 25 bp, E. coli
gcgtacatcggcatcaggaacagga

SEQ ID NO: 46217 - DNA, 25 bp, E. coli
tgtccagagacaccgtttccagtgc

SEQ ID NO: 46218 - DNA, 25 bp, E. coli
gatagacttaccattaccacgcaga

SEQ ID NO: 46219 - DNA, 25 bp, E. coli
tgtccagagacagcgtttccagtgc

SEQ ID NO: 46220 - DNA, 25 bp, E. coli
gattgccacgctataaaccagcagg

SEQ ID NO: 46221 - DNA, 25 bp, E. coli
gatagacttacctttaccacgcaga

SEQ ID NO: 46222 - DNA, 25 bp, E. coli
gattgccacgctttaaaccagcagg

SEQ ID NO: 46223 - DNA, 25 bp, E. coli
cacgggaaacaacagagagtatcgc

SEQ ID NO: 46224 - DNA, 25 bp, E. coli
cacgtatatcgtactgcccgcgaag

SEQ ID NO: 46225 - DNA, 25 bp, E. coli
cacgtatatcgttctgcccgcgaag

SEQ ID NO: 46226 - DNA, 25 bp, E. coli
cacgggaaacaagagagagtatcgc

SEQ ID NO: 46227 - DNA, 25 bp, E. coli
caacaggcgtggaacgaacatatcc

SEQ ID NO: 46228 - DNA, 25 bp, E. coli
caacaggcgtggtacgaacatatcc

SEQ ID NO: 46229 - DNA, 25 bp, E. coli
tattaatgccgacaatgaagcgtcc

SEQ ID NO: 46230 - DNA, 25 bp, E. coli
tattaatgccgagaatgaagcgtcc

SEQ ID NO: 46231 - DNA, 25 bp, E. coli
tgcgatggcgcaacaccagatggtc

SEQ ID NO: 46232 - DNA, 25 bp, E. coli
tgcgatggcgcatcaccagatggtc

SEQ ID NO: 46233 - DNA, 25 bp, E. coli
tcatcccgacgtccaggacaaaggg

SEQ ID NO: 46234 - DNA, 25 bp, E. coli
tcaggaaggcgtaaagcgcgtgacc

SEQ ID NO: 46235 - DNA, 25 bp, E. coli
tcaggaaggcgttaagcgcgtgacc

SEQ ID NO: 46236 - DNA, 25 bp, E. coli
tcatcccgacgtgcaggacaaaggg

SEQ ID NO: 46237 - DNA, 25 bp, E. coli
ccagcttccaggcttgtcacgggaa

SEQ ID NO: 46238 - DNA, 25 bp, E. coli
ccagcttccagggttgtcacgggaa

SEQ ID NO: 46239 - DNA, 25 bp, E. coli
gcgcattcagcaatataccgggcaa

SEQ ID NO: 46240 - DNA, 25 bp, E. coli
gcgcattcagcattataccgggcaa

SEQ ID NO: 46241 - DNA, 25 bp, E. coli
gaaatctttggccacgagacgccgg

SEQ ID NO: 46242 - DNA, 25 bp, E. coli
gaaatctttggcgacgagacgccgg

SEQ ID NO: 46243 - DNA, 25 bp, E. coli
ggaaatgttgcgtaagcccctgcat

SEQ ID NO: 46244 - DNA, 25 bp, E. coli
ggaaatgttgcgaaagcccctgcat

SEQ ID NO: 46245 - DNA, 25 bp, E. coli
caaaaatattgtgccgaaggagtgg

SEQ ID NO: 46246 - DNA, 25 bp, E. coli
caaaaatattgtcccgaaggagtgg

SEQ ID NO: 46247 - DNA, 25 bp, E. coli
cagtgagggcgtgattctgacagaa

SEQ ID NO: 46248 - DNA, 25 bp, E. coli
cagtgagggcgtcattctgacagaa

SEQ ID NO: 46249 - DNA, 25 bp, E. coli
aacaatggcgcgcaagatgggtact

SEQ ID NO: 46250 - DNA, 25 bp, E. coli
aacaatggcgcggaagatgggtact

SEQ ID NO: 46251 - DNA, 25 bp, E. coli
tatgaaatgttagcaaagccctgct

SEQ ID NO: 46252 - DNA, 25 bp, E. coli
tatgaaatgttaccaaagccctgct

SEQ ID NO: 46253 - DNA, 25 bp, E. coli
tgaactacgagattaagcaggaaga

SEQ ID NO: 46254 - DNA, 25 bp, E. coli
tgaactacgagaataagcaggaaga

SEQ ID NO: 46255 - DNA, 25 bp, E. coli
tgcggtgcagccaaaacatcactaa

SEQ ID NO: 46256 - DNA, 25 bp, E. coli
tcgaaatgtatgatgcggtgcagcc

SEQ ID NO: 46257 - DNA, 25 bp, E. coli
tcgaaatgtatgttgcggtgcagcc

SEQ ID NO: 46258 - DNA, 25 bp, E. coli
tgcggtgcagcctaaacatcactaa

SEQ ID NO: 46259 - DNA, 25 bp, E. coli
tctcgttggcccgtgggaacagacg

SEQ ID NO: 46260 - DNA, 25 bp, E. coli
tctcgttggcccctgggaacagacg

SEQ ID NO: 46261 - DNA, 25 bp, E. coli
gaaaaattacgctgcgacaccgtcg

SEQ ID NO: 46262 - DNA, 25 bp, E. coli
gaaaaattacgcagcgacaccgtcg

SEQ ID NO: 46263 - DNA, 25 bp, E. coli
cgttgcaggtttgcatctcgttggc

SEQ ID NO: 46264 - DNA, 25 bp, E. coli
cgttgcaggtttccatctcgttggc

SEQ ID NO: 46265 - DNA, 25 bp, E. coli
gtgatgattttgctaaaccctggta

SEQ ID NO: 46266 - DNA, 25 bp, E. coli
gtgatgattttggtaaaccctggta

SEQ ID NO: 46267 - DNA, 25 bp, E. coli
cagagaagatccctgccgcttttta

SEQ ID NO: 46268 - DNA, 25 bp, E. coli
cagacataaagcagattactttttg

SEQ ID NO: 46269 - DNA, 25 bp, E. coli
cagagaagatccgtgccgcttttta

SEQ ID NO: 46270 - DNA, 25 bp, E. coli
cagacataaagctgattactttttg

SEQ ID NO: 46271 - DNA, 25 bp, E. coli
tcccaatgtaatctcagacaaaaaa

SEQ ID NO: 46272 - DNA, 25 bp, E. coli
tcccaatgtaatgtcagacaaaaaa

SEQ ID NO: 46273 - DNA, 25 bp, E. coli
tcttcccaatgtaatctcagacaaa

SEQ ID NO: 46274 - DNA, 25 bp, E. coli
tcttcccaatgttatctcagacaaa

SEQ ID NO: 46275 - DNA, 25 bp, E. coli
gccgctttttattgttggatgcgac

SEQ ID NO: 46276 - DNA, 25 bp, E. coli
gccgctttttatagttggatgcgac

SEQ ID NO: 46277 - DNA, 25 bp, E. coli
gcatcagacataaagcagattactt

SEQ ID NO: 46278 - DNA, 25 bp, E. coli
gcatcagacatatagcagattactt

SEQ ID NO: 46279 - DNA, 25 bp, E. coli
cgtcgcatcagagataaagcagatt

SEQ ID NO: 46280 - DNA, 25 bp, E. coli
cgtcgcatcagacataaagcagatt

SEQ ID NO: 46281 - DNA, 25 bp, E. coli
gatccctgccgcattttattgttgg

SEQ ID NO: 46282 - DNA, 25 bp, E. coli
ggcagagaagatccctgccgctttt

SEQ ID NO: 46283 - DNA, 25 bp, E. coli
ggcagagaagatgcctgccgctttt

SEQ ID NO: 46284 - DNA, 25 bp, E. coli
taatctcagacaaaaaaagcggcag

SEQ ID NO: 46285 - DNA, 25 bp, E. coli
taatctcagacataaaaagcggcag

SEQ ID NO: 46286 - DNA, 25 bp, E. coli
gagaagatccctgccgctttttatt

SEQ ID NO: 46287 - DNA, 25 bp, E. coli
gatccctgccgctttttattgttgg

SEQ ID NO: 46288 - DNA, 25 bp, E. coli
gagaagatccctcccgctttttatt

SEQ ID NO: 46289 - DNA, 25 bp, E. coli
cactgtgtcgcttaaaagagacaac

SEQ ID NO: 46290 - DNA, 25 bp, E. coli
cactgtgtcgctaaaaagagacaac

SEQ ID NO: 46291 - DNA, 25 bp, E. coli
tactgattataccttgctttgaggg

SEQ ID NO: 46292 - DNA, 25 bp, E. coli
tactgattatacgttgctttgaggg

SEQ ID NO: 46293 - DNA, 25 bp, E. coli
aatgagttaagtgtcgccagaaagc

SEQ ID NO: 46294 - DNA, 25 bp, E. coli
aatgagttaagtctcgccagaaagc

SEQ ID NO: 46295 - DNA, 25 bp, E. coli
cccggagttgggagcttatgatagt

SEQ ID NO: 46296 - DNA, 25 bp, E. coli
cccggagttgggtgcttatgatagt

SEQ ID NO: 46297 - DNA, 25 bp, E. coli
tttacagacacaaaaaagctcccgg

SEQ ID NO: 46298 - DNA, 25 bp, E. coli
tttacagacacataaaagctcccgg

SEQ ID NO: 46299 - DNA, 25 bp, E. coli
tgcttaatgccgcatccgggctgca

SEQ ID NO: 46300 - DNA, 25 bp, E. coli
tgcttaatgccggatccgggctgca

SEQ ID NO: 46301 - DNA, 25 bp, E. coli
tccgggctgcaataccaatgggctg

SEQ ID NO: 46302 - DNA, 25 bp, E. coli
tccgggctgcaaaaccaatgggctg

SEQ ID NO: 46303 - DNA, 25 bp, E. coli
gaatgtaaatcagccactgtgtcgc

SEQ ID NO: 46304 - DNA, 25 bp, E. coli
gaatgtaaatcacccactgtgtcgc

SEQ ID NO: 46305 - DNA, 25 bp, E. coli
gacacggcaaaccacccattgtcgt

SEQ ID NO: 46306 - DNA, 25 bp, E. coli
gacacggcaaacgacccattgtcgt

SEQ ID NO: 46307 - DNA, 25 bp, E. coli
gatagtggttggtgcttaatgccgc

SEQ ID NO: 46308 - DNA, 25 bp, E. coli
gatagtggttggagcttaatgccgc

SEQ ID NO: 46309 - DNA, 25 bp, E. coli
ggtttatgtctcgtccgctgtttga

SEQ ID NO: 46310 - DNA, 25 bp, E. coli
ggtttatgtctcctccgctgtttga

SEQ ID NO: 46311 - DNA, 25 bp, E. coli
taaattcaccgtcaaggaggccatc

SEQ ID NO: 46312 - DNA, 25 bp, E. coli
taaattcaccgtgaaggaggccatc

SEQ ID NO: 46313 - DNA, 25 bp, E. coli
acgagcaaggcatcaagcaggtggc

SEQ ID NO: 46314 - DNA, 25 bp, E. coli
acgagcaaggcaacaagcaggtggc

SEQ ID NO: 46315 - DNA, 25 bp, E. coli
tatgaagaagtgagcgccagatatc

SEQ ID NO: 46316 - DNA, 25 bp, E. coli
tatgaagaagtgtgcgccagatatc

SEQ ID NO: 46317 - DNA, 25 bp, E. coli
tggtggaaacctttctgcccgtcgg

SEQ ID NO: 46318 - DNA, 25 bp, E. coli
tgtaccgatatctcgcgcgacggca

SEQ ID NO: 46319 - DNA, 25 bp, E. coli
tgtaccgatatcacgcgcgacggca

SEQ ID NO: 46320 - DNA, 25 bp, E. coli
tggtggaaacctatctgcccgtcgg

SEQ ID NO: 46321 - DNA, 25 bp, E. coli
tccatcagggcgattacggcaaaca

SEQ ID NO: 46322 - DNA, 25 bp, E. coli
tcccgctgattataaccctggtcgc

SEQ ID NO: 46323 - DNA, 25 bp, E. coli
tcccgctgattaaaaccctggtcgc

SEQ ID NO: 46324 - DNA, 25 bp, E. coli
tgcccgtcggccagaaacatgtgct

SEQ ID NO: 46325 - DNA, 25 bp, E. coli
tgcccgtcggcctgaaacatgtgct

SEQ ID NO: 46326 - DNA, 25 bp, E. coli
tccatcagggcgtttacggcaaaca

SEQ ID NO: 46327 - DNA, 25 bp, E. coli
cgctggatgtccctattgacgagca

SEQ ID NO: 46328 - DNA, 25 bp, E. coli
cgctggatgtccgtattgacgagca

SEQ ID NO: 46329 - DNA, 25 bp, E. coli
cggcattagattaaatcgacggcac

SEQ ID NO: 46330 - DNA, 25 bp, E. coli
cggcattagatttaatcgacggcac

SEQ ID NO: 46331 - DNA, 25 bp, E. coli
tcactggaacaagtggtggaaacct

SEQ ID NO: 46332 - DNA, 25 bp, E. coli
tcactggaacaactggtggaaacct

SEQ ID NO: 46333 - DNA, 25 bp, E. coli
aagaaattatgcctggcagtctcct

SEQ ID NO: 46334 - DNA, 25 bp, E. coli
aattatgcgtgggagtctcctttcg

SEQ ID NO: 46335 - DNA, 25 bp, E. coli
aattatgcgtggcagtctcctttcg

SEQ ID NO: 46336 - DNA, 25 bp, E. coli
caattgatggaataacgctccggca

SEQ ID NO: 46337 - DNA, 25 bp, E. coli
caattgatggaaaaacgctccggca

SEQ ID NO: 46338 - DNA, 25 bp, E. coli
aagaaattatgcgtggcagtctcct

SEQ ID NO: 46339 - DNA, 25 bp, E. coli
attatgcgtggctgtctcctttcgg

SEQ ID NO: 46340 - DNA, 25 bp, E. coli
attatgcgtggcagtctcctttcgg

SEQ ID NO: 46341 - DNA, 25 bp, E. coli
aaatgacggtcagatattatatcag

SEQ ID NO: 46342 - DNA, 25 bp, E. coli
aaatgacggtcacatattatatcag

SEQ ID NO: 46343 - DNA, 25 bp, E. coli
tatgcgtggcagtctcctttcggtc

SEQ ID NO: 46344 - DNA, 25 bp, E. coli
tatgcgtggcagactcctttcggtc

SEQ ID NO: 46345 - DNA, 25 bp, E. coli
tgaagaaattatgcgtggcagtctc

SEQ ID NO: 46346 - DNA, 25 bp, E. coli
tgaagaaattatccgtggcagtctc

SEQ ID NO: 46347 - DNA, 25 bp, E. coli
tcagatattatatcagttctgctga

SEQ ID NO: 46348 - DNA, 25 bp, E. coli
gaaattatgcgtggcagtctccttt

SEQ ID NO: 46349 - DNA, 25 bp, E. coli
gaaattatgcgtcgcagtctccttt

SEQ ID NO: 46350 - DNA, 25 bp, E. coli
cggtcagatattatatcagttctgc

SEQ ID NO: 46351 - DNA, 25 bp, E. coli
ctgaagaaattatgcgtggcagtct

SEQ ID NO: 46352 - DNA, 25 bp, E. coli
cggtcagatattttatcagttctgc

SEQ ID NO: 46353 - DNA, 25 bp, E. coli
ctgaagaaattaagcgtggcagtct

SEQ ID NO: 46354 - DNA, 25 bp, E. coli
tcagatattataacagttctgctga

SEQ ID NO: 46355 - DNA, 25 bp, E. coli
aggagacataatggcatggctgaaa

SEQ ID NO: 46356 - DNA, 25 bp, E. coli
acataatggcatcgctgaaagtact

SEQ ID NO: 46357 - DNA, 25 bp, E. coli
aggagacataatcgcatggctgaaa

SEQ ID NO: 46358 - DNA, 25 bp, E. coli
acataatggcatggctgaaagtact

SEQ ID NO: 46359 - DNA, 25 bp, E. coli
actggttatcgcctgtttgccaggc

SEQ ID NO: 46360 - DNA, 25 bp, E. coli
actggttatcgcgtgtttgccaggc

SEQ ID NO: 46361 - DNA, 25 bp, E. coli
tatcgcctgtttgccaggctacgaa

SEQ ID NO: 46362 - DNA, 25 bp, E. coli
tatcgcctgtttcccaggctacgaa

SEQ ID NO: 46363 - DNA, 25 bp, E. coli
tttgccaggctacgaaacaatcggt

SEQ ID NO: 46364 - DNA, 25 bp, E. coli
tttgccaggctaggaaacaatcggt

SEQ ID NO: 46365 - DNA, 25 bp, E. coli
ttcactaacattgcaccgtaaagga

SEQ ID NO: 46366 - DNA, 25 bp, E. coli
ttcactaacattccaccgtaaagga

SEQ ID NO: 46367 - DNA, 25 bp, E. coli
tgcaccgtaaagcaaaagggatgcg

SEQ ID NO: 46368 - DNA, 25 bp, E. coli
tgcaccgtaaaggaaaagggatgcg

SEQ ID NO: 46369 - DNA, 25 bp, E. coli
ctacgaaacaatgggtacctgggct

SEQ ID NO: 46370 - DNA, 25 bp, E. coli
ctacgaaacaatcggtacctgggct

SEQ ID NO: 46371 - DNA, 25 bp, E. coli
ggcgtttctggtttcactaacattg

SEQ ID NO: 46372 - DNA, 25 bp, E. coli
ggcgtttctggtatcactaacattg

SEQ ID NO: 46373 - DNA, 25 bp, E. coli
taaaggaaaaggcatgcggctttag

SEQ ID NO: 46374 - DNA, 25 bp, E. coli
taacattgcaccgtaaaggaaaagg

SEQ ID NO: 46375 - DNA, 25 bp, E. coli
taacattgcaccctaaaggaaaagg

SEQ ID NO: 46376 - DNA, 25 bp, E. coli
taaaggaaaagggatgcggctttag

SEQ ID NO: 46377 - DNA, 25 bp, E. coli
cataaccgctatcgctggactgtcg

SEQ ID NO: 46378 - DNA, 25 bp, E. coli
cataaccgctatggctggactgtcg

SEQ ID NO: 46379 - DNA, 25 bp, E. coli
atcaacagaaacataaaaaactgcg

SEQ ID NO: 46380 - DNA, 25 bp, E. coli
agagtgcagggcgatcaaggcggag

SEQ ID NO: 46381 - DNA, 25 bp, E. coli
atcaacagaaacttaaaaaactgcg

SEQ ID NO: 46382 - DNA, 25 bp, E. coli
agagtgcagggccatcaaggcggag

SEQ ID NO: 46383 - DNA, 25 bp, E. coli
tatcgcgtcgaactgattagccgca

SEQ ID NO: 46384 - DNA, 25 bp, E. coli
tatcgcgtcgaagtgattagccgca

SEQ ID NO: 46385 - DNA, 25 bp, E. coli
tatcaacagaaagttaaaaaactgc

SEQ ID NO: 46386 - DNA, 25 bp, E. coli
tatcaacagaaacttaaaaaactgc

SEQ ID NO: 46387 - DNA, 25 bp, E. coli
tgattagccgcatcgggcaggaagc

SEQ ID NO: 46388 - DNA, 25 bp, E. coli
tgattagccgcaacgggcaggaagc

SEQ ID NO: 46389 - DNA, 25 bp, E. coli
gcggagtatcaagagaaacttaaaa

SEQ ID NO: 46390 - DNA, 25 bp, E. coli
gcggagtatcaacagaaacttaaaa

SEQ ID NO: 46391 - DNA, 25 bp, E. coli
gtatcaacagaatcttaaaaaactg

SEQ ID NO: 46392 - DNA, 25 bp, E. coli
gtatcaacagaaacttaaaaaactg

SEQ ID NO: 46393 - DNA, 25 bp, E. coli
gtgcagggccatgaaggcggagtat

SEQ ID NO: 46394 - DNA, 25 bp, E. coli
gtgcagggccatcaaggcggagtat

SEQ ID NO: 46395 - DNA, 25 bp, E. coli
tcaacagaaacttaaaaaactgcga

SEQ ID NO: 46396 - DNA, 25 bp, E. coli
tcaacagaaactaaaaaaactgcga

SEQ ID NO: 46397 - DNA, 25 bp, E. coli
gagtgcagggccttcaaggcggagt

SEQ ID NO: 46398 - DNA, 25 bp, E. coli
gagtgcagggccatcaaggcggagt

SEQ ID NO: 46399 - DNA, 25 bp, E. coli
caccagtaggtcttcgccaggaaga

SEQ ID NO: 46400 - DNA, 25 bp, E. coli
caccagtaggtcatcgccaggaaga

SEQ ID NO: 46401 - DNA, 25 bp, E. coli
tacgccgtgtggatgaactggaaaa

SEQ ID NO: 46402 - DNA, 25 bp, E. coli
tacgccgtgtggttgaactggaaaa

SEQ ID NO: 46403 - DNA, 25 bp, E. coli
tgttgttgacgcgattgaacgcgcg

SEQ ID NO: 46404 - DNA, 25 bp, E. coli
tgttgttgacgccattgaacgcgcg

SEQ ID NO: 46405 - DNA, 25 bp, E. coli
tgaacgtgcgcaggagattgcccgt

SEQ ID NO: 46406 - DNA, 25 bp, E. coli
tgaacgtgcgcacgagattgcccgt

SEQ ID NO: 46407 - DNA, 25 bp, E. coli
tgccggagatcgtagctattgccac

SEQ ID NO: 46408 - DNA, 25 bp, E. coli
tgcgctcgcgcaacgaaattaacga

SEQ ID NO: 46409 - DNA, 25 bp, E. coli
tgcgctcgcgcatcgaaattaacga

SEQ ID NO: 46410 - DNA, 25 bp, E. coli
tgccggagatcgaagctattgccac

SEQ ID NO: 46411 - DNA, 25 bp, E. coli
gctatccctgcattgtaaaaccggt

SEQ ID NO: 46412 - DNA, 25 bp, E. coli
gctatccctgcaatgtaaaaccggt

SEQ ID NO: 46413 - DNA, 25 bp, E. coli
gactgaatgttgtcccctgcgctcg

SEQ ID NO: 46414 - DNA, 25 bp, E. coli
gaaattaccctggtaaccgtcagcg

SEQ ID NO: 46415 - DNA, 25 bp, E. coli
gaaattaccctgctaaccgtcagcg

SEQ ID NO: 46416 - DNA, 25 bp, E. coli
gactgaatgttgacccctgcgctcg

SEQ ID NO: 46417 - DNA, 25 bp, E. coli
taagccggaaattgatggcagccgt

SEQ ID NO: 46418 - DNA, 25 bp, E. coli
taagccggaaatagatggcagccgt

SEQ ID NO: 46419 - DNA, 25 bp, E. coli
taatgtgcagaatgccgtaggcgca

SEQ ID NO: 46420 - DNA, 25 bp, E. coli
taatgtgcagaaagccgtaggcgca

SEQ ID NO: 46421 - DNA, 25 bp, E. coli
caatcggcagaacagtatcgtcagt

SEQ ID NO: 46422 - DNA, 25 bp, E. coli
caatcggcagaagagtatcgtcagt

SEQ ID NO: 46423 - DNA, 25 bp, E. coli
cactggatgaacgagatgaccgggt

SEQ ID NO: 46424 - DNA, 25 bp, E. coli
cactggatgaaccagatgaccgggt

SEQ ID NO: 46425 - DNA, 25 bp, E. coli
cagatcaatctcaaaccactggatg

SEQ ID NO: 46426 - DNA, 25 bp, E. coli
cagatcaatctctaaccactggatg

SEQ ID NO: 46427 - DNA, 25 bp, E. coli
taccggcgcgaaggttaactcagcg

SEQ ID NO: 46428 - DNA, 25 bp, E. coli
taccggcgcgaacgttaactcagcg

SEQ ID NO: 46429 - DNA, 25 bp, E. coli
tgtcaatgtcgacagggacagcgcc

SEQ ID NO: 46430 - DNA, 25 bp, E. coli
tgtcaatgtcgagagggacagcgcc

SEQ ID NO: 46431 - DNA, 25 bp, E. coli
tgatggcactaaccatcgccaccgg

SEQ ID NO: 46432 - DNA, 25 bp, E. coli
tgatggcactaagcatcgccaccgg

SEQ ID NO: 46433 - DNA, 25 bp, E. coli
tccaattcgtctaggcgatgtcgct

SEQ ID NO: 46434 - DNA, 25 bp, E. coli
tcgccgcgcgaagctatttaccagg

SEQ ID NO: 46435 - DNA, 25 bp, E. coli
tcgccgcgcgaacctatttaccagg

SEQ ID NO: 46436 - DNA, 25 bp, E. coli
tccaattcgtcttggcgatgtcgct

SEQ ID NO: 46437 - DNA, 25 bp, E. coli
cgctgtcagcgattgaccagatgca

SEQ ID NO: 46438 - DNA, 25 bp, E. coli
cgctgtcagcgaatgaccagatgca

SEQ ID NO: 46439 - DNA, 25 bp, E. coli
gattatcgcttaacagaacggcgct

SEQ ID NO: 46440 - DNA, 25 bp, E. coli
gattatcgcttatcagaacggcgct

SEQ ID NO: 46441 - DNA, 25 bp, E. coli
taactcagcgaatgggagccttgac

SEQ ID NO: 46442 - DNA, 25 bp, E. coli
taactcagcgaaagggagccttgac

SEQ ID NO: 46443 - DNA, 25 bp, E. coli
cactttattcgtttgcatcagtgga

SEQ ID NO: 46444 - DNA, 25 bp, E. coli
cactttattcgtatgcatcagtgga

SEQ ID NO: 46445 - DNA, 25 bp, E. coli
caaatcttcgttcgccgctggtggc

SEQ ID NO: 46446 - DNA, 25 bp, E. coli
caaatcttcgttggccgctggtggc

SEQ ID NO: 46447 - DNA, 25 bp, E. coli
tttacaggcgtcaaatcttcgttcg

SEQ ID NO: 46448 - DNA, 25 bp, E. coli
tttacaggcgtctaatcttcgttcg

SEQ ID NO: 46449 - DNA, 25 bp, E. coli
tgcgtttcctctatgccattgagct

SEQ ID NO: 46450 - DNA, 25 bp, E. coli
tttttagtcgttgaagagacgatta

SEQ ID NO: 46451 - DNA, 25 bp, E. coli
tgcgtttcctctttgccattgagct

SEQ ID NO: 46452 - DNA, 25 bp, E. coli
tttttagtcgttcaagagacgatta

SEQ ID NO: 46453 - DNA, 25 bp, E. coli
gccttttacaaacggtgtcatctaa

SEQ ID NO: 46454 - DNA, 25 bp, E. coli
gccttttacaaagggtgtcatctaa

SEQ ID NO: 46455 - DNA, 25 bp, E. coli
gcgcgcagccgctacactttattcg

SEQ ID NO: 46456 - DNA, 25 bp, E. coli
gcgcgcagccgcaacactttattcg

SEQ ID NO: 46457 - DNA, 25 bp, E. coli
gaagccgatgaaaccttagtggaag

SEQ ID NO: 46458 - DNA, 25 bp, E. coli
gaagccgatgaatccttagtggaag

SEQ ID NO: 46459 - DNA, 25 bp, E. coli
cattgagcttgaccaaatatgcccg

SEQ ID NO: 46460 - DNA, 25 bp, E. coli
cattgagcttgagcaaatatgcccg

SEQ ID NO: 46461 - DNA, 25 bp, E. coli
gtcagcgccgaagaaattttacagg

SEQ ID NO: 46462 - DNA, 25 bp, E. coli
gtcagcgccgaacaaattttacagg

SEQ ID NO: 46463 - DNA, 25 bp, E. coli
tggcgattttaagtggccttttaca

SEQ ID NO: 46464 - DNA, 25 bp, E. coli
tggcgattttaactggccttttaca

SEQ ID NO: 46465 - DNA, 25 bp, E. coli
aatacagtagtaatttgcagacaaa

SEQ ID NO: 46466 - DNA, 25 bp, E. coli
aatacagtagtattttgcagacaaa

SEQ ID NO: 46467 - DNA, 25 bp, E. coli
catggaacaaatcaaagttactcct

SEQ ID NO: 46468 - DNA, 25 bp, E. coli
catggaacaaatgaaagttactcct

SEQ ID NO: 46469 - DNA, 25 bp, E. coli
tatgtcgaaaaaaggacggcgatga

SEQ ID NO: 46470 - DNA, 25 bp, E. coli
tatgtcgaaaaatggacggcgatga

SEQ ID NO: 46471 - DNA, 25 bp, E. coli
tttagccggatagtgaaaaacatcc

SEQ ID NO: 46472 - DNA, 25 bp, E. coli
ttatggcctcatgccttttagccgg

SEQ ID NO: 46473 - DNA, 25 bp, E. coli
tttagccggatactgaaaaacatcc

SEQ ID NO: 46474 - DNA, 25 bp, E. coli
ttatggcctcatcccttttagccgg

SEQ ID NO: 46475 - DNA, 25 bp, E. coli
tgcagacaaaaaatccgtaaatgga

SEQ ID NO: 46476 - DNA, 25 bp, E. coli
tgcagacaaaaattccgtaaatgga

SEQ ID NO: 46477 - DNA, 25 bp, E. coli
gccgtccatttactcctgaatacag

SEQ ID NO: 46478 - DNA, 25 bp, E. coli
gccgtccatttagtcctgaatacag

SEQ ID NO: 46479 - DNA, 25 bp, E. coli
gcgatgatacatggccgtccattta

SEQ ID NO: 46480 - DNA, 25 bp, E. coli
gcgatgatacatcgccgtccattta

SEQ ID NO: 46481 - DNA, 25 bp, E. coli
gacccctgaaaatgtggttaacatg

SEQ ID NO: 46482 - DNA, 25 bp, E. coli
gacccctgaaaaagtggttaacatg

SEQ ID NO: 46483 - DNA, 25 bp, E. coli
gaaaaacatccttcgagagggacgg

SEQ ID NO: 46484 - DNA, 25 bp, E. coli
gaaaaacatcctacgagagggacgg

SEQ ID NO: 46485 - DNA, 25 bp, E. coli
gtaattgttatgtcttatggcctca

SEQ ID NO: 46486 - DNA, 25 bp, E. coli
gtaattgttatgacttatggcctca

SEQ ID NO: 46487 - DNA, 25 bp, E. coli
cacagataaatgaaagcaaggaaac

SEQ ID NO: 46488 - DNA, 25 bp, E. coli
cacagataaatgtaagcaaggaaac

SEQ ID NO: 46489 - DNA, 25 bp, E. coli
catattaaaagagtttctcttccag

SEQ ID NO: 46490 - DNA, 25 bp, E. coli
catattaaaagactttctcttccag

SEQ ID NO: 46491 - DNA, 25 bp, E. coli
agtattccccaatcagtgtagtgcc

SEQ ID NO: 46492 - DNA, 25 bp, E. coli
agtattccccaaacagtgtagtgcc

SEQ ID NO: 46493 - DNA, 25 bp, E. coli
tattgcgtcacttaatggacattgg

SEQ ID NO: 46494 - DNA, 25 bp, E. coli
tattacaaagtatatattgcgtcac

SEQ ID NO: 46495 - DNA, 25 bp, E. coli
tattgcgtcactaaatggacattgg

SEQ ID NO: 46496 - DNA, 25 bp, E. coli
tattacaaagtaaatattgcgtcac

SEQ ID NO: 46497 - DNA, 25 bp, E. coli
ttgtccccgatcacactttttagtg

SEQ ID NO: 46498 - DNA, 25 bp, E. coli
ttgtccccgatctcactttttagtg

SEQ ID NO: 46499 - DNA, 25 bp, E. coli
ccagaacttctctaacctgtgttat

SEQ ID NO: 46500 - DNA, 25 bp, E. coli
ccagaacttctcaaacctgtgttat

SEQ ID NO: 46501 - DNA, 25 bp, E. coli
gtagtgcctttaaacataacgtgcg

SEQ ID NO: 46502 - DNA, 25 bp, E. coli
gtagtgcctttatacataacgtgcg

SEQ ID NO: 46503 - DNA, 25 bp, E. coli
ggttatcgcatagcttttaaggcca

SEQ ID NO: 46504 - DNA, 25 bp, E. coli
ggttatcgcataccttttaaggcca

SEQ ID NO: 46505 - DNA, 25 bp, E. coli
ggccatatgcttattctgatttcag

SEQ ID NO: 46506 - DNA, 25 bp, E. coli
ggccatatgctttttctgatttcag

SEQ ID NO: 46507 - DNA, 25 bp, E. coli
taacgtgcgtaattatattgtcccc

SEQ ID NO: 46508 - DNA, 25 bp, E. coli
taacgtgcgtaaatatattgtcccc

SEQ ID NO: 46509 - DNA, 25 bp, E. coli
aaccccagggcgcatatggcgttca

SEQ ID NO: 46510 - DNA, 25 bp, E. coli
aatggcactgaacgttaaatacccg

SEQ ID NO: 46511 - DNA, 25 bp, E. coli
aatggcactgaaggttaaatacccg

SEQ ID NO: 46512 - DNA, 25 bp, E. coli
tacagtgaacagtaccgtaggtcgg

SEQ ID NO: 46513 - DNA, 25 bp, E. coli
taaatagttgaccaatttactcggg

SEQ ID NO: 46514 - DNA, 25 bp, E. coli
taaatagttgacgaatttactcggg

SEQ ID NO: 46515 - DNA, 25 bp, E. coli
tacagtgaacagaaccgtaggtcgg

SEQ ID NO: 46516 - DNA, 25 bp, E. coli
taaatacccgacaaaatcagtcaag

SEQ ID NO: 46517 - DNA, 25 bp, E. coli
aaccccagggcggatatggcgttca

SEQ ID NO: 46518 - DNA, 25 bp, E. coli
tatcaggcctacagtgaacagaacc

SEQ ID NO: 46519 - DNA, 25 bp, E. coli
tatcaggcctactgtgaacagaacc

SEQ ID NO: 46520 - DNA, 25 bp, E. coli
tttactcgggaatgtcagacttgac

SEQ ID NO: 46521 - DNA, 25 bp, E. coli
tttactcgggaaagtcagacttgac

SEQ ID NO: 46522 - DNA, 25 bp, E. coli
gcctacagtgtagagaaccccaggg

SEQ ID NO: 46523 - DNA, 25 bp, E. coli
gcctacagtgtacagaaccccaggg

SEQ ID NO: 46524 - DNA, 25 bp, E. coli
gccgcatccgactacaggtacaaac

SEQ ID NO: 46525 - DNA, 25 bp, E. coli
gccgcatccgacaacaggtacaaac

SEQ ID NO: 46526 - DNA, 25 bp, E. coli
gacaacaggtacaaacgccacgata

SEQ ID NO: 46527 - DNA, 25 bp, E. coli
gacaacaggtactaacgccacgata

SEQ ID NO: 46528 - DNA, 25 bp, E. coli
tcagacttgaccgtgctatgcaata

SEQ ID NO: 46529 - DNA, 25 bp, E. coli
tcagacttgaccctgctatgcaata

SEQ ID NO: 46530 - DNA, 25 bp, E. coli
taaatacccgactaaatcagtcaag

SEQ ID NO: 46531 - DNA, 25 bp, E. coli
caataacgcgtattcatcagtgccg

SEQ ID NO: 46532 - DNA, 25 bp, E. coli
caataacgcgtaatcatcagtgccg

SEQ ID NO: 46533 - DNA, 25 bp, E. coli
caaaagccgggaaacacagagctgg

SEQ ID NO: 46534 - DNA, 25 bp, E. coli
caaacatgggctggcaaaagtgtag

SEQ ID NO: 46535 - DNA, 25 bp, E. coli
caaacatgggctcgcaaaagtgtag

SEQ ID NO: 46536 - DNA, 25 bp, E. coli
caaaagccgggatacacagagctgg

SEQ ID NO: 46537 - DNA, 25 bp, E. coli
catcagtgccgctcaatgtggcaac

SEQ ID NO: 46538 - DNA, 25 bp, E. coli
catgttgaacgggtatggcaggcac

SEQ ID NO: 46539 - DNA, 25 bp, E. coli
cattttatggaaaccgttagcccat

SEQ ID NO: 46540 - DNA, 25 bp, E. coli
catcagtgccgcacaatgtggcaac

SEQ ID NO: 46541 - DNA, 25 bp, E. coli
catgttgaacggctatggcaggcac

SEQ ID NO: 46542 - DNA, 25 bp, E. coli
cattttatggaatccgttagcccat

SEQ ID NO: 46543 - DNA, 25 bp, E. coli
attccccggaggcaaacatgggctg

SEQ ID NO: 46544 - DNA, 25 bp, E. coli
acccgaagttcagggtcatttatca

SEQ ID NO: 46545 - DNA, 25 bp, E. coli
acccgaagttcacggtcatttatca

SEQ ID NO: 46546 - DNA, 25 bp, E. coli
attccccggagggaaacatgggctg

SEQ ID NO: 46547 - DNA, 25 bp, E. coli
gctggctgaaggtgaacccgaagtt

SEQ ID NO: 46548 - DNA, 25 bp, E. coli
gctggctgaaggagaacccgaagtt

SEQ ID NO: 46549 - DNA, 25 bp, E. coli
ggcaggcacttctcgacacaataac

SEQ ID NO: 46550 - DNA, 25 bp, E. coli
ggcaggcacttcacgacacaataac

SEQ ID NO: 46551 - DNA, 25 bp, E. coli
tggcaactgttgtaaaaagttcgcc

SEQ ID NO: 46552 - DNA, 25 bp, E. coli
tggcaactgttgaaaaaagttcgcc

SEQ ID NO: 46553 - DNA, 25 bp, E. coli
agtaggcattatgtttggcgcactg

SEQ ID NO: 46554 - DNA, 25 bp, E. coli
agtaggcattatctttggcgcactg

SEQ ID NO: 46555 - DNA, 25 bp, E. coli
tatctcctggttatttgcgctggcg

SEQ ID NO: 46556 - DNA, 25 bp, E. coli
tagccataacattacactaacaaat

SEQ ID NO: 46557 - DNA, 25 bp, E. coli
tagccataacataacactaacaaat

SEQ ID NO: 46558 - DNA, 25 bp, E. coli
tatctcctggttttttgcgctggcg

SEQ ID NO: 46559 - DNA, 25 bp, E. coli
tgcgtaatagccataacattacact

SEQ ID NO: 46560 - DNA, 25 bp, E. coli
tcctggttatttccgctggcgatgc

SEQ ID NO: 46561 - DNA, 25 bp, E. coli
tcctggttatttgcgctggcgatgc

SEQ ID NO: 46562 - DNA, 25 bp, E. coli
tgcgtaatagccttaacattacact

SEQ ID NO: 46563 - DNA, 25 bp, E. coli
tcactgcctggtgccgtggtcggtt

SEQ ID NO: 46564 - DNA, 25 bp, E. coli
tcactgcctggtcccgtggtcggtt

SEQ ID NO: 46565 - DNA, 25 bp, E. coli
gctggcgatgcccatgttgatttat

SEQ ID NO: 46566 - DNA, 25 bp, E. coli
gctggcgatgccgatgttgatttat

SEQ ID NO: 46567 - DNA, 25 bp, E. coli
gaaaccacatggacactgcctggtg

SEQ ID NO: 46568 - DNA, 25 bp, E. coli
gacagtaggcattatgtttggcgca

SEQ ID NO: 46569 - DNA, 25 bp, E. coli
gacagtaggcataatgtttggcgca

SEQ ID NO: 46570 - DNA, 25 bp, E. coli
gaaaccacatggtcactgcctggtg

SEQ ID NO: 46571 - DNA, 25 bp, E. coli
ggatgaagaaaccacatggtcactg

SEQ ID NO: 46572 - DNA, 25 bp, E. coli
gtggtcggttttatctcctggttat

SEQ ID NO: 46573 - DNA, 25 bp, E. coli
gtggtcggttttttctcctggttat

SEQ ID NO: 46574 - DNA, 25 bp, E. coli
ggatgaagaaacgacatggtcactg

SEQ ID NO: 46575 - DNA, 25 bp, E. coli
aataatgccggagaaatgactgcgc

SEQ ID NO: 46576 - DNA, 25 bp, E. coli
aataatgccggacaaatgactgcgc

SEQ ID NO: 46577 - DNA, 25 bp, E. coli
tactgctatcaaggaccagacgggt

SEQ ID NO: 46578 - DNA, 25 bp, E. coli
tactgctatcaacgaccagacgggt

SEQ ID NO: 46579 - DNA, 25 bp, E. coli
taactatttatatcgccggcgcagg

SEQ ID NO: 46580 - DNA, 25 bp, E. coli
tatacgttgccgcatgtgccgaagc

SEQ ID NO: 46581 - DNA, 25 bp, E. coli
tatcaatgttggaactggtcaggcg

SEQ ID NO: 46582 - DNA, 25 bp, E. coli
tatacgttgccggatgtgccgaagc

SEQ ID NO: 46583 - DNA, 25 bp, E. coli
tatcaatgttggtactggtcaggcg

SEQ ID NO: 46584 - DNA, 25 bp, E. coli
tctggactgatcaagcagggcgaca

SEQ ID NO: 46585 - DNA, 25 bp, E. coli
tcagctttcaataaccgcggcgagt

SEQ ID NO: 46586 - DNA, 25 bp, E. coli
tctggactgatctagcagggcgaca

SEQ ID NO: 46587 - DNA, 25 bp, E. coli
tcagctttcaattaccgcggcgagt

SEQ ID NO: 46588 - DNA, 25 bp, E. coli
ccatatgcgggtctaaaactgcgtc

SEQ ID NO: 46589 - DNA, 25 bp, E. coli
ccatatgcgggtgtaaaactgcgtc

SEQ ID NO: 46590 - DNA, 25 bp, E. coli
gcatcaatagcctgacaagcgtcgg

SEQ ID NO: 46591 - DNA, 25 bp, E. coli
gcatcaatagccagacaagcgtcgg

SEQ ID NO: 46592 - DNA, 25 bp, E. coli
gtaattcttcccacaacggagccgt

SEQ ID NO: 46593 - DNA, 25 bp, E. coli
gtaattcttccctcaacggagccgt

SEQ ID NO: 46594 - DNA, 25 bp, E. coli
taactatttataacgccggcgcagg

SEQ ID NO: 46595 - DNA, 25 bp, E. coli
tcaataaaatcgagcagaacgcggg

SEQ ID NO: 46596 - DNA, 25 bp, E. coli
tcaataaaatcgtgcagaacgcggg

SEQ ID NO: 46597 - DNA, 25 bp, E. coli
caacacttttatctggtcaccccgg

SEQ ID NO: 46598 - DNA, 25 bp, E. coli
caacacttttatgtggtcaccccgg

SEQ ID NO: 46599 - DNA, 25 bp, E. coli
aacaggtgtccggagaacgggtcat

SEQ ID NO: 46600 - DNA, 25 bp, E. coli
aacaggtgtccgcagaacgggtcat

SEQ ID NO: 46601 - DNA, 25 bp, E. coli
ttttatctggtctccccggcgtccg

SEQ ID NO: 46602 - DNA, 25 bp, E. coli
ttttatctggtcaccccggcgtccg

SEQ ID NO: 46603 - DNA, 25 bp, E. coli
tgcaccttgccgtcacgggtgactg

SEQ ID NO: 46604 - DNA, 25 bp, E. coli
tgcaccttgccgacacgggtgactg

SEQ ID NO: 46605 - DNA, 25 bp, E. coli
tccggagaacgggtcatccttcagg

SEQ ID NO: 46606 - DNA, 25 bp, E. coli
tccggagaacggctcatccttcagg

SEQ ID NO: 46607 - DNA, 25 bp, E. coli
ccttcaggacgttctgaacttttga

SEQ ID NO: 46608 - DNA, 25 bp, E. coli
ccttcaggacgtactgaacttttga

SEQ ID NO: 46609 - DNA, 25 bp, E. coli
gagaacgggtcaaccttcaggacgt

SEQ ID NO: 46610 - DNA, 25 bp, E. coli
gagaacgggtcatccttcaggacgt

SEQ ID NO: 46611 - DNA, 25 bp, E. coli
cgggtcatccttcaggacgttctga

SEQ ID NO: 46612 - DNA, 25 bp, E. coli
cgggtcatccttgaggacgttctga

SEQ ID NO: 46613 - DNA, 25 bp, E. coli
tcacgggtgactcgccagacgaagc

SEQ ID NO: 46614 - DNA, 25 bp, E. coli
tcactgtcagcccacaacactttta

SEQ ID NO: 46615 - DNA, 25 bp, E. coli
tcactgtcagccgacaacactttta

SEQ ID NO: 46616 - DNA, 25 bp, E. coli
tcaccccggcgtgcgcggaagatga

SEQ ID NO: 46617 - DNA, 25 bp, E. coli
tcaccccggcgtccgcggaagatga

SEQ ID NO: 46618 - DNA, 25 bp, E. coli
tcacgggtgactggccagacgaagc

SEQ ID NO: 46619 - DNA, 25 bp, E. coli
cactacacttcctctgttgcgtcag

SEQ ID NO: 46620 - DNA, 25 bp, E. coli
cactacacttccactgttgcgtcag

SEQ ID NO: 46621 - DNA, 25 bp, E. coli
tattcccgctttgtcgtctgctgta

SEQ ID NO: 46622 - DNA, 25 bp, E. coli
tattcccgctttctcgtctgctgta

SEQ ID NO: 46623 - DNA, 25 bp, E. coli
ttctcgtctgctctaattttcccca

SEQ ID NO: 46624 - DNA, 25 bp, E. coli
ttgcgtcaggcgattgtcgccatac

SEQ ID NO: 46625 - DNA, 25 bp, E. coli
ttctcgtctgctgtaattttcccca

SEQ ID NO: 46626 - DNA, 25 bp, E. coli
ttgcgtcaggcgtttgtcgccatac

SEQ ID NO: 46627 - DNA, 25 bp, E. coli
tgtaattttcccgactacacttcca

SEQ ID NO: 46628 - DNA, 25 bp, E. coli
tgtaattttccccactacacttcca

SEQ ID NO: 46629 - DNA, 25 bp, E. coli
tcgtctgctgtatttttccccacta

SEQ ID NO: 46630 - DNA, 25 bp, E. coli
tcgtctgctgtaattttccccacta

SEQ ID NO: 46631 - DNA, 25 bp, E. coli
tgcgtcaggcgtttgtcgccatacg

SEQ ID NO: 46632 - DNA, 25 bp, E. coli
tgcgtcaggcgtatgtcgccatacg

SEQ ID NO: 46633 - DNA, 25 bp, E. coli
gcgtcaggcgttagtcgccatacgc

SEQ ID NO: 46634 - DNA, 25 bp, E. coli
gcgtcaggcgtttgtcgccatacgc

SEQ ID NO: 46635 - DNA, 25 bp, E. coli
cgtcaggcgtttctcgccatacgct

SEQ ID NO: 46636 - DNA, 25 bp, E. coli
cgtcaggcgtttgtcgccatacgct

SEQ ID NO: 46637 - DNA, 25 bp, E. coli
gttgcgtcaggcctttgtcgccata

SEQ ID NO: 46638 - DNA, 25 bp, E. coli
gttgcgtcaggcgtttgtcgccata

SEQ ID NO: 46639 - DNA, 25 bp, E. coli
ggcgaatttattgccgctttctcgt

SEQ ID NO: 46640 - DNA, 25 bp, E. coli
ggcgaatttattcccgctttctcgt

SEQ ID NO: 46641 - DNA, 25 bp, E. coli
cacagcggcccgctcattatggcgg

SEQ ID NO: 46642 - DNA, 25 bp, E. coli
cacagcggcccggtcattatggcgg

SEQ ID NO: 46643 - DNA, 25 bp, E. coli
cagtgtattgctccccgttacgtga

SEQ ID NO: 46644 - DNA, 25 bp, E. coli
catctggtgttaatgcaggaagcgc

SEQ ID NO: 46645 - DNA, 25 bp, E. coli
cagtgtattgctgcccgttacgtga

SEQ ID NO: 46646 - DNA, 25 bp, E. coli
catctggtgttattgcaggaagcgc

SEQ ID NO: 46647 - DNA, 25 bp, E. coli
tacgtgaacgagaacccattttgcg

SEQ ID NO: 46648 - DNA, 25 bp, E. coli
tacgtgaacgagtacccattttgcg

SEQ ID NO: 46649 - DNA, 25 bp, E. coli
tatgccatgcgctatgttgccggac

SEQ ID NO: 46650 - DNA, 25 bp, E. coli
tatgccatgcgcaatgttgccggac

SEQ ID NO: 46651 - DNA, 25 bp, E. coli
tcgttgaattcagtcccggcaagcc

SEQ ID NO: 46652 - DNA, 25 bp, E. coli
tgcgaaaaaacacctatgccatgcg

SEQ ID NO: 46653 - DNA, 25 bp, E. coli
tgcgaaaaaacagctatgccatgcg

SEQ ID NO: 46654 - DNA, 25 bp, E. coli
tcgttgaattcactcccggcaagcc

SEQ ID NO: 46655 - DNA, 25 bp, E. coli
tctggcgtaatgaccctttcggcgg

SEQ ID NO: 46656 - DNA, 25 bp, E. coli
tcttttgcgagcttcggccaggcat

SEQ ID NO: 46657 - DNA, 25 bp, E. coli
tcttttgcgagcatcggccaggcat

SEQ ID NO: 46658 - DNA, 25 bp, E. coli
tctggcgtaatgtccctttcggcgg

SEQ ID NO: 46659 - DNA, 25 bp, E. coli
gaagcttctgtagtggttacgcgcg

SEQ ID NO: 46660 - DNA, 25 bp, E. coli
gaagcttctgtactggttacgcgcg

SEQ ID NO: 46661 - DNA, 25 bp, E. coli
gaacatatacaaacagcaacgcgct

SEQ ID NO: 46662 - DNA, 25 bp, E. coli
gaacatatacaatcagcaacgcgct

SEQ ID NO: 46663 - DNA, 25 bp, E. coli
caacggtgtgggtgctattagccga

SEQ ID NO: 46664 - DNA, 25 bp, E. coli
caacggtgtgggagctattagccga

SEQ ID NO: 46665 - DNA, 25 bp, E. coli
aacaaagagtcaacagcaaggtgct

SEQ ID NO: 46666 - DNA, 25 bp, E. coli
aacaaagagtcatcagcaaggtgct

SEQ ID NO: 46667 - DNA, 25 bp, E. coli
taggccgtttgcattcagggatcac

SEQ ID NO: 46668 - DNA, 25 bp, E. coli
taggccgtttgctttcagggatcac

SEQ ID NO: 46669 - DNA, 25 bp, E. coli
tatttttcagcggaattgataggcc

SEQ ID NO: 46670 - DNA, 25 bp, E. coli
tatttttcagcgcaattgataggcc

SEQ ID NO: 46671 - DNA, 25 bp, E. coli
ttgtcattaataggcgcatcgctgg

SEQ ID NO: 46672 - DNA, 25 bp, E. coli
ttgtcattaatacgcgcatcgctgg

SEQ ID NO: 46673 - DNA, 25 bp, E. coli
tgataggccaaaatcccgcaacggt

SEQ ID NO: 46674 - DNA, 25 bp, E. coli
tgataggccaaattcccgcaacggt

SEQ ID NO: 46675 - DNA, 25 bp, E. coli
ccttggcttggaaaaatgtctgacc

SEQ ID NO: 46676 - DNA, 25 bp, E. coli
ccttggcttggataaatgtctgacc

SEQ ID NO: 46677 - DNA, 25 bp, E. coli
gcaggagagattacaccgcatagtc

SEQ ID NO: 46678 - DNA, 25 bp, E. coli
gcaggagagatttcaccgcatagtc

SEQ ID NO: 46679 - DNA, 25 bp, E. coli
gcttcggaagatatcgctaaccact

SEQ ID NO: 46680 - DNA, 25 bp, E. coli
gcttcggaagatttcgctaaccact

SEQ ID NO: 46681 - DNA, 25 bp, E. coli
ggtgagccttaccaatgcaaccggt

SEQ ID NO: 46682 - DNA, 25 bp, E. coli
ggtgagccttacgaatgcaaccggt

SEQ ID NO: 46683 - DNA, 25 bp, E. coli
tccaagcctttgaggcaggaagaat

SEQ ID NO: 46684 - DNA, 25 bp, E. coli
tccaagcctttgtggcaggaagaat

SEQ ID NO: 46685 - DNA, 25 bp, E. coli
cagcggaccgtaagcttgactgatg

SEQ ID NO: 46686 - DNA, 25 bp, E. coli
cagcggaccgtatgcttgactgatg

SEQ ID NO: 46687 - DNA, 25 bp, E. coli
agggatgttccgcatatcacaggag

SEQ ID NO: 46688 - DNA, 25 bp, E. coli
agggatgttccggatatcacaggag

SEQ ID NO: 46689 - DNA, 25 bp, E. coli
ttccggatatcagaggagtcctggc

SEQ ID NO: 46690 - DNA, 25 bp, E. coli
ttccggatatcacaggagtcctggc

SEQ ID NO: 46691 - DNA, 25 bp, E. coli
cctgaactgacaataaagaggttat

SEQ ID NO: 46692 - DNA, 25 bp, E. coli
cctgaactgacattaaagaggttat

SEQ ID NO: 46693 - DNA, 25 bp, E. coli
gcttgactgatgtgtatcaccctga

SEQ ID NO: 46694 - DNA, 25 bp, E. coli
gcttgactgatgagtatcaccctga

SEQ ID NO: 46695 - DNA, 25 bp, E. coli
ctgtgtacgccgaacgccgcaggac

SEQ ID NO: 46696 - DNA, 25 bp, E. coli
ctgtgtacgccgtacgccgcaggac

SEQ ID NO: 46697 - DNA, 25 bp, E. coli
ggaccgcagcggaccgtatgcttga

SEQ ID NO: 46698 - DNA, 25 bp, E. coli
ggaccgcagcggtccgtatgcttga

SEQ ID NO: 46699 - DNA, 25 bp, E. coli
tcacaggagtcctggctgtgtacgc

SEQ ID NO: 46700 - DNA, 25 bp, E. coli
tcacaggagtccaggctgtgtacgc

SEQ ID NO: 46701 - DNA, 25 bp, E. coli
gaccgtatgcttcactgatgagtat

SEQ ID NO: 46702 - DNA, 25 bp, E. coli
gagtcctggctgagtacgccgaacg

SEQ ID NO: 46703 - DNA, 25 bp, E. coli
gatgttccggatttcacaggagtcc

SEQ ID NO: 46704 - DNA, 25 bp, E. coli
gaccgtatgcttgactgatgagtat

SEQ ID NO: 46705 - DNA, 25 bp, E. coli
gatgttccggatatcacaggagtcc

SEQ ID NO: 46706 - DNA, 25 bp, E. coli
gagtcctggctgtgtacgccgaacg

SEQ ID NO: 46707 - DNA, 25 bp, E. coli
caggcgatgcctcctttgaggaaat

SEQ ID NO: 46708 - DNA, 25 bp, E. coli
caggcgatgcctgctttgaggaaat

SEQ ID NO: 46709 - DNA, 25 bp, E. coli
tttagtgtctactcatctgacggca

SEQ ID NO: 46710 - DNA, 25 bp, E. coli
tttagtgtctacacatctgacggca

SEQ ID NO: 46711 - DNA, 25 bp, E. coli
tgtcgttaacgatgcaggcgatgcc

SEQ ID NO: 46712 - DNA, 25 bp, E. coli
tgtctactcatcagacggcatttgc

SEQ ID NO: 46713 - DNA, 25 bp, E. coli
tgtcgttaacgaagcaggcgatgcc

SEQ ID NO: 46714 - DNA, 25 bp, E. coli
tgtctactcatctgacggcatttgc

SEQ ID NO: 46715 - DNA, 25 bp, E. coli
tgcctgctttgaggaaattctcacg

SEQ ID NO: 46716 - DNA, 25 bp, E. coli
tgcctgctttgacgaaattctcacg

SEQ ID NO: 46717 - DNA, 25 bp, E. coli
tcgttaacgaagcaggcgatgcctg

SEQ ID NO: 46718 - DNA, 25 bp, E. coli
tcgttaacgaaggaggcgatgcctg

SEQ ID NO: 46719 - DNA, 25 bp, E. coli
tctaccctgtcgttaacgaagcagg

SEQ ID NO: 46720 - DNA, 25 bp, E. coli
tctaccctgtcgataacgaagcagg

SEQ ID NO: 46721 - DNA, 25 bp, E. coli
gcccgatttttgtttagtgtctact

SEQ ID NO: 46722 - DNA, 25 bp, E. coli
gcccgatttttgattagtgtctact

SEQ ID NO: 46723 - DNA, 25 bp, E. coli
gcagtattgcccgatttttgtttag

SEQ ID NO: 46724 - DNA, 25 bp, E. coli
gcagtattgccccatttttgtttag

SEQ ID NO: 46725 - DNA, 25 bp, E. coli
gaaattctcacggagtattgcccga

SEQ ID NO: 46726 - DNA, 25 bp, E. coli
gaaattctcacgcagtattgcccga

SEQ ID NO: 46727 - DNA, 25 bp, E. coli
gaggaaattctcacgcagtattgcc

SEQ ID NO: 46728 - DNA, 25 bp, E. coli
gaggaaattctctcgcagtattgcc

SEQ ID NO: 46729 - DNA, 25 bp, E. coli
aagatcatgatccacctggacggca

SEQ ID NO: 46730 - DNA, 25 bp, E. coli
aattcatgattcagccggttggcgc

SEQ ID NO: 46731 - DNA, 25 bp, E. coli
aattcatgattctgccggttggcgc

SEQ ID NO: 46732 - DNA, 25 bp, E. coli
aagatcatgatcgacctggacggca

SEQ ID NO: 46733 - DNA, 25 bp, E. coli
aaaatccagctggttggtgacgacc

SEQ ID NO: 46734 - DNA, 25 bp, E. coli
aaaatccagctgcttggtgacgacc

SEQ ID NO: 46735 - DNA, 25 bp, E. coli
tgcgcgatggcgacaaatcccgttt

SEQ ID NO: 46736 - DNA, 25 bp, E. coli
tgcgcgatggcgtcaaatcccgttt

SEQ ID NO: 46737 - DNA, 25 bp, E. coli
tcatcaacggtgctgagcacgctga

SEQ ID NO: 46738 - DNA, 25 bp, E. coli
tcgtaaagagatcaaaggccaggca

SEQ ID NO: 46739 - DNA, 25 bp, E. coli
tcgtaaagagatgaaaggccaggca

SEQ ID NO: 46740 - DNA, 25 bp, E. coli
tcatcaacggtggtgagcacgctga

SEQ ID NO: 46741 - DNA, 25 bp, E. coli
ccgtgaagctctcgaactgcgcgat

SEQ ID NO: 46742 - DNA, 25 bp, E. coli
ccgtgaagctctggaactgcgcgat

SEQ ID NO: 46743 - DNA, 25 bp, E. coli
gaagctctgggcgaaaaagcaccgt

SEQ ID NO: 46744 - DNA, 25 bp, E. coli
gaagctctgggccaaaaagcaccgt

SEQ ID NO: 46745 - DNA, 25 bp, E. coli
gaaaactgtgaaagaagccatccgc

SEQ ID NO: 46746 - DNA, 25 bp, E. coli
gaacctgggttcgaacgctgaagct

SEQ ID NO: 46747 - DNA, 25 bp, E. coli
gaaaactgtgaatgaagccatccgc

SEQ ID NO: 46748 - DNA, 25 bp, E. coli
gaacctgggttccaacgctgaagct

SEQ ID NO: 46749 - DNA, 25 bp, E. coli
ggcgcgaacgcaatcctggctgtat

SEQ ID NO: 46750 - DNA, 25 bp, E. coli
ggcgcgaacgcattcctggctgtat

SEQ ID NO: 46751 - DNA, 25 bp, E. coli
gctatgggaacttactgcggaacct

SEQ ID NO: 46752 - DNA, 25 bp, E. coli
gctatgggaactaactgcggaacct

SEQ ID NO: 46753 - DNA, 25 bp, E. coli
aaatccttctggctggcaacagggc

SEQ ID NO: 46754 - DNA, 25 bp, E. coli
aaatccttctgggtggcaacagggc

SEQ ID NO: 46755 - DNA, 25 bp, E. coli
tatgccccgagcaccattatggttg

SEQ ID NO: 46756 - DNA, 25 bp, E. coli
tatgaatctgaaagaaagcccggtc

SEQ ID NO: 46757 - DNA, 25 bp, E. coli
tatgaatctgaatgaaagcccggtc

SEQ ID NO: 46758 - DNA, 25 bp, E. coli
tatgccccgagctccattatggttg

SEQ ID NO: 46759 - DNA, 25 bp, E. coli
tttctgcaccatcacggaatcctgg

SEQ ID NO: 46760 - DNA, 25 bp, E. coli
ttccagttatatacgctcggcgcag

SEQ ID NO: 46761 - DNA, 25 bp, E. coli
tttctgcaccatgacggaatcctgg

SEQ ID NO: 46762 - DNA, 25 bp, E. coli
ttccagttatattcgctcggcgcag

SEQ ID NO: 46763 - DNA, 25 bp, E. coli
tgattcataactctgcggtgctggg

SEQ ID NO: 46764 - DNA, 25 bp, E. coli
tgattcataactgtgcggtgctggg

SEQ ID NO: 46765 - DNA, 25 bp, E. coli
tcctgaatcatcaacggcaatggcg

SEQ ID NO: 46766 - DNA, 25 bp, E. coli
tcctgaatcatctacggcaatggcg

SEQ ID NO: 46767 - DNA, 25 bp, E. coli
ccgtgatttaagtgcgctggaagac

SEQ ID NO: 46768 - DNA, 25 bp, E. coli
ccgtgatttaagagcgctggaagac

SEQ ID NO: 46769 - DNA, 25 bp, E. coli
gaaccttgagcgcaacggcaatctg

SEQ ID NO: 46770 - DNA, 25 bp, E. coli
gaaccttgagcggaacggcaatctg

SEQ ID NO: 46771 - DNA, 25 bp, E. coli
gataaaattggtggccggatcccgt

SEQ ID NO: 46772 - DNA, 25 bp, E. coli
gataaaattggtcgccggatcccgt

SEQ ID NO: 46773 - DNA, 25 bp, E. coli
attgcgcttaaaaccggagctgccg

SEQ ID NO: 46774 - DNA, 25 bp, E. coli
attgcgcttaaatccggagctgccg

SEQ ID NO: 46775 - DNA, 25 bp, E. coli
tatttctgggtcaatcgtgaacgcc

SEQ ID NO: 46776 - DNA, 25 bp, E. coli
tatttctgggtctatcgtgaacgcc

SEQ ID NO: 46777 - DNA, 25 bp, E. coli
tgatgcctaaaaagcaacgcgcccg

SEQ ID NO: 46778 - DNA, 25 bp, E. coli
tgatgcctaaaatgcaacgcgcccg

SEQ ID NO: 46779 - DNA, 25 bp, E. coli
tcgaacacgttcaaccctggtgggt

SEQ ID NO: 46780 - DNA, 25 bp, E. coli
tcgaacacgttctaccctggtgggt

SEQ ID NO: 46781 - DNA, 25 bp, E. coli
gctgcgacacatactgccggaatat

SEQ ID NO: 46782 - DNA, 25 bp, E. coli
gctcagggcggtgcagaagtattcc

SEQ ID NO: 46783 - DNA, 25 bp, E. coli
gctcagggcggtccagaagtattcc

SEQ ID NO: 46784 - DNA, 25 bp, E. coli
gctgcgacacattctgccggaatat

SEQ ID NO: 46785 - DNA, 25 bp, E. coli
gaaaactttcgattgtggccgctgt

SEQ ID NO: 46786 - DNA, 25 bp, E. coli
gaaaactttcgaatgtggccgctgt

SEQ ID NO: 46787 - DNA, 25 bp, E. coli
ctgccgcggcgaaaagtgaatatct

SEQ ID NO: 46788 - DNA, 25 bp, E. coli
ctgccgcggcgataagtgaatatct

SEQ ID NO: 46789 - DNA, 25 bp, E. coli
gttgaggaaaccatacacgccgctt

SEQ ID NO: 46790 - DNA, 25 bp, E. coli
gttgaggaaaccttacacgccgctt

SEQ ID NO: 46791 - DNA, 25 bp, E. coli
gtttgatcaagcgaacccagcgtat

SEQ ID NO: 46792 - DNA, 25 bp, E. coli
gtttgatcaagccaacccagcgtat

SEQ ID NO: 46793 - DNA, 25 bp, E. coli
tgtggaaccgatgttgtacaacccg

SEQ ID NO: 46794 - DNA, 25 bp, E. coli
tgtggaaccgatcttgtacaacccg

SEQ ID NO: 46795 - DNA, 25 bp, E. coli
tatatggcaaaagcgctcagggcgg

SEQ ID NO: 46796 - DNA, 25 bp, E. coli
tatatggcaaaaccgctcagggcgg

SEQ ID NO: 46797 - DNA, 25 bp, E. coli
ttttcgacgatcacgctacgcggcg

SEQ ID NO: 46798 - DNA, 25 bp, E. coli
ttttcgacgatctcgctacgcggcg

SEQ ID NO: 46799 - DNA, 25 bp, E. coli
tgggaaatacacgaccgatgactgg

SEQ ID NO: 46800 - DNA, 25 bp, E. coli
tgggaaatacaccaccgatgactgg

SEQ ID NO: 46801 - DNA, 25 bp, E. coli
tcatctactgttgtcagcgcgccgg

SEQ ID NO: 46802 - DNA, 25 bp, E. coli
tcatctactgttctcagcgcgccgg

SEQ ID NO: 46803 - DNA, 25 bp, E. coli
ccaccggcgttgtgcttgaagcgaa

SEQ ID NO: 46804 - DNA, 25 bp, E. coli
gcctactgcgggacttgatgccaaa

SEQ ID NO: 46805 - DNA, 25 bp, E. coli
ccaccggcgttgagcttgaagcgaa

SEQ ID NO: 46806 - DNA, 25 bp, E. coli
gcctactgcgggtcttgatgccaaa

SEQ ID NO: 46807 - DNA, 25 bp, E. coli
gaagtaagttcaacctgagcggccc

SEQ ID NO: 46808 - DNA, 25 bp, E. coli
gaagtaagttcatcctgagcggccc

SEQ ID NO: 46809 - DNA, 25 bp, E. coli
taaaccttccggctacaacatcgtg

SEQ ID NO: 46810 - DNA, 25 bp, E. coli
ggtcaatatgggacgcaccgtcggt

SEQ ID NO: 46811 - DNA, 25 bp, E. coli
ggtcaatatgggtcgcaccgtcggt

SEQ ID NO: 46812 - DNA, 25 bp, E. coli
ggaatgtgaaactgcgtctggcgcc

SEQ ID NO: 46813 - DNA, 25 bp, E. coli
ggaatgtgaaacagcgtctggcgcc

SEQ ID NO: 46814 - DNA, 25 bp, E. coli
taagggccgtaacctgtcgatcagc

SEQ ID NO: 46815 - DNA, 25 bp, E. coli
taagggccgtaagctgtcgatcagc

SEQ ID NO: 46816 - DNA, 25 bp, E. coli
taaaccttccgggtacaacatcgtg

SEQ ID NO: 46817 - DNA, 25 bp, E. coli
aacggactctaaatatatacctcac

SEQ ID NO: 46818 - DNA, 25 bp, E. coli
tacgccagagtaaaatcattgaaca

SEQ ID NO: 46819 - DNA, 25 bp, E. coli
aaattaaaaatcatgcggctctctg

SEQ ID NO: 46820 - DNA, 25 bp, E. coli
aacggactctaattatatacctcac

SEQ ID NO: 46821 - DNA, 25 bp, E. coli
aaattaaaaatcttgcggctctctg

SEQ ID NO: 46822 - DNA, 25 bp, E. coli
tacgccagagtataatcattgaaca

SEQ ID NO: 46823 - DNA, 25 bp, E. coli
tatttaagctgaatggttcgatatc

SEQ ID NO: 46824 - DNA, 25 bp, E. coli
tatttaagctgattggttcgatatc

SEQ ID NO: 46825 - DNA, 25 bp, E. coli
tttaatgaatgacacaacaagcgag

SEQ ID NO: 46826 - DNA, 25 bp, E. coli
tttaatgaatgagacaacaagcgag

SEQ ID NO: 46827 - DNA, 25 bp, E. coli
tcattgaacagacaaatggtggaat

SEQ ID NO: 46828 - DNA, 25 bp, E. coli
tcattgaacagagaaatggtggaat

SEQ ID NO: 46829 - DNA, 25 bp, E. coli
gcggctctctgatctcattttcatg

SEQ ID NO: 46830 - DNA, 25 bp, E. coli
gcggctctctgaactcattttcatg

SEQ ID NO: 46831 - DNA, 25 bp, E. coli
gaatatttagcaatgataacggact

SEQ ID NO: 46832 - DNA, 25 bp, E. coli
gaatatttagcattgataacggact

SEQ ID NO: 46833 - DNA, 25 bp, E. coli
gaatcacgcaccaacgccagagtaa

SEQ ID NO: 46834 - DNA, 25 bp, E. coli
gaatcacgcacctacgccagagtaa

SEQ ID NO: 46835 - DNA, 25 bp, E. coli
gacaacaagcgagaatcacgcacct

SEQ ID NO: 46836 - DNA, 25 bp, E. coli
gacaacaagcgacaatcacgcacct

SEQ ID NO: 46837 - DNA, 25 bp, E. coli
ctccctcgcctgtcataatgattag

SEQ ID NO: 46838 - DNA, 25 bp, E. coli
ctccctcgcctgacataatgattag

SEQ ID NO: 46839 - DNA, 25 bp, E. coli
caagccggtgattgtcttgctctta

SEQ ID NO: 46840 - DNA, 25 bp, E. coli
caaactctatggatgttaagcggca

SEQ ID NO: 46841 - DNA, 25 bp, E. coli
caaactctatggttgttaagcggca

SEQ ID NO: 46842 - DNA, 25 bp, E. coli
caaatgagcatcattctggacaaac

SEQ ID NO: 46843 - DNA, 25 bp, E. coli
caagccggtgatagtcttgctctta

SEQ ID NO: 46844 - DNA, 25 bp, E. coli
caaatgagcatctttctggacaaac

SEQ ID NO: 46845 - DNA, 25 bp, E. coli
cagactcatcatttacaagccggtg

SEQ ID NO: 46846 - DNA, 25 bp, E. coli
cagactcatcatatacaagccggtg

SEQ ID NO: 46847 - DNA, 25 bp, E. coli
tctttgtccccagcgggtgcatgtc

SEQ ID NO: 46848 - DNA, 25 bp, E. coli
tctttgtccccaccgggtgcatgtc

SEQ ID NO: 46849 - DNA, 25 bp, E. coli
ccaaatgagaaagccagatagcggc

SEQ ID NO: 46850 - DNA, 25 bp, E. coli
ccaaatgagaaacccagatagcggc

SEQ ID NO: 46851 - DNA, 25 bp, E. coli
gactatccctgcctctgcaaatgag

SEQ ID NO: 46852 - DNA, 25 bp, E. coli
gactatccctgcgtctgcaaatgag

SEQ ID NO: 46853 - DNA, 25 bp, E. coli
ctttgccagcgagtaccaaatgaga

SEQ ID NO: 46854 - DNA, 25 bp, E. coli
ctttgccagcgactaccaaatgaga

SEQ ID NO: 46855 - DNA, 25 bp, E. coli
gatagcggccagtgttgttcttaca

SEQ ID NO: 46856 - DNA, 25 bp, E. coli
gatagcggccagagttgttcttaca

SEQ ID NO: 46857 - DNA, 25 bp, E. coli
ggtgcatgtccggaactaataaaag

SEQ ID NO: 46858 - DNA, 25 bp, E. coli
ggtgcatgtccgcaactaataaaag

SEQ ID NO: 46859 - DNA, 25 bp, E. coli
taagcggcagccatgattttcgagt

SEQ ID NO: 46860 - DNA, 25 bp, E. coli
taagcggcagccttgattttcgagt

SEQ ID NO: 46861 - DNA, 25 bp, E. coli
cagtacctggttagcgcaaggcgaa

SEQ ID NO: 46862 - DNA, 25 bp, E. coli
cagtacctggtttgcgcaaggcgaa

SEQ ID NO: 46863 - DNA, 25 bp, E. coli
tagaacgccggataaagactgataa

SEQ ID NO: 46864 - DNA, 25 bp, E. coli
tagaacgccggaaaaagactgataa

SEQ ID NO: 46865 - DNA, 25 bp, E. coli
aaaattatgcctctgatctagcgcc

SEQ ID NO: 46866 - DNA, 25 bp, E. coli
aaaattatgcctgtgatctagcgcc

SEQ ID NO: 46867 - DNA, 25 bp, E. coli
ttcagccgtgatagtgggataaaca

SEQ ID NO: 46868 - DNA, 25 bp, E. coli
ttcagccgtgattgtgggataaaca

SEQ ID NO: 46869 - DNA, 25 bp, E. coli
tgggataaacacgttagaacgccgg

SEQ ID NO: 46870 - DNA, 25 bp, E. coli
tgtgtcaggagcgacacaagctgct

SEQ ID NO: 46871 - DNA, 25 bp, E. coli
gcatagacggtcttttgagcaggat

SEQ ID NO: 46872 - DNA, 25 bp, E. coli
gcatagacggtcatttgagcaggat

SEQ ID NO: 46873 - DNA, 25 bp, E. coli
gcaaaatattaacgattcagccgtg

SEQ ID NO: 46874 - DNA, 25 bp, E. coli
gcaaaatattaaggattcagccgtg

SEQ ID NO: 46875 - DNA, 25 bp, E. coli
gaaaaatgacgctgacagttacacc

SEQ ID NO: 46876 - DNA, 25 bp, E. coli
gacggtcgggtataacgagacatcg

SEQ ID NO: 46877 - DNA, 25 bp, E. coli
gacggtcgggtaaaacgagacatcg

SEQ ID NO: 46878 - DNA, 25 bp, E. coli
gaaaaatgacgcagacagttacacc

SEQ ID NO: 46879 - DNA, 25 bp, E. coli
gataattgtcttggacggtcgggta

SEQ ID NO: 46880 - DNA, 25 bp, E. coli
gataattgtcttcgacggtcgggta

SEQ ID NO: 46881 - DNA, 25 bp, E. coli
tgggataaacaccttagaacgccgg

SEQ ID NO: 46882 - DNA, 25 bp, E. coli
tgtgtcaggagccacacaagctgct

SEQ ID NO: 46883 - DNA, 25 bp, E. coli
caccctcgattatacgttcagcagc

SEQ ID NO: 46884 - DNA, 25 bp, E. coli
caccctcgattaaacgttcagcagc

SEQ ID NO: 46885 - DNA, 25 bp, E. coli
catatggcaagtgcctataataccc

SEQ ID NO: 46886 - DNA, 25 bp, E. coli
catatggcaagtccctataataccc

SEQ ID NO: 46887 - DNA, 25 bp, E. coli
tatgctgattacaaaacgcgatggc

SEQ ID NO: 46888 - DNA, 25 bp, E. coli
tatgctgattactaaacgcgatggc

SEQ ID NO: 46889 - DNA, 25 bp, E. coli
ttacaaaacgcgttggcccgcaatg

SEQ ID NO: 46890 - DNA, 25 bp, E. coli
ttacaaaacgcgatggcccgcaatg

SEQ ID NO: 46891 - DNA, 25 bp, E. coli
tgaattcgcaaaggcattaaaaagt

SEQ ID NO: 46892 - DNA, 25 bp, E. coli
tgaattcgcaaacgcattaaaaagt

SEQ ID NO: 46893 - DNA, 25 bp, E. coli
gcattaaaaagtcttttggcgagaa

SEQ ID NO: 46894 - DNA, 25 bp, E. coli
gcattaaaaagtgttttggcgagaa

SEQ ID NO: 46895 - DNA, 25 bp, E. coli
gcaataactcctcacacctcaatat

SEQ ID NO: 46896 - DNA, 25 bp, E. coli
gcaataactcctgacacctcaatat

SEQ ID NO: 46897 - DNA, 25 bp, E. coli
cgttcagcagcaatcataaaagatg

SEQ ID NO: 46898 - DNA, 25 bp, E. coli
cgttcagcagcattcataaaagatg

SEQ ID NO: 46899 - DNA, 25 bp, E. coli
tggattgttataataatgtctaccg

SEQ ID NO: 46900 - DNA, 25 bp, E. coli
tggattgttatattaatgtctaccg

SEQ ID NO: 46901 - DNA, 25 bp, E. coli
taagtctggatgaattcgcaaaggc

SEQ ID NO: 46902 - DNA, 25 bp, E. coli
taagtctggatgtattcgcaaaggc

SEQ ID NO: 46903 - DNA, 25 bp, E. coli
tcaatattacatttggcaagtgcct

SEQ ID NO: 46904 - DNA, 25 bp, E. coli
tcaatattacatatggcaagtgcct

SEQ ID NO: 46905 - DNA, 25 bp, E. coli
aatatgaacgacttgcctgacggcg

SEQ ID NO: 46906 - DNA, 25 bp, E. coli
aatatgaacgacatgcctgacggcg

SEQ ID NO: 46907 - DNA, 25 bp, E. coli
aatcaaaaaggcctcgtagctcccg

SEQ ID NO: 46908 - DNA, 25 bp, E. coli
aatcaaaaaggcgtcgtagctcccg

SEQ ID NO: 46909 - DNA, 25 bp, E. coli
tttgatacccaagaggatgagcagg

SEQ ID NO: 46910 - DNA, 25 bp, E. coli
tatatggcggcaagcttctcgcagg

SEQ ID NO: 46911 - DNA, 25 bp, E. coli
tatatggcggcatgcttctcgcagg

SEQ ID NO: 46912 - DNA, 25 bp, E. coli
tttgatacccaacaggatgagcagg

SEQ ID NO: 46913 - DNA, 25 bp, E. coli
ttacaatcccgctggcatggctggc

SEQ ID NO: 46914 - DNA, 25 bp, E. coli
ttacaatcccgcaggcatggctggc

SEQ ID NO: 46915 - DNA, 25 bp, E. coli
tgcgctataaacaggctgccggtcg

SEQ ID NO: 46916 - DNA, 25 bp, E. coli
tgcgctataaactggctgccggtcg

SEQ ID NO: 46917 - DNA, 25 bp, E. coli
tcagagctggtggaatgcggatacc

SEQ ID NO: 46918 - DNA, 25 bp, E. coli
gccacggtcacgttaagccattctg

SEQ ID NO: 46919 - DNA, 25 bp, E. coli
gccacggtcacgataagccattctg

SEQ ID NO: 46920 - DNA, 25 bp, E. coli
gaataacttccacgtttcagcggcc

SEQ ID NO: 46921 - DNA, 25 bp, E. coli
gaatgggatctgtccggaacctatg

SEQ ID NO: 46922 - DNA, 25 bp, E. coli
gaatgggatctgaccggaacctatg

SEQ ID NO: 46923 - DNA, 25 bp, E. coli
gaataacttccaggtttcagcggcc

SEQ ID NO: 46924 - DNA, 25 bp, E. coli
gacgatcgaatggtcccctgggagt

SEQ ID NO: 46925 - DNA, 25 bp, E. coli
gacgatcgaatgctcccctgggagt

SEQ ID NO: 46926 - DNA, 25 bp, E. coli
tcagagctggtgcaatgcggatacc

SEQ ID NO: 46927 - DNA, 25 bp, E. coli
taaagtcagcatccttgctccggga

SEQ ID NO: 46928 - DNA, 25 bp, E. coli
taaagtcagcatgcttgctccggga

SEQ ID NO: 46929 - DNA, 25 bp, E. coli
tatgccgatcacaatgccatgcgcg

SEQ ID NO: 46930 - DNA, 25 bp, E. coli
tatgccgatcactatgccatgcgcg

SEQ ID NO: 46931 - DNA, 25 bp, E. coli
tatcctgacactaacgcgaacatgg

SEQ ID NO: 46932 - DNA, 25 bp, E. coli
tatcctgacacttacgcgaacatgg

SEQ ID NO: 46933 - DNA, 25 bp, E. coli
tatttggtgccgttcgctcctggtc

SEQ ID NO: 46934 - DNA, 25 bp, E. coli
tatttggtgccgatcgctcctggtc

SEQ ID NO: 46935 - DNA, 25 bp, E. coli
ttcatgagcgcctacaaaacgtgcc

SEQ ID NO: 46936 - DNA, 25 bp, E. coli
ttcatgagcgccaacaaaacgtgcc

SEQ ID NO: 46937 - DNA, 25 bp, E. coli
tgcactttgacgtagcctggtacgg

SEQ ID NO: 46938 - DNA, 25 bp, E. coli
tgcactttgacgaagcctggtacgg

SEQ ID NO: 46939 - DNA, 25 bp, E. coli
tgaaagaaaacaaccctggcgcacg

SEQ ID NO: 46940 - DNA, 25 bp, E. coli
tgaaagaaaacatccctggcgcacg

SEQ ID NO: 46941 - DNA, 25 bp, E. coli
tcagttatcccgtatccgccaggaa

SEQ ID NO: 46942 - DNA, 25 bp, E. coli
tcagttatcccgaatccgccaggaa

SEQ ID NO: 46943 - DNA, 25 bp, E. coli
ccatgaatattcgtgggcagcgcca

SEQ ID NO: 46944 - DNA, 25 bp, E. coli
ccatgaatattcctgggcagcgcca

SEQ ID NO: 46945 - DNA, 25 bp, E. coli
gcaggcttgcatgaccgataacgat

SEQ ID NO: 46946 - DNA, 25 bp, E. coli
gcaggcttgcatcaccgataacgat

SEQ ID NO: 46947 - DNA, 25 bp, E. coli
gataactggagtatgctcgacccga

SEQ ID NO: 46948 - DNA, 25 bp, E. coli
gataactggagtttgctcgacccga

SEQ ID NO: 46949 - DNA, 25 bp, E. coli
caaggccacttaaggcgaaaaaaca

SEQ ID NO: 46950 - DNA, 25 bp, E. coli
aataacaagtatatgcggtgggtgg

SEQ ID NO: 46951 - DNA, 25 bp, E. coli
caaggccacttatggcgaaaaaaca

SEQ ID NO: 46952 - DNA, 25 bp, E. coli
aaacatcattattttgctgaaggtg

SEQ ID NO: 46953 - DNA, 25 bp, E. coli
aataacaagtatttgcggtgggtgg

SEQ ID NO: 46954 - DNA, 25 bp, E. coli
aaacatcattatattgctgaaggtg

SEQ ID NO: 46955 - DNA, 25 bp, E. coli
tattttggcaatgagcgtgagccgg

SEQ ID NO: 46956 - DNA, 25 bp, E. coli
tatttgcggtggctggatgtatttt

SEQ ID NO: 46957 - DNA, 25 bp, E. coli
tatttgcggtgggtggatgtatttt

SEQ ID NO: 46958 - DNA, 25 bp, E. coli
tattttggcaatcagcgtgagccgg

SEQ ID NO: 46959 - DNA, 25 bp, E. coli
tgagtaaaacgattccgggctgggc

SEQ ID NO: 46960 - DNA, 25 bp, E. coli
tgagtaaaacgaatccgggctgggc

SEQ ID NO: 46961 - DNA, 25 bp, E. coli
tccgggctgggctaggccacttatg

SEQ ID NO: 46962 - DNA, 25 bp, E. coli
tccgggctgggcaaggccacttatg

SEQ ID NO: 46963 - DNA, 25 bp, E. coli
tccagatgattgaaaaaagtgtcgt

SEQ ID NO: 46964 - DNA, 25 bp, E. coli
tccagatgattgtaaaaagtgtcgt

SEQ ID NO: 46965 - DNA, 25 bp, E. coli
cggatacattcgaaagtccagatga

SEQ ID NO: 46966 - DNA, 25 bp, E. coli
cggatacattcgtaagtccagatga

SEQ ID NO: 46967 - DNA, 25 bp, E. coli
ttttgctgaaggtgaaataacaagt

SEQ ID NO: 46968 - DNA, 25 bp, E. coli
ttttgctgaaggagaaataacaagt

SEQ ID NO: 46969 - DNA, 25 bp, E. coli
gagcgtgagccgcatacattcgaaa

SEQ ID NO: 46970 - DNA, 25 bp, E. coli
gagcgtgagccggatacattcgaaa

SEQ ID NO: 46971 - DNA, 25 bp, E. coli
aaggagagatgaatattgcgaaagc

SEQ ID NO: 46972 - DNA, 25 bp, E. coli
aaggagagatgattattgcgaaagc

SEQ ID NO: 46973 - DNA, 25 bp, E. coli
actggcatcccggtgacatcattgc

SEQ ID NO: 46974 - DNA, 25 bp, E. coli
actggcatcccgctgacatcattgc

SEQ ID NO: 46975 - DNA, 25 bp, E. coli
ttgcgaaagcccagggaactgaccc

SEQ ID NO: 46976 - DNA, 25 bp, E. coli
ttatctggccatgacgctaccatga

SEQ ID NO: 46977 - DNA, 25 bp, E. coli
ttatctggccatcacgctaccatga

SEQ ID NO: 46978 - DNA, 25 bp, E. coli
ttgcgaaagccctgggaactgaccc

SEQ ID NO: 46979 - DNA, 25 bp, E. coli
tctcgcagaaatcgtttgagttcct

SEQ ID NO: 46980 - DNA, 25 bp, E. coli
tctcgcagaaatggtttgagttcct

SEQ ID NO: 46981 - DNA, 25 bp, E. coli
gaactgacccctgggttatctggcc

SEQ ID NO: 46982 - DNA, 25 bp, E. coli
gaactgacccctcggttatctggcc

SEQ ID NO: 46983 - DNA, 25 bp, E. coli
cccatgagtttatcgacagaacgca

SEQ ID NO: 46984 - DNA, 25 bp, E. coli
cgcccatggccgaaaggagagatga

SEQ ID NO: 46985 - DNA, 25 bp, E. coli
cgcccatggccgtaaggagagatga

SEQ ID NO: 46986 - DNA, 25 bp, E. coli
cccatgagtttaacgacagaacgca

SEQ ID NO: 46987 - DNA, 25 bp, E. coli
gtttgagttcctcaacgctggcgaa

SEQ ID NO: 46988 - DNA, 25 bp, E. coli
gtttgagttcctgaacgctggcgaa

SEQ ID NO: 46989 - DNA, 25 bp, E. coli
taatttcattgactggcatcccgct

SEQ ID NO: 46990 - DNA, 25 bp, E. coli
taatttcattgagtggcatcccgct

SEQ ID NO: 46991 - DNA, 25 bp, E. coli
gatgcgtagctagactaaaccgaaa

SEQ ID NO: 46992 - DNA, 25 bp, E. coli
gatgcgtagctacactaaaccgaaa

SEQ ID NO: 46993 - DNA, 25 bp, E. coli
caatgaaaatgacgcacaaattgca

SEQ ID NO: 46994 - DNA, 25 bp, E. coli
caatgaaaatgaggcacaaattgca

SEQ ID NO: 46995 - DNA, 25 bp, E. coli
caccgcacggctggtgtcggatgaa

SEQ ID NO: 46996 - DNA, 25 bp, E. coli
caccgcacggctcgtgtcggatgaa

SEQ ID NO: 46997 - DNA, 25 bp, E. coli
caaattgcagaacgcttaacgggcg

SEQ ID NO: 46998 - DNA, 25 bp, E. coli
caaattgcagaaggcttaacgggcg

SEQ ID NO: 46999 - DNA, 25 bp, E. coli
agaaaccaccgcacggctggtgtcg

SEQ ID NO: 47000 - DNA, 25 bp, E. coli
agaaaccaccgctcggctggtgtcg

SEQ ID NO: 47001 - DNA, 25 bp, E. coli
aaaaatctctaccaagaaagcaatg

SEQ ID NO: 47002 - DNA, 25 bp, E. coli
aaatgacgcacaaattgcagaacgc

SEQ ID NO: 47003 - DNA, 25 bp, E. coli
aaaaatctctacgaagaaagcaatg

SEQ ID NO: 47004 - DNA, 25 bp, E. coli
aaatgacgcacatattgcagaacgc

SEQ ID NO: 47005 - DNA, 25 bp, E. coli
tgcagaacgcttaacgggcgtcagt

SEQ ID NO: 47006 - DNA, 25 bp, E. coli
tgcagaacgctttacgggcgtcagt

SEQ ID NO: 47007 - DNA, 25 bp, E. coli
tctcgggaggaagagcttgatgaac

SEQ ID NO: 47008 - DNA, 25 bp, E. coli
tctcgggaggaacagcttgatgaac

SEQ ID NO: 47009 - DNA, 25 bp, E. coli
gcacaaattgcagaacgcttaacgg

SEQ ID NO: 47010 - DNA, 25 bp, E. coli
gcacaaattgcacaacgcttaacgg

SEQ ID NO: 47011 - DNA, 25 bp, E. coli
ctctaccaagaatgcaatgaaaatg

SEQ ID NO: 47012 - DNA, 25 bp, E. coli
ctctaccaagaaagcaatgaaaatg

SEQ ID NO: 47013 - DNA, 25 bp, E. coli
ggaacagcttgatgaactgctaaac

SEQ ID NO: 47014 - DNA, 25 bp, E. coli
ggaacagcttgaagaactgctaaac

SEQ ID NO: 47015 - DNA, 25 bp, E. coli
caaatagcacgtagcgagcaggcgg

SEQ ID NO: 47016 - DNA, 25 bp, E. coli
caaatagcacgttgcgagcaggcgg

SEQ ID NO: 47017 - DNA, 25 bp, E. coli
cagaagtcatccctgagtcagcgaa

SEQ ID NO: 47018 - DNA, 25 bp, E. coli
cagaagtcatccgtgagtcagcgaa

SEQ ID NO: 47019 - DNA, 25 bp, E. coli
aaaatcgatgatagggcagctgctg

SEQ ID NO: 47020 - DNA, 25 bp, E. coli
aaaatcgatgattgggcagctgctg

SEQ ID NO: 47021 - DNA, 25 bp, E. coli
taccggtttgtcagatgcatatgca

SEQ ID NO: 47022 - DNA, 25 bp, E. coli
taccggtttgtctgatgcatatgca

SEQ ID NO: 47023 - DNA, 25 bp, E. coli
tctgtctgcaaaggaaaacaaacgc

SEQ ID NO: 47024 - DNA, 25 bp, E. coli
tctgtctgcaaacgaaaacaaacgc

SEQ ID NO: 47025 - DNA, 25 bp, E. coli
gaatctgatgatgaacgctggcgcg

SEQ ID NO: 47026 - DNA, 25 bp, E. coli
gaatctgatgatcaacgctggcgcg

SEQ ID NO: 47027 - DNA, 25 bp, E. coli
ggcgcgcctggcagaatttcaccat

SEQ ID NO: 47028 - DNA, 25 bp, E. coli
ggcgcgcctggctgaatttcaccat

SEQ ID NO: 47029 - DNA, 25 bp, E. coli
taactattcattactggcgcgcctg

SEQ ID NO: 47030 - DNA, 25 bp, E. coli
tcaaagaaaccgaagaagcgatgcg

SEQ ID NO: 47031 - DNA, 25 bp, E. coli
tcaaagaaaccgtagaagcgatgcg

SEQ ID NO: 47032 - DNA, 25 bp, E. coli
taactattcatttctggcgcgcctg

SEQ ID NO: 47033 - DNA, 25 bp, E. coli
gagaaattgttggtcgaccccggat

SEQ ID NO: 47034 - DNA, 25 bp, E. coli
gagaaattgttgctcgaccccggat

SEQ ID NO: 47035 - DNA, 25 bp, E. coli
gaggcaattgctgaacgcttcgaag

SEQ ID NO: 47036 - DNA, 25 bp, E. coli
gaggcaattgctcaacgcttcgaag

SEQ ID NO: 47037 - DNA, 25 bp, E. coli
gaataactaaagcaacaggttaggg

SEQ ID NO: 47038 - DNA, 25 bp, E. coli
gaataactaaaggaacaggttaggg

SEQ ID NO: 47039 - DNA, 25 bp, E. coli
taaactaaacatattatctgccccg

SEQ ID NO: 47040 - DNA, 25 bp, E. coli
taaatggcttcactgcaaaatgacc

SEQ ID NO: 47041 - DNA, 25 bp, E. coli
taaatggcttcagtgcaaaatgacc

SEQ ID NO: 47042 - DNA, 25 bp, E. coli
taaactaaacattttatctgccccg

SEQ ID NO: 47043 - DNA, 25 bp, E. coli
tgatcaaaagcatcaaattagtaac

SEQ ID NO: 47044 - DNA, 25 bp, E. coli
tgatcaaaagcaacaaattagtaac

SEQ ID NO: 47045 - DNA, 25 bp, E. coli
taaggcaaagtgtgacaggaaatga

SEQ ID NO: 47046 - DNA, 25 bp, E. coli
taaggcaaagtgagacaggaaatga

SEQ ID NO: 47047 - DNA, 25 bp, E. coli
ggtcgataaaaatcagtaaatggct

SEQ ID NO: 47048 - DNA, 25 bp, E. coli
gggagttaacataagagaacagatt

SEQ ID NO: 47049 - DNA, 25 bp, E. coli
gggagttaacattagagaacagatt

SEQ ID NO: 47050 - DNA, 25 bp, E. coli
ggtcgataaaaaacagtaaatggct

SEQ ID NO: 47051 - DNA, 25 bp, E. coli
tgcaaaatgacccttagtaaactaa

SEQ ID NO: 47052 - DNA, 25 bp, E. coli
tgcaaaatgaccgttagtaaactaa

SEQ ID NO: 47053 - DNA, 25 bp, E. coli
taacgtagggtattaaggcaaagtg

SEQ ID NO: 47054 - DNA, 25 bp, E. coli
taacgtagggtaataaggcaaagtg

SEQ ID NO: 47055 - DNA, 25 bp, E. coli
gagacaggaaatcaataactaaagc

SEQ ID NO: 47056 - DNA, 25 bp, E. coli
gagaacagattatctggtcgataaa

SEQ ID NO: 47057 - DNA, 25 bp, E. coli
gagaacagattaactggtcgataaa

SEQ ID NO: 47058 - DNA, 25 bp, E. coli
gagacaggaaatgaataactaaagc

SEQ ID NO: 47059 - DNA, 25 bp, E. coli
caaaggtacggcagtatgcaaatag

SEQ ID NO: 47060 - DNA, 25 bp, E. coli
caaaggtacggctgtatgcaaatag

SEQ ID NO: 47061 - DNA, 25 bp, E. coli
cagattttgtgagttgcgtcctgga

SEQ ID NO: 47062 - DNA, 25 bp, E. coli
cagattttgtgacttgcgtcctgga

SEQ ID NO: 47063 - DNA, 25 bp, E. coli
tatgcgcagattatgtgacttgcgt

SEQ ID NO: 47064 - DNA, 25 bp, E. coli
tatgcgcagattttgtgacttgcgt

SEQ ID NO: 47065 - DNA, 25 bp, E. coli
tgagaacgactaacaattcgacgtc

SEQ ID NO: 47066 - DNA, 25 bp, E. coli
tgagaacgactatcaattcgacgtc

SEQ ID NO: 47067 - DNA, 25 bp, E. coli
tgacttgcgtccaggagatacacag

SEQ ID NO: 47068 - DNA, 25 bp, E. coli
tgacttgcgtcctggagatacacag

SEQ ID NO: 47069 - DNA, 25 bp, E. coli
tgcgtaaacgcatggaaaagaaagc

SEQ ID NO: 47070 - DNA, 25 bp, E. coli
tgcgtaaacgcaaggaaaagaaagc

SEQ ID NO: 47071 - DNA, 25 bp, E. coli
gaaaagaaagcaaaggtacggcagt

SEQ ID NO: 47072 - DNA, 25 bp, E. coli
gaaaagaaagcataggtacggcagt

SEQ ID NO: 47073 - DNA, 25 bp, E. coli
gactatcaattccacgtcgttttga

SEQ ID NO: 47074 - DNA, 25 bp, E. coli
gactatcaattcgacgtcgttttga

SEQ ID NO: 47075 - DNA, 25 bp, E. coli
cgtcgttttgatattattatgcgca

SEQ ID NO: 47076 - DNA, 25 bp, E. coli
cgtcctggagatacacagtgggtaa

SEQ ID NO: 47077 - DNA, 25 bp, E. coli
cgtcgttttgattttattatgcgca

SEQ ID NO: 47078 - DNA, 25 bp, E. coli
cgtcctggagattcacagtgggtaa

SEQ ID NO: 47079 - DNA, 25 bp, E. coli
gtatgcaaatagtaatgagaacgac

SEQ ID NO: 47080 - DNA, 25 bp, E. coli
gtatgcaaatagaaatgagaacgac

SEQ ID NO: 47081 - DNA, 25 bp, E. coli
aacgccgtgctccagcaaaatttca

SEQ ID NO: 47082 - DNA, 25 bp, E. coli
aagaaggcgctgaggctgtagccac

SEQ ID NO: 47083 - DNA, 25 bp, E. coli
aagaaggcgctgtggctgtagccac

SEQ ID NO: 47084 - DNA, 25 bp, E. coli
aactggcaacaagggaagaaggcgc

SEQ ID NO: 47085 - DNA, 25 bp, E. coli
aactggcaacaacggaagaaggcgc

SEQ ID NO: 47086 - DNA, 25 bp, E. coli
aacgccgtgctcgagcaaaatttca

SEQ ID NO: 47087 - DNA, 25 bp, E. coli
tattcctgacgatctggcaacaagg

SEQ ID NO: 47088 - DNA, 25 bp, E. coli
tattcctgacgaactggcaacaagg

SEQ ID NO: 47089 - DNA, 25 bp, E. coli
ttgaagctggcgacgaacgccgtgc

SEQ ID NO: 47090 - DNA, 25 bp, E. coli
ttgcacgccattgggtgggttaagc

SEQ ID NO: 47091 - DNA, 25 bp, E. coli
ttgaagctggcgtcgaacgccgtgc

SEQ ID NO: 47092 - DNA, 25 bp, E. coli
ttgcacgccattcggtgggttaagc

SEQ ID NO: 47093 - DNA, 25 bp, E. coli
tgtagccacagcgattgaagctggc

SEQ ID NO: 47094 - DNA, 25 bp, E. coli
tgtattcctggtcctaaatggcccg

SEQ ID NO: 47095 - DNA, 25 bp, E. coli
tgtattcctggtgctaaatggcccg

SEQ ID NO: 47096 - DNA, 25 bp, E. coli
tgtagccacagccattgaagctggc

SEQ ID NO: 47097 - DNA, 25 bp, E. coli
tccggagcttaacttgcacgccatt

SEQ ID NO: 47098 - DNA, 25 bp, E. coli
tccggagcttaagttgcacgccatt

SEQ ID NO: 47099 - DNA, 25 bp, E. coli
gagtctgcttcttttgtcccggttg

SEQ ID NO: 47100 - DNA, 25 bp, E. coli
gacgaactggcctatgggcgctgct

SEQ ID NO: 47101 - DNA, 25 bp, E. coli
gacgaactggccaatgggcgctgct

SEQ ID NO: 47102 - DNA, 25 bp, E. coli
gagtctgcttctattgtcccggttg

SEQ ID NO: 47103 - DNA, 25 bp, E. coli
cacttccactgcgattaaaaaacaa

SEQ ID NO: 47104 - DNA, 25 bp, E. coli
caaagcacttctcgaaatgaagtca

SEQ ID NO: 47105 - DNA, 25 bp, E. coli
cacttccactgccattaaaaaacaa

SEQ ID NO: 47106 - DNA, 25 bp, E. coli
caaagcacttctggaaatgaagtca

SEQ ID NO: 47107 - DNA, 25 bp, E. coli
tttttcacccatactcgaaaaatga

SEQ ID NO: 47108 - DNA, 25 bp, E. coli
tttttcacccattctcgaaaaatga

SEQ ID NO: 47109 - DNA, 25 bp, E. coli
tggtcacttccagtgcgattaaaaa

SEQ ID NO: 47110 - DNA, 25 bp, E. coli
tgaagccagtatatccgatgtctgg

SEQ ID NO: 47111 - DNA, 25 bp, E. coli
tgaagccagtatttccgatgtctgg

SEQ ID NO: 47112 - DNA, 25 bp, E. coli
ttggttgaagccagtatttccgatg

SEQ ID NO: 47113 - DNA, 25 bp, E. coli
ttggttgaagcctgtatttccgatg

SEQ ID NO: 47114 - DNA, 25 bp, E. coli
gaacagaaaccaatttttcacccat

SEQ ID NO: 47115 - DNA, 25 bp, E. coli
gaaaccattttttcacccattctcg

SEQ ID NO: 47116 - DNA, 25 bp, E. coli
gaaatgaagtcaatcaccatatggg

SEQ ID NO: 47117 - DNA, 25 bp, E. coli
gaaaccatttttacacccattctcg

SEQ ID NO: 47118 - DNA, 25 bp, E. coli
gaacagaaaccattttttcacccat

SEQ ID NO: 47119 - DNA, 25 bp, E. coli
gaaatgaagtcattcaccatatggg

SEQ ID NO: 47120 - DNA, 25 bp, E. coli
cgatgtctggtctcttccactgcga

SEQ ID NO: 47121 - DNA, 25 bp, E. coli
cgattaaaaaacaaagcacttctgg

SEQ ID NO: 47122 - DNA, 25 bp, E. coli
cgatgtctggtcacttccactgcga

SEQ ID NO: 47123 - DNA, 25 bp, E. coli
cgattaaaaaactaagcacttctgg

SEQ ID NO: 47124 - DNA, 25 bp, E. coli
tggtcacttccactgcgattaaaaa

SEQ ID NO: 47125 - DNA, 25 bp, E. coli
caatgcgctgtagtgccttacgcta

SEQ ID NO: 47126 - DNA, 25 bp, E. coli
caatgcgctgtactgccttacgcta

SEQ ID NO: 47127 - DNA, 25 bp, E. coli
aaaactttgcgtgttctggtgataa

SEQ ID NO: 47128 - DNA, 25 bp, E. coli
aaaactttgcgtcttctggtgataa

SEQ ID NO: 47129 - DNA, 25 bp, E. coli
tatggcgctcatgcccgtttgctgt

SEQ ID NO: 47130 - DNA, 25 bp, E. coli
tatcgcaatgggtctatggcgctca

SEQ ID NO: 47131 - DNA, 25 bp, E. coli
tatggcgctcatccccgtttgctgt

SEQ ID NO: 47132 - DNA, 25 bp, E. coli
tacgctaccgcgctgatggttctta

SEQ ID NO: 47133 - DNA, 25 bp, E. coli
tacgctaccgcggtgatggttctta

SEQ ID NO: 47134 - DNA, 25 bp, E. coli
tatcgcaatgggactatggcgctca

SEQ ID NO: 47135 - DNA, 25 bp, E. coli
ttattactcgtatagcaatgcgctg

SEQ ID NO: 47136 - DNA, 25 bp, E. coli
ttattactcgtaaagcaatgcgctg

SEQ ID NO: 47137 - DNA, 25 bp, E. coli
tgctgttcgatattggcttctctga

SEQ ID NO: 47138 - DNA, 25 bp, E. coli
tgctgttcgataatggcttctctga

SEQ ID NO: 47139 - DNA, 25 bp, E. coli
tcgtcaactaaacgagatgaggccc

SEQ ID NO: 47140 - DNA, 25 bp, E. coli
tcgtcaactaaaggagatgaggccc

SEQ ID NO: 47141 - DNA, 25 bp, E. coli
gcttctctgagcttacggtgttgca

SEQ ID NO: 47142 - DNA, 25 bp, E. coli
gcttctctgagcatacggtgttgca

SEQ ID NO: 47143 - DNA, 25 bp, E. coli
cggtgttgcagtactcgtaaaaact

SEQ ID NO: 47144 - DNA, 25 bp, E. coli
cggtgttgcagttctcgtaaaaact

SEQ ID NO: 47145 - DNA, 25 bp, E. coli
gatgaggcccgtttgtatcgcaatg

SEQ ID NO: 47146 - DNA, 25 bp, E. coli
gatgaggcccgtatgtatcgcaatg

SEQ ID NO: 47147 - DNA, 25 bp, E. coli
catggcctttggagatgcgatgaac

SEQ ID NO: 47148 - DNA, 25 bp, E. coli
catttaccggtgattggacattgcc

SEQ ID NO: 47149 - DNA, 25 bp, E. coli
catggcctttggtgatgcgatgaac

SEQ ID NO: 47150 - DNA, 25 bp, E. coli
catttaccggtgtttggacattgcc

SEQ ID NO: 47151 - DNA, 25 bp, E. coli
agaaaaccctctgtactttggcgcg

SEQ ID NO: 47152 - DNA, 25 bp, E. coli
agaaaaccctctctactttggcgcg

SEQ ID NO: 47153 - DNA, 25 bp, E. coli
tatttgacgcactggctggactatc

SEQ ID NO: 47154 - DNA, 25 bp, E. coli
tatttgacgcacaggctggactatc

SEQ ID NO: 47155 - DNA, 25 bp, E. coli
tatcagcaatgggatacccgagcca

SEQ ID NO: 47156 - DNA, 25 bp, E. coli
tatcagcaatggcatacccgagcca

SEQ ID NO: 47157 - DNA, 25 bp, E. coli
ttgattaccggcaacggaacgcgcg

SEQ ID NO: 47158 - DNA, 25 bp, E. coli
ttgattaccggctacggaacgcgcg

SEQ ID NO: 47159 - DNA, 25 bp, E. coli
tgatgatttacctgcggatgtcgcg

SEQ ID NO: 47160 - DNA, 25 bp, E. coli
tgatgatttaccagcggatgtcgcg

SEQ ID NO: 47161 - DNA, 25 bp, E. coli
tgacggtgctgagccaacatttagg

SEQ ID NO: 47162 - DNA, 25 bp, E. coli
tgacggtgctgacccaacatttagg

SEQ ID NO: 47163 - DNA, 25 bp, E. coli
gaagcattaggcgagcgtgcacatt

SEQ ID NO: 47164 - DNA, 25 bp, E. coli
gaagcattaggccagcgtgcacatt

SEQ ID NO: 47165 - DNA, 25 bp, E. coli
gaaagaaatggctcgtctggcagca

SEQ ID NO: 47166 - DNA, 25 bp, E. coli
gaacgcgcgtgcattctctggaagg

SEQ ID NO: 47167 - DNA, 25 bp, E. coli
gaaagaaatggcacgtctggcagca

SEQ ID NO: 47168 - DNA, 25 bp, E. coli
gaacgcgcgtgctttctctggaagg

SEQ ID NO: 47169 - DNA, 25 bp, E. coli
caggaatcaccgctacttgaagagt

SEQ ID NO: 47170 - DNA, 25 bp, E. coli
caggaatcaccggtacttgaagagt

SEQ ID NO: 47171 - DNA, 25 bp, E. coli
tacttgaagagtggctctcggccca

SEQ ID NO: 47172 - DNA, 25 bp, E. coli
tactgacagctatcgccagttgctg

SEQ ID NO: 47173 - DNA, 25 bp, E. coli
tacttgaagagtcgctctcggccca

SEQ ID NO: 47174 - DNA, 25 bp, E. coli
tactgacagctaacgccagttgctg

SEQ ID NO: 47175 - DNA, 25 bp, E. coli
tacatcctaccgtgcaaggactgcg

SEQ ID NO: 47176 - DNA, 25 bp, E. coli
tacatcctaccgagcaaggactgcg

SEQ ID NO: 47177 - DNA, 25 bp, E. coli
tgaagaagtgcaacgatcctggtac

SEQ ID NO: 47178 - DNA, 25 bp, E. coli
tgaagaagtgcatcgatcctggtac

SEQ ID NO: 47179 - DNA, 25 bp, E. coli
tctcggcccagcgtcatgatttagg

SEQ ID NO: 47180 - DNA, 25 bp, E. coli
tctcggcccagcctcatgatttagg

SEQ ID NO: 47181 - DNA, 25 bp, E. coli
tcagcttaaataacgtgccccagga

SEQ ID NO: 47182 - DNA, 25 bp, E. coli
tcagcttaaatatcgtgccccagga

SEQ ID NO: 47183 - DNA, 25 bp, E. coli
cctggtacggacaggatcgcattgt

SEQ ID NO: 47184 - DNA, 25 bp, E. coli
cctggtacggactggatcgcattgt

SEQ ID NO: 47185 - DNA, 25 bp, E. coli
gcatgatcgtagaaacccacagcgc

SEQ ID NO: 47186 - DNA, 25 bp, E. coli
gcatgatcgtagtaacccacagcgc

SEQ ID NO: 47187 - DNA, 25 bp, E. coli
gaaagtctgcgccagtttcgccagg

SEQ ID NO: 47188 - DNA, 25 bp, E. coli
gaaagtctgcgcgagtttcgccagg

SEQ ID NO: 47189 - DNA, 25 bp, E. coli
gagaactgtctaatgcctgcctgcc

SEQ ID NO: 47190 - DNA, 25 bp, E. coli
gagaactgtctattgcctgcctgcc

SEQ ID NO: 47191 - DNA, 25 bp, E. coli
caatgcttcaacgaataaagcggga

SEQ ID NO: 47192 - DNA, 25 bp, E. coli
caatgcttcaaccaataaagcggga

SEQ ID NO: 47193 - DNA, 25 bp, E. coli
cactgaagcgggagtgaatactaac

SEQ ID NO: 47194 - DNA, 25 bp, E. coli
cactgaagcgggtgtgaatactaac

SEQ ID NO: 47195 - DNA, 25 bp, E. coli
aaagcgaatgaccttcgcaagggca

SEQ ID NO: 47196 - DNA, 25 bp, E. coli
aaagcgaatgacgttcgcaagggca

SEQ ID NO: 47197 - DNA, 25 bp, E. coli
tatcgcattgtatcaactgcggaaa

SEQ ID NO: 47198 - DNA, 25 bp, E. coli
ttaatctttccctctgaagcgggtg

SEQ ID NO: 47199 - DNA, 25 bp, E. coli
ttaatctttcccactgaagcgggtg

SEQ ID NO: 47200 - DNA, 25 bp, E. coli
tatcgcattgtaacaactgcggaaa

SEQ ID NO: 47201 - DNA, 25 bp, E. coli
tgaatactaaccaaagcgaatgacc

SEQ ID NO: 47202 - DNA, 25 bp, E. coli
tgaatactaacctaagcgaatgacc

SEQ ID NO: 47203 - DNA, 25 bp, E. coli
tcgcaagggcaaatttatcgcattg

SEQ ID NO: 47204 - DNA, 25 bp, E. coli
tcgcaagggcaattttatcgcattg

SEQ ID NO: 47205 - DNA, 25 bp, E. coli
gcctttttagcctgttatctaacgc

SEQ ID NO: 47206 - DNA, 25 bp, E. coli
gcctttttagccagttatctaacgc

SEQ ID NO: 47207 - DNA, 25 bp, E. coli
gctgagaaaaaacgcgacaatcgcc

SEQ ID NO: 47208 - DNA, 25 bp, E. coli
gctgagaaaaaaggcgacaatcgcc

SEQ ID NO: 47209 - DNA, 25 bp, E. coli
gcaaaaccgatgtgttcgctgagaa

SEQ ID NO: 47210 - DNA, 25 bp, E. coli
gcaaaaccgatgagttcgctgagaa

SEQ ID NO: 47211 - DNA, 25 bp, E. coli
gacaatcgccgcgtttttagccagt

SEQ ID NO: 47212 - DNA, 25 bp, E. coli
gacaatcgccgcctttttagccagt

SEQ ID NO: 47213 - DNA, 25 bp, E. coli
caccaccgtgtatacactgcatgag

SEQ ID NO: 47214 - DNA, 25 bp, E. coli
caccaccgtgtaaacactgcatgag

SEQ ID NO: 47215 - DNA, 25 bp, E. coli
tacagaagcgtaacttctggcagtt

SEQ ID NO: 47216 - DNA, 25 bp, E. coli
tacagaagcgtatcttctggcagtt

SEQ ID NO: 47217 - DNA, 25 bp, E. coli
agcgtaacttctggcagttacaggc

SEQ ID NO: 47218 - DNA, 25 bp, E. coli
atgagctatcctccaccgcacagga

SEQ ID NO: 47219 - DNA, 25 bp, E. coli
atgagctatcctgcaccgcacagga

SEQ ID NO: 47220 - DNA, 25 bp, E. coli
agcgtaacttctcgcagttacaggc

SEQ ID NO: 47221 - DNA, 25 bp, E. coli
tatcctccaccggacaggaaaaagc

SEQ ID NO: 47222 - DNA, 25 bp, E. coli
tatcctccaccgcacaggaaaaagc

SEQ ID NO: 47223 - DNA, 25 bp, E. coli
tatacactgcatgagctatcctcca

SEQ ID NO: 47224 - DNA, 25 bp, E. coli
tatacactgcatcagctatcctcca

SEQ ID NO: 47225 - DNA, 25 bp, E. coli
tgagcagaattatcaccaccaccgt

SEQ ID NO: 47226 - DNA, 25 bp, E. coli
tgagcagaattaacaccaccaccgt

SEQ ID NO: 47227 - DNA, 25 bp, E. coli
gccattcacatctatgcatatacct

SEQ ID NO: 47228 - DNA, 25 bp, E. coli
gccattcacatcaatgcatatacct

SEQ ID NO: 47229 - DNA, 25 bp, E. coli
gccctgcaggcggtacagaagcgta

SEQ ID NO: 47230 - DNA, 25 bp, E. coli
gccctgcaggcgctacagaagcgta

SEQ ID NO: 47231 - DNA, 25 bp, E. coli
gcagaattatcagcaccaccgtgta

SEQ ID NO: 47232 - DNA, 25 bp, E. coli
gcagaattatcaccaccaccgtgta

SEQ ID NO: 47233 - DNA, 25 bp, E. coli
cgtgtatacactgcatgagctatcc

SEQ ID NO: 47234 - DNA, 25 bp, E. coli
cgtgtatacactccatgagctatcc

SEQ ID NO: 47235 - DNA, 25 bp, E. coli
tacaactgaccaacgtaagccctgg

SEQ ID NO: 47236 - DNA, 25 bp, E. coli
tacaactgaccatcgtaagccctgg

SEQ ID NO: 47237 - DNA, 25 bp, E. coli
aaattattgcgccttaccgtggagc

SEQ ID NO: 47238 - DNA, 25 bp, E. coli
aaattattgcgcgttaccgtggagc

SEQ ID NO: 47239 - DNA, 25 bp, E. coli
tatatacaggcagtgcgtcccgatg

SEQ ID NO: 47240 - DNA, 25 bp, E. coli
tatatacaggcactgcgtcccgatg

SEQ ID NO: 47241 - DNA, 25 bp, E. coli
tcgataataaactaccgcttccagg

SEQ ID NO: 47242 - DNA, 25 bp, E. coli
tcgccggacgcactaagatatatgg

SEQ ID NO: 47243 - DNA, 25 bp, E. coli
tcgccggacgcagtaagatatatgg

SEQ ID NO: 47244 - DNA, 25 bp, E. coli
tcgataataaacaaccgcttccagg

SEQ ID NO: 47245 - DNA, 25 bp, E. coli
gcttcgcaggattacaggacattca

SEQ ID NO: 47246 - DNA, 25 bp, E. coli
gcttcgcaggataacaggacattca

SEQ ID NO: 47247 - DNA, 25 bp, E. coli
gaaatggttggaatacaccgctggg

SEQ ID NO: 47248 - DNA, 25 bp, E. coli
gaaatggttggattacaccgctggg

SEQ ID NO: 47249 - DNA, 25 bp, E. coli
cgaaggtacgaggtatcaggtcgcc

SEQ ID NO: 47250 - DNA, 25 bp, E. coli
cgaaggtacgagctatcaggtcgcc

SEQ ID NO: 47251 - DNA, 25 bp, E. coli
gatacgcactttatgatcggcggca

SEQ ID NO: 47252 - DNA, 25 bp, E. coli
gatttgcaactctcgggcagcggct

SEQ ID NO: 47253 - DNA, 25 bp, E. coli
gatttgcaactcacgggcagcggct

SEQ ID NO: 47254 - DNA, 25 bp, E. coli
gatacgcactttttgatcggcggca

SEQ ID NO: 47255 - DNA, 25 bp, E. coli
gatgccagctattgcaaacccgatg

SEQ ID NO: 47256 - DNA, 25 bp, E. coli
gatgccagctatagcaaacccgatg

SEQ ID NO: 47257 - DNA, 25 bp, E. coli
aataaggctttaatccgcatccggc

SEQ ID NO: 47258 - DNA, 25 bp, E. coli
aataaggctttattccgcatccggc

SEQ ID NO: 47259 - DNA, 25 bp, E. coli
taccagataactgcaatatattgaa

SEQ ID NO: 47260 - DNA, 25 bp, E. coli
taccagataactccaatatattgaa

SEQ ID NO: 47261 - DNA, 25 bp, E. coli
ttgccaccaattagagcgcccctta

SEQ ID NO: 47262 - DNA, 25 bp, E. coli
ttgccaccaatttgagcgcccctta

SEQ ID NO: 47263 - DNA, 25 bp, E. coli
tgtactttgccagcaatttgagcgc

SEQ ID NO: 47264 - DNA, 25 bp, E. coli
tgtactttgccaccaatttgagcgc

SEQ ID NO: 47265 - DNA, 25 bp, E. coli
tgaattttcgagtttatgtaggccg

SEQ ID NO: 47266 - DNA, 25 bp, E. coli
tgaattttcgagattatgtaggccg

SEQ ID NO: 47267 - DNA, 25 bp, E. coli
tccggcataaacaatgtgtactttg

SEQ ID NO: 47268 - DNA, 25 bp, E. coli
tccggcataaactatgtgtactttg

SEQ ID NO: 47269 - DNA, 25 bp, E. coli
tcgagattatgtaggccgaataagg

SEQ ID NO: 47270 - DNA, 25 bp, E. coli
tcgagattatgttggccgaataagg

SEQ ID NO: 47271 - DNA, 25 bp, E. coli
ccaggcctaccacataactgcaata

SEQ ID NO: 47272 - DNA, 25 bp, E. coli
ccaggcctaccagataactgcaata

SEQ ID NO: 47273 - DNA, 25 bp, E. coli
gcttaccaggccaaccagataactg

SEQ ID NO: 47274 - DNA, 25 bp, E. coli
gctacgcttaccaggcctaccagat

SEQ ID NO: 47275 - DNA, 25 bp, E. coli
gcttaccaggcctaccagataactg

SEQ ID NO: 47276 - DNA, 25 bp, E. coli
gctacgcttacctggcctaccagat

SEQ ID NO: 47277 - DNA, 25 bp, E. coli
taaggctttattccgcatccggcat

SEQ ID NO: 47278 - DNA, 25 bp, E. coli
taaggctttattgcgcatccggcat

SEQ ID NO: 47279 - DNA, 25 bp, E. coli
taaaaatccggtagcgcgtgaacgt

SEQ ID NO: 47280 - DNA, 25 bp, E. coli
tactgatggccagaaacgtgcgctc

SEQ ID NO: 47281 - DNA, 25 bp, E. coli
tactgatggccacaaacgtgcgctc

SEQ ID NO: 47282 - DNA, 25 bp, E. coli
taaaaatccggttgcgcgtgaacgt

SEQ ID NO: 47283 - DNA, 25 bp, E. coli
aaaaagcccagcctgaatatgccag

SEQ ID NO: 47284 - DNA, 25 bp, E. coli
aaaaagcccagcgtgaatatgccag

SEQ ID NO: 47285 - DNA, 25 bp, E. coli
tgaaaacgttggtccgaaacacctg

SEQ ID NO: 47286 - DNA, 25 bp, E. coli
tgcattcagccagtatgaccgtccg

SEQ ID NO: 47287 - DNA, 25 bp, E. coli
tgcattcagccactatgaccgtccg

SEQ ID NO: 47288 - DNA, 25 bp, E. coli
tgaaaacgttggaccgaaacacctg

SEQ ID NO: 47289 - DNA, 25 bp, E. coli
tcctgaaaaacggtgcgctgaacgc

SEQ ID NO: 47290 - DNA, 25 bp, E. coli
tcctgaaaaacgctgcgctgaacgc

SEQ ID NO: 47291 - DNA, 25 bp, E. coli
cctggcgaacgtggataaactgtct

SEQ ID NO: 47292 - DNA, 25 bp, E. coli
gccaacctggttttggacatgccga

SEQ ID NO: 47293 - DNA, 25 bp, E. coli
cctggcgaacgtcgataaactgtct

SEQ ID NO: 47294 - DNA, 25 bp, E. coli
gccaacctggttatggacatgccga

SEQ ID NO: 47295 - DNA, 25 bp, E. coli
cgaaatctatccgtgaagctggcgt

SEQ ID NO: 47296 - DNA, 25 bp, E. coli
cgaaatctatccctgaagctggcgt

SEQ ID NO: 47297 - DNA, 25 bp, E. coli
taagatcgagaaactgctggcatgg

SEQ ID NO: 47298 - DNA, 25 bp, E. coli
tcaatggcgcactaactgggttccc

SEQ ID NO: 47299 - DNA, 25 bp, E. coli
taagatcgagaatctgctggcatgg

SEQ ID NO: 47300 - DNA, 25 bp, E. coli
tcaatggcgcacaaactgggttccc

SEQ ID NO: 47301 - DNA, 25 bp, E. coli
cacactaagcatttcggcgagagcg

SEQ ID NO: 47302 - DNA, 25 bp, E. coli
caacaccggccgaaaatgcagcatg

SEQ ID NO: 47303 - DNA, 25 bp, E. coli
caacaccggccgtaaatgcagcatg

SEQ ID NO: 47304 - DNA, 25 bp, E. coli
cacactaagcatatcggcgagagcg

SEQ ID NO: 47305 - DNA, 25 bp, E. coli
tactttgcggcagatgaacaaacgc

SEQ ID NO: 47306 - DNA, 25 bp, E. coli
tactttgcggcacatgaacaaacgc

SEQ ID NO: 47307 - DNA, 25 bp, E. coli
aaagaggttcgccttgcgtcacctg

SEQ ID NO: 47308 - DNA, 25 bp, E. coli
actatattctcttgacgcccaggcg

SEQ ID NO: 47309 - DNA, 25 bp, E. coli
actatattctctagacgcccaggcg

SEQ ID NO: 47310 - DNA, 25 bp, E. coli
aaagaggttcgcgttgcgtcacctg

SEQ ID NO: 47311 - DNA, 25 bp, E. coli
aacggaatcgttgcacggtcgtaca

SEQ ID NO: 47312 - DNA, 25 bp, E. coli
aacggaatcgttccacggtcgtaca

SEQ ID NO: 47313 - DNA, 25 bp, E. coli
ttaaagacaaggatcgcgcaatgcg

SEQ ID NO: 47314 - DNA, 25 bp, E. coli
ttaaagacaaggttcgcgcaatgcg

SEQ ID NO: 47315 - DNA, 25 bp, E. coli
tgctgctccggtgacgaaagaggtt

SEQ ID NO: 47316 - DNA, 25 bp, E. coli
tgctgctccggtcacgaaagaggtt

SEQ ID NO: 47317 - DNA, 25 bp, E. coli
tgcagtcgatgctattcccggcgga

SEQ ID NO: 47318 - DNA, 25 bp, E. coli
tgcagtcgatgcaattcccggcgga

SEQ ID NO: 47319 - DNA, 25 bp, E. coli
taatcagaccaagccgaaacatgtg

SEQ ID NO: 47320 - DNA, 25 bp, E. coli
taatcagaccaacccgaaacatgtg

SEQ ID NO: 47321 - DNA, 25 bp, E. coli
gcgtcacctgctttcgtcgaagcga

SEQ ID NO: 47322 - DNA, 25 bp, E. coli
gcgtcacctgctatcgtcgaagcga

SEQ ID NO: 47323 - DNA, 25 bp, E. coli
aattttattatttgtacctcttgag

SEQ ID NO: 47324 - DNA, 25 bp, E. coli
aattttattattagtacctcttgag

SEQ ID NO: 47325 - DNA, 25 bp, E. coli
catgcgttaatggtgttctggtttg

SEQ ID NO: 47326 - DNA, 25 bp, E. coli
cttgttggtttttctctctgatatt

SEQ ID NO: 47327 - DNA, 25 bp, E. coli
catgcgttaatgctgttctggtttg

SEQ ID NO: 47328 - DNA, 25 bp, E. coli
cttgttggttttactctctgatatt

SEQ ID NO: 47329 - DNA, 25 bp, E. coli
tatctgaagcagacattgttataat

SEQ ID NO: 47330 - DNA, 25 bp, E. coli
tatctgaagcagtcattgttataat

SEQ ID NO: 47331 - DNA, 25 bp, E. coli
ttttttcggacctttctgcccaagg

SEQ ID NO: 47332 - DNA, 25 bp, E. coli
tttcggaccattctgcccaagggct

SEQ ID NO: 47333 - DNA, 25 bp, E. coli
ttttttcggaccattctgcccaagg

SEQ ID NO: 47334 - DNA, 25 bp, E. coli
tttcggaccattgtgcccaagggct

SEQ ID NO: 47335 - DNA, 25 bp, E. coli
tcggaccattctgcccaagggctaa

SEQ ID NO: 47336 - DNA, 25 bp, E. coli
tcggaccattctccccaagggctaa

SEQ ID NO: 47337 - DNA, 25 bp, E. coli
gaagcagtcattcttataattttat

SEQ ID NO: 47338 - DNA, 25 bp, E. coli
gaagcagtcattgttataattttat

SEQ ID NO: 47339 - DNA, 25 bp, E. coli
ggttaatcatgcgttaatggtgttc

SEQ ID NO: 47340 - DNA, 25 bp, E. coli
ggttaatcatgccttaatggtgttc

SEQ ID NO: 47341 - DNA, 25 bp, E. coli
taatggtgttctggtttgttacaaa

SEQ ID NO: 47342 - DNA, 25 bp, E. coli
taatcatgcgttaatggtgttctgg

SEQ ID NO: 47343 - DNA, 25 bp, E. coli
taatcatgcgtttatggtgttctgg

SEQ ID NO: 47344 - DNA, 25 bp, E. coli
taatggtgttctcgtttgttacaaa

SEQ ID NO: 47345 - DNA, 25 bp, E. coli
caggtgtggtggatgttgcttttcc

SEQ ID NO: 47346 - DNA, 25 bp, E. coli
caggtgtggtggttgttgcttttcc

SEQ ID NO: 47347 - DNA, 25 bp, E. coli
tactgtttttgtgaatggcattgca

SEQ ID NO: 47348 - DNA, 25 bp, E. coli
tactgtttttgtcaatggcattgca

SEQ ID NO: 47349 - DNA, 25 bp, E. coli
atggcattgcagcagccggataatg

SEQ ID NO: 47350 - DNA, 25 bp, E. coli
atggcattgcaggagccggataatg

SEQ ID NO: 47351 - DNA, 25 bp, E. coli
tgtgaatggcatagcagcagccgga

SEQ ID NO: 47352 - DNA, 25 bp, E. coli
tgtgaatggcattgcagcagccgga

SEQ ID NO: 47353 - DNA, 25 bp, E. coli
tgaaaaagaaaaggccagactgtta

SEQ ID NO: 47354 - DNA, 25 bp, E. coli
tgaaaaagaaaacgccagactgtta

SEQ ID NO: 47355 - DNA, 25 bp, E. coli
tgctgaaaaagaaaacgccagactg

SEQ ID NO: 47356 - DNA, 25 bp, E. coli
tccgttgctgaaaaagaaaacgcca

SEQ ID NO: 47357 - DNA, 25 bp, E. coli
tgctgaaaaagataacgccagactg

SEQ ID NO: 47358 - DNA, 25 bp, E. coli
tccgttgctgaataagaaaacgcca

SEQ ID NO: 47359 - DNA, 25 bp, E. coli
ccggataatgtcagtgctggctgac

SEQ ID NO: 47360 - DNA, 25 bp, E. coli
ccggataatgtctgtgctggctgac

SEQ ID NO: 47361 - DNA, 25 bp, E. coli
ctgacggtgtgcaggtggcaggtgt

SEQ ID NO: 47362 - DNA, 25 bp, E. coli
ctgacggtgtgctggtggcaggtgt

SEQ ID NO: 47363 - DNA, 25 bp, E. coli
tggttgttgcttttccgttgctgaa

SEQ ID NO: 47364 - DNA, 25 bp, E. coli
tggttgttgcttatccgttgctgaa

SEQ ID NO: 47365 - DNA, 25 bp, E. coli
taatgtcagtgcaggctgacggtgt

SEQ ID NO: 47366 - DNA, 25 bp, E. coli
taatgtcagtgctggctgacggtgt

SEQ ID NO: 47367 - DNA, 25 bp, E. coli
aatttatgcgctgcgggaatatggc

SEQ ID NO: 47368 - DNA, 25 bp, E. coli
aatttatgcgctccgggaatatggc

SEQ ID NO: 47369 - DNA, 25 bp, E. coli
tatggttgacatgaaaactacgcat

SEQ ID NO: 47370 - DNA, 25 bp, E. coli
tatggttgacatcaaaactacgcat

SEQ ID NO: 47371 - DNA, 25 bp, E. coli
tagccggaataatcaacaggtcata

SEQ ID NO: 47372 - DNA, 25 bp, E. coli
tagccggaataaacaacaggtcata

SEQ ID NO: 47373 - DNA, 25 bp, E. coli
tttagccgggcgcatcgctgcaatt

SEQ ID NO: 47374 - DNA, 25 bp, E. coli
tttagccgggcggatcgctgcaatt

SEQ ID NO: 47375 - DNA, 25 bp, E. coli
gctgcaatttatgcgctgcgggaat

SEQ ID NO: 47376 - DNA, 25 bp, E. coli
gcgagttttcgccagcaggatttac

SEQ ID NO: 47377 - DNA, 25 bp, E. coli
gctgcaatttatccgctgcgggaat

SEQ ID NO: 47378 - DNA, 25 bp, E. coli
gcgagttttcgcgagcaggatttac

SEQ ID NO: 47379 - DNA, 25 bp, E. coli
cgtttgtcatcaatctctaatatgg

SEQ ID NO: 47380 - DNA, 25 bp, E. coli
cgtttgtcatcattctctaatatgg

SEQ ID NO: 47381 - DNA, 25 bp, E. coli
gattttctctgcacaaaccgcaaga

SEQ ID NO: 47382 - DNA, 25 bp, E. coli
gttgagtttgatccggcgagttttc

SEQ ID NO: 47383 - DNA, 25 bp, E. coli
gattttctctgctcaaaccgcaaga

SEQ ID NO: 47384 - DNA, 25 bp, E. coli
gttgagtttgatgcggcgagttttc

SEQ ID NO: 47385 - DNA, 25 bp, E. coli
gggtatacggcaccattagtcactg

SEQ ID NO: 47386 - DNA, 25 bp, E. coli
gggtatacggcagcattagtcactg

SEQ ID NO: 47387 - DNA, 25 bp, E. coli
tggcattgatattgaagagattttc

SEQ ID NO: 47388 - DNA, 25 bp, E. coli
tggcattgatatagaagagattttc

SEQ ID NO: 47389 - DNA, 25 bp, E. coli
tactccatttctcccgggctggatt

SEQ ID NO: 47390 - DNA, 25 bp, E. coli
tactccatttctgccgggctggatt

SEQ ID NO: 47391 - DNA, 25 bp, E. coli
actgaaattattgccgaaaccggtg

SEQ ID NO: 47392 - DNA, 25 bp, E. coli
actgaaattattcccgaaaccggtg

SEQ ID NO: 47393 - DNA, 25 bp, E. coli
agagtcttactccatttctgccggg

SEQ ID NO: 47394 - DNA, 25 bp, E. coli
agagtcttactcgatttctgccggg

SEQ ID NO: 47395 - DNA, 25 bp, E. coli
ttaaaacgctttccctgcatgaagg

SEQ ID NO: 47396 - DNA, 25 bp, E. coli
ttaaaacgctttgcctgcatgaagg

SEQ ID NO: 47397 - DNA, 25 bp, E. coli
gcctttaaaacgctttgcctgcatg

SEQ ID NO: 47398 - DNA, 25 bp, E. coli
gcccaacgttttgcggatgcgctta

SEQ ID NO: 47399 - DNA, 25 bp, E. coli
gccagtcgcccaacgttttccggat

SEQ ID NO: 47400 - DNA, 25 bp, E. coli
gccagtcgcccatcgttttccggat

SEQ ID NO: 47401 - DNA, 25 bp, E. coli
gcctttaaaacggtttgcctgcatg

SEQ ID NO: 47402 - DNA, 25 bp, E. coli
gcccaacgttttccggatgcgctta

SEQ ID NO: 47403 - DNA, 25 bp, E. coli
gcggatgggtaatactgaaattatt

SEQ ID NO: 47404 - DNA, 25 bp, E. coli
gcggatgggtaaaactgaaattatt

SEQ ID NO: 47405 - DNA, 25 bp, E. coli
gcaacatgcgtaactcaacagcact

SEQ ID NO: 47406 - DNA, 25 bp, E. coli
gcaacatgcgtatctcaacagcact

SEQ ID NO: 47407 - DNA, 25 bp, E. coli
gacgatgaagccgtggaagccttta

SEQ ID NO: 47408 - DNA, 25 bp, E. coli
gacgatgaagccctggaagccttta

SEQ ID NO: 47409 - DNA, 25 bp, E. coli
gtcggcccgcaacatgcgtatctca

SEQ ID NO: 47410 - DNA, 25 bp, E. coli
gtcggcccgcaagatgcgtatctca

SEQ ID NO: 47411 - DNA, 25 bp, E. coli
caactggaaaatccagccgggagca

SEQ ID NO: 47412 - DNA, 25 bp, E. coli
caactggaaaatgcagccgggagca

SEQ ID NO: 47413 - DNA, 25 bp, E. coli
tacaggagaaaggaaagtgaaccgc

SEQ ID NO: 47414 - DNA, 25 bp, E. coli
tacaggagaaagcaaagtgaaccgc

SEQ ID NO: 47415 - DNA, 25 bp, E. coli
tattcgtggtgattttctggcggac

SEQ ID NO: 47416 - DNA, 25 bp, E. coli
tattcgtggtgaatttctggcggac

SEQ ID NO: 47417 - DNA, 25 bp, E. coli
tattatgctctgaaaaccgttggcc

SEQ ID NO: 47418 - DNA, 25 bp, E. coli
tatcattttctggtcagtgccgcga

SEQ ID NO: 47419 - DNA, 25 bp, E. coli
tatcattttctgctcagtgccgcga

SEQ ID NO: 47420 - DNA, 25 bp, E. coli
tattatgctctgtaaaccgttggcc

SEQ ID NO: 47421 - DNA, 25 bp, E. coli
ttttctggcggacacaccatcgcga

SEQ ID NO: 47422 - DNA, 25 bp, E. coli
ttttctggcggagacaccatcgcga

SEQ ID NO: 47423 - DNA, 25 bp, E. coli
tgacacattacgagaaatgcagcgt

SEQ ID NO: 47424 - DNA, 25 bp, E. coli
tgacacattacgtgaaatgcagcgt

SEQ ID NO: 47425 - DNA, 25 bp, E. coli
ccgggagcaccgatatatgatacga

SEQ ID NO: 47426 - DNA, 25 bp, E. coli
ccattgcggatgcttaaaggaacag

SEQ ID NO: 47427 - DNA, 25 bp, E. coli
ccattgcggatggttaaaggaacag

SEQ ID NO: 47428 - DNA, 25 bp, E. coli
ccgggagcaccgttatatgatacga

SEQ ID NO: 47429 - DNA, 25 bp, E. coli
gttatgaacaacagagtagcacggg

SEQ ID NO: 47430 - DNA, 25 bp, E. coli
gttatgaacaactgagtagcacggg

SEQ ID NO: 47431 - DNA, 25 bp, E. coli
taactggctggcactacggctattc

SEQ ID NO: 47432 - DNA, 25 bp, E. coli
taactggctggctctacggctattc

SEQ ID NO: 47433 - DNA, 25 bp, E. coli
aatgtgctggtccaaaaaccgttca

SEQ ID NO: 47434 - DNA, 25 bp, E. coli
aatgtgctggtcgaaaaaccgttca

SEQ ID NO: 47435 - DNA, 25 bp, E. coli
cattttgactattaccgcccggtgg

SEQ ID NO: 47436 - DNA, 25 bp, E. coli
tatcgttcacggtaagaaaggttcg

SEQ ID NO: 47437 - DNA, 25 bp, E. coli
taaacgatcccgttgttaagctggt

SEQ ID NO: 47438 - DNA, 25 bp, E. coli
tatcgttcacggaaagaaaggttcg

SEQ ID NO: 47439 - DNA, 25 bp, E. coli
taaacgatcccgatgttaagctggt

SEQ ID NO: 47440 - DNA, 25 bp, E. coli
aggctaatattaagccgggcgaacc

SEQ ID NO: 47441 - DNA, 25 bp, E. coli
attatttctctgttcggtcgcccgg

SEQ ID NO: 47442 - DNA, 25 bp, E. coli
attatttctctgatcggtcgcccgg

SEQ ID NO: 47443 - DNA, 25 bp, E. coli
aggctaatattatgccgggcgaacc

SEQ ID NO: 47444 - DNA, 25 bp, E. coli
tatcgaccagcacgaaaccagcctg

SEQ ID NO: 47445 - DNA, 25 bp, E. coli
tatcgaccagcaggaaaccagcctg

SEQ ID NO: 47446 - DNA, 25 bp, E. coli
cattttgactataaccgcccggtgg

SEQ ID NO: 47447 - DNA, 25 bp, E. coli
gatcacgtcgctaatgacatccgca

SEQ ID NO: 47448 - DNA, 25 bp, E. coli
gatcacgtcgcttatgacatccgca

SEQ ID NO: 47449 - DNA, 25 bp, E. coli
ggtgcgccaaattacgtcaaggaat

SEQ ID NO: 47450 - DNA, 25 bp, E. coli
ggtgcgccaaataacgtcaaggaat

SEQ ID NO: 47451 - DNA, 25 bp, E. coli
tggccttggtgtgcatacgatggac

SEQ ID NO: 47452 - DNA, 25 bp, E. coli
tggccttggtgtccatacgatggac

SEQ ID NO: 47453 - DNA, 25 bp, E. coli
taaccgcaaggaaagctggcatgtc

SEQ ID NO: 47454 - DNA, 25 bp, E. coli
taaccgcaaggatagctggcatgtc

SEQ ID NO: 47455 - DNA, 25 bp, E. coli
caactggcgtggattgattaccaac

SEQ ID NO: 47456 - DNA, 25 bp, E. coli
caactggcgtggtttgattaccaac

SEQ ID NO: 47457 - DNA, 25 bp, E. coli
tatgcctttgcgcttatcaacctgg

SEQ ID NO: 47458 - DNA, 25 bp, E. coli
tatgcctttgcggttatcaacctgg

SEQ ID NO: 47459 - DNA, 25 bp, E. coli
tgatagcggacataacctcagcctg

SEQ ID NO: 47460 - DNA, 25 bp, E. coli
tgatagcggacaaaacctcagcctg

SEQ ID NO: 47461 - DNA, 25 bp, E. coli
tgagtatcgagcgtaaaatgttcca

SEQ ID NO: 47462 - DNA, 25 bp, E. coli
tgagtatcgagcctaaaatgttcca

SEQ ID NO: 47463 - DNA, 25 bp, E. coli
tctgtacggtaatgaccattgtggc

SEQ ID NO: 47464 - DNA, 25 bp, E. coli
tctgtacggtaaagaccattgtggc

SEQ ID NO: 47465 - DNA, 25 bp, E. coli
tctgacactggcgtacttcggcagc

SEQ ID NO: 47466 - DNA, 25 bp, E. coli
tctgacactggcctacttcggcagc

SEQ ID NO: 47467 - DNA, 25 bp, E. coli
gctggcggcgcaaggctattatttc

SEQ ID NO: 47468 - DNA, 25 bp, E. coli
gctggcggcgcatggctattatttc

SEQ ID NO: 47469 - DNA, 25 bp, E. coli
cattgtggcttcacgcaatcgtggc

SEQ ID NO: 47470 - DNA, 25 bp, E. coli
cattgtggcttctcgcaatcgtggc

SEQ ID NO: 47471 - DNA, 25 bp, E. coli
cattatcatgaaggatggcgtggac

SEQ ID NO: 47472 - DNA, 25 bp, E. coli
cattatcatgaacgatggcgtggac

SEQ ID NO: 47473 - DNA, 25 bp, E. coli
gattgttcccggtctgctgcaaaaa

SEQ ID NO: 47474 - DNA, 25 bp, E. coli
gattgttcccggactgctgcaaaaa

SEQ ID NO: 47475 - DNA, 25 bp, E. coli
ggcagccgaattgtccagcagttaa

SEQ ID NO: 47476 - DNA, 25 bp, E. coli
ggcagccgaattctccagcagttaa

SEQ ID NO: 47477 - DNA, 25 bp, E. coli
cagactggcgaacatatcacacaag

SEQ ID NO: 47478 - DNA, 25 bp, E. coli
cagactggcgaagatatcacacaag

SEQ ID NO: 47479 - DNA, 25 bp, E. coli
aaacctgctggatatcgaaagctta

SEQ ID NO: 47480 - DNA, 25 bp, E. coli
aaacctgctggaaatcgaaagctta

SEQ ID NO: 47481 - DNA, 25 bp, E. coli
tgatagcccgaaaaaggcaattacc

SEQ ID NO: 47482 - DNA, 25 bp, E. coli
tgatagcccgaataaggcaattacc

SEQ ID NO: 47483 - DNA, 25 bp, E. coli
tgctctacgcaaatacaacgcgaag

SEQ ID NO: 47484 - DNA, 25 bp, E. coli
tgctctacgcaattacaacgcgaag

SEQ ID NO: 47485 - DNA, 25 bp, E. coli
tcgtgatagcccgaaaaaggcaatt

SEQ ID NO: 47486 - DNA, 25 bp, E. coli
tcgtgatagccccaaaaaggcaatt

SEQ ID NO: 47487 - DNA, 25 bp, E. coli
gaagatatcacacaagatacgttgt

SEQ ID NO: 47488 - DNA, 25 bp, E. coli
gcagattcaacacactggcgaagat

SEQ ID NO: 47489 - DNA, 25 bp, E. coli
gcagattcaacagactggcgaagat

SEQ ID NO: 47490 - DNA, 25 bp, E. coli
gaagatatcacagaagatacgttgt

SEQ ID NO: 47491 - DNA, 25 bp, E. coli
ctggatatcgaaagcttaaaagttg

SEQ ID NO: 47492 - DNA, 25 bp, E. coli
cgttatgtgatgtaaccgatgttac

SEQ ID NO: 47493 - DNA, 25 bp, E. coli
cgaaagcttaaatgttgatgatctt

SEQ ID NO: 47494 - DNA, 25 bp, E. coli
cgaaagcttaaaagttgatgatctt

SEQ ID NO: 47495 - DNA, 25 bp, E. coli
ctggatatcgaatgcttaaaagttg

SEQ ID NO: 47496 - DNA, 25 bp, E. coli
cgttatgtgatgaaaccgatgttac

SEQ ID NO: 47497 - DNA, 25 bp, E. coli
gggcgtaatgctgtacgcaattaca

SEQ ID NO: 47498 - DNA, 25 bp, E. coli
gggcgtaatgctctacgcaattaca

SEQ ID NO: 47499 - DNA, 25 bp, E. coli
aatggtggtcgggtgttcgtcaaag

SEQ ID NO: 47500 - DNA, 25 bp, E. coli
aatggtggtcggctgttcgtcaaag

SEQ ID NO: 47501 - DNA, 25 bp, E. coli
taaaaatgatgctcttcggcgcaag

SEQ ID NO: 47502 - DNA, 25 bp, E. coli
taaaaatgatgcacttcggcgcaag

SEQ ID NO: 47503 - DNA, 25 bp, E. coli
agctaaaaatgatgctcttcggcgc

SEQ ID NO: 47504 - DNA, 25 bp, E. coli
ataatggtggtccggtgttcgtcaa

SEQ ID NO: 47505 - DNA, 25 bp, E. coli
ataatggtggtcgggtgttcgtcaa

SEQ ID NO: 47506 - DNA, 25 bp, E. coli
agctaaaaatgaagctcttcggcgc

SEQ ID NO: 47507 - DNA, 25 bp, E. coli
aaaaatgatgctgttcggcgcaagc

SEQ ID NO: 47508 - DNA, 25 bp, E. coli
aaaaatgatgctcttcggcgcaagc

SEQ ID NO: 47509 - DNA, 25 bp, E. coli
tgataatggtggtcgggtgttcgtc

SEQ ID NO: 47510 - DNA, 25 bp, E. coli
tgataatggtggacgggtgttcgtc

SEQ ID NO: 47511 - DNA, 25 bp, E. coli
gcttgataatggaggtcgggtgttc

SEQ ID NO: 47512 - DNA, 25 bp, E. coli
gcttgataatggtggtcgggtgttc

SEQ ID NO: 47513 - DNA, 25 bp, E. coli
gctaaaaatgatcctcttcggcgca

SEQ ID NO: 47514 - DNA, 25 bp, E. coli
gctaaaaatgatgctcttcggcgca

SEQ ID NO: 47515 - DNA, 25 bp, E. coli
ctaaaaatgatggtcttcggcgcaa

SEQ ID NO: 47516 - DNA, 25 bp, E. coli
ctaaaaatgatgctcttcggcgcaa

SEQ ID NO: 47517 - DNA, 25 bp, E. coli
tggtggtcgggtcttcgtcaaagga

SEQ ID NO: 47518 - DNA, 25 bp, E. coli
tggtggtcgggtgttcgtcaaagga

SEQ ID NO: 47519 - DNA, 25 bp, E. coli
taatggtggtcgcgtgttcgtcaaa

SEQ ID NO: 47520 - DNA, 25 bp, E. coli
taatggtggtcgggtgttcgtcaaa

SEQ ID NO: 47521 - DNA, 25 bp, E. coli
aattacgtgacgcatggaaacgcct

SEQ ID NO: 47522 - DNA, 25 bp, E. coli
aattacgtgacggatggaaacgcct

SEQ ID NO: 47523 - DNA, 25 bp, E. coli
ttgaacgaatcacccgtaaattacg

SEQ ID NO: 47524 - DNA, 25 bp, E. coli
ttgaacgaatcagccgtaaattacg

SEQ ID NO: 47525 - DNA, 25 bp, E. coli
tacgtgacggatcgaaacgccttat

SEQ ID NO: 47526 - DNA, 25 bp, E. coli
tacgtgacggatggaaacgccttat

SEQ ID NO: 47527 - DNA, 25 bp, E. coli
tgctggctgcccatccgaatcttta

SEQ ID NO: 47528 - DNA, 25 bp, E. coli
tgctggctgcccttccgaatcttta

SEQ ID NO: 47529 - DNA, 25 bp, E. coli
tgacggatggaaacgccttatcgac

SEQ ID NO: 47530 - DNA, 25 bp, E. coli
tgacggatggaatcgccttatcgac

SEQ ID NO: 47531 - DNA, 25 bp, E. coli
tgccattgcagggtggcctgttgct

SEQ ID NO: 47532 - DNA, 25 bp, E. coli
tgccattgcaggctggcctgttgct

SEQ ID NO: 47533 - DNA, 25 bp, E. coli
gctgcccttccgaatctttacttga

SEQ ID NO: 47534 - DNA, 25 bp, E. coli
gctgcccttccgtatctttacttga

SEQ ID NO: 47535 - DNA, 25 bp, E. coli
gaatctttacttgaacgaatcaccc

SEQ ID NO: 47536 - DNA, 25 bp, E. coli
gaatcacccgtatattacgtgacgg

SEQ ID NO: 47537 - DNA, 25 bp, E. coli
gaatctttacttcaacgaatcaccc

SEQ ID NO: 47538 - DNA, 25 bp, E. coli
gaatcacccgtaaattacgtgacgg

SEQ ID NO: 47539 - DNA, 25 bp, E. coli
cctgttgctggctgcccttccgaat

SEQ ID NO: 47540 - DNA, 25 bp, E. coli
cctgttgctggcagcccttccgaat

SEQ ID NO: 47541 - DNA, 25 bp, E. coli
ggatggaaacgccttatcgacatac

SEQ ID NO: 47542 - DNA, 25 bp, E. coli
ggatggaaacgcgttatcgacatac

SEQ ID NO: 47543 - DNA, 25 bp, E. coli
aacgacaagcggccgcggctctggc

SEQ ID NO: 47544 - DNA, 25 bp, E. coli
caacgacaagcgcgcgcggctctgg

SEQ ID NO: 47545 - DNA, 25 bp, E. coli
caacgacaagcgggcgcggctctgg

SEQ ID NO: 47546 - DNA, 25 bp, E. coli
atgcagtgcgccgccgggcaaactg

SEQ ID NO: 47547 - DNA, 25 bp, E. coli
atgcagtgcgcccccgggcaaactg

SEQ ID NO: 47548 - DNA, 25 bp, E. coli
agtgcgccgccgcgcaaactgttca

SEQ ID NO: 47549 - DNA, 25 bp, E. coli
agtgcgccgccgggcaaactgttca

SEQ ID NO: 47550 - DNA, 25 bp, E. coli
aacgacaagcgggcgcggctctggc

SEQ ID NO: 47551 - DNA, 25 bp, E. coli
gccgggcaaactgttcacgaactac

SEQ ID NO: 47552 - DNA, 25 bp, E. coli
gccgggcaaactcttcacgaactac

SEQ ID NO: 47553 - DNA, 25 bp, E. coli
gcaaactgttcacgaactactggag

SEQ ID NO: 47554 - DNA, 25 bp, E. coli
gcaaactgttcaggaactactggag

SEQ ID NO: 47555 - DNA, 25 bp, E. coli
ccgggcaaactgttcacgaactact

SEQ ID NO: 47556 - DNA, 25 bp, E. coli
ccgggcaaactgatcacgaactact

SEQ ID NO: 47557 - DNA, 25 bp, E. coli
cgggcaaactgtacacgaactactg

SEQ ID NO: 47558 - DNA, 25 bp, E. coli
cgggcaaactgttcacgaactactg

SEQ ID NO: 47559 - DNA, 25 bp, E. coli
ggcaaactgttcacgaactactgga

SEQ ID NO: 47560 - DNA, 25 bp, E. coli
ggcaaactgttctcgaactactgga

SEQ ID NO: 47561 - DNA, 25 bp, E. coli
gggcaaactgttgacgaactactgg

SEQ ID NO: 47562 - DNA, 25 bp, E. coli
gatgcagtgcgcggccgggcaaact

SEQ ID NO: 47563 - DNA, 25 bp, E. coli
gggcaaactgttcacgaactactgg

SEQ ID NO: 47564 - DNA, 25 bp, E. coli
gatgcagtgcgccgccgggcaaact

SEQ ID NO: 47565 - DNA, 25 bp, E. coli
tactgatatcctcttgggacctcgc

SEQ ID NO: 47566 - DNA, 25 bp, E. coli
tactgatatcctgttgggacctcgc

SEQ ID NO: 47567 - DNA, 25 bp, E. coli
tgaaactgaatcatcacccgcgcgc

SEQ ID NO: 47568 - DNA, 25 bp, E. coli
tgaaactgaatcttcacccgcgcgc

SEQ ID NO: 47569 - DNA, 25 bp, E. coli
tgaaattgccatgactgcccgctat

SEQ ID NO: 47570 - DNA, 25 bp, E. coli
tgaaattgccatcactgcccgctat

SEQ ID NO: 47571 - DNA, 25 bp, E. coli
tgctggaaggccagatcgacgatcg

SEQ ID NO: 47572 - DNA, 25 bp, E. coli
tgccggaaatccctccagcgatgga

SEQ ID NO: 47573 - DNA, 25 bp, E. coli
tgccggaaatccgtccagcgatgga

SEQ ID NO: 47574 - DNA, 25 bp, E. coli
tgctggaaggcctgatcgacgatcg

SEQ ID NO: 47575 - DNA, 25 bp, E. coli
gcgcgccagtaagagcatcaatacg

SEQ ID NO: 47576 - DNA, 25 bp, E. coli
ccacttttttctgagcgctgcggcg

SEQ ID NO: 47577 - DNA, 25 bp, E. coli
gcgcgccagtaacagcatcaatacg

SEQ ID NO: 47578 - DNA, 25 bp, E. coli
ccacttttttctcagcgctgcggcg

SEQ ID NO: 47579 - DNA, 25 bp, E. coli
gcaaccaggtctttgacgccgaaat

SEQ ID NO: 47580 - DNA, 25 bp, E. coli
gcaaccaggtctatgacgccgaaat

SEQ ID NO: 47581 - DNA, 25 bp, E. coli
cgatcgaactcggtgtaagcctcat

SEQ ID NO: 47582 - DNA, 25 bp, E. coli
cgatcgaactcgctgtaagcctcat

SEQ ID NO: 47583 - DNA, 25 bp, E. coli
taaactggatagagaacgtctgaac

SEQ ID NO: 47584 - DNA, 25 bp, E. coli
taaactggatagtgaacgtctgaac

SEQ ID NO: 47585 - DNA, 25 bp, E. coli
gacgatcgcgaatctccgctgcata

SEQ ID NO: 47586 - DNA, 25 bp, E. coli
gacgatcgcgaaactccgctgcata

SEQ ID NO: 47587 - DNA, 25 bp, E. coli
cagcggtagacactaacgatccagg

SEQ ID NO: 47588 - DNA, 25 bp, E. coli
cagcggtagacagtaacgatccagg

SEQ ID NO: 47589 - DNA, 25 bp, E. coli
tacgctcaagacaaagctgatagcc

SEQ ID NO: 47590 - DNA, 25 bp, E. coli
tacagttactgcatgatgaaggtcg

SEQ ID NO: 47591 - DNA, 25 bp, E. coli
tacagttactgcttgatgaaggtcg

SEQ ID NO: 47592 - DNA, 25 bp, E. coli
caactttcccgaacaaggagttgtg

SEQ ID NO: 47593 - DNA, 25 bp, E. coli
caactttcccgatcaaggagttgtg

SEQ ID NO: 47594 - DNA, 25 bp, E. coli
tacgctcaagactaagctgatagcc

SEQ ID NO: 47595 - DNA, 25 bp, E. coli
tccggcacatttagcacgtttacag

SEQ ID NO: 47596 - DNA, 25 bp, E. coli
tccggcacattttgcacgtttacag

SEQ ID NO: 47597 - DNA, 25 bp, E. coli
gctgatagcctcgaaaaacgccttt

SEQ ID NO: 47598 - DNA, 25 bp, E. coli
gctgatagcctccaaaaacgccttt

SEQ ID NO: 47599 - DNA, 25 bp, E. coli
cgttgcagatcttcgccctttcaaa

SEQ ID NO: 47600 - DNA, 25 bp, E. coli
cggcaggagtctttgaacacgtttc

SEQ ID NO: 47601 - DNA, 25 bp, E. coli
cgttgcagatctacgccctttcaaa

SEQ ID NO: 47602 - DNA, 25 bp, E. coli
cggcaggagtctatgaacacgtttc

SEQ ID NO: 47603 - DNA, 25 bp, E. coli
ggtccaatgccaccggtagacagta

SEQ ID NO: 47604 - DNA, 25 bp, E. coli
ggtccaatgccagcggtagacagta

SEQ ID NO: 47605 - DNA, 25 bp, E. coli
ggctgcgggattaactggctcaacc

SEQ ID NO: 47606 - DNA, 25 bp, E. coli
ggctgcgggatttactggctcaacc

SEQ ID NO: 47607 - DNA, 25 bp, E. coli
gatgctgacccgtacgtagcggcag

SEQ ID NO: 47608 - DNA, 25 bp, E. coli
gatgctgacccgaacgtagcggcag

SEQ ID NO: 47609 - DNA, 25 bp, E. coli
cagttagggatctcgcgcaaaacgc

SEQ ID NO: 47610 - DNA, 25 bp, E. coli
cagttagggatcacgcgcaaaacgc

SEQ ID NO: 47611 - DNA, 25 bp, E. coli
atatatttccgatcgcgagctgccg

SEQ ID NO: 47612 - DNA, 25 bp, E. coli
atatatttccgaacgcgagctgccg

SEQ ID NO: 47613 - DNA, 25 bp, E. coli
tatggtcggtaatagcccggcgatg

SEQ ID NO: 47614 - DNA, 25 bp, E. coli
tatggtcggtaaaagcccggcgatg

SEQ ID NO: 47615 - DNA, 25 bp, E. coli
tgaatgccgggccttttcgccagga

SEQ ID NO: 47616 - DNA, 25 bp, E. coli
tgaatgccgggcgttttcgccagga

SEQ ID NO: 47617 - DNA, 25 bp, E. coli
tgcgattcaggagcgcgaagttcag

SEQ ID NO: 47618 - DNA, 25 bp, E. coli
tgcgattcaggaccgcgaagttcag

SEQ ID NO: 47619 - DNA, 25 bp, E. coli
gaaaaaccgctgctaacgctcaact

SEQ ID NO: 47620 - DNA, 25 bp, E. coli
gaaaaaccgctggtaacgctcaact

SEQ ID NO: 47621 - DNA, 25 bp, E. coli
gattcattacgactggccgggaaat

SEQ ID NO: 47622 - DNA, 25 bp, E. coli
gatcttgccgcacaggtgaatgccg

SEQ ID NO: 47623 - DNA, 25 bp, E. coli
gatcttgccgcagaggtgaatgccg

SEQ ID NO: 47624 - DNA, 25 bp, E. coli
gattcattacgagtggccgggaaat

SEQ ID NO: 47625 - DNA, 25 bp, E. coli
ggattatctcatgaagccgctggat

SEQ ID NO: 47626 - DNA, 25 bp, E. coli
ggattatctcatcaagccgctggat

SEQ ID NO: 47627 - DNA, 25 bp, E. coli
ggatgatgacattagccactgcact

SEQ ID NO: 47628 - DNA, 25 bp, E. coli
ggcgatgcaacacctgctcagtgaa

SEQ ID NO: 47629 - DNA, 25 bp, E. coli
ggatgatgacataagccactgcact

SEQ ID NO: 47630 - DNA, 25 bp, E. coli
ggcgatgcaacagctgctcagtgaa

SEQ ID NO: 47631 - DNA, 25 bp, E. coli
aatgctccggtttcatgtcgtcaaa

SEQ ID NO: 47632 - DNA, 25 bp, E. coli
aatgctccggttacatgtcgtcaaa

SEQ ID NO: 47633 - DNA, 25 bp, E. coli
caaaatgctccgctttcatgtcgtc

SEQ ID NO: 47634 - DNA, 25 bp, E. coli
caaaatgctccggtttcatgtcgtc

SEQ ID NO: 47635 - DNA, 25 bp, E. coli
aaatgatgacgttattaagcattga

SEQ ID NO: 47636 - DNA, 25 bp, E. coli
aaattccatgcataatgctccggtt

SEQ ID NO: 47637 - DNA, 25 bp, E. coli
aaatgatgacgtaattaagcattga

SEQ ID NO: 47638 - DNA, 25 bp, E. coli
aaattccatgcaaaatgctccggtt

SEQ ID NO: 47639 - DNA, 25 bp, E. coli
tccatgcaaaatgctccggtttcat

SEQ ID NO: 47640 - DNA, 25 bp, E. coli
tccatgcaaaatcctccggtttcat

SEQ ID NO: 47641 - DNA, 25 bp, E. coli
tcatgtcgtcaaaatgatgacgtaa

SEQ ID NO: 47642 - DNA, 25 bp, E. coli
tcatgtcgtcaatatgatgacgtaa

SEQ ID NO: 47643 - DNA, 25 bp, E. coli
gctccggtttcaagtcgtcaaaatg

SEQ ID NO: 47644 - DNA, 25 bp, E. coli
gctccggtttcatgtcgtcaaaatg

SEQ ID NO: 47645 - DNA, 25 bp, E. coli
gaaaattccatggaaaatgctccgg

SEQ ID NO: 47646 - DNA, 25 bp, E. coli
gaaaattccatgcaaaatgctccgg

SEQ ID NO: 47647 - DNA, 25 bp, E. coli
ccggtttcatgtcgtcaaaatgatg

SEQ ID NO: 47648 - DNA, 25 bp, E. coli
ccggtttcatgtggtcaaaatgatg

SEQ ID NO: 47649 - DNA, 25 bp, E. coli
ggtttcatgtcgacaaaatgatgac

SEQ ID NO: 47650 - DNA, 25 bp, E. coli
ggtttcatgtcgtcaaaatgatgac

SEQ ID NO: 47651 - DNA, 25 bp, E. coli
tcaaaatgatgaggtaattaagcat

SEQ ID NO: 47652 - DNA, 25 bp, E. coli
tcaaaatgatgacgtaattaagcat

SEQ ID NO: 47653 - DNA, 25 bp, E. coli
tacgaacctttattgagccgccgtt

SEQ ID NO: 47654 - DNA, 25 bp, E. coli
tacgaacctttaatgagccgccgtt

SEQ ID NO: 47655 - DNA, 25 bp, E. coli
actctggtgaatattggcgtgggac

SEQ ID NO: 47656 - DNA, 25 bp, E. coli
actctggtgaattttggcgtgggac

SEQ ID NO: 47657 - DNA, 25 bp, E. coli
tatggaaagtgctaccattgccgcg

SEQ ID NO: 47658 - DNA, 25 bp, E. coli
tatcgtttccgcctgccatacggga

SEQ ID NO: 47659 - DNA, 25 bp, E. coli
tatcgtttccgcgtgccatacggga

SEQ ID NO: 47660 - DNA, 25 bp, E. coli
tatggaaagtgcaaccattgccgcg

SEQ ID NO: 47661 - DNA, 25 bp, E. coli
tgccctttcttgtgctggcgggaac

SEQ ID NO: 47662 - DNA, 25 bp, E. coli
tgccctttcttgagctggcgggaac

SEQ ID NO: 47663 - DNA, 25 bp, E. coli
tcaggcactggaaaaactcgacgcg

SEQ ID NO: 47664 - DNA, 25 bp, E. coli
tcaggcactggataaactcgacgcg

SEQ ID NO: 47665 - DNA, 25 bp, E. coli
gaattacctgatgaaaacgcccgca

SEQ ID NO: 47666 - DNA, 25 bp, E. coli
gaattacctgatcaaaacgcccgca

SEQ ID NO: 47667 - DNA, 25 bp, E. coli
gaagcgccagaacaagccatttccg

SEQ ID NO: 47668 - DNA, 25 bp, E. coli
gaagcgccagaagaagccatttccg

SEQ ID NO: 47669 - DNA, 25 bp, E. coli
cattcgggcgatcgatttgctgcgc

SEQ ID NO: 47670 - DNA, 25 bp, E. coli
cattcgggcgatggatttgctgcgc

SEQ ID NO: 47671 - DNA, 25 bp, E. coli
taagccgggccgtagcaattgatat

SEQ ID NO: 47672 - DNA, 25 bp, E. coli
taagccgggccgaagcaattgatat

SEQ ID NO: 47673 - DNA, 25 bp, E. coli
gacgcgctgtatgagcaatctgtag

SEQ ID NO: 47674 - DNA, 25 bp, E. coli
gacgcgctgtatcagcaatctgtag

SEQ ID NO: 47675 - DNA, 25 bp, E. coli
aatggacgttatatcaatgcaggcg

SEQ ID NO: 47676 - DNA, 25 bp, E. coli
aatggacgttatttcaatgcaggcg

SEQ ID NO: 47677 - DNA, 25 bp, E. coli
caatgatagtacacaggcggcatgt

SEQ ID NO: 47678 - DNA, 25 bp, E. coli
caatgatagtactcaggcggcatgt

SEQ ID NO: 47679 - DNA, 25 bp, E. coli
cacactgctgtaactggatgccgat

SEQ ID NO: 47680 - DNA, 25 bp, E. coli
cacactgctgtatctggatgccgat

SEQ ID NO: 47681 - DNA, 25 bp, E. coli
taaagaggcgcgcactgttgcagaa

SEQ ID NO: 47682 - DNA, 25 bp, E. coli
taactaaaccatcgcatagctgggc

SEQ ID NO: 47683 - DNA, 25 bp, E. coli
taaagaggcgcggactgttgcagaa

SEQ ID NO: 47684 - DNA, 25 bp, E. coli
aaaatactttgcagatctgccgacg

SEQ ID NO: 47685 - DNA, 25 bp, E. coli
aaaatactttgctgatctgccgacg

SEQ ID NO: 47686 - DNA, 25 bp, E. coli
tgaataatatcttcctcgcgaagga

SEQ ID NO: 47687 - DNA, 25 bp, E. coli
tgaataatatctacctcgcgaagga

SEQ ID NO: 47688 - DNA, 25 bp, E. coli
ggtcgtacgcgacatacttcagggt

SEQ ID NO: 47689 - DNA, 25 bp, E. coli
ggtcgtacgcgagatacttcagggt

SEQ ID NO: 47690 - DNA, 25 bp, E. coli
ggcggcatgtgctaaacgtcttaac

SEQ ID NO: 47691 - DNA, 25 bp, E. coli
ggcggcatgtgcaaaacgtcttaac

SEQ ID NO: 47692 - DNA, 25 bp, E. coli
taagcatctgtttgcccatggtgag

SEQ ID NO: 47693 - DNA, 25 bp, E. coli
taatatcgcgcgtgaacaatctccc

SEQ ID NO: 47694 - DNA, 25 bp, E. coli
taagcatctgttagcccatggtgag

SEQ ID NO: 47695 - DNA, 25 bp, E. coli
taactaaaccatggcatagctgggc

SEQ ID NO: 47696 - DNA, 25 bp, E. coli
taatatcgcgcgagaacaatctccc

SEQ ID NO: 47697 - DNA, 25 bp, E. coli
caacgatgccatctgcctggtggag

SEQ ID NO: 47698 - DNA, 25 bp, E. coli
caaccgtaatctatctgtatggcga

SEQ ID NO: 47699 - DNA, 25 bp, E. coli
caacgatgccatgtgcctggtggag

SEQ ID NO: 47700 - DNA, 25 bp, E. coli
caaccgtaatctttctgtatggcga

SEQ ID NO: 47701 - DNA, 25 bp, E. coli
caacattagacctgggcgagcgggt

SEQ ID NO: 47702 - DNA, 25 bp, E. coli
caacattagaccagggcgagcgggt

SEQ ID NO: 47703 - DNA, 25 bp, E. coli
tagcgaaagcctgcgatggcgcaac

SEQ ID NO: 47704 - DNA, 25 bp, E. coli
actttgatttgttccgccttgccga

SEQ ID NO: 47705 - DNA, 25 bp, E. coli
aaagccccacttatacgctggtcga

SEQ ID NO: 47706 - DNA, 25 bp, E. coli
actttgatttgtaccgccttgccga

SEQ ID NO: 47707 - DNA, 25 bp, E. coli
aaagccccacttttacgctggtcga

SEQ ID NO: 47708 - DNA, 25 bp, E. coli
tagcgaaagcctccgatggcgcaac

SEQ ID NO: 47709 - DNA, 25 bp, E. coli
tgttcttcctgacccggatgtcgaa

SEQ ID NO: 47710 - DNA, 25 bp, E. coli
tgttcttcctgagccggatgtcgaa

SEQ ID NO: 47711 - DNA, 25 bp, E. coli
gccgatcccgaggagctggagttta

SEQ ID NO: 47712 - DNA, 25 bp, E. coli
gccgatcccgagcagctggagttta

SEQ ID NO: 47713 - DNA, 25 bp, E. coli
cattgattatcaggcacaaggccgt

SEQ ID NO: 47714 - DNA, 25 bp, E. coli
cattgattatcacgcacaaggccgt

SEQ ID NO: 47715 - DNA, 25 bp, E. coli
gggatccgcgattattttgccaacg

SEQ ID NO: 47716 - DNA, 25 bp, E. coli
gggatccgcgataattttgccaacg

SEQ ID NO: 47717 - DNA, 25 bp, E. coli
tggagtggccactacaaggtacagg

SEQ ID NO: 47718 - DNA, 25 bp, E. coli
tggagtggccacaacaaggtacagg

SEQ ID NO: 47719 - DNA, 25 bp, E. coli
caacgttgtgtaacgatggcgggaa

SEQ ID NO: 47720 - DNA, 25 bp, E. coli
caacgttgtgtatcgatggcgggaa

SEQ ID NO: 47721 - DNA, 25 bp, E. coli
tacatcgcatcgctcgtacagctcg

SEQ ID NO: 47722 - DNA, 25 bp, E. coli
tacagctcgtgctggaaatagcggt

SEQ ID NO: 47723 - DNA, 25 bp, E. coli
tacagctcgtgcaggaaatagcggt

SEQ ID NO: 47724 - DNA, 25 bp, E. coli
tacgttttgctaacggtagcgcccg

SEQ ID NO: 47725 - DNA, 25 bp, E. coli
tacatcgcatcggtcgtacagctcg

SEQ ID NO: 47726 - DNA, 25 bp, E. coli
aaaagccaaaatgcgcccgggtgat

SEQ ID NO: 47727 - DNA, 25 bp, E. coli
aaaagccaaaatccgcccgggtgat

SEQ ID NO: 47728 - DNA, 25 bp, E. coli
tacgttttgctatcggtagcgcccg

SEQ ID NO: 47729 - DNA, 25 bp, E. coli
tatttaaccatgtcgccggtgcagg

SEQ ID NO: 47730 - DNA, 25 bp, E. coli
tatttaaccatgacgccggtgcagg

SEQ ID NO: 47731 - DNA, 25 bp, E. coli
tgaactttgagcaggcgtgggaccc

SEQ ID NO: 47732 - DNA, 25 bp, E. coli
tgaactttgagctggcgtgggaccc

SEQ ID NO: 47733 - DNA, 25 bp, E. coli
tctgcgacgcgcagaatgaagtagg

SEQ ID NO: 47734 - DNA, 25 bp, E. coli
tctgcgacgcgctgaatgaagtagg

SEQ ID NO: 47735 - DNA, 25 bp, E. coli
cgcatattatcgaggcaacgccggg

SEQ ID NO: 47736 - DNA, 25 bp, E. coli
cgcatattatcgtggcaacgccggg

SEQ ID NO: 47737 - DNA, 25 bp, E. coli
gatccttgccggaaaagatgttcgc

SEQ ID NO: 47738 - DNA, 25 bp, E. coli
gatgcgtcgctatttcaaacccagg

SEQ ID NO: 47739 - DNA, 25 bp, E. coli
gatgcgtcgctaattcaaacccagg

SEQ ID NO: 47740 - DNA, 25 bp, E. coli
gatccttgccggtaaagatgttcgc

SEQ ID NO: 47741 - DNA, 25 bp, E. coli
atggattattgttgcgtaggaagga

SEQ ID NO: 47742 - DNA, 25 bp, E. coli
aaagacactaatgaaaatggccaat

SEQ ID NO: 47743 - DNA, 25 bp, E. coli
atggattattgtagcgtaggaagga

SEQ ID NO: 47744 - DNA, 25 bp, E. coli
aaagacactaatcaaaatggccaat

SEQ ID NO: 47745 - DNA, 25 bp, E. coli
tgttgcgtaggatggaacaataatg

SEQ ID NO: 47746 - DNA, 25 bp, E. coli
tgttgcgtaggaaggaacaataatg

SEQ ID NO: 47747 - DNA, 25 bp, E. coli
tgcgtaggaaggtacaataatgata

SEQ ID NO: 47748 - DNA, 25 bp, E. coli
tgcgtaggaaggaacaataatgata

SEQ ID NO: 47749 - DNA, 25 bp, E. coli
gctactgagagtaaagacactaatg

SEQ ID NO: 47750 - DNA, 25 bp, E. coli
gctactgagagttaagacactaatg

SEQ ID NO: 47751 - DNA, 25 bp, E. coli
gaaggaacgctactgagagtaaaga

SEQ ID NO: 47752 - DNA, 25 bp, E. coli
gaaggaacgctagtgagagtaaaga

SEQ ID NO: 47753 - DNA, 25 bp, E. coli
gaacgctactgagagtaaagacact

SEQ ID NO: 47754 - DNA, 25 bp, E. coli
gaacgctactgacagtaaagacact

SEQ ID NO: 47755 - DNA, 25 bp, E. coli
cgtaggaaggaagaataatgatagt

SEQ ID NO: 47756 - DNA, 25 bp, E. coli
cgtaggaaggaacaataatgatagt

SEQ ID NO: 47757 - DNA, 25 bp, E. coli
gattattgttgcctaggaaggaaca

SEQ ID NO: 47758 - DNA, 25 bp, E. coli
gtaaagacactattgaaaatggcca

SEQ ID NO: 47759 - DNA, 25 bp, E. coli
gattattgttgcgtaggaaggaaca

SEQ ID NO: 47760 - DNA, 25 bp, E. coli
gtaaagacactaatgaaaatggcca

SEQ ID NO: 47761 - DNA, 25 bp, E. coli
ggaacaataatgttagtgttcccag

SEQ ID NO: 47762 - DNA, 25 bp, E. coli
ggaacaataatgatagtgttcccag

SEQ ID NO: 47763 - DNA, 25 bp, E. coli
aatcagcatctgacgccattgtacg

SEQ ID NO: 47764 - DNA, 25 bp, E. coli
aatgcggtaaaggacatagaactcc

SEQ ID NO: 47765 - DNA, 25 bp, E. coli
aatcagcatctgtcgccattgtacg

SEQ ID NO: 47766 - DNA, 25 bp, E. coli
tacgttcgggctacgcacgttcaaa

SEQ ID NO: 47767 - DNA, 25 bp, E. coli
taaattaatgtatcagcaagtagtg

SEQ ID NO: 47768 - DNA, 25 bp, E. coli
taaataatagtcaccaaaatgcggt

SEQ ID NO: 47769 - DNA, 25 bp, E. coli
taaataatagtctccaaaatgcggt

SEQ ID NO: 47770 - DNA, 25 bp, E. coli
taaattaatgtaacagcaagtagtg

SEQ ID NO: 47771 - DNA, 25 bp, E. coli
tacgttcgggcttcgcacgttcaaa

SEQ ID NO: 47772 - DNA, 25 bp, E. coli
gaccaaaacgttgaaaggaactgag

SEQ ID NO: 47773 - DNA, 25 bp, E. coli
gaccaaaacgttcaaaggaactgag

SEQ ID NO: 47774 - DNA, 25 bp, E. coli
aatgcggtaaagcacatagaactcc

SEQ ID NO: 47775 - DNA, 25 bp, E. coli
tagaactccgaagactacgttcggg

SEQ ID NO: 47776 - DNA, 25 bp, E. coli
tagaactccgaacactacgttcggg

SEQ ID NO: 47777 - DNA, 25 bp, E. coli
tcgccttaaagaaatgcaaacaact

SEQ ID NO: 47778 - DNA, 25 bp, E. coli
tcgccttaaagatatgcaaacaact

SEQ ID NO: 47779 - DNA, 25 bp, E. coli
cccgttttcggtatcataatcagca

SEQ ID NO: 47780 - DNA, 25 bp, E. coli
cccgttttcggtttcataatcagca

SEQ ID NO: 47781 - DNA, 25 bp, E. coli
ggaactgagaattcgttaagagaag

SEQ ID NO: 47782 - DNA, 25 bp, E. coli
ggaactgagaatacgttaagagaag

SEQ ID NO: 47783 - DNA, 25 bp, E. coli
tcaaaaaagtgacaaaggaagcatc

SEQ ID NO: 47784 - DNA, 25 bp, E. coli
tcaaaaaagtgagaaaggaagcatc

SEQ ID NO: 47785 - DNA, 25 bp, E. coli
caatgccagtgagtatgacgcgcgt

SEQ ID NO: 47786 - DNA, 25 bp, E. coli
caatgccagtgactatgacgcgcgt

SEQ ID NO: 47787 - DNA, 25 bp, E. coli
aaagatagattccacgctgcgaggc

SEQ ID NO: 47788 - DNA, 25 bp, E. coli
aaagatagattcgacgctgcgaggc

SEQ ID NO: 47789 - DNA, 25 bp, E. coli
tatcggcgcagaaattgaagccctg

SEQ ID NO: 47790 - DNA, 25 bp, E. coli
tattgagcgccccaattgcggacat

SEQ ID NO: 47791 - DNA, 25 bp, E. coli
tatcggcgcagatattgaagccctg

SEQ ID NO: 47792 - DNA, 25 bp, E. coli
tattgagcgcccgaattgcggacat

SEQ ID NO: 47793 - DNA, 25 bp, E. coli
tgtgatgcaggctaaacaaccgctg

SEQ ID NO: 47794 - DNA, 25 bp, E. coli
tgtgatgcaggcaaaacaaccgctg

SEQ ID NO: 47795 - DNA, 25 bp, E. coli
tgacgcgcgtattgtgcaggccttg

SEQ ID NO: 47796 - DNA, 25 bp, E. coli
tgacgcgcgtatagtgcaggccttg

SEQ ID NO: 47797 - DNA, 25 bp, E. coli
gacatcatccggatgcagacggcca

SEQ ID NO: 47798 - DNA, 25 bp, E. coli
gacatcatccggttgcagacggcca

SEQ ID NO: 47799 - DNA, 25 bp, E. coli
gatcgacaccctatgccagcgttgg

SEQ ID NO: 47800 - DNA, 25 bp, E. coli
ggaaaccgagtttgccagcgatccg

SEQ ID NO: 47801 - DNA, 25 bp, E. coli
ggaaaccgagttagccagcgatccg

SEQ ID NO: 47802 - DNA, 25 bp, E. coli
taagctggcggcgatgaaaataacc

SEQ ID NO: 47803 - DNA, 25 bp, E. coli
taagctggcggccatgaaaataacc

SEQ ID NO: 47804 - DNA, 25 bp, E. coli
gatgagtcatctgcctctggcgaat

SEQ ID NO: 47805 - DNA, 25 bp, E. coli
gatcgacaccctttgccagcgttgg

SEQ ID NO: 47806 - DNA, 25 bp, E. coli
gatgagtcatctccctctggcgaat

SEQ ID NO: 47807 - DNA, 25 bp, E. coli
aatgttggtactcactgatggcgct

SEQ ID NO: 47808 - DNA, 25 bp, E. coli
aatgttggtactgactgatggcgct

SEQ ID NO: 47809 - DNA, 25 bp, E. coli
caccagcaggataatgttggtactg

SEQ ID NO: 47810 - DNA, 25 bp, E. coli
caccagcaggattatgttggtactg

SEQ ID NO: 47811 - DNA, 25 bp, E. coli
cagcaggataatgttggtactgact

SEQ ID NO: 47812 - DNA, 25 bp, E. coli
cagcaggataatcttggtactgact

SEQ ID NO: 47813 - DNA, 25 bp, E. coli
atgttggtactgactgatggcgctc

SEQ ID NO: 47814 - DNA, 25 bp, E. coli
atgttggtactgtctgatggcgctc

SEQ ID NO: 47815 - DNA, 25 bp, E. coli
ttcaccagcaggataatgttggtac

SEQ ID NO: 47816 - DNA, 25 bp, E. coli
ttcaccagcaggttaatgttggtac

SEQ ID NO: 47817 - DNA, 25 bp, E. coli
ccagcaggataaagttggtactgac

SEQ ID NO: 47818 - DNA, 25 bp, E. coli
ccagcaggataatgttggtactgac

SEQ ID NO: 47819 - DNA, 25 bp, E. coli
gcaggataatgtaggtactgactga

SEQ ID NO: 47820 - DNA, 25 bp, E. coli
gcaggataatgttggtactgactga

SEQ ID NO: 47821 - DNA, 25 bp, E. coli
gatttcaccagcaggataatgttgg

SEQ ID NO: 47822 - DNA, 25 bp, E. coli
gatttcaccagctggataatgttgg

SEQ ID NO: 47823 - DNA, 25 bp, E. coli
gataatgttggttctgactgatggc

SEQ ID NO: 47824 - DNA, 25 bp, E. coli
gataatgttggtactgactgatggc

SEQ ID NO: 47825 - DNA, 25 bp, E. coli
ggatttcaccagcaggataatgttg

SEQ ID NO: 47826 - DNA, 25 bp, E. coli
ggatttcaccaggaggataatgttg

SEQ ID NO: 47827 - DNA, 25 bp, E. coli
taatgttggtacagactgatggcgc

SEQ ID NO: 47828 - DNA, 25 bp, E. coli
taatgttggtactgactgatggcgc

SEQ ID NO: 47829 - DNA, 25 bp, E. coli
caagaatacaggcaaagaagtctct

SEQ ID NO: 47830 - DNA, 25 bp, E. coli
caagccgaaacggaaatcgccgact

SEQ ID NO: 47831 - DNA, 25 bp, E. coli
caagaatacagggaaagaagtctct

SEQ ID NO: 47832 - DNA, 25 bp, E. coli
caagccgaaacgcaaatcgccgact

SEQ ID NO: 47833 - DNA, 25 bp, E. coli
accgggcttgaatgttatgatgtca

SEQ ID NO: 47834 - DNA, 25 bp, E. coli
accgggcttgaaagttatgatgtca

SEQ ID NO: 47835 - DNA, 25 bp, E. coli
aaaaatcgccgacctgaacaagaat

SEQ ID NO: 47836 - DNA, 25 bp, E. coli
aaaaatcgccgagctgaacaagaat

SEQ ID NO: 47837 - DNA, 25 bp, E. coli
tgatgtcaaaatcaaaataatgtga

SEQ ID NO: 47838 - DNA, 25 bp, E. coli
tgatgtcaaaatgaaaataatgtga

SEQ ID NO: 47839 - DNA, 25 bp, E. coli
tcgccgagctgaacaagaatacagg

SEQ ID NO: 47840 - DNA, 25 bp, E. coli
tcgcttcaccgcacgagaaaaaatg

SEQ ID NO: 47841 - DNA, 25 bp, E. coli
tcgccgagctgatcaagaatacagg

SEQ ID NO: 47842 - DNA, 25 bp, E. coli
tcgcttcaccgctcgagaaaaaatg

SEQ ID NO: 47843 - DNA, 25 bp, E. coli
gcacgagaaaaaatgaccgggcttg

SEQ ID NO: 47844 - DNA, 25 bp, E. coli
gcacgagaaaaattgaccgggcttg

SEQ ID NO: 47845 - DNA, 25 bp, E. coli
gactttatcgcgcaaaaaatcgccg

SEQ ID NO: 47846 - DNA, 25 bp, E. coli
gactttatcgcggaaaaaatcgccg

SEQ ID NO: 47847 - DNA, 25 bp, E. coli
gaaattcgcttctccgcacgagaaa

SEQ ID NO: 47848 - DNA, 25 bp, E. coli
gaaattcgcttcaccgcacgagaaa

SEQ ID NO: 47849 - DNA, 25 bp, E. coli
gggaaagaagtctctgaaattcgct

SEQ ID NO: 47850 - DNA, 25 bp, E. coli
gggaaagaagtcactgaaattcgct

SEQ ID NO: 47851 - DNA, 25 bp, E. coli
caagttacttgtgggcggcttcgct

SEQ ID NO: 47852 - DNA, 25 bp, E. coli
caagttacttgtcggcggcttcgct

SEQ ID NO: 47853 - DNA, 25 bp, E. coli
tagcctgatgctgcagaagctgccg

SEQ ID NO: 47854 - DNA, 25 bp, E. coli
tagcctgatgctccagaagctgccg

SEQ ID NO: 47855 - DNA, 25 bp, E. coli
ttttcactggtgtaagggcgtcgct

SEQ ID NO: 47856 - DNA, 25 bp, E. coli
ttttcaatacgctgggcgtgcgcgg

SEQ ID NO: 47857 - DNA, 25 bp, E. coli
ttttcactggtgaaagggcgtcgct

SEQ ID NO: 47858 - DNA, 25 bp, E. coli
ttttcaatacgcagggcgtgcgcgg

SEQ ID NO: 47859 - DNA, 25 bp, E. coli
tcggcggttcttgcagttgcaataa

SEQ ID NO: 47860 - DNA, 25 bp, E. coli
tcatcgcagcgtacaaacctggagt

SEQ ID NO: 47861 - DNA, 25 bp, E. coli
tcatgctcgcctgaatgtgcctgcg

SEQ ID NO: 47862 - DNA, 25 bp, E. coli
tcatgctcgcctcaatgtgcctgcg

SEQ ID NO: 47863 - DNA, 25 bp, E. coli
tcggcggttcttccagttgcaataa

SEQ ID NO: 47864 - DNA, 25 bp, E. coli
tcatcgcagcgttcaaacctggagt

SEQ ID NO: 47865 - DNA, 25 bp, E. coli
gcattcccggtgtatcaaaacgtga

SEQ ID NO: 47866 - DNA, 25 bp, E. coli
gcattcccggtgaatcaaaacgtga

SEQ ID NO: 47867 - DNA, 25 bp, E. coli
gaagctgccggaaatgctcatcctg

SEQ ID NO: 47868 - DNA, 25 bp, E. coli
gaagctgccggatatgctcatcctg

SEQ ID NO: 47869 - DNA, 25 bp, E. coli
cattattatgatccgtggcctcgac

SEQ ID NO: 47870 - DNA, 25 bp, E. coli
cattattatgatgcgtggcctcgac

SEQ ID NO: 47871 - DNA, 25 bp, E. coli
ggcctcgacgtggtgatgattttca

SEQ ID NO: 47872 - DNA, 25 bp, E. coli
ggcctcgacgtgctgatgattttca

SEQ ID NO: 47873 - DNA, 25 bp, E. coli
caactcgaacagtgtgcaaggcatc

SEQ ID NO: 47874 - DNA, 25 bp, E. coli
caactcgaacagagtgcaaggcatc

SEQ ID NO: 47875 - DNA, 25 bp, E. coli
cttggcaccgcaatagaaaagatgg

SEQ ID NO: 47876 - DNA, 25 bp, E. coli
cttggcaccgcattagaaaagatgg

SEQ ID NO: 47877 - DNA, 25 bp, E. coli
taaagccgcagacaattatcgcaag

SEQ ID NO: 47878 - DNA, 25 bp, E. coli
taaagccgcagagaattatcgcaag

SEQ ID NO: 47879 - DNA, 25 bp, E. coli
aaatccgtacatgttctgggacgca

SEQ ID NO: 47880 - DNA, 25 bp, E. coli
aaatccgtacatcttctgggacgca

SEQ ID NO: 47881 - DNA, 25 bp, E. coli
tagacggtctctacaacggaatgcg

SEQ ID NO: 47882 - DNA, 25 bp, E. coli
tagacggtctcttcaacggaatgcg

SEQ ID NO: 47883 - DNA, 25 bp, E. coli
tccgcgatgggatttatcaacaggc

SEQ ID NO: 47884 - DNA, 25 bp, E. coli
tccggtttgctaatgctccgaaaga

SEQ ID NO: 47885 - DNA, 25 bp, E. coli
tccggtttgctattgctccgaaaga

SEQ ID NO: 47886 - DNA, 25 bp, E. coli
tccgcgatgggaattatcaacaggc

SEQ ID NO: 47887 - DNA, 25 bp, E. coli
tcatcaatataagggacgctgggct

SEQ ID NO: 47888 - DNA, 25 bp, E. coli
tcatcaatataacggacgctgggct

SEQ ID NO: 47889 - DNA, 25 bp, E. coli
gttaggttatcctcgcattgaccgg

SEQ ID NO: 47890 - DNA, 25 bp, E. coli
gttaggttatccacgcattgaccgg

SEQ ID NO: 47891 - DNA, 25 bp, E. coli
gaacgttatttcaaacttggcaccg

SEQ ID NO: 47892 - DNA, 25 bp, E. coli
gaacgttatttctaacttggcaccg

SEQ ID NO: 47893 - DNA, 25 bp, E. coli
gatcttgaaaagttggctgaccagg

SEQ ID NO: 47894 - DNA, 25 bp, E. coli
gatcttgaaaagatggctgaccagg

SEQ ID NO: 47895 - DNA, 25 bp, E. coli
ctcaaacagagtggctattgcgggc

SEQ ID NO: 47896 - DNA, 25 bp, E. coli
ctcaaacagagtcgctattgcgggc

SEQ ID NO: 47897 - DNA, 25 bp, E. coli
tatgacgtttactatcaggaagcca

SEQ ID NO: 47898 - DNA, 25 bp, E. coli
tatgacgtttacaatcaggaagcca

SEQ ID NO: 47899 - DNA, 25 bp, E. coli
tattgcgggccgtacctgattgaga

SEQ ID NO: 47900 - DNA, 25 bp, E. coli
tattgcgggccgaacctgattgaga

SEQ ID NO: 47901 - DNA, 25 bp, E. coli
tgcaggccggaatcgggcatatcgt

SEQ ID NO: 47902 - DNA, 25 bp, E. coli
tgcaggccggaaacgggcatatcgt

SEQ ID NO: 47903 - DNA, 25 bp, E. coli
tccgtgacggccagaaagagagcgt

SEQ ID NO: 47904 - DNA, 25 bp, E. coli
tccgtgacggcctgaaagagagcgt

SEQ ID NO: 47905 - DNA, 25 bp, E. coli
tcaggaagccaaaaacgaaacgcgt

SEQ ID NO: 47906 - DNA, 25 bp, E. coli
tctgctcatcgtggtttcccgctgg

SEQ ID NO: 47907 - DNA, 25 bp, E. coli
tctgctcatcgtcgtttcccgctgg

SEQ ID NO: 47908 - DNA, 25 bp, E. coli
tcaggaagccaataacgaaacgcgt

SEQ ID NO: 47909 - DNA, 25 bp, E. coli
gcgcgtgccgtccatgtgcctttct

SEQ ID NO: 47910 - DNA, 25 bp, E. coli
gcgcgtgccgtcgatgtgcctttct

SEQ ID NO: 47911 - DNA, 25 bp, E. coli
gaaacgcgtcgtggtttccgtgacg

SEQ ID NO: 47912 - DNA, 25 bp, E. coli
gaaacgcgtcgtcgtttccgtgacg

SEQ ID NO: 47913 - DNA, 25 bp, E. coli
cgctggcgatggagatcatggatta

SEQ ID NO: 47914 - DNA, 25 bp, E. coli
cgctggcgatggtgatcatggatta

SEQ ID NO: 47915 - DNA, 25 bp, E. coli
ggcatctatgaaaaagcgctccccg

SEQ ID NO: 47916 - DNA, 25 bp, E. coli
ggcatctatgaataagcgctccccg

SEQ ID NO: 47917 - DNA, 25 bp, E. coli
caaaaaatctggacgagctggcgca

SEQ ID NO: 47918 - DNA, 25 bp, E. coli
caaaaaatctggtcgagctggcgca

SEQ ID NO: 47919 - DNA, 25 bp, E. coli
catggtttctcgtcttgcacagctg

SEQ ID NO: 47920 - DNA, 25 bp, E. coli
catggtttctcgacttgcacagctg

SEQ ID NO: 47921 - DNA, 25 bp, E. coli
tatttgagtccgcaatggcaacgct

SEQ ID NO: 47922 - DNA, 25 bp, E. coli
tatttgagtccggaatggcaacgct

SEQ ID NO: 47923 - DNA, 25 bp, E. coli
ttaatgttccggtggtgtactccga

SEQ ID NO: 47924 - DNA, 25 bp, E. coli
ttaatgttccggaggtgtactccga

SEQ ID NO: 47925 - DNA, 25 bp, E. coli
tgcccacgatgcgatgaataagttc

SEQ ID NO: 47926 - DNA, 25 bp, E. coli
tgcccacgatgccatgaataagttc

SEQ ID NO: 47927 - DNA, 25 bp, E. coli
gcccgggaagcatcgctggcaatta

SEQ ID NO: 47928 - DNA, 25 bp, E. coli
gcccgggaagcaacgctggcaatta

SEQ ID NO: 47929 - DNA, 25 bp, E. coli
gaatcgtttctgacgcagcatggac

SEQ ID NO: 47930 - DNA, 25 bp, E. coli
gaagccaatgttagcgaaccgacgg

SEQ ID NO: 47931 - DNA, 25 bp, E. coli
gaatggcactccctatgttaatcgc

SEQ ID NO: 47932 - DNA, 25 bp, E. coli
gaagccaatgtttgcgaaccgacgg

SEQ ID NO: 47933 - DNA, 25 bp, E. coli
gaatcgtttctgtcgcagcatggac

SEQ ID NO: 47934 - DNA, 25 bp, E. coli
gaatggcactccgtatgttaatcgc

SEQ ID NO: 47935 - DNA, 25 bp, E. coli
gacgtaccggaacatactgacattt

SEQ ID NO: 47936 - DNA, 25 bp, E. coli
gacgtaccggaagatactgacattt

SEQ ID NO: 47937 - DNA, 25 bp, E. coli
gaccgtgatagatgtgctggcgaca

SEQ ID NO: 47938 - DNA, 25 bp, E. coli
gaccgtgatagaagtgctggcgaca

SEQ ID NO: 47939 - DNA, 25 bp, E. coli
aatttcgacggcgtgcatcgcggtc

SEQ ID NO: 47940 - DNA, 25 bp, E. coli
aatttcgacggcctgcatcgcggtc

SEQ ID NO: 47941 - DNA, 25 bp, E. coli
caaactttttgcgaaggtggcgtgc

SEQ ID NO: 47942 - DNA, 25 bp, E. coli
caaactttttgccaaggtggcgtgc

SEQ ID NO: 47943 - DNA, 25 bp, E. coli
ttttgaacctcatccactggaactg

SEQ ID NO: 47944 - DNA, 25 bp, E. coli
ttttgaacctcaaccactggaactg

SEQ ID NO: 47945 - DNA, 25 bp, E. coli
tccacggtgatgtattagggcgcac

SEQ ID NO: 47946 - DNA, 25 bp, E. coli
tccacggtgatgaattagggcgcac

SEQ ID NO: 47947 - DNA, 25 bp, E. coli
gcagattgcgcgtgatgaattaacc

SEQ ID NO: 47948 - DNA, 25 bp, E. coli
gcactataggtttcccgacggcgaa

SEQ ID NO: 47949 - DNA, 25 bp, E. coli
gcagattgcgcgagatgaattaacc

SEQ ID NO: 47950 - DNA, 25 bp, E. coli
gcactataggttacccgacggcgaa

SEQ ID NO: 47951 - DNA, 25 bp, E. coli
cgcgctgttacacggcttgcaggaa

SEQ ID NO: 47952 - DNA, 25 bp, E. coli
cccgcaagaagggtgtgtgctgact

SEQ ID NO: 47953 - DNA, 25 bp, E. coli
cgcgctgttacagggcttgcaggaa

SEQ ID NO: 47954 - DNA, 25 bp, E. coli
cccgcaagaaggctgtgtgctgact

SEQ ID NO: 47955 - DNA, 25 bp, E. coli
gatacgcggcatacataatctcagc

SEQ ID NO: 47956 - DNA, 25 bp, E. coli
gatacgcggcattcataatctcagc

SEQ ID NO: 47957 - DNA, 25 bp, E. coli
tggaatacggctacgatatcaccag

SEQ ID NO: 47958 - DNA, 25 bp, E. coli
ggcgcaagcgcatcttaccggtgat

SEQ ID NO: 47959 - DNA, 25 bp, E. coli
tggaatacggcttcgatatcaccag

SEQ ID NO: 47960 - DNA, 25 bp, E. coli
ggcgcaagcgcaacttaccggtgat

SEQ ID NO: 47961 - DNA, 25 bp, E. coli
catcgaacgtgacctgaaagctggc

SEQ ID NO: 47962 - DNA, 25 bp, E. coli
catcgaacgtgagctgaaagctggc

SEQ ID NO: 47963 - DNA, 25 bp, E. coli
cgaaggttcctgcaaagcgtacaac

SEQ ID NO: 47964 - DNA, 25 bp, E. coli
cgaaggttcctggaaagcgtacaac

SEQ ID NO: 47965 - DNA, 25 bp, E. coli
taccgtaaaactgacaaccagggcg

SEQ ID NO: 47966 - DNA, 25 bp, E. coli
taccgtaaaactcacaaccagggcg

SEQ ID NO: 47967 - DNA, 25 bp, E. coli
tgtggtctgaaaaactgccgctgaa

SEQ ID NO: 47968 - DNA, 25 bp, E. coli
tgtggtctgaaatactgccgctgaa

SEQ ID NO: 47969 - DNA, 25 bp, E. coli
tggtctgcagacagaagctccgctg

SEQ ID NO: 47970 - DNA, 25 bp, E. coli
tggtctgcagactgaagctccgctg

SEQ ID NO: 47971 - DNA, 25 bp, E. coli
tctatcggtggtatgggcctcgacg

SEQ ID NO: 47972 - DNA, 25 bp, E. coli
tctgcaggctgatctggaaaacggc

SEQ ID NO: 47973 - DNA, 25 bp, E. coli
tctatcggtggtttgggcctcgacg

SEQ ID NO: 47974 - DNA, 25 bp, E. coli
tctgcaggctgaactggaaaacggc

SEQ ID NO: 47975 - DNA, 25 bp, E. coli
gaagcgcaggaaatggttgaccacc

SEQ ID NO: 47976 - DNA, 25 bp, E. coli
gaagcgcaggaattggttgaccacc

SEQ ID NO: 47977 - DNA, 25 bp, E. coli
gaaagctggcaagatcaccgaacaa

SEQ ID NO: 47978 - DNA, 25 bp, E. coli
gaaatacggctaggacatctctggt

SEQ ID NO: 47979 - DNA, 25 bp, E. coli
gaaatacggctacgacatctctggt

SEQ ID NO: 47980 - DNA, 25 bp, E. coli
gaaagctggcaacatcaccgaacaa

SEQ ID NO: 47981 - DNA, 25 bp, E. coli
gaccacctggtcatgaaactgcgta

SEQ ID NO: 47982 - DNA, 25 bp, E. coli
gaccacctggtcttgaaactgcgta

SEQ ID NO: 47983 - DNA, 25 bp, E. coli
aatgttcctcttgtgacgccagtcg

SEQ ID NO: 47984 - DNA, 25 bp, E. coli
aatgttcctcttctgacgccagtcg

SEQ ID NO: 47985 - DNA, 25 bp, E. coli
tacggctgagaccattgcactgtcc

SEQ ID NO: 47986 - DNA, 25 bp, E. coli
tacggctgagacgattgcactgtcc

SEQ ID NO: 47987 - DNA, 25 bp, E. coli
attatcgccgggtaatctcgccagg

SEQ ID NO: 47988 - DNA, 25 bp, E. coli
attatcgccgggaaatctcgccagg

SEQ ID NO: 47989 - DNA, 25 bp, E. coli
aaataacaggcgcatcgtgcccgtg

SEQ ID NO: 47990 - DNA, 25 bp, E. coli
aaataacaggcggatcgtgcccgtg

SEQ ID NO: 47991 - DNA, 25 bp, E. coli
ttcagcgaaacccatacctcatggg

SEQ ID NO: 47992 - DNA, 25 bp, E. coli
ttcagcgaaaccgatacctcatggg

SEQ ID NO: 47993 - DNA, 25 bp, E. coli
ccctgtcggaatcgaacggcggctt

SEQ ID NO: 47994 - DNA, 25 bp, E. coli
ccctgtcggaatggaacggcggctt

SEQ ID NO: 47995 - DNA, 25 bp, E. coli
cattgcgcaatctacaccggtggtc

SEQ ID NO: 47996 - DNA, 25 bp, E. coli
cattgcgcaatcaacaccggtggtc

SEQ ID NO: 47997 - DNA, 25 bp, E. coli
gatcaccttggcctatgcgcggcaa

SEQ ID NO: 47998 - DNA, 25 bp, E. coli
gatcaccttggcgtatgcgcggcaa

SEQ ID NO: 47999 - DNA, 25 bp, E. coli
ggatatctggactctgacactgcgt

SEQ ID NO: 48000 - DNA, 25 bp, E. coli
ggatatctggacactgacactgcgt

SEQ ID NO: 48001 - DNA, 25 bp, E. coli
taaccttactgagttctggcgcgaa

SEQ ID NO: 48002 - DNA, 25 bp, E. coli
taaccttactgacttctggcgcgaa

SEQ ID NO: 48003 - DNA, 25 bp, E. coli
gagaagtgacctatctgtggcgcgc

SEQ ID NO: 48004 - DNA, 25 bp, E. coli
gagaagtgacctttctgtggcgcgc

SEQ ID NO: 48005 - DNA, 25 bp, E. coli
atcatccgtctttgcgctaataccg

SEQ ID NO: 48006 - DNA, 25 bp, E. coli
atcatccgtcttagcgctaataccg

SEQ ID NO: 48007 - DNA, 25 bp, E. coli
ttaccgccgttacgcgtcatcatga

SEQ ID NO: 48008 - DNA, 25 bp, E. coli
ttaccgccgttaggcgtcatcatga

SEQ ID NO: 48009 - DNA, 25 bp, E. coli
tgccctgcccgcagaacaaaaaatt

SEQ ID NO: 48010 - DNA, 25 bp, E. coli
tgccctgcccgctgaacaaaaaatt

SEQ ID NO: 48011 - DNA, 25 bp, E. coli
tcatcgaaccgaagggatttgcctg

SEQ ID NO: 48012 - DNA, 25 bp, E. coli
tcatcgaaccgatgggatttgcctg

SEQ ID NO: 48013 - DNA, 25 bp, E. coli
gctaataccggctttcgtctgcata

SEQ ID NO: 48014 - DNA, 25 bp, E. coli
gctaataccggcattcgtctgcata

SEQ ID NO: 48015 - DNA, 25 bp, E. coli
gaaccagaaattgcgccaaatactg

SEQ ID NO: 48016 - DNA, 25 bp, E. coli
gaaccagaaattccgccaaatactg

SEQ ID NO: 48017 - DNA, 25 bp, E. coli
gatttgcctgggtcgataagcgcct

SEQ ID NO: 48018 - DNA, 25 bp, E. coli
gattatctgatgatcggcccggaaa

SEQ ID NO: 48019 - DNA, 25 bp, E. coli
gattatctgatgttcggcccggaaa

SEQ ID NO: 48020 - DNA, 25 bp, E. coli
gatttgcctgggacgataagcgcct

SEQ ID NO: 48021 - DNA, 25 bp, E. coli
ggcctgccagcgtgcattcttgatg

SEQ ID NO: 48022 - DNA, 25 bp, E. coli
ggcctgccagcgagcattcttgatg

SEQ ID NO: 48023 - DNA, 25 bp, E. coli
tggactatcacgagtttaccgccgt

SEQ ID NO: 48024 - DNA, 25 bp, E. coli
tggactatcacgtgtttaccgccgt

SEQ ID NO: 48025 - DNA, 25 bp, E. coli
taaacatcgtacattacgaaccaga

SEQ ID NO: 48026 - DNA, 25 bp, E. coli
taaacatcgtactttacgaaccaga

SEQ ID NO: 48027 - DNA, 25 bp, E. coli
aatgcgctgcttcatgacgctgaac

SEQ ID NO: 48028 - DNA, 25 bp, E. coli
aatgcgctgcttgatgacgctgaac

SEQ ID NO: 48029 - DNA, 25 bp, E. coli
atgattgcaaaacacgatctggtgc

SEQ ID NO: 48030 - DNA, 25 bp, E. coli
atgattgcaaaagacgatctggtgc

SEQ ID NO: 48031 - DNA, 25 bp, E. coli
tgctgcgatgattgcaaaacacgat

SEQ ID NO: 48032 - DNA, 25 bp, E. coli
tgctgcgatgatagcaaaacacgat

SEQ ID NO: 48033 - DNA, 25 bp, E. coli
tgcttgatgacggtgaacttgctgc

SEQ ID NO: 48034 - DNA, 25 bp, E. coli
tgcttgatgacgctgaacttgctgc

SEQ ID NO: 48035 - DNA, 25 bp, E. coli
gcttggtggcctcggctgcgcagct

SEQ ID NO: 48036 - DNA, 25 bp, E. coli
gcgatgattgcataacacgatctgg

SEQ ID NO: 48037 - DNA, 25 bp, E. coli
gctgaaggattctcgcgtgttggtg

SEQ ID NO: 48038 - DNA, 25 bp, E. coli
gctgaaggattcacgcgtgttggtg

SEQ ID NO: 48039 - DNA, 25 bp, E. coli
gcttggtggcctgggctgcgcagct

SEQ ID NO: 48040 - DNA, 25 bp, E. coli
gcgatgattgcaaaacacgatctgg

SEQ ID NO: 48041 - DNA, 25 bp, E. coli
gaacttgctgcgttgattgcaaaac

SEQ ID NO: 48042 - DNA, 25 bp, E. coli
gaacttgctgcgatgattgcaaaac

SEQ ID NO: 48043 - DNA, 25 bp, E. coli
cgctgcttgatgtcgctgaacttgc

SEQ ID NO: 48044 - DNA, 25 bp, E. coli
cgctgcttgatgacgctgaacttgc

SEQ ID NO: 48045 - DNA, 25 bp, E. coli
cgctgaacttgcagcgatgattgca

SEQ ID NO: 48046 - DNA, 25 bp, E. coli
cgctgaacttgctgcgatgattgca

SEQ ID NO: 48047 - DNA, 25 bp, E. coli
gatgacgctgaacttgctgcgatga

SEQ ID NO: 48048 - DNA, 25 bp, E. coli
gatgacgctgaagttgctgcgatga

SEQ ID NO: 48049 - DNA, 25 bp, E. coli
aagaaacctctattccagtgacaca

SEQ ID NO: 48050 - DNA, 25 bp, E. coli
aagaaacctctaatccagtgacaca

SEQ ID NO: 48051 - DNA, 25 bp, E. coli
cacaattgcgccaaattaattacat

SEQ ID NO: 48052 - DNA, 25 bp, E. coli
cacatgcgccactagaaacctctat

SEQ ID NO: 48053 - DNA, 25 bp, E. coli
cacatgcgccacaagaaacctctat

SEQ ID NO: 48054 - DNA, 25 bp, E. coli
cacaattgcgcctaattaattacat

SEQ ID NO: 48055 - DNA, 25 bp, E. coli
cagtgacacaatagcgcctaattaa

SEQ ID NO: 48056 - DNA, 25 bp, E. coli
cagtgacacaattgcgcctaattaa

SEQ ID NO: 48057 - DNA, 25 bp, E. coli
tgcattcgacgtcctgcgcctttat

SEQ ID NO: 48058 - DNA, 25 bp, E. coli
tgcattcgacgtgctgcgcctttat

SEQ ID NO: 48059 - DNA, 25 bp, E. coli
tcaccagcaggaaacgccttgtcca

SEQ ID NO: 48060 - DNA, 25 bp, E. coli
tctattccagtgacacaattgcgcc

SEQ ID NO: 48061 - DNA, 25 bp, E. coli
tctattccagtgtcacaattgcgcc

SEQ ID NO: 48062 - DNA, 25 bp, E. coli
gccagacgcagcacattcttgcatt

SEQ ID NO: 48063 - DNA, 25 bp, E. coli
gccagacgcagctcattcttgcatt

SEQ ID NO: 48064 - DNA, 25 bp, E. coli
cattcttgcattggacgtgctgcgc

SEQ ID NO: 48065 - DNA, 25 bp, E. coli
cattcttgcattcgacgtgctgcgc

SEQ ID NO: 48066 - DNA, 25 bp, E. coli
ggaaacgccttgtccatagacgccc

SEQ ID NO: 48067 - DNA, 25 bp, E. coli
ggaaacgccttgaccatagacgccc

SEQ ID NO: 48068 - DNA, 25 bp, E. coli
tcaccagcaggatacgccttgtcca

SEQ ID NO: 48069 - DNA, 25 bp, E. coli
gacgtgctgcgcctttatttatcac

SEQ ID NO: 48070 - DNA, 25 bp, E. coli
gacgtgctgcgcgtttatttatcac

SEQ ID NO: 48071 - DNA, 25 bp, E. coli
caactggagcttatcagcagcgcct

SEQ ID NO: 48072 - DNA, 25 bp, E. coli
caactggagcttttcagcagcgcct

SEQ ID NO: 48073 - DNA, 25 bp, E. coli
tacaggaagcactggagcgaatcag

SEQ ID NO: 48074 - DNA, 25 bp, E. coli
tacaggaagcacaggagcgaatcag

SEQ ID NO: 48075 - DNA, 25 bp, E. coli
aaatcaaccggctgaaggcgctggt

SEQ ID NO: 48076 - DNA, 25 bp, E. coli
aaatcaaccggcagaaggcgctggt

SEQ ID NO: 48077 - DNA, 25 bp, E. coli
tatccggccggaagaggaatgctgt

SEQ ID NO: 48078 - DNA, 25 bp, E. coli
tatccggccggatgaggaatgctgt

SEQ ID NO: 48079 - DNA, 25 bp, E. coli
ttacagcggtgtgcttcaggccgat

SEQ ID NO: 48080 - DNA, 25 bp, E. coli
ttacagcggtgtccttcaggccgat

SEQ ID NO: 48081 - DNA, 25 bp, E. coli
tgttgctgaactgctggagccgctg

SEQ ID NO: 48082 - DNA, 25 bp, E. coli
tgttgctgaactcctggagccgctg

SEQ ID NO: 48083 - DNA, 25 bp, E. coli
tccacgatgtgcatgcaagagcgcc

SEQ ID NO: 48084 - DNA, 25 bp, E. coli
tccacgatgtgcttgcaagagcgcc

SEQ ID NO: 48085 - DNA, 25 bp, E. coli
tataccgtcgtcagggagtggagct

SEQ ID NO: 48086 - DNA, 25 bp, E. coli
tataccgtcgtctgggagtggagct

SEQ ID NO: 48087 - DNA, 25 bp, E. coli
taaggttatcgaaacacaacgtccg

SEQ ID NO: 48088 - DNA, 25 bp, E. coli
gaaacgctgggtcagcaatatgacc

SEQ ID NO: 48089 - DNA, 25 bp, E. coli
gaaacgctgggtgagcaatatgacc

SEQ ID NO: 48090 - DNA, 25 bp, E. coli
ggttaccttataggaatccggcaga

SEQ ID NO: 48091 - DNA, 25 bp, E. coli
ggttaccttatacgaatccggcaga

SEQ ID NO: 48092 - DNA, 25 bp, E. coli
taaggttatcgatacacaacgtccg

SEQ ID NO: 48093 - DNA, 25 bp, E. coli
tcgccctttcaactgtagcggaaac

SEQ ID NO: 48094 - DNA, 25 bp, E. coli
tgccgggtttaacgatgtggtattc

SEQ ID NO: 48095 - DNA, 25 bp, E. coli
tgccgggtttaaggatgtggtattc

SEQ ID NO: 48096 - DNA, 25 bp, E. coli
tcgccctttcaagtgtagcggaaac

SEQ ID NO: 48097 - DNA, 25 bp, E. coli
tgccggaggcaattactcaggcggt

SEQ ID NO: 48098 - DNA, 25 bp, E. coli
tgccggaggcaaatactcaggcggt

SEQ ID NO: 48099 - DNA, 25 bp, E. coli
gcgcagctgccggaggcaattactc

SEQ ID NO: 48100 - DNA, 25 bp, E. coli
gcgcagctgccgcaggcaattactc

SEQ ID NO: 48101 - DNA, 25 bp, E. coli
gaagagagcaaattcgccctttcaa

SEQ ID NO: 48102 - DNA, 25 bp, E. coli
gcaaaatcgcccattcaagtgtagc

SEQ ID NO: 48103 - DNA, 25 bp, E. coli
gcaaaatcgccctttcaagtgtagc

SEQ ID NO: 48104 - DNA, 25 bp, E. coli
gaagagagcaaaatcgccctttcaa

SEQ ID NO: 48105 - DNA, 25 bp, E. coli
gttactgggcatcggtggcgaaacc

SEQ ID NO: 48106 - DNA, 25 bp, E. coli
gttactgggcatgggtggcgaaacc

SEQ ID NO: 48107 - DNA, 25 bp, E. coli
gatcaacgacgttcctgcgcaaagt

SEQ ID NO: 48108 - DNA, 25 bp, E. coli
gatcaacgacgtacctgcgcaaagt

SEQ ID NO: 48109 - DNA, 25 bp, E. coli
gtttaaggatgtcgtattccagtac

SEQ ID NO: 48110 - DNA, 25 bp, E. coli
gtttaaggatgtggtattccagtac

SEQ ID NO: 48111 - DNA, 25 bp, E. coli
ggcgtttaagaacctgatgccgtta

SEQ ID NO: 48112 - DNA, 25 bp, E. coli
ggcgtttaagaagctgatgccgtta

SEQ ID NO: 48113 - DNA, 25 bp, E. coli
taagaacctgatcccgttactgggc

SEQ ID NO: 48114 - DNA, 25 bp, E. coli
taagaacctgatgccgttactgggc

SEQ ID NO: 48115 - DNA, 25 bp, E. coli
aaatagtggcagctaccggacgact

SEQ ID NO: 48116 - DNA, 25 bp, E. coli
aaatagtggcaggtaccggacgact

SEQ ID NO: 48117 - DNA, 25 bp, E. coli
tatggtgttacacaaaaagctgcgc

SEQ ID NO: 48118 - DNA, 25 bp, E. coli
tatggtgttacagaaaaagctgcgc

SEQ ID NO: 48119 - DNA, 25 bp, E. coli
tgtaacccgggatgaccagcagata

SEQ ID NO: 48120 - DNA, 25 bp, E. coli
tgtaacccgggaagaccagcagata

SEQ ID NO: 48121 - DNA, 25 bp, E. coli
tccattgcggtacttgaacagagcc

SEQ ID NO: 48122 - DNA, 25 bp, E. coli
tcccatagtaatggaagcccgggcg

SEQ ID NO: 48123 - DNA, 25 bp, E. coli
tccattgcggtagttgaacagagcc

SEQ ID NO: 48124 - DNA, 25 bp, E. coli
tcccatagtaatcgaagcccgggcg

SEQ ID NO: 48125 - DNA, 25 bp, E. coli
tcagtattcatgataccgggcggga

SEQ ID NO: 48126 - DNA, 25 bp, E. coli
tcagtattcatgttaccgggcggga

SEQ ID NO: 48127 - DNA, 25 bp, E. coli
ccagaaggttgaaggttcggcagca

SEQ ID NO: 48128 - DNA, 25 bp, E. coli
ccagaaggttgatggttcggcagca

SEQ ID NO: 48129 - DNA, 25 bp, E. coli
gctcagacgtcacgaacaggcttca

SEQ ID NO: 48130 - DNA, 25 bp, E. coli
gctcagacgtcaggaacaggcttca

SEQ ID NO: 48131 - DNA, 25 bp, E. coli
cgaatgattgatgaaaccgggcgat

SEQ ID NO: 48132 - DNA, 25 bp, E. coli
cgaatgattgatcaaaccgggcgat

SEQ ID NO: 48133 - DNA, 25 bp, E. coli
ggctccacagaaaggtaacccgtcg

SEQ ID NO: 48134 - DNA, 25 bp, E. coli
gatcagatgctccacggtatgctgg

SEQ ID NO: 48135 - DNA, 25 bp, E. coli
gatcagatgctcgacggtatgctgg

SEQ ID NO: 48136 - DNA, 25 bp, E. coli
ggctccacagaatggtaacccgtcg

SEQ ID NO: 48137 - DNA, 25 bp, E. coli
cacagattttatattctgttgggcc

SEQ ID NO: 48138 - DNA, 25 bp, E. coli
cacagattttattttctgttgggcc

SEQ ID NO: 48139 - DNA, 25 bp, E. coli
catataaaaagagaagcccgaacag

SEQ ID NO: 48140 - DNA, 25 bp, E. coli
catataaaaagacaagcccgaacag

SEQ ID NO: 48141 - DNA, 25 bp, E. coli
ataaaaagacaagcccgaacagtcg

SEQ ID NO: 48142 - DNA, 25 bp, E. coli
ataaaaagacaaccccgaacagtcg

SEQ ID NO: 48143 - DNA, 25 bp, E. coli
agacaagcccgaacagtcgtccggg

SEQ ID NO: 48144 - DNA, 25 bp, E. coli
agacaagcccgatcagtcgtccggg

SEQ ID NO: 48145 - DNA, 25 bp, E. coli
tatatgcctttaatgtcacagattt

SEQ ID NO: 48146 - DNA, 25 bp, E. coli
tatatgcctttattgtcacagattt

SEQ ID NO: 48147 - DNA, 25 bp, E. coli
ttttattttctgttgggccattgca

SEQ ID NO: 48148 - DNA, 25 bp, E. coli
ttttattttctgatgggccattgca

SEQ ID NO: 48149 - DNA, 25 bp, E. coli
tctgttgggccattgcattgccact

SEQ ID NO: 48150 - DNA, 25 bp, E. coli
tctgttgggccaatgcattgccact

SEQ ID NO: 48151 - DNA, 25 bp, E. coli
tccaacatataaaaagacaagcccg

SEQ ID NO: 48152 - DNA, 25 bp, E. coli
tccaacatataataagacaagcccg

SEQ ID NO: 48153 - DNA, 25 bp, E. coli
ccattgcattgcgactgattttcca

SEQ ID NO: 48154 - DNA, 25 bp, E. coli
ccattgcattgccactgattttcca

SEQ ID NO: 48155 - DNA, 25 bp, E. coli
gcattgccactgtttttccaacata

SEQ ID NO: 48156 - DNA, 25 bp, E. coli
gcattgccactgattttccaacata

SEQ ID NO: 48157 - DNA, 25 bp, E. coli
gttgggccattgcattgccactgat

SEQ ID NO: 48158 - DNA, 25 bp, E. coli
gttgggccattggattgccactgat

SEQ ID NO: 48159 - DNA, 25 bp, E. coli
cacaggccaattatgaaagaggaga

SEQ ID NO: 48160 - DNA, 25 bp, E. coli
cacaggccaattttgaaagaggaga

SEQ ID NO: 48161 - DNA, 25 bp, E. coli
caccctctggtgttttcgtatgcag

SEQ ID NO: 48162 - DNA, 25 bp, E. coli
caccctctggtgatttcgtatgcag

SEQ ID NO: 48163 - DNA, 25 bp, E. coli
aaaagcacttcgcatcactcagaca

SEQ ID NO: 48164 - DNA, 25 bp, E. coli
aaaagcacttcggatcactcagaca

SEQ ID NO: 48165 - DNA, 25 bp, E. coli
acagacactgcggtcttagcatggg

SEQ ID NO: 48166 - DNA, 25 bp, E. coli
acagacactgcgctcttagcatggg

SEQ ID NO: 48167 - DNA, 25 bp, E. coli
ttaaataagtaagagcaccctctgg

SEQ ID NO: 48168 - DNA, 25 bp, E. coli
ttaaataagtaacagcaccctctgg

SEQ ID NO: 48169 - DNA, 25 bp, E. coli
tcgttggcggtcttgattgtcatgc

SEQ ID NO: 48170 - DNA, 25 bp, E. coli
tcgttggcggtcatgattgtcatgc

SEQ ID NO: 48171 - DNA, 25 bp, E. coli
tcttgaaccctgtacgaataacgac

SEQ ID NO: 48172 - DNA, 25 bp, E. coli
tcttgaaccctgaacgaataacgac

SEQ ID NO: 48173 - DNA, 25 bp, E. coli
gaataacgactaccagaaaagcact

SEQ ID NO: 48174 - DNA, 25 bp, E. coli
gaataacgactagcagaaaagcact

SEQ ID NO: 48175 - DNA, 25 bp, E. coli
cgtatgcagtgtctatgcgacagac

SEQ ID NO: 48176 - DNA, 25 bp, E. coli
cgtatgcagtgtgtatgcgacagac

SEQ ID NO: 48177 - DNA, 25 bp, E. coli
ggctatttctccttgcacaggccaa

SEQ ID NO: 48178 - DNA, 25 bp, E. coli
ggctatttctccatgcacaggccaa

SEQ ID NO: 48179 - DNA, 25 bp, E. coli
gaggagaggcttaagttcttgaacc

SEQ ID NO: 48180 - DNA, 25 bp, E. coli
gaggagaggctttagttcttgaacc

SEQ ID NO: 48181 - DNA, 25 bp, E. coli
caccatgaccggttatgcaggcgga

SEQ ID NO: 48182 - DNA, 25 bp, E. coli
cactgtgggtgaattgcgatgagca

SEQ ID NO: 48183 - DNA, 25 bp, E. coli
cactgtgggtgatttgcgatgagca

SEQ ID NO: 48184 - DNA, 25 bp, E. coli
caccatgaccggatatgcaggcgga

SEQ ID NO: 48185 - DNA, 25 bp, E. coli
catcgggttattcgccgaaacggca

SEQ ID NO: 48186 - DNA, 25 bp, E. coli
catcgggttattggccgaaacggca

SEQ ID NO: 48187 - DNA, 25 bp, E. coli
ttcagcgcgaagactggaaaacact

SEQ ID NO: 48188 - DNA, 25 bp, E. coli
ttcagcgcgaagtctggaaaacact

SEQ ID NO: 48189 - DNA, 25 bp, E. coli
tggtgcggcaaagggatcgaatccc

SEQ ID NO: 48190 - DNA, 25 bp, E. coli
tggtgcggcaaacggatcgaatccc

SEQ ID NO: 48191 - DNA, 25 bp, E. coli
tgaatgggaagagtacagcgaacgc

SEQ ID NO: 48192 - DNA, 25 bp, E. coli
tgaatgggaagactacagcgaacgc

SEQ ID NO: 48193 - DNA, 25 bp, E. coli
gctggacatccattatcgcaaagaa

SEQ ID NO: 48194 - DNA, 25 bp, E. coli
gctggacatccaatatcgcaaagaa

SEQ ID NO: 48195 - DNA, 25 bp, E. coli
gctatgagcgcaattctgccaccaa

SEQ ID NO: 48196 - DNA, 25 bp, E. coli
gctatgagcgcatttctgccaccaa

SEQ ID NO: 48197 - DNA, 25 bp, E. coli
cgatgagcaatttcgcctgcgggcg

SEQ ID NO: 48198 - DNA, 25 bp, E. coli
cgatgagcaattacgcctgcgggcg

SEQ ID NO: 48199 - DNA, 25 bp, E. coli
cgaacgcatggtgcagctgctggac

SEQ ID NO: 48200 - DNA, 25 bp, E. coli
cgaacgcatggtccagctgctggac

SEQ ID NO: 48201 - DNA, 25 bp, E. coli
gcatcgtcgtaccttgccatcgggt

SEQ ID NO: 48202 - DNA, 25 bp, E. coli
gcatcgtcgtacgttgccatcgggt

SEQ ID NO: 48203 - DNA, 25 bp, E. coli
caatctgcggctatcatcggcgaaa

SEQ ID NO: 48204 - DNA, 25 bp, E. coli
caatctgcggctttcatcggcgaaa

SEQ ID NO: 48205 - DNA, 25 bp, E. coli
caacggattgtgctgctggaactct

SEQ ID NO: 48206 - DNA, 25 bp, E. coli
caacggattgtggtgctggaactct

SEQ ID NO: 48207 - DNA, 25 bp, E. coli
catactcaggagtcctggaccggca

SEQ ID NO: 48208 - DNA, 25 bp, E. coli
catactcaggagacctggaccggca

SEQ ID NO: 48209 - DNA, 25 bp, E. coli
caggcacgtctgcaacaacataaag

SEQ ID NO: 48210 - DNA, 25 bp, E. coli
caggcacgtctggaacaacataaag

SEQ ID NO: 48211 - DNA, 25 bp, E. coli
taaacgctggcatcaagatccgctc

SEQ ID NO: 48212 - DNA, 25 bp, E. coli
taaacgctggcaacaagatccgctc

SEQ ID NO: 48213 - DNA, 25 bp, E. coli
ttcggtcgacagtaacacctgggcg

SEQ ID NO: 48214 - DNA, 25 bp, E. coli
ttcggtcgacagaaacacctgggcg

SEQ ID NO: 48215 - DNA, 25 bp, E. coli
tggttgcccactttcgcgaagagag

SEQ ID NO: 48216 - DNA, 25 bp, E. coli
tctggcagatgtaaaccgccgcgca

SEQ ID NO: 48217 - DNA, 25 bp, E. coli
tctggcagatgttaaccgccgcgca

SEQ ID NO: 48218 - DNA, 25 bp, E. coli
cggtattgccgacgataacgatgca

SEQ ID NO: 48219 - DNA, 25 bp, E. coli
ctgaaaccgtggcagtccgtcggaa

SEQ ID NO: 48220 - DNA, 25 bp, E. coli
ctgaaaccgtgggagtccgtcggaa

SEQ ID NO: 48221 - DNA, 25 bp, E. coli
cggtattgccgaggataacgatgca

SEQ ID NO: 48222 - DNA, 25 bp, E. coli
ggttcaggacgatcacggcacgttt

SEQ ID NO: 48223 - DNA, 25 bp, E. coli
ggttcaggacgaacacggcacgttt

SEQ ID NO: 48224 - DNA, 25 bp, E. coli
tggttgcccactatcgcgaagagag

SEQ ID NO: 48225 - DNA, 25 bp, E. coli
tacacacaaatattaccgggtggag

SEQ ID NO: 48226 - DNA, 25 bp, E. coli
tacacacaaataataccgggtggag

SEQ ID NO: 48227 - DNA, 25 bp, E. coli
aaaatcacttcacacactatcagag

SEQ ID NO: 48228 - DNA, 25 bp, E. coli
aaaatcacttcagacactatcagag

SEQ ID NO: 48229 - DNA, 25 bp, E. coli
tatcaggaagatataacgcattaca

SEQ ID NO: 48230 - DNA, 25 bp, E. coli
tatcaggaagatttaacgcattaca

SEQ ID NO: 48231 - DNA, 25 bp, E. coli
tgtgtgtagaagtaaatccattcct

SEQ ID NO: 48232 - DNA, 25 bp, E. coli
tgtgtgtagaagaaaatccattcct

SEQ ID NO: 48233 - DNA, 25 bp, E. coli
tgcttagttatcagcgatacagcgc

SEQ ID NO: 48234 - DNA, 25 bp, E. coli
tgcttagttatctgcgatacagcgc

SEQ ID NO: 48235 - DNA, 25 bp, E. coli
cccacaggttgttagaaaagtgcgc

SEQ ID NO: 48236 - DNA, 25 bp, E. coli
cgctttatttatctcggatgcgacg

SEQ ID NO: 48237 - DNA, 25 bp, E. coli
cccacaggttgtaagaaaagtgcgc

SEQ ID NO: 48238 - DNA, 25 bp, E. coli
cgctttatttatgtcggatgcgacg

SEQ ID NO: 48239 - DNA, 25 bp, E. coli
gatttatcagtgctttacacaacaa

SEQ ID NO: 48240 - DNA, 25 bp, E. coli
gatttatcagtggtttacacaacaa

SEQ ID NO: 48241 - DNA, 25 bp, E. coli
gatacagcgcagtagtttaaagacg

SEQ ID NO: 48242 - DNA, 25 bp, E. coli
gatacagcgcagaagtttaaagacg

SEQ ID NO: 48243 - DNA, 25 bp, E. coli
ggtgtatcagtgagctgcttagtta

SEQ ID NO: 48244 - DNA, 25 bp, E. coli
ggtgtatcagtgtgctgcttagtta

SEQ ID NO: 48245 - DNA, 25 bp, E. coli
gagcgcattttgttagttgttaacg

SEQ ID NO: 48246 - DNA, 25 bp, E. coli
gagcgcattttgatagttgttaacg

SEQ ID NO: 48247 - DNA, 25 bp, E. coli
caaagggttgttcggcactatcgtc

SEQ ID NO: 48248 - DNA, 25 bp, E. coli
caaagggttgttgggcactatcgtc

SEQ ID NO: 48249 - DNA, 25 bp, E. coli
taccgatcccatggctaaaggcggc

SEQ ID NO: 48250 - DNA, 25 bp, E. coli
taccgatcccatcgctaaaggcggc

SEQ ID NO: 48251 - DNA, 25 bp, E. coli
tattaaagacgccaaacagaactgg

SEQ ID NO: 48252 - DNA, 25 bp, E. coli
tattaaagacgcgaaacagaactgg

SEQ ID NO: 48253 - DNA, 25 bp, E. coli
tctgatcgaacactacggtgtggcg

SEQ ID NO: 48254 - DNA, 25 bp, E. coli
tctgatcgaacagtacggtgtggcg

SEQ ID NO: 48255 - DNA, 25 bp, E. coli
ccgctggtaggtgaaaaacacgcca

SEQ ID NO: 48256 - DNA, 25 bp, E. coli
ccgctggtgacccagtgtatgcaat

SEQ ID NO: 48257 - DNA, 25 bp, E. coli
ccgctggtaggtcaaaaacacgcca

SEQ ID NO: 48258 - DNA, 25 bp, E. coli
ccgctggtgaccgagtgtatgcaat

SEQ ID NO: 48259 - DNA, 25 bp, E. coli
gatcttcgcgatcggtaccagtctg

SEQ ID NO: 48260 - DNA, 25 bp, E. coli
ggcccgtatgcctaaaagcgtttag

SEQ ID NO: 48261 - DNA, 25 bp, E. coli
ggcccgtatgccaaaaagcgtttag

SEQ ID NO: 48262 - DNA, 25 bp, E. coli
tggcgatgtccacttgccgcgaagt

SEQ ID NO: 48263 - DNA, 25 bp, E. coli
tggcgatgtccagttgccgcgaagt

SEQ ID NO: 48264 - DNA, 25 bp, E. coli
gacgctatcatctttacctgctgga

SEQ ID NO: 48265 - DNA, 25 bp, E. coli
gaggatgcccgcagttcttcgtcaa

SEQ ID NO: 48266 - DNA, 25 bp, E. coli
gacgctatcatcattacctgctgga

SEQ ID NO: 48267 - DNA, 25 bp, E. coli
gaggatgcccgctgttcttcgtcaa

SEQ ID NO: 48268 - DNA, 25 bp, E. coli
gatcttcgcgatgggtaccagtctg

SEQ ID NO: 48269 - DNA, 25 bp, E. coli
tacggattcactgaaaccctttgcg

SEQ ID NO: 48270 - DNA, 25 bp, E. coli
tacggattcactcaaaccctttgcg

SEQ ID NO: 48271 - DNA, 25 bp, E. coli
tttgatacgcaaaccgaacgccgaa

SEQ ID NO: 48272 - DNA, 25 bp, E. coli
tagctcactcctagtagatgcagaa

SEQ ID NO: 48273 - DNA, 25 bp, E. coli
tagctcactccttgtagatgcagaa

SEQ ID NO: 48274 - DNA, 25 bp, E. coli
tttgatacgcaatccgaacgccgaa

SEQ ID NO: 48275 - DNA, 25 bp, E. coli
ttcatgttgctatcgataacgctgc

SEQ ID NO: 48276 - DNA, 25 bp, E. coli
ttcatgttgctaacgataacgctgc

SEQ ID NO: 48277 - DNA, 25 bp, E. coli
tgcacttgatgtccgtcgcgccgct

SEQ ID NO: 48278 - DNA, 25 bp, E. coli
tgcacttgatgtgcgtcgcgccgct

SEQ ID NO: 48279 - DNA, 25 bp, E. coli
tcttaggcgcagacgtaaataacgc

SEQ ID NO: 48280 - DNA, 25 bp, E. coli
tcttgtttatccagtcgtaccggga

SEQ ID NO: 48281 - DNA, 25 bp, E. coli
tcttaggcgcagtcgtaaataacgc

SEQ ID NO: 48282 - DNA, 25 bp, E. coli
tcttgtttatcctgtcgtaccggga

SEQ ID NO: 48283 - DNA, 25 bp, E. coli
gccgctacgtctgttggcgatacaa

SEQ ID NO: 48284 - DNA, 25 bp, E. coli
gccgctacgtctcttggcgatacaa

SEQ ID NO: 48285 - DNA, 25 bp, E. coli
cattccgatgagagttatagacaca

SEQ ID NO: 48286 - DNA, 25 bp, E. coli
cattccgatgagtgttatagacaca

SEQ ID NO: 48287 - DNA, 25 bp, E. coli
ggtagaaattacgatcagcatgtcg

SEQ ID NO: 48288 - DNA, 25 bp, E. coli
ggtagaaattaccatcagcatgtcg

SEQ ID NO: 48289 - DNA, 25 bp, E. coli
taacgacgctgaagatgattctccc

SEQ ID NO: 48290 - DNA, 25 bp, E. coli
taacgacgctgatgatgattctccc

SEQ ID NO: 48291 - DNA, 25 bp, E. coli
caggatagcgcagcggttgaagttc

SEQ ID NO: 48292 - DNA, 25 bp, E. coli
caggatagcgcaccggttgaagttc

SEQ ID NO: 48293 - DNA, 25 bp, E. coli
cataccgttggagcaatgaaagcgg

SEQ ID NO: 48294 - DNA, 25 bp, E. coli
cataccgttggaccaatgaaagcgg

SEQ ID NO: 48295 - DNA, 25 bp, E. coli
acagcacctggccaacgtctgggaa

SEQ ID NO: 48296 - DNA, 25 bp, E. coli
acagcacctggcgaacgtctgggaa

SEQ ID NO: 48297 - DNA, 25 bp, E. coli
tatccgtacagttcagcagccgatc

SEQ ID NO: 48298 - DNA, 25 bp, E. coli
tatccgtacagtacagcagccgatc

SEQ ID NO: 48299 - DNA, 25 bp, E. coli
tgcttaaagacgtgacccgcgtggt

SEQ ID NO: 48300 - DNA, 25 bp, E. coli
tgcttaaagacgagacccgcgtggt

SEQ ID NO: 48301 - DNA, 25 bp, E. coli
tctctggcctgaagatgaaaaacga

SEQ ID NO: 48302 - DNA, 25 bp, E. coli
tctctggcctgatgatgaaaaacga

SEQ ID NO: 48303 - DNA, 25 bp, E. coli
gaatactcatggacgcctgatgctg

SEQ ID NO: 48304 - DNA, 25 bp, E. coli
gaatactcatggtcgcctgatgctg

SEQ ID NO: 48305 - DNA, 25 bp, E. coli
cattgtcaggaatccgggctgtcac

SEQ ID NO: 48306 - DNA, 25 bp, E. coli
cattgtcaggaaaccgggctgtcac

SEQ ID NO: 48307 - DNA, 25 bp, E. coli
ggtaacctgccggataccgtggata

SEQ ID NO: 48308 - DNA, 25 bp, E. coli
ggtaacctgccgcataccgtggata

SEQ ID NO: 48309 - DNA, 25 bp, E. coli
gataaaaccaccactgacccgatgg

SEQ ID NO: 48310 - DNA, 25 bp, E. coli
gataaaaccacctctgacccgatgg

SEQ ID NO: 48311 - DNA, 25 bp, E. coli
gagttcccggttgatcagtgcatga

SEQ ID NO: 48312 - DNA, 25 bp, E. coli
gagttcccggttcatcagtgcatga

SEQ ID NO: 48313 - DNA, 25 bp, E. coli
caatgttacaaaacgcctgccagcg

SEQ ID NO: 48314 - DNA, 25 bp, E. coli
caatgttacaaatcgcctgccagcg

SEQ ID NO: 48315 - DNA, 25 bp, E. coli
cacacgttgatcgatatgggcgacg

SEQ ID NO: 48316 - DNA, 25 bp, E. coli
caaaagggattcagcgcagcttcca

SEQ ID NO: 48317 - DNA, 25 bp, E. coli
cacacgttgatccatatgggcgacg

SEQ ID NO: 48318 - DNA, 25 bp, E. coli
caaaagggattctgcgcagcttcca

SEQ ID NO: 48319 - DNA, 25 bp, E. coli
taaaacaccggataaggtcagcctg

SEQ ID NO: 48320 - DNA, 25 bp, E. coli
taaaacaccggaaaaggtcagcctg

SEQ ID NO: 48321 - DNA, 25 bp, E. coli
tatttctcaggccttgggaacaggc

SEQ ID NO: 48322 - DNA, 25 bp, E. coli
tattcaacaggcgtcggtcgtcatg

SEQ ID NO: 48323 - DNA, 25 bp, E. coli
tattcaacaggcctcggtcgtcatg

SEQ ID NO: 48324 - DNA, 25 bp, E. coli
tatttctcaggcgttgggaacaggc

SEQ ID NO: 48325 - DNA, 25 bp, E. coli
tgcaatgaagcagtggtactggccc

SEQ ID NO: 48326 - DNA, 25 bp, E. coli
tgcaatgaagcactggtactggccc

SEQ ID NO: 48327 - DNA, 25 bp, E. coli
tgcgctggcgcatgacgatgaaact

SEQ ID NO: 48328 - DNA, 25 bp, E. coli
tgcgctggcgcaagacgatgaaact

SEQ ID NO: 48329 - DNA, 25 bp, E. coli
tgcgggtctgggaaacgaaatcaac

SEQ ID NO: 48330 - DNA, 25 bp, E. coli
tgcgggtctgggtaacgaaatcaac

SEQ ID NO: 48331 - DNA, 25 bp, E. coli
gatcaaccacttccggctgtcgaga

SEQ ID NO: 48332 - DNA, 25 bp, E. coli
gatcaaccacttgcggctgtcgaga

SEQ ID NO: 48333 - DNA, 25 bp, E. coli
taatgggacctgactgtggaaccgc

SEQ ID NO: 48334 - DNA, 25 bp, E. coli
taatgggacctgtctgtggaaccgc

SEQ ID NO: 48335 - DNA, 25 bp, E. coli
aaggcgatgtctcttccagtgacga

SEQ ID NO: 48336 - DNA, 25 bp, E. coli
aaggcgatgtctgttccagtgacga

SEQ ID NO: 48337 - DNA, 25 bp, E. coli
cagacctggacgaaagataaaccgg

SEQ ID NO: 48338 - DNA, 25 bp, E. coli
cagacctggacgtaagataaaccgg

SEQ ID NO: 48339 - DNA, 25 bp, E. coli
aaagataccgaacaactgcggcgca

SEQ ID NO: 48340 - DNA, 25 bp, E. coli
aaagataccgaagaactgcggcgca

SEQ ID NO: 48341 - DNA, 25 bp, E. coli
tagccgtaaattgcaggatgactgg

SEQ ID NO: 48342 - DNA, 25 bp, E. coli
tagccgtaaattccaggatgactgg

SEQ ID NO: 48343 - DNA, 25 bp, E. coli
tgctaagggtaaacaggccacctgg

SEQ ID NO: 48344 - DNA, 25 bp, E. coli
tgctaagggtaatcaggccacctgg

SEQ ID NO: 48345 - DNA, 25 bp, E. coli
tgacaaagaggtttatcaaccggcg

SEQ ID NO: 48346 - DNA, 25 bp, E. coli
tgacaaagaggtatatcaaccggcg

SEQ ID NO: 48347 - DNA, 25 bp, E. coli
tctcggcgatgttaaccagtaaagg

SEQ ID NO: 48348 - DNA, 25 bp, E. coli
tctcggcgatgtaaaccagtaaagg

SEQ ID NO: 48349 - DNA, 25 bp, E. coli
cttgataagcaaatggtggcggcgc

SEQ ID NO: 48350 - DNA, 25 bp, E. coli
cttgataagcaattggtggcggcgc

SEQ ID NO: 48351 - DNA, 25 bp, E. coli
gatatcaacgaagaacggcgacaga

SEQ ID NO: 48352 - DNA, 25 bp, E. coli
gatatcaacgaacaacggcgacaga

SEQ ID NO: 48353 - DNA, 25 bp, E. coli
taacgctcgaaaaagggcaatatcc

SEQ ID NO: 48354 - DNA, 25 bp, E. coli
taacgctcgaaatagggcaatatcc

SEQ ID NO: 48355 - DNA, 25 bp, E. coli
gaggcgttcgcgcttaaatatgaca

SEQ ID NO: 48356 - DNA, 25 bp, E. coli
gaggcgttcgcggttaaatatgaca

SEQ ID NO: 48357 - DNA, 25 bp, E. coli
atgtcgataacgacggcgacggaac

SEQ ID NO: 48358 - DNA, 25 bp, E. coli
atgtcgataacgtcggcgacggaac

SEQ ID NO: 48359 - DNA, 25 bp, E. coli
ttttatgccgatcttccgaagaata

SEQ ID NO: 48360 - DNA, 25 bp, E. coli
ttttatgccgatgttccgaagaata

SEQ ID NO: 48361 - DNA, 25 bp, E. coli
ttctcgcggcgggtatggtcgttct

SEQ ID NO: 48362 - DNA, 25 bp, E. coli
ttctcgcggcggctatggtcgttct

SEQ ID NO: 48363 - DNA, 25 bp, E. coli
tgttccgaagaaaatgactcagcag

SEQ ID NO: 48364 - DNA, 25 bp, E. coli
taagccgggttaatcgtaaagatcg

SEQ ID NO: 48365 - DNA, 25 bp, E. coli
tgttccgaagaatatgactcagcag

SEQ ID NO: 48366 - DNA, 25 bp, E. coli
taagccgggttattcgtaaagatcg

SEQ ID NO: 48367 - DNA, 25 bp, E. coli
tccggttctggctaaaaagagtctt

SEQ ID NO: 48368 - DNA, 25 bp, E. coli
tccggttctggcaaaaaagagtctt

SEQ ID NO: 48369 - DNA, 25 bp, E. coli
gttattcgtaaagatcgcgatgagc

SEQ ID NO: 48370 - DNA, 25 bp, E. coli
gttattcgtaaacatcgcgatgagc

SEQ ID NO: 48371 - DNA, 25 bp, E. coli
ggtgattactccaggcgctccggtt

SEQ ID NO: 48372 - DNA, 25 bp, E. coli
ggtcgttcttccagcgcccgtgggc

SEQ ID NO: 48373 - DNA, 25 bp, E. coli
ggtcgttcttcctgcgcccgtgggc

SEQ ID NO: 48374 - DNA, 25 bp, E. coli
ggtgattactcctggcgctccggtt

SEQ ID NO: 48375 - DNA, 25 bp, E. coli
tggcgctccggtactggcaaaaaag

SEQ ID NO: 48376 - DNA, 25 bp, E. coli
ggctatggtcgttcttccagcgccc

SEQ ID NO: 48377 - DNA, 25 bp, E. coli
ggctatggtcgtacttccagcgccc

SEQ ID NO: 48378 - DNA, 25 bp, E. coli
tggcgctccggttctggcaaaaaag

SEQ ID NO: 48379 - DNA, 25 bp, E. coli
cacttactgggatatagctgctgat

SEQ ID NO: 48380 - DNA, 25 bp, E. coli
caaactacgggcctcttatgcgtga

SEQ ID NO: 48381 - DNA, 25 bp, E. coli
cagaatattatcgttcgccacgagg

SEQ ID NO: 48382 - DNA, 25 bp, E. coli
caaactacgggcgtcttatgcgtga

SEQ ID NO: 48383 - DNA, 25 bp, E. coli
caaagaacagacgaagctaacggcg

SEQ ID NO: 48384 - DNA, 25 bp, E. coli
caaagaacagaccaagctaacggcg

SEQ ID NO: 48385 - DNA, 25 bp, E. coli
cacttactgggaaatagctgctgat

SEQ ID NO: 48386 - DNA, 25 bp, E. coli
cagaatattatccttcgccacgagg

SEQ ID NO: 48387 - DNA, 25 bp, E. coli
catccaattggaagctgcaaagaac

SEQ ID NO: 48388 - DNA, 25 bp, E. coli
catccaattggatgctgcaaagaac

SEQ ID NO: 48389 - DNA, 25 bp, E. coli
tactgtcacgggagcaaactacggg

SEQ ID NO: 48390 - DNA, 25 bp, E. coli
tactgtcacgggtgcaaactacggg

SEQ ID NO: 48391 - DNA, 25 bp, E. coli
acagcgtttaatgctatcggagcac

SEQ ID NO: 48392 - DNA, 25 bp, E. coli
acagcgtttaatcctatcggagcac

SEQ ID NO: 48393 - DNA, 25 bp, E. coli
tatctggaagatgcaacaatgcgag

SEQ ID NO: 48394 - DNA, 25 bp, E. coli
tatctggaagatccaacaatgcgag

SEQ ID NO: 48395 - DNA, 25 bp, E. coli
tgcaaagaacagtcatcgggtagtg

SEQ ID NO: 48396 - DNA, 25 bp, E. coli
tgcaaagaacagacatcgggtagtg

SEQ ID NO: 48397 - DNA, 25 bp, E. coli
gaagcaatggcgcaacaaagaacag

SEQ ID NO: 48398 - DNA, 25 bp, E. coli
gaagcaatggcggaacaaagaacag

SEQ ID NO: 48399 - DNA, 25 bp, E. coli
gataagccagaagctgtgaaacagg

SEQ ID NO: 48400 - DNA, 25 bp, E. coli
gataagccagaacctgtgaaacagg

SEQ ID NO: 48401 - DNA, 25 bp, E. coli
aagtctatctctcacaaattccggg

SEQ ID NO: 48402 - DNA, 25 bp, E. coli
aagtctatctctgacaaattccggg

SEQ ID NO: 48403 - DNA, 25 bp, E. coli
tatgacccgacccacgatatcgaag

SEQ ID NO: 48404 - DNA, 25 bp, E. coli
tatgacccgaccgacgatatcgaag

SEQ ID NO: 48405 - DNA, 25 bp, E. coli
ttccgggactggtaaacatggcgct

SEQ ID NO: 48406 - DNA, 25 bp, E. coli
ttcctgccggacaacacgatggtgc

SEQ ID NO: 48407 - DNA, 25 bp, E. coli
ttccgggactggaaaacatggcgct

SEQ ID NO: 48408 - DNA, 25 bp, E. coli
ttcctgccggactacacgatggtgc

SEQ ID NO: 48409 - DNA, 25 bp, E. coli
tgagagctatcccttcaccacggag

SEQ ID NO: 48410 - DNA, 25 bp, E. coli
tgagagctatccgttcaccacggag

SEQ ID NO: 48411 - DNA, 25 bp, E. coli
tcaggtcgaagagatgcaggcagtt

SEQ ID NO: 48412 - DNA, 25 bp, E. coli
tcaggtcgaagacatgcaggcagtt

SEQ ID NO: 48413 - DNA, 25 bp, E. coli
gctgcattcaggatgcggacgcaca

SEQ ID NO: 48414 - DNA, 25 bp, E. coli
gctgcattcaggttgcggacgcaca

SEQ ID NO: 48415 - DNA, 25 bp, E. coli
cggtctgcgcacctatggctgcatt

SEQ ID NO: 48416 - DNA, 25 bp, E. coli
cggtctgcgcacgtatggctgcatt

SEQ ID NO: 48417 - DNA, 25 bp, E. coli
gatatcgaagccaacgcgctgaacg

SEQ ID NO: 48418 - DNA, 25 bp, E. coli
gttcgtgtccgtacaactggcgtaa

SEQ ID NO: 48419 - DNA, 25 bp, E. coli
gatatcgaagcctacgcgctgaacg

SEQ ID NO: 48420 - DNA, 25 bp, E. coli
gttcgtgtccgttcaactggcgtaa

SEQ ID NO: 48421 - DNA, 25 bp, E. coli
tggagcaagcgtgacaagtccacgt

SEQ ID NO: 48422 - DNA, 25 bp, E. coli
tggagcaagcgtcacaagtccacgt

SEQ ID NO: 48423 - DNA, 25 bp, E. coli
aacaacttgcgggatcggctaaacg

SEQ ID NO: 48424 - DNA, 25 bp, E. coli
aacaacttgcggcatcggctaaacg

SEQ ID NO: 48425 - DNA, 25 bp, E. coli
taggtgcgctgaaacagacctctgg

SEQ ID NO: 48426 - DNA, 25 bp, E. coli
taggtgcgctgatacagacctctgg

SEQ ID NO: 48427 - DNA, 25 bp, E. coli
tatatggatgtcctttctgtgccgc

SEQ ID NO: 48428 - DNA, 25 bp, E. coli
tatatggatgtcgtttctgtgccgc

SEQ ID NO: 48429 - DNA, 25 bp, E. coli
tatctgccagaagtgaaggcgctgg

SEQ ID NO: 48430 - DNA, 25 bp, E. coli
tatctgccagaactgaaggcgctgg

SEQ ID NO: 48431 - DNA, 25 bp, E. coli
tggtgtacaacattccagccctgag

SEQ ID NO: 48432 - DNA, 25 bp, E. coli
tggtgtacaacaatccagccctgag

SEQ ID NO: 48433 - DNA, 25 bp, E. coli
tgaaagaaggcgatatccagaccgc

SEQ ID NO: 48434 - DNA, 25 bp, E. coli
tgaaagaaggcgttatccagaccgc

SEQ ID NO: 48435 - DNA, 25 bp, E. coli
tctatcagatggagcagatccgtcg

SEQ ID NO: 48436 - DNA, 25 bp, E. coli
tctatcagatggtgcagatccgtcg

SEQ ID NO: 48437 - DNA, 25 bp, E. coli
gattaaactcatcgcccacgtcggt

SEQ ID NO: 48438 - DNA, 25 bp, E. coli
gttcagttcaatattcagcagggca

SEQ ID NO: 48439 - DNA, 25 bp, E. coli
gttcagttcaattttcagcagggca

SEQ ID NO: 48440 - DNA, 25 bp, E. coli
gattaaactcatggcccacgtcggt

SEQ ID NO: 48441 - DNA, 25 bp, E. coli
tggcgtaatggcagcactcctgact

SEQ ID NO: 48442 - DNA, 25 bp, E. coli
tggcgtaatggctgcactcctgact

SEQ ID NO: 48443 - DNA, 25 bp, E. coli
taaacgttatgggttcgatgccgtc

SEQ ID NO: 48444 - DNA, 25 bp, E. coli
taaacgttatggcttcgatgccgtc

SEQ ID NO: 48445 - DNA, 25 bp, E. coli
catggttattgtcgtgggctattac

SEQ ID NO: 48446 - DNA, 25 bp, E. coli
catggttattgtggtgggctattac

SEQ ID NO: 48447 - DNA, 25 bp, E. coli
aaaatctgattttgttaaggcatgg

SEQ ID NO: 48448 - DNA, 25 bp, E. coli
aaaatctgatttagttaaggcatgg

SEQ ID NO: 48449 - DNA, 25 bp, E. coli
tgggaaatggtatcttttggcagtt

SEQ ID NO: 48450 - DNA, 25 bp, E. coli
tgtggtgggctattaccatccttgt

SEQ ID NO: 48451 - DNA, 25 bp, E. coli
tgtggtgggctaataccatccttgt

SEQ ID NO: 48452 - DNA, 25 bp, E. coli
tatttattttaagcctgactacgac

SEQ ID NO: 48453 - DNA, 25 bp, E. coli
tatttattttaaccctgactacgac

SEQ ID NO: 48454 - DNA, 25 bp, E. coli
tctctaggatggagtaagtactggg

SEQ ID NO: 48455 - DNA, 25 bp, E. coli
tctctaggatggtgtaagtactggg

SEQ ID NO: 48456 - DNA, 25 bp, E. coli
gcctgactacgagattaaatttaag

SEQ ID NO: 48457 - DNA, 25 bp, E. coli
tccttggtagatatacgatgtctct

SEQ ID NO: 48458 - DNA, 25 bp, E. coli
tccttggtagatttacgatgtctct

SEQ ID NO: 48459 - DNA, 25 bp, E. coli
gcctgactacgacattaaatttaag

SEQ ID NO: 48460 - DNA, 25 bp, E. coli
gggttttgtcaattccttggtagat

SEQ ID NO: 48461 - DNA, 25 bp, E. coli
gggatttcctgtaacaaatattgtt

SEQ ID NO: 48462 - DNA, 25 bp, E. coli
gggttttgtcaaatccttggtagat

SEQ ID NO: 48463 - DNA, 25 bp, E. coli
gggatttcctgttacaaatattgtt

SEQ ID NO: 48464 - DNA, 25 bp, E. coli
tggcagttgttcatgggtaaagaac

SEQ ID NO: 48465 - DNA, 25 bp, E. coli
tgggaaatggtaacttttggcagtt

SEQ ID NO: 48466 - DNA, 25 bp, E. coli
tggcagttgttcttgggtaaagaac

SEQ ID NO: 48467 - DNA, 25 bp, E. coli
aagagatcctcggacagttgtcgca

SEQ ID NO: 48468 - DNA, 25 bp, E. coli
aagagatcctcgcacagttgtcgca

SEQ ID NO: 48469 - DNA, 25 bp, E. coli
caaaatcttggtctgggtgcgcagt

SEQ ID NO: 48470 - DNA, 25 bp, E. coli
caaaatcttggtgtgggtgcgcagt

SEQ ID NO: 48471 - DNA, 25 bp, E. coli
tactatgatgaactgccaacggaag

SEQ ID NO: 48472 - DNA, 25 bp, E. coli
tactatgatgaagtgccaacggaag

SEQ ID NO: 48473 - DNA, 25 bp, E. coli
taaaaaagggcagcgtgtatggacc

SEQ ID NO: 48474 - DNA, 25 bp, E. coli
taaaaaagggcaccgtgtatggacc

SEQ ID NO: 48475 - DNA, 25 bp, E. coli
aaatatgtggcggtgcaattcctgc

SEQ ID NO: 48476 - DNA, 25 bp, E. coli
aaatatgtggcgctgcaattcctgc

SEQ ID NO: 48477 - DNA, 25 bp, E. coli
tacctggttgagaagatgcgcacgc

SEQ ID NO: 48478 - DNA, 25 bp, E. coli
tacctggttgagtagatgcgcacgc

SEQ ID NO: 48479 - DNA, 25 bp, E. coli
tatatcccggaacagctgcgcaaag

SEQ ID NO: 48480 - DNA, 25 bp, E. coli
tatatcccggaagagctgcgcaaag

SEQ ID NO: 48481 - DNA, 25 bp, E. coli
tgacggatgcctctaaaaaacacgg

SEQ ID NO: 48482 - DNA, 25 bp, E. coli
tgacggatgcctgtaaaaaacacgg

SEQ ID NO: 48483 - DNA, 25 bp, E. coli
tccggaactgggaatggaagccatc

SEQ ID NO: 48484 - DNA, 25 bp, E. coli
tccggaactgggtatggaagccatc

SEQ ID NO: 48485 - DNA, 25 bp, E. coli
tcaaagcgaagaacaaccgtcaggg

SEQ ID NO: 48486 - DNA, 25 bp, E. coli
tcaaagcgaagatcaaccgtcaggg

SEQ ID NO: 48487 - DNA, 25 bp, E. coli
gagattttgaaagtcgcacccgaag

SEQ ID NO: 48488 - DNA, 25 bp, E. coli
gagattttgaaactcgcacccgaag

SEQ ID NO: 48489 - DNA, 25 bp, E. coli
taaaagcaacgcatgccgacagtgc

SEQ ID NO: 48490 - DNA, 25 bp, E. coli
taaaagcaacgcttgccgacagtgc

SEQ ID NO: 48491 - DNA, 25 bp, E. coli
aaaagaccggagatcgccagcttag

SEQ ID NO: 48492 - DNA, 25 bp, E. coli
aaaagaccggagttcgccagcttag

SEQ ID NO: 48493 - DNA, 25 bp, E. coli
tatggactggattaagagatggtaa

SEQ ID NO: 48494 - DNA, 25 bp, E. coli
tatggactggataaagagatggtaa

SEQ ID NO: 48495 - DNA, 25 bp, E. coli
tgtattaggctagtcacaccggatg

SEQ ID NO: 48496 - DNA, 25 bp, E. coli
tgtattaggctactcacaccggatg

SEQ ID NO: 48497 - DNA, 25 bp, E. coli
tgcgcttttttaaggccggttatcg

SEQ ID NO: 48498 - DNA, 25 bp, E. coli
tgcgcttttttatggccggttatcg

SEQ ID NO: 48499 - DNA, 25 bp, E. coli
gaataattcctgttctacgttgcgc

SEQ ID NO: 48500 - DNA, 25 bp, E. coli
gaataattcctgatctacgttgcgc

SEQ ID NO: 48501 - DNA, 25 bp, E. coli
gacaaaattctgtgccgattataaa

SEQ ID NO: 48502 - DNA, 25 bp, E. coli
gacaaaattctgagccgattataaa

SEQ ID NO: 48503 - DNA, 25 bp, E. coli
ccgacagtgcggataatgtgacaaa

SEQ ID NO: 48504 - DNA, 25 bp, E. coli
ccgacagtgcggttaatgtgacaaa

SEQ ID NO: 48505 - DNA, 25 bp, E. coli
cttagcgcctggcaagcgggtattc

SEQ ID NO: 48506 - DNA, 25 bp, E. coli
cttagcgcctgggaagcgggtattc

SEQ ID NO: 48507 - DNA, 25 bp, E. coli
tcacaccggatgaacgaaaagaccg

SEQ ID NO: 48508 - DNA, 25 bp, E. coli
taatggcgggattaaaagcaacgca

SEQ ID NO: 48509 - DNA, 25 bp, E. coli
taatggcgggataaaaagcaacgca

SEQ ID NO: 48510 - DNA, 25 bp, E. coli
tcacaccggatgtacgaaaagaccg

SEQ ID NO: 48511 - DNA, 25 bp, E. coli
catgtgcagattattgagcgcgttc

SEQ ID NO: 48512 - DNA, 25 bp, E. coli
catgtgcagatttttgagcgcgttc

SEQ ID NO: 48513 - DNA, 25 bp, E. coli
aacgcatttttcactttctttagtg

SEQ ID NO: 48514 - DNA, 25 bp, E. coli
aacgcatttttctctttctttagtg

SEQ ID NO: 48515 - DNA, 25 bp, E. coli
tctacgataatatattgtgcttaag

SEQ ID NO: 48516 - DNA, 25 bp, E. coli
tctacgataataaattgtgcttaag

SEQ ID NO: 48517 - DNA, 25 bp, E. coli
tctttagtgcccttgctcctgagcg

SEQ ID NO: 48518 - DNA, 25 bp, E. coli
tctttagtgcccatgctcctgagcg

SEQ ID NO: 48519 - DNA, 25 bp, E. coli
ccttgctcctgaccgtacgcaggga

SEQ ID NO: 48520 - DNA, 25 bp, E. coli
ccttgctcctgagcgtacgcaggga

SEQ ID NO: 48521 - DNA, 25 bp, E. coli
gctttagagtataacgaaaacgcat

SEQ ID NO: 48522 - DNA, 25 bp, E. coli
gctttagagtattacgaaaacgcat

SEQ ID NO: 48523 - DNA, 25 bp, E. coli
gaatacttttcatcagcatgtgcag

SEQ ID NO: 48524 - DNA, 25 bp, E. coli
gaatacttttcaacagcatgtgcag

SEQ ID NO: 48525 - DNA, 25 bp, E. coli
cgtacgcagggagtgattgaacata

SEQ ID NO: 48526 - DNA, 25 bp, E. coli
cgtacgcagggactgattgaacata

SEQ ID NO: 48527 - DNA, 25 bp, E. coli
gataaccgtgttgaaattgatttta

SEQ ID NO: 48528 - DNA, 25 bp, E. coli
gataaccgtgttcaaattgatttta

SEQ ID NO: 48529 - DNA, 25 bp, E. coli
taagttgtttgttaaccaatatcga

SEQ ID NO: 48530 - DNA, 25 bp, E. coli
taagttgtttgtaaaccaatatcga

SEQ ID NO: 48531 - DNA, 25 bp, E. coli
gagcgcgttcgcaggatgacatcat

SEQ ID NO: 48532 - DNA, 25 bp, E. coli
gagcgcgttcgctggatgacatcat

SEQ ID NO: 48533 - DNA, 25 bp, E. coli
aagcattcactatccccctttcctg

SEQ ID NO: 48534 - DNA, 25 bp, E. coli
catttcgcgggcgatattttcacag

SEQ ID NO: 48535 - DNA, 25 bp, E. coli
caggagttcagcgatgaacgcttat

SEQ ID NO: 48536 - DNA, 25 bp, E. coli
caggagttcagccatgaacgcttat

SEQ ID NO: 48537 - DNA, 25 bp, E. coli
catttcgcgggccatattttcacag

SEQ ID NO: 48538 - DNA, 25 bp, E. coli
aggagttcagccttgaacgcttatt

SEQ ID NO: 48539 - DNA, 25 bp, E. coli
aggagttcagccatgaacgcttatt

SEQ ID NO: 48540 - DNA, 25 bp, E. coli
agcattcactaagcccctttcctgt

SEQ ID NO: 48541 - DNA, 25 bp, E. coli
atttcgcgggcgatattttcacagc

SEQ ID NO: 48542 - DNA, 25 bp, E. coli
atttcgcgggcgttattttcacagc

SEQ ID NO: 48543 - DNA, 25 bp, E. coli
agcattcactaaccccctttcctgt

SEQ ID NO: 48544 - DNA, 25 bp, E. coli
aagcattcactaaccccctttcctg

SEQ ID NO: 48545 - DNA, 25 bp, E. coli
ttcaggagttcagccatgaacgctt

SEQ ID NO: 48546 - DNA, 25 bp, E. coli
tttcaggagttctgccatgaacgct

SEQ ID NO: 48547 - DNA, 25 bp, E. coli
ttcaggagttcacccatgaacgctt

SEQ ID NO: 48548 - DNA, 25 bp, E. coli
tttcaggagttcagccatgaacgct

SEQ ID NO: 48549 - DNA, 25 bp, E. coli
tcaggagttcagccatgaacgctta

SEQ ID NO: 48550 - DNA, 25 bp, E. coli
tcaggagttcaggcatgaacgctta

SEQ ID NO: 48551 - DNA, 25 bp, E. coli
ggagttcagccatgaacgcttatta

SEQ ID NO: 48552 - DNA, 25 bp, E. coli
ggagttcagccaagaacgcttatta

SEQ ID NO: 48553 - DNA, 25 bp, E. coli
gagttcagccatcaacgcttattac

SEQ ID NO: 48554 - DNA, 25 bp, E. coli
gagttcagccatgaacgcttattac

SEQ ID NO: 48555 - DNA, 25 bp, E. coli
caggttgagagatctctgcgtaacg

SEQ ID NO: 48556 - DNA, 25 bp, E. coli
caggttgagagaactctgcgtaacg

SEQ ID NO: 48557 - DNA, 25 bp, E. coli
agtgggctgagatagcaggtgtgaa

SEQ ID NO: 48558 - DNA, 25 bp, E. coli
agtgggctgagaaagcaggtgtgaa

SEQ ID NO: 48559 - DNA, 25 bp, E. coli
ttgagagaactctgcgtaacgtggt

SEQ ID NO: 48560 - DNA, 25 bp, E. coli
ttgagagaactcagcgtaacgtggt

SEQ ID NO: 48561 - DNA, 25 bp, E. coli
tgtgcaggttgacagaactctgcgt

SEQ ID NO: 48562 - DNA, 25 bp, E. coli
tgtgcaggttgagagaactctgcgt

SEQ ID NO: 48563 - DNA, 25 bp, E. coli
tgcaggttgagacaactctgcgtaa

SEQ ID NO: 48564 - DNA, 25 bp, E. coli
tgcaggttgagagaactctgcgtaa

SEQ ID NO: 48565 - DNA, 25 bp, E. coli
tcatctgatgacgtattacccctcg

SEQ ID NO: 48566 - DNA, 25 bp, E. coli
tcatctgatgacctattacccctcg

SEQ ID NO: 48567 - DNA, 25 bp, E. coli
tctgatgacgtattacccctcgttg

SEQ ID NO: 48568 - DNA, 25 bp, E. coli
tctgatgacgtaatacccctcgttg

SEQ ID NO: 48569 - DNA, 25 bp, E. coli
gctgagaaagcaggtgtgaagctgg

SEQ ID NO: 48570 - DNA, 25 bp, E. coli
gctgagaaagcacgtgtgaagctgg

SEQ ID NO: 48571 - DNA, 25 bp, E. coli
gaactgcgcaatgtaccggggaaat

SEQ ID NO: 48572 - DNA, 25 bp, E. coli
gaactgcgcaatctaccggggaaat

SEQ ID NO: 48573 - DNA, 25 bp, E. coli
ggttgagagaacactgcgtaacgtg

SEQ ID NO: 48574 - DNA, 25 bp, E. coli
ggttgagagaactctgcgtaacgtg

SEQ ID NO: 48575 - DNA, 25 bp, E. coli
gatgtgcaggttcagagaactctgc

SEQ ID NO: 48576 - DNA, 25 bp, E. coli
gatgtgcaggttgagagaactctgc

SEQ ID NO: 48577 - DNA, 25 bp, E. coli
caaccagcgcgagcttaaagtgctg

SEQ ID NO: 48578 - DNA, 25 bp, E. coli
caaccagcgcgaccttaaagtgctg

SEQ ID NO: 48579 - DNA, 25 bp, E. coli
taaagtgctgaatcgcgcagaaggc

SEQ ID NO: 48580 - DNA, 25 bp, E. coli
taaagtgctgaaacgcgcagaaggc

SEQ ID NO: 48581 - DNA, 25 bp, E. coli
aaccggctggtcctccgctggttga

SEQ ID NO: 48582 - DNA, 25 bp, E. coli
aaccggctggtcgtccgctggttga

SEQ ID NO: 48583 - DNA, 25 bp, E. coli
ttccagctacgatcacgacaaccag

SEQ ID NO: 48584 - DNA, 25 bp, E. coli
ttccagctacgaacacgacaaccag

SEQ ID NO: 48585 - DNA, 25 bp, E. coli
gcttcatcgttaatgatgacctggt

SEQ ID NO: 48586 - DNA, 25 bp, E. coli
gcttcatcgttattgatgacctggt

SEQ ID NO: 48587 - DNA, 25 bp, E. coli
cgtgaactgggtattcgtcatgtcg

SEQ ID NO: 48588 - DNA, 25 bp, E. coli
cgtgaactgggttttcgtcatgtcg

SEQ ID NO: 48589 - DNA, 25 bp, E. coli
cgtgaaatgtatccaaaagcgcact

SEQ ID NO: 48590 - DNA, 25 bp, E. coli
cgtgaaatgtatgcaaaagcgcact

SEQ ID NO: 48591 - DNA, 25 bp, E. coli
gatatgggcgtcgtattcgtcccgc

SEQ ID NO: 48592 - DNA, 25 bp, E. coli
gatatgggcgtcctattcgtcccgc

SEQ ID NO: 48593 - DNA, 25 bp, E. coli
ggtactgcggttccgattcgtgaaa

SEQ ID NO: 48594 - DNA, 25 bp, E. coli
ggtactgcggttgcgattcgtgaaa

SEQ ID NO: 48595 - DNA, 25 bp, E. coli
ggcgatggcgaaggcttcatcgtta

SEQ ID NO: 48596 - DNA, 25 bp, E. coli
ggcgatggcgaacgcttcatcgtta

SEQ ID NO: 48597 - DNA, 25 bp, E. coli
gataccgtttgtatttccagctacg

SEQ ID NO: 48598 - DNA, 25 bp, E. coli
gataccgtttgtttttccagctacg

SEQ ID NO: 48599 - DNA, 25 bp, E. coli
caatgggcgctactgatcaccggtc

SEQ ID NO: 48600 - DNA, 25 bp, E. coli
caatgggcgctagtgatcaccggtc

SEQ ID NO: 48601 - DNA, 25 bp, E. coli
tactgccatcgcgactatctttgag

SEQ ID NO: 48602 - DNA, 25 bp, E. coli
tactgccatcgccactatctttgag

SEQ ID NO: 48603 - DNA, 25 bp, E. coli
tacctggacggtgatggaaaccctt

SEQ ID NO: 48604 - DNA, 25 bp, E. coli
tacctggacggtcatggaaaccctt

SEQ ID NO: 48605 - DNA, 25 bp, E. coli
taggcaagctgatttctgatacggg

SEQ ID NO: 48606 - DNA, 25 bp, E. coli
taggcaagctgaattctgatacggg

SEQ ID NO: 48607 - DNA, 25 bp, E. coli
tttgagaaagcagcaccggaaggct

SEQ ID NO: 48608 - DNA, 25 bp, E. coli
tattgatgtgctcgactgttgcggc

SEQ ID NO: 48609 - DNA, 25 bp, E. coli
tttgagaaagcaccaccggaaggct

SEQ ID NO: 48610 - DNA, 25 bp, E. coli
tattgcgattttgacactgggccga

SEQ ID NO: 48611 - DNA, 25 bp, E. coli
tattgatgtgctggactgttgcggc

SEQ ID NO: 48612 - DNA, 25 bp, E. coli
tattgcgattttcacactgggccga

SEQ ID NO: 48613 - DNA, 25 bp, E. coli
ttaatcattattgcggcaggcgtcg

SEQ ID NO: 48614 - DNA, 25 bp, E. coli
ttaatcattattccggcaggcgtcg

SEQ ID NO: 48615 - DNA, 25 bp, E. coli
gagatgccctccttctggaacagta

SEQ ID NO: 48616 - DNA, 25 bp, E. coli
gagatgccctccatctggaacagta

SEQ ID NO: 48617 - DNA, 25 bp, E. coli
gacagttattgtggcaggaccgctg

SEQ ID NO: 48618 - DNA, 25 bp, E. coli
gacagttattgtcgcaggaccgctg

SEQ ID NO: 48619 - DNA, 25 bp, E. coli
ggtaaaaaacgcctgcaatgggcgc

SEQ ID NO: 48620 - DNA, 25 bp, E. coli
ggtaaaaaacgcgtgcaatgggcgc

SEQ ID NO: 48621 - DNA, 25 bp, E. coli
aaccatgttgcatcgtacgctgggc

SEQ ID NO: 48622 - DNA, 25 bp, E. coli
aaccatgttgcaacgtacgctgggc

SEQ ID NO: 48623 - DNA, 25 bp, E. coli
catgttgcaacgtacgctgggcagt

SEQ ID NO: 48624 - DNA, 25 bp, E. coli
catgttgcaacgaacgctgggcagt

SEQ ID NO: 48625 - DNA, 25 bp, E. coli
cagggctgatgtatgcggatttatc

SEQ ID NO: 48626 - DNA, 25 bp, E. coli
cagggctgatgtttgcggatttatc

SEQ ID NO: 48627 - DNA, 25 bp, E. coli
attgcagggctgatgtatgcggatt

SEQ ID NO: 48628 - DNA, 25 bp, E. coli
attgcagggctgttgtatgcggatt

SEQ ID NO: 48629 - DNA, 25 bp, E. coli
atgttgcaacgtacgctgggcagtg

SEQ ID NO: 48630 - DNA, 25 bp, E. coli
atgttgcaacgttcgctgggcagtg

SEQ ID NO: 48631 - DNA, 25 bp, E. coli
aaaccatgttgctacgtacgctggg

SEQ ID NO: 48632 - DNA, 25 bp, E. coli
aaaccatgttgcaacgtacgctggg

SEQ ID NO: 48633 - DNA, 25 bp, E. coli
tgcagggctgatctatgcggattta

SEQ ID NO: 48634 - DNA, 25 bp, E. coli
tgcagggctgatgtatgcggattta

SEQ ID NO: 48635 - DNA, 25 bp, E. coli
ccatgttgcaacgtacgctgggcag

SEQ ID NO: 48636 - DNA, 25 bp, E. coli
ccatgttgcaacctacgctgggcag

SEQ ID NO: 48637 - DNA, 25 bp, E. coli
gctggggagtgttgctgccgggatt

SEQ ID NO: 48638 - DNA, 25 bp, E. coli
gctggggagtgtagctgccgggatt

SEQ ID NO: 48639 - DNA, 25 bp, E. coli
gcaacgtacgctcggcagtggctgg

SEQ ID NO: 48640 - DNA, 25 bp, E. coli
gcaacgtacgctgggcagtggctgg

SEQ ID NO: 48641 - DNA, 25 bp, E. coli
gggctgatgtatccggatttatcgc

SEQ ID NO: 48642 - DNA, 25 bp, E. coli
gggctgatgtatgcggatttatcgc

SEQ ID NO: 48643 - DNA, 25 bp, E. coli
catagcgttgtccatcccgttgccg

SEQ ID NO: 48644 - DNA, 25 bp, E. coli
catagcgttgtcgatcccgttgccg

SEQ ID NO: 48645 - DNA, 25 bp, E. coli
cagttgctgaaagagtgccgcgagc

SEQ ID NO: 48646 - DNA, 25 bp, E. coli
cagttgctgaaacagtgccgcgagc

SEQ ID NO: 48647 - DNA, 25 bp, E. coli
tattgagtaactggacgctgccggg

SEQ ID NO: 48648 - DNA, 25 bp, E. coli
tatattggctggagcgcaggcgcta

SEQ ID NO: 48649 - DNA, 25 bp, E. coli
tatattggctggtgcgcaggcgcta

SEQ ID NO: 48650 - DNA, 25 bp, E. coli
tattgagtaactcgacgctgccggg

SEQ ID NO: 48651 - DNA, 25 bp, E. coli
ttgctgaacagtagcagggtcgccg

SEQ ID NO: 48652 - DNA, 25 bp, E. coli
ttgctgaacagttgcagggtcgccg

SEQ ID NO: 48653 - DNA, 25 bp, E. coli
tgaaacccgtgagcagcgtattcgc

SEQ ID NO: 48654 - DNA, 25 bp, E. coli
tgaaacccgtgaccagcgtattcgc

SEQ ID NO: 48655 - DNA, 25 bp, E. coli
tgccggaaggccttaaaggtgaaac

SEQ ID NO: 48656 - DNA, 25 bp, E. coli
tgccggaaggccataaaggtgaaac

SEQ ID NO: 48657 - DNA, 25 bp, E. coli
tctgtcaccggttttcatagcgttg

SEQ ID NO: 48658 - DNA, 25 bp, E. coli
tctgtcaccggtattcatagcgttg

SEQ ID NO: 48659 - DNA, 25 bp, E. coli
gatatgccgattgtcgatccgcaag

SEQ ID NO: 48660 - DNA, 25 bp, E. coli
gatatgccgattctcgatccgcaag

SEQ ID NO: 48661 - DNA, 25 bp, E. coli
taacgcagacctgggatgattacac

SEQ ID NO: 48662 - DNA, 25 bp, E. coli
taacgcagacctcggatgattacac

SEQ ID NO: 48663 - DNA, 25 bp, E. coli
gatccgcaaggtatcgatgcgctaa

SEQ ID NO: 48664 - DNA, 25 bp, E. coli
gatccgcaaggtttcgatgcgctaa

SEQ ID NO: 48665 - DNA, 25 bp, E. coli
cagagactttgctgaacttgtggca

SEQ ID NO: 48666 - DNA, 25 bp, E. coli
cagagactttgcagaacttgtggca

SEQ ID NO: 48667 - DNA, 25 bp, E. coli
taaaaacgctgaaggaacagtgcgc

SEQ ID NO: 48668 - DNA, 25 bp, E. coli
taaagcagaaaggtgatggacccgc

SEQ ID NO: 48669 - DNA, 25 bp, E. coli
taaaaacgctgatggaacagtgcgc

SEQ ID NO: 48670 - DNA, 25 bp, E. coli
taaagcagaaagctgatggacccgc

SEQ ID NO: 48671 - DNA, 25 bp, E. coli
agccagtgcgctgatgaaagatatg

SEQ ID NO: 48672 - DNA, 25 bp, E. coli
agccagtgcgctcatgaaagatatg

SEQ ID NO: 48673 - DNA, 25 bp, E. coli
aacttgtggcaatgaaagccagtgc

SEQ ID NO: 48674 - DNA, 25 bp, E. coli
aacttgtggcaaagaaagccagtgc

SEQ ID NO: 48675 - DNA, 25 bp, E. coli
tatgctcgcggaaagcagagacttt

SEQ ID NO: 48676 - DNA, 25 bp, E. coli
tatgctcgcggatagcagagacttt

SEQ ID NO: 48677 - DNA, 25 bp, E. coli
tattttcgaatagaaggagcacgtt

SEQ ID NO: 48678 - DNA, 25 bp, E. coli
tattttcgaatacaaggagcacgtt

SEQ ID NO: 48679 - DNA, 25 bp, E. coli
tgatggacccgcgatgatttttggg

SEQ ID NO: 48680 - DNA, 25 bp, E. coli
tgatggacccgccatgatttttggg

SEQ ID NO: 48681 - DNA, 25 bp, E. coli
tgaaagatatgagcatgcgttccgg

SEQ ID NO: 48682 - DNA, 25 bp, E. coli
tgaaagatatgaccatgcgttccgg

SEQ ID NO: 48683 - DNA, 25 bp, E. coli
gttcaaccgggataaagcagaaagg

SEQ ID NO: 48684 - DNA, 25 bp, E. coli
gttcaaccgggaaaaagcagaaagg

SEQ ID NO: 48685 - DNA, 25 bp, E. coli
taagtctggacaaacgttcaaccgg

SEQ ID NO: 48686 - DNA, 25 bp, E. coli
taagtctggacatacgttcaaccgg

SEQ ID NO: 48687 - DNA, 25 bp, E. coli
tacgctgaatcaccgtggtgagtcg

SEQ ID NO: 48688 - DNA, 25 bp, E. coli
tagcgtgggcgttacgctgaatcac

SEQ ID NO: 48689 - DNA, 25 bp, E. coli
tacgctgaatcagcgtggtgagtcg

SEQ ID NO: 48690 - DNA, 25 bp, E. coli
tagcgtgggcgtaacgctgaatcac

SEQ ID NO: 48691 - DNA, 25 bp, E. coli
tgggcgttacgcagaatcaccgtgg

SEQ ID NO: 48692 - DNA, 25 bp, E. coli
tgggcgttacgctgaatcaccgtgg

SEQ ID NO: 48693 - DNA, 25 bp, E. coli
gcgttacgctgaatcaccgtggtga

SEQ ID NO: 48694 - DNA, 25 bp, E. coli
gcgttacgctgattcaccgtggtga

SEQ ID NO: 48695 - DNA, 25 bp, E. coli
gaatcaccgtggagagtcgatgtcg

SEQ ID NO: 48696 - DNA, 25 bp, E. coli
gaatcaccgtggtgagtcgatgtcg

SEQ ID NO: 48697 - DNA, 25 bp, E. coli
cgctaaagattctacggaatgaagt

SEQ ID NO: 48698 - DNA, 25 bp, E. coli
cgctaaagattcaacggaatgaagt

SEQ ID NO: 48699 - DNA, 25 bp, E. coli
ccgccgctaaagtttcaacggaatg

SEQ ID NO: 48700 - DNA, 25 bp, E. coli
ccgccgctaaagattcaacggaatg

SEQ ID NO: 48701 - DNA, 25 bp, E. coli
gattcaacggaatgaagtgattgta

SEQ ID NO: 48702 - DNA, 25 bp, E. coli
gattcaacggaaagaagtgattgta

SEQ ID NO: 48703 - DNA, 25 bp, E. coli
taattccgccgcaaaagattcaacg

SEQ ID NO: 48704 - DNA, 25 bp, E. coli
taattccgccgctaaagattcaacg

SEQ ID NO: 48705 - DNA, 25 bp, E. coli
tcaacggaatgaagtgattgtaaat

SEQ ID NO: 48706 - DNA, 25 bp, E. coli
tcaacggaatgatgtgattgtaaat

SEQ ID NO: 48707 - DNA, 25 bp, E. coli
gatgtggcaggcgagtagcgtgggc

SEQ ID NO: 48708 - DNA, 25 bp, E. coli
gatgtggcaggccagtagcgtgggc

SEQ ID NO: 48709 - DNA, 25 bp, E. coli
aatttctgctgtagctgcatcagta

SEQ ID NO: 48710 - DNA, 25 bp, E. coli
aatttctgctgttgctgcatcagta

SEQ ID NO: 48711 - DNA, 25 bp, E. coli
aattaacagtggcaatttctgctgt

SEQ ID NO: 48712 - DNA, 25 bp, E. coli
caatttctgctgaagctgcatcagt

SEQ ID NO: 48713 - DNA, 25 bp, E. coli
caatttctgctgtagctgcatcagt

SEQ ID NO: 48714 - DNA, 25 bp, E. coli
aattaacagtgggaatttctgctgt

SEQ ID NO: 48715 - DNA, 25 bp, E. coli
cagtggcaatttctgctgtagctgc

SEQ ID NO: 48716 - DNA, 25 bp, E. coli
cagtggcaatttgtgctgtagctgc

SEQ ID NO: 48717 - DNA, 25 bp, E. coli
taacagtggcaaattctgctgtagc

SEQ ID NO: 48718 - DNA, 25 bp, E. coli
taacagtggcaatttctgctgtagc

SEQ ID NO: 48719 - DNA, 25 bp, E. coli
agtggcaatttctgctgtagctgca

SEQ ID NO: 48720 - DNA, 25 bp, E. coli
agtggcaatttcagctgtagctgca

SEQ ID NO: 48721 - DNA, 25 bp, E. coli
aaaaattaacagtggcaatttctgc

SEQ ID NO: 48722 - DNA, 25 bp, E. coli
aaaaattaacagaggcaatttctgc

SEQ ID NO: 48723 - DNA, 25 bp, E. coli
tttctgctgtaggtgcatcagtact

SEQ ID NO: 48724 - DNA, 25 bp, E. coli
tttctgctgtagctgcatcagtact

SEQ ID NO: 48725 - DNA, 25 bp, E. coli
gcaatttctgctgtagctgcatcag

SEQ ID NO: 48726 - DNA, 25 bp, E. coli
gcaatttctgctctagctgcatcag

SEQ ID NO: 48727 - DNA, 25 bp, E. coli
tgaaaaaattaacagtggcaatttc

SEQ ID NO: 48728 - DNA, 25 bp, E. coli
tgaaaaaattaagagtggcaatttc

SEQ ID NO: 48729 - DNA, 25 bp, E. coli
tggcaatttctggtgtagctgcatc

SEQ ID NO: 48730 - DNA, 25 bp, E. coli
tggcaatttctgctgtagctgcatc

SEQ ID NO: 48731 - DNA, 25 bp, E. coli
catgacggcgttatcccattcttaa

SEQ ID NO: 48732 - DNA, 25 bp, E. coli
catgacggcgttttcccattcttaa

SEQ ID NO: 48733 - DNA, 25 bp, E. coli
tacgctcttgttataaatgggaatg

SEQ ID NO: 48734 - DNA, 25 bp, E. coli
tacaatttcatttccatgacggcgt

SEQ ID NO: 48735 - DNA, 25 bp, E. coli
tacaatttcattaccatgacggcgt

SEQ ID NO: 48736 - DNA, 25 bp, E. coli
gccgttacgactacaattttctcaa

SEQ ID NO: 48737 - DNA, 25 bp, E. coli
gccgttacgacttcaattttctcaa

SEQ ID NO: 48738 - DNA, 25 bp, E. coli
tacgctcttgttttaaatgggaatg

SEQ ID NO: 48739 - DNA, 25 bp, E. coli
tgctgcttcacaatgcttcgctaag

SEQ ID NO: 48740 - DNA, 25 bp, E. coli
tgctgcttcacattgcttcgctaag

SEQ ID NO: 48741 - DNA, 25 bp, E. coli
tcaattacttaaggtattgtgccgt

SEQ ID NO: 48742 - DNA, 25 bp, E. coli
tcaattacttaacgtattgtgccgt

SEQ ID NO: 48743 - DNA, 25 bp, E. coli
tcattattttctcaaatgtggagca

SEQ ID NO: 48744 - DNA, 25 bp, E. coli
tcattattttctgaaatgtggagca

SEQ ID NO: 48745 - DNA, 25 bp, E. coli
gcttcgctaagcgtaatcatcgtta

SEQ ID NO: 48746 - DNA, 25 bp, E. coli
gcttcgctaagcctaatcatcgtta

SEQ ID NO: 48747 - DNA, 25 bp, E. coli
ggagcatttcttgccgttacgacta

SEQ ID NO: 48748 - DNA, 25 bp, E. coli
ggagcatttcttcccgttacgacta

SEQ ID NO: 48749 - DNA, 25 bp, E. coli
gacgactcccttagatgaaccgata

SEQ ID NO: 48750 - DNA, 25 bp, E. coli
gatgaaccgataattttgctgcttc

SEQ ID NO: 48751 - DNA, 25 bp, E. coli
gacgactccctttgatgaaccgata

SEQ ID NO: 48752 - DNA, 25 bp, E. coli
gatgaaccgatatttttgctgcttc

SEQ ID NO: 48753 - DNA, 25 bp, E. coli
catggcggcaaccatgcgcttaagc

SEQ ID NO: 48754 - DNA, 25 bp, E. coli
catggcggcaacgatgcgcttaagc

SEQ ID NO: 48755 - DNA, 25 bp, E. coli
tacgggcggcgaacgcatttctaat

SEQ ID NO: 48756 - DNA, 25 bp, E. coli
tacgggcggcgatcgcatttctaat

SEQ ID NO: 48757 - DNA, 25 bp, E. coli
tgaaaacgccgaaagccagaatgag

SEQ ID NO: 48758 - DNA, 25 bp, E. coli
tgaaaacgccgatagccagaatgag

SEQ ID NO: 48759 - DNA, 25 bp, E. coli
tccgatccgaaagtgcgggcgttac

SEQ ID NO: 48760 - DNA, 25 bp, E. coli
tccgatccgaaactgcgggcgttac

SEQ ID NO: 48761 - DNA, 25 bp, E. coli
tctcaaaatcgaactggtccaggaa

SEQ ID NO: 48762 - DNA, 25 bp, E. coli
tctcaaaatcgatctggtccaggaa

SEQ ID NO: 48763 - DNA, 25 bp, E. coli
gcaactgggagctttctgccgatcg

SEQ ID NO: 48764 - DNA, 25 bp, E. coli
gaagtgaataagcagccgaacatcg

SEQ ID NO: 48765 - DNA, 25 bp, E. coli
gcaactgggagcattctgccgatcg

SEQ ID NO: 48766 - DNA, 25 bp, E. coli
gaagtgaataaggagccgaacatcg

SEQ ID NO: 48767 - DNA, 25 bp, E. coli
ggtccaggaaggtctacgtattcag

SEQ ID NO: 48768 - DNA, 25 bp, E. coli
ggtccaggaaggactacgtattcag

SEQ ID NO: 48769 - DNA, 25 bp, E. coli
taagcgatcgcgcacctgatgatgc

SEQ ID NO: 48770 - DNA, 25 bp, E. coli
taagcgccctggaaaaacctgaggt

SEQ ID NO: 48771 - DNA, 25 bp, E. coli
taagcgatcgcggacctgatgatgc

SEQ ID NO: 48772 - DNA, 25 bp, E. coli
taagcgccctggtaaaacctgaggt

SEQ ID NO: 48773 - DNA, 25 bp, E. coli
gagtacttccggtctccactggcga

SEQ ID NO: 48774 - DNA, 25 bp, E. coli
gagtacttccggactccactggcga

SEQ ID NO: 48775 - DNA, 25 bp, E. coli
caagggatgagcagcggccaggcaa

SEQ ID NO: 48776 - DNA, 25 bp, E. coli
caagggatgagctgcggccaggcaa

SEQ ID NO: 48777 - DNA, 25 bp, E. coli
cactcacccatgaacagcagcaaaa

SEQ ID NO: 48778 - DNA, 25 bp, E. coli
cactcacccatgtacagcagcaaaa

SEQ ID NO: 48779 - DNA, 25 bp, E. coli
tgagcagcggccaggcaatcgcgct

SEQ ID NO: 48780 - DNA, 25 bp, E. coli
tgagcagcggcctggcaatcgcgct

SEQ ID NO: 48781 - DNA, 25 bp, E. coli
tcgagcggatccaggaactgatggc

SEQ ID NO: 48782 - DNA, 25 bp, E. coli
tccggcgagcgaatcgtggcgcgtt

SEQ ID NO: 48783 - DNA, 25 bp, E. coli
tcgagcggatcctggaactgatggc

SEQ ID NO: 48784 - DNA, 25 bp, E. coli
tccggcgagcgattcgtggcgcgtt

SEQ ID NO: 48785 - DNA, 25 bp, E. coli
gcgttttgaggatgaagacgagtaa

SEQ ID NO: 48786 - DNA, 25 bp, E. coli
gcggccaggcaaacgcgctggtggc

SEQ ID NO: 48787 - DNA, 25 bp, E. coli
gcgttttgaggaagaagacgagtaa

SEQ ID NO: 48788 - DNA, 25 bp, E. coli
gcggccaggcaatcgcgctggtggc

SEQ ID NO: 48789 - DNA, 25 bp, E. coli
cgctggtggcagtagagctgcgtgc

SEQ ID NO: 48790 - DNA, 25 bp, E. coli
cgcgttttgaggttgaagacgagta

SEQ ID NO: 48791 - DNA, 25 bp, E. coli
cgcgttttgaggatgaagacgagta

SEQ ID NO: 48792 - DNA, 25 bp, E. coli
cgctggtggcagaagagctgcgtgc

SEQ ID NO: 48793 - DNA, 25 bp, E. coli
cggcgagcgaatcgtggcgcgtttt

SEQ ID NO: 48794 - DNA, 25 bp, E. coli
cggcgagcgaatggtggcgcgtttt

SEQ ID NO: 48795 - DNA, 25 bp, E. coli
tggcagaagagcagcgtgccaacca

SEQ ID NO: 48796 - DNA, 25 bp, E. coli
tggcagaagagctgcgtgccaacca

SEQ ID NO: 48797 - DNA, 25 bp, E. coli
cagttatggcgaaacgcgacctggt

SEQ ID NO: 48798 - DNA, 25 bp, E. coli
cagttatggcgatacgcgacctggt

SEQ ID NO: 48799 - DNA, 25 bp, E. coli
tatatggccccgaaagagggtcgtc

SEQ ID NO: 48800 - DNA, 25 bp, E. coli
tatatggccccgtaagagggtcgtc

SEQ ID NO: 48801 - DNA, 25 bp, E. coli
ttaatggttgctcagcgcggtgcca

SEQ ID NO: 48802 - DNA, 25 bp, E. coli
ttgttatcgacggtaaccagcgcgt

SEQ ID NO: 48803 - DNA, 25 bp, E. coli
ttaatggttgctgagcgcggtgcca

SEQ ID NO: 48804 - DNA, 25 bp, E. coli
ttgttatcgacgctaaccagcgcgt

SEQ ID NO: 48805 - DNA, 25 bp, E. coli
tgattggcatggatgtccccggcaa

SEQ ID NO: 48806 - DNA, 25 bp, E. coli
tgattggcatggttgtccccggcaa

SEQ ID NO: 48807 - DNA, 25 bp, E. coli
tcatattttttacggcagcggtgcc

SEQ ID NO: 48808 - DNA, 25 bp, E. coli
tcatattttttagggcagcggtgcc

SEQ ID NO: 48809 - DNA, 25 bp, E. coli
gccgttgacgcgctttaaaaatatg

SEQ ID NO: 48810 - DNA, 25 bp, E. coli
gccgttgacgcggtttaaaaatatg

SEQ ID NO: 48811 - DNA, 25 bp, E. coli
taagtaaatatggtccgccaggcgc

SEQ ID NO: 48812 - DNA, 25 bp, E. coli
taagtaaatatgctccgccaggcgc

SEQ ID NO: 48813 - DNA, 25 bp, E. coli
gacgttgatttatcagcgcgcgcag

SEQ ID NO: 48814 - DNA, 25 bp, E. coli
gatgatcccgcagaagaatattggc

SEQ ID NO: 48815 - DNA, 25 bp, E. coli
gacctggtaataacgttcgcccgca

SEQ ID NO: 48816 - DNA, 25 bp, E. coli
gacctggtaatatcgttcgcccgca

SEQ ID NO: 48817 - DNA, 25 bp, E. coli
gatgatcccgcacaagaatattggc

SEQ ID NO: 48818 - DNA, 25 bp, E. coli
gacgttgatttaacagcgcgcgcag

SEQ ID NO: 48819 - DNA, 25 bp, E. coli
cagtttgcaggttgcgatggtcgcc

SEQ ID NO: 48820 - DNA, 25 bp, E. coli
cagtttgcaggtagcgatggtcgcc

SEQ ID NO: 48821 - DNA, 25 bp, E. coli
tacttcaattcggaaatcgctcagg

SEQ ID NO: 48822 - DNA, 25 bp, E. coli
tacttcaattcgcaaatcgctcagg

SEQ ID NO: 48823 - DNA, 25 bp, E. coli
aaaatcgctcaggaaaaactggtcg

SEQ ID NO: 48824 - DNA, 25 bp, E. coli
aaaatcgctcagcaaaaactggtcg

SEQ ID NO: 48825 - DNA, 25 bp, E. coli
tgaaactcattaaccgctggccgct

SEQ ID NO: 48826 - DNA, 25 bp, E. coli
tgagattagccacgattcaccgctg

SEQ ID NO: 48827 - DNA, 25 bp, E. coli
tgagattagccaggattcaccgctg

SEQ ID NO: 48828 - DNA, 25 bp, E. coli
tgaaactcattatccgctggccgct

SEQ ID NO: 48829 - DNA, 25 bp, E. coli
tcttgctggcaaaaacgcgactgga

SEQ ID NO: 48830 - DNA, 25 bp, E. coli
tcttgctggcaataacgcgactgga

SEQ ID NO: 48831 - DNA, 25 bp, E. coli
gcggtaatgtcatcgccgaacgtat

SEQ ID NO: 48832 - DNA, 25 bp, E. coli
gcggtaatgtcaacgccgaacgtat

SEQ ID NO: 48833 - DNA, 25 bp, E. coli
cgcagccaggagatggactacttca

SEQ ID NO: 48834 - DNA, 25 bp, E. coli
cgcaacgtgcggacggaaaatgtgt

SEQ ID NO: 48835 - DNA, 25 bp, E. coli
cgcagccaggagttggactacttca

SEQ ID NO: 48836 - DNA, 25 bp, E. coli
cgcaacgtgcggtcggaaaatgtgt

SEQ ID NO: 48837 - DNA, 25 bp, E. coli
ctggtcgatatggttccggaagagc

SEQ ID NO: 48838 - DNA, 25 bp, E. coli
ctggtcgatatgcttccggaagagc

SEQ ID NO: 48839 - DNA, 25 bp, E. coli
taattgacgagcatgcatatagcga

SEQ ID NO: 48840 - DNA, 25 bp, E. coli
taattgacgagcttgcatatagcga

SEQ ID NO: 48841 - DNA, 25 bp, E. coli
tgcgttgataaagacaaagcaaggg

SEQ ID NO: 48842 - DNA, 25 bp, E. coli
tgcgttgataaacacaaagcaaggg

SEQ ID NO: 48843 - DNA, 25 bp, E. coli
tcatgaactaatgcgcaaatatgcg

SEQ ID NO: 48844 - DNA, 25 bp, E. coli
tcatgaactaatccgcaaatatgcg

SEQ ID NO: 48845 - DNA, 25 bp, E. coli
tcaggcaatgttacaccgcgtttca

SEQ ID NO: 48846 - DNA, 25 bp, E. coli
tcggtttcttaactttgcggtgcgc

SEQ ID NO: 48847 - DNA, 25 bp, E. coli
tcaggcaatgtttcaccgcgtttca

SEQ ID NO: 48848 - DNA, 25 bp, E. coli
tcggtttcttaagtttgcggtgcgc

SEQ ID NO: 48849 - DNA, 25 bp, E. coli
gcccatcctttgttatcaacttgtt

SEQ ID NO: 48850 - DNA, 25 bp, E. coli
gcccatcctttgatatcaacttgtt

SEQ ID NO: 48851 - DNA, 25 bp, E. coli
gaaacaagactaaacccaatattcg

SEQ ID NO: 48852 - DNA, 25 bp, E. coli
gaaacaagactatacccaatattcg

SEQ ID NO: 48853 - DNA, 25 bp, E. coli
ccgcgtttcattccaacaattatga

SEQ ID NO: 48854 - DNA, 25 bp, E. coli
ccgcgtttcattgcaacaattatga

SEQ ID NO: 48855 - DNA, 25 bp, E. coli
ccgcaaatatgcgtttcagttaacg

SEQ ID NO: 48856 - DNA, 25 bp, E. coli
ccgcaaatatgcctttcagttaacg

SEQ ID NO: 48857 - DNA, 25 bp, E. coli
gtttcagttaacctttcaggcaatg

SEQ ID NO: 48858 - DNA, 25 bp, E. coli
gtttcagttaacgtttcaggcaatg

SEQ ID NO: 48859 - DNA, 25 bp, E. coli
gggtgtgccacatttgccttaataa

SEQ ID NO: 48860 - DNA, 25 bp, E. coli
gggtgtgccacaattgccttaataa

SEQ ID NO: 48861 - DNA, 25 bp, E. coli
gagataaagtcatgaactaatccgc

SEQ ID NO: 48862 - DNA, 25 bp, E. coli
gagataaagtcaagaactaatccgc

SEQ ID NO: 48863 - DNA, 25 bp, E. coli
caattatggaggctaccactggatg

SEQ ID NO: 48864 - DNA, 25 bp, E. coli
aagttcacggcgctagtgcctgcaa

SEQ ID NO: 48865 - DNA, 25 bp, E. coli
aagttcacggcggtagtgcctgcaa

SEQ ID NO: 48866 - DNA, 25 bp, E. coli
caattatggagggtaccactggatg

SEQ ID NO: 48867 - DNA, 25 bp, E. coli
aacaggctcgtgtggctctggatgc

SEQ ID NO: 48868 - DNA, 25 bp, E. coli
acatatgaaggtcgcgcgattgatc

SEQ ID NO: 48869 - DNA, 25 bp, E. coli
aacaggctcgtgaggctctggatgc

SEQ ID NO: 48870 - DNA, 25 bp, E. coli
acatatgaaggtggcgcgattgatc

SEQ ID NO: 48871 - DNA, 25 bp, E. coli
tcgagtgaagatttttgaacgctgg

SEQ ID NO: 48872 - DNA, 25 bp, E. coli
tcgagtgaagatatttgaacgctgg

SEQ ID NO: 48873 - DNA, 25 bp, E. coli
tctggatgcctggatatgtcgacca

SEQ ID NO: 48874 - DNA, 25 bp, E. coli
tctggatgcctgcatatgtcgacca

SEQ ID NO: 48875 - DNA, 25 bp, E. coli
ccagggataagcctgaaaagttcac

SEQ ID NO: 48876 - DNA, 25 bp, E. coli
ccagggataagcgtgaaaagttcac

SEQ ID NO: 48877 - DNA, 25 bp, E. coli
gaaaatcactccagaacaggctcgt

SEQ ID NO: 48878 - DNA, 25 bp, E. coli
gaaaatcactcctgaacaggctcgt

SEQ ID NO: 48879 - DNA, 25 bp, E. coli
cgcgattgatcaccgagcgcttggc

SEQ ID NO: 48880 - DNA, 25 bp, E. coli
cgcgattgatcagcgagcgcttggc

SEQ ID NO: 48881 - DNA, 25 bp, E. coli
gatgttcagcgtgtcacatatgaag

SEQ ID NO: 48882 - DNA, 25 bp, E. coli
gatgttcagcgtctcacatatgaag

SEQ ID NO: 48883 - DNA, 25 bp, E. coli
gagcgcttggcgataatcgagtgaa

SEQ ID NO: 48884 - DNA, 25 bp, E. coli
gagcgcttggcgttaatcgagtgaa

SEQ ID NO: 48885 - DNA, 25 bp, E. coli
gttaggcattaataccgatagcttt

SEQ ID NO: 48886 - DNA, 25 bp, E. coli
caggagctgcctttgttgagaatga

SEQ ID NO: 48887 - DNA, 25 bp, E. coli
caggagctgcctatgttgagaatga

SEQ ID NO: 48888 - DNA, 25 bp, E. coli
gttaggcattaaaaccgatagcttt

SEQ ID NO: 48889 - DNA, 25 bp, E. coli
accgatagctttgccagcggtaagc

SEQ ID NO: 48890 - DNA, 25 bp, E. coli
accgatagctttcccagcggtaagc

SEQ ID NO: 48891 - DNA, 25 bp, E. coli
tacctgatgttggatgtgtcacaaa

SEQ ID NO: 48892 - DNA, 25 bp, E. coli
tacctgatgttgcatgtgtcacaaa

SEQ ID NO: 48893 - DNA, 25 bp, E. coli
tatcaagggaaatgatcaagcggtt

SEQ ID NO: 48894 - DNA, 25 bp, E. coli
tatcaagggaaaagatcaagcggtt

SEQ ID NO: 48895 - DNA, 25 bp, E. coli
ttgaagataatcagcccttgccggg

SEQ ID NO: 48896 - DNA, 25 bp, E. coli
ttgaagataatctgcccttgccggg

SEQ ID NO: 48897 - DNA, 25 bp, E. coli
gattataaagcgaccggtaatagca

SEQ ID NO: 48898 - DNA, 25 bp, E. coli
gattatcaggaaccgttggaagccg

SEQ ID NO: 48899 - DNA, 25 bp, E. coli
gattataaagcgtccggtaatagca

SEQ ID NO: 48900 - DNA, 25 bp, E. coli
gattatcaggaagcgttggaagccg

SEQ ID NO: 48901 - DNA, 25 bp, E. coli
tggaagccgggaacagtttaactat

SEQ ID NO: 48902 - DNA, 25 bp, E. coli
ggtcaacctgagatatcagtatcag

SEQ ID NO: 48903 - DNA, 25 bp, E. coli
tggaagccgggatcagtttaactat

SEQ ID NO: 48904 - DNA, 25 bp, E. coli
ggtcaacctgagttatcagtatcag

SEQ ID NO: 48905 - DNA, 25 bp, E. coli
taagcaacttatacagggcgggagc

SEQ ID NO: 48906 - DNA, 25 bp, E. coli
taagcaacttattcagggcgggagc

SEQ ID NO: 48907 - DNA, 25 bp, E. coli
aatccattaccgtcccgtgtctggg

SEQ ID NO: 48908 - DNA, 25 bp, E. coli
caaatccgcaatcgctctacggcga

SEQ ID NO: 48909 - DNA, 25 bp, E. coli
caaatccgcaatggctctacggcga

SEQ ID NO: 48910 - DNA, 25 bp, E. coli
tacggtatcccgtaacgcctggcgt

SEQ ID NO: 48911 - DNA, 25 bp, E. coli
tacggtatcccgaaacgcctggcgt

SEQ ID NO: 48912 - DNA, 25 bp, E. coli
agttcctcgataaggtgaccggtca

SEQ ID NO: 48913 - DNA, 25 bp, E. coli
agttcctcgatatggtgaccggtca

SEQ ID NO: 48914 - DNA, 25 bp, E. coli
aatccattaccgacccgtgtctggg

SEQ ID NO: 48915 - DNA, 25 bp, E. coli
gcaccgtcgccacttagaagtttgt

SEQ ID NO: 48916 - DNA, 25 bp, E. coli
gcaccgtcgccagttagaagtttgt

SEQ ID NO: 48917 - DNA, 25 bp, E. coli
gaactgacgaacaccgtactgcgcg

SEQ ID NO: 48918 - DNA, 25 bp, E. coli
gaacatctggtggtggatttcagcc

SEQ ID NO: 48919 - DNA, 25 bp, E. coli
gaactgacgaactccgtactgcgcg

SEQ ID NO: 48920 - DNA, 25 bp, E. coli
gaacatctggtgctggatttcagcc

SEQ ID NO: 48921 - DNA, 25 bp, E. coli
cgtattgagagcgtggtaacgcccg

SEQ ID NO: 48922 - DNA, 25 bp, E. coli
cgtattgagagcctggtaacgcccg

SEQ ID NO: 48923 - DNA, 25 bp, E. coli
tggcgcacgtactaccgaaagtcag

SEQ ID NO: 48924 - DNA, 25 bp, E. coli
tggcgcacgtacaaccgaaagtcag

SEQ ID NO: 48925 - DNA, 25 bp, E. coli
tacaggtaaatgagctgggcgtccc

SEQ ID NO: 48926 - DNA, 25 bp, E. coli
tacaggtaaatgtgctgggcgtccc

SEQ ID NO: 48927 - DNA, 25 bp, E. coli
gatgaccatctaacagaccagcggc

SEQ ID NO: 48928 - DNA, 25 bp, E. coli
gatgaccatctatcagaccagcggc

SEQ ID NO: 48929 - DNA, 25 bp, E. coli
aacgctattttctacctcgtatgcc

SEQ ID NO: 48930 - DNA, 25 bp, E. coli
agcataaccatgtcggaacggggtt

SEQ ID NO: 48931 - DNA, 25 bp, E. coli
agcataaccatgacggaacggggtt

SEQ ID NO: 48932 - DNA, 25 bp, E. coli
aacgctattttcaacctcgtatgcc

SEQ ID NO: 48933 - DNA, 25 bp, E. coli
ttcaggtttatgtccagacttcata

SEQ ID NO: 48934 - DNA, 25 bp, E. coli
ttcaacctcgtatgccttcttcagg

SEQ ID NO: 48935 - DNA, 25 bp, E. coli
ttcaacctcgtaagccttcttcagg

SEQ ID NO: 48936 - DNA, 25 bp, E. coli
ttcaggtttatgaccagacttcata

SEQ ID NO: 48937 - DNA, 25 bp, E. coli
tgccttcttcaggtttatgtccaga

SEQ ID NO: 48938 - DNA, 25 bp, E. coli
tgccttcttcagctttatgtccaga

SEQ ID NO: 48939 - DNA, 25 bp, E. coli
tcttcaggtttatgtccagacttca

SEQ ID NO: 48940 - DNA, 25 bp, E. coli
tcttcaggtttaagtccagacttca

SEQ ID NO: 48941 - DNA, 25 bp, E. coli
gctattttcaacctcgtatgccttc

SEQ ID NO: 48942 - DNA, 25 bp, E. coli
gctattttcaacgtcgtatgccttc

SEQ ID NO: 48943 - DNA, 25 bp, E. coli
ctcgtatgccttcttcaggtttatg

SEQ ID NO: 48944 - DNA, 25 bp, E. coli
ctcgtatgccttgttcaggtttatg

SEQ ID NO: 48945 - DNA, 25 bp, E. coli
gtctttttcactctaaatatcctgg

SEQ ID NO: 48946 - DNA, 25 bp, E. coli
gtctttttcactgtaaatatcctgg

SEQ ID NO: 48947 - DNA, 25 bp, E. coli
tggatgcctgtctttttcactgtaa

SEQ ID NO: 48948 - DNA, 25 bp, E. coli
tggatgcctgtcattttcactgtaa

SEQ ID NO: 48949 - DNA, 25 bp, E. coli
gatgcctgtctttttcactgtaaat

SEQ ID NO: 48950 - DNA, 25 bp, E. coli
gatgcctgtcttattcactgtaaat

SEQ ID NO: 48951 - DNA, 25 bp, E. coli
catcatcatgggtctggcaggaaac

SEQ ID NO: 48952 - DNA, 25 bp, E. coli
catcatcatgggactggcaggaaac

SEQ ID NO: 48953 - DNA, 25 bp, E. coli
aacggaatgcggttcactgcctgga

SEQ ID NO: 48954 - DNA, 25 bp, E. coli
aacggaatgcggatcactgcctgga

SEQ ID NO: 48955 - DNA, 25 bp, E. coli
tattaaccgcgaggagccatattgt

SEQ ID NO: 48956 - DNA, 25 bp, E. coli
tattgatcggctggaaagtagcggc

SEQ ID NO: 48957 - DNA, 25 bp, E. coli
tattaaccgcgacgagccatattgt

SEQ ID NO: 48958 - DNA, 25 bp, E. coli
tattgatcggctcgaaagtagcggc

SEQ ID NO: 48959 - DNA, 25 bp, E. coli
tgttgtcattgatgagatccctgca

SEQ ID NO: 48960 - DNA, 25 bp, E. coli
tgttgtcattgaagagatccctgca

SEQ ID NO: 48961 - DNA, 25 bp, E. coli
tctgtacgggtcgttgtcactgacg

SEQ ID NO: 48962 - DNA, 25 bp, E. coli
tctgtacgggtccttgtcactgacg

SEQ ID NO: 48963 - DNA, 25 bp, E. coli
ccatattgtggtggatctgtacggg

SEQ ID NO: 48964 - DNA, 25 bp, E. coli
ccatattgtggtcgatctgtacggg

SEQ ID NO: 48965 - DNA, 25 bp, E. coli
gaaatgttgcctcgccatgagaacg

SEQ ID NO: 48966 - DNA, 25 bp, E. coli
gaaatgttgcctggccatgagaacg

SEQ ID NO: 48967 - DNA, 25 bp, E. coli
tggcaggaaacactccgcaggatgt

SEQ ID NO: 48968 - DNA, 25 bp, E. coli
tggcaggaaacagtccgcaggatgt

SEQ ID NO: 48969 - DNA, 25 bp, E. coli
tcaaaattgggaatggtccctccag

SEQ ID NO: 48970 - DNA, 25 bp, E. coli
tcactgacgggcaaaggccatgcca

SEQ ID NO: 48971 - DNA, 25 bp, E. coli
tcaaaattgggattggtccctccag

SEQ ID NO: 48972 - DNA, 25 bp, E. coli
tcactgacgggctaaggccatgcca

SEQ ID NO: 48973 - DNA, 25 bp, E. coli
cattgattcgaaagttaccagacgg

SEQ ID NO: 48974 - DNA, 25 bp, E. coli
tatacatgcccgctaaatacggtgt

SEQ ID NO: 48975 - DNA, 25 bp, E. coli
tatacatgcccggtaaatacggtgt

SEQ ID NO: 48976 - DNA, 25 bp, E. coli
tcagtcagacgttgccttgtggatg

SEQ ID NO: 48977 - DNA, 25 bp, E. coli
tcagtcagacgtagccttgtggatg

SEQ ID NO: 48978 - DNA, 25 bp, E. coli
tcagaacaggtgtatcgcgtatggc

SEQ ID NO: 48979 - DNA, 25 bp, E. coli
gccgctacgacacacaacagaacat

SEQ ID NO: 48980 - DNA, 25 bp, E. coli
gccgctacgacagacaacagaacat

SEQ ID NO: 48981 - DNA, 25 bp, E. coli
gaattatcgggcaggtacgcaaaaa

SEQ ID NO: 48982 - DNA, 25 bp, E. coli
gaattatcgggctggtacgcaaaaa

SEQ ID NO: 48983 - DNA, 25 bp, E. coli
gaaaccttttactcacgaacagcgt

SEQ ID NO: 48984 - DNA, 25 bp, E. coli
gaacagcgtgaagaactgaaggccc

SEQ ID NO: 48985 - DNA, 25 bp, E. coli
gaaaccttttacacacgaacagcgt

SEQ ID NO: 48986 - DNA, 25 bp, E. coli
gaacagcgtgaacaactgaaggccc

SEQ ID NO: 48987 - DNA, 25 bp, E. coli
cattgattcgaatgttaccagacgg

SEQ ID NO: 48988 - DNA, 25 bp, E. coli
tcagaacaggtgaatcgcgtatggc

SEQ ID NO: 48989 - DNA, 25 bp, E. coli
gagaaagcaacccaccagacattga

SEQ ID NO: 48990 - DNA, 25 bp, E. coli
gagcaggctggcattcagtcagacg

SEQ ID NO: 48991 - DNA, 25 bp, E. coli
gagcaggctggctttcagtcagacg

SEQ ID NO: 48992 - DNA, 25 bp, E. coli
gacgatatcacaactggagagagcg

SEQ ID NO: 48993 - DNA, 25 bp, E. coli
gacgatatcacatctggagagagcg

SEQ ID NO: 48994 - DNA, 25 bp, E. coli
gagaaagcaaccgaccagacattga

SEQ ID NO: 48995 - DNA, 25 bp, E. coli
cagagttgcgggcacagacaaagat

SEQ ID NO: 48996 - DNA, 25 bp, E. coli
cagagttgcggggacagacaaagat

SEQ ID NO: 48997 - DNA, 25 bp, E. coli
tatcgggcggcagaggtaaaaagaa

SEQ ID NO: 48998 - DNA, 25 bp, E. coli
atcgggcggcagaggtaaaaagaat

SEQ ID NO: 48999 - DNA, 25 bp, E. coli
agttgcggggacagacaaagattaa

SEQ ID NO: 49000 - DNA, 25 bp, E. coli
atcgggcggcagtggtaaaaagaat

SEQ ID NO: 49001 - DNA, 25 bp, E. coli
agttgcggggactgacaaagattaa

SEQ ID NO: 49002 - DNA, 25 bp, E. coli
ttatcgggcggcagaggtaaaaaga

SEQ ID NO: 49003 - DNA, 25 bp, E. coli
ttatcgggcggctgaggtaaaaaga

SEQ ID NO: 49004 - DNA, 25 bp, E. coli
aaaatcccgcagtgttgcggggaca

SEQ ID NO: 49005 - DNA, 25 bp, E. coli
aaaatcccgcagagttgcggggaca

SEQ ID NO: 49006 - DNA, 25 bp, E. coli
tatcgggcggcacaggtaaaaagaa

SEQ ID NO: 49007 - DNA, 25 bp, E. coli
ttgtggcgggcggtcgtggttatcg

SEQ ID NO: 49008 - DNA, 25 bp, E. coli
ttgtggcgggcgctcgtggttatcg

SEQ ID NO: 49009 - DNA, 25 bp, E. coli
tgtggcgggcggacgtggttatcgg

SEQ ID NO: 49010 - DNA, 25 bp, E. coli
tgtggcgggcggtcgtggttatcgg

SEQ ID NO: 49011 - DNA, 25 bp, E. coli
tcccgcagagttgcggggacagaca

SEQ ID NO: 49012 - DNA, 25 bp, E. coli
tcccgcagagttccggggacagaca

SEQ ID NO: 49013 - DNA, 25 bp, E. coli
tcgggcggcagaggtaaaaagaata

SEQ ID NO: 49014 - DNA, 25 bp, E. coli
tcgggcggcagacgtaaaaagaata

SEQ ID NO: 49015 - DNA, 25 bp, E. coli
gaataaaaaaatgccgcagagttgc

SEQ ID NO: 49016 - DNA, 25 bp, E. coli
gaataaaaaaatcccgcagagttgc

SEQ ID NO: 49017 - DNA, 25 bp, E. coli
aaaagaaaccttccacgatcgtcag

SEQ ID NO: 49018 - DNA, 25 bp, E. coli
aaaagaaaccttgcacgatcgtcag

SEQ ID NO: 49019 - DNA, 25 bp, E. coli
tatgggaacatcgttgagcggactg

SEQ ID NO: 49020 - DNA, 25 bp, E. coli
tatgggaacatccttgagcggactg

SEQ ID NO: 49021 - DNA, 25 bp, E. coli
tatttctatcttggagcaggctgac

SEQ ID NO: 49022 - DNA, 25 bp, E. coli
tatttctatcttcgagcaggctgac

SEQ ID NO: 49023 - DNA, 25 bp, E. coli
ttcagggacttacggcatgtgcaga

SEQ ID NO: 49024 - DNA, 25 bp, E. coli
ttcagggacttagggcatgtgcaga

SEQ ID NO: 49025 - DNA, 25 bp, E. coli
gccttacgtgaagcgggaatcattc

SEQ ID NO: 49026 - DNA, 25 bp, E. coli
gccttgcccgggatttcatcgataa

SEQ ID NO: 49027 - DNA, 25 bp, E. coli
gccttacgtgaaccgggaatcattc

SEQ ID NO: 49028 - DNA, 25 bp, E. coli
gccttgcccgggttttcatcgataa

SEQ ID NO: 49029 - DNA, 25 bp, E. coli
ccgaagatattcctgggcgcgtagc

SEQ ID NO: 49030 - DNA, 25 bp, E. coli
ccgaagatattcgtgggcgcgtagc

SEQ ID NO: 49031 - DNA, 25 bp, E. coli
cattctgcgcctccatgaagccgta

SEQ ID NO: 49032 - DNA, 25 bp, E. coli
cattctgcgcctgcatgaagccgta

SEQ ID NO: 49033 - DNA, 25 bp, E. coli
ctggcctgatgatgaagaagcaacc

SEQ ID NO: 49034 - DNA, 25 bp, E. coli
ctggcctgatgaagaagaagcaacc

SEQ ID NO: 49035 - DNA, 25 bp, E. coli
gattatacgttacagcaacccgaag

SEQ ID NO: 49036 - DNA, 25 bp, E. coli
gattatacgttagagcaacccgaag

SEQ ID NO: 49037 - DNA, 25 bp, E. coli
tggttgatgcaccaccagcctttcg

SEQ ID NO: 49038 - DNA, 25 bp, E. coli
tggttgatgcacgaccagcctttcg

SEQ ID NO: 49039 - DNA, 25 bp, E. coli
tacacgcttgcccatttggttgaag

SEQ ID NO: 49040 - DNA, 25 bp, E. coli
tacacgcttgccgatttggttgaag

SEQ ID NO: 49041 - DNA, 25 bp, E. coli
tcttacggaactcgataactacacg

SEQ ID NO: 49042 - DNA, 25 bp, E. coli
tctgaagtgactcacgtctacggcg

SEQ ID NO: 49043 - DNA, 25 bp, E. coli
tcattgccagaagggcggatgacca

SEQ ID NO: 49044 - DNA, 25 bp, E. coli
tcattgccagaacggcggatgacca

SEQ ID NO: 49045 - DNA, 25 bp, E. coli
tcgtgccggctacgtgactgctgtt

SEQ ID NO: 49046 - DNA, 25 bp, E. coli
tctgaagtgactgacgtctacggcg

SEQ ID NO: 49047 - DNA, 25 bp, E. coli
tcttacggaactggataactacacg

SEQ ID NO: 49048 - DNA, 25 bp, E. coli
tcgtgccggctaggtgactgctgtt

SEQ ID NO: 49049 - DNA, 25 bp, E. coli
gaattgcagcagagagttttgccac

SEQ ID NO: 49050 - DNA, 25 bp, E. coli
gaattgcagcagtgagttttgccac

SEQ ID NO: 49051 - DNA, 25 bp, E. coli
ctgttcgtggaataaatggcggcat

SEQ ID NO: 49052 - DNA, 25 bp, E. coli
ctgttcgtggaaaaaatggcggcat

SEQ ID NO: 49053 - DNA, 25 bp, E. coli
gattacgtgcgcagatctacatggc

SEQ ID NO: 49054 - DNA, 25 bp, E. coli
gattacgtgcgctgatctacatggc

SEQ ID NO: 49055 - DNA, 25 bp, E. coli
ggcgtctcccgtaatcatatggtca

SEQ ID NO: 49056 - DNA, 25 bp, E. coli
ggcgtctcccgttatcatatggtca

SEQ ID NO: 49057 - DNA, 25 bp, E. coli
taatcaatcaacatagtcgtgccgg

SEQ ID NO: 49058 - DNA, 25 bp, E. coli
taatcaatcaacttagtcgtgccgg

SEQ ID NO: 49059 - DNA, 25 bp, E. coli
gagctggagcccatatcgctggtga

SEQ ID NO: 49060 - DNA, 25 bp, E. coli
gagctggagcccttatcgctggtga

SEQ ID NO: 49061 - DNA, 25 bp, E. coli
aatggcagtaaaacaataaagtacc

SEQ ID NO: 49062 - DNA, 25 bp, E. coli
actggaagtgacaaccgcaataatg

SEQ ID NO: 49063 - DNA, 25 bp, E. coli
aatcaataaagtaccatttcatatg

SEQ ID NO: 49064 - DNA, 25 bp, E. coli
actggaagtgactaccgcaataatg

SEQ ID NO: 49065 - DNA, 25 bp, E. coli
aatggcagtaaatcaataaagtacc

SEQ ID NO: 49066 - DNA, 25 bp, E. coli
aatcaataaagttccatttcatatg

SEQ ID NO: 49067 - DNA, 25 bp, E. coli
tcagaatggcagtaaatcaataaag

SEQ ID NO: 49068 - DNA, 25 bp, E. coli
gaaactggaagtgacaaccgcaata

SEQ ID NO: 49069 - DNA, 25 bp, E. coli
gaaactggaagtcacaaccgcaata

SEQ ID NO: 49070 - DNA, 25 bp, E. coli
ccgcaataatgatcataaaaaggca

SEQ ID NO: 49071 - DNA, 25 bp, E. coli
ccgcaataatgaacataaaaaggca

SEQ ID NO: 49072 - DNA, 25 bp, E. coli
gtgacaaccgcaataatgaacataa

SEQ ID NO: 49073 - DNA, 25 bp, E. coli
gtgacaaccgcattaatgaacataa

SEQ ID NO: 49074 - DNA, 25 bp, E. coli
tggaagtgacaagcgcaataatgaa

SEQ ID NO: 49075 - DNA, 25 bp, E. coli
ggcagtaaatcaataaagtaccatt

SEQ ID NO: 49076 - DNA, 25 bp, E. coli
ggcaaatcagaaaggcagtaaatca

SEQ ID NO: 49077 - DNA, 25 bp, E. coli
ggcaaatcagaatggcagtaaatca

SEQ ID NO: 49078 - DNA, 25 bp, E. coli
tggaagtgacaaccgcaataatgaa

SEQ ID NO: 49079 - DNA, 25 bp, E. coli
ggcagtaaatcattaaagtaccatt

SEQ ID NO: 49080 - DNA, 25 bp, E. coli
taatgaacataataaggcaaatcag

SEQ ID NO: 49081 - DNA, 25 bp, E. coli
taatgaacataaaaaggcaaatcag

SEQ ID NO: 49082 - DNA, 25 bp, E. coli
tcagaatggcagaaaatcaataaag

SEQ ID NO: 49083 - DNA, 25 bp, E. coli
caattccaggaaatgctacgaccca

SEQ ID NO: 49084 - DNA, 25 bp, E. coli
caattccaggaattgctacgaccca

SEQ ID NO: 49085 - DNA, 25 bp, E. coli
caccaggtgtagttaagtcaacagc

SEQ ID NO: 49086 - DNA, 25 bp, E. coli
caccaggtgtagataagtcaacagc

SEQ ID NO: 49087 - DNA, 25 bp, E. coli
tactggccgtgtagtgaaagctacc

SEQ ID NO: 49088 - DNA, 25 bp, E. coli
tactggccgtgttgtgaaagctacc

SEQ ID NO: 49089 - DNA, 25 bp, E. coli
tatgctgatgtctactgcggtaacc

SEQ ID NO: 49090 - DNA, 25 bp, E. coli
tatgctgatgtcaactgcggtaacc

SEQ ID NO: 49091 - DNA, 25 bp, E. coli
tgaagttgtcctcccggttgtgcct

SEQ ID NO: 49092 - DNA, 25 bp, E. coli
tgaagttgtcctgccggttgtgcct

SEQ ID NO: 49093 - DNA, 25 bp, E. coli
gttttaccggtagtgcagatagcgc

SEQ ID NO: 49094 - DNA, 25 bp, E. coli
gttttaccggtactgcagatagcgc

SEQ ID NO: 49095 - DNA, 25 bp, E. coli
ggatcaacggatgctgacaacagcg

SEQ ID NO: 49096 - DNA, 25 bp, E. coli
ggatcaacggatcctgacaacagcg

SEQ ID NO: 49097 - DNA, 25 bp, E. coli
tggagcaccgttgattatcccaggc

SEQ ID NO: 49098 - DNA, 25 bp, E. coli
ggcgagcaaccagaccgatttcaat

SEQ ID NO: 49099 - DNA, 25 bp, E. coli
tggagcaccgttcattatcccaggc

SEQ ID NO: 49100 - DNA, 25 bp, E. coli
ggcgagcaaccacaccgatttcaat

SEQ ID NO: 49101 - DNA, 25 bp, E. coli
taacctgaataccactgcggcagag

SEQ ID NO: 49102 - DNA, 25 bp, E. coli
tcactggtatcgtcgtagaagcaca

SEQ ID NO: 49103 - DNA, 25 bp, E. coli
taacctgaatacgactgcggcagag

SEQ ID NO: 49104 - DNA, 25 bp, E. coli
tcactggtatcgacgtagaagcaca

SEQ ID NO: 49105 - DNA, 25 bp, E. coli
aaggtggaagaagaatgagtgcgtc

SEQ ID NO: 49106 - DNA, 25 bp, E. coli
aaggtggaagaacaatgagtgcgtc

SEQ ID NO: 49107 - DNA, 25 bp, E. coli
taaaagtaaggtcgaagaacaatga

SEQ ID NO: 49108 - DNA, 25 bp, E. coli
taaaagtaaggtggaagaacaatga

SEQ ID NO: 49109 - DNA, 25 bp, E. coli
agtaaggtggaagaacaatgagtgc

SEQ ID NO: 49110 - DNA, 25 bp, E. coli
agtaaggtggaacaacaatgagtgc

SEQ ID NO: 49111 - DNA, 25 bp, E. coli
aggtggaagaactatgagtgcgtcg

SEQ ID NO: 49112 - DNA, 25 bp, E. coli
aggtggaagaacaatgagtgcgtcg

SEQ ID NO: 49113 - DNA, 25 bp, E. coli
aagtaaggtggaagaacaatgagtg

SEQ ID NO: 49114 - DNA, 25 bp, E. coli
aaaagtaaggtgcaagaacaatgag

SEQ ID NO: 49115 - DNA, 25 bp, E. coli
aaagtaaggtggaagaacaatgagt

SEQ ID NO: 49116 - DNA, 25 bp, E. coli
aagtaaggtggatgaacaatgagtg

SEQ ID NO: 49117 - DNA, 25 bp, E. coli
aaagtaaggtggtagaacaatgagt

SEQ ID NO: 49118 - DNA, 25 bp, E. coli
aaaagtaaggtggaagaacaatgag

SEQ ID NO: 49119 - DNA, 25 bp, E. coli
ggtggaagaacattgagtgcgtcgt

SEQ ID NO: 49120 - DNA, 25 bp, E. coli
gtggaagaacaatgagtgcgtcgtt

SEQ ID NO: 49121 - DNA, 25 bp, E. coli
ggtggaagaacaatgagtgcgtcgt

SEQ ID NO: 49122 - DNA, 25 bp, E. coli
gtggaagaacaaagagtgcgtcgtt

SEQ ID NO: 49123 - DNA, 25 bp, E. coli
tggaagaacaatgagtgcgtcgttg

SEQ ID NO: 49124 - DNA, 25 bp, E. coli
tggaagaacaatcagtgcgtcgttg

SEQ ID NO: 49125 - DNA, 25 bp, E. coli
taaggtggaagaacaatgagtgcgt

SEQ ID NO: 49126 - DNA, 25 bp, E. coli
taaggtggaagatcaatgagtgcgt

SEQ ID NO: 49127 - DNA, 25 bp, E. coli
cgtcgttgccaggtgtcgttcccgg

SEQ ID NO: 49128 - DNA, 25 bp, E. coli
cgtcgttgccagctgtcgttcccgg

SEQ ID NO: 49129 - DNA, 25 bp, E. coli
cagcgcgtgatgatcgccatggcga

SEQ ID NO: 49130 - DNA, 25 bp, E. coli
cagcgcgtgatgttcgccatggcga

SEQ ID NO: 49131 - DNA, 25 bp, E. coli
acgtctggcgtccttgccaggtgtc

SEQ ID NO: 49132 - DNA, 25 bp, E. coli
acgtctggcgtcgttgccaggtgtc

SEQ ID NO: 49133 - DNA, 25 bp, E. coli
aaagtacccgccctcagcgagcgat

SEQ ID NO: 49134 - DNA, 25 bp, E. coli
aaagtacccgccgtcagcgagcgat

SEQ ID NO: 49135 - DNA, 25 bp, E. coli
tcgttgccaggtctcgttcccggca

SEQ ID NO: 49136 - DNA, 25 bp, E. coli
tgccaggtgtcgatcccggcaagta

SEQ ID NO: 49137 - DNA, 25 bp, E. coli
tcgttgccaggtgtcgttcccggca

SEQ ID NO: 49138 - DNA, 25 bp, E. coli
tgccaggtgtcgttcccggcaagta

SEQ ID NO: 49139 - DNA, 25 bp, E. coli
gccaggtgtcgtacccggcaagtac

SEQ ID NO: 49140 - DNA, 25 bp, E. coli
gccaggtgtcgttcccggcaagtac

SEQ ID NO: 49141 - DNA, 25 bp, E. coli
ccgccgtcagcgagcgattgacctg

SEQ ID NO: 49142 - DNA, 25 bp, E. coli
ccgccgtcagcgtgcgattgacctg

SEQ ID NO: 49143 - DNA, 25 bp, E. coli
cggcaacaaaagaacccgccgtcag

SEQ ID NO: 49144 - DNA, 25 bp, E. coli
cggcaacaaaagtacccgccgtcag

SEQ ID NO: 49145 - DNA, 25 bp, E. coli
gtacccgccgtcagcgagcgattga

SEQ ID NO: 49146 - DNA, 25 bp, E. coli
gtacccgccgtctgcgagcgattga

SEQ ID NO: 49147 - DNA, 25 bp, E. coli
ggcgtcgttgcctggtgtcgttccc

SEQ ID NO: 49148 - DNA, 25 bp, E. coli
ggcgtcgttgccaggtgtcgttccc

SEQ ID NO: 49149 - DNA, 25 bp, E. coli
aattcagtgggcaaaggacggcagc

SEQ ID NO: 49150 - DNA, 25 bp, E. coli
aattcagtgggctaaggacggcagc

SEQ ID NO: 49151 - DNA, 25 bp, E. coli
aaataaacgccgctatccgtgggcg

SEQ ID NO: 49152 - DNA, 25 bp, E. coli
aaataaacgccggtatccgtgggcg

SEQ ID NO: 49153 - DNA, 25 bp, E. coli
tagatcatgtcattgcgttggcgca

SEQ ID NO: 49154 - DNA, 25 bp, E. coli
tagatcatgtcaatgcgttggcgca

SEQ ID NO: 49155 - DNA, 25 bp, E. coli
tattgacggcaaaggacagggacgc

SEQ ID NO: 49156 - DNA, 25 bp, E. coli
tattgacggcaatggacagggacgc

SEQ ID NO: 49157 - DNA, 25 bp, E. coli
ttctggtgctgaataaagccgggca

SEQ ID NO: 49158 - DNA, 25 bp, E. coli
ttctggtgctgattaaagccgggca

SEQ ID NO: 49159 - DNA, 25 bp, E. coli
tttatatccaggaaggcggcgagct

SEQ ID NO: 49160 - DNA, 25 bp, E. coli
tttatatccaggtaggcggcgagct

SEQ ID NO: 49161 - DNA, 25 bp, E. coli
tgattatcatgctcttagccccggg

SEQ ID NO: 49162 - DNA, 25 bp, E. coli
tgattatcatgcacttagccccggg

SEQ ID NO: 49163 - DNA, 25 bp, E. coli
tcggcgaagaaaaagaactcactgt

SEQ ID NO: 49164 - DNA, 25 bp, E. coli
tcggcgaagaaatagaactcactgt

SEQ ID NO: 49165 - DNA, 25 bp, E. coli
gctgcttctgaaaagcgacgacgaa

SEQ ID NO: 49166 - DNA, 25 bp, E. coli
gctgcttctgaatagcgacgacgaa

SEQ ID NO: 49167 - DNA, 25 bp, E. coli
cattattcagtatatcgccgggcgt

SEQ ID NO: 49168 - DNA, 25 bp, E. coli
cattattcagtaaatcgccgggcgt

SEQ ID NO: 49169 - DNA, 25 bp, E. coli
tggaacagcacagaattagcgggaa

SEQ ID NO: 49170 - DNA, 25 bp, E. coli
tggaacagcacacaattagcgggaa

SEQ ID NO: 49171 - DNA, 25 bp, E. coli
ttgagctgtcgattaacctttcgcc

SEQ ID NO: 49172 - DNA, 25 bp, E. coli
ttatcctcatcaatttttcgtcgcg

SEQ ID NO: 49173 - DNA, 25 bp, E. coli
ttgagctgtcgaataacctttcgcc

SEQ ID NO: 49174 - DNA, 25 bp, E. coli
ttttttcgtcgcctcacatctccga

SEQ ID NO: 49175 - DNA, 25 bp, E. coli
ttatcctcatcattttttcgtcgcg

SEQ ID NO: 49176 - DNA, 25 bp, E. coli
ttttttcgtcgcgtcacatctccga

SEQ ID NO: 49177 - DNA, 25 bp, E. coli
tcgcgtcacatcaccgacgagatga

SEQ ID NO: 49178 - DNA, 25 bp, E. coli
tcgcgtcacatctccgacgagatga

SEQ ID NO: 49179 - DNA, 25 bp, E. coli
tccgacgagatgagtgtaaaaattg

SEQ ID NO: 49180 - DNA, 25 bp, E. coli
tccgacgagatgtgtgtaaaaattg

SEQ ID NO: 49181 - DNA, 25 bp, E. coli
cgattaacctttggcctgttgccgc

SEQ ID NO: 49182 - DNA, 25 bp, E. coli
cgcgttactcatgttcttatcctca

SEQ ID NO: 49183 - DNA, 25 bp, E. coli
cgatttactggctatcacggcatta

SEQ ID NO: 49184 - DNA, 25 bp, E. coli
cgcgttactcatcttcttatcctca

SEQ ID NO: 49185 - DNA, 25 bp, E. coli
cgattaacctttcgcctgttgccgc

SEQ ID NO: 49186 - DNA, 25 bp, E. coli
cgatttactggcaatcacggcatta

SEQ ID NO: 49187 - DNA, 25 bp, E. coli
gttgccgccgctgccgatttactgg

SEQ ID NO: 49188 - DNA, 25 bp, E. coli
gttgccgccgctcccgatttactgg

SEQ ID NO: 49189 - DNA, 25 bp, E. coli
ggcaatcacggcattaagtgggtga

SEQ ID NO: 49190 - DNA, 25 bp, E. coli
ggcaatcacggctttaagtgggtga

SEQ ID NO: 49191 - DNA, 25 bp, E. coli
gatgagtgtaaatattgagctgtcg

SEQ ID NO: 49192 - DNA, 25 bp, E. coli
gatgagtgtaaaaattgagctgtcg

SEQ ID NO: 49193 - DNA, 25 bp, E. coli
cacgctttcactactacctttgaag

SEQ ID NO: 49194 - DNA, 25 bp, E. coli
cacgctttcacttctacctttgaag

SEQ ID NO: 49195 - DNA, 25 bp, E. coli
catgcggaacaccttgttaatgcac

SEQ ID NO: 49196 - DNA, 25 bp, E. coli
catgcggaacacgttgttaatgcac

SEQ ID NO: 49197 - DNA, 25 bp, E. coli
tacagaagcgaacttgccctgcaaa

SEQ ID NO: 49198 - DNA, 25 bp, E. coli
tacagaagcgaagttgccctgcaaa

SEQ ID NO: 49199 - DNA, 25 bp, E. coli
agccagcatcttaacggcccggaga

SEQ ID NO: 49200 - DNA, 25 bp, E. coli
agccagcatctttacggcccggaga

SEQ ID NO: 49201 - DNA, 25 bp, E. coli
atctgccgagcgcttccgaagcgtg

SEQ ID NO: 49202 - DNA, 25 bp, E. coli
aggtggcttccaggctttcactact

SEQ ID NO: 49203 - DNA, 25 bp, E. coli
atctgccgagcggttccgaagcgtg

SEQ ID NO: 49204 - DNA, 25 bp, E. coli
aggtggcttccacgctttcactact

SEQ ID NO: 49205 - DNA, 25 bp, E. coli
tgttaatgcactgaatacagaagcg

SEQ ID NO: 49206 - DNA, 25 bp, E. coli
tgttaatgcactcaatacagaagcg

SEQ ID NO: 49207 - DNA, 25 bp, E. coli
tctgcgccaggtcacgcaacatgcg

SEQ ID NO: 49208 - DNA, 25 bp, E. coli
tttacggcccggtgactctgcgcca

SEQ ID NO: 49209 - DNA, 25 bp, E. coli
tttacggcccggagactctgcgcca

SEQ ID NO: 49210 - DNA, 25 bp, E. coli
tctgcgccaggtgacgcaacatgcg

SEQ ID NO: 49211 - DNA, 25 bp, E. coli
gaagtctgtccgacgatcgctgtgg

SEQ ID NO: 49212 - DNA, 25 bp, E. coli
gaagtctgtccgtcgatcgctgtgg

SEQ ID NO: 49213 - DNA, 25 bp, E. coli
cgatcgctgtggaagagaaaccgat

SEQ ID NO: 49214 - DNA, 25 bp, E. coli
cgatcgctgtggtagagaaaccgat

SEQ ID NO: 49215 - DNA, 25 bp, E. coli
aaaagcggcagggagatactgcccg

SEQ ID NO: 49216 - DNA, 25 bp, E. coli
aactgtggctgaattccaaattgcg

SEQ ID NO: 49217 - DNA, 25 bp, E. coli
aactgtggctgatttccaaattgcg

SEQ ID NO: 49218 - DNA, 25 bp, E. coli
aaaagcggcaggcagatactgcccg

SEQ ID NO: 49219 - DNA, 25 bp, E. coli
tgtcgtcgtccttatgcgcagcaga

SEQ ID NO: 49220 - DNA, 25 bp, E. coli
tgtcgtcgtcctaatgcgcagcaga

SEQ ID NO: 49221 - DNA, 25 bp, E. coli
tccaaattgcgtgacggcaatacgg

SEQ ID NO: 49222 - DNA, 25 bp, E. coli
tccaaattgcgtcacggcaatacgg

SEQ ID NO: 49223 - DNA, 25 bp, E. coli
ccggaactgtgggatcacagagtcg

SEQ ID NO: 49224 - DNA, 25 bp, E. coli
ccggaactgtggcatcacagagtcg

SEQ ID NO: 49225 - DNA, 25 bp, E. coli
gcttcgcctgatccagactgatgta

SEQ ID NO: 49226 - DNA, 25 bp, E. coli
gcttcgcctgatgcagactgatgta

SEQ ID NO: 49227 - DNA, 25 bp, E. coli
ctgatgtacagggaatacgccggga

SEQ ID NO: 49228 - DNA, 25 bp, E. coli
ctgatgtacaggcaatacgccggga

SEQ ID NO: 49229 - DNA, 25 bp, E. coli
gatattgccaaattgcggcttcgcc

SEQ ID NO: 49230 - DNA, 25 bp, E. coli
gatattgccaaaatgcggcttcgcc

SEQ ID NO: 49231 - DNA, 25 bp, E. coli
taatgcgcagcagaatcgcatccag

SEQ ID NO: 49232 - DNA, 25 bp, E. coli
tcacgcggtgttatcatgcatttcg

SEQ ID NO: 49233 - DNA, 25 bp, E. coli
taatgcgcagcacaatcgcatccag

SEQ ID NO: 49234 - DNA, 25 bp, E. coli
tcacgcggtgttttcatgcatttcg

SEQ ID NO: 49235 - DNA, 25 bp, E. coli
gagatactgcccctctctgtcgtcg

SEQ ID NO: 49236 - DNA, 25 bp, E. coli
gagatactgcccgtctctgtcgtcg

SEQ ID NO: 49237 - DNA, 25 bp, E. coli
catcgcaaccctcaaaaagtgactt

SEQ ID NO: 49238 - DNA, 25 bp, E. coli
catcgcaaccctgaaaaagtgactt

SEQ ID NO: 49239 - DNA, 25 bp, E. coli
catagacaagtcagcgtccggtgaa

SEQ ID NO: 49240 - DNA, 25 bp, E. coli
catagacaagtctgcgtccggtgaa

SEQ ID NO: 49241 - DNA, 25 bp, E. coli
tgttgaaaaatagtatgacgcgaca

SEQ ID NO: 49242 - DNA, 25 bp, E. coli
tgttgaaaaatactatgacgcgaca

SEQ ID NO: 49243 - DNA, 25 bp, E. coli
tgacgcgacatcttagacaagtctg

SEQ ID NO: 49244 - DNA, 25 bp, E. coli
tgacgcgacatcatagacaagtctg

SEQ ID NO: 49245 - DNA, 25 bp, E. coli
tccctgacctgaattcaacgtgttg

SEQ ID NO: 49246 - DNA, 25 bp, E. coli
tccctgacctgatttcaacgtgttg

SEQ ID NO: 49247 - DNA, 25 bp, E. coli
tctgcatccagattagaaattctgt

SEQ ID NO: 49248 - DNA, 25 bp, E. coli
tctgcatccagaatagaaattctgt

SEQ ID NO: 49249 - DNA, 25 bp, E. coli
gaaattctgtatacggcgttgagac

SEQ ID NO: 49250 - DNA, 25 bp, E. coli
gaaattctgtattcggcgttgagac

SEQ ID NO: 49251 - DNA, 25 bp, E. coli
cttcagacgacgcatacaggtatgt

SEQ ID NO: 49252 - DNA, 25 bp, E. coli
cttcagacgacggatacaggtatgt

SEQ ID NO: 49253 - DNA, 25 bp, E. coli
ctgcgtccggtgtagataaatctgc

SEQ ID NO: 49254 - DNA, 25 bp, E. coli
ctgcgtccggtgaagataaatctgc

SEQ ID NO: 49255 - DNA, 25 bp, E. coli
gttgagacttccatcagacgacgca

SEQ ID NO: 49256 - DNA, 25 bp, E. coli
gttgagacttccttcagacgacgca

SEQ ID NO: 49257 - DNA, 25 bp, E. coli
taagatcattctatacatcgcaacc

SEQ ID NO: 49258 - DNA, 25 bp, E. coli
taagatcattctttacatcgcaacc

SEQ ID NO: 49259 - DNA, 25 bp, E. coli
cactgaatatctgacggctattgaa

SEQ ID NO: 49260 - DNA, 25 bp, E. coli
cactgaatatctcacggctattgaa

SEQ ID NO: 49261 - DNA, 25 bp, E. coli
tactcgtcttcggacgaccgtttca

SEQ ID NO: 49262 - DNA, 25 bp, E. coli
tactcgtcttcgcacgaccgtttca

SEQ ID NO: 49263 - DNA, 25 bp, E. coli
tacattaaaggcaacggcgttgtcg

SEQ ID NO: 49264 - DNA, 25 bp, E. coli
tacattaaaggctacggcgttgtcg

SEQ ID NO: 49265 - DNA, 25 bp, E. coli
tgtgaaaaacttagccgtgaacgcg

SEQ ID NO: 49266 - DNA, 25 bp, E. coli
tgtgaaaaactttgccgtgaacgcg

SEQ ID NO: 49267 - DNA, 25 bp, E. coli
tgagcagtcgatcattgaagccctg

SEQ ID NO: 49268 - DNA, 25 bp, E. coli
tgagcagtcgatgattgaagccctg

SEQ ID NO: 49269 - DNA, 25 bp, E. coli
tgctggagcgcgacactgaatatct

SEQ ID NO: 49270 - DNA, 25 bp, E. coli
tgctggagcgcgtcactgaatatct

SEQ ID NO: 49271 - DNA, 25 bp, E. coli
gcgttgtcgactagccgaagttgca

SEQ ID NO: 49272 - DNA, 25 bp, E. coli
gcgttgtcgacttgccgaagttgca

SEQ ID NO: 49273 - DNA, 25 bp, E. coli
ctgccaatcaggtgcatgacgcgcc

SEQ ID NO: 49274 - DNA, 25 bp, E. coli
cgtcgtgaagtgttaagccagttgg

SEQ ID NO: 49275 - DNA, 25 bp, E. coli
cgtcgtgaagtgataagccagttgg

SEQ ID NO: 49276 - DNA, 25 bp, E. coli
ctgccaatcaggagcatgacgcgcc

SEQ ID NO: 49277 - DNA, 25 bp, E. coli
ggaatatgacccgacggcagccttc

SEQ ID NO: 49278 - DNA, 25 bp, E. coli
ggaatatgaccccacggcagccttc

SEQ ID NO: 49279 - DNA, 25 bp, E. coli
gacggcagccttccgcaatcaggtg

SEQ ID NO: 49280 - DNA, 25 bp, E. coli
gacggcagccttgcgcaatcaggtg

SEQ ID NO: 49281 - DNA, 25 bp, E. coli
caggaatggccgtgtatacatcaag

SEQ ID NO: 49282 - DNA, 25 bp, E. coli
caggaatggccgagtatacatcaag

SEQ ID NO: 49283 - DNA, 25 bp, E. coli
tatccccacgtacataccgcagtga

SEQ ID NO: 49284 - DNA, 25 bp, E. coli
tatccccacgtagataccgcagtga

SEQ ID NO: 49285 - DNA, 25 bp, E. coli
tgctaaaacaattcgcggcttccat

SEQ ID NO: 49286 - DNA, 25 bp, E. coli
tgctaaaacaatacgcggcttccat

SEQ ID NO: 49287 - DNA, 25 bp, E. coli
tgaagacacgctcgctaaccgaatt

SEQ ID NO: 49288 - DNA, 25 bp, E. coli
tgaagacacgctggctaaccgaatt

SEQ ID NO: 49289 - DNA, 25 bp, E. coli
tcttaatcatgggaaaaccgtcagt

SEQ ID NO: 49290 - DNA, 25 bp, E. coli
tcttaatcatggcaaaaccgtcagt

SEQ ID NO: 49291 - DNA, 25 bp, E. coli
gaacagcccgtgttacctgtccgta

SEQ ID NO: 49292 - DNA, 25 bp, E. coli
gaacagcccgtgatacctgtccgta

SEQ ID NO: 49293 - DNA, 25 bp, E. coli
ccgtcaatttagctcaggaatggcc

SEQ ID NO: 49294 - DNA, 25 bp, E. coli
cgccgagggcttgagcttgattaca

SEQ ID NO: 49295 - DNA, 25 bp, E. coli
cgccgagggcttcagcttgattaca

SEQ ID NO: 49296 - DNA, 25 bp, E. coli
ccgtcaatttaggtcaggaatggcc

SEQ ID NO: 49297 - DNA, 25 bp, E. coli
gatcattcctggcatcaaagggcga

SEQ ID NO: 49298 - DNA, 25 bp, E. coli
gatcattcctgggatcaaagggcga

SEQ ID NO: 49299 - DNA, 25 bp, E. coli
ggttttacagctatcacgccgaggg

SEQ ID NO: 49300 - DNA, 25 bp, E. coli
ggttttacagctttcacgccgaggg

SEQ ID NO: 49301 - DNA, 25 bp, E. coli
ggcaaaccttgaagccatacccggt

SEQ ID NO: 49302 - DNA, 25 bp, E. coli
ggcaaaccttgatgccatacccggt

SEQ ID NO: 49303 - DNA, 25 bp, E. coli
tacaaacaatcacgcattggccgcg

SEQ ID NO: 49304 - DNA, 25 bp, E. coli
tacaaacaatcaggcattggccgcg

SEQ ID NO: 49305 - DNA, 25 bp, E. coli
aaccttgaacttttagcgacggcag

SEQ ID NO: 49306 - DNA, 25 bp, E. coli
aaccttgaacttatagcgacggcag

SEQ ID NO: 49307 - DNA, 25 bp, E. coli
acaatcaggcataggccgcgaaacc

SEQ ID NO: 49308 - DNA, 25 bp, E. coli
acaatcaggcattggccgcgaaacc

SEQ ID NO: 49309 - DNA, 25 bp, E. coli
ttggccgcgaaagccacaaaatgat

SEQ ID NO: 49310 - DNA, 25 bp, E. coli
ttttagcgacggcagaaacctggga

SEQ ID NO: 49311 - DNA, 25 bp, E. coli
ttttagcgacgggagaaacctggga

SEQ ID NO: 49312 - DNA, 25 bp, E. coli
ttggccgcgaaacccacaaaatgat

SEQ ID NO: 49313 - DNA, 25 bp, E. coli
tgatcattttcggtattttgcctcg

SEQ ID NO: 49314 - DNA, 25 bp, E. coli
tgatcattttcgctattttgcctcg

SEQ ID NO: 49315 - DNA, 25 bp, E. coli
tgaacttttagcgacggcagaaacc

SEQ ID NO: 49316 - DNA, 25 bp, E. coli
tgaacttttagccacggcagaaacc

SEQ ID NO: 49317 - DNA, 25 bp, E. coli
tgccgctggcgaatgatcattttcg

SEQ ID NO: 49318 - DNA, 25 bp, E. coli
tgccgctggcgattgatcattttcg

SEQ ID NO: 49319 - DNA, 25 bp, E. coli
tcattttcgctattttgcctcgtgt

SEQ ID NO: 49320 - DNA, 25 bp, E. coli
tcattttcgctaatttgcctcgtgt

SEQ ID NO: 49321 - DNA, 25 bp, E. coli
gcattggccgcgtaacccacaaaat

SEQ ID NO: 49322 - DNA, 25 bp, E. coli
gcattggccgcgaaacccacaaaat

SEQ ID NO: 49323 - DNA, 25 bp, E. coli
cgaaaccagtgctgccgacgtgccg

SEQ ID NO: 49324 - DNA, 25 bp, E. coli
cgaaaccagtgcagccgacgtgccg

SEQ ID NO: 49325 - DNA, 25 bp, E. coli
aacgcattatcaactgccgggcagg

SEQ ID NO: 49326 - DNA, 25 bp, E. coli
aacgcattatcatctgccgggcagg

SEQ ID NO: 49327 - DNA, 25 bp, E. coli
tacggtctgccggatctcagtctga

SEQ ID NO: 49328 - DNA, 25 bp, E. coli
tacggtctgccgcatctcagtctga

SEQ ID NO: 49329 - DNA, 25 bp, E. coli
taccggctggattcgctttgatggc

SEQ ID NO: 49330 - DNA, 25 bp, E. coli
taccggctggatacgctttgatggc

SEQ ID NO: 49331 - DNA, 25 bp, E. coli
tcatctcaaacatcaggagcgggcg

SEQ ID NO: 49332 - DNA, 25 bp, E. coli
tcttaattacctcatccacgcgcag

SEQ ID NO: 49333 - DNA, 25 bp, E. coli
tcatctcaaacaacaggagcgggcg

SEQ ID NO: 49334 - DNA, 25 bp, E. coli
tcagatacaggtggaattactcccc

SEQ ID NO: 49335 - DNA, 25 bp, E. coli
tcttaattacctgatccacgcgcag

SEQ ID NO: 49336 - DNA, 25 bp, E. coli
gacgttcagtttcagcggcgagtta

SEQ ID NO: 49337 - DNA, 25 bp, E. coli
cgttatgaaccacgcctgagtcaga

SEQ ID NO: 49338 - DNA, 25 bp, E. coli
cgttatgaaccaggcctgagtcaga

SEQ ID NO: 49339 - DNA, 25 bp, E. coli
ggtattcatggcgtgatgcgtcaga

SEQ ID NO: 49340 - DNA, 25 bp, E. coli
ggtattcatggcctgatgcgtcaga

SEQ ID NO: 49341 - DNA, 25 bp, E. coli
tcagatacaggtcgaattactcccc

SEQ ID NO: 49342 - DNA, 25 bp, E. coli
tcagattgaagatacactgctgcgt

SEQ ID NO: 49343 - DNA, 25 bp, E. coli
tcagattgaagaaacactgctgcgt

SEQ ID NO: 49344 - DNA, 25 bp, E. coli
gatggcgtattttctccggaaggac

SEQ ID NO: 49345 - DNA, 25 bp, E. coli
gacgttcagtttgagcggcgagtta

SEQ ID NO: 49346 - DNA, 25 bp, E. coli
gatggcgtatttactccggaaggac

SEQ ID NO: 49347 - DNA, 25 bp, E. coli
aagagtccaacggtttttatcgccg

SEQ ID NO: 49348 - DNA, 25 bp, E. coli
aagagtccaacgctttttatcgccg

SEQ ID NO: 49349 - DNA, 25 bp, E. coli
cagatcccgctggataaaatgtcgg

SEQ ID NO: 49350 - DNA, 25 bp, E. coli
cagatcccgctgcataaaatgtcgg

SEQ ID NO: 49351 - DNA, 25 bp, E. coli
taccacatgggtgaagcgggtgcca

SEQ ID NO: 49352 - DNA, 25 bp, E. coli
taccacatgggtcaagcgggtgcca

SEQ ID NO: 49353 - DNA, 25 bp, E. coli
ttgagccgtcgggagaaaactgtcg

SEQ ID NO: 49354 - DNA, 25 bp, E. coli
ttgccaacaaggaattgagccgtcg

SEQ ID NO: 49355 - DNA, 25 bp, E. coli
ttgccaacaaggtattgagccgtcg

SEQ ID NO: 49356 - DNA, 25 bp, E. coli
ttgagccgtcggcagaaaactgtcg

SEQ ID NO: 49357 - DNA, 25 bp, E. coli
ccatgaatggcgcagtgctaccagt

SEQ ID NO: 49358 - DNA, 25 bp, E. coli
ccatgaatggcggagtgctaccagt

SEQ ID NO: 49359 - DNA, 25 bp, E. coli
gctgtataccgatgccgatctcgat

SEQ ID NO: 49360 - DNA, 25 bp, E. coli
gctgtataccgaagccgatctcgat

SEQ ID NO: 49361 - DNA, 25 bp, E. coli
gaaagtcctgttggaccagatcccg

SEQ ID NO: 49362 - DNA, 25 bp, E. coli
gacatcatcgccaggtgttccggca

SEQ ID NO: 49363 - DNA, 25 bp, E. coli
gaaagtcctgttcgaccagatcccg

SEQ ID NO: 49364 - DNA, 25 bp, E. coli
gacatcatcgcctggtgttccggca

SEQ ID NO: 49365 - DNA, 25 bp, E. coli
cgttatttatggtgcgaagcggtca

SEQ ID NO: 49366 - DNA, 25 bp, E. coli
cgttatttatggagcgaagcggtca

SEQ ID NO: 49367 - DNA, 25 bp, E. coli
gggatcgccatctagccgctgtata

SEQ ID NO: 49368 - DNA, 25 bp, E. coli
gggatcgccatcaagccgctgtata

SEQ ID NO: 49369 - DNA, 25 bp, E. coli
caattcaaagcgtgggtgccggtaa

SEQ ID NO: 49370 - DNA, 25 bp, E. coli
caattcaaagcgagggtgccggtaa

SEQ ID NO: 49371 - DNA, 25 bp, E. coli
caaaatatccgttcctgcgctgcac

SEQ ID NO: 49372 - DNA, 25 bp, E. coli
caaaatatccgtacctgcgctgcac

SEQ ID NO: 49373 - DNA, 25 bp, E. coli
catgacccgggaactgaaactggcg

SEQ ID NO: 49374 - DNA, 25 bp, E. coli
catgacccgggatctgaaactggcg

SEQ ID NO: 49375 - DNA, 25 bp, E. coli
tatgcaggatgatagcggtacgcac

SEQ ID NO: 49376 - DNA, 25 bp, E. coli
tatgcaggatgaaagcggtacgcac

SEQ ID NO: 49377 - DNA, 25 bp, E. coli
ttgaagcactgataccgttcggcgg

SEQ ID NO: 49378 - DNA, 25 bp, E. coli
ttgaagcactgaaaccgttcggcgg

SEQ ID NO: 49379 - DNA, 25 bp, E. coli
tgattactggcagaacgtcgaaccg

SEQ ID NO: 49380 - DNA, 25 bp, E. coli
tgattactggcacaacgtcgaaccg

SEQ ID NO: 49381 - DNA, 25 bp, E. coli
tgccggtaactcaggtgccaaactg

SEQ ID NO: 49382 - DNA, 25 bp, E. coli
tgccggtaactctggtgccaaactg

SEQ ID NO: 49383 - DNA, 25 bp, E. coli
gctgcgcgcggctatatcggttata

SEQ ID NO: 49384 - DNA, 25 bp, E. coli
gctgcgcgcggcaatatcggttata

SEQ ID NO: 49385 - DNA, 25 bp, E. coli
cattcgtatcgaagacaacgtggtg

SEQ ID NO: 49386 - DNA, 25 bp, E. coli
cattcgtatcgatgacaacgtggtg

SEQ ID NO: 49387 - DNA, 25 bp, E. coli
tggtgttaaccatcgaaccgggtat

SEQ ID NO: 49388 - DNA, 25 bp, E. coli
tggtgttaaccaacgaaccgggtat

SEQ ID NO: 49389 - DNA, 25 bp, E. coli
gatgcgttacttattcactccggcg

SEQ ID NO: 49390 - DNA, 25 bp, E. coli
gatgcgttactttttcactccggcg

SEQ ID NO: 49391 - DNA, 25 bp, E. coli
caacaaaatcaaagcgtcaccgtgg

SEQ ID NO: 49392 - DNA, 25 bp, E. coli
caacaaaatcaatgcgtcaccgtgg

SEQ ID NO: 49393 - DNA, 25 bp, E. coli
catggaaagcgggacgtaacacctg

SEQ ID NO: 49394 - DNA, 25 bp, E. coli
catggaaagcggcacgtaacacctg

SEQ ID NO: 49395 - DNA, 25 bp, E. coli
cagaactatttcgtgcagggcgcga

SEQ ID NO: 49396 - DNA, 25 bp, E. coli
cagaactatttcctgcagggcgcga

SEQ ID NO: 49397 - DNA, 25 bp, E. coli
taaagatacggtgatcgacatggcg

SEQ ID NO: 49398 - DNA, 25 bp, E. coli
taaagatacggtcatcgacatggcg

SEQ ID NO: 49399 - DNA, 25 bp, E. coli
aaaatcgagtactagcatccgctgc

SEQ ID NO: 49400 - DNA, 25 bp, E. coli
aaaatcgagtacaagcatccgctgc

SEQ ID NO: 49401 - DNA, 25 bp, E. coli
tattttgataaccaggctttcccgg

SEQ ID NO: 49402 - DNA, 25 bp, E. coli
tatctacggcgatagtctcgagcgg

SEQ ID NO: 49403 - DNA, 25 bp, E. coli
tattttgataacgaggctttcccgg

SEQ ID NO: 49404 - DNA, 25 bp, E. coli
tatctacggcgaaagtctcgagcgg

SEQ ID NO: 49405 - DNA, 25 bp, E. coli
gccagcccggcaattcgtcagataa

SEQ ID NO: 49406 - DNA, 25 bp, E. coli
gccagcccggcatttcgtcagataa

SEQ ID NO: 49407 - DNA, 25 bp, E. coli
gcgaatctgcgtattgccggtaaag

SEQ ID NO: 49408 - DNA, 25 bp, E. coli
gcgaatctgcgttttgccggtaaag

SEQ ID NO: 49409 - DNA, 25 bp, E. coli
gaatcagtcattgagcgcggtaagt

SEQ ID NO: 49410 - DNA, 25 bp, E. coli
gaatcagtcattcagcgcggtaagt

SEQ ID NO: 49411 - DNA, 25 bp, E. coli
gaacctgtctcatccaacgaaggga

SEQ ID NO: 49412 - DNA, 25 bp, E. coli
gaacctgtctcaaccaacgaaggga

SEQ ID NO: 49413 - DNA, 25 bp, E. coli
catccttatcgtattgctgaacgga

SEQ ID NO: 49414 - DNA, 25 bp, E. coli
catccttatcgttttgctgaacgga

SEQ ID NO: 49415 - DNA, 25 bp, E. coli
ttcggttgattcttttcccggcggg

SEQ ID NO: 49416 - DNA, 25 bp, E. coli
ttcggttgattcatttcccggcggg

SEQ ID NO: 49417 - DNA, 25 bp, E. coli
atgtccgctgccgggagatttcagg

SEQ ID NO: 49418 - DNA, 25 bp, E. coli
atgtccgctgcccggagatttcagg

SEQ ID NO: 49419 - DNA, 25 bp, E. coli
aaaccggctgtggactttcctctga

SEQ ID NO: 49420 - DNA, 25 bp, E. coli
aaaccggctgtgcactttcctctga

SEQ ID NO: 49421 - DNA, 25 bp, E. coli
tgcaaaaaccggctgtggactttcc

SEQ ID NO: 49422 - DNA, 25 bp, E. coli
tgcaaaaaccgggtgtggactttcc

SEQ ID NO: 49423 - DNA, 25 bp, E. coli
tcctctgactttatcggttgattca

SEQ ID NO: 49424 - DNA, 25 bp, E. coli
tcctctgactttttcggttgattca

SEQ ID NO: 49425 - DNA, 25 bp, E. coli
gctgaacggatcaggttgcaaaaac

SEQ ID NO: 49426 - DNA, 25 bp, E. coli
gctgaacggatctggttgcaaaaac

SEQ ID NO: 49427 - DNA, 25 bp, E. coli
gtggactttcctctgactttttcgg

SEQ ID NO: 49428 - DNA, 25 bp, E. coli
gtggactttcctgtgactttttcgg

SEQ ID NO: 49429 - DNA, 25 bp, E. coli
tggaacgggtggtctggcatcctta

SEQ ID NO: 49430 - DNA, 25 bp, E. coli
tggactggcatcgttatcgttttgc

SEQ ID NO: 49431 - DNA, 25 bp, E. coli
tggaacgggtggactggcatcctta

SEQ ID NO: 49432 - DNA, 25 bp, E. coli
tggactggcatccttatcgttttgc

SEQ ID NO: 49433 - DNA, 25 bp, E. coli
gatctggttgcaaaaaccggctgtg

SEQ ID NO: 49434 - DNA, 25 bp, E. coli
gatctggttgcataaaccggctgtg

SEQ ID NO: 49435 - DNA, 25 bp, E. coli
tatgtagcccggaatacgctcaaag

SEQ ID NO: 49436 - DNA, 25 bp, E. coli
tatgtagcccggtatacgctcaaag

SEQ ID NO: 49437 - DNA, 25 bp, E. coli
ttctgatttagcagttattgccgcg

SEQ ID NO: 49438 - DNA, 25 bp, E. coli
ttctgatttagctgttattgccgcg

SEQ ID NO: 49439 - DNA, 25 bp, E. coli
tctggctaagagaacaggtaaaaac

SEQ ID NO: 49440 - DNA, 25 bp, E. coli
tctggctaagagtacaggtaaaaac

SEQ ID NO: 49441 - DNA, 25 bp, E. coli
gcgcaactcactgatcactttctga

SEQ ID NO: 49442 - DNA, 25 bp, E. coli
gcgcaactcactcatcactttctga

SEQ ID NO: 49443 - DNA, 25 bp, E. coli
gaagcgtttattttctggctaagag

SEQ ID NO: 49444 - DNA, 25 bp, E. coli
gaagcgtttattatctggctaagag

SEQ ID NO: 49445 - DNA, 25 bp, E. coli
gaaatcctgccagtatgtagcccgg

SEQ ID NO: 49446 - DNA, 25 bp, E. coli
gaaatcctgccactatgtagcccgg

SEQ ID NO: 49447 - DNA, 25 bp, E. coli
cgatgggaagaatacgcctggtaca

SEQ ID NO: 49448 - DNA, 25 bp, E. coli
cgatgggaagaaaacgcctggtaca

SEQ ID NO: 49449 - DNA, 25 bp, E. coli
gtcagcgcaactgactcatcacttt

SEQ ID NO: 49450 - DNA, 25 bp, E. coli
ggatgaagaaatcctgccagtatgt

SEQ ID NO: 49451 - DNA, 25 bp, E. coli
ggatgaagaaatgctgccagtatgt

SEQ ID NO: 49452 - DNA, 25 bp, E. coli
gtcagcgcaactcactcatcacttt

SEQ ID NO: 49453 - DNA, 25 bp, E. coli
ggccaaaaattgtagcgtttattat

SEQ ID NO: 49454 - DNA, 25 bp, E. coli
ggccaaaaattgaagcgtttattat

SEQ ID NO: 49455 - DNA, 25 bp, E. coli
gagaacaggtaataaccacttcata

SEQ ID NO: 49456 - DNA, 25 bp, E. coli
gagaacaggtaaaaaccacttcata

SEQ ID NO: 49457 - DNA, 25 bp, E. coli
caatagattatcaagtgagagctac

SEQ ID NO: 49458 - DNA, 25 bp, E. coli
caatagattatctagtgagagctac

SEQ ID NO: 49459 - DNA, 25 bp, E. coli
tacgagcctgtcgtgaataacgtcg

SEQ ID NO: 49460 - DNA, 25 bp, E. coli
tacgagcctgtcctgaataacgtcg

SEQ ID NO: 49461 - DNA, 25 bp, E. coli
taccactgaagctagatcatccggc

SEQ ID NO: 49462 - DNA, 25 bp, E. coli
taccactgaagcaagatcatccggc

SEQ ID NO: 49463 - DNA, 25 bp, E. coli
tatctgtaggactaatatggagagc

SEQ ID NO: 49464 - DNA, 25 bp, E. coli
tattactcgctgtaatgtacgagcc

SEQ ID NO: 49465 - DNA, 25 bp, E. coli
tttgggaacaatgcatcaggtactc

SEQ ID NO: 49466 - DNA, 25 bp, E. coli
tattactcgctgaaatgtacgagcc

SEQ ID NO: 49467 - DNA, 25 bp, E. coli
tttgggaacaatccatcaggtactc

SEQ ID NO: 49468 - DNA, 25 bp, E. coli
tatctgtaggacaaatatggagagc

SEQ ID NO: 49469 - DNA, 25 bp, E. coli
tgttgactaaactgacacccgtttc

SEQ ID NO: 49470 - DNA, 25 bp, E. coli
tgttgactaaacagacacccgtttc

SEQ ID NO: 49471 - DNA, 25 bp, E. coli
tgcagtgctttgcaaatggtcccct

SEQ ID NO: 49472 - DNA, 25 bp, E. coli
tgcagtgctttggaaatggtcccct

SEQ ID NO: 49473 - DNA, 25 bp, E. coli
gacatttttctgatattccccggta

SEQ ID NO: 49474 - DNA, 25 bp, E. coli
gacatttttctgttattccccggta

SEQ ID NO: 49475 - DNA, 25 bp, E. coli
cttgatgagtcagagctaaaacagc

SEQ ID NO: 49476 - DNA, 25 bp, E. coli
cttgatgagtcacagctaaaacagc

SEQ ID NO: 49477 - DNA, 25 bp, E. coli
taacgtcgagaagccatccgttgcg

SEQ ID NO: 49478 - DNA, 25 bp, E. coli
taacgtcgagaacccatccgttgcg

SEQ ID NO: 49479 - DNA, 25 bp, E. coli
caatatggtcggttgctatagcggt

SEQ ID NO: 49480 - DNA, 25 bp, E. coli
caatatggtcggatgctatagcggt

SEQ ID NO: 49481 - DNA, 25 bp, E. coli
caaatcggacgggtcatcaatgcct

SEQ ID NO: 49482 - DNA, 25 bp, E. coli
caaatcggacggctcatcaatgcct

SEQ ID NO: 49483 - DNA, 25 bp, E. coli
tagcctgtggcgcaatggcctaaac

SEQ ID NO: 49484 - DNA, 25 bp, E. coli
tagcctgtggcggaatggcctaaac

SEQ ID NO: 49485 - DNA, 25 bp, E. coli
tatttcggcactcgcgagtgtccgc

SEQ ID NO: 49486 - DNA, 25 bp, E. coli
tatttcggcactggcgagtgtccgc

SEQ ID NO: 49487 - DNA, 25 bp, E. coli
ttgaaaaaccagtgattctgccggg

SEQ ID NO: 49488 - DNA, 25 bp, E. coli
ttgaaaaaccagagattctgccggg

SEQ ID NO: 49489 - DNA, 25 bp, E. coli
tgctgggtgacgcatgactttaaac

SEQ ID NO: 49490 - DNA, 25 bp, E. coli
tgctgggtgacggatgactttaaac

SEQ ID NO: 49491 - DNA, 25 bp, E. coli
gaacatcaccgcatatgggcgcagg

SEQ ID NO: 49492 - DNA, 25 bp, E. coli
gaacatcaccgcttatgggcgcagg

SEQ ID NO: 49493 - DNA, 25 bp, E. coli
gatttactgccgacaatgatggcgc

SEQ ID NO: 49494 - DNA, 25 bp, E. coli
gatttactgccgtcaatgatggcgc

SEQ ID NO: 49495 - DNA, 25 bp, E. coli
taaccgctacgacattgagcatgac

SEQ ID NO: 49496 - DNA, 25 bp, E. coli
taaccgctacgagattgagcatgac

SEQ ID NO: 49497 - DNA, 25 bp, E. coli
gatgacgggctttatcaccatccgc

SEQ ID NO: 49498 - DNA, 25 bp, E. coli
gatgggcgcacataagctgatcagt

SEQ ID NO: 49499 - DNA, 25 bp, E. coli
gatgggcgcacaaaagctgatcagt

SEQ ID NO: 49500 - DNA, 25 bp, E. coli
gatgacgggcttaatcaccatccgc

SEQ ID NO: 49501 - DNA, 25 bp, E. coli
caaagctattgaaagaatgcttcac

SEQ ID NO: 49502 - DNA, 25 bp, E. coli
caaagctattgatagaatgcttcac

SEQ ID NO: 49503 - DNA, 25 bp, E. coli
catgcacgggattttatcaaaagac

SEQ ID NO: 49504 - DNA, 25 bp, E. coli
catgcacgggatattatcaaaagac

SEQ ID NO: 49505 - DNA, 25 bp, E. coli
agaccagatggctcatgaactttaa

SEQ ID NO: 49506 - DNA, 25 bp, E. coli
agaccagatggcacatgaactttaa

SEQ ID NO: 49507 - DNA, 25 bp, E. coli
taccacctttgctaaaaagacgttg

SEQ ID NO: 49508 - DNA, 25 bp, E. coli
taccacctttgcaaaaaagacgttg

SEQ ID NO: 49509 - DNA, 25 bp, E. coli
tgcagtgaagctagtgccgaaaaag

SEQ ID NO: 49510 - DNA, 25 bp, E. coli
tgcagtgaagcttgtgccgaaaaag

SEQ ID NO: 49511 - DNA, 25 bp, E. coli
gccgaaaaagacgagatggcacatg

SEQ ID NO: 49512 - DNA, 25 bp, E. coli
gccgaaaaagaccagatggcacatg

SEQ ID NO: 49513 - DNA, 25 bp, E. coli
gaatgcttcacttcatgcacgggat

SEQ ID NO: 49514 - DNA, 25 bp, E. coli
gaatgcttcactacatgcacgggat

SEQ ID NO: 49515 - DNA, 25 bp, E. coli
gacgaaccgagaaaatattgcagtg

SEQ ID NO: 49516 - DNA, 25 bp, E. coli
gacgaaccgagataatattgcagtg

SEQ ID NO: 49517 - DNA, 25 bp, E. coli
gaaaataaaatgtgcttaccacctt

SEQ ID NO: 49518 - DNA, 25 bp, E. coli
gaaaataaaatgagcttaccacctt

SEQ ID NO: 49519 - DNA, 25 bp, E. coli
gattttatcaaaagacgaaccgaga

SEQ ID NO: 49520 - DNA, 25 bp, E. coli
gattttatcaaatgacgaaccgaga

SEQ ID NO: 49521 - DNA, 25 bp, E. coli
gacgttgaagaaagcaaagctattg

SEQ ID NO: 49522 - DNA, 25 bp, E. coli
gacgttgaagaatgcaaagctattg

SEQ ID NO: 49523 - DNA, 25 bp, E. coli
aagccctgctgctagagccggatgt

SEQ ID NO: 49524 - DNA, 25 bp, E. coli
aagacctggcccatagccaacgtgg

SEQ ID NO: 49525 - DNA, 25 bp, E. coli
aagccctgctgcaagagccggatgt

SEQ ID NO: 49526 - DNA, 25 bp, E. coli
aagacctggcccttagccaacgtgg

SEQ ID NO: 49527 - DNA, 25 bp, E. coli
cactgagcagtgcttcattggtcta

SEQ ID NO: 49528 - DNA, 25 bp, E. coli
cactgagcagtggttcattggtcta

SEQ ID NO: 49529 - DNA, 25 bp, E. coli
aaaactggaactgccagacggtgcc

SEQ ID NO: 49530 - DNA, 25 bp, E. coli
actggaactgccagacggtgccgga

SEQ ID NO: 49531 - DNA, 25 bp, E. coli
aaaactggaactcccagacggtgcc

SEQ ID NO: 49532 - DNA, 25 bp, E. coli
actggaactgcctgacggtgccgga

SEQ ID NO: 49533 - DNA, 25 bp, E. coli
tctcggttcactcagcagtggttca

SEQ ID NO: 49534 - DNA, 25 bp, E. coli
tctcggttcactgagcagtggttca

SEQ ID NO: 49535 - DNA, 25 bp, E. coli
cctgctgcaagagccggatgttctg

SEQ ID NO: 49536 - DNA, 25 bp, E. coli
cctgctgcaagacccggatgttctg

SEQ ID NO: 49537 - DNA, 25 bp, E. coli
gcaagagccggatgttctgacactg

SEQ ID NO: 49538 - DNA, 25 bp, E. coli
gcaagagccggaagttctgacactg

SEQ ID NO: 49539 - DNA, 25 bp, E. coli
ccccgatctcggatcactgagcagt

SEQ ID NO: 49540 - DNA, 25 bp, E. coli
ccccgatctcggttcactgagcagt

SEQ ID NO: 49541 - DNA, 25 bp, E. coli
gtatgaagacctggcccatagccaa

SEQ ID NO: 49542 - DNA, 25 bp, E. coli
gtatgaagacctcgcccatagccaa

SEQ ID NO: 49543 - DNA, 25 bp, E. coli
ggcgaaaaagccctgctgcaagagc

SEQ ID NO: 49544 - DNA, 25 bp, E. coli
ggcgaaaaagccgtgctgcaagagc

SEQ ID NO: 49545 - DNA, 25 bp, E. coli
cagcattggtaaggtcagtatcgac

SEQ ID NO: 49546 - DNA, 25 bp, E. coli
cacgccggcgatcctgatatttaca

SEQ ID NO: 49547 - DNA, 25 bp, E. coli
cagcattggtaacgtcagtatcgac

SEQ ID NO: 49548 - DNA, 25 bp, E. coli
cacgccggcgatgctgatatttaca

SEQ ID NO: 49549 - DNA, 25 bp, E. coli
cattagttgggcgtcttcctggctc

SEQ ID NO: 49550 - DNA, 25 bp, E. coli
cattagttgggcctcttcctggctc

SEQ ID NO: 49551 - DNA, 25 bp, E. coli
taccggtggtatagccagacgactg

SEQ ID NO: 49552 - DNA, 25 bp, E. coli
taccggtggtattgccagacgactg

SEQ ID NO: 49553 - DNA, 25 bp, E. coli
tatttacgcctagagaagcatcggc

SEQ ID NO: 49554 - DNA, 25 bp, E. coli
tatttacgcctacagaagcatcggc

SEQ ID NO: 49555 - DNA, 25 bp, E. coli
tgtttattccctcgccagtggcggg

SEQ ID NO: 49556 - DNA, 25 bp, E. coli
tgtttattccctggccagtggcggg

SEQ ID NO: 49557 - DNA, 25 bp, E. coli
tgtcaccactgctagaaaaagaggg

SEQ ID NO: 49558 - DNA, 25 bp, E. coli
tgtcaccactgcaagaaaaagaggg

SEQ ID NO: 49559 - DNA, 25 bp, E. coli
tccggtggccgagcgcattaattac

SEQ ID NO: 49560 - DNA, 25 bp, E. coli
tccggtggccgaccgcattaattac

SEQ ID NO: 49561 - DNA, 25 bp, E. coli
tcttagctggatatctgccgggcat

SEQ ID NO: 49562 - DNA, 25 bp, E. coli
tcttagctggatttctgccgggcat

SEQ ID NO: 49563 - DNA, 25 bp, E. coli
taacctggcgcatgcattagttggg

SEQ ID NO: 49564 - DNA, 25 bp, E. coli
taacctggcgcaagcattagttggg

SEQ ID NO: 49565 - DNA, 25 bp, E. coli
gatgatcccacccagcaatgtgttg

SEQ ID NO: 49566 - DNA, 25 bp, E. coli
gatgatcccaccgagcaatgtgttg

SEQ ID NO: 49567 - DNA, 25 bp, E. coli
cattcagacggacgtgcgtctaatc

SEQ ID NO: 49568 - DNA, 25 bp, E. coli
acgtgcgtctaaacgccgcgactaa

SEQ ID NO: 49569 - DNA, 25 bp, E. coli
acgtgcgtctaatcgccgcgactaa

SEQ ID NO: 49570 - DNA, 25 bp, E. coli
aaaagctccctgatcctcgacgaag

SEQ ID NO: 49571 - DNA, 25 bp, E. coli
aaaagctccctgttcctcgacgaag

SEQ ID NO: 49572 - DNA, 25 bp, E. coli
ccagcgtatcggtcgttttgaactg

SEQ ID NO: 49573 - DNA, 25 bp, E. coli
ccagcgtatcggacgttttgaactg

SEQ ID NO: 49574 - DNA, 25 bp, E. coli
gacggacgtgcgtctaatcgccgcg

SEQ ID NO: 49575 - DNA, 25 bp, E. coli
gacggacgtgcgactaatcgccgcg

SEQ ID NO: 49576 - DNA, 25 bp, E. coli
gcgcccagcgtatcggtcgttttga

SEQ ID NO: 49577 - DNA, 25 bp, E. coli
ccctgttcctcgtcgaagtgggcga

SEQ ID NO: 49578 - DNA, 25 bp, E. coli
ccctgttcctcgacgaagtgggcga

SEQ ID NO: 49579 - DNA, 25 bp, E. coli
gcgcccagcgtaacggtcgttttga

SEQ ID NO: 49580 - DNA, 25 bp, E. coli
cattcagacggaggtgcgtctaatc

SEQ ID NO: 49581 - DNA, 25 bp, E. coli
cgtacgcgaactcgaaaacgtcatt

SEQ ID NO: 49582 - DNA, 25 bp, E. coli
cgtacgcgaactggaaaacgtcatt

SEQ ID NO: 49583 - DNA, 25 bp, E. coli
gataaaagctccctgttcctcgacg

SEQ ID NO: 49584 - DNA, 25 bp, E. coli
gataaaagctccgtgttcctcgacg

SEQ ID NO: 49585 - DNA, 25 bp, E. coli
gtgccagcgcccagcgtatcggtcg

SEQ ID NO: 49586 - DNA, 25 bp, E. coli
gtgccagcgccctgcgtatcggtcg

SEQ ID NO: 49587 - DNA, 25 bp, E. coli
tggagtggccggctaacgtacgcga

SEQ ID NO: 49588 - DNA, 25 bp, E. coli
tggagtggccgggtaacgtacgcga

SEQ ID NO: 49589 - DNA, 25 bp, E. coli
cccaagtggtaacgatggtctggaa

SEQ ID NO: 49590 - DNA, 25 bp, E. coli
caaagatattgttggtgtatggact

SEQ ID NO: 49591 - DNA, 25 bp, E. coli
caaagatattgtaggtgtatggact

SEQ ID NO: 49592 - DNA, 25 bp, E. coli
cccaagtggtaaggatggtctggaa

SEQ ID NO: 49593 - DNA, 25 bp, E. coli
cataccatacaaagatattgttggt

SEQ ID NO: 49594 - DNA, 25 bp, E. coli
cagtgttaatcactggcccaagtgg

SEQ ID NO: 49595 - DNA, 25 bp, E. coli
cagtgttaatcagtggcccaagtgg

SEQ ID NO: 49596 - DNA, 25 bp, E. coli
cataccatacaatgatattgttggt

SEQ ID NO: 49597 - DNA, 25 bp, E. coli
acgaaaagccgttgctgctgctatt

SEQ ID NO: 49598 - DNA, 25 bp, E. coli
acgaaaagccgtagctgctgctatt

SEQ ID NO: 49599 - DNA, 25 bp, E. coli
tagcatcagtgttaatcactggccc

SEQ ID NO: 49600 - DNA, 25 bp, E. coli
tagcatcagtgtaaatcactggccc

SEQ ID NO: 49601 - DNA, 25 bp, E. coli
tgctgctattggtggcggagcaatt

SEQ ID NO: 49602 - DNA, 25 bp, E. coli
tgctgctattggaggcggagcaatt

SEQ ID NO: 49603 - DNA, 25 bp, E. coli
tgcctccatcattacgaaaagccgt

SEQ ID NO: 49604 - DNA, 25 bp, E. coli
tgcctccatcataacgaaaagccgt

SEQ ID NO: 49605 - DNA, 25 bp, E. coli
tcattacgaaaagccgttgctgctg

SEQ ID NO: 49606 - DNA, 25 bp, E. coli
tcattacgaaaacccgttgctgctg

SEQ ID NO: 49607 - DNA, 25 bp, E. coli
gcggagcaattgctatagcatcagt

SEQ ID NO: 49608 - DNA, 25 bp, E. coli
gcggagcaattggtatagcatcagt

SEQ ID NO: 49609 - DNA, 25 bp, E. coli
tcactggcccaagtggtaacgatgg

SEQ ID NO: 49610 - DNA, 25 bp, E. coli
tcactggcccaactggtaacgatgg

SEQ ID NO: 49611 - DNA, 25 bp, E. coli
caatcgatgttcagggctacagcgc

SEQ ID NO: 49612 - DNA, 25 bp, E. coli
caatcgatgttctgggctacagcgc

SEQ ID NO: 49613 - DNA, 25 bp, E. coli
caacatgacgatcgttatgccgcca

SEQ ID NO: 49614 - DNA, 25 bp, E. coli
caacatgacgatggttatgccgcca

SEQ ID NO: 49615 - DNA, 25 bp, E. coli
agacagtttggcaatcaccggcgcg

SEQ ID NO: 49616 - DNA, 25 bp, E. coli
agacagtttggctatcaccggcgcg

SEQ ID NO: 49617 - DNA, 25 bp, E. coli
aaaaactctgttctcgatctcggaa

SEQ ID NO: 49618 - DNA, 25 bp, E. coli
aaaaactctgttgtcgatctcggaa

SEQ ID NO: 49619 - DNA, 25 bp, E. coli
tatggtgtaatgtccccagcaggaa

SEQ ID NO: 49620 - DNA, 25 bp, E. coli
tatggtgtaatgaccccagcaggaa

SEQ ID NO: 49621 - DNA, 25 bp, E. coli
tgttgatgtaactggagccgcggcc

SEQ ID NO: 49622 - DNA, 25 bp, E. coli
tgttgatgtaacaggagccgcggcc

SEQ ID NO: 49623 - DNA, 25 bp, E. coli
tgatatgagtactcccgaccagatg

SEQ ID NO: 49624 - DNA, 25 bp, E. coli
tgatatgagtacacccgaccagatg

SEQ ID NO: 49625 - DNA, 25 bp, E. coli
tcggtggtctcatcggcaataacgc

SEQ ID NO: 49626 - DNA, 25 bp, E. coli
tcggtggtctcaacggcaataacgc

SEQ ID NO: 49627 - DNA, 25 bp, E. coli
ctttggccaggtaagcgcgaatgca

SEQ ID NO: 49628 - DNA, 25 bp, E. coli
ctttggccaggttagcgcgaatgca

SEQ ID NO: 49629 - DNA, 25 bp, E. coli
gatagccatatttcttccgcgcagg

SEQ ID NO: 49630 - DNA, 25 bp, E. coli
gatacaggaagtgaatatggcacca

SEQ ID NO: 49631 - DNA, 25 bp, E. coli
gatacaggaagtcaatatggcacca

SEQ ID NO: 49632 - DNA, 25 bp, E. coli
gatagccatattacttccgcgcagg

SEQ ID NO: 49633 - DNA, 25 bp, E. coli
caataacttaggtttacttcgtggc

SEQ ID NO: 49634 - DNA, 25 bp, E. coli
caataacttaggattacttcgtggc

SEQ ID NO: 49635 - DNA, 25 bp, E. coli
agttggtgggaagccgtcatgacaa

SEQ ID NO: 49636 - DNA, 25 bp, E. coli
agttggtgggaacccgtcatgacaa

SEQ ID NO: 49637 - DNA, 25 bp, E. coli
aaacaatccattgaacgactggcgg

SEQ ID NO: 49638 - DNA, 25 bp, E. coli
aaacaatccattcaacgactggcgg

SEQ ID NO: 49639 - DNA, 25 bp, E. coli
tagaggcttacgattttgagggcga

SEQ ID NO: 49640 - DNA, 25 bp, E. coli
tagaggcttacgtttttgagggcga

SEQ ID NO: 49641 - DNA, 25 bp, E. coli
gcttacgtttttgagggcgaacaag

SEQ ID NO: 49642 - DNA, 25 bp, E. coli
gcttacgtttttcagggcgaacaag

SEQ ID NO: 49643 - DNA, 25 bp, E. coli
gacagcattattgtcgttgcccagt

SEQ ID NO: 49644 - DNA, 25 bp, E. coli
gacagcattattctcgttgcccagt

SEQ ID NO: 49645 - DNA, 25 bp, E. coli
cgtcatgacaaggtgaaacaatcca

SEQ ID NO: 49646 - DNA, 25 bp, E. coli
cattgaacgactcgcggttcgaggt

SEQ ID NO: 49647 - DNA, 25 bp, E. coli
cgtcatgacaagctgaaacaatcca

SEQ ID NO: 49648 - DNA, 25 bp, E. coli
cattgaacgactggcggttcgaggt

SEQ ID NO: 49649 - DNA, 25 bp, E. coli
gtgatccgaaatcccccaatggtgg

SEQ ID NO: 49650 - DNA, 25 bp, E. coli
gtgatccgaaatgccccaatggtgg

SEQ ID NO: 49651 - DNA, 25 bp, E. coli
ggttcgaggtgtcatccgaaatccc

SEQ ID NO: 49652 - DNA, 25 bp, E. coli
ggttcgaggtgtgatccgaaatccc

SEQ ID NO: 49653 - DNA, 25 bp, E. coli
tacttcgtggcgtagaggcttacgt

SEQ ID NO: 49654 - DNA, 25 bp, E. coli
tacttcgtggcgaagaggcttacgt

SEQ ID NO: 49655 - DNA, 25 bp, E. coli
aaccgaaacgcttatccggcaactg

SEQ ID NO: 49656 - DNA, 25 bp, E. coli
aaccgaaacgctaatccggcaactg

SEQ ID NO: 49657 - DNA, 25 bp, E. coli
aacctcgactgccaaatctggcgtg

SEQ ID NO: 49658 - DNA, 25 bp, E. coli
aacctcgactgcgaaatctggcgtg

SEQ ID NO: 49659 - DNA, 25 bp, E. coli
tatccgacacgttgtgacggtacgg

SEQ ID NO: 49660 - DNA, 25 bp, E. coli
ttggcggcaaaagcgccctggaccg

SEQ ID NO: 49661 - DNA, 25 bp, E. coli
ttggcggcaaaaccgccctggaccg

SEQ ID NO: 49662 - DNA, 25 bp, E. coli
tatccgacacgtagtgacggtacgg

SEQ ID NO: 49663 - DNA, 25 bp, E. coli
tgacagcagcagacattggcggcaa

SEQ ID NO: 49664 - DNA, 25 bp, E. coli
tgacagcagcagtcattggcggcaa

SEQ ID NO: 49665 - DNA, 25 bp, E. coli
cctggaccgggccatgaaacaggat

SEQ ID NO: 49666 - DNA, 25 bp, E. coli
cctggaccgggcgatgaaacaggat

SEQ ID NO: 49667 - DNA, 25 bp, E. coli
gctccaccagtaaccgacacgttgt

SEQ ID NO: 49668 - DNA, 25 bp, E. coli
gctccaccagtatccgacacgttgt

SEQ ID NO: 49669 - DNA, 25 bp, E. coli
gcagaaatctcactcctgacagcag

SEQ ID NO: 49670 - DNA, 25 bp, E. coli
gcactgcaacaaaccgaaacgctta

SEQ ID NO: 49671 - DNA, 25 bp, E. coli
gcactgcaacaatccgaaacgctta

SEQ ID NO: 49672 - DNA, 25 bp, E. coli
gcagaaatctcagtcctgacagcag

SEQ ID NO: 49673 - DNA, 25 bp, E. coli
gacggtacggaatgcagcactgcaa

SEQ ID NO: 49674 - DNA, 25 bp, E. coli
gacggtacggaaagcagcactgcaa

SEQ ID NO: 49675 - DNA, 25 bp, E. coli
ctgagtctgatggatgcacagggct

SEQ ID NO: 49676 - DNA, 25 bp, E. coli
ctgagtctgatgcatgcacagggct

SEQ ID NO: 49677 - DNA, 25 bp, E. coli
aatctttcagaacgccgcgaatccc

SEQ ID NO: 49678 - DNA, 25 bp, E. coli
aatctttcagaaggccgcgaatccc

SEQ ID NO: 49679 - DNA, 25 bp, E. coli
tatgacaaaggaaatactttgcgca

SEQ ID NO: 49680 - DNA, 25 bp, E. coli
tatgacaaaggatatactttgcgca

SEQ ID NO: 49681 - DNA, 25 bp, E. coli
tgtttcacaactacatagtgtctgg

SEQ ID NO: 49682 - DNA, 25 bp, E. coli
tgtttcacaacttcatagtgtctgg

SEQ ID NO: 49683 - DNA, 25 bp, E. coli
tgcactttgtgttagacgggatagg

SEQ ID NO: 49684 - DNA, 25 bp, E. coli
tgcactttgtgtaagacgggatagg

SEQ ID NO: 49685 - DNA, 25 bp, E. coli
ccaaagtatggacaagttaacatta

SEQ ID NO: 49686 - DNA, 25 bp, E. coli
ccaaagtatggagaagttaacatta

SEQ ID NO: 49687 - DNA, 25 bp, E. coli
cccgttttgtcgtggtaatgtatgc

SEQ ID NO: 49688 - DNA, 25 bp, E. coli
cccgttttgtcgaggtaatgtatgc

SEQ ID NO: 49689 - DNA, 25 bp, E. coli
ctgtatttccttttccaaagtatgg

SEQ ID NO: 49690 - DNA, 25 bp, E. coli
ctgtatttccttatccaaagtatgg

SEQ ID NO: 49691 - DNA, 25 bp, E. coli
gattgcaacaatctttcagaaggcc

SEQ ID NO: 49692 - DNA, 25 bp, E. coli
gattgcaacaatgtttcagaaggcc

SEQ ID NO: 49693 - DNA, 25 bp, E. coli
tgtttgattacctgcgaaacgtttc

SEQ ID NO: 49694 - DNA, 25 bp, E. coli
tgtttgattaccagcgaaacgtttc

SEQ ID NO: 49695 - DNA, 25 bp, E. coli
tcaccgcatggccatttaagccagg

SEQ ID NO: 49696 - DNA, 25 bp, E. coli
tcaccgcatggcgatttaagccagg

SEQ ID NO: 49697 - DNA, 25 bp, E. coli
taattacccacagaaaatataggct

SEQ ID NO: 49698 - DNA, 25 bp, E. coli
taattacccacacaaaatataggct

SEQ ID NO: 49699 - DNA, 25 bp, E. coli
caaacagtgatgaggcaaacccgga

SEQ ID NO: 49700 - DNA, 25 bp, E. coli
caaacagtgatgtggcaaacccgga

SEQ ID NO: 49701 - DNA, 25 bp, E. coli
tacagccattctattgtcatacagg

SEQ ID NO: 49702 - DNA, 25 bp, E. coli
tacagccattcttttgtcatacagg

SEQ ID NO: 49703 - DNA, 25 bp, E. coli
caataactgaaacagccccggattt

SEQ ID NO: 49704 - DNA, 25 bp, E. coli
caaggaaaattggtcgaaagtgact

SEQ ID NO: 49705 - DNA, 25 bp, E. coli
caaggaaaattgctcgaaagtgact

SEQ ID NO: 49706 - DNA, 25 bp, E. coli
caataactgaaagagccccggattt

SEQ ID NO: 49707 - DNA, 25 bp, E. coli
tatgcgtatagagccttgcagcgtc

SEQ ID NO: 49708 - DNA, 25 bp, E. coli
taggttgcgaactgcgtggcgctat

SEQ ID NO: 49709 - DNA, 25 bp, E. coli
tatgcgtatagacccttgcagcgtc

SEQ ID NO: 49710 - DNA, 25 bp, E. coli
taggttgcgaacagcgtggcgctat

SEQ ID NO: 49711 - DNA, 25 bp, E. coli
tcgcgataccttatcggcgttgcgg

SEQ ID NO: 49712 - DNA, 25 bp, E. coli
tcgcgataccttttcggcgttgcgg

SEQ ID NO: 49713 - DNA, 25 bp, E. coli
cctacagtgatgagttgtcaaacag

SEQ ID NO: 49714 - DNA, 25 bp, E. coli
cctacagtgatgtgttgtcaaacag

SEQ ID NO: 49715 - DNA, 25 bp, E. coli
gcagcgtcaacctctttttcaagga

SEQ ID NO: 49716 - DNA, 25 bp, E. coli
gcagcgtcaaccactttttcaagga

SEQ ID NO: 49717 - DNA, 25 bp, E. coli
gaatcaacaagcacctcaataactg

SEQ ID NO: 49718 - DNA, 25 bp, E. coli
gaatcaacaagctcctcaataactg

SEQ ID NO: 49719 - DNA, 25 bp, E. coli
ggaacatttccttactgcatatcag

SEQ ID NO: 49720 - DNA, 25 bp, E. coli
ggaacatttcctaactgcatatcag

SEQ ID NO: 49721 - DNA, 25 bp, E. coli
caatgctctttttctctaacctggg

SEQ ID NO: 49722 - DNA, 25 bp, E. coli
caatgctcttttactctaacctggg

SEQ ID NO: 49723 - DNA, 25 bp, E. coli
caaaaatggaattgtgatgaggacg

SEQ ID NO: 49724 - DNA, 25 bp, E. coli
caaaaatggaatagtgatgaggacg

SEQ ID NO: 49725 - DNA, 25 bp, E. coli
aaaggtctggcatttgacatttcca

SEQ ID NO: 49726 - DNA, 25 bp, E. coli
aaaggtctggcaattgacatttcca

SEQ ID NO: 49727 - DNA, 25 bp, E. coli
tatacgttacagatttgctcaatgc

SEQ ID NO: 49728 - DNA, 25 bp, E. coli
tatacgttacagttttgctcaatgc

SEQ ID NO: 49729 - DNA, 25 bp, E. coli
tccatgtctaaacaatgtagtggtg

SEQ ID NO: 49730 - DNA, 25 bp, E. coli
tccatgtctaaagaatgtagtggtg

SEQ ID NO: 49731 - DNA, 25 bp, E. coli
ccagagtagggccactggcattctc

SEQ ID NO: 49732 - DNA, 25 bp, E. coli
ccagagtagggcgactggcattctc

SEQ ID NO: 49733 - DNA, 25 bp, E. coli
gactggcattctctcggctatatcc

SEQ ID NO: 49734 - DNA, 25 bp, E. coli
cattctcatgtacaaaaggtctggc

SEQ ID NO: 49735 - DNA, 25 bp, E. coli
cggctatatccaagctatactgagt

SEQ ID NO: 49736 - DNA, 25 bp, E. coli
cggctatatccatgctatactgagt

SEQ ID NO: 49737 - DNA, 25 bp, E. coli
cattctcatgtagaaaaggtctggc

SEQ ID NO: 49738 - DNA, 25 bp, E. coli
tcaaaatccagaagagatatccagc

SEQ ID NO: 49739 - DNA, 25 bp, E. coli
taagagccatgctactaaacaatgc

SEQ ID NO: 49740 - DNA, 25 bp, E. coli
taagagccatgcaactaaacaatgc

SEQ ID NO: 49741 - DNA, 25 bp, E. coli
tcaaaatccagatgagatatccagc

SEQ ID NO: 49742 - DNA, 25 bp, E. coli
gactggcattctgtcggctatatcc

SEQ ID NO: 49743 - DNA, 25 bp, E. coli
caagcaggcttagtgatcggtggaa

SEQ ID NO: 49744 - DNA, 25 bp, E. coli
caagcaggcttactgatcggtggaa

SEQ ID NO: 49745 - DNA, 25 bp, E. coli
caggccccagatatgtgacactcta

SEQ ID NO: 49746 - DNA, 25 bp, E. coli
catatcaaaaataacgctgggcacg

SEQ ID NO: 49747 - DNA, 25 bp, E. coli
catatcaaaaattacgctgggcacg

SEQ ID NO: 49748 - DNA, 25 bp, E. coli
caggccccagatttgtgacactcta

SEQ ID NO: 49749 - DNA, 25 bp, E. coli
taccgtttataatccaggccccaga

SEQ ID NO: 49750 - DNA, 25 bp, E. coli
taccgtttataaaccaggccccaga

SEQ ID NO: 49751 - DNA, 25 bp, E. coli
tttattctctacagcacaagcaggc

SEQ ID NO: 49752 - DNA, 25 bp, E. coli
tttattctctactgcacaagcaggc

SEQ ID NO: 49753 - DNA, 25 bp, E. coli
tgttagtcaaggttgcagtctcccc

SEQ ID NO: 49754 - DNA, 25 bp, E. coli
tgttagtcaaggatgcagtctcccc

SEQ ID NO: 49755 - DNA, 25 bp, E. coli
tgacgggaacggttgaatctttgcc

SEQ ID NO: 49756 - DNA, 25 bp, E. coli
tgacgggaacggatgaatctttgcc

SEQ ID NO: 49757 - DNA, 25 bp, E. coli
cgctgggcacgaaaaaatgaaattg

SEQ ID NO: 49758 - DNA, 25 bp, E. coli
cgctgggcacgataaaatgaaattg

SEQ ID NO: 49759 - DNA, 25 bp, E. coli
ggtcgcaccatttagccatcgccaa

SEQ ID NO: 49760 - DNA, 25 bp, E. coli
ggtatttatcgcaactccgccactg

SEQ ID NO: 49761 - DNA, 25 bp, E. coli
ggtatttatcgctactccgccactg

SEQ ID NO: 49762 - DNA, 25 bp, E. coli
ggtcgcaccattaagccatcgccaa

SEQ ID NO: 49763 - DNA, 25 bp, E. coli
taatcaattgcatatagcagtccgc

SEQ ID NO: 49764 - DNA, 25 bp, E. coli
taatcaattgcaaatagcagtccgc

SEQ ID NO: 49765 - DNA, 25 bp, E. coli
cacaggagttcgtatctggtatcca

SEQ ID NO: 49766 - DNA, 25 bp, E. coli
cacaggagttcgaatctggtatcca

SEQ ID NO: 49767 - DNA, 25 bp, E. coli
catcctgaaatggagcgggcttcct

SEQ ID NO: 49768 - DNA, 25 bp, E. coli
cattttgtgggcaatctgaacggtc

SEQ ID NO: 49769 - DNA, 25 bp, E. coli
cattttgtgggctatctgaacggtc

SEQ ID NO: 49770 - DNA, 25 bp, E. coli
catcctgaaatgcagcgggcttcct

SEQ ID NO: 49771 - DNA, 25 bp, E. coli
tactgcgactgattaacgaagtggg

SEQ ID NO: 49772 - DNA, 25 bp, E. coli
tactgcgactgaataacgaagtggg

SEQ ID NO: 49773 - DNA, 25 bp, E. coli
tatacggaacgttaagggcttcaca

SEQ ID NO: 49774 - DNA, 25 bp, E. coli
tatacggaacgtaaagggcttcaca

SEQ ID NO: 49775 - DNA, 25 bp, E. coli
tgtgcctgcaggtacgccatgtgtg

SEQ ID NO: 49776 - DNA, 25 bp, E. coli
tgtgcctgcaggaacgccatgtgtg

SEQ ID NO: 49777 - DNA, 25 bp, E. coli
tgaagacttacaacaccaatcccgg

SEQ ID NO: 49778 - DNA, 25 bp, E. coli
tgaagacttacatcaccaatcccgg

SEQ ID NO: 49779 - DNA, 25 bp, E. coli
tcccggttacgatatggatccccag

SEQ ID NO: 49780 - DNA, 25 bp, E. coli
tcccggttacgaaatggatccccag

SEQ ID NO: 49781 - DNA, 25 bp, E. coli
tcacaaagcggtcaatgccttacgc

SEQ ID NO: 49782 - DNA, 25 bp, E. coli
tcacaaagcggtgaatgccttacgc

SEQ ID NO: 49783 - DNA, 25 bp, E. coli
ccatgtgtgcggtgatactgcgact

SEQ ID NO: 49784 - DNA, 25 bp, E. coli
ccatgtgtgcggagatactgcgact

SEQ ID NO: 49785 - DNA, 25 bp, E. coli
ctgaacggtcagagccacaggagtt

SEQ ID NO: 49786 - DNA, 25 bp, E. coli
ctgaacggtcagtgccacaggagtt

SEQ ID NO: 49787 - DNA, 25 bp, E. coli
caaccagaaaggtgtggaacgtctc

SEQ ID NO: 49788 - DNA, 25 bp, E. coli
caaccagaaaggagtggaacgtctc

SEQ ID NO: 49789 - DNA, 25 bp, E. coli
caacaacccgtttggtgcgctgcat

SEQ ID NO: 49790 - DNA, 25 bp, E. coli
caacaacccgttaggtgcgctgcat

SEQ ID NO: 49791 - DNA, 25 bp, E. coli
taaaggcatgatcctaccactggct

SEQ ID NO: 49792 - DNA, 25 bp, E. coli
taaaggcatgatgctaccactggct

SEQ ID NO: 49793 - DNA, 25 bp, E. coli
tatgcactgcgtggatccgaactgt

SEQ ID NO: 49794 - DNA, 25 bp, E. coli
tatgcactgcgtcgatccgaactgt

SEQ ID NO: 49795 - DNA, 25 bp, E. coli
tattatccgcatctgtacggcgaga

SEQ ID NO: 49796 - DNA, 25 bp, E. coli
tattatccgcatgtgtacggcgaga

SEQ ID NO: 49797 - DNA, 25 bp, E. coli
ttttattaaagcagcctcctgcggg

SEQ ID NO: 49798 - DNA, 25 bp, E. coli
ttttattaaagctgcctcctgcggg

SEQ ID NO: 49799 - DNA, 25 bp, E. coli
tgtgccttatgaaaatctcgacctg

SEQ ID NO: 49800 - DNA, 25 bp, E. coli
tgtgccttatgataatctcgacctg

SEQ ID NO: 49801 - DNA, 25 bp, E. coli
ccatcacgacggtggagacgatcat

SEQ ID NO: 49802 - DNA, 25 bp, E. coli
ccatcacgacggaggagacgatcat

SEQ ID NO: 49803 - DNA, 25 bp, E. coli
gacacttacctgcatacggtgccga

SEQ ID NO: 49804 - DNA, 25 bp, E. coli
gacacttacctggatacggtgccga

SEQ ID NO: 49805 - DNA, 25 bp, E. coli
gaactgtgtctcagtgtgcccggtc

SEQ ID NO: 49806 - DNA, 25 bp, E. coli
gaactgtgtctctgtgtgcccggtc

SEQ ID NO: 49807 - DNA, 25 bp, E. coli
cgaaaaaacgtcaggcgctgaagcc

SEQ ID NO: 49808 - DNA, 25 bp, E. coli
cgaaaaaacgtctggcgctgaagcc

SEQ ID NO: 49809 - DNA, 25 bp, E. coli
caagccgaatgttatttcaggaact

SEQ ID NO: 49810 - DNA, 25 bp, E. coli
caagccgaatgtaatttcaggaact

SEQ ID NO: 49811 - DNA, 25 bp, E. coli
cagaagaaggcataaggaatcggat

SEQ ID NO: 49812 - DNA, 25 bp, E. coli
cagaagaaggcaaaaggaatcggat

SEQ ID NO: 49813 - DNA, 25 bp, E. coli
taaaagagtttattgaacaagccga

SEQ ID NO: 49814 - DNA, 25 bp, E. coli
taaaccactgtaaggtaaagcaaca

SEQ ID NO: 49815 - DNA, 25 bp, E. coli
taaaccactgtatggtaaagcaaca

SEQ ID NO: 49816 - DNA, 25 bp, E. coli
taaaagagtttaatgaacaagccga

SEQ ID NO: 49817 - DNA, 25 bp, E. coli
tttttacgatgagacagaagaaggc

SEQ ID NO: 49818 - DNA, 25 bp, E. coli
tttttacgatgacacagaagaaggc

SEQ ID NO: 49819 - DNA, 25 bp, E. coli
tcaggaactatatggacggattacg

SEQ ID NO: 49820 - DNA, 25 bp, E. coli
tcaggaactataaggacggattacg

SEQ ID NO: 49821 - DNA, 25 bp, E. coli
ccttcgtcagctatggattgtctat

SEQ ID NO: 49822 - DNA, 25 bp, E. coli
ccttcgtcagctttggattgtctat

SEQ ID NO: 49823 - DNA, 25 bp, E. coli
taaggtaaagcatcaccttcgtcag

SEQ ID NO: 49824 - DNA, 25 bp, E. coli
taaggtaaagcaacaccttcgtcag

SEQ ID NO: 49825 - DNA, 25 bp, E. coli
gattacggcggattgcaccagatga

SEQ ID NO: 49826 - DNA, 25 bp, E. coli
gattacggcggaatgcaccagatga

SEQ ID NO: 49827 - DNA, 25 bp, E. coli
gatttatggagaagtaaaccactgt

SEQ ID NO: 49828 - DNA, 25 bp, E. coli
gatttatggagatgtaaaccactgt

SEQ ID NO: 49829 - DNA, 25 bp, E. coli
gattgtctataactgtgtataccgc

SEQ ID NO: 49830 - DNA, 25 bp, E. coli
gattgtctataagtgtgtataccgc

SEQ ID NO: 49831 - DNA, 25 bp, E. coli
aagaaaaaatcattccggctggcgc

SEQ ID NO: 49832 - DNA, 25 bp, E. coli
aagaaaaaatcaatccggctggcgc

SEQ ID NO: 49833 - DNA, 25 bp, E. coli
taaacgccgcgtagttgttggcctg

SEQ ID NO: 49834 - DNA, 25 bp, E. coli
taaaagcgagctggtcaacgttgcg

SEQ ID NO: 49835 - DNA, 25 bp, E. coli
taaacgccgcgttgttgttggcctg

SEQ ID NO: 49836 - DNA, 25 bp, E. coli
taaaagcgagctcgtcaacgttgcg

SEQ ID NO: 49837 - DNA, 25 bp, E. coli
aaaaacaagctcaggaactgccgcg

SEQ ID NO: 49838 - DNA, 25 bp, E. coli
aaaaacaagctctggaactgccgcg

SEQ ID NO: 49839 - DNA, 25 bp, E. coli
tgttcgaagaacaggctaaacgccg

SEQ ID NO: 49840 - DNA, 25 bp, E. coli
tgttcgaagaactggctaaacgccg

SEQ ID NO: 49841 - DNA, 25 bp, E. coli
tgacggcttccggaaaggcaaagtg

SEQ ID NO: 49842 - DNA, 25 bp, E. coli
tgacggcttccgcaaaggcaaagtg

SEQ ID NO: 49843 - DNA, 25 bp, E. coli
cctggaaagaaatagacggcgctgt

SEQ ID NO: 49844 - DNA, 25 bp, E. coli
cctggaaagaaaaagacggcgctgt

SEQ ID NO: 49845 - DNA, 25 bp, E. coli
gaagttatccgcaccaacgagctga

SEQ ID NO: 49846 - DNA, 25 bp, E. coli
gaagttatccgctccaacgagctga

SEQ ID NO: 49847 - DNA, 25 bp, E. coli
gaaaaaccgatccttgaagtgaccg

SEQ ID NO: 49848 - DNA, 25 bp, E. coli
gacggtatcaaaggccacaaagctg

SEQ ID NO: 49849 - DNA, 25 bp, E. coli
gaaaaaccgatcgttgaagtgaccg

SEQ ID NO: 49850 - DNA, 25 bp, E. coli
gacggtatcaaacgccacaaagctg

SEQ ID NO: 49851 - DNA, 25 bp, E. coli
cgtaaaaacatggagcgcgagctga

SEQ ID NO: 49852 - DNA, 25 bp, E. coli
cgtaaaaacatgcagcgcgagctga

SEQ ID NO: 49853 - DNA, 25 bp, E. coli
cactatttatgtttccggcggcaag

SEQ ID NO: 49854 - DNA, 25 bp, E. coli
cactatttatgtatccggcggcaag

SEQ ID NO: 49855 - DNA, 25 bp, E. coli
aaattaggtttgaatccggatcagg

SEQ ID NO: 49856 - DNA, 25 bp, E. coli
aaattaggtttgtatccggatcagg

SEQ ID NO: 49857 - DNA, 25 bp, E. coli
aaaagtagcaaatgcgctgggtgcc

SEQ ID NO: 49858 - DNA, 25 bp, E. coli
aaaagtagcaaaagcgctgggtgcc

SEQ ID NO: 49859 - DNA, 25 bp, E. coli
ttacgccggtcggaggtcaactgga

SEQ ID NO: 49860 - DNA, 25 bp, E. coli
tttcaaatccattcctacgagcacg

SEQ ID NO: 49861 - DNA, 25 bp, E. coli
ttacgccggtcgcaggtcaactgga

SEQ ID NO: 49862 - DNA, 25 bp, E. coli
tttcaaatccatacctacgagcacg

SEQ ID NO: 49863 - DNA, 25 bp, E. coli
ccaattttggcgatgaagtcgtcaa

SEQ ID NO: 49864 - DNA, 25 bp, E. coli
ccaattttggcgttgaagtcgtcaa

SEQ ID NO: 49865 - DNA, 25 bp, E. coli
ccaagaaagttgtgatggccgatcc

SEQ ID NO: 49866 - DNA, 25 bp, E. coli
ccaagaaagttgagatggccgatcc

SEQ ID NO: 49867 - DNA, 25 bp, E. coli
gatcaggtctacaaaacgctgctgg

SEQ ID NO: 49868 - DNA, 25 bp, E. coli
gatatgaaacaccttgccgtggccg

SEQ ID NO: 49869 - DNA, 25 bp, E. coli
gatcaggtctactaaacgctgctgg

SEQ ID NO: 49870 - DNA, 25 bp, E. coli
gatatgaaacacgttgccgtggccg

SEQ ID NO: 49871 - DNA, 25 bp, E. coli
gatccggctgaatccaattttggcg

SEQ ID NO: 49872 - DNA, 25 bp, E. coli
gatgccaaatttcctgatatcgccc

SEQ ID NO: 49873 - DNA, 25 bp, E. coli
gatccggctgaaaccaattttggcg

SEQ ID NO: 49874 - DNA, 25 bp, E. coli
gatgccaaatttgctgatatcgccc

SEQ ID NO: 49875 - DNA, 25 bp, E. coli
caacctgtcgtaatgtggtcataaa

SEQ ID NO: 49876 - DNA, 25 bp, E. coli
caacctgtcgtattgtggtcataaa

SEQ ID NO: 49877 - DNA, 25 bp, E. coli
caccgcgagcgcgaaataattttat

SEQ ID NO: 49878 - DNA, 25 bp, E. coli
caaaatatcgtcgtagctgcactcg

SEQ ID NO: 49879 - DNA, 25 bp, E. coli
caaaatatcgtcctagctgcactcg

SEQ ID NO: 49880 - DNA, 25 bp, E. coli
caccgcgagcgccaaataattttat

SEQ ID NO: 49881 - DNA, 25 bp, E. coli
cataaaaaattgacggctggaggga

SEQ ID NO: 49882 - DNA, 25 bp, E. coli
cataaaaaattgtcggctggaggga

SEQ ID NO: 49883 - DNA, 25 bp, E. coli
taaaatcctgtaacaagtgctgaaa

SEQ ID NO: 49884 - DNA, 25 bp, E. coli
taaaatgcgagtttatagcaccgcg

SEQ ID NO: 49885 - DNA, 25 bp, E. coli
taaaatgcgagtatatagcaccgcg

SEQ ID NO: 49886 - DNA, 25 bp, E. coli
taaaatcctgtatcaagtgctgaaa

SEQ ID NO: 49887 - DNA, 25 bp, E. coli
ttcgtggtaatcagagagagtcgcg

SEQ ID NO: 49888 - DNA, 25 bp, E. coli
ttacaactgtaacaagcgccggtga

SEQ ID NO: 49889 - DNA, 25 bp, E. coli
ttacaactgtaagaagcgccggtga

SEQ ID NO: 49890 - DNA, 25 bp, E. coli
ttacctcaatatactgcctgtcagc

SEQ ID NO: 49891 - DNA, 25 bp, E. coli
ttacctcaatattctgcctgtcagc

SEQ ID NO: 49892 - DNA, 25 bp, E. coli
ttcgtggtaatctgagagagtcgcg

SEQ ID NO: 49893 - DNA, 25 bp, E. coli
tctgcatggtaagtagtgaggacga

SEQ ID NO: 49894 - DNA, 25 bp, E. coli
tctgcatggtaactagtgaggacga

SEQ ID NO: 49895 - DNA, 25 bp, E. coli
gcgccggtgatttacaagcaagggt

SEQ ID NO: 49896 - DNA, 25 bp, E. coli
gcgccggtgattaacaagcaagggt

SEQ ID NO: 49897 - DNA, 25 bp, E. coli
caaaccatgctgtttaatgaaaaga

SEQ ID NO: 49898 - DNA, 25 bp, E. coli
caaaccatgctgattaatgaaaaga

SEQ ID NO: 49899 - DNA, 25 bp, E. coli
caggagatggtcaacttcctgttcg

SEQ ID NO: 49900 - DNA, 25 bp, E. coli
caggagatggtctacttcctgttcg

SEQ ID NO: 49901 - DNA, 25 bp, E. coli
aggattttcagcagtaccccggcga

SEQ ID NO: 49902 - DNA, 25 bp, E. coli
aggattttcagctgtaccccggcga

SEQ ID NO: 49903 - DNA, 25 bp, E. coli
tgtactttcctgcaacgtgaagcag

SEQ ID NO: 49904 - DNA, 25 bp, E. coli
tgtactttcctggaacgtgaagcag

SEQ ID NO: 49905 - DNA, 25 bp, E. coli
tcctgttcgaggctaaagaggtgca

SEQ ID NO: 49906 - DNA, 25 bp, E. coli
tcctgttcgagggtaaagaggtgca

SEQ ID NO: 49907 - DNA, 25 bp, E. coli
tccaaagaagcctgggcgcagtggc

SEQ ID NO: 49908 - DNA, 25 bp, E. coli
tccaaagaagccagggcgcagtggc

SEQ ID NO: 49909 - DNA, 25 bp, E. coli
tctataacgagatctccaaagaagc

SEQ ID NO: 49910 - DNA, 25 bp, E. coli
tctataacgagaactccaaagaagc

SEQ ID NO: 49911 - DNA, 25 bp, E. coli
gaacgattttttgtactttcctgca

SEQ ID NO: 49912 - DNA, 25 bp, E. coli
gaacgattttttctactttcctgca

SEQ ID NO: 49913 - DNA, 25 bp, E. coli
cgtgaagcagaaggtcaggattttc

SEQ ID NO: 49914 - DNA, 25 bp, E. coli
ctgggaaaacgcttctataacgaga

SEQ ID NO: 49915 - DNA, 25 bp, E. coli
cgtgaagcagaacgtcaggattttc

SEQ ID NO: 49916 - DNA, 25 bp, E. coli
ctgggaaaacgcatctataacgaga

SEQ ID NO: 49917 - DNA, 25 bp, E. coli
tcaacatgatgattgccgagcaccg

SEQ ID NO: 49918 - DNA, 25 bp, E. coli
tcaacatgatgaatgccgagcaccg

SEQ ID NO: 49919 - DNA, 25 bp, E. coli
agcgacgcggatacgtaccacctgg

SEQ ID NO: 49920 - DNA, 25 bp, E. coli
agcgacgcggattcgtaccacctgg

SEQ ID NO: 49921 - DNA, 25 bp, E. coli
atcccgacaacaacaaccgcccctg

SEQ ID NO: 49922 - DNA, 25 bp, E. coli
atcccgacaacatcaaccgcccctg

SEQ ID NO: 49923 - DNA, 25 bp, E. coli
aactgatttcagtgaggactttatc

SEQ ID NO: 49924 - DNA, 25 bp, E. coli
aactgatttcagagaggactttatc

SEQ ID NO: 49925 - DNA, 25 bp, E. coli
acaacgcatccccacaacaacaacc

SEQ ID NO: 49926 - DNA, 25 bp, E. coli
acaacgcatcccgacaacaacaacc

SEQ ID NO: 49927 - DNA, 25 bp, E. coli
tatcgtgtcagacacactgcccggg

SEQ ID NO: 49928 - DNA, 25 bp, E. coli
tatcgtgtcagagacactgcccggg

SEQ ID NO: 49929 - DNA, 25 bp, E. coli
tcagcgacgcggtttcgtaccacct

SEQ ID NO: 49930 - DNA, 25 bp, E. coli
tcagcgacgcggattcgtaccacct

SEQ ID NO: 49931 - DNA, 25 bp, E. coli
gcgacgcggattcgtaccacctgga

SEQ ID NO: 49932 - DNA, 25 bp, E. coli
gctcaccagtggagaactcagccct

SEQ ID NO: 49933 - DNA, 25 bp, E. coli
gctcaccagtggtgaactcagccct

SEQ ID NO: 49934 - DNA, 25 bp, E. coli
gcgacgcggattggtaccacctgga

SEQ ID NO: 49935 - DNA, 25 bp, E. coli
gaactcagccctcgctatcagcata

SEQ ID NO: 49936 - DNA, 25 bp, E. coli
gacgcggattcgtaccacctggacc

SEQ ID NO: 49937 - DNA, 25 bp, E. coli
gaactcagccctggctatcagcata

SEQ ID NO: 49938 - DNA, 25 bp, E. coli
cgaattatcgccaccatcgaactat

SEQ ID NO: 49939 - DNA, 25 bp, E. coli
cgaattatcgcctccatcgaactat

SEQ ID NO: 49940 - DNA, 25 bp, E. coli
gacgcggattcgaaccacctggacc

SEQ ID NO: 49941 - DNA, 25 bp, E. coli
aattattgaccacttcctcaccgcg

SEQ ID NO: 49942 - DNA, 25 bp, E. coli
aattattgaccagttcctcaccgcg

SEQ ID NO: 49943 - DNA, 25 bp, E. coli
catggcgctcattaatctggtatac

SEQ ID NO: 49944 - DNA, 25 bp, E. coli
catggcgctcataaatctggtatac

SEQ ID NO: 49945 - DNA, 25 bp, E. coli
taaaaatcaggctacatgggtgcta

SEQ ID NO: 49946 - DNA, 25 bp, E. coli
taaaaatcaggcaacatgggtgcta

SEQ ID NO: 49947 - DNA, 25 bp, E. coli
tatcacatccgacacaaatgttgcc

SEQ ID NO: 49948 - DNA, 25 bp, E. coli
tatcacatccgagacaaatgttgcc

SEQ ID NO: 49949 - DNA, 25 bp, E. coli
ttgcttaatcgattaaaaatcaggc

SEQ ID NO: 49950 - DNA, 25 bp, E. coli
ttgcttaatcgaataaaaatcaggc

SEQ ID NO: 49951 - DNA, 25 bp, E. coli
tccggcggcgcgtatgaacatctta

SEQ ID NO: 49952 - DNA, 25 bp, E. coli
tccggcggcgcgaatgaacatctta

SEQ ID NO: 49953 - DNA, 25 bp, E. coli
tctttaacgataacgccattgaggc

SEQ ID NO: 49954 - DNA, 25 bp, E. coli
tctttaacgatatcgccattgaggc

SEQ ID NO: 49955 - DNA, 25 bp, E. coli
ccattgaggctggtcatggcgctca

SEQ ID NO: 49956 - DNA, 25 bp, E. coli
ccattgaggctgctcatggcgctca

SEQ ID NO: 49957 - DNA, 25 bp, E. coli
gctacatgggtggtaaatctttaac

SEQ ID NO: 49958 - DNA, 25 bp, E. coli
gctacatgggtgctaaatctttaac

SEQ ID NO: 49959 - DNA, 25 bp, E. coli
gaacatcttattggctatcacatcc

SEQ ID NO: 49960 - DNA, 25 bp, E. coli
gaacatcttattcgctatcacatcc

SEQ ID NO: 49961 - DNA, 25 bp, E. coli
gttgccatcccaatgcttaatcgaa

SEQ ID NO: 49962 - DNA, 25 bp, E. coli
gttgccatcccattgcttaatcgaa

SEQ ID NO: 49963 - DNA, 25 bp, E. coli
caggctccgcaagcgttgaaaaagg

SEQ ID NO: 49964 - DNA, 25 bp, E. coli
caggctccgcaaccgttgaaaaagg

SEQ ID NO: 49965 - DNA, 25 bp, E. coli
agtcaggctccggaaccgttgaaaa

SEQ ID NO: 49966 - DNA, 25 bp, E. coli
agtagtcaggctgcgcaaccgttga

SEQ ID NO: 49967 - DNA, 25 bp, E. coli
atcttcgctgtcattgttggcggtt

SEQ ID NO: 49968 - DNA, 25 bp, E. coli
agtagtcaggctccgcaaccgttga

SEQ ID NO: 49969 - DNA, 25 bp, E. coli
agtcaggctccgcaaccgttgaaaa

SEQ ID NO: 49970 - DNA, 25 bp, E. coli
atcttcgctgtctttgttggcggtt

SEQ ID NO: 49971 - DNA, 25 bp, E. coli
tgtcgcgcgtcaatcctctatcttc

SEQ ID NO: 49972 - DNA, 25 bp, E. coli
tgtcgcgcgtcattcctctatcttc

SEQ ID NO: 49973 - DNA, 25 bp, E. coli
cctctatcttcgctgtcattgttgg

SEQ ID NO: 49974 - DNA, 25 bp, E. coli
cctctatcttcggtgtcattgttgg

SEQ ID NO: 49975 - DNA, 25 bp, E. coli
gcgcgtcaatcctctatcttcgctg

SEQ ID NO: 49976 - DNA, 25 bp, E. coli
gcgcgtcaatccactatcttcgctg

SEQ ID NO: 49977 - DNA, 25 bp, E. coli
ctatcttcgctgtcattgttggcgg

SEQ ID NO: 49978 - DNA, 25 bp, E. coli
ctatcttcgctgacattgttggcgg

SEQ ID NO: 49979 - DNA, 25 bp, E. coli
gtcaatcctctatcttcgctgtcat

SEQ ID NO: 49980 - DNA, 25 bp, E. coli
gtcaatcctctaacttcgctgtcat

SEQ ID NO: 49981 - DNA, 25 bp, E. coli
ggtgtagtagtctggctccgcaacc

SEQ ID NO: 49982 - DNA, 25 bp, E. coli
ggtgtagtagtcaggctccgcaacc

SEQ ID NO: 49983 - DNA, 25 bp, E. coli
gtagtagtcaggctccgcaaccgtt

SEQ ID NO: 49984 - DNA, 25 bp, E. coli
gtagtagtcagggtccgcaaccgtt

SEQ ID NO: 49985 - DNA, 25 bp, E. coli
tatgaaatgcgctggttaaaccgtg

SEQ ID NO: 49986 - DNA, 25 bp, E. coli
tatgaaatgcgcaggttaaaccgtg

SEQ ID NO: 49987 - DNA, 25 bp, E. coli
ttcctctgcaatgggttcgagccgg

SEQ ID NO: 49988 - DNA, 25 bp, E. coli
tttttgctgtgaacgcgctgagtac

SEQ ID NO: 49989 - DNA, 25 bp, E. coli
tttttgctgtgatcgcgctgagtac

SEQ ID NO: 49990 - DNA, 25 bp, E. coli
ttcctctgcaatcggttcgagccgg

SEQ ID NO: 49991 - DNA, 25 bp, E. coli
tgttttttgtccgtgccgtggtggc

SEQ ID NO: 49992 - DNA, 25 bp, E. coli
tgttttttgtccctgccgtggtggc

SEQ ID NO: 49993 - DNA, 25 bp, E. coli
tgcacaactattactggtggatggc

SEQ ID NO: 49994 - DNA, 25 bp, E. coli
tgcacaactatttctggtggatggc

SEQ ID NO: 49995 - DNA, 25 bp, E. coli
tgcgcagtatctggtctcctggctg

SEQ ID NO: 49996 - DNA, 25 bp, E. coli
tgcgcagtatctcgtctcctggctg

SEQ ID NO: 49997 - DNA, 25 bp, E. coli
gccgtagtgcaatctatccaggtat

SEQ ID NO: 49998 - DNA, 25 bp, E. coli
gccgtagtgcaaactatccaggtat

SEQ ID NO: 49999 - DNA, 25 bp, E. coli
gcacgactgcctgggtagtggaaaa

SEQ ID NO: 50000 - DNA, 25 bp, E. coli
gcacgactgcctcggtagtggaaaa

SEQ ID NO: 50001 - DNA, 25 bp, E. coli
gaaaaagtctatggctatgaaatgc

SEQ ID NO: 50002 - DNA, 25 bp, E. coli
gaaaaagtctatcgctatgaaatgc

SEQ ID NO: 50003 - DNA, 25 bp, E. coli
tggctattggccgaaatgttgctgt

SEQ ID NO: 50004 - DNA, 25 bp, E. coli
tggctattggcccaaatgttgctgt

SEQ ID NO: 50005 - DNA, 25 bp, E. coli
gatgatcctgatcctggcgctgatt

SEQ ID NO: 50006 - DNA, 25 bp, E. coli
gatgatcctgatgctggcgctgatt

SEQ ID NO: 50007 - DNA, 25 bp, E. coli
cagtgtcttgatggtaatccttatg

SEQ ID NO: 50008 - DNA, 25 bp, E. coli
cagtgtcttgatcgtaatccttatg

SEQ ID NO: 50009 - DNA, 25 bp, E. coli
aacatttggtgccttaccgttagat

SEQ ID NO: 50010 - DNA, 25 bp, E. coli
aacatttggtgcgttaccgttagat

SEQ ID NO: 50011 - DNA, 25 bp, E. coli
tatatgcacttagaggtttggctcg

SEQ ID NO: 50012 - DNA, 25 bp, E. coli
tatgttttctttatccgccgtcgca

SEQ ID NO: 50013 - DNA, 25 bp, E. coli
tatatgcacttacaggtttggctcg

SEQ ID NO: 50014 - DNA, 25 bp, E. coli
tatgttttctttttccgccgtcgca

SEQ ID NO: 50015 - DNA, 25 bp, E. coli
ttggctcgaatataaggtaaaacat

SEQ ID NO: 50016 - DNA, 25 bp, E. coli
ttggctcgaataaaaggtaaaacat

SEQ ID NO: 50017 - DNA, 25 bp, E. coli
tgatgccgcccctgggttaaaaaag

SEQ ID NO: 50018 - DNA, 25 bp, E. coli
tgatgccgccccagggttaaaaaag

SEQ ID NO: 50019 - DNA, 25 bp, E. coli
tccgccgtcgcattgccttttaaaa

SEQ ID NO: 50020 - DNA, 25 bp, E. coli
tccgccgtcgcaatgccttttaaaa

SEQ ID NO: 50021 - DNA, 25 bp, E. coli
gccttttaaaactattgaacgtgag

SEQ ID NO: 50022 - DNA, 25 bp, E. coli
gccttttaaaacaattgaacgtgag

SEQ ID NO: 50023 - DNA, 25 bp, E. coli
cattttggctagataatgatgccgc

SEQ ID NO: 50024 - DNA, 25 bp, E. coli
cattttggctagttaatgatgccgc

SEQ ID NO: 50025 - DNA, 25 bp, E. coli
gggatgtcactaaggctgcatttga

SEQ ID NO: 50026 - DNA, 25 bp, E. coli
gggatgtcactatggctgcatttga

SEQ ID NO: 50027 - DNA, 25 bp, E. coli
ggccatttaatactgatgaggttca

SEQ ID NO: 50028 - DNA, 25 bp, E. coli
ggccatttaatagtgatgaggttca

SEQ ID NO: 50029 - DNA, 25 bp, E. coli
tatgctgcagcaaattatatcaagg

SEQ ID NO: 50030 - DNA, 25 bp, E. coli
tatgctgcagcatattatatcaagg

SEQ ID NO: 50031 - DNA, 25 bp, E. coli
tttcgtgatgaagtggtgaaggcca

SEQ ID NO: 50032 - DNA, 25 bp, E. coli
tttcgtgatgaactggtgaaggcca

SEQ ID NO: 50033 - DNA, 25 bp, E. coli
tgctgatgggactgtgacacggatc

SEQ ID NO: 50034 - DNA, 25 bp, E. coli
tgctgatgggacagtgacacggatc

SEQ ID NO: 50035 - DNA, 25 bp, E. coli
ccatggcgaaatggcgatttgaaaa

SEQ ID NO: 50036 - DNA, 25 bp, E. coli
ccatggcgaaatcgcgatttgaaaa

SEQ ID NO: 50037 - DNA, 25 bp, E. coli
gctcagagcctcataatttgtttcg

SEQ ID NO: 50038 - DNA, 25 bp, E. coli
gctcagagcctcttaatttgtttcg

SEQ ID NO: 50039 - DNA, 25 bp, E. coli
gacaatttatctatacgccgtcacg

SEQ ID NO: 50040 - DNA, 25 bp, E. coli
gacaatttatctttacgccgtcacg

SEQ ID NO: 50041 - DNA, 25 bp, E. coli
cccctgtcagggagtgaagagacaa

SEQ ID NO: 50042 - DNA, 25 bp, E. coli
cccctgtcagggtgtgaagagacaa

SEQ ID NO: 50043 - DNA, 25 bp, E. coli
gatttgaaaagaatcgcccctgtca

SEQ ID NO: 50044 - DNA, 25 bp, E. coli
gatttgaaaagattcgcccctgtca

SEQ ID NO: 50045 - DNA, 25 bp, E. coli
ggatatattgtctgaataagacccg

SEQ ID NO: 50046 - DNA, 25 bp, E. coli
ggatatattgtcagaataagacccg

SEQ ID NO: 50047 - DNA, 25 bp, E. coli
ggatcgtttttcaccgctcagagcc

SEQ ID NO: 50048 - DNA, 25 bp, E. coli
ggatcgtttttctccgctcagagcc

SEQ ID NO: 50049 - DNA, 25 bp, E. coli
ggcagtctggaagacaggatatatt

SEQ ID NO: 50050 - DNA, 25 bp, E. coli
ggcagtctggaacacaggatatatt

SEQ ID NO: 50051 - DNA, 25 bp, E. coli
caaaattgttttgtcccgtgcgtgc

SEQ ID NO: 50052 - DNA, 25 bp, E. coli
caaaattgttttctcccgtgcgtgc

SEQ ID NO: 50053 - DNA, 25 bp, E. coli
attcggcgcgccgaaacacgggacg

SEQ ID NO: 50054 - DNA, 25 bp, E. coli
attcggcgcgcccaaacacgggacg

SEQ ID NO: 50055 - DNA, 25 bp, E. coli
tacccgtcgttgagatattgcccgt

SEQ ID NO: 50056 - DNA, 25 bp, E. coli
tacccgtcgttgtgatattgcccgt

SEQ ID NO: 50057 - DNA, 25 bp, E. coli
ttaatgacgactttaatggcgaatg

SEQ ID NO: 50058 - DNA, 25 bp, E. coli
tattacccgtcgatgtgatattgcc

SEQ ID NO: 50059 - DNA, 25 bp, E. coli
tattacccgtcgttgtgatattgcc

SEQ ID NO: 50060 - DNA, 25 bp, E. coli
ttaatgacgactataatggcgaatg

SEQ ID NO: 50061 - DNA, 25 bp, E. coli
ttctcccgtgcgtgcagcgagccga

SEQ ID NO: 50062 - DNA, 25 bp, E. coli
ttctcccgtgcgagcagcgagccga

SEQ ID NO: 50063 - DNA, 25 bp, E. coli
tgtcttaaccccattggcgctgacg

SEQ ID NO: 50064 - DNA, 25 bp, E. coli
tgttttctcccgtgcgtgcagcgag

SEQ ID NO: 50065 - DNA, 25 bp, E. coli
tgtcttaacccctttggcgctgacg

SEQ ID NO: 50066 - DNA, 25 bp, E. coli
tgttttctcccgagcgtgcagcgag

SEQ ID NO: 50067 - DNA, 25 bp, E. coli
gacggaagtggtagatttccgcgcc

SEQ ID NO: 50068 - DNA, 25 bp, E. coli
gacggaagtggttgatttccgcgcc

SEQ ID NO: 50069 - DNA, 25 bp, E. coli
ccccattggcgcagacgtaggtaaa

SEQ ID NO: 50070 - DNA, 25 bp, E. coli
ccccattggcgctgacgtaggtaaa

SEQ ID NO: 50071 - DNA, 25 bp, E. coli
gatttctgtcttaaccccattggcg

SEQ ID NO: 50072 - DNA, 25 bp, E. coli
gatttctgtctttaccccattggcg

SEQ ID NO: 50073 - DNA, 25 bp, E. coli
agcaaaaacgatttccaggtcgtcg

SEQ ID NO: 50074 - DNA, 25 bp, E. coli
agcaaaaacgatatccaggtcgtcg

SEQ ID NO: 50075 - DNA, 25 bp, E. coli
gaggttagttatgtttttagtatca

SEQ ID NO: 50076 - DNA, 25 bp, E. coli
aggtcgtcggttaaccatgaagtgc

SEQ ID NO: 50077 - DNA, 25 bp, E. coli
aggtcgtcggtttaccatgaagtgc

SEQ ID NO: 50078 - DNA, 25 bp, E. coli
gaggttagttatctttttagtatca

SEQ ID NO: 50079 - DNA, 25 bp, E. coli
tttccaggtcgtcggttaaccatga

SEQ ID NO: 50080 - DNA, 25 bp, E. coli
tttccaggtcgtgggttaaccatga

SEQ ID NO: 50081 - DNA, 25 bp, E. coli
tgaaagcaaaaacgatttccaggtc

SEQ ID NO: 50082 - DNA, 25 bp, E. coli
tgaaagcaaaaaggatttccaggtc

SEQ ID NO: 50083 - DNA, 25 bp, E. coli
tccaggtcgtcggttaaccatgaag

SEQ ID NO: 50084 - DNA, 25 bp, E. coli
tccaggtcgtcgcttaaccatgaag

SEQ ID NO: 50085 - DNA, 25 bp, E. coli
gcaaaaacgattaccaggtcgtcgg

SEQ ID NO: 50086 - DNA, 25 bp, E. coli
gcaaaaacgatttccaggtcgtcgg

SEQ ID NO: 50087 - DNA, 25 bp, E. coli
ccaggtcgtcggttaaccatgaagt

SEQ ID NO: 50088 - DNA, 25 bp, E. coli
ccaggtcgtcggataaccatgaagt

SEQ ID NO: 50089 - DNA, 25 bp, E. coli
gaaagcaaaaaccatttccaggtcg

SEQ ID NO: 50090 - DNA, 25 bp, E. coli
gaaagcaaaaacgatttccaggtcg

SEQ ID NO: 50091 - DNA, 25 bp, E. coli
gaggcgaggttagttatgtttttag

SEQ ID NO: 50092 - DNA, 25 bp, E. coli
gaggcgaggttacttatgtttttag

SEQ ID NO: 50093 - DNA, 25 bp, E. coli
gatttccaggtcctcggttaaccat

SEQ ID NO: 50094 - DNA, 25 bp, E. coli
gatttccaggtcgtcggttaaccat

SEQ ID NO: 50095 - DNA, 25 bp, E. coli
agcccacttatcagacgccagctga

SEQ ID NO: 50096 - DNA, 25 bp, E. coli
agcccacttatctgacgccagctga

SEQ ID NO: 50097 - DNA, 25 bp, E. coli
ttttactgcgcgcactacgccaggc

SEQ ID NO: 50098 - DNA, 25 bp, E. coli
ttttactgcgcggactacgccaggc

SEQ ID NO: 50099 - DNA, 25 bp, E. coli
tcttaaaggccacaaagttgcgttc

SEQ ID NO: 50100 - DNA, 25 bp, E. coli
tcttaaaggccagaaagttgcgttc

SEQ ID NO: 50101 - DNA, 25 bp, E. coli
tgacatccagcccacttatctgacg

SEQ ID NO: 50102 - DNA, 25 bp, E. coli
tgacatccagccgacttatctgacg

SEQ ID NO: 50103 - DNA, 25 bp, E. coli
tctacgattgtggttgctgcagaat

SEQ ID NO: 50104 - DNA, 25 bp, E. coli
tctacgattgtgcttgctgcagaat

SEQ ID NO: 50105 - DNA, 25 bp, E. coli
ccacaaagttgccttccagaaaggt

SEQ ID NO: 50106 - DNA, 25 bp, E. coli
gccgaagccaaaagccgaggtgatt

SEQ ID NO: 50107 - DNA, 25 bp, E. coli
gccgaagccaaatgccgaggtgatt

SEQ ID NO: 50108 - DNA, 25 bp, E. coli
ccacaaagttgcgttccagaaaggt

SEQ ID NO: 50109 - DNA, 25 bp, E. coli
gcttagcgtctcaacgattgtggtt

SEQ ID NO: 50110 - DNA, 25 bp, E. coli
gcttagcgtctctacgattgtggtt

SEQ ID NO: 50111 - DNA, 25 bp, E. coli
gcaaatgcttgaggcgttaaacgtt

SEQ ID NO: 50112 - DNA, 25 bp, E. coli
gcaaatgcttgacgcgttaaacgtt

SEQ ID NO: 50113 - DNA, 25 bp, E. coli
gacttaagtttagtgacatccagcc

SEQ ID NO: 50114 - DNA, 25 bp, E. coli
gacttaagtttactgacatccagcc

SEQ ID NO: 50115 - DNA, 25 bp, E. coli
ccgctggcccgcaaatgcttgaggc

SEQ ID NO: 50116 - DNA, 25 bp, E. coli
ccgctggcccgctaatgcttgaggc

SEQ ID NO: 50117 - DNA, 25 bp, E. coli
ctaaaccgtttgatatgccaatggc

SEQ ID NO: 50118 - DNA, 25 bp, E. coli
cattacattcgcgacagctggcgca

SEQ ID NO: 50119 - DNA, 25 bp, E. coli
catcatcacaggtgcgggtgcaggt

SEQ ID NO: 50120 - DNA, 25 bp, E. coli
catcatcacaggagcgggtgcaggt

SEQ ID NO: 50121 - DNA, 25 bp, E. coli
ctaaaccgtttgttatgccaatggc

SEQ ID NO: 50122 - DNA, 25 bp, E. coli
aaattcaacaacagggtggtcaggc

SEQ ID NO: 50123 - DNA, 25 bp, E. coli
aaattcaacaactgggtggtcaggc

SEQ ID NO: 50124 - DNA, 25 bp, E. coli
tatgcatcatctaaagctgcggcca

SEQ ID NO: 50125 - DNA, 25 bp, E. coli
tatgcatcatcttaagctgcggcca

SEQ ID NO: 50126 - DNA, 25 bp, E. coli
tgcaggtattggtaaagaaatcgcc

SEQ ID NO: 50127 - DNA, 25 bp, E. coli
tgcaggtattggaaaagaaatcgcc

SEQ ID NO: 50128 - DNA, 25 bp, E. coli
cctgagactcgagggaaaatgcgcc

SEQ ID NO: 50129 - DNA, 25 bp, E. coli
cctgagactcgacggaaaatgcgcc

SEQ ID NO: 50130 - DNA, 25 bp, E. coli
gctgggtaagcgcacaaattctcac

SEQ ID NO: 50131 - DNA, 25 bp, E. coli
gctgggtaagcggacaaattctcac

SEQ ID NO: 50132 - DNA, 25 bp, E. coli
gacgtctgggcctaccgcaagatat

SEQ ID NO: 50133 - DNA, 25 bp, E. coli
gacgtctgggccaaccgcaagatat

SEQ ID NO: 50134 - DNA, 25 bp, E. coli
cgaacaggaactctctgcactggca

SEQ ID NO: 50135 - DNA, 25 bp, E. coli
cgaacaggaactgtctgcactggca

SEQ ID NO: 50136 - DNA, 25 bp, E. coli
cattacattcgccacagctggcgca

SEQ ID NO: 50137 - DNA, 25 bp, E. coli
tcacaacttgttccgccagaaatgg

SEQ ID NO: 50138 - DNA, 25 bp, E. coli
tcacaacttgttgcgccagaaatgg

SEQ ID NO: 50139 - DNA, 25 bp, E. coli
taaaatggcgtggttcgccaaccag

SEQ ID NO: 50140 - DNA, 25 bp, E. coli
taaaatggcgtgcttcgccaaccag

SEQ ID NO: 50141 - DNA, 25 bp, E. coli
agatccagattcaggcggcgtttgc

SEQ ID NO: 50142 - DNA, 25 bp, E. coli
agtttggcggcggttatcagcagca

SEQ ID NO: 50143 - DNA, 25 bp, E. coli
agatccagattctggcggcgtttgc

SEQ ID NO: 50144 - DNA, 25 bp, E. coli
agtttggcggcgcttatcagcagca

SEQ ID NO: 50145 - DNA, 25 bp, E. coli
aaatcagacaataacccgctgcgcg

SEQ ID NO: 50146 - DNA, 25 bp, E. coli
aaatcagacaattacccgctgcgcg

SEQ ID NO: 50147 - DNA, 25 bp, E. coli
aaaatcattggcgtggccgtggcct

SEQ ID NO: 50148 - DNA, 25 bp, E. coli
aaaatcattggcctggccgtggcct

SEQ ID NO: 50149 - DNA, 25 bp, E. coli
tatgtttgataatgcccgtagccgt

SEQ ID NO: 50150 - DNA, 25 bp, E. coli
tatgtttgataaagcccgtagccgt

SEQ ID NO: 50151 - DNA, 25 bp, E. coli
taccgtaagctgatgagtgaacacc

SEQ ID NO: 50152 - DNA, 25 bp, E. coli
taccgtaagctgttgagtgaacacc

SEQ ID NO: 50153 - DNA, 25 bp, E. coli
cctgtaatgtgctgggcgtgaagcc

SEQ ID NO: 50154 - DNA, 25 bp, E. coli
gccagccagttgatggaccgaatga

SEQ ID NO: 50155 - DNA, 25 bp, E. coli
gccagccagttgttggaccgaatga

SEQ ID NO: 50156 - DNA, 25 bp, E. coli
cctgtaatgtgcagggcgtgaagcc

SEQ ID NO: 50157 - DNA, 25 bp, E. coli
gaaaagatgcgcgagtttcgcagtg

SEQ ID NO: 50158 - DNA, 25 bp, E. coli
gaaaagatgcgccagtttcgcagtg

SEQ ID NO: 50159 - DNA, 25 bp, E. coli
ccaaatccaaaggtcgcgtcacgga

SEQ ID NO: 50160 - DNA, 25 bp, E. coli
ccaaatccaaagctcgcgtcacgga

SEQ ID NO: 50161 - DNA, 25 bp, E. coli
tacgcagtttcatgaccaggtggtc

SEQ ID NO: 50162 - DNA, 25 bp, E. coli
tacgcagtttcaagaccaggtggtc

SEQ ID NO: 50163 - DNA, 25 bp, E. coli
tggtaaaaccttcccaggctgtggc

SEQ ID NO: 50164 - DNA, 25 bp, E. coli
tggtaaaaccttgccaggctgtggc

SEQ ID NO: 50165 - DNA, 25 bp, E. coli
tgagacttaacagcagccaggtagc

SEQ ID NO: 50166 - DNA, 25 bp, E. coli
tgagacttaacaccagccaggtagc

SEQ ID NO: 50167 - DNA, 25 bp, E. coli
gccaggtagccgtagtaagtccact

SEQ ID NO: 50168 - DNA, 25 bp, E. coli
gccaggtagccgaagtaagtccact

SEQ ID NO: 50169 - DNA, 25 bp, E. coli
gatttacggcaacgcaggatgtccg

SEQ ID NO: 50170 - DNA, 25 bp, E. coli
gataagagcacgtttcagcggagct

SEQ ID NO: 50171 - DNA, 25 bp, E. coli
gatagattcggttgcccagatcggg

SEQ ID NO: 50172 - DNA, 25 bp, E. coli
gatagattcggtagcccagatcggg

SEQ ID NO: 50173 - DNA, 25 bp, E. coli
gatcattttgattccaccgaacggg

SEQ ID NO: 50174 - DNA, 25 bp, E. coli
gataagagcacgattcagcggagct

SEQ ID NO: 50175 - DNA, 25 bp, E. coli
gatcattttgataccaccgaacggg

SEQ ID NO: 50176 - DNA, 25 bp, E. coli
gatttacggcaaggcaggatgtccg

SEQ ID NO: 50177 - DNA, 25 bp, E. coli
tcagcggcagtttttcagaccacag

SEQ ID NO: 50178 - DNA, 25 bp, E. coli
taaacgtcgaacacgccctggttgt

SEQ ID NO: 50179 - DNA, 25 bp, E. coli
taaacgtcgaactcgccctggttgt

SEQ ID NO: 50180 - DNA, 25 bp, E. coli
tcagcggcagttattcagaccacag

SEQ ID NO: 50181 - DNA, 25 bp, E. coli
gaccgaaggacaatgcagcaccgtt

SEQ ID NO: 50182 - DNA, 25 bp, E. coli
gaccgaaggacattgcagcaccgtt

SEQ ID NO: 50183 - DNA, 25 bp, E. coli
taatccttaactgatcggcattgcc

SEQ ID NO: 50184 - DNA, 25 bp, E. coli
taatccttaactcatcggcattgcc

SEQ ID NO: 50185 - DNA, 25 bp, E. coli
aactgatcggcaatgcccagaaggg

SEQ ID NO: 50186 - DNA, 25 bp, E. coli
aactgatcggcattgcccagaaggg

SEQ ID NO: 50187 - DNA, 25 bp, E. coli
tagtgcctcagtttaaggatcggtc

SEQ ID NO: 50188 - DNA, 25 bp, E. coli
tagtgcctcagtataaggatcggtc

SEQ ID NO: 50189 - DNA, 25 bp, E. coli
tcgagcagatcaatgagaagtggca

SEQ ID NO: 50190 - DNA, 25 bp, E. coli
tcgagcagatcattgagaagtggca

SEQ ID NO: 50191 - DNA, 25 bp, E. coli
tctgcaaatagttgtgcagagggcg

SEQ ID NO: 50192 - DNA, 25 bp, E. coli
tctgcaaatagtagtgcagagggcg

SEQ ID NO: 50193 - DNA, 25 bp, E. coli
gaaggtgttctgcaaatagttgtgc

SEQ ID NO: 50194 - DNA, 25 bp, E. coli
gaaggtgttctggaaatagttgtgc

SEQ ID NO: 50195 - DNA, 25 bp, E. coli
ggatcggtcaactaatccttaactg

SEQ ID NO: 50196 - DNA, 25 bp, E. coli
ggatcggtcaacaaatccttaactg

SEQ ID NO: 50197 - DNA, 25 bp, E. coli
gaagtggcataacaaaacggctccc

SEQ ID NO: 50198 - DNA, 25 bp, E. coli
gaagtggcataagaaaacggctccc

SEQ ID NO: 50199 - DNA, 25 bp, E. coli
gaaaacggctccgtgttgtggaagc

SEQ ID NO: 50200 - DNA, 25 bp, E. coli
gaaaacggctccctgttgtggaagc

SEQ ID NO: 50201 - DNA, 25 bp, E. coli
gtggaagccgttttagtgcctcagt

SEQ ID NO: 50202 - DNA, 25 bp, E. coli
ggatggtcactgaaatcgagcagat

SEQ ID NO: 50203 - DNA, 25 bp, E. coli
ggatggtcactgtaatcgagcagat

SEQ ID NO: 50204 - DNA, 25 bp, E. coli
gtggaagccgttatagtgcctcagt

SEQ ID NO: 50205 - DNA, 25 bp, E. coli
caaagacgacgctatacggatgggc

SEQ ID NO: 50206 - DNA, 25 bp, E. coli
caaagacgacgcaatacggatgggc

SEQ ID NO: 50207 - DNA, 25 bp, E. coli
aactcctggcaaacgatctggtgtg

SEQ ID NO: 50208 - DNA, 25 bp, E. coli
aactcctggcaatcgatctggtgtg

SEQ ID NO: 50209 - DNA, 25 bp, E. coli
tattggtgccaatgacaaagacgac

SEQ ID NO: 50210 - DNA, 25 bp, E. coli
ttatggtgcgcaaaatagagccgtc

SEQ ID NO: 50211 - DNA, 25 bp, E. coli
ttatggtgcgcataatagagccgtc

SEQ ID NO: 50212 - DNA, 25 bp, E. coli
tattggtgccaaagacaaagacgac

SEQ ID NO: 50213 - DNA, 25 bp, E. coli
ttacgccgtgtataacctgacctgg

SEQ ID NO: 50214 - DNA, 25 bp, E. coli
ttacgccgtgtaaaacctgacctgg

SEQ ID NO: 50215 - DNA, 25 bp, E. coli
tgattcaggcacaacacaagaggca

SEQ ID NO: 50216 - DNA, 25 bp, E. coli
tgattcaggcactacacaagaggca

SEQ ID NO: 50217 - DNA, 25 bp, E. coli
gctatacccattgtccggcggaggt

SEQ ID NO: 50218 - DNA, 25 bp, E. coli
gctatacccattctccggcggaggt

SEQ ID NO: 50219 - DNA, 25 bp, E. coli
gaacacaacattccggtgcagcgag

SEQ ID NO: 50220 - DNA, 25 bp, E. coli
gaacacaacattgcggtgcagcgag

SEQ ID NO: 50221 - DNA, 25 bp, E. coli
gtgataaacccgttgcgctgcgact

SEQ ID NO: 50222 - DNA, 25 bp, E. coli
gtgataaacccgatgcgctgcgact

SEQ ID NO: 50223 - DNA, 25 bp, E. coli
tggctcccggcgagataacagaaac

SEQ ID NO: 50224 - DNA, 25 bp, E. coli
tggctcccggcgtgataacagaaac

SEQ ID NO: 50225 - DNA, 25 bp, E. coli
taatcagggcgtagggatcacctgc

SEQ ID NO: 50226 - DNA, 25 bp, E. coli
taatcagggcgttgggatcacctgc

SEQ ID NO: 50227 - DNA, 25 bp, E. coli
caattgtatcaacagcaggcggcag

SEQ ID NO: 50228 - DNA, 25 bp, E. coli
caattgtatcaagagcaggcggcag

SEQ ID NO: 50229 - DNA, 25 bp, E. coli
cactcggtcaaatctggctgtcagg

SEQ ID NO: 50230 - DNA, 25 bp, E. coli
cactcggtcaaaactggctgtcagg

SEQ ID NO: 50231 - DNA, 25 bp, E. coli
tacagagttttggtacaggtgccat

SEQ ID NO: 50232 - DNA, 25 bp, E. coli
tacagagttttgctacaggtgccat

SEQ ID NO: 50233 - DNA, 25 bp, E. coli
tataaagaccttgcagggcaggcgc

SEQ ID NO: 50234 - DNA, 25 bp, E. coli
tataaagaccttccagggcaggcgc

SEQ ID NO: 50235 - DNA, 25 bp, E. coli
tgaaaagggcatggaactgcagcgt

SEQ ID NO: 50236 - DNA, 25 bp, E. coli
tgaaaagggcatcgaactgcagcgt

SEQ ID NO: 50237 - DNA, 25 bp, E. coli
tctggcaaatatgggccttggtgct

SEQ ID NO: 50238 - DNA, 25 bp, E. coli
tctggcaaatatcggccttggtgct

SEQ ID NO: 50239 - DNA, 25 bp, E. coli
ccttggtgctcttacaggtcaggca

SEQ ID NO: 50240 - DNA, 25 bp, E. coli
ccttggtgctctaacaggtcaggca

SEQ ID NO: 50241 - DNA, 25 bp, E. coli
gcaacgggtggattaggctctacag

SEQ ID NO: 50242 - DNA, 25 bp, E. coli
gcaacgggtggaataggctctacag

SEQ ID NO: 50243 - DNA, 25 bp, E. coli
gcaggcgcgctatcagagtctggca

SEQ ID NO: 50244 - DNA, 25 bp, E. coli
gcaggcgcgctaacagagtctggca

SEQ ID NO: 50245 - DNA, 25 bp, E. coli
tggcagacgaacatgcaaaaccttg

SEQ ID NO: 50246 - DNA, 25 bp, E. coli
ggctctacagcaacaggaaaccagt

SEQ ID NO: 50247 - DNA, 25 bp, E. coli
ggctctacagcatcaggaaaccagt

SEQ ID NO: 50248 - DNA, 25 bp, E. coli
tggcagacgaacttgcaaaaccttg

SEQ ID NO: 50249 - DNA, 25 bp, E. coli
aatcccgtgaagctgacgacgtgcc

SEQ ID NO: 50250 - DNA, 25 bp, E. coli
aatcccgtgaaggtgacgacgtgcc

SEQ ID NO: 50251 - DNA, 25 bp, E. coli
cacacggtgctgttatatggcggca

SEQ ID NO: 50252 - DNA, 25 bp, E. coli
cacacggtgctgatatatggcggca

SEQ ID NO: 50253 - DNA, 25 bp, E. coli
tatcgtatccgcgaaggtgcgccgt

SEQ ID NO: 50254 - DNA, 25 bp, E. coli
tatcgtatccgccaaggtgcgccgt

SEQ ID NO: 50255 - DNA, 25 bp, E. coli
ttttcagtacggaacagacggtgcc

SEQ ID NO: 50256 - DNA, 25 bp, E. coli
ttttcagtacggtacagacggtgcc

SEQ ID NO: 50257 - DNA, 25 bp, E. coli
tgtcgggccgctcgataaaaccttc

SEQ ID NO: 50258 - DNA, 25 bp, E. coli
tgtcgggccgctggataaaaccttc

SEQ ID NO: 50259 - DNA, 25 bp, E. coli
tctgcgctacgacaatatcccggaa

SEQ ID NO: 50260 - DNA, 25 bp, E. coli
tctgcgctacgagaatatcccggaa

SEQ ID NO: 50261 - DNA, 25 bp, E. coli
ccagattggtgtccgtaatgccgaa

SEQ ID NO: 50262 - DNA, 25 bp, E. coli
ccagattggtgtgcgtaatgccgaa

SEQ ID NO: 50263 - DNA, 25 bp, E. coli
cgggatacattttgaactgcgggca

SEQ ID NO: 50264 - DNA, 25 bp, E. coli
cgggatacatttagaactgcgggca

SEQ ID NO: 50265 - DNA, 25 bp, E. coli
gataaacggcggaaagcgactcggt

SEQ ID NO: 50266 - DNA, 25 bp, E. coli
gataaacggcggtaagcgactcggt

SEQ ID NO: 50267 - DNA, 25 bp, E. coli
tcactggaaaaacgaagactcgctc

SEQ ID NO: 50268 - DNA, 25 bp, E. coli
tcactggaaaaaggaagactcgctc

SEQ ID NO: 50269 - DNA, 25 bp, E. coli
taatgctggaagcacaaaccctgcc

SEQ ID NO: 50270 - DNA, 25 bp, E. coli
taatgctggaaggacaaaccctgcc

SEQ ID NO: 50271 - DNA, 25 bp, E. coli
caacaattgcgtaaatgccgggaac

SEQ ID NO: 50272 - DNA, 25 bp, E. coli
caacaattgcgttaatgccgggaac

SEQ ID NO: 50273 - DNA, 25 bp, E. coli
tatgacagccgagagtttaccgcag

SEQ ID NO: 50274 - DNA, 25 bp, E. coli
tatgacagccgacagtttaccgcag

SEQ ID NO: 50275 - DNA, 25 bp, E. coli
ttacctgtcatgtctgtgcagcggg

SEQ ID NO: 50276 - DNA, 25 bp, E. coli
ttacctgtcatgactgtgcagcggg

SEQ ID NO: 50277 - DNA, 25 bp, E. coli
tggtgataccactcctgcgtcggta

SEQ ID NO: 50278 - DNA, 25 bp, E. coli
tgacattctcctgcatgctggccgg

SEQ ID NO: 50279 - DNA, 25 bp, E. coli
tgacattctcctccatgctggccgg

SEQ ID NO: 50280 - DNA, 25 bp, E. coli
tgccgggaacactgaccatagcgtt

SEQ ID NO: 50281 - DNA, 25 bp, E. coli
tgccgggaacacagaccatagcgtt

SEQ ID NO: 50282 - DNA, 25 bp, E. coli
gctggccggcagtatgttcgttacc

SEQ ID NO: 50283 - DNA, 25 bp, E. coli
gctggccggcagaatgttcgttacc

SEQ ID NO: 50284 - DNA, 25 bp, E. coli
gaagctgacattaacgggcacacca

SEQ ID NO: 50285 - DNA, 25 bp, E. coli
gaagctgacatttacgggcacacca

SEQ ID NO: 50286 - DNA, 25 bp, E. coli
gaaagccacttaacttccggtaaag

SEQ ID NO: 50287 - DNA, 25 bp, E. coli
gaaagccacttatcttccggtaaag

SEQ ID NO: 50288 - DNA, 25 bp, E. coli
cgaaaccttgatctcagtctgggaa

SEQ ID NO: 50289 - DNA, 25 bp, E. coli
cgaaaccttgatgtcagtctgggaa

SEQ ID NO: 50290 - DNA, 25 bp, E. coli
gattaacagcataaatggagcgcgg

SEQ ID NO: 50291 - DNA, 25 bp, E. coli
gattaacagcattaatggagcgcgg

SEQ ID NO: 50292 - DNA, 25 bp, E. coli
tggtgataccacacctgcgtcggta

SEQ ID NO: 50293 - DNA, 25 bp, E. coli
caactacggtgggacgtgtttgcgc

SEQ ID NO: 50294 - DNA, 25 bp, E. coli
caactacggtggcacgtgtttgcgc

SEQ ID NO: 50295 - DNA, 25 bp, E. coli
actgtggtgtttgccgaaagtggac

SEQ ID NO: 50296 - DNA, 25 bp, E. coli
actgtggtgtttcccgaaagtggac

SEQ ID NO: 50297 - DNA, 25 bp, E. coli
tatcgaggaaaactatcacgcgcag

SEQ ID NO: 50298 - DNA, 25 bp, E. coli
tatcgaggaaaagtatcacgcgcag

SEQ ID NO: 50299 - DNA, 25 bp, E. coli
ttttgatgacaccaccattctgggc

SEQ ID NO: 50300 - DNA, 25 bp, E. coli
ttttgatgacacgaccattctgggc

SEQ ID NO: 50301 - DNA, 25 bp, E. coli
ttacgcagtgaatccgatcgccggt

SEQ ID NO: 50302 - DNA, 25 bp, E. coli
ttacgcagtgaaaccgatcgccggt

SEQ ID NO: 50303 - DNA, 25 bp, E. coli
tgctggtctttgagccgctgtggac

SEQ ID NO: 50304 - DNA, 25 bp, E. coli
tgctggtctttgtgccgctgtggac

SEQ ID NO: 50305 - DNA, 25 bp, E. coli
tcatgaagaggtgctggacaaaacc

SEQ ID NO: 50306 - DNA, 25 bp, E. coli
tcatgaagaggtcctggacaaaacc

SEQ ID NO: 50307 - DNA, 25 bp, E. coli
gaaaaacatctaacagcaactgtgg

SEQ ID NO: 50308 - DNA, 25 bp, E. coli
gaaaaacatctatcagcaactgtgg

SEQ ID NO: 50309 - DNA, 25 bp, E. coli
cgttacctgctgcataccgatttca

SEQ ID NO: 50310 - DNA, 25 bp, E. coli
cgttacctgctggataccgatttca

SEQ ID NO: 50311 - DNA, 25 bp, E. coli
gtatgtaccttctccgttggcggca

SEQ ID NO: 50312 - DNA, 25 bp, E. coli
gtatgtaccttcaccgttggcggca

SEQ ID NO: 50313 - DNA, 25 bp, E. coli
gtttacgagtactacgccgactccg

SEQ ID NO: 50314 - DNA, 25 bp, E. coli
gtttacgagtacaacgccgactccg

SEQ ID NO: 50315 - DNA, 25 bp, E. coli
caaaacgtggtgaatgccatgcggc

SEQ ID NO: 50316 - DNA, 25 bp, E. coli
caaaacgtggtgtatgccatgcggc

SEQ ID NO: 50317 - DNA, 25 bp, E. coli
aacgttgaaggcttacgctcgggca

SEQ ID NO: 50318 - DNA, 25 bp, E. coli
aacgttgaaggcatacgctcgggca

SEQ ID NO: 50319 - DNA, 25 bp, E. coli
tatgacgctgagtgcgcaaaaggcc

SEQ ID NO: 50320 - DNA, 25 bp, E. coli
tatgacgctgagagcgcaaaaggcc

SEQ ID NO: 50321 - DNA, 25 bp, E. coli
ttacagagctggcatatcgaccgcg

SEQ ID NO: 50322 - DNA, 25 bp, E. coli
ttacagagctgggatatcgaccgcg

SEQ ID NO: 50323 - DNA, 25 bp, E. coli
tgttatcacacgttacagcgccgga

SEQ ID NO: 50324 - DNA, 25 bp, E. coli
tgttatcacacgatacagcgccgga

SEQ ID NO: 50325 - DNA, 25 bp, E. coli
tcgatttaaccgaggcatccgagga

SEQ ID NO: 50326 - DNA, 25 bp, E. coli
tcgatttaaccgtggcatccgagga

SEQ ID NO: 50327 - DNA, 25 bp, E. coli
gccagaaacgtatcttgcgcgagca

SEQ ID NO: 50328 - DNA, 25 bp, E. coli
gccagaaacgtaacttgcgcgagca

SEQ ID NO: 50329 - DNA, 25 bp, E. coli
gcaggcaggctgaatattccccggt

SEQ ID NO: 50330 - DNA, 25 bp, E. coli
gcaggcaggctgtatattccccggt

SEQ ID NO: 50331 - DNA, 25 bp, E. coli
gatttattctttagcgtccccgtgg

SEQ ID NO: 50332 - DNA, 25 bp, E. coli
gatttattcttttgcgtccccgtgg

SEQ ID NO: 50333 - DNA, 25 bp, E. coli
tcacgggacaatcgctgagggaaca

SEQ ID NO: 50334 - DNA, 25 bp, E. coli
tcacgggacaatggctgagggaaca

SEQ ID NO: 50335 - DNA, 25 bp, E. coli
gatgcagcaattgcaacagggcggt

SEQ ID NO: 50336 - DNA, 25 bp, E. coli
gatgcagcaattccaacagggcggt

SEQ ID NO: 50337 - DNA, 25 bp, E. coli
aacaaactgattccgccattaccgg

SEQ ID NO: 50338 - DNA, 25 bp, E. coli
aaagcgtttatccacttcctgcaga

SEQ ID NO: 50339 - DNA, 25 bp, E. coli
aaagcgtttatcgacttcctgcaga

SEQ ID NO: 50340 - DNA, 25 bp, E. coli
aaagtcctgctcacgctggtttgcg

SEQ ID NO: 50341 - DNA, 25 bp, E. coli
aaagtcctgctctcgctggtttgcg

SEQ ID NO: 50342 - DNA, 25 bp, E. coli
gattacgttacggaaagcggtccgc

SEQ ID NO: 50343 - DNA, 25 bp, E. coli
aacaaactgattgcgccattaccgg

SEQ ID NO: 50344 - DNA, 25 bp, E. coli
gattacgttacgcaaagcggtccgc

SEQ ID NO: 50345 - DNA, 25 bp, E. coli
tcaccaaagtggaaacgacgccagc

SEQ ID NO: 50346 - DNA, 25 bp, E. coli
tcaccaaagtggtaacgacgccagc

SEQ ID NO: 50347 - DNA, 25 bp, E. coli
cccggttgtagacagcgttaacgca

SEQ ID NO: 50348 - DNA, 25 bp, E. coli
cccggttgtagagagcgttaacgca

SEQ ID NO: 50349 - DNA, 25 bp, E. coli
cgtagaaagggtatcctgcaagcct

SEQ ID NO: 50350 - DNA, 25 bp, E. coli
cgtagaaagggtttcctgcaagcct

SEQ ID NO: 50351 - DNA, 25 bp, E. coli
gattccggcggctcaaactttcacg

SEQ ID NO: 50352 - DNA, 25 bp, E. coli
gattccggcggcacaaactttcacg

SEQ ID NO: 50353 - DNA, 25 bp, E. coli
ggtgaacgtctagcaaccctgactg

SEQ ID NO: 50354 - DNA, 25 bp, E. coli
ggtgaacgtctaccaaccctgactg

SEQ ID NO: 50355 - DNA, 25 bp, E. coli
taatcaggcctgcactacagcagtt

SEQ ID NO: 50356 - DNA, 25 bp, E. coli
taatcaggcctggactacagcagtt

SEQ ID NO: 50357 - DNA, 25 bp, E. coli
gacgccagctgatgcattgcaaccg

SEQ ID NO: 50358 - DNA, 25 bp, E. coli
gacgccagctgaagcattgcaaccg

SEQ ID NO: 50359 - DNA, 25 bp, E. coli
aatgttgcatctaaagccgctgttg

SEQ ID NO: 50360 - DNA, 25 bp, E. coli
aatgttgcatcttaagccgctgttg

SEQ ID NO: 50361 - DNA, 25 bp, E. coli
agccgctgttgcgtttttaggtacg

SEQ ID NO: 50362 - DNA, 25 bp, E. coli
agccgctgttgcctttttaggtacg

SEQ ID NO: 50363 - DNA, 25 bp, E. coli
atcctggacagaacgggtgctgcgc

SEQ ID NO: 50364 - DNA, 25 bp, E. coli
atcctggacagatcgggtgctgcgc

SEQ ID NO: 50365 - DNA, 25 bp, E. coli
tgtgcagatcctcgacagaacgggt

SEQ ID NO: 50366 - DNA, 25 bp, E. coli
tgtgcagatcctggacagaacgggt

SEQ ID NO: 50367 - DNA, 25 bp, E. coli
tgcgggtcatacgaacgttctggct

SEQ ID NO: 50368 - DNA, 25 bp, E. coli
tgcgggtcataccaacgttctggct

SEQ ID NO: 50369 - DNA, 25 bp, E. coli
tctggctctgcacagttcagctgcg

SEQ ID NO: 50370 - DNA, 25 bp, E. coli
tctggctctgcagagttcagctgcg

SEQ ID NO: 50371 - DNA, 25 bp, E. coli
gcaaccccgggtgctgctaatgcgg

SEQ ID NO: 50372 - DNA, 25 bp, E. coli
gcaaccccgggtcctgctaatgcgg

SEQ ID NO: 50373 - DNA, 25 bp, E. coli
cgttctggctctgcagagttcagct

SEQ ID NO: 50374 - DNA, 25 bp, E. coli
cgttctggctctccagagttcagct

SEQ ID NO: 50375 - DNA, 25 bp, E. coli
gataccaatgttgcatctaaagccg

SEQ ID NO: 50376 - DNA, 25 bp, E. coli
gataccaatgttccatctaaagccg

SEQ ID NO: 50377 - DNA, 25 bp, E. coli
gattgatgcgggacataccaacgtt

SEQ ID NO: 50378 - DNA, 25 bp, E. coli
gattgatgcgggtcataccaacgtt

SEQ ID NO: 50379 - DNA, 25 bp, E. coli
gtgctgcgctgacgctggatggtgc

SEQ ID NO: 50380 - DNA, 25 bp, E. coli
gtgctgcgctgaggctggatggtgc

SEQ ID NO: 50381 - DNA, 25 bp, E. coli
aatgtgcgcaatcctttttctgggc

SEQ ID NO: 50382 - DNA, 25 bp, E. coli
aatgtgcgcaatgctttttctgggc

SEQ ID NO: 50383 - DNA, 25 bp, E. coli
catactttaggctctgtggatatca

SEQ ID NO: 50384 - DNA, 25 bp, E. coli
catactttaggcactgtggatatca

SEQ ID NO: 50385 - DNA, 25 bp, E. coli
agagccttgttgatgccctgtttcg

SEQ ID NO: 50386 - DNA, 25 bp, E. coli
aaagatttaccatcgccattacagg

SEQ ID NO: 50387 - DNA, 25 bp, E. coli
agagccttgttgttgccctgtttcg

SEQ ID NO: 50388 - DNA, 25 bp, E. coli
aaagatttaccaacgccattacagg

SEQ ID NO: 50389 - DNA, 25 bp, E. coli
aaatgatgcaaatctgcgagggcgc

SEQ ID NO: 50390 - DNA, 25 bp, E. coli
aaatgatgcaaaactgcgagggcgc

SEQ ID NO: 50391 - DNA, 25 bp, E. coli
tagtaccgcagaaaaagaaaccatc

SEQ ID NO: 50392 - DNA, 25 bp, E. coli
tagtaccgcagataaagaaaccatc

SEQ ID NO: 50393 - DNA, 25 bp, E. coli
tgcctttgcattgtacagagccttg

SEQ ID NO: 50394 - DNA, 25 bp, E. coli
tgcctttgcattctacagagccttg

SEQ ID NO: 50395 - DNA, 25 bp, E. coli
tcatcaatcaaatcagaaacggcga

SEQ ID NO: 50396 - DNA, 25 bp, E. coli
tcatcaatcaaaacagaaacggcga

SEQ ID NO: 50397 - DNA, 25 bp, E. coli
gcgagggcgcataatagcacatcca

SEQ ID NO: 50398 - DNA, 25 bp, E. coli
gcgagggcgcattatagcacatcca

SEQ ID NO: 50399 - DNA, 25 bp, E. coli
gaaacggcgacactcttcgattgcc

SEQ ID NO: 50400 - DNA, 25 bp, E. coli
gaaacggcgacagtcttcgattgcc

SEQ ID NO: 50401 - DNA, 25 bp, E. coli
taatttctgtttccgtgaatggcca

SEQ ID NO: 50402 - DNA, 25 bp, E. coli
taatttctgtttgcgtgaatggcca

SEQ ID NO: 50403 - DNA, 25 bp, E. coli
catcaccggattcacagtgggtcag

SEQ ID NO: 50404 - DNA, 25 bp, E. coli
catcaccggattgacagtgggtcag

SEQ ID NO: 50405 - DNA, 25 bp, E. coli
tatgcaaacagtgacgaagaggaga

SEQ ID NO: 50406 - DNA, 25 bp, E. coli
tatgcaaacagtcacgaagaggaga

SEQ ID NO: 50407 - DNA, 25 bp, E. coli
tgggcctcagtctttccacggagcg

SEQ ID NO: 50408 - DNA, 25 bp, E. coli
tctgaaccgttataagcctgcatgg

SEQ ID NO: 50409 - DNA, 25 bp, E. coli
tctgaaccgttaaaagcctgcatgg

SEQ ID NO: 50410 - DNA, 25 bp, E. coli
ccggctaccggattatgaatgtgct

SEQ ID NO: 50411 - DNA, 25 bp, E. coli
ccggctaccggaatatgaatgtgct

SEQ ID NO: 50412 - DNA, 25 bp, E. coli
gaaatagatattgagccatcaccgg

SEQ ID NO: 50413 - DNA, 25 bp, E. coli
gaaatagatattcagccatcaccgg

SEQ ID NO: 50414 - DNA, 25 bp, E. coli
cgattaacagtgtaaccggctaccg

SEQ ID NO: 50415 - DNA, 25 bp, E. coli
cgattaacagtgaaaccggctaccg

SEQ ID NO: 50416 - DNA, 25 bp, E. coli
ggatgatattctcacgccgctgcgt

SEQ ID NO: 50417 - DNA, 25 bp, E. coli
ggatgatattctgacgccgctgcgt

SEQ ID NO: 50418 - DNA, 25 bp, E. coli
ggaatgtgatatgaccggcgcaacc

SEQ ID NO: 50419 - DNA, 25 bp, E. coli
tgggcctcagtcattccacggagcg

SEQ ID NO: 50420 - DNA, 25 bp, E. coli
ggaatgtgatatcaccggcgcaacc

SEQ ID NO: 50421 - DNA, 25 bp, E. coli
gagcgtcagcgtaatgccgggaata

SEQ ID NO: 50422 - DNA, 25 bp, E. coli
gatgaaaccctcacttaaccgtgaa

SEQ ID NO: 50423 - DNA, 25 bp, E. coli
gagcgtcagcgttatgccgggaata

SEQ ID NO: 50424 - DNA, 25 bp, E. coli
gatgaaaccctctcttaaccgtgaa

SEQ ID NO: 50425 - DNA, 25 bp, E. coli
caatccggagtttgtatgacgttgc

SEQ ID NO: 50426 - DNA, 25 bp, E. coli
caatccggagttagtatgacgttgc

SEQ ID NO: 50427 - DNA, 25 bp, E. coli
tacgctgatgatctggatgcactta

SEQ ID NO: 50428 - DNA, 25 bp, E. coli
actttccgagctgatctgtgccgca

SEQ ID NO: 50429 - DNA, 25 bp, E. coli
actttccgagctcatctgtgccgca

SEQ ID NO: 50430 - DNA, 25 bp, E. coli
tacgctgatgatgtggatgcactta

SEQ ID NO: 50431 - DNA, 25 bp, E. coli
tatgacgttgctatttacgctgatg

SEQ ID NO: 50432 - DNA, 25 bp, E. coli
tatgacgttgctttttacgctgatg

SEQ ID NO: 50433 - DNA, 25 bp, E. coli
tattttcgcttatgtgcatcaggcg

SEQ ID NO: 50434 - DNA, 25 bp, E. coli
tattttcgcttaagtgcatcaggcg

SEQ ID NO: 50435 - DNA, 25 bp, E. coli
tgctgaacgtgcagcccgtgactca

SEQ ID NO: 50436 - DNA, 25 bp, E. coli
tgcatcaggcgcacatgctgaacgt

SEQ ID NO: 50437 - DNA, 25 bp, E. coli
tgcatcaggcgctcatgctgaacgt

SEQ ID NO: 50438 - DNA, 25 bp, E. coli
tgctgaacgtgctgcccgtgactca

SEQ ID NO: 50439 - DNA, 25 bp, E. coli
tctcattaacaatgcacctgaacga

SEQ ID NO: 50440 - DNA, 25 bp, E. coli
tctcattaacaaagcacctgaacga

SEQ ID NO: 50441 - DNA, 25 bp, E. coli
gactcattgaccagggcaatccgga

SEQ ID NO: 50442 - DNA, 25 bp, E. coli
gactcattgacctgggcaatccgga

SEQ ID NO: 50443 - DNA, 25 bp, E. coli
gggaacacattgtaccatataagct

SEQ ID NO: 50444 - DNA, 25 bp, E. coli
ggatgcacttaaggaactttccgag

SEQ ID NO: 50445 - DNA, 25 bp, E. coli
ggatgcacttaacgaactttccgag

SEQ ID NO: 50446 - DNA, 25 bp, E. coli
gggaacacattgaaccatataagct

SEQ ID NO: 50447 - DNA, 25 bp, E. coli
aagtgcatccaaaacgaatttgcga

SEQ ID NO: 50448 - DNA, 25 bp, E. coli
aagtgcatccaatacgaatttgcga

SEQ ID NO: 50449 - DNA, 25 bp, E. coli
aatggcgtgtcgcagaatgaattgc

SEQ ID NO: 50450 - DNA, 25 bp, E. coli
aatggcgtgtcggagaatgaattgc

SEQ ID NO: 50451 - DNA, 25 bp, E. coli
caaaacgaatttccgagagaaagaa

SEQ ID NO: 50452 - DNA, 25 bp, E. coli
caaaacgaatttgcgagagaaagaa

SEQ ID NO: 50453 - DNA, 25 bp, E. coli
aaagaaaatggcctgtcggagaatg

SEQ ID NO: 50454 - DNA, 25 bp, E. coli
aaagaaaatggcgtgtcggagaatg

SEQ ID NO: 50455 - DNA, 25 bp, E. coli
ttgaattaataatgaaagaatcttc

SEQ ID NO: 50456 - DNA, 25 bp, E. coli
ttgaattaataaagaaagaatcttc

SEQ ID NO: 50457 - DNA, 25 bp, E. coli
tgcaacacaaaattaacaaattgaa

SEQ ID NO: 50458 - DNA, 25 bp, E. coli
tgcaacacaaaaataacaaattgaa

SEQ ID NO: 50459 - DNA, 25 bp, E. coli
tgcgagagaaagtaaatggcgtgtc

SEQ ID NO: 50460 - DNA, 25 bp, E. coli
tgcgagagaaagaaaatggcgtgtc

SEQ ID NO: 50461 - DNA, 25 bp, E. coli
gcgtgtcggagaatgaattgcaaca

SEQ ID NO: 50462 - DNA, 25 bp, E. coli
gcgtgtcggagattgaattgcaaca

SEQ ID NO: 50463 - DNA, 25 bp, E. coli
gcatccaaaacgaatttgcgagaga

SEQ ID NO: 50464 - DNA, 25 bp, E. coli
gaatgaattgcatcacaaaaataac

SEQ ID NO: 50465 - DNA, 25 bp, E. coli
gcatccaaaacgtatttgcgagaga

SEQ ID NO: 50466 - DNA, 25 bp, E. coli
gaatgaattgcaacacaaaaataac

SEQ ID NO: 50467 - DNA, 25 bp, E. coli
gtcggagaatgatttgcaacacaaa

SEQ ID NO: 50468 - DNA, 25 bp, E. coli
gtcggagaatgaattgcaacacaaa

SEQ ID NO: 50469 - DNA, 25 bp, E. coli
aataaaactgtctgtggtgatcggc

SEQ ID NO: 50470 - DNA, 25 bp, E. coli
aataaaactgtcagtggtgatcggc

SEQ ID NO: 50471 - DNA, 25 bp, E. coli
aattgcgccctctacggcaagtcga

SEQ ID NO: 50472 - DNA, 25 bp, E. coli
aatggcaataaatctgtctgtggtg

SEQ ID NO: 50473 - DNA, 25 bp, E. coli
aatggcaataaaactgtctgtggtg

SEQ ID NO: 50474 - DNA, 25 bp, E. coli
aattgcgccctcaacggcaagtcga

SEQ ID NO: 50475 - DNA, 25 bp, E. coli
taaaactgtctgtggtgatcggcag

SEQ ID NO: 50476 - DNA, 25 bp, E. coli
taaaactgtctgaggtgatcggcag

SEQ ID NO: 50477 - DNA, 25 bp, E. coli
aaaactgtctgtggtgatcggcagt

SEQ ID NO: 50478 - DNA, 25 bp, E. coli
aaaactgtctgtcgtgatcggcagt

SEQ ID NO: 50479 - DNA, 25 bp, E. coli
ttgcgccctctacggcaagtcgatt

SEQ ID NO: 50480 - DNA, 25 bp, E. coli
ttgcgccctctagggcaagtcgatt

SEQ ID NO: 50481 - DNA, 25 bp, E. coli
gccagaaatggctataaaactgtct

SEQ ID NO: 50482 - DNA, 25 bp, E. coli
gccagaaatggcaataaaactgtct

SEQ ID NO: 50483 - DNA, 25 bp, E. coli
gccctctacggcaagtcgattgctg

SEQ ID NO: 50484 - DNA, 25 bp, E. coli
gccctctacggctagtcgattgctg

SEQ ID NO: 50485 - DNA, 25 bp, E. coli
gaaatggcaatataactgtctgtgg

SEQ ID NO: 50486 - DNA, 25 bp, E. coli
gaaatggcaataaaactgtctgtgg

SEQ ID NO: 50487 - DNA, 25 bp, E. coli
ggaaattgcgccctctacggcaagt

SEQ ID NO: 50488 - DNA, 25 bp, E. coli
ggaaattgcgccgtctacggcaagt

SEQ ID NO: 50489 - DNA, 25 bp, E. coli
ggcaataaaactctctgtggtgatc

SEQ ID NO: 50490 - DNA, 25 bp, E. coli
ggcaataaaactgtctgtggtgatc

SEQ ID NO: 50491 - DNA, 25 bp, E. coli
cactgggtctggttgattctggtcg

SEQ ID NO: 50492 - DNA, 25 bp, E. coli
cactgggtctggatgattctggtcg

SEQ ID NO: 50493 - DNA, 25 bp, E. coli
catcaggataaaattgagcgggcgc

SEQ ID NO: 50494 - DNA, 25 bp, E. coli
catcaggataaatttgagcgggcgc

SEQ ID NO: 50495 - DNA, 25 bp, E. coli
catccgtatctgtttgtcattggta

SEQ ID NO: 50496 - DNA, 25 bp, E. coli
catccgtatctgattgtcattggta

SEQ ID NO: 50497 - DNA, 25 bp, E. coli
acgctgattggtcccagccagctgc

SEQ ID NO: 50498 - DNA, 25 bp, E. coli
acgctgattggtgccagccagctgc

SEQ ID NO: 50499 - DNA, 25 bp, E. coli
tatggctttcggctgattggcccga

SEQ ID NO: 50500 - DNA, 25 bp, E. coli
tatggctttcgggtgattggcccga

SEQ ID NO: 50501 - DNA, 25 bp, E. coli
tattctcggcgcttttgcctgggcg

SEQ ID NO: 50502 - DNA, 25 bp, E. coli
tattctcggcgcatttgcctgggcg

SEQ ID NO: 50503 - DNA, 25 bp, E. coli
tgaaaccgtgacattgctgggaggc

SEQ ID NO: 50504 - DNA, 25 bp, E. coli
tgaaaccgtgactttgctgggaggc

SEQ ID NO: 50505 - DNA, 25 bp, E. coli
tgcgccgtggttccacaatctcgac

SEQ ID NO: 50506 - DNA, 25 bp, E. coli
tgcgccgtggttgcacaatctcgac

SEQ ID NO: 50507 - DNA, 25 bp, E. coli
tctcgaccagcatttgaagcactgg

SEQ ID NO: 50508 - DNA, 25 bp, E. coli
tctcgaccagcaattgaagcactgg

SEQ ID NO: 50509 - DNA, 25 bp, E. coli
ggctattaaagtacccgctggtggt

SEQ ID NO: 50510 - DNA, 25 bp, E. coli
ggctattaaagttcccgctggtggt

SEQ ID NO: 50511 - DNA, 25 bp, E. coli
tcacaatatggtaatgccgcgctgg

SEQ ID NO: 50512 - DNA, 25 bp, E. coli
tcacaatatggttatgccgcgctgg

SEQ ID NO: 50513 - DNA, 25 bp, E. coli
caatgtcagcagatagcgaacggct

SEQ ID NO: 50514 - DNA, 25 bp, E. coli
caatgtcagcagttagcgaacggct

SEQ ID NO: 50515 - DNA, 25 bp, E. coli
aagtgttcaacggtgtctgggatgc

SEQ ID NO: 50516 - DNA, 25 bp, E. coli
aagtgttcaacgctgtctgggatgc

SEQ ID NO: 50517 - DNA, 25 bp, E. coli
tatgcatagggaaggtgccaacaca

SEQ ID NO: 50518 - DNA, 25 bp, E. coli
tatgcatagggatggtgccaacaca

SEQ ID NO: 50519 - DNA, 25 bp, E. coli
tataccgtgcgtcagctggaagagt

SEQ ID NO: 50520 - DNA, 25 bp, E. coli
tatctcggcgattgtgagacgctga

SEQ ID NO: 50521 - DNA, 25 bp, E. coli
tataccgtgcgtgagctggaagagt

SEQ ID NO: 50522 - DNA, 25 bp, E. coli
tatctcggcgatagtgagacgctga

SEQ ID NO: 50523 - DNA, 25 bp, E. coli
tgatatgtcgcctgcgttaacctgg

SEQ ID NO: 50524 - DNA, 25 bp, E. coli
tgatatgtcgccagcgttaacctgg

SEQ ID NO: 50525 - DNA, 25 bp, E. coli
gcgatgatacgttgcgcaactggcc

SEQ ID NO: 50526 - DNA, 25 bp, E. coli
gcgatgatacgtagcgcaactggcc

SEQ ID NO: 50527 - DNA, 25 bp, E. coli
gactgggaatcaacggcaacctgta

SEQ ID NO: 50528 - DNA, 25 bp, E. coli
gactgggaatcatcggcaacctgta

SEQ ID NO: 50529 - DNA, 25 bp, E. coli
cggtcagttagctatcgcagtggat

SEQ ID NO: 50530 - DNA, 25 bp, E. coli
cggtcagttagcaatcgcagtggat

SEQ ID NO: 50531 - DNA, 25 bp, E. coli
tggaactggcgaatggcgcaacacg

SEQ ID NO: 50532 - DNA, 25 bp, E. coli
tggaactggcgattggcgcaacacg

SEQ ID NO: 50533 - DNA, 25 bp, E. coli
gatggatggccccttcagcgatgat

SEQ ID NO: 50534 - DNA, 25 bp, E. coli
gatggatggcccgttcagcgatgat

SEQ ID NO: 50535 - DNA, 25 bp, E. coli
caggcctacgcgctgcgattttgta

SEQ ID NO: 50536 - DNA, 25 bp, E. coli
caggcctacgcggtgcgattttgta

SEQ ID NO: 50537 - DNA, 25 bp, E. coli
ataagcaaagcggatccggcacgaa

SEQ ID NO: 50538 - DNA, 25 bp, E. coli
ataagcaaagcgcatccggcacgaa

SEQ ID NO: 50539 - DNA, 25 bp, E. coli
tagccgcatccggtatgtaacgcct

SEQ ID NO: 50540 - DNA, 25 bp, E. coli
tagccgcatccgctatgtaacgcct

SEQ ID NO: 50541 - DNA, 25 bp, E. coli
tatcaggcctactcgctgcgatttt

SEQ ID NO: 50542 - DNA, 25 bp, E. coli
tatcaggcctacacgctgcgatttt

SEQ ID NO: 50543 - DNA, 25 bp, E. coli
tccggtatgtaaggcctgatgcgac

SEQ ID NO: 50544 - DNA, 25 bp, E. coli
tccggtatgtaacgcctgatgcgac

SEQ ID NO: 50545 - DNA, 25 bp, E. coli
gcgcatccggcacgaaggagtcaac

SEQ ID NO: 50546 - DNA, 25 bp, E. coli
cctacgcgctgcgattttgtaggcc

SEQ ID NO: 50547 - DNA, 25 bp, E. coli
cctacacgctgccattttgtaggcc

SEQ ID NO: 50548 - DNA, 25 bp, E. coli
cctacacgctgcgattttgtaggcc

SEQ ID NO: 50549 - DNA, 25 bp, E. coli
cctacgcgctgccattttgtaggcc

SEQ ID NO: 50550 - DNA, 25 bp, E. coli
gcgcatccggcaggaaggagtcaac

SEQ ID NO: 50551 - DNA, 25 bp, E. coli
cttatctggccttcacgctgcgatt

SEQ ID NO: 50552 - DNA, 25 bp, E. coli
cttatctggcctacacgctgcgatt

SEQ ID NO: 50553 - DNA, 25 bp, E. coli
tggcctacacgctgcgattttgtag

SEQ ID NO: 50554 - DNA, 25 bp, E. coli
tggcctacacgcagcgattttgtag

SEQ ID NO: 50555 - DNA, 25 bp, E. coli
taagcaaagcgcttccggcattcaa

SEQ ID NO: 50556 - DNA, 25 bp, E. coli
taagcaaagcgcatccggcattcaa

SEQ ID NO: 50557 - DNA, 25 bp, E. coli
ttcactgccgtcatcggtttccgca

SEQ ID NO: 50558 - DNA, 25 bp, E. coli
ttcactgccgtcttcggtttccgca

SEQ ID NO: 50559 - DNA, 25 bp, E. coli
tgtacgatgtacagcttgtcggcgt

SEQ ID NO: 50560 - DNA, 25 bp, E. coli
tgtacgatgtactgcttgtcggcgt

SEQ ID NO: 50561 - DNA, 25 bp, E. coli
tgcaaaatcagcgtaagccacggtt

SEQ ID NO: 50562 - DNA, 25 bp, E. coli
tgcaaaatcagcctaagccacggtt

SEQ ID NO: 50563 - DNA, 25 bp, E. coli
tcttcgctgtagtacggcaccaggc

SEQ ID NO: 50564 - DNA, 25 bp, E. coli
tcttcgctgtagaacggcaccaggc

SEQ ID NO: 50565 - DNA, 25 bp, E. coli
gcattttcgcttattgcagattgca

SEQ ID NO: 50566 - DNA, 25 bp, E. coli
gcattttcgctttttgcagattgca

SEQ ID NO: 50567 - DNA, 25 bp, E. coli
gcaccaggctggtcacggtttgcag

SEQ ID NO: 50568 - DNA, 25 bp, E. coli
gcaccaggctggacacggtttgcag

SEQ ID NO: 50569 - DNA, 25 bp, E. coli
cgtttcacttccacaatctttccga

SEQ ID NO: 50570 - DNA, 25 bp, E. coli
cgtttcacttcctcaatctttccga

SEQ ID NO: 50571 - DNA, 25 bp, E. coli
gattgcataagaccaccaccgtttt

SEQ ID NO: 50572 - DNA, 25 bp, E. coli
gattgcataagagcaccaccgtttt

SEQ ID NO: 50573 - DNA, 25 bp, E. coli
ggcatcatccgctccggcgttaaca

SEQ ID NO: 50574 - DNA, 25 bp, E. coli
ggcatcatccgcaccggcgttaaca

SEQ ID NO: 50575 - DNA, 25 bp, E. coli
tgtcggcgttttcatggcgtttcac

SEQ ID NO: 50576 - DNA, 25 bp, E. coli
tgtcggcgttttgatggcgtttcac

SEQ ID NO: 50577 - DNA, 25 bp, E. coli
gacgcgcatttcgagacgtgcaaaa

SEQ ID NO: 50578 - DNA, 25 bp, E. coli
gacgcgcatttccagacgtgcaaaa

SEQ ID NO: 50579 - DNA, 25 bp, E. coli
aattttcggtcaccatgcccgccag

SEQ ID NO: 50580 - DNA, 25 bp, E. coli
aattttcggtcagcatgcccgccag

SEQ ID NO: 50581 - DNA, 25 bp, E. coli
caaagaggtcgctgaagcctgggaa

SEQ ID NO: 50582 - DNA, 25 bp, E. coli
cacgcggccacgatattgaaatcga

SEQ ID NO: 50583 - DNA, 25 bp, E. coli
caaagaggtcgcagaagcctgggaa

SEQ ID NO: 50584 - DNA, 25 bp, E. coli
cacgcggccacgttattgaaatcga

SEQ ID NO: 50585 - DNA, 25 bp, E. coli
tactgaaaatcgagatgccgccgaa

SEQ ID NO: 50586 - DNA, 25 bp, E. coli
tactgaaaatcgtgatgccgccgaa

SEQ ID NO: 50587 - DNA, 25 bp, E. coli
aaacgctgaatgtgaagatcccggc

SEQ ID NO: 50588 - DNA, 25 bp, E. coli
aaacgctgaatgagaagatcccggc

SEQ ID NO: 50589 - DNA, 25 bp, E. coli
tctggtgagcaataaacagaccggc

SEQ ID NO: 50590 - DNA, 25 bp, E. coli
tctggtgagcaaaaaacagaccggc

SEQ ID NO: 50591 - DNA, 25 bp, E. coli
cctgatgtcagcaaagaaccggatg

SEQ ID NO: 50592 - DNA, 25 bp, E. coli
cctgatgtcagctaagaaccggatg

SEQ ID NO: 50593 - DNA, 25 bp, E. coli
gaaaccgacggaggatctcaagaca

SEQ ID NO: 50594 - DNA, 25 bp, E. coli
gaaaccgacggacgatctcaagaca

SEQ ID NO: 50595 - DNA, 25 bp, E. coli
ggatgaaaacactgccgcgctgtgg

SEQ ID NO: 50596 - DNA, 25 bp, E. coli
ggatgaaaacacagccgcgctgtgg

SEQ ID NO: 50597 - DNA, 25 bp, E. coli
taagtgatgaacaacgtcgcgctga

SEQ ID NO: 50598 - DNA, 25 bp, E. coli
taacgcctttgggatgatcgaacag

SEQ ID NO: 50599 - DNA, 25 bp, E. coli
taacgcctttggcatgatcgaacag

SEQ ID NO: 50600 - DNA, 25 bp, E. coli
taagtgatgaactacgtcgcgctga

SEQ ID NO: 50601 - DNA, 25 bp, E. coli
cacgcggaagcatatgaatgggcga

SEQ ID NO: 50602 - DNA, 25 bp, E. coli
cacgcggaagcaaatgaatgggcga

SEQ ID NO: 50603 - DNA, 25 bp, E. coli
agagccgatccttggtcagacctac

SEQ ID NO: 50604 - DNA, 25 bp, E. coli
agctggaaccacgtcacgcgatgct

SEQ ID NO: 50605 - DNA, 25 bp, E. coli
agctggaaccacctcacgcgatgct

SEQ ID NO: 50606 - DNA, 25 bp, E. coli
agagccgatcctaggtcagacctac

SEQ ID NO: 50607 - DNA, 25 bp, E. coli
agaagctggaacgacgtcacgcgat

SEQ ID NO: 50608 - DNA, 25 bp, E. coli
agaagctggaaccacgtcacgcgat

SEQ ID NO: 50609 - DNA, 25 bp, E. coli
aaattcgagccgattcgtccgtatg

SEQ ID NO: 50610 - DNA, 25 bp, E. coli
aaattcgagccgtttcgtccgtatg

SEQ ID NO: 50611 - DNA, 25 bp, E. coli
tatgaatgggcgtagaaaatttctg

SEQ ID NO: 50612 - DNA, 25 bp, E. coli
tatgaatgggcgaagaaaatttctg

SEQ ID NO: 50613 - DNA, 25 bp, E. coli
tgaagagccgatccttggtcagacc

SEQ ID NO: 50614 - DNA, 25 bp, E. coli
tgaacagaagctggaaccacgtcac

SEQ ID NO: 50615 - DNA, 25 bp, E. coli
tgaacagaagctcgaaccacgtcac

SEQ ID NO: 50616 - DNA, 25 bp, E. coli
tgaagagccgatgcttggtcagacc

SEQ ID NO: 50617 - DNA, 25 bp, E. coli
tgatgaagagccgatccttggtcag

SEQ ID NO: 50618 - DNA, 25 bp, E. coli
tgatgaagagcccatccttggtcag

SEQ ID NO: 50619 - DNA, 25 bp, E. coli
gctgcacgcggatgcatatgaatgg

SEQ ID NO: 50620 - DNA, 25 bp, E. coli
gctgcacgcggaagcatatgaatgg

SEQ ID NO: 50621 - DNA, 25 bp, E. coli
gggatcaaattccagccgattcgtc

SEQ ID NO: 50622 - DNA, 25 bp, E. coli
gggatcaaattcgagccgattcgtc

SEQ ID NO: 50623 - DNA, 25 bp, E. coli
catttttcaggtctggataccgacg

SEQ ID NO: 50624 - DNA, 25 bp, E. coli
cagtttacggatttcgccacgcagc

SEQ ID NO: 50625 - DNA, 25 bp, E. coli
catttttcaggtgtggataccgacg

SEQ ID NO: 50626 - DNA, 25 bp, E. coli
cagggagattccacgctttcagcgt

SEQ ID NO: 50627 - DNA, 25 bp, E. coli
cagggagattcctcgctttcagcgt

SEQ ID NO: 50628 - DNA, 25 bp, E. coli
cagtttacggatatcgccacgcagc

SEQ ID NO: 50629 - DNA, 25 bp, E. coli
tgatgccatcaaccagagtgtcgcg

SEQ ID NO: 50630 - DNA, 25 bp, E. coli
tgatgccatcaagcagagtgtcgcg

SEQ ID NO: 50631 - DNA, 25 bp, E. coli
tccgtttcgatgagcagatgagccg

SEQ ID NO: 50632 - DNA, 25 bp, E. coli
tccgtttcgatgtgcagatgagccg

SEQ ID NO: 50633 - DNA, 25 bp, E. coli
gaaccctgcccggacagtttacgga

SEQ ID NO: 50634 - DNA, 25 bp, E. coli
gaaccctgcccgcacagtttacgga

SEQ ID NO: 50635 - DNA, 25 bp, E. coli
gacaaggttgcagaggctttcggaa

SEQ ID NO: 50636 - DNA, 25 bp, E. coli
gacaaggttgcacaggctttcggaa

SEQ ID NO: 50637 - DNA, 25 bp, E. coli
gtataaagcggccatgcgaaccctg

SEQ ID NO: 50638 - DNA, 25 bp, E. coli
gtgcgctggtgtacgcctggtacca

SEQ ID NO: 50639 - DNA, 25 bp, E. coli
gtataaagcggcgatgcgaaccctg

SEQ ID NO: 50640 - DNA, 25 bp, E. coli
gtgcgctggtgttcgcctggtacca

SEQ ID NO: 50641 - DNA, 25 bp, E. coli
ggactgactgccgatcgcatgctga

SEQ ID NO: 50642 - DNA, 25 bp, E. coli
ggactgactgcccatcgcatgctga

SEQ ID NO: 50643 - DNA, 25 bp, E. coli
gagtgtcgcgcgatttgcttctgca

SEQ ID NO: 50644 - DNA, 25 bp, E. coli
gagtgtcgcgcgttttgcttctgca

SEQ ID NO: 50645 - DNA, 25 bp, E. coli
aatcatcggtatgcttgagcgtgcg

SEQ ID NO: 50646 - DNA, 25 bp, E. coli
aatcatcggtatccttgagcgtgcg

SEQ ID NO: 50647 - DNA, 25 bp, E. coli
caccggactgcgaagagatatttca

SEQ ID NO: 50648 - DNA, 25 bp, E. coli
caccggactgcgtagagatatttca

SEQ ID NO: 50649 - DNA, 25 bp, E. coli
cagaaagatctggttcggtatggac

SEQ ID NO: 50650 - DNA, 25 bp, E. coli
cagaaagatctgcttcggtatggac

SEQ ID NO: 50651 - DNA, 25 bp, E. coli
tatttcaagcgcagatctgggcgtt

SEQ ID NO: 50652 - DNA, 25 bp, E. coli
tatttcaagcgctgatctgggcgtt

SEQ ID NO: 50653 - DNA, 25 bp, E. coli
tgaccgtaccttgagcagcagaaag

SEQ ID NO: 50654 - DNA, 25 bp, E. coli
tgaccgtaccttcagcagcagaaag

SEQ ID NO: 50655 - DNA, 25 bp, E. coli
tcatgtcaccggctgaagcggcacc

SEQ ID NO: 50656 - DNA, 25 bp, E. coli
tctgccatgtgattatgaccgtacc

SEQ ID NO: 50657 - DNA, 25 bp, E. coli
tctgccatgtgaatatgaccgtacc

SEQ ID NO: 50658 - DNA, 25 bp, E. coli
tcatgtcaccgggtgaagcggcacc

SEQ ID NO: 50659 - DNA, 25 bp, E. coli
gctctgaactggatcggctgattct

SEQ ID NO: 50660 - DNA, 25 bp, E. coli
gctctgaactggttcggctgattct

SEQ ID NO: 50661 - DNA, 25 bp, E. coli
gctgattcttgaagcctggagcaac

SEQ ID NO: 50662 - DNA, 25 bp, E. coli
gctgattcttgatgcctggagcaac

SEQ ID NO: 50663 - DNA, 25 bp, E. coli
cgtcttatcagaacaaaatcatcgg

SEQ ID NO: 50664 - DNA, 25 bp, E. coli
cgtcttatcagatcaaaatcatcgg

SEQ ID NO: 50665 - DNA, 25 bp, E. coli
gagcaacgtactcggcttcatgtca

SEQ ID NO: 50666 - DNA, 25 bp, E. coli
gagcaacgtactgggcttcatgtca

SEQ ID NO: 50667 - DNA, 25 bp, E. coli
aacgtgcggcttgcagactgatgac

SEQ ID NO: 50668 - DNA, 25 bp, E. coli
caacatcaaaaatggactcggtcag

SEQ ID NO: 50669 - DNA, 25 bp, E. coli
caacatcaaaaaaggactcggtcag

SEQ ID NO: 50670 - DNA, 25 bp, E. coli
caaagtgtttgcaaggtcgagtata

SEQ ID NO: 50671 - DNA, 25 bp, E. coli
caaagtgtttgctaggtcgagtata

SEQ ID NO: 50672 - DNA, 25 bp, E. coli
tataaggaaagttacagcttcggga

SEQ ID NO: 50673 - DNA, 25 bp, E. coli
tataaggaaagtaacagcttcggga

SEQ ID NO: 50674 - DNA, 25 bp, E. coli
aacgtgcggcttccagactgatgac

SEQ ID NO: 50675 - DNA, 25 bp, E. coli
ttgtgttgtcgcacatccctggtgc

SEQ ID NO: 50676 - DNA, 25 bp, E. coli
ttgtgttgtcgctcatccctggtgc

SEQ ID NO: 50677 - DNA, 25 bp, E. coli
tctgtcgacgcatctttcaggatgt

SEQ ID NO: 50678 - DNA, 25 bp, E. coli
tctgtcgacgcaactttcaggatgt

SEQ ID NO: 50679 - DNA, 25 bp, E. coli
tctccctggaagcagaggagaaaac

SEQ ID NO: 50680 - DNA, 25 bp, E. coli
tctccctggaaggagaggagaaaac

SEQ ID NO: 50681 - DNA, 25 bp, E. coli
gcttcgggaagcgaaaaatgctgga

SEQ ID NO: 50682 - DNA, 25 bp, E. coli
gcttcgggaagccaaaaatgctgga

SEQ ID NO: 50683 - DNA, 25 bp, E. coli
gagaaaacggtggtcatgttaatga

SEQ ID NO: 50684 - DNA, 25 bp, E. coli
gagaaaacggtgctcatgttaatga

SEQ ID NO: 50685 - DNA, 25 bp, E. coli
gaacaggccagcatcggtgcgaaaa

SEQ ID NO: 50686 - DNA, 25 bp, E. coli
gaacaggccagcttcggtgcgaaaa

SEQ ID NO: 50687 - DNA, 25 bp, E. coli
taatgacagggtacacggcttaggc

SEQ ID NO: 50688 - DNA, 25 bp, E. coli
taatgacagggttcacggcttaggc

SEQ ID NO: 50689 - DNA, 25 bp, E. coli
caaaataacaaacggcaaggagaca

SEQ ID NO: 50690 - DNA, 25 bp, E. coli
caaaataacaaagggcaaggagaca

SEQ ID NO: 50691 - DNA, 25 bp, E. coli
taaatagttacacctaaacgcctga

SEQ ID NO: 50692 - DNA, 25 bp, E. coli
atgaaattccgcgaccacaagccaa

SEQ ID NO: 50693 - DNA, 25 bp, E. coli
atgaaattccgccaccacaagccaa

SEQ ID NO: 50694 - DNA, 25 bp, E. coli
aaaataagaattggccatttggcgg

SEQ ID NO: 50695 - DNA, 25 bp, E. coli
aaaataagaattcgccatttggcgg

SEQ ID NO: 50696 - DNA, 25 bp, E. coli
tattccgcccttatcctgctgagaa

SEQ ID NO: 50697 - DNA, 25 bp, E. coli
tatattggtggtaagtacgcatgca

SEQ ID NO: 50698 - DNA, 25 bp, E. coli
tatattggtggttagtacgcatgca

SEQ ID NO: 50699 - DNA, 25 bp, E. coli
tattccgcccttttcctgctgagaa

SEQ ID NO: 50700 - DNA, 25 bp, E. coli
tgagaaatcgcctcattcggcatga

SEQ ID NO: 50701 - DNA, 25 bp, E. coli
tgagaaatcgccacattcggcatga

SEQ ID NO: 50702 - DNA, 25 bp, E. coli
tgaaattacatgtcgagggcactat

SEQ ID NO: 50703 - DNA, 25 bp, E. coli
tgaaattacatgacgagggcactat

SEQ ID NO: 50704 - DNA, 25 bp, E. coli
gacaacattgtgtaacccggcatta

SEQ ID NO: 50705 - DNA, 25 bp, E. coli
gacaacattgtgaaacccggcatta

SEQ ID NO: 50706 - DNA, 25 bp, E. coli
tggcggtggccattctacagagatg

SEQ ID NO: 50707 - DNA, 25 bp, E. coli
tggcggtggccaatctacagagatg

SEQ ID NO: 50708 - DNA, 25 bp, E. coli
taagcacaaatacccaacacgtcct

SEQ ID NO: 50709 - DNA, 25 bp, E. coli
taagcacaaatagccaacacgtcct

SEQ ID NO: 50710 - DNA, 25 bp, E. coli
taaatagttacagctaaacgcctga

SEQ ID NO: 50711 - DNA, 25 bp, E. coli
cactgtacggcaggcggcaaatttg

SEQ ID NO: 50712 - DNA, 25 bp, E. coli
caaatttgtctgaaatgatggttct

SEQ ID NO: 50713 - DNA, 25 bp, E. coli
cactgtacggcacgcggcaaatttg

SEQ ID NO: 50714 - DNA, 25 bp, E. coli
caaatttgtctgtaatgatggttct

SEQ ID NO: 50715 - DNA, 25 bp, E. coli
catcgaaaaaaagatgcactaactg

SEQ ID NO: 50716 - DNA, 25 bp, E. coli
catcgaaaaaaacatgcactaactg

SEQ ID NO: 50717 - DNA, 25 bp, E. coli
ttttatgccgatgccgggcgcaaac

SEQ ID NO: 50718 - DNA, 25 bp, E. coli
ttttatgccgatcccgggcgcaaac

SEQ ID NO: 50719 - DNA, 25 bp, E. coli
tccttttatgccgatgccgggcgca

SEQ ID NO: 50720 - DNA, 25 bp, E. coli
tgccgggcgcaaaccctgttctggt

SEQ ID NO: 50721 - DNA, 25 bp, E. coli
tccttttatgcccatgccgggcgca

SEQ ID NO: 50722 - DNA, 25 bp, E. coli
tgccgggcgcaatccctgttctggt

SEQ ID NO: 50723 - DNA, 25 bp, E. coli
tctggttcgaaaggggggatctcac

SEQ ID NO: 50724 - DNA, 25 bp, E. coli
tctggttcgaaacgggggatctcac

SEQ ID NO: 50725 - DNA, 25 bp, E. coli
gcaaaccctgttgtggttcgaaagg

SEQ ID NO: 50726 - DNA, 25 bp, E. coli
gcaaaccctgttctggttcgaaagg

SEQ ID NO: 50727 - DNA, 25 bp, E. coli
cggcaggcggcatatttgtctgtaa

SEQ ID NO: 50728 - DNA, 25 bp, E. coli
cggcaggcggcaaatttgtctgtaa

SEQ ID NO: 50729 - DNA, 25 bp, E. coli
gggatctcacactgtacggcaggcg

SEQ ID NO: 50730 - DNA, 25 bp, E. coli
gggatctcacacagtacggcaggcg

SEQ ID NO: 50731 - DNA, 25 bp, E. coli
gatggttctatttgtgcatcgaaaa

SEQ ID NO: 50732 - DNA, 25 bp, E. coli
gatggttctattagtgcatcgaaaa

SEQ ID NO: 50733 - DNA, 25 bp, E. coli
caaacgggtggatgaatccctgtcc

SEQ ID NO: 50734 - DNA, 25 bp, E. coli
cacttgagcagatggcagaacaggg

SEQ ID NO: 50735 - DNA, 25 bp, E. coli
caaacgggtggaagaatccctgtcc

SEQ ID NO: 50736 - DNA, 25 bp, E. coli
cacttgagcagaaggcagaacaggg

SEQ ID NO: 50737 - DNA, 25 bp, E. coli
catgcggcaaacagtcgggtaaacc

SEQ ID NO: 50738 - DNA, 25 bp, E. coli
catgcggcaaactgtcgggtaaacc

SEQ ID NO: 50739 - DNA, 25 bp, E. coli
aaagcatggcccctgattgaaggca

SEQ ID NO: 50740 - DNA, 25 bp, E. coli
aaagcatggcccgtgattgaaggca

SEQ ID NO: 50741 - DNA, 25 bp, E. coli
tatgccgcgccgcattgagttcact

SEQ ID NO: 50742 - DNA, 25 bp, E. coli
tatgccgcgccggattgagttcact

SEQ ID NO: 50743 - DNA, 25 bp, E. coli
tccacgcagtttctgggaccggaca

SEQ ID NO: 50744 - DNA, 25 bp, E. coli
tccacgcagtttgtgggaccggaca

SEQ ID NO: 50745 - DNA, 25 bp, E. coli
tcttatgccggagataacaggtggc

SEQ ID NO: 50746 - DNA, 25 bp, E. coli
tcttatgccggacataacaggtggc

SEQ ID NO: 50747 - DNA, 25 bp, E. coli
gaaggcagcggctcaatttatggca

SEQ ID NO: 50748 - DNA, 25 bp, E. coli
gaaggcagcggcacaatttatggca

SEQ ID NO: 50749 - DNA, 25 bp, E. coli
cggtgatctccgttcgcagctgaat

SEQ ID NO: 50750 - DNA, 25 bp, E. coli
cggtgatctccgatcgcagctgaat

SEQ ID NO: 50751 - DNA, 25 bp, E. coli
taagcgatatcagtaaaacggtggg

SEQ ID NO: 50752 - DNA, 25 bp, E. coli
taagcgatatcactaaaacggtggg

SEQ ID NO: 50753 - DNA, 25 bp, E. coli
gagttcactctgacgctcaaacggg

SEQ ID NO: 50754 - DNA, 25 bp, E. coli
gagttcactctgtcgctcaaacggg

SEQ ID NO: 50755 - DNA, 25 bp, E. coli
caagggtgactaaaggttctgaaac

SEQ ID NO: 50756 - DNA, 25 bp, E. coli
caagggtgactataggttctgaaac

SEQ ID NO: 50757 - DNA, 25 bp, E. coli
caggcagtcggttgtggccactatc

SEQ ID NO: 50758 - DNA, 25 bp, E. coli
caggcagtcggtagtggccactatc

SEQ ID NO: 50759 - DNA, 25 bp, E. coli
tactggctgcagatcacgttataca

SEQ ID NO: 50760 - DNA, 25 bp, E. coli
tactggctgcagttcacgttataca

SEQ ID NO: 50761 - DNA, 25 bp, E. coli
tagtttctggaactgcaagggtgac

SEQ ID NO: 50762 - DNA, 25 bp, E. coli
tagtttctggaagtgcaagggtgac

SEQ ID NO: 50763 - DNA, 25 bp, E. coli
ttaaaaattcaggtcgtagcgagca

SEQ ID NO: 50764 - DNA, 25 bp, E. coli
ttaaaaattcagctcgtagcgagca

SEQ ID NO: 50765 - DNA, 25 bp, E. coli
gaatatcatcctagagcctgttggg

SEQ ID NO: 50766 - DNA, 25 bp, E. coli
gaatatcatccttgagcctgttggg

SEQ ID NO: 50767 - DNA, 25 bp, E. coli
ccgaatcgggaattgttgctacagt

SEQ ID NO: 50768 - DNA, 25 bp, E. coli
ccgaatcgggaaatgttgctacagt

SEQ ID NO: 50769 - DNA, 25 bp, E. coli
gataaagactcacacggcaacgtaa

SEQ ID NO: 50770 - DNA, 25 bp, E. coli
gataaagactcagacggcaacgtaa

SEQ ID NO: 50771 - DNA, 25 bp, E. coli
taatacactgctaggaaaatccagg

SEQ ID NO: 50772 - DNA, 25 bp, E. coli
taatacactgcttggaaaatccagg

SEQ ID NO: 50773 - DNA, 25 bp, E. coli
taacgctgttagatcggcaattcca

SEQ ID NO: 50774 - DNA, 25 bp, E. coli
taacgctgttagttcggcaattcca

SEQ ID NO: 50775 - DNA, 25 bp, E. coli
gatgatcttatggtcgtactggctg

SEQ ID NO: 50776 - DNA, 25 bp, E. coli
gatgatcttatgctcgtactggctg

SEQ ID NO: 50777 - DNA, 25 bp, E. coli
catagatgctacgaatattattgga

SEQ ID NO: 50778 - DNA, 25 bp, E. coli
catagatgctaccaatattattgga

SEQ ID NO: 50779 - DNA, 25 bp, E. coli
tatcgttggtttagttgccagcagg

SEQ ID NO: 50780 - DNA, 25 bp, E. coli
tagttgccagcaggtattatatcgc

SEQ ID NO: 50781 - DNA, 25 bp, E. coli
tatcgttggttttgttgccagcagg

SEQ ID NO: 50782 - DNA, 25 bp, E. coli
tagttgccagcacgtattatatcgc

SEQ ID NO: 50783 - DNA, 25 bp, E. coli
tattatatcgccttagatgctacga

SEQ ID NO: 50784 - DNA, 25 bp, E. coli
tattatatcgccatagatgctacga

SEQ ID NO: 50785 - DNA, 25 bp, E. coli
ttatatggaaccagatcccacgcct

SEQ ID NO: 50786 - DNA, 25 bp, E. coli
ttatatggaacctgatcccacgcct

SEQ ID NO: 50787 - DNA, 25 bp, E. coli
tcacttaccggaggttatatggaac

SEQ ID NO: 50788 - DNA, 25 bp, E. coli
tcacttaccggacgttatatggaac

SEQ ID NO: 50789 - DNA, 25 bp, E. coli
gcctctccctcgtcggagattaaaa

SEQ ID NO: 50790 - DNA, 25 bp, E. coli
gcctctccctcgacggagattaaaa

SEQ ID NO: 50791 - DNA, 25 bp, E. coli
gcggcgcttttttcacttaccggag

SEQ ID NO: 50792 - DNA, 25 bp, E. coli
gcattcagcaatcggtaaactctgg

SEQ ID NO: 50793 - DNA, 25 bp, E. coli
gcggcgctttttacacttaccggag

SEQ ID NO: 50794 - DNA, 25 bp, E. coli
gcattcagcaatgggtaaactctgg

SEQ ID NO: 50795 - DNA, 25 bp, E. coli
ggattctccttattatttgcggcgc

SEQ ID NO: 50796 - DNA, 25 bp, E. coli
ggattctccttaatatttgcggcgc

SEQ ID NO: 50797 - DNA, 25 bp, E. coli
tgggtaaactctcgtttatcgttgg

SEQ ID NO: 50798 - DNA, 25 bp, E. coli
tgggtaaactctggtttatcgttgg

SEQ ID NO: 50799 - DNA, 25 bp, E. coli
aaacgtgcgcgatctggaacatgct

SEQ ID NO: 50800 - DNA, 25 bp, E. coli
aaacgtgcgcgaactggaacatgct

SEQ ID NO: 50801 - DNA, 25 bp, E. coli
ttccgggaaacgtgcgcgaactgga

SEQ ID NO: 50802 - DNA, 25 bp, E. coli
ttccgggaaacgagcgcgaactgga

SEQ ID NO: 50803 - DNA, 25 bp, E. coli
ttttccgggaaacgtgcgcgaactg

SEQ ID NO: 50804 - DNA, 25 bp, E. coli
ttttccgggaaaggtgcgcgaactg

SEQ ID NO: 50805 - DNA, 25 bp, E. coli
gcgccgatttgtatcatcgcctgag

SEQ ID NO: 50806 - DNA, 25 bp, E. coli
gcgccgatttgtttcatcgcctgag

SEQ ID NO: 50807 - DNA, 25 bp, E. coli
gaaacgtgcgcgtactggaacatgc

SEQ ID NO: 50808 - DNA, 25 bp, E. coli
gaaacgtgcgcgaactggaacatgc

SEQ ID NO: 50809 - DNA, 25 bp, E. coli
ctggcagggcgattccgcgccgatt

SEQ ID NO: 50810 - DNA, 25 bp, E. coli
ctggcagggcgaatccgcgccgatt

SEQ ID NO: 50811 - DNA, 25 bp, E. coli
gatctcaacgtcctgatcagcggtg

SEQ ID NO: 50812 - DNA, 25 bp, E. coli
gattccgcgccgttttgtttcatcg

SEQ ID NO: 50813 - DNA, 25 bp, E. coli
gatctcaacgtcgtgatcagcggtg

SEQ ID NO: 50814 - DNA, 25 bp, E. coli
gattccgcgccgatttgtttcatcg

SEQ ID NO: 50815 - DNA, 25 bp, E. coli
tggcggcgtccgatctcaacgtcct

SEQ ID NO: 50816 - DNA, 25 bp, E. coli
ggcgtccgatctcaacgtcctgatc

SEQ ID NO: 50817 - DNA, 25 bp, E. coli
tggcggcgtccgttctcaacgtcct

SEQ ID NO: 50818 - DNA, 25 bp, E. coli
ggcgtccgatctgaacgtcctgatc

SEQ ID NO: 50819 - DNA, 25 bp, E. coli
tcaacgtcctgatcagcggtgagac

SEQ ID NO: 50820 - DNA, 25 bp, E. coli
tcaacgtcctgaacagcggtgagac

SEQ ID NO: 50821 - DNA, 25 bp, E. coli
caaaatatctcaccgcagatccgcg

SEQ ID NO: 50822 - DNA, 25 bp, E. coli
caactgacgctgttcaccgatgaag

SEQ ID NO: 50823 - DNA, 25 bp, E. coli
caaaatatctcagcgcagatccgcg

SEQ ID NO: 50824 - DNA, 25 bp, E. coli
caactgacgctgatcaccgatgaag

SEQ ID NO: 50825 - DNA, 25 bp, E. coli
taaagaattatggtgcggcgggtaa

SEQ ID NO: 50826 - DNA, 25 bp, E. coli
taaagaattatgctgcggcgggtaa

SEQ ID NO: 50827 - DNA, 25 bp, E. coli
tacggctggttctctcgtgggatac

SEQ ID NO: 50828 - DNA, 25 bp, E. coli
aaatgcagtttttctcaacgccggg

SEQ ID NO: 50829 - DNA, 25 bp, E. coli
aaatgcagttttactcaacgccggg

SEQ ID NO: 50830 - DNA, 25 bp, E. coli
tacggctggttcactcgtgggatac

SEQ ID NO: 50831 - DNA, 25 bp, E. coli
tattgtaccgatccgtaatgctggc

SEQ ID NO: 50832 - DNA, 25 bp, E. coli
tattgtaccgatgcgtaatgctggc

SEQ ID NO: 50833 - DNA, 25 bp, E. coli
ttcactgaaggcagcaacagcgtgc

SEQ ID NO: 50834 - DNA, 25 bp, E. coli
ttcactgaaggctgcaacagcgtgc

SEQ ID NO: 50835 - DNA, 25 bp, E. coli
cgtgggatacggtcaataccgacct

SEQ ID NO: 50836 - DNA, 25 bp, E. coli
cgtgggatacggacaataccgacct

SEQ ID NO: 50837 - DNA, 25 bp, E. coli
gtaacaccgtgctgaaaaacagtgg

SEQ ID NO: 50838 - DNA, 25 bp, E. coli
gtaacaccgtgcagaaaaacagtgg

SEQ ID NO: 50839 - DNA, 25 bp, E. coli
ggcgtcgtccgtcaacatggcagat

SEQ ID NO: 50840 - DNA, 25 bp, E. coli
ggcgtcgtccgtgaacatggcagat

SEQ ID NO: 50841 - DNA, 25 bp, E. coli
tcaacggtgccactatgccgcagag

SEQ ID NO: 50842 - DNA, 25 bp, E. coli
tcaacggtgccagtatgccgcagag

SEQ ID NO: 50843 - DNA, 25 bp, E. coli
caaaaaagccactggatgagcgtac

SEQ ID NO: 50844 - DNA, 25 bp, E. coli
caaaaaagccacaggatgagcgtac

SEQ ID NO: 50845 - DNA, 25 bp, E. coli
atgagcgtacacatcaccagccagg

SEQ ID NO: 50846 - DNA, 25 bp, E. coli
atgagcgtacacttcaccagccagg

SEQ ID NO: 50847 - DNA, 25 bp, E. coli
ttgtctgggcgctgtacaataagct

SEQ ID NO: 50848 - DNA, 25 bp, E. coli
ttgtctgggcgcagtacaataagct

SEQ ID NO: 50849 - DNA, 25 bp, E. coli
tcatgcagcctaccaatatacgccg

SEQ ID NO: 50850 - DNA, 25 bp, E. coli
tctattttttgctggcagtggcgaa

SEQ ID NO: 50851 - DNA, 25 bp, E. coli
tctattttttgcaggcagtggcgaa

SEQ ID NO: 50852 - DNA, 25 bp, E. coli
tcatgcagcctagcaatatacgccg

SEQ ID NO: 50853 - DNA, 25 bp, E. coli
gcgaggccagaagccgacttcagtt

SEQ ID NO: 50854 - DNA, 25 bp, E. coli
gcgaggccagaacccgacttcagtt

SEQ ID NO: 50855 - DNA, 25 bp, E. coli
gaatgccgtcgtcttaattgtctgg

SEQ ID NO: 50856 - DNA, 25 bp, E. coli
gaatgccgtcgtgttaattgtctgg

SEQ ID NO: 50857 - DNA, 25 bp, E. coli
cgggttattactggcaaagcgaggc

SEQ ID NO: 50858 - DNA, 25 bp, E. coli
cgggttattactcgcaaagcgaggc

SEQ ID NO: 50859 - DNA, 25 bp, E. coli
tcaaaaacagcagcatcatgcagcc

SEQ ID NO: 50860 - DNA, 25 bp, E. coli
tcaaaaacagcaccatcatgcagcc

SEQ ID NO: 50861 - DNA, 25 bp, E. coli
gatgagctctatcagcaactacaaa

SEQ ID NO: 50862 - DNA, 25 bp, E. coli
gagagcttagcattacctgatgagc

SEQ ID NO: 50863 - DNA, 25 bp, E. coli
gagagcttagcaatacctgatgagc

SEQ ID NO: 50864 - DNA, 25 bp, E. coli
gatgagctctatgagcaactacaaa

SEQ ID NO: 50865 - DNA, 25 bp, E. coli
taaatgatgaaaaagtgatgacgcc

SEQ ID NO: 50866 - DNA, 25 bp, E. coli
taaatgatgaaatagtgatgacgcc

SEQ ID NO: 50867 - DNA, 25 bp, E. coli
tactggtgcgcgtaagtctgatggc

SEQ ID NO: 50868 - DNA, 25 bp, E. coli
tactggtgcgcgaaagtctgatggc

SEQ ID NO: 50869 - DNA, 25 bp, E. coli
gctcagcagctgcagtacgattact

SEQ ID NO: 50870 - DNA, 25 bp, E. coli
gcgcacatggttaacgccgcggtgt

SEQ ID NO: 50871 - DNA, 25 bp, E. coli
gcgcacatggtttacgccgcggtgt

SEQ ID NO: 50872 - DNA, 25 bp, E. coli
gctcagcagctggagtacgattact

SEQ ID NO: 50873 - DNA, 25 bp, E. coli
cgccgcggtgtctctcagtatttaa

SEQ ID NO: 50874 - DNA, 25 bp, E. coli
cgccgcggtgtcactcagtatttaa

SEQ ID NO: 50875 - DNA, 25 bp, E. coli
ccgcagaagaggtctaccatgaaat

SEQ ID NO: 50876 - DNA, 25 bp, E. coli
ccgcagaagaggactaccatgaaat

SEQ ID NO: 50877 - DNA, 25 bp, E. coli
cggtgctgaaccctgaaaactttag

SEQ ID NO: 50878 - DNA, 25 bp, E. coli
cgcgaaataccctttcttagtgatg

SEQ ID NO: 50879 - DNA, 25 bp, E. coli
cgcggccgctactggcttaatttga

SEQ ID NO: 50880 - DNA, 25 bp, E. coli
cggtgctgaaccgtgaaaactttag

SEQ ID NO: 50881 - DNA, 25 bp, E. coli
cgcggccgctacaggcttaatttga

SEQ ID NO: 50882 - DNA, 25 bp, E. coli
cgcgaaatacccattcttagtgatg

SEQ ID NO: 50883 - DNA, 25 bp, E. coli
tcagcaagcgcgtaaaagaaattct

SEQ ID NO: 50884 - DNA, 25 bp, E. coli
tcagcaagcgcgaaaaagaaattct

SEQ ID NO: 50885 - DNA, 25 bp, E. coli
gatgacgccagacatgaatttcagc

SEQ ID NO: 50886 - DNA, 25 bp, E. coli
gatgacgccagagatgaatttcagc

SEQ ID NO: 50887 - DNA, 25 bp, E. coli
caaaagccgaaatacgagccagagc

SEQ ID NO: 50888 - DNA, 25 bp, E. coli
caaaagccgaaaaacgagccagagc

SEQ ID NO: 50889 - DNA, 25 bp, E. coli
cagtatctggctcttccggaatgac

SEQ ID NO: 50890 - DNA, 25 bp, E. coli
cagtatctggctgttccggaatgac

SEQ ID NO: 50891 - DNA, 25 bp, E. coli
aaaaccccgatggacgcttgatcag

SEQ ID NO: 50892 - DNA, 25 bp, E. coli
aaaaccccgatgcacgcttgatcag

SEQ ID NO: 50893 - DNA, 25 bp, E. coli
aaaaacatcacgttgccgcatggcg

SEQ ID NO: 50894 - DNA, 25 bp, E. coli
aaaaacatcacgatgccgcatggcg

SEQ ID NO: 50895 - DNA, 25 bp, E. coli
tgccagccttctgagttaaccgatg

SEQ ID NO: 50896 - DNA, 25 bp, E. coli
tgccagccttctcagttaaccgatg

SEQ ID NO: 50897 - DNA, 25 bp, E. coli
tccggaatgactgatggcagaccat

SEQ ID NO: 50898 - DNA, 25 bp, E. coli
tccggaatgactcatggcagaccat

SEQ ID NO: 50899 - DNA, 25 bp, E. coli
gccttacccgtgaacagtactgtga

SEQ ID NO: 50900 - DNA, 25 bp, E. coli
gccttacccgtgtacagtactgtga

SEQ ID NO: 50901 - DNA, 25 bp, E. coli
gtttaaatccctccgccagtggccg

SEQ ID NO: 50902 - DNA, 25 bp, E. coli
gtttaaatccctgcgccagtggccg

SEQ ID NO: 50903 - DNA, 25 bp, E. coli
ggtatccggatgagctgccagcctt

SEQ ID NO: 50904 - DNA, 25 bp, E. coli
ggtatccggatgtgctgccagcctt

SEQ ID NO: 50905 - DNA, 25 bp, E. coli
gagccagagcacgagaaattattcc

SEQ ID NO: 50906 - DNA, 25 bp, E. coli
gaccattgtcggatgagcctgtcac

SEQ ID NO: 50907 - DNA, 25 bp, E. coli
gagccagagcaccagaaattattcc

SEQ ID NO: 50908 - DNA, 25 bp, E. coli
gaccattgtcggttgagcctgtcac

SEQ ID NO: 50909 - DNA, 25 bp, E. coli
cacaaaaagccgttaacgatctcaa

SEQ ID NO: 50910 - DNA, 25 bp, E. coli
cacaaaaagccgataacgatctcaa

SEQ ID NO: 50911 - DNA, 25 bp, E. coli
catgatattgatcaggcgctacggc

SEQ ID NO: 50912 - DNA, 25 bp, E. coli
catgatattgatgaggcgctacggc

SEQ ID NO: 50913 - DNA, 25 bp, E. coli
ttagccatgtcagcaaactgttcgg

SEQ ID NO: 50914 - DNA, 25 bp, E. coli
ttagccatgtcaccaaactgttcgg

SEQ ID NO: 50915 - DNA, 25 bp, E. coli
gcggcacgctgctttttcaggatct

SEQ ID NO: 50916 - DNA, 25 bp, E. coli
gcggcacgctgcattttcaggatct

SEQ ID NO: 50917 - DNA, 25 bp, E. coli
gcaattacaaaattggtcgcgggcg

SEQ ID NO: 50918 - DNA, 25 bp, E. coli
gcaattacaaaaatggtcgcgggcg

SEQ ID NO: 50919 - DNA, 25 bp, E. coli
gaacatctggtattgatggatcacg

SEQ ID NO: 50920 - DNA, 25 bp, E. coli
gaacatctggtaatgatggatcacg

SEQ ID NO: 50921 - DNA, 25 bp, E. coli
cgttgcaacaagtgatgacgcgcat

SEQ ID NO: 50922 - DNA, 25 bp, E. coli
cgttgcaacaagagatgacgcgcat

SEQ ID NO: 50923 - DNA, 25 bp, E. coli
cggattacgtgcctcgcgaagaacg

SEQ ID NO: 50924 - DNA, 25 bp, E. coli
cggattacgtgcgtcgcgaagaacg

SEQ ID NO: 50925 - DNA, 25 bp, E. coli
gatcgtatcgaccaattaatggcgc

SEQ ID NO: 50926 - DNA, 25 bp, E. coli
ggagaagaaattcgctcgctgccag

SEQ ID NO: 50927 - DNA, 25 bp, E. coli
ggagaagaaattggctcgctgccag

SEQ ID NO: 50928 - DNA, 25 bp, E. coli
gatcgtatcgacgaattaatggcgc

SEQ ID NO: 50929 - DNA, 25 bp, E. coli
gagatgacgcgctttcaccgtttgc

SEQ ID NO: 50930 - DNA, 25 bp, E. coli
gagatgacgcgcattcaccgtttgc

SEQ ID NO: 50931 - DNA, 25 bp, E. coli
aattttgctgcacgcttcagcggcg

SEQ ID NO: 50932 - DNA, 25 bp, E. coli
aattttgctgcaggcttcagcggcg

SEQ ID NO: 50933 - DNA, 25 bp, E. coli
cagtactgagctcgttgctggcaaa

SEQ ID NO: 50934 - DNA, 25 bp, E. coli
cagagagtcagtgcgctgcgagcta

SEQ ID NO: 50935 - DNA, 25 bp, E. coli
cagagagtcagtccgctgcgagcta

SEQ ID NO: 50936 - DNA, 25 bp, E. coli
gcattaaccccggaaattggtgccg

SEQ ID NO: 50937 - DNA, 25 bp, E. coli
gcattaaccccgcaaattggtgccg

SEQ ID NO: 50938 - DNA, 25 bp, E. coli
cagtactgagctggttgctggcaaa

SEQ ID NO: 50939 - DNA, 25 bp, E. coli
tactggcgaacaccttgagcaacct

SEQ ID NO: 50940 - DNA, 25 bp, E. coli
tactggcgaacagcttgagcaacct

SEQ ID NO: 50941 - DNA, 25 bp, E. coli
gccagtgcgccgatattgccaaagt

SEQ ID NO: 50942 - DNA, 25 bp, E. coli
gccagtgcgccgttattgccaaagt

SEQ ID NO: 50943 - DNA, 25 bp, E. coli
gaatatgcgtctcgtggcacccgca

SEQ ID NO: 50944 - DNA, 25 bp, E. coli
gaatatgcgtctggtggcacccgca

SEQ ID NO: 50945 - DNA, 25 bp, E. coli
gattaatcggtaacgccattctcgc

SEQ ID NO: 50946 - DNA, 25 bp, E. coli
gattaatcggtatcgccattctcgc

SEQ ID NO: 50947 - DNA, 25 bp, E. coli
gggcatgttttctcacccagtgatg

SEQ ID NO: 50948 - DNA, 25 bp, E. coli
gtcgttccgggatttatcatggcca

SEQ ID NO: 50949 - DNA, 25 bp, E. coli
gtcgttccgggaattatcatggcca

SEQ ID NO: 50950 - DNA, 25 bp, E. coli
gggcatgttttcacacccagtgatg

SEQ ID NO: 50951 - DNA, 25 bp, E. coli
taattatccagcaggtgtctgcggg

SEQ ID NO: 50952 - DNA, 25 bp, E. coli
taattatccagctggtgtctgcggg

SEQ ID NO: 50953 - DNA, 25 bp, E. coli
catttaatccgccactacgccggga

SEQ ID NO: 50954 - DNA, 25 bp, E. coli
caggcactggcttttgttgaagagg

SEQ ID NO: 50955 - DNA, 25 bp, E. coli
catgaaccggaccatggagaaatca

SEQ ID NO: 50956 - DNA, 25 bp, E. coli
catgaaccggacgatggagaaatca

SEQ ID NO: 50957 - DNA, 25 bp, E. coli
catttaatccgcgactacgccggga

SEQ ID NO: 50958 - DNA, 25 bp, E. coli
caggcactggctattgttgaagagg

SEQ ID NO: 50959 - DNA, 25 bp, E. coli
tatgcgcacgtagaaattgccggac

SEQ ID NO: 50960 - DNA, 25 bp, E. coli
tatccatgatgtacaccgaagtgcc

SEQ ID NO: 50961 - DNA, 25 bp, E. coli
tatccatgatgttcaccgaagtgcc

SEQ ID NO: 50962 - DNA, 25 bp, E. coli
tatgcgcacgtacaaattgccggac

SEQ ID NO: 50963 - DNA, 25 bp, E. coli
taccgctcccggagatattaatgcg

SEQ ID NO: 50964 - DNA, 25 bp, E. coli
taccgctcccggtgatattaatgcg

SEQ ID NO: 50965 - DNA, 25 bp, E. coli
ttttattgaacgcttcgccgcagcg

SEQ ID NO: 50966 - DNA, 25 bp, E. coli
ttttattgaacggttcgccgcagcg

SEQ ID NO: 50967 - DNA, 25 bp, E. coli
tgccggactaccagatcgacatgaa

SEQ ID NO: 50968 - DNA, 25 bp, E. coli
tgccggactacctgatcgacatgaa

SEQ ID NO: 50969 - DNA, 25 bp, E. coli
gcagacatcgacctggcactggaat

SEQ ID NO: 50970 - DNA, 25 bp, E. coli
gcagacatcgacgtggcactggaat

SEQ ID NO: 50971 - DNA, 25 bp, E. coli
cgaagatgctgatcggtaccgggca

SEQ ID NO: 50972 - DNA, 25 bp, E. coli
cgaagatgctgaacggtaccgggca

SEQ ID NO: 50973 - DNA, 25 bp, E. coli
ggagaaatcaactatccgtggctgt

SEQ ID NO: 50974 - DNA, 25 bp, E. coli
ggagaaatcaacaatccgtggctgt

SEQ ID NO: 50975 - DNA, 25 bp, E. coli
catggttatcacagacctgcccggg

SEQ ID NO: 50976 - DNA, 25 bp, E. coli
catggttatcactgacctgcccggg

SEQ ID NO: 50977 - DNA, 25 bp, E. coli
atgaagccctgttccgtgacattct

SEQ ID NO: 50978 - DNA, 25 bp, E. coli
atgaagccctgtaccgtgacattct

SEQ ID NO: 50979 - DNA, 25 bp, E. coli
acagcatggttatcactgacctgcc

SEQ ID NO: 50980 - DNA, 25 bp, E. coli
acagcatggttaacactgacctgcc

SEQ ID NO: 50981 - DNA, 25 bp, E. coli
tatcactgacctgcccggggtgggc

SEQ ID NO: 50982 - DNA, 25 bp, E. coli
tatcactgacctccccggggtgggc

SEQ ID NO: 50983 - DNA, 25 bp, E. coli
tgcagagtatgaagccctgtaccgt

SEQ ID NO: 50984 - DNA, 25 bp, E. coli
tgcagagtatgatgccctgtaccgt

SEQ ID NO: 50985 - DNA, 25 bp, E. coli
gacagggatgcagagtatgaagccc

SEQ ID NO: 50986 - DNA, 25 bp, E. coli
gacagggatgcacagtatgaagccc

SEQ ID NO: 50987 - DNA, 25 bp, E. coli
gtatgaagccctgtaccgtgacatt

SEQ ID NO: 50988 - DNA, 25 bp, E. coli
gggatgcagagtttgaagccctgta

SEQ ID NO: 50989 - DNA, 25 bp, E. coli
gggtgggcgagagccgggacaggga

SEQ ID NO: 50990 - DNA, 25 bp, E. coli
gggtgggcgagacccgggacaggga

SEQ ID NO: 50991 - DNA, 25 bp, E. coli
gtatgaagccctctaccgtgacatt

SEQ ID NO: 50992 - DNA, 25 bp, E. coli
gggatgcagagtatgaagccctgta

SEQ ID NO: 50993 - DNA, 25 bp, E. coli
gagtatgaagccctgtaccgtgaca

SEQ ID NO: 50994 - DNA, 25 bp, E. coli
gatgcagagtatcaagccctgtacc

SEQ ID NO: 50995 - DNA, 25 bp, E. coli
gatgcagagtatgaagccctgtacc

SEQ ID NO: 50996 - DNA, 25 bp, E. coli
gagtatgaagccgtgtaccgtgaca

SEQ ID NO: 50997 - DNA, 25 bp, E. coli
cacgtttcgcggttctcgccagcgg

SEQ ID NO: 50998 - DNA, 25 bp, E. coli
cacgtttcgcggatctcgccagcgg

SEQ ID NO: 50999 - DNA, 25 bp, E. coli
atgcttttgccatcgctgccgcctt

SEQ ID NO: 51000 - DNA, 25 bp, E. coli
atgcttttgccaacgctgccgcctt

SEQ ID NO: 51001 - DNA, 25 bp, E. coli
tagcggaacgtatcggcattcgaga

SEQ ID NO: 51002 - DNA, 25 bp, E. coli
tagcggaacgtaacggcattcgaga

SEQ ID NO: 51003 - DNA, 25 bp, E. coli
tgccgccttccgagctgggcattcg

SEQ ID NO: 51004 - DNA, 25 bp, E. coli
tgccgccttccgtgctgggcattcg

SEQ ID NO: 51005 - DNA, 25 bp, E. coli
ccttgcggcagcttcgttgcgtgaa

SEQ ID NO: 51006 - DNA, 25 bp, E. coli
ccttgcggcagcatcgttgcgtgaa

SEQ ID NO: 51007 - DNA, 25 bp, E. coli
gactggtagcggtacgtaacggcat

SEQ ID NO: 51008 - DNA, 25 bp, E. coli
gactggtagcggaacgtaacggcat

SEQ ID NO: 51009 - DNA, 25 bp, E. coli
ccgtgctgggcaatcgtctgcaaaa

SEQ ID NO: 51010 - DNA, 25 bp, E. coli
ccgtgctgggcattcgtctgcaaaa

SEQ ID NO: 51011 - DNA, 25 bp, E. coli
cttgatgcgcttattcctgtcgcca

SEQ ID NO: 51012 - DNA, 25 bp, E. coli
cggttctcgccaccggcagtttctt

SEQ ID NO: 51013 - DNA, 25 bp, E. coli
cttgatgcgctttttcctgtcgcca

SEQ ID NO: 51014 - DNA, 25 bp, E. coli
cggttctcgccagcggcagtttctt

SEQ ID NO: 51015 - DNA, 25 bp, E. coli
tggccgctgttagttgatgcgctta

SEQ ID NO: 51016 - DNA, 25 bp, E. coli
tggccgctgttacttgatgcgctta

SEQ ID NO: 51017 - DNA, 25 bp, E. coli
tcactgatgcttttgccaacgctgc

SEQ ID NO: 51018 - DNA, 25 bp, E. coli
tcactgatgcttatgccaacgctgc

SEQ ID NO: 51019 - DNA, 25 bp, E. coli
catttaatgacacggtctcggagct

SEQ ID NO: 51020 - DNA, 25 bp, E. coli
tacggtgagtcaacgcaacttggca

SEQ ID NO: 51021 - DNA, 25 bp, E. coli
tacggtgagtcatcgcaacttggca

SEQ ID NO: 51022 - DNA, 25 bp, E. coli
ttaatcctttcgtctgacagtggcg

SEQ ID NO: 51023 - DNA, 25 bp, E. coli
ttaatcctttcgactgacagtggcg

SEQ ID NO: 51024 - DNA, 25 bp, E. coli
tctgcgtaaccttctggaacacggg

SEQ ID NO: 51025 - DNA, 25 bp, E. coli
tctgcgtaacctactggaacacggg

SEQ ID NO: 51026 - DNA, 25 bp, E. coli
gactacgactttgcttgcacttggg

SEQ ID NO: 51027 - DNA, 25 bp, E. coli
gactacgactttccttgcacttggg

SEQ ID NO: 51028 - DNA, 25 bp, E. coli
catttaatgacagggtctcggagct

SEQ ID NO: 51029 - DNA, 25 bp, E. coli
gatattctgattaccgggcatgccc

SEQ ID NO: 51030 - DNA, 25 bp, E. coli
gataaggttgacctcaccgtggcgc

SEQ ID NO: 51031 - DNA, 25 bp, E. coli
gatcttgtacgcgaaccagtcggtg

SEQ ID NO: 51032 - DNA, 25 bp, E. coli
gatattctgatttccgggcatgccc

SEQ ID NO: 51033 - DNA, 25 bp, E. coli
gataaggttgacgtcaccgtggcgc

SEQ ID NO: 51034 - DNA, 25 bp, E. coli
gagaaacccttctggaacaagccct

SEQ ID NO: 51035 - DNA, 25 bp, E. coli
gacggaaaacgccacattggtggct

SEQ ID NO: 51036 - DNA, 25 bp, E. coli
gatgctggagactatttcaccgggc

SEQ ID NO: 51037 - DNA, 25 bp, E. coli
gatgctggagacaatttcaccgggc

SEQ ID NO: 51038 - DNA, 25 bp, E. coli
gagaaacccttcaggaacaagccct

SEQ ID NO: 51039 - DNA, 25 bp, E. coli
gacggaaaacgcgacattggtggct

SEQ ID NO: 51040 - DNA, 25 bp, E. coli
gatcttgtacgccaaccagtcggtg

SEQ ID NO: 51041 - DNA, 25 bp, E. coli
caaaccgaagcgatatattgccagc

SEQ ID NO: 51042 - DNA, 25 bp, E. coli
caaaccgaagcgttatattgccagc

SEQ ID NO: 51043 - DNA, 25 bp, E. coli
tacgatgcagaagcgtcaaccaggc

SEQ ID NO: 51044 - DNA, 25 bp, E. coli
actggcagtgcgtggtgcattacga

SEQ ID NO: 51045 - DNA, 25 bp, E. coli
actggcagtgcgaggtgcattacga

SEQ ID NO: 51046 - DNA, 25 bp, E. coli
tacgatgcagaaccgtcaaccaggc

SEQ ID NO: 51047 - DNA, 25 bp, E. coli
tatattgccagcagggcagcgactg

SEQ ID NO: 51048 - DNA, 25 bp, E. coli
tatattgccagctgggcagcgactg

SEQ ID NO: 51049 - DNA, 25 bp, E. coli
tgatccctgggcaaaccgaagcgat

SEQ ID NO: 51050 - DNA, 25 bp, E. coli
tgatccctgggctaaccgaagcgat

SEQ ID NO: 51051 - DNA, 25 bp, E. coli
tgcagaagcgtcaaccaggcaatag

SEQ ID NO: 51052 - DNA, 25 bp, E. coli
tgcagaagcgtctaccaggcaatag

SEQ ID NO: 51053 - DNA, 25 bp, E. coli
gcagtgcgtggtgcattacgatgca

SEQ ID NO: 51054 - DNA, 25 bp, E. coli
gaagcgatatattgccagcagggca

SEQ ID NO: 51055 - DNA, 25 bp, E. coli
gcagtgcgtggtccattacgatgca

SEQ ID NO: 51056 - DNA, 25 bp, E. coli
gaagcgatatatagccagcagggca

SEQ ID NO: 51057 - DNA, 25 bp, E. coli
ccccggcgaggaaatacaatgggtg

SEQ ID NO: 51058 - DNA, 25 bp, E. coli
ccccggcgaggatatacaatgggtg

SEQ ID NO: 51059 - DNA, 25 bp, E. coli
cctgggcaaacccaagcgatatatt

SEQ ID NO: 51060 - DNA, 25 bp, E. coli
cctgggcaaaccgaagcgatatatt

SEQ ID NO: 51061 - DNA, 25 bp, E. coli
ggtgcattacgaagcagaagcgtca

SEQ ID NO: 51062 - DNA, 25 bp, E. coli
ggtgcattacgatgcagaagcgtca

SEQ ID NO: 51063 - DNA, 25 bp, E. coli
catcggacagtaatgcgaccagtcg

SEQ ID NO: 51064 - DNA, 25 bp, E. coli
catcggacagtattgcgaccagtcg

SEQ ID NO: 51065 - DNA, 25 bp, E. coli
atgcctggctgagcacgcagcgtaa

SEQ ID NO: 51066 - DNA, 25 bp, E. coli
atgcctggctgaccacgcagcgtaa

SEQ ID NO: 51067 - DNA, 25 bp, E. coli
acagtattgcgaccagtcggtgccg

SEQ ID NO: 51068 - DNA, 25 bp, E. coli
acagtattgcgagcagtcggtgccg

SEQ ID NO: 51069 - DNA, 25 bp, E. coli
tcggacagtattgcgaccagtcggt

SEQ ID NO: 51070 - DNA, 25 bp, E. coli
tcggacagtattccgaccagtcggt

SEQ ID NO: 51071 - DNA, 25 bp, E. coli
cctggctgaccaggcagcgtaaggc

SEQ ID NO: 51072 - DNA, 25 bp, E. coli
gcttcaggcagcaggcgctgggaag

SEQ ID NO: 51073 - DNA, 25 bp, E. coli
gcttcaggcagctggcgctgggaag

SEQ ID NO: 51074 - DNA, 25 bp, E. coli
gaagaccagagtccggcaattcagc

SEQ ID NO: 51075 - DNA, 25 bp, E. coli
gaagaccagagtgcggcaattcagc

SEQ ID NO: 51076 - DNA, 25 bp, E. coli
gaagtacgacacgccgattacccgg

SEQ ID NO: 51077 - DNA, 25 bp, E. coli
gaagtacgacaccccgattacccgg

SEQ ID NO: 51078 - DNA, 25 bp, E. coli
cctggctgaccacgcagcgtaaggc

SEQ ID NO: 51079 - DNA, 25 bp, E. coli
gtaatgcctggcagaccacgcagcg

SEQ ID NO: 51080 - DNA, 25 bp, E. coli
gtaatgcctggctgaccacgcagcg

SEQ ID NO: 51081 - DNA, 25 bp, E. coli
ggcagctggcgctgggaagctacag

SEQ ID NO: 51082 - DNA, 25 bp, E. coli
ggcagctggcgcagggaagctacag

SEQ ID NO: 51083 - DNA, 25 bp, E. coli
gaccagagtgcggcaattcagcaga

SEQ ID NO: 51084 - DNA, 25 bp, E. coli
gaccagagtgcgccaattcagcaga

SEQ ID NO: 51085 - DNA, 25 bp, E. coli
tatccggtacaggacgatgcacact

SEQ ID NO: 51086 - DNA, 25 bp, E. coli
tatccggtacagcacgatgcacact

SEQ ID NO: 51087 - DNA, 25 bp, E. coli
ttttctctaacaccaccgaagcggg

SEQ ID NO: 51088 - DNA, 25 bp, E. coli
ttttctctaacagcaccgaagcggg

SEQ ID NO: 51089 - DNA, 25 bp, E. coli
tgcgctatgcgcaagagtgggcact

SEQ ID NO: 51090 - DNA, 25 bp, E. coli
tcctgaatgagctcaccgatctgaa

SEQ ID NO: 51091 - DNA, 25 bp, E. coli
tcctgaatgagcacaccgatctgaa

SEQ ID NO: 51092 - DNA, 25 bp, E. coli
tgcgctatgcgctagagtgggcact

SEQ ID NO: 51093 - DNA, 25 bp, E. coli
tctcgaaaaaggcatgcgcgaagct

SEQ ID NO: 51094 - DNA, 25 bp, E. coli
tctcgaaaaagggatgcgcgaagct

SEQ ID NO: 51095 - DNA, 25 bp, E. coli
gacaaatatccggtcaacgtgctga

SEQ ID NO: 51096 - DNA, 25 bp, E. coli
gacaaatatccgctcaacgtgctga

SEQ ID NO: 51097 - DNA, 25 bp, E. coli
cgataaattcgatgacgcgccagcg

SEQ ID NO: 51098 - DNA, 25 bp, E. coli
cgataaattcgaagacgcgccagcg

SEQ ID NO: 51099 - DNA, 25 bp, E. coli
gattcagggaccgaaatccttagcg

SEQ ID NO: 51100 - DNA, 25 bp, E. coli
gattttcccggtgcacagtatccag

SEQ ID NO: 51101 - DNA, 25 bp, E. coli
gattttcccggtccacagtatccag

SEQ ID NO: 51102 - DNA, 25 bp, E. coli
gattcagggacccaaatccttagcg

SEQ ID NO: 51103 - DNA, 25 bp, E. coli
taatgacctggatgcgattctcgaa

SEQ ID NO: 51104 - DNA, 25 bp, E. coli
taatgacctggaagcgattctcgaa

SEQ ID NO: 51105 - DNA, 25 bp, E. coli
gatgaattcctgaaactggcgcaca

SEQ ID NO: 51106 - DNA, 25 bp, E. coli
gatgaattcctgtaactggcgcaca

SEQ ID NO: 51107 - DNA, 25 bp, E. coli
cagcgtcaggcactgcaggtttacg

SEQ ID NO: 51108 - DNA, 25 bp, E. coli
cagcgtcaggcagtgcaggtttacg

SEQ ID NO: 51109 - DNA, 25 bp, E. coli
caggcactgcaggtttacgtcgtga

SEQ ID NO: 51110 - DNA, 25 bp, E. coli
caggcactgcagctttacgtcgtga

SEQ ID NO: 51111 - DNA, 25 bp, E. coli
tacgtcgtgatctgatttcttctgc

SEQ ID NO: 51112 - DNA, 25 bp, E. coli
ataccgccaggctgtcatgcagtaa

SEQ ID NO: 51113 - DNA, 25 bp, E. coli
ataccgccaggcagtcatgcagtaa

SEQ ID NO: 51114 - DNA, 25 bp, E. coli
cacttatcccgaacacggaagttcc

SEQ ID NO: 51115 - DNA, 25 bp, E. coli
cacttatcccgatcacggaagttcc

SEQ ID NO: 51116 - DNA, 25 bp, E. coli
tacgtcgtgatcagatttcttctgc

SEQ ID NO: 51117 - DNA, 25 bp, E. coli
tcctgtttccgctatccgggatcgg

SEQ ID NO: 51118 - DNA, 25 bp, E. coli
tcctgtttccgcaatccgggatcgg

SEQ ID NO: 51119 - DNA, 25 bp, E. coli
tcttctgcacttttcccgatcacgg

SEQ ID NO: 51120 - DNA, 25 bp, E. coli
tcttctgcacttatcccgatcacgg

SEQ ID NO: 51121 - DNA, 25 bp, E. coli
gcaatccgggatcggcaacgtccca

SEQ ID NO: 51122 - DNA, 25 bp, E. coli
gcaacgtcccatcgttaatgccact

SEQ ID NO: 51123 - DNA, 25 bp, E. coli
gcaacgtcccatggttaatgccact

SEQ ID NO: 51124 - DNA, 25 bp, E. coli
gcaatccgggatgggcaacgtccca

SEQ ID NO: 51125 - DNA, 25 bp, E. coli
gacatttcacaaaaccgccaggctg

SEQ ID NO: 51126 - DNA, 25 bp, E. coli
gacatttcacaataccgccaggctg

SEQ ID NO: 51127 - DNA, 25 bp, E. coli
ggttaatgccacttgcagcgtcagg

SEQ ID NO: 51128 - DNA, 25 bp, E. coli
ggttaatgccacatgcagcgtcagg

SEQ ID NO: 51129 - DNA, 25 bp, E. coli
cagctactacggtgaagcgatggcg

SEQ ID NO: 51130 - DNA, 25 bp, E. coli
cagctactacggagaagcgatggcg

SEQ ID NO: 51131 - DNA, 25 bp, E. coli
tactacggtgaaccgatggcgattg

SEQ ID NO: 51132 - DNA, 25 bp, E. coli
tactacggtgaagcgatggcgattg

SEQ ID NO: 51133 - DNA, 25 bp, E. coli
atcgatctgccggtggacgtcctgc

SEQ ID NO: 51134 - DNA, 25 bp, E. coli
atcgatctgccgctggacgtcctgc

SEQ ID NO: 51135 - DNA, 25 bp, E. coli
tgaagcggtcgagtccgtactggca

SEQ ID NO: 51136 - DNA, 25 bp, E. coli
tgaagcggtcgactccgtactggca

SEQ ID NO: 51137 - DNA, 25 bp, E. coli
gccgctggacgtgctgcttggtaaa

SEQ ID NO: 51138 - DNA, 25 bp, E. coli
gccctggtcgcgtgcggtggtttct

SEQ ID NO: 51139 - DNA, 25 bp, E. coli
gccgctggacgtcctgcttggtaaa

SEQ ID NO: 51140 - DNA, 25 bp, E. coli
gccctggtcgcgagcggtggtttct

SEQ ID NO: 51141 - DNA, 25 bp, E. coli
cgctgaccgtgatgcggtcgagtcc

SEQ ID NO: 51142 - DNA, 25 bp, E. coli
cgctgaccgtgaagcggtcgagtcc

SEQ ID NO: 51143 - DNA, 25 bp, E. coli
gatttccacgccgtggtcgcgtgcg

SEQ ID NO: 51144 - DNA, 25 bp, E. coli
gattggcgagcgtgcgccggttgcg

SEQ ID NO: 51145 - DNA, 25 bp, E. coli
gattggcgagcgagcgccggttgcg

SEQ ID NO: 51146 - DNA, 25 bp, E. coli
gatttccacgccctggtcgcgtgcg

SEQ ID NO: 51147 - DNA, 25 bp, E. coli
ggtcgagtccgtactggcacagcat

SEQ ID NO: 51148 - DNA, 25 bp, E. coli
ggtcgagtccgttctggcacagcat

SEQ ID NO: 51149 - DNA, 25 bp, E. coli
tggcggcgttgtttaacgaagaact

SEQ ID NO: 51150 - DNA, 25 bp, E. coli
tggcggcgttgtataacgaagaact

SEQ ID NO: 51151 - DNA, 25 bp, E. coli
aattttgtagaaatgcgcctcctcg

SEQ ID NO: 51152 - DNA, 25 bp, E. coli
aattttgtagaattgcgcctcctcg

SEQ ID NO: 51153 - DNA, 25 bp, E. coli
catactgcgtatacgacttctccac

SEQ ID NO: 51154 - DNA, 25 bp, E. coli
catactgcgtattcgacttctccac

SEQ ID NO: 51155 - DNA, 25 bp, E. coli
tattcgacttctccacctgttgcgc

SEQ ID NO: 51156 - DNA, 25 bp, E. coli
tattcgacttctgcacctgttgcgc

SEQ ID NO: 51157 - DNA, 25 bp, E. coli
tcgcgacctccccagtgaatctgtt

SEQ ID NO: 51158 - DNA, 25 bp, E. coli
tagtgaaatgcggaattttgtagaa

SEQ ID NO: 51159 - DNA, 25 bp, E. coli
tcgcgacctcccgagtgaatctgtt

SEQ ID NO: 51160 - DNA, 25 bp, E. coli
tagtgaaatgcgcaattttgtagaa

SEQ ID NO: 51161 - DNA, 25 bp, E. coli
tctccacctgttccgcaagagaaac

SEQ ID NO: 51162 - DNA, 25 bp, E. coli
tctccacctgttgcgcaagagaaac

SEQ ID NO: 51163 - DNA, 25 bp, E. coli
gctttttactgtcagcacccggcaa

SEQ ID NO: 51164 - DNA, 25 bp, E. coli
gctttttactgtgagcacccggcaa

SEQ ID NO: 51165 - DNA, 25 bp, E. coli
ccgctgattctacgattgcttttta

SEQ ID NO: 51166 - DNA, 25 bp, E. coli
ccccagtgaatctgttgcctcattt

SEQ ID NO: 51167 - DNA, 25 bp, E. coli
ccgctgattctaggattgcttttta

SEQ ID NO: 51168 - DNA, 25 bp, E. coli
ccccagtgaatcagttgcctcattt

SEQ ID NO: 51169 - DNA, 25 bp, E. coli
gtagaattgcgcgtcctcgcgacct

SEQ ID NO: 51170 - DNA, 25 bp, E. coli
gttgcctcatttattacatactgcg

SEQ ID NO: 51171 - DNA, 25 bp, E. coli
gttgcctcattttttacatactgcg

SEQ ID NO: 51172 - DNA, 25 bp, E. coli
gtagaattgcgcctcctcgcgacct

SEQ ID NO: 51173 - DNA, 25 bp, E. coli
catattgtcgttattgtgatcgtta

SEQ ID NO: 51174 - DNA, 25 bp, E. coli
catattgtcgtttttgtgatcgtta

SEQ ID NO: 51175 - DNA, 25 bp, E. coli
ttttttgcctttcactcctcgaata

SEQ ID NO: 51176 - DNA, 25 bp, E. coli
taaaaacacgcggactttgctacgg

SEQ ID NO: 51177 - DNA, 25 bp, E. coli
ttttttgcctttgactcctcgaata

SEQ ID NO: 51178 - DNA, 25 bp, E. coli
taaaaacacgcgcactttgctacgg

SEQ ID NO: 51179 - DNA, 25 bp, E. coli
tacggcttccctttcgggaggccgt

SEQ ID NO: 51180 - DNA, 25 bp, E. coli
agcactgccacgaatgtttacaccg

SEQ ID NO: 51181 - DNA, 25 bp, E. coli
agcactgccacgtatgtttacaccg

SEQ ID NO: 51182 - DNA, 25 bp, E. coli
tacggcttccctatcgggaggccgt

SEQ ID NO: 51183 - DNA, 25 bp, E. coli
tatcatgcctacttagcactgccac

SEQ ID NO: 51184 - DNA, 25 bp, E. coli
ttatacgaacaacaccaccccgtag

SEQ ID NO: 51185 - DNA, 25 bp, E. coli
tatcatgcctacatagcactgccac

SEQ ID NO: 51186 - DNA, 25 bp, E. coli
tttgctacggctaccctatcgggag

SEQ ID NO: 51187 - DNA, 25 bp, E. coli
tttgaaatcgaaaacaaacgacagg

SEQ ID NO: 51188 - DNA, 25 bp, E. coli
tttgctacggcttccctatcgggag

SEQ ID NO: 51189 - DNA, 25 bp, E. coli
ttatacgaacaagaccaccccgtag

SEQ ID NO: 51190 - DNA, 25 bp, E. coli
tttgaaatcgaatacaaacgacagg

SEQ ID NO: 51191 - DNA, 25 bp, E. coli
tcctcgaataattttcatattgtcg

SEQ ID NO: 51192 - DNA, 25 bp, E. coli
tcctcgaataatattcatattgtcg

SEQ ID NO: 51193 - DNA, 25 bp, E. coli
gatcgttatctccatatttaaaaac

SEQ ID NO: 51194 - DNA, 25 bp, E. coli
gatcgttatctcgatatttaaaaac

SEQ ID NO: 51195 - DNA, 25 bp, E. coli
aaccaggggatcgagctcgcgcaat

SEQ ID NO: 51196 - DNA, 25 bp, E. coli
aaccaggggatccagctcgcgcaat

SEQ ID NO: 51197 - DNA, 25 bp, E. coli
ataaacgccgtatgcaggagcaacg

SEQ ID NO: 51198 - DNA, 25 bp, E. coli
ataaacgccgtaagcaggagcaacg

SEQ ID NO: 51199 - DNA, 25 bp, E. coli
aacgccgtaagcaggagcaacgcca

SEQ ID NO: 51200 - DNA, 25 bp, E. coli
aaatggaataaacgccgtaagcagg

SEQ ID NO: 51201 - DNA, 25 bp, E. coli
aacgccgtaagctggagcaacgcca

SEQ ID NO: 51202 - DNA, 25 bp, E. coli
aaatggaataaaggccgtaagcagg

SEQ ID NO: 51203 - DNA, 25 bp, E. coli
ttgacggcatggaaccaggggatcc

SEQ ID NO: 51204 - DNA, 25 bp, E. coli
ttgacggcatggtaccaggggatcc

SEQ ID NO: 51205 - DNA, 25 bp, E. coli
tgttctgcagcgcacgatggctgtc

SEQ ID NO: 51206 - DNA, 25 bp, E. coli
tgttctgcagcggacgatggctgtc

SEQ ID NO: 51207 - DNA, 25 bp, E. coli
tctgcagcggaccatggctgtcact

SEQ ID NO: 51208 - DNA, 25 bp, E. coli
tcatgaaaaaatggaataaacgccg

SEQ ID NO: 51209 - DNA, 25 bp, E. coli
tcatgaaaaaatcgaataaacgccg

SEQ ID NO: 51210 - DNA, 25 bp, E. coli
tctgcagcggacgatggctgtcact

SEQ ID NO: 51211 - DNA, 25 bp, E. coli
ggacgatggctgtcactgttgttca

SEQ ID NO: 51212 - DNA, 25 bp, E. coli
ggaataaacgccgtaagcaggagca

SEQ ID NO: 51213 - DNA, 25 bp, E. coli
ggctgtcactgtagttcatgaaaaa

SEQ ID NO: 51214 - DNA, 25 bp, E. coli
ggacgatggctgacactgttgttca

SEQ ID NO: 51215 - DNA, 25 bp, E. coli
ggctgtcactgttgttcatgaaaaa

SEQ ID NO: 51216 - DNA, 25 bp, E. coli
ggaataaacgccctaagcaggagca

SEQ ID NO: 51217 - DNA, 25 bp, E. coli
aagcgggctgatcggttattgttat

SEQ ID NO: 51218 - DNA, 25 bp, E. coli
cacagagatggatatatcacaatga

SEQ ID NO: 51219 - DNA, 25 bp, E. coli
cacagagatggaaatatcacaatga

SEQ ID NO: 51220 - DNA, 25 bp, E. coli
cagttatctgcgataatttcgtgca

SEQ ID NO: 51221 - DNA, 25 bp, E. coli
cagttatctgcgttaatttcgtgca

SEQ ID NO: 51222 - DNA, 25 bp, E. coli
aagcgggctgatgggttattgttat

SEQ ID NO: 51223 - DNA, 25 bp, E. coli
tattgttattgcgagttatctgcga

SEQ ID NO: 51224 - DNA, 25 bp, E. coli
tattgttattgccagttatctgcga

SEQ ID NO: 51225 - DNA, 25 bp, E. coli
tcgtgcaaatgctgcaattaaatgc

SEQ ID NO: 51226 - DNA, 25 bp, E. coli
tcgtgcaaatgcagcaattaaatgc

SEQ ID NO: 51227 - DNA, 25 bp, E. coli
ccggtattgatctcagagatggaaa

SEQ ID NO: 51228 - DNA, 25 bp, E. coli
ccggtattgatcacagagatggaaa

SEQ ID NO: 51229 - DNA, 25 bp, E. coli
gctgcaattaaatgcttatccggta

SEQ ID NO: 51230 - DNA, 25 bp, E. coli
gcgataatttcgtgcaaatgctgca

SEQ ID NO: 51231 - DNA, 25 bp, E. coli
gctgcaattaaaagcttatccggta

SEQ ID NO: 51232 - DNA, 25 bp, E. coli
gcttatccggtattgatcacagaga

SEQ ID NO: 51233 - DNA, 25 bp, E. coli
gcgataatttcgagcaaatgctgca

SEQ ID NO: 51234 - DNA, 25 bp, E. coli
gcttatccggtaatgatcacagaga

SEQ ID NO: 51235 - DNA, 25 bp, E. coli
gatcacagagatcgaaatatcacaa

SEQ ID NO: 51236 - DNA, 25 bp, E. coli
gatcacagagatggaaatatcacaa

SEQ ID NO: 51237 - DNA, 25 bp, E. coli
tggaggtattactgaagcgggctga

SEQ ID NO: 51238 - DNA, 25 bp, E. coli
tggaggtattacagaagcgggctga

SEQ ID NO: 51239 - DNA, 25 bp, E. coli
caattcggtgttagtttcagcaagc

SEQ ID NO: 51240 - DNA, 25 bp, E. coli
aatactctcttctacaagtgcagca

SEQ ID NO: 51241 - DNA, 25 bp, E. coli
caattcggtgtttgtttcagcaagc

SEQ ID NO: 51242 - DNA, 25 bp, E. coli
aatactctcttcaacaagtgcagca

SEQ ID NO: 51243 - DNA, 25 bp, E. coli
cagcaataaactagttgtggaacca

SEQ ID NO: 51244 - DNA, 25 bp, E. coli
cagcaataaacttgttgtggaacca

SEQ ID NO: 51245 - DNA, 25 bp, E. coli
aaccctgcacttatctgtttagagc

SEQ ID NO: 51246 - DNA, 25 bp, E. coli
aaccctgcacttttctgtttagagc

SEQ ID NO: 51247 - DNA, 25 bp, E. coli
tatagccatatttaccattggtagc

SEQ ID NO: 51248 - DNA, 25 bp, E. coli
tatagccatattaaccattggtagc

SEQ ID NO: 51249 - DNA, 25 bp, E. coli
ttcagcaagcaatcattaaccatag

SEQ ID NO: 51250 - DNA, 25 bp, E. coli
ttcagcaagcaaacattaaccatag

SEQ ID NO: 51251 - DNA, 25 bp, E. coli
tctgtcggacagctttaataaaccc

SEQ ID NO: 51252 - DNA, 25 bp, E. coli
tctgtcggacaggtttaataaaccc

SEQ ID NO: 51253 - DNA, 25 bp, E. coli
gacacttcccttcttcgcaataata

SEQ ID NO: 51254 - DNA, 25 bp, E. coli
gcaataatattcagtttagtcacgg

SEQ ID NO: 51255 - DNA, 25 bp, E. coli
gacacttcccttgttcgcaataata

SEQ ID NO: 51256 - DNA, 25 bp, E. coli
gcaataatattctgtttagtcacgg

SEQ ID NO: 51257 - DNA, 25 bp, E. coli
gaaatcgtcatgttatttagcgaca

SEQ ID NO: 51258 - DNA, 25 bp, E. coli
gaaatcgtcatgatatttagcgaca

SEQ ID NO: 51259 - DNA, 25 bp, E. coli
tggtagctcttgtcctttcctgaca

SEQ ID NO: 51260 - DNA, 25 bp, E. coli
tggtagctcttgacctttcctgaca

SEQ ID NO: 51261 - DNA, 25 bp, E. coli
cagtcgcaacgctttatcagtctga

SEQ ID NO: 51262 - DNA, 25 bp, E. coli
catttctggcagctggtgcttcagg

SEQ ID NO: 51263 - DNA, 25 bp, E. coli
cagtcgcaacgcattatcagtctga

SEQ ID NO: 51264 - DNA, 25 bp, E. coli
catttctggcaggtggtgcttcagg

SEQ ID NO: 51265 - DNA, 25 bp, E. coli
agccacaacggctgcgatgacggtc

SEQ ID NO: 51266 - DNA, 25 bp, E. coli
attgttttgttatgcgccctgggca

SEQ ID NO: 51267 - DNA, 25 bp, E. coli
agccacaacggcagcgatgacggtc

SEQ ID NO: 51268 - DNA, 25 bp, E. coli
attgttttgttaagcgccctgggca

SEQ ID NO: 51269 - DNA, 25 bp, E. coli
tatggctggagcaggacgccattct

SEQ ID NO: 51270 - DNA, 25 bp, E. coli
tatggctggagctggacgccattct

SEQ ID NO: 51271 - DNA, 25 bp, E. coli
ttgtggaacggcatactggtagcga

SEQ ID NO: 51272 - DNA, 25 bp, E. coli
ttctggctgttgacccgcaaaacgg

SEQ ID NO: 51273 - DNA, 25 bp, E. coli
ttgtggaacggcttactggtagcga

SEQ ID NO: 51274 - DNA, 25 bp, E. coli
ttctggctgttgtcccgcaaaacgg

SEQ ID NO: 51275 - DNA, 25 bp, E. coli
cgttggtatcaagattcgggcggca

SEQ ID NO: 51276 - DNA, 25 bp, E. coli
cgttggtatcaacattcgggcggca

SEQ ID NO: 51277 - DNA, 25 bp, E. coli
gatattcgcggtgccgatgccaaca

SEQ ID NO: 51278 - DNA, 25 bp, E. coli
gatattcgcggtcccgatgccaaca

SEQ ID NO: 51279 - DNA, 25 bp, E. coli
gggatgtttatccaagccgttggta

SEQ ID NO: 51280 - DNA, 25 bp, E. coli
ggtagcgatcctcaaaattcagccg

SEQ ID NO: 51281 - DNA, 25 bp, E. coli
ggtagcgatcctgaaaattcagccg

SEQ ID NO: 51282 - DNA, 25 bp, E. coli
gggatgtttatcgaagccgttggta

SEQ ID NO: 51283 - DNA, 25 bp, E. coli
caggttttacctctcaacgtgcggg

SEQ ID NO: 51284 - DNA, 25 bp, E. coli
caggttttacctgtcaacgtgcggg

SEQ ID NO: 51285 - DNA, 25 bp, E. coli
ttctgttgtcaggttttacctctca

SEQ ID NO: 51286 - DNA, 25 bp, E. coli
ttctgttgtcagcttttacctctca

SEQ ID NO: 51287 - DNA, 25 bp, E. coli
ttgtcaggtttttcctctcaacgtg

SEQ ID NO: 51288 - DNA, 25 bp, E. coli
ttgtcaggttttacctctcaacgtg

SEQ ID NO: 51289 - DNA, 25 bp, E. coli
tgtcaggttttacctctcaacgtgc

SEQ ID NO: 51290 - DNA, 25 bp, E. coli
tgtcaggttttagctctcaacgtgc

SEQ ID NO: 51291 - DNA, 25 bp, E. coli
tgttgtcaggttatacctctcaacg

SEQ ID NO: 51292 - DNA, 25 bp, E. coli
tgttgtcaggttttacctctcaacg

SEQ ID NO: 51293 - DNA, 25 bp, E. coli
tcaggttttacctctcaacgtgcgg

SEQ ID NO: 51294 - DNA, 25 bp, E. coli
tctgttgtcaggttttacctctcaa

SEQ ID NO: 51295 - DNA, 25 bp, E. coli
tcaggttttaccactcaacgtgcgg

SEQ ID NO: 51296 - DNA, 25 bp, E. coli
tctgttgtcaggatttacctctcaa

SEQ ID NO: 51297 - DNA, 25 bp, E. coli
ctgttgtcaggttttacctctcaac

SEQ ID NO: 51298 - DNA, 25 bp, E. coli
ctgttgtcaggtattacctctcaac

SEQ ID NO: 51299 - DNA, 25 bp, E. coli
cgttctgttgtctggttttacctct

SEQ ID NO: 51300 - DNA, 25 bp, E. coli
cgttctgttgtcaggttttacctct

SEQ ID NO: 51301 - DNA, 25 bp, E. coli
gttctgttgtcaggttttacctctc

SEQ ID NO: 51302 - DNA, 25 bp, E. coli
gttctgttgtcacgttttacctctc

SEQ ID NO: 51303 - DNA, 25 bp, E. coli
ggtttcaagatttgcccccgttctg

SEQ ID NO: 51304 - DNA, 25 bp, E. coli
ggtttcaagattagcccccgttctg

SEQ ID NO: 51305 - DNA, 25 bp, E. coli
aagtatggcggctcgattgacggca

SEQ ID NO: 51306 - DNA, 25 bp, E. coli
caagctgagtgttaacgatcgcccg

SEQ ID NO: 51307 - DNA, 25 bp, E. coli
caaggacattgtccccgatcgcatc

SEQ ID NO: 51308 - DNA, 25 bp, E. coli
caaggacattgtgcccgatcgcatc

SEQ ID NO: 51309 - DNA, 25 bp, E. coli
aagtatggcggcacgattgacggca

SEQ ID NO: 51310 - DNA, 25 bp, E. coli
caagctgagtgtaaacgatcgcccg

SEQ ID NO: 51311 - DNA, 25 bp, E. coli
tactacaccgatgatgaaagcgacc

SEQ ID NO: 51312 - DNA, 25 bp, E. coli
tactacaccgatcatgaaagcgacc

SEQ ID NO: 51313 - DNA, 25 bp, E. coli
tgcctaaactgacgcgcaaaaccga

SEQ ID NO: 51314 - DNA, 25 bp, E. coli
tgcctaaactgaggcgcaaaaccga

SEQ ID NO: 51315 - DNA, 25 bp, E. coli
tcatttaccggatggacggcaagga

SEQ ID NO: 51316 - DNA, 25 bp, E. coli
tcatttaccggaaggacggcaagga

SEQ ID NO: 51317 - DNA, 25 bp, E. coli
gcccgttgtgggagattgacctgct

SEQ ID NO: 51318 - DNA, 25 bp, E. coli
gcccgttgtgggtgattgacctgct

SEQ ID NO: 51319 - DNA, 25 bp, E. coli
gcgcagttcgtgtgctgttcctgaa

SEQ ID NO: 51320 - DNA, 25 bp, E. coli
gcgcagttcgtgagctgttcctgaa

SEQ ID NO: 51321 - DNA, 25 bp, E. coli
gacgactccgcgcttgatgcgagct

SEQ ID NO: 51322 - DNA, 25 bp, E. coli
cgcggacgtgtgtcggaaattgata

SEQ ID NO: 51323 - DNA, 25 bp, E. coli
cgcggacgtgtgacggaaattgata

SEQ ID NO: 51324 - DNA, 25 bp, E. coli
taagtattgacctcggcctggacga

SEQ ID NO: 51325 - DNA, 25 bp, E. coli
taagtattgaccacggcctggacga

SEQ ID NO: 51326 - DNA, 25 bp, E. coli
gacgactccgcggttgatgcgagct

SEQ ID NO: 51327 - DNA, 25 bp, E. coli
catcttcgcactcgtcttattggga

SEQ ID NO: 51328 - DNA, 25 bp, E. coli
catcttcgcactggtcttattggga

SEQ ID NO: 51329 - DNA, 25 bp, E. coli
tacagctgtaggagttctattctcc

SEQ ID NO: 51330 - DNA, 25 bp, E. coli
tacagctgtaggtgttctattctcc

SEQ ID NO: 51331 - DNA, 25 bp, E. coli
tcttaaggcccagaaaataaagtga

SEQ ID NO: 51332 - DNA, 25 bp, E. coli
tcttaaggcccacaaaataaagtga

SEQ ID NO: 51333 - DNA, 25 bp, E. coli
tatccagccgtatgcgttaatatca

SEQ ID NO: 51334 - DNA, 25 bp, E. coli
tatccagccgtaagcgttaatatca

SEQ ID NO: 51335 - DNA, 25 bp, E. coli
gctctttttacgtggactgcctggg

SEQ ID NO: 51336 - DNA, 25 bp, E. coli
gctctttttacgaggactgcctggg

SEQ ID NO: 51337 - DNA, 25 bp, E. coli
gaaatttctcagcatacatgcagcc

SEQ ID NO: 51338 - DNA, 25 bp, E. coli
gaaatttctcaggatacatgcagcc

SEQ ID NO: 51339 - DNA, 25 bp, E. coli
ccagttcgggacaagcttacttagc

SEQ ID NO: 51340 - DNA, 25 bp, E. coli
ccagttcgggactagcttacttagc

SEQ ID NO: 51341 - DNA, 25 bp, E. coli
gattatgtttatatttccgcggagc

SEQ ID NO: 51342 - DNA, 25 bp, E. coli
gattatgtttatttttccgcggagc

SEQ ID NO: 51343 - DNA, 25 bp, E. coli
ggtcagccctattatcgcgtttcag

SEQ ID NO: 51344 - DNA, 25 bp, E. coli
ggtcagccctataatcgcgtttcag

SEQ ID NO: 51345 - DNA, 25 bp, E. coli
gggctattaacacgtggagtctcta

SEQ ID NO: 51346 - DNA, 25 bp, E. coli
gggctattaacaggtggagtctcta

SEQ ID NO: 51347 - DNA, 25 bp, E. coli
taagagatgctgatgttgaagacac

SEQ ID NO: 51348 - DNA, 25 bp, E. coli
taagagatgctgttgttgaagacac

SEQ ID NO: 51349 - DNA, 25 bp, E. coli
caagggatatgtatatgagagcgac

SEQ ID NO: 51350 - DNA, 25 bp, E. coli
caagggatatgtttatgagagcgac

SEQ ID NO: 51351 - DNA, 25 bp, E. coli
catttgttgtaatctgctgcgtctc

SEQ ID NO: 51352 - DNA, 25 bp, E. coli
catgagtgttggtttatatacctaa

SEQ ID NO: 51353 - DNA, 25 bp, E. coli
catttgttgtaaactgctgcgtctc

SEQ ID NO: 51354 - DNA, 25 bp, E. coli
catgagtgttggattatatacctaa

SEQ ID NO: 51355 - DNA, 25 bp, E. coli
tatggcttcatttgttgtaatctgc

SEQ ID NO: 51356 - DNA, 25 bp, E. coli
tatggcttcattagttgtaatctgc

SEQ ID NO: 51357 - DNA, 25 bp, E. coli
ttgtaatctgctgcgtctcaaggga

SEQ ID NO: 51358 - DNA, 25 bp, E. coli
tttatgagagcgaccatgagtgttg

SEQ ID NO: 51359 - DNA, 25 bp, E. coli
tttatgagagcgtccatgagtgttg

SEQ ID NO: 51360 - DNA, 25 bp, E. coli
ttgtaatctgctccgtctcaaggga

SEQ ID NO: 51361 - DNA, 25 bp, E. coli
tctgctgcgtctgaagggatatgtt

SEQ ID NO: 51362 - DNA, 25 bp, E. coli
tctgctgcgtctcaagggatatgtt

SEQ ID NO: 51363 - DNA, 25 bp, E. coli
gctgcgtctcaacggatatgtttat

SEQ ID NO: 51364 - DNA, 25 bp, E. coli
gctgcgtctcaagggatatgtttat

SEQ ID NO: 51365 - DNA, 25 bp, E. coli
ctttactgttcaattatatggcttc

SEQ ID NO: 51366 - DNA, 25 bp, E. coli
ctttactgttcatttatatggcttc

SEQ ID NO: 51367 - DNA, 25 bp, E. coli
gatatgtttatgagagcgaccatga

SEQ ID NO: 51368 - DNA, 25 bp, E. coli
gatatgtttatgtgagcgaccatga

SEQ ID NO: 51369 - DNA, 25 bp, E. coli
gaccatgagtgttggattatatacc

SEQ ID NO: 51370 - DNA, 25 bp, E. coli
gaccatgagtgtaggattatatacc

SEQ ID NO: 51371 - DNA, 25 bp, E. coli
catatgaagcgttttacctggccac

SEQ ID NO: 51372 - DNA, 25 bp, E. coli
catatgaagcgtattacctggccac

SEQ ID NO: 51373 - DNA, 25 bp, E. coli
aaaagagtgggaacgtctcagcgaa

SEQ ID NO: 51374 - DNA, 25 bp, E. coli
aaaagagtgggatcgtctcagcgaa

SEQ ID NO: 51375 - DNA, 25 bp, E. coli
aacatgctgcaatcgctgaacgaag

SEQ ID NO: 51376 - DNA, 25 bp, E. coli
aacatgctgcaaacgctgaacgaag

SEQ ID NO: 51377 - DNA, 25 bp, E. coli
tatgaggatttagagtacgcccgcg

SEQ ID NO: 51378 - DNA, 25 bp, E. coli
tatgaggatttacagtacgcccgcg

SEQ ID NO: 51379 - DNA, 25 bp, E. coli
tagtaccgggctatgtcgatacaca

SEQ ID NO: 51380 - DNA, 25 bp, E. coli
tagtaccgggctttgtcgatacaca

SEQ ID NO: 51381 - DNA, 25 bp, E. coli
tatcgcggcaaagtgatagtaccgg

SEQ ID NO: 51382 - DNA, 25 bp, E. coli
tatcgcggcaaactgatagtaccgg

SEQ ID NO: 51383 - DNA, 25 bp, E. coli
tgatgcgctgtttgaagccgccagt

SEQ ID NO: 51384 - DNA, 25 bp, E. coli
tgatgcgctgttagaagccgccagt

SEQ ID NO: 51385 - DNA, 25 bp, E. coli
tcaggagaacacacgttaaaagcgg

SEQ ID NO: 51386 - DNA, 25 bp, E. coli
tcaggagaacactcgttaaaagcgg

SEQ ID NO: 51387 - DNA, 25 bp, E. coli
gctgatttcgtggtgatggaaccca

SEQ ID NO: 51388 - DNA, 25 bp, E. coli
gctgatttcgtgctgatggaaccca

SEQ ID NO: 51389 - DNA, 25 bp, E. coli
gagcgaaatctctgggccttgacga

SEQ ID NO: 51390 - DNA, 25 bp, E. coli
gatgtttaccatgagtacggcctga

SEQ ID NO: 51391 - DNA, 25 bp, E. coli
gagcgaaatctcagggccttgacga

SEQ ID NO: 51392 - DNA, 25 bp, E. coli
gatgtttaccatcagtacggcctga

SEQ ID NO: 51393 - DNA, 25 bp, E. coli
aaaacggatgtctaccctgacgcaa

SEQ ID NO: 51394 - DNA, 25 bp, E. coli
aaaacggatgtcaaccctgacgcaa

SEQ ID NO: 51395 - DNA, 25 bp, E. coli
tagctaattgtgctgcggtggttaa

SEQ ID NO: 51396 - DNA, 25 bp, E. coli
taccgacgcttttcatcggttgaca

SEQ ID NO: 51397 - DNA, 25 bp, E. coli
tagctaattgtggtgcggtggttaa

SEQ ID NO: 51398 - DNA, 25 bp, E. coli
taccgacgctttacatcggttgaca

SEQ ID NO: 51399 - DNA, 25 bp, E. coli
tgacgcaataaaaacgtcccgccag

SEQ ID NO: 51400 - DNA, 25 bp, E. coli
tgacgcaataaatacgtcccgccag

SEQ ID NO: 51401 - DNA, 25 bp, E. coli
gccagcgtgagttctgcatccgtaa

SEQ ID NO: 51402 - DNA, 25 bp, E. coli
gccagcgtgagtactgcatccgtaa

SEQ ID NO: 51403 - DNA, 25 bp, E. coli
gcatctaatcaacgaggaaaaaggg

SEQ ID NO: 51404 - DNA, 25 bp, E. coli
gcgttgcaaaacgtatcctgatgat

SEQ ID NO: 51405 - DNA, 25 bp, E. coli
gcgttgcaaaacctatcctgatgat

SEQ ID NO: 51406 - DNA, 25 bp, E. coli
gcatctaatcaaggaggaaaaaggg

SEQ ID NO: 51407 - DNA, 25 bp, E. coli
gggacaaaatgcacgcgttgcaaaa

SEQ ID NO: 51408 - DNA, 25 bp, E. coli
gggacaaaatgctcgcgttgcaaaa

SEQ ID NO: 51409 - DNA, 25 bp, E. coli
taatttctgctttactaccgacgct

SEQ ID NO: 51410 - DNA, 25 bp, E. coli
tcagctccagatcaatgcgatatgc

SEQ ID NO: 51411 - DNA, 25 bp, E. coli
tcagctccagatgaatgcgatatgc

SEQ ID NO: 51412 - DNA, 25 bp, E. coli
taatttctgcttaactaccgacgct

SEQ ID NO: 51413 - DNA, 25 bp, E. coli
gagttactggatacaaaaacggatg

SEQ ID NO: 51414 - DNA, 25 bp, E. coli
gagttactggattcaaaaacggatg

SEQ ID NO: 51415 - DNA, 25 bp, E. coli
aatgcttatggctctgaatgtccgg

SEQ ID NO: 51416 - DNA, 25 bp, E. coli
aatgcttatggcactgaatgtccgg

SEQ ID NO: 51417 - DNA, 25 bp, E. coli
taacatggccctggatagctgctgg

SEQ ID NO: 51418 - DNA, 25 bp, E. coli
taacatggccctcgatagctgctgg

SEQ ID NO: 51419 - DNA, 25 bp, E. coli
tgctggttttaatggattaatcccg

SEQ ID NO: 51420 - DNA, 25 bp, E. coli
tgctggttttaaaggattaatcccg

SEQ ID NO: 51421 - DNA, 25 bp, E. coli
tcctaagtgttcagatgatgacgcc

SEQ ID NO: 51422 - DNA, 25 bp, E. coli
tcctaagtgttctgatgatgacgcc

SEQ ID NO: 51423 - DNA, 25 bp, E. coli
tctgatgggcttattggtaaaaggc

SEQ ID NO: 51424 - DNA, 25 bp, E. coli
tctgatgggctttttggtaaaaggc

SEQ ID NO: 51425 - DNA, 25 bp, E. coli
gacatttatggctcttgcacgtaag

SEQ ID NO: 51426 - DNA, 25 bp, E. coli
gacatttatggcacttgcacgtaag

SEQ ID NO: 51427 - DNA, 25 bp, E. coli
cgtaagcatagaagttctgatgggc

SEQ ID NO: 51428 - DNA, 25 bp, E. coli
cgtaagcatagatgttctgatgggc

SEQ ID NO: 51429 - DNA, 25 bp, E. coli
tggcgcgtgataaccagatggttct

SEQ ID NO: 51430 - DNA, 25 bp, E. coli
ggcatgggcagcaaataatcatgaa

SEQ ID NO: 51431 - DNA, 25 bp, E. coli
tggcgcgtgatatccagatggttct

SEQ ID NO: 51432 - DNA, 25 bp, E. coli
ggcatgggcagctaataatcatgaa

SEQ ID NO: 51433 - DNA, 25 bp, E. coli
taatcccgactaaagtgaaatcacg

SEQ ID NO: 51434 - DNA, 25 bp, E. coli
taatcatgaagaagtaacatggccc

SEQ ID NO: 51435 - DNA, 25 bp, E. coli
taatcccgactatagtgaaatcacg

SEQ ID NO: 51436 - DNA, 25 bp, E. coli
taatcatgaagatgtaacatggccc

SEQ ID NO: 51437 - DNA, 25 bp, E. coli
caatggtgcaacttcttgagcatta

SEQ ID NO: 51438 - DNA, 25 bp, E. coli
caatggtgcaacatcttgagcatta

SEQ ID NO: 51439 - DNA, 25 bp, E. coli
acttcttgagcaatatttttctgag

SEQ ID NO: 51440 - DNA, 25 bp, E. coli
acttcttgagcattatttttctgag

SEQ ID NO: 51441 - DNA, 25 bp, E. coli
tccgcaatggtgcaacttcttgagc

SEQ ID NO: 51442 - DNA, 25 bp, E. coli
tcgctactaccaactcgggagagtt

SEQ ID NO: 51443 - DNA, 25 bp, E. coli
tcgctactaccatctcgggagagtt

SEQ ID NO: 51444 - DNA, 25 bp, E. coli
tccgcaatggtggaacttcttgagc

SEQ ID NO: 51445 - DNA, 25 bp, E. coli
tcatcgctgtttccccgctgttggc

SEQ ID NO: 51446 - DNA, 25 bp, E. coli
tcatcgctgtttgcccgctgttggc

SEQ ID NO: 51447 - DNA, 25 bp, E. coli
gctactaccaacacgggagagttgc

SEQ ID NO: 51448 - DNA, 25 bp, E. coli
gcatcgctactagcaactcgggaga

SEQ ID NO: 51449 - DNA, 25 bp, E. coli
gctggcgcgcggtcgggccgactaa

SEQ ID NO: 51450 - DNA, 25 bp, E. coli
gctactaccaactcgggagagttgc

SEQ ID NO: 51451 - DNA, 25 bp, E. coli
gctggcgcgcggacgggccgactaa

SEQ ID NO: 51452 - DNA, 25 bp, E. coli
gcatcgctactaccaactcgggaga

SEQ ID NO: 51453 - DNA, 25 bp, E. coli
cccgctgttggcagctggtggaagg

SEQ ID NO: 51454 - DNA, 25 bp, E. coli
cccgctgttggctgctggtggaagg

SEQ ID NO: 51455 - DNA, 25 bp, E. coli
cattgcagcgcaacgctactaccaa

SEQ ID NO: 51456 - DNA, 25 bp, E. coli
cattgcagcgcatcgctactaccaa

SEQ ID NO: 51457 - DNA, 25 bp, E. coli
ggtgcaacttctagagcattatttt

SEQ ID NO: 51458 - DNA, 25 bp, E. coli
ggtgcaacttcttgagcattatttt

SEQ ID NO: 51459 - DNA, 25 bp, E. coli
aaaacagcgcgcttttctcgtggcg

SEQ ID NO: 51460 - DNA, 25 bp, E. coli
aaaacagcgcgcatttctcgtggcg

SEQ ID NO: 51461 - DNA, 25 bp, E. coli
tattgatggcgggaaaacagcgcgc

SEQ ID NO: 51462 - DNA, 25 bp, E. coli
tattgatggcggcaaaacagcgcgc

SEQ ID NO: 51463 - DNA, 25 bp, E. coli
tgtgatttcgatcctgggcttccct

SEQ ID NO: 51464 - DNA, 25 bp, E. coli
tgtgatttcgatgctgggcttccct

SEQ ID NO: 51465 - DNA, 25 bp, E. coli
tccagtaatgtcctgagcgccttgc

SEQ ID NO: 51466 - DNA, 25 bp, E. coli
tccagtaatgtcgtgagcgccttgc

SEQ ID NO: 51467 - DNA, 25 bp, E. coli
tcatctgtttggtgtgctgggagca

SEQ ID NO: 51468 - DNA, 25 bp, E. coli
tcatctgtttggagtgctgggagca

SEQ ID NO: 51469 - DNA, 25 bp, E. coli
cctgattcaggtgatgctgggcgca

SEQ ID NO: 51470 - DNA, 25 bp, E. coli
cctgattcaggtcatgctgggcgca

SEQ ID NO: 51471 - DNA, 25 bp, E. coli
gcttacttcggtgggcaatgtctgg

SEQ ID NO: 51472 - DNA, 25 bp, E. coli
gcttacttcggtcggcaatgtctgg

SEQ ID NO: 51473 - DNA, 25 bp, E. coli
gacgtggcgctctcgttaattccaa

SEQ ID NO: 51474 - DNA, 25 bp, E. coli
cattccttgctttataacgcagccg

SEQ ID NO: 51475 - DNA, 25 bp, E. coli
cattccttgcttaataacgcagccg

SEQ ID NO: 51476 - DNA, 25 bp, E. coli
gggcttccctcaggagtcattgcta

SEQ ID NO: 51477 - DNA, 25 bp, E. coli
gggcttccctcacgagtcattgcta

SEQ ID NO: 51478 - DNA, 25 bp, E. coli
taacgcagccggagagaaatcctga

SEQ ID NO: 51479 - DNA, 25 bp, E. coli
taacgcagccggtgagaaatcctga

SEQ ID NO: 51480 - DNA, 25 bp, E. coli
gacgtggcgctcacgttaattccaa

SEQ ID NO: 51481 - DNA, 25 bp, E. coli
tacaaagcgctacccttcaagaagt

SEQ ID NO: 51482 - DNA, 25 bp, E. coli
tacaaagcgctagccttcaagaagt

SEQ ID NO: 51483 - DNA, 25 bp, E. coli
tattacaactagtaggcaggaagcg

SEQ ID NO: 51484 - DNA, 25 bp, E. coli
tatttcaagggacgacaaacacaac

SEQ ID NO: 51485 - DNA, 25 bp, E. coli
tattacaactagaaggcaggaagcg

SEQ ID NO: 51486 - DNA, 25 bp, E. coli
tatttcaagggaggacaaacacaac

SEQ ID NO: 51487 - DNA, 25 bp, E. coli
ttaaagagggcatgggtgaatcacc

SEQ ID NO: 51488 - DNA, 25 bp, E. coli
ttaaagagggcaagggtgaatcacc

SEQ ID NO: 51489 - DNA, 25 bp, E. coli
tgtagatatgcctgacgattgcgtc

SEQ ID NO: 51490 - DNA, 25 bp, E. coli
tgtagatatgccagacgattgcgtc

SEQ ID NO: 51491 - DNA, 25 bp, E. coli
tccttgctcgcataggtgtagagac

SEQ ID NO: 51492 - DNA, 25 bp, E. coli
tccttgctcgcaaaggtgtagagac

SEQ ID NO: 51493 - DNA, 25 bp, E. coli
cattccttacgatagacgaacgaga

SEQ ID NO: 51494 - DNA, 25 bp, E. coli
cattccttacgaaagacgaacgaga

SEQ ID NO: 51495 - DNA, 25 bp, E. coli
tcaaatccggtacaatctaaagcgg

SEQ ID NO: 51496 - DNA, 25 bp, E. coli
tcaagaagtgcacctgccagagcgt

SEQ ID NO: 51497 - DNA, 25 bp, E. coli
tcaaatccggtagaatctaaagcgg

SEQ ID NO: 51498 - DNA, 25 bp, E. coli
tcaagaagtgcagctgccagagcgt

SEQ ID NO: 51499 - DNA, 25 bp, E. coli
gagacggttctgacactgctggata

SEQ ID NO: 51500 - DNA, 25 bp, E. coli
gagacaagtaggcaatcaaatccgg

SEQ ID NO: 51501 - DNA, 25 bp, E. coli
gagacggttctgtcactgctggata

SEQ ID NO: 51502 - DNA, 25 bp, E. coli
gagacaagtagggaatcaaatccgg

SEQ ID NO: 51503 - DNA, 25 bp, E. coli
gcgacgttacggctttcacggaaca

SEQ ID NO: 51504 - DNA, 25 bp, E. coli
gcgacgttacgggtttcacggaaca

SEQ ID NO: 51505 - DNA, 25 bp, E. coli
aacctgattggttttgaagcggctc

SEQ ID NO: 51506 - DNA, 25 bp, E. coli
aacctgattggtattgaagcggctc

SEQ ID NO: 51507 - DNA, 25 bp, E. coli
aaaatgctcaataaccagtccggcc

SEQ ID NO: 51508 - DNA, 25 bp, E. coli
aaaatgctcaattaccagtccggcc

SEQ ID NO: 51509 - DNA, 25 bp, E. coli
tgatgtgatcgaaaaagtccgcgcg

SEQ ID NO: 51510 - DNA, 25 bp, E. coli
tgatgtgatcgataaagtccgcgcg

SEQ ID NO: 51511 - DNA, 25 bp, E. coli
tcggcggacgtagcggactgatttc

SEQ ID NO: 51512 - DNA, 25 bp, E. coli
tcggcggacgtaccggactgatttc

SEQ ID NO: 51513 - DNA, 25 bp, E. coli
tcaccggtggaattggcgaaaactc

SEQ ID NO: 51514 - DNA, 25 bp, E. coli
tcaccggtggaaatggcgaaaactc

SEQ ID NO: 51515 - DNA, 25 bp, E. coli
gctatagatgcaccggagattgccc

SEQ ID NO: 51516 - DNA, 25 bp, E. coli
gctatagatgcagcggagattgccc

SEQ ID NO: 51517 - DNA, 25 bp, E. coli
cgccgaggcgcttgcatcactagat

SEQ ID NO: 51518 - DNA, 25 bp, E. coli
cgccgaggcgctagcatcactagat

SEQ ID NO: 51519 - DNA, 25 bp, E. coli
cattcctcaggatgcagatcagccg

SEQ ID NO: 51520 - DNA, 25 bp, E. coli
cattcctcaggaagcagatcagccg

SEQ ID NO: 51521 - DNA, 25 bp, E. coli
gataaagaacgttaccagcagctgt

SEQ ID NO: 51522 - DNA, 25 bp, E. coli
gataaagaacgtaaccagcagctgt

SEQ ID NO: 51523 - DNA, 25 bp, E. coli
taattcgagaacataccgtgcaacg

SEQ ID NO: 51524 - DNA, 25 bp, E. coli
taattcgagaacttaccgtgcaacg

SEQ ID NO: 51525 - DNA, 25 bp, E. coli
caatacgttaatggccgaaatggcg

SEQ ID NO: 51526 - DNA, 25 bp, E. coli
caatacgttaatcgccgaaatggcg

SEQ ID NO: 51527 - DNA, 25 bp, E. coli
cagcggtacgcgtagcggtcaaaac

SEQ ID NO: 51528 - DNA, 25 bp, E. coli
cagcggtacgcgaagcggtcaaaac

SEQ ID NO: 51529 - DNA, 25 bp, E. coli
taaaagagaactatcgccgtgaacg

SEQ ID NO: 51530 - DNA, 25 bp, E. coli
taaagcttgtcaggcgctgctacgc

SEQ ID NO: 51531 - DNA, 25 bp, E. coli
taaagcttgtcacgcgctgctacgc

SEQ ID NO: 51532 - DNA, 25 bp, E. coli
taaaagagaactttcgccgtgaacg

SEQ ID NO: 51533 - DNA, 25 bp, E. coli
tatctatgaaatgagcgccaatccg

SEQ ID NO: 51534 - DNA, 25 bp, E. coli
tatctatgaaatcagcgccaatccg

SEQ ID NO: 51535 - DNA, 25 bp, E. coli
tcgaagtcgatatggcctggcatga

SEQ ID NO: 51536 - DNA, 25 bp, E. coli
tgcgattatccatagcgatggcgac

SEQ ID NO: 51537 - DNA, 25 bp, E. coli
tcgaagtcgataaggcctggcatga

SEQ ID NO: 51538 - DNA, 25 bp, E. coli
tgcgattatccaaagcgatggcgac

SEQ ID NO: 51539 - DNA, 25 bp, E. coli
gccgtgaacgctcgatcgaagtcga

SEQ ID NO: 51540 - DNA, 25 bp, E. coli
gccgtgaacgctggatcgaagtcga

SEQ ID NO: 51541 - DNA, 25 bp, E. coli
cgtcaattaccagcgacacagtgat

SEQ ID NO: 51542 - DNA, 25 bp, E. coli
cgtcaattaccaccgacacagtgat

SEQ ID NO: 51543 - DNA, 25 bp, E. coli
tggttttaccgcgaccgcgaattgg

SEQ ID NO: 51544 - DNA, 25 bp, E. coli
tggttttaccgccaccgcgaattgg

SEQ ID NO: 51545 - DNA, 25 bp, E. coli
tggcgacgcggcatttaaagcttgt

SEQ ID NO: 51546 - DNA, 25 bp, E. coli
tggcgacgcggcttttaaagcttgt

SEQ ID NO: 51547 - DNA, 25 bp, E. coli
aagtgaaaacatccacccggacggg

SEQ ID NO: 51548 - DNA, 25 bp, E. coli
aagtgaaaacatgcacccggacggg

SEQ ID NO: 51549 - DNA, 25 bp, E. coli
aactgctctgaatagagtaacgcgc

SEQ ID NO: 51550 - DNA, 25 bp, E. coli
caccaaaagtgatcgcttgtgttat

SEQ ID NO: 51551 - DNA, 25 bp, E. coli
caccaaaagtgaacgcttgtgttat

SEQ ID NO: 51552 - DNA, 25 bp, E. coli
tacaataataagtatgcgctgatgg

SEQ ID NO: 51553 - DNA, 25 bp, E. coli
taaattcctggtataatatccgaca

SEQ ID NO: 51554 - DNA, 25 bp, E. coli
tacaataataagaatgcgctgatgg

SEQ ID NO: 51555 - DNA, 25 bp, E. coli
agcatgtcgctccacaagtgcagag

SEQ ID NO: 51556 - DNA, 25 bp, E. coli
agcatgtcgctcgacaagtgcagag

SEQ ID NO: 51557 - DNA, 25 bp, E. coli
aactgctctgaaaagagtaacgcgc

SEQ ID NO: 51558 - DNA, 25 bp, E. coli
tattcagggatgtaaaactgctctg

SEQ ID NO: 51559 - DNA, 25 bp, E. coli
tattcagggatgaaaaactgctctg

SEQ ID NO: 51560 - DNA, 25 bp, E. coli
tgcgctgatggcaaatattcaggga

SEQ ID NO: 51561 - DNA, 25 bp, E. coli
tgcgctgatggctaatattcaggga

SEQ ID NO: 51562 - DNA, 25 bp, E. coli
cctgacaatcacgaacaacatcgaa

SEQ ID NO: 51563 - DNA, 25 bp, E. coli
cctgacaatcaccaacaacatcgaa

SEQ ID NO: 51564 - DNA, 25 bp, E. coli
taatatccgacaagtgaaaacatgc

SEQ ID NO: 51565 - DNA, 25 bp, E. coli
taacgcgctttagtatccctgacaa

SEQ ID NO: 51566 - DNA, 25 bp, E. coli
taacgcgctttactatccctgacaa

SEQ ID NO: 51567 - DNA, 25 bp, E. coli
taatatccgacatgtgaaaacatgc

SEQ ID NO: 51568 - DNA, 25 bp, E. coli
taaattcctggtttaatatccgaca

SEQ ID NO: 51569 - DNA, 25 bp, E. coli
caaggtttatatccgatgcgtgacg

SEQ ID NO: 51570 - DNA, 25 bp, E. coli
caaggtttatatgcgatgcgtgacg

SEQ ID NO: 51571 - DNA, 25 bp, E. coli
caaacctggcgcttaaaggtgcgga

SEQ ID NO: 51572 - DNA, 25 bp, E. coli
caaacctggcgcataaaggtgcgga

SEQ ID NO: 51573 - DNA, 25 bp, E. coli
catcttcaactgaatgggctgctga

SEQ ID NO: 51574 - DNA, 25 bp, E. coli
catcttcaactgtatgggctgctga

SEQ ID NO: 51575 - DNA, 25 bp, E. coli
taaaggtgcggatgatggaatcatc

SEQ ID NO: 51576 - DNA, 25 bp, E. coli
taaacagactcgtaatgcacttgct

SEQ ID NO: 51577 - DNA, 25 bp, E. coli
taaacagactcgaaatgcacttgct

SEQ ID NO: 51578 - DNA, 25 bp, E. coli
taaaggtgcggaagatggaatcatc

SEQ ID NO: 51579 - DNA, 25 bp, E. coli
aggtagcgcgcctggctctgtttca

SEQ ID NO: 51580 - DNA, 25 bp, E. coli
aggtagcgcgccaggctctgtttca

SEQ ID NO: 51581 - DNA, 25 bp, E. coli
aagcaatactacgaggcaaacctgg

SEQ ID NO: 51582 - DNA, 25 bp, E. coli
aagcaatactaccaggcaaacctgg

SEQ ID NO: 51583 - DNA, 25 bp, E. coli
tagcggcacaacagcaaactcagca

SEQ ID NO: 51584 - DNA, 25 bp, E. coli
tagcggcacaactgcaaactcagca

SEQ ID NO: 51585 - DNA, 25 bp, E. coli
tgcacttgctgaagcgcagaaactg

SEQ ID NO: 51586 - DNA, 25 bp, E. coli
tgcacttgctgatgcgcagaaactg

SEQ ID NO: 51587 - DNA, 25 bp, E. coli
ccgaatgggcaatgttcgctaagcc

SEQ ID NO: 51588 - DNA, 25 bp, E. coli
ccgaatgggcaaagttcgctaagcc

SEQ ID NO: 51589 - DNA, 25 bp, E. coli
ggcaaaagaactcaccaatgaagct

SEQ ID NO: 51590 - DNA, 25 bp, E. coli
ggcaaaagaactgaccaatgaagct

SEQ ID NO: 51591 - DNA, 25 bp, E. coli
caattttcgttctaggtgctcacca

SEQ ID NO: 51592 - DNA, 25 bp, E. coli
caattttcgttcaaggtgctcacca

SEQ ID NO: 51593 - DNA, 25 bp, E. coli
tgatcatgcccctttaagtgcggag

SEQ ID NO: 51594 - DNA, 25 bp, E. coli
tgatcatgccccattaagtgcggag

SEQ ID NO: 51595 - DNA, 25 bp, E. coli
tgtgcgtacatcagggcctgcgtga

SEQ ID NO: 51596 - DNA, 25 bp, E. coli
tgatgggcgcgctcgaagttcatcc

SEQ ID NO: 51597 - DNA, 25 bp, E. coli
tgatgggcgcgcacgaagttcatcc

SEQ ID NO: 51598 - DNA, 25 bp, E. coli
tgtgcgtacatctgggcctgcgtga

SEQ ID NO: 51599 - DNA, 25 bp, E. coli
gctgcatgtggataactggcccgat

SEQ ID NO: 51600 - DNA, 25 bp, E. coli
gctgcatgtggaaaactggcccgat

SEQ ID NO: 51601 - DNA, 25 bp, E. coli
gactggcggcaaaaagctaatcatc

SEQ ID NO: 51602 - DNA, 25 bp, E. coli
cgccgatattgtttgcctgcaggaa

SEQ ID NO: 51603 - DNA, 25 bp, E. coli
cgccgatattgtatgcctgcaggaa

SEQ ID NO: 51604 - DNA, 25 bp, E. coli
gatctacgtcaataatgccagcgcc

SEQ ID NO: 51605 - DNA, 25 bp, E. coli
ggtcgcaatgccctatacccggaag

SEQ ID NO: 51606 - DNA, 25 bp, E. coli
ggtcgcaatgccgtatacccggaag

SEQ ID NO: 51607 - DNA, 25 bp, E. coli
tggatgagatttttacccgcgccca

SEQ ID NO: 51608 - DNA, 25 bp, E. coli
tggatgagatttatacccgcgccca

SEQ ID NO: 51609 - DNA, 25 bp, E. coli
taatcatccgttaaaagtgcaggcc

SEQ ID NO: 51610 - DNA, 25 bp, E. coli
taatcatccgtttaaagtgcaggcc

SEQ ID NO: 51611 - DNA, 25 bp, E. coli
gactggcggcaataagctaatcatc

SEQ ID NO: 51612 - DNA, 25 bp, E. coli
gatctacgtcaaaaatgccagcgcc

SEQ ID NO: 51613 - DNA, 25 bp, E. coli
caactggtgattctcgttgcactgg

SEQ ID NO: 51614 - DNA, 25 bp, E. coli
caactggtgattgtcgttgcactgg

SEQ ID NO: 51615 - DNA, 25 bp, E. coli
cagtggcgagctgacatatgaagtc

SEQ ID NO: 51616 - DNA, 25 bp, E. coli
cagtggcgagctcacatatgaagtc

SEQ ID NO: 51617 - DNA, 25 bp, E. coli
catgtggcaggtcttgaccgactac

SEQ ID NO: 51618 - DNA, 25 bp, E. coli
catgtggcaggtgttgaccgactac

SEQ ID NO: 51619 - DNA, 25 bp, E. coli
tatcttgatccatgcctggatcggc

SEQ ID NO: 51620 - DNA, 25 bp, E. coli
tatcttgatccaagcctggatcggc

SEQ ID NO: 51621 - DNA, 25 bp, E. coli
tgaccgactacgttaaaccgctggc

SEQ ID NO: 51622 - DNA, 25 bp, E. coli
tgaccgactacgataaaccgctggc

SEQ ID NO: 51623 - DNA, 25 bp, E. coli
ccaaagtgttcaccctgctggcgct

SEQ ID NO: 51624 - DNA, 25 bp, E. coli
gcctctgcgttctccaaagtgttca

SEQ ID NO: 51625 - DNA, 25 bp, E. coli
ccaaagtgttcagcctgctggcgct

SEQ ID NO: 51626 - DNA, 25 bp, E. coli
gcctctgcgttcaccaaagtgttca

SEQ ID NO: 51627 - DNA, 25 bp, E. coli
gctggcgctgttatctatcttgatc

SEQ ID NO: 51628 - DNA, 25 bp, E. coli
gctggcgctgttttctatcttgatc

SEQ ID NO: 51629 - DNA, 25 bp, E. coli
cgctctacatcaattatatggtcgg

SEQ ID NO: 51630 - DNA, 25 bp, E. coli
cgctctacatcatttatatggtcgg

SEQ ID NO: 51631 - DNA, 25 bp, E. coli
taagcaacgcctccgcattaggacg

SEQ ID NO: 51632 - DNA, 25 bp, E. coli
taagcaacgcctgcgcattaggacg

SEQ ID NO: 51633 - DNA, 25 bp, E. coli
gacgcaatggcgaacatgatttcat

SEQ ID NO: 51634 - DNA, 25 bp, E. coli
gacgcaatggcgtacatgatttcat

SEQ ID NO: 51635 - DNA, 25 bp, E. coli
aatgagcctcatcttctggcacggg

SEQ ID NO: 51636 - DNA, 25 bp, E. coli
aatgagcctcatgttctggcacggg

SEQ ID NO: 51637 - DNA, 25 bp, E. coli
tacagacagtcgacaagggacagcc

SEQ ID NO: 51638 - DNA, 25 bp, E. coli
tacagacagtcgtcaagggacagcc

SEQ ID NO: 51639 - DNA, 25 bp, E. coli
caaaattgtgacagtggaagccctg

SEQ ID NO: 51640 - DNA, 25 bp, E. coli
caaaattgtgactgtggaagccctg

SEQ ID NO: 51641 - DNA, 25 bp, E. coli
taccggaccgctagcagtactgaaa

SEQ ID NO: 51642 - DNA, 25 bp, E. coli
taccagtgatgaaggcaaagagggc

SEQ ID NO: 51643 - DNA, 25 bp, E. coli
taccagtgatgatggcaaagagggc

SEQ ID NO: 51644 - DNA, 25 bp, E. coli
taccggaccgcttgcagtactgaaa

SEQ ID NO: 51645 - DNA, 25 bp, E. coli
ttattgccgcagcagagaccagcga

SEQ ID NO: 51646 - DNA, 25 bp, E. coli
ttattgccgcaggagagaccagcga

SEQ ID NO: 51647 - DNA, 25 bp, E. coli
tccgcgggccggttctgcaatataa

SEQ ID NO: 51648 - DNA, 25 bp, E. coli
tccgcgggccggatctgcaatataa

SEQ ID NO: 51649 - DNA, 25 bp, E. coli
tctcagctggcaacaaaggacgcaa

SEQ ID NO: 51650 - DNA, 25 bp, E. coli
tctcagctggcatcaaaggacgcaa

SEQ ID NO: 51651 - DNA, 25 bp, E. coli
gcttatcaggctccaaccggtggga

SEQ ID NO: 51652 - DNA, 25 bp, E. coli
gcttatcaggctgcaaccggtggga

SEQ ID NO: 51653 - DNA, 25 bp, E. coli
cttaaagagagagccgatatccgcg

SEQ ID NO: 51654 - DNA, 25 bp, E. coli
cttaaagagagacccgatatccgcg

SEQ ID NO: 51655 - DNA, 25 bp, E. coli
taagagccccttccactggcaggaa

SEQ ID NO: 51656 - DNA, 25 bp, E. coli
taagagccccttgcactggcaggaa

SEQ ID NO: 51657 - DNA, 25 bp, E. coli
agtcaaccgggttcggacgatcgcg

SEQ ID NO: 51658 - DNA, 25 bp, E. coli
agtcaaccgggtacggacgatcgcg

SEQ ID NO: 51659 - DNA, 25 bp, E. coli
tattatcctcaggagtcaaccgggt

SEQ ID NO: 51660 - DNA, 25 bp, E. coli
tattatcctcagcagtcaaccgggt

SEQ ID NO: 51661 - DNA, 25 bp, E. coli
ttacgagccggaagactgggaatcg

SEQ ID NO: 51662 - DNA, 25 bp, E. coli
ttacgagccggatgactgggaatcg

SEQ ID NO: 51663 - DNA, 25 bp, E. coli
ccgatctcgcctggtttaaacgcaa

SEQ ID NO: 51664 - DNA, 25 bp, E. coli
ccgatctcgcctcgtttaaacgcaa

SEQ ID NO: 51665 - DNA, 25 bp, E. coli
gaatcggtattctgcgaattccacg

SEQ ID NO: 51666 - DNA, 25 bp, E. coli
gaatcggtattcagcgaattccacg

SEQ ID NO: 51667 - DNA, 25 bp, E. coli
ccgttgccaggaggcaaaaatatta

SEQ ID NO: 51668 - DNA, 25 bp, E. coli
ccgttgccaggacgcaaaaatatta

SEQ ID NO: 51669 - DNA, 25 bp, E. coli
cggtagatcgcgttatcggcatgga

SEQ ID NO: 51670 - DNA, 25 bp, E. coli
cggcgtgtggtgacgtaccagaaat

SEQ ID NO: 51671 - DNA, 25 bp, E. coli
cggcgtgtggtgtcgtaccagaaat

SEQ ID NO: 51672 - DNA, 25 bp, E. coli
cggtagatcgcgatatcggcatgga

SEQ ID NO: 51673 - DNA, 25 bp, E. coli
gatcagtctgatagcggcgttagcg

SEQ ID NO: 51674 - DNA, 25 bp, E. coli
gatcagtctgattgcggcgttagcg

SEQ ID NO: 51675 - DNA, 25 bp, E. coli
tggaaaacgccatgccgtggaacct

SEQ ID NO: 51676 - DNA, 25 bp, E. coli
tggaaaacgccaagccgtggaacct

SEQ ID NO: 51677 - DNA, 25 bp, E. coli
gatgcgcagaacactcacagctatt

SEQ ID NO: 51678 - DNA, 25 bp, E. coli
gatgcgcagaactctcacagctatt

SEQ ID NO: 51679 - DNA, 25 bp, E. coli
catcccagagcgatgttgagtgtaa

SEQ ID NO: 51680 - DNA, 25 bp, E. coli
catcccagagcgttgttgagtgtaa

SEQ ID NO: 51681 - DNA, 25 bp, E. coli
cattcaattacgaacccgtgatggg

SEQ ID NO: 51682 - DNA, 25 bp, E. coli
cattcaattacgtacccgtgatggg

SEQ ID NO: 51683 - DNA, 25 bp, E. coli
tacgcaggattaagcaagttggccc

SEQ ID NO: 51684 - DNA, 25 bp, E. coli
tacgcaggattatgcaagttggccc

SEQ ID NO: 51685 - DNA, 25 bp, E. coli
agctttatcagtcagaaatgccggg

SEQ ID NO: 51686 - DNA, 25 bp, E. coli
agctttatcagtgagaaatgccggg

SEQ ID NO: 51687 - DNA, 25 bp, E. coli
tgatgttagttcattacctcgggca

SEQ ID NO: 51688 - DNA, 25 bp, E. coli
tgatgttagttctttacctcgggca

SEQ ID NO: 51689 - DNA, 25 bp, E. coli
gccgatacgtcagggacactgtgga

SEQ ID NO: 51690 - DNA, 25 bp, E. coli
gccgatacgtcacggacactgtgga

SEQ ID NO: 51691 - DNA, 25 bp, E. coli
gttggcccacgctcacgatagtgtt

SEQ ID NO: 51692 - DNA, 25 bp, E. coli
gttggcccacgcacacgatagtgtt

SEQ ID NO: 51693 - DNA, 25 bp, E. coli
ggtggtttctcatctcatagcgaga

SEQ ID NO: 51694 - DNA, 25 bp, E. coli
ggtggtttctcaactcatagcgaga

SEQ ID NO: 51695 - DNA, 25 bp, E. coli
tggcggagcgtgctatacaactaag

SEQ ID NO: 51696 - DNA, 25 bp, E. coli
tggcggagcgtggtatacaactaag

SEQ ID NO: 51697 - DNA, 25 bp, E. coli
taaggatgacaatctcactccccgc

SEQ ID NO: 51698 - DNA, 25 bp, E. coli
taaggatgacaaactcactccccgc

SEQ ID NO: 51699 - DNA, 25 bp, E. coli
gatgctatttgtgacgggatttcca

SEQ ID NO: 51700 - DNA, 25 bp, E. coli
gatgctatttgtcacgggatttcca

SEQ ID NO: 51701 - DNA, 25 bp, E. coli
taaagacccattgttgccggaggag

SEQ ID NO: 51702 - DNA, 25 bp, E. coli
taaatggctcctcttgctctcggaa

SEQ ID NO: 51703 - DNA, 25 bp, E. coli
tacagacacttttgcatgaagcggg

SEQ ID NO: 51704 - DNA, 25 bp, E. coli
taaatggctcctgttgctctcggaa

SEQ ID NO: 51705 - DNA, 25 bp, E. coli
taaagacccattcttgccggaggag

SEQ ID NO: 51706 - DNA, 25 bp, E. coli
tacagacactttagcatgaagcggg

SEQ ID NO: 51707 - DNA, 25 bp, E. coli
acggcgcgtcagctgtgtatcaaca

SEQ ID NO: 51708 - DNA, 25 bp, E. coli
acggcgcgtcaggtgtgtatcaaca

SEQ ID NO: 51709 - DNA, 25 bp, E. coli
tatcaacatttatcagcgcgtagcg

SEQ ID NO: 51710 - DNA, 25 bp, E. coli
tatcaacatttaacagcgcgtagcg

SEQ ID NO: 51711 - DNA, 25 bp, E. coli
ttttgaagcgcaaataccactggcg

SEQ ID NO: 51712 - DNA, 25 bp, E. coli
ttttgaagcgcatataccactggcg

SEQ ID NO: 51713 - DNA, 25 bp, E. coli
tgtaaacgctgtaccggtcagtggc

SEQ ID NO: 51714 - DNA, 25 bp, E. coli
tgataaaggcttccgcctgacgcga

SEQ ID NO: 51715 - DNA, 25 bp, E. coli
tgataaaggcttgcgcctgacgcga

SEQ ID NO: 51716 - DNA, 25 bp, E. coli
tgtaaacgctgttccggtcagtggc

SEQ ID NO: 51717 - DNA, 25 bp, E. coli
tgaaacctcggtcggtgaactgcct

SEQ ID NO: 51718 - DNA, 25 bp, E. coli
tgaaacctcggtgggtgaactgcct

SEQ ID NO: 51719 - DNA, 25 bp, E. coli
gaaggctggctgcatgtttcccgca

SEQ ID NO: 51720 - DNA, 25 bp, E. coli
gaaggctggctggatgtttcccgca

SEQ ID NO: 51721 - DNA, 25 bp, E. coli
ggtgattcgcttacccatcgtggtg

SEQ ID NO: 51722 - DNA, 25 bp, E. coli
ggtgattcgctttcccatcgtggtg

SEQ ID NO: 51723 - DNA, 25 bp, E. coli
catgctcagggacaagatgccagaa

SEQ ID NO: 51724 - DNA, 25 bp, E. coli
cagggacaagatcccagaatattaa

SEQ ID NO: 51725 - DNA, 25 bp, E. coli
catgctcagggagaagatgccagaa

SEQ ID NO: 51726 - DNA, 25 bp, E. coli
cagggacaagatgccagaatattaa

SEQ ID NO: 51727 - DNA, 25 bp, E. coli
taaaaagaaaataggagcaagaaca

SEQ ID NO: 51728 - DNA, 25 bp, E. coli
taaaaagaaaattggagcaagaaca

SEQ ID NO: 51729 - DNA, 25 bp, E. coli
taccgaagagtttggttggatcgat

SEQ ID NO: 51730 - DNA, 25 bp, E. coli
tatggattagttaataccgaagagt

SEQ ID NO: 51731 - DNA, 25 bp, E. coli
taccgaagagttaggttggatcgat

SEQ ID NO: 51732 - DNA, 25 bp, E. coli
tatggattagtttataccgaagagt

SEQ ID NO: 51733 - DNA, 25 bp, E. coli
tatttgcaacaaggaaaaagtatgg

SEQ ID NO: 51734 - DNA, 25 bp, E. coli
tatcatcaggaattgggaattcgga

SEQ ID NO: 51735 - DNA, 25 bp, E. coli
tatcatcaggaaatgggaattcgga

SEQ ID NO: 51736 - DNA, 25 bp, E. coli
tatttgcaacaacgaaaaagtatgg

SEQ ID NO: 51737 - DNA, 25 bp, E. coli
tgatgagcaaacgtaacgatattac

SEQ ID NO: 51738 - DNA, 25 bp, E. coli
tgatgagcaaacctaacgatattac

SEQ ID NO: 51739 - DNA, 25 bp, E. coli
gaatttcatgattggtattttcctg

SEQ ID NO: 51740 - DNA, 25 bp, E. coli
gaatttcatgataggtattttcctg

SEQ ID NO: 51741 - DNA, 25 bp, E. coli
ggagcaagaacatttttcaacatat

SEQ ID NO: 51742 - DNA, 25 bp, E. coli
ggagcaagaacaattttcaacatat

SEQ ID NO: 51743 - DNA, 25 bp, E. coli
tcaacatattaccatgaatttcatg

SEQ ID NO: 51744 - DNA, 25 bp, E. coli
tcaacatattacgatgaatttcatg

SEQ ID NO: 51745 - DNA, 25 bp, E. coli
taaacgtattgctgccggtacgcaa

SEQ ID NO: 51746 - DNA, 25 bp, E. coli
taaacgtattgcagccggtacgcaa

SEQ ID NO: 51747 - DNA, 25 bp, E. coli
aaagccctggtccatattgttccgc

SEQ ID NO: 51748 - DNA, 25 bp, E. coli
aaagccctggtcgatattgttccgc

SEQ ID NO: 51749 - DNA, 25 bp, E. coli
tgtagttgcctcaaacgatgccacc

SEQ ID NO: 51750 - DNA, 25 bp, E. coli
tgtagttgcctctaacgatgccacc

SEQ ID NO: 51751 - DNA, 25 bp, E. coli
tgatgatctccgacttgaacgctgg

SEQ ID NO: 51752 - DNA, 25 bp, E. coli
tgatgatctccgtcttgaacgctgg

SEQ ID NO: 51753 - DNA, 25 bp, E. coli
tcggtgaactgcaggcaaaagccct

SEQ ID NO: 51754 - DNA, 25 bp, E. coli
tcggtgaactgctggcaaaagccct

SEQ ID NO: 51755 - DNA, 25 bp, E. coli
ctctcggcgcgaaagtatttgtaca

SEQ ID NO: 51756 - DNA, 25 bp, E. coli
ctctcggcgcgatagtatttgtaca

SEQ ID NO: 51757 - DNA, 25 bp, E. coli
ggcaattcaggcattaagcgcgcaa

SEQ ID NO: 51758 - DNA, 25 bp, E. coli
ggcaattcaggctttaagcgcgcaa

SEQ ID NO: 51759 - DNA, 25 bp, E. coli
ggctggttaccggaaaacgcattga

SEQ ID NO: 51760 - DNA, 25 bp, E. coli
ggctggttaccgcaaaacgcattga

SEQ ID NO: 51761 - DNA, 25 bp, E. coli
taagcgcgcaagctttatcagggaa

SEQ ID NO: 51762 - DNA, 25 bp, E. coli
taagcgcgcaaggtttatcagggaa

SEQ ID NO: 51763 - DNA, 25 bp, E. coli
taattacttcctgatgggcggctcg

SEQ ID NO: 51764 - DNA, 25 bp, E. coli
taattacttcctcatgggcggctcg

SEQ ID NO: 51765 - DNA, 25 bp, E. coli
gacggattccacaaagagagcgagc

SEQ ID NO: 51766 - DNA, 25 bp, E. coli
gacggattccactaagagagcgagc

SEQ ID NO: 51767 - DNA, 25 bp, E. coli
cagcttttagaaggcgaagtcacgc

SEQ ID NO: 51768 - DNA, 25 bp, E. coli
caacaacgttgtccggccagtgtaa

SEQ ID NO: 51769 - DNA, 25 bp, E. coli
caacaacgttgtgcggccagtgtaa

SEQ ID NO: 51770 - DNA, 25 bp, E. coli
cagcttttagaacgcgaagtcacgc

SEQ ID NO: 51771 - DNA, 25 bp, E. coli
tatcccttattcttgccgcgcgggc

SEQ ID NO: 51772 - DNA, 25 bp, E. coli
tatgatcacggaacctgacggtacg

SEQ ID NO: 51773 - DNA, 25 bp, E. coli
tatgatcacggatcctgacggtacg

SEQ ID NO: 51774 - DNA, 25 bp, E. coli
tatcccttattcatgccgcgcgggc

SEQ ID NO: 51775 - DNA, 25 bp, E. coli
tgtaaaaatggagcaattccgcccc

SEQ ID NO: 51776 - DNA, 25 bp, E. coli
tgtaaaaatggaccaattccgcccc

SEQ ID NO: 51777 - DNA, 25 bp, E. coli
tgactggcagggtcaggcatttcgt

SEQ ID NO: 51778 - DNA, 25 bp, E. coli
tgactggcagggacaggcatttcgt

SEQ ID NO: 51779 - DNA, 25 bp, E. coli
tcctgttaaatccatgcgcggcatt

SEQ ID NO: 51780 - DNA, 25 bp, E. coli
tcctgttaaatcgatgcgcggcatt

SEQ ID NO: 51781 - DNA, 25 bp, E. coli
gaaaaagggcaaaaacatccggcag

SEQ ID NO: 51782 - DNA, 25 bp, E. coli
gaaaaagggcaataacatccggcag

SEQ ID NO: 51783 - DNA, 25 bp, E. coli
gggcacacatttaaccgcgcgaatt

SEQ ID NO: 51784 - DNA, 25 bp, E. coli
gggcacacattttaccgcgcgaatt

SEQ ID NO: 51785 - DNA, 25 bp, E. coli
taagtggattttactcccgcgaagt

SEQ ID NO: 51786 - DNA, 25 bp, E. coli
taagtggatttttctcccgcgaagt

SEQ ID NO: 51787 - DNA, 25 bp, E. coli
taattgcccgtattagcggcgtgat

SEQ ID NO: 51788 - DNA, 25 bp, E. coli
taattgcccgtaatagcggcgtgat

SEQ ID NO: 51789 - DNA, 25 bp, E. coli
cagcgtctgaccctagtaaattcta

SEQ ID NO: 51790 - DNA, 25 bp, E. coli
cagcgtacgtctcaacgtgaacgta

SEQ ID NO: 51791 - DNA, 25 bp, E. coli
cagcgtacgtctgaacgtgaacgta

SEQ ID NO: 51792 - DNA, 25 bp, E. coli
cagcgtctgaccgtagtaaattcta

SEQ ID NO: 51793 - DNA, 25 bp, E. coli
acgtctgaacgtgaacgtacgtgaa

SEQ ID NO: 51794 - DNA, 25 bp, E. coli
acgtttaagccagccaggtggttct

SEQ ID NO: 51795 - DNA, 25 bp, E. coli
atattgatgaacaggaagctctgca

SEQ ID NO: 51796 - DNA, 25 bp, E. coli
acgtttaagccacccaggtggttct

SEQ ID NO: 51797 - DNA, 25 bp, E. coli
atattgatgaactggaagctctgca

SEQ ID NO: 51798 - DNA, 25 bp, E. coli
acgtctgaacgtcaacgtacgtgaa

SEQ ID NO: 51799 - DNA, 25 bp, E. coli
tgatgaactggaagctctgcatcag

SEQ ID NO: 51800 - DNA, 25 bp, E. coli
tgatgaactggatgctctgcatcag

SEQ ID NO: 51801 - DNA, 25 bp, E. coli
tcgacatggcgccagagctggctga

SEQ ID NO: 51802 - DNA, 25 bp, E. coli
tcgacatggcgcgagagctggctga

SEQ ID NO: 51803 - DNA, 25 bp, E. coli
tctgcgctcagcgtctgaccgtagt

SEQ ID NO: 51804 - DNA, 25 bp, E. coli
tctgcgctcagcctctgaccgtagt

SEQ ID NO: 51805 - DNA, 25 bp, E. coli
gccaggtggttctgaagatcagcgt

SEQ ID NO: 51806 - DNA, 25 bp, E. coli
gccaggtggttcagaagatcagcgt

SEQ ID NO: 51807 - DNA, 25 bp, E. coli
ggccaggtgaactgcgtacgtctga

SEQ ID NO: 51808 - DNA, 25 bp, E. coli
ggccaggtgaacagcgtacgtctga

SEQ ID NO: 51809 - DNA, 25 bp, E. coli
taagccagccagctggttctgaaga

SEQ ID NO: 51810 - DNA, 25 bp, E. coli
taagccagccaggtggttctgaaga

SEQ ID NO: 51811 - DNA, 25 bp, E. coli
caaaaacggctagtattcactggga

SEQ ID NO: 51812 - DNA, 25 bp, E. coli
caaaaacggctactattcactggga

SEQ ID NO: 51813 - DNA, 25 bp, E. coli
taaattccagtaccccaaaagcagc

SEQ ID NO: 51814 - DNA, 25 bp, E. coli
taaattccagtagcccaaaagcagc

SEQ ID NO: 51815 - DNA, 25 bp, E. coli
tatctcgacaagttcgaaagtccgg

SEQ ID NO: 51816 - DNA, 25 bp, E. coli
tatctcgacaagatcgaaagtccgg

SEQ ID NO: 51817 - DNA, 25 bp, E. coli
tatatttgaggtgactaagcggcca

SEQ ID NO: 51818 - DNA, 25 bp, E. coli
tatatttgaggtcactaagcggcca

SEQ ID NO: 51819 - DNA, 25 bp, E. coli
tgagttgcatataaccgcgttgggt

SEQ ID NO: 51820 - DNA, 25 bp, E. coli
tgagttgcatattaccgcgttgggt

SEQ ID NO: 51821 - DNA, 25 bp, E. coli
tctgtaccgacgagcaaaagctgga

SEQ ID NO: 51822 - DNA, 25 bp, E. coli
tctggaattgctgcggaaatgcgct

SEQ ID NO: 51823 - DNA, 25 bp, E. coli
tctgtaccgacgtgcaaaagctgga

SEQ ID NO: 51824 - DNA, 25 bp, E. coli
tctggaattgctccggaaatgcgct

SEQ ID NO: 51825 - DNA, 25 bp, E. coli
gcaatctcacttactggcgatccgg

SEQ ID NO: 51826 - DNA, 25 bp, E. coli
gcaatctcactttctggcgatccgg

SEQ ID NO: 51827 - DNA, 25 bp, E. coli
cgaattgggttgacaggcgttacac

SEQ ID NO: 51828 - DNA, 25 bp, E. coli
cgaattgggttgtcaggcgttacac

SEQ ID NO: 51829 - DNA, 25 bp, E. coli
cattattagcctggaagacacgaga

SEQ ID NO: 51830 - DNA, 25 bp, E. coli
cattattagcctcgaagacacgaga

SEQ ID NO: 51831 - DNA, 25 bp, E. coli
taagcggccaatgcaggagttgtcg

SEQ ID NO: 51832 - DNA, 25 bp, E. coli
taagcggccaatccaggagttgtcg

SEQ ID NO: 51833 - DNA, 25 bp, E. coli
caatcctctggcgatgctgactcat

SEQ ID NO: 51834 - DNA, 25 bp, E. coli
caatcctctggccatgctgactcat

SEQ ID NO: 51835 - DNA, 25 bp, E. coli
aggctccggtaattccaccactctg

SEQ ID NO: 51836 - DNA, 25 bp, E. coli
aggctccggtaaatccaccactctg

SEQ ID NO: 51837 - DNA, 25 bp, E. coli
acagtggcgtgatccgctttgccgg

SEQ ID NO: 51838 - DNA, 25 bp, E. coli
acagtggcgtgaaccgctttgccgg

SEQ ID NO: 51839 - DNA, 25 bp, E. coli
tttgggcatagtcaactgggtgtcc

SEQ ID NO: 51840 - DNA, 25 bp, E. coli
tttgggcatagtgaactgggtgtcc

SEQ ID NO: 51841 - DNA, 25 bp, E. coli
tgattggtacatcaggctccggtaa

SEQ ID NO: 51842 - DNA, 25 bp, E. coli
tgattggtacatgaggctccggtaa

SEQ ID NO: 51843 - DNA, 25 bp, E. coli
tctggcgatgctcactcatccggcg

SEQ ID NO: 51844 - DNA, 25 bp, E. coli
tctggcgatgctgactcatccggcg

SEQ ID NO: 51845 - DNA, 25 bp, E. coli
gcatagtgaactcggtgtccgcctg

SEQ ID NO: 51846 - DNA, 25 bp, E. coli
gcatagtgaactgggtgtccgcctg

SEQ ID NO: 51847 - DNA, 25 bp, E. coli
gcaagtcttgctcatggatgagcca

SEQ ID NO: 51848 - DNA, 25 bp, E. coli
gcaagtcttgctgatggatgagcca

SEQ ID NO: 51849 - DNA, 25 bp, E. coli
ctggagccggatttgcgtgagcgtt

SEQ ID NO: 51850 - DNA, 25 bp, E. coli
ctggagccggatatgcgtgagcgtt

SEQ ID NO: 51851 - DNA, 25 bp, E. coli
tggatgagccatacggcgcactgga

SEQ ID NO: 51852 - DNA, 25 bp, E. coli
tggatgagccattcggcgcactgga

SEQ ID NO: 51853 - DNA, 25 bp, E. coli
gagcatgacagtcgcgtgatccgct

SEQ ID NO: 51854 - DNA, 25 bp, E. coli
gagcatgacagtggcgtgatccgct

SEQ ID NO: 51855 - DNA, 25 bp, E. coli
tactcaaagacgtggccgctggaaa

SEQ ID NO: 51856 - DNA, 25 bp, E. coli
tactcaaagacgaggccgctggaaa

SEQ ID NO: 51857 - DNA, 25 bp, E. coli
tacccatgcaggcattgtggtggct

SEQ ID NO: 51858 - DNA, 25 bp, E. coli
tatgcgatccgttttatgccgccga

SEQ ID NO: 51859 - DNA, 25 bp, E. coli
tatgcgatccgtattatgccgccga

SEQ ID NO: 51860 - DNA, 25 bp, E. coli
tacccatgcagggattgtggtggct

SEQ ID NO: 51861 - DNA, 25 bp, E. coli
tatgccgccgatcgccgtatttact

SEQ ID NO: 51862 - DNA, 25 bp, E. coli
tatgccgccgatggccgtatttact

SEQ ID NO: 51863 - DNA, 25 bp, E. coli
tgttcgccttaactttacccatgca

SEQ ID NO: 51864 - DNA, 25 bp, E. coli
tgtcaacgccggttaatcgttctgt

SEQ ID NO: 51865 - DNA, 25 bp, E. coli
tgtcaacgccggataatcgttctgt

SEQ ID NO: 51866 - DNA, 25 bp, E. coli
tgttcgccttaagtttacccatgca

SEQ ID NO: 51867 - DNA, 25 bp, E. coli
tcgaaaatcgcgatatcaagatgac

SEQ ID NO: 51868 - DNA, 25 bp, E. coli
tcgaaaatcgcgttatcaagatgac

SEQ ID NO: 51869 - DNA, 25 bp, E. coli
tctctgctggcacattgccctgggc

SEQ ID NO: 51870 - DNA, 25 bp, E. coli
tctctgctggcagattgccctgggc

SEQ ID NO: 51871 - DNA, 25 bp, E. coli
gatcgccgtattaactctctgctgg

SEQ ID NO: 51872 - DNA, 25 bp, E. coli
gatcgccgtatttactctctgctgg

SEQ ID NO: 51873 - DNA, 25 bp, E. coli
gggacagcattactcaaagacgtgg

SEQ ID NO: 51874 - DNA, 25 bp, E. coli
gggacagcattagtcaaagacgtgg

SEQ ID NO: 51875 - DNA, 25 bp, E. coli
tcaagatgacgccttatgcgatccg

SEQ ID NO: 51876 - DNA, 25 bp, E. coli
tcaagatgacgcgttatgcgatccg

SEQ ID NO: 51877 - DNA, 25 bp, E. coli
aatcagggcaacaagcgtaactggc

SEQ ID NO: 51878 - DNA, 25 bp, E. coli
aatcagggcaactagcgtaactggc

SEQ ID NO: 51879 - DNA, 25 bp, E. coli
catgtgctcgattaagtacagggcg

SEQ ID NO: 51880 - DNA, 25 bp, E. coli
catgtgctcgataaagtacagggcg

SEQ ID NO: 51881 - DNA, 25 bp, E. coli
aacttgccgatgttgtgaccgatcc

SEQ ID NO: 51882 - DNA, 25 bp, E. coli
aacttgccgatgatgtgaccgatcc

SEQ ID NO: 51883 - DNA, 25 bp, E. coli
tagatgaaacattccgtcaggcgat

SEQ ID NO: 51884 - DNA, 25 bp, E. coli
tagatgaaacataccgtcaggcgat

SEQ ID NO: 51885 - DNA, 25 bp, E. coli
ttttgctggtcataggcggctgcgc

SEQ ID NO: 51886 - DNA, 25 bp, E. coli
ttttgctggtcaaaggcggctgcgc

SEQ ID NO: 51887 - DNA, 25 bp, E. coli
tgaccgatcctgttgaacttctgcg

SEQ ID NO: 51888 - DNA, 25 bp, E. coli
tgaccgatcctgatgaacttctgcg

SEQ ID NO: 51889 - DNA, 25 bp, E. coli
tgcataaatacctcaaccgggcgct

SEQ ID NO: 51890 - DNA, 25 bp, E. coli
tgcataaataccacaaccgggcgct

SEQ ID NO: 51891 - DNA, 25 bp, E. coli
ggactggttgctcacacaactggaa

SEQ ID NO: 51892 - DNA, 25 bp, E. coli
tggagaaaggcaatccggacgatcc

SEQ ID NO: 51893 - DNA, 25 bp, E. coli
tggagaaaggcattccggacgatcc

SEQ ID NO: 51894 - DNA, 25 bp, E. coli
ggactggttgctgacacaactggaa

SEQ ID NO: 51895 - DNA, 25 bp, E. coli
tggcgaaagatcacgagctggactg

SEQ ID NO: 51896 - DNA, 25 bp, E. coli
tggcgaaagatctcgagctggactg

SEQ ID NO: 51897 - DNA, 25 bp, E. coli
gagtatgttgctccgcatccggaac

SEQ ID NO: 51898 - DNA, 25 bp, E. coli
gagtatgttgctgcgcatccggaac

SEQ ID NO: 51899 - DNA, 25 bp, E. coli
aaggtatcttctactgcttgatcga

SEQ ID NO: 51900 - DNA, 25 bp, E. coli
aaggtatcttcttctgcttgatcga

SEQ ID NO: 51901 - DNA, 25 bp, E. coli
aactcgctgaatgaggtttctcaga

SEQ ID NO: 51902 - DNA, 25 bp, E. coli
aaaatgaccttcaccaacagggagg

SEQ ID NO: 51903 - DNA, 25 bp, E. coli
aaaatgaccttctccaacagggagg

SEQ ID NO: 51904 - DNA, 25 bp, E. coli
aactcgctgaatcaggtttctcaga

SEQ ID NO: 51905 - DNA, 25 bp, E. coli
tagccgaacagagaaagtctatgct

SEQ ID NO: 51906 - DNA, 25 bp, E. coli
tatgaggcttcatctctaaaaagag

SEQ ID NO: 51907 - DNA, 25 bp, E. coli
tagccgaacagacaaagtctatgct

SEQ ID NO: 51908 - DNA, 25 bp, E. coli
tatgaggcttcaactctaaaaagag

SEQ ID NO: 51909 - DNA, 25 bp, E. coli
tatagtcagtaatggtagccgaaca

SEQ ID NO: 51910 - DNA, 25 bp, E. coli
tatagtcagtaaaggtagccgaaca

SEQ ID NO: 51911 - DNA, 25 bp, E. coli
ccagagtggtatagaaaaaatgacc

SEQ ID NO: 51912 - DNA, 25 bp, E. coli
ccagagtggtattgaaaaaatgacc

SEQ ID NO: 51913 - DNA, 25 bp, E. coli
ctaatgagaaaacgaaatatgaggc

SEQ ID NO: 51914 - DNA, 25 bp, E. coli
ctaatgagaaaaggaaatatgaggc

SEQ ID NO: 51915 - DNA, 25 bp, E. coli
gatcgattcgttgataaactcgctg

SEQ ID NO: 51916 - DNA, 25 bp, E. coli
gatcgattcgttcataaactcgctg

SEQ ID NO: 51917 - DNA, 25 bp, E. coli
ggtttctcagagcaacgaattatcg

SEQ ID NO: 51918 - DNA, 25 bp, E. coli
ggtttctcagaggaacgaattatcg

SEQ ID NO: 51919 - DNA, 25 bp, E. coli
tcaacaaagagcctatgaagcatgt

SEQ ID NO: 51920 - DNA, 25 bp, E. coli
tcaacaaagagcgtatgaagcatgt

SEQ ID NO: 51921 - DNA, 25 bp, E. coli
caagccgacagccttaaggtgatta

SEQ ID NO: 51922 - DNA, 25 bp, E. coli
caagccgacagcgttaaggtgatta

SEQ ID NO: 51923 - DNA, 25 bp, E. coli
taacatatacccatttgactcaggg

SEQ ID NO: 51924 - DNA, 25 bp, E. coli
tactcaacagactaaatagcactcc

SEQ ID NO: 51925 - DNA, 25 bp, E. coli
taacatatacccttttgactcaggg

SEQ ID NO: 51926 - DNA, 25 bp, E. coli
tactcaacagacaaaatagcactcc

SEQ ID NO: 51927 - DNA, 25 bp, E. coli
aaaaatagcacctctaacatacgga

SEQ ID NO: 51928 - DNA, 25 bp, E. coli
aaaaatagcaccactaacatacgga

SEQ ID NO: 51929 - DNA, 25 bp, E. coli
tagtcaataaaatcccacaagccga

SEQ ID NO: 51930 - DNA, 25 bp, E. coli
tagtcaataaaaacccacaagccga

SEQ ID NO: 51931 - DNA, 25 bp, E. coli
tagctggaataaaggaacgtcatcg

SEQ ID NO: 51932 - DNA, 25 bp, E. coli
tagctggaataatggaacgtcatcg

SEQ ID NO: 51933 - DNA, 25 bp, E. coli
tcacgcccgactacgcttatactgt

SEQ ID NO: 51934 - DNA, 25 bp, E. coli
tcacgcccgacttcgcttatactgt

SEQ ID NO: 51935 - DNA, 25 bp, E. coli
cattacagagcatagatacatgggt

SEQ ID NO: 51936 - DNA, 25 bp, E. coli
cattacagagcaaagatacatgggt

SEQ ID NO: 51937 - DNA, 25 bp, E. coli
ggtttgtatttatccgctccagcaa

SEQ ID NO: 51938 - DNA, 25 bp, E. coli
ggtttgtatttaaccgctccagcaa

SEQ ID NO: 51939 - DNA, 25 bp, E. coli
taagtggatactacctactcaacag

SEQ ID NO: 51940 - DNA, 25 bp, E. coli
taagtggatacttcctactcaacag

SEQ ID NO: 51941 - DNA, 25 bp, E. coli
taataggaattcttgtcacgcccga

SEQ ID NO: 51942 - DNA, 25 bp, E. coli
taataggaattcatgtcacgcccga

SEQ ID NO: 51943 - DNA, 25 bp, E. coli
aaccgcatgtccttcaggtgttgcc

SEQ ID NO: 51944 - DNA, 25 bp, E. coli
aaccgcatgtccatcaggtgttgcc

SEQ ID NO: 51945 - DNA, 25 bp, E. coli
cagtaaccgcatgtccttcaggtgt

SEQ ID NO: 51946 - DNA, 25 bp, E. coli
cagtaaccgcatctccttcaggtgt

SEQ ID NO: 51947 - DNA, 25 bp, E. coli
accgcatgtcctacaggtgttgccc

SEQ ID NO: 51948 - DNA, 25 bp, E. coli
agtaaccgcatgaccttcaggtgtt

SEQ ID NO: 51949 - DNA, 25 bp, E. coli
accgcatgtccttcaggtgttgccc

SEQ ID NO: 51950 - DNA, 25 bp, E. coli
agtaaccgcatgtccttcaggtgtt

SEQ ID NO: 51951 - DNA, 25 bp, E. coli
gcagtaaccgcatgtccttcaggtg

SEQ ID NO: 51952 - DNA, 25 bp, E. coli
gcagtaaccgcaagtccttcaggtg

SEQ ID NO: 51953 - DNA, 25 bp, E. coli
cgcatgtccttcaggtgttgcccat

SEQ ID NO: 51954 - DNA, 25 bp, E. coli
ccgcatgtccttgaggtgttgccca

SEQ ID NO: 51955 - DNA, 25 bp, E. coli
ccgcatgtccttcaggtgttgccca

SEQ ID NO: 51956 - DNA, 25 bp, E. coli
cgcatgtccttctggtgttgcccat

SEQ ID NO: 51957 - DNA, 25 bp, E. coli
gtaaccgcatgtccttcaggtgttg

SEQ ID NO: 51958 - DNA, 25 bp, E. coli
gtaaccgcatgtgcttcaggtgttg

SEQ ID NO: 51959 - DNA, 25 bp, E. coli
taaccgcatgtcgttcaggtgttgc

SEQ ID NO: 51960 - DNA, 25 bp, E. coli
taaccgcatgtccttcaggtgttgc

SEQ ID NO: 51961 - DNA, 25 bp, E. coli
aatgagcaggcgcttgggttctata

SEQ ID NO: 51962 - DNA, 25 bp, E. coli
aatgagcaggcggttgggttctata

SEQ ID NO: 51963 - DNA, 25 bp, E. coli
catatggatgcggtgtttatcgatc

SEQ ID NO: 51964 - DNA, 25 bp, E. coli
catatggatgcgctgtttatcgatc

SEQ ID NO: 51965 - DNA, 25 bp, E. coli
tatcgatcctgatgtgcgcggctgc

SEQ ID NO: 51966 - DNA, 25 bp, E. coli
tatcgatcctgaagtgcgcggctgc

SEQ ID NO: 51967 - DNA, 25 bp, E. coli
ttaatgagcaaattgagcaggcggt

SEQ ID NO: 51968 - DNA, 25 bp, E. coli
ttaatgagcaaaatgagcaggcggt

SEQ ID NO: 51969 - DNA, 25 bp, E. coli
tggttattagtaatcgccgctcacg

SEQ ID NO: 51970 - DNA, 25 bp, E. coli
tgtttatcgatcgtgatgtgcgcgg

SEQ ID NO: 51971 - DNA, 25 bp, E. coli
tgtttatcgatcctgatgtgcgcgg

SEQ ID NO: 51972 - DNA, 25 bp, E. coli
gtattcgccgctcacggcatgagga

SEQ ID NO: 51973 - DNA, 25 bp, E. coli
gttattagtattcgccgctcacggc

SEQ ID NO: 51974 - DNA, 25 bp, E. coli
gtattcgccgctgacggcatgagga

SEQ ID NO: 51975 - DNA, 25 bp, E. coli
gttattagtattggccgctcacggc

SEQ ID NO: 51976 - DNA, 25 bp, E. coli
tggttattagtattcgccgctcacg

SEQ ID NO: 51977 - DNA, 25 bp, E. coli
taagtgggcagcttatggatgcgct

SEQ ID NO: 51978 - DNA, 25 bp, E. coli
taagtgggcagcatatggatgcgct

SEQ ID NO: 51979 - DNA, 25 bp, E. coli
gatgcgctgtttttcgatcctgatg

SEQ ID NO: 51980 - DNA, 25 bp, E. coli
gaggaactcgttccgatttggtgtc

SEQ ID NO: 51981 - DNA, 25 bp, E. coli
gaggaactcgttgcgatttggtgtc

SEQ ID NO: 51982 - DNA, 25 bp, E. coli
gatgcgctgtttatcgatcctgatg

SEQ ID NO: 51983 - DNA, 25 bp, E. coli
aacccgcaaggcgttgcaggcagcg

SEQ ID NO: 51984 - DNA, 25 bp, E. coli
aacccgcaaggccttgcaggcagcg

SEQ ID NO: 51985 - DNA, 25 bp, E. coli
caggcagcgggcttgacttttcgcg

SEQ ID NO: 51986 - DNA, 25 bp, E. coli
caggcagcgggcatgacttttcgcg

SEQ ID NO: 51987 - DNA, 25 bp, E. coli
tacaaacccgcatggcgttgcaggc

SEQ ID NO: 51988 - DNA, 25 bp, E. coli
tacaaacccgcaaggcgttgcaggc

SEQ ID NO: 51989 - DNA, 25 bp, E. coli
tatttcactccagggtcggcgtcat

SEQ ID NO: 51990 - DNA, 25 bp, E. coli
tattccccgtgaattacgcggcggc

SEQ ID NO: 51991 - DNA, 25 bp, E. coli
tatttcactccacggtcggcgtcat

SEQ ID NO: 51992 - DNA, 25 bp, E. coli
tattccccgtgatttacgcggcggc

SEQ ID NO: 51993 - DNA, 25 bp, E. coli
tttttatttcacaccacggtcggcg

SEQ ID NO: 51994 - DNA, 25 bp, E. coli
ttcgcgtcagcgttattccccgtga

SEQ ID NO: 51995 - DNA, 25 bp, E. coli
tttttatttcactccacggtcggcg

SEQ ID NO: 51996 - DNA, 25 bp, E. coli
ttcgcgtcagcgatattccccgtga

SEQ ID NO: 51997 - DNA, 25 bp, E. coli
gctgcgggttatccatttggctgac

SEQ ID NO: 51998 - DNA, 25 bp, E. coli
gctgcgggttatgcatttggctgac

SEQ ID NO: 51999 - DNA, 25 bp, E. coli
ggtcggcgtcatacaaacccgcaag

SEQ ID NO: 52000 - DNA, 25 bp, E. coli
ggttatgcatttggctgacctgtcc

SEQ ID NO: 52001 - DNA, 25 bp, E. coli
ggttatgcatttcgctgacctgtcc

SEQ ID NO: 52002 - DNA, 25 bp, E. coli
ggtcggcgtcattcaaacccgcaag

SEQ ID NO: 52003 - DNA, 25 bp, E. coli
ggcatgacttttggcgtcagcgata

SEQ ID NO: 52004 - DNA, 25 bp, E. coli
ggcatgacttttcgcgtcagcgata

SEQ ID NO: 52005 - DNA, 25 bp, E. coli
caactaaatttgatggctcgcatga

SEQ ID NO: 52006 - DNA, 25 bp, E. coli
caactaaatttgttggctcgcatga

SEQ ID NO: 52007 - DNA, 25 bp, E. coli
cacactttgctaatggtgatatcgc

SEQ ID NO: 52008 - DNA, 25 bp, E. coli
cacactttgctattggtgatatcgc

SEQ ID NO: 52009 - DNA, 25 bp, E. coli
cagaattacatgttgcacgcccttt

SEQ ID NO: 52010 - DNA, 25 bp, E. coli
cagaattacatgatgcacgcccttt

SEQ ID NO: 52011 - DNA, 25 bp, E. coli
taaaagtgagtgctttacctctgtc

SEQ ID NO: 52012 - DNA, 25 bp, E. coli
aaacggcattggtgttggaacaaca

SEQ ID NO: 52013 - DNA, 25 bp, E. coli
aaacggcattggagttggaacaaca

SEQ ID NO: 52014 - DNA, 25 bp, E. coli
tccattgcaagaacaagagcgcatt

SEQ ID NO: 52015 - DNA, 25 bp, E. coli
tccattgcaagatcaagagcgcatt

SEQ ID NO: 52016 - DNA, 25 bp, E. coli
tctaccgcaaagtgaacaagatcgc

SEQ ID NO: 52017 - DNA, 25 bp, E. coli
tctaccgcaaagagaacaagatcgc

SEQ ID NO: 52018 - DNA, 25 bp, E. coli
tctgctggtcagaaacgtgttccaa

SEQ ID NO: 52019 - DNA, 25 bp, E. coli
tctgctggtcagtaacgtgttccaa

SEQ ID NO: 52020 - DNA, 25 bp, E. coli
gaatcacaaatgactggttctgctg

SEQ ID NO: 52021 - DNA, 25 bp, E. coli
gaatcacaaatgtctggttctgctg

SEQ ID NO: 52022 - DNA, 25 bp, E. coli
gacactatttccacttctaccgcaa

SEQ ID NO: 52023 - DNA, 25 bp, E. coli
gacactatttcctcttctaccgcaa

SEQ ID NO: 52024 - DNA, 25 bp, E. coli
tggatgggagtggacaacgctaact

SEQ ID NO: 52025 - DNA, 25 bp, E. coli
tggatgggagtgcacaacgctaact

SEQ ID NO: 52026 - DNA, 25 bp, E. coli
taaaagtgagtggtttacctctgtc

SEQ ID NO: 52027 - DNA, 25 bp, E. coli
caatcatcgtcatggtatggccagg

SEQ ID NO: 52028 - DNA, 25 bp, E. coli
caatcatcgtcaaggtatggccagg

SEQ ID NO: 52029 - DNA, 25 bp, E. coli
cactggataatcagagcctcgggta

SEQ ID NO: 52030 - DNA, 25 bp, E. coli
cactggataatctgagcctcgggta

SEQ ID NO: 52031 - DNA, 25 bp, E. coli
cagttcagcacattcagtttcggca

SEQ ID NO: 52032 - DNA, 25 bp, E. coli
cagttcagcacaatcagtttcggca

SEQ ID NO: 52033 - DNA, 25 bp, E. coli
ttatttgtggtcgtcgcgcttgggc

SEQ ID NO: 52034 - DNA, 25 bp, E. coli
ttatttgtggtcctcgcgcttgggc

SEQ ID NO: 52035 - DNA, 25 bp, E. coli
ttttacaagtcaccggcgatgcccg

SEQ ID NO: 52036 - DNA, 25 bp, E. coli
ttttacaagtcagcggcgatgcccg

SEQ ID NO: 52037 - DNA, 25 bp, E. coli
tgcagcatcaggacttacagaccag

SEQ ID NO: 52038 - DNA, 25 bp, E. coli
tgcagcatcaggtcttacagaccag

SEQ ID NO: 52039 - DNA, 25 bp, E. coli
tcggtgctggcgttacactgcgtca

SEQ ID NO: 52040 - DNA, 25 bp, E. coli
tctatgacgtcgacaccggttctgg

SEQ ID NO: 52041 - DNA, 25 bp, E. coli
tcggtgctggcgatacactgcgtca

SEQ ID NO: 52042 - DNA, 25 bp, E. coli
tctatgacgtcgtcaccggttctgg

SEQ ID NO: 52043 - DNA, 25 bp, E. coli
cattcgtagccagattgagatgccg

SEQ ID NO: 52044 - DNA, 25 bp, E. coli
cattcgtagccacattgagatgccg

SEQ ID NO: 52045 - DNA, 25 bp, E. coli
tggaaagcaggctgctctcactggc

SEQ ID NO: 52046 - DNA, 25 bp, E. coli
tggaaagcaggcagctctcactggc

SEQ ID NO: 52047 - DNA, 25 bp, E. coli
gatcgtgaccttctcgacatgcgta

SEQ ID NO: 52048 - DNA, 25 bp, E. coli
gatcgtgaccttgtcgacatgcgta

SEQ ID NO: 52049 - DNA, 25 bp, E. coli
cattgggtacgcgaaagtattctgg

SEQ ID NO: 52050 - DNA, 25 bp, E. coli
caggtgtatgtgacgccattgcgct

SEQ ID NO: 52051 - DNA, 25 bp, E. coli
caggtgtatgtgtcgccattgcgct

SEQ ID NO: 52052 - DNA, 25 bp, E. coli
tacgtaaaatatgcggaactggcct

SEQ ID NO: 52053 - DNA, 25 bp, E. coli
tacgtaaaatatccggaactggcct

SEQ ID NO: 52054 - DNA, 25 bp, E. coli
tatatactggcagattcgatgggcg

SEQ ID NO: 52055 - DNA, 25 bp, E. coli
tatatactggcacattcgatgggcg

SEQ ID NO: 52056 - DNA, 25 bp, E. coli
ttatttctgcaacgccatccaggtg

SEQ ID NO: 52057 - DNA, 25 bp, E. coli
ttatttctgcaaggccatccaggtg

SEQ ID NO: 52058 - DNA, 25 bp, E. coli
gctgcttttaccttgggaccgctga

SEQ ID NO: 52059 - DNA, 25 bp, E. coli
gctgcttttaccatgggaccgctga

SEQ ID NO: 52060 - DNA, 25 bp, E. coli
gactgggaaacatgagaaaacgcgt

SEQ ID NO: 52061 - DNA, 25 bp, E. coli
gactgggaaacaagagaaaacgcgt

SEQ ID NO: 52062 - DNA, 25 bp, E. coli
cgtcatttatgggacggcagatcct

SEQ ID NO: 52063 - DNA, 25 bp, E. coli
cgtcatttatggcacggcagatcct

SEQ ID NO: 52064 - DNA, 25 bp, E. coli
cattgggtacgccaaagtattctgg

SEQ ID NO: 52065 - DNA, 25 bp, E. coli
gtactgacccactgcagacagcgat

SEQ ID NO: 52066 - DNA, 25 bp, E. coli
gtactgacccacagcagacagcgat

SEQ ID NO: 52067 - DNA, 25 bp, E. coli
gatgacccaacgattcgcgtcggtg

SEQ ID NO: 52068 - DNA, 25 bp, E. coli
gatgggcggtgcgatctccacatta

SEQ ID NO: 52069 - DNA, 25 bp, E. coli
gatgggcggtgccatctccacatta

SEQ ID NO: 52070 - DNA, 25 bp, E. coli
gatgacccaacgtttcgcgtcggtg

SEQ ID NO: 52071 - DNA, 25 bp, E. coli
tacggaattcactttgtcatatcag

SEQ ID NO: 52072 - DNA, 25 bp, E. coli
tacggaattcacattgtcatatcag

SEQ ID NO: 52073 - DNA, 25 bp, E. coli
atatcagtgccaacattccgccttc

SEQ ID NO: 52074 - DNA, 25 bp, E. coli
atatcagtgccatcattccgccttc

SEQ ID NO: 52075 - DNA, 25 bp, E. coli
aagttgacgcgggaacaggtattgt

SEQ ID NO: 52076 - DNA, 25 bp, E. coli
aagttgacgcggcaacaggtattgt

SEQ ID NO: 52077 - DNA, 25 bp, E. coli
taccgatcgttaagtcagtcgcggg

SEQ ID NO: 52078 - DNA, 25 bp, E. coli
taccgatcgttatgtcagtcgcggg

SEQ ID NO: 52079 - DNA, 25 bp, E. coli
ttgtcatatcagtgccatcattccg

SEQ ID NO: 52080 - DNA, 25 bp, E. coli
ttgtcatatcagagccatcattccg

SEQ ID NO: 52081 - DNA, 25 bp, E. coli
tcccctttggtcagccagtaggcaa

SEQ ID NO: 52082 - DNA, 25 bp, E. coli
tcccctttggtctgccagtaggcaa

SEQ ID NO: 52083 - DNA, 25 bp, E. coli
ccttatgtttgattacggaattcac

SEQ ID NO: 52084 - DNA, 25 bp, E. coli
ccatgtgagcgaagttgacgcggca

SEQ ID NO: 52085 - DNA, 25 bp, E. coli
ccttatgtttgaatacggaattcac

SEQ ID NO: 52086 - DNA, 25 bp, E. coli
ccatgtgagcgatgttgacgcggca

SEQ ID NO: 52087 - DNA, 25 bp, E. coli
ggtcagccagtaggcaactgtagcc

SEQ ID NO: 52088 - DNA, 25 bp, E. coli
ggtcagccagtacgcaactgtagcc

SEQ ID NO: 52089 - DNA, 25 bp, E. coli
tgagacttctgattctgactctttc

SEQ ID NO: 52090 - DNA, 25 bp, E. coli
tgagacttctgaatctgactctttc

SEQ ID NO: 52091 - DNA, 25 bp, E. coli
tgcgggttccttatgtttgaatacg

SEQ ID NO: 52092 - DNA, 25 bp, E. coli
tgcgggttccttttgtttgaatacg

SEQ ID NO: 52093 - DNA, 25 bp, E. coli
cattccgaaaaagcacgaatatcga

SEQ ID NO: 52094 - DNA, 25 bp, E. coli
cattccgaaaaaccacgaatatcga

SEQ ID NO: 52095 - DNA, 25 bp, E. coli
tagcggcaatatccgctgaagcaag

SEQ ID NO: 52096 - DNA, 25 bp, E. coli
tatgttcgcttattcgtagcggcaa

SEQ ID NO: 52097 - DNA, 25 bp, E. coli
taggcgctgttttactaacgcatgc

SEQ ID NO: 52098 - DNA, 25 bp, E. coli
tatgttcgcttaatcgtagcggcaa

SEQ ID NO: 52099 - DNA, 25 bp, E. coli
tagcggcaatatgcgctgaagcaag

SEQ ID NO: 52100 - DNA, 25 bp, E. coli
taggcgctgtttaactaacgcatgc

SEQ ID NO: 52101 - DNA, 25 bp, E. coli
tattaaacgcgcatgctataagagt

SEQ ID NO: 52102 - DNA, 25 bp, E. coli
tattaaacgcgcttgctataagagt

SEQ ID NO: 52103 - DNA, 25 bp, E. coli
tgatgaatcgcattacaacctcttc

SEQ ID NO: 52104 - DNA, 25 bp, E. coli
tgatgaatcgcaatacaacctcttc

SEQ ID NO: 52105 - DNA, 25 bp, E. coli
tcggaatatcaaacagacaggttct

SEQ ID NO: 52106 - DNA, 25 bp, E. coli
tcggaatatcaatcagacaggttct

SEQ ID NO: 52107 - DNA, 25 bp, E. coli
gctgaagcaagccactcattccgaa

SEQ ID NO: 52108 - DNA, 25 bp, E. coli
gctgaagcaagcgactcattccgaa

SEQ ID NO: 52109 - DNA, 25 bp, E. coli
gaatatcgacattgttaggcgctgt

SEQ ID NO: 52110 - DNA, 25 bp, E. coli
gaatatcgacatagttaggcgctgt

SEQ ID NO: 52111 - DNA, 25 bp, E. coli
taatgacataagctaggtgaaacgg

SEQ ID NO: 52112 - DNA, 25 bp, E. coli
taatgacataaggtaggtgaaacgg

SEQ ID NO: 52113 - DNA, 25 bp, E. coli
gagagtaagaacctgtcggaatatc

SEQ ID NO: 52114 - DNA, 25 bp, E. coli
gagagtaagaacgtgtcggaatatc

SEQ ID NO: 52115 - DNA, 25 bp, E. coli
caatctggctacaggaagtgcgtgc

SEQ ID NO: 52116 - DNA, 25 bp, E. coli
caatctggctactggaagtgcgtgc

SEQ ID NO: 52117 - DNA, 25 bp, E. coli
atggcctgggcgaccaataccgagt

SEQ ID NO: 52118 - DNA, 25 bp, E. coli
atggcctgggcgtccaataccgagt

SEQ ID NO: 52119 - DNA, 25 bp, E. coli
taccgagtcgggttttgaatttcag

SEQ ID NO: 52120 - DNA, 25 bp, E. coli
taccgagtcgggatttgaatttcag

SEQ ID NO: 52121 - DNA, 25 bp, E. coli
tgagcatggtcgtggttgttacaga

SEQ ID NO: 52122 - DNA, 25 bp, E. coli
tgttacagaaaaagtccctccgcgc

SEQ ID NO: 52123 - DNA, 25 bp, E. coli
tgttacagaaaatgtccctccgcgc

SEQ ID NO: 52124 - DNA, 25 bp, E. coli
tgagcatggtcgaggttgttacaga

SEQ ID NO: 52125 - DNA, 25 bp, E. coli
tctggcagcaaaatacccaactggc

SEQ ID NO: 52126 - DNA, 25 bp, E. coli
tctggcagcaaattacccaactggc

SEQ ID NO: 52127 - DNA, 25 bp, E. coli
ccaactggctggatgcggaaatgtg

SEQ ID NO: 52128 - DNA, 25 bp, E. coli
ccaactggctggttgcggaaatgtg

SEQ ID NO: 52129 - DNA, 25 bp, E. coli
cgtattcgggagttgatctggcagc

SEQ ID NO: 52130 - DNA, 25 bp, E. coli
cgcttacgtggagggctcgcaatct

SEQ ID NO: 52131 - DNA, 25 bp, E. coli
cgcttacgtggacggctcgcaatct

SEQ ID NO: 52132 - DNA, 25 bp, E. coli
cgtattcgggagatgatctggcagc

SEQ ID NO: 52133 - DNA, 25 bp, E. coli
ggtgatacatcaaaacgtattcggg

SEQ ID NO: 52134 - DNA, 25 bp, E. coli
ggtgatacatcataacgtattcggg

SEQ ID NO: 52135 - DNA, 25 bp, E. coli
gagaaaacagacctattccggtgga

SEQ ID NO: 52136 - DNA, 25 bp, E. coli
gagaaaacagacgtattccggtgga

SEQ ID NO: 52137 - DNA, 25 bp, E. coli
cacgctgtatcttgaaaaatcgacg

SEQ ID NO: 52138 - DNA, 25 bp, E. coli
cacaatttgcttgattgtggtgatg

SEQ ID NO: 52139 - DNA, 25 bp, E. coli
cacgctgtatctagaaaaatcgacg

SEQ ID NO: 52140 - DNA, 25 bp, E. coli
cacaatttgcttcattgtggtgatg

SEQ ID NO: 52141 - DNA, 25 bp, E. coli
tgggccattggctaccagggaaaga

SEQ ID NO: 52142 - DNA, 25 bp, E. coli
ccagggaaagatgaacgtgatgatg

SEQ ID NO: 52143 - DNA, 25 bp, E. coli
ccagggaaagatcaacgtgatgatg

SEQ ID NO: 52144 - DNA, 25 bp, E. coli
gcattttctgaaaattcacgctgta

SEQ ID NO: 52145 - DNA, 25 bp, E. coli
gctgtatcttgaaaaatcgacgttt

SEQ ID NO: 52146 - DNA, 25 bp, E. coli
gcattttctgaatattcacgctgta

SEQ ID NO: 52147 - DNA, 25 bp, E. coli
gctgtatcttgataaatcgacgttt

SEQ ID NO: 52148 - DNA, 25 bp, E. coli
cttcattgtggtgatgtgatgctca

SEQ ID NO: 52149 - DNA, 25 bp, E. coli
cttcattgtggtcatgtgatgctca

SEQ ID NO: 52150 - DNA, 25 bp, E. coli
cgtgatgatgttgacaatttgcttc

SEQ ID NO: 52151 - DNA, 25 bp, E. coli
cgtgatgatgttcacaatttgcttc

SEQ ID NO: 52152 - DNA, 25 bp, E. coli
tgggccattggcaaccagggaaaga

SEQ ID NO: 52153 - DNA, 25 bp, E. coli
tggcaaccagggaaagatgaacgtg

SEQ ID NO: 52154 - DNA, 25 bp, E. coli
tggcaaccagggtaagatgaacgtg

SEQ ID NO: 52155 - DNA, 25 bp, E. coli
gatgctcaccgctttttctgaaaat

SEQ ID NO: 52156 - DNA, 25 bp, E. coli
gatgtgatgctcaccgcattttctg

SEQ ID NO: 52157 - DNA, 25 bp, E. coli
gatgtgatgctctccgcattttctg

SEQ ID NO: 52158 - DNA, 25 bp, E. coli
gatgctcaccgcattttctgaaaat

SEQ ID NO: 52159 - DNA, 25 bp, E. coli
cacgacactggcgtttgtcatggct

SEQ ID NO: 52160 - DNA, 25 bp, E. coli
cacgacactggcctttgtcatggct

SEQ ID NO: 52161 - DNA, 25 bp, E. coli
atcgcactgggttcagccagggcac

SEQ ID NO: 52162 - DNA, 25 bp, E. coli
atcgcactgggtacagccagggcac

SEQ ID NO: 52163 - DNA, 25 bp, E. coli
cagggcacgacactggcctttgtca

SEQ ID NO: 52164 - DNA, 25 bp, E. coli
cagggcacgacagtggcctttgtca

SEQ ID NO: 52165 - DNA, 25 bp, E. coli
actggcctttgtgatggctgcagga

SEQ ID NO: 52166 - DNA, 25 bp, E. coli
actggcctttgtcatggctgcagga

SEQ ID NO: 52167 - DNA, 25 bp, E. coli
tgattgcgatgcagatcgcactggg

SEQ ID NO: 52168 - DNA, 25 bp, E. coli
tgattgcgatgctgatcgcactggg

SEQ ID NO: 52169 - DNA, 25 bp, E. coli
tgatcgcactgggttcagccagggc

SEQ ID NO: 52170 - DNA, 25 bp, E. coli
tgatcgcactggcttcagccagggc

SEQ ID NO: 52171 - DNA, 25 bp, E. coli
gacactggccttagtcatggctgca

SEQ ID NO: 52172 - DNA, 25 bp, E. coli
gacactggcctttgtcatggctgca

SEQ ID NO: 52173 - DNA, 25 bp, E. coli
ctgggttcagccagggcacgacact

SEQ ID NO: 52174 - DNA, 25 bp, E. coli
ctgggttcagcctgggcacgacact

SEQ ID NO: 52175 - DNA, 25 bp, E. coli
gggcacgacactggcctttgtcatg

SEQ ID NO: 52176 - DNA, 25 bp, E. coli
gggcacgacactcgcctttgtcatg

SEQ ID NO: 52177 - DNA, 25 bp, E. coli
ggcctttgtcatcgctgcaggattt

SEQ ID NO: 52178 - DNA, 25 bp, E. coli
ggcctttgtcatggctgcaggattt

SEQ ID NO: 52179 - DNA, 25 bp, E. coli
tcagccagggcacgacactggcctt

SEQ ID NO: 52180 - DNA, 25 bp, E. coli
tcagccagggcaggacactggcctt

SEQ ID NO: 52181 - DNA, 25 bp, E. coli
caatttcaaatggtatcggttctgc

SEQ ID NO: 52182 - DNA, 25 bp, E. coli
caatttcaaatgctatcggttctgc

SEQ ID NO: 52183 - DNA, 25 bp, E. coli
caacaggtactgtggcactactccc

SEQ ID NO: 52184 - DNA, 25 bp, E. coli
caacaaagatccactgtctggtgca

SEQ ID NO: 52185 - DNA, 25 bp, E. coli
caacaggtactgaggcactactccc

SEQ ID NO: 52186 - DNA, 25 bp, E. coli
caacaaagatcctctgtctggtgca

SEQ ID NO: 52187 - DNA, 25 bp, E. coli
tactccccggtagtgctcaggctat

SEQ ID NO: 52188 - DNA, 25 bp, E. coli
tactccccggtactgctcaggctat

SEQ ID NO: 52189 - DNA, 25 bp, E. coli
tagggctggctcaggcaacaggtac

SEQ ID NO: 52190 - DNA, 25 bp, E. coli
tagggctggctctggcaacaggtac

SEQ ID NO: 52191 - DNA, 25 bp, E. coli
tgtacagaaaactcttccggtgccg

SEQ ID NO: 52192 - DNA, 25 bp, E. coli
tgttcagcatgggtaatggcctggc

SEQ ID NO: 52193 - DNA, 25 bp, E. coli
tgtagatccggcaaacgcagccatt

SEQ ID NO: 52194 - DNA, 25 bp, E. coli
tgggtaactggatcggcaacaaaga

SEQ ID NO: 52195 - DNA, 25 bp, E. coli
tgttcagcatggctaatggcctggc

SEQ ID NO: 52196 - DNA, 25 bp, E. coli
tgggtaactggaacggcaacaaaga

SEQ ID NO: 52197 - DNA, 25 bp, E. coli
tgtagatccggctaacgcagccatt

SEQ ID NO: 52198 - DNA, 25 bp, E. coli
tgtacagaaaacacttccggtgccg

SEQ ID NO: 52199 - DNA, 25 bp, E. coli
tctggctgatggtactgtagatccg

SEQ ID NO: 52200 - DNA, 25 bp, E. coli
tctggctgatggaactgtagatccg

SEQ ID NO: 52201 - DNA, 25 bp, E. coli
cgaatgctggtatcagttatctggc

SEQ ID NO: 52202 - DNA, 25 bp, E. coli
cgaatgctggtaacagttatctggc

SEQ ID NO: 52203 - DNA, 25 bp, E. coli
catagcgtctggtgcgatcataaac

SEQ ID NO: 52204 - DNA, 25 bp, E. coli
catagcgtctggagcgatcataaac

SEQ ID NO: 52205 - DNA, 25 bp, E. coli
ataatggtgctttatcgccgcctgc

SEQ ID NO: 52206 - DNA, 25 bp, E. coli
ataatggtgcttaatcgccgcctgc

SEQ ID NO: 52207 - DNA, 25 bp, E. coli
tattggcagatgctaaacacagcgc

SEQ ID NO: 52208 - DNA, 25 bp, E. coli
ttatcgctaacggtaaatggacgcc

SEQ ID NO: 52209 - DNA, 25 bp, E. coli
tattggcagatggtaaacacagcgc

SEQ ID NO: 52210 - DNA, 25 bp, E. coli
ttatcgctaacgctaaatggacgcc

SEQ ID NO: 52211 - DNA, 25 bp, E. coli
tcgatgacatcaatgacgcgcacag

SEQ ID NO: 52212 - DNA, 25 bp, E. coli
tcgatgacatcattgacgcgcacag

SEQ ID NO: 52213 - DNA, 25 bp, E. coli
gctctccagcgtaaaaattccggtg

SEQ ID NO: 52214 - DNA, 25 bp, E. coli
ccagagcaggtgacagttatcggat

SEQ ID NO: 52215 - DNA, 25 bp, E. coli
gctctccagcgttaaaattccggtg

SEQ ID NO: 52216 - DNA, 25 bp, E. coli
ccagagcaggtgtcagttatcggat

SEQ ID NO: 52217 - DNA, 25 bp, E. coli
gcagagttgatatacgccgggcatc

SEQ ID NO: 52218 - DNA, 25 bp, E. coli
gcagagttgataaacgccgggcatc

SEQ ID NO: 52219 - DNA, 25 bp, E. coli
cccgcgtgctttgaggtaatggcta

SEQ ID NO: 52220 - DNA, 25 bp, E. coli
cgataggtgcgaagaaagcgttaca

SEQ ID NO: 52221 - DNA, 25 bp, E. coli
cccgcgtgctttcaggtaatggcta

SEQ ID NO: 52222 - DNA, 25 bp, E. coli
cgataggtgcgatgaaagcgttaca

SEQ ID NO: 52223 - DNA, 25 bp, E. coli
tcagccaggagactaaagatcgcgt

SEQ ID NO: 52224 - DNA, 25 bp, E. coli
tcagccaggagagtaaagatcgcgt

SEQ ID NO: 52225 - DNA, 25 bp, E. coli
tacgattttattgggcctggctccc

SEQ ID NO: 52226 - DNA, 25 bp, E. coli
tacgattttattcggcctggctccc

SEQ ID NO: 52227 - DNA, 25 bp, E. coli
ttcatagaagaaaaatcactggcct

SEQ ID NO: 52228 - DNA, 25 bp, E. coli
ttcatagaagaataatcactggcct

SEQ ID NO: 52229 - DNA, 25 bp, E. coli
tgctgtgcgtaatatggctattcgt

SEQ ID NO: 52230 - DNA, 25 bp, E. coli
tgctgtgcgtaaaatggctattcgt

SEQ ID NO: 52231 - DNA, 25 bp, E. coli
tcactggcctaatcattatcccctt

SEQ ID NO: 52232 - DNA, 25 bp, E. coli
tcactggcctaaacattatcccctt

SEQ ID NO: 52233 - DNA, 25 bp, E. coli
gctataatgcgctcataacctcttg

SEQ ID NO: 52234 - DNA, 25 bp, E. coli
gctataatgcgcacataacctcttg

SEQ ID NO: 52235 - DNA, 25 bp, E. coli
gaaatatcacttatgctgtgcgtaa

SEQ ID NO: 52236 - DNA, 25 bp, E. coli
gaaatatcacttttgctgtgcgtaa

SEQ ID NO: 52237 - DNA, 25 bp, E. coli
ggagcaaacaatttcattccaactc

SEQ ID NO: 52238 - DNA, 25 bp, E. coli
ggagcaaacaatatcattccaactc

SEQ ID NO: 52239 - DNA, 25 bp, E. coli
taaccccagcatttaaatccagttg

SEQ ID NO: 52240 - DNA, 25 bp, E. coli
tcagccatctatttgggagcaaaca

SEQ ID NO: 52241 - DNA, 25 bp, E. coli
taacctcttgaaactcgtccccaga

SEQ ID NO: 52242 - DNA, 25 bp, E. coli
taaccccagcatataaatccagttg

SEQ ID NO: 52243 - DNA, 25 bp, E. coli
taacctcttgaatctcgtccccaga

SEQ ID NO: 52244 - DNA, 25 bp, E. coli
tcagccatctatatgggagcaaaca

SEQ ID NO: 52245 - DNA, 25 bp, E. coli
gaccatttccgccatttgttacaca

SEQ ID NO: 52246 - DNA, 25 bp, E. coli
gaccatttccgcgatttgttacaca

SEQ ID NO: 52247 - DNA, 25 bp, E. coli
aatttggccttgtacatccctacgc

SEQ ID NO: 52248 - DNA, 25 bp, E. coli
aatttggccttgaacatccctacgc

SEQ ID NO: 52249 - DNA, 25 bp, E. coli
aactggtgctggtgccgcgtgaaat

SEQ ID NO: 52250 - DNA, 25 bp, E. coli
aactggtgctggagccgcgtgaaat

SEQ ID NO: 52251 - DNA, 25 bp, E. coli
tatccgcgctggttacgctgatggc

SEQ ID NO: 52252 - DNA, 25 bp, E. coli
tatgctcgcactttcacgcatgggc

SEQ ID NO: 52253 - DNA, 25 bp, E. coli
tatgctcgcactatcacgcatgggc

SEQ ID NO: 52254 - DNA, 25 bp, E. coli
tatccgcgctggatacgctgatggc

SEQ ID NO: 52255 - DNA, 25 bp, E. coli
tgcagtatgaaatcgctcgccggta

SEQ ID NO: 52256 - DNA, 25 bp, E. coli
tgcagtatgaaaacgctcgccggta

SEQ ID NO: 52257 - DNA, 25 bp, E. coli
tcccgaaacggttgatgacattgtc

SEQ ID NO: 52258 - DNA, 25 bp, E. coli
tcccgaaacggtagatgacattgtc

SEQ ID NO: 52259 - DNA, 25 bp, E. coli
tcaggttcctttggtacagacggca

SEQ ID NO: 52260 - DNA, 25 bp, E. coli
tcaggttcctttcgtacagacggca

SEQ ID NO: 52261 - DNA, 25 bp, E. coli
gcattactgcaagcgctgcgggaga

SEQ ID NO: 52262 - DNA, 25 bp, E. coli
gcattactgcaaccgctgcgggaga

SEQ ID NO: 52263 - DNA, 25 bp, E. coli
gacgtcgtgcttaaagaaggccgca

SEQ ID NO: 52264 - DNA, 25 bp, E. coli
gacgtcgtgctttaagaaggccgca

SEQ ID NO: 52265 - DNA, 25 bp, E. coli
cccgcgtgctggatcaatttggcct

SEQ ID NO: 52266 - DNA, 25 bp, E. coli
cccgcgtgctggttcaatttggcct

SEQ ID NO: 52267 - DNA, 25 bp, E. coli
cgcaggcccggaatttttctcagga

SEQ ID NO: 52268 - DNA, 25 bp, E. coli
cgcaggcccggattttttctcagga

SEQ ID NO: 52269 - DNA, 25 bp, E. coli
catccacgcactctttatctgaata

SEQ ID NO: 52270 - DNA, 25 bp, E. coli
cattttttgcgccatcgttgacatc

SEQ ID NO: 52271 - DNA, 25 bp, E. coli
catccacgcactgtttatctgaata

SEQ ID NO: 52272 - DNA, 25 bp, E. coli
cattttttgcgcgatcgttgacatc

SEQ ID NO: 52273 - DNA, 25 bp, E. coli
aaaagcgggcatattttgcgccatc

SEQ ID NO: 52274 - DNA, 25 bp, E. coli
aaaagcgggcattttttgcgccatc

SEQ ID NO: 52275 - DNA, 25 bp, E. coli
ttgacatcattaacaaccatcgatc

SEQ ID NO: 52276 - DNA, 25 bp, E. coli
ttgacatcattatcaaccatcgatc

SEQ ID NO: 52277 - DNA, 25 bp, E. coli
gcgccatcgttgtcatcattaacaa

SEQ ID NO: 52278 - DNA, 25 bp, E. coli
gcgccatcgttgacatcattaacaa

SEQ ID NO: 52279 - DNA, 25 bp, E. coli
gaaattctgctaccatccacgcact

SEQ ID NO: 52280 - DNA, 25 bp, E. coli
gaaatttactggtaattactgcgcc

SEQ ID NO: 52281 - DNA, 25 bp, E. coli
gaaattctgctagcatccacgcact

SEQ ID NO: 52282 - DNA, 25 bp, E. coli
gaaatttactggaaattactgcgcc

SEQ ID NO: 52283 - DNA, 25 bp, E. coli
ctggaaattactgcgccattctgac

SEQ ID NO: 52284 - DNA, 25 bp, E. coli
cgcgcaccaaaagcgggcatttttt

SEQ ID NO: 52285 - DNA, 25 bp, E. coli
ctggaaattactccgccattctgac

SEQ ID NO: 52286 - DNA, 25 bp, E. coli
cgcgcaccaaaaccgggcatttttt

SEQ ID NO: 52287 - DNA, 25 bp, E. coli
gatcaaatcacttaacaacaggcgg

SEQ ID NO: 52288 - DNA, 25 bp, E. coli
gatcaaatcactaaacaacaggcgg

SEQ ID NO: 52289 - DNA, 25 bp, E. coli
tcacttaacaactggcggtaagcaa

SEQ ID NO: 52290 - DNA, 25 bp, E. coli
tcacttaacaacaggcggtaagcaa

SEQ ID NO: 52291 - DNA, 25 bp, E. coli
caattcaggtcggttcccattatca

SEQ ID NO: 52292 - DNA, 25 bp, E. coli
caattcaggtcgcttcccattatca

SEQ ID NO: 52293 - DNA, 25 bp, E. coli
atcgtctcaataacgccgccggaac

SEQ ID NO: 52294 - DNA, 25 bp, E. coli
atcgtctcaatatcgccgccggaac

SEQ ID NO: 52295 - DNA, 25 bp, E. coli
tatcacttcgcggaggttaacccgg

SEQ ID NO: 52296 - DNA, 25 bp, E. coli
tatcacttcgcgcaggttaacccgg

SEQ ID NO: 52297 - DNA, 25 bp, E. coli
tatatagagcttaacatcggccggg

SEQ ID NO: 52298 - DNA, 25 bp, E. coli
ttaacccggcactgaagttcgatcg

SEQ ID NO: 52299 - DNA, 25 bp, E. coli
tatatagagctttacatcggccggg

SEQ ID NO: 52300 - DNA, 25 bp, E. coli
ttaacccggcacagaagttcgatcg

SEQ ID NO: 52301 - DNA, 25 bp, E. coli
ttcgaaccaggcgaaaagcgtgagg

SEQ ID NO: 52302 - DNA, 25 bp, E. coli
ttcgaaccaggccaaaagcgtgagg

SEQ ID NO: 52303 - DNA, 25 bp, E. coli
tgaaaatcacggagaccgaccaatt

SEQ ID NO: 52304 - DNA, 25 bp, E. coli
tgaaaatcacggtgaccgaccaatt

SEQ ID NO: 52305 - DNA, 25 bp, E. coli
tcggccgggctagctgcagtattat

SEQ ID NO: 52306 - DNA, 25 bp, E. coli
tccgcggagataaaatgggtgagct

SEQ ID NO: 52307 - DNA, 25 bp, E. coli
tcggccgggctacctgcagtattat

SEQ ID NO: 52308 - DNA, 25 bp, E. coli
tccgcggagatataatgggtgagct

SEQ ID NO: 52309 - DNA, 25 bp, E. coli
gccagaaggcaagaggctatcgtct

SEQ ID NO: 52310 - DNA, 25 bp, E. coli
gccagaaggcaacaggctatcgtct

SEQ ID NO: 52311 - DNA, 25 bp, E. coli
gtatcgtgcacggtttccgcggaga

SEQ ID NO: 52312 - DNA, 25 bp, E. coli
gtatcgtgcacgctttccgcggaga

SEQ ID NO: 52313 - DNA, 25 bp, E. coli
cacggcattaaaggccacacttcag

SEQ ID NO: 52314 - DNA, 25 bp, E. coli
cacggcattaaacgccacacttcag

SEQ ID NO: 52315 - DNA, 25 bp, E. coli
cagtcgtttacaatccctgtggtgg

SEQ ID NO: 52316 - DNA, 25 bp, E. coli
cagtcgtttacattccctgtggtgg

SEQ ID NO: 52317 - DNA, 25 bp, E. coli
tactgtggaatgttgttacaggttg

SEQ ID NO: 52318 - DNA, 25 bp, E. coli
tacattccctgtcgtggcaggcatc

SEQ ID NO: 52319 - DNA, 25 bp, E. coli
tacattccctgtggtggcaggcatc

SEQ ID NO: 52320 - DNA, 25 bp, E. coli
tactgtggaatgatgttacaggttg

SEQ ID NO: 52321 - DNA, 25 bp, E. coli
aggagaccatgacccgttcacggca

SEQ ID NO: 52322 - DNA, 25 bp, E. coli
aggagaccatgagccgttcacggca

SEQ ID NO: 52323 - DNA, 25 bp, E. coli
aaaggccacacttcagtcgtttaca

SEQ ID NO: 52324 - DNA, 25 bp, E. coli
aaaggccacactacagtcgtttaca

SEQ ID NO: 52325 - DNA, 25 bp, E. coli
tgtggtggcaggcatcttccgttaa

SEQ ID NO: 52326 - DNA, 25 bp, E. coli
tgtggtggcagggatcttccgttaa

SEQ ID NO: 52327 - DNA, 25 bp, E. coli
gccgttcacggcattaaaggccaca

SEQ ID NO: 52328 - DNA, 25 bp, E. coli
gccgttcacggctttaaaggccaca

SEQ ID NO: 52329 - DNA, 25 bp, E. coli
gcattaaaggcctcacttcagtcgt

SEQ ID NO: 52330 - DNA, 25 bp, E. coli
gcattaaaggccacacttcagtcgt

SEQ ID NO: 52331 - DNA, 25 bp, E. coli
gtgccaggagaccatgagccgttca

SEQ ID NO: 52332 - DNA, 25 bp, E. coli
gtgccaggagacgatgagccgttca

SEQ ID NO: 52333 - DNA, 25 bp, E. coli
ggcggcaaccgtcccaggagaccat

SEQ ID NO: 52334 - DNA, 25 bp, E. coli
ggcggcaaccgtgccaggagaccat

SEQ ID NO: 52335 - DNA, 25 bp, E. coli
caacgacttgcattataggataacg

SEQ ID NO: 52336 - DNA, 25 bp, E. coli
caacgacttgcaatataggataacg

SEQ ID NO: 52337 - DNA, 25 bp, E. coli
cagagaaaagagtatttcggcgact

SEQ ID NO: 52338 - DNA, 25 bp, E. coli
cagagaaaagagaatttcggcgact

SEQ ID NO: 52339 - DNA, 25 bp, E. coli
taaaggttgtttaacgacagacgat

SEQ ID NO: 52340 - DNA, 25 bp, E. coli
taaaggttgttttacgacagacgat

SEQ ID NO: 52341 - DNA, 25 bp, E. coli
tacgacagacgataacagggttgac

SEQ ID NO: 52342 - DNA, 25 bp, E. coli
ataacagggttgacggcgattgagc

SEQ ID NO: 52343 - DNA, 25 bp, E. coli
ataacagggttgtcggcgattgagc

SEQ ID NO: 52344 - DNA, 25 bp, E. coli
gaaacccaatacgtaatcaacgact

SEQ ID NO: 52345 - DNA, 25 bp, E. coli
gaaacccaatacctaatcaacgact

SEQ ID NO: 52346 - DNA, 25 bp, E. coli
tacgacagacgaaaacagggttgac

SEQ ID NO: 52347 - DNA, 25 bp, E. coli
tatttcggcgactaacaaaaaatgg

SEQ ID NO: 52348 - DNA, 25 bp, E. coli
tatttcggcgacaaacaaaaaatgg

SEQ ID NO: 52349 - DNA, 25 bp, E. coli
gaattgcgcaaagtttacgtttaat

SEQ ID NO: 52350 - DNA, 25 bp, E. coli
gaattgcgcaaactttacgtttaat

SEQ ID NO: 52351 - DNA, 25 bp, E. coli
gggttatcggtcagaattgcgcaaa

SEQ ID NO: 52352 - DNA, 25 bp, E. coli
gggttatcggtctgaattgcgcaaa

SEQ ID NO: 52353 - DNA, 25 bp, E. coli
tgagccgacgggtggaaacccaata

SEQ ID NO: 52354 - DNA, 25 bp, E. coli
tgagccgacgggaggaaacccaata

SEQ ID NO: 52355 - DNA, 25 bp, E. coli
gatttccttttatctttcgacacgt

SEQ ID NO: 52356 - DNA, 25 bp, E. coli
gatttccttttaactttcgacacgt

SEQ ID NO: 52357 - DNA, 25 bp, E. coli
aatgcgtacgttctcaacaatctgc

SEQ ID NO: 52358 - DNA, 25 bp, E. coli
aatgcgtacgttgtcaacaatctgc

SEQ ID NO: 52359 - DNA, 25 bp, E. coli
catgaacaatgcctacgttgtcaac

SEQ ID NO: 52360 - DNA, 25 bp, E. coli
catgaacaatgcgtacgttgtcaac

SEQ ID NO: 52361 - DNA, 25 bp, E. coli
tactgatgacaattgtaagcttgcc

SEQ ID NO: 52362 - DNA, 25 bp, E. coli
tactgatgacaaatgtaagcttgcc

SEQ ID NO: 52363 - DNA, 25 bp, E. coli
tacccggtggttgatactgatgaca

SEQ ID NO: 52364 - DNA, 25 bp, E. coli
tacccggtggttcatactgatgaca

SEQ ID NO: 52365 - DNA, 25 bp, E. coli
tgtaagcttgcctgatgcgcgatgc

SEQ ID NO: 52366 - DNA, 25 bp, E. coli
tgtaagcttgccagatgcgcgatgc

SEQ ID NO: 52367 - DNA, 25 bp, E. coli
tcaggcctaccacaagattgcaata

SEQ ID NO: 52368 - DNA, 25 bp, E. coli
tcaggcctaccagaagattgcaata

SEQ ID NO: 52369 - DNA, 25 bp, E. coli
gcctaccagaagtttgcaatatatt

SEQ ID NO: 52370 - DNA, 25 bp, E. coli
gcctaccagaagattgcaatatatt

SEQ ID NO: 52371 - DNA, 25 bp, E. coli
cccggtggttgaaactgatgacaaa

SEQ ID NO: 52372 - DNA, 25 bp, E. coli
cccggtggttgatactgatgacaaa

SEQ ID NO: 52373 - DNA, 25 bp, E. coli
cttatcaggcctaccagaagattgc

SEQ ID NO: 52374 - DNA, 25 bp, E. coli
cgggctaatcaaagacgaatgcatt

SEQ ID NO: 52375 - DNA, 25 bp, E. coli
cgggctaatcaatgacgaatgcatt

SEQ ID NO: 52376 - DNA, 25 bp, E. coli
cttatcaggccttccagaagattgc

SEQ ID NO: 52377 - DNA, 25 bp, E. coli
tcaatgacgaatccatttttgtctg

SEQ ID NO: 52378 - DNA, 25 bp, E. coli
tcaatgacgaatgcatttttgtctg

SEQ ID NO: 52379 - DNA, 25 bp, E. coli
aaggatgatccagagcgtctgcagg

SEQ ID NO: 52380 - DNA, 25 bp, E. coli
aaggatgatccacagcgtctgcagg

SEQ ID NO: 52381 - DNA, 25 bp, E. coli
cacgatatctggcagcactggctac

SEQ ID NO: 52382 - DNA, 25 bp, E. coli
cactggctacgattcgaggactcaa

SEQ ID NO: 52383 - DNA, 25 bp, E. coli
cacgatatctgggagcactggctac

SEQ ID NO: 52384 - DNA, 25 bp, E. coli
cactggctacgaatcgaggactcaa

SEQ ID NO: 52385 - DNA, 25 bp, E. coli
aaacgtttgattctgtcggtagcac

SEQ ID NO: 52386 - DNA, 25 bp, E. coli
aaacgtttgattgtgtcggtagcac

SEQ ID NO: 52387 - DNA, 25 bp, E. coli
taggaggaactatagctggcactgc

SEQ ID NO: 52388 - DNA, 25 bp, E. coli
taggaggaactaaagctggcactgc

SEQ ID NO: 52389 - DNA, 25 bp, E. coli
tttgaaccagcccagcagtagtcta

SEQ ID NO: 52390 - DNA, 25 bp, E. coli
tttgaaccagccgagcagtagtcta

SEQ ID NO: 52391 - DNA, 25 bp, E. coli
gaaacaactactcatatggacgctt

SEQ ID NO: 52392 - DNA, 25 bp, E. coli
gaaacaactactgatatggacgctt

SEQ ID NO: 52393 - DNA, 25 bp, E. coli
ggtggccgccctcaatcgtttgaaa

SEQ ID NO: 52394 - DNA, 25 bp, E. coli
ggtggccgccctgaatcgtttgaaa

SEQ ID NO: 52395 - DNA, 25 bp, E. coli
taacgcggaaagtgaagcttggaca

SEQ ID NO: 52396 - DNA, 25 bp, E. coli
taagaataagtaatcggtggccgcc

SEQ ID NO: 52397 - DNA, 25 bp, E. coli
taacgcggaaagagaagcttggaca

SEQ ID NO: 52398 - DNA, 25 bp, E. coli
taagaataagtattcggtggccgcc

SEQ ID NO: 52399 - DNA, 25 bp, E. coli
gagaaagcgtcaaagtccgtccagg

SEQ ID NO: 52400 - DNA, 25 bp, E. coli
gagaaagcgtcatagtccgtccagg

SEQ ID NO: 52401 - DNA, 25 bp, E. coli
aatttgaccgcataaaggcgctggc

SEQ ID NO: 52402 - DNA, 25 bp, E. coli
aatttgaccgcaaaaaggcgctggc

SEQ ID NO: 52403 - DNA, 25 bp, E. coli
cacaaatttgacggcaaaaaggcgc

SEQ ID NO: 52404 - DNA, 25 bp, E. coli
caaatttgaccgcaaaaaggcgctg

SEQ ID NO: 52405 - DNA, 25 bp, E. coli
cacaaatttgaccgcaaaaaggcgc

SEQ ID NO: 52406 - DNA, 25 bp, E. coli
caaatttgaccggaaaaaggcgctg

SEQ ID NO: 52407 - DNA, 25 bp, E. coli
atttgaccgcaaaaaggcgctggct

SEQ ID NO: 52408 - DNA, 25 bp, E. coli
atttgaccgcaataaggcgctggct

SEQ ID NO: 52409 - DNA, 25 bp, E. coli
acacaaatttgaccgcaaaaaggcg

SEQ ID NO: 52410 - DNA, 25 bp, E. coli
aaatttgaccgctaaaaggcgctgg

SEQ ID NO: 52411 - DNA, 25 bp, E. coli
aaatttgaccgcaaaaaggcgctgg

SEQ ID NO: 52412 - DNA, 25 bp, E. coli
acacaaatttgagcgcaaaaaggcg

SEQ ID NO: 52413 - DNA, 25 bp, E. coli
tttgaccgcaaataggcgctggctt

SEQ ID NO: 52414 - DNA, 25 bp, E. coli
tttgaccgcaaaaaggcgctggctt

SEQ ID NO: 52415 - DNA, 25 bp, E. coli
ttgaccgcaaaatggcgctggctta

SEQ ID NO: 52416 - DNA, 25 bp, E. coli
ttgaccgcaaaaaggcgctggctta

SEQ ID NO: 52417 - DNA, 25 bp, E. coli
tgaccgcaaaaaggcgctggcttat

SEQ ID NO: 52418 - DNA, 25 bp, E. coli
tgaccgcaaaaacgcgctggcttat

SEQ ID NO: 52419 - DNA, 25 bp, E. coli
ccgcaaaaaggcgctggcttatgag

SEQ ID NO: 52420 - DNA, 25 bp, E. coli
ccgcaaaaaggccctggcttatgag

SEQ ID NO: 52421 - DNA, 25 bp, E. coli
gaccgcaaaaaggcgctggcttatg

SEQ ID NO: 52422 - DNA, 25 bp, E. coli
gaccgcaaaaagccgctggcttatg

SEQ ID NO: 52423 - DNA, 25 bp, E. coli
aattgcttatcaaagaagagacgat

SEQ ID NO: 52424 - DNA, 25 bp, E. coli
aattgcttatcatagaagagacgat

SEQ ID NO: 52425 - DNA, 25 bp, E. coli
caaattgcttatgaaagaagagacg

SEQ ID NO: 52426 - DNA, 25 bp, E. coli
caaattgcttatcaaagaagagacg

SEQ ID NO: 52427 - DNA, 25 bp, E. coli
ttgataatcttgttattgctggtgg

SEQ ID NO: 52428 - DNA, 25 bp, E. coli
ttgataatcttgatattgctggtgg

SEQ ID NO: 52429 - DNA, 25 bp, E. coli
tcgccgctggtgagggcgtctggaa

SEQ ID NO: 52430 - DNA, 25 bp, E. coli
tcgccgctggtgtgggcgtctggaa

SEQ ID NO: 52431 - DNA, 25 bp, E. coli
tcttgccgacaggaaattgcttatc

SEQ ID NO: 52432 - DNA, 25 bp, E. coli
tcttgccgacagcaaattgcttatc

SEQ ID NO: 52433 - DNA, 25 bp, E. coli
gccgacagcaaaatgcttatcaaag

SEQ ID NO: 52434 - DNA, 25 bp, E. coli
gccgacagcaaattgcttatcaaag

SEQ ID NO: 52435 - DNA, 25 bp, E. coli
gcttatcaaagatgagacgatattt

SEQ ID NO: 52436 - DNA, 25 bp, E. coli
gcttatcaaagaagagacgatattt

SEQ ID NO: 52437 - DNA, 25 bp, E. coli
gacagcaaattgcttatcaaagaag

SEQ ID NO: 52438 - DNA, 25 bp, E. coli
gacagcaaattggttatcaaagaag

SEQ ID NO: 52439 - DNA, 25 bp, E. coli
ggtactgggtatcgccgctggtgtg

SEQ ID NO: 52440 - DNA, 25 bp, E. coli
ggtactgggtatggccgctggtgtg

SEQ ID NO: 52441 - DNA, 25 bp, E. coli
tggtgtgggcgtctggaaggttcgc

SEQ ID NO: 52442 - DNA, 25 bp, E. coli
tggtgtgggcgtgtggaaggttcgc

SEQ ID NO: 52443 - DNA, 25 bp, E. coli
tcaaagaagagaggatatttaccct

SEQ ID NO: 52444 - DNA, 25 bp, E. coli
tcaaagaagagacgatatttaccct

SEQ ID NO: 52445 - DNA, 25 bp, E. coli
aatcatggtaccagtcgtgatggcc

SEQ ID NO: 52446 - DNA, 25 bp, E. coli
aatcatggtacctgtcgtgatggcc

SEQ ID NO: 52447 - DNA, 25 bp, E. coli
atttacggtcttggtgaagtattca

SEQ ID NO: 52448 - DNA, 25 bp, E. coli
atttacggtcttcgtgaagtattca

SEQ ID NO: 52449 - DNA, 25 bp, E. coli
tgtcgtgatggcgatcatcctgggt

SEQ ID NO: 52450 - DNA, 25 bp, E. coli
tgtcgtgatggccatcatcctgggt

SEQ ID NO: 52451 - DNA, 25 bp, E. coli
tctgatttacggtcttggtgaagta

SEQ ID NO: 52452 - DNA, 25 bp, E. coli
tcatcctgggtcagatttacggtct

SEQ ID NO: 52453 - DNA, 25 bp, E. coli
tcatcctgggtctgatttacggtct

SEQ ID NO: 52454 - DNA, 25 bp, E. coli
tctgatttacggacttggtgaagta

SEQ ID NO: 52455 - DNA, 25 bp, E. coli
gccgtaatcatggtacctgtcgtga

SEQ ID NO: 52456 - DNA, 25 bp, E. coli
gccgtaatcatgctacctgtcgtga

SEQ ID NO: 52457 - DNA, 25 bp, E. coli
cctgggtctgatatacggtcttggt

SEQ ID NO: 52458 - DNA, 25 bp, E. coli
cctgggtctgatttacggtcttggt

SEQ ID NO: 52459 - DNA, 25 bp, E. coli
gtattcgccgtaatcatggtacctg

SEQ ID NO: 52460 - DNA, 25 bp, E. coli
ggtacctgtcgtcatggccatcatc

SEQ ID NO: 52461 - DNA, 25 bp, E. coli
gtattcgccgtattcatggtacctg

SEQ ID NO: 52462 - DNA, 25 bp, E. coli
ggtacctgtcgtgatggccatcatc

SEQ ID NO: 52463 - DNA, 25 bp, E. coli
gatggccatcatgctgggtctgatt

SEQ ID NO: 52464 - DNA, 25 bp, E. coli
ttattaaaaagtgtggtattcgccg

SEQ ID NO: 52465 - DNA, 25 bp, E. coli
gatggccatcatcctgggtctgatt

SEQ ID NO: 52466 - DNA, 25 bp, E. coli
ttattaaaaagtctggtattcgccg

SEQ ID NO: 52467 - DNA, 25 bp, E. coli
cacagagtgagaaaatagcgaaggt

SEQ ID NO: 52468 - DNA, 25 bp, E. coli
cacagagtgagataatagcgaaggt

SEQ ID NO: 52469 - DNA, 25 bp, E. coli
taactattcctttcatcgacgaatg

SEQ ID NO: 52470 - DNA, 25 bp, E. coli
taaatatattcgacacagagtgaga

SEQ ID NO: 52471 - DNA, 25 bp, E. coli
taaatatattcgtcacagagtgaga

SEQ ID NO: 52472 - DNA, 25 bp, E. coli
tacgagaggctattattgagttgct

SEQ ID NO: 52473 - DNA, 25 bp, E. coli
tacgagaggctaatattgagttgct

SEQ ID NO: 52474 - DNA, 25 bp, E. coli
tatgtgccttgacatgcctgtattc

SEQ ID NO: 52475 - DNA, 25 bp, E. coli
tatgtgccttgagatgcctgtattc

SEQ ID NO: 52476 - DNA, 25 bp, E. coli
ttaattctgcctgtttcaacccgcg

SEQ ID NO: 52477 - DNA, 25 bp, E. coli
ttaattctgcctctttcaacccgcg

SEQ ID NO: 52478 - DNA, 25 bp, E. coli
tgataatttgtaggatagcgaactg

SEQ ID NO: 52479 - DNA, 25 bp, E. coli
tgataatttgtacgatagcgaactg

SEQ ID NO: 52480 - DNA, 25 bp, E. coli
tctttctgcgagttaacgcgttgcc

SEQ ID NO: 52481 - DNA, 25 bp, E. coli
tctttctgcgagataacgcgttgcc

SEQ ID NO: 52482 - DNA, 25 bp, E. coli
cctaatgtgtatttatacgagaggc

SEQ ID NO: 52483 - DNA, 25 bp, E. coli
cctaatgtgtatatatacgagaggc

SEQ ID NO: 52484 - DNA, 25 bp, E. coli
tgcctttttgggaaaataacgcgct

SEQ ID NO: 52485 - DNA, 25 bp, E. coli
tgcctttttgggtaaataacgcgct

SEQ ID NO: 52486 - DNA, 25 bp, E. coli
tcaacccgcgtcaaaataaaacagt

SEQ ID NO: 52487 - DNA, 25 bp, E. coli
tcaacccgcgtctaaataaaacagt

SEQ ID NO: 52488 - DNA, 25 bp, E. coli
taactattccttacatcgacgaatg

SEQ ID NO: 52489 - DNA, 25 bp, E. coli
aattgaagtgcaaacgctggacggc

SEQ ID NO: 52490 - DNA, 25 bp, E. coli
caatgtggctgataatgccggcggc

SEQ ID NO: 52491 - DNA, 25 bp, E. coli
aattgaagtgcatacgctggacggc

SEQ ID NO: 52492 - DNA, 25 bp, E. coli
caatgtggctgaaaatgccggcggc

SEQ ID NO: 52493 - DNA, 25 bp, E. coli
acatcttgttgatagcgggcgcgac

SEQ ID NO: 52494 - DNA, 25 bp, E. coli
acatcttgttgaaagcgggcgcgac

SEQ ID NO: 52495 - DNA, 25 bp, E. coli
tttctgggccggtcgcaaaaatgcg

SEQ ID NO: 52496 - DNA, 25 bp, E. coli
ttttcgatgccaacgaacccggtga

SEQ ID NO: 52497 - DNA, 25 bp, E. coli
tttctgggccggacgcaaaaatgcg

SEQ ID NO: 52498 - DNA, 25 bp, E. coli
ttttcgatgccatcgaacccggtga

SEQ ID NO: 52499 - DNA, 25 bp, E. coli
tccgcgcggcggtagattttattca

SEQ ID NO: 52500 - DNA, 25 bp, E. coli
tccgcgcggcggaagattttattca

SEQ ID NO: 52501 - DNA, 25 bp, E. coli
ccggacttgcggatggtgacatcat

SEQ ID NO: 52502 - DNA, 25 bp, E. coli
gaagatcctcgaactctgcgttgaa

SEQ ID NO: 52503 - DNA, 25 bp, E. coli
gaagatcctcgatctctgcgttgaa

SEQ ID NO: 52504 - DNA, 25 bp, E. coli
ccggacttgcggttggtgacatcat

SEQ ID NO: 52505 - DNA, 25 bp, E. coli
gattactactgcatggatggcacca

SEQ ID NO: 52506 - DNA, 25 bp, E. coli
gattactactgcttggatggcacca

SEQ ID NO: 52507 - DNA, 25 bp, E. coli
gatggcgctttacccgatgtcgacc

SEQ ID NO: 52508 - DNA, 25 bp, E. coli
gagatcctcgactttaaccccgttg

SEQ ID NO: 52509 - DNA, 25 bp, E. coli
gatggcgctttagccgatgtcgacc

SEQ ID NO: 52510 - DNA, 25 bp, E. coli
gagatcctcgacattaaccccgttg

SEQ ID NO: 52511 - DNA, 25 bp, E. coli
caagtagtactgttgggaagcggta

SEQ ID NO: 52512 - DNA, 25 bp, E. coli
caagtagtactgatgggaagcggta

SEQ ID NO: 52513 - DNA, 25 bp, E. coli
cagtatctgtctgtttccaacctaa

SEQ ID NO: 52514 - DNA, 25 bp, E. coli
cagtatctgtctctttccaacctaa

SEQ ID NO: 52515 - DNA, 25 bp, E. coli
tactaagagaaatggtagcgatgga

SEQ ID NO: 52516 - DNA, 25 bp, E. coli
tactaagagaaaaggtagcgatgga

SEQ ID NO: 52517 - DNA, 25 bp, E. coli
caagtaaacctgaaaccataaagcg

SEQ ID NO: 52518 - DNA, 25 bp, E. coli
caagtaaacctgtaaccataaagcg

SEQ ID NO: 52519 - DNA, 25 bp, E. coli
taaagcgaaacctccgcgaaaggat

SEQ ID NO: 52520 - DNA, 25 bp, E. coli
taaagcgaaaccaccgcgaaaggat

SEQ ID NO: 52521 - DNA, 25 bp, E. coli
taatttagacggtgatagaacagtc

SEQ ID NO: 52522 - DNA, 25 bp, E. coli
tccgcgaaaggaagaaaaatgctaa

SEQ ID NO: 52523 - DNA, 25 bp, E. coli
tccgcgaaaggatgaaaaatgctaa

SEQ ID NO: 52524 - DNA, 25 bp, E. coli
taatttagacggagatagaacagtc

SEQ ID NO: 52525 - DNA, 25 bp, E. coli
tcgtcttatggaggcatggaaagca

SEQ ID NO: 52526 - DNA, 25 bp, E. coli
tcgtcttatggacgcatggaaagca

SEQ ID NO: 52527 - DNA, 25 bp, E. coli
gacatatgtggcttttgcaagtgaa

SEQ ID NO: 52528 - DNA, 25 bp, E. coli
gacatatgtggcatttgcaagtgaa

SEQ ID NO: 52529 - DNA, 25 bp, E. coli
gaacagtcgataagaacttcattcc

SEQ ID NO: 52530 - DNA, 25 bp, E. coli
gaacagtcgatatgaacttcattcc

SEQ ID NO: 52531 - DNA, 25 bp, E. coli
ggagtatcgtttcttgcccatgaaa

SEQ ID NO: 52532 - DNA, 25 bp, E. coli
ggagtatcgtttgttgcccatgaaa

SEQ ID NO: 52533 - DNA, 25 bp, E. coli
aattaatacgaatcctgaacggtgg

SEQ ID NO: 52534 - DNA, 25 bp, E. coli
aattctatttacgtcacccctgatg

SEQ ID NO: 52535 - DNA, 25 bp, E. coli
aattaatacgaaacctgaacggtgg

SEQ ID NO: 52536 - DNA, 25 bp, E. coli
aattctatttacctcacccctgatg

SEQ ID NO: 52537 - DNA, 25 bp, E. coli
cacgttggactacttaggtggttca

SEQ ID NO: 52538 - DNA, 25 bp, E. coli
cacgttggactagttaggtggttca

SEQ ID NO: 52539 - DNA, 25 bp, E. coli
cagttatgggcaattgaggatgaaa

SEQ ID NO: 52540 - DNA, 25 bp, E. coli
cagttatgggcatttgaggatgaaa

SEQ ID NO: 52541 - DNA, 25 bp, E. coli
aaaccattcagaatcaactctggga

SEQ ID NO: 52542 - DNA, 25 bp, E. coli
aaaccattcagattcaactctggga

SEQ ID NO: 52543 - DNA, 25 bp, E. coli
aactctgggaatttcacgttggact

SEQ ID NO: 52544 - DNA, 25 bp, E. coli
aactctgggaatatcacgttggact

SEQ ID NO: 52545 - DNA, 25 bp, E. coli
gacaagtggttttcactcaaatcaa

SEQ ID NO: 52546 - DNA, 25 bp, E. coli
gacaagtggtttacactcaaatcaa

SEQ ID NO: 52547 - DNA, 25 bp, E. coli
gatatgtatgccattataccaggag

SEQ ID NO: 52548 - DNA, 25 bp, E. coli
gatatgtatgcctttataccaggag

SEQ ID NO: 52549 - DNA, 25 bp, E. coli
tggaaaaggagaagaatatgatgcg

SEQ ID NO: 52550 - DNA, 25 bp, E. coli
ggaatactattaaaccaggtcgtag

SEQ ID NO: 52551 - DNA, 25 bp, E. coli
tggaaaaggagatgaatatgatgcg

SEQ ID NO: 52552 - DNA, 25 bp, E. coli
ggaatactattataccaggtcgtag

SEQ ID NO: 52553 - DNA, 25 bp, E. coli
gatgcgatatgcaaaaaaccattca

SEQ ID NO: 52554 - DNA, 25 bp, E. coli
gatgcgatatgctaaaaaccattca

SEQ ID NO: 52555 - DNA, 25 bp, E. coli
catatttccggcgagttcaacgccg

SEQ ID NO: 52556 - DNA, 25 bp, E. coli
catatttccggccagttcaacgccg

SEQ ID NO: 52557 - DNA, 25 bp, E. coli
tatcgaacgtattggcgaccgctgc

SEQ ID NO: 52558 - DNA, 25 bp, E. coli
tatcgaacgtataggcgaccgctgc

SEQ ID NO: 52559 - DNA, 25 bp, E. coli
tattggcgacgtcgcggacaaaatc

SEQ ID NO: 52560 - DNA, 25 bp, E. coli
tattggcgacgtggcggacaaaatc

SEQ ID NO: 52561 - DNA, 25 bp, E. coli
tgacctacatgaaggaagattcgcg

SEQ ID NO: 52562 - DNA, 25 bp, E. coli
tgacctacatgatggaagattcgcg

SEQ ID NO: 52563 - DNA, 25 bp, E. coli
tccgcacgcaggtgatgaccatggg

SEQ ID NO: 52564 - DNA, 25 bp, E. coli
tccgcacgcaggagatgaccatggg

SEQ ID NO: 52565 - DNA, 25 bp, E. coli
gcgaccgctgccagaatatttgtga

SEQ ID NO: 52566 - DNA, 25 bp, E. coli
gcgaccgctgcctgaatatttgtga

SEQ ID NO: 52567 - DNA, 25 bp, E. coli
cggatggacattcacgaagcggtac

SEQ ID NO: 52568 - DNA, 25 bp, E. coli
cggatggacattgacgaagcggtac

SEQ ID NO: 52569 - DNA, 25 bp, E. coli
gatcgatgaagcgtgcgtgcgcatt

SEQ ID NO: 52570 - DNA, 25 bp, E. coli
tcaccgcgatgcataaccaggacag

SEQ ID NO: 52571 - DNA, 25 bp, E. coli
tcaacatgatggaagtggcgatcga

SEQ ID NO: 52572 - DNA, 25 bp, E. coli
tcaccgcgatgcttaaccaggacag

SEQ ID NO: 52573 - DNA, 25 bp, E. coli
tcaacatgatggtagtggcgatcga

SEQ ID NO: 52574 - DNA, 25 bp, E. coli
gagaaattctcccagcagcatcagc

SEQ ID NO: 52575 - DNA, 25 bp, E. coli
gagaaattctccgagcagcatcagc

SEQ ID NO: 52576 - DNA, 25 bp, E. coli
gatcgatgaagcctgcgtgcgcatt

SEQ ID NO: 52577 - DNA, 25 bp, E. coli
aattgctttttcagttccggcgtca

SEQ ID NO: 52578 - DNA, 25 bp, E. coli
aattgctttttctgttccggcgtca

SEQ ID NO: 52579 - DNA, 25 bp, E. coli
cagcggcggacgattcatctggtca

SEQ ID NO: 52580 - DNA, 25 bp, E. coli
cagcggcggacgtttcatctggtca

SEQ ID NO: 52581 - DNA, 25 bp, E. coli
catctggtcacggtggcctttcatg

SEQ ID NO: 52582 - DNA, 25 bp, E. coli
catctggtcacgctggcctttcatg

SEQ ID NO: 52583 - DNA, 25 bp, E. coli
atctgctgtttctgcgcgtcggtca

SEQ ID NO: 52584 - DNA, 25 bp, E. coli
atctgctgtttcagcgcgtcggtca

SEQ ID NO: 52585 - DNA, 25 bp, E. coli
ttatcgaaggtatcgctggcaatga

SEQ ID NO: 52586 - DNA, 25 bp, E. coli
ttgttctgggttaccatgtgcgcca

SEQ ID NO: 52587 - DNA, 25 bp, E. coli
ttgttctgggtttccatgtgcgcca

SEQ ID NO: 52588 - DNA, 25 bp, E. coli
ttatcgaaggtaacgctggcaatga

SEQ ID NO: 52589 - DNA, 25 bp, E. coli
tgtgcgccagcatgttagctttgcg

SEQ ID NO: 52590 - DNA, 25 bp, E. coli
tgtgcgccagcaagttagctttgcg

SEQ ID NO: 52591 - DNA, 25 bp, E. coli
tctgtcagacgcatctcaaaattag

SEQ ID NO: 52592 - DNA, 25 bp, E. coli
tctgtcagacgcttctcaaaattag

SEQ ID NO: 52593 - DNA, 25 bp, E. coli
ccagggtagaggcaacaaacagtgc

SEQ ID NO: 52594 - DNA, 25 bp, E. coli
ccagggtagagggaacaaacagtgc

SEQ ID NO: 52595 - DNA, 25 bp, E. coli
gcattttaccttttgccgctggacg

SEQ ID NO: 52596 - DNA, 25 bp, E. coli
gcgtcggtcaggatcaggtctttga

SEQ ID NO: 52597 - DNA, 25 bp, E. coli
gcgtcggtcaggttcaggtctttga

SEQ ID NO: 52598 - DNA, 25 bp, E. coli
gcattttaccttatgccgctggacg

SEQ ID NO: 52599 - DNA, 25 bp, E. coli
cagcaaagtctttagcgaacgcgtc

SEQ ID NO: 52600 - DNA, 25 bp, E. coli
cagcaaagtcttaagcgaacgcgtc

SEQ ID NO: 52601 - DNA, 25 bp, E. coli
tagacgcaggcgcagacggttatct

SEQ ID NO: 52602 - DNA, 25 bp, E. coli
tagacgcaggcggagacggttatct

SEQ ID NO: 52603 - DNA, 25 bp, E. coli
tgttgaaagacagcgacccggaagt

SEQ ID NO: 52604 - DNA, 25 bp, E. coli
tgttgaaagacaccgacccggaagt

SEQ ID NO: 52605 - DNA, 25 bp, E. coli
tgccggagcgaaaggcagcaaagtc

SEQ ID NO: 52606 - DNA, 25 bp, E. coli
tgccggagcgaatggcagcaaagtc

SEQ ID NO: 52607 - DNA, 25 bp, E. coli
ccttgcgcagggttggcgttaccgc

SEQ ID NO: 52608 - DNA, 25 bp, E. coli
ccttgcgcagggatggcgttaccgc

SEQ ID NO: 52609 - DNA, 25 bp, E. coli
gcgttaccgcgcaaattattatcct

SEQ ID NO: 52610 - DNA, 25 bp, E. coli
gcgttaccgcgctaattattatcct

SEQ ID NO: 52611 - DNA, 25 bp, E. coli
cgatctggcgaaaagactggatatc

SEQ ID NO: 52612 - DNA, 25 bp, E. coli
cgatctggcgaatagactggatatc

SEQ ID NO: 52613 - DNA, 25 bp, E. coli
ggtgttgaatatttccgagcagaca

SEQ ID NO: 52614 - DNA, 25 bp, E. coli
ggtgttgaatatatccgagcagaca

SEQ ID NO: 52615 - DNA, 25 bp, E. coli
tcaaataaacagtttgcctcggtgt

SEQ ID NO: 52616 - DNA, 25 bp, E. coli
tcaaataaacagattgcctcggtgt

SEQ ID NO: 52617 - DNA, 25 bp, E. coli
gatgttctgcacgagctggcacagg

SEQ ID NO: 52618 - DNA, 25 bp, E. coli
gatgatcatccagttatgcgacgcg

SEQ ID NO: 52619 - DNA, 25 bp, E. coli
gatgatcatccacttatgcgacgcg

SEQ ID NO: 52620 - DNA, 25 bp, E. coli
gatgttctgcaccagctggcacagg

SEQ ID NO: 52621 - DNA, 25 bp, E. coli
tattaaccgactgtgaggaagcgat

SEQ ID NO: 52622 - DNA, 25 bp, E. coli
tacattgacgctcagttgaacggtg

SEQ ID NO: 52623 - DNA, 25 bp, E. coli
tacattgacgctgagttgaacggtg

SEQ ID NO: 52624 - DNA, 25 bp, E. coli
tattaaccgactctgaggaagcgat

SEQ ID NO: 52625 - DNA, 25 bp, E. coli
acctttgagtcgatcgggcggccat

SEQ ID NO: 52626 - DNA, 25 bp, E. coli
acctttgagtcgttcgggcggccat

SEQ ID NO: 52627 - DNA, 25 bp, E. coli
aaacctgtggtgatgggacgtcgca

SEQ ID NO: 52628 - DNA, 25 bp, E. coli
aaacctgtggtgttgggacgtcgca

SEQ ID NO: 52629 - DNA, 25 bp, E. coli
ttggagcggtcaacgcatcctgctg

SEQ ID NO: 52630 - DNA, 25 bp, E. coli
ttggagcggtcatcgcatcctgctg

SEQ ID NO: 52631 - DNA, 25 bp, E. coli
tgaacggtgatagccatttcccgga

SEQ ID NO: 52632 - DNA, 25 bp, E. coli
tgaacggtgatacccatttcccgga

SEQ ID NO: 52633 - DNA, 25 bp, E. coli
tgttaccttgagtcgtcagcgctga

SEQ ID NO: 52634 - DNA, 25 bp, E. coli
tgttaccttgagacgtcagcgctga

SEQ ID NO: 52635 - DNA, 25 bp, E. coli
gacgataagaacagctatgcctgcg

SEQ ID NO: 52636 - DNA, 25 bp, E. coli
cggattacctatcgcttgggtggca

SEQ ID NO: 52637 - DNA, 25 bp, E. coli
cggattacctatggcttgggtggca

SEQ ID NO: 52638 - DNA, 25 bp, E. coli
gttagtcgcaatccccaatggcagg

SEQ ID NO: 52639 - DNA, 25 bp, E. coli
gttagtcgcaatgcccaatggcagg

SEQ ID NO: 52640 - DNA, 25 bp, E. coli
gtcatttcaaagctgtcaccctggg

SEQ ID NO: 52641 - DNA, 25 bp, E. coli
gtcatttcaaaggtgtcaccctggg

SEQ ID NO: 52642 - DNA, 25 bp, E. coli
gacgataagaactgctatgcctgcg

SEQ ID NO: 52643 - DNA, 25 bp, E. coli
caagtggtgccgctggttgaacaac

SEQ ID NO: 52644 - DNA, 25 bp, E. coli
caagtggtgccggtggttgaacaac

SEQ ID NO: 52645 - DNA, 25 bp, E. coli
tatgcccgctcgtttttgctgacag

SEQ ID NO: 52646 - DNA, 25 bp, E. coli
tatgatctctgccagcttgaggcgc

SEQ ID NO: 52647 - DNA, 25 bp, E. coli
tatgcccgctcgattttgctgacag

SEQ ID NO: 52648 - DNA, 25 bp, E. coli
tatgatctctgcgagcttgaggcgc

SEQ ID NO: 52649 - DNA, 25 bp, E. coli
tttacgcgaaaggagtcatggaccg

SEQ ID NO: 52650 - DNA, 25 bp, E. coli
tttacgcgaaagcagtcatggaccg

SEQ ID NO: 52651 - DNA, 25 bp, E. coli
tgttaacggcggtattgcaggatca

SEQ ID NO: 52652 - DNA, 25 bp, E. coli
tgttaacggcggaattgcaggatca

SEQ ID NO: 52653 - DNA, 25 bp, E. coli
tgacctcggtagtagctatcacgga

SEQ ID NO: 52654 - DNA, 25 bp, E. coli
tgacctcggtagaagctatcacgga

SEQ ID NO: 52655 - DNA, 25 bp, E. coli
ccttaagctgtaaagtgacctcggt

SEQ ID NO: 52656 - DNA, 25 bp, E. coli
ccttaagctgtatagtgacctcggt

SEQ ID NO: 52657 - DNA, 25 bp, E. coli
cgtatatcgtgtgcgcatcgtgcca

SEQ ID NO: 52658 - DNA, 25 bp, E. coli
cgtatatcgtgtccgcatcgtgcca

SEQ ID NO: 52659 - DNA, 25 bp, E. coli
ggcgcgtaaccctaaccgtgatatc

SEQ ID NO: 52660 - DNA, 25 bp, E. coli
tggatgagcgcgtcaaacgtccgtt

SEQ ID NO: 52661 - DNA, 25 bp, E. coli
tggatgagcgcgacaaacgtccgtt

SEQ ID NO: 52662 - DNA, 25 bp, E. coli
ggcgcgtaacccaaaccgtgatatc

SEQ ID NO: 52663 - DNA, 25 bp, E. coli
gatgattttgattgcgggcggcacc

SEQ ID NO: 52664 - DNA, 25 bp, E. coli
gatgattttgatagcgggcggcacc

SEQ ID NO: 52665 - DNA, 25 bp, E. coli
cagaagttagtggaatgcaatcgct

SEQ ID NO: 52666 - DNA, 25 bp, E. coli
cagaagttagtgcaatgcaatcgct

SEQ ID NO: 52667 - DNA, 25 bp, E. coli
catgtacgcggtcgatgctgttgcc

SEQ ID NO: 52668 - DNA, 25 bp, E. coli
catgtacgcggtggatgctgttgcc

SEQ ID NO: 52669 - DNA, 25 bp, E. coli
tagtacctgaagaaaaaccaatgcc

SEQ ID NO: 52670 - DNA, 25 bp, E. coli
tagtacctgaagtaaaaccaatgcc

SEQ ID NO: 52671 - DNA, 25 bp, E. coli
ttcgatgattttcacggcgacaggc

SEQ ID NO: 52672 - DNA, 25 bp, E. coli
ttcgatgattttgacggcgacaggc

SEQ ID NO: 52673 - DNA, 25 bp, E. coli
taattcctggtgtggtgttgtccgc

SEQ ID NO: 52674 - DNA, 25 bp, E. coli
taattcctggtgaggtgttgtccgc

SEQ ID NO: 52675 - DNA, 25 bp, E. coli
ccagtcagttgggagcagaaccgat

SEQ ID NO: 52676 - DNA, 25 bp, E. coli
ccagtcagttggcagcagaaccgat

SEQ ID NO: 52677 - DNA, 25 bp, E. coli
gctgttgccgctattgcagaggtga

SEQ ID NO: 52678 - DNA, 25 bp, E. coli
gctgttgccgcttttgcagaggtga

SEQ ID NO: 52679 - DNA, 25 bp, E. coli
gcagaaccgataccgactaatgacg

SEQ ID NO: 52680 - DNA, 25 bp, E. coli
gcagaaccgatagcgactaatgacg

SEQ ID NO: 52681 - DNA, 25 bp, E. coli
taatacaggctgttgtcgcgcaagc

SEQ ID NO: 52682 - DNA, 25 bp, E. coli
taagggcgtagaggatgcctgccac

SEQ ID NO: 52683 - DNA, 25 bp, E. coli
taatacaggctgatgtcgcgcaagc

SEQ ID NO: 52684 - DNA, 25 bp, E. coli
taatgacgttcgagagcagcagaca

SEQ ID NO: 52685 - DNA, 25 bp, E. coli
taatgacgttcgtgagcagcagaca

SEQ ID NO: 52686 - DNA, 25 bp, E. coli
taagggcgtagacgatgcctgccac

SEQ ID NO: 52687 - DNA, 25 bp, E. coli
tttcgcgacgatttgcaacgactga

SEQ ID NO: 52688 - DNA, 25 bp, E. coli
ttttgggcatttcgcgacgatttgc

SEQ ID NO: 52689 - DNA, 25 bp, E. coli
tttcgcgacgatatgcaacgactga

SEQ ID NO: 52690 - DNA, 25 bp, E. coli
ttttgggcatttggcgacgatttgc

SEQ ID NO: 52691 - DNA, 25 bp, E. coli
tcgaatttcgaccacgctgttttta

SEQ ID NO: 52692 - DNA, 25 bp, E. coli
tgcagattggcagtaacggcatgtc

SEQ ID NO: 52693 - DNA, 25 bp, E. coli
tgcagattggcactaacggcatgtc

SEQ ID NO: 52694 - DNA, 25 bp, E. coli
tcgaatttcgacgacgctgttttta

SEQ ID NO: 52695 - DNA, 25 bp, E. coli
tttaattttgattctctgcgggatc

SEQ ID NO: 52696 - DNA, 25 bp, E. coli
tctctgcgggatgttgcagattggc

SEQ ID NO: 52697 - DNA, 25 bp, E. coli
tttaattttgatactctgcgggatc

SEQ ID NO: 52698 - DNA, 25 bp, E. coli
tctctgcgggatcttgcagattggc

SEQ ID NO: 52699 - DNA, 25 bp, E. coli
cgaccacgctgtatttaattttgat

SEQ ID NO: 52700 - DNA, 25 bp, E. coli
cgaccacgctgtttttaattttgat

SEQ ID NO: 52701 - DNA, 25 bp, E. coli
gattggcagtaacggcatgtctttt

SEQ ID NO: 52702 - DNA, 25 bp, E. coli
gatcttgcagattggcagtaacggc

SEQ ID NO: 52703 - DNA, 25 bp, E. coli
gatcttgcagataggcagtaacggc

SEQ ID NO: 52704 - DNA, 25 bp, E. coli
gattggcagtaagggcatgtctttt

SEQ ID NO: 52705 - DNA, 25 bp, E. coli
ggcatttcgcgaggatttgcaacga

SEQ ID NO: 52706 - DNA, 25 bp, E. coli
ggcatttcgcgacgatttgcaacga

SEQ ID NO: 52707 - DNA, 25 bp, E. coli
taatcgtattcgaatttcgaccacg

SEQ ID NO: 52708 - DNA, 25 bp, E. coli
taatcgtattcgtatttcgaccacg

SEQ ID NO: 52709 - DNA, 25 bp, E. coli
caactggtgatgctgtggcaagccc

SEQ ID NO: 52710 - DNA, 25 bp, E. coli
cacaaatggtcagatggtcatgaag

SEQ ID NO: 52711 - DNA, 25 bp, E. coli
cagcaaagcctattgccatgtttaa

SEQ ID NO: 52712 - DNA, 25 bp, E. coli
caactggtgatggtgtggcaagccc

SEQ ID NO: 52713 - DNA, 25 bp, E. coli
cacaaatggtcacatggtcatgaag

SEQ ID NO: 52714 - DNA, 25 bp, E. coli
cagcaaagcctaatgccatgtttaa

SEQ ID NO: 52715 - DNA, 25 bp, E. coli
catatgacaattgacacaaatggtc

SEQ ID NO: 52716 - DNA, 25 bp, E. coli
catatgacaattcacacaaatggtc

SEQ ID NO: 52717 - DNA, 25 bp, E. coli
agcgtttgtcgagcgccgttgaact

SEQ ID NO: 52718 - DNA, 25 bp, E. coli
agcgtttgtcgaccgccgttgaact

SEQ ID NO: 52719 - DNA, 25 bp, E. coli
aaagagaactgcctgcaactggtga

SEQ ID NO: 52720 - DNA, 25 bp, E. coli
aaagagaactgcgtgcaactggtga

SEQ ID NO: 52721 - DNA, 25 bp, E. coli
tgaccgaggaactaaaagagaactg

SEQ ID NO: 52722 - DNA, 25 bp, E. coli
tgaccgaggaacaaaaagagaactg

SEQ ID NO: 52723 - DNA, 25 bp, E. coli
gaagattttggtttctcagcaaagc

SEQ ID NO: 52724 - DNA, 25 bp, E. coli
gaagattttggtatctcagcaaagc

SEQ ID NO: 52725 - DNA, 25 bp, E. coli
cgaagcacagcatatgacaattgac

SEQ ID NO: 52726 - DNA, 25 bp, E. coli
cgaagcacagcaaatgacaattgac

SEQ ID NO: 52727 - DNA, 25 bp, E. coli
gtataccagcgtatgtcgaccgccg

SEQ ID NO: 52728 - DNA, 25 bp, E. coli
gtataccagcgtttgtcgaccgccg

SEQ ID NO: 52729 - DNA, 25 bp, E. coli
ggtcatgaagagcaaacagcagtta

SEQ ID NO: 52730 - DNA, 25 bp, E. coli
ggtcatgaagaggaaacagcagtta

SEQ ID NO: 52731 - DNA, 25 bp, E. coli
catcatctgtttatctgaagttcag

SEQ ID NO: 52732 - DNA, 25 bp, E. coli
cataccatcatcagtttttctgaag

SEQ ID NO: 52733 - DNA, 25 bp, E. coli
cataccatcatctgtttttctgaag

SEQ ID NO: 52734 - DNA, 25 bp, E. coli
catcatctgtttttctgaagttcag

SEQ ID NO: 52735 - DNA, 25 bp, E. coli
acacactgttttgcatcttcgttga

SEQ ID NO: 52736 - DNA, 25 bp, E. coli
acacactgttttccatcttcgttga

SEQ ID NO: 52737 - DNA, 25 bp, E. coli
tttaaattgcgtcgcggttcagagc

SEQ ID NO: 52738 - DNA, 25 bp, E. coli
tttaaattgcgtggcggttcagagc

SEQ ID NO: 52739 - DNA, 25 bp, E. coli
tccatcttcgttgattacaacagtc

SEQ ID NO: 52740 - DNA, 25 bp, E. coli
tccatcttcgttcattacaacagtc

SEQ ID NO: 52741 - DNA, 25 bp, E. coli
tcagattagttttaacacactgttt

SEQ ID NO: 52742 - DNA, 25 bp, E. coli
tcagattagtttaaacacactgttt

SEQ ID NO: 52743 - DNA, 25 bp, E. coli
gaagttcagattagttttaacacac

SEQ ID NO: 52744 - DNA, 25 bp, E. coli
gaagttcagatttgttttaacacac

SEQ ID NO: 52745 - DNA, 25 bp, E. coli
cggttcagagcggatatatatatca

SEQ ID NO: 52746 - DNA, 25 bp, E. coli
cgtggcggttcagagcggatatata

SEQ ID NO: 52747 - DNA, 25 bp, E. coli
cgtggcggttcacagcggatatata

SEQ ID NO: 52748 - DNA, 25 bp, E. coli
cggttcagagcgcatatatatatca

SEQ ID NO: 52749 - DNA, 25 bp, E. coli
gatttttattttaaattgcgtggcg

SEQ ID NO: 52750 - DNA, 25 bp, E. coli
gatttttatttttaattgcgtggcg

SEQ ID NO: 52751 - DNA, 25 bp, E. coli
ggatatatatatgaccataccatca

SEQ ID NO: 52752 - DNA, 25 bp, E. coli
ggatatatatatcaccataccatca

SEQ ID NO: 52753 - DNA, 25 bp, E. coli
catcgtattaggttcagccgcgcca

SEQ ID NO: 52754 - DNA, 25 bp, E. coli
catagcaataaagtggccgtcgaca

SEQ ID NO: 52755 - DNA, 25 bp, E. coli
catcgtattaggatcagccgcgcca

SEQ ID NO: 52756 - DNA, 25 bp, E. coli
catagcaataaactggccgtcgaca

SEQ ID NO: 52757 - DNA, 25 bp, E. coli
tacgactgatggacaaaaatgacgg

SEQ ID NO: 52758 - DNA, 25 bp, E. coli
tacgactgatggtcaaaaatgacgg

SEQ ID NO: 52759 - DNA, 25 bp, E. coli
tataaaccgggaccatcatagcaat

SEQ ID NO: 52760 - DNA, 25 bp, E. coli
tataaaccgggagcatcatagcaat

SEQ ID NO: 52761 - DNA, 25 bp, E. coli
ttgttgagcaacaccagtgcaggcg

SEQ ID NO: 52762 - DNA, 25 bp, E. coli
ttgttgagcaactccagtgcaggcg

SEQ ID NO: 52763 - DNA, 25 bp, E. coli
tgtgatctgcctccttctgacaacg

SEQ ID NO: 52764 - DNA, 25 bp, E. coli
tgtgatctgcctgcttctgacaacg

SEQ ID NO: 52765 - DNA, 25 bp, E. coli
tctgacaacggtagcggaatgccgg

SEQ ID NO: 52766 - DNA, 25 bp, E. coli
tctgacaacggttgcggaatgccgg

SEQ ID NO: 52767 - DNA, 25 bp, E. coli
gaatgccggtatccaaagttggcgt

SEQ ID NO: 52768 - DNA, 25 bp, E. coli
gaatgccggtatgcaaagttggcgt

SEQ ID NO: 52769 - DNA, 25 bp, E. coli
gataatgcagtcgatgtcacggcag

SEQ ID NO: 52770 - DNA, 25 bp, E. coli
gataatgcagtccatgtcacggcag

SEQ ID NO: 52771 - DNA, 25 bp, E. coli
tggcgtaaccttggatagcacggct

SEQ ID NO: 52772 - DNA, 25 bp, E. coli
tggcgtaaccttcgatagcacggct

SEQ ID NO: 52773 - DNA, 25 bp, E. coli
taagacaactggagctacgcctttg

SEQ ID NO: 52774 - DNA, 25 bp, E. coli
taagacaactggtgctacgcctttg

SEQ ID NO: 52775 - DNA, 25 bp, E. coli
aagtgagcgccgtggagatttcccc

SEQ ID NO: 52776 - DNA, 25 bp, E. coli
aagtgagcgccgaggagatttcccc

SEQ ID NO: 52777 - DNA, 25 bp, E. coli
caccaactggtatagtgagcgccgt

SEQ ID NO: 52778 - DNA, 25 bp, E. coli
caccaactggtaaagtgagcgccgt

SEQ ID NO: 52779 - DNA, 25 bp, E. coli
cattcagtggaaggaatttacaaac

SEQ ID NO: 52780 - DNA, 25 bp, E. coli
cattcagtggaacgaatttacaaac

SEQ ID NO: 52781 - DNA, 25 bp, E. coli
taggtttgatgaatatttctcttaa

SEQ ID NO: 52782 - DNA, 25 bp, E. coli
taggtttgatgattatttctcttaa

SEQ ID NO: 52783 - DNA, 25 bp, E. coli
tataaacccataattacagaaaata

SEQ ID NO: 52784 - DNA, 25 bp, E. coli
tataaacccatatttacagaaaata

SEQ ID NO: 52785 - DNA, 25 bp, E. coli
tgaatgttgcattcagtggaaggaa

SEQ ID NO: 52786 - DNA, 25 bp, E. coli
tgaatgttgcatacagtggaaggaa

SEQ ID NO: 52787 - DNA, 25 bp, E. coli
tctcttaaatagagtgaatgttgca

SEQ ID NO: 52788 - DNA, 25 bp, E. coli
tctcttaaatagtgtgaatgttgca

SEQ ID NO: 52789 - DNA, 25 bp, E. coli
gcttcggataataatcaccaactgg

SEQ ID NO: 52790 - DNA, 25 bp, E. coli
gcttcggataattatcaccaactgg

SEQ ID NO: 52791 - DNA, 25 bp, E. coli
ggagatttccccgtattggactcat

SEQ ID NO: 52792 - DNA, 25 bp, E. coli
ggaatttacaaacttcagcttcgga

SEQ ID NO: 52793 - DNA, 25 bp, E. coli
ggagatttccccctattggactcat

SEQ ID NO: 52794 - DNA, 25 bp, E. coli
tggactcattttgaggttatacccc

SEQ ID NO: 52795 - DNA, 25 bp, E. coli
tggactcattttcaggttatacccc

SEQ ID NO: 52796 - DNA, 25 bp, E. coli
ggaatttacaaagttcagcttcgga

SEQ ID NO: 52797 - DNA, 25 bp, E. coli
caaggctgctgggtcacggcgattc

SEQ ID NO: 52798 - DNA, 25 bp, E. coli
caaggctgctggctcacggcgattc

SEQ ID NO: 52799 - DNA, 25 bp, E. coli
caaaaggtaaaaccagaattgctgg

SEQ ID NO: 52800 - DNA, 25 bp, E. coli
caaaaggtaaaagcagaattgctgg

SEQ ID NO: 52801 - DNA, 25 bp, E. coli
caggatttgccgattacgcttgctg

SEQ ID NO: 52802 - DNA, 25 bp, E. coli
caggatttgccgtttacgcttgctg

SEQ ID NO: 52803 - DNA, 25 bp, E. coli
taacagccgtgccttacaactggca

SEQ ID NO: 52804 - DNA, 25 bp, E. coli
tatttaggtttatgccatcatccgc

SEQ ID NO: 52805 - DNA, 25 bp, E. coli
tatttaggtttaagccatcatccgc

SEQ ID NO: 52806 - DNA, 25 bp, E. coli
ttatctacagcaccagtatgccgcc

SEQ ID NO: 52807 - DNA, 25 bp, E. coli
ttatctacagcagcagtatgccgcc

SEQ ID NO: 52808 - DNA, 25 bp, E. coli
tccggtcacgtcagcggttatagcg

SEQ ID NO: 52809 - DNA, 25 bp, E. coli
tccggtcacgtctgcggttatagcg

SEQ ID NO: 52810 - DNA, 25 bp, E. coli
tgcgcgactgcggttaacgctaacc

SEQ ID NO: 52811 - DNA, 25 bp, E. coli
tgcgcgactgcgcttaacgctaacc

SEQ ID NO: 52812 - DNA, 25 bp, E. coli
gccagtatctgatcttttccagtaa

SEQ ID NO: 52813 - DNA, 25 bp, E. coli
gccagtatctgaacttttccagtaa

SEQ ID NO: 52814 - DNA, 25 bp, E. coli
cggcttagccatgcctcattgctgg

SEQ ID NO: 52815 - DNA, 25 bp, E. coli
cggcttagccatccctcattgctgg

SEQ ID NO: 52816 - DNA, 25 bp, E. coli
ctcaggcgcaggcattacgtgcgtc

SEQ ID NO: 52817 - DNA, 25 bp, E. coli
ctcaggcgcagggattacgtgcgtc

SEQ ID NO: 52818 - DNA, 25 bp, E. coli
taacagccgtgcgttacaactggca

SEQ ID NO: 52819 - DNA, 25 bp, E. coli
cagacgtgggtaagagtttaggaaa

SEQ ID NO: 52820 - DNA, 25 bp, E. coli
cagacgtgggtatgagtttaggaaa

SEQ ID NO: 52821 - DNA, 25 bp, E. coli
tatgagtttaggaaagccctcagcc

SEQ ID NO: 52822 - DNA, 25 bp, E. coli
tatgagtttaggtaagccctcagcc

SEQ ID NO: 52823 - DNA, 25 bp, E. coli
tttaggaaagccctcagcctcgatt

SEQ ID NO: 52824 - DNA, 25 bp, E. coli
tttaggaaagccgtcagcctcgatt

SEQ ID NO: 52825 - DNA, 25 bp, E. coli
tccagactacacaattctgataatt

SEQ ID NO: 52826 - DNA, 25 bp, E. coli
tccagactacactattctgataatt

SEQ ID NO: 52827 - DNA, 25 bp, E. coli
tctacgtcaggcagccgtactccga

SEQ ID NO: 52828 - DNA, 25 bp, E. coli
tctacgtcaggctgccgtactccga

SEQ ID NO: 52829 - DNA, 25 bp, E. coli
gaatggctgattgagaactaccgca

SEQ ID NO: 52830 - DNA, 25 bp, E. coli
gaatggctgattcagaactaccgca

SEQ ID NO: 52831 - DNA, 25 bp, E. coli
gaactaccgcagtcgtgggtatgag

SEQ ID NO: 52832 - DNA, 25 bp, E. coli
gaactaccgcagacgtgggtatgag

SEQ ID NO: 52833 - DNA, 25 bp, E. coli
gattcagaactaccgcagacgtggg

SEQ ID NO: 52834 - DNA, 25 bp, E. coli
gattcagaactagcgcagacgtggg

SEQ ID NO: 52835 - DNA, 25 bp, E. coli
tggataatctacgtcaggctgccgt

SEQ ID NO: 52836 - DNA, 25 bp, E. coli
ggcgcaaaattcgagactacacaat

SEQ ID NO: 52837 - DNA, 25 bp, E. coli
ggcgcaaaattccagactacacaat

SEQ ID NO: 52838 - DNA, 25 bp, E. coli
tggataatctacctcaggctgccgt

SEQ ID NO: 52839 - DNA, 25 bp, E. coli
tcaaatctgactcgttccggcacgc

SEQ ID NO: 52840 - DNA, 25 bp, E. coli
tcaaatctgactggttccggcacgc

SEQ ID NO: 52841 - DNA, 25 bp, E. coli
catatagtgagagcctaccaaccgg

SEQ ID NO: 52842 - DNA, 25 bp, E. coli
catatagtgagaccctaccaaccgg

SEQ ID NO: 52843 - DNA, 25 bp, E. coli
aaatagccggtgaattctgcgagac

SEQ ID NO: 52844 - DNA, 25 bp, E. coli
aaatagccggtgtattctgcgagac

SEQ ID NO: 52845 - DNA, 25 bp, E. coli
tacctaagccggttagcggtggccg

SEQ ID NO: 52846 - DNA, 25 bp, E. coli
tacctaagccggatagcggtggccg

SEQ ID NO: 52847 - DNA, 25 bp, E. coli
taggtcacacaattccaaaaggcgg

SEQ ID NO: 52848 - DNA, 25 bp, E. coli
taggtcacacaaatccaaaaggcgg

SEQ ID NO: 52849 - DNA, 25 bp, E. coli
tatatgccgcagtgtttatccgccg

SEQ ID NO: 52850 - DNA, 25 bp, E. coli
tatatgccgcagagtttatccgccg

SEQ ID NO: 52851 - DNA, 25 bp, E. coli
tgacagttggtattgcgatgcccgg

SEQ ID NO: 52852 - DNA, 25 bp, E. coli
tgacagttggtaatgcgatgcccgg

SEQ ID NO: 52853 - DNA, 25 bp, E. coli
gaatgccatattcagccggagcaga

SEQ ID NO: 52854 - DNA, 25 bp, E. coli
gaatgccatattgagccggagcaga

SEQ ID NO: 52855 - DNA, 25 bp, E. coli
gattatcctgtccatcgagcctggc

SEQ ID NO: 52856 - DNA, 25 bp, E. coli
gattatcctgtcgatcgagcctggc

SEQ ID NO: 52857 - DNA, 25 bp, E. coli
taaggaaccccgtcagctttgggcg

SEQ ID NO: 52858 - DNA, 25 bp, E. coli
taaggaaccccgacagctttgggcg

SEQ ID NO: 52859 - DNA, 25 bp, E. coli
taagaaacctggcacaagcttcggg

SEQ ID NO: 52860 - DNA, 25 bp, E. coli
taatttgatgttagtcgcagcgctg

SEQ ID NO: 52861 - DNA, 25 bp, E. coli
taagaaacctgggacaagcttcggg

SEQ ID NO: 52862 - DNA, 25 bp, E. coli
taatttgatgtttgtcgcagcgctg

SEQ ID NO: 52863 - DNA, 25 bp, E. coli
tacgcagaacgtagccatcagtcgt

SEQ ID NO: 52864 - DNA, 25 bp, E. coli
actggacgagatacagatacctgac

SEQ ID NO: 52865 - DNA, 25 bp, E. coli
actggacgagattcagatacctgac

SEQ ID NO: 52866 - DNA, 25 bp, E. coli
tacgcagaacgttgccatcagtcgt

SEQ ID NO: 52867 - DNA, 25 bp, E. coli
tattcgtaccggaactggagttgac

SEQ ID NO: 52868 - DNA, 25 bp, E. coli
tattcgtaccggtactggagttgac

SEQ ID NO: 52869 - DNA, 25 bp, E. coli
tatactgacaggagcaggatggttt

SEQ ID NO: 52870 - DNA, 25 bp, E. coli
tatactgacaggtgcaggatggttt

SEQ ID NO: 52871 - DNA, 25 bp, E. coli
tgatccatatcacaacgaaacactg

SEQ ID NO: 52872 - DNA, 25 bp, E. coli
tgatccatatcagaacgaaacactg

SEQ ID NO: 52873 - DNA, 25 bp, E. coli
gccaattatgtcagtagaagggaaa

SEQ ID NO: 52874 - DNA, 25 bp, E. coli
gccaattatgtctgtagaagggaaa

SEQ ID NO: 52875 - DNA, 25 bp, E. coli
gcgtaccggcacgatcgtttcaagg

SEQ ID NO: 52876 - DNA, 25 bp, E. coli
gcgtaccggcaccatcgtttcaagg

SEQ ID NO: 52877 - DNA, 25 bp, E. coli
cgtttcaaggtagcagctacgagta

SEQ ID NO: 52878 - DNA, 25 bp, E. coli
gctacgagtaaagcaactggacgag

SEQ ID NO: 52879 - DNA, 25 bp, E. coli
gctacgagtaaaccaactggacgag

SEQ ID NO: 52880 - DNA, 25 bp, E. coli
cgtttcaaggtaccagctacgagta

SEQ ID NO: 52881 - DNA, 25 bp, E. coli
tggagttgacacaataaagtgccaa

SEQ ID NO: 52882 - DNA, 25 bp, E. coli
tggagttgacactataaagtgccaa

SEQ ID NO: 52883 - DNA, 25 bp, E. coli
gatgcggccattccgttctcagtaa

SEQ ID NO: 52884 - DNA, 25 bp, E. coli
gatgcggccattgcgttctcagtaa

SEQ ID NO: 52885 - DNA, 25 bp, E. coli
caaagattttgagcgtctaagtcag

SEQ ID NO: 52886 - DNA, 25 bp, E. coli
caaagattttgaccgtctaagtcag

SEQ ID NO: 52887 - DNA, 25 bp, E. coli
ataagcataatgtgttccggattac

SEQ ID NO: 52888 - DNA, 25 bp, E. coli
ataagcataatgagttccggattac

SEQ ID NO: 52889 - DNA, 25 bp, E. coli
tgagcgtctaagacagtttgctgac

SEQ ID NO: 52890 - DNA, 25 bp, E. coli
tgagcgtctaagtcagtttgctgac

SEQ ID NO: 52891 - DNA, 25 bp, E. coli
tctcaataaggatgtcgaaaatttg

SEQ ID NO: 52892 - DNA, 25 bp, E. coli
tctcaataagcaaaatgtgttccgg

SEQ ID NO: 52893 - DNA, 25 bp, E. coli
tctaagtcagttagctgacgatctc

SEQ ID NO: 52894 - DNA, 25 bp, E. coli
tctcaataaggaagtcgaaaatttg

SEQ ID NO: 52895 - DNA, 25 bp, E. coli
tctcaataagcataatgtgttccgg

SEQ ID NO: 52896 - DNA, 25 bp, E. coli
tctaagtcagtttgctgacgatctc

SEQ ID NO: 52897 - DNA, 25 bp, E. coli
ccagttttcttgataccaacagcta

SEQ ID NO: 52898 - DNA, 25 bp, E. coli
ccagttttcttgttaccaacagcta

SEQ ID NO: 52899 - DNA, 25 bp, E. coli
cgaaaatttgttggactatcttgaa

SEQ ID NO: 52900 - DNA, 25 bp, E. coli
cgaaaatttgttcgactatcttgaa

SEQ ID NO: 52901 - DNA, 25 bp, E. coli
gattttgagcgtctaagtcagtttg

SEQ ID NO: 52902 - DNA, 25 bp, E. coli
gattttgagcgtgtaagtcagtttg

SEQ ID NO: 52903 - DNA, 25 bp, E. coli
gttttcttgatagcaacagctatct

SEQ ID NO: 52904 - DNA, 25 bp, E. coli
gataccaacagcaatcttaatattg

SEQ ID NO: 52905 - DNA, 25 bp, E. coli
gataccaacagctatcttaatattg

SEQ ID NO: 52906 - DNA, 25 bp, E. coli
gttttcttgataccaacagctatct

SEQ ID NO: 52907 - DNA, 25 bp, E. coli
caatcaggaaaaaagcatgggtgcc

SEQ ID NO: 52908 - DNA, 25 bp, E. coli
caatcaggaaaatagcatgggtgcc

SEQ ID NO: 52909 - DNA, 25 bp, E. coli
caaacctgttttcgcttgcagctca

SEQ ID NO: 52910 - DNA, 25 bp, E. coli
caaacctgttttggcttgcagctca

SEQ ID NO: 52911 - DNA, 25 bp, E. coli
cagcccatgttctgagcgcaagtgt

SEQ ID NO: 52912 - DNA, 25 bp, E. coli
cagcccatgttcagagcgcaagtgt

SEQ ID NO: 52913 - DNA, 25 bp, E. coli
catgggtgccaagattgcgaaaagc

SEQ ID NO: 52914 - DNA, 25 bp, E. coli
catgggtgccaacattgcgaaaagc

SEQ ID NO: 52915 - DNA, 25 bp, E. coli
taacaccagcaagcctgaaagcgtg

SEQ ID NO: 52916 - DNA, 25 bp, E. coli
taaaaaatgccgtagtgcgttagcc

SEQ ID NO: 52917 - DNA, 25 bp, E. coli
taacaatcaggatacaccaccaggg

SEQ ID NO: 52918 - DNA, 25 bp, E. coli
taaaccctggacaagtgctgatgca

SEQ ID NO: 52919 - DNA, 25 bp, E. coli
taaaaaatgccgaagtgcgttagcc

SEQ ID NO: 52920 - DNA, 25 bp, E. coli
taaaccctggactagtgctgatgca

SEQ ID NO: 52921 - DNA, 25 bp, E. coli
tcgtgagccgctttccaatctggaa

SEQ ID NO: 52922 - DNA, 25 bp, E. coli
tcgtgagccgctatccaatctggaa

SEQ ID NO: 52923 - DNA, 25 bp, E. coli
taacaatcaggaaacaccaccaggg

SEQ ID NO: 52924 - DNA, 25 bp, E. coli
taacaccagcaaccctgaaagcgtg

SEQ ID NO: 52925 - DNA, 25 bp, E. coli
tcagcacttgatgaagccgtgaccg

SEQ ID NO: 52926 - DNA, 25 bp, E. coli
tcagcacttgatcaagccgtgaccg

SEQ ID NO: 52927 - DNA, 25 bp, E. coli
gatgcattactagcagcagccggaa

SEQ ID NO: 52928 - DNA, 25 bp, E. coli
gatgcattactaccagcagccggaa

SEQ ID NO: 52929 - DNA, 25 bp, E. coli
caatgacggcgtagatcagtgagca

SEQ ID NO: 52930 - DNA, 25 bp, E. coli
aagattttcgcgatcgtggtcagca

SEQ ID NO: 52931 - DNA, 25 bp, E. coli
caaggcatttttcaacgcgcggact

SEQ ID NO: 52932 - DNA, 25 bp, E. coli
caatgacggcgttgatcagtgagca

SEQ ID NO: 52933 - DNA, 25 bp, E. coli
aagattttcgcgttcgtggtcagca

SEQ ID NO: 52934 - DNA, 25 bp, E. coli
caaggcatttttgaacgcgcggact

SEQ ID NO: 52935 - DNA, 25 bp, E. coli
caaattaccggctctggtcgagcgt

SEQ ID NO: 52936 - DNA, 25 bp, E. coli
caaattaccggcactggtcgagcgt

SEQ ID NO: 52937 - DNA, 25 bp, E. coli
catgtgttgctgattatggactccc

SEQ ID NO: 52938 - DNA, 25 bp, E. coli
catgtgttgctgtttatggactccc

SEQ ID NO: 52939 - DNA, 25 bp, E. coli
tgtcgagttttctgcgtaaccgcga

SEQ ID NO: 52940 - DNA, 25 bp, E. coli
tgtcgagttttcagcgtaaccgcga

SEQ ID NO: 52941 - DNA, 25 bp, E. coli
tcagtgagcaacattacgcgcgagt

SEQ ID NO: 52942 - DNA, 25 bp, E. coli
tcagtgagcaactttacgcgcgagt

SEQ ID NO: 52943 - DNA, 25 bp, E. coli
gacggaaaccggtgcgctgattacc

SEQ ID NO: 52944 - DNA, 25 bp, E. coli
gacggaaaccggagcgctgattacc

SEQ ID NO: 52945 - DNA, 25 bp, E. coli
cggattacaattgccgctcggcgca

SEQ ID NO: 52946 - DNA, 25 bp, E. coli
cggattacaattcccgctcggcgca

SEQ ID NO: 52947 - DNA, 25 bp, E. coli
gattgaacatgtcctggacaccggc

SEQ ID NO: 52948 - DNA, 25 bp, E. coli
gattgaacatgtgctggacaccggc

SEQ ID NO: 52949 - DNA, 25 bp, E. coli
taaccgcgatctcgttagcgtcggc

SEQ ID NO: 52950 - DNA, 25 bp, E. coli
taaccgcgatctggttagcgtcggc

SEQ ID NO: 52951 - DNA, 25 bp, E. coli
aaggtaacgtgattgacccactgga

SEQ ID NO: 52952 - DNA, 25 bp, E. coli
aaggtaacgtgaatgacccactgga

SEQ ID NO: 52953 - DNA, 25 bp, E. coli
tacaaagatcgtcgacggcgcagaa

SEQ ID NO: 52954 - DNA, 25 bp, E. coli
tacaaagatcgtggacggcgcagaa

SEQ ID NO: 52955 - DNA, 25 bp, E. coli
accggctgcgtgaagatcaccccag

SEQ ID NO: 52956 - DNA, 25 bp, E. coli
accggctgcgtgtagatcaccccag

SEQ ID NO: 52957 - DNA, 25 bp, E. coli
aacagaagccgaactgcgcggtact

SEQ ID NO: 52958 - DNA, 25 bp, E. coli
aacagaagccgatctgcgcggtact

SEQ ID NO: 52959 - DNA, 25 bp, E. coli
aaagatcgtcgagggcgcagaactg

SEQ ID NO: 52960 - DNA, 25 bp, E. coli
aaagatcgtcgacggcgcagaactg

SEQ ID NO: 52961 - DNA, 25 bp, E. coli
tgtggaccttctgcacgctcggctg

SEQ ID NO: 52962 - DNA, 25 bp, E. coli
tgtggaccttctccacgctcggctg

SEQ ID NO: 52963 - DNA, 25 bp, E. coli
tgaacggtggaacagaagccgaact

SEQ ID NO: 52964 - DNA, 25 bp, E. coli
tgaacggtggaagagaagccgaact

SEQ ID NO: 52965 - DNA, 25 bp, E. coli
tccaaaggtaacctgattgacccac

SEQ ID NO: 52966 - DNA, 25 bp, E. coli
tccaaatccaaaggtaacgtgattg

SEQ ID NO: 52967 - DNA, 25 bp, E. coli
tccaaaggtaacgtgattgacccac

SEQ ID NO: 52968 - DNA, 25 bp, E. coli
tccaaatccaaacgtaacgtgattg

SEQ ID NO: 52969 - DNA, 25 bp, E. coli
gaagatcacccctgcgcacgacttt

SEQ ID NO: 52970 - DNA, 25 bp, E. coli
gaagatcaccccagcgcacgacttt

SEQ ID NO: 52971 - DNA, 25 bp, E. coli
ggtaatgaacggtggaacagaagcc

SEQ ID NO: 52972 - DNA, 25 bp, E. coli
ggtaatgaacggaggaacagaagcc

SEQ ID NO: 52973 - DNA, 25 bp, E. coli
tactttcccgaattgctcttcttga

SEQ ID NO: 52974 - DNA, 25 bp, E. coli
tactttcccgaaatgctcttcttga

SEQ ID NO: 52975 - DNA, 25 bp, E. coli
agatgccattaacatgaggaaatat

SEQ ID NO: 52976 - DNA, 25 bp, E. coli
agatgccattaagatgaggaaatat

SEQ ID NO: 52977 - DNA, 25 bp, E. coli
aagatgccattatcatgaggaaata

SEQ ID NO: 52978 - DNA, 25 bp, E. coli
aagatgccattaacatgaggaaata

SEQ ID NO: 52979 - DNA, 25 bp, E. coli
ttctgctcagtaaccgggagtttac

SEQ ID NO: 52980 - DNA, 25 bp, E. coli
ttctgctcagtatccgggagtttac

SEQ ID NO: 52981 - DNA, 25 bp, E. coli
tgttctgctcagaaaccgggagttt

SEQ ID NO: 52982 - DNA, 25 bp, E. coli
tgttctgctcagtaaccgggagttt

SEQ ID NO: 52983 - DNA, 25 bp, E. coli
tcccgaattgctgttcttgaacttg

SEQ ID NO: 52984 - DNA, 25 bp, E. coli
tcccgaattgctcttcttgaacttg

SEQ ID NO: 52985 - DNA, 25 bp, E. coli
tctgctcagtaagcgggagtttact

SEQ ID NO: 52986 - DNA, 25 bp, E. coli
tctgctcagtaaccgggagtttact

SEQ ID NO: 52987 - DNA, 25 bp, E. coli
gctcttcttgaacttggtattttcg

SEQ ID NO: 52988 - DNA, 25 bp, E. coli
gctcttcttgaagttggtattttcg

SEQ ID NO: 52989 - DNA, 25 bp, E. coli
gaattgctcttcttgaacttggtat

SEQ ID NO: 52990 - DNA, 25 bp, E. coli
gaattgctcttcatgaacttggtat

SEQ ID NO: 52991 - DNA, 25 bp, E. coli
cgaattgctcttgttgaacttggta

SEQ ID NO: 52992 - DNA, 25 bp, E. coli
cgaattgctcttcttgaacttggta

SEQ ID NO: 52993 - DNA, 25 bp, E. coli
taaccgggagttaactgaagatgcc

SEQ ID NO: 52994 - DNA, 25 bp, E. coli
taaccgggagtttactgaagatgcc

SEQ ID NO: 52995 - DNA, 25 bp, E. coli
aatgctgctattatccgcttctttt

SEQ ID NO: 52996 - DNA, 25 bp, E. coli
atgaatgctgcttttttccgcttct

SEQ ID NO: 52997 - DNA, 25 bp, E. coli
atgctgctatttaccgcttcttttt

SEQ ID NO: 52998 - DNA, 25 bp, E. coli
atgaatgctgctattttccgcttct

SEQ ID NO: 52999 - DNA, 25 bp, E. coli
atgctgctattttccgcttcttttt

SEQ ID NO: 53000 - DNA, 25 bp, E. coli
aatgctgctattttccgcttctttt

SEQ ID NO: 53001 - DNA, 25 bp, E. coli
tgaatgctgctaatttccgcttctt

SEQ ID NO: 53002 - DNA, 25 bp, E. coli
tgaatgctgctattttccgcttctt

SEQ ID NO: 53003 - DNA, 25 bp, E. coli
tgctgctattttccgcttctttttt

SEQ ID NO: 53004 - DNA, 25 bp, E. coli
tgctgctattttgcgcttctttttt

SEQ ID NO: 53005 - DNA, 25 bp, E. coli
gcttctttttttactttagcacctg

SEQ ID NO: 53006 - DNA, 25 bp, E. coli
gctgctattttcggcttcttttttt

SEQ ID NO: 53007 - DNA, 25 bp, E. coli
gcttcttttttttctttagcacctg

SEQ ID NO: 53008 - DNA, 25 bp, E. coli
gctgctattttccgcttcttttttt

SEQ ID NO: 53009 - DNA, 25 bp, E. coli
gaatgctgctattttccgcttcttt

SEQ ID NO: 53010 - DNA, 25 bp, E. coli
gaatgctgctatattccgcttcttt

SEQ ID NO: 53011 - DNA, 25 bp, E. coli
caatgaaccagatactctgcctgat

SEQ ID NO: 53012 - DNA, 25 bp, E. coli
caatgaaccagaaactctgcctgat

SEQ ID NO: 53013 - DNA, 25 bp, E. coli
tactctgcctgaacccgcgataggc

SEQ ID NO: 53014 - DNA, 25 bp, E. coli
tactctgcctgatcccgcgataggc

SEQ ID NO: 53015 - DNA, 25 bp, E. coli
aaaacgctggcccttgctggcagag

SEQ ID NO: 53016 - DNA, 25 bp, E. coli
aaaacgctggccgttgctggcagag

SEQ ID NO: 53017 - DNA, 25 bp, E. coli
ttcccaacgcgatcagttggccgcg

SEQ ID NO: 53018 - DNA, 25 bp, E. coli
ttcccaacgcgaacagttggccgcg

SEQ ID NO: 53019 - DNA, 25 bp, E. coli
ttaaagcaggcaatttcactgcctg

SEQ ID NO: 53020 - DNA, 25 bp, E. coli
ttaaagcaggcattttcactgcctg

SEQ ID NO: 53021 - DNA, 25 bp, E. coli
gctggcagagtttgcgcaacaaaag

SEQ ID NO: 53022 - DNA, 25 bp, E. coli
gctggcagagttagcgcaacaaaag

SEQ ID NO: 53023 - DNA, 25 bp, E. coli
gaataacaatgaaccagatactctg

SEQ ID NO: 53024 - DNA, 25 bp, E. coli
gaataacaatgatccagatactctg

SEQ ID NO: 53025 - DNA, 25 bp, E. coli
ccgcgataggctttatcttccagaa

SEQ ID NO: 53026 - DNA, 25 bp, E. coli
ccgcgataggctatatcttccagaa

SEQ ID NO: 53027 - DNA, 25 bp, E. coli
gttggccgcggctttaaaacgctgg

SEQ ID NO: 53028 - DNA, 25 bp, E. coli
gttggccgcggcattaaaacgctgg

SEQ ID NO: 53029 - DNA, 25 bp, E. coli
gattatgccgatatttcccaacgcg

SEQ ID NO: 53030 - DNA, 25 bp, E. coli
gattatgccgatttttcccaacgcg

SEQ ID NO: 53031 - DNA, 25 bp, E. coli
tggcgttaaagcaggcattttcact

SEQ ID NO: 53032 - DNA, 25 bp, E. coli
tggcgttaaagctggcattttcact

SEQ ID NO: 53033 - DNA, 25 bp, E. coli
aaggatcatcaggattcgctcaagg

SEQ ID NO: 53034 - DNA, 25 bp, E. coli
aaggatcatcagcattcgctcaagg

SEQ ID NO: 53035 - DNA, 25 bp, E. coli
cactggctcacctgaaatagcttca

SEQ ID NO: 53036 - DNA, 25 bp, E. coli
cactggctcaccagaaatagcttca

SEQ ID NO: 53037 - DNA, 25 bp, E. coli
cagtatgccattgccgtccggcttg

SEQ ID NO: 53038 - DNA, 25 bp, E. coli
catccagtatgccattgccgtccgg

SEQ ID NO: 53039 - DNA, 25 bp, E. coli
catccagtatgcgattgccgtccgg

SEQ ID NO: 53040 - DNA, 25 bp, E. coli
cagtatgccattcccgtccggcttg

SEQ ID NO: 53041 - DNA, 25 bp, E. coli
tatgccatccagtatgccattgccg

SEQ ID NO: 53042 - DNA, 25 bp, E. coli
tatgccatccagaatgccattgccg

SEQ ID NO: 53043 - DNA, 25 bp, E. coli
ttttcggtatgcgatccagtatgcc

SEQ ID NO: 53044 - DNA, 25 bp, E. coli
ttgccgtccggcatgcactggctca

SEQ ID NO: 53045 - DNA, 25 bp, E. coli
ttttcggtatgccatccagtatgcc

SEQ ID NO: 53046 - DNA, 25 bp, E. coli
ttgccgtccggcttgcactggctca

SEQ ID NO: 53047 - DNA, 25 bp, E. coli
tgcttgttttttgggtatgccatcc

SEQ ID NO: 53048 - DNA, 25 bp, E. coli
tgcttgttttttcggtatgccatcc

SEQ ID NO: 53049 - DNA, 25 bp, E. coli
tcagcattcgctcaaggtctgctaa

SEQ ID NO: 53050 - DNA, 25 bp, E. coli
tcagcattcgctgaaggtctgctaa

SEQ ID NO: 53051 - DNA, 25 bp, E. coli
gaaatagcttcagacaactcactca

SEQ ID NO: 53052 - DNA, 25 bp, E. coli
gaaatagcttcacacaactcactca

SEQ ID NO: 53053 - DNA, 25 bp, E. coli
ggcttgcactgggtcacctgaaata

SEQ ID NO: 53054 - DNA, 25 bp, E. coli
ggcttgcactggctcacctgaaata

SEQ ID NO: 53055 - DNA, 25 bp, E. coli
cacttacaaaggagaacaaggcgcg

SEQ ID NO: 53056 - DNA, 25 bp, E. coli
cacttacaaaggtgaacaaggcgcg

SEQ ID NO: 53057 - DNA, 25 bp, E. coli
caaagccggtatagaagcggccaac

SEQ ID NO: 53058 - DNA, 25 bp, E. coli
caaagccggtattgaagcggccaac

SEQ ID NO: 53059 - DNA, 25 bp, E. coli
catcgaaaggcgaaggtctgggtaa

SEQ ID NO: 53060 - DNA, 25 bp, E. coli
catcgaaaggcgtaggtctgggtaa

SEQ ID NO: 53061 - DNA, 25 bp, E. coli
tcgcgtacagaagaaagccaaaggt

SEQ ID NO: 53062 - DNA, 25 bp, E. coli
tcgcgtacagaacaaagccaaaggt

SEQ ID NO: 53063 - DNA, 25 bp, E. coli
ccggtctggtaaaaggcgcatcgaa

SEQ ID NO: 53064 - DNA, 25 bp, E. coli
ccggtctggtaataggcgcatcgaa

SEQ ID NO: 53065 - DNA, 25 bp, E. coli
gaatttgtcgatttcgccggtctgg

SEQ ID NO: 53066 - DNA, 25 bp, E. coli
gaatttgtcgatatcgccggtctgg

SEQ ID NO: 53067 - DNA, 25 bp, E. coli
gaaaaaggctttatccgtgcacaaa

SEQ ID NO: 53068 - DNA, 25 bp, E. coli
gacattgccgaactggacgacgaag

SEQ ID NO: 53069 - DNA, 25 bp, E. coli
gacattgccgaagtggacgacgaag

SEQ ID NO: 53070 - DNA, 25 bp, E. coli
gaaaaaggctttttccgtgcacaaa

SEQ ID NO: 53071 - DNA, 25 bp, E. coli
gttatcaacacccaactggcgctgg

SEQ ID NO: 53072 - DNA, 25 bp, E. coli
gttatcaacaccgaactggcgctgg

SEQ ID NO: 53073 - DNA, 25 bp, E. coli
tcaactggctgatatcgtaaaaccg

SEQ ID NO: 53074 - DNA, 25 bp, E. coli
tcaactggctgaaatcgtaaaaccg

SEQ ID NO: 53075 - DNA, 25 bp, E. coli
gaccaacatccgagaaaccgaagcg

SEQ ID NO: 53076 - DNA, 25 bp, E. coli
gaccaacatccgtgaaaccgaagcg

SEQ ID NO: 53077 - DNA, 25 bp, E. coli
caaggctacgatgccagcgaattta

SEQ ID NO: 53078 - DNA, 25 bp, E. coli
caaggctacgatcccagcgaattta

SEQ ID NO: 53079 - DNA, 25 bp, E. coli
acggtgtattttgcgatgttaaaga

SEQ ID NO: 53080 - DNA, 25 bp, E. coli
acggtgtattttccgatgttaaaga

SEQ ID NO: 53081 - DNA, 25 bp, E. coli
aacttacaatcaatacaaggctacg

SEQ ID NO: 53082 - DNA, 25 bp, E. coli
aacttacaatcattacaaggctacg

SEQ ID NO: 53083 - DNA, 25 bp, E. coli
tttatatcggatagtcaggtgtggg

SEQ ID NO: 53084 - DNA, 25 bp, E. coli
tttatatcggattgtcaggtgtggg

SEQ ID NO: 53085 - DNA, 25 bp, E. coli
tccccagagttaacaaggaaatatc

SEQ ID NO: 53086 - DNA, 25 bp, E. coli
tccccagagttatcaaggaaatatc

SEQ ID NO: 53087 - DNA, 25 bp, E. coli
tcagatggcattaccccagagttaa

SEQ ID NO: 53088 - DNA, 25 bp, E. coli
tcagatggcatttccccagagttaa

SEQ ID NO: 53089 - DNA, 25 bp, E. coli
gcgaaaaagccggtgaaaacttaca

SEQ ID NO: 53090 - DNA, 25 bp, E. coli
gcgaaaaagccgctgaaaacttaca

SEQ ID NO: 53091 - DNA, 25 bp, E. coli
ggtaagcggagtcgaaaaatcaatc

SEQ ID NO: 53092 - DNA, 25 bp, E. coli
ggtaagcggagtggaaaaatcaatc

SEQ ID NO: 53093 - DNA, 25 bp, E. coli
ggcgttgtttgcgacccgtatattt

SEQ ID NO: 53094 - DNA, 25 bp, E. coli
ggcgttgtttgccacccgtatattt

SEQ ID NO: 53095 - DNA, 25 bp, E. coli
tcaatcaaaccagcacaaagatgtt

SEQ ID NO: 53096 - DNA, 25 bp, E. coli
tcaatcaaaccaccacaaagatgtt

SEQ ID NO: 53097 - DNA, 25 bp, E. coli
gatgttctcatcaatggcgtctgga

SEQ ID NO: 53098 - DNA, 25 bp, E. coli
gatgttctcatctatggcgtctgga

SEQ ID NO: 53099 - DNA, 25 bp, E. coli
ttggctggcctcagtaagtggactg

SEQ ID NO: 53100 - DNA, 25 bp, E. coli
ttggctggcctctgtaagtggactg

SEQ ID NO: 53101 - DNA, 25 bp, E. coli
ttctgggcgagcgtaattactaccg

SEQ ID NO: 53102 - DNA, 25 bp, E. coli
ttctgggcgagcctaattactaccg

SEQ ID NO: 53103 - DNA, 25 bp, E. coli
tgggcgagcgtaattactaccgtac

SEQ ID NO: 53104 - DNA, 25 bp, E. coli
tgggcgagcgtatttactaccgtac

SEQ ID NO: 53105 - DNA, 25 bp, E. coli
tctgggcgagcgaaattactaccgt

SEQ ID NO: 53106 - DNA, 25 bp, E. coli
tctgggcgagcgtaattactaccgt

SEQ ID NO: 53107 - DNA, 25 bp, E. coli
gctggcctctgttagtggactgtcc

SEQ ID NO: 53108 - DNA, 25 bp, E. coli
gcgagcgtaattactaccgtaccct

SEQ ID NO: 53109 - DNA, 25 bp, E. coli
gctggcctctgtaagtggactgtcc

SEQ ID NO: 53110 - DNA, 25 bp, E. coli
gcgagcgtaatttctaccgtaccct

SEQ ID NO: 53111 - DNA, 25 bp, E. coli
ctgggcgagcgttattactaccgta

SEQ ID NO: 53112 - DNA, 25 bp, E. coli
ctgggcgagcgtaattactaccgta

SEQ ID NO: 53113 - DNA, 25 bp, E. coli
ggctggcctctgaaagtggactgtc

SEQ ID NO: 53114 - DNA, 25 bp, E. coli
tggcctctgtaagtggactgtccgc

SEQ ID NO: 53115 - DNA, 25 bp, E. coli
tggcctctgtaactggactgtccgc

SEQ ID NO: 53116 - DNA, 25 bp, E. coli
ggcctctgtaagtggactgtccgcg

SEQ ID NO: 53117 - DNA, 25 bp, E. coli
tggctggcctctgtaagtggactgt

SEQ ID NO: 53118 - DNA, 25 bp, E. coli
ggctggcctctgtaagtggactgtc

SEQ ID NO: 53119 - DNA, 25 bp, E. coli
ggcctctgtaagaggactgtccgcg

SEQ ID NO: 53120 - DNA, 25 bp, E. coli
tggctggcctctctaagtggactgt

SEQ ID NO: 53121 - DNA, 25 bp, E. coli
caattctgttagtttgcgacccagg

SEQ ID NO: 53122 - DNA, 25 bp, E. coli
caattctgttagattgcgacccagg

SEQ ID NO: 53123 - DNA, 25 bp, E. coli
caaagcaattacctcttccgccgga

SEQ ID NO: 53124 - DNA, 25 bp, E. coli
caaagcaattacgtcttccgccgga

SEQ ID NO: 53125 - DNA, 25 bp, E. coli
tctaccggaccgcaaactaacgttg

SEQ ID NO: 53126 - DNA, 25 bp, E. coli
tctaccggaccggaaactaacgttg

SEQ ID NO: 53127 - DNA, 25 bp, E. coli
tatttacgttgacccggaagcggca

SEQ ID NO: 53128 - DNA, 25 bp, E. coli
tatttacgttgagccggaagcggca

SEQ ID NO: 53129 - DNA, 25 bp, E. coli
tgctgaccttgcataatcgcaccga

SEQ ID NO: 53130 - DNA, 25 bp, E. coli
tgctgaccttgcttaatcgcaccga

SEQ ID NO: 53131 - DNA, 25 bp, E. coli
gcctcaccagagcttgatgtcaaag

SEQ ID NO: 53132 - DNA, 25 bp, E. coli
gcctcaccagaggttgatgtcaaag

SEQ ID NO: 53133 - DNA, 25 bp, E. coli
cggcagaaattgacttccagtcagg

SEQ ID NO: 53134 - DNA, 25 bp, E. coli
cggcagaaattgtcttccagtcagg

SEQ ID NO: 53135 - DNA, 25 bp, E. coli
ggaactgcataggaaaattgcccgt

SEQ ID NO: 53136 - DNA, 25 bp, E. coli
ggaactgcatagcaaaattgcccgt

SEQ ID NO: 53137 - DNA, 25 bp, E. coli
taacgttgccttgctgctcaatagc

SEQ ID NO: 53138 - DNA, 25 bp, E. coli
taacgttgccttcctgctcaatagc

SEQ ID NO: 53139 - DNA, 25 bp, E. coli
tcaaccattgttgccgaactgctgg

SEQ ID NO: 53140 - DNA, 25 bp, E. coli
tcaaccattgttcccgaactgctgg

SEQ ID NO: 53141 - DNA, 25 bp, E. coli
gacgcctgcggcagaatttaatatt

SEQ ID NO: 53142 - DNA, 25 bp, E. coli
gacgcctgcggctgaatttaatatt

SEQ ID NO: 53143 - DNA, 25 bp, E. coli
aaccgtcggttatgcctgtgcggca

SEQ ID NO: 53144 - DNA, 25 bp, E. coli
aaccgtcggttaagcctgtgcggca

SEQ ID NO: 53145 - DNA, 25 bp, E. coli
cagggtggtgcaaccatagggctat

SEQ ID NO: 53146 - DNA, 25 bp, E. coli
cagggtggtgcatccatagggctat

SEQ ID NO: 53147 - DNA, 25 bp, E. coli
acattacagggtttgcgtcagctca

SEQ ID NO: 53148 - DNA, 25 bp, E. coli
acattacagggtatgcgtcagctca

SEQ ID NO: 53149 - DNA, 25 bp, E. coli
tagggctattgatttgtaccgtggc

SEQ ID NO: 53150 - DNA, 25 bp, E. coli
tagggctattgaattgtaccgtggc

SEQ ID NO: 53151 - DNA, 25 bp, E. coli
tgctaacttgtgtaccctggcggca

SEQ ID NO: 53152 - DNA, 25 bp, E. coli
tgaatctgcgggaaaaaatcgccta

SEQ ID NO: 53153 - DNA, 25 bp, E. coli
tgaatctgcgggtaaaaatcgccta

SEQ ID NO: 53154 - DNA, 25 bp, E. coli
tgctaacttgtgaaccctggcggca

SEQ ID NO: 53155 - DNA, 25 bp, E. coli
tcgcggaaaaatattgggcctaaag

SEQ ID NO: 53156 - DNA, 25 bp, E. coli
tcgcggaaaaattttgggcctaaag

SEQ ID NO: 53157 - DNA, 25 bp, E. coli
tctgatgaactgctcgtatggtgcg

SEQ ID NO: 53158 - DNA, 25 bp, E. coli
tctgatgaactggtcgtatggtgcg

SEQ ID NO: 53159 - DNA, 25 bp, E. coli
gctgtgctacagaggcgtcaaagag

SEQ ID NO: 53160 - DNA, 25 bp, E. coli
gcgtttaccgatatgctcaccggat

SEQ ID NO: 53161 - DNA, 25 bp, E. coli
gctgtgctacagtggcgtcaaagag

SEQ ID NO: 53162 - DNA, 25 bp, E. coli
gcgtttaccgatttgctcaccggat

SEQ ID NO: 53163 - DNA, 25 bp, E. coli
taatatcaaactggcgattcaggtc

SEQ ID NO: 53164 - DNA, 25 bp, E. coli
taatatcaaactcgcgattcaggtc

SEQ ID NO: 53165 - DNA, 25 bp, E. coli
tttgttttcgcaccaatgacctggg

SEQ ID NO: 53166 - DNA, 25 bp, E. coli
tattacttgcgctgaagccaacgaa

SEQ ID NO: 53167 - DNA, 25 bp, E. coli
tattacttgcgcagaagccaacgaa

SEQ ID NO: 53168 - DNA, 25 bp, E. coli
tttgttttcgcagcaatgacctggg

SEQ ID NO: 53169 - DNA, 25 bp, E. coli
tgttgcggtaatcggtaatgccagc

SEQ ID NO: 53170 - DNA, 25 bp, E. coli
tgttgcggtaatgggtaatgccagc

SEQ ID NO: 53171 - DNA, 25 bp, E. coli
tctccggaactgagcgccaaagtgg

SEQ ID NO: 53172 - DNA, 25 bp, E. coli
tctccggaactgtgcgccaaagtgg

SEQ ID NO: 53173 - DNA, 25 bp, E. coli
cctgggcgcaggactacaatattaa

SEQ ID NO: 53174 - DNA, 25 bp, E. coli
gccagcgttgccagccgtgatttaa

SEQ ID NO: 53175 - DNA, 25 bp, E. coli
gccagcgttgcctgccgtgatttaa

SEQ ID NO: 53176 - DNA, 25 bp, E. coli
cctgggcgcaggtctacaatattaa

SEQ ID NO: 53177 - DNA, 25 bp, E. coli
gaaatggcaaaaactgacagcgcac

SEQ ID NO: 53178 - DNA, 25 bp, E. coli
gacaccatgcgtcctatcggcaaaa

SEQ ID NO: 53179 - DNA, 25 bp, E. coli
gacaccatgcgtgctatcggcaaaa

SEQ ID NO: 53180 - DNA, 25 bp, E. coli
gaaatggcaaaatctgacagcgcac

SEQ ID NO: 53181 - DNA, 25 bp, E. coli
gacagcgcacagcttgcagaaattg

SEQ ID NO: 53182 - DNA, 25 bp, E. coli
gacagcgcacaggttgcagaaattg

SEQ ID NO: 53183 - DNA, 25 bp, E. coli
ccgcaaatgctgatgatcacggcaa

SEQ ID NO: 53184 - DNA, 25 bp, E. coli
ccgcaaatgctgttgatcacggcaa

SEQ ID NO: 53185 - DNA, 25 bp, E. coli
gatcacggcaatagatgacaccatg

SEQ ID NO: 53186 - DNA, 25 bp, E. coli
gatcacggcaattgatgacaccatg

SEQ ID NO: 53187 - DNA, 25 bp, E. coli
taccaacgcgaacctaacaaggaaa

SEQ ID NO: 53188 - DNA, 25 bp, E. coli
taccaacgcgaagctaacaaggaaa

SEQ ID NO: 53189 - DNA, 25 bp, E. coli
tgcaaactatctagaaatcggaggt

SEQ ID NO: 53190 - DNA, 25 bp, E. coli
tgcaaactatcttgaaatcggaggt

SEQ ID NO: 53191 - DNA, 25 bp, E. coli
tcgtcgcgatcactctaaagtagct

SEQ ID NO: 53192 - DNA, 25 bp, E. coli
tcgcaggtgagtagtaaaggttcag

SEQ ID NO: 53193 - DNA, 25 bp, E. coli
tcgcaggacttataaaattcgcagg

SEQ ID NO: 53194 - DNA, 25 bp, E. coli
tcgtcgcgatcagtctaaagtagct

SEQ ID NO: 53195 - DNA, 25 bp, E. coli
tcgcaggacttaaaaaattcgcagg

SEQ ID NO: 53196 - DNA, 25 bp, E. coli
tcgcaggtgagttgtaaaggttcag

SEQ ID NO: 53197 - DNA, 25 bp, E. coli
tcttacaccggtgatccattcgatg

SEQ ID NO: 53198 - DNA, 25 bp, E. coli
tcttacaccggtcatccattcgatg

SEQ ID NO: 53199 - DNA, 25 bp, E. coli
tctgcaaagatagagcatgcatgct

SEQ ID NO: 53200 - DNA, 25 bp, E. coli
tctgcaaagatacagcatgcatgct

SEQ ID NO: 53201 - DNA, 25 bp, E. coli
gaaatcggaggtaaatgtatcgcca

SEQ ID NO: 53202 - DNA, 25 bp, E. coli
gaaatcggaggttaatgtatcgcca

SEQ ID NO: 53203 - DNA, 25 bp, E. coli
cggttacttaagagctatgaggatg

SEQ ID NO: 53204 - DNA, 25 bp, E. coli
cggttacttaagtgctatgaggatg

SEQ ID NO: 53205 - DNA, 25 bp, E. coli
gtatcgccatttattgaccaacagc

SEQ ID NO: 53206 - DNA, 25 bp, E. coli
gtatcgccattttttgaccaacagc

SEQ ID NO: 53207 - DNA, 25 bp, E. coli
gaccaacagcgtttaaatacactaa

SEQ ID NO: 53208 - DNA, 25 bp, E. coli
gaccaacagcgtataaatacactaa

SEQ ID NO: 53209 - DNA, 25 bp, E. coli
aaccgctcgttacttcctgtggcga

SEQ ID NO: 53210 - DNA, 25 bp, E. coli
aaccgctcgttagttcctgtggcga

SEQ ID NO: 53211 - DNA, 25 bp, E. coli
cacatgggtacacgcagtgacaaat

SEQ ID NO: 53212 - DNA, 25 bp, E. coli
cacatgggtacaggcagtgacaaat

SEQ ID NO: 53213 - DNA, 25 bp, E. coli
caggcagtgacatatcggatgcgct

SEQ ID NO: 53214 - DNA, 25 bp, E. coli
caggcagtgacaaatcggatgcgct

SEQ ID NO: 53215 - DNA, 25 bp, E. coli
agcaaccgctcgatacttcctgtgg

SEQ ID NO: 53216 - DNA, 25 bp, E. coli
agcaaccgctcgttacttcctgtgg

SEQ ID NO: 53217 - DNA, 25 bp, E. coli
ttgcggaacaaagccagcaaccgct

SEQ ID NO: 53218 - DNA, 25 bp, E. coli
ttgcggaacaaacccagcaaccgct

SEQ ID NO: 53219 - DNA, 25 bp, E. coli
tgacaaatcggaagcgctgggcgtg

SEQ ID NO: 53220 - DNA, 25 bp, E. coli
tgacaaatcggatgcgctgggcgtg

SEQ ID NO: 53221 - DNA, 25 bp, E. coli
ctattataaccatcaagccatgtag

SEQ ID NO: 53222 - DNA, 25 bp, E. coli
ctattataaccaacaagccatgtag

SEQ ID NO: 53223 - DNA, 25 bp, E. coli
cgttacttcctgaggcgatgtggtg

SEQ ID NO: 53224 - DNA, 25 bp, E. coli
cgtgccctattaaaaccaacaagcc

SEQ ID NO: 53225 - DNA, 25 bp, E. coli
cgtgccctattataaccaacaagcc

SEQ ID NO: 53226 - DNA, 25 bp, E. coli
cgttacttcctgtggcgatgtggtg

SEQ ID NO: 53227 - DNA, 25 bp, E. coli
ggtacaggcagtgacaaatcggatg

SEQ ID NO: 53228 - DNA, 25 bp, E. coli
ggtacaggcagtcacaaatcggatg

SEQ ID NO: 53229 - DNA, 25 bp, E. coli
tggcgatgtggtggttgttccccca

SEQ ID NO: 53230 - DNA, 25 bp, E. coli
tggcgatgtggtcgttgttccccca

SEQ ID NO: 53231 - DNA, 25 bp, E. coli
aatcttttgcgcgagccggtggaag

SEQ ID NO: 53232 - DNA, 25 bp, E. coli
aatcttttgcgccagccggtggaag

SEQ ID NO: 53233 - DNA, 25 bp, E. coli
aagcaagaaaactgggagcgccacg

SEQ ID NO: 53234 - DNA, 25 bp, E. coli
aagcaagaaaacagggagcgccacg

SEQ ID NO: 53235 - DNA, 25 bp, E. coli
taaatatccgcatcaggcgagcctg

SEQ ID NO: 53236 - DNA, 25 bp, E. coli
taaatcgcatgcgaatattgtccgc

SEQ ID NO: 53237 - DNA, 25 bp, E. coli
taaatatccgcaacaggcgagcctg

SEQ ID NO: 53238 - DNA, 25 bp, E. coli
taaatcgcatgccaatattgtccgc

SEQ ID NO: 53239 - DNA, 25 bp, E. coli
tattgtccgcagctatgtggcgcgc

SEQ ID NO: 53240 - DNA, 25 bp, E. coli
tattgtccgcaggtatgtggcgcgc

SEQ ID NO: 53241 - DNA, 25 bp, E. coli
taagtcagccgctggagtttcggcg

SEQ ID NO: 53242 - DNA, 25 bp, E. coli
taagtcagccgcaggagtttcggcg

SEQ ID NO: 53243 - DNA, 25 bp, E. coli
tcttgacgccatggaagatgtccag

SEQ ID NO: 53244 - DNA, 25 bp, E. coli
tcttgacgccatcgaagatgtccag

SEQ ID NO: 53245 - DNA, 25 bp, E. coli
gacaaatcgctgtttcttgacgcca

SEQ ID NO: 53246 - DNA, 25 bp, E. coli
gacaaatcgctgattcttgacgcca

SEQ ID NO: 53247 - DNA, 25 bp, E. coli
taagctgcgcagaggtaaatatccg

SEQ ID NO: 53248 - DNA, 25 bp, E. coli
taagctgcgcagtggtaaatatccg

SEQ ID NO: 53249 - DNA, 25 bp, E. coli
gatgtccagccggtgaaacgtgcta

SEQ ID NO: 53250 - DNA, 25 bp, E. coli
gatgtccagccgctgaaacgtgcta

SEQ ID NO: 53251 - DNA, 25 bp, E. coli
gatgtccactggcatccaacgcgta

SEQ ID NO: 53252 - DNA, 25 bp, E. coli
gatgtccactgggatccaacgcgta

SEQ ID NO: 53253 - DNA, 25 bp, E. coli
caatggctgttgcttggacgcaaga

SEQ ID NO: 53254 - DNA, 25 bp, E. coli
caatggctgttggttggacgcaaga

SEQ ID NO: 53255 - DNA, 25 bp, E. coli
cactaatggtaggtatatcgaagaa

SEQ ID NO: 53256 - DNA, 25 bp, E. coli
cactaatggtagctatatcgaagaa

SEQ ID NO: 53257 - DNA, 25 bp, E. coli
catggagtgccataggtgaacagct

SEQ ID NO: 53258 - DNA, 25 bp, E. coli
catggagtgccaaaggtgaacagct

SEQ ID NO: 53259 - DNA, 25 bp, E. coli
tacaatagacatcgagccggaaggt

SEQ ID NO: 53260 - DNA, 25 bp, E. coli
tacaatagacatggagccggaaggt

SEQ ID NO: 53261 - DNA, 25 bp, E. coli
agaatggagttaacgggaatggccc

SEQ ID NO: 53262 - DNA, 25 bp, E. coli
agaatggagttatcgggaatggccc

SEQ ID NO: 53263 - DNA, 25 bp, E. coli
gctattacctataaccaatggctgt

SEQ ID NO: 53264 - DNA, 25 bp, E. coli
gctattacctattaccaatggctgt

SEQ ID NO: 53265 - DNA, 25 bp, E. coli
gaatggccctgatattccatggagt

SEQ ID NO: 53266 - DNA, 25 bp, E. coli
gaatggccctgaaattccatggagt

SEQ ID NO: 53267 - DNA, 25 bp, E. coli
gaaatccccagctattttaggccag

SEQ ID NO: 53268 - DNA, 25 bp, E. coli
gaaagtatgcggacgtaacacgttc

SEQ ID NO: 53269 - DNA, 25 bp, E. coli
gaaagtatgcggtcgtaacacgttc

SEQ ID NO: 53270 - DNA, 25 bp, E. coli
gaaatccccagcaattttaggccag

SEQ ID NO: 53271 - DNA, 25 bp, E. coli
ggagcattaccctaccgaaagtatg

SEQ ID NO: 53272 - DNA, 25 bp, E. coli
gggagatatacataagcctgatcga

SEQ ID NO: 53273 - DNA, 25 bp, E. coli
gggagatatacaaaagcctgatcga

SEQ ID NO: 53274 - DNA, 25 bp, E. coli
ggagcattacccaaccgaaagtatg

SEQ ID NO: 53275 - DNA, 25 bp, E. coli
caactgtgaatagaccgtgccgggt

SEQ ID NO: 53276 - DNA, 25 bp, E. coli
caactgtgaatacaccgtgccgggt

SEQ ID NO: 53277 - DNA, 25 bp, E. coli
agtgtgattgtccacctggcagccc

SEQ ID NO: 53278 - DNA, 25 bp, E. coli
atccgtgcgggccaaattacctggc

SEQ ID NO: 53279 - DNA, 25 bp, E. coli
agtgtgattgtcgacctggcagccc

SEQ ID NO: 53280 - DNA, 25 bp, E. coli
atccgtgcgggcgaaattacctggc

SEQ ID NO: 53281 - DNA, 25 bp, E. coli
tatgccaaagtgatgtcggacgcgt

SEQ ID NO: 53282 - DNA, 25 bp, E. coli
tatgccaaagtgttgtcggacgcgt

SEQ ID NO: 53283 - DNA, 25 bp, E. coli
tatcgcgccattcttgaagcggcac

SEQ ID NO: 53284 - DNA, 25 bp, E. coli
tatcgcgccattgttgaagcggcac

SEQ ID NO: 53285 - DNA, 25 bp, E. coli
gaatcctgggactacgctggtgagt

SEQ ID NO: 53286 - DNA, 25 bp, E. coli
gaatcctgggacaacgctggtgagt

SEQ ID NO: 53287 - DNA, 25 bp, E. coli
gaaatggaactcattgccgcccagg

SEQ ID NO: 53288 - DNA, 25 bp, E. coli
gaaatggaactctttgccgcccagg

SEQ ID NO: 53289 - DNA, 25 bp, E. coli
cgataaagcgtttgtgcaagcgggc

SEQ ID NO: 53290 - DNA, 25 bp, E. coli
cgattcaggtatgagctcagccgca

SEQ ID NO: 53291 - DNA, 25 bp, E. coli
cgattcaggtatcagctcagccgca

SEQ ID NO: 53292 - DNA, 25 bp, E. coli
cgataaagcgttagtgcaagcgggc

SEQ ID NO: 53293 - DNA, 25 bp, E. coli
tggcctgcgcagaatccggaattaa

SEQ ID NO: 53294 - DNA, 25 bp, E. coli
tggcctgcgcagtatccggaattaa

SEQ ID NO: 53295 - DNA, 25 bp, E. coli
taacgtgaccgtcatggcgatggac

SEQ ID NO: 53296 - DNA, 25 bp, E. coli
taacgtgaccgtgatggcgatggac

SEQ ID NO: 53297 - DNA, 25 bp, E. coli
aaaaaatgatgtgttgctcgcggaa

SEQ ID NO: 53298 - DNA, 25 bp, E. coli
aaaaaatgatgtcttgctcgcggaa

SEQ ID NO: 53299 - DNA, 25 bp, E. coli
ttccagtcgtaacggtgagttgtct

SEQ ID NO: 53300 - DNA, 25 bp, E. coli
ttccagtcgtaagggtgagttgtct

SEQ ID NO: 53301 - DNA, 25 bp, E. coli
tgagttgtctacatgggataccatc

SEQ ID NO: 53302 - DNA, 25 bp, E. coli
tgagttgtctacttgggataccatc

SEQ ID NO: 53303 - DNA, 25 bp, E. coli
tgacaaagggaacgcaatgcatgat

SEQ ID NO: 53304 - DNA, 25 bp, E. coli
tgacaaagggaaggcaatgcatgat

SEQ ID NO: 53305 - DNA, 25 bp, E. coli
gcctgttccagttgccacgatggta

SEQ ID NO: 53306 - DNA, 25 bp, E. coli
gcctgttccagtagccacgatggta

SEQ ID NO: 53307 - DNA, 25 bp, E. coli
gaatcgcacccaatattatacaggc

SEQ ID NO: 53308 - DNA, 25 bp, E. coli
gaagaagttttcttgtctctgcctg

SEQ ID NO: 53309 - DNA, 25 bp, E. coli
gaagaagttttcatgtctctgcctg

SEQ ID NO: 53310 - DNA, 25 bp, E. coli
gaatcgcacccattattatacaggc

SEQ ID NO: 53311 - DNA, 25 bp, E. coli
cggaaaatattccaacagcggatta

SEQ ID NO: 53312 - DNA, 25 bp, E. coli
cggaaaatattcgaacagcggatta

SEQ ID NO: 53313 - DNA, 25 bp, E. coli
gatcaagcgtcaacatttccatgca

SEQ ID NO: 53314 - DNA, 25 bp, E. coli
gatttagtgcctatcaagataccgt

SEQ ID NO: 53315 - DNA, 25 bp, E. coli
gatcaagcgtcatcatttccatgca

SEQ ID NO: 53316 - DNA, 25 bp, E. coli
gataatttcctccattcactgaggg

SEQ ID NO: 53317 - DNA, 25 bp, E. coli
gataatttcctcgattcactgaggg

SEQ ID NO: 53318 - DNA, 25 bp, E. coli
gatttagtgcctttcaagataccgt

SEQ ID NO: 53319 - DNA, 25 bp, E. coli
aacgccggtagaccatgtttgccga

SEQ ID NO: 53320 - DNA, 25 bp, E. coli
aacgccggtagagcatgtttgccga

SEQ ID NO: 53321 - DNA, 25 bp, E. coli
tagagcatgtttgccgactggtacg

SEQ ID NO: 53322 - DNA, 25 bp, E. coli
tagagcatgtttcccgactggtacg

SEQ ID NO: 53323 - DNA, 25 bp, E. coli
ttaacgccggtacagcatgtttgcc

SEQ ID NO: 53324 - DNA, 25 bp, E. coli
ttaacgccggtagagcatgtttgcc

SEQ ID NO: 53325 - DNA, 25 bp, E. coli
tgagtaccgaagttagccgacgcat

SEQ ID NO: 53326 - DNA, 25 bp, E. coli
tgagtaccgaagatagccgacgcat

SEQ ID NO: 53327 - DNA, 25 bp, E. coli
tgctttcgttaacgccggtagagca

SEQ ID NO: 53328 - DNA, 25 bp, E. coli
tgctttcgttaaggccggtagagca

SEQ ID NO: 53329 - DNA, 25 bp, E. coli
tcgttaacgccgctagagcatgttt

SEQ ID NO: 53330 - DNA, 25 bp, E. coli
tcgttaacgccggtagagcatgttt

SEQ ID NO: 53331 - DNA, 25 bp, E. coli
gccggtagagcaagtttgccgactg

SEQ ID NO: 53332 - DNA, 25 bp, E. coli
gccggtagagcatgtttgccgactg

SEQ ID NO: 53333 - DNA, 25 bp, E. coli
gcttgagtaccgtagatagccgacg

SEQ ID NO: 53334 - DNA, 25 bp, E. coli
gcttgagtaccgaagatagccgacg

SEQ ID NO: 53335 - DNA, 25 bp, E. coli
ccgagtggcttgagtaccgaagata

SEQ ID NO: 53336 - DNA, 25 bp, E. coli
ccgagtggcttgtgtaccgaagata

SEQ ID NO: 53337 - DNA, 25 bp, E. coli
gttgctttcgtttacgccggtagag

SEQ ID NO: 53338 - DNA, 25 bp, E. coli
gagttgctttcgataacgccggtag

SEQ ID NO: 53339 - DNA, 25 bp, E. coli
gttgctttcgttaacgccggtagag

SEQ ID NO: 53340 - DNA, 25 bp, E. coli
gagttgctttcgttaacgccggtag

SEQ ID NO: 53341 - DNA, 25 bp, E. coli
cacgttacaatacccgggtactgga

SEQ ID NO: 53342 - DNA, 25 bp, E. coli
cacgttacaatagccgggtactgga

SEQ ID NO: 53343 - DNA, 25 bp, E. coli
caatagccgggttctggattttcgt

SEQ ID NO: 53344 - DNA, 25 bp, E. coli
aacacgttacaaaagccgggtactg

SEQ ID NO: 53345 - DNA, 25 bp, E. coli
caatagccgggtactggattttcgt

SEQ ID NO: 53346 - DNA, 25 bp, E. coli
aacacgttacaatagccgggtactg

SEQ ID NO: 53347 - DNA, 25 bp, E. coli
tacgcgatctgtgccttctgcgagg

SEQ ID NO: 53348 - DNA, 25 bp, E. coli
tacgcgatctgtcccttctgcgagg

SEQ ID NO: 53349 - DNA, 25 bp, E. coli
tgtgaattaatttcgcgatcgcgat

SEQ ID NO: 53350 - DNA, 25 bp, E. coli
tgtttactgataatcccgtaaaaga

SEQ ID NO: 53351 - DNA, 25 bp, E. coli
tgtgaattaattacgcgatcgcgat

SEQ ID NO: 53352 - DNA, 25 bp, E. coli
tgtttactgatattcccgtaaaaga

SEQ ID NO: 53353 - DNA, 25 bp, E. coli
ccgggtactggattttcgtgagaca

SEQ ID NO: 53354 - DNA, 25 bp, E. coli
ccgggtactggaatttcgtgagaca

SEQ ID NO: 53355 - DNA, 25 bp, E. coli
gaattgttgtgatttaatttcgcga

SEQ ID NO: 53356 - DNA, 25 bp, E. coli
gaattgttgtgaattaatttcgcga

SEQ ID NO: 53357 - DNA, 25 bp, E. coli
cttctgcgaggccacttccaaaaaa

SEQ ID NO: 53358 - DNA, 25 bp, E. coli
cttctgcgaggcgacttccaaaaaa

SEQ ID NO: 53359 - DNA, 25 bp, E. coli
tggattttcgtgagacaggaagaag

SEQ ID NO: 53360 - DNA, 25 bp, E. coli
tggattttcgtgtgacaggaagaag

SEQ ID NO: 53361 - DNA, 25 bp, E. coli
gatctgtgccttctgcgaggcgact

SEQ ID NO: 53362 - DNA, 25 bp, E. coli
gatctgtgccttgtgcgaggcgact

SEQ ID NO: 53363 - DNA, 25 bp, E. coli
caatctgcgtgagcaggtagggcca

SEQ ID NO: 53364 - DNA, 25 bp, E. coli
caatctgcgtgaccaggtagggcca

SEQ ID NO: 53365 - DNA, 25 bp, E. coli
cagttagtcgattacagccagggcc

SEQ ID NO: 53366 - DNA, 25 bp, E. coli
cagttagtcgataacagccagggcc

SEQ ID NO: 53367 - DNA, 25 bp, E. coli
agacattatttaagccccggagggc

SEQ ID NO: 53368 - DNA, 25 bp, E. coli
agacattatttatgccccggagggc

SEQ ID NO: 53369 - DNA, 25 bp, E. coli
tacccgcagcgtcaaatacagtgac

SEQ ID NO: 53370 - DNA, 25 bp, E. coli
tatcggaccttaagtggaacagacc

SEQ ID NO: 53371 - DNA, 25 bp, E. coli
tatcggaccttatgtggaacagacc

SEQ ID NO: 53372 - DNA, 25 bp, E. coli
tacccgcagcgtgaaatacagtgac

SEQ ID NO: 53373 - DNA, 25 bp, E. coli
ttaccagagcctcaaaacgcgggcg

SEQ ID NO: 53374 - DNA, 25 bp, E. coli
ttaccagagcctgaaaacgcgggcg

SEQ ID NO: 53375 - DNA, 25 bp, E. coli
ccatgtcggtaatcaggcggtgatc

SEQ ID NO: 53376 - DNA, 25 bp, E. coli
ccatgtcggtaaacaggcggtgatc

SEQ ID NO: 53377 - DNA, 25 bp, E. coli
gacaagcccgtgctatcagcacaga

SEQ ID NO: 53378 - DNA, 25 bp, E. coli
gaacgcttcttttaaccggatggca

SEQ ID NO: 53379 - DNA, 25 bp, E. coli
gaacgcttctttaaaccggatggca

SEQ ID NO: 53380 - DNA, 25 bp, E. coli
gacaagcccgtggtatcagcacaga

SEQ ID NO: 53381 - DNA, 25 bp, E. coli
gtctggcctaactacatgcgcgaag

SEQ ID NO: 53382 - DNA, 25 bp, E. coli
gtctggcctaacaacatgcgcgaag

SEQ ID NO: 53383 - DNA, 25 bp, E. coli
gatttacccgatctgctgaccgcag

SEQ ID NO: 53384 - DNA, 25 bp, E. coli
gatttacccgatgtgctgaccgcag

SEQ ID NO: 53385 - DNA, 25 bp, E. coli
catgccggagtggttcgtattgaag

SEQ ID NO: 53386 - DNA, 25 bp, E. coli
catgccggagtgcttcgtattgaag

SEQ ID NO: 53387 - DNA, 25 bp, E. coli
agtttaccggcattacagtttctga

SEQ ID NO: 53388 - DNA, 25 bp, E. coli
agtttaccggcaatacagtttctga

SEQ ID NO: 53389 - DNA, 25 bp, E. coli
tatataagctggtagatggctcggt

SEQ ID NO: 53390 - DNA, 25 bp, E. coli
tatataagctggaagatggctcggt

SEQ ID NO: 53391 - DNA, 25 bp, E. coli
ttaatatgccagtcgtacccagtag

SEQ ID NO: 53392 - DNA, 25 bp, E. coli
ttaatatgccagacgtacccagtag

SEQ ID NO: 53393 - DNA, 25 bp, E. coli
ttttccataacgttaacccgctgtg

SEQ ID NO: 53394 - DNA, 25 bp, E. coli
ttttccataacgataacccgctgtg

SEQ ID NO: 53395 - DNA, 25 bp, E. coli
tgaagatgccagattatataagctg

SEQ ID NO: 53396 - DNA, 25 bp, E. coli
tgaagatgccagtttatataagctg

SEQ ID NO: 53397 - DNA, 25 bp, E. coli
gctgatgatatctctcatgccggag

SEQ ID NO: 53398 - DNA, 25 bp, E. coli
gctgatgatatcactcatgccggag

SEQ ID NO: 53399 - DNA, 25 bp, E. coli
cccagtagttcggtaaggagtgcag

SEQ ID NO: 53400 - DNA, 25 bp, E. coli
cccgctgtggtactgatgttggcaa

SEQ ID NO: 53401 - DNA, 25 bp, E. coli
cccgctgtggtagtgatgttggcaa

SEQ ID NO: 53402 - DNA, 25 bp, E. coli
cccagtagttcgctaaggagtgcag

SEQ ID NO: 53403 - DNA, 25 bp, E. coli
gggcttgcacttacgatttttgata

SEQ ID NO: 53404 - DNA, 25 bp, E. coli
ggcaacgcgtatataaagtttaccg

SEQ ID NO: 53405 - DNA, 25 bp, E. coli
gggcttgcactttcgatttttgata

SEQ ID NO: 53406 - DNA, 25 bp, E. coli
ggcaacgcgtatttaaagtttaccg

SEQ ID NO: 53407 - DNA, 25 bp, E. coli
caatctttgcgcaaacgactgcacg

SEQ ID NO: 53408 - DNA, 25 bp, E. coli
caatctttgcgctaacgactgcacg

SEQ ID NO: 53409 - DNA, 25 bp, E. coli
caaaacggctgcagacgtagagcgg

SEQ ID NO: 53410 - DNA, 25 bp, E. coli
caaaacggctgctgacgtagagcgg

SEQ ID NO: 53411 - DNA, 25 bp, E. coli
caggacttcttcaggcggctggaaa

SEQ ID NO: 53412 - DNA, 25 bp, E. coli
caggacttcttctggcggctggaaa

SEQ ID NO: 53413 - DNA, 25 bp, E. coli
atcgctggcgactactggactggga

SEQ ID NO: 53414 - DNA, 25 bp, E. coli
atcgctggcgacaactggactggga

SEQ ID NO: 53415 - DNA, 25 bp, E. coli
tgcaacagcatttctggcaaagccg

SEQ ID NO: 53416 - DNA, 25 bp, E. coli
tgcaacagcattactggcaaagccg

SEQ ID NO: 53417 - DNA, 25 bp, E. coli
tcaggagacatatcacgaggcgact

SEQ ID NO: 53418 - DNA, 25 bp, E. coli
tcaggagacataacacgaggcgact

SEQ ID NO: 53419 - DNA, 25 bp, E. coli
ccggtatggaaagactgggacagct

SEQ ID NO: 53420 - DNA, 25 bp, E. coli
ccggtatggaaacactgggacagct

SEQ ID NO: 53421 - DNA, 25 bp, E. coli
gaatcaccgtggattcgcgatcgcg

SEQ ID NO: 53422 - DNA, 25 bp, E. coli
gaatcaccgtggtttcgcgatcgcg

SEQ ID NO: 53423 - DNA, 25 bp, E. coli
ccgctatacgggagatgggctttga

SEQ ID NO: 53424 - DNA, 25 bp, E. coli
ccgctatacgggtgatgggctttga

SEQ ID NO: 53425 - DNA, 25 bp, E. coli
gattgaactgtcactctccacgcgg

SEQ ID NO: 53426 - DNA, 25 bp, E. coli
gattgaactgtctctctccacgcgg

SEQ ID NO: 53427 - DNA, 25 bp, E. coli
gattgataagattggcctcggcgcg

SEQ ID NO: 53428 - DNA, 25 bp, E. coli
gattgataagataggcctcggcgcg

SEQ ID NO: 53429 - DNA, 25 bp, E. coli
catagaacttgcagcgcgacttgat

SEQ ID NO: 53430 - DNA, 25 bp, E. coli
catagaacttgctgcgcgacttgat

SEQ ID NO: 53431 - DNA, 25 bp, E. coli
gcaggcagaactgccggaagaaatc

SEQ ID NO: 53432 - DNA, 25 bp, E. coli
gcaggcagaactcccggaagaaatc

SEQ ID NO: 53433 - DNA, 25 bp, E. coli
gcagcatcggtatctccgctctggt

SEQ ID NO: 53434 - DNA, 25 bp, E. coli
gaagaaatcacctcagcaacagtag

SEQ ID NO: 53435 - DNA, 25 bp, E. coli
gcagcatcggtaactccgctctggt

SEQ ID NO: 53436 - DNA, 25 bp, E. coli
gaagaaatcaccacagcaacagtag

SEQ ID NO: 53437 - DNA, 25 bp, E. coli
gaaagcaatgggaaaagccacatcc

SEQ ID NO: 53438 - DNA, 25 bp, E. coli
gaaagcaatgggtaaagccacatcc

SEQ ID NO: 53439 - DNA, 25 bp, E. coli
cgtacacctggcgtgtggctgataa

SEQ ID NO: 53440 - DNA, 25 bp, E. coli
cgaggaccacaaacggctgatgagc

SEQ ID NO: 53441 - DNA, 25 bp, E. coli
cgtacacctggcctgtggctgataa

SEQ ID NO: 53442 - DNA, 25 bp, E. coli
cgaggaccacaatcggctgatgagc

SEQ ID NO: 53443 - DNA, 25 bp, E. coli
ctgatgagctgggtacattgtttgg

SEQ ID NO: 53444 - DNA, 25 bp, E. coli
ctgatgagctggctacattgtttgg

SEQ ID NO: 53445 - DNA, 25 bp, E. coli
gataaaagcgcgtacacctggcgtg

SEQ ID NO: 53446 - DNA, 25 bp, E. coli
gataaaagcgcgaacacctggcgtg

SEQ ID NO: 53447 - DNA, 25 bp, E. coli
ggctggttttgttgataaaagcgcg

SEQ ID NO: 53448 - DNA, 25 bp, E. coli
ggaaaagccacatccatagaacttg

SEQ ID NO: 53449 - DNA, 25 bp, E. coli
ggctggttttgtagataaaagcgcg

SEQ ID NO: 53450 - DNA, 25 bp, E. coli
ggaaaagccacaaccatagaacttg

SEQ ID NO: 53451 - DNA, 25 bp, E. coli
caaagccgcatttgaacaaaaggtt

SEQ ID NO: 53452 - DNA, 25 bp, E. coli
caaagccgcattagaacaaaaggtt

SEQ ID NO: 53453 - DNA, 25 bp, E. coli
catttgaacaaatggttctggcgcg

SEQ ID NO: 53454 - DNA, 25 bp, E. coli
catttgaacaaaaggttctggcgcg

SEQ ID NO: 53455 - DNA, 25 bp, E. coli
aacggcactcgcctcttcgttccga

SEQ ID NO: 53456 - DNA, 25 bp, E. coli
aacggcactcgcgtcttcgttccga

SEQ ID NO: 53457 - DNA, 25 bp, E. coli
tatgaccattgtgcgcgaagagatt

SEQ ID NO: 53458 - DNA, 25 bp, E. coli
tatgaccattgtccgcgaagagatt

SEQ ID NO: 53459 - DNA, 25 bp, E. coli
tttgaacaaaagcttctggcgcgcg

SEQ ID NO: 53460 - DNA, 25 bp, E. coli
tttgaacaaaaggttctggcgcgcg

SEQ ID NO: 53461 - DNA, 25 bp, E. coli
tgagacgtcatttgtttatacccgc

SEQ ID NO: 53462 - DNA, 25 bp, E. coli
tgaacaaaaggtactggcgcgcgtt

SEQ ID NO: 53463 - DNA, 25 bp, E. coli
tgagacgtcattagtttatacccgc

SEQ ID NO: 53464 - DNA, 25 bp, E. coli
tgaacaaaaggttctggcgcgcgtt

SEQ ID NO: 53465 - DNA, 25 bp, E. coli
tgcgtgagacgtgatttgtttatac

SEQ ID NO: 53466 - DNA, 25 bp, E. coli
tgcgtgagacgtcatttgtttatac

SEQ ID NO: 53467 - DNA, 25 bp, E. coli
gacgtcatttgtatatacccgccgc

SEQ ID NO: 53468 - DNA, 25 bp, E. coli
gacgtcatttgtttatacccgccgc

SEQ ID NO: 53469 - DNA, 25 bp, E. coli
ctgaagggggattgcttcgataacg

SEQ ID NO: 53470 - DNA, 25 bp, E. coli
ctgaagggggatagcttcgataacg

SEQ ID NO: 53471 - DNA, 25 bp, E. coli
gaccattgtgcgcgaagagattttc

SEQ ID NO: 53472 - DNA, 25 bp, E. coli
gaccattgtgcgggaagagattttc

SEQ ID NO: 53473 - DNA, 25 bp, E. coli
catcattggcgaaccgacgtcacta

SEQ ID NO: 53474 - DNA, 25 bp, E. coli
catcattggcgatccgacgtcacta

SEQ ID NO: 53475 - DNA, 25 bp, E. coli
attcacggtggcgacgcttctaacc

SEQ ID NO: 53476 - DNA, 25 bp, E. coli
attcacggtggccacgcttctaacc

SEQ ID NO: 53477 - DNA, 25 bp, E. coli
actacaaccggttcgcgcacataaa

SEQ ID NO: 53478 - DNA, 25 bp, E. coli
actacaaccggtacgcgcacataaa

SEQ ID NO: 53479 - DNA, 25 bp, E. coli
tgtcgacgtcacgaaactgaaaaaa

SEQ ID NO: 53480 - DNA, 25 bp, E. coli
tgtcgacgtcaccaaactgaaaaaa

SEQ ID NO: 53481 - DNA, 25 bp, E. coli
tgatgaatatctggaaacacggttt

SEQ ID NO: 53482 - DNA, 25 bp, E. coli
tgatgaatatctcgaaacacggttt

SEQ ID NO: 53483 - DNA, 25 bp, E. coli
tctggaaacacggtttatcaagccc

SEQ ID NO: 53484 - DNA, 25 bp, E. coli
tctggaaacacgctttatcaagccc

SEQ ID NO: 53485 - DNA, 25 bp, E. coli
gcgaaccgacgtgactacaaccggt

SEQ ID NO: 53486 - DNA, 25 bp, E. coli
gcgaaccgacgtcactacaaccggt

SEQ ID NO: 53487 - DNA, 25 bp, E. coli
ccgtttacactgacggagcatgacg

SEQ ID NO: 53488 - DNA, 25 bp, E. coli
ccgtttacactgtcggagcatgacg

SEQ ID NO: 53489 - DNA, 25 bp, E. coli
cgaaactgaaaaaaccgctctacat

SEQ ID NO: 53490 - DNA, 25 bp, E. coli
cgaaactgaaaataccgctctacat

SEQ ID NO: 53491 - DNA, 25 bp, E. coli
tggacgcgcgatgcgtttacactga

SEQ ID NO: 53492 - DNA, 25 bp, E. coli
tggcgacgcttctaaccgtatttgc

SEQ ID NO: 53493 - DNA, 25 bp, E. coli
tggcgacgcttcaaaccgtatttgc

SEQ ID NO: 53494 - DNA, 25 bp, E. coli
tggacgcgcgatccgtttacactga

SEQ ID NO: 53495 - DNA, 25 bp, E. coli
aacggctgttgctgcaactcattgt

SEQ ID NO: 53496 - DNA, 25 bp, E. coli
aacggctgttgcagcaactcattgt

SEQ ID NO: 53497 - DNA, 25 bp, E. coli
gcgtggctggcgtcgtactattccc

SEQ ID NO: 53498 - DNA, 25 bp, E. coli
gcgtggctggcgacgtactattccc

SEQ ID NO: 53499 - DNA, 25 bp, E. coli
gcgtctgcgttaccaatggcgatgc

SEQ ID NO: 53500 - DNA, 25 bp, E. coli
gcgtctgcgttagcaatggcgatgc

SEQ ID NO: 53501 - DNA, 25 bp, E. coli
gaaaaacggctgttgcagcaactca

SEQ ID NO: 53502 - DNA, 25 bp, E. coli
gaaaaacggctgatgcagcaactca

SEQ ID NO: 53503 - DNA, 25 bp, E. coli
cctccgtcgcgtctgcgttagcaat

SEQ ID NO: 53504 - DNA, 25 bp, E. coli
cctccgtcgcgtgtgcgttagcaat

SEQ ID NO: 53505 - DNA, 25 bp, E. coli
ctcaccctggcggtaaaagaaagcg

SEQ ID NO: 53506 - DNA, 25 bp, E. coli
ctcaccctggcgctaaaagaaagcg

SEQ ID NO: 53507 - DNA, 25 bp, E. coli
cgtcgcgtctgcgttagcaatggcg

SEQ ID NO: 53508 - DNA, 25 bp, E. coli
ctatggcgtggctggcgacgtacta

SEQ ID NO: 53509 - DNA, 25 bp, E. coli
cgtcgcgtctgccttagcaatggcg

SEQ ID NO: 53510 - DNA, 25 bp, E. coli
ctatggcgtggcaggcgacgtacta

SEQ ID NO: 53511 - DNA, 25 bp, E. coli
tgggcctcaccctggcggtaaaaga

SEQ ID NO: 53512 - DNA, 25 bp, E. coli
tgggcctcacccaggcggtaaaaga

SEQ ID NO: 53513 - DNA, 25 bp, E. coli
gtctgcgttagcaatggcgatgctg

SEQ ID NO: 53514 - DNA, 25 bp, E. coli
gtctgcgttagctatggcgatgctg

SEQ ID NO: 53515 - DNA, 25 bp, E. coli
tggctggcgacgaactattccccgc

SEQ ID NO: 53516 - DNA, 25 bp, E. coli
tggctggcgacgtactattccccgc

SEQ ID NO: 53517 - DNA, 25 bp, E. coli
aagtttctccgccattctggctggg

SEQ ID NO: 53518 - DNA, 25 bp, E. coli
aagtttctccgcgattctggctggg

SEQ ID NO: 53519 - DNA, 25 bp, E. coli
caggagcaggagaaagaacaggaac

SEQ ID NO: 53520 - DNA, 25 bp, E. coli
catgatgcagagatggtctgggtcc

SEQ ID NO: 53521 - DNA, 25 bp, E. coli
caggagcaggagtaagaacaggaac

SEQ ID NO: 53522 - DNA, 25 bp, E. coli
catgatgcagagttggtctgggtcc

SEQ ID NO: 53523 - DNA, 25 bp, E. coli
tataccttgctcatgaaaccgggct

SEQ ID NO: 53524 - DNA, 25 bp, E. coli
tataccttgctcttgaaaccgggct

SEQ ID NO: 53525 - DNA, 25 bp, E. coli
tccatgaaatggcagcctggcaggt

SEQ ID NO: 53526 - DNA, 25 bp, E. coli
tccatctggatgtgaggcggaataa

SEQ ID NO: 53527 - DNA, 25 bp, E. coli
tccatgaaatgggagcctggcaggt

SEQ ID NO: 53528 - DNA, 25 bp, E. coli
tccatctggatgagaggcggaataa

SEQ ID NO: 53529 - DNA, 25 bp, E. coli
gcttcgaagccatgaacaggaacag

SEQ ID NO: 53530 - DNA, 25 bp, E. coli
gcttcgaagccaagaacaggaacag

SEQ ID NO: 53531 - DNA, 25 bp, E. coli
cgttacgcgagaaacctggcggcga

SEQ ID NO: 53532 - DNA, 25 bp, E. coli
cgttacgcgagatacctggcggcga

SEQ ID NO: 53533 - DNA, 25 bp, E. coli
gataaccgttgtccaggtgtcagga

SEQ ID NO: 53534 - DNA, 25 bp, E. coli
gataaccgttgtgcaggtgtcagga

SEQ ID NO: 53535 - DNA, 25 bp, E. coli
gggaaacgttgatgcctggcgataa

SEQ ID NO: 53536 - DNA, 25 bp, E. coli
gggaaacgttgaagcctggcgataa

SEQ ID NO: 53537 - DNA, 25 bp, E. coli
gatgacatcccctcacgcaaatatg

SEQ ID NO: 53538 - DNA, 25 bp, E. coli
gatgacatccccacacgcaaatatg

SEQ ID NO: 53539 - DNA, 25 bp, E. coli
cagctgtaagtgtcaggaacatcag

SEQ ID NO: 53540 - DNA, 25 bp, E. coli
caccttcccctagagctgtaagtgt

SEQ ID NO: 53541 - DNA, 25 bp, E. coli
caccttcccctacagctgtaagtgt

SEQ ID NO: 53542 - DNA, 25 bp, E. coli
cagctgtaagtgacaggaacatcag

SEQ ID NO: 53543 - DNA, 25 bp, E. coli
caggccaacctgaaattggggcgta

SEQ ID NO: 53544 - DNA, 25 bp, E. coli
caggccaacctgtaattggggcgta

SEQ ID NO: 53545 - DNA, 25 bp, E. coli
tacagctgtaagtgtcaggaacatc

SEQ ID NO: 53546 - DNA, 25 bp, E. coli
tacagctgtaagagtcaggaacatc

SEQ ID NO: 53547 - DNA, 25 bp, E. coli
ttcccctacagctgtaagtgtcagg

SEQ ID NO: 53548 - DNA, 25 bp, E. coli
ttcccctacagcagtaagtgtcagg

SEQ ID NO: 53549 - DNA, 25 bp, E. coli
tgcggcgaacaactggtcgcaaaat

SEQ ID NO: 53550 - DNA, 25 bp, E. coli
tgcggcgaacaagtggtcgcaaaat

SEQ ID NO: 53551 - DNA, 25 bp, E. coli
ccctacagctgttagtgtcaggaac

SEQ ID NO: 53552 - DNA, 25 bp, E. coli
ccctacagctgtaagtgtcaggaac

SEQ ID NO: 53553 - DNA, 25 bp, E. coli
cggcgaacaactggtcgcaaaataa

SEQ ID NO: 53554 - DNA, 25 bp, E. coli
cggcgaacaactcgtcgcaaaataa

SEQ ID NO: 53555 - DNA, 25 bp, E. coli
tgtgctgggcgttccagcccgccgt

SEQ ID NO: 53556 - DNA, 25 bp, E. coli
tgtgctgggcgtaccagcccgccgt

SEQ ID NO: 53557 - DNA, 25 bp, E. coli
tcactgcggcgatcaactggtcgca

SEQ ID NO: 53558 - DNA, 25 bp, E. coli
tcactgcggcgaacaactggtcgca

SEQ ID NO: 53559 - DNA, 25 bp, E. coli
taagtgtcaggatcatcagcttacc

SEQ ID NO: 53560 - DNA, 25 bp, E. coli
taagtgtcaggaacatcagcttacc

SEQ ID NO: 53561 - DNA, 25 bp, E. coli
tacagcgtgtggttgccgtatgccg

SEQ ID NO: 53562 - DNA, 25 bp, E. coli
tacagcgtgtggatgccgtatgccg

SEQ ID NO: 53563 - DNA, 25 bp, E. coli
ttgatcgacgaagccctggaacagg

SEQ ID NO: 53564 - DNA, 25 bp, E. coli
ttgatcgacgaacccctggaacagg

SEQ ID NO: 53565 - DNA, 25 bp, E. coli
gccgtatgccgatgactgttcgcag

SEQ ID NO: 53566 - DNA, 25 bp, E. coli
gccgtatgccgaagactgttcgcag

SEQ ID NO: 53567 - DNA, 25 bp, E. coli
gcgttgcgcgtagaccctggtttac

SEQ ID NO: 53568 - DNA, 25 bp, E. coli
gcgttgcgcgtacaccctggtttac

SEQ ID NO: 53569 - DNA, 25 bp, E. coli
gacgatagcgcattggacctgctgt

SEQ ID NO: 53570 - DNA, 25 bp, E. coli
gacgatagcgcaatggacctgctgt

SEQ ID NO: 53571 - DNA, 25 bp, E. coli
ccctggaacaggcaatgctggataa

SEQ ID NO: 53572 - DNA, 25 bp, E. coli
ccctggaacagggaatgctggataa

SEQ ID NO: 53573 - DNA, 25 bp, E. coli
gttgaaacaggtggacgatagcgca

SEQ ID NO: 53574 - DNA, 25 bp, E. coli
gttgaaacaggtcgacgatagcgca

SEQ ID NO: 53575 - DNA, 25 bp, E. coli
ggtttacctccatcgaggaagccat

SEQ ID NO: 53576 - DNA, 25 bp, E. coli
ggtttacctccaacgaggaagccat

SEQ ID NO: 53577 - DNA, 25 bp, E. coli
tggacaatgccgctattatttcggg

SEQ ID NO: 53578 - DNA, 25 bp, E. coli
tggacaatgccggtattatttcggg

SEQ ID NO: 53579 - DNA, 25 bp, E. coli
taagggtaatccgtcagtggcgacg

SEQ ID NO: 53580 - DNA, 25 bp, E. coli
taagggtaatccctcagtggcgacg

SEQ ID NO: 53581 - DNA, 25 bp, E. coli
gacctgctgtctgagttgatcgacg

SEQ ID NO: 53582 - DNA, 25 bp, E. coli
gacctgctgtctcagttgatcgacg

SEQ ID NO: 53583 - DNA, 25 bp, E. coli
caggcgctgttatcccgactggact

SEQ ID NO: 53584 - DNA, 25 bp, E. coli
caggcgctgttaacccgactggact

SEQ ID NO: 53585 - DNA, 25 bp, E. coli
tacccgtaaggtgcgtgaggataaa

SEQ ID NO: 53586 - DNA, 25 bp, E. coli
tacgatcaggaccataaccttagag

SEQ ID NO: 53587 - DNA, 25 bp, E. coli
tacgatcaggacgataaccttagag

SEQ ID NO: 53588 - DNA, 25 bp, E. coli
tacccgtaaggtccgtgaggataaa

SEQ ID NO: 53589 - DNA, 25 bp, E. coli
ttgcttccctaacctggaacctggg

SEQ ID NO: 53590 - DNA, 25 bp, E. coli
ttgcttccctaagctggaacctggg

SEQ ID NO: 53591 - DNA, 25 bp, E. coli
tgaatccctcagtgctaagctggag

SEQ ID NO: 53592 - DNA, 25 bp, E. coli
tgagactggagagagacgatcaccc

SEQ ID NO: 53593 - DNA, 25 bp, E. coli
tgacttccagcagaactaccaggcg

SEQ ID NO: 53594 - DNA, 25 bp, E. coli
tgaatccctcagagctaagctggag

SEQ ID NO: 53595 - DNA, 25 bp, E. coli
tgagactggagacagacgatcaccc

SEQ ID NO: 53596 - DNA, 25 bp, E. coli
tgacttccagcacaactaccaggcg

SEQ ID NO: 53597 - DNA, 25 bp, E. coli
ccttagagggatgatcacaggagcc

SEQ ID NO: 53598 - DNA, 25 bp, E. coli
ccttagagggatcatcacaggagcc

SEQ ID NO: 53599 - DNA, 25 bp, E. coli
gactggactaccagaccaaagttga

SEQ ID NO: 53600 - DNA, 25 bp, E. coli
gactggactacctgaccaaagttga

SEQ ID NO: 53601 - DNA, 25 bp, E. coli
cggctgtagccaaatcgaactgtaa

SEQ ID NO: 53602 - DNA, 25 bp, E. coli
cggctgtagccatatcgaactgtaa

SEQ ID NO: 53603 - DNA, 25 bp, E. coli
gatatcccggatgcgtgaatccctc

SEQ ID NO: 53604 - DNA, 25 bp, E. coli
gatatcccggatccgtgaatccctc

SEQ ID NO: 53605 - DNA, 25 bp, E. coli
aaaacactgaacttagcgcccgtga

SEQ ID NO: 53606 - DNA, 25 bp, E. coli
acactgaacttaccgcccgtgaaat

SEQ ID NO: 53607 - DNA, 25 bp, E. coli
aaaacactgaacatagcgcccgtga

SEQ ID NO: 53608 - DNA, 25 bp, E. coli
acactgaacttagcgcccgtgaaat

SEQ ID NO: 53609 - DNA, 25 bp, E. coli
aacactgaacttagcgcccgtgaaa

SEQ ID NO: 53610 - DNA, 25 bp, E. coli
aacactgaactttgcgcccgtgaaa

SEQ ID NO: 53611 - DNA, 25 bp, E. coli
tagaaaacactgaacttagcgcccg

SEQ ID NO: 53612 - DNA, 25 bp, E. coli
tagaaaacactgtacttagcgcccg

SEQ ID NO: 53613 - DNA, 25 bp, E. coli
gctgttagaaaacactgaacttagc

SEQ ID NO: 53614 - DNA, 25 bp, E. coli
gctgttagaaaagactgaacttagc

SEQ ID NO: 53615 - DNA, 25 bp, E. coli
gaaaacactgaacttagcgcccgtg

SEQ ID NO: 53616 - DNA, 25 bp, E. coli
gaaaacactgaagttagcgcccgtg

SEQ ID NO: 53617 - DNA, 25 bp, E. coli
cgcgctgttagaaaacactgaactt

SEQ ID NO: 53618 - DNA, 25 bp, E. coli
cgcgctgttagataacactgaactt

SEQ ID NO: 53619 - DNA, 25 bp, E. coli
cgcgcgcgctgtaagaaaacactga

SEQ ID NO: 53620 - DNA, 25 bp, E. coli
cgcgcgctgttacaaaacactgaac

SEQ ID NO: 53621 - DNA, 25 bp, E. coli
cgcgcgcgctgttagaaaacactga

SEQ ID NO: 53622 - DNA, 25 bp, E. coli
cgcgcgctgttagaaaacactgaac

SEQ ID NO: 53623 - DNA, 25 bp, E. coli
ggcgcgcgcgctgttagaaaacact

SEQ ID NO: 53624 - DNA, 25 bp, E. coli
ggcgcgcgcgctcttagaaaacact

SEQ ID NO: 53625 - DNA, 25 bp, E. coli
gttagaaaacactgaacttagcgcc

SEQ ID NO: 53626 - DNA, 25 bp, E. coli
gttagaaaacacagaacttagcgcc

SEQ ID NO: 53627 - DNA, 25 bp, E. coli
cggtacgtctttcaacgtcttgcaa

SEQ ID NO: 53628 - DNA, 25 bp, E. coli
cggtacgtctttgaacgtcttgcaa

SEQ ID NO: 53629 - DNA, 25 bp, E. coli
catttgttatacaggtgttattgtc

SEQ ID NO: 53630 - DNA, 25 bp, E. coli
catttgttatactggtgttattgtc

SEQ ID NO: 53631 - DNA, 25 bp, E. coli
actccgaccatttgttatacaggtg

SEQ ID NO: 53632 - DNA, 25 bp, E. coli
actccgaccattagttatacaggtg

SEQ ID NO: 53633 - DNA, 25 bp, E. coli
tagttattgaacttacttttcagga

SEQ ID NO: 53634 - DNA, 25 bp, E. coli
tagttattgaacatacttttcagga

SEQ ID NO: 53635 - DNA, 25 bp, E. coli
tattgcctggcgctacgtctttgaa

SEQ ID NO: 53636 - DNA, 25 bp, E. coli
tattgcctggcggtacgtctttgaa

SEQ ID NO: 53637 - DNA, 25 bp, E. coli
ttatcggaacattttgcctggcggt

SEQ ID NO: 53638 - DNA, 25 bp, E. coli
ttatcggaacatattgcctggcggt

SEQ ID NO: 53639 - DNA, 25 bp, E. coli
tcggaacatattgcctggcggtacg

SEQ ID NO: 53640 - DNA, 25 bp, E. coli
tcggaacatattccctggcggtacg

SEQ ID NO: 53641 - DNA, 25 bp, E. coli
gcctggcggtacctctttgaacgtc

SEQ ID NO: 53642 - DNA, 25 bp, E. coli
gcctggcggtacgtctttgaacgtc

SEQ ID NO: 53643 - DNA, 25 bp, E. coli
gaacatattgccaggcggtacgtct

SEQ ID NO: 53644 - DNA, 25 bp, E. coli
gaacgtcttgcaatagttattgaac

SEQ ID NO: 53645 - DNA, 25 bp, E. coli
gaacgtcttgcattagttattgaac

SEQ ID NO: 53646 - DNA, 25 bp, E. coli
gaacatattgcctggcggtacgtct

SEQ ID NO: 53647 - DNA, 25 bp, E. coli
cgtctttgaacgacttgcaatagtt

SEQ ID NO: 53648 - DNA, 25 bp, E. coli
cgtctttgaacgtcttgcaatagtt

SEQ ID NO: 53649 - DNA, 25 bp, E. coli
aatttctggcgtccttaaagatggc

SEQ ID NO: 53650 - DNA, 25 bp, E. coli
aatttctggcgtgcttaaagatggc

SEQ ID NO: 53651 - DNA, 25 bp, E. coli
cagaactgcaccattgtgctgaagg

SEQ ID NO: 53652 - DNA, 25 bp, E. coli
cagtaaaaatttgtggcgtgcttaa

SEQ ID NO: 53653 - DNA, 25 bp, E. coli
cagaactgcacctttgtgctgaagg

SEQ ID NO: 53654 - DNA, 25 bp, E. coli
cagtaaaaatttctggcgtgcttaa

SEQ ID NO: 53655 - DNA, 25 bp, E. coli
taaagatggcactggaaaaccagta

SEQ ID NO: 53656 - DNA, 25 bp, E. coli
taaagatggcacaggaaaaccagta

SEQ ID NO: 53657 - DNA, 25 bp, E. coli
aactgcaccattctgctgaaggcca

SEQ ID NO: 53658 - DNA, 25 bp, E. coli
aactgcaccattgtgctgaaggcca

SEQ ID NO: 53659 - DNA, 25 bp, E. coli
ttctggcgtgcttaaagatggcaca

SEQ ID NO: 53660 - DNA, 25 bp, E. coli
ttctggcgtgctaaaagatggcaca

SEQ ID NO: 53661 - DNA, 25 bp, E. coli
tgcaccattgtgctgaaggccagac

SEQ ID NO: 53662 - DNA, 25 bp, E. coli
tgcaccattgtggtgaaggccagac

SEQ ID NO: 53663 - DNA, 25 bp, E. coli
tgacagtaaaaaattctggcgtgct

SEQ ID NO: 53664 - DNA, 25 bp, E. coli
tgacagtaaaaatttctggcgtgct

SEQ ID NO: 53665 - DNA, 25 bp, E. coli
gcttaaagatgggacaggaaaacca

SEQ ID NO: 53666 - DNA, 25 bp, E. coli
gcttaaagatggcacaggaaaacca

SEQ ID NO: 53667 - DNA, 25 bp, E. coli
gcaccattgtgcagaaggccagacg

SEQ ID NO: 53668 - DNA, 25 bp, E. coli
gcaccattgtgctgaaggccagacg

SEQ ID NO: 53669 - DNA, 25 bp, E. coli
ggcgtgcttaaacatggcacaggaa

SEQ ID NO: 53670 - DNA, 25 bp, E. coli
ggcgtgcttaaagatggcacaggaa

SEQ ID NO: 53671 - DNA, 25 bp, E. coli
taaaaaactggataatcagagtgcg

SEQ ID NO: 53672 - DNA, 25 bp, E. coli
taaaaaactggaaaatcagagtgcg

SEQ ID NO: 53673 - DNA, 25 bp, E. coli
acggtgcgggcgataaacagctatg

SEQ ID NO: 53674 - DNA, 25 bp, E. coli
acggtgcgggcgttaaacagctatg

SEQ ID NO: 53675 - DNA, 25 bp, E. coli
tacgccagcaggtatgcagagtcag

SEQ ID NO: 53676 - DNA, 25 bp, E. coli
tacgccagcaggaatgcagagtcag

SEQ ID NO: 53677 - DNA, 25 bp, E. coli
tgagtgtggacaacaccgcacaccc

SEQ ID NO: 53678 - DNA, 25 bp, E. coli
tgagtgtggacatcaccgcacaccc

SEQ ID NO: 53679 - DNA, 25 bp, E. coli
tgccggtattgacaatacgccagca

SEQ ID NO: 53680 - DNA, 25 bp, E. coli
tgccggtattgagaatacgccagca

SEQ ID NO: 53681 - DNA, 25 bp, E. coli
cctgaccagtggtaagggaacggat

SEQ ID NO: 53682 - DNA, 25 bp, E. coli
cctgaccagtggaaagggaacggat

SEQ ID NO: 53683 - DNA, 25 bp, E. coli
gaacggatgccagactggtgaccac

SEQ ID NO: 53684 - DNA, 25 bp, E. coli
gaacggatgccacactggtgaccac

SEQ ID NO: 53685 - DNA, 25 bp, E. coli
gaaaatcagagtgcggcaatccagc

SEQ ID NO: 53686 - DNA, 25 bp, E. coli
gaaatcgggaaaacacatctggccc

SEQ ID NO: 53687 - DNA, 25 bp, E. coli
gaaaatcagagtccggcaatccagc

SEQ ID NO: 53688 - DNA, 25 bp, E. coli
gaaatcgggaaatcacatctggccc

SEQ ID NO: 53689 - DNA, 25 bp, E. coli
gataaacagctaaggccagcagggt

SEQ ID NO: 53690 - DNA, 25 bp, E. coli
gataaacagctatggccagcagggt

SEQ ID NO: 53691 - DNA, 25 bp, E. coli
taagccggtgagtgtggacatcacc

SEQ ID NO: 53692 - DNA, 25 bp, E. coli
taagccggtgagagtggacatcacc

SEQ ID NO: 53693 - DNA, 25 bp, E. coli
caatgtctcacaaagcatatggctt

SEQ ID NO: 53694 - DNA, 25 bp, E. coli
caatgtctcacatagcatatggctt

SEQ ID NO: 53695 - DNA, 25 bp, E. coli
atgcgtcgcagatttttctctgcta

SEQ ID NO: 53696 - DNA, 25 bp, E. coli
atgcgtcgcagaattttctctgcta

SEQ ID NO: 53697 - DNA, 25 bp, E. coli
aaatccgccttttattatggttcag

SEQ ID NO: 53698 - DNA, 25 bp, E. coli
aaatccgcctttaattatggttcag

SEQ ID NO: 53699 - DNA, 25 bp, E. coli
tatggttcaggtttaatcgccgcaa

SEQ ID NO: 53700 - DNA, 25 bp, E. coli
tatggttcaggtataatcgccgcaa

SEQ ID NO: 53701 - DNA, 25 bp, E. coli
ttttacttacaaggctcacgccgaa

SEQ ID NO: 53702 - DNA, 25 bp, E. coli
ttttacttacaacgctcacgccgaa

SEQ ID NO: 53703 - DNA, 25 bp, E. coli
ttcaggtataatggccgcaaagctt

SEQ ID NO: 53704 - DNA, 25 bp, E. coli
ttcaggtataatcgccgcaaagctt

SEQ ID NO: 53705 - DNA, 25 bp, E. coli
gctatttcgcattaagactatcggc

SEQ ID NO: 53706 - DNA, 25 bp, E. coli
gcatatggcttttacttacaacgct

SEQ ID NO: 53707 - DNA, 25 bp, E. coli
gctatttcgcataaagactatcggc

SEQ ID NO: 53708 - DNA, 25 bp, E. coli
gctcacgccgaaaaatccgcctttt

SEQ ID NO: 53709 - DNA, 25 bp, E. coli
gcatatggctttaacttacaacgct

SEQ ID NO: 53710 - DNA, 25 bp, E. coli
gctcacgccgaataatccgcctttt

SEQ ID NO: 53711 - DNA, 25 bp, E. coli
gaattttctctgctatttcgcataa

SEQ ID NO: 53712 - DNA, 25 bp, E. coli
gaattttctctggtatttcgcataa

SEQ ID NO: 53713 - DNA, 25 bp, E. coli
gactatcggcaaagtctcacaaagc

SEQ ID NO: 53714 - DNA, 25 bp, E. coli
gactatcggcaatgtctcacaaagc

SEQ ID NO: 53715 - DNA, 25 bp, E. coli
caagatgctggtagccacgtccgat

SEQ ID NO: 53716 - DNA, 25 bp, E. coli
caagatgctggttgccacgtccgat

SEQ ID NO: 53717 - DNA, 25 bp, E. coli
cacgtccgatctcgaaatggaacgg

SEQ ID NO: 53718 - DNA, 25 bp, E. coli
cacgtccgatctggaaatggaacgg

SEQ ID NO: 53719 - DNA, 25 bp, E. coli
aaaaatcttccagtccagaggcggt

SEQ ID NO: 53720 - DNA, 25 bp, E. coli
aaaaatcttccactccagaggcggt

SEQ ID NO: 53721 - DNA, 25 bp, E. coli
tatcgagcgcgattggcttaacgcc

SEQ ID NO: 53722 - DNA, 25 bp, E. coli
tatcgagcgcgaatggcttaacgcc

SEQ ID NO: 53723 - DNA, 25 bp, E. coli
ttccagtccagacgcggtgaaatta

SEQ ID NO: 53724 - DNA, 25 bp, E. coli
ttccagtccagaggcggtgaaatta

SEQ ID NO: 53725 - DNA, 25 bp, E. coli
tggttgccacgtgcgatctcgaaat

SEQ ID NO: 53726 - DNA, 25 bp, E. coli
gcgggcttaatgtgcataaaaacgg

SEQ ID NO: 53727 - DNA, 25 bp, E. coli
gcgggcttaatgagcataaaaacgg

SEQ ID NO: 53728 - DNA, 25 bp, E. coli
cgaatggcttaacgccgacgaactg

SEQ ID NO: 53729 - DNA, 25 bp, E. coli
cgaatggcttaaggccgacgaactg

SEQ ID NO: 53730 - DNA, 25 bp, E. coli
cttatgggaacgcacagcggcgaac

SEQ ID NO: 53731 - DNA, 25 bp, E. coli
cttatgggaacggacagcggcgaac

SEQ ID NO: 53732 - DNA, 25 bp, E. coli
tggttgccacgtccgatctcgaaat

SEQ ID NO: 53733 - DNA, 25 bp, E. coli
tcagcgggcttaatgagcataaaaa

SEQ ID NO: 53734 - DNA, 25 bp, E. coli
tcagcgggcttattgagcataaaaa

SEQ ID NO: 53735 - DNA, 25 bp, E. coli
gatgcgcgccttatgggaacgcaca

SEQ ID NO: 53736 - DNA, 25 bp, E. coli
gatgcgcgccttttgggaacgcaca

SEQ ID NO: 53737 - DNA, 25 bp, E. coli
cagtttccagtggagtcagcgcaga

SEQ ID NO: 53738 - DNA, 25 bp, E. coli
cagtttccagtgcagtcagcgcaga

SEQ ID NO: 53739 - DNA, 25 bp, E. coli
catggtttcgattcccagagacagc

SEQ ID NO: 53740 - DNA, 25 bp, E. coli
catggtttcgatacccagagacagc

SEQ ID NO: 53741 - DNA, 25 bp, E. coli
taacttcgatctccggcatgccgcg

SEQ ID NO: 53742 - DNA, 25 bp, E. coli
tttacgttcaccctgcagcacatgg

SEQ ID NO: 53743 - DNA, 25 bp, E. coli
tttacgttcaccgtgcagcacatgg

SEQ ID NO: 53744 - DNA, 25 bp, E. coli
ttcaaacttacgctcagcttcggcg

SEQ ID NO: 53745 - DNA, 25 bp, E. coli
ttcaaacttacggtcagcttcggcg

SEQ ID NO: 53746 - DNA, 25 bp, E. coli
tgtttgcagaagcatcagcaccggc

SEQ ID NO: 53747 - DNA, 25 bp, E. coli
tgtttgcagaaggatcagcaccggc

SEQ ID NO: 53748 - DNA, 25 bp, E. coli
tcgatatcagattcggacaggccag

SEQ ID NO: 53749 - DNA, 25 bp, E. coli
tcgatatcagatacggacaggccag

SEQ ID NO: 53750 - DNA, 25 bp, E. coli
tctttcgcggaatcgtgcaggatac

SEQ ID NO: 53751 - DNA, 25 bp, E. coli
tcttcagcggtagagaacacctggc

SEQ ID NO: 53752 - DNA, 25 bp, E. coli
tcttcagcggtacagaacacctggc

SEQ ID NO: 53753 - DNA, 25 bp, E. coli
tctttcgcggaaacgtgcaggatac

SEQ ID NO: 53754 - DNA, 25 bp, E. coli
gatagcagttttctcgtcagccggc

SEQ ID NO: 53755 - DNA, 25 bp, E. coli
gatacgttttacatccagaccagcg

SEQ ID NO: 53756 - DNA, 25 bp, E. coli
gatagcagttttgtcgtcagccggc

SEQ ID NO: 53757 - DNA, 25 bp, E. coli
gatacgttttacttccagaccagcg

SEQ ID NO: 53758 - DNA, 25 bp, E. coli
taacttcgatctgcggcatgccgcg

SEQ ID NO: 53759 - DNA, 25 bp, E. coli
catttggtcaggacggagcgcgtta

SEQ ID NO: 53760 - DNA, 25 bp, E. coli
catttggtcaggtcggagcgcgtta

SEQ ID NO: 53761 - DNA, 25 bp, E. coli
taaattatgcggcacaacaggcggc

SEQ ID NO: 53762 - DNA, 25 bp, E. coli
taaaaccgcggacatgacttcagca

SEQ ID NO: 53763 - DNA, 25 bp, E. coli
taaattatgcgggacaacaggcggc

SEQ ID NO: 53764 - DNA, 25 bp, E. coli
taaaaccgcggagatgacttcagca

SEQ ID NO: 53765 - DNA, 25 bp, E. coli
tatttataaagtcacggctcgcgcc

SEQ ID NO: 53766 - DNA, 25 bp, E. coli
tatttataaagtgacggctcgcgcc

SEQ ID NO: 53767 - DNA, 25 bp, E. coli
tcatggttgttatacccggacccgg

SEQ ID NO: 53768 - DNA, 25 bp, E. coli
tcatggttgttaaacccggacccgg

SEQ ID NO: 53769 - DNA, 25 bp, E. coli
tcagggcggtcagattcagcatagc

SEQ ID NO: 53770 - DNA, 25 bp, E. coli
tcagggcggtcacattcagcatagc

SEQ ID NO: 53771 - DNA, 25 bp, E. coli
taagaaagactaagatgagcgccca

SEQ ID NO: 53772 - DNA, 25 bp, E. coli
taagctgcagtcgaatcctggtgcg

SEQ ID NO: 53773 - DNA, 25 bp, E. coli
tcaacggtaagtctcaaacgcaagc

SEQ ID NO: 53774 - DNA, 25 bp, E. coli
taacggctatttgcgcatgagcggc

SEQ ID NO: 53775 - DNA, 25 bp, E. coli
taaccaggcttcctcacagttgcag

SEQ ID NO: 53776 - DNA, 25 bp, E. coli
taaccaggcttcgtcacagttgcag

SEQ ID NO: 53777 - DNA, 25 bp, E. coli
taagctgcagtccaatcctggtgcg

SEQ ID NO: 53778 - DNA, 25 bp, E. coli
taagaaagactatgatgagcgccca

SEQ ID NO: 53779 - DNA, 25 bp, E. coli
taacggctatttccgcatgagcggc

SEQ ID NO: 53780 - DNA, 25 bp, E. coli
tcaacggtaagtgtcaaacgcaagc

SEQ ID NO: 53781 - DNA, 25 bp, E. coli
taaagacaaaaatggccgcaggctg

SEQ ID NO: 53782 - DNA, 25 bp, E. coli
taaagacaaaaaaggccgcaggctg

SEQ ID NO: 53783 - DNA, 25 bp, E. coli
agctcgggttgccaatatttacttg

SEQ ID NO: 53784 - DNA, 25 bp, E. coli
ataaagacaaaaatggccgcaggct

SEQ ID NO: 53785 - DNA, 25 bp, E. coli
ataaagacaaaattggccgcaggct

SEQ ID NO: 53786 - DNA, 25 bp, E. coli
agctcgggttgcgaatatttacttg

SEQ ID NO: 53787 - DNA, 25 bp, E. coli
aaagacaaaaatcgccgcaggctgt

SEQ ID NO: 53788 - DNA, 25 bp, E. coli
ctcgggttgccattatttacttgtg

SEQ ID NO: 53789 - DNA, 25 bp, E. coli
ctcgggttgccaatatttacttgtg

SEQ ID NO: 53790 - DNA, 25 bp, E. coli
aaagacaaaaatggccgcaggctgt

SEQ ID NO: 53791 - DNA, 25 bp, E. coli
tccagctcgggttgccaatatttac

SEQ ID NO: 53792 - DNA, 25 bp, E. coli
tccagctcgggtagccaatatttac

SEQ ID NO: 53793 - DNA, 25 bp, E. coli
ccagctcgggttgccaatatttact

SEQ ID NO: 53794 - DNA, 25 bp, E. coli
ccagctcgggttcccaatatttact

SEQ ID NO: 53795 - DNA, 25 bp, E. coli
cttccagctcggcttgccaatattt

SEQ ID NO: 53796 - DNA, 25 bp, E. coli
cgggttgccaatatttacttgtgga

SEQ ID NO: 53797 - DNA, 25 bp, E. coli
cttccagctcgggttgccaatattt

SEQ ID NO: 53798 - DNA, 25 bp, E. coli
cgggttgccaatttttacttgtgga

SEQ ID NO: 53799 - DNA, 25 bp, E. coli
gataaagacaaaaatggccgcaggc

SEQ ID NO: 53800 - DNA, 25 bp, E. coli
gataaagacaaatatggccgcaggc

SEQ ID NO: 53801 - DNA, 25 bp, E. coli
ggttgccaatatttacttgtggaag

SEQ ID NO: 53802 - DNA, 25 bp, E. coli
ggttgccaatatatacttgtggaag

SEQ ID NO: 53803 - DNA, 25 bp, E. coli
catggctgagagttaaggcgtcgcc

SEQ ID NO: 53804 - DNA, 25 bp, E. coli
catggctgagagataaggcgtcgcc

SEQ ID NO: 53805 - DNA, 25 bp, E. coli
catatccgggacttattcgggtaca

SEQ ID NO: 53806 - DNA, 25 bp, E. coli
catatccgggacatattcgggtaca

SEQ ID NO: 53807 - DNA, 25 bp, E. coli
tactcagcaatctgtcatatccggg

SEQ ID NO: 53808 - DNA, 25 bp, E. coli
tactcagcaatcagtcatatccggg

SEQ ID NO: 53809 - DNA, 25 bp, E. coli
tagcagatgatccttccgtcagaac

SEQ ID NO: 53810 - DNA, 25 bp, E. coli
tagcagatgatcgttccgtcagaac

SEQ ID NO: 53811 - DNA, 25 bp, E. coli
tgaacttgcacaacaggaactggga

SEQ ID NO: 53812 - DNA, 25 bp, E. coli
tgaacttgcacatcaggaactggga

SEQ ID NO: 53813 - DNA, 25 bp, E. coli
tccggatgactggtatgaactactc

SEQ ID NO: 53814 - DNA, 25 bp, E. coli
tccggatgactgctatgaactactc

SEQ ID NO: 53815 - DNA, 25 bp, E. coli
tcagacagctaactacccgctatgg

SEQ ID NO: 53816 - DNA, 25 bp, E. coli
tcagacagctaagtacccgctatgg

SEQ ID NO: 53817 - DNA, 25 bp, E. coli
tgtgggttaggatccccgaacagga

SEQ ID NO: 53818 - DNA, 25 bp, E. coli
tgtgggttaggaaccccgaacagga

SEQ ID NO: 53819 - DNA, 25 bp, E. coli
ccaactggaacgtaaggcacgggat

SEQ ID NO: 53820 - DNA, 25 bp, E. coli
ccaactggaacgaaaggcacgggat

SEQ ID NO: 53821 - DNA, 25 bp, E. coli
ctatgaatataacggcagaacggcc

SEQ ID NO: 53822 - DNA, 25 bp, E. coli
ctatgaatataagggcagaacggcc

SEQ ID NO: 53823 - DNA, 25 bp, E. coli
gtccgtcccgcacaaactatgaata

SEQ ID NO: 53824 - DNA, 25 bp, E. coli
gtccgtcccgcagaaactatgaata

SEQ ID NO: 53825 - DNA, 25 bp, E. coli
caaccgccgcagagatggtcagata

SEQ ID NO: 53826 - DNA, 25 bp, E. coli
caaccgccgcagtgatggtcagata

SEQ ID NO: 53827 - DNA, 25 bp, E. coli
taaagagcgtgagcgaacaaccctt

SEQ ID NO: 53828 - DNA, 25 bp, E. coli
taaagagcgtgaccgaacaaccctt

SEQ ID NO: 53829 - DNA, 25 bp, E. coli
aaacattgatgccatctcccgtgag

SEQ ID NO: 53830 - DNA, 25 bp, E. coli
aaacattgatgcgatctcccgtgag

SEQ ID NO: 53831 - DNA, 25 bp, E. coli
tatacaggctatcgttcgcgcccag

SEQ ID NO: 53832 - DNA, 25 bp, E. coli
tatacaggctatggttcgcgcccag

SEQ ID NO: 53833 - DNA, 25 bp, E. coli
tgaaagtttctaaacggcgggatac

SEQ ID NO: 53834 - DNA, 25 bp, E. coli
tgaaagtttctatacggcgggatac

SEQ ID NO: 53835 - DNA, 25 bp, E. coli
tctgggccgtgtggtgaacgacctt

SEQ ID NO: 53836 - DNA, 25 bp, E. coli
tctgggccgtgtcgtgaacgacctt

SEQ ID NO: 53837 - DNA, 25 bp, E. coli
gcatttgtcgcgctcacatatggga

SEQ ID NO: 53838 - DNA, 25 bp, E. coli
gcaggttccctaatgctggcggtta

SEQ ID NO: 53839 - DNA, 25 bp, E. coli
gcatttgtcgcggtcacatatggga

SEQ ID NO: 53840 - DNA, 25 bp, E. coli
gcaggttccctattgctggcggtta

SEQ ID NO: 53841 - DNA, 25 bp, E. coli
gactgtactgattgaaacctctgca

SEQ ID NO: 53842 - DNA, 25 bp, E. coli
gaaaattcccacgagcaaagacgtg

SEQ ID NO: 53843 - DNA, 25 bp, E. coli
gactgtactgatagaaacctctgca

SEQ ID NO: 53844 - DNA, 25 bp, E. coli
gaaaattcccaccagcaaagacgtg

SEQ ID NO: 53845 - DNA, 25 bp, E. coli
taacattattggcagaggagccgct

SEQ ID NO: 53846 - DNA, 25 bp, E. coli
taacattattgggagaggagccgct

SEQ ID NO: 53847 - DNA, 25 bp, E. coli
cagggcgaactgagtccggtctttc

SEQ ID NO: 53848 - DNA, 25 bp, E. coli
cagggcgaactgtgtccggtctttc

SEQ ID NO: 53849 - DNA, 25 bp, E. coli
cagcaacaagaaaatttttagcgtc

SEQ ID NO: 53850 - DNA, 25 bp, E. coli
cagcaacaagaatatttttagcgtc

SEQ ID NO: 53851 - DNA, 25 bp, E. coli
tatttttagcgtgattcagcgaccg

SEQ ID NO: 53852 - DNA, 25 bp, E. coli
tatttttagcgtcattcagcgaccg

SEQ ID NO: 53853 - DNA, 25 bp, E. coli
tgtatcggatactttccagggcgaa

SEQ ID NO: 53854 - DNA, 25 bp, E. coli
tgtatcggatacattccagggcgaa

SEQ ID NO: 53855 - DNA, 25 bp, E. coli
tgcattcaatatgaataagcgcgtg

SEQ ID NO: 53856 - DNA, 25 bp, E. coli
tgcattcaatatcaataagcgcgtg

SEQ ID NO: 53857 - DNA, 25 bp, E. coli
tgcgcaagctctcccgtgcattcaa

SEQ ID NO: 53858 - DNA, 25 bp, E. coli
tgcgcaagctctgccgtgcattcaa

SEQ ID NO: 53859 - DNA, 25 bp, E. coli
gcgtccggtgtggttttattgcaca

SEQ ID NO: 53860 - DNA, 25 bp, E. coli
gcgtccggtgtgcttttattgcaca

SEQ ID NO: 53861 - DNA, 25 bp, E. coli
cccattttcacattcagcaacaaga

SEQ ID NO: 53862 - DNA, 25 bp, E. coli
cccattttcacaatcagcaacaaga

SEQ ID NO: 53863 - DNA, 25 bp, E. coli
gtctttctgttcttctccctgcgca

SEQ ID NO: 53864 - DNA, 25 bp, E. coli
gtctttctgttcatctccctgcgca

SEQ ID NO: 53865 - DNA, 25 bp, E. coli
taagcgcgtgcatcagcgtagtgag

SEQ ID NO: 53866 - DNA, 25 bp, E. coli
tcagcgaccgcgatgcgatgtatcg

SEQ ID NO: 53867 - DNA, 25 bp, E. coli
tcagcgaccgcgttgcgatgtatcg

SEQ ID NO: 53868 - DNA, 25 bp, E. coli
taagcgcgtgcaacagcgtagtgag

SEQ ID NO: 53869 - DNA, 25 bp, E. coli
caagatgacgttggaatattccggc

SEQ ID NO: 53870 - DNA, 25 bp, E. coli
caagatgacgttcgaatattccggc

SEQ ID NO: 53871 - DNA, 25 bp, E. coli
cactgtgttcatcagcgtagccgag

SEQ ID NO: 53872 - DNA, 25 bp, E. coli
cacttttctggacggaacaccgcaa

SEQ ID NO: 53873 - DNA, 25 bp, E. coli
cactgtgttcatgagcgtagccgag

SEQ ID NO: 53874 - DNA, 25 bp, E. coli
cacttttctggagggaacaccgcaa

SEQ ID NO: 53875 - DNA, 25 bp, E. coli
catgcataacggaaaggcgtgggta

SEQ ID NO: 53876 - DNA, 25 bp, E. coli
catgcataacggtaaggcgtgggta

SEQ ID NO: 53877 - DNA, 25 bp, E. coli
cagtcatggcttgaatgttgtgcca

SEQ ID NO: 53878 - DNA, 25 bp, E. coli
cagtcatggcttcaatgttgtgcca

SEQ ID NO: 53879 - DNA, 25 bp, E. coli
ttatgaatgactatccgttgttgcg

SEQ ID NO: 53880 - DNA, 25 bp, E. coli
ttatgaatgactttccgttgttgcg

SEQ ID NO: 53881 - DNA, 25 bp, E. coli
gcagtttgtttattccagaaaggcg

SEQ ID NO: 53882 - DNA, 25 bp, E. coli
gcagtttgtttaatccagaaaggcg

SEQ ID NO: 53883 - DNA, 25 bp, E. coli
gaaataagtatcctcagtcatggct

SEQ ID NO: 53884 - DNA, 25 bp, E. coli
gaaataagtatcgtcagtcatggct

SEQ ID NO: 53885 - DNA, 25 bp, E. coli
cccgggcgcgttgctttatcaagat

SEQ ID NO: 53886 - DNA, 25 bp, E. coli
cccgcttcgataaggatcacctgat

SEQ ID NO: 53887 - DNA, 25 bp, E. coli
cccgcttcgatatggatcacctgat

SEQ ID NO: 53888 - DNA, 25 bp, E. coli
cccgggcgcgttcctttatcaagat

SEQ ID NO: 53889 - DNA, 25 bp, E. coli
gtagccgagataattgaccgcccca

SEQ ID NO: 53890 - DNA, 25 bp, E. coli
gtagccgagatatttgaccgcccca

SEQ ID NO: 53891 - DNA, 25 bp, E. coli
tacccaacaaagacaaacacgacca

SEQ ID NO: 53892 - DNA, 25 bp, E. coli
acccaacaaagacaaacacgaccag

SEQ ID NO: 53893 - DNA, 25 bp, E. coli
acccaacaaagagaaacacgaccag

SEQ ID NO: 53894 - DNA, 25 bp, E. coli
tacccaacaaagtcaaacacgacca

SEQ ID NO: 53895 - DNA, 25 bp, E. coli
ttgtacccaacaaagacaaacacga

SEQ ID NO: 53896 - DNA, 25 bp, E. coli
ttgtacccaacatagacaaacacga

SEQ ID NO: 53897 - DNA, 25 bp, E. coli
tgtacccaacaaagacaaacacgac

SEQ ID NO: 53898 - DNA, 25 bp, E. coli
tgtacccaacaatgacaaacacgac

SEQ ID NO: 53899 - DNA, 25 bp, E. coli
cctgcagaagaagattaattaatga

SEQ ID NO: 53900 - DNA, 25 bp, E. coli
ccaacaaagacaaacacgaccagag

SEQ ID NO: 53901 - DNA, 25 bp, E. coli
cctgcagaagaacattaattaatga

SEQ ID NO: 53902 - DNA, 25 bp, E. coli
gcctgcagaagaagattaattaatg

SEQ ID NO: 53903 - DNA, 25 bp, E. coli
gcctgcagaagatgattaattaatg

SEQ ID NO: 53904 - DNA, 25 bp, E. coli
ccaacaaagacatacacgaccagag

SEQ ID NO: 53905 - DNA, 25 bp, E. coli
gcagaagaagattaattaatgaaaa

SEQ ID NO: 53906 - DNA, 25 bp, E. coli
gcagaagaagataaattaatgaaaa

SEQ ID NO: 53907 - DNA, 25 bp, E. coli
cccaacaaagacaaacacgaccaga

SEQ ID NO: 53908 - DNA, 25 bp, E. coli
cccaacaaagactaacacgaccaga

SEQ ID NO: 53909 - DNA, 25 bp, E. coli
tcaatttgtacccaacaaagacaaa

SEQ ID NO: 53910 - DNA, 25 bp, E. coli
tcaatttgtaccgaacaaagacaaa

SEQ ID NO: 53911 - DNA, 25 bp, E. coli
tttgtacccaacaaagacaaacacg

SEQ ID NO: 53912 - DNA, 25 bp, E. coli
tttgtacccaactaagacaaacacg

SEQ ID NO: 53913 - DNA, 25 bp, E. coli
aaaatataccctgccggtactgatc

SEQ ID NO: 53914 - DNA, 25 bp, E. coli
aaaatataccctcccggtactgatc

SEQ ID NO: 53915 - DNA, 25 bp, E. coli
tagggttacccgacgaagatggact

SEQ ID NO: 53916 - DNA, 25 bp, E. coli
tagggttacccgtcgaagatggact

SEQ ID NO: 53917 - DNA, 25 bp, E. coli
tataactgggacaatgaaccctcga

SEQ ID NO: 53918 - DNA, 25 bp, E. coli
tataactgggactatgaaccctcga

SEQ ID NO: 53919 - DNA, 25 bp, E. coli
ttaatgctcaaagcaggcagtccgg

SEQ ID NO: 53920 - DNA, 25 bp, E. coli
ttaatgctcaaaccaggcagtccgg

SEQ ID NO: 53921 - DNA, 25 bp, E. coli
tctgacgctgaacatgggtcgccgt

SEQ ID NO: 53922 - DNA, 25 bp, E. coli
tctgacgctgaagatgggtcgccgt

SEQ ID NO: 53923 - DNA, 25 bp, E. coli
gctctgctgtcacggttaatgctca

SEQ ID NO: 53924 - DNA, 25 bp, E. coli
gctcgcgatacggtgaccgacaaaa

SEQ ID NO: 53925 - DNA, 25 bp, E. coli
gctcgcgatacgctgaccgacaaaa

SEQ ID NO: 53926 - DNA, 25 bp, E. coli
gctctgctgtcagggttaatgctca

SEQ ID NO: 53927 - DNA, 25 bp, E. coli
cgaagatggactccattttctcgcc

SEQ ID NO: 53928 - DNA, 25 bp, E. coli
cgaagatggactgcattttctcgcc

SEQ ID NO: 53929 - DNA, 25 bp, E. coli
gtactgatcctcaccgctcgcgata

SEQ ID NO: 53930 - DNA, 25 bp, E. coli
gattgttggcaatctgacgctgaac

SEQ ID NO: 53931 - DNA, 25 bp, E. coli
gattgttggcaaactgacgctgaac

SEQ ID NO: 53932 - DNA, 25 bp, E. coli
ggtgaagagttgtttctgacgccca

SEQ ID NO: 53933 - DNA, 25 bp, E. coli
gtactgatcctctccgctcgcgata

SEQ ID NO: 53934 - DNA, 25 bp, E. coli
ggtgaagagttgattctgacgccca

SEQ ID NO: 53935 - DNA, 25 bp, E. coli
ctgcgcgggcgcgtaggtcgtggcg

SEQ ID NO: 53936 - DNA, 25 bp, E. coli
ctgcgcgggcgcctaggtcgtggcg

SEQ ID NO: 53937 - DNA, 25 bp, E. coli
taaaacggcgcaaattcgcctgcaa

SEQ ID NO: 53938 - DNA, 25 bp, E. coli
taaaacggcgcatattcgcctgcaa

SEQ ID NO: 53939 - DNA, 25 bp, E. coli
acggctggcacagcaggaagccatc

SEQ ID NO: 53940 - DNA, 25 bp, E. coli
acggctggcacaccaggaagccatc

SEQ ID NO: 53941 - DNA, 25 bp, E. coli
ttgtgattgcgctaaaagatctgga

SEQ ID NO: 53942 - DNA, 25 bp, E. coli
ttgtgattgcgcaaaaagatctgga

SEQ ID NO: 53943 - DNA, 25 bp, E. coli
tgcgcaaaaagaactggagattcgc

SEQ ID NO: 53944 - DNA, 25 bp, E. coli
tgcgcaaaaagatctggagattcgc

SEQ ID NO: 53945 - DNA, 25 bp, E. coli
gccctggcgaatagttaggcacgcg

SEQ ID NO: 53946 - DNA, 25 bp, E. coli
gccctggcgaattgttaggcacgcg

SEQ ID NO: 53947 - DNA, 25 bp, E. coli
gacggaacgttagtcgaatgcgtaa

SEQ ID NO: 53948 - DNA, 25 bp, E. coli
gacggaacgttactcgaatgcgtaa

SEQ ID NO: 53949 - DNA, 25 bp, E. coli
cgctttctaaaacggcgcaaattcg

SEQ ID NO: 53950 - DNA, 25 bp, E. coli
cgaattgttaggcacgcgtcagacg

SEQ ID NO: 53951 - DNA, 25 bp, E. coli
cgaattgttagggacgcgtcagacg

SEQ ID NO: 53952 - DNA, 25 bp, E. coli
cgctttctaaaagggcgcaaattcg

SEQ ID NO: 53953 - DNA, 25 bp, E. coli
gattcgcggcccaggcgaattgtta

SEQ ID NO: 53954 - DNA, 25 bp, E. coli
gattcgcggccctggcgaattgtta

SEQ ID NO: 53955 - DNA, 25 bp, E. coli
gtaaagcacggctggcacagcagga

SEQ ID NO: 53956 - DNA, 25 bp, E. coli
gtaaagcacggcaggcacagcagga

SEQ ID NO: 53957 - DNA, 25 bp, E. coli
caatataacgaatcgaaaggccata

SEQ ID NO: 53958 - DNA, 25 bp, E. coli
caatataacgaaacgaaaggccata

SEQ ID NO: 53959 - DNA, 25 bp, E. coli
caaatgcgatggttgttatgaccgt

SEQ ID NO: 53960 - DNA, 25 bp, E. coli
caaatgcgatggatgttatgaccgt

SEQ ID NO: 53961 - DNA, 25 bp, E. coli
taaaaagccgatgtgtgttgaatct

SEQ ID NO: 53962 - DNA, 25 bp, E. coli
taaaaagccgatctgtgttgaatct

SEQ ID NO: 53963 - DNA, 25 bp, E. coli
agatgtgtgcattggctgccgctac

SEQ ID NO: 53964 - DNA, 25 bp, E. coli
agatgtgtgcataggctgccgctac

SEQ ID NO: 53965 - DNA, 25 bp, E. coli
tgttgcggagggaaaaaagccgatc

SEQ ID NO: 53966 - DNA, 25 bp, E. coli
tgttgaatcttgaccgctgcgggcg

SEQ ID NO: 53967 - DNA, 25 bp, E. coli
tgttgcggagggtaaaaagccgatc

SEQ ID NO: 53968 - DNA, 25 bp, E. coli
tgttgaatcttgtccgctgcgggcg

SEQ ID NO: 53969 - DNA, 25 bp, E. coli
gcgagctcacttaaccaaaccgaat

SEQ ID NO: 53970 - DNA, 25 bp, E. coli
gcgagctcactttaccaaaccgaat

SEQ ID NO: 53971 - DNA, 25 bp, E. coli
gaaaggccatatgaccaaatgcgat

SEQ ID NO: 53972 - DNA, 25 bp, E. coli
gaaaggccatatcaccaaatgcgat

SEQ ID NO: 53973 - DNA, 25 bp, E. coli
cgttgccgcgagctcactttaccaa

SEQ ID NO: 53974 - DNA, 25 bp, E. coli
cgttgccgcgaggtcactttaccaa

SEQ ID NO: 53975 - DNA, 25 bp, E. coli
tggcgcaccgcattataacgaaacg

SEQ ID NO: 53976 - DNA, 25 bp, E. coli
tatgaccgtgttccggagggtaaaa

SEQ ID NO: 53977 - DNA, 25 bp, E. coli
tggcgcaccgcaatataacgaaacg

SEQ ID NO: 53978 - DNA, 25 bp, E. coli
tatgaccgtgttgcggagggtaaaa

SEQ ID NO: 53979 - DNA, 25 bp, E. coli
tactggctattcagtacggcctggc

SEQ ID NO: 53980 - DNA, 25 bp, E. coli
tactggctattctgtacggcctggc

SEQ ID NO: 53981 - DNA, 25 bp, E. coli
tacgcctatgttgcccgtcatgatg

SEQ ID NO: 53982 - DNA, 25 bp, E. coli
tacgcctatgttccccgtcatgatg

SEQ ID NO: 53983 - DNA, 25 bp, E. coli
tagccagctctcgtggattgccagc

SEQ ID NO: 53984 - DNA, 25 bp, E. coli
tagccagctctcctggattgccagc

SEQ ID NO: 53985 - DNA, 25 bp, E. coli
tgccattggcaataacggagcaaca

SEQ ID NO: 53986 - DNA, 25 bp, E. coli
tgccattggcaaaaacggagcaaca

SEQ ID NO: 53987 - DNA, 25 bp, E. coli
tcgcaaacgttaaggcaaggcgccg

SEQ ID NO: 53988 - DNA, 25 bp, E. coli
tcgcaaacgttatggcaaggcgccg

SEQ ID NO: 53989 - DNA, 25 bp, E. coli
tcatggcgaaagatgcaggctcacc

SEQ ID NO: 53990 - DNA, 25 bp, E. coli
tcatggcgaaagttgcaggctcacc

SEQ ID NO: 53991 - DNA, 25 bp, E. coli
gccaactgagcgaaccgggaaatct

SEQ ID NO: 53992 - DNA, 25 bp, E. coli
gccaactgagcgtaccgggaaatct

SEQ ID NO: 53993 - DNA, 25 bp, E. coli
gaaggatcgtttacatttagccagc

SEQ ID NO: 53994 - DNA, 25 bp, E. coli
gaaggatcgttttcatttagccagc

SEQ ID NO: 53995 - DNA, 25 bp, E. coli
cgggttgttgatgctcgcaatggca

SEQ ID NO: 53996 - DNA, 25 bp, E. coli
cgggttgttgatcctcgcaatggca

SEQ ID NO: 53997 - DNA, 25 bp, E. coli
tggcggtaccttaatgggcacgaca

SEQ ID NO: 53998 - DNA, 25 bp, E. coli
tggcggtacctttatgggcacgaca

SEQ ID NO: 53999 - DNA, 25 bp, E. coli
gacgctcatttagggcattgggcaa

SEQ ID NO: 54000 - DNA, 25 bp, E. coli
gacgctcatttacggcattgggcaa

SEQ ID NO: 54001 - DNA, 25 bp, E. coli
caacaccggagctgtttgcaaatca

SEQ ID NO: 54002 - DNA, 25 bp, E. coli
caccggagctgtatgcaaatcaagt

SEQ ID NO: 54003 - DNA, 25 bp, E. coli
caacaccggagcagtttgcaaatca

SEQ ID NO: 54004 - DNA, 25 bp, E. coli
caccaacaccggagctgtttgcaaa

SEQ ID NO: 54005 - DNA, 25 bp, E. coli
caaatcaagtacacaaaatatctag

SEQ ID NO: 54006 - DNA, 25 bp, E. coli
caaatcaagtactcaaaatatctag

SEQ ID NO: 54007 - DNA, 25 bp, E. coli
caccaacaccggtgctgtttgcaaa

SEQ ID NO: 54008 - DNA, 25 bp, E. coli
caccggagctgtttgcaaatcaagt

SEQ ID NO: 54009 - DNA, 25 bp, E. coli
acaccggagctgattgcaaatcaag

SEQ ID NO: 54010 - DNA, 25 bp, E. coli
acaccggagctgtttgcaaatcaag

SEQ ID NO: 54011 - DNA, 25 bp, E. coli
tgcaaatcaagtacacaaaatatct

SEQ ID NO: 54012 - DNA, 25 bp, E. coli
tgcaaatcaagttcacaaaatatct

SEQ ID NO: 54013 - DNA, 25 bp, E. coli
ccggagctgtttgcaaatcaagtac

SEQ ID NO: 54014 - DNA, 25 bp, E. coli
ccaacaccggaggtgtttgcaaatc

SEQ ID NO: 54015 - DNA, 25 bp, E. coli
ccaacaccggagctgtttgcaaatc

SEQ ID NO: 54016 - DNA, 25 bp, E. coli
ccggagctgtttccaaatcaagtac

SEQ ID NO: 54017 - DNA, 25 bp, E. coli
gctgtttgcaaaacaagtacacaaa

SEQ ID NO: 54018 - DNA, 25 bp, E. coli
gctgtttgcaaatcaagtacacaaa

SEQ ID NO: 54019 - DNA, 25 bp, E. coli
cggagctgtttgcaaatcaagtaca

SEQ ID NO: 54020 - DNA, 25 bp, E. coli
cggagctgtttggaaatcaagtaca

SEQ ID NO: 54021 - DNA, 25 bp, E. coli
gagctgtttgcaaatcaagtacaca

SEQ ID NO: 54022 - DNA, 25 bp, E. coli
gagctgtttgcatatcaagtacaca

SEQ ID NO: 54023 - DNA, 25 bp, E. coli
caaggcagggttaagacgtaagatg

SEQ ID NO: 54024 - DNA, 25 bp, E. coli
caaggcagggtttagacgtaagatg

SEQ ID NO: 54025 - DNA, 25 bp, E. coli
cagggttaagacgtaagatgcgaaa

SEQ ID NO: 54026 - DNA, 25 bp, E. coli
cagggttaagacctaagatgcgaaa

SEQ ID NO: 54027 - DNA, 25 bp, E. coli
ttcaaggcagggttaagacgtaaga

SEQ ID NO: 54028 - DNA, 25 bp, E. coli
ttcaaggcagggataagacgtaaga

SEQ ID NO: 54029 - DNA, 25 bp, E. coli
gcagaattattttcagggatacggc

SEQ ID NO: 54030 - DNA, 25 bp, E. coli
gaattattttcagggatacggcaca

SEQ ID NO: 54031 - DNA, 25 bp, E. coli
gcagaattatttacagggatacggc

SEQ ID NO: 54032 - DNA, 25 bp, E. coli
gaattattttcacggatacggcaca

SEQ ID NO: 54033 - DNA, 25 bp, E. coli
cgtaagatgcgataagcagccatgg

SEQ ID NO: 54034 - DNA, 25 bp, E. coli
cgtaagatgcgaaaagcagccatgg

SEQ ID NO: 54035 - DNA, 25 bp, E. coli
gtaagatgcgaaaagcagccatgga

SEQ ID NO: 54036 - DNA, 25 bp, E. coli
ggtattcaaggctgggttaagacgt

SEQ ID NO: 54037 - DNA, 25 bp, E. coli
ggtattcaaggcagggttaagacgt

SEQ ID NO: 54038 - DNA, 25 bp, E. coli
ggttaagacgtatgatgcgaaaagc

SEQ ID NO: 54039 - DNA, 25 bp, E. coli
ggttaagacgtaagatgcgaaaagc

SEQ ID NO: 54040 - DNA, 25 bp, E. coli
gtaagatgcgaatagcagccatgga

SEQ ID NO: 54041 - DNA, 25 bp, E. coli
taagacgtaagatgcgaaaagcagc

SEQ ID NO: 54042 - DNA, 25 bp, E. coli
taagacgtaagaagcgaaaagcagc

SEQ ID NO: 54043 - DNA, 25 bp, E. coli
gacgtaagatgcgaaaagcagccat

SEQ ID NO: 54044 - DNA, 25 bp, E. coli
gacgtaagatgccaaaagcagccat

SEQ ID NO: 54045 - DNA, 25 bp, E. coli
caagagtagataatgttgaccacac

SEQ ID NO: 54046 - DNA, 25 bp, E. coli
caagagtagatattgttgaccacac

SEQ ID NO: 54047 - DNA, 25 bp, E. coli
aataagtattacctttagacaatgt

SEQ ID NO: 54048 - DNA, 25 bp, E. coli
aataagtattacgtttagacaatgt

SEQ ID NO: 54049 - DNA, 25 bp, E. coli
tacgaatttttaccccgctgtcgat

SEQ ID NO: 54050 - DNA, 25 bp, E. coli
tacgaatttttagcccgctgtcgat

SEQ ID NO: 54051 - DNA, 25 bp, E. coli
tagacaatgtttcttttagcgtctc

SEQ ID NO: 54052 - DNA, 25 bp, E. coli
tagacaatgtttgttttagcgtctc

SEQ ID NO: 54053 - DNA, 25 bp, E. coli
tagcgtctcttaagaagagtctgac

SEQ ID NO: 54054 - DNA, 25 bp, E. coli
tagcgtctcttatgaagagtctgac

SEQ ID NO: 54055 - DNA, 25 bp, E. coli
ttcaactttgtaaaaggagtcaacg

SEQ ID NO: 54056 - DNA, 25 bp, E. coli
ttcaactttgtataaggagtcaacg

SEQ ID NO: 54057 - DNA, 25 bp, E. coli
tgaccacacttaatgttcaactttg

SEQ ID NO: 54058 - DNA, 25 bp, E. coli
tgaccacacttattgttcaactttg

SEQ ID NO: 54059 - DNA, 25 bp, E. coli
gaaaattcttatcttttggcaagag

SEQ ID NO: 54060 - DNA, 25 bp, E. coli
gaaaattcttatgttttggcaagag

SEQ ID NO: 54061 - DNA, 25 bp, E. coli
cgctgtcgatttattactcattggg

SEQ ID NO: 54062 - DNA, 25 bp, E. coli
cgctgtcgattttttactcattggg

SEQ ID NO: 54063 - DNA, 25 bp, E. coli
ggatatcggtaagattttacgaatt

SEQ ID NO: 54064 - DNA, 25 bp, E. coli
ggatatcggtaacattttacgaatt

SEQ ID NO: 54065 - DNA, 25 bp, E. coli
taagaagagtctgacctgaaaattc

SEQ ID NO: 54066 - DNA, 25 bp, E. coli
taagaagagtctcacctgaaaattc

SEQ ID NO: 54067 - DNA, 25 bp, E. coli
tagacgattgcgattacacccagtg

SEQ ID NO: 54068 - DNA, 25 bp, E. coli
tagacgattgcgtttacacccagtg

SEQ ID NO: 54069 - DNA, 25 bp, E. coli
tagccagtatatgaccgccaaaggg

SEQ ID NO: 54070 - DNA, 25 bp, E. coli
tagccagtatatcaccgccaaaggg

SEQ ID NO: 54071 - DNA, 25 bp, E. coli
tttttgacacgctcaacggtgcctg

SEQ ID NO: 54072 - DNA, 25 bp, E. coli
tttttgacacgcacaacggtgcctg

SEQ ID NO: 54073 - DNA, 25 bp, E. coli
tgcgatccatgaagcctcaaccggt

SEQ ID NO: 54074 - DNA, 25 bp, E. coli
tgagcccatcgatttagaatccctg

SEQ ID NO: 54075 - DNA, 25 bp, E. coli
tgagcccatcgaattagaatccctg

SEQ ID NO: 54076 - DNA, 25 bp, E. coli
tcccgcgccctaaaacagaaagtgt

SEQ ID NO: 54077 - DNA, 25 bp, E. coli
tgcgatccatgatgcctcaaccggt

SEQ ID NO: 54078 - DNA, 25 bp, E. coli
tcccgcgccctataacagaaagtgt

SEQ ID NO: 54079 - DNA, 25 bp, E. coli
tctcccagtgtgaggaaaacgctgc

SEQ ID NO: 54080 - DNA, 25 bp, E. coli
tctcccagtgtgtggaaaacgctgc

SEQ ID NO: 54081 - DNA, 25 bp, E. coli
gactaaccgtaaagtcgccgcgctg

SEQ ID NO: 54082 - DNA, 25 bp, E. coli
gactaaccgtaatgtcgccgcgctg

SEQ ID NO: 54083 - DNA, 25 bp, E. coli
gattatcgaaaactcgtgtccccgg

SEQ ID NO: 54084 - DNA, 25 bp, E. coli
gattatcgaaaagtcgtgtccccgg

SEQ ID NO: 54085 - DNA, 25 bp, E. coli
gagaaaatgaaatatcccgcgccct

SEQ ID NO: 54086 - DNA, 25 bp, E. coli
gacgctcgatgaggtggcagcaaaa

SEQ ID NO: 54087 - DNA, 25 bp, E. coli
gagaaaatgaaaaatcccgcgccct

SEQ ID NO: 54088 - DNA, 25 bp, E. coli
gacgctcgatgacgtggcagcaaaa

SEQ ID NO: 54089 - DNA, 25 bp, E. coli
aggtctcatcatccatggaaacaac

SEQ ID NO: 54090 - DNA, 25 bp, E. coli
aggtctcatcatgcatggaaacaac

SEQ ID NO: 54091 - DNA, 25 bp, E. coli
atggcaggtctcttcatccatggaa

SEQ ID NO: 54092 - DNA, 25 bp, E. coli
atggcaggtctcatcatccatggaa

SEQ ID NO: 54093 - DNA, 25 bp, E. coli
ttttacctgggttagcacatggcag

SEQ ID NO: 54094 - DNA, 25 bp, E. coli
ttttacctgggtaagcacatggcag

SEQ ID NO: 54095 - DNA, 25 bp, E. coli
ttacctgggtaaccacatggcaggg

SEQ ID NO: 54096 - DNA, 25 bp, E. coli
ttacctgggtaagcacatggcaggg

SEQ ID NO: 54097 - DNA, 25 bp, E. coli
tcgtgggatggctggtctcatcatc

SEQ ID NO: 54098 - DNA, 25 bp, E. coli
tcgtgggatggcaggtctcatcatc

SEQ ID NO: 54099 - DNA, 25 bp, E. coli
gcaggtctcatcatccatggaaaca

SEQ ID NO: 54100 - DNA, 25 bp, E. coli
gcaggtctcatcttccatggaaaca

SEQ ID NO: 54101 - DNA, 25 bp, E. coli
gattttacctgggtaagcacatggc

SEQ ID NO: 54102 - DNA, 25 bp, E. coli
gattttacctggctaagcacatggc

SEQ ID NO: 54103 - DNA, 25 bp, E. coli
ggtggctgatttaacctgggtaagc

SEQ ID NO: 54104 - DNA, 25 bp, E. coli
gtgggatggcaggtctcatcatcca

SEQ ID NO: 54105 - DNA, 25 bp, E. coli
gtgggatggcagctctcatcatcca

SEQ ID NO: 54106 - DNA, 25 bp, E. coli
ggtggctgattttacctgggtaagc

SEQ ID NO: 54107 - DNA, 25 bp, E. coli
ggctgattttacctgggtaagcaca

SEQ ID NO: 54108 - DNA, 25 bp, E. coli
ggctgattttacgtgggtaagcaca

SEQ ID NO: 54109 - DNA, 25 bp, E. coli
gatggcaggtctcatcatccatgga

SEQ ID NO: 54110 - DNA, 25 bp, E. coli
gatggcaggtctgatcatccatgga

SEQ ID NO: 54111 - DNA, 25 bp, E. coli
catttttactcgattatcatgccag

SEQ ID NO: 54112 - DNA, 25 bp, E. coli
catttttactcgtttatcatgccag

SEQ ID NO: 54113 - DNA, 25 bp, E. coli
tacccgaagtaagacaaccactgga

SEQ ID NO: 54114 - DNA, 25 bp, E. coli
agattacccgtcttatcagcgtttc

SEQ ID NO: 54115 - DNA, 25 bp, E. coli
agattacccgtcatatcagcgtttc

SEQ ID NO: 54116 - DNA, 25 bp, E. coli
agtaagacaacctctggaggattaa

SEQ ID NO: 54117 - DNA, 25 bp, E. coli
agtaagacaaccactggaggattaa

SEQ ID NO: 54118 - DNA, 25 bp, E. coli
tacccgaagtaacacaaccactgga

SEQ ID NO: 54119 - DNA, 25 bp, E. coli
gccagattacccctcatatcagcgt

SEQ ID NO: 54120 - DNA, 25 bp, E. coli
gccagattacccgtcatatcagcgt

SEQ ID NO: 54121 - DNA, 25 bp, E. coli
gctacccgcagcaggcgagtcattt

SEQ ID NO: 54122 - DNA, 25 bp, E. coli
gctacccgcagctggcgagtcattt

SEQ ID NO: 54123 - DNA, 25 bp, E. coli
gaagatgcaatagccgaagtaagac

SEQ ID NO: 54124 - DNA, 25 bp, E. coli
gaagatgcaatacccgaagtaagac

SEQ ID NO: 54125 - DNA, 25 bp, E. coli
cgttggcacggatgatgcaataccc

SEQ ID NO: 54126 - DNA, 25 bp, E. coli
cgttggcacggaagatgcaataccc

SEQ ID NO: 54127 - DNA, 25 bp, E. coli
cgaagtaagacaaccactggaggat

SEQ ID NO: 54128 - DNA, 25 bp, E. coli
cccgcagcaggccagtcatttttac

SEQ ID NO: 54129 - DNA, 25 bp, E. coli
cccgcagcaggcgagtcatttttac

SEQ ID NO: 54130 - DNA, 25 bp, E. coli
cgaagtaagacatccactggaggat

SEQ ID NO: 54131 - DNA, 25 bp, E. coli
gtttatcatgcctgattacccgtca

SEQ ID NO: 54132 - DNA, 25 bp, E. coli
gtttatcatgccagattacccgtca

SEQ ID NO: 54133 - DNA, 25 bp, E. coli
tacaacctgctggaacagaccgaag

SEQ ID NO: 54134 - DNA, 25 bp, E. coli
tacaacctgctgcaacagaccgaag

SEQ ID NO: 54135 - DNA, 25 bp, E. coli
tatgacgatcgtatctggacccgca

SEQ ID NO: 54136 - DNA, 25 bp, E. coli
tatgacgatcgtttctggacccgca

SEQ ID NO: 54137 - DNA, 25 bp, E. coli
tattgtcggctacgctcgtgaagcg

SEQ ID NO: 54138 - DNA, 25 bp, E. coli
tattgtcggctaggctcgtgaagcg

SEQ ID NO: 54139 - DNA, 25 bp, E. coli
tgtgaacaaactatccgtactccgg

SEQ ID NO: 54140 - DNA, 25 bp, E. coli
tgtgaacaaactttccgtactccgg

SEQ ID NO: 54141 - DNA, 25 bp, E. coli
tgctgaacgagaaattcggcctgcg

SEQ ID NO: 54142 - DNA, 25 bp, E. coli
tgctgaacgagatattcggcctgcg

SEQ ID NO: 54143 - DNA, 25 bp, E. coli
tctggtgagccgtgaaaaactgcgt

SEQ ID NO: 54144 - DNA, 25 bp, E. coli
tctggtgagccgagaaaaactgcgt

SEQ ID NO: 54145 - DNA, 25 bp, E. coli
gttaatgtctacacccacggcgaaa

SEQ ID NO: 54146 - DNA, 25 bp, E. coli
gttaatgtctactcccacggcgaaa

SEQ ID NO: 54147 - DNA, 25 bp, E. coli
ggaaacggctgcacatacgcgcagg

SEQ ID NO: 54148 - DNA, 25 bp, E. coli
ggaaacggctgctcatacgcgcagg

SEQ ID NO: 54149 - DNA, 25 bp, E. coli
tcaagcatctggacggtaactacgg

SEQ ID NO: 54150 - DNA, 25 bp, E. coli
tcaagcatctggtcggtaactacgg

SEQ ID NO: 54151 - DNA, 25 bp, E. coli
gacccaaccgtaggcgcttatgacg

SEQ ID NO: 54152 - DNA, 25 bp, E. coli
gatggctgacctgcaactggtgagc

SEQ ID NO: 54153 - DNA, 25 bp, E. coli
gacccaaccgtacgcgcttatgacg

SEQ ID NO: 54154 - DNA, 25 bp, E. coli
gatggctgacctccaactggtgagc

SEQ ID NO: 54155 - DNA, 25 bp, E. coli
cagcggcgagaatagcaaaatcact

SEQ ID NO: 54156 - DNA, 25 bp, E. coli
cagcggcgagaaaagcaaaatcact

SEQ ID NO: 54157 - DNA, 25 bp, E. coli
cagtatctgtggtgctgccgcggta

SEQ ID NO: 54158 - DNA, 25 bp, E. coli
cagtatctgtggagctgccgcggta

SEQ ID NO: 54159 - DNA, 25 bp, E. coli
taaagtaaccgtcgctgttgcaacc

SEQ ID NO: 54160 - DNA, 25 bp, E. coli
taaagtaaccgtggctgttgcaacc

SEQ ID NO: 54161 - DNA, 25 bp, E. coli
aaatgctgcgcgagatgatgctggc

SEQ ID NO: 54162 - DNA, 25 bp, E. coli
aaatgctgcgcgtgatgatgctggc

SEQ ID NO: 54163 - DNA, 25 bp, E. coli
tagccctgagtggagttatcaccgg

SEQ ID NO: 54164 - DNA, 25 bp, E. coli
taccgcagagcgaggtgaacatgct

SEQ ID NO: 54165 - DNA, 25 bp, E. coli
taccgcagagcgtggtgaacatgct

SEQ ID NO: 54166 - DNA, 25 bp, E. coli
tagccctgagtgcagttatcaccgg

SEQ ID NO: 54167 - DNA, 25 bp, E. coli
tggtctggataagcacaccagctgg

SEQ ID NO: 54168 - DNA, 25 bp, E. coli
tggtctggataaccacaccagctgg

SEQ ID NO: 54169 - DNA, 25 bp, E. coli
tgaacatgctggaaacgctggatac

SEQ ID NO: 54170 - DNA, 25 bp, E. coli
tgaacatgctggtaacgctggatac

SEQ ID NO: 54171 - DNA, 25 bp, E. coli
gaaacaacatcgtacactgtggcat

SEQ ID NO: 54172 - DNA, 25 bp, E. coli
gaaacaacatcgaacactgtggcat

SEQ ID NO: 54173 - DNA, 25 bp, E. coli
cgtctgacgttctcgcaaattgccg

SEQ ID NO: 54174 - DNA, 25 bp, E. coli
cgtctgacgttcacgcaaattgccg

SEQ ID NO: 54175 - DNA, 25 bp, E. coli
gttctactgtgcacgaagtggcgca

SEQ ID NO: 54176 - DNA, 25 bp, E. coli
gttctactgtgctcgaagtggcgca

SEQ ID NO: 54177 - DNA, 25 bp, E. coli
taaacagcaaaatcagcagacgtct

SEQ ID NO: 54178 - DNA, 25 bp, E. coli
taaacagcaaaaacagcagacgtct

SEQ ID NO: 54179 - DNA, 25 bp, E. coli
aaaccccgtaaacagcattcgcctg

SEQ ID NO: 54180 - DNA, 25 bp, E. coli
acgccagctggcagaacgggatgaa

SEQ ID NO: 54181 - DNA, 25 bp, E. coli
aaaccccgtaaagagcattcgcctg

SEQ ID NO: 54182 - DNA, 25 bp, E. coli
acgccagctggctgaacgggatgaa

SEQ ID NO: 54183 - DNA, 25 bp, E. coli
tgaagccctgaagcttgctgaacgc

SEQ ID NO: 54184 - DNA, 25 bp, E. coli
tgaagccctgaaccttgctgaacgc

SEQ ID NO: 54185 - DNA, 25 bp, E. coli
gaatcacaactcaacaactggcgca

SEQ ID NO: 54186 - DNA, 25 bp, E. coli
gaagagctggctatcctccaaaagg

SEQ ID NO: 54187 - DNA, 25 bp, E. coli
gaagagctggctttcctccaaaagg

SEQ ID NO: 54188 - DNA, 25 bp, E. coli
gaatcacaactctacaactggcgca

SEQ ID NO: 54189 - DNA, 25 bp, E. coli
gaacgcatcggtgttactgccgcag

SEQ ID NO: 54190 - DNA, 25 bp, E. coli
gaacgcatcggtcttactgccgcag

SEQ ID NO: 54191 - DNA, 25 bp, E. coli
cctgaatttcgctgtgaagccctga

SEQ ID NO: 54192 - DNA, 25 bp, E. coli
cctgaatttcgcagtgaagccctga

SEQ ID NO: 54193 - DNA, 25 bp, E. coli
cgtcttctgaacgtgaactggagat

SEQ ID NO: 54194 - DNA, 25 bp, E. coli
cgtcttctgaacctgaactggagat

SEQ ID NO: 54195 - DNA, 25 bp, E. coli
gattgcacgtctgaaacgccagctg

SEQ ID NO: 54196 - DNA, 25 bp, E. coli
gattgcacgtctcaaacgccagctg

SEQ ID NO: 54197 - DNA, 25 bp, E. coli
tggagatgtctagcgagattgcacg

SEQ ID NO: 54198 - DNA, 25 bp, E. coli
tggagatgtctaccgagattgcacg

SEQ ID NO: 54199 - DNA, 25 bp, E. coli
caatatttgcctggtcgccacaagt

SEQ ID NO: 54200 - DNA, 25 bp, E. coli
caatatttgcctcgtcgccacaagt

SEQ ID NO: 54201 - DNA, 25 bp, E. coli
cacaagtattgtatcgctggcgggc

SEQ ID NO: 54202 - DNA, 25 bp, E. coli
cacattcggtgatatcgcaaaaaag

SEQ ID NO: 54203 - DNA, 25 bp, E. coli
cacattcggtgaaatcgcaaaaaag

SEQ ID NO: 54204 - DNA, 25 bp, E. coli
cacaagtattgtttcgctggcgggc

SEQ ID NO: 54205 - DNA, 25 bp, E. coli
tatccgtggaaattaaccttaggtg

SEQ ID NO: 54206 - DNA, 25 bp, E. coli
tatccgtggaaaataaccttaggtg

SEQ ID NO: 54207 - DNA, 25 bp, E. coli
tttaaatcgcttccggcaaatgtgg

SEQ ID NO: 54208 - DNA, 25 bp, E. coli
tttaaatcgcttgcggcaaatgtgg

SEQ ID NO: 54209 - DNA, 25 bp, E. coli
ttaacgccacgcgtattgtgattgg

SEQ ID NO: 54210 - DNA, 25 bp, E. coli
ttgtgattggcgagaaatgctggct

SEQ ID NO: 54211 - DNA, 25 bp, E. coli
ttgtgattggcgtgaaatgctggct

SEQ ID NO: 54212 - DNA, 25 bp, E. coli
ttaacgccacgcctattgtgattgg

SEQ ID NO: 54213 - DNA, 25 bp, E. coli
gccacgaccatgcaagtcaacattt

SEQ ID NO: 54214 - DNA, 25 bp, E. coli
gccacgaccatggaagtcaacattt

SEQ ID NO: 54215 - DNA, 25 bp, E. coli
gaaataaccattcgcgcacattcgg

SEQ ID NO: 54216 - DNA, 25 bp, E. coli
gaaataaccattggcgcacattcgg

SEQ ID NO: 54217 - DNA, 25 bp, E. coli
ggtgggcagtacaggcaacaatatt

SEQ ID NO: 54218 - DNA, 25 bp, E. coli
ggtgggcagtactggcaacaatatt

SEQ ID NO: 54219 - DNA, 25 bp, E. coli
tcaacatttcaccattaacgccacg

SEQ ID NO: 54220 - DNA, 25 bp, E. coli
tcaacatttcacgattaacgccacg

SEQ ID NO: 54221 - DNA, 25 bp, E. coli
caggccccgcttatgatgcgctgga

SEQ ID NO: 54222 - DNA, 25 bp, E. coli
caggccccgcttttgatgcgctgga

SEQ ID NO: 54223 - DNA, 25 bp, E. coli
tatcctgacagggtctatcgacggc

SEQ ID NO: 54224 - DNA, 25 bp, E. coli
tatcgacggcgtgccggacatctac

SEQ ID NO: 54225 - DNA, 25 bp, E. coli
tatcctgacaggctctatcgacggc

SEQ ID NO: 54226 - DNA, 25 bp, E. coli
tatcgacggcgtcccggacatctac

SEQ ID NO: 54227 - DNA, 25 bp, E. coli
tggtggcgacggcttgggagccggt

SEQ ID NO: 54228 - DNA, 25 bp, E. coli
tgaagccgaaaaacgcggtatcaca

SEQ ID NO: 54229 - DNA, 25 bp, E. coli
tgaagccgaaaatcgcggtatcaca

SEQ ID NO: 54230 - DNA, 25 bp, E. coli
tgacaggctctatcgacggcgtgcc

SEQ ID NO: 54231 - DNA, 25 bp, E. coli
tgacaggctctaacgacggcgtgcc

SEQ ID NO: 54232 - DNA, 25 bp, E. coli
gctaaccctgaccaaatccaccctt

SEQ ID NO: 54233 - DNA, 25 bp, E. coli
gctaaccctgacgaaatccaccctt

SEQ ID NO: 54234 - DNA, 25 bp, E. coli
gaaaaacgcggtatcacactgaaaa

SEQ ID NO: 54235 - DNA, 25 bp, E. coli
gaaaaacgcggtttcacactgaaaa

SEQ ID NO: 54236 - DNA, 25 bp, E. coli
cggtatcacactcaaaattgccgat

SEQ ID NO: 54237 - DNA, 25 bp, E. coli
cggtatcacactgaaaattgccgat

SEQ ID NO: 54238 - DNA, 25 bp, E. coli
gggcaaagatatcctgacaggctct

SEQ ID NO: 54239 - DNA, 25 bp, E. coli
gggcaaagatatgctgacaggctct

SEQ ID NO: 54240 - DNA, 25 bp, E. coli
tggcaggccccgcttttgatgcgct

SEQ ID NO: 54241 - DNA, 25 bp, E. coli
tggtggcgacgggttgggagccggt

SEQ ID NO: 54242 - DNA, 25 bp, E. coli
tggcaggccccggttttgatgcgct

SEQ ID NO: 54243 - DNA, 25 bp, E. coli
tacaaatggttaggacgcggcgata

SEQ ID NO: 54244 - DNA, 25 bp, E. coli
tacaaatggttacgacgcggcgata

SEQ ID NO: 54245 - DNA, 25 bp, E. coli
attgatctgaacctgccgctggcgg

SEQ ID NO: 54246 - DNA, 25 bp, E. coli
attgatctgaacgtgccgctggcgg

SEQ ID NO: 54247 - DNA, 25 bp, E. coli
acatgaacggtcgtctgctggcgcg

SEQ ID NO: 54248 - DNA, 25 bp, E. coli
aaagacccggaaatgcaggtgcaca

SEQ ID NO: 54249 - DNA, 25 bp, E. coli
aaagacccggaattgcaggtgcaca

SEQ ID NO: 54250 - DNA, 25 bp, E. coli
acatgaacggtcctctgctggcgcg

SEQ ID NO: 54251 - DNA, 25 bp, E. coli
tgcgtattatgcacaaccaggtcaa

SEQ ID NO: 54252 - DNA, 25 bp, E. coli
tgaaatcgacgaagcaccgatgctc

SEQ ID NO: 54253 - DNA, 25 bp, E. coli
tgaaaaagtcggtactggtcgcggc

SEQ ID NO: 54254 - DNA, 25 bp, E. coli
tgcgtattatgctcaaccaggtcaa

SEQ ID NO: 54255 - DNA, 25 bp, E. coli
tgaaaaagtcggaactggtcgcggc

SEQ ID NO: 54256 - DNA, 25 bp, E. coli
tgaaatcgacgatgcaccgatgctc

SEQ ID NO: 54257 - DNA, 25 bp, E. coli
gaacttgccatccaattttcccgcg

SEQ ID NO: 54258 - DNA, 25 bp, E. coli
gaacttgccatcgaattttcccgcg

SEQ ID NO: 54259 - DNA, 25 bp, E. coli
ccggtattaccataggcgatctgct

SEQ ID NO: 54260 - DNA, 25 bp, E. coli
cgcgtcatgacgacaaaggcgacaa

SEQ ID NO: 54261 - DNA, 25 bp, E. coli
cgcgtcatgacgtcaaaggcgacaa

SEQ ID NO: 54262 - DNA, 25 bp, E. coli
ccggtattaccaaaggcgatctgct

SEQ ID NO: 54263 - DNA, 25 bp, E. coli
ggagccaaaggcaccattgatctga

SEQ ID NO: 54264 - DNA, 25 bp, E. coli
ggagccaaaggctccattgatctga

SEQ ID NO: 54265 - DNA, 25 bp, E. coli
caatggagagcatcggcaaagcgct

SEQ ID NO: 54266 - DNA, 25 bp, E. coli
caatggagagcaacggcaaagcgct

SEQ ID NO: 54267 - DNA, 25 bp, E. coli
agtccacctggagttacgaactgga

SEQ ID NO: 54268 - DNA, 25 bp, E. coli
agtccacctggacttacgaactgga

SEQ ID NO: 54269 - DNA, 25 bp, E. coli
aaacgttatctccaatccggcggcg

SEQ ID NO: 54270 - DNA, 25 bp, E. coli
aaacgttatctcgaatccggcggcg

SEQ ID NO: 54271 - DNA, 25 bp, E. coli
tccggcggcgcgaatctttaaagac

SEQ ID NO: 54272 - DNA, 25 bp, E. coli
tccggcggcgcgtatctttaaagac

SEQ ID NO: 54273 - DNA, 25 bp, E. coli
cctgcaacatcctcgttgcgtgtgg

SEQ ID NO: 54274 - DNA, 25 bp, E. coli
cctgcaacatccacgttgcgtgtgg

SEQ ID NO: 54275 - DNA, 25 bp, E. coli
gaaattcctcgtcactatcgacccg

SEQ ID NO: 54276 - DNA, 25 bp, E. coli
gaaattcctcgtgactatcgacccg

SEQ ID NO: 54277 - DNA, 25 bp, E. coli
ctttacacgtactgcggcggtggct

SEQ ID NO: 54278 - DNA, 25 bp, E. coli
cggcttcgccaatcgtgatactacc

SEQ ID NO: 54279 - DNA, 25 bp, E. coli
ctttacacgtacagcggcggtggct

SEQ ID NO: 54280 - DNA, 25 bp, E. coli
cggcttcgccaaacgtgatactacc

SEQ ID NO: 54281 - DNA, 25 bp, E. coli
gatcggctgtctctcgaagctgaaa

SEQ ID NO: 54282 - DNA, 25 bp, E. coli
gataaaacagcgacgttcctctacg

SEQ ID NO: 54283 - DNA, 25 bp, E. coli
gataaaacagcgtcgttcctctacg

SEQ ID NO: 54284 - DNA, 25 bp, E. coli
gtgatactacccagcaacatccacg

SEQ ID NO: 54285 - DNA, 25 bp, E. coli
gtgatactaccctgcaacatccacg

SEQ ID NO: 54286 - DNA, 25 bp, E. coli
gatcggctgtctgtcgaagctgaaa

SEQ ID NO: 54287 - DNA, 25 bp, E. coli
cttgcgggaaggagttgaagatcaa

SEQ ID NO: 54288 - DNA, 25 bp, E. coli
cttgcgggaaggtgttgaagatcaa

SEQ ID NO: 54289 - DNA, 25 bp, E. coli
tatacctgcattcatctctacattg

SEQ ID NO: 54290 - DNA, 25 bp, E. coli
tatacctgcattgatctctacattg

SEQ ID NO: 54291 - DNA, 25 bp, E. coli
tgaaatttatgattacccggcagga

SEQ ID NO: 54292 - DNA, 25 bp, E. coli
tgaaatttatgaatacccggcagga

SEQ ID NO: 54293 - DNA, 25 bp, E. coli
tcgatatgatgcaggcgaatacgcc

SEQ ID NO: 54294 - DNA, 25 bp, E. coli
tcgatatgatgctggcgaatacgcc

SEQ ID NO: 54295 - DNA, 25 bp, E. coli
gatcaactcattgtggaaaaagcca

SEQ ID NO: 54296 - DNA, 25 bp, E. coli
ggacgcattgctcttttgaaaagga

SEQ ID NO: 54297 - DNA, 25 bp, E. coli
ggacgcattgctgttttgaaaagga

SEQ ID NO: 54298 - DNA, 25 bp, E. coli
ggcattaatgcgctcatgctcgact

SEQ ID NO: 54299 - DNA, 25 bp, E. coli
ggctaacgcgtgtacaaattgagtc

SEQ ID NO: 54300 - DNA, 25 bp, E. coli
ggcattaatgcggtcatgctcgact

SEQ ID NO: 54301 - DNA, 25 bp, E. coli
ggctaacgcgtgaacaaattgagtc

SEQ ID NO: 54302 - DNA, 25 bp, E. coli
taatggtggcgtgaacgttatgttc

SEQ ID NO: 54303 - DNA, 25 bp, E. coli
taatggtggcgtcaacgttatgttc

SEQ ID NO: 54304 - DNA, 25 bp, E. coli
gatgagtcgccacgcgcgcttcttg

SEQ ID NO: 54305 - DNA, 25 bp, E. coli
gatcaactcattctggaaaaagcca

SEQ ID NO: 54306 - DNA, 25 bp, E. coli
gacgtatcaacatgctggacgcatt

SEQ ID NO: 54307 - DNA, 25 bp, E. coli
gatgagtcgccaggcgcgcttcttg

SEQ ID NO: 54308 - DNA, 25 bp, E. coli
gacgtatcaacaagctggacgcatt

SEQ ID NO: 54309 - DNA, 25 bp, E. coli
caagcgcgggtcgacttcataagcg

SEQ ID NO: 54310 - DNA, 25 bp, E. coli
caacaggccattacgatagaggaca

SEQ ID NO: 54311 - DNA, 25 bp, E. coli
caacaggccatttcgatagaggaca

SEQ ID NO: 54312 - DNA, 25 bp, E. coli
caagcgcgggtccacttcataagcg

SEQ ID NO: 54313 - DNA, 25 bp, E. coli
tactggatacgcaggaacatggcac

SEQ ID NO: 54314 - DNA, 25 bp, E. coli
tactggatacgctggaacatggcac

SEQ ID NO: 54315 - DNA, 25 bp, E. coli
tattttaccgatcaacccgcaggga

SEQ ID NO: 54316 - DNA, 25 bp, E. coli
tattcgcgtcgcgagtttgccgggc

SEQ ID NO: 54317 - DNA, 25 bp, E. coli
tattttaccgatgaacccgcaggga

SEQ ID NO: 54318 - DNA, 25 bp, E. coli
tattcgcgtcgccagtttgccgggc

SEQ ID NO: 54319 - DNA, 25 bp, E. coli
tctggtactggttcaaaccgccggc

SEQ ID NO: 54320 - DNA, 25 bp, E. coli
tctggtactggtacaaaccgccggc

SEQ ID NO: 54321 - DNA, 25 bp, E. coli
gaatatcctgatgaatgccgtccag

SEQ ID NO: 54322 - DNA, 25 bp, E. coli
gaatatcctgatcaatgccgtccag

SEQ ID NO: 54323 - DNA, 25 bp, E. coli
gaaatcctcggcaatatctgggcca

SEQ ID NO: 54324 - DNA, 25 bp, E. coli
gaaatcctcggctatatctgggcca

SEQ ID NO: 54325 - DNA, 25 bp, E. coli
cattgccattgaccgccagggtgat

SEQ ID NO: 54326 - DNA, 25 bp, E. coli
cattgccattgagcgccagggtgat

SEQ ID NO: 54327 - DNA, 25 bp, E. coli
gatgtaaccaccatgaacccagcag

SEQ ID NO: 54328 - DNA, 25 bp, E. coli
gatgtaaccaccttgaacccagcag

SEQ ID NO: 54329 - DNA, 25 bp, E. coli
gatctgattattgaaaacgctgccg

SEQ ID NO: 54330 - DNA, 25 bp, E. coli
gatctgattattcaaaacgctgccg

SEQ ID NO: 54331 - DNA, 25 bp, E. coli
catgacatggtggtgtgtgtgcaac

SEQ ID NO: 54332 - DNA, 25 bp, E. coli
catcacttactttgccgggaactgg

SEQ ID NO: 54333 - DNA, 25 bp, E. coli
catgacatggtgctgtgtgtgcaac

SEQ ID NO: 54334 - DNA, 25 bp, E. coli
catcacttacttagccgggaactgg

SEQ ID NO: 54335 - DNA, 25 bp, E. coli
tacagtagcggtgtacaagttggct

SEQ ID NO: 54336 - DNA, 25 bp, E. coli
tacagtagcggtctacaagttggct

SEQ ID NO: 54337 - DNA, 25 bp, E. coli
tcgaccattgggtggtgggcaccta

SEQ ID NO: 54338 - DNA, 25 bp, E. coli
tcgaccattgggaggtgggcaccta

SEQ ID NO: 54339 - DNA, 25 bp, E. coli
gccgcactggtgattaatcgcgagt

SEQ ID NO: 54340 - DNA, 25 bp, E. coli
gccgcactggtgtttaatcgcgagt

SEQ ID NO: 54341 - DNA, 25 bp, E. coli
gcatgttaatgctgaccgtctggat

SEQ ID NO: 54342 - DNA, 25 bp, E. coli
gcatgttaatgcagaccgtctggat

SEQ ID NO: 54343 - DNA, 25 bp, E. coli
cgctcggcggtgtcattttcggtca

SEQ ID NO: 54344 - DNA, 25 bp, E. coli
cgctcggcggtgacattttcggtca

SEQ ID NO: 54345 - DNA, 25 bp, E. coli
gattaagctgccagacaattccctg

SEQ ID NO: 54346 - DNA, 25 bp, E. coli
gattaagctgcctgacaattccctg

SEQ ID NO: 54347 - DNA, 25 bp, E. coli
ggtttactgctttcaaccggactgg

SEQ ID NO: 54348 - DNA, 25 bp, E. coli
ggtttactgcttacaaccggactgg

SEQ ID NO: 54349 - DNA, 25 bp, E. coli
tggatgatgggcttcgcgacagcct

SEQ ID NO: 54350 - DNA, 25 bp, E. coli
tggatgatgggcatcgcgacagcct

SEQ ID NO: 54351 - DNA, 25 bp, E. coli
gagtccgcggaatttgaacaacagc

SEQ ID NO: 54352 - DNA, 25 bp, E. coli
gagtccgcggaaattgaacaacagc

SEQ ID NO: 54353 - DNA, 25 bp, E. coli
aacagtttgctgtcacgctacgcga

SEQ ID NO: 54354 - DNA, 25 bp, E. coli
aacagtttgctgacacgctacgcga

SEQ ID NO: 54355 - DNA, 25 bp, E. coli
tgggcttattaaatggcgggatcga

SEQ ID NO: 54356 - DNA, 25 bp, E. coli
tgggcttattaattggcgggatcga

SEQ ID NO: 54357 - DNA, 25 bp, E. coli
tgaatcggaaaatagaagaaccagc

SEQ ID NO: 54358 - DNA, 25 bp, E. coli
tgctgaaagagctgaataaccgctc

SEQ ID NO: 54359 - DNA, 25 bp, E. coli
tgctgaaagagcagaataaccgctc

SEQ ID NO: 54360 - DNA, 25 bp, E. coli
tgaatcggaaaaaagaagaaccagc

SEQ ID NO: 54361 - DNA, 25 bp, E. coli
tcgcgaatttgcgatgcgcgggaac

SEQ ID NO: 54362 - DNA, 25 bp, E. coli
tccctgctgttgtgatgcattacgg

SEQ ID NO: 54363 - DNA, 25 bp, E. coli
tcgcgaatttgccatgcgcgggaac

SEQ ID NO: 54364 - DNA, 25 bp, E. coli
tccctgctgttgagatgcattacgg

SEQ ID NO: 54365 - DNA, 25 bp, E. coli
tcttcactggttgccgatatcatca

SEQ ID NO: 54366 - DNA, 25 bp, E. coli
tcttcactggttcccgatatcatca

SEQ ID NO: 54367 - DNA, 25 bp, E. coli
gaaattcgtgatatgctgaaagagc

SEQ ID NO: 54368 - DNA, 25 bp, E. coli
gaaattcgtgatttgctgaaagagc

SEQ ID NO: 54369 - DNA, 25 bp, E. coli
cattacggtgtcatcattcaaaacg

SEQ ID NO: 54370 - DNA, 25 bp, E. coli
cattacggtgtcttcattcaaaacg

SEQ ID NO: 54371 - DNA, 25 bp, E. coli
taagctaatcaagaaactgaatcgg

SEQ ID NO: 54372 - DNA, 25 bp, E. coli
taagctaatcaacaaactgaatcgg

SEQ ID NO: 54373 - DNA, 25 bp, E. coli
gagcattattaatgaatttcgcgaa

SEQ ID NO: 54374 - DNA, 25 bp, E. coli
gagcattattaaagaatttcgcgaa

SEQ ID NO: 54375 - DNA, 25 bp, E. coli
taaatcaatcggctaaattgccatg

SEQ ID NO: 54376 - DNA, 25 bp, E. coli
taaacgtctgaactgtaagtgatcg

SEQ ID NO: 54377 - DNA, 25 bp, E. coli
taaatcaatcgggtaaattgccatg

SEQ ID NO: 54378 - DNA, 25 bp, E. coli
taaacgtctgaagtgtaagtgatcg

SEQ ID NO: 54379 - DNA, 25 bp, E. coli
agacagatacccattacacctcggg

SEQ ID NO: 54380 - DNA, 25 bp, E. coli
ataacccgcaggatcaaccgcatgt

SEQ ID NO: 54381 - DNA, 25 bp, E. coli
agacagataccctttacacctcggg

SEQ ID NO: 54382 - DNA, 25 bp, E. coli
ataacccgcaggttcaaccgcatgt

SEQ ID NO: 54383 - DNA, 25 bp, E. coli
aattaaaaaagaccgtgttgtcctg

SEQ ID NO: 54384 - DNA, 25 bp, E. coli
aattaaaaaagagcgtgttgtcctg

SEQ ID NO: 54385 - DNA, 25 bp, E. coli
tagcaaagacaccagtatataagcg

SEQ ID NO: 54386 - DNA, 25 bp, E. coli
tagcaaagacacgagtatataagcg

SEQ ID NO: 54387 - DNA, 25 bp, E. coli
tgccgcctgatcttaatctgaaaaa

SEQ ID NO: 54388 - DNA, 25 bp, E. coli
tgccgcctgatcataatctgaaaaa

SEQ ID NO: 54389 - DNA, 25 bp, E. coli
gaaatccgtctggttgctgtagcaa

SEQ ID NO: 54390 - DNA, 25 bp, E. coli
gaaatccgtctgcttgctgtagcaa

SEQ ID NO: 54391 - DNA, 25 bp, E. coli
cgaaagcaagatgggtaaacgtctg

SEQ ID NO: 54392 - DNA, 25 bp, E. coli
cgaaagcaagatcggtaaacgtctg

SEQ ID NO: 54393 - DNA, 25 bp, E. coli
gttttatcatcaatcttgccgcctg

SEQ ID NO: 54394 - DNA, 25 bp, E. coli
gatcgtcagggcaaatctgaaaagc

SEQ ID NO: 54395 - DNA, 25 bp, E. coli
gttttatcatcattcttgccgcctg

SEQ ID NO: 54396 - DNA, 25 bp, E. coli
gatcgtcagggctaatctgaaaagc

SEQ ID NO: 54397 - DNA, 25 bp, E. coli
caaaattgtttgcaccatcggaccg

SEQ ID NO: 54398 - DNA, 25 bp, E. coli
caaaattgtttggaccatcggaccg

SEQ ID NO: 54399 - DNA, 25 bp, E. coli
taccgaagcggtatgccgtggtgcc

SEQ ID NO: 54400 - DNA, 25 bp, E. coli
taccgtctgggtaaagaactggctc

SEQ ID NO: 54401 - DNA, 25 bp, E. coli
taccgaagcggtttgccgtggtgcc

SEQ ID NO: 54402 - DNA, 25 bp, E. coli
taccgtctgggttaagaactggctc

SEQ ID NO: 54403 - DNA, 25 bp, E. coli
ttctggtgcactcgtaccgagcggc

SEQ ID NO: 54404 - DNA, 25 bp, E. coli
ttctggtgcactggtaccgagcggc

SEQ ID NO: 54405 - DNA, 25 bp, E. coli
tgaatccgcaaaaggtaaatacccg

SEQ ID NO: 54406 - DNA, 25 bp, E. coli
tgaatccgcaaatggtaaatacccg

SEQ ID NO: 54407 - DNA, 25 bp, E. coli
tcatggcgaccaactgcgaacgtac

SEQ ID NO: 54408 - DNA, 25 bp, E. coli
tcatggcgaccatctgcgaacgtac

SEQ ID NO: 54409 - DNA, 25 bp, E. coli
gaaatccgtgagcacctgaaagcgc

SEQ ID NO: 54410 - DNA, 25 bp, E. coli
gactatgcagaagacggtcagcgca

SEQ ID NO: 54411 - DNA, 25 bp, E. coli
gaaatccgtgaggacctgaaagcgc

SEQ ID NO: 54412 - DNA, 25 bp, E. coli
gactatgcagaacacggtcagcgca

SEQ ID NO: 54413 - DNA, 25 bp, E. coli
gtacgtaaatacttcccggatgcca

SEQ ID NO: 54414 - DNA, 25 bp, E. coli
gtacgtaaatacatcccggatgcca

SEQ ID NO: 54415 - DNA, 25 bp, E. coli
tggaagcggtttgtatcatggcgac

SEQ ID NO: 54416 - DNA, 25 bp, E. coli
tggaagcggtttctatcatggcgac

SEQ ID NO: 54417 - DNA, 25 bp, E. coli
gatgagcaaaactggtaaaaccgcc

SEQ ID NO: 54418 - DNA, 25 bp, E. coli
gatgagcaaaacaggtaaaaccgcc

SEQ ID NO: 54419 - DNA, 25 bp, E. coli
caacagcaagcacacacagtttata

SEQ ID NO: 54420 - DNA, 25 bp, E. coli
caacagcaagcagacacagtttata

SEQ ID NO: 54421 - DNA, 25 bp, E. coli
catcatcaccatgactaaaagcagg

SEQ ID NO: 54422 - DNA, 25 bp, E. coli
catcatcaccatcactaaaagcagg

SEQ ID NO: 54423 - DNA, 25 bp, E. coli
taaaagcaggatgacaacagcaagc

SEQ ID NO: 54424 - DNA, 25 bp, E. coli
taaaagcaggatcacaacagcaagc

SEQ ID NO: 54425 - DNA, 25 bp, E. coli
tctttttcttgcttggtgccgggtg

SEQ ID NO: 54426 - DNA, 25 bp, E. coli
tctttttcttgcatggtgccgggtg

SEQ ID NO: 54427 - DNA, 25 bp, E. coli
gcaggatcacaacagcaagcagaca

SEQ ID NO: 54428 - DNA, 25 bp, E. coli
gcaggatcacaagagcaagcagaca

SEQ ID NO: 54429 - DNA, 25 bp, E. coli
cattctttttctagcatggtgccgg

SEQ ID NO: 54430 - DNA, 25 bp, E. coli
cattctttttcttgcatggtgccgg

SEQ ID NO: 54431 - DNA, 25 bp, E. coli
gatcacaacagctagcagacacagt

SEQ ID NO: 54432 - DNA, 25 bp, E. coli
gatcacaacagcaagcagacacagt

SEQ ID NO: 54433 - DNA, 25 bp, E. coli
gtttgcatgcactttctttttcttg

SEQ ID NO: 54434 - DNA, 25 bp, E. coli
gtttgcatgcacattctttttcttg

SEQ ID NO: 54435 - DNA, 25 bp, E. coli
ggtgaaatccatcatcaccatcact

SEQ ID NO: 54436 - DNA, 25 bp, E. coli
ggtgaaatccatgatcaccatcact

SEQ ID NO: 54437 - DNA, 25 bp, E. coli
tcaccatcactataagcaggatcac

SEQ ID NO: 54438 - DNA, 25 bp, E. coli
tcactaaaagcacgatcacaacagc

SEQ ID NO: 54439 - DNA, 25 bp, E. coli
tcaccatcactaaaagcaggatcac

SEQ ID NO: 54440 - DNA, 25 bp, E. coli
tcactaaaagcaggatcacaacagc

SEQ ID NO: 54441 - DNA, 25 bp, E. coli
taccagcaagggtgtgatgcgttcc

SEQ ID NO: 54442 - DNA, 25 bp, E. coli
taccagcaagggagtgatgcgttcc

SEQ ID NO: 54443 - DNA, 25 bp, E. coli
tttctggcaggcgagacgaatctag

SEQ ID NO: 54444 - DNA, 25 bp, E. coli
tatcgttatggtggcatgacgcggc

SEQ ID NO: 54445 - DNA, 25 bp, E. coli
tatcgttatggtcgcatgacgcggc

SEQ ID NO: 54446 - DNA, 25 bp, E. coli
tttgtggttgtgtcgatgcgcgatc

SEQ ID NO: 54447 - DNA, 25 bp, E. coli
tttctggcaggccagacgaatctag

SEQ ID NO: 54448 - DNA, 25 bp, E. coli
tttgtggttgtgacgatgcgcgatc

SEQ ID NO: 54449 - DNA, 25 bp, E. coli
tttatccacgcctctaccagcaagg

SEQ ID NO: 54450 - DNA, 25 bp, E. coli
tttatccacgccactaccagcaagg

SEQ ID NO: 54451 - DNA, 25 bp, E. coli
tctggccgggtgtagccaccataaa

SEQ ID NO: 54452 - DNA, 25 bp, E. coli
tctggccgggtgaagccaccataaa

SEQ ID NO: 54453 - DNA, 25 bp, E. coli
tctgattcgatttccgttattgccg

SEQ ID NO: 54454 - DNA, 25 bp, E. coli
tctgattcgattaccgttattgccg

SEQ ID NO: 54455 - DNA, 25 bp, E. coli
gccgccaaatgccagactttctgat

SEQ ID NO: 54456 - DNA, 25 bp, E. coli
gccgccaaatgcgagactttctgat

SEQ ID NO: 54457 - DNA, 25 bp, E. coli
ctacaaagctgggatggcacgccgt

SEQ ID NO: 54458 - DNA, 25 bp, E. coli
ctacaaagctggcatggcacgccgt

SEQ ID NO: 54459 - DNA, 25 bp, E. coli
gttattgccggtatgaacgaccagc

SEQ ID NO: 54460 - DNA, 25 bp, E. coli
gttattgccggtttgaacgaccagc

SEQ ID NO: 54461 - DNA, 25 bp, E. coli
gatcgtttcgatatgcagctgcccc

SEQ ID NO: 54462 - DNA, 25 bp, E. coli
gatcgtttcgatttgcagctgcccc

SEQ ID NO: 54463 - DNA, 25 bp, E. coli
caacatttgcaagagcggctaaagc

SEQ ID NO: 54464 - DNA, 25 bp, E. coli
aagctacacatatcgcaaatccagg

SEQ ID NO: 54465 - DNA, 25 bp, E. coli
aagctacacataacgcaaatccagg

SEQ ID NO: 54466 - DNA, 25 bp, E. coli
aactggcctggtaaaaaattcgctg

SEQ ID NO: 54467 - DNA, 25 bp, E. coli
caacatttgcaacagcggctaaagc

SEQ ID NO: 54468 - DNA, 25 bp, E. coli
tactcccacagagcagcaagtgctt

SEQ ID NO: 54469 - DNA, 25 bp, E. coli
tactcccacagaccagcaagtgctt

SEQ ID NO: 54470 - DNA, 25 bp, E. coli
taaacgcgccctctgaagatatgcg

SEQ ID NO: 54471 - DNA, 25 bp, E. coli
taaacgcgccctgtgaagatatgcg

SEQ ID NO: 54472 - DNA, 25 bp, E. coli
aaattcgctggatatacccgcaggg

SEQ ID NO: 54473 - DNA, 25 bp, E. coli
aactggcctggttaaaaattcgctg

SEQ ID NO: 54474 - DNA, 25 bp, E. coli
aaagcgccaacttcgggtggaacat

SEQ ID NO: 54475 - DNA, 25 bp, E. coli
aaattcgctggaaatacccgcaggg

SEQ ID NO: 54476 - DNA, 25 bp, E. coli
aaagcgccaactacgggtggaacat

SEQ ID NO: 54477 - DNA, 25 bp, E. coli
tattaagggcgggatcaatcgcatt

SEQ ID NO: 54478 - DNA, 25 bp, E. coli
tattaagggcggcatcaatcgcatt

SEQ ID NO: 54479 - DNA, 25 bp, E. coli
tgggccgcaaccagagaataaggaa

SEQ ID NO: 54480 - DNA, 25 bp, E. coli
tgggccgcaacctgagaataaggaa

SEQ ID NO: 54481 - DNA, 25 bp, E. coli
gcgattgcaggatgcgccaacattt

SEQ ID NO: 54482 - DNA, 25 bp, E. coli
gcgattgcaggaagcgccaacattt

SEQ ID NO: 54483 - DNA, 25 bp, E. coli
taaggcgtttccacaatcaagggct

SEQ ID NO: 54484 - DNA, 25 bp, E. coli
taaggcgtttcctcaatcaagggct

SEQ ID NO: 54485 - DNA, 25 bp, E. coli
catttttccggtcccattcaccggg

SEQ ID NO: 54486 - DNA, 25 bp, E. coli
catttttccggtgccattcaccggg

SEQ ID NO: 54487 - DNA, 25 bp, E. coli
cacaaaaggcggaactattttcatc

SEQ ID NO: 54488 - DNA, 25 bp, E. coli
cacaaaaggcggtactattttcatc

SEQ ID NO: 54489 - DNA, 25 bp, E. coli
caggatgaatgttaataaaccatca

SEQ ID NO: 54490 - DNA, 25 bp, E. coli
caggatgaatgtaaataaaccatca

SEQ ID NO: 54491 - DNA, 25 bp, E. coli
tgtgtaacttaattacaggatgaat

SEQ ID NO: 54492 - DNA, 25 bp, E. coli
tgtgtaacttaaatacaggatgaat

SEQ ID NO: 54493 - DNA, 25 bp, E. coli
gcaaaaataagtcgtcggatgagta

SEQ ID NO: 54494 - DNA, 25 bp, E. coli
gcaaaaataagtggtcggatgagta

SEQ ID NO: 54495 - DNA, 25 bp, E. coli
cattcaccgggttgatacaaaaggg

SEQ ID NO: 54496 - DNA, 25 bp, E. coli
cattcaccgggtagatacaaaaggg

SEQ ID NO: 54497 - DNA, 25 bp, E. coli
gataaacaaattgatttttccggtg

SEQ ID NO: 54498 - DNA, 25 bp, E. coli
gataaacaaattcatttttccggtg

SEQ ID NO: 54499 - DNA, 25 bp, E. coli
ggtcggatgagttgtaaaattacac

SEQ ID NO: 54500 - DNA, 25 bp, E. coli
ggtcggatgagtagtaaaattacac

SEQ ID NO: 54501 - DNA, 25 bp, E. coli
ggcaaaagccatgatttaactaatg

SEQ ID NO: 54502 - DNA, 25 bp, E. coli
ggcaaaagccatcatttaactaatg

SEQ ID NO: 54503 - DNA, 25 bp, E. coli
tcaataagcaaaaataagtggtcgg

SEQ ID NO: 54504 - DNA, 25 bp, E. coli
tcaataagcaaatataagtggtcgg

SEQ ID NO: 54505 - DNA, 25 bp, E. coli
gagtagtaaaattacacaaaaggcg

SEQ ID NO: 54506 - DNA, 25 bp, E. coli
gagtagtaaaataacacaaaaggcg

SEQ ID NO: 54507 - DNA, 25 bp, E. coli
cagcatctgtctgggttcaggtcga

SEQ ID NO: 54508 - DNA, 25 bp, E. coli
cacaaggcagtattaacgtcgtcaa

SEQ ID NO: 54509 - DNA, 25 bp, E. coli
cagcatctgtctcggttcaggtcga

SEQ ID NO: 54510 - DNA, 25 bp, E. coli
cacaaggcagtaataacgtcgtcaa

SEQ ID NO: 54511 - DNA, 25 bp, E. coli
caagcgttcaaagccctatgtacag

SEQ ID NO: 54512 - DNA, 25 bp, E. coli
caagcgttcaaacccctatgtacag

SEQ ID NO: 54513 - DNA, 25 bp, E. coli
tcatatgaacattgcggagctggtg

SEQ ID NO: 54514 - DNA, 25 bp, E. coli
tcatatgaacatagcggagctggtg

SEQ ID NO: 54515 - DNA, 25 bp, E. coli
gcaacattatctcgtgatcactgcg

SEQ ID NO: 54516 - DNA, 25 bp, E. coli
gcaacattatctggtgatcactgcg

SEQ ID NO: 54517 - DNA, 25 bp, E. coli
cgatgctgggagaagagttcacgtt

SEQ ID NO: 54518 - DNA, 25 bp, E. coli
cgatgctgggagtagagttcacgtt

SEQ ID NO: 54519 - DNA, 25 bp, E. coli
gatcactgcgttcggtgccgatcgc

SEQ ID NO: 54520 - DNA, 25 bp, E. coli
gtacagaactcattgcacaaggcag

SEQ ID NO: 54521 - DNA, 25 bp, E. coli
gatcactgcgttgggtgccgatcgc

SEQ ID NO: 54522 - DNA, 25 bp, E. coli
gtacagaactcaatgcacaaggcag

SEQ ID NO: 54523 - DNA, 25 bp, E. coli
taatcgtgatgatgcgcacgacggc

SEQ ID NO: 54524 - DNA, 25 bp, E. coli
taatcgtgatgaagcgcacgacggc

SEQ ID NO: 54525 - DNA, 25 bp, E. coli
taatattgaagagagtcgcctggcg

SEQ ID NO: 54526 - DNA, 25 bp, E. coli
taatattgaagacagtcgcctggcg

SEQ ID NO: 54527 - DNA, 25 bp, E. coli
gatgtggcagactccccgcatttaa

SEQ ID NO: 54528 - DNA, 25 bp, E. coli
gatgtggcagacaccccgcatttaa

SEQ ID NO: 54529 - DNA, 25 bp, E. coli
caacgttggtggaaatatatgaccg

SEQ ID NO: 54530 - DNA, 25 bp, E. coli
caacgttggtggtaatatatgaccg

SEQ ID NO: 54531 - DNA, 25 bp, E. coli
cacgaagagtatgagcgtcggcata

SEQ ID NO: 54532 - DNA, 25 bp, E. coli
cagcgtcggcataatcccatctggc

SEQ ID NO: 54533 - DNA, 25 bp, E. coli
cagcgtcggcattatcccatctggc

SEQ ID NO: 54534 - DNA, 25 bp, E. coli
cacgaagagtatcagcgtcggcata

SEQ ID NO: 54535 - DNA, 25 bp, E. coli
ttgtcatgcaggaaaaccccgacgc

SEQ ID NO: 54536 - DNA, 25 bp, E. coli
ttgtcatgcaggtaaaccccgacgc

SEQ ID NO: 54537 - DNA, 25 bp, E. coli
tgaaatctcacgctgcgcataacta

SEQ ID NO: 54538 - DNA, 25 bp, E. coli
tgaaatctcacggtgcgcataacta

SEQ ID NO: 54539 - DNA, 25 bp, E. coli
gcctttgtcatgcaggtaaaccccg

SEQ ID NO: 54540 - DNA, 25 bp, E. coli
gcctttgtcatggaggtaaaccccg

SEQ ID NO: 54541 - DNA, 25 bp, E. coli
ccgacgcccacgaagagtatcagcg

SEQ ID NO: 54542 - DNA, 25 bp, E. coli
ccgacgcccacgtagagtatcagcg

SEQ ID NO: 54543 - DNA, 25 bp, E. coli
cgcaaagcctttgtcatgcaggtaa

SEQ ID NO: 54544 - DNA, 25 bp, E. coli
cgcaaagcctttctcatgcaggtaa

SEQ ID NO: 54545 - DNA, 25 bp, E. coli
ctcacggtgcgcttaactacgccat

SEQ ID NO: 54546 - DNA, 25 bp, E. coli
ctcacggtgcgcataactacgccat

SEQ ID NO: 54547 - DNA, 25 bp, E. coli
gatccgcaaagcgtttgtcatgcag

SEQ ID NO: 54548 - DNA, 25 bp, E. coli
gagtatcagcgtcggcataatccca

SEQ ID NO: 54549 - DNA, 25 bp, E. coli
gatccgcaaagcctttgtcatgcag

SEQ ID NO: 54550 - DNA, 25 bp, E. coli
gagtatcagcgtgggcataatccca

SEQ ID NO: 54551 - DNA, 25 bp, E. coli
cagccgtagtctggaccttctactg

SEQ ID NO: 54552 - DNA, 25 bp, E. coli
cagccgtagtctcgaccttctactg

SEQ ID NO: 54553 - DNA, 25 bp, E. coli
ttgtaccggcgcagttggcccgcgc

SEQ ID NO: 54554 - DNA, 25 bp, E. coli
ttgtaccggcgctgttggcccgcgc

SEQ ID NO: 54555 - DNA, 25 bp, E. coli
tccggagtttatcggcatcgccgag

SEQ ID NO: 54556 - DNA, 25 bp, E. coli
tccggagtttatgggcatcgccgag

SEQ ID NO: 54557 - DNA, 25 bp, E. coli
cctgaattatcgaatcggttctagc

SEQ ID NO: 54558 - DNA, 25 bp, E. coli
cctgaattatcgtatcggttctagc

SEQ ID NO: 54559 - DNA, 25 bp, E. coli
gcctgctgtttcgtaacggattcct

SEQ ID NO: 54560 - DNA, 25 bp, E. coli
gcctgctgtttcctaacggattcct

SEQ ID NO: 54561 - DNA, 25 bp, E. coli
cgaatcggttctagctttgacacca

SEQ ID NO: 54562 - DNA, 25 bp, E. coli
cgaatcggttcttgctttgacacca

SEQ ID NO: 54563 - DNA, 25 bp, E. coli
cgtttgaaaacaccgttgctgacct

SEQ ID NO: 54564 - DNA, 25 bp, E. coli
cgtttgaaaacagcgttgctgacct

SEQ ID NO: 54565 - DNA, 25 bp, E. coli
cggctatgggccgtttgaaaacagc

SEQ ID NO: 54566 - DNA, 25 bp, E. coli
cggctatgggccctttgaaaacagc

SEQ ID NO: 54567 - DNA, 25 bp, E. coli
ggaccttctactggtcgtgttctca

SEQ ID NO: 54568 - DNA, 25 bp, E. coli
tgtgggtggcctgctgtttcctaac

SEQ ID NO: 54569 - DNA, 25 bp, E. coli
tgtgggtggcctcctgtttcctaac

SEQ ID NO: 54570 - DNA, 25 bp, E. coli
ggaccttctactcgtcgtgttctca

SEQ ID NO: 54571 - DNA, 25 bp, E. coli
ttgacgactcgggtatgggccgttt

SEQ ID NO: 54572 - DNA, 25 bp, E. coli
ttgacgactcggctatgggccgttt

SEQ ID NO: 54573 - DNA, 25 bp, E. coli
cagacggcgagtggctgcatatcaa

SEQ ID NO: 54574 - DNA, 25 bp, E. coli
cagacggcgagtcgctgcatatcaa

SEQ ID NO: 54575 - DNA, 25 bp, E. coli
taaaccgctggcagagcatttcggc

SEQ ID NO: 54576 - DNA, 25 bp, E. coli
taaaccgctggctgagcatttcggc

SEQ ID NO: 54577 - DNA, 25 bp, E. coli
tatgttcggctccaaaggaatcgac

SEQ ID NO: 54578 - DNA, 25 bp, E. coli
tatgaaggtgttgccagctgggaca

SEQ ID NO: 54579 - DNA, 25 bp, E. coli
tatgttcagctcaagggcgatgacc

SEQ ID NO: 54580 - DNA, 25 bp, E. coli
tatgttcggctcgaaaggaatcgac

SEQ ID NO: 54581 - DNA, 25 bp, E. coli
tatgaaggtgttcccagctgggaca

SEQ ID NO: 54582 - DNA, 25 bp, E. coli
tatgttcagctctagggcgatgacc

SEQ ID NO: 54583 - DNA, 25 bp, E. coli
tataaatcggtcattcaggcgctcg

SEQ ID NO: 54584 - DNA, 25 bp, E. coli
tatcgctgacaaaagagaagcctgc

SEQ ID NO: 54585 - DNA, 25 bp, E. coli
tataaatcggtctttcaggcgctcg

SEQ ID NO: 54586 - DNA, 25 bp, E. coli
tatcgctgacaatagagaagcctgc

SEQ ID NO: 54587 - DNA, 25 bp, E. coli
tgaaatccggatcaacctgaactgg

SEQ ID NO: 54588 - DNA, 25 bp, E. coli
tgaaatccggatgaacctgaactgg

SEQ ID NO: 54589 - DNA, 25 bp, E. coli
tcaggcgctcggtaatgcattcggt

SEQ ID NO: 54590 - DNA, 25 bp, E. coli
tcaggcgctcggaaatgcattcggt

SEQ ID NO: 54591 - DNA, 25 bp, E. coli
ccagtacttcaatggccaggacgaa

SEQ ID NO: 54592 - DNA, 25 bp, E. coli
ccagtacttcaaaggccaggacgaa

SEQ ID NO: 54593 - DNA, 25 bp, E. coli
taacgatgatggaaccgtcagcctg

SEQ ID NO: 54594 - DNA, 25 bp, E. coli
taacgatgatggtaccgtcagcctg

SEQ ID NO: 54595 - DNA, 25 bp, E. coli
aattaatcaggatgtttcagtccag

SEQ ID NO: 54596 - DNA, 25 bp, E. coli
aattaatcaggaagtttcagtccag

SEQ ID NO: 54597 - DNA, 25 bp, E. coli
caggatgtttcactccagaggagta

SEQ ID NO: 54598 - DNA, 25 bp, E. coli
caggatgtttcagtccagaggagta

SEQ ID NO: 54599 - DNA, 25 bp, E. coli
aaagtgatgatcaatctgttaggct

SEQ ID NO: 54600 - DNA, 25 bp, E. coli
aaagtgatgatctatctgttaggct

SEQ ID NO: 54601 - DNA, 25 bp, E. coli
tatgtagtagcgtaaattaatcagg

SEQ ID NO: 54602 - DNA, 25 bp, E. coli
tatgtagtagcgaaaattaatcagg

SEQ ID NO: 54603 - DNA, 25 bp, E. coli
tctgttaggctaagtagtagcgaaa

SEQ ID NO: 54604 - DNA, 25 bp, E. coli
tctgttaggctatgtagtagcgaaa

SEQ ID NO: 54605 - DNA, 25 bp, E. coli
tcagtccagaggtgtatggtttggc

SEQ ID NO: 54606 - DNA, 25 bp, E. coli
tcagtccagaggagtatggtttggc

SEQ ID NO: 54607 - DNA, 25 bp, E. coli
ccagaggagtatggtttggcaactc

SEQ ID NO: 54608 - DNA, 25 bp, E. coli
ccagaggagtatcgtttggcaactc

SEQ ID NO: 54609 - DNA, 25 bp, E. coli
cgattgttgccgcaaaagtgatgat

SEQ ID NO: 54610 - DNA, 25 bp, E. coli
cgattgttgccggaaaagtgatgat

SEQ ID NO: 54611 - DNA, 25 bp, E. coli
gttgccggaaaagtgatgatctatc

SEQ ID NO: 54612 - DNA, 25 bp, E. coli
gttgccggaaaactgatgatctatc

SEQ ID NO: 54613 - DNA, 25 bp, E. coli
ggagtatggtttggcaactcacgag

SEQ ID NO: 54614 - DNA, 25 bp, E. coli
ggagtatggtttcgcaactcacgag

SEQ ID NO: 54615 - DNA, 25 bp, E. coli
gatgcggtcgattgttgccggaaaa

SEQ ID NO: 54616 - DNA, 25 bp, E. coli
gatgcggtcgatagttgccggaaaa

SEQ ID NO: 54617 - DNA, 25 bp, E. coli
cactttgtgaagttattcgccggga

SEQ ID NO: 54618 - DNA, 25 bp, E. coli
catctggttttagccacgggcgggc

SEQ ID NO: 54619 - DNA, 25 bp, E. coli
cactatttaacctgcgggagctgga

SEQ ID NO: 54620 - DNA, 25 bp, E. coli
cactttgtgaagatattcgccggga

SEQ ID NO: 54621 - DNA, 25 bp, E. coli
cactatttaaccagcgggagctgga

SEQ ID NO: 54622 - DNA, 25 bp, E. coli
catctggttttacccacgggcgggc

SEQ ID NO: 54623 - DNA, 25 bp, E. coli
tacttacatgcacgcgatgccgcgc

SEQ ID NO: 54624 - DNA, 25 bp, E. coli
tacttacatgcaggcgatgccgcgc

SEQ ID NO: 54625 - DNA, 25 bp, E. coli
tttgggcacgtagatcgctaactgg

SEQ ID NO: 54626 - DNA, 25 bp, E. coli
tatttcgcaaaggttaccagtggcc

SEQ ID NO: 54627 - DNA, 25 bp, E. coli
tatttcgcaaagcttaccagtggcc

SEQ ID NO: 54628 - DNA, 25 bp, E. coli
tttgggcacgtacatcgctaactgg

SEQ ID NO: 54629 - DNA, 25 bp, E. coli
tattgcaccgcatacaccaggtggg

SEQ ID NO: 54630 - DNA, 25 bp, E. coli
tattgcaccgcaaacaccaggtggg

SEQ ID NO: 54631 - DNA, 25 bp, E. coli
tgaagagactcataaagggcgcgat

SEQ ID NO: 54632 - DNA, 25 bp, E. coli
tgctcatcagaatagccaggaccgg

SEQ ID NO: 54633 - DNA, 25 bp, E. coli
tgctcatcagaaaagccaggaccgg

SEQ ID NO: 54634 - DNA, 25 bp, E. coli
tgaagagactcaaaaagggcgcgat

SEQ ID NO: 54635 - DNA, 25 bp, E. coli
gctaaccaacttagagcgccagtgg

SEQ ID NO: 54636 - DNA, 25 bp, E. coli
gctaaccaactttgagcgccagtgg

SEQ ID NO: 54637 - DNA, 25 bp, E. coli
gacattaagtaacaccctggcggca

SEQ ID NO: 54638 - DNA, 25 bp, E. coli
gacattaagtaagaccctggcggca

SEQ ID NO: 54639 - DNA, 25 bp, E. coli
cagggctcacataccgggatcgtta

SEQ ID NO: 54640 - DNA, 25 bp, E. coli
cagggctcacattccgggatcgtta

SEQ ID NO: 54641 - DNA, 25 bp, E. coli
tacaagctgactgagcagggctcac

SEQ ID NO: 54642 - DNA, 25 bp, E. coli
tacaagctgactcagcagggctcac

SEQ ID NO: 54643 - DNA, 25 bp, E. coli
tatgcactccgatatcgtttcagcg

SEQ ID NO: 54644 - DNA, 25 bp, E. coli
tatgcactccgaaatcgtttcagcg

SEQ ID NO: 54645 - DNA, 25 bp, E. coli
tgcacagtggcgttaacctgaccgg

SEQ ID NO: 54646 - DNA, 25 bp, E. coli
tgcacagtggcgataacctgaccgg

SEQ ID NO: 54647 - DNA, 25 bp, E. coli
tcgcggccgcacaattgacgatatg

SEQ ID NO: 54648 - DNA, 25 bp, E. coli
tcgcggccgcactattgacgatatg

SEQ ID NO: 54649 - DNA, 25 bp, E. coli
gacaccatctggatccgcaaactga

SEQ ID NO: 54650 - DNA, 25 bp, E. coli
gacaccatctggttccgcaaactga

SEQ ID NO: 54651 - DNA, 25 bp, E. coli
gaaccagacggtatcactcagcaaa

SEQ ID NO: 54652 - DNA, 25 bp, E. coli
gaaccagacggtttcactcagcaaa

SEQ ID NO: 54653 - DNA, 25 bp, E. coli
cgatcaaaccggcaaagagctggct

SEQ ID NO: 54654 - DNA, 25 bp, E. coli
cgatcaaaccgggaaagagctggct

SEQ ID NO: 54655 - DNA, 25 bp, E. coli
gatcgttatttcatcgctgcgccgt

SEQ ID NO: 54656 - DNA, 25 bp, E. coli
ggtaaacagcttccgtggtcagtcg

SEQ ID NO: 54657 - DNA, 25 bp, E. coli
ggtaaacagcttgcgtggtcagtcg

SEQ ID NO: 54658 - DNA, 25 bp, E. coli
taagccagcttcatttcggtctcgg

SEQ ID NO: 54659 - DNA, 25 bp, E. coli
taagccagcttcttttcggtctcgg

SEQ ID NO: 54660 - DNA, 25 bp, E. coli
gatcgttatttcttcgctgcgccgt

SEQ ID NO: 54661 - DNA, 25 bp, E. coli
tttcagccggttacgaatatcagcg

SEQ ID NO: 54662 - DNA, 25 bp, E. coli
tttaccgcgctggaatactgatggc

SEQ ID NO: 54663 - DNA, 25 bp, E. coli
tttcagccggtttcgaatatcagcg

SEQ ID NO: 54664 - DNA, 25 bp, E. coli
tttaccgcgctgcaatactgatggc

SEQ ID NO: 54665 - DNA, 25 bp, E. coli
gcaattaccgactactggcagctga

SEQ ID NO: 54666 - DNA, 25 bp, E. coli
gcaattaccgacaactggcagctga

SEQ ID NO: 54667 - DNA, 25 bp, E. coli
gaatgccacccactctgaagtcgaa

SEQ ID NO: 54668 - DNA, 25 bp, E. coli
gaatttaaaggcgatgtctcggcgg

SEQ ID NO: 54669 - DNA, 25 bp, E. coli
gaataacgactcatggctggaccgc

SEQ ID NO: 54670 - DNA, 25 bp, E. coli
gaatttaaaggccatgtctcggcgg

SEQ ID NO: 54671 - DNA, 25 bp, E. coli
gaatgccacccagtctgaagtcgaa

SEQ ID NO: 54672 - DNA, 25 bp, E. coli
gaataacgactcttggctggaccgc

SEQ ID NO: 54673 - DNA, 25 bp, E. coli
gataatgtcgctcagtccaccggta

SEQ ID NO: 54674 - DNA, 25 bp, E. coli
gataatgtcgctgagtccaccggta

SEQ ID NO: 54675 - DNA, 25 bp, E. coli
ggtcactattgttagccagcagcgg

SEQ ID NO: 54676 - DNA, 25 bp, E. coli
ggtcactattgtaagccagcagcgg

SEQ ID NO: 54677 - DNA, 25 bp, E. coli
taatatggttcgtaaacacgcgacc

SEQ ID NO: 54678 - DNA, 25 bp, E. coli
tcaccggtaacaactacgagctggg

SEQ ID NO: 54679 - DNA, 25 bp, E. coli
taatatggttcgaaaacacgcgacc

SEQ ID NO: 54680 - DNA, 25 bp, E. coli
tcaccggtaacatctacgagctggg

SEQ ID NO: 54681 - DNA, 25 bp, E. coli
gacgggtaatccttctgcggcaatt

SEQ ID NO: 54682 - DNA, 25 bp, E. coli
gacgggtaatccatctgcggcaatt

SEQ ID NO: 54683 - DNA, 25 bp, E. coli
cggaagttcgtcctcgtgagttcta

SEQ ID NO: 54684 - DNA, 25 bp, E. coli
cggaagttcgtcgtcgtgagttcta

SEQ ID NO: 54685 - DNA, 25 bp, E. coli
agtgaaacgtcaggcgaagaaactg

SEQ ID NO: 54686 - DNA, 25 bp, E. coli
agtgaaacgtcacgcgaagaaactg

SEQ ID NO: 54687 - DNA, 25 bp, E. coli
aaagcttctgcagtgaaacgtcacg

SEQ ID NO: 54688 - DNA, 25 bp, E. coli
aaaaagcaggtgttctggcggaagt

SEQ ID NO: 54689 - DNA, 25 bp, E. coli
aaaaagcaggtgatctggcggaagt

SEQ ID NO: 54690 - DNA, 25 bp, E. coli
acgtagctctgcgtcgcttcaagcg

SEQ ID NO: 54691 - DNA, 25 bp, E. coli
acgtagctctgcctcgcttcaagcg

SEQ ID NO: 54692 - DNA, 25 bp, E. coli
aaagcttctgcactgaaacgtcacg

SEQ ID NO: 54693 - DNA, 25 bp, E. coli
tgaaaacgagcccttcgacgtagct

SEQ ID NO: 54694 - DNA, 25 bp, E. coli
tgaaaacgagccgttcgacgtagct

SEQ ID NO: 54695 - DNA, 25 bp, E. coli
cgttcctgcgaataagcaggtgttc

SEQ ID NO: 54696 - DNA, 25 bp, E. coli
cgttcctgcgaaaaagcaggtgttc

SEQ ID NO: 54697 - DNA, 25 bp, E. coli
cgactaccgaacctaagcgcgctaa

SEQ ID NO: 54698 - DNA, 25 bp, E. coli
cgactaccgaacgtaagcgcgctaa

SEQ ID NO: 54699 - DNA, 25 bp, E. coli
cgcttcaagcgtacctgcgaaaaag

SEQ ID NO: 54700 - DNA, 25 bp, E. coli
cgcttcaagcgttcctgcgaaaaag

SEQ ID NO: 54701 - DNA, 25 bp, E. coli
taagcgcgctaatgcttctgcagtg

SEQ ID NO: 54702 - DNA, 25 bp, E. coli
taagcgcgctaaagcttctgcagtg

SEQ ID NO: 54703 - DNA, 25 bp, E. coli
gagttctatgaataaccgactaccg

SEQ ID NO: 54704 - DNA, 25 bp, E. coli
gagttctatgaaaaaccgactaccg

SEQ ID NO: 54705 - DNA, 25 bp, E. coli
cagcttgagcaaaaagatggcgata

SEQ ID NO: 54706 - DNA, 25 bp, E. coli
cagcttgagcaataagatggcgata

SEQ ID NO: 54707 - DNA, 25 bp, E. coli
caaattgatcctgagatggtaaccg

SEQ ID NO: 54708 - DNA, 25 bp, E. coli
caaattgatcctcagatggtaaccg

SEQ ID NO: 54709 - DNA, 25 bp, E. coli
tactcgatttctttctctcgcggaa

SEQ ID NO: 54710 - DNA, 25 bp, E. coli
tactcgatttctatctctcgcggaa

SEQ ID NO: 54711 - DNA, 25 bp, E. coli
agaaccgcattatctgccgcagttg

SEQ ID NO: 54712 - DNA, 25 bp, E. coli
agaaccgcattaactgccgcagttg

SEQ ID NO: 54713 - DNA, 25 bp, E. coli
ttcttgagctgatcgtgaccttacc

SEQ ID NO: 54714 - DNA, 25 bp, E. coli
ttcttgagctgaacgtgaccttacc

SEQ ID NO: 54715 - DNA, 25 bp, E. coli
tgaccttaccggaagcagaagagct

SEQ ID NO: 54716 - DNA, 25 bp, E. coli
tgaccttaccggtagcagaagagct

SEQ ID NO: 54717 - DNA, 25 bp, E. coli
gccgcagttgcgaaaagatattctt

SEQ ID NO: 54718 - DNA, 25 bp, E. coli
gccgcagttgcgtaaagatattctt

SEQ ID NO: 54719 - DNA, 25 bp, E. coli
cgtcgcagcgatgcagaaccgcatt

SEQ ID NO: 54720 - DNA, 25 bp, E. coli
cgtcgcagcgatccagaaccgcatt

SEQ ID NO: 54721 - DNA, 25 bp, E. coli
gattattgttgcagaacgccgtcgc

SEQ ID NO: 54722 - DNA, 25 bp, E. coli
gattattgttgctgaacgccgtcgc

SEQ ID NO: 54723 - DNA, 25 bp, E. coli
gatggcgatatttctattcttgagc

SEQ ID NO: 54724 - DNA, 25 bp, E. coli
gatggtaaccgtacagcttgagcaa

SEQ ID NO: 54725 - DNA, 25 bp, E. coli
gatggtaaccgttcagcttgagcaa

SEQ ID NO: 54726 - DNA, 25 bp, E. coli
gatggcgatattactattcttgagc

SEQ ID NO: 54727 - DNA, 25 bp, E. coli
caaatgggcaaaaaagcagcggtct

SEQ ID NO: 54728 - DNA, 25 bp, E. coli
caaatgggcaaataagcagcggtct

SEQ ID NO: 54729 - DNA, 25 bp, E. coli
catgtctatatgaccgatgcgcagg

SEQ ID NO: 54730 - DNA, 25 bp, E. coli
catgtctatatgtccgatgcgcagg

SEQ ID NO: 54731 - DNA, 25 bp, E. coli
taaaaagcccacaggcggcgattcg

SEQ ID NO: 54732 - DNA, 25 bp, E. coli
taaaaagcccactggcggcgattcg

SEQ ID NO: 54733 - DNA, 25 bp, E. coli
tatggtgcgcgcagcacgttgcaaa

SEQ ID NO: 54734 - DNA, 25 bp, E. coli
tatggtgcgcgctgcacgttgcaaa

SEQ ID NO: 54735 - DNA, 25 bp, E. coli
tttgagcgtagggaaaccgaacgcg

SEQ ID NO: 54736 - DNA, 25 bp, E. coli
tttgagcgtaggcaaaccgaacgcg

SEQ ID NO: 54737 - DNA, 25 bp, E. coli
tattcgcgctggtatgacgtctggc

SEQ ID NO: 54738 - DNA, 25 bp, E. coli
tattcgcgctggaatgacgtctggc

SEQ ID NO: 54739 - DNA, 25 bp, E. coli
tttaacggcgaagtcacgctgcgca

SEQ ID NO: 54740 - DNA, 25 bp, E. coli
tttaacggcgaactcacgctgcgca

SEQ ID NO: 54741 - DNA, 25 bp, E. coli
gctaagcgccgatgtggatcaggaa

SEQ ID NO: 54742 - DNA, 25 bp, E. coli
gctaagcgccgaagtggatcaggaa

SEQ ID NO: 54743 - DNA, 25 bp, E. coli
gaaacgttactaggccaggcaagac

SEQ ID NO: 54744 - DNA, 25 bp, E. coli
gaaacgttactacgccaggcaagac

SEQ ID NO: 54745 - DNA, 25 bp, E. coli
ggcgcaggcgtttaatcagctacaa

SEQ ID NO: 54746 - DNA, 25 bp, E. coli
ggcgcaggcgttaaatcagctacaa

SEQ ID NO: 54747 - DNA, 25 bp, E. coli
tcaaagaagttaaaccgggcgtgcg

SEQ ID NO: 54748 - DNA, 25 bp, E. coli
tcaaagaagttataccgggcgtgcg

SEQ ID NO: 54749 - DNA, 25 bp, E. coli
cagggtgatccaacttctgttaggc

SEQ ID NO: 54750 - DNA, 25 bp, E. coli
cagggtgatccatcttctgttaggc

SEQ ID NO: 54751 - DNA, 25 bp, E. coli
catgggtgggtagcaaaacttggtc

SEQ ID NO: 54752 - DNA, 25 bp, E. coli
catgggtgggtaccaaaacttggtc

SEQ ID NO: 54753 - DNA, 25 bp, E. coli
aaagactatttgatccgatctcggg

SEQ ID NO: 54754 - DNA, 25 bp, E. coli
aaagactatttgttccgatctcggg

SEQ ID NO: 54755 - DNA, 25 bp, E. coli
tgaactggaaggaaaaacacgcgat

SEQ ID NO: 54756 - DNA, 25 bp, E. coli
tgaactggaaggtaaaacacgcgat

SEQ ID NO: 54757 - DNA, 25 bp, E. coli
tcaccgtggaacaaagaccgtatca

SEQ ID NO: 54758 - DNA, 25 bp, E. coli
tcaccgtggaactaagaccgtatca

SEQ ID NO: 54759 - DNA, 25 bp, E. coli
gcagagctacggttctacaacagaa

SEQ ID NO: 54760 - DNA, 25 bp, E. coli
gcagagctacggatctacaacagaa

SEQ ID NO: 54761 - DNA, 25 bp, E. coli
cggcagccctgtgcaatttgagata

SEQ ID NO: 54762 - DNA, 25 bp, E. coli
cggcagccctgtccaatttgagata

SEQ ID NO: 54763 - DNA, 25 bp, E. coli
tggaaagcacagaccgttatctggg

SEQ ID NO: 54764 - DNA, 25 bp, E. coli
tggaaagcacagtccgttatctggg

SEQ ID NO: 54765 - DNA, 25 bp, E. coli
taaccaaagggacaagagaagctgt

SEQ ID NO: 54766 - DNA, 25 bp, E. coli
tcaacatggccttggacagtaagct

SEQ ID NO: 54767 - DNA, 25 bp, E. coli
tcaacatggcctaggacagtaagct

SEQ ID NO: 54768 - DNA, 25 bp, E. coli
taaccaaagggagaagagaagctgt

SEQ ID NO: 54769 - DNA, 25 bp, E. coli
gatctcgggtcggtactaaccaaca

SEQ ID NO: 54770 - DNA, 25 bp, E. coli
gatctcgggtcgctactaaccaaca

SEQ ID NO: 54771 - DNA, 25 bp, E. coli
catctccagagaagtactacaagtt

SEQ ID NO: 54772 - DNA, 25 bp, E. coli
catctccagagatgtactacaagtt

SEQ ID NO: 54773 - DNA, 25 bp, E. coli
taaaatcctctagaaaatccgagtg

SEQ ID NO: 54774 - DNA, 25 bp, E. coli
aacgtgttatggaaggtatgatgcc

SEQ ID NO: 54775 - DNA, 25 bp, E. coli
aacgtgttatggtaggtatgatgcc

SEQ ID NO: 54776 - DNA, 25 bp, E. coli
taggcttcgtacatctacaatctgt

SEQ ID NO: 54777 - DNA, 25 bp, E. coli
tagctacagagcatgtgaactcagt

SEQ ID NO: 54778 - DNA, 25 bp, E. coli
tagctacagagcttgtgaactcagt

SEQ ID NO: 54779 - DNA, 25 bp, E. coli
tatgatgcctgaagaaccaaaagcc

SEQ ID NO: 54780 - DNA, 25 bp, E. coli
taggcttcgtacttctacaatctgt

SEQ ID NO: 54781 - DNA, 25 bp, E. coli
tatgatgcctgatgaaccaaaagcc

SEQ ID NO: 54782 - DNA, 25 bp, E. coli
tgaactcagtgtagaatacatcctg

SEQ ID NO: 54783 - DNA, 25 bp, E. coli
tgaactcagtgttgaatacatcctg

SEQ ID NO: 54784 - DNA, 25 bp, E. coli
tctatgttaatcaacgaggagctgg

SEQ ID NO: 54785 - DNA, 25 bp, E. coli
tctatgttaatctacgaggagctgg

SEQ ID NO: 54786 - DNA, 25 bp, E. coli
gaagcggaagttgctaaatcagtct

SEQ ID NO: 54787 - DNA, 25 bp, E. coli
gaagcggaagttcctaaatcagtct

SEQ ID NO: 54788 - DNA, 25 bp, E. coli
gggtgtatccactcgcagtatcact

SEQ ID NO: 54789 - DNA, 25 bp, E. coli
gggtgtatccacacgcagtatcact

SEQ ID NO: 54790 - DNA, 25 bp, E. coli
tcactaccaagaaaaagatcctgcg

SEQ ID NO: 54791 - DNA, 25 bp, E. coli
tcactaccaagataaagatcctgcg

SEQ ID NO: 54792 - DNA, 25 bp, E. coli
taaaatcctctacaaaatccgagtg

SEQ ID NO: 54793 - DNA, 25 bp, E. coli
tacagcgccagagaggataggagaa

SEQ ID NO: 54794 - DNA, 25 bp, E. coli
tacagcgccagacaggataggagaa

SEQ ID NO: 54795 - DNA, 25 bp, E. coli
taaaagacagagtaattatatcaac

SEQ ID NO: 54796 - DNA, 25 bp, E. coli
ttctccagatactacttaccgagag

SEQ ID NO: 54797 - DNA, 25 bp, E. coli
ttctccagatacaacttaccgagag

SEQ ID NO: 54798 - DNA, 25 bp, E. coli
tgatctgttaaaaaacgattataaa

SEQ ID NO: 54799 - DNA, 25 bp, E. coli
tgatctgttaaataacgattataaa

SEQ ID NO: 54800 - DNA, 25 bp, E. coli
tatcaacttttcacgcagaaaaagt

SEQ ID NO: 54801 - DNA, 25 bp, E. coli
tatcaacttttctcgcagaaaaagt

SEQ ID NO: 54802 - DNA, 25 bp, E. coli
gcattacagcgcgagacaggatagg

SEQ ID NO: 54803 - DNA, 25 bp, E. coli
gcattacagcgccagacaggatagg

SEQ ID NO: 54804 - DNA, 25 bp, E. coli
gcacagcgtagcattacagcgccag

SEQ ID NO: 54805 - DNA, 25 bp, E. coli
gcacagcgtagctttacagcgccag

SEQ ID NO: 54806 - DNA, 25 bp, E. coli
gaaattatatcaacttttcacgcag

SEQ ID NO: 54807 - DNA, 25 bp, E. coli
gaaattatatcatcttttcacgcag

SEQ ID NO: 54808 - DNA, 25 bp, E. coli
gttatcatggaagattactgacggg

SEQ ID NO: 54809 - DNA, 25 bp, E. coli
gttatcatggaacattactgacggg

SEQ ID NO: 54810 - DNA, 25 bp, E. coli
ggatctaaattccaaattaaataca

SEQ ID NO: 54811 - DNA, 25 bp, E. coli
ggatctaaattcgaaattaaataca

SEQ ID NO: 54812 - DNA, 25 bp, E. coli
taaaagacagagaaattatatcaac

SEQ ID NO: 54813 - DNA, 25 bp, E. coli
gattataaaattaccctttctccag

SEQ ID NO: 54814 - DNA, 25 bp, E. coli
gattataaaatttccctttctccag

SEQ ID NO: 54815 - DNA, 25 bp, E. coli
cacgaactttgcgagcgatggatgc

SEQ ID NO: 54816 - DNA, 25 bp, E. coli
cacgaactttgccagcgatggatgc

SEQ ID NO: 54817 - DNA, 25 bp, E. coli
tacggaagttctcgacggcgacatt

SEQ ID NO: 54818 - DNA, 25 bp, E. coli
tacggaagttctggacggcgacatt

SEQ ID NO: 54819 - DNA, 25 bp, E. coli
aaataaattataggctttcagaggg

SEQ ID NO: 54820 - DNA, 25 bp, E. coli
aaataaattatacgctttcagaggg

SEQ ID NO: 54821 - DNA, 25 bp, E. coli
tatgaatgccaagagacaggtattg

SEQ ID NO: 54822 - DNA, 25 bp, E. coli
tatgaatgccaacagacaggtattg

SEQ ID NO: 54823 - DNA, 25 bp, E. coli
tttcagcgaatatacggtctggcct

SEQ ID NO: 54824 - DNA, 25 bp, E. coli
tttcagcgaataaacggtctggcct

SEQ ID NO: 54825 - DNA, 25 bp, E. coli
ttgatactcaaatacatactgtccg

SEQ ID NO: 54826 - DNA, 25 bp, E. coli
ttgatactcaaaaacatactgtccg

SEQ ID NO: 54827 - DNA, 25 bp, E. coli
gcactacaacagctttacggaagtt

SEQ ID NO: 54828 - DNA, 25 bp, E. coli
gcactacaacaggtttacggaagtt

SEQ ID NO: 54829 - DNA, 25 bp, E. coli
cattacgaggtaagaataatgcggc

SEQ ID NO: 54830 - DNA, 25 bp, E. coli
cattacgaggtatgaataatgcggc

SEQ ID NO: 54831 - DNA, 25 bp, E. coli
ggacggcgacattctttcgtatgaa

SEQ ID NO: 54832 - DNA, 25 bp, E. coli
ggacggcgacatactttcgtatgaa

SEQ ID NO: 54833 - DNA, 25 bp, E. coli
taatgcggctatagctaactggaga

SEQ ID NO: 54834 - DNA, 25 bp, E. coli
taactggagagatcaactttcagcg

SEQ ID NO: 54835 - DNA, 25 bp, E. coli
taatgcggctattgctaactggaga

SEQ ID NO: 54836 - DNA, 25 bp, E. coli
taactggagagaacaactttcagcg

SEQ ID NO: 54837 - DNA, 25 bp, E. coli
ttaacggtacgggaccacacttcgg

SEQ ID NO: 54838 - DNA, 25 bp, E. coli
cagcagtgtcttaattctatgagcg

SEQ ID NO: 54839 - DNA, 25 bp, E. coli
cagcagtgtctttattctatgagcg

SEQ ID NO: 54840 - DNA, 25 bp, E. coli
ttaacggtacggcaccacacttcgg

SEQ ID NO: 54841 - DNA, 25 bp, E. coli
gaaatgttcgcgctggtactttttg

SEQ ID NO: 54842 - DNA, 25 bp, E. coli
gaaatgttcgcggtggtactttttg

SEQ ID NO: 54843 - DNA, 25 bp, E. coli
tattctatgagcgatcaacggatcc

SEQ ID NO: 54844 - DNA, 25 bp, E. coli
tattctatgagccatcaacggatcc

SEQ ID NO: 54845 - DNA, 25 bp, E. coli
ttgctacctggaaggcggttgtgaa

SEQ ID NO: 54846 - DNA, 25 bp, E. coli
ttgctacctggatggcggttgtgaa

SEQ ID NO: 54847 - DNA, 25 bp, E. coli
tgtaaaatctctgctaaacttaacg

SEQ ID NO: 54848 - DNA, 25 bp, E. coli
tgtaaaatctctcctaaacttaacg

SEQ ID NO: 54849 - DNA, 25 bp, E. coli
tccgattgaggattttatagatggt

SEQ ID NO: 54850 - DNA, 25 bp, E. coli
tccgattgaggaatttatagatggt

SEQ ID NO: 54851 - DNA, 25 bp, E. coli
tctacaacacggtacagcagtgtct

SEQ ID NO: 54852 - DNA, 25 bp, E. coli
tctacaacacggaacagcagtgtct

SEQ ID NO: 54853 - DNA, 25 bp, E. coli
gattttatagatcgtttctggcgac

SEQ ID NO: 54854 - DNA, 25 bp, E. coli
gattttatagatggtttctggcgac

SEQ ID NO: 54855 - DNA, 25 bp, E. coli
gggatgaaatgtacgcgctggtact

SEQ ID NO: 54856 - DNA, 25 bp, E. coli
gggatgaaatgttcgcgctggtact

SEQ ID NO: 54857 - DNA, 25 bp, E. coli
tactttttgtttgctacctggatgg

SEQ ID NO: 54858 - DNA, 25 bp, E. coli
tactttttgtttcctacctggatgg

SEQ ID NO: 54859 - DNA, 25 bp, E. coli
tatgccgacgttatcattgagccga

SEQ ID NO: 54860 - DNA, 25 bp, E. coli
tatgccgacgttttcattgagccga

SEQ ID NO: 54861 - DNA, 25 bp, E. coli
ttgtgattcacagcgcccttcagtg

SEQ ID NO: 54862 - DNA, 25 bp, E. coli
ttgtgattcacaccgcccttcagtg

SEQ ID NO: 54863 - DNA, 25 bp, E. coli
tgaggactgtttcatccacgatgct

SEQ ID NO: 54864 - DNA, 25 bp, E. coli
tgaggactgtttgatccacgatgct

SEQ ID NO: 54865 - DNA, 25 bp, E. coli
gccaagaccgtttcatcgcataaag

SEQ ID NO: 54866 - DNA, 25 bp, E. coli
gccaagaccgttacatcgcataaag

SEQ ID NO: 54867 - DNA, 25 bp, E. coli
gaatctctcgaccatatccttggcg

SEQ ID NO: 54868 - DNA, 25 bp, E. coli
gcaggtcagggatccattcaaatct

SEQ ID NO: 54869 - DNA, 25 bp, E. coli
gaatctctcgacgatatccttggcg

SEQ ID NO: 54870 - DNA, 25 bp, E. coli
gcaggtcagggaaccattcaaatct

SEQ ID NO: 54871 - DNA, 25 bp, E. coli
gaaaccgttgatcaccttgccatag

SEQ ID NO: 54872 - DNA, 25 bp, E. coli
gaaaccgttgatgaccttgccatag

SEQ ID NO: 54873 - DNA, 25 bp, E. coli
ccgactgacggaaaatgtgactaat

SEQ ID NO: 54874 - DNA, 25 bp, E. coli
ccgactgacggataatgtgactaat

SEQ ID NO: 54875 - DNA, 25 bp, E. coli
cattgagccgaaccgaatcgagtat

SEQ ID NO: 54876 - DNA, 25 bp, E. coli
cattgagccgaagcgaatcgagtat

SEQ ID NO: 54877 - DNA, 25 bp, E. coli
ggttatctaccaagtcgtccgactg

SEQ ID NO: 54878 - DNA, 25 bp, E. coli
ggttatctaccatgtcgtccgactg

SEQ ID NO: 54879 - DNA, 25 bp, E. coli
taaccgggtatctgttgagtagagg

SEQ ID NO: 54880 - DNA, 25 bp, E. coli
taaccgggtatcagttgagtagagg

SEQ ID NO: 54881 - DNA, 25 bp, E. coli
cagtctgccaattcgaaaacgctcc

SEQ ID NO: 54882 - DNA, 25 bp, E. coli
cagtctgccaatacgaaaacgctcc

SEQ ID NO: 54883 - DNA, 25 bp, E. coli
aaatggcgcgctaactggctatggc

SEQ ID NO: 54884 - DNA, 25 bp, E. coli
aaatggcgcgcttactggctatggc

SEQ ID NO: 54885 - DNA, 25 bp, E. coli
tatccagaggagataaaaatggctg

SEQ ID NO: 54886 - DNA, 25 bp, E. coli
taccgatagcagtagagagtggcag

SEQ ID NO: 54887 - DNA, 25 bp, E. coli
taccgatagcagaagagagtggcag

SEQ ID NO: 54888 - DNA, 25 bp, E. coli
tatccagaggagttaaaaatggctg

SEQ ID NO: 54889 - DNA, 25 bp, E. coli
tatagagatacgagtaaatggcgcg

SEQ ID NO: 54890 - DNA, 25 bp, E. coli
tatagagatacgtgtaaatggcgcg

SEQ ID NO: 54891 - DNA, 25 bp, E. coli
tatatgaaatagacgagctctgtgc

SEQ ID NO: 54892 - DNA, 25 bp, E. coli
tatatgaaatagtcgagctctgtgc

SEQ ID NO: 54893 - DNA, 25 bp, E. coli
ttaatttctgccgagctcgctggga

SEQ ID NO: 54894 - DNA, 25 bp, E. coli
ttaatttctgcccagctcgctggga

SEQ ID NO: 54895 - DNA, 25 bp, E. coli
gctcagtttatccagttccccgtta

SEQ ID NO: 54896 - DNA, 25 bp, E. coli
gctcagtttatcgagttccccgtta

SEQ ID NO: 54897 - DNA, 25 bp, E. coli
ggttagataaagacacagtctgcca

SEQ ID NO: 54898 - DNA, 25 bp, E. coli
ggttagataaagtcacagtctgcca

SEQ ID NO: 54899 - DNA, 25 bp, E. coli
gagattcattctaggttatcagggc

SEQ ID NO: 54900 - DNA, 25 bp, E. coli
gagtccagctcaaccactgataaga

SEQ ID NO: 54901 - DNA, 25 bp, E. coli
gagtccagctcatccactgataaga

SEQ ID NO: 54902 - DNA, 25 bp, E. coli
gagattcattcttggttatcagggc

SEQ ID NO: 54903 - DNA, 25 bp, E. coli
catgccaattactgctataaatcta

SEQ ID NO: 54904 - DNA, 25 bp, E. coli
catgccaattacagctataaatcta

SEQ ID NO: 54905 - DNA, 25 bp, E. coli
cttggctcggcgagagttagagtta

SEQ ID NO: 54906 - DNA, 25 bp, E. coli
cttggctcggcgtgagttagagtta

SEQ ID NO: 54907 - DNA, 25 bp, E. coli
atttcagcgaaaataaaagtccctg

SEQ ID NO: 54908 - DNA, 25 bp, E. coli
atttcagcgaaattaaaagtccctg

SEQ ID NO: 54909 - DNA, 25 bp, E. coli
aaatagtctacatgccaattacagc

SEQ ID NO: 54910 - DNA, 25 bp, E. coli
aaatagtctacaagccaattacagc

SEQ ID NO: 54911 - DNA, 25 bp, E. coli
tatttattgagaaatctgacccaga

SEQ ID NO: 54912 - DNA, 25 bp, E. coli
tatttattgagatatctgacccaga

SEQ ID NO: 54913 - DNA, 25 bp, E. coli
tgagttagagttaagggaaattcct

SEQ ID NO: 54914 - DNA, 25 bp, E. coli
tgagttagagtttagggaaattcct

SEQ ID NO: 54915 - DNA, 25 bp, E. coli
tctaagcaaggttggttaatttcag

SEQ ID NO: 54916 - DNA, 25 bp, E. coli
tctgacccagaaggttttattaata

SEQ ID NO: 54917 - DNA, 25 bp, E. coli
tctaagcaaggtaggttaatttcag

SEQ ID NO: 54918 - DNA, 25 bp, E. coli
tctgacccagaacgttttattaata

SEQ ID NO: 54919 - DNA, 25 bp, E. coli
cctgaaacttttgagcctgatatga

SEQ ID NO: 54920 - DNA, 25 bp, E. coli
cctgaaacttttcagcctgatatga

SEQ ID NO: 54921 - DNA, 25 bp, E. coli
ctattagtattggttctaagcaagg

SEQ ID NO: 54922 - DNA, 25 bp, E. coli
ctattagtattgcttctaagcaagg

SEQ ID NO: 54923 - DNA, 25 bp, E. coli
tggctcttgacttggctcggcgtga

SEQ ID NO: 54924 - DNA, 25 bp, E. coli
tggctcttgactaggctcggcgtga

SEQ ID NO: 54925 - DNA, 25 bp, E. coli
cacatcacgaatcacgcagagtatg

SEQ ID NO: 54926 - DNA, 25 bp, E. coli
caaactgacacgatactacagagag

SEQ ID NO: 54927 - DNA, 25 bp, E. coli
cacatcacgaatgacgcagagtatg

SEQ ID NO: 54928 - DNA, 25 bp, E. coli
caaactgacacgttactacagagag

SEQ ID NO: 54929 - DNA, 25 bp, E. coli
ttactacagagacaacaaagaatga

SEQ ID NO: 54930 - DNA, 25 bp, E. coli
ttactacagagagaacaaagaatga

SEQ ID NO: 54931 - DNA, 25 bp, E. coli
tgtgcgcgcaaaaatcctaacgacg

SEQ ID NO: 54932 - DNA, 25 bp, E. coli
tgtgcgcgcaaatatcctaacgacg

SEQ ID NO: 54933 - DNA, 25 bp, E. coli
tgcacatcatttctaaagcgccatt

SEQ ID NO: 54934 - DNA, 25 bp, E. coli
tgcacatcatttgtaaagcgccatt

SEQ ID NO: 54935 - DNA, 25 bp, E. coli
gccatttgaagagtgtgcgcgcaaa

SEQ ID NO: 54936 - DNA, 25 bp, E. coli
gccatttgaagactgtgcgcgcaaa

SEQ ID NO: 54937 - DNA, 25 bp, E. coli
gcagagtatgactaactgacacgtt

SEQ ID NO: 54938 - DNA, 25 bp, E. coli
gcaaatatcctaacgacgctctggc

SEQ ID NO: 54939 - DNA, 25 bp, E. coli
gcaaatatcctatcgacgctctggc

SEQ ID NO: 54940 - DNA, 25 bp, E. coli
gcagagtatgacaaactgacacgtt

SEQ ID NO: 54941 - DNA, 25 bp, E. coli
ctaaagcgccatttgaagagtgtgc

SEQ ID NO: 54942 - DNA, 25 bp, E. coli
ctaaagcgccatatgaagagtgtgc

SEQ ID NO: 54943 - DNA, 25 bp, E. coli
ggctctacactctttgtatcgggtt

SEQ ID NO: 54944 - DNA, 25 bp, E. coli
ggctctacactcattgtatcgggtt

SEQ ID NO: 54945 - DNA, 25 bp, E. coli
gacgctctggctgtacactcattgt

SEQ ID NO: 54946 - DNA, 25 bp, E. coli
gacgctctggctctacactcattgt

SEQ ID NO: 54947 - DNA, 25 bp, E. coli
caaaaagcgactgatgccactgagg

SEQ ID NO: 54948 - DNA, 25 bp, E. coli
caaatattaccctgacggcgctgac

SEQ ID NO: 54949 - DNA, 25 bp, E. coli
caaaaagcgactcatgccactgagg

SEQ ID NO: 54950 - DNA, 25 bp, E. coli
caaatattacccagacggcgctgac

SEQ ID NO: 54951 - DNA, 25 bp, E. coli
caaatgtggctgttgcaacgacggc

SEQ ID NO: 54952 - DNA, 25 bp, E. coli
caaatgtggctgatgcaacgacggc

SEQ ID NO: 54953 - DNA, 25 bp, E. coli
catacccggagaactgctgacagat

SEQ ID NO: 54954 - DNA, 25 bp, E. coli
catacccggagatctgctgacagat

SEQ ID NO: 54955 - DNA, 25 bp, E. coli
taaaggcgaaactggtccagtgggc

SEQ ID NO: 54956 - DNA, 25 bp, E. coli
taaaggcgaaacaggtccagtgggc

SEQ ID NO: 54957 - DNA, 25 bp, E. coli
tattcgtcgcctgaatgaagacacg

SEQ ID NO: 54958 - DNA, 25 bp, E. coli
tattcgtcgcctcaatgaagacacg

SEQ ID NO: 54959 - DNA, 25 bp, E. coli
ttaagcagcgcatcggacagtgatg

SEQ ID NO: 54960 - DNA, 25 bp, E. coli
ttaagcagcgcaacggacagtgatg

SEQ ID NO: 54961 - DNA, 25 bp, E. coli
tgatgatgaaaccaaggctgccacc

SEQ ID NO: 54962 - DNA, 25 bp, E. coli
tgatgatgaaacgaaggctgccacc

SEQ ID NO: 54963 - DNA, 25 bp, E. coli
tgccggagagtctgaaaaagccgcc

SEQ ID NO: 54964 - DNA, 25 bp, E. coli
tgccggagagtcagaaaaagccgcc

SEQ ID NO: 54965 - DNA, 25 bp, E. coli
gaatgcagaggatagctcgacccgt

SEQ ID NO: 54966 - DNA, 25 bp, E. coli
gaatgcagaggaaagctcgacccgt

SEQ ID NO: 54967 - DNA, 25 bp, E. coli
gacacggcgacataaaacactcagg

SEQ ID NO: 54968 - DNA, 25 bp, E. coli
gacacggcgacaaaaaacactcagg

SEQ ID NO: 54969 - DNA, 25 bp, E. coli
aagttaccccattttgacgcagtga

SEQ ID NO: 54970 - DNA, 25 bp, E. coli
aagttaccccatattgacgcagtga

SEQ ID NO: 54971 - DNA, 25 bp, E. coli
cattaccttttaagggacggcggca

SEQ ID NO: 54972 - DNA, 25 bp, E. coli
cattaccttttatgggacggcggca

SEQ ID NO: 54973 - DNA, 25 bp, E. coli
tacatgaacatatatcctgcggcgt

SEQ ID NO: 54974 - DNA, 25 bp, E. coli
taaaagccgcgcgaacgatggcgct

SEQ ID NO: 54975 - DNA, 25 bp, E. coli
tacatgaacataaatcctgcggcgt

SEQ ID NO: 54976 - DNA, 25 bp, E. coli
taaaagccgcgccaacgatggcgct

SEQ ID NO: 54977 - DNA, 25 bp, E. coli
tattgtcccgggttggaacgctcta

SEQ ID NO: 54978 - DNA, 25 bp, E. coli
tattctgcgtgcaaatcgcgggccg

SEQ ID NO: 54979 - DNA, 25 bp, E. coli
tattgtcccgggatggaacgctcta

SEQ ID NO: 54980 - DNA, 25 bp, E. coli
tattctgcgtgctaatcgcgggccg

SEQ ID NO: 54981 - DNA, 25 bp, E. coli
ttccaatttgcatcgtggcggcgcg

SEQ ID NO: 54982 - DNA, 25 bp, E. coli
ttccaatttgcaacgtggcggcgcg

SEQ ID NO: 54983 - DNA, 25 bp, E. coli
tgcccgggcgcgagacaaattgcgt

SEQ ID NO: 54984 - DNA, 25 bp, E. coli
tgcccgggcgcgtgacaaattgcgt

SEQ ID NO: 54985 - DNA, 25 bp, E. coli
gccagtatcacaccacaggagcgtg

SEQ ID NO: 54986 - DNA, 25 bp, E. coli
gccagtatcacagcacaggagcgtg

SEQ ID NO: 54987 - DNA, 25 bp, E. coli
gaacgcgcatatactggtgcaggaa

SEQ ID NO: 54988 - DNA, 25 bp, E. coli
gaacgcgcatattctggtgcaggaa

SEQ ID NO: 54989 - DNA, 25 bp, E. coli
taatcgacatggacggtggtgcgcc

SEQ ID NO: 54990 - DNA, 25 bp, E. coli
taatcgacatggtcggtggtgcgcc

SEQ ID NO: 54991 - DNA, 25 bp, E. coli
aatgggcacgactgggtattcaggc

SEQ ID NO: 54992 - DNA, 25 bp, E. coli
aatgggcacgacagggtattcaggc

SEQ ID NO: 54993 - DNA, 25 bp, E. coli
cagattgtaatgtgaagtataaaac

SEQ ID NO: 54994 - DNA, 25 bp, E. coli
cagattgtaatgagaagtataaaac

SEQ ID NO: 54995 - DNA, 25 bp, E. coli
aagctgtctggttgatttttattgc

SEQ ID NO: 54996 - DNA, 25 bp, E. coli
aagctgtctggtagatttttattgc

SEQ ID NO: 54997 - DNA, 25 bp, E. coli
tagttcgagagagcagacaactgcg

SEQ ID NO: 54998 - DNA, 25 bp, E. coli
tagttcgagagaccagacaactgcg

SEQ ID NO: 54999 - DNA, 25 bp, E. coli
tattcaggcaacgtcgctgaggagg

SEQ ID NO: 55000 - DNA, 25 bp, E. coli
tattcaggcaacctcgctgaggagg

SEQ ID NO: 55001 - DNA, 25 bp, E. coli
tttattgccagttgttcgagagagc

SEQ ID NO: 55002 - DNA, 25 bp, E. coli
tttattgccagtagttcgagagagc

SEQ ID NO: 55003 - DNA, 25 bp, E. coli
tgtaacggacatcaagctgtctggt

SEQ ID NO: 55004 - DNA, 25 bp, E. coli
tgattagtcctgcatgtaacggaca

SEQ ID NO: 55005 - DNA, 25 bp, E. coli
tgtaacggacatgaagctgtctggt

SEQ ID NO: 55006 - DNA, 25 bp, E. coli
tgattagtcctggatgtaacggaca

SEQ ID NO: 55007 - DNA, 25 bp, E. coli
tccgatggaaaattgggcacgacag

SEQ ID NO: 55008 - DNA, 25 bp, E. coli
tccgatggaaaaatgggcacgacag

SEQ ID NO: 55009 - DNA, 25 bp, E. coli
gcagacaactgcctccgatggaaaa

SEQ ID NO: 55010 - DNA, 25 bp, E. coli
gcagacaactgcgtccgatggaaaa

SEQ ID NO: 55011 - DNA, 25 bp, E. coli
cgctgaggaggcatatggtacagat

SEQ ID NO: 55012 - DNA, 25 bp, E. coli
cgctgaggaggcttatggtacagat

SEQ ID NO: 55013 - DNA, 25 bp, E. coli
ctctgccaaccacgaatcggtttat

SEQ ID NO: 55014 - DNA, 25 bp, E. coli
ctctgccaaccaggaatcggtttat

SEQ ID NO: 55015 - DNA, 25 bp, E. coli
atgagcgcaccgtcagtcacggcct

SEQ ID NO: 55016 - DNA, 25 bp, E. coli
atgagcgcaccgacagtcacggcct

SEQ ID NO: 55017 - DNA, 25 bp, E. coli
tttcgccagcgtggttagtcagtag

SEQ ID NO: 55018 - DNA, 25 bp, E. coli
tttcgccagcgtcgttagtcagtag

SEQ ID NO: 55019 - DNA, 25 bp, E. coli
ttgtcaacgataggttgcgccagca

SEQ ID NO: 55020 - DNA, 25 bp, E. coli
ttgtcaacgatacgttgcgccagca

SEQ ID NO: 55021 - DNA, 25 bp, E. coli
ttattcactcatcgcatcgcgccag

SEQ ID NO: 55022 - DNA, 25 bp, E. coli
ttattcactcatggcatcgcgccag

SEQ ID NO: 55023 - DNA, 25 bp, E. coli
tgctcggcaaactgcatttcgccag

SEQ ID NO: 55024 - DNA, 25 bp, E. coli
tgctcggcaaacagcatttcgccag

SEQ ID NO: 55025 - DNA, 25 bp, E. coli
tccgtaatgtcgttgagcgcaccgt

SEQ ID NO: 55026 - DNA, 25 bp, E. coli
tccgtaatgtcgatgagcgcaccgt

SEQ ID NO: 55027 - DNA, 25 bp, E. coli
tcgccggcggttagcggaactgtct

SEQ ID NO: 55028 - DNA, 25 bp, E. coli
tcgccggcggtttgcggaactgtct

SEQ ID NO: 55029 - DNA, 25 bp, E. coli
gcatcgcgccagatcttgtcaacga

SEQ ID NO: 55030 - DNA, 25 bp, E. coli
gcatcgcgccagttcttgtcaacga

SEQ ID NO: 55031 - DNA, 25 bp, E. coli
cgaaaaatggtgctcggcaaacagc

SEQ ID NO: 55032 - DNA, 25 bp, E. coli
cgaaaaatggtggtcggcaaacagc

SEQ ID NO: 55033 - DNA, 25 bp, E. coli
cattcaatgaagagccgcgcacagc

SEQ ID NO: 55034 - DNA, 25 bp, E. coli
cattcaatgaagtgccgcgcacagc

SEQ ID NO: 55035 - DNA, 25 bp, E. coli
cagttttccttcttcatatttcagg

SEQ ID NO: 55036 - DNA, 25 bp, E. coli
caggctaaggtgatcgccttatcag

SEQ ID NO: 55037 - DNA, 25 bp, E. coli
catatttcaggcaaaggtgatcgcc

SEQ ID NO: 55038 - DNA, 25 bp, E. coli
cagttttccttcatcatatttcagg

SEQ ID NO: 55039 - DNA, 25 bp, E. coli
caggctaaggtgttcgccttatcag

SEQ ID NO: 55040 - DNA, 25 bp, E. coli
catatttcaggctaaggtgatcgcc

SEQ ID NO: 55041 - DNA, 25 bp, E. coli
tatttcaggctatggtgatcgcctt

SEQ ID NO: 55042 - DNA, 25 bp, E. coli
tatttcaggctaaggtgatcgcctt

SEQ ID NO: 55043 - DNA, 25 bp, E. coli
ttcaggctaaggagatcgccttatc

SEQ ID NO: 55044 - DNA, 25 bp, E. coli
ttcaggctaaggtgatcgccttatc

SEQ ID NO: 55045 - DNA, 25 bp, E. coli
tcatatttcaggctaaggtgatcgc

SEQ ID NO: 55046 - DNA, 25 bp, E. coli
tcatatttcagggtaaggtgatcgc

SEQ ID NO: 55047 - DNA, 25 bp, E. coli
cttcatcatatttcaggctaaggtg

SEQ ID NO: 55048 - DNA, 25 bp, E. coli
cttcatcatattacaggctaaggtg

SEQ ID NO: 55049 - DNA, 25 bp, E. coli
gtgatgcagaaatcacctggcattc

SEQ ID NO: 55050 - DNA, 25 bp, E. coli
gtgatgcagaaaacacctggcattc

SEQ ID NO: 55051 - DNA, 25 bp, E. coli
ggctaaggtgatggccttatcagtg

SEQ ID NO: 55052 - DNA, 25 bp, E. coli
ggcattcttcagttttccttcatca

SEQ ID NO: 55053 - DNA, 25 bp, E. coli
ggctaaggtgatcgccttatcagtg

SEQ ID NO: 55054 - DNA, 25 bp, E. coli
ggcattcttcagatttccttcatca

SEQ ID NO: 55055 - DNA, 25 bp, E. coli
gatgcagaaatctcctggcattctt

SEQ ID NO: 55056 - DNA, 25 bp, E. coli
gatgcagaaatcacctggcattctt

SEQ ID NO: 55057 - DNA, 25 bp, E. coli
gctcctgggattttcaactggtgga

SEQ ID NO: 55058 - DNA, 25 bp, E. coli
gcgatattgtgcagccgaagccgcg

SEQ ID NO: 55059 - DNA, 25 bp, E. coli
gcgatattgtgctgccgaagccgcg

SEQ ID NO: 55060 - DNA, 25 bp, E. coli
gctaccaacgtctgcgtcgaatcga

SEQ ID NO: 55061 - DNA, 25 bp, E. coli
gctacttagatctcgccgggtttga

SEQ ID NO: 55062 - DNA, 25 bp, E. coli
gctaccaacgtcagcgtcgaatcga

SEQ ID NO: 55063 - DNA, 25 bp, E. coli
gctcctgggattatcaactggtgga

SEQ ID NO: 55064 - DNA, 25 bp, E. coli
gctacttagatcacgccgggtttga

SEQ ID NO: 55065 - DNA, 25 bp, E. coli
gaaattgctggcgaaaggctcctgg

SEQ ID NO: 55066 - DNA, 25 bp, E. coli
gaaattgctggccaaaggctcctgg

SEQ ID NO: 55067 - DNA, 25 bp, E. coli
gaaagccgcgttgttcaatatcgaa

SEQ ID NO: 55068 - DNA, 25 bp, E. coli
gaaaccttttttggctgggtcagcg

SEQ ID NO: 55069 - DNA, 25 bp, E. coli
gaaaccttttttcgctgggtcagcg

SEQ ID NO: 55070 - DNA, 25 bp, E. coli
gaaagccgcgttcttcaatatcgaa

SEQ ID NO: 55071 - DNA, 25 bp, E. coli
cgctgatcgtggtggatatgcaaaa

SEQ ID NO: 55072 - DNA, 25 bp, E. coli
cgctgatcgtggaggatatgcaaaa

SEQ ID NO: 55073 - DNA, 25 bp, E. coli
cattgccaacattcaaaccgccgtg

SEQ ID NO: 55074 - DNA, 25 bp, E. coli
cattgccaacatacaaaccgccgtg

SEQ ID NO: 55075 - DNA, 25 bp, E. coli
gatcatctggttacaaaatggctgg

SEQ ID NO: 55076 - DNA, 25 bp, E. coli
gatcatctggtttcaaaatggctgg

SEQ ID NO: 55077 - DNA, 25 bp, E. coli
ggaagccattaccttcgatccgcag

SEQ ID NO: 55078 - DNA, 25 bp, E. coli
ggaagccattacgttcgatccgcag

SEQ ID NO: 55079 - DNA, 25 bp, E. coli
cagtattctcgggtattggctgaag

SEQ ID NO: 55080 - DNA, 25 bp, E. coli
cagtattctcggctattggctgaag

SEQ ID NO: 55081 - DNA, 25 bp, E. coli
tactccttatttcccgtgtggttag

SEQ ID NO: 55082 - DNA, 25 bp, E. coli
tactccttatttgccgtgtggttag

SEQ ID NO: 55083 - DNA, 25 bp, E. coli
atgtgacgatactttctggaatggc

SEQ ID NO: 55084 - DNA, 25 bp, E. coli
atgtgacgatacattctggaatggc

SEQ ID NO: 55085 - DNA, 25 bp, E. coli
aaagagttactcgttatttgccgtg

SEQ ID NO: 55086 - DNA, 25 bp, E. coli
aaagagttactccttatttgccgtg

SEQ ID NO: 55087 - DNA, 25 bp, E. coli
tctggaatggcactattctcggcta

SEQ ID NO: 55088 - DNA, 25 bp, E. coli
tctggaatggcagtattctcggcta

SEQ ID NO: 55089 - DNA, 25 bp, E. coli
gctttacatcggtaagggtagggat

SEQ ID NO: 55090 - DNA, 25 bp, E. coli
gctttacatcggaaagggtagggat

SEQ ID NO: 55091 - DNA, 25 bp, E. coli
gaagtatacccatacccggaaagag

SEQ ID NO: 55092 - DNA, 25 bp, E. coli
gaagtatacccaaacccggaaagag

SEQ ID NO: 55093 - DNA, 25 bp, E. coli
ctcggctattggctgaagtataccc

SEQ ID NO: 55094 - DNA, 25 bp, E. coli
ctcggctattgggtgaagtataccc

SEQ ID NO: 55095 - DNA, 25 bp, E. coli
tggctgaagtattcccatacccgga

SEQ ID NO: 55096 - DNA, 25 bp, E. coli
tggctgaagtatacccatacccgga

SEQ ID NO: 55097 - DNA, 25 bp, E. coli
taaccttaatgaatgtgacgataca

SEQ ID NO: 55098 - DNA, 25 bp, E. coli
taaccttaatgattgtgacgataca

SEQ ID NO: 55099 - DNA, 25 bp, E. coli
gagcaataaccttaatgaatgtgac

SEQ ID NO: 55100 - DNA, 25 bp, E. coli
gagcaataacctaaatgaatgtgac

SEQ ID NO: 55101 - DNA, 25 bp, E. coli
cactgttagatatggccggcgatac

SEQ ID NO: 55102 - DNA, 25 bp, E. coli
cactgttagataaggccggcgatac

SEQ ID NO: 55103 - DNA, 25 bp, E. coli
tatcagccaatggtggtctttcccg

SEQ ID NO: 55104 - DNA, 25 bp, E. coli
tatcagccaatgctggtctttcccg

SEQ ID NO: 55105 - DNA, 25 bp, E. coli
ttatcatgctcgttggtacctggcc

SEQ ID NO: 55106 - DNA, 25 bp, E. coli
ttatcatgctcgatggtacctggcc

SEQ ID NO: 55107 - DNA, 25 bp, E. coli
ttaccccagcacaagcaaaaagtcg

SEQ ID NO: 55108 - DNA, 25 bp, E. coli
ttaccccagcactagcaaaaagtcg

SEQ ID NO: 55109 - DNA, 25 bp, E. coli
tgatgttcgacaccgagccaatgaa

SEQ ID NO: 55110 - DNA, 25 bp, E. coli
tgctgatgagcatcgggaagtgatc

SEQ ID NO: 55111 - DNA, 25 bp, E. coli
tgcgtttcaatggtcgcgtaccgaa

SEQ ID NO: 55112 - DNA, 25 bp, E. coli
tgatgttcgacagcgagccaatgaa

SEQ ID NO: 55113 - DNA, 25 bp, E. coli
tgcgtttcaatgctcgcgtaccgaa

SEQ ID NO: 55114 - DNA, 25 bp, E. coli
tgctgatgagcaacgggaagtgatc

SEQ ID NO: 55115 - DNA, 25 bp, E. coli
ccaatattgtacagccgaggtagcc

SEQ ID NO: 55116 - DNA, 25 bp, E. coli
ccaatattgtactgccgaggtagcc

SEQ ID NO: 55117 - DNA, 25 bp, E. coli
gaaaacgctgttgtccagttacgcg

SEQ ID NO: 55118 - DNA, 25 bp, E. coli
gaaaacgctgttctccagttacgcg

SEQ ID NO: 55119 - DNA, 25 bp, E. coli
gatattttgcctgataccgttgcgt

SEQ ID NO: 55120 - DNA, 25 bp, E. coli
gatattttgcctcataccgttgcgt

SEQ ID NO: 55121 - DNA, 25 bp, E. coli
ggctttctgcctttcgcctgcgtga

SEQ ID NO: 55122 - DNA, 25 bp, E. coli
ggctttctgcctatcgcctgcgtga

SEQ ID NO: 55123 - DNA, 25 bp, E. coli
caaggtacgactccggacatgatcc

SEQ ID NO: 55124 - DNA, 25 bp, E. coli
caaggtacgactgcggacatgatcc

SEQ ID NO: 55125 - DNA, 25 bp, E. coli
caaagcggtgatgagctgacagtca

SEQ ID NO: 55126 - DNA, 25 bp, E. coli
caaagcggtgatcagctgacagtca

SEQ ID NO: 55127 - DNA, 25 bp, E. coli
catattaaagagatgggcagcgcag

SEQ ID NO: 55128 - DNA, 25 bp, E. coli
catattaaagagttgggcagcgcag

SEQ ID NO: 55129 - DNA, 25 bp, E. coli
aaacggcactgtccgatctgcggca

SEQ ID NO: 55130 - DNA, 25 bp, E. coli
aaacggcactgtgcgatctgcggca

SEQ ID NO: 55131 - DNA, 25 bp, E. coli
tgataactcttgaccgctttccggg

SEQ ID NO: 55132 - DNA, 25 bp, E. coli
tgataactcttgtccgctttccggg

SEQ ID NO: 55133 - DNA, 25 bp, E. coli
tgacagtcacttacgatgggcattc

SEQ ID NO: 55134 - DNA, 25 bp, E. coli
tgacagtcactttcgatgggcattc

SEQ ID NO: 55135 - DNA, 25 bp, E. coli
gaaaaatgaagatagccgggcagcc

SEQ ID NO: 55136 - DNA, 25 bp, E. coli
gaaaaatgaagaaagccgggcagcc

SEQ ID NO: 55137 - DNA, 25 bp, E. coli
cgtcaggctacggaagagcatgtcc

SEQ ID NO: 55138 - DNA, 25 bp, E. coli
cgtcaggctacgcaagagcatgtcc

SEQ ID NO: 55139 - DNA, 25 bp, E. coli
cattggcgatcccatccgatttcgg

SEQ ID NO: 55140 - DNA, 25 bp, E. coli
cattggcgatccgatccgatttcgg

SEQ ID NO: 55141 - DNA, 25 bp, E. coli
tcaacatcacaactggcaaggtgcg

SEQ ID NO: 55142 - DNA, 25 bp, E. coli
tcaacatcacaagtggcaaggtgcg

SEQ ID NO: 55143 - DNA, 25 bp, E. coli
gatgggcattctatgacaactcgcg

SEQ ID NO: 55144 - DNA, 25 bp, E. coli
gatgggcattctttgacaactcgcg

SEQ ID NO: 55145 - DNA, 25 bp, E. coli
tacagaatgcccaccgttaatggtt

SEQ ID NO: 55146 - DNA, 25 bp, E. coli
tacagaatgccctccgttaatggtt

SEQ ID NO: 55147 - DNA, 25 bp, E. coli
tgttacagagtatatgccaccagtc

SEQ ID NO: 55148 - DNA, 25 bp, E. coli
tgttacagagtaaatgccaccagtc

SEQ ID NO: 55149 - DNA, 25 bp, E. coli
tccgatagaaaattggcaaagcctg

SEQ ID NO: 55150 - DNA, 25 bp, E. coli
tccgatagaaaaatggcaaagcctg

SEQ ID NO: 55151 - DNA, 25 bp, E. coli
cctgcttctggattggcttgcggaa

SEQ ID NO: 55152 - DNA, 25 bp, E. coli
cctgcttctggaatggcttgcggaa

SEQ ID NO: 55153 - DNA, 25 bp, E. coli
gaagagacttctgtgcgtcctgact

SEQ ID NO: 55154 - DNA, 25 bp, E. coli
gaagagacttctctgcgtcctgact

SEQ ID NO: 55155 - DNA, 25 bp, E. coli
gaaacgtcttctggatgcaggtgaa

SEQ ID NO: 55156 - DNA, 25 bp, E. coli
gaaacgtcttctcgatgcaggtgaa

SEQ ID NO: 55157 - DNA, 25 bp, E. coli
ctttgcagatgcgaagaatgccctg

SEQ ID NO: 55158 - DNA, 25 bp, E. coli
ctcatcagggatgccggaaacgtct

SEQ ID NO: 55159 - DNA, 25 bp, E. coli
ctcatcagggatcccggaaacgtct

SEQ ID NO: 55160 - DNA, 25 bp, E. coli
ctttgcagatgccaagaatgccctg

SEQ ID NO: 55161 - DNA, 25 bp, E. coli
gatagcaggtcagggatatacggca

SEQ ID NO: 55162 - DNA, 25 bp, E. coli
gatagcaggtcacggatatacggca

SEQ ID NO: 55163 - DNA, 25 bp, E. coli
tgaactttatttgttactgggccgg

SEQ ID NO: 55164 - DNA, 25 bp, E. coli
tgaactttatttcttactgggccgg

SEQ ID NO: 55165 - DNA, 25 bp, E. coli
taagggacatcatgcagaagctcat

SEQ ID NO: 55166 - DNA, 25 bp, E. coli
taagggacatcaagcagaagctcat

SEQ ID NO: 55167 - DNA, 25 bp, E. coli
aagcactatttcttccttgttgctg

SEQ ID NO: 55168 - DNA, 25 bp, E. coli
aaggaactggtgtctctcaccaggg

SEQ ID NO: 55169 - DNA, 25 bp, E. coli
aaggaactggtgactctcaccaggg

SEQ ID NO: 55170 - DNA, 25 bp, E. coli
aagcactatttcatccttgttgctg

SEQ ID NO: 55171 - DNA, 25 bp, E. coli
cagtccggaactcgagtagaactct

SEQ ID NO: 55172 - DNA, 25 bp, E. coli
cagtccggaactggagtagaactct

SEQ ID NO: 55173 - DNA, 25 bp, E. coli
accgtggcgtgagcagtccggaact

SEQ ID NO: 55174 - DNA, 25 bp, E. coli
accgtggcgtgaccagtccggaact

SEQ ID NO: 55175 - DNA, 25 bp, E. coli
tataggatatgcctaataccgtggc

SEQ ID NO: 55176 - DNA, 25 bp, E. coli
tatttaatcaaggaactggtgactc

SEQ ID NO: 55177 - DNA, 25 bp, E. coli
tatttaatcaagcaactggtgactc

SEQ ID NO: 55178 - DNA, 25 bp, E. coli
tataggatatgcgtaataccgtggc

SEQ ID NO: 55179 - DNA, 25 bp, E. coli
gatatgcctaataccgtggcgtgag

SEQ ID NO: 55180 - DNA, 25 bp, E. coli
gatatgcctaattccgtggcgtgag

SEQ ID NO: 55181 - DNA, 25 bp, E. coli
gtaaaaagcactatttcatccttgt

SEQ ID NO: 55182 - DNA, 25 bp, E. coli
gtaaaaagcactttttcatccttgt

SEQ ID NO: 55183 - DNA, 25 bp, E. coli
tcaccaggggctttataggatatgc

SEQ ID NO: 55184 - DNA, 25 bp, E. coli
tcaccaggggctatataggatatgc

SEQ ID NO: 55185 - DNA, 25 bp, E. coli
taataccgtggcgtgagcagtccgg

SEQ ID NO: 55186 - DNA, 25 bp, E. coli
taataccgtggcctgagcagtccgg

SEQ ID NO: 55187 - DNA, 25 bp, E. coli
gagtagaactctaagtaaaaagcac

SEQ ID NO: 55188 - DNA, 25 bp, E. coli
gagtagaactcttagtaaaaagcac

SEQ ID NO: 55189 - DNA, 25 bp, E. coli
caccgccgcgttccttatcgatatt

SEQ ID NO: 55190 - DNA, 25 bp, E. coli
caccgccgcgttgcttatcgatatt

SEQ ID NO: 55191 - DNA, 25 bp, E. coli
catggtcgccgaaaaaccgtggatt

SEQ ID NO: 55192 - DNA, 25 bp, E. coli
catggtcgccgataaaccgtggatt

SEQ ID NO: 55193 - DNA, 25 bp, E. coli
tacggtagtgaatggtatgtcgcgc

SEQ ID NO: 55194 - DNA, 25 bp, E. coli
tacggtagtgaaaggtatgtcgcgc

SEQ ID NO: 55195 - DNA, 25 bp, E. coli
tatcgatacagaaacctgcggtttg

SEQ ID NO: 55196 - DNA, 25 bp, E. coli
tatgtcgcgcattacgccagctttg

SEQ ID NO: 55197 - DNA, 25 bp, E. coli
tatgtcgcgcataacgccagctttg

SEQ ID NO: 55198 - DNA, 25 bp, E. coli
tttgcactatgatactggcccgtcg

SEQ ID NO: 55199 - DNA, 25 bp, E. coli
tttgcactatgaaactggcccgtcg

SEQ ID NO: 55200 - DNA, 25 bp, E. coli
tatcgatacagatacctgcggtttg

SEQ ID NO: 55201 - DNA, 25 bp, E. coli
ttgccgaacgcgatccgggctatct

SEQ ID NO: 55202 - DNA, 25 bp, E. coli
ttgccgaacgcgttccgggctatct

SEQ ID NO: 55203 - DNA, 25 bp, E. coli
gcaaagcggtttgcgacgttgccga

SEQ ID NO: 55204 - DNA, 25 bp, E. coli
gcaaagcggtttccgacgttgccga

SEQ ID NO: 55205 - DNA, 25 bp, E. coli
gtatgactgttatatcaccgccgcg

SEQ ID NO: 55206 - DNA, 25 bp, E. coli
gtatgactgttaaatcaccgccgcg

SEQ ID NO: 55207 - DNA, 25 bp, E. coli
gagcccggagctccgtttaacactg

SEQ ID NO: 55208 - DNA, 25 bp, E. coli
gatgacgaccttcacctttggcaaa

SEQ ID NO: 55209 - DNA, 25 bp, E. coli
gatgacgaccttgacctttggcaaa

SEQ ID NO: 55210 - DNA, 25 bp, E. coli
gagcccggagctgcgtttaacactg

SEQ ID NO: 55211 - DNA, 25 bp, E. coli
caaaatggaccgtgcggtgacaaca

SEQ ID NO: 55212 - DNA, 25 bp, E. coli
caaaatggaccgagcggtgacaaca

SEQ ID NO: 55213 - DNA, 25 bp, E. coli
aaaaattttggtgtggcaattgccg

SEQ ID NO: 55214 - DNA, 25 bp, E. coli
aaaaattttggtctggcaattgccg

SEQ ID NO: 55215 - DNA, 25 bp, E. coli
tagcccggatggtgataatgcatgg

SEQ ID NO: 55216 - DNA, 25 bp, E. coli
tagcccggatggagataatgcatgg

SEQ ID NO: 55217 - DNA, 25 bp, E. coli
tgacaacagcctcgtggcgcttaaa

SEQ ID NO: 55218 - DNA, 25 bp, E. coli
tgacaacagcctggtggcgcttaaa

SEQ ID NO: 55219 - DNA, 25 bp, E. coli
tcgactgccgcagaactatcgctgg

SEQ ID NO: 55220 - DNA, 25 bp, E. coli
tcgaagttccatcttcggtgctgga

SEQ ID NO: 55221 - DNA, 25 bp, E. coli
tcgaagttccatgttcggtgctgga

SEQ ID NO: 55222 - DNA, 25 bp, E. coli
tcgactgccgcacaactatcgctgg

SEQ ID NO: 55223 - DNA, 25 bp, E. coli
ggttgaaccgataccgcaaaatgga

SEQ ID NO: 55224 - DNA, 25 bp, E. coli
ggtctgctggttacgcaggttcgaa

SEQ ID NO: 55225 - DNA, 25 bp, E. coli
ggtctgctggtttcgcaggttcgaa

SEQ ID NO: 55226 - DNA, 25 bp, E. coli
ggttgaaccgattccgcaaaatgga

SEQ ID NO: 55227 - DNA, 25 bp, E. coli
ggcgcttaaattccttagcccggat

SEQ ID NO: 55228 - DNA, 25 bp, E. coli
ggcgcttaaattgcttagcccggat

SEQ ID NO: 55229 - DNA, 25 bp, E. coli
tggcaattgccgaacccttttcaaa

SEQ ID NO: 55230 - DNA, 25 bp, E. coli
tggcaattgccgtacccttttcaaa

SEQ ID NO: 55231 - DNA, 25 bp, E. coli
gagccgtgcctgtttgtaaatcgcc

SEQ ID NO: 55232 - DNA, 25 bp, E. coli
gagccgtgcctgattgtaaatcgcc

SEQ ID NO: 55233 - DNA, 25 bp, E. coli
aaggccctttctcacgcgaacaggc

SEQ ID NO: 55234 - DNA, 25 bp, E. coli
aaggccctttctgacgcgaacaggc

SEQ ID NO: 55235 - DNA, 25 bp, E. coli
cagtgagggaatactcaggcaataa

SEQ ID NO: 55236 - DNA, 25 bp, E. coli
cagggaacgcatatccggctggtta

SEQ ID NO: 55237 - DNA, 25 bp, E. coli
cagtgagggaattctcaggcaataa

SEQ ID NO: 55238 - DNA, 25 bp, E. coli
cagggaacgcatttccggctggtta

SEQ ID NO: 55239 - DNA, 25 bp, E. coli
accgcaatgtgcatattgaagatga

SEQ ID NO: 55240 - DNA, 25 bp, E. coli
accgcaatgtgcttattgaagatga

SEQ ID NO: 55241 - DNA, 25 bp, E. coli
tatctcgccagtcagggaattctca

SEQ ID NO: 55242 - DNA, 25 bp, E. coli
tatctcgccagtgagggaattctca

SEQ ID NO: 55243 - DNA, 25 bp, E. coli
tttattgcccgatggccctttctca

SEQ ID NO: 55244 - DNA, 25 bp, E. coli
tttattgcccgaaggccctttctca

SEQ ID NO: 55245 - DNA, 25 bp, E. coli
gcttaccgcaatctgcttattgaag

SEQ ID NO: 55246 - DNA, 25 bp, E. coli
gctggaattttgaacctgatgccgg

SEQ ID NO: 55247 - DNA, 25 bp, E. coli
gctggaattttgtacctgatgccgg

SEQ ID NO: 55248 - DNA, 25 bp, E. coli
gcttaccgcaatgtgcttattgaag

SEQ ID NO: 55249 - DNA, 25 bp, E. coli
gaagggcagctaggctggcggtgct

SEQ ID NO: 55250 - DNA, 25 bp, E. coli
gaagggcagctacgctggcggtgct

SEQ ID NO: 55251 - DNA, 25 bp, E. coli
gaattttgaacctgatgccggaaaa

SEQ ID NO: 55252 - DNA, 25 bp, E. coli
gaattttgaaccagatgccggaaaa

SEQ ID NO: 55253 - DNA, 25 bp, E. coli
tggcggtgctggaattttgaacctg

SEQ ID NO: 55254 - DNA, 25 bp, E. coli
tggcggtgctggtattttgaacctg

SEQ ID NO: 55255 - DNA, 25 bp, E. coli
aatttattcagctacaacaccagag

SEQ ID NO: 55256 - DNA, 25 bp, E. coli
aatttattcagcaacaacaccagag

SEQ ID NO: 55257 - DNA, 25 bp, E. coli
tacaacaccagagaataatccgcct

SEQ ID NO: 55258 - DNA, 25 bp, E. coli
tacaacaccagacaataatccgcct

SEQ ID NO: 55259 - DNA, 25 bp, E. coli
agaataatccgcctcagttggttgc

SEQ ID NO: 55260 - DNA, 25 bp, E. coli
agaataatccgcgtcagttggttgc

SEQ ID NO: 55261 - DNA, 25 bp, E. coli
ttggttgccagcctcgtccctgatg

SEQ ID NO: 55262 - DNA, 25 bp, E. coli
ttgccagcctcgaccctgatgaaca

SEQ ID NO: 55263 - DNA, 25 bp, E. coli
ttgccagcctcgtccctgatgaaca

SEQ ID NO: 55264 - DNA, 25 bp, E. coli
ttggttgccagcgtcgtccctgatg

SEQ ID NO: 55265 - DNA, 25 bp, E. coli
tcagttggttgcgagcctcgtccct

SEQ ID NO: 55266 - DNA, 25 bp, E. coli
tcagttggttgccagcctcgtccct

SEQ ID NO: 55267 - DNA, 25 bp, E. coli
ccagagaataatccgcctcagttgg

SEQ ID NO: 55268 - DNA, 25 bp, E. coli
ccagagaataatgcgcctcagttgg

SEQ ID NO: 55269 - DNA, 25 bp, E. coli
gctacaacaccacagaataatccgc

SEQ ID NO: 55270 - DNA, 25 bp, E. coli
gctacaacaccagagaataatccgc

SEQ ID NO: 55271 - DNA, 25 bp, E. coli
ccccacaatttattcagctacaaca

SEQ ID NO: 55272 - DNA, 25 bp, E. coli
ccccacaatttaatcagctacaaca

SEQ ID NO: 55273 - DNA, 25 bp, E. coli
cgtttctcagaaaacccccacaatt

SEQ ID NO: 55274 - DNA, 25 bp, E. coli
cgtttctcagaatacccccacaatt

SEQ ID NO: 55275 - DNA, 25 bp, E. coli
tcagctacaacaccagagaataatc

SEQ ID NO: 55276 - DNA, 25 bp, E. coli
tcagctacaacagcagagaataatc

SEQ ID NO: 55277 - DNA, 25 bp, E. coli
aactgttcggcgataccacgctgga

SEQ ID NO: 55278 - DNA, 25 bp, E. coli
catttgaacagatcgcgctggaagg

SEQ ID NO: 55279 - DNA, 25 bp, E. coli
catttgaacagaacgcgctggaagg

SEQ ID NO: 55280 - DNA, 25 bp, E. coli
aacagccaggcgaagttgaagtgcc

SEQ ID NO: 55281 - DNA, 25 bp, E. coli
aacagccaggcgtagttgaagtgcc

SEQ ID NO: 55282 - DNA, 25 bp, E. coli
actgcagggcgaacaaggcgttgtc

SEQ ID NO: 55283 - DNA, 25 bp, E. coli
aactgttcggcgttaccacgctgga

SEQ ID NO: 55284 - DNA, 25 bp, E. coli
actgcagggcgatcaaggcgttgtc

SEQ ID NO: 55285 - DNA, 25 bp, E. coli
tatgatatcgctccagtgactcccg

SEQ ID NO: 55286 - DNA, 25 bp, E. coli
tatgatatcgctgcagtgactcccg

SEQ ID NO: 55287 - DNA, 25 bp, E. coli
ttgcgaaaacctccccgaaagcgtg

SEQ ID NO: 55288 - DNA, 25 bp, E. coli
ttgcgaaaacctgcccgaaagcgtg

SEQ ID NO: 55289 - DNA, 25 bp, E. coli
tgttaaaaacccaactgccttcagg

SEQ ID NO: 55290 - DNA, 25 bp, E. coli
tgttaaaaaccctactgccttcagg

SEQ ID NO: 55291 - DNA, 25 bp, E. coli
gaaaaacctggtacagcaagttgcg

SEQ ID NO: 55292 - DNA, 25 bp, E. coli
gaaaaacctggttcagcaagttgcg

SEQ ID NO: 55293 - DNA, 25 bp, E. coli
tggcgttagttttaccgagcaggaa

SEQ ID NO: 55294 - DNA, 25 bp, E. coli
ggccaggcgcttccactactgttaa

SEQ ID NO: 55295 - DNA, 25 bp, E. coli
tggcgttagtttaaccgagcaggaa

SEQ ID NO: 55296 - DNA, 25 bp, E. coli
ggccaggcgcttgcactactgttaa

SEQ ID NO: 55297 - DNA, 25 bp, E. coli
taacgccggcatcgtgaaaaacctg

SEQ ID NO: 55298 - DNA, 25 bp, E. coli
taacgccggcatggtgaaaaacctg

SEQ ID NO: 55299 - DNA, 25 bp, E. coli
cacatgtgctggcaaggctgatcgc

SEQ ID NO: 55300 - DNA, 25 bp, E. coli
cacatgtgctgggaaggctgatcgc

SEQ ID NO: 55301 - DNA, 25 bp, E. coli
accgctccgcacttgtgctggcaag

SEQ ID NO: 55302 - DNA, 25 bp, E. coli
accgctccgcacatgtgctggcaag

SEQ ID NO: 55303 - DNA, 25 bp, E. coli
acatgtgctggcaaggctgatcgct

SEQ ID NO: 55304 - DNA, 25 bp, E. coli
acatgtgctggctaggctgatcgct

SEQ ID NO: 55305 - DNA, 25 bp, E. coli
tccgcacatgtggtggcaaggctga

SEQ ID NO: 55306 - DNA, 25 bp, E. coli
tccgcacatgtgctggcaaggctga

SEQ ID NO: 55307 - DNA, 25 bp, E. coli
gctccgcacatgagctggcaaggct

SEQ ID NO: 55308 - DNA, 25 bp, E. coli
gctccgcacatgtgctggcaaggct

SEQ ID NO: 55309 - DNA, 25 bp, E. coli
gcacatgtgctgccaaggctgatcg

SEQ ID NO: 55310 - DNA, 25 bp, E. coli
gcacatgtgctggcaaggctgatcg

SEQ ID NO: 55311 - DNA, 25 bp, E. coli
ccgctccgcacatgtgctggcaagg

SEQ ID NO: 55312 - DNA, 25 bp, E. coli
cgcacatgtgctggcaaggctgatc

SEQ ID NO: 55313 - DNA, 25 bp, E. coli
ccgctccgcacaagtgctggcaagg

SEQ ID NO: 55314 - DNA, 25 bp, E. coli
cgctccgcacatctgctggcaaggc

SEQ ID NO: 55315 - DNA, 25 bp, E. coli
ccgcacatgtgcaggcaaggctgat

SEQ ID NO: 55316 - DNA, 25 bp, E. coli
cgcacatgtgctcgcaaggctgatc

SEQ ID NO: 55317 - DNA, 25 bp, E. coli
ccgcacatgtgctggcaaggctgat

SEQ ID NO: 55318 - DNA, 25 bp, E. coli
cgctccgcacatgtgctggcaaggc

SEQ ID NO: 55319 - DNA, 25 bp, E. coli
ctccgcacatgtgctggcaaggctg

SEQ ID NO: 55320 - DNA, 25 bp, E. coli
ctccgcacatgtcctggcaaggctg

SEQ ID NO: 55321 - DNA, 25 bp, E. coli
caacaatgtgcgtttcgacgacgaa

SEQ ID NO: 55322 - DNA, 25 bp, E. coli
caacaatgtgcgattcgacgacgaa

SEQ ID NO: 55323 - DNA, 25 bp, E. coli
taaactggcctgtaaatgatgacgg

SEQ ID NO: 55324 - DNA, 25 bp, E. coli
taaactggcctgaaaatgatgacgg

SEQ ID NO: 55325 - DNA, 25 bp, E. coli
cctgcgcccggatggaataaactgg

SEQ ID NO: 55326 - DNA, 25 bp, E. coli
cctgcgcccggaaggaataaactgg

SEQ ID NO: 55327 - DNA, 25 bp, E. coli
gaattcaatgtcatcggcgaacccg

SEQ ID NO: 55328 - DNA, 25 bp, E. coli
gaattcaatgtcttcggcgaacccg

SEQ ID NO: 55329 - DNA, 25 bp, E. coli
gattatgccgaggagcaacgctggc

SEQ ID NO: 55330 - DNA, 25 bp, E. coli
gttagatcgcccagcacagttcgca

SEQ ID NO: 55331 - DNA, 25 bp, E. coli
gattacgaaacctttggcacgcacc

SEQ ID NO: 55332 - DNA, 25 bp, E. coli
gattatgccgagcagcaacgctggc

SEQ ID NO: 55333 - DNA, 25 bp, E. coli
gattacgaaaccattggcacgcacc

SEQ ID NO: 55334 - DNA, 25 bp, E. coli
gttagatcgccctgcacagttcgca

SEQ ID NO: 55335 - DNA, 25 bp, E. coli
ggtattgaacattgcaacgcccacg

SEQ ID NO: 55336 - DNA, 25 bp, E. coli
ggtattgaacatagcaacgcccacg

SEQ ID NO: 55337 - DNA, 25 bp, E. coli
ggaattaatcgtcagcattgcctcg

SEQ ID NO: 55338 - DNA, 25 bp, E. coli
ggaattaatcgtgagcattgcctcg

SEQ ID NO: 55339 - DNA, 25 bp, E. coli
taatttctacgatccttacgcctgg

SEQ ID NO: 55340 - DNA, 25 bp, E. coli
taatttctacgaaccttacgcctgg

SEQ ID NO: 55341 - DNA, 25 bp, E. coli
gatgttccgcagatgaaacccctgg

SEQ ID NO: 55342 - DNA, 25 bp, E. coli
gatgttccgcagttgaaacccctgg

SEQ ID NO: 55343 - DNA, 25 bp, E. coli
cagagcgtttctgcttttactgatg

SEQ ID NO: 55344 - DNA, 25 bp, E. coli
cagagcgtttctccttttactgatg

SEQ ID NO: 55345 - DNA, 25 bp, E. coli
caggacaacagtaaaatcagagcgt

SEQ ID NO: 55346 - DNA, 25 bp, E. coli
cttacattctctggcttatcgccgt

SEQ ID NO: 55347 - DNA, 25 bp, E. coli
cttacattctctcgcttatcgccgt

SEQ ID NO: 55348 - DNA, 25 bp, E. coli
caggacaacagttaaatcagagcgt

SEQ ID NO: 55349 - DNA, 25 bp, E. coli
actgctcatgcggtgaagttaacgc

SEQ ID NO: 55350 - DNA, 25 bp, E. coli
actgctcatgcgctgaagttaacgc

SEQ ID NO: 55351 - DNA, 25 bp, E. coli
tttactgatgtcaggcggtcggagc

SEQ ID NO: 55352 - DNA, 25 bp, E. coli
tttactgatgtctggcggtcggagc

SEQ ID NO: 55353 - DNA, 25 bp, E. coli
tgtacggagtttccccgatgcacgc

SEQ ID NO: 55354 - DNA, 25 bp, E. coli
tgtacggagtttgcccgatgcacgc

SEQ ID NO: 55355 - DNA, 25 bp, E. coli
tcgcttatcgccctttcgcgcgaaa

SEQ ID NO: 55356 - DNA, 25 bp, E. coli
tcgcttatcgccgtttcgcgcgaaa

SEQ ID NO: 55357 - DNA, 25 bp, E. coli
gcgcgaattttcacctctctgtacg

SEQ ID NO: 55358 - DNA, 25 bp, E. coli
gcgcgaattttctcctctctgtacg

SEQ ID NO: 55359 - DNA, 25 bp, E. coli
gcacgctcactgcaggacaacagta

SEQ ID NO: 55360 - DNA, 25 bp, E. coli
gaagttaacgcaggctcactgcagg

SEQ ID NO: 55361 - DNA, 25 bp, E. coli
gaagttaacgcacgctcactgcagg

SEQ ID NO: 55362 - DNA, 25 bp, E. coli
gcacgctcactggaggacaacagta

SEQ ID NO: 55363 - DNA, 25 bp, E. coli
cctctctgtacggagtttgcccgat

SEQ ID NO: 55364 - DNA, 25 bp, E. coli
cctctctgtacgcagtttgcccgat

SEQ ID NO: 55365 - DNA, 25 bp, E. coli
caatccatcgatgaacgtcgtgtca

SEQ ID NO: 55366 - DNA, 25 bp, E. coli
caatccatcgatcaacgtcgtgtca

SEQ ID NO: 55367 - DNA, 25 bp, E. coli
cagtaccatttgagcgccaacgaaa

SEQ ID NO: 55368 - DNA, 25 bp, E. coli
cagtaccatttgtgcgccaacgaaa

SEQ ID NO: 55369 - DNA, 25 bp, E. coli
gttttaacgcccagacgccaatgtg

SEQ ID NO: 55370 - DNA, 25 bp, E. coli
gttttaacgccctgacgccaatgtg

SEQ ID NO: 55371 - DNA, 25 bp, E. coli
tgaaagaagaaagctgccgcactat

SEQ ID NO: 55372 - DNA, 25 bp, E. coli
tgaaagaagaaacctgccgcactat

SEQ ID NO: 55373 - DNA, 25 bp, E. coli
gccactgaagcacgttacctcggtt

SEQ ID NO: 55374 - DNA, 25 bp, E. coli
gccactgaagcaggttacctcggtt

SEQ ID NO: 55375 - DNA, 25 bp, E. coli
ccaatgtgggaaaaatatcagcgca

SEQ ID NO: 55376 - DNA, 25 bp, E. coli
ccaatgtgggaataatatcagcgca

SEQ ID NO: 55377 - DNA, 25 bp, E. coli
gaagggcgctattcccattttgacg

SEQ ID NO: 55378 - DNA, 25 bp, E. coli
gaagggcgctatacccattttgacg

SEQ ID NO: 55379 - DNA, 25 bp, E. coli
gtcgtgtcaccttcctcggctttga

SEQ ID NO: 55380 - DNA, 25 bp, E. coli
gtcgtgtcacctacctcggctttga

SEQ ID NO: 55381 - DNA, 25 bp, E. coli
ggcaaatgctgaacgttaccgtcgc

SEQ ID NO: 55382 - DNA, 25 bp, E. coli
tggaaatgaccaacgcgcaacgtct

SEQ ID NO: 55383 - DNA, 25 bp, E. coli
tggaaatgaccatcgcgcaacgtct

SEQ ID NO: 55384 - DNA, 25 bp, E. coli
ggcaaatgctgatcgttaccgtcgc

SEQ ID NO: 55385 - DNA, 25 bp, E. coli
gatgatgactatcctcgatccggca

SEQ ID NO: 55386 - DNA, 25 bp, E. coli
gatgatgactatgctcgatccggca

SEQ ID NO: 55387 - DNA, 25 bp, E. coli
aatcgacgagcttgatccgaagggc

SEQ ID NO: 55388 - DNA, 25 bp, E. coli
aatcgacgagctagatccgaagggc

SEQ ID NO: 55389 - DNA, 25 bp, E. coli
aacgtcggttcaattgccagcggca

SEQ ID NO: 55390 - DNA, 25 bp, E. coli
agaaaccatgaaactcggcgagctg

SEQ ID NO: 55391 - DNA, 25 bp, E. coli
agaaaccatgaatctcggcgagctg

SEQ ID NO: 55392 - DNA, 25 bp, E. coli
aaagttgagatgaagcgcctgcagg

SEQ ID NO: 55393 - DNA, 25 bp, E. coli
aacataaagaactcctcggcacggg

SEQ ID NO: 55394 - DNA, 25 bp, E. coli
aaagttgagatgtagcgcctgcagg

SEQ ID NO: 55395 - DNA, 25 bp, E. coli
aacataaagaacacctcggcacggg

SEQ ID NO: 55396 - DNA, 25 bp, E. coli
aacgtcggttcatttgccagcggca

SEQ ID NO: 55397 - DNA, 25 bp, E. coli
tggtcaccagcaagcgaatctcgat

SEQ ID NO: 55398 - DNA, 25 bp, E. coli
tggtcaccagcatgcgaatctcgat

SEQ ID NO: 55399 - DNA, 25 bp, E. coli
tgatgtcgccgatatccctgctgcg

SEQ ID NO: 55400 - DNA, 25 bp, E. coli
tgatgtcgccgaaatccctgctgcg

SEQ ID NO: 55401 - DNA, 25 bp, E. coli
tcctgactcggttgacgctaactgg

SEQ ID NO: 55402 - DNA, 25 bp, E. coli
tcctgactcggtagacgctaactgg

SEQ ID NO: 55403 - DNA, 25 bp, E. coli
ggttaacctgtaccgcgatgcgctg

SEQ ID NO: 55404 - DNA, 25 bp, E. coli
ggtttaccacatcctgcgtcgtcag

SEQ ID NO: 55405 - DNA, 25 bp, E. coli
ggtttaccacatgctgcgtcgtcag

SEQ ID NO: 55406 - DNA, 25 bp, E. coli
ggttaacctgtagcgcgatgcgctg

SEQ ID NO: 55407 - DNA, 25 bp, E. coli
tcaaggattttgtctggtgccagga

SEQ ID NO: 55408 - DNA, 25 bp, E. coli
tcaaggattttgactggtgccagga

SEQ ID NO: 55409 - DNA, 25 bp, E. coli
tacatatggattacttaatcagttc

SEQ ID NO: 55410 - DNA, 25 bp, E. coli
tacatatggatttcttaatcagttc

SEQ ID NO: 55411 - DNA, 25 bp, E. coli
tattgctacaaggagctggctggtt

SEQ ID NO: 55412 - DNA, 25 bp, E. coli
tattgctacaagcagctggctggtt

SEQ ID NO: 55413 - DNA, 25 bp, E. coli
tcagttcaccgcgactcaggatctt

SEQ ID NO: 55414 - DNA, 25 bp, E. coli
tcagttcaccgccactcaggatctt

SEQ ID NO: 55415 - DNA, 25 bp, E. coli
gactcaggatcttaacaaccatgat

SEQ ID NO: 55416 - DNA, 25 bp, E. coli
gactcaggatctaaacaaccatgat

SEQ ID NO: 55417 - DNA, 25 bp, E. coli
gaacgccggaacgtattgctacaag

SEQ ID NO: 55418 - DNA, 25 bp, E. coli
gaacgccggaacctattgctacaag

SEQ ID NO: 55419 - DNA, 25 bp, E. coli
gaacgtattgcttcaaggagctggc

SEQ ID NO: 55420 - DNA, 25 bp, E. coli
gaacgtattgctacaaggagctggc

SEQ ID NO: 55421 - DNA, 25 bp, E. coli
cgtgataactgaacgccggaacgta

SEQ ID NO: 55422 - DNA, 25 bp, E. coli
cgtttttcttctttacatatggatt

SEQ ID NO: 55423 - DNA, 25 bp, E. coli
cgtcgtgataacagaacgccggaac

SEQ ID NO: 55424 - DNA, 25 bp, E. coli
cgtgataactgatcgccggaacgta

SEQ ID NO: 55425 - DNA, 25 bp, E. coli
cgtcgtgataactgaacgccggaac

SEQ ID NO: 55426 - DNA, 25 bp, E. coli
cgtttttcttctatacatatggatt

SEQ ID NO: 55427 - DNA, 25 bp, E. coli
tcaccgcgactcaggatcttaacaa

SEQ ID NO: 55428 - DNA, 25 bp, E. coli
tcaccgcgactctggatcttaacaa

SEQ ID NO: 55429 - DNA, 25 bp, E. coli
gatgaagtgattagttatattcgag

SEQ ID NO: 55430 - DNA, 25 bp, E. coli
gatgaagtgatttgttatattcgag

SEQ ID NO: 55431 - DNA, 25 bp, E. coli
caataaagaagctgcagctctttcc

SEQ ID NO: 55432 - DNA, 25 bp, E. coli
caataaagaagcagcagctctttcc

SEQ ID NO: 55433 - DNA, 25 bp, E. coli
aaatcactggcattaccggacaact

SEQ ID NO: 55434 - DNA, 25 bp, E. coli
aaatcactggcaataccggacaact

SEQ ID NO: 55435 - DNA, 25 bp, E. coli
taccggacaactccaataaagaagc

SEQ ID NO: 55436 - DNA, 25 bp, E. coli
tatgaaaaatcagtggcattaccgg

SEQ ID NO: 55437 - DNA, 25 bp, E. coli
tatgctgatgctgtcaaagttattg

SEQ ID NO: 55438 - DNA, 25 bp, E. coli
tatgctgatgctctcaaagttattg

SEQ ID NO: 55439 - DNA, 25 bp, E. coli
tatgaaaaatcactggcattaccgg

SEQ ID NO: 55440 - DNA, 25 bp, E. coli
taccggacaactgcaataaagaagc

SEQ ID NO: 55441 - DNA, 25 bp, E. coli
ttacctgcagctgaaatgattttgc

SEQ ID NO: 55442 - DNA, 25 bp, E. coli
ttacctgcagctcaaatgattttgc

SEQ ID NO: 55443 - DNA, 25 bp, E. coli
ttaacatcaaaattacctgcagctg

SEQ ID NO: 55444 - DNA, 25 bp, E. coli
ttaacatcaaaaatacctgcagctg

SEQ ID NO: 55445 - DNA, 25 bp, E. coli
gcagctctttccactttaacatcaa

SEQ ID NO: 55446 - DNA, 25 bp, E. coli
gcagctctttcctctttaacatcaa

SEQ ID NO: 55447 - DNA, 25 bp, E. coli
gttccgtccatatgaaaaatcactg

SEQ ID NO: 55448 - DNA, 25 bp, E. coli
gttccgtccataagaaaaatcactg

SEQ ID NO: 55449 - DNA, 25 bp, E. coli
taattaatggattaagattatcctg

SEQ ID NO: 55450 - DNA, 25 bp, E. coli
taattaatggataaagattatcctg

SEQ ID NO: 55451 - DNA, 25 bp, E. coli
tcaaagttattgagttccgtccata

SEQ ID NO: 55452 - DNA, 25 bp, E. coli
tcaaagttattgtgttccgtccata

SEQ ID NO: 55453 - DNA, 25 bp, E. coli
catgccgtctgaacaatgtggagcc

SEQ ID NO: 55454 - DNA, 25 bp, E. coli
catgccgtctgatcaatgtggagcc

SEQ ID NO: 55455 - DNA, 25 bp, E. coli
aacatcacagagaacgccttacggg

SEQ ID NO: 55456 - DNA, 25 bp, E. coli
aacatgcggcggtgttgtactcgct

SEQ ID NO: 55457 - DNA, 25 bp, E. coli
aacatgcggcggagttgtactcgct

SEQ ID NO: 55458 - DNA, 25 bp, E. coli
aacatcacagagtacgccttacggg

SEQ ID NO: 55459 - DNA, 25 bp, E. coli
tacctgctgaaagagtgggatgcac

SEQ ID NO: 55460 - DNA, 25 bp, E. coli
tacctgctgaaacagtgggatgcac

SEQ ID NO: 55461 - DNA, 25 bp, E. coli
ttccgacagcggtggtgaacatgcg

SEQ ID NO: 55462 - DNA, 25 bp, E. coli
ttccgacagcggaggtgaacatgcg

SEQ ID NO: 55463 - DNA, 25 bp, E. coli
ccagaaaagtggctgcgttacgtca

SEQ ID NO: 55464 - DNA, 25 bp, E. coli
gccgtaggccggtaaaactggatgt

SEQ ID NO: 55465 - DNA, 25 bp, E. coli
gccgtaggccggaaaaactggatgt

SEQ ID NO: 55466 - DNA, 25 bp, E. coli
ccagaaaagtgggtgcgttacgtca

SEQ ID NO: 55467 - DNA, 25 bp, E. coli
ccctggaaagttgatctgagctctc

SEQ ID NO: 55468 - DNA, 25 bp, E. coli
ccctggaaagttcatctgagctctc

SEQ ID NO: 55469 - DNA, 25 bp, E. coli
cattgaacatatgcaggactggccg

SEQ ID NO: 55470 - DNA, 25 bp, E. coli
cattgaacatatccaggactggccg

SEQ ID NO: 55471 - DNA, 25 bp, E. coli
gtcactcagatacggcaaaagcgtt

SEQ ID NO: 55472 - DNA, 25 bp, E. coli
gtcactcagatagggcaaaagcgtt

SEQ ID NO: 55473 - DNA, 25 bp, E. coli
ggtacgcgatctcttgccctggaaa

SEQ ID NO: 55474 - DNA, 25 bp, E. coli
ggtacgcgatctgttgccctggaaa

SEQ ID NO: 55475 - DNA, 25 bp, E. coli
caaaatttccatggcccaggtgcgc

SEQ ID NO: 55476 - DNA, 25 bp, E. coli
caaaatttccatcgcccaggtgcgc

SEQ ID NO: 55477 - DNA, 25 bp, E. coli
caggcacaccgttgtcggaaaaaga

SEQ ID NO: 55478 - DNA, 25 bp, E. coli
caggcacaccgtagtcggaaaaaga

SEQ ID NO: 55479 - DNA, 25 bp, E. coli
aactcctgacgctgattgccgactg

SEQ ID NO: 55480 - DNA, 25 bp, E. coli
aactcctgacgcagattgccgactg

SEQ ID NO: 55481 - DNA, 25 bp, E. coli
tatccgtcaggccattgagtgcgcg

SEQ ID NO: 55482 - DNA, 25 bp, E. coli
tatccgtcaggcgattgagtgcgcg

SEQ ID NO: 55483 - DNA, 25 bp, E. coli
tctctgccctgctaaaacgtgatgg

SEQ ID NO: 55484 - DNA, 25 bp, E. coli
tctctgccctgcaaaaacgtgatgg

SEQ ID NO: 55485 - DNA, 25 bp, E. coli
ccaggtgcgcaagggcagttttatc

SEQ ID NO: 55486 - DNA, 25 bp, E. coli
ccattgagaacctgaaagcgaccgt

SEQ ID NO: 55487 - DNA, 25 bp, E. coli
ccaggtgcgcaacggcagttttatc

SEQ ID NO: 55488 - DNA, 25 bp, E. coli
ccattgagaaccagaaagcgaccgt

SEQ ID NO: 55489 - DNA, 25 bp, E. coli
ccattgagcgcatgcaactggatga

SEQ ID NO: 55490 - DNA, 25 bp, E. coli
ccattgagcgcaagcaactggatga

SEQ ID NO: 55491 - DNA, 25 bp, E. coli
gaaatcagcgaatccgtgcgccaga

SEQ ID NO: 55492 - DNA, 25 bp, E. coli
gaaatcagcgaaaccgtgcgccaga

SEQ ID NO: 55493 - DNA, 25 bp, E. coli
ccgactgtcaactggcgtgggatac

SEQ ID NO: 55494 - DNA, 25 bp, E. coli
ccgactgtcaacaggcgtgggatac

SEQ ID NO: 55495 - DNA, 25 bp, E. coli
gtttcaatgtgtcacgccagccggt

SEQ ID NO: 55496 - DNA, 25 bp, E. coli
gtttcaatgtgtgacgccagccggt

SEQ ID NO: 55497 - DNA, 25 bp, E. coli
cagagtatgctgctaaagcacgggt

SEQ ID NO: 55498 - DNA, 25 bp, E. coli
cagagtatgctggtaaagcacgggt

SEQ ID NO: 55499 - DNA, 25 bp, E. coli
cagagaaccctgcatgagagtccgg

SEQ ID NO: 55500 - DNA, 25 bp, E. coli
cagagaaccctggatgagagtccgg

SEQ ID NO: 55501 - DNA, 25 bp, E. coli
taaactgtcaaaatagctattccaa

SEQ ID NO: 55502 - DNA, 25 bp, E. coli
taaactgtcaaattagctattccaa

SEQ ID NO: 55503 - DNA, 25 bp, E. coli
tgcataaaacgaaataaagtgctga

SEQ ID NO: 55504 - DNA, 25 bp, E. coli
tgcataaaacgatataaagtgctga

SEQ ID NO: 55505 - DNA, 25 bp, E. coli
tccgctattaagcagagaaccctgg

SEQ ID NO: 55506 - DNA, 25 bp, E. coli
tccccacgcagaatgttaataaact

SEQ ID NO: 55507 - DNA, 25 bp, E. coli
tccgctattaaggagagaaccctgg

SEQ ID NO: 55508 - DNA, 25 bp, E. coli
tccccacgcagattgttaataaact

SEQ ID NO: 55509 - DNA, 25 bp, E. coli
tcgggtatgttttagcagagtatgc

SEQ ID NO: 55510 - DNA, 25 bp, E. coli
tcgggtatgtttaagcagagtatgc

SEQ ID NO: 55511 - DNA, 25 bp, E. coli
gcacgggtagtcttgcataaaacga

SEQ ID NO: 55512 - DNA, 25 bp, E. coli
gcacgggtagtcatgcataaaacga

SEQ ID NO: 55513 - DNA, 25 bp, E. coli
gttttttgggcctctgtaataatca

SEQ ID NO: 55514 - DNA, 25 bp, E. coli
gttttttgggccactgtaataatca

SEQ ID NO: 55515 - DNA, 25 bp, E. coli
cgaaataaagtgctgaaaaacaaca

SEQ ID NO: 55516 - DNA, 25 bp, E. coli
cgaaataaagtggtgaaaaacaaca

SEQ ID NO: 55517 - DNA, 25 bp, E. coli
taataatcaattacccctccggcaa

SEQ ID NO: 55518 - DNA, 25 bp, E. coli
taataatcaatttcccctccggcaa

SEQ ID NO: 55519 - DNA, 25 bp, E. coli
tatacgctgcaactcagtatcggcg

SEQ ID NO: 55520 - DNA, 25 bp, E. coli
tatacgctgcaagtcagtatcggcg

SEQ ID NO: 55521 - DNA, 25 bp, E. coli
tatttttcgtggaacgccgctcatc

SEQ ID NO: 55522 - DNA, 25 bp, E. coli
tatttttcgtggtacgccgctcatc

SEQ ID NO: 55523 - DNA, 25 bp, E. coli
tgcgtcgcgcgaatttgccacaggc

SEQ ID NO: 55524 - DNA, 25 bp, E. coli
tgcgtcgcgcgattttgccacaggc

SEQ ID NO: 55525 - DNA, 25 bp, E. coli
gccgctcatcgctcaactgtttatg

SEQ ID NO: 55526 - DNA, 25 bp, E. coli
gccgctcatcgcacaactgtttatg

SEQ ID NO: 55527 - DNA, 25 bp, E. coli
gaattagatccctttccgtcagcaa

SEQ ID NO: 55528 - DNA, 25 bp, E. coli
gaattagatcccattccgtcagcaa

SEQ ID NO: 55529 - DNA, 25 bp, E. coli
gactgtgttatccacgttgcagaac

SEQ ID NO: 55530 - DNA, 25 bp, E. coli
gactgtgttatcgacgttgcagaac

SEQ ID NO: 55531 - DNA, 25 bp, E. coli
cgacaatccaggagccggagctgtt

SEQ ID NO: 55532 - DNA, 25 bp, E. coli
cgacaatccaggtgccggagctgtt

SEQ ID NO: 55533 - DNA, 25 bp, E. coli
gattccttgccgttcctgctgaaag

SEQ ID NO: 55534 - DNA, 25 bp, E. coli
gtaaaagatacgtcgctggccgcga

SEQ ID NO: 55535 - DNA, 25 bp, E. coli
gattccttgccgatcctgctgaaag

SEQ ID NO: 55536 - DNA, 25 bp, E. coli
gtaaaagatacgacgctggccgcga

SEQ ID NO: 55537 - DNA, 25 bp, E. coli
tggcggcttcgctcatctactggat

SEQ ID NO: 55538 - DNA, 25 bp, E. coli
tggcggcttcgcacatctactggat

SEQ ID NO: 55539 - DNA, 25 bp, E. coli
gagaatcaactttatcgccaggaga

SEQ ID NO: 55540 - DNA, 25 bp, E. coli
gagaatcaacttaatcgccaggaga

SEQ ID NO: 55541 - DNA, 25 bp, E. coli
cggaagtaaaagtacgctttgctga

SEQ ID NO: 55542 - DNA, 25 bp, E. coli
cggaagtaaaagaacgctttgctga

SEQ ID NO: 55543 - DNA, 25 bp, E. coli
acacataccatcgcggaagtaaaag

SEQ ID NO: 55544 - DNA, 25 bp, E. coli
acacataccatcccggaagtaaaag

SEQ ID NO: 55545 - DNA, 25 bp, E. coli
tcgccggaccgtatgccgggcaaat

SEQ ID NO: 55546 - DNA, 25 bp, E. coli
tcgccggaccgtttgccgggcaaat

SEQ ID NO: 55547 - DNA, 25 bp, E. coli
gcggaagtaaaacaacgctttgctg

SEQ ID NO: 55548 - DNA, 25 bp, E. coli
gcggaagtaaaagaacgctttgctg

SEQ ID NO: 55549 - DNA, 25 bp, E. coli
gcgacacataccatcgcggaagtaa

SEQ ID NO: 55550 - DNA, 25 bp, E. coli
gcgacacataccttcgcggaagtaa

SEQ ID NO: 55551 - DNA, 25 bp, E. coli
gacacataccatcgcggaagtaaaa

SEQ ID NO: 55552 - DNA, 25 bp, E. coli
gacacataccatggcggaagtaaaa

SEQ ID NO: 55553 - DNA, 25 bp, E. coli
cgccggaccgtttgccgggcaaatg

SEQ ID NO: 55554 - DNA, 25 bp, E. coli
cgcggaagtaaaagaacgctttgct

SEQ ID NO: 55555 - DNA, 25 bp, E. coli
cgccggaccgttagccgggcaaatg

SEQ ID NO: 55556 - DNA, 25 bp, E. coli
cgacacataccaacgcggaagtaaa

SEQ ID NO: 55557 - DNA, 25 bp, E. coli
cgacacataccatcgcggaagtaaa

SEQ ID NO: 55558 - DNA, 25 bp, E. coli
cgcggaagtaaatgaacgctttgct

SEQ ID NO: 55559 - DNA, 25 bp, E. coli
ggaagtaaaagaacgctttgctgaa

SEQ ID NO: 55560 - DNA, 25 bp, E. coli
ggcgacacatacgatcgcggaagta

SEQ ID NO: 55561 - DNA, 25 bp, E. coli
ggcgacacataccatcgcggaagta

SEQ ID NO: 55562 - DNA, 25 bp, E. coli
ggaagtaaaagatcgctttgctgaa

SEQ ID NO: 55563 - DNA, 25 bp, E. coli
aagcggttcagctgaatttcggcgc

SEQ ID NO: 55564 - DNA, 25 bp, E. coli
tactcaggcagagggtcatgagtcc

SEQ ID NO: 55565 - DNA, 25 bp, E. coli
tactcaggcagacggtcatgagtcc

SEQ ID NO: 55566 - DNA, 25 bp, E. coli
agtgaaaccattctcagggatgcta

SEQ ID NO: 55567 - DNA, 25 bp, E. coli
agtgaaaccattgtcagggatgcta

SEQ ID NO: 55568 - DNA, 25 bp, E. coli
accattgtcagggatgctattgcca

SEQ ID NO: 55569 - DNA, 25 bp, E. coli
accattgtcaggcatgctattgcca

SEQ ID NO: 55570 - DNA, 25 bp, E. coli
aagcggttcagcagaatttcggcgc

SEQ ID NO: 55571 - DNA, 25 bp, E. coli
ttcagcagaatttcggcgcgtggcg

SEQ ID NO: 55572 - DNA, 25 bp, E. coli
ttcagcagaattacggcgcgtggcg

SEQ ID NO: 55573 - DNA, 25 bp, E. coli
tgtcagggatgctattgccaaatgg

SEQ ID NO: 55574 - DNA, 25 bp, E. coli
tgtcagggatgcaattgccaaatgg

SEQ ID NO: 55575 - DNA, 25 bp, E. coli
tgccgtcagactaccttcaatgtcc

SEQ ID NO: 55576 - DNA, 25 bp, E. coli
tgccgtcagacttccttcaatgtcc

SEQ ID NO: 55577 - DNA, 25 bp, E. coli
tcaggcagagggtcatgagtccact

SEQ ID NO: 55578 - DNA, 25 bp, E. coli
tcaggcagagggacatgagtccact

SEQ ID NO: 55579 - DNA, 25 bp, E. coli
gaactactcagggagagggtcatga

SEQ ID NO: 55580 - DNA, 25 bp, E. coli
gaactactcaggcagagggtcatga

SEQ ID NO: 55581 - DNA, 25 bp, E. coli
cggttcagcagattttcggcgcgtg

SEQ ID NO: 55582 - DNA, 25 bp, E. coli
cggttcagcagaatttcggcgcgtg

SEQ ID NO: 55583 - DNA, 25 bp, E. coli
cattgtcagggatgctattgccaaa

SEQ ID NO: 55584 - DNA, 25 bp, E. coli
cattgtcagggaagctattgccaaa

SEQ ID NO: 55585 - DNA, 25 bp, E. coli
caagtgagttcaatacccagcgcgt

SEQ ID NO: 55586 - DNA, 25 bp, E. coli
caagtgagttcattacccagcgcgt

SEQ ID NO: 55587 - DNA, 25 bp, E. coli
caaaactgaaacttgaccatctggg

SEQ ID NO: 55588 - DNA, 25 bp, E. coli
caaaactgaaacatgaccatctggg

SEQ ID NO: 55589 - DNA, 25 bp, E. coli
tactttaaagctggcgcgacagtgc

SEQ ID NO: 55590 - DNA, 25 bp, E. coli
tactttaaagctcgcgcgacagtgc

SEQ ID NO: 55591 - DNA, 25 bp, E. coli
agtggtttacttaaaagctcgcgcg

SEQ ID NO: 55592 - DNA, 25 bp, E. coli
agtggtttactttaaagctcgcgcg

SEQ ID NO: 55593 - DNA, 25 bp, E. coli
aaagctcgcgcgacagtgctggcga

SEQ ID NO: 55594 - DNA, 25 bp, E. coli
aaagctcgcgcgtcagtgctggcga

SEQ ID NO: 55595 - DNA, 25 bp, E. coli
tcgtatttggtcgtgcggcaggtct

SEQ ID NO: 55596 - DNA, 25 bp, E. coli
tcgtatttggtcctgcggcaggtct

SEQ ID NO: 55597 - DNA, 25 bp, E. coli
tctgccgggtatccttgaactctcc

SEQ ID NO: 55598 - DNA, 25 bp, E. coli
tctgccgggtatgcttgaactctcc

SEQ ID NO: 55599 - DNA, 25 bp, E. coli
cctggtcgtattaggtcgtgcggca

SEQ ID NO: 55600 - DNA, 25 bp, E. coli
cctggtcgtatttggtcgtgcggca

SEQ ID NO: 55601 - DNA, 25 bp, E. coli
ccatctggggaaagaagttcttgaa

SEQ ID NO: 55602 - DNA, 25 bp, E. coli
ccatctggggaatgaagttcttgaa

SEQ ID NO: 55603 - DNA, 25 bp, E. coli
gccacacgcaaaactgaaacttgac

SEQ ID NO: 55604 - DNA, 25 bp, E. coli
gccacacgcaaatctgaaacttgac

SEQ ID NO: 55605 - DNA, 25 bp, E. coli
gacacttcaagtgagttcaataccc

SEQ ID NO: 55606 - DNA, 25 bp, E. coli
gacacttcaagtcagttcaataccc

SEQ ID NO: 55607 - DNA, 25 bp, E. coli
caatgtcgcaggtgttaggctggca

SEQ ID NO: 55608 - DNA, 25 bp, E. coli
cgaccccaaagtttatgacgaatat

SEQ ID NO: 55609 - DNA, 25 bp, E. coli
caatgtcgcaggagttaggctggca

SEQ ID NO: 55610 - DNA, 25 bp, E. coli
cgaccccaaagtatatgacgaatat

SEQ ID NO: 55611 - DNA, 25 bp, E. coli
caaagcttgccaatgtcgcaggagt

SEQ ID NO: 55612 - DNA, 25 bp, E. coli
catccggcggggaacttcagtacga

SEQ ID NO: 55613 - DNA, 25 bp, E. coli
caaagcttgccattgtcgcaggagt

SEQ ID NO: 55614 - DNA, 25 bp, E. coli
catccggcggggtacttcagtacga

SEQ ID NO: 55615 - DNA, 25 bp, E. coli
ttttggcagcaaaacaaagcttgcc

SEQ ID NO: 55616 - DNA, 25 bp, E. coli
ttttggcagcaatacaaagcttgcc

SEQ ID NO: 55617 - DNA, 25 bp, E. coli
tgttgaaaattgttgctatagcgtt

SEQ ID NO: 55618 - DNA, 25 bp, E. coli
tgttgaaaattgatgctatagcgtt

SEQ ID NO: 55619 - DNA, 25 bp, E. coli
tcagtacgaccccaaagtttatgac

SEQ ID NO: 55620 - DNA, 25 bp, E. coli
tcagtacgacccgaaagtttatgac

SEQ ID NO: 55621 - DNA, 25 bp, E. coli
gctatagcgttttttggcagcaaaa

SEQ ID NO: 55622 - DNA, 25 bp, E. coli
gctatagcgtttattggcagcaaaa

SEQ ID NO: 55623 - DNA, 25 bp, E. coli
gacgaatatcgttaggcaaagcggg

SEQ ID NO: 55624 - DNA, 25 bp, E. coli
gaactggttcctcaaggtcgcgcga

SEQ ID NO: 55625 - DNA, 25 bp, E. coli
gaactggttcctgaaggtcgcgcga

SEQ ID NO: 55626 - DNA, 25 bp, E. coli
gacgaatatcgtaaggcaaagcggg

SEQ ID NO: 55627 - DNA, 25 bp, E. coli
gatgcgcctgcaagaggcatccggc

SEQ ID NO: 55628 - DNA, 25 bp, E. coli
gatgcgcctgcatgaggcatccggc

SEQ ID NO: 55629 - DNA, 25 bp, E. coli
aatgcgtttctctcccggggctgcg

SEQ ID NO: 55630 - DNA, 25 bp, E. coli
aatgcgtttctcacccggggctgcg

SEQ ID NO: 55631 - DNA, 25 bp, E. coli
caaagtcccgcaacctgtcatgctg

SEQ ID NO: 55632 - DNA, 25 bp, E. coli
caaagtcccgcatcctgtcatgctg

SEQ ID NO: 55633 - DNA, 25 bp, E. coli
aaagcgaatgcgtttctctcccggg

SEQ ID NO: 55634 - DNA, 25 bp, E. coli
aaagcgaatgcgattctctcccggg

SEQ ID NO: 55635 - DNA, 25 bp, E. coli
tatcgtgaaagatagcgaatgcgtt

SEQ ID NO: 55636 - DNA, 25 bp, E. coli
tatcgtgaaagaaagcgaatgcgtt

SEQ ID NO: 55637 - DNA, 25 bp, E. coli
tccggttccgaatatatcgtgaaag

SEQ ID NO: 55638 - DNA, 25 bp, E. coli
tccggttccgaaaatatcgtgaaag

SEQ ID NO: 55639 - DNA, 25 bp, E. coli
tccgaaaatatcctgaaagaaagcg

SEQ ID NO: 55640 - DNA, 25 bp, E. coli
tccgaaaatatcgtgaaagaaagcg

SEQ ID NO: 55641 - DNA, 25 bp, E. coli
tcgtgaaagaaaccgaatgcgtttc

SEQ ID NO: 55642 - DNA, 25 bp, E. coli
tcgtgaaagaaagcgaatgcgtttc

SEQ ID NO: 55643 - DNA, 25 bp, E. coli
tcatgctgatttccggttccgaaaa

SEQ ID NO: 55644 - DNA, 25 bp, E. coli
tcatgctgatttgcggttccgaaaa

SEQ ID NO: 55645 - DNA, 25 bp, E. coli
gcatcctgtcatgctgatttccggt

SEQ ID NO: 55646 - DNA, 25 bp, E. coli
gcatcctgtcatcctgatttccggt

SEQ ID NO: 55647 - DNA, 25 bp, E. coli
ctgtcatgctgatttccggttccga

SEQ ID NO: 55648 - DNA, 25 bp, E. coli
ctgtcatgctgaattccggttccga

SEQ ID NO: 55649 - DNA, 25 bp, E. coli
tgatttccggttgcgaaaatatcgt

SEQ ID NO: 55650 - DNA, 25 bp, E. coli
tgatttccggttccgaaaatatcgt

SEQ ID NO: 55651 - DNA, 25 bp, E. coli
caaaacgctgaacgcagaaatcgtc

SEQ ID NO: 55652 - DNA, 25 bp, E. coli
caaaacgctgaaggcagaaatcgtc

SEQ ID NO: 55653 - DNA, 25 bp, E. coli
cagggcactgattctccggaacagt

SEQ ID NO: 55654 - DNA, 25 bp, E. coli
cagggcactgatactccggaacagt

SEQ ID NO: 55655 - DNA, 25 bp, E. coli
tactccggaacagttgaaagagcgt

SEQ ID NO: 55656 - DNA, 25 bp, E. coli
tactccggaacacttgaaagagcgt

SEQ ID NO: 55657 - DNA, 25 bp, E. coli
aaaagtgaacaacgttgatccggcg

SEQ ID NO: 55658 - DNA, 25 bp, E. coli
aaaagtgaacaaggttgatccggcg

SEQ ID NO: 55659 - DNA, 25 bp, E. coli
tgagcagggtcgtacccgtccggat

SEQ ID NO: 55660 - DNA, 25 bp, E. coli
tgagcagggtcgaacccgtccggat

SEQ ID NO: 55661 - DNA, 25 bp, E. coli
tccaccaaagcaaaagtgaacaacg

SEQ ID NO: 55662 - DNA, 25 bp, E. coli
tccggttgatgagcagggtcgtacc

SEQ ID NO: 55663 - DNA, 25 bp, E. coli
tccaccaaagcataagtgaacaacg

SEQ ID NO: 55664 - DNA, 25 bp, E. coli
tccggttgatgaccagggtcgtacc

SEQ ID NO: 55665 - DNA, 25 bp, E. coli
gctgacctgatctctatcggaccga

SEQ ID NO: 55666 - DNA, 25 bp, E. coli
gctgacctgatcactatcggaccga

SEQ ID NO: 55667 - DNA, 25 bp, E. coli
gcaaaaaacaccaatattaccggcg

SEQ ID NO: 55668 - DNA, 25 bp, E. coli
gcaaaaaacacctatattaccggcg

SEQ ID NO: 55669 - DNA, 25 bp, E. coli
gaaatcgccaaatcgctgaacgcag

SEQ ID NO: 55670 - DNA, 25 bp, E. coli
gaaatcgccaaaacgctgaacgcag

SEQ ID NO: 55671 - DNA, 25 bp, E. coli
gatttttgacgactccaccaaagca

SEQ ID NO: 55672 - DNA, 25 bp, E. coli
gatttttgacgagtccaccaaagca

SEQ ID NO: 55673 - DNA, 25 bp, E. coli
aattgggatcgctgttgctgccgag

SEQ ID NO: 55674 - DNA, 25 bp, E. coli
aattgggatcgcagttgctgccgag

SEQ ID NO: 55675 - DNA, 25 bp, E. coli
cagtgccggaatagggatcgcagtt

SEQ ID NO: 55676 - DNA, 25 bp, E. coli
cagtgccggaattgggatcgcagtt

SEQ ID NO: 55677 - DNA, 25 bp, E. coli
taccccgtttgaccagttaatctgg

SEQ ID NO: 55678 - DNA, 25 bp, E. coli
acccgcgcggcatcgcagttggcgt

SEQ ID NO: 55679 - DNA, 25 bp, E. coli
acccgcgcggcaacgcagttggcgt

SEQ ID NO: 55680 - DNA, 25 bp, E. coli
taccccgtttgagcagttaatctgg

SEQ ID NO: 55681 - DNA, 25 bp, E. coli
ttgaccagttaatctgggatgtggg

SEQ ID NO: 55682 - DNA, 25 bp, E. coli
ttgaccagttaaactgggatgtggg

SEQ ID NO: 55683 - DNA, 25 bp, E. coli
tgggatcgcagttgctgccgagaaa

SEQ ID NO: 55684 - DNA, 25 bp, E. coli
tgttgcgatctagtccaccttcctg

SEQ ID NO: 55685 - DNA, 25 bp, E. coli
tgttgcgatctactccaccttcctg

SEQ ID NO: 55686 - DNA, 25 bp, E. coli
tgggatcgcagtagctgccgagaaa

SEQ ID NO: 55687 - DNA, 25 bp, E. coli
ccggaattgggaacgcagttgctgc

SEQ ID NO: 55688 - DNA, 25 bp, E. coli
ccggaattgggatcgcagttgctgc

SEQ ID NO: 55689 - DNA, 25 bp, E. coli
gctacaaacccattgttgcgatcta

SEQ ID NO: 55690 - DNA, 25 bp, E. coli
gctacaaacccaatgttgcgatcta

SEQ ID NO: 55691 - DNA, 25 bp, E. coli
gattggaggctacaaacccattgtt

SEQ ID NO: 55692 - DNA, 25 bp, E. coli
gattggaggctagaaacccattgtt

SEQ ID NO: 55693 - DNA, 25 bp, E. coli
ggaggctacaaacccattgttgcga

SEQ ID NO: 55694 - DNA, 25 bp, E. coli
ggaggctacaaagccattgttgcga

SEQ ID NO: 55695 - DNA, 25 bp, E. coli
ttcttcgcgcctataaacagccgac

SEQ ID NO: 55696 - DNA, 25 bp, E. coli
ttcttcgcgcctttaaacagccgac

SEQ ID NO: 55697 - DNA, 25 bp, E. coli
tttcaccggcgacccgcgactggtt

SEQ ID NO: 55698 - DNA, 25 bp, E. coli
ttttcaccggcgtcccgcgactggt

SEQ ID NO: 55699 - DNA, 25 bp, E. coli
ttttcaccggcgacccgcgactggt

SEQ ID NO: 55700 - DNA, 25 bp, E. coli
tttcaccggcgagccgcgactggtt

SEQ ID NO: 55701 - DNA, 25 bp, E. coli
tgccggacgtgtattcaccggcgac

SEQ ID NO: 55702 - DNA, 25 bp, E. coli
tgccggacgtgttttcaccggcgac

SEQ ID NO: 55703 - DNA, 25 bp, E. coli
gcgacccgcgacaggtttcttcgcg

SEQ ID NO: 55704 - DNA, 25 bp, E. coli
gcgactggtttcatcgcgcctttaa

SEQ ID NO: 55705 - DNA, 25 bp, E. coli
gcgcctttaaactgccgaccgctgt

SEQ ID NO: 55706 - DNA, 25 bp, E. coli
gcgcctttaaacagccgaccgctgt

SEQ ID NO: 55707 - DNA, 25 bp, E. coli
gcgactggtttcttcgcgcctttaa

SEQ ID NO: 55708 - DNA, 25 bp, E. coli
gcgacccgcgactggtttcttcgcg

SEQ ID NO: 55709 - DNA, 25 bp, E. coli
gacgtgttttcaccggcgacccgcg

SEQ ID NO: 55710 - DNA, 25 bp, E. coli
gacgtgttttcagcggcgacccgcg

SEQ ID NO: 55711 - DNA, 25 bp, E. coli
ctttaaacagcccaccgctgtccag

SEQ ID NO: 55712 - DNA, 25 bp, E. coli
cggcgacccgcgactggtttcttcg

SEQ ID NO: 55713 - DNA, 25 bp, E. coli
cggcgacccgcgtctggtttcttcg

SEQ ID NO: 55714 - DNA, 25 bp, E. coli
ctttaaacagccgaccgctgtccag

SEQ ID NO: 55715 - DNA, 25 bp, E. coli
gtttcttcgcgcgtttaaacagccg

SEQ ID NO: 55716 - DNA, 25 bp, E. coli
gtttcttcgcgcctttaaacagccg

SEQ ID NO: 55717 - DNA, 25 bp, E. coli
taacaatccagtcattaattaatgg

SEQ ID NO: 55718 - DNA, 25 bp, E. coli
taacaatccagtgattaattaatgg

SEQ ID NO: 55719 - DNA, 25 bp, E. coli
catccaggttcgaaaattaatttag

SEQ ID NO: 55720 - DNA, 25 bp, E. coli
aaaattaatttagttgcgtgcagaa

SEQ ID NO: 55721 - DNA, 25 bp, E. coli
catccaggttcgtaaattaatttag

SEQ ID NO: 55722 - DNA, 25 bp, E. coli
aaaattaatttacttgcgtgcagaa

SEQ ID NO: 55723 - DNA, 25 bp, E. coli
ttagttgcgtgcagaaaaaatagca

SEQ ID NO: 55724 - DNA, 25 bp, E. coli
ttagttgcgtgctgaaaaaatagca

SEQ ID NO: 55725 - DNA, 25 bp, E. coli
cctgcgaatgcactaacaatccagt

SEQ ID NO: 55726 - DNA, 25 bp, E. coli
cctgcgaatgcagtaacaatccagt

SEQ ID NO: 55727 - DNA, 25 bp, E. coli
gcgaatgcagtatcaatccagtcat

SEQ ID NO: 55728 - DNA, 25 bp, E. coli
gcgaatgcagtaacaatccagtcat

SEQ ID NO: 55729 - DNA, 25 bp, E. coli
tgcagtaacaatgcagtcattaatt

SEQ ID NO: 55730 - DNA, 25 bp, E. coli
tgcagtaacaatccagtcattaatt

SEQ ID NO: 55731 - DNA, 25 bp, E. coli
gcaatgctctatttataaaagtatg

SEQ ID NO: 55732 - DNA, 25 bp, E. coli
gcaatgctctatatataaaagtatg

SEQ ID NO: 55733 - DNA, 25 bp, E. coli
cgtgcagaaaaaatagcaatgctct

SEQ ID NO: 55734 - DNA, 25 bp, E. coli
cgtgcagaaaaattagcaatgctct

SEQ ID NO: 55735 - DNA, 25 bp, E. coli
taacgaacatcctggttcgaaaatt

SEQ ID NO: 55736 - DNA, 25 bp, E. coli
taatggtttttaaaacgaacatcca

SEQ ID NO: 55737 - DNA, 25 bp, E. coli
taacgaacatccaggttcgaaaatt

SEQ ID NO: 55738 - DNA, 25 bp, E. coli
taatggtttttataacgaacatcca

SEQ ID NO: 55739 - DNA, 25 bp, E. coli
aattgtgacatacatccctgagcgg

SEQ ID NO: 55740 - DNA, 25 bp, E. coli
aattgtgacatagatccctgagcgg

SEQ ID NO: 55741 - DNA, 25 bp, E. coli
cactggcgtatattacctgggcata

SEQ ID NO: 55742 - DNA, 25 bp, E. coli
cactggcgtataatacctgggcata

SEQ ID NO: 55743 - DNA, 25 bp, E. coli
tactggactgaaaatgcgatacagc

SEQ ID NO: 55744 - DNA, 25 bp, E. coli
tacagtctgtatccggtgttaacca

SEQ ID NO: 55745 - DNA, 25 bp, E. coli
tacagtctgtatgcggtgttaacca

SEQ ID NO: 55746 - DNA, 25 bp, E. coli
tactggactgaatatgcgatacagc

SEQ ID NO: 55747 - DNA, 25 bp, E. coli
tatctcatacagcttcagccatggg

SEQ ID NO: 55748 - DNA, 25 bp, E. coli
tatctcatacaggttcagccatggg

SEQ ID NO: 55749 - DNA, 25 bp, E. coli
tgattcacgaggatttccactggcg

SEQ ID NO: 55750 - DNA, 25 bp, E. coli
tgattcacgaggttttccactggcg

SEQ ID NO: 55751 - DNA, 25 bp, E. coli
tgaacagatcggttttgcggtcagt

SEQ ID NO: 55752 - DNA, 25 bp, E. coli
tgctcagggatcgagaattcaggtt

SEQ ID NO: 55753 - DNA, 25 bp, E. coli
tgaacagatcggatttgcggtcagt

SEQ ID NO: 55754 - DNA, 25 bp, E. coli
tgctcagggatccagaattcaggtt

SEQ ID NO: 55755 - DNA, 25 bp, E. coli
tcttgaggctgaaacagaagcacgc

SEQ ID NO: 55756 - DNA, 25 bp, E. coli
tcttgaggctgatacagaagcacgc

SEQ ID NO: 55757 - DNA, 25 bp, E. coli
gaagtacgatggataagcaggcgaa

SEQ ID NO: 55758 - DNA, 25 bp, E. coli
gaagtacgatggttaagcaggcgaa

SEQ ID NO: 55759 - DNA, 25 bp, E. coli
ccctgagcggctgcataaaacgtag

SEQ ID NO: 55760 - DNA, 25 bp, E. coli
ccctgagcggctccataaaacgtag

SEQ ID NO: 55761 - DNA, 25 bp, E. coli
caaaccggaagagatcgccgggagt

SEQ ID NO: 55762 - DNA, 25 bp, E. coli
caaaccggaagacatcgccgggagt

SEQ ID NO: 55763 - DNA, 25 bp, E. coli
ttcgatatcctagatgccgggcacg

SEQ ID NO: 55764 - DNA, 25 bp, E. coli
ttcgatatcctacatgccgggcacg

SEQ ID NO: 55765 - DNA, 25 bp, E. coli
ttgaagaagacacgccgcagcgtct

SEQ ID NO: 55766 - DNA, 25 bp, E. coli
ttgaagaagacaggccgcagcgtct

SEQ ID NO: 55767 - DNA, 25 bp, E. coli
tgtcttcgatatgctacatgccggg

SEQ ID NO: 55768 - DNA, 25 bp, E. coli
tgtcttcgatatcctacatgccggg

SEQ ID NO: 55769 - DNA, 25 bp, E. coli
tgaaaggcggtgactacaaaccgga

SEQ ID NO: 55770 - DNA, 25 bp, E. coli
tgaaaggcggtgtctacaaaccgga

SEQ ID NO: 55771 - DNA, 25 bp, E. coli
gctcgaccactaacattatcaagaa

SEQ ID NO: 55772 - DNA, 25 bp, E. coli
gctcgaccactatcattatcaagaa

SEQ ID NO: 55773 - DNA, 25 bp, E. coli
gactacaaaccgcaagagatcgccg

SEQ ID NO: 55774 - DNA, 25 bp, E. coli
gacggttgctcgaccactaacatta

SEQ ID NO: 55775 - DNA, 25 bp, E. coli
gactacaaaccggaagagatcgccg

SEQ ID NO: 55776 - DNA, 25 bp, E. coli
cgcagcgtctgaacgccgggatcct

SEQ ID NO: 55777 - DNA, 25 bp, E. coli
cgcagcgtctgatcgccgggatcct

SEQ ID NO: 55778 - DNA, 25 bp, E. coli
gatatcctacatgccgggcacgtct

SEQ ID NO: 55779 - DNA, 25 bp, E. coli
gatatcctacatcccgggcacgtct

SEQ ID NO: 55780 - DNA, 25 bp, E. coli
gaccaacggtgtgttcgatatccta

SEQ ID NO: 55781 - DNA, 25 bp, E. coli
gaccaacggtgtcttcgatatccta

SEQ ID NO: 55782 - DNA, 25 bp, E. coli
gacggttgctcgtccactaacatta

SEQ ID NO: 55783 - DNA, 25 bp, E. coli
cattgtttttgctgggaatagggcg

SEQ ID NO: 55784 - DNA, 25 bp, E. coli
catttgttggttaattggtagggct

SEQ ID NO: 55785 - DNA, 25 bp, E. coli
cattgtttttgcagggaatagggcg

SEQ ID NO: 55786 - DNA, 25 bp, E. coli
catttgttggtttattggtagggct

SEQ ID NO: 55787 - DNA, 25 bp, E. coli
aacagacgttgcgatttggcgtgaa

SEQ ID NO: 55788 - DNA, 25 bp, E. coli
aacagacgttgccatttggcgtgaa

SEQ ID NO: 55789 - DNA, 25 bp, E. coli
tttttcaaacggtaacgcagttgca

SEQ ID NO: 55790 - DNA, 25 bp, E. coli
tttttcaaacggaaacgcagttgca

SEQ ID NO: 55791 - DNA, 25 bp, E. coli
tgattttagttatgtctgcaggacc

SEQ ID NO: 55792 - DNA, 25 bp, E. coli
tgattttagttaagtctgcaggacc

SEQ ID NO: 55793 - DNA, 25 bp, E. coli
ccatttggcgtgaaattattgtgcg

SEQ ID NO: 55794 - DNA, 25 bp, E. coli
ccatttggcgtgtaattattgtgcg

SEQ ID NO: 55795 - DNA, 25 bp, E. coli
gctgaatttagcttttgcgagagga

SEQ ID NO: 55796 - DNA, 25 bp, E. coli
gcaggacctattgcagtagcgacat

SEQ ID NO: 55797 - DNA, 25 bp, E. coli
gcaggacctattccagtagcgacat

SEQ ID NO: 55798 - DNA, 25 bp, E. coli
gctgaatttagcatttgcgagagga

SEQ ID NO: 55799 - DNA, 25 bp, E. coli
gaatagggcgctctatctgatttta

SEQ ID NO: 55800 - DNA, 25 bp, E. coli
gaatagggcgctgtatctgatttta

SEQ ID NO: 55801 - DNA, 25 bp, E. coli
cgcagttgcaagtacagacgttgcc

SEQ ID NO: 55802 - DNA, 25 bp, E. coli
cgcagttgcaagaacagacgttgcc

SEQ ID NO: 55803 - DNA, 25 bp, E. coli
taatgagcggatggtatggtgaaaa

SEQ ID NO: 55804 - DNA, 25 bp, E. coli
taatgagcggatcgtatggtgaaaa

SEQ ID NO: 55805 - DNA, 25 bp, E. coli
caatagagcaagatgaaagtgttcc

SEQ ID NO: 55806 - DNA, 25 bp, E. coli
caatagagcaagttgaaagtgttcc

SEQ ID NO: 55807 - DNA, 25 bp, E. coli
caagtatttggacacatgggagcaa

SEQ ID NO: 55808 - DNA, 25 bp, E. coli
aacccatagctccataaattgcgca

SEQ ID NO: 55809 - DNA, 25 bp, E. coli
caagtatttggagacatgggagcaa

SEQ ID NO: 55810 - DNA, 25 bp, E. coli
tacttagtggctgggaatgcatcgg

SEQ ID NO: 55811 - DNA, 25 bp, E. coli
tacttagtggctcggaatgcatcgg

SEQ ID NO: 55812 - DNA, 25 bp, E. coli
aaaaatttatcgtgaactgggagct

SEQ ID NO: 55813 - DNA, 25 bp, E. coli
aacccatagctcgataaattgcgca

SEQ ID NO: 55814 - DNA, 25 bp, E. coli
aaaaatttatcgagaactgggagct

SEQ ID NO: 55815 - DNA, 25 bp, E. coli
tatctaagtttaggacaagacggag

SEQ ID NO: 55816 - DNA, 25 bp, E. coli
tatctaagtttacgacaagacggag

SEQ ID NO: 55817 - DNA, 25 bp, E. coli
tgagcataaattcaaacagaggacc

SEQ ID NO: 55818 - DNA, 25 bp, E. coli
tgagcataaattgaaacagaggacc

SEQ ID NO: 55819 - DNA, 25 bp, E. coli
tcctgtcaaaggttaaccgtaatcc

SEQ ID NO: 55820 - DNA, 25 bp, E. coli
tcctgtcaaaggataaccgtaatcc

SEQ ID NO: 55821 - DNA, 25 bp, E. coli
tcagttactacgtatggagcagaac

SEQ ID NO: 55822 - DNA, 25 bp, E. coli
tcagttactacgaatggagcagaac

SEQ ID NO: 55823 - DNA, 25 bp, E. coli
gaacgatttcttaccgacaccagag

SEQ ID NO: 55824 - DNA, 25 bp, E. coli
gaacgatttctttccgacaccagag

SEQ ID NO: 55825 - DNA, 25 bp, E. coli
tcaagacttattttatggagaacgg

SEQ ID NO: 55826 - DNA, 25 bp, E. coli
tcaagacttattatatggagaacgg

SEQ ID NO: 55827 - DNA, 25 bp, E. coli
aagcgtcccgtttcgatcttagtgg

SEQ ID NO: 55828 - DNA, 25 bp, E. coli
aagcgtcccgttacgatcttagtgg

SEQ ID NO: 55829 - DNA, 25 bp, E. coli
caccattgatgtagtcgctgaacaa

SEQ ID NO: 55830 - DNA, 25 bp, E. coli
caccattgatgttgtcgctgaacaa

SEQ ID NO: 55831 - DNA, 25 bp, E. coli
catggttctgtcttgcgcttccgca

SEQ ID NO: 55832 - DNA, 25 bp, E. coli
catgcgcgaagttaaggaagaggtc

SEQ ID NO: 55833 - DNA, 25 bp, E. coli
catgcgcgaagtaaaggaagaggtc

SEQ ID NO: 55834 - DNA, 25 bp, E. coli
catggttctgtcatgcgcttccgca

SEQ ID NO: 55835 - DNA, 25 bp, E. coli
tttacgtcatcgctatgcgccgggc

SEQ ID NO: 55836 - DNA, 25 bp, E. coli
tttacgtcatcggtatgcgccgggc

SEQ ID NO: 55837 - DNA, 25 bp, E. coli
tctacgcacaagatacgaaacgggt

SEQ ID NO: 55838 - DNA, 25 bp, E. coli
tctacgcacaagttacgaaacgggt

SEQ ID NO: 55839 - DNA, 25 bp, E. coli
tcactaagtcctcgagcaaccggca

SEQ ID NO: 55840 - DNA, 25 bp, E. coli
tcactaagtcctggagcaaccggca

SEQ ID NO: 55841 - DNA, 25 bp, E. coli
ccggcaggcgattgaacagtttgta

SEQ ID NO: 55842 - DNA, 25 bp, E. coli
ccggcaggcgatagaacagtttgta

SEQ ID NO: 55843 - DNA, 25 bp, E. coli
gaacatctggcttacaagtggcttg

SEQ ID NO: 55844 - DNA, 25 bp, E. coli
gaacatctggctaacaagtggcttg

SEQ ID NO: 55845 - DNA, 25 bp, E. coli
gatttctggcagtcggtaaccggca

SEQ ID NO: 55846 - DNA, 25 bp, E. coli
gatttctggcagacggtaaccggca

SEQ ID NO: 55847 - DNA, 25 bp, E. coli
taattgactgtcagcgcacggtaga

SEQ ID NO: 55848 - DNA, 25 bp, E. coli
taattgactgtctgcgcacggtaga

SEQ ID NO: 55849 - DNA, 25 bp, E. coli
caatgacttcacgtttactgctgga

SEQ ID NO: 55850 - DNA, 25 bp, E. coli
caatgacttcacctttactgctgga

SEQ ID NO: 55851 - DNA, 25 bp, E. coli
taacatgcagactgaagcacaaccg

SEQ ID NO: 55852 - DNA, 25 bp, E. coli
tactgctggatctgacctacggtgt

SEQ ID NO: 55853 - DNA, 25 bp, E. coli
taacatgcagacagaagcacaaccg

SEQ ID NO: 55854 - DNA, 25 bp, E. coli
tactgctggatcagacctacggtgt

SEQ ID NO: 55855 - DNA, 25 bp, E. coli
tatggcggaaggcatgcgtaaccca

SEQ ID NO: 55856 - DNA, 25 bp, E. coli
tatggcggaagggatgcgtaaccca

SEQ ID NO: 55857 - DNA, 25 bp, E. coli
ttatcttacaggaccaggagagggc

SEQ ID NO: 55858 - DNA, 25 bp, E. coli
ttatcttacaggtccaggagagggc

SEQ ID NO: 55859 - DNA, 25 bp, E. coli
tccgggaaccgattgaagggattca

SEQ ID NO: 55860 - DNA, 25 bp, E. coli
tccgggaaccgaatgaagggattca

SEQ ID NO: 55861 - DNA, 25 bp, E. coli
gcggatgcgtgatgcccagcaaaaa

SEQ ID NO: 55862 - DNA, 25 bp, E. coli
gcggatgcgtgaagcccagcaaaaa

SEQ ID NO: 55863 - DNA, 25 bp, E. coli
cgtttgctcaggcattacgcgcgat

SEQ ID NO: 55864 - DNA, 25 bp, E. coli
cgtttgctcagggattacgcgcgat

SEQ ID NO: 55865 - DNA, 25 bp, E. coli
cggatcctcaatgctgccagagaga

SEQ ID NO: 55866 - DNA, 25 bp, E. coli
cggatcctcaatcctgccagagaga

SEQ ID NO: 55867 - DNA, 25 bp, E. coli
ggtcgccgccatgcttaaaaataag

SEQ ID NO: 55868 - DNA, 25 bp, E. coli
ggtcgccgccatccttaaaaataag

SEQ ID NO: 55869 - DNA, 25 bp, E. coli
tcacagtgcctcgatgaaagccatc

SEQ ID NO: 55870 - DNA, 25 bp, E. coli
tcacagtgcctccatgaaagccatc

SEQ ID NO: 55871 - DNA, 25 bp, E. coli
gcaaccttagggcacatttagcgac

SEQ ID NO: 55872 - DNA, 25 bp, E. coli
gcaaccttaggggacatttagcgac

SEQ ID NO: 55873 - DNA, 25 bp, E. coli
tagttgccccgacattgctaacaaa

SEQ ID NO: 55874 - DNA, 25 bp, E. coli
tagttgccccgagattgctaacaaa

SEQ ID NO: 55875 - DNA, 25 bp, E. coli
cctacgaaaccggaagaattcaata

SEQ ID NO: 55876 - DNA, 25 bp, E. coli
cctacgaaaccgcaagaattcaata

SEQ ID NO: 55877 - DNA, 25 bp, E. coli
tttgcgtttgccggcaaccttaggg

SEQ ID NO: 55878 - DNA, 25 bp, E. coli
tttgcgtttgcccgcaaccttaggg

SEQ ID NO: 55879 - DNA, 25 bp, E. coli
ttgccccgagatagctaacaaagtg

SEQ ID NO: 55880 - DNA, 25 bp, E. coli
ttgccccgagattgctaacaaagtg

SEQ ID NO: 55881 - DNA, 25 bp, E. coli
gcaacatttagttgccccgagattg

SEQ ID NO: 55882 - DNA, 25 bp, E. coli
gcaacatttagtagccccgagattg

SEQ ID NO: 55883 - DNA, 25 bp, E. coli
gaaaccgcaagaattcaatatattg

SEQ ID NO: 55884 - DNA, 25 bp, E. coli
gacatttagcgaccccatttatttc

SEQ ID NO: 55885 - DNA, 25 bp, E. coli
gaaaccgcaagatttcaatatattg

SEQ ID NO: 55886 - DNA, 25 bp, E. coli
gacatttagcgagcccatttatttc

SEQ ID NO: 55887 - DNA, 25 bp, E. coli
ccccgagattgctaacaaagtgcgc

SEQ ID NO: 55888 - DNA, 25 bp, E. coli
ccccgagattgcaaacaaagtgcgc

SEQ ID NO: 55889 - DNA, 25 bp, E. coli
cggcctacgaaaccgcaagaattca

SEQ ID NO: 55890 - DNA, 25 bp, E. coli
cggcctacgaaagcgcaagaattca

SEQ ID NO: 55891 - DNA, 25 bp, E. coli
gggacatttagcgaccccatttatt

SEQ ID NO: 55892 - DNA, 25 bp, E. coli
gggacatttagccaccccatttatt

SEQ ID NO: 55893 - DNA, 25 bp, E. coli
taaacgccgtccatctgaagaagcc

SEQ ID NO: 55894 - DNA, 25 bp, E. coli
taaacgccgtccttctgaagaagcc

SEQ ID NO: 55895 - DNA, 25 bp, E. coli
ttcccgggtttttcagagcacgcca

SEQ ID NO: 55896 - DNA, 25 bp, E. coli
ttttacagagcacgccagagaaaca

SEQ ID NO: 55897 - DNA, 25 bp, E. coli
ttcccgggttttacagagcacgcca

SEQ ID NO: 55898 - DNA, 25 bp, E. coli
ttttacagagcaggccagagaaaca

SEQ ID NO: 55899 - DNA, 25 bp, E. coli
tgttcccgggttttacagagcacgc

SEQ ID NO: 55900 - DNA, 25 bp, E. coli
tgttcccgggttatacagagcacgc

SEQ ID NO: 55901 - DNA, 25 bp, E. coli
tccatctgaagaagccatcgccgtt

SEQ ID NO: 55902 - DNA, 25 bp, E. coli
tccatctgaagatgccatcgccgtt

SEQ ID NO: 55903 - DNA, 25 bp, E. coli
tcagaaaacaccacgcttccgacgc

SEQ ID NO: 55904 - DNA, 25 bp, E. coli
tcagaaaacacctcgcttccgacgc

SEQ ID NO: 55905 - DNA, 25 bp, E. coli
gcttccgacgctcccactggattta

SEQ ID NO: 55906 - DNA, 25 bp, E. coli
gctgccactggatttacgcgagttt

SEQ ID NO: 55907 - DNA, 25 bp, E. coli
gctgccactggaattacgcgagttt

SEQ ID NO: 55908 - DNA, 25 bp, E. coli
gcttccgacgctgccactggattta

SEQ ID NO: 55909 - DNA, 25 bp, E. coli
cgggttttacagtgcacgccagaga

SEQ ID NO: 55910 - DNA, 25 bp, E. coli
cgggttttacagagcacgccagaga

SEQ ID NO: 55911 - DNA, 25 bp, E. coli
gatccctttaaacgccgtccatctg

SEQ ID NO: 55912 - DNA, 25 bp, E. coli
gatccctttaaaggccgtccatctg

SEQ ID NO: 55913 - DNA, 25 bp, E. coli
gacgctgccactcgatttacgcgag

SEQ ID NO: 55914 - DNA, 25 bp, E. coli
gacgctgccactggatttacgcgag

SEQ ID NO: 55915 - DNA, 25 bp, E. coli
caacgccgctatggcgtgaaagacg

SEQ ID NO: 55916 - DNA, 25 bp, E. coli
caacgccgctatcgcgtgaaagacg

SEQ ID NO: 55917 - DNA, 25 bp, E. coli
tagcctgtgaatgcccgggagctta

SEQ ID NO: 55918 - DNA, 25 bp, E. coli
tagcctgtgaatccccgggagctta

SEQ ID NO: 55919 - DNA, 25 bp, E. coli
cgaagaattaggtgaatttccgaag

SEQ ID NO: 55920 - DNA, 25 bp, E. coli
cgaagaattaggagaatttccgaag

SEQ ID NO: 55921 - DNA, 25 bp, E. coli
tatttcgcgtcacagcaaggcggct

SEQ ID NO: 55922 - DNA, 25 bp, E. coli
tatttcgcgtcagagcaaggcggct

SEQ ID NO: 55923 - DNA, 25 bp, E. coli
gaatttccgaagaatttcgcgtcag

SEQ ID NO: 55924 - DNA, 25 bp, E. coli
gcaaggcggctagcctgtgaatccc

SEQ ID NO: 55925 - DNA, 25 bp, E. coli
gcaaggcggctaccctgtgaatccc

SEQ ID NO: 55926 - DNA, 25 bp, E. coli
gaagaaaatcggctgccgcagcacc

SEQ ID NO: 55927 - DNA, 25 bp, E. coli
gaatttccgaagtatttcgcgtcag

SEQ ID NO: 55928 - DNA, 25 bp, E. coli
gaagaaaatcgggtgccgcagcacc

SEQ ID NO: 55929 - DNA, 25 bp, E. coli
ctatggcgtgaatgacgaaggaaat

SEQ ID NO: 55930 - DNA, 25 bp, E. coli
ctatggcgtgaaagacgaaggaaat

SEQ ID NO: 55931 - DNA, 25 bp, E. coli
ggtgccgcagcacccgaagaattag

SEQ ID NO: 55932 - DNA, 25 bp, E. coli
ggtgccgcagcagccgaagaattag

SEQ ID NO: 55933 - DNA, 25 bp, E. coli
tggatgcagcttccatcatggtgcg

SEQ ID NO: 55934 - DNA, 25 bp, E. coli
ggcctctgcggctacctggatgcag

SEQ ID NO: 55935 - DNA, 25 bp, E. coli
tggatgcagcttgcatcatggtgcg

SEQ ID NO: 55936 - DNA, 25 bp, E. coli
ggcctctgcggcaacctggatgcag

SEQ ID NO: 55937 - DNA, 25 bp, E. coli
caaacgtctggttcgtgcagcgatc

SEQ ID NO: 55938 - DNA, 25 bp, E. coli
cacacaggtttatggtcaggacgtc

SEQ ID NO: 55939 - DNA, 25 bp, E. coli
caaacgtctggtacgtgcagcgatc

SEQ ID NO: 55940 - DNA, 25 bp, E. coli
cacacaggtttaaggtcaggacgtc

SEQ ID NO: 55941 - DNA, 25 bp, E. coli
taaaggcgagcgtaaaatctcctgg

SEQ ID NO: 55942 - DNA, 25 bp, E. coli
tacgttactatctgggcactccaag

SEQ ID NO: 55943 - DNA, 25 bp, E. coli
taaagtagttgtaccggcacaaggc

SEQ ID NO: 55944 - DNA, 25 bp, E. coli
taaagtagttgttccggcacaaggc

SEQ ID NO: 55945 - DNA, 25 bp, E. coli
taaacaccctgatctgaccgatatg

SEQ ID NO: 55946 - DNA, 25 bp, E. coli
tacgttactatcagggcactccaag

SEQ ID NO: 55947 - DNA, 25 bp, E. coli
taaacaccctgaactgaccgatatg

SEQ ID NO: 55948 - DNA, 25 bp, E. coli
taaaggcgagcgaaaaatctcctgg

SEQ ID NO: 55949 - DNA, 25 bp, E. coli
gaatcggtgtagatgtaaccccagc

SEQ ID NO: 55950 - DNA, 25 bp, E. coli
gaatcggtgtagttgtaaccccagc

SEQ ID NO: 55951 - DNA, 25 bp, E. coli
gatcctgctgcgaccggctgaatat

SEQ ID NO: 55952 - DNA, 25 bp, E. coli
ggtgactacattactgacgccctgg

SEQ ID NO: 55953 - DNA, 25 bp, E. coli
ggtgactacatttctgacgccctgg

SEQ ID NO: 55954 - DNA, 25 bp, E. coli
gacgaatgcgccgtgtttgaagcca

SEQ ID NO: 55955 - DNA, 25 bp, E. coli
gacgctgcagtcgagaaagcctata

SEQ ID NO: 55956 - DNA, 25 bp, E. coli
gatcctgctgcgtccggctgaatat

SEQ ID NO: 55957 - DNA, 25 bp, E. coli
gacgaatgcgccctgtttgaagcca

SEQ ID NO: 55958 - DNA, 25 bp, E. coli
gacgctgcagtccagaaagcctata

SEQ ID NO: 55959 - DNA, 25 bp, E. coli
aatttccctgctggacagcctgcag

SEQ ID NO: 55960 - DNA, 25 bp, E. coli
aatttccctgctcgacagcctgcag

SEQ ID NO: 55961 - DNA, 25 bp, E. coli
tacgtatcgcttaggtgaggaccac

SEQ ID NO: 55962 - DNA, 25 bp, E. coli
tacgtatcgctttggtgaggaccac

SEQ ID NO: 55963 - DNA, 25 bp, E. coli
tgcaaatcttatacgccgtgaccgt

SEQ ID NO: 55964 - DNA, 25 bp, E. coli
tgcaaatcttattcgccgtgaccgt

SEQ ID NO: 55965 - DNA, 25 bp, E. coli
gaatcccgcagtcaacgctacacgt

SEQ ID NO: 55966 - DNA, 25 bp, E. coli
gaagagttatttggcgtggtgccca

SEQ ID NO: 55967 - DNA, 25 bp, E. coli
gaatcccgcagtgaacgctacacgt

SEQ ID NO: 55968 - DNA, 25 bp, E. coli
gaagagttatttcgcgtggtgccca

SEQ ID NO: 55969 - DNA, 25 bp, E. coli
gacctttggacctcctatcagcgga

SEQ ID NO: 55970 - DNA, 25 bp, E. coli
gaactcatactcctgccgtgcgtgg

SEQ ID NO: 55971 - DNA, 25 bp, E. coli
gaactcatactcgtgccgtgcgtgg

SEQ ID NO: 55972 - DNA, 25 bp, E. coli
gacctttggaccacctatcagcgga

SEQ ID NO: 55973 - DNA, 25 bp, E. coli
cccgtcgtcgtgtgcatactaagca

SEQ ID NO: 55974 - DNA, 25 bp, E. coli
cccgtcgtcgtgagcatactaagca

SEQ ID NO: 55975 - DNA, 25 bp, E. coli
cgtaatgctaaacgcggacgaactc

SEQ ID NO: 55976 - DNA, 25 bp, E. coli
cgtaatgctaaaggcggacgaactc

SEQ ID NO: 55977 - DNA, 25 bp, E. coli
taagcatatgctgcgcctacgtcgg

SEQ ID NO: 55978 - DNA, 25 bp, E. coli
taagcatatgctccgcctacgtcgg

SEQ ID NO: 55979 - DNA, 25 bp, E. coli
gatgtgaagctttaccgtgcgctgt

SEQ ID NO: 55980 - DNA, 25 bp, E. coli
gatgtgaagcttaaccgtgcgctgt

SEQ ID NO: 55981 - DNA, 25 bp, E. coli
agaagctcgccaaaaccttcaatca

SEQ ID NO: 55982 - DNA, 25 bp, E. coli
agaagctcgccataaccttcaatca

SEQ ID NO: 55983 - DNA, 25 bp, E. coli
atgcaaacgattttccgtgtcgaga

SEQ ID NO: 55984 - DNA, 25 bp, E. coli
atgcaaacgattatccgtgtcgaga

SEQ ID NO: 55985 - DNA, 25 bp, E. coli
aacgattatccgagtcgagaagctc

SEQ ID NO: 55986 - DNA, 25 bp, E. coli
aacgattatccgtgtcgagaagctc

SEQ ID NO: 55987 - DNA, 25 bp, E. coli
tatccgtgtcgacaagctcgccaaa

SEQ ID NO: 55988 - DNA, 25 bp, E. coli
tatccgtgtcgagaagctcgccaaa

SEQ ID NO: 55989 - DNA, 25 bp, E. coli
tgtcgagaagctggccaaaaccttc

SEQ ID NO: 55990 - DNA, 25 bp, E. coli
tgtcgagaagctcgccaaaaccttc

SEQ ID NO: 55991 - DNA, 25 bp, E. coli
tccgtgtcgagaagctcgccaaaac

SEQ ID NO: 55992 - DNA, 25 bp, E. coli
tccgtgtcgagatgctcgccaaaac

SEQ ID NO: 55993 - DNA, 25 bp, E. coli
gcaaacgattatgcgtgtcgagaag

SEQ ID NO: 55994 - DNA, 25 bp, E. coli
gcaaacgattatccgtgtcgagaag

SEQ ID NO: 55995 - DNA, 25 bp, E. coli
cgctgacccgcgatggcatggtgca

SEQ ID NO: 55996 - DNA, 25 bp, E. coli
cgctgacccgcgttggcatggtgca

SEQ ID NO: 55997 - DNA, 25 bp, E. coli
cgtgtcgagaagctcgccaaaacct

SEQ ID NO: 55998 - DNA, 25 bp, E. coli
cgtgtcgagaaggtcgccaaaacct

SEQ ID NO: 55999 - DNA, 25 bp, E. coli
cgagaagctcgcgaaaaccttcaat

SEQ ID NO: 56000 - DNA, 25 bp, E. coli
cgagaagctcgccaaaaccttcaat

SEQ ID NO: 56001 - DNA, 25 bp, E. coli
gattatccgtgtggagaagctcgcc

SEQ ID NO: 56002 - DNA, 25 bp, E. coli
gattatccgtgtcgagaagctcgcc

SEQ ID NO: 56003 - DNA, 25 bp, E. coli
cagctggcgctgttgtcgtgcattt

SEQ ID NO: 56004 - DNA, 25 bp, E. coli
cagctggcgctgatgtcgtgcattt

SEQ ID NO: 56005 - DNA, 25 bp, E. coli
agaagcctccgaccatgttgaccgc

SEQ ID NO: 56006 - DNA, 25 bp, E. coli
agaagcctccgagcatgttgaccgc

SEQ ID NO: 56007 - DNA, 25 bp, E. coli
tgtcggctgattatgcccgcctggg

SEQ ID NO: 56008 - DNA, 25 bp, E. coli
tgtcggctgattttgcccgcctggg

SEQ ID NO: 56009 - DNA, 25 bp, E. coli
tgatgaaatgcggagtgaactggca

SEQ ID NO: 56010 - DNA, 25 bp, E. coli
tgatgaaatgcgcagtgaactggca

SEQ ID NO: 56011 - DNA, 25 bp, E. coli
tcctcaaacactcgataaactgcgc

SEQ ID NO: 56012 - DNA, 25 bp, E. coli
tcctcaaacactggataaactgcgc

SEQ ID NO: 56013 - DNA, 25 bp, E. coli
gcattttgacgtgatggataaccac

SEQ ID NO: 56014 - DNA, 25 bp, E. coli
gcattttgacgtcatggataaccac

SEQ ID NO: 56015 - DNA, 25 bp, E. coli
cggtggcgtgaacgtgaacaacatt

SEQ ID NO: 56016 - DNA, 25 bp, E. coli
cggtggcgtgaaggtgaacaacatt

SEQ ID NO: 56017 - DNA, 25 bp, E. coli
cgtatcgacgagtctggctttgaca

SEQ ID NO: 56018 - DNA, 25 bp, E. coli
cgtatcgacgagactggctttgaca

SEQ ID NO: 56019 - DNA, 25 bp, E. coli
gattgggccaatggtgctgaaatcc

SEQ ID NO: 56020 - DNA, 25 bp, E. coli
gattgggccaatcgtgctgaaatcc

SEQ ID NO: 56021 - DNA, 25 bp, E. coli
gtgaagataccggaaaagccctggc

SEQ ID NO: 56022 - DNA, 25 bp, E. coli
ggttcggcaatcttcgaccagccag

SEQ ID NO: 56023 - DNA, 25 bp, E. coli
gtgaagataccgcaaaagccctggc

SEQ ID NO: 56024 - DNA, 25 bp, E. coli
ggttcggcaatcatcgaccagccag

SEQ ID NO: 56025 - DNA, 25 bp, E. coli
aataggccgcattacctggcgttga

SEQ ID NO: 56026 - DNA, 25 bp, E. coli
aataggccgcataacctggcgttga

SEQ ID NO: 56027 - DNA, 25 bp, E. coli
cacgatcacatttcggaccggcaga

SEQ ID NO: 56028 - DNA, 25 bp, E. coli
cacgatcacattacggaccggcaga

SEQ ID NO: 56029 - DNA, 25 bp, E. coli
catcgcagaattacagtgagaacgt

SEQ ID NO: 56030 - DNA, 25 bp, E. coli
catcgcagaatttcagtgagaacgt

SEQ ID NO: 56031 - DNA, 25 bp, E. coli
taacagaacacgtataatgagagcc

SEQ ID NO: 56032 - DNA, 25 bp, E. coli
taacagaacacgaataatgagagcc

SEQ ID NO: 56033 - DNA, 25 bp, E. coli
taggagagcaatttcacatcgcaga

SEQ ID NO: 56034 - DNA, 25 bp, E. coli
taggagagcaatatcacatcgcaga

SEQ ID NO: 56035 - DNA, 25 bp, E. coli
tgagaacgtgcaaaaatttagcggg

SEQ ID NO: 56036 - DNA, 25 bp, E. coli
tgagaacgtgcataaatttagcggg

SEQ ID NO: 56037 - DNA, 25 bp, E. coli
tgagagccatctcgcaaaaatgaaa

SEQ ID NO: 56038 - DNA, 25 bp, E. coli
tgagagccatctggcaaaaatgaaa

SEQ ID NO: 56039 - DNA, 25 bp, E. coli
tctttttaaccagtcaataggccgc

SEQ ID NO: 56040 - DNA, 25 bp, E. coli
tctttggtacccatgcgggatgtct

SEQ ID NO: 56041 - DNA, 25 bp, E. coli
tctttggtacccttgcgggatgtct

SEQ ID NO: 56042 - DNA, 25 bp, E. coli
tctttttaaccactcaataggccgc

SEQ ID NO: 56043 - DNA, 25 bp, E. coli
gacaaattgtcgtatgcacagcaga

SEQ ID NO: 56044 - DNA, 25 bp, E. coli
gacaaattgtcgaatgcacagcaga

SEQ ID NO: 56045 - DNA, 25 bp, E. coli
taataaccgcaagtcaaagatgtgg

SEQ ID NO: 56046 - DNA, 25 bp, E. coli
taataaccgcaactcaaagatgtgg

SEQ ID NO: 56047 - DNA, 25 bp, E. coli
caatgcttgtaaagcggaccacgcg

SEQ ID NO: 56048 - DNA, 25 bp, E. coli
caatgcttgtaatgcggaccacgcg

SEQ ID NO: 56049 - DNA, 25 bp, E. coli
taaagccgccgctcggctgggcgtt

SEQ ID NO: 56050 - DNA, 25 bp, E. coli
taaagccgccgcacggctgggcgtt

SEQ ID NO: 56051 - DNA, 25 bp, E. coli
aaatcgatcttattcttttacccat

SEQ ID NO: 56052 - DNA, 25 bp, E. coli
aaatcgatcttaatcttttacccat

SEQ ID NO: 56053 - DNA, 25 bp, E. coli
tacccatttttaacgcggtagcaga

SEQ ID NO: 56054 - DNA, 25 bp, E. coli
tacccatttttatcgcggtagcaga

SEQ ID NO: 56055 - DNA, 25 bp, E. coli
tgggcgttacccgttcagcggtcag

SEQ ID NO: 56056 - DNA, 25 bp, E. coli
tgggcgttaccccttcagcggtcag

SEQ ID NO: 56057 - DNA, 25 bp, E. coli
tcgcggtagcagtagagagtaattt

SEQ ID NO: 56058 - DNA, 25 bp, E. coli
tcgcggtagcagaagagagtaattt

SEQ ID NO: 56059 - DNA, 25 bp, E. coli
ccgttcagcggtcagtcagggaata

SEQ ID NO: 56060 - DNA, 25 bp, E. coli
ccgttcagcggtgagtcagggaata

SEQ ID NO: 56061 - DNA, 25 bp, E. coli
cggtcagtcagggaataagacgcct

SEQ ID NO: 56062 - DNA, 25 bp, E. coli
cggtcagtcaggcaataagacgcct

SEQ ID NO: 56063 - DNA, 25 bp, E. coli
taattttagtaatgccgccgcacgg

SEQ ID NO: 56064 - DNA, 25 bp, E. coli
taagacgccttgtagatgcattcgg

SEQ ID NO: 56065 - DNA, 25 bp, E. coli
taagacgccttgaagatgcattcgg

SEQ ID NO: 56066 - DNA, 25 bp, E. coli
taattttagtaaagccgccgcacgg

SEQ ID NO: 56067 - DNA, 25 bp, E. coli
gatgcattcgggacaatgcttgtaa

SEQ ID NO: 56068 - DNA, 25 bp, E. coli
gatgcattcgggtcaatgcttgtaa

SEQ ID NO: 56069 - DNA, 25 bp, E. coli
catgatgtgtacgtgctgtgcggct

SEQ ID NO: 56070 - DNA, 25 bp, E. coli
catgatgtgtacctgctgtgcggct

SEQ ID NO: 56071 - DNA, 25 bp, E. coli
ttgtttgtcattcccacggcagcag

SEQ ID NO: 56072 - DNA, 25 bp, E. coli
ttgtttgtcattgccacggcagcag

SEQ ID NO: 56073 - DNA, 25 bp, E. coli
tgattcaggtgcagatcccgcgtga

SEQ ID NO: 56074 - DNA, 25 bp, E. coli
tgattcaggtgctgatcccgcgtga

SEQ ID NO: 56075 - DNA, 25 bp, E. coli
tcggtaaatctatccttgcgcaggc

SEQ ID NO: 56076 - DNA, 25 bp, E. coli
tcggtaaatctaaccttgcgcaggc

SEQ ID NO: 56077 - DNA, 25 bp, E. coli
gaatgcgtcgcctacaggtgtcgat

SEQ ID NO: 56078 - DNA, 25 bp, E. coli
gaatgcgtcgccaacaggtgtcgat

SEQ ID NO: 56079 - DNA, 25 bp, E. coli
cccatgccgatggtgctgtcgataa

SEQ ID NO: 56080 - DNA, 25 bp, E. coli
cccatgccgatgctgctgtcgataa

SEQ ID NO: 56081 - DNA, 25 bp, E. coli
cattcagtggtgcaaacccgcgctt

SEQ ID NO: 56082 - DNA, 25 bp, E. coli
cattcagtggtggaaacccgcgctt

SEQ ID NO: 56083 - DNA, 25 bp, E. coli
gattgtacaaaccatgatgctggca

SEQ ID NO: 56084 - DNA, 25 bp, E. coli
gattgtacaaacgatgatgctggca

SEQ ID NO: 56085 - DNA, 25 bp, E. coli
tggcattgttgatgacgctcccggc

SEQ ID NO: 56086 - DNA, 25 bp, E. coli
tggtcagtcttcttctcaggcggca

SEQ ID NO: 56087 - DNA, 25 bp, E. coli
tggcattgttgaagacgctcccggc

SEQ ID NO: 56088 - DNA, 25 bp, E. coli
tggtcagtcttcatctcaggcggca

SEQ ID NO: 56089 - DNA, 25 bp, E. coli
gacgcttttctgcagtacgatcccg

SEQ ID NO: 56090 - DNA, 25 bp, E. coli
gacgcttttctggagtacgatcccg

SEQ ID NO: 56091 - DNA, 25 bp, E. coli
caaacgtgcgctgatattacgtggc

SEQ ID NO: 56092 - DNA, 25 bp, E. coli
caaacgtgcgctcatattacgtggc

SEQ ID NO: 56093 - DNA, 25 bp, E. coli
aacacgcggttggttttgcccaatc

SEQ ID NO: 56094 - DNA, 25 bp, E. coli
aacacgcggttgcttttgcccaatc

SEQ ID NO: 56095 - DNA, 25 bp, E. coli
tacgatggtgcagaagaagcgatgc

SEQ ID NO: 56096 - DNA, 25 bp, E. coli
taccagcggtgaaatgttgcagcaa

SEQ ID NO: 56097 - DNA, 25 bp, E. coli
taccagcggtgatatgttgcagcaa

SEQ ID NO: 56098 - DNA, 25 bp, E. coli
tacgatggtgcacaagaagcgatgc

SEQ ID NO: 56099 - DNA, 25 bp, E. coli
tcgtcagtgagcgtttggcgaaact

SEQ ID NO: 56100 - DNA, 25 bp, E. coli
tcgtcagtgagcctttggcgaaact

SEQ ID NO: 56101 - DNA, 25 bp, E. coli
tctggtcgctgatcccacaatggta

SEQ ID NO: 56102 - DNA, 25 bp, E. coli
tcagcaagatcgtaaatggccccga

SEQ ID NO: 56103 - DNA, 25 bp, E. coli
tctggtcgctgaacccacaatggta

SEQ ID NO: 56104 - DNA, 25 bp, E. coli
gctgacaacgatccgcttttacggg

SEQ ID NO: 56105 - DNA, 25 bp, E. coli
gctgacaacgatgcgcttttacggg

SEQ ID NO: 56106 - DNA, 25 bp, E. coli
gcaacttgctgaacaactggcagcg

SEQ ID NO: 56107 - DNA, 25 bp, E. coli
gaagagttagtgtgccgtctgcgca

SEQ ID NO: 56108 - DNA, 25 bp, E. coli
gaagattctctagccgcaggatcgg

SEQ ID NO: 56109 - DNA, 25 bp, E. coli
gaagagttagtgagccgtctgcgca

SEQ ID NO: 56110 - DNA, 25 bp, E. coli
gaagattctctacccgcaggatcgg

SEQ ID NO: 56111 - DNA, 25 bp, E. coli
gcaacttgctgatcaactggcagcg

SEQ ID NO: 56112 - DNA, 25 bp, E. coli
tcagcaagatcgaaaatggccccga

SEQ ID NO: 56113 - DNA, 25 bp, E. coli
cagaaagggcgaacattcaatcgcc

SEQ ID NO: 56114 - DNA, 25 bp, E. coli
cagaaagggcgatcattcaatcgcc

SEQ ID NO: 56115 - DNA, 25 bp, E. coli
cattcaatcgccgttttttactttg

SEQ ID NO: 56116 - DNA, 25 bp, E. coli
cattcaatcgcccttttttactttg

SEQ ID NO: 56117 - DNA, 25 bp, E. coli
aggccgggccggttcctgttccagt

SEQ ID NO: 56118 - DNA, 25 bp, E. coli
aggccgggccggatcctgttccagt

SEQ ID NO: 56119 - DNA, 25 bp, E. coli
tatttgccaacaaacagaaagggcg

SEQ ID NO: 56120 - DNA, 25 bp, E. coli
tatttgccaacatacagaaagggcg

SEQ ID NO: 56121 - DNA, 25 bp, E. coli
tgctgtgttcgaacgcgtttagacc

SEQ ID NO: 56122 - DNA, 25 bp, E. coli
tgcggcataaataacgaactatttg

SEQ ID NO: 56123 - DNA, 25 bp, E. coli
tgctgtgttcgatcgcgtttagacc

SEQ ID NO: 56124 - DNA, 25 bp, E. coli
tgcggcataaattacgaactatttg

SEQ ID NO: 56125 - DNA, 25 bp, E. coli
gccacttttttctaagcataaaccg

SEQ ID NO: 56126 - DNA, 25 bp, E. coli
ccaacaaacagaaagggcgatcatt

SEQ ID NO: 56127 - DNA, 25 bp, E. coli
gccacttttttcaaagcataaaccg

SEQ ID NO: 56128 - DNA, 25 bp, E. coli
ccaacaaacagatagggcgatcatt

SEQ ID NO: 56129 - DNA, 25 bp, E. coli
gcgtttagacccaacatctgccgga

SEQ ID NO: 56130 - DNA, 25 bp, E. coli
gcgtttagaccctacatctgccgga

SEQ ID NO: 56131 - DNA, 25 bp, E. coli
taataaaatggccaggccgggccgg

SEQ ID NO: 56132 - DNA, 25 bp, E. coli
tagaccctacatgtgccggatgcgg

SEQ ID NO: 56133 - DNA, 25 bp, E. coli
taataaaatggcgaggccgggccgg

SEQ ID NO: 56134 - DNA, 25 bp, E. coli
tagaccctacatctgccggatgcgg

SEQ ID NO: 56135 - DNA, 25 bp, E. coli
aatctacggcgcgaaaggtctggct

SEQ ID NO: 56136 - DNA, 25 bp, E. coli
aatctacggcgccaaaggtctggct

SEQ ID NO: 56137 - DNA, 25 bp, E. coli
taaagctggcctgtgaactgcgtaa

SEQ ID NO: 56138 - DNA, 25 bp, E. coli
taaagctggcctctgaactgcgtaa

SEQ ID NO: 56139 - DNA, 25 bp, E. coli
tatcaacgaagaggaacagcgcgag

SEQ ID NO: 56140 - DNA, 25 bp, E. coli
tatcaacgaagacgaacagcgcgag

SEQ ID NO: 56141 - DNA, 25 bp, E. coli
tgatcttcatcgttatgcgcgaccg

SEQ ID NO: 56142 - DNA, 25 bp, E. coli
tgatcttcatcgatatgcgcgaccg

SEQ ID NO: 56143 - DNA, 25 bp, E. coli
tcatcaatggtttcgaagtgggcgg

SEQ ID NO: 56144 - DNA, 25 bp, E. coli
tcatcaatggttacgaagtgggcgg

SEQ ID NO: 56145 - DNA, 25 bp, E. coli
tctgaccgacgatagcaaatgggca

SEQ ID NO: 56146 - DNA, 25 bp, E. coli
tctgaccgacgaaagcaaatgggca

SEQ ID NO: 56147 - DNA, 25 bp, E. coli
gatatgattttcttcggtgccgaca

SEQ ID NO: 56148 - DNA, 25 bp, E. coli
gatatgattttcatcggtgccgaca

SEQ ID NO: 56149 - DNA, 25 bp, E. coli
ggaaacttctttcatgaccgcgccg

SEQ ID NO: 56150 - DNA, 25 bp, E. coli
ggaaacttctttgatgaccgcgccg

SEQ ID NO: 56151 - DNA, 25 bp, E. coli
taacgaacgcgccaaaggtctggaa

SEQ ID NO: 56152 - DNA, 25 bp, E. coli
taaaccggatctccgtaacccgatg

SEQ ID NO: 56153 - DNA, 25 bp, E. coli
taaaccggatctgcgtaacccgatg

SEQ ID NO: 56154 - DNA, 25 bp, E. coli
taacgaacgcgcgaaaggtctggaa

SEQ ID NO: 56155 - DNA, 25 bp, E. coli
gagttctgcattgaggtcacgggca

SEQ ID NO: 56156 - DNA, 25 bp, E. coli
gagttctgcattcaggtcacgggca

SEQ ID NO: 56157 - DNA, 25 bp, E. coli
cccattaaaggtgccgatggcgtgc

SEQ ID NO: 56158 - DNA, 25 bp, E. coli
cccattaaaggtcccgatggcgtgc

SEQ ID NO: 56159 - DNA, 25 bp, E. coli
catctgcccattaaaggtgccgatg

SEQ ID NO: 56160 - DNA, 25 bp, E. coli
catctgcccatttaaggtgccgatg

SEQ ID NO: 56161 - DNA, 25 bp, E. coli
taaaggtgccgaaggcgtgctgatc

SEQ ID NO: 56162 - DNA, 25 bp, E. coli
taaaggtgccgatggcgtgctgatc

SEQ ID NO: 56163 - DNA, 25 bp, E. coli
acatctgcccataaaaggtgccgat

SEQ ID NO: 56164 - DNA, 25 bp, E. coli
attaaaggtgcccatggcgtgctga

SEQ ID NO: 56165 - DNA, 25 bp, E. coli
acatctgcccattaaaggtgccgat

SEQ ID NO: 56166 - DNA, 25 bp, E. coli
attaaaggtgccgatggcgtgctga

SEQ ID NO: 56167 - DNA, 25 bp, E. coli
tgcccattaaaggtgccgatggcgt

SEQ ID NO: 56168 - DNA, 25 bp, E. coli
tgcccattaaagctgccgatggcgt

SEQ ID NO: 56169 - DNA, 25 bp, E. coli
tctgcccattaaaggtgccgatggc

SEQ ID NO: 56170 - DNA, 25 bp, E. coli
tctgcccattaatggtgccgatggc

SEQ ID NO: 56171 - DNA, 25 bp, E. coli
gcccattaaaggagccgatggcgtg

SEQ ID NO: 56172 - DNA, 25 bp, E. coli
gcccattaaaggtgccgatggcgtg

SEQ ID NO: 56173 - DNA, 25 bp, E. coli
gacatctgcccattaaaggtgccga

SEQ ID NO: 56174 - DNA, 25 bp, E. coli
gacatctgcccaataaaggtgccga

SEQ ID NO: 56175 - DNA, 25 bp, E. coli
cggacatctgccgattaaaggtgcc

SEQ ID NO: 56176 - DNA, 25 bp, E. coli
cggacatctgcccattaaaggtgcc

SEQ ID NO: 56177 - DNA, 25 bp, E. coli
ggacatctgcccattaaaggtgccg

SEQ ID NO: 56178 - DNA, 25 bp, E. coli
ggacatctgccctttaaaggtgccg

SEQ ID NO: 56179 - DNA, 25 bp, E. coli
cactgctggaatccctgaagtctca

SEQ ID NO: 56180 - DNA, 25 bp, E. coli
cactgctggaatgcctgaagtctca

SEQ ID NO: 56181 - DNA, 25 bp, E. coli
tacacacggagacacagattacctc

SEQ ID NO: 56182 - DNA, 25 bp, E. coli
tacacacggagagacagattacctc

SEQ ID NO: 56183 - DNA, 25 bp, E. coli
taaaaactaccgaatctcaccagca

SEQ ID NO: 56184 - DNA, 25 bp, E. coli
taaaaactaccgtatctcaccagca

SEQ ID NO: 56185 - DNA, 25 bp, E. coli
tattactgggaacgtaagctggagc

SEQ ID NO: 56186 - DNA, 25 bp, E. coli
tattactgggaaggtaagctggagc

SEQ ID NO: 56187 - DNA, 25 bp, E. coli
tggttttacctgatacacacggaga

SEQ ID NO: 56188 - DNA, 25 bp, E. coli
tcatcatccataacaaaccccggaa

SEQ ID NO: 56189 - DNA, 25 bp, E. coli
tcatcatccatatcaaaccccggaa

SEQ ID NO: 56190 - DNA, 25 bp, E. coli
gatttagccgcctaagtgctggcgg

SEQ ID NO: 56191 - DNA, 25 bp, E. coli
gattacctctcaaggctcaacgcat

SEQ ID NO: 56192 - DNA, 25 bp, E. coli
gatttagccgccaaagtgctggcgg

SEQ ID NO: 56193 - DNA, 25 bp, E. coli
gattacctctcatggctcaacgcat

SEQ ID NO: 56194 - DNA, 25 bp, E. coli
tggttttacctgttacacacggaga

SEQ ID NO: 56195 - DNA, 25 bp, E. coli
ggcgctacctctgtctattactggg

SEQ ID NO: 56196 - DNA, 25 bp, E. coli
ggcgctacctctctctattactggg

SEQ ID NO: 56197 - DNA, 25 bp, E. coli
taagctggagcatgaatacgaagtg

SEQ ID NO: 56198 - DNA, 25 bp, E. coli
taagctggagcaagaatacgaagtg

SEQ ID NO: 56199 - DNA, 25 bp, E. coli
gatgaagcgacagcccaggatttag

SEQ ID NO: 56200 - DNA, 25 bp, E. coli
gatgaagcgacaccccaggatttag

SEQ ID NO: 56201 - DNA, 25 bp, E. coli
caggcacaagtcagcggattacaga

SEQ ID NO: 56202 - DNA, 25 bp, E. coli
caggcacaagtctgcggattacaga

SEQ ID NO: 56203 - DNA, 25 bp, E. coli
tacggtttactcagcatggtatcgc

SEQ ID NO: 56204 - DNA, 25 bp, E. coli
tacggtttactctgcatggtatcgc

SEQ ID NO: 56205 - DNA, 25 bp, E. coli
tattataatatcgttcccctgtgca

SEQ ID NO: 56206 - DNA, 25 bp, E. coli
tattataatatccttcccctgtgca

SEQ ID NO: 56207 - DNA, 25 bp, E. coli
tgtcttgactatcaacaggcacaag

SEQ ID NO: 56208 - DNA, 25 bp, E. coli
tgtcttgactatgaacaggcacaag

SEQ ID NO: 56209 - DNA, 25 bp, E. coli
tcctggtattaataggctgggcgct

SEQ ID NO: 56210 - DNA, 25 bp, E. coli
tcctggtattaaaaggctgggcgct

SEQ ID NO: 56211 - DNA, 25 bp, E. coli
gccgctgggaataggtgcatttatt

SEQ ID NO: 56212 - DNA, 25 bp, E. coli
gccgctgggaattggtgcatttatt

SEQ ID NO: 56213 - DNA, 25 bp, E. coli
gaaccacgcaatgtttcctggcata

SEQ ID NO: 56214 - DNA, 25 bp, E. coli
gaaccacgcaatctttcctggcata

SEQ ID NO: 56215 - DNA, 25 bp, E. coli
gactgtcttgtggaattacaactgg

SEQ ID NO: 56216 - DNA, 25 bp, E. coli
gactgtcttgtgcaattacaactgg

SEQ ID NO: 56217 - DNA, 25 bp, E. coli
ctggattataggtatgccgctggga

SEQ ID NO: 56218 - DNA, 25 bp, E. coli
ctggattataggaatgccgctggga

SEQ ID NO: 56219 - DNA, 25 bp, E. coli
ggtatcgcctaccatttttgccaca

SEQ ID NO: 56220 - DNA, 25 bp, E. coli
ggtatcgcctacgatttttgccaca

SEQ ID NO: 56221 - DNA, 25 bp, E. coli
taataggagatgcaatgaaccacgc

SEQ ID NO: 56222 - DNA, 25 bp, E. coli
taataggagatggaatgaaccacgc

SEQ ID NO: 56223 - DNA, 25 bp, E. coli
caatgcagaaaaagacgaaccggcg

SEQ ID NO: 56224 - DNA, 25 bp, E. coli
caatgcagaaaatgacgaaccggcg

SEQ ID NO: 56225 - DNA, 25 bp, E. coli
agaataaacggcaccgctggctgga

SEQ ID NO: 56226 - DNA, 25 bp, E. coli
agaataaacggctccgctggctgga

SEQ ID NO: 56227 - DNA, 25 bp, E. coli
aaatagatatgctgcgccgggtggc

SEQ ID NO: 56228 - DNA, 25 bp, E. coli
aaatagatatgcagcgccgggtggc

SEQ ID NO: 56229 - DNA, 25 bp, E. coli
tataaaggccctgctaagagccgca

SEQ ID NO: 56230 - DNA, 25 bp, E. coli
tataaaggccctcctaagagccgca

SEQ ID NO: 56231 - DNA, 25 bp, E. coli
tttcacgacttgagacacacctggg

SEQ ID NO: 56232 - DNA, 25 bp, E. coli
tttcacgacttgtgacacacctggg

SEQ ID NO: 56233 - DNA, 25 bp, E. coli
gaaccggcgtcatgaggaaaactgg

SEQ ID NO: 56234 - DNA, 25 bp, E. coli
gaaccggcgtcaagaggaaaactgg

SEQ ID NO: 56235 - DNA, 25 bp, E. coli
gaacacgcacggcaaatagactcga

SEQ ID NO: 56236 - DNA, 25 bp, E. coli
gaacacgcacgggaaatagactcga

SEQ ID NO: 56237 - DNA, 25 bp, E. coli
ggtatgacgcaaacacagcctggaa

SEQ ID NO: 56238 - DNA, 25 bp, E. coli
ggaaagctgtaccaaaccagacgga

SEQ ID NO: 56239 - DNA, 25 bp, E. coli
ggtatgacgcaatcacagcctggaa

SEQ ID NO: 56240 - DNA, 25 bp, E. coli
tggcaacaggctaaagacgctcgaa

SEQ ID NO: 56241 - DNA, 25 bp, E. coli
tggcaacaggcttaagacgctcgaa

SEQ ID NO: 56242 - DNA, 25 bp, E. coli
ggaaagctgtacgaaaccagacgga

SEQ ID NO: 56243 - DNA, 25 bp, E. coli
gagtaaatcaaaccgcgcaattggc

SEQ ID NO: 56244 - DNA, 25 bp, E. coli
gagtaaatcaaagcgcgcaattggc

SEQ ID NO: 56245 - DNA, 25 bp, E. coli
aagccgacgatagccatcaacatgg

SEQ ID NO: 56246 - DNA, 25 bp, E. coli
aagccgacgatacccatcaacatgg

SEQ ID NO: 56247 - DNA, 25 bp, E. coli
tacccatcaacaaggcatgatgctg

SEQ ID NO: 56248 - DNA, 25 bp, E. coli
tacccatcaacatggcatgatgctg

SEQ ID NO: 56249 - DNA, 25 bp, E. coli
acccatcaacatggcatgatgctgg

SEQ ID NO: 56250 - DNA, 25 bp, E. coli
atagcgcctgtcagcagcggattta

SEQ ID NO: 56251 - DNA, 25 bp, E. coli
atagcgcctgtctgcagcggattta

SEQ ID NO: 56252 - DNA, 25 bp, E. coli
acccatcaacatcgcatgatgctgg

SEQ ID NO: 56253 - DNA, 25 bp, E. coli
tagcgcctgtcagcagcggatttat

SEQ ID NO: 56254 - DNA, 25 bp, E. coli
tagcgcctgtcaccagcggatttat

SEQ ID NO: 56255 - DNA, 25 bp, E. coli
gccgacgatacccatcaacatggca

SEQ ID NO: 56256 - DNA, 25 bp, E. coli
gccgacgataccgatcaacatggca

SEQ ID NO: 56257 - DNA, 25 bp, E. coli
gaagccgacgatacccatcaacatg

SEQ ID NO: 56258 - DNA, 25 bp, E. coli
gaagccgacgattcccatcaacatg

SEQ ID NO: 56259 - DNA, 25 bp, E. coli
gacgatacccatcaacatggcatga

SEQ ID NO: 56260 - DNA, 25 bp, E. coli
gacgatacccatgaacatggcatga

SEQ ID NO: 56261 - DNA, 25 bp, E. coli
cgtggaagccgaggatacccatcaa

SEQ ID NO: 56262 - DNA, 25 bp, E. coli
cgtggaagccgacgatacccatcaa

SEQ ID NO: 56263 - DNA, 25 bp, E. coli
gatacccatcaagatggcatgatgc

SEQ ID NO: 56264 - DNA, 25 bp, E. coli
gatacccatcaacatggcatgatgc

SEQ ID NO: 56265 - DNA, 25 bp, E. coli
tggaagccgacgatacccatcaaca

SEQ ID NO: 56266 - DNA, 25 bp, E. coli
tggaagccgacgttacccatcaaca

SEQ ID NO: 56267 - DNA, 25 bp, E. coli
aagtaaagggcgaatcgatgtctta

SEQ ID NO: 56268 - DNA, 25 bp, E. coli
aagtaaagggcgtatcgatgtctta

SEQ ID NO: 56269 - DNA, 25 bp, E. coli
tagtgaaggtattgctgacagaggt

SEQ ID NO: 56270 - DNA, 25 bp, E. coli
tagtgaaggtatagctgacagaggt

SEQ ID NO: 56271 - DNA, 25 bp, E. coli
tagattttcgtaaatccaaagaggg

SEQ ID NO: 56272 - DNA, 25 bp, E. coli
tagattttcgtatatccaaagaggg

SEQ ID NO: 56273 - DNA, 25 bp, E. coli
tgtatcacgataaaagtaaagggcg

SEQ ID NO: 56274 - DNA, 25 bp, E. coli
tgtatcacgatataagtaaagggcg

SEQ ID NO: 56275 - DNA, 25 bp, E. coli
tcagagtccgaagttactgaactat

SEQ ID NO: 56276 - DNA, 25 bp, E. coli
tcagagtccgaacttactgaactat

SEQ ID NO: 56277 - DNA, 25 bp, E. coli
ccaaagagggtaaaaggtgtatctc

SEQ ID NO: 56278 - DNA, 25 bp, E. coli
ccaaagagggtataaggtgtatctc

SEQ ID NO: 56279 - DNA, 25 bp, E. coli
gctgacagaggtataaaaaatacgg

SEQ ID NO: 56280 - DNA, 25 bp, E. coli
gctttcgaaggaagttcagagtccg

SEQ ID NO: 56281 - DNA, 25 bp, E. coli
gctgacagaggtttaaaaaatacgg

SEQ ID NO: 56282 - DNA, 25 bp, E. coli
gctttcgaaggatgttcagagtccg

SEQ ID NO: 56283 - DNA, 25 bp, E. coli
ggtgtatctcatgcagtattctgta

SEQ ID NO: 56284 - DNA, 25 bp, E. coli
ggtgtatctcatccagtattctgta

SEQ ID NO: 56285 - DNA, 25 bp, E. coli
taatataaaaactggtgtggagtgg

SEQ ID NO: 56286 - DNA, 25 bp, E. coli
taatataaaaacaggtgtggagtgg

SEQ ID NO: 56287 - DNA, 25 bp, E. coli
gagtgttaatcctaaaacgcccgca

SEQ ID NO: 56288 - DNA, 25 bp, E. coli
gagtgttaatccaaaaacgcccgca

SEQ ID NO: 56289 - DNA, 25 bp, E. coli
catcgacgctatgggttttaacgcg

SEQ ID NO: 56290 - DNA, 25 bp, E. coli
catcgacgctatcggttttaacgcg

SEQ ID NO: 56291 - DNA, 25 bp, E. coli
aaaatcctccatcgccagccgaaat

SEQ ID NO: 56292 - DNA, 25 bp, E. coli
aaaatcctccatggccagccgaaat

SEQ ID NO: 56293 - DNA, 25 bp, E. coli
tatcggttttaacgcgccagacctc

SEQ ID NO: 56294 - DNA, 25 bp, E. coli
tatcggttttaaggcgccagacctc

SEQ ID NO: 56295 - DNA, 25 bp, E. coli
ttgatcgctaaaggcgtaccagcaa

SEQ ID NO: 56296 - DNA, 25 bp, E. coli
ttgatcgctaaacgcgtaccagcaa

SEQ ID NO: 56297 - DNA, 25 bp, E. coli
tgcgggagaaacacgctcgtgtcag

SEQ ID NO: 56298 - DNA, 25 bp, E. coli
tgcgggagaaactcgctcgtgtcag

SEQ ID NO: 56299 - DNA, 25 bp, E. coli
gccagacctcaaaatgaagcacggt

SEQ ID NO: 56300 - DNA, 25 bp, E. coli
gccagacctcaatatgaagcacggt

SEQ ID NO: 56301 - DNA, 25 bp, E. coli
gaagcacggtttttatactcaactg

SEQ ID NO: 56302 - DNA, 25 bp, E. coli
gaagcacggtttatatactcaactg

SEQ ID NO: 56303 - DNA, 25 bp, E. coli
ctaaaggcgtacgagcaaaagtgat

SEQ ID NO: 56304 - DNA, 25 bp, E. coli
ctaaaggcgtaccagcaaaagtgat

SEQ ID NO: 56305 - DNA, 25 bp, E. coli
ggtttttatactcaactgcgggaga

SEQ ID NO: 56306 - DNA, 25 bp, E. coli
ggtttttatactgaactgcgggaga

SEQ ID NO: 56307 - DNA, 25 bp, E. coli
taacgcgccagacctcaatatgaag

SEQ ID NO: 56308 - DNA, 25 bp, E. coli
tcaactgcgggacaaactcgctcgt

SEQ ID NO: 56309 - DNA, 25 bp, E. coli
taacgcgccagagctcaatatgaag

SEQ ID NO: 56310 - DNA, 25 bp, E. coli
tcaactgcgggagaaactcgctcgt

SEQ ID NO: 56311 - DNA, 25 bp, E. coli
catgaaccatgctttagtggaggct

SEQ ID NO: 56312 - DNA, 25 bp, E. coli
catgaaccatgcattagtggaggct

SEQ ID NO: 56313 - DNA, 25 bp, E. coli
taaaggtccaggaggtggctctccg

SEQ ID NO: 56314 - DNA, 25 bp, E. coli
taaaggtccaggtggtggctctccg

SEQ ID NO: 56315 - DNA, 25 bp, E. coli
tgatgatcagccacagcaaccgtta

SEQ ID NO: 56316 - DNA, 25 bp, E. coli
tgatgatcagcctcagcaaccgtta

SEQ ID NO: 56317 - DNA, 25 bp, E. coli
tcccggagaacctagcatcgatttg

SEQ ID NO: 56318 - DNA, 25 bp, E. coli
tcccggagaaccaagcatcgatttg

SEQ ID NO: 56319 - DNA, 25 bp, E. coli
tcatgcagaaattgaactccgggaa

SEQ ID NO: 56320 - DNA, 25 bp, E. coli
tctaatagggcaaggaacaaagcag

SEQ ID NO: 56321 - DNA, 25 bp, E. coli
tcatgcagaaatagaactccgggaa

SEQ ID NO: 56322 - DNA, 25 bp, E. coli
tctaatagggcatggaacaaagcag

SEQ ID NO: 56323 - DNA, 25 bp, E. coli
cctggcaagaatcggaggcatacca

SEQ ID NO: 56324 - DNA, 25 bp, E. coli
cctggcaagaatgggaggcatacca

SEQ ID NO: 56325 - DNA, 25 bp, E. coli
gctggttccaccttgggctgatgat

SEQ ID NO: 56326 - DNA, 25 bp, E. coli
gctggttccaccatgggctgatgat

SEQ ID NO: 56327 - DNA, 25 bp, E. coli
gaaaagatctgtccggccatgaacc

SEQ ID NO: 56328 - DNA, 25 bp, E. coli
gaaaagatctgtgcggccatgaacc

SEQ ID NO: 56329 - DNA, 25 bp, E. coli
gatttcagaaaagccatagggcact

SEQ ID NO: 56330 - DNA, 25 bp, E. coli
gatttcagaaaacccatagggcact

SEQ ID NO: 56331 - DNA, 25 bp, E. coli
ggcaggccttccatgcgaaatagca

SEQ ID NO: 56332 - DNA, 25 bp, E. coli
ggcaggccttccttgcgaaatagca

SEQ ID NO: 56333 - DNA, 25 bp, E. coli
aatttacgccggagctgggcacggc

SEQ ID NO: 56334 - DNA, 25 bp, E. coli
aatttacgccggtgctgggcacggc

SEQ ID NO: 56335 - DNA, 25 bp, E. coli
attggctatgaccagagcaccggcg

SEQ ID NO: 56336 - DNA, 25 bp, E. coli
attggctatgacgagagcaccggcg

SEQ ID NO: 56337 - DNA, 25 bp, E. coli
tattgatctgaccaaatacgtgccc

SEQ ID NO: 56338 - DNA, 25 bp, E. coli
tattgatctgacgaaatacgtgccc

SEQ ID NO: 56339 - DNA, 25 bp, E. coli
tggtgtcagatcttgccagccggtc

SEQ ID NO: 56340 - DNA, 25 bp, E. coli
tgaccgtgccggataaaaagactgc

SEQ ID NO: 56341 - DNA, 25 bp, E. coli
tgaccgtgccggttaaaaagactgc

SEQ ID NO: 56342 - DNA, 25 bp, E. coli
tctgtcggcagacctggaaaccgca

SEQ ID NO: 56343 - DNA, 25 bp, E. coli
tctgtcggcagagctggaaaccgca

SEQ ID NO: 56344 - DNA, 25 bp, E. coli
tctgcgtaataacgaattcccctgg

SEQ ID NO: 56345 - DNA, 25 bp, E. coli
tctgcgtaataaggaattcccctgg

SEQ ID NO: 56346 - DNA, 25 bp, E. coli
gaaggctggctgatcaaccatgcag

SEQ ID NO: 56347 - DNA, 25 bp, E. coli
gaaggctggctgttcaaccatgcag

SEQ ID NO: 56348 - DNA, 25 bp, E. coli
gaaaacacaggtcgccagtctgtcg

SEQ ID NO: 56349 - DNA, 25 bp, E. coli
gaaaacacaggtggccagtctgtcg

SEQ ID NO: 56350 - DNA, 25 bp, E. coli
gttgtggcgctctatcagccggtga

SEQ ID NO: 56351 - DNA, 25 bp, E. coli
gttgaaacgtattacgccctgcgta

SEQ ID NO: 56352 - DNA, 25 bp, E. coli
gttgtggcgctcaatcagccggtga

SEQ ID NO: 56353 - DNA, 25 bp, E. coli
gttgaaacgtataacgccctgcgta

SEQ ID NO: 56354 - DNA, 25 bp, E. coli
tggtgtcagatcatgccagccggtc

SEQ ID NO: 56355 - DNA, 25 bp, E. coli
caataatagcgtgttggaaggagcc

SEQ ID NO: 56356 - DNA, 25 bp, E. coli
caataatagcgtcttggaaggagcc

SEQ ID NO: 56357 - DNA, 25 bp, E. coli
caactggtggaagagctgcgctgct

SEQ ID NO: 56358 - DNA, 25 bp, E. coli
caactggtggaacagctgcgctgct

SEQ ID NO: 56359 - DNA, 25 bp, E. coli
caaaaatgatcaaacaaggccgtgg

SEQ ID NO: 56360 - DNA, 25 bp, E. coli
caaaaatgatcatacaaggccgtgg

SEQ ID NO: 56361 - DNA, 25 bp, E. coli
tactggtgtcatgggagtcgtctca

SEQ ID NO: 56362 - DNA, 25 bp, E. coli
tacgaaagactcactgcaaggacag

SEQ ID NO: 56363 - DNA, 25 bp, E. coli
tacgaaagactctctgcaaggacag

SEQ ID NO: 56364 - DNA, 25 bp, E. coli
tactctctgatgtgcagccgtgcag

SEQ ID NO: 56365 - DNA, 25 bp, E. coli
tactctctgatgagcagccgtgcag

SEQ ID NO: 56366 - DNA, 25 bp, E. coli
tactggtgtcatcggagtcgtctca

SEQ ID NO: 56367 - DNA, 25 bp, E. coli
tatgagacagcatcaggagagtgcc

SEQ ID NO: 56368 - DNA, 25 bp, E. coli
tatgagacagcaacaggagagtgcc

SEQ ID NO: 56369 - DNA, 25 bp, E. coli
tcaggagttgagttcgataccgcca

SEQ ID NO: 56370 - DNA, 25 bp, E. coli
tcaggagttgagatcgataccgcca

SEQ ID NO: 56371 - DNA, 25 bp, E. coli
ccagccgtggcgtacatcaggagtt

SEQ ID NO: 56372 - DNA, 25 bp, E. coli
ccagccgtggcgaacatcaggagtt

SEQ ID NO: 56373 - DNA, 25 bp, E. coli
gaattacatctctggcaggcccagt

SEQ ID NO: 56374 - DNA, 25 bp, E. coli
gaattacatctcaggcaggcccagt

SEQ ID NO: 56375 - DNA, 25 bp, E. coli
tggatctcacaaacgcagcaactgg

SEQ ID NO: 56376 - DNA, 25 bp, E. coli
tggatctcacaatcgcagcaactgg

SEQ ID NO: 56377 - DNA, 25 bp, E. coli
caaatcatcctctggctgactcgcg

SEQ ID NO: 56378 - DNA, 25 bp, E. coli
caaatcatcctcaggctgactcgcg

SEQ ID NO: 56379 - DNA, 25 bp, E. coli
tactgctggtgtacgctgactggtg

SEQ ID NO: 56380 - DNA, 25 bp, E. coli
tactgctggtgttcgctgactggtg

SEQ ID NO: 56381 - DNA, 25 bp, E. coli
tatgaaggtcaacgatcgtgtcgcg

SEQ ID NO: 56382 - DNA, 25 bp, E. coli
tatgaaggtcaaggatcgtgtcgcg

SEQ ID NO: 56383 - DNA, 25 bp, E. coli
tttacgcagcattagcgcgccggat

SEQ ID NO: 56384 - DNA, 25 bp, E. coli
tttacgcagcataagcgcgccggat

SEQ ID NO: 56385 - DNA, 25 bp, E. coli
tgatgggctttccacggacgatgcc

SEQ ID NO: 56386 - DNA, 25 bp, E. coli
tgatgggctttcgacggacgatgcc

SEQ ID NO: 56387 - DNA, 25 bp, E. coli
ccggatattgacgtcatcgagcaga

SEQ ID NO: 56388 - DNA, 25 bp, E. coli
ccggatattgacctcatcgagcaga

SEQ ID NO: 56389 - DNA, 25 bp, E. coli
ctgttagcggcttgcctgacggcga

SEQ ID NO: 56390 - DNA, 25 bp, E. coli
ctgttagcggctagcctgacggcga

SEQ ID NO: 56391 - DNA, 25 bp, E. coli
gattttgctggccattaccccgctg

SEQ ID NO: 56392 - DNA, 25 bp, E. coli
gattttgctggcgattaccccgctg

SEQ ID NO: 56393 - DNA, 25 bp, E. coli
ggatgaacttctcgcaggcgctgcc

SEQ ID NO: 56394 - DNA, 25 bp, E. coli
ggctgaccatttaaccgctgggtgg

SEQ ID NO: 56395 - DNA, 25 bp, E. coli
ggctgaccattttaccgctgggtgg

SEQ ID NO: 56396 - DNA, 25 bp, E. coli
ggatgaacttctggcaggcgctgcc

SEQ ID NO: 56397 - DNA, 25 bp, E. coli
tcactgcgttgaacggtgcgccgct

SEQ ID NO: 56398 - DNA, 25 bp, E. coli
tcactgcgttgatcggtgcgccgct

SEQ ID NO: 56399 - DNA, 25 bp, E. coli
aatgcgtcgcctgaactaccagact

SEQ ID NO: 56400 - DNA, 25 bp, E. coli
aatgcgtcgcctcaactaccagact

SEQ ID NO: 56401 - DNA, 25 bp, E. coli
accagactgtatccgcaactcattg

SEQ ID NO: 56402 - DNA, 25 bp, E. coli
actaccagactgaatccgcaactca

SEQ ID NO: 56403 - DNA, 25 bp, E. coli
agactgtatccgcaactcattgttg

SEQ ID NO: 56404 - DNA, 25 bp, E. coli
accagactgtatgcgcaactcattg

SEQ ID NO: 56405 - DNA, 25 bp, E. coli
actaccagactgtatccgcaactca

SEQ ID NO: 56406 - DNA, 25 bp, E. coli
agactgtatccggaactcattgttg

SEQ ID NO: 56407 - DNA, 25 bp, E. coli
aaaatgcgtcgcgtgaactaccaga

SEQ ID NO: 56408 - DNA, 25 bp, E. coli
aaaatgcgtcgcctgaactaccaga

SEQ ID NO: 56409 - DNA, 25 bp, E. coli
tgtatccgcaacacattgttgtgag

SEQ ID NO: 56410 - DNA, 25 bp, E. coli
tgtatccgcaactcattgttgtgag

SEQ ID NO: 56411 - DNA, 25 bp, E. coli
tcgcctgaactagcagactgtatcc

SEQ ID NO: 56412 - DNA, 25 bp, E. coli
tcgcctgaactaccagactgtatcc

SEQ ID NO: 56413 - DNA, 25 bp, E. coli
tgcgtcgcctgatctaccagactgt

SEQ ID NO: 56414 - DNA, 25 bp, E. coli
tgcgtcgcctgaactaccagactgt

SEQ ID NO: 56415 - DNA, 25 bp, E. coli
gcctgaactaccagactgtatccgc

SEQ ID NO: 56416 - DNA, 25 bp, E. coli
gcctgaactacctgactgtatccgc

SEQ ID NO: 56417 - DNA, 25 bp, E. coli
gaactaccagactgtatccgcaact

SEQ ID NO: 56418 - DNA, 25 bp, E. coli
gaactaccagacagtatccgcaact

SEQ ID NO: 56419 - DNA, 25 bp, E. coli
cgtcgcctgaacaaccagactgtat

SEQ ID NO: 56420 - DNA, 25 bp, E. coli
cgtcgcctgaactaccagactgtat

SEQ ID NO: 56421 - DNA, 25 bp, E. coli
aatgacatgaatttactaaaaaaac

SEQ ID NO: 56422 - DNA, 25 bp, E. coli
cacggggagttacttacagcacagc

SEQ ID NO: 56423 - DNA, 25 bp, E. coli
cacggggagttagttacagcacagc

SEQ ID NO: 56424 - DNA, 25 bp, E. coli
cattatcccggaccaggccagggta

SEQ ID NO: 56425 - DNA, 25 bp, E. coli
cattatcccggagcaggccagggta

SEQ ID NO: 56426 - DNA, 25 bp, E. coli
atgacatgaatatactaaaaaaact

SEQ ID NO: 56427 - DNA, 25 bp, E. coli
acacggggagttacttacagcacag

SEQ ID NO: 56428 - DNA, 25 bp, E. coli
acacggggagtttcttacagcacag

SEQ ID NO: 56429 - DNA, 25 bp, E. coli
atgacatgaataaactaaaaaaact

SEQ ID NO: 56430 - DNA, 25 bp, E. coli
aatgacatgaatatactaaaaaaac

SEQ ID NO: 56431 - DNA, 25 bp, E. coli
tatactaaaaaatcttatgcagcgt

SEQ ID NO: 56432 - DNA, 25 bp, E. coli
tatactaaaaaaacttatgcagcgt

SEQ ID NO: 56433 - DNA, 25 bp, E. coli
tgacatgaatatactaaaaaaactt

SEQ ID NO: 56434 - DNA, 25 bp, E. coli
tgatgaccgtgaacacggggagtta

SEQ ID NO: 56435 - DNA, 25 bp, E. coli
tgacatgaatattctaaaaaaactt

SEQ ID NO: 56436 - DNA, 25 bp, E. coli
tgatgaccgtgatcacggggagtta

SEQ ID NO: 56437 - DNA, 25 bp, E. coli
gggagttacttacagcacagctgcg

SEQ ID NO: 56438 - DNA, 25 bp, E. coli
ggagttacttactgcacagctgcga

SEQ ID NO: 56439 - DNA, 25 bp, E. coli
ggagttacttacagcacagctgcga

SEQ ID NO: 56440 - DNA, 25 bp, E. coli
gggagttacttagagcacagctgcg

SEQ ID NO: 56441 - DNA, 25 bp, E. coli
gagttacttacaccacagctgcgac

SEQ ID NO: 56442 - DNA, 25 bp, E. coli
gagttacttacagcacagctgcgac

SEQ ID NO: 56443 - DNA, 25 bp, E. coli
caacgaccgctttgtgccgatggat

SEQ ID NO: 56444 - DNA, 25 bp, E. coli
cacgtctggcggaaatcaaagcgca

SEQ ID NO: 56445 - DNA, 25 bp, E. coli
cacgtctggcggtaatcaaagcgca

SEQ ID NO: 56446 - DNA, 25 bp, E. coli
caacgaccgcttagtgccgatggat

SEQ ID NO: 56447 - DNA, 25 bp, E. coli
cagtgggaacatcccgacgctttca

SEQ ID NO: 56448 - DNA, 25 bp, E. coli
cagtgggaacatgccgacgctttca

SEQ ID NO: 56449 - DNA, 25 bp, E. coli
cattttaatgacagcggacaaggcg

SEQ ID NO: 56450 - DNA, 25 bp, E. coli
cattttaatgactgcggacaaggcg

SEQ ID NO: 56451 - DNA, 25 bp, E. coli
acgaaaccgttgacctgctgcatgg

SEQ ID NO: 56452 - DNA, 25 bp, E. coli
acgaaaccgttgtcctgctgcatgg

SEQ ID NO: 56453 - DNA, 25 bp, E. coli
tttgataccagcgatttgaccgacg

SEQ ID NO: 56454 - DNA, 25 bp, E. coli
tttgataccagccatttgaccgacg

SEQ ID NO: 56455 - DNA, 25 bp, E. coli
tgaataatatgcagtcgcgccgcga

SEQ ID NO: 56456 - DNA, 25 bp, E. coli
tgaataatatgctgtcgcgccgcga

SEQ ID NO: 56457 - DNA, 25 bp, E. coli
ccaaccgaaggttttaagcgactga

SEQ ID NO: 56458 - DNA, 25 bp, E. coli
gccgcaatatcgatccgctggtaga

SEQ ID NO: 56459 - DNA, 25 bp, E. coli
gccgcaatatcgttccgctggtaga

SEQ ID NO: 56460 - DNA, 25 bp, E. coli
gccctgtttgaagcgcgcctgaata

SEQ ID NO: 56461 - DNA, 25 bp, E. coli
ccaaccgaaggtattaagcgactga

SEQ ID NO: 56462 - DNA, 25 bp, E. coli
gccctgtttgaaccgcgcctgaata

SEQ ID NO: 56463 - DNA, 25 bp, E. coli
gatatcgccaaaatccacctgctgg

SEQ ID NO: 56464 - DNA, 25 bp, E. coli
gatatcgccaaattccacctgctgg

SEQ ID NO: 56465 - DNA, 25 bp, E. coli
tacaaatcaccggtagcaacggcgc

SEQ ID NO: 56466 - DNA, 25 bp, E. coli
tacaaatcaccgctagcaacggcgc

SEQ ID NO: 56467 - DNA, 25 bp, E. coli
taccgcacaatgtctggaagccctg

SEQ ID NO: 56468 - DNA, 25 bp, E. coli
taccgcacaatgactggaagccctg

SEQ ID NO: 56469 - DNA, 25 bp, E. coli
tatcatcgcgatggcgataccgcac

SEQ ID NO: 56470 - DNA, 25 bp, E. coli
tatcatcgcgatcgcgataccgcac

SEQ ID NO: 56471 - DNA, 25 bp, E. coli
tttagcgcgtctctggctgacccgt

SEQ ID NO: 56472 - DNA, 25 bp, E. coli
tttagcgcgtctgtggctgacccgt

SEQ ID NO: 56473 - DNA, 25 bp, E. coli
gccgctcaacgttgctgaaagtaaa

SEQ ID NO: 56474 - DNA, 25 bp, E. coli
gccgctcaacgtagctgaaagtaaa

SEQ ID NO: 56475 - DNA, 25 bp, E. coli
gcttgtcatttaggctgaacgcagg

SEQ ID NO: 56476 - DNA, 25 bp, E. coli
gcttgtcatttacgctgaacgcagg

SEQ ID NO: 56477 - DNA, 25 bp, E. coli
ccgggcttgccggattcgaagatat

SEQ ID NO: 56478 - DNA, 25 bp, E. coli
ccgggcttgccgcattcgaagatat

SEQ ID NO: 56479 - DNA, 25 bp, E. coli
gatcgtctgaccgagcgtatggcgc

SEQ ID NO: 56480 - DNA, 25 bp, E. coli
ggctgacggcgtaagaaaatctgca

SEQ ID NO: 56481 - DNA, 25 bp, E. coli
ggctgacggcgttagaaaatctgca

SEQ ID NO: 56482 - DNA, 25 bp, E. coli
gagcgggatgaaggaaccttattta

SEQ ID NO: 56483 - DNA, 25 bp, E. coli
gacgagcctttttccgcgattgacg

SEQ ID NO: 56484 - DNA, 25 bp, E. coli
gagcgggatgaacgaaccttattta

SEQ ID NO: 56485 - DNA, 25 bp, E. coli
gacgagccttttaccgcgattgacg

SEQ ID NO: 56486 - DNA, 25 bp, E. coli
gatcgtctgacccagcgtatggcgc

SEQ ID NO: 56487 - DNA, 25 bp, E. coli
aaccagcgtctattattcaggtaaa

SEQ ID NO: 56488 - DNA, 25 bp, E. coli
cacggaattgtggttaattaaagag

SEQ ID NO: 56489 - DNA, 25 bp, E. coli
caaaaccagcgtgtaatattcaggt

SEQ ID NO: 56490 - DNA, 25 bp, E. coli
caaaaccagcgtctaatattcaggt

SEQ ID NO: 56491 - DNA, 25 bp, E. coli
cacggaattgtgcttaattaaagag

SEQ ID NO: 56492 - DNA, 25 bp, E. coli
catcagtcacaataccagcgtctaa

SEQ ID NO: 56493 - DNA, 25 bp, E. coli
catcagtcacaaaaccagcgtctaa

SEQ ID NO: 56494 - DNA, 25 bp, E. coli
caggtaaatgttatctattcaacga

SEQ ID NO: 56495 - DNA, 25 bp, E. coli
caggtaaatgttttctattcaacga

SEQ ID NO: 56496 - DNA, 25 bp, E. coli
aaccagcgtctaatattcaggtaaa

SEQ ID NO: 56497 - DNA, 25 bp, E. coli
tatccgacatcagtcacaaaaccag

SEQ ID NO: 56498 - DNA, 25 bp, E. coli
tttcaagccgactttcaaatatccg

SEQ ID NO: 56499 - DNA, 25 bp, E. coli
tatccgacatcactcacaaaaccag

SEQ ID NO: 56500 - DNA, 25 bp, E. coli
tttcaagccgacattcaaatatccg

SEQ ID NO: 56501 - DNA, 25 bp, E. coli
tgcgtatacattacacggaattgtg

SEQ ID NO: 56502 - DNA, 25 bp, E. coli
tgcgtatacatttcacggaattgtg

SEQ ID NO: 56503 - DNA, 25 bp, E. coli
gccgacattcaaatatccgacatca

SEQ ID NO: 56504 - DNA, 25 bp, E. coli
gccgacattcaattatccgacatca

SEQ ID NO: 56505 - DNA, 25 bp, E. coli
ggcttatttttcaagccgacattca

SEQ ID NO: 56506 - DNA, 25 bp, E. coli
ggcttatttttctagccgacattca

SEQ ID NO: 56507 - DNA, 25 bp, E. coli
taattaaagagaaggtcggcttatt

SEQ ID NO: 56508 - DNA, 25 bp, E. coli
taattaaagagatggtcggcttatt

SEQ ID NO: 56509 - DNA, 25 bp, E. coli
cagccgggcgattggcgtcctgtta

SEQ ID NO: 56510 - DNA, 25 bp, E. coli
caaacagaagggatacgaacaggcg

SEQ ID NO: 56511 - DNA, 25 bp, E. coli
caaacagaagggttacgaacaggcg

SEQ ID NO: 56512 - DNA, 25 bp, E. coli
cagccgggcgataggcgtcctgtta

SEQ ID NO: 56513 - DNA, 25 bp, E. coli
agttcctgacgaaatggcgattgcc

SEQ ID NO: 56514 - DNA, 25 bp, E. coli
agttcctgacgatatggcgattgcc

SEQ ID NO: 56515 - DNA, 25 bp, E. coli
tatccgcagctggatggcgtgttct

SEQ ID NO: 56516 - DNA, 25 bp, E. coli
tatccgcagctgcatggcgtgttct

SEQ ID NO: 56517 - DNA, 25 bp, E. coli
tattacgcggaatcgaaagcgtcac

SEQ ID NO: 56518 - DNA, 25 bp, E. coli
tataaaccggaattggagcaagaac

SEQ ID NO: 56519 - DNA, 25 bp, E. coli
tattacgcggaaacgaaagcgtcac

SEQ ID NO: 56520 - DNA, 25 bp, E. coli
tataaaccggaaatggagcaagaac

SEQ ID NO: 56521 - DNA, 25 bp, E. coli
ttacgcaacccgcagcaggtttccg

SEQ ID NO: 56522 - DNA, 25 bp, E. coli
ttacgcaacccggagcaggtttccg

SEQ ID NO: 56523 - DNA, 25 bp, E. coli
tccgtcgctctaggcggcaagattg

SEQ ID NO: 56524 - DNA, 25 bp, E. coli
tccgtcgctctacgcggcaagattg

SEQ ID NO: 56525 - DNA, 25 bp, E. coli
gctgaccgtgtaggcgtgaccaaaa

SEQ ID NO: 56526 - DNA, 25 bp, E. coli
gctgaccgtgtacgcgtgaccaaaa

SEQ ID NO: 56527 - DNA, 25 bp, E. coli
gacattggtcagctgatggagccac

SEQ ID NO: 56528 - DNA, 25 bp, E. coli
gacattggtcaggtgatggagccac

SEQ ID NO: 56529 - DNA, 25 bp, E. coli
gattgccggtttgcacggtcatgac

SEQ ID NO: 56530 - DNA, 25 bp, E. coli
gattgccggtttccacggtcatgac

SEQ ID NO: 56531 - DNA, 25 bp, E. coli
caagcagcaaattgccgagcgcgtt

SEQ ID NO: 56532 - DNA, 25 bp, E. coli
aagcagcaaattgccgagcgcgtta

SEQ ID NO: 56533 - DNA, 25 bp, E. coli
aagcagcaaattcccgagcgcgtta

SEQ ID NO: 56534 - DNA, 25 bp, E. coli
caagcagcaaatagccgagcgcgtt

SEQ ID NO: 56535 - DNA, 25 bp, E. coli
cagcaaattgccgagcgcgttaaag

SEQ ID NO: 56536 - DNA, 25 bp, E. coli
cagcaaattgcccagcgcgttaaag

SEQ ID NO: 56537 - DNA, 25 bp, E. coli
agcaaattgccgagcgcgttaaaga

SEQ ID NO: 56538 - DNA, 25 bp, E. coli
atcgacgctgctccgcatggttgcc

SEQ ID NO: 56539 - DNA, 25 bp, E. coli
atcgacgctgctgcgcatggttgcc

SEQ ID NO: 56540 - DNA, 25 bp, E. coli
agcaaattgccgtgcgcgttaaaga

SEQ ID NO: 56541 - DNA, 25 bp, E. coli
gcgattgtgcgcgatccggcggtgt

SEQ ID NO: 56542 - DNA, 25 bp, E. coli
gcgattgtgcgccatccggcggtgt

SEQ ID NO: 56543 - DNA, 25 bp, E. coli
gcaagcagcaaattgccgagcgcgt

SEQ ID NO: 56544 - DNA, 25 bp, E. coli
gcaagcagcaaaatgccgagcgcgt

SEQ ID NO: 56545 - DNA, 25 bp, E. coli
cgatccggcggtcttcctgtttgat

SEQ ID NO: 56546 - DNA, 25 bp, E. coli
gcgatccggcggagttcctgtttga

SEQ ID NO: 56547 - DNA, 25 bp, E. coli
cgatccggcggtgttcctgtttgat

SEQ ID NO: 56548 - DNA, 25 bp, E. coli
gcgatccggcggtgttcctgtttga

SEQ ID NO: 56549 - DNA, 25 bp, E. coli
gggcaagcagcaaattgccgagcgc

SEQ ID NO: 56550 - DNA, 25 bp, E. coli
gggcaagcagcatattgccgagcgc

SEQ ID NO: 56551 - DNA, 25 bp, E. coli
taagctcgcagggagaaggcggcgt

SEQ ID NO: 56552 - DNA, 25 bp, E. coli
taagctcgcaggcagaaggcggcgt

SEQ ID NO: 56553 - DNA, 25 bp, E. coli
caatggcgctttgagtactggttgc

SEQ ID NO: 56554 - DNA, 25 bp, E. coli
caatggcgctttcagtactggttgc

SEQ ID NO: 56555 - DNA, 25 bp, E. coli
tactggttgcgcagattctcacccc

SEQ ID NO: 56556 - DNA, 25 bp, E. coli
tactggttgcgctgattctcacccc

SEQ ID NO: 56557 - DNA, 25 bp, E. coli
tctatccaggaactggtgaaaacgc

SEQ ID NO: 56558 - DNA, 25 bp, E. coli
tctatccaggaagtggtgaaaacgc

SEQ ID NO: 56559 - DNA, 25 bp, E. coli
gaacatgcgggcaacattgataccc

SEQ ID NO: 56560 - DNA, 25 bp, E. coli
gaacatgcgggctacattgataccc

SEQ ID NO: 56561 - DNA, 25 bp, E. coli
cccgcgttatgtgcaacattgctga

SEQ ID NO: 56562 - DNA, 25 bp, E. coli
cccgcgttatgtccaacattgctga

SEQ ID NO: 56563 - DNA, 25 bp, E. coli
cgtaatgatggacgataaactcccc

SEQ ID NO: 56564 - DNA, 25 bp, E. coli
cgtaatgatggaggataaactcccc

SEQ ID NO: 56565 - DNA, 25 bp, E. coli
cattgctgaaacgagtctctgccga

SEQ ID NO: 56566 - DNA, 25 bp, E. coli
cattgctgaaaccagtctctgccga

SEQ ID NO: 56567 - DNA, 25 bp, E. coli
gtcgcaaatccacggcgcgctggta

SEQ ID NO: 56568 - DNA, 25 bp, E. coli
gtcgcaaatccagggcgcgctggta

SEQ ID NO: 56569 - DNA, 25 bp, E. coli
tggtacttgccatcggacttcttgt

SEQ ID NO: 56570 - DNA, 25 bp, E. coli
tggtacttgccaacggacttcttgt

SEQ ID NO: 56571 - DNA, 25 bp, E. coli
taatcactacacgaatagcgttggc

SEQ ID NO: 56572 - DNA, 25 bp, E. coli
taatcactacaccaatagcgttggc

SEQ ID NO: 56573 - DNA, 25 bp, E. coli
gatggcattcttcggtggctcaaca

SEQ ID NO: 56574 - DNA, 25 bp, E. coli
gatggcattcttgggtggctcaaca

SEQ ID NO: 56575 - DNA, 25 bp, E. coli
cattaggtctttatgcctgggcgcg

SEQ ID NO: 56576 - DNA, 25 bp, E. coli
taacaattctctgcttaatcctgcg

SEQ ID NO: 56577 - DNA, 25 bp, E. coli
taccaggctccacaaaacgttgatg

SEQ ID NO: 56578 - DNA, 25 bp, E. coli
taccaggctccagaaaacgttgatg

SEQ ID NO: 56579 - DNA, 25 bp, E. coli
tttcattattggagaaaccacgcgc

SEQ ID NO: 56580 - DNA, 25 bp, E. coli
tttcattattggtgaaaccacgcgc

SEQ ID NO: 56581 - DNA, 25 bp, E. coli
ttggtgaaaccacgcgctgggatca

SEQ ID NO: 56582 - DNA, 25 bp, E. coli
ttggtgaaaccaggcgctgggatca

SEQ ID NO: 56583 - DNA, 25 bp, E. coli
ccttaatcctgcgaagaagtttacg

SEQ ID NO: 56584 - DNA, 25 bp, E. coli
ccttaatcctgccaagaagtttacg

SEQ ID NO: 56585 - DNA, 25 bp, E. coli
gaagaagtttacctaccaggctcca

SEQ ID NO: 56586 - DNA, 25 bp, E. coli
gaagaagtttacgtaccaggctcca

SEQ ID NO: 56587 - DNA, 25 bp, E. coli
gaacgcaataccacaccgaagctgg

SEQ ID NO: 56588 - DNA, 25 bp, E. coli
gaacagttccgtgtgccgatgatgg

SEQ ID NO: 56589 - DNA, 25 bp, E. coli
gaacagttccgtctgccgatgatgg

SEQ ID NO: 56590 - DNA, 25 bp, E. coli
gaacgcaatacctcaccgaagctgg

SEQ ID NO: 56591 - DNA, 25 bp, E. coli
cattaggtctttttgcctgggcgcg

SEQ ID NO: 56592 - DNA, 25 bp, E. coli
cgtcagggtggaccagaagataatc

SEQ ID NO: 56593 - DNA, 25 bp, E. coli
cgtcagggtggagcagaagataatc

SEQ ID NO: 56594 - DNA, 25 bp, E. coli
tcaaactggctttcggcattaggtc

SEQ ID NO: 56595 - DNA, 25 bp, E. coli
tcaaactggcttacggcattaggtc

SEQ ID NO: 56596 - DNA, 25 bp, E. coli
taacaattctctccttaatcctgcg

SEQ ID NO: 56597 - DNA, 25 bp, E. coli
aagaattacccggagaagcgccgga

SEQ ID NO: 56598 - DNA, 25 bp, E. coli
aagaattacccgcagaagcgccgga

SEQ ID NO: 56599 - DNA, 25 bp, E. coli
cactcaagttttcgcgatccggtaa

SEQ ID NO: 56600 - DNA, 25 bp, E. coli
cactcaagttttggcgatccggtaa

SEQ ID NO: 56601 - DNA, 25 bp, E. coli
taccctcaggagtgcagggaaagct

SEQ ID NO: 56602 - DNA, 25 bp, E. coli
taccctcaggagagcagggaaagct

SEQ ID NO: 56603 - DNA, 25 bp, E. coli
ttagaaatagccataccaatgagcg

SEQ ID NO: 56604 - DNA, 25 bp, E. coli
ttagaaatagccttaccaatgagcg

SEQ ID NO: 56605 - DNA, 25 bp, E. coli
tcgtggattgaatacagcagcggtg

SEQ ID NO: 56606 - DNA, 25 bp, E. coli
tcgtggattgaaaacagcagcggtg

SEQ ID NO: 56607 - DNA, 25 bp, E. coli
ccatgctgccggtgggatcgcatta

SEQ ID NO: 56608 - DNA, 25 bp, E. coli
ccatgctgccggagggatcgcatta

SEQ ID NO: 56609 - DNA, 25 bp, E. coli
gctgatgctaaacagactgcggtat

SEQ ID NO: 56610 - DNA, 25 bp, E. coli
gctgatgctaaagagactgcggtat

SEQ ID NO: 56611 - DNA, 25 bp, E. coli
cgctggcagcagatcgtgagtctct

SEQ ID NO: 56612 - DNA, 25 bp, E. coli
cgctggcagcagttcgtgagtctct

SEQ ID NO: 56613 - DNA, 25 bp, E. coli
gtattatttacagcggtccaccgct

SEQ ID NO: 56614 - DNA, 25 bp, E. coli
gtattatttacaccggtccaccgct

SEQ ID NO: 56615 - DNA, 25 bp, E. coli
ggaatgctatgggtgcacccagagt

SEQ ID NO: 56616 - DNA, 25 bp, E. coli
ggaatgctatggctgcacccagagt

SEQ ID NO: 56617 - DNA, 25 bp, E. coli
taacttacaagtcggcagccaaaag

SEQ ID NO: 56618 - DNA, 25 bp, E. coli
taacttacaagtgggcagccaaaag

SEQ ID NO: 56619 - DNA, 25 bp, E. coli
caatcactgcggctggtatcgcggc

SEQ ID NO: 56620 - DNA, 25 bp, E. coli
caatcactgcgggtggtatcgcggc

SEQ ID NO: 56621 - DNA, 25 bp, E. coli
caaatcctggtcgatgctggaaacc

SEQ ID NO: 56622 - DNA, 25 bp, E. coli
caaatcctggtccatgctggaaacc

SEQ ID NO: 56623 - DNA, 25 bp, E. coli
aaaggtcacgctatcctgccggtag

SEQ ID NO: 56624 - DNA, 25 bp, E. coli
aaaggtcacgctttcctgccggtag

SEQ ID NO: 56625 - DNA, 25 bp, E. coli
tatcggcgagaccatcaaatcctgg

SEQ ID NO: 56626 - DNA, 25 bp, E. coli
tattggctccatgaaagccggtgtc

SEQ ID NO: 56627 - DNA, 25 bp, E. coli
tattggctccatcaaagccggtgtc

SEQ ID NO: 56628 - DNA, 25 bp, E. coli
tatcggcgagacgatcaaatcctgg

SEQ ID NO: 56629 - DNA, 25 bp, E. coli
tgcgattgccgatatgatcctgccg

SEQ ID NO: 56630 - DNA, 25 bp, E. coli
tgcgattgccgaaatgatcctgccg

SEQ ID NO: 56631 - DNA, 25 bp, E. coli
gacagcggcgtgcacaaatacattg

SEQ ID NO: 56632 - DNA, 25 bp, E. coli
gacagcggcgtggacaaatacattg

SEQ ID NO: 56633 - DNA, 25 bp, E. coli
gattgctgccgtactgcgtatcgcg

SEQ ID NO: 56634 - DNA, 25 bp, E. coli
gattgctgccgttctgcgtatcgcg

SEQ ID NO: 56635 - DNA, 25 bp, E. coli
tggtaaaaaacacatccagtgggcg

SEQ ID NO: 56636 - DNA, 25 bp, E. coli
tggatcagattaacgacacgctggt

SEQ ID NO: 56637 - DNA, 25 bp, E. coli
tggatcagattatcgacacgctggt

SEQ ID NO: 56638 - DNA, 25 bp, E. coli
tggtaaaaaacagatccagtgggcg

SEQ ID NO: 56639 - DNA, 25 bp, E. coli
gagtactttaacgtgactatcggcg

SEQ ID NO: 56640 - DNA, 25 bp, E. coli
gagtactttaacctgactatcggcg

SEQ ID NO: 56641 - DNA, 25 bp, E. coli
aatcattgcccgagaaaccggcaag

SEQ ID NO: 56642 - DNA, 25 bp, E. coli
aaggcgaattaaccgcaatcattgc

SEQ ID NO: 56643 - DNA, 25 bp, E. coli
aataaaggcgaaataaccgcaatca

SEQ ID NO: 56644 - DNA, 25 bp, E. coli
caatcattgcccgagaaaccggcaa

SEQ ID NO: 56645 - DNA, 25 bp, E. coli
aatcattgcccgtgaaaccggcaag

SEQ ID NO: 56646 - DNA, 25 bp, E. coli
aattaaccgcaatcattgcccgaga

SEQ ID NO: 56647 - DNA, 25 bp, E. coli
aataaaggcgaattaaccgcaatca

SEQ ID NO: 56648 - DNA, 25 bp, E. coli
aattaaccgcaaacattgcccgaga

SEQ ID NO: 56649 - DNA, 25 bp, E. coli
aaggcgaattaagcgcaatcattgc

SEQ ID NO: 56650 - DNA, 25 bp, E. coli
caatcattgccccagaaaccggcaa

SEQ ID NO: 56651 - DNA, 25 bp, E. coli
taaaggcgaatttaccgcaatcatt

SEQ ID NO: 56652 - DNA, 25 bp, E. coli
taaaggcgaattaaccgcaatcatt

SEQ ID NO: 56653 - DNA, 25 bp, E. coli
gcgaattaaccgcaatcattgcccg

SEQ ID NO: 56654 - DNA, 25 bp, E. coli
gcgaattaaccggaatcattgcccg

SEQ ID NO: 56655 - DNA, 25 bp, E. coli
gaattaaccgcattcattgcccgag

SEQ ID NO: 56656 - DNA, 25 bp, E. coli
gaattaaccgcaatcattgcccgag

SEQ ID NO: 56657 - DNA, 25 bp, E. coli
cggattgctggataggaataaaggc

SEQ ID NO: 56658 - DNA, 25 bp, E. coli
cggattgctggaaaggaataaaggc

SEQ ID NO: 56659 - DNA, 25 bp, E. coli
ggaataaaggcgtattaaccgcaat

SEQ ID NO: 56660 - DNA, 25 bp, E. coli
ggaataaaggcgaattaaccgcaat

SEQ ID NO: 56661 - DNA, 25 bp, E. coli
taaccgcaatcattgcccgagaaac

SEQ ID NO: 56662 - DNA, 25 bp, E. coli
taaccgcaatcaatgcccgagaaac

SEQ ID NO: 56663 - DNA, 25 bp, E. coli
cagttaaacaattcggtggcggcaa

SEQ ID NO: 56664 - DNA, 25 bp, E. coli
ctctgatcttacaattacccagcat

SEQ ID NO: 56665 - DNA, 25 bp, E. coli
ctctgatcttactattacccagcat

SEQ ID NO: 56666 - DNA, 25 bp, E. coli
cagttaaacaatacggtggcggcaa

SEQ ID NO: 56667 - DNA, 25 bp, E. coli
atcagtggaacgctaaagactctca

SEQ ID NO: 56668 - DNA, 25 bp, E. coli
atcagtggaacggtaaagactctca

SEQ ID NO: 56669 - DNA, 25 bp, E. coli
aaagactctcatttgacagttaaac

SEQ ID NO: 56670 - DNA, 25 bp, E. coli
aaagactctcatatgacagttaaac

SEQ ID NO: 56671 - DNA, 25 bp, E. coli
tacccagcatggtggtggtaacggt

SEQ ID NO: 56672 - DNA, 25 bp, E. coli
tacccagcatggaggtggtaacggt

SEQ ID NO: 56673 - DNA, 25 bp, E. coli
ttccaccgtcaacgtaactcaggtt

SEQ ID NO: 56674 - DNA, 25 bp, E. coli
ttccaccgtcaaggtaactcaggtt

SEQ ID NO: 56675 - DNA, 25 bp, E. coli
tgcatctaattccaccgtcaacgta

SEQ ID NO: 56676 - DNA, 25 bp, E. coli
tgcatctaattcgaccgtcaacgta

SEQ ID NO: 56677 - DNA, 25 bp, E. coli
gctgatgctcgtaactctgatctta

SEQ ID NO: 56678 - DNA, 25 bp, E. coli
gctgatgctcgttactctgatctta

SEQ ID NO: 56679 - DNA, 25 bp, E. coli
gacagttaaacaattcggtggcggc

SEQ ID NO: 56680 - DNA, 25 bp, E. coli
gacagttaaacatttcggtggcggc

SEQ ID NO: 56681 - DNA, 25 bp, E. coli
ggaacggtaaagactctcatatgac

SEQ ID NO: 56682 - DNA, 25 bp, E. coli
ggaacggtaaagtctctcatatgac

SEQ ID NO: 56683 - DNA, 25 bp, E. coli
tggcggcaacggagcagcggttgac

SEQ ID NO: 56684 - DNA, 25 bp, E. coli
tggcggcaacggtgcagcggttgac

SEQ ID NO: 56685 - DNA, 25 bp, E. coli
aattggtaactttgacgcccatctg

SEQ ID NO: 56686 - DNA, 25 bp, E. coli
aattggtaacttagacgcccatctg

SEQ ID NO: 56687 - DNA, 25 bp, E. coli
cagacgaaaattcgtaacttagacg

SEQ ID NO: 56688 - DNA, 25 bp, E. coli
cagacgaaaattggtaacttagacg

SEQ ID NO: 56689 - DNA, 25 bp, E. coli
catcagacgaaaattggtaacttag

SEQ ID NO: 56690 - DNA, 25 bp, E. coli
catcagacgaaatttggtaacttag

SEQ ID NO: 56691 - DNA, 25 bp, E. coli
tagccatcagaccaaaattggtaac

SEQ ID NO: 56692 - DNA, 25 bp, E. coli
tatgtagccatcagacgaaaattgg

SEQ ID NO: 56693 - DNA, 25 bp, E. coli
tatgtagccatctgacgaaaattgg

SEQ ID NO: 56694 - DNA, 25 bp, E. coli
tagccatcagacgaaaattggtaac

SEQ ID NO: 56695 - DNA, 25 bp, E. coli
tgtagccatcagacgaaaattggta

SEQ ID NO: 56696 - DNA, 25 bp, E. coli
tgtagccatcagtcgaaaattggta

SEQ ID NO: 56697 - DNA, 25 bp, E. coli
tggtaacttagaggcccatctgata

SEQ ID NO: 56698 - DNA, 25 bp, E. coli
taacttagacgcccatctgatatag

SEQ ID NO: 56699 - DNA, 25 bp, E. coli
taacttagacgcgcatctgatatag

SEQ ID NO: 56700 - DNA, 25 bp, E. coli
gccgtatgtagcgatcagacgaaaa

SEQ ID NO: 56701 - DNA, 25 bp, E. coli
gccgtatgtagccatcagacgaaaa

SEQ ID NO: 56702 - DNA, 25 bp, E. coli
gccatcagacgataattggtaactt

SEQ ID NO: 56703 - DNA, 25 bp, E. coli
gccatcagacgaaaattggtaactt

SEQ ID NO: 56704 - DNA, 25 bp, E. coli
gaaaattggtaacttagacgcccat

SEQ ID NO: 56705 - DNA, 25 bp, E. coli
gaaaattggtaagttagacgcccat

SEQ ID NO: 56706 - DNA, 25 bp, E. coli
tggtaacttagacgcccatctgata

SEQ ID NO: 56707 - DNA, 25 bp, E. coli
caaagatctggcaggtcgctggcat

SEQ ID NO: 56708 - DNA, 25 bp, E. coli
caaagatctggctggtcgctggcat

SEQ ID NO: 56709 - DNA, 25 bp, E. coli
taaaagactgctaacgtccctgact

SEQ ID NO: 56710 - DNA, 25 bp, E. coli
taaaagactgcttacgtccctgact

SEQ ID NO: 56711 - DNA, 25 bp, E. coli
aaagacgatccgttgtcaggtcacg

SEQ ID NO: 56712 - DNA, 25 bp, E. coli
aaagacgatccgatgtcaggtcacg

SEQ ID NO: 56713 - DNA, 25 bp, E. coli
ttaccatcagggtcaaagatctggc

SEQ ID NO: 56714 - DNA, 25 bp, E. coli
ttaccatcagggacaaagatctggc

SEQ ID NO: 56715 - DNA, 25 bp, E. coli
tttatcttccgtcggcgtaatggca

SEQ ID NO: 56716 - DNA, 25 bp, E. coli
tttatcttccgtgggcgtaatggca

SEQ ID NO: 56717 - DNA, 25 bp, E. coli
tcgactggcggcagcctaaaagact

SEQ ID NO: 56718 - DNA, 25 bp, E. coli
tcgactggcggctgcctaaaagact

SEQ ID NO: 56719 - DNA, 25 bp, E. coli
tctaccggcgatggactgtgtctgc

SEQ ID NO: 56720 - DNA, 25 bp, E. coli
tctaccggcgatcgactgtgtctgc

SEQ ID NO: 56721 - DNA, 25 bp, E. coli
cgtaatggcagtgaggtaaagctcc

SEQ ID NO: 56722 - DNA, 25 bp, E. coli
cggcaaaggtgcagacgacgctgaa

SEQ ID NO: 56723 - DNA, 25 bp, E. coli
cggcaaaggtgctgacgacgctgaa

SEQ ID NO: 56724 - DNA, 25 bp, E. coli
cgtaatggcagtcaggtaaagctcc

SEQ ID NO: 56725 - DNA, 25 bp, E. coli
gtaaagctcctctggtctaccggcg

SEQ ID NO: 56726 - DNA, 25 bp, E. coli
gtaaagctcctcaggtctaccggcg

SEQ ID NO: 56727 - DNA, 25 bp, E. coli
tggcaaagtgttcctcacaccggca

SEQ ID NO: 56728 - DNA, 25 bp, E. coli
tggcaaagtgttgctcacaccggca

SEQ ID NO: 56729 - DNA, 25 bp, E. coli
caccatgaatatcatgtacgatcgt

SEQ ID NO: 56730 - DNA, 25 bp, E. coli
caccatgaatatgatgtacgatcgt

SEQ ID NO: 56731 - DNA, 25 bp, E. coli
tatgatgtacgatcgttatcagaag

SEQ ID NO: 56732 - DNA, 25 bp, E. coli
tatgatgtacgaacgttatcagaag

SEQ ID NO: 56733 - DNA, 25 bp, E. coli
tttccgcagggcgatgaaatcacgc

SEQ ID NO: 56734 - DNA, 25 bp, E. coli
tttccgcagggccatgaaatcacgc

SEQ ID NO: 56735 - DNA, 25 bp, E. coli
tgcctggagccgactctttccgcag

SEQ ID NO: 56736 - DNA, 25 bp, E. coli
tgcctggagccgtctctttccgcag

SEQ ID NO: 56737 - DNA, 25 bp, E. coli
tctgaccactgtcgatatgatccca

SEQ ID NO: 56738 - DNA, 25 bp, E. coli
tctgaccactgtggatatgatccca

SEQ ID NO: 56739 - DNA, 25 bp, E. coli
gcgatgaaatcaggcccaatcagca

SEQ ID NO: 56740 - DNA, 25 bp, E. coli
gcgatgaaatcacgcccaatcagca

SEQ ID NO: 56741 - DNA, 25 bp, E. coli
gaaggtgacaaaggtctgaccactg

SEQ ID NO: 56742 - DNA, 25 bp, E. coli
gaaggtgacaaacgtctgaccactg

SEQ ID NO: 56743 - DNA, 25 bp, E. coli
gaaatcacgcccaatcagcagggca

SEQ ID NO: 56744 - DNA, 25 bp, E. coli
gacaaaggtctgaccactgtcgata

SEQ ID NO: 56745 - DNA, 25 bp, E. coli
gacaaaggtctgtccactgtcgata

SEQ ID NO: 56746 - DNA, 25 bp, E. coli
gaaatcacgccctatcagcagggca

SEQ ID NO: 56747 - DNA, 25 bp, E. coli
ccgtgaaggtgacaaaggtctgacc

SEQ ID NO: 56748 - DNA, 25 bp, E. coli
ccgtgaaggtgagaaaggtctgacc

SEQ ID NO: 56749 - DNA, 25 bp, E. coli
gagccgtctcttaccgcagggcgat

SEQ ID NO: 56750 - DNA, 25 bp, E. coli
gagccgtctctttccgcagggcgat

SEQ ID NO: 56751 - DNA, 25 bp, E. coli
tatccgcagcaataccggtctggtg

SEQ ID NO: 56752 - DNA, 25 bp, E. coli
tatccgcagcaaaaccggtctggtg

SEQ ID NO: 56753 - DNA, 25 bp, E. coli
tgttgttcaacatccataccctgga

SEQ ID NO: 56754 - DNA, 25 bp, E. coli
tgttgttcaacaaccataccctgga

SEQ ID NO: 56755 - DNA, 25 bp, E. coli
tctgcgagcatttaaaacgtgacgg

SEQ ID NO: 56756 - DNA, 25 bp, E. coli
tctgcacgccctgcgcgtggatggt

SEQ ID NO: 56757 - DNA, 25 bp, E. coli
tctcgcaggcctcgcggttggcttc

SEQ ID NO: 56758 - DNA, 25 bp, E. coli
tctgcgagcattaaaaacgtgacgg

SEQ ID NO: 56759 - DNA, 25 bp, E. coli
tctcgcaggcctggcggttggcttc

SEQ ID NO: 56760 - DNA, 25 bp, E. coli
tctgcacgccctccgcgtggatggt

SEQ ID NO: 56761 - DNA, 25 bp, E. coli
cgccgtactgggtcccgtatgcgcg

SEQ ID NO: 56762 - DNA, 25 bp, E. coli
cgccgtactgggacccgtatgcgcg

SEQ ID NO: 56763 - DNA, 25 bp, E. coli
cgtgacggtttagaagattatatcc

SEQ ID NO: 56764 - DNA, 25 bp, E. coli
cgtgacggtttacaagattatatcc

SEQ ID NO: 56765 - DNA, 25 bp, E. coli
gtggcgcagtaggaaacaatttcct

SEQ ID NO: 56766 - DNA, 25 bp, E. coli
gtgcggcctatcacgcaggcctggc

SEQ ID NO: 56767 - DNA, 25 bp, E. coli
gtgcggcctatctcgcaggcctggc

SEQ ID NO: 56768 - DNA, 25 bp, E. coli
gtggcgcagtagcaaacaatttcct

SEQ ID NO: 56769 - DNA, 25 bp, E. coli
tcaacatccatagcctggactggga

SEQ ID NO: 56770 - DNA, 25 bp, E. coli
tcaacatccataccctggactggga

SEQ ID NO: 56771 - DNA, 25 bp, E. coli
gatgcaggccgactctggtatccgt

SEQ ID NO: 56772 - DNA, 25 bp, E. coli
gatgcaggccgagtctggtatccgt

SEQ ID NO: 56773 - DNA, 25 bp, E. coli
catggatgatcagttcggagcaaaa

SEQ ID NO: 56774 - DNA, 25 bp, E. coli
catggatgatcacttcggagcaaaa

SEQ ID NO: 56775 - DNA, 25 bp, E. coli
tatggcagacaaaaaccgcgtactc

SEQ ID NO: 56776 - DNA, 25 bp, E. coli
tatggcagacaataaccgcgtactc

SEQ ID NO: 56777 - DNA, 25 bp, E. coli
tatatcctcaagtggcagaatggcg

SEQ ID NO: 56778 - DNA, 25 bp, E. coli
tatatcctcaagaggcagaatggcg

SEQ ID NO: 56779 - DNA, 25 bp, E. coli
ttgattatctcagcgactccggcgg

SEQ ID NO: 56780 - DNA, 25 bp, E. coli
ttatcgggcaaagcgcttcaggcgc

SEQ ID NO: 56781 - DNA, 25 bp, E. coli
ttgattatctcaccgactccggcgg

SEQ ID NO: 56782 - DNA, 25 bp, E. coli
ttatcgggcaaaccgcttcaggcgc

SEQ ID NO: 56783 - DNA, 25 bp, E. coli
tgtcgttatacagcaaccagccgga

SEQ ID NO: 56784 - DNA, 25 bp, E. coli
tgtcgttatacaccaaccagccgga

SEQ ID NO: 56785 - DNA, 25 bp, E. coli
gctctactcgaatggcaatggctgt

SEQ ID NO: 56786 - DNA, 25 bp, E. coli
gctctactcgaaaggcaatggctgt

SEQ ID NO: 56787 - DNA, 25 bp, E. coli
gaatagccaggtttcagtagccaaa

SEQ ID NO: 56788 - DNA, 25 bp, E. coli
gaatagccaggtatcagtagccaaa

SEQ ID NO: 56789 - DNA, 25 bp, E. coli
gaaaagtttacgtccaatcgcctga

SEQ ID NO: 56790 - DNA, 25 bp, E. coli
gaaaagtttacgaccaatcgcctga

SEQ ID NO: 56791 - DNA, 25 bp, E. coli
gatattacatcacgcgggtgctacc

SEQ ID NO: 56792 - DNA, 25 bp, E. coli
gatattacatcaggcgggtgctacc

SEQ ID NO: 56793 - DNA, 25 bp, E. coli
tctccggtcggttcgaaaaacgcag

SEQ ID NO: 56794 - DNA, 25 bp, E. coli
tctccggtcggtacgaaaaacgcag

SEQ ID NO: 56795 - DNA, 25 bp, E. coli
caatcgactttgatcttgaagggca

SEQ ID NO: 56796 - DNA, 25 bp, E. coli
aaccgcataggtatgcctgccacgg

SEQ ID NO: 56797 - DNA, 25 bp, E. coli
caatcgactttgttcttgaagggca

SEQ ID NO: 56798 - DNA, 25 bp, E. coli
caaacggcgatggaaattgcggcca

SEQ ID NO: 56799 - DNA, 25 bp, E. coli
caaacggcgatgcaaattgcggcca

SEQ ID NO: 56800 - DNA, 25 bp, E. coli
tacgacggtgagtaacttgacgagc

SEQ ID NO: 56801 - DNA, 25 bp, E. coli
tacgacggtgagaaacttgacgagc

SEQ ID NO: 56802 - DNA, 25 bp, E. coli
aaccgcataggtttgcctgccacgg

SEQ ID NO: 56803 - DNA, 25 bp, E. coli
tatcgtgattcaagttccgcgcggg

SEQ ID NO: 56804 - DNA, 25 bp, E. coli
tatcgtgattcatgttccgcgcggg

SEQ ID NO: 56805 - DNA, 25 bp, E. coli
tctgaaacgcactctggaacagtgg

SEQ ID NO: 56806 - DNA, 25 bp, E. coli
tctgaaacgcacactggaacagtgg

SEQ ID NO: 56807 - DNA, 25 bp, E. coli
cctgtaatgtccagtcagagcctga

SEQ ID NO: 56808 - DNA, 25 bp, E. coli
cctgtaatgtcctgtcagagcctga

SEQ ID NO: 56809 - DNA, 25 bp, E. coli
gcttcgggtattctggcggactata

SEQ ID NO: 56810 - DNA, 25 bp, E. coli
gcttcgggtattgtggcggactata

SEQ ID NO: 56811 - DNA, 25 bp, E. coli
cgatgttctgatcatgatggcgcaa

SEQ ID NO: 56812 - DNA, 25 bp, E. coli
cgatgttctgatgatgatggcgcaa

SEQ ID NO: 56813 - DNA, 25 bp, E. coli
gattcacgttttagcaaagacgcca

SEQ ID NO: 56814 - DNA, 25 bp, E. coli
gattcacgtttttgcaaagacgcca

SEQ ID NO: 56815 - DNA, 25 bp, E. coli
ggtccagccctttgttccagcgaaa

SEQ ID NO: 56816 - DNA, 25 bp, E. coli
ggtccagcccttagttccagcgaaa

SEQ ID NO: 56817 - DNA, 25 bp, E. coli
taaaatagtcggagacggagaccgt

SEQ ID NO: 56818 - DNA, 25 bp, E. coli
tacgcatgggtcagagaatatacca

SEQ ID NO: 56819 - DNA, 25 bp, E. coli
taaaatagtcggtgacggagaccgt

SEQ ID NO: 56820 - DNA, 25 bp, E. coli
tacgcatgggtctgagaatatacca

SEQ ID NO: 56821 - DNA, 25 bp, E. coli
taacgacagcttcgtacagtgcact

SEQ ID NO: 56822 - DNA, 25 bp, E. coli
ttggcatccctatagatagctcggg

SEQ ID NO: 56823 - DNA, 25 bp, E. coli
ttggcatccctaaagatagctcggg

SEQ ID NO: 56824 - DNA, 25 bp, E. coli
taatttcggctggagtcgcgggtaa

SEQ ID NO: 56825 - DNA, 25 bp, E. coli
taatttcggctgcagtcgcgggtaa

SEQ ID NO: 56826 - DNA, 25 bp, E. coli
tctacgtgttgatctgcatgaccca

SEQ ID NO: 56827 - DNA, 25 bp, E. coli
tctacgtgttgaactgcatgaccca

SEQ ID NO: 56828 - DNA, 25 bp, E. coli
gacaactttgagcagacttatagcg

SEQ ID NO: 56829 - DNA, 25 bp, E. coli
gactggcctgatagtcgacattcca

SEQ ID NO: 56830 - DNA, 25 bp, E. coli
gacaactttgaggagacttatagcg

SEQ ID NO: 56831 - DNA, 25 bp, E. coli
ggataacccattctttcaacccagg

SEQ ID NO: 56832 - DNA, 25 bp, E. coli
ggataacccattgtttcaacccagg

SEQ ID NO: 56833 - DNA, 25 bp, E. coli
ggatcacatgtaaccctatatcggg

SEQ ID NO: 56834 - DNA, 25 bp, E. coli
ggatcacatgtatccctatatcggg

SEQ ID NO: 56835 - DNA, 25 bp, E. coli
taaaactcaacgcaaagactggcct

SEQ ID NO: 56836 - DNA, 25 bp, E. coli
taacgacagcttggtacagtgcact

SEQ ID NO: 56837 - DNA, 25 bp, E. coli
taaaactcaacggaaagactggcct

SEQ ID NO: 56838 - DNA, 25 bp, E. coli
gactggcctgattgtcgacattcca

SEQ ID NO: 56839 - DNA, 25 bp, E. coli
ctattttgttgttaaagactattgc

SEQ ID NO: 56840 - DNA, 25 bp, E. coli
ctattttgttgtaaaagactattgc

SEQ ID NO: 56841 - DNA, 25 bp, E. coli
acaggttagtcgttttggttattag

SEQ ID NO: 56842 - DNA, 25 bp, E. coli
acaggttagtcgatttggttattag

SEQ ID NO: 56843 - DNA, 25 bp, E. coli
tttgcttactggaacataacgacgc

SEQ ID NO: 56844 - DNA, 25 bp, E. coli
tttgcttactggtacataacgacgc

SEQ ID NO: 56845 - DNA, 25 bp, E. coli
tcccgtctttaatccacaccgtttg

SEQ ID NO: 56846 - DNA, 25 bp, E. coli
tcccgtctttaaaccacaccgtttg

SEQ ID NO: 56847 - DNA, 25 bp, E. coli
tgacagggcgcacaaacagctttgc

SEQ ID NO: 56848 - DNA, 25 bp, E. coli
tgacagggcgcagaaacagctttgc

SEQ ID NO: 56849 - DNA, 25 bp, E. coli
tcgctgatttatcttaatgattggc

SEQ ID NO: 56850 - DNA, 25 bp, E. coli
tcgctgatttatgttaatgattggc

SEQ ID NO: 56851 - DNA, 25 bp, E. coli
tctcttctgtttaatgggcgctgac

SEQ ID NO: 56852 - DNA, 25 bp, E. coli
tctcttctgttttatgggcgctgac

SEQ ID NO: 56853 - DNA, 25 bp, E. coli
gactattgctaatacaggttagtcg

SEQ ID NO: 56854 - DNA, 25 bp, E. coli
gactattgctaaaacaggttagtcg

SEQ ID NO: 56855 - DNA, 25 bp, E. coli
gactttgttgcggaaaatcgctgat

SEQ ID NO: 56856 - DNA, 25 bp, E. coli
gactttgttgcgcaaaatcgctgat

SEQ ID NO: 56857 - DNA, 25 bp, E. coli
gaaacagctttggttactggaacat

SEQ ID NO: 56858 - DNA, 25 bp, E. coli
gaaacagctttgcttactggaacat

SEQ ID NO: 56859 - DNA, 25 bp, E. coli
ggttattagttatcgctatcccgtc

SEQ ID NO: 56860 - DNA, 25 bp, E. coli
ggttattagttaacgctatcccgtc

SEQ ID NO: 56861 - DNA, 25 bp, E. coli
taaagagctcggtaaaaatctgcca

SEQ ID NO: 56862 - DNA, 25 bp, E. coli
taaagagctcggaaaaaatctgcca

SEQ ID NO: 56863 - DNA, 25 bp, E. coli
agtacggcggccaggagttttcagc

SEQ ID NO: 56864 - DNA, 25 bp, E. coli
agtacggcggcctggagttttcagc

SEQ ID NO: 56865 - DNA, 25 bp, E. coli
taccgatcgacttcattatcggcgg

SEQ ID NO: 56866 - DNA, 25 bp, E. coli
taccgatcgactacattatcggcgg

SEQ ID NO: 56867 - DNA, 25 bp, E. coli
tgggcgtatctgaaagagcatcgct

SEQ ID NO: 56868 - DNA, 25 bp, E. coli
tgggcgtatctgtaagagcatcgct

SEQ ID NO: 56869 - DNA, 25 bp, E. coli
tctgaaagagcatcgcttcttcgcg

SEQ ID NO: 56870 - DNA, 25 bp, E. coli
tctgaaagagcaacgcttcttcgcg

SEQ ID NO: 56871 - DNA, 25 bp, E. coli
tcggtaaaaatctgccatttacccg

SEQ ID NO: 56872 - DNA, 25 bp, E. coli
tcggtaaaaatcagccatttacccg

SEQ ID NO: 56873 - DNA, 25 bp, E. coli
gcctggagttttcagcttatgccca

SEQ ID NO: 56874 - DNA, 25 bp, E. coli
gcctggagttttgagcttatgccca

SEQ ID NO: 56875 - DNA, 25 bp, E. coli
gaacgccactcggtcacgtattggt

SEQ ID NO: 56876 - DNA, 25 bp, E. coli
gaacgccactcgctcacgtattggt

SEQ ID NO: 56877 - DNA, 25 bp, E. coli
cggcggcctggacttttcagcttat

SEQ ID NO: 56878 - DNA, 25 bp, E. coli
cggcggcctggagttttcagcttat

SEQ ID NO: 56879 - DNA, 25 bp, E. coli
gtcttcgtaccgttcgactacatta

SEQ ID NO: 56880 - DNA, 25 bp, E. coli
gtcttcgtaccgatcgactacatta

SEQ ID NO: 56881 - DNA, 25 bp, E. coli
gagctcggtaaaaatctgccattta

SEQ ID NO: 56882 - DNA, 25 bp, E. coli
gagctcggtaaatatctgccattta

SEQ ID NO: 56883 - DNA, 25 bp, E. coli
caagttaaatatatccgcgcatcga

SEQ ID NO: 56884 - DNA, 25 bp, E. coli
caagttaaatatttccgcgcatcga

SEQ ID NO: 56885 - DNA, 25 bp, E. coli
cagcaacttcaatgtcttaatggca

SEQ ID NO: 56886 - DNA, 25 bp, E. coli
cagcaacttcaaagtcttaatggca

SEQ ID NO: 56887 - DNA, 25 bp, E. coli
taaagaataatcagaatagctgctc

SEQ ID NO: 56888 - DNA, 25 bp, E. coli
taaagatgatgcgtcgttttctgcg

SEQ ID NO: 56889 - DNA, 25 bp, E. coli
taaagatgatgcctcgttttctgcg

SEQ ID NO: 56890 - DNA, 25 bp, E. coli
taaagaataatctgaatagctgctc

SEQ ID NO: 56891 - DNA, 25 bp, E. coli
tagattatttttagagcgcacagcc

SEQ ID NO: 56892 - DNA, 25 bp, E. coli
tagattattttttgagcgcacagcc

SEQ ID NO: 56893 - DNA, 25 bp, E. coli
tatgtgataattgccaaccgctaaa

SEQ ID NO: 56894 - DNA, 25 bp, E. coli
tatgtgataattcccaaccgctaaa

SEQ ID NO: 56895 - DNA, 25 bp, E. coli
tctactactagcatagcaaagctac

SEQ ID NO: 56896 - DNA, 25 bp, E. coli
tctactactagcttagcaaagctac

SEQ ID NO: 56897 - DNA, 25 bp, E. coli
gccgcagctaactccattgcaatta

SEQ ID NO: 56898 - DNA, 25 bp, E. coli
gccgcagctaacaccattgcaatta

SEQ ID NO: 56899 - DNA, 25 bp, E. coli
cgttttctgcgaagggaatagtcaa

SEQ ID NO: 56900 - DNA, 25 bp, E. coli
cgttttctgcgatgggaatagtcaa

SEQ ID NO: 56901 - DNA, 25 bp, E. coli
gattttaatcaggattcatcgccaa

SEQ ID NO: 56902 - DNA, 25 bp, E. coli
gattttaatcagcattcatcgccaa

SEQ ID NO: 56903 - DNA, 25 bp, E. coli
taatatatatcgtcaacctatgctc

SEQ ID NO: 56904 - DNA, 25 bp, E. coli
taatatatatcgacaacctatgctc

SEQ ID NO: 56905 - DNA, 25 bp, E. coli
taaagggatgatatgcccatgggct

SEQ ID NO: 56906 - DNA, 25 bp, E. coli
taaagggatgatttgcccatgggct

SEQ ID NO: 56907 - DNA, 25 bp, E. coli
aaaaaagtgcagagtcgatcacgaa

SEQ ID NO: 56908 - DNA, 25 bp, E. coli
aaaaaagtgcagtgtcgatcacgaa

SEQ ID NO: 56909 - DNA, 25 bp, E. coli
tattcaacagataaatgacggcaga

SEQ ID NO: 56910 - DNA, 25 bp, E. coli
tattcaacagattaatgacggcaga

SEQ ID NO: 56911 - DNA, 25 bp, E. coli
ttatcggtaaggtggaaatgcagag

SEQ ID NO: 56912 - DNA, 25 bp, E. coli
ttatcggtaaggaggaaatgcagag

SEQ ID NO: 56913 - DNA, 25 bp, E. coli
tgagaatggaaatatgagggagccc

SEQ ID NO: 56914 - DNA, 25 bp, E. coli
tgagaatggaaaaatgagggagccc

SEQ ID NO: 56915 - DNA, 25 bp, E. coli
tgagggagcccacaaaatgtatgtc

SEQ ID NO: 56916 - DNA, 25 bp, E. coli
tgagggagcccagaaaatgtatgtc

SEQ ID NO: 56917 - DNA, 25 bp, E. coli
tcagtgaagcgtcaaaatagaaaac

SEQ ID NO: 56918 - DNA, 25 bp, E. coli
tcagtgaagcgtgaaaatagaaaac

SEQ ID NO: 56919 - DNA, 25 bp, E. coli
gcccatgggctagggttttcaatta

SEQ ID NO: 56920 - DNA, 25 bp, E. coli
gcccatgggctacggttttcaatta

SEQ ID NO: 56921 - DNA, 25 bp, E. coli
gaaaatgtatgtggacttgccagcc

SEQ ID NO: 56922 - DNA, 25 bp, E. coli
gaaaatgtatgtcgacttgccagcc

SEQ ID NO: 56923 - DNA, 25 bp, E. coli
gatcacgaatatctcatgagaatgg

SEQ ID NO: 56924 - DNA, 25 bp, E. coli
gatcacgaatatgtcatgagaatgg

SEQ ID NO: 56925 - DNA, 25 bp, E. coli
tcaacctccgattatcagtgaagcg

SEQ ID NO: 56926 - DNA, 25 bp, E. coli
tcaacctccgataatcagtgaagcg

SEQ ID NO: 56927 - DNA, 25 bp, E. coli
tattcagcgaaagctcccttcagca

SEQ ID NO: 56928 - DNA, 25 bp, E. coli
tattcagcgaaacctcccttcagca

SEQ ID NO: 56929 - DNA, 25 bp, E. coli
tgatggcggatgttaaaaaccagcg

SEQ ID NO: 56930 - DNA, 25 bp, E. coli
tgatggcggatgataaaaaccagcg

SEQ ID NO: 56931 - DNA, 25 bp, E. coli
tcctgatgataagcaggcgcagcag

SEQ ID NO: 56932 - DNA, 25 bp, E. coli
tcctgatgataaccaggcgcagcag

SEQ ID NO: 56933 - DNA, 25 bp, E. coli
tcagttgcagcctacggcagcagtt

SEQ ID NO: 56934 - DNA, 25 bp, E. coli
tcttcaccggaagggttatggcggc

SEQ ID NO: 56935 - DNA, 25 bp, E. coli
tcttcaccggaacggttatggcggc

SEQ ID NO: 56936 - DNA, 25 bp, E. coli
tcagttgcagccaacggcagcagtt

SEQ ID NO: 56937 - DNA, 25 bp, E. coli
gccacactggtgagtatcaagccct

SEQ ID NO: 56938 - DNA, 25 bp, E. coli
gccacactggtgtgtatcaagccct

SEQ ID NO: 56939 - DNA, 25 bp, E. coli
gctggatgttttaccgccgcaggta

SEQ ID NO: 56940 - DNA, 25 bp, E. coli
gctggatgtttttccgccgcaggta

SEQ ID NO: 56941 - DNA, 25 bp, E. coli
gaattctgcgttaccctgcgctcag

SEQ ID NO: 56942 - DNA, 25 bp, E. coli
gaattctgcgtttccctgcgctcag

SEQ ID NO: 56943 - DNA, 25 bp, E. coli
gacaaaacgggctggacgcaattaa

SEQ ID NO: 56944 - DNA, 25 bp, E. coli
gaactggcaacgtaaaccatcgccg

SEQ ID NO: 56945 - DNA, 25 bp, E. coli
gacaaaacgggcaggacgcaattaa

SEQ ID NO: 56946 - DNA, 25 bp, E. coli
gaactggcaacgaaaaccatcgccg

SEQ ID NO: 56947 - DNA, 25 bp, E. coli
tggacttcactctacaaagcggatg

SEQ ID NO: 56948 - DNA, 25 bp, E. coli
tggacttcactcaacaaagcggatg

SEQ ID NO: 56949 - DNA, 25 bp, E. coli
cataccaactgattgcccgggaagt

SEQ ID NO: 56950 - DNA, 25 bp, E. coli
cataccaactgaatgcccgggaagt

SEQ ID NO: 56951 - DNA, 25 bp, E. coli
tacagaactgaaagaatctccacgc

SEQ ID NO: 56952 - DNA, 25 bp, E. coli
tacagaactgaatgaatctccacgc

SEQ ID NO: 56953 - DNA, 25 bp, E. coli
agacaggattgctggtgagcgcact

SEQ ID NO: 56954 - DNA, 25 bp, E. coli
agacaggattgcaggtgagcgcact

SEQ ID NO: 56955 - DNA, 25 bp, E. coli
tatcctgaggctgagaaagtacggg

SEQ ID NO: 56956 - DNA, 25 bp, E. coli
tatcctgaggctcagaaagtacggg

SEQ ID NO: 56957 - DNA, 25 bp, E. coli
tatgacaacatatccggaacaactc

SEQ ID NO: 56958 - DNA, 25 bp, E. coli
tatgacaacataaccggaacaactc

SEQ ID NO: 56959 - DNA, 25 bp, E. coli
tcgtacaccacaactgattgccgcg

SEQ ID NO: 56960 - DNA, 25 bp, E. coli
tcgtacaccacatctgattgccgcg

SEQ ID NO: 56961 - DNA, 25 bp, E. coli
ccagctgaatctatatacggaatgc

SEQ ID NO: 56962 - DNA, 25 bp, E. coli
gcgcattgcggctgatatcctgagg

SEQ ID NO: 56963 - DNA, 25 bp, E. coli
gcgcattgcggcagatatcctgagg

SEQ ID NO: 56964 - DNA, 25 bp, E. coli
ccagctgaatctttatacggaatgc

SEQ ID NO: 56965 - DNA, 25 bp, E. coli
gcttctgtggacctgtatgacaaca

SEQ ID NO: 56966 - DNA, 25 bp, E. coli
gcgggtggttgccaatgaaaacaca

SEQ ID NO: 56967 - DNA, 25 bp, E. coli
gcgggtggttgcgaatgaaaacaca

SEQ ID NO: 56968 - DNA, 25 bp, E. coli
gcttctgtggacgtgtatgacaaca

SEQ ID NO: 56969 - DNA, 25 bp, E. coli
ggaacaactcgtgatatccctgtat

SEQ ID NO: 56970 - DNA, 25 bp, E. coli
ggaacaactcgtcatatccctgtat

SEQ ID NO: 56971 - DNA, 25 bp, E. coli
aattaccgatatcgatacatcagga

SEQ ID NO: 56972 - DNA, 25 bp, E. coli
aattaccgatatggatacatcagga

SEQ ID NO: 56973 - DNA, 25 bp, E. coli
catatggtgttgtgtgtgagttcga

SEQ ID NO: 56974 - DNA, 25 bp, E. coli
catatggtgttgagtgtgagttcga

SEQ ID NO: 56975 - DNA, 25 bp, E. coli
tacatcattgataacgactggaaag

SEQ ID NO: 56976 - DNA, 25 bp, E. coli
tacatcattgattacgactggaaag

SEQ ID NO: 56977 - DNA, 25 bp, E. coli
tcgactggaatgttggaaatggtca

SEQ ID NO: 56978 - DNA, 25 bp, E. coli
tcgactggaatgatggaaatggtca

SEQ ID NO: 56979 - DNA, 25 bp, E. coli
gctgtattaatcatgctggcgcaac

SEQ ID NO: 56980 - DNA, 25 bp, E. coli
gctgtattaatcttgctggcgcaac

SEQ ID NO: 56981 - DNA, 25 bp, E. coli
gctggcgcaacaagctctgcttata

SEQ ID NO: 56982 - DNA, 25 bp, E. coli
gctggcgcaacatgctctgcttata

SEQ ID NO: 56983 - DNA, 25 bp, E. coli
gaataccgactctataaacacggct

SEQ ID NO: 56984 - DNA, 25 bp, E. coli
gaataccgactcaataaacacggct

SEQ ID NO: 56985 - DNA, 25 bp, E. coli
gactggaaagcatcaatagaaattg

SEQ ID NO: 56986 - DNA, 25 bp, E. coli
gacgtaatgacacaggaaaaacttc

SEQ ID NO: 56987 - DNA, 25 bp, E. coli
gacgtaatgacagaggaaaaacttc

SEQ ID NO: 56988 - DNA, 25 bp, E. coli
ggtcagactctgtataccgactcaa

SEQ ID NO: 56989 - DNA, 25 bp, E. coli
ggtcagactctgaataccgactcaa

SEQ ID NO: 56990 - DNA, 25 bp, E. coli
tcaagcgacttatatgcatatggtg

SEQ ID NO: 56991 - DNA, 25 bp, E. coli
tcaagcgacttaaatgcatatggtg

SEQ ID NO: 56992 - DNA, 25 bp, E. coli
gactggaaagcaacaatagaaattg

SEQ ID NO: 56993 - DNA, 25 bp, E. coli
cacaaaatggtggaagtgaacgcct

SEQ ID NO: 56994 - DNA, 25 bp, E. coli
cacaaaatggtgcaagtgaacgcct

SEQ ID NO: 56995 - DNA, 25 bp, E. coli
tacggcgctgcataaagtggtcgaa

SEQ ID NO: 56996 - DNA, 25 bp, E. coli
taaactgaaaaagcagccggaactg

SEQ ID NO: 56997 - DNA, 25 bp, E. coli
tacggcgctgcaaaaagtggtcgaa

SEQ ID NO: 56998 - DNA, 25 bp, E. coli
tttgtcgaacgaggagctgctgccc

SEQ ID NO: 56999 - DNA, 25 bp, E. coli
tttgtcgaacgacgagctgctgccc

SEQ ID NO: 57000 - DNA, 25 bp, E. coli
tgtgggaaccgcactacgcttgcta

SEQ ID NO: 57001 - DNA, 25 bp, E. coli
tgtgggaaccgctctacgcttgcta

SEQ ID NO: 57002 - DNA, 25 bp, E. coli
tgatatccgtcaggagagcacgcgt

SEQ ID NO: 57003 - DNA, 25 bp, E. coli
tgatatccgtcacgagagcacgcgt

SEQ ID NO: 57004 - DNA, 25 bp, E. coli
tgcgcgaactgatcgaacaactgga

SEQ ID NO: 57005 - DNA, 25 bp, E. coli
tgcgcgaactgaacgaacaactgga

SEQ ID NO: 57006 - DNA, 25 bp, E. coli
ccaagcccggtacatgaagccaaat

SEQ ID NO: 57007 - DNA, 25 bp, E. coli
ccaagcccggtagatgaagccaaat

SEQ ID NO: 57008 - DNA, 25 bp, E. coli
gaatcgctgtcgctggaactggtcc

SEQ ID NO: 57009 - DNA, 25 bp, E. coli
gaatcgctgtcggtggaactggtcc

SEQ ID NO: 57010 - DNA, 25 bp, E. coli
ggaatatttacaccgacccgctgaa

SEQ ID NO: 57011 - DNA, 25 bp, E. coli
ggaatatttacagcgacccgctgaa

SEQ ID NO: 57012 - DNA, 25 bp, E. coli
taaactgaaaaaccagccggaactg

SEQ ID NO: 57013 - DNA, 25 bp, E. coli
taatcaaaacctgcgaaaaagcggg

SEQ ID NO: 57014 - DNA, 25 bp, E. coli
taatcaaaacctccgaaaaagcggg

SEQ ID NO: 57015 - DNA, 25 bp, E. coli
tgtgtgactttattaatgcgcatcc

SEQ ID NO: 57016 - DNA, 25 bp, E. coli
tgtgtgactttaataatgcgcatcc

SEQ ID NO: 57017 - DNA, 25 bp, E. coli
tcgtgatttagaattgtatgtagca

SEQ ID NO: 57018 - DNA, 25 bp, E. coli
tcgtgatttagatttgtatgtagca

SEQ ID NO: 57019 - DNA, 25 bp, E. coli
cctgcttcgtttaatcgtgatttag

SEQ ID NO: 57020 - DNA, 25 bp, E. coli
cctgcttcgttttatcgtgatttag

SEQ ID NO: 57021 - DNA, 25 bp, E. coli
gactttattaatccgcatcctgctt

SEQ ID NO: 57022 - DNA, 25 bp, E. coli
gactttattaatgcgcatcctgctt

SEQ ID NO: 57023 - DNA, 25 bp, E. coli
cgcatcctgcttggttttatcgtga

SEQ ID NO: 57024 - DNA, 25 bp, E. coli
cgatgatctattacttctggttaag

SEQ ID NO: 57025 - DNA, 25 bp, E. coli
cgatgatctatttcttctggttaag

SEQ ID NO: 57026 - DNA, 25 bp, E. coli
cgcatcctgcttcgttttatcgtga

SEQ ID NO: 57027 - DNA, 25 bp, E. coli
ctattacttctggttaagatttcta

SEQ ID NO: 57028 - DNA, 25 bp, E. coli
ctattacttctgcttaagatttcta

SEQ ID NO: 57029 - DNA, 25 bp, E. coli
gatttctatttttattatgtgtgac

SEQ ID NO: 57030 - DNA, 25 bp, E. coli
gtatgtagcatttgccataaaatga

SEQ ID NO: 57031 - DNA, 25 bp, E. coli
gtatgtagcattagccataaaatga

SEQ ID NO: 57032 - DNA, 25 bp, E. coli
gatttctattttaattatgtgtgac

SEQ ID NO: 57033 - DNA, 25 bp, E. coli
ggtgattgatttacacgatgatcta

SEQ ID NO: 57034 - DNA, 25 bp, E. coli
ggtgattgattttcacgatgatcta

SEQ ID NO: 57035 - DNA, 25 bp, E. coli
tagaattgtatgtagcattagccat

SEQ ID NO: 57036 - DNA, 25 bp, E. coli
tagaattgtatgaagcattagccat

SEQ ID NO: 57037 - DNA, 25 bp, E. coli
aaatgtgccggctgttgacccgtgg

SEQ ID NO: 57038 - DNA, 25 bp, E. coli
aaatgtgccggcagttgacccgtgg

SEQ ID NO: 57039 - DNA, 25 bp, E. coli
ttatcgctgagggaggaacctgtcc

SEQ ID NO: 57040 - DNA, 25 bp, E. coli
ttatcgctgaggcaggaacctgtcc

SEQ ID NO: 57041 - DNA, 25 bp, E. coli
taataaaggtacagttaccgctcag

SEQ ID NO: 57042 - DNA, 25 bp, E. coli
taataaaggtactgttaccgctcag

SEQ ID NO: 57043 - DNA, 25 bp, E. coli
tcgacagttgaaaggctcagcgcca

SEQ ID NO: 57044 - DNA, 25 bp, E. coli
tcgacagttgaatggctcagcgcca

SEQ ID NO: 57045 - DNA, 25 bp, E. coli
tcagcgccagcgtgtcgagattaga

SEQ ID NO: 57046 - DNA, 25 bp, E. coli
ccgtggctggcaaaatcgacagttg

SEQ ID NO: 57047 - DNA, 25 bp, E. coli
ccgtggctggcataatcgacagttg

SEQ ID NO: 57048 - DNA, 25 bp, E. coli
gaattacttgtttcgttccagacgc

SEQ ID NO: 57049 - DNA, 25 bp, E. coli
gaattacttgttacgttccagacgc

SEQ ID NO: 57050 - DNA, 25 bp, E. coli
gacccagggtgcttatccagattga

SEQ ID NO: 57051 - DNA, 25 bp, E. coli
gacccagggtgcatatccagattga

SEQ ID NO: 57052 - DNA, 25 bp, E. coli
ctttggaaagaacgctaccgttgat

SEQ ID NO: 57053 - DNA, 25 bp, E. coli
ctttggaaagaaggctaccgttgat

SEQ ID NO: 57054 - DNA, 25 bp, E. coli
gattgattagcccacctttggaaag

SEQ ID NO: 57055 - DNA, 25 bp, E. coli
gttgataagcattcgacccgaggcg

SEQ ID NO: 57056 - DNA, 25 bp, E. coli
gattgattagccgacctttggaaag

SEQ ID NO: 57057 - DNA, 25 bp, E. coli
gttgataagcatacgacccgaggcg

SEQ ID NO: 57058 - DNA, 25 bp, E. coli
tcagcgccagcgagtcgagattaga

SEQ ID NO: 57059 - DNA, 25 bp, E. coli
caatttcctcaatgtggtgagcatt

SEQ ID NO: 57060 - DNA, 25 bp, E. coli
caatttcctcaaagtggtgagcatt

SEQ ID NO: 57061 - DNA, 25 bp, E. coli
aatgtggtgagcattgcgccggact

SEQ ID NO: 57062 - DNA, 25 bp, E. coli
aatgtggtgagctttgcgccggact

SEQ ID NO: 57063 - DNA, 25 bp, E. coli
cagaaccatcgaaagcggtaaagtt

SEQ ID NO: 57064 - DNA, 25 bp, E. coli
cagaaccatcgatagcggtaaagtt

SEQ ID NO: 57065 - DNA, 25 bp, E. coli
tttcctcaatgtggtgagcattgcg

SEQ ID NO: 57066 - DNA, 25 bp, E. coli
tttcctcaatgtcgtgagcattgcg

SEQ ID NO: 57067 - DNA, 25 bp, E. coli
tgtggtgagcattgcgccggactgc

SEQ ID NO: 57068 - DNA, 25 bp, E. coli
tgtggtgagcatagcgccggactgc

SEQ ID NO: 57069 - DNA, 25 bp, E. coli
tcctcaatgtggtgagcattgcgcc

SEQ ID NO: 57070 - DNA, 25 bp, E. coli
tcctcaatgtggagagcattgcgcc

SEQ ID NO: 57071 - DNA, 25 bp, E. coli
cctcaatgtggtgagcattgcgccg

SEQ ID NO: 57072 - DNA, 25 bp, E. coli
cctcaatgtggtcagcattgcgccg

SEQ ID NO: 57073 - DNA, 25 bp, E. coli
gcaatttcctcaatgtggtgagcat

SEQ ID NO: 57074 - DNA, 25 bp, E. coli
gcaatttcctcattgtggtgagcat

SEQ ID NO: 57075 - DNA, 25 bp, E. coli
gggcaatttcctcaatgtggtgagc

SEQ ID NO: 57076 - DNA, 25 bp, E. coli
gggcaatttcctgaatgtggtgagc

SEQ ID NO: 57077 - DNA, 25 bp, E. coli
ggcaatttcctctatgtggtgagca

SEQ ID NO: 57078 - DNA, 25 bp, E. coli
ggcaatttcctcaatgtggtgagca

SEQ ID NO: 57079 - DNA, 25 bp, E. coli
tcaatgtggtgaccattgcgccgga

SEQ ID NO: 57080 - DNA, 25 bp, E. coli
tcaatgtggtgagcattgcgccgga

SEQ ID NO: 57081 - DNA, 25 bp, E. coli
tactggaggttaaagcaacaggtga

SEQ ID NO: 57082 - DNA, 25 bp, E. coli
tactggaggttatagcaacaggtga

SEQ ID NO: 57083 - DNA, 25 bp, E. coli
acaacgggcgcggtgatgcggcatt

SEQ ID NO: 57084 - DNA, 25 bp, E. coli
acaacgggcgcgctgatgcggcatt

SEQ ID NO: 57085 - DNA, 25 bp, E. coli
ttatagaaaagggagggctactgga

SEQ ID NO: 57086 - DNA, 25 bp, E. coli
ttatagaaaaggcagggctactgga

SEQ ID NO: 57087 - DNA, 25 bp, E. coli
tctttgccgttaaagaaaagggagg

SEQ ID NO: 57088 - DNA, 25 bp, E. coli
tctcgcagagaatcgcgcacaaatg

SEQ ID NO: 57089 - DNA, 25 bp, E. coli
tctcgcagagaaacgcgcacaaatg

SEQ ID NO: 57090 - DNA, 25 bp, E. coli
tctttgccgttatagaaaagggagg

SEQ ID NO: 57091 - DNA, 25 bp, E. coli
gccgtctttgccgttatagaaaagg

SEQ ID NO: 57092 - DNA, 25 bp, E. coli
gccgtctttgcccttatagaaaagg

SEQ ID NO: 57093 - DNA, 25 bp, E. coli
cgttatagaaaacggagggctactg

SEQ ID NO: 57094 - DNA, 25 bp, E. coli
cgttatagaaaagggagggctactg

SEQ ID NO: 57095 - DNA, 25 bp, E. coli
ggaggttaaagcaacaggtgatttc

SEQ ID NO: 57096 - DNA, 25 bp, E. coli
ggattgccgtctttgccgttataga

SEQ ID NO: 57097 - DNA, 25 bp, E. coli
ggattgccgtctatgccgttataga

SEQ ID NO: 57098 - DNA, 25 bp, E. coli
ggaggttaaagctacaggtgatttc

SEQ ID NO: 57099 - DNA, 25 bp, E. coli
gatgggattgccgtctttgccgtta

SEQ ID NO: 57100 - DNA, 25 bp, E. coli
gatgggattgccctctttgccgtta

SEQ ID NO: 57101 - DNA, 25 bp, E. coli
gagaatcgcgcagaaatgccccctt

SEQ ID NO: 57102 - DNA, 25 bp, E. coli
gagaatcgcgcacaaatgccccctt

SEQ ID NO: 57103 - DNA, 25 bp, E. coli
catgacctctgttccgacgctcatc

SEQ ID NO: 57104 - DNA, 25 bp, E. coli
catgacctctgtaccgacgctcatc

SEQ ID NO: 57105 - DNA, 25 bp, E. coli
acttttgcaactcaacattaatctg

SEQ ID NO: 57106 - DNA, 25 bp, E. coli
acttttgcaactgaacattaatctg

SEQ ID NO: 57107 - DNA, 25 bp, E. coli
ttgtcggcacgaagaaagcaggcaa

SEQ ID NO: 57108 - DNA, 25 bp, E. coli
ttgtcggcacgatgaaagcaggcaa

SEQ ID NO: 57109 - DNA, 25 bp, E. coli
tgtcggcacgatgaaagcaggcaaa

SEQ ID NO: 57110 - DNA, 25 bp, E. coli
tgtcggcacgatcaaagcaggcaaa

SEQ ID NO: 57111 - DNA, 25 bp, E. coli
tgttgtcggcacgatgaaagcaggc

SEQ ID NO: 57112 - DNA, 25 bp, E. coli
tgttgtcggcaccatgaaagcaggc

SEQ ID NO: 57113 - DNA, 25 bp, E. coli
gctgttgtcggctcgatgaaagcag

SEQ ID NO: 57114 - DNA, 25 bp, E. coli
gctgttgtcggcacgatgaaagcag

SEQ ID NO: 57115 - DNA, 25 bp, E. coli
ccgacttttgcatctgaacattaat

SEQ ID NO: 57116 - DNA, 25 bp, E. coli
cgaccgacttttccaactgaacatt

SEQ ID NO: 57117 - DNA, 25 bp, E. coli
cgaccgacttttgcaactgaacatt

SEQ ID NO: 57118 - DNA, 25 bp, E. coli
ccgacttttgcaactgaacattaat

SEQ ID NO: 57119 - DNA, 25 bp, E. coli
cgacttttgcaactgaacattaatc

SEQ ID NO: 57120 - DNA, 25 bp, E. coli
cgacttttgcaagtgaacattaatc

SEQ ID NO: 57121 - DNA, 25 bp, E. coli
gttgtcggcacgatgaaagcaggca

SEQ ID NO: 57122 - DNA, 25 bp, E. coli
gttgtcggcacgttgaaagcaggca

SEQ ID NO: 57123 - DNA, 25 bp, E. coli
gaccgacttttggaactgaacatta

SEQ ID NO: 57124 - DNA, 25 bp, E. coli
gaccgacttttgcaactgaacatta

SEQ ID NO: 57125 - DNA, 25 bp, E. coli
agcaactggcgctcgccgcacgctg

SEQ ID NO: 57126 - DNA, 25 bp, E. coli
atctgcgctgcgaactgccgcatca

SEQ ID NO: 57127 - DNA, 25 bp, E. coli
agcaactggcgcacgccgcacgctg

SEQ ID NO: 57128 - DNA, 25 bp, E. coli
atctgcgctgcgtactgccgcatca

SEQ ID NO: 57129 - DNA, 25 bp, E. coli
ttgagctgcatagcgataatctgga

SEQ ID NO: 57130 - DNA, 25 bp, E. coli
ttgagctgcataccgataatctgga

SEQ ID NO: 57131 - DNA, 25 bp, E. coli
tgctcgatgcggcatttcgcgtcgc

SEQ ID NO: 57132 - DNA, 25 bp, E. coli
tgctcgatgcgggatttcgcgtcgc

SEQ ID NO: 57133 - DNA, 25 bp, E. coli
tcgatgcggcatttcgcgtcgccga

SEQ ID NO: 57134 - DNA, 25 bp, E. coli
tcgatgcggcatatcgcgtcgccga

SEQ ID NO: 57135 - DNA, 25 bp, E. coli
tctgcatctgcgctgcgaactgccg

SEQ ID NO: 57136 - DNA, 25 bp, E. coli
tctgcatctgcggtgcgaactgccg

SEQ ID NO: 57137 - DNA, 25 bp, E. coli
ccagcctgctcgatgcggcatttcg

SEQ ID NO: 57138 - DNA, 25 bp, E. coli
ccagcctgctcgttgcggcatttcg

SEQ ID NO: 57139 - DNA, 25 bp, E. coli
gctgcataccgaaaatctggataaa

SEQ ID NO: 57140 - DNA, 25 bp, E. coli
gctgcataccgataatctggataaa

SEQ ID NO: 57141 - DNA, 25 bp, E. coli
gcaccgtctgcatctgcgctgcgaa

SEQ ID NO: 57142 - DNA, 25 bp, E. coli
gcaccgtctgcaactgcgctgcgaa

SEQ ID NO: 57143 - DNA, 25 bp, E. coli
cgataatctggataaattcttcacc

SEQ ID NO: 57144 - DNA, 25 bp, E. coli
cgataatctggaaaaattcttcacc

SEQ ID NO: 57145 - DNA, 25 bp, E. coli
gattgagctgcataccgataatctg

SEQ ID NO: 57146 - DNA, 25 bp, E. coli
gattgagctgcaaaccgataatctg

SEQ ID NO: 57147 - DNA, 25 bp, E. coli
aagcccgtcttggtctggaatcgca

SEQ ID NO: 57148 - DNA, 25 bp, E. coli
aagcccgtcttgctctggaatcgca

SEQ ID NO: 57149 - DNA, 25 bp, E. coli
cagtgaaaatgagcgctggcgcaaa

SEQ ID NO: 57150 - DNA, 25 bp, E. coli
cagtgaaaatgaccgctggcgcaaa

SEQ ID NO: 57151 - DNA, 25 bp, E. coli
taaatctccctgctttggccgggca

SEQ ID NO: 57152 - DNA, 25 bp, E. coli
ccgtaaggataaaggtcagtctgca

SEQ ID NO: 57153 - DNA, 25 bp, E. coli
cctcttcacgaaaaggcggccatga

SEQ ID NO: 57154 - DNA, 25 bp, E. coli
cctcttcacgaataggcggccatga

SEQ ID NO: 57155 - DNA, 25 bp, E. coli
cctggaagaaccagcatggcgtcaa

SEQ ID NO: 57156 - DNA, 25 bp, E. coli
ccgtaaggataatggtcagtctgca

SEQ ID NO: 57157 - DNA, 25 bp, E. coli
cctggaagaacctgcatggcgtcaa

SEQ ID NO: 57158 - DNA, 25 bp, E. coli
gacttccgcggagatcacatggtag

SEQ ID NO: 57159 - DNA, 25 bp, E. coli
gacagaaatggacgcagaggaaccc

SEQ ID NO: 57160 - DNA, 25 bp, E. coli
gacaaatcgtttgggacggcggcta

SEQ ID NO: 57161 - DNA, 25 bp, E. coli
gacaataccggatatggcagcctgg

SEQ ID NO: 57162 - DNA, 25 bp, E. coli
gacttccgcggacatcacatggtag

SEQ ID NO: 57163 - DNA, 25 bp, E. coli
gacaataccggaaatggcagcctgg

SEQ ID NO: 57164 - DNA, 25 bp, E. coli
gacaaatcgtttcggacggcggcta

SEQ ID NO: 57165 - DNA, 25 bp, E. coli
gacagaaatggaggcagaggaaccc

SEQ ID NO: 57166 - DNA, 25 bp, E. coli
taaatctccctggtttggccgggca

SEQ ID NO: 57167 - DNA, 25 bp, E. coli
gagttcccgggtagcaaaccgcttg

SEQ ID NO: 57168 - DNA, 25 bp, E. coli
gagttcccgggttgcaaaccgcttg

SEQ ID NO: 57169 - DNA, 25 bp, E. coli
cagccactggcagatggtcatcctg

SEQ ID NO: 57170 - DNA, 25 bp, E. coli
cagccactggcacatggtcatcctg

SEQ ID NO: 57171 - DNA, 25 bp, E. coli
ttatccctttatatccggctgcgca

SEQ ID NO: 57172 - DNA, 25 bp, E. coli
ttttttacgacctgccactggcaga

SEQ ID NO: 57173 - DNA, 25 bp, E. coli
ttatccctttatttccggctgcgca

SEQ ID NO: 57174 - DNA, 25 bp, E. coli
tttacgaccagccactggcagatgg

SEQ ID NO: 57175 - DNA, 25 bp, E. coli
tttacgaccagcgactggcagatgg

SEQ ID NO: 57176 - DNA, 25 bp, E. coli
ttatttccggctccgcatggcgcgg

SEQ ID NO: 57177 - DNA, 25 bp, E. coli
ttatttccggctgcgcatggcgcgg

SEQ ID NO: 57178 - DNA, 25 bp, E. coli
ttttttacgaccagccactggcaga

SEQ ID NO: 57179 - DNA, 25 bp, E. coli
tgctttgccacaaaagtgttatttc

SEQ ID NO: 57180 - DNA, 25 bp, E. coli
tgctttgccacataagtgttatttc

SEQ ID NO: 57181 - DNA, 25 bp, E. coli
tccggctgcgcatggcgcggccttt

SEQ ID NO: 57182 - DNA, 25 bp, E. coli
tccggctgcgcaaggcgcggccttt

SEQ ID NO: 57183 - DNA, 25 bp, E. coli
tcatcgttatccgtttatttccggc

SEQ ID NO: 57184 - DNA, 25 bp, E. coli
tcatcgttatccctttatttccggc

SEQ ID NO: 57185 - DNA, 25 bp, E. coli
gcatggcgcggccttttttttacga

SEQ ID NO: 57186 - DNA, 25 bp, E. coli
gcatggcgcggcgttttttttacga

SEQ ID NO: 57187 - DNA, 25 bp, E. coli
gtttttctcaaagtatcatcgttat

SEQ ID NO: 57188 - DNA, 25 bp, E. coli
gtttttctcaaactatcatcgttat

SEQ ID NO: 57189 - DNA, 25 bp, E. coli
ggcagatggtcatcctgtgatttga

SEQ ID NO: 57190 - DNA, 25 bp, E. coli
ggcagatggtcaacctgtgatttga

SEQ ID NO: 57191 - DNA, 25 bp, E. coli
aagcgcctcactggcatcggcatag

SEQ ID NO: 57192 - DNA, 25 bp, E. coli
aagcgcctcactcgcatcggcatag

SEQ ID NO: 57193 - DNA, 25 bp, E. coli
cactggcatcggcatagaaagaaac

SEQ ID NO: 57194 - DNA, 25 bp, E. coli
cactggcatcgggatagaaagaaac

SEQ ID NO: 57195 - DNA, 25 bp, E. coli
agcggcaagcgcctcactggcatcg

SEQ ID NO: 57196 - DNA, 25 bp, E. coli
agcggcaagcgcgtcactggcatcg

SEQ ID NO: 57197 - DNA, 25 bp, E. coli
tgattttatcaaggcgatgttgttg

SEQ ID NO: 57198 - DNA, 25 bp, E. coli
tgattttatcaacgcgatgttgttg

SEQ ID NO: 57199 - DNA, 25 bp, E. coli
cctcactggcatcggcatagaaaga

SEQ ID NO: 57200 - DNA, 25 bp, E. coli
gcgcctcactgggatcggcatagaa

SEQ ID NO: 57201 - DNA, 25 bp, E. coli
cctcactggcatgggcatagaaaga

SEQ ID NO: 57202 - DNA, 25 bp, E. coli
gcgcctcactggcatcggcatagaa

SEQ ID NO: 57203 - DNA, 25 bp, E. coli
gcatagaaagaatcgttttcccgca

SEQ ID NO: 57204 - DNA, 25 bp, E. coli
gcatcggcatagaaagaaacgtttt

SEQ ID NO: 57205 - DNA, 25 bp, E. coli
gcatagaaagaaacgttttcccgca

SEQ ID NO: 57206 - DNA, 25 bp, E. coli
gcatcggcatagtaagaaacgtttt

SEQ ID NO: 57207 - DNA, 25 bp, E. coli
gaaagccagcggcaagcgcctcact

SEQ ID NO: 57208 - DNA, 25 bp, E. coli
gaaagccagcgggaagcgcctcact

SEQ ID NO: 57209 - DNA, 25 bp, E. coli
gtgggtgattttttcaaggcgatgt

SEQ ID NO: 57210 - DNA, 25 bp, E. coli
gtgggtgattttatcaaggcgatgt

SEQ ID NO: 57211 - DNA, 25 bp, E. coli
tggcatcggcattgaaagaaacgtt

SEQ ID NO: 57212 - DNA, 25 bp, E. coli
tggcatcggcatagaaagaaacgtt

SEQ ID NO: 57213 - DNA, 25 bp, E. coli
caaacgatcctgtaaaggcgagcga

SEQ ID NO: 57214 - DNA, 25 bp, E. coli
caaacgatcctgaaaaggcgagcga

SEQ ID NO: 57215 - DNA, 25 bp, E. coli
actccaggagttacaggacagtctg

SEQ ID NO: 57216 - DNA, 25 bp, E. coli
actccaggagtttcaggacagtctg

SEQ ID NO: 57217 - DNA, 25 bp, E. coli
aaaggcgagcctcactaacctgacg

SEQ ID NO: 57218 - DNA, 25 bp, E. coli
aaaggcgagcctgactaacctgacg

SEQ ID NO: 57219 - DNA, 25 bp, E. coli
tggtaaaacctggtgcggacgctga

SEQ ID NO: 57220 - DNA, 25 bp, E. coli
tggtaaaacctgctgcggacgctga

SEQ ID NO: 57221 - DNA, 25 bp, E. coli
tgcagaacgaactgacccaggagtt

SEQ ID NO: 57222 - DNA, 25 bp, E. coli
tgcagaacgaacagacccaggagtt

SEQ ID NO: 57223 - DNA, 25 bp, E. coli
tctgaaaaaggttgaaaaggcgagc

SEQ ID NO: 57224 - DNA, 25 bp, E. coli
tctgaaaaaggtagaaaaggcgagc

SEQ ID NO: 57225 - DNA, 25 bp, E. coli
tccccttcgtcgagtgataaaccgt

SEQ ID NO: 57226 - DNA, 25 bp, E. coli
tccccttcgtcgtgtgataaaccgt

SEQ ID NO: 57227 - DNA, 25 bp, E. coli
cgcccgaactgatagcgtcgatgga

SEQ ID NO: 57228 - DNA, 25 bp, E. coli
cgatgaagcgttcctacgttgcaaa

SEQ ID NO: 57229 - DNA, 25 bp, E. coli
cgcccgaactgaaagcgtcgatgga

SEQ ID NO: 57230 - DNA, 25 bp, E. coli
cgatgaagcgttgctacgttgcaaa

SEQ ID NO: 57231 - DNA, 25 bp, E. coli
gattcgcgcgttgcgttcactggcg

SEQ ID NO: 57232 - DNA, 25 bp, E. coli
gattcgcgcgttccgttcactggcg

SEQ ID NO: 57233 - DNA, 25 bp, E. coli
tcactggcgacatcggtgcagaacg

SEQ ID NO: 57234 - DNA, 25 bp, E. coli
tcactggcgacaacggtgcagaacg

SEQ ID NO: 57235 - DNA, 25 bp, E. coli
aattattcccggtcactcccgcaga

SEQ ID NO: 57236 - DNA, 25 bp, E. coli
gaaatttcaactgattgtttagggt

SEQ ID NO: 57237 - DNA, 25 bp, E. coli
aattttctacacttacgattctgcg

SEQ ID NO: 57238 - DNA, 25 bp, E. coli
aattttctacacatacgattctgcg

SEQ ID NO: 57239 - DNA, 25 bp, E. coli
gaaatttcaactcattgtttagggt

SEQ ID NO: 57240 - DNA, 25 bp, E. coli
aattattcccggacactcccgcaga

SEQ ID NO: 57241 - DNA, 25 bp, E. coli
cacatacgattctgcgaacttcaaa

SEQ ID NO: 57242 - DNA, 25 bp, E. coli
cacatacgattcagcgaacttcaaa

SEQ ID NO: 57243 - DNA, 25 bp, E. coli
catgtacgcgctaaaccctgtgtgc

SEQ ID NO: 57244 - DNA, 25 bp, E. coli
catgtacgcgcttaaccctgtgtgc

SEQ ID NO: 57245 - DNA, 25 bp, E. coli
tcataacgtccggtttcttccgtgt

SEQ ID NO: 57246 - DNA, 25 bp, E. coli
tcataacgtccgctttcttccgtgt

SEQ ID NO: 57247 - DNA, 25 bp, E. coli
gaacttcaaaaaccatcgggaataa

SEQ ID NO: 57248 - DNA, 25 bp, E. coli
gaacttcaaaaagcatcgggaataa

SEQ ID NO: 57249 - DNA, 25 bp, E. coli
cggtttcttccgtgtcagcaccggg

SEQ ID NO: 57250 - DNA, 25 bp, E. coli
cggtttcttccgagtcagcaccggg

SEQ ID NO: 57251 - DNA, 25 bp, E. coli
gattcatcgcacctggcatacatta

SEQ ID NO: 57252 - DNA, 25 bp, E. coli
gattcatcgcacgtggcatacatta

SEQ ID NO: 57253 - DNA, 25 bp, E. coli
gtgcatcgtttttaattattcccgg

SEQ ID NO: 57254 - DNA, 25 bp, E. coli
gtgcatcgttttaaattattcccgg

SEQ ID NO: 57255 - DNA, 25 bp, E. coli
tggcataatacaatacatgtacgcg

SEQ ID NO: 57256 - DNA, 25 bp, E. coli
tggcataatacattacatgtacgcg

SEQ ID NO: 57257 - DNA, 25 bp, E. coli
caaaaactgttgttctcccgctggg

SEQ ID NO: 57258 - DNA, 25 bp, E. coli
caaaaactgttgatctcccgctggg

SEQ ID NO: 57259 - DNA, 25 bp, E. coli
aacattatgaccatagcgactggcg

SEQ ID NO: 57260 - DNA, 25 bp, E. coli
aacattatgaccttagcgactggcg

SEQ ID NO: 57261 - DNA, 25 bp, E. coli
taccggatcatgaacgagatggcgc

SEQ ID NO: 57262 - DNA, 25 bp, E. coli
taccggatcatgtacgagatggcgc

SEQ ID NO: 57263 - DNA, 25 bp, E. coli
tatgagctttccgatcgcgtcagcg

SEQ ID NO: 57264 - DNA, 25 bp, E. coli
tatgagctttcccatcgcgtcagcg

SEQ ID NO: 57265 - DNA, 25 bp, E. coli
tttgaactgattatgcggctgcgcg

SEQ ID NO: 57266 - DNA, 25 bp, E. coli
tattccttgaaaaggcagcagccga

SEQ ID NO: 57267 - DNA, 25 bp, E. coli
tattccttgaaatggcagcagccga

SEQ ID NO: 57268 - DNA, 25 bp, E. coli
tttatcaggagatgcagctggcacc

SEQ ID NO: 57269 - DNA, 25 bp, E. coli
tttatcaggagaagcagctggcacc

SEQ ID NO: 57270 - DNA, 25 bp, E. coli
tttgaactgattttgcggctgcgcg

SEQ ID NO: 57271 - DNA, 25 bp, E. coli
cgcattctggtgttggacgaaccca

SEQ ID NO: 57272 - DNA, 25 bp, E. coli
cgcattctggtgatggacgaaccca

SEQ ID NO: 57273 - DNA, 25 bp, E. coli
gttcaataaagagcgcgatatcccg

SEQ ID NO: 57274 - DNA, 25 bp, E. coli
gatttgacggtcaaccctggcgaga

SEQ ID NO: 57275 - DNA, 25 bp, E. coli
gttcaataaagaccgcgatatcccg

SEQ ID NO: 57276 - DNA, 25 bp, E. coli
gatttgacggtctaccctggcgaga

SEQ ID NO: 57277 - DNA, 25 bp, E. coli
tggcgccaaaagagagatctaccgg

SEQ ID NO: 57278 - DNA, 25 bp, E. coli
tggcgccaaaagtgagatctaccgg

SEQ ID NO: 57279 - DNA, 25 bp, E. coli
aaggtcagattttctatcgccgccg

SEQ ID NO: 57280 - DNA, 25 bp, E. coli
aaggtcagatttactatcgccgccg

SEQ ID NO: 57281 - DNA, 25 bp, E. coli
taaaggcgcgtctggaacaagcctg

SEQ ID NO: 57282 - DNA, 25 bp, E. coli
taaaggcgcgtcaggaacaagcctg

SEQ ID NO: 57283 - DNA, 25 bp, E. coli
tatatgctgcaatccggtatcctga

SEQ ID NO: 57284 - DNA, 25 bp, E. coli
tatatgctgcaaaccggtatcctga

SEQ ID NO: 57285 - DNA, 25 bp, E. coli
tgctgctaagcgttccggtgacgat

SEQ ID NO: 57286 - DNA, 25 bp, E. coli
tgctgctaagcgatccggtgacgat

SEQ ID NO: 57287 - DNA, 25 bp, E. coli
tctgtaacgaagtcgtgaaccgtgt

SEQ ID NO: 57288 - DNA, 25 bp, E. coli
tctgtaacgaagacgtgaaccgtgt

SEQ ID NO: 57289 - DNA, 25 bp, E. coli
tctgcgtcgcagagcaaaaagcctg

SEQ ID NO: 57290 - DNA, 25 bp, E. coli
tcagtaaaagccaccgggaatgcca

SEQ ID NO: 57291 - DNA, 25 bp, E. coli
tctgcgtcgcagtgcaaaaagcctg

SEQ ID NO: 57292 - DNA, 25 bp, E. coli
tcagtaaaagcctccgggaatgcca

SEQ ID NO: 57293 - DNA, 25 bp, E. coli
gctggatgctgagtcggtaatgacc

SEQ ID NO: 57294 - DNA, 25 bp, E. coli
gctggatgctgactcggtaatgacc

SEQ ID NO: 57295 - DNA, 25 bp, E. coli
cattctgttgatgctgacgctcgcg

SEQ ID NO: 57296 - DNA, 25 bp, E. coli
cattgccgaagagtgatatccgcgc

SEQ ID NO: 57297 - DNA, 25 bp, E. coli
cattctgttgatcctgacgctcgcg

SEQ ID NO: 57298 - DNA, 25 bp, E. coli
cattgccgaagactgatatccgcgc

SEQ ID NO: 57299 - DNA, 25 bp, E. coli
gagaagctgaatggcgatcgtcgcc

SEQ ID NO: 57300 - DNA, 25 bp, E. coli
gagaagctgaatcgcgatcgtcgcc

SEQ ID NO: 57301 - DNA, 25 bp, E. coli
aatgatgtgcaagtcctgctggcgc

SEQ ID NO: 57302 - DNA, 25 bp, E. coli
aatgatgtgcaactcctgctggcgc

SEQ ID NO: 57303 - DNA, 25 bp, E. coli
caaatggtcgagtctttacggcagc

SEQ ID NO: 57304 - DNA, 25 bp, E. coli
caaatggtcgagactttacggcagc

SEQ ID NO: 57305 - DNA, 25 bp, E. coli
tacggtctgctgcaaatgcggcatg

SEQ ID NO: 57306 - DNA, 25 bp, E. coli
tacggtctgctggaaatgcggcatg

SEQ ID NO: 57307 - DNA, 25 bp, E. coli
tggtatttaatcgtcagcacgctgg

SEQ ID NO: 57308 - DNA, 25 bp, E. coli
tgttatcccaaccaggtgctcacgg

SEQ ID NO: 57309 - DNA, 25 bp, E. coli
tgttatcccaacgaggtgctcacgg

SEQ ID NO: 57310 - DNA, 25 bp, E. coli
tgcgttactacaccgaagagccttg

SEQ ID NO: 57311 - DNA, 25 bp, E. coli
tgcgttactacagcgaagagccttg

SEQ ID NO: 57312 - DNA, 25 bp, E. coli
tctggcgagcaaaacggtagattcc

SEQ ID NO: 57313 - DNA, 25 bp, E. coli
tctggcgagcaatacggtagattcc

SEQ ID NO: 57314 - DNA, 25 bp, E. coli
gaattacatcggtgtgcaggcgcaa

SEQ ID NO: 57315 - DNA, 25 bp, E. coli
gaattacatcggagtgcaggcgcaa

SEQ ID NO: 57316 - DNA, 25 bp, E. coli
gatttggcaaaaggcacgcatggtg

SEQ ID NO: 57317 - DNA, 25 bp, E. coli
gatttggcaaaacgcacgcatggtg

SEQ ID NO: 57318 - DNA, 25 bp, E. coli
tggtaataccgcctacagcgccgaa

SEQ ID NO: 57319 - DNA, 25 bp, E. coli
tggtatttaatcctcagcacgctgg

SEQ ID NO: 57320 - DNA, 25 bp, E. coli
tggtaataccgcgtacagcgccgaa

SEQ ID NO: 57321 - DNA, 25 bp, E. coli
gagtttaatattgcgcgctcggcag

SEQ ID NO: 57322 - DNA, 25 bp, E. coli
gagtttaatattccgcgctcggcag

SEQ ID NO: 57323 - DNA, 25 bp, E. coli
aatgcttaccgaagagagccgcacg

SEQ ID NO: 57324 - DNA, 25 bp, E. coli
caaggcggacgtgtctatttcggtc

SEQ ID NO: 57325 - DNA, 25 bp, E. coli
aatgcttaccgatgagagccgcacg

SEQ ID NO: 57326 - DNA, 25 bp, E. coli
caaggcggacgtctctatttcggtc

SEQ ID NO: 57327 - DNA, 25 bp, E. coli
agcgatgcggatgccaatcacatgt

SEQ ID NO: 57328 - DNA, 25 bp, E. coli
agcgatgcggatcccaatcacatgt

SEQ ID NO: 57329 - DNA, 25 bp, E. coli
ttaccgaagagagccgcacggtact

SEQ ID NO: 57330 - DNA, 25 bp, E. coli
tttagcgatgcggatgccaatcaca

SEQ ID NO: 57331 - DNA, 25 bp, E. coli
tttagcgatgcgcatgccaatcaca

SEQ ID NO: 57332 - DNA, 25 bp, E. coli
ttaccgaagagacccgcacggtact

SEQ ID NO: 57333 - DNA, 25 bp, E. coli
tgcttaccgaagagagccgcacggt

SEQ ID NO: 57334 - DNA, 25 bp, E. coli
tgcttaccgaagtgagccgcacggt

SEQ ID NO: 57335 - DNA, 25 bp, E. coli
tgctgatgccgggagaaatgcttac

SEQ ID NO: 57336 - DNA, 25 bp, E. coli
tgctgatgccggcagaaatgcttac

SEQ ID NO: 57337 - DNA, 25 bp, E. coli
gcgggaataccctcaaggcggacgt

SEQ ID NO: 57338 - DNA, 25 bp, E. coli
gcgggaatacccacaaggcggacgt

SEQ ID NO: 57339 - DNA, 25 bp, E. coli
gaataccctcaacgcggacgtctct

SEQ ID NO: 57340 - DNA, 25 bp, E. coli
gaataccctcaaggcggacgtctct

SEQ ID NO: 57341 - DNA, 25 bp, E. coli
cgggagaaatgcttaccgaagagag

SEQ ID NO: 57342 - DNA, 25 bp, E. coli
cgggagaaatgcataccgaagagag

SEQ ID NO: 57343 - DNA, 25 bp, E. coli
gatgccgggagatatgcttaccgaa

SEQ ID NO: 57344 - DNA, 25 bp, E. coli
gatgccgggagaaatgcttaccgaa

SEQ ID NO: 57345 - DNA, 25 bp, E. coli
aagagcggcgggaattccgacgata

SEQ ID NO: 57346 - DNA, 25 bp, E. coli
aagagcggcgggtattccgacgata

SEQ ID NO: 57347 - DNA, 25 bp, E. coli
caacagactacattctgagttggga

SEQ ID NO: 57348 - DNA, 25 bp, E. coli
caacagactacaatctgagttggga

SEQ ID NO: 57349 - DNA, 25 bp, E. coli
tacagctaagtgatgaccagaaaag

SEQ ID NO: 57350 - DNA, 25 bp, E. coli
tacagctaagtgttgaccagaaaag

SEQ ID NO: 57351 - DNA, 25 bp, E. coli
aaaagtggcggctcagaaacgagca

SEQ ID NO: 57352 - DNA, 25 bp, E. coli
aacgagcagagtgtttgcgtaaggc

SEQ ID NO: 57353 - DNA, 25 bp, E. coli
aaaagtggcggcacagaaacgagca

SEQ ID NO: 57354 - DNA, 25 bp, E. coli
aacgagcagagtctttgcgtaaggc

SEQ ID NO: 57355 - DNA, 25 bp, E. coli
tgggcaaaagtgttggtacagctaa

SEQ ID NO: 57356 - DNA, 25 bp, E. coli
gaaaaaaggactctaccggagagca

SEQ ID NO: 57357 - DNA, 25 bp, E. coli
gaaataaaacaagcggtcaacagac

SEQ ID NO: 57358 - DNA, 25 bp, E. coli
gaaataaaacaaccggtcaacagac

SEQ ID NO: 57359 - DNA, 25 bp, E. coli
gaaaaaaggactgtaccggagagca

SEQ ID NO: 57360 - DNA, 25 bp, E. coli
gacaggagaacacaatacgtccgga

SEQ ID NO: 57361 - DNA, 25 bp, E. coli
gacaggagaacagaatacgtccgga

SEQ ID NO: 57362 - DNA, 25 bp, E. coli
cgacgatataaacggacaggagaac

SEQ ID NO: 57363 - DNA, 25 bp, E. coli
cgacgatataaagggacaggagaac

SEQ ID NO: 57364 - DNA, 25 bp, E. coli
tgggcaaaagtgatggtacagctaa

SEQ ID NO: 57365 - DNA, 25 bp, E. coli
gagagcagctgatcgatgggcaaaa

SEQ ID NO: 57366 - DNA, 25 bp, E. coli
gagagcagctgaacgatgggcaaaa

SEQ ID NO: 57367 - DNA, 25 bp, E. coli
cagtgatgaaaaaagctgtgtgctt

SEQ ID NO: 57368 - DNA, 25 bp, E. coli
cagtgatgaaaatagctgtgtgctt

SEQ ID NO: 57369 - DNA, 25 bp, E. coli
taaaacaccatttcagtgacattag

SEQ ID NO: 57370 - DNA, 25 bp, E. coli
taaaacaccattacagtgacattag

SEQ ID NO: 57371 - DNA, 25 bp, E. coli
aaagctgtgtgctttcagcaggatt

SEQ ID NO: 57372 - DNA, 25 bp, E. coli
aaagctgtgtgcattcagcaggatt

SEQ ID NO: 57373 - DNA, 25 bp, E. coli
aaaaagctgtgtcctttcagcagga

SEQ ID NO: 57374 - DNA, 25 bp, E. coli
aaaaagctgtgtgctttcagcagga

SEQ ID NO: 57375 - DNA, 25 bp, E. coli
ttaactataaaagaccatttcagtg

SEQ ID NO: 57376 - DNA, 25 bp, E. coli
ttaactataaaacaccatttcagtg

SEQ ID NO: 57377 - DNA, 25 bp, E. coli
tctactggaaagttgacagagtgat

SEQ ID NO: 57378 - DNA, 25 bp, E. coli
tctactggaaagatgacagagtgat

SEQ ID NO: 57379 - DNA, 25 bp, E. coli
ccatttcagtgacattagtttctac

SEQ ID NO: 57380 - DNA, 25 bp, E. coli
ccatttcagtgagattagtttctac

SEQ ID NO: 57381 - DNA, 25 bp, E. coli
gaaagatgacagtgtgatgacagtg

SEQ ID NO: 57382 - DNA, 25 bp, E. coli
gaaagatgacagagtgatgacagtg

SEQ ID NO: 57383 - DNA, 25 bp, E. coli
tagtttctactggaaagatgacaga

SEQ ID NO: 57384 - DNA, 25 bp, E. coli
tagtttctactgcaaagatgacaga

SEQ ID NO: 57385 - DNA, 25 bp, E. coli
gatgacagagtgatgacagtgatga

SEQ ID NO: 57386 - DNA, 25 bp, E. coli
gatgacagagtgttgacagtgatga

SEQ ID NO: 57387 - DNA, 25 bp, E. coli
gagtgatgacagagatgaaaaaagc

SEQ ID NO: 57388 - DNA, 25 bp, E. coli
gagtgatgacagtgatgaaaaaagc

SEQ ID NO: 57389 - DNA, 25 bp, E. coli
catgacgggcgaaatactcgaaacg

SEQ ID NO: 57390 - DNA, 25 bp, E. coli
catgacgggcgatatactcgaaacg

SEQ ID NO: 57391 - DNA, 25 bp, E. coli
aaacagaccagagccatgacgggcg

SEQ ID NO: 57392 - DNA, 25 bp, E. coli
aaacagaccagacccatgacgggcg

SEQ ID NO: 57393 - DNA, 25 bp, E. coli
tagggcgactgcgtgacaggataac

SEQ ID NO: 57394 - DNA, 25 bp, E. coli
tagggcgactgcctgacaggataac

SEQ ID NO: 57395 - DNA, 25 bp, E. coli
tgaacatagggccactgcgtgacag

SEQ ID NO: 57396 - DNA, 25 bp, E. coli
tgaacatagggcgactgcgtgacag

SEQ ID NO: 57397 - DNA, 25 bp, E. coli
gcgaaatactcgaaacgtgggagga

SEQ ID NO: 57398 - DNA, 25 bp, E. coli
gcgaaatactcgtaacgtgggagga

SEQ ID NO: 57399 - DNA, 25 bp, E. coli
ctcgaaacgtggcaggacggtcaca

SEQ ID NO: 57400 - DNA, 25 bp, E. coli
cgtgggaggacgctcacacactctg

SEQ ID NO: 57401 - DNA, 25 bp, E. coli
cgtgggaggacggtcacacactctg

SEQ ID NO: 57402 - DNA, 25 bp, E. coli
cgtgacaggatatcgattcagaccc

SEQ ID NO: 57403 - DNA, 25 bp, E. coli
ctcgaaacgtgggaggacggtcaca

SEQ ID NO: 57404 - DNA, 25 bp, E. coli
cgtgacaggataacgattcagaccc

SEQ ID NO: 57405 - DNA, 25 bp, E. coli
gattcagaccctgaaacagaccaga

SEQ ID NO: 57406 - DNA, 25 bp, E. coli
gattcagaccctcaaacagaccaga

SEQ ID NO: 57407 - DNA, 25 bp, E. coli
gaccctgaaacacaccagagccatg

SEQ ID NO: 57408 - DNA, 25 bp, E. coli
gaccagagccatcacgggcgaaata

SEQ ID NO: 57409 - DNA, 25 bp, E. coli
gaccctgaaacagaccagagccatg

SEQ ID NO: 57410 - DNA, 25 bp, E. coli
gaccagagccatgacgggcgaaata

SEQ ID NO: 57411 - DNA, 25 bp, E. coli
caatcatggtgcgagagttgcttat

SEQ ID NO: 57412 - DNA, 25 bp, E. coli
caatcatggtgccagagttgcttat

SEQ ID NO: 57413 - DNA, 25 bp, E. coli
tactgaaccgaaaagacggcgggca

SEQ ID NO: 57414 - DNA, 25 bp, E. coli
tactgaaccgaatagacggcgggca

SEQ ID NO: 57415 - DNA, 25 bp, E. coli
tgttgttgtctcatcagtacccgaa

SEQ ID NO: 57416 - DNA, 25 bp, E. coli
tgttgttgtctcttcagtacccgaa

SEQ ID NO: 57417 - DNA, 25 bp, E. coli
tgaacgcacttgtacgcctgatggg

SEQ ID NO: 57418 - DNA, 25 bp, E. coli
tgaacgcacttgaacgcctgatggg

SEQ ID NO: 57419 - DNA, 25 bp, E. coli
tccggcaggtgatgagccatttatc

SEQ ID NO: 57420 - DNA, 25 bp, E. coli
tcctgattatggatccgctcggaaa

SEQ ID NO: 57421 - DNA, 25 bp, E. coli
tccggcaggtgaagagccatttatc

SEQ ID NO: 57422 - DNA, 25 bp, E. coli
tcctgattatggttccgctcggaaa

SEQ ID NO: 57423 - DNA, 25 bp, E. coli
tctggtgattgctctgctgctggcc

SEQ ID NO: 57424 - DNA, 25 bp, E. coli
tctggtgattgcactgctgctggcc

SEQ ID NO: 57425 - DNA, 25 bp, E. coli
gctatttttacgactgctgggcgag

SEQ ID NO: 57426 - DNA, 25 bp, E. coli
gcttcaggaaattgcagcgggcttc

SEQ ID NO: 57427 - DNA, 25 bp, E. coli
gcttcaggaaatagcagcgggcttc

SEQ ID NO: 57428 - DNA, 25 bp, E. coli
gctatttttacgtctgctgggcgag

SEQ ID NO: 57429 - DNA, 25 bp, E. coli
gaaaccgtctccttttctggcggca

SEQ ID NO: 57430 - DNA, 25 bp, E. coli
gaaaccgtctccatttctggcggca

SEQ ID NO: 57431 - DNA, 25 bp, E. coli
gatgttcctcgagggcattcgaatg

SEQ ID NO: 57432 - DNA, 25 bp, E. coli
gatgttcctcgacggcattcgaatg

SEQ ID NO: 57433 - DNA, 25 bp, E. coli
cataatcacatactggatatgctgc

SEQ ID NO: 57434 - DNA, 25 bp, E. coli
cataatcacatagtggatatgctgc

SEQ ID NO: 57435 - DNA, 25 bp, E. coli
tacggtgctggaaacaagaaaacat

SEQ ID NO: 57436 - DNA, 25 bp, E. coli
tacggtgctggatacaagaaaacat

SEQ ID NO: 57437 - DNA, 25 bp, E. coli
aaacatcgcatgtgcttcgggcata

SEQ ID NO: 57438 - DNA, 25 bp, E. coli
aaacatcgcatgagcttcgggcata

SEQ ID NO: 57439 - DNA, 25 bp, E. coli
tatgcttatttctagtacggtgctg

SEQ ID NO: 57440 - DNA, 25 bp, E. coli
tatgcttatttcaagtacggtgctg

SEQ ID NO: 57441 - DNA, 25 bp, E. coli
tcggccccgtgtcacatatgcttat

SEQ ID NO: 57442 - DNA, 25 bp, E. coli
tcggccccgtgtgacatatgcttat

SEQ ID NO: 57443 - DNA, 25 bp, E. coli
tcagatatcatgatttcggccccgt

SEQ ID NO: 57444 - DNA, 25 bp, E. coli
tcgggcatataatacagcagtgcgg

SEQ ID NO: 57445 - DNA, 25 bp, E. coli
tcgggcatataaaacagcagtgcgg

SEQ ID NO: 57446 - DNA, 25 bp, E. coli
tcagatatcatgttttcggccccgt

SEQ ID NO: 57447 - DNA, 25 bp, E. coli
gctgacccgtatgtggtaataaaca

SEQ ID NO: 57448 - DNA, 25 bp, E. coli
gctgacccgtatctggtaataaaca

SEQ ID NO: 57449 - DNA, 25 bp, E. coli
gcactgtgtcaggaaaaacatcgca

SEQ ID NO: 57450 - DNA, 25 bp, E. coli
gcactgtgtcagcaaaaacatcgca

SEQ ID NO: 57451 - DNA, 25 bp, E. coli
gatatgctgcgtcttgctgacccgt

SEQ ID NO: 57452 - DNA, 25 bp, E. coli
gatatgctgcgtgttgctgacccgt

SEQ ID NO: 57453 - DNA, 25 bp, E. coli
ggaattttctttgtgagaagcactg

SEQ ID NO: 57454 - DNA, 25 bp, E. coli
ggaattttctttctgagaagcactg

SEQ ID NO: 57455 - DNA, 25 bp, E. coli
cacacaagatggtgtcgaagcggcc

SEQ ID NO: 57456 - DNA, 25 bp, E. coli
cacacaagatggagtcgaagcggcc

SEQ ID NO: 57457 - DNA, 25 bp, E. coli
tacaagagttagaggatagcgcgct

SEQ ID NO: 57458 - DNA, 25 bp, E. coli
tacaagagttagtggatagcgcgct

SEQ ID NO: 57459 - DNA, 25 bp, E. coli
ttgttacaggcagctaaaggcggac

SEQ ID NO: 57460 - DNA, 25 bp, E. coli
ttgttacaggcacctaaaggcggac

SEQ ID NO: 57461 - DNA, 25 bp, E. coli
ttagaagaactccaagactggctgc

SEQ ID NO: 57462 - DNA, 25 bp, E. coli
ttagaagaactcgaagactggctgc

SEQ ID NO: 57463 - DNA, 25 bp, E. coli
tgaataccagtatcccgatccgctg

SEQ ID NO: 57464 - DNA, 25 bp, E. coli
tgaataccagtaacccgatccgctg

SEQ ID NO: 57465 - DNA, 25 bp, E. coli
tcgatattctgcctcttgcgggcct

SEQ ID NO: 57466 - DNA, 25 bp, E. coli
tcgatattctgcgtcttgcgggcct

SEQ ID NO: 57467 - DNA, 25 bp, E. coli
gctggcaagtcagcgggagtaaaac

SEQ ID NO: 57468 - DNA, 25 bp, E. coli
gctggcaagtcaccgggagtaaaac

SEQ ID NO: 57469 - DNA, 25 bp, E. coli
gactggctgcactatttacccggta

SEQ ID NO: 57470 - DNA, 25 bp, E. coli
gactggctgcacaatttacccggta

SEQ ID NO: 57471 - DNA, 25 bp, E. coli
cggccccggcgaagagttctattta

SEQ ID NO: 57472 - DNA, 25 bp, E. coli
cggccccggcgatgagttctattta

SEQ ID NO: 57473 - DNA, 25 bp, E. coli
gattctgacgatctggatgccctga

SEQ ID NO: 57474 - DNA, 25 bp, E. coli
gattctgacgatgtggatgccctga

SEQ ID NO: 57475 - DNA, 25 bp, E. coli
taatgttttctatccgcagatggcc

SEQ ID NO: 57476 - DNA, 25 bp, E. coli
taatgttttctaaccgcagatggcc

SEQ ID NO: 57477 - DNA, 25 bp, E. coli
taccacgtcagtctgtgactcctgg

SEQ ID NO: 57478 - DNA, 25 bp, E. coli
taccacgtcagtgtgtgactcctgg

SEQ ID NO: 57479 - DNA, 25 bp, E. coli
tttacctgtaaaggcggagtcatgg

SEQ ID NO: 57480 - DNA, 25 bp, E. coli
tttacctgtaaacgcggagtcatgg

SEQ ID NO: 57481 - DNA, 25 bp, E. coli
tgtgtgactcctggcgattatgttc

SEQ ID NO: 57482 - DNA, 25 bp, E. coli
tgtgtgactcctcgcgattatgttc

SEQ ID NO: 57483 - DNA, 25 bp, E. coli
tgattgcacatctcttcggaactga

SEQ ID NO: 57484 - DNA, 25 bp, E. coli
tgattgcacatcacttcggaactga

SEQ ID NO: 57485 - DNA, 25 bp, E. coli
tcggaactgatgtaataccacgtca

SEQ ID NO: 57486 - DNA, 25 bp, E. coli
tcggaactgatgaaataccacgtca

SEQ ID NO: 57487 - DNA, 25 bp, E. coli
cctcggcaaacaatattaaaaagcg

SEQ ID NO: 57488 - DNA, 25 bp, E. coli
cctcggcaaacattattaaaaagcg

SEQ ID NO: 57489 - DNA, 25 bp, E. coli
gaaggccggacatatattgcctcgg

SEQ ID NO: 57490 - DNA, 25 bp, E. coli
gaaggccggacaaatattgcctcgg

SEQ ID NO: 57491 - DNA, 25 bp, E. coli
cctcggtcgtgatggtttacctgta

SEQ ID NO: 57492 - DNA, 25 bp, E. coli
cctcggtcgtgaaggtttacctgta

SEQ ID NO: 57493 - DNA, 25 bp, E. coli
cattactgaccggatgattaaagtc

SEQ ID NO: 57494 - DNA, 25 bp, E. coli
cattactgaccgcatgattaaagtc

SEQ ID NO: 57495 - DNA, 25 bp, E. coli
gattaaagtcttgctcggtcgtgat

SEQ ID NO: 57496 - DNA, 25 bp, E. coli
gattaaagtcttcctcggtcgtgat

SEQ ID NO: 57497 - DNA, 25 bp, E. coli
gattatgttcttgatgaaggccgga

SEQ ID NO: 57498 - DNA, 25 bp, E. coli
gattatgttcttcatgaaggccgga

SEQ ID NO: 57499 - DNA, 25 bp, E. coli
caccgctttgaacgtggactggaaa

SEQ ID NO: 57500 - DNA, 25 bp, E. coli
caccgctttgaaggtggactggaaa

SEQ ID NO: 57501 - DNA, 25 bp, E. coli
catacagcctgcctgatgacggcgg

SEQ ID NO: 57502 - DNA, 25 bp, E. coli
catacagcctgcgtgatgacggcgg

SEQ ID NO: 57503 - DNA, 25 bp, E. coli
aacaggagatgctggcagtcgcgac

SEQ ID NO: 57504 - DNA, 25 bp, E. coli
aacaggagatgcaggcagtcgcgac

SEQ ID NO: 57505 - DNA, 25 bp, E. coli
tataacgttattgcactcgatcggg

SEQ ID NO: 57506 - DNA, 25 bp, E. coli
tataacgttattccactcgatcggg

SEQ ID NO: 57507 - DNA, 25 bp, E. coli
tgagattgcccgatttgatcaccgc

SEQ ID NO: 57508 - DNA, 25 bp, E. coli
tgagattgcccgttttgatcaccgc

SEQ ID NO: 57509 - DNA, 25 bp, E. coli
tcgatcgggaattccgccatgcgct

SEQ ID NO: 57510 - DNA, 25 bp, E. coli
tcgcgctgcgctgaaagtgtcattc

SEQ ID NO: 57511 - DNA, 25 bp, E. coli
tcgatcgggaataccgccatgcgct

SEQ ID NO: 57512 - DNA, 25 bp, E. coli
tcgcgctgcgctcaaagtgtcattc

SEQ ID NO: 57513 - DNA, 25 bp, E. coli
gcacgccaaccatttctgacgaagt

SEQ ID NO: 57514 - DNA, 25 bp, E. coli
gcacgccaaccaattctgacgaagt

SEQ ID NO: 57515 - DNA, 25 bp, E. coli
gaaagcgtacttaaccggcgcacca

SEQ ID NO: 57516 - DNA, 25 bp, E. coli
gaaagcgtactttaccggcgcacca

SEQ ID NO: 57517 - DNA, 25 bp, E. coli
gacggcggcctgaatgtcattaata

SEQ ID NO: 57518 - DNA, 25 bp, E. coli
gaccgcgactacgtgtggatactct

SEQ ID NO: 57519 - DNA, 25 bp, E. coli
gaccgcgactacctgtggatactct

SEQ ID NO: 57520 - DNA, 25 bp, E. coli
gacggcggcctgtatgtcattaata

SEQ ID NO: 57521 - DNA, 25 bp, E. coli
caatcattcataccaagaggccggg

SEQ ID NO: 57522 - DNA, 25 bp, E. coli
caatcattcatagcaagaggccggg

SEQ ID NO: 57523 - DNA, 25 bp, E. coli
cagcgtcggttattttttgcttcaa

SEQ ID NO: 57524 - DNA, 25 bp, E. coli
cagcgtcggttaatttttgcttcaa

SEQ ID NO: 57525 - DNA, 25 bp, E. coli
taaaaaccgacgtttcatcagcgtc

SEQ ID NO: 57526 - DNA, 25 bp, E. coli
taaaaaccgacgattcatcagcgtc

SEQ ID NO: 57527 - DNA, 25 bp, E. coli
ttcataccaagacgccgggcttcgt

SEQ ID NO: 57528 - DNA, 25 bp, E. coli
ttcataccaagaggccgggcttcgt

SEQ ID NO: 57529 - DNA, 25 bp, E. coli
tttgcttacgcgacggttatcaccg

SEQ ID NO: 57530 - DNA, 25 bp, E. coli
tttgcttacgcgtcggttatcaccg

SEQ ID NO: 57531 - DNA, 25 bp, E. coli
tgttgtcgctgacgaatccaaaaaa

SEQ ID NO: 57532 - DNA, 25 bp, E. coli
tgttgtcgctgaggaatccaaaaaa

SEQ ID NO: 57533 - DNA, 25 bp, E. coli
gacagttgttgtcgctgaggaatcc

SEQ ID NO: 57534 - DNA, 25 bp, E. coli
ggcttcgtaccgcatagatatttac

SEQ ID NO: 57535 - DNA, 25 bp, E. coli
gacagttgttgtggctgaggaatcc

SEQ ID NO: 57536 - DNA, 25 bp, E. coli
ggcttcgtaccggatagatatttac

SEQ ID NO: 57537 - DNA, 25 bp, E. coli
gcgacggttatctccgtaaaggaga

SEQ ID NO: 57538 - DNA, 25 bp, E. coli
gcgacggttatcaccgtaaaggaga

SEQ ID NO: 57539 - DNA, 25 bp, E. coli
gatatttactaataatcgacagttg

SEQ ID NO: 57540 - DNA, 25 bp, E. coli
gatatttactaaaaatcgacagttg

SEQ ID NO: 57541 - DNA, 25 bp, E. coli
ggcaattttttggttacgcgacggt

SEQ ID NO: 57542 - DNA, 25 bp, E. coli
ggcaattttttgcttacgcgacggt

SEQ ID NO: 57543 - DNA, 25 bp, E. coli
acgcattagcacgaccattaccacc

SEQ ID NO: 57544 - DNA, 25 bp, E. coli
atgaaacgcattagcaccaccatta

SEQ ID NO: 57545 - DNA, 25 bp, E. coli
accattaccacaggtaacggtgcgg

SEQ ID NO: 57546 - DNA, 25 bp, E. coli
attaccacaggttacggtgcgggct

SEQ ID NO: 57547 - DNA, 25 bp, E. coli
accattaccacacgtaacggtgcgg

SEQ ID NO: 57548 - DNA, 25 bp, E. coli
attaccacaggtaacggtgcgggct

SEQ ID NO: 57549 - DNA, 25 bp, E. coli
atgaaacgcatttgcaccaccatta

SEQ ID NO: 57550 - DNA, 25 bp, E. coli
acgcattagcaccaccattaccacc

SEQ ID NO: 57551 - DNA, 25 bp, E. coli
aaacgcattagctccaccattacca

SEQ ID NO: 57552 - DNA, 25 bp, E. coli
aaacgcattagcaccaccattacca

SEQ ID NO: 57553 - DNA, 25 bp, E. coli
taccacaggtaagggtgcgggctga

SEQ ID NO: 57554 - DNA, 25 bp, E. coli
taccacaggtaacggtgcgggctga

SEQ ID NO: 57555 - DNA, 25 bp, E. coli
ttaccacaggtaacggtgcgggctg

SEQ ID NO: 57556 - DNA, 25 bp, E. coli
ttaccacaggtatcggtgcgggctg

SEQ ID NO: 57557 - DNA, 25 bp, E. coli
tgaaacgcattaccaccaccattac

SEQ ID NO: 57558 - DNA, 25 bp, E. coli
tgaaacgcattagcaccaccattac

SEQ ID NO: 57559 - DNA, 25 bp, E. coli
ccattaccacagctaacggtgcggg

SEQ ID NO: 57560 - DNA, 25 bp, E. coli
ccattaccacaggtaacggtgcggg

SEQ ID NO: 57561 - DNA, 25 bp, E. coli
gaaacgcattaggaccaccattacc

SEQ ID NO: 57562 - DNA, 25 bp, E. coli
gaaacgcattagcaccaccattacc

SEQ ID NO: 57563 - DNA, 25 bp, E. coli
cattaccacaggaaacggtgcgggc

SEQ ID NO: 57564 - DNA, 25 bp, E. coli
cattaccacaggtaacggtgcgggc

SEQ ID NO: 57565 - DNA, 25 bp, E. coli
caagttaacgcttcgtatgggcctc

SEQ ID NO: 57566 - DNA, 25 bp, E. coli
caagttaacgctacgtatgggcctc

SEQ ID NO: 57567 - DNA, 25 bp, E. coli
cacaggtgatgcagggctattggca

SEQ ID NO: 57568 - DNA, 25 bp, E. coli
cacaggtgatgctgggctattggca

SEQ ID NO: 57569 - DNA, 25 bp, E. coli
caggtcagccagctgaactttgcgt

SEQ ID NO: 57570 - DNA, 25 bp, E. coli
caggtcagccaggtgaactttgcgt

SEQ ID NO: 57571 - DNA, 25 bp, E. coli
ataatgaagtatcgccaggtcagcc

SEQ ID NO: 57572 - DNA, 25 bp, E. coli
atgggcctctgctgcatccgggcaa

SEQ ID NO: 57573 - DNA, 25 bp, E. coli
atgggcctctgcagcatccgggcaa

SEQ ID NO: 57574 - DNA, 25 bp, E. coli
ataatgaagtatggccaggtcagcc

SEQ ID NO: 57575 - DNA, 25 bp, E. coli
tatgggcgatcacctttccacagcg

SEQ ID NO: 57576 - DNA, 25 bp, E. coli
tatgtcaaacctcaactggtgccag

SEQ ID NO: 57577 - DNA, 25 bp, E. coli
tatgtcaaacctgaactggtgccag

SEQ ID NO: 57578 - DNA, 25 bp, E. coli
tatgggcgatcagctttccacagcg

SEQ ID NO: 57579 - DNA, 25 bp, E. coli
ttccacagcgaatggcacactggtt

SEQ ID NO: 57580 - DNA, 25 bp, E. coli
ttccacagcgaaaggcacactggtt

SEQ ID NO: 57581 - DNA, 25 bp, E. coli
tgtgtccaactttgctcacacgctg

SEQ ID NO: 57582 - DNA, 25 bp, E. coli
tgtgtccaacttagctcacacgctg

SEQ ID NO: 57583 - DNA, 25 bp, E. coli
gcatcggcgattgtcattgtgtcca

SEQ ID NO: 57584 - DNA, 25 bp, E. coli
gcatcggcgattctcattgtgtcca

SEQ ID NO: 57585 - DNA, 25 bp, E. coli
gaactttgcgtctgaggtccacagg

SEQ ID NO: 57586 - DNA, 25 bp, E. coli
gaactttgcgtcagaggtccacagg

SEQ ID NO: 57587 - DNA, 25 bp, E. coli
caaatttgatgtcgctgttggcgcg

SEQ ID NO: 57588 - DNA, 25 bp, E. coli
caaaagacctggtggtcagcctggc

SEQ ID NO: 57589 - DNA, 25 bp, E. coli
caaatttgatgtggctgttggcgcg

SEQ ID NO: 57590 - DNA, 25 bp, E. coli
caaaagacctggaggtcagcctggc

SEQ ID NO: 57591 - DNA, 25 bp, E. coli
catgaacacggtcgcgaaggctgct

SEQ ID NO: 57592 - DNA, 25 bp, E. coli
catgaacacggtggcgaaggctgct

SEQ ID NO: 57593 - DNA, 25 bp, E. coli
tacggtcagtacgacgaaaacctgg

SEQ ID NO: 57594 - DNA, 25 bp, E. coli
tacggtcagtaccacgaaaacctgg

SEQ ID NO: 57595 - DNA, 25 bp, E. coli
atgagtctccggagagtgcgccgct

SEQ ID NO: 57596 - DNA, 25 bp, E. coli
atgagtctccggtgagtgcgccgct

SEQ ID NO: 57597 - DNA, 25 bp, E. coli
tatcaggtacgttcagaagacggtg

SEQ ID NO: 57598 - DNA, 25 bp, E. coli
tatcaggtacgtacagaagacggtg

SEQ ID NO: 57599 - DNA, 25 bp, E. coli
tccggtaccggtagaaatcactgcg

SEQ ID NO: 57600 - DNA, 25 bp, E. coli
tccggtaccggttgaaatcactgcg

SEQ ID NO: 57601 - DNA, 25 bp, E. coli
gctggactacctccatggtcacggt

SEQ ID NO: 57602 - DNA, 25 bp, E. coli
gctggactacctgcatggtcacggt

SEQ ID NO: 57603 - DNA, 25 bp, E. coli
ggttccctgatcactggcctggaaa

SEQ ID NO: 57604 - DNA, 25 bp, E. coli
ggttccctgatctctggcctggaaa

SEQ ID NO: 57605 - DNA, 25 bp, E. coli
tggctgaaaccgtccagggtccggt

SEQ ID NO: 57606 - DNA, 25 bp, E. coli
tggctgaaaccgaccagggtccggt

SEQ ID NO: 57607 - DNA, 25 bp, E. coli
tcactgcggttgaagacgatcacgt

SEQ ID NO: 57608 - DNA, 25 bp, E. coli
tcactgcggttgtagacgatcacgt

SEQ ID NO: 57609 - DNA, 25 bp, E. coli
catcttgactttggtatctcattcg

SEQ ID NO: 57610 - DNA, 25 bp, E. coli
catcttgactttcgtatctcattcg

SEQ ID NO: 57611 - DNA, 25 bp, E. coli
actttggtatctcattcgccagcca

SEQ ID NO: 57612 - DNA, 25 bp, E. coli
actttggtatctgattcgccagcca

SEQ ID NO: 57613 - DNA, 25 bp, E. coli
tttggtatctcattcgccagccaac

SEQ ID NO: 57614 - DNA, 25 bp, E. coli
tttggtatctcaatcgccagccaac

SEQ ID NO: 57615 - DNA, 25 bp, E. coli
ttgactttggtaactcattcgccag

SEQ ID NO: 57616 - DNA, 25 bp, E. coli
ttgactttggtatctcattcgccag

SEQ ID NO: 57617 - DNA, 25 bp, E. coli
tctcattcgccagccaacgcccggt

SEQ ID NO: 57618 - DNA, 25 bp, E. coli
tcttgactttggaatctcattcgcc

SEQ ID NO: 57619 - DNA, 25 bp, E. coli
tcttgactttggtatctcattcgcc

SEQ ID NO: 57620 - DNA, 25 bp, E. coli
tctcattcgccacccaacgcccggt

SEQ ID NO: 57621 - DNA, 25 bp, E. coli
gcgctgcatcttcactttggtatct

SEQ ID NO: 57622 - DNA, 25 bp, E. coli
gcgctgcatcttgactttggtatct

SEQ ID NO: 57623 - DNA, 25 bp, E. coli
gctgcatcttgactttggtatctca

SEQ ID NO: 57624 - DNA, 25 bp, E. coli
gctgcatcttgagtttggtatctca

SEQ ID NO: 57625 - DNA, 25 bp, E. coli
gactttggtatctcattcgccagcc

SEQ ID NO: 57626 - DNA, 25 bp, E. coli
gactttggtatcacattcgccagcc

SEQ ID NO: 57627 - DNA, 25 bp, E. coli
tggtatctcattcgccagccaacgc

SEQ ID NO: 57628 - DNA, 25 bp, E. coli
tggtatctcattggccagccaacgc

SEQ ID NO: 57629 - DNA, 25 bp, E. coli
ggcgctgcatcttgactttggtatc

SEQ ID NO: 57630 - DNA, 25 bp, E. coli
ggcgctgcatctagactttggtatc

SEQ ID NO: 57631 - DNA, 25 bp, E. coli
aagtggaacaaggagcgcacgcact

SEQ ID NO: 57632 - DNA, 25 bp, E. coli
aagcagcgcacgcactgaaaggtag

SEQ ID NO: 57633 - DNA, 25 bp, E. coli
aagcctgtcgctttgcggcgttgag

SEQ ID NO: 57634 - DNA, 25 bp, E. coli
aagcctgtcgctatgcggcgttgag

SEQ ID NO: 57635 - DNA, 25 bp, E. coli
aagcagcgcacggactgaaaggtag

SEQ ID NO: 57636 - DNA, 25 bp, E. coli
aagtggaacaagcagcgcacgcact

SEQ ID NO: 57637 - DNA, 25 bp, E. coli
tactacgacgaacaaagcctgtcgc

SEQ ID NO: 57638 - DNA, 25 bp, E. coli
tactacgacgaagaaagcctgtcgc

SEQ ID NO: 57639 - DNA, 25 bp, E. coli
tttctgcaggtcgtggcggcttacc

SEQ ID NO: 57640 - DNA, 25 bp, E. coli
tttctgcaggtcctggcggcttacc

SEQ ID NO: 57641 - DNA, 25 bp, E. coli
ttgatgaagtggtacaagcagcgca

SEQ ID NO: 57642 - DNA, 25 bp, E. coli
ttgatgaagtggaacaagcagcgca

SEQ ID NO: 57643 - DNA, 25 bp, E. coli
tgaactactacgacgaagaaagcct

SEQ ID NO: 57644 - DNA, 25 bp, E. coli
tgaactactacgtcgaagaaagcct

SEQ ID NO: 57645 - DNA, 25 bp, E. coli
gaagaaagcctgacgctatgcggcg

SEQ ID NO: 57646 - DNA, 25 bp, E. coli
gaagaaagcctgtcgctatgcggcg

SEQ ID NO: 57647 - DNA, 25 bp, E. coli
cgcacgcactgaaaggtagcgaacg

SEQ ID NO: 57648 - DNA, 25 bp, E. coli
cgcacgcactgataggtagcgaacg

SEQ ID NO: 57649 - DNA, 25 bp, E. coli
cgttgaggatttactgcaggtcgtg

SEQ ID NO: 57650 - DNA, 25 bp, E. coli
cgttgaggattttctgcaggtcgtg

SEQ ID NO: 57651 - DNA, 25 bp, E. coli
cgtggcggcttaccgcaatttcgtg

SEQ ID NO: 57652 - DNA, 25 bp, E. coli
cgtggcggcttagcgcaatttcgtg

SEQ ID NO: 57653 - DNA, 25 bp, E. coli
aagcagcgggtgttgttgacgttct

SEQ ID NO: 57654 - DNA, 25 bp, E. coli
aagcagcgggtgatgttgacgttct

SEQ ID NO: 57655 - DNA, 25 bp, E. coli
caactgcgtaaaggtgacatcgtgc

SEQ ID NO: 57656 - DNA, 25 bp, E. coli
cacaaggcgtggaggaaaaagcgct

SEQ ID NO: 57657 - DNA, 25 bp, E. coli
caactgcgtaaacgtgacatcgtgc

SEQ ID NO: 57658 - DNA, 25 bp, E. coli
cacaaggcgtggtggaaaaagcgct

SEQ ID NO: 57659 - DNA, 25 bp, E. coli
caaactgcgcgaaccgaaatatggc

SEQ ID NO: 57660 - DNA, 25 bp, E. coli
caccagcgggcgagcagttgaagca

SEQ ID NO: 57661 - DNA, 25 bp, E. coli
caaactgcgcgatccgaaatatggc

SEQ ID NO: 57662 - DNA, 25 bp, E. coli
caccagcgggcgtgcagttgaagca

SEQ ID NO: 57663 - DNA, 25 bp, E. coli
aaaccgcttttggtcgcaaactgcg

SEQ ID NO: 57664 - DNA, 25 bp, E. coli
aaaccgcttttgctcgcaaactgcg

SEQ ID NO: 57665 - DNA, 25 bp, E. coli
tttatccccgcagaaggcgtggagg

SEQ ID NO: 57666 - DNA, 25 bp, E. coli
tttatccccgcacaaggcgtggagg

SEQ ID NO: 57667 - DNA, 25 bp, E. coli
tgacatcgtgctcgtagaagctggc

SEQ ID NO: 57668 - DNA, 25 bp, E. coli
tgacatcgtgctggtagaagctggc

SEQ ID NO: 57669 - DNA, 25 bp, E. coli
gtgcgcagcgacgtaaaacgccgaa

SEQ ID NO: 57670 - DNA, 25 bp, E. coli
gtgcgcagcgacctaaaacgccgaa

SEQ ID NO: 57671 - DNA, 25 bp, E. coli
tggaaggtgcgctgcgacgtaaaac

SEQ ID NO: 57672 - DNA, 25 bp, E. coli
tggaaggtgcgcagcgacgtaaaac

SEQ ID NO: 57673 - DNA, 25 bp, E. coli
ggcgtcagagttaatccccgcacaa

SEQ ID NO: 57674 - DNA, 25 bp, E. coli
ggcgtcagagtttatccccgcacaa

SEQ ID NO: 57675 - DNA, 25 bp, E. coli
aattatcggcgcactcggaatggca

SEQ ID NO: 57676 - DNA, 25 bp, E. coli
aattatcggcgctctcggaatggca

SEQ ID NO: 57677 - DNA, 25 bp, E. coli
caagcaagaacaggcggaaggtatc

SEQ ID NO: 57678 - DNA, 25 bp, E. coli
caagcaagaacacgcggaaggtatc

SEQ ID NO: 57679 - DNA, 25 bp, E. coli
caaaacttaagtgaatccgctgcca

SEQ ID NO: 57680 - DNA, 25 bp, E. coli
caaaacttaagtcaatccgctgcca

SEQ ID NO: 57681 - DNA, 25 bp, E. coli
tacgcgccggaactgttcaaaacgc

SEQ ID NO: 57682 - DNA, 25 bp, E. coli
tacgcgccggaagtgttcaaaacgc

SEQ ID NO: 57683 - DNA, 25 bp, E. coli
tattatttggcttcgacaccgccgt

SEQ ID NO: 57684 - DNA, 25 bp, E. coli
tataccgtgccagaaagtcctcgct

SEQ ID NO: 57685 - DNA, 25 bp, E. coli
tattatttggctacgacaccgccgt

SEQ ID NO: 57686 - DNA, 25 bp, E. coli
tataccgtgccacaaagtcctcgct

SEQ ID NO: 57687 - DNA, 25 bp, E. coli
tcatggccgcaaaaccggtggtcgt

SEQ ID NO: 57688 - DNA, 25 bp, E. coli
tcatggccgcaataccggtggtcgt

SEQ ID NO: 57689 - DNA, 25 bp, E. coli
gcgttttacactcaggcaccgggta

SEQ ID NO: 57690 - DNA, 25 bp, E. coli
gcgttttacactgaggcaccgggta

SEQ ID NO: 57691 - DNA, 25 bp, E. coli
gacaaaaactccaggctggtggccc

SEQ ID NO: 57692 - DNA, 25 bp, E. coli
gacaaaaactcctggctggtggccc

SEQ ID NO: 57693 - DNA, 25 bp, E. coli
tggctgaatactcacggctggcgtt

SEQ ID NO: 57694 - DNA, 25 bp, E. coli
tggctgaatactgacggctggcgtt

SEQ ID NO: 57695 - DNA, 25 bp, E. coli
tcaatgtggtgctgtactacgcgcc

SEQ ID NO: 57696 - DNA, 25 bp, E. coli
tcaatgtggtgcagtactacgcgcc

SEQ ID NO: 57697 - DNA, 25 bp, E. coli
cattccggtcgaaactaaactggcc

SEQ ID NO: 57698 - DNA, 25 bp, E. coli
catgggaagtaccacaggaacgcga

SEQ ID NO: 57699 - DNA, 25 bp, E. coli
catgggaagtacgacaggaacgcga

SEQ ID NO: 57700 - DNA, 25 bp, E. coli
cattccggtcgatactaaactggcc

SEQ ID NO: 57701 - DNA, 25 bp, E. coli
tacgtgtgccaaccataaatgtgac

SEQ ID NO: 57702 - DNA, 25 bp, E. coli
caaaacgttggtgtggtgcgataac

SEQ ID NO: 57703 - DNA, 25 bp, E. coli
caaaacgttggtctggtgcgataac

SEQ ID NO: 57704 - DNA, 25 bp, E. coli
tacgtgtgccaagcataaatgtgac

SEQ ID NO: 57705 - DNA, 25 bp, E. coli
tattgagtccgggactgtgaccaca

SEQ ID NO: 57706 - DNA, 25 bp, E. coli
tattgagtccggcactgtgaccaca

SEQ ID NO: 57707 - DNA, 25 bp, E. coli
ttgtcgatggcagccaaacccgggt

SEQ ID NO: 57708 - DNA, 25 bp, E. coli
ttgtcgatggcacccaaacccgggt

SEQ ID NO: 57709 - DNA, 25 bp, E. coli
tggtggcaatcaacgaactggcgga

SEQ ID NO: 57710 - DNA, 25 bp, E. coli
tggtggcaatcatcgaactggcgga

SEQ ID NO: 57711 - DNA, 25 bp, E. coli
tgctttgtatgaatccggacgccgg

SEQ ID NO: 57712 - DNA, 25 bp, E. coli
tgctttgtatgattccggacgccgg

SEQ ID NO: 57713 - DNA, 25 bp, E. coli
gattttaaccacgatccgcacagtg

SEQ ID NO: 57714 - DNA, 25 bp, E. coli
gattttaaccaccatccgcacagtg

SEQ ID NO: 57715 - DNA, 25 bp, E. coli
tggcgcacacctgatcaaaacgttg

SEQ ID NO: 57716 - DNA, 25 bp, E. coli
tggcgcacacctcatcaaaacgttg

SEQ ID NO: 57717 - DNA, 25 bp, E. coli
tcaatcaggatcaacttcgtgcgga

SEQ ID NO: 57718 - DNA, 25 bp, E. coli
tcaatcaggatctacttcgtgcgga

SEQ ID NO: 57719 - DNA, 25 bp, E. coli
caagatttccatgccttatccgttc

SEQ ID NO: 57720 - DNA, 25 bp, E. coli
caagatttccatcccttatccgttc

SEQ ID NO: 57721 - DNA, 25 bp, E. coli
caaccgcttgaaaaaatgtaccaga

SEQ ID NO: 57722 - DNA, 25 bp, E. coli
caaccgcttgaataaatgtaccaga

SEQ ID NO: 57723 - DNA, 25 bp, E. coli
tatccgttcatacgcattcacatga

SEQ ID NO: 57724 - DNA, 25 bp, E. coli
tatccgttcataggcattcacatga

SEQ ID NO: 57725 - DNA, 25 bp, E. coli
tgttttctcataatggcggcagccc

SEQ ID NO: 57726 - DNA, 25 bp, E. coli
tggtcattcaaaatgtatgtagaca

SEQ ID NO: 57727 - DNA, 25 bp, E. coli
tgttttctcatattggcggcagccc

SEQ ID NO: 57728 - DNA, 25 bp, E. coli
tgaaaaaatgtaccagacgcgctaa

SEQ ID NO: 57729 - DNA, 25 bp, E. coli
tgctcacacacaagttcaagatttc

SEQ ID NO: 57730 - DNA, 25 bp, E. coli
tgaaaaaatgtagcagacgcgctaa

SEQ ID NO: 57731 - DNA, 25 bp, E. coli
tgctcacacacatgttcaagatttc

SEQ ID NO: 57732 - DNA, 25 bp, E. coli
gcggcagccctagaaccgcttgaaa

SEQ ID NO: 57733 - DNA, 25 bp, E. coli
gcggcagccctacaaccgcttgaaa

SEQ ID NO: 57734 - DNA, 25 bp, E. coli
gcattcacatgaacttctcgatcga

SEQ ID NO: 57735 - DNA, 25 bp, E. coli
gcattcacatgatcttctcgatcga

SEQ ID NO: 57736 - DNA, 25 bp, E. coli
gaacttctcgatcgaattggtcatt

SEQ ID NO: 57737 - DNA, 25 bp, E. coli
gaacttctcgatggaattggtcatt

SEQ ID NO: 57738 - DNA, 25 bp, E. coli
gtatgtagacatgtgtgttttctca

SEQ ID NO: 57739 - DNA, 25 bp, E. coli
gtatgtagacatctgtgttttctca

SEQ ID NO: 57740 - DNA, 25 bp, E. coli
tggtcattcaaattgtatgtagaca

SEQ ID NO: 57741 - DNA, 25 bp, E. coli
cacaactggctgagtctgacgctgc

SEQ ID NO: 57742 - DNA, 25 bp, E. coli
cacaactggctgtgtctgacgctgc

SEQ ID NO: 57743 - DNA, 25 bp, E. coli
caggctgaataacgagcaacggtca

SEQ ID NO: 57744 - DNA, 25 bp, E. coli
caggctgaataaggagcaacggtca

SEQ ID NO: 57745 - DNA, 25 bp, E. coli
atagatcaatggctcgcgcccgtcg

SEQ ID NO: 57746 - DNA, 25 bp, E. coli
atagatcaatgggtcgcgcccgtcg

SEQ ID NO: 57747 - DNA, 25 bp, E. coli
taccgtaatggtctgccctatcatg

SEQ ID NO: 57748 - DNA, 25 bp, E. coli
taccgtaatggtgtgccctatcatg

SEQ ID NO: 57749 - DNA, 25 bp, E. coli
tttaaggaaaaagtacagcagcgcc

SEQ ID NO: 57750 - DNA, 25 bp, E. coli
tttacgggaactcggccaatactgc

SEQ ID NO: 57751 - DNA, 25 bp, E. coli
tttacgggaactgggccaatactgc

SEQ ID NO: 57752 - DNA, 25 bp, E. coli
tttaaggaaaaactacagcagcgcc

SEQ ID NO: 57753 - DNA, 25 bp, E. coli
tgaagtcatcaaccgaacagaaagt

SEQ ID NO: 57754 - DNA, 25 bp, E. coli
tgaagtcatcaagcgaacagaaagt

SEQ ID NO: 57755 - DNA, 25 bp, E. coli
ccaatactgcgtttccgccggttta

SEQ ID NO: 57756 - DNA, 25 bp, E. coli
ccaatactgcgtatccgccggttta

SEQ ID NO: 57757 - DNA, 25 bp, E. coli
tggcggcacaatgcaaactaccgta

SEQ ID NO: 57758 - DNA, 25 bp, E. coli
tggcggcacaatccaaactaccgta

SEQ ID NO: 57759 - DNA, 25 bp, E. coli
gagacgcagcgcgtgagcgtattca

SEQ ID NO: 57760 - DNA, 25 bp, E. coli
gagacgcagcgcctgagcgtattca

SEQ ID NO: 57761 - DNA, 25 bp, E. coli
gagcagcgccaggtgtttaaggaaa

SEQ ID NO: 57762 - DNA, 25 bp, E. coli
gagcagcgccagctgtttaaggaaa

SEQ ID NO: 57763 - DNA, 25 bp, E. coli
caagggatttctgtggcttgcaaat

SEQ ID NO: 57764 - DNA, 25 bp, E. coli
caagggatttctctggcttgcaaat

SEQ ID NO: 57765 - DNA, 25 bp, E. coli
tttacccgataggaagggatttctc

SEQ ID NO: 57766 - DNA, 25 bp, E. coli
tttacccgatagcaagggatttctc

SEQ ID NO: 57767 - DNA, 25 bp, E. coli
taatcctatcgaaaggtttacccga

SEQ ID NO: 57768 - DNA, 25 bp, E. coli
taatcctatcgataggtttacccga

SEQ ID NO: 57769 - DNA, 25 bp, E. coli
taggtttacccgttagcaagggatt

SEQ ID NO: 57770 - DNA, 25 bp, E. coli
taggtttacccgatagcaagggatt

SEQ ID NO: 57771 - DNA, 25 bp, E. coli
tacccgatagcaagggatttctctg

SEQ ID NO: 57772 - DNA, 25 bp, E. coli
tacccgatagcatgggatttctctg

SEQ ID NO: 57773 - DNA, 25 bp, E. coli
tcgataggtttagccgatagcaagg

SEQ ID NO: 57774 - DNA, 25 bp, E. coli
tcgataggtttacccgatagcaagg

SEQ ID NO: 57775 - DNA, 25 bp, E. coli
tctctggcttgctaatgataaaaat

SEQ ID NO: 57776 - DNA, 25 bp, E. coli
tctctggcttgcaaatgataaaaat

SEQ ID NO: 57777 - DNA, 25 bp, E. coli
ccgatagcaaggcatttctctggct

SEQ ID NO: 57778 - DNA, 25 bp, E. coli
ccgatagcaagggatttctctggct

SEQ ID NO: 57779 - DNA, 25 bp, E. coli
gatagcaagggatttctctggcttg

SEQ ID NO: 57780 - DNA, 25 bp, E. coli
gatagcaagggaattctctggcttg

SEQ ID NO: 57781 - DNA, 25 bp, E. coli
ggatttctctgggttgcaaatgata

SEQ ID NO: 57782 - DNA, 25 bp, E. coli
ggatttctctggcttgcaaatgata

SEQ ID NO: 57783 - DNA, 25 bp, E. coli
tggcttgcaaatgataaaaattatc

SEQ ID NO: 57784 - DNA, 25 bp, E. coli
tggcttgcaaatcataaaaattatc

SEQ ID NO: 57785 - DNA, 25 bp, E. coli
aatgcgaccgtgatgatccccggcc

SEQ ID NO: 57786 - DNA, 25 bp, E. coli
aatgcgaccgtgttgatccccggcc

SEQ ID NO: 57787 - DNA, 25 bp, E. coli
catgatcgtaaaagagatgtacgac

SEQ ID NO: 57788 - DNA, 25 bp, E. coli
catcgcgaaagaaaccgcatcggta

SEQ ID NO: 57789 - DNA, 25 bp, E. coli
catcgcgaaagataccgcatcggta

SEQ ID NO: 57790 - DNA, 25 bp, E. coli
cagagtatcagatgatcatgacggt

SEQ ID NO: 57791 - DNA, 25 bp, E. coli
catgatcgtaaatgagatgtacgac

SEQ ID NO: 57792 - DNA, 25 bp, E. coli
cagagtatcagaagatcatgacggt

SEQ ID NO: 57793 - DNA, 25 bp, E. coli
taaagtgagcatggcgaaagatacc

SEQ ID NO: 57794 - DNA, 25 bp, E. coli
taaagtgagcatcgcgaaagatacc

SEQ ID NO: 57795 - DNA, 25 bp, E. coli
ccatccttgcgtttgggtaaagtga

SEQ ID NO: 57796 - DNA, 25 bp, E. coli
ccatccttgcgtatgggtaaagtga

SEQ ID NO: 57797 - DNA, 25 bp, E. coli
gcgaaagataacgaacaagacatga

SEQ ID NO: 57798 - DNA, 25 bp, E. coli
gcgaaagataaccaacaagacatga

SEQ ID NO: 57799 - DNA, 25 bp, E. coli
gaacaagacatgatcgtaaaagaga

SEQ ID NO: 57800 - DNA, 25 bp, E. coli
gaacaagacatgttcgtaaaagaga

SEQ ID NO: 57801 - DNA, 25 bp, E. coli
cgcatcggtattccgtaacggtcaa

SEQ ID NO: 57802 - DNA, 25 bp, E. coli
cgcatcggtattgcgtaacggtcaa

SEQ ID NO: 57803 - DNA, 25 bp, E. coli
taacggtcaaacagcagagtatcag

SEQ ID NO: 57804 - DNA, 25 bp, E. coli
taacggtcaaactgcagagtatcag

SEQ ID NO: 57805 - DNA, 25 bp, E. coli
gaccgtgttgatccccggccgtgat

SEQ ID NO: 57806 - DNA, 25 bp, E. coli
gaccgtgttgatgcccggccgtgat

SEQ ID NO: 57807 - DNA, 25 bp, E. coli
taaacctctatgttaggtaacctga

SEQ ID NO: 57808 - DNA, 25 bp, E. coli
taaaatgttctaaaacgctggacag

SEQ ID NO: 57809 - DNA, 25 bp, E. coli
taaacctctatgataggtaacctga

SEQ ID NO: 57810 - DNA, 25 bp, E. coli
taaaatgttctataacgctggacag

SEQ ID NO: 57811 - DNA, 25 bp, E. coli
aacagccaccatggtggcagcgtcg

SEQ ID NO: 57812 - DNA, 25 bp, E. coli
aacagccaccatcgtggcagcgtcg

SEQ ID NO: 57813 - DNA, 25 bp, E. coli
aagcagagttcctcatttaacgtca

SEQ ID NO: 57814 - DNA, 25 bp, E. coli
aagcagagttccacatttaacgtca

SEQ ID NO: 57815 - DNA, 25 bp, E. coli
tattttcaaaacagccaccatcgtg

SEQ ID NO: 57816 - DNA, 25 bp, E. coli
tattttcaaaactgccaccatcgtg

SEQ ID NO: 57817 - DNA, 25 bp, E. coli
tcgctcggacggaccgggcgctaac

SEQ ID NO: 57818 - DNA, 25 bp, E. coli
tcgctcggacggtccgggcgctaac

SEQ ID NO: 57819 - DNA, 25 bp, E. coli
tcttgttagcgcagataaatttcct

SEQ ID NO: 57820 - DNA, 25 bp, E. coli
tcttgttagcgctgataaatttcct

SEQ ID NO: 57821 - DNA, 25 bp, E. coli
gactctgaataaggattaaacctct

SEQ ID NO: 57822 - DNA, 25 bp, E. coli
gactctgaataacgattaaacctct

SEQ ID NO: 57823 - DNA, 25 bp, E. coli
gtaacctgaaggctgatgaccagca

SEQ ID NO: 57824 - DNA, 25 bp, E. coli
gtaacctgaagggtgatgaccagca

SEQ ID NO: 57825 - DNA, 25 bp, E. coli
tggacagacagaaattaatcaggct

SEQ ID NO: 57826 - DNA, 25 bp, E. coli
tggacagacagatattaatcaggct

SEQ ID NO: 57827 - DNA, 25 bp, E. coli
gagtggtaatttacttgttagcgca

SEQ ID NO: 57828 - DNA, 25 bp, E. coli
gagtggtaattttcttgttagcgca

SEQ ID NO: 57829 - DNA, 25 bp, E. coli
aaaactgccaatctgaccaccggaa

SEQ ID NO: 57830 - DNA, 25 bp, E. coli
aaaactgccaatgtgaccaccggaa

SEQ ID NO: 57831 - DNA, 25 bp, E. coli
tatacgccgcagattgaaaacctta

SEQ ID NO: 57832 - DNA, 25 bp, E. coli
tatacgccgcagtttgaaaacctta

SEQ ID NO: 57833 - DNA, 25 bp, E. coli
tgagcgttttatccgcacgaaagag

SEQ ID NO: 57834 - DNA, 25 bp, E. coli
tgagcgttttatgcgcacgaaagag

SEQ ID NO: 57835 - DNA, 25 bp, E. coli
gcaccctgggcgatattcagcgaga

SEQ ID NO: 57836 - DNA, 25 bp, E. coli
gcaccctgggcgttattcagcgaga

SEQ ID NO: 57837 - DNA, 25 bp, E. coli
ccgtgaagaggtgagccgcgatatc

SEQ ID NO: 57838 - DNA, 25 bp, E. coli
gaatccatcatggagcgtcagtcgt

SEQ ID NO: 57839 - DNA, 25 bp, E. coli
gaatccatcatgcagcgtcagtcgt

SEQ ID NO: 57840 - DNA, 25 bp, E. coli
gactggtgcaaaaccaaccgtgatg

SEQ ID NO: 57841 - DNA, 25 bp, E. coli
gactggtgcaaatccaaccgtgatg

SEQ ID NO: 57842 - DNA, 25 bp, E. coli
ccgtgaagaggtcagccgcgatatc

SEQ ID NO: 57843 - DNA, 25 bp, E. coli
ccttttgaacaggacgccggactga

SEQ ID NO: 57844 - DNA, 25 bp, E. coli
ccttttgaacagcacgccggactga

SEQ ID NO: 57845 - DNA, 25 bp, E. coli
gattgaaatgctccgccgtatgggc

SEQ ID NO: 57846 - DNA, 25 bp, E. coli
gttacaaaattataggccgcagcag

SEQ ID NO: 57847 - DNA, 25 bp, E. coli
gattgaaatgctgcgccgtatgggc

SEQ ID NO: 57848 - DNA, 25 bp, E. coli
gttacaaaattaaaggccgcagcag

SEQ ID NO: 57849 - DNA, 25 bp, E. coli
gatgaagtggcagaaatcaccgccc

SEQ ID NO: 57850 - DNA, 25 bp, E. coli
gatgaagtggcacaaatcaccgccc

SEQ ID NO: 57851 - DNA, 25 bp, E. coli
caggcgaaacccagcgtcaggattt

SEQ ID NO: 57852 - DNA, 25 bp, E. coli
caggcgaaaccctgcgtcaggattt

SEQ ID NO: 57853 - DNA, 25 bp, E. coli
taaatagtcagctagagtatcgcgc

SEQ ID NO: 57854 - DNA, 25 bp, E. coli
taaatagtcagcaagagtatcgcgc

SEQ ID NO: 57855 - DNA, 25 bp, E. coli
attccattaaccgtgattgccgccg

SEQ ID NO: 57856 - DNA, 25 bp, E. coli
attccattaaccctgattgccgccg

SEQ ID NO: 57857 - DNA, 25 bp, E. coli
tatcgcgcctgtgaaacgcaactgc

SEQ ID NO: 57858 - DNA, 25 bp, E. coli
tatcgcgcctgtcaaacgcaactgc

SEQ ID NO: 57859 - DNA, 25 bp, E. coli
tggtgctggcaataaatcttctcgg

SEQ ID NO: 57860 - DNA, 25 bp, E. coli
tggtgctggcaaaaaatcttctcgg

SEQ ID NO: 57861 - DNA, 25 bp, E. coli
gccgcccgccaagtggtgaaaaata

SEQ ID NO: 57862 - DNA, 25 bp, E. coli
gccgcccgccaactggtgaaaaata

SEQ ID NO: 57863 - DNA, 25 bp, E. coli
gctggtgaaaatcaaaacgccggaa

SEQ ID NO: 57864 - DNA, 25 bp, E. coli
gctggtgaaaatgaaaacgccggaa

SEQ ID NO: 57865 - DNA, 25 bp, E. coli
gaattaccgctggatctggcaggcg

SEQ ID NO: 57866 - DNA, 25 bp, E. coli
gaattaccgctgcatctggcaggcg

SEQ ID NO: 57867 - DNA, 25 bp, E. coli
gaaaaatattcgcaaacaggacgcc

SEQ ID NO: 57868 - DNA, 25 bp, E. coli
gaaaaatattcggaaacaggacgcc

SEQ ID NO: 57869 - DNA, 25 bp, E. coli
tggatgagtacatcaaacctgacct

SEQ ID NO: 57870 - DNA, 25 bp, E. coli
tggatgagtacaacaaacctgacct

SEQ ID NO: 57871 - DNA, 25 bp, E. coli
tcaacttagcgcgatggtgctggca

SEQ ID NO: 57872 - DNA, 25 bp, E. coli
tcaacttagcgccatggtgctggca

SEQ ID NO: 57873 - DNA, 25 bp, E. coli
cacttcttcgtacgtgcagctgcag

SEQ ID NO: 57874 - DNA, 25 bp, E. coli
cacttcttcgtaggtgcagctgcag

SEQ ID NO: 57875 - DNA, 25 bp, E. coli
catccgtacatgaagaaagtgaccg

SEQ ID NO: 57876 - DNA, 25 bp, E. coli
cataattttcctggtgacgtgcctg

SEQ ID NO: 57877 - DNA, 25 bp, E. coli
cataattttcctcgtgacgtgcctg

SEQ ID NO: 57878 - DNA, 25 bp, E. coli
catccgtacatgtagaaagtgaccg

SEQ ID NO: 57879 - DNA, 25 bp, E. coli
taaagagcactccactgaagacatg

SEQ ID NO: 57880 - DNA, 25 bp, E. coli
taaagagcactcgactgaagacatg

SEQ ID NO: 57881 - DNA, 25 bp, E. coli
tatgattgcccgtttcacaccgtgg

SEQ ID NO: 57882 - DNA, 25 bp, E. coli
tatgattgcccgattcacaccgtgg

SEQ ID NO: 57883 - DNA, 25 bp, E. coli
tgtcgtgccgaagaatgaagccatt

SEQ ID NO: 57884 - DNA, 25 bp, E. coli
tgtcgtgccgaacaatgaagccatt

SEQ ID NO: 57885 - DNA, 25 bp, E. coli
gaagccattgttaccgtagcgcaga

SEQ ID NO: 57886 - DNA, 25 bp, E. coli
gaagccattgtttccgtagcgcaga

SEQ ID NO: 57887 - DNA, 25 bp, E. coli
gaaaagtctgctgttcttgcgcgac

SEQ ID NO: 57888 - DNA, 25 bp, E. coli
gaaaagtctgctcttcttgcgcgac

SEQ ID NO: 57889 - DNA, 25 bp, E. coli
gattattcctggagtggtgccgcac

SEQ ID NO: 57890 - DNA, 25 bp, E. coli
gattattcctggtgtggtgccgcac

SEQ ID NO: 57891 - DNA, 25 bp, E. coli
taattctggcaacagcaggcatgac

SEQ ID NO: 57892 - DNA, 25 bp, E. coli
taattctggcaagagcaggcatgac

SEQ ID NO: 57893 - DNA, 25 bp, E. coli
gatgagcgatgtactttccgaaccc

SEQ ID NO: 57894 - DNA, 25 bp, E. coli
gatgagcgatgttctttccgaaccc

SEQ ID NO: 57895 - DNA, 25 bp, E. coli
aaaattctgaatcgctctggcatcc

SEQ ID NO: 57896 - DNA, 25 bp, E. coli
aaaattctgaatggctctggcatcc

SEQ ID NO: 57897 - DNA, 25 bp, E. coli
tggtaccgggaagaaccacttagcg

SEQ ID NO: 57898 - DNA, 25 bp, E. coli
tggtaccgggaacaaccacttagcg

SEQ ID NO: 57899 - DNA, 25 bp, E. coli
tgcgacaggcgaagttcttgaacgt

SEQ ID NO: 57900 - DNA, 25 bp, E. coli
tgcgacaggcgatgttcttgaacgt

SEQ ID NO: 57901 - DNA, 25 bp, E. coli
gaaatccatcgcagatgaactgatg

SEQ ID NO: 57902 - DNA, 25 bp, E. coli
gagctggcgtcccaatgtcgtccag

SEQ ID NO: 57903 - DNA, 25 bp, E. coli
gagctggcgtccgaatgtcgtccag

SEQ ID NO: 57904 - DNA, 25 bp, E. coli
gaaatccatcgctgatgaactgatg

SEQ ID NO: 57905 - DNA, 25 bp, E. coli
cgatgttcttgaacgtatccgcaga

SEQ ID NO: 57906 - DNA, 25 bp, E. coli
cgatgttcttgatcgtatccgcaga

SEQ ID NO: 57907 - DNA, 25 bp, E. coli
cttagcggcagctatcgggaatcgc

SEQ ID NO: 57908 - DNA, 25 bp, E. coli
cttagcggcagcaatcgggaatcgc

SEQ ID NO: 57909 - DNA, 25 bp, E. coli
ggtgtacaaattttgcgttcagcgg

SEQ ID NO: 57910 - DNA, 25 bp, E. coli
ggtgtacaaattatgcgttcagcgg

SEQ ID NO: 57911 - DNA, 25 bp, E. coli
gggaagaaccacatagcggcagcta

SEQ ID NO: 57912 - DNA, 25 bp, E. coli
gggaagaaccacttagcggcagcta

SEQ ID NO: 57913 - DNA, 25 bp, E. coli
tggcatccagccattgcaccgcaaa

SEQ ID NO: 57914 - DNA, 25 bp, E. coli
tggcatccagcctttgcaccgcaaa

SEQ ID NO: 57915 - DNA, 25 bp, E. coli
gatgaccgggtgtacaaattttgcg

SEQ ID NO: 57916 - DNA, 25 bp, E. coli
gatgaccgggtgaacaaattttgcg

SEQ ID NO: 57917 - DNA, 25 bp, E. coli
accgaatcgggccagataccatcaa

SEQ ID NO: 57918 - DNA, 25 bp, E. coli
accgaatcgggcgagataccatcaa

SEQ ID NO: 57919 - DNA, 25 bp, E. coli
acagcgttatcagcacaaatggaaa

SEQ ID NO: 57920 - DNA, 25 bp, E. coli
acagcgttatcaccacaaatggaaa

SEQ ID NO: 57921 - DNA, 25 bp, E. coli
aaatggaaaagcaggtatcagttga

SEQ ID NO: 57922 - DNA, 25 bp, E. coli
aaatggaaaagctggtatcagttga

SEQ ID NO: 57923 - DNA, 25 bp, E. coli
taccatcaattagagcgttatcagc

SEQ ID NO: 57924 - DNA, 25 bp, E. coli
taccatcaattacagcgttatcagc

SEQ ID NO: 57925 - DNA, 25 bp, E. coli
tatcagcacaaatggaaaagctggt

SEQ ID NO: 57926 - DNA, 25 bp, E. coli
tatcagcacaaaaggaaaagctggt

SEQ ID NO: 57927 - DNA, 25 bp, E. coli
tcgggcgagataccatcaattacag

SEQ ID NO: 57928 - DNA, 25 bp, E. coli
tcgggcgagatagcatcaattacag

SEQ ID NO: 57929 - DNA, 25 bp, E. coli
gcgttatcagcagaaatggaaaagc

SEQ ID NO: 57930 - DNA, 25 bp, E. coli
gcgttatcagcacaaatggaaaagc

SEQ ID NO: 57931 - DNA, 25 bp, E. coli
gaatcgggcgagttaccatcaatta

SEQ ID NO: 57932 - DNA, 25 bp, E. coli
gcacaaatggaaaagctggtatcag

SEQ ID NO: 57933 - DNA, 25 bp, E. coli
gaatcgggcgagataccatcaatta

SEQ ID NO: 57934 - DNA, 25 bp, E. coli
gcacaaatggaatagctggtatcag

SEQ ID NO: 57935 - DNA, 25 bp, E. coli
cgagataccatcaattacagcgtta

SEQ ID NO: 57936 - DNA, 25 bp, E. coli
cgagataccatctattacagcgtta

SEQ ID NO: 57937 - DNA, 25 bp, E. coli
ggcgagataccatcaattacagcgt

SEQ ID NO: 57938 - DNA, 25 bp, E. coli
ggcgagataccaacaattacagcgt

SEQ ID NO: 57939 - DNA, 25 bp, E. coli
tataaacagtcggaagagccggatg

SEQ ID NO: 57940 - DNA, 25 bp, E. coli
tataaacagtcgcaagagccggatg

SEQ ID NO: 57941 - DNA, 25 bp, E. coli
tgaatccaccaggatccgtgtagcg

SEQ ID NO: 57942 - DNA, 25 bp, E. coli
tgaatatctgccgatcgtcgaactg

SEQ ID NO: 57943 - DNA, 25 bp, E. coli
tgaatatctgcccatcgtcgaactg

SEQ ID NO: 57944 - DNA, 25 bp, E. coli
tgaatccaccagcatccgtgtagcg

SEQ ID NO: 57945 - DNA, 25 bp, E. coli
gaagcgccagatgccgaacaattga

SEQ ID NO: 57946 - DNA, 25 bp, E. coli
gaattctggcaaaagcggcctcgca

SEQ ID NO: 57947 - DNA, 25 bp, E. coli
gaagcgccagatcccgaacaattga

SEQ ID NO: 57948 - DNA, 25 bp, E. coli
gaattctggcaatagcggcctcgca

SEQ ID NO: 57949 - DNA, 25 bp, E. coli
gacatcatgcaacaacagctcgacg

SEQ ID NO: 57950 - DNA, 25 bp, E. coli
gacatcatgcaagaacagctcgacg

SEQ ID NO: 57951 - DNA, 25 bp, E. coli
gattgttgatgtctccgccttgcag

SEQ ID NO: 57952 - DNA, 25 bp, E. coli
gattgttgatgtgtccgccttgcag

SEQ ID NO: 57953 - DNA, 25 bp, E. coli
gtaactatcgcaaagtccccggcat

SEQ ID NO: 57954 - DNA, 25 bp, E. coli
gtgatctggcgggaaaactcggcaa

SEQ ID NO: 57955 - DNA, 25 bp, E. coli
gtaactatcgcatagtccccggcat

SEQ ID NO: 57956 - DNA, 25 bp, E. coli
gtgatctggcggcaaaactcggcaa

SEQ ID NO: 57957 - DNA, 25 bp, E. coli
tggtacgcaataccctcgatcacgg

SEQ ID NO: 57958 - DNA, 25 bp, E. coli
tggtacgcaatagcctcgatcacgg

SEQ ID NO: 57959 - DNA, 25 bp, E. coli
gatggaaaacctgctcgatgaagcc

SEQ ID NO: 57960 - DNA, 25 bp, E. coli
gatggaaaacctcctcgatgaagcc

SEQ ID NO: 57961 - DNA, 25 bp, E. coli
taagaaaatccccttcgacgttctg

SEQ ID NO: 57962 - DNA, 25 bp, E. coli
taagaaaatcccgttcgacgttctg

SEQ ID NO: 57963 - DNA, 25 bp, E. coli
aacggaactacactccttaagtgag

SEQ ID NO: 57964 - DNA, 25 bp, E. coli
aacggaactacagtccttaagtgag

SEQ ID NO: 57965 - DNA, 25 bp, E. coli
tattagcagatacttatttcgtgac

SEQ ID NO: 57966 - DNA, 25 bp, E. coli
tattagcagatagttatttcgtgac

SEQ ID NO: 57967 - DNA, 25 bp, E. coli
tatctttgacgaagatgaacgcgtc

SEQ ID NO: 57968 - DNA, 25 bp, E. coli
tatctttgacgatgatgaacgcgtc

SEQ ID NO: 57969 - DNA, 25 bp, E. coli
ccttgttcgaaatttagcagtgcaa

SEQ ID NO: 57970 - DNA, 25 bp, E. coli
ccttaagtgagaaggaccgaagaca

SEQ ID NO: 57971 - DNA, 25 bp, E. coli
ccttgttcgaaaattagcagtgcaa

SEQ ID NO: 57972 - DNA, 25 bp, E. coli
ccttaagtgagatggaccgaagaca

SEQ ID NO: 57973 - DNA, 25 bp, E. coli
gcagtgcaagctatggaaaaactta

SEQ ID NO: 57974 - DNA, 25 bp, E. coli
gcagtgcaagctttggaaaaactta

SEQ ID NO: 57975 - DNA, 25 bp, E. coli
gacatgtagtctctattttagccga

SEQ ID NO: 57976 - DNA, 25 bp, E. coli
gacatgtagtctgtattttagccga

SEQ ID NO: 57977 - DNA, 25 bp, E. coli
gaacgcgtctttcctcaatgtatca

SEQ ID NO: 57978 - DNA, 25 bp, E. coli
gaacgcgtctttgctcaatgtatca

SEQ ID NO: 57979 - DNA, 25 bp, E. coli
cgtgactatatcttatccgatgaac

SEQ ID NO: 57980 - DNA, 25 bp, E. coli
cgtgactatatcatatccgatgaac

SEQ ID NO: 57981 - DNA, 25 bp, E. coli
gagattaccagcagaaaattccttg

SEQ ID NO: 57982 - DNA, 25 bp, E. coli
gagattaccagctgaaaattccttg

SEQ ID NO: 57983 - DNA, 25 bp, E. coli
aatacattctgataatgcgtcctgc

SEQ ID NO: 57984 - DNA, 25 bp, E. coli
aatacattctgaaaatgcgtcctgc

SEQ ID NO: 57985 - DNA, 25 bp, E. coli
taaatacattctgataatgcgtcct

SEQ ID NO: 57986 - DNA, 25 bp, E. coli
tacattctgataatgcgtcctgctg

SEQ ID NO: 57987 - DNA, 25 bp, E. coli
tacattctgatattgcgtcctgctg

SEQ ID NO: 57988 - DNA, 25 bp, E. coli
taaatacattctcataatgcgtcct

SEQ ID NO: 57989 - DNA, 25 bp, E. coli
tataaatacattgtgataatgcgtc

SEQ ID NO: 57990 - DNA, 25 bp, E. coli
tataaatacattctgataatgcgtc

SEQ ID NO: 57991 - DNA, 25 bp, E. coli
tatttcagcatatgtggatattcaa

SEQ ID NO: 57992 - DNA, 25 bp, E. coli
tatttcagcataagtggatattcaa

SEQ ID NO: 57993 - DNA, 25 bp, E. coli
ttcagcataagtcgatattcaaagt

SEQ ID NO: 57994 - DNA, 25 bp, E. coli
tcctgctgctggacattatttcagc

SEQ ID NO: 57995 - DNA, 25 bp, E. coli
tcctgctgctggtcattatttcagc

SEQ ID NO: 57996 - DNA, 25 bp, E. coli
ttcagcataagtggatattcaaagt

SEQ ID NO: 57997 - DNA, 25 bp, E. coli
cctgctgctggacattatttcagca

SEQ ID NO: 57998 - DNA, 25 bp, E. coli
cctgctgctggagattatttcagca

SEQ ID NO: 57999 - DNA, 25 bp, E. coli
gctgctggacattatttcagcataa

SEQ ID NO: 58000 - DNA, 25 bp, E. coli
gctgctggacataatttcagcataa

SEQ ID NO: 58001 - DNA, 25 bp, E. coli
gacattatttcagcataagtggata

SEQ ID NO: 58002 - DNA, 25 bp, E. coli
gacattatttcaccataagtggata

SEQ ID NO: 58003 - DNA, 25 bp, E. coli
ctggacattattacagcataagtgg

SEQ ID NO: 58004 - DNA, 25 bp, E. coli
ctggacattatttcagcataagtgg

SEQ ID NO: 58005 - DNA, 25 bp, E. coli
catattactggtcctgtcgctggtg

SEQ ID NO: 58006 - DNA, 25 bp, E. coli
catattactggtgctgtcgctggtg

SEQ ID NO: 58007 - DNA, 25 bp, E. coli
tacaggcagcgctgcattcactaac

SEQ ID NO: 58008 - DNA, 25 bp, E. coli
tacaggcagcgcagcattcactaac

SEQ ID NO: 58009 - DNA, 25 bp, E. coli
tacgcttatcggttcactgacggca

SEQ ID NO: 58010 - DNA, 25 bp, E. coli
tacgcttatcggatcactgacggca

SEQ ID NO: 58011 - DNA, 25 bp, E. coli
tatagcctgctgatgaacaacgaca

SEQ ID NO: 58012 - DNA, 25 bp, E. coli
tattcgcgcctgaaaggttttgacg

SEQ ID NO: 58013 - DNA, 25 bp, E. coli
tattcgcgcctgtaaggttttgacg

SEQ ID NO: 58014 - DNA, 25 bp, E. coli
tatagcctgctgttgaacaacgaca

SEQ ID NO: 58015 - DNA, 25 bp, E. coli
tgtgaactcctttaacagctcgcgc

SEQ ID NO: 58016 - DNA, 25 bp, E. coli
tgtgaactccttaaacagctcgcgc

SEQ ID NO: 58017 - DNA, 25 bp, E. coli
tcgcgctttggcttcaactggcagg

SEQ ID NO: 58018 - DNA, 25 bp, E. coli
tcgcgctttggcatcaactggcagg

SEQ ID NO: 58019 - DNA, 25 bp, E. coli
gaagcggcgaaacatctcggtgcca

SEQ ID NO: 58020 - DNA, 25 bp, E. coli
gaagcggcgaaagatctcggtgcca

SEQ ID NO: 58021 - DNA, 25 bp, E. coli
cgatggtcaaagacggcgtatcgcc

SEQ ID NO: 58022 - DNA, 25 bp, E. coli
cgatggtcaaagtcggcgtatcgcc

SEQ ID NO: 58023 - DNA, 25 bp, E. coli
cgtatcgccggaagttaacgcgctg

SEQ ID NO: 58024 - DNA, 25 bp, E. coli
cgtatcgccggatgttaacgcgctg

SEQ ID NO: 58025 - DNA, 25 bp, E. coli
taagctttaccctgtcgatggacga

SEQ ID NO: 58026 - DNA, 25 bp, E. coli
taagctttacccagtcgatggacga

SEQ ID NO: 58027 - DNA, 25 bp, E. coli
caggattgcccttacaagatctggt

SEQ ID NO: 58028 - DNA, 25 bp, E. coli
caggattgccctaacaagatctggt

SEQ ID NO: 58029 - DNA, 25 bp, E. coli
tacaccgcctgcatcgtggctggat

SEQ ID NO: 58030 - DNA, 25 bp, E. coli
tacaccgcctgcttcgtggctggat

SEQ ID NO: 58031 - DNA, 25 bp, E. coli
tatgctcaatgcaacaggattgccc

SEQ ID NO: 58032 - DNA, 25 bp, E. coli
tatgctcaatgctacaggattgccc

SEQ ID NO: 58033 - DNA, 25 bp, E. coli
ttcgcgtttggattcgtcatctggc

SEQ ID NO: 58034 - DNA, 25 bp, E. coli
ttcgcgtttggaatcgtcatctggc

SEQ ID NO: 58035 - DNA, 25 bp, E. coli
tgtttgcgatttgcgtttgccttgc

SEQ ID NO: 58036 - DNA, 25 bp, E. coli
tgtttgcgatttccgtttgccttgc

SEQ ID NO: 58037 - DNA, 25 bp, E. coli
tgaagtttatgctcaatgcaacagg

SEQ ID NO: 58038 - DNA, 25 bp, E. coli
tgaagtttatgcacaatgcaacagg

SEQ ID NO: 58039 - DNA, 25 bp, E. coli
ccttacaagatctggtgttcggtgc

SEQ ID NO: 58040 - DNA, 25 bp, E. coli
cgcctgcttcgtggctggatctacg

SEQ ID NO: 58041 - DNA, 25 bp, E. coli
cccttgttaatgcatttatcgctgt

SEQ ID NO: 58042 - DNA, 25 bp, E. coli
ccttacaagatcaggtgttcggtgc

SEQ ID NO: 58043 - DNA, 25 bp, E. coli
cccttgttaatggatttatcgctgt

SEQ ID NO: 58044 - DNA, 25 bp, E. coli
cgcctgcttcgtcgctggatctacg

SEQ ID NO: 58045 - DNA, 25 bp, E. coli
gtttggattcgtcatctggcttgtc

SEQ ID NO: 58046 - DNA, 25 bp, E. coli
gtttggattcgtgatctggcttgtc

SEQ ID NO: 58047 - DNA, 25 bp, E. coli
ggtgacatctggcatcccttgttaa

SEQ ID NO: 58048 - DNA, 25 bp, E. coli
ggtgacatctgggatcccttgttaa

SEQ ID NO: 58049 - DNA, 25 bp, E. coli
agtattaactgcctgcaacaccacg

SEQ ID NO: 58050 - DNA, 25 bp, E. coli
agtattaactgcgtgcaacaccacg

SEQ ID NO: 58051 - DNA, 25 bp, E. coli
tgcctgcaacaccacgcgtggcgtt

SEQ ID NO: 58052 - DNA, 25 bp, E. coli
tgcctgcaacacgacgcgtggcgtt

SEQ ID NO: 58053 - DNA, 25 bp, E. coli
ccacgcgtggcgatggtgaagacat

SEQ ID NO: 58054 - DNA, 25 bp, E. coli
ccacgcgtggcgttggtgaagacat

SEQ ID NO: 58055 - DNA, 25 bp, E. coli
gacaattgcagcgatcttttctgtt

SEQ ID NO: 58056 - DNA, 25 bp, E. coli
gacatttctgatggcggtaacgcga

SEQ ID NO: 58057 - DNA, 25 bp, E. coli
gacatttctgatcgcggtaacgcga

SEQ ID NO: 58058 - DNA, 25 bp, E. coli
gacaattgcagccatcttttctgtt

SEQ ID NO: 58059 - DNA, 25 bp, E. coli
cgttggtgaagacatttctgatggc

SEQ ID NO: 58060 - DNA, 25 bp, E. coli
cgcgtggcgttgctgaagacatttc

SEQ ID NO: 58061 - DNA, 25 bp, E. coli
cgttggtgaagagatttctgatggc

SEQ ID NO: 58062 - DNA, 25 bp, E. coli
cgcgtggcgttggtgaagacatttc

SEQ ID NO: 58063 - DNA, 25 bp, E. coli
ctgatggcggtatcgcgatttctgg

SEQ ID NO: 58064 - DNA, 25 bp, E. coli
ctgatggcggtaacgcgatttctgg

SEQ ID NO: 58065 - DNA, 25 bp, E. coli
gatcttttctgtactggtgctttca

SEQ ID NO: 58066 - DNA, 25 bp, E. coli
ggtgaagaagactattgcagcgatc

SEQ ID NO: 58067 - DNA, 25 bp, E. coli
tggtgctttcaagagtattaactgc

SEQ ID NO: 58068 - DNA, 25 bp, E. coli
ggtgaagaagacaattgcagcgatc

SEQ ID NO: 58069 - DNA, 25 bp, E. coli
tggtgctttcaacagtattaactgc

SEQ ID NO: 58070 - DNA, 25 bp, E. coli
gatcttttctgttctggtgctttca

SEQ ID NO: 58071 - DNA, 25 bp, E. coli
aatttctactggtcatcactggcgg

SEQ ID NO: 58072 - DNA, 25 bp, E. coli
aatttctactggacatcactggcgg

SEQ ID NO: 58073 - DNA, 25 bp, E. coli
taaatccgccgatggtaaagaccag

SEQ ID NO: 58074 - DNA, 25 bp, E. coli
taaaaacgccgttggtcgcgagcct

SEQ ID NO: 58075 - DNA, 25 bp, E. coli
taaatccgccgaaggtaaagaccag

SEQ ID NO: 58076 - DNA, 25 bp, E. coli
taaaaacgccgtaggtcgcgagcct

SEQ ID NO: 58077 - DNA, 25 bp, E. coli
tatgaaagtgttgtgacgctcgccg

SEQ ID NO: 58078 - DNA, 25 bp, E. coli
taccattagtggcatgacaggcgcg

SEQ ID NO: 58079 - DNA, 25 bp, E. coli
tatgaaatgagcaccactgacgcgt

SEQ ID NO: 58080 - DNA, 25 bp, E. coli
tatgaaagtgttctgacgctcgccg

SEQ ID NO: 58081 - DNA, 25 bp, E. coli
tatgaaatgagctccactgacgcgt

SEQ ID NO: 58082 - DNA, 25 bp, E. coli
taccattagtgggatgacaggcgcg

SEQ ID NO: 58083 - DNA, 25 bp, E. coli
tatataatgatcttccaggcgggac

SEQ ID NO: 58084 - DNA, 25 bp, E. coli
tatataatgatcatccaggcgggac

SEQ ID NO: 58085 - DNA, 25 bp, E. coli
ttttagtcgaccaaaactggcggcg

SEQ ID NO: 58086 - DNA, 25 bp, E. coli
ttacggtaattatcgcggcaggcgc

SEQ ID NO: 58087 - DNA, 25 bp, E. coli
ttttagtcgacctaaactggcggcg

SEQ ID NO: 58088 - DNA, 25 bp, E. coli
ttacggtaattaacgcggcaggcgc

SEQ ID NO: 58089 - DNA, 25 bp, E. coli
tgtcactgaaactggctggcctgcg

SEQ ID NO: 58090 - DNA, 25 bp, E. coli
tgtcactgaaacaggctggcctgcg

SEQ ID NO: 58091 - DNA, 25 bp, E. coli
tgaatatgttccctctcaggccggg

SEQ ID NO: 58092 - DNA, 25 bp, E. coli
tgaatatgttccgtctcaggccggg

SEQ ID NO: 58093 - DNA, 25 bp, E. coli
aatatcgccagttgatcatgctggg

SEQ ID NO: 58094 - DNA, 25 bp, E. coli
caattcgccggagatccgttcggca

SEQ ID NO: 58095 - DNA, 25 bp, E. coli
aatgcgttaagccaggcgattatcg

SEQ ID NO: 58096 - DNA, 25 bp, E. coli
caattcgccggacatccgttcggca

SEQ ID NO: 58097 - DNA, 25 bp, E. coli
aatgcgttaagcgaggcgattatcg

SEQ ID NO: 58098 - DNA, 25 bp, E. coli
aatatcgccagtagatcatgctggg

SEQ ID NO: 58099 - DNA, 25 bp, E. coli
taaaagcgcagggtaaagagattgc

SEQ ID NO: 58100 - DNA, 25 bp, E. coli
taaaagcgcaggctaaagagattgc

SEQ ID NO: 58101 - DNA, 25 bp, E. coli
taccttcgcacccttgacgcaatgg

SEQ ID NO: 58102 - DNA, 25 bp, E. coli
taccttcgcaccgttgacgcaatgg

SEQ ID NO: 58103 - DNA, 25 bp, E. coli
gctaaagagattgccggatgcgaaa

SEQ ID NO: 58104 - DNA, 25 bp, E. coli
gcgaaaaccgcgactggctgggata

SEQ ID NO: 58105 - DNA, 25 bp, E. coli
gcgaaaaccgcgtctggctgggata

SEQ ID NO: 58106 - DNA, 25 bp, E. coli
gctaaagagattcccggatgcgaaa

SEQ ID NO: 58107 - DNA, 25 bp, E. coli
gaaacgttacgcaataccttcgcac

SEQ ID NO: 58108 - DNA, 25 bp, E. coli
gaaacgttacgctataccttcgcac

SEQ ID NO: 58109 - DNA, 25 bp, E. coli
ctggcattgtttgatgagctgggat

SEQ ID NO: 58110 - DNA, 25 bp, E. coli
ctggcattgtttcatgagctgggat

SEQ ID NO: 58111 - DNA, 25 bp, E. coli
ggcacaaccgtatccgcagaaacgt

SEQ ID NO: 58112 - DNA, 25 bp, E. coli
ggcacaaccgtaaccgcagaaacgt

SEQ ID NO: 58113 - DNA, 25 bp, E. coli
gacgcaatgggaagataaatatcgc

SEQ ID NO: 58114 - DNA, 25 bp, E. coli
gacgcaatgggatgataaatatcgc

SEQ ID NO: 58115 - DNA, 25 bp, E. coli
taaaggaacggtccagactgaaacg

SEQ ID NO: 58116 - DNA, 25 bp, E. coli
taaaggaacggtgcagactgaaacg

SEQ ID NO: 58117 - DNA, 25 bp, E. coli
atggcggccccactgaaacaggcgt

SEQ ID NO: 58118 - DNA, 25 bp, E. coli
atggcggccccagtgaaacaggcgt

SEQ ID NO: 58119 - DNA, 25 bp, E. coli
aaaaacgccattccggcggcttcag

SEQ ID NO: 58120 - DNA, 25 bp, E. coli
aaaaacgccattgcggcggcttcag

SEQ ID NO: 58121 - DNA, 25 bp, E. coli
ttcatcacaggtagcccgggagaca

SEQ ID NO: 58122 - DNA, 25 bp, E. coli
ttcatcacaggttgcccgggagaca

SEQ ID NO: 58123 - DNA, 25 bp, E. coli
tgagccgggttcctaaaaacgccat

SEQ ID NO: 58124 - DNA, 25 bp, E. coli
tgagccgggttcgtaaaaacgccat

SEQ ID NO: 58125 - DNA, 25 bp, E. coli
tcagtcttcatctcaggttgcccgg

SEQ ID NO: 58126 - DNA, 25 bp, E. coli
tcagtcttcatcacaggttgcccgg

SEQ ID NO: 58127 - DNA, 25 bp, E. coli
ccgcgtggccactacggcgattaat

SEQ ID NO: 58128 - DNA, 25 bp, E. coli
cccactgaaacaggcgtttgatgag

SEQ ID NO: 58129 - DNA, 25 bp, E. coli
ccgcgtggccacaacggcgattaat

SEQ ID NO: 58130 - DNA, 25 bp, E. coli
cccactgaaacacgcgtttgatgag

SEQ ID NO: 58131 - DNA, 25 bp, E. coli
gataaaagggctagatcaggcgatt

SEQ ID NO: 58132 - DNA, 25 bp, E. coli
gataaaagggcttgatcaggcgatt

SEQ ID NO: 58133 - DNA, 25 bp, E. coli
ggtcagcatcggtatcagcgggcat

SEQ ID NO: 58134 - DNA, 25 bp, E. coli
ggtcagcatcggaatcagcgggcat

SEQ ID NO: 58135 - DNA, 25 bp, E. coli
ggcgattaatcagtcttcatcacag

SEQ ID NO: 58136 - DNA, 25 bp, E. coli
ggcgattaatcactcttcatcacag

SEQ ID NO: 58137 - DNA, 25 bp, E. coli
aatgccatgtcgcatcgatgcgctc

SEQ ID NO: 58138 - DNA, 25 bp, E. coli
aatgccatgtcggatcgatgcgctc

SEQ ID NO: 58139 - DNA, 25 bp, E. coli
aaggtctgggcggttcatcgctgat

SEQ ID NO: 58140 - DNA, 25 bp, E. coli
aaggtctgggcgcttcatcgctgat

SEQ ID NO: 58141 - DNA, 25 bp, E. coli
cagtccatattctaaccaggaggtt

SEQ ID NO: 58142 - DNA, 25 bp, E. coli
cagtccatattcaaaccaggaggtt

SEQ ID NO: 58143 - DNA, 25 bp, E. coli
aaaatgggttatgacgagatggctg

SEQ ID NO: 58144 - DNA, 25 bp, E. coli
aaaatgggttatcacgagatggctg

SEQ ID NO: 58145 - DNA, 25 bp, E. coli
ttcatcgctgatcaacggtatgtgc

SEQ ID NO: 58146 - DNA, 25 bp, E. coli
ttcatcgctgatgaacggtatgtgc

SEQ ID NO: 58147 - DNA, 25 bp, E. coli
ccaggaggtttaattgcaatttgac

SEQ ID NO: 58148 - DNA, 25 bp, E. coli
ccaggaggtttatttgcaatttgac

SEQ ID NO: 58149 - DNA, 25 bp, E. coli
gaagatccgaacacaaccgtgctgc

SEQ ID NO: 58150 - DNA, 25 bp, E. coli
gaagatccgaactcaaccgtgctgc

SEQ ID NO: 58151 - DNA, 25 bp, E. coli
gcacggcttccattgccatgtcgga

SEQ ID NO: 58152 - DNA, 25 bp, E. coli
gcacggcttccaatgccatgtcgga

SEQ ID NO: 58153 - DNA, 25 bp, E. coli
cgagaacgattagcacggtggcgat

SEQ ID NO: 58154 - DNA, 25 bp, E. coli
cgagaacgattaccacggtggcgat

SEQ ID NO: 58155 - DNA, 25 bp, E. coli
ggcacaagaacctagtctggagaac

SEQ ID NO: 58156 - DNA, 25 bp, E. coli
ggcacaagaaccaagtctggagaac

SEQ ID NO: 58157 - DNA, 25 bp, E. coli
gataactgggcacaagaacctagtc

SEQ ID NO: 58158 - DNA, 25 bp, E. coli
gataactgggcagaagaacctagtc

SEQ ID NO: 58159 - DNA, 25 bp, E. coli
cacagtcttaatcgttaacggaagc

SEQ ID NO: 58160 - DNA, 25 bp, E. coli
cacagtcttaatggttaacggaagc

SEQ ID NO: 58161 - DNA, 25 bp, E. coli
aaatgtcaggcctggctccgctcag

SEQ ID NO: 58162 - DNA, 25 bp, E. coli
aaatgtcaggccaggctccgctcag

SEQ ID NO: 58163 - DNA, 25 bp, E. coli
tccataacgcgacatccgggaaatg

SEQ ID NO: 58164 - DNA, 25 bp, E. coli
tccgggaaatgtgtggattaccagc

SEQ ID NO: 58165 - DNA, 25 bp, E. coli
tccgggaaatgtctggattaccagc

SEQ ID NO: 58166 - DNA, 25 bp, E. coli
tccataacgcgagatccgggaaatg

SEQ ID NO: 58167 - DNA, 25 bp, E. coli
cctgtttagcaacggaagcaaaggg

SEQ ID NO: 58168 - DNA, 25 bp, E. coli
cctgtttagcaagggaagcaaaggg

SEQ ID NO: 58169 - DNA, 25 bp, E. coli
gcatcatctcatttcctcgtcacag

SEQ ID NO: 58170 - DNA, 25 bp, E. coli
gcatcatctcatatcctcgtcacag

SEQ ID NO: 58171 - DNA, 25 bp, E. coli
gggatttaatcaacggcatcatctc

SEQ ID NO: 58172 - DNA, 25 bp, E. coli
gggcggagtccagtcagtagcagga

SEQ ID NO: 58173 - DNA, 25 bp, E. coli
gggatttaatcatcggcatcatctc

SEQ ID NO: 58174 - DNA, 25 bp, E. coli
gggcggagtccactcagtagcagga

SEQ ID NO: 58175 - DNA, 25 bp, E. coli
ggccgatgaaactaccccgcaaggg

SEQ ID NO: 58176 - DNA, 25 bp, E. coli
tggctccgctcaggccgatgaaaca

SEQ ID NO: 58177 - DNA, 25 bp, E. coli
ggccgatgaaacaaccccgcaaggg

SEQ ID NO: 58178 - DNA, 25 bp, E. coli
tggctccgctcacgccgatgaaaca

SEQ ID NO: 58179 - DNA, 25 bp, E. coli
tggattaccagcaaatgtcaggcct

SEQ ID NO: 58180 - DNA, 25 bp, E. coli
tggattaccagctaatgtcaggcct

SEQ ID NO: 58181 - DNA, 25 bp, E. coli
aacaggtgtgcgaccgttactggtg

SEQ ID NO: 58182 - DNA, 25 bp, E. coli
gaccgttactggtgggttcgccact

SEQ ID NO: 58183 - DNA, 25 bp, E. coli
aacaggtgtgcgtccgttactggtg

SEQ ID NO: 58184 - DNA, 25 bp, E. coli
gaccgttactggagggttcgccact

SEQ ID NO: 58185 - DNA, 25 bp, E. coli
tatgccccagtatttcgcacatggt

SEQ ID NO: 58186 - DNA, 25 bp, E. coli
tatgccccagtaattcgcacatggt

SEQ ID NO: 58187 - DNA, 25 bp, E. coli
tgggttcgccacaatgacaaacgtt

SEQ ID NO: 58188 - DNA, 25 bp, E. coli
tgaaacgcaaaaacgcttcgttact

SEQ ID NO: 58189 - DNA, 25 bp, E. coli
tgaaacgcaaaatcgcttcgttact

SEQ ID NO: 58190 - DNA, 25 bp, E. coli
tcgccactatgacaaacgttgccgc

SEQ ID NO: 58191 - DNA, 25 bp, E. coli
tcgccactatgagaaacgttgccgc

SEQ ID NO: 58192 - DNA, 25 bp, E. coli
cgttactcggtatcgtgctcatggg

SEQ ID NO: 58193 - DNA, 25 bp, E. coli
cgttactcggtaacgtgctcatggg

SEQ ID NO: 58194 - DNA, 25 bp, E. coli
gttaccacagtttaatatgccccag

SEQ ID NO: 58195 - DNA, 25 bp, E. coli
gttaccacagttaaatatgccccag

SEQ ID NO: 58196 - DNA, 25 bp, E. coli
gggtattcaatcctcaaccagttac

SEQ ID NO: 58197 - DNA, 25 bp, E. coli
gggtattcaatcgtcaaccagttac

SEQ ID NO: 58198 - DNA, 25 bp, E. coli
ggcatgaacaggtgtgcgaccgtta

SEQ ID NO: 58199 - DNA, 25 bp, E. coli
ggcatgaacaggagtgcgaccgtta

SEQ ID NO: 58200 - DNA, 25 bp, E. coli
tgggttcgccactatgacaaacgtt

SEQ ID NO: 58201 - DNA, 25 bp, E. coli
tcaatcctcaaccagttaccacagt

SEQ ID NO: 58202 - DNA, 25 bp, E. coli
tcaatcctcaacgagttaccacagt

SEQ ID NO: 58203 - DNA, 25 bp, E. coli
cacacaccgctatggctgacgatat

SEQ ID NO: 58204 - DNA, 25 bp, E. coli
caccgctatggcagacgatattaaa

SEQ ID NO: 58205 - DNA, 25 bp, E. coli
caccgctatggctgacgatattaaa

SEQ ID NO: 58206 - DNA, 25 bp, E. coli
cacacaccgctaaggctgacgatat

SEQ ID NO: 58207 - DNA, 25 bp, E. coli
tatggctgacgaaattaaagtcgcc

SEQ ID NO: 58208 - DNA, 25 bp, E. coli
tatggctgacgatattaaagtcgcc

SEQ ID NO: 58209 - DNA, 25 bp, E. coli
accgctatggctgacgatattaaag

SEQ ID NO: 58210 - DNA, 25 bp, E. coli
acaccgctatgggtgacgatattaa

SEQ ID NO: 58211 - DNA, 25 bp, E. coli
acaccgctatggctgacgatattaa

SEQ ID NO: 58212 - DNA, 25 bp, E. coli
accgctatggctcacgatattaaag

SEQ ID NO: 58213 - DNA, 25 bp, E. coli
acacaccgctatcgctgacgatatt

SEQ ID NO: 58214 - DNA, 25 bp, E. coli
acacaccgctatggctgacgatatt

SEQ ID NO: 58215 - DNA, 25 bp, E. coli
tttcacacaccgctatggctgacga

SEQ ID NO: 58216 - DNA, 25 bp, E. coli
tttcacacaccggtatggctgacga

SEQ ID NO: 58217 - DNA, 25 bp, E. coli
taagggcgataaactggttggcgtg

SEQ ID NO: 58218 - DNA, 25 bp, E. coli
taagggcgataatctggttggcgtg

SEQ ID NO: 58219 - DNA, 25 bp, E. coli
gctatggctgaccatattaaagtcg

SEQ ID NO: 58220 - DNA, 25 bp, E. coli
gctatggctgacgatattaaagtcg

SEQ ID NO: 58221 - DNA, 25 bp, E. coli
ccgctatggctgacgatattaaagt

SEQ ID NO: 58222 - DNA, 25 bp, E. coli
ccgctatggctgtcgatattaaagt

SEQ ID NO: 58223 - DNA, 25 bp, E. coli
tcacacaccgctttggctgacgata

SEQ ID NO: 58224 - DNA, 25 bp, E. coli
tcacacaccgctatggctgacgata

SEQ ID NO: 58225 - DNA, 25 bp, E. coli
aatgaatatccgcttcttgtcaaga

SEQ ID NO: 58226 - DNA, 25 bp, E. coli
aatgaatatccggttcttgtcaaga

SEQ ID NO: 58227 - DNA, 25 bp, E. coli
caagcccaattttctactcgttctg

SEQ ID NO: 58228 - DNA, 25 bp, E. coli
caagcccaatttactactcgttctg

SEQ ID NO: 58229 - DNA, 25 bp, E. coli
tactcttgatgaaggtcagccagcc

SEQ ID NO: 58230 - DNA, 25 bp, E. coli
tactcttgatgatggtcagccagcc

SEQ ID NO: 58231 - DNA, 25 bp, E. coli
tggtgtttctcgtcagggcaagcct

SEQ ID NO: 58232 - DNA, 25 bp, E. coli
tggtgtttctcgacagggcaagcct

SEQ ID NO: 58233 - DNA, 25 bp, E. coli
tcaaagttggtcagttcggttccct

SEQ ID NO: 58234 - DNA, 25 bp, E. coli
tcaaagttggtctgttcggttccct

SEQ ID NO: 58235 - DNA, 25 bp, E. coli
tctgcgcctcgtaccggctaagtaa

SEQ ID NO: 58236 - DNA, 25 bp, E. coli
tctgcgcctcgttccggctaagtaa

SEQ ID NO: 58237 - DNA, 25 bp, E. coli
gcctggtctgtacaccgttcatctg

SEQ ID NO: 58238 - DNA, 25 bp, E. coli
gcctggtctgtagaccgttcatctg

SEQ ID NO: 58239 - DNA, 25 bp, E. coli
gaatgagcagctatgttacgttgat

SEQ ID NO: 58240 - DNA, 25 bp, E. coli
gaatgagcagctttgttacgttgat

SEQ ID NO: 58241 - DNA, 25 bp, E. coli
gttcccttatgaatgaccgtctgcg

SEQ ID NO: 58242 - DNA, 25 bp, E. coli
gttcccttatgattgaccgtctgcg

SEQ ID NO: 58243 - DNA, 25 bp, E. coli
gggcaagccttattcactgaatgag

SEQ ID NO: 58244 - DNA, 25 bp, E. coli
gggcaagccttaatcactgaatgag

SEQ ID NO: 58245 - DNA, 25 bp, E. coli
tcagccagcctaagcgcctggtctg

SEQ ID NO: 58246 - DNA, 25 bp, E. coli
tcagccagcctatgcgcctggtctg

SEQ ID NO: 58247 - DNA, 25 bp, E. coli
caatgaagtggcaaccgggcttttt

SEQ ID NO: 58248 - DNA, 25 bp, E. coli
caaccgggctttatgggcatctggt

SEQ ID NO: 58249 - DNA, 25 bp, E. coli
caatgaagtggctaccgggcttttt

SEQ ID NO: 58250 - DNA, 25 bp, E. coli
caaccgggctttttgggcatctggt

SEQ ID NO: 58251 - DNA, 25 bp, E. coli
caaaggtagcgcttcatccaccgat

SEQ ID NO: 58252 - DNA, 25 bp, E. coli
caaaggtagcgcatcatccaccgat

SEQ ID NO: 58253 - DNA, 25 bp, E. coli
ttcgctgggtaatcaaattctgccg

SEQ ID NO: 58254 - DNA, 25 bp, E. coli
ttcgctgggtaaacaaattctgccg

SEQ ID NO: 58255 - DNA, 25 bp, E. coli
tcgccagatcccagtgccggcgtgg

SEQ ID NO: 58256 - DNA, 25 bp, E. coli
tcgccagatccctgtgccggcgtgg

SEQ ID NO: 58257 - DNA, 25 bp, E. coli
tctaccttcctgctggattcgctgg

SEQ ID NO: 58258 - DNA, 25 bp, E. coli
tctaccttcctggtggattcgctgg

SEQ ID NO: 58259 - DNA, 25 bp, E. coli
gaaccgcaaaggtagcgcatcatcc

SEQ ID NO: 58260 - DNA, 25 bp, E. coli
gaaccgcaaaggaagcgcatcatcc

SEQ ID NO: 58261 - DNA, 25 bp, E. coli
cgcaccgagcgtggcgatattatta

SEQ ID NO: 58262 - DNA, 25 bp, E. coli
cgatattattaatgatggcatcctg

SEQ ID NO: 58263 - DNA, 25 bp, E. coli
cgcaccgagcgtcgcgatattatta

SEQ ID NO: 58264 - DNA, 25 bp, E. coli
cgatattattaaagatggcatcctg

SEQ ID NO: 58265 - DNA, 25 bp, E. coli
cggacaaggtctaagcttcgagcag

SEQ ID NO: 58266 - DNA, 25 bp, E. coli
cggacaaggtcttagcttcgagcag

SEQ ID NO: 58267 - DNA, 25 bp, E. coli
ggtctaagcttccagcagatgctca

SEQ ID NO: 58268 - DNA, 25 bp, E. coli
ggtctaagcttcgagcagatgctca

SEQ ID NO: 58269 - DNA, 25 bp, E. coli
tgacatgattaatatcctctgggct

SEQ ID NO: 58270 - DNA, 25 bp, E. coli
tgacatgattaaaatcctctgggct

SEQ ID NO: 58271 - DNA, 25 bp, E. coli
ccgtggccgacgcagtgacatgatt

SEQ ID NO: 58272 - DNA, 25 bp, E. coli
gacggagtgacaagattaaaatcct

SEQ ID NO: 58273 - DNA, 25 bp, E. coli
gacggagtgacatgattaaaatcct

SEQ ID NO: 58274 - DNA, 25 bp, E. coli
cgacggagtgacatgattaaaatcc

SEQ ID NO: 58275 - DNA, 25 bp, E. coli
ccgacggagtgacatgattaaaatc

SEQ ID NO: 58276 - DNA, 25 bp, E. coli
ccgtggccgacggagtgacatgatt

SEQ ID NO: 58277 - DNA, 25 bp, E. coli
cgacggagtgacttgattaaaatcc

SEQ ID NO: 58278 - DNA, 25 bp, E. coli
ccgacggagtgagatgattaaaatc

SEQ ID NO: 58279 - DNA, 25 bp, E. coli
cggagtgacatgattaaaatcctct

SEQ ID NO: 58280 - DNA, 25 bp, E. coli
cgtggccgacggagtgacatgatta

SEQ ID NO: 58281 - DNA, 25 bp, E. coli
cggagtgacatgtttaaaatcctct

SEQ ID NO: 58282 - DNA, 25 bp, E. coli
cgtggccgacggtgtgacatgatta

SEQ ID NO: 58283 - DNA, 25 bp, E. coli
gtggccgacggagtgacatgattaa

SEQ ID NO: 58284 - DNA, 25 bp, E. coli
gtgacatgattaaaatcctctgggc

SEQ ID NO: 58285 - DNA, 25 bp, E. coli
gtggccgacggactgacatgattaa

SEQ ID NO: 58286 - DNA, 25 bp, E. coli
gtgacatgattataatcctctgggc

SEQ ID NO: 58287 - DNA, 25 bp, E. coli
tggccgacggagtgacatgattaaa

SEQ ID NO: 58288 - DNA, 25 bp, E. coli
tggccgacggagagacatgattaaa

SEQ ID NO: 58289 - DNA, 25 bp, E. coli
gagtgacatgattaaaatcctctgg

SEQ ID NO: 58290 - DNA, 25 bp, E. coli
gagtgacatgataaaaatcctctgg

SEQ ID NO: 58291 - DNA, 25 bp, E. coli
caatattaattactggcggaggtcg

SEQ ID NO: 58292 - DNA, 25 bp, E. coli
caatattaattagtggcggaggtcg

SEQ ID NO: 58293 - DNA, 25 bp, E. coli
caaaagcaaccggtgattgtcagct

SEQ ID NO: 58294 - DNA, 25 bp, E. coli
caaaagcaaccgctgattgtcagct

SEQ ID NO: 58295 - DNA, 25 bp, E. coli
tactaaaaagcacccatggtctgcg

SEQ ID NO: 58296 - DNA, 25 bp, E. coli
tactaaaaagcagccatggtctgcg

SEQ ID NO: 58297 - DNA, 25 bp, E. coli
agcgcggtagcgtcaaacatattgc

SEQ ID NO: 58298 - DNA, 25 bp, E. coli
agcgcggtagcgacaaacatattgc

SEQ ID NO: 58299 - DNA, 25 bp, E. coli
tatgctgcaagcaaagcggcactgg

SEQ ID NO: 58300 - DNA, 25 bp, E. coli
tatgctgcaagctaagcggcactgg

SEQ ID NO: 58301 - DNA, 25 bp, E. coli
tgatttttcgacgaacgacggtgtg

SEQ ID NO: 58302 - DNA, 25 bp, E. coli
tgatttttcgaccaacgacggtgtg

SEQ ID NO: 58303 - DNA, 25 bp, E. coli
gaaagtgaattcaattgcgccatcg

SEQ ID NO: 58304 - DNA, 25 bp, E. coli
gaaagtgaattctattgcgccatcg

SEQ ID NO: 58305 - DNA, 25 bp, E. coli
cgcgcctggcgagaaagaagtgatc

SEQ ID NO: 58306 - DNA, 25 bp, E. coli
ccgacgtactggcttgcatgatgca

SEQ ID NO: 58307 - DNA, 25 bp, E. coli
ccgacgtactgggttgcatgatgca

SEQ ID NO: 58308 - DNA, 25 bp, E. coli
cgcgcctggcgacaaagaagtgatc

SEQ ID NO: 58309 - DNA, 25 bp, E. coli
ggcactggataatatgacccgctcg

SEQ ID NO: 58310 - DNA, 25 bp, E. coli
ggcactggataaaatgacccgctcg

SEQ ID NO: 58311 - DNA, 25 bp, E. coli
gatgcagatccacgttaatacccca

SEQ ID NO: 58312 - DNA, 25 bp, E. coli
gatgcagatccaggttaatacccca

SEQ ID NO: 58313 - DNA, 25 bp, E. coli
catttccagattcgttaccgtgcaa

SEQ ID NO: 58314 - DNA, 25 bp, E. coli
tatatcgtatttcgcgcaccacggg

SEQ ID NO: 58315 - DNA, 25 bp, E. coli
tatatcgtatttggcgcaccacggg

SEQ ID NO: 58316 - DNA, 25 bp, E. coli
gcaaccagctgcctggctacggtaa

SEQ ID NO: 58317 - DNA, 25 bp, E. coli
gcaaatcatccgttacaggaacgta

SEQ ID NO: 58318 - DNA, 25 bp, E. coli
gcaaatcatccgatacaggaacgta

SEQ ID NO: 58319 - DNA, 25 bp, E. coli
gcaaccagctgcgtggctacggtaa

SEQ ID NO: 58320 - DNA, 25 bp, E. coli
gacacgatgctggtaaataatgggc

SEQ ID NO: 58321 - DNA, 25 bp, E. coli
gacacgatgctgctaaataatgggc

SEQ ID NO: 58322 - DNA, 25 bp, E. coli
cgtattcgacaggagatggcggcaa

SEQ ID NO: 58323 - DNA, 25 bp, E. coli
cgtattcgacagcagatggcggcaa

SEQ ID NO: 58324 - DNA, 25 bp, E. coli
catttccagattggttaccgtgcaa

SEQ ID NO: 58325 - DNA, 25 bp, E. coli
cgggctgttcgggtagcaaatcatc

SEQ ID NO: 58326 - DNA, 25 bp, E. coli
cgggctgttcggctagcaaatcatc

SEQ ID NO: 58327 - DNA, 25 bp, E. coli
gggattgatatcacagctccacggg

SEQ ID NO: 58328 - DNA, 25 bp, E. coli
gggattgatatctcagctccacggg

SEQ ID NO: 58329 - DNA, 25 bp, E. coli
ggtacacctatttacgccgcgggtg

SEQ ID NO: 58330 - DNA, 25 bp, E. coli
ggtacacctattaacgccgcgggtg

SEQ ID NO: 58331 - DNA, 25 bp, E. coli
tggccgccagtacggcaacgttgtt

SEQ ID NO: 58332 - DNA, 25 bp, E. coli
tggccaacgacacggaaagttatca

SEQ ID NO: 58333 - DNA, 25 bp, E. coli
tggccgccagtagggcaacgttgtt

SEQ ID NO: 58334 - DNA, 25 bp, E. coli
tggccaacgacagggaaagttatca

SEQ ID NO: 58335 - DNA, 25 bp, E. coli
aaagtcttaattccagataacagcg

SEQ ID NO: 58336 - DNA, 25 bp, E. coli
aaagtcttaattgcagataacagcg

SEQ ID NO: 58337 - DNA, 25 bp, E. coli
aaaccgcccgcagaataacatcatt

SEQ ID NO: 58338 - DNA, 25 bp, E. coli
aaaccgcccgcacaataacatcatt

SEQ ID NO: 58339 - DNA, 25 bp, E. coli
tttcttttggattggcgttcacgcc

SEQ ID NO: 58340 - DNA, 25 bp, E. coli
tttcttttggataggcgttcacgcc

SEQ ID NO: 58341 - DNA, 25 bp, E. coli
tctttcttcaccagcgttcaaaggc

SEQ ID NO: 58342 - DNA, 25 bp, E. coli
tctttcttcacctgcgttcaaaggc

SEQ ID NO: 58343 - DNA, 25 bp, E. coli
cgttcaaaggcctgcctcgcgctgg

SEQ ID NO: 58344 - DNA, 25 bp, E. coli
cgttcaaaggccagcctcgcgctgg

SEQ ID NO: 58345 - DNA, 25 bp, E. coli
gattatcatcacaactgaaaccgat

SEQ ID NO: 58346 - DNA, 25 bp, E. coli
gattacactgatgtgatttgcttca

SEQ ID NO: 58347 - DNA, 25 bp, E. coli
tgaaaccgattacaccaaccacaac

SEQ ID NO: 58348 - DNA, 25 bp, E. coli
gatcacgtttcaccgcagattatca

SEQ ID NO: 58349 - DNA, 25 bp, E. coli
gattacactgatctgatttgcttca

SEQ ID NO: 58350 - DNA, 25 bp, E. coli
tgaaaccgattagaccaaccacaac

SEQ ID NO: 58351 - DNA, 25 bp, E. coli
gattatcatcactactgaaaccgat

SEQ ID NO: 58352 - DNA, 25 bp, E. coli
gataacagcgtttaatctatgatga

SEQ ID NO: 58353 - DNA, 25 bp, E. coli
gataacagcgttaaatctatgatga

SEQ ID NO: 58354 - DNA, 25 bp, E. coli
gatcacgtttcagcgcagattatca

SEQ ID NO: 58355 - DNA, 25 bp, E. coli
taaaaaataaccatattggagggca

SEQ ID NO: 58356 - DNA, 25 bp, E. coli
taaaaaataaccttattggagggca

SEQ ID NO: 58357 - DNA, 25 bp, E. coli
caatattttgatttgctccgcgcac

SEQ ID NO: 58358 - DNA, 25 bp, E. coli
caatattttgatatgctccgcgcac

SEQ ID NO: 58359 - DNA, 25 bp, E. coli
tacgtactgattcgctatatggcgc

SEQ ID NO: 58360 - DNA, 25 bp, E. coli
taaagtcgtaggtcagaaaggatca

SEQ ID NO: 58361 - DNA, 25 bp, E. coli
taaagtcgtaggacagaaaggatca

SEQ ID NO: 58362 - DNA, 25 bp, E. coli
accattccgggcagcatcatcggga

SEQ ID NO: 58363 - DNA, 25 bp, E. coli
accattccgggctgcatcatcggga

SEQ ID NO: 58364 - DNA, 25 bp, E. coli
atctggcaatatatacgcgctttcg

SEQ ID NO: 58365 - DNA, 25 bp, E. coli
atctggcaatatttacgcgctttcg

SEQ ID NO: 58366 - DNA, 25 bp, E. coli
tacgtactgattggctatatggcgc

SEQ ID NO: 58367 - DNA, 25 bp, E. coli
tatatggcgctaatgtttgtgccga

SEQ ID NO: 58368 - DNA, 25 bp, E. coli
tatatggcgctattgtttgtgccga

SEQ ID NO: 58369 - DNA, 25 bp, E. coli
tttttctggtggagagctggagttc

SEQ ID NO: 58370 - DNA, 25 bp, E. coli
tttttctggtggtgagctggagttc

SEQ ID NO: 58371 - DNA, 25 bp, E. coli
tcgtcctgatttttgcctgcctgta

SEQ ID NO: 58372 - DNA, 25 bp, E. coli
tcgtcctgatttatgcctgcctgta

SEQ ID NO: 58373 - DNA, 25 bp, E. coli
tgctggccttgcaaattcttccggc

SEQ ID NO: 58374 - DNA, 25 bp, E. coli
tgctggccttgctaattcttccggc

SEQ ID NO: 58375 - DNA, 25 bp, E. coli
tcattgcttccctgctaccggtaac

SEQ ID NO: 58376 - DNA, 25 bp, E. coli
tcattgcttcccagctaccggtaac

SEQ ID NO: 58377 - DNA, 25 bp, E. coli
gtaagacactgaacattatctggca

SEQ ID NO: 58378 - DNA, 25 bp, E. coli
gtaagacactgatcattatctggca

SEQ ID NO: 58379 - DNA, 25 bp, E. coli
caatatctcaatcactgaggtggca

SEQ ID NO: 58380 - DNA, 25 bp, E. coli
caatatctcaatgactgaggtggca

SEQ ID NO: 58381 - DNA, 25 bp, E. coli
cagagctcgctggtgtattaattca

SEQ ID NO: 58382 - DNA, 25 bp, E. coli
cagagctcgctgctgtattaattca

SEQ ID NO: 58383 - DNA, 25 bp, E. coli
tacggctaaatcagctaaaagtgcc

SEQ ID NO: 58384 - DNA, 25 bp, E. coli
tacggctaaatctgctaaaagtgcc

SEQ ID NO: 58385 - DNA, 25 bp, E. coli
tatctcaaaggaacatactcagctc

SEQ ID NO: 58386 - DNA, 25 bp, E. coli
tatctcaaaggatcatactcagctc

SEQ ID NO: 58387 - DNA, 25 bp, E. coli
tgtcgcatgcgccaaactgaaaatt

SEQ ID NO: 58388 - DNA, 25 bp, E. coli
tgtcgcatgcgcgaaactgaaaatt

SEQ ID NO: 58389 - DNA, 25 bp, E. coli
tactcagctcttcgcaagtctgtcg

SEQ ID NO: 58390 - DNA, 25 bp, E. coli
tactcagctcttggcaagtctgtcg

SEQ ID NO: 58391 - DNA, 25 bp, E. coli
gcatccagatcggatcacagtacgg

SEQ ID NO: 58392 - DNA, 25 bp, E. coli
gctactaactttctcgcgcgtctga

SEQ ID NO: 58393 - DNA, 25 bp, E. coli
gctactaactttgtcgcgcgtctga

SEQ ID NO: 58394 - DNA, 25 bp, E. coli
gcatccagatcgcatcacagtacgg

SEQ ID NO: 58395 - DNA, 25 bp, E. coli
gattcaggtgatcgtagtgaccccg

SEQ ID NO: 58396 - DNA, 25 bp, E. coli
gattcaggtgatggtagtgaccccg

SEQ ID NO: 58397 - DNA, 25 bp, E. coli
gtatccatagaacccactctggcag

SEQ ID NO: 58398 - DNA, 25 bp, E. coli
gtatccatagaagccactctggcag

SEQ ID NO: 58399 - DNA, 25 bp, E. coli
taacgatcctgcctccatggaagag

SEQ ID NO: 58400 - DNA, 25 bp, E. coli
taacgatcctgcgtccatggaagag

SEQ ID NO: 58401 - DNA, 25 bp, E. coli
agggtatataaatgaacatcaatgg

SEQ ID NO: 58402 - DNA, 25 bp, E. coli
agggtatataaaagaacatcaatgg

SEQ ID NO: 58403 - DNA, 25 bp, E. coli
attgagggtataaaaaagaacatca

SEQ ID NO: 58404 - DNA, 25 bp, E. coli
atgaaacgggtattgagggtatata

SEQ ID NO: 58405 - DNA, 25 bp, E. coli
atgaaacgggtaatgagggtatata

SEQ ID NO: 58406 - DNA, 25 bp, E. coli
attgagggtatataaaagaacatca

SEQ ID NO: 58407 - DNA, 25 bp, E. coli
tattgagggtatttaaaagaacatc

SEQ ID NO: 58408 - DNA, 25 bp, E. coli
tattgagggtatataaaagaacatc

SEQ ID NO: 58409 - DNA, 25 bp, E. coli
ttgagggtatataaaagaacatcaa

SEQ ID NO: 58410 - DNA, 25 bp, E. coli
ttgagggtatattaaagaacatcaa

SEQ ID NO: 58411 - DNA, 25 bp, E. coli
tgagggtatataaaagaacatcaat

SEQ ID NO: 58412 - DNA, 25 bp, E. coli
tgagggtatatataagaacatcaat

SEQ ID NO: 58413 - DNA, 25 bp, E. coli
tgaaacgggtatagagggtatataa

SEQ ID NO: 58414 - DNA, 25 bp, E. coli
tgaaacgggtattgagggtatataa

SEQ ID NO: 58415 - DNA, 25 bp, E. coli
gtattgagggtaaataaaagaacat

SEQ ID NO: 58416 - DNA, 25 bp, E. coli
gtattgagggtatataaaagaacat

SEQ ID NO: 58417 - DNA, 25 bp, E. coli
ggtattgagggtttataaaagaaca

SEQ ID NO: 58418 - DNA, 25 bp, E. coli
ggtattgagggtatataaaagaaca

SEQ ID NO: 58419 - DNA, 25 bp, E. coli
gggtatataaaagaacatcaatggg

SEQ ID NO: 58420 - DNA, 25 bp, E. coli
gggtatataaaacaacatcaatggg

SEQ ID NO: 58421 - DNA, 25 bp, E. coli
gagggtatataaaagaacatcaatg

SEQ ID NO: 58422 - DNA, 25 bp, E. coli
gagggtatataatagaacatcaatg

SEQ ID NO: 58423 - DNA, 25 bp, E. coli
cactggggatggagacgtcgttcag

SEQ ID NO: 58424 - DNA, 25 bp, E. coli
cactggggatggtgacgtcgttcag

SEQ ID NO: 58425 - DNA, 25 bp, E. coli
catgggcgtctgaacatcagtcaac

SEQ ID NO: 58426 - DNA, 25 bp, E. coli
catgggcgtctgtacatcagtcaac

SEQ ID NO: 58427 - DNA, 25 bp, E. coli
atgtctcgacgaacgttcctggcag

SEQ ID NO: 58428 - DNA, 25 bp, E. coli
actggggatggtcacgtcgttcagc

SEQ ID NO: 58429 - DNA, 25 bp, E. coli
actggggatggtgacgtcgttcagc

SEQ ID NO: 58430 - DNA, 25 bp, E. coli
atgtctcgacgatcgttcctggcag

SEQ ID NO: 58431 - DNA, 25 bp, E. coli
acgttcctggcagcgatgaactgaa

SEQ ID NO: 58432 - DNA, 25 bp, E. coli
acgttcctggcaccgatgaactgaa

SEQ ID NO: 58433 - DNA, 25 bp, E. coli
tatgagtttacgcacacactgggga

SEQ ID NO: 58434 - DNA, 25 bp, E. coli
tatgagtttacggacacactgggga

SEQ ID NO: 58435 - DNA, 25 bp, E. coli
ttcctggcagcgttgaactgaacgg

SEQ ID NO: 58436 - DNA, 25 bp, E. coli
ttcctggcagcgatgaactgaacgg

SEQ ID NO: 58437 - DNA, 25 bp, E. coli
tgtctcgacgaacgttcctggcagc

SEQ ID NO: 58438 - DNA, 25 bp, E. coli
tgtctcgacgaaggttcctggcagc

SEQ ID NO: 58439 - DNA, 25 bp, E. coli
ctggcagcgatgaactgaacgggat

SEQ ID NO: 58440 - DNA, 25 bp, E. coli
ctggcagcgatgtactgaacgggat

SEQ ID NO: 58441 - DNA, 25 bp, E. coli
gttcctggcagccatgaactgaacg

SEQ ID NO: 58442 - DNA, 25 bp, E. coli
gttcctggcagcgatgaactgaacg

SEQ ID NO: 58443 - DNA, 25 bp, E. coli
gtctcgacgaaccttcctggcagcg

SEQ ID NO: 58444 - DNA, 25 bp, E. coli
gtctcgacgaacgttcctggcagcg

SEQ ID NO: 58445 - DNA, 25 bp, E. coli
caacgtagtgagtattgccccggac

SEQ ID NO: 58446 - DNA, 25 bp, E. coli
caacgtagtgagaattgccccggac

SEQ ID NO: 58447 - DNA, 25 bp, E. coli
agtgagtattgccccggactgcgac

SEQ ID NO: 58448 - DNA, 25 bp, E. coli
agtgagtattgcgccggactgcgac

SEQ ID NO: 58449 - DNA, 25 bp, E. coli
acgtagtgagtattgccccggactg

SEQ ID NO: 58450 - DNA, 25 bp, E. coli
acgtagtgagtaatgccccggactg

SEQ ID NO: 58451 - DNA, 25 bp, E. coli
aacgtagtgagttttgccccggact

SEQ ID NO: 58452 - DNA, 25 bp, E. coli
aacgtagtgagtattgccccggact

SEQ ID NO: 58453 - DNA, 25 bp, E. coli
tttcctcaacgtagtgagtattgcc

SEQ ID NO: 58454 - DNA, 25 bp, E. coli
tttcctcaacgttgtgagtattgcc

SEQ ID NO: 58455 - DNA, 25 bp, E. coli
tcctcaacgtagtgagtattgcccc

SEQ ID NO: 58456 - DNA, 25 bp, E. coli
tcaacgtagtgactattgccccgga

SEQ ID NO: 58457 - DNA, 25 bp, E. coli
tcctcaacgtagagagtattgcccc

SEQ ID NO: 58458 - DNA, 25 bp, E. coli
tcaacgtagtgagtattgccccgga

SEQ ID NO: 58459 - DNA, 25 bp, E. coli
cctcaacgtagtcagtattgccccg

SEQ ID NO: 58460 - DNA, 25 bp, E. coli
cctcaacgtagtgagtattgccccg

SEQ ID NO: 58461 - DNA, 25 bp, E. coli
cgtagtgagtatagccccggactgc

SEQ ID NO: 58462 - DNA, 25 bp, E. coli
cgtagtgagtattgccccggactgc

SEQ ID NO: 58463 - DNA, 25 bp, E. coli
ggctggatttaacgacggtaattga

SEQ ID NO: 58464 - DNA, 25 bp, E. coli
gggctggatttaacgacggtaattg

SEQ ID NO: 58465 - DNA, 25 bp, E. coli
gggctggatttatcgacggtaattg

SEQ ID NO: 58466 - DNA, 25 bp, E. coli
ggctggatttaaggacggtaattga

SEQ ID NO: 58467 - DNA, 25 bp, E. coli
caaccttaatctggtggcgcgtgaa

SEQ ID NO: 58468 - DNA, 25 bp, E. coli
caaccttaatctcgtggcgcgtgaa

SEQ ID NO: 58469 - DNA, 25 bp, E. coli
aaattcgcctgctggttaataccgg

SEQ ID NO: 58470 - DNA, 25 bp, E. coli
aaattcgcctgcaggttaataccgg

SEQ ID NO: 58471 - DNA, 25 bp, E. coli
tatcatgtgggaaacgccgtggcag

SEQ ID NO: 58472 - DNA, 25 bp, E. coli
tatcatgtgggatacgccgtggcag

SEQ ID NO: 58473 - DNA, 25 bp, E. coli
tttaacatgaaagcgttgcaggcgg

SEQ ID NO: 58474 - DNA, 25 bp, E. coli
ttctatcagaaaaggtacaccccgg

SEQ ID NO: 58475 - DNA, 25 bp, E. coli
tttaacatgaaaccgttgcaggcgg

SEQ ID NO: 58476 - DNA, 25 bp, E. coli
ttctatcagaaatggtacaccccgg

SEQ ID NO: 58477 - DNA, 25 bp, E. coli
gctatgtgcagggagatgcgctcca

SEQ ID NO: 58478 - DNA, 25 bp, E. coli
gctatgtgcaggcagatgcgctcca

SEQ ID NO: 58479 - DNA, 25 bp, E. coli
cctggcctgccgttactaaagaggg

SEQ ID NO: 58480 - DNA, 25 bp, E. coli
cctggcctgccgatactaaagaggg

SEQ ID NO: 58481 - DNA, 25 bp, E. coli
taacgcaaagcggtggccttgacgc

SEQ ID NO: 58482 - DNA, 25 bp, E. coli
taatactgctgctgccgaaaggcga

SEQ ID NO: 58483 - DNA, 25 bp, E. coli
taacgcaaagcgctggccttgacgc

SEQ ID NO: 58484 - DNA, 25 bp, E. coli
taatactgctgcagccgaaaggcga

SEQ ID NO: 58485 - DNA, 25 bp, E. coli
gatccgctgaaacaacccgttgaag

SEQ ID NO: 58486 - DNA, 25 bp, E. coli
gatgacgtacatcctgaagtgacgg

SEQ ID NO: 58487 - DNA, 25 bp, E. coli
gatgacgtacatgctgaagtgacgg

SEQ ID NO: 58488 - DNA, 25 bp, E. coli
gatccgctgaaagaacccgttgaag

SEQ ID NO: 58489 - DNA, 25 bp, E. coli
aacgaattattattcgccctgagcg

SEQ ID NO: 58490 - DNA, 25 bp, E. coli
cataaagaagatatggaagcgcgcc

SEQ ID NO: 58491 - DNA, 25 bp, E. coli
cataaagaagatttggaagcgcgcc

SEQ ID NO: 58492 - DNA, 25 bp, E. coli
cattgcccatatcaacgaattatta

SEQ ID NO: 58493 - DNA, 25 bp, E. coli
cattgcccatatgaacgaattatta

SEQ ID NO: 58494 - DNA, 25 bp, E. coli
aacgaattattaatcgccctgagcg

SEQ ID NO: 58495 - DNA, 25 bp, E. coli
tcatcgcgcgcgtggatgccgcgat

SEQ ID NO: 58496 - DNA, 25 bp, E. coli
tcgggaagatcggtacacccagcag

SEQ ID NO: 58497 - DNA, 25 bp, E. coli
tcatcgcgcgcgaggatgccgcgat

SEQ ID NO: 58498 - DNA, 25 bp, E. coli
tcgggaagatcgctacacccagcag

SEQ ID NO: 58499 - DNA, 25 bp, E. coli
gaagagagcgtcattgcccatatga

SEQ ID NO: 58500 - DNA, 25 bp, E. coli
gaagagagcgtctttgcccatatga

SEQ ID NO: 58501 - DNA, 25 bp, E. coli
ccctgagcgatgtcgcggagttaag

SEQ ID NO: 58502 - DNA, 25 bp, E. coli
ccctgagcgatgacgcggagttaag

SEQ ID NO: 58503 - DNA, 25 bp, E. coli
cgtggatgccgccattgaagagagc

SEQ ID NO: 58504 - DNA, 25 bp, E. coli
cgtggatgccgcgattgaagagagc

SEQ ID NO: 58505 - DNA, 25 bp, E. coli
taagtcgggaagttcgctacaccca

SEQ ID NO: 58506 - DNA, 25 bp, E. coli
taatcgccctgaccgatgacgcgga

SEQ ID NO: 58507 - DNA, 25 bp, E. coli
taatcgccctgagcgatgacgcgga

SEQ ID NO: 58508 - DNA, 25 bp, E. coli
taagtcgggaagatcgctacaccca

SEQ ID NO: 58509 - DNA, 25 bp, E. coli
gagttaagtcgggaagatcgctaca

SEQ ID NO: 58510 - DNA, 25 bp, E. coli
gagttaagtcggcaagatcgctaca

SEQ ID NO: 58511 - DNA, 25 bp, E. coli
cacagtggcacgctttttcaacgaa

SEQ ID NO: 58512 - DNA, 25 bp, E. coli
caacgaagtgaaacatgccattgag

SEQ ID NO: 58513 - DNA, 25 bp, E. coli
cacagtggcacggtttttcaacgaa

SEQ ID NO: 58514 - DNA, 25 bp, E. coli
caacgaagtgaatcatgccattgag

SEQ ID NO: 58515 - DNA, 25 bp, E. coli
caaactttttccagtaagcgatgaa

SEQ ID NO: 58516 - DNA, 25 bp, E. coli
caaactttttcctgtaagcgatgaa

SEQ ID NO: 58517 - DNA, 25 bp, E. coli
catgccattgagcttgatgaagctc

SEQ ID NO: 58518 - DNA, 25 bp, E. coli
catgccattgaggttgatgaagctc

SEQ ID NO: 58519 - DNA, 25 bp, E. coli
aggttgatgaaggtctactggcgca

SEQ ID NO: 58520 - DNA, 25 bp, E. coli
aggttgatgaagctctactggcgca

SEQ ID NO: 58521 - DNA, 25 bp, E. coli
ttgatgaagctcaactggcgcaaac

SEQ ID NO: 58522 - DNA, 25 bp, E. coli
ttgatgaagctctactggcgcaaac

SEQ ID NO: 58523 - DNA, 25 bp, E. coli
tgtaacgagcgctcagtggcacgct

SEQ ID NO: 58524 - DNA, 25 bp, E. coli
tgtaacgagcgcacagtggcacgct

SEQ ID NO: 58525 - DNA, 25 bp, E. coli
tccagtaagcgatgaaattaactgg

SEQ ID NO: 58526 - DNA, 25 bp, E. coli
tccagtaagcgaagaaattaactgg

SEQ ID NO: 58527 - DNA, 25 bp, E. coli
gaagtgaatcatcccattgaggttg

SEQ ID NO: 58528 - DNA, 25 bp, E. coli
gaagtgaatcatgccattgaggttg

SEQ ID NO: 58529 - DNA, 25 bp, E. coli
ggacaaacttttaccagtaagcgat

SEQ ID NO: 58530 - DNA, 25 bp, E. coli
ggacaaactttttccagtaagcgat

SEQ ID NO: 58531 - DNA, 25 bp, E. coli
ggcacgctttttcaacgaagtgaat

SEQ ID NO: 58532 - DNA, 25 bp, E. coli
ggcacgctttttgaacgaagtgaat

SEQ ID NO: 58533 - DNA, 25 bp, E. coli
caactttatgcagattgccgccgga

SEQ ID NO: 58534 - DNA, 25 bp, E. coli
caactttatgcacattgccgccgga

SEQ ID NO: 58535 - DNA, 25 bp, E. coli
tatcgaagaactcccgcaggtcatg

SEQ ID NO: 58536 - DNA, 25 bp, E. coli
tatcgaagaactgccgcaggtcatg

SEQ ID NO: 58537 - DNA, 25 bp, E. coli
ttgaataacgaagccgatccgcagg

SEQ ID NO: 58538 - DNA, 25 bp, E. coli
ttgaataacgaacccgatccgcagg

SEQ ID NO: 58539 - DNA, 25 bp, E. coli
ttatcgctcagggaatggcgcgcac

SEQ ID NO: 58540 - DNA, 25 bp, E. coli
ttatcgctcaggcaatggcgcgcac

SEQ ID NO: 58541 - DNA, 25 bp, E. coli
tgatgaccgggccattggcaaaacc

SEQ ID NO: 58542 - DNA, 25 bp, E. coli
tgatgaccgggcgattggcaaaacc

SEQ ID NO: 58543 - DNA, 25 bp, E. coli
tggtgcatcagctacagagtctgtt

SEQ ID NO: 58544 - DNA, 25 bp, E. coli
gccgttgccgcctgtgtcgatgaca

SEQ ID NO: 58545 - DNA, 25 bp, E. coli
ccaactatattttgcaggaggcgga

SEQ ID NO: 58546 - DNA, 25 bp, E. coli
ccaactatatttagcaggaggcgga

SEQ ID NO: 58547 - DNA, 25 bp, E. coli
gccgttgccgccagtgtcgatgaca

SEQ ID NO: 58548 - DNA, 25 bp, E. coli
gaatattcaggacatggcgaccgcc

SEQ ID NO: 58549 - DNA, 25 bp, E. coli
gaatattcaggagatggcgaccgcc

SEQ ID NO: 58550 - DNA, 25 bp, E. coli
gtgtccaatcccgaaagcgtgcgat

SEQ ID NO: 58551 - DNA, 25 bp, E. coli
gtgtccaatccccaaagcgtgcgat

SEQ ID NO: 58552 - DNA, 25 bp, E. coli
ggcccggtgtggatagacattccta

SEQ ID NO: 58553 - DNA, 25 bp, E. coli
ggcccggtgtggttagacattccta

SEQ ID NO: 58554 - DNA, 25 bp, E. coli
tggtgcatcagcaacagagtctgtt

SEQ ID NO: 58555 - DNA, 25 bp, E. coli
caactatcactacatggtgccggag

SEQ ID NO: 58556 - DNA, 25 bp, E. coli
caaaacggttggctacagagctacg

SEQ ID NO: 58557 - DNA, 25 bp, E. coli
caactatcactagatggtgccggag

SEQ ID NO: 58558 - DNA, 25 bp, E. coli
caaaacggttgggtacagagctacg

SEQ ID NO: 58559 - DNA, 25 bp, E. coli
tgaaaagctggtatgccttcgccct

SEQ ID NO: 58560 - DNA, 25 bp, E. coli
tgaaaagctggtttgccttcgccct

SEQ ID NO: 58561 - DNA, 25 bp, E. coli
tcgttcccgcgtgaagatgtcagcc

SEQ ID NO: 58562 - DNA, 25 bp, E. coli
tcgttcccgcgtcaagatgtcagcc

SEQ ID NO: 58563 - DNA, 25 bp, E. coli
tccagggacaggtgaaactgctgct

SEQ ID NO: 58564 - DNA, 25 bp, E. coli
tccagggacaggagaaactgctgct

SEQ ID NO: 58565 - DNA, 25 bp, E. coli
gaactccacgcgtgaagaactgctg

SEQ ID NO: 58566 - DNA, 25 bp, E. coli
gaactccacgcgagaagaactgctg

SEQ ID NO: 58567 - DNA, 25 bp, E. coli
cgctgggccacatggtgaaacctgt

SEQ ID NO: 58568 - DNA, 25 bp, E. coli
cgctgggccacaaggtgaaacctgt

SEQ ID NO: 58569 - DNA, 25 bp, E. coli
ctgggatcaacataagcaagcgggt

SEQ ID NO: 58570 - DNA, 25 bp, E. coli
ctgggatcaacaaaagcaagcgggt

SEQ ID NO: 58571 - DNA, 25 bp, E. coli
tcaatggtcgtatcgtctggcgcgc

SEQ ID NO: 58572 - DNA, 25 bp, E. coli
tcaaactgacctcgacgcagctgct

SEQ ID NO: 58573 - DNA, 25 bp, E. coli
tcaatggtcgtaacgtctggcgcgc

SEQ ID NO: 58574 - DNA, 25 bp, E. coli
tcaaactgacctggacgcagctgct

SEQ ID NO: 58575 - DNA, 25 bp, E. coli
gagcctgctgaacgacattctgccg

SEQ ID NO: 58576 - DNA, 25 bp, E. coli
gagcctgctgaaggacattctgccg

SEQ ID NO: 58577 - DNA, 25 bp, E. coli
aatcacaaaaatgcgcctttttccg

SEQ ID NO: 58578 - DNA, 25 bp, E. coli
aatcacaaaaatccgcctttttccg

SEQ ID NO: 58579 - DNA, 25 bp, E. coli
caaaaaacaaccacaatcatcatct

SEQ ID NO: 58580 - DNA, 25 bp, E. coli
caaaaaacaacctcaatcatcatct

SEQ ID NO: 58581 - DNA, 25 bp, E. coli
catcgcaccggactggcgactatga

SEQ ID NO: 58582 - DNA, 25 bp, E. coli
catcgcaccggagtggcgactatga

SEQ ID NO: 58583 - DNA, 25 bp, E. coli
catcatctttttaatactaacagca

SEQ ID NO: 58584 - DNA, 25 bp, E. coli
catcatcttttttatactaacagca

SEQ ID NO: 58585 - DNA, 25 bp, E. coli
agttaccatcatgatgatgatgacg

SEQ ID NO: 58586 - DNA, 25 bp, E. coli
agttaccatcatcatgatgatgacg

SEQ ID NO: 58587 - DNA, 25 bp, E. coli
aaaatccagtttcttccaccatcgc

SEQ ID NO: 58588 - DNA, 25 bp, E. coli
aaaatccagtttgttccaccatcgc

SEQ ID NO: 58589 - DNA, 25 bp, E. coli
ttaaaaacaacaagttaccatcatg

SEQ ID NO: 58590 - DNA, 25 bp, E. coli
ttaaaaacaacatgttaccatcatg

SEQ ID NO: 58591 - DNA, 25 bp, E. coli
tgccgccatataaagatgtcgaaca

SEQ ID NO: 58592 - DNA, 25 bp, E. coli
tgccgccatatatagatgtcgaaca

SEQ ID NO: 58593 - DNA, 25 bp, E. coli
gacgataaaatcacaaaaatgcgcc

SEQ ID NO: 58594 - DNA, 25 bp, E. coli
gacgataaaatctcaaaaatgcgcc

SEQ ID NO: 58595 - DNA, 25 bp, E. coli
gtcgaacaaaaatcaaccacaatca

SEQ ID NO: 58596 - DNA, 25 bp, E. coli
gtcgaacaaaaaacaaccacaatca

SEQ ID NO: 58597 - DNA, 25 bp, E. coli
ggttatcatttgcaacaaaatccag

SEQ ID NO: 58598 - DNA, 25 bp, E. coli
ggttatcatttggaacaaaatccag

SEQ ID NO: 58599 - DNA, 25 bp, E. coli
cagttcggcagggtttattgttacc

SEQ ID NO: 58600 - DNA, 25 bp, E. coli
cagttcggcaggctttattgttacc

SEQ ID NO: 58601 - DNA, 25 bp, E. coli
aactattacgccgagccattgctcg

SEQ ID NO: 58602 - DNA, 25 bp, E. coli
aactattacgcccagccattgctcg

SEQ ID NO: 58603 - DNA, 25 bp, E. coli
ttaccgccgcgcagttgggctatgc

SEQ ID NO: 58604 - DNA, 25 bp, E. coli
ttaccgccgcgctgttgggctatgc

SEQ ID NO: 58605 - DNA, 25 bp, E. coli
tgattgtctcgaagaccttactggc

SEQ ID NO: 58606 - DNA, 25 bp, E. coli
tgattgtctcgatgaccttactggc

SEQ ID NO: 58607 - DNA, 25 bp, E. coli
tgctgatgtctatcgccaccggtct

SEQ ID NO: 58608 - DNA, 25 bp, E. coli
tgctgatgtctaacgccaccggtct

SEQ ID NO: 58609 - DNA, 25 bp, E. coli
tgctcgacaccatcgcgcgtaactt

SEQ ID NO: 58610 - DNA, 25 bp, E. coli
tgctcgacaccaacgcgcgtaactt

SEQ ID NO: 58611 - DNA, 25 bp, E. coli
cgccgccgcctgtttgtctcgatga

SEQ ID NO: 58612 - DNA, 25 bp, E. coli
cgccgccgcctgattgtctcgatga

SEQ ID NO: 58613 - DNA, 25 bp, E. coli
ctgtttcttgttcccctcggtgata

SEQ ID NO: 58614 - DNA, 25 bp, E. coli
ctgtttcttgttgccctcggtgata

SEQ ID NO: 58615 - DNA, 25 bp, E. coli
ctaatcatgagcttagcccggcgct

SEQ ID NO: 58616 - DNA, 25 bp, E. coli
ctaatcatgagcatagcccggcgct

SEQ ID NO: 58617 - DNA, 25 bp, E. coli
ggtgatatgtttgaacgccgccgcc

SEQ ID NO: 58618 - DNA, 25 bp, E. coli
ggtgatatgtttcaacgccgccgcc

SEQ ID NO: 58619 - DNA, 25 bp, E. coli
tgtctatcgccaccggtctggcggt

SEQ ID NO: 58620 - DNA, 25 bp, E. coli
tgtctatcgccagcggtctggcggt

SEQ ID NO: 58621 - DNA, 25 bp, E. coli
cactgccgcgttaggtactgtgacg

SEQ ID NO: 58622 - DNA, 25 bp, E. coli
cactgccgcgtttggtactgtgacg

SEQ ID NO: 58623 - DNA, 25 bp, E. coli
caactgaacggcttgtgcagcgcca

SEQ ID NO: 58624 - DNA, 25 bp, E. coli
caactgaacggcatgtgcagcgcca

SEQ ID NO: 58625 - DNA, 25 bp, E. coli
caaacggatgctggctgacaagcgt

SEQ ID NO: 58626 - DNA, 25 bp, E. coli
caaacggatgctcgctgacaagcgt

SEQ ID NO: 58627 - DNA, 25 bp, E. coli
taaaaatggcagatacggtcagcga

SEQ ID NO: 58628 - DNA, 25 bp, E. coli
taaaaatggcagttacggtcagcga

SEQ ID NO: 58629 - DNA, 25 bp, E. coli
aaagtgtcattgtcaccggacgcgg

SEQ ID NO: 58630 - DNA, 25 bp, E. coli
aaagtgtcattgacaccggacgcgg

SEQ ID NO: 58631 - DNA, 25 bp, E. coli
tttgataacggctttcaggcccagc

SEQ ID NO: 58632 - DNA, 25 bp, E. coli
tttgataacggcattcaggcccagc

SEQ ID NO: 58633 - DNA, 25 bp, E. coli
tttacctgggagtcacagaaccggc

SEQ ID NO: 58634 - DNA, 25 bp, E. coli
tttacctgggagacacagaaccggc

SEQ ID NO: 58635 - DNA, 25 bp, E. coli
tgaaggaacaggtcgatacgcgcgt

SEQ ID NO: 58636 - DNA, 25 bp, E. coli
tgaaggaacaggacgatacgcgcgt

SEQ ID NO: 58637 - DNA, 25 bp, E. coli
tcttgattgttttcaccggcaacgg

SEQ ID NO: 58638 - DNA, 25 bp, E. coli
tcttgattgtttacaccggcaacgg

SEQ ID NO: 58639 - DNA, 25 bp, E. coli
ggcaacggcaaacggaaatccactg

SEQ ID NO: 58640 - DNA, 25 bp, E. coli
ggcaacggcaaagggaaatccactg

SEQ ID NO: 58641 - DNA, 25 bp, E. coli
tggaagcgcgaatttcaactgaacg

SEQ ID NO: 58642 - DNA, 25 bp, E. coli
tggaagcgcgaaattcaactgaacg

SEQ ID NO: 58643 - DNA, 25 bp, E. coli
tacccaggtacgcaacgagattaca

SEQ ID NO: 58644 - DNA, 25 bp, E. coli
agagcacgctgataatggaccgcag

SEQ ID NO: 58645 - DNA, 25 bp, E. coli
agagcacgctgaaaatggaccgcag

SEQ ID NO: 58646 - DNA, 25 bp, E. coli
aaagtgaacctcaatgcgctgatgc

SEQ ID NO: 58647 - DNA, 25 bp, E. coli
aaagtgaacctctatgcgctgatgc

SEQ ID NO: 58648 - DNA, 25 bp, E. coli
taccgtagcgcctgtgataccggca

SEQ ID NO: 58649 - DNA, 25 bp, E. coli
tacccaggtacggaacgagattaca

SEQ ID NO: 58650 - DNA, 25 bp, E. coli
taccgtagcgccagtgataccggca

SEQ ID NO: 58651 - DNA, 25 bp, E. coli
ttatgtcgcaggctaacccggagct

SEQ ID NO: 58652 - DNA, 25 bp, E. coli
tttattccgcgctacgatgatctga

SEQ ID NO: 58653 - DNA, 25 bp, E. coli
ttatgtcgcagggtaacccggagct

SEQ ID NO: 58654 - DNA, 25 bp, E. coli
tttatcagctgattgcgaaggacgc

SEQ ID NO: 58655 - DNA, 25 bp, E. coli
tttatcagctgaatgcgaaggacgc

SEQ ID NO: 58656 - DNA, 25 bp, E. coli
tttattccgcgcaacgatgatctga

SEQ ID NO: 58657 - DNA, 25 bp, E. coli
tgaaagcccgcatgtcgatgtcagc

SEQ ID NO: 58658 - DNA, 25 bp, E. coli
tgaaagcccgcaagtcgatgtcagc

SEQ ID NO: 58659 - DNA, 25 bp, E. coli
gaagtcagcaaaacgggtcagcagc

SEQ ID NO: 58660 - DNA, 25 bp, E. coli
gaagtcagcaaatcgggtcagcagc

SEQ ID NO: 58661 - DNA, 25 bp, E. coli
gattgattgatctgttgcgcgccaa

SEQ ID NO: 58662 - DNA, 25 bp, E. coli
gattgattgatcagttgcgcgccaa

SEQ ID NO: 58663 - DNA, 25 bp, E. coli
gacgcatcggcattgatactcggaa

SEQ ID NO: 58664 - DNA, 25 bp, E. coli
gacgcatcggcaatgatactcggaa

SEQ ID NO: 58665 - DNA, 25 bp, E. coli
aatcgctaactttatcggcacaccg

SEQ ID NO: 58666 - DNA, 25 bp, E. coli
aatcgctaacttaatcggcacaccg

SEQ ID NO: 58667 - DNA, 25 bp, E. coli
cattttgtacgcgtcattcccggtc

SEQ ID NO: 58668 - DNA, 25 bp, E. coli
cattttgtacgcctcattcccggtc

SEQ ID NO: 58669 - DNA, 25 bp, E. coli
aaatcggttatgagccgaacgtggc

SEQ ID NO: 58670 - DNA, 25 bp, E. coli
aaatcggttatgtgccgaacgtggc

SEQ ID NO: 58671 - DNA, 25 bp, E. coli
tcccggcgtaagattggcccgaaag

SEQ ID NO: 58672 - DNA, 25 bp, E. coli
tcccggcgtaagtttggcccgaaag

SEQ ID NO: 58673 - DNA, 25 bp, E. coli
gcgatggtgcctgctattaccaaaa

SEQ ID NO: 58674 - DNA, 25 bp, E. coli
gcgatggtgcctcctattaccaaaa

SEQ ID NO: 58675 - DNA, 25 bp, E. coli
gaagaaggtctaaatcggcggccta

SEQ ID NO: 58676 - DNA, 25 bp, E. coli
gaagaaggtctatatcggcggccta

SEQ ID NO: 58677 - DNA, 25 bp, E. coli
gaactgctcctatggcgcgatggtg

SEQ ID NO: 58678 - DNA, 25 bp, E. coli
gaactgctcctaaggcgcgatggtg

SEQ ID NO: 58679 - DNA, 25 bp, E. coli
cgcagtcaggcgttttggtaagaag

SEQ ID NO: 58680 - DNA, 25 bp, E. coli
cgcagtcaggcgatttggtaagaag

SEQ ID NO: 58681 - DNA, 25 bp, E. coli
cccggtcacctttttggcaatcgct

SEQ ID NO: 58682 - DNA, 25 bp, E. coli
cccggtcaccttattggcaatcgct

SEQ ID NO: 58683 - DNA, 25 bp, E. coli
cggtgtgttcctgatgcctggcgca

SEQ ID NO: 58684 - DNA, 25 bp, E. coli
cggtgtgttcctcatgcctggcgca

SEQ ID NO: 58685 - DNA, 25 bp, E. coli
ggcatcatgttggattcccggcgta

SEQ ID NO: 58686 - DNA, 25 bp, E. coli
ggcatcatgttgcattcccggcgta

SEQ ID NO: 58687 - DNA, 25 bp, E. coli
aatcaggtggtggatcatttgcgat

SEQ ID NO: 58688 - DNA, 25 bp, E. coli
aatcaggtggtgcatcatttgcgat

SEQ ID NO: 58689 - DNA, 25 bp, E. coli
aatgccccggttcctataacaaaag

SEQ ID NO: 58690 - DNA, 25 bp, E. coli
taaaagacccttgcctgatctggcg

SEQ ID NO: 58691 - DNA, 25 bp, E. coli
taaaagacccttccctgatctggcg

SEQ ID NO: 58692 - DNA, 25 bp, E. coli
aatgccccggttgctataacaaaag

SEQ ID NO: 58693 - DNA, 25 bp, E. coli
tggtcgacggcatatttgtgcagga

SEQ ID NO: 58694 - DNA, 25 bp, E. coli
tgtggacaggctataaactcgacga

SEQ ID NO: 58695 - DNA, 25 bp, E. coli
tgtggacaggctttaaactcgacga

SEQ ID NO: 58696 - DNA, 25 bp, E. coli
tggtcgacggcaaatttgtgcagga

SEQ ID NO: 58697 - DNA, 25 bp, E. coli
tccgcgccgagtgtccgggtaaaga

SEQ ID NO: 58698 - DNA, 25 bp, E. coli
tcgacgaactcaacgctgcgcaaat

SEQ ID NO: 58699 - DNA, 25 bp, E. coli
tcgacgaactcatcgctgcgcaaat

SEQ ID NO: 58700 - DNA, 25 bp, E. coli
tccgcgccgagtctccgggtaaaga

SEQ ID NO: 58701 - DNA, 25 bp, E. coli
tctccgggtgtgttcatgaatgccc

SEQ ID NO: 58702 - DNA, 25 bp, E. coli
tctccgggtgtgatcatgaatgccc

SEQ ID NO: 58703 - DNA, 25 bp, E. coli
tccgcaaaacgtgccggatattctg

SEQ ID NO: 58704 - DNA, 25 bp, E. coli
tccgcaaaacgtcccggatattctg

SEQ ID NO: 58705 - DNA, 25 bp, E. coli
tactatcctgtcgacatcgtcaacg

SEQ ID NO: 58706 - DNA, 25 bp, E. coli
tactatcctgtccacatcgtcaacg

SEQ ID NO: 58707 - DNA, 25 bp, E. coli
ggcgggtaaattgcggtcagccatt

SEQ ID NO: 58708 - DNA, 25 bp, E. coli
ggcgggtaaattccggtcagccatt

SEQ ID NO: 58709 - DNA, 25 bp, E. coli
tacgaacagtggaatgtaccggctg

SEQ ID NO: 58710 - DNA, 25 bp, E. coli
tacgaacagtggtatgtaccggctg

SEQ ID NO: 58711 - DNA, 25 bp, E. coli
taaaaaagccttagcgttgtctggc

SEQ ID NO: 58712 - DNA, 25 bp, E. coli
taaaaaagcctttgcgttgtctggc

SEQ ID NO: 58713 - DNA, 25 bp, E. coli
atttgtcgccagtccgggaggtatc

SEQ ID NO: 58714 - DNA, 25 bp, E. coli
atttgtcgccagaccgggaggtatc

SEQ ID NO: 58715 - DNA, 25 bp, E. coli
taccggctgtatgacttgcgtagag

SEQ ID NO: 58716 - DNA, 25 bp, E. coli
tatgttgtcgccgtacagcgtggtg

SEQ ID NO: 58717 - DNA, 25 bp, E. coli
tatctttgcccatatggcgcgctga

SEQ ID NO: 58718 - DNA, 25 bp, E. coli
taccggctgtatcacttgcgtagag

SEQ ID NO: 58719 - DNA, 25 bp, E. coli
tatgttgtcgccctacagcgtggtg

SEQ ID NO: 58720 - DNA, 25 bp, E. coli
tattgggtgcgctattacgaaacgg

SEQ ID NO: 58721 - DNA, 25 bp, E. coli
tatctttgcccaaatggcgcgctga

SEQ ID NO: 58722 - DNA, 25 bp, E. coli
tattgggtgcgcaattacgaaacgg

SEQ ID NO: 58723 - DNA, 25 bp, E. coli
tgcgtagagtcatgtccggtagcct

SEQ ID NO: 58724 - DNA, 25 bp, E. coli
tgcgtagagtcaagtccggtagcct

SEQ ID NO: 58725 - DNA, 25 bp, E. coli
tctggctggttattgacgctactgg

SEQ ID NO: 58726 - DNA, 25 bp, E. coli
tctggctggttaatgacgctactgg

SEQ ID NO: 58727 - DNA, 25 bp, E. coli
gccgtttaagatacgtcgcaatgcc

SEQ ID NO: 58728 - DNA, 25 bp, E. coli
gccgtttaagattcgtcgcaatgcc

SEQ ID NO: 58729 - DNA, 25 bp, E. coli
ggcaaattaccgaggaatgactggc

SEQ ID NO: 58730 - DNA, 25 bp, E. coli
ggcaaattaccgtggaatgactggc

SEQ ID NO: 58731 - DNA, 25 bp, E. coli
cagcattgtggtcagttaacgtata

SEQ ID NO: 58732 - DNA, 25 bp, E. coli
cagcattgtggtgagttaacgtata

SEQ ID NO: 58733 - DNA, 25 bp, E. coli
caggaattatttatcttgcctatgg

SEQ ID NO: 58734 - DNA, 25 bp, E. coli
caggaattatttttcttgcctatgg

SEQ ID NO: 58735 - DNA, 25 bp, E. coli
atggtcaacctcaacagcattgtgg

SEQ ID NO: 58736 - DNA, 25 bp, E. coli
atggtcaacctctacagcattgtgg

SEQ ID NO: 58737 - DNA, 25 bp, E. coli
tagcgatagcaatcgtcgaatcgtg

SEQ ID NO: 58738 - DNA, 25 bp, E. coli
ttgcctatggattggcttctcccgc

SEQ ID NO: 58739 - DNA, 25 bp, E. coli
ttgcctatggataggcttctcccgc

SEQ ID NO: 58740 - DNA, 25 bp, E. coli
tagcgatagcaaacgtcgaatcgtg

SEQ ID NO: 58741 - DNA, 25 bp, E. coli
tgtggtcagttatcgtataatgttg

SEQ ID NO: 58742 - DNA, 25 bp, E. coli
tgtggtcagttaacgtataatgttg

SEQ ID NO: 58743 - DNA, 25 bp, E. coli
gcagtatggctatggttaatggtca

SEQ ID NO: 58744 - DNA, 25 bp, E. coli
gcaaacgtcgaatcgtgttaaatcg

SEQ ID NO: 58745 - DNA, 25 bp, E. coli
gcagtatggctaaggttaatggtca

SEQ ID NO: 58746 - DNA, 25 bp, E. coli
gcaaacgtcgaaacgtgttaaatcg

SEQ ID NO: 58747 - DNA, 25 bp, E. coli
ggctatggttaatggtcaacctcaa

SEQ ID NO: 58748 - DNA, 25 bp, E. coli
ggctgtcaggaaatatttttcttgc

SEQ ID NO: 58749 - DNA, 25 bp, E. coli
ggctatggttaaaggtcaacctcaa

SEQ ID NO: 58750 - DNA, 25 bp, E. coli
ggctgtcaggaattatttttcttgc

SEQ ID NO: 58751 - DNA, 25 bp, E. coli
tcaacagcattgtggtcagttaacg

SEQ ID NO: 58752 - DNA, 25 bp, E. coli
tcaacagcattgaggtcagttaacg

SEQ ID NO: 58753 - DNA, 25 bp, E. coli
tacatgccggagtattagtggccac

SEQ ID NO: 58754 - DNA, 25 bp, E. coli
tacatgccggagaattagtggccac

SEQ ID NO: 58755 - DNA, 25 bp, E. coli
aaatgtacctttatcctgagccggg

SEQ ID NO: 58756 - DNA, 25 bp, E. coli
aaatgtacctttttcctgagccggg

SEQ ID NO: 58757 - DNA, 25 bp, E. coli
tatagtcagacgttaccgctgcagc

SEQ ID NO: 58758 - DNA, 25 bp, E. coli
tatagtcagacgataccgctgcagc

SEQ ID NO: 58759 - DNA, 25 bp, E. coli
tatatccagacaggtacatgcaggg

SEQ ID NO: 58760 - DNA, 25 bp, E. coli
tattcgcaaatacggcaacatcagg

SEQ ID NO: 58761 - DNA, 25 bp, E. coli
ttaagaaaagcagcgtcctcgaggg

SEQ ID NO: 58762 - DNA, 25 bp, E. coli
tatctcagggtcagacagggaaccg

SEQ ID NO: 58763 - DNA, 25 bp, E. coli
tatctcagggtctgacagggaaccg

SEQ ID NO: 58764 - DNA, 25 bp, E. coli
ttaagaaaagcaccgtcctcgaggg

SEQ ID NO: 58765 - DNA, 25 bp, E. coli
tattcgcaaatagggcaacatcagg

SEQ ID NO: 58766 - DNA, 25 bp, E. coli
tatatccagacacgtacatgcaggg

SEQ ID NO: 58767 - DNA, 25 bp, E. coli
ttgtgcagaaataaccagacagggc

SEQ ID NO: 58768 - DNA, 25 bp, E. coli
ttgtgcagaaattaccagacagggc

SEQ ID NO: 58769 - DNA, 25 bp, E. coli
tgaaggcctcttttgctctgaccgg

SEQ ID NO: 58770 - DNA, 25 bp, E. coli
tgctaaaacatagggaaggctggac

SEQ ID NO: 58771 - DNA, 25 bp, E. coli
tgctaaaacatacggaaggctggac

SEQ ID NO: 58772 - DNA, 25 bp, E. coli
tgaaggcctcttatgctctgaccgg

SEQ ID NO: 58773 - DNA, 25 bp, E. coli
tctctgggacagctaggcagctctc

SEQ ID NO: 58774 - DNA, 25 bp, E. coli
tctctgggacaggtaggcagctctc

SEQ ID NO: 58775 - DNA, 25 bp, E. coli
catataacctgcacaggacgcgaac

SEQ ID NO: 58776 - DNA, 25 bp, E. coli
cagagtgaaagtattttaaatcaag

SEQ ID NO: 58777 - DNA, 25 bp, E. coli
catataacctgctcaggacgcgaac

SEQ ID NO: 58778 - DNA, 25 bp, E. coli
cagagtgaaagttttttaaatcaag

SEQ ID NO: 58779 - DNA, 25 bp, E. coli
tttgtgtttaaatcgcaaattgcga

SEQ ID NO: 58780 - DNA, 25 bp, E. coli
tttgtgtttaaaacgcaaattgcga

SEQ ID NO: 58781 - DNA, 25 bp, E. coli
ttaacaaccatataacctgcacagg

SEQ ID NO: 58782 - DNA, 25 bp, E. coli
ttaacaaccataaaacctgcacagg

SEQ ID NO: 58783 - DNA, 25 bp, E. coli
tcgcaaattgcgttctaaatcaaat

SEQ ID NO: 58784 - DNA, 25 bp, E. coli
tcgcaaattgcgatctaaatcaaat

SEQ ID NO: 58785 - DNA, 25 bp, E. coli
tctgacaagaagataacaaccatat

SEQ ID NO: 58786 - DNA, 25 bp, E. coli
tctgacaagaagttaacaaccatat

SEQ ID NO: 58787 - DNA, 25 bp, E. coli
gcaataattgcctgatttttgggca

SEQ ID NO: 58788 - DNA, 25 bp, E. coli
gcaataattgccagatttttgggca

SEQ ID NO: 58789 - DNA, 25 bp, E. coli
cgttttcgtatactaacagagtgaa

SEQ ID NO: 58790 - DNA, 25 bp, E. coli
cgttttcgtatagtaacagagtgaa

SEQ ID NO: 58791 - DNA, 25 bp, E. coli
tgggcaagataaataacgttttcgt

SEQ ID NO: 58792 - DNA, 25 bp, E. coli
ggccgacataaagtctgacaagaag

SEQ ID NO: 58793 - DNA, 25 bp, E. coli
tgggcaagataattaacgttttcgt

SEQ ID NO: 58794 - DNA, 25 bp, E. coli
ggccgacataaactctgacaagaag

SEQ ID NO: 58795 - DNA, 25 bp, E. coli
taatcggttaaacataaccgcagcg

SEQ ID NO: 58796 - DNA, 25 bp, E. coli
taatcggttaaagataaccgcagcg

SEQ ID NO: 58797 - DNA, 25 bp, E. coli
caaccgtattgctgcgtggatcatt

SEQ ID NO: 58798 - DNA, 25 bp, E. coli
caaccgtattgcagcgtggatcatt

SEQ ID NO: 58799 - DNA, 25 bp, E. coli
aaccgtattgctccgtggatcattg

SEQ ID NO: 58800 - DNA, 25 bp, E. coli
atcaaccgtattcctgcgtggatca

SEQ ID NO: 58801 - DNA, 25 bp, E. coli
atcaaccgtattgctgcgtggatca

SEQ ID NO: 58802 - DNA, 25 bp, E. coli
aaccgtattgctgcgtggatcattg

SEQ ID NO: 58803 - DNA, 25 bp, E. coli
tattgctgcgtggatcattggtaca

SEQ ID NO: 58804 - DNA, 25 bp, E. coli
tatcaaccgtattgctgcgtggatc

SEQ ID NO: 58805 - DNA, 25 bp, E. coli
tatcaaccgtatagctgcgtggatc

SEQ ID NO: 58806 - DNA, 25 bp, E. coli
tattgctgcgtgcatcattggtaca

SEQ ID NO: 58807 - DNA, 25 bp, E. coli
tctatcaaccgtattgctgcgtgga

SEQ ID NO: 58808 - DNA, 25 bp, E. coli
tctatcaaccgttttgctgcgtgga

SEQ ID NO: 58809 - DNA, 25 bp, E. coli
ccgtattgctgcctggatcattggt

SEQ ID NO: 58810 - DNA, 25 bp, E. coli
ccgtattgctgcgtggatcattggt

SEQ ID NO: 58811 - DNA, 25 bp, E. coli
ctatcaaccgtattgctgcgtggat

SEQ ID NO: 58812 - DNA, 25 bp, E. coli
cgtattgctgcgaggatcattggta

SEQ ID NO: 58813 - DNA, 25 bp, E. coli
cgtattgctgcgtggatcattggta

SEQ ID NO: 58814 - DNA, 25 bp, E. coli
ctatcaaccgtaatgctgcgtggat

SEQ ID NO: 58815 - DNA, 25 bp, E. coli
gtattgctgcgtcgatcattggtac

SEQ ID NO: 58816 - DNA, 25 bp, E. coli
gtattgctgcgtggatcattggtac

SEQ ID NO: 58817 - DNA, 25 bp, E. coli
tcaaccgtattgctgcgtggatcat

SEQ ID NO: 58818 - DNA, 25 bp, E. coli
tcaaccgtattggtgcgtggatcat

SEQ ID NO: 58819 - DNA, 25 bp, E. coli
caccagtggtatgggtctgtttatt

SEQ ID NO: 58820 - DNA, 25 bp, E. coli
caccagtggtatcggtctgtttatt

SEQ ID NO: 58821 - DNA, 25 bp, E. coli
catcccggtaagtctacgtgttggc

SEQ ID NO: 58822 - DNA, 25 bp, E. coli
caggtctggctgttgagaaaggtaa

SEQ ID NO: 58823 - DNA, 25 bp, E. coli
caggtctggctgatgagaaaggtaa

SEQ ID NO: 58824 - DNA, 25 bp, E. coli
catcccggtaagactacgtgttggc

SEQ ID NO: 58825 - DNA, 25 bp, E. coli
gcgtatattgaaacttcttccggcg

SEQ ID NO: 58826 - DNA, 25 bp, E. coli
tcttcttccggcctttccgttggcg

SEQ ID NO: 58827 - DNA, 25 bp, E. coli
tcttcttccggcgtttccgttggcg

SEQ ID NO: 58828 - DNA, 25 bp, E. coli
gcgtatattgaatcttcttccggcg

SEQ ID NO: 58829 - DNA, 25 bp, E. coli
ctgatgagaaagctaaattcccgcg

SEQ ID NO: 58830 - DNA, 25 bp, E. coli
ctgatgagaaaggtaaattcccgcg

SEQ ID NO: 58831 - DNA, 25 bp, E. coli
cgtgttggcatctccagtggtatcg

SEQ ID NO: 58832 - DNA, 25 bp, E. coli
cgtgttggcatcaccagtggtatcg

SEQ ID NO: 58833 - DNA, 25 bp, E. coli
tgttacggcgtatattgaatcttct

SEQ ID NO: 58834 - DNA, 25 bp, E. coli
gatagccaacatcccggtaagtcta

SEQ ID NO: 58835 - DNA, 25 bp, E. coli
tgttacggcgtaaattgaatcttct

SEQ ID NO: 58836 - DNA, 25 bp, E. coli
gatagccaacatgccggtaagtcta

SEQ ID NO: 58837 - DNA, 25 bp, E. coli
tggcatcaccagtggtatcggtctg

SEQ ID NO: 58838 - DNA, 25 bp, E. coli
tggcatcaccagaggtatcggtctg

SEQ ID NO: 58839 - DNA, 25 bp, E. coli
taagtctacgtgatggcatcaccag

SEQ ID NO: 58840 - DNA, 25 bp, E. coli
taagtctacgtgttggcatcaccag

SEQ ID NO: 58841 - DNA, 25 bp, E. coli
catgaatgaggctgaaacacaggct

SEQ ID NO: 58842 - DNA, 25 bp, E. coli
catgaatgaggcagaaacacaggct

SEQ ID NO: 58843 - DNA, 25 bp, E. coli
tacacaatggaactgcgacttgccg

SEQ ID NO: 58844 - DNA, 25 bp, E. coli
tacgtcctgatgcaactgttggtgc

SEQ ID NO: 58845 - DNA, 25 bp, E. coli
tacacaatggaagtgcgacttgccg

SEQ ID NO: 58846 - DNA, 25 bp, E. coli
tacgtcctgatggaactgttggtgc

SEQ ID NO: 58847 - DNA, 25 bp, E. coli
tagtacaccttcaaaattcctggcg

SEQ ID NO: 58848 - DNA, 25 bp, E. coli
tagtttcagcgcgaaagaagccgaa

SEQ ID NO: 58849 - DNA, 25 bp, E. coli
tagtacaccttctaaattcctggcg

SEQ ID NO: 58850 - DNA, 25 bp, E. coli
tagtttcagcgccaaagaagccgaa

SEQ ID NO: 58851 - DNA, 25 bp, E. coli
tatacggccagggaaagagccaact

SEQ ID NO: 58852 - DNA, 25 bp, E. coli
tatacggccaggcaaagagccaact

SEQ ID NO: 58853 - DNA, 25 bp, E. coli
ttaactgccatgatcgacgtatgcg

SEQ ID NO: 58854 - DNA, 25 bp, E. coli
ttaactgccatgttcgacgtatgcg

SEQ ID NO: 58855 - DNA, 25 bp, E. coli
cctcgcgatgaactgggtactgaag

SEQ ID NO: 58856 - DNA, 25 bp, E. coli
gcatccggccgtttgttgttaaaca

SEQ ID NO: 58857 - DNA, 25 bp, E. coli
cctcgcgatgaagtgggtactgaag

SEQ ID NO: 58858 - DNA, 25 bp, E. coli
gcatccggccgtatgttgttaaaca

SEQ ID NO: 58859 - DNA, 25 bp, E. coli
taataccagttatcgtgcccgcgag

SEQ ID NO: 58860 - DNA, 25 bp, E. coli
tcaacgggcttttgatgagcgaaca

SEQ ID NO: 58861 - DNA, 25 bp, E. coli
tcaacgggctttagatgagcgaaca

SEQ ID NO: 58862 - DNA, 25 bp, E. coli
taataccagttaacgtgcccgcgag

SEQ ID NO: 58863 - DNA, 25 bp, E. coli
caaaaccatacaaatcagtatgttg

SEQ ID NO: 58864 - DNA, 25 bp, E. coli
caaaaccatacatatcagtatgttg

SEQ ID NO: 58865 - DNA, 25 bp, E. coli
catttggttcctgtcgccggatgcg

SEQ ID NO: 58866 - DNA, 25 bp, E. coli
catttggttcctctcgccggatgcg

SEQ ID NO: 58867 - DNA, 25 bp, E. coli
tacaaaaccatagaaatcagtatgt

SEQ ID NO: 58868 - DNA, 25 bp, E. coli
tacaaaaccatacaaatcagtatgt

SEQ ID NO: 58869 - DNA, 25 bp, E. coli
atccggcatttgcttcctgtcgccg

SEQ ID NO: 58870 - DNA, 25 bp, E. coli
atccggcatttggttcctgtcgccg

SEQ ID NO: 58871 - DNA, 25 bp, E. coli
atttggttcctgtcgccggatgcgg

SEQ ID NO: 58872 - DNA, 25 bp, E. coli
atttggttcctgacgccggatgcgg

SEQ ID NO: 58873 - DNA, 25 bp, E. coli
gcctacaaaaccatacaaatcagta

SEQ ID NO: 58874 - DNA, 25 bp, E. coli
gcctacaaaaccttacaaatcagta

SEQ ID NO: 58875 - DNA, 25 bp, E. coli
gcatttggttccagtcgccggatgc

SEQ ID NO: 58876 - DNA, 25 bp, E. coli
gcatccggcattaggttcctgtcgc

SEQ ID NO: 58877 - DNA, 25 bp, E. coli
gcatccggcatttggttcctgtcgc

SEQ ID NO: 58878 - DNA, 25 bp, E. coli
gcatttggttcctgtcgccggatgc

SEQ ID NO: 58879 - DNA, 25 bp, E. coli
cggcctacaaaagcatacaaatcag

SEQ ID NO: 58880 - DNA, 25 bp, E. coli
cggcatttggttcctgtcgccggat

SEQ ID NO: 58881 - DNA, 25 bp, E. coli
cggcatttggttgctgtcgccggat

SEQ ID NO: 58882 - DNA, 25 bp, E. coli
cggcctacaaaaccatacaaatcag

SEQ ID NO: 58883 - DNA, 25 bp, E. coli
ggcctacaaaaccatacaaatcagt

SEQ ID NO: 58884 - DNA, 25 bp, E. coli
ggcctacaaaacgatacaaatcagt

SEQ ID NO: 58885 - DNA, 25 bp, E. coli
aatattgccagtctatagcgcggcg

SEQ ID NO: 58886 - DNA, 25 bp, E. coli
aatattgccagtgtatagcgcggcg

SEQ ID NO: 58887 - DNA, 25 bp, E. coli
catttcgaatcaacaataggcgcac

SEQ ID NO: 58888 - DNA, 25 bp, E. coli
tacgccatgatattgctaatgctgg

SEQ ID NO: 58889 - DNA, 25 bp, E. coli
acgccacgctctccagaacggtggg

SEQ ID NO: 58890 - DNA, 25 bp, E. coli
acgccacgctctgcagaacggtggg

SEQ ID NO: 58891 - DNA, 25 bp, E. coli
tatgcgggcattacgaatcaacaat

SEQ ID NO: 58892 - DNA, 25 bp, E. coli
tatgcgggcatttcgaatcaacaat

SEQ ID NO: 58893 - DNA, 25 bp, E. coli
tacgccatgataatgctaatgctgg

SEQ ID NO: 58894 - DNA, 25 bp, E. coli
tatcctgcccactcagacaatattg

SEQ ID NO: 58895 - DNA, 25 bp, E. coli
tatcctgcccacacagacaatattg

SEQ ID NO: 58896 - DNA, 25 bp, E. coli
taggcgcactacgttatgggcacca

SEQ ID NO: 58897 - DNA, 25 bp, E. coli
taggcgcactaccttatgggcacca

SEQ ID NO: 58898 - DNA, 25 bp, E. coli
tttacatccttatcgctgtgggcgc

SEQ ID NO: 58899 - DNA, 25 bp, E. coli
tttacatccttaacgctgtgggcgc

SEQ ID NO: 58900 - DNA, 25 bp, E. coli
cgcgtagcacgtaacgccatgatat

SEQ ID NO: 58901 - DNA, 25 bp, E. coli
cgcgtagcacgttacgccatgatat

SEQ ID NO: 58902 - DNA, 25 bp, E. coli
ctccagaacggtcggcgcatgctat

SEQ ID NO: 58903 - DNA, 25 bp, E. coli
ctccagaacggtgggcgcatgctat

SEQ ID NO: 58904 - DNA, 25 bp, E. coli
catttcgaatcatcaataggcgcac

SEQ ID NO: 58905 - DNA, 25 bp, E. coli
taatgctggctgtattcggagcgtg

SEQ ID NO: 58906 - DNA, 25 bp, E. coli
taatgctggctgaattcggagcgtg

SEQ ID NO: 58907 - DNA, 25 bp, E. coli
aactctggtggtacgctggtgcagc

SEQ ID NO: 58908 - DNA, 25 bp, E. coli
aataactctggtcgttcgctggtgc

SEQ ID NO: 58909 - DNA, 25 bp, E. coli
aataactctggtggttcgctggtgc

SEQ ID NO: 58910 - DNA, 25 bp, E. coli
cactcggtgattcgttcatcgtgca

SEQ ID NO: 58911 - DNA, 25 bp, E. coli
cactcggtgattggttcatcgtgca

SEQ ID NO: 58912 - DNA, 25 bp, E. coli
aactctggtggttcgctggtgcagc

SEQ ID NO: 58913 - DNA, 25 bp, E. coli
tatcggcggtatgtgtaataactct

SEQ ID NO: 58914 - DNA, 25 bp, E. coli
tatcggcggtatctgtaataactct

SEQ ID NO: 58915 - DNA, 25 bp, E. coli
tgtaataactctggtggttcgctgg

SEQ ID NO: 58916 - DNA, 25 bp, E. coli
tgtaataactctcgtggttcgctgg

SEQ ID NO: 58917 - DNA, 25 bp, E. coli
tggttcgctggtccagcgtggcccg

SEQ ID NO: 58918 - DNA, 25 bp, E. coli
tgcattggcgcatcggttatcggcg

SEQ ID NO: 58919 - DNA, 25 bp, E. coli
tgcattggcgcaacggttatcggcg

SEQ ID NO: 58920 - DNA, 25 bp, E. coli
tcatcgtgcattcgcgcatcggtta

SEQ ID NO: 58921 - DNA, 25 bp, E. coli
tcatcgtgcattggcgcatcggtta

SEQ ID NO: 58922 - DNA, 25 bp, E. coli
gcggtatctgtaataactctggtgg

SEQ ID NO: 58923 - DNA, 25 bp, E. coli
gcggtatctgtattaactctggtgg

SEQ ID NO: 58924 - DNA, 25 bp, E. coli
gattggttcatcctgcattggcgca

SEQ ID NO: 58925 - DNA, 25 bp, E. coli
gattggttcatcgtgcattggcgca

SEQ ID NO: 58926 - DNA, 25 bp, E. coli
tggcgcatcggtaatcggcggtatc

SEQ ID NO: 58927 - DNA, 25 bp, E. coli
tggcgcatcggttatcggcggtatc

SEQ ID NO: 58928 - DNA, 25 bp, E. coli
tggttcgctggtgcagcgtggcccg

SEQ ID NO: 58929 - DNA, 25 bp, E. coli
aatctgttgctgcattacgtccgca

SEQ ID NO: 58930 - DNA, 25 bp, E. coli
aatctgttgctggattacgtccgca

SEQ ID NO: 58931 - DNA, 25 bp, E. coli
tattattgccggaccgtggatgctc

SEQ ID NO: 58932 - DNA, 25 bp, E. coli
tattattgccggtccgtggatgctc

SEQ ID NO: 58933 - DNA, 25 bp, E. coli
tgacacctgaatgggtcatgatgat

SEQ ID NO: 58934 - DNA, 25 bp, E. coli
tgacacctgaatcggtcatgatgat

SEQ ID NO: 58935 - DNA, 25 bp, E. coli
gccacgcagattaacgaaatgacgc

SEQ ID NO: 58936 - DNA, 25 bp, E. coli
gccacgcagatttacgaaatgacgc

SEQ ID NO: 58937 - DNA, 25 bp, E. coli
gaagcgatgaaagtcgcgctggcac

SEQ ID NO: 58938 - DNA, 25 bp, E. coli
gaagcgatgaaactcgcgctggcac

SEQ ID NO: 58939 - DNA, 25 bp, E. coli
gaaatgacgctgacgtttattccga

SEQ ID NO: 58940 - DNA, 25 bp, E. coli
gaaatgacgctgtcgtttattccga

SEQ ID NO: 58941 - DNA, 25 bp, E. coli
gtttattccgaaaatcatcgccgta

SEQ ID NO: 58942 - DNA, 25 bp, E. coli
gtttattccgaatatcatcgccgta

SEQ ID NO: 58943 - DNA, 25 bp, E. coli
gattacgtccgctccttgttcacta

SEQ ID NO: 58944 - DNA, 25 bp, E. coli
gattacgtccgcaccttgttcacta

SEQ ID NO: 58945 - DNA, 25 bp, E. coli
ggtcacgggccttatcatcagtatt

SEQ ID NO: 58946 - DNA, 25 bp, E. coli
ggtcacgggcctaatcatcagtatt

SEQ ID NO: 58947 - DNA, 25 bp, E. coli
taacctgccgtatatcatcgggtag

SEQ ID NO: 58948 - DNA, 25 bp, E. coli
taacctgccgtaaatcatcgggtag

SEQ ID NO: 58949 - DNA, 25 bp, E. coli
gaccgtggatgcacaatctgttgct

SEQ ID NO: 58950 - DNA, 25 bp, E. coli
gaccgtggatgctcaatctgttgct

SEQ ID NO: 58951 - DNA, 25 bp, E. coli
cgtattgttaatgagggatttatga

SEQ ID NO: 58952 - DNA, 25 bp, E. coli
cgtattgttaatcagggatttatga

SEQ ID NO: 58953 - DNA, 25 bp, E. coli
atttgcggaagcgatgtccactata

SEQ ID NO: 58954 - DNA, 25 bp, E. coli
atttgcggaagccatgtccactata

SEQ ID NO: 58955 - DNA, 25 bp, E. coli
tatgaaaacgatcctggcagcttat

SEQ ID NO: 58956 - DNA, 25 bp, E. coli
tatgaaaacgatgctggcagcttat

SEQ ID NO: 58957 - DNA, 25 bp, E. coli
tatttaccaggaaattcgaccgtcg

SEQ ID NO: 58958 - DNA, 25 bp, E. coli
tatttaccaggatattcgaccgtcg

SEQ ID NO: 58959 - DNA, 25 bp, E. coli
ccaggtactgatgaaaatgaaatcc

SEQ ID NO: 58960 - DNA, 25 bp, E. coli
ccaggtactgatcaaaatgaaatcc

SEQ ID NO: 58961 - DNA, 25 bp, E. coli
gcggaagcgatgaccactatatcta

SEQ ID NO: 58962 - DNA, 25 bp, E. coli
gcggaagcgatgtccactatatcta

SEQ ID NO: 58963 - DNA, 25 bp, E. coli
gaaattcgaccgtcgatctgcggga

SEQ ID NO: 58964 - DNA, 25 bp, E. coli
gaaattcgaccgacgatctgcggga

SEQ ID NO: 58965 - DNA, 25 bp, E. coli
cgaccgtcgatcagcgggaagttgc

SEQ ID NO: 58966 - DNA, 25 bp, E. coli
cgaccgtcgatctgcgggaagttgc

SEQ ID NO: 58967 - DNA, 25 bp, E. coli
gatttatgaaaacgatgctggcagc

SEQ ID NO: 58968 - DNA, 25 bp, E. coli
gatttatgaaaaggatgctggcagc

SEQ ID NO: 58969 - DNA, 25 bp, E. coli
gggattaaccagctactgatcaaaa

SEQ ID NO: 58970 - DNA, 25 bp, E. coli
gggattaaccaggtactgatcaaaa

SEQ ID NO: 58971 - DNA, 25 bp, E. coli
gatgctggcagcatatttaccagga

SEQ ID NO: 58972 - DNA, 25 bp, E. coli
gatgctggcagcttatttaccagga

SEQ ID NO: 58973 - DNA, 25 bp, E. coli
aatagttaccactgcgcatcagcgg

SEQ ID NO: 58974 - DNA, 25 bp, E. coli
aatagttaccacagcgcatcagcgg

SEQ ID NO: 58975 - DNA, 25 bp, E. coli
atcgacagcgacagcgttcagccta

SEQ ID NO: 58976 - DNA, 25 bp, E. coli
agttatcgggcaatccccgccagtg

SEQ ID NO: 58977 - DNA, 25 bp, E. coli
agttatcgggcattccccgccagtg

SEQ ID NO: 58978 - DNA, 25 bp, E. coli
atcgacagcgactgcgttcagccta

SEQ ID NO: 58979 - DNA, 25 bp, E. coli
ttggcaccggcagcctatttaatga

SEQ ID NO: 58980 - DNA, 25 bp, E. coli
ttggcaccggcaccctatttaatga

SEQ ID NO: 58981 - DNA, 25 bp, E. coli
ttaacccgaatgacgcggtgagcgg

SEQ ID NO: 58982 - DNA, 25 bp, E. coli
ttaacccgaatgtcgcggtgagcgg

SEQ ID NO: 58983 - DNA, 25 bp, E. coli
ccttatctgaattttccccaggaag

SEQ ID NO: 58984 - DNA, 25 bp, E. coli
ccttatctgaatattccccaggaag

SEQ ID NO: 58985 - DNA, 25 bp, E. coli
gattatctgcgcgaacgtgttagcg

SEQ ID NO: 58986 - DNA, 25 bp, E. coli
gattatctgcgccaacgtgttagcg

SEQ ID NO: 58987 - DNA, 25 bp, E. coli
ggctggagcacaccctggcaacgct

SEQ ID NO: 58988 - DNA, 25 bp, E. coli
ggctggagcacagcctggcaacgct

SEQ ID NO: 58989 - DNA, 25 bp, E. coli
tcagcctacgcacgcagaactgacg

SEQ ID NO: 58990 - DNA, 25 bp, E. coli
tcaactgcgggccattttgcgcgcc

SEQ ID NO: 58991 - DNA, 25 bp, E. coli
tcaactgcgggcgattttgcgcgcc

SEQ ID NO: 58992 - DNA, 25 bp, E. coli
tcagcctacgcaggcagaactgacg

SEQ ID NO: 58993 - DNA, 25 bp, E. coli
gagcaatttgaaccctaccagcagg

SEQ ID NO: 58994 - DNA, 25 bp, E. coli
gagcaatttgaagcctaccagcagg

SEQ ID NO: 58995 - DNA, 25 bp, E. coli
caaaccacccgataatgaacaccag

SEQ ID NO: 58996 - DNA, 25 bp, E. coli
caaaccacccgaaaatgaacaccag

SEQ ID NO: 58997 - DNA, 25 bp, E. coli
cagactgactcaccgcgtttctggc

SEQ ID NO: 58998 - DNA, 25 bp, E. coli
cagactgactcagcgcgtttctggc

SEQ ID NO: 58999 - DNA, 25 bp, E. coli
taaatcgccacgtgtttaactgaca

SEQ ID NO: 59000 - DNA, 25 bp, E. coli
tatgaatggatatgcactcaaccga

SEQ ID NO: 59001 - DNA, 25 bp, E. coli
tatgaatggataagcactcaaccga

SEQ ID NO: 59002 - DNA, 25 bp, E. coli
tagcataggctaattaccataacgc

SEQ ID NO: 59003 - DNA, 25 bp, E. coli
tagcataggctatttaccataacgc

SEQ ID NO: 59004 - DNA, 25 bp, E. coli
tcatcgggccacttttcgccatcag

SEQ ID NO: 59005 - DNA, 25 bp, E. coli
tcatcgggccacatttcgccatcag

SEQ ID NO: 59006 - DNA, 25 bp, E. coli
gctcttagcggagattagcataggc

SEQ ID NO: 59007 - DNA, 25 bp, E. coli
gcgtttctggcatatccccggtaaa

SEQ ID NO: 59008 - DNA, 25 bp, E. coli
gctcttagcggacattagcataggc

SEQ ID NO: 59009 - DNA, 25 bp, E. coli
gcgtttctggcaaatccccggtaaa

SEQ ID NO: 59010 - DNA, 25 bp, E. coli
gacagccgtattgtggccctcatcg

SEQ ID NO: 59011 - DNA, 25 bp, E. coli
gaaacgcgactttagaatctaccct

SEQ ID NO: 59012 - DNA, 25 bp, E. coli
gaaacgcgacttaagaatctaccct

SEQ ID NO: 59013 - DNA, 25 bp, E. coli
gacagccgtattctggccctcatcg

SEQ ID NO: 59014 - DNA, 25 bp, E. coli
gatataagtaatggacgcactccca

SEQ ID NO: 59015 - DNA, 25 bp, E. coli
gatataagtaatcgacgcactccca

SEQ ID NO: 59016 - DNA, 25 bp, E. coli
taaatcgccacgagtttaactgaca

SEQ ID NO: 59017 - DNA, 25 bp, E. coli
caagccaggtgtccagtgtcagaaa

SEQ ID NO: 59018 - DNA, 25 bp, E. coli
caagccaggtgtgcagtgtcagaaa

SEQ ID NO: 59019 - DNA, 25 bp, E. coli
catgaaccaaatggcggcgtcggtg

SEQ ID NO: 59020 - DNA, 25 bp, E. coli
catgaaccaaatcgcggcgtcggtg

SEQ ID NO: 59021 - DNA, 25 bp, E. coli
tatatgtcgattggtacccgggcga

SEQ ID NO: 59022 - DNA, 25 bp, E. coli
tatatgtcgattcgtacccgggcga

SEQ ID NO: 59023 - DNA, 25 bp, E. coli
tgaacgaacatacccagcagacagt

SEQ ID NO: 59024 - DNA, 25 bp, E. coli
tgaacgaacatagccagcagacagt

SEQ ID NO: 59025 - DNA, 25 bp, E. coli
cctggagcggcaacgtgaaaaatcg

SEQ ID NO: 59026 - DNA, 25 bp, E. coli
cctggagcggcatcgtgaaaaatcg

SEQ ID NO: 59027 - DNA, 25 bp, E. coli
gcgtcacccggatatgccaaaagcg

SEQ ID NO: 59028 - DNA, 25 bp, E. coli
gcgtcacccggaaatgccaaaagcg

SEQ ID NO: 59029 - DNA, 25 bp, E. coli
cgtattcataaacgcctggtggtgc

SEQ ID NO: 59030 - DNA, 25 bp, E. coli
cgtattcataaaggcctggtggtgc

SEQ ID NO: 59031 - DNA, 25 bp, E. coli
ctgatgtttatcatgctggcggcca

SEQ ID NO: 59032 - DNA, 25 bp, E. coli
cattcaacgctggaacaggccgatg

SEQ ID NO: 59033 - DNA, 25 bp, E. coli
ctgatgtttatcttgctggcggcca

SEQ ID NO: 59034 - DNA, 25 bp, E. coli
cattcaacgctgcaacaggccgatg

SEQ ID NO: 59035 - DNA, 25 bp, E. coli
taacgttcagcaaacggtggcgacc

SEQ ID NO: 59036 - DNA, 25 bp, E. coli
taacgttcagcatacggtggcgacc

SEQ ID NO: 59037 - DNA, 25 bp, E. coli
gacccgtgcagtcgatgagcttaac

SEQ ID NO: 59038 - DNA, 25 bp, E. coli
gacccgtgcagtggatgagcttaac

SEQ ID NO: 59039 - DNA, 25 bp, E. coli
caggaaatgcatatgctgacggtaa

SEQ ID NO: 59040 - DNA, 25 bp, E. coli
caggaaatgcatttgctgacggtaa

SEQ ID NO: 59041 - DNA, 25 bp, E. coli
taaattgcctgtccgatctgatcga

SEQ ID NO: 59042 - DNA, 25 bp, E. coli
taaattgcctgtgcgatctgatcga

SEQ ID NO: 59043 - DNA, 25 bp, E. coli
aacttgcaggttagttagggccaca

SEQ ID NO: 59044 - DNA, 25 bp, E. coli
aacttgcaggtttgttagggccaca

SEQ ID NO: 59045 - DNA, 25 bp, E. coli
tattgttagccatttccacccgtgg

SEQ ID NO: 59046 - DNA, 25 bp, E. coli
tattgttagccaattccacccgtgg

SEQ ID NO: 59047 - DNA, 25 bp, E. coli
tgtatgcaaaactggtgcgggcgct

SEQ ID NO: 59048 - DNA, 25 bp, E. coli
tgtatgcaaaacaggtgcgggcgct

SEQ ID NO: 59049 - DNA, 25 bp, E. coli
tgctcaatggcatcaaaatcctctg

SEQ ID NO: 59050 - DNA, 25 bp, E. coli
tgctcaatggcaacaaaatcctctg

SEQ ID NO: 59051 - DNA, 25 bp, E. coli
cctctgttgtggaaatggaacttcc

SEQ ID NO: 59052 - DNA, 25 bp, E. coli
gccgttacgcgtcatatgaccattg

SEQ ID NO: 59053 - DNA, 25 bp, E. coli
cctctgttgtggtaatggaacttcc

SEQ ID NO: 59054 - DNA, 25 bp, E. coli
gccgttacgcgtgatatgaccattg

SEQ ID NO: 59055 - DNA, 25 bp, E. coli
gctgccagcatgatcaaccgtttcg

SEQ ID NO: 59056 - DNA, 25 bp, E. coli
gctgccagcatgttcaaccgtttcg

SEQ ID NO: 59057 - DNA, 25 bp, E. coli
tggaacttccgctgccaatgcacag

SEQ ID NO: 59058 - DNA, 25 bp, E. coli
tggaacttccgcagccaatgcacag

SEQ ID NO: 59059 - DNA, 25 bp, E. coli
tcaaactcaaattgcggcggcagag

SEQ ID NO: 59060 - DNA, 25 bp, E. coli
tcaaactcaaatagcggcggcagag

SEQ ID NO: 59061 - DNA, 25 bp, E. coli
caaggagggcttttgtcactgtcaa

SEQ ID NO: 59062 - DNA, 25 bp, E. coli
caaggagggcttatgtcactgtcaa

SEQ ID NO: 59063 - DNA, 25 bp, E. coli
caatagcggataagaatatccggcg

SEQ ID NO: 59064 - DNA, 25 bp, E. coli
caatagcggatatgaatatccggcg

SEQ ID NO: 59065 - DNA, 25 bp, E. coli
cacataatggtgactcaaggagggc

SEQ ID NO: 59066 - DNA, 25 bp, E. coli
cacataatggtgtctcaaggagggc

SEQ ID NO: 59067 - DNA, 25 bp, E. coli
aaagaagctcgcgatcgcgtgcgca

SEQ ID NO: 59068 - DNA, 25 bp, E. coli
aaagaagctcgccatcgcgtgcgca

SEQ ID NO: 59069 - DNA, 25 bp, E. coli
tggtgggcttaccagaaacaacggt

SEQ ID NO: 59070 - DNA, 25 bp, E. coli
tggtgggcttacgagaaacaacggt

SEQ ID NO: 59071 - DNA, 25 bp, E. coli
tgtcaattgttcttacccgcgcagc

SEQ ID NO: 59072 - DNA, 25 bp, E. coli
tgtcaattgttcatacccgcgcagc

SEQ ID NO: 59073 - DNA, 25 bp, E. coli
gaaacaacggtaaaagaagctcgcg

SEQ ID NO: 59074 - DNA, 25 bp, E. coli
gaaacaacggtataagaagctcgcg

SEQ ID NO: 59075 - DNA, 25 bp, E. coli
cgtgcgcagcgcgattatcaatagc

SEQ ID NO: 59076 - DNA, 25 bp, E. coli
gcttaacgatggagggcttaccaga

SEQ ID NO: 59077 - DNA, 25 bp, E. coli
ctggcggcctcacaacagcttacag

SEQ ID NO: 59078 - DNA, 25 bp, E. coli
cgcagccctgggtgtaaatgcgccc

SEQ ID NO: 59079 - DNA, 25 bp, E. coli
cgcagccctgggagtaaatgcgccc

SEQ ID NO: 59080 - DNA, 25 bp, E. coli
gcttaacgatggtgggcttaccaga

SEQ ID NO: 59081 - DNA, 25 bp, E. coli
cgtgcgcagcgccattatcaatagc

SEQ ID NO: 59082 - DNA, 25 bp, E. coli
ctggcggcctcagaacagcttacag

SEQ ID NO: 59083 - DNA, 25 bp, E. coli
cagaagaggtgggaactgcgcttaa

SEQ ID NO: 59084 - DNA, 25 bp, E. coli
cagaagaggtggcaactgcgcttaa

SEQ ID NO: 59085 - DNA, 25 bp, E. coli
cagatgaaattattcgtcaggacgt

SEQ ID NO: 59086 - DNA, 25 bp, E. coli
cagatgaaattaatcgtcaggacgt

SEQ ID NO: 59087 - DNA, 25 bp, E. coli
caggcaggaggtactcatttccgaa

SEQ ID NO: 59088 - DNA, 25 bp, E. coli
caggcaggaggttctcatttccgaa

SEQ ID NO: 59089 - DNA, 25 bp, E. coli
aaaaataaacttgatggaactgcca

SEQ ID NO: 59090 - DNA, 25 bp, E. coli
aaaaataaacttcatggaactgcca

SEQ ID NO: 59091 - DNA, 25 bp, E. coli
tgttatctgcactaccattgtcgcc

SEQ ID NO: 59092 - DNA, 25 bp, E. coli
tgttatctgcacaaccattgtcgcc

SEQ ID NO: 59093 - DNA, 25 bp, E. coli
tcgcccttggtcacattctgacagg

SEQ ID NO: 59094 - DNA, 25 bp, E. coli
tccgaatcacttcattgggaggaaa

SEQ ID NO: 59095 - DNA, 25 bp, E. coli
tcgcccttggtctcattctgacagg

SEQ ID NO: 59096 - DNA, 25 bp, E. coli
tccgaatcacttgattgggaggaaa

SEQ ID NO: 59097 - DNA, 25 bp, E. coli
tctgacaggctaggcaactgctgca

SEQ ID NO: 59098 - DNA, 25 bp, E. coli
tcaggacgttgttggtttgatgccg

SEQ ID NO: 59099 - DNA, 25 bp, E. coli
tcaggacgttgtaggtttgatgccg

SEQ ID NO: 59100 - DNA, 25 bp, E. coli
tctgacaggctacgcaactgctgca

SEQ ID NO: 59101 - DNA, 25 bp, E. coli
cgcttaaagacaaagcggagcaggc

SEQ ID NO: 59102 - DNA, 25 bp, E. coli
cgcttaaagacatagcggagcaggc

SEQ ID NO: 59103 - DNA, 25 bp, E. coli
ggtaatctatattcaccagaagagg

SEQ ID NO: 59104 - DNA, 25 bp, E. coli
ggtaatctatatacaccagaagagg

SEQ ID NO: 59105 - DNA, 25 bp, E. coli
aatgcgttgtggttatttaaagaga

SEQ ID NO: 59106 - DNA, 25 bp, E. coli
aatgcgttgtggatatttaaagaga

SEQ ID NO: 59107 - DNA, 25 bp, E. coli
catgacgttttaggagtgcgctcga

SEQ ID NO: 59108 - DNA, 25 bp, E. coli
catgacgttttacgagtgcgctcga

SEQ ID NO: 59109 - DNA, 25 bp, E. coli
tactgccgtaataaatcccttattc

SEQ ID NO: 59110 - DNA, 25 bp, E. coli
tactgccgtaattaatcccttattc

SEQ ID NO: 59111 - DNA, 25 bp, E. coli
ttaaagagagtttacgatggcaggg

SEQ ID NO: 59112 - DNA, 25 bp, E. coli
ttaaagagagttaacgatggcaggg

SEQ ID NO: 59113 - DNA, 25 bp, E. coli
tcctgcaatgtaagtctgccttaca

SEQ ID NO: 59114 - DNA, 25 bp, E. coli
tcctgcaatgtatgtctgccttaca

SEQ ID NO: 59115 - DNA, 25 bp, E. coli
tgcgctcgaagaaaagatttaaagg

SEQ ID NO: 59116 - DNA, 25 bp, E. coli
tgcgctcgaagataagatttaaagg

SEQ ID NO: 59117 - DNA, 25 bp, E. coli
tctgccttacatgacgttttacgag

SEQ ID NO: 59118 - DNA, 25 bp, E. coli
tcatcgcccacgattactgccgtaa

SEQ ID NO: 59119 - DNA, 25 bp, E. coli
tcatcgcccacgtttactgccgtaa

SEQ ID NO: 59120 - DNA, 25 bp, E. coli
tctgccttacatcacgttttacgag

SEQ ID NO: 59121 - DNA, 25 bp, E. coli
cgagtgcgctcgtagaaaagattta

SEQ ID NO: 59122 - DNA, 25 bp, E. coli
cgagtgcgctcgaagaaaagattta

SEQ ID NO: 59123 - DNA, 25 bp, E. coli
gatttaaaggtagatcaatgcgttg

SEQ ID NO: 59124 - DNA, 25 bp, E. coli
gatttaaaggtacatcaatgcgttg

SEQ ID NO: 59125 - DNA, 25 bp, E. coli
taatcccttattcctgcaatgtatg

SEQ ID NO: 59126 - DNA, 25 bp, E. coli
taatcccttattgctgcaatgtatg

SEQ ID NO: 59127 - DNA, 25 bp, E. coli
ttctggatgtttccccgtgccctgg

SEQ ID NO: 59128 - DNA, 25 bp, E. coli
ttctggatgtttgcccgtgccctgg

SEQ ID NO: 59129 - DNA, 25 bp, E. coli
ttatcgcggtaattatcaccgcgca

SEQ ID NO: 59130 - DNA, 25 bp, E. coli
ttatgcggcgcgctctgtaccagag

SEQ ID NO: 59131 - DNA, 25 bp, E. coli
ttatgcggcgcggtctgtaccagag

SEQ ID NO: 59132 - DNA, 25 bp, E. coli
ttatcgcggtaaatatcaccgcgca

SEQ ID NO: 59133 - DNA, 25 bp, E. coli
tcatggttttcagcttctggatgtt

SEQ ID NO: 59134 - DNA, 25 bp, E. coli
tcatggttttcaccttctggatgtt

SEQ ID NO: 59135 - DNA, 25 bp, E. coli
cctggcgttgctggtggacacgtta

SEQ ID NO: 59136 - DNA, 25 bp, E. coli
cctgaatccgtttatcatggttttc

SEQ ID NO: 59137 - DNA, 25 bp, E. coli
cctggcgttgctcgtggacacgtta

SEQ ID NO: 59138 - DNA, 25 bp, E. coli
cctgaatccgttaatcatggttttc

SEQ ID NO: 59139 - DNA, 25 bp, E. coli
gcggcgcggtctgtaccagagaaaa

SEQ ID NO: 59140 - DNA, 25 bp, E. coli
gcggcgcggtctctaccagagaaaa

SEQ ID NO: 59141 - DNA, 25 bp, E. coli
gtacttatcgcggtaaatatcaccg

SEQ ID NO: 59142 - DNA, 25 bp, E. coli
gtacttatcgcgctaaatatcaccg

SEQ ID NO: 59143 - DNA, 25 bp, E. coli
ttacccctgaatgcgttaatcatgg

SEQ ID NO: 59144 - DNA, 25 bp, E. coli
ttacccctgaatccgttaatcatgg

SEQ ID NO: 59145 - DNA, 25 bp, E. coli
tcagcttctggatgtttgcccgtgc

SEQ ID NO: 59146 - DNA, 25 bp, E. coli
tcagcttctggaagtttgcccgtgc

SEQ ID NO: 59147 - DNA, 25 bp, E. coli
gatgtttgcccgagccctggcgttg

SEQ ID NO: 59148 - DNA, 25 bp, E. coli
gatgtttgcccgtgccctggcgttg

SEQ ID NO: 59149 - DNA, 25 bp, E. coli
agcctggtggtcaggttttgcctga

SEQ ID NO: 59150 - DNA, 25 bp, E. coli
agcctggtggtctggttttgcctga

SEQ ID NO: 59151 - DNA, 25 bp, E. coli
tagtcattgtctccacctgggaagc

SEQ ID NO: 59152 - DNA, 25 bp, E. coli
tagtcattgtctgcacctgggaagc

SEQ ID NO: 59153 - DNA, 25 bp, E. coli
ttttgcctgatttaagccgccgtgg

SEQ ID NO: 59154 - DNA, 25 bp, E. coli
ttttgcctgattaaagccgccgtgg

SEQ ID NO: 59155 - DNA, 25 bp, E. coli
tgggaagcaattaaccggagtacct

SEQ ID NO: 59156 - DNA, 25 bp, E. coli
tgggaagcaatttaccggagtacct

SEQ ID NO: 59157 - DNA, 25 bp, E. coli
gccgccgtgggtatttgtccaagaa

SEQ ID NO: 59158 - DNA, 25 bp, E. coli
gccgccgtgggtttttgtccaagaa

SEQ ID NO: 59159 - DNA, 25 bp, E. coli
gctccaatcgttatggcctggtgaa

SEQ ID NO: 59160 - DNA, 25 bp, E. coli
gctccaatcgttttggcctggtgaa

SEQ ID NO: 59161 - DNA, 25 bp, E. coli
ctggtgtactttatcgcgctggcgc

SEQ ID NO: 59162 - DNA, 25 bp, E. coli
ctggtgtactttttcgcgctggcgc

SEQ ID NO: 59163 - DNA, 25 bp, E. coli
ggagtacctcacactacggcaaaaa

SEQ ID NO: 59164 - DNA, 25 bp, E. coli
ggagtacctcactctacggcaaaaa

SEQ ID NO: 59165 - DNA, 25 bp, E. coli
ggcgctcaagcatggataatgcgat

SEQ ID NO: 59166 - DNA, 25 bp, E. coli
ggcgctcaagcaaggataatgcgat

SEQ ID NO: 59167 - DNA, 25 bp, E. coli
taatgcgattgcgtgtagttcttcg

SEQ ID NO: 59168 - DNA, 25 bp, E. coli
taatgcgattgcctgtagttcttcg

SEQ ID NO: 59169 - DNA, 25 bp, E. coli
gatgggttaagctaagactctcgtt

SEQ ID NO: 59170 - DNA, 25 bp, E. coli
gatgggttaagcaaagactctcgtt

SEQ ID NO: 59171 - DNA, 25 bp, E. coli
cagttgatactgtcggcgcgggcaa

SEQ ID NO: 59172 - DNA, 25 bp, E. coli
cagttgatactgacggcgcgggcaa

SEQ ID NO: 59173 - DNA, 25 bp, E. coli
aaacacgcctcggtgaatggctcaa

SEQ ID NO: 59174 - DNA, 25 bp, E. coli
aaacacgcctcgctgaatggctcaa

SEQ ID NO: 59175 - DNA, 25 bp, E. coli
tgtgatcatcaccaccggcagttcg

SEQ ID NO: 59176 - DNA, 25 bp, E. coli
tgtacctcgctaaagttactggcgc

SEQ ID NO: 59177 - DNA, 25 bp, E. coli
tgtgatcatcacgaccggcagttcg

SEQ ID NO: 59178 - DNA, 25 bp, E. coli
tgtacctcgctatagttactggcgc

SEQ ID NO: 59179 - DNA, 25 bp, E. coli
tgagcaacaacaaagatcactcggt

SEQ ID NO: 59180 - DNA, 25 bp, E. coli
tgagcaacaacatagatcactcggt

SEQ ID NO: 59181 - DNA, 25 bp, E. coli
tcgtcgactcgcacgaacttaacgg

SEQ ID NO: 59182 - DNA, 25 bp, E. coli
tcgtcgactcgctcgaacttaacgg

SEQ ID NO: 59183 - DNA, 25 bp, E. coli
gcagttcggcgcctatgagcaacaa

SEQ ID NO: 59184 - DNA, 25 bp, E. coli
gcagttcggcgcgtatgagcaacaa

SEQ ID NO: 59185 - DNA, 25 bp, E. coli
ctgccgtggtgggtatcgtcgactc

SEQ ID NO: 59186 - DNA, 25 bp, E. coli
ctgccgtggtggctatcgtcgactc

SEQ ID NO: 59187 - DNA, 25 bp, E. coli
gatcactcggtgattgacgctgccg

SEQ ID NO: 59188 - DNA, 25 bp, E. coli
gatcactcggtgtttgacgctgccg

SEQ ID NO: 59189 - DNA, 25 bp, E. coli
tggcgcggctcgatgaaaactatca

SEQ ID NO: 59190 - DNA, 25 bp, E. coli
tggcgcggctcgttgaaaactatca

SEQ ID NO: 59191 - DNA, 25 bp, E. coli
tcaaaactgctgttagtggcgcggc

SEQ ID NO: 59192 - DNA, 25 bp, E. coli
tcaaaactgctgatagtggcgcggc

SEQ ID NO: 59193 - DNA, 25 bp, E. coli
catcgaaagatggtaaaggtgattt

SEQ ID NO: 59194 - DNA, 25 bp, E. coli
catcgaaagatgctaaaggtgattt

SEQ ID NO: 59195 - DNA, 25 bp, E. coli
acgtctggatgctgcgttacaagat

SEQ ID NO: 59196 - DNA, 25 bp, E. coli
acgtctggatgcagcgttacaagat

SEQ ID NO: 59197 - DNA, 25 bp, E. coli
tagtcggtctctccacagcggcttc

SEQ ID NO: 59198 - DNA, 25 bp, E. coli
tagtcggtctctgcacagcggcttc

SEQ ID NO: 59199 - DNA, 25 bp, E. coli
tttgttagtcggtctctccacagcg

SEQ ID NO: 59200 - DNA, 25 bp, E. coli
tttgttagtcggactctccacagcg

SEQ ID NO: 59201 - DNA, 25 bp, E. coli
ttgattgcggccaaaggttcaccga

SEQ ID NO: 59202 - DNA, 25 bp, E. coli
ttgattgcggcctaaggttcaccga

SEQ ID NO: 59203 - DNA, 25 bp, E. coli
tgcgttacaagatgaagttgctgcc

SEQ ID NO: 59204 - DNA, 25 bp, E. coli
tgcgttacaagaagaagttgctgcc

SEQ ID NO: 59205 - DNA, 25 bp, E. coli
gcagattctcgtttgattgcggcca

SEQ ID NO: 59206 - DNA, 25 bp, E. coli
gctatgcggcgctaccggagacggt

SEQ ID NO: 59207 - DNA, 25 bp, E. coli
gcagattctcgtatgattgcggcca

SEQ ID NO: 59208 - DNA, 25 bp, E. coli
gctatgcggcgcaaccggagacggt

SEQ ID NO: 59209 - DNA, 25 bp, E. coli
cgcaccgttctcatcgaaagatgct

SEQ ID NO: 59210 - DNA, 25 bp, E. coli
cgcaccgttctcttcgaaagatgct

SEQ ID NO: 59211 - DNA, 25 bp, E. coli
gattctcgtttgtttgcggccaaag

SEQ ID NO: 59212 - DNA, 25 bp, E. coli
gattctcgtttgattgcggccaaag

SEQ ID NO: 59213 - DNA, 25 bp, E. coli
gatgctaaaggtcattttgttggct

SEQ ID NO: 59214 - DNA, 25 bp, E. coli
gatgctaaaggtgattttgttggct

SEQ ID NO: 59215 - DNA, 25 bp, E. coli
caagttcagtgacatcgaatgccgg

SEQ ID NO: 59216 - DNA, 25 bp, E. coli
caagttcagtgagatcgaatgccgg

SEQ ID NO: 59217 - DNA, 25 bp, E. coli
caacgatttaacctgcgaagccgac

SEQ ID NO: 59218 - DNA, 25 bp, E. coli
caacgatttaacgtgcgaagccgac

SEQ ID NO: 59219 - DNA, 25 bp, E. coli
cacccttggcagttgcggctacgta

SEQ ID NO: 59220 - DNA, 25 bp, E. coli
cacccttggcagatgcggctacgta

SEQ ID NO: 59221 - DNA, 25 bp, E. coli
tatcctccagatggaatcgatgctg

SEQ ID NO: 59222 - DNA, 25 bp, E. coli
tatcctccagatcgaatcgatgctg

SEQ ID NO: 59223 - DNA, 25 bp, E. coli
gcaaccgactgcattatctggctga

SEQ ID NO: 59224 - DNA, 25 bp, E. coli
gcaaccgactgctttatctggctga

SEQ ID NO: 59225 - DNA, 25 bp, E. coli
cgaatgccggaagctggatgaaaca

SEQ ID NO: 59226 - DNA, 25 bp, E. coli
cgaatgccggaacctggatgaaaca

SEQ ID NO: 59227 - DNA, 25 bp, E. coli
gggccagcatcaccggcaagttcag

SEQ ID NO: 59228 - DNA, 25 bp, E. coli
gtctggtgcaggtaggcaaccgact

SEQ ID NO: 59229 - DNA, 25 bp, E. coli
gggccagcatcagcggcaagttcag

SEQ ID NO: 59230 - DNA, 25 bp, E. coli
ggagattacactgcgcctgggagcc

SEQ ID NO: 59231 - DNA, 25 bp, E. coli
gtctggtgcaggaaggcaaccgact

SEQ ID NO: 59232 - DNA, 25 bp, E. coli
ggcctgcagcggcagattacactgc

SEQ ID NO: 59233 - DNA, 25 bp, E. coli
tggatgaaacatacccgcactttat

SEQ ID NO: 59234 - DNA, 25 bp, E. coli
ggcctgcagcgggagattacactgc

SEQ ID NO: 59235 - DNA, 25 bp, E. coli
tggatgaaacattcccgcactttat

SEQ ID NO: 59236 - DNA, 25 bp, E. coli
ggagattacactccgcctgggagcc

SEQ ID NO: 59237 - DNA, 25 bp, E. coli
tacagcctgcaacattgtattgcct

SEQ ID NO: 59238 - DNA, 25 bp, E. coli
tacagcctgcaagattgtattgcct

SEQ ID NO: 59239 - DNA, 25 bp, E. coli
aaaacttctgccactggagcaggcg

SEQ ID NO: 59240 - DNA, 25 bp, E. coli
aaaacttctgcctctggagcaggcg

SEQ ID NO: 59241 - DNA, 25 bp, E. coli
tggtcaacgacaacccggagatcat

SEQ ID NO: 59242 - DNA, 25 bp, E. coli
tggtcaacgacatcccggagatcat

SEQ ID NO: 59243 - DNA, 25 bp, E. coli
tgcattatgggcagcgcgcatcaac

SEQ ID NO: 59244 - DNA, 25 bp, E. coli
tgcattatgggctgcgcgcatcaac

SEQ ID NO: 59245 - DNA, 25 bp, E. coli
cctttggcgatggaatgaacgatgc

SEQ ID NO: 59246 - DNA, 25 bp, E. coli
ccagtgacctgtatggcgtggtcaa

SEQ ID NO: 59247 - DNA, 25 bp, E. coli
cctttggcgatgcaatgaacgatgc

SEQ ID NO: 59248 - DNA, 25 bp, E. coli
ccagtgacctgtttggcgtggtcaa

SEQ ID NO: 59249 - DNA, 25 bp, E. coli
gaaagatctgcatccagagctggaa

SEQ ID NO: 59250 - DNA, 25 bp, E. coli
gaaagatctgcaaccagagctggaa

SEQ ID NO: 59251 - DNA, 25 bp, E. coli
cgattcccatgataaacttctgcca

SEQ ID NO: 59252 - DNA, 25 bp, E. coli
cgcatcaacggcagaaagatctgca

SEQ ID NO: 59253 - DNA, 25 bp, E. coli
cgccgaagacgctgtgccgcattat

SEQ ID NO: 59254 - DNA, 25 bp, E. coli
cgattcccatgaaaaacttctgcca

SEQ ID NO: 59255 - DNA, 25 bp, E. coli
cgcatcaacggctgaaagatctgca

SEQ ID NO: 59256 - DNA, 25 bp, E. coli
cgccgaagacgcagtgccgcattat

SEQ ID NO: 59257 - DNA, 25 bp, E. coli
gattggtactaacgccgaagacgca

SEQ ID NO: 59258 - DNA, 25 bp, E. coli
gattggtactaaggccgaagacgca

SEQ ID NO: 59259 - DNA, 25 bp, E. coli
caaaggcccttcagctgcaaacgta

SEQ ID NO: 59260 - DNA, 25 bp, E. coli
caaaggcccttctgctgcaaacgta

SEQ ID NO: 59261 - DNA, 25 bp, E. coli
tactccggaagacggcagcaaagac

SEQ ID NO: 59262 - DNA, 25 bp, E. coli
tactccggaagagggcagcaaagac

SEQ ID NO: 59263 - DNA, 25 bp, E. coli
aaactcttgctgtaggtcagcgcgt

SEQ ID NO: 59264 - DNA, 25 bp, E. coli
aatcactaacggtgccaaaggccct

SEQ ID NO: 59265 - DNA, 25 bp, E. coli
aaactcttgctgaaggtcagcgcgt

SEQ ID NO: 59266 - DNA, 25 bp, E. coli
aatcactaacggagccaaaggccct

SEQ ID NO: 59267 - DNA, 25 bp, E. coli
tagagttcgaaatcactaacggtgc

SEQ ID NO: 59268 - DNA, 25 bp, E. coli
tagagttcgaaaacactaacggtgc

SEQ ID NO: 59269 - DNA, 25 bp, E. coli
taatgagtccaatggattcggtttc

SEQ ID NO: 59270 - DNA, 25 bp, E. coli
taatgagtccaaaggattcggtttc

SEQ ID NO: 59271 - DNA, 25 bp, E. coli
tctgctgcaaacctaatcgctctgt

SEQ ID NO: 59272 - DNA, 25 bp, E. coli
tctgctgcaaacgtaatcgctctgt

SEQ ID NO: 59273 - DNA, 25 bp, E. coli
tccagactaatgcttttaaaactct

SEQ ID NO: 59274 - DNA, 25 bp, E. coli
tccagactaatggttttaaaactct

SEQ ID NO: 59275 - DNA, 25 bp, E. coli
gattcggtttcattactccggaaga

SEQ ID NO: 59276 - DNA, 25 bp, E. coli
gtacacttctctgcaatccagacta

SEQ ID NO: 59277 - DNA, 25 bp, E. coli
gattcggtttcaatactccggaaga

SEQ ID NO: 59278 - DNA, 25 bp, E. coli
ggtcagcgcgtagagttcgaaatca

SEQ ID NO: 59279 - DNA, 25 bp, E. coli
ggtcagcgcgtacagttcgaaatca

SEQ ID NO: 59280 - DNA, 25 bp, E. coli
gtacacttctctccaatccagacta

SEQ ID NO: 59281 - DNA, 25 bp, E. coli
aattttgcgtgctttagcattcaca

SEQ ID NO: 59282 - DNA, 25 bp, E. coli
aatcactcgaacctatttaatgctg

SEQ ID NO: 59283 - DNA, 25 bp, E. coli
aattttgcgtgcattagcattcaca

SEQ ID NO: 59284 - DNA, 25 bp, E. coli
aatcactcgaacgtatttaatgctg

SEQ ID NO: 59285 - DNA, 25 bp, E. coli
tgtcaatcggtttattttgcgtgct

SEQ ID NO: 59286 - DNA, 25 bp, E. coli
tgtcaatcggttaattttgcgtgct

SEQ ID NO: 59287 - DNA, 25 bp, E. coli
tgctttagcattgacatctatccag

SEQ ID NO: 59288 - DNA, 25 bp, E. coli
tgctttagcattcacatctatccag

SEQ ID NO: 59289 - DNA, 25 bp, E. coli
tcgaacctattttatgctgagcatt

SEQ ID NO: 59290 - DNA, 25 bp, E. coli
tcggttaattttgcgtgctttagca

SEQ ID NO: 59291 - DNA, 25 bp, E. coli
tcggttaattttccgtgctttagca

SEQ ID NO: 59292 - DNA, 25 bp, E. coli
tcgaacctatttaatgctgagcatt

SEQ ID NO: 59293 - DNA, 25 bp, E. coli
gctgagcattgtcaatcggttaatt

SEQ ID NO: 59294 - DNA, 25 bp, E. coli
gctgagcattgtgaatcggttaatt

SEQ ID NO: 59295 - DNA, 25 bp, E. coli
gaataatctgattttgtttgactac

SEQ ID NO: 59296 - DNA, 25 bp, E. coli
gaataatctgatattgtttgactac

SEQ ID NO: 59297 - DNA, 25 bp, E. coli
gactacaaattaatcactcgaacct

SEQ ID NO: 59298 - DNA, 25 bp, E. coli
gactacaaattattcactcgaacct

SEQ ID NO: 59299 - DNA, 25 bp, E. coli
gtttgactacaaattaatcactcga

SEQ ID NO: 59300 - DNA, 25 bp, E. coli
gtttgactacaatttaatcactcga

SEQ ID NO: 59301 - DNA, 25 bp, E. coli
taatgctgagcattgtcaatcggtt

SEQ ID NO: 59302 - DNA, 25 bp, E. coli
taatgctgagcaatgtcaatcggtt

SEQ ID NO: 59303 - DNA, 25 bp, E. coli
caaagctggcgaattgcaccaggtc

SEQ ID NO: 59304 - DNA, 25 bp, E. coli
caaagctggcgatttgcaccaggtc

SEQ ID NO: 59305 - DNA, 25 bp, E. coli
tatctccagcgctgcttatccgcga

SEQ ID NO: 59306 - DNA, 25 bp, E. coli
tatctccagcgcagcttatccgcga

SEQ ID NO: 59307 - DNA, 25 bp, E. coli
tgtcgccgctgtaggcaattctggc

SEQ ID NO: 59308 - DNA, 25 bp, E. coli
tgtcgccgctgttggcaattctggc

SEQ ID NO: 59309 - DNA, 25 bp, E. coli
tcgctgcgggcatactgactgcaaa

SEQ ID NO: 59310 - DNA, 25 bp, E. coli
tgccaatgtgactgttaaagccgac

SEQ ID NO: 59311 - DNA, 25 bp, E. coli
tcgctgcgggcaaactgactgcaaa

SEQ ID NO: 59312 - DNA, 25 bp, E. coli
tgccaatgtgacagttaaagccgac

SEQ ID NO: 59313 - DNA, 25 bp, E. coli
ccattactggcgacatgacaccgtt

SEQ ID NO: 59314 - DNA, 25 bp, E. coli
ccattactggcgtcatgacaccgtt

SEQ ID NO: 59315 - DNA, 25 bp, E. coli
gaatatcggcattactaccgccgcg

SEQ ID NO: 59316 - DNA, 25 bp, E. coli
gaatatcggcataactaccgccgcg

SEQ ID NO: 59317 - DNA, 25 bp, E. coli
cgtactcgcattgcggtattcgcaa

SEQ ID NO: 59318 - DNA, 25 bp, E. coli
cgtactcgcattccggtattcgcaa

SEQ ID NO: 59319 - DNA, 25 bp, E. coli
gatacgccattcacgcaggtctgct

SEQ ID NO: 59320 - DNA, 25 bp, E. coli
gatacgccattctcgcaggtctgct

SEQ ID NO: 59321 - DNA, 25 bp, E. coli
tcacaacagccgttgcgagcatgat

SEQ ID NO: 59322 - DNA, 25 bp, E. coli
tcacaacagccgatgcgagcatgat

SEQ ID NO: 59323 - DNA, 25 bp, E. coli
gatgcgcgaagtattcatccgccag

SEQ ID NO: 59324 - DNA, 25 bp, E. coli
gatgcgcgaagttttcatccgccag

SEQ ID NO: 59325 - DNA, 25 bp, E. coli
aattagcgcgccagctggtgcaact

SEQ ID NO: 59326 - DNA, 25 bp, E. coli
aattagcgcgcctgctggtgcaact

SEQ ID NO: 59327 - DNA, 25 bp, E. coli
caccgggccgtgatgcgtcaaaata

SEQ ID NO: 59328 - DNA, 25 bp, E. coli
caccgggccgtgttgcgtcaaaata

SEQ ID NO: 59329 - DNA, 25 bp, E. coli
aggacgtattgacacagcaggcgct

SEQ ID NO: 59330 - DNA, 25 bp, E. coli
aggacgtattgagacagcaggcgct

SEQ ID NO: 59331 - DNA, 25 bp, E. coli
ttcaacctgatagcggcgaatgtcg

SEQ ID NO: 59332 - DNA, 25 bp, E. coli
ttcaacctgataccggcgaatgtcg

SEQ ID NO: 59333 - DNA, 25 bp, E. coli
tgtctcgctgacttttcccggtggg

SEQ ID NO: 59334 - DNA, 25 bp, E. coli
tgtctcgctgacatttcccggtggg

SEQ ID NO: 59335 - DNA, 25 bp, E. coli
tgcgggaaaatctacgctgcttcgc

SEQ ID NO: 59336 - DNA, 25 bp, E. coli
tgcgggaaaatcaacgctgcttcgc

SEQ ID NO: 59337 - DNA, 25 bp, E. coli
tcttgatgaaccaacttcggcgctg

SEQ ID NO: 59338 - DNA, 25 bp, E. coli
tcttgatgaacctacttcggcgctg

SEQ ID NO: 59339 - DNA, 25 bp, E. coli
gactgtcaggcgatagcaaaccgcg

SEQ ID NO: 59340 - DNA, 25 bp, E. coli
gactgtcaggcgttagcaaaccgcg

SEQ ID NO: 59341 - DNA, 25 bp, E. coli
gattactgaactcgcgaaacaccgg

SEQ ID NO: 59342 - DNA, 25 bp, E. coli
gattactgaactggcgaaacaccgg

SEQ ID NO: 59343 - DNA, 25 bp, E. coli
ggatattcaccatcagcagcacttg

SEQ ID NO: 59344 - DNA, 25 bp, E. coli
ggatattcaccaacagcagcacttg

SEQ ID NO: 59345 - DNA, 25 bp, E. coli
taatggcgttatgtgactgtcaggc

SEQ ID NO: 59346 - DNA, 25 bp, E. coli
taatggcgttatctgactgtcaggc

SEQ ID NO: 59347 - DNA, 25 bp, E. coli
aatgcgtaacagaatggcggtggcc

SEQ ID NO: 59348 - DNA, 25 bp, E. coli
aatgcgtaacagtatggcggtggcc

SEQ ID NO: 59349 - DNA, 25 bp, E. coli
tactcggcgtgcaatatgcccgtgc

SEQ ID NO: 59350 - DNA, 25 bp, E. coli
tactcggcgtgctatatgcccgtgc

SEQ ID NO: 59351 - DNA, 25 bp, E. coli
tagtggtcggcaatatcctcaacat

SEQ ID NO: 59352 - DNA, 25 bp, E. coli
tagtggtcggcattatcctcaacat

SEQ ID NO: 59353 - DNA, 25 bp, E. coli
ttaattgcgctggtgcgtacgccga

SEQ ID NO: 59354 - DNA, 25 bp, E. coli
ttaattgcgctgctgcgtacgccga

SEQ ID NO: 59355 - DNA, 25 bp, E. coli
gcccgtgcgccagtaattttgttag

SEQ ID NO: 59356 - DNA, 25 bp, E. coli
gcccgtgcgccactaattttgttag

SEQ ID NO: 59357 - DNA, 25 bp, E. coli
ccgattatcgatgtggcgctgcata

SEQ ID NO: 59358 - DNA, 25 bp, E. coli
ccgattatcgatctggcgctgcata

SEQ ID NO: 59359 - DNA, 25 bp, E. coli
gactgcgcaggcatatggtgccaaa

SEQ ID NO: 59360 - DNA, 25 bp, E. coli
gaaatccgctggttaagcgcaccgg

SEQ ID NO: 59361 - DNA, 25 bp, E. coli
gactgcgcaggcttatggtgccaaa

SEQ ID NO: 59362 - DNA, 25 bp, E. coli
gaaatccgctggataagcgcaccgg

SEQ ID NO: 59363 - DNA, 25 bp, E. coli
cgtcgttaaccctgattcagcagct

SEQ ID NO: 59364 - DNA, 25 bp, E. coli
cgtcgttaacccagattcagcagct

SEQ ID NO: 59365 - DNA, 25 bp, E. coli
gtttttacgcatcagcaccaccggg

SEQ ID NO: 59366 - DNA, 25 bp, E. coli
gtttttacgcatgagcaccaccggg

SEQ ID NO: 59367 - DNA, 25 bp, E. coli
ggcatgtttataggcgcaacgcgtg

SEQ ID NO: 59368 - DNA, 25 bp, E. coli
ggcatgtttatacgcgcaacgcgtg

SEQ ID NO: 59369 - DNA, 25 bp, E. coli
taaagcagtgaaacaggtggtgtat

SEQ ID NO: 59370 - DNA, 25 bp, E. coli
taaagcagtgaatcaggtggtgtat

SEQ ID NO: 59371 - DNA, 25 bp, E. coli
aagcatccctaatgcagtgaatcag

SEQ ID NO: 59372 - DNA, 25 bp, E. coli
aacattgcgtaggaaagtgaattaa

SEQ ID NO: 59373 - DNA, 25 bp, E. coli
aacattgcgtagcaaagtgaattaa

SEQ ID NO: 59374 - DNA, 25 bp, E. coli
aagcatccctaaagcagtgaatcag

SEQ ID NO: 59375 - DNA, 25 bp, E. coli
tgtttgtggcgtttaaaacattgcg

SEQ ID NO: 59376 - DNA, 25 bp, E. coli
tgtttgtggcgtataaaacattgcg

SEQ ID NO: 59377 - DNA, 25 bp, E. coli
tgagaaagccagtatcaataacctc

SEQ ID NO: 59378 - DNA, 25 bp, E. coli
tgagaaagccagaatcaataacctc

SEQ ID NO: 59379 - DNA, 25 bp, E. coli
tccggaaaaaagcatccctaaagca

SEQ ID NO: 59380 - DNA, 25 bp, E. coli
tccctaaagcagagaatcaggtggt

SEQ ID NO: 59381 - DNA, 25 bp, E. coli
tccctaaagcagtgaatcaggtggt

SEQ ID NO: 59382 - DNA, 25 bp, E. coli
tccggaaaaaaggatccctaaagca

SEQ ID NO: 59383 - DNA, 25 bp, E. coli
gcgtttaaaacaatgcgtaggaaag

SEQ ID NO: 59384 - DNA, 25 bp, E. coli
gcgtttaaaacattgcgtaggaaag

SEQ ID NO: 59385 - DNA, 25 bp, E. coli
cggcggtgagaaagccagtatcaat

SEQ ID NO: 59386 - DNA, 25 bp, E. coli
cggcggtgagaatgccagtatcaat

SEQ ID NO: 59387 - DNA, 25 bp, E. coli
ggattgtgttccagtttgtggcgtt

SEQ ID NO: 59388 - DNA, 25 bp, E. coli
ggattgtgttcctgtttgtggcgtt

SEQ ID NO: 59389 - DNA, 25 bp, E. coli
ggaaaaaagcatgcctaaagcagtg

SEQ ID NO: 59390 - DNA, 25 bp, E. coli
ggaaaaaagcatccctaaagcagtg

SEQ ID NO: 59391 - DNA, 25 bp, E. coli
taaatcgggaaggttgtacgcaatg

SEQ ID NO: 59392 - DNA, 25 bp, E. coli
taaatcgggaagcttgtacgcaatg

SEQ ID NO: 59393 - DNA, 25 bp, E. coli
aaaggcctgatagggcttcgctcac

SEQ ID NO: 59394 - DNA, 25 bp, E. coli
aaaggcctgatacggcttcgctcac

SEQ ID NO: 59395 - DNA, 25 bp, E. coli
ttatctactgacgaaaaaggcctga

SEQ ID NO: 59396 - DNA, 25 bp, E. coli
ttatctactgaccaaaaaggcctga

SEQ ID NO: 59397 - DNA, 25 bp, E. coli
tccgtaaaaagataacgcgcctgcc

SEQ ID NO: 59398 - DNA, 25 bp, E. coli
tccgtaaaaagaaaacgcgcctgcc

SEQ ID NO: 59399 - DNA, 25 bp, E. coli
gctcactatacaaccttggctgcag

SEQ ID NO: 59400 - DNA, 25 bp, E. coli
gctcactatacatccttggctgcag

SEQ ID NO: 59401 - DNA, 25 bp, E. coli
cgcaataggtaaacaagggaggaag

SEQ ID NO: 59402 - DNA, 25 bp, E. coli
cgcaataggtaatcaagggaggaag

SEQ ID NO: 59403 - DNA, 25 bp, E. coli
gtagcaggcgcaatacgcaataggt

SEQ ID NO: 59404 - DNA, 25 bp, E. coli
gtagcaggcgcattacgcaataggt

SEQ ID NO: 59405 - DNA, 25 bp, E. coli
ggttgcatgattctttgtccgtaaa

SEQ ID NO: 59406 - DNA, 25 bp, E. coli
ggaagttcagaaatgtaaatcggga

SEQ ID NO: 59407 - DNA, 25 bp, E. coli
ggttgcatgattgtttgtccgtaaa

SEQ ID NO: 59408 - DNA, 25 bp, E. coli
tggcaatgtgttgaataaagctcga

SEQ ID NO: 59409 - DNA, 25 bp, E. coli
ggctgcaggttttgttgtacaccac

SEQ ID NO: 59410 - DNA, 25 bp, E. coli
ggctgcaggtttagttgtacaccac

SEQ ID NO: 59411 - DNA, 25 bp, E. coli
tggcaatgtgttcaataaagctcga

SEQ ID NO: 59412 - DNA, 25 bp, E. coli
ggaagttcagaattgtaaatcggga

SEQ ID NO: 59413 - DNA, 25 bp, E. coli
caggtcgcagcgctaaaggaaaacg

SEQ ID NO: 59414 - DNA, 25 bp, E. coli
caggtcgcagcggtaaaggaaaacg

SEQ ID NO: 59415 - DNA, 25 bp, E. coli
aatttcaggtcggagcgctaaagga

SEQ ID NO: 59416 - DNA, 25 bp, E. coli
aatttcaggtcgcagcgctaaagga

SEQ ID NO: 59417 - DNA, 25 bp, E. coli
atacagtcgctgtttctgccgccac

SEQ ID NO: 59418 - DNA, 25 bp, E. coli
atacagtcgctgattctgccgccac

SEQ ID NO: 59419 - DNA, 25 bp, E. coli
gaaaggcggaatatcaggtcgcagc

SEQ ID NO: 59420 - DNA, 25 bp, E. coli
gaaaggcggaatttcaggtcgcagc

SEQ ID NO: 59421 - DNA, 25 bp, E. coli
cgaagaactgatccactatgtgccg

SEQ ID NO: 59422 - DNA, 25 bp, E. coli
cgaagaactgatgcactatgtgccg

SEQ ID NO: 59423 - DNA, 25 bp, E. coli
cattgacactgacattaagctcaac

SEQ ID NO: 59424 - DNA, 25 bp, E. coli
cattgacactgagattaagctcaac

SEQ ID NO: 59425 - DNA, 25 bp, E. coli
cgtgatgccatacagtcgctgattc

SEQ ID NO: 59426 - DNA, 25 bp, E. coli
cggaatttcaggtcgcagcgctaaa

SEQ ID NO: 59427 - DNA, 25 bp, E. coli
cggaatttcaggacgcagcgctaaa

SEQ ID NO: 59428 - DNA, 25 bp, E. coli
cgtgatgccatagagtcgctgattc

SEQ ID NO: 59429 - DNA, 25 bp, E. coli
gattgaggaaaaccgtgatgccata

SEQ ID NO: 59430 - DNA, 25 bp, E. coli
gattgaggaaaagcgtgatgccata

SEQ ID NO: 59431 - DNA, 25 bp, E. coli
ggcggaatttcacgtcgcagcgcta

SEQ ID NO: 59432 - DNA, 25 bp, E. coli
tggcggaaaccctgctggagagcct

SEQ ID NO: 59433 - DNA, 25 bp, E. coli
ggcggaatttcaggtcgcagcgcta

SEQ ID NO: 59434 - DNA, 25 bp, E. coli
tggcggaaacccagctggagagcct

SEQ ID NO: 59435 - DNA, 25 bp, E. coli
aatatcagcactaggttctggaggg

SEQ ID NO: 59436 - DNA, 25 bp, E. coli
aatatcagcacttggttctggaggg

SEQ ID NO: 59437 - DNA, 25 bp, E. coli
cactctaagaggaggagaaattagg

SEQ ID NO: 59438 - DNA, 25 bp, E. coli
cactctaagaggtggagaaattagg

SEQ ID NO: 59439 - DNA, 25 bp, E. coli
caggagatatagacactctaagagg

SEQ ID NO: 59440 - DNA, 25 bp, E. coli
caggagatatagtcactctaagagg

SEQ ID NO: 59441 - DNA, 25 bp, E. coli
ttacaataaacaacgaatcagggca

SEQ ID NO: 59442 - DNA, 25 bp, E. coli
ttacaataaacatcgaatcagggca

SEQ ID NO: 59443 - DNA, 25 bp, E. coli
tgttaagtataacacaggaatcact

SEQ ID NO: 59444 - DNA, 25 bp, E. coli
tgttaagtataagacaggaatcact

SEQ ID NO: 59445 - DNA, 25 bp, E. coli
tcagggcatttgatagtcaataccg

SEQ ID NO: 59446 - DNA, 25 bp, E. coli
tcagggcatttgttagtcaataccg

SEQ ID NO: 59447 - DNA, 25 bp, E. coli
cgtctgcagatacaggagatattac

SEQ ID NO: 59448 - DNA, 25 bp, E. coli
cgtctgcagatagaggagatattac

SEQ ID NO: 59449 - DNA, 25 bp, E. coli
gtcaataccgcaattctatcaggag

SEQ ID NO: 59450 - DNA, 25 bp, E. coli
ggtattatagctagtgcgcgccatg

SEQ ID NO: 59451 - DNA, 25 bp, E. coli
gtcaataccgcatttctatcaggag

SEQ ID NO: 59452 - DNA, 25 bp, E. coli
ggtattatagcttgtgcgcgccatg

SEQ ID NO: 59453 - DNA, 25 bp, E. coli
ggaatcacttataacgataatcagt

SEQ ID NO: 59454 - DNA, 25 bp, E. coli
ggaatcacttattacgataatcagt

SEQ ID NO: 59455 - DNA, 25 bp, E. coli
gatgcatttaagttatcgtctgcag

SEQ ID NO: 59456 - DNA, 25 bp, E. coli
gatgcatttaagatatcgtctgcag

SEQ ID NO: 59457 - DNA, 25 bp, E. coli
cagcaactgtggtgcctgccaaaag

SEQ ID NO: 59458 - DNA, 25 bp, E. coli
catgaagaggtgcttgatcagacca

SEQ ID NO: 59459 - DNA, 25 bp, E. coli
catgaagaggtggttgatcagacca

SEQ ID NO: 59460 - DNA, 25 bp, E. coli
cagcaactgtggagcctgccaaaag

SEQ ID NO: 59461 - DNA, 25 bp, E. coli
taactatggtggtacttgcctgcgc

SEQ ID NO: 59462 - DNA, 25 bp, E. coli
taactatggtggaacttgcctgcgc

SEQ ID NO: 59463 - DNA, 25 bp, E. coli
tatgccgttaaaccgattgccgggc

SEQ ID NO: 59464 - DNA, 25 bp, E. coli
tatgccgttaaagcgattgccgggc

SEQ ID NO: 59465 - DNA, 25 bp, E. coli
tatctgttggatactgacttcaccg

SEQ ID NO: 59466 - DNA, 25 bp, E. coli
tattgaagagaactatcacgctcag

SEQ ID NO: 59467 - DNA, 25 bp, E. coli
tatctgttggattctgacttcaccg

SEQ ID NO: 59468 - DNA, 25 bp, E. coli
tattgaagagaagtatcacgctcag

SEQ ID NO: 59469 - DNA, 25 bp, E. coli
tgagctggtgaaaaccggttatgcc

SEQ ID NO: 59470 - DNA, 25 bp, E. coli
tgagctggtgaataccggttatgcc

SEQ ID NO: 59471 - DNA, 25 bp, E. coli
ccgggcgctgtggtagcaacattga

SEQ ID NO: 59472 - DNA, 25 bp, E. coli
ccgggcgctgtgctagcaacattga

SEQ ID NO: 59473 - DNA, 25 bp, E. coli
gacttcaccgtgtatgatgagctgg

SEQ ID NO: 59474 - DNA, 25 bp, E. coli
gaaagacaccttcgatgacaccact

SEQ ID NO: 59475 - DNA, 25 bp, E. coli
gaaagtctacgattacaacgccgat

SEQ ID NO: 59476 - DNA, 25 bp, E. coli
gaaagtctacgaatacaacgccgat

SEQ ID NO: 59477 - DNA, 25 bp, E. coli
gaaagacaccttggatgacaccact

SEQ ID NO: 59478 - DNA, 25 bp, E. coli
gacttcaccgtgaatgatgagctgg

SEQ ID NO: 59479 - DNA, 25 bp, E. coli
cagggctgtcatttagttattccac

SEQ ID NO: 59480 - DNA, 25 bp, E. coli
cagggctgtcatatagttattccac

SEQ ID NO: 59481 - DNA, 25 bp, E. coli
tattccacataaacccgaagagatg

SEQ ID NO: 59482 - DNA, 25 bp, E. coli
tattactggaacgagggaaaacgca

SEQ ID NO: 59483 - DNA, 25 bp, E. coli
tattccacataatcccgaagagatg

SEQ ID NO: 59484 - DNA, 25 bp, E. coli
tattactggaaccagggaaaacgca

SEQ ID NO: 59485 - DNA, 25 bp, E. coli
ttgttccgatcatccctgggtacaa

SEQ ID NO: 59486 - DNA, 25 bp, E. coli
ttgttccgatcaaccctgggtacaa

SEQ ID NO: 59487 - DNA, 25 bp, E. coli
tgactggcaaatcagcgaattaacc

SEQ ID NO: 59488 - DNA, 25 bp, E. coli
tgactggcaaatgagcgaattaacc

SEQ ID NO: 59489 - DNA, 25 bp, E. coli
cctgggtacaaatttatagcggtga

SEQ ID NO: 59490 - DNA, 25 bp, E. coli
cctgggtacaaaattatagcggtga

SEQ ID NO: 59491 - DNA, 25 bp, E. coli
gctcgcctggcgagactggcaaatc

SEQ ID NO: 59492 - DNA, 25 bp, E. coli
gctcgcctggcgtgactggcaaatc

SEQ ID NO: 59493 - DNA, 25 bp, E. coli
gctggcacatctgggcaaagtcctt

SEQ ID NO: 59494 - DNA, 25 bp, E. coli
gctggcacatctcggcaaagtcctt

SEQ ID NO: 59495 - DNA, 25 bp, E. coli
gaatattggtactgtgaccgcaccc

SEQ ID NO: 59496 - DNA, 25 bp, E. coli
gaatattggtacagtgaccgcaccc

SEQ ID NO: 59497 - DNA, 25 bp, E. coli
gagatcgcaagtcagaatattggta

SEQ ID NO: 59498 - DNA, 25 bp, E. coli
gaccgcaccctatggtgtgggtatt

SEQ ID NO: 59499 - DNA, 25 bp, E. coli
gaccgcaccctaaggtgtgggtatt

SEQ ID NO: 59500 - DNA, 25 bp, E. coli
gagatcgcaagtgagaatattggta

SEQ ID NO: 59501 - DNA, 25 bp, E. coli
caaggtttttatccaggcccaatgt

SEQ ID NO: 59502 - DNA, 25 bp, E. coli
caaggtttttatgcaggcccaatgt

SEQ ID NO: 59503 - DNA, 25 bp, E. coli
aaggtgatgttatttaatatcaagg

SEQ ID NO: 59504 - DNA, 25 bp, E. coli
aaggtgatgttaattaatatcaagg

SEQ ID NO: 59505 - DNA, 25 bp, E. coli
tagatctgtccggttctttatggat

SEQ ID NO: 59506 - DNA, 25 bp, E. coli
tagatctgtccgcttctttatggat

SEQ ID NO: 59507 - DNA, 25 bp, E. coli
tttttataaaactagatctgtccgg

SEQ ID NO: 59508 - DNA, 25 bp, E. coli
ttcgcctctggcgatggtgttgcat

SEQ ID NO: 59509 - DNA, 25 bp, E. coli
tttttataaaacaagatctgtccgg

SEQ ID NO: 59510 - DNA, 25 bp, E. coli
ttcgcctctggccatggtgttgcat

SEQ ID NO: 59511 - DNA, 25 bp, E. coli
gccatggtgttgcatttcatactga

SEQ ID NO: 59512 - DNA, 25 bp, E. coli
gccatggtgttggatttcatactga

SEQ ID NO: 59513 - DNA, 25 bp, E. coli
ccggttctttatggattcattcgga

SEQ ID NO: 59514 - DNA, 25 bp, E. coli
ccggttctttatcgattcattcgga

SEQ ID NO: 59515 - DNA, 25 bp, E. coli
ggatatattttacgatttaaggtga

SEQ ID NO: 59516 - DNA, 25 bp, E. coli
ggattcattcggttatattttacga

SEQ ID NO: 59517 - DNA, 25 bp, E. coli
gggaataacattatcgcctctggcc

SEQ ID NO: 59518 - DNA, 25 bp, E. coli
ggattcattcggatatattttacga

SEQ ID NO: 59519 - DNA, 25 bp, E. coli
ggtttttatgcacgcccaatgttta

SEQ ID NO: 59520 - DNA, 25 bp, E. coli
gggaataacattttcgcctctggcc

SEQ ID NO: 59521 - DNA, 25 bp, E. coli
ggatatattttaggatttaaggtga

SEQ ID NO: 59522 - DNA, 25 bp, E. coli
ggtttttatgcaggcccaatgttta

SEQ ID NO: 59523 - DNA, 25 bp, E. coli
aacgcgtctgggttacctgcgcgag

SEQ ID NO: 59524 - DNA, 25 bp, E. coli
aacgcgtctgggatacctgcgcgag

SEQ ID NO: 59525 - DNA, 25 bp, E. coli
aactgctgaaagacagccgtctggg

SEQ ID NO: 59526 - DNA, 25 bp, E. coli
aaccgtcagcaagtgctgaaagtca

SEQ ID NO: 59527 - DNA, 25 bp, E. coli
caccgcttctgtaccgctattaact

SEQ ID NO: 59528 - DNA, 25 bp, E. coli
caccgcttctgttccgctattaact

SEQ ID NO: 59529 - DNA, 25 bp, E. coli
aaacgcgtctggcatacctgcgcga

SEQ ID NO: 59530 - DNA, 25 bp, E. coli
aaacgcgtctgggatacctgcgcga

SEQ ID NO: 59531 - DNA, 25 bp, E. coli
aaccgtcagcaactgctgaaagtca

SEQ ID NO: 59532 - DNA, 25 bp, E. coli
aactgctgaaagtcagccgtctggg

SEQ ID NO: 59533 - DNA, 25 bp, E. coli
tctgggatacctgcgcgagctggaa

SEQ ID NO: 59534 - DNA, 25 bp, E. coli
tctgggatacctccgcgagctggaa

SEQ ID NO: 59535 - DNA, 25 bp, E. coli
tcagcaactgctgaaagtcagccgt

SEQ ID NO: 59536 - DNA, 25 bp, E. coli
gcaactgctgaatgtcagccgtctg

SEQ ID NO: 59537 - DNA, 25 bp, E. coli
gcaactgctgaaagtcagccgtctg

SEQ ID NO: 59538 - DNA, 25 bp, E. coli
cgcgtctgggatacctgcgcgagct

SEQ ID NO: 59539 - DNA, 25 bp, E. coli
cgcgtctgggattcctgcgcgagct

SEQ ID NO: 59540 - DNA, 25 bp, E. coli
ctggaaacgcgtgtgggatacctgc

SEQ ID NO: 59541 - DNA, 25 bp, E. coli
ctggaaacgcgtctgggatacctgc

SEQ ID NO: 59542 - DNA, 25 bp, E. coli
ggaaacgcgtctcggatacctgcgc

SEQ ID NO: 59543 - DNA, 25 bp, E. coli
ggaaacgcgtctgggatacctgcgc

SEQ ID NO: 59544 - DNA, 25 bp, E. coli
tcagcaactgctcaaagtcagccgt

SEQ ID NO: 59545 - DNA, 25 bp, E. coli
tacagcaactctctgatggataatt

SEQ ID NO: 59546 - DNA, 25 bp, E. coli
tacagcaactctgtgatggataatt

SEQ ID NO: 59547 - DNA, 25 bp, E. coli
tatcccaccaggtacaaccttgctg

SEQ ID NO: 59548 - DNA, 25 bp, E. coli
tatcccaccaggaacaaccttgctg

SEQ ID NO: 59549 - DNA, 25 bp, E. coli
tgagcgataagttcatcctcgctta

SEQ ID NO: 59550 - DNA, 25 bp, E. coli
tgagcgataagtacatcctcgctta

SEQ ID NO: 59551 - DNA, 25 bp, E. coli
gcaactctctgaaggataatttcat

SEQ ID NO: 59552 - DNA, 25 bp, E. coli
gcaactctctgatggataatttcat

SEQ ID NO: 59553 - DNA, 25 bp, E. coli
cctcgcttacagcaactctctgatg

SEQ ID NO: 59554 - DNA, 25 bp, E. coli
cctcgcttacaggaactctctgatg

SEQ ID NO: 59555 - DNA, 25 bp, E. coli
ctacgcgggtgcattgagcgataag

SEQ ID NO: 59556 - DNA, 25 bp, E. coli
cattgagcgatatgtacatcctcgc

SEQ ID NO: 59557 - DNA, 25 bp, E. coli
cattgagcgataagtacatcctcgc

SEQ ID NO: 59558 - DNA, 25 bp, E. coli
ctacgcgggtgctttgagcgataag

SEQ ID NO: 59559 - DNA, 25 bp, E. coli
gataagtacatcgtcgcttacagca

SEQ ID NO: 59560 - DNA, 25 bp, E. coli
gataagtacatcctcgcttacagca

SEQ ID NO: 59561 - DNA, 25 bp, E. coli
gtacatcctcgcatacagcaactct

SEQ ID NO: 59562 - DNA, 25 bp, E. coli
gtacatcctcgcttacagcaactct

SEQ ID NO: 59563 - DNA, 25 bp, E. coli
taagtacatcctcgcttacagcaac

SEQ ID NO: 59564 - DNA, 25 bp, E. coli
taagtacatcctggcttacagcaac

SEQ ID NO: 59565 - DNA, 25 bp, E. coli
gttccattatccgaccaggtacaac

SEQ ID NO: 59566 - DNA, 25 bp, E. coli
gttccattatcccaccaggtacaac

SEQ ID NO: 59567 - DNA, 25 bp, E. coli
tactgcggcggtcgtcaccatcatg

SEQ ID NO: 59568 - DNA, 25 bp, E. coli
tacgtcattttaccgctggcactgc

SEQ ID NO: 59569 - DNA, 25 bp, E. coli
tactgcggcggtggtcaccatcatg

SEQ ID NO: 59570 - DNA, 25 bp, E. coli
accatcatgatcaactccggcgcgt

SEQ ID NO: 59571 - DNA, 25 bp, E. coli
accatcatgatctactccggcgcgt

SEQ ID NO: 59572 - DNA, 25 bp, E. coli
aacttccgcgccgttgagatctgga

SEQ ID NO: 59573 - DNA, 25 bp, E. coli
aaatcacgcgtgctgcggtgctgtc

SEQ ID NO: 59574 - DNA, 25 bp, E. coli
aaatcacgcgtggtgcggtgctgtc

SEQ ID NO: 59575 - DNA, 25 bp, E. coli
aacttccgcgcccttgagatctgga

SEQ ID NO: 59576 - DNA, 25 bp, E. coli
tacgtcattttagcgctggcactgc

SEQ ID NO: 59577 - DNA, 25 bp, E. coli
ttttcgtgaagctggactggcgctc

SEQ ID NO: 59578 - DNA, 25 bp, E. coli
ttttcgtgaagcaggactggcgctc

SEQ ID NO: 59579 - DNA, 25 bp, E. coli
cgccgtggcggtgttctatctgatt

SEQ ID NO: 59580 - DNA, 25 bp, E. coli
cgccgtggcggtcttctatctgatt

SEQ ID NO: 59581 - DNA, 25 bp, E. coli
gttggatagccatccacgtcgcgct

SEQ ID NO: 59582 - DNA, 25 bp, E. coli
gttgggaaaccattcgctacgtcat

SEQ ID NO: 59583 - DNA, 25 bp, E. coli
gttgggaaaccaatcgctacgtcat

SEQ ID NO: 59584 - DNA, 25 bp, E. coli
gattgaaggtgccaaaatgaccctg

SEQ ID NO: 59585 - DNA, 25 bp, E. coli
gttggatagccaaccacgtcgcgct

SEQ ID NO: 59586 - DNA, 25 bp, E. coli
gattgaaggtgcgaaaatgaccctg

SEQ ID NO: 59587 - DNA, 25 bp, E. coli
ggcgctcggtctttcacgttgggaa

SEQ ID NO: 59588 - DNA, 25 bp, E. coli
ggcgctcggtctatcacgttgggaa

SEQ ID NO: 59589 - DNA, 25 bp, E. coli
aaaaattcgtactgctgatagcgcc

SEQ ID NO: 59590 - DNA, 25 bp, E. coli
aaaaattcgtacagctgatagcgcc

SEQ ID NO: 59591 - DNA, 25 bp, E. coli
tagcggcggcgtaagtttcgacctg

SEQ ID NO: 59592 - DNA, 25 bp, E. coli
tagcggcggcgttagtttcgacctg

SEQ ID NO: 59593 - DNA, 25 bp, E. coli
tttctcgctttgcaccggatgacag

SEQ ID NO: 59594 - DNA, 25 bp, E. coli
tttctcgctttggaccggatgacag

SEQ ID NO: 59595 - DNA, 25 bp, E. coli
tctaacccgcaaacggtcgcgatgg

SEQ ID NO: 59596 - DNA, 25 bp, E. coli
tctaacccgcaatcggtcgcgatgg

SEQ ID NO: 59597 - DNA, 25 bp, E. coli
gccgttggataaccctcgcgataat

SEQ ID NO: 59598 - DNA, 25 bp, E. coli
gccgttggataagcctcgcgataat

SEQ ID NO: 59599 - DNA, 25 bp, E. coli
gcaaaatgattacttccgcgatgat

SEQ ID NO: 59600 - DNA, 25 bp, E. coli
gcaaaatgattagttccgcgatgat

SEQ ID NO: 59601 - DNA, 25 bp, E. coli
gaaaaacagtcaatccagcttagcg

SEQ ID NO: 59602 - DNA, 25 bp, E. coli
gaaaaacagtcattccagcttagcg

SEQ ID NO: 59603 - DNA, 25 bp, E. coli
tacattatgggcaccacggtaggta

SEQ ID NO: 59604 - DNA, 25 bp, E. coli
gggattcagcaaaaccgagataggt

SEQ ID NO: 59605 - DNA, 25 bp, E. coli
tacattatgggctccacggtaggta

SEQ ID NO: 59606 - DNA, 25 bp, E. coli
gggattcagcaataccgagataggt

SEQ ID NO: 59607 - DNA, 25 bp, E. coli
tggcgaagcgagtacaccgtcttac

SEQ ID NO: 59608 - DNA, 25 bp, E. coli
tgggattcacctcttacgcctcacg

SEQ ID NO: 59609 - DNA, 25 bp, E. coli
tggcgaagcgagaacaccgtcttac

SEQ ID NO: 59610 - DNA, 25 bp, E. coli
tgggattcacctgttacgcctcacg

SEQ ID NO: 59611 - DNA, 25 bp, E. coli
tgatcagcagattcgttgggccaaa

SEQ ID NO: 59612 - DNA, 25 bp, E. coli
tgcagacatacacagggcggtcatc

SEQ ID NO: 59613 - DNA, 25 bp, E. coli
tgcagacatacagagggcggtcatc

SEQ ID NO: 59614 - DNA, 25 bp, E. coli
tgatcagcagatacgttgggccaaa

SEQ ID NO: 59615 - DNA, 25 bp, E. coli
tcagtcgaaacacattaaacagagc

SEQ ID NO: 59616 - DNA, 25 bp, E. coli
tcagtcgaaacagattaaacagagc

SEQ ID NO: 59617 - DNA, 25 bp, E. coli
ccacatgagttgcttgcagacatac

SEQ ID NO: 59618 - DNA, 25 bp, E. coli
ccagtaatgttaacaatgacctgca

SEQ ID NO: 59619 - DNA, 25 bp, E. coli
ccagtaatgttatcaatgacctgca

SEQ ID NO: 59620 - DNA, 25 bp, E. coli
ccacatgagttggttgcagacatac

SEQ ID NO: 59621 - DNA, 25 bp, E. coli
gacaagttaaaaggtggaatgcatg

SEQ ID NO: 59622 - DNA, 25 bp, E. coli
gacaagttaaaacgtggaatgcatg

SEQ ID NO: 59623 - DNA, 25 bp, E. coli
ggaatgcatgttgaaatagccagta

SEQ ID NO: 59624 - DNA, 25 bp, E. coli
ggcggtcatcaactcaatcaatgcc

SEQ ID NO: 59625 - DNA, 25 bp, E. coli
ggaatgcatgttcaaatagccagta

SEQ ID NO: 59626 - DNA, 25 bp, E. coli
ggcggtcatcaagtcaatcaatgcc

SEQ ID NO: 59627 - DNA, 25 bp, E. coli
gacctggtacaagaagtcagtcgaa

SEQ ID NO: 59628 - DNA, 25 bp, E. coli
gagggtatcttattcaatgtttgcc

SEQ ID NO: 59629 - DNA, 25 bp, E. coli
gacctgcaattctttgatcagcaga

SEQ ID NO: 59630 - DNA, 25 bp, E. coli
gacctggtacaacaagtcagtcgaa

SEQ ID NO: 59631 - DNA, 25 bp, E. coli
gacctgcaattcattgatcagcaga

SEQ ID NO: 59632 - DNA, 25 bp, E. coli
gagggtatcttaatcaatgtttgcc

SEQ ID NO: 59633 - DNA, 25 bp, E. coli
taacttatccataacctccagaggg

SEQ ID NO: 59634 - DNA, 25 bp, E. coli
agccgctggagagttttgccgcaca

SEQ ID NO: 59635 - DNA, 25 bp, E. coli
agccgctggagacttttgccgcaca

SEQ ID NO: 59636 - DNA, 25 bp, E. coli
tttgccgcacaatacgggcaagggt

SEQ ID NO: 59637 - DNA, 25 bp, E. coli
tttgccgcacaaaacgggcaagggt

SEQ ID NO: 59638 - DNA, 25 bp, E. coli
tcgatcgggaatgcctgtgcaaatt

SEQ ID NO: 59639 - DNA, 25 bp, E. coli
tcgatcgggaatccctgtgcaaatt

SEQ ID NO: 59640 - DNA, 25 bp, E. coli
tctttgcgggcgtttatcaacgggc

SEQ ID NO: 59641 - DNA, 25 bp, E. coli
tctttcctattgctatcggccaggc

SEQ ID NO: 59642 - DNA, 25 bp, E. coli
tctttcctattggtatcggccaggc

SEQ ID NO: 59643 - DNA, 25 bp, E. coli
tctttgcgggcgattatcaacgggc

SEQ ID NO: 59644 - DNA, 25 bp, E. coli
cctccagagggttgccgtttagtgg

SEQ ID NO: 59645 - DNA, 25 bp, E. coli
cctccagagggtagccgtttagtgg

SEQ ID NO: 59646 - DNA, 25 bp, E. coli
cattgccggtaagcccatctttgcg

SEQ ID NO: 59647 - DNA, 25 bp, E. coli
cattgccggtaaccccatctttgcg

SEQ ID NO: 59648 - DNA, 25 bp, E. coli
gggctgtacgcgttttatattggca

SEQ ID NO: 59649 - DNA, 25 bp, E. coli
gggctgtacgcgatttatattggca

SEQ ID NO: 59650 - DNA, 25 bp, E. coli
taactgggtgactaccgttgaacgt

SEQ ID NO: 59651 - DNA, 25 bp, E. coli
taactgggtgacaaccgttgaacgt

SEQ ID NO: 59652 - DNA, 25 bp, E. coli
taacttatccattacctccagaggg

SEQ ID NO: 59653 - DNA, 25 bp, E. coli
gagtctgaccgataagtgccattgc

SEQ ID NO: 59654 - DNA, 25 bp, E. coli
gagtctgaccgaaaagtgccattgc

SEQ ID NO: 59655 - DNA, 25 bp, E. coli
caacgcattgatgtgactttgattt

SEQ ID NO: 59656 - DNA, 25 bp, E. coli
caagtcagtgacctgcccgttgatt

SEQ ID NO: 59657 - DNA, 25 bp, E. coli
caagtcagtgacgtgcccgttgatt

SEQ ID NO: 59658 - DNA, 25 bp, E. coli
caacgcattgatctgactttgattt

SEQ ID NO: 59659 - DNA, 25 bp, E. coli
cctgccatcgtaaatccccattaaa

SEQ ID NO: 59660 - DNA, 25 bp, E. coli
cctgccatcgtatatccccattaaa

SEQ ID NO: 59661 - DNA, 25 bp, E. coli
tattttctggaggagactcgcaaag

SEQ ID NO: 59662 - DNA, 25 bp, E. coli
tattttctggagcagactcgcaaag

SEQ ID NO: 59663 - DNA, 25 bp, E. coli
gcaacggtgtggagaagggataaaa

SEQ ID NO: 59664 - DNA, 25 bp, E. coli
gcaacggtgtggtgaagggataaaa

SEQ ID NO: 59665 - DNA, 25 bp, E. coli
gcaaagtagaatccgcaacgcggca

SEQ ID NO: 59666 - DNA, 25 bp, E. coli
gcaaagtagaatgcgcaacgcggca

SEQ ID NO: 59667 - DNA, 25 bp, E. coli
gactttgatttaatttctggagcag

SEQ ID NO: 59668 - DNA, 25 bp, E. coli
gactttgatttattttctggagcag

SEQ ID NO: 59669 - DNA, 25 bp, E. coli
ccccattaaataaacacaacgcatt

SEQ ID NO: 59670 - DNA, 25 bp, E. coli
ccccattaaatatacacaacgcatt

SEQ ID NO: 59671 - DNA, 25 bp, E. coli
gtagaatgcgcaacgcggcaacggt

SEQ ID NO: 59672 - DNA, 25 bp, E. coli
gtagaatgcgcatcgcggcaacggt

SEQ ID NO: 59673 - DNA, 25 bp, E. coli
ggagcagactcgcaaagtagaatgc

SEQ ID NO: 59674 - DNA, 25 bp, E. coli
ggagcagactcggaaagtagaatgc

SEQ ID NO: 59675 - DNA, 25 bp, E. coli
gacctgcccgttcattttcagagaa

SEQ ID NO: 59676 - DNA, 25 bp, E. coli
gacctgcccgttgattttcagagaa

SEQ ID NO: 59677 - DNA, 25 bp, E. coli
caagaactgcaaggtggacaaggcc

SEQ ID NO: 59678 - DNA, 25 bp, E. coli
aatttactgatatggccggaacgcc

SEQ ID NO: 59679 - DNA, 25 bp, E. coli
aatggctggctgactgcctggtccc

SEQ ID NO: 59680 - DNA, 25 bp, E. coli
caagaactgcaacgtggacaaggcc

SEQ ID NO: 59681 - DNA, 25 bp, E. coli
aatttactgataaggccggaacgcc

SEQ ID NO: 59682 - DNA, 25 bp, E. coli
aatggctggctgtctgcctggtccc

SEQ ID NO: 59683 - DNA, 25 bp, E. coli
acttacaacctggaactgctggcgg

SEQ ID NO: 59684 - DNA, 25 bp, E. coli
actgctggcggtcatcaagaactgc

SEQ ID NO: 59685 - DNA, 25 bp, E. coli
actgctggcggtgatcaagaactgc

SEQ ID NO: 59686 - DNA, 25 bp, E. coli
acttacaacctgcaactgctggcgg

SEQ ID NO: 59687 - DNA, 25 bp, E. coli
tgctgttccggctggaaaaacgaag

SEQ ID NO: 59688 - DNA, 25 bp, E. coli
tgctgttccggcaggaaaaacgaag

SEQ ID NO: 59689 - DNA, 25 bp, E. coli
tcgtcgtctggacacgcggcgacaa

SEQ ID NO: 59690 - DNA, 25 bp, E. coli
tcgtcgtctggagacgcggcgacaa

SEQ ID NO: 59691 - DNA, 25 bp, E. coli
gcggcgacaacatgaatttactgat

SEQ ID NO: 59692 - DNA, 25 bp, E. coli
gcggcgacaacaagaatttactgat

SEQ ID NO: 59693 - DNA, 25 bp, E. coli
gatatggccggatcgcctgctgttc

SEQ ID NO: 59694 - DNA, 25 bp, E. coli
gatatggccggaacgcctgctgttc

SEQ ID NO: 59695 - DNA, 25 bp, E. coli
gggcatcggtcacttacaacctgca

SEQ ID NO: 59696 - DNA, 25 bp, E. coli
gggcatcggtcagttacaacctgca

SEQ ID NO: 59697 - DNA, 25 bp, E. coli
ggacaaggccagtattcgtcgtctg

SEQ ID NO: 59698 - DNA, 25 bp, E. coli
ggacaaggccagaattcgtcgtctg

SEQ ID NO: 59699 - DNA, 25 bp, E. coli
cagggtaatttccaccactatttgc

SEQ ID NO: 59700 - DNA, 25 bp, E. coli
cagggtaatttcgaccactatttgc

SEQ ID NO: 59701 - DNA, 25 bp, E. coli
catcgcgccgtatcttcattttaaa

SEQ ID NO: 59702 - DNA, 25 bp, E. coli
catcgcgccgtaacttcattttaaa

SEQ ID NO: 59703 - DNA, 25 bp, E. coli
taaatacgcgtcattgaccccgaag

SEQ ID NO: 59704 - DNA, 25 bp, E. coli
taaatacgcgtctttgaccccgaag

SEQ ID NO: 59705 - DNA, 25 bp, E. coli
acatctagtatcactgtatcaacag

SEQ ID NO: 59706 - DNA, 25 bp, E. coli
acatctagtatctctgtatcaacag

SEQ ID NO: 59707 - DNA, 25 bp, E. coli
tgcctggtgaatcacaaaaatcccc

SEQ ID NO: 59708 - DNA, 25 bp, E. coli
tgcctggtgaatgacaaaaatcccc

SEQ ID NO: 59709 - DNA, 25 bp, E. coli
tctttgaccccgtagcctgtcttcg

SEQ ID NO: 59710 - DNA, 25 bp, E. coli
tctttgaccccgaagcctgtcttcg

SEQ ID NO: 59711 - DNA, 25 bp, E. coli
gcaaaaatgataataaatacgcgtc

SEQ ID NO: 59712 - DNA, 25 bp, E. coli
gcaaaaatgatattaaatacgcgtc

SEQ ID NO: 59713 - DNA, 25 bp, E. coli
gaatcttttttcaactacatctagt

SEQ ID NO: 59714 - DNA, 25 bp, E. coli
gaatcttttttctactacatctagt

SEQ ID NO: 59715 - DNA, 25 bp, E. coli
ccgtcacgctcaaatccagggtaat

SEQ ID NO: 59716 - DNA, 25 bp, E. coli
ccgtcacgctcatatccagggtaat

SEQ ID NO: 59717 - DNA, 25 bp, E. coli
gtatcaacagagagacaacccgacg

SEQ ID NO: 59718 - DNA, 25 bp, E. coli
gggtttctttttccctggtgaatca

SEQ ID NO: 59719 - DNA, 25 bp, E. coli
gggtttctttttgcctggtgaatca

SEQ ID NO: 59720 - DNA, 25 bp, E. coli
gtatcaacagagtgacaacccgacg

SEQ ID NO: 59721 - DNA, 25 bp, E. coli
caatggtgaactaaccggtggacgt

SEQ ID NO: 59722 - DNA, 25 bp, E. coli
caatggtgaacttaccggtggacgt

SEQ ID NO: 59723 - DNA, 25 bp, E. coli
aagcggcgagaaaatgcgtaaagca

SEQ ID NO: 59724 - DNA, 25 bp, E. coli
aagcggcgagaatatgcgtaaagca

SEQ ID NO: 59725 - DNA, 25 bp, E. coli
taaagcaccgattctgtttcactac

SEQ ID NO: 59726 - DNA, 25 bp, E. coli
taaagcaccgatactgtttcactac

SEQ ID NO: 59727 - DNA, 25 bp, E. coli
aaatgcgtaaaggaccgattctgtt

SEQ ID NO: 59728 - DNA, 25 bp, E. coli
aaatgcgtaaagcaccgattctgtt

SEQ ID NO: 59729 - DNA, 25 bp, E. coli
tgtgagcaatggtgaacttaccggt

SEQ ID NO: 59730 - DNA, 25 bp, E. coli
tgtgagcaatggagaacttaccggt

SEQ ID NO: 59731 - DNA, 25 bp, E. coli
taatcgttatggtgtgagcaatggt

SEQ ID NO: 59732 - DNA, 25 bp, E. coli
gcgtaaagcacccattctgtttcac

SEQ ID NO: 59733 - DNA, 25 bp, E. coli
gcgtaaagcaccgattctgtttcac

SEQ ID NO: 59734 - DNA, 25 bp, E. coli
cgttatggtgtgagcaatggtgaac

SEQ ID NO: 59735 - DNA, 25 bp, E. coli
cgttatggtgtgtgcaatggtgaac

SEQ ID NO: 59736 - DNA, 25 bp, E. coli
tggtgtgagcaaaggtgaacttacc

SEQ ID NO: 59737 - DNA, 25 bp, E. coli
tggtgtgagcaatggtgaacttacc

SEQ ID NO: 59738 - DNA, 25 bp, E. coli
ttaccggtggacgttatgccgtggc

SEQ ID NO: 59739 - DNA, 25 bp, E. coli
ttaccggtggaccttatgccgtggc

SEQ ID NO: 59740 - DNA, 25 bp, E. coli
taatcgttatggagtgagcaatggt

SEQ ID NO: 59741 - DNA, 25 bp, E. coli
gagcaatggtgatcttaccggtgga

SEQ ID NO: 59742 - DNA, 25 bp, E. coli
gagcaatggtgaacttaccggtgga

SEQ ID NO: 59743 - DNA, 25 bp, E. coli
caaatataatacgttggcctgggaa

SEQ ID NO: 59744 - DNA, 25 bp, E. coli
caaatataataccttggcctgggaa

SEQ ID NO: 59745 - DNA, 25 bp, E. coli
cagtacccgcgcaacgtgaatattt

SEQ ID NO: 59746 - DNA, 25 bp, E. coli
catacatggcatctgaatagcgccg

SEQ ID NO: 59747 - DNA, 25 bp, E. coli
cagtacccgcgctacgtgaatattt

SEQ ID NO: 59748 - DNA, 25 bp, E. coli
catacatggcatgtgaatagcgccg

SEQ ID NO: 59749 - DNA, 25 bp, E. coli
taaagccttgtttaccacgccgtct

SEQ ID NO: 59750 - DNA, 25 bp, E. coli
taaagccttgttaaccacgccgtct

SEQ ID NO: 59751 - DNA, 25 bp, E. coli
tacgctatcccttgaaaaaatggtg

SEQ ID NO: 59752 - DNA, 25 bp, E. coli
tacgctatccctagaaaaaatggtg

SEQ ID NO: 59753 - DNA, 25 bp, E. coli
ttagtggtcatgacgacgctgtgcg

SEQ ID NO: 59754 - DNA, 25 bp, E. coli
ttaatctattcgtgccatacatggc

SEQ ID NO: 59755 - DNA, 25 bp, E. coli
ttaatctattcgagccatacatggc

SEQ ID NO: 59756 - DNA, 25 bp, E. coli
ttagtggtcatgtcgacgctgtgcg

SEQ ID NO: 59757 - DNA, 25 bp, E. coli
tgagaacgataaagcaccagcccgt

SEQ ID NO: 59758 - DNA, 25 bp, E. coli
tgcttaacttcctgtcagcgcgggt

SEQ ID NO: 59759 - DNA, 25 bp, E. coli
tgcttaacttccagtcagcgcgggt

SEQ ID NO: 59760 - DNA, 25 bp, E. coli
tgagaacgataatgcaccagcccgt

SEQ ID NO: 59761 - DNA, 25 bp, E. coli
cgttctttatcctcggcgcactggc

SEQ ID NO: 59762 - DNA, 25 bp, E. coli
cgttctttatccacggcgcactggc

SEQ ID NO: 59763 - DNA, 25 bp, E. coli
tcaaccagcgctatggcagtggcga

SEQ ID NO: 59764 - DNA, 25 bp, E. coli
tcaaccagcgctttggcagtggcga

SEQ ID NO: 59765 - DNA, 25 bp, E. coli
aataatactttagcgcttccagctg

SEQ ID NO: 59766 - DNA, 25 bp, E. coli
aataatactttaccgcttccagctg

SEQ ID NO: 59767 - DNA, 25 bp, E. coli
cacccgctgcaaggttcatggaaag

SEQ ID NO: 59768 - DNA, 25 bp, E. coli
cacccgctgcaacgttcatggaaag

SEQ ID NO: 59769 - DNA, 25 bp, E. coli
aacttttacgatatgagagaactgg

SEQ ID NO: 59770 - DNA, 25 bp, E. coli
aacttttacgatttgagagaactgg

SEQ ID NO: 59771 - DNA, 25 bp, E. coli
taccgcttccagctgtttataaaga

SEQ ID NO: 59772 - DNA, 25 bp, E. coli
tatcgcgatgctcatgtcgaaccgg

SEQ ID NO: 59773 - DNA, 25 bp, E. coli
taccgcttccaggtgtttataaaga

SEQ ID NO: 59774 - DNA, 25 bp, E. coli
tatcgcgatgctgatgtcgaaccgg

SEQ ID NO: 59775 - DNA, 25 bp, E. coli
tgtttataaagagcacccgctgcaa

SEQ ID NO: 59776 - DNA, 25 bp, E. coli
tgtcgaaccggactggatcctgatt

SEQ ID NO: 59777 - DNA, 25 bp, E. coli
tgtttataaagaccacccgctgcaa

SEQ ID NO: 59778 - DNA, 25 bp, E. coli
tgtcgaaccggagtggatcctgatt

SEQ ID NO: 59779 - DNA, 25 bp, E. coli
tgagagaactggtactcacgcggcg

SEQ ID NO: 59780 - DNA, 25 bp, E. coli
tgagagaactggaactcacgcggcg

SEQ ID NO: 59781 - DNA, 25 bp, E. coli
tcatggaaaggtaatcgcgatgctc

SEQ ID NO: 59782 - DNA, 25 bp, E. coli
tcatggaaaggttatcgcgatgctc

SEQ ID NO: 59783 - DNA, 25 bp, E. coli
gaaatatcttatcacgcttcttatc

SEQ ID NO: 59784 - DNA, 25 bp, E. coli
gaaatatcttatgacgcttcttatc

SEQ ID NO: 59785 - DNA, 25 bp, E. coli
ggatcctgattttcaaacttaccga

SEQ ID NO: 59786 - DNA, 25 bp, E. coli
ggatcctgatttacaaacttaccga

SEQ ID NO: 59787 - DNA, 25 bp, E. coli
caagctgcgttaaaaataccgccag

SEQ ID NO: 59788 - DNA, 25 bp, E. coli
cagcgcggcggttcccataaacatt

SEQ ID NO: 59789 - DNA, 25 bp, E. coli
cagcgcggcggtacccataaacatt

SEQ ID NO: 59790 - DNA, 25 bp, E. coli
caagctgcgttataaataccgccag

SEQ ID NO: 59791 - DNA, 25 bp, E. coli
cataaacattccagctgcggtattg

SEQ ID NO: 59792 - DNA, 25 bp, E. coli
cataaacattcctgctgcggtattg

SEQ ID NO: 59793 - DNA, 25 bp, E. coli
agcgcggcggttgccataaacattc

SEQ ID NO: 59794 - DNA, 25 bp, E. coli
agcgcggcggttcccataaacattc

SEQ ID NO: 59795 - DNA, 25 bp, E. coli
aaacattcctgctgcggtattgtga

SEQ ID NO: 59796 - DNA, 25 bp, E. coli
aaacattcctgcagcggtattgtga

SEQ ID NO: 59797 - DNA, 25 bp, E. coli
tgcgttaaaaataccgccagccagc

SEQ ID NO: 59798 - DNA, 25 bp, E. coli
tcccataaacatacctgctgcggta

SEQ ID NO: 59799 - DNA, 25 bp, E. coli
tcccataaacattcctgctgcggta

SEQ ID NO: 59800 - DNA, 25 bp, E. coli
tgcgttaaaaattccgccagccagc

SEQ ID NO: 59801 - DNA, 25 bp, E. coli
gcgttaaaaatagcgccagccagcg

SEQ ID NO: 59802 - DNA, 25 bp, E. coli
gcgttaaaaataccgccagccagcg

SEQ ID NO: 59803 - DNA, 25 bp, E. coli
gcggcggttcccataaacattcctg

SEQ ID NO: 59804 - DNA, 25 bp, E. coli
gcggcggttcccttaaacattcctg

SEQ ID NO: 59805 - DNA, 25 bp, E. coli
ggttcccataaacattcctgctgcg

SEQ ID NO: 59806 - DNA, 25 bp, E. coli
ggttcccataaagattcctgctgcg

SEQ ID NO: 59807 - DNA, 25 bp, E. coli
ggcggttcccataaacattcctgct

SEQ ID NO: 59808 - DNA, 25 bp, E. coli
ggcggttcccattaacattcctgct

SEQ ID NO: 59809 - DNA, 25 bp, E. coli
aatgatggcactcctcgcggcgtta

SEQ ID NO: 59810 - DNA, 25 bp, E. coli
aatgatggcactgctcgcggcgtta

SEQ ID NO: 59811 - DNA, 25 bp, E. coli
caaagtgctgctggtaccgttaatc

SEQ ID NO: 59812 - DNA, 25 bp, E. coli
caaagtgctgctcgtaccgttaatc

SEQ ID NO: 59813 - DNA, 25 bp, E. coli
tactgcctgatgcaaaacggctccc

SEQ ID NO: 59814 - DNA, 25 bp, E. coli
tactgcctgatggaaaacggctccc

SEQ ID NO: 59815 - DNA, 25 bp, E. coli
agagcaactgctcatctggtccgcc

SEQ ID NO: 59816 - DNA, 25 bp, E. coli
agagcaactgctgatctggtccgcc

SEQ ID NO: 59817 - DNA, 25 bp, E. coli
tgaagctaccgatggctaccgggct

SEQ ID NO: 59818 - DNA, 25 bp, E. coli
tgaacaacttgaccgcgctgaaggg

SEQ ID NO: 59819 - DNA, 25 bp, E. coli
tgaacaacttgagcgcgctgaaggg

SEQ ID NO: 59820 - DNA, 25 bp, E. coli
tgaagctaccgaaggctaccgggct

SEQ ID NO: 59821 - DNA, 25 bp, E. coli
tctggcgggactgatgatgctgaca

SEQ ID NO: 59822 - DNA, 25 bp, E. coli
tctggcgggactcatgatgctgaca

SEQ ID NO: 59823 - DNA, 25 bp, E. coli
gcgcatttgtcgatcagcccgtgaa

SEQ ID NO: 59824 - DNA, 25 bp, E. coli
gcgcatttgtcgttcagcccgtgaa

SEQ ID NO: 59825 - DNA, 25 bp, E. coli
gaaaacggctccgatctggtgctgg

SEQ ID NO: 59826 - DNA, 25 bp, E. coli
gaaaaatatggcctacccacggcac

SEQ ID NO: 59827 - DNA, 25 bp, E. coli
gaaaacggctcccatctggtgctgg

SEQ ID NO: 59828 - DNA, 25 bp, E. coli
gaaaaatatggcgtacccacggcac

SEQ ID NO: 59829 - DNA, 25 bp, E. coli
gttaatcatgacttacgctgcacga

SEQ ID NO: 59830 - DNA, 25 bp, E. coli
gttaatcatgacatacgctgcacga

SEQ ID NO: 59831 - DNA, 25 bp, E. coli
caggaggatcattctatgaatgcat

SEQ ID NO: 59832 - DNA, 25 bp, E. coli
caggaggatcatactatgaatgcat

SEQ ID NO: 59833 - DNA, 25 bp, E. coli
atacgcggacaatcaactatccccg

SEQ ID NO: 59834 - DNA, 25 bp, E. coli
atacgcggacaaacaactatccccg

SEQ ID NO: 59835 - DNA, 25 bp, E. coli
tatttatgtgcccactgggagatga

SEQ ID NO: 59836 - DNA, 25 bp, E. coli
tatttatgtgccgactgggagatga

SEQ ID NO: 59837 - DNA, 25 bp, E. coli
tcgctggcatggtcgtcaacattga

SEQ ID NO: 59838 - DNA, 25 bp, E. coli
tcgctggcatggacgtcaacattga

SEQ ID NO: 59839 - DNA, 25 bp, E. coli
tgcgtgaggcctaaaaactgaagcc

SEQ ID NO: 59840 - DNA, 25 bp, E. coli
tgcgtgaggccttaaaactgaagcc

SEQ ID NO: 59841 - DNA, 25 bp, E. coli
gcctggtgggcaagtatttatgtgc

SEQ ID NO: 59842 - DNA, 25 bp, E. coli
gcctggtgggcatgtatttatgtgc

SEQ ID NO: 59843 - DNA, 25 bp, E. coli
gctgtactgaccactgaatcaaagg

SEQ ID NO: 59844 - DNA, 25 bp, E. coli
gcattcattacgtaattctgcctgg

SEQ ID NO: 59845 - DNA, 25 bp, E. coli
gctgtactgacctctgaatcaaagg

SEQ ID NO: 59846 - DNA, 25 bp, E. coli
gcattcattacgaaattctgcctgg

SEQ ID NO: 59847 - DNA, 25 bp, E. coli
gaaagaaacttgacgctggcatgga

SEQ ID NO: 59848 - DNA, 25 bp, E. coli
gaaagaaacttgtcgctggcatgga

SEQ ID NO: 59849 - DNA, 25 bp, E. coli
cgcgccagtgcgagaggccttaaaa

SEQ ID NO: 59850 - DNA, 25 bp, E. coli
cgcgccagtgcgtgaggccttaaaa

SEQ ID NO: 59851 - DNA, 25 bp, E. coli
gatatccagaactacccgcaaaaaa

SEQ ID NO: 59852 - DNA, 25 bp, E. coli
gatatccagaacaacccgcaaaaaa

SEQ ID NO: 59853 - DNA, 25 bp, E. coli
catcctatgggacaacaatgaataa

SEQ ID NO: 59854 - DNA, 25 bp, E. coli
catcctatgggagaacaatgaataa

SEQ ID NO: 59855 - DNA, 25 bp, E. coli
cagttacggcgggaaacctcatcct

SEQ ID NO: 59856 - DNA, 25 bp, E. coli
cagttacggcggcaaacctcatcct

SEQ ID NO: 59857 - DNA, 25 bp, E. coli
tacggcgggaaacctcatcctatgg

SEQ ID NO: 59858 - DNA, 25 bp, E. coli
tacggcgggaaagctcatcctatgg

SEQ ID NO: 59859 - DNA, 25 bp, E. coli
acctcatcctatcggagaacaatga

SEQ ID NO: 59860 - DNA, 25 bp, E. coli
acctcatcctatgggagaacaatga

SEQ ID NO: 59861 - DNA, 25 bp, E. coli
cctatgggagaacaatgaataatga

SEQ ID NO: 59862 - DNA, 25 bp, E. coli
cctatgggagaagaatgaataatga

SEQ ID NO: 59863 - DNA, 25 bp, E. coli
gcgggaaacctcatcctatgggaga

SEQ ID NO: 59864 - DNA, 25 bp, E. coli
gcgggaaacctcttcctatgggaga

SEQ ID NO: 59865 - DNA, 25 bp, E. coli
gttacggcgggatacctcatcctat

SEQ ID NO: 59866 - DNA, 25 bp, E. coli
gttacggcgggaaacctcatcctat

SEQ ID NO: 59867 - DNA, 25 bp, E. coli
gaaacctcatcctatgggagaacaa

SEQ ID NO: 59868 - DNA, 25 bp, E. coli
gaaattgcggggatatcatctccca

SEQ ID NO: 59869 - DNA, 25 bp, E. coli
gaaattgcggggttatcatctccca

SEQ ID NO: 59870 - DNA, 25 bp, E. coli
gaaacctcatccaatgggagaacaa

SEQ ID NO: 59871 - DNA, 25 bp, E. coli
cggcgggaaaccacatcctatggga

SEQ ID NO: 59872 - DNA, 25 bp, E. coli
cggcgggaaacctcatcctatggga

SEQ ID NO: 59873 - DNA, 25 bp, E. coli
gggaaacctcatgctatgggagaac

SEQ ID NO: 59874 - DNA, 25 bp, E. coli
gggaaacctcatcctatgggagaac

SEQ ID NO: 59875 - DNA, 25 bp, E. coli
aatctataccaatgaaacctgcccg

SEQ ID NO: 59876 - DNA, 25 bp, E. coli
aatctataccaaagaaacctgcccg

SEQ ID NO: 59877 - DNA, 25 bp, E. coli
agagatgatcaaacgcagcggtcgc

SEQ ID NO: 59878 - DNA, 25 bp, E. coli
agagatgatcaatcgcagcggtcgc

SEQ ID NO: 59879 - DNA, 25 bp, E. coli
aaacgcagcggtcgcaccacggttc

SEQ ID NO: 59880 - DNA, 25 bp, E. coli
aaacgcagcggtggcaccacggttc

SEQ ID NO: 59881 - DNA, 25 bp, E. coli
aaagcactgctgagcagcaagggcg

SEQ ID NO: 59882 - DNA, 25 bp, E. coli
aaagcactgctgtgcagcaagggcg

SEQ ID NO: 59883 - DNA, 25 bp, E. coli
tattgccatcgtccaaaagcactgc

SEQ ID NO: 59884 - DNA, 25 bp, E. coli
tattgccatcgtgcaaaagcactgc

SEQ ID NO: 59885 - DNA, 25 bp, E. coli
tgctgagcagcatgggcgtgagttt

SEQ ID NO: 59886 - DNA, 25 bp, E. coli
tgctgagcagcaagggcgtgagttt

SEQ ID NO: 59887 - DNA, 25 bp, E. coli
tgcccgtattgcgatcgtgcaaaag

SEQ ID NO: 59888 - DNA, 25 bp, E. coli
tgcccgtattgccatcgtgcaaaag

SEQ ID NO: 59889 - DNA, 25 bp, E. coli
gaaacctgcccgtattgccatcgtg

SEQ ID NO: 59890 - DNA, 25 bp, E. coli
gaaacctgcccgaattgccatcgtg

SEQ ID NO: 59891 - DNA, 25 bp, E. coli
cgtgcaaaagcactgctgagcagca

SEQ ID NO: 59892 - DNA, 25 bp, E. coli
cgtgcaaaagcagtgctgagcagca

SEQ ID NO: 59893 - DNA, 25 bp, E. coli
tggccaatgttgtaatctataccaa

SEQ ID NO: 59894 - DNA, 25 bp, E. coli
tggccaatgttgaaatctataccaa

SEQ ID NO: 59895 - DNA, 25 bp, E. coli
gatgatcaaacgcagcggtcgcacc

SEQ ID NO: 59896 - DNA, 25 bp, E. coli
gatgatcaaacggagcggtcgcacc

SEQ ID NO: 59897 - DNA, 25 bp, E. coli
aattcgatcgatccagtcagaggcg

SEQ ID NO: 59898 - DNA, 25 bp, E. coli
aattcgatcgatgcagtcagaggcg

SEQ ID NO: 59899 - DNA, 25 bp, E. coli
tagttaaagagggaggaatcgatcc

SEQ ID NO: 59900 - DNA, 25 bp, E. coli
tagttaaagaggcaggaatcgatcc

SEQ ID NO: 59901 - DNA, 25 bp, E. coli
tatgtttctggtcgcctcggcacaa

SEQ ID NO: 59902 - DNA, 25 bp, E. coli
tatgtttctggtggcctcggcacaa

SEQ ID NO: 59903 - DNA, 25 bp, E. coli
tgttgacctgcccatgaaactggtg

SEQ ID NO: 59904 - DNA, 25 bp, E. coli
tgttgacctgccgatgaaactggtg

SEQ ID NO: 59905 - DNA, 25 bp, E. coli
tgaaatcatgaaagcgggcggcttg

SEQ ID NO: 59906 - DNA, 25 bp, E. coli
tgaaatgaccttggccacactttgg

SEQ ID NO: 59907 - DNA, 25 bp, E. coli
tgaaatcatgaatgcgggcggcttg

SEQ ID NO: 59908 - DNA, 25 bp, E. coli
tgcaaccgttggtcgattcaccgcg

SEQ ID NO: 59909 - DNA, 25 bp, E. coli
tgcaaccgttggacgattcaccgcg

SEQ ID NO: 59910 - DNA, 25 bp, E. coli
tgaaatgaccttcgccacactttgg

SEQ ID NO: 59911 - DNA, 25 bp, E. coli
tcatggcacaaaggctggtgaacgg

SEQ ID NO: 59912 - DNA, 25 bp, E. coli
tcatggcacaaacgctggtgaacgg

SEQ ID NO: 59913 - DNA, 25 bp, E. coli
cattattggcgggtttcgctccggc

SEQ ID NO: 59914 - DNA, 25 bp, E. coli
cattattggcggctttcgctccggc

SEQ ID NO: 59915 - DNA, 25 bp, E. coli
gggtggcaaaacacaaattcgatcg

SEQ ID NO: 59916 - DNA, 25 bp, E. coli
gggtggcaaaactcaaattcgatcg

SEQ ID NO: 59917 - DNA, 25 bp, E. coli
tggcatgtactctttggcgcggcga

SEQ ID NO: 59918 - DNA, 25 bp, E. coli
tggcatgtactcattggcgcggcga

SEQ ID NO: 59919 - DNA, 25 bp, E. coli
tatgttggcgcgctatcgacgaatt

SEQ ID NO: 59920 - DNA, 25 bp, E. coli
tatgttggcgcggtatcgacgaatt

SEQ ID NO: 59921 - DNA, 25 bp, E. coli
tatttgcgccccagacaacaggagc

SEQ ID NO: 59922 - DNA, 25 bp, E. coli
tatttgcgcccctgacaacaggagc

SEQ ID NO: 59923 - DNA, 25 bp, E. coli
cctgacaacaggtgcgattcgctat

SEQ ID NO: 59924 - DNA, 25 bp, E. coli
cctgacaacaggagcgattcgctat

SEQ ID NO: 59925 - DNA, 25 bp, E. coli
cctcaattgatactggcggcgatta

SEQ ID NO: 59926 - DNA, 25 bp, E. coli
cctcaattgatagtggcggcgatta

SEQ ID NO: 59927 - DNA, 25 bp, E. coli
gcgattcgctatcacatcccgacga

SEQ ID NO: 59928 - DNA, 25 bp, E. coli
gcgattcgctatgacatcccgacga

SEQ ID NO: 59929 - DNA, 25 bp, E. coli
gaatgctcctcatttgatactggcg

SEQ ID NO: 59930 - DNA, 25 bp, E. coli
gaatttgctataattgcgcccctga

SEQ ID NO: 59931 - DNA, 25 bp, E. coli
gcagacatggaatgctcctcaattg

SEQ ID NO: 59932 - DNA, 25 bp, E. coli
gaatttgctatatttgcgcccctga

SEQ ID NO: 59933 - DNA, 25 bp, E. coli
gcagacatggaaagctcctcaattg

SEQ ID NO: 59934 - DNA, 25 bp, E. coli
gaatgctcctcaattgatactggcg

SEQ ID NO: 59935 - DNA, 25 bp, E. coli
gatactggcggcgattatagccata

SEQ ID NO: 59936 - DNA, 25 bp, E. coli
gatactggcggccattatagccata

SEQ ID NO: 59937 - DNA, 25 bp, E. coli
gattatagccatatgttggcgcggt

SEQ ID NO: 59938 - DNA, 25 bp, E. coli
gattatagccatttgttggcgcggt

SEQ ID NO: 59939 - DNA, 25 bp, E. coli
ggcgcggtatcgacgaatttgctat

SEQ ID NO: 59940 - DNA, 25 bp, E. coli
ggcgcggtatcgtcgaatttgctat

SEQ ID NO: 59941 - DNA, 25 bp, E. coli
aaccggatgtcggaggcttgtacca

SEQ ID NO: 59942 - DNA, 25 bp, E. coli
aaccggatgtcgcaggcttgtacca

SEQ ID NO: 59943 - DNA, 25 bp, E. coli
tatgccatggctggagacggatgca

SEQ ID NO: 59944 - DNA, 25 bp, E. coli
taggttgggaacaacagcgtgctct

SEQ ID NO: 59945 - DNA, 25 bp, E. coli
tatgccatggctcgagacggatgca

SEQ ID NO: 59946 - DNA, 25 bp, E. coli
taggttgggaactacagcgtgctct

SEQ ID NO: 59947 - DNA, 25 bp, E. coli
tttggtgcgccaacaggtgctgaac

SEQ ID NO: 59948 - DNA, 25 bp, E. coli
tattattgtcaatgcagccgctcac

SEQ ID NO: 59949 - DNA, 25 bp, E. coli
tttggtgcgccatcaggtgctgaac

SEQ ID NO: 59950 - DNA, 25 bp, E. coli
tattattgtcaaagcagccgctcac

SEQ ID NO: 59951 - DNA, 25 bp, E. coli
tgtcgaagcgatagcgaaagcagca

SEQ ID NO: 59952 - DNA, 25 bp, E. coli
tgtcgaagcgattgcgaaagcagca

SEQ ID NO: 59953 - DNA, 25 bp, E. coli
tcttccctggaaatggcgatatgcc

SEQ ID NO: 59954 - DNA, 25 bp, E. coli
tcttccctggaattggcgatatgcc

SEQ ID NO: 59955 - DNA, 25 bp, E. coli
cctgactggcaggttggcgtgaaac

SEQ ID NO: 59956 - DNA, 25 bp, E. coli
cctgactggcagcttggcgtgaaac

SEQ ID NO: 59957 - DNA, 25 bp, E. coli
gaagcatcttattttccggaccagc

SEQ ID NO: 59958 - DNA, 25 bp, E. coli
gaagcatcttatattccggaccagc

SEQ ID NO: 59959 - DNA, 25 bp, E. coli
cgtgtcgcactgaataaaccggatg

SEQ ID NO: 59960 - DNA, 25 bp, E. coli
cgtgtcgcactgtataaaccggatg

SEQ ID NO: 59961 - DNA, 25 bp, E. coli
gaccagctgggtctatgcaggaaaa

SEQ ID NO: 59962 - DNA, 25 bp, E. coli
gaccagctgggtgtatgcaggaaaa

SEQ ID NO: 59963 - DNA, 25 bp, E. coli
aacgctggcagcctacgaagaagcg

SEQ ID NO: 59964 - DNA, 25 bp, E. coli
cagagaaaacagctgtgacgttgga

SEQ ID NO: 59965 - DNA, 25 bp, E. coli
cagagaaaacaggtgtgacgttgga

SEQ ID NO: 59966 - DNA, 25 bp, E. coli
tacatcgcctgtaggcggaacaacc

SEQ ID NO: 59967 - DNA, 25 bp, E. coli
tacgaagaagcgaggaaaggagcct

SEQ ID NO: 59968 - DNA, 25 bp, E. coli
tacgaagaagcgtggaaaggagcct

SEQ ID NO: 59969 - DNA, 25 bp, E. coli
taaaaacgcatgcttgaaacggctg

SEQ ID NO: 59970 - DNA, 25 bp, E. coli
tacatcgcctgttggcggaacaacc

SEQ ID NO: 59971 - DNA, 25 bp, E. coli
taaaaacgcatggttgaaacggctg

SEQ ID NO: 59972 - DNA, 25 bp, E. coli
accgccatttgatgacgtattatcc

SEQ ID NO: 59973 - DNA, 25 bp, E. coli
accgccatttgaagacgtattatcc

SEQ ID NO: 59974 - DNA, 25 bp, E. coli
aacgctggcagcgtacgaagaagcg

SEQ ID NO: 59975 - DNA, 25 bp, E. coli
aacttaatgcgctacaaatcgcgct

SEQ ID NO: 59976 - DNA, 25 bp, E. coli
aacttaatgcgcaacaaatcgcgct

SEQ ID NO: 59977 - DNA, 25 bp, E. coli
tatccttcgctgagtaaacatcgtc

SEQ ID NO: 59978 - DNA, 25 bp, E. coli
tatccttcgctgtgtaaacatcgtc

SEQ ID NO: 59979 - DNA, 25 bp, E. coli
tcgatcacaaagtggcaaggctgcg

SEQ ID NO: 59980 - DNA, 25 bp, E. coli
tcgatcacaaagaggcaaggctgcg

SEQ ID NO: 59981 - DNA, 25 bp, E. coli
cgcccatttaaaggcctggcaggag

SEQ ID NO: 59982 - DNA, 25 bp, E. coli
cgcccatttaaacgcctggcaggag

SEQ ID NO: 59983 - DNA, 25 bp, E. coli
tggcaaagcaatcccgcccatttaa

SEQ ID NO: 59984 - DNA, 25 bp, E. coli
tggcaaagcaatgccgcccatttaa

SEQ ID NO: 59985 - DNA, 25 bp, E. coli
taaagggccaaacatgatgatcgat

SEQ ID NO: 59986 - DNA, 25 bp, E. coli
taaagggccaaagatgatgatcgat

SEQ ID NO: 59987 - DNA, 25 bp, E. coli
aaaccgaggcttttgagctgagtgc

SEQ ID NO: 59988 - DNA, 25 bp, E. coli
aaaccgaggcttatgagctgagtgc

SEQ ID NO: 59989 - DNA, 25 bp, E. coli
tgaacatcaaaccagggcaaacgac

SEQ ID NO: 59990 - DNA, 25 bp, E. coli
tgaacatcaaacgagggcaaacgac

SEQ ID NO: 59991 - DNA, 25 bp, E. coli
tgcggcgtccatagaagcgctgaaa

SEQ ID NO: 59992 - DNA, 25 bp, E. coli
tgcggcgtccattgaagcgctgaaa

SEQ ID NO: 59993 - DNA, 25 bp, E. coli
gaaaatcgttcagaagcagcgtggc

SEQ ID NO: 59994 - DNA, 25 bp, E. coli
gaaaatcgttcacaagcagcgtggc

SEQ ID NO: 59995 - DNA, 25 bp, E. coli
cgctgctgccaacttgctgcctggg

SEQ ID NO: 59996 - DNA, 25 bp, E. coli
cgctgctgccaagttgctgcctggg

SEQ ID NO: 59997 - DNA, 25 bp, E. coli
ggaagcgatcccagaactgctggag

SEQ ID NO: 59998 - DNA, 25 bp, E. coli
ggaagcgatccctgaactgctggag

SEQ ID NO: 59999 - DNA, 25 bp, E. coli
gagcacgagatgcaccactacgaag

SEQ ID NO: 60000 - DNA, 25 bp, E. coli
gatcgccgatgtgctgggtattccg

SEQ ID NO: 60001 - DNA, 25 bp, E. coli
gatcgccgatgtcctgggtattccg

SEQ ID NO: 60002 - DNA, 25 bp, E. coli
gagcacgagatggaccactacgaag

SEQ ID NO: 60003 - DNA, 25 bp, E. coli
gagaatcaacaagcacaaaccgagg

SEQ ID NO: 60004 - DNA, 25 bp, E. coli
gatgatcgatgaggacactcacgcg

SEQ ID NO: 60005 - DNA, 25 bp, E. coli
gagaatcaacaaccacaaaccgagg

SEQ ID NO: 60006 - DNA, 25 bp, E. coli
gatgatcgatgacgacactcacgcg

SEQ ID NO: 60007 - DNA, 25 bp, E. coli
taaatgcctgctgccaaagctggcg

SEQ ID NO: 60008 - DNA, 25 bp, E. coli
taaatgcctgctcccaaagctggcg

SEQ ID NO: 60009 - DNA, 25 bp, E. coli
taaactgtcgctgacgcaagcaggc

SEQ ID NO: 60010 - DNA, 25 bp, E. coli
taaactgtcgctcacgcaagcaggc

SEQ ID NO: 60011 - DNA, 25 bp, E. coli
agctatatggaagcagaagccgccc

SEQ ID NO: 60012 - DNA, 25 bp, E. coli
agctatatggaaccagaagccgccc

SEQ ID NO: 60013 - DNA, 25 bp, E. coli
aaatgttagatcatgggcttgccac

SEQ ID NO: 60014 - DNA, 25 bp, E. coli
aaatgttagatcttgggcttgccac

SEQ ID NO: 60015 - DNA, 25 bp, E. coli
tgataaatgagagccggttcgtcga

SEQ ID NO: 60016 - DNA, 25 bp, E. coli
tgataaatgagacccggttcgtcga

SEQ ID NO: 60017 - DNA, 25 bp, E. coli
tgctcagtcaggagtcagccgttct

SEQ ID NO: 60018 - DNA, 25 bp, E. coli
tgctcagtcaggtgtcagccgttct

SEQ ID NO: 60019 - DNA, 25 bp, E. coli
tgccagccagcacgcgattgataaa

SEQ ID NO: 60020 - DNA, 25 bp, E. coli
tgccagccagcaggcgattgataaa

SEQ ID NO: 60021 - DNA, 25 bp, E. coli
gacggcagcgtaaaccagtgggaac

SEQ ID NO: 60022 - DNA, 25 bp, E. coli
gaaagattcgatgcaggtgtccgcc

SEQ ID NO: 60023 - DNA, 25 bp, E. coli
gaaagattcgatccaggtgtccgcc

SEQ ID NO: 60024 - DNA, 25 bp, E. coli
gacaatgggcctattccgacagcta

SEQ ID NO: 60025 - DNA, 25 bp, E. coli
gacaatgggccttttccgacagcta

SEQ ID NO: 60026 - DNA, 25 bp, E. coli
gacggcagcgtataccagtgggaac

SEQ ID NO: 60027 - DNA, 25 bp, E. coli
taagcggctgggtcttgctcagtca

SEQ ID NO: 60028 - DNA, 25 bp, E. coli
taagcggctgggacttgctcagtca

SEQ ID NO: 60029 - DNA, 25 bp, E. coli
aacgtttttgccgtatgagctccgg

SEQ ID NO: 60030 - DNA, 25 bp, E. coli
cactttcaggcctcgtgcggattca

SEQ ID NO: 60031 - DNA, 25 bp, E. coli
cactttcaggccacgtgcggattca

SEQ ID NO: 60032 - DNA, 25 bp, E. coli
tacactgactgatacgtttttgccc

SEQ ID NO: 60033 - DNA, 25 bp, E. coli
tacactgactgaaacgtttttgccc

SEQ ID NO: 60034 - DNA, 25 bp, E. coli
acaatttttacagtttcaggcctcg

SEQ ID NO: 60035 - DNA, 25 bp, E. coli
aacgtttttgccctatgagctccgg

SEQ ID NO: 60036 - DNA, 25 bp, E. coli
acaatttttacactttcaggcctcg

SEQ ID NO: 60037 - DNA, 25 bp, E. coli
tatctgcgcttaacctttatggtta

SEQ ID NO: 60038 - DNA, 25 bp, E. coli
tatgagctccggatacaggcgtttc

SEQ ID NO: 60039 - DNA, 25 bp, E. coli
tatgagctccggttacaggcgtttc

SEQ ID NO: 60040 - DNA, 25 bp, E. coli
tatctgcgcttatcctttatggtta

SEQ ID NO: 60041 - DNA, 25 bp, E. coli
ttttaccggtaagatgatcttgcgc

SEQ ID NO: 60042 - DNA, 25 bp, E. coli
ttttaccggtaacatgatcttgcgc

SEQ ID NO: 60043 - DNA, 25 bp, E. coli
tgcggattcacccacgaggcttttt

SEQ ID NO: 60044 - DNA, 25 bp, E. coli
tgcggattcaccgacgaggcttttt

SEQ ID NO: 60045 - DNA, 25 bp, E. coli
ccggttacaggcctttcagtcataa

SEQ ID NO: 60046 - DNA, 25 bp, E. coli
ccggttacaggcgtttcagtcataa

SEQ ID NO: 60047 - DNA, 25 bp, E. coli
gatcttgcgcagtttgtagaacaat

SEQ ID NO: 60048 - DNA, 25 bp, E. coli
ggcgtttcagtcataaatcctctga

SEQ ID NO: 60049 - DNA, 25 bp, E. coli
ggcgtttcagtcttaaatcctctga

SEQ ID NO: 60050 - DNA, 25 bp, E. coli
gatcttgcgcagattgtagaacaat

SEQ ID NO: 60051 - DNA, 25 bp, E. coli
caagtgccgatgactttctatcagg

SEQ ID NO: 60052 - DNA, 25 bp, E. coli
caagtgccgatgtctttctatcagg

SEQ ID NO: 60053 - DNA, 25 bp, E. coli
cacgaaattgcgtgctgttttccag

SEQ ID NO: 60054 - DNA, 25 bp, E. coli
cacgaaattgcgagctgttttccag

SEQ ID NO: 60055 - DNA, 25 bp, E. coli
cataagtaattagcgtcaagtgccg

SEQ ID NO: 60056 - DNA, 25 bp, E. coli
cataagtaattaccgtcaagtgccg

SEQ ID NO: 60057 - DNA, 25 bp, E. coli
taaacctggacgagagacaacggta

SEQ ID NO: 60058 - DNA, 25 bp, E. coli
taaacctggacgtgagacaacggta

SEQ ID NO: 60059 - DNA, 25 bp, E. coli
atttttcgtcatacgggttagccag

SEQ ID NO: 60060 - DNA, 25 bp, E. coli
atttttcgtcattcgggttagccag

SEQ ID NO: 60061 - DNA, 25 bp, E. coli
gattcccggttagcctgaaaacaga

SEQ ID NO: 60062 - DNA, 25 bp, E. coli
gattcccggttaccctgaaaacaga

SEQ ID NO: 60063 - DNA, 25 bp, E. coli
tgtaaaaatgtgacgcaaagaggtt

SEQ ID NO: 60064 - DNA, 25 bp, E. coli
tccttagggacgtaaataatcactt

SEQ ID NO: 60065 - DNA, 25 bp, E. coli
tgtaaaaatgtgtcgcaaagaggtt

SEQ ID NO: 60066 - DNA, 25 bp, E. coli
gaaaacagaaagactcaggcacccg

SEQ ID NO: 60067 - DNA, 25 bp, E. coli
gaaaacagaaagtctcaggcacccg

SEQ ID NO: 60068 - DNA, 25 bp, E. coli
ggttagccagtttagccattcgtta

SEQ ID NO: 60069 - DNA, 25 bp, E. coli
ggcacccgcaggcatcctatgaggt

SEQ ID NO: 60070 - DNA, 25 bp, E. coli
ggttagccagttaagccattcgtta

SEQ ID NO: 60071 - DNA, 25 bp, E. coli
ggcacccgcagggatcctatgaggt

SEQ ID NO: 60072 - DNA, 25 bp, E. coli
tccttagggacgaaaataatcactt

SEQ ID NO: 60073 - DNA, 25 bp, E. coli
aaggcataattcgtcctgttcagaa

SEQ ID NO: 60074 - DNA, 25 bp, E. coli
aaggcataattcctcctgttcagaa

SEQ ID NO: 60075 - DNA, 25 bp, E. coli
cagcagcaggtttcaaaaatccgga

SEQ ID NO: 60076 - DNA, 25 bp, E. coli
caaaaatccggacaaatattcaacg

SEQ ID NO: 60077 - DNA, 25 bp, E. coli
cagcagcaggttacaaaaatccgga

SEQ ID NO: 60078 - DNA, 25 bp, E. coli
caaaaatccggagaaatattcaacg

SEQ ID NO: 60079 - DNA, 25 bp, E. coli
aacgaaatattaatcacttcaccgg

SEQ ID NO: 60080 - DNA, 25 bp, E. coli
aacgaaatattattcacttcaccgg

SEQ ID NO: 60081 - DNA, 25 bp, E. coli
tccggagaaataatcaacgaaatat

SEQ ID NO: 60082 - DNA, 25 bp, E. coli
tccggagaaatattcaacgaaatat

SEQ ID NO: 60083 - DNA, 25 bp, E. coli
tcacttcaccggttattctgatgcg

SEQ ID NO: 60084 - DNA, 25 bp, E. coli
tctgatgcgtaccttcactggtcta

SEQ ID NO: 60085 - DNA, 25 bp, E. coli
tcacttcaccggatattctgatgcg

SEQ ID NO: 60086 - DNA, 25 bp, E. coli
tctgatgcgtacgttcactggtcta

SEQ ID NO: 60087 - DNA, 25 bp, E. coli
gcgtaccttcacaggtctatttaag

SEQ ID NO: 60088 - DNA, 25 bp, E. coli
gcgtaccttcactggtctatttaag

SEQ ID NO: 60089 - DNA, 25 bp, E. coli
ccggatattctgttgcgtaccttca

SEQ ID NO: 60090 - DNA, 25 bp, E. coli
ccggatattctgatgcgtaccttca

SEQ ID NO: 60091 - DNA, 25 bp, E. coli
gttcagaatttctacagcagcaggt

SEQ ID NO: 60092 - DNA, 25 bp, E. coli
gttcagaatttcaacagcagcaggt

SEQ ID NO: 60093 - DNA, 25 bp, E. coli
ggctgctaaaggcataattcctcct

SEQ ID NO: 60094 - DNA, 25 bp, E. coli
ggctgctaaagggataattcctcct

SEQ ID NO: 60095 - DNA, 25 bp, E. coli
aatttatgtgttgatccgtgcccga

SEQ ID NO: 60096 - DNA, 25 bp, E. coli
aatttatgtgttcatccgtgcccga

SEQ ID NO: 60097 - DNA, 25 bp, E. coli
actaaatgtattgaggcgtgtccgg

SEQ ID NO: 60098 - DNA, 25 bp, E. coli
actaaatgtattcaggcgtgtccgg

SEQ ID NO: 60099 - DNA, 25 bp, E. coli
tgagtgatctctctacgggctgcaa

SEQ ID NO: 60100 - DNA, 25 bp, E. coli
tgagtgatctctgtacgggctgcaa

SEQ ID NO: 60101 - DNA, 25 bp, E. coli
tcctggaaatggcatctgaacacca

SEQ ID NO: 60102 - DNA, 25 bp, E. coli
tcctggaaatgggatctgaacacca

SEQ ID NO: 60103 - DNA, 25 bp, E. coli
ccagtgtggtcactgcggttatccc

SEQ ID NO: 60104 - DNA, 25 bp, E. coli
ccagtgtggtcagtgcggttatccc

SEQ ID NO: 60105 - DNA, 25 bp, E. coli
gcatctcgttgctaccggtcgcaga

SEQ ID NO: 60106 - DNA, 25 bp, E. coli
gaagccatcagctgtaacggtgaaa

SEQ ID NO: 60107 - DNA, 25 bp, E. coli
gaagccatcagcagtaacggtgaaa

SEQ ID NO: 60108 - DNA, 25 bp, E. coli
gcatctcgttgcaaccggtcgcaga

SEQ ID NO: 60109 - DNA, 25 bp, E. coli
gaaatcttaccgcagagccagtgtg

SEQ ID NO: 60110 - DNA, 25 bp, E. coli
gaaatcttaccggagagccagtgtg

SEQ ID NO: 60111 - DNA, 25 bp, E. coli
gatccggtcgttcagaaaattgacg

SEQ ID NO: 60112 - DNA, 25 bp, E. coli
ttttgcggtggaagacgatccggtc

SEQ ID NO: 60113 - DNA, 25 bp, E. coli
ttttgcggtggatgacgatccggtc

SEQ ID NO: 60114 - DNA, 25 bp, E. coli
gatccggtcgttgagaaaattgacg

SEQ ID NO: 60115 - DNA, 25 bp, E. coli
gagttgcttaatctcgagccgcagc

SEQ ID NO: 60116 - DNA, 25 bp, E. coli
gagttgcttaatgtcgagccgcagc

SEQ ID NO: 60117 - DNA, 25 bp, E. coli
cacgtcttcctggatcagtgggcaa

SEQ ID NO: 60118 - DNA, 25 bp, E. coli
cacgtcttcctgcatcagtgggcaa

SEQ ID NO: 60119 - DNA, 25 bp, E. coli
cggaagttttgtaccatcacgtctt

SEQ ID NO: 60120 - DNA, 25 bp, E. coli
catcacgtcttcgtgcatcagtggg

SEQ ID NO: 60121 - DNA, 25 bp, E. coli
catcacgtcttcctgcatcagtggg

SEQ ID NO: 60122 - DNA, 25 bp, E. coli
cagtgggcaaatttgttacagttgc

SEQ ID NO: 60123 - DNA, 25 bp, E. coli
cggaagttttgttccatcacgtctt

SEQ ID NO: 60124 - DNA, 25 bp, E. coli
cagtgggcaaatatgttacagttgc

SEQ ID NO: 60125 - DNA, 25 bp, E. coli
tccaccaaatcctgcataaccaaaa

SEQ ID NO: 60126 - DNA, 25 bp, E. coli
tccaccaaatccagcataaccaaaa

SEQ ID NO: 60127 - DNA, 25 bp, E. coli
tcctgcataacctaaatcatttcgg

SEQ ID NO: 60128 - DNA, 25 bp, E. coli
tcctgcataaccaaaatcatttcgg

SEQ ID NO: 60129 - DNA, 25 bp, E. coli
gcatcagtgggctaatatgttacag

SEQ ID NO: 60130 - DNA, 25 bp, E. coli
gcatcagtgggcaaatatgttacag

SEQ ID NO: 60131 - DNA, 25 bp, E. coli
gaagttttgtacgatcacgtcttcc

SEQ ID NO: 60132 - DNA, 25 bp, E. coli
gaagttttgtaccatcacgtcttcc

SEQ ID NO: 60133 - DNA, 25 bp, E. coli
cgtcttcctgcatcagtgggcaaat

SEQ ID NO: 60134 - DNA, 25 bp, E. coli
cgtcttcctgcaacagtgggcaaat

SEQ ID NO: 60135 - DNA, 25 bp, E. coli
gtaccatcacgtgttcctgcatcag

SEQ ID NO: 60136 - DNA, 25 bp, E. coli
gtaccatcacgtcttcctgcatcag

SEQ ID NO: 60137 - DNA, 25 bp, E. coli
gtgggcaaatatgttacagttgctg

SEQ ID NO: 60138 - DNA, 25 bp, E. coli
gtgggcaaatatcttacagttgctg

SEQ ID NO: 60139 - DNA, 25 bp, E. coli
cactaacactttagtcgagcgcgga

SEQ ID NO: 60140 - DNA, 25 bp, E. coli
cactaacacttttgtcgagcgcgga

SEQ ID NO: 60141 - DNA, 25 bp, E. coli
taaagagtggatcaaacgtctgccg

SEQ ID NO: 60142 - DNA, 25 bp, E. coli
taaagagtggatgaaacgtctgccg

SEQ ID NO: 60143 - DNA, 25 bp, E. coli
aaagcacaggattttgttcgggcac

SEQ ID NO: 60144 - DNA, 25 bp, E. coli
aaagcacaggatattgttcgggcac

SEQ ID NO: 60145 - DNA, 25 bp, E. coli
aacagtacaacaaggcattcagcgc

SEQ ID NO: 60146 - DNA, 25 bp, E. coli
aacagtacaacatggcattcagcgc

SEQ ID NO: 60147 - DNA, 25 bp, E. coli
tcgaagttctggattctggcgcgcg

SEQ ID NO: 60148 - DNA, 25 bp, E. coli
tccaacgcgcgatttgtacgaacag

SEQ ID NO: 60149 - DNA, 25 bp, E. coli
tccaacgcgcgaattgtacgaacag

SEQ ID NO: 60150 - DNA, 25 bp, E. coli
tcgaagttctggtttctggcgcgcg

SEQ ID NO: 60151 - DNA, 25 bp, E. coli
gataaattcgaaatcgtcacgccga

SEQ ID NO: 60152 - DNA, 25 bp, E. coli
gataaattcgaattcgtcacgccga

SEQ ID NO: 60153 - DNA, 25 bp, E. coli
tggctctggcctttgacgtggacgc

SEQ ID NO: 60154 - DNA, 25 bp, E. coli
tggctctggcctatgacgtggacgc

SEQ ID NO: 60155 - DNA, 25 bp, E. coli
tggcggaagcctacctgaaatatct

SEQ ID NO: 60156 - DNA, 25 bp, E. coli
tggcggaagccttcctgaaatatct

SEQ ID NO: 60157 - DNA, 25 bp, E. coli
taatccgaaaagctctggtggcgcg

SEQ ID NO: 60158 - DNA, 25 bp, E. coli
taatccgaaaaggtctggtggcgcg

SEQ ID NO: 60159 - DNA, 25 bp, E. coli
gagtgagtctatgctcgcagagcca

SEQ ID NO: 60160 - DNA, 25 bp, E. coli
gagtgagtctatcctcgcagagcca

SEQ ID NO: 60161 - DNA, 25 bp, E. coli
caacaactgaggatatggctgaccc

SEQ ID NO: 60162 - DNA, 25 bp, E. coli
caacaactgaggttatggctgaccc

SEQ ID NO: 60163 - DNA, 25 bp, E. coli
taccgttgcgggagataaccaggtg

SEQ ID NO: 60164 - DNA, 25 bp, E. coli
taccgttgcgggtgataaccaggtg

SEQ ID NO: 60165 - DNA, 25 bp, E. coli
tattcagcaactggcgaatggtcgc

SEQ ID NO: 60166 - DNA, 25 bp, E. coli
tattcagcaactcgcgaatggtcgc

SEQ ID NO: 60167 - DNA, 25 bp, E. coli
tattgatggcaaaaatcgttacccc

SEQ ID NO: 60168 - DNA, 25 bp, E. coli
tattgatggcaataatcgttacccc

SEQ ID NO: 60169 - DNA, 25 bp, E. coli
tgaacagccttgatacccgtatggt

SEQ ID NO: 60170 - DNA, 25 bp, E. coli
tgaacagccttgttacccgtatggt

SEQ ID NO: 60171 - DNA, 25 bp, E. coli
tccggaccgctgacacaggcatttg

SEQ ID NO: 60172 - DNA, 25 bp, E. coli
tccggaccgctgtcacaggcatttg

SEQ ID NO: 60173 - DNA, 25 bp, E. coli
tcaggaaaaatgacggccaggatcc

SEQ ID NO: 60174 - DNA, 25 bp, E. coli
tcaggaaaaatgtcggccaggatcc

SEQ ID NO: 60175 - DNA, 25 bp, E. coli
gaaactggttcgacagcgtgtccgg

SEQ ID NO: 60176 - DNA, 25 bp, E. coli
gactggcccagcctggtggaaaact

SEQ ID NO: 60177 - DNA, 25 bp, E. coli
gaaactggttcgtcagcgtgtccgg

SEQ ID NO: 60178 - DNA, 25 bp, E. coli
gactggcccagcgtggtggaaaact

SEQ ID NO: 60179 - DNA, 25 bp, E. coli
cgcatgggcgattaaccgtgtggca

SEQ ID NO: 60180 - DNA, 25 bp, E. coli
cgcatgggcgataaaccgtgtggca

SEQ ID NO: 60181 - DNA, 25 bp, E. coli
ggtgtttaaagcgagtccgtcagga

SEQ ID NO: 60182 - DNA, 25 bp, E. coli
ggtgtttaaagccagtccgtcagga

SEQ ID NO: 60183 - DNA, 25 bp, E. coli
taaaactggaatgcgccagctttgt

SEQ ID NO: 60184 - DNA, 25 bp, E. coli
taaaactggaatccgccagctttgt

SEQ ID NO: 60185 - DNA, 25 bp, E. coli
atttacgtgaactgtgcgatctcga

SEQ ID NO: 60186 - DNA, 25 bp, E. coli
atttacgtgaacagtgcgatctcga

SEQ ID NO: 60187 - DNA, 25 bp, E. coli
aaagatttacgtcaactgtgcgatc

SEQ ID NO: 60188 - DNA, 25 bp, E. coli
aaagatttacgtgaactgtgcgatc

SEQ ID NO: 60189 - DNA, 25 bp, E. coli
tcgatgaaaaatagcgggcgctaca

SEQ ID NO: 60190 - DNA, 25 bp, E. coli
tccgccagctttctcgatgaaaaat

SEQ ID NO: 60191 - DNA, 25 bp, E. coli
tccgccagctttgtcgatgaaaaat

SEQ ID NO: 60192 - DNA, 25 bp, E. coli
tcgatgaaaaattgcgggcgctaca

SEQ ID NO: 60193 - DNA, 25 bp, E. coli
ccagctttgtcgatgaaaaattgcg

SEQ ID NO: 60194 - DNA, 25 bp, E. coli
ccagctttgtcgttgaaaaattgcg

SEQ ID NO: 60195 - DNA, 25 bp, E. coli
gcttaaaactggaatccgccagctt

SEQ ID NO: 60196 - DNA, 25 bp, E. coli
gcttaaaactggtatccgccagctt

SEQ ID NO: 60197 - DNA, 25 bp, E. coli
gaatccgccagcattgtcgatgaaa

SEQ ID NO: 60198 - DNA, 25 bp, E. coli
gaatccgccagctttgtcgatgaaa

SEQ ID NO: 60199 - DNA, 25 bp, E. coli
ctttgtcgatgataaattgcgggcg

SEQ ID NO: 60200 - DNA, 25 bp, E. coli
ctttgtcgatgaaaaattgcgggcg

SEQ ID NO: 60201 - DNA, 25 bp, E. coli
gatttacgtgaactgtgcgatctcg

SEQ ID NO: 60202 - DNA, 25 bp, E. coli
gatttacgtgaagtgtgcgatctcg

SEQ ID NO: 60203 - DNA, 25 bp, E. coli
tggaatccgccagctttgtcgatga

SEQ ID NO: 60204 - DNA, 25 bp, E. coli
tggaatccgccacctttgtcgatga

SEQ ID NO: 60205 - DNA, 25 bp, E. coli
caatcccgaatcaaccagaagcgcg

SEQ ID NO: 60206 - DNA, 25 bp, E. coli
caatcccgaatctaccagaagcgcg

SEQ ID NO: 60207 - DNA, 25 bp, E. coli
cagttaagctaaggtgccagggtaa

SEQ ID NO: 60208 - DNA, 25 bp, E. coli
cagttaagctaacgtgccagggtaa

SEQ ID NO: 60209 - DNA, 25 bp, E. coli
tacgaatatgccaaacacggtgcct

SEQ ID NO: 60210 - DNA, 25 bp, E. coli
tacgaatatgcctaacacggtgcct

SEQ ID NO: 60211 - DNA, 25 bp, E. coli
ttttgccagagtgaacacgatcgaa

SEQ ID NO: 60212 - DNA, 25 bp, E. coli
ttttgccagagtcaacacgatcgaa

SEQ ID NO: 60213 - DNA, 25 bp, E. coli
tgaatgtcgcctgcaaaccgaaacg

SEQ ID NO: 60214 - DNA, 25 bp, E. coli
tgaatgtcgcctccaaaccgaaacg

SEQ ID NO: 60215 - DNA, 25 bp, E. coli
tcctgcctggaacgctacgaatatg

SEQ ID NO: 60216 - DNA, 25 bp, E. coli
tcctgcctggaaggctacgaatatg

SEQ ID NO: 60217 - DNA, 25 bp, E. coli
gaaacggccgcttaactaagtgaag

SEQ ID NO: 60218 - DNA, 25 bp, E. coli
gaaacggccgctaaactaagtgaag

SEQ ID NO: 60219 - DNA, 25 bp, E. coli
gattttgatcgctatgtcctggccc

SEQ ID NO: 60220 - DNA, 25 bp, E. coli
gattttgatcgcaatgtcctggccc

SEQ ID NO: 60221 - DNA, 25 bp, E. coli
ggtaaaacagtgagccgccgtgact

SEQ ID NO: 60222 - DNA, 25 bp, E. coli
gggtaaccctgcgtatttgactgaa

SEQ ID NO: 60223 - DNA, 25 bp, E. coli
gggtaaccctgcctatttgactgaa

SEQ ID NO: 60224 - DNA, 25 bp, E. coli
ggtaaaacagtgtgccgccgtgact

SEQ ID NO: 60225 - DNA, 25 bp, E. coli
taagtgaagtcatgccaggagctgg

SEQ ID NO: 60226 - DNA, 25 bp, E. coli
taagtgaagtcaagccaggagctgg

SEQ ID NO: 60227 - DNA, 25 bp, E. coli
cactgtgatgacacgcatggcggac

SEQ ID NO: 60228 - DNA, 25 bp, E. coli
cactgtgatgactcgcatggcggac

SEQ ID NO: 60229 - DNA, 25 bp, E. coli
tattttcgaggcactgagcaacacg

SEQ ID NO: 60230 - DNA, 25 bp, E. coli
tattttcgaggctctgagcaacacg

SEQ ID NO: 60231 - DNA, 25 bp, E. coli
gcattctattacaggcacggtgaca

SEQ ID NO: 60232 - DNA, 25 bp, E. coli
gcattctattactggcacggtgaca

SEQ ID NO: 60233 - DNA, 25 bp, E. coli
gctaatggtgatggcgcaacgcaca

SEQ ID NO: 60234 - DNA, 25 bp, E. coli
gctaatggtgatcgcgcaacgcaca

SEQ ID NO: 60235 - DNA, 25 bp, E. coli
gacaattcgcggacaactaacggcc

SEQ ID NO: 60236 - DNA, 25 bp, E. coli
gacaattcgcggtcaactaacggcc

SEQ ID NO: 60237 - DNA, 25 bp, E. coli
gatttaccgctagagccacgctggt

SEQ ID NO: 60238 - DNA, 25 bp, E. coli
gtaacgttttattcagcgcccgcca

SEQ ID NO: 60239 - DNA, 25 bp, E. coli
gattcagggcgcacggcaaaattat

SEQ ID NO: 60240 - DNA, 25 bp, E. coli
gattcagggcgctcggcaaaattat

SEQ ID NO: 60241 - DNA, 25 bp, E. coli
gatttaccgctacagccacgctggt

SEQ ID NO: 60242 - DNA, 25 bp, E. coli
gtaacgttttatacagcgcccgcca

SEQ ID NO: 60243 - DNA, 25 bp, E. coli
taacggccccgctgaactgtgagtt

SEQ ID NO: 60244 - DNA, 25 bp, E. coli
taacggccccgcagaactgtgagtt

SEQ ID NO: 60245 - DNA, 25 bp, E. coli
gagttctcctcaacggcgggttcaa

SEQ ID NO: 60246 - DNA, 25 bp, E. coli
gagttctcctcatcggcgggttcaa

SEQ ID NO: 60247 - DNA, 25 bp, E. coli
ggaccgggccaacaaacagcatttt

SEQ ID NO: 60248 - DNA, 25 bp, E. coli
ggaccgggccaagaaacagcatttt

SEQ ID NO: 60249 - DNA, 25 bp, E. coli
taaaagcagcacgtactggcaacac

SEQ ID NO: 60250 - DNA, 25 bp, E. coli
taaaagcagcacctactggcaacac

SEQ ID NO: 60251 - DNA, 25 bp, E. coli
actttaaaagcaccacgtactggca

SEQ ID NO: 60252 - DNA, 25 bp, E. coli
aaaagcagcacgtactggcaacacg

SEQ ID NO: 60253 - DNA, 25 bp, E. coli
actttaaaagcagcacgtactggca

SEQ ID NO: 60254 - DNA, 25 bp, E. coli
aaaagcagcacgaactggcaacacg

SEQ ID NO: 60255 - DNA, 25 bp, E. coli
tttactttaaaaccagcacgtactg

SEQ ID NO: 60256 - DNA, 25 bp, E. coli
tttaaaagcagcacgtactggcaac

SEQ ID NO: 60257 - DNA, 25 bp, E. coli
tttaaaagcagctcgtactggcaac

SEQ ID NO: 60258 - DNA, 25 bp, E. coli
tttactttaaaagcagcacgtactg

SEQ ID NO: 60259 - DNA, 25 bp, E. coli
tgatctttactttaaaagcagcacg

SEQ ID NO: 60260 - DNA, 25 bp, E. coli
tgatctttacttaaaaagcagcacg

SEQ ID NO: 60261 - DNA, 25 bp, E. coli
tcggtgatcttttctttaaaagcag

SEQ ID NO: 60262 - DNA, 25 bp, E. coli
tcggtgatctttactttaaaagcag

SEQ ID NO: 60263 - DNA, 25 bp, E. coli
tactttaaaagctgcacgtactggc

SEQ ID NO: 60264 - DNA, 25 bp, E. coli
tactttaaaagcagcacgtactggc

SEQ ID NO: 60265 - DNA, 25 bp, E. coli
ctttaaaagcagcacgtactggcaa

SEQ ID NO: 60266 - DNA, 25 bp, E. coli
ctttaaaagcaggacgtactggcaa

SEQ ID NO: 60267 - DNA, 25 bp, E. coli
ggtgatctttactttaaaagcagca

SEQ ID NO: 60268 - DNA, 25 bp, E. coli
ggtgatctttacattaaaagcagca

SEQ ID NO: 60269 - DNA, 25 bp, E. coli
gatctttacttttaaagcagcacgt

SEQ ID NO: 60270 - DNA, 25 bp, E. coli
gatctttactttaaaagcagcacgt

SEQ ID NO: 60271 - DNA, 25 bp, E. coli
cagctaaccgtcaggaataccaggc

SEQ ID NO: 60272 - DNA, 25 bp, E. coli
cagctaaccgtctggaataccaggc

SEQ ID NO: 60273 - DNA, 25 bp, E. coli
catgccgagtctattcctcctgaaa

SEQ ID NO: 60274 - DNA, 25 bp, E. coli
catgaagcaggtgtgagatcctgac

SEQ ID NO: 60275 - DNA, 25 bp, E. coli
catgaagcaggtctgagatcctgac

SEQ ID NO: 60276 - DNA, 25 bp, E. coli
catgccgagtcttttcctcctgaaa

SEQ ID NO: 60277 - DNA, 25 bp, E. coli
tgaaagtagaaaccactccagccat

SEQ ID NO: 60278 - DNA, 25 bp, E. coli
tgaaagtagaaagcactccagccat

SEQ ID NO: 60279 - DNA, 25 bp, E. coli
tcccgtaatcgtatgaattgtcagc

SEQ ID NO: 60280 - DNA, 25 bp, E. coli
tcccgtaatcgtttgaattgtcagc

SEQ ID NO: 60281 - DNA, 25 bp, E. coli
tgcgaaagagaactagccggtagcc

SEQ ID NO: 60282 - DNA, 25 bp, E. coli
tgcgaaagagaagtagccggtagcc

SEQ ID NO: 60283 - DNA, 25 bp, E. coli
tcagggaagagtttcacatgaagca

SEQ ID NO: 60284 - DNA, 25 bp, E. coli
tcagggaagagtatcacatgaagca

SEQ ID NO: 60285 - DNA, 25 bp, E. coli
gcttaataatcccaaacatgccgag

SEQ ID NO: 60286 - DNA, 25 bp, E. coli
gcttaataatccgaaacatgccgag

SEQ ID NO: 60287 - DNA, 25 bp, E. coli
gaataccaggctaagtacacagcac

SEQ ID NO: 60288 - DNA, 25 bp, E. coli
gaataccaggcttagtacacagcac

SEQ ID NO: 60289 - DNA, 25 bp, E. coli
cggtagcccggcagaaatcatcagg

SEQ ID NO: 60290 - DNA, 25 bp, E. coli
cggtagcccggctgaaatcatcagg

SEQ ID NO: 60291 - DNA, 25 bp, E. coli
taaggttgaacaagaaggttcagcc

SEQ ID NO: 60292 - DNA, 25 bp, E. coli
taaggttgaacatgaaggttcagcc

SEQ ID NO: 60293 - DNA, 25 bp, E. coli
taccgatccgtccaatttaccctgg

SEQ ID NO: 60294 - DNA, 25 bp, E. coli
taacactggcaagcgaaaatatcgg

SEQ ID NO: 60295 - DNA, 25 bp, E. coli
taacactggcaaccgaaaatatcgg

SEQ ID NO: 60296 - DNA, 25 bp, E. coli
taccgatccgtcgaatttaccctgg

SEQ ID NO: 60297 - DNA, 25 bp, E. coli
tattcctctatgttgccgagccagg

SEQ ID NO: 60298 - DNA, 25 bp, E. coli
tatcggcgcgcttctgttgaatggt

SEQ ID NO: 60299 - DNA, 25 bp, E. coli
tattcctctatgatgccgagccagg

SEQ ID NO: 60300 - DNA, 25 bp, E. coli
tatcggcgcgctactgttgaatggt

SEQ ID NO: 60301 - DNA, 25 bp, E. coli
tatcgtcaataaaaagctacgcgcc

SEQ ID NO: 60302 - DNA, 25 bp, E. coli
tatcgtcaataataagctacgcgcc

SEQ ID NO: 60303 - DNA, 25 bp, E. coli
ttacttctggttccctgggaggatc

SEQ ID NO: 60304 - DNA, 25 bp, E. coli
ttacttctggttgcctgggaggatc

SEQ ID NO: 60305 - DNA, 25 bp, E. coli
tgcaagcggcgaagattatcaggga

SEQ ID NO: 60306 - DNA, 25 bp, E. coli
tgcaagcggcgatgattatcaggga

SEQ ID NO: 60307 - DNA, 25 bp, E. coli
tgccttcaaaagagatgacctgatg

SEQ ID NO: 60308 - DNA, 25 bp, E. coli
tgccttcaaaagtgatgacctgatg

SEQ ID NO: 60309 - DNA, 25 bp, E. coli
cgccttttgcgatcgtaccactggt

SEQ ID NO: 60310 - DNA, 25 bp, E. coli
cgccttttgcgaacgtaccactggt

SEQ ID NO: 60311 - DNA, 25 bp, E. coli
ggaccaatttaatcgttgcctgcgg

SEQ ID NO: 60312 - DNA, 25 bp, E. coli
ggaccaatttaaacgttgcctgcgg

SEQ ID NO: 60313 - DNA, 25 bp, E. coli
ggatcactctcagtggcgccattta

SEQ ID NO: 60314 - DNA, 25 bp, E. coli
ggatcactctcactggcgccattta

SEQ ID NO: 60315 - DNA, 25 bp, E. coli
tacctcatactcaacgccggaaggc

SEQ ID NO: 60316 - DNA, 25 bp, E. coli
tacctcatactctacgccggaaggc

SEQ ID NO: 60317 - DNA, 25 bp, E. coli
ttgatctcttctgcggtcatcaggc

SEQ ID NO: 60318 - DNA, 25 bp, E. coli
ttgatctcttctccggtcatcaggc

SEQ ID NO: 60319 - DNA, 25 bp, E. coli
tgggtatgcactttgccgccaatct

SEQ ID NO: 60320 - DNA, 25 bp, E. coli
tgggtatgcactatgccgccaatct

SEQ ID NO: 60321 - DNA, 25 bp, E. coli
tcgtcggcggtctttacctcatact

SEQ ID NO: 60322 - DNA, 25 bp, E. coli
tcgtcggcggtcattacctcatact

SEQ ID NO: 60323 - DNA, 25 bp, E. coli
tctccgcaaagccacggtaaagcgc

SEQ ID NO: 60324 - DNA, 25 bp, E. coli
tctccgcaaagcgacggtaaagcgc

SEQ ID NO: 60325 - DNA, 25 bp, E. coli
gccggaaggcttaatcaccatccat

SEQ ID NO: 60326 - DNA, 25 bp, E. coli
gccggaaggctttatcaccatccat

SEQ ID NO: 60327 - DNA, 25 bp, E. coli
gcggcattttttgcccaggcgaacg

SEQ ID NO: 60328 - DNA, 25 bp, E. coli
gcggcattttttccccaggcgaacg

SEQ ID NO: 60329 - DNA, 25 bp, E. coli
gcactcttccagtaccacggcgtta

SEQ ID NO: 60330 - DNA, 25 bp, E. coli
gcactcttccagaaccacggcgtta

SEQ ID NO: 60331 - DNA, 25 bp, E. coli
gtttgccgccagcacgtcagctttc

SEQ ID NO: 60332 - DNA, 25 bp, E. coli
gtttgccgccaggacgtcagctttc

SEQ ID NO: 60333 - DNA, 25 bp, E. coli
gggttcaacccaggctcttcgaagg

SEQ ID NO: 60334 - DNA, 25 bp, E. coli
gtctggtattcaaactcgccgttga

SEQ ID NO: 60335 - DNA, 25 bp, E. coli
gtctggtattcatactcgccgttga

SEQ ID NO: 60336 - DNA, 25 bp, E. coli
gggttcaacccacgctcttcgaagg

SEQ ID NO: 60337 - DNA, 25 bp, E. coli
caatgggatggctacatttgtgtcg

SEQ ID NO: 60338 - DNA, 25 bp, E. coli
caatgggatggcaacatttgtgtcg

SEQ ID NO: 60339 - DNA, 25 bp, E. coli
catttgtgtcggttgtgatagccaa

SEQ ID NO: 60340 - DNA, 25 bp, E. coli
catttgtgtcggatgtgatagccaa

SEQ ID NO: 60341 - DNA, 25 bp, E. coli
ataagatgttcattcgcgccgccgg

SEQ ID NO: 60342 - DNA, 25 bp, E. coli
ataagatgttcaatcgcgccgccgg

SEQ ID NO: 60343 - DNA, 25 bp, E. coli
aactggtcaataattggagtgcagg

SEQ ID NO: 60344 - DNA, 25 bp, E. coli
aaagatttagcagccatgtagcctg

SEQ ID NO: 60345 - DNA, 25 bp, E. coli
aaagatttagcacccatgtagcctg

SEQ ID NO: 60346 - DNA, 25 bp, E. coli
aactggtcaatatttggagtgcagg

SEQ ID NO: 60347 - DNA, 25 bp, E. coli
tattcgattaaggaatgggatggca

SEQ ID NO: 60348 - DNA, 25 bp, E. coli
tattcgattaagcaatgggatggca

SEQ ID NO: 60349 - DNA, 25 bp, E. coli
tgagcgccatgagcagcctcaatgg

SEQ ID NO: 60350 - DNA, 25 bp, E. coli
tgagcgccatgaccagcctcaatgg

SEQ ID NO: 60351 - DNA, 25 bp, E. coli
gcctcaatggcgttatcgttaaaga

SEQ ID NO: 60352 - DNA, 25 bp, E. coli
gcctcaatggcgatatcgttaaaga

SEQ ID NO: 60353 - DNA, 25 bp, E. coli
gcgcggtgaggaactggtcaataat

SEQ ID NO: 60354 - DNA, 25 bp, E. coli
gcgcggtgaggatctggtcaataat

SEQ ID NO: 60355 - DNA, 25 bp, E. coli
ggatgtgatagccaataagatgttc

SEQ ID NO: 60356 - DNA, 25 bp, E. coli
ggatgtgatagcgaataagatgttc

SEQ ID NO: 60357 - DNA, 25 bp, E. coli
taagtataccagatttatgagcgcc

SEQ ID NO: 60358 - DNA, 25 bp, E. coli
taagtataccagttttatgagcgcc

SEQ ID NO: 60359 - DNA, 25 bp, E. coli
cactatccgggactgttaccttcat

SEQ ID NO: 60360 - DNA, 25 bp, E. coli
cactatccgggagtgttaccttcat

SEQ ID NO: 60361 - DNA, 25 bp, E. coli
agccaccccgggctgggccatgaaa

SEQ ID NO: 60362 - DNA, 25 bp, E. coli
agccaccccggggtgggccatgaaa

SEQ ID NO: 60363 - DNA, 25 bp, E. coli
attgcgaaacacaatccgggagtgt

SEQ ID NO: 60364 - DNA, 25 bp, E. coli
attgcgaaacactatccgggagtgt

SEQ ID NO: 60365 - DNA, 25 bp, E. coli
attattgcgaaagactatccgggag

SEQ ID NO: 60366 - DNA, 25 bp, E. coli
attattgcgaaacactatccgggag

SEQ ID NO: 60367 - DNA, 25 bp, E. coli
actatccgggagagttaccttcata

SEQ ID NO: 60368 - DNA, 25 bp, E. coli
actatccgggagtgttaccttcata

SEQ ID NO: 60369 - DNA, 25 bp, E. coli
tattgcgaaacactatccgggagtg

SEQ ID NO: 60370 - DNA, 25 bp, E. coli
tattgcgaaacagtatccgggagtg

SEQ ID NO: 60371 - DNA, 25 bp, E. coli
ttgcgaaacactttccgggagtgtt

SEQ ID NO: 60372 - DNA, 25 bp, E. coli
ttgcgaaacactatccgggagtgtt

SEQ ID NO: 60373 - DNA, 25 bp, E. coli
gcgaaacactatgcgggagtgttac

SEQ ID NO: 60374 - DNA, 25 bp, E. coli
gcgaaacactatccgggagtgttac

SEQ ID NO: 60375 - DNA, 25 bp, E. coli
ctatccgggagtcttaccttcataa

SEQ ID NO: 60376 - DNA, 25 bp, E. coli
ctatccgggagtgttaccttcataa

SEQ ID NO: 60377 - DNA, 25 bp, E. coli
tggcggtaaagcgaccccgggctgg

SEQ ID NO: 60378 - DNA, 25 bp, E. coli
tggcggtaaagccaccccgggctgg

SEQ ID NO: 60379 - DNA, 25 bp, E. coli
ttattgcgaaactctatccgggagt

SEQ ID NO: 60380 - DNA, 25 bp, E. coli
ttattgcgaaacactatccgggagt

SEQ ID NO: 60381 - DNA, 25 bp, E. coli
cagaaagcgtttagcccggatgcga

SEQ ID NO: 60382 - DNA, 25 bp, E. coli
cagaaagcgttttgcccggatgcga

SEQ ID NO: 60383 - DNA, 25 bp, E. coli
taacgacgggctcgactatgtgccg

SEQ ID NO: 60384 - DNA, 25 bp, E. coli
aaagccctgactgatagcccgtggg

SEQ ID NO: 60385 - DNA, 25 bp, E. coli
aacagtcgatcatttcccgtgcggg

SEQ ID NO: 60386 - DNA, 25 bp, E. coli
aacagtcgatcaattcccgtgcggg

SEQ ID NO: 60387 - DNA, 25 bp, E. coli
aaagccctgactcatagcccgtggg

SEQ ID NO: 60388 - DNA, 25 bp, E. coli
tatactgagtcagagctggcgcaac

SEQ ID NO: 60389 - DNA, 25 bp, E. coli
tatactgagtcacagctggcgcaac

SEQ ID NO: 60390 - DNA, 25 bp, E. coli
tgctgatttgtaccctgaccgcagg

SEQ ID NO: 60391 - DNA, 25 bp, E. coli
tgctgatttgtagcctgaccgcagg

SEQ ID NO: 60392 - DNA, 25 bp, E. coli
tcagggaaatacctcgtctggacag

SEQ ID NO: 60393 - DNA, 25 bp, E. coli
tcagggaaatacgtcgtctggacag

SEQ ID NO: 60394 - DNA, 25 bp, E. coli
cgtactttgactataccggcgtgca

SEQ ID NO: 60395 - DNA, 25 bp, E. coli
cgtactttgactttaccggcgtgca

SEQ ID NO: 60396 - DNA, 25 bp, E. coli
gattcactgcctcctaacctgctgg

SEQ ID NO: 60397 - DNA, 25 bp, E. coli
gattcactgcctgctaacctgctgg

SEQ ID NO: 60398 - DNA, 25 bp, E. coli
tggcgcaactggagttcaacaaccg

SEQ ID NO: 60399 - DNA, 25 bp, E. coli
tggcgcaactggtgttcaacaaccg

SEQ ID NO: 60400 - DNA, 25 bp, E. coli
taagttccaggctatgatcgacagc

SEQ ID NO: 60401 - DNA, 25 bp, E. coli
taacgacgggctggactatgtgccg

SEQ ID NO: 60402 - DNA, 25 bp, E. coli
taagttccaggcaatgatcgacagc

SEQ ID NO: 60403 - DNA, 25 bp, E. coli
cagtctactgattggcgggcctgaa

SEQ ID NO: 60404 - DNA, 25 bp, E. coli
cagttagccgctgagctggaacgct

SEQ ID NO: 60405 - DNA, 25 bp, E. coli
cagtctactgataggcgggcctgaa

SEQ ID NO: 60406 - DNA, 25 bp, E. coli
cagttagccgctcagctggaacgct

SEQ ID NO: 60407 - DNA, 25 bp, E. coli
tgtcgccgtgggtacgaaaatgccg

SEQ ID NO: 60408 - DNA, 25 bp, E. coli
tgaagctgcaacatgtcgccgtggg

SEQ ID NO: 60409 - DNA, 25 bp, E. coli
tgaagctgcaacttgtcgccgtggg

SEQ ID NO: 60410 - DNA, 25 bp, E. coli
cctgaagggttgacgcctgcctgta

SEQ ID NO: 60411 - DNA, 25 bp, E. coli
cctgaagggttgtcgcctgcctgta

SEQ ID NO: 60412 - DNA, 25 bp, E. coli
gaaagatatgccgttcgagctgatt

SEQ ID NO: 60413 - DNA, 25 bp, E. coli
gaaagatatgcccttcgagctgatt

SEQ ID NO: 60414 - DNA, 25 bp, E. coli
tgtcgccgtgggaacgaaaatgccg

SEQ ID NO: 60415 - DNA, 25 bp, E. coli
ggccgcaggcaataaccgcattgtc

SEQ ID NO: 60416 - DNA, 25 bp, E. coli
ggccgcaggcaaaaaccgcattgtc

SEQ ID NO: 60417 - DNA, 25 bp, E. coli
tcaagcgcatacacgacaaagaggg

SEQ ID NO: 60418 - DNA, 25 bp, E. coli
tcaagcgcatactcgacaaagaggg

SEQ ID NO: 60419 - DNA, 25 bp, E. coli
gatggtcgcgacgtcagtctactga

SEQ ID NO: 60420 - DNA, 25 bp, E. coli
gagtacctgcgtggttttccgaaag

SEQ ID NO: 60421 - DNA, 25 bp, E. coli
gagctgattgaaattccggccggaa

SEQ ID NO: 60422 - DNA, 25 bp, E. coli
gatggtcgcgacctcagtctactga

SEQ ID NO: 60423 - DNA, 25 bp, E. coli
gagctgattgaatttccggccggaa

SEQ ID NO: 60424 - DNA, 25 bp, E. coli
gagtacctgcgtcgttttccgaaag

SEQ ID NO: 60425 - DNA, 25 bp, E. coli
caccgttgatggtcacttttaccag

SEQ ID NO: 60426 - DNA, 25 bp, E. coli
caccgttgatggacacttttaccag

SEQ ID NO: 60427 - DNA, 25 bp, E. coli
caggtcttccaggatctctttgtcg

SEQ ID NO: 60428 - DNA, 25 bp, E. coli
catcttaaagcctggcggcagctgc

SEQ ID NO: 60429 - DNA, 25 bp, E. coli
caggtcttccagcatctctttgtcg

SEQ ID NO: 60430 - DNA, 25 bp, E. coli
catcttaaagccaggcggcagctgc

SEQ ID NO: 60431 - DNA, 25 bp, E. coli
agcaggctcgggacgatctctacgc

SEQ ID NO: 60432 - DNA, 25 bp, E. coli
agcaggctcgggtcgatctctacgc

SEQ ID NO: 60433 - DNA, 25 bp, E. coli
ttttaccagaccagcgccagattcg

SEQ ID NO: 60434 - DNA, 25 bp, E. coli
ttttaccagacctgcgccagattcg

SEQ ID NO: 60435 - DNA, 25 bp, E. coli
tcgttgaatgctgcagccaccaggt

SEQ ID NO: 60436 - DNA, 25 bp, E. coli
tcgttgaatgctccagccaccaggt

SEQ ID NO: 60437 - DNA, 25 bp, E. coli
tctttgtcgtctaccagcaggctcg

SEQ ID NO: 60438 - DNA, 25 bp, E. coli
tcttgcatctgcagggcttgcttca

SEQ ID NO: 60439 - DNA, 25 bp, E. coli
tcttgcatctgctgggcttgcttca

SEQ ID NO: 60440 - DNA, 25 bp, E. coli
tctttgtcgtcttccagcaggctcg

SEQ ID NO: 60441 - DNA, 25 bp, E. coli
cgtttcttcaatacgacgtgctgcg

SEQ ID NO: 60442 - DNA, 25 bp, E. coli
cgtttcttcaattcgacgtgctgcg

SEQ ID NO: 60443 - DNA, 25 bp, E. coli
cggcagctgcataccggaggataca

SEQ ID NO: 60444 - DNA, 25 bp, E. coli
cggcagctgcattccggaggataca

SEQ ID NO: 60445 - DNA, 25 bp, E. coli
ggcttgcttcatcaggttacccaga

SEQ ID NO: 60446 - DNA, 25 bp, E. coli
ggcttgcttcatgaggttacccaga

SEQ ID NO: 60447 - DNA, 25 bp, E. coli
atggcgcgccggatccttacgtctg

SEQ ID NO: 60448 - DNA, 25 bp, E. coli
atggcgcgccggttccttacgtctg

SEQ ID NO: 60449 - DNA, 25 bp, E. coli
aaaacgttgcttagttgtgccaaca

SEQ ID NO: 60450 - DNA, 25 bp, E. coli
aaaacgttgctttgttgtgccaaca

SEQ ID NO: 60451 - DNA, 25 bp, E. coli
tgttgggttctgtccttgcgtccgc

SEQ ID NO: 60452 - DNA, 25 bp, E. coli
tgttgggttctgaccttgcgtccgc

SEQ ID NO: 60453 - DNA, 25 bp, E. coli
tctgtccttgcgtccgcatggcgcg

SEQ ID NO: 60454 - DNA, 25 bp, E. coli
tctgtccttgcgaccgcatggcgcg

SEQ ID NO: 60455 - DNA, 25 bp, E. coli
gcgcgccggttccttacgtctggtt

SEQ ID NO: 60456 - DNA, 25 bp, E. coli
gcgcgccggttcgttacgtctggtt

SEQ ID NO: 60457 - DNA, 25 bp, E. coli
gctctggctgtcgaaaacctcacta

SEQ ID NO: 60458 - DNA, 25 bp, E. coli
gctctggctgtccaaaacctcacta

SEQ ID NO: 60459 - DNA, 25 bp, E. coli
ctggtttcggtatatgcgctctttg

SEQ ID NO: 60460 - DNA, 25 bp, E. coli
ctggtttcggtaaatgcgctctttg

SEQ ID NO: 60461 - DNA, 25 bp, E. coli
gttgtgccaacaatacagccgataa

SEQ ID NO: 60462 - DNA, 25 bp, E. coli
gtaaatgcgctctttgtcgcaccag

SEQ ID NO: 60463 - DNA, 25 bp, E. coli
gttgtgccaacattacagccgataa

SEQ ID NO: 60464 - DNA, 25 bp, E. coli
gtaaatgcgctcattgtcgcaccag

SEQ ID NO: 60465 - DNA, 25 bp, E. coli
tgtcgaaaacctgactatgcaaaaa

SEQ ID NO: 60466 - DNA, 25 bp, E. coli
tgggaaaacgtcaattaaatgaaat

SEQ ID NO: 60467 - DNA, 25 bp, E. coli
tgtcgaaaacctcactatgcaaaaa

SEQ ID NO: 60468 - DNA, 25 bp, E. coli
tgggaaaacgtctattaaatgaaat

SEQ ID NO: 60469 - DNA, 25 bp, E. coli
agtttttacgccactggaagtccag

SEQ ID NO: 60470 - DNA, 25 bp, E. coli
agtttttacgcctctggaagtccag

SEQ ID NO: 60471 - DNA, 25 bp, E. coli
aacaatggtacgcagataatccggg

SEQ ID NO: 60472 - DNA, 25 bp, E. coli
aacaatggtacggagataatccggg

SEQ ID NO: 60473 - DNA, 25 bp, E. coli
tatacggattggactggtctgccgc

SEQ ID NO: 60474 - DNA, 25 bp, E. coli
tatacggattggtctggtctgccgc

SEQ ID NO: 60475 - DNA, 25 bp, E. coli
ttcaggtactcacggaaagcggcaa

SEQ ID NO: 60476 - DNA, 25 bp, E. coli
ttcaggtactcagggaaagcggcaa

SEQ ID NO: 60477 - DNA, 25 bp, E. coli
tcagcaatcatgtcgtaagcctgcc

SEQ ID NO: 60478 - DNA, 25 bp, E. coli
tcagcaatcatgacgtaagcctgcc

SEQ ID NO: 60479 - DNA, 25 bp, E. coli
gcactcttgtaaaactggcccagca

SEQ ID NO: 60480 - DNA, 25 bp, E. coli
gcactcttgtaatactggcccagca

SEQ ID NO: 60481 - DNA, 25 bp, E. coli
cgatcgaacgttttctgcgccgcct

SEQ ID NO: 60482 - DNA, 25 bp, E. coli
cgatcgaacgttatctgcgccgcct

SEQ ID NO: 60483 - DNA, 25 bp, E. coli
cattcgggtcaaaaatggtaacgcg

SEQ ID NO: 60484 - DNA, 25 bp, E. coli
cattcgggtcaataatggtaacgcg

SEQ ID NO: 60485 - DNA, 25 bp, E. coli
ggtttgaccgtgatacatcgccagc

SEQ ID NO: 60486 - DNA, 25 bp, E. coli
ggtggtgatcatactgacgccttca

SEQ ID NO: 60487 - DNA, 25 bp, E. coli
ggttgctcattcttcaggcgatcga

SEQ ID NO: 60488 - DNA, 25 bp, E. coli
ggtttgaccgtgttacatcgccagc

SEQ ID NO: 60489 - DNA, 25 bp, E. coli
ggttgctcattcatcaggcgatcga

SEQ ID NO: 60490 - DNA, 25 bp, E. coli
ggtggtgatcattctgacgccttca

SEQ ID NO: 60491 - DNA, 25 bp, E. coli
caatgaagcaggaatgccggtcgcg

SEQ ID NO: 60492 - DNA, 25 bp, E. coli
caatgaagcaggtatgccggtcgcg

SEQ ID NO: 60493 - DNA, 25 bp, E. coli
cagcgccgcgtgtatgaaaaagatc

SEQ ID NO: 60494 - DNA, 25 bp, E. coli
cagcgccgcgtgaatgaaaaagatc

SEQ ID NO: 60495 - DNA, 25 bp, E. coli
taaaactttcatcccgtgctacgga

SEQ ID NO: 60496 - DNA, 25 bp, E. coli
taaaactttcatgccgtgctacgga

SEQ ID NO: 60497 - DNA, 25 bp, E. coli
ttaaaagcacgtgccgaagctggtg

SEQ ID NO: 60498 - DNA, 25 bp, E. coli
ttaaaagcacgtcccgaagctggtg

SEQ ID NO: 60499 - DNA, 25 bp, E. coli
tgatcagtaaaaatcgcggcaccgt

SEQ ID NO: 60500 - DNA, 25 bp, E. coli
tgttgatgctttggactacgccgct

SEQ ID NO: 60501 - DNA, 25 bp, E. coli
tgatcagtaaaattcgcggcaccgt

SEQ ID NO: 60502 - DNA, 25 bp, E. coli
tgttgatgctttcgactacgccgct

SEQ ID NO: 60503 - DNA, 25 bp, E. coli
gccagtcttaatctgcaggaatccc

SEQ ID NO: 60504 - DNA, 25 bp, E. coli
gccagtcttaatgtgcaggaatccc

SEQ ID NO: 60505 - DNA, 25 bp, E. coli
gaatatcagggttaagccgtcgcgc

SEQ ID NO: 60506 - DNA, 25 bp, E. coli
gaatatcagggtaaagccgtcgcgc

SEQ ID NO: 60507 - DNA, 25 bp, E. coli
gaactggatcttacctgctggcgcg

SEQ ID NO: 60508 - DNA, 25 bp, E. coli
gaactggatctttcctgctggcgcg

SEQ ID NO: 60509 - DNA, 25 bp, E. coli
gattgcttttgttaccgcccaggaa

SEQ ID NO: 60510 - DNA, 25 bp, E. coli
gattgcttttgtaaccgcccaggaa

SEQ ID NO: 60511 - DNA, 25 bp, E. coli
ggcggcacggatgcaaagcgaattt

SEQ ID NO: 60512 - DNA, 25 bp, E. coli
ggcggcacggatccaaagcgaattt

SEQ ID NO: 60513 - DNA, 25 bp, E. coli
tagcagtatgccgtggcgaacgtga

SEQ ID NO: 60514 - DNA, 25 bp, E. coli
actgcttgagcgtcatggttatgcc

SEQ ID NO: 60515 - DNA, 25 bp, E. coli
actgcttgagcgacatggttatgcc

SEQ ID NO: 60516 - DNA, 25 bp, E. coli
tagcagtatgccctggcgaacgtga

SEQ ID NO: 60517 - DNA, 25 bp, E. coli
ccagtgacagaaccagaacgcgtgt

SEQ ID NO: 60518 - DNA, 25 bp, E. coli
ccagtgacagaagcagaacgcgtgt

SEQ ID NO: 60519 - DNA, 25 bp, E. coli
gccttcaatgagttggatcttggca

SEQ ID NO: 60520 - DNA, 25 bp, E. coli
gccttcaatgagatggatcttggca

SEQ ID NO: 60521 - DNA, 25 bp, E. coli
gctgaagactactccgattctgacg

SEQ ID NO: 60522 - DNA, 25 bp, E. coli
gcggaaagcttttcgacgactaatc

SEQ ID NO: 60523 - DNA, 25 bp, E. coli
gctgaagactacaccgattctgacg

SEQ ID NO: 60524 - DNA, 25 bp, E. coli
gcggaaagctttacgacgactaatc

SEQ ID NO: 60525 - DNA, 25 bp, E. coli
gacaataaacataatccacgtggat

SEQ ID NO: 60526 - DNA, 25 bp, E. coli
gacaataaacattatccacgtggat

SEQ ID NO: 60527 - DNA, 25 bp, E. coli
cgtgtggtccaagtatatgacgcgt

SEQ ID NO: 60528 - DNA, 25 bp, E. coli
cgtgtggtccaactatatgacgcgt

SEQ ID NO: 60529 - DNA, 25 bp, E. coli
tcaccatcaaagtggcacaactgct

SEQ ID NO: 60530 - DNA, 25 bp, E. coli
tcaccatcaaagaggcacaactgct

SEQ ID NO: 60531 - DNA, 25 bp, E. coli
gatcttggcaaacgcgagccggtta

SEQ ID NO: 60532 - DNA, 25 bp, E. coli
gagaaactcttcctagcagtatgcc

SEQ ID NO: 60533 - DNA, 25 bp, E. coli
gatcttggcaaaggcgagccggtta

SEQ ID NO: 60534 - DNA, 25 bp, E. coli
gagaaactcttcgtagcagtatgcc

SEQ ID NO: 60535 - DNA, 25 bp, E. coli
aagatgttgaagagaagccgcaggc

SEQ ID NO: 60536 - DNA, 25 bp, E. coli
aagatgttgaagtgaagccgcaggc

SEQ ID NO: 60537 - DNA, 25 bp, E. coli
cactggtgtattgccgggaaagcgc

SEQ ID NO: 60538 - DNA, 25 bp, E. coli
cactggtgtattcccgggaaagcgc

SEQ ID NO: 60539 - DNA, 25 bp, E. coli
tacggcggaacacttcccgtggccg

SEQ ID NO: 60540 - DNA, 25 bp, E. coli
tacaaaattattatcacacgccgga

SEQ ID NO: 60541 - DNA, 25 bp, E. coli
tacatgcgcaggtgatggattatct

SEQ ID NO: 60542 - DNA, 25 bp, E. coli
tacaaaattattttcacacgccgga

SEQ ID NO: 60543 - DNA, 25 bp, E. coli
taaaggcgacgacgaaccgatctat

SEQ ID NO: 60544 - DNA, 25 bp, E. coli
tacatgcgcaggagatggattatct

SEQ ID NO: 60545 - DNA, 25 bp, E. coli
tacggcggaacagttcccgtggccg

SEQ ID NO: 60546 - DNA, 25 bp, E. coli
taaaggcgacgaggaaccgatctat

SEQ ID NO: 60547 - DNA, 25 bp, E. coli
tatcacacgccgcaacttacggcgg

SEQ ID NO: 60548 - DNA, 25 bp, E. coli
tatcacacgccggaacttacggcgg

SEQ ID NO: 60549 - DNA, 25 bp, E. coli
tttttaatagctcctttgccgatga

SEQ ID NO: 60550 - DNA, 25 bp, E. coli
tttttaatagctgctttgccgatga

SEQ ID NO: 60551 - DNA, 25 bp, E. coli
tcccgtggccggaagcgctcaactg

SEQ ID NO: 60552 - DNA, 25 bp, E. coli
tcccgtggccggtagcgctcaactg

SEQ ID NO: 60553 - DNA, 25 bp, E. coli
taatacccgtctgattaaaggcgac

SEQ ID NO: 60554 - DNA, 25 bp, E. coli
taatacccgtctcattaaaggcgac

SEQ ID NO: 60555 - DNA, 25 bp, E. coli
gagatttcgcactggtgtattgccg

SEQ ID NO: 60556 - DNA, 25 bp, E. coli
gagatttcgcacaggtgtattgccg

SEQ ID NO: 60557 - DNA, 25 bp, E. coli
cagcagctcacggaagtacaggacg

SEQ ID NO: 60558 - DNA, 25 bp, E. coli
cagcagctcacgcaagtacaggacg

SEQ ID NO: 60559 - DNA, 25 bp, E. coli
catcagcgatgtggttctgggacaa

SEQ ID NO: 60560 - DNA, 25 bp, E. coli
caggaactggtaatcaacatcagcg

SEQ ID NO: 60561 - DNA, 25 bp, E. coli
caggtgctgctttatcgagtacgcc

SEQ ID NO: 60562 - DNA, 25 bp, E. coli
caggaactggtattcaacatcagcg

SEQ ID NO: 60563 - DNA, 25 bp, E. coli
catcagcgatgtcgttctgggacaa

SEQ ID NO: 60564 - DNA, 25 bp, E. coli
caggtgctgcttaatcgagtacgcc

SEQ ID NO: 60565 - DNA, 25 bp, E. coli
tatggctgtcttctgcgccgaacga

SEQ ID NO: 60566 - DNA, 25 bp, E. coli
tatggcacatcggtacgtttagaca

SEQ ID NO: 60567 - DNA, 25 bp, E. coli
tatggcacatcgctacgtttagaca

SEQ ID NO: 60568 - DNA, 25 bp, E. coli
tatggctgtcttgtgcgccgaacga

SEQ ID NO: 60569 - DNA, 25 bp, E. coli
tgttagggcgaatcacaggtgctgc

SEQ ID NO: 60570 - DNA, 25 bp, E. coli
tgttagggcgaaacacaggtgctgc

SEQ ID NO: 60571 - DNA, 25 bp, E. coli
tcatcagtccgtggaggtatgcggt

SEQ ID NO: 60572 - DNA, 25 bp, E. coli
tcatcagtccgtcgaggtatgcggt

SEQ ID NO: 60573 - DNA, 25 bp, E. coli
gacaactgccagcagtagagcgcct

SEQ ID NO: 60574 - DNA, 25 bp, E. coli
gacaactgccaggagtagagcgcct

SEQ ID NO: 60575 - DNA, 25 bp, E. coli
gagtacgccgttgacgaacttatgg

SEQ ID NO: 60576 - DNA, 25 bp, E. coli
gatcgcttcgtttatggccactttg

SEQ ID NO: 60577 - DNA, 25 bp, E. coli
gatcgcttcgttaatggccactttg

SEQ ID NO: 60578 - DNA, 25 bp, E. coli
gagtacgccgttcacgaacttatgg

SEQ ID NO: 60579 - DNA, 25 bp, E. coli
cagcggatgcgatgtccggcaatca

SEQ ID NO: 60580 - DNA, 25 bp, E. coli
cagcggatgcgaagtccggcaatca

SEQ ID NO: 60581 - DNA, 25 bp, E. coli
attgtggaattaggggaagcgcaac

SEQ ID NO: 60582 - DNA, 25 bp, E. coli
attgtggaattacgggaagcgcaac

SEQ ID NO: 60583 - DNA, 25 bp, E. coli
aagcgcaacaggagctaacggctcc

SEQ ID NO: 60584 - DNA, 25 bp, E. coli
aacaggtgctaacggctccggcaca

SEQ ID NO: 60585 - DNA, 25 bp, E. coli
aacgacgcgggcagacggacgtgag

SEQ ID NO: 60586 - DNA, 25 bp, E. coli
aacgacgcgggctgacggacgtgag

SEQ ID NO: 60587 - DNA, 25 bp, E. coli
aacaggtgctaagggctccggcaca

SEQ ID NO: 60588 - DNA, 25 bp, E. coli
aagcgcaacaggtgctaacggctcc

SEQ ID NO: 60589 - DNA, 25 bp, E. coli
tgcaaccagcggatgcgaagtccgg

SEQ ID NO: 60590 - DNA, 25 bp, E. coli
tgcaaccagcggttgcgaagtccgg

SEQ ID NO: 60591 - DNA, 25 bp, E. coli
tctcgggcagatagtggaattaggg

SEQ ID NO: 60592 - DNA, 25 bp, E. coli
tctcgggcagattgtggaattaggg

SEQ ID NO: 60593 - DNA, 25 bp, E. coli
gctgacggacgtcagatccgttgct

SEQ ID NO: 60594 - DNA, 25 bp, E. coli
gctgacggacgtgagatccgttgct

SEQ ID NO: 60595 - DNA, 25 bp, E. coli
cccttgcaaccaccggatgcgaagt

SEQ ID NO: 60596 - DNA, 25 bp, E. coli
cccttgcaaccagcggatgcgaagt

SEQ ID NO: 60597 - DNA, 25 bp, E. coli
cgttgccacagggctgttttttccg

SEQ ID NO: 60598 - DNA, 25 bp, E. coli
cgttgccacaggcctgttttttccg

SEQ ID NO: 60599 - DNA, 25 bp, E. coli
ggaagcgcaacaggtgctaacggct

SEQ ID NO: 60600 - DNA, 25 bp, E. coli
ggaagcgcaacacgtgctaacggct

SEQ ID NO: 60601 - DNA, 25 bp, E. coli
tacccgacgtatgtggcggatgaac

SEQ ID NO: 60602 - DNA, 25 bp, E. coli
tacccgacgtatctggcggatgaac

SEQ ID NO: 60603 - DNA, 25 bp, E. coli
agaaacagggatcctgcggtcagcc

SEQ ID NO: 60604 - DNA, 25 bp, E. coli
agaaacagggatgctgcggtcagcc

SEQ ID NO: 60605 - DNA, 25 bp, E. coli
tacctgctgcggatttggcggcacg

SEQ ID NO: 60606 - DNA, 25 bp, E. coli
tacctgctgcggttttggcggcacg

SEQ ID NO: 60607 - DNA, 25 bp, E. coli
ttgcaagggagagcggtgtatcacc

SEQ ID NO: 60608 - DNA, 25 bp, E. coli
ttacaacgggaacggcagaaagtca

SEQ ID NO: 60609 - DNA, 25 bp, E. coli
ttacaacgggaagggcagaaagtca

SEQ ID NO: 60610 - DNA, 25 bp, E. coli
ttgcaagggagaccggtgtatcacc

SEQ ID NO: 60611 - DNA, 25 bp, E. coli
tggtgacgccctgaaatcaagaatg

SEQ ID NO: 60612 - DNA, 25 bp, E. coli
tggtgacgccctcaaatcaagaatg

SEQ ID NO: 60613 - DNA, 25 bp, E. coli
gaaaaatctgatggccgcactggag

SEQ ID NO: 60614 - DNA, 25 bp, E. coli
gaaaaatctgatcgccgcactggag

SEQ ID NO: 60615 - DNA, 25 bp, E. coli
ctactggaaaaactcggctgtcgcg

SEQ ID NO: 60616 - DNA, 25 bp, E. coli
ctactggaaaaagtcggctgtcgcg

SEQ ID NO: 60617 - DNA, 25 bp, E. coli
gttgccgcgcgtttgcaggatctca

SEQ ID NO: 60618 - DNA, 25 bp, E. coli
gttgccgcgcgtatgcaggatctca

SEQ ID NO: 60619 - DNA, 25 bp, E. coli
ggctgtcgcgtaaatttcccggaga

SEQ ID NO: 60620 - DNA, 25 bp, E. coli
tggcggcacgttctcggtcaaaatg

SEQ ID NO: 60621 - DNA, 25 bp, E. coli
tggcggcacgttgtcggtcaaaatg

SEQ ID NO: 60622 - DNA, 25 bp, E. coli
ggctgtcgcgtatatttcccggaga

SEQ ID NO: 60623 - DNA, 25 bp, E. coli
caagccgggagcgattttaagctgc

SEQ ID NO: 60624 - DNA, 25 bp, E. coli
caagccgggagccattttaagctgc

SEQ ID NO: 60625 - DNA, 25 bp, E. coli
aaagagcggtgtggacttacccgag

SEQ ID NO: 60626 - DNA, 25 bp, E. coli
aaatgacgttgacctggagtggtac

SEQ ID NO: 60627 - DNA, 25 bp, E. coli
aaatgacgttgagctggagtggtac

SEQ ID NO: 60628 - DNA, 25 bp, E. coli
aaagagcggtgtcgacttacccgag

SEQ ID NO: 60629 - DNA, 25 bp, E. coli
tagcaattacgatcaggtcgtgccg

SEQ ID NO: 60630 - DNA, 25 bp, E. coli
tagcaattacgaacaggtcgtgccg

SEQ ID NO: 60631 - DNA, 25 bp, E. coli
tataccattaccagcgataccgctg

SEQ ID NO: 60632 - DNA, 25 bp, E. coli
tataccattacctgcgataccgctg

SEQ ID NO: 60633 - DNA, 25 bp, E. coli
tcagactttgaaccatgggctacgt

SEQ ID NO: 60634 - DNA, 25 bp, E. coli
tcatggttattttgtgcagccaccc

SEQ ID NO: 60635 - DNA, 25 bp, E. coli
tcatggttatttagtgcagccaccc

SEQ ID NO: 60636 - DNA, 25 bp, E. coli
tcagactttgaagcatgggctacgt

SEQ ID NO: 60637 - DNA, 25 bp, E. coli
gctgcatacgcccttagtggtgaat

SEQ ID NO: 60638 - DNA, 25 bp, E. coli
gctgcatacgccgttagtggtgaat

SEQ ID NO: 60639 - DNA, 25 bp, E. coli
gactttgacgattcggccgtagcca

SEQ ID NO: 60640 - DNA, 25 bp, E. coli
gactttgacgatacggccgtagcca

SEQ ID NO: 60641 - DNA, 25 bp, E. coli
tggtgaatgaaacatcccttccggt

SEQ ID NO: 60642 - DNA, 25 bp, E. coli
ggaatacacctcaaacaagccggga

SEQ ID NO: 60643 - DNA, 25 bp, E. coli
ggaatacacctctaacaagccggga

SEQ ID NO: 60644 - DNA, 25 bp, E. coli
tggtgaatgaaagatcccttccggt

SEQ ID NO: 60645 - DNA, 25 bp, E. coli
taaaggcgttagtgctgatccagag

SEQ ID NO: 60646 - DNA, 25 bp, E. coli
taaaggcgttagagctgatccagag

SEQ ID NO: 60647 - DNA, 25 bp, E. coli
aaagcgccttgaagtcgtgaatcac

SEQ ID NO: 60648 - DNA, 25 bp, E. coli
aaagcgccttgatgtcgtgaatcac

SEQ ID NO: 60649 - DNA, 25 bp, E. coli
tatcagttgatcgagaaaaagcggc

SEQ ID NO: 60650 - DNA, 25 bp, E. coli
tatcagttgatccagaaaaagcggc

SEQ ID NO: 60651 - DNA, 25 bp, E. coli
tggttacaggatgatctcggcacgt

SEQ ID NO: 60652 - DNA, 25 bp, E. coli
ccaggtcaggacatgggttgccctc

SEQ ID NO: 60653 - DNA, 25 bp, E. coli
ccaggtcaggacttgggttgccctc

SEQ ID NO: 60654 - DNA, 25 bp, E. coli
gaaagccttagctcatcccacgaaa

SEQ ID NO: 60655 - DNA, 25 bp, E. coli
gaaagccttagcacatcccacgaaa

SEQ ID NO: 60656 - DNA, 25 bp, E. coli
cattggagctgtcaaaagaccgacg

SEQ ID NO: 60657 - DNA, 25 bp, E. coli
cattggagctgtgaaaagaccgacg

SEQ ID NO: 60658 - DNA, 25 bp, E. coli
ggttgccctctaagaaaaacatgga

SEQ ID NO: 60659 - DNA, 25 bp, E. coli
ggtttacgcgcgctcaagattggca

SEQ ID NO: 60660 - DNA, 25 bp, E. coli
ggtttacgcgcggtcaagattggca

SEQ ID NO: 60661 - DNA, 25 bp, E. coli
ggttgccctctatgaaaaacatgga

SEQ ID NO: 60662 - DNA, 25 bp, E. coli
tggttacaggatcatctcggcacgt

SEQ ID NO: 60663 - DNA, 25 bp, E. coli
gaccgacgcattcaggatcttgaaa

SEQ ID NO: 60664 - DNA, 25 bp, E. coli
gagcagcacatgacccttaatcagg

SEQ ID NO: 60665 - DNA, 25 bp, E. coli
gaccgacgcattgaggatcttgaaa

SEQ ID NO: 60666 - DNA, 25 bp, E. coli
gagcagcacatgtcccttaatcagg

SEQ ID NO: 60667 - DNA, 25 bp, E. coli
caataccggtatcgcccataaagag

SEQ ID NO: 60668 - DNA, 25 bp, E. coli
caataccggtatggcccataaagag

SEQ ID NO: 60669 - DNA, 25 bp, E. coli
attcgtcgcgtgctagaaaccggca

SEQ ID NO: 60670 - DNA, 25 bp, E. coli
attcgtcgcgtggtagaaaccggca

SEQ ID NO: 60671 - DNA, 25 bp, E. coli
actgttaatgcgtgcgctggcccca

SEQ ID NO: 60672 - DNA, 25 bp, E. coli
actgttaatgcgagcgctggcccca

SEQ ID NO: 60673 - DNA, 25 bp, E. coli
tatgcagttgcacatcccaagctgg

SEQ ID NO: 60674 - DNA, 25 bp, E. coli
tatgcagttgcagatcccaagctgg

SEQ ID NO: 60675 - DNA, 25 bp, E. coli
tgatggatttcctcagcgtgaccga

SEQ ID NO: 60676 - DNA, 25 bp, E. coli
tgatggatttccacagcgtgaccga

SEQ ID NO: 60677 - DNA, 25 bp, E. coli
cccaagctgggaatttcagggcgcg

SEQ ID NO: 60678 - DNA, 25 bp, E. coli
cccaagctgggattttcagggcgcg

SEQ ID NO: 60679 - DNA, 25 bp, E. coli
cgatggcttactgcaaggcggcgat

SEQ ID NO: 60680 - DNA, 25 bp, E. coli
cgatggcttactccaaggcggcgat

SEQ ID NO: 60681 - DNA, 25 bp, E. coli
gtttttcaccgggttctcgcaggag

SEQ ID NO: 60682 - DNA, 25 bp, E. coli
gtttttcaccggcttctcgcaggag

SEQ ID NO: 60683 - DNA, 25 bp, E. coli
gggcgtactgcaacctcaacgaagg

SEQ ID NO: 60684 - DNA, 25 bp, E. coli
gggcgtactgcatcctcaacgaagg

SEQ ID NO: 60685 - DNA, 25 bp, E. coli
taatgccagtataaagcgcggcgct

SEQ ID NO: 60686 - DNA, 25 bp, E. coli
taatgccagtattaagcgcggcgct

SEQ ID NO: 60687 - DNA, 25 bp, E. coli
gatgtcctgactggccatcgctgga

SEQ ID NO: 60688 - DNA, 25 bp, E. coli
gatgtcctgactcgccatcgctgga

SEQ ID NO: 60689 - DNA, 25 bp, E. coli
caggcatccggaggaggcgaaacaa

SEQ ID NO: 60690 - DNA, 25 bp, E. coli
caggcatccggacgaggcgaaacaa

SEQ ID NO: 60691 - DNA, 25 bp, E. coli
taccctgggcaggcatccggaggag

SEQ ID NO: 60692 - DNA, 25 bp, E. coli
accctgggcagggatccggaggagg

SEQ ID NO: 60693 - DNA, 25 bp, E. coli
accctgggcaggcatccggaggagg

SEQ ID NO: 60694 - DNA, 25 bp, E. coli
taccctgggcagccatccggaggag

SEQ ID NO: 60695 - DNA, 25 bp, E. coli
ttaccctgggcaggcatccggagga

SEQ ID NO: 60696 - DNA, 25 bp, E. coli
ttaccctgggcacgcatccggagga

SEQ ID NO: 60697 - DNA, 25 bp, E. coli
tgggcaggcatccggaggaggcgaa

SEQ ID NO: 60698 - DNA, 25 bp, E. coli
tgggcaggcatcgggaggaggcgaa

SEQ ID NO: 60699 - DNA, 25 bp, E. coli
cctgggcaggcatccggaggaggcg

SEQ ID NO: 60700 - DNA, 25 bp, E. coli
cctgggcaggcaaccggaggaggcg

SEQ ID NO: 60701 - DNA, 25 bp, E. coli
gcaggcatccggaggaggcgaaaca

SEQ ID NO: 60702 - DNA, 25 bp, E. coli
gcaggcatccggtggaggcgaaaca

SEQ ID NO: 60703 - DNA, 25 bp, E. coli
ccctgggcaggcttccggaggaggc

SEQ ID NO: 60704 - DNA, 25 bp, E. coli
ccctgggcaggcatccggaggaggc

SEQ ID NO: 60705 - DNA, 25 bp, E. coli
ctgggcaggcatgcggaggaggcga

SEQ ID NO: 60706 - DNA, 25 bp, E. coli
ctgggcaggcatccggaggaggcga

SEQ ID NO: 60707 - DNA, 25 bp, E. coli
gggcaggcatcccgaggaggcgaaa

SEQ ID NO: 60708 - DNA, 25 bp, E. coli
gggcaggcatccggaggaggcgaaa

SEQ ID NO: 60709 - DNA, 25 bp, E. coli
ggcaggcatccgcaggaggcgaaac

SEQ ID NO: 60710 - DNA, 25 bp, E. coli
ggcaggcatccggaggaggcgaaac

SEQ ID NO: 60711 - DNA, 25 bp, E. coli
aggcaatgaacctctgccagatccc

SEQ ID NO: 60712 - DNA, 25 bp, E. coli
aggatggcgaaatatgcagggaaat

SEQ ID NO: 60713 - DNA, 25 bp, E. coli
atgctctggcagacgggctaccgct

SEQ ID NO: 60714 - DNA, 25 bp, E. coli
atgctctggcagtcgggctaccgct

SEQ ID NO: 60715 - DNA, 25 bp, E. coli
aggatggcgaaaaatgcagggaaat

SEQ ID NO: 60716 - DNA, 25 bp, E. coli
aggcaatgaaccactgccagatccc

SEQ ID NO: 60717 - DNA, 25 bp, E. coli
aaagaggctctgcttgcgtcagccg

SEQ ID NO: 60718 - DNA, 25 bp, E. coli
aaagaggctctggttgcgtcagccg

SEQ ID NO: 60719 - DNA, 25 bp, E. coli
tgttccaggcaatgaacctctgcca

SEQ ID NO: 60720 - DNA, 25 bp, E. coli
tgttccaggcaaagaacctctgcca

SEQ ID NO: 60721 - DNA, 25 bp, E. coli
tccggaaaccgctggcagcacgtca

SEQ ID NO: 60722 - DNA, 25 bp, E. coli
tccggaaaccgcaggcagcacgtca

SEQ ID NO: 60723 - DNA, 25 bp, E. coli
gcatatccggaatccgctggcagca

SEQ ID NO: 60724 - DNA, 25 bp, E. coli
gcatatccggaaaccgctggcagca

SEQ ID NO: 60725 - DNA, 25 bp, E. coli
cccgcggacagctgaaagaggctct

SEQ ID NO: 60726 - DNA, 25 bp, E. coli
cccgcggacagcagaaagaggctct

SEQ ID NO: 60727 - DNA, 25 bp, E. coli
cgtccccggaaatggctgaaatatg

SEQ ID NO: 60728 - DNA, 25 bp, E. coli
cattgctgaaaaaattgttccaggc

SEQ ID NO: 60729 - DNA, 25 bp, E. coli
cattgctgaaaatattgttccaggc

SEQ ID NO: 60730 - DNA, 25 bp, E. coli
cgtccccggaaaaggctgaaatatg

SEQ ID NO: 60731 - DNA, 25 bp, E. coli
gatccccggacgagcaggagcactg

SEQ ID NO: 60732 - DNA, 25 bp, E. coli
gatccccggacgtgcaggagcactg

SEQ ID NO: 60733 - DNA, 25 bp, E. coli
caatcgtgggtatgcggattatctg

SEQ ID NO: 60734 - DNA, 25 bp, E. coli
caatcgtgggtaagcggattatctg

SEQ ID NO: 60735 - DNA, 25 bp, E. coli
aactggtcgcttgatgacattcccg

SEQ ID NO: 60736 - DNA, 25 bp, E. coli
aactggtcgcttcatgacattcccg

SEQ ID NO: 60737 - DNA, 25 bp, E. coli
tttatgacatttgcgggttaccact

SEQ ID NO: 60738 - DNA, 25 bp, E. coli
tttatgacatttccgggttaccact

SEQ ID NO: 60739 - DNA, 25 bp, E. coli
tgctggagcattatccgctgcgcaa

SEQ ID NO: 60740 - DNA, 25 bp, E. coli
tgctggagcattttccgctgcgcaa

SEQ ID NO: 60741 - DNA, 25 bp, E. coli
ccggtcaggcggttaagcattgcca

SEQ ID NO: 60742 - DNA, 25 bp, E. coli
ccggtcaggcggataagcattgcca

SEQ ID NO: 60743 - DNA, 25 bp, E. coli
gcgggttaccactgcacagcaatta

SEQ ID NO: 60744 - DNA, 25 bp, E. coli
gcgggttaccacagcacagcaatta

SEQ ID NO: 60745 - DNA, 25 bp, E. coli
cgctctgtaaaaggcttgggttctc

SEQ ID NO: 60746 - DNA, 25 bp, E. coli
cgctctgtaaaacgcttgggttctc

SEQ ID NO: 60747 - DNA, 25 bp, E. coli
gtacactgtgcctggacgtgcgcaa

SEQ ID NO: 60748 - DNA, 25 bp, E. coli
gggtgtttcttgtcgaacatggcga

SEQ ID NO: 60749 - DNA, 25 bp, E. coli
ggagatcgccgtgtcgctcaatcgt

SEQ ID NO: 60750 - DNA, 25 bp, E. coli
gggtgtttcttgacgaacatggcga

SEQ ID NO: 60751 - DNA, 25 bp, E. coli
ggagatcgccgtctcgctcaatcgt

SEQ ID NO: 60752 - DNA, 25 bp, E. coli
gtacactgtgccaggacgtgcgcaa

SEQ ID NO: 60753 - DNA, 25 bp, E. coli
gatgggtcagtgagtcgctctgtaa

SEQ ID NO: 60754 - DNA, 25 bp, E. coli
gatgggtcagtgtgtcgctctgtaa

SEQ ID NO: 60755 - DNA, 25 bp, E. coli
caccaggatatacttgtgcagaacc

SEQ ID NO: 60756 - DNA, 25 bp, E. coli
caccaggatatagttgtgcagaacc

SEQ ID NO: 60757 - DNA, 25 bp, E. coli
caaatctgacttctacgccacagga

SEQ ID NO: 60758 - DNA, 25 bp, E. coli
caaatctgacttgtacgccacagga

SEQ ID NO: 60759 - DNA, 25 bp, E. coli
tacacactgtattgcaggaagtggg

SEQ ID NO: 60760 - DNA, 25 bp, E. coli
tacacactgtatagcaggaagtggg

SEQ ID NO: 60761 - DNA, 25 bp, E. coli
tagattcaatgggactggcatcaaa

SEQ ID NO: 60762 - DNA, 25 bp, E. coli
tagattcaatggcactggcatcaaa

SEQ ID NO: 60763 - DNA, 25 bp, E. coli
tattgaccaggcgagtagtgcgcct

SEQ ID NO: 60764 - DNA, 25 bp, E. coli
tattgaccaggccagtagtgcgcct

SEQ ID NO: 60765 - DNA, 25 bp, E. coli
tccagggatggaaacaaagacagca

SEQ ID NO: 60766 - DNA, 25 bp, E. coli
tccagggatggatacaaagacagca

SEQ ID NO: 60767 - DNA, 25 bp, E. coli
ccagcaacagcagggatagatgatt

SEQ ID NO: 60768 - DNA, 25 bp, E. coli
ccagcaacagcacggatagatgatt

SEQ ID NO: 60769 - DNA, 25 bp, E. coli
gacagcaagtgaatacctgccacag

SEQ ID NO: 60770 - DNA, 25 bp, E. coli
gacagcaagtgattacctgccacag

SEQ ID NO: 60771 - DNA, 25 bp, E. coli
ggccaacaactcaattaccaccagg

SEQ ID NO: 60772 - DNA, 25 bp, E. coli
ggccaacaactctattaccaccagg

SEQ ID NO: 60773 - DNA, 25 bp, E. coli
taatggcggatatggagcgagaccc

SEQ ID NO: 60774 - DNA, 25 bp, E. coli
taataaacccgaagggccagcaaca

SEQ ID NO: 60775 - DNA, 25 bp, E. coli
taataaacccgatgggccagcaaca

SEQ ID NO: 60776 - DNA, 25 bp, E. coli
taatggcggataaggagcgagaccc

SEQ ID NO: 60777 - DNA, 25 bp, E. coli
aagcgtattgagttcgtcggtccga

SEQ ID NO: 60778 - DNA, 25 bp, E. coli
aagcgtattgagatcgtcggtccga

SEQ ID NO: 60779 - DNA, 25 bp, E. coli
tatcgagattgacctgaccattgtg

SEQ ID NO: 60780 - DNA, 25 bp, E. coli
tatcgttattatgggcgtgcgcggc

SEQ ID NO: 60781 - DNA, 25 bp, E. coli
tatcggtgtttccatcggtactgca

SEQ ID NO: 60782 - DNA, 25 bp, E. coli
tatcgagattgagctgaccattgtg

SEQ ID NO: 60783 - DNA, 25 bp, E. coli
tatcgttattatcggcgtgcgcggc

SEQ ID NO: 60784 - DNA, 25 bp, E. coli
tatcggtgtttcgatcggtactgca

SEQ ID NO: 60785 - DNA, 25 bp, E. coli
tgttgaacaacttaaccacggccgt

SEQ ID NO: 60786 - DNA, 25 bp, E. coli
tgttgaacaactaaaccacggccgt

SEQ ID NO: 60787 - DNA, 25 bp, E. coli
ccggttttgaagagccgatgctgca

SEQ ID NO: 60788 - DNA, 25 bp, E. coli
ccggttttgaagtgccgatgctgca

SEQ ID NO: 60789 - DNA, 25 bp, E. coli
gaaaacttccgcaagatccgtcgcg

SEQ ID NO: 60790 - DNA, 25 bp, E. coli
gaaaacttccgctagatccgtcgcg

SEQ ID NO: 60791 - DNA, 25 bp, E. coli
gaaattacgctcgaaaaaccggctg

SEQ ID NO: 60792 - DNA, 25 bp, E. coli
gactttatgcgctgggactactggg

SEQ ID NO: 60793 - DNA, 25 bp, E. coli
gaaattacgctccaaaaaccggctg

SEQ ID NO: 60794 - DNA, 25 bp, E. coli
gactttatgcgcagggactactggg

SEQ ID NO: 60795 - DNA, 25 bp, E. coli
ggtatgaagcgcgaacacatgttgc

SEQ ID NO: 60796 - DNA, 25 bp, E. coli
ggtatgaagcgccaacacatgttgc

SEQ ID NO: 60797 - DNA, 25 bp, E. coli
tggaaggcttctggctgaccatgct

SEQ ID NO: 60798 - DNA, 25 bp, E. coli
tggaaggcttctcgctgaccatgct

SEQ ID NO: 60799 - DNA, 25 bp, E. coli
caaggcaagcagttattaccgtggt

SEQ ID NO: 60800 - DNA, 25 bp, E. coli
caaggcaagcagatattaccgtggt

SEQ ID NO: 60801 - DNA, 25 bp, E. coli
caactgggtctgtgcttcctcgcaa

SEQ ID NO: 60802 - DNA, 25 bp, E. coli
caactgggtctgagcttcctcgcaa

SEQ ID NO: 60803 - DNA, 25 bp, E. coli
catgtgtcgctggtcgaaatcctga

SEQ ID NO: 60804 - DNA, 25 bp, E. coli
catgtgtcgctgctcgaaatcctga

SEQ ID NO: 60805 - DNA, 25 bp, E. coli
tacgttctaaaagctatcgcggcaa

SEQ ID NO: 60806 - DNA, 25 bp, E. coli
tacgttctaaaacctatcgcggcaa

SEQ ID NO: 60807 - DNA, 25 bp, E. coli
tatgtatctgcctgctttcgccgcc

SEQ ID NO: 60808 - DNA, 25 bp, E. coli
tatgtatctgccagctttcgccgcc

SEQ ID NO: 60809 - DNA, 25 bp, E. coli
tattttctggctgaaacccacgacg

SEQ ID NO: 60810 - DNA, 25 bp, E. coli
ttttgcatggctgaccggttcaccg

SEQ ID NO: 60811 - DNA, 25 bp, E. coli
tattttctggctcaaacccacgacg

SEQ ID NO: 60812 - DNA, 25 bp, E. coli
ttttgcatggctcaccggttcaccg

SEQ ID NO: 60813 - DNA, 25 bp, E. coli
tcctctgttaggaagctggctgctg

SEQ ID NO: 60814 - DNA, 25 bp, E. coli
tcctctgttaggtagctggctgctg

SEQ ID NO: 60815 - DNA, 25 bp, E. coli
gcaatgccgaagacgctcatagcga

SEQ ID NO: 60816 - DNA, 25 bp, E. coli
gcaatgccgaagtcgctcatagcga

SEQ ID NO: 60817 - DNA, 25 bp, E. coli
cattaccgtggtcctgattctgcct

SEQ ID NO: 60818 - DNA, 25 bp, E. coli
cattaccgtggtgctgattctgcct

SEQ ID NO: 60819 - DNA, 25 bp, E. coli
gacgaaggcccgtaacaatagtcag

SEQ ID NO: 60820 - DNA, 25 bp, E. coli
gacgaaggcccgaaacaatagtcag

SEQ ID NO: 60821 - DNA, 25 bp, E. coli
taaaccgatggcgacattcactgag

SEQ ID NO: 60822 - DNA, 25 bp, E. coli
taaaccgatggccacattcactgag

SEQ ID NO: 60823 - DNA, 25 bp, E. coli
tatgtgctgaccgtgtttggacaag

SEQ ID NO: 60824 - DNA, 25 bp, E. coli
tatgagaaagactaaggctggcagc

SEQ ID NO: 60825 - DNA, 25 bp, E. coli
tatccgccggaaaaagtggatgtgg

SEQ ID NO: 60826 - DNA, 25 bp, E. coli
tatccgcgtttacatgtgggtaggc

SEQ ID NO: 60827 - DNA, 25 bp, E. coli
tatgtgctgaccctgtttggacaag

SEQ ID NO: 60828 - DNA, 25 bp, E. coli
tatgagaaagacaaaggctggcagc

SEQ ID NO: 60829 - DNA, 25 bp, E. coli
tatccgccggaataagtggatgtgg

SEQ ID NO: 60830 - DNA, 25 bp, E. coli
tatccgcgtttagatgtgggtaggc

SEQ ID NO: 60831 - DNA, 25 bp, E. coli
ttacatcagtcaggaagggcgcgtc

SEQ ID NO: 60832 - DNA, 25 bp, E. coli
ttacatcagtcacgaagggcgcgtc

SEQ ID NO: 60833 - DNA, 25 bp, E. coli
gccagactgggtgcgctatgagaaa

SEQ ID NO: 60834 - DNA, 25 bp, E. coli
gccagactgggtccgctatgagaaa

SEQ ID NO: 60835 - DNA, 25 bp, E. coli
gctggacagcaattcggcctccgat

SEQ ID NO: 60836 - DNA, 25 bp, E. coli
gctggacagcaaatcggcctccgat

SEQ ID NO: 60837 - DNA, 25 bp, E. coli
gtatttcacccgctttggcgcgccg

SEQ ID NO: 60838 - DNA, 25 bp, E. coli
gtatttcacccggtttggcgcgccg

SEQ ID NO: 60839 - DNA, 25 bp, E. coli
ggacaaggctgggatcaacaccgtt

SEQ ID NO: 60840 - DNA, 25 bp, E. coli
ggacaaggctggcatcaacaccgtt

SEQ ID NO: 60841 - DNA, 25 bp, E. coli
gacgcagaacaaactcgctcagggt

SEQ ID NO: 60842 - DNA, 25 bp, E. coli
gacgcagaacaatctcgctcagggt

SEQ ID NO: 60843 - DNA, 25 bp, E. coli
cactggaactgaacgctgatgcaga

SEQ ID NO: 60844 - DNA, 25 bp, E. coli
cactggaactgatcgctgatgcaga

SEQ ID NO: 60845 - DNA, 25 bp, E. coli
aactgatcgctgttgcagagtcggc

SEQ ID NO: 60846 - DNA, 25 bp, E. coli
aactgatcgctgatgcagagtcggc

SEQ ID NO: 60847 - DNA, 25 bp, E. coli
acatgcccggttcctgcgtcaggca

SEQ ID NO: 60848 - DNA, 25 bp, E. coli
acatgcccggttgctgcgtcaggca

SEQ ID NO: 60849 - DNA, 25 bp, E. coli
tatggtccggtagatgcccggttgc

SEQ ID NO: 60850 - DNA, 25 bp, E. coli
tatggtccggtacatgcccggttgc

SEQ ID NO: 60851 - DNA, 25 bp, E. coli
tgttctgcgatgtcctgtgtgatac

SEQ ID NO: 60852 - DNA, 25 bp, E. coli
tgttctgcgatgacctgtgtgatac

SEQ ID NO: 60853 - DNA, 25 bp, E. coli
tgcagagtcggcgagaaaaaagtag

SEQ ID NO: 60854 - DNA, 25 bp, E. coli
tgctggccgtctttggtccggtaca

SEQ ID NO: 60855 - DNA, 25 bp, E. coli
tgcagagtcggccagaaaaaagtag

SEQ ID NO: 60856 - DNA, 25 bp, E. coli
tgctggccgtctatggtccggtaca

SEQ ID NO: 60857 - DNA, 25 bp, E. coli
tcgctgatgcagtgtcggccagaaa

SEQ ID NO: 60858 - DNA, 25 bp, E. coli
tcgctgatgcagagtcggccagaaa

SEQ ID NO: 60859 - DNA, 25 bp, E. coli
ccgtgagcaggtgctggccgtctat

SEQ ID NO: 60860 - DNA, 25 bp, E. coli
ccgtgagcaggtcctggccgtctat

SEQ ID NO: 60861 - DNA, 25 bp, E. coli
cgtcaggcactgcaactgatcgctg

SEQ ID NO: 60862 - DNA, 25 bp, E. coli
cgtcaggcactggaactgatcgctg

SEQ ID NO: 60863 - DNA, 25 bp, E. coli
ctccggacgaccgtgagcaggtgct

SEQ ID NO: 60864 - DNA, 25 bp, E. coli
ctccggacgaccctgagcaggtgct

SEQ ID NO: 60865 - DNA, 25 bp, E. coli
caaatgttgggacaaaatgtcctgg

SEQ ID NO: 60866 - DNA, 25 bp, E. coli
caaatgttgggagaaaatgtcctgg

SEQ ID NO: 60867 - DNA, 25 bp, E. coli
aatgtcctggtggtcgatgcctgcc

SEQ ID NO: 60868 - DNA, 25 bp, E. coli
aatgtcctggtgctcgatgcctgcc

SEQ ID NO: 60869 - DNA, 25 bp, E. coli
tagcctggtcataacaaatgttggg

SEQ ID NO: 60870 - DNA, 25 bp, E. coli
tagcctggtcattacaaatgttggg

SEQ ID NO: 60871 - DNA, 25 bp, E. coli
tgcccggacaacatgttgcgcctgt

SEQ ID NO: 60872 - DNA, 25 bp, E. coli
tgcccggacaacttgttgcgcctgt

SEQ ID NO: 60873 - DNA, 25 bp, E. coli
gccgcattagccaggtcattacaaa

SEQ ID NO: 60874 - DNA, 25 bp, E. coli
cctggtcattactaatgttgggaga

SEQ ID NO: 60875 - DNA, 25 bp, E. coli
gccgcattagcctggtcattacaaa

SEQ ID NO: 60876 - DNA, 25 bp, E. coli
cctggtcattacaaatgttgggaga

SEQ ID NO: 60877 - DNA, 25 bp, E. coli
gaaaatgtcctggtggtcgatgcct

SEQ ID NO: 60878 - DNA, 25 bp, E. coli
gaaaatgtcctgctggtcgatgcct

SEQ ID NO: 60879 - DNA, 25 bp, E. coli
ggacaacttgttgcgcctgtcattt

SEQ ID NO: 60880 - DNA, 25 bp, E. coli
ggacaacttgttccgcctgtcattt

SEQ ID NO: 60881 - DNA, 25 bp, E. coli
tcaccgccgcataagcctggtcatt

SEQ ID NO: 60882 - DNA, 25 bp, E. coli
tcaccgccgcattagcctggtcatt

SEQ ID NO: 60883 - DNA, 25 bp, E. coli
gaggcgtggggagaacaaccatcac

SEQ ID NO: 60884 - DNA, 25 bp, E. coli
gatgcctgcccgcacaacttgttgc

SEQ ID NO: 60885 - DNA, 25 bp, E. coli
gaggcgtggggacaacaaccatcac

SEQ ID NO: 60886 - DNA, 25 bp, E. coli
gatgcctgcccggacaacttgttgc

SEQ ID NO: 60887 - DNA, 25 bp, E. coli
aagatcgctacaccaccaaagagag

SEQ ID NO: 60888 - DNA, 25 bp, E. coli
aagatcgctacagcaccaaagagag

SEQ ID NO: 60889 - DNA, 25 bp, E. coli
tttgtggatgttggcccggacacca

SEQ ID NO: 60890 - DNA, 25 bp, E. coli
tatcaaccagcatcgtctggcgctg

SEQ ID NO: 60891 - DNA, 25 bp, E. coli
tatcaaccagcaacgtctggcgctg

SEQ ID NO: 60892 - DNA, 25 bp, E. coli
tttgtggatgttcgcccggacacca

SEQ ID NO: 60893 - DNA, 25 bp, E. coli
tgatcatgccgagctacacctttgt

SEQ ID NO: 60894 - DNA, 25 bp, E. coli
tgatcatgccgacctacacctttgt

SEQ ID NO: 60895 - DNA, 25 bp, E. coli
tgaaagaagcggaaatcatggcggt

SEQ ID NO: 60896 - DNA, 25 bp, E. coli
tgaaagaagcggtaatcatggcggt

SEQ ID NO: 60897 - DNA, 25 bp, E. coli
tccagcctggcgatgaagtgatcat

SEQ ID NO: 60898 - DNA, 25 bp, E. coli
tccagcctggcgttgaagtgatcat

SEQ ID NO: 60899 - DNA, 25 bp, E. coli
tccgtggtcaggacgataaatatac

SEQ ID NO: 60900 - DNA, 25 bp, E. coli
tcgaacgagccgagatcatccgtga

SEQ ID NO: 60901 - DNA, 25 bp, E. coli
tccgtggtcaggtcgataaatatac

SEQ ID NO: 60902 - DNA, 25 bp, E. coli
tcgaacgagccgtgatcatccgtga

SEQ ID NO: 60903 - DNA, 25 bp, E. coli
cgtgatgtccacatacaaagggcgt

SEQ ID NO: 60904 - DNA, 25 bp, E. coli
cgtgatgtccacttacaaagggcgt

SEQ ID NO: 60905 - DNA, 25 bp, E. coli
ggcgctgtggcataactactacgat

SEQ ID NO: 60906 - DNA, 25 bp, E. coli
ggcgctgtggcaaaactactacgat

SEQ ID NO: 60907 - DNA, 25 bp, E. coli
ggcgatcaccgacaaaacgcgcgtt

SEQ ID NO: 60908 - DNA, 25 bp, E. coli
ggcgatcaccgagaaaacgcgcgtt

SEQ ID NO: 60909 - DNA, 25 bp, E. coli
caactgcgtgatgagcgtcagggca

SEQ ID NO: 60910 - DNA, 25 bp, E. coli
aagctatggatgttggcctttccac

SEQ ID NO: 60911 - DNA, 25 bp, E. coli
caagatgggtcatacaactgcgtga

SEQ ID NO: 60912 - DNA, 25 bp, E. coli
aagctatggatgatggcctttccac

SEQ ID NO: 60913 - DNA, 25 bp, E. coli
caagatgggtcaaacaactgcgtga

SEQ ID NO: 60914 - DNA, 25 bp, E. coli
caacacaggtgctccaatgaaaaaa

SEQ ID NO: 60915 - DNA, 25 bp, E. coli
caacacaggtgcaccaatgaaaaaa

SEQ ID NO: 60916 - DNA, 25 bp, E. coli
caactgcgtgatcagcgtcagggca

SEQ ID NO: 60917 - DNA, 25 bp, E. coli
taacaccagaactaatcgaaatacg

SEQ ID NO: 60918 - DNA, 25 bp, E. coli
tacgtaagctgacgaaaaagctaca

SEQ ID NO: 60919 - DNA, 25 bp, E. coli
tacgtaagctgaggaaaaagctaca

SEQ ID NO: 60920 - DNA, 25 bp, E. coli
aaaagcctctcccataacaccagaa

SEQ ID NO: 60921 - DNA, 25 bp, E. coli
aaaagcctctccgataacaccagaa

SEQ ID NO: 60922 - DNA, 25 bp, E. coli
cctttccacaatcacaagatgggtc

SEQ ID NO: 60923 - DNA, 25 bp, E. coli
cctttccacaatgacaagatgggtc

SEQ ID NO: 60924 - DNA, 25 bp, E. coli
gaaatacacggtggcagatgccgcg

SEQ ID NO: 60925 - DNA, 25 bp, E. coli
gaaatacacggtcgcagatgccgcg

SEQ ID NO: 60926 - DNA, 25 bp, E. coli
ggcagatgccgcgaaagctatggat

SEQ ID NO: 60927 - DNA, 25 bp, E. coli
ggcagatgccgccaaagctatggat

SEQ ID NO: 60928 - DNA, 25 bp, E. coli
tggttgttgaccagaaatacacggt

SEQ ID NO: 60929 - DNA, 25 bp, E. coli
tggttgttgacctgaaatacacggt

SEQ ID NO: 60930 - DNA, 25 bp, E. coli
taacaccagaacaaatcgaaatacg

SEQ ID NO: 60931 - DNA, 25 bp, E. coli
caacagccttcattgcgggagttaa

SEQ ID NO: 60932 - DNA, 25 bp, E. coli
aagacgacgctcaacgacattgccg

SEQ ID NO: 60933 - DNA, 25 bp, E. coli
aagacgacgctctacgacattgccg

SEQ ID NO: 60934 - DNA, 25 bp, E. coli
caacagccttcaatgcgggagttaa

SEQ ID NO: 60935 - DNA, 25 bp, E. coli
cagactctccgccaagtattgcagg

SEQ ID NO: 60936 - DNA, 25 bp, E. coli
cagactctccgcgaagtattgcagg

SEQ ID NO: 60937 - DNA, 25 bp, E. coli
tacgcgtggcgctatctactggcac

SEQ ID NO: 60938 - DNA, 25 bp, E. coli
aactgattgaaactgccatcgccca

SEQ ID NO: 60939 - DNA, 25 bp, E. coli
aactgattgaaagtgccatcgccca

SEQ ID NO: 60940 - DNA, 25 bp, E. coli
tacgcgtggcgcaatctactggcac

SEQ ID NO: 60941 - DNA, 25 bp, E. coli
tattgcaggcgtgtcagcaacaagg

SEQ ID NO: 60942 - DNA, 25 bp, E. coli
tattgcaggcgtctcagcaacaagg

SEQ ID NO: 60943 - DNA, 25 bp, E. coli
tattattgatggtgccttcagcgga

SEQ ID NO: 60944 - DNA, 25 bp, E. coli
tattattgatggagccttcagcgga

SEQ ID NO: 60945 - DNA, 25 bp, E. coli
tgaagacccggcaagaactgattga

SEQ ID NO: 60946 - DNA, 25 bp, E. coli
tgaagacccggctagaactgattga

SEQ ID NO: 60947 - DNA, 25 bp, E. coli
gaaaagatgggctttaatccgcaga

SEQ ID NO: 60948 - DNA, 25 bp, E. coli
gaaaagatgggcattaatccgcaga

SEQ ID NO: 60949 - DNA, 25 bp, E. coli
ccccgctctggtggataacgtatta

SEQ ID NO: 60950 - DNA, 25 bp, E. coli
ccccgctctggtcgataacgtatta

SEQ ID NO: 60951 - DNA, 25 bp, E. coli
taatgagatgtggttgcaacagcct

SEQ ID NO: 60952 - DNA, 25 bp, E. coli
taatgagatgtgcttgcaacagcct

SEQ ID NO: 60953 - DNA, 25 bp, E. coli
catcgaccagaaaggtggcatatgg

SEQ ID NO: 60954 - DNA, 25 bp, E. coli
cagttcctgaagttgtttattgtac

SEQ ID NO: 60955 - DNA, 25 bp, E. coli
cagttcctgaagatgtttattgtac

SEQ ID NO: 60956 - DNA, 25 bp, E. coli
catcgaccagaatggtggcatatgg

SEQ ID NO: 60957 - DNA, 25 bp, E. coli
taaattgcgaaagaaggtatactcc

SEQ ID NO: 60958 - DNA, 25 bp, E. coli
tacatttttatatcatacaccgcgt

SEQ ID NO: 60959 - DNA, 25 bp, E. coli
taaattgcgaaacaaggtatactcc

SEQ ID NO: 60960 - DNA, 25 bp, E. coli
tacatttttataacatacaccgcgt

SEQ ID NO: 60961 - DNA, 25 bp, E. coli
taaatcgcgctatgcagaatcttca

SEQ ID NO: 60962 - DNA, 25 bp, E. coli
taaatcgcgctaagcagaatcttca

SEQ ID NO: 60963 - DNA, 25 bp, E. coli
atacaccgcgtaatgccatcgacca

SEQ ID NO: 60964 - DNA, 25 bp, E. coli
atacaccgcgtattgccatcgacca

SEQ ID NO: 60965 - DNA, 25 bp, E. coli
tcttcatcttttgaggtacaaacgc

SEQ ID NO: 60966 - DNA, 25 bp, E. coli
tctattcctgttccgtaaatcgcgc

SEQ ID NO: 60967 - DNA, 25 bp, E. coli
tctattcctgttgcgtaaatcgcgc

SEQ ID NO: 60968 - DNA, 25 bp, E. coli
tcttcatcttttcaggtacaaacgc

SEQ ID NO: 60969 - DNA, 25 bp, E. coli
ggtatactccagcagttcctgaaga

SEQ ID NO: 60970 - DNA, 25 bp, E. coli
ggtacaaacgccattattgctacat

SEQ ID NO: 60971 - DNA, 25 bp, E. coli
ggtacaaacgcctttattgctacat

SEQ ID NO: 60972 - DNA, 25 bp, E. coli
ggtatactccaggagttcctgaaga

SEQ ID NO: 60973 - DNA, 25 bp, E. coli
gagtctggtgttcagtctattcctg

SEQ ID NO: 60974 - DNA, 25 bp, E. coli
gagtctggtgttgagtctattcctg

SEQ ID NO: 60975 - DNA, 25 bp, E. coli
cagcgcttattaccagccacgtctg

SEQ ID NO: 60976 - DNA, 25 bp, E. coli
cagcgcttattagcagccacgtctg

SEQ ID NO: 60977 - DNA, 25 bp, E. coli
attaccagccacctctgttgcagta

SEQ ID NO: 60978 - DNA, 25 bp, E. coli
agcgcttattaccagccacgtctgt

SEQ ID NO: 60979 - DNA, 25 bp, E. coli
agcgcttattacgagccacgtctgt

SEQ ID NO: 60980 - DNA, 25 bp, E. coli
attaccagccacgtctgttgcagta

SEQ ID NO: 60981 - DNA, 25 bp, E. coli
aaacagcctttctccctgcattgtc

SEQ ID NO: 60982 - DNA, 25 bp, E. coli
aaacagcctttcaccctgcattgtc

SEQ ID NO: 60983 - DNA, 25 bp, E. coli
taccagccacgtgtgttgcagtaaa

SEQ ID NO: 60984 - DNA, 25 bp, E. coli
taccagccacgtctgttgcagtaaa

SEQ ID NO: 60985 - DNA, 25 bp, E. coli
tattaccagccacgtctgttgcagt

SEQ ID NO: 60986 - DNA, 25 bp, E. coli
ttattaccagcctcgtctgttgcag

SEQ ID NO: 60987 - DNA, 25 bp, E. coli
tattaccagccaggtctgttgcagt

SEQ ID NO: 60988 - DNA, 25 bp, E. coli
ttattaccagccacgtctgttgcag

SEQ ID NO: 60989 - DNA, 25 bp, E. coli
tgcattgtccgccagcgcttattac

SEQ ID NO: 60990 - DNA, 25 bp, E. coli
tgcattgtccgcgagcgcttattac

SEQ ID NO: 60991 - DNA, 25 bp, E. coli
gcgcttattacctgccacgtctgtt

SEQ ID NO: 60992 - DNA, 25 bp, E. coli
gcgcttattaccagccacgtctgtt

SEQ ID NO: 60993 - DNA, 25 bp, E. coli
gaaaacagccttacaccctgcattg

SEQ ID NO: 60994 - DNA, 25 bp, E. coli
gaaaacagcctttcaccctgcattg

SEQ ID NO: 60995 - DNA, 25 bp, E. coli
cgcttattaccagccacgtctgttg

SEQ ID NO: 60996 - DNA, 25 bp, E. coli
cgcttattaccacccacgtctgttg

SEQ ID NO: 60997 - DNA, 25 bp, E. coli
aatttccttgtgacgattcatgccg

SEQ ID NO: 60998 - DNA, 25 bp, E. coli
aatttccttgtgtcgattcatgccg

SEQ ID NO: 60999 - DNA, 25 bp, E. coli
catcgcctccgccaatggttgcgaa

SEQ ID NO: 61000 - DNA, 25 bp, E. coli
catcgcctccgcgaatggttgcgaa

SEQ ID NO: 61001 - DNA, 25 bp, E. coli
taaacgccgacctgaacacgcgagt

SEQ ID NO: 61002 - DNA, 25 bp, E. coli
taaacgccgaccagaacacgcgagt

SEQ ID NO: 61003 - DNA, 25 bp, E. coli
tagtgccaccggtgcctctgtatgg

SEQ ID NO: 61004 - DNA, 25 bp, E. coli
tagtgccaccggagcctctgtatgg

SEQ ID NO: 61005 - DNA, 25 bp, E. coli
ttcgccggatattccgtcagtactg

SEQ ID NO: 61006 - DNA, 25 bp, E. coli
ttcgccggatataccgtcagtactg

SEQ ID NO: 61007 - DNA, 25 bp, E. coli
tgtgtcgattcaagccgatgccgca

SEQ ID NO: 61008 - DNA, 25 bp, E. coli
tgtgtcgattcatgccgatgccgca

SEQ ID NO: 61009 - DNA, 25 bp, E. coli
cgccattgcgcgtaaattacgtacc

SEQ ID NO: 61010 - DNA, 25 bp, E. coli
cgagtctcggcgatctgcgttcgcc

SEQ ID NO: 61011 - DNA, 25 bp, E. coli
cgagtctcggcgttctgcgttcgcc

SEQ ID NO: 61012 - DNA, 25 bp, E. coli
cgccattgcgcgaaaattacgtacc

SEQ ID NO: 61013 - DNA, 25 bp, E. coli
cggtgcctctgtatgggtgctctct

SEQ ID NO: 61014 - DNA, 25 bp, E. coli
cgtaaattacgtaccttgctcaata

SEQ ID NO: 61015 - DNA, 25 bp, E. coli
cggtgcctctgtttgggtgctctct

SEQ ID NO: 61016 - DNA, 25 bp, E. coli
cgtaaattacgttccttgctcaata

SEQ ID NO: 61017 - DNA, 25 bp, E. coli
gatgccgcaccaaaccgtagtgcca

SEQ ID NO: 61018 - DNA, 25 bp, E. coli
gatgccgcaccataccgtagtgcca

SEQ ID NO: 61019 - DNA, 25 bp, E. coli
aattacacccttatgtagtgtgccg

SEQ ID NO: 61020 - DNA, 25 bp, E. coli
aattacacccttttgtagtgtgccg

SEQ ID NO: 61021 - DNA, 25 bp, E. coli
caacaaagccgtctgcgggaaatat

SEQ ID NO: 61022 - DNA, 25 bp, E. coli
caacaaagccgtgtgcgggaaatat

SEQ ID NO: 61023 - DNA, 25 bp, E. coli
caacatcgtgttaatggagtgtaat

SEQ ID NO: 61024 - DNA, 25 bp, E. coli
caacatcgtgtttatggagtgtaat

SEQ ID NO: 61025 - DNA, 25 bp, E. coli
tagtgtgccgaaatacaacatcgtg

SEQ ID NO: 61026 - DNA, 25 bp, E. coli
tagtgtgccgaattacaacatcgtg

SEQ ID NO: 61027 - DNA, 25 bp, E. coli
tattttgcttttgtgacgccaacga

SEQ ID NO: 61028 - DNA, 25 bp, E. coli
tattttgcttttctgacgccaacga

SEQ ID NO: 61029 - DNA, 25 bp, E. coli
ttcaaaaacaactaagccgtctgcg

SEQ ID NO: 61030 - DNA, 25 bp, E. coli
ttcaaaaacaacaaagccgtctgcg

SEQ ID NO: 61031 - DNA, 25 bp, E. coli
gcgggaaatattccgcagacggttt

SEQ ID NO: 61032 - DNA, 25 bp, E. coli
gcgggaaatattgcgcagacggttt

SEQ ID NO: 61033 - DNA, 25 bp, E. coli
gcagacggttttttctcttaaaata

SEQ ID NO: 61034 - DNA, 25 bp, E. coli
gcaatggtcataacttatttccgaa

SEQ ID NO: 61035 - DNA, 25 bp, E. coli
gcaatggtcatatcttatttccgaa

SEQ ID NO: 61036 - DNA, 25 bp, E. coli
gcagacggttttatctcttaaaata

SEQ ID NO: 61037 - DNA, 25 bp, E. coli
gacgccaacgatttatctcaactaa

SEQ ID NO: 61038 - DNA, 25 bp, E. coli
gacgccaacgatatatctcaactaa

SEQ ID NO: 61039 - DNA, 25 bp, E. coli
gagctattcaattaaccagcaatgg

SEQ ID NO: 61040 - DNA, 25 bp, E. coli
gagctattcaataaaccagcaatgg

SEQ ID NO: 61041 - DNA, 25 bp, E. coli
aatggtactggctgaagggatcgcc

SEQ ID NO: 61042 - DNA, 25 bp, E. coli
aatggtactggcagaagggatcgcc

SEQ ID NO: 61043 - DNA, 25 bp, E. coli
cagagcctgctgtggacctctttaa

SEQ ID NO: 61044 - DNA, 25 bp, E. coli
caaaacctgatggaaatggtactgg

SEQ ID NO: 61045 - DNA, 25 bp, E. coli
caaaacctgatgcaaatggtactgg

SEQ ID NO: 61046 - DNA, 25 bp, E. coli
cagagcctgctgaggacctctttaa

SEQ ID NO: 61047 - DNA, 25 bp, E. coli
tacgtttctggaggctgcaaaaagt

SEQ ID NO: 61048 - DNA, 25 bp, E. coli
tacgtttctggacgctgcaaaaagt

SEQ ID NO: 61049 - DNA, 25 bp, E. coli
tccggtgaatcggattaacgttggc

SEQ ID NO: 61050 - DNA, 25 bp, E. coli
tccggtgaatcgcattaacgttggc

SEQ ID NO: 61051 - DNA, 25 bp, E. coli
gccgatcgacagaaaatcctgctgg

SEQ ID NO: 61052 - DNA, 25 bp, E. coli
gccaaaacggtttctgtggatgcgg

SEQ ID NO: 61053 - DNA, 25 bp, E. coli
gccaaaacggttactgtggatgcgg

SEQ ID NO: 61054 - DNA, 25 bp, E. coli
gccgatcgacagtaaatcctgctgg

SEQ ID NO: 61055 - DNA, 25 bp, E. coli
gaagatccggtacaacaaaacctga

SEQ ID NO: 61056 - DNA, 25 bp, E. coli
gaagggatcgccgtacgtttctgga

SEQ ID NO: 61057 - DNA, 25 bp, E. coli
gaagggatcgccctacgtttctgga

SEQ ID NO: 61058 - DNA, 25 bp, E. coli
gaagatccggtagaacaaaacctga

SEQ ID NO: 61059 - DNA, 25 bp, E. coli
taacgttggcaatatgcactacgcc

SEQ ID NO: 61060 - DNA, 25 bp, E. coli
taacgttggcaaaatgcactacgcc

SEQ ID NO: 61061 - DNA, 25 bp, E. coli
gatgaacgcttgtttcacggtcagg

SEQ ID NO: 61062 - DNA, 25 bp, E. coli
gatgaacgcttgattcacggtcagg

SEQ ID NO: 61063 - DNA, 25 bp, E. coli
caactggatgcattaacgaagcagc

SEQ ID NO: 61064 - DNA, 25 bp, E. coli
cagaatgtcactctggaacagacgc

SEQ ID NO: 61065 - DNA, 25 bp, E. coli
caactggatgcaataacgaagcagc

SEQ ID NO: 61066 - DNA, 25 bp, E. coli
cagaatgtcactgtggaacagacgc

SEQ ID NO: 61067 - DNA, 25 bp, E. coli
tgtcactctggatcagacgcaacgt

SEQ ID NO: 61068 - DNA, 25 bp, E. coli
tgtcactctggaacagacgcaacgt

SEQ ID NO: 61069 - DNA, 25 bp, E. coli
tgcgcgggcaactggatgcattaac

SEQ ID NO: 61070 - DNA, 25 bp, E. coli
tgcgcgggcaacaggatgcattaac

SEQ ID NO: 61071 - DNA, 25 bp, E. coli
gctcggcgaagaaggtgcggcgctg

SEQ ID NO: 61072 - DNA, 25 bp, E. coli
gctcggcgaagatggtgcggcgctg

SEQ ID NO: 61073 - DNA, 25 bp, E. coli
gcgggcaactggttgcattaacgaa

SEQ ID NO: 61074 - DNA, 25 bp, E. coli
gcgggcaactggatgcattaacgaa

SEQ ID NO: 61075 - DNA, 25 bp, E. coli
cgctgcgcgggctactggatgcatt

SEQ ID NO: 61076 - DNA, 25 bp, E. coli
cgcagttaatggtcactatccagaa

SEQ ID NO: 61077 - DNA, 25 bp, E. coli
cgcagttaatggacactatccagaa

SEQ ID NO: 61078 - DNA, 25 bp, E. coli
cgctgcgcgggcaactggatgcatt

SEQ ID NO: 61079 - DNA, 25 bp, E. coli
cgtctggcgcagttaatggtcacta

SEQ ID NO: 61080 - DNA, 25 bp, E. coli
cgtctggcgcagataatggtcacta

SEQ ID NO: 61081 - DNA, 25 bp, E. coli
ggcgcagttaatcgtcactatccag

SEQ ID NO: 61082 - DNA, 25 bp, E. coli
ggcgcagttaatggtcactatccag

SEQ ID NO: 61083 - DNA, 25 bp, E. coli
gatgcattaacgaagcagcttcagc

SEQ ID NO: 61084 - DNA, 25 bp, E. coli
gatgcattaacgtagcagcttcagc

SEQ ID NO: 61085 - DNA, 25 bp, E. coli
caacgtaaaatgataatcgcgcagt

SEQ ID NO: 61086 - DNA, 25 bp, E. coli
caacgtaaaatgttaatcgcgcagt

SEQ ID NO: 61087 - DNA, 25 bp, E. coli
catgtgtgcgttcgtggtgatatcc

SEQ ID NO: 61088 - DNA, 25 bp, E. coli
catgtgtgcgttggtggtgatatcc

SEQ ID NO: 61089 - DNA, 25 bp, E. coli
tacgggcggtctggcttatccactg

SEQ ID NO: 61090 - DNA, 25 bp, E. coli
aaatatggatgattgactggcaggc

SEQ ID NO: 61091 - DNA, 25 bp, E. coli
aaatatggatgaatgactggcaggc

SEQ ID NO: 61092 - DNA, 25 bp, E. coli
tacgggcggtctcgcttatccactg

SEQ ID NO: 61093 - DNA, 25 bp, E. coli
tatttatggcaggaaaaggactgcg

SEQ ID NO: 61094 - DNA, 25 bp, E. coli
tatttgctgggccatttggatgacc

SEQ ID NO: 61095 - DNA, 25 bp, E. coli
tatttatggcagcaaaaggactgcg

SEQ ID NO: 61096 - DNA, 25 bp, E. coli
tatttgctgggcgatttggatgacc

SEQ ID NO: 61097 - DNA, 25 bp, E. coli
tgatatccgggaatacgggcggtct

SEQ ID NO: 61098 - DNA, 25 bp, E. coli
tgatatccgggattacgggcggtct

SEQ ID NO: 61099 - DNA, 25 bp, E. coli
tgacagtgtcaggagatatgccgct

SEQ ID NO: 61100 - DNA, 25 bp, E. coli
tgagcaacctgtgactgaatgatgg

SEQ ID NO: 61101 - DNA, 25 bp, E. coli
tgaccagtctcatcggcgtaagatt

SEQ ID NO: 61102 - DNA, 25 bp, E. coli
tgacagtgtcagcagatatgccgct

SEQ ID NO: 61103 - DNA, 25 bp, E. coli
tgagcaacctgtcactgaatgatgg

SEQ ID NO: 61104 - DNA, 25 bp, E. coli
tgaccagtctcaacggcgtaagatt

SEQ ID NO: 61105 - DNA, 25 bp, E. coli
tcggtatacatcctttcaaggtgaa

SEQ ID NO: 61106 - DNA, 25 bp, E. coli
tcggtatacatcgtttcaaggtgaa

SEQ ID NO: 61107 - DNA, 25 bp, E. coli
cagcctccttttccttaattagata

SEQ ID NO: 61108 - DNA, 25 bp, E. coli
cagcctccttttgcttaattagata

SEQ ID NO: 61109 - DNA, 25 bp, E. coli
catccggcgttgagtaatgatgcct

SEQ ID NO: 61110 - DNA, 25 bp, E. coli
catccggcgttgtgtaatgatgcct

SEQ ID NO: 61111 - DNA, 25 bp, E. coli
tatctgattaccatcacgaaggcga

SEQ ID NO: 61112 - DNA, 25 bp, E. coli
tatctgattaccttcacgaaggcga

SEQ ID NO: 61113 - DNA, 25 bp, E. coli
tcttatcagactatagacatatcag

SEQ ID NO: 61114 - DNA, 25 bp, E. coli
tctgatatgagcgttcttgcaagtg

SEQ ID NO: 61115 - DNA, 25 bp, E. coli
tctgatatgagccttcttgcaagtg

SEQ ID NO: 61116 - DNA, 25 bp, E. coli
tcttatcagactttagacatatcag

SEQ ID NO: 61117 - DNA, 25 bp, E. coli
gaagaggcggttggtcttatcagac

SEQ ID NO: 61118 - DNA, 25 bp, E. coli
gaagaggcggttcgtcttatcagac

SEQ ID NO: 61119 - DNA, 25 bp, E. coli
gacatatcagttgtacaaatcgctt

SEQ ID NO: 61120 - DNA, 25 bp, E. coli
gactcatctcactcgtaggccggat

SEQ ID NO: 61121 - DNA, 25 bp, E. coli
gacatatcagttctacaaatcgctt

SEQ ID NO: 61122 - DNA, 25 bp, E. coli
gactcatctcacacgtaggccggat

SEQ ID NO: 61123 - DNA, 25 bp, E. coli
gattaacaatcaatatcatttgcga

SEQ ID NO: 61124 - DNA, 25 bp, E. coli
gattaacaatcattatcatttgcga

SEQ ID NO: 61125 - DNA, 25 bp, E. coli
gatttttaaacgtggactcatctca

SEQ ID NO: 61126 - DNA, 25 bp, E. coli
gatttttaaacgaggactcatctca

SEQ ID NO: 61127 - DNA, 25 bp, E. coli
taatgatgcctgtgaagaggcggtt

SEQ ID NO: 61128 - DNA, 25 bp, E. coli
taatgatgcctgagaagaggcggtt

SEQ ID NO: 61129 - DNA, 25 bp, E. coli
caagatttctcgttttataataaga

SEQ ID NO: 61130 - DNA, 25 bp, E. coli
caagatttctcgatttataataaga

SEQ ID NO: 61131 - DNA, 25 bp, E. coli
tacaccaattagagaagacagcaaa

SEQ ID NO: 61132 - DNA, 25 bp, E. coli
tacaccaattagtgaagacagcaaa

SEQ ID NO: 61133 - DNA, 25 bp, E. coli
actggtaacccagccattcggcata

SEQ ID NO: 61134 - DNA, 25 bp, E. coli
actggtaacccacccattcggcata

SEQ ID NO: 61135 - DNA, 25 bp, E. coli
tagtctctggttacaagatttctcg

SEQ ID NO: 61136 - DNA, 25 bp, E. coli
tagtctctggtttcaagatttctcg

SEQ ID NO: 61137 - DNA, 25 bp, E. coli
ttgcactcagaatatttcgaatggg

SEQ ID NO: 61138 - DNA, 25 bp, E. coli
ttgcactcagaaaatttcgaatggg

SEQ ID NO: 61139 - DNA, 25 bp, E. coli
tcagggaactggtaacccacccatt

SEQ ID NO: 61140 - DNA, 25 bp, E. coli
tcagggaactggaaacccacccatt

SEQ ID NO: 61141 - DNA, 25 bp, E. coli
tcagaatttaagttattgcactcag

SEQ ID NO: 61142 - DNA, 25 bp, E. coli
tcatgatagaaataatcagggaact

SEQ ID NO: 61143 - DNA, 25 bp, E. coli
tcagaatttaagatattgcactcag

SEQ ID NO: 61144 - DNA, 25 bp, E. coli
tcatgatagaaaaaatcagggaact

SEQ ID NO: 61145 - DNA, 25 bp, E. coli
gcaaattatttattatgctgtcaga

SEQ ID NO: 61146 - DNA, 25 bp, E. coli
gcaaattatttaatatgctgtcaga

SEQ ID NO: 61147 - DNA, 25 bp, E. coli
gtcacatctaatactgaatctacga

SEQ ID NO: 61148 - DNA, 25 bp, E. coli
gggtgattatagactctggtttcaa

SEQ ID NO: 61149 - DNA, 25 bp, E. coli
gtcacatctaattctgaatctacga

SEQ ID NO: 61150 - DNA, 25 bp, E. coli
gggtgattatagtctctggtttcaa

SEQ ID NO: 61151 - DNA, 25 bp, E. coli
aattgacgagcagaccggatggcac

SEQ ID NO: 61152 - DNA, 25 bp, E. coli
aattgacgagcacaccggatggcac

SEQ ID NO: 61153 - DNA, 25 bp, E. coli
cacaaaagcctgaccaacgtgggcg

SEQ ID NO: 61154 - DNA, 25 bp, E. coli
cacaaaagcctgtccaacgtgggcg

SEQ ID NO: 61155 - DNA, 25 bp, E. coli
agtgccgccactagaaaacctgatg

SEQ ID NO: 61156 - DNA, 25 bp, E. coli
agtgccgccacttgaaaacctgatg

SEQ ID NO: 61157 - DNA, 25 bp, E. coli
tacctgtcggcgtatggctgcaaaa

SEQ ID NO: 61158 - DNA, 25 bp, E. coli
tacctgtcggcgaatggctgcaaaa

SEQ ID NO: 61159 - DNA, 25 bp, E. coli
tgttgaagtcaaggaaggcacccga

SEQ ID NO: 61160 - DNA, 25 bp, E. coli
tgttgaagtcaacgaaggcacccga

SEQ ID NO: 61161 - DNA, 25 bp, E. coli
tgatggacacgatggcagaagcgca

SEQ ID NO: 61162 - DNA, 25 bp, E. coli
tgaatttcgccagccaggtcagcgc

SEQ ID NO: 61163 - DNA, 25 bp, E. coli
tgaatttcgccacccaggtcagcgc

SEQ ID NO: 61164 - DNA, 25 bp, E. coli
tgatggacacgaaggcagaagcgca

SEQ ID NO: 61165 - DNA, 25 bp, E. coli
gaagaagtgcttacctaccgcgaaa

SEQ ID NO: 61166 - DNA, 25 bp, E. coli
gaagaagtgctttcctaccgcgaaa

SEQ ID NO: 61167 - DNA, 25 bp, E. coli
gacattatcgaaggtatccgcgcca

SEQ ID NO: 61168 - DNA, 25 bp, E. coli
gacattatcgaacgtatccgcgcca

SEQ ID NO: 61169 - DNA, 25 bp, E. coli
gattttatcagctgggacacggtgc

SEQ ID NO: 61170 - DNA, 25 bp, E. coli
gattttatcagcagggacacggtgc

SEQ ID NO: 61171 - DNA, 25 bp, E. coli
ggctcaggattaccaccacggagtg

SEQ ID NO: 61172 - DNA, 25 bp, E. coli
ggctcaggattagcaccacggagtg

SEQ ID NO: 61173 - DNA, 25 bp, E. coli
aagcggaagatgagctggatgtggc

SEQ ID NO: 61174 - DNA, 25 bp, E. coli
aagcggaagatgtgctggatgtggc

SEQ ID NO: 61175 - DNA, 25 bp, E. coli
cacgatacgcgtgaagcggaagatg

SEQ ID NO: 61176 - DNA, 25 bp, E. coli
cacgatacgcgtcaagcggaagatg

SEQ ID NO: 61177 - DNA, 25 bp, E. coli
acgatacgcgtgaagcggaagatgt

SEQ ID NO: 61178 - DNA, 25 bp, E. coli
aacacgatacgcctgaagcggaaga

SEQ ID NO: 61179 - DNA, 25 bp, E. coli
aacacgatacgcgtgaagcggaaga

SEQ ID NO: 61180 - DNA, 25 bp, E. coli
acgatacgcgtgtagcggaagatgt

SEQ ID NO: 61181 - DNA, 25 bp, E. coli
tgtgaaacacgatacgcgtgaagcg

SEQ ID NO: 61182 - DNA, 25 bp, E. coli
tgtgaaacacgaaacgcgtgaagcg

SEQ ID NO: 61183 - DNA, 25 bp, E. coli
tgaaacacgatacgcgtgaagcgga

SEQ ID NO: 61184 - DNA, 25 bp, E. coli
tgaaacacgataggcgtgaagcgga

SEQ ID NO: 61185 - DNA, 25 bp, E. coli
cgcgtgaagcggaagatgtgctgga

SEQ ID NO: 61186 - DNA, 25 bp, E. coli
cgcgtgaagcggtagatgtgctgga

SEQ ID NO: 61187 - DNA, 25 bp, E. coli
gtgaaacacgattcgcgtgaagcgg

SEQ ID NO: 61188 - DNA, 25 bp, E. coli
gtgaaacacgatacgcgtgaagcgg

SEQ ID NO: 61189 - DNA, 25 bp, E. coli
ggatgtgaaacacgatacgcgtgaa

SEQ ID NO: 61190 - DNA, 25 bp, E. coli
ggatgtgaaacaggatacgcgtgaa

SEQ ID NO: 61191 - DNA, 25 bp, E. coli
gatgtgctggatgtggcggtggcca

SEQ ID NO: 61192 - DNA, 25 bp, E. coli
gatgtgctggatctggcggtggcca

SEQ ID NO: 61193 - DNA, 25 bp, E. coli
gatgtgaaacaccatacgcgtgaag

SEQ ID NO: 61194 - DNA, 25 bp, E. coli
gatgtgaaacacgatacgcgtgaag

SEQ ID NO: 61195 - DNA, 25 bp, E. coli
acctcttcggcctgtgcaccggaga

SEQ ID NO: 61196 - DNA, 25 bp, E. coli
acctcttcggccagtgcaccggaga

SEQ ID NO: 61197 - DNA, 25 bp, E. coli
ttgtctcagaacaccacctcttcgg

SEQ ID NO: 61198 - DNA, 25 bp, E. coli
ttgtctcagaactccacctcttcgg

SEQ ID NO: 61199 - DNA, 25 bp, E. coli
ttcggcctgtgctccggagactggc

SEQ ID NO: 61200 - DNA, 25 bp, E. coli
ttcggcctgtgcaccggagactggc

SEQ ID NO: 61201 - DNA, 25 bp, E. coli
tgcaccggagacaggcctgcaacaa

SEQ ID NO: 61202 - DNA, 25 bp, E. coli
tgcaccggagactggcctgcaacaa

SEQ ID NO: 61203 - DNA, 25 bp, E. coli
tcatacatgaaaacattgtctcaga

SEQ ID NO: 61204 - DNA, 25 bp, E. coli
tcatacatgaaatcattgtctcaga

SEQ ID NO: 61205 - DNA, 25 bp, E. coli
gaaaacattgtcacagaacaccacc

SEQ ID NO: 61206 - DNA, 25 bp, E. coli
gactggcctgcaacaactggttgcc

SEQ ID NO: 61207 - DNA, 25 bp, E. coli
gaaaacattgtctcagaacaccacc

SEQ ID NO: 61208 - DNA, 25 bp, E. coli
gactggcctgcatcaactggttgcc

SEQ ID NO: 61209 - DNA, 25 bp, E. coli
ctgtgcaccggagactggcctgcaa

SEQ ID NO: 61210 - DNA, 25 bp, E. coli
ctgcaacaactgcttgccaccatag

SEQ ID NO: 61211 - DNA, 25 bp, E. coli
ctgtgcaccggacactggcctgcaa

SEQ ID NO: 61212 - DNA, 25 bp, E. coli
ctgcaacaactggttgccaccatag

SEQ ID NO: 61213 - DNA, 25 bp, E. coli
ggagactggcctgcaacaactggtt

SEQ ID NO: 61214 - DNA, 25 bp, E. coli
ggagactggcctccaacaactggtt

SEQ ID NO: 61215 - DNA, 25 bp, E. coli
tggcctgcaacaactggttgccacc

SEQ ID NO: 61216 - DNA, 25 bp, E. coli
tggcctgcaacatctggttgccacc

SEQ ID NO: 61217 - DNA, 25 bp, E. coli
aagtcctacgcacgaattatttacg

SEQ ID NO: 61218 - DNA, 25 bp, E. coli
aagtcctacgcaggaattatttacg

SEQ ID NO: 61219 - DNA, 25 bp, E. coli
caaatgcaaaaagggcgccgaagcg

SEQ ID NO: 61220 - DNA, 25 bp, E. coli
caaatgcaaaaacggcgccgaagcg

SEQ ID NO: 61221 - DNA, 25 bp, E. coli
cgttttacgagatcccttcaatatg

SEQ ID NO: 61222 - DNA, 25 bp, E. coli
cgttttacgagaacccttcaatatg

SEQ ID NO: 61223 - DNA, 25 bp, E. coli
tgacgtaaaaacagcaaaacaaaag

SEQ ID NO: 61224 - DNA, 25 bp, E. coli
tgacgtaaaaactgcaaaacaaaag

SEQ ID NO: 61225 - DNA, 25 bp, E. coli
tgcaaaacaaaagtcctacgcagga

SEQ ID NO: 61226 - DNA, 25 bp, E. coli
tgcaaaacaaaactcctacgcagga

SEQ ID NO: 61227 - DNA, 25 bp, E. coli
taatcccttgtgacgtaaaaactgc

SEQ ID NO: 61228 - DNA, 25 bp, E. coli
taatcccttgtgtcgtaaaaactgc

SEQ ID NO: 61229 - DNA, 25 bp, E. coli
gccgaagcgcccatttcaattcaaa

SEQ ID NO: 61230 - DNA, 25 bp, E. coli
gccgaagcgcccttttcaattcaaa

SEQ ID NO: 61231 - DNA, 25 bp, E. coli
gcaggaattattaacgttttacgag

SEQ ID NO: 61232 - DNA, 25 bp, E. coli
gcaggaattatttacgttttacgag

SEQ ID NO: 61233 - DNA, 25 bp, E. coli
ccttcaatatgatttaaattacggc

SEQ ID NO: 61234 - DNA, 25 bp, E. coli
ccttcaatatgaattaaattacggc

SEQ ID NO: 61235 - DNA, 25 bp, E. coli
gatatgccgtcatcaaatgcaaaaa

SEQ ID NO: 61236 - DNA, 25 bp, E. coli
gatatgccgtcaacaaatgcaaaaa

SEQ ID NO: 61237 - DNA, 25 bp, E. coli
gtcaacaaatgcaaaaagggcgccg

SEQ ID NO: 61238 - DNA, 25 bp, E. coli
gtcaacaaatgctaaaagggcgccg

SEQ ID NO: 61239 - DNA, 25 bp, E. coli
aagcggcaggtgacgttgacgttct

SEQ ID NO: 61240 - DNA, 25 bp, E. coli
aagcggcaggtgtcgttgacgttct

SEQ ID NO: 61241 - DNA, 25 bp, E. coli
caagctgcgtgagccgaaatatggc

SEQ ID NO: 61242 - DNA, 25 bp, E. coli
caagctgcgtgacccgaaatatggc

SEQ ID NO: 61243 - DNA, 25 bp, E. coli
caccagcggacgtgcagttgaagcg

SEQ ID NO: 61244 - DNA, 25 bp, E. coli
caccagcggacgagcagttgaagcg

SEQ ID NO: 61245 - DNA, 25 bp, E. coli
tttgcccgcaagctgcgtgagccga

SEQ ID NO: 61246 - DNA, 25 bp, E. coli
tttgcccgcaaggtgcgtgagccga

SEQ ID NO: 61247 - DNA, 25 bp, E. coli
gctggcgcaggctgatgtcgcggtg

SEQ ID NO: 61248 - DNA, 25 bp, E. coli
gctggcgcaggcagatgtcgcggtg

SEQ ID NO: 61249 - DNA, 25 bp, E. coli
gctgcgtgagcccaaatatggcgct

SEQ ID NO: 61250 - DNA, 25 bp, E. coli
gctgcgtgagccgaaatatggcgct

SEQ ID NO: 61251 - DNA, 25 bp, E. coli
cgcagggcgtggttgaaaaaacgct

SEQ ID NO: 61252 - DNA, 25 bp, E. coli
cgcagggcgtggatgaaaaaacgct

SEQ ID NO: 61253 - DNA, 25 bp, E. coli
cccgcaagctgcctgagccgaaata

SEQ ID NO: 61254 - DNA, 25 bp, E. coli
cccgcaagctgcgtgagccgaaata

SEQ ID NO: 61255 - DNA, 25 bp, E. coli
cggcaggtgacgatgacgttctgct

SEQ ID NO: 61256 - DNA, 25 bp, E. coli
cggcaggtgacgttgacgttctgct

SEQ ID NO: 61257 - DNA, 25 bp, E. coli
tggaaggcgcactgcgacgcaaaac

SEQ ID NO: 61258 - DNA, 25 bp, E. coli
ggcgcacagcgaggcaaaacgccga

SEQ ID NO: 61259 - DNA, 25 bp, E. coli
ggcgcacagcgacgcaaaacgccga

SEQ ID NO: 61260 - DNA, 25 bp, E. coli
tggaaggcgcacagcgacgcaaaac

SEQ ID NO: 61261 - DNA, 25 bp, E. coli
caacctatactttctggtggcacta

SEQ ID NO: 61262 - DNA, 25 bp, E. coli
caactactgtgagataacgcgaaac

SEQ ID NO: 61263 - DNA, 25 bp, E. coli
caagcctgaataaaaagagtacgac

SEQ ID NO: 61264 - DNA, 25 bp, E. coli
caagcctgaatataaagagtacgac

SEQ ID NO: 61265 - DNA, 25 bp, E. coli
caactactgtgacataacgcgaaac

SEQ ID NO: 61266 - DNA, 25 bp, E. coli
caacctatacttactggtggcacta

SEQ ID NO: 61267 - DNA, 25 bp, E. coli
tatggtatgaacatgctgagcatcg

SEQ ID NO: 61268 - DNA, 25 bp, E. coli
tatggtatgaacttgctgagcatcg

SEQ ID NO: 61269 - DNA, 25 bp, E. coli
ccgtgaagtgaaatggcctgaagat

SEQ ID NO: 61270 - DNA, 25 bp, E. coli
gacacctttaacctgataacgacag

SEQ ID NO: 61271 - DNA, 25 bp, E. coli
gaaatctatcaaaactgctccaggt

SEQ ID NO: 61272 - DNA, 25 bp, E. coli
gacacctttaacgtgataacgacag

SEQ ID NO: 61273 - DNA, 25 bp, E. coli
gaaatctatcaatactgctccaggt

SEQ ID NO: 61274 - DNA, 25 bp, E. coli
ccgtgaagtgaattggcctgaagat

SEQ ID NO: 61275 - DNA, 25 bp, E. coli
gatacgtggagatacagagcagact

SEQ ID NO: 61276 - DNA, 25 bp, E. coli
gatacgtggagaaacagagcagact

SEQ ID NO: 61277 - DNA, 25 bp, E. coli
taacgacagagagtgctatagatgc

SEQ ID NO: 61278 - DNA, 25 bp, E. coli
taatgctacatattgcttactgcgc

SEQ ID NO: 61279 - DNA, 25 bp, E. coli
taacgacagagactgctatagatgc

SEQ ID NO: 61280 - DNA, 25 bp, E. coli
taatgctacataatgcttactgcgc

SEQ ID NO: 61281 - DNA, 25 bp, E. coli
gagtacgactgggaacaaattcaag

SEQ ID NO: 61282 - DNA, 25 bp, E. coli
gagtacgactggcaacaaattcaag

SEQ ID NO: 61283 - DNA, 25 bp, E. coli
tacatgtgtatggaagcgactgccc

SEQ ID NO: 61284 - DNA, 25 bp, E. coli
taaaactaccagtgctctggcggca

SEQ ID NO: 61285 - DNA, 25 bp, E. coli
taaaactaccagagctctggcggca

SEQ ID NO: 61286 - DNA, 25 bp, E. coli
tacatgtgtatgcaagcgactgccc

SEQ ID NO: 61287 - DNA, 25 bp, E. coli
tacgctgaagaagcatcccgtctgg

SEQ ID NO: 61288 - DNA, 25 bp, E. coli
tatgtggaatcagaacgcgcggtgt

SEQ ID NO: 61289 - DNA, 25 bp, E. coli
tacgctgaagaaccatcccgtctgg

SEQ ID NO: 61290 - DNA, 25 bp, E. coli
tatgtggaatcacaacgcgcggtgt

SEQ ID NO: 61291 - DNA, 25 bp, E. coli
tatcggccgtggaaaatctctccag

SEQ ID NO: 61292 - DNA, 25 bp, E. coli
tatcggccgtggtaaatctctccag

SEQ ID NO: 61293 - DNA, 25 bp, E. coli
tgttatcccgaataagactgctcag

SEQ ID NO: 61294 - DNA, 25 bp, E. coli
tgttatcccgaaaaagactgctcag

SEQ ID NO: 61295 - DNA, 25 bp, E. coli
tgagaaatatacgaacccgcgcggt

SEQ ID NO: 61296 - DNA, 25 bp, E. coli
tgagaaatataccaacccgcgcggt

SEQ ID NO: 61297 - DNA, 25 bp, E. coli
tctttggctggccagaacggtctgc

SEQ ID NO: 61298 - DNA, 25 bp, E. coli
tctttggctggcgagaacggtctgc

SEQ ID NO: 61299 - DNA, 25 bp, E. coli
tctcaatccgcgaatggcagggtac

SEQ ID NO: 61300 - DNA, 25 bp, E. coli
tctcaatccgcgtatggcagggtac

SEQ ID NO: 61301 - DNA, 25 bp, E. coli
gatttacaactttactgggccgcaa

SEQ ID NO: 61302 - DNA, 25 bp, E. coli
gatttacaacttaactgggccgcaa

SEQ ID NO: 61303 - DNA, 25 bp, E. coli
tcaaaactgtacacgcgtgccggaa

SEQ ID NO: 61304 - DNA, 25 bp, E. coli
tcaaaactgtactcgcgtgccggaa

SEQ ID NO: 61305 - DNA, 25 bp, E. coli
aaccgcaagagatttgacagacaac

SEQ ID NO: 61306 - DNA, 25 bp, E. coli
caaaccgcaagacaattgacagaca

SEQ ID NO: 61307 - DNA, 25 bp, E. coli
caaaccgcaagagaattgacagaca

SEQ ID NO: 61308 - DNA, 25 bp, E. coli
cactgtgggacttcggcattagccg

SEQ ID NO: 61309 - DNA, 25 bp, E. coli
cactgtgggactacggcattagccg

SEQ ID NO: 61310 - DNA, 25 bp, E. coli
actgtgggactacggcattagccgt

SEQ ID NO: 61311 - DNA, 25 bp, E. coli
acaaaccgcaagagaattgacagac

SEQ ID NO: 61312 - DNA, 25 bp, E. coli
aaaccgcaagagaattgacagacaa

SEQ ID NO: 61313 - DNA, 25 bp, E. coli
aaaccgcaagagtattgacagacaa

SEQ ID NO: 61314 - DNA, 25 bp, E. coli
actgtgggactagggcattagccgt

SEQ ID NO: 61315 - DNA, 25 bp, E. coli
acaaaccgcaagtgaattgacagac

SEQ ID NO: 61316 - DNA, 25 bp, E. coli
aaccgcaagagaattgacagacaac

SEQ ID NO: 61317 - DNA, 25 bp, E. coli
tgtgggactacggcattagccgtgg

SEQ ID NO: 61318 - DNA, 25 bp, E. coli
tgtgggactacgccattagccgtgg

SEQ ID NO: 61319 - DNA, 25 bp, E. coli
ctgtgggactaccgcattagccgtg

SEQ ID NO: 61320 - DNA, 25 bp, E. coli
ctgtgggactacggcattagccgtg

SEQ ID NO: 61321 - DNA, 25 bp, E. coli
gtgggactacggcattagccgtggt

SEQ ID NO: 61322 - DNA, 25 bp, E. coli
gtgggactacgggattagccgtggt

SEQ ID NO: 61323 - DNA, 25 bp, E. coli
caggttttagccactatttcggtca

SEQ ID NO: 61324 - DNA, 25 bp, E. coli
caggttttagcctctatttcggtca

SEQ ID NO: 61325 - DNA, 25 bp, E. coli
acgcttacaaccttcgccaggcaaa

SEQ ID NO: 61326 - DNA, 25 bp, E. coli
acgcttacaaccatcgccaggcaaa

SEQ ID NO: 61327 - DNA, 25 bp, E. coli
acaaccatcgcctggcaaatcattg

SEQ ID NO: 61328 - DNA, 25 bp, E. coli
acgaagccgcgcctcgggtgattac

SEQ ID NO: 61329 - DNA, 25 bp, E. coli
acaaccatcgccaggcaaatcattg

SEQ ID NO: 61330 - DNA, 25 bp, E. coli
acgaagccgcgcgtcgggtgattac

SEQ ID NO: 61331 - DNA, 25 bp, E. coli
taccgaggcaggatttagccactat

SEQ ID NO: 61332 - DNA, 25 bp, E. coli
taccgaggcaggttttagccactat

SEQ ID NO: 61333 - DNA, 25 bp, E. coli
tgacgcgacgcagacgcttacaacc

SEQ ID NO: 61334 - DNA, 25 bp, E. coli
tgacgcgacgcacacgcttacaacc

SEQ ID NO: 61335 - DNA, 25 bp, E. coli
gcttacaaccatggccaggcaaatc

SEQ ID NO: 61336 - DNA, 25 bp, E. coli
gcttacaaccatcgccaggcaaatc

SEQ ID NO: 61337 - DNA, 25 bp, E. coli
gattaccgaggctggttttagccac

SEQ ID NO: 61338 - DNA, 25 bp, E. coli
gattaccgaggcaggttttagccac

SEQ ID NO: 61339 - DNA, 25 bp, E. coli
ggttttagccactatttcggtcata

SEQ ID NO: 61340 - DNA, 25 bp, E. coli
ggtgattaccgaggcaggttttagc

SEQ ID NO: 61341 - DNA, 25 bp, E. coli
ggtgattaccgacgcaggttttagc

SEQ ID NO: 61342 - DNA, 25 bp, E. coli
ggttttagccacaatttcggtcata

SEQ ID NO: 61343 - DNA, 25 bp, E. coli
gaggcaggttttagccactatttcg

SEQ ID NO: 61344 - DNA, 25 bp, E. coli
gaggcaggtttttgccactatttcg

SEQ ID NO: 61345 - DNA, 25 bp, E. coli
aaacttgctttctgggcgcactgcc

SEQ ID NO: 61346 - DNA, 25 bp, E. coli
aaaaagcgtgcacaggaatgtgtgc

SEQ ID NO: 61347 - DNA, 25 bp, E. coli
aaaaagcgtgcagaggaatgtgtgc

SEQ ID NO: 61348 - DNA, 25 bp, E. coli
aaacttgctttcagggcgcactgcc

SEQ ID NO: 61349 - DNA, 25 bp, E. coli
tgtctcagcccaacgtgagtgcctg

SEQ ID NO: 61350 - DNA, 25 bp, E. coli
tgtctcagcccatcgtgagtgcctg

SEQ ID NO: 61351 - DNA, 25 bp, E. coli
tgagtgcctgttattgagtcgttga

SEQ ID NO: 61352 - DNA, 25 bp, E. coli
tgagtgcctgtttttgagtcgttga

SEQ ID NO: 61353 - DNA, 25 bp, E. coli
tgagaaggatggcagaaacttgctt

SEQ ID NO: 61354 - DNA, 25 bp, E. coli
tgagaaggatgggagaaacttgctt

SEQ ID NO: 61355 - DNA, 25 bp, E. coli
tgcctcgctctaaggataggtgaca

SEQ ID NO: 61356 - DNA, 25 bp, E. coli
tgcctcgctctatggataggtgaca

SEQ ID NO: 61357 - DNA, 25 bp, E. coli
tctacagtccaaagtgctgaaacca

SEQ ID NO: 61358 - DNA, 25 bp, E. coli
tctacagtccaatgtgctgaaacca

SEQ ID NO: 61359 - DNA, 25 bp, E. coli
gcgaatccggtaatacgaaagtggt

SEQ ID NO: 61360 - DNA, 25 bp, E. coli
gcgaatccggtattacgaaagtggt

SEQ ID NO: 61361 - DNA, 25 bp, E. coli
gaatgtgtgcttctgtctcagccca

SEQ ID NO: 61362 - DNA, 25 bp, E. coli
gaatgtgtgcttgtgtctcagccca

SEQ ID NO: 61363 - DNA, 25 bp, E. coli
gataggtgacatcgaaaaagcgtgc

SEQ ID NO: 61364 - DNA, 25 bp, E. coli
gataggtgacatggaaaaagcgtgc

SEQ ID NO: 61365 - DNA, 25 bp, E. coli
gagtcgttgagttctacagtccaaa

SEQ ID NO: 61366 - DNA, 25 bp, E. coli
gagtcgttgagtactacagtccaaa

SEQ ID NO: 61367 - DNA, 25 bp, E. coli
caagcactcgcgatggctcgtttgg

SEQ ID NO: 61368 - DNA, 25 bp, E. coli
caagcactcgcgttggctcgtttgg

SEQ ID NO: 61369 - DNA, 25 bp, E. coli
taaaacggctcagaagcggtttggc

SEQ ID NO: 61370 - DNA, 25 bp, E. coli
taaaacggctcacaagcggtttggc

SEQ ID NO: 61371 - DNA, 25 bp, E. coli
taggcctaatccaagcggcaactgg

SEQ ID NO: 61372 - DNA, 25 bp, E. coli
taggcctaatcctagcggcaactgg

SEQ ID NO: 61373 - DNA, 25 bp, E. coli
tatatgagccgcattgaacgcggtg

SEQ ID NO: 61374 - DNA, 25 bp, E. coli
tatatgagccgctttgaacgcggtg

SEQ ID NO: 61375 - DNA, 25 bp, E. coli
ttgccaccggaaagagccaagaagc

SEQ ID NO: 61376 - DNA, 25 bp, E. coli
ttgccaccggaatgagccaagaagc

SEQ ID NO: 61377 - DNA, 25 bp, E. coli
tctgaagatagtgacccggaattac

SEQ ID NO: 61378 - DNA, 25 bp, E. coli
tctgaagatagtcacccggaattac

SEQ ID NO: 61379 - DNA, 25 bp, E. coli
tcgtgttttcatcccgggctggcaa

SEQ ID NO: 61380 - DNA, 25 bp, E. coli
tcgtgttttcatgccgggctggcaa

SEQ ID NO: 61381 - DNA, 25 bp, E. coli
ccaagaagcctttgccgatcggtgt

SEQ ID NO: 61382 - DNA, 25 bp, E. coli
ccaagaagccttagccgatcggtgt

SEQ ID NO: 61383 - DNA, 25 bp, E. coli
cgagtaaaagagttgcgcattgcca

SEQ ID NO: 61384 - DNA, 25 bp, E. coli
cgagtaaaagagatgcgcattgcca

SEQ ID NO: 61385 - DNA, 25 bp, E. coli
tggagacagcaaaatggcgtaggcc

SEQ ID NO: 61386 - DNA, 25 bp, E. coli
tggagacagcaatatggcgtaggcc

SEQ ID NO: 61387 - DNA, 25 bp, E. coli
gagtatcttcgttgcatggagacag

SEQ ID NO: 61388 - DNA, 25 bp, E. coli
gagtatcttcgtagcatggagacag

SEQ ID NO: 61389 - DNA, 25 bp, E. coli
tactgtttagcagatggagcgatgg

SEQ ID NO: 61390 - DNA, 25 bp, E. coli
tactggagccttccgtcaatgacgg

SEQ ID NO: 61391 - DNA, 25 bp, E. coli
tactggagccttgcgtcaatgacgg

SEQ ID NO: 61392 - DNA, 25 bp, E. coli
tactgtttagcacatggagcgatgg

SEQ ID NO: 61393 - DNA, 25 bp, E. coli
tgtgttcaagcctgcagatttttcg

SEQ ID NO: 61394 - DNA, 25 bp, E. coli
tgtgttcaagccagcagatttttcg

SEQ ID NO: 61395 - DNA, 25 bp, E. coli
tggtgacaatagaacagactgcgcc

SEQ ID NO: 61396 - DNA, 25 bp, E. coli
tggtgacaatagtacagactgcgcc

SEQ ID NO: 61397 - DNA, 25 bp, E. coli
tgcgcccgcgatcagttactggagc

SEQ ID NO: 61398 - DNA, 25 bp, E. coli
tgcgcccgcgatgagttactggagc

SEQ ID NO: 61399 - DNA, 25 bp, E. coli
tctgtatcatgaggcgatggtggct

SEQ ID NO: 61400 - DNA, 25 bp, E. coli
tctgtatcatgacgcgatggtggct

SEQ ID NO: 61401 - DNA, 25 bp, E. coli
gcgcctgtgcgacatgaacttttca

SEQ ID NO: 61402 - DNA, 25 bp, E. coli
gcgcctgtgcgagatgaacttttca

SEQ ID NO: 61403 - DNA, 25 bp, E. coli
gcaaacgcacaaaatcggctgacga

SEQ ID NO: 61404 - DNA, 25 bp, E. coli
gcaaacgcacaatatcggctgacga

SEQ ID NO: 61405 - DNA, 25 bp, E. coli
gactttcctgaattgatgcgcctgt

SEQ ID NO: 61406 - DNA, 25 bp, E. coli
gactttcctgaaatgatgcgcctgt

SEQ ID NO: 61407 - DNA, 25 bp, E. coli
cgcacccggcgatactgtaagctat

SEQ ID NO: 61408 - DNA, 25 bp, E. coli
cgcacccggcgaaactgtaagctat

SEQ ID NO: 61409 - DNA, 25 bp, E. coli
taagctatcaggaggcaaacgcaca

SEQ ID NO: 61410 - DNA, 25 bp, E. coli
taagctatcaggtggcaaacgcaca

SEQ ID NO: 61411 - DNA, 25 bp, E. coli
tacatctctaaaacaaaacataacg

SEQ ID NO: 61412 - DNA, 25 bp, E. coli
tacatctctaaatcaaaacataacg

SEQ ID NO: 61413 - DNA, 25 bp, E. coli
taacagttgattggttagtcgccgg

SEQ ID NO: 61414 - DNA, 25 bp, E. coli
acgaaacgcactgccggacagacaa

SEQ ID NO: 61415 - DNA, 25 bp, E. coli
acgaaacgcactcccggacagacaa

SEQ ID NO: 61416 - DNA, 25 bp, E. coli
aaacataacgaaacgcactgccgga

SEQ ID NO: 61417 - DNA, 25 bp, E. coli
aaacataacgaatcgcactgccgga

SEQ ID NO: 61418 - DNA, 25 bp, E. coli
tagtcgccggttacgacggcattaa

SEQ ID NO: 61419 - DNA, 25 bp, E. coli
tagtcgccggtttcgacggcattaa

SEQ ID NO: 61420 - DNA, 25 bp, E. coli
tatacttcggatttttgccatgcta

SEQ ID NO: 61421 - DNA, 25 bp, E. coli
tatacttcggatatttgccatgcta

SEQ ID NO: 61422 - DNA, 25 bp, E. coli
ttttgtaagcaatcaacttagctga

SEQ ID NO: 61423 - DNA, 25 bp, E. coli
ttttgtaagcaaacaacttagctga

SEQ ID NO: 61424 - DNA, 25 bp, E. coli
gccatgctatttctttacatctcta

SEQ ID NO: 61425 - DNA, 25 bp, E. coli
gccatgctatttgtttacatctcta

SEQ ID NO: 61426 - DNA, 25 bp, E. coli
gcaaataagtcggtatacttcggat

SEQ ID NO: 61427 - DNA, 25 bp, E. coli
gcaaataagtcgctatacttcggat

SEQ ID NO: 61428 - DNA, 25 bp, E. coli
cgacggcattaatgcgcaaataagt

SEQ ID NO: 61429 - DNA, 25 bp, E. coli
cgacggcattaaagcgcaaataagt

SEQ ID NO: 61430 - DNA, 25 bp, E. coli
ctctgaatttcatcttttgtaagca

SEQ ID NO: 61431 - DNA, 25 bp, E. coli
ctctgaatttcaacttttgtaagca

SEQ ID NO: 61432 - DNA, 25 bp, E. coli
taacagttgattcgttagtcgccgg

SEQ ID NO: 61433 - DNA, 25 bp, E. coli
cacaggcacagggagtgaaagagtt

SEQ ID NO: 61434 - DNA, 25 bp, E. coli
cacaggcacaggcagtgaaagagtt

SEQ ID NO: 61435 - DNA, 25 bp, E. coli
cagtgattagttctccagtgatgga

SEQ ID NO: 61436 - DNA, 25 bp, E. coli
catgcccttattacaggcggttcgc

SEQ ID NO: 61437 - DNA, 25 bp, E. coli
cagtaaatgggtcgatgtcacgcat

SEQ ID NO: 61438 - DNA, 25 bp, E. coli
catgcccttatttcaggcggttcgc

SEQ ID NO: 61439 - DNA, 25 bp, E. coli
cagtgattagttgtccagtgatgga

SEQ ID NO: 61440 - DNA, 25 bp, E. coli
cagtaaatgggtggatgtcacgcat

SEQ ID NO: 61441 - DNA, 25 bp, E. coli
cagtgatggaaataaggcagtggca

SEQ ID NO: 61442 - DNA, 25 bp, E. coli
cagtgatggaaaaaaggcagtggca

SEQ ID NO: 61443 - DNA, 25 bp, E. coli
taaatcaccaacacgatatggcggt

SEQ ID NO: 61444 - DNA, 25 bp, E. coli
taaatcaccaactcgatatggcggt

SEQ ID NO: 61445 - DNA, 25 bp, E. coli
aactggcggtgcataacgttggtca

SEQ ID NO: 61446 - DNA, 25 bp, E. coli
aactggcggtgcttaacgttggtca

SEQ ID NO: 61447 - DNA, 25 bp, E. coli
taccgcagcgatagccagcggcatg

SEQ ID NO: 61448 - DNA, 25 bp, E. coli
taccgcagcgattgccagcggcatg

SEQ ID NO: 61449 - DNA, 25 bp, E. coli
tttatgagcattgccctgtggctgg

SEQ ID NO: 61450 - DNA, 25 bp, E. coli
tttatgagcattcccctgtggctgg

SEQ ID NO: 61451 - DNA, 25 bp, E. coli
gcggcatgggcgttgcagtattacc

SEQ ID NO: 61452 - DNA, 25 bp, E. coli
gcggcatgggcgatgcagtattacc

SEQ ID NO: 61453 - DNA, 25 bp, E. coli
tggtaggaactcaagattgcccggg

SEQ ID NO: 61454 - DNA, 25 bp, E. coli
tggtaggaactctagattgcccggg

SEQ ID NO: 61455 - DNA, 25 bp, E. coli
actgaatgcgaggacgctacaacga

SEQ ID NO: 61456 - DNA, 25 bp, E. coli
actgaatgcgagcacgctacaacga

SEQ ID NO: 61457 - DNA, 25 bp, E. coli
tttaactgcagaactgaatgcgagg

SEQ ID NO: 61458 - DNA, 25 bp, E. coli
tttaactgcagatctgaatgcgagg

SEQ ID NO: 61459 - DNA, 25 bp, E. coli
tgttgatgccgcaggcgtggtcagc

SEQ ID NO: 61460 - DNA, 25 bp, E. coli
tgttgatgccgctggcgtggtcagc

SEQ ID NO: 61461 - DNA, 25 bp, E. coli
ttgccatttatttccaatttccgcg

SEQ ID NO: 61462 - DNA, 25 bp, E. coli
ttgccatttattaccaatttccgcg

SEQ ID NO: 61463 - DNA, 25 bp, E. coli
cctctcaatgaatcgggtgttagcc

SEQ ID NO: 61464 - DNA, 25 bp, E. coli
cctctcaatgaaacgggtgttagcc

SEQ ID NO: 61465 - DNA, 25 bp, E. coli
gctggtctggttgccatttattacc

SEQ ID NO: 61466 - DNA, 25 bp, E. coli
gctggtctggttcccatttattacc

SEQ ID NO: 61467 - DNA, 25 bp, E. coli
cgccagccagctagatgcactaatt

SEQ ID NO: 61468 - DNA, 25 bp, E. coli
cgccagccagcttgatgcactaatt

SEQ ID NO: 61469 - DNA, 25 bp, E. coli
ctcaggatctgatgccacggctgga

SEQ ID NO: 61470 - DNA, 25 bp, E. coli
ctcaggatctgaagccacggctgga

SEQ ID NO: 61471 - DNA, 25 bp, E. coli
cggtatcgctcaggatctgatgcca

SEQ ID NO: 61472 - DNA, 25 bp, E. coli
cggtatcgctcacgatctgatgcca

SEQ ID NO: 61473 - DNA, 25 bp, E. coli
ggatctgatgcctcggctggatgtt

SEQ ID NO: 61474 - DNA, 25 bp, E. coli
ggatctgatgccacggctggatgtt

SEQ ID NO: 61475 - DNA, 25 bp, E. coli
gatgcactaattggccagtttgacc

SEQ ID NO: 61476 - DNA, 25 bp, E. coli
gatgcactaattcgccagtttgacc

SEQ ID NO: 61477 - DNA, 25 bp, E. coli
tacctataacgacccgggacgtacg

SEQ ID NO: 61478 - DNA, 25 bp, E. coli
tacctataacgagccgggacgtacg

SEQ ID NO: 61479 - DNA, 25 bp, E. coli
aacacgctgattttgattgacggca

SEQ ID NO: 61480 - DNA, 25 bp, E. coli
aacacgctgattatgattgacggca

SEQ ID NO: 61481 - DNA, 25 bp, E. coli
tattgaagttctgcgtggtccggca

SEQ ID NO: 61482 - DNA, 25 bp, E. coli
tattgtcggcaaaaactggagcccg

SEQ ID NO: 61483 - DNA, 25 bp, E. coli
tattgtcggcaataactggagcccg

SEQ ID NO: 61484 - DNA, 25 bp, E. coli
tattgaagttctccgtggtccggca

SEQ ID NO: 61485 - DNA, 25 bp, E. coli
ccagaacataaacaggaaggtgcca

SEQ ID NO: 61486 - DNA, 25 bp, E. coli
ccaggctgacgcctgggatatcaac

SEQ ID NO: 61487 - DNA, 25 bp, E. coli
ccagaacataaagaggaaggtgcca

SEQ ID NO: 61488 - DNA, 25 bp, E. coli
ccaggctgacgcgtgggatatcaac

SEQ ID NO: 61489 - DNA, 25 bp, E. coli
gcgggcggcgtggttaacatcatta

SEQ ID NO: 61490 - DNA, 25 bp, E. coli
gcgggcggcgtgcttaacatcatta

SEQ ID NO: 61491 - DNA, 25 bp, E. coli
gctgtagggcaatacgcagtcggca

SEQ ID NO: 61492 - DNA, 25 bp, E. coli
gctgtagggcaaaacgcagtcggca

SEQ ID NO: 61493 - DNA, 25 bp, E. coli
ggcaccgatctcaatcagtgggata

SEQ ID NO: 61494 - DNA, 25 bp, E. coli
ggcaccgatctctatcagtgggata

SEQ ID NO: 61495 - DNA, 25 bp, E. coli
gagcccggcgctcaacatatcgcaa

SEQ ID NO: 61496 - DNA, 25 bp, E. coli
gaccgtagcccgtattcaaaagcag

SEQ ID NO: 61497 - DNA, 25 bp, E. coli
gaccgtagcccgaattcaaaagcag

SEQ ID NO: 61498 - DNA, 25 bp, E. coli
gagcccggcgctgaacatatcgcaa

SEQ ID NO: 61499 - DNA, 25 bp, E. coli
aagagataaaaattatcagatgtag

SEQ ID NO: 61500 - DNA, 25 bp, E. coli
aagagataaaaaatatcagatgtag

SEQ ID NO: 61501 - DNA, 25 bp, E. coli
cacggtgattttcctcgtgttggta

SEQ ID NO: 61502 - DNA, 25 bp, E. coli
cacggtgattttgctcgtgttggta

SEQ ID NO: 61503 - DNA, 25 bp, E. coli
taaagatgcacaacagaaagccgct

SEQ ID NO: 61504 - DNA, 25 bp, E. coli
taaagatgcacatcagaaagccgct

SEQ ID NO: 61505 - DNA, 25 bp, E. coli
tctcaagaggtatatgtccaatttg

SEQ ID NO: 61506 - DNA, 25 bp, E. coli
tcgtaggtaatgtctggagcgacag

SEQ ID NO: 61507 - DNA, 25 bp, E. coli
tctcaagaggtaaatgtccaatttg

SEQ ID NO: 61508 - DNA, 25 bp, E. coli
tcgtaggtaatgactggagcgacag

SEQ ID NO: 61509 - DNA, 25 bp, E. coli
gctcgtgttggtaggatttgtcgta

SEQ ID NO: 61510 - DNA, 25 bp, E. coli
gctcgtgttggttggatttgtcgta

SEQ ID NO: 61511 - DNA, 25 bp, E. coli
gaattatctcaagaggtaaatgtcc

SEQ ID NO: 61512 - DNA, 25 bp, E. coli
gcacaacagaaagccgctgaaattt

SEQ ID NO: 61513 - DNA, 25 bp, E. coli
gaattatctcaacaggtaaatgtcc

SEQ ID NO: 61514 - DNA, 25 bp, E. coli
gcacaacagaaacccgctgaaattt

SEQ ID NO: 61515 - DNA, 25 bp, E. coli
gatttgtcgtaggtaatgtctggag

SEQ ID NO: 61516 - DNA, 25 bp, E. coli
gatttgtcgtagctaatgtctggag

SEQ ID NO: 61517 - DNA, 25 bp, E. coli
gatgcacaacagtaagccgctgaaa

SEQ ID NO: 61518 - DNA, 25 bp, E. coli
gagcgtgatgctgccgaattatctc

SEQ ID NO: 61519 - DNA, 25 bp, E. coli
gagcgtgatgctcccgaattatctc

SEQ ID NO: 61520 - DNA, 25 bp, E. coli
gatgcacaacagaaagccgctgaaa

SEQ ID NO: 61521 - DNA, 25 bp, E. coli
cagctcatgaggttgagaacctccg

SEQ ID NO: 61522 - DNA, 25 bp, E. coli
caaaaaaggtcaggcagcgacaacc

SEQ ID NO: 61523 - DNA, 25 bp, E. coli
cagctcatgaggatgagaacctccg

SEQ ID NO: 61524 - DNA, 25 bp, E. coli
caacaaacatcacaattggagcaga

SEQ ID NO: 61525 - DNA, 25 bp, E. coli
caaaaaaggtcacgcagcgacaacc

SEQ ID NO: 61526 - DNA, 25 bp, E. coli
caacaaacatcagaattggagcaga

SEQ ID NO: 61527 - DNA, 25 bp, E. coli
aaatgtgccggccattgtcggatgc

SEQ ID NO: 61528 - DNA, 25 bp, E. coli
aaatgtgccggcgattgtcggatgc

SEQ ID NO: 61529 - DNA, 25 bp, E. coli
ttgcgttacttatggctggccctgg

SEQ ID NO: 61530 - DNA, 25 bp, E. coli
ttgcgttacttaaggctggccctgg

SEQ ID NO: 61531 - DNA, 25 bp, E. coli
tgttaattagtacggcatccccacc

SEQ ID NO: 61532 - DNA, 25 bp, E. coli
tgttaattagtagggcatccccacc

SEQ ID NO: 61533 - DNA, 25 bp, E. coli
tcataacgttgacccgaccgggcaa

SEQ ID NO: 61534 - DNA, 25 bp, E. coli
tcataacgttgagccgaccgggcaa

SEQ ID NO: 61535 - DNA, 25 bp, E. coli
ccacgaagtggcgagtaatcctcta

SEQ ID NO: 61536 - DNA, 25 bp, E. coli
ccacgaagtggccagtaatcctcta

SEQ ID NO: 61537 - DNA, 25 bp, E. coli
gcgacaacccactgcaaagggttaa

SEQ ID NO: 61538 - DNA, 25 bp, E. coli
gcgacaacccacagcaaagggttaa

SEQ ID NO: 61539 - DNA, 25 bp, E. coli
tggaggatccgcactgttacactga

SEQ ID NO: 61540 - DNA, 25 bp, E. coli
tggaggatccgctctgttacactga

SEQ ID NO: 61541 - DNA, 25 bp, E. coli
gacgttttcacattctgttgacaga

SEQ ID NO: 61542 - DNA, 25 bp, E. coli
gacgttttcacaatctgttgacaga

SEQ ID NO: 61543 - DNA, 25 bp, E. coli
catgatgtctttggtgagcggtgaa

SEQ ID NO: 61544 - DNA, 25 bp, E. coli
catgatgtctttcgtgagcggtgaa

SEQ ID NO: 61545 - DNA, 25 bp, E. coli
tagtcattttattttgccgacggcc

SEQ ID NO: 61546 - DNA, 25 bp, E. coli
tagtcattttatattgccgacggcc

SEQ ID NO: 61547 - DNA, 25 bp, E. coli
taggtcacttagacgctactatcat

SEQ ID NO: 61548 - DNA, 25 bp, E. coli
taggtcacttagtcgctactatcat

SEQ ID NO: 61549 - DNA, 25 bp, E. coli
tcatcagcaacgattacattagtca

SEQ ID NO: 61550 - DNA, 25 bp, E. coli
tcatcagcaacgtttacattagtca

SEQ ID NO: 61551 - DNA, 25 bp, E. coli
tcttcaacttagatgtccggtatta

SEQ ID NO: 61552 - DNA, 25 bp, E. coli
tcttcaacttagttgtccggtatta

SEQ ID NO: 61553 - DNA, 25 bp, E. coli
gaagtgtcattgtctgttaacgcaa

SEQ ID NO: 61554 - DNA, 25 bp, E. coli
gaagtgtcattgactgttaacgcaa

SEQ ID NO: 61555 - DNA, 25 bp, E. coli
cgcaatgttgtaaaggtaagataat

SEQ ID NO: 61556 - DNA, 25 bp, E. coli
cgcaatgttgtataggtaagataat

SEQ ID NO: 61557 - DNA, 25 bp, E. coli
taagcgtacgactgtattatcagaa

SEQ ID NO: 61558 - DNA, 25 bp, E. coli
taagcgtacgacagtattatcagaa

SEQ ID NO: 61559 - DNA, 25 bp, E. coli
gagcggtgaacagaatacacctgcg

SEQ ID NO: 61560 - DNA, 25 bp, E. coli
gatgttgcagcagagcttaggtcac

SEQ ID NO: 61561 - DNA, 25 bp, E. coli
gagcggtgaacacaatacacctgcg

SEQ ID NO: 61562 - DNA, 25 bp, E. coli
gacggcctcattgtcgaaagataag

SEQ ID NO: 61563 - DNA, 25 bp, E. coli
gacggcctcattctcgaaagataag

SEQ ID NO: 61564 - DNA, 25 bp, E. coli
gatgttgcagcacagcttaggtcac

SEQ ID NO: 61565 - DNA, 25 bp, E. coli
caaccagcgcgaacttgattcgttg

SEQ ID NO: 61566 - DNA, 25 bp, E. coli
caaccagcgcgatcttgattcgttg

SEQ ID NO: 61567 - DNA, 25 bp, E. coli
acggagaagcgttcctgtttggcgc

SEQ ID NO: 61568 - DNA, 25 bp, E. coli
acttgattcgttgtacggtcgcgtc

SEQ ID NO: 61569 - DNA, 25 bp, E. coli
acttgattcgttctacggtcgcgtc

SEQ ID NO: 61570 - DNA, 25 bp, E. coli
acggagaagcgtacctgtttggcgc

SEQ ID NO: 61571 - DNA, 25 bp, E. coli
tgcgcgacggagaagcgttcctgtt

SEQ ID NO: 61572 - DNA, 25 bp, E. coli
tgcgcgacggagtagcgttcctgtt

SEQ ID NO: 61573 - DNA, 25 bp, E. coli
tctgcgcgacggagaagcgttcctg

SEQ ID NO: 61574 - DNA, 25 bp, E. coli
tctgcgcgacggtgaagcgttcctg

SEQ ID NO: 61575 - DNA, 25 bp, E. coli
ccagcgcgaactagattcgttgtac

SEQ ID NO: 61576 - DNA, 25 bp, E. coli
ccagcgcgaacttgattcgttgtac

SEQ ID NO: 61577 - DNA, 25 bp, E. coli
gcgttcctgtttggcgcaaacatca

SEQ ID NO: 61578 - DNA, 25 bp, E. coli
gcgttcctgtttcgcgcaaacatca

SEQ ID NO: 61579 - DNA, 25 bp, E. coli
gaagcgttcctgattggcgcaaaca

SEQ ID NO: 61580 - DNA, 25 bp, E. coli
gaagcgttcctgtttggcgcaaaca

SEQ ID NO: 61581 - DNA, 25 bp, E. coli
gaacttgattcgatgtacggtcgcg

SEQ ID NO: 61582 - DNA, 25 bp, E. coli
gaacttgattcgttgtacggtcgcg

SEQ ID NO: 61583 - DNA, 25 bp, E. coli
cgacggagaagcgttcctgtttggc

SEQ ID NO: 61584 - DNA, 25 bp, E. coli
cgacggagaagccttcctgtttggc

SEQ ID NO: 61585 - DNA, 25 bp, E. coli
gagaagcgttccagtttggcgcaaa

SEQ ID NO: 61586 - DNA, 25 bp, E. coli
gagaagcgttcctgtttggcgcaaa

SEQ ID NO: 61587 - DNA, 25 bp, E. coli
cagattatgaagttgccagtgcacc

SEQ ID NO: 61588 - DNA, 25 bp, E. coli
cagattatgaagatgccagtgcacc

SEQ ID NO: 61589 - DNA, 25 bp, E. coli
tatgaaaccgcagcagaataccggg

SEQ ID NO: 61590 - DNA, 25 bp, E. coli
tatgaaaccgcaccagaataccggg

SEQ ID NO: 61591 - DNA, 25 bp, E. coli
tattcaggctaaagccaccggcagc

SEQ ID NO: 61592 - DNA, 25 bp, E. coli
tattcaggctaatgccaccggcagc

SEQ ID NO: 61593 - DNA, 25 bp, E. coli
ttagtgcgcgcgtaaaagccattcg

SEQ ID NO: 61594 - DNA, 25 bp, E. coli
ttagtgcgcgcgaaaaagccattcg

SEQ ID NO: 61595 - DNA, 25 bp, E. coli
tgacttttgatgacggctaccagag

SEQ ID NO: 61596 - DNA, 25 bp, E. coli
tgacttttgatgtcggctaccagag

SEQ ID NO: 61597 - DNA, 25 bp, E. coli
gcatattttactgaccacgcacggt

SEQ ID NO: 61598 - DNA, 25 bp, E. coli
gcatattttactcaccacgcacggt

SEQ ID NO: 61599 - DNA, 25 bp, E. coli
gaacaatttgcctggctgcgcgaga

SEQ ID NO: 61600 - DNA, 25 bp, E. coli
gaacatcatttataccgccacagga

SEQ ID NO: 61601 - DNA, 25 bp, E. coli
gaacaatttgccaggctgcgcgaga

SEQ ID NO: 61602 - DNA, 25 bp, E. coli
gaacatcatttaaaccgccacagga

SEQ ID NO: 61603 - DNA, 25 bp, E. coli
gatttagatcccacattaacgcgag

SEQ ID NO: 61604 - DNA, 25 bp, E. coli
gatttagatccctcattaacgcgag

SEQ ID NO: 61605 - DNA, 25 bp, E. coli
tggcaattacgtacccgctcaggtg

SEQ ID NO: 61606 - DNA, 25 bp, E. coli
tggcaattacgttcccgctcaggtg

SEQ ID NO: 61607 - DNA, 25 bp, E. coli
taacgttgaagaggaagctgccgac

SEQ ID NO: 61608 - DNA, 25 bp, E. coli
taacgttgaagacgaagctgccgac

SEQ ID NO: 61609 - DNA, 25 bp, E. coli
caacatcggtgtggcggtggatacc

SEQ ID NO: 61610 - DNA, 25 bp, E. coli
caacatcggtgtcgcggtggatacc

SEQ ID NO: 61611 - DNA, 25 bp, E. coli
taaacagcagaacgaagaagcggcg

SEQ ID NO: 61612 - DNA, 25 bp, E. coli
taaaggtcgtatcctgcgcgaagac

SEQ ID NO: 61613 - DNA, 25 bp, E. coli
taaacagcagaaggaagaagcggcg

SEQ ID NO: 61614 - DNA, 25 bp, E. coli
taaaggtcgtatgctgcgcgaagac

SEQ ID NO: 61615 - DNA, 25 bp, E. coli
tatttctaagaaagcgcgtgacggt

SEQ ID NO: 61616 - DNA, 25 bp, E. coli
tatcaaacgtgctgaagcagctccg

SEQ ID NO: 61617 - DNA, 25 bp, E. coli
tatcaaacgtgcagaagcagctccg

SEQ ID NO: 61618 - DNA, 25 bp, E. coli
tatttctaagaatgcgcgtgacggt

SEQ ID NO: 61619 - DNA, 25 bp, E. coli
tgaaagtgggcgacaaagttgccgc

SEQ ID NO: 61620 - DNA, 25 bp, E. coli
tgaaagtgggcgtcaaagttgccgc

SEQ ID NO: 61621 - DNA, 25 bp, E. coli
tcttcgaagttgaaggcgcagcgcc

SEQ ID NO: 61622 - DNA, 25 bp, E. coli
tcttcgaagttgtaggcgcagcgcc

SEQ ID NO: 61623 - DNA, 25 bp, E. coli
gaagtggctatcctcggcgtttcca

SEQ ID NO: 61624 - DNA, 25 bp, E. coli
gaagtggctatcgtcggcgtttcca

SEQ ID NO: 61625 - DNA, 25 bp, E. coli
gaacagtcgctgatcaccgtagaag

SEQ ID NO: 61626 - DNA, 25 bp, E. coli
gaacagtcgctgttcaccgtagaag

SEQ ID NO: 61627 - DNA, 25 bp, E. coli
taagctggatgtcaagatcaccccg

SEQ ID NO: 61628 - DNA, 25 bp, E. coli
taagctggatgtgaagatcaccccg

SEQ ID NO: 61629 - DNA, 25 bp, E. coli
gagatcctggtctaagtgggcgaca

SEQ ID NO: 61630 - DNA, 25 bp, E. coli
gagatcctggtcaaagtgggcgaca

SEQ ID NO: 61631 - DNA, 25 bp, E. coli
cactgagggaactatttattgagtt

SEQ ID NO: 61632 - DNA, 25 bp, E. coli
cactgagggaacaatttattgagtt

SEQ ID NO: 61633 - DNA, 25 bp, E. coli
cataagtgagcattttaaccgaaca

SEQ ID NO: 61634 - DNA, 25 bp, E. coli
cataagtgagcaatttaaccgaaca

SEQ ID NO: 61635 - DNA, 25 bp, E. coli
accgaacactgagggaacaatttat

SEQ ID NO: 61636 - DNA, 25 bp, E. coli
tttaaccgaacactgagggaacaat

SEQ ID NO: 61637 - DNA, 25 bp, E. coli
accgaacactgacggaacaatttat

SEQ ID NO: 61638 - DNA, 25 bp, E. coli
tttaaccgaacagtgagggaacaat

SEQ ID NO: 61639 - DNA, 25 bp, E. coli
tattgagtttaatgaagaattgctc

SEQ ID NO: 61640 - DNA, 25 bp, E. coli
tattgagtttaaagaagaattgctc

SEQ ID NO: 61641 - DNA, 25 bp, E. coli
tgagcattttaagcgaacactgagg

SEQ ID NO: 61642 - DNA, 25 bp, E. coli
tgagcattttaaccgaacactgagg

SEQ ID NO: 61643 - DNA, 25 bp, E. coli
tgccataagtgagcattttaaccga

SEQ ID NO: 61644 - DNA, 25 bp, E. coli
tgccataagtgaccattttaaccga

SEQ ID NO: 61645 - DNA, 25 bp, E. coli
gcattttaaccgaacactgagggaa

SEQ ID NO: 61646 - DNA, 25 bp, E. coli
gcattttaaccgtacactgagggaa

SEQ ID NO: 61647 - DNA, 25 bp, E. coli
gaacactgagggaacaatttattga

SEQ ID NO: 61648 - DNA, 25 bp, E. coli
gaacactgagggtacaatttattga

SEQ ID NO: 61649 - DNA, 25 bp, E. coli
taatgaagaattgctctttgaatag

SEQ ID NO: 61650 - DNA, 25 bp, E. coli
taaccgaacactgagggaacaattt

SEQ ID NO: 61651 - DNA, 25 bp, E. coli
taaccgaacactcagggaacaattt

SEQ ID NO: 61652 - DNA, 25 bp, E. coli
taatgaagaattcctctttgaatag

SEQ ID NO: 61653 - DNA, 25 bp, E. coli
aatgtcagcaatccagcatttcctc

SEQ ID NO: 61654 - DNA, 25 bp, E. coli
caatgcagcatttcctcacgattct

SEQ ID NO: 61655 - DNA, 25 bp, E. coli
caatgcagcattacctcacgattct

SEQ ID NO: 61656 - DNA, 25 bp, E. coli
aatgtcagcaatgcagcatttcctc

SEQ ID NO: 61657 - DNA, 25 bp, E. coli
tgcattgctggcctaaatgtcagca

SEQ ID NO: 61658 - DNA, 25 bp, E. coli
tgcattgctggcgtaaatgtcagca

SEQ ID NO: 61659 - DNA, 25 bp, E. coli
tgacgatcgcacattttgctcgtta

SEQ ID NO: 61660 - DNA, 25 bp, E. coli
tgacgatcgcactttttgctcgtta

SEQ ID NO: 61661 - DNA, 25 bp, E. coli
tcagcaatgcaggatttcctcacga

SEQ ID NO: 61662 - DNA, 25 bp, E. coli
tcagcaatgcagcatttcctcacga

SEQ ID NO: 61663 - DNA, 25 bp, E. coli
gcaatgcagcatttcctcacgattc

SEQ ID NO: 61664 - DNA, 25 bp, E. coli
gcaatgcagcatatcctcacgattc

SEQ ID NO: 61665 - DNA, 25 bp, E. coli
cgatcgcactttatgctcgttatga

SEQ ID NO: 61666 - DNA, 25 bp, E. coli
cgatcgcactttttgctcgttatga

SEQ ID NO: 61667 - DNA, 25 bp, E. coli
ctggcgtaaatgtcagcaatgcagc

SEQ ID NO: 61668 - DNA, 25 bp, E. coli
ctttgacgatcgcactttttgctcg

SEQ ID NO: 61669 - DNA, 25 bp, E. coli
ctggcgtaaatgacagcaatgcagc

SEQ ID NO: 61670 - DNA, 25 bp, E. coli
ctttgacgatcggactttttgctcg

SEQ ID NO: 61671 - DNA, 25 bp, E. coli
ggcgtaaatgtctgcaatgcagcat

SEQ ID NO: 61672 - DNA, 25 bp, E. coli
ggcgtaaatgtcagcaatgcagcat

SEQ ID NO: 61673 - DNA, 25 bp, E. coli
taaatgtcagcattgcagcatttcc

SEQ ID NO: 61674 - DNA, 25 bp, E. coli
taaatgtcagcaatgcagcatttcc

SEQ ID NO: 61675 - DNA, 25 bp, E. coli
aagcggttccgcagcaaaatcaggg

SEQ ID NO: 61676 - DNA, 25 bp, E. coli
caatcgcgttataactgacgtggcg

SEQ ID NO: 61677 - DNA, 25 bp, E. coli
aagcggttccgctgcaaaatcaggg

SEQ ID NO: 61678 - DNA, 25 bp, E. coli
caatcgcgttattactgacgtggcg

SEQ ID NO: 61679 - DNA, 25 bp, E. coli
cattttgttggcgatcccgcgtccg

SEQ ID NO: 61680 - DNA, 25 bp, E. coli
cattttgttggccatcccgcgtccg

SEQ ID NO: 61681 - DNA, 25 bp, E. coli
aaaaatgtggtgttcctcatgcccg

SEQ ID NO: 61682 - DNA, 25 bp, E. coli
aaaaatgtggtgatcctcatgcccg

SEQ ID NO: 61683 - DNA, 25 bp, E. coli
tatctgacggcacgattaaccgcca

SEQ ID NO: 61684 - DNA, 25 bp, E. coli
tatctgacggcaggattaaccgcca

SEQ ID NO: 61685 - DNA, 25 bp, E. coli
tattaccgggctatgtccatgatgt

SEQ ID NO: 61686 - DNA, 25 bp, E. coli
tattaccgggctttgtccatgatgt

SEQ ID NO: 61687 - DNA, 25 bp, E. coli
tgctttagcgttcagataatcggcc

SEQ ID NO: 61688 - DNA, 25 bp, E. coli
tgctttagcgttgagataatcggcc

SEQ ID NO: 61689 - DNA, 25 bp, E. coli
ccgtggatggcgaaaatcggcgtct

SEQ ID NO: 61690 - DNA, 25 bp, E. coli
ccgtggatggcgtaaatcggcgtct

SEQ ID NO: 61691 - DNA, 25 bp, E. coli
cgctaaacggatagcgcctgaattt

SEQ ID NO: 61692 - DNA, 25 bp, E. coli
cgctaaacggattgcgcctgaattt

SEQ ID NO: 61693 - DNA, 25 bp, E. coli
gattgtcgtcttcggtttatgcggc

SEQ ID NO: 61694 - DNA, 25 bp, E. coli
gattgtcgtcttgggtttatgcggc

SEQ ID NO: 61695 - DNA, 25 bp, E. coli
taatcggcctgctactggttggcgt

SEQ ID NO: 61696 - DNA, 25 bp, E. coli
taatcggcctgcaactggttggcgt

SEQ ID NO: 61697 - DNA, 25 bp, E. coli
caatgatcggcggttcgctttctgt

SEQ ID NO: 61698 - DNA, 25 bp, E. coli
caatgatcggcgcttcgctttctgt

SEQ ID NO: 61699 - DNA, 25 bp, E. coli
caaattgtgcaaagatcggcggttc

SEQ ID NO: 61700 - DNA, 25 bp, E. coli
caaattgtgcaatgatcggcggttc

SEQ ID NO: 61701 - DNA, 25 bp, E. coli
tacggcgattgggatgtgtgcatta

SEQ ID NO: 61702 - DNA, 25 bp, E. coli
tacggcgattggcatgtgtgcatta

SEQ ID NO: 61703 - DNA, 25 bp, E. coli
tagtggagaagctaattgtgcaatg

SEQ ID NO: 61704 - DNA, 25 bp, E. coli
tagtggagaagcaaattgtgcaatg

SEQ ID NO: 61705 - DNA, 25 bp, E. coli
ttacccaacggctaacgctgtagcg

SEQ ID NO: 61706 - DNA, 25 bp, E. coli
ttacccaacggcaaacgctgtagcg

SEQ ID NO: 61707 - DNA, 25 bp, E. coli
tgtgcattacccaacggcaaacgct

SEQ ID NO: 61708 - DNA, 25 bp, E. coli
tgtagcgaacagtcacttgccgccg

SEQ ID NO: 61709 - DNA, 25 bp, E. coli
tgtgcattaccctacggcaaacgct

SEQ ID NO: 61710 - DNA, 25 bp, E. coli
tgtagcgaacagacacttgccgccg

SEQ ID NO: 61711 - DNA, 25 bp, E. coli
tcggcggttcgctttctgttgcccg

SEQ ID NO: 61712 - DNA, 25 bp, E. coli
tcggcggttcgcattctgttgcccg

SEQ ID NO: 61713 - DNA, 25 bp, E. coli
gcgaacagtcacatgccgccgggag

SEQ ID NO: 61714 - DNA, 25 bp, E. coli
gcgaacagtcacttgccgccgggag

SEQ ID NO: 61715 - DNA, 25 bp, E. coli
cggcaaacgctgtagcgaacagtca

SEQ ID NO: 61716 - DNA, 25 bp, E. coli
cggcaaacgctgaagcgaacagtca

SEQ ID NO: 61717 - DNA, 25 bp, E. coli
ggatgtgtgcattacccaacggcaa

SEQ ID NO: 61718 - DNA, 25 bp, E. coli
ggatgtgtgcataacccaacggcaa

SEQ ID NO: 61719 - DNA, 25 bp, E. coli
tactggccaggttcgtcaaagtcgg

SEQ ID NO: 61720 - DNA, 25 bp, E. coli
tactggccaggtacgtcaaagtcgg

SEQ ID NO: 61721 - DNA, 25 bp, E. coli
aaaacacattctgggtcgattcggc

SEQ ID NO: 61722 - DNA, 25 bp, E. coli
aaaacacattctcggtcgattcggc

SEQ ID NO: 61723 - DNA, 25 bp, E. coli
tatggtcgatacatttcgcgccagc

SEQ ID NO: 61724 - DNA, 25 bp, E. coli
tatggtcgatacttttcgcgccagc

SEQ ID NO: 61725 - DNA, 25 bp, E. coli
tgctggttaccctcaatggacgtct

SEQ ID NO: 61726 - DNA, 25 bp, E. coli
tgctggttacccacaatggacgtct

SEQ ID NO: 61727 - DNA, 25 bp, E. coli
gcgccagcctttacgataatcagga

SEQ ID NO: 61728 - DNA, 25 bp, E. coli
gcgccagccttttcgataatcagga

SEQ ID NO: 61729 - DNA, 25 bp, E. coli
gctggacgcgcgttattctctggag

SEQ ID NO: 61730 - DNA, 25 bp, E. coli
gctggacgcgcgatattctctggag

SEQ ID NO: 61731 - DNA, 25 bp, E. coli
gaagtgacaaataccgggcaggacc

SEQ ID NO: 61732 - DNA, 25 bp, E. coli
gaagtgacaaattccgggcaggacc

SEQ ID NO: 61733 - DNA, 25 bp, E. coli
gatcagcagatccaggcgttgcctt

SEQ ID NO: 61734 - DNA, 25 bp, E. coli
gatcagcagatcgaggcgttgcctt

SEQ ID NO: 61735 - DNA, 25 bp, E. coli
ggatgtacgcacagccagcaaagta

SEQ ID NO: 61736 - DNA, 25 bp, E. coli
ggatgtacgcactgccagcaaagta

SEQ ID NO: 61737 - DNA, 25 bp, E. coli
tcaaagtcggcaaatgttaggcgca

SEQ ID NO: 61738 - DNA, 25 bp, E. coli
tcaaagtcggcatatgttaggcgca

SEQ ID NO: 61739 - DNA, 25 bp, E. coli
taatcaggatatgaccgtagcggat

SEQ ID NO: 61740 - DNA, 25 bp, E. coli
taatcaggatatcaccgtagcggat

SEQ ID NO: 61741 - DNA, 25 bp, E. coli
caaagtctgcttcgcggtgcggatc

SEQ ID NO: 61742 - DNA, 25 bp, E. coli
caaagtctgcttggcggtgcggatc

SEQ ID NO: 61743 - DNA, 25 bp, E. coli
ctctccgggcaatgtctgcttggcg

SEQ ID NO: 61744 - DNA, 25 bp, E. coli
ctctccgggcaaagtctgcttggcg

SEQ ID NO: 61745 - DNA, 25 bp, E. coli
atctctccgggctaagtctgcttgg

SEQ ID NO: 61746 - DNA, 25 bp, E. coli
atctctccgggcaaagtctgcttgg

SEQ ID NO: 61747 - DNA, 25 bp, E. coli
tctctccgggcatagtctgcttggc

SEQ ID NO: 61748 - DNA, 25 bp, E. coli
tctccgggcaaagtctgcttggcgg

SEQ ID NO: 61749 - DNA, 25 bp, E. coli
tctgcttggcggagcggatcgtagc

SEQ ID NO: 61750 - DNA, 25 bp, E. coli
tctctccgggcaaagtctgcttggc

SEQ ID NO: 61751 - DNA, 25 bp, E. coli
tctgcttggcggtgcggatcgtagc

SEQ ID NO: 61752 - DNA, 25 bp, E. coli
tctccgggcaaactctgcttggcgg

SEQ ID NO: 61753 - DNA, 25 bp, E. coli
gcgagctatctctccgggcaaagtc

SEQ ID NO: 61754 - DNA, 25 bp, E. coli
gcgagctatctcaccgggcaaagtc

SEQ ID NO: 61755 - DNA, 25 bp, E. coli
cgagctatctctgcgggcaaagtct

SEQ ID NO: 61756 - DNA, 25 bp, E. coli
cgagctatctctccgggcaaagtct

SEQ ID NO: 61757 - DNA, 25 bp, E. coli
cttggcggtgcgcatcgtagctacg

SEQ ID NO: 61758 - DNA, 25 bp, E. coli
ctccgggcaaagtctgcttggcggt

SEQ ID NO: 61759 - DNA, 25 bp, E. coli
cttggcggtgcggatcgtagctacg

SEQ ID NO: 61760 - DNA, 25 bp, E. coli
ctccgggcaaagactgcttggcggt

SEQ ID NO: 61761 - DNA, 25 bp, E. coli
ggcgagctatctctccgggcaaagt

SEQ ID NO: 61762 - DNA, 25 bp, E. coli
ggcgagctatctgtccgggcaaagt

SEQ ID NO: 61763 - DNA, 25 bp, E. coli
caaggcgacctgaaacgtatgggcg

SEQ ID NO: 61764 - DNA, 25 bp, E. coli
caaggcgacctgtaacgtatgggcg

SEQ ID NO: 61765 - DNA, 25 bp, E. coli
caaacgtaccctcgttggcagcgaa

SEQ ID NO: 61766 - DNA, 25 bp, E. coli
caaacgtaccctggttggcagcgaa

SEQ ID NO: 61767 - DNA, 25 bp, E. coli
taaaccatcacatggagcaggacag

SEQ ID NO: 61768 - DNA, 25 bp, E. coli
tacgttcgtggcctggtgaaacatc

SEQ ID NO: 61769 - DNA, 25 bp, E. coli
tacgttcgtggcgtggtgaaacatc

SEQ ID NO: 61770 - DNA, 25 bp, E. coli
taaaccatcacaaggagcaggacag

SEQ ID NO: 61771 - DNA, 25 bp, E. coli
aaaccggtgcgcctttcttccagca

SEQ ID NO: 61772 - DNA, 25 bp, E. coli
aaaccggtgcgcgtttcttccagca

SEQ ID NO: 61773 - DNA, 25 bp, E. coli
tggtgcctgccgtacagcaagctgt

SEQ ID NO: 61774 - DNA, 25 bp, E. coli
tggtgcctgccgaacagcaagctgt

SEQ ID NO: 61775 - DNA, 25 bp, E. coli
tgaaaacgcccggaccgttgaagct

SEQ ID NO: 61776 - DNA, 25 bp, E. coli
tgaaaacgcccgcaccgttgaagct

SEQ ID NO: 61777 - DNA, 25 bp, E. coli
gcttcactggaactcgcggtcggaa

SEQ ID NO: 61778 - DNA, 25 bp, E. coli
gcttcactggaagtcgcggtcggaa

SEQ ID NO: 61779 - DNA, 25 bp, E. coli
cggtcggaaccgtattgcagcagct

SEQ ID NO: 61780 - DNA, 25 bp, E. coli
cggtcggaaccgaattgcagcagct

SEQ ID NO: 61781 - DNA, 25 bp, E. coli
tggcagcgaatagaacacccgtcgt

SEQ ID NO: 61782 - DNA, 25 bp, E. coli
tggcagcgaatacaacacccgtcgt

SEQ ID NO: 61783 - DNA, 25 bp, E. coli
gagtctcatgcctctatgcgcgatg

SEQ ID NO: 61784 - DNA, 25 bp, E. coli
gagtctcatgccactatgcgcgatg

SEQ ID NO: 61785 - DNA, 25 bp, E. coli
cagttgacacactaaaattctctga

SEQ ID NO: 61786 - DNA, 25 bp, E. coli
cagttgacacacaaaaattctctga

SEQ ID NO: 61787 - DNA, 25 bp, E. coli
tacgcttcagagacaacagttgaca

SEQ ID NO: 61788 - DNA, 25 bp, E. coli
tatgaaacagaatatctcagcgatc

SEQ ID NO: 61789 - DNA, 25 bp, E. coli
tacgcttcagagtcaacagttgaca

SEQ ID NO: 61790 - DNA, 25 bp, E. coli
tatgaaacagaaaatctcagcgatc

SEQ ID NO: 61791 - DNA, 25 bp, E. coli
tcttttttggtcaacaacgagaagg

SEQ ID NO: 61792 - DNA, 25 bp, E. coli
tcttttttggtctacaacgagaagg

SEQ ID NO: 61793 - DNA, 25 bp, E. coli
tctctgacatcctctactcagcggg

SEQ ID NO: 61794 - DNA, 25 bp, E. coli
tctctgacatccactactcagcggg

SEQ ID NO: 61795 - DNA, 25 bp, E. coli
ccagtcaatgcaacatacgcttcag

SEQ ID NO: 61796 - DNA, 25 bp, E. coli
gccgtagtacaattgaaatcaagat

SEQ ID NO: 61797 - DNA, 25 bp, E. coli
ccagtcaatgcatcatacgcttcag

SEQ ID NO: 61798 - DNA, 25 bp, E. coli
gccgtagtacaaatgaaatcaagat

SEQ ID NO: 61799 - DNA, 25 bp, E. coli
cgactctcgccaaaaacatttatga

SEQ ID NO: 61800 - DNA, 25 bp, E. coli
cgactctcgccataaacatttatga

SEQ ID NO: 61801 - DNA, 25 bp, E. coli
gggtgttccctaaaggatatggctt

SEQ ID NO: 61802 - DNA, 25 bp, E. coli
gggtgttccctataggatatggctt

SEQ ID NO: 61803 - DNA, 25 bp, E. coli
tggcttatctgaccagatgtctggc

SEQ ID NO: 61804 - DNA, 25 bp, E. coli
tggcttatctgagcagatgtctggc

SEQ ID NO: 61805 - DNA, 25 bp, E. coli
gatgtctggcatgaatacacccgac

SEQ ID NO: 61806 - DNA, 25 bp, E. coli
gatgtctggcatcaatacacccgac

SEQ ID NO: 61807 - DNA, 25 bp, E. coli
caattaaataagcatggcagcctcc

SEQ ID NO: 61808 - DNA, 25 bp, E. coli
caattaaataaggatggcagcctcc

SEQ ID NO: 61809 - DNA, 25 bp, E. coli
caaagtaccagaaagcgcagcgctg

SEQ ID NO: 61810 - DNA, 25 bp, E. coli
caaagtaccagatagcgcagcgctg

SEQ ID NO: 61811 - DNA, 25 bp, E. coli
caaagatatggtgacaaagtccggg

SEQ ID NO: 61812 - DNA, 25 bp, E. coli
cagcgctggcaaagacgggaacagt

SEQ ID NO: 61813 - DNA, 25 bp, E. coli
cagcgctggcaatgacgggaacagt

SEQ ID NO: 61814 - DNA, 25 bp, E. coli
caaagatatggtcacaaagtccggg

SEQ ID NO: 61815 - DNA, 25 bp, E. coli
cttgtagttaagcaatgcacgggta

SEQ ID NO: 61816 - DNA, 25 bp, E. coli
cttgtagttaaggaatgcacgggta

SEQ ID NO: 61817 - DNA, 25 bp, E. coli
taaaaatctcctggaaatggctatg

SEQ ID NO: 61818 - DNA, 25 bp, E. coli
tactcagccaaacatgtagcgccag

SEQ ID NO: 61819 - DNA, 25 bp, E. coli
taaaaatctcctcgaaatggctatg

SEQ ID NO: 61820 - DNA, 25 bp, E. coli
tactcagccaaagatgtagcgccag

SEQ ID NO: 61821 - DNA, 25 bp, E. coli
tagagaaacctcactgtggaaacgc

SEQ ID NO: 61822 - DNA, 25 bp, E. coli
tagagaaacctctctgtggaaacgc

SEQ ID NO: 61823 - DNA, 25 bp, E. coli
ttggtagtcgcttactcaacgcccg

SEQ ID NO: 61824 - DNA, 25 bp, E. coli
ttggtagtcgctaactcaacgcccg

SEQ ID NO: 61825 - DNA, 25 bp, E. coli
gacatacttgtaatgcccgtcaacg

SEQ ID NO: 61826 - DNA, 25 bp, E. coli
gacatacttgtattgcccgtcaacg

SEQ ID NO: 61827 - DNA, 25 bp, E. coli
gattcacggccgtcgatcaccaata

SEQ ID NO: 61828 - DNA, 25 bp, E. coli
gattcacggccgacgatcaccaata

SEQ ID NO: 61829 - DNA, 25 bp, E. coli
catttcttacctcaccagggtaccg

SEQ ID NO: 61830 - DNA, 25 bp, E. coli
catttcttacctgaccagggtaccg

SEQ ID NO: 61831 - DNA, 25 bp, E. coli
tactggcgtgttcctgtcttttaag

SEQ ID NO: 61832 - DNA, 25 bp, E. coli
tactggcgtgttgctgtcttttaag

SEQ ID NO: 61833 - DNA, 25 bp, E. coli
tataacatttcttacctgaccaggg

SEQ ID NO: 61834 - DNA, 25 bp, E. coli
tataacatttctaacctgaccaggg

SEQ ID NO: 61835 - DNA, 25 bp, E. coli
ttcacaaaataatatcaggctccct

SEQ ID NO: 61836 - DNA, 25 bp, E. coli
ttcaacgctgtatgtatagtaagcg

SEQ ID NO: 61837 - DNA, 25 bp, E. coli
ttcaacgctgtaagtatagtaagcg

SEQ ID NO: 61838 - DNA, 25 bp, E. coli
ttcacaaaataaaatcaggctccct

SEQ ID NO: 61839 - DNA, 25 bp, E. coli
tgtatagtaagcgataacctgttga

SEQ ID NO: 61840 - DNA, 25 bp, E. coli
tgtatagtaagccataacctgttga

SEQ ID NO: 61841 - DNA, 25 bp, E. coli
ccagaagaggtttacagtgaatatt

SEQ ID NO: 61842 - DNA, 25 bp, E. coli
ccagaagaggttaacagtgaatatt

SEQ ID NO: 61843 - DNA, 25 bp, E. coli
cctgttgattattgaatctttcggg

SEQ ID NO: 61844 - DNA, 25 bp, E. coli
cctgttgattatagaatctttcggg

SEQ ID NO: 61845 - DNA, 25 bp, E. coli
gctgtcttttaacaccagaagaggt

SEQ ID NO: 61846 - DNA, 25 bp, E. coli
gctgtcttttaagaccagaagaggt

SEQ ID NO: 61847 - DNA, 25 bp, E. coli
cgggaaccaacagcttactggcgtg

SEQ ID NO: 61848 - DNA, 25 bp, E. coli
cgggaaccaacaccttactggcgtg

SEQ ID NO: 61849 - DNA, 25 bp, E. coli
gggagatggcttataacatttctta

SEQ ID NO: 61850 - DNA, 25 bp, E. coli
gggagatggcttttaacatttctta

SEQ ID NO: 61851 - DNA, 25 bp, E. coli
aatgtgaaacatgtggagagtagcg

SEQ ID NO: 61852 - DNA, 25 bp, E. coli
aatgtgaaacatctggagagtagcg

SEQ ID NO: 61853 - DNA, 25 bp, E. coli
cacgaatcacatagttttatgaaag

SEQ ID NO: 61854 - DNA, 25 bp, E. coli
cacgaatcacattgttttatgaaag

SEQ ID NO: 61855 - DNA, 25 bp, E. coli
tacagatcgcatagttaacatttcg

SEQ ID NO: 61856 - DNA, 25 bp, E. coli
tacagatcgcattgttaacatttcg

SEQ ID NO: 61857 - DNA, 25 bp, E. coli
tatgtttgaactgtgacggatttcg

SEQ ID NO: 61858 - DNA, 25 bp, E. coli
tatgtttgaactctgacggatttcg

SEQ ID NO: 61859 - DNA, 25 bp, E. coli
tttccgcagttgctatacagatcgc

SEQ ID NO: 61860 - DNA, 25 bp, E. coli
tttccgcagttggtatacagatcgc

SEQ ID NO: 61861 - DNA, 25 bp, E. coli
tatcagtgcatttatgttttccgca

SEQ ID NO: 61862 - DNA, 25 bp, E. coli
tatcagtgcattaatgttttccgca

SEQ ID NO: 61863 - DNA, 25 bp, E. coli
gattcgcgattttactattagcaac

SEQ ID NO: 61864 - DNA, 25 bp, E. coli
gtcatcacctttacgattccagttt

SEQ ID NO: 61865 - DNA, 25 bp, E. coli
gattcgcgatttaactattagcaac

SEQ ID NO: 61866 - DNA, 25 bp, E. coli
gtcatcaccttttcgattccagttt

SEQ ID NO: 61867 - DNA, 25 bp, E. coli
taacatttcgttaaaagatcctttg

SEQ ID NO: 61868 - DNA, 25 bp, E. coli
taacatttcgtttaaagatcctttg

SEQ ID NO: 61869 - DNA, 25 bp, E. coli
gacggatttcgctccctatttttat

SEQ ID NO: 61870 - DNA, 25 bp, E. coli
gatcctttgctttttatgattcgcg

SEQ ID NO: 61871 - DNA, 25 bp, E. coli
gatcctttgcttattatgattcgcg

SEQ ID NO: 61872 - DNA, 25 bp, E. coli
gacggatttcgcaccctatttttat

SEQ ID NO: 61873 - DNA, 25 bp, E. coli
aagagatcgtcaagctgggcggaac

SEQ ID NO: 61874 - DNA, 25 bp, E. coli
aagagatcgtcatgctgggcggaac

SEQ ID NO: 61875 - DNA, 25 bp, E. coli
catttttgggcatagtctcggaggg

SEQ ID NO: 61876 - DNA, 25 bp, E. coli
catattcaggtgcttctgccgccat

SEQ ID NO: 61877 - DNA, 25 bp, E. coli
catttttgggcaaagtctcggaggg

SEQ ID NO: 61878 - DNA, 25 bp, E. coli
catattcaggtggttctgccgccat

SEQ ID NO: 61879 - DNA, 25 bp, E. coli
tacgatggtggatgccgtcgctgac

SEQ ID NO: 61880 - DNA, 25 bp, E. coli
tactttgcggccattagaacctgcg

SEQ ID NO: 61881 - DNA, 25 bp, E. coli
tacgatggtggaagccgtcgctgac

SEQ ID NO: 61882 - DNA, 25 bp, E. coli
tactttgcggcctttagaacctgcg

SEQ ID NO: 61883 - DNA, 25 bp, E. coli
aaaattcaccactcgaaagacgcgg

SEQ ID NO: 61884 - DNA, 25 bp, E. coli
aaaattcaccacacgaaagacgcgg

SEQ ID NO: 61885 - DNA, 25 bp, E. coli
tataaatggcgtagcgtgctgtcgg

SEQ ID NO: 61886 - DNA, 25 bp, E. coli
tataaatggcgttgcgtgctgtcgg

SEQ ID NO: 61887 - DNA, 25 bp, E. coli
cgatcgggcctcacatgaagtaata

SEQ ID NO: 61888 - DNA, 25 bp, E. coli
cgatcgggcctctcatgaagtaata

SEQ ID NO: 61889 - DNA, 25 bp, E. coli
gtatgtatttcaggccaaggcgcgc

SEQ ID NO: 61890 - DNA, 25 bp, E. coli
ggatcatggccttcgaactggtgca

SEQ ID NO: 61891 - DNA, 25 bp, E. coli
ggatcatggcctacgaactggtgca

SEQ ID NO: 61892 - DNA, 25 bp, E. coli
gtatgtatttcacgccaaggcgcgc

SEQ ID NO: 61893 - DNA, 25 bp, E. coli
ggaactagaatacgccagccgctgt

SEQ ID NO: 61894 - DNA, 25 bp, E. coli
ggaactagaataggccagccgctgt

SEQ ID NO: 61895 - DNA, 25 bp, E. coli
cactatggctgggtgcgaatctgca

SEQ ID NO: 61896 - DNA, 25 bp, E. coli
cactatggctggctgcgaatctgca

SEQ ID NO: 61897 - DNA, 25 bp, E. coli
tacgcactatggctgggtgcgaatc

SEQ ID NO: 61898 - DNA, 25 bp, E. coli
agtgctttacgctctatggctgggt

SEQ ID NO: 61899 - DNA, 25 bp, E. coli
agtgctttacgcactatggctgggt

SEQ ID NO: 61900 - DNA, 25 bp, E. coli
acgcactatggcagggtgcgaatct

SEQ ID NO: 61901 - DNA, 25 bp, E. coli
atggctgggtgcgaatctgcaggcc

SEQ ID NO: 61902 - DNA, 25 bp, E. coli
atggctgggtgccaatctgcaggcc

SEQ ID NO: 61903 - DNA, 25 bp, E. coli
acgcactatggctgggtgcgaatct

SEQ ID NO: 61904 - DNA, 25 bp, E. coli
actatggctgggagcgaatctgcag

SEQ ID NO: 61905 - DNA, 25 bp, E. coli
actatggctgggtgcgaatctgcag

SEQ ID NO: 61906 - DNA, 25 bp, E. coli
tacgcactatgggtgggtgcgaatc

SEQ ID NO: 61907 - DNA, 25 bp, E. coli
tttacgcactatcgctgggtgcgaa

SEQ ID NO: 61908 - DNA, 25 bp, E. coli
tttacgcactatggctgggtgcgaa

SEQ ID NO: 61909 - DNA, 25 bp, E. coli
tgctttacgcactatggctgggtgc

SEQ ID NO: 61910 - DNA, 25 bp, E. coli
tgctttacgcacaatggctgggtgc

SEQ ID NO: 61911 - DNA, 25 bp, E. coli
gctttacgcactttggctgggtgcg

SEQ ID NO: 61912 - DNA, 25 bp, E. coli
gctttacgcactatggctgggtgcg

SEQ ID NO: 61913 - DNA, 25 bp, E. coli
cgcactatggctcggtgcgaatctg

SEQ ID NO: 61914 - DNA, 25 bp, E. coli
cgcactatggctgggtgcgaatctg

SEQ ID NO: 61915 - DNA, 25 bp, E. coli
ctttacgcactatggctgggtgcga

SEQ ID NO: 61916 - DNA, 25 bp, E. coli
ctttacgcactaaggctgggtgcga

SEQ ID NO: 61917 - DNA, 25 bp, E. coli
aagtgatctattcgaaccacccgga

SEQ ID NO: 61918 - DNA, 25 bp, E. coli
aagtgatctattggaaccacccgga

SEQ ID NO: 61919 - DNA, 25 bp, E. coli
caaacaatatcccttgatcgggcag

SEQ ID NO: 61920 - DNA, 25 bp, E. coli
caaacaatatccgttgatcgggcag

SEQ ID NO: 61921 - DNA, 25 bp, E. coli
taaaagtggataacagccagacgcc

SEQ ID NO: 61922 - DNA, 25 bp, E. coli
tactacccgggatgatatggcaacc

SEQ ID NO: 61923 - DNA, 25 bp, E. coli
taaaagtggatatcagccagacgcc

SEQ ID NO: 61924 - DNA, 25 bp, E. coli
tactacccgggaagatatggcaacc

SEQ ID NO: 61925 - DNA, 25 bp, E. coli
agccgcctgcgtacctggattgaaa

SEQ ID NO: 61926 - DNA, 25 bp, E. coli
agccgcctgcgttcctggattgaaa

SEQ ID NO: 61927 - DNA, 25 bp, E. coli
aaattgcctccggtagcgcgatgat

SEQ ID NO: 61928 - DNA, 25 bp, E. coli
aaattgcctccgctagcgcgatgat

SEQ ID NO: 61929 - DNA, 25 bp, E. coli
tatcaataataatccggtggcgctg

SEQ ID NO: 61930 - DNA, 25 bp, E. coli
tatcaataataaaccggtggcgctg

SEQ ID NO: 61931 - DNA, 25 bp, E. coli
tgatgtcttcagtaaaccgcgcggc

SEQ ID NO: 61932 - DNA, 25 bp, E. coli
tgatgtcttcagaaaaccgcgcggc

SEQ ID NO: 61933 - DNA, 25 bp, E. coli
gaaatcgctcggtatgaacaacacg

SEQ ID NO: 61934 - DNA, 25 bp, E. coli
gaaatcgctcggaatgaacaacacg

SEQ ID NO: 61935 - DNA, 25 bp, E. coli
cattatcccggtggttacaaagcct

SEQ ID NO: 61936 - DNA, 25 bp, E. coli
cattatcccggtcgttacaaagcct

SEQ ID NO: 61937 - DNA, 25 bp, E. coli
gattgaaaccggtaaagtgatgcct

SEQ ID NO: 61938 - DNA, 25 bp, E. coli
gattgaaaccggaaaagtgatgcct

SEQ ID NO: 61939 - DNA, 25 bp, E. coli
caggaagaagttaccaacaatgctt

SEQ ID NO: 61940 - DNA, 25 bp, E. coli
caggaagaagtttccaacaatgctt

SEQ ID NO: 61941 - DNA, 25 bp, E. coli
acagctgggcgttaagcaggaagaa

SEQ ID NO: 61942 - DNA, 25 bp, E. coli
aacaatgcttctttcgttgaagacc

SEQ ID NO: 61943 - DNA, 25 bp, E. coli
aacaatgcttctatcgttgaagacc

SEQ ID NO: 61944 - DNA, 25 bp, E. coli
aaaattatcggccaacagctgggcg

SEQ ID NO: 61945 - DNA, 25 bp, E. coli
aaaattatcggcgaacagctgggcg

SEQ ID NO: 61946 - DNA, 25 bp, E. coli
acagctgggcgtaaagcaggaagaa

SEQ ID NO: 61947 - DNA, 25 bp, E. coli
ttgattacatcaacggccaccaggc

SEQ ID NO: 61948 - DNA, 25 bp, E. coli
ttgattacatcatcggccaccaggc

SEQ ID NO: 61949 - DNA, 25 bp, E. coli
tgacaccgttgagctggtaatggct

SEQ ID NO: 61950 - DNA, 25 bp, E. coli
tgacaccgttgacctggtaatggct

SEQ ID NO: 61951 - DNA, 25 bp, E. coli
tccggacgaagaagctgagaaaatc

SEQ ID NO: 61952 - DNA, 25 bp, E. coli
tccggacgaagatgctgagaaaatc

SEQ ID NO: 61953 - DNA, 25 bp, E. coli
ggcgcggattctcttgacaccgttg

SEQ ID NO: 61954 - DNA, 25 bp, E. coli
ggcgcggattctgttgacaccgttg

SEQ ID NO: 61955 - DNA, 25 bp, E. coli
gagtttgatactcagattccggacg

SEQ ID NO: 61956 - DNA, 25 bp, E. coli
gagcactatcgatgaacgcgttaag

SEQ ID NO: 61957 - DNA, 25 bp, E. coli
gagcactatcgaagaacgcgttaag

SEQ ID NO: 61958 - DNA, 25 bp, E. coli
gagtttgatactgagattccggacg

SEQ ID NO: 61959 - DNA, 25 bp, E. coli
gagaaaatcaccaccgttcaggctg

SEQ ID NO: 61960 - DNA, 25 bp, E. coli
gagaaaatcacctccgttcaggctg

SEQ ID NO: 61961 - DNA, 25 bp, E. coli
catccggtgctgataatcggcgtga

SEQ ID NO: 61962 - DNA, 25 bp, E. coli
catccggtgctgttaatcggcgtga

SEQ ID NO: 61963 - DNA, 25 bp, E. coli
tacttcctgcggctgaaaaaagcgc

SEQ ID NO: 61964 - DNA, 25 bp, E. coli
taaaaaagatatcacccgtctgggc

SEQ ID NO: 61965 - DNA, 25 bp, E. coli
taaaaaagatatgacccgtctgggc

SEQ ID NO: 61966 - DNA, 25 bp, E. coli
tacttcctgcgggtgaaaaaagcgc

SEQ ID NO: 61967 - DNA, 25 bp, E. coli
tacctgggcgatcttgccgatcctg

SEQ ID NO: 61968 - DNA, 25 bp, E. coli
tacctgggcgatgttgccgatcctg

SEQ ID NO: 61969 - DNA, 25 bp, E. coli
tatctttttcctccgcgtcggctgg

SEQ ID NO: 61970 - DNA, 25 bp, E. coli
tatctttttcctgcgcgtcggctgg

SEQ ID NO: 61971 - DNA, 25 bp, E. coli
gacaccattaaaggcctcaaagtgg

SEQ ID NO: 61972 - DNA, 25 bp, E. coli
gacaccattaaacgcctcaaagtgg

SEQ ID NO: 61973 - DNA, 25 bp, E. coli
cgatggcctacaccctgctgatgta

SEQ ID NO: 61974 - DNA, 25 bp, E. coli
cgatggcctacagcctgctgatgta

SEQ ID NO: 61975 - DNA, 25 bp, E. coli
ctgtttggcccattcgccgggattg

SEQ ID NO: 61976 - DNA, 25 bp, E. coli
ctgtttggcccaatcgccgggattg

SEQ ID NO: 61977 - DNA, 25 bp, E. coli
gatttcttcgattaagtcttcccga

SEQ ID NO: 61978 - DNA, 25 bp, E. coli
gatttcttcgataaagtcttcccga

SEQ ID NO: 61979 - DNA, 25 bp, E. coli
ggacccacgtcgcttattcagtcgg

SEQ ID NO: 61980 - DNA, 25 bp, E. coli
ggacccacgtcggttattcagtcgg

SEQ ID NO: 61981 - DNA, 25 bp, E. coli
taatcggcgggctgatcgcttcgta

SEQ ID NO: 61982 - DNA, 25 bp, E. coli
taatcggcgggcagatcgcttcgta

SEQ ID NO: 61983 - DNA, 25 bp, E. coli
taccgctgcgtactgcgctgttcgg

SEQ ID NO: 61984 - DNA, 25 bp, E. coli
taccgctgcgtagtgcgctgttcgg

SEQ ID NO: 61985 - DNA, 25 bp, E. coli
tattagcgcggttctgcttggtccg

SEQ ID NO: 61986 - DNA, 25 bp, E. coli
tattagcgcggtactgcttggtccg

SEQ ID NO: 61987 - DNA, 25 bp, E. coli
ttacgcttgcggtaacggtcgtcgc

SEQ ID NO: 61988 - DNA, 25 bp, E. coli
ttacgcttgcggaaacggtcgtcgc

SEQ ID NO: 61989 - DNA, 25 bp, E. coli
tggtttcgcaccgtgccaaaagtcg

SEQ ID NO: 61990 - DNA, 25 bp, E. coli
tcttacagcggtgattgtctggctt

SEQ ID NO: 61991 - DNA, 25 bp, E. coli
tcttacagcggtcattgtctggctt

SEQ ID NO: 61992 - DNA, 25 bp, E. coli
tcatcggcctggacgccggttggct

SEQ ID NO: 61993 - DNA, 25 bp, E. coli
tcatcggcctggtcgccggttggct

SEQ ID NO: 61994 - DNA, 25 bp, E. coli
gccatcaatatgatcggcgggcaac

SEQ ID NO: 61995 - DNA, 25 bp, E. coli
gccatcaatatgttcggcgggcaac

SEQ ID NO: 61996 - DNA, 25 bp, E. coli
gactccatcggctcacttattagcg

SEQ ID NO: 61997 - DNA, 25 bp, E. coli
gactccatcggcacacttattagcg

SEQ ID NO: 61998 - DNA, 25 bp, E. coli
cgattacggtgataggcgcgaacct

SEQ ID NO: 61999 - DNA, 25 bp, E. coli
cgattacggtgaaaggcgcgaacct

SEQ ID NO: 62000 - DNA, 25 bp, E. coli
ccgatttgttcgttgcctggatgca

SEQ ID NO: 62001 - DNA, 25 bp, E. coli
ccgatttgttcgatgcctggatgca

SEQ ID NO: 62002 - DNA, 25 bp, E. coli
gggcaactggccagcatggtcaaat

SEQ ID NO: 62003 - DNA, 25 bp, E. coli
gggcaactggcctgcatggtcaaat

SEQ ID NO: 62004 - DNA, 25 bp, E. coli
tggtttcgcaccctgccaaaagtcg

SEQ ID NO: 62005 - DNA, 25 bp, E. coli
caacaacagtggctcgacgctatca

SEQ ID NO: 62006 - DNA, 25 bp, E. coli
caacaacagtgggtcgacgctatca

SEQ ID NO: 62007 - DNA, 25 bp, E. coli
aacaactcggctcgacgctgatgga

SEQ ID NO: 62008 - DNA, 25 bp, E. coli
aacaactcggctggacgctgatgga

SEQ ID NO: 62009 - DNA, 25 bp, E. coli
tgcataacgaattggctcgccgtgg

SEQ ID NO: 62010 - DNA, 25 bp, E. coli
tgcataacgaataggctcgccgtgg

SEQ ID NO: 62011 - DNA, 25 bp, E. coli
tcggcagtatgctacccaaagtgga

SEQ ID NO: 62012 - DNA, 25 bp, E. coli
tcggcagtatgcaacccaaagtgga

SEQ ID NO: 62013 - DNA, 25 bp, E. coli
taattgccctggagacacaaacgcg

SEQ ID NO: 62014 - DNA, 25 bp, E. coli
taattgccctggtgacacaaacgcg

SEQ ID NO: 62015 - DNA, 25 bp, E. coli
gcgagacgggcatcaactgaaaggt

SEQ ID NO: 62016 - DNA, 25 bp, E. coli
gcgagacgggcaacaactgaaaggt

SEQ ID NO: 62017 - DNA, 25 bp, E. coli
gaaattattgaggacgacaccatcg

SEQ ID NO: 62018 - DNA, 25 bp, E. coli
gaaattattgagcacgacaccatcg

SEQ ID NO: 62019 - DNA, 25 bp, E. coli
gatatctggttattgcctgcggcgg

SEQ ID NO: 62020 - DNA, 25 bp, E. coli
gtttctcgatgatgcaacggcccaa

SEQ ID NO: 62021 - DNA, 25 bp, E. coli
gtttctcgatgaagcaacggcccaa

SEQ ID NO: 62022 - DNA, 25 bp, E. coli
gatcgataaagaactggcctccgcg

SEQ ID NO: 62023 - DNA, 25 bp, E. coli
gatatctggttaatgcctgcggcgg

SEQ ID NO: 62024 - DNA, 25 bp, E. coli
gacgagcaacgctatagtattcccg

SEQ ID NO: 62025 - DNA, 25 bp, E. coli
gatcgataaagatctggcctccgcg

SEQ ID NO: 62026 - DNA, 25 bp, E. coli
gacgagcaacgcaatagtattcccg

SEQ ID NO: 62027 - DNA, 25 bp, E. coli
cagcttccggcagtgtttaacggta

SEQ ID NO: 62028 - DNA, 25 bp, E. coli
caaagtgacccaccttgatgaagag

SEQ ID NO: 62029 - DNA, 25 bp, E. coli
cagcttccggcactgtttaacggta

SEQ ID NO: 62030 - DNA, 25 bp, E. coli
caaagtgacccagcttgatgaagag

SEQ ID NO: 62031 - DNA, 25 bp, E. coli
cattatcaccggagcactggcggga

SEQ ID NO: 62032 - DNA, 25 bp, E. coli
tactgctggatactgaagaggcgct

SEQ ID NO: 62033 - DNA, 25 bp, E. coli
tactgctggatagtgaagaggcgct

SEQ ID NO: 62034 - DNA, 25 bp, E. coli
tgtttctcggtgtcggcgacagcgt

SEQ ID NO: 62035 - DNA, 25 bp, E. coli
tgtttctcggtgacggcgacagcgt

SEQ ID NO: 62036 - DNA, 25 bp, E. coli
tgatgaacgtcaatgccgaccaggc

SEQ ID NO: 62037 - DNA, 25 bp, E. coli
tgatgaaagggctgaatctgccggt

SEQ ID NO: 62038 - DNA, 25 bp, E. coli
tgatgaaagggcagaatctgccggt

SEQ ID NO: 62039 - DNA, 25 bp, E. coli
tgatgaacgtcattgccgaccaggc

SEQ ID NO: 62040 - DNA, 25 bp, E. coli
gcgcagccaggttcgcctaagctta

SEQ ID NO: 62041 - DNA, 25 bp, E. coli
gcgcagccaggtacgcctaagctta

SEQ ID NO: 62042 - DNA, 25 bp, E. coli
gaacgtctgttttgcgcactggtga

SEQ ID NO: 62043 - DNA, 25 bp, E. coli
gaacgtctgtttagcgcactggtga

SEQ ID NO: 62044 - DNA, 25 bp, E. coli
ccggtggtcagctccattggcgtaa

SEQ ID NO: 62045 - DNA, 25 bp, E. coli
ccggtggtcagcaccattggcgtaa

SEQ ID NO: 62046 - DNA, 25 bp, E. coli
cattatcaccggtgcactggcggga

SEQ ID NO: 62047 - DNA, 25 bp, E. coli
gagcagggcatttttactgacggca

SEQ ID NO: 62048 - DNA, 25 bp, E. coli
gagcagggcattattactgacggca

SEQ ID NO: 62049 - DNA, 25 bp, E. coli
cacagactattttgcgtcaggagta

SEQ ID NO: 62050 - DNA, 25 bp, E. coli
cacagactatttagcgtcaggagta

SEQ ID NO: 62051 - DNA, 25 bp, E. coli
catcagaagagaagcatttttgaac

SEQ ID NO: 62052 - DNA, 25 bp, E. coli
catcagaagagatgcatttttgaac

SEQ ID NO: 62053 - DNA, 25 bp, E. coli
taaaggacgtatatttggctgtgac

SEQ ID NO: 62054 - DNA, 25 bp, E. coli
taaaggacgtatttttggctgtgac

SEQ ID NO: 62055 - DNA, 25 bp, E. coli
ttggctgtgacgagggcaaaaccct

SEQ ID NO: 62056 - DNA, 25 bp, E. coli
ttggctgtgacgtgggcaaaaccct

SEQ ID NO: 62057 - DNA, 25 bp, E. coli
tgtcaaaaagtgtcagtaaagaaat

SEQ ID NO: 62058 - DNA, 25 bp, E. coli
tgtcaaaaagtgacagtaaagaaat

SEQ ID NO: 62059 - DNA, 25 bp, E. coli
tgacgagggcaaaaccctgttccgg

SEQ ID NO: 62060 - DNA, 25 bp, E. coli
tgacgagggcaataccctgttccgg

SEQ ID NO: 62061 - DNA, 25 bp, E. coli
tcgaagaaatgtgataaaggacgta

SEQ ID NO: 62062 - DNA, 25 bp, E. coli
tcgaagaaatgtcataaaggacgta

SEQ ID NO: 62063 - DNA, 25 bp, E. coli
cctgttccggtttccggtcatgctc

SEQ ID NO: 62064 - DNA, 25 bp, E. coli
cctgttccggttaccggtcatgctc

SEQ ID NO: 62065 - DNA, 25 bp, E. coli
gaagcatttttgtacagtaacccgg

SEQ ID NO: 62066 - DNA, 25 bp, E. coli
gaagcatttttgaacagtaacccgg

SEQ ID NO: 62067 - DNA, 25 bp, E. coli
gaaatttacatctgaagagaagcat

SEQ ID NO: 62068 - DNA, 25 bp, E. coli
gaaatttacatcagaagagaagcat

SEQ ID NO: 62069 - DNA, 25 bp, E. coli
ggtaaaatatcaggaaaaatcgaag

SEQ ID NO: 62070 - DNA, 25 bp, E. coli
ggtaaaatatcacgaaaaatcgaag

SEQ ID NO: 62071 - DNA, 25 bp, E. coli
cagcgcgtctgtatggtgaaaaagc

SEQ ID NO: 62072 - DNA, 25 bp, E. coli
cagcgcgtctgtttggtgaaaaagc

SEQ ID NO: 62073 - DNA, 25 bp, E. coli
attgatagtgtacggcccaaagcgg

SEQ ID NO: 62074 - DNA, 25 bp, E. coli
attgatagtgtagggcccaaagcgg

SEQ ID NO: 62075 - DNA, 25 bp, E. coli
ttcgtgacgccgcataacgtagcgc

SEQ ID NO: 62076 - DNA, 25 bp, E. coli
ttcgtgacgccggataacgtagcgc

SEQ ID NO: 62077 - DNA, 25 bp, E. coli
tgtgcgtcaccattaccaatcggca

SEQ ID NO: 62078 - DNA, 25 bp, E. coli
tgtgcgtcaccaataccaatcggca

SEQ ID NO: 62079 - DNA, 25 bp, E. coli
tgaaaaacagtaaaggtaagctcgg

SEQ ID NO: 62080 - DNA, 25 bp, E. coli
tgaaaaacagtataggtaagctcgg

SEQ ID NO: 62081 - DNA, 25 bp, E. coli
tctggcgaaaacgattcaggacccg

SEQ ID NO: 62082 - DNA, 25 bp, E. coli
tcagcgttttggtggcacagcgcgt

SEQ ID NO: 62083 - DNA, 25 bp, E. coli
tcagcgttttggaggcacagcgcgt

SEQ ID NO: 62084 - DNA, 25 bp, E. coli
tctggcgaaaaccattcaggacccg

SEQ ID NO: 62085 - DNA, 25 bp, E. coli
cgctgattgcttattgtcggcgcaa

SEQ ID NO: 62086 - DNA, 25 bp, E. coli
cgctgattgctttttgtcggcgcaa

SEQ ID NO: 62087 - DNA, 25 bp, E. coli
cgatatggatgaagtgtgcgtcacc

SEQ ID NO: 62088 - DNA, 25 bp, E. coli
cgatatggatgatgtgtgcgtcacc

SEQ ID NO: 62089 - DNA, 25 bp, E. coli
ggattggcgcaaacacgcttatcga

SEQ ID NO: 62090 - DNA, 25 bp, E. coli
ggattggcgcaatcacgcttatcga

SEQ ID NO: 62091 - DNA, 25 bp, E. coli
taattagtgatggatggcgtcagcg

SEQ ID NO: 62092 - DNA, 25 bp, E. coli
taattagtgatgcatggcgtcagcg

SEQ ID NO: 62093 - DNA, 25 bp, E. coli
taaaaggaatgtatgtccagccgaa

SEQ ID NO: 62094 - DNA, 25 bp, E. coli
taaaaggaatgtttgtccagccgaa

SEQ ID NO: 62095 - DNA, 25 bp, E. coli
tgtccagccgaacaagacatttatc

SEQ ID NO: 62096 - DNA, 25 bp, E. coli
tgggaagctttattccaggctggcg

SEQ ID NO: 62097 - DNA, 25 bp, E. coli
tgtccagccgaagaagacatttatc

SEQ ID NO: 62098 - DNA, 25 bp, E. coli
tgggaagctttaatccaggctggcg

SEQ ID NO: 62099 - DNA, 25 bp, E. coli
tccaggctggcgaaataataaccct

SEQ ID NO: 62100 - DNA, 25 bp, E. coli
tccaggctggcgtaataataaccct

SEQ ID NO: 62101 - DNA, 25 bp, E. coli
tcacacttttatccccttttgtggg

SEQ ID NO: 62102 - DNA, 25 bp, E. coli
taataaccctactataactggaata

SEQ ID NO: 62103 - DNA, 25 bp, E. coli
tcacacttttatgcccttttgtggg

SEQ ID NO: 62104 - DNA, 25 bp, E. coli
taataaccctacaataactggaata

SEQ ID NO: 62105 - DNA, 25 bp, E. coli
gctaggataagcgaaacgtggaata

SEQ ID NO: 62106 - DNA, 25 bp, E. coli
gctaggataagccaaacgtggaata

SEQ ID NO: 62107 - DNA, 25 bp, E. coli
gaagacatttatctgactcacatca

SEQ ID NO: 62108 - DNA, 25 bp, E. coli
gaagacatttatgtgactcacatca

SEQ ID NO: 62109 - DNA, 25 bp, E. coli
cgcaaactgcgagtgattggttaat

SEQ ID NO: 62110 - DNA, 25 bp, E. coli
cgaacatttaatggactgaaacgct

SEQ ID NO: 62111 - DNA, 25 bp, E. coli
cgaacatttaatcgactgaaacgct

SEQ ID NO: 62112 - DNA, 25 bp, E. coli
cgcaaactgcgactgattggttaat

SEQ ID NO: 62113 - DNA, 25 bp, E. coli
ctgaaacgcttcagctaggataagc

SEQ ID NO: 62114 - DNA, 25 bp, E. coli
ctgaaacgcttctgctaggataagc

SEQ ID NO: 62115 - DNA, 25 bp, E. coli
caagctgtcatacaagaaaccgtca

SEQ ID NO: 62116 - DNA, 25 bp, E. coli
caagctgtcatagaagaaaccgtca

SEQ ID NO: 62117 - DNA, 25 bp, E. coli
caaattgccgctggaggcgttacag

SEQ ID NO: 62118 - DNA, 25 bp, E. coli
caaattgccgctcgaggcgttacag

SEQ ID NO: 62119 - DNA, 25 bp, E. coli
tatcgatggtcaggaagccgtgcag

SEQ ID NO: 62120 - DNA, 25 bp, E. coli
tagtgcctgtgtaacgcaatgcgca

SEQ ID NO: 62121 - DNA, 25 bp, E. coli
tagtgcctgtgttacgcaatgcgca

SEQ ID NO: 62122 - DNA, 25 bp, E. coli
tacgcgcccgctcgaaagatcgttt

SEQ ID NO: 62123 - DNA, 25 bp, E. coli
tacgcgcccgctggaaagatcgttt

SEQ ID NO: 62124 - DNA, 25 bp, E. coli
tatcgatggtcacgaagccgtgcag

SEQ ID NO: 62125 - DNA, 25 bp, E. coli
tgagctactggaatcaccggaacaa

SEQ ID NO: 62126 - DNA, 25 bp, E. coli
tgagctactggattcaccggaacaa

SEQ ID NO: 62127 - DNA, 25 bp, E. coli
tcctgaaagaggatgtacagcgcgt

SEQ ID NO: 62128 - DNA, 25 bp, E. coli
tcctgaaagaggttgtacagcgcgt

SEQ ID NO: 62129 - DNA, 25 bp, E. coli
cggtcgcagaaaacggccaggttgt

SEQ ID NO: 62130 - DNA, 25 bp, E. coli
cattggtggcaatacgtgagctact

SEQ ID NO: 62131 - DNA, 25 bp, E. coli
cattggtggcaaaacgtgagctact

SEQ ID NO: 62132 - DNA, 25 bp, E. coli
cggtcgcagaaatcggccaggttgt

SEQ ID NO: 62133 - DNA, 25 bp, E. coli
gattgccgagctggaaaccgataaa

SEQ ID NO: 62134 - DNA, 25 bp, E. coli
gatatcggcattccagtgagcagca

SEQ ID NO: 62135 - DNA, 25 bp, E. coli
gatatcggcattgcagtgagcagca

SEQ ID NO: 62136 - DNA, 25 bp, E. coli
gattgccgagctcgaaaccgataaa

SEQ ID NO: 62137 - DNA, 25 bp, E. coli
aatgcgctgaaatgacattctctgt

SEQ ID NO: 62138 - DNA, 25 bp, E. coli
aatgcgctgaaaagacattctctgt

SEQ ID NO: 62139 - DNA, 25 bp, E. coli
cattattcccatttctgcctgcgaa

SEQ ID NO: 62140 - DNA, 25 bp, E. coli
cattattcccatatctgcctgcgaa

SEQ ID NO: 62141 - DNA, 25 bp, E. coli
aaagacattctctgtttggtttaca

SEQ ID NO: 62142 - DNA, 25 bp, E. coli
aaaattattcgctcactaaatataa

SEQ ID NO: 62143 - DNA, 25 bp, E. coli
aaaattattcgcacactaaatataa

SEQ ID NO: 62144 - DNA, 25 bp, E. coli
aaagacattctcagtttggtttaca

SEQ ID NO: 62145 - DNA, 25 bp, E. coli
tatcgccattattcccatttctgcc

SEQ ID NO: 62146 - DNA, 25 bp, E. coli
tatcgccattatacccatttctgcc

SEQ ID NO: 62147 - DNA, 25 bp, E. coli
tgctgccgtatatatcgccattatt

SEQ ID NO: 62148 - DNA, 25 bp, E. coli
tgaatgcgtataattctcatttgca

SEQ ID NO: 62149 - DNA, 25 bp, E. coli
tgaatgcgtatatttctcatttgca

SEQ ID NO: 62150 - DNA, 25 bp, E. coli
tgctgccgtataaatcgccattatt

SEQ ID NO: 62151 - DNA, 25 bp, E. coli
tctgcctgcgaatgcgctgaaaaga

SEQ ID NO: 62152 - DNA, 25 bp, E. coli
tctgcctgcgaaagcgctgaaaaga

SEQ ID NO: 62153 - DNA, 25 bp, E. coli
cctgcgaatgcgctgaaaagacatt

SEQ ID NO: 62154 - DNA, 25 bp, E. coli
ccatttctgcctgcgaatgcgctga

SEQ ID NO: 62155 - DNA, 25 bp, E. coli
ccatttctgcctccgaatgcgctga

SEQ ID NO: 62156 - DNA, 25 bp, E. coli
cctgcgaatgcggtgaaaagacatt

SEQ ID NO: 62157 - DNA, 25 bp, E. coli
cgtatatttctcttttgcatttaca

SEQ ID NO: 62158 - DNA, 25 bp, E. coli
cgtatatttctcatttgcatttaca

SEQ ID NO: 62159 - DNA, 25 bp, E. coli
tacaaagtgacgatagacacggcga

SEQ ID NO: 62160 - DNA, 25 bp, E. coli
tacaaagtgacgttagacacggcga

SEQ ID NO: 62161 - DNA, 25 bp, E. coli
acagacgtgacgttgggcttcccga

SEQ ID NO: 62162 - DNA, 25 bp, E. coli
acagacgtgacgatgggcttcccga

SEQ ID NO: 62163 - DNA, 25 bp, E. coli
tatgctgaactgacggtaaccaacc

SEQ ID NO: 62164 - DNA, 25 bp, E. coli
tatggttatgccaatccgcgcgtac

SEQ ID NO: 62165 - DNA, 25 bp, E. coli
tatgctgaactgtcggtaaccaacc

SEQ ID NO: 62166 - DNA, 25 bp, E. coli
tatggttatgcctatccgcgcgtac

SEQ ID NO: 62167 - DNA, 25 bp, E. coli
ttacgaatgtgcgactcaggacggc

SEQ ID NO: 62168 - DNA, 25 bp, E. coli
ttacgaatgtgccactcaggacggc

SEQ ID NO: 62169 - DNA, 25 bp, E. coli
tgcgcacaggcgacacggttaatga

SEQ ID NO: 62170 - DNA, 25 bp, E. coli
tgcgcacaggcgtcacggttaatga

SEQ ID NO: 62171 - DNA, 25 bp, E. coli
gaaaaagttgctgatagcgtcgctg

SEQ ID NO: 62172 - DNA, 25 bp, E. coli
gaaaaagttgctcatagcgtcgctg

SEQ ID NO: 62173 - DNA, 25 bp, E. coli
gatacctcgaaagatgccgtcctgc

SEQ ID NO: 62174 - DNA, 25 bp, E. coli
gatacctcgaaacatgccgtcctgc

SEQ ID NO: 62175 - DNA, 25 bp, E. coli
tcaccgaaggcgatcagtacaagct

SEQ ID NO: 62176 - DNA, 25 bp, E. coli
tcaccgaaggcgttcagtacaagct

SEQ ID NO: 62177 - DNA, 25 bp, E. coli
taatgacttccacgcagatgacgcc

SEQ ID NO: 62178 - DNA, 25 bp, E. coli
taatgacttccaggcagatgacgcc

SEQ ID NO: 62179 - DNA, 25 bp, E. coli
gaccgtggttacttcccgacagatg

SEQ ID NO: 62180 - DNA, 25 bp, E. coli
gaccgtggttacatcccgacagatg

SEQ ID NO: 62181 - DNA, 25 bp, E. coli
cagggataacgcgtactttgtcggc

SEQ ID NO: 62182 - DNA, 25 bp, E. coli
cagggataacgcctactttgtcggc

SEQ ID NO: 62183 - DNA, 25 bp, E. coli
agcatggctttcacagttctactta

SEQ ID NO: 62184 - DNA, 25 bp, E. coli
agcatggctttctcagttctactta

SEQ ID NO: 62185 - DNA, 25 bp, E. coli
tagcaaaatgcaacaactcttagga

SEQ ID NO: 62186 - DNA, 25 bp, E. coli
tagcaaaatgcatcaactcttagga

SEQ ID NO: 62187 - DNA, 25 bp, E. coli
tgatgacaaacgaaacataacctga

SEQ ID NO: 62188 - DNA, 25 bp, E. coli
tgatgacaaacgtaacataacctga

SEQ ID NO: 62189 - DNA, 25 bp, E. coli
tcctccagagttaatgtatatgatg

SEQ ID NO: 62190 - DNA, 25 bp, E. coli
tcctccagagtttatgtatatgatg

SEQ ID NO: 62191 - DNA, 25 bp, E. coli
tcttaggaaacgagagcatggcttt

SEQ ID NO: 62192 - DNA, 25 bp, E. coli
tcttaggaaacgtgagcatggcttt

SEQ ID NO: 62193 - DNA, 25 bp, E. coli
gccacatccggctgggataacgcgt

SEQ ID NO: 62194 - DNA, 25 bp, E. coli
gccacatccggcagggataacgcgt

SEQ ID NO: 62195 - DNA, 25 bp, E. coli
gaaacataacctcatgcgatctgtg

SEQ ID NO: 62196 - DNA, 25 bp, E. coli
gaaacataacctgatgcgatctgtg

SEQ ID NO: 62197 - DNA, 25 bp, E. coli
cgcgtactttgtcggcaatatgaag

SEQ ID NO: 62198 - DNA, 25 bp, E. coli
cgcgtactttgtgggcaatatgaag

SEQ ID NO: 62199 - DNA, 25 bp, E. coli
tggtgatttgagcttgatgacaaac

SEQ ID NO: 62200 - DNA, 25 bp, E. coli
tggtgatttgaggttgatgacaaac

SEQ ID NO: 62201 - DNA, 25 bp, E. coli
gatgcgatctgtgtatgccggatag

SEQ ID NO: 62202 - DNA, 25 bp, E. coli
gatgcgatctgtctatgccggatag

SEQ ID NO: 62203 - DNA, 25 bp, E. coli
aagaggccaatttactgcaaaccga

SEQ ID NO: 62204 - DNA, 25 bp, E. coli
aaccgactgggctgagactctgccc

SEQ ID NO: 62205 - DNA, 25 bp, E. coli
aatttactgcaatccgactgggcag

SEQ ID NO: 62206 - DNA, 25 bp, E. coli
aatttactgcaaaccgactgggcag

SEQ ID NO: 62207 - DNA, 25 bp, E. coli
caatttactgcataccgactgggca

SEQ ID NO: 62208 - DNA, 25 bp, E. coli
aagaggccaattaactgcaaaccga

SEQ ID NO: 62209 - DNA, 25 bp, E. coli
caatttactgcaaaccgactgggca

SEQ ID NO: 62210 - DNA, 25 bp, E. coli
aaccgactgggcagagactctgccc

SEQ ID NO: 62211 - DNA, 25 bp, E. coli
tactgcaaaccgtctgggcagagac

SEQ ID NO: 62212 - DNA, 25 bp, E. coli
tactgcaaaccgactgggcagagac

SEQ ID NO: 62213 - DNA, 25 bp, E. coli
aaagaggccaatatactgcaaaccg

SEQ ID NO: 62214 - DNA, 25 bp, E. coli
aaagaggccaatttactgcaaaccg

SEQ ID NO: 62215 - DNA, 25 bp, E. coli
tgcaaaccgactgggcagagactct

SEQ ID NO: 62216 - DNA, 25 bp, E. coli
tgcaaaccgactcggcagagactct

SEQ ID NO: 62217 - DNA, 25 bp, E. coli
gccaatttactggaaaccgactggg

SEQ ID NO: 62218 - DNA, 25 bp, E. coli
gccaatttactgcaaaccgactggg

SEQ ID NO: 62219 - DNA, 25 bp, E. coli
ccgactgggcagagactctgcccaa

SEQ ID NO: 62220 - DNA, 25 bp, E. coli
ccgactgggcagtgactctgcccaa

SEQ ID NO: 62221 - DNA, 25 bp, E. coli
ggccaatttactgcaaaccgactgg

SEQ ID NO: 62222 - DNA, 25 bp, E. coli
ggccaatttactccaaaccgactgg

SEQ ID NO: 62223 - DNA, 25 bp, E. coli
gaggccaatttagtgcaaaccgact

SEQ ID NO: 62224 - DNA, 25 bp, E. coli
gaggccaatttactgcaaaccgact

SEQ ID NO: 62225 - DNA, 25 bp, E. coli
caatggtcgcaatatctggtaaact

SEQ ID NO: 62226 - DNA, 25 bp, E. coli
caatggtcgcaaaatctggtaaact

SEQ ID NO: 62227 - DNA, 25 bp, E. coli
caactatttcagactaaagcgcatc

SEQ ID NO: 62228 - DNA, 25 bp, E. coli
caactatttcagtctaaagcgcatc

SEQ ID NO: 62229 - DNA, 25 bp, E. coli
tttttccccattaccggcatcgact

SEQ ID NO: 62230 - DNA, 25 bp, E. coli
tttttccccatttccggcatcgact

SEQ ID NO: 62231 - DNA, 25 bp, E. coli
tttatagctaaaatctgaatcagcg

SEQ ID NO: 62232 - DNA, 25 bp, E. coli
tttatagctaaattctgaatcagcg

SEQ ID NO: 62233 - DNA, 25 bp, E. coli
tgctgccacctgtcagacaggtaaa

SEQ ID NO: 62234 - DNA, 25 bp, E. coli
tgaatcagcgtaaaaactggaaagt

SEQ ID NO: 62235 - DNA, 25 bp, E. coli
tgaatcagcgtataaactggaaagt

SEQ ID NO: 62236 - DNA, 25 bp, E. coli
tgctgccacctgacagacaggtaaa

SEQ ID NO: 62237 - DNA, 25 bp, E. coli
tcgccaataagggactaagtcaact

SEQ ID NO: 62238 - DNA, 25 bp, E. coli
tcgccaataaggcactaagtcaact

SEQ ID NO: 62239 - DNA, 25 bp, E. coli
gacaggtaaaactaaaaccacatcg

SEQ ID NO: 62240 - DNA, 25 bp, E. coli
gacaggtaaaacaaaaaccacatcg

SEQ ID NO: 62241 - DNA, 25 bp, E. coli
ctgctccggcagaaaacaattttcg

SEQ ID NO: 62242 - DNA, 25 bp, E. coli
ctgctccggcagtaaacaattttcg

SEQ ID NO: 62243 - DNA, 25 bp, E. coli
ggaaagttgctttttgctgccacct

SEQ ID NO: 62244 - DNA, 25 bp, E. coli
ggaaagttgcttattgctgccacct

SEQ ID NO: 62245 - DNA, 25 bp, E. coli
ggcatcgactcagcacaatggtcgc

SEQ ID NO: 62246 - DNA, 25 bp, E. coli
ggcatcgactcaccacaatggtcgc

SEQ ID NO: 62247 - DNA, 25 bp, E. coli
cattggcgattaggaaactatcttg

SEQ ID NO: 62248 - DNA, 25 bp, E. coli
taaacgttaagcttagtcggcgaca

SEQ ID NO: 62249 - DNA, 25 bp, E. coli
taaacgttaagcatagtcggcgaca

SEQ ID NO: 62250 - DNA, 25 bp, E. coli
aaataagagtgcgttgcgagagtgc

SEQ ID NO: 62251 - DNA, 25 bp, E. coli
aaataagagtgccttgcgagagtgc

SEQ ID NO: 62252 - DNA, 25 bp, E. coli
tataacataatgctacaagcagggt

SEQ ID NO: 62253 - DNA, 25 bp, E. coli
tataacataatggtacaagcagggt

SEQ ID NO: 62254 - DNA, 25 bp, E. coli
tgtacgatgcaataaccaataagga

SEQ ID NO: 62255 - DNA, 25 bp, E. coli
tgttttatgaatactcctgaagagg

SEQ ID NO: 62256 - DNA, 25 bp, E. coli
tgtacgatgcaaaaaccaataagga

SEQ ID NO: 62257 - DNA, 25 bp, E. coli
tgttttatgaattctcctgaagagg

SEQ ID NO: 62258 - DNA, 25 bp, E. coli
tcggcgacagcacgaggattattct

SEQ ID NO: 62259 - DNA, 25 bp, E. coli
tcggcgacagcaggaggattattct

SEQ ID NO: 62260 - DNA, 25 bp, E. coli
cgaatgcagctaagagcccggctaa

SEQ ID NO: 62261 - DNA, 25 bp, E. coli
cgaatgcagctatgagcccggctaa

SEQ ID NO: 62262 - DNA, 25 bp, E. coli
cattggcgattacgaaactatcttg

SEQ ID NO: 62263 - DNA, 25 bp, E. coli
gattattcttaatacgcgaatgcag

SEQ ID NO: 62264 - DNA, 25 bp, E. coli
gattattcttaaaacgcgaatgcag

SEQ ID NO: 62265 - DNA, 25 bp, E. coli
ggaaacctgtgattttcagctctac

SEQ ID NO: 62266 - DNA, 25 bp, E. coli
ggaaacctgtgaatttcagctctac

SEQ ID NO: 62267 - DNA, 25 bp, E. coli
taataaattcatgttcgccgggatg

SEQ ID NO: 62268 - DNA, 25 bp, E. coli
taataaattcatcttcgccgggatg

SEQ ID NO: 62269 - DNA, 25 bp, E. coli
caatttttgcgttacctggatgtcc

SEQ ID NO: 62270 - DNA, 25 bp, E. coli
caatttttgcgtaacctggatgtcc

SEQ ID NO: 62271 - DNA, 25 bp, E. coli
cagtatgttgcttttgccagccagc

SEQ ID NO: 62272 - DNA, 25 bp, E. coli
cagtatgttgctattgccagccagc

SEQ ID NO: 62273 - DNA, 25 bp, E. coli
aaaccggccgaagacgctgaaaatg

SEQ ID NO: 62274 - DNA, 25 bp, E. coli
aaaccggccgaacacgctgaaaatg

SEQ ID NO: 62275 - DNA, 25 bp, E. coli
tatgcaactggcctcgtgggatacc

SEQ ID NO: 62276 - DNA, 25 bp, E. coli
tatgcaactggcgtcgtgggatacc

SEQ ID NO: 62277 - DNA, 25 bp, E. coli
tggtgtcgcattaacccgccgttgc

SEQ ID NO: 62278 - DNA, 25 bp, E. coli
tggtgtcgcatttacccgccgttgc

SEQ ID NO: 62279 - DNA, 25 bp, E. coli
tcgctatttgcgtacgccggaagaa

SEQ ID NO: 62280 - DNA, 25 bp, E. coli
tcgctatttgcgaacgccggaagaa

SEQ ID NO: 62281 - DNA, 25 bp, E. coli
tctgaatgatgagctgaaaggcgca

SEQ ID NO: 62282 - DNA, 25 bp, E. coli
tctgaatgatgacctgaaaggcgca

SEQ ID NO: 62283 - DNA, 25 bp, E. coli
ccatcggtcatgcacgaagcctata

SEQ ID NO: 62284 - DNA, 25 bp, E. coli
ccatcggtcatggacgaagcctata

SEQ ID NO: 62285 - DNA, 25 bp, E. coli
gaaatgttcctggttgggcgtccaa

SEQ ID NO: 62286 - DNA, 25 bp, E. coli
gaaatgttcctgcttgggcgtccaa

SEQ ID NO: 62287 - DNA, 25 bp, E. coli
ggtaaaacgcgaaagcccacgtcgt

SEQ ID NO: 62288 - DNA, 25 bp, E. coli
gtgatgacacaaccaatgcctggga

SEQ ID NO: 62289 - DNA, 25 bp, E. coli
gtgatgacacaagcaatgcctggga

SEQ ID NO: 62290 - DNA, 25 bp, E. coli
ggtaaaacgcgatagcccacgtcgt

SEQ ID NO: 62291 - DNA, 25 bp, E. coli
aatggtgtccggtagcagtgatgct

SEQ ID NO: 62292 - DNA, 25 bp, E. coli
aatggtgtccggaagcagtgatgct

SEQ ID NO: 62293 - DNA, 25 bp, E. coli
tttccggaggtgtgcgttatggacc

SEQ ID NO: 62294 - DNA, 25 bp, E. coli
tttccggaggtgagcgttatggacc

SEQ ID NO: 62295 - DNA, 25 bp, E. coli
aaatgtcggccactgagcttggtga

SEQ ID NO: 62296 - DNA, 25 bp, E. coli
aaatgtcggccagtgagcttggtga

SEQ ID NO: 62297 - DNA, 25 bp, E. coli
taccggagcgaagggacgaagaact

SEQ ID NO: 62298 - DNA, 25 bp, E. coli
taccggagcgaacggacgaagaact

SEQ ID NO: 62299 - DNA, 25 bp, E. coli
tatttccggatggagagcttcagtg

SEQ ID NO: 62300 - DNA, 25 bp, E. coli
tatttccggatgcagagcttcagtg

SEQ ID NO: 62301 - DNA, 25 bp, E. coli
tgatgctgcggtggctgatttcagc

SEQ ID NO: 62302 - DNA, 25 bp, E. coli
tgatgctgcggtcgctgatttcagc

SEQ ID NO: 62303 - DNA, 25 bp, E. coli
tcgctgaaggcattgatcgtgagaa

SEQ ID NO: 62304 - DNA, 25 bp, E. coli
tcgctgaaggcaatgatcgtgagaa

SEQ ID NO: 62305 - DNA, 25 bp, E. coli
cggatgctgtcggaaatgtcggcca

SEQ ID NO: 62306 - DNA, 25 bp, E. coli
cggatgctgtcgcaaatgtcggcca

SEQ ID NO: 62307 - DNA, 25 bp, E. coli
cattgatcgtgacaatggtgtccgg

SEQ ID NO: 62308 - DNA, 25 bp, E. coli
cattgatcgtgagaatggtgtccgg

SEQ ID NO: 62309 - DNA, 25 bp, E. coli
gatttcagccttataccggaagaga

SEQ ID NO: 62310 - DNA, 25 bp, E. coli
gatttcagccttttaccggaagaga

SEQ ID NO: 62311 - DNA, 25 bp, E. coli
gatgcgcagtttccctcgctgaagg

SEQ ID NO: 62312 - DNA, 25 bp, E. coli
gatgcgcagtttgcctcgctgaagg

SEQ ID NO: 62313 - DNA, 25 bp, E. coli
cagaaacatcatccgatgccgcgcg

SEQ ID NO: 62314 - DNA, 25 bp, E. coli
cagaaacatcatgcgatgccgcgcg

SEQ ID NO: 62315 - DNA, 25 bp, E. coli
tatatgtggcgaattccggtgattg

SEQ ID NO: 62316 - DNA, 25 bp, E. coli
tatatgtggcgatttccggtgattg

SEQ ID NO: 62317 - DNA, 25 bp, E. coli
ttgatgaaaagctagaaaagcactg

SEQ ID NO: 62318 - DNA, 25 bp, E. coli
ttgatgaaaagcaagaaaagcactg

SEQ ID NO: 62319 - DNA, 25 bp, E. coli
ttaatcatcattcgctggctggcgg

SEQ ID NO: 62320 - DNA, 25 bp, E. coli
ttaatcatcattggctggctggcgg

SEQ ID NO: 62321 - DNA, 25 bp, E. coli
tgggtgcgcatcatgttgctggtaa

SEQ ID NO: 62322 - DNA, 25 bp, E. coli
tgggtgcgcatcttgttgctggtaa

SEQ ID NO: 62323 - DNA, 25 bp, E. coli
tgctggtaattctcgcctgtttgct

SEQ ID NO: 62324 - DNA, 25 bp, E. coli
tgctggtaattcacgcctgtttgct

SEQ ID NO: 62325 - DNA, 25 bp, E. coli
tgctgtaccgctcatggtttggcag

SEQ ID NO: 62326 - DNA, 25 bp, E. coli
tgctgtaccgctgatggtttggcag

SEQ ID NO: 62327 - DNA, 25 bp, E. coli
gctttcacgcctcgttgctgtaccg

SEQ ID NO: 62328 - DNA, 25 bp, E. coli
gctttcacgcctggttgctgtaccg

SEQ ID NO: 62329 - DNA, 25 bp, E. coli
cgctgggcgtggtattaccggtatt

SEQ ID NO: 62330 - DNA, 25 bp, E. coli
cgctgggcgtggaattaccggtatt

SEQ ID NO: 62331 - DNA, 25 bp, E. coli
tggcggcctggtcctttgcccgttc

SEQ ID NO: 62332 - DNA, 25 bp, E. coli
tggcggcctggtgctttgcccgttc

SEQ ID NO: 62333 - DNA, 25 bp, E. coli
gacgacgccgtttatcctgctggcg

SEQ ID NO: 62334 - DNA, 25 bp, E. coli
gacgacgccgttaatcctgctggcg

SEQ ID NO: 62335 - DNA, 25 bp, E. coli
caccccggaacagctgaaagagcgt

SEQ ID NO: 62336 - DNA, 25 bp, E. coli
caccccggaacacctgaaagagcgt

SEQ ID NO: 62337 - DNA, 25 bp, E. coli
taaagtaaacaaagttgatccggcg

SEQ ID NO: 62338 - DNA, 25 bp, E. coli
taaaacgctgaatgcggaaatcgtc

SEQ ID NO: 62339 - DNA, 25 bp, E. coli
taaagtaaacaatgttgatccggcg

SEQ ID NO: 62340 - DNA, 25 bp, E. coli
taaaacgctgaaagcggaaatcgtc

SEQ ID NO: 62341 - DNA, 25 bp, E. coli
accggttgatgaacagggtcgtact

SEQ ID NO: 62342 - DNA, 25 bp, E. coli
accggttgatgatcagggtcgtact

SEQ ID NO: 62343 - DNA, 25 bp, E. coli
agggcactgacaccccggaacagct

SEQ ID NO: 62344 - DNA, 25 bp, E. coli
agggcactgacagcccggaacagct

SEQ ID NO: 62345 - DNA, 25 bp, E. coli
aacagggtcgtagtcgcccggatct

SEQ ID NO: 62346 - DNA, 25 bp, E. coli
aacagggtcgtactcgcccggatct

SEQ ID NO: 62347 - DNA, 25 bp, E. coli
gaaatcgctaaaacgctgaatgcgg

SEQ ID NO: 62348 - DNA, 25 bp, E. coli
gaaatcgctaaatcgctgaatgcgg

SEQ ID NO: 62349 - DNA, 25 bp, E. coli
cgacctgatctcgatcgggccgatg

SEQ ID NO: 62350 - DNA, 25 bp, E. coli
cgacctgatctccatcgggccgatg

SEQ ID NO: 62351 - DNA, 25 bp, E. coli
ggcggtgccaaaaacaccaacatca

SEQ ID NO: 62352 - DNA, 25 bp, E. coli
ggcggtgccaaatacaccaacatca

SEQ ID NO: 62353 - DNA, 25 bp, E. coli
gacgactcttcctaagctaaagtaa

SEQ ID NO: 62354 - DNA, 25 bp, E. coli
gagattttcgacgactcttccaaag

SEQ ID NO: 62355 - DNA, 25 bp, E. coli
gacgactcttccaaagctaaagtaa

SEQ ID NO: 62356 - DNA, 25 bp, E. coli
gagattttcgaccactcttccaaag

SEQ ID NO: 62357 - DNA, 25 bp, E. coli
aactgggcgcacctgaactctatcg

SEQ ID NO: 62358 - DNA, 25 bp, E. coli
aataccgctggtggctggatcaaga

SEQ ID NO: 62359 - DNA, 25 bp, E. coli
aataccgctggtcgctggatcaaga

SEQ ID NO: 62360 - DNA, 25 bp, E. coli
cagcaagctgctcaaaccggtggac

SEQ ID NO: 62361 - DNA, 25 bp, E. coli
cagcaagctgctgaaaccggtggac

SEQ ID NO: 62362 - DNA, 25 bp, E. coli
taaaaatgccggtatccttgatgcg

SEQ ID NO: 62363 - DNA, 25 bp, E. coli
taaaaatgccggaatccttgatgcg

SEQ ID NO: 62364 - DNA, 25 bp, E. coli
agaaatcagctaacccgtgggtcag

SEQ ID NO: 62365 - DNA, 25 bp, E. coli
agaaatcagctatcccgtgggtcag

SEQ ID NO: 62366 - DNA, 25 bp, E. coli
aactgggcgcacgtgaactctatcg

SEQ ID NO: 62367 - DNA, 25 bp, E. coli
tacctgtaacgaaaatggcctgtgc

SEQ ID NO: 62368 - DNA, 25 bp, E. coli
tatgtggtgcactcttcggccatcg

SEQ ID NO: 62369 - DNA, 25 bp, E. coli
tacctgtaacgataatggcctgtgc

SEQ ID NO: 62370 - DNA, 25 bp, E. coli
tatgtggtgcacacttcggccatcg

SEQ ID NO: 62371 - DNA, 25 bp, E. coli
tatctgatgggtttccgcgaaacgc

SEQ ID NO: 62372 - DNA, 25 bp, E. coli
tatctgatgggtatccgcgaaacgc

SEQ ID NO: 62373 - DNA, 25 bp, E. coli
tgctcgaagatctcaaactaccgcg

SEQ ID NO: 62374 - DNA, 25 bp, E. coli
tgctcgaagatcacaaactaccgcg

SEQ ID NO: 62375 - DNA, 25 bp, E. coli
tcaaagttaccgtccatgggaaggg

SEQ ID NO: 62376 - DNA, 25 bp, E. coli
taacgttgaccttgcccatgcagga

SEQ ID NO: 62377 - DNA, 25 bp, E. coli
tcaaagttaccgaccatgggaaggg

SEQ ID NO: 62378 - DNA, 25 bp, E. coli
taacgttgacctagcccatgcagga

SEQ ID NO: 62379 - DNA, 25 bp, E. coli
aataacactgcttcaccggaaaccg

SEQ ID NO: 62380 - DNA, 25 bp, E. coli
aataacactgctacaccggaaaccg

SEQ ID NO: 62381 - DNA, 25 bp, E. coli
cagttatggtgagcgccgggatctt

SEQ ID NO: 62382 - DNA, 25 bp, E. coli
cagttatggtgaccgccgggatctt

SEQ ID NO: 62383 - DNA, 25 bp, E. coli
taaatttcttcatgccaggtacagg

SEQ ID NO: 62384 - DNA, 25 bp, E. coli
taaatttcttcaagccaggtacagg

SEQ ID NO: 62385 - DNA, 25 bp, E. coli
aaacgtcatgaggaacgcaatgggc

SEQ ID NO: 62386 - DNA, 25 bp, E. coli
aaacgtcatgagcaacgcaatgggc

SEQ ID NO: 62387 - DNA, 25 bp, E. coli
ttcgccacagttttcatcgcccagg

SEQ ID NO: 62388 - DNA, 25 bp, E. coli
ttcgccacagttatcatcgcccagg

SEQ ID NO: 62389 - DNA, 25 bp, E. coli
tgaatcgaacgttgctctgccctga

SEQ ID NO: 62390 - DNA, 25 bp, E. coli
tgaatcgaacgtagctctgccctga

SEQ ID NO: 62391 - DNA, 25 bp, E. coli
tctgaagcggcttttccgggaacgc

SEQ ID NO: 62392 - DNA, 25 bp, E. coli
taatctcgttggatcaatggcctac

SEQ ID NO: 62393 - DNA, 25 bp, E. coli
taatctcgttggttcaatggcctac

SEQ ID NO: 62394 - DNA, 25 bp, E. coli
tctgaagcggctattccgggaacgc

SEQ ID NO: 62395 - DNA, 25 bp, E. coli
cctcgaaaggaaaggctggcgtacc

SEQ ID NO: 62396 - DNA, 25 bp, E. coli
cctcgaaaggaatggctggcgtacc

SEQ ID NO: 62397 - DNA, 25 bp, E. coli
cattgattgctgaacgaggactggc

SEQ ID NO: 62398 - DNA, 25 bp, E. coli
cattgattgctgtacgaggactggc

SEQ ID NO: 62399 - DNA, 25 bp, E. coli
cgggaacgcttgaaaaactggagca

SEQ ID NO: 62400 - DNA, 25 bp, E. coli
cgggaacgcttgtaaaactggagca

SEQ ID NO: 62401 - DNA, 25 bp, E. coli
caattgtgatatgtgtgaacccgaa

SEQ ID NO: 62402 - DNA, 25 bp, E. coli
caattgtgatatctgtgaacccgaa

SEQ ID NO: 62403 - DNA, 25 bp, E. coli
tgtgaacccgaaagcccgaatgagg

SEQ ID NO: 62404 - DNA, 25 bp, E. coli
tgtgaacccgaatgcccgaatgagg

SEQ ID NO: 62405 - DNA, 25 bp, E. coli
tgcgtagggcacaacgagacaccaa

SEQ ID NO: 62406 - DNA, 25 bp, E. coli
tgcgtagggcactacgagacaccaa

SEQ ID NO: 62407 - DNA, 25 bp, E. coli
gctgatgcaccacgcggataaaatt

SEQ ID NO: 62408 - DNA, 25 bp, E. coli
gctgatgcaccaggcggataaaatt

SEQ ID NO: 62409 - DNA, 25 bp, E. coli
gaacagttgtggcataaatttgtgc

SEQ ID NO: 62410 - DNA, 25 bp, E. coli
gaacagttgtgggataaatttgtgc

SEQ ID NO: 62411 - DNA, 25 bp, E. coli
ccccaatactatagtgaaagatccg

SEQ ID NO: 62412 - DNA, 25 bp, E. coli
ccccaatactattgtgaaagatccg

SEQ ID NO: 62413 - DNA, 25 bp, E. coli
gataaatttgtggtgatgcaccacg

SEQ ID NO: 62414 - DNA, 25 bp, E. coli
gataaatttgtgctgatgcaccacg

SEQ ID NO: 62415 - DNA, 25 bp, E. coli
taatcactaaaatatgcatcaattg

SEQ ID NO: 62416 - DNA, 25 bp, E. coli
taagtgtaccgattgcgtagggcac

SEQ ID NO: 62417 - DNA, 25 bp, E. coli
taagtgtaccgaatgcgtagggcac

SEQ ID NO: 62418 - DNA, 25 bp, E. coli
taatcactaaaaaatgcatcaattg

SEQ ID NO: 62419 - DNA, 25 bp, E. coli
gagattaacagccataagtgtaccg

SEQ ID NO: 62420 - DNA, 25 bp, E. coli
gagacaccaacctgccagaaggtgt

SEQ ID NO: 62421 - DNA, 25 bp, E. coli
gagacaccaaccagccagaaggtgt

SEQ ID NO: 62422 - DNA, 25 bp, E. coli
gagattaacagcgataagtgtaccg

SEQ ID NO: 62423 - DNA, 25 bp, E. coli
cagtattgagccactaacctgggaa

SEQ ID NO: 62424 - DNA, 25 bp, E. coli
cagtattgagcctctaacctgggaa

SEQ ID NO: 62425 - DNA, 25 bp, E. coli
taacagtgccatagtgcgcattacg

SEQ ID NO: 62426 - DNA, 25 bp, E. coli
acgccttctttggtgttaacagtgc

SEQ ID NO: 62427 - DNA, 25 bp, E. coli
attacgtctgaagcaccgctcctga

SEQ ID NO: 62428 - DNA, 25 bp, E. coli
attacgtctgaaccaccgctcctga

SEQ ID NO: 62429 - DNA, 25 bp, E. coli
acgccttctttgctgttaacagtgc

SEQ ID NO: 62430 - DNA, 25 bp, E. coli
gagccactaacctgggaaaacgcct

SEQ ID NO: 62431 - DNA, 25 bp, E. coli
gagccactaaccagggaaaacgcct

SEQ ID NO: 62432 - DNA, 25 bp, E. coli
gccagacgcgttagcgccgtggtca

SEQ ID NO: 62433 - DNA, 25 bp, E. coli
gccagacgcgtttgcgccgtggtca

SEQ ID NO: 62434 - DNA, 25 bp, E. coli
gcgccagtattgtgccactaacctg

SEQ ID NO: 62435 - DNA, 25 bp, E. coli
gcgccagtattgagccactaacctg

SEQ ID NO: 62436 - DNA, 25 bp, E. coli
gctcctgacgcctgacgcgttagcg

SEQ ID NO: 62437 - DNA, 25 bp, E. coli
gctcctgacgccagacgcgttagcg

SEQ ID NO: 62438 - DNA, 25 bp, E. coli
cattgtgcgcataacgtctgaagca

SEQ ID NO: 62439 - DNA, 25 bp, E. coli
cattgtgcgcattacgtctgaagca

SEQ ID NO: 62440 - DNA, 25 bp, E. coli
gtggtcacgggtccaggccaaaatt

SEQ ID NO: 62441 - DNA, 25 bp, E. coli
ggtgttaacagtgccattgtgcgca

SEQ ID NO: 62442 - DNA, 25 bp, E. coli
ggtgttaacagtcccattgtgcgca

SEQ ID NO: 62443 - DNA, 25 bp, E. coli
gtggtcacgggtgcaggccaaaatt

SEQ ID NO: 62444 - DNA, 25 bp, E. coli
taacagtgccattgtgcgcattacg

SEQ ID NO: 62445 - DNA, 25 bp, E. coli
aattctaaccgtgagcatttcgccg

SEQ ID NO: 62446 - DNA, 25 bp, E. coli
aattctaaccgtcagcatttcgccg

SEQ ID NO: 62447 - DNA, 25 bp, E. coli
catgagacaattgtaaccgtgagca

SEQ ID NO: 62448 - DNA, 25 bp, E. coli
catgagacaattctaaccgtgagca

SEQ ID NO: 62449 - DNA, 25 bp, E. coli
actgataatcagtcaaaatggtgac

SEQ ID NO: 62450 - DNA, 25 bp, E. coli
actgataatcagacaaaatggtgac

SEQ ID NO: 62451 - DNA, 25 bp, E. coli
tgtttacggcgacacgggaatttgc

SEQ ID NO: 62452 - DNA, 25 bp, E. coli
tgtttacggcgagacgggaatttgc

SEQ ID NO: 62453 - DNA, 25 bp, E. coli
tgactttccgttacgcaacagaaaa

SEQ ID NO: 62454 - DNA, 25 bp, E. coli
tgcttgatccctttgaaataaccgt

SEQ ID NO: 62455 - DNA, 25 bp, E. coli
tgcttgatccctatgaaataaccgt

SEQ ID NO: 62456 - DNA, 25 bp, E. coli
tgactttccgtttcgcaacagaaaa

SEQ ID NO: 62457 - DNA, 25 bp, E. coli
gcatttcgccggattattgtttacg

SEQ ID NO: 62458 - DNA, 25 bp, E. coli
gcatttcgccggtttattgtttacg

SEQ ID NO: 62459 - DNA, 25 bp, E. coli
gctttcgctagtaaactgataatca

SEQ ID NO: 62460 - DNA, 25 bp, E. coli
gctttcgctagttaactgataatca

SEQ ID NO: 62461 - DNA, 25 bp, E. coli
gaaataaccgtaccgttcatgagac

SEQ ID NO: 62462 - DNA, 25 bp, E. coli
gactaaaatcactcgtcttgtgacc

SEQ ID NO: 62463 - DNA, 25 bp, E. coli
gaaataaccgtagcgttcatgagac

SEQ ID NO: 62464 - DNA, 25 bp, E. coli
gactaaaatcacacgtcttgtgacc

SEQ ID NO: 62465 - DNA, 25 bp, E. coli
gaccttctaaattgattcacatgct

SEQ ID NO: 62466 - DNA, 25 bp, E. coli
gaccttctaaatagattcacatgct

SEQ ID NO: 62467 - DNA, 25 bp, E. coli
cataacgttgtcttaaccagcagcg

SEQ ID NO: 62468 - DNA, 25 bp, E. coli
caggctacaaaatacacccggtgag

SEQ ID NO: 62469 - DNA, 25 bp, E. coli
cagaaaggctggcatcggcaagtct

SEQ ID NO: 62470 - DNA, 25 bp, E. coli
caggctacaaaaaacacccggtgag

SEQ ID NO: 62471 - DNA, 25 bp, E. coli
cagaaaggctgggatcggcaagtct

SEQ ID NO: 62472 - DNA, 25 bp, E. coli
cataacgttgtcataaccagcagcg

SEQ ID NO: 62473 - DNA, 25 bp, E. coli
tacgctgggccgtgcaacatttgtg

SEQ ID NO: 62474 - DNA, 25 bp, E. coli
tacgctgggccgagcaacatttgtg

SEQ ID NO: 62475 - DNA, 25 bp, E. coli
tgcactacggtctgggctggctcta

SEQ ID NO: 62476 - DNA, 25 bp, E. coli
tgcactacggtcagggctggctcta

SEQ ID NO: 62477 - DNA, 25 bp, E. coli
tcaggttaatcccagacagatcgcg

SEQ ID NO: 62478 - DNA, 25 bp, E. coli
tctttgaagatatgggcgactggct

SEQ ID NO: 62479 - DNA, 25 bp, E. coli
tctttgaagataagggcgactggct

SEQ ID NO: 62480 - DNA, 25 bp, E. coli
tcaggttaatccgagacagatcgcg

SEQ ID NO: 62481 - DNA, 25 bp, E. coli
gaacgcgagtttcccgatccgaaaa

SEQ ID NO: 62482 - DNA, 25 bp, E. coli
gaacgcgagtttgccgatccgaaaa

SEQ ID NO: 62483 - DNA, 25 bp, E. coli
cgacacaagggatagatgcgctgca

SEQ ID NO: 62484 - DNA, 25 bp, E. coli
cgacacaagggaaagatgcgctgca

SEQ ID NO: 62485 - DNA, 25 bp, E. coli
gatagttttattccgctggcacagc

SEQ ID NO: 62486 - DNA, 25 bp, E. coli
gataatttctcgctaccgggaggcg

SEQ ID NO: 62487 - DNA, 25 bp, E. coli
gataatttctcggtaccgggaggcg

SEQ ID NO: 62488 - DNA, 25 bp, E. coli
gatagttttattgcgctggcacagc

SEQ ID NO: 62489 - DNA, 25 bp, E. coli
tactgcggcgcaaggaagcgattaa

SEQ ID NO: 62490 - DNA, 25 bp, E. coli
tactgcggcgcatggaagcgattaa

SEQ ID NO: 62491 - DNA, 25 bp, E. coli
tactggcatgaatggcttaactggc

SEQ ID NO: 62492 - DNA, 25 bp, E. coli
tacgcgaggcttgtcagtacatcag

SEQ ID NO: 62493 - DNA, 25 bp, E. coli
tactggcatgaaaggcttaactggc

SEQ ID NO: 62494 - DNA, 25 bp, E. coli
tacgcgaggcttctcagtacatcag

SEQ ID NO: 62495 - DNA, 25 bp, E. coli
tttgatatcgcctgcgtcgcacagc

SEQ ID NO: 62496 - DNA, 25 bp, E. coli
tttgatatcgccagcgtcgcacagc

SEQ ID NO: 62497 - DNA, 25 bp, E. coli
tttatcgaccgagcgctgggaatga

SEQ ID NO: 62498 - DNA, 25 bp, E. coli
tttatcgaccgaccgctgggaatga

SEQ ID NO: 62499 - DNA, 25 bp, E. coli
ttcagcgacctgattgggcaaatca

SEQ ID NO: 62500 - DNA, 25 bp, E. coli
ttcagcgacctgtttgggcaaatca

SEQ ID NO: 62501 - DNA, 25 bp, E. coli
tgctgccgggatactcgtttaacgc

SEQ ID NO: 62502 - DNA, 25 bp, E. coli
tgctgccgggattctcgtttaacgc

SEQ ID NO: 62503 - DNA, 25 bp, E. coli
tccgccagcagttagggattagcgt

SEQ ID NO: 62504 - DNA, 25 bp, E. coli
tccgccagcagtaagggattagcgt

SEQ ID NO: 62505 - DNA, 25 bp, E. coli
tcaatctcaccaatcgcggtcaggg

SEQ ID NO: 62506 - DNA, 25 bp, E. coli
tcaatctcaccattcgcggtcaggg

SEQ ID NO: 62507 - DNA, 25 bp, E. coli
gagaatttgtctcccgaccgggtga

SEQ ID NO: 62508 - DNA, 25 bp, E. coli
gagagattcatctctacggtcgtca

SEQ ID NO: 62509 - DNA, 25 bp, E. coli
gagagattcatcactacggtcgtca

SEQ ID NO: 62510 - DNA, 25 bp, E. coli
gagaatttgtctgccgaccgggtga

SEQ ID NO: 62511 - DNA, 25 bp, E. coli
caatgtgcttgcctcaaccagggaa

SEQ ID NO: 62512 - DNA, 25 bp, E. coli
caatgtgcttgcgtcaaccagggaa

SEQ ID NO: 62513 - DNA, 25 bp, E. coli
taaatggcaggaaaaagtcttcggg

SEQ ID NO: 62514 - DNA, 25 bp, E. coli
taaatggcaggataaagtcttcggg

SEQ ID NO: 62515 - DNA, 25 bp, E. coli
tgctgaaaaagtggcacaaggcgcc

SEQ ID NO: 62516 - DNA, 25 bp, E. coli
tgctgatgccagatccaaagcgtgg

SEQ ID NO: 62517 - DNA, 25 bp, E. coli
tgaaatatggtgtacgcgtggcgac

SEQ ID NO: 62518 - DNA, 25 bp, E. coli
tgctgatgccagttccaaagcgtgg

SEQ ID NO: 62519 - DNA, 25 bp, E. coli
tgaaatatggtgaacgcgtggcgac

SEQ ID NO: 62520 - DNA, 25 bp, E. coli
tccctacgggcgttctggatacagc

SEQ ID NO: 62521 - DNA, 25 bp, E. coli
tccctacgggcgatctggatacagc

SEQ ID NO: 62522 - DNA, 25 bp, E. coli
tgctgaaaaagtcgcacaaggcgcc

SEQ ID NO: 62523 - DNA, 25 bp, E. coli
gatctatctgcatacgctggcttca

SEQ ID NO: 62524 - DNA, 25 bp, E. coli
gatatggtcacactaaactggttgc

SEQ ID NO: 62525 - DNA, 25 bp, E. coli
gatatggtcacagtaaactggttgc

SEQ ID NO: 62526 - DNA, 25 bp, E. coli
gtgcaatctccagccgatgcgggtg

SEQ ID NO: 62527 - DNA, 25 bp, E. coli
gtgcaatctccacccgatgcgggtg

SEQ ID NO: 62528 - DNA, 25 bp, E. coli
gatgccattatcatcggtgctccca

SEQ ID NO: 62529 - DNA, 25 bp, E. coli
gatctatctgcaaacgctggcttca

SEQ ID NO: 62530 - DNA, 25 bp, E. coli
gatgccattatcttcggtgctccca

SEQ ID NO: 62531 - DNA, 25 bp, E. coli
gatgcgggtgcacaccaaatcccta

SEQ ID NO: 62532 - DNA, 25 bp, E. coli
gatgcgggtgcagaccaaatcccta

SEQ ID NO: 62533 - DNA, 25 bp, E. coli
caaagaaacaaatattgcactaccg

SEQ ID NO: 62534 - DNA, 25 bp, E. coli
caaagaaacaaaaattgcactaccg

SEQ ID NO: 62535 - DNA, 25 bp, E. coli
aagcgggttcttttatcagattatc

SEQ ID NO: 62536 - DNA, 25 bp, E. coli
aagcgggttcttatatcagattatc

SEQ ID NO: 62537 - DNA, 25 bp, E. coli
tatcgttgctattctcaattcatcg

SEQ ID NO: 62538 - DNA, 25 bp, E. coli
tatcagattatccttgctattctca

SEQ ID NO: 62539 - DNA, 25 bp, E. coli
tattctcaattcttcgaaaacagcc

SEQ ID NO: 62540 - DNA, 25 bp, E. coli
tatcgttgctatactcaattcatcg

SEQ ID NO: 62541 - DNA, 25 bp, E. coli
tattctcaattcatcgaaaacagcc

SEQ ID NO: 62542 - DNA, 25 bp, E. coli
tatcagattatcgttgctattctca

SEQ ID NO: 62543 - DNA, 25 bp, E. coli
tctcaattcatcgaaaacagccaca

SEQ ID NO: 62544 - DNA, 25 bp, E. coli
tctcaattcatccaaaacagccaca

SEQ ID NO: 62545 - DNA, 25 bp, E. coli
gaaacaaatattgcactaccgcaca

SEQ ID NO: 62546 - DNA, 25 bp, E. coli
gaaacaaatattccactaccgcaca

SEQ ID NO: 62547 - DNA, 25 bp, E. coli
cgggtcaaagaatcaaatattgcac

SEQ ID NO: 62548 - DNA, 25 bp, E. coli
cgggtcaaagaaacaaatattgcac

SEQ ID NO: 62549 - DNA, 25 bp, E. coli
ggtatcgggtcatagaaacaaatat

SEQ ID NO: 62550 - DNA, 25 bp, E. coli
ggttcttttatcagattatcgttgc

SEQ ID NO: 62551 - DNA, 25 bp, E. coli
ggttcttttatctgattatcgttgc

SEQ ID NO: 62552 - DNA, 25 bp, E. coli
ggtatcgggtcaaagaaacaaatat

SEQ ID NO: 62553 - DNA, 25 bp, E. coli
tcgaaaacagccacaaaaaccaggg

SEQ ID NO: 62554 - DNA, 25 bp, E. coli
tcgaaaacagcctcaaaaaccaggg

SEQ ID NO: 62555 - DNA, 25 bp, E. coli
cagcgcctccgaaagatgtaaatat

SEQ ID NO: 62556 - DNA, 25 bp, E. coli
cagcgcctccgatagatgtaaatat

SEQ ID NO: 62557 - DNA, 25 bp, E. coli
gacttggagtcggttctttagaagg

SEQ ID NO: 62558 - DNA, 25 bp, E. coli
gacttggagtcgcttctttagaagg

SEQ ID NO: 62559 - DNA, 25 bp, E. coli
accgtctcacatcttcagcgattgc

SEQ ID NO: 62560 - DNA, 25 bp, E. coli
accgtctcacatgttcagcgattgc

SEQ ID NO: 62561 - DNA, 25 bp, E. coli
tacctcctgggtaagtgagcagata

SEQ ID NO: 62562 - DNA, 25 bp, E. coli
tacctcctgggttagtgagcagata

SEQ ID NO: 62563 - DNA, 25 bp, E. coli
tgagcagatactttcagcgcctccg

SEQ ID NO: 62564 - DNA, 25 bp, E. coli
tgagcagatactatcagcgcctccg

SEQ ID NO: 62565 - DNA, 25 bp, E. coli
tctttagaaggttcaaccgtctcac

SEQ ID NO: 62566 - DNA, 25 bp, E. coli
tctttagaaggtacaaccgtctcac

SEQ ID NO: 62567 - DNA, 25 bp, E. coli
cctggtggcgcggagcaattattga

SEQ ID NO: 62568 - DNA, 25 bp, E. coli
cctggtggcgcgcagcaattattga

SEQ ID NO: 62569 - DNA, 25 bp, E. coli
gcatcattcgttaatcgcagctggt

SEQ ID NO: 62570 - DNA, 25 bp, E. coli
gcatcattcgtttatcgcagctggt

SEQ ID NO: 62571 - DNA, 25 bp, E. coli
gcagctggtttggaaagtaacctca

SEQ ID NO: 62572 - DNA, 25 bp, E. coli
gcagctggtttgcaaagtaacctca

SEQ ID NO: 62573 - DNA, 25 bp, E. coli
cattacctgagaataatacctcctg

SEQ ID NO: 62574 - DNA, 25 bp, E. coli
cattacctgagattaatacctcctg

SEQ ID NO: 62575 - DNA, 25 bp, E. coli
tcactgtctataccggtggtcacga

SEQ ID NO: 62576 - DNA, 25 bp, E. coli
tcactgtctatagcggtggtcacga

SEQ ID NO: 62577 - DNA, 25 bp, E. coli
cagtgatgtaatctgaaatagcctt

SEQ ID NO: 62578 - DNA, 25 bp, E. coli
cagtgatgtaatgtgaaatagcctt

SEQ ID NO: 62579 - DNA, 25 bp, E. coli
aaaaaattggttacttgcatcctgc

SEQ ID NO: 62580 - DNA, 25 bp, E. coli
aaaaaattggtttcttgcatcctgc

SEQ ID NO: 62581 - DNA, 25 bp, E. coli
tatgtgtcattaacgctacaggaaa

SEQ ID NO: 62582 - DNA, 25 bp, E. coli
tatgtgtcattatcgctacaggaaa

SEQ ID NO: 62583 - DNA, 25 bp, E. coli
tataaccagcaaatttaaccaaatg

SEQ ID NO: 62584 - DNA, 25 bp, E. coli
tataaccagcaattttaaccaaatg

SEQ ID NO: 62585 - DNA, 25 bp, E. coli
tttaagaaaacaaaagaggtgctgg

SEQ ID NO: 62586 - DNA, 25 bp, E. coli
tttaagaaaacataagaggtgctgg

SEQ ID NO: 62587 - DNA, 25 bp, E. coli
tgctggttatagaggttaactgcac

SEQ ID NO: 62588 - DNA, 25 bp, E. coli
tgctggttatagtggttaactgcac

SEQ ID NO: 62589 - DNA, 25 bp, E. coli
cctgcttaagcattagaaattatgg

SEQ ID NO: 62590 - DNA, 25 bp, E. coli
cctgcttaagcaatagaaattatgg

SEQ ID NO: 62591 - DNA, 25 bp, E. coli
gacatatctatggttgtgttcacta

SEQ ID NO: 62592 - DNA, 25 bp, E. coli
gacatatctatgcttgtgttcacta

SEQ ID NO: 62593 - DNA, 25 bp, E. coli
cgctacaggaaaatacatttgacat

SEQ ID NO: 62594 - DNA, 25 bp, E. coli
cgctacaggaaattacatttgacat

SEQ ID NO: 62595 - DNA, 25 bp, E. coli
gataaagtagatagttctctaacgc

SEQ ID NO: 62596 - DNA, 25 bp, E. coli
gataaagtagattgttctctaacgc

SEQ ID NO: 62597 - DNA, 25 bp, E. coli
tagttaacctctatgaaaaaattgg

SEQ ID NO: 62598 - DNA, 25 bp, E. coli
tagttaacctctttgaaaaaattgg

SEQ ID NO: 62599 - DNA, 25 bp, E. coli
taacggccgcatagtactgaacgaa

SEQ ID NO: 62600 - DNA, 25 bp, E. coli
tatgtttttacaagataacggccgc

SEQ ID NO: 62601 - DNA, 25 bp, E. coli
tatcctgtttttgttaagccggcgc

SEQ ID NO: 62602 - DNA, 25 bp, E. coli
tatgtttttacatgataacggccgc

SEQ ID NO: 62603 - DNA, 25 bp, E. coli
tatcctgtttttcttaagccggcgc

SEQ ID NO: 62604 - DNA, 25 bp, E. coli
ttaataaagatgttaggccggtggc

SEQ ID NO: 62605 - DNA, 25 bp, E. coli
ttatccccgtatgatggccgctgca

SEQ ID NO: 62606 - DNA, 25 bp, E. coli
ttatccccgtatcatggccgctgca

SEQ ID NO: 62607 - DNA, 25 bp, E. coli
ttaataaagatgataggccggtggc

SEQ ID NO: 62608 - DNA, 25 bp, E. coli
tgaacgaagtcaatactctgcccgg

SEQ ID NO: 62609 - DNA, 25 bp, E. coli
tgaacgaagtcattactctgcccgg

SEQ ID NO: 62610 - DNA, 25 bp, E. coli
tcatcaggaagtggagccggaaaaa

SEQ ID NO: 62611 - DNA, 25 bp, E. coli
tcaggctgcagttcggaatctttcg

SEQ ID NO: 62612 - DNA, 25 bp, E. coli
tcaggctgcagtacggaatctttcg

SEQ ID NO: 62613 - DNA, 25 bp, E. coli
tcatcaggaagtcgagccggaaaaa

SEQ ID NO: 62614 - DNA, 25 bp, E. coli
ccttgcgcggaaagggaaaacgaca

SEQ ID NO: 62615 - DNA, 25 bp, E. coli
ccttgcgcggaatgggaaaacgaca

SEQ ID NO: 62616 - DNA, 25 bp, E. coli
gctattcagctgtactctcgccgga

SEQ ID NO: 62617 - DNA, 25 bp, E. coli
gctattcagctgaactctcgccgga

SEQ ID NO: 62618 - DNA, 25 bp, E. coli
gaaaatgtgcgataaaccttgcgcg

SEQ ID NO: 62619 - DNA, 25 bp, E. coli
gaaaatgtgcgaaaaaccttgcgcg

SEQ ID NO: 62620 - DNA, 25 bp, E. coli
taacggccgcattgtactgaacgaa

SEQ ID NO: 62621 - DNA, 25 bp, E. coli
cacaaattacattccgccgggctgg

SEQ ID NO: 62622 - DNA, 25 bp, E. coli
cacaaattacataccgccgggctgg

SEQ ID NO: 62623 - DNA, 25 bp, E. coli
taaaaacacgtctcactgtggtgcg

SEQ ID NO: 62624 - DNA, 25 bp, E. coli
taaaaacacgtcacactgtggtgcg

SEQ ID NO: 62625 - DNA, 25 bp, E. coli
aaaacatattggagaagggctggcg

SEQ ID NO: 62626 - DNA, 25 bp, E. coli
aaaacatattggtgaagggctggcg

SEQ ID NO: 62627 - DNA, 25 bp, E. coli
aaaatggtcacggagctgcatgccg

SEQ ID NO: 62628 - DNA, 25 bp, E. coli
aaaatggtcacgcagctgcatgccg

SEQ ID NO: 62629 - DNA, 25 bp, E. coli
tttcccggtggaaaacagccatccg

SEQ ID NO: 62630 - DNA, 25 bp, E. coli
tttcccggtggataacagccatccg

SEQ ID NO: 62631 - DNA, 25 bp, E. coli
tgagcaaatttcaccgtcagtggcc

SEQ ID NO: 62632 - DNA, 25 bp, E. coli
tgagcaaatttctccgtcagtggcc

SEQ ID NO: 62633 - DNA, 25 bp, E. coli
taaactggcccaccaagagggtctc

SEQ ID NO: 62634 - DNA, 25 bp, E. coli
taaactggcccagcaagagggtctc

SEQ ID NO: 62635 - DNA, 25 bp, E. coli
ccgatgattgttcatatggcgacca

SEQ ID NO: 62636 - DNA, 25 bp, E. coli
ccgatgattgttgatatggcgacca

SEQ ID NO: 62637 - DNA, 25 bp, E. coli
ccggctcctggtgtcgaaaaagtgt

SEQ ID NO: 62638 - DNA, 25 bp, E. coli
ccggctcctggtctcgaaaaagtgt

SEQ ID NO: 62639 - DNA, 25 bp, E. coli
tggataccgacaccacacaacaggt

SEQ ID NO: 62640 - DNA, 25 bp, E. coli
tggataccgacagcacacaacaggt

SEQ ID NO: 62641 - DNA, 25 bp, E. coli
taaagccccgcagtttagcattgag

SEQ ID NO: 62642 - DNA, 25 bp, E. coli
taaagccccgcactttagcattgag

SEQ ID NO: 62643 - DNA, 25 bp, E. coli
aaggatgggtgaacggctttacgcc

SEQ ID NO: 62644 - DNA, 25 bp, E. coli
aaggatgggtgatcggctttacgcc

SEQ ID NO: 62645 - DNA, 25 bp, E. coli
caggttgtgctggaactcgacccgg

SEQ ID NO: 62646 - DNA, 25 bp, E. coli
caggttgtgctgcaactcgacccgg

SEQ ID NO: 62647 - DNA, 25 bp, E. coli
tatcagtgaatttggttccacggcc

SEQ ID NO: 62648 - DNA, 25 bp, E. coli
tatcagtgaattaggttccacggcc

SEQ ID NO: 62649 - DNA, 25 bp, E. coli
tttgccgccagaagtacgttgcccg

SEQ ID NO: 62650 - DNA, 25 bp, E. coli
tttgccgccagatgtacgttgcccg

SEQ ID NO: 62651 - DNA, 25 bp, E. coli
ttgtaccgctgcgatagttgccgcg

SEQ ID NO: 62652 - DNA, 25 bp, E. coli
ttgtaccgctgccatagttgccgcg

SEQ ID NO: 62653 - DNA, 25 bp, E. coli
tgaggcaatgactaccaacgggttt

SEQ ID NO: 62654 - DNA, 25 bp, E. coli
tgaggcaatgacaaccaacgggttt

SEQ ID NO: 62655 - DNA, 25 bp, E. coli
tgcccgtgagcgtctgcgagagtat

SEQ ID NO: 62656 - DNA, 25 bp, E. coli
tgcccgtgagcgactgcgagagtat

SEQ ID NO: 62657 - DNA, 25 bp, E. coli
gaacatttgattggcgcgatacgtg

SEQ ID NO: 62658 - DNA, 25 bp, E. coli
gaacatttgattcgcgcgatacgtg

SEQ ID NO: 62659 - DNA, 25 bp, E. coli
gttccacggcctgcaaagcattgta

SEQ ID NO: 62660 - DNA, 25 bp, E. coli
gttccacggcctccaaagcattgta

SEQ ID NO: 62661 - DNA, 25 bp, E. coli
ggtatgcaacgtctggccaccattg

SEQ ID NO: 62662 - DNA, 25 bp, E. coli
ggtatgcaacgtgtggccaccattg

SEQ ID NO: 62663 - DNA, 25 bp, E. coli
gagatatgggcgctactcagccaga

SEQ ID NO: 62664 - DNA, 25 bp, E. coli
gagatatgggcggtactcagccaga

SEQ ID NO: 62665 - DNA, 25 bp, E. coli
tgttaccggaaattcaacaggcgct

SEQ ID NO: 62666 - DNA, 25 bp, E. coli
tgttaccggaaaatcaacaggcgct

SEQ ID NO: 62667 - DNA, 25 bp, E. coli
tgtttctcgataaccagatgccgcg

SEQ ID NO: 62668 - DNA, 25 bp, E. coli
tgtttctcgatatccagatgccgcg

SEQ ID NO: 62669 - DNA, 25 bp, E. coli
tgacattacgtagcctggaaagtcg

SEQ ID NO: 62670 - DNA, 25 bp, E. coli
tgatgaagcgcgactggagaaaacg

SEQ ID NO: 62671 - DNA, 25 bp, E. coli
tgatgaagcgcgtctggagaaaacg

SEQ ID NO: 62672 - DNA, 25 bp, E. coli
tgacattacgtaccctggaaagtcg

SEQ ID NO: 62673 - DNA, 25 bp, E. coli
cgtaatggcttatccgtgccggtca

SEQ ID NO: 62674 - DNA, 25 bp, E. coli
cgtaatggcttaaccgtgccggtca

SEQ ID NO: 62675 - DNA, 25 bp, E. coli
gattgcgtcaggtgcgcagcaagca

SEQ ID NO: 62676 - DNA, 25 bp, E. coli
gattgcgtcaggagcgcagcaagca

SEQ ID NO: 62677 - DNA, 25 bp, E. coli
gtcagtatctggttaacctcgcgca

SEQ ID NO: 62678 - DNA, 25 bp, E. coli
ggtgcataaactccgcccggatgtg

SEQ ID NO: 62679 - DNA, 25 bp, E. coli
gtcagtatctggataacctcgcgca

SEQ ID NO: 62680 - DNA, 25 bp, E. coli
ggtgcataaactgcgcccggatgtg

SEQ ID NO: 62681 - DNA, 25 bp, E. coli
ggcgctgaaatttatcccttgtacg

SEQ ID NO: 62682 - DNA, 25 bp, E. coli
ggcgctgaaattaatcccttgtacg

SEQ ID NO: 62683 - DNA, 25 bp, E. coli
gatgtggcatttctcagcagtcgga

SEQ ID NO: 62684 - DNA, 25 bp, E. coli
gatgaaccgttaccacgggagaacc

SEQ ID NO: 62685 - DNA, 25 bp, E. coli
gatgaaccgttagcacgggagaacc

SEQ ID NO: 62686 - DNA, 25 bp, E. coli
gatgtggcatttgtcagcagtcgga

SEQ ID NO: 62687 - DNA, 25 bp, E. coli
taaacaggtattgggcacagcagag

SEQ ID NO: 62688 - DNA, 25 bp, E. coli
taaacaggtattcggcacagcagag

SEQ ID NO: 62689 - DNA, 25 bp, E. coli
tacgccattgttaactcccggtgag

SEQ ID NO: 62690 - DNA, 25 bp, E. coli
tacgccattgtttactcccggtgag

SEQ ID NO: 62691 - DNA, 25 bp, E. coli
tatctacatctggtgctgctgccgg

SEQ ID NO: 62692 - DNA, 25 bp, E. coli
tatctacatctgctgctgctgccgg

SEQ ID NO: 62693 - DNA, 25 bp, E. coli
tatattatcgcagagcgcgctgcac

SEQ ID NO: 62694 - DNA, 25 bp, E. coli
tatattatcgcacagcgcgctgcac

SEQ ID NO: 62695 - DNA, 25 bp, E. coli
tttactgatatcttccatggcgcgg

SEQ ID NO: 62696 - DNA, 25 bp, E. coli
tttactgatatcatccatggcgcgg

SEQ ID NO: 62697 - DNA, 25 bp, E. coli
tgatggcacaaaagcaaccgaagcg

SEQ ID NO: 62698 - DNA, 25 bp, E. coli
tgctgaatgggacaaaaaacacggc

SEQ ID NO: 62699 - DNA, 25 bp, E. coli
tgctgaatgggagaaaaaacacggc

SEQ ID NO: 62700 - DNA, 25 bp, E. coli
tgatggcacaaatgcaaccgaagcg

SEQ ID NO: 62701 - DNA, 25 bp, E. coli
gaagaacttattgggaccacgcgtg

SEQ ID NO: 62702 - DNA, 25 bp, E. coli
gaagaacttattcggaccacgcgtg

SEQ ID NO: 62703 - DNA, 25 bp, E. coli
gaaattcgtgaatggaggcagtccg

SEQ ID NO: 62704 - DNA, 25 bp, E. coli
gaaattcgtgaaaggaggcagtccg

SEQ ID NO: 62705 - DNA, 25 bp, E. coli
gataccggaactaaagctgcagcag

SEQ ID NO: 62706 - DNA, 25 bp, E. coli
gataccggaacttaagctgcagcag

SEQ ID NO: 62707 - DNA, 25 bp, E. coli
ggctcagccaatttctacgcaggta

SEQ ID NO: 62708 - DNA, 25 bp, E. coli
ggctcagccaatatctacgcaggta

SEQ ID NO: 62709 - DNA, 25 bp, E. coli
aacggcctggctacgaaggtgcaga

SEQ ID NO: 62710 - DNA, 25 bp, E. coli
cacagatatgcgttgtggcttcaac

SEQ ID NO: 62711 - DNA, 25 bp, E. coli
cacagatatgcgatgtggcttcaac

SEQ ID NO: 62712 - DNA, 25 bp, E. coli
cagaacacgctgaaagatgccccgt

SEQ ID NO: 62713 - DNA, 25 bp, E. coli
cagaacacgctgtaagatgccccgt

SEQ ID NO: 62714 - DNA, 25 bp, E. coli
ataacgctgccatccggtaccagaa

SEQ ID NO: 62715 - DNA, 25 bp, E. coli
ataacgctgccaaccggtaccagaa

SEQ ID NO: 62716 - DNA, 25 bp, E. coli
acagaacggcctggcatccggatat

SEQ ID NO: 62717 - DNA, 25 bp, E. coli
acagaacggcctcgcatccggatat

SEQ ID NO: 62718 - DNA, 25 bp, E. coli
aacggcctggcttcgaaggtgcaga

SEQ ID NO: 62719 - DNA, 25 bp, E. coli
tggtgaaaatactgtgggccgatcg

SEQ ID NO: 62720 - DNA, 25 bp, E. coli
tggtgaaaatacagtgggccgatcg

SEQ ID NO: 62721 - DNA, 25 bp, E. coli
gccgcagtggcaaaatggtgaaaat

SEQ ID NO: 62722 - DNA, 25 bp, E. coli
gccgcagtggcataatggtgaaaat

SEQ ID NO: 62723 - DNA, 25 bp, E. coli
gaatctggatcatcgctggcatcac

SEQ ID NO: 62724 - DNA, 25 bp, E. coli
gaatctggatcaacgctggcatcac

SEQ ID NO: 62725 - DNA, 25 bp, E. coli
ggaagggaaagtccacctgacgcca

SEQ ID NO: 62726 - DNA, 25 bp, E. coli
ggaagggaaagtgcacctgacgcca

SEQ ID NO: 62727 - DNA, 25 bp, E. coli
gacgggttatgcctgttcgccaaac

SEQ ID NO: 62728 - DNA, 25 bp, E. coli
gatcgcatggcatcatcccaaacgg

SEQ ID NO: 62729 - DNA, 25 bp, E. coli
gatcgcatggcaacatcccaaacgg

SEQ ID NO: 62730 - DNA, 25 bp, E. coli
gacgggttatgcgtgttcgccaaac

SEQ ID NO: 62731 - DNA, 25 bp, E. coli
caacagcttggctcttcgggtggca

SEQ ID NO: 62732 - DNA, 25 bp, E. coli
caacagcttggcacttcgggtggca

SEQ ID NO: 62733 - DNA, 25 bp, E. coli
caaaagagctgggaacgaaggtgac

SEQ ID NO: 62734 - DNA, 25 bp, E. coli
caaaagagctggcaacgaaggtgac

SEQ ID NO: 62735 - DNA, 25 bp, E. coli
tacgtggccaaactgtactcggatg

SEQ ID NO: 62736 - DNA, 25 bp, E. coli
tacgtggccaaagtgtactcggatg

SEQ ID NO: 62737 - DNA, 25 bp, E. coli
ttctgatctaaatggcgctcgcccg

SEQ ID NO: 62738 - DNA, 25 bp, E. coli
ttctgatctaaaaggcgctcgcccg

SEQ ID NO: 62739 - DNA, 25 bp, E. coli
tgaagcaggataaaagacgcggtct

SEQ ID NO: 62740 - DNA, 25 bp, E. coli
tgaagcaggatataagacgcggtct

SEQ ID NO: 62741 - DNA, 25 bp, E. coli
tcgggtggcatccttaactcaagct

SEQ ID NO: 62742 - DNA, 25 bp, E. coli
tcgggtggcatcgttaactcaagct

SEQ ID NO: 62743 - DNA, 25 bp, E. coli
gctggatgagctacaaggatgcgca

SEQ ID NO: 62744 - DNA, 25 bp, E. coli
gctggatgagcttcaaggatgcgca

SEQ ID NO: 62745 - DNA, 25 bp, E. coli
gacttccgttggctactttctggca

SEQ ID NO: 62746 - DNA, 25 bp, E. coli
gacagatgccgaccgtgtaacgttg

SEQ ID NO: 62747 - DNA, 25 bp, E. coli
gacagatgccgagcgtgtaacgttg

SEQ ID NO: 62748 - DNA, 25 bp, E. coli
gacttccgttgggtactttctggca

SEQ ID NO: 62749 - DNA, 25 bp, E. coli
tcgaacttggcataacctacgtggc

SEQ ID NO: 62750 - DNA, 25 bp, E. coli
tcgaacttggcaaaacctacgtggc

SEQ ID NO: 62751 - DNA, 25 bp, E. coli
gtctgacccggaacgcattagcgct

SEQ ID NO: 62752 - DNA, 25 bp, E. coli
gtctgacccggatcgcattagcgct

SEQ ID NO: 62753 - DNA, 25 bp, E. coli
caagcacactgcaattgacggcggc

SEQ ID NO: 62754 - DNA, 25 bp, E. coli
caagcacactgctattgacggcggc

SEQ ID NO: 62755 - DNA, 25 bp, E. coli
taccggtctgatgggcgaacgtttt

SEQ ID NO: 62756 - DNA, 25 bp, E. coli
taccggtctgatcggcgaacgtttt

SEQ ID NO: 62757 - DNA, 25 bp, E. coli
tattcacaacatggaactggccggt

SEQ ID NO: 62758 - DNA, 25 bp, E. coli
tattcacaacatcgaactggccggt

SEQ ID NO: 62759 - DNA, 25 bp, E. coli
ttgatgtgatcgtcagccagagcgc

SEQ ID NO: 62760 - DNA, 25 bp, E. coli
ttgatgtgatcgacagccagagcgc

SEQ ID NO: 62761 - DNA, 25 bp, E. coli
tcatccgtcgaaagaagcgcagtct

SEQ ID NO: 62762 - DNA, 25 bp, E. coli
tctgaatgcgcaaaccacggaagtg

SEQ ID NO: 62763 - DNA, 25 bp, E. coli
tcatccgtcgaatgaagcgcagtct

SEQ ID NO: 62764 - DNA, 25 bp, E. coli
tctgaatgcgcataccacggaagtg

SEQ ID NO: 62765 - DNA, 25 bp, E. coli
gaagatcagtatcgcaccaaaggcg

SEQ ID NO: 62766 - DNA, 25 bp, E. coli
gaagataacagcatgccggtgcgta

SEQ ID NO: 62767 - DNA, 25 bp, E. coli
gaagataacagcttgccggtgcgta

SEQ ID NO: 62768 - DNA, 25 bp, E. coli
gaagatcagtatggcaccaaaggcg

SEQ ID NO: 62769 - DNA, 25 bp, E. coli
gacggttccgtacaagcagatcatc

SEQ ID NO: 62770 - DNA, 25 bp, E. coli
gaaagccgaccacgttctgcaggac

SEQ ID NO: 62771 - DNA, 25 bp, E. coli
gaaagccgaccaggttctgcaggac

SEQ ID NO: 62772 - DNA, 25 bp, E. coli
gaaacagcttctggcgcggtactga

SEQ ID NO: 62773 - DNA, 25 bp, E. coli
gaaacagcttctcgcgcggtactga

SEQ ID NO: 62774 - DNA, 25 bp, E. coli
gacggttccgtagaagcagatcatc

SEQ ID NO: 62775 - DNA, 25 bp, E. coli
aagaagccgttaataccgccgtgcg

SEQ ID NO: 62776 - DNA, 25 bp, E. coli
caagaagctgaagagtttgccgcac

SEQ ID NO: 62777 - DNA, 25 bp, E. coli
caagaagctgaacagtttgccgcac

SEQ ID NO: 62778 - DNA, 25 bp, E. coli
aagaagccgttattaccgccgtgcg

SEQ ID NO: 62779 - DNA, 25 bp, E. coli
cagcattcagcgactgttgcaggaa

SEQ ID NO: 62780 - DNA, 25 bp, E. coli
cagcattcagcgtctgttgcaggaa

SEQ ID NO: 62781 - DNA, 25 bp, E. coli
tactgaatggcttgctcgacggtca

SEQ ID NO: 62782 - DNA, 25 bp, E. coli
tactgaatggctagctcgacggtca

SEQ ID NO: 62783 - DNA, 25 bp, E. coli
agcgtgccgccgttattctgcgcga

SEQ ID NO: 62784 - DNA, 25 bp, E. coli
agcgtgccgccgatattctgcgcga

SEQ ID NO: 62785 - DNA, 25 bp, E. coli
tcgacggtcagattctcaagcgcag

SEQ ID NO: 62786 - DNA, 25 bp, E. coli
tcgacggtcagaatctcaagcgcag

SEQ ID NO: 62787 - DNA, 25 bp, E. coli
ccacgacgtgatgttgcgtatcgcc

SEQ ID NO: 62788 - DNA, 25 bp, E. coli
ccacgacgtgatcttgcgtatcgcc

SEQ ID NO: 62789 - DNA, 25 bp, E. coli
gaacggcagccgaaattatcaacct

SEQ ID NO: 62790 - DNA, 25 bp, E. coli
gaacggcagccgtaattatcaacct

SEQ ID NO: 62791 - DNA, 25 bp, E. coli
cattctggtgcaactgaagcgcgcc

SEQ ID NO: 62792 - DNA, 25 bp, E. coli
cattctggtgcatctgaagcgcgcc

SEQ ID NO: 62793 - DNA, 25 bp, E. coli
tcaagcgcagcaaaatgggcggcgt

SEQ ID NO: 62794 - DNA, 25 bp, E. coli
tcaagcgcagcataatgggcggcgt

SEQ ID NO: 62795 - DNA, 25 bp, E. coli
gatgagcatccggaaattatcgcca

SEQ ID NO: 62796 - DNA, 25 bp, E. coli
gatgagcatccgcaaattatcgcca

SEQ ID NO: 62797 - DNA, 25 bp, E. coli
aatcgccagtcgctttattgatggg

SEQ ID NO: 62798 - DNA, 25 bp, E. coli
aatcgccagtcggtttattgatggg

SEQ ID NO: 62799 - DNA, 25 bp, E. coli
cagcacaatcctttgctgcgctgtt

SEQ ID NO: 62800 - DNA, 25 bp, E. coli
cagcacaatcctatgctgcgctgtt

SEQ ID NO: 62801 - DNA, 25 bp, E. coli
agtaactgcagaatcacacaaagag

SEQ ID NO: 62802 - DNA, 25 bp, E. coli
agtaactgcagattcacacaaagag

SEQ ID NO: 62803 - DNA, 25 bp, E. coli
ccaaagatatgtgggttttcagcac

SEQ ID NO: 62804 - DNA, 25 bp, E. coli
gcccgcaagcggaaattcgtgccaa

SEQ ID NO: 62805 - DNA, 25 bp, E. coli
ccaaagatatgtcggttttcagcac

SEQ ID NO: 62806 - DNA, 25 bp, E. coli
gcccgcaagcggtaattcgtgccaa

SEQ ID NO: 62807 - DNA, 25 bp, E. coli
gcttaccggcaggacaatcctttgc

SEQ ID NO: 62808 - DNA, 25 bp, E. coli
gcttaccggcagcacaatcctttgc

SEQ ID NO: 62809 - DNA, 25 bp, E. coli
gaaattcgtgccaaagatatgtcgg

SEQ ID NO: 62810 - DNA, 25 bp, E. coli
gaaattcgtgcctaagatatgtcgg

SEQ ID NO: 62811 - DNA, 25 bp, E. coli
cgccagtgctggttgtaggacatat

SEQ ID NO: 62812 - DNA, 25 bp, E. coli
cgccagtgctggatgtaggacatat

SEQ ID NO: 62813 - DNA, 25 bp, E. coli
gttttacccgcttaccggcagcaca

SEQ ID NO: 62814 - DNA, 25 bp, E. coli
gattcacacaaacagacgccgtgcg

SEQ ID NO: 62815 - DNA, 25 bp, E. coli
gattcacacaaagagacgccgtgcg

SEQ ID NO: 62816 - DNA, 25 bp, E. coli
gttttacccgctaaccggcagcaca

SEQ ID NO: 62817 - DNA, 25 bp, E. coli
ggttttcagcaccttaatccgcgaa

SEQ ID NO: 62818 - DNA, 25 bp, E. coli
ggttttcagcacgttaatccgcgaa

SEQ ID NO: 62819 - DNA, 25 bp, E. coli
cttttacagggcttttggcagttga

SEQ ID NO: 62820 - DNA, 25 bp, E. coli
cttttacagggcatttggcagttga

SEQ ID NO: 62821 - DNA, 25 bp, E. coli
tatgagcgacatcgtcaccctgggt

SEQ ID NO: 62822 - DNA, 25 bp, E. coli
tatgagcgacatggtcaccctgggt

SEQ ID NO: 62823 - DNA, 25 bp, E. coli
ttcgcaacaaactttaaagattcag

SEQ ID NO: 62824 - DNA, 25 bp, E. coli
ttcgcaacaaacattaaagattcag

SEQ ID NO: 62825 - DNA, 25 bp, E. coli
ttacttatggtaaacacttgcccca

SEQ ID NO: 62826 - DNA, 25 bp, E. coli
ttacttatggtatacacttgcccca

SEQ ID NO: 62827 - DNA, 25 bp, E. coli
cctgtcagagatgaaaaaagtaggc

SEQ ID NO: 62828 - DNA, 25 bp, E. coli
cctgtcagagatcaaaaaagtaggc

SEQ ID NO: 62829 - DNA, 25 bp, E. coli
gtaaactaaaaggtaaagcgcctat

SEQ ID NO: 62830 - DNA, 25 bp, E. coli
gtaaactaaaagctaaagcgcctat

SEQ ID NO: 62831 - DNA, 25 bp, E. coli
ccgagagaattaatgttttggcacc

SEQ ID NO: 62832 - DNA, 25 bp, E. coli
ccgagagaattattgttttggcacc

SEQ ID NO: 62833 - DNA, 25 bp, E. coli
ctggagaaattacatgccgagagaa

SEQ ID NO: 62834 - DNA, 25 bp, E. coli
ctggagaaattagatgccgagagaa

SEQ ID NO: 62835 - DNA, 25 bp, E. coli
gataaaaatcaattccctgtcagag

SEQ ID NO: 62836 - DNA, 25 bp, E. coli
gtcaccctgggtatcacatcttatt

SEQ ID NO: 62837 - DNA, 25 bp, E. coli
gataaaaatcaaatccctgtcagag

SEQ ID NO: 62838 - DNA, 25 bp, E. coli
gtcaccctgggtttcacatcttatt

SEQ ID NO: 62839 - DNA, 25 bp, E. coli
tggcaccttatctcatcagtaaact

SEQ ID NO: 62840 - DNA, 25 bp, E. coli
tggcaccttatcacatcagtaaact

SEQ ID NO: 62841 - DNA, 25 bp, E. coli
agcgggaagcttatcatgaaaccga

SEQ ID NO: 62842 - DNA, 25 bp, E. coli
agcgggaagcttttcatgaaaccga

SEQ ID NO: 62843 - DNA, 25 bp, E. coli
tagtgaggaagtaacggttaaagag

SEQ ID NO: 62844 - DNA, 25 bp, E. coli
tagtgaggaagttacggttaaagag

SEQ ID NO: 62845 - DNA, 25 bp, E. coli
tgattgtcactggatactccagcgg

SEQ ID NO: 62846 - DNA, 25 bp, E. coli
tgtcactggatagtccagcggtatg

SEQ ID NO: 62847 - DNA, 25 bp, E. coli
tgtcactggatactccagcggtatg

SEQ ID NO: 62848 - DNA, 25 bp, E. coli
tgattgtcactgcatactccagcgg

SEQ ID NO: 62849 - DNA, 25 bp, E. coli
tgagtgtcgttgctatgacggttac

SEQ ID NO: 62850 - DNA, 25 bp, E. coli
tgagtgtcgttggtatgacggttac

SEQ ID NO: 62851 - DNA, 25 bp, E. coli
gctttatggttactgaggaagttac

SEQ ID NO: 62852 - DNA, 25 bp, E. coli
gctttatggttagtgaggaagttac

SEQ ID NO: 62853 - DNA, 25 bp, E. coli
ccgcggatgattgtcactggatact

SEQ ID NO: 62854 - DNA, 25 bp, E. coli
ccgcggatgattctcactggatact

SEQ ID NO: 62855 - DNA, 25 bp, E. coli
ctccagcggtatcgttgagtgtcgt

SEQ ID NO: 62856 - DNA, 25 bp, E. coli
ctccagcggtatggttgagtgtcgt

SEQ ID NO: 62857 - DNA, 25 bp, E. coli
ctggatactccaccggtatggttga

SEQ ID NO: 62858 - DNA, 25 bp, E. coli
cggcccgcggatcattgtcactgga

SEQ ID NO: 62859 - DNA, 25 bp, E. coli
ctggatactccagcggtatggttga

SEQ ID NO: 62860 - DNA, 25 bp, E. coli
cggcccgcggatgattgtcactgga

SEQ ID NO: 62861 - DNA, 25 bp, E. coli
gggtcaagcgggtagcttttcatga

SEQ ID NO: 62862 - DNA, 25 bp, E. coli
gggtcaagcgggaagcttttcatga

SEQ ID NO: 62863 - DNA, 25 bp, E. coli
cacattgaggtaggtgatgctgcca

SEQ ID NO: 62864 - DNA, 25 bp, E. coli
cacattgaggtacgtgatgctgcca

SEQ ID NO: 62865 - DNA, 25 bp, E. coli
catcggctgatacattctgaacaag

SEQ ID NO: 62866 - DNA, 25 bp, E. coli
catcggctgatagattctgaacaag

SEQ ID NO: 62867 - DNA, 25 bp, E. coli
actgccggttgccagatagtcaaaa

SEQ ID NO: 62868 - DNA, 25 bp, E. coli
actgccggttgcgagatagtcaaaa

SEQ ID NO: 62869 - DNA, 25 bp, E. coli
tgaactcttcgtggcttaagaatcg

SEQ ID NO: 62870 - DNA, 25 bp, E. coli
tgaactcttcgtcgcttaagaatcg

SEQ ID NO: 62871 - DNA, 25 bp, E. coli
tgcgtgagagaagacactgccggtt

SEQ ID NO: 62872 - DNA, 25 bp, E. coli
tgcgtgagagaacacactgccggtt

SEQ ID NO: 62873 - DNA, 25 bp, E. coli
cctgctgcttttgtgatgcgtgaga

SEQ ID NO: 62874 - DNA, 25 bp, E. coli
cctgctgcttttctgatgcgtgaga

SEQ ID NO: 62875 - DNA, 25 bp, E. coli
gacatgccgttgaactatctgaact

SEQ ID NO: 62876 - DNA, 25 bp, E. coli
gacatgccgttgtactatctgaact

SEQ ID NO: 62877 - DNA, 25 bp, E. coli
cgccaatttgctcaagctttgtgaa

SEQ ID NO: 62878 - DNA, 25 bp, E. coli
cgccaatttgctgaagctttgtgaa

SEQ ID NO: 62879 - DNA, 25 bp, E. coli
ctttgtgaaaaaccccgcgcaagcg

SEQ ID NO: 62880 - DNA, 25 bp, E. coli
ctttgtgaaaaagcccgcgcaagcg

SEQ ID NO: 62881 - DNA, 25 bp, E. coli
gatagtcaaaagagacatgccgttg

SEQ ID NO: 62882 - DNA, 25 bp, E. coli
gatagtcaaaagtgacatgccgttg

SEQ ID NO: 62883 - DNA, 25 bp, E. coli
taagaatcgtagaaccatcggctga

SEQ ID NO: 62884 - DNA, 25 bp, E. coli
taagaatcgtagtaccatcggctga

SEQ ID NO: 62885 - DNA, 25 bp, E. coli
aagccccggcgcaatgaacaggaat

SEQ ID NO: 62886 - DNA, 25 bp, E. coli
aagccccggcgctatgaacaggaat

SEQ ID NO: 62887 - DNA, 25 bp, E. coli
caaactctcaatcgctatggctccg

SEQ ID NO: 62888 - DNA, 25 bp, E. coli
caaactctcaatggctatggctccg

SEQ ID NO: 62889 - DNA, 25 bp, E. coli
catttaccgcactggaaagtgtgga

SEQ ID NO: 62890 - DNA, 25 bp, E. coli
taaatgtcccgaatgcggtacgacg

SEQ ID NO: 62891 - DNA, 25 bp, E. coli
taaacgctcatgctatcagtgccag

SEQ ID NO: 62892 - DNA, 25 bp, E. coli
taaatgtcccgattgcggtacgacg

SEQ ID NO: 62893 - DNA, 25 bp, E. coli
taaacgctcatggtatcagtgccag

SEQ ID NO: 62894 - DNA, 25 bp, E. coli
tatgaagcaccaacggttaaacgct

SEQ ID NO: 62895 - DNA, 25 bp, E. coli
tatgaagcaccatcggttaaacgct

SEQ ID NO: 62896 - DNA, 25 bp, E. coli
tatggctccgcgtcaaagctgtcaa

SEQ ID NO: 62897 - DNA, 25 bp, E. coli
tatggctccgcgacaaagctgtcaa

SEQ ID NO: 62898 - DNA, 25 bp, E. coli
tgtcaagccgtcagcaaattcctgt

SEQ ID NO: 62899 - DNA, 25 bp, E. coli
tgtcaagccgtctgcaaattcctgt

SEQ ID NO: 62900 - DNA, 25 bp, E. coli
gccggaaaaacaacagcaaactctc

SEQ ID NO: 62901 - DNA, 25 bp, E. coli
gccggaaaaacatcagcaaactctc

SEQ ID NO: 62902 - DNA, 25 bp, E. coli
gaatcagagaaagcacaaatgccgg

SEQ ID NO: 62903 - DNA, 25 bp, E. coli
gaatcagagaaaccacaaatgccgg

SEQ ID NO: 62904 - DNA, 25 bp, E. coli
catttaccgcacaggaaagtgtgga

SEQ ID NO: 62905 - DNA, 25 bp, E. coli
gatacgataatcatgaagccccggc

SEQ ID NO: 62906 - DNA, 25 bp, E. coli
gatacgataatcttgaagccccggc

SEQ ID NO: 62907 - DNA, 25 bp, E. coli
caggtcgataccaaagcaattgaag

SEQ ID NO: 62908 - DNA, 25 bp, E. coli
catactacgctgacgcggattattc

SEQ ID NO: 62909 - DNA, 25 bp, E. coli
caggtcgatacctaagcaattgaag

SEQ ID NO: 62910 - DNA, 25 bp, E. coli
catactacgctgtcgcggattattc

SEQ ID NO: 62911 - DNA, 25 bp, E. coli
atatcgcctggtgatgctaaccggg

SEQ ID NO: 62912 - DNA, 25 bp, E. coli
acgctgtcgcggattattcgtatgg

SEQ ID NO: 62913 - DNA, 25 bp, E. coli
atatcgcctggtcatgctaaccggg

SEQ ID NO: 62914 - DNA, 25 bp, E. coli
acgctgtcgcggtttattcgtatgg

SEQ ID NO: 62915 - DNA, 25 bp, E. coli
tgaccaacaggtggataccaaagca

SEQ ID NO: 62916 - DNA, 25 bp, E. coli
tgaccaacaggtcgataccaaagca

SEQ ID NO: 62917 - DNA, 25 bp, E. coli
cgctggcggaagagcaaccaggtat

SEQ ID NO: 62918 - DNA, 25 bp, E. coli
cgctggcggaagtgcaaccaggtat

SEQ ID NO: 62919 - DNA, 25 bp, E. coli
cgataccaaagctattgaagcagat

SEQ ID NO: 62920 - DNA, 25 bp, E. coli
cgataccaaagcaattgaagcagat

SEQ ID NO: 62921 - DNA, 25 bp, E. coli
cgggatatcgccaggtgatgctaac

SEQ ID NO: 62922 - DNA, 25 bp, E. coli
cgggatatcgcctggtgatgctaac

SEQ ID NO: 62923 - DNA, 25 bp, E. coli
ctgttaaatgacgaacaggtcgata

SEQ ID NO: 62924 - DNA, 25 bp, E. coli
ctgttaaatgaccaacaggtcgata

SEQ ID NO: 62925 - DNA, 25 bp, E. coli
gtgatagccggcctgctgccagacg

SEQ ID NO: 62926 - DNA, 25 bp, E. coli
gtgatagccggcgtgctgccagacg

SEQ ID NO: 62927 - DNA, 25 bp, E. coli
ggtgattgcgctcatcagtgcggca

SEQ ID NO: 62928 - DNA, 25 bp, E. coli
ggtgattgcgctgatcagtgcggca

SEQ ID NO: 62929 - DNA, 25 bp, E. coli
aagcagatgcctaacgccgcgaact

SEQ ID NO: 62930 - DNA, 25 bp, E. coli
aagcagatgccttacgccgcgaact

SEQ ID NO: 62931 - DNA, 25 bp, E. coli
aacagtgctgggtttgtgcggcttc

SEQ ID NO: 62932 - DNA, 25 bp, E. coli
aacagtgctgggattgtgcggcttc

SEQ ID NO: 62933 - DNA, 25 bp, E. coli
tttgttgtcgaacccacgccgctcg

SEQ ID NO: 62934 - DNA, 25 bp, E. coli
tttgttgtcgaagccacgccgctcg

SEQ ID NO: 62935 - DNA, 25 bp, E. coli
tttgtgcggcttgactgcgcgaacg

SEQ ID NO: 62936 - DNA, 25 bp, E. coli
tttgtgcggcttcactgcgcgaacg

SEQ ID NO: 62937 - DNA, 25 bp, E. coli
tgccaggacaaatgcccgatgcagt

SEQ ID NO: 62938 - DNA, 25 bp, E. coli
tgccaggacaaaagcccgatgcagt

SEQ ID NO: 62939 - DNA, 25 bp, E. coli
gccaactacgatgttattttgaggt

SEQ ID NO: 62940 - DNA, 25 bp, E. coli
gcgcgtgattactttgccactttta

SEQ ID NO: 62941 - DNA, 25 bp, E. coli
gccaactacgatcttattttgaggt

SEQ ID NO: 62942 - DNA, 25 bp, E. coli
gcgcgtgattacattgccactttta

SEQ ID NO: 62943 - DNA, 25 bp, E. coli
gcgaacgcgggtaagatccgcagac

SEQ ID NO: 62944 - DNA, 25 bp, E. coli
gcgaacgcgggttagatccgcagac

SEQ ID NO: 62945 - DNA, 25 bp, E. coli
cgcgaactcgcctactacgatgtta

SEQ ID NO: 62946 - DNA, 25 bp, E. coli
cgccgctcgaagcagatgccttacg

SEQ ID NO: 62947 - DNA, 25 bp, E. coli
cgccgctcgaaggagatgccttacg

SEQ ID NO: 62948 - DNA, 25 bp, E. coli
ccgatgcagtgcaggcgcgtgatta

SEQ ID NO: 62949 - DNA, 25 bp, E. coli
cgcgaactcgccaactacgatgtta

SEQ ID NO: 62950 - DNA, 25 bp, E. coli
ccgatgcagtgctggcgcgtgatta

SEQ ID NO: 62951 - DNA, 25 bp, E. coli
caacttttgtattgatgttgttctc

SEQ ID NO: 62952 - DNA, 25 bp, E. coli
caacttttgtatagatgttgttctc

SEQ ID NO: 62953 - DNA, 25 bp, E. coli
tgtggactaaatctagttttggaaa

SEQ ID NO: 62954 - DNA, 25 bp, E. coli
tgtggactaaatgtagttttggaaa

SEQ ID NO: 62955 - DNA, 25 bp, E. coli
tatccccttttaaatccgcaagttg

SEQ ID NO: 62956 - DNA, 25 bp, E. coli
tagattgcctgtaattgaaaccaag

SEQ ID NO: 62957 - DNA, 25 bp, E. coli
tatccccttttatatccgcaagttg

SEQ ID NO: 62958 - DNA, 25 bp, E. coli
tagattgcctgttattgaaaccaag

SEQ ID NO: 62959 - DNA, 25 bp, E. coli
ttgaaaccaagcagaccggtcggcg

SEQ ID NO: 62960 - DNA, 25 bp, E. coli
ttgaaaccaagctgaccggtcggcg

SEQ ID NO: 62961 - DNA, 25 bp, E. coli
tgttctcttaaggttttagattgcc

SEQ ID NO: 62962 - DNA, 25 bp, E. coli
tgttctcttaagcttttagattgcc

SEQ ID NO: 62963 - DNA, 25 bp, E. coli
tcagtatttttacatgataaccctg

SEQ ID NO: 62964 - DNA, 25 bp, E. coli
tcagtatttttagatgataaccctg

SEQ ID NO: 62965 - DNA, 25 bp, E. coli
gaacggaattatcttacaaggacaa

SEQ ID NO: 62966 - DNA, 25 bp, E. coli
gaacggaattatgttacaaggacaa

SEQ ID NO: 62967 - DNA, 25 bp, E. coli
cgcaagttgcgtgattttcttatcc

SEQ ID NO: 62968 - DNA, 25 bp, E. coli
cgcaagttgcgtcattttcttatcc

SEQ ID NO: 62969 - DNA, 25 bp, E. coli
gataaccctgttgaatttgtggact

SEQ ID NO: 62970 - DNA, 25 bp, E. coli
gataaccctgttcaatttgtggact

SEQ ID NO: 62971 - DNA, 25 bp, E. coli
tcaggtatccccatttaaatccgca

SEQ ID NO: 62972 - DNA, 25 bp, E. coli
tcaggtatccccttttaaatccgca

SEQ ID NO: 62973 - DNA, 25 bp, E. coli
cagccgatgtatgacgagtttgccg

SEQ ID NO: 62974 - DNA, 25 bp, E. coli
cagccgatgtatcacgagtttgccg

SEQ ID NO: 62975 - DNA, 25 bp, E. coli
cagtgaaatttgaagcggcgcgtca

SEQ ID NO: 62976 - DNA, 25 bp, E. coli
cagtgaaatttgtagcggcgcgtca

SEQ ID NO: 62977 - DNA, 25 bp, E. coli
tttaccgatccggaactggcgcgtg

SEQ ID NO: 62978 - DNA, 25 bp, E. coli
ttactgctggcactggaagccgcca

SEQ ID NO: 62979 - DNA, 25 bp, E. coli
tttaccgatccgcaactggcgcgtg

SEQ ID NO: 62980 - DNA, 25 bp, E. coli
ttactgctggcagtggaagccgcca

SEQ ID NO: 62981 - DNA, 25 bp, E. coli
tgcacacggcaaatatcgcggcgaa

SEQ ID NO: 62982 - DNA, 25 bp, E. coli
tgaagaaaatgtccgccagacgcgg

SEQ ID NO: 62983 - DNA, 25 bp, E. coli
tgcacacggcaattatcgcggcgaa

SEQ ID NO: 62984 - DNA, 25 bp, E. coli
tgaagaaaatgtgcgccagacgcgg

SEQ ID NO: 62985 - DNA, 25 bp, E. coli
tcggtaatgtttgatggctccacgc

SEQ ID NO: 62986 - DNA, 25 bp, E. coli
tcggtaatgtttcatggctccacgc

SEQ ID NO: 62987 - DNA, 25 bp, E. coli
tcagggattagccatgccgatttcc

SEQ ID NO: 62988 - DNA, 25 bp, E. coli
tcagggattagcgatgccgatttcc

SEQ ID NO: 62989 - DNA, 25 bp, E. coli
gaaaatgtgccaagccgttggcgta

SEQ ID NO: 62990 - DNA, 25 bp, E. coli
gaaaatgtgccatgccgttggcgta

SEQ ID NO: 62991 - DNA, 25 bp, E. coli
cgtgattttgtccaccgtaccggca

SEQ ID NO: 62992 - DNA, 25 bp, E. coli
cgtgattttgtcgaccgtaccggca

SEQ ID NO: 62993 - DNA, 25 bp, E. coli
gatttctctcgcagaagggctggca

SEQ ID NO: 62994 - DNA, 25 bp, E. coli
gatttctctcgctgaagggctggca

SEQ ID NO: 62995 - DNA, 25 bp, E. coli
atctggcctgcgctgcgtgacggta

SEQ ID NO: 62996 - DNA, 25 bp, E. coli
atctggcctgcggtgcgtgacggta

SEQ ID NO: 62997 - DNA, 25 bp, E. coli
atgctgatggtcagtgcctgttcac

SEQ ID NO: 62998 - DNA, 25 bp, E. coli
atgctgatggtctgtgcctgttcac

SEQ ID NO: 62999 - DNA, 25 bp, E. coli
tgctgatggtctgtgcctgttcacc

SEQ ID NO: 63000 - DNA, 25 bp, E. coli
tgctgatggtctctgcctgttcacc

SEQ ID NO: 63001 - DNA, 25 bp, E. coli
tctggcctgcggagcgtgacggtaa

SEQ ID NO: 63002 - DNA, 25 bp, E. coli
tctggcctgcggtgcgtgacggtaa

SEQ ID NO: 63003 - DNA, 25 bp, E. coli
gctgatggtctgtgcctgttcacca

SEQ ID NO: 63004 - DNA, 25 bp, E. coli
gctgatggtctgagcctgttcacca

SEQ ID NO: 63005 - DNA, 25 bp, E. coli
ctggcctgcggtgcgtgacggtaag

SEQ ID NO: 63006 - DNA, 25 bp, E. coli
ctgatggtctgtccctgttcaccaa

SEQ ID NO: 63007 - DNA, 25 bp, E. coli
ctgatggtctgtgcctgttcaccaa

SEQ ID NO: 63008 - DNA, 25 bp, E. coli
ctggcctgcggtccgtgacggtaag

SEQ ID NO: 63009 - DNA, 25 bp, E. coli
gatgctgatggtctgtgcctgttca

SEQ ID NO: 63010 - DNA, 25 bp, E. coli
gatgctgatggtgtgtgcctgttca

SEQ ID NO: 63011 - DNA, 25 bp, E. coli
aatatctggagctggcgttgctggc

SEQ ID NO: 63012 - DNA, 25 bp, E. coli
aatatctggagcaggcgttgctggc

SEQ ID NO: 63013 - DNA, 25 bp, E. coli
caggttcgatagatggttactacta

SEQ ID NO: 63014 - DNA, 25 bp, E. coli
caggttcgatagttggttactacta

SEQ ID NO: 63015 - DNA, 25 bp, E. coli
taaagtgctggttgcgacaacggcg

SEQ ID NO: 63016 - DNA, 25 bp, E. coli
taaaattaaagtgctggttgcgaca

SEQ ID NO: 63017 - DNA, 25 bp, E. coli
taaaattaaagtcctggttgcgaca

SEQ ID NO: 63018 - DNA, 25 bp, E. coli
taaagtgctggtagcgacaacggcg

SEQ ID NO: 63019 - DNA, 25 bp, E. coli
taccagatgccaggttcgatagttg

SEQ ID NO: 63020 - DNA, 25 bp, E. coli
taccagatgccacgttcgatagttg

SEQ ID NO: 63021 - DNA, 25 bp, E. coli
tattcattaccagatgccaggttcg

SEQ ID NO: 63022 - DNA, 25 bp, E. coli
tattcattaccacatgccaggttcg

SEQ ID NO: 63023 - DNA, 25 bp, E. coli
ttgttattcatttccagatgccagg

SEQ ID NO: 63024 - DNA, 25 bp, E. coli
ttgttattcattaccagatgccagg

SEQ ID NO: 63025 - DNA, 25 bp, E. coli
tggttgcgacaagggcgctgggaat

SEQ ID NO: 63026 - DNA, 25 bp, E. coli
ccagggaatatctggagcaggcgtt

SEQ ID NO: 63027 - DNA, 25 bp, E. coli
ccagggaatatcaggagcaggcgtt

SEQ ID NO: 63028 - DNA, 25 bp, E. coli
ctgggaatgggcattgacaaaccgg

SEQ ID NO: 63029 - DNA, 25 bp, E. coli
ctgggaatgggctttgacaaaccgg

SEQ ID NO: 63030 - DNA, 25 bp, E. coli
tgggctttgacaaaccggatttggg

SEQ ID NO: 63031 - DNA, 25 bp, E. coli
tggttgcgacaacggcgctgggaat

SEQ ID NO: 63032 - DNA, 25 bp, E. coli
tgggctttgacataccggatttggg

SEQ ID NO: 63033 - DNA, 25 bp, E. coli
caacggacctggtgacgccgtatct

SEQ ID NO: 63034 - DNA, 25 bp, E. coli
cacaaagatggaccaacggacctgg

SEQ ID NO: 63035 - DNA, 25 bp, E. coli
caaagatggaccaacggacctggtg

SEQ ID NO: 63036 - DNA, 25 bp, E. coli
caacggacctggagacgccgtatct

SEQ ID NO: 63037 - DNA, 25 bp, E. coli
caaagatggacctacggacctggtg

SEQ ID NO: 63038 - DNA, 25 bp, E. coli
cacaaagatggagcaacggacctgg

SEQ ID NO: 63039 - DNA, 25 bp, E. coli
accgttcgcgacctggctgcaaatc

SEQ ID NO: 63040 - DNA, 25 bp, E. coli
aaagatggaccaacggacctggtga

SEQ ID NO: 63041 - DNA, 25 bp, E. coli
aaagatggaccatcggacctggtga

SEQ ID NO: 63042 - DNA, 25 bp, E. coli
accgttcgcgacgtggctgcaaatc

SEQ ID NO: 63043 - DNA, 25 bp, E. coli
gaccaacggaccaggtgacgccgta

SEQ ID NO: 63044 - DNA, 25 bp, E. coli
gaccaacggacctggtgacgccgta

SEQ ID NO: 63045 - DNA, 25 bp, E. coli
gaaatcaccgttcgcgacctggctg

SEQ ID NO: 63046 - DNA, 25 bp, E. coli
gaaatcaccgttggcgacctggctg

SEQ ID NO: 63047 - DNA, 25 bp, E. coli
ctggtgacgccgaatctgtccacgt

SEQ ID NO: 63048 - DNA, 25 bp, E. coli
cggacctggtgaggccgtatctgtc

SEQ ID NO: 63049 - DNA, 25 bp, E. coli
ctggtgacgccgtatctgtccacgt

SEQ ID NO: 63050 - DNA, 25 bp, E. coli
cggacctggtgacgccgtatctgtc

SEQ ID NO: 63051 - DNA, 25 bp, E. coli
gatggaccaacgcacctggtgacgc

SEQ ID NO: 63052 - DNA, 25 bp, E. coli
gatggaccaacggacctggtgacgc

SEQ ID NO: 63053 - DNA, 25 bp, E. coli
gatccacaaagatggaccaacggac

SEQ ID NO: 63054 - DNA, 25 bp, E. coli
gatccacaaagaaggaccaacggac

SEQ ID NO: 63055 - DNA, 25 bp, E. coli
aacgactgcgatgctgttgttgccg

SEQ ID NO: 63056 - DNA, 25 bp, E. coli
cactattcgccggtacgggtagtta

SEQ ID NO: 63057 - DNA, 25 bp, E. coli
cactattcgccgctacgggtagtta

SEQ ID NO: 63058 - DNA, 25 bp, E. coli
tacaacaacagctacgggtgtcggt

SEQ ID NO: 63059 - DNA, 25 bp, E. coli
tacaagtgcatctgcagggcaagca

SEQ ID NO: 63060 - DNA, 25 bp, E. coli
tacaacaacagcaacgggtgtcggt

SEQ ID NO: 63061 - DNA, 25 bp, E. coli
tacaagtgcatcagcagggcaagca

SEQ ID NO: 63062 - DNA, 25 bp, E. coli
aacgactgcgatcctgttgttgccg

SEQ ID NO: 63063 - DNA, 25 bp, E. coli
tttatttcgtctccgctggctgccg

SEQ ID NO: 63064 - DNA, 25 bp, E. coli
tttatttcgtctgcgctggctgccg

SEQ ID NO: 63065 - DNA, 25 bp, E. coli
tgttgccgctaatgctgccgttgca

SEQ ID NO: 63066 - DNA, 25 bp, E. coli
tgttgccgctaaagctgccgttgca

SEQ ID NO: 63067 - DNA, 25 bp, E. coli
tgaatactgactgggcagaccaggt

SEQ ID NO: 63068 - DNA, 25 bp, E. coli
tgaatactgactcggcagaccaggt

SEQ ID NO: 63069 - DNA, 25 bp, E. coli
gcaagcaaatgcagacgcgactttt

SEQ ID NO: 63070 - DNA, 25 bp, E. coli
gcaagcaaatgctgacgcgactttt

SEQ ID NO: 63071 - DNA, 25 bp, E. coli
gggaatagcttctcaaccaaccaga

SEQ ID NO: 63072 - DNA, 25 bp, E. coli
gggaatagcttcacaaccaaccaga

SEQ ID NO: 63073 - DNA, 25 bp, E. coli
tttctgcacgttataaaggcaccgg

SEQ ID NO: 63074 - DNA, 25 bp, E. coli
tttctgcacgttttaaaggcaccgg

SEQ ID NO: 63075 - DNA, 25 bp, E. coli
gatggcggtacatttcactttgaag

SEQ ID NO: 63076 - DNA, 25 bp, E. coli
gatggcggtacaattcactttgaag

SEQ ID NO: 63077 - DNA, 25 bp, E. coli
cagttcttctgcaggtggcggtagc

SEQ ID NO: 63078 - DNA, 25 bp, E. coli
cagttcttctgctggtggcggtagc

SEQ ID NO: 63079 - DNA, 25 bp, E. coli
aacagcaattgggtcgaccgtggga

SEQ ID NO: 63080 - DNA, 25 bp, E. coli
aacagcaattggctcgaccgtggga

SEQ ID NO: 63081 - DNA, 25 bp, E. coli
tatgcgagaaattacagaatcacag

SEQ ID NO: 63082 - DNA, 25 bp, E. coli
tatgcgagaaataacagaatcacag

SEQ ID NO: 63083 - DNA, 25 bp, E. coli
tggtcaggctggtaaaacggaagtt

SEQ ID NO: 63084 - DNA, 25 bp, E. coli
tggtcaggctggaaaaacggaagtt

SEQ ID NO: 63085 - DNA, 25 bp, E. coli
tcgaaggattctcgtctggtcaggc

SEQ ID NO: 63086 - DNA, 25 bp, E. coli
tcgccggaatacgtggtggtccact

SEQ ID NO: 63087 - DNA, 25 bp, E. coli
tcgccggaatacctggtggtccact

SEQ ID NO: 63088 - DNA, 25 bp, E. coli
tcgaaggattctggtctggtcaggc

SEQ ID NO: 63089 - DNA, 25 bp, E. coli
tcagctaatgctgcaggtgctgcag

SEQ ID NO: 63090 - DNA, 25 bp, E. coli
gctattgttggacctctcgccggaa

SEQ ID NO: 63091 - DNA, 25 bp, E. coli
gctattgttggagctctcgccggaa

SEQ ID NO: 63092 - DNA, 25 bp, E. coli
cgtatctgccggtttgacaacagca

SEQ ID NO: 63093 - DNA, 25 bp, E. coli
cgtatctgccggattgacaacagca

SEQ ID NO: 63094 - DNA, 25 bp, E. coli
ggttgtagttggtgccgtatctgcc

SEQ ID NO: 63095 - DNA, 25 bp, E. coli
ggtgcgccagcgtcttcagctaatg

SEQ ID NO: 63096 - DNA, 25 bp, E. coli
ggttgtagttggagccgtatctgcc

SEQ ID NO: 63097 - DNA, 25 bp, E. coli
ggtgcgccagcgacttcagctaatg

SEQ ID NO: 63098 - DNA, 25 bp, E. coli
tcagctaatgctccaggtgctgcag

SEQ ID NO: 63099 - DNA, 25 bp, E. coli
caattcttgtggcttatctctctga

SEQ ID NO: 63100 - DNA, 25 bp, E. coli
caattcttgtgggttatctctctga

SEQ ID NO: 63101 - DNA, 25 bp, E. coli
taaaaagggcttcggtaagatagct

SEQ ID NO: 63102 - DNA, 25 bp, E. coli
taaaaagggcttgggtaagatagct

SEQ ID NO: 63103 - DNA, 25 bp, E. coli
tgcgtttcctcggtttccttctggt

SEQ ID NO: 63104 - DNA, 25 bp, E. coli
tgttattctctctgtaaaggctgct

SEQ ID NO: 63105 - DNA, 25 bp, E. coli
tgttattctctcagtaaaggctgct

SEQ ID NO: 63106 - DNA, 25 bp, E. coli
tgcgtttcctcgctttccttctggt

SEQ ID NO: 63107 - DNA, 25 bp, E. coli
tgccagttctttagggtattccgtt

SEQ ID NO: 63108 - DNA, 25 bp, E. coli
tgccagttcttttgggtattccgtt

SEQ ID NO: 63109 - DNA, 25 bp, E. coli
cctctgactttgatcagggtgttca

SEQ ID NO: 63110 - DNA, 25 bp, E. coli
cctctgactttgttcagggtgttca

SEQ ID NO: 63111 - DNA, 25 bp, E. coli
cgtctaatgcgcttccctgttttta

SEQ ID NO: 63112 - DNA, 25 bp, E. coli
ttgggcttaactcaattcttgtggg

SEQ ID NO: 63113 - DNA, 25 bp, E. coli
ttgggcttaactgaattcttgtggg

SEQ ID NO: 63114 - DNA, 25 bp, E. coli
cgtctaatgcgcatccctgttttta

SEQ ID NO: 63115 - DNA, 25 bp, E. coli
gatattagcgctgaattaccctctg

SEQ ID NO: 63116 - DNA, 25 bp, E. coli
gatattagcgctcaattaccctctg

SEQ ID NO: 63117 - DNA, 25 bp, E. coli
ggtaactttgttgggctatctgctt

SEQ ID NO: 63118 - DNA, 25 bp, E. coli
ggtgttcagttaattctcccgtcta

SEQ ID NO: 63119 - DNA, 25 bp, E. coli
ggtaactttgttcggctatctgctt

SEQ ID NO: 63120 - DNA, 25 bp, E. coli
ggtgttcagttatttctcccgtcta

SEQ ID NO: 63121 - DNA, 25 bp, E. coli
catctgctaaggtgtatggagccga

SEQ ID NO: 63122 - DNA, 25 bp, E. coli
catctgctaaggagtatggagccga

SEQ ID NO: 63123 - DNA, 25 bp, E. coli
tatgacttgctccaaacacgacacg

SEQ ID NO: 63124 - DNA, 25 bp, E. coli
tatggcaaagctacagcgatccgct

SEQ ID NO: 63125 - DNA, 25 bp, E. coli
tagtaccgatgatgacaaggaacgc

SEQ ID NO: 63126 - DNA, 25 bp, E. coli
tagtaccgatgaagacaaggaacgc

SEQ ID NO: 63127 - DNA, 25 bp, E. coli
tatggcaaagcttcagcgatccgct

SEQ ID NO: 63128 - DNA, 25 bp, E. coli
tatgacttgctcgaaacacgacacg

SEQ ID NO: 63129 - DNA, 25 bp, E. coli
tatcagattgccctcaccgaagcgg

SEQ ID NO: 63130 - DNA, 25 bp, E. coli
tatcagattgccgtcaccgaagcgg

SEQ ID NO: 63131 - DNA, 25 bp, E. coli
ttgaagcgattatggccggtaagcc

SEQ ID NO: 63132 - DNA, 25 bp, E. coli
ttgaagcgattaaggccggtaagcc

SEQ ID NO: 63133 - DNA, 25 bp, E. coli
tctggcgatctggacgcggaatcaa

SEQ ID NO: 63134 - DNA, 25 bp, E. coli
tctggcgatctgcacgcggaatcaa

SEQ ID NO: 63135 - DNA, 25 bp, E. coli
gcacttttgtccagagcagcctatg

SEQ ID NO: 63136 - DNA, 25 bp, E. coli
gaattgctctattcgcgtcgcgaga

SEQ ID NO: 63137 - DNA, 25 bp, E. coli
gaagggcttgttgcttcgtcgccag

SEQ ID NO: 63138 - DNA, 25 bp, E. coli
gaagggcttgttccttcgtcgccag

SEQ ID NO: 63139 - DNA, 25 bp, E. coli
gcacttttgtcctgagcagcctatg

SEQ ID NO: 63140 - DNA, 25 bp, E. coli
gaattgctctatacgcgtcgcgaga

SEQ ID NO: 63141 - DNA, 25 bp, E. coli
gattcaacgtctcgaagcgaagggc

SEQ ID NO: 63142 - DNA, 25 bp, E. coli
gattcaacgtctggaagcgaagggc

SEQ ID NO: 63143 - DNA, 25 bp, E. coli
tatttttggtctgaacgtagccagc

SEQ ID NO: 63144 - DNA, 25 bp, E. coli
tattctggcgaagctggactgcgac

SEQ ID NO: 63145 - DNA, 25 bp, E. coli
tatttttggtctcaacgtagccagc

SEQ ID NO: 63146 - DNA, 25 bp, E. coli
tattctggcgaacctggactgcgac

SEQ ID NO: 63147 - DNA, 25 bp, E. coli
tggtggcgcaaatcgaactgctgaa

SEQ ID NO: 63148 - DNA, 25 bp, E. coli
tggtggcgcaaaacgaactgctgaa

SEQ ID NO: 63149 - DNA, 25 bp, E. coli
tgaacagtcgatcaccactccggtg

SEQ ID NO: 63150 - DNA, 25 bp, E. coli
tgaaagcgcagcaggcgatgcaact

SEQ ID NO: 63151 - DNA, 25 bp, E. coli
tgaaagcgcagctggcgatgcaact

SEQ ID NO: 63152 - DNA, 25 bp, E. coli
tgaacagtcgatgaccactccggtg

SEQ ID NO: 63153 - DNA, 25 bp, E. coli
tccgcgccctgcaggataaagtgct

SEQ ID NO: 63154 - DNA, 25 bp, E. coli
tccgcgccctgctggataaagtgct

SEQ ID NO: 63155 - DNA, 25 bp, E. coli
ccattgctgaaagacgcctggcagt

SEQ ID NO: 63156 - DNA, 25 bp, E. coli
ccattgctgaaacacgcctggcagt

SEQ ID NO: 63157 - DNA, 25 bp, E. coli
gcggcgcagtactacgggcaattta

SEQ ID NO: 63158 - DNA, 25 bp, E. coli
gcggcgcagtacaacgggcaattta

SEQ ID NO: 63159 - DNA, 25 bp, E. coli
gctgattgcgctgaaccgttctgaa

SEQ ID NO: 63160 - DNA, 25 bp, E. coli
gctgattgcgctcaaccgttctgaa

SEQ ID NO: 63161 - DNA, 25 bp, E. coli
gaaaaccattcccttgcaggatcag

SEQ ID NO: 63162 - DNA, 25 bp, E. coli
gaaaaccattccgttgcaggatcag

SEQ ID NO: 63163 - DNA, 25 bp, E. coli
tcaacagttgcatcagcaggtggcg

SEQ ID NO: 63164 - DNA, 25 bp, E. coli
tcaacagttgcaacagcaggtggcg

SEQ ID NO: 63165 - DNA, 25 bp, E. coli
taaaaccatctcagcctactgggat

SEQ ID NO: 63166 - DNA, 25 bp, E. coli
taaacacattaagctacagcgcggc

SEQ ID NO: 63167 - DNA, 25 bp, E. coli
taaaaccatctctgcctactgggat

SEQ ID NO: 63168 - DNA, 25 bp, E. coli
taaacacattaacctacagcgcggc

SEQ ID NO: 63169 - DNA, 25 bp, E. coli
tacgaacaggatatgacgcaggcgc

SEQ ID NO: 63170 - DNA, 25 bp, E. coli
tacgaacaggatttgacgcaggcgc

SEQ ID NO: 63171 - DNA, 25 bp, E. coli
tgactacaacgaaaatctctggctg

SEQ ID NO: 63172 - DNA, 25 bp, E. coli
tgactacaacgataatctctggctg

SEQ ID NO: 63173 - DNA, 25 bp, E. coli
tgagcgcactggttgaaaacttgcc

SEQ ID NO: 63174 - DNA, 25 bp, E. coli
tgagcgcactggatgaaaacttgcc

SEQ ID NO: 63175 - DNA, 25 bp, E. coli
tctggtaacgaaaagcagcacagct

SEQ ID NO: 63176 - DNA, 25 bp, E. coli
tctggtaacgaatagcagcacagct

SEQ ID NO: 63177 - DNA, 25 bp, E. coli
gcttgcttaaaccaggccgcgatca

SEQ ID NO: 63178 - DNA, 25 bp, E. coli
gcttgcttaaacgaggccgcgatca

SEQ ID NO: 63179 - DNA, 25 bp, E. coli
gaagagagtgacgacctgaatgccc

SEQ ID NO: 63180 - DNA, 25 bp, E. coli
gaagagagtgaccacctgaatgccc

SEQ ID NO: 63181 - DNA, 25 bp, E. coli
gatcagggaattctcaccatcgcca

SEQ ID NO: 63182 - DNA, 25 bp, E. coli
gataatctggatctcgccctggtgg

SEQ ID NO: 63183 - DNA, 25 bp, E. coli
gataatctggatgtcgccctggtgg

SEQ ID NO: 63184 - DNA, 25 bp, E. coli
gatcagggaattgtcaccatcgcca

SEQ ID NO: 63185 - DNA, 25 bp, E. coli
ggtaaactcgaatgccgctatcacg

SEQ ID NO: 63186 - DNA, 25 bp, E. coli
ggtaaactcgaaagccgctatcacg

SEQ ID NO: 63187 - DNA, 25 bp, E. coli
cacacaccgtttttcttcgcattct

SEQ ID NO: 63188 - DNA, 25 bp, E. coli
cacacaccgtttatcttcgcattct

SEQ ID NO: 63189 - DNA, 25 bp, E. coli
atgaaacacacaccgtttttcttcg

SEQ ID NO: 63190 - DNA, 25 bp, E. coli
atgaaacacacagcgtttttcttcg

SEQ ID NO: 63191 - DNA, 25 bp, E. coli
cacaccgtttttgttcgcattcttt

SEQ ID NO: 63192 - DNA, 25 bp, E. coli
acacaccgttttacttcgcattctt

SEQ ID NO: 63193 - DNA, 25 bp, E. coli
acacaccgtttttcttcgcattctt

SEQ ID NO: 63194 - DNA, 25 bp, E. coli
aaacacacaccgtttttcttcgcat

SEQ ID NO: 63195 - DNA, 25 bp, E. coli
aacacacaccgtttttcttcgcatt

SEQ ID NO: 63196 - DNA, 25 bp, E. coli
acacacaccgttattcttcgcattc

SEQ ID NO: 63197 - DNA, 25 bp, E. coli
acacacaccgtttttcttcgcattc

SEQ ID NO: 63198 - DNA, 25 bp, E. coli
aaacacacaccgattttcttcgcat

SEQ ID NO: 63199 - DNA, 25 bp, E. coli
cacaccgtttttcttcgcattcttt

SEQ ID NO: 63200 - DNA, 25 bp, E. coli
aacacacaccgtatttcttcgcatt

SEQ ID NO: 63201 - DNA, 25 bp, E. coli
tgaaacacacacggtttttcttcgc

SEQ ID NO: 63202 - DNA, 25 bp, E. coli
tgaaacacacaccgtttttcttcgc

SEQ ID NO: 63203 - DNA, 25 bp, E. coli
gaaacacacaccgtttttcttcgca

SEQ ID NO: 63204 - DNA, 25 bp, E. coli
gaaacacacaccctttttcttcgca

SEQ ID NO: 63205 - DNA, 25 bp, E. coli
tcgcattcttttttaccttcccctg

SEQ ID NO: 63206 - DNA, 25 bp, E. coli
tcgcattcttttataccttcccctg

SEQ ID NO: 63207 - DNA, 25 bp, E. coli
tacactcagcttattgcgacgcgaa

SEQ ID NO: 63208 - DNA, 25 bp, E. coli
tacactcagctttttgcgacgcgaa

SEQ ID NO: 63209 - DNA, 25 bp, E. coli
aacacgcgtaaaaattttgcgccaa

SEQ ID NO: 63210 - DNA, 25 bp, E. coli
aacacgcgtaaatattttgcgccaa

SEQ ID NO: 63211 - DNA, 25 bp, E. coli
tattctgctgggaaattccctgctg

SEQ ID NO: 63212 - DNA, 25 bp, E. coli
tattctgcttagtaaaacacgcgta

SEQ ID NO: 63213 - DNA, 25 bp, E. coli
tattctgctgggtaattccctgctg

SEQ ID NO: 63214 - DNA, 25 bp, E. coli
tattctgcttagaaaaacacgcgta

SEQ ID NO: 63215 - DNA, 25 bp, E. coli
tgcttataagaggatggccacagac

SEQ ID NO: 63216 - DNA, 25 bp, E. coli
tgcttataagagcatggccacagac

SEQ ID NO: 63217 - DNA, 25 bp, E. coli
tgctgatttagcatgttacatcgcg

SEQ ID NO: 63218 - DNA, 25 bp, E. coli
tgctgatttagcttgttacatcgcg

SEQ ID NO: 63219 - DNA, 25 bp, E. coli
gaaatcgtgcgcaaaagctggcact

SEQ ID NO: 63220 - DNA, 25 bp, E. coli
gaaatcgtgcgctaaagctggcact

SEQ ID NO: 63221 - DNA, 25 bp, E. coli
ggagttccgcgctctttttaacgat

SEQ ID NO: 63222 - DNA, 25 bp, E. coli
ggagttccgcgcactttttaacgat

SEQ ID NO: 63223 - DNA, 25 bp, E. coli
ggcgcatgtttctttttcgcaccat

SEQ ID NO: 63224 - DNA, 25 bp, E. coli
ggcgcatgtttcattttcgcaccat

SEQ ID NO: 63225 - DNA, 25 bp, E. coli
tggccacagacacgtaaaagacgtt

SEQ ID NO: 63226 - DNA, 25 bp, E. coli
tggccacagacaggtaaaagacgtt

SEQ ID NO: 63227 - DNA, 25 bp, E. coli
gataattttcgcctcacaggaagca

SEQ ID NO: 63228 - DNA, 25 bp, E. coli
gataattttcgcgtcacaggaagca

SEQ ID NO: 63229 - DNA, 25 bp, E. coli
caatcaggcgagaggtttcgtaggc

SEQ ID NO: 63230 - DNA, 25 bp, E. coli
aatggtgcccacatcgataatgtcg

SEQ ID NO: 63231 - DNA, 25 bp, E. coli
caatcaggcgagtggtttcgtaggc

SEQ ID NO: 63232 - DNA, 25 bp, E. coli
aatggtgcccacttcgataatgtcg

SEQ ID NO: 63233 - DNA, 25 bp, E. coli
cagttcgatctgcacgtcgccgtta

SEQ ID NO: 63234 - DNA, 25 bp, E. coli
cagttcgatctggacgtcgccgtta

SEQ ID NO: 63235 - DNA, 25 bp, E. coli
caggtccagtaaccggtcagttcga

SEQ ID NO: 63236 - DNA, 25 bp, E. coli
caggtccagtaagcggtcagttcga

SEQ ID NO: 63237 - DNA, 25 bp, E. coli
ttaaactcttttcccacgtccagcg

SEQ ID NO: 63238 - DNA, 25 bp, E. coli
ttaaactcttttgccacgtccagcg

SEQ ID NO: 63239 - DNA, 25 bp, E. coli
tttgaagcccatatcggaaagacgt

SEQ ID NO: 63240 - DNA, 25 bp, E. coli
tttgaagcccatttcggaaagacgt

SEQ ID NO: 63241 - DNA, 25 bp, E. coli
tcgtaggcgctatccatagtctggt

SEQ ID NO: 63242 - DNA, 25 bp, E. coli
tcgtaggcgctaaccatagtctggt

SEQ ID NO: 63243 - DNA, 25 bp, E. coli
tctggttgtccaccgcgacttgcaa

SEQ ID NO: 63244 - DNA, 25 bp, E. coli
tctggttgtccagcgcgacttgcaa

SEQ ID NO: 63245 - DNA, 25 bp, E. coli
gcaattttggcgtctgccagtacga

SEQ ID NO: 63246 - DNA, 25 bp, E. coli
gcaattttggcgactgccagtacga

SEQ ID NO: 63247 - DNA, 25 bp, E. coli
cggtgttgatatgcgcacagcaaat

SEQ ID NO: 63248 - DNA, 25 bp, E. coli
cggtgttgatatccgcacagcaaat

SEQ ID NO: 63249 - DNA, 25 bp, E. coli
tcacggctgcggtgataaaccacct

SEQ ID NO: 63250 - DNA, 25 bp, E. coli
tcacggctgcggagataaaccacct

SEQ ID NO: 63251 - DNA, 25 bp, E. coli
catcatgaaatgaaccggcaggaca

SEQ ID NO: 63252 - DNA, 25 bp, E. coli
catcatgaaatgtaccggcaggaca

SEQ ID NO: 63253 - DNA, 25 bp, E. coli
tacaccatatgcagtagcgaacagc

SEQ ID NO: 63254 - DNA, 25 bp, E. coli
tacaccatatgctgtagcgaacagc

SEQ ID NO: 63255 - DNA, 25 bp, E. coli
cttggcagaactgtggaggacttac

SEQ ID NO: 63256 - DNA, 25 bp, E. coli
cttggcagaactctggaggacttac

SEQ ID NO: 63257 - DNA, 25 bp, E. coli
tacctgaacatgttgtgatcgagca

SEQ ID NO: 63258 - DNA, 25 bp, E. coli
tacctgaacatgatgtgatcgagca

SEQ ID NO: 63259 - DNA, 25 bp, E. coli
tttatcgactgtgaagcggcactgg

SEQ ID NO: 63260 - DNA, 25 bp, E. coli
tttatcgactgtcaagcggcactgg

SEQ ID NO: 63261 - DNA, 25 bp, E. coli
tgacaccggagtccatcagatgcgt

SEQ ID NO: 63262 - DNA, 25 bp, E. coli
tgacaccggagtgcatcagatgcgt

SEQ ID NO: 63263 - DNA, 25 bp, E. coli
ccagatctaagctgtcttggcagaa

SEQ ID NO: 63264 - DNA, 25 bp, E. coli
ccagatctaagcagtcttggcagaa

SEQ ID NO: 63265 - DNA, 25 bp, E. coli
gcggcactggaataacggaatcatc

SEQ ID NO: 63266 - DNA, 25 bp, E. coli
gcggcactggaaaaacggaatcatc

SEQ ID NO: 63267 - DNA, 25 bp, E. coli
gaaaggtggattaactcaggctgag

SEQ ID NO: 63268 - DNA, 25 bp, E. coli
gacacgcttgtcattccagatctaa

SEQ ID NO: 63269 - DNA, 25 bp, E. coli
gacacgcttgtctttccagatctaa

SEQ ID NO: 63270 - DNA, 25 bp, E. coli
gaaaggtggatttactcaggctgag

SEQ ID NO: 63271 - DNA, 25 bp, E. coli
ggagggaagcaattaccgacgtgat

SEQ ID NO: 63272 - DNA, 25 bp, E. coli
ggagggaagcaaataccgacgtgat

SEQ ID NO: 63273 - DNA, 25 bp, E. coli
cagtccgggtaaatcactattcgaa

SEQ ID NO: 63274 - DNA, 25 bp, E. coli
cagtccgggtaattcactattcgaa

SEQ ID NO: 63275 - DNA, 25 bp, E. coli
tactggcctacgcttcgaatttgca

SEQ ID NO: 63276 - DNA, 25 bp, E. coli
tactggcctacggttcgaatttgca

SEQ ID NO: 63277 - DNA, 25 bp, E. coli
accgcatctggcaacgaacgccttg

SEQ ID NO: 63278 - DNA, 25 bp, E. coli
accgcatctggctacgaacgccttg

SEQ ID NO: 63279 - DNA, 25 bp, E. coli
tttgttggcaaatcatctggtctca

SEQ ID NO: 63280 - DNA, 25 bp, E. coli
tttgttggcaaaacatctggtctca

SEQ ID NO: 63281 - DNA, 25 bp, E. coli
tctggtctcatgacgctgtcaaacg

SEQ ID NO: 63282 - DNA, 25 bp, E. coli
tctggtctcatgtcgctgtcaaacg

SEQ ID NO: 63283 - DNA, 25 bp, E. coli
gccttgcctgacttaaaagtgccgg

SEQ ID NO: 63284 - DNA, 25 bp, E. coli
gccttgcctgacataaaagtgccgg

SEQ ID NO: 63285 - DNA, 25 bp, E. coli
gctgcgatataagcttgagccacat

SEQ ID NO: 63286 - DNA, 25 bp, E. coli
gctgcgatataaccttgagccacat

SEQ ID NO: 63287 - DNA, 25 bp, E. coli
cgaatttgcacgtaatcgtagggca

SEQ ID NO: 63288 - DNA, 25 bp, E. coli
cgaatttgcacgaaatcgtagggca

SEQ ID NO: 63289 - DNA, 25 bp, E. coli
gttaatgagaaagaagtaggcacct

SEQ ID NO: 63290 - DNA, 25 bp, E. coli
gttaatgagaaacaagtaggcacct

SEQ ID NO: 63291 - DNA, 25 bp, E. coli
tgtcaaacgcccgatgaggtagtta

SEQ ID NO: 63292 - DNA, 25 bp, E. coli
tgtcaaacgccccatgaggtagtta

SEQ ID NO: 63293 - DNA, 25 bp, E. coli
taattaaacattagccagtccgggt

SEQ ID NO: 63294 - DNA, 25 bp, E. coli
taattaaacatttgccagtccgggt

SEQ ID NO: 63295 - DNA, 25 bp, E. coli
cacacgtcagcaattgcaggaggca

SEQ ID NO: 63296 - DNA, 25 bp, E. coli
cacacgtcagcatttgcaggaggca

SEQ ID NO: 63297 - DNA, 25 bp, E. coli
tacgttatctcatccggctctcggg

SEQ ID NO: 63298 - DNA, 25 bp, E. coli
tacgttatctcaaccggctctcggg

SEQ ID NO: 63299 - DNA, 25 bp, E. coli
tatcccgggcgctacaacatgatct

SEQ ID NO: 63300 - DNA, 25 bp, E. coli
tatcccgggcgcaacaacatgatct

SEQ ID NO: 63301 - DNA, 25 bp, E. coli
ttatcagggaaagcataaccgctgc

SEQ ID NO: 63302 - DNA, 25 bp, E. coli
ttatcagggaaaccataaccgctgc

SEQ ID NO: 63303 - DNA, 25 bp, E. coli
ccagagagcgcctatttaagcggca

SEQ ID NO: 63304 - DNA, 25 bp, E. coli
ccagagagcgccaatttaagcggca

SEQ ID NO: 63305 - DNA, 25 bp, E. coli
gctggcgggcactaccttttactga

SEQ ID NO: 63306 - DNA, 25 bp, E. coli
gctggcgggcacaaccttttactga

SEQ ID NO: 63307 - DNA, 25 bp, E. coli
gtttctggaaggaaagcacgctctc

SEQ ID NO: 63308 - DNA, 25 bp, E. coli
gtacaaaaacaaaggcggcagcgcc

SEQ ID NO: 63309 - DNA, 25 bp, E. coli
gtttctggaaggtaagcacgctctc

SEQ ID NO: 63310 - DNA, 25 bp, E. coli
gtacaaaaacaatggcggcagcgcc

SEQ ID NO: 63311 - DNA, 25 bp, E. coli
ggtaaaacaatgctcgccagccgta

SEQ ID NO: 63312 - DNA, 25 bp, E. coli
ggttatcgattcctgcctggcagcg

SEQ ID NO: 63313 - DNA, 25 bp, E. coli
ggttatcgattcgtgcctggcagcg

SEQ ID NO: 63314 - DNA, 25 bp, E. coli
ggtaaaacaatggtcgccagccgta

SEQ ID NO: 63315 - DNA, 25 bp, E. coli
gatgagctacctcaatttgaacggc

SEQ ID NO: 63316 - DNA, 25 bp, E. coli
gatgagctacctgaatttgaacggc

SEQ ID NO: 63317 - DNA, 25 bp, E. coli
caggcagaaggatacaaagccatct

SEQ ID NO: 63318 - DNA, 25 bp, E. coli
caggcagaaggaaacaaagccatct

SEQ ID NO: 63319 - DNA, 25 bp, E. coli
tacaaagccatcacagatctgtcgc

SEQ ID NO: 63320 - DNA, 25 bp, E. coli
tacaaagccatctcagatctgtcgc

SEQ ID NO: 63321 - DNA, 25 bp, E. coli
tagccctccccaatcttttttgtga

SEQ ID NO: 63322 - DNA, 25 bp, E. coli
tagccctccccattcttttttgtga

SEQ ID NO: 63323 - DNA, 25 bp, E. coli
tattttcgtgcagaaggctctagcc

SEQ ID NO: 63324 - DNA, 25 bp, E. coli
tattttcgtgcacaaggctctagcc

SEQ ID NO: 63325 - DNA, 25 bp, E. coli
tgtaaaacatggactgctccaggcc

SEQ ID NO: 63326 - DNA, 25 bp, E. coli
tgtaaaacatggtctgctccaggcc

SEQ ID NO: 63327 - DNA, 25 bp, E. coli
tgctccaggcctgaaccaggcagaa

SEQ ID NO: 63328 - DNA, 25 bp, E. coli
tgctccaggcctcaaccaggcagaa

SEQ ID NO: 63329 - DNA, 25 bp, E. coli
tgcaacacgttacgctgccgagtat

SEQ ID NO: 63330 - DNA, 25 bp, E. coli
tgcaacacgttaggctgccgagtat

SEQ ID NO: 63331 - DNA, 25 bp, E. coli
cgctgccgagtaattttgtaaaaca

SEQ ID NO: 63332 - DNA, 25 bp, E. coli
cgctgccgagtatttttgtaaaaca

SEQ ID NO: 63333 - DNA, 25 bp, E. coli
gatctgtcgcatcactattttcgtg

SEQ ID NO: 63334 - DNA, 25 bp, E. coli
gatctgtcgcatgactattttcgtg

SEQ ID NO: 63335 - DNA, 25 bp, E. coli
gtctgatgccgctcttgcaacacgt

SEQ ID NO: 63336 - DNA, 25 bp, E. coli
gtctgatgccgcacttgcaacacgt

SEQ ID NO: 63337 - DNA, 25 bp, E. coli
ggaacctcaggttcctcgtctgatg

SEQ ID NO: 63338 - DNA, 25 bp, E. coli
ggaacctcaggtacctcgtctgatg

SEQ ID NO: 63339 - DNA, 25 bp, E. coli
aactgtcatacaacgttacggtacc

SEQ ID NO: 63340 - DNA, 25 bp, E. coli
cagcgaaactgtgatacatcgttac

SEQ ID NO: 63341 - DNA, 25 bp, E. coli
cagcgaaactgtcatacatcgttac

SEQ ID NO: 63342 - DNA, 25 bp, E. coli
catcacagcgaaactgtcatacatc

SEQ ID NO: 63343 - DNA, 25 bp, E. coli
catcacagcgaatctgtcatacatc

SEQ ID NO: 63344 - DNA, 25 bp, E. coli
aaactgtcatacttcgttacggtac

SEQ ID NO: 63345 - DNA, 25 bp, E. coli
aaactgtcatacatcgttacggtac

SEQ ID NO: 63346 - DNA, 25 bp, E. coli
aactgtcatacatcgttacggtacc

SEQ ID NO: 63347 - DNA, 25 bp, E. coli
tgtcatacatcgttacggtaccggc

SEQ ID NO: 63348 - DNA, 25 bp, E. coli
tgtcatacatcgatacggtaccggc

SEQ ID NO: 63349 - DNA, 25 bp, E. coli
tcatcacagcgatactgtcatacat

SEQ ID NO: 63350 - DNA, 25 bp, E. coli
tcatcacagcgaaactgtcatacat

SEQ ID NO: 63351 - DNA, 25 bp, E. coli
gcgaaactgtcaaacatcgttacgg

SEQ ID NO: 63352 - DNA, 25 bp, E. coli
gcgaaactgtcatacatcgttacgg

SEQ ID NO: 63353 - DNA, 25 bp, E. coli
gaaactgtcatacatcgttacggta

SEQ ID NO: 63354 - DNA, 25 bp, E. coli
gaaactgtcatagatcgttacggta

SEQ ID NO: 63355 - DNA, 25 bp, E. coli
cgcaatgaatgggatacaggaacgg

SEQ ID NO: 63356 - DNA, 25 bp, E. coli
cgcaatgaatggcatacaggaacgg

SEQ ID NO: 63357 - DNA, 25 bp, E. coli
ctgtcatacatcgttacggtaccgg

SEQ ID NO: 63358 - DNA, 25 bp, E. coli
ctgtcatacatccttacggtaccgg

SEQ ID NO: 63359 - DNA, 25 bp, E. coli
tcacagcgaaacagtcatacatcgt

SEQ ID NO: 63360 - DNA, 25 bp, E. coli
tcacagcgaaactgtcatacatcgt

SEQ ID NO: 63361 - DNA, 25 bp, E. coli
caactgtcgttgagcggtgccattg

SEQ ID NO: 63362 - DNA, 25 bp, E. coli
caactgtcgttgtgcggtgccattg

SEQ ID NO: 63363 - DNA, 25 bp, E. coli
taaactgggtttaagctgcgcgatg

SEQ ID NO: 63364 - DNA, 25 bp, E. coli
taaactgggttttagctgcgcgatg

SEQ ID NO: 63365 - DNA, 25 bp, E. coli
tttagcctggattcggtgatcaccg

SEQ ID NO: 63366 - DNA, 25 bp, E. coli
tttagcctggatacggtgatcaccg

SEQ ID NO: 63367 - DNA, 25 bp, E. coli
tgattgccgccgaaatgattgccgt

SEQ ID NO: 63368 - DNA, 25 bp, E. coli
tggtgatttcgtaaacgccacgccg

SEQ ID NO: 63369 - DNA, 25 bp, E. coli
tgattgccgccgtaatgattgccgt

SEQ ID NO: 63370 - DNA, 25 bp, E. coli
tggtgatttcgttaacgccacgccg

SEQ ID NO: 63371 - DNA, 25 bp, E. coli
gctttttaccgtcctgacgctggag

SEQ ID NO: 63372 - DNA, 25 bp, E. coli
gctcgaaacgcaagaatcgcactcg

SEQ ID NO: 63373 - DNA, 25 bp, E. coli
gctttttaccgtgctgacgctggag

SEQ ID NO: 63374 - DNA, 25 bp, E. coli
gctcgaaacgcatgaatcgcactcg

SEQ ID NO: 63375 - DNA, 25 bp, E. coli
gaagacgaacatcgcagcggatcgc

SEQ ID NO: 63376 - DNA, 25 bp, E. coli
gaagacgaacatggcagcggatcgc

SEQ ID NO: 63377 - DNA, 25 bp, E. coli
cgatacaggagatacgcgaagagct

SEQ ID NO: 63378 - DNA, 25 bp, E. coli
cgatacaggagaaacgcgaagagct

SEQ ID NO: 63379 - DNA, 25 bp, E. coli
tggtggtggcaaaacttccgttatc

SEQ ID NO: 63380 - DNA, 25 bp, E. coli
tggtggtggcaatacttccgttatc

SEQ ID NO: 63381 - DNA, 25 bp, E. coli
gacgctggagatttcgttccgcacc

SEQ ID NO: 63382 - DNA, 25 bp, E. coli
gacgctggagatatcgttccgcacc

SEQ ID NO: 63383 - DNA, 25 bp, E. coli
taaacaccgcaaatcaggctgtcgg

SEQ ID NO: 63384 - DNA, 25 bp, E. coli
taaacaccgcaattcaggctgtcgg

SEQ ID NO: 63385 - DNA, 25 bp, E. coli
tgacgccggagaaataccatgacga

SEQ ID NO: 63386 - DNA, 25 bp, E. coli
tgaaccgccgcgtgaaagaagagaa

SEQ ID NO: 63387 - DNA, 25 bp, E. coli
tgacgccggagatataccatgacga

SEQ ID NO: 63388 - DNA, 25 bp, E. coli
tgaaccgccgcgagaaagaagagaa

SEQ ID NO: 63389 - DNA, 25 bp, E. coli
cccttaacgcgcgtggatggcaaca

SEQ ID NO: 63390 - DNA, 25 bp, E. coli
cccttaacgcgcctggatggcaaca

SEQ ID NO: 63391 - DNA, 25 bp, E. coli
cattaggcaatgtacgtctggcgct

SEQ ID NO: 63392 - DNA, 25 bp, E. coli
cattaggcaatgaacgtctggcgct

SEQ ID NO: 63393 - DNA, 25 bp, E. coli
gttcaggtaagtccatgaccgcccg

SEQ ID NO: 63394 - DNA, 25 bp, E. coli
gttcaggtaagtgcatgaccgcccg

SEQ ID NO: 63395 - DNA, 25 bp, E. coli
ggtattgcaagatccgcgttacgcg

SEQ ID NO: 63396 - DNA, 25 bp, E. coli
ggtattgcaagaaccgcgttacgcg

SEQ ID NO: 63397 - DNA, 25 bp, E. coli
ggttacccagtgtgaacaacgtcag

SEQ ID NO: 63398 - DNA, 25 bp, E. coli
ggttacccagtgagaacaacgtcag

SEQ ID NO: 63399 - DNA, 25 bp, E. coli
ggctgtcggcctgaatacgcgagta

SEQ ID NO: 63400 - DNA, 25 bp, E. coli
tggatgaaatgcacgctgctgcgct

SEQ ID NO: 63401 - DNA, 25 bp, E. coli
tggatgaaatgctcgctgctgcgct

SEQ ID NO: 63402 - DNA, 25 bp, E. coli
ggctgtcggcctcaatacgcgagta

SEQ ID NO: 63403 - DNA, 25 bp, E. coli
gagtcccgggtcgtcaacaatgtca

SEQ ID NO: 63404 - DNA, 25 bp, E. coli
gagtcccgggtcctcaacaatgtca

SEQ ID NO: 63405 - DNA, 25 bp, E. coli
aagctgaactgggaacgctcgaatt

SEQ ID NO: 63406 - DNA, 25 bp, E. coli
caacctgatttggatcgatcttgag

SEQ ID NO: 63407 - DNA, 25 bp, E. coli
aagctgaactggcaacgctcgaatt

SEQ ID NO: 63408 - DNA, 25 bp, E. coli
caacctgatttgcatcgatcttgag

SEQ ID NO: 63409 - DNA, 25 bp, E. coli
tactaccgcgagcattttatcaagc

SEQ ID NO: 63410 - DNA, 25 bp, E. coli
tactaccgcgaggattttatcaagc

SEQ ID NO: 63411 - DNA, 25 bp, E. coli
atgccggagctggaagcctacttcc

SEQ ID NO: 63412 - DNA, 25 bp, E. coli
atgccggagctgcaagcctacttcc

SEQ ID NO: 63413 - DNA, 25 bp, E. coli
tattgagattgcgacgctggtgacc

SEQ ID NO: 63414 - DNA, 25 bp, E. coli
tattctggcagatgggccgaccatt

SEQ ID NO: 63415 - DNA, 25 bp, E. coli
tattgagattgccacgctggtgacc

SEQ ID NO: 63416 - DNA, 25 bp, E. coli
tattctggcagaagggccgaccatt

SEQ ID NO: 63417 - DNA, 25 bp, E. coli
tgagtgccaatgtaaacaacctgat

SEQ ID NO: 63418 - DNA, 25 bp, E. coli
tgagtgccaatgaaaacaacctgat

SEQ ID NO: 63419 - DNA, 25 bp, E. coli
tgagatgaccggtctggatcccgag

SEQ ID NO: 63420 - DNA, 25 bp, E. coli
tgagatgaccggactggatcccgag

SEQ ID NO: 63421 - DNA, 25 bp, E. coli
cctgtttaaatacatgccggagctg

SEQ ID NO: 63422 - DNA, 25 bp, E. coli
cctgtttaaatagatgccggagctg

SEQ ID NO: 63423 - DNA, 25 bp, E. coli
gcatcaggcgatggatgatatccgt

SEQ ID NO: 63424 - DNA, 25 bp, E. coli
gcatcaggcgatcgatgatatccgt

SEQ ID NO: 63425 - DNA, 25 bp, E. coli
gatcccgagcgccatcgcattattg

SEQ ID NO: 63426 - DNA, 25 bp, E. coli
gatcccgagcgcgatcgcattattg

SEQ ID NO: 63427 - DNA, 25 bp, E. coli
cagtcagttgcagcaattaaacggt

SEQ ID NO: 63428 - DNA, 25 bp, E. coli
cataacatcgccatcgtcgtggtca

SEQ ID NO: 63429 - DNA, 25 bp, E. coli
catcgccttcgtcgtggtcaatatc

SEQ ID NO: 63430 - DNA, 25 bp, E. coli
cataacatcgccttcgtcgtggtca

SEQ ID NO: 63431 - DNA, 25 bp, E. coli
cagtcagttgcaccaattaaacggt

SEQ ID NO: 63432 - DNA, 25 bp, E. coli
catcgccttcgtggtggtcaatatc

SEQ ID NO: 63433 - DNA, 25 bp, E. coli
taccagtcagttccagcaattaaac

SEQ ID NO: 63434 - DNA, 25 bp, E. coli
taccagtcagttgcagcaattaaac

SEQ ID NO: 63435 - DNA, 25 bp, E. coli
attaccagtcagttgcagcaattaa

SEQ ID NO: 63436 - DNA, 25 bp, E. coli
ataacatcgcctacgtcgtggtcaa

SEQ ID NO: 63437 - DNA, 25 bp, E. coli
attaccagtcagatgcagcaattaa

SEQ ID NO: 63438 - DNA, 25 bp, E. coli
ataacatcgccttcgtcgtggtcaa

SEQ ID NO: 63439 - DNA, 25 bp, E. coli
aacatcgccttcctcgtggtcaata

SEQ ID NO: 63440 - DNA, 25 bp, E. coli
aacatcgccttcgtcgtggtcaata

SEQ ID NO: 63441 - DNA, 25 bp, E. coli
tcgccttcgtcgtggtcaatatcaa

SEQ ID NO: 63442 - DNA, 25 bp, E. coli
tcgccttcgtcgaggtcaatatcaa

SEQ ID NO: 63443 - DNA, 25 bp, E. coli
ccagtcagttgcagcaattaaacgg

SEQ ID NO: 63444 - DNA, 25 bp, E. coli
ccagtcagttgctgcaattaaacgg

SEQ ID NO: 63445 - DNA, 25 bp, E. coli
cgccttcgtcgtggtcaatatcaat

SEQ ID NO: 63446 - DNA, 25 bp, E. coli
cgccttcgtcgtcgtcaatatcaat

SEQ ID NO: 63447 - DNA, 25 bp, E. coli
taacatcgccttcgtcgtggtcaat

SEQ ID NO: 63448 - DNA, 25 bp, E. coli
taacatcgccttggtcgtggtcaat

SEQ ID NO: 63449 - DNA, 25 bp, E. coli
gtaacgttggcaacgacccggaagt

SEQ ID NO: 63450 - DNA, 25 bp, E. coli
gtaacgttggcatcgacccggaagt

SEQ ID NO: 63451 - DNA, 25 bp, E. coli
tagccaggcgtctgatgttgccgcg

SEQ ID NO: 63452 - DNA, 25 bp, E. coli
tagccaggcgtcagatgttgccgcg

SEQ ID NO: 63453 - DNA, 25 bp, E. coli
tttaccaacctgtaaggcacgctgc

SEQ ID NO: 63454 - DNA, 25 bp, E. coli
ttactctggtttggccttcgggatg

SEQ ID NO: 63455 - DNA, 25 bp, E. coli
tttaccaacctgaaaggcacgctgc

SEQ ID NO: 63456 - DNA, 25 bp, E. coli
ttactctggtttcgccttcgggatg

SEQ ID NO: 63457 - DNA, 25 bp, E. coli
tgagcttggctttaccgtggcaacc

SEQ ID NO: 63458 - DNA, 25 bp, E. coli
tgagcttggcttaaccgtggcaacc

SEQ ID NO: 63459 - DNA, 25 bp, E. coli
tctggcggcggatacgattgatgtc

SEQ ID NO: 63460 - DNA, 25 bp, E. coli
tctggcggcggaaacgattgatgtc

SEQ ID NO: 63461 - DNA, 25 bp, E. coli
gctgaatgcgcgtaaagcggaactg

SEQ ID NO: 63462 - DNA, 25 bp, E. coli
gctgaatgcgcgaaaagcggaactg

SEQ ID NO: 63463 - DNA, 25 bp, E. coli
cgaaagagcaggttcagcaggcgct

SEQ ID NO: 63464 - DNA, 25 bp, E. coli
cgaaagagcaggatcagcaggcgct

SEQ ID NO: 63465 - DNA, 25 bp, E. coli
cggaactggaaagcgctgcactgaa

SEQ ID NO: 63466 - DNA, 25 bp, E. coli
cggaactggaaaccgctgcactgaa

SEQ ID NO: 63467 - DNA, 25 bp, E. coli
gttgccagtgcgaaggcggccatta

SEQ ID NO: 63468 - DNA, 25 bp, E. coli
gttgccagtgcgtaggcggccatta

SEQ ID NO: 63469 - DNA, 25 bp, E. coli
tcacatctcgcacaactggttgcca

SEQ ID NO: 63470 - DNA, 25 bp, E. coli
tcacatctcgcagaactggttgcca

SEQ ID NO: 63471 - DNA, 25 bp, E. coli
aattatcagaagtcaggcggagtgc

SEQ ID NO: 63472 - DNA, 25 bp, E. coli
aattatcagaagacaggcggagtgc

SEQ ID NO: 63473 - DNA, 25 bp, E. coli
taaagcatttcatcgggctgcggag

SEQ ID NO: 63474 - DNA, 25 bp, E. coli
taaagcatttcaacgggctgcggag

SEQ ID NO: 63475 - DNA, 25 bp, E. coli
tgtagaaaacgacgtgatctcgcct

SEQ ID NO: 63476 - DNA, 25 bp, E. coli
tgtctgaaaatgtaaacgttgcctt

SEQ ID NO: 63477 - DNA, 25 bp, E. coli
tgtctgaaaatgaaaacgttgcctt

SEQ ID NO: 63478 - DNA, 25 bp, E. coli
tgttctagaggatgatcatccggaa

SEQ ID NO: 63479 - DNA, 25 bp, E. coli
tgtagaaaacgaggtgatctcgcct

SEQ ID NO: 63480 - DNA, 25 bp, E. coli
tgttctagaggaagatcatccggaa

SEQ ID NO: 63481 - DNA, 25 bp, E. coli
gaaatacggattcagctaggcagaa

SEQ ID NO: 63482 - DNA, 25 bp, E. coli
gaaatacggattgagctaggcagaa

SEQ ID NO: 63483 - DNA, 25 bp, E. coli
tggcaaaagcaatgcggaagtgtac

SEQ ID NO: 63484 - DNA, 25 bp, E. coli
tggcaaaagcaaagcggaagtgtac

SEQ ID NO: 63485 - DNA, 25 bp, E. coli
taatgaacttatggaaccgctatgg

SEQ ID NO: 63486 - DNA, 25 bp, E. coli
tcacatgtccgaatgcgaatgggcg

SEQ ID NO: 63487 - DNA, 25 bp, E. coli
taatgactctgttccgaatgatggg

SEQ ID NO: 63488 - DNA, 25 bp, E. coli
taatgaacttatcgaaccgctatgg

SEQ ID NO: 63489 - DNA, 25 bp, E. coli
tcacatgtccgattgcgaatgggcg

SEQ ID NO: 63490 - DNA, 25 bp, E. coli
taatgactctgtaccgaatgatggg

SEQ ID NO: 63491 - DNA, 25 bp, E. coli
gatgtaccatgggaaacaaggcacc

SEQ ID NO: 63492 - DNA, 25 bp, E. coli
gatgtaccatggcaaacaaggcacc

SEQ ID NO: 63493 - DNA, 25 bp, E. coli
tactttcggtgcatctgccgcagag

SEQ ID NO: 63494 - DNA, 25 bp, E. coli
tacttgcttcctatactttcggtgc

SEQ ID NO: 63495 - DNA, 25 bp, E. coli
tacttgcttcctttactttcggtgc

SEQ ID NO: 63496 - DNA, 25 bp, E. coli
tactttcggtgcttctgccgcagag

SEQ ID NO: 63497 - DNA, 25 bp, E. coli
tatccaccctttcaatctataggtg

SEQ ID NO: 63498 - DNA, 25 bp, E. coli
tatccaccctttgaatctataggtg

SEQ ID NO: 63499 - DNA, 25 bp, E. coli
ttttggcgtttcagccacctatcca

SEQ ID NO: 63500 - DNA, 25 bp, E. coli
ttttggcgtttctgccacctatcca

SEQ ID NO: 63501 - DNA, 25 bp, E. coli
tagttcttgccggtttacttgcttc

SEQ ID NO: 63502 - DNA, 25 bp, E. coli
tagttcttgccgctttacttgcttc

SEQ ID NO: 63503 - DNA, 25 bp, E. coli
ccggagcgtagcaaacaggtatcgt

SEQ ID NO: 63504 - DNA, 25 bp, E. coli
ccttgtgcaaacaaatgcaggcaga

SEQ ID NO: 63505 - DNA, 25 bp, E. coli
ccttgtgcaaactaatgcaggcaga

SEQ ID NO: 63506 - DNA, 25 bp, E. coli
ccggagcgtagctaacaggtatcgt

SEQ ID NO: 63507 - DNA, 25 bp, E. coli
gcgtagcaaacacgtatcgtttacc

SEQ ID NO: 63508 - DNA, 25 bp, E. coli
gcgtagcaaacaggtatcgtttacc

SEQ ID NO: 63509 - DNA, 25 bp, E. coli
ccctttgaatctataggtgctaata

SEQ ID NO: 63510 - DNA, 25 bp, E. coli
ccctttgaatctttaggtgctaata

SEQ ID NO: 63511 - DNA, 25 bp, E. coli
gatctggcaaaacccttgtgcaaac

SEQ ID NO: 63512 - DNA, 25 bp, E. coli
gatctggcaaaagccttgtgcaaac

SEQ ID NO: 63513 - DNA, 25 bp, E. coli
ggtgctaataatcagattgtcggct

SEQ ID NO: 63514 - DNA, 25 bp, E. coli
ggtgctaataatgagattgtcggct

SEQ ID NO: 63515 - DNA, 25 bp, E. coli
caagacaaggtcacagagctggaaa

SEQ ID NO: 63516 - DNA, 25 bp, E. coli
aagcccgcttaataactgttcacag

SEQ ID NO: 63517 - DNA, 25 bp, E. coli
caagacaaggtctcagagctggaaa

SEQ ID NO: 63518 - DNA, 25 bp, E. coli
aagcccgcttaaaaactgttcacag

SEQ ID NO: 63519 - DNA, 25 bp, E. coli
cacgtaagtgattatgttacatcaa

SEQ ID NO: 63520 - DNA, 25 bp, E. coli
cacgtaagtgataatgttacatcaa

SEQ ID NO: 63521 - DNA, 25 bp, E. coli
aaaatggtctgaccggtagctaaag

SEQ ID NO: 63522 - DNA, 25 bp, E. coli
aaaatggtctgagcggtagctaaag

SEQ ID NO: 63523 - DNA, 25 bp, E. coli
tgttcacagaaggagcgcgcaaaaa

SEQ ID NO: 63524 - DNA, 25 bp, E. coli
tgttcacagaagcagcgcgcaaaaa

SEQ ID NO: 63525 - DNA, 25 bp, E. coli
tgccacacaacacaacaaagcgaag

SEQ ID NO: 63526 - DNA, 25 bp, E. coli
tcgcaaaacacggacatcacgtaag

SEQ ID NO: 63527 - DNA, 25 bp, E. coli
tgccacacaacagaacaaagcgaag

SEQ ID NO: 63528 - DNA, 25 bp, E. coli
tcgcaaaacacgcacatcacgtaag

SEQ ID NO: 63529 - DNA, 25 bp, E. coli
cgcgcaaaaatctgctgccacacaa

SEQ ID NO: 63530 - DNA, 25 bp, E. coli
cgcgcaaaaatcagctgccacacaa

SEQ ID NO: 63531 - DNA, 25 bp, E. coli
gatagacgaaaaggaaaagcccgct

SEQ ID NO: 63532 - DNA, 25 bp, E. coli
gatagacgaaaacgaaaagcccgct

SEQ ID NO: 63533 - DNA, 25 bp, E. coli
taacattgagttaaccaagacaagg

SEQ ID NO: 63534 - DNA, 25 bp, E. coli
taacattgagtttaccaagacaagg

SEQ ID NO: 63535 - DNA, 25 bp, E. coli
gaccggtagctaaagagatagacga

SEQ ID NO: 63536 - DNA, 25 bp, E. coli
gaccggtagctatagagatagacga

SEQ ID NO: 63537 - DNA, 25 bp, E. coli
caggataaacatcagtcaggataaa

SEQ ID NO: 63538 - DNA, 25 bp, E. coli
caggataaacatgagtcaggataaa

SEQ ID NO: 63539 - DNA, 25 bp, E. coli
taaatttattaatattcacgcaggg

SEQ ID NO: 63540 - DNA, 25 bp, E. coli
taaatgtattgcgtataaagggata

SEQ ID NO: 63541 - DNA, 25 bp, E. coli
taaatgtattgcctataaagggata

SEQ ID NO: 63542 - DNA, 25 bp, E. coli
taaatttattaaaattcacgcaggg

SEQ ID NO: 63543 - DNA, 25 bp, E. coli
aaagcatccgactgcgaagtgccgt

SEQ ID NO: 63544 - DNA, 25 bp, E. coli
aaagcatccgacagcgaagtgccgt

SEQ ID NO: 63545 - DNA, 25 bp, E. coli
tattccttgttatacacattacgaa

SEQ ID NO: 63546 - DNA, 25 bp, E. coli
tattccttgttaaacacattacgaa

SEQ ID NO: 63547 - DNA, 25 bp, E. coli
tatttcgcagcctaacaggataaac

SEQ ID NO: 63548 - DNA, 25 bp, E. coli
tatctgccgctttgataatcccaaa

SEQ ID NO: 63549 - DNA, 25 bp, E. coli
tatttcgcagccaaacaggataaac

SEQ ID NO: 63550 - DNA, 25 bp, E. coli
tatctgccgcttagataatcccaaa

SEQ ID NO: 63551 - DNA, 25 bp, E. coli
tttaagatcatctaaagaggaaagt

SEQ ID NO: 63552 - DNA, 25 bp, E. coli
tttaagatcatcaaaagaggaaagt

SEQ ID NO: 63553 - DNA, 25 bp, E. coli
tctgtgaaagtgcagaaggtaaccg

SEQ ID NO: 63554 - DNA, 25 bp, E. coli
tctgtgaaagtggagaaggtaaccg

SEQ ID NO: 63555 - DNA, 25 bp, E. coli
gaagtgccgttaagttctgtgaaag

SEQ ID NO: 63556 - DNA, 25 bp, E. coli
gaagtgccgttatgttctgtgaaag

SEQ ID NO: 63557 - DNA, 25 bp, E. coli
taatcccaaacaccaaaagcatccg

SEQ ID NO: 63558 - DNA, 25 bp, E. coli
taatcccaaacagcaaaagcatccg

SEQ ID NO: 63559 - DNA, 25 bp, E. coli
caacgtgcgcacattggcttcaaca

SEQ ID NO: 63560 - DNA, 25 bp, E. coli
caacgtgcgcactttggcttcaaca

SEQ ID NO: 63561 - DNA, 25 bp, E. coli
acgtcgtcgcagtaccgcatattgg

SEQ ID NO: 63562 - DNA, 25 bp, E. coli
acgtcgtcgcagaaccgcatattgg

SEQ ID NO: 63563 - DNA, 25 bp, E. coli
ttttgatgtcgatgcgcttaccgcc

SEQ ID NO: 63564 - DNA, 25 bp, E. coli
ttttgatgtcgaagcgcttaccgcc

SEQ ID NO: 63565 - DNA, 25 bp, E. coli
tgacgttcaccaaaaaacactgggc

SEQ ID NO: 63566 - DNA, 25 bp, E. coli
tgacgttcaccataaaacactgggc

SEQ ID NO: 63567 - DNA, 25 bp, E. coli
tcattaatgccggacgtggcccggt

SEQ ID NO: 63568 - DNA, 25 bp, E. coli
tcattaatgccgcacgtggcccggt

SEQ ID NO: 63569 - DNA, 25 bp, E. coli
gccgcctgtgccctggataatttga

SEQ ID NO: 63570 - DNA, 25 bp, E. coli
ccgggctggatgtcttcgaacaaga

SEQ ID NO: 63571 - DNA, 25 bp, E. coli
gccgcctgtgccgtggataatttga

SEQ ID NO: 63572 - DNA, 25 bp, E. coli
ccgggctggatgacttcgaacaaga

SEQ ID NO: 63573 - DNA, 25 bp, E. coli
gaaaaaatgccgaaactgcgtgcca

SEQ ID NO: 63574 - DNA, 25 bp, E. coli
gaaaccgtcgccgatacgctgatgg

SEQ ID NO: 63575 - DNA, 25 bp, E. coli
gaactgtgtgaaaccgcacgtcgcg

SEQ ID NO: 63576 - DNA, 25 bp, E. coli
gaaaccgtcgcccatacgctgatgg

SEQ ID NO: 63577 - DNA, 25 bp, E. coli
gaactgtgtgaatccgcacgtcgcg

SEQ ID NO: 63578 - DNA, 25 bp, E. coli
gaaaaaatgccgtaactgcgtgcca

SEQ ID NO: 63579 - DNA, 25 bp, E. coli
gatgatttactgcaacgcctgcaag

SEQ ID NO: 63580 - DNA, 25 bp, E. coli
gatgatttactggaacgcctgcaag

SEQ ID NO: 63581 - DNA, 25 bp, E. coli
aaagagggttctatccgtttcgctg

SEQ ID NO: 63582 - DNA, 25 bp, E. coli
agggttctatccgtttcgctgcgga

SEQ ID NO: 63583 - DNA, 25 bp, E. coli
agggttctatccctttcgctgcgga

SEQ ID NO: 63584 - DNA, 25 bp, E. coli
actgctgtcgcccatggcggataaa

SEQ ID NO: 63585 - DNA, 25 bp, E. coli
aaagagggttctttccgtttcgctg

SEQ ID NO: 63586 - DNA, 25 bp, E. coli
actgctgtcgccgatggcggataaa

SEQ ID NO: 63587 - DNA, 25 bp, E. coli
aaaactgcaccggacattatggtcg

SEQ ID NO: 63588 - DNA, 25 bp, E. coli
aaaactgcaccgcacattatggtcg

SEQ ID NO: 63589 - DNA, 25 bp, E. coli
aactgcaccgcagattatggtcgta

SEQ ID NO: 63590 - DNA, 25 bp, E. coli
aactgcaccgcacattatggtcgta

SEQ ID NO: 63591 - DNA, 25 bp, E. coli
tatccgtttcgcagcggaacagccg

SEQ ID NO: 63592 - DNA, 25 bp, E. coli
tatccgtttcgctgcggaacagccg

SEQ ID NO: 63593 - DNA, 25 bp, E. coli
tcgctgcggaacagccggaaaacgg

SEQ ID NO: 63594 - DNA, 25 bp, E. coli
tcgctgcggaactgccggaaaacgg

SEQ ID NO: 63595 - DNA, 25 bp, E. coli
ccgtgactgcggtagaactgctgtc

SEQ ID NO: 63596 - DNA, 25 bp, E. coli
ccgtgactgcggaagaactgctgtc

SEQ ID NO: 63597 - DNA, 25 bp, E. coli
gactgcggaagaactgctgtcgccg

SEQ ID NO: 63598 - DNA, 25 bp, E. coli
gactgcggaagatctgctgtcgccg

SEQ ID NO: 63599 - DNA, 25 bp, E. coli
cgtttcgctgcgcaacagccggaaa

SEQ ID NO: 63600 - DNA, 25 bp, E. coli
cggaagaactgctgtcgccgatggc

SEQ ID NO: 63601 - DNA, 25 bp, E. coli
cgtttcgctgcggaacagccggaaa

SEQ ID NO: 63602 - DNA, 25 bp, E. coli
cggaagaactgcagtcgccgatggc

SEQ ID NO: 63603 - DNA, 25 bp, E. coli
caatggatattagcgttccgtacac

SEQ ID NO: 63604 - DNA, 25 bp, E. coli
caatggatattaccgttccgtacac

SEQ ID NO: 63605 - DNA, 25 bp, E. coli
caccgtcgcggcgtgattgttgaag

SEQ ID NO: 63606 - DNA, 25 bp, E. coli
caccgtcgcggcctgattgttgaag

SEQ ID NO: 63607 - DNA, 25 bp, E. coli
catcagttcgattcggcgctggatt

SEQ ID NO: 63608 - DNA, 25 bp, E. coli
catcagttcgatacggcgctggatt

SEQ ID NO: 63609 - DNA, 25 bp, E. coli
tatccacggacctgaaaatcctcat

SEQ ID NO: 63610 - DNA, 25 bp, E. coli
tatccacggaccagaaaatcctcat

SEQ ID NO: 63611 - DNA, 25 bp, E. coli
ttacgatttccaacaccgtcgcggc

SEQ ID NO: 63612 - DNA, 25 bp, E. coli
ttacgatttccatcaccgtcgcggc

SEQ ID NO: 63613 - DNA, 25 bp, E. coli
tattaccgttccctacacatcaggg

SEQ ID NO: 63614 - DNA, 25 bp, E. coli
tattaccgttccgtacacatcaggg

SEQ ID NO: 63615 - DNA, 25 bp, E. coli
tgtaatgcatcacttcgattcggcg

SEQ ID NO: 63616 - DNA, 25 bp, E. coli
tgtaatgcatcagttcgattcggcg

SEQ ID NO: 63617 - DNA, 25 bp, E. coli
ggcggcaagatgaacaatctcgatg

SEQ ID NO: 63618 - DNA, 25 bp, E. coli
ggcattacgatttccatcaccgtcg

SEQ ID NO: 63619 - DNA, 25 bp, E. coli
ggcattacgattaccatcaccgtcg

SEQ ID NO: 63620 - DNA, 25 bp, E. coli
ggcggcaagatgtacaatctcgatg

SEQ ID NO: 63621 - DNA, 25 bp, E. coli
gacctgaaaatcctcatgaaacatg

SEQ ID NO: 63622 - DNA, 25 bp, E. coli
gagaaatatgtctttatccacggac

SEQ ID NO: 63623 - DNA, 25 bp, E. coli
gagaaatatgtcattatccacggac

SEQ ID NO: 63624 - DNA, 25 bp, E. coli
gacctgaaaatcgtcatgaaacatg

SEQ ID NO: 63625 - DNA, 25 bp, E. coli
caagatctatcgcatcggtcaggag

SEQ ID NO: 63626 - DNA, 25 bp, E. coli
caagatctatcggatcggtcaggag

SEQ ID NO: 63627 - DNA, 25 bp, E. coli
ctttataccgggtaattgtgccgca

SEQ ID NO: 63628 - DNA, 25 bp, E. coli
cagatggttcgatcagaatgcgcgt

SEQ ID NO: 63629 - DNA, 25 bp, E. coli
cagatggttcgaacagaatgcgcgt

SEQ ID NO: 63630 - DNA, 25 bp, E. coli
ctttataccgggaaattgtgccgca

SEQ ID NO: 63631 - DNA, 25 bp, E. coli
tagttcccctcctaagcggcttgaa

SEQ ID NO: 63632 - DNA, 25 bp, E. coli
tagttcccctccaaagcggcttgaa

SEQ ID NO: 63633 - DNA, 25 bp, E. coli
tgatcattgcctacgtggaccggag

SEQ ID NO: 63634 - DNA, 25 bp, E. coli
tgatcattgccttcgtggaccggag

SEQ ID NO: 63635 - DNA, 25 bp, E. coli
ccagatctgattcagcgcttcggtg

SEQ ID NO: 63636 - DNA, 25 bp, E. coli
ccagatctgattgagcgcttcggtg

SEQ ID NO: 63637 - DNA, 25 bp, E. coli
gaatggctcaatccaggcactgcta

SEQ ID NO: 63638 - DNA, 25 bp, E. coli
gaatggctcaatgcaggcactgcta

SEQ ID NO: 63639 - DNA, 25 bp, E. coli
cgagcgttgagcgacccgatattat

SEQ ID NO: 63640 - DNA, 25 bp, E. coli
cgagcgttgagccacccgatattat

SEQ ID NO: 63641 - DNA, 25 bp, E. coli
ctatatgttgcagcgctggcgggta

SEQ ID NO: 63642 - DNA, 25 bp, E. coli
ctatatgttgcaccgctggcgggta

SEQ ID NO: 63643 - DNA, 25 bp, E. coli
gttatggctcaaagatcatctcgca

SEQ ID NO: 63644 - DNA, 25 bp, E. coli
gttatggctcaatgatcatctcgca

SEQ ID NO: 63645 - DNA, 25 bp, E. coli
tacttcttcggtgagatcggtcgcc

SEQ ID NO: 63646 - DNA, 25 bp, E. coli
tacttcttcggtcagatcggtcgcc

SEQ ID NO: 63647 - DNA, 25 bp, E. coli
ggaaggccatttccggagtctttac

SEQ ID NO: 63648 - DNA, 25 bp, E. coli
ggaaggccatttgcggagtctttac

SEQ ID NO: 63649 - DNA, 25 bp, E. coli
caaagtggcgatggtgaacaagtac

SEQ ID NO: 63650 - DNA, 25 bp, E. coli
caaagtggcgatcgtgaacaagtac

SEQ ID NO: 63651 - DNA, 25 bp, E. coli
tacgcgagggagaatgagcatccat

SEQ ID NO: 63652 - DNA, 25 bp, E. coli
tacgcgagggagtatgagcatccat

SEQ ID NO: 63653 - DNA, 25 bp, E. coli
tgatgctcgctgatcactaccaggg

SEQ ID NO: 63654 - DNA, 25 bp, E. coli
tgatgctcgctgttcactaccaggg

SEQ ID NO: 63655 - DNA, 25 bp, E. coli
tcttatgatgtacaacgtgcaacgc

SEQ ID NO: 63656 - DNA, 25 bp, E. coli
tcttatgatgtagaacgtgcaacgc

SEQ ID NO: 63657 - DNA, 25 bp, E. coli
gctgtgtacgcttgaaaaagcctga

SEQ ID NO: 63658 - DNA, 25 bp, E. coli
gctggactttgaacaactggcggaa

SEQ ID NO: 63659 - DNA, 25 bp, E. coli
gctgtgtacgctagaaaaagcctga

SEQ ID NO: 63660 - DNA, 25 bp, E. coli
gctggactttgatcaactggcggaa

SEQ ID NO: 63661 - DNA, 25 bp, E. coli
gaacgtgcaacgcaattgatgctcg

SEQ ID NO: 63662 - DNA, 25 bp, E. coli
gaacgtgcaacggaattgatgctcg

SEQ ID NO: 63663 - DNA, 25 bp, E. coli
ggtaaaacgaacgactggctggact

SEQ ID NO: 63664 - DNA, 25 bp, E. coli
ggaagaaaaagttcgcgacgcgcta

SEQ ID NO: 63665 - DNA, 25 bp, E. coli
ggtaaaacgaaccactggctggact

SEQ ID NO: 63666 - DNA, 25 bp, E. coli
ggaagaaaaagtacgcgacgcgcta

SEQ ID NO: 63667 - DNA, 25 bp, E. coli
gacgcgctaaaagcgccatctatgt

SEQ ID NO: 63668 - DNA, 25 bp, E. coli
gacgcgctaaaaccgccatctatgt

SEQ ID NO: 63669 - DNA, 25 bp, E. coli
cagcgggcgttcaggcgctgccttt

SEQ ID NO: 63670 - DNA, 25 bp, E. coli
cagcgggcgttctggcgctgccttt

SEQ ID NO: 63671 - DNA, 25 bp, E. coli
tttctggaaagaccgcgcccgcttt

SEQ ID NO: 63672 - DNA, 25 bp, E. coli
tttctggaaagagcgcgcccgcttt

SEQ ID NO: 63673 - DNA, 25 bp, E. coli
tggtcgaaaacctgcgataaaccgg

SEQ ID NO: 63674 - DNA, 25 bp, E. coli
tgcttttctggatagaccgcgcccg

SEQ ID NO: 63675 - DNA, 25 bp, E. coli
tgcttttctggaaagaccgcgcccg

SEQ ID NO: 63676 - DNA, 25 bp, E. coli
tcatgcttttctcgaaagaccgcgc

SEQ ID NO: 63677 - DNA, 25 bp, E. coli
tcatgcttttctggaaagaccgcgc

SEQ ID NO: 63678 - DNA, 25 bp, E. coli
gcgctgcctttcttgcttttctgga

SEQ ID NO: 63679 - DNA, 25 bp, E. coli
gcgctgcctttcatgcttttctgga

SEQ ID NO: 63680 - DNA, 25 bp, E. coli
gcatggcttatcattttacgccgta

SEQ ID NO: 63681 - DNA, 25 bp, E. coli
gcatggcttatctttttacgccgta

SEQ ID NO: 63682 - DNA, 25 bp, E. coli
gaatatcctgcatggcttatctttt

SEQ ID NO: 63683 - DNA, 25 bp, E. coli
gaatatcctgcaaggcttatctttt

SEQ ID NO: 63684 - DNA, 25 bp, E. coli
cgcgtctggtcgtaaaccagcgata

SEQ ID NO: 63685 - DNA, 25 bp, E. coli
cgcgtctggtcgaaaaccagcgata

SEQ ID NO: 63686 - DNA, 25 bp, E. coli
tggatggatcagcccgaaaaggcaa

SEQ ID NO: 63687 - DNA, 25 bp, E. coli
tggatggatcaggccgaaaaggcaa

SEQ ID NO: 63688 - DNA, 25 bp, E. coli
tggcttatctttatacgccgtactt

SEQ ID NO: 63689 - DNA, 25 bp, E. coli
tggtcgaaaaccagcgataaaccgg

SEQ ID NO: 63690 - DNA, 25 bp, E. coli
tggcttatctttttacgccgtactt

SEQ ID NO: 63691 - DNA, 25 bp, E. coli
cagaggttggcggaccgtttatcga

SEQ ID NO: 63692 - DNA, 25 bp, E. coli
cagtgatgaccgcactgaaagatgc

SEQ ID NO: 63693 - DNA, 25 bp, E. coli
cagtgatgaccggactgaaagatgc

SEQ ID NO: 63694 - DNA, 25 bp, E. coli
cagaggttggcgcaccgtttatcga

SEQ ID NO: 63695 - DNA, 25 bp, E. coli
aaaatgcgcgatgcctgcaaacgtc

SEQ ID NO: 63696 - DNA, 25 bp, E. coli
aaaatgcgcgatccctgcaaacgtc

SEQ ID NO: 63697 - DNA, 25 bp, E. coli
tatgctgatgccaaaactgacgccg

SEQ ID NO: 63698 - DNA, 25 bp, E. coli
tacccgcatgaaactggagatggcg

SEQ ID NO: 63699 - DNA, 25 bp, E. coli
tacccgcatgaatctggagatggcg

SEQ ID NO: 63700 - DNA, 25 bp, E. coli
tatgctgatgcctaaactgacgccg

SEQ ID NO: 63701 - DNA, 25 bp, E. coli
tgaccgaagagaagctggcgatcgc

SEQ ID NO: 63702 - DNA, 25 bp, E. coli
tgaccgaagagatgctggcgatcgc

SEQ ID NO: 63703 - DNA, 25 bp, E. coli
gaagtaacaaccgaaggcggcctgg

SEQ ID NO: 63704 - DNA, 25 bp, E. coli
gaagtaacaacccaaggcggcctgg

SEQ ID NO: 63705 - DNA, 25 bp, E. coli
cggcattaccgtgcatttacgtgaa

SEQ ID NO: 63706 - DNA, 25 bp, E. coli
cggcattaccgtccatttacgtgaa

SEQ ID NO: 63707 - DNA, 25 bp, E. coli
gtttatcgagatgcacaccggttgc

SEQ ID NO: 63708 - DNA, 25 bp, E. coli
gtttatcgagatccacaccggttgc

SEQ ID NO: 63709 - DNA, 25 bp, E. coli
ggctgaattactgttaggcgtcaac

SEQ ID NO: 63710 - DNA, 25 bp, E. coli
ggctgaattactcttaggcgtcaac

SEQ ID NO: 63711 - DNA, 25 bp, E. coli
taacgccggacacggtctgacctat

SEQ ID NO: 63712 - DNA, 25 bp, E. coli
taacgccggacagggtctgacctat

SEQ ID NO: 63713 - DNA, 25 bp, E. coli
aatggtcggtgtgcccgcaagagtt

SEQ ID NO: 63714 - DNA, 25 bp, E. coli
aatggtcggtgtccccgcaagagtt

SEQ ID NO: 63715 - DNA, 25 bp, E. coli
cagtgcgttacaacctttgcaagtc

SEQ ID NO: 63716 - DNA, 25 bp, E. coli
cagtgcgttacatcctttgcaagtc

SEQ ID NO: 63717 - DNA, 25 bp, E. coli
acacaacggcgatgtttacgcctgc

SEQ ID NO: 63718 - DNA, 25 bp, E. coli
acacaacggcgaagtttacgcctgc

SEQ ID NO: 63719 - DNA, 25 bp, E. coli
tatgcttcagcagacgattgcagaa

SEQ ID NO: 63720 - DNA, 25 bp, E. coli
tatgcttcagcacacgattgcagaa

SEQ ID NO: 63721 - DNA, 25 bp, E. coli
tatcgactagggtatatgcttcagc

SEQ ID NO: 63722 - DNA, 25 bp, E. coli
tatcgactagggaatatgcttcagc

SEQ ID NO: 63723 - DNA, 25 bp, E. coli
tcgccaattttgacggcgcaccggg

SEQ ID NO: 63724 - DNA, 25 bp, E. coli
tcgccaattttgtcggcgcaccggg

SEQ ID NO: 63725 - DNA, 25 bp, E. coli
tcccggcgatattcagggcgaactg

SEQ ID NO: 63726 - DNA, 25 bp, E. coli
tcccggcgatatacagggcgaactg

SEQ ID NO: 63727 - DNA, 25 bp, E. coli
gaaacggctgctgatgctggactta

SEQ ID NO: 63728 - DNA, 25 bp, E. coli
gacttaagctacatgctcccggcga

SEQ ID NO: 63729 - DNA, 25 bp, E. coli
gacttaagctacttgctcccggcga

SEQ ID NO: 63730 - DNA, 25 bp, E. coli
gaaacggctgctcatgctggactta

SEQ ID NO: 63731 - DNA, 25 bp, E. coli
ctgcgtcaatcggaccagtgcgtta

SEQ ID NO: 63732 - DNA, 25 bp, E. coli
ctgcgtcaatcgcaccagtgcgtta

SEQ ID NO: 63733 - DNA, 25 bp, E. coli
gtgatgcaggtgttgagttcatcca

SEQ ID NO: 63734 - DNA, 25 bp, E. coli
gtgatgcaggtgatgagttcatcca

SEQ ID NO: 63735 - DNA, 25 bp, E. coli
aagagttaccgcctatcatggccga

SEQ ID NO: 63736 - DNA, 25 bp, E. coli
aagagttaccgcgtatcatggccga

SEQ ID NO: 63737 - DNA, 25 bp, E. coli
acttcgcagtgctggagtgcgatct

SEQ ID NO: 63738 - DNA, 25 bp, E. coli
acttcgcagtgcaggagtgcgatct

SEQ ID NO: 63739 - DNA, 25 bp, E. coli
tatcatggccgaagcgtttgacgtc

SEQ ID NO: 63740 - DNA, 25 bp, E. coli
tatcatggccgatgcgtttgacgtc

SEQ ID NO: 63741 - DNA, 25 bp, E. coli
tgcaatcactggaagagttaccgcg

SEQ ID NO: 63742 - DNA, 25 bp, E. coli
tgcaatcactggtagagttaccgcg

SEQ ID NO: 63743 - DNA, 25 bp, E. coli
gcacagtttcctggtgcaatcactg

SEQ ID NO: 63744 - DNA, 25 bp, E. coli
gcacagtttcctcgtgcaatcactg

SEQ ID NO: 63745 - DNA, 25 bp, E. coli
gacacgagcaagctgcagcaatggc

SEQ ID NO: 63746 - DNA, 25 bp, E. coli
gacacgagcaaggtgcagcaatggc

SEQ ID NO: 63747 - DNA, 25 bp, E. coli
cgttgttgctatgaccggtcaggta

SEQ ID NO: 63748 - DNA, 25 bp, E. coli
cgttgttgctatcaccggtcaggta

SEQ ID NO: 63749 - DNA, 25 bp, E. coli
gtttgacgtcgccagctctggtcgt

SEQ ID NO: 63750 - DNA, 25 bp, E. coli
gttagcctgcacgaagcacagtttc

SEQ ID NO: 63751 - DNA, 25 bp, E. coli
gtttgacgtcgcgagctctggtcgt

SEQ ID NO: 63752 - DNA, 25 bp, E. coli
gttagcctgcaccaagcacagtttc

SEQ ID NO: 63753 - DNA, 25 bp, E. coli
gtgcgatctactcatcgccgtgggc

SEQ ID NO: 63754 - DNA, 25 bp, E. coli
gtgcgatctactgatcgccgtgggc

SEQ ID NO: 63755 - DNA, 25 bp, E. coli
gacgcatttcagcaggtggatattc

SEQ ID NO: 63756 - DNA, 25 bp, E. coli
gacgcatttcaggaggtggatattc

SEQ ID NO: 63757 - DNA, 25 bp, E. coli
caaggcgcggttacgcaaatctgta

SEQ ID NO: 63758 - DNA, 25 bp, E. coli
caaggcgcggtttcgcaaatctgta

SEQ ID NO: 63759 - DNA, 25 bp, E. coli
tacatctgcctgatgctggagccac

SEQ ID NO: 63760 - DNA, 25 bp, E. coli
tacatctgcctgttgctggagccac

SEQ ID NO: 63761 - DNA, 25 bp, E. coli
ataaggccagcacggagccccgtgc

SEQ ID NO: 63762 - DNA, 25 bp, E. coli
ataaggccagcagggagccccgtgc

SEQ ID NO: 63763 - DNA, 25 bp, E. coli
aaatctctggcgcataatgaccccg

SEQ ID NO: 63764 - DNA, 25 bp, E. coli
aaatctctggcggataatgaccccg

SEQ ID NO: 63765 - DNA, 25 bp, E. coli
tttcgcaaatctctataaggccagc

SEQ ID NO: 63766 - DNA, 25 bp, E. coli
tttcgcaaatctgtataaggccagc

SEQ ID NO: 63767 - DNA, 25 bp, E. coli
tgcctgttgctggagccacgcaagg

SEQ ID NO: 63768 - DNA, 25 bp, E. coli
tgcctgttgctgcagccacgcaagg

SEQ ID NO: 63769 - DNA, 25 bp, E. coli
tctgtataaggccagcagggagccc

SEQ ID NO: 63770 - DNA, 25 bp, E. coli
tctgtataaggcgagcagggagccc

SEQ ID NO: 63771 - DNA, 25 bp, E. coli
cccgtgcagccaaggcgctgagaaa

SEQ ID NO: 63772 - DNA, 25 bp, E. coli
cccgtgcagccatggcgctgagaaa

SEQ ID NO: 63773 - DNA, 25 bp, E. coli
ctggagccacgctaggcgcggtttc

SEQ ID NO: 63774 - DNA, 25 bp, E. coli
ctggagccacgcaaggcgcggtttc

SEQ ID NO: 63775 - DNA, 25 bp, E. coli
gtgtacaaatctgtggcggataatg

SEQ ID NO: 63776 - DNA, 25 bp, E. coli
gtgtacaaatctctggcggataatg

SEQ ID NO: 63777 - DNA, 25 bp, E. coli
taatgaccccggtattacatctgcc

SEQ ID NO: 63778 - DNA, 25 bp, E. coli
taatgaccccggaattacatctgcc

SEQ ID NO: 63779 - DNA, 25 bp, E. coli
agttgacggtcaacgctgttctacc

SEQ ID NO: 63780 - DNA, 25 bp, E. coli
agttgacggtcatcgctgttctacc

SEQ ID NO: 63781 - DNA, 25 bp, E. coli
ttcaacggaatctctcacctggccg

SEQ ID NO: 63782 - DNA, 25 bp, E. coli
ttcaacggaatcactcacctggccg

SEQ ID NO: 63783 - DNA, 25 bp, E. coli
ttaactcgcaggagagggcgcaact

SEQ ID NO: 63784 - DNA, 25 bp, E. coli
ttaactcgcaggtgagggcgcaact

SEQ ID NO: 63785 - DNA, 25 bp, E. coli
tgctctatgtcctctcactacgcga

SEQ ID NO: 63786 - DNA, 25 bp, E. coli
tgttctacccggcattcgctctttg

SEQ ID NO: 63787 - DNA, 25 bp, E. coli
tgctctatgtccactcactacgcga

SEQ ID NO: 63788 - DNA, 25 bp, E. coli
tgttctacccgggattcgctctttg

SEQ ID NO: 63789 - DNA, 25 bp, E. coli
tcactacgcgagttgacggtcaacg

SEQ ID NO: 63790 - DNA, 25 bp, E. coli
tcactacgcgagatgacggtcaacg

SEQ ID NO: 63791 - DNA, 25 bp, E. coli
tctttgctggcacatctccgtgcac

SEQ ID NO: 63792 - DNA, 25 bp, E. coli
tctttgctggcagatctccgtgcac

SEQ ID NO: 63793 - DNA, 25 bp, E. coli
ccggcattcgctctttgctggcaga

SEQ ID NO: 63794 - DNA, 25 bp, E. coli
ccggcattcgctgtttgctggcaga

SEQ ID NO: 63795 - DNA, 25 bp, E. coli
gcaattactgttcccttcaacggaa

SEQ ID NO: 63796 - DNA, 25 bp, E. coli
gcaattactgttgccttcaacggaa

SEQ ID NO: 63797 - DNA, 25 bp, E. coli
cgtgcacagcagttctcggttgggc

SEQ ID NO: 63798 - DNA, 25 bp, E. coli
cgtgcacagcagatctcggttgggc

SEQ ID NO: 63799 - DNA, 25 bp, E. coli
ggaatcactcacctggccgcggtta

SEQ ID NO: 63800 - DNA, 25 bp, E. coli
ggaatcactcacgtggccgcggtta

SEQ ID NO: 63801 - DNA, 25 bp, E. coli
aaatggctctctaccgtcaatgcag

SEQ ID NO: 63802 - DNA, 25 bp, E. coli
aaatggctctcttccgtcaatgcag

SEQ ID NO: 63803 - DNA, 25 bp, E. coli
tttaatttctggagcagtggtcccc

SEQ ID NO: 63804 - DNA, 25 bp, E. coli
tttaatttctggtgcagtggtcccc

SEQ ID NO: 63805 - DNA, 25 bp, E. coli
ttgatatggatagcacccggcagcg

SEQ ID NO: 63806 - DNA, 25 bp, E. coli
ttgatatggataccacccggcagcg

SEQ ID NO: 63807 - DNA, 25 bp, E. coli
tgaactggcagatcaccgaagaggt

SEQ ID NO: 63808 - DNA, 25 bp, E. coli
tgaactggcagaacaccgaagaggt

SEQ ID NO: 63809 - DNA, 25 bp, E. coli
tgaccacgggatataaggcacccag

SEQ ID NO: 63810 - DNA, 25 bp, E. coli
tgaccacgggatttaaggcacccag

SEQ ID NO: 63811 - DNA, 25 bp, E. coli
tcagccgcgggagcttaaggaatcg

SEQ ID NO: 63812 - DNA, 25 bp, E. coli
cctggacccgaagtgaacaacgtga

SEQ ID NO: 63813 - DNA, 25 bp, E. coli
cctggacccgaactgaacaacgtga

SEQ ID NO: 63814 - DNA, 25 bp, E. coli
gctatgtaaacaccggaaaggcccg

SEQ ID NO: 63815 - DNA, 25 bp, E. coli
gctatgtaaacagcggaaaggcccg

SEQ ID NO: 63816 - DNA, 25 bp, E. coli
gaaagacggagttgtccttgccagc

SEQ ID NO: 63817 - DNA, 25 bp, E. coli
gaaagacggagtagtccttgccagc

SEQ ID NO: 63818 - DNA, 25 bp, E. coli
ggagaatacctgaaagcctggacgg

SEQ ID NO: 63819 - DNA, 25 bp, E. coli
ggagaatacctgtaagcctggacgg

SEQ ID NO: 63820 - DNA, 25 bp, E. coli
taatcttggtgcacgtcttgactgg

SEQ ID NO: 63821 - DNA, 25 bp, E. coli
tcagccgcgggaccttaaggaatcg

SEQ ID NO: 63822 - DNA, 25 bp, E. coli
taatcttggtgctcgtcttgactgg

SEQ ID NO: 63823 - DNA, 25 bp, E. coli
cagctgttggcgtgcaaaaccgtat

SEQ ID NO: 63824 - DNA, 25 bp, E. coli
cagctgttggcgagcaaaaccgtat

SEQ ID NO: 63825 - DNA, 25 bp, E. coli
catgaatcacttcgacgcttgcgta

SEQ ID NO: 63826 - DNA, 25 bp, E. coli
catgaatcacttggacgcttgcgta

SEQ ID NO: 63827 - DNA, 25 bp, E. coli
taaaggcggctaacagactggtctg

SEQ ID NO: 63828 - DNA, 25 bp, E. coli
taaaggcggctatcagactggtctg

SEQ ID NO: 63829 - DNA, 25 bp, E. coli
aaacaacactgtgcagcctgtagcg

SEQ ID NO: 63830 - DNA, 25 bp, E. coli
aaacaacactgtccagcctgtagcg

SEQ ID NO: 63831 - DNA, 25 bp, E. coli
tatcgttcgcgccaatccgtgagcg

SEQ ID NO: 63832 - DNA, 25 bp, E. coli
tatcgttcgcgcgaatccgtgagcg

SEQ ID NO: 63833 - DNA, 25 bp, E. coli
tattcgtgccgaagccatcaaagag

SEQ ID NO: 63834 - DNA, 25 bp, E. coli
tattcgtgccgatgccatcaaagag

SEQ ID NO: 63835 - DNA, 25 bp, E. coli
tcgaagttgtggcagctgttccagc

SEQ ID NO: 63836 - DNA, 25 bp, E. coli
tcggtgtcatcttcgcgttcagcaa

SEQ ID NO: 63837 - DNA, 25 bp, E. coli
tcgaagttgtgggagctgttccagc

SEQ ID NO: 63838 - DNA, 25 bp, E. coli
tcggtgtcatctacgcgttcagcaa

SEQ ID NO: 63839 - DNA, 25 bp, E. coli
gctaaagcctgtggtttcccctcaa

SEQ ID NO: 63840 - DNA, 25 bp, E. coli
gctaaagcctgtcgtttcccctcaa

SEQ ID NO: 63841 - DNA, 25 bp, E. coli
gatattaaaatcaccggtcctcgac

SEQ ID NO: 63842 - DNA, 25 bp, E. coli
gatattaaaatctccggtcctcgac

SEQ ID NO: 63843 - DNA, 25 bp, E. coli
gattgatgccaccaaagcgttttcc

SEQ ID NO: 63844 - DNA, 25 bp, E. coli
gattgatgccacgaaagcgttttcc

SEQ ID NO: 63845 - DNA, 25 bp, E. coli
aacgcgacgcgttttgccgatgaac

SEQ ID NO: 63846 - DNA, 25 bp, E. coli
aacgcgacgcgtattgccgatgaac

SEQ ID NO: 63847 - DNA, 25 bp, E. coli
taactgcctgcaacaactctggtcc

SEQ ID NO: 63848 - DNA, 25 bp, E. coli
taactgcctgcatcaactctggtcc

SEQ ID NO: 63849 - DNA, 25 bp, E. coli
aaaggtcacgagattttgcgcgagg

SEQ ID NO: 63850 - DNA, 25 bp, E. coli
aaatgctaaaatttcgcgccagccg

SEQ ID NO: 63851 - DNA, 25 bp, E. coli
aaatgctaaaatatcgcgccagccg

SEQ ID NO: 63852 - DNA, 25 bp, E. coli
aaaggtcacgagtttttgcgcgagg

SEQ ID NO: 63853 - DNA, 25 bp, E. coli
tacgctggagtcacaggaaaaccac

SEQ ID NO: 63854 - DNA, 25 bp, E. coli
tacgctggagtctcaggaaaaccac

SEQ ID NO: 63855 - DNA, 25 bp, E. coli
tgaaagcgataacgatcgccgctgc

SEQ ID NO: 63856 - DNA, 25 bp, E. coli
tgaaagcgataaggatcgccgctgc

SEQ ID NO: 63857 - DNA, 25 bp, E. coli
tgcatctgcaattaacggaaaaagg

SEQ ID NO: 63858 - DNA, 25 bp, E. coli
tgcatctgcaataaacggaaaaagg

SEQ ID NO: 63859 - DNA, 25 bp, E. coli
tccgcgctcagcacaacagaaaaag

SEQ ID NO: 63860 - DNA, 25 bp, E. coli
tccgcgctcagctcaacagaaaaag

SEQ ID NO: 63861 - DNA, 25 bp, E. coli
ccgcaataaaatgctgaaggctcag

SEQ ID NO: 63862 - DNA, 25 bp, E. coli
ccgcaataaaatcctgaaggctcag

SEQ ID NO: 63863 - DNA, 25 bp, E. coli
ggatagttcgtttacgcccattgaa

SEQ ID NO: 63864 - DNA, 25 bp, E. coli
ggatagttcgttaacgcccattgaa

SEQ ID NO: 63865 - DNA, 25 bp, E. coli
tggaaaaacgcgcttggatcgaacg

SEQ ID NO: 63866 - DNA, 25 bp, E. coli
tggaaaaacgcggttggatcgaacg

SEQ ID NO: 63867 - DNA, 25 bp, E. coli
catgtggttaacaggcggtaatgaa

SEQ ID NO: 63868 - DNA, 25 bp, E. coli
catgtggttaactggcggtaatgaa

SEQ ID NO: 63869 - DNA, 25 bp, E. coli
tacttcaccatgtggttaactggcg

SEQ ID NO: 63870 - DNA, 25 bp, E. coli
tacttcaccatgaggttaactggcg

SEQ ID NO: 63871 - DNA, 25 bp, E. coli
tatggatgtttctcgccctgtgtat

SEQ ID NO: 63872 - DNA, 25 bp, E. coli
tatggatgtttcacgccctgtgtat

SEQ ID NO: 63873 - DNA, 25 bp, E. coli
ttgccccggcttctggcttgatgat

SEQ ID NO: 63874 - DNA, 25 bp, E. coli
ttgccccggcttgtggcttgatgat

SEQ ID NO: 63875 - DNA, 25 bp, E. coli
tctcttctttctacggcatggtgat

SEQ ID NO: 63876 - DNA, 25 bp, E. coli
tctcttctttcttcggcatggtgat

SEQ ID NO: 63877 - DNA, 25 bp, E. coli
tctttcttcggcttggtgatcctcg

SEQ ID NO: 63878 - DNA, 25 bp, E. coli
tctttcttcggcatggtgatcctcg

SEQ ID NO: 63879 - DNA, 25 bp, E. coli
gctgcactcattaattacttcacca

SEQ ID NO: 63880 - DNA, 25 bp, E. coli
gctgcactcatttattacttcacca

SEQ ID NO: 63881 - DNA, 25 bp, E. coli
ccctgtgtattgtctgcgtaagcgg

SEQ ID NO: 63882 - DNA, 25 bp, E. coli
ccctgtgtattgactgcgtaagcgg

SEQ ID NO: 63883 - DNA, 25 bp, E. coli
gatatttatgtttcttgccccggct

SEQ ID NO: 63884 - DNA, 25 bp, E. coli
gatatttatgttacttgccccggct

SEQ ID NO: 63885 - DNA, 25 bp, E. coli
ggcatggtgatcctcgctgcactca

SEQ ID NO: 63886 - DNA, 25 bp, E. coli
ggtgatcctcgcagcactcatttat

SEQ ID NO: 63887 - DNA, 25 bp, E. coli
ggtgatcctcgctgcactcatttat

SEQ ID NO: 63888 - DNA, 25 bp, E. coli
ggcatggtgatcgtcgctgcactca

SEQ ID NO: 63889 - DNA, 25 bp, E. coli
caacatccgacatcccgtcttttcc

SEQ ID NO: 63890 - DNA, 25 bp, E. coli
caacatccgacaacccgtcttttcc

SEQ ID NO: 63891 - DNA, 25 bp, E. coli
catccgacatcccgtcttttcccgt

SEQ ID NO: 63892 - DNA, 25 bp, E. coli
catccgacatccggtcttttcccgt

SEQ ID NO: 63893 - DNA, 25 bp, E. coli
acatccgacatcccgtcttttcccg

SEQ ID NO: 63894 - DNA, 25 bp, E. coli
acatccgacatcgcgtcttttcccg

SEQ ID NO: 63895 - DNA, 25 bp, E. coli
acaacatccgacttcccgtcttttc

SEQ ID NO: 63896 - DNA, 25 bp, E. coli
acaacatccgacatcccgtcttttc

SEQ ID NO: 63897 - DNA, 25 bp, E. coli
ttcaccaacaacatccgacatcccg

SEQ ID NO: 63898 - DNA, 25 bp, E. coli
ttcaccaacaacttccgacatcccg

SEQ ID NO: 63899 - DNA, 25 bp, E. coli
tcccgttctgtaccggcaaataccg

SEQ ID NO: 63900 - DNA, 25 bp, E. coli
tcccgttctgtagcggcaaataccg

SEQ ID NO: 63901 - DNA, 25 bp, E. coli
tgctggccgtgtttgctgaacgtcg

SEQ ID NO: 63902 - DNA, 25 bp, E. coli
tgctggccgtgtatgctgaacgtcg

SEQ ID NO: 63903 - DNA, 25 bp, E. coli
gaaaattatcactcgtggtgaagcc

SEQ ID NO: 63904 - DNA, 25 bp, E. coli
gaaaattatcacacgtggtgaagcc

SEQ ID NO: 63905 - DNA, 25 bp, E. coli
ctggccgtgtttcctgaacgtcgta

SEQ ID NO: 63906 - DNA, 25 bp, E. coli
ctggccgtgtttgctgaacgtcgta

SEQ ID NO: 63907 - DNA, 25 bp, E. coli
ggccgtgtttgctgaacgtcgtaag

SEQ ID NO: 63908 - DNA, 25 bp, E. coli
tgtgctggccgtgtttgctgaacgt

SEQ ID NO: 63909 - DNA, 25 bp, E. coli
tgtgctggccgtctttgctgaacgt

SEQ ID NO: 63910 - DNA, 25 bp, E. coli
ggccgtgtttgcagaacgtcgtaag

SEQ ID NO: 63911 - DNA, 25 bp, E. coli
aaccttatctatattgcggcgacac

SEQ ID NO: 63912 - DNA, 25 bp, E. coli
aaccttatctattttgcggcgacac

SEQ ID NO: 63913 - DNA, 25 bp, E. coli
cacgttggcggcctaaaagaactgg

SEQ ID NO: 63914 - DNA, 25 bp, E. coli
cacgttggcggcgtaaaagaactgg

SEQ ID NO: 63915 - DNA, 25 bp, E. coli
tacccgtaattctgaaaaatgagcg

SEQ ID NO: 63916 - DNA, 25 bp, E. coli
tacccgtaattcagaaaaatgagcg

SEQ ID NO: 63917 - DNA, 25 bp, E. coli
ttgaatgatgaagcaggtcgctgcc

SEQ ID NO: 63918 - DNA, 25 bp, E. coli
ttgaatgatgaaccaggtcgctgcc

SEQ ID NO: 63919 - DNA, 25 bp, E. coli
tgcctgattgtccatcccggagacg

SEQ ID NO: 63920 - DNA, 25 bp, E. coli
tgcctgattgtcgatcccggagacg

SEQ ID NO: 63921 - DNA, 25 bp, E. coli
ccaataactggctaccggaggccat

SEQ ID NO: 63922 - DNA, 25 bp, E. coli
ccaataactggcaaccggaggccat

SEQ ID NO: 63923 - DNA, 25 bp, E. coli
gacacaagataacggaacaacacag

SEQ ID NO: 63924 - DNA, 25 bp, E. coli
gacacaagataagggaacaacacag

SEQ ID NO: 63925 - DNA, 25 bp, E. coli
cccggagacgcacagccagtattaa

SEQ ID NO: 63926 - DNA, 25 bp, E. coli
cccggagacgcagagccagtattaa

SEQ ID NO: 63927 - DNA, 25 bp, E. coli
ggtgtatggtccacaagagacacaa

SEQ ID NO: 63928 - DNA, 25 bp, E. coli
gggtcacacttttggacatatctgt

SEQ ID NO: 63929 - DNA, 25 bp, E. coli
gggtcacactttaggacatatctgt

SEQ ID NO: 63930 - DNA, 25 bp, E. coli
ggtgtatggtcctcaagagacacaa

SEQ ID NO: 63931 - DNA, 25 bp, E. coli
gagccagtattatacgccattgccg

SEQ ID NO: 63932 - DNA, 25 bp, E. coli
gagccagtattaaacgccattgccg

SEQ ID NO: 63933 - DNA, 25 bp, E. coli
atgacgcccggcgaagtggttagct

SEQ ID NO: 63934 - DNA, 25 bp, E. coli
atgacgcccggccaagtggttagct

SEQ ID NO: 63935 - DNA, 25 bp, E. coli
tagaagactttgaggcagatattgc

SEQ ID NO: 63936 - DNA, 25 bp, E. coli
tagaagactttgtggcagatattgc

SEQ ID NO: 63937 - DNA, 25 bp, E. coli
tattgccgttatttttaactggtcg

SEQ ID NO: 63938 - DNA, 25 bp, E. coli
tattgccgttatatttaactggtcg

SEQ ID NO: 63939 - DNA, 25 bp, E. coli
tggttagctggcctgagcgggcggc

SEQ ID NO: 63940 - DNA, 25 bp, E. coli
tgctttgagcacatagaagactttg

SEQ ID NO: 63941 - DNA, 25 bp, E. coli
tgctttgagcacttagaagactttg

SEQ ID NO: 63942 - DNA, 25 bp, E. coli
gcgggaatgcagacaatgaagactc

SEQ ID NO: 63943 - DNA, 25 bp, E. coli
gcgggaatgcagtcaatgaagactc

SEQ ID NO: 63944 - DNA, 25 bp, E. coli
gaatgcagacaatgaagactcttga

SEQ ID NO: 63945 - DNA, 25 bp, E. coli
gaatgcagacaaagaagactcttga

SEQ ID NO: 63946 - DNA, 25 bp, E. coli
gactttgtggcagatattgccgtta

SEQ ID NO: 63947 - DNA, 25 bp, E. coli
gaaatcttcatgttgacgcccggcg

SEQ ID NO: 63948 - DNA, 25 bp, E. coli
gaaatcttcatgatgacgcccggcg

SEQ ID NO: 63949 - DNA, 25 bp, E. coli
gactttgtggcacatattgccgtta

SEQ ID NO: 63950 - DNA, 25 bp, E. coli
cggcacttcgcaccgggaatgcaga

SEQ ID NO: 63951 - DNA, 25 bp, E. coli
cggcacttcgcagcgggaatgcaga

SEQ ID NO: 63952 - DNA, 25 bp, E. coli
tggtcgcccgccgaaatcttcatga

SEQ ID NO: 63953 - DNA, 25 bp, E. coli
tggttagctggcgtgagcgggcggc

SEQ ID NO: 63954 - DNA, 25 bp, E. coli
tggtcgcccgcccaaatcttcatga

SEQ ID NO: 63955 - DNA, 25 bp, E. coli
aatagcctgctgtgttgttttccgc

SEQ ID NO: 63956 - DNA, 25 bp, E. coli
aatagcctgctgagttgttttccgc

SEQ ID NO: 63957 - DNA, 25 bp, E. coli
tacgttgatttgtacccgtttatct

SEQ ID NO: 63958 - DNA, 25 bp, E. coli
tacgttgatttgaacccgtttatct

SEQ ID NO: 63959 - DNA, 25 bp, E. coli
aactgttttctgtatgcattgtgca

SEQ ID NO: 63960 - DNA, 25 bp, E. coli
aactgttttctgaatgcattgtgca

SEQ ID NO: 63961 - DNA, 25 bp, E. coli
aaaatctttcttttgcagcgaatcc

SEQ ID NO: 63962 - DNA, 25 bp, E. coli
aaaatctttcttatgcagcgaatcc

SEQ ID NO: 63963 - DNA, 25 bp, E. coli
ttttccatcgattaactgttttctg

SEQ ID NO: 63964 - DNA, 25 bp, E. coli
ttttccatcgataaactgttttctg

SEQ ID NO: 63965 - DNA, 25 bp, E. coli
tggtcagtctgtgcagagcgctttt

SEQ ID NO: 63966 - DNA, 25 bp, E. coli
tgttccagaatagcctgctgtgttg

SEQ ID NO: 63967 - DNA, 25 bp, E. coli
tgttttccgctctctggtcagtctg

SEQ ID NO: 63968 - DNA, 25 bp, E. coli
tgttttccgctcactggtcagtctg

SEQ ID NO: 63969 - DNA, 25 bp, E. coli
tgttccagaataccctgctgtgttg

SEQ ID NO: 63970 - DNA, 25 bp, E. coli
ccagagcgctttttgcggatggcga

SEQ ID NO: 63971 - DNA, 25 bp, E. coli
ccagagcgctttatgcggatggcga

SEQ ID NO: 63972 - DNA, 25 bp, E. coli
gcggatggcgatttctttacgttga

SEQ ID NO: 63973 - DNA, 25 bp, E. coli
gcattgtgcatcttgtcgaaaaatc

SEQ ID NO: 63974 - DNA, 25 bp, E. coli
gcggatggcgatatctttacgttga

SEQ ID NO: 63975 - DNA, 25 bp, E. coli
gcattgtgcatcatgtcgaaaaatc

SEQ ID NO: 63976 - DNA, 25 bp, E. coli
tggtcagtctgtccagagcgctttt

SEQ ID NO: 63977 - DNA, 25 bp, E. coli
aacgtggcgcggaaggtattttgct

SEQ ID NO: 63978 - DNA, 25 bp, E. coli
aacgtggcgcggtaggtattttgct

SEQ ID NO: 63979 - DNA, 25 bp, E. coli
aacacgcagcattatcatcccaaca

SEQ ID NO: 63980 - DNA, 25 bp, E. coli
aacacgcagcataatcatcccaaca

SEQ ID NO: 63981 - DNA, 25 bp, E. coli
tgtctctaccgcaccagaagtgatg

SEQ ID NO: 63982 - DNA, 25 bp, E. coli
tgtctctaccgctccagaagtgatg

SEQ ID NO: 63983 - DNA, 25 bp, E. coli
tgccagtttctaaaaaacacgcagc

SEQ ID NO: 63984 - DNA, 25 bp, E. coli
tgccagtttctataaaacacgcagc

SEQ ID NO: 63985 - DNA, 25 bp, E. coli
gcttcgcggtacagggtgccagttt

SEQ ID NO: 63986 - DNA, 25 bp, E. coli
gcttcgcggtactgggtgccagttt

SEQ ID NO: 63987 - DNA, 25 bp, E. coli
ctgcgcctgcgtctgggtaatgccc

SEQ ID NO: 63988 - DNA, 25 bp, E. coli
cattggcatcgcgtcgatatgcgct

SEQ ID NO: 63989 - DNA, 25 bp, E. coli
ctgcgcctgcgtgtgggtaatgccc

SEQ ID NO: 63990 - DNA, 25 bp, E. coli
cattggcatcgcctcgatatgcgct

SEQ ID NO: 63991 - DNA, 25 bp, E. coli
gatatgcgctctcctggttgtctct

SEQ ID NO: 63992 - DNA, 25 bp, E. coli
gatatgcgctctgctggttgtctct

SEQ ID NO: 63993 - DNA, 25 bp, E. coli
ggtattttgctccacaccattggca

SEQ ID NO: 63994 - DNA, 25 bp, E. coli
tggcctatgggctcgcctggaaagt

SEQ ID NO: 63995 - DNA, 25 bp, E. coli
gtgatgcacgatacacgccgtttcg

SEQ ID NO: 63996 - DNA, 25 bp, E. coli
ggtattttgctcgacaccattggca

SEQ ID NO: 63997 - DNA, 25 bp, E. coli
tggcctatgggcacgcctggaaagt

SEQ ID NO: 63998 - DNA, 25 bp, E. coli
gtgatgcacgattcacgccgtttcg

SEQ ID NO: 63999 - DNA, 25 bp, E. coli
aatgcctgcagcatgcggcggcaat

SEQ ID NO: 64000 - DNA, 25 bp, E. coli
aatgcctgcagcttgcggcggcaat

SEQ ID NO: 64001 - DNA, 25 bp, E. coli
cagtcgctgcgtcaactcatcatgg

SEQ ID NO: 64002 - DNA, 25 bp, E. coli
cagtcgctgcgtgaactcatcatgg

SEQ ID NO: 64003 - DNA, 25 bp, E. coli
tatcggttttggctacgcagcatag

SEQ ID NO: 64004 - DNA, 25 bp, E. coli
tatcggttttgggtacgcagcatag

SEQ ID NO: 64005 - DNA, 25 bp, E. coli
tttccttcctctatcagtcgctgcg

SEQ ID NO: 64006 - DNA, 25 bp, E. coli
tttccttcctctttcagtcgctgcg

SEQ ID NO: 64007 - DNA, 25 bp, E. coli
gctctcgtctgtagcaatgcctgca

SEQ ID NO: 64008 - DNA, 25 bp, E. coli
gctggcagttttccaactggtcaaa

SEQ ID NO: 64009 - DNA, 25 bp, E. coli
gcggcaatgcgcgttgcttttacta

SEQ ID NO: 64010 - DNA, 25 bp, E. coli
gcggcaatgcgccttgcttttacta

SEQ ID NO: 64011 - DNA, 25 bp, E. coli
gctctcgtctgttgcaatgcctgca

SEQ ID NO: 64012 - DNA, 25 bp, E. coli
gctggcagttttgcaactggtcaaa

SEQ ID NO: 64013 - DNA, 25 bp, E. coli
gaataccaggtatatgcggatgtta

SEQ ID NO: 64014 - DNA, 25 bp, E. coli
gaataccaggtaaatgcggatgtta

SEQ ID NO: 64015 - DNA, 25 bp, E. coli
cgtgaactcatcttggaataccagg

SEQ ID NO: 64016 - DNA, 25 bp, E. coli
cgtgaactcatcatggaataccagg

SEQ ID NO: 64017 - DNA, 25 bp, E. coli
ggtcaaaaatacgtgctctcgtctg

SEQ ID NO: 64018 - DNA, 25 bp, E. coli
ggtcaaaaatacctgctctcgtctg

SEQ ID NO: 64019 - DNA, 25 bp, E. coli
gatgttatcggttttggctacgcag

SEQ ID NO: 64020 - DNA, 25 bp, E. coli
gatgttatcggtattggctacgcag

SEQ ID NO: 64021 - DNA, 25 bp, E. coli
cactcactggcatgggatagcggcg

SEQ ID NO: 64022 - DNA, 25 bp, E. coli
cactcactggcaagggatagcggcg

SEQ ID NO: 64023 - DNA, 25 bp, E. coli
cattgataagactgccgaaacggat

SEQ ID NO: 64024 - DNA, 25 bp, E. coli
cattgataagacagccgaaacggat

SEQ ID NO: 64025 - DNA, 25 bp, E. coli
tactgcagcatggtaaggaccgttc

SEQ ID NO: 64026 - DNA, 25 bp, E. coli
taaaacggcgcaatctggtggtgcc

SEQ ID NO: 64027 - DNA, 25 bp, E. coli
taaaacggcgcattctggtggtgcc

SEQ ID NO: 64028 - DNA, 25 bp, E. coli
tactgcagcatgctaaggaccgttc

SEQ ID NO: 64029 - DNA, 25 bp, E. coli
tgcaatggccggtcgatggttacct

SEQ ID NO: 64030 - DNA, 25 bp, E. coli
tgcaatggccggacgatggttacct

SEQ ID NO: 64031 - DNA, 25 bp, E. coli
gcaatatgaactggctgagcacggt

SEQ ID NO: 64032 - DNA, 25 bp, E. coli
gcaatatgaactcgctgagcacggt

SEQ ID NO: 64033 - DNA, 25 bp, E. coli
gacttcaacgaagaaccaggctgta

SEQ ID NO: 64034 - DNA, 25 bp, E. coli
gacttcaacgaacaaccaggctgta

SEQ ID NO: 64035 - DNA, 25 bp, E. coli
gacaggcttggacactccggagata

SEQ ID NO: 64036 - DNA, 25 bp, E. coli
gacaggcttggagactccggagata

SEQ ID NO: 64037 - DNA, 25 bp, E. coli
ggttttttatatccgacgccagcga

SEQ ID NO: 64038 - DNA, 25 bp, E. coli
ggttttttatatgcgacgccagcga

SEQ ID NO: 64039 - DNA, 25 bp, E. coli
tggccccaggagcaaaattcagcga

SEQ ID NO: 64040 - DNA, 25 bp, E. coli
tggccccaggaggaaaattcagcga

SEQ ID NO: 64041 - DNA, 25 bp, E. coli
taagtttccgctcgcaaaggctcag

SEQ ID NO: 64042 - DNA, 25 bp, E. coli
taagtttccgctggcaaaggctcag

SEQ ID NO: 64043 - DNA, 25 bp, E. coli
cagctcgcgcgccataatattgaga

SEQ ID NO: 64044 - DNA, 25 bp, E. coli
cagctcgcgcgcgataatattgaga

SEQ ID NO: 64045 - DNA, 25 bp, E. coli
tacttcatgcgatttgcacggcggc

SEQ ID NO: 64046 - DNA, 25 bp, E. coli
tacaccggcagcatgaatatggtcg

SEQ ID NO: 64047 - DNA, 25 bp, E. coli
tacttcatgcgaattgcacggcggc

SEQ ID NO: 64048 - DNA, 25 bp, E. coli
tacaccggcagcttgaatatggtcg

SEQ ID NO: 64049 - DNA, 25 bp, E. coli
tattcaagctttccgagcgtcgtca

SEQ ID NO: 64050 - DNA, 25 bp, E. coli
tattcaagctttgcgagcgtcgtca

SEQ ID NO: 64051 - DNA, 25 bp, E. coli
ttactgcatacctagagcgtgctgg

SEQ ID NO: 64052 - DNA, 25 bp, E. coli
ttttatatctggcagcccggcggca

SEQ ID NO: 64053 - DNA, 25 bp, E. coli
tttttacgccgtttggacctgcgcc

SEQ ID NO: 64054 - DNA, 25 bp, E. coli
ttactgcataccaagagcgtgctgg

SEQ ID NO: 64055 - DNA, 25 bp, E. coli
ttttatatctgggagcccggcggca

SEQ ID NO: 64056 - DNA, 25 bp, E. coli
tttttacgccgtatggacctgcgcc

SEQ ID NO: 64057 - DNA, 25 bp, E. coli
ttcaaacaagatgcgggcgtagggc

SEQ ID NO: 64058 - DNA, 25 bp, E. coli
ttcaaacaagatccgggcgtagggc

SEQ ID NO: 64059 - DNA, 25 bp, E. coli
gcattctaatgaaacgacgcgcagt

SEQ ID NO: 64060 - DNA, 25 bp, E. coli
gcattctaatgatacgacgcgcagt

SEQ ID NO: 64061 - DNA, 25 bp, E. coli
cgtggcccgagcaaatgcgtaatgc

SEQ ID NO: 64062 - DNA, 25 bp, E. coli
cattatggcaacgtgtcgccgagcg

SEQ ID NO: 64063 - DNA, 25 bp, E. coli
cattatggcaacctgtcgccgagcg

SEQ ID NO: 64064 - DNA, 25 bp, E. coli
cgtggcccgagctaatgcgtaatgc

SEQ ID NO: 64065 - DNA, 25 bp, E. coli
atcttgccgcgcgtggttggctcaa

SEQ ID NO: 64066 - DNA, 25 bp, E. coli
atcttgccgcgcctggttggctcaa

SEQ ID NO: 64067 - DNA, 25 bp, E. coli
aaagagccagtaattattagcccga

SEQ ID NO: 64068 - DNA, 25 bp, E. coli
aaagagccagtatttattagcccga

SEQ ID NO: 64069 - DNA, 25 bp, E. coli
tattagcccgaaggatgccagcgcg

SEQ ID NO: 64070 - DNA, 25 bp, E. coli
tattagcccgaacgatgccagcgcg

SEQ ID NO: 64071 - DNA, 25 bp, E. coli
tttattagcccgaaggatgccagcg

SEQ ID NO: 64072 - DNA, 25 bp, E. coli
tttattagcccgtaggatgccagcg

SEQ ID NO: 64073 - DNA, 25 bp, E. coli
tggtcaggtgttcgctggagcagtg

SEQ ID NO: 64074 - DNA, 25 bp, E. coli
ccagtatttatttgcccgaaggatg

SEQ ID NO: 64075 - DNA, 25 bp, E. coli
ccagtatttattagcccgaaggatg

SEQ ID NO: 64076 - DNA, 25 bp, E. coli
gagccagtatttattagcccgaagg

SEQ ID NO: 64077 - DNA, 25 bp, E. coli
gagccagtattttttagcccgaagg

SEQ ID NO: 64078 - DNA, 25 bp, E. coli
cgatccggacaatggcggcgagcca

SEQ ID NO: 64079 - DNA, 25 bp, E. coli
cgatccggacaaaggcggcgagcca

SEQ ID NO: 64080 - DNA, 25 bp, E. coli
cgtggttggctctatggaagtgtat

SEQ ID NO: 64081 - DNA, 25 bp, E. coli
cgtggttggctcaatggaagtgtat

SEQ ID NO: 64082 - DNA, 25 bp, E. coli
ggttggctcaatcgaagtgtatgaa

SEQ ID NO: 64083 - DNA, 25 bp, E. coli
ggttggctcaatggaagtgtatgaa

SEQ ID NO: 64084 - DNA, 25 bp, E. coli
tggtcaggtgttggctggagcagtg

SEQ ID NO: 64085 - DNA, 25 bp, E. coli
taacgttcgtggtcaggtgttggct

SEQ ID NO: 64086 - DNA, 25 bp, E. coli
taacgttcgtggacaggtgttggct

SEQ ID NO: 64087 - DNA, 25 bp, E. coli
caacgctaatcaaagcattaactgg

SEQ ID NO: 64088 - DNA, 25 bp, E. coli
aaggcaaaccgctaaacctgcgatc

SEQ ID NO: 64089 - DNA, 25 bp, E. coli
aaggcaaaccgcaaaacctgcgatc

SEQ ID NO: 64090 - DNA, 25 bp, E. coli
caacgctaatcatagcattaactgg

SEQ ID NO: 64091 - DNA, 25 bp, E. coli
aaaacctgcgatcgccacatcaggc

SEQ ID NO: 64092 - DNA, 25 bp, E. coli
aaaacctgcgatggccacatcaggc

SEQ ID NO: 64093 - DNA, 25 bp, E. coli
taggctgtcgggaaacgtgcgagct

SEQ ID NO: 64094 - DNA, 25 bp, E. coli
taggctgtcgggtaacgtgcgagct

SEQ ID NO: 64095 - DNA, 25 bp, E. coli
tttcgtaggctgtcgggaaacgtgc

SEQ ID NO: 64096 - DNA, 25 bp, E. coli
tttataggccgcgaacccaaacgct

SEQ ID NO: 64097 - DNA, 25 bp, E. coli
tttataggccgccaacccaaacgct

SEQ ID NO: 64098 - DNA, 25 bp, E. coli
tttcgtaggctgacgggaaacgtgc

SEQ ID NO: 64099 - DNA, 25 bp, E. coli
tgtttgacctgatgcgtcagttgcg

SEQ ID NO: 64100 - DNA, 25 bp, E. coli
tgtttgacctgaagcgtcagttgcg

SEQ ID NO: 64101 - DNA, 25 bp, E. coli
tgacctgatgcgtcagttgcgcgat

SEQ ID NO: 64102 - DNA, 25 bp, E. coli
tgacctgatgcgacagttgcgcgat

SEQ ID NO: 64103 - DNA, 25 bp, E. coli
gcgcgagctggatacccacgcgcta

SEQ ID NO: 64104 - DNA, 25 bp, E. coli
gcgcgagctggaaacccacgcgcta

SEQ ID NO: 64105 - DNA, 25 bp, E. coli
gctacgtcccatttcccgcaaagaa

SEQ ID NO: 64106 - DNA, 25 bp, E. coli
gctacgtcccatatcccgcaaagaa

SEQ ID NO: 64107 - DNA, 25 bp, E. coli
ctgatgcgtcagatgcgcgatcgcg

SEQ ID NO: 64108 - DNA, 25 bp, E. coli
ctgatgcgtcagttgcgcgatcgcg

SEQ ID NO: 64109 - DNA, 25 bp, E. coli
aaagaagctgctggccgttgtgacc

SEQ ID NO: 64110 - DNA, 25 bp, E. coli
aaagaagctgctcgccgttgtgacc

SEQ ID NO: 64111 - DNA, 25 bp, E. coli
tatacttgtggtggccaagaccaac

SEQ ID NO: 64112 - DNA, 25 bp, E. coli
tatacttgtggtcgccaagaccaac

SEQ ID NO: 64113 - DNA, 25 bp, E. coli
tgaaagaagcggtccagatatatgg

SEQ ID NO: 64114 - DNA, 25 bp, E. coli
tgaaagaagcggaccagatatatgg

SEQ ID NO: 64115 - DNA, 25 bp, E. coli
tctttgtgtccctgatggtaaaggg

SEQ ID NO: 64116 - DNA, 25 bp, E. coli
tctttgtgtcccagatggtaaaggg

SEQ ID NO: 64117 - DNA, 25 bp, E. coli
gctggccgttgtgacctcgttgaaa

SEQ ID NO: 64118 - DNA, 25 bp, E. coli
gctggccgttgtcacctcgttgaaa

SEQ ID NO: 64119 - DNA, 25 bp, E. coli
gaatcaaaaggagatggtctatggg

SEQ ID NO: 64120 - DNA, 25 bp, E. coli
gaatcaaaaggacatggtctatggg

SEQ ID NO: 64121 - DNA, 25 bp, E. coli
ccgataatagttgtgtggagaactg

SEQ ID NO: 64122 - DNA, 25 bp, E. coli
ccgataatagttctgtggagaactg

SEQ ID NO: 64123 - DNA, 25 bp, E. coli
gtgacctcgttgaaaccgataatag

SEQ ID NO: 64124 - DNA, 25 bp, E. coli
gtgacctcgttgtaaccgataatag

SEQ ID NO: 64125 - DNA, 25 bp, E. coli
gggaatccgttctatcatcaatatc

SEQ ID NO: 64126 - DNA, 25 bp, E. coli
gggccaggtaaagcaagtaatgata

SEQ ID NO: 64127 - DNA, 25 bp, E. coli
gggaatccgttcaatcatcaatatc

SEQ ID NO: 64128 - DNA, 25 bp, E. coli
gggccaggtaaaccaagtaatgata

SEQ ID NO: 64129 - DNA, 25 bp, E. coli
taatgatacaaaagaagctgctggc

SEQ ID NO: 64130 - DNA, 25 bp, E. coli
taatgatacaaatgaagctgctggc

SEQ ID NO: 64131 - DNA, 25 bp, E. coli
caggtcatacactttaaggcattta

SEQ ID NO: 64132 - DNA, 25 bp, E. coli
caggtcatacacattaaggcattta

SEQ ID NO: 64133 - DNA, 25 bp, E. coli
aaaatataccataagcaatgcaagc

SEQ ID NO: 64134 - DNA, 25 bp, E. coli
aaaatataccattagcaatgcaagc

SEQ ID NO: 64135 - DNA, 25 bp, E. coli
tgagtcaatcaaaaataatttggca

SEQ ID NO: 64136 - DNA, 25 bp, E. coli
tgaatccaggtcttacacattaagg

SEQ ID NO: 64137 - DNA, 25 bp, E. coli
tgagtcaatcaataataatttggca

SEQ ID NO: 64138 - DNA, 25 bp, E. coli
tgaatccaggtcatacacattaagg

SEQ ID NO: 64139 - DNA, 25 bp, E. coli
gcaatgcaagctaaaaactcataat

SEQ ID NO: 64140 - DNA, 25 bp, E. coli
gcaatgcaagcttaaaactcataat

SEQ ID NO: 64141 - DNA, 25 bp, E. coli
gaacagtacttttaccaataatgaa

SEQ ID NO: 64142 - DNA, 25 bp, E. coli
gaacagtactttaaccaataatgaa

SEQ ID NO: 64143 - DNA, 25 bp, E. coli
cgtaattaagataactaataaggtg

SEQ ID NO: 64144 - DNA, 25 bp, E. coli
cgtaattaagattactaataaggtg

SEQ ID NO: 64145 - DNA, 25 bp, E. coli
gttattagtttgtagtgaacagtac

SEQ ID NO: 64146 - DNA, 25 bp, E. coli
gttattagtttgaagtgaacagtac

SEQ ID NO: 64147 - DNA, 25 bp, E. coli
tcacgagacacaacacagaggaata

SEQ ID NO: 64148 - DNA, 25 bp, E. coli
taaggtgaatataagtaaaacaact

SEQ ID NO: 64149 - DNA, 25 bp, E. coli
taataatttggcttcacgagacaca

SEQ ID NO: 64150 - DNA, 25 bp, E. coli
taaggtgaatattagtaaaacaact

SEQ ID NO: 64151 - DNA, 25 bp, E. coli
tcacgagacacatcacagaggaata

SEQ ID NO: 64152 - DNA, 25 bp, E. coli
taataatttggcatcacgagacaca

SEQ ID NO: 64153 - DNA, 25 bp, E. coli
catggcgcgcactagctataatacc

SEQ ID NO: 64154 - DNA, 25 bp, E. coli
catggcgcgcacaagctataatacc

SEQ ID NO: 64155 - DNA, 25 bp, E. coli
taaattgcgcgcgaatcatggcgcg

SEQ ID NO: 64156 - DNA, 25 bp, E. coli
taaattgcgcgccaatcatggcgcg

SEQ ID NO: 64157 - DNA, 25 bp, E. coli
tagagtgactatttctcctgataga

SEQ ID NO: 64158 - DNA, 25 bp, E. coli
tagagtgactatatctcctgataga

SEQ ID NO: 64159 - DNA, 25 bp, E. coli
tatacttaacataaggacttccact

SEQ ID NO: 64160 - DNA, 25 bp, E. coli
tatacttaacattaggacttccact

SEQ ID NO: 64161 - DNA, 25 bp, E. coli
tgccctgattcgttgtttattgtaa

SEQ ID NO: 64162 - DNA, 25 bp, E. coli
tgccctgattcgatgtttattgtaa

SEQ ID NO: 64163 - DNA, 25 bp, E. coli
ccctccagaacctagtgctgatatt

SEQ ID NO: 64164 - DNA, 25 bp, E. coli
ccctccagaaccaagtgctgatatt

SEQ ID NO: 64165 - DNA, 25 bp, E. coli
ctcctgatagaaatgcggtattgac

SEQ ID NO: 64166 - DNA, 25 bp, E. coli
cggtattgactatcaaatgccctga

SEQ ID NO: 64167 - DNA, 25 bp, E. coli
cggtattgactaacaaatgccctga

SEQ ID NO: 64168 - DNA, 25 bp, E. coli
ctcctgatagaattgcggtattgac

SEQ ID NO: 64169 - DNA, 25 bp, E. coli
gataacttaaatgcatcattgccca

SEQ ID NO: 64170 - DNA, 25 bp, E. coli
gataacttaaatccatcattgccca

SEQ ID NO: 64171 - DNA, 25 bp, E. coli
gtaatatctcctctatctgcagacg

SEQ ID NO: 64172 - DNA, 25 bp, E. coli
gtaatatctcctgtatctgcagacg

SEQ ID NO: 64173 - DNA, 25 bp, E. coli
taatttctcctcgtcttagagtgac

SEQ ID NO: 64174 - DNA, 25 bp, E. coli
taatttctcctcctcttagagtgac

SEQ ID NO: 64175 - DNA, 25 bp, E. coli
caaaggccgccatgaaagaagtcgt

SEQ ID NO: 64176 - DNA, 25 bp, E. coli
caaattgactccctggcggtagcaa

SEQ ID NO: 64177 - DNA, 25 bp, E. coli
caaattgactccgtggcggtagcaa

SEQ ID NO: 64178 - DNA, 25 bp, E. coli
caaaggccgccaagaaagaagtcgt

SEQ ID NO: 64179 - DNA, 25 bp, E. coli
tttaacaaggttcgcgcagggatcc

SEQ ID NO: 64180 - DNA, 25 bp, E. coli
tatatgcgcatgaaccacgactgga

SEQ ID NO: 64181 - DNA, 25 bp, E. coli
tatatgcgcatgtaccacgactgga

SEQ ID NO: 64182 - DNA, 25 bp, E. coli
tttaacaaggttggcgcagggatcc

SEQ ID NO: 64183 - DNA, 25 bp, E. coli
tttgaagacaacattgcgcgagtgc

SEQ ID NO: 64184 - DNA, 25 bp, E. coli
tttgaagacaactttgcgcgagtgc

SEQ ID NO: 64185 - DNA, 25 bp, E. coli
tcgttagtacaatcgctggctcgcg

SEQ ID NO: 64186 - DNA, 25 bp, E. coli
tcgggcttatcgcaacaggacgttc

SEQ ID NO: 64187 - DNA, 25 bp, E. coli
tcgggcttatcggaacaggacgttc

SEQ ID NO: 64188 - DNA, 25 bp, E. coli
tcgttagtacaaacgctggctcgcg

SEQ ID NO: 64189 - DNA, 25 bp, E. coli
gaaaattgcgtttgccgatgcgtta

SEQ ID NO: 64190 - DNA, 25 bp, E. coli
gaaaattgcgttagccgatgcgtta

SEQ ID NO: 64191 - DNA, 25 bp, E. coli
cgactggattttgtgcggctggaac

SEQ ID NO: 64192 - DNA, 25 bp, E. coli
cgactggattttctgcggctggaac

SEQ ID NO: 64193 - DNA, 25 bp, E. coli
gatccacgtcacaatatgcagcccg

SEQ ID NO: 64194 - DNA, 25 bp, E. coli
ggtagcaatcggcacagcacatggt

SEQ ID NO: 64195 - DNA, 25 bp, E. coli
ggtagcaatcgggacagcacatggt

SEQ ID NO: 64196 - DNA, 25 bp, E. coli
gatccacgtcactatatgcagcccg

SEQ ID NO: 64197 - DNA, 25 bp, E. coli
aacggcaaaacccagcagcttgagg

SEQ ID NO: 64198 - DNA, 25 bp, E. coli
caaatttgctcatcagtagcggtgc

SEQ ID NO: 64199 - DNA, 25 bp, E. coli
cagcttgaggtggatacccgaacca

SEQ ID NO: 64200 - DNA, 25 bp, E. coli
cagcttgaggtgcatacccgaacca

SEQ ID NO: 64201 - DNA, 25 bp, E. coli
caaatttgctcaacagtagcggtgc

SEQ ID NO: 64202 - DNA, 25 bp, E. coli
atgagcaaccaacgcgaataccccg

SEQ ID NO: 64203 - DNA, 25 bp, E. coli
agataatcttcagcccatgcaggcg

SEQ ID NO: 64204 - DNA, 25 bp, E. coli
agataatcttcaccccatgcaggcg

SEQ ID NO: 64205 - DNA, 25 bp, E. coli
atgagcaaccaaggcgaataccccg

SEQ ID NO: 64206 - DNA, 25 bp, E. coli
aacggcaaaaccgagcagcttgagg

SEQ ID NO: 64207 - DNA, 25 bp, E. coli
gcaggcggcctttatcaagcatgat

SEQ ID NO: 64208 - DNA, 25 bp, E. coli
gcaggcggccttaatcaagcatgat

SEQ ID NO: 64209 - DNA, 25 bp, E. coli
gaaaggttgcgaacacggacagtgc

SEQ ID NO: 64210 - DNA, 25 bp, E. coli
gaaaggttgcgatcacggacagtgc

SEQ ID NO: 64211 - DNA, 25 bp, E. coli
cgtgaacgtatgtgcggcaacatct

SEQ ID NO: 64212 - DNA, 25 bp, E. coli
cgtgaacgtatgagcggcaacatct

SEQ ID NO: 64213 - DNA, 25 bp, E. coli
tgtaccgtgctggtcaatggtcgca

SEQ ID NO: 64214 - DNA, 25 bp, E. coli
gatctgattaaagtgagcgccgcaa

SEQ ID NO: 64215 - DNA, 25 bp, E. coli
gatctgattaaactgagcgccgcaa

SEQ ID NO: 64216 - DNA, 25 bp, E. coli
tgtaccgtgctgctcaatggtcgca

SEQ ID NO: 64217 - DNA, 25 bp, E. coli
gagatcaccacctttgaaggcctgg

SEQ ID NO: 64218 - DNA, 25 bp, E. coli
gagatcaccaccattgaaggcctgg

SEQ ID NO: 64219 - DNA, 25 bp, E. coli
aatatttgatacgagacctctccgc

SEQ ID NO: 64220 - DNA, 25 bp, E. coli
aatatttgataccagacctctccgc

SEQ ID NO: 64221 - DNA, 25 bp, E. coli
tgtgtggatgcaaaaggcgtaagcc

SEQ ID NO: 64222 - DNA, 25 bp, E. coli
tgggcaagtaaagcggaaacatcag

SEQ ID NO: 64223 - DNA, 25 bp, E. coli
tgtgtggatgcataaggcgtaagcc

SEQ ID NO: 64224 - DNA, 25 bp, E. coli
tgagccattaaatcatttgcctgac

SEQ ID NO: 64225 - DNA, 25 bp, E. coli
tgactactgcaatgatccgagcgct

SEQ ID NO: 64226 - DNA, 25 bp, E. coli
tgactactgcaaagatccgagcgct

SEQ ID NO: 64227 - DNA, 25 bp, E. coli
tgagccattaaaacatttgcctgac

SEQ ID NO: 64228 - DNA, 25 bp, E. coli
tcctgatgcaggtggccaataatgc

SEQ ID NO: 64229 - DNA, 25 bp, E. coli
tcctgatgcaggaggccaataatgc

SEQ ID NO: 64230 - DNA, 25 bp, E. coli
gccgccatgattctctttctcctga

SEQ ID NO: 64231 - DNA, 25 bp, E. coli
ccaacaaatggttttacggaaatgc

SEQ ID NO: 64232 - DNA, 25 bp, E. coli
gccgccatgattgtctttctcctga

SEQ ID NO: 64233 - DNA, 25 bp, E. coli
ccaacaaatggtattacggaaatgc

SEQ ID NO: 64234 - DNA, 25 bp, E. coli
cgagcgcttcatcgccgattattga

SEQ ID NO: 64235 - DNA, 25 bp, E. coli
cgagcgcttcatggccgattattga

SEQ ID NO: 64236 - DNA, 25 bp, E. coli
cggaaatgctgatacaacttttgag

SEQ ID NO: 64237 - DNA, 25 bp, E. coli
cggaaatgctgaaacaacttttgag

SEQ ID NO: 64238 - DNA, 25 bp, E. coli
ggaaacatcaggcaataacaccaac

SEQ ID NO: 64239 - DNA, 25 bp, E. coli
ggaaacatcagggaataacaccaac

SEQ ID NO: 64240 - DNA, 25 bp, E. coli
tgggcaagtaaaccggaaacatcag

SEQ ID NO: 64241 - DNA, 25 bp, E. coli
aaaagcgagatttaccgcgatcggc

SEQ ID NO: 64242 - DNA, 25 bp, E. coli
aaaagcgagattaaccgcgatcggc

SEQ ID NO: 64243 - DNA, 25 bp, E. coli
tttttgacggactaggccaggagca

SEQ ID NO: 64244 - DNA, 25 bp, E. coli
tttttgacggacaaggccaggagca

SEQ ID NO: 64245 - DNA, 25 bp, E. coli
tgtctgttccgcagcaagagcagcc

SEQ ID NO: 64246 - DNA, 25 bp, E. coli
tgtctgttccgctgcaagagcagcc

SEQ ID NO: 64247 - DNA, 25 bp, E. coli
tgagaaatacaccttcagcgacccg

SEQ ID NO: 64248 - DNA, 25 bp, E. coli
tgagaaatacacgttcagcgacccg

SEQ ID NO: 64249 - DNA, 25 bp, E. coli
tcaggcgctcgtagaagccaaaggc

SEQ ID NO: 64250 - DNA, 25 bp, E. coli
tctgctgtatatggcccaaagcggg

SEQ ID NO: 64251 - DNA, 25 bp, E. coli
tcaggcgctcgttgaagccaaaggc

SEQ ID NO: 64252 - DNA, 25 bp, E. coli
tctgctgtatatcgcccaaagcggg

SEQ ID NO: 64253 - DNA, 25 bp, E. coli
gacgcgccgggacgttcacaatttg

SEQ ID NO: 64254 - DNA, 25 bp, E. coli
cggcccgtggatcgaacaagtcaaa

SEQ ID NO: 64255 - DNA, 25 bp, E. coli
cggcccgtggatggaacaagtcaaa

SEQ ID NO: 64256 - DNA, 25 bp, E. coli
gattgccggactgatctgttcacca

SEQ ID NO: 64257 - DNA, 25 bp, E. coli
gattgccggactcatctgttcacca

SEQ ID NO: 64258 - DNA, 25 bp, E. coli
tggtaaccgcttcctgccgaaaagc

SEQ ID NO: 64259 - DNA, 25 bp, E. coli
tggtaaccgcttgctgccgaaaagc

SEQ ID NO: 64260 - DNA, 25 bp, E. coli
taactgtcacctaccagggctgtgc

SEQ ID NO: 64261 - DNA, 25 bp, E. coli
taactgtcaccttccagggctgtgc

SEQ ID NO: 64262 - DNA, 25 bp, E. coli
gacgcgccgggaggttcacaatttg

SEQ ID NO: 64263 - DNA, 25 bp, E. coli
cagcgagacgctggcgatgattatt

SEQ ID NO: 64264 - DNA, 25 bp, E. coli
cagcgagacgctcgcgatgattatt

SEQ ID NO: 64265 - DNA, 25 bp, E. coli
atatcaacgccggtggcgaagcgca

SEQ ID NO: 64266 - DNA, 25 bp, E. coli
atatcaacgccgctggcgaagcgca

SEQ ID NO: 64267 - DNA, 25 bp, E. coli
aaagcggaaaccgtgcgtgaagcgc

SEQ ID NO: 64268 - DNA, 25 bp, E. coli
aaagcggaaaccctgcgtgaagcgc

SEQ ID NO: 64269 - DNA, 25 bp, E. coli
tgtcgcaactgacccatatcaacgc

SEQ ID NO: 64270 - DNA, 25 bp, E. coli
tgtcgcaactgagccatatcaacgc

SEQ ID NO: 64271 - DNA, 25 bp, E. coli
gcggcaaaacgcacctgggatctga

SEQ ID NO: 64272 - DNA, 25 bp, E. coli
gcggcaaaacgctcctgggatctga

SEQ ID NO: 64273 - DNA, 25 bp, E. coli
gaagcgcacatggtggatgtctccg

SEQ ID NO: 64274 - DNA, 25 bp, E. coli
gaagcgcacatgctggatgtctccg

SEQ ID NO: 64275 - DNA, 25 bp, E. coli
cgatgattattgatggtcgccacca

SEQ ID NO: 64276 - DNA, 25 bp, E. coli
cgatgattattgttggtcgccacca

SEQ ID NO: 64277 - DNA, 25 bp, E. coli
ctttgtcaccatccgcagcgagacg

SEQ ID NO: 64278 - DNA, 25 bp, E. coli
ctttgtcaccatgcgcagcgagacg

SEQ ID NO: 64279 - DNA, 25 bp, E. coli
ggtcgccaccactaaggcgacgtat

SEQ ID NO: 64280 - DNA, 25 bp, E. coli
ggtcgccaccacaaaggcgacgtat

SEQ ID NO: 64281 - DNA, 25 bp, E. coli
ggcgacgtatttcccactgcgcgta

SEQ ID NO: 64282 - DNA, 25 bp, E. coli
ggcgacgtatttgccactgcgcgta

SEQ ID NO: 64283 - DNA, 25 bp, E. coli
gatgtctccgccaaagcggaaaccg

SEQ ID NO: 64284 - DNA, 25 bp, E. coli
gatgtctccgcctaagcggaaaccg

SEQ ID NO: 64285 - DNA, 25 bp, E. coli
tacaaggcgcgtcactgtggaatgc

SEQ ID NO: 64286 - DNA, 25 bp, E. coli
tacaaggcgcgtgactgtggaatgc

SEQ ID NO: 64287 - DNA, 25 bp, E. coli
ttgccgggattaggcgccataagtg

SEQ ID NO: 64288 - DNA, 25 bp, E. coli
ttcaatcccggtcttctggctggcg

SEQ ID NO: 64289 - DNA, 25 bp, E. coli
ttgccgggattacgcgccataagtg

SEQ ID NO: 64290 - DNA, 25 bp, E. coli
ttcaatcccggtgttctggctggcg

SEQ ID NO: 64291 - DNA, 25 bp, E. coli
tgatcaacgccatcgccttactggg

SEQ ID NO: 64292 - DNA, 25 bp, E. coli
tgatcaacgccaacgccttactggg

SEQ ID NO: 64293 - DNA, 25 bp, E. coli
tcccggcgacgatggaactgtgcat

SEQ ID NO: 64294 - DNA, 25 bp, E. coli
tcccggcgacgaaggaactgtgcat

SEQ ID NO: 64295 - DNA, 25 bp, E. coli
tctacgaagtgaaaccgattaccgg

SEQ ID NO: 64296 - DNA, 25 bp, E. coli
tctacgaagtgataccgattaccgg

SEQ ID NO: 64297 - DNA, 25 bp, E. coli
cggttgcgccaagaactgaagtgat

SEQ ID NO: 64298 - DNA, 25 bp, E. coli
cggttgcgccaacaactgaagtgat

SEQ ID NO: 64299 - DNA, 25 bp, E. coli
gatattgcccgtgatcaccctgtcg

SEQ ID NO: 64300 - DNA, 25 bp, E. coli
gatattgcccgtcatcaccctgtcg

SEQ ID NO: 64301 - DNA, 25 bp, E. coli
ggtttaacggcctgatccactggga

SEQ ID NO: 64302 - DNA, 25 bp, E. coli
ggtttaacggccagatccactggga

SEQ ID NO: 64303 - DNA, 25 bp, E. coli
tcactcacgctacgttggttgcccg

SEQ ID NO: 64304 - DNA, 25 bp, E. coli
tcaccgaaatggtttttagctggcc

SEQ ID NO: 64305 - DNA, 25 bp, E. coli
tcactcacgctaggttggttgcccg

SEQ ID NO: 64306 - DNA, 25 bp, E. coli
tcaccgaaatggattttagctggcc

SEQ ID NO: 64307 - DNA, 25 bp, E. coli
aatgtctttgcagtacctgcggata

SEQ ID NO: 64308 - DNA, 25 bp, E. coli
aatgtctttgcactacctgcggata

SEQ ID NO: 64309 - DNA, 25 bp, E. coli
caaatacagggcgttttacgcgatc

SEQ ID NO: 64310 - DNA, 25 bp, E. coli
caaatacagggccttttacgcgatc

SEQ ID NO: 64311 - DNA, 25 bp, E. coli
acagggcgtttttcgcgatctgcgc

SEQ ID NO: 64312 - DNA, 25 bp, E. coli
aacaatgtctttgcactacctgcgg

SEQ ID NO: 64313 - DNA, 25 bp, E. coli
aacaatgtctttccactacctgcgg

SEQ ID NO: 64314 - DNA, 25 bp, E. coli
acagggcgttttacgcgatctgcgc

SEQ ID NO: 64315 - DNA, 25 bp, E. coli
ttaacagccgtgaaatgagcgcgcc

SEQ ID NO: 64316 - DNA, 25 bp, E. coli
ttaacagccgtgtaatgagcgcgcc

SEQ ID NO: 64317 - DNA, 25 bp, E. coli
tctttgcactacgtgcggatatgcc

SEQ ID NO: 64318 - DNA, 25 bp, E. coli
tctttgcactacctgcggatatgcc

SEQ ID NO: 64319 - DNA, 25 bp, E. coli
gcgttccatttagcgcaaggatgtg

SEQ ID NO: 64320 - DNA, 25 bp, E. coli
gcgaaacaatgtgtttgcactacct

SEQ ID NO: 64321 - DNA, 25 bp, E. coli
gcgaaacaatgtctttgcactacct

SEQ ID NO: 64322 - DNA, 25 bp, E. coli
gcgttccatttaccgcaaggatgtg

SEQ ID NO: 64323 - DNA, 25 bp, E. coli
gcactacctgcgcatatgcctattg

SEQ ID NO: 64324 - DNA, 25 bp, E. coli
gcaaacatttaacagccgtgaaatg

SEQ ID NO: 64325 - DNA, 25 bp, E. coli
gcactacctgcggatatgcctattg

SEQ ID NO: 64326 - DNA, 25 bp, E. coli
gcatgcgttccatttagcgcaagga

SEQ ID NO: 64327 - DNA, 25 bp, E. coli
gcaaacatttaagagccgtgaaatg

SEQ ID NO: 64328 - DNA, 25 bp, E. coli
gcatgcgttccaattagcgcaagga

SEQ ID NO: 64329 - DNA, 25 bp, E. coli
caggctcatgtattaaatgttgcag

SEQ ID NO: 64330 - DNA, 25 bp, E. coli
caggctcatgtaataaatgttgcag

SEQ ID NO: 64331 - DNA, 25 bp, E. coli
aacagccccgaaatgctcccggatt

SEQ ID NO: 64332 - DNA, 25 bp, E. coli
acaaaccgctggtgtaacagccccg

SEQ ID NO: 64333 - DNA, 25 bp, E. coli
aacagccccgaattgctcccggatt

SEQ ID NO: 64334 - DNA, 25 bp, E. coli
acaaaccgctggagtaacagccccg

SEQ ID NO: 64335 - DNA, 25 bp, E. coli
tgttgcagcaacaaaccgctggtgt

SEQ ID NO: 64336 - DNA, 25 bp, E. coli
tgttgcagcaactaaccgctggtgt

SEQ ID NO: 64337 - DNA, 25 bp, E. coli
tcccggattacacagcctggctgcg

SEQ ID NO: 64338 - DNA, 25 bp, E. coli
tcccggattacagagcctggctgcg

SEQ ID NO: 64339 - DNA, 25 bp, E. coli
gctgcgcgccgaaacataccttcgt

SEQ ID NO: 64340 - DNA, 25 bp, E. coli
gctgcgcgccgatacataccttcgt

SEQ ID NO: 64341 - DNA, 25 bp, E. coli
gacatattgattagcgaacttcaaa

SEQ ID NO: 64342 - DNA, 25 bp, E. coli
gaaatgctcccgcattacagagcct

SEQ ID NO: 64343 - DNA, 25 bp, E. coli
gaaatgctcccggattacagagcct

SEQ ID NO: 64344 - DNA, 25 bp, E. coli
gaaacataccttggtctcgacatat

SEQ ID NO: 64345 - DNA, 25 bp, E. coli
gacatattgatttgcgaacttcaaa

SEQ ID NO: 64346 - DNA, 25 bp, E. coli
gaaacataccttcgtctcgacatat

SEQ ID NO: 64347 - DNA, 25 bp, E. coli
cgctggtgtaactgccccgaaatgc

SEQ ID NO: 64348 - DNA, 25 bp, E. coli
cgctggtgtaacagccccgaaatgc

SEQ ID NO: 64349 - DNA, 25 bp, E. coli
cttcgtctcgacttattgattagcg

SEQ ID NO: 64350 - DNA, 25 bp, E. coli
cttcgtctcgacatattgattagcg

SEQ ID NO: 64351 - DNA, 25 bp, E. coli
caaaaatgaatgattccagtagaac

SEQ ID NO: 64352 - DNA, 25 bp, E. coli
caaaaatgaatgtttccagtagaac

SEQ ID NO: 64353 - DNA, 25 bp, E. coli
catcttcagaatgagtattattgcg

SEQ ID NO: 64354 - DNA, 25 bp, E. coli
catcttcagaatcagtattattgcg

SEQ ID NO: 64355 - DNA, 25 bp, E. coli
aaaaatcatcaaacagcaacttgcc

SEQ ID NO: 64356 - DNA, 25 bp, E. coli
aaaaatcatcaatcagcaacttgcc

SEQ ID NO: 64357 - DNA, 25 bp, E. coli
tattattgcggaatttcttaacccg

SEQ ID NO: 64358 - DNA, 25 bp, E. coli
tattattgcggattttcttaacccg

SEQ ID NO: 64359 - DNA, 25 bp, E. coli
tgataaatttctatgctgctgttgg

SEQ ID NO: 64360 - DNA, 25 bp, E. coli
tgataaatttctttgctgctgttgg

SEQ ID NO: 64361 - DNA, 25 bp, E. coli
tgtagtgattttgcacgcagcacgt

SEQ ID NO: 64362 - DNA, 25 bp, E. coli
tgtagtgattttccacgcagcacgt

SEQ ID NO: 64363 - DNA, 25 bp, E. coli
tgacagtacgcaagatcatctcata

SEQ ID NO: 64364 - DNA, 25 bp, E. coli
tgacagtacgcatgatcatctcata

SEQ ID NO: 64365 - DNA, 25 bp, E. coli
tcttaacccgtactatacacatagg

SEQ ID NO: 64366 - DNA, 25 bp, E. coli
tcttaacccgtagtatacacatagg

SEQ ID NO: 64367 - DNA, 25 bp, E. coli
gcaacttgcccttatccatcttcag

SEQ ID NO: 64368 - DNA, 25 bp, E. coli
gcaacttgccctaatccatcttcag

SEQ ID NO: 64369 - DNA, 25 bp, E. coli
gcagcacgtactctcagagaaatca

SEQ ID NO: 64370 - DNA, 25 bp, E. coli
gcagcacgtactgtcagagaaatca

SEQ ID NO: 64371 - DNA, 25 bp, E. coli
gaaatcagtgctctgacagtacgca

SEQ ID NO: 64372 - DNA, 25 bp, E. coli
gaaatcagtgctgtgacagtacgca

SEQ ID NO: 64373 - DNA, 25 bp, E. coli
cagtttaggaaaacatctcattgtg

SEQ ID NO: 64374 - DNA, 25 bp, E. coli
cagtttaggaaatcatctcattgtg

SEQ ID NO: 64375 - DNA, 25 bp, E. coli
tatctgtttcgtaaccggatattgg

SEQ ID NO: 64376 - DNA, 25 bp, E. coli
tatctgtttcgttaccggatattgg

SEQ ID NO: 64377 - DNA, 25 bp, E. coli
tattggtttcataatggagcaccgc

SEQ ID NO: 64378 - DNA, 25 bp, E. coli
tattggtttcattatggagcaccgc

SEQ ID NO: 64379 - DNA, 25 bp, E. coli
tgtcaaaaacagctacataagcctg

SEQ ID NO: 64380 - DNA, 25 bp, E. coli
tgtcaaaaacaggtacataagcctg

SEQ ID NO: 64381 - DNA, 25 bp, E. coli
tgccatgttgggtagaaggttttga

SEQ ID NO: 64382 - DNA, 25 bp, E. coli
tgccatgttgggaagaaggttttga

SEQ ID NO: 64383 - DNA, 25 bp, E. coli
tctcattgtgtctaaaacagctaca

SEQ ID NO: 64384 - DNA, 25 bp, E. coli
tctcattgtgtcaaaaacagctaca

SEQ ID NO: 64385 - DNA, 25 bp, E. coli
gccggcaacattaatgagtgggaag

SEQ ID NO: 64386 - DNA, 25 bp, E. coli
gccggcaacatttatgagtgggaag

SEQ ID NO: 64387 - DNA, 25 bp, E. coli
gccctattatgttgtgccggcaaca

SEQ ID NO: 64388 - DNA, 25 bp, E. coli
gccctattatgtagtgccggcaaca

SEQ ID NO: 64389 - DNA, 25 bp, E. coli
gaagaaggttttcatcagtttagga

SEQ ID NO: 64390 - DNA, 25 bp, E. coli
gaagaaggttttgatcagtttagga

SEQ ID NO: 64391 - DNA, 25 bp, E. coli
ggagcaccgctttcctgccctatta

SEQ ID NO: 64392 - DNA, 25 bp, E. coli
ggagcaccgcttacctgccctatta

SEQ ID NO: 64393 - DNA, 25 bp, E. coli
taagcctgtacaattatctgtttcg

SEQ ID NO: 64394 - DNA, 25 bp, E. coli
taagcctgtacatttatctgtttcg

SEQ ID NO: 64395 - DNA, 25 bp, E. coli
cacttgcactatggagatctgactg

SEQ ID NO: 64396 - DNA, 25 bp, E. coli
cacttgcactatcgagatctgactg

SEQ ID NO: 64397 - DNA, 25 bp, E. coli
cagtttgtcgaaatggcagcagcac

SEQ ID NO: 64398 - DNA, 25 bp, E. coli
cagtttgtcgaattggcagcagcac

SEQ ID NO: 64399 - DNA, 25 bp, E. coli
tagaattctaaaggaggtacagcca

SEQ ID NO: 64400 - DNA, 25 bp, E. coli
tagaattctaaacgaggtacagcca

SEQ ID NO: 64401 - DNA, 25 bp, E. coli
gaagttcatggtatcaaacgccgag

SEQ ID NO: 64402 - DNA, 25 bp, E. coli
gaagttcatggtttcaaacgccgag

SEQ ID NO: 64403 - DNA, 25 bp, E. coli
gatactttgcttggagatccgagca

SEQ ID NO: 64404 - DNA, 25 bp, E. coli
gattcggttgaaggacaggatgctc

SEQ ID NO: 64405 - DNA, 25 bp, E. coli
gatactttgcttcgagatccgagca

SEQ ID NO: 64406 - DNA, 25 bp, E. coli
gattcggttgaacgacaggatgctc

SEQ ID NO: 64407 - DNA, 25 bp, E. coli
ggagtccaatacacagtccgtcagt

SEQ ID NO: 64408 - DNA, 25 bp, E. coli
ggagtccaatactcagtccgtcagt

SEQ ID NO: 64409 - DNA, 25 bp, E. coli
tggttgccaaagttcttgaagccgc

SEQ ID NO: 64410 - DNA, 25 bp, E. coli
tggttgccaaagatcttgaagccgc

SEQ ID NO: 64411 - DNA, 25 bp, E. coli
tcaatcatgaatgtccacgccgtgg

SEQ ID NO: 64412 - DNA, 25 bp, E. coli
tcaatcatgaatctccacgccgtgg

SEQ ID NO: 64413 - DNA, 25 bp, E. coli
gatgttacaacacgagcaacccgaa

SEQ ID NO: 64414 - DNA, 25 bp, E. coli
gatgctccaggtctgaaaccaggtg

SEQ ID NO: 64415 - DNA, 25 bp, E. coli
gatgctccaggtgtgaaaccaggtg

SEQ ID NO: 64416 - DNA, 25 bp, E. coli
gatgttacaacaggagcaacccgaa

SEQ ID NO: 64417 - DNA, 25 bp, E. coli
catcgctatgtgctcgtgtgcctca

SEQ ID NO: 64418 - DNA, 25 bp, E. coli
catcgctatgtggtcgtgtgcctca

SEQ ID NO: 64419 - DNA, 25 bp, E. coli
taaaaaatagtttctgcgttgtcca

SEQ ID NO: 64420 - DNA, 25 bp, E. coli
taaaaaatagttactgcgttgtcca

SEQ ID NO: 64421 - DNA, 25 bp, E. coli
agttaactttccaggagaatctctc

SEQ ID NO: 64422 - DNA, 25 bp, E. coli
acctgtccgcatggctatgtgctcg

SEQ ID NO: 64423 - DNA, 25 bp, E. coli
agtcagttaactatcctggagaatc

SEQ ID NO: 64424 - DNA, 25 bp, E. coli
agttaactttcctggagaatctctc

SEQ ID NO: 64425 - DNA, 25 bp, E. coli
acctgtccgcatcgctatgtgctcg

SEQ ID NO: 64426 - DNA, 25 bp, E. coli
agtcagttaactttcctggagaatc

SEQ ID NO: 64427 - DNA, 25 bp, E. coli
acgtttcatgttcccacgttgttaa

SEQ ID NO: 64428 - DNA, 25 bp, E. coli
acgtttcatgttgccacgttgttaa

SEQ ID NO: 64429 - DNA, 25 bp, E. coli
tatgtgctcgtgagcctcaatcccc

SEQ ID NO: 64430 - DNA, 25 bp, E. coli
tatgtgctcgtgtgcctcaatcccc

SEQ ID NO: 64431 - DNA, 25 bp, E. coli
tgttgccacgttgttaatatcggac

SEQ ID NO: 64432 - DNA, 25 bp, E. coli
tgttgccacgttcttaatatcggac

SEQ ID NO: 64433 - DNA, 25 bp, E. coli
tccgcatcgctaagtgctcgtgtgc

SEQ ID NO: 64434 - DNA, 25 bp, E. coli
tccgcatcgctatgtgctcgtgtgc

SEQ ID NO: 64435 - DNA, 25 bp, E. coli
ccccgttacatctggcttttgcaga

SEQ ID NO: 64436 - DNA, 25 bp, E. coli
ccccgttacatcaggcttttgcaga

SEQ ID NO: 64437 - DNA, 25 bp, E. coli
gtgtgcctcaatgccccggttatag

SEQ ID NO: 64438 - DNA, 25 bp, E. coli
gtgtgcctcaatcccccggttatag

SEQ ID NO: 64439 - DNA, 25 bp, E. coli
catatgcgttgaatggatattatcc

SEQ ID NO: 64440 - DNA, 25 bp, E. coli
catatgcgttgattggatattatcc

SEQ ID NO: 64441 - DNA, 25 bp, E. coli
tatgaacaataactaaaagggcact

SEQ ID NO: 64442 - DNA, 25 bp, E. coli
tatgaacaataagtaaaagggcact

SEQ ID NO: 64443 - DNA, 25 bp, E. coli
tatagccctacataaataactcaga

SEQ ID NO: 64444 - DNA, 25 bp, E. coli
tatagccctacaaaaataactcaga

SEQ ID NO: 64445 - DNA, 25 bp, E. coli
ttgttgctaacagagggatatgaac

SEQ ID NO: 64446 - DNA, 25 bp, E. coli
ttgttgctaacacagggatatgaac

SEQ ID NO: 64447 - DNA, 25 bp, E. coli
tgaaagtgacctgtaataacagttg

SEQ ID NO: 64448 - DNA, 25 bp, E. coli
tgaaagtgacctctaataacagttg

SEQ ID NO: 64449 - DNA, 25 bp, E. coli
gctgatattaatctgaatcggtgga

SEQ ID NO: 64450 - DNA, 25 bp, E. coli
gctgatattaatgtgaatcggtgga

SEQ ID NO: 64451 - DNA, 25 bp, E. coli
cattagctggtcttgtgtgtcattt

SEQ ID NO: 64452 - DNA, 25 bp, E. coli
cattagctggtcatgtgtgtcattt

SEQ ID NO: 64453 - DNA, 25 bp, E. coli
ctggttgaatggtacgccttgttta

SEQ ID NO: 64454 - DNA, 25 bp, E. coli
ctggttgaatggaacgccttgttta

SEQ ID NO: 64455 - DNA, 25 bp, E. coli
tgatttcctatctttctattgctga

SEQ ID NO: 64456 - DNA, 25 bp, E. coli
tgatttcctatcattctattgctga

SEQ ID NO: 64457 - DNA, 25 bp, E. coli
taacagttgttgttgattgagaaca

SEQ ID NO: 64458 - DNA, 25 bp, E. coli
taacagttgttgatgattgagaaca

SEQ ID NO: 64459 - DNA, 25 bp, E. coli
gatgaattcatctgtgctaaaaatg

SEQ ID NO: 64460 - DNA, 25 bp, E. coli
gatgaattcatcagtgctaaaaatg

SEQ ID NO: 64461 - DNA, 25 bp, E. coli
aaagcgccatgtcaatgtaggtcgc

SEQ ID NO: 64462 - DNA, 25 bp, E. coli
acaaatcgcatcgaaccgtaggccg

SEQ ID NO: 64463 - DNA, 25 bp, E. coli
acaaatcgcatccaaccgtaggccg

SEQ ID NO: 64464 - DNA, 25 bp, E. coli
aaagcgccatgtgaatgtaggtcgc

SEQ ID NO: 64465 - DNA, 25 bp, E. coli
tatccgacctactaatcgcatcgaa

SEQ ID NO: 64466 - DNA, 25 bp, E. coli
tatccgacctacaaatcgcatcgaa

SEQ ID NO: 64467 - DNA, 25 bp, E. coli
taggccagataaggcattttcgcag

SEQ ID NO: 64468 - DNA, 25 bp, E. coli
taggccagataacgcattttcgcag

SEQ ID NO: 64469 - DNA, 25 bp, E. coli
ttttcgcagcatccggcacttattg

SEQ ID NO: 64470 - DNA, 25 bp, E. coli
ttatccgacctaggaatcgcatcga

SEQ ID NO: 64471 - DNA, 25 bp, E. coli
ttttcgcagcatgcggcacttattg

SEQ ID NO: 64472 - DNA, 25 bp, E. coli
ttatccgacctacgaatcgcatcga

SEQ ID NO: 64473 - DNA, 25 bp, E. coli
tgtaggtcgcattcggcacttattg

SEQ ID NO: 64474 - DNA, 25 bp, E. coli
tgtaggtcgcatacggcacttattg

SEQ ID NO: 64475 - DNA, 25 bp, E. coli
tcggcacttattgtcggatgcgatg

SEQ ID NO: 64476 - DNA, 25 bp, E. coli
tcggcacttattctcggatgcgatg

SEQ ID NO: 64477 - DNA, 25 bp, E. coli
gccgcatccggcaaatagttaattg

SEQ ID NO: 64478 - DNA, 25 bp, E. coli
gccgcatccggctaatagttaattg

SEQ ID NO: 64479 - DNA, 25 bp, E. coli
gaatcgcatcgattctgtaggccag

SEQ ID NO: 64480 - DNA, 25 bp, E. coli
gaatcgcatcgaatctgtaggccag

SEQ ID NO: 64481 - DNA, 25 bp, E. coli
cttattgtcggaagcgatgcttgcg

SEQ ID NO: 64482 - DNA, 25 bp, E. coli
cttattgtcggatgcgatgcttgcg

SEQ ID NO: 64483 - DNA, 25 bp, E. coli
aaggagttgctactgaagaagttgc

SEQ ID NO: 64484 - DNA, 25 bp, E. coli
aaggagttgctagtgaagaagttgc

SEQ ID NO: 64485 - DNA, 25 bp, E. coli
ctaaaggagttggtactgaagaagt

SEQ ID NO: 64486 - DNA, 25 bp, E. coli
attgatactaaacgagttgctactg

SEQ ID NO: 64487 - DNA, 25 bp, E. coli
ctaaaggagttgctactgaagaagt

SEQ ID NO: 64488 - DNA, 25 bp, E. coli
attgatactaaaggagttgctactg

SEQ ID NO: 64489 - DNA, 25 bp, E. coli
acggtgctacctccttatatgatga

SEQ ID NO: 64490 - DNA, 25 bp, E. coli
acggtgctacctgcttatatgatga

SEQ ID NO: 64491 - DNA, 25 bp, E. coli
gctacctccttatatgatgaggtaa

SEQ ID NO: 64492 - DNA, 25 bp, E. coli
gctacctccttaaatgatgaggtaa

SEQ ID NO: 64493 - DNA, 25 bp, E. coli
gcaattattgaatgagccagaataa

SEQ ID NO: 64494 - DNA, 25 bp, E. coli
gcaattattgaaagagccagaataa

SEQ ID NO: 64495 - DNA, 25 bp, E. coli
gatactaaaggagttgctactgaag

SEQ ID NO: 64496 - DNA, 25 bp, E. coli
gatactaaaggacttgctactgaag

SEQ ID NO: 64497 - DNA, 25 bp, E. coli
gaacggtgctacctccttatatgat

SEQ ID NO: 64498 - DNA, 25 bp, E. coli
gaacggtgctacgtccttatatgat

SEQ ID NO: 64499 - DNA, 25 bp, E. coli
cggtgctacctccttatatgatgag

SEQ ID NO: 64500 - DNA, 25 bp, E. coli
cggtgctacctcgttatatgatgag

SEQ ID NO: 64501 - DNA, 25 bp, E. coli
gtgaacggtgcttcctccttatatg

SEQ ID NO: 64502 - DNA, 25 bp, E. coli
gtgaacggtgctacctccttatatg

SEQ ID NO: 64503 - DNA, 25 bp, E. coli
tactaaaggagtagctactgaagaa

SEQ ID NO: 64504 - DNA, 25 bp, E. coli
tactaaaggagttgctactgaagaa

SEQ ID NO: 64505 - DNA, 25 bp, E. coli
aatttgtgaaagaaccccgatatca

SEQ ID NO: 64506 - DNA, 25 bp, E. coli
aagtaccccgatttcacatattcgt

SEQ ID NO: 64507 - DNA, 25 bp, E. coli
aagtaccccgatatcacatattcgt

SEQ ID NO: 64508 - DNA, 25 bp, E. coli
aatttgtgaaagtaccccgatatca

SEQ ID NO: 64509 - DNA, 25 bp, E. coli
caaatgccgggaaccgaacagtaac

SEQ ID NO: 64510 - DNA, 25 bp, E. coli
caaatgccgggatccgaacagtaac

SEQ ID NO: 64511 - DNA, 25 bp, E. coli
aggatgtggatctcgaaaagggaat

SEQ ID NO: 64512 - DNA, 25 bp, E. coli
aggatgtggatcacgaaaagggaat

SEQ ID NO: 64513 - DNA, 25 bp, E. coli
aacattaaaaggctgggagattaca

SEQ ID NO: 64514 - DNA, 25 bp, E. coli
aacattaaaagggtgggagattaca

SEQ ID NO: 64515 - DNA, 25 bp, E. coli
tctcgaaaagggaatagtgaatgtc

SEQ ID NO: 64516 - DNA, 25 bp, E. coli
tctcgaaaagggtatagtgaatgtc

SEQ ID NO: 64517 - DNA, 25 bp, E. coli
ccgggatccgaacagtaacactact

SEQ ID NO: 64518 - DNA, 25 bp, E. coli
ccgggatccgaagagtaacactact

SEQ ID NO: 64519 - DNA, 25 bp, E. coli
gttcatgaaataaactccggtgaat

SEQ ID NO: 64520 - DNA, 25 bp, E. coli
gttcatgaaatatactccggtgaat

SEQ ID NO: 64521 - DNA, 25 bp, E. coli
ggaaatttgccgtttactcaggact

SEQ ID NO: 64522 - DNA, 25 bp, E. coli
ggaaatttgccgattactcaggact

SEQ ID NO: 64523 - DNA, 25 bp, E. coli
ggccggaaatttaagagcgctgata

SEQ ID NO: 64524 - DNA, 25 bp, E. coli
ggctgggagatttcaaacagtaata

SEQ ID NO: 64525 - DNA, 25 bp, E. coli
ggccggaaattttagagcgctgata

SEQ ID NO: 64526 - DNA, 25 bp, E. coli
ggctgggagattacaaacagtaata

SEQ ID NO: 64527 - DNA, 25 bp, E. coli
caagccgcatggtgagcaaaatcgc

SEQ ID NO: 64528 - DNA, 25 bp, E. coli
cactggtgaaactgccgggtattgg

SEQ ID NO: 64529 - DNA, 25 bp, E. coli
cactggtgaaacagccgggtattgg

SEQ ID NO: 64530 - DNA, 25 bp, E. coli
caagccgcatggagagcaaaatcgc

SEQ ID NO: 64531 - DNA, 25 bp, E. coli
tatgaagtgcatatgccgatgacct

SEQ ID NO: 64532 - DNA, 25 bp, E. coli
tatgaagtgcatttgccgatgacct

SEQ ID NO: 64533 - DNA, 25 bp, E. coli
tataaaccacaacaagcaagccgca

SEQ ID NO: 64534 - DNA, 25 bp, E. coli
tataaaccacaagaagcaagccgca

SEQ ID NO: 64535 - DNA, 25 bp, E. coli
ttgatcaaaacctacggcgtcggcc

SEQ ID NO: 64536 - DNA, 25 bp, E. coli
ttgatcaaaaccaacggcgtcggcc

SEQ ID NO: 64537 - DNA, 25 bp, E. coli
tgaagacgcgcaactgctgtacggt

SEQ ID NO: 64538 - DNA, 25 bp, E. coli
tgaagacgcgcatctgctgtacggt

SEQ ID NO: 64539 - DNA, 25 bp, E. coli
tctccggaatgtcagcgcagcagtt

SEQ ID NO: 64540 - DNA, 25 bp, E. coli
tctccggaatgtgagcgcagcagtt

SEQ ID NO: 64541 - DNA, 25 bp, E. coli
gaagcgatcgttatcacccactttg

SEQ ID NO: 64542 - DNA, 25 bp, E. coli
gaagcgatcgttttcacccactttg

SEQ ID NO: 64543 - DNA, 25 bp, E. coli
cccactttgtggagcgtgaagacgc

SEQ ID NO: 64544 - DNA, 25 bp, E. coli
cccactttgtggtgcgtgaagacgc

SEQ ID NO: 64545 - DNA, 25 bp, E. coli
gtttttatgaacaccctgaagcggg

SEQ ID NO: 64546 - DNA, 25 bp, E. coli
gtttttatgaactccctgaagcggg

SEQ ID NO: 64547 - DNA, 25 bp, E. coli
taatgccgttgaccgtgaagaagtg

SEQ ID NO: 64548 - DNA, 25 bp, E. coli
taatgccgttgagcgtgaagaagtg

SEQ ID NO: 64549 - DNA, 25 bp, E. coli
taaagctgaactggataaagccgga

SEQ ID NO: 64550 - DNA, 25 bp, E. coli
taaagctgaactcgataaagccgga

SEQ ID NO: 64551 - DNA, 25 bp, E. coli
tagcaataaaagtagcgcccaggat

SEQ ID NO: 64552 - DNA, 25 bp, E. coli
taccgctgaagagcaagtgttgtcg

SEQ ID NO: 64553 - DNA, 25 bp, E. coli
taccgctgaagaccaagtgttgtcg

SEQ ID NO: 64554 - DNA, 25 bp, E. coli
tagcaataaaagaagcgcccaggat

SEQ ID NO: 64555 - DNA, 25 bp, E. coli
ttagcaagactggaacgccaacagg

SEQ ID NO: 64556 - DNA, 25 bp, E. coli
tttacgtgagcgcaaagccagtctg

SEQ ID NO: 64557 - DNA, 25 bp, E. coli
ttagcaagactgcaacgccaacagg

SEQ ID NO: 64558 - DNA, 25 bp, E. coli
ttaaagccactgtagccatgcagcg

SEQ ID NO: 64559 - DNA, 25 bp, E. coli
tttacgtgagcggaaagccagtctg

SEQ ID NO: 64560 - DNA, 25 bp, E. coli
ttaaagccactgaagccatgcagcg

SEQ ID NO: 64561 - DNA, 25 bp, E. coli
tgctggaacagcttattcgtgacgc

SEQ ID NO: 64562 - DNA, 25 bp, E. coli
tgctggaacagcatattcgtgacgc

SEQ ID NO: 64563 - DNA, 25 bp, E. coli
gaagttgctgaagaaatcgcgcgcc

SEQ ID NO: 64564 - DNA, 25 bp, E. coli
gaagttgctgaacaaatcgcgcgcc

SEQ ID NO: 64565 - DNA, 25 bp, E. coli
gaaaatctcgcgatgatctgctggc

SEQ ID NO: 64566 - DNA, 25 bp, E. coli
gaaatcgtttatctcccaggcggaa

SEQ ID NO: 64567 - DNA, 25 bp, E. coli
gaaatcgcgcgccttgagaatctca

SEQ ID NO: 64568 - DNA, 25 bp, E. coli
gaaatcgcgcgcgttgagaatctca

SEQ ID NO: 64569 - DNA, 25 bp, E. coli
gaaaatctcgcgttgatctgctggc

SEQ ID NO: 64570 - DNA, 25 bp, E. coli
gaaatcgtttatgtcccaggcggaa

SEQ ID NO: 64571 - DNA, 25 bp, E. coli
catacagtttatgggaagatcgtct

SEQ ID NO: 64572 - DNA, 25 bp, E. coli
catacagtttatcggaagatcgtct

SEQ ID NO: 64573 - DNA, 25 bp, E. coli
taaatcgagatctaaacgtcaacca

SEQ ID NO: 64574 - DNA, 25 bp, E. coli
taactggagcaatgataagcgacat

SEQ ID NO: 64575 - DNA, 25 bp, E. coli
taaatcgagatcaaaacgtcaacca

SEQ ID NO: 64576 - DNA, 25 bp, E. coli
tatatgggagcattgttccgctggc

SEQ ID NO: 64577 - DNA, 25 bp, E. coli
tatatgggagcaatgttccgctggc

SEQ ID NO: 64578 - DNA, 25 bp, E. coli
ttgttcatcacaaccatccattgga

SEQ ID NO: 64579 - DNA, 25 bp, E. coli
ttgttcatcacatccatccattgga

SEQ ID NO: 64580 - DNA, 25 bp, E. coli
tgataacagcgttcaacccgaagag

SEQ ID NO: 64581 - DNA, 25 bp, E. coli
tgataacagcgtacaacccgaagag

SEQ ID NO: 64582 - DNA, 25 bp, E. coli
tccgctggcactagtgcatacagtt

SEQ ID NO: 64583 - DNA, 25 bp, E. coli
tccgctggcacttgtgcatacagtt

SEQ ID NO: 64584 - DNA, 25 bp, E. coli
ccattggaaatatagctcaaacagc

SEQ ID NO: 64585 - DNA, 25 bp, E. coli
ccattggaaataaagctcaaacagc

SEQ ID NO: 64586 - DNA, 25 bp, E. coli
gaattcatgcatggattaaatcgag

SEQ ID NO: 64587 - DNA, 25 bp, E. coli
gaattcatgcatcgattaaatcgag

SEQ ID NO: 64588 - DNA, 25 bp, E. coli
gataaagcatcacccttattaggca

SEQ ID NO: 64589 - DNA, 25 bp, E. coli
gataaagcatcagccttattaggca

SEQ ID NO: 64590 - DNA, 25 bp, E. coli
taatcaagggctcatttcaagtggt

SEQ ID NO: 64591 - DNA, 25 bp, E. coli
taactggagcaaagataagcgacat

SEQ ID NO: 64592 - DNA, 25 bp, E. coli
taatcaagggctgatttcaagtggt

SEQ ID NO: 64593 - DNA, 25 bp, E. coli
caccttacgcttacactatctgtta

SEQ ID NO: 64594 - DNA, 25 bp, E. coli
cactatctgttaatggaagtaccga

SEQ ID NO: 64595 - DNA, 25 bp, E. coli
caccttacgctttcactatctgtta

SEQ ID NO: 64596 - DNA, 25 bp, E. coli
cactatctgttattggaagtaccga

SEQ ID NO: 64597 - DNA, 25 bp, E. coli
agtcggaatttcagactggtcagtg

SEQ ID NO: 64598 - DNA, 25 bp, E. coli
agtcggaatttctgactggtcagtg

SEQ ID NO: 64599 - DNA, 25 bp, E. coli
taccgatttattttggtgctgctca

SEQ ID NO: 64600 - DNA, 25 bp, E. coli
taccgatttattatggtgctgctca

SEQ ID NO: 64601 - DNA, 25 bp, E. coli
ttacggtcattcacggaagaggatg

SEQ ID NO: 64602 - DNA, 25 bp, E. coli
ttacggtcattctcggaagaggatg

SEQ ID NO: 64603 - DNA, 25 bp, E. coli
tggtggtgaaccctacgatcctggc

SEQ ID NO: 64604 - DNA, 25 bp, E. coli
tggtggtgaaccgtacgatcctggc

SEQ ID NO: 64605 - DNA, 25 bp, E. coli
tcatgttcatatatcaccttacgct

SEQ ID NO: 64606 - DNA, 25 bp, E. coli
tcatgttcatatttcaccttacgct

SEQ ID NO: 64607 - DNA, 25 bp, E. coli
ccgtacgatcctcgctgctggcgag

SEQ ID NO: 64608 - DNA, 25 bp, E. coli
ccgtacgatcctggctgctggcgag

SEQ ID NO: 64609 - DNA, 25 bp, E. coli
gtatctgcttccattctcatgttca

SEQ ID NO: 64610 - DNA, 25 bp, E. coli
gtatctgcttcctttctcatgttca

SEQ ID NO: 64611 - DNA, 25 bp, E. coli
ggtgctgctcacatacggtcattca

SEQ ID NO: 64612 - DNA, 25 bp, E. coli
ggtgctgctcacttacggtcattca

SEQ ID NO: 64613 - DNA, 25 bp, E. coli
tggtggaagatgagtcggaatttct

SEQ ID NO: 64614 - DNA, 25 bp, E. coli
tggtggaagatgtgtcggaatttct

SEQ ID NO: 64615 - DNA, 25 bp, E. coli
catattgaggtgattttaccggcac

SEQ ID NO: 64616 - DNA, 25 bp, E. coli
catattgaggtgtttttaccggcac

SEQ ID NO: 64617 - DNA, 25 bp, E. coli
agcttgatcagtggatggaaagccg

SEQ ID NO: 64618 - DNA, 25 bp, E. coli
acgatatggcgttatggagttctgc

SEQ ID NO: 64619 - DNA, 25 bp, E. coli
agcttgatcagtcgatggaaagccg

SEQ ID NO: 64620 - DNA, 25 bp, E. coli
acgatatggcgtaatggagttctgc

SEQ ID NO: 64621 - DNA, 25 bp, E. coli
tcgccccgttgtatttgacgaagag

SEQ ID NO: 64622 - DNA, 25 bp, E. coli
tcgcggtttatctgacggatgcaga

SEQ ID NO: 64623 - DNA, 25 bp, E. coli
tcgcggtttatcagacggatgcaga

SEQ ID NO: 64624 - DNA, 25 bp, E. coli
tcgccccgttgtttttgacgaagag

SEQ ID NO: 64625 - DNA, 25 bp, E. coli
tctgacggatgcagagtataccggt

SEQ ID NO: 64626 - DNA, 25 bp, E. coli
tctgacggatgctgagtataccggt

SEQ ID NO: 64627 - DNA, 25 bp, E. coli
gacttattccattacatacgagatg

SEQ ID NO: 64628 - DNA, 25 bp, E. coli
gacttattccataacatacgagatg

SEQ ID NO: 64629 - DNA, 25 bp, E. coli
cgatggttacgcagggctatgagta

SEQ ID NO: 64630 - DNA, 25 bp, E. coli
cgatggttacgctgggctatgagta

SEQ ID NO: 64631 - DNA, 25 bp, E. coli
ctggatgcagattcctggcgggcca

SEQ ID NO: 64632 - DNA, 25 bp, E. coli
ctggatgcagatacctggcgggcca

SEQ ID NO: 64633 - DNA, 25 bp, E. coli
gtataccggtgaagagctggatgca

SEQ ID NO: 64634 - DNA, 25 bp, E. coli
gtataccggtgatgagctggatgca

SEQ ID NO: 64635 - DNA, 25 bp, E. coli
gggctatgagtatcgtcgtgatgac

SEQ ID NO: 64636 - DNA, 25 bp, E. coli
gggctatgagtaacgtcgtgatgac

SEQ ID NO: 64637 - DNA, 25 bp, E. coli
catgatggcgactcaataattcttg

SEQ ID NO: 64638 - DNA, 25 bp, E. coli
catgatggcgacacaataattcttg

SEQ ID NO: 64639 - DNA, 25 bp, E. coli
taaaacgcttatgaacacccacaaa

SEQ ID NO: 64640 - DNA, 25 bp, E. coli
taaaacgcttatcaacacccacaaa

SEQ ID NO: 64641 - DNA, 25 bp, E. coli
tgactcatcgaagtttggtcgtaaa

SEQ ID NO: 64642 - DNA, 25 bp, E. coli
tgactcatcgaactttggtcgtaaa

SEQ ID NO: 64643 - DNA, 25 bp, E. coli
tcatgatggcgactcaataattctt

SEQ ID NO: 64644 - DNA, 25 bp, E. coli
tcatgatggcgagtcaataattctt

SEQ ID NO: 64645 - DNA, 25 bp, E. coli
gctgactcatcgtagtttggtcgta

SEQ ID NO: 64646 - DNA, 25 bp, E. coli
gctgactcatcgaagtttggtcgta

SEQ ID NO: 64647 - DNA, 25 bp, E. coli
cgcttatcaacacccacaaaaaaga

SEQ ID NO: 64648 - DNA, 25 bp, E. coli
cgactcaataatacttgatgctggc

SEQ ID NO: 64649 - DNA, 25 bp, E. coli
cgactcaataattcttgatgctggc

SEQ ID NO: 64650 - DNA, 25 bp, E. coli
cgcttatcaacagccacaaaaaaga

SEQ ID NO: 64651 - DNA, 25 bp, E. coli
tggctgactcatcgaagtttggtcg

SEQ ID NO: 64652 - DNA, 25 bp, E. coli
ggcgactcaataattcttgatgctg

SEQ ID NO: 64653 - DNA, 25 bp, E. coli
tggctgactcatggaagtttggtcg

SEQ ID NO: 64654 - DNA, 25 bp, E. coli
ggcgactcaatatttcttgatgctg

SEQ ID NO: 64655 - DNA, 25 bp, E. coli
gatggctgactcttcgaagtttggt

SEQ ID NO: 64656 - DNA, 25 bp, E. coli
gatggcgactcaataattcttgatg

SEQ ID NO: 64657 - DNA, 25 bp, E. coli
gatggcgactcattaattcttgatg

SEQ ID NO: 64658 - DNA, 25 bp, E. coli
gatggctgactcatcgaagtttggt

SEQ ID NO: 64659 - DNA, 25 bp, E. coli
gaggtaggccacctactttcgaacg

SEQ ID NO: 64660 - DNA, 25 bp, E. coli
gaggtaggccacgtactttcgaacg

SEQ ID NO: 64661 - DNA, 25 bp, E. coli
ataacaaccctgtttgcctccggcg

SEQ ID NO: 64662 - DNA, 25 bp, E. coli
ataacaaccctgattgcctccggcg

SEQ ID NO: 64663 - DNA, 25 bp, E. coli
ttttttggctgttagctccgctgtg

SEQ ID NO: 64664 - DNA, 25 bp, E. coli
ttttttggctgtaagctccgctgtg

SEQ ID NO: 64665 - DNA, 25 bp, E. coli
tgtaagctccgcagtgagcgcaggc

SEQ ID NO: 64666 - DNA, 25 bp, E. coli
tgtaagctccgctgtgagcgcaggc

SEQ ID NO: 64667 - DNA, 25 bp, E. coli
tgagcgcaggctgtgttaaaactcc

SEQ ID NO: 64668 - DNA, 25 bp, E. coli
tgagcgcaggctctgttaaaactcc

SEQ ID NO: 64669 - DNA, 25 bp, E. coli
tctccttaatctccagaggtaggcc

SEQ ID NO: 64670 - DNA, 25 bp, E. coli
tctccttaatctgcagaggtaggcc

SEQ ID NO: 64671 - DNA, 25 bp, E. coli
cctgatcactttatggtctaagcga

SEQ ID NO: 64672 - DNA, 25 bp, E. coli
cctgatcactttttggtctaagcga

SEQ ID NO: 64673 - DNA, 25 bp, E. coli
cgatgagcgcagaggtcagtttttt

SEQ ID NO: 64674 - DNA, 25 bp, E. coli
cgatgagcgcagtggtcagtttttt

SEQ ID NO: 64675 - DNA, 25 bp, E. coli
ctttcgaacgatcagcgcagtggtc

SEQ ID NO: 64676 - DNA, 25 bp, E. coli
ctttcgaacgatgagcgcagtggtc

SEQ ID NO: 64677 - DNA, 25 bp, E. coli
tggtctaagcgaaggtttcatatga

SEQ ID NO: 64678 - DNA, 25 bp, E. coli
ggctgtgttaaatctcctgatcact

SEQ ID NO: 64679 - DNA, 25 bp, E. coli
tggtctaagcgatggtttcatatga

SEQ ID NO: 64680 - DNA, 25 bp, E. coli
ggctgtgttaaaactcctgatcact

SEQ ID NO: 64681 - DNA, 25 bp, E. coli
aaggaattcatttgcggccgcggag

SEQ ID NO: 64682 - DNA, 25 bp, E. coli
aaggaattcattagcggccgcggag

SEQ ID NO: 64683 - DNA, 25 bp, E. coli
catataaagggtagcccgttcgcct

SEQ ID NO: 64684 - DNA, 25 bp, E. coli
catataaagggttgcccgttcgcct

SEQ ID NO: 64685 - DNA, 25 bp, E. coli
tatcctgccgaaaaaaccgatcgtg

SEQ ID NO: 64686 - DNA, 25 bp, E. coli
tatcctgccgaataaaccgatcgtg

SEQ ID NO: 64687 - DNA, 25 bp, E. coli
tattaatgccgtacgtccacgtccg

SEQ ID NO: 64688 - DNA, 25 bp, E. coli
tattaatgccgttcgtccacgtccg

SEQ ID NO: 64689 - DNA, 25 bp, E. coli
ttcaggctccttacgtagacggcgc

SEQ ID NO: 64690 - DNA, 25 bp, E. coli
ttcaggctcctttcgtagacggcgc

SEQ ID NO: 64691 - DNA, 25 bp, E. coli
tgatataaacctctatggccccggc

SEQ ID NO: 64692 - DNA, 25 bp, E. coli
tgatacccactgcattggcggcgac

SEQ ID NO: 64693 - DNA, 25 bp, E. coli
tgatacccactggattggcggcgac

SEQ ID NO: 64694 - DNA, 25 bp, E. coli
tgatataaacctgtatggccccggc

SEQ ID NO: 64695 - DNA, 25 bp, E. coli
tcgaaggaaaatcccagcgtgctgg

SEQ ID NO: 64696 - DNA, 25 bp, E. coli
tcgaaggaaaatgccagcgtgctgg

SEQ ID NO: 64697 - DNA, 25 bp, E. coli
gggttacaataacccgcgcgacgtt

SEQ ID NO: 64698 - DNA, 25 bp, E. coli
gggttacaataagccgcgcgacgtt

SEQ ID NO: 64699 - DNA, 25 bp, E. coli
gatcaggtctggtgctacttcgcga

SEQ ID NO: 64700 - DNA, 25 bp, E. coli
gatgtaccacgggatagtcagcgcc

SEQ ID NO: 64701 - DNA, 25 bp, E. coli
gatcaggtctggagctacttcgcga

SEQ ID NO: 64702 - DNA, 25 bp, E. coli
gatgtaccacggcatagtcagcgcc

SEQ ID NO: 64703 - DNA, 25 bp, E. coli
aatacagacgcattctggagcgagc

SEQ ID NO: 64704 - DNA, 25 bp, E. coli
caattaagttcaaggcacaggacgt

SEQ ID NO: 64705 - DNA, 25 bp, E. coli
caattaagttcatggcacaggacgt

SEQ ID NO: 64706 - DNA, 25 bp, E. coli
aatacagacgcaatctggagcgagc

SEQ ID NO: 64707 - DNA, 25 bp, E. coli
cacaggacgtgatctggcaacagaa

SEQ ID NO: 64708 - DNA, 25 bp, E. coli
cacaggacgtgaactggcaacagaa

SEQ ID NO: 64709 - DNA, 25 bp, E. coli
tcaggctaaaggtactcacgaaacg

SEQ ID NO: 64710 - DNA, 25 bp, E. coli
tcaggctaaaggaactcacgaaacg

SEQ ID NO: 64711 - DNA, 25 bp, E. coli
ctaagcagagcggagattcaggcta

SEQ ID NO: 64712 - DNA, 25 bp, E. coli
ctaagcagagcgcagattcaggcta

SEQ ID NO: 64713 - DNA, 25 bp, E. coli
ggtgtatgtcttccaaacgtagcca

SEQ ID NO: 64714 - DNA, 25 bp, E. coli
ggtgtatgtcttgcaaacgtagcca

SEQ ID NO: 64715 - DNA, 25 bp, E. coli
tcgtcgtcgtgagcgtttaaaggca

SEQ ID NO: 64716 - DNA, 25 bp, E. coli
ggcaaaggcattagctaacggcgta

SEQ ID NO: 64717 - DNA, 25 bp, E. coli
tggcccgcgaagaagcaataagttc

SEQ ID NO: 64718 - DNA, 25 bp, E. coli
tcgtcgtcgtgaccgtttaaaggca

SEQ ID NO: 64719 - DNA, 25 bp, E. coli
ggcaaaggcatttgctaacggcgta

SEQ ID NO: 64720 - DNA, 25 bp, E. coli
tggcccgcgaagtagcaataagttc

SEQ ID NO: 64721 - DNA, 25 bp, E. coli
taagttcagaagtattacaccgccc

SEQ ID NO: 64722 - DNA, 25 bp, E. coli
taagttcagaagaattacaccgccc

SEQ ID NO: 64723 - DNA, 25 bp, E. coli
tcaaaggcaattgacgttctcgtcg

SEQ ID NO: 64724 - DNA, 25 bp, E. coli
tcaaaggcaattcacgttctcgtcg

SEQ ID NO: 64725 - DNA, 25 bp, E. coli
cagacggtaaagtgaaattcgaagt

SEQ ID NO: 64726 - DNA, 25 bp, E. coli
cagacggtaaagagaaattcgaagt

SEQ ID NO: 64727 - DNA, 25 bp, E. coli
gtttgctaaagcagacggtaaagtg

SEQ ID NO: 64728 - DNA, 25 bp, E. coli
gtttgctaaagctgacggtaaagtg

SEQ ID NO: 64729 - DNA, 25 bp, E. coli
acataaaaaggctggcggctccaca

SEQ ID NO: 64730 - DNA, 25 bp, E. coli
acataaaaaggcaggcggctccaca

SEQ ID NO: 64731 - DNA, 25 bp, E. coli
tgcggtcgtgaccacactctgtttg

SEQ ID NO: 64732 - DNA, 25 bp, E. coli
tgcggtcgtgacgacactctgtttg

SEQ ID NO: 64733 - DNA, 25 bp, E. coli
gaaaaaccgtaattttatcagcatc

SEQ ID NO: 64734 - DNA, 25 bp, E. coli
gaaaaaccgtaaatttatcagcatc

SEQ ID NO: 64735 - DNA, 25 bp, E. coli
ccgtaaatttatcagcatcgaagct

SEQ ID NO: 64736 - DNA, 25 bp, E. coli
ccgtaaatttatgagcatcgaagct

SEQ ID NO: 64737 - DNA, 25 bp, E. coli
cggtcgcgattcagaagctaaacgc

SEQ ID NO: 64738 - DNA, 25 bp, E. coli
cggtcgcgattctgaagctaaacgc

SEQ ID NO: 64739 - DNA, 25 bp, E. coli
cgtaacggtcgcgattcagaagcta

SEQ ID NO: 64740 - DNA, 25 bp, E. coli
cgtaacggtcgccattcagaagcta

SEQ ID NO: 64741 - DNA, 25 bp, E. coli
ggctccacacgtaacggtcgcgatt

SEQ ID NO: 64742 - DNA, 25 bp, E. coli
tggcacataaaaaggctggcggctc

SEQ ID NO: 64743 - DNA, 25 bp, E. coli
ggctccacacgttacggtcgcgatt

SEQ ID NO: 64744 - DNA, 25 bp, E. coli
tggcacataaaatggctggcggctc

SEQ ID NO: 64745 - DNA, 25 bp, E. coli
gaccacactctgattgctaaagcag

SEQ ID NO: 64746 - DNA, 25 bp, E. coli
gaccacactctgtttgctaaagcag

SEQ ID NO: 64747 - DNA, 25 bp, E. coli
cagtaatgttactgcctggccttta

SEQ ID NO: 64748 - DNA, 25 bp, E. coli
cagtaatgttacagcctggccttta

SEQ ID NO: 64749 - DNA, 25 bp, E. coli
tactgcctggccattaatcaatgaa

SEQ ID NO: 64750 - DNA, 25 bp, E. coli
tactgcctggcctttaatcaatgaa

SEQ ID NO: 64751 - DNA, 25 bp, E. coli
tactggctggtcagagagtgctgac

SEQ ID NO: 64752 - DNA, 25 bp, E. coli
tactggctggtctgagagtgctgac

SEQ ID NO: 64753 - DNA, 25 bp, E. coli
agtaatgttactcgctggtctgaga

SEQ ID NO: 64754 - DNA, 25 bp, E. coli
agtaatgttactggctggtctgaga

SEQ ID NO: 64755 - DNA, 25 bp, E. coli
tccggcgtgtacaacgcgcacttgg

SEQ ID NO: 64756 - DNA, 25 bp, E. coli
tccggcgtgtactacgcgcacttgg

SEQ ID NO: 64757 - DNA, 25 bp, E. coli
tcaggcctacgtggagcccacaata

SEQ ID NO: 64758 - DNA, 25 bp, E. coli
tctgaggccagtcagtaatgttact

SEQ ID NO: 64759 - DNA, 25 bp, E. coli
tcaggcctacgtcgagcccacaata

SEQ ID NO: 64760 - DNA, 25 bp, E. coli
tctgaggccagtgagtaatgttact

SEQ ID NO: 64761 - DNA, 25 bp, E. coli
cctttaatcaatgaatcagaaacgc

SEQ ID NO: 64762 - DNA, 25 bp, E. coli
cctttaatcaatcaatcagaaacgc

SEQ ID NO: 64763 - DNA, 25 bp, E. coli
gcacttggtcaagaatctgaggcca

SEQ ID NO: 64764 - DNA, 25 bp, E. coli
gcacttggtcaacaatctgaggcca

SEQ ID NO: 64765 - DNA, 25 bp, E. coli
cgtggagcccactatatattgaatt

SEQ ID NO: 64766 - DNA, 25 bp, E. coli
cgtggagcccacaatatattgaatt

SEQ ID NO: 64767 - DNA, 25 bp, E. coli
ggtctgagagtggtgacaaacgcaa

SEQ ID NO: 64768 - DNA, 25 bp, E. coli
ggtctgagagtgctgacaaacgcaa

SEQ ID NO: 64769 - DNA, 25 bp, E. coli
aatggtctgcgtcgcccttcagctg

SEQ ID NO: 64770 - DNA, 25 bp, E. coli
aatggtctgcgtggcccttcagctg

SEQ ID NO: 64771 - DNA, 25 bp, E. coli
caaaagcggcaacggtcttatcacc

SEQ ID NO: 64772 - DNA, 25 bp, E. coli
caaaagcggcaagggtcttatcacc

SEQ ID NO: 64773 - DNA, 25 bp, E. coli
agggtcttatcagcccatccgatgg

SEQ ID NO: 64774 - DNA, 25 bp, E. coli
agggtcttatcaccccatccgatgg

SEQ ID NO: 64775 - DNA, 25 bp, E. coli
tttgacggcaaaagcggcaagggtc

SEQ ID NO: 64776 - DNA, 25 bp, E. coli
tttgacggcaaatgcggcaagggtc

SEQ ID NO: 64777 - DNA, 25 bp, E. coli
ttcagctgccaatgtttacctttca

SEQ ID NO: 64778 - DNA, 25 bp, E. coli
ttcagctgccaaagtttacctttca

SEQ ID NO: 64779 - DNA, 25 bp, E. coli
tccgatggtcgtttcgatgtccagc

SEQ ID NO: 64780 - DNA, 25 bp, E. coli
tccgatggtcgtatcgatgtccagc

SEQ ID NO: 64781 - DNA, 25 bp, E. coli
tctccgcgatgctgaagaaattacc

SEQ ID NO: 64782 - DNA, 25 bp, E. coli
tctccgcgatgcagaagaaattacc

SEQ ID NO: 64783 - DNA, 25 bp, E. coli
gaagaaattaccaccggattacgcg

SEQ ID NO: 64784 - DNA, 25 bp, E. coli
gaattttgccggttaaatggtctgc

SEQ ID NO: 64785 - DNA, 25 bp, E. coli
gaattttgccggataaatggtctgc

SEQ ID NO: 64786 - DNA, 25 bp, E. coli
gaagaaattacctccggattacgcg

SEQ ID NO: 64787 - DNA, 25 bp, E. coli
gtttcagcgctctatctccgcgatg

SEQ ID NO: 64788 - DNA, 25 bp, E. coli
gtttcagcgctcaatctccgcgatg

SEQ ID NO: 64789 - DNA, 25 bp, E. coli
gatgtccagcttgatgtttcagcgc

SEQ ID NO: 64790 - DNA, 25 bp, E. coli
gatgtccagcttcatgtttcagcgc

SEQ ID NO: 64791 - DNA, 25 bp, E. coli
caatcctgccacagagatagcgcaa

SEQ ID NO: 64792 - DNA, 25 bp, E. coli
caatcctgccactgagatagcgcaa

SEQ ID NO: 64793 - DNA, 25 bp, E. coli
cactaacgttatcacagaacaacaa

SEQ ID NO: 64794 - DNA, 25 bp, E. coli
cactaacgttatgacagaacaacaa

SEQ ID NO: 64795 - DNA, 25 bp, E. coli
tagatgtttgaatgggcgatgcccc

SEQ ID NO: 64796 - DNA, 25 bp, E. coli
tagatgtttgaaagggcgatgcccc

SEQ ID NO: 64797 - DNA, 25 bp, E. coli
tattgaacaacgcatagaaagccgc

SEQ ID NO: 64798 - DNA, 25 bp, E. coli
tattgaacaacggatagaaagccgc

SEQ ID NO: 64799 - DNA, 25 bp, E. coli
gcgatgccccgttgcttgttgacac

SEQ ID NO: 64800 - DNA, 25 bp, E. coli
gcgatgccccgtagcttgttgacac

SEQ ID NO: 64801 - DNA, 25 bp, E. coli
gaaagccgcgatctggtactctata

SEQ ID NO: 64802 - DNA, 25 bp, E. coli
gaaaattaatcacgcagactactgc

SEQ ID NO: 64803 - DNA, 25 bp, E. coli
gaaagccgcgatgtggtactctata

SEQ ID NO: 64804 - DNA, 25 bp, E. coli
gactactgcccagtaacgttatgac

SEQ ID NO: 64805 - DNA, 25 bp, E. coli
gactactgcccactaacgttatgac

SEQ ID NO: 64806 - DNA, 25 bp, E. coli
gaaaattaatcaggcagactactgc

SEQ ID NO: 64807 - DNA, 25 bp, E. coli
gaagcctatgttcgaatttattgaa

SEQ ID NO: 64808 - DNA, 25 bp, E. coli
gaagcctatgttggaatttattgaa

SEQ ID NO: 64809 - DNA, 25 bp, E. coli
gttgacactttattcacaatcctgc

SEQ ID NO: 64810 - DNA, 25 bp, E. coli
gttgacactttaatcacaatcctgc

SEQ ID NO: 64811 - DNA, 25 bp, E. coli
gagatagcgcaaaaaatcgaagcct

SEQ ID NO: 64812 - DNA, 25 bp, E. coli
gagatagcgcaataaatcgaagcct

SEQ ID NO: 64813 - DNA, 25 bp, E. coli
caatatttgcgttcacactggcaga

SEQ ID NO: 64814 - DNA, 25 bp, E. coli
caatatttgcgtacacactggcaga

SEQ ID NO: 64815 - DNA, 25 bp, E. coli
cactttaaagcgagcagaacgcgga

SEQ ID NO: 64816 - DNA, 25 bp, E. coli
cactttaaagcgtgcagaacgcgga

SEQ ID NO: 64817 - DNA, 25 bp, E. coli
taaatcctggatgaaagacaaagtc

SEQ ID NO: 64818 - DNA, 25 bp, E. coli
taaatcctggatcaaagacaaagtc

SEQ ID NO: 64819 - DNA, 25 bp, E. coli
taccgcagtgggtgctgcactattg

SEQ ID NO: 64820 - DNA, 25 bp, E. coli
taccgcagtgggagctgcactattg

SEQ ID NO: 64821 - DNA, 25 bp, E. coli
tgctgctcgggatgcattggccacg

SEQ ID NO: 64822 - DNA, 25 bp, E. coli
tgctgctcgggaagcattggccacg

SEQ ID NO: 64823 - DNA, 25 bp, E. coli
tccggtcacacgatgtttgctgcca

SEQ ID NO: 64824 - DNA, 25 bp, E. coli
tccggtcacacgttgtttgctgcca

SEQ ID NO: 64825 - DNA, 25 bp, E. coli
gacaaagtccaggaaccacgacctt

SEQ ID NO: 64826 - DNA, 25 bp, E. coli
gacaaagtccagcaaccacgacctt

SEQ ID NO: 64827 - DNA, 25 bp, E. coli
cgtcggcgaacgataaccattgcta

SEQ ID NO: 64828 - DNA, 25 bp, E. coli
cgtcggcgaacgttaaccattgcta

SEQ ID NO: 64829 - DNA, 25 bp, E. coli
ggccattaacacgacctgcggaaga

SEQ ID NO: 64830 - DNA, 25 bp, E. coli
tggcgttggcaagctggagaacaaa

SEQ ID NO: 64831 - DNA, 25 bp, E. coli
tggcaacgtggcttgcgcaacgaat

SEQ ID NO: 64832 - DNA, 25 bp, E. coli
tggcaacgtggcatgcgcaacgaat

SEQ ID NO: 64833 - DNA, 25 bp, E. coli
ggccattaacaccacctgcggaaga

SEQ ID NO: 64834 - DNA, 25 bp, E. coli
tggcgttggcaacctggagaacaaa

SEQ ID NO: 64835 - DNA, 25 bp, E. coli
caaggacttgtctttattatgcccc

SEQ ID NO: 64836 - DNA, 25 bp, E. coli
caaggacttgtcattattatgcccc

SEQ ID NO: 64837 - DNA, 25 bp, E. coli
tacggtggttatcacacaaaaactc

SEQ ID NO: 64838 - DNA, 25 bp, E. coli
tacggtggttatgacacaaaaactc

SEQ ID NO: 64839 - DNA, 25 bp, E. coli
ttgtcattattaagcccctgcccga

SEQ ID NO: 64840 - DNA, 25 bp, E. coli
ttgtcattattatgcccctgcccga

SEQ ID NO: 64841 - DNA, 25 bp, E. coli
tgttctattacctcacccaaaggcc

SEQ ID NO: 64842 - DNA, 25 bp, E. coli
tgttctattaccacacccaaaggcc

SEQ ID NO: 64843 - DNA, 25 bp, E. coli
tgcgactgactacaaacttgacgac

SEQ ID NO: 64844 - DNA, 25 bp, E. coli
tgctaccgctaggagccctcgtgct

SEQ ID NO: 64845 - DNA, 25 bp, E. coli
tgcgactgactagaaacttgacgac

SEQ ID NO: 64846 - DNA, 25 bp, E. coli
tgctaccgctagcagccctcgtgct

SEQ ID NO: 64847 - DNA, 25 bp, E. coli
gctcactgcctgttctattaccaca

SEQ ID NO: 64848 - DNA, 25 bp, E. coli
gctcactgcctgatctattaccaca

SEQ ID NO: 64849 - DNA, 25 bp, E. coli
gactgactacaatcttgacgaccag

SEQ ID NO: 64850 - DNA, 25 bp, E. coli
gactgactacaaacttgacgaccag

SEQ ID NO: 64851 - DNA, 25 bp, E. coli
cggtggttatgagacaaaaactcaa

SEQ ID NO: 64852 - DNA, 25 bp, E. coli
cggtggttatgacacaaaaactcaa

SEQ ID NO: 64853 - DNA, 25 bp, E. coli
gggtgatgcgacagactacaaactt

SEQ ID NO: 64854 - DNA, 25 bp, E. coli
gggtgatgcgactgactacaaactt

SEQ ID NO: 64855 - DNA, 25 bp, E. coli
gatgcgactgacaacaaacttgacg

SEQ ID NO: 64856 - DNA, 25 bp, E. coli
gatgcgactgactacaaacttgacg

SEQ ID NO: 64857 - DNA, 25 bp, E. coli
aactggttgatagatccagtgcgcc

SEQ ID NO: 64858 - DNA, 25 bp, E. coli
taaaatctcaagctgaaggaggcgt

SEQ ID NO: 64859 - DNA, 25 bp, E. coli
taaaatctcaaggtgaaggaggcgt

SEQ ID NO: 64860 - DNA, 25 bp, E. coli
aggctgcattgggaagacttaaaga

SEQ ID NO: 64861 - DNA, 25 bp, E. coli
aggctgcattggcaagacttaaaga

SEQ ID NO: 64862 - DNA, 25 bp, E. coli
aactggttgatacatccagtgcgcc

SEQ ID NO: 64863 - DNA, 25 bp, E. coli
aaaagcagatgcatatctctgatgc

SEQ ID NO: 64864 - DNA, 25 bp, E. coli
aaaagcagatgcttatctctgatgc

SEQ ID NO: 64865 - DNA, 25 bp, E. coli
tatggatggctgaggcgtcattccg

SEQ ID NO: 64866 - DNA, 25 bp, E. coli
tatggatggctgtggcgtcattccg

SEQ ID NO: 64867 - DNA, 25 bp, E. coli
ttatcaatagcacacagtggcaggg

SEQ ID NO: 64868 - DNA, 25 bp, E. coli
ttatcaatagcagacagtggcaggg

SEQ ID NO: 64869 - DNA, 25 bp, E. coli
tctattaaagaggttatccgtactc

SEQ ID NO: 64870 - DNA, 25 bp, E. coli
tctattaaagagcttatccgtactc

SEQ ID NO: 64871 - DNA, 25 bp, E. coli
tcatgatgatgaagtcgcagatgcg

SEQ ID NO: 64872 - DNA, 25 bp, E. coli
tcatgatgatgatgtcgcagatgcg

SEQ ID NO: 64873 - DNA, 25 bp, E. coli
gacttaaagaagatgagctgaaaca

SEQ ID NO: 64874 - DNA, 25 bp, E. coli
gacttaaagaagttgagctgaaaca

SEQ ID NO: 64875 - DNA, 25 bp, E. coli
gaaataacggcagaacactggcagt

SEQ ID NO: 64876 - DNA, 25 bp, E. coli
gaaataacggcacaacactggcagt

SEQ ID NO: 64877 - DNA, 25 bp, E. coli
cgcagatgcgaactttcaaaagcag

SEQ ID NO: 64878 - DNA, 25 bp, E. coli
cgcagatgcgaagtttcaaaagcag

SEQ ID NO: 64879 - DNA, 25 bp, E. coli
aatgggcgtctcttacttctggcaa

SEQ ID NO: 64880 - DNA, 25 bp, E. coli
aatgggcgtctcatacttctggcaa

SEQ ID NO: 64881 - DNA, 25 bp, E. coli
caacttaggcatgggttacgaactg

SEQ ID NO: 64882 - DNA, 25 bp, E. coli
caacttaggcatcggttacgaactg

SEQ ID NO: 64883 - DNA, 25 bp, E. coli
tacgcttggcacctatacggcgctg

SEQ ID NO: 64884 - DNA, 25 bp, E. coli
tagccctgagttcgccatgctgtcg

SEQ ID NO: 64885 - DNA, 25 bp, E. coli
tagccctgagttggccatgctgtcg

SEQ ID NO: 64886 - DNA, 25 bp, E. coli
tacgcttggcacgtatacggcgctg

SEQ ID NO: 64887 - DNA, 25 bp, E. coli
ttcatcattttgaccggcgggatcg

SEQ ID NO: 64888 - DNA, 25 bp, E. coli
ttcatcattttgtccggcgggatcg

SEQ ID NO: 64889 - DNA, 25 bp, E. coli
tgctgatcgacaaataccgtacccg

SEQ ID NO: 64890 - DNA, 25 bp, E. coli
tgctgatcgacatataccgtacccg

SEQ ID NO: 64891 - DNA, 25 bp, E. coli
cgatcaacattgatctggcggcggg

SEQ ID NO: 64892 - DNA, 25 bp, E. coli
cgatcaacattgttctggcggcggg

SEQ ID NO: 64893 - DNA, 25 bp, E. coli
gcggacggcaccacggttatcaact

SEQ ID NO: 64894 - DNA, 25 bp, E. coli
gcggacggcacctcggttatcaact

SEQ ID NO: 64895 - DNA, 25 bp, E. coli
gattatgagcgcgtcacggctgtac

SEQ ID NO: 64896 - DNA, 25 bp, E. coli
gattatgagcgcctcacggctgtac

SEQ ID NO: 64897 - DNA, 25 bp, E. coli
taatttcgagtggataggcaacaac

SEQ ID NO: 64898 - DNA, 25 bp, E. coli
taatttcgagtgcataggcaacaac

SEQ ID NO: 64899 - DNA, 25 bp, E. coli
gatgccattgcaccggtgatcctcg

SEQ ID NO: 64900 - DNA, 25 bp, E. coli
gatgccattgcagcggtgatcctcg

SEQ ID NO: 64901 - DNA, 25 bp, E. coli
cattggtctggtgccggttatcgcc

SEQ ID NO: 64902 - DNA, 25 bp, E. coli
cattggtctggtcccggttatcgcc

SEQ ID NO: 64903 - DNA, 25 bp, E. coli
cattttccgaatgacgcggagcacg

SEQ ID NO: 64904 - DNA, 25 bp, E. coli
aaagtttggcatcttcggcgaaccg

SEQ ID NO: 64905 - DNA, 25 bp, E. coli
aaagtttggcatgttcggcgaaccg

SEQ ID NO: 64906 - DNA, 25 bp, E. coli
tgccaaataccctgaccgtgacgat

SEQ ID NO: 64907 - DNA, 25 bp, E. coli
tgccaaatacccagaccgtgacgat

SEQ ID NO: 64908 - DNA, 25 bp, E. coli
tctgattaacgtcgcgatgctggcg

SEQ ID NO: 64909 - DNA, 25 bp, E. coli
tctgattaacgtggcgatgctggcg

SEQ ID NO: 64910 - DNA, 25 bp, E. coli
ccaacctggcggaaatggcgtcgat

SEQ ID NO: 64911 - DNA, 25 bp, E. coli
ccaacctggcggtaatggcgtcgat

SEQ ID NO: 64912 - DNA, 25 bp, E. coli
cattttccgaatcacgcggagcacg

SEQ ID NO: 64913 - DNA, 25 bp, E. coli
gtgatgttcatcctgccacgcatgg

SEQ ID NO: 64914 - DNA, 25 bp, E. coli
ggtagtacttaaactcgccgactgg

SEQ ID NO: 64915 - DNA, 25 bp, E. coli
ggtagtacttaatctcgccgactgg

SEQ ID NO: 64916 - DNA, 25 bp, E. coli
gtgatgttcatcgtgccacgcatgg

SEQ ID NO: 64917 - DNA, 25 bp, E. coli
tggatatcgccgatgccgtaggtaa

SEQ ID NO: 64918 - DNA, 25 bp, E. coli
tggtttattacagcaccggcagcct

SEQ ID NO: 64919 - DNA, 25 bp, E. coli
tggtttattacaccaccggcagcct

SEQ ID NO: 64920 - DNA, 25 bp, E. coli
tggatatcgccgttgccgtaggtaa

SEQ ID NO: 64921 - DNA, 25 bp, E. coli
gatgattgcttttgccagccgtggc

SEQ ID NO: 64922 - DNA, 25 bp, E. coli
gatgattgctttagccagccgtggc

SEQ ID NO: 64923 - DNA, 25 bp, E. coli
aatacacgggcgtagagctggacag

SEQ ID NO: 64924 - DNA, 25 bp, E. coli
aatacacgggcgaagagctggacag

SEQ ID NO: 64925 - DNA, 25 bp, E. coli
aagagctggacaccgatacctggca

SEQ ID NO: 64926 - DNA, 25 bp, E. coli
aagagctggacagcgatacctggca

SEQ ID NO: 64927 - DNA, 25 bp, E. coli
atctcaccggcggtgaatacacggg

SEQ ID NO: 64928 - DNA, 25 bp, E. coli
atctcaccggcgctgaatacacggg

SEQ ID NO: 64929 - DNA, 25 bp, E. coli
tgtttttgatgacgcggattttccg

SEQ ID NO: 64930 - DNA, 25 bp, E. coli
tgtttttgatgaggcggattttccg

SEQ ID NO: 64931 - DNA, 25 bp, E. coli
tccgtgcagccgaactggatgcact

SEQ ID NO: 64932 - DNA, 25 bp, E. coli
tccgtgcagccgtactggatgcact

SEQ ID NO: 64933 - DNA, 25 bp, E. coli
tgccgtttatctcaccggcgctgaa

SEQ ID NO: 64934 - DNA, 25 bp, E. coli
tgccgtttatctgaccggcgctgaa

SEQ ID NO: 64935 - DNA, 25 bp, E. coli
cgatacctggcacgcggagctgcat

SEQ ID NO: 64936 - DNA, 25 bp, E. coli
cgatacctggcaggcggagctgcat

SEQ ID NO: 64937 - DNA, 25 bp, E. coli
gatttgatcaccagtatggtggcca

SEQ ID NO: 64938 - DNA, 25 bp, E. coli
gatttgatcacctgtatggtggcca

SEQ ID NO: 64939 - DNA, 25 bp, E. coli
ggagttcagccgatctgacttatgt

SEQ ID NO: 64940 - DNA, 25 bp, E. coli
ggagttcagccgttctgacttatgt

SEQ ID NO: 64941 - DNA, 25 bp, E. coli
tggtcgccccgctgtttttgatgag

SEQ ID NO: 64942 - DNA, 25 bp, E. coli
tggtcgccccgcagtttttgatgag

SEQ ID NO: 64943 - DNA, 25 bp, E. coli
gatctgacttatctcattacctatg

SEQ ID NO: 64944 - DNA, 25 bp, E. coli
gatctgacttatgtcattacctatg

SEQ ID NO: 64945 - DNA, 25 bp, E. coli
aatttagtccggagattggtgaaga

SEQ ID NO: 64946 - DNA, 25 bp, E. coli
aatttagtccggtgattggtgaaga

SEQ ID NO: 64947 - DNA, 25 bp, E. coli
aaccgctggaggtgctgccgctcac

SEQ ID NO: 64948 - DNA, 25 bp, E. coli
attgcttttgcaagggcgcggttgg

SEQ ID NO: 64949 - DNA, 25 bp, E. coli
attgcttttgcatgggcgcggttgg

SEQ ID NO: 64950 - DNA, 25 bp, E. coli
acagggttacgcgaacgccactgaa

SEQ ID NO: 64951 - DNA, 25 bp, E. coli
acagggttacgccaacgccactgaa

SEQ ID NO: 64952 - DNA, 25 bp, E. coli
aggagctgccgctcaccgagttgca

SEQ ID NO: 64953 - DNA, 25 bp, E. coli
aggagctgccgcacaccgagttgca

SEQ ID NO: 64954 - DNA, 25 bp, E. coli
aaccgctggaggagctgccgctcac

SEQ ID NO: 64955 - DNA, 25 bp, E. coli
aaaggtgtgccgatccgcgaggcac

SEQ ID NO: 64956 - DNA, 25 bp, E. coli
aaaggtgtgccgttccgcgaggcac

SEQ ID NO: 64957 - DNA, 25 bp, E. coli
tgcagaaatttactccggtgattgg

SEQ ID NO: 64958 - DNA, 25 bp, E. coli
tgcagaaatttagtccggtgattgg

SEQ ID NO: 64959 - DNA, 25 bp, E. coli
tcaccgagttgctgaaatttagtcc

SEQ ID NO: 64960 - DNA, 25 bp, E. coli
tcaccgagttgcagaaatttagtcc

SEQ ID NO: 64961 - DNA, 25 bp, E. coli
gatttgcttcaggaacccgtaacag

SEQ ID NO: 64962 - DNA, 25 bp, E. coli
gatttgcttcagcaacccgtaacag

SEQ ID NO: 64963 - DNA, 25 bp, E. coli
ggcgcaacagggttacgcgaacgcc

SEQ ID NO: 64964 - DNA, 25 bp, E. coli
ggctggctgggatttgcttcagcaa

SEQ ID NO: 64965 - DNA, 25 bp, E. coli
ggcgcaacagggatacgcgaacgcc

SEQ ID NO: 64966 - DNA, 25 bp, E. coli
ggctggctgggaattgcttcagcaa

SEQ ID NO: 64967 - DNA, 25 bp, E. coli
cagagtattcagctggcgcatcaac

SEQ ID NO: 64968 - DNA, 25 bp, E. coli
catcaagggttgtgcgcagtctcac

SEQ ID NO: 64969 - DNA, 25 bp, E. coli
catcaagggttgagcgcagtctcac

SEQ ID NO: 64970 - DNA, 25 bp, E. coli
cagagtattcaggtggcgcatcaac

SEQ ID NO: 64971 - DNA, 25 bp, E. coli
tactgagcgttactggaaagagcgc

SEQ ID NO: 64972 - DNA, 25 bp, E. coli
tactgagcgttagtggaaagagcgc

SEQ ID NO: 64973 - DNA, 25 bp, E. coli
tatatgaaatgaagagcggcgcgga

SEQ ID NO: 64974 - DNA, 25 bp, E. coli
tattcttgaagttggcggcggaacc

SEQ ID NO: 64975 - DNA, 25 bp, E. coli
tattacgtggcattgtccagacgcg

SEQ ID NO: 64976 - DNA, 25 bp, E. coli
tatatgaaatgatgagcggcgcgga

SEQ ID NO: 64977 - DNA, 25 bp, E. coli
tattcttgaagtaggcggcggaacc

SEQ ID NO: 64978 - DNA, 25 bp, E. coli
tattacgtggcaatgtccagacgcg

SEQ ID NO: 64979 - DNA, 25 bp, E. coli
cctgctgaataagtgcgtggtcgac

SEQ ID NO: 64980 - DNA, 25 bp, E. coli
cctgctgaataactgcgtggtcgac

SEQ ID NO: 64981 - DNA, 25 bp, E. coli
gaatcactgctgtcggaacttgccg

SEQ ID NO: 64982 - DNA, 25 bp, E. coli
gaatcactgctgacggaacttgccg

SEQ ID NO: 64983 - DNA, 25 bp, E. coli
cgcagtctcagggtttccaggcaca

SEQ ID NO: 64984 - DNA, 25 bp, E. coli
cgcagtctcaggctttccaggcaca

SEQ ID NO: 64985 - DNA, 25 bp, E. coli
gattgattgtggatactcgccgcgc

SEQ ID NO: 64986 - DNA, 25 bp, E. coli
gattgattgtggttactcgccgcgc

SEQ ID NO: 64987 - DNA, 25 bp, E. coli
gatgagtcaacgctcaaccaggcgg

SEQ ID NO: 64988 - DNA, 25 bp, E. coli
gatgagtcaacggtcaaccaggcgg

SEQ ID NO: 64989 - DNA, 25 bp, E. coli
tacaaatagactagagcctcgacaa

SEQ ID NO: 64990 - DNA, 25 bp, E. coli
tacaaatagacttgagcctcgacaa

SEQ ID NO: 64991 - DNA, 25 bp, E. coli
aaaccaagggttcaagcgattcgca

SEQ ID NO: 64992 - DNA, 25 bp, E. coli
aaaccaagggttgaagcgattcgca

SEQ ID NO: 64993 - DNA, 25 bp, E. coli
aaaaagggcttagtgtcacatctca

SEQ ID NO: 64994 - DNA, 25 bp, E. coli
aaaaagggcttactgtcacatctca

SEQ ID NO: 64995 - DNA, 25 bp, E. coli
ttagttactttgtgcgtctggccgc

SEQ ID NO: 64996 - DNA, 25 bp, E. coli
ttagttactttgagcgtctggccgc

SEQ ID NO: 64997 - DNA, 25 bp, E. coli
tgtgctattacatacgccccgatct

SEQ ID NO: 64998 - DNA, 25 bp, E. coli
tgtgctattacaaacgccccgatct

SEQ ID NO: 64999 - DNA, 25 bp, E. coli
tctggccgcactagaaaatgagatg

SEQ ID NO: 65000 - DNA, 25 bp, E. coli
tctggccgcacttgaaaatgagatg

SEQ ID NO: 65001 - DNA, 25 bp, E. coli
gactgctaataatgggttccgtgaa

SEQ ID NO: 65002 - DNA, 25 bp, E. coli
gaaaacgcctctagttgcgtggata

SEQ ID NO: 65003 - DNA, 25 bp, E. coli
gactgctaataaagggttccgtgaa

SEQ ID NO: 65004 - DNA, 25 bp, E. coli
gaaaacgcctcttgttgcgtggata

SEQ ID NO: 65005 - DNA, 25 bp, E. coli
gattcgcaacggtaaaccaacaacg

SEQ ID NO: 65006 - DNA, 25 bp, E. coli
gattcgcaacggaaaaccaacaacg

SEQ ID NO: 65007 - DNA, 25 bp, E. coli
ggcgcaattgttcgttcacagcata

SEQ ID NO: 65008 - DNA, 25 bp, E. coli
ggcgcaattgttggttcacagcata

SEQ ID NO: 65009 - DNA, 25 bp, E. coli
tcaacatgggcttagtgaaaacgcc

SEQ ID NO: 65010 - DNA, 25 bp, E. coli
tcaacatgggctaagtgaaaacgcc

SEQ ID NO: 65011 - DNA, 25 bp, E. coli
aatttcttttatgtggcaacgcggg

SEQ ID NO: 65012 - DNA, 25 bp, E. coli
aatttcttttatctggcaacgcggg

SEQ ID NO: 65013 - DNA, 25 bp, E. coli
tatacggtgtggcaacgacacagca

SEQ ID NO: 65014 - DNA, 25 bp, E. coli
tatacggtgtgggaacgacacagca

SEQ ID NO: 65015 - DNA, 25 bp, E. coli
tggtgacccgggatgcccatgctat

SEQ ID NO: 65016 - DNA, 25 bp, E. coli
tggtgacccgggttgcccatgctat

SEQ ID NO: 65017 - DNA, 25 bp, E. coli
tcacggttccgaccaaacagtgggt

SEQ ID NO: 65018 - DNA, 25 bp, E. coli
tcacggttccgagcaaacagtgggt

SEQ ID NO: 65019 - DNA, 25 bp, E. coli
gcattcaatcgaggaacttaccgcg

SEQ ID NO: 65020 - DNA, 25 bp, E. coli
gcattcaatcgacgaacttaccgcg

SEQ ID NO: 65021 - DNA, 25 bp, E. coli
gaagcagccgcacctttattcgcgg

SEQ ID NO: 65022 - DNA, 25 bp, E. coli
gaagcagccgcagctttattcgcgg

SEQ ID NO: 65023 - DNA, 25 bp, E. coli
cgcgactcaaaacggaactgcagaa

SEQ ID NO: 65024 - DNA, 25 bp, E. coli
cgcgactcaaaagggaactgcagaa

SEQ ID NO: 65025 - DNA, 25 bp, E. coli
cgcttatcaggaaggagtgcaaaca

SEQ ID NO: 65026 - DNA, 25 bp, E. coli
cgcttatcaggatggagtgcaaaca

SEQ ID NO: 65027 - DNA, 25 bp, E. coli
ggattatactttcccggagccaggt

SEQ ID NO: 65028 - DNA, 25 bp, E. coli
ggattatactttgccggagccaggt

SEQ ID NO: 65029 - DNA, 25 bp, E. coli
ggagccaggtatgaccgtcacggtt

SEQ ID NO: 65030 - DNA, 25 bp, E. coli
ggagccaggtatcaccgtcacggtt

SEQ ID NO: 65031 - DNA, 25 bp, E. coli
taatttgatacaactggtcgcagct

SEQ ID NO: 65032 - DNA, 25 bp, E. coli
taatttgatacatctggtcgcagct

SEQ ID NO: 65033 - DNA, 25 bp, E. coli
tacggcagtgaagatggtgggcggg

SEQ ID NO: 65034 - DNA, 25 bp, E. coli
tacggcagtgaacatggtgggcggg

SEQ ID NO: 65035 - DNA, 25 bp, E. coli
gtccgtaacctctttcgagattacg

SEQ ID NO: 65036 - DNA, 25 bp, E. coli
gtccgtaacctcattcgagattacg

SEQ ID NO: 65037 - DNA, 25 bp, E. coli
tacctgtgaattactaagctgcctg

SEQ ID NO: 65038 - DNA, 25 bp, E. coli
tacctgtgaatttctaagctgcctg

SEQ ID NO: 65039 - DNA, 25 bp, E. coli
ttgaccaacctacctaacaatcaga

SEQ ID NO: 65040 - DNA, 25 bp, E. coli
ttgaccaacctagctaacaatcaga

SEQ ID NO: 65041 - DNA, 25 bp, E. coli
tatcaacaacttaccatcatcatta

SEQ ID NO: 65042 - DNA, 25 bp, E. coli
tatcaacaactttccatcatcatta

SEQ ID NO: 65043 - DNA, 25 bp, E. coli
ttctcctgcagcacccttttttatc

SEQ ID NO: 65044 - DNA, 25 bp, E. coli
ttctcctgcagctcccttttttatc

SEQ ID NO: 65045 - DNA, 25 bp, E. coli
ttaccttcccgctgcactaattatc

SEQ ID NO: 65046 - DNA, 25 bp, E. coli
ttaccttcccgcagcactaattatc

SEQ ID NO: 65047 - DNA, 25 bp, E. coli
tctttcgagatttcggacttgacca

SEQ ID NO: 65048 - DNA, 25 bp, E. coli
tctttcgagattacggacttgacca

SEQ ID NO: 65049 - DNA, 25 bp, E. coli
ccatcatcattaaaaaaagggtctg

SEQ ID NO: 65050 - DNA, 25 bp, E. coli
ccatcatcattataaaaagggtctg

SEQ ID NO: 65051 - DNA, 25 bp, E. coli
cgggtggagtatcttacctgtgaat

SEQ ID NO: 65052 - DNA, 25 bp, E. coli
cgggtggagtatgttacctgtgaat

SEQ ID NO: 65053 - DNA, 25 bp, E. coli
gattacggacttcaccaacctacct

SEQ ID NO: 65054 - DNA, 25 bp, E. coli
gattacggacttgaccaacctacct

SEQ ID NO: 65055 - DNA, 25 bp, E. coli
caagaaaggacaaggaatccggagt

SEQ ID NO: 65056 - DNA, 25 bp, E. coli
gaaaattcccgttttattaccgcag

SEQ ID NO: 65057 - DNA, 25 bp, E. coli
caagaaaggacatggaatccggagt

SEQ ID NO: 65058 - DNA, 25 bp, E. coli
gaaaattcccgtattattaccgcag

SEQ ID NO: 65059 - DNA, 25 bp, E. coli
tagattgctcctgggaaaattcccg

SEQ ID NO: 65060 - DNA, 25 bp, E. coli
tagattgctcctcggaaaattcccg

SEQ ID NO: 65061 - DNA, 25 bp, E. coli
tatatctgccgccaggaatttctgg

SEQ ID NO: 65062 - DNA, 25 bp, E. coli
tatatctgccgcgaggaatttctgg

SEQ ID NO: 65063 - DNA, 25 bp, E. coli
tgacaaagacagagcaagaaaggac

SEQ ID NO: 65064 - DNA, 25 bp, E. coli
tgacaaagacagtgcaagaaaggac

SEQ ID NO: 65065 - DNA, 25 bp, E. coli
tctgtggcgaaattgactaccttcg

SEQ ID NO: 65066 - DNA, 25 bp, E. coli
tctggcggcaataatacaaaattct

SEQ ID NO: 65067 - DNA, 25 bp, E. coli
tctgtggcgaaaatgactaccttcg

SEQ ID NO: 65068 - DNA, 25 bp, E. coli
tctggcggcaattatacaaaattct

SEQ ID NO: 65069 - DNA, 25 bp, E. coli
gctgtattgttaagtctgtggcgaa

SEQ ID NO: 65070 - DNA, 25 bp, E. coli
gctgtattgttatgtctgtggcgaa

SEQ ID NO: 65071 - DNA, 25 bp, E. coli
gacatatcctgtcacaaaaggagct

SEQ ID NO: 65072 - DNA, 25 bp, E. coli
gacatatcctgtgacaaaaggagct

SEQ ID NO: 65073 - DNA, 25 bp, E. coli
ggaaaacgacatcaaaccgaagcac

SEQ ID NO: 65074 - DNA, 25 bp, E. coli
ggaaaacgacatgaaaccgaagcac

SEQ ID NO: 65075 - DNA, 25 bp, E. coli
taactgctgaatgttccttgcgaga

SEQ ID NO: 65076 - DNA, 25 bp, E. coli
taactgctgaatcttccttgcgaga

SEQ ID NO: 65077 - DNA, 25 bp, E. coli
aaccgtctggtgatgtccggcaccg

SEQ ID NO: 65078 - DNA, 25 bp, E. coli
aaccgtctggtgttgtccggcaccg

SEQ ID NO: 65079 - DNA, 25 bp, E. coli
cacagtataacggtcggcagtcgca

SEQ ID NO: 65080 - DNA, 25 bp, E. coli
cacagtataacgctcggcagtcgca

SEQ ID NO: 65081 - DNA, 25 bp, E. coli
caaaatggttttccatgccgagcag

SEQ ID NO: 65082 - DNA, 25 bp, E. coli
caaatgcccgtttttgttagcggac

SEQ ID NO: 65083 - DNA, 25 bp, E. coli
caaaatggttttgcatgccgagcag

SEQ ID NO: 65084 - DNA, 25 bp, E. coli
caaatgcccgttattgttagcggac

SEQ ID NO: 65085 - DNA, 25 bp, E. coli
ttctgtgcaggaggaagccggcttt

SEQ ID NO: 65086 - DNA, 25 bp, E. coli
ttagcggacacgtaaaccaggccat

SEQ ID NO: 65087 - DNA, 25 bp, E. coli
ttagcggacacgaaaaccaggccat

SEQ ID NO: 65088 - DNA, 25 bp, E. coli
ttctgtgcaggacgaagccggcttt

SEQ ID NO: 65089 - DNA, 25 bp, E. coli
tcggcagtcgcataaccgttcaggg

SEQ ID NO: 65090 - DNA, 25 bp, E. coli
tgccacaaggcaaagaacggactga

SEQ ID NO: 65091 - DNA, 25 bp, E. coli
tcggcagtcgcaaaaccgttcaggg

SEQ ID NO: 65092 - DNA, 25 bp, E. coli
tgccacaaggcatagaacggactga

SEQ ID NO: 65093 - DNA, 25 bp, E. coli
tcaggaattcctgactgccagttcg

SEQ ID NO: 65094 - DNA, 25 bp, E. coli
tcgtgcttgagcatcgttctgtgca

SEQ ID NO: 65095 - DNA, 25 bp, E. coli
tcgtgcttgagcttcgttctgtgca

SEQ ID NO: 65096 - DNA, 25 bp, E. coli
tcaggaattcctcactgccagttcg

SEQ ID NO: 65097 - DNA, 25 bp, E. coli
ccttcgaaaggtcagtccatcagga

SEQ ID NO: 65098 - DNA, 25 bp, E. coli
ccttcgaaaggtgagtccatcagga

SEQ ID NO: 65099 - DNA, 25 bp, E. coli
atgcacgccaccttttgctaccctt

SEQ ID NO: 65100 - DNA, 25 bp, E. coli
atgcacgccaccatttgctaccctt

SEQ ID NO: 65101 - DNA, 25 bp, E. coli
acgtcgatggtaatgagctcgctga

SEQ ID NO: 65102 - DNA, 25 bp, E. coli
acgtcgatggtattgagctcgctga

SEQ ID NO: 65103 - DNA, 25 bp, E. coli
tggtattgagctggctgaactgatt

SEQ ID NO: 65104 - DNA, 25 bp, E. coli
tgacgtcgatggtattgagctcgct

SEQ ID NO: 65105 - DNA, 25 bp, E. coli
tgacgtcgatggaattgagctcgct

SEQ ID NO: 65106 - DNA, 25 bp, E. coli
tcgatggtattgtgctcgctgaact

SEQ ID NO: 65107 - DNA, 25 bp, E. coli
tcgatggtattgagctcgctgaact

SEQ ID NO: 65108 - DNA, 25 bp, E. coli
cgatggtattgacctcgctgaactg

SEQ ID NO: 65109 - DNA, 25 bp, E. coli
cgatggtattgagctcgctgaactg

SEQ ID NO: 65110 - DNA, 25 bp, E. coli
cgtcgatggtatagagctcgctgaa

SEQ ID NO: 65111 - DNA, 25 bp, E. coli
cgtcgatggtattgagctcgctgaa

SEQ ID NO: 65112 - DNA, 25 bp, E. coli
gtcgatggtattcagctcgctgaac

SEQ ID NO: 65113 - DNA, 25 bp, E. coli
gtcgatggtattgagctcgctgaac

SEQ ID NO: 65114 - DNA, 25 bp, E. coli
tggtattgagctcgctgaactgatt

SEQ ID NO: 65115 - DNA, 25 bp, E. coli
gacgtcgatggttttgagctcgctg

SEQ ID NO: 65116 - DNA, 25 bp, E. coli
gacgtcgatggtattgagctcgctg

SEQ ID NO: 65117 - DNA, 25 bp, E. coli
aagggcgcatcatccagctgttcga

SEQ ID NO: 65118 - DNA, 25 bp, E. coli
aagggcgcatcaaccagctgttcga

SEQ ID NO: 65119 - DNA, 25 bp, E. coli
tttccgaagcggcactgtatcgcca

SEQ ID NO: 65120 - DNA, 25 bp, E. coli
tttccgaagcgggactgtatcgcca

SEQ ID NO: 65121 - DNA, 25 bp, E. coli
ttggtgagcgtattcctggcctgac

SEQ ID NO: 65122 - DNA, 25 bp, E. coli
ttacaccaccgatgaaaccctgctg

SEQ ID NO: 65123 - DNA, 25 bp, E. coli
ttggtgagcgtaatcctggcctgac

SEQ ID NO: 65124 - DNA, 25 bp, E. coli
ttacaccaccgaagaaaccctgctg

SEQ ID NO: 65125 - DNA, 25 bp, E. coli
tgtatcgccacttccccagtaagac

SEQ ID NO: 65126 - DNA, 25 bp, E. coli
tgtatcgccactaccccagtaagac

SEQ ID NO: 65127 - DNA, 25 bp, E. coli
taagacccgcatgttcgatagcctg

SEQ ID NO: 65128 - DNA, 25 bp, E. coli
taagacccgcatcttcgatagcctg

SEQ ID NO: 65129 - DNA, 25 bp, E. coli
gaagccaacgtatcacgacggcaaa

SEQ ID NO: 65130 - DNA, 25 bp, E. coli
gaagccaacgtaacacgacggcaaa

SEQ ID NO: 65131 - DNA, 25 bp, E. coli
gacggatgattttgacgcccgctgg

SEQ ID NO: 65132 - DNA, 25 bp, E. coli
gaaatacttcagtctctggcgctga

SEQ ID NO: 65133 - DNA, 25 bp, E. coli
gaaatacttcagactctggcgctga

SEQ ID NO: 65134 - DNA, 25 bp, E. coli
gacggatgatttagacgcccgctgg

SEQ ID NO: 65135 - DNA, 25 bp, E. coli
ggaaccgtcgcgaggaaatacttca

SEQ ID NO: 65136 - DNA, 25 bp, E. coli
ggaaccgtcgcgtggaaatacttca

SEQ ID NO: 65137 - DNA, 25 bp, E. coli
tggaatccagcgatggaagccaacg

SEQ ID NO: 65138 - DNA, 25 bp, E. coli
tggaatccagcgttggaagccaacg

SEQ ID NO: 65139 - DNA, 25 bp, E. coli
tactcggtagtgtacataaacgcgt

SEQ ID NO: 65140 - DNA, 25 bp, E. coli
tactcggtagtgaacataaacgcgt

SEQ ID NO: 65141 - DNA, 25 bp, E. coli
aaccaaagttgctgctatttatggc

SEQ ID NO: 65142 - DNA, 25 bp, E. coli
aaccaaagttgcagctatttatggc

SEQ ID NO: 65143 - DNA, 25 bp, E. coli
aaaggccagcgtattgtattgcaac

SEQ ID NO: 65144 - DNA, 25 bp, E. coli
aaaggccagcgttttgtattgcaac

SEQ ID NO: 65145 - DNA, 25 bp, E. coli
tatttatggcaaccgggatgtccgt

SEQ ID NO: 65146 - DNA, 25 bp, E. coli
tattgtcgaagtgggtaaaaatctc

SEQ ID NO: 65147 - DNA, 25 bp, E. coli
tattgtcgaagtcggtaaaaatctc

SEQ ID NO: 65148 - DNA, 25 bp, E. coli
tatttatggcaagcgggatgtccgt

SEQ ID NO: 65149 - DNA, 25 bp, E. coli
tcattaccgggcatgaatgtgccgg

SEQ ID NO: 65150 - DNA, 25 bp, E. coli
tcattaccgggcttgaatgtgccgg

SEQ ID NO: 65151 - DNA, 25 bp, E. coli
gaaaatcatccggtcattaccgggc

SEQ ID NO: 65152 - DNA, 25 bp, E. coli
gaaagcggcgtttctcggtagtgaa

SEQ ID NO: 65153 - DNA, 25 bp, E. coli
gaaagcggcgttactcggtagtgaa

SEQ ID NO: 65154 - DNA, 25 bp, E. coli
gaaaatcatccgctcattaccgggc

SEQ ID NO: 65155 - DNA, 25 bp, E. coli
cccgacgatttagaaaatcatccgg

SEQ ID NO: 65156 - DNA, 25 bp, E. coli
cccgacgatttacaaaatcatccgg

SEQ ID NO: 65157 - DNA, 25 bp, E. coli
gttttgtattgcaaccggcgatggg

SEQ ID NO: 65158 - DNA, 25 bp, E. coli
gttttgtattgctaccggcgatggg

SEQ ID NO: 65159 - DNA, 25 bp, E. coli
tgggtaaaaatcacactggcaaata

SEQ ID NO: 65160 - DNA, 25 bp, E. coli
tgggtaaaaatctcactggcaaata

SEQ ID NO: 65161 - DNA, 25 bp, E. coli
caaagaagggaatttgccagaaaat

SEQ ID NO: 65162 - DNA, 25 bp, E. coli
caaagaagggaaattgccagaaaat

SEQ ID NO: 65163 - DNA, 25 bp, E. coli
cagaaaattagggatgccgctgcgc

SEQ ID NO: 65164 - DNA, 25 bp, E. coli
cagaaaattaggcatgccgctgcgc

SEQ ID NO: 65165 - DNA, 25 bp, E. coli
aaagcgttggcgcacttatcggacg

SEQ ID NO: 65166 - DNA, 25 bp, E. coli
aaagcgttggcggacttatcggacg

SEQ ID NO: 65167 - DNA, 25 bp, E. coli
aactgaagcggctgtgagaacgaag

SEQ ID NO: 65168 - DNA, 25 bp, E. coli
aactgaagcggcagtgagaacgaag

SEQ ID NO: 65169 - DNA, 25 bp, E. coli
tgccgctgcgcatagtgaataacta

SEQ ID NO: 65170 - DNA, 25 bp, E. coli
tgccgctgcgcaaagtgaataacta

SEQ ID NO: 65171 - DNA, 25 bp, E. coli
tcagagaggcatgcaaagaagggaa

SEQ ID NO: 65172 - DNA, 25 bp, E. coli
tcagagaggcatccaaagaagggaa

SEQ ID NO: 65173 - DNA, 25 bp, E. coli
cgcggcaactgcttcagagaggcat

SEQ ID NO: 65174 - DNA, 25 bp, E. coli
cgatgaaggtaataagcgttggcgc

SEQ ID NO: 65175 - DNA, 25 bp, E. coli
cgatgaaggtaaaaagcgttggcgc

SEQ ID NO: 65176 - DNA, 25 bp, E. coli
cgcggcaactgcatcagagaggcat

SEQ ID NO: 65177 - DNA, 25 bp, E. coli
cttatcggacgatctgaagcggcag

SEQ ID NO: 65178 - DNA, 25 bp, E. coli
cgtcggcaaaatattctcagcgtga

SEQ ID NO: 65179 - DNA, 25 bp, E. coli
cgtcggcaaaattttctcagcgtga

SEQ ID NO: 65180 - DNA, 25 bp, E. coli
cttatcggacgaactgaagcggcag

SEQ ID NO: 65181 - DNA, 25 bp, E. coli
gtggtgattttcacccgtcggcaaa

SEQ ID NO: 65182 - DNA, 25 bp, E. coli
gtggtgattttctcccgtcggcaaa

SEQ ID NO: 65183 - DNA, 25 bp, E. coli
caaaagcggtttctccaggacctgg

SEQ ID NO: 65184 - DNA, 25 bp, E. coli
caaaagcggtttgtccaggacctgg

SEQ ID NO: 65185 - DNA, 25 bp, E. coli
caggacctggtgttaactgattggc

SEQ ID NO: 65186 - DNA, 25 bp, E. coli
cataaagttgtcgatgactggccag

SEQ ID NO: 65187 - DNA, 25 bp, E. coli
caggacctggtgataactgattggc

SEQ ID NO: 65188 - DNA, 25 bp, E. coli
cataaagttgtccatgactggccag

SEQ ID NO: 65189 - DNA, 25 bp, E. coli
aactgattggcagcgtatcgggagc

SEQ ID NO: 65190 - DNA, 25 bp, E. coli
aactgattggcaccgtatcgggagc

SEQ ID NO: 65191 - DNA, 25 bp, E. coli
taccttatagcgacccggatgatcc

SEQ ID NO: 65192 - DNA, 25 bp, E. coli
tagagccgctcgtatgttggtcacc

SEQ ID NO: 65193 - DNA, 25 bp, E. coli
taccttatagcgtcccggatgatcc

SEQ ID NO: 65194 - DNA, 25 bp, E. coli
tagagccgctcgaatgttggtcacc

SEQ ID NO: 65195 - DNA, 25 bp, E. coli
ttcttgtgccgttacgtcacccgcg

SEQ ID NO: 65196 - DNA, 25 bp, E. coli
ttcttgtgccgtaacgtcacccgcg

SEQ ID NO: 65197 - DNA, 25 bp, E. coli
tgttggtcaccacaaaagcggtttc

SEQ ID NO: 65198 - DNA, 25 bp, E. coli
tgttggtcaccagaaaagcggtttc

SEQ ID NO: 65199 - DNA, 25 bp, E. coli
gactggccagctagcgtttcttgtg

SEQ ID NO: 65200 - DNA, 25 bp, E. coli
gactggccagcttgcgtttcttgtg

SEQ ID NO: 65201 - DNA, 25 bp, E. coli
ggatgatccgtcaatccgccttgct

SEQ ID NO: 65202 - DNA, 25 bp, E. coli
ggatgatccgtctatccgccttgct

SEQ ID NO: 65203 - DNA, 25 bp, E. coli
taacccagccgttaagattcagtgt

SEQ ID NO: 65204 - DNA, 25 bp, E. coli
taacccagccgtaaagattcagtgt

SEQ ID NO: 65205 - DNA, 25 bp, E. coli
catttgtgtaccagattgcgaacca

SEQ ID NO: 65206 - DNA, 25 bp, E. coli
catttgtgtacctgattgcgaacca

SEQ ID NO: 65207 - DNA, 25 bp, E. coli
taaacctttcagtcgcaccgtgatg

SEQ ID NO: 65208 - DNA, 25 bp, E. coli
taaacctttcagacgcaccgtgatg

SEQ ID NO: 65209 - DNA, 25 bp, E. coli
tatgtgatctttggtgtgggtcacc

SEQ ID NO: 65210 - DNA, 25 bp, E. coli
tatgctgctgtatatccgctcgcag

SEQ ID NO: 65211 - DNA, 25 bp, E. coli
tatgctgctgtaaatccgctcgcag

SEQ ID NO: 65212 - DNA, 25 bp, E. coli
tatgtgatctttcgtgtgggtcacc

SEQ ID NO: 65213 - DNA, 25 bp, E. coli
ttatcgccagaaggaaatgtgcacg

SEQ ID NO: 65214 - DNA, 25 bp, E. coli
ttatcgccagaacgaaatgtgcacg

SEQ ID NO: 65215 - DNA, 25 bp, E. coli
tgttaacatcgcacaaccgggtgga

SEQ ID NO: 65216 - DNA, 25 bp, E. coli
tgttaacatcgctcaaccgggtgga

SEQ ID NO: 65217 - DNA, 25 bp, E. coli
tgtactcactactaacgaattgcga

SEQ ID NO: 65218 - DNA, 25 bp, E. coli
tgtactcactacaaacgaattgcga

SEQ ID NO: 65219 - DNA, 25 bp, E. coli
tgaaacggaaagctacaatctccct

SEQ ID NO: 65220 - DNA, 25 bp, E. coli
tgaaacggaaaggtacaatctccct

SEQ ID NO: 65221 - DNA, 25 bp, E. coli
gtgggtcaccacagcaaataaggat

SEQ ID NO: 65222 - DNA, 25 bp, E. coli
gtgggtcaccactgcaaataaggat

SEQ ID NO: 65223 - DNA, 25 bp, E. coli
tggctagatggtatcgcaatgaact

SEQ ID NO: 65224 - DNA, 25 bp, E. coli
tggctagatggtttcgcaatgaact

SEQ ID NO: 65225 - DNA, 25 bp, E. coli
taagcgttttgctggtgtactcact

SEQ ID NO: 65226 - DNA, 25 bp, E. coli
taagcgttttgcaggtgtactcact

SEQ ID NO: 65227 - DNA, 25 bp, E. coli
cagcccgttattggtgttgaagccg

SEQ ID NO: 65228 - DNA, 25 bp, E. coli
cagcccgttattcgtgttgaagccg

SEQ ID NO: 65229 - DNA, 25 bp, E. coli
taccttagccacagggatggttcct

SEQ ID NO: 65230 - DNA, 25 bp, E. coli
taccttagccactgggatggttcct

SEQ ID NO: 65231 - DNA, 25 bp, E. coli
tccaccaaaagatgacaagagcagc

SEQ ID NO: 65232 - DNA, 25 bp, E. coli
tccaccaaaagaagacaagagcagc

SEQ ID NO: 65233 - DNA, 25 bp, E. coli
tcagaagagctgaaacgcgtaacgt

SEQ ID NO: 65234 - DNA, 25 bp, E. coli
tcagaagagctgtaacgcgtaacgt

SEQ ID NO: 65235 - DNA, 25 bp, E. coli
tacaatttaaaacgctcccttcagg

SEQ ID NO: 65236 - DNA, 25 bp, E. coli
gccggtcaagtagaacaggttcgat

SEQ ID NO: 65237 - DNA, 25 bp, E. coli
cctggaatggcgaaaaaatggcgac

SEQ ID NO: 65238 - DNA, 25 bp, E. coli
ccaccattgttgttttgcctgaaag

SEQ ID NO: 65239 - DNA, 25 bp, E. coli
ccaccattgttgatttgcctgaaag

SEQ ID NO: 65240 - DNA, 25 bp, E. coli
cctggaatggcgtaaaaatggcgac

SEQ ID NO: 65241 - DNA, 25 bp, E. coli
gccggtcaagtacaacaggttcgat

SEQ ID NO: 65242 - DNA, 25 bp, E. coli
ggcgactgttcctctgcaatcagaa

SEQ ID NO: 65243 - DNA, 25 bp, E. coli
ggcgactgttccactgcaatcagaa

SEQ ID NO: 65244 - DNA, 25 bp, E. coli
tacaatttaaaaggctcccttcagg

SEQ ID NO: 65245 - DNA, 25 bp, E. coli
gagttttacccacccagccgatatg

SEQ ID NO: 65246 - DNA, 25 bp, E. coli
gagcgagagaccaggaaattcctgg

SEQ ID NO: 65247 - DNA, 25 bp, E. coli
gagcgagagacctggaaattcctgg

SEQ ID NO: 65248 - DNA, 25 bp, E. coli
gagttttacccagccagccgatatg

SEQ ID NO: 65249 - DNA, 25 bp, E. coli
cacgttggcgtgattgattgtctga

SEQ ID NO: 65250 - DNA, 25 bp, E. coli
cacgttggcgtgtttgattgtctga

SEQ ID NO: 65251 - DNA, 25 bp, E. coli
agtagcgacgagttgccggaacaca

SEQ ID NO: 65252 - DNA, 25 bp, E. coli
agtagcgacgagatgccggaacaca

SEQ ID NO: 65253 - DNA, 25 bp, E. coli
ttttggtgagatagttattgacgcc

SEQ ID NO: 65254 - DNA, 25 bp, E. coli
ttttggtgagattgttattgacgcc

SEQ ID NO: 65255 - DNA, 25 bp, E. coli
tgcactggtcgatgaggagcaagcc

SEQ ID NO: 65256 - DNA, 25 bp, E. coli
tgcactggtcgaagaggagcaagcc

SEQ ID NO: 65257 - DNA, 25 bp, E. coli
tctgatggccagtaaaattgcgtga

SEQ ID NO: 65258 - DNA, 25 bp, E. coli
tctgatggccagaaaaattgcgtga

SEQ ID NO: 65259 - DNA, 25 bp, E. coli
gctgcccactgagggaatacgaaga

SEQ ID NO: 65260 - DNA, 25 bp, E. coli
gctgcccactgacggaatacgaaga

SEQ ID NO: 65261 - DNA, 25 bp, E. coli
gcgcgtagcattcaattcattcatc

SEQ ID NO: 65262 - DNA, 25 bp, E. coli
gcgcgtagcattgaattcattcatc

SEQ ID NO: 65263 - DNA, 25 bp, E. coli
gaatacgaagattggcttgcactgg

SEQ ID NO: 65264 - DNA, 25 bp, E. coli
gaatacgaagataggcttgcactgg

SEQ ID NO: 65265 - DNA, 25 bp, E. coli
gaaaaaagtttgacgccagtagcga

SEQ ID NO: 65266 - DNA, 25 bp, E. coli
gaaaaaagtttgtcgccagtagcga

SEQ ID NO: 65267 - DNA, 25 bp, E. coli
ggaaattgttttctggacgctgcga

SEQ ID NO: 65268 - DNA, 25 bp, E. coli
ggagcaagcccgacgtaagatgctg

SEQ ID NO: 65269 - DNA, 25 bp, E. coli
ggagcaagcccgtcgtaagatgctg

SEQ ID NO: 65270 - DNA, 25 bp, E. coli
ggaaattgttttgtggacgctgcga

SEQ ID NO: 65271 - DNA, 25 bp, E. coli
cactttcagacattagtcttttgcc

SEQ ID NO: 65272 - DNA, 25 bp, E. coli
cactttcagacaatagtcttttgcc

SEQ ID NO: 65273 - DNA, 25 bp, E. coli
caatagtcttttgccatcgtgatga

SEQ ID NO: 65274 - DNA, 25 bp, E. coli
caatagtcttttcccatcgtgatga

SEQ ID NO: 65275 - DNA, 25 bp, E. coli
cagacaatagtcatttgccatcgtg

SEQ ID NO: 65276 - DNA, 25 bp, E. coli
cagacaatagtcttttgccatcgtg

SEQ ID NO: 65277 - DNA, 25 bp, E. coli
tacttcacaaggtcttcactttcag

SEQ ID NO: 65278 - DNA, 25 bp, E. coli
tacttcacaaggacttcactttcag

SEQ ID NO: 65279 - DNA, 25 bp, E. coli
tagtcttttgccttcgtgatgaatg

SEQ ID NO: 65280 - DNA, 25 bp, E. coli
tagtcttttgccatcgtgatgaatg

SEQ ID NO: 65281 - DNA, 25 bp, E. coli
ttcccgccatcatacttcacaagga

SEQ ID NO: 65282 - DNA, 25 bp, E. coli
ttttgccatcgtgatgaatgtgagt

SEQ ID NO: 65283 - DNA, 25 bp, E. coli
ttcccgccatcaaacttcacaagga

SEQ ID NO: 65284 - DNA, 25 bp, E. coli
ttttgccatcgtcatgaatgtgagt

SEQ ID NO: 65285 - DNA, 25 bp, E. coli
tcatacttcacatggacttcacttt

SEQ ID NO: 65286 - DNA, 25 bp, E. coli
tcatacttcacaaggacttcacttt

SEQ ID NO: 65287 - DNA, 25 bp, E. coli
gccatcatacttgacaaggacttca

SEQ ID NO: 65288 - DNA, 25 bp, E. coli
gccatcatacttcacaaggacttca

SEQ ID NO: 65289 - DNA, 25 bp, E. coli
ggttcccgccatcatacttcacaag

SEQ ID NO: 65290 - DNA, 25 bp, E. coli
ggttcccgccatgatacttcacaag

SEQ ID NO: 65291 - DNA, 25 bp, E. coli
tcacaaggacttgactttcagacaa

SEQ ID NO: 65292 - DNA, 25 bp, E. coli
tcacaaggacttcactttcagacaa

SEQ ID NO: 65293 - DNA, 25 bp, E. coli
cagttcggatgtactgcatcaagaa

SEQ ID NO: 65294 - DNA, 25 bp, E. coli
cagttcggatgttctgcatcaagaa

SEQ ID NO: 65295 - DNA, 25 bp, E. coli
ttcactgcgaccagaacgattgctg

SEQ ID NO: 65296 - DNA, 25 bp, E. coli
ttagcgatccctgcagttcggatgt

SEQ ID NO: 65297 - DNA, 25 bp, E. coli
ttagcgatccctccagttcggatgt

SEQ ID NO: 65298 - DNA, 25 bp, E. coli
ttcactgcgacctgaacgattgctg

SEQ ID NO: 65299 - DNA, 25 bp, E. coli
tgtaatgcagccttaaccagatcgg

SEQ ID NO: 65300 - DNA, 25 bp, E. coli
tgtaatgcagccataaccagatcgg

SEQ ID NO: 65301 - DNA, 25 bp, E. coli
tcatcagccagtagcgctaatcgct

SEQ ID NO: 65302 - DNA, 25 bp, E. coli
tcatcagccagttgcgctaatcgct

SEQ ID NO: 65303 - DNA, 25 bp, E. coli
ccagatcggtaaaacaaacagcaca

SEQ ID NO: 65304 - DNA, 25 bp, E. coli
gcctgaatacgttcgcgcatccgtt

SEQ ID NO: 65305 - DNA, 25 bp, E. coli
ccagatcggtaatacaaacagcaca

SEQ ID NO: 65306 - DNA, 25 bp, E. coli
gcctgaatacgtacgcgcatccgtt

SEQ ID NO: 65307 - DNA, 25 bp, E. coli
gctcactttgcgtcaattcactgcg

SEQ ID NO: 65308 - DNA, 25 bp, E. coli
gcgctaatcgctcctgctcactttg

SEQ ID NO: 65309 - DNA, 25 bp, E. coli
gcatccgttttgcttcatcagccag

SEQ ID NO: 65310 - DNA, 25 bp, E. coli
gcgctaatcgctgctgctcactttg

SEQ ID NO: 65311 - DNA, 25 bp, E. coli
gcatccgttttggttcatcagccag

SEQ ID NO: 65312 - DNA, 25 bp, E. coli
gctcactttgcgacaattcactgcg

SEQ ID NO: 65313 - DNA, 25 bp, E. coli
gaccagaacgatagctgtaatgcag

SEQ ID NO: 65314 - DNA, 25 bp, E. coli
gaccagaacgattgctgtaatgcag

SEQ ID NO: 65315 - DNA, 25 bp, E. coli
caaacagcctgatagtattgcccga

SEQ ID NO: 65316 - DNA, 25 bp, E. coli
caaaaaaggcgtcatgaacgtgctg

SEQ ID NO: 65317 - DNA, 25 bp, E. coli
caaaaaaggcgtgatgaacgtgctg

SEQ ID NO: 65318 - DNA, 25 bp, E. coli
caaacagcctgaaagtattgcccga

SEQ ID NO: 65319 - DNA, 25 bp, E. coli
aacagcctgaaactattgcccgaag

SEQ ID NO: 65320 - DNA, 25 bp, E. coli
aaaaggcgtgatcaacgtgctgatg

SEQ ID NO: 65321 - DNA, 25 bp, E. coli
aaaaggcgtgatgaacgtgctgatg

SEQ ID NO: 65322 - DNA, 25 bp, E. coli
aacagcctgaaagtattgcccgaag

SEQ ID NO: 65323 - DNA, 25 bp, E. coli
tgaaactgtccggaaaaatccacaa

SEQ ID NO: 65324 - DNA, 25 bp, E. coli
tgaaaagtgcccgggagcaacaaaa

SEQ ID NO: 65325 - DNA, 25 bp, E. coli
tgaaactgtccgcaaaaatccacaa

SEQ ID NO: 65326 - DNA, 25 bp, E. coli
tgaaaagtgccccggagcaacaaaa

SEQ ID NO: 65327 - DNA, 25 bp, E. coli
tccggaaaaatcgacaaacagcctg

SEQ ID NO: 65328 - DNA, 25 bp, E. coli
tccggaaaaatccacaaacagcctg

SEQ ID NO: 65329 - DNA, 25 bp, E. coli
cctgaaagtattccccgaagtcgtg

SEQ ID NO: 65330 - DNA, 25 bp, E. coli
gaaaaatccacaaacagcctgaaag

SEQ ID NO: 65331 - DNA, 25 bp, E. coli
gaaaaatccacatacagcctgaaag

SEQ ID NO: 65332 - DNA, 25 bp, E. coli
cgctgaaactgtgcggaaaaatcca

SEQ ID NO: 65333 - DNA, 25 bp, E. coli
cctgaaagtattgcccgaagtcgtg

SEQ ID NO: 65334 - DNA, 25 bp, E. coli
cgctgaaactgtccggaaaaatcca

SEQ ID NO: 65335 - DNA, 25 bp, E. coli
gggagcaacaaaaaaggcgtgatga

SEQ ID NO: 65336 - DNA, 25 bp, E. coli
gggagcaacaaataaggcgtgatga

SEQ ID NO: 65337 - DNA, 25 bp, E. coli
aatctgcaagccacgcgtgcggtgg

SEQ ID NO: 65338 - DNA, 25 bp, E. coli
aatctgcaagcctcgcgtgcggtgg

SEQ ID NO: 65339 - DNA, 25 bp, E. coli
aattattggcacaacgctttctggc

SEQ ID NO: 65340 - DNA, 25 bp, E. coli
aattattggcactacgctttctggc

SEQ ID NO: 65341 - DNA, 25 bp, E. coli
tttactggcgatgaccgactgctca

SEQ ID NO: 65342 - DNA, 25 bp, E. coli
tttactggcgatcaccgactgctca

SEQ ID NO: 65343 - DNA, 25 bp, E. coli
gcctgaaacgcctgaagagccggat

SEQ ID NO: 65344 - DNA, 25 bp, E. coli
gcctgaaacgccagaagagccggat

SEQ ID NO: 65345 - DNA, 25 bp, E. coli
gcctggcatgccaaaagctgggagc

SEQ ID NO: 65346 - DNA, 25 bp, E. coli
gcctggcatgcctaaagctgggagc

SEQ ID NO: 65347 - DNA, 25 bp, E. coli
gctttctggctaaaccacgcctgaa

SEQ ID NO: 65348 - DNA, 25 bp, E. coli
gctttctggctataccacgcctgaa

SEQ ID NO: 65349 - DNA, 25 bp, E. coli
gacattatcgccattgacggcaccg

SEQ ID NO: 65350 - DNA, 25 bp, E. coli
gacattatcgcctttgacggcaccg

SEQ ID NO: 65351 - DNA, 25 bp, E. coli
ggtgattgccgaagggcgttacaac

SEQ ID NO: 65352 - DNA, 25 bp, E. coli
ggtgattgccgatgggcgttacaac

SEQ ID NO: 65353 - DNA, 25 bp, E. coli
tcaaaaaatcgctgctaacggtggc

SEQ ID NO: 65354 - DNA, 25 bp, E. coli
taacggtggcctcattgtctcctgc

SEQ ID NO: 65355 - DNA, 25 bp, E. coli
taacggtggcctgattgtctcctgc

SEQ ID NO: 65356 - DNA, 25 bp, E. coli
tcaaaaaatcgcagctaacggtggc

SEQ ID NO: 65357 - DNA, 25 bp, E. coli
gaggattctccggtacgcatcacgg

SEQ ID NO: 65358 - DNA, 25 bp, E. coli
gaggattctccgctacgcatcacgg

SEQ ID NO: 65359 - DNA, 25 bp, E. coli
cacaggaaacgtttgagagcgggat

SEQ ID NO: 65360 - DNA, 25 bp, E. coli
cacaggaaacgtatgagagcgggat

SEQ ID NO: 65361 - DNA, 25 bp, E. coli
catgcgcgtgcgatatataccgtcg

SEQ ID NO: 65362 - DNA, 25 bp, E. coli
catgcgcgtgcgttatataccgtcg

SEQ ID NO: 65363 - DNA, 25 bp, E. coli
tatgtccttttggaagccgctcgca

SEQ ID NO: 65364 - DNA, 25 bp, E. coli
tatggcaaaggacatcagatccgcg

SEQ ID NO: 65365 - DNA, 25 bp, E. coli
tatgtccttttgcaagccgctcgca

SEQ ID NO: 65366 - DNA, 25 bp, E. coli
tatggcaaaggagatcagatccgcg

SEQ ID NO: 65367 - DNA, 25 bp, E. coli
tatgttgctgatcgtccgggacacg

SEQ ID NO: 65368 - DNA, 25 bp, E. coli
tatgttgctgatggtccgggacacg

SEQ ID NO: 65369 - DNA, 25 bp, E. coli
tttactgagacgacagcttacgcgc

SEQ ID NO: 65370 - DNA, 25 bp, E. coli
tttactgagacgtcagcttacgcgc

SEQ ID NO: 65371 - DNA, 25 bp, E. coli
tgaccgttcaataacaggccctgcg

SEQ ID NO: 65372 - DNA, 25 bp, E. coli
tgaccgttcaattacaggccctgcg

SEQ ID NO: 65373 - DNA, 25 bp, E. coli
gccggaaaccgggaatcacttgctg

SEQ ID NO: 65374 - DNA, 25 bp, E. coli
gccggaaaccggcaatcacttgctg

SEQ ID NO: 65375 - DNA, 25 bp, E. coli
gaaaagtggtgcgtatcaatcgtgg

SEQ ID NO: 65376 - DNA, 25 bp, E. coli
gaaaagtggtgcctatcaatcgtgg

SEQ ID NO: 65377 - DNA, 25 bp, E. coli
cgatcatttagtccgcgcgtggaaa

SEQ ID NO: 65378 - DNA, 25 bp, E. coli
cgatcatttagtgcgcgcgtggaaa

SEQ ID NO: 65379 - DNA, 25 bp, E. coli
gattgaacagaactatgagggccgc

SEQ ID NO: 65380 - DNA, 25 bp, E. coli
gattgaacagaagtatgagggccgc

SEQ ID NO: 65381 - DNA, 25 bp, E. coli
caatggaacttagcaatgacgcggt

SEQ ID NO: 65382 - DNA, 25 bp, E. coli
caatggaacttaccaatgacgcggt

SEQ ID NO: 65383 - DNA, 25 bp, E. coli
caggtatcggcatggacaaacgtcc

SEQ ID NO: 65384 - DNA, 25 bp, E. coli
caggtatcggcaaggacaaacgtcc

SEQ ID NO: 65385 - DNA, 25 bp, E. coli
taaataccgatgcacaagcgctgcg

SEQ ID NO: 65386 - DNA, 25 bp, E. coli
taaagtcgtgaaagacaatgcgccg

SEQ ID NO: 65387 - DNA, 25 bp, E. coli
taaagtcgtgaatgacaatgcgccg

SEQ ID NO: 65388 - DNA, 25 bp, E. coli
taaataccgatggacaagcgctgcg

SEQ ID NO: 65389 - DNA, 25 bp, E. coli
tagcggtatcacgaaaggactgggc

SEQ ID NO: 65390 - DNA, 25 bp, E. coli
tagcggtatcaccaaaggactgggc

SEQ ID NO: 65391 - DNA, 25 bp, E. coli
tgattaaagtcaacggcgtcggcgg

SEQ ID NO: 65392 - DNA, 25 bp, E. coli
tgattaaagtcatcggcgtcggcgg

SEQ ID NO: 65393 - DNA, 25 bp, E. coli
tccgctgctggatgatatcgacctg

SEQ ID NO: 65394 - DNA, 25 bp, E. coli
tccgctgctggaagatatcgacctg

SEQ ID NO: 65395 - DNA, 25 bp, E. coli
cccggatatgaaagacgagctgcgc

SEQ ID NO: 65396 - DNA, 25 bp, E. coli
cccggatatgaatgacgagctgcgc

SEQ ID NO: 65397 - DNA, 25 bp, E. coli
tggactttgcagtcgtacgcaccgt

SEQ ID NO: 65398 - DNA, 25 bp, E. coli
tggactttgcagacgtacgcaccgt

SEQ ID NO: 65399 - DNA, 25 bp, E. coli
taatccagaagtaggccgcaatgcg

SEQ ID NO: 65400 - DNA, 25 bp, E. coli
taagcaggttcaccagccagtgatg

SEQ ID NO: 65401 - DNA, 25 bp, E. coli
taatccagaagttggccgcaatgcg

SEQ ID NO: 65402 - DNA, 25 bp, E. coli
taagcaggttcagcagccagtgatg

SEQ ID NO: 65403 - DNA, 25 bp, E. coli
aatctgcaggacattgtaggccgga

SEQ ID NO: 65404 - DNA, 25 bp, E. coli
aatctgcaggactttgtaggccgga

SEQ ID NO: 65405 - DNA, 25 bp, E. coli
ttgaatctgcagcactttgtaggcc

SEQ ID NO: 65406 - DNA, 25 bp, E. coli
ttaacgccgcatcaggcattaacaa

SEQ ID NO: 65407 - DNA, 25 bp, E. coli
ttgaatctgcaggactttgtaggcc

SEQ ID NO: 65408 - DNA, 25 bp, E. coli
ttaacgccgcatgaggcattaacaa

SEQ ID NO: 65409 - DNA, 25 bp, E. coli
tgtcagcaatctcagtaacgtcgaa

SEQ ID NO: 65410 - DNA, 25 bp, E. coli
tgtcagcaatctgagtaacgtcgaa

SEQ ID NO: 65411 - DNA, 25 bp, E. coli
gcatcaggcattaacaaagcgcatt

SEQ ID NO: 65412 - DNA, 25 bp, E. coli
gcaatctgagtatcgtcgaatcgat

SEQ ID NO: 65413 - DNA, 25 bp, E. coli
gaatcgattttcttaatcccacatc

SEQ ID NO: 65414 - DNA, 25 bp, E. coli
gcatcaggcatttacaaagcgcatt

SEQ ID NO: 65415 - DNA, 25 bp, E. coli
gaatcgattttcataatcccacatc

SEQ ID NO: 65416 - DNA, 25 bp, E. coli
gcaatctgagtaacgtcgaatcgat

SEQ ID NO: 65417 - DNA, 25 bp, E. coli
cgtcgaatcgatattcttaatccca

SEQ ID NO: 65418 - DNA, 25 bp, E. coli
cgtcgaatcgattttcttaatccca

SEQ ID NO: 65419 - DNA, 25 bp, E. coli
gtgattatccgtcaccccgatactg

SEQ ID NO: 65420 - DNA, 25 bp, E. coli
gtgattatccgtgaccccgatactg

SEQ ID NO: 65421 - DNA, 25 bp, E. coli
ggcattaacaaaccgcatttgtcag

SEQ ID NO: 65422 - DNA, 25 bp, E. coli
ggcattaacaaagcgcatttgtcag

SEQ ID NO: 65423 - DNA, 25 bp, E. coli
taatcccacatcaattcacttccat

SEQ ID NO: 65424 - DNA, 25 bp, E. coli
taatcccacatctattcacttccat

SEQ ID NO: 65425 - DNA, 25 bp, E. coli
aaaatggattcgacacccgtgtcgc

SEQ ID NO: 65426 - DNA, 25 bp, E. coli
aaaggatgccattctgattaactca

SEQ ID NO: 65427 - DNA, 25 bp, E. coli
aaaatggattcgtcacccgtgtcgc

SEQ ID NO: 65428 - DNA, 25 bp, E. coli
aaaggatgccatactgattaactca

SEQ ID NO: 65429 - DNA, 25 bp, E. coli
tatgctggccgcaagcgcagccagc

SEQ ID NO: 65430 - DNA, 25 bp, E. coli
tatgtattaactcgattctgaacgg

SEQ ID NO: 65431 - DNA, 25 bp, E. coli
tatgtattaactggattctgaacgg

SEQ ID NO: 65432 - DNA, 25 bp, E. coli
tatgctggccgctagcgcagccagc

SEQ ID NO: 65433 - DNA, 25 bp, E. coli
tgatcttgatcaggagaagtgaggt

SEQ ID NO: 65434 - DNA, 25 bp, E. coli
tgatcttgatcacgagaagtgaggt

SEQ ID NO: 65435 - DNA, 25 bp, E. coli
tctgaacggtacaaaaatgatggtc

SEQ ID NO: 65436 - DNA, 25 bp, E. coli
tcagcaaaaaatcgattcgacaccc

SEQ ID NO: 65437 - DNA, 25 bp, E. coli
tcagcaaaaaatggattcgacaccc

SEQ ID NO: 65438 - DNA, 25 bp, E. coli
tctgaacggtactaaaatgatggtc

SEQ ID NO: 65439 - DNA, 25 bp, E. coli
gccagcacggaaaggagcaaagtaa

SEQ ID NO: 65440 - DNA, 25 bp, E. coli
gccagcacggaatggagcaaagtaa

SEQ ID NO: 65441 - DNA, 25 bp, E. coli
gaaagcgagaatctgatcttgatca

SEQ ID NO: 65442 - DNA, 25 bp, E. coli
gaaagcgagaatgtgatcttgatca

SEQ ID NO: 65443 - DNA, 25 bp, E. coli
tcacgagaagtgaggtatgctggcc

SEQ ID NO: 65444 - DNA, 25 bp, E. coli
tcacgagaagtgtggtatgctggcc

SEQ ID NO: 65445 - DNA, 25 bp, E. coli
gatggtcattaacgttcagcaaaaa

SEQ ID NO: 65446 - DNA, 25 bp, E. coli
gatggtcattaaggttcagcaaaaa

SEQ ID NO: 65447 - DNA, 25 bp, E. coli
aaccatgctgtttgatgcgccgctg

SEQ ID NO: 65448 - DNA, 25 bp, E. coli
aaccatgctgttagatgcgccgctg

SEQ ID NO: 65449 - DNA, 25 bp, E. coli
agattaaatactcggcgcgctgggt

SEQ ID NO: 65450 - DNA, 25 bp, E. coli
accttcttttgcaacggcggcagcg

SEQ ID NO: 65451 - DNA, 25 bp, E. coli
accttcttttgctacggcggcagcg

SEQ ID NO: 65452 - DNA, 25 bp, E. coli
agattaaatactgggcgcgctgggt

SEQ ID NO: 65453 - DNA, 25 bp, E. coli
aaaaagaagctaatcgcgtgcagcg

SEQ ID NO: 65454 - DNA, 25 bp, E. coli
aaaaagaagctattcgcgtgcagcg

SEQ ID NO: 65455 - DNA, 25 bp, E. coli
tatcaatatggtctggttgccgccc

SEQ ID NO: 65456 - DNA, 25 bp, E. coli
tatcaatatggtgtggttgccgccc

SEQ ID NO: 65457 - DNA, 25 bp, E. coli
tgttaacgactacaccggcgaaggc

SEQ ID NO: 65458 - DNA, 25 bp, E. coli
tgttaacgactagaccggcgaaggc

SEQ ID NO: 65459 - DNA, 25 bp, E. coli
tgcgccgctgcagatgaaattccat

SEQ ID NO: 65460 - DNA, 25 bp, E. coli
tgcgccgctgcacatgaaattccat

SEQ ID NO: 65461 - DNA, 25 bp, E. coli
gaacacgtacagcaagttgcgccaa

SEQ ID NO: 65462 - DNA, 25 bp, E. coli
gaacacgtacaggaagttgcgccaa

SEQ ID NO: 65463 - DNA, 25 bp, E. coli
cgctgggtgatgcaacaaacgcaat

SEQ ID NO: 65464 - DNA, 25 bp, E. coli
cgctgggtgatggaacaaacgcaat

SEQ ID NO: 65465 - DNA, 25 bp, E. coli
gattttcgcaatgatgccgtgacgg

SEQ ID NO: 65466 - DNA, 25 bp, E. coli
gattttcgcaatcatgccgtgacgg

SEQ ID NO: 65467 - DNA, 25 bp, E. coli
ggtagtcaaccagaaaatgggcgcg

SEQ ID NO: 65468 - DNA, 25 bp, E. coli
ggtagtcaaccacaaaatgggcgcg

SEQ ID NO: 65469 - DNA, 25 bp, E. coli
aatgcaagaatgagctgcgtctggc

SEQ ID NO: 65470 - DNA, 25 bp, E. coli
aatgcaagaatgtgctgcgtctggc

SEQ ID NO: 65471 - DNA, 25 bp, E. coli
cactggaatagaggtttcttgtggc

SEQ ID NO: 65472 - DNA, 25 bp, E. coli
cactggaatagacgtttcttgtggc

SEQ ID NO: 65473 - DNA, 25 bp, E. coli
taaaggcgcagcacgtcgaatgcaa

SEQ ID NO: 65474 - DNA, 25 bp, E. coli
taaaggcgcagctcgtcgaatgcaa

SEQ ID NO: 65475 - DNA, 25 bp, E. coli
atagaggtttctagtggcgcatgtg

SEQ ID NO: 65476 - DNA, 25 bp, E. coli
atagaggtttcttgtggcgcatgtg

SEQ ID NO: 65477 - DNA, 25 bp, E. coli
tggtgataaatataggcgcagcacg

SEQ ID NO: 65478 - DNA, 25 bp, E. coli
tggtgataaataaaggcgcagcacg

SEQ ID NO: 65479 - DNA, 25 bp, E. coli
cgcagcacgtcgtatgcaagaatgt

SEQ ID NO: 65480 - DNA, 25 bp, E. coli
cgcagcacgtcgaatgcaagaatgt

SEQ ID NO: 65481 - DNA, 25 bp, E. coli
gggcgtctatggacaaggcgtttcc

SEQ ID NO: 65482 - DNA, 25 bp, E. coli
gggcgtctatggtcaaggcgtttcc

SEQ ID NO: 65483 - DNA, 25 bp, E. coli
tggacaaggcgtttcctgctggtga

SEQ ID NO: 65484 - DNA, 25 bp, E. coli
tggacaaggcgtatcctgctggtga

SEQ ID NO: 65485 - DNA, 25 bp, E. coli
ggcgcaattgtgacactggaataga

SEQ ID NO: 65486 - DNA, 25 bp, E. coli
ggcgcaattgtgtcactggaataga

SEQ ID NO: 65487 - DNA, 25 bp, E. coli
taattaggcgcatttgtgtcactgg

SEQ ID NO: 65488 - DNA, 25 bp, E. coli
taattaggcgcaattgtgtcactgg

SEQ ID NO: 65489 - DNA, 25 bp, E. coli
taaataaaggcggagcacgtcgaat

SEQ ID NO: 65490 - DNA, 25 bp, E. coli
taaataaaggcgcagcacgtcgaat

SEQ ID NO: 65491 - DNA, 25 bp, E. coli
aatggagagataatcgctgtggtgc

SEQ ID NO: 65492 - DNA, 25 bp, E. coli
aatatcgagataatatatagactgc

SEQ ID NO: 65493 - DNA, 25 bp, E. coli
aatggagagatattcgctgtggtgc

SEQ ID NO: 65494 - DNA, 25 bp, E. coli
aatatcgagatattatatagactgc

SEQ ID NO: 65495 - DNA, 25 bp, E. coli
taaactttcatatgcaacgcatgaa

SEQ ID NO: 65496 - DNA, 25 bp, E. coli
tactaatatattccagctaaactgc

SEQ ID NO: 65497 - DNA, 25 bp, E. coli
tactaatatattgcagctaaactgc

SEQ ID NO: 65498 - DNA, 25 bp, E. coli
taaactttcataagcaacgcatgaa

SEQ ID NO: 65499 - DNA, 25 bp, E. coli
tattcgcaaactgagtaataagctt

SEQ ID NO: 65500 - DNA, 25 bp, E. coli
tattcgcaaactcagtaataagctt

SEQ ID NO: 65501 - DNA, 25 bp, E. coli
tgcaacgcatgattataaataaaat

SEQ ID NO: 65502 - DNA, 25 bp, E. coli
tgcaacgcatgaatataaataaaat

SEQ ID NO: 65503 - DNA, 25 bp, E. coli
tgaggtagatcagtaagaatggaga

SEQ ID NO: 65504 - DNA, 25 bp, E. coli
tgaggtagatcactaagaatggaga

SEQ ID NO: 65505 - DNA, 25 bp, E. coli
tcgctgtggtgcttaaactttcata

SEQ ID NO: 65506 - DNA, 25 bp, E. coli
tcgctgtggtgcataaactttcata

SEQ ID NO: 65507 - DNA, 25 bp, E. coli
tcagggtaagcgagagagttaaaaa

SEQ ID NO: 65508 - DNA, 25 bp, E. coli
tcagggtaagcgtgagagttaaaaa

SEQ ID NO: 65509 - DNA, 25 bp, E. coli
gcagctaaactgcttaccctgaata

SEQ ID NO: 65510 - DNA, 25 bp, E. coli
gcagctaaactggttaccctgaata

SEQ ID NO: 65511 - DNA, 25 bp, E. coli
cgcgtttaaaagctgaggtagatca

SEQ ID NO: 65512 - DNA, 25 bp, E. coli
cgcgtttaaaaggtgaggtagatca

SEQ ID NO: 65513 - DNA, 25 bp, E. coli
cacctgtcaattgactcactggaaa

SEQ ID NO: 65514 - DNA, 25 bp, E. coli
cacctgtcaattcactcactggaaa

SEQ ID NO: 65515 - DNA, 25 bp, E. coli
cagatatatattacctgagagaaag

SEQ ID NO: 65516 - DNA, 25 bp, E. coli
cagatatatatttcctgagagaaag

SEQ ID NO: 65517 - DNA, 25 bp, E. coli
tacaaagctgcgcttgacaaagcat

SEQ ID NO: 65518 - DNA, 25 bp, E. coli
tactggctttaaggtggaagcagcg

SEQ ID NO: 65519 - DNA, 25 bp, E. coli
tacaaagctgcggttgacaaagcat

SEQ ID NO: 65520 - DNA, 25 bp, E. coli
tactggctttaacgtggaagcagcg

SEQ ID NO: 65521 - DNA, 25 bp, E. coli
tatggatggccctggcggaaacgta

SEQ ID NO: 65522 - DNA, 25 bp, E. coli
tatggatggcccaggcggaaacgta

SEQ ID NO: 65523 - DNA, 25 bp, E. coli
tcctggctggtgttattgaaaatat

SEQ ID NO: 65524 - DNA, 25 bp, E. coli
tcctggctggtgatattgaaaatat

SEQ ID NO: 65525 - DNA, 25 bp, E. coli
gcggaaacgtaaggccagtaaccat

SEQ ID NO: 65526 - DNA, 25 bp, E. coli
gcggaaacgtaacgccagtaaccat

SEQ ID NO: 65527 - DNA, 25 bp, E. coli
ggtgacgctgccaacaaagctgcgc

SEQ ID NO: 65528 - DNA, 25 bp, E. coli
gtgaaacaagcgctcagctgcgacc

SEQ ID NO: 65529 - DNA, 25 bp, E. coli
ggtgacgctgcctacaaagctgcgc

SEQ ID NO: 65530 - DNA, 25 bp, E. coli
gtgaaacaagcggtcagctgcgacc

SEQ ID NO: 65531 - DNA, 25 bp, E. coli
tggaagcagcgaccgtgaaacaagc

SEQ ID NO: 65532 - DNA, 25 bp, E. coli
tggaagcagcgagcgtgaaacaagc

SEQ ID NO: 65533 - DNA, 25 bp, E. coli
gagagaaagttttacccctcacctg

SEQ ID NO: 65534 - DNA, 25 bp, E. coli
gagagaaagtttaacccctcacctg

SEQ ID NO: 65535 - DNA, 25 bp, E. coli
caagctggacgatgtccgcgaagca

SEQ ID NO: 65536 - DNA, 25 bp, E. coli
caagctggacgaagtccgcgaagca

SEQ ID NO: 65537 - DNA, 25 bp, E. coli
aaacccttcaaggtggacgatgtcc

SEQ ID NO: 65538 - DNA, 25 bp, E. coli
aaacccttcaagctggacgatgtcc

SEQ ID NO: 65539 - DNA, 25 bp, E. coli
tttctgccgaaactgaaaattgaga

SEQ ID NO: 65540 - DNA, 25 bp, E. coli
tttctgccgaaagtgaaaattgaga

SEQ ID NO: 65541 - DNA, 25 bp, E. coli
tgtcgtaccggacgacattgtcgat

SEQ ID NO: 65542 - DNA, 25 bp, E. coli
tgtcgtaccggaggacattgtcgat

SEQ ID NO: 65543 - DNA, 25 bp, E. coli
tcggtgacggtataatcttcgtctt

SEQ ID NO: 65544 - DNA, 25 bp, E. coli
tcggtgacggtaaaatcttcgtctt

SEQ ID NO: 65545 - DNA, 25 bp, E. coli
gcaaaccggcaatatcggtgacggt

SEQ ID NO: 65546 - DNA, 25 bp, E. coli
gcaaaccggcaaaatcggtgacggt

SEQ ID NO: 65547 - DNA, 25 bp, E. coli
gaaaattgagatagtcgtaccggac

SEQ ID NO: 65548 - DNA, 25 bp, E. coli
gaaaattgagattgtcgtaccggac

SEQ ID NO: 65549 - DNA, 25 bp, E. coli
cgccagaaaggccataccgagctgt

SEQ ID NO: 65550 - DNA, 25 bp, E. coli
cgccagaaaggcgataccgagctgt

SEQ ID NO: 65551 - DNA, 25 bp, E. coli
cattgtcgatacctgtgtcgatacc

SEQ ID NO: 65552 - DNA, 25 bp, E. coli
cattgtcgatacgtgtgtcgatacc

SEQ ID NO: 65553 - DNA, 25 bp, E. coli
gataccattattggcacggcgcaaa

SEQ ID NO: 65554 - DNA, 25 bp, E. coli
gataccattattcgcacggcgcaaa

SEQ ID NO: 65555 - DNA, 25 bp, E. coli
gagtatatggtgcattttctgccga

SEQ ID NO: 65556 - DNA, 25 bp, E. coli
gagtatatggtggattttctgccga

SEQ ID NO: 65557 - DNA, 25 bp, E. coli
tacagagcgggatggattatccaca

SEQ ID NO: 65558 - DNA, 25 bp, E. coli
tacagagcgggaaggattatccaca

SEQ ID NO: 65559 - DNA, 25 bp, E. coli
acagtttgaccgcaaccagtgggca

SEQ ID NO: 65560 - DNA, 25 bp, E. coli
acagtttgaccggaaccagtgggca

SEQ ID NO: 65561 - DNA, 25 bp, E. coli
tatcggaagatgtgatcgcccgtct

SEQ ID NO: 65562 - DNA, 25 bp, E. coli
tataagctcgaatctgcgccgtcag

SEQ ID NO: 65563 - DNA, 25 bp, E. coli
tatcggaagatgagatcgcccgtct

SEQ ID NO: 65564 - DNA, 25 bp, E. coli
tataagctcgaaactgcgccgtcag

SEQ ID NO: 65565 - DNA, 25 bp, E. coli
ttcttggtaccaacgggcaacgcat

SEQ ID NO: 65566 - DNA, 25 bp, E. coli
ttcttggtaccatcgggcaacgcat

SEQ ID NO: 65567 - DNA, 25 bp, E. coli
tctgatgaagaacaaaggcttcccg

SEQ ID NO: 65568 - DNA, 25 bp, E. coli
tctgatgaagaagaaaggcttcccg

SEQ ID NO: 65569 - DNA, 25 bp, E. coli
gcagctctgcgtcattccgtaccta

SEQ ID NO: 65570 - DNA, 25 bp, E. coli
gcagctctgcgtgattccgtaccta

SEQ ID NO: 65571 - DNA, 25 bp, E. coli
cgatatatgttgttgcaccggaaga

SEQ ID NO: 65572 - DNA, 25 bp, E. coli
cgtatgatatgcatcgcctggtgaa

SEQ ID NO: 65573 - DNA, 25 bp, E. coli
cgatatatgttgatgcaccggaaga

SEQ ID NO: 65574 - DNA, 25 bp, E. coli
cgtatgatatgcttcgcctggtgaa

SEQ ID NO: 65575 - DNA, 25 bp, E. coli
gatctctcgttacaagaagttgccg

SEQ ID NO: 65576 - DNA, 25 bp, E. coli
gatctctcgttagaagaagttgccg

SEQ ID NO: 65577 - DNA, 25 bp, E. coli
gatggcttccttcaccctaatcagg

SEQ ID NO: 65578 - DNA, 25 bp, E. coli
gatggcttccttgaccctaatcagg

SEQ ID NO: 65579 - DNA, 25 bp, E. coli
caattgggctttgtgaccgttgaga

SEQ ID NO: 65580 - DNA, 25 bp, E. coli
aagcggcctcgctgctggttaatcc

SEQ ID NO: 65581 - DNA, 25 bp, E. coli
aagcggcctcgcagctggttaatcc

SEQ ID NO: 65582 - DNA, 25 bp, E. coli
caattgggctttctgaccgttgaga

SEQ ID NO: 65583 - DNA, 25 bp, E. coli
taaacttgacgaaagcggcaaactg

SEQ ID NO: 65584 - DNA, 25 bp, E. coli
taaacttgacgatagcggcaaactg

SEQ ID NO: 65585 - DNA, 25 bp, E. coli
tagcagtaagataggcgaacgcgcg

SEQ ID NO: 65586 - DNA, 25 bp, E. coli
tagcagtaagattggcgaacgcgcg

SEQ ID NO: 65587 - DNA, 25 bp, E. coli
tcctggaaatgctcgcacaattggg

SEQ ID NO: 65588 - DNA, 25 bp, E. coli
tcctggaaatgcacgcacaattggg

SEQ ID NO: 65589 - DNA, 25 bp, E. coli
tcattatgggcggacagtacaacaa

SEQ ID NO: 65590 - DNA, 25 bp, E. coli
tcattatgggcgcacagtacaacaa

SEQ ID NO: 65591 - DNA, 25 bp, E. coli
ccgttgagaaagtcgttgagcgtct

SEQ ID NO: 65592 - DNA, 25 bp, E. coli
gcgctggacgccgatgaatctgcat

SEQ ID NO: 65593 - DNA, 25 bp, E. coli
ccgttgagaaagacgttgagcgtct

SEQ ID NO: 65594 - DNA, 25 bp, E. coli
gcgctggacgcccatgaatctgcat

SEQ ID NO: 65595 - DNA, 25 bp, E. coli
gaatgctttttacccgtgccgatca

SEQ ID NO: 65596 - DNA, 25 bp, E. coli
gaatgctttttagccgtgccgatca

SEQ ID NO: 65597 - DNA, 25 bp, E. coli
gaaaacagtctctatgccgggcact

SEQ ID NO: 65598 - DNA, 25 bp, E. coli
gaaaacagtctcaatgccgggcact

SEQ ID NO: 65599 - DNA, 25 bp, E. coli
taatccgggcgaaagcgtagtcatc

SEQ ID NO: 65600 - DNA, 25 bp, E. coli
taatccgggcgatagcgtagtcatc

SEQ ID NO: 65601 - DNA, 25 bp, E. coli
tacgaccttcgatatggacacccga

SEQ ID NO: 65602 - DNA, 25 bp, E. coli
aaactatcaatcgacgctggcgtgg

SEQ ID NO: 65603 - DNA, 25 bp, E. coli
aaactatcaatccacgctggcgtgg

SEQ ID NO: 65604 - DNA, 25 bp, E. coli
tacgaccttcgaaatggacacccga

SEQ ID NO: 65605 - DNA, 25 bp, E. coli
tttaagcgtcacatccgtcatcggg

SEQ ID NO: 65606 - DNA, 25 bp, E. coli
tttaagcgtcacttccgtcatcggg

SEQ ID NO: 65607 - DNA, 25 bp, E. coli
tgcgtgaggcaggacaaaactatca

SEQ ID NO: 65608 - DNA, 25 bp, E. coli
tgcgtgaggcagcacaaaactatca

SEQ ID NO: 65609 - DNA, 25 bp, E. coli
gcccaaatgctgtacgggattgtga

SEQ ID NO: 65610 - DNA, 25 bp, E. coli
gcccaaatgctgaacgggattgtga

SEQ ID NO: 65611 - DNA, 25 bp, E. coli
gaagttcaattaccgactcgctacg

SEQ ID NO: 65612 - DNA, 25 bp, E. coli
gaaggcgttatctctgatgggagca

SEQ ID NO: 65613 - DNA, 25 bp, E. coli
gaagttcaattagcgactcgctacg

SEQ ID NO: 65614 - DNA, 25 bp, E. coli
gaaggcgttatcactgatgggagca

SEQ ID NO: 65615 - DNA, 25 bp, E. coli
gacacccgataaatgcagatgagcg

SEQ ID NO: 65616 - DNA, 25 bp, E. coli
gacacccgataattgcagatgagcg

SEQ ID NO: 65617 - DNA, 25 bp, E. coli
cgctgatttgctggatggactggaa

SEQ ID NO: 65618 - DNA, 25 bp, E. coli
cgctgatttgctcgatggactggaa

SEQ ID NO: 65619 - DNA, 25 bp, E. coli
gattgacctagaacacgcattacgc

SEQ ID NO: 65620 - DNA, 25 bp, E. coli
gattgacctagatcacgcattacgc

SEQ ID NO: 65621 - DNA, 25 bp, E. coli
gatgcggctcttgctgcgtttaagc

SEQ ID NO: 65622 - DNA, 25 bp, E. coli
gatgcggctcttcctgcgtttaagc

SEQ ID NO: 65623 - DNA, 25 bp, E. coli
atcggccaggttgcagcggatctgc

SEQ ID NO: 65624 - DNA, 25 bp, E. coli
atcggccaggttccagcggatctgc

SEQ ID NO: 65625 - DNA, 25 bp, E. coli
tcctgttgaccatcagctgcctgcg

SEQ ID NO: 65626 - DNA, 25 bp, E. coli
tcctgttgaccaacagctgcctgcg

SEQ ID NO: 65627 - DNA, 25 bp, E. coli
gcaagggtgttcgttacgccgacga

SEQ ID NO: 65628 - DNA, 25 bp, E. coli
gcaagggtgttccttacgccgacga

SEQ ID NO: 65629 - DNA, 25 bp, E. coli
gctgaatgtccgactcagactgaaa

SEQ ID NO: 65630 - DNA, 25 bp, E. coli
gctgcctgcgggtatcactgctgaa

SEQ ID NO: 65631 - DNA, 25 bp, E. coli
gctgaatgtccgtctcagactgaaa

SEQ ID NO: 65632 - DNA, 25 bp, E. coli
gctgcctgcgggaatcactgctgaa

SEQ ID NO: 65633 - DNA, 25 bp, E. coli
gcaatgtgattaacctgtctctggg

SEQ ID NO: 65634 - DNA, 25 bp, E. coli
gaagtcgtgcgttccaaagaggcta

SEQ ID NO: 65635 - DNA, 25 bp, E. coli
gcaatgtgattatcctgtctctggg

SEQ ID NO: 65636 - DNA, 25 bp, E. coli
gaagtcgtgcgtaccaaagaggcta

SEQ ID NO: 65637 - DNA, 25 bp, E. coli
gactgaaatcgtcctgaaaggcgct

SEQ ID NO: 65638 - DNA, 25 bp, E. coli
gactgaaatcgtgctgaaaggcgct

SEQ ID NO: 65639 - DNA, 25 bp, E. coli
cgctgataagcaggtgatcggccag

SEQ ID NO: 65640 - DNA, 25 bp, E. coli
cgctgataagcacgtgatcggccag

SEQ ID NO: 65641 - DNA, 25 bp, E. coli
ctgcagctggttcgtgtaggttacc

SEQ ID NO: 65642 - DNA, 25 bp, E. coli
ctgcagctggttggtgtaggttacc

SEQ ID NO: 65643 - DNA, 25 bp, E. coli
ggcttcactaagtagctgcagctgg

SEQ ID NO: 65644 - DNA, 25 bp, E. coli
ggcttcactaagaagctgcagctgg

SEQ ID NO: 65645 - DNA, 25 bp, E. coli
cacggcacgcggctaattgttaact

SEQ ID NO: 65646 - DNA, 25 bp, E. coli
cacggcacgcgggtaattgttaact

SEQ ID NO: 65647 - DNA, 25 bp, E. coli
tatgtcaggcccaataatgctaccg

SEQ ID NO: 65648 - DNA, 25 bp, E. coli
tatgtcaggccctataatgctaccg

SEQ ID NO: 65649 - DNA, 25 bp, E. coli
tatctttgagttactgcgccagcag

SEQ ID NO: 65650 - DNA, 25 bp, E. coli
tatctttgagtttctgcgccagcag

SEQ ID NO: 65651 - DNA, 25 bp, E. coli
tgaacggttatctcatgctggcaac

SEQ ID NO: 65652 - DNA, 25 bp, E. coli
tgaacggttatcacatgctggcaac

SEQ ID NO: 65653 - DNA, 25 bp, E. coli
ccaataacggtctacaggcggtgtt

SEQ ID NO: 65654 - DNA, 25 bp, E. coli
gccgaagccagcgaagtgacgatta

SEQ ID NO: 65655 - DNA, 25 bp, E. coli
ccaataacggtcaacaggcggtgtt

SEQ ID NO: 65656 - DNA, 25 bp, E. coli
gccgaagccagccaagtgacgatta

SEQ ID NO: 65657 - DNA, 25 bp, E. coli
gcatctggaagtcagcgacaacggt

SEQ ID NO: 65658 - DNA, 25 bp, E. coli
gctcctgggactcgatacgcataat

SEQ ID NO: 65659 - DNA, 25 bp, E. coli
gctcctgggactggatacgcataat

SEQ ID NO: 65660 - DNA, 25 bp, E. coli
gcatctggaagtgagcgacaacggt

SEQ ID NO: 65661 - DNA, 25 bp, E. coli
gaaaagctgatccacaccgaggagg

SEQ ID NO: 65662 - DNA, 25 bp, E. coli
gaaaagctgatcgacaccgaggagg

SEQ ID NO: 65663 - DNA, 25 bp, E. coli
gagagctgcacgacgaaatcggtca

SEQ ID NO: 65664 - DNA, 25 bp, E. coli
gatgaactgacatttcgcgaagcgt

SEQ ID NO: 65665 - DNA, 25 bp, E. coli
gagagctgcacgtcgaaatcggtca

SEQ ID NO: 65666 - DNA, 25 bp, E. coli
gatgaactgacaattcgcgaagcgt

SEQ ID NO: 65667 - DNA, 25 bp, E. coli
aaagatattacccaacgcgcgctgg

SEQ ID NO: 65668 - DNA, 25 bp, E. coli
aaagatattaccgaacgcgcgctgg

SEQ ID NO: 65669 - DNA, 25 bp, E. coli
ttgattaccccaccctcgaagcggt

SEQ ID NO: 65670 - DNA, 25 bp, E. coli
ttgattaccccagcctcgaagcggt

SEQ ID NO: 65671 - DNA, 25 bp, E. coli
ccagtggtgaaatctcgcaggctaa

SEQ ID NO: 65672 - DNA, 25 bp, E. coli
ccagtggtgaaaactcgcaggctaa

SEQ ID NO: 65673 - DNA, 25 bp, E. coli
gaatctcggtttaagccatctggaa

SEQ ID NO: 65674 - DNA, 25 bp, E. coli
gaatctcggttttagccatctggaa

SEQ ID NO: 65675 - DNA, 25 bp, E. coli
gaaagacggctgaattgccatcgct

SEQ ID NO: 65676 - DNA, 25 bp, E. coli
gaaagacggctgtattgccatcgct

SEQ ID NO: 65677 - DNA, 25 bp, E. coli
cattatcctcgatatattgcgtgcg

SEQ ID NO: 65678 - DNA, 25 bp, E. coli
cattatcctcgaaatattgcgtgcg

SEQ ID NO: 65679 - DNA, 25 bp, E. coli
gattcagtttggaggcgcagaaccg

SEQ ID NO: 65680 - DNA, 25 bp, E. coli
gattcagtttggtggcgcagaaccg

SEQ ID NO: 65681 - DNA, 25 bp, E. coli
ggttccggtgcacatttacgccaga

SEQ ID NO: 65682 - DNA, 25 bp, E. coli
ggttccggtgcagatttacgccaga

SEQ ID NO: 65683 - DNA, 25 bp, E. coli
ggcaatctggcggtcaatctcggga

SEQ ID NO: 65684 - DNA, 25 bp, E. coli
ggcgatcccgatcctgaaaaaagag

SEQ ID NO: 65685 - DNA, 25 bp, E. coli
ggcgatcccgatgctgaaaaaagag

SEQ ID NO: 65686 - DNA, 25 bp, E. coli
ggcaatctggcgctcaatctcggga

SEQ ID NO: 65687 - DNA, 25 bp, E. coli
tcaatctcgggagatttggcggcgt

SEQ ID NO: 65688 - DNA, 25 bp, E. coli
tcaatctcgggacatttggcggcgt

SEQ ID NO: 65689 - DNA, 25 bp, E. coli
cagaggattgtcaggaagacaaacg

SEQ ID NO: 65690 - DNA, 25 bp, E. coli
cagaggattgtctggaagacaaacg

SEQ ID NO: 65691 - DNA, 25 bp, E. coli
caggaagacaaaggtccggagacgt

SEQ ID NO: 65692 - DNA, 25 bp, E. coli
caggaagacaaacgtccggagacgt

SEQ ID NO: 65693 - DNA, 25 bp, E. coli
atgagggtcaggagcgccaggaggc

SEQ ID NO: 65694 - DNA, 25 bp, E. coli
atgagggtcaggtgcgccaggaggc

SEQ ID NO: 65695 - DNA, 25 bp, E. coli
ttgtcaggaagacaaacgtccggag

SEQ ID NO: 65696 - DNA, 25 bp, E. coli
ttgtcaggaagagaaacgtccggag

SEQ ID NO: 65697 - DNA, 25 bp, E. coli
tgtcaggaagacaaacgtccggaga

SEQ ID NO: 65698 - DNA, 25 bp, E. coli
tgtcaggaagactaacgtccggaga

SEQ ID NO: 65699 - DNA, 25 bp, E. coli
tcaggaagacaaacgtccggagacg

SEQ ID NO: 65700 - DNA, 25 bp, E. coli
tcaggaagacaatcgtccggagacg

SEQ ID NO: 65701 - DNA, 25 bp, E. coli
gaagacagaggattgtcaggaagac

SEQ ID NO: 65702 - DNA, 25 bp, E. coli
gaagacagaggaatgtcaggaagac

SEQ ID NO: 65703 - DNA, 25 bp, E. coli
gactcaggatgagggtcaggagcgc

SEQ ID NO: 65704 - DNA, 25 bp, E. coli
gacagaggattgtcaggaagacaaa

SEQ ID NO: 65705 - DNA, 25 bp, E. coli
gactcaggatgacggtcaggagcgc

SEQ ID NO: 65706 - DNA, 25 bp, E. coli
gacagaggattgacaggaagacaaa

SEQ ID NO: 65707 - DNA, 25 bp, E. coli
cgccaggaggcgtagacagaggatt

SEQ ID NO: 65708 - DNA, 25 bp, E. coli
cgccaggaggcgaagacagaggatt

SEQ ID NO: 65709 - DNA, 25 bp, E. coli
gattgtcaggaacacaaacgtccgg

SEQ ID NO: 65710 - DNA, 25 bp, E. coli
gattgtcaggaagacaaacgtccgg

SEQ ID NO: 65711 - DNA, 25 bp, E. coli
catccggcgattcatttattaggta

SEQ ID NO: 65712 - DNA, 25 bp, E. coli
catccggcgattgatttattaggta

SEQ ID NO: 65713 - DNA, 25 bp, E. coli
tggtactggcaagttcaccccatct

SEQ ID NO: 65714 - DNA, 25 bp, E. coli
tggtccgttgtcaaacatcgcggtg

SEQ ID NO: 65715 - DNA, 25 bp, E. coli
tgaaattgttctgatgggcggtgct

SEQ ID NO: 65716 - DNA, 25 bp, E. coli
tgatttattaggtatcaccattgta

SEQ ID NO: 65717 - DNA, 25 bp, E. coli
tgatttattaggaatcaccattgta

SEQ ID NO: 65718 - DNA, 25 bp, E. coli
tgtagcgggtaaacaaaccctcgat

SEQ ID NO: 65719 - DNA, 25 bp, E. coli
tggtactggcaacttcaccccatct

SEQ ID NO: 65720 - DNA, 25 bp, E. coli
tggtccgttgtctaacatcgcggtg

SEQ ID NO: 65721 - DNA, 25 bp, E. coli
tgtagcgggtaatcaaaccctcgat

SEQ ID NO: 65722 - DNA, 25 bp, E. coli
tgcttatggtacaggcaacttcacc

SEQ ID NO: 65723 - DNA, 25 bp, E. coli
tgaaattgttctcatgggcggtgct

SEQ ID NO: 65724 - DNA, 25 bp, E. coli
tgcttatggtactggcaacttcacc

SEQ ID NO: 65725 - DNA, 25 bp, E. coli
tctgatgggcggagcttatggtact

SEQ ID NO: 65726 - DNA, 25 bp, E. coli
tctgatgggcggtgcttatggtact

SEQ ID NO: 65727 - DNA, 25 bp, E. coli
gttgtcaaacatggcggtggcaatg

SEQ ID NO: 65728 - DNA, 25 bp, E. coli
gttgtcaaacatcgcggtggcaatg

SEQ ID NO: 65729 - DNA, 25 bp, E. coli
gtgccggttggtccgttgtcaaaca

SEQ ID NO: 65730 - DNA, 25 bp, E. coli
ggtaatcaaaccctcgataaaacat

SEQ ID NO: 65731 - DNA, 25 bp, E. coli
gtgccggttggtgcgttgtcaaaca

SEQ ID NO: 65732 - DNA, 25 bp, E. coli
ggtaatcaaaccgtcgataaaacat

SEQ ID NO: 65733 - DNA, 25 bp, E. coli
caattatgttatgtgcgattccctc

SEQ ID NO: 65734 - DNA, 25 bp, E. coli
caattatgttatctgcgattccctc

SEQ ID NO: 65735 - DNA, 25 bp, E. coli
caacgtggcatgcatattattcaca

SEQ ID NO: 65736 - DNA, 25 bp, E. coli
caacgtggcatggatattattcaca

SEQ ID NO: 65737 - DNA, 25 bp, E. coli
taaaatgtcgctgtcagcacactaa

SEQ ID NO: 65738 - DNA, 25 bp, E. coli
taaaatgtcgctctcagcacactaa

SEQ ID NO: 65739 - DNA, 25 bp, E. coli
aacctggctttgtgttttattctgg

SEQ ID NO: 65740 - DNA, 25 bp, E. coli
aacctggctttgagttttattctgg

SEQ ID NO: 65741 - DNA, 25 bp, E. coli
tattctacccatccaagcttgagcg

SEQ ID NO: 65742 - DNA, 25 bp, E. coli
tattatctctgctgcaattgaaggg

SEQ ID NO: 65743 - DNA, 25 bp, E. coli
tattatctctgcagcaattgaaggg

SEQ ID NO: 65744 - DNA, 25 bp, E. coli
tattctacccatgcaagcttgagcg

SEQ ID NO: 65745 - DNA, 25 bp, E. coli
gcgtttatcacgctttcagttcata

SEQ ID NO: 65746 - DNA, 25 bp, E. coli
gcgtttatcacggtttcagttcata

SEQ ID NO: 65747 - DNA, 25 bp, E. coli
gattccctctgctaaaatgtcgctg

SEQ ID NO: 65748 - DNA, 25 bp, E. coli
gatactggatgtaaggcaatctact

SEQ ID NO: 65749 - DNA, 25 bp, E. coli
gatactggatgttaggcaatctact

SEQ ID NO: 65750 - DNA, 25 bp, E. coli
gattccctctgcaaaaatgtcgctg

SEQ ID NO: 65751 - DNA, 25 bp, E. coli
taagcgtccaacacaacgtggcatg

SEQ ID NO: 65752 - DNA, 25 bp, E. coli
taagcgtccaactcaacgtggcatg

SEQ ID NO: 65753 - DNA, 25 bp, E. coli
gagatgtgagtcattaagcgtccaa

SEQ ID NO: 65754 - DNA, 25 bp, E. coli
gagatgtgagtctttaagcgtccaa

SEQ ID NO: 65755 - DNA, 25 bp, E. coli
cagagtacatcacggactggcaaca

SEQ ID NO: 65756 - DNA, 25 bp, E. coli
cagagtacatcagggactggcaaca

SEQ ID NO: 65757 - DNA, 25 bp, E. coli
agggactggcaacaaccgcgccacg

SEQ ID NO: 65758 - DNA, 25 bp, E. coli
agcgccgccaggtaatggctgatgc

SEQ ID NO: 65759 - DNA, 25 bp, E. coli
agcgccgccaggaaatggctgatgc

SEQ ID NO: 65760 - DNA, 25 bp, E. coli
agggactggcaagaaccgcgccacg

SEQ ID NO: 65761 - DNA, 25 bp, E. coli
taccgggtagagaacgagcgccgcc

SEQ ID NO: 65762 - DNA, 25 bp, E. coli
taccgggtagagtacgagcgccgcc

SEQ ID NO: 65763 - DNA, 25 bp, E. coli
tttcctcctggctggatgcctaccg

SEQ ID NO: 65764 - DNA, 25 bp, E. coli
tttcctcctggcaggatgcctaccg

SEQ ID NO: 65765 - DNA, 25 bp, E. coli
tgaatccgcgctttcctcctggctg

SEQ ID NO: 65766 - DNA, 25 bp, E. coli
tgacggcagagtacatcagggactg

SEQ ID NO: 65767 - DNA, 25 bp, E. coli
tgaatccgcgctatcctcctggctg

SEQ ID NO: 65768 - DNA, 25 bp, E. coli
tgacggcagagttcatcagggactg

SEQ ID NO: 65769 - DNA, 25 bp, E. coli
tcctggctggatccctaccgggtag

SEQ ID NO: 65770 - DNA, 25 bp, E. coli
tcctggctggatgcctaccgggtag

SEQ ID NO: 65771 - DNA, 25 bp, E. coli
tgcctaccgggtagagaacgagcgc

SEQ ID NO: 65772 - DNA, 25 bp, E. coli
tgcctaccgggttgagaacgagcgc

SEQ ID NO: 65773 - DNA, 25 bp, E. coli
cgagcgccgccacgaaatggctgat

SEQ ID NO: 65774 - DNA, 25 bp, E. coli
cgagcgccgccaggaaatggctgat

SEQ ID NO: 65775 - DNA, 25 bp, E. coli
gtacatcagggactggcaacaaccg

SEQ ID NO: 65776 - DNA, 25 bp, E. coli
gtacatcagggagtggcaacaaccg

SEQ ID NO: 65777 - DNA, 25 bp, E. coli
cacgtttaatgatggcgaggttgat

SEQ ID NO: 65778 - DNA, 25 bp, E. coli
cactgaacaggtttgtgaggctctg

SEQ ID NO: 65779 - DNA, 25 bp, E. coli
cacgtttaatgaaggcgaggttgat

SEQ ID NO: 65780 - DNA, 25 bp, E. coli
cactgaacaggtatgtgaggctctg

SEQ ID NO: 65781 - DNA, 25 bp, E. coli
catgatcgccgggttaaacaaagaa

SEQ ID NO: 65782 - DNA, 25 bp, E. coli
catgatcgccggcttaaacaaagaa

SEQ ID NO: 65783 - DNA, 25 bp, E. coli
aaattcacggcgctgattccggcaa

SEQ ID NO: 65784 - DNA, 25 bp, E. coli
aaagcattacgttcatgatcgccgg

SEQ ID NO: 65785 - DNA, 25 bp, E. coli
aaattcacggcggtgattccggcaa

SEQ ID NO: 65786 - DNA, 25 bp, E. coli
aaagcattacgtacatgatcgccgg

SEQ ID NO: 65787 - DNA, 25 bp, E. coli
ttatggaggctaaccggatcagcga

SEQ ID NO: 65788 - DNA, 25 bp, E. coli
ttatggaggctatccggatcagcga

SEQ ID NO: 65789 - DNA, 25 bp, E. coli
tgtggaacgtgacactgacgagctt

SEQ ID NO: 65790 - DNA, 25 bp, E. coli
tgtggaacgtgagactgacgagctt

SEQ ID NO: 65791 - DNA, 25 bp, E. coli
tgaggctctggaaacctgggtatgc

SEQ ID NO: 65792 - DNA, 25 bp, E. coli
tgaggctctggatacctgggtatgc

SEQ ID NO: 65793 - DNA, 25 bp, E. coli
tgctttcaagcacgcgtatcgtcag

SEQ ID NO: 65794 - DNA, 25 bp, E. coli
tgctttcaagcaggcgtatcgtcag

SEQ ID NO: 65795 - DNA, 25 bp, E. coli
gaacatcgatgtacaacgcgtcacg

SEQ ID NO: 65796 - DNA, 25 bp, E. coli
gaacatcgatgttcaacgcgtcacg

SEQ ID NO: 65797 - DNA, 25 bp, E. coli
taaccgggtgaacatattcgaacgc

SEQ ID NO: 65798 - DNA, 25 bp, E. coli
taaccgggtgaagatattcgaacgc

SEQ ID NO: 65799 - DNA, 25 bp, E. coli
aactccgtttgcttgtaactagcgc

SEQ ID NO: 65800 - DNA, 25 bp, E. coli
aaagtggcgaccatttggacatccg

SEQ ID NO: 65801 - DNA, 25 bp, E. coli
aactccgtttgcatgtaactagcgc

SEQ ID NO: 65802 - DNA, 25 bp, E. coli
aaagtggcgaccttttggacatccg

SEQ ID NO: 65803 - DNA, 25 bp, E. coli
ttattgagaaataagcagcttcctc

SEQ ID NO: 65804 - DNA, 25 bp, E. coli
ttattgagaaattagcagcttcctc

SEQ ID NO: 65805 - DNA, 25 bp, E. coli
tgcatgtaactaccgcttatcccat

SEQ ID NO: 65806 - DNA, 25 bp, E. coli
tgcatgtaactagcgcttatcccat

SEQ ID NO: 65807 - DNA, 25 bp, E. coli
tgcgttcagggcattcagggaaaag

SEQ ID NO: 65808 - DNA, 25 bp, E. coli
tgcgttcagggctttcagggaaaag

SEQ ID NO: 65809 - DNA, 25 bp, E. coli
gcgcttatcccaattctgaaaaaca

SEQ ID NO: 65810 - DNA, 25 bp, E. coli
ccttttggacatccggatggtgata

SEQ ID NO: 65811 - DNA, 25 bp, E. coli
ccttttggacatgcggatggtgata

SEQ ID NO: 65812 - DNA, 25 bp, E. coli
gcgcttatcccatttctgaaaaaca

SEQ ID NO: 65813 - DNA, 25 bp, E. coli
gacatccggatggtgatattcgtga

SEQ ID NO: 65814 - DNA, 25 bp, E. coli
gaaaagaaaaaagtccgtttgcatg

SEQ ID NO: 65815 - DNA, 25 bp, E. coli
gacatccggatgctgatattcgtga

SEQ ID NO: 65816 - DNA, 25 bp, E. coli
gaaaagaaaaaactccgtttgcatg

SEQ ID NO: 65817 - DNA, 25 bp, E. coli
gaaaaacagaaaggtaaatcagtga

SEQ ID NO: 65818 - DNA, 25 bp, E. coli
gaaaaacagaaacgtaaatcagtga

SEQ ID NO: 65819 - DNA, 25 bp, E. coli
taagcagcttccacagccctcaaaa

SEQ ID NO: 65820 - DNA, 25 bp, E. coli
taagcagcttcctcagccctcaaaa

SEQ ID NO: 65821 - DNA, 25 bp, E. coli
cacgtacttgcataacggcgtcagt

SEQ ID NO: 65822 - DNA, 25 bp, E. coli
cacgtacttgcaaaacggcgtcagt

SEQ ID NO: 65823 - DNA, 25 bp, E. coli
atgaagaaggccgtagcgactggac

SEQ ID NO: 65824 - DNA, 25 bp, E. coli
atgaagaaggccctagcgactggac

SEQ ID NO: 65825 - DNA, 25 bp, E. coli
tctggcaaaagaagcctctggcggt

SEQ ID NO: 65826 - DNA, 25 bp, E. coli
tctggcaaaagatgcctctggcggt

SEQ ID NO: 65827 - DNA, 25 bp, E. coli
cctctggcggtgtctatctggtgga

SEQ ID NO: 65828 - DNA, 25 bp, E. coli
cctctggcggtgactatctggtgga

SEQ ID NO: 65829 - DNA, 25 bp, E. coli
gaagcggcacaacacggctatctgg

SEQ ID NO: 65830 - DNA, 25 bp, E. coli
gaagttaccgttaatgcgcccatcg

SEQ ID NO: 65831 - DNA, 25 bp, E. coli
gaagttaccgtttatgcgcccatcg

SEQ ID NO: 65832 - DNA, 25 bp, E. coli
gaagcggcacaagacggctatctgg

SEQ ID NO: 65833 - DNA, 25 bp, E. coli
cattaagcagtggaatcaggagggc

SEQ ID NO: 65834 - DNA, 25 bp, E. coli
cattctggtcgctccggtgcatgaa

SEQ ID NO: 65835 - DNA, 25 bp, E. coli
cattaagcagtgcaatcaggagggc

SEQ ID NO: 65836 - DNA, 25 bp, E. coli
cattctggtcgcaccggtgcatgaa

SEQ ID NO: 65837 - DNA, 25 bp, E. coli
gatacgccacgtgcacagttattag

SEQ ID NO: 65838 - DNA, 25 bp, E. coli
gatacgccacgtccacagttattag

SEQ ID NO: 65839 - DNA, 25 bp, E. coli
ggcactgttcgcctcgttaaaaagc

SEQ ID NO: 65840 - DNA, 25 bp, E. coli
ggcactgttcgcgtcgttaaaaagc

SEQ ID NO: 65841 - DNA, 25 bp, E. coli
gatgcgcacacttacaccctgaaat

SEQ ID NO: 65842 - DNA, 25 bp, E. coli
gatgcgcacactaacaccctgaaat

SEQ ID NO: 65843 - DNA, 25 bp, E. coli
cataaccggtattgtcgcgtttctg

SEQ ID NO: 65844 - DNA, 25 bp, E. coli
catgcgcggcatgaacatacttctc

SEQ ID NO: 65845 - DNA, 25 bp, E. coli
catgcgcggcatcaacatacttctc

SEQ ID NO: 65846 - DNA, 25 bp, E. coli
cataaccggtatagtcgcgtttctg

SEQ ID NO: 65847 - DNA, 25 bp, E. coli
agctgctgctttgatttgttccggg

SEQ ID NO: 65848 - DNA, 25 bp, E. coli
agctgctgctttcatttgttccggg

SEQ ID NO: 65849 - DNA, 25 bp, E. coli
aaactggtgttaccttcgctggcgc

SEQ ID NO: 65850 - DNA, 25 bp, E. coli
aacaggcattctctccggtatctgg

SEQ ID NO: 65851 - DNA, 25 bp, E. coli
aacaggcattctgtccggtatctgg

SEQ ID NO: 65852 - DNA, 25 bp, E. coli
aaactggtgttagcttcgctggcgc

SEQ ID NO: 65853 - DNA, 25 bp, E. coli
ttataggcgcatgcgcgacgtttgc

SEQ ID NO: 65854 - DNA, 25 bp, E. coli
ttataggcgcatccgcgacgtttgc

SEQ ID NO: 65855 - DNA, 25 bp, E. coli
tgcctgcccgcatggtgggctgaaa

SEQ ID NO: 65856 - DNA, 25 bp, E. coli
tgcctgcccgcaaggtgggctgaaa

SEQ ID NO: 65857 - DNA, 25 bp, E. coli
gcttactaagctgggcgggcttcct

SEQ ID NO: 65858 - DNA, 25 bp, E. coli
gcttactaagctcggcgggcttcct

SEQ ID NO: 65859 - DNA, 25 bp, E. coli
gtgtattcaggcgaaacagctgctg

SEQ ID NO: 65860 - DNA, 25 bp, E. coli
gtgtattcaggccaaacagctgctg

SEQ ID NO: 65861 - DNA, 25 bp, E. coli
ggcttcctgggctgtacggcctact

SEQ ID NO: 65862 - DNA, 25 bp, E. coli
tggccgcgttttgtgctatcatgcg

SEQ ID NO: 65863 - DNA, 25 bp, E. coli
tggccgcgttttctgctatcatgcg

SEQ ID NO: 65864 - DNA, 25 bp, E. coli
ggcttcctgggcagtacggcctact

SEQ ID NO: 65865 - DNA, 25 bp, E. coli
atgcacacgggctgcacgacgctgc

SEQ ID NO: 65866 - DNA, 25 bp, E. coli
atgcacacgggcagcacgacgctgc

SEQ ID NO: 65867 - DNA, 25 bp, E. coli
tttcacgccgcccatttttgcaggc

SEQ ID NO: 65868 - DNA, 25 bp, E. coli
ttgcaggctactgccgcgacgatag

SEQ ID NO: 65869 - DNA, 25 bp, E. coli
ttgcaggctactcccgcgacgatag

SEQ ID NO: 65870 - DNA, 25 bp, E. coli
tttcacgccgccgatttttgcaggc

SEQ ID NO: 65871 - DNA, 25 bp, E. coli
ttttgcagggatgagcgatgatttc

SEQ ID NO: 65872 - DNA, 25 bp, E. coli
ttttgcagggatcagcgatgatttc

SEQ ID NO: 65873 - DNA, 25 bp, E. coli
gcgacgatagcctcgagctcaggtt

SEQ ID NO: 65874 - DNA, 25 bp, E. coli
gcgacgatagccacgagctcaggtt

SEQ ID NO: 65875 - DNA, 25 bp, E. coli
gcagcacgacgcagcccgatttttt

SEQ ID NO: 65876 - DNA, 25 bp, E. coli
gcagcacgacgctgcccgatttttt

SEQ ID NO: 65877 - DNA, 25 bp, E. coli
cgagctcaggttacggttatatgca

SEQ ID NO: 65878 - DNA, 25 bp, E. coli
cgagctcaggtttcggttatatgca

SEQ ID NO: 65879 - DNA, 25 bp, E. coli
ggtttcggttatatgcattactgtg

SEQ ID NO: 65880 - DNA, 25 bp, E. coli
gatagccacgagctcaggtttcggt

SEQ ID NO: 65881 - DNA, 25 bp, E. coli
gatagccacgaggtcaggtttcggt

SEQ ID NO: 65882 - DNA, 25 bp, E. coli
gatttttgcaggctactgccgcgac

SEQ ID NO: 65883 - DNA, 25 bp, E. coli
gatttttgcagggtactgccgcgac

SEQ ID NO: 65884 - DNA, 25 bp, E. coli
ggtttcggttatttgcattactgtg

SEQ ID NO: 65885 - DNA, 25 bp, E. coli
gatgagcgatgaattcacgccgccg

SEQ ID NO: 65886 - DNA, 25 bp, E. coli
gatgagcgatgatttcacgccgccg

SEQ ID NO: 65887 - DNA, 25 bp, E. coli
caaacatagcacgtggatgggcctc

SEQ ID NO: 65888 - DNA, 25 bp, E. coli
caaacatagcacctggatgggcctc

SEQ ID NO: 65889 - DNA, 25 bp, E. coli
caacatgggtcactataacggaagc

SEQ ID NO: 65890 - DNA, 25 bp, E. coli
caacatgggtcagtataacggaagc

SEQ ID NO: 65891 - DNA, 25 bp, E. coli
aactatgcatgcatgacagggacgg

SEQ ID NO: 65892 - DNA, 25 bp, E. coli
aaattcaggcagtttgtgggagacc

SEQ ID NO: 65893 - DNA, 25 bp, E. coli
aactatgcatgcttgacagggacgg

SEQ ID NO: 65894 - DNA, 25 bp, E. coli
aaattcaggcagattgtgggagacc

SEQ ID NO: 65895 - DNA, 25 bp, E. coli
tttgttcgtaatctccgcccgggtg

SEQ ID NO: 65896 - DNA, 25 bp, E. coli
tttgttcgtaatgtccgcccgggtg

SEQ ID NO: 65897 - DNA, 25 bp, E. coli
tatttatcgtcaagccttgagtggc

SEQ ID NO: 65898 - DNA, 25 bp, E. coli
tatttatcgtcatgccttgagtggc

SEQ ID NO: 65899 - DNA, 25 bp, E. coli
gcctgaagaactgccgtgacggcaa

SEQ ID NO: 65900 - DNA, 25 bp, E. coli
gcctgaagaactcccgtgacggcaa

SEQ ID NO: 65901 - DNA, 25 bp, E. coli
gctaattggatctctgctcgccgaa

SEQ ID NO: 65902 - DNA, 25 bp, E. coli
gctaattggatcactgctcgccgaa

SEQ ID NO: 65903 - DNA, 25 bp, E. coli
taacggaagcagttgagatcactac

SEQ ID NO: 65904 - DNA, 25 bp, E. coli
taacggaagcagatgagatcactac

SEQ ID NO: 65905 - DNA, 25 bp, E. coli
gagtggcaacatgctactatcggtc

SEQ ID NO: 65906 - DNA, 25 bp, E. coli
gggagacctacttgataaactatgc

SEQ ID NO: 65907 - DNA, 25 bp, E. coli
gggagacctactagataaactatgc

SEQ ID NO: 65908 - DNA, 25 bp, E. coli
gagtggcaacatcctactatcggtc

SEQ ID NO: 65909 - DNA, 25 bp, E. coli
caaactcgagttctaccatcagggt

SEQ ID NO: 65910 - DNA, 25 bp, E. coli
caaactcgagttgtaccatcagggt

SEQ ID NO: 65911 - DNA, 25 bp, E. coli
catgggtgcaacaaacgcgtcgttc

SEQ ID NO: 65912 - DNA, 25 bp, E. coli
catgggtgcaactaacgcgtcgttc

SEQ ID NO: 65913 - DNA, 25 bp, E. coli
taccgccttgccttcgggtgaagaa

SEQ ID NO: 65914 - DNA, 25 bp, E. coli
taccgccttgccatcgggtgaagaa

SEQ ID NO: 65915 - DNA, 25 bp, E. coli
ccggagccgggtaaagagatgaact

SEQ ID NO: 65916 - DNA, 25 bp, E. coli
ccggagccgggttaagagatgaact

SEQ ID NO: 65917 - DNA, 25 bp, E. coli
gacaaagcgtacaggaacaatctga

SEQ ID NO: 65918 - DNA, 25 bp, E. coli
gaaaaaactgcctgaggataccccg

SEQ ID NO: 65919 - DNA, 25 bp, E. coli
gacaaagcgtactggaacaatctga

SEQ ID NO: 65920 - DNA, 25 bp, E. coli
gaaaaaactgccagaggataccccg

SEQ ID NO: 65921 - DNA, 25 bp, E. coli
ccagtatgttcctgtttgggccgaa

SEQ ID NO: 65922 - DNA, 25 bp, E. coli
ccagtatgttccagtttgggccgaa

SEQ ID NO: 65923 - DNA, 25 bp, E. coli
gatctggcgtcccttgaataacccg

SEQ ID NO: 65924 - DNA, 25 bp, E. coli
gatctggcgtccgttgaataacccg

SEQ ID NO: 65925 - DNA, 25 bp, E. coli
gtccaagcgcatcggtgactccgaa

SEQ ID NO: 65926 - DNA, 25 bp, E. coli
gtccaagcgcatgggtgactccgaa

SEQ ID NO: 65927 - DNA, 25 bp, E. coli
tcaaagagttctcgatcgagcgtcc

SEQ ID NO: 65928 - DNA, 25 bp, E. coli
tcaaagagttctggatcgagcgtcc

SEQ ID NO: 65929 - DNA, 25 bp, E. coli
gatgaagacaaagtgcatgcgccag

SEQ ID NO: 65930 - DNA, 25 bp, E. coli
gatgaagacaaactgcatgcgccag

SEQ ID NO: 65931 - DNA, 25 bp, E. coli
aacgccgggcaagggctgaagcaat

SEQ ID NO: 65932 - DNA, 25 bp, E. coli
aacgccgggcaacggctgaagcaat

SEQ ID NO: 65933 - DNA, 25 bp, E. coli
taaaccacgtcgaagcagcagaact

SEQ ID NO: 65934 - DNA, 25 bp, E. coli
taaaccacgtcgtagcagcagaact

SEQ ID NO: 65935 - DNA, 25 bp, E. coli
agaactgctgcgagtgactgctgaa

SEQ ID NO: 65936 - DNA, 25 bp, E. coli
agaactgctgcgtgtgactgctgaa

SEQ ID NO: 65937 - DNA, 25 bp, E. coli
agaacgaagcgctggagatccactg

SEQ ID NO: 65938 - DNA, 25 bp, E. coli
agaacgaagcgcaggagatccactg

SEQ ID NO: 65939 - DNA, 25 bp, E. coli
tagcctggcgtgacatatcacatcc

SEQ ID NO: 65940 - DNA, 25 bp, E. coli
tagcctggcgtgtcatatcacatcc

SEQ ID NO: 65941 - DNA, 25 bp, E. coli
tattttactgacagaggctcgtctg

SEQ ID NO: 65942 - DNA, 25 bp, E. coli
tattttactgactgaggctcgtctg

SEQ ID NO: 65943 - DNA, 25 bp, E. coli
tgctgaagcaatgcagaacgaagcg

SEQ ID NO: 65944 - DNA, 25 bp, E. coli
tgctgaagcaatccagaacgaagcg

SEQ ID NO: 65945 - DNA, 25 bp, E. coli
ccggaccggatgttgcagggcttaa

SEQ ID NO: 65946 - DNA, 25 bp, E. coli
ccggaccggatgatgcagggcttaa

SEQ ID NO: 65947 - DNA, 25 bp, E. coli
gcgtaatattgataccctcacgact

SEQ ID NO: 65948 - DNA, 25 bp, E. coli
gcgtaatattgaaaccctcacgact

SEQ ID NO: 65949 - DNA, 25 bp, E. coli
gaagcaatggcacctcgccttgata

SEQ ID NO: 65950 - DNA, 25 bp, E. coli
gaagcaatggcagctcgccttgata

SEQ ID NO: 65951 - DNA, 25 bp, E. coli
ctcacgactaaaaccggaccggatg

SEQ ID NO: 65952 - DNA, 25 bp, E. coli
ctcacgactaaatccggaccggatg

SEQ ID NO: 65953 - DNA, 25 bp, E. coli
caatgtggatcctgttgcacagcca

SEQ ID NO: 65954 - DNA, 25 bp, E. coli
caatgtggatccagttgcacagcca

SEQ ID NO: 65955 - DNA, 25 bp, E. coli
caaagagtggttgggcgatcacaaa

SEQ ID NO: 65956 - DNA, 25 bp, E. coli
caaagagtggttcggcgatcacaaa

SEQ ID NO: 65957 - DNA, 25 bp, E. coli
caggctacccgcgaagatatcgtca

SEQ ID NO: 65958 - DNA, 25 bp, E. coli
cagaaatgcttgatgtcacgcggac

SEQ ID NO: 65959 - DNA, 25 bp, E. coli
cagaaatgcttgttgtcacgcggac

SEQ ID NO: 65960 - DNA, 25 bp, E. coli
caggctacccgccaagatatcgtca

SEQ ID NO: 65961 - DNA, 25 bp, E. coli
tgacagcctgtatcgcaaagagtgg

SEQ ID NO: 65962 - DNA, 25 bp, E. coli
tgcaactggaagagcgtgaactggc

SEQ ID NO: 65963 - DNA, 25 bp, E. coli
tgcaactggaagtgcgtgaactggc

SEQ ID NO: 65964 - DNA, 25 bp, E. coli
tgaaatctgccacctctgcgcaaag

SEQ ID NO: 65965 - DNA, 25 bp, E. coli
tgaaatctgccagctctgcgcaaag

SEQ ID NO: 65966 - DNA, 25 bp, E. coli
tgacagcctgtaacgcaaagagtgg

SEQ ID NO: 65967 - DNA, 25 bp, E. coli
tcagtcctggcagtggcgggaaaac

SEQ ID NO: 65968 - DNA, 25 bp, E. coli
tcatgctggagaacaaagggctggt

SEQ ID NO: 65969 - DNA, 25 bp, E. coli
tcagtcctggcactggcgggaaaac

SEQ ID NO: 65970 - DNA, 25 bp, E. coli
tcatgctggagatcaaagggctggt

SEQ ID NO: 65971 - DNA, 25 bp, E. coli
cgaaagcggtgagatgcagttccat

SEQ ID NO: 65972 - DNA, 25 bp, E. coli
cgaaagcggtgacatgcagttccat

SEQ ID NO: 65973 - DNA, 25 bp, E. coli
taatcaaaaaagatgcccgagcggc

SEQ ID NO: 65974 - DNA, 25 bp, E. coli
taatcaaaaaagttgcccgagcggc

SEQ ID NO: 65975 - DNA, 25 bp, E. coli
aatcctgttgttactgccgaaactg

SEQ ID NO: 65976 - DNA, 25 bp, E. coli
aatcctgttgtttctgccgaaactg

SEQ ID NO: 65977 - DNA, 25 bp, E. coli
cagcttaaagggtcgcaaattggtg

SEQ ID NO: 65978 - DNA, 25 bp, E. coli
cagcttaaagggacgcaaattggtg

SEQ ID NO: 65979 - DNA, 25 bp, E. coli
caggcgctggttgtcataaatgagc

SEQ ID NO: 65980 - DNA, 25 bp, E. coli
caggcgctggttctcataaatgagc

SEQ ID NO: 65981 - DNA, 25 bp, E. coli
taaatgagcacgttgcaaaaagcga

SEQ ID NO: 65982 - DNA, 25 bp, E. coli
taaatgagcacgatgcaaaaagcga

SEQ ID NO: 65983 - DNA, 25 bp, E. coli
ttctgccgaaactgctaacgcgttg

SEQ ID NO: 65984 - DNA, 25 bp, E. coli
ttaactcgcctgcatccttcaacgg

SEQ ID NO: 65985 - DNA, 25 bp, E. coli
ttaactcgcctggatccttcaacgg

SEQ ID NO: 65986 - DNA, 25 bp, E. coli
ttctgccgaaacagctaacgcgttg

SEQ ID NO: 65987 - DNA, 25 bp, E. coli
tgatcagtgccagcttaaagggacg

SEQ ID NO: 65988 - DNA, 25 bp, E. coli
tgatcagtgccaccttaaagggacg

SEQ ID NO: 65989 - DNA, 25 bp, E. coli
tccaaaagtgaacggtaatgcgggt

SEQ ID NO: 65990 - DNA, 25 bp, E. coli
tccaaaagtgaagggtaatgcgggt

SEQ ID NO: 65991 - DNA, 25 bp, E. coli
cctggatccttcaacggtaacgcca

SEQ ID NO: 65992 - DNA, 25 bp, E. coli
cctggatccttctacggtaacgcca

SEQ ID NO: 65993 - DNA, 25 bp, E. coli
ggtacaccgtcatcaggcgctggtt

SEQ ID NO: 65994 - DNA, 25 bp, E. coli
ggtacaccgtcaacaggcgctggtt

SEQ ID NO: 65995 - DNA, 25 bp, E. coli
taacgcgttgttcgcacaatttcca

SEQ ID NO: 65996 - DNA, 25 bp, E. coli
taacgcgttgttggcacaatttcca

SEQ ID NO: 65997 - DNA, 25 bp, E. coli
caaataattgcttcggtcaggtctc

SEQ ID NO: 65998 - DNA, 25 bp, E. coli
caaataattgctacggtcaggtctc

SEQ ID NO: 65999 - DNA, 25 bp, E. coli
tgcgaccgggtttatgccatcgaac

SEQ ID NO: 66000 - DNA, 25 bp, E. coli
tgcgaccgggttaatgccatcgaac

SEQ ID NO: 66001 - DNA, 25 bp, E. coli
tgccatcgaacgagacaaggcgctg

SEQ ID NO: 66002 - DNA, 25 bp, E. coli
tgccatcgaacgtgacaaggcgctg

SEQ ID NO: 66003 - DNA, 25 bp, E. coli
ccatcgaacgtgtcaaggcgctggc

SEQ ID NO: 66004 - DNA, 25 bp, E. coli
ccatcgaacgtgacaaggcgctggc

SEQ ID NO: 66005 - DNA, 25 bp, E. coli
cgggttaatgccatcgaacgtgaca

SEQ ID NO: 66006 - DNA, 25 bp, E. coli
cgtatccgttcatataattgctacg

SEQ ID NO: 66007 - DNA, 25 bp, E. coli
cgtatccgttcaaataattgctacg

SEQ ID NO: 66008 - DNA, 25 bp, E. coli
cgggttaatgccttcgaacgtgaca

SEQ ID NO: 66009 - DNA, 25 bp, E. coli
ggttaatgccatcgaacgtgacaag

SEQ ID NO: 66010 - DNA, 25 bp, E. coli
ggttaatgccatggaacgtgacaag

SEQ ID NO: 66011 - DNA, 25 bp, E. coli
ggcgtgctgggacatcgacagatag

SEQ ID NO: 66012 - DNA, 25 bp, E. coli
ggcgtgctgggagatcgacagatag

SEQ ID NO: 66013 - DNA, 25 bp, E. coli
taatgccatcgaacgtgacaaggcg

SEQ ID NO: 66014 - DNA, 25 bp, E. coli
taattgctacggtcaggtctcacgg

SEQ ID NO: 66015 - DNA, 25 bp, E. coli
taattgctacggacaggtctcacgg

SEQ ID NO: 66016 - DNA, 25 bp, E. coli
taatgccatcgatcgtgacaaggcg

SEQ ID NO: 66017 - DNA, 25 bp, E. coli
gaccgggttaatcccatcgaacgtg

SEQ ID NO: 66018 - DNA, 25 bp, E. coli
gaccgggttaatgccatcgaacgtg

SEQ ID NO: 66019 - DNA, 25 bp, E. coli
aaggcatcccggcatcggcaaagaa

SEQ ID NO: 66020 - DNA, 25 bp, E. coli
aaggcatcccgggatcggcaaagaa

SEQ ID NO: 66021 - DNA, 25 bp, E. coli
caaacatcagaatggaaggcatccc

SEQ ID NO: 66022 - DNA, 25 bp, E. coli
caaacatcagaaaggaaggcatccc

SEQ ID NO: 66023 - DNA, 25 bp, E. coli
catcagaatggaaggcatcccggga

SEQ ID NO: 66024 - DNA, 25 bp, E. coli
catcagaatggatggcatcccggga

SEQ ID NO: 66025 - DNA, 25 bp, E. coli
atcggcaaagaagcagcaatggcgc

SEQ ID NO: 66026 - DNA, 25 bp, E. coli
atcggcaaagaaccagcaatggcgc

SEQ ID NO: 66027 - DNA, 25 bp, E. coli
aacatcagaatggaaggcatcccgg

SEQ ID NO: 66028 - DNA, 25 bp, E. coli
aacatcagaatgcaaggcatcccgg

SEQ ID NO: 66029 - DNA, 25 bp, E. coli
ccgggatcggcatagaagcagcaat

SEQ ID NO: 66030 - DNA, 25 bp, E. coli
ccgggatcggcaaagaagcagcaat

SEQ ID NO: 66031 - DNA, 25 bp, E. coli
gcatcccgggatgggcaaagaagca

SEQ ID NO: 66032 - DNA, 25 bp, E. coli
gaagtcaaacatcagaatggaaggc

SEQ ID NO: 66033 - DNA, 25 bp, E. coli
gaagtcaaacatgagaatggaaggc

SEQ ID NO: 66034 - DNA, 25 bp, E. coli
gcatcccgggatcggcaaagaagca

SEQ ID NO: 66035 - DNA, 25 bp, E. coli
gtgggcgaagtctaacatcagaatg

SEQ ID NO: 66036 - DNA, 25 bp, E. coli
gtgggcgaagtcaaacatcagaatg

SEQ ID NO: 66037 - DNA, 25 bp, E. coli
ggatcggcaaagaagcagcaatggc

SEQ ID NO: 66038 - DNA, 25 bp, E. coli
gggcgaagtcaatcatcagaatgga

SEQ ID NO: 66039 - DNA, 25 bp, E. coli
ggatcggcaaagtagcagcaatggc

SEQ ID NO: 66040 - DNA, 25 bp, E. coli
gggcgaagtcaaacatcagaatgga

SEQ ID NO: 66041 - DNA, 25 bp, E. coli
aattgccgcttccagttccgcaggg

SEQ ID NO: 66042 - DNA, 25 bp, E. coli
aattgccgcttcgagttccgcaggg

SEQ ID NO: 66043 - DNA, 25 bp, E. coli
cactgccgggattgcctcgtttgaa

SEQ ID NO: 66044 - DNA, 25 bp, E. coli
cactgccgggatagcctcgtttgaa

SEQ ID NO: 66045 - DNA, 25 bp, E. coli
ttaccggtacggagcccattctggc

SEQ ID NO: 66046 - DNA, 25 bp, E. coli
ttaccggtacggtgcccattctggc

SEQ ID NO: 66047 - DNA, 25 bp, E. coli
tccgggccgctcatgacgatgatta

SEQ ID NO: 66048 - DNA, 25 bp, E. coli
tccgggccgctcttgacgatgatta

SEQ ID NO: 66049 - DNA, 25 bp, E. coli
gcgacacctgtgctgattgcagaaa

SEQ ID NO: 66050 - DNA, 25 bp, E. coli
gcgacacctgtggtgattgcagaaa

SEQ ID NO: 66051 - DNA, 25 bp, E. coli
gcagtacggcacaaaagaagaagct

SEQ ID NO: 66052 - DNA, 25 bp, E. coli
gcagtacggcactaaagaagaagct

SEQ ID NO: 66053 - DNA, 25 bp, E. coli
gaaccgcatgttttcgtcggcgcag

SEQ ID NO: 66054 - DNA, 25 bp, E. coli
gaaccgcatgttatcgtcggcgcag

SEQ ID NO: 66055 - DNA, 25 bp, E. coli
gtaactaaaattcccgtcgcgtggg

SEQ ID NO: 66056 - DNA, 25 bp, E. coli
ggtcacgtaaagacaaagccagagc

SEQ ID NO: 66057 - DNA, 25 bp, E. coli
ggtcacgtaaagtcaaagccagagc

SEQ ID NO: 66058 - DNA, 25 bp, E. coli
tcaataaaattatgcgcgacgggaa

SEQ ID NO: 66059 - DNA, 25 bp, E. coli
tcaataaaattaagcgcgacgggaa

SEQ ID NO: 66060 - DNA, 25 bp, E. coli
gatgattattctcggcactgccggg

SEQ ID NO: 66061 - DNA, 25 bp, E. coli
gatgattattctgggcactgccggg

SEQ ID NO: 66062 - DNA, 25 bp, E. coli
gtaactaaaattgccgtcgcgtggg

SEQ ID NO: 66063 - DNA, 25 bp, E. coli
caacgagcgtaaggtaccggtaatg

SEQ ID NO: 66064 - DNA, 25 bp, E. coli
caacgagcgtaacgtaccggtaatg

SEQ ID NO: 66065 - DNA, 25 bp, E. coli
atgtgggcgaagacaacgagcgtaa

SEQ ID NO: 66066 - DNA, 25 bp, E. coli
cgaagacaacgagcgtaaggtaccg

SEQ ID NO: 66067 - DNA, 25 bp, E. coli
atgtgggcgaagtcaacgagcgtaa

SEQ ID NO: 66068 - DNA, 25 bp, E. coli
cgaagacaacgaccgtaaggtaccg

SEQ ID NO: 66069 - DNA, 25 bp, E. coli
tgagcgcctcctatgtgggcgaaga

SEQ ID NO: 66070 - DNA, 25 bp, E. coli
tgagcgcctcctttgtgggcgaaga

SEQ ID NO: 66071 - DNA, 25 bp, E. coli
tcctatgtgggccaagacaacgagc

SEQ ID NO: 66072 - DNA, 25 bp, E. coli
tcctatgtgggcgaagacaacgagc

SEQ ID NO: 66073 - DNA, 25 bp, E. coli
tcgtctgagcgcctcctatgtgggc

SEQ ID NO: 66074 - DNA, 25 bp, E. coli
tcgtctgagcgcgtcctatgtgggc

SEQ ID NO: 66075 - DNA, 25 bp, E. coli
tctgagcgcctcgtatgtgggcgaa

SEQ ID NO: 66076 - DNA, 25 bp, E. coli
tctgagcgcctcctatgtgggcgaa

SEQ ID NO: 66077 - DNA, 25 bp, E. coli
cgcctcctatgtcggcgaagacaac

SEQ ID NO: 66078 - DNA, 25 bp, E. coli
cgagcgtaaggtaccggtaatgatt

SEQ ID NO: 66079 - DNA, 25 bp, E. coli
cgagcgtaaggttccggtaatgatt

SEQ ID NO: 66080 - DNA, 25 bp, E. coli
cgcctcctatgtgggcgaagacaac

SEQ ID NO: 66081 - DNA, 25 bp, E. coli
ctatgtgggcgatgacaacgagcgt

SEQ ID NO: 66082 - DNA, 25 bp, E. coli
ctatgtgggcgaagacaacgagcgt

SEQ ID NO: 66083 - DNA, 25 bp, E. coli
ggcgaagacaaccagcgtaaggtac

SEQ ID NO: 66084 - DNA, 25 bp, E. coli
ggcgaagacaacgagcgtaaggtac

SEQ ID NO: 66085 - DNA, 25 bp, E. coli
taaagtgattataactgaaggcgca

SEQ ID NO: 66086 - DNA, 25 bp, E. coli
taaagtgattattactgaaggcgca

SEQ ID NO: 66087 - DNA, 25 bp, E. coli
acttgtttgtggtgttcgatccgga

SEQ ID NO: 66088 - DNA, 25 bp, E. coli
actgaaggcgcattcgaaggttttc

SEQ ID NO: 66089 - DNA, 25 bp, E. coli
acttgtttgtggagttcgatccgga

SEQ ID NO: 66090 - DNA, 25 bp, E. coli
actgaaggcgcaatcgaaggttttc

SEQ ID NO: 66091 - DNA, 25 bp, E. coli
tcgacgccgtatcctggtgataaag

SEQ ID NO: 66092 - DNA, 25 bp, E. coli
tcgacgccgtatgctggtgataaag

SEQ ID NO: 66093 - DNA, 25 bp, E. coli
tcagtgtataaagcgaaagatattg

SEQ ID NO: 66094 - DNA, 25 bp, E. coli
tcagtgtataaaccgaaagatattg

SEQ ID NO: 66095 - DNA, 25 bp, E. coli
gccgtatcctggtgataaagtgatt

SEQ ID NO: 66096 - DNA, 25 bp, E. coli
gccgtatcctggagataaagtgatt

SEQ ID NO: 66097 - DNA, 25 bp, E. coli
ccgaaagatattctcgatccatcga

SEQ ID NO: 66098 - DNA, 25 bp, E. coli
gcggtgattcatgagttatcagtgt

SEQ ID NO: 66099 - DNA, 25 bp, E. coli
gcggtgattcatcagttatcagtgt

SEQ ID NO: 66100 - DNA, 25 bp, E. coli
ccgaaagatattgtcgatccatcga

SEQ ID NO: 66101 - DNA, 25 bp, E. coli
cccaactacttgtttgtggagttcg

SEQ ID NO: 66102 - DNA, 25 bp, E. coli
cccaactacttgattgtggagttcg

SEQ ID NO: 66103 - DNA, 25 bp, E. coli
gttcgatccggaagtgattcatacc

SEQ ID NO: 66104 - DNA, 25 bp, E. coli
gatattgtcgatgcatcgacgccgt

SEQ ID NO: 66105 - DNA, 25 bp, E. coli
gttcgatccggatgtgattcatacc

SEQ ID NO: 66106 - DNA, 25 bp, E. coli
gatattgtcgatccatcgacgccgt

SEQ ID NO: 66107 - DNA, 25 bp, E. coli
aatgccacacggctccaggagttgt

SEQ ID NO: 66108 - DNA, 25 bp, E. coli
aatgccacacgggtccaggagttgt

SEQ ID NO: 66109 - DNA, 25 bp, E. coli
cacgctgctgcaagaagttgtcaga

SEQ ID NO: 66110 - DNA, 25 bp, E. coli
cacgctgctgcatgaagttgtcaga

SEQ ID NO: 66111 - DNA, 25 bp, E. coli
caggccgtctacattaccgtacaga

SEQ ID NO: 66112 - DNA, 25 bp, E. coli
cagtgtaggtttgagcacggtcgcc

SEQ ID NO: 66113 - DNA, 25 bp, E. coli
cagtgtaggtttcagcacggtcgcc

SEQ ID NO: 66114 - DNA, 25 bp, E. coli
caggccgtctactttaccgtacaga

SEQ ID NO: 66115 - DNA, 25 bp, E. coli
taggtctgggtgtactgagcagcca

SEQ ID NO: 66116 - DNA, 25 bp, E. coli
taggtctgggtgaactgagcagcca

SEQ ID NO: 66117 - DNA, 25 bp, E. coli
tcgtatttcagaccaccagtgtagg

SEQ ID NO: 66118 - DNA, 25 bp, E. coli
tcgtatttcagagcaccagtgtagg

SEQ ID NO: 66119 - DNA, 25 bp, E. coli
gccgtaaccggtgagctggtcagta

SEQ ID NO: 66120 - DNA, 25 bp, E. coli
gccgtaaccggtcagctggtcagta

SEQ ID NO: 66121 - DNA, 25 bp, E. coli
gaagttctgtgctttgttcgcccaa

SEQ ID NO: 66122 - DNA, 25 bp, E. coli
gaagttctgtgcattgttcgcccaa

SEQ ID NO: 66123 - DNA, 25 bp, E. coli
gacgcatgtaggtctggtcgccatc

SEQ ID NO: 66124 - DNA, 25 bp, E. coli
gtcagagaaatactgcaggccgtct

SEQ ID NO: 66125 - DNA, 25 bp, E. coli
gtcagagaaatagtgcaggccgtct

SEQ ID NO: 66126 - DNA, 25 bp, E. coli
ggatctgatattcccactggccgta

SEQ ID NO: 66127 - DNA, 25 bp, E. coli
ggatctgatattgccactggccgta

SEQ ID NO: 66128 - DNA, 25 bp, E. coli
gacgcatgtaggactggtcgccatc

SEQ ID NO: 66129 - DNA, 25 bp, E. coli
catgctggtaagagaaatgccgcac

SEQ ID NO: 66130 - DNA, 25 bp, E. coli
catgctggtaagtgaaatgccgcac

SEQ ID NO: 66131 - DNA, 25 bp, E. coli
aactggagtcccgtaattgtggcaa

SEQ ID NO: 66132 - DNA, 25 bp, E. coli
aactggagtcccctaattgtggcaa

SEQ ID NO: 66133 - DNA, 25 bp, E. coli
tatgggctggaggattacaccgtcg

SEQ ID NO: 66134 - DNA, 25 bp, E. coli
tatgggctggagcattacaccgtcg

SEQ ID NO: 66135 - DNA, 25 bp, E. coli
tgtggcaaaccgctgcatagtgcgt

SEQ ID NO: 66136 - DNA, 25 bp, E. coli
tgtggcaaaccggtgcatagtgcgt

SEQ ID NO: 66137 - DNA, 25 bp, E. coli
tctggttacggctaggatatgtcac

SEQ ID NO: 66138 - DNA, 25 bp, E. coli
tctggttacggcaaggatatgtcac

SEQ ID NO: 66139 - DNA, 25 bp, E. coli
gacgagtctacgcagcttggacctt

SEQ ID NO: 66140 - DNA, 25 bp, E. coli
gacgagtctacggagcttggacctt

SEQ ID NO: 66141 - DNA, 25 bp, E. coli
cgtactcatatggaacttggtggca

SEQ ID NO: 66142 - DNA, 25 bp, E. coli
cgtactcatatgcaacttggtggca

SEQ ID NO: 66143 - DNA, 25 bp, E. coli
cgtggcttctatggcaccgtggaat

SEQ ID NO: 66144 - DNA, 25 bp, E. coli
cgtggcttctatcgcaccgtggaat

SEQ ID NO: 66145 - DNA, 25 bp, E. coli
gtctggcggcaggtgaatatcttga

SEQ ID NO: 66146 - DNA, 25 bp, E. coli
gtctggcggcagctgaatatcttga

SEQ ID NO: 66147 - DNA, 25 bp, E. coli
ggatctacgcgctaaaaggcattta

SEQ ID NO: 66148 - DNA, 25 bp, E. coli
ggatctacgcgcaaaaaggcattta

SEQ ID NO: 66149 - DNA, 25 bp, E. coli
taatggctattagtatgcgccgacg

SEQ ID NO: 66150 - DNA, 25 bp, E. coli
taatggctattactatgcgccgacg

SEQ ID NO: 66151 - DNA, 25 bp, E. coli
caatacgtctgtctaaagagctggg

SEQ ID NO: 66152 - DNA, 25 bp, E. coli
caatacgtctgtgtaaagagctggg

SEQ ID NO: 66153 - DNA, 25 bp, E. coli
taaagagctgggtgatcagtcggtc

SEQ ID NO: 66154 - DNA, 25 bp, E. coli
taaagagctgggagatcagtcggtc

SEQ ID NO: 66155 - DNA, 25 bp, E. coli
aactatgctaacgagcggcttaccc

SEQ ID NO: 66156 - DNA, 25 bp, E. coli
aactatgctaaccagcggcttaccc

SEQ ID NO: 66157 - DNA, 25 bp, E. coli
tatggtttaacccaatcgggaggcg

SEQ ID NO: 66158 - DNA, 25 bp, E. coli
tatggtttaaccgaatcgggaggcg

SEQ ID NO: 66159 - DNA, 25 bp, E. coli
tgaataacgttgctcaggcactggg

SEQ ID NO: 66160 - DNA, 25 bp, E. coli
tgaaccgcaagctgaagatgcgccg

SEQ ID NO: 66161 - DNA, 25 bp, E. coli
tgaaccgcaagcagaagatgcgccg

SEQ ID NO: 66162 - DNA, 25 bp, E. coli
tgaataacgttggtcaggcactggg

SEQ ID NO: 66163 - DNA, 25 bp, E. coli
tgccagcgatgtaatgttgacgcgc

SEQ ID NO: 66164 - DNA, 25 bp, E. coli
tgccagcgatgttatgttgacgcgc

SEQ ID NO: 66165 - DNA, 25 bp, E. coli
gcgaaggcggcacaagctgcaatac

SEQ ID NO: 66166 - DNA, 25 bp, E. coli
gcgaaggcggcagaagctgcaatac

SEQ ID NO: 66167 - DNA, 25 bp, E. coli
gattagcgaacgattgcagcaggaa

SEQ ID NO: 66168 - DNA, 25 bp, E. coli
gattagcgaacgtttgcagcaggaa

SEQ ID NO: 66169 - DNA, 25 bp, E. coli
ggcgttcattgagcctgctcccgga

SEQ ID NO: 66170 - DNA, 25 bp, E. coli
ggcgttcattgaccctgctcccgga

SEQ ID NO: 66171 - DNA, 25 bp, E. coli
tgcaatgccgttgtttgggatccgg

SEQ ID NO: 66172 - DNA, 25 bp, E. coli
tgcaatgccgttctttgggatccgg

SEQ ID NO: 66173 - DNA, 25 bp, E. coli
cagctgactgtttttgccggagaga

SEQ ID NO: 66174 - DNA, 25 bp, E. coli
cagctgactgttattgccggagaga

SEQ ID NO: 66175 - DNA, 25 bp, E. coli
caacggttaaggatcaatacggcaa

SEQ ID NO: 66176 - DNA, 25 bp, E. coli
caacggttaaggttcaatacggcaa

SEQ ID NO: 66177 - DNA, 25 bp, E. coli
tatcatggtgaacgccgacaaggag

SEQ ID NO: 66178 - DNA, 25 bp, E. coli
tatcatggtgaaggccgacaaggag

SEQ ID NO: 66179 - DNA, 25 bp, E. coli
tttcagtaccggacaggcgagcctg

SEQ ID NO: 66180 - DNA, 25 bp, E. coli
tttcagtaccggtcaggcgagcctg

SEQ ID NO: 66181 - DNA, 25 bp, E. coli
tgtaactggcctcaatccggatgca

SEQ ID NO: 66182 - DNA, 25 bp, E. coli
tgtaactggcctgaatccggatgca

SEQ ID NO: 66183 - DNA, 25 bp, E. coli
tgaagtgaattagacgccagtgcct

SEQ ID NO: 66184 - DNA, 25 bp, E. coli
tgaagtgaattacacgccagtgcct

SEQ ID NO: 66185 - DNA, 25 bp, E. coli
tgtcaaccccgttggaggaaccatg

SEQ ID NO: 66186 - DNA, 25 bp, E. coli
tgtcaaccccgtaggaggaaccatg

SEQ ID NO: 66187 - DNA, 25 bp, E. coli
gaacctatgagaacacggcgtcagc

SEQ ID NO: 66188 - DNA, 25 bp, E. coli
gaaatgaccagcgttcgaatgcgca

SEQ ID NO: 66189 - DNA, 25 bp, E. coli
gaaatgaccagccttcgaatgcgca

SEQ ID NO: 66190 - DNA, 25 bp, E. coli
gaacctatgagatcacggcgtcagc

SEQ ID NO: 66191 - DNA, 25 bp, E. coli
ggatgataaaaacgcggtgctcgct

SEQ ID NO: 66192 - DNA, 25 bp, E. coli
ggatgataaaaaggcggtgctcgct

SEQ ID NO: 66193 - DNA, 25 bp, E. coli
ggaagactactggaacactgacggt

SEQ ID NO: 66194 - DNA, 25 bp, E. coli
ggaagactactgcaacactgacggt

SEQ ID NO: 66195 - DNA, 25 bp, E. coli
caaatgaccgccgatatcgaagggc

SEQ ID NO: 66196 - DNA, 25 bp, E. coli
caaatgaccgcccatatcgaagggc

SEQ ID NO: 66197 - DNA, 25 bp, E. coli
tacgatatgcaactcattggcggcg

SEQ ID NO: 66198 - DNA, 25 bp, E. coli
aaagcactggcgctgaacctaagcg

SEQ ID NO: 66199 - DNA, 25 bp, E. coli
aaagcactggcggtgaacctaagcg

SEQ ID NO: 66200 - DNA, 25 bp, E. coli
tacgatatgcaagtcattggcggcg

SEQ ID NO: 66201 - DNA, 25 bp, E. coli
tatcaatgacgttgggtatccacgg

SEQ ID NO: 66202 - DNA, 25 bp, E. coli
tatcaatgacgtagggtatccacgg

SEQ ID NO: 66203 - DNA, 25 bp, E. coli
tggatctatgtgtccggtacaccgg

SEQ ID NO: 66204 - DNA, 25 bp, E. coli
tgacgctggcataaaccttaccgga

SEQ ID NO: 66205 - DNA, 25 bp, E. coli
tgacgctggcattaaccttaccgga

SEQ ID NO: 66206 - DNA, 25 bp, E. coli
gccgggctggcgattttgcaaaacc

SEQ ID NO: 66207 - DNA, 25 bp, E. coli
ccttaccggacgaagacgaagcgtg

SEQ ID NO: 66208 - DNA, 25 bp, E. coli
ccttaccggacgtagacgaagcgtg

SEQ ID NO: 66209 - DNA, 25 bp, E. coli
gccgggctggcgtttttgcaaaacc

SEQ ID NO: 66210 - DNA, 25 bp, E. coli
gcggcgcacgtaatgacctggcatt

SEQ ID NO: 66211 - DNA, 25 bp, E. coli
gcggcgcacgtattgacctggcatt

SEQ ID NO: 66212 - DNA, 25 bp, E. coli
cgctctctggcgctgaagattacga

SEQ ID NO: 66213 - DNA, 25 bp, E. coli
cgctctctggcggtgaagattacga

SEQ ID NO: 66214 - DNA, 25 bp, E. coli
tgttccgatgggacgagccttaacg

SEQ ID NO: 66215 - DNA, 25 bp, E. coli
tgttccgatgggtcgagccttaacg

SEQ ID NO: 66216 - DNA, 25 bp, E. coli
tggatctatgtgaccggtacaccgg

SEQ ID NO: 66217 - DNA, 25 bp, E. coli
caagaacgtttttcatgacgaaagg

SEQ ID NO: 66218 - DNA, 25 bp, E. coli
caacctgtatttagttaacgctgcg

SEQ ID NO: 66219 - DNA, 25 bp, E. coli
caagaacgttttacatgacgaaagg

SEQ ID NO: 66220 - DNA, 25 bp, E. coli
caacctgtattttgttaacgctgcg

SEQ ID NO: 66221 - DNA, 25 bp, E. coli
cacggaggtgtgcagaaaaaacaag

SEQ ID NO: 66222 - DNA, 25 bp, E. coli
cacggaggtgtggagaaaaaacaag

SEQ ID NO: 66223 - DNA, 25 bp, E. coli
tatgcattattactaagttatcacc

SEQ ID NO: 66224 - DNA, 25 bp, E. coli
tatgcattattagtaagttatcacc

SEQ ID NO: 66225 - DNA, 25 bp, E. coli
tatattttacccatttagggctgat

SEQ ID NO: 66226 - DNA, 25 bp, E. coli
tatattttacccttttagggctgat

SEQ ID NO: 66227 - DNA, 25 bp, E. coli
tcaacttggttgataacgcaacctg

SEQ ID NO: 66228 - DNA, 25 bp, E. coli
tcaacttggttgttaacgcaacctg

SEQ ID NO: 66229 - DNA, 25 bp, E. coli
gacgaaaggacttcaccgaaatatt

SEQ ID NO: 66230 - DNA, 25 bp, E. coli
gacgaaaggactacaccgaaatatt

SEQ ID NO: 66231 - DNA, 25 bp, E. coli
gctagattgaaatcagatgtaatcc

SEQ ID NO: 66232 - DNA, 25 bp, E. coli
gctagattgaaaacagatgtaatcc

SEQ ID NO: 66233 - DNA, 25 bp, E. coli
gcagtaaaaaatagtccacggaggt

SEQ ID NO: 66234 - DNA, 25 bp, E. coli
gcagtaaaaaattgtccacggaggt

SEQ ID NO: 66235 - DNA, 25 bp, E. coli
gacctggtcgtacatttaagaaatt

SEQ ID NO: 66236 - DNA, 25 bp, E. coli
gacctggtcgtagatttaagaaatt

SEQ ID NO: 66237 - DNA, 25 bp, E. coli
taacgctgcgttacgatggaaagta

SEQ ID NO: 66238 - DNA, 25 bp, E. coli
taacgctgcgtttcgatggaaagta

SEQ ID NO: 66239 - DNA, 25 bp, E. coli
cagatgaaatgttagccggaaagaa

SEQ ID NO: 66240 - DNA, 25 bp, E. coli
cagatgaaatgtaagccggaaagaa

SEQ ID NO: 66241 - DNA, 25 bp, E. coli
taaaaaccttttcctcatcgccagt

SEQ ID NO: 66242 - DNA, 25 bp, E. coli
taaaaaccttttgctcatcgccagt

SEQ ID NO: 66243 - DNA, 25 bp, E. coli
tagatatgtatgtgcctaacccgct

SEQ ID NO: 66244 - DNA, 25 bp, E. coli
tacctatccgatggctgcgacaaat

SEQ ID NO: 66245 - DNA, 25 bp, E. coli
tagatatgtatgagcctaacccgct

SEQ ID NO: 66246 - DNA, 25 bp, E. coli
tacctatccgatcgctgcgacaaat

SEQ ID NO: 66247 - DNA, 25 bp, E. coli
tagtattacttgaatccgctggtca

SEQ ID NO: 66248 - DNA, 25 bp, E. coli
tagtattacttgtatccgctggtca

SEQ ID NO: 66249 - DNA, 25 bp, E. coli
tgtctggacaaggaaaagtatctca

SEQ ID NO: 66250 - DNA, 25 bp, E. coli
tgtctggacaagcaaaagtatctca

SEQ ID NO: 66251 - DNA, 25 bp, E. coli
tgaaagcatttacagggccatgact

SEQ ID NO: 66252 - DNA, 25 bp, E. coli
tgaaagcatttagagggccatgact

SEQ ID NO: 66253 - DNA, 25 bp, E. coli
gactgataactggtctgtctggaca

SEQ ID NO: 66254 - DNA, 25 bp, E. coli
cccagaagacgataagcagttgtga

SEQ ID NO: 66255 - DNA, 25 bp, E. coli
cccagaagacgaaaagcagttgtga

SEQ ID NO: 66256 - DNA, 25 bp, E. coli
gttattgccttctagcggaatgcca

SEQ ID NO: 66257 - DNA, 25 bp, E. coli
gttattgccttcaagcggaatgcca

SEQ ID NO: 66258 - DNA, 25 bp, E. coli
taacgctcacggtagatggaattct

SEQ ID NO: 66259 - DNA, 25 bp, E. coli
taacgctcacggaagatggaattct

SEQ ID NO: 66260 - DNA, 25 bp, E. coli
gactgataactgctctgtctggaca

SEQ ID NO: 66261 - DNA, 25 bp, E. coli
cacagatgagtgtagaaccgattcc

SEQ ID NO: 66262 - DNA, 25 bp, E. coli
cacgcgacgcattgtgtggtggtac

SEQ ID NO: 66263 - DNA, 25 bp, E. coli
cacgcgacgcatagtgtggtggtac

SEQ ID NO: 66264 - DNA, 25 bp, E. coli
cacagatgagtgaagaaccgattcc

SEQ ID NO: 66265 - DNA, 25 bp, E. coli
taaacacgatgaagcgctaaaccgt

SEQ ID NO: 66266 - DNA, 25 bp, E. coli
taaacacgatgatgcgctaaaccgt

SEQ ID NO: 66267 - DNA, 25 bp, E. coli
tatgggcagcaagaaacaggaagcg

SEQ ID NO: 66268 - DNA, 25 bp, E. coli
tatgggcagcaacaaacaggaagcg

SEQ ID NO: 66269 - DNA, 25 bp, E. coli
tttgcaggtgatcagcacgcgacgc

SEQ ID NO: 66270 - DNA, 25 bp, E. coli
tttgcaggtgatgagcacgcgacgc

SEQ ID NO: 66271 - DNA, 25 bp, E. coli
ttattggaggcggtattgccagcgc

SEQ ID NO: 66272 - DNA, 25 bp, E. coli
ttattggaggcgctattgccagcgc

SEQ ID NO: 66273 - DNA, 25 bp, E. coli
ccggagctggcgtaactgaagcaag

SEQ ID NO: 66274 - DNA, 25 bp, E. coli
ccgtgcggattttgcgctggcgcat

SEQ ID NO: 66275 - DNA, 25 bp, E. coli
ccgtgcggatttagcgctggcgcat

SEQ ID NO: 66276 - DNA, 25 bp, E. coli
ccggagctggcgaaactgaagcaag

SEQ ID NO: 66277 - DNA, 25 bp, E. coli
gacggcgtacagtgatgaagatcag

SEQ ID NO: 66278 - DNA, 25 bp, E. coli
gggtaaccatcttgaggcacgtttt

SEQ ID NO: 66279 - DNA, 25 bp, E. coli
gggtaaccatctagaggcacgtttt

SEQ ID NO: 66280 - DNA, 25 bp, E. coli
ggcaacgtgcctcattatgacgcta

SEQ ID NO: 66281 - DNA, 25 bp, E. coli
ggcaacgtgcctgattatgacgcta

SEQ ID NO: 66282 - DNA, 25 bp, E. coli
gacggcgtacagagatgaagatcag

SEQ ID NO: 66283 - DNA, 25 bp, E. coli
caacagcttgagtaggttcacccta

SEQ ID NO: 66284 - DNA, 25 bp, E. coli
caacagcttgagaaggttcacccta

SEQ ID NO: 66285 - DNA, 25 bp, E. coli
tagggatttcatacaccgccacaga

SEQ ID NO: 66286 - DNA, 25 bp, E. coli
tagggatttcattcaccgccacaga

SEQ ID NO: 66287 - DNA, 25 bp, E. coli
tgtaacaagcgacccgtcaactacg

SEQ ID NO: 66288 - DNA, 25 bp, E. coli
tgaaacttatcgcattcgcaccgga

SEQ ID NO: 66289 - DNA, 25 bp, E. coli
tgaaacttatcggattcgcaccgga

SEQ ID NO: 66290 - DNA, 25 bp, E. coli
tccctcgggataatagcaatgttgc

SEQ ID NO: 66291 - DNA, 25 bp, E. coli
tccctcgggatattagcaatgttgc

SEQ ID NO: 66292 - DNA, 25 bp, E. coli
tcgcaccggaagagaacaaatcagc

SEQ ID NO: 66293 - DNA, 25 bp, E. coli
tcgcaccggaagtgaacaaatcagc

SEQ ID NO: 66294 - DNA, 25 bp, E. coli
tctaaatggaaagcgtgcaagctgg

SEQ ID NO: 66295 - DNA, 25 bp, E. coli
tctaaatggaaaccgtgcaagctgg

SEQ ID NO: 66296 - DNA, 25 bp, E. coli
ggtgatagtatcacttccggacgaa

SEQ ID NO: 66297 - DNA, 25 bp, E. coli
ggtgatagtatctcttccggacgaa

SEQ ID NO: 66298 - DNA, 25 bp, E. coli
ggcaggcaaaatgcatcggcaggtt

SEQ ID NO: 66299 - DNA, 25 bp, E. coli
ggcaggcaaaatccatcggcaggtt

SEQ ID NO: 66300 - DNA, 25 bp, E. coli
tgtaacaagcgagccgtcaactacg

SEQ ID NO: 66301 - DNA, 25 bp, E. coli
gatgttctgattgtgctccctcggg

SEQ ID NO: 66302 - DNA, 25 bp, E. coli
gatgttctgattctgctccctcggg

SEQ ID NO: 66303 - DNA, 25 bp, E. coli
gttcaccctaccaggcgaagcgagt

SEQ ID NO: 66304 - DNA, 25 bp, E. coli
gttcaccctacctggcgaagcgagt

SEQ ID NO: 66305 - DNA, 25 bp, E. coli
caaagagaggtaatgccaagggata

SEQ ID NO: 66306 - DNA, 25 bp, E. coli
caaagagaggtattgccaagggata

SEQ ID NO: 66307 - DNA, 25 bp, E. coli
tatcaagcaatttcgtccatccgcg

SEQ ID NO: 66308 - DNA, 25 bp, E. coli
tatcaagcaattacgtccatccgcg

SEQ ID NO: 66309 - DNA, 25 bp, E. coli
ttgcccggaacataataacagctcg

SEQ ID NO: 66310 - DNA, 25 bp, E. coli
ttgcccggaacaaaataacagctcg

SEQ ID NO: 66311 - DNA, 25 bp, E. coli
tccatgtaaaactgataagcgggtg

SEQ ID NO: 66312 - DNA, 25 bp, E. coli
tccatgtaaaacagataagcgggtg

SEQ ID NO: 66313 - DNA, 25 bp, E. coli
gaaccatgtgttcttgccggatgcc

SEQ ID NO: 66314 - DNA, 25 bp, E. coli
gaaccatgtgttgttgccggatgcc

SEQ ID NO: 66315 - DNA, 25 bp, E. coli
gactcaatgcatcagagcttccatg

SEQ ID NO: 66316 - DNA, 25 bp, E. coli
gactcaatgcatgagagcttccatg

SEQ ID NO: 66317 - DNA, 25 bp, E. coli
cgaggcacattaagggagcgcaacc

SEQ ID NO: 66318 - DNA, 25 bp, E. coli
cgaggcacattatgggagcgcaacc

SEQ ID NO: 66319 - DNA, 25 bp, E. coli
cattcaatttatatggcgaggcaca

SEQ ID NO: 66320 - DNA, 25 bp, E. coli
cattcaatttatttggcgaggcaca

SEQ ID NO: 66321 - DNA, 25 bp, E. coli
gtatccagccgagaaaactgtccag

SEQ ID NO: 66322 - DNA, 25 bp, E. coli
gatataaacgataattccagggtag

SEQ ID NO: 66323 - DNA, 25 bp, E. coli
gatataaacgattattccagggtag

SEQ ID NO: 66324 - DNA, 25 bp, E. coli
gtatccagccgacaaaactgtccag

SEQ ID NO: 66325 - DNA, 25 bp, E. coli
ggcaaagaaaaagacaagcggaatg

SEQ ID NO: 66326 - DNA, 25 bp, E. coli
ggcaaagaaaaacacaagcggaatg

SEQ ID NO: 66327 - DNA, 25 bp, E. coli
cactgatgcgcactcgccgtggtga

SEQ ID NO: 66328 - DNA, 25 bp, E. coli
cagccactggcatgccgttgtgcaa

SEQ ID NO: 66329 - DNA, 25 bp, E. coli
cacatatggcgagtgcactgatgcg

SEQ ID NO: 66330 - DNA, 25 bp, E. coli
cactgatgcgcagtcgccgtggtga

SEQ ID NO: 66331 - DNA, 25 bp, E. coli
cagccactggcaagccgttgtgcaa

SEQ ID NO: 66332 - DNA, 25 bp, E. coli
cacatatggcgactgcactgatgcg

SEQ ID NO: 66333 - DNA, 25 bp, E. coli
aacgaaaggcatgtgatatggaaac

SEQ ID NO: 66334 - DNA, 25 bp, E. coli
aacgaaaggcatctgatatggaaac

SEQ ID NO: 66335 - DNA, 25 bp, E. coli
tatggaaaccagactcaacctgctt

SEQ ID NO: 66336 - DNA, 25 bp, E. coli
tatggaaaccagtctcaacctgctt

SEQ ID NO: 66337 - DNA, 25 bp, E. coli
tgataaggacatgtgcaaaggcatg

SEQ ID NO: 66338 - DNA, 25 bp, E. coli
tgataaggacatctgcaaaggcatg

SEQ ID NO: 66339 - DNA, 25 bp, E. coli
gccgtggtgaagtaatagagccgct

SEQ ID NO: 66340 - DNA, 25 bp, E. coli
gccgtggtgaagaaatagagccgct

SEQ ID NO: 66341 - DNA, 25 bp, E. coli
gaagttaacccgtgtgaagaaggct

SEQ ID NO: 66342 - DNA, 25 bp, E. coli
gaacgatggcgatgacacatatggc

SEQ ID NO: 66343 - DNA, 25 bp, E. coli
gcaaaggcatgaagcaggtcgtcaa

SEQ ID NO: 66344 - DNA, 25 bp, E. coli
gcaaaggcatgatgcaggtcgtcaa

SEQ ID NO: 66345 - DNA, 25 bp, E. coli
gaagttaacccgagtgaagaaggct

SEQ ID NO: 66346 - DNA, 25 bp, E. coli
gaacgatggcgaagacacatatggc

SEQ ID NO: 66347 - DNA, 25 bp, E. coli
gattatggatggctgctaacgaaga

SEQ ID NO: 66348 - DNA, 25 bp, E. coli
gattatggatgggtgctaacgaaga

SEQ ID NO: 66349 - DNA, 25 bp, E. coli
cagccaggctttcctcgatgaggca

SEQ ID NO: 66350 - DNA, 25 bp, E. coli
cagccaggctttgctcgatgaggca

SEQ ID NO: 66351 - DNA, 25 bp, E. coli
tactggcgaagtatctgaacagacc

SEQ ID NO: 66352 - DNA, 25 bp, E. coli
tactggcgaagtttctgaacagacc

SEQ ID NO: 66353 - DNA, 25 bp, E. coli
aacagcgcggcgtttagtgattacg

SEQ ID NO: 66354 - DNA, 25 bp, E. coli
aaagttttatcgatagcgccgcgcg

SEQ ID NO: 66355 - DNA, 25 bp, E. coli
aaagttttatcgttagcgccgcgcg

SEQ ID NO: 66356 - DNA, 25 bp, E. coli
aacagcgcggcgattagtgattacg

SEQ ID NO: 66357 - DNA, 25 bp, E. coli
tgatatcaacctctatggctggcat

SEQ ID NO: 66358 - DNA, 25 bp, E. coli
tgatatcaacctgtatggctggcat

SEQ ID NO: 66359 - DNA, 25 bp, E. coli
tgcatcatggcttcttctggaaagg

SEQ ID NO: 66360 - DNA, 25 bp, E. coli
tgcatcatggctacttctggaaagg

SEQ ID NO: 66361 - DNA, 25 bp, E. coli
gcgagtggctgattgaaaataccga

SEQ ID NO: 66362 - DNA, 25 bp, E. coli
gcgagtggctgaatgaaaataccga

SEQ ID NO: 66363 - DNA, 25 bp, E. coli
gaaaaacaccgaactggaacaactg

SEQ ID NO: 66364 - DNA, 25 bp, E. coli
gaaaaacaccgatctggaacaactg

SEQ ID NO: 66365 - DNA, 25 bp, E. coli
gatcacggtcatcggcgaaattgag

SEQ ID NO: 66366 - DNA, 25 bp, E. coli
gatcacggtcatgggcgaaattgag

SEQ ID NO: 66367 - DNA, 25 bp, E. coli
gattacgcgccgtatggtttgcagg

SEQ ID NO: 66368 - DNA, 25 bp, E. coli
gattacgcgccgaatggtttgcagg

SEQ ID NO: 66369 - DNA, 25 bp, E. coli
taagccgttatgctgtggcgatacc

SEQ ID NO: 66370 - DNA, 25 bp, E. coli
taagccgttatggtgtggcgatacc

SEQ ID NO: 66371 - DNA, 25 bp, E. coli
atgaagtgaccgtggcgtactacac

SEQ ID NO: 66372 - DNA, 25 bp, E. coli
aggcgtactacaccaccggccacta

SEQ ID NO: 66373 - DNA, 25 bp, E. coli
atgaagtgaccgaggcgtactacac

SEQ ID NO: 66374 - DNA, 25 bp, E. coli
aggcgtactacagcaccggccacta

SEQ ID NO: 66375 - DNA, 25 bp, E. coli
aagcctcgatgatgtgaccgaggcg

SEQ ID NO: 66376 - DNA, 25 bp, E. coli
aagcctcgatgaagtgaccgaggcg

SEQ ID NO: 66377 - DNA, 25 bp, E. coli
tgaccgaggcgtactacaccaccgg

SEQ ID NO: 66378 - DNA, 25 bp, E. coli
tgaagtgaccgaggcgtactacacc

SEQ ID NO: 66379 - DNA, 25 bp, E. coli
tgaccgaggcgttctacaccaccgg

SEQ ID NO: 66380 - DNA, 25 bp, E. coli
tgaagtgaccgacgcgtactacacc

SEQ ID NO: 66381 - DNA, 25 bp, E. coli
tcgatgaagtgaccgaggcgtacta

SEQ ID NO: 66382 - DNA, 25 bp, E. coli
tcgatgaagtgagcgaggcgtacta

SEQ ID NO: 66383 - DNA, 25 bp, E. coli
cctcgatgaagtgaccgaggcgtac

SEQ ID NO: 66384 - DNA, 25 bp, E. coli
cctcgatgaagtcaccgaggcgtac

SEQ ID NO: 66385 - DNA, 25 bp, E. coli
cgtactacaccagcggccactacag

SEQ ID NO: 66386 - DNA, 25 bp, E. coli
cgtactacaccaccggccactacag

SEQ ID NO: 66387 - DNA, 25 bp, E. coli
ctcgatgaagtgaccgaggcgtact

SEQ ID NO: 66388 - DNA, 25 bp, E. coli
ctcgatgaagtgtccgaggcgtact

SEQ ID NO: 66389 - DNA, 25 bp, E. coli
gtgaccgaggcgaactacaccaccg

SEQ ID NO: 66390 - DNA, 25 bp, E. coli
gtgaccgaggcgtactacaccaccg

SEQ ID NO: 66391 - DNA, 25 bp, E. coli
gatgaagtgaccgaggcgtactaca

SEQ ID NO: 66392 - DNA, 25 bp, E. coli
gatgaagtgacccaggcgtactaca

SEQ ID NO: 66393 - DNA, 25 bp, E. coli
cacctgttatgtcagccgggcgaaa

SEQ ID NO: 66394 - DNA, 25 bp, E. coli
cacctgttatgtgagccgggcgaaa

SEQ ID NO: 66395 - DNA, 25 bp, E. coli
cagaagagattgcttcggtcgacac

SEQ ID NO: 66396 - DNA, 25 bp, E. coli
cagaagagattggttcggtcgacac

SEQ ID NO: 66397 - DNA, 25 bp, E. coli
tatctggcttacaccgacaaagttg

SEQ ID NO: 66398 - DNA, 25 bp, E. coli
tatctggcttactccgacaaagttg

SEQ ID NO: 66399 - DNA, 25 bp, E. coli
tattaaaaacggcaaagctcagggc

SEQ ID NO: 66400 - DNA, 25 bp, E. coli
tattaaaaacgggaaagctcagggc

SEQ ID NO: 66401 - DNA, 25 bp, E. coli
tcggcccggatcacaaaattgttgt

SEQ ID NO: 66402 - DNA, 25 bp, E. coli
tcggcccggatctcaaaattgttgt

SEQ ID NO: 66403 - DNA, 25 bp, E. coli
gctcagggcgagctagtattcaaaa

SEQ ID NO: 66404 - DNA, 25 bp, E. coli
gctcagggcgaggtagtattcaaaa

SEQ ID NO: 66405 - DNA, 25 bp, E. coli
gacaaagttgtagaaggttcgccga

SEQ ID NO: 66406 - DNA, 25 bp, E. coli
gacaaagttgtacaaggttcgccga

SEQ ID NO: 66407 - DNA, 25 bp, E. coli
cgtatttaaaatcatcggcccggat

SEQ ID NO: 66408 - DNA, 25 bp, E. coli
ctttaagtcgttacaggtcgtgcgc

SEQ ID NO: 66409 - DNA, 25 bp, E. coli
ctttaagtcgtttcaggtcgtgcgc

SEQ ID NO: 66410 - DNA, 25 bp, E. coli
cgtatttaaaatgatcggcccggat

SEQ ID NO: 66411 - DNA, 25 bp, E. coli
gtattcaaaaaacgcacgtccctgg

SEQ ID NO: 66412 - DNA, 25 bp, E. coli
gattagcgcggtacctgtcatgccg

SEQ ID NO: 66413 - DNA, 25 bp, E. coli
gtattcaaaaaaggcacgtccctgg

SEQ ID NO: 66414 - DNA, 25 bp, E. coli
gattagcgcggttcctgtcatgccg

SEQ ID NO: 66415 - DNA, 25 bp, E. coli
cacttcaaagagagagcaacagtca

SEQ ID NO: 66416 - DNA, 25 bp, E. coli
cacttcaaagagtgagcaacagtca

SEQ ID NO: 66417 - DNA, 25 bp, E. coli
tgatttacaaaagacgctaattcgt

SEQ ID NO: 66418 - DNA, 25 bp, E. coli
tgatttacaaaacacgctaattcgt

SEQ ID NO: 66419 - DNA, 25 bp, E. coli
tgcgctgcattgaggaattccctga

SEQ ID NO: 66420 - DNA, 25 bp, E. coli
tgcgctgcattgtggaattccctga

SEQ ID NO: 66421 - DNA, 25 bp, E. coli
tcatgtgagttataccctcgccgcc

SEQ ID NO: 66422 - DNA, 25 bp, E. coli
tcatgtgagttaaaccctcgccgcc

SEQ ID NO: 66423 - DNA, 25 bp, E. coli
gaattccctgaatgtgacgcaaatc

SEQ ID NO: 66424 - DNA, 25 bp, E. coli
gaattccctgaaagtgacgcaaatc

SEQ ID NO: 66425 - DNA, 25 bp, E. coli
gcaacagtcagtttcatcatgtgag

SEQ ID NO: 66426 - DNA, 25 bp, E. coli
gcaacagtcagtatcatcatgtgag

SEQ ID NO: 66427 - DNA, 25 bp, E. coli
cgcagcaccgaccacatggagtaaa

SEQ ID NO: 66428 - DNA, 25 bp, E. coli
cgcagcaccgacgacatggagtaaa

SEQ ID NO: 66429 - DNA, 25 bp, E. coli
cgccgcctgacggtgagggttttct

SEQ ID NO: 66430 - DNA, 25 bp, E. coli
cgccgcctgacgctgagggttttct

SEQ ID NO: 66431 - DNA, 25 bp, E. coli
cgtcttccataatccaaggcgatta

SEQ ID NO: 66432 - DNA, 25 bp, E. coli
cgtcttccataaaccaaggcgatta

SEQ ID NO: 66433 - DNA, 25 bp, E. coli
ggtatgtttatctgcgacactcgca

SEQ ID NO: 66434 - DNA, 25 bp, E. coli
ggtatgtttatcagcgacactcgca

SEQ ID NO: 66435 - DNA, 25 bp, E. coli
taagatttatacataatgcgctgca

SEQ ID NO: 66436 - DNA, 25 bp, E. coli
taagatttatacttaatgcgctgca

SEQ ID NO: 66437 - DNA, 25 bp, E. coli
caaaaggttttattgcgtcggctgg

SEQ ID NO: 66438 - DNA, 25 bp, E. coli
caaaaggttttaatgcgtcggctgg

SEQ ID NO: 66439 - DNA, 25 bp, E. coli
tgatagcgcagcttagccactggca

SEQ ID NO: 66440 - DNA, 25 bp, E. coli
tgtacaattgcgctcttccctctgg

SEQ ID NO: 66441 - DNA, 25 bp, E. coli
tgtacaattgcggtcttccctctgg

SEQ ID NO: 66442 - DNA, 25 bp, E. coli
tgatagcgcagcatagccactggca

SEQ ID NO: 66443 - DNA, 25 bp, E. coli
tccttgcaatacctgagtccgaccg

SEQ ID NO: 66444 - DNA, 25 bp, E. coli
tccttgcaatacgtgagtccgaccg

SEQ ID NO: 66445 - DNA, 25 bp, E. coli
gccactggcagcacgcatgtttaat

SEQ ID NO: 66446 - DNA, 25 bp, E. coli
gccactggcagctcgcatgtttaat

SEQ ID NO: 66447 - DNA, 25 bp, E. coli
gcttcgcaggtgtttgggcaactct

SEQ ID NO: 66448 - DNA, 25 bp, E. coli
gcttcgcaggtgattgggcaactct

SEQ ID NO: 66449 - DNA, 25 bp, E. coli
ccgccgggctgtatgggaacttcat

SEQ ID NO: 66450 - DNA, 25 bp, E. coli
ccgccgggctgtttgggaacttcat

SEQ ID NO: 66451 - DNA, 25 bp, E. coli
cattggcattcttttggcgctcacc

SEQ ID NO: 66452 - DNA, 25 bp, E. coli
cattggcattctattggcgctcacc

SEQ ID NO: 66453 - DNA, 25 bp, E. coli
gatcttttatcagtggcctggcccg

SEQ ID NO: 66454 - DNA, 25 bp, E. coli
gattacgtaagcttacaacggtggt

SEQ ID NO: 66455 - DNA, 25 bp, E. coli
gattacgtaagcatacaacggtggt

SEQ ID NO: 66456 - DNA, 25 bp, E. coli
gatcttttatcactggcctggcccg

SEQ ID NO: 66457 - DNA, 25 bp, E. coli
ggtgatggaaccaccgacaatcgtg

SEQ ID NO: 66458 - DNA, 25 bp, E. coli
ggtgatggaacctccgacaatcgtg

SEQ ID NO: 66459 - DNA, 25 bp, E. coli
tacgcgtgggtaaaacctgaagatc

SEQ ID NO: 66460 - DNA, 25 bp, E. coli
agctgcttttgagagaaatcacgcc

SEQ ID NO: 66461 - DNA, 25 bp, E. coli
agctgcttttgacagaaatcacgcc

SEQ ID NO: 66462 - DNA, 25 bp, E. coli
tacgcgtgggtataacctgaagatc

SEQ ID NO: 66463 - DNA, 25 bp, E. coli
tgctgtgtaaaaaggccgacgatcg

SEQ ID NO: 66464 - DNA, 25 bp, E. coli
tgctgtgtaaaatggccgacgatcg

SEQ ID NO: 66465 - DNA, 25 bp, E. coli
tgcgacaacggagtattgtatgccc

SEQ ID NO: 66466 - DNA, 25 bp, E. coli
tgcgacaacggactattgtatgccc

SEQ ID NO: 66467 - DNA, 25 bp, E. coli
gaactgggagaacagctgcttttga

SEQ ID NO: 66468 - DNA, 25 bp, E. coli
gaactgggagaagagctgcttttga

SEQ ID NO: 66469 - DNA, 25 bp, E. coli
cgcgaaattcgccaagaactgggag

SEQ ID NO: 66470 - DNA, 25 bp, E. coli
cgtatgcagatgctcgcaaggaaga

SEQ ID NO: 66471 - DNA, 25 bp, E. coli
cgcgaaattcgcgaagaactgggag

SEQ ID NO: 66472 - DNA, 25 bp, E. coli
cgaagagtttcacgactacgcgtgg

SEQ ID NO: 66473 - DNA, 25 bp, E. coli
ccctttgattcaaaatgatggtgct

SEQ ID NO: 66474 - DNA, 25 bp, E. coli
ccctttgattcataatgatggtgct

SEQ ID NO: 66475 - DNA, 25 bp, E. coli
cgaagagtttcaggactacgcgtgg

SEQ ID NO: 66476 - DNA, 25 bp, E. coli
cgtatgcagatggtcgcaaggaaga

SEQ ID NO: 66477 - DNA, 25 bp, E. coli
gatattcgcacctagacgtatgcag

SEQ ID NO: 66478 - DNA, 25 bp, E. coli
gatattcgcaccaagacgtatgcag

SEQ ID NO: 66479 - DNA, 25 bp, E. coli
tggaccttcagcgatgatattcgca

SEQ ID NO: 66480 - DNA, 25 bp, E. coli
tggaccttcagccatgatattcgca

SEQ ID NO: 66481 - DNA, 25 bp, E. coli
catcccttccattattattataagc

SEQ ID NO: 66482 - DNA, 25 bp, E. coli
caggcattaaaaaatcatgagatga

SEQ ID NO: 66483 - DNA, 25 bp, E. coli
caggcattaaaatatcatgagatga

SEQ ID NO: 66484 - DNA, 25 bp, E. coli
cattcatttataatcatcccttcca

SEQ ID NO: 66485 - DNA, 25 bp, E. coli
catcccttccataattattataagc

SEQ ID NO: 66486 - DNA, 25 bp, E. coli
accacaggcatttaaaaatcatgag

SEQ ID NO: 66487 - DNA, 25 bp, E. coli
accacaggcattaaaaaatcatgag

SEQ ID NO: 66488 - DNA, 25 bp, E. coli
tttgcgtaaaaatataccacaggca

SEQ ID NO: 66489 - DNA, 25 bp, E. coli
tttgcgtaaaaaaataccacaggca

SEQ ID NO: 66490 - DNA, 25 bp, E. coli
tccaaagaatactttgatgaaataa

SEQ ID NO: 66491 - DNA, 25 bp, E. coli
tccaaagaatacattgatgaaataa

SEQ ID NO: 66492 - DNA, 25 bp, E. coli
tcatgagatgattaaaatattacaa

SEQ ID NO: 66493 - DNA, 25 bp, E. coli
tcatcctgagtgaaaatgctttaac

SEQ ID NO: 66494 - DNA, 25 bp, E. coli
tcatgagatgataaaaatattacaa

SEQ ID NO: 66495 - DNA, 25 bp, E. coli
tcatcctgagtgtaaatgctttaac

SEQ ID NO: 66496 - DNA, 25 bp, E. coli
cattcatttatattcatcccttcca

SEQ ID NO: 66497 - DNA, 25 bp, E. coli
taacgcattcatatataatcatccc

SEQ ID NO: 66498 - DNA, 25 bp, E. coli
taacgcattcatttataatcatccc

SEQ ID NO: 66499 - DNA, 25 bp, E. coli
taagcaaaatccaaagaatacattg

SEQ ID NO: 66500 - DNA, 25 bp, E. coli
taagcaaaatcctaagaatacattg

SEQ ID NO: 66501 - DNA, 25 bp, E. coli
gagtgtaaatgcattaacgcattca

SEQ ID NO: 66502 - DNA, 25 bp, E. coli
gagtgtaaatgctttaacgcattca

SEQ ID NO: 66503 - DNA, 25 bp, E. coli
caatgggcggtcttttttaacacga

SEQ ID NO: 66504 - DNA, 25 bp, E. coli
caatgggcggtcatttttaacacga

SEQ ID NO: 66505 - DNA, 25 bp, E. coli
caactgtgctaactcaaaaagccgg

SEQ ID NO: 66506 - DNA, 25 bp, E. coli
caactgtgctaagtcaaaaagccgg

SEQ ID NO: 66507 - DNA, 25 bp, E. coli
taaaggagccgattatccctctctg

SEQ ID NO: 66508 - DNA, 25 bp, E. coli
taaaggagccgaatatccctctctg

SEQ ID NO: 66509 - DNA, 25 bp, E. coli
tgcaagcggatttcaaaaagggatc

SEQ ID NO: 66510 - DNA, 25 bp, E. coli
tgcaagcggattacaaaaagggatc

SEQ ID NO: 66511 - DNA, 25 bp, E. coli
tccaaaagtggactcggcaatggtc

SEQ ID NO: 66512 - DNA, 25 bp, E. coli
tccaaaagtggagtcggcaatggtc

SEQ ID NO: 66513 - DNA, 25 bp, E. coli
cctctctgtgttcctttacgcggaa

SEQ ID NO: 66514 - DNA, 25 bp, E. coli
cctctctgtgttgctttacgcggaa

SEQ ID NO: 66515 - DNA, 25 bp, E. coli
gcttttgaacaaacctgcaagcgga

SEQ ID NO: 66516 - DNA, 25 bp, E. coli
gcttttgaacaatcctgcaagcgga

SEQ ID NO: 66517 - DNA, 25 bp, E. coli
gacttgccgaattcgcgctaaagga

SEQ ID NO: 66518 - DNA, 25 bp, E. coli
gacttgccgaatacgcgctaaagga

SEQ ID NO: 66519 - DNA, 25 bp, E. coli
gatatactcacacgtaaaacggcac

SEQ ID NO: 66520 - DNA, 25 bp, E. coli
gatatactcacaggtaaaacggcac

SEQ ID NO: 66521 - DNA, 25 bp, E. coli
ggaacgctcaccgaaaaccaatggg

SEQ ID NO: 66522 - DNA, 25 bp, E. coli
ggaacgctcacccaaaaccaatggg

SEQ ID NO: 66523 - DNA, 25 bp, E. coli
gagcaaataagccaaaacccggaga

SEQ ID NO: 66524 - DNA, 25 bp, E. coli
gagcaaataagcgaaaacccggaga

SEQ ID NO: 66525 - DNA, 25 bp, E. coli
cagatttcgcaattccggcagcagg

SEQ ID NO: 66526 - DNA, 25 bp, E. coli
cagatggtgatcaaactagcaggta

SEQ ID NO: 66527 - DNA, 25 bp, E. coli
cagatttcgcaaatccggcagcagg

SEQ ID NO: 66528 - DNA, 25 bp, E. coli
cagatggtgatctaactagcaggta

SEQ ID NO: 66529 - DNA, 25 bp, E. coli
taaagccaatgcagctggtcttgcc

SEQ ID NO: 66530 - DNA, 25 bp, E. coli
taaagccaatgctgctggtcttgcc

SEQ ID NO: 66531 - DNA, 25 bp, E. coli
tggtgaaagtcaccagccgctgcct

SEQ ID NO: 66532 - DNA, 25 bp, E. coli
gcattatgcccaccgacggcagtgg

SEQ ID NO: 66533 - DNA, 25 bp, E. coli
gcgggtacctttgtcagtgagcaga

SEQ ID NO: 66534 - DNA, 25 bp, E. coli
gcattatgcccagcgacggcagtgg

SEQ ID NO: 66535 - DNA, 25 bp, E. coli
gcgggtacctttctcagtgagcaga

SEQ ID NO: 66536 - DNA, 25 bp, E. coli
gaaaactgaaacgtggcgcaaggct

SEQ ID NO: 66537 - DNA, 25 bp, E. coli
gaaaactgaaacctggcgcaaggct

SEQ ID NO: 66538 - DNA, 25 bp, E. coli
cgtgacattcgtccataaagccaat

SEQ ID NO: 66539 - DNA, 25 bp, E. coli
cgtgacattcgtgcataaagccaat

SEQ ID NO: 66540 - DNA, 25 bp, E. coli
ggattgagcagggacttacgcagca

SEQ ID NO: 66541 - DNA, 25 bp, E. coli
ggattgagcaggcacttacgcagca

SEQ ID NO: 66542 - DNA, 25 bp, E. coli
ggaaccatgtgctgtacccgtactg

SEQ ID NO: 66543 - DNA, 25 bp, E. coli
tggcactctctttagcgcgtaggta

SEQ ID NO: 66544 - DNA, 25 bp, E. coli
tggtgaaagtcagcagccgctgcct

SEQ ID NO: 66545 - DNA, 25 bp, E. coli
ggaaccatgtgcagtacccgtactg

SEQ ID NO: 66546 - DNA, 25 bp, E. coli
tggcactctcttaagcgcgtaggta

SEQ ID NO: 66547 - DNA, 25 bp, E. coli
cagcgtcgaagatacccgagtggtt

SEQ ID NO: 66548 - DNA, 25 bp, E. coli
caaagacgatcatggagcactggcc

SEQ ID NO: 66549 - DNA, 25 bp, E. coli
caaagacgatcaaggagcactggcc

SEQ ID NO: 66550 - DNA, 25 bp, E. coli
cagcgtcgaagaaacccgagtggtt

SEQ ID NO: 66551 - DNA, 25 bp, E. coli
atcatggagcacaggccaccgtaac

SEQ ID NO: 66552 - DNA, 25 bp, E. coli
gccaccgtaaccagcgtcgaagaaa

SEQ ID NO: 66553 - DNA, 25 bp, E. coli
atcatggagcactggccaccgtaac

SEQ ID NO: 66554 - DNA, 25 bp, E. coli
agacgatcatggagcactggccacc

SEQ ID NO: 66555 - DNA, 25 bp, E. coli
agggttatccgcttccctgtatgcg

SEQ ID NO: 66556 - DNA, 25 bp, E. coli
gccaccgtaacctgcgtcgaagaaa

SEQ ID NO: 66557 - DNA, 25 bp, E. coli
agacgatcatggtgcactggccacc

SEQ ID NO: 66558 - DNA, 25 bp, E. coli
agggttatccgcatccctgtatgcg

SEQ ID NO: 66559 - DNA, 25 bp, E. coli
actggccaccgtaaccagcgtcgaa

SEQ ID NO: 66560 - DNA, 25 bp, E. coli
actggccaccgttaccagcgtcgaa

SEQ ID NO: 66561 - DNA, 25 bp, E. coli
tatgcgggagggttatccgcatccc

SEQ ID NO: 66562 - DNA, 25 bp, E. coli
tatgcgggagggatatccgcatccc

SEQ ID NO: 66563 - DNA, 25 bp, E. coli
tttttatgcgggtgggttatccgca

SEQ ID NO: 66564 - DNA, 25 bp, E. coli
tttttatgcgggagggttatccgca

SEQ ID NO: 66565 - DNA, 25 bp, E. coli
cgggagggttatgcgcatccctgta

SEQ ID NO: 66566 - DNA, 25 bp, E. coli
cgggagggttatccgcatccctgta

SEQ ID NO: 66567 - DNA, 25 bp, E. coli
taaccagcgtcgaagaaacccgagt

SEQ ID NO: 66568 - DNA, 25 bp, E. coli
taaccagcgtcgtagaaacccgagt

SEQ ID NO: 66569 - DNA, 25 bp, E. coli
aaggtggcggagttcgaacgacaca

SEQ ID NO: 66570 - DNA, 25 bp, E. coli
aaggtggcggagatcgaacgacaca

SEQ ID NO: 66571 - DNA, 25 bp, E. coli
aggagctgcaatccatgcgcgacca

SEQ ID NO: 66572 - DNA, 25 bp, E. coli
agctgcaatccaagcgcgaccagct

SEQ ID NO: 66573 - DNA, 25 bp, E. coli
agctgcaatccatgcgcgaccagct

SEQ ID NO: 66574 - DNA, 25 bp, E. coli
aggagctgcaatgcatgcgcgacca

SEQ ID NO: 66575 - DNA, 25 bp, E. coli
ttgaggagctgctatccatgcgcga

SEQ ID NO: 66576 - DNA, 25 bp, E. coli
ttgaggagctgcaatccatgcgcga

SEQ ID NO: 66577 - DNA, 25 bp, E. coli
tgcgcgaccagcagctggcactggc

SEQ ID NO: 66578 - DNA, 25 bp, E. coli
tgcgcgaccagctgctggcactggc

SEQ ID NO: 66579 - DNA, 25 bp, E. coli
gacacattgaggtgctgcaatccat

SEQ ID NO: 66580 - DNA, 25 bp, E. coli
gacacattgaggagctgcaatccat

SEQ ID NO: 66581 - DNA, 25 bp, E. coli
cgaacgacacattgaggagctgcaa

SEQ ID NO: 66582 - DNA, 25 bp, E. coli
cgaacgacacatagaggagctgcaa

SEQ ID NO: 66583 - DNA, 25 bp, E. coli
cattgaggagctgcaatccatgcgc

SEQ ID NO: 66584 - DNA, 25 bp, E. coli
cattgaggagctccaatccatgcgc

SEQ ID NO: 66585 - DNA, 25 bp, E. coli
gatcgaacgacagattgaggagctg

SEQ ID NO: 66586 - DNA, 25 bp, E. coli
gatcgaacgacacattgaggagctg

SEQ ID NO: 66587 - DNA, 25 bp, E. coli
tggcggagatcgaacgacacattga

SEQ ID NO: 66588 - DNA, 25 bp, E. coli
tggcggagatcgtacgacacattga

SEQ ID NO: 66589 - DNA, 25 bp, E. coli
gagatcgaacgacacattgaggagc

SEQ ID NO: 66590 - DNA, 25 bp, E. coli
gagatcgaacgagacattgaggagc

SEQ ID NO: 66591 - DNA, 25 bp, E. coli
caaacgggacagatgaagagatcgc

SEQ ID NO: 66592 - DNA, 25 bp, E. coli
caaacctcttgctttgaaggcggcg

SEQ ID NO: 66593 - DNA, 25 bp, E. coli
caaacgggacagttgaagagatcgc

SEQ ID NO: 66594 - DNA, 25 bp, E. coli
caaacctcttgcattgaaggcggcg

SEQ ID NO: 66595 - DNA, 25 bp, E. coli
catatcgcggatacgaagagcttcc

SEQ ID NO: 66596 - DNA, 25 bp, E. coli
catatcgcggattcgaagagcttcc

SEQ ID NO: 66597 - DNA, 25 bp, E. coli
taaaggctgcacttcctcaatggcg

SEQ ID NO: 66598 - DNA, 25 bp, E. coli
taaaggctgcacatcctcaatggcg

SEQ ID NO: 66599 - DNA, 25 bp, E. coli
ttttgacgacaaccgaaagactggc

SEQ ID NO: 66600 - DNA, 25 bp, E. coli
ttttgacgacaagcgaaagactggc

SEQ ID NO: 66601 - DNA, 25 bp, E. coli
tcgaaatcgaccaagcaaacgggac

SEQ ID NO: 66602 - DNA, 25 bp, E. coli
tcgaaatcgacctagcaaacgggac

SEQ ID NO: 66603 - DNA, 25 bp, E. coli
gccgtaaggctcaacatcgacagga

SEQ ID NO: 66604 - DNA, 25 bp, E. coli
cctcaatggcgttaagtgcgtggca

SEQ ID NO: 66605 - DNA, 25 bp, E. coli
cctcaatggcgtaaagtgcgtggca

SEQ ID NO: 66606 - DNA, 25 bp, E. coli
gccgtaaggctctacatcgacagga

SEQ ID NO: 66607 - DNA, 25 bp, E. coli
gaatttgaagcacaagccgtaaggc

SEQ ID NO: 66608 - DNA, 25 bp, E. coli
gaatttgaagcagaagccgtaaggc

SEQ ID NO: 66609 - DNA, 25 bp, E. coli
gatgatgagatcaacactcgcctga

SEQ ID NO: 66610 - DNA, 25 bp, E. coli
gagatcgctgaatccctaaaggctg

SEQ ID NO: 66611 - DNA, 25 bp, E. coli
gatgatgagatctacactcgcctga

SEQ ID NO: 66612 - DNA, 25 bp, E. coli
gagatcgctgaaaccctaaaggctg

SEQ ID NO: 66613 - DNA, 25 bp, E. coli
caatcatcggctggacggtgagttt

SEQ ID NO: 66614 - DNA, 25 bp, E. coli
caatcatcggctcgacggtgagttt

SEQ ID NO: 66615 - DNA, 25 bp, E. coli
caaccggtctttacttgctcatcgt

SEQ ID NO: 66616 - DNA, 25 bp, E. coli
caaccggtcttttcttgctcatcgt

SEQ ID NO: 66617 - DNA, 25 bp, E. coli
catagggtggcatcgttcagcacga

SEQ ID NO: 66618 - DNA, 25 bp, E. coli
catagggtggcaacgttcagcacga

SEQ ID NO: 66619 - DNA, 25 bp, E. coli
acgttcagcacgatacgggtcataa

SEQ ID NO: 66620 - DNA, 25 bp, E. coli
acgttcagcacgttacgggtcataa

SEQ ID NO: 66621 - DNA, 25 bp, E. coli
aaattaatcttccatcacagaccgg

SEQ ID NO: 66622 - DNA, 25 bp, E. coli
aaattaatcttcgatcacagaccgg

SEQ ID NO: 66623 - DNA, 25 bp, E. coli
ttccatcacagaccggtcagtactg

SEQ ID NO: 66624 - DNA, 25 bp, E. coli
ttccatcacagagcggtcagtactg

SEQ ID NO: 66625 - DNA, 25 bp, E. coli
gcattgacgtcaatcatcggctcga

SEQ ID NO: 66626 - DNA, 25 bp, E. coli
gcattgacgtcattcatcggctcga

SEQ ID NO: 66627 - DNA, 25 bp, E. coli
gcatcatccgatagcattgacgtca

SEQ ID NO: 66628 - DNA, 25 bp, E. coli
gcatcatccgattgcattgacgtca

SEQ ID NO: 66629 - DNA, 25 bp, E. coli
gtcagtactgcctccaaccggtctt

SEQ ID NO: 66630 - DNA, 25 bp, E. coli
gtcagtactgccaccaaccggtctt

SEQ ID NO: 66631 - DNA, 25 bp, E. coli
tgttggtaacagttcgggaaacaag

SEQ ID NO: 66632 - DNA, 25 bp, E. coli
tgttggtaacagatcgggaaacaag

SEQ ID NO: 66633 - DNA, 25 bp, E. coli
taatcgcatcatagggtggcaacgt

SEQ ID NO: 66634 - DNA, 25 bp, E. coli
taatcgcatcattgggtggcaacgt

SEQ ID NO: 66635 - DNA, 25 bp, E. coli
catagtcagtatgggtattggtatc

SEQ ID NO: 66636 - DNA, 25 bp, E. coli
catagtcagtatcggtattggtatc

SEQ ID NO: 66637 - DNA, 25 bp, E. coli
attatggaacgcgtatatagaacag

SEQ ID NO: 66638 - DNA, 25 bp, E. coli
attatggaacgcctatatagaacag

SEQ ID NO: 66639 - DNA, 25 bp, E. coli
agctacgcgcagttgaactggcccg

SEQ ID NO: 66640 - DNA, 25 bp, E. coli
atggagcacttaattatggaacgcg

SEQ ID NO: 66641 - DNA, 25 bp, E. coli
agctacgcgcagatgaactggcccg

SEQ ID NO: 66642 - DNA, 25 bp, E. coli
atggagcacttatttatggaacgcg

SEQ ID NO: 66643 - DNA, 25 bp, E. coli
acgcccgcgctggttaaactgctgg

SEQ ID NO: 66644 - DNA, 25 bp, E. coli
aaataatatattggctcgggttgaa

SEQ ID NO: 66645 - DNA, 25 bp, E. coli
acgcccgcgctgcttaaactgctgg

SEQ ID NO: 66646 - DNA, 25 bp, E. coli
aaataatatattcgctcgggttgaa

SEQ ID NO: 66647 - DNA, 25 bp, E. coli
tattccgtccgcacaaagaacgcat

SEQ ID NO: 66648 - DNA, 25 bp, E. coli
tattccgtccgctcaaagaacgcat

SEQ ID NO: 66649 - DNA, 25 bp, E. coli
cgcagatgaactcgcccggtgtcat

SEQ ID NO: 66650 - DNA, 25 bp, E. coli
cccggcaggcttatatattgtttat

SEQ ID NO: 66651 - DNA, 25 bp, E. coli
cgcagatgaactggcccggtgtcat

SEQ ID NO: 66652 - DNA, 25 bp, E. coli
cccggcaggcttttatattgtttat

SEQ ID NO: 66653 - DNA, 25 bp, E. coli
ggtactcgccattgtcagtatgggt

SEQ ID NO: 66654 - DNA, 25 bp, E. coli
ggtactcgccatagtcagtatgggt

SEQ ID NO: 66655 - DNA, 25 bp, E. coli
tcaaagaacgcatcccggcaggctt

SEQ ID NO: 66656 - DNA, 25 bp, E. coli
tcaaagaacgcaacccggcaggctt

SEQ ID NO: 66657 - DNA, 25 bp, E. coli
taacaatggtttatagcatatgcct

SEQ ID NO: 66658 - DNA, 25 bp, E. coli
aaacaggcaaggtttgacgcaaact

SEQ ID NO: 66659 - DNA, 25 bp, E. coli
aaacaggcaaggattgacgcaaact

SEQ ID NO: 66660 - DNA, 25 bp, E. coli
tacgccgctgataattgcacctgtg

SEQ ID NO: 66661 - DNA, 25 bp, E. coli
tacgccgctgattattgcacctgtg

SEQ ID NO: 66662 - DNA, 25 bp, E. coli
tatacatcttcataaacaggcaagg

SEQ ID NO: 66663 - DNA, 25 bp, E. coli
tatcaatcactaaagagtgtgacag

SEQ ID NO: 66664 - DNA, 25 bp, E. coli
tatcaatcactatagagtgtgacag

SEQ ID NO: 66665 - DNA, 25 bp, E. coli
tatacatcttcaaaaacaggcaagg

SEQ ID NO: 66666 - DNA, 25 bp, E. coli
tgcggcgttaccaatacagagacaa

SEQ ID NO: 66667 - DNA, 25 bp, E. coli
tgcggcgttacctatacagagacaa

SEQ ID NO: 66668 - DNA, 25 bp, E. coli
tccgggaacaggttcgcaaaatggc

SEQ ID NO: 66669 - DNA, 25 bp, E. coli
tccgggaacaggatcgcaaaatggc

SEQ ID NO: 66670 - DNA, 25 bp, E. coli
cctgtggctaaagagaatatctgcg

SEQ ID NO: 66671 - DNA, 25 bp, E. coli
cctgtggctaaacagaatatctgcg

SEQ ID NO: 66672 - DNA, 25 bp, E. coli
gcaaactatgccagattagcccctg

SEQ ID NO: 66673 - DNA, 25 bp, E. coli
gcaaactatgcctgattagcccctg

SEQ ID NO: 66674 - DNA, 25 bp, E. coli
gcaaaatggcttgttgaacgcctgt

SEQ ID NO: 66675 - DNA, 25 bp, E. coli
gcaaaatggcttcttgaacgcctgt

SEQ ID NO: 66676 - DNA, 25 bp, E. coli
gacagaaatatgacttttttccggg

SEQ ID NO: 66677 - DNA, 25 bp, E. coli
gacagaaatatgtcttttttccggg

SEQ ID NO: 66678 - DNA, 25 bp, E. coli
taacaatggtttttagcatatgcct

SEQ ID NO: 66679 - DNA, 25 bp, E. coli
aattcgctccattaggcttatggta

SEQ ID NO: 66680 - DNA, 25 bp, E. coli
aattcgctccataaggcttatggta

SEQ ID NO: 66681 - DNA, 25 bp, E. coli
caaagatgcgaaaagtgtgacatgg

SEQ ID NO: 66682 - DNA, 25 bp, E. coli
caaagatgcgaatagtgtgacatgg

SEQ ID NO: 66683 - DNA, 25 bp, E. coli
cagagggtttatcaatgattgcgct

SEQ ID NO: 66684 - DNA, 25 bp, E. coli
catggaataaataagtggaatcgtt

SEQ ID NO: 66685 - DNA, 25 bp, E. coli
cagagggtttatgaatgattgcgct

SEQ ID NO: 66686 - DNA, 25 bp, E. coli
catggaataaattagtggaatcgtt

SEQ ID NO: 66687 - DNA, 25 bp, E. coli
atgcctgcatgcctcgaaccgttgg

SEQ ID NO: 66688 - DNA, 25 bp, E. coli
atgcctgcatgcgtcgaaccgttgg

SEQ ID NO: 66689 - DNA, 25 bp, E. coli
tgctaaggccgcctccggcaaggtc

SEQ ID NO: 66690 - DNA, 25 bp, E. coli
tgctaaggccgcgtccggcaaggtc

SEQ ID NO: 66691 - DNA, 25 bp, E. coli
tctgaaaaaagaggcggtttcatgc

SEQ ID NO: 66692 - DNA, 25 bp, E. coli
tctgaaaaaagacgcggtttcatgc

SEQ ID NO: 66693 - DNA, 25 bp, E. coli
gcgcgattaagtgattataaaacag

SEQ ID NO: 66694 - DNA, 25 bp, E. coli
gcgcgattaagtcattataaaacag

SEQ ID NO: 66695 - DNA, 25 bp, E. coli
gaatttagccgtattttatgcgcga

SEQ ID NO: 66696 - DNA, 25 bp, E. coli
gaatttagccgttttttatgcgcga

SEQ ID NO: 66697 - DNA, 25 bp, E. coli
gaatcgtttacagaagaatttagcc

SEQ ID NO: 66698 - DNA, 25 bp, E. coli
gaatcgtttacacaagaatttagcc

SEQ ID NO: 66699 - DNA, 25 bp, E. coli
taaccatagcattacaaagatgcga

SEQ ID NO: 66700 - DNA, 25 bp, E. coli
taaccatagcataacaaagatgcga

SEQ ID NO: 66701 - DNA, 25 bp, E. coli
aaggggcacaggtctatatccgcac

SEQ ID NO: 66702 - DNA, 25 bp, E. coli
aaggggcacaggactatatccgcac

SEQ ID NO: 66703 - DNA, 25 bp, E. coli
aggggcacaggactatatccgcact

SEQ ID NO: 66704 - DNA, 25 bp, E. coli
aggggcacaggagtatatccgcact

SEQ ID NO: 66705 - DNA, 25 bp, E. coli
tatccgcactcagtgcctgaactaa

SEQ ID NO: 66706 - DNA, 25 bp, E. coli
tatccgcactcactgcctgaactaa

SEQ ID NO: 66707 - DNA, 25 bp, E. coli
ttgatgacaatgcagaagcagctgg

SEQ ID NO: 66708 - DNA, 25 bp, E. coli
ttgatgacaatggagaagcagctgg

SEQ ID NO: 66709 - DNA, 25 bp, E. coli
gaaggggcacagcactatatccgca

SEQ ID NO: 66710 - DNA, 25 bp, E. coli
gaaggggcacaggactatatccgca

SEQ ID NO: 66711 - DNA, 25 bp, E. coli
gttgatgacaatccagaagcagctg

SEQ ID NO: 66712 - DNA, 25 bp, E. coli
gttgatgacaatgcagaagcagctg

SEQ ID NO: 66713 - DNA, 25 bp, E. coli
ggaaggggcacaggactatatccgc

SEQ ID NO: 66714 - DNA, 25 bp, E. coli
gggcacaggactatatccgcactca

SEQ ID NO: 66715 - DNA, 25 bp, E. coli
ggggcacaggacaatatccgcactc

SEQ ID NO: 66716 - DNA, 25 bp, E. coli
ggttgatgacaaagcagaagcagct

SEQ ID NO: 66717 - DNA, 25 bp, E. coli
ggttgatgacaatgcagaagcagct

SEQ ID NO: 66718 - DNA, 25 bp, E. coli
ggggcacaggactatatccgcactc

SEQ ID NO: 66719 - DNA, 25 bp, E. coli
gggcacaggactttatccgcactca

SEQ ID NO: 66720 - DNA, 25 bp, E. coli
ggcacaggactatatccgcactcag

SEQ ID NO: 66721 - DNA, 25 bp, E. coli
ggcacaggactaaatccgcactcag

SEQ ID NO: 66722 - DNA, 25 bp, E. coli
ggaaggggcacacgactatatccgc

SEQ ID NO: 66723 - DNA, 25 bp, E. coli
caccggacgcgctgcgatcttttat

SEQ ID NO: 66724 - DNA, 25 bp, E. coli
cacgcgtaactagcagcgaagctat

SEQ ID NO: 66725 - DNA, 25 bp, E. coli
caccggacgcgcagcgatcttttat

SEQ ID NO: 66726 - DNA, 25 bp, E. coli
cacgcgtaactaccagcgaagctat

SEQ ID NO: 66727 - DNA, 25 bp, E. coli
acgtggcgattattggcctcggccc

SEQ ID NO: 66728 - DNA, 25 bp, E. coli
acgtggcgattaatggcctcggccc

SEQ ID NO: 66729 - DNA, 25 bp, E. coli
aaagatggaacaattcgacgtggcg

SEQ ID NO: 66730 - DNA, 25 bp, E. coli
aaagatggaacatttcgacgtggcg

SEQ ID NO: 66731 - DNA, 25 bp, E. coli
tagtaaaaagccgatgcctgaccgc

SEQ ID NO: 66732 - DNA, 25 bp, E. coli
tagtaaaaagcccatgcctgaccgc

SEQ ID NO: 66733 - DNA, 25 bp, E. coli
tcatggagtatcagcaaagacggtt

SEQ ID NO: 66734 - DNA, 25 bp, E. coli
tcatggagtatctgcaaagacggtt

SEQ ID NO: 66735 - DNA, 25 bp, E. coli
gcgggatttatcagcgccagctcgc

SEQ ID NO: 66736 - DNA, 25 bp, E. coli
gcgggatttatctgcgccagctcgc

SEQ ID NO: 66737 - DNA, 25 bp, E. coli
gcaaactgcgttaaaaactcttcgg

SEQ ID NO: 66738 - DNA, 25 bp, E. coli
gcaaactgcgtttaaaactcttcgg

SEQ ID NO: 66739 - DNA, 25 bp, E. coli
ggatgaaatcgcagatccccgccag

SEQ ID NO: 66740 - DNA, 25 bp, E. coli
ggatgaaatcgctgatccccgccag

SEQ ID NO: 66741 - DNA, 25 bp, E. coli
taatcgccatgcattcgacttgtgg

SEQ ID NO: 66742 - DNA, 25 bp, E. coli
taatcgccatgctttcgacttgtgg

SEQ ID NO: 66743 - DNA, 25 bp, E. coli
gagaaacatccgctgccgttctact

SEQ ID NO: 66744 - DNA, 25 bp, E. coli
gagaaacatccggtgccgttctact

SEQ ID NO: 66745 - DNA, 25 bp, E. coli
caggatccgcagctttatgccgaca

SEQ ID NO: 66746 - DNA, 25 bp, E. coli
caggatccgcaggtttatgccgaca

SEQ ID NO: 66747 - DNA, 25 bp, E. coli
tactataagcgtatcggcgaggcga

SEQ ID NO: 66748 - DNA, 25 bp, E. coli
tactataagcgtttcggcgaggcga

SEQ ID NO: 66749 - DNA, 25 bp, E. coli
tacgcacagcgttttcagagtgaaa

SEQ ID NO: 66750 - DNA, 25 bp, E. coli
agcaacatgactgggatcgagcggc

SEQ ID NO: 66751 - DNA, 25 bp, E. coli
agcaacatgactcggatcgagcggc

SEQ ID NO: 66752 - DNA, 25 bp, E. coli
tacgcacagcgtattcagagtgaaa

SEQ ID NO: 66753 - DNA, 25 bp, E. coli
tagcctggcaaaccaagttgtggtc

SEQ ID NO: 66754 - DNA, 25 bp, E. coli
tagcctggcaaagcaagttgtggtc

SEQ ID NO: 66755 - DNA, 25 bp, E. coli
tatcaggtgcggattctggagcaac

SEQ ID NO: 66756 - DNA, 25 bp, E. coli
tattagcgaagcgtctggaactggt

SEQ ID NO: 66757 - DNA, 25 bp, E. coli
tattagcgaagcctctggaactggt

SEQ ID NO: 66758 - DNA, 25 bp, E. coli
tatcaggtgcggtttctggagcaac

SEQ ID NO: 66759 - DNA, 25 bp, E. coli
gaaaagccgctttggactgcctatt

SEQ ID NO: 66760 - DNA, 25 bp, E. coli
gacagtttccgcaaggtggagcact

SEQ ID NO: 66761 - DNA, 25 bp, E. coli
gacagtttccgctaggtggagcact

SEQ ID NO: 66762 - DNA, 25 bp, E. coli
gaaagccgcgtgttattgcgtcagg

SEQ ID NO: 66763 - DNA, 25 bp, E. coli
gaaaagccgcttaggactgcctatt

SEQ ID NO: 66764 - DNA, 25 bp, E. coli
gaaagccgcgtgatattgcgtcagg

SEQ ID NO: 66765 - DNA, 25 bp, E. coli
gatgcgtgaatcttactccagtgaa

SEQ ID NO: 66766 - DNA, 25 bp, E. coli
gatgcgtgaatcatactccagtgaa

SEQ ID NO: 66767 - DNA, 25 bp, E. coli
tatccgcagtcatgatgatccggcg

SEQ ID NO: 66768 - DNA, 25 bp, E. coli
tatccgcagtcaagatgatccggcg

SEQ ID NO: 66769 - DNA, 25 bp, E. coli
tgtcctttatcacgccacaggcggg

SEQ ID NO: 66770 - DNA, 25 bp, E. coli
tgtcctttatcaggccacaggcggg

SEQ ID NO: 66771 - DNA, 25 bp, E. coli
tgtttaagctgagcaataagccggt

SEQ ID NO: 66772 - DNA, 25 bp, E. coli
tgtttaagctgaccaataagccggt

SEQ ID NO: 66773 - DNA, 25 bp, E. coli
tgctttataacgaatcgcggccggg

SEQ ID NO: 66774 - DNA, 25 bp, E. coli
tgaaaccaccctgaatgccattgcg

SEQ ID NO: 66775 - DNA, 25 bp, E. coli
tgctttataacgtatcgcggccggg

SEQ ID NO: 66776 - DNA, 25 bp, E. coli
tgaaaccaccctcaatgccattgcg

SEQ ID NO: 66777 - DNA, 25 bp, E. coli
gaagctgatgaacccgaactcctga

SEQ ID NO: 66778 - DNA, 25 bp, E. coli
gaagctgatgaagccgaactcctga

SEQ ID NO: 66779 - DNA, 25 bp, E. coli
gacacaacaggatatcagccagcgc

SEQ ID NO: 66780 - DNA, 25 bp, E. coli
gaaacggtgccggagttgctgtcca

SEQ ID NO: 66781 - DNA, 25 bp, E. coli
gaaacggtgccgcagttgctgtcca

SEQ ID NO: 66782 - DNA, 25 bp, E. coli
gacacaacaggaaatcagccagcgc

SEQ ID NO: 66783 - DNA, 25 bp, E. coli
gacggaccggtacaactgatgctga

SEQ ID NO: 66784 - DNA, 25 bp, E. coli
gacggaccggtagaactgatgctga

SEQ ID NO: 66785 - DNA, 25 bp, E. coli
gatcaggattgttcccaaaacgccg

SEQ ID NO: 66786 - DNA, 25 bp, E. coli
gattttgaagttcgcagcccgctga

SEQ ID NO: 66787 - DNA, 25 bp, E. coli
gattttgaagttggcagcccgctga

SEQ ID NO: 66788 - DNA, 25 bp, E. coli
gatcaggattgtacccaaaacgccg

SEQ ID NO: 66789 - DNA, 25 bp, E. coli
aagagtgttggtcccttgcgctccc

SEQ ID NO: 66790 - DNA, 25 bp, E. coli
aacggatgtttctgccgatacgcgg

SEQ ID NO: 66791 - DNA, 25 bp, E. coli
catttccgttagagaatcgcctggc

SEQ ID NO: 66792 - DNA, 25 bp, E. coli
catttccgttagtgaatcgcctggc

SEQ ID NO: 66793 - DNA, 25 bp, E. coli
tacattgtgcagcaagggcaacagc

SEQ ID NO: 66794 - DNA, 25 bp, E. coli
taaattctccgggatgatgcagtaa

SEQ ID NO: 66795 - DNA, 25 bp, E. coli
taaattctccggcatgatgcagtaa

SEQ ID NO: 66796 - DNA, 25 bp, E. coli
tacattgtgcaggaagggcaacagc

SEQ ID NO: 66797 - DNA, 25 bp, E. coli
aagagtgttggtgccttgcgctccc

SEQ ID NO: 66798 - DNA, 25 bp, E. coli
aacggatgtttcagccgatacgcgg

SEQ ID NO: 66799 - DNA, 25 bp, E. coli
tacgcaagcggctgagtatttaggc

SEQ ID NO: 66800 - DNA, 25 bp, E. coli
tacgcaagcggcagagtatttaggc

SEQ ID NO: 66801 - DNA, 25 bp, E. coli
tatcacgaaaaggatacgcaagcgg

SEQ ID NO: 66802 - DNA, 25 bp, E. coli
tatcacgaaaagcatacgcaagcgg

SEQ ID NO: 66803 - DNA, 25 bp, E. coli
tttttagcgcgtgactacattgtgc

SEQ ID NO: 66804 - DNA, 25 bp, E. coli
tttttagcgcgtcactacattgtgc

SEQ ID NO: 66805 - DNA, 25 bp, E. coli
tcctggctgtttaacctgacgcgag

SEQ ID NO: 66806 - DNA, 25 bp, E. coli
tcctggctgttttacctgacgcgag

SEQ ID NO: 66807 - DNA, 25 bp, E. coli
ctaatggtcgcgtgtcgctgatcga

SEQ ID NO: 66808 - DNA, 25 bp, E. coli
ctaatggtcgcgagtcgctgatcga

SEQ ID NO: 66809 - DNA, 25 bp, E. coli
gagatggacccgcagaataaattct

SEQ ID NO: 66810 - DNA, 25 bp, E. coli
gagatggacccggagaataaattct

SEQ ID NO: 66811 - DNA, 25 bp, E. coli
caatatgatgcagccgcagctggcg

SEQ ID NO: 66812 - DNA, 25 bp, E. coli
caatatgatgcacccgcagctggcg

SEQ ID NO: 66813 - DNA, 25 bp, E. coli
actgtactggaaggtctgctgcgcc

SEQ ID NO: 66814 - DNA, 25 bp, E. coli
actgtactggaacgtctgctgcgcc

SEQ ID NO: 66815 - DNA, 25 bp, E. coli
tacccagatggtggttgagcgcaag

SEQ ID NO: 66816 - DNA, 25 bp, E. coli
tacccagatggtcgttgagcgcaag

SEQ ID NO: 66817 - DNA, 25 bp, E. coli
tccgtgcagaaaagaacatcgcgcc

SEQ ID NO: 66818 - DNA, 25 bp, E. coli
tccgtgcagaaatgaacatcgcgcc

SEQ ID NO: 66819 - DNA, 25 bp, E. coli
tctgtaacaagcagtggaacgccag

SEQ ID NO: 66820 - DNA, 25 bp, E. coli
tctgtaacaagctgtggaacgccag

SEQ ID NO: 66821 - DNA, 25 bp, E. coli
gaagacctgatttaccgtggcaaac

SEQ ID NO: 66822 - DNA, 25 bp, E. coli
gaagacctgattaaccgtggcaaac

SEQ ID NO: 66823 - DNA, 25 bp, E. coli
gaacagccgctttacgagcactggg

SEQ ID NO: 66824 - DNA, 25 bp, E. coli
gaaagtttctgcatcatgatcccgc

SEQ ID NO: 66825 - DNA, 25 bp, E. coli
gaaaccatctggcagcgtgtgaaag

SEQ ID NO: 66826 - DNA, 25 bp, E. coli
gaaagtttctgcttcatgatcccgc

SEQ ID NO: 66827 - DNA, 25 bp, E. coli
gaacagccgcttaacgagcactggg

SEQ ID NO: 66828 - DNA, 25 bp, E. coli
gaaaccatctgggagcgtgtgaaag

SEQ ID NO: 66829 - DNA, 25 bp, E. coli
gatatccgtgaatgcgcccaggtgt

SEQ ID NO: 66830 - DNA, 25 bp, E. coli
gatatccgtgaaagcgcccaggtgt

SEQ ID NO: 66831 - DNA, 25 bp, E. coli
tcagcgcatgcacggcaaaaacacc

SEQ ID NO: 66832 - DNA, 25 bp, E. coli
tcagcgcatgcagggcaaaaacacc

SEQ ID NO: 66833 - DNA, 25 bp, E. coli
tacaacggcaacgagctgatctacg

SEQ ID NO: 66834 - DNA, 25 bp, E. coli
tacaacggcaaccagctgatctacg

SEQ ID NO: 66835 - DNA, 25 bp, E. coli
tatgtaggctggaacaactatgccg

SEQ ID NO: 66836 - DNA, 25 bp, E. coli
tatggatgtgactctgaacaacggc

SEQ ID NO: 66837 - DNA, 25 bp, E. coli
tatggatgtgacactgaacaacggc

SEQ ID NO: 66838 - DNA, 25 bp, E. coli
tatgtaggctggtacaactatgccg

SEQ ID NO: 66839 - DNA, 25 bp, E. coli
tatagcaacacggtgactgcagacg

SEQ ID NO: 66840 - DNA, 25 bp, E. coli
tattacaacggcgatatctacccgg

SEQ ID NO: 66841 - DNA, 25 bp, E. coli
tattacaacggccatatctacccgg

SEQ ID NO: 66842 - DNA, 25 bp, E. coli
tatagcaacacgctgactgcagacg

SEQ ID NO: 66843 - DNA, 25 bp, E. coli
tgactactgattctgctgatgaccg

SEQ ID NO: 66844 - DNA, 25 bp, E. coli
tgactactgattgtgctgatgaccg

SEQ ID NO: 66845 - DNA, 25 bp, E. coli
tcagttcgatgcaaacccgttccag

SEQ ID NO: 66846 - DNA, 25 bp, E. coli
tcagttcgatgctaacccgttccag

SEQ ID NO: 66847 - DNA, 25 bp, E. coli
cctgaacatcggagaagacggtcat

SEQ ID NO: 66848 - DNA, 25 bp, E. coli
cctgaacatcggtgaagacggtcat

SEQ ID NO: 66849 - DNA, 25 bp, E. coli
gcctgtggccttgatcaactgtcgg

SEQ ID NO: 66850 - DNA, 25 bp, E. coli
gcctgtggccttcatcaactgtcgg

SEQ ID NO: 66851 - DNA, 25 bp, E. coli
gatattgcagcttacagcctgtggc

SEQ ID NO: 66852 - DNA, 25 bp, E. coli
gatattgcagctaacagcctgtggc

SEQ ID NO: 66853 - DNA, 25 bp, E. coli
gatgaaaacttcatcccgcaaggtg

SEQ ID NO: 66854 - DNA, 25 bp, E. coli
gatgaaaacttcttcccgcaaggtg

SEQ ID NO: 66855 - DNA, 25 bp, E. coli
tacggcttatattgagtcctcttcc

SEQ ID NO: 66856 - DNA, 25 bp, E. coli
tacggcttatatagagtcctcttcc

SEQ ID NO: 66857 - DNA, 25 bp, E. coli
aacattccggtgagtctgcgtgtgg

SEQ ID NO: 66858 - DNA, 25 bp, E. coli
aacattccggtgtgtctgcgtgtgg

SEQ ID NO: 66859 - DNA, 25 bp, E. coli
tattgagtcctcttccggcgtatcg

SEQ ID NO: 66860 - DNA, 25 bp, E. coli
tattgagtcctcatccggcgtatcg

SEQ ID NO: 66861 - DNA, 25 bp, E. coli
tatattgagtcctcttccggcgtat

SEQ ID NO: 66862 - DNA, 25 bp, E. coli
tatattgagtccacttccggcgtat

SEQ ID NO: 66863 - DNA, 25 bp, E. coli
ttgagtcctcttgcggcgtatcggt

SEQ ID NO: 66864 - DNA, 25 bp, E. coli
ttgagtcctcttccggcgtatcggt

SEQ ID NO: 66865 - DNA, 25 bp, E. coli
gccaacattccgctgagtctgcgtg

SEQ ID NO: 66866 - DNA, 25 bp, E. coli
gccaacattccggtgagtctgcgtg

SEQ ID NO: 66867 - DNA, 25 bp, E. coli
gcttatattgagacctcttccggcg

SEQ ID NO: 66868 - DNA, 25 bp, E. coli
tcctcttccggcctatcggttggcg

SEQ ID NO: 66869 - DNA, 25 bp, E. coli
gcttatattgagtcctcttccggcg

SEQ ID NO: 66870 - DNA, 25 bp, E. coli
tcctcttccggcgtatcggttggcg

SEQ ID NO: 66871 - DNA, 25 bp, E. coli
ctcttccggcgtatcggttggcggt

SEQ ID NO: 66872 - DNA, 25 bp, E. coli
cttccgttacgggttatattgagtc

SEQ ID NO: 66873 - DNA, 25 bp, E. coli
ccgttacggcttttattgagtcctc

SEQ ID NO: 66874 - DNA, 25 bp, E. coli
ctcttccggcgtttcggttggcggt

SEQ ID NO: 66875 - DNA, 25 bp, E. coli
ccgttacggcttatattgagtcctc

SEQ ID NO: 66876 - DNA, 25 bp, E. coli
cttccgttacggcttatattgagtc

SEQ ID NO: 66877 - DNA, 25 bp, E. coli
atttgcgcatgaccgacaccatcga

SEQ ID NO: 66878 - DNA, 25 bp, E. coli
atttgcgcatgagcgacaccatcga

SEQ ID NO: 66879 - DNA, 25 bp, E. coli
aaacctgtttgcgatcctcggcctg

SEQ ID NO: 66880 - DNA, 25 bp, E. coli
aaacctgtttgccatcctcggcctg

SEQ ID NO: 66881 - DNA, 25 bp, E. coli
tatgctggctatggacctgttgttg

SEQ ID NO: 66882 - DNA, 25 bp, E. coli
tatgctggctatcgacctgttgttg

SEQ ID NO: 66883 - DNA, 25 bp, E. coli
tttaccggcgtgaagatggcgctcg

SEQ ID NO: 66884 - DNA, 25 bp, E. coli
tttaccggcgtgtagatggcgctcg

SEQ ID NO: 66885 - DNA, 25 bp, E. coli
ccatgaccatgaaacaggctgcggc

SEQ ID NO: 66886 - DNA, 25 bp, E. coli
ccatgaccatgatacaggctgcggc

SEQ ID NO: 66887 - DNA, 25 bp, E. coli
gaatactgtcggcacgccgttgcta

SEQ ID NO: 66888 - DNA, 25 bp, E. coli
gaatactgtcgggacgccgttgcta

SEQ ID NO: 66889 - DNA, 25 bp, E. coli
cgctggcggtcgataacgtctttgt

SEQ ID NO: 66890 - DNA, 25 bp, E. coli
cgctggcggtcgttaacgtctttgt

SEQ ID NO: 66891 - DNA, 25 bp, E. coli
gtatatcttcggtgccttcctgctg

SEQ ID NO: 66892 - DNA, 25 bp, E. coli
gtatatcttcggagccttcctgctg

SEQ ID NO: 66893 - DNA, 25 bp, E. coli
ggcgctcgcccaagaagatgaatca

SEQ ID NO: 66894 - DNA, 25 bp, E. coli
ggcgctcgcccatgaagatgaatca

SEQ ID NO: 66895 - DNA, 25 bp, E. coli
tcaacgcctgggtgaattatcggca

SEQ ID NO: 66896 - DNA, 25 bp, E. coli
tcaacgcctgggagaattatcggca

SEQ ID NO: 66897 - DNA, 25 bp, E. coli
gatgaatcaggcattggcgacaagc

SEQ ID NO: 66898 - DNA, 25 bp, E. coli
gatgaatcaggctttggcgacaagc

SEQ ID NO: 66899 - DNA, 25 bp, E. coli
cagcgaggcgctacgcgatcgttat

SEQ ID NO: 66900 - DNA, 25 bp, E. coli
cagcgaggcgcttcgcgatcgttat

SEQ ID NO: 66901 - DNA, 25 bp, E. coli
aggcgcttcgcgttcgttatgattt

SEQ ID NO: 66902 - DNA, 25 bp, E. coli
aggcgcttcgcgatcgttatgattt

SEQ ID NO: 66903 - DNA, 25 bp, E. coli
ttcagcgaggcgcttcgcgatcgtt

SEQ ID NO: 66904 - DNA, 25 bp, E. coli
ttcagcgaggcggttcgcgatcgtt

SEQ ID NO: 66905 - DNA, 25 bp, E. coli
tcgcgatcgttaagattttatgaaa

SEQ ID NO: 66906 - DNA, 25 bp, E. coli
tcgcgatcgttatgattttatgaaa

SEQ ID NO: 66907 - DNA, 25 bp, E. coli
tcagcgaggcgcatcgcgatcgtta

SEQ ID NO: 66908 - DNA, 25 bp, E. coli
tcagcgaggcgcttcgcgatcgtta

SEQ ID NO: 66909 - DNA, 25 bp, E. coli
gcgcttcgcgatggttatgatttta

SEQ ID NO: 66910 - DNA, 25 bp, E. coli
gcgcttcgcgatcgttatgatttta

SEQ ID NO: 66911 - DNA, 25 bp, E. coli
gcttcgcgatcgttatgattttatg

SEQ ID NO: 66912 - DNA, 25 bp, E. coli
gcttcgcgatcgatatgattttatg

SEQ ID NO: 66913 - DNA, 25 bp, E. coli
cgcttcgcgatccttatgattttat

SEQ ID NO: 66914 - DNA, 25 bp, E. coli
cgcttcgcgatcgttatgattttat

SEQ ID NO: 66915 - DNA, 25 bp, E. coli
cttcgcgatcgtaatgattttatga

SEQ ID NO: 66916 - DNA, 25 bp, E. coli
cttcgcgatcgttatgattttatga

SEQ ID NO: 66917 - DNA, 25 bp, E. coli
ggcgcttcgcgatcgttatgatttt

SEQ ID NO: 66918 - DNA, 25 bp, E. coli
ggcgcttcgcgaacgttatgatttt

SEQ ID NO: 66919 - DNA, 25 bp, E. coli
gaggcgcttcgcgatcgttatgatt

SEQ ID NO: 66920 - DNA, 25 bp, E. coli
gaggcgcttcgccatcgttatgatt

SEQ ID NO: 66921 - DNA, 25 bp, E. coli
catttcacggattcaacgggcatcg

SEQ ID NO: 66922 - DNA, 25 bp, E. coli
catttcacggatacaacgggcatcg

SEQ ID NO: 66923 - DNA, 25 bp, E. coli
cagggctgcgcggagttcttcaata

SEQ ID NO: 66924 - DNA, 25 bp, E. coli
cagggctgcgcgcagttcttcaata

SEQ ID NO: 66925 - DNA, 25 bp, E. coli
tatccggcagagagggataacctcc

SEQ ID NO: 66926 - DNA, 25 bp, E. coli
tatccggcagagtgggataacctcc

SEQ ID NO: 66927 - DNA, 25 bp, E. coli
tcttcagtgtaaaaccatgtgccgg

SEQ ID NO: 66928 - DNA, 25 bp, E. coli
tcttcagtgtaataccatgtgccgg

SEQ ID NO: 66929 - DNA, 25 bp, E. coli
tcggtgatgttttccctgtaatgcg

SEQ ID NO: 66930 - DNA, 25 bp, E. coli
tcggtgatgtttaccctgtaatgcg

SEQ ID NO: 66931 - DNA, 25 bp, E. coli
gccggatgtccccttggccagaaaa

SEQ ID NO: 66932 - DNA, 25 bp, E. coli
gccggatgtcccgttggccagaaaa

SEQ ID NO: 66933 - DNA, 25 bp, E. coli
gcgtggtttccagcatcatatgatg

SEQ ID NO: 66934 - DNA, 25 bp, E. coli
gcgtggtttccaccatcatatgatg

SEQ ID NO: 66935 - DNA, 25 bp, E. coli
gaaaacgcatttaccaggcttctgg

SEQ ID NO: 66936 - DNA, 25 bp, E. coli
gaaaacgcattttccaggcttctgg

SEQ ID NO: 66937 - DNA, 25 bp, E. coli
cgaagccacgcgtcagtgactgcaa

SEQ ID NO: 66938 - DNA, 25 bp, E. coli
cgaagccacgcgacagtgactgcaa

SEQ ID NO: 66939 - DNA, 25 bp, E. coli
gataacctccacatcatccgggtgc

SEQ ID NO: 66940 - DNA, 25 bp, E. coli
gataacctccacttcatccgggtgc

SEQ ID NO: 66941 - DNA, 25 bp, E. coli
gatgcatatgcagcatccgggccag

SEQ ID NO: 66942 - DNA, 25 bp, E. coli
gatgcatatgcaccatccgggccag

SEQ ID NO: 66943 - DNA, 25 bp, E. coli
caaggaagatttactgcgtcgcagc

SEQ ID NO: 66944 - DNA, 25 bp, E. coli
caaggaagattttctgcgtcgcagc

SEQ ID NO: 66945 - DNA, 25 bp, E. coli
tactggcctggtagcaatcacaaag

SEQ ID NO: 66946 - DNA, 25 bp, E. coli
tactggcctggttgcaatcacaaag

SEQ ID NO: 66947 - DNA, 25 bp, E. coli
aaatatttggtcttgaggcgggcgc

SEQ ID NO: 66948 - DNA, 25 bp, E. coli
aaatatttggtcatgaggcgggcgc

SEQ ID NO: 66949 - DNA, 25 bp, E. coli
tacgccagcgacgagaagatatccc

SEQ ID NO: 66950 - DNA, 25 bp, E. coli
tacgccagcgaccagaagatatccc

SEQ ID NO: 66951 - DNA, 25 bp, E. coli
ttaatgtcgcagttaccggtgccga

SEQ ID NO: 66952 - DNA, 25 bp, E. coli
ttaatgtcgcagataccggtgccga

SEQ ID NO: 66953 - DNA, 25 bp, E. coli
tgtgcaggcttagcagaaacgttgt

SEQ ID NO: 66954 - DNA, 25 bp, E. coli
tgtgcaggcttaccagaaacgttgt

SEQ ID NO: 66955 - DNA, 25 bp, E. coli
tgaacaaacgctcacgctggctggt

SEQ ID NO: 66956 - DNA, 25 bp, E. coli
tgaacaaacgctgacgctggctggt

SEQ ID NO: 66957 - DNA, 25 bp, E. coli
tctgcaacaggataatggcccggtg

SEQ ID NO: 66958 - DNA, 25 bp, E. coli
tctgcaacaggaaaatggcccggtg

SEQ ID NO: 66959 - DNA, 25 bp, E. coli
gcgtcgcagcgaagaacatctgttt

SEQ ID NO: 66960 - DNA, 25 bp, E. coli
gcgtcgcagcgatgaacatctgttt

SEQ ID NO: 66961 - DNA, 25 bp, E. coli
gaattgccgtgtaattgcagcgacc

SEQ ID NO: 66962 - DNA, 25 bp, E. coli
gaattgccgtgttattgcagcgacc

SEQ ID NO: 66963 - DNA, 25 bp, E. coli
gatatgctgcgagaaacggaaggcc

SEQ ID NO: 66964 - DNA, 25 bp, E. coli
gatatgctgcgacaaacggaaggcc

SEQ ID NO: 66965 - DNA, 25 bp, E. coli
aatgtcattaattggtctgcgcgcg

SEQ ID NO: 66966 - DNA, 25 bp, E. coli
aatgtcattaataggtctgcgcgcg

SEQ ID NO: 66967 - DNA, 25 bp, E. coli
tattcccgttaaagcagcaaagccg

SEQ ID NO: 66968 - DNA, 25 bp, E. coli
tattcccgttaatgcagcaaagccg

SEQ ID NO: 66969 - DNA, 25 bp, E. coli
tgcccaaaatctcgagaaagctcgc

SEQ ID NO: 66970 - DNA, 25 bp, E. coli
tcactgggctttgcgcgtaaaacgc

SEQ ID NO: 66971 - DNA, 25 bp, E. coli
tcactgggctttccgcgtaaaacgc

SEQ ID NO: 66972 - DNA, 25 bp, E. coli
tgcccaaaatctggagaaagctcgc

SEQ ID NO: 66973 - DNA, 25 bp, E. coli
ccaataaccggatggtgaccagctg

SEQ ID NO: 66974 - DNA, 25 bp, E. coli
ccaataaccggaaggtgaccagctg

SEQ ID NO: 66975 - DNA, 25 bp, E. coli
gaaagcaggctttatgaccacggtg

SEQ ID NO: 66976 - DNA, 25 bp, E. coli
gaaagcaggcttaatgaccacggtg

SEQ ID NO: 66977 - DNA, 25 bp, E. coli
gaaagctcgctatggatattcccgt

SEQ ID NO: 66978 - DNA, 25 bp, E. coli
gaaagctcgctaaggatattcccgt

SEQ ID NO: 66979 - DNA, 25 bp, E. coli
cgatgcgcctgaatggtttaaccgg

SEQ ID NO: 66980 - DNA, 25 bp, E. coli
cgatgcgcctgattggtttaaccgg

SEQ ID NO: 66981 - DNA, 25 bp, E. coli
cccaggaaaaaggaatcacggcgct

SEQ ID NO: 66982 - DNA, 25 bp, E. coli
cccaggaaaaagcaatcacggcgct

SEQ ID NO: 66983 - DNA, 25 bp, E. coli
gtttaaggtttaacagccgccgcgc

SEQ ID NO: 66984 - DNA, 25 bp, E. coli
gtttaaggtttatcagccgccgcgc

SEQ ID NO: 66985 - DNA, 25 bp, E. coli
tggttcccggaacatgaacgcgctt

SEQ ID NO: 66986 - DNA, 25 bp, E. coli
tggttcccggaagatgaacgcgctt

SEQ ID NO: 66987 - DNA, 25 bp, E. coli
aagcgattattgagctggccgcgca

SEQ ID NO: 66988 - DNA, 25 bp, E. coli
aagcgattattgtgctggccgcgca

SEQ ID NO: 66989 - DNA, 25 bp, E. coli
cagcaggcgcaaaagctggcgcgtc

SEQ ID NO: 66990 - DNA, 25 bp, E. coli
cagcaggcgcaatagctggcgcgtc

SEQ ID NO: 66991 - DNA, 25 bp, E. coli
agtattcgtcctcttggtcaacggc

SEQ ID NO: 66992 - DNA, 25 bp, E. coli
agtattcgtcctgttggtcaacggc

SEQ ID NO: 66993 - DNA, 25 bp, E. coli
tttgttgcccaggtacgcattgccg

SEQ ID NO: 66994 - DNA, 25 bp, E. coli
tatttatgcactctcgcgatgccca

SEQ ID NO: 66995 - DNA, 25 bp, E. coli
tttgttgcccagctacgcattgccg

SEQ ID NO: 66996 - DNA, 25 bp, E. coli
tatttatgcactgtcgcgatgccca

SEQ ID NO: 66997 - DNA, 25 bp, E. coli
ttttcgacgccgcaagagcaggaac

SEQ ID NO: 66998 - DNA, 25 bp, E. coli
ttttcgacgccggaagagcaggaac

SEQ ID NO: 66999 - DNA, 25 bp, E. coli
gaatgtggtctccactttaaccgca

SEQ ID NO: 67000 - DNA, 25 bp, E. coli
gaatgtggtctcgactttaaccgca

SEQ ID NO: 67001 - DNA, 25 bp, E. coli
cgcaatttgcgaaagaccgtgatga

SEQ ID NO: 67002 - DNA, 25 bp, E. coli
cgcaatttgcgatagaccgtgatga

SEQ ID NO: 67003 - DNA, 25 bp, E. coli
cgatgcccacgagcggtttatgaca

SEQ ID NO: 67004 - DNA, 25 bp, E. coli
cgatgcccacgaccggtttatgaca

SEQ ID NO: 67005 - DNA, 25 bp, E. coli
gagccgtggctgcataaactgcctg

SEQ ID NO: 67006 - DNA, 25 bp, E. coli
gagccgtggctggataaactgcctg

SEQ ID NO: 67007 - DNA, 25 bp, E. coli
gagttaatgggcaactcatcaccgg

SEQ ID NO: 67008 - DNA, 25 bp, E. coli
gagttaatgggctactcatcaccgg

SEQ ID NO: 67009 - DNA, 25 bp, E. coli
cagacgtgaccgttacgctcacgta

SEQ ID NO: 67010 - DNA, 25 bp, E. coli
cagacgtgaccgatacgctcacgta

SEQ ID NO: 67011 - DNA, 25 bp, E. coli
ttggcgagcaacacaccagacgtga

SEQ ID NO: 67012 - DNA, 25 bp, E. coli
ttggcgagcaactcaccagacgtga

SEQ ID NO: 67013 - DNA, 25 bp, E. coli
tgattggcgagcaactcaccagacg

SEQ ID NO: 67014 - DNA, 25 bp, E. coli
tgaccgttacgctcacgtagtgcgt

SEQ ID NO: 67015 - DNA, 25 bp, E. coli
tgattggcgagctactcaccagacg

SEQ ID NO: 67016 - DNA, 25 bp, E. coli
tgaccgttacgcacacgtagtgcgt

SEQ ID NO: 67017 - DNA, 25 bp, E. coli
ccaatgattggcgagcaactcacca

SEQ ID NO: 67018 - DNA, 25 bp, E. coli
ccaatgattggccagcaactcacca

SEQ ID NO: 67019 - DNA, 25 bp, E. coli
cgcgaaaccctgtactggccaatga

SEQ ID NO: 67020 - DNA, 25 bp, E. coli
cgctcacgtagtgcgtaataccaaa

SEQ ID NO: 67021 - DNA, 25 bp, E. coli
cgaaaccctgaagtggccaatgatt

SEQ ID NO: 67022 - DNA, 25 bp, E. coli
cgctcacgtagtccgtaataccaaa

SEQ ID NO: 67023 - DNA, 25 bp, E. coli
cgaaaccctgaactggccaatgatt

SEQ ID NO: 67024 - DNA, 25 bp, E. coli
cgcgaaaccctgaactggccaatga

SEQ ID NO: 67025 - DNA, 25 bp, E. coli
ctcacgtagtgcctaataccaaaga

SEQ ID NO: 67026 - DNA, 25 bp, E. coli
ctcacgtagtgcgtaataccaaaga

SEQ ID NO: 67027 - DNA, 25 bp, E. coli
tcaccagacgtgtccgttacgctca

SEQ ID NO: 67028 - DNA, 25 bp, E. coli
tcaccagacgtgaccgttacgctca

SEQ ID NO: 67029 - DNA, 25 bp, E. coli
gagcaactcacctgacgtgaccgtt

SEQ ID NO: 67030 - DNA, 25 bp, E. coli
gagcaactcaccagacgtgaccgtt

SEQ ID NO: 67031 - DNA, 25 bp, E. coli
cagtttttgcagtaagtgacccgta

SEQ ID NO: 67032 - DNA, 25 bp, E. coli
cagtttttgcagaaagtgacccgta

SEQ ID NO: 67033 - DNA, 25 bp, E. coli
agctgctgccggagaaattaagcga

SEQ ID NO: 67034 - DNA, 25 bp, E. coli
agctgctgccggtgaaattaagcga

SEQ ID NO: 67035 - DNA, 25 bp, E. coli
tagctttaacaagcagctgctgccg

SEQ ID NO: 67036 - DNA, 25 bp, E. coli
tagctttaacaaccagctgctgccg

SEQ ID NO: 67037 - DNA, 25 bp, E. coli
tttgctggcacgtgaaaacttcggc

SEQ ID NO: 67038 - DNA, 25 bp, E. coli
ttttggcgcgcaactgtttaacgac

SEQ ID NO: 67039 - DNA, 25 bp, E. coli
tttgctggcacgagaaaacttcggc

SEQ ID NO: 67040 - DNA, 25 bp, E. coli
tttatcaaacactcaggcctggtgg

SEQ ID NO: 67041 - DNA, 25 bp, E. coli
ttctggatgaaaaaggccaacagcc

SEQ ID NO: 67042 - DNA, 25 bp, E. coli
tttatcaaacacacaggcctggtgg

SEQ ID NO: 67043 - DNA, 25 bp, E. coli
ttctggatgaaataggccaacagcc

SEQ ID NO: 67044 - DNA, 25 bp, E. coli
ttttggcgcgcatctgtttaacgac

SEQ ID NO: 67045 - DNA, 25 bp, E. coli
tcagggcgcttccattttgctggca

SEQ ID NO: 67046 - DNA, 25 bp, E. coli
gccaaacccggagttcgtgctgaac

SEQ ID NO: 67047 - DNA, 25 bp, E. coli
gccaaacccggacttcgtgctgaac

SEQ ID NO: 67048 - DNA, 25 bp, E. coli
tcagggcgcttcgattttgctggca

SEQ ID NO: 67049 - DNA, 25 bp, E. coli
gatgccgccaatgtcgataccgatg

SEQ ID NO: 67050 - DNA, 25 bp, E. coli
gagttttgctgacatcttctacggc

SEQ ID NO: 67051 - DNA, 25 bp, E. coli
gagttttgctgagatcttctacggc

SEQ ID NO: 67052 - DNA, 25 bp, E. coli
gatgccgccaatctcgataccgatg

SEQ ID NO: 67053 - DNA, 25 bp, E. coli
aagtcattgcgatagaagggataac

SEQ ID NO: 67054 - DNA, 25 bp, E. coli
aagtcattgcgaaagaagggataac

SEQ ID NO: 67055 - DNA, 25 bp, E. coli
catattttctggctcagtctcggcg

SEQ ID NO: 67056 - DNA, 25 bp, E. coli
catattttctgggtcagtctcggcg

SEQ ID NO: 67057 - DNA, 25 bp, E. coli
acagttcatggcctgtcagcgccag

SEQ ID NO: 67058 - DNA, 25 bp, E. coli
acagttcatggcgtgtcagcgccag

SEQ ID NO: 67059 - DNA, 25 bp, E. coli
tatgcgcgtcggtgacagttcatgg

SEQ ID NO: 67060 - DNA, 25 bp, E. coli
tatgcgcgtcggagacagttcatgg

SEQ ID NO: 67061 - DNA, 25 bp, E. coli
gccgacgttttgagctggaatctcc

SEQ ID NO: 67062 - DNA, 25 bp, E. coli
gccgacgttttgtgctggaatctcc

SEQ ID NO: 67063 - DNA, 25 bp, E. coli
gcagcagctgattggccgacgtttt

SEQ ID NO: 67064 - DNA, 25 bp, E. coli
gcagcagctgataggccgacgtttt

SEQ ID NO: 67065 - DNA, 25 bp, E. coli
ctgtcagcgccaccgaggatctcgg

SEQ ID NO: 67066 - DNA, 25 bp, E. coli
cggcgggtgcgccaacaaaagcaca

SEQ ID NO: 67067 - DNA, 25 bp, E. coli
ctgtcagcgccagcgaggatctcgg

SEQ ID NO: 67068 - DNA, 25 bp, E. coli
cggcgggtgcgcgaacaaaagcaca

SEQ ID NO: 67069 - DNA, 25 bp, E. coli
gtcatttaaacctgcgcgggcagca

SEQ ID NO: 67070 - DNA, 25 bp, E. coli
gtcatttaaaccagcgcgggcagca

SEQ ID NO: 67071 - DNA, 25 bp, E. coli
ggtacgcatgttcaagtcattgcga

SEQ ID NO: 67072 - DNA, 25 bp, E. coli
ggtacgcatgttgaagtcattgcga

SEQ ID NO: 67073 - DNA, 25 bp, E. coli
tcaacgggcgcggtcatatgcgcgt

SEQ ID NO: 67074 - DNA, 25 bp, E. coli
tcaacgggcgcgctcatatgcgcgt

SEQ ID NO: 67075 - DNA, 25 bp, E. coli
cactggaacctaatctggcagacaa

SEQ ID NO: 67076 - DNA, 25 bp, E. coli
cactggaacctattctggcagacaa

SEQ ID NO: 67077 - DNA, 25 bp, E. coli
taactacacgccatgtggtcactgc

SEQ ID NO: 67078 - DNA, 25 bp, E. coli
tatgaatgaactcaacagcggtctg

SEQ ID NO: 67079 - DNA, 25 bp, E. coli
tatgaatgaactgaacagcggtctg

SEQ ID NO: 67080 - DNA, 25 bp, E. coli
tattggtgcgacaatgcagcaaacc

SEQ ID NO: 67081 - DNA, 25 bp, E. coli
tattggtgcgactatgcagcaaacc

SEQ ID NO: 67082 - DNA, 25 bp, E. coli
ttcatgccgaacaaagcgcgatcag

SEQ ID NO: 67083 - DNA, 25 bp, E. coli
ttcatgccgaactaagcgcgatcag

SEQ ID NO: 67084 - DNA, 25 bp, E. coli
tgagtggtgaaatagcgcttgcagc

SEQ ID NO: 67085 - DNA, 25 bp, E. coli
tgagtggtgaaaaagcgcttgcagc

SEQ ID NO: 67086 - DNA, 25 bp, E. coli
tcgcgctggaatgtaaagacggtcg

SEQ ID NO: 67087 - DNA, 25 bp, E. coli
tcgcgctggaatctaaagacggtcg

SEQ ID NO: 67088 - DNA, 25 bp, E. coli
tctcatcgctgatgagcgcaacggg

SEQ ID NO: 67089 - DNA, 25 bp, E. coli
tctcatcgctgaagagcgcaacggg

SEQ ID NO: 67090 - DNA, 25 bp, E. coli
gcctttgggccgtaagatctggaga

SEQ ID NO: 67091 - DNA, 25 bp, E. coli
gcctttgggccgaaagatctggaga

SEQ ID NO: 67092 - DNA, 25 bp, E. coli
ccttacagtaagtcgccaagcggtg

SEQ ID NO: 67093 - DNA, 25 bp, E. coli
ccttacagtaagacgccaagcggtg

SEQ ID NO: 67094 - DNA, 25 bp, E. coli
ggcagctacgctgaaaacgccgcat

SEQ ID NO: 67095 - DNA, 25 bp, E. coli
ggcagctacgctcaaaacgccgcat

SEQ ID NO: 67096 - DNA, 25 bp, E. coli
taactacacgccttgtggtcactgc

SEQ ID NO: 67097 - DNA, 25 bp, E. coli
cgatcacccgttcaccgttcagcag

SEQ ID NO: 67098 - DNA, 25 bp, E. coli
cgatcacccgttgaccgttcagcag

SEQ ID NO: 67099 - DNA, 25 bp, E. coli
tttcgacgatcacccgttcaccgtt

SEQ ID NO: 67100 - DNA, 25 bp, E. coli
tttcgacgatcagccgttcaccgtt

SEQ ID NO: 67101 - DNA, 25 bp, E. coli
tcgacccacagctatcttgatgaag

SEQ ID NO: 67102 - DNA, 25 bp, E. coli
tcgacccacagcaatcttgatgaag

SEQ ID NO: 67103 - DNA, 25 bp, E. coli
tcgagccgcgcgtaacggaaacccg

SEQ ID NO: 67104 - DNA, 25 bp, E. coli
tcgagccgcgcgaaacggaaacccg

SEQ ID NO: 67105 - DNA, 25 bp, E. coli
tctatgcggtgcggccgtttacccg

SEQ ID NO: 67106 - DNA, 25 bp, E. coli
tctatgcggtgccgccgtttacccg

SEQ ID NO: 67107 - DNA, 25 bp, E. coli
ccacagctatcttgatgaagtggtg

SEQ ID NO: 67108 - DNA, 25 bp, E. coli
ccacagctatctagatgaagtggtg

SEQ ID NO: 67109 - DNA, 25 bp, E. coli
gcgaaacggaaacccgcaccatgca

SEQ ID NO: 67110 - DNA, 25 bp, E. coli
gcgctttatcgagccgcgcgaaacg

SEQ ID NO: 67111 - DNA, 25 bp, E. coli
gcgaaacggaaagccgcaccatgca

SEQ ID NO: 67112 - DNA, 25 bp, E. coli
gcgctttatcgacccgcgcgaaacg

SEQ ID NO: 67113 - DNA, 25 bp, E. coli
ctgcgctttatcgagccgcgcgaaa

SEQ ID NO: 67114 - DNA, 25 bp, E. coli
ctgcgctttatccagccgcgcgaaa

SEQ ID NO: 67115 - DNA, 25 bp, E. coli
ggatcgacccacagctatcttgatg

SEQ ID NO: 67116 - DNA, 25 bp, E. coli
ggatcgacccactgctatcttgatg

SEQ ID NO: 67117 - DNA, 25 bp, E. coli
gacccacagctatcttgatgaagtg

SEQ ID NO: 67118 - DNA, 25 bp, E. coli
gacccacagctaacttgatgaagtg

SEQ ID NO: 67119 - DNA, 25 bp, E. coli
cacatgatgagcaggcggtagatgc

SEQ ID NO: 67120 - DNA, 25 bp, E. coli
cacatgatgagctggcggtagatgc

SEQ ID NO: 67121 - DNA, 25 bp, E. coli
tatgtctgcgatcaatccggaatgc

SEQ ID NO: 67122 - DNA, 25 bp, E. coli
tatgacgaactaggccatgaactgg

SEQ ID NO: 67123 - DNA, 25 bp, E. coli
tatgacgaactacgccatgaactgg

SEQ ID NO: 67124 - DNA, 25 bp, E. coli
tatgtctgcgatgaatccggaatgc

SEQ ID NO: 67125 - DNA, 25 bp, E. coli
ccaacggtaacgcaagagggcatcg

SEQ ID NO: 67126 - DNA, 25 bp, E. coli
gccgcctggaaaggttgagcaaact

SEQ ID NO: 67127 - DNA, 25 bp, E. coli
ccaacggtaacggaagagggcatcg

SEQ ID NO: 67128 - DNA, 25 bp, E. coli
gccgcctggaaacgttgagcaaact

SEQ ID NO: 67129 - DNA, 25 bp, E. coli
gcgaggcgctggacggttttacatc

SEQ ID NO: 67130 - DNA, 25 bp, E. coli
gcgaggcgctggtcggttttacatc

SEQ ID NO: 67131 - DNA, 25 bp, E. coli
cgtctggcgcagatgcaaatccctg

SEQ ID NO: 67132 - DNA, 25 bp, E. coli
cggaacagtatgtcccacagcgggt

SEQ ID NO: 67133 - DNA, 25 bp, E. coli
cgtctggcgcagttgcaaatccctg

SEQ ID NO: 67134 - DNA, 25 bp, E. coli
cggaacagtatgacccacagcgggt

SEQ ID NO: 67135 - DNA, 25 bp, E. coli
gattacttcatctggataaccggcg

SEQ ID NO: 67136 - DNA, 25 bp, E. coli
gataaacttacggtggcaggtccgc

SEQ ID NO: 67137 - DNA, 25 bp, E. coli
gataaacttacgctggcaggtccgc

SEQ ID NO: 67138 - DNA, 25 bp, E. coli
gattacttcatcaggataaccggcg

SEQ ID NO: 67139 - DNA, 25 bp, E. coli
ggttttaatatccaatggctggcac

SEQ ID NO: 67140 - DNA, 25 bp, E. coli
ggttttaatatcgaatggctggcac

SEQ ID NO: 67141 - DNA, 25 bp, E. coli
aatctcctgcagtgcgcaagagggc

SEQ ID NO: 67142 - DNA, 25 bp, E. coli
aatctcctgcagagcgcaagagggc

SEQ ID NO: 67143 - DNA, 25 bp, E. coli
caaaatggcgattgtcacggcgcgt

SEQ ID NO: 67144 - DNA, 25 bp, E. coli
caaaatggcgatagtcacggcgcgt

SEQ ID NO: 67145 - DNA, 25 bp, E. coli
tacgcaagatacttggcggctaccg

SEQ ID NO: 67146 - DNA, 25 bp, E. coli
accggaagccgattcagcgtatgcg

SEQ ID NO: 67147 - DNA, 25 bp, E. coli
accggaagccgaatcagcgtatgcg

SEQ ID NO: 67148 - DNA, 25 bp, E. coli
tacgcaagatacatggcggctaccg

SEQ ID NO: 67149 - DNA, 25 bp, E. coli
tgtcacgcgaggacacattgatgtc

SEQ ID NO: 67150 - DNA, 25 bp, E. coli
tgtcacgcgaggtcacattgatgtc

SEQ ID NO: 67151 - DNA, 25 bp, E. coli
ccaggtgcttaaagaggacaacggc

SEQ ID NO: 67152 - DNA, 25 bp, E. coli
ccaggtgcttaatgaggacaacggc

SEQ ID NO: 67153 - DNA, 25 bp, E. coli
gaagatttggcaagtgcgctcgacg

SEQ ID NO: 67154 - DNA, 25 bp, E. coli
gaagatttggcatgtgcgctcgacg

SEQ ID NO: 67155 - DNA, 25 bp, E. coli
gaaatgtcacgctcatgtcacgacg

SEQ ID NO: 67156 - DNA, 25 bp, E. coli
gaaatgtcacgcacatgtcacgacg

SEQ ID NO: 67157 - DNA, 25 bp, E. coli
gatcaaaacactatggtccatggcg

SEQ ID NO: 67158 - DNA, 25 bp, E. coli
gatcaaaacactttggtccatggcg

SEQ ID NO: 67159 - DNA, 25 bp, E. coli
ggacaacggcaatatttcgcaaacc

SEQ ID NO: 67160 - DNA, 25 bp, E. coli
gtcagggcagcctattgcaacagtg

SEQ ID NO: 67161 - DNA, 25 bp, E. coli
gtcagggcagccaattgcaacagtg

SEQ ID NO: 67162 - DNA, 25 bp, E. coli
ggacaacggcaaaatttcgcaaacc

SEQ ID NO: 67163 - DNA, 25 bp, E. coli
caaagagtcttgacaggctgtaaac

SEQ ID NO: 67164 - DNA, 25 bp, E. coli
caaagagtcttgtcaggctgtaaac

SEQ ID NO: 67165 - DNA, 25 bp, E. coli
cagatatgtactttgcagcaaccgg

SEQ ID NO: 67166 - DNA, 25 bp, E. coli
cagatatgtactatgcagcaaccgg

SEQ ID NO: 67167 - DNA, 25 bp, E. coli
taaacagccatcaccagtagtaccg

SEQ ID NO: 67168 - DNA, 25 bp, E. coli
taaacagccatctccagtagtaccg

SEQ ID NO: 67169 - DNA, 25 bp, E. coli
aaagacgctattcactgggtgctca

SEQ ID NO: 67170 - DNA, 25 bp, E. coli
aaagacgctattgactgggtgctca

SEQ ID NO: 67171 - DNA, 25 bp, E. coli
gcagtgcgcttctatgaacaggtta

SEQ ID NO: 67172 - DNA, 25 bp, E. coli
gcagtgcgcttcaatgaacaggtta

SEQ ID NO: 67173 - DNA, 25 bp, E. coli
gaaaatccaccactcgaaacagagg

SEQ ID NO: 67174 - DNA, 25 bp, E. coli
gaaacagaggcaaggaaagacgcta

SEQ ID NO: 67175 - DNA, 25 bp, E. coli
gaaacagaggcatggaaagacgcta

SEQ ID NO: 67176 - DNA, 25 bp, E. coli
gaaaatccaccagtcgaaacagagg

SEQ ID NO: 67177 - DNA, 25 bp, E. coli
cgatgccgtggtagacagaattgct

SEQ ID NO: 67178 - DNA, 25 bp, E. coli
cgatgccgtggttgacagaattgct

SEQ ID NO: 67179 - DNA, 25 bp, E. coli
cgagcgtgaccaagctgaatctgct

SEQ ID NO: 67180 - DNA, 25 bp, E. coli
cgagcgtgaccatgctgaatctgct

SEQ ID NO: 67181 - DNA, 25 bp, E. coli
taagcaactcataaacgagcgtgac

SEQ ID NO: 67182 - DNA, 25 bp, E. coli
taagcaactcattaacgagcgtgac

SEQ ID NO: 67183 - DNA, 25 bp, E. coli
gagcaactggttgggcttttcagat

SEQ ID NO: 67184 - DNA, 25 bp, E. coli
gagcaactggttcggcttttcagat

SEQ ID NO: 67185 - DNA, 25 bp, E. coli
tcaccaacggccaggttgaaagtgg

SEQ ID NO: 67186 - DNA, 25 bp, E. coli
cactaacgtattatccgcatccagg

SEQ ID NO: 67187 - DNA, 25 bp, E. coli
cactaacgtattttccgcatccagg

SEQ ID NO: 67188 - DNA, 25 bp, E. coli
tcaccaacggcctggttgaaagtgg

SEQ ID NO: 67189 - DNA, 25 bp, E. coli
cagcagccagcaagccattaattcc

SEQ ID NO: 67190 - DNA, 25 bp, E. coli
caggatcttttagtacacgactcgt

SEQ ID NO: 67191 - DNA, 25 bp, E. coli
cattaggttttatcgcctgggctgc

SEQ ID NO: 67192 - DNA, 25 bp, E. coli
caggatcttttactacacgactcgt

SEQ ID NO: 67193 - DNA, 25 bp, E. coli
cagcagccagcatgccattaattcc

SEQ ID NO: 67194 - DNA, 25 bp, E. coli
tactgatactcctgcctctgacagc

SEQ ID NO: 67195 - DNA, 25 bp, E. coli
tactgatactccagcctctgacagc

SEQ ID NO: 67196 - DNA, 25 bp, E. coli
attaaaacaatccacgccgccacta

SEQ ID NO: 67197 - DNA, 25 bp, E. coli
attaaaacaatcgacgccgccacta

SEQ ID NO: 67198 - DNA, 25 bp, E. coli
ccggcagcaccatcacattaggttt

SEQ ID NO: 67199 - DNA, 25 bp, E. coli
gcctgggctgcgacgtttatcttat

SEQ ID NO: 67200 - DNA, 25 bp, E. coli
gcctgggctgcgtcgtttatcttat

SEQ ID NO: 67201 - DNA, 25 bp, E. coli
ccggcagcaccaacacattaggttt

SEQ ID NO: 67202 - DNA, 25 bp, E. coli
gaaagtggtctggacgataaacatc

SEQ ID NO: 67203 - DNA, 25 bp, E. coli
gaaagtggtctgcacgataaacatc

SEQ ID NO: 67204 - DNA, 25 bp, E. coli
cgcatgcgtcatgttcattgagtga

SEQ ID NO: 67205 - DNA, 25 bp, E. coli
cgcatgcgtcatcttcattgagtga

SEQ ID NO: 67206 - DNA, 25 bp, E. coli
cattaggttttaacgcctgggctgc

SEQ ID NO: 67207 - DNA, 25 bp, E. coli
aagccatcagcaagagatccagccg

SEQ ID NO: 67208 - DNA, 25 bp, E. coli
aagccatcagcatgagatccagccg

SEQ ID NO: 67209 - DNA, 25 bp, E. coli
tttgatattcatgggcgggtgccgt

SEQ ID NO: 67210 - DNA, 25 bp, E. coli
tttgatattcatcggcgggtgccgt

SEQ ID NO: 67211 - DNA, 25 bp, E. coli
gaagaaaacgaactcggcgtctcct

SEQ ID NO: 67212 - DNA, 25 bp, E. coli
gaagaaaacgaagtcggcgtctcct

SEQ ID NO: 67213 - DNA, 25 bp, E. coli
gaaaaatctcctcaaaccactgcgt

SEQ ID NO: 67214 - DNA, 25 bp, E. coli
gacatcacgtctcaaacaggtggga

SEQ ID NO: 67215 - DNA, 25 bp, E. coli
gaaaaatctcctgaaaccactgcgt

SEQ ID NO: 67216 - DNA, 25 bp, E. coli
gacatcacgtctgaaacaggtggga

SEQ ID NO: 67217 - DNA, 25 bp, E. coli
cgttggcgcatctttcggagctggc

SEQ ID NO: 67218 - DNA, 25 bp, E. coli
cgctctactgttgcgcaatgggcaa

SEQ ID NO: 67219 - DNA, 25 bp, E. coli
cgttggcgcatcattcggagctggc

SEQ ID NO: 67220 - DNA, 25 bp, E. coli
cgctctactgttccgcaatgggcaa

SEQ ID NO: 67221 - DNA, 25 bp, E. coli
gatctacatggcgtttggtcacccg

SEQ ID NO: 67222 - DNA, 25 bp, E. coli
gatctacatggcctttggtcacccg

SEQ ID NO: 67223 - DNA, 25 bp, E. coli
ggatgctgcgaacccgtgcctatat

SEQ ID NO: 67224 - DNA, 25 bp, E. coli
ggatgctgcgaagccgtgcctatat

SEQ ID NO: 67225 - DNA, 25 bp, E. coli
gggagttatcgcgtgaccaccaaat

SEQ ID NO: 67226 - DNA, 25 bp, E. coli
gggagttatcgcctgaccaccaaat

SEQ ID NO: 67227 - DNA, 25 bp, E. coli
tacgtgaagtcatactgggaaagcc

SEQ ID NO: 67228 - DNA, 25 bp, E. coli
tacgtgaagtcaaactgggaaagcc

SEQ ID NO: 67229 - DNA, 25 bp, E. coli
aaccgtggacgcgtgttgctgcgta

SEQ ID NO: 67230 - DNA, 25 bp, E. coli
aaccgtggacgcctgttgctgcgta

SEQ ID NO: 67231 - DNA, 25 bp, E. coli
agcggcgatccacttgagcatgagt

SEQ ID NO: 67232 - DNA, 25 bp, E. coli
agcggcgatccagttgagcatgagt

SEQ ID NO: 67233 - DNA, 25 bp, E. coli
acgcgtgttgctccgtaaatccggc

SEQ ID NO: 67234 - DNA, 25 bp, E. coli
acgcgtgttgctgcgtaaatccggc

SEQ ID NO: 67235 - DNA, 25 bp, E. coli
aaaatgttcccgcagattctggtta

SEQ ID NO: 67236 - DNA, 25 bp, E. coli
aaaatgttcccggagattctggtta

SEQ ID NO: 67237 - DNA, 25 bp, E. coli
ttgaagctgcgctgggcaaccgtgg

SEQ ID NO: 67238 - DNA, 25 bp, E. coli
ttgaagctgcgcagggcaaccgtgg

SEQ ID NO: 67239 - DNA, 25 bp, E. coli
tgagcatgagtctgttaaagccgtg

SEQ ID NO: 67240 - DNA, 25 bp, E. coli
tgagcatgagtcagttaaagccgtg

SEQ ID NO: 67241 - DNA, 25 bp, E. coli
ccgtgaccgcagaggttgaagctgc

SEQ ID NO: 67242 - DNA, 25 bp, E. coli
ccgtgaccgcagtggttgaagctgc

SEQ ID NO: 67243 - DNA, 25 bp, E. coli
gttcccgcagattctggttaacgta

SEQ ID NO: 67244 - DNA, 25 bp, E. coli
gttcccgcagatactggttaacgta

SEQ ID NO: 67245 - DNA, 25 bp, E. coli
tctggttaacgtacgttacaccgca

SEQ ID NO: 67246 - DNA, 25 bp, E. coli
tctggttaacgttcgttacaccgca

SEQ ID NO: 67247 - DNA, 25 bp, E. coli
gagtcagttaaagccgtgaccgcag

SEQ ID NO: 67248 - DNA, 25 bp, E. coli
gagtcagttaaacccgtgaccgcag

SEQ ID NO: 67249 - DNA, 25 bp, E. coli
gatccacttgaggatgagtcagtta

SEQ ID NO: 67250 - DNA, 25 bp, E. coli
gatccacttgagcatgagtcagtta

SEQ ID NO: 67251 - DNA, 25 bp, E. coli
cataatgtctacagttcggcgctga

SEQ ID NO: 67252 - DNA, 25 bp, E. coli
cataatgtctactgttcggcgctga

SEQ ID NO: 67253 - DNA, 25 bp, E. coli
tatccctgggctggtagcactcatc

SEQ ID NO: 67254 - DNA, 25 bp, E. coli
tatccctgggctcgtagcactcatc

SEQ ID NO: 67255 - DNA, 25 bp, E. coli
tattggcggcttctcgacacatgat

SEQ ID NO: 67256 - DNA, 25 bp, E. coli
tattggcggcttgtcgacacatgat

SEQ ID NO: 67257 - DNA, 25 bp, E. coli
tgaaacgactggtgcatccgaacgc

SEQ ID NO: 67258 - DNA, 25 bp, E. coli
tgaaggtttattcgcgcgatccgga

SEQ ID NO: 67259 - DNA, 25 bp, E. coli
tgaaggtttattggcgcgatccgga

SEQ ID NO: 67260 - DNA, 25 bp, E. coli
tgaaacgactggagcatccgaacgc

SEQ ID NO: 67261 - DNA, 25 bp, E. coli
tgaaagataacataatgcgcccgcg

SEQ ID NO: 67262 - DNA, 25 bp, E. coli
tgaaagataacaaaatgcgcccgcg

SEQ ID NO: 67263 - DNA, 25 bp, E. coli
gatactgcctatcctcggcgtgggt

SEQ ID NO: 67264 - DNA, 25 bp, E. coli
gatgccatcggcgatagctttgcga

SEQ ID NO: 67265 - DNA, 25 bp, E. coli
gatactgcctatgctcggcgtgggt

SEQ ID NO: 67266 - DNA, 25 bp, E. coli
gatttatgtcttcctgaccgtcgcc

SEQ ID NO: 67267 - DNA, 25 bp, E. coli
gatttatgtcttgctgaccgtcgcc

SEQ ID NO: 67268 - DNA, 25 bp, E. coli
tgccggaacgtatcctcgaagccgt

SEQ ID NO: 67269 - DNA, 25 bp, E. coli
tgccggaacgtaacctcgaagccgt

SEQ ID NO: 67270 - DNA, 25 bp, E. coli
gatgccatcggccatagctttgcga

SEQ ID NO: 67271 - DNA, 25 bp, E. coli
gatgcagctctatcgcgcagaaatg

SEQ ID NO: 67272 - DNA, 25 bp, E. coli
gatgcagctctaacgcgcagaaatg

SEQ ID NO: 67273 - DNA, 25 bp, E. coli
aatttcggtcacgttaacgcgctgg

SEQ ID NO: 67274 - DNA, 25 bp, E. coli
aagagaactttgctcgcctgctgcg

SEQ ID NO: 67275 - DNA, 25 bp, E. coli
aatttcggtcaccttaacgcgctgg

SEQ ID NO: 67276 - DNA, 25 bp, E. coli
aagagaactttggtcgcctgctgcg

SEQ ID NO: 67277 - DNA, 25 bp, E. coli
cacagcagcgtgcacaatcaatggc

SEQ ID NO: 67278 - DNA, 25 bp, E. coli
cacagcagcgtggacaatcaatggc

SEQ ID NO: 67279 - DNA, 25 bp, E. coli
tctgtggcaggcctcttccgataaa

SEQ ID NO: 67280 - DNA, 25 bp, E. coli
tctgtggcaggcgtcttccgataaa

SEQ ID NO: 67281 - DNA, 25 bp, E. coli
gaatcacagcgtgcgatcctgcgta

SEQ ID NO: 67282 - DNA, 25 bp, E. coli
gaatcacagcgtccgatcctgcgta

SEQ ID NO: 67283 - DNA, 25 bp, E. coli
gaaaatacgccgttggaagaaaccg

SEQ ID NO: 67284 - DNA, 25 bp, E. coli
gaaaatacgccgatggaagaaaccg

SEQ ID NO: 67285 - DNA, 25 bp, E. coli
gataaaagcggcctgctggataccc

SEQ ID NO: 67286 - DNA, 25 bp, E. coli
gataccctgcaatataacggcgtgg

SEQ ID NO: 67287 - DNA, 25 bp, E. coli
gatttagccaactattacgggccgc

SEQ ID NO: 67288 - DNA, 25 bp, E. coli
gatttagccaacaattacgggccgc

SEQ ID NO: 67289 - DNA, 25 bp, E. coli
gataccctgcaaaataacggcgtgg

SEQ ID NO: 67290 - DNA, 25 bp, E. coli
gataaaagcggcgtgctggataccc

SEQ ID NO: 67291 - DNA, 25 bp, E. coli
tggttagcgaatcccgaacgttacg

SEQ ID NO: 67292 - DNA, 25 bp, E. coli
tggttagcgaatgccgaacgttacg

SEQ ID NO: 67293 - DNA, 25 bp, E. coli
taaggcgctgtatgtcgggatctcc

SEQ ID NO: 67294 - DNA, 25 bp, E. coli
taaggcgctgtaagtcgggatctcc

SEQ ID NO: 67295 - DNA, 25 bp, E. coli
aatgtacgaatgttgctgcgcaggc

SEQ ID NO: 67296 - DNA, 25 bp, E. coli
aatgtacgaatgatgctgcgcaggc

SEQ ID NO: 67297 - DNA, 25 bp, E. coli
catcgttatttagtgcggcagggcc

SEQ ID NO: 67298 - DNA, 25 bp, E. coli
catcgttatttactgcggcagggcc

SEQ ID NO: 67299 - DNA, 25 bp, E. coli
taacaatgcgtcaggaagccagtgc

SEQ ID NO: 67300 - DNA, 25 bp, E. coli
taacaatgcgtctggaagccagtgc

SEQ ID NO: 67301 - DNA, 25 bp, E. coli
tactggcgtagcagaagatgaacac

SEQ ID NO: 67302 - DNA, 25 bp, E. coli
tactggcgtagctgaagatgaacac

SEQ ID NO: 67303 - DNA, 25 bp, E. coli
tattgtcgccgatcagaacgatacg

SEQ ID NO: 67304 - DNA, 25 bp, E. coli
tattgtcgccgaacagaacgatacg

SEQ ID NO: 67305 - DNA, 25 bp, E. coli
ttattaacatggaggagatccccag

SEQ ID NO: 67306 - DNA, 25 bp, E. coli
ttattaacatggtggagatccccag

SEQ ID NO: 67307 - DNA, 25 bp, E. coli
tgtgtctggcaaacatatcctgggc

SEQ ID NO: 67308 - DNA, 25 bp, E. coli
tgtgtctggcaatcatatcctgggc

SEQ ID NO: 67309 - DNA, 25 bp, E. coli
gccgggttgaagaaccgcaaaactg

SEQ ID NO: 67310 - DNA, 25 bp, E. coli
gccgggttgaagtaccgcaaaactg

SEQ ID NO: 67311 - DNA, 25 bp, E. coli
gaaaaatccggcagggtaggtgtct

SEQ ID NO: 67312 - DNA, 25 bp, E. coli
gaaaaatccggctgggtaggtgtct

SEQ ID NO: 67313 - DNA, 25 bp, E. coli
ggtgtcatgccggaaaccaagagca

SEQ ID NO: 67314 - DNA, 25 bp, E. coli
ggtgtcatgccgcaaaccaagagca

SEQ ID NO: 67315 - DNA, 25 bp, E. coli
taatagcaccaaaaaccagccaggg

SEQ ID NO: 67316 - DNA, 25 bp, E. coli
taatagcaccaataaccagccaggg

SEQ ID NO: 67317 - DNA, 25 bp, E. coli
tgtataacagcctgtccaaagcaac

SEQ ID NO: 67318 - DNA, 25 bp, E. coli
tgatcgatggtgaagaacaatggtc

SEQ ID NO: 67319 - DNA, 25 bp, E. coli
tgatcgatggtgtagaacaatggtc

SEQ ID NO: 67320 - DNA, 25 bp, E. coli
tgtataacagccagtccaaagcaac

SEQ ID NO: 67321 - DNA, 25 bp, E. coli
tctctgacagtttctttcaaaggcg

SEQ ID NO: 67322 - DNA, 25 bp, E. coli
tctctgacagttactttcaaaggcg

SEQ ID NO: 67323 - DNA, 25 bp, E. coli
gcaacctctttcttccccgttgtgg

SEQ ID NO: 67324 - DNA, 25 bp, E. coli
gcaggtggcgcacactcacaaacta

SEQ ID NO: 67325 - DNA, 25 bp, E. coli
gcaggtggcgcagactcacaaacta

SEQ ID NO: 67326 - DNA, 25 bp, E. coli
gcaacctctttcatccccgttgtgg

SEQ ID NO: 67327 - DNA, 25 bp, E. coli
gacgtgttagcatcgttcggtgaac

SEQ ID NO: 67328 - DNA, 25 bp, E. coli
gaacaagcaacgtgaagactggcat

SEQ ID NO: 67329 - DNA, 25 bp, E. coli
gacgtgttagcaacgttcggtgaac

SEQ ID NO: 67330 - DNA, 25 bp, E. coli
gaacaagcaacgagaagactggcat

SEQ ID NO: 67331 - DNA, 25 bp, E. coli
ccccgttgtgggtctgcttgcaggt

SEQ ID NO: 67332 - DNA, 25 bp, E. coli
ccccgttgtgggactgcttgcaggt

SEQ ID NO: 67333 - DNA, 25 bp, E. coli
gttcggtgaaccagacagccgttct

SEQ ID NO: 67334 - DNA, 25 bp, E. coli
gttcggtgaacctgacagccgttct

SEQ ID NO: 67335 - DNA, 25 bp, E. coli
ggcaaaactacaaaacaggacgtgt

SEQ ID NO: 67336 - DNA, 25 bp, E. coli
ggcgaaaaagtcagcacatacatct

SEQ ID NO: 67337 - DNA, 25 bp, E. coli
ggcgaaaaagtctgcacatacatct

SEQ ID NO: 67338 - DNA, 25 bp, E. coli
ggcaaaactacataacaggacgtgt

SEQ ID NO: 67339 - DNA, 25 bp, E. coli
agagttcgaatctctgcgcttccgc

SEQ ID NO: 67340 - DNA, 25 bp, E. coli
agagttcgaatcactgcgcttccgc

SEQ ID NO: 67341 - DNA, 25 bp, E. coli
cgaaagggttcctgagttcgaatct

SEQ ID NO: 67342 - DNA, 25 bp, E. coli
agttcgaatctcagcgcttccgcca

SEQ ID NO: 67343 - DNA, 25 bp, E. coli
agttcgaatctctgcgcttccgcca

SEQ ID NO: 67344 - DNA, 25 bp, E. coli
cgaaagggttccagagttcgaatct

SEQ ID NO: 67345 - DNA, 25 bp, E. coli
tgaaggcaccggacttgaaaaccgg

SEQ ID NO: 67346 - DNA, 25 bp, E. coli
tgaaggcaccggtcttgaaaaccgg

SEQ ID NO: 67347 - DNA, 25 bp, E. coli
ccgagcggttgatggcaccggtctt

SEQ ID NO: 67348 - DNA, 25 bp, E. coli
gcggttgaaggctccggtcttgaaa

SEQ ID NO: 67349 - DNA, 25 bp, E. coli
gcggttgaaggcaccggtcttgaaa

SEQ ID NO: 67350 - DNA, 25 bp, E. coli
gaatctctgcgcttccgccaaataa

SEQ ID NO: 67351 - DNA, 25 bp, E. coli
gaatctctgcgcatccgccaaataa

SEQ ID NO: 67352 - DNA, 25 bp, E. coli
ccgagcggttgaaggcaccggtctt

SEQ ID NO: 67353 - DNA, 25 bp, E. coli
cgcgtcattccggaagtgtggccga

SEQ ID NO: 67354 - DNA, 25 bp, E. coli
cgcgtcattccgcaagtgtggccga

SEQ ID NO: 67355 - DNA, 25 bp, E. coli
cgtcattccggaagtgtggccgagc

SEQ ID NO: 67356 - DNA, 25 bp, E. coli
cattccggaagtctggccgagcggt

SEQ ID NO: 67357 - DNA, 25 bp, E. coli
cattccggaagtgtggccgagcggt

SEQ ID NO: 67358 - DNA, 25 bp, E. coli
cgtcattccggatgtgtggccgagc

SEQ ID NO: 67359 - DNA, 25 bp, E. coli
gggttccagagttcgaatctctgcg

SEQ ID NO: 67360 - DNA, 25 bp, E. coli
gggttccagagtacgaatctctgcg

SEQ ID NO: 67361 - DNA, 25 bp, E. coli
aaccttgaatggtggcaggcgtccg

SEQ ID NO: 67362 - DNA, 25 bp, E. coli
aaccttgaatggaggcaggcgtccg

SEQ ID NO: 67363 - DNA, 25 bp, E. coli
cacaccgggcattgggagatcggca

SEQ ID NO: 67364 - DNA, 25 bp, E. coli
cacaccgggcatagggagatcggca

SEQ ID NO: 67365 - DNA, 25 bp, E. coli
catcaaccgtaatgtgccgcgtctg

SEQ ID NO: 67366 - DNA, 25 bp, E. coli
catcaaccgtaaagtgccgcgtctg

SEQ ID NO: 67367 - DNA, 25 bp, E. coli
tagcgacctgcgataaagggctgcc

SEQ ID NO: 67368 - DNA, 25 bp, E. coli
tagcgacctgcgttaaagggctgcc

SEQ ID NO: 67369 - DNA, 25 bp, E. coli
ttttatgcggtgatcacccacgcgg

SEQ ID NO: 67370 - DNA, 25 bp, E. coli
ttttatgcggtgttcacccacgcgg

SEQ ID NO: 67371 - DNA, 25 bp, E. coli
tgattatcggcagtcagggcggcat

SEQ ID NO: 67372 - DNA, 25 bp, E. coli
tgtttgtctcggaagcgcaggcgat

SEQ ID NO: 67373 - DNA, 25 bp, E. coli
tgattatcggcactcagggcggcat

SEQ ID NO: 67374 - DNA, 25 bp, E. coli
tgtttgtctcggtagcgcaggcgat

SEQ ID NO: 67375 - DNA, 25 bp, E. coli
tcgaaaacgcgaaggtgatccacgc

SEQ ID NO: 67376 - DNA, 25 bp, E. coli
tcgaaaacgcgatggtgatccacgc

SEQ ID NO: 67377 - DNA, 25 bp, E. coli
gagaaaattttcaccccgcaggacg

SEQ ID NO: 67378 - DNA, 25 bp, E. coli
gagaaaattttctccccgcaggacg

SEQ ID NO: 67379 - DNA, 25 bp, E. coli
gattggcaagctccgcgataacgac

SEQ ID NO: 67380 - DNA, 25 bp, E. coli
gattggcaagctgcgcgataacgac

SEQ ID NO: 67381 - DNA, 25 bp, E. coli
taactggcagcgtgaacttcatcgg

SEQ ID NO: 67382 - DNA, 25 bp, E. coli
taactggcagcgagaacttcatcgg

SEQ ID NO: 67383 - DNA, 25 bp, E. coli
aaccgtgggcaaaaccatccgctgg

SEQ ID NO: 67384 - DNA, 25 bp, E. coli
atctcggcgggctacaaggtgcatc

SEQ ID NO: 67385 - DNA, 25 bp, E. coli
attcgctggtggcattcaacccggg

SEQ ID NO: 67386 - DNA, 25 bp, E. coli
atctcggcgggcaacaaggtgcatc

SEQ ID NO: 67387 - DNA, 25 bp, E. coli
attcgctggtgggattcaacccggg

SEQ ID NO: 67388 - DNA, 25 bp, E. coli
aaccgtgggcaataccatccgctgg

SEQ ID NO: 67389 - DNA, 25 bp, E. coli
tgggtcgctactcgaacctgccgta

SEQ ID NO: 67390 - DNA, 25 bp, E. coli
tgggtcgctactggaacctgccgta

SEQ ID NO: 67391 - DNA, 25 bp, E. coli
tgagtcatgatcgacaaccgctggg

SEQ ID NO: 67392 - DNA, 25 bp, E. coli
tgagtcatgatccacaaccgctggg

SEQ ID NO: 67393 - DNA, 25 bp, E. coli
tgctgacggcgtacatcatgggctt

SEQ ID NO: 67394 - DNA, 25 bp, E. coli
tgctgacggcgttcatcatgggctt

SEQ ID NO: 67395 - DNA, 25 bp, E. coli
tcggtactgttcgagacggcggtct

SEQ ID NO: 67396 - DNA, 25 bp, E. coli
tcggtactgttccagacggcggtct

SEQ ID NO: 67397 - DNA, 25 bp, E. coli
gaaatgttgccggtgttctcgctgc

SEQ ID NO: 67398 - DNA, 25 bp, E. coli
gaaatgttgccgctgttctcgctgc

SEQ ID NO: 67399 - DNA, 25 bp, E. coli
cccgacctgggatgaactgttgatt

SEQ ID NO: 67400 - DNA, 25 bp, E. coli
cccgacctgggaagaactgttgatt

SEQ ID NO: 67401 - DNA, 25 bp, E. coli
taatgattcccggatgctgttcctg

SEQ ID NO: 67402 - DNA, 25 bp, E. coli
taatgattcccgcatgctgttcctg

SEQ ID NO: 67403 - DNA, 25 bp, E. coli
taatcgtcatgacgcgagcaaagca

SEQ ID NO: 67404 - DNA, 25 bp, E. coli
taatcgtcatgaggcgagcaaagca

SEQ ID NO: 67405 - DNA, 25 bp, E. coli
aaaattttgccctctgaatggctgg

SEQ ID NO: 67406 - DNA, 25 bp, E. coli
acttattttgtatttgctgtcgcag

SEQ ID NO: 67407 - DNA, 25 bp, E. coli
aaaattttgcccactgaatggctgg

SEQ ID NO: 67408 - DNA, 25 bp, E. coli
acttattttgtaattgctgtcgcag

SEQ ID NO: 67409 - DNA, 25 bp, E. coli
tttgcccactgattggctgggcgaa

SEQ ID NO: 67410 - DNA, 25 bp, E. coli
tttgcccactgaatggctgggcgaa

SEQ ID NO: 67411 - DNA, 25 bp, E. coli
ttcttacgatatgaataaactcatt

SEQ ID NO: 67412 - DNA, 25 bp, E. coli
ttcttacgatatcaataaactcatt

SEQ ID NO: 67413 - DNA, 25 bp, E. coli
tgcgttttcttaccgtcaggctcta

SEQ ID NO: 67414 - DNA, 25 bp, E. coli
tgcgttttcttagcgtcaggctcta

SEQ ID NO: 67415 - DNA, 25 bp, E. coli
tgaaagccaaaaatttgcccactga

SEQ ID NO: 67416 - DNA, 25 bp, E. coli
tgaaagccaaaattttgcccactga

SEQ ID NO: 67417 - DNA, 25 bp, E. coli
gcacaccgcattgcgcctgagtttt

SEQ ID NO: 67418 - DNA, 25 bp, E. coli
gcacaccgcattccgcctgagtttt

SEQ ID NO: 67419 - DNA, 25 bp, E. coli
cgtcaggctctattcttacgatatg

SEQ ID NO: 67420 - DNA, 25 bp, E. coli
cgtcaggctctaatcttacgatatg

SEQ ID NO: 67421 - DNA, 25 bp, E. coli
tggcggttgtattggacttattttg

SEQ ID NO: 67422 - DNA, 25 bp, E. coli
tggaacaagccgcacaccgcattgc

SEQ ID NO: 67423 - DNA, 25 bp, E. coli
ggcaactggtttagtcagccggaga

SEQ ID NO: 67424 - DNA, 25 bp, E. coli
tggcggttgtataggacttattttg

SEQ ID NO: 67425 - DNA, 25 bp, E. coli
tggaacaagccggacaccgcattgc

SEQ ID NO: 67426 - DNA, 25 bp, E. coli
ggcaactggttttgtcagccggaga

SEQ ID NO: 67427 - DNA, 25 bp, E. coli
cactgaggcccgcattttgttagca

SEQ ID NO: 67428 - DNA, 25 bp, E. coli
caaaacaggcataaaagacttgcgg

SEQ ID NO: 67429 - DNA, 25 bp, E. coli
cactgaggcccggattttgttagca

SEQ ID NO: 67430 - DNA, 25 bp, E. coli
caaaacaggcattaaagacttgcgg

SEQ ID NO: 67431 - DNA, 25 bp, E. coli
catgaatttcatcgctaacacactc

SEQ ID NO: 67432 - DNA, 25 bp, E. coli
catgaatttcatggctaacacactc

SEQ ID NO: 67433 - DNA, 25 bp, E. coli
taaacgtttgcagcagatagagcca

SEQ ID NO: 67434 - DNA, 25 bp, E. coli
taaacgtttgcaccagatagagcca

SEQ ID NO: 67435 - DNA, 25 bp, E. coli
tagagccaaatggaggcactgaggc

SEQ ID NO: 67436 - DNA, 25 bp, E. coli
tagagccaaatgcaggcactgaggc

SEQ ID NO: 67437 - DNA, 25 bp, E. coli
tatcacgacacaatggttaaggctt

SEQ ID NO: 67438 - DNA, 25 bp, E. coli
tatcacgacacattggttaaggctt

SEQ ID NO: 67439 - DNA, 25 bp, E. coli
ccatgcaatggagagaaggtgagcc

SEQ ID NO: 67440 - DNA, 25 bp, E. coli
gcccctggtcgatccgagttcatga

SEQ ID NO: 67441 - DNA, 25 bp, E. coli
ccatgcaatggacagaaggtgagcc

SEQ ID NO: 67442 - DNA, 25 bp, E. coli
gcccctggtcgaaccgagttcatga

SEQ ID NO: 67443 - DNA, 25 bp, E. coli
gaaggtgagccgtgtttatcacgac

SEQ ID NO: 67444 - DNA, 25 bp, E. coli
gaaggtgagccgagtttatcacgac

SEQ ID NO: 67445 - DNA, 25 bp, E. coli
cgcattgttgctcgaagacgctaaa

SEQ ID NO: 67446 - DNA, 25 bp, E. coli
cgcattgttgctggaagacgctaaa

SEQ ID NO: 67447 - DNA, 25 bp, E. coli
tggttaaggctttaagaatcgagct

SEQ ID NO: 67448 - DNA, 25 bp, E. coli
tggttaaggcttaaagaatcgagct

SEQ ID NO: 67449 - DNA, 25 bp, E. coli
caaggagttcgtcatgagcaaaata

SEQ ID NO: 67450 - DNA, 25 bp, E. coli
caaggagttcgtgatgagcaaaata

SEQ ID NO: 67451 - DNA, 25 bp, E. coli
cactttgggtggtagaatagaccta

SEQ ID NO: 67452 - DNA, 25 bp, E. coli
cactttgggtggaagaatagaccta

SEQ ID NO: 67453 - DNA, 25 bp, E. coli
taaatcatattattcttcgcagcga

SEQ ID NO: 67454 - DNA, 25 bp, E. coli
taaatcatattaatcttcgcagcga

SEQ ID NO: 67455 - DNA, 25 bp, E. coli
tagtccacaggagttaaatgatccg

SEQ ID NO: 67456 - DNA, 25 bp, E. coli
tagacgttcttaatcactcaaggag

SEQ ID NO: 67457 - DNA, 25 bp, E. coli
tagtccacaggacttaaatgatccg

SEQ ID NO: 67458 - DNA, 25 bp, E. coli
tagacgttcttattcactcaaggag

SEQ ID NO: 67459 - DNA, 25 bp, E. coli
tttcagttgattctacgattacggg

SEQ ID NO: 67460 - DNA, 25 bp, E. coli
tttcagttgattgtacgattacggg

SEQ ID NO: 67461 - DNA, 25 bp, E. coli
ttcgcagcgatctgtctaaaatagc

SEQ ID NO: 67462 - DNA, 25 bp, E. coli
ttcgcagcgatcagtctaaaatagc

SEQ ID NO: 67463 - DNA, 25 bp, E. coli
ccttacaccggtgatcgattcgatt

SEQ ID NO: 67464 - DNA, 25 bp, E. coli
ccttacaccggtcatcgattcgatt

SEQ ID NO: 67465 - DNA, 25 bp, E. coli
gaaggaatattcattctcctggagc

SEQ ID NO: 67466 - DNA, 25 bp, E. coli
gaaggaatattctttctcctggagc

SEQ ID NO: 67467 - DNA, 25 bp, E. coli
cgtatagcaatagaacactttgggt

SEQ ID NO: 67468 - DNA, 25 bp, E. coli
cgtatagcaatacaacactttgggt

SEQ ID NO: 67469 - DNA, 25 bp, E. coli
taatcctcaggagttaaataatccg

SEQ ID NO: 67470 - DNA, 25 bp, E. coli
taatcctcaggacttaaataatccg

SEQ ID NO: 67471 - DNA, 25 bp, E. coli
cagcattttggtcgcgatagtatcg

SEQ ID NO: 67472 - DNA, 25 bp, E. coli
cagcattttggtggcgatagtatcg

SEQ ID NO: 67473 - DNA, 25 bp, E. coli
tactgatgcgcatcgaactgtttaa

SEQ ID NO: 67474 - DNA, 25 bp, E. coli
tactgatgcgcaacgaactgtttaa

SEQ ID NO: 67475 - DNA, 25 bp, E. coli
aaaactcgcctctccagcgtactga

SEQ ID NO: 67476 - DNA, 25 bp, E. coli
aaaactcgcctcaccagcgtactga

SEQ ID NO: 67477 - DNA, 25 bp, E. coli
tagtatcgccaacaaactgcgcgga

SEQ ID NO: 67478 - DNA, 25 bp, E. coli
tagtatcgccaagaaactgcgcgga

SEQ ID NO: 67479 - DNA, 25 bp, E. coli
tgcgcggacacggtaaattgtatcg

SEQ ID NO: 67480 - DNA, 25 bp, E. coli
tgcgcggacacgctaaattgtatcg

SEQ ID NO: 67481 - DNA, 25 bp, E. coli
ccataatgaaaatggcaaaactcgc

SEQ ID NO: 67482 - DNA, 25 bp, E. coli
cctggaagaaaatggacgaggaaca

SEQ ID NO: 67483 - DNA, 25 bp, E. coli
ccataatgaaaaaggcaaaactcgc

SEQ ID NO: 67484 - DNA, 25 bp, E. coli
cctggaagaaaaaggacgaggaaca

SEQ ID NO: 67485 - DNA, 25 bp, E. coli
gctgaaagccgagaaagagatgtct

SEQ ID NO: 67486 - DNA, 25 bp, E. coli
gctgaaagccgacaaagagatgtct

SEQ ID NO: 67487 - DNA, 25 bp, E. coli
gctgccgctgctcatgaaagacaaa

SEQ ID NO: 67488 - DNA, 25 bp, E. coli
gctgccgctgctgatgaaagacaaa

SEQ ID NO: 67489 - DNA, 25 bp, E. coli
ggaacaatttctccgtaatacctgg

SEQ ID NO: 67490 - DNA, 25 bp, E. coli
ggaacaatttctgcgtaatacctgg

SEQ ID NO: 67491 - DNA, 25 bp, E. coli
taagcaggagtttctgcacgcggtc

SEQ ID NO: 67492 - DNA, 25 bp, E. coli
taagcaggagttactgcacgcggtc

SEQ ID NO: 67493 - DNA, 25 bp, E. coli
cagcatgaagtttgttgcgccagaa

SEQ ID NO: 67494 - DNA, 25 bp, E. coli
cagcatgaagttagttgcgccagaa

SEQ ID NO: 67495 - DNA, 25 bp, E. coli
agctgtatgagtatcgcagacgcca

SEQ ID NO: 67496 - DNA, 25 bp, E. coli
agctgtatgagtttcgcagacgcca

SEQ ID NO: 67497 - DNA, 25 bp, E. coli
tttcggaggtcaacgcagagctgta

SEQ ID NO: 67498 - DNA, 25 bp, E. coli
tttcggaggtcatcgcagagctgta

SEQ ID NO: 67499 - DNA, 25 bp, E. coli
tttaaagcaggttgcgctgtcggca

SEQ ID NO: 67500 - DNA, 25 bp, E. coli
tttaaagcaggtagcgctgtcggca

SEQ ID NO: 67501 - DNA, 25 bp, E. coli
gcactgcacagtggagcttatctga

SEQ ID NO: 67502 - DNA, 25 bp, E. coli
gcactgcacagtcgagcttatctga

SEQ ID NO: 67503 - DNA, 25 bp, E. coli
gcacggtgacgctgccgcgtttaaa

SEQ ID NO: 67504 - DNA, 25 bp, E. coli
gcacggtgacgcagccgcgtttaaa

SEQ ID NO: 67505 - DNA, 25 bp, E. coli
cgttaccaggacaatgacgccacgg

SEQ ID NO: 67506 - DNA, 25 bp, E. coli
cgttaccaggactatgacgccacgg

SEQ ID NO: 67507 - DNA, 25 bp, E. coli
cggaacaggcggtaatcatcaggaa

SEQ ID NO: 67508 - DNA, 25 bp, E. coli
cggaacaggcggaaatcatcaggaa

SEQ ID NO: 67509 - DNA, 25 bp, E. coli
ctggacggcaaatgtgagcgcattc

SEQ ID NO: 67510 - DNA, 25 bp, E. coli
ctggacggcaaaagtgagcgcattc

SEQ ID NO: 67511 - DNA, 25 bp, E. coli
tcaacgcggtttactgctgggcacg

SEQ ID NO: 67512 - DNA, 25 bp, E. coli
tcaacgcggttttctgctgggcacg

SEQ ID NO: 67513 - DNA, 25 bp, E. coli
gagcgcattcaggactatttcaacg

SEQ ID NO: 67514 - DNA, 25 bp, E. coli
gagcgcattcagcactatttcaacg

SEQ ID NO: 67515 - DNA, 25 bp, E. coli
taaaaggtgacgtgctggagatgaa

SEQ ID NO: 67516 - DNA, 25 bp, E. coli
taaaaggtgacgagctggagatgaa

SEQ ID NO: 67517 - DNA, 25 bp, E. coli
tactgaaagaagaaggttgccacgg

SEQ ID NO: 67518 - DNA, 25 bp, E. coli
tactgaaagaagtaggttgccacgg

SEQ ID NO: 67519 - DNA, 25 bp, E. coli
tatagcgaagccgtaaaaggtgacg

SEQ ID NO: 67520 - DNA, 25 bp, E. coli
tatagcgaagccctaaaaggtgacg

SEQ ID NO: 67521 - DNA, 25 bp, E. coli
ttgccacggctatgcgccaatggtg

SEQ ID NO: 67522 - DNA, 25 bp, E. coli
ttgccacggctaagcgccaatggtg

SEQ ID NO: 67523 - DNA, 25 bp, E. coli
tgattgagcagtgggaaagcatcgc

SEQ ID NO: 67524 - DNA, 25 bp, E. coli
tgattgagcagtcggaaagcatcgc

SEQ ID NO: 67525 - DNA, 25 bp, E. coli
tctatggcaccggattctatcgtga

SEQ ID NO: 67526 - DNA, 25 bp, E. coli
tctatggcaccgcattctatcgtga

SEQ ID NO: 67527 - DNA, 25 bp, E. coli
tcttgaagcgcatctgcaaaccccg

SEQ ID NO: 67528 - DNA, 25 bp, E. coli
tcttgaagcgcaactgcaaaccccg

SEQ ID NO: 67529 - DNA, 25 bp, E. coli
gctaaaatcgttccaaccgtactga

SEQ ID NO: 67530 - DNA, 25 bp, E. coli
gctaaaatcgttgcaaccgtactga

SEQ ID NO: 67531 - DNA, 25 bp, E. coli
gaaatccgtactcgtcctggtcaac

SEQ ID NO: 67532 - DNA, 25 bp, E. coli
gaaagcatcgcgcatcttgaagcgc

SEQ ID NO: 67533 - DNA, 25 bp, E. coli
gaaatccgtactggtcctggtcaac

SEQ ID NO: 67534 - DNA, 25 bp, E. coli
gaaagcatcgcggatcttgaagcgc

SEQ ID NO: 67535 - DNA, 25 bp, E. coli
ggcgtgagtttccagtctatggcac

SEQ ID NO: 67536 - DNA, 25 bp, E. coli
ggcgtgagtttcgagtctatggcac

SEQ ID NO: 67537 - DNA, 25 bp, E. coli
aatccgctctggtcgagaccgcgca

SEQ ID NO: 67538 - DNA, 25 bp, E. coli
aatccgctctggacgagaccgcgca

SEQ ID NO: 67539 - DNA, 25 bp, E. coli
agcaaaaggcggagtctcaccgcaa

SEQ ID NO: 67540 - DNA, 25 bp, E. coli
agcaaaaggcggtgtctcaccgcaa

SEQ ID NO: 67541 - DNA, 25 bp, E. coli
aaccggcagttagaatccgctctgg

SEQ ID NO: 67542 - DNA, 25 bp, E. coli
aaccggcagttacaatccgctctgg

SEQ ID NO: 67543 - DNA, 25 bp, E. coli
ttgtggcgcactcgcaggaacggcc

SEQ ID NO: 67544 - DNA, 25 bp, E. coli
ttgtggcgcactggcaggaacggcc

SEQ ID NO: 67545 - DNA, 25 bp, E. coli
ttacaatccgctctggtcgagaccg

SEQ ID NO: 67546 - DNA, 25 bp, E. coli
ttacaatccgctgtggtcgagaccg

SEQ ID NO: 67547 - DNA, 25 bp, E. coli
tcgagaccgcgctgaacaatcagga

SEQ ID NO: 67548 - DNA, 25 bp, E. coli
tcgagaccgcgcagaacaatcagga

SEQ ID NO: 67549 - DNA, 25 bp, E. coli
cccgctaggttgtggcgcactggca

SEQ ID NO: 67550 - DNA, 25 bp, E. coli
cccgctaggttgaggcgcactggca

SEQ ID NO: 67551 - DNA, 25 bp, E. coli
ctctggtcgagaccgcgcagaacaa

SEQ ID NO: 67552 - DNA, 25 bp, E. coli
ctctggtcgagagcgcgcagaacaa

SEQ ID NO: 67553 - DNA, 25 bp, E. coli
ggctaaccggcagttacaatccgct

SEQ ID NO: 67554 - DNA, 25 bp, E. coli
ggctaaccggcacttacaatccgct

SEQ ID NO: 67555 - DNA, 25 bp, E. coli
ggcagttacaatccgctctggtcga

SEQ ID NO: 67556 - DNA, 25 bp, E. coli
ggcagttacaatgcgctctggtcga

SEQ ID NO: 67557 - DNA, 25 bp, E. coli
gaccgcgcagaagaatcaggacgcg

SEQ ID NO: 67558 - DNA, 25 bp, E. coli
gaccgcgcagaacaatcaggacgcg

SEQ ID NO: 67559 - DNA, 25 bp, E. coli
aaggtgatgtggtggtcagtggtgc

SEQ ID NO: 67560 - DNA, 25 bp, E. coli
aaggtgatgtggaggtcagtggtgc

SEQ ID NO: 67561 - DNA, 25 bp, E. coli
cagcagaaggtgatgtggtggtcag

SEQ ID NO: 67562 - DNA, 25 bp, E. coli
cagaaggtgatgtggtggtcagtgg

SEQ ID NO: 67563 - DNA, 25 bp, E. coli
cagcagaaggtgttgtggtggtcag

SEQ ID NO: 67564 - DNA, 25 bp, E. coli
cagaaggtgatgaggtggtcagtgg

SEQ ID NO: 67565 - DNA, 25 bp, E. coli
tggtcagtggtggaactgagccgga

SEQ ID NO: 67566 - DNA, 25 bp, E. coli
tggtggtcagtgctgcaactgagcc

SEQ ID NO: 67567 - DNA, 25 bp, E. coli
tgtggtggtcagaggtgcaactgag

SEQ ID NO: 67568 - DNA, 25 bp, E. coli
tgtggtggtcagtggtgcaactgag

SEQ ID NO: 67569 - DNA, 25 bp, E. coli
tgatgtggtggtcagtggtgcaact

SEQ ID NO: 67570 - DNA, 25 bp, E. coli
tgatgtggtggtgagtggtgcaact

SEQ ID NO: 67571 - DNA, 25 bp, E. coli
ggtggtcagtggagcaactgagccg

SEQ ID NO: 67572 - DNA, 25 bp, E. coli
ggtgatgtggtgctcagtggtgcaa

SEQ ID NO: 67573 - DNA, 25 bp, E. coli
gtgatgtggtggtcagtggtgcaac

SEQ ID NO: 67574 - DNA, 25 bp, E. coli
ggtgatgtggtggtcagtggtgcaa

SEQ ID NO: 67575 - DNA, 25 bp, E. coli
ggtggtcagtggtgcaactgagccg

SEQ ID NO: 67576 - DNA, 25 bp, E. coli
gtgatgtggtggacagtggtgcaac

SEQ ID NO: 67577 - DNA, 25 bp, E. coli
tggtggtcagtggtgcaactgagcc

SEQ ID NO: 67578 - DNA, 25 bp, E. coli
tggtcagtggtgcaactgagccgga

SEQ ID NO: 67579 - DNA, 25 bp, E. coli
gatgtggtggtctgtggtgcaactg

SEQ ID NO: 67580 - DNA, 25 bp, E. coli
gatgtggtggtcagtggtgcaactg

SEQ ID NO: 67581 - DNA, 25 bp, E. coli
cagaccgtacgagaaatcattagcg

SEQ ID NO: 67582 - DNA, 25 bp, E. coli
cagaccgtacgacaaatcattagcg

SEQ ID NO: 67583 - DNA, 25 bp, E. coli
tacgtttatctgaacggtacgcgcc

SEQ ID NO: 67584 - DNA, 25 bp, E. coli
aaaaggctcgtcaggttaatggcga

SEQ ID NO: 67585 - DNA, 25 bp, E. coli
aaaaggctcgtctggttaatggcga

SEQ ID NO: 67586 - DNA, 25 bp, E. coli
tacgtttatctgtacggtacgcgcc

SEQ ID NO: 67587 - DNA, 25 bp, E. coli
tgtggagcttccgtaccagaccgta

SEQ ID NO: 67588 - DNA, 25 bp, E. coli
tgtggagcttccctaccagaccgta

SEQ ID NO: 67589 - DNA, 25 bp, E. coli
tgacggaattgttccatccgaaaaa

SEQ ID NO: 67590 - DNA, 25 bp, E. coli
tgacggaattgtaccatccgaaaaa

SEQ ID NO: 67591 - DNA, 25 bp, E. coli
tgaccaaagagcttgcacaaggtgt

SEQ ID NO: 67592 - DNA, 25 bp, E. coli
tgaccaaagagcatgcacaaggtgt

SEQ ID NO: 67593 - DNA, 25 bp, E. coli
tcattagcgaagctgaaaaggctcg

SEQ ID NO: 67594 - DNA, 25 bp, E. coli
tcattagcgaaggtgaaaaggctcg

SEQ ID NO: 67595 - DNA, 25 bp, E. coli
cgcgcatcagcctttgacggaattg

SEQ ID NO: 67596 - DNA, 25 bp, E. coli
cgcgcatcagccattgacggaattg

SEQ ID NO: 67597 - DNA, 25 bp, E. coli
cggtgaactgtttttacgcgcatca

SEQ ID NO: 67598 - DNA, 25 bp, E. coli
cggtacgcgcctgactgtggagctt

SEQ ID NO: 67599 - DNA, 25 bp, E. coli
cggtgaactgttattacgcgcatca

SEQ ID NO: 67600 - DNA, 25 bp, E. coli
cggtacgcgcctcactgtggagctt

SEQ ID NO: 67601 - DNA, 25 bp, E. coli
taatggcgatgaaccctatatcgaa

SEQ ID NO: 67602 - DNA, 25 bp, E. coli
taatggcgatgatccctatatcgaa

SEQ ID NO: 67603 - DNA, 25 bp, E. coli
tattcatgtggctaacggtatcacg

SEQ ID NO: 67604 - DNA, 25 bp, E. coli
tattcatgtggcaaacggtatcacg

SEQ ID NO: 67605 - DNA, 25 bp, E. coli
tgttaattcacaacggcatgggcac

SEQ ID NO: 67606 - DNA, 25 bp, E. coli
tgttaattcacatcggcatgggcac

SEQ ID NO: 67607 - DNA, 25 bp, E. coli
tgcgcgtaccgcaaccttattgtag

SEQ ID NO: 67608 - DNA, 25 bp, E. coli
tgcgcgtaccgctaccttattgtag

SEQ ID NO: 67609 - DNA, 25 bp, E. coli
tctcgtcgatgtagcaggatatccg

SEQ ID NO: 67610 - DNA, 25 bp, E. coli
tctcgtcgatgttgcaggatatccg

SEQ ID NO: 67611 - DNA, 25 bp, E. coli
gcgcatgggattcccgtaccggaaa

SEQ ID NO: 67612 - DNA, 25 bp, E. coli
gcaggtttccgatgccgtcaaaagc

SEQ ID NO: 67613 - DNA, 25 bp, E. coli
gcgcatgggattgccgtaccggaaa

SEQ ID NO: 67614 - DNA, 25 bp, E. coli
gcaggtttccgaagccgtcaaaagc

SEQ ID NO: 67615 - DNA, 25 bp, E. coli
gatctgctcctgctgacgctgaaag

SEQ ID NO: 67616 - DNA, 25 bp, E. coli
gatcgaacgcgatgggcatcatact

SEQ ID NO: 67617 - DNA, 25 bp, E. coli
gatatttaacgattcgctgaccgcc

SEQ ID NO: 67618 - DNA, 25 bp, E. coli
gatatttaacgaatcgctgaccgcc

SEQ ID NO: 67619 - DNA, 25 bp, E. coli
gatcgaacgcgaagggcatcatact

SEQ ID NO: 67620 - DNA, 25 bp, E. coli
gatctgctcctggtgacgctgaaag

SEQ ID NO: 67621 - DNA, 25 bp, E. coli
ggtgaattacgtcatcatccgcaag

SEQ ID NO: 67622 - DNA, 25 bp, E. coli
ggtgaattacgtgatcatccgcaag

SEQ ID NO: 67623 - DNA, 25 bp, E. coli
tcaatggttttcacttacgccgcgc

SEQ ID NO: 67624 - DNA, 25 bp, E. coli
tcaatggttttctcttacgccgcgc

SEQ ID NO: 67625 - DNA, 25 bp, E. coli
taaatttcagtaagttaagctgcta

SEQ ID NO: 67626 - DNA, 25 bp, E. coli
taaatttcagtatgttaagctgcta

SEQ ID NO: 67627 - DNA, 25 bp, E. coli
aaagcgccgcttggtgttgtggcaa

SEQ ID NO: 67628 - DNA, 25 bp, E. coli
aaagcgccgcttcgtgttgtggcaa

SEQ ID NO: 67629 - DNA, 25 bp, E. coli
tatgcttaccgataagaagaacagt

SEQ ID NO: 67630 - DNA, 25 bp, E. coli
tatgcttaccgaaaagaagaacagt

SEQ ID NO: 67631 - DNA, 25 bp, E. coli
tttcacgcgtttagtgcttaccggg

SEQ ID NO: 67632 - DNA, 25 bp, E. coli
tttcacgcgttttgtgcttaccggg

SEQ ID NO: 67633 - DNA, 25 bp, E. coli
ttcagcccctttacagacgacatag

SEQ ID NO: 67634 - DNA, 25 bp, E. coli
ttcagccccttttcagacgacatag

SEQ ID NO: 67635 - DNA, 25 bp, E. coli
tctaagttataggaaaaagcgccgc

SEQ ID NO: 67636 - DNA, 25 bp, E. coli
tctaagttatagcaaaaagcgccgc

SEQ ID NO: 67637 - DNA, 25 bp, E. coli
gctgctaaaaacatcgactactgtg

SEQ ID NO: 67638 - DNA, 25 bp, E. coli
gctgctaaaaacttcgactactgtg

SEQ ID NO: 67639 - DNA, 25 bp, E. coli
gaacagtaaatcatctcagcgtggg

SEQ ID NO: 67640 - DNA, 25 bp, E. coli
gaacagtaaatcttctcagcgtggg

SEQ ID NO: 67641 - DNA, 25 bp, E. coli
cgacatagtcaaagccgaaaaaggg

SEQ ID NO: 67642 - DNA, 25 bp, E. coli
cgacatagtcaatgccgaaaaaggg

SEQ ID NO: 67643 - DNA, 25 bp, E. coli
gattaatttcacttcccttcgataa

SEQ ID NO: 67644 - DNA, 25 bp, E. coli
gattaatttcacatcccttcgataa

SEQ ID NO: 67645 - DNA, 25 bp, E. coli
gggctaagtcaaacatcagtactta

SEQ ID NO: 67646 - DNA, 25 bp, E. coli
gggctaagtcaatcatcagtactta

SEQ ID NO: 67647 - DNA, 25 bp, E. coli
cacgacgctctccttgttattggct

SEQ ID NO: 67648 - DNA, 25 bp, E. coli
cacgacgctctcgttgttattggct

SEQ ID NO: 67649 - DNA, 25 bp, E. coli
tatatcactggtgctgacaatgtgg

SEQ ID NO: 67650 - DNA, 25 bp, E. coli
tatatcactggtcctgacaatgtgg

SEQ ID NO: 67651 - DNA, 25 bp, E. coli
tttttcacggtgacaaacagcgcgt

SEQ ID NO: 67652 - DNA, 25 bp, E. coli
tttttcacggtgtcaaacagcgcgt

SEQ ID NO: 67653 - DNA, 25 bp, E. coli
tgtggatgaggtcgcctttaaaaaa

SEQ ID NO: 67654 - DNA, 25 bp, E. coli
tgtggatgaggtggcctttaaaaaa

SEQ ID NO: 67655 - DNA, 25 bp, E. coli
tgctgacaatgtcgatgaggtcgcc

SEQ ID NO: 67656 - DNA, 25 bp, E. coli
tgctgacaatgtggatgaggtcgcc

SEQ ID NO: 67657 - DNA, 25 bp, E. coli
cgtgcgctttgctatccgtcttata

SEQ ID NO: 67658 - DNA, 25 bp, E. coli
cggtgacaaacaccgcgtgcgcttt

SEQ ID NO: 67659 - DNA, 25 bp, E. coli
cggtgacaaacagcgcgtgcgcttt

SEQ ID NO: 67660 - DNA, 25 bp, E. coli
cgtgcgctttgcaatccgtcttata

SEQ ID NO: 67661 - DNA, 25 bp, E. coli
gttattggctttagccgtcgcaccg

SEQ ID NO: 67662 - DNA, 25 bp, E. coli
gttattggcttttgccgtcgcaccg

SEQ ID NO: 67663 - DNA, 25 bp, E. coli
gtgcagaggaatgcgcacgacgctc

SEQ ID NO: 67664 - DNA, 25 bp, E. coli
gtgcagaggaatccgcacgacgctc

SEQ ID NO: 67665 - DNA, 25 bp, E. coli
ggaatgcgcacgtcgctctcgttgt

SEQ ID NO: 67666 - DNA, 25 bp, E. coli
tttgccgtcgcagcgtcgtttttca

SEQ ID NO: 67667 - DNA, 25 bp, E. coli
tttgccgtcgcaccgtcgtttttca

SEQ ID NO: 67668 - DNA, 25 bp, E. coli
ggaatgcgcacgacgctctcgttgt

SEQ ID NO: 67669 - DNA, 25 bp, E. coli
caagtcgtagtaaatctggcgtcat

SEQ ID NO: 67670 - DNA, 25 bp, E. coli
caagtcgtagtatatctggcgtcat

SEQ ID NO: 67671 - DNA, 25 bp, E. coli
acgttgagtcaagccgagggctcca

SEQ ID NO: 67672 - DNA, 25 bp, E. coli
acgttgagtcaacccgagggctcca

SEQ ID NO: 67673 - DNA, 25 bp, E. coli
aaaagtttatgtccgagacccgatg

SEQ ID NO: 67674 - DNA, 25 bp, E. coli
aaaagtttatgtgcgagacccgatg

SEQ ID NO: 67675 - DNA, 25 bp, E. coli
tatggtctaatccttgagtcgtggg

SEQ ID NO: 67676 - DNA, 25 bp, E. coli
tatggtctaatcgttgagtcgtggg

SEQ ID NO: 67677 - DNA, 25 bp, E. coli
tgaaaactgtggtaaaaatgctccg

SEQ ID NO: 67678 - DNA, 25 bp, E. coli
tgaaaactgtggaaaaaatgctccg

SEQ ID NO: 67679 - DNA, 25 bp, E. coli
gccgggtgacagtaacaaagattac

SEQ ID NO: 67680 - DNA, 25 bp, E. coli
gccgggtgacagaaacaaagattac

SEQ ID NO: 67681 - DNA, 25 bp, E. coli
gattctggtgtatcccaagtcgtag

SEQ ID NO: 67682 - DNA, 25 bp, E. coli
gattctggtgtaacccaagtcgtag

SEQ ID NO: 67683 - DNA, 25 bp, E. coli
gggctccaggaatccagttgaggta

SEQ ID NO: 67684 - DNA, 25 bp, E. coli
gggctccaggaaaccagttgaggta

SEQ ID NO: 67685 - DNA, 25 bp, E. coli
taatacgtggagtactatcagagct

SEQ ID NO: 67686 - DNA, 25 bp, E. coli
tcacagcctacagatgatgaatcgc

SEQ ID NO: 67687 - DNA, 25 bp, E. coli
tcacagcctacacatgatgaatcgc

SEQ ID NO: 67688 - DNA, 25 bp, E. coli
taatacgtggagaactatcagagct

SEQ ID NO: 67689 - DNA, 25 bp, E. coli
gataactgtgttcccctttgtccga

SEQ ID NO: 67690 - DNA, 25 bp, E. coli
gataactgtgttgccctttgtccga

SEQ ID NO: 67691 - DNA, 25 bp, E. coli
catgaacagcatcggatttaccggc

SEQ ID NO: 67692 - DNA, 25 bp, E. coli
catgaacagcatgggatttaccggc

SEQ ID NO: 67693 - DNA, 25 bp, E. coli
taaatatgcgctcgaggcgtggtca

SEQ ID NO: 67694 - DNA, 25 bp, E. coli
taaatatgcgctggaggcgtggtca

SEQ ID NO: 67695 - DNA, 25 bp, E. coli
taaagcaacggacatcctgacaggt

SEQ ID NO: 67696 - DNA, 25 bp, E. coli
taaagcaacggagatcctgacaggt

SEQ ID NO: 67697 - DNA, 25 bp, E. coli
atcagccgtgcggagatggaacagc

SEQ ID NO: 67698 - DNA, 25 bp, E. coli
agaaagtgttgatcgcgcagccgac

SEQ ID NO: 67699 - DNA, 25 bp, E. coli
atcagccgtgcgcagatggaacagc

SEQ ID NO: 67700 - DNA, 25 bp, E. coli
agaaagtgttgaacgcgcagccgac

SEQ ID NO: 67701 - DNA, 25 bp, E. coli
tattagcgagaacccgaagatgcgc

SEQ ID NO: 67702 - DNA, 25 bp, E. coli
tattagcgagaagccgaagatgcgc

SEQ ID NO: 67703 - DNA, 25 bp, E. coli
ttaccggcgtgttgatcgatctgga

SEQ ID NO: 67704 - DNA, 25 bp, E. coli
ttaccggcgtgtagatcgatctgga

SEQ ID NO: 67705 - DNA, 25 bp, E. coli
gaaaccggatgatgttgagcgcatg

SEQ ID NO: 67706 - DNA, 25 bp, E. coli
gaaaccggatgaagttgagcgcatg

SEQ ID NO: 67707 - DNA, 25 bp, E. coli
ggcgcgtgatggacaaaatattgca

SEQ ID NO: 67708 - DNA, 25 bp, E. coli
ggcgcgtgatggtcaaaatattgca

SEQ ID NO: 67709 - DNA, 25 bp, E. coli
taatggtgcttatgcgcctgctgcc

SEQ ID NO: 67710 - DNA, 25 bp, E. coli
taatggtgcttaagcgcctgctgcc

SEQ ID NO: 67711 - DNA, 25 bp, E. coli
gatctttaacaatgccggattcggc

SEQ ID NO: 67712 - DNA, 25 bp, E. coli
gatctttaacaaagccggattcggc

SEQ ID NO: 67713 - DNA, 25 bp, E. coli
aacgcggtcgctcaatgacgctaaa

SEQ ID NO: 67714 - DNA, 25 bp, E. coli
cagttcgccctgcaatgtatccgat

SEQ ID NO: 67715 - DNA, 25 bp, E. coli
cagttcgccctggaatgtatccgat

SEQ ID NO: 67716 - DNA, 25 bp, E. coli
gacgctaaaaatattcttgttgctg

SEQ ID NO: 67717 - DNA, 25 bp, E. coli
gacgctaaaaattttcttgttgctg

SEQ ID NO: 67718 - DNA, 25 bp, E. coli
acagaaagaccgcacacagttcgcc

SEQ ID NO: 67719 - DNA, 25 bp, E. coli
aacgcggtcgctgaatgacgctaaa

SEQ ID NO: 67720 - DNA, 25 bp, E. coli
acagaaagaccggacacagttcgcc

SEQ ID NO: 67721 - DNA, 25 bp, E. coli
tatccgatacatcgcaacgcggtcg

SEQ ID NO: 67722 - DNA, 25 bp, E. coli
tatccgatacatggcaacgcggtcg

SEQ ID NO: 67723 - DNA, 25 bp, E. coli
tgtgcaataaaagcacaccggacgc

SEQ ID NO: 67724 - DNA, 25 bp, E. coli
tgtgcaataaaaccacaccggacgc

SEQ ID NO: 67725 - DNA, 25 bp, E. coli
tgaatgcacggcagagcttgcgcag

SEQ ID NO: 67726 - DNA, 25 bp, E. coli
tgaatgcacggctgagcttgcgcag

SEQ ID NO: 67727 - DNA, 25 bp, E. coli
tgcgcagggagaagaacagaaagac

SEQ ID NO: 67728 - DNA, 25 bp, E. coli
tgcgcagggagatgaacagaaagac

SEQ ID NO: 67729 - DNA, 25 bp, E. coli
tcttgttgctgattgtgaaaatggg

SEQ ID NO: 67730 - DNA, 25 bp, E. coli
tcttgttgctgaatgtgaaaatggg

SEQ ID NO: 67731 - DNA, 25 bp, E. coli
tcactacgctgatgcacgcgcttat

SEQ ID NO: 67732 - DNA, 25 bp, E. coli
cgcttattgatattgaatgcacggc

SEQ ID NO: 67733 - DNA, 25 bp, E. coli
cgcttattgataatgaatgcacggc

SEQ ID NO: 67734 - DNA, 25 bp, E. coli
tcactacgctgaagcacgcgcttat

SEQ ID NO: 67735 - DNA, 25 bp, E. coli
caacaattacgcctactgcggtagg

SEQ ID NO: 67736 - DNA, 25 bp, E. coli
caacaattacgcgtactgcggtagg

SEQ ID NO: 67737 - DNA, 25 bp, E. coli
taggctcttagactaaaagtgacga

SEQ ID NO: 67738 - DNA, 25 bp, E. coli
taggctcttagagtaaaagtgacga

SEQ ID NO: 67739 - DNA, 25 bp, E. coli
tattagctataaagcgcaacaattt

SEQ ID NO: 67740 - DNA, 25 bp, E. coli
tattagctataatgcgcaacaattt

SEQ ID NO: 67741 - DNA, 25 bp, E. coli
tttatttgtcagattggccctgggt

SEQ ID NO: 67742 - DNA, 25 bp, E. coli
tttatttgtcagtttggccctgggt

SEQ ID NO: 67743 - DNA, 25 bp, E. coli
tgcggtcctcaattgaaaataagcc

SEQ ID NO: 67744 - DNA, 25 bp, E. coli
tgcggtcctcaaatgaaaataagcc

SEQ ID NO: 67745 - DNA, 25 bp, E. coli
cctactgcggtacgctcttagagta

SEQ ID NO: 67746 - DNA, 25 bp, E. coli
gcgcctgtcccattaggctatttta

SEQ ID NO: 67747 - DNA, 25 bp, E. coli
cctactgcggtaggctcttagagta

SEQ ID NO: 67748 - DNA, 25 bp, E. coli
gcgcctgtcccaataggctatttta

SEQ ID NO: 67749 - DNA, 25 bp, E. coli
gccctcaactttttgacatgacgcg

SEQ ID NO: 67750 - DNA, 25 bp, E. coli
gccctcaactttatgacatgacgcg

SEQ ID NO: 67751 - DNA, 25 bp, E. coli
gcaacaattttcttagcgcctgtcc

SEQ ID NO: 67752 - DNA, 25 bp, E. coli
gcaacaattttcatagcgcctgtcc

SEQ ID NO: 67753 - DNA, 25 bp, E. coli
gacatgacgcgcatattagctataa

SEQ ID NO: 67754 - DNA, 25 bp, E. coli
gacatgacgcgcttattagctataa

SEQ ID NO: 67755 - DNA, 25 bp, E. coli
ggccctgggttatgctcgaaatcct

SEQ ID NO: 67756 - DNA, 25 bp, E. coli
ggccctgggttaagctcgaaatcct

SEQ ID NO: 67757 - DNA, 25 bp, E. coli
ttttgtcaccgaccgtaagccgcta

SEQ ID NO: 67758 - DNA, 25 bp, E. coli
ttttgtcaccgagcgtaagccgcta

SEQ ID NO: 67759 - DNA, 25 bp, E. coli
tgcaaaactggaagcagcgcagtca

SEQ ID NO: 67760 - DNA, 25 bp, E. coli
tgcaaaactggatgcagcgcagtca

SEQ ID NO: 67761 - DNA, 25 bp, E. coli
gctcgaacaatggtttgaacccgga

SEQ ID NO: 67762 - DNA, 25 bp, E. coli
gctcgaacaatgctttgaacccgga

SEQ ID NO: 67763 - DNA, 25 bp, E. coli
gctctacgcgctcgctagccgaaaa

SEQ ID NO: 67764 - DNA, 25 bp, E. coli
gctctacgcgctggctagccgaaaa

SEQ ID NO: 67765 - DNA, 25 bp, E. coli
gcatgccaggctatcaccgatatga

SEQ ID NO: 67766 - DNA, 25 bp, E. coli
gcatgccaggctttcaccgatatga

SEQ ID NO: 67767 - DNA, 25 bp, E. coli
gaaaaaattatccaggccacgctgg

SEQ ID NO: 67768 - DNA, 25 bp, E. coli
gaaaaaattatcgaggccacgctgg

SEQ ID NO: 67769 - DNA, 25 bp, E. coli
cccgcgcgcttgttgcgtttattga

SEQ ID NO: 67770 - DNA, 25 bp, E. coli
ccgatatgatcttcagctcacaggt

SEQ ID NO: 67771 - DNA, 25 bp, E. coli
ccgttgggatcgatgacctactatt

SEQ ID NO: 67772 - DNA, 25 bp, E. coli
ccgttgggatcgttgacctactatt

SEQ ID NO: 67773 - DNA, 25 bp, E. coli
cccgcgcgcttgatgcgtttattga

SEQ ID NO: 67774 - DNA, 25 bp, E. coli
ccgatatgatctacagctcacaggt

SEQ ID NO: 67775 - DNA, 25 bp, E. coli
cggtgaaactttacggaatacatgc

SEQ ID NO: 67776 - DNA, 25 bp, E. coli
cggtgaaacttttcggaatacatgc

SEQ ID NO: 67777 - DNA, 25 bp, E. coli
gttttactgagatcatgtcccggca

SEQ ID NO: 67778 - DNA, 25 bp, E. coli
gttttactgagaacatgtcccggca

SEQ ID NO: 67779 - DNA, 25 bp, E. coli
catcgtcgggatttagaaaaccagc

SEQ ID NO: 67780 - DNA, 25 bp, E. coli
catcgtcgggatatagaaaaccagc

SEQ ID NO: 67781 - DNA, 25 bp, E. coli
aaaccagctggtacgtgtggacaag

SEQ ID NO: 67782 - DNA, 25 bp, E. coli
aaaacaatcttcatagcctgagcgg

SEQ ID NO: 67783 - DNA, 25 bp, E. coli
aaaacaatcttcttagcctgagcgg

SEQ ID NO: 67784 - DNA, 25 bp, E. coli
aaaccagctggttcgtgtggacaag

SEQ ID NO: 67785 - DNA, 25 bp, E. coli
tatctaccagatggaactgcaacgg

SEQ ID NO: 67786 - DNA, 25 bp, E. coli
tatagccgccgtcttaatgtcagtg

SEQ ID NO: 67787 - DNA, 25 bp, E. coli
tatctaccagatcgaactgcaacgg

SEQ ID NO: 67788 - DNA, 25 bp, E. coli
tataagggagcaccacagaatacgc

SEQ ID NO: 67789 - DNA, 25 bp, E. coli
tatagccgccgtgttaatgtcagtg

SEQ ID NO: 67790 - DNA, 25 bp, E. coli
tataagggagcagcacagaatacgc

SEQ ID NO: 67791 - DNA, 25 bp, E. coli
ttattgttggtacctatagccgccg

SEQ ID NO: 67792 - DNA, 25 bp, E. coli
ttattgttggtagctatagccgccg

SEQ ID NO: 67793 - DNA, 25 bp, E. coli
tcagattcagacacaggcagcagat

SEQ ID NO: 67794 - DNA, 25 bp, E. coli
tcagatattatagagcgtgcagagg

SEQ ID NO: 67795 - DNA, 25 bp, E. coli
tcagattcagactcaggcagcagat

SEQ ID NO: 67796 - DNA, 25 bp, E. coli
tcagatattatacagcgtgcagagg

SEQ ID NO: 67797 - DNA, 25 bp, E. coli
tcactgtcgggcaaatggtcaatcc

SEQ ID NO: 67798 - DNA, 25 bp, E. coli
tcactgtcgggctaatggtcaatcc

SEQ ID NO: 67799 - DNA, 25 bp, E. coli
gaggtcacaacctggccaagagctg

SEQ ID NO: 67800 - DNA, 25 bp, E. coli
gaggtcacaaccaggccaagagctg

SEQ ID NO: 67801 - DNA, 25 bp, E. coli
caaggtactgaatctgaacatcggc

SEQ ID NO: 67802 - DNA, 25 bp, E. coli
aaccggcgcggtatattccaaagag

SEQ ID NO: 67803 - DNA, 25 bp, E. coli
aaccggcgcggtttattccaaagag

SEQ ID NO: 67804 - DNA, 25 bp, E. coli
caaggtactgaaactgaacatcggc

SEQ ID NO: 67805 - DNA, 25 bp, E. coli
catcggcaatggagtatcggagctt

SEQ ID NO: 67806 - DNA, 25 bp, E. coli
catcggcaatggtgtatcggagctt

SEQ ID NO: 67807 - DNA, 25 bp, E. coli
tccaaaggtctttactccgcgcgta

SEQ ID NO: 67808 - DNA, 25 bp, E. coli
tccaaaggtcttaactccgcgcgta

SEQ ID NO: 67809 - DNA, 25 bp, E. coli
tccgtggtccggagctgaaagaagc

SEQ ID NO: 67810 - DNA, 25 bp, E. coli
tccgtggtccggtgctgaaagaagc

SEQ ID NO: 67811 - DNA, 25 bp, E. coli
tctttatgagcaccgtaaccgcgcg

SEQ ID NO: 67812 - DNA, 25 bp, E. coli
tcggagcttatccttcaggcaatgc

SEQ ID NO: 67813 - DNA, 25 bp, E. coli
tcggagcttatcgttcaggcaatgc

SEQ ID NO: 67814 - DNA, 25 bp, E. coli
tctttatgagcagcgtaaccgcgcg

SEQ ID NO: 67815 - DNA, 25 bp, E. coli
tccagcggtaaagcggtgcattatc

SEQ ID NO: 67816 - DNA, 25 bp, E. coli
tccagcggtaaaccggtgcattatc

SEQ ID NO: 67817 - DNA, 25 bp, E. coli
gacaaaattctcaacgacgacgctg

SEQ ID NO: 67818 - DNA, 25 bp, E. coli
gacaaaattctctacgacgacgctg

SEQ ID NO: 67819 - DNA, 25 bp, E. coli
gatattccgggcctttcctgcgtga

SEQ ID NO: 67820 - DNA, 25 bp, E. coli
gatattccgggcgtttcctgcgtga

SEQ ID NO: 67821 - DNA, 25 bp, E. coli
taaaattacgccacgtacgcgtggg

SEQ ID NO: 67822 - DNA, 25 bp, E. coli
taaaattacgcctcgtacgcgtggg

SEQ ID NO: 67823 - DNA, 25 bp, E. coli
caatcttatcgtgaaggcatacttt

SEQ ID NO: 67824 - DNA, 25 bp, E. coli
caatcttatcgtcaaggcatacttt

SEQ ID NO: 67825 - DNA, 25 bp, E. coli
ccgccctggtagtcttagtaagcgg

SEQ ID NO: 67826 - DNA, 25 bp, E. coli
ccgccctggtagacttagtaagcgg

SEQ ID NO: 67827 - DNA, 25 bp, E. coli
tatcgtgaaggcatactttcaggag

SEQ ID NO: 67828 - DNA, 25 bp, E. coli
tatcgtgaaggcttactttcaggag

SEQ ID NO: 67829 - DNA, 25 bp, E. coli
tgatgagtagcttcatcatgaccct

SEQ ID NO: 67830 - DNA, 25 bp, E. coli
tgacaatcttatggtgaaggcatac

SEQ ID NO: 67831 - DNA, 25 bp, E. coli
tgatgagtagctacatcatgaccct

SEQ ID NO: 67832 - DNA, 25 bp, E. coli
tgacaatcttatcgtgaaggcatac

SEQ ID NO: 67833 - DNA, 25 bp, E. coli
tgaaggcatactatcaggagtgagg

SEQ ID NO: 67834 - DNA, 25 bp, E. coli
tgaaggcatactttcaggagtgagg

SEQ ID NO: 67835 - DNA, 25 bp, E. coli
tcttatcgtgaaggcatactttcag

SEQ ID NO: 67836 - DNA, 25 bp, E. coli
tcttatcgtgaacgcatactttcag

SEQ ID NO: 67837 - DNA, 25 bp, E. coli
gcaccacgatgaagagtagcttcat

SEQ ID NO: 67838 - DNA, 25 bp, E. coli
gcaccacgatgatgagtagcttcat

SEQ ID NO: 67839 - DNA, 25 bp, E. coli
cccgccctggtagtcttagtaagcg

SEQ ID NO: 67840 - DNA, 25 bp, E. coli
cccgccctggtactcttagtaagcg

SEQ ID NO: 67841 - DNA, 25 bp, E. coli
cggggaagcttatgactaagagcac

SEQ ID NO: 67842 - DNA, 25 bp, E. coli
cgtgaaggcatactttcaggagtga

SEQ ID NO: 67843 - DNA, 25 bp, E. coli
cggggaagcttaagactaagagcac

SEQ ID NO: 67844 - DNA, 25 bp, E. coli
cgtgaaggcatagtttcaggagtga

SEQ ID NO: 67845 - DNA, 25 bp, E. coli
caacgcattggtcgcgccggacatc

SEQ ID NO: 67846 - DNA, 25 bp, E. coli
caacgcattggtggcgccggacatc

SEQ ID NO: 67847 - DNA, 25 bp, E. coli
cacgtattcctgacaccgatggtaa

SEQ ID NO: 67848 - DNA, 25 bp, E. coli
cacgtattcctgtcaccgatggtaa

SEQ ID NO: 67849 - DNA, 25 bp, E. coli
taaaacgaatctacccagcgatgat

SEQ ID NO: 67850 - DNA, 25 bp, E. coli
taaaacgaatcttcccagcgatgat

SEQ ID NO: 67851 - DNA, 25 bp, E. coli
tacccggcgtgatttagtcgattcc

SEQ ID NO: 67852 - DNA, 25 bp, E. coli
tacccggcgtgaattagtcgattcc

SEQ ID NO: 67853 - DNA, 25 bp, E. coli
tcttgcagtaaaacgaatcttccca

SEQ ID NO: 67854 - DNA, 25 bp, E. coli
tcttgcagtaaatcgaatcttccca

SEQ ID NO: 67855 - DNA, 25 bp, E. coli
ccagcgatgatttgcggacaggagc

SEQ ID NO: 67856 - DNA, 25 bp, E. coli
ccagcgatgattagcggacaggagc

SEQ ID NO: 67857 - DNA, 25 bp, E. coli
ccggacatcaggttggcggtgtatc

SEQ ID NO: 67858 - DNA, 25 bp, E. coli
ccggacatcaggatggcggtgtatc

SEQ ID NO: 67859 - DNA, 25 bp, E. coli
cgcgtacgcgactattcgtcagaaa

SEQ ID NO: 67860 - DNA, 25 bp, E. coli
cgcgtacgcgacaattcgtcagaaa

SEQ ID NO: 67861 - DNA, 25 bp, E. coli
cattgttgcacgaattcctgacacc

SEQ ID NO: 67862 - DNA, 25 bp, E. coli
cattgttgcacgtattcctgacacc

SEQ ID NO: 67863 - DNA, 25 bp, E. coli
gatctctctgccgtgcaagaggcgt

SEQ ID NO: 67864 - DNA, 25 bp, E. coli
tggcggtgtatctaaagggctgttt

SEQ ID NO: 67865 - DNA, 25 bp, E. coli
tggcggtgtatcaaaagggctgttt

SEQ ID NO: 67866 - DNA, 25 bp, E. coli
gatctctctgccctgcaagaggcgt

SEQ ID NO: 67867 - DNA, 25 bp, E. coli
caatccgcaggcgaaattgcttgcc

SEQ ID NO: 67868 - DNA, 25 bp, E. coli
caatccgcaggccaaattgcttgcc

SEQ ID NO: 67869 - DNA, 25 bp, E. coli
cgtaatgtcgccacctacggcggaa

SEQ ID NO: 67870 - DNA, 25 bp, E. coli
cgtaatgtcgcctcctacggcggaa

SEQ ID NO: 67871 - DNA, 25 bp, E. coli
agatggcgcgctccgaatcggctct

SEQ ID NO: 67872 - DNA, 25 bp, E. coli
ataacacaggcggaagatggcgcgc

SEQ ID NO: 67873 - DNA, 25 bp, E. coli
ataacacaggcgcaagatggcgcgc

SEQ ID NO: 67874 - DNA, 25 bp, E. coli
agatggcgcgctgcgaatcggctct

SEQ ID NO: 67875 - DNA, 25 bp, E. coli
tttactcagctctttgaagatcccg

SEQ ID NO: 67876 - DNA, 25 bp, E. coli
tttactcagctcattgaagatcccg

SEQ ID NO: 67877 - DNA, 25 bp, E. coli
tgttgatatccacaatctggcagag

SEQ ID NO: 67878 - DNA, 25 bp, E. coli
tgttgatatccagaatctggcagag

SEQ ID NO: 67879 - DNA, 25 bp, E. coli
tgaagatcccgttatccaacgcaat

SEQ ID NO: 67880 - DNA, 25 bp, E. coli
tgctgcggctgcttcaatcgccggg

SEQ ID NO: 67881 - DNA, 25 bp, E. coli
tgctgcggctgcatcaatcgccggg

SEQ ID NO: 67882 - DNA, 25 bp, E. coli
tgaagatcccgtaatccaacgcaat

SEQ ID NO: 67883 - DNA, 25 bp, E. coli
tcggctctgcgacaacatttactca

SEQ ID NO: 67884 - DNA, 25 bp, E. coli
tctggcagagctacagggaataaca

SEQ ID NO: 67885 - DNA, 25 bp, E. coli
tcggctctgcgagaacatttactca

SEQ ID NO: 67886 - DNA, 25 bp, E. coli
tctggcagagcttcagggaataaca

SEQ ID NO: 67887 - DNA, 25 bp, E. coli
gccgggccgcagttccgtaatgtcg

SEQ ID NO: 67888 - DNA, 25 bp, E. coli
gccgggccgcagatccgtaatgtcg

SEQ ID NO: 67889 - DNA, 25 bp, E. coli
cagcattgtaaaattccaccaggag

SEQ ID NO: 67890 - DNA, 25 bp, E. coli
cagcattgtaaatttccaccaggag

SEQ ID NO: 67891 - DNA, 25 bp, E. coli
atgcgcaaggctcgcaactctccgg

SEQ ID NO: 67892 - DNA, 25 bp, E. coli
atgcgcaaggctggcaactctccgg

SEQ ID NO: 67893 - DNA, 25 bp, E. coli
tgagcgaatgccgaacgataaacag

SEQ ID NO: 67894 - DNA, 25 bp, E. coli
tgagcgaatgcccaacgataaacag

SEQ ID NO: 67895 - DNA, 25 bp, E. coli
ccaggcagcagaggcatattggtca

SEQ ID NO: 67896 - DNA, 25 bp, E. coli
ccaggcagcagacgcatattggtca

SEQ ID NO: 67897 - DNA, 25 bp, E. coli
ccaccaggagatatggttgaaatca

SEQ ID NO: 67898 - DNA, 25 bp, E. coli
ccaccaggagatttggttgaaatca

SEQ ID NO: 67899 - DNA, 25 bp, E. coli
gctggactgagtccgataccttcga

SEQ ID NO: 67900 - DNA, 25 bp, E. coli
gctggactgagtgcgataccttcga

SEQ ID NO: 67901 - DNA, 25 bp, E. coli
gaaagtaacccactggatgccgcta

SEQ ID NO: 67902 - DNA, 25 bp, E. coli
gaaatcatggagattgccatgcgca

SEQ ID NO: 67903 - DNA, 25 bp, E. coli
gaaagtaacccagtggatgccgcta

SEQ ID NO: 67904 - DNA, 25 bp, E. coli
gaaatcatggagtttgccatgcgca

SEQ ID NO: 67905 - DNA, 25 bp, E. coli
gattaatcgtatcaagctggagcac

SEQ ID NO: 67906 - DNA, 25 bp, E. coli
gttcgagaaacatatggtgggcagt

SEQ ID NO: 67907 - DNA, 25 bp, E. coli
gttcgagaaacaaatggtgggcagt

SEQ ID NO: 67908 - DNA, 25 bp, E. coli
gattaatcgtatgaagctggagcac

SEQ ID NO: 67909 - DNA, 25 bp, E. coli
ggagcacatcctcgaatatgccagg

SEQ ID NO: 67910 - DNA, 25 bp, E. coli
ggagcacatcctggaatatgccagg

SEQ ID NO: 67911 - DNA, 25 bp, E. coli
aatcgcccacacgtaaacaggcgga

SEQ ID NO: 67912 - DNA, 25 bp, E. coli
aatcgcccacacctaaacaggcgga

SEQ ID NO: 67913 - DNA, 25 bp, E. coli
caaatcagggcgactggacatcagt

SEQ ID NO: 67914 - DNA, 25 bp, E. coli
caaatcagggcgtctggacatcagt

SEQ ID NO: 67915 - DNA, 25 bp, E. coli
aacaggcggatagggtatcgttccg

SEQ ID NO: 67916 - DNA, 25 bp, E. coli
aacaggcggatacggtatcgttccg

SEQ ID NO: 67917 - DNA, 25 bp, E. coli
tgacgtgctgttacaatcgcccaca

SEQ ID NO: 67918 - DNA, 25 bp, E. coli
tgacgtgctgtttcaatcgcccaca

SEQ ID NO: 67919 - DNA, 25 bp, E. coli
tccgtcatggatcgcaaactgcata

SEQ ID NO: 67920 - DNA, 25 bp, E. coli
tctgtttctatacaatcaagtagcc

SEQ ID NO: 67921 - DNA, 25 bp, E. coli
tccgtcatggatggcaaactgcata

SEQ ID NO: 67922 - DNA, 25 bp, E. coli
tctgtttctatagaatcaagtagcc

SEQ ID NO: 67923 - DNA, 25 bp, E. coli
tctggacatcagatgacgtgctgtt

SEQ ID NO: 67924 - DNA, 25 bp, E. coli
tctggacatcagttgacgtgctgtt

SEQ ID NO: 67925 - DNA, 25 bp, E. coli
cggtatcgttccctcatggatggca

SEQ ID NO: 67926 - DNA, 25 bp, E. coli
cggtatcgttccgtcatggatggca

SEQ ID NO: 67927 - DNA, 25 bp, E. coli
gatcaaatcagctaatcagggcgtc

SEQ ID NO: 67928 - DNA, 25 bp, E. coli
gatcaaatcagcaaatcagggcgtc

SEQ ID NO: 67929 - DNA, 25 bp, E. coli
ggcggcgattaccaggctatgatca

SEQ ID NO: 67930 - DNA, 25 bp, E. coli
ggcggcgattacgaggctatgatca

SEQ ID NO: 67931 - DNA, 25 bp, E. coli
tcaagtagcctacagggcggcgatt

SEQ ID NO: 67932 - DNA, 25 bp, E. coli
tcaagtagcctagagggcggcgatt

SEQ ID NO: 67933 - DNA, 25 bp, E. coli
aaccgacttgcaagattcgcggcga

SEQ ID NO: 67934 - DNA, 25 bp, E. coli
aaccgacttgcatgattcgcggcga

SEQ ID NO: 67935 - DNA, 25 bp, E. coli
tacggcacccgtcctaatggctggg

SEQ ID NO: 67936 - DNA, 25 bp, E. coli
tacggcacccgtgctaatggctggg

SEQ ID NO: 67937 - DNA, 25 bp, E. coli
tatttatgcaccagaacggatccgt

SEQ ID NO: 67938 - DNA, 25 bp, E. coli
tattctcagccagcgtgagagcgcc

SEQ ID NO: 67939 - DNA, 25 bp, E. coli
tattctcagccaccgtgagagcgcc

SEQ ID NO: 67940 - DNA, 25 bp, E. coli
tatttatgcacctgaacggatccgt

SEQ ID NO: 67941 - DNA, 25 bp, E. coli
tgaagaagatgtcggtaaaccgcct

SEQ ID NO: 67942 - DNA, 25 bp, E. coli
tgaagttaatgaaatcgcgcacggc

SEQ ID NO: 67943 - DNA, 25 bp, E. coli
tgaagaagatgtgggtaaaccgcct

SEQ ID NO: 67944 - DNA, 25 bp, E. coli
tgatgtcatggccttcagcgaacgg

SEQ ID NO: 67945 - DNA, 25 bp, E. coli
tgatgtcatggcgttcagcgaacgg

SEQ ID NO: 67946 - DNA, 25 bp, E. coli
tgaagttaatgatatcgcgcacggc

SEQ ID NO: 67947 - DNA, 25 bp, E. coli
tcagcccggtggaaaaatgcgtacg

SEQ ID NO: 67948 - DNA, 25 bp, E. coli
gaaaaacaggcaatcgttcaggcgc

SEQ ID NO: 67949 - DNA, 25 bp, E. coli
gaaaaacaggcattcgttcaggcgc

SEQ ID NO: 67950 - DNA, 25 bp, E. coli
cccattacggtgtaagcggttgtct

SEQ ID NO: 67951 - DNA, 25 bp, E. coli
cccattacggtgaaagcggttgtct

SEQ ID NO: 67952 - DNA, 25 bp, E. coli
tcagcccggtggtaaaatgcgtacg

SEQ ID NO: 67953 - DNA, 25 bp, E. coli
gacgcccgcgttgagtatggattat

SEQ ID NO: 67954 - DNA, 25 bp, E. coli
gacgcccgcgttcagtatggattat

SEQ ID NO: 67955 - DNA, 25 bp, E. coli
caagtggtggtgctgtcaccttcac

SEQ ID NO: 67956 - DNA, 25 bp, E. coli
caagtggtggtggtgtcaccttcac

SEQ ID NO: 67957 - DNA, 25 bp, E. coli
caagctttatcaatcataatgttac

SEQ ID NO: 67958 - DNA, 25 bp, E. coli
cagctatttcctcctgacttacaaa

SEQ ID NO: 67959 - DNA, 25 bp, E. coli
caagctttatcattcataatgttac

SEQ ID NO: 67960 - DNA, 25 bp, E. coli
cagctatttcctgctgacttacaaa

SEQ ID NO: 67961 - DNA, 25 bp, E. coli
cataatgttaccttaactgcatggt

SEQ ID NO: 67962 - DNA, 25 bp, E. coli
cataatgttaccataactgcatggt

SEQ ID NO: 67963 - DNA, 25 bp, E. coli
cgtaacgggtccttatgccggaaag

SEQ ID NO: 67964 - DNA, 25 bp, E. coli
cgtaacgggtccatatgccggaaag

SEQ ID NO: 67965 - DNA, 25 bp, E. coli
tattaatcaagtggtggtggtgtca

SEQ ID NO: 67966 - DNA, 25 bp, E. coli
tattaatcaagtcgtggtggtgtca

SEQ ID NO: 67967 - DNA, 25 bp, E. coli
ttcacggaaaaacgtcataaatagc

SEQ ID NO: 67968 - DNA, 25 bp, E. coli
ttcacggaaaaaggtcataaatagc

SEQ ID NO: 67969 - DNA, 25 bp, E. coli
tccatatgccggaaaggacccataa

SEQ ID NO: 67970 - DNA, 25 bp, E. coli
tccatatgccggtaaggacccataa

SEQ ID NO: 67971 - DNA, 25 bp, E. coli
gctgacttacaatacaagctttatc

SEQ ID NO: 67972 - DNA, 25 bp, E. coli
gctgacttacaaaacaagctttatc

SEQ ID NO: 67973 - DNA, 25 bp, E. coli
gtcaccttcacggaaaaacgtcata

SEQ ID NO: 67974 - DNA, 25 bp, E. coli
gtcaccttcacgcaaaaacgtcata

SEQ ID NO: 67975 - DNA, 25 bp, E. coli
taactgcatggttaaatattaatca

SEQ ID NO: 67976 - DNA, 25 bp, E. coli
taactgcatggtaaaatattaatca

SEQ ID NO: 67977 - DNA, 25 bp, E. coli
caacgaattacttagccgtgccggt

SEQ ID NO: 67978 - DNA, 25 bp, E. coli
cactttgtgatgcaagactggcata

SEQ ID NO: 67979 - DNA, 25 bp, E. coli
caacgaattactaagccgtgccggt

SEQ ID NO: 67980 - DNA, 25 bp, E. coli
cactttgtgatggaagactggcata

SEQ ID NO: 67981 - DNA, 25 bp, E. coli
taaaaaacgtgcctggatagtcggc

SEQ ID NO: 67982 - DNA, 25 bp, E. coli
taaaaaacgtgcgtggatagtcggc

SEQ ID NO: 67983 - DNA, 25 bp, E. coli
tagcaaagtcttacgcgcaggtctc

SEQ ID NO: 67984 - DNA, 25 bp, E. coli
tagcaaagtctttcgcgcaggtctc

SEQ ID NO: 67985 - DNA, 25 bp, E. coli
tatcgtgacctgaacgaccagtttg

SEQ ID NO: 67986 - DNA, 25 bp, E. coli
tatagccattaagggttctgccccg

SEQ ID NO: 67987 - DNA, 25 bp, E. coli
tatagccattaacggttctgccccg

SEQ ID NO: 67988 - DNA, 25 bp, E. coli
tatcgtgacctgtacgaccagtttg

SEQ ID NO: 67989 - DNA, 25 bp, E. coli
tgtacgccagattgctcagtccagc

SEQ ID NO: 67990 - DNA, 25 bp, E. coli
tgtacgccagatagctcagtccagc

SEQ ID NO: 67991 - DNA, 25 bp, E. coli
tctcacgcggtgatgaaaacggcct

SEQ ID NO: 67992 - DNA, 25 bp, E. coli
tctcacgcggtgttgaaaacggcct

SEQ ID NO: 67993 - DNA, 25 bp, E. coli
gcaaaaaatggcacaggaacgctgt

SEQ ID NO: 67994 - DNA, 25 bp, E. coli
gcaaaaaatggctcaggaacgctgt

SEQ ID NO: 67995 - DNA, 25 bp, E. coli
ggtaatgacttgatcagccgcatgc

SEQ ID NO: 67996 - DNA, 25 bp, E. coli
ggtaatgacttgttcagccgcatgc

SEQ ID NO: 67997 - DNA, 25 bp, E. coli
taatctggaatcagcccagcaggcg

SEQ ID NO: 67998 - DNA, 25 bp, E. coli
taatctggaatctgcccagcaggcg

SEQ ID NO: 67999 - DNA, 25 bp, E. coli
aacgttttacgcgacgccaggagtg

SEQ ID NO: 68000 - DNA, 25 bp, E. coli
tacgcagcaagcctggttaaatcgc

SEQ ID NO: 68001 - DNA, 25 bp, E. coli
aacgttttacgccacgccaggagtg

SEQ ID NO: 68002 - DNA, 25 bp, E. coli
aactctcagtgacggttcaggctcg

SEQ ID NO: 68003 - DNA, 25 bp, E. coli
aactctcagtgagggttcaggctcg

SEQ ID NO: 68004 - DNA, 25 bp, E. coli
tacgcagcaagcgtggttaaatcgc

SEQ ID NO: 68005 - DNA, 25 bp, E. coli
tatgatgttggcgtctctcggcccg

SEQ ID NO: 68006 - DNA, 25 bp, E. coli
tatgatgttggcctctctcggcccg

SEQ ID NO: 68007 - DNA, 25 bp, E. coli
tgtaaactgtgtcccgtgctggcga

SEQ ID NO: 68008 - DNA, 25 bp, E. coli
tgtaaactgtgtgccgtgctggcga

SEQ ID NO: 68009 - DNA, 25 bp, E. coli
gccgttgccgggtttcgtcatgcga

SEQ ID NO: 68010 - DNA, 25 bp, E. coli
ccaggagtggaaattatggatcgcc

SEQ ID NO: 68011 - DNA, 25 bp, E. coli
ccaggagtggaatttatggatcgcc

SEQ ID NO: 68012 - DNA, 25 bp, E. coli
gccgttgccgggattcgtcatgcga

SEQ ID NO: 68013 - DNA, 25 bp, E. coli
gattgaccgggatggcgacactgtt

SEQ ID NO: 68014 - DNA, 25 bp, E. coli
gattgaccgggaaggcgacactgtt

SEQ ID NO: 68015 - DNA, 25 bp, E. coli
ggcagtctggtcaatgcagcgacaa

SEQ ID NO: 68016 - DNA, 25 bp, E. coli
ggctcgtgactaagcgctgattatc

SEQ ID NO: 68017 - DNA, 25 bp, E. coli
tggtagtaaccagcggcagtgcaat

SEQ ID NO: 68018 - DNA, 25 bp, E. coli
ggcagtctggtctatgcagcgacaa

SEQ ID NO: 68019 - DNA, 25 bp, E. coli
tggtagtaaccaccggcagtgcaat

SEQ ID NO: 68020 - DNA, 25 bp, E. coli
ggctcgtgactatgcgctgattatc

SEQ ID NO: 68021 - DNA, 25 bp, E. coli
cagcttgaattgaagctcaaatgag

SEQ ID NO: 68022 - DNA, 25 bp, E. coli
cagcttgaattgtagctcaaatgag

SEQ ID NO: 68023 - DNA, 25 bp, E. coli
cggatgtttttacataattaactga

SEQ ID NO: 68024 - DNA, 25 bp, E. coli
cggatgtttttagataattaactga

SEQ ID NO: 68025 - DNA, 25 bp, E. coli
aaagcatgaccagccattattgagt

SEQ ID NO: 68026 - DNA, 25 bp, E. coli
aaagcatgaccacccattattgagt

SEQ ID NO: 68027 - DNA, 25 bp, E. coli
tgttcagaaacgatccgggatacac

SEQ ID NO: 68028 - DNA, 25 bp, E. coli
tgttcagaaacgttccgggatacac

SEQ ID NO: 68029 - DNA, 25 bp, E. coli
tctcctgtgctgaatatttattcag

SEQ ID NO: 68030 - DNA, 25 bp, E. coli
tctcctgtgctgtatatttattcag

SEQ ID NO: 68031 - DNA, 25 bp, E. coli
ccatgagtaatttaataaacggatg

SEQ ID NO: 68032 - DNA, 25 bp, E. coli
ccatgagtaattaaataaacggatg

SEQ ID NO: 68033 - DNA, 25 bp, E. coli
gctcaaatgagcaacagcgacaatc

SEQ ID NO: 68034 - DNA, 25 bp, E. coli
gctcaaatgagctacagcgacaatc

SEQ ID NO: 68035 - DNA, 25 bp, E. coli
gcaacagcgacattccatgagtaat

SEQ ID NO: 68036 - DNA, 25 bp, E. coli
gcaacattaaagcatgaccagccat

SEQ ID NO: 68037 - DNA, 25 bp, E. coli
gcaacattaaaggatgaccagccat

SEQ ID NO: 68038 - DNA, 25 bp, E. coli
gcaacagcgacaatccatgagtaat

SEQ ID NO: 68039 - DNA, 25 bp, E. coli
taagtttgttcacaaacgatccggg

SEQ ID NO: 68040 - DNA, 25 bp, E. coli
taagtttgttcagaaacgatccggg

SEQ ID NO: 68041 - DNA, 25 bp, E. coli
gatccgggatactctgcaacattaa

SEQ ID NO: 68042 - DNA, 25 bp, E. coli
gatccgggatacactgcaacattaa

SEQ ID NO: 68043 - DNA, 25 bp, E. coli
caaaaagaaaacccgcagagcggca

SEQ ID NO: 68044 - DNA, 25 bp, E. coli
caaaaagaaaacgcgcagagcggca

SEQ ID NO: 68045 - DNA, 25 bp, E. coli
atcttcaaaaagaaaacccgcagag

SEQ ID NO: 68046 - DNA, 25 bp, E. coli
atcttcaaaaagtaaacccgcagag

SEQ ID NO: 68047 - DNA, 25 bp, E. coli
aacaggtactgcgtaatcagcctgc

SEQ ID NO: 68048 - DNA, 25 bp, E. coli
aacaggtactgcctaatcagcctgc

SEQ ID NO: 68049 - DNA, 25 bp, E. coli
ttcaaaaagaaaacccgcagagcgg

SEQ ID NO: 68050 - DNA, 25 bp, E. coli
ttcaaaaagaaatcccgcagagcgg

SEQ ID NO: 68051 - DNA, 25 bp, E. coli
tgcgctgtccgcgtttacgtcagaa

SEQ ID NO: 68052 - DNA, 25 bp, E. coli
tgcgctgtccgcctttacgtcagaa

SEQ ID NO: 68053 - DNA, 25 bp, E. coli
tcttcaaaaagaaaacccgcagagc

SEQ ID NO: 68054 - DNA, 25 bp, E. coli
tcttcaaaaagataacccgcagagc

SEQ ID NO: 68055 - DNA, 25 bp, E. coli
gaatcttcaaaaagaaaacccgcag

SEQ ID NO: 68056 - DNA, 25 bp, E. coli
gaatcttcaaaatgaaaacccgcag

SEQ ID NO: 68057 - DNA, 25 bp, E. coli
ccgcgtttacgtcagaaattaatgc

SEQ ID NO: 68058 - DNA, 25 bp, E. coli
ccgcgtttacgtgagaaattaatgc

SEQ ID NO: 68059 - DNA, 25 bp, E. coli
cttcaaaaagaatacccgcagagcg

SEQ ID NO: 68060 - DNA, 25 bp, E. coli
cttcaaaaagaaaacccgcagagcg

SEQ ID NO: 68061 - DNA, 25 bp, E. coli
ggtactgcgtaatcagcctgcgctg

SEQ ID NO: 68062 - DNA, 25 bp, E. coli
ggtactgcgtaaacagcctgcgctg

SEQ ID NO: 68063 - DNA, 25 bp, E. coli
tcaaaaagaaaacccgcagagcggc

SEQ ID NO: 68064 - DNA, 25 bp, E. coli
tcaaaaagaaaagccgcagagcggc

SEQ ID NO: 68065 - DNA, 25 bp, E. coli
caacgattttatggtcgtcgacgcg

SEQ ID NO: 68066 - DNA, 25 bp, E. coli
caacgattttatcgtcgtcgacgcg

SEQ ID NO: 68067 - DNA, 25 bp, E. coli
aaagccacgagcgttttccggagcg

SEQ ID NO: 68068 - DNA, 25 bp, E. coli
aaagccacgagccttttccggagcg

SEQ ID NO: 68069 - DNA, 25 bp, E. coli
tttgctggccgatgaagtacgcgtg

SEQ ID NO: 68070 - DNA, 25 bp, E. coli
tttgctggccgaagaagtacgcgtg

SEQ ID NO: 68071 - DNA, 25 bp, E. coli
tttatgcaagtgcttaagcgcgagc

SEQ ID NO: 68072 - DNA, 25 bp, E. coli
tttatgcaagtggttaagcgcgagc

SEQ ID NO: 68073 - DNA, 25 bp, E. coli
ttgatatcgcctcgaaaggtccggg

SEQ ID NO: 68074 - DNA, 25 bp, E. coli
ttgatatcgcctggaaaggtccggg

SEQ ID NO: 68075 - DNA, 25 bp, E. coli
tgagccgccgtaagatcctgaactg

SEQ ID NO: 68076 - DNA, 25 bp, E. coli
tgagccgccgtatgatcctgaactg

SEQ ID NO: 68077 - DNA, 25 bp, E. coli
tcgaaaatgcatcgccttggcaacg

SEQ ID NO: 68078 - DNA, 25 bp, E. coli
tccgcgtaaatatgggcgaacccaa

SEQ ID NO: 68079 - DNA, 25 bp, E. coli
tcgaaaatgcatggccttggcaacg

SEQ ID NO: 68080 - DNA, 25 bp, E. coli
tccgcgtaaataagggcgaacccaa

SEQ ID NO: 68081 - DNA, 25 bp, E. coli
tcgtcgacgcggaaacgcagaatgt

SEQ ID NO: 68082 - DNA, 25 bp, E. coli
tcgtcgacgcggtaacgcagaatgt

SEQ ID NO: 68083 - DNA, 25 bp, E. coli
cgttatatatgagtggcccggcggt

SEQ ID NO: 68084 - DNA, 25 bp, E. coli
cgttatatatgactggcccggcggt

SEQ ID NO: 68085 - DNA, 25 bp, E. coli
cggagcgcgccattatcggttttat

SEQ ID NO: 68086 - DNA, 25 bp, E. coli
cggagcgcgccaatatcggttttat

SEQ ID NO: 68087 - DNA, 25 bp, E. coli
aatgcgccgcctgaaccaccaggct

SEQ ID NO: 68088 - DNA, 25 bp, E. coli
aatgcgccgcctcaaccaccaggct

SEQ ID NO: 68089 - DNA, 25 bp, E. coli
caccaggctatatctgccactcatt

SEQ ID NO: 68090 - DNA, 25 bp, E. coli
caccaggctataactgccactcatt

SEQ ID NO: 68091 - DNA, 25 bp, E. coli
caggctatatctgccactcattgtt

SEQ ID NO: 68092 - DNA, 25 bp, E. coli
caggctatatctcccactcattgtt

SEQ ID NO: 68093 - DNA, 25 bp, E. coli
accaggctatatgtgccactcattg

SEQ ID NO: 68094 - DNA, 25 bp, E. coli
accaggctatatctgccactcattg

SEQ ID NO: 68095 - DNA, 25 bp, E. coli
aaaatgcgccgcgtgaaccaccagg

SEQ ID NO: 68096 - DNA, 25 bp, E. coli
aaaatgcgccgcctgaaccaccagg

SEQ ID NO: 68097 - DNA, 25 bp, E. coli
tatatctgccacacattgttgtgag

SEQ ID NO: 68098 - DNA, 25 bp, E. coli
tatatctgccactcattgttgtgag

SEQ ID NO: 68099 - DNA, 25 bp, E. coli
tgcgccgcctgatccaccaggctat

SEQ ID NO: 68100 - DNA, 25 bp, E. coli
tgcgccgcctgaaccaccaggctat

SEQ ID NO: 68101 - DNA, 25 bp, E. coli
ccaggctatatctgccactcattgt

SEQ ID NO: 68102 - DNA, 25 bp, E. coli
ccaggctatatcagccactcattgt

SEQ ID NO: 68103 - DNA, 25 bp, E. coli
gctatatctgcctctcattgttgtg

SEQ ID NO: 68104 - DNA, 25 bp, E. coli
gctatatctgccactcattgttgtg

SEQ ID NO: 68105 - DNA, 25 bp, E. coli
ctatatctgccagtcattgttgtga

SEQ ID NO: 68106 - DNA, 25 bp, E. coli
ctatatctgccactcattgttgtga

SEQ ID NO: 68107 - DNA, 25 bp, E. coli
ggctatatctgccactcattgttgt

SEQ ID NO: 68108 - DNA, 25 bp, E. coli
ggctatatctgcgactcattgttgt

SEQ ID NO: 68109 - DNA, 25 bp, E. coli
caagtcgttagggtctgggaaaaat

SEQ ID NO: 68110 - DNA, 25 bp, E. coli
caagtcgttaggctctgggaaaaat

SEQ ID NO: 68111 - DNA, 25 bp, E. coli
cacaaagggttaatggttgggcgct

SEQ ID NO: 68112 - DNA, 25 bp, E. coli
cacaaagggttattggttgggcgct

SEQ ID NO: 68113 - DNA, 25 bp, E. coli
taaaaagaggacatcctcctgccga

SEQ ID NO: 68114 - DNA, 25 bp, E. coli
taaaaagaggacttcctcctgccga

SEQ ID NO: 68115 - DNA, 25 bp, E. coli
catccctgttttcaggaaacctacg

SEQ ID NO: 68116 - DNA, 25 bp, E. coli
catccctgttttgaggaaacctacg

SEQ ID NO: 68117 - DNA, 25 bp, E. coli
aaacagatgcctataccgtattcag

SEQ ID NO: 68118 - DNA, 25 bp, E. coli
aaacagatgcctttaccgtattcag

SEQ ID NO: 68119 - DNA, 25 bp, E. coli
tgggaaaaataaagactggtcacgg

SEQ ID NO: 68120 - DNA, 25 bp, E. coli
tgggaaaaataatgactggtcacgg

SEQ ID NO: 68121 - DNA, 25 bp, E. coli
tgaggagcatatcacggtcaatcca

SEQ ID NO: 68122 - DNA, 25 bp, E. coli
tgaggagcatatgacggtcaatcca

SEQ ID NO: 68123 - DNA, 25 bp, E. coli
tctgggatggatcaacgatgaaaac

SEQ ID NO: 68124 - DNA, 25 bp, E. coli
tctgggatggatgaacgatgaaaac

SEQ ID NO: 68125 - DNA, 25 bp, E. coli
gttgggcgctatatgctcatccctg

SEQ ID NO: 68126 - DNA, 25 bp, E. coli
gttgggcgctatttgctcatccctg

SEQ ID NO: 68127 - DNA, 25 bp, E. coli
ggtcaatccatcttcaccggcattc

SEQ ID NO: 68128 - DNA, 25 bp, E. coli
ggtcaatccatcatcaccggcattc

SEQ ID NO: 68129 - DNA, 25 bp, E. coli
ggcattccgtcaaggcaagtcgtta

SEQ ID NO: 68130 - DNA, 25 bp, E. coli
ggcattccgtcatggcaagtcgtta

SEQ ID NO: 68131 - DNA, 25 bp, E. coli
aaggtggcgcgctgttttcatgacc

SEQ ID NO: 68132 - DNA, 25 bp, E. coli
aaggtggcgcgcagttttcatgacc

SEQ ID NO: 68133 - DNA, 25 bp, E. coli
cattctcatggcaaccccagtttcg

SEQ ID NO: 68134 - DNA, 25 bp, E. coli
cattctcatggctaccccagtttcg

SEQ ID NO: 68135 - DNA, 25 bp, E. coli
tacaaactcatcaaagttgggggct

SEQ ID NO: 68136 - DNA, 25 bp, E. coli
tacaaactcatctaagttgggggct

SEQ ID NO: 68137 - DNA, 25 bp, E. coli
aactgaccggctaaaccgataagtg

SEQ ID NO: 68138 - DNA, 25 bp, E. coli
aactgaccggcttaaccgataagtg

SEQ ID NO: 68139 - DNA, 25 bp, E. coli
ttctcatggctagcccagtttcgct

SEQ ID NO: 68140 - DNA, 25 bp, E. coli
ttctcatggctaccccagtttcgct

SEQ ID NO: 68141 - DNA, 25 bp, E. coli
tgttttcatgaccacaccggctggt

SEQ ID NO: 68142 - DNA, 25 bp, E. coli
tgttttcatgacgacaccggctggt

SEQ ID NO: 68143 - DNA, 25 bp, E. coli
tcaactgaccggcttaaccgataag

SEQ ID NO: 68144 - DNA, 25 bp, E. coli
tcaactgaccgggttaaccgataag

SEQ ID NO: 68145 - DNA, 25 bp, E. coli
ttcatgaccacaccggctggtttaa

SEQ ID NO: 68146 - DNA, 25 bp, E. coli
ttcatgaccacagcggctggtttaa

SEQ ID NO: 68147 - DNA, 25 bp, E. coli
gctgttttcatgaccacaccggctg

SEQ ID NO: 68148 - DNA, 25 bp, E. coli
gctgttttcatgtccacaccggctg

SEQ ID NO: 68149 - DNA, 25 bp, E. coli
ggcgcgctgttttcatgaccacacc

SEQ ID NO: 68150 - DNA, 25 bp, E. coli
ggcgcgctgtttacatgaccacacc

SEQ ID NO: 68151 - DNA, 25 bp, E. coli
tcactcaactgagcggcttaaccga

SEQ ID NO: 68152 - DNA, 25 bp, E. coli
tcactcaactgaccggcttaaccga

SEQ ID NO: 68153 - DNA, 25 bp, E. coli
cactttgcctttgcggaagccgtca

SEQ ID NO: 68154 - DNA, 25 bp, E. coli
cactttgcctttccggaagccgtca

SEQ ID NO: 68155 - DNA, 25 bp, E. coli
cagctttcagctggttggtgcggat

SEQ ID NO: 68156 - DNA, 25 bp, E. coli
cagctttcagctcgttggtgcggat

SEQ ID NO: 68157 - DNA, 25 bp, E. coli
caggccaacaacaacgcggcgttta

SEQ ID NO: 68158 - DNA, 25 bp, E. coli
cagagcttgtttttcgttgccaccg

SEQ ID NO: 68159 - DNA, 25 bp, E. coli
caggccaacaactacgcggcgttta

SEQ ID NO: 68160 - DNA, 25 bp, E. coli
cagagcttgtttatcgttgccaccg

SEQ ID NO: 68161 - DNA, 25 bp, E. coli
tagtaatcgttacacggcggccaag

SEQ ID NO: 68162 - DNA, 25 bp, E. coli
tagtaatcgttagacggcggccaag

SEQ ID NO: 68163 - DNA, 25 bp, E. coli
ttttcgcaacgtagaccagctcgct

SEQ ID NO: 68164 - DNA, 25 bp, E. coli
ttttcgcaacgttgaccagctcgct

SEQ ID NO: 68165 - DNA, 25 bp, E. coli
tttacgcagagtttccagcatgccg

SEQ ID NO: 68166 - DNA, 25 bp, E. coli
ttgataccgtcttcaaagcccggga

SEQ ID NO: 68167 - DNA, 25 bp, E. coli
ttcgcgcggcagatccagagcttgt

SEQ ID NO: 68168 - DNA, 25 bp, E. coli
ttcgcgcggcagttccagagcttgt

SEQ ID NO: 68169 - DNA, 25 bp, E. coli
ttgataccgtctacaaagcccggga

SEQ ID NO: 68170 - DNA, 25 bp, E. coli
tttacgcagagtatccagcatgccg

SEQ ID NO: 68171 - DNA, 25 bp, E. coli
tcttccgggaaggtcacgtcgatgg

SEQ ID NO: 68172 - DNA, 25 bp, E. coli
tcttccgggaagctcacgtcgatgg

SEQ ID NO: 68173 - DNA, 25 bp, E. coli
gacttaacgcggatacggatggcgc

SEQ ID NO: 68174 - DNA, 25 bp, E. coli
gacttaacgcggttacggatggcgc

SEQ ID NO: 68175 - DNA, 25 bp, E. coli
agcgttctattgagggtgttcattc

SEQ ID NO: 68176 - DNA, 25 bp, E. coli
agcgttctattgtgggtgttcattc

SEQ ID NO: 68177 - DNA, 25 bp, E. coli
agtcgctttgctcgccatgaagagg

SEQ ID NO: 68178 - DNA, 25 bp, E. coli
agtcgctttgctggccatgaagagg

SEQ ID NO: 68179 - DNA, 25 bp, E. coli
aaaagtcgctttcctcgccatgaag

SEQ ID NO: 68180 - DNA, 25 bp, E. coli
aaaagtcgctttgctcgccatgaag

SEQ ID NO: 68181 - DNA, 25 bp, E. coli
tgtagtgctggagcacaataccgaa

SEQ ID NO: 68182 - DNA, 25 bp, E. coli
tgttggcgccctgctggcgttaatg

SEQ ID NO: 68183 - DNA, 25 bp, E. coli
tgtagtgctggaccacaataccgaa

SEQ ID NO: 68184 - DNA, 25 bp, E. coli
tgttggcgccctcctggcgttaatg

SEQ ID NO: 68185 - DNA, 25 bp, E. coli
ccacggcaggtgttggcgccctgct

SEQ ID NO: 68186 - DNA, 25 bp, E. coli
ccacggcaggtgatggcgccctgct

SEQ ID NO: 68187 - DNA, 25 bp, E. coli
gctacccacggcaggtgttggcgcc

SEQ ID NO: 68188 - DNA, 25 bp, E. coli
gcgtttgcagatgaacctcaaaccg

SEQ ID NO: 68189 - DNA, 25 bp, E. coli
gcgtttgcagatcaacctcaaaccg

SEQ ID NO: 68190 - DNA, 25 bp, E. coli
gctacccacggctggtgttggcgcc

SEQ ID NO: 68191 - DNA, 25 bp, E. coli
ctgctgcttagcgttctattgtggg

SEQ ID NO: 68192 - DNA, 25 bp, E. coli
ctgctgcttagccttctattgtggg

SEQ ID NO: 68193 - DNA, 25 bp, E. coli
gtatcgtgtagtcctggagcacaat

SEQ ID NO: 68194 - DNA, 25 bp, E. coli
gtatcgtgtagtgctggagcacaat

SEQ ID NO: 68195 - DNA, 25 bp, E. coli
tggaccaaaagtcgctttgctcgcc

SEQ ID NO: 68196 - DNA, 25 bp, E. coli
tggaccaaaagtggctttgctcgcc

SEQ ID NO: 68197 - DNA, 25 bp, E. coli
caacctgtataaggcggtagtgacc

SEQ ID NO: 68198 - DNA, 25 bp, E. coli
caacctgtataacgcggtagtgacc

SEQ ID NO: 68199 - DNA, 25 bp, E. coli
cacggtaccgacacgatggaagaaa

SEQ ID NO: 68200 - DNA, 25 bp, E. coli
cacggtaccgactcgatggaagaaa

SEQ ID NO: 68201 - DNA, 25 bp, E. coli
tatcaccattttagcaaccggcggg

SEQ ID NO: 68202 - DNA, 25 bp, E. coli
tagtgaccgcaggtgataaagcctc

SEQ ID NO: 68203 - DNA, 25 bp, E. coli
tatgagcgcagagggtccattcaac

SEQ ID NO: 68204 - DNA, 25 bp, E. coli
tatgagcgcagacggtccattcaac

SEQ ID NO: 68205 - DNA, 25 bp, E. coli
tagtgaccgcagctgataaagcctc

SEQ ID NO: 68206 - DNA, 25 bp, E. coli
tatcaccatttttgcaaccggcggg

SEQ ID NO: 68207 - DNA, 25 bp, E. coli
tgtctctaagctgaatgaactgccg

SEQ ID NO: 68208 - DNA, 25 bp, E. coli
tgtctctaagctcaatgaactgccg

SEQ ID NO: 68209 - DNA, 25 bp, E. coli
gcgctaccactctggatgccgaagt

SEQ ID NO: 68210 - DNA, 25 bp, E. coli
gcgctaccactcaggatgccgaagt

SEQ ID NO: 68211 - DNA, 25 bp, E. coli
gcttacttcctcgacctgacggtga

SEQ ID NO: 68212 - DNA, 25 bp, E. coli
gcttacttcctccacctgacggtga

SEQ ID NO: 68213 - DNA, 25 bp, E. coli
gaaaatctggttaatgcggtgccgc

SEQ ID NO: 68214 - DNA, 25 bp, E. coli
gacattgcgaacgttaaaggcgagc

SEQ ID NO: 68215 - DNA, 25 bp, E. coli
gacattgcgaaccttaaaggcgagc

SEQ ID NO: 68216 - DNA, 25 bp, E. coli
gaaaatctggtttatgcggtgccgc

SEQ ID NO: 68217 - DNA, 25 bp, E. coli
gtgaaatgcgacaaaccggtggtga

SEQ ID NO: 68218 - DNA, 25 bp, E. coli
gtgaaatgcgactaaccggtggtga

SEQ ID NO: 68219 - DNA, 25 bp, E. coli
caattactggaacggtgcaggccct

SEQ ID NO: 68220 - DNA, 25 bp, E. coli
ccggcccttaccagaagcgattatg

SEQ ID NO: 68221 - DNA, 25 bp, E. coli
caattactggaagggtgcaggccct

SEQ ID NO: 68222 - DNA, 25 bp, E. coli
ccggcccttacctgaagcgattatg

SEQ ID NO: 68223 - DNA, 25 bp, E. coli
tacagatgccgcttacgatgaccgt

SEQ ID NO: 68224 - DNA, 25 bp, E. coli
tacagatgccgcatacgatgaccgt

SEQ ID NO: 68225 - DNA, 25 bp, E. coli
taccaactggatgaacaattactgg

SEQ ID NO: 68226 - DNA, 25 bp, E. coli
taccaactggatcaacaattactgg

SEQ ID NO: 68227 - DNA, 25 bp, E. coli
tgcaaaacgtatgaacaatagcctc

SEQ ID NO: 68228 - DNA, 25 bp, E. coli
tgcaaaacgtatcaacaatagcctc

SEQ ID NO: 68229 - DNA, 25 bp, E. coli
tccaaatgccgttcagatgccgctt

SEQ ID NO: 68230 - DNA, 25 bp, E. coli
tccaaatgccgtacagatgccgctt

SEQ ID NO: 68231 - DNA, 25 bp, E. coli
tctgggaactggttgtgcaaaacgt

SEQ ID NO: 68232 - DNA, 25 bp, E. coli
tctgggaactggatgtgcaaaacgt

SEQ ID NO: 68233 - DNA, 25 bp, E. coli
gcgattatggcatactaccaactgg

SEQ ID NO: 68234 - DNA, 25 bp, E. coli
gcgattatggcaaactaccaactgg

SEQ ID NO: 68235 - DNA, 25 bp, E. coli
gaattgcgcaaagctacgaaccatg

SEQ ID NO: 68236 - DNA, 25 bp, E. coli
gaattgcgcaaacctacgaaccatg

SEQ ID NO: 68237 - DNA, 25 bp, E. coli
gaaccatggctggatttctgggaac

SEQ ID NO: 68238 - DNA, 25 bp, E. coli
gaaccatggctgcatttctgggaac

SEQ ID NO: 68239 - DNA, 25 bp, E. coli
cgatgaccgtatcacagaaattctg

SEQ ID NO: 68240 - DNA, 25 bp, E. coli
cgatgaccgtatgacagaaattctg

SEQ ID NO: 68241 - DNA, 25 bp, E. coli
tattgcagaaatgatgaccgcgctg

SEQ ID NO: 68242 - DNA, 25 bp, E. coli
tattctcgatatcgcccagcaggcg

SEQ ID NO: 68243 - DNA, 25 bp, E. coli
tattgcagaaatcatgaccgcgctg

SEQ ID NO: 68244 - DNA, 25 bp, E. coli
tattctcgatatggcccagcaggcg

SEQ ID NO: 68245 - DNA, 25 bp, E. coli
tttaccccggatcaagaagtgggca

SEQ ID NO: 68246 - DNA, 25 bp, E. coli
ttgttgaaaactttcgcggtggcga

SEQ ID NO: 68247 - DNA, 25 bp, E. coli
tttaccccggatgaagaagtgggca

SEQ ID NO: 68248 - DNA, 25 bp, E. coli
ttgttgaaaactatcgcggtggcga

SEQ ID NO: 68249 - DNA, 25 bp, E. coli
tgcatcagctactgggtcagacgct

SEQ ID NO: 68250 - DNA, 25 bp, E. coli
tgcatcagctacagggtcagacgct

SEQ ID NO: 68251 - DNA, 25 bp, E. coli
tgcgatattgaagcggaactgaaac

SEQ ID NO: 68252 - DNA, 25 bp, E. coli
tgcgatattgaaccggaactgaaac

SEQ ID NO: 68253 - DNA, 25 bp, E. coli
tcagacgctgattaccaccgatggt

SEQ ID NO: 68254 - DNA, 25 bp, E. coli
gaactacgtgtctctggatacccaa

SEQ ID NO: 68255 - DNA, 25 bp, E. coli
gacagttactacaatatgcgcgaga

SEQ ID NO: 68256 - DNA, 25 bp, E. coli
gaactacgtgtcactggatacccaa

SEQ ID NO: 68257 - DNA, 25 bp, E. coli
gacagttactactatatgcgcgaga

SEQ ID NO: 68258 - DNA, 25 bp, E. coli
gatacctcaccggattgcagcggca

SEQ ID NO: 68259 - DNA, 25 bp, E. coli
gatacctcaccgcattgcagcggca

SEQ ID NO: 68260 - DNA, 25 bp, E. coli
tcagacgctgataaccaccgatggt

SEQ ID NO: 68261 - DNA, 25 bp, E. coli
gagaaagtggttcagcatccgcata

SEQ ID NO: 68262 - DNA, 25 bp, E. coli
gagaaagtggttgagcatccgcata

SEQ ID NO: 68263 - DNA, 25 bp, E. coli
caacaaggatttttggagtttactc

SEQ ID NO: 68264 - DNA, 25 bp, E. coli
caacaaggatttatggagtttactc

SEQ ID NO: 68265 - DNA, 25 bp, E. coli
tacatgtggtatatctttttcagcc

SEQ ID NO: 68266 - DNA, 25 bp, E. coli
tacaccggttaactctggtattatc

SEQ ID NO: 68267 - DNA, 25 bp, E. coli
tacaccggttaagtctggtattatc

SEQ ID NO: 68268 - DNA, 25 bp, E. coli
tactatatttctgcctcctggcagt

SEQ ID NO: 68269 - DNA, 25 bp, E. coli
tactatatttctccctcctggcagt

SEQ ID NO: 68270 - DNA, 25 bp, E. coli
tacatgtggtatttctttttcagcc

SEQ ID NO: 68271 - DNA, 25 bp, E. coli
gacacggtaattgaacctacatgtg

SEQ ID NO: 68272 - DNA, 25 bp, E. coli
gacacggtaattcaacctacatgtg

SEQ ID NO: 68273 - DNA, 25 bp, E. coli
aaaaatatgcccttatgggctcaag

SEQ ID NO: 68274 - DNA, 25 bp, E. coli
aaaaatatgcccatatgggctcaag

SEQ ID NO: 68275 - DNA, 25 bp, E. coli
tatcacatcgcagcattcaacaagg

SEQ ID NO: 68276 - DNA, 25 bp, E. coli
tatcacatcgcaccattcaacaagg

SEQ ID NO: 68277 - DNA, 25 bp, E. coli
tgaagtggatagtaattgacacggt

SEQ ID NO: 68278 - DNA, 25 bp, E. coli
tgaagtggatagaaattgacacggt

SEQ ID NO: 68279 - DNA, 25 bp, E. coli
tcctggcagtatttttacaccggtt

SEQ ID NO: 68280 - DNA, 25 bp, E. coli
tcctccaggagatagcaaaataaca

SEQ ID NO: 68281 - DNA, 25 bp, E. coli
tcctccaggagaaagcaaaataaca

SEQ ID NO: 68282 - DNA, 25 bp, E. coli
tcctggcagtatatttacaccggtt

SEQ ID NO: 68283 - DNA, 25 bp, E. coli
tcaaaagcagtcaagagtgtcctcc

SEQ ID NO: 68284 - DNA, 25 bp, E. coli
tcaaaagcagtctagagtgtcctcc

SEQ ID NO: 68285 - DNA, 25 bp, E. coli
caataattatcggtgtgaatactgg

SEQ ID NO: 68286 - DNA, 25 bp, E. coli
caataattatcgctgtgaatactgg

SEQ ID NO: 68287 - DNA, 25 bp, E. coli
taaatcagcttaataactttgcccc

SEQ ID NO: 68288 - DNA, 25 bp, E. coli
taacatctgctgttgaaaggcagcg

SEQ ID NO: 68289 - DNA, 25 bp, E. coli
taacatctgctgatgaaaggcagcg

SEQ ID NO: 68290 - DNA, 25 bp, E. coli
taaatcagcttattaactttgcccc

SEQ ID NO: 68291 - DNA, 25 bp, E. coli
taccgtttattcaatgtgctgtgag

SEQ ID NO: 68292 - DNA, 25 bp, E. coli
taccgtttattctatgtgctgtgag

SEQ ID NO: 68293 - DNA, 25 bp, E. coli
tgtttgcaatttgttcatcataccg

SEQ ID NO: 68294 - DNA, 25 bp, E. coli
tgtttgcaatttcttcatcataccg

SEQ ID NO: 68295 - DNA, 25 bp, E. coli
gcctcacgcacattaatcaggctgt

SEQ ID NO: 68296 - DNA, 25 bp, E. coli
gcctcacgcacaataatcaggctgt

SEQ ID NO: 68297 - DNA, 25 bp, E. coli
gaatactggattatgtgcgccgcct

SEQ ID NO: 68298 - DNA, 25 bp, E. coli
gaatactggattttgtgcgccgcct

SEQ ID NO: 68299 - DNA, 25 bp, E. coli
gaaaggcagcggcaattacaataat

SEQ ID NO: 68300 - DNA, 25 bp, E. coli
gaaaggcagcgggaattacaataat

SEQ ID NO: 68301 - DNA, 25 bp, E. coli
gtgctgtgagtaactttcacttccg

SEQ ID NO: 68302 - DNA, 25 bp, E. coli
gtgctgtgagtatctttcacttccg

SEQ ID NO: 68303 - DNA, 25 bp, E. coli
tcacttccgtatttgcataacgatg

SEQ ID NO: 68304 - DNA, 25 bp, E. coli
tcacttccgtatatgcataacgatg

SEQ ID NO: 68305 - DNA, 25 bp, E. coli
gaggcgtcacacgtgcaggagaaat

SEQ ID NO: 68306 - DNA, 25 bp, E. coli
gaggcgtcacacctgcaggagaaat

SEQ ID NO: 68307 - DNA, 25 bp, E. coli
caacgttttgggtttggcggtagca

SEQ ID NO: 68308 - DNA, 25 bp, E. coli
caacgttttgggattggcggtagca

SEQ ID NO: 68309 - DNA, 25 bp, E. coli
caatacccgtttagtggcggatgca

SEQ ID NO: 68310 - DNA, 25 bp, E. coli
caatacccgttttgtggcggatgca

SEQ ID NO: 68311 - DNA, 25 bp, E. coli
cagagcgatgctgctgtatccgcaa

SEQ ID NO: 68312 - DNA, 25 bp, E. coli
cagagcgatgctcctgtatccgcaa

SEQ ID NO: 68313 - DNA, 25 bp, E. coli
tacaattagccggacgtggtagctg

SEQ ID NO: 68314 - DNA, 25 bp, E. coli
tacaattagccgcacgtggtagctg

SEQ ID NO: 68315 - DNA, 25 bp, E. coli
agtttttggttgacggcagcccgca

SEQ ID NO: 68316 - DNA, 25 bp, E. coli
agtttttggttgtcggcagcccgca

SEQ ID NO: 68317 - DNA, 25 bp, E. coli
tgagcgcctcaaaaaagcagacgtt

SEQ ID NO: 68318 - DNA, 25 bp, E. coli
tgagcgcctcaataaagcagacgtt

SEQ ID NO: 68319 - DNA, 25 bp, E. coli
gcccgcagtgcgatgtttaatcaga

SEQ ID NO: 68320 - DNA, 25 bp, E. coli
gcccgcagtgcgttgtttaatcaga

SEQ ID NO: 68321 - DNA, 25 bp, E. coli
gctgggcgcaaaccaatactccggt

SEQ ID NO: 68322 - DNA, 25 bp, E. coli
gctgggcgcaaagcaatactccggt

SEQ ID NO: 68323 - DNA, 25 bp, E. coli
gaacagtggttaagcgctcgcgtgc

SEQ ID NO: 68324 - DNA, 25 bp, E. coli
gaacagtggttatgcgctcgcgtgc

SEQ ID NO: 68325 - DNA, 25 bp, E. coli
taatcagattgtagctgagcgcctc

SEQ ID NO: 68326 - DNA, 25 bp, E. coli
taatcagattgttgctgagcgcctc

SEQ ID NO: 68327 - DNA, 25 bp, E. coli
tcaagttgttgacggcgatgcgcta

SEQ ID NO: 68328 - DNA, 25 bp, E. coli
tcaagttgttgagggcgatgcgcta

SEQ ID NO: 68329 - DNA, 25 bp, E. coli
aagccctggcaatagaagtccgcga

SEQ ID NO: 68330 - DNA, 25 bp, E. coli
caatatgagggtaaaatcgtcgccg

SEQ ID NO: 68331 - DNA, 25 bp, E. coli
aagccctggcaaaagaagtccgcga

SEQ ID NO: 68332 - DNA, 25 bp, E. coli
caatatgagggttaaatcgtcgccg

SEQ ID NO: 68333 - DNA, 25 bp, E. coli
catagtctgaaaacgccactggcgg

SEQ ID NO: 68334 - DNA, 25 bp, E. coli
catagtctgaaatcgccactggcgg

SEQ ID NO: 68335 - DNA, 25 bp, E. coli
tattgtggtcgaggatgatggcccc

SEQ ID NO: 68336 - DNA, 25 bp, E. coli
tattgtggtcgacgatgatggcccc

SEQ ID NO: 68337 - DNA, 25 bp, E. coli
ttttatgggcgcaacgtgacgtgcc

SEQ ID NO: 68338 - DNA, 25 bp, E. coli
ttttatgggcgctacgtgacgtgcc

SEQ ID NO: 68339 - DNA, 25 bp, E. coli
gccccggtattcgattaagcaagcg

SEQ ID NO: 68340 - DNA, 25 bp, E. coli
gccccggtattccattaagcaagcg

SEQ ID NO: 68341 - DNA, 25 bp, E. coli
gaaaatatcgactagcaaagcccca

SEQ ID NO: 68342 - DNA, 25 bp, E. coli
gaaaatatcgacaagcaaagcccca

SEQ ID NO: 68343 - DNA, 25 bp, E. coli
ggttgatacttttcgccctgggcaa

SEQ ID NO: 68344 - DNA, 25 bp, E. coli
ggttgatactttacgccctgggcaa

SEQ ID NO: 68345 - DNA, 25 bp, E. coli
taagttgcatgtggagttacccgaa

SEQ ID NO: 68346 - DNA, 25 bp, E. coli
taatttatgatgagaacgggcagct

SEQ ID NO: 68347 - DNA, 25 bp, E. coli
taagttgcatgtcgagttacccgaa

SEQ ID NO: 68348 - DNA, 25 bp, E. coli
taatttatgatgtgaacgggcagct

SEQ ID NO: 68349 - DNA, 25 bp, E. coli
gatgttaacgataccagcctcttgc

SEQ ID NO: 68350 - DNA, 25 bp, E. coli
gatgttaacgattccagcctcttgc

SEQ ID NO: 68351 - DNA, 25 bp, E. coli
cagtaccggcgatagccagtgacga

SEQ ID NO: 68352 - DNA, 25 bp, E. coli
cagtaccggcgaaagccagtgacga

SEQ ID NO: 68353 - DNA, 25 bp, E. coli
taaagcactgctcattaccctgtcc

SEQ ID NO: 68354 - DNA, 25 bp, E. coli
taaagcactgctgattaccctgtcc

SEQ ID NO: 68355 - DNA, 25 bp, E. coli
ttcgctggtggaacgtaatctggcg

SEQ ID NO: 68356 - DNA, 25 bp, E. coli
ttcgctggtggatcgtaatctggcg

SEQ ID NO: 68357 - DNA, 25 bp, E. coli
tgaaacacggaaataaagcactgct

SEQ ID NO: 68358 - DNA, 25 bp, E. coli
tgaaacacggaattaaagcactgct

SEQ ID NO: 68359 - DNA, 25 bp, E. coli
tcagttatcgcgaagagtacggtcc

SEQ ID NO: 68360 - DNA, 25 bp, E. coli
tcagttatcgcgtagagtacggtcc

SEQ ID NO: 68361 - DNA, 25 bp, E. coli
ccggaatgtctcatagcgcgctggc

SEQ ID NO: 68362 - DNA, 25 bp, E. coli
ccggaatgtctcttagcgcgctggc

SEQ ID NO: 68363 - DNA, 25 bp, E. coli
gaaaccaaagcgcaagctcctgcag

SEQ ID NO: 68364 - DNA, 25 bp, E. coli
gaaaccaaagcggaagctcctgcag

SEQ ID NO: 68365 - DNA, 25 bp, E. coli
cgatgaatggcgatggcctgaagaa

SEQ ID NO: 68366 - DNA, 25 bp, E. coli
cgatgaatggcgttggcctgaagaa

SEQ ID NO: 68367 - DNA, 25 bp, E. coli
ctggcggcagctactgtggcgaaac

SEQ ID NO: 68368 - DNA, 25 bp, E. coli
ctggcggcagcttctgtggcgaaac

SEQ ID NO: 68369 - DNA, 25 bp, E. coli
cattaataatgccagcgcggaagag

SEQ ID NO: 68370 - DNA, 25 bp, E. coli
cattaataatgcgagcgcggaagag

SEQ ID NO: 68371 - DNA, 25 bp, E. coli
tgtccctggcctgtgccggaatgtc

SEQ ID NO: 68372 - DNA, 25 bp, E. coli
tgtccctggcctctgccggaatgtc

SEQ ID NO: 68373 - DNA, 25 bp, E. coli
aacccaccttactatcagcagggag

SEQ ID NO: 68374 - DNA, 25 bp, E. coli
aacccaccttacaatcagcagggag

SEQ ID NO: 68375 - DNA, 25 bp, E. coli
cagcgtgatgatagatgcagttgaa

SEQ ID NO: 68376 - DNA, 25 bp, E. coli
cagcgtgatgattgatgcagttgaa

SEQ ID NO: 68377 - DNA, 25 bp, E. coli
cagacagtacgcatcgatttaatca

SEQ ID NO: 68378 - DNA, 25 bp, E. coli
cagacagtacgcttcgatttaatca

SEQ ID NO: 68379 - DNA, 25 bp, E. coli
tacgcttgatcacccatcgttgctg

SEQ ID NO: 68380 - DNA, 25 bp, E. coli
acctcaacgggaacaggctcgctat

SEQ ID NO: 68381 - DNA, 25 bp, E. coli
accagtccccgtcggcagagcggat

SEQ ID NO: 68382 - DNA, 25 bp, E. coli
agtggatcacactgcagacagtacg

SEQ ID NO: 68383 - DNA, 25 bp, E. coli
agtggatcacacagcagacagtacg

SEQ ID NO: 68384 - DNA, 25 bp, E. coli
acctcaacgggatcaggctcgctat

SEQ ID NO: 68385 - DNA, 25 bp, E. coli
accagtccccgtgggcagagcggat

SEQ ID NO: 68386 - DNA, 25 bp, E. coli
aaatatcaaccactccccgtgggca

SEQ ID NO: 68387 - DNA, 25 bp, E. coli
aaatatcaaccagtccccgtgggca

SEQ ID NO: 68388 - DNA, 25 bp, E. coli
tacgcttgatcagccatcgttgctg

SEQ ID NO: 68389 - DNA, 25 bp, E. coli
ttactatcagcacggagtagagtgc

SEQ ID NO: 68390 - DNA, 25 bp, E. coli
ttactatcagcagggagtagagtgc

SEQ ID NO: 68391 - DNA, 25 bp, E. coli
ggaacaggctcgctataccactacg

SEQ ID NO: 68392 - DNA, 25 bp, E. coli
ggaacaggctcggtataccactacg

SEQ ID NO: 68393 - DNA, 25 bp, E. coli
gatgattgatgctgttgaactggaa

SEQ ID NO: 68394 - DNA, 25 bp, E. coli
gatgattgatgcagttgaactggaa

SEQ ID NO: 68395 - DNA, 25 bp, E. coli
cacgcttcagtgagcaaattgtccc

SEQ ID NO: 68396 - DNA, 25 bp, E. coli
caacagacatcaggattcgcaaggt

SEQ ID NO: 68397 - DNA, 25 bp, E. coli
cacgcttcagtgtgcaaattgtccc

SEQ ID NO: 68398 - DNA, 25 bp, E. coli
caacagacatcacgattcgcaaggt

SEQ ID NO: 68399 - DNA, 25 bp, E. coli
taaatattatttctctgggaacggg

SEQ ID NO: 68400 - DNA, 25 bp, E. coli
taaatattatttgtctgggaacggg

SEQ ID NO: 68401 - DNA, 25 bp, E. coli
aaaaatgccttatgcgggatgtcgc

SEQ ID NO: 68402 - DNA, 25 bp, E. coli
aaaaatgccttaagcgggatgtcgc

SEQ ID NO: 68403 - DNA, 25 bp, E. coli
tatcgggaaactttgcgtaattgcc

SEQ ID NO: 68404 - DNA, 25 bp, E. coli
tatcgggaaactatgcgtaattgcc

SEQ ID NO: 68405 - DNA, 25 bp, E. coli
ttaaagaaatctcccgtaaagacag

SEQ ID NO: 68406 - DNA, 25 bp, E. coli
ttaaagaaatctgccgtaaagacag

SEQ ID NO: 68407 - DNA, 25 bp, E. coli
tctgttccatgaagtaccgtacaaa

SEQ ID NO: 68408 - DNA, 25 bp, E. coli
tctgttccatgatgtaccgtacaaa

SEQ ID NO: 68409 - DNA, 25 bp, E. coli
tgccactttgccttctgtaatcaga

SEQ ID NO: 68410 - DNA, 25 bp, E. coli
tgccactttgccatctgtaatcaga

SEQ ID NO: 68411 - DNA, 25 bp, E. coli
gattcgcaaggtcaaaaactctgtt

SEQ ID NO: 68412 - DNA, 25 bp, E. coli
gtttcgtgcgctaaatcgagtctca

SEQ ID NO: 68413 - DNA, 25 bp, E. coli
gtttcgtgcgcttaatcgagtctca

SEQ ID NO: 68414 - DNA, 25 bp, E. coli
gattcgcaaggtgaaaaactctgtt

SEQ ID NO: 68415 - DNA, 25 bp, E. coli
gtcgctatcgcgactttatcgggaa

SEQ ID NO: 68416 - DNA, 25 bp, E. coli
gtcgctatcgcgtctttatcgggaa

SEQ ID NO: 68417 - DNA, 25 bp, E. coli
cagagagttgtgttttttgccctta

SEQ ID NO: 68418 - DNA, 25 bp, E. coli
cagagagttgtgatttttgccctta

SEQ ID NO: 68419 - DNA, 25 bp, E. coli
aaatctgatatataaaactgtggcg

SEQ ID NO: 68420 - DNA, 25 bp, E. coli
aaaactgtggcgtgtatggtacgga

SEQ ID NO: 68421 - DNA, 25 bp, E. coli
aaaactgtggcgagtatggtacgga

SEQ ID NO: 68422 - DNA, 25 bp, E. coli
aaatctgatataaaaaactgtggcg

SEQ ID NO: 68423 - DNA, 25 bp, E. coli
tgccggaacgcccagcataagaaat

SEQ ID NO: 68424 - DNA, 25 bp, E. coli
tgccggaacgccgagcataagaaat

SEQ ID NO: 68425 - DNA, 25 bp, E. coli
tcagaagagtatgcgtcatgccgga

SEQ ID NO: 68426 - DNA, 25 bp, E. coli
gcgacatttaaaagcgactcaattc

SEQ ID NO: 68427 - DNA, 25 bp, E. coli
gcgacatttaaatgcgactcaattc

SEQ ID NO: 68428 - DNA, 25 bp, E. coli
gcagtcacgtcgtatgcaagaacgt

SEQ ID NO: 68429 - DNA, 25 bp, E. coli
gcagtcacgtcgaatgcaagaacgt

SEQ ID NO: 68430 - DNA, 25 bp, E. coli
gaaatgaatcaataagcccgcagca

SEQ ID NO: 68431 - DNA, 25 bp, E. coli
gactcaattcgtaatatggcatcag

SEQ ID NO: 68432 - DNA, 25 bp, E. coli
gaaatgaatcaaaaagcccgcagca

SEQ ID NO: 68433 - DNA, 25 bp, E. coli
gactcaattcgttatatggcatcag

SEQ ID NO: 68434 - DNA, 25 bp, E. coli
cgtgctgcggttcgtttgactttga

SEQ ID NO: 68435 - DNA, 25 bp, E. coli
cgtgctgcggttggtttgactttga

SEQ ID NO: 68436 - DNA, 25 bp, E. coli
gttgaaaaaccggagtcacgtcgta

SEQ ID NO: 68437 - DNA, 25 bp, E. coli
gttgaaaaaccgcagtcacgtcgta

SEQ ID NO: 68438 - DNA, 25 bp, E. coli
tcagaagagtatccgtcatgccgga

SEQ ID NO: 68439 - DNA, 25 bp, E. coli
aagccgccatccaacactgagtgaa

SEQ ID NO: 68440 - DNA, 25 bp, E. coli
aagccgccatcctacactgagtgaa

SEQ ID NO: 68441 - DNA, 25 bp, E. coli
cactggcggccagacttgaagaatt

SEQ ID NO: 68442 - DNA, 25 bp, E. coli
cactggcggccacacttgaagaatt

SEQ ID NO: 68443 - DNA, 25 bp, E. coli
cagttgagtaactgccaggatgcgc

SEQ ID NO: 68444 - DNA, 25 bp, E. coli
cagttgagtaacagccaggatgcgc

SEQ ID NO: 68445 - DNA, 25 bp, E. coli
tttctattgagcatgtcggcgtggc

SEQ ID NO: 68446 - DNA, 25 bp, E. coli
tttctattgagcttgtcggcgtggc

SEQ ID NO: 68447 - DNA, 25 bp, E. coli
tgcatttcaactggcgggctacacg

SEQ ID NO: 68448 - DNA, 25 bp, E. coli
tgcatttcaactcgcgggctacacg

SEQ ID NO: 68449 - DNA, 25 bp, E. coli
gcctgcgacgtaagttgctcaactg

SEQ ID NO: 68450 - DNA, 25 bp, E. coli
gcctgcgacgtatgttgctcaactg

SEQ ID NO: 68451 - DNA, 25 bp, E. coli
gaaaaacatgcacgcccgattactg

SEQ ID NO: 68452 - DNA, 25 bp, E. coli
gaaaaacatgcaggcccgattactg

SEQ ID NO: 68453 - DNA, 25 bp, E. coli
cgataacgccgatgctatgtggagc

SEQ ID NO: 68454 - DNA, 25 bp, E. coli
cgataacgccgaagctatgtggagc

SEQ ID NO: 68455 - DNA, 25 bp, E. coli
gggcctgtgcgcacttcacgaataa

SEQ ID NO: 68456 - DNA, 25 bp, E. coli
gggcctgtgcgctcttcacgaataa

SEQ ID NO: 68457 - DNA, 25 bp, E. coli
tggcgttcagcataaatcactggcg

SEQ ID NO: 68458 - DNA, 25 bp, E. coli
tggcgttcagcaaaaatcactggcg

SEQ ID NO: 68459 - DNA, 25 bp, E. coli
taatattactgaggccagccagctg

SEQ ID NO: 68460 - DNA, 25 bp, E. coli
taatattactgacgccagccagctg

SEQ ID NO: 68461 - DNA, 25 bp, E. coli
aatgctgcaacaacctgatcatttg

SEQ ID NO: 68462 - DNA, 25 bp, E. coli
aatgctgcaacatcctgatcatttg

SEQ ID NO: 68463 - DNA, 25 bp, E. coli
cacgcaatgctttctctgatgcagt

SEQ ID NO: 68464 - DNA, 25 bp, E. coli
cacgcaatgcttactctgatgcagt

SEQ ID NO: 68465 - DNA, 25 bp, E. coli
cacgcaaaatgctgcaacaacctga

SEQ ID NO: 68466 - DNA, 25 bp, E. coli
cacgcaaaatgcagcaacaacctga

SEQ ID NO: 68467 - DNA, 25 bp, E. coli
aacctgatcattagcactttttagc

SEQ ID NO: 68468 - DNA, 25 bp, E. coli
aacctgatcatttgcactttttagc

SEQ ID NO: 68469 - DNA, 25 bp, E. coli
ttttgggccagggattattcctgga

SEQ ID NO: 68470 - DNA, 25 bp, E. coli
ttttgggccaggcattattcctgga

SEQ ID NO: 68471 - DNA, 25 bp, E. coli
tgggccagggattattcctggaaga

SEQ ID NO: 68472 - DNA, 25 bp, E. coli
tgggccagggataattcctggaaga

SEQ ID NO: 68473 - DNA, 25 bp, E. coli
tgctttctctgatgcagttttgcct

SEQ ID NO: 68474 - DNA, 25 bp, E. coli
tgctttctctgaagcagttttgcct

SEQ ID NO: 68475 - DNA, 25 bp, E. coli
gcaacaacctgatcatttgcacttt

SEQ ID NO: 68476 - DNA, 25 bp, E. coli
gcaacaacctgaacatttgcacttt

SEQ ID NO: 68477 - DNA, 25 bp, E. coli
gcaaaatgctgcaacaacctgatca

SEQ ID NO: 68478 - DNA, 25 bp, E. coli
gcaaaatgctgctacaacctgatca

SEQ ID NO: 68479 - DNA, 25 bp, E. coli
gaccccacgcaaagctttctctgat

SEQ ID NO: 68480 - DNA, 25 bp, E. coli
gatgagcgccagtccccacgcaatg

SEQ ID NO: 68481 - DNA, 25 bp, E. coli
gatgagcgccagaccccacgcaatg

SEQ ID NO: 68482 - DNA, 25 bp, E. coli
gaccccacgcaatgctttctctgat

SEQ ID NO: 68483 - DNA, 25 bp, E. coli
caccatatgcgtaatcagggatacc

SEQ ID NO: 68484 - DNA, 25 bp, E. coli
caccatatgcgttatcagggatacc

SEQ ID NO: 68485 - DNA, 25 bp, E. coli
aacagctgttggttatgccttcgcc

SEQ ID NO: 68486 - DNA, 25 bp, E. coli
aacagctgttggatatgccttcgcc

SEQ ID NO: 68487 - DNA, 25 bp, E. coli
taccttgaggcgatgaatcaccatg

SEQ ID NO: 68488 - DNA, 25 bp, E. coli
tagtgaccggcaaaaacaggtgctt

SEQ ID NO: 68489 - DNA, 25 bp, E. coli
taccttgaggcgttgaatcaccatg

SEQ ID NO: 68490 - DNA, 25 bp, E. coli
tagtgaccggcataaacaggtgctt

SEQ ID NO: 68491 - DNA, 25 bp, E. coli
tattaatcacgaagcgtcctctgga

SEQ ID NO: 68492 - DNA, 25 bp, E. coli
tattaatcacgatgcgtcctctgga

SEQ ID NO: 68493 - DNA, 25 bp, E. coli
tgatgtccaatacctcccagcgtag

SEQ ID NO: 68494 - DNA, 25 bp, E. coli
tgatgtccaatagctcccagcgtag

SEQ ID NO: 68495 - DNA, 25 bp, E. coli
gctggcggagcagggttttatcacc

SEQ ID NO: 68496 - DNA, 25 bp, E. coli
gctggcggagcacggttttatcacc

SEQ ID NO: 68497 - DNA, 25 bp, E. coli
gaagccgatttagagcgttatgcca

SEQ ID NO: 68498 - DNA, 25 bp, E. coli
gaagccgatttacagcgttatgcca

SEQ ID NO: 68499 - DNA, 25 bp, E. coli
cattaaccgatgatgcgcgtgcggc

SEQ ID NO: 68500 - DNA, 25 bp, E. coli
cgggcattgtccactgtccagtgaa

SEQ ID NO: 68501 - DNA, 25 bp, E. coli
cattaaccgatgttgcgcgtgcggc

SEQ ID NO: 68502 - DNA, 25 bp, E. coli
cgggcattgtcctctgtccagtgaa

SEQ ID NO: 68503 - DNA, 25 bp, E. coli
gataccttgctggaacaccacgtcg

SEQ ID NO: 68504 - DNA, 25 bp, E. coli
gataccttgctgcaacaccacgtcg

SEQ ID NO: 68505 - DNA, 25 bp, E. coli
caactttattcggtgggaacgccga

SEQ ID NO: 68506 - DNA, 25 bp, E. coli
aagtctggacgtcggataaatccgc

SEQ ID NO: 68507 - DNA, 25 bp, E. coli
aagtctggacgtgggataaatccgc

SEQ ID NO: 68508 - DNA, 25 bp, E. coli
caactttattcgctgggaacgccga

SEQ ID NO: 68509 - DNA, 25 bp, E. coli
catgagcgccatgacgccagtgatt

SEQ ID NO: 68510 - DNA, 25 bp, E. coli
catgagcgccatcacgccagtgatt

SEQ ID NO: 68511 - DNA, 25 bp, E. coli
acgtgctggataagcaactggcgca

SEQ ID NO: 68512 - DNA, 25 bp, E. coli
acgtgctggatatgcaactggcgca

SEQ ID NO: 68513 - DNA, 25 bp, E. coli
ttatcagcccgccaaagtctggacg

SEQ ID NO: 68514 - DNA, 25 bp, E. coli
ttatcagcccgcgaaagtctggacg

SEQ ID NO: 68515 - DNA, 25 bp, E. coli
tgttctggttactgggcgcggcacc

SEQ ID NO: 68516 - DNA, 25 bp, E. coli
tgttgcgggcgatgagtacaccatt

SEQ ID NO: 68517 - DNA, 25 bp, E. coli
tggtccgacgcatgaaaaaacgctg

SEQ ID NO: 68518 - DNA, 25 bp, E. coli
tgttctggttacagggcgcggcacc

SEQ ID NO: 68519 - DNA, 25 bp, E. coli
tggtccgacgcaagaaaaaacgctg

SEQ ID NO: 68520 - DNA, 25 bp, E. coli
tgttgcgggcgaagagtacaccatt

SEQ ID NO: 68521 - DNA, 25 bp, E. coli
tccagcggctttctcgaagtgaacc

SEQ ID NO: 68522 - DNA, 25 bp, E. coli
tccagcggctttgtcgaagtgaacc

SEQ ID NO: 68523 - DNA, 25 bp, E. coli
cgccgaacggtctgaaagtaacgat

SEQ ID NO: 68524 - DNA, 25 bp, E. coli
cgccgaacggtcagaaagtaacgat

SEQ ID NO: 68525 - DNA, 25 bp, E. coli
gttcgccaatatcaatcgcccggtt

SEQ ID NO: 68526 - DNA, 25 bp, E. coli
gttcgccaatatgaatcgcccggtt

SEQ ID NO: 68527 - DNA, 25 bp, E. coli
aatgccgccgtttgccagaaattcg

SEQ ID NO: 68528 - DNA, 25 bp, E. coli
gccgtttgccagaaattcgtcggta

SEQ ID NO: 68529 - DNA, 25 bp, E. coli
aattcgtcggtaagcagatttgcat

SEQ ID NO: 68530 - DNA, 25 bp, E. coli
aatgccgccgttagccagaaattcg

SEQ ID NO: 68531 - DNA, 25 bp, E. coli
gccgtttgccagtaattcgtcggta

SEQ ID NO: 68532 - DNA, 25 bp, E. coli
aattcgtcggtatgcagatttgcat

SEQ ID NO: 68533 - DNA, 25 bp, E. coli
cagaatgccgccctttgccagaaat

SEQ ID NO: 68534 - DNA, 25 bp, E. coli
cagaatgccgccgtttgccagaaat

SEQ ID NO: 68535 - DNA, 25 bp, E. coli
catatctccagattgccgccgtttg

SEQ ID NO: 68536 - DNA, 25 bp, E. coli
catatctccagaatgccgccgtttg

SEQ ID NO: 68537 - DNA, 25 bp, E. coli
agcagatttgcattgatttacgtca

SEQ ID NO: 68538 - DNA, 25 bp, E. coli
agcagatttgcaatgatttacgtca

SEQ ID NO: 68539 - DNA, 25 bp, E. coli
tgcatgagccactaaataatataaa

SEQ ID NO: 68540 - DNA, 25 bp, E. coli
tgcatgagccacaaaataatataaa

SEQ ID NO: 68541 - DNA, 25 bp, E. coli
tcccgccattaagttgacttttagc

SEQ ID NO: 68542 - DNA, 25 bp, E. coli
tcccgccattaacttgacttttagc

SEQ ID NO: 68543 - DNA, 25 bp, E. coli
gccagaaattcgtcggtaagcagat

SEQ ID NO: 68544 - DNA, 25 bp, E. coli
gccagaaattcgacggtaagcagat

SEQ ID NO: 68545 - DNA, 25 bp, E. coli
gcattgatttacctcatcattgtga

SEQ ID NO: 68546 - DNA, 25 bp, E. coli
gcattgatttacgtcatcattgtga

SEQ ID NO: 68547 - DNA, 25 bp, E. coli
gatttacgtcatcattgtgaattaa

SEQ ID NO: 68548 - DNA, 25 bp, E. coli
gatttacgtcatgattgtgaattaa

SEQ ID NO: 68549 - DNA, 25 bp, E. coli
cagttattgatatgcctagtggtgg

SEQ ID NO: 68550 - DNA, 25 bp, E. coli
cagttattgataagcctagtggtgg

SEQ ID NO: 68551 - DNA, 25 bp, E. coli
taaagctgtatctaaagccttcccg

SEQ ID NO: 68552 - DNA, 25 bp, E. coli
taaagctgtatcaaaagccttcccg

SEQ ID NO: 68553 - DNA, 25 bp, E. coli
ttcagcttgagcgtggtggtaaatg

SEQ ID NO: 68554 - DNA, 25 bp, E. coli
ttcagcttgagcctggtggtaaatg

SEQ ID NO: 68555 - DNA, 25 bp, E. coli
tgtccgcctgctcattcagcttgag

SEQ ID NO: 68556 - DNA, 25 bp, E. coli
tgtccgcctgctgattcagcttgag

SEQ ID NO: 68557 - DNA, 25 bp, E. coli
tcacgattaacctgaactgtacgat

SEQ ID NO: 68558 - DNA, 25 bp, E. coli
tcacgattaaccagaactgtacgat

SEQ ID NO: 68559 - DNA, 25 bp, E. coli
tcaggagcgctcaacaatgtcacga

SEQ ID NO: 68560 - DNA, 25 bp, E. coli
tcaggagcgctctacaatgtcacga

SEQ ID NO: 68561 - DNA, 25 bp, E. coli
cggcatttgtagtggctgtcggtca

SEQ ID NO: 68562 - DNA, 25 bp, E. coli
cggcatttgtagaggctgtcggtca

SEQ ID NO: 68563 - DNA, 25 bp, E. coli
ggagcggaaataacccaggaggcac

SEQ ID NO: 68564 - DNA, 25 bp, E. coli
ggagcggaaatatcccaggaggcac

SEQ ID NO: 68565 - DNA, 25 bp, E. coli
tggtaaatggatcacggaaaaggat

SEQ ID NO: 68566 - DNA, 25 bp, E. coli
tggtaaatggatgacggaaaaggat

SEQ ID NO: 68567 - DNA, 25 bp, E. coli
taacggtatagcgtatgacgatccg

SEQ ID NO: 68568 - DNA, 25 bp, E. coli
taacggtatagcctatgacgatccg

SEQ ID NO: 68569 - DNA, 25 bp, E. coli
gaccgccagatttttattccgccca

SEQ ID NO: 68570 - DNA, 25 bp, E. coli
gaccgccagattattattccgccca

SEQ ID NO: 68571 - DNA, 25 bp, E. coli
tactggcggtgccacagcagaaaaa

SEQ ID NO: 68572 - DNA, 25 bp, E. coli
tactggcggtgcgacagcagaaaaa

SEQ ID NO: 68573 - DNA, 25 bp, E. coli
aaatggatcgaacagtgcctgccgc

SEQ ID NO: 68574 - DNA, 25 bp, E. coli
aaatggatcgaagagtgcctgccgc

SEQ ID NO: 68575 - DNA, 25 bp, E. coli
tatcggtggcaaaatgccgacgcac

SEQ ID NO: 68576 - DNA, 25 bp, E. coli
tatcggtggcaatatgccgacgcac

SEQ ID NO: 68577 - DNA, 25 bp, E. coli
tattactccggctctggtggcctgg

SEQ ID NO: 68578 - DNA, 25 bp, E. coli
tattactccggcactggtggcctgg

SEQ ID NO: 68579 - DNA, 25 bp, E. coli
tgttcggcaaagtggtcgggcttcc

SEQ ID NO: 68580 - DNA, 25 bp, E. coli
tgttcggcaaagaggtcgggcttcc

SEQ ID NO: 68581 - DNA, 25 bp, E. coli
tgcgcgccctataacctgaaatgga

SEQ ID NO: 68582 - DNA, 25 bp, E. coli
tgcgcgccctattacctgaaatgga

SEQ ID NO: 68583 - DNA, 25 bp, E. coli
tcagttctacgccacaggtgcgcgt

SEQ ID NO: 68584 - DNA, 25 bp, E. coli
tctggttaatgctcgactgctggat

SEQ ID NO: 68585 - DNA, 25 bp, E. coli
tctggttaatgcacgactgctggat

SEQ ID NO: 68586 - DNA, 25 bp, E. coli
tcagttctacgcgacaggtgcgcgt

SEQ ID NO: 68587 - DNA, 25 bp, E. coli
gccaccccgatgagtaaataccgcg

SEQ ID NO: 68588 - DNA, 25 bp, E. coli
gccaccccgatgtgtaaataccgcg

SEQ ID NO: 68589 - DNA, 25 bp, E. coli
gaaaccggtatccacattatgcagc

SEQ ID NO: 68590 - DNA, 25 bp, E. coli
gaaaccggtatcgacattatgcagc

SEQ ID NO: 68591 - DNA, 25 bp, E. coli
gggatccgcaaagatgccgctatgg

SEQ ID NO: 68592 - DNA, 25 bp, E. coli
gggatccgcaaacatgccgctatgg

SEQ ID NO: 68593 - DNA, 25 bp, E. coli
tatcgagcagagagcgccgctctgt

SEQ ID NO: 68594 - DNA, 25 bp, E. coli
tatcgagcagagtgcgccgctctgt

SEQ ID NO: 68595 - DNA, 25 bp, E. coli
ttcttttattctcttgagttgcatt

SEQ ID NO: 68596 - DNA, 25 bp, E. coli
ttcttttattctgttgagttgcatt

SEQ ID NO: 68597 - DNA, 25 bp, E. coli
tttattctgttgtgttgcattttta

SEQ ID NO: 68598 - DNA, 25 bp, E. coli
tgttcaccaataaccgaaattactc

SEQ ID NO: 68599 - DNA, 25 bp, E. coli
tttattctgttgagttgcattttta

SEQ ID NO: 68600 - DNA, 25 bp, E. coli
tgttcaccaatatccgaaattactc

SEQ ID NO: 68601 - DNA, 25 bp, E. coli
ttctgttgagttccatttttattca

SEQ ID NO: 68602 - DNA, 25 bp, E. coli
ttctgttgagttgcatttttattca

SEQ ID NO: 68603 - DNA, 25 bp, E. coli
tcaggcttgcggtattatcgagcag

SEQ ID NO: 68604 - DNA, 25 bp, E. coli
tcaggcttgcggaattatcgagcag

SEQ ID NO: 68605 - DNA, 25 bp, E. coli
gccgctctgttctccaataaccgaa

SEQ ID NO: 68606 - DNA, 25 bp, E. coli
gccgctctgttcaccaataaccgaa

SEQ ID NO: 68607 - DNA, 25 bp, E. coli
gaattatcgagctgagagcgccgct

SEQ ID NO: 68608 - DNA, 25 bp, E. coli
gaattatcgagcagagagcgccgct

SEQ ID NO: 68609 - DNA, 25 bp, E. coli
ccgaaattactcatcaaaatggcta

SEQ ID NO: 68610 - DNA, 25 bp, E. coli
ccgaaattactcttcaaaatggcta

SEQ ID NO: 68611 - DNA, 25 bp, E. coli
tcactttggtttagtcaggcttgcg

SEQ ID NO: 68612 - DNA, 25 bp, E. coli
tcactttggttttgtcaggcttgcg

SEQ ID NO: 68613 - DNA, 25 bp, E. coli
gagttgcattttaattcactttggt

SEQ ID NO: 68614 - DNA, 25 bp, E. coli
gagttgcatttttattcactttggt

SEQ ID NO: 68615 - DNA, 25 bp, E. coli
cactggcagtctgagtgttaatcgg

SEQ ID NO: 68616 - DNA, 25 bp, E. coli
cactggcagtctcagtgttaatcgg

SEQ ID NO: 68617 - DNA, 25 bp, E. coli
cagtctgagtgttaatcggtatgga

SEQ ID NO: 68618 - DNA, 25 bp, E. coli
caggttaaaaactctggcagtctga

SEQ ID NO: 68619 - DNA, 25 bp, E. coli
cagtctgagtgtaaatcggtatgga

SEQ ID NO: 68620 - DNA, 25 bp, E. coli
caggttaaaaacactggcagtctga

SEQ ID NO: 68621 - DNA, 25 bp, E. coli
acatctggatgggtattttaggtca

SEQ ID NO: 68622 - DNA, 25 bp, E. coli
acatctggatggctattttaggtca

SEQ ID NO: 68623 - DNA, 25 bp, E. coli
tcggtatggatgcattaacatctgg

SEQ ID NO: 68624 - DNA, 25 bp, E. coli
tcggtatggatggattaacatctgg

SEQ ID NO: 68625 - DNA, 25 bp, E. coli
ccacgactctgcaggttaaaaacac

SEQ ID NO: 68626 - DNA, 25 bp, E. coli
ccacgactctgctggttaaaaacac

SEQ ID NO: 68627 - DNA, 25 bp, E. coli
gaatcgtgtctctttctgttaaaaa

SEQ ID NO: 68628 - DNA, 25 bp, E. coli
gaatcgtgtctcattctgttaaaaa

SEQ ID NO: 68629 - DNA, 25 bp, E. coli
gactctgcaggttaaaaacactggc

SEQ ID NO: 68630 - DNA, 25 bp, E. coli
gactctgcaggtaaaaaacactggc

SEQ ID NO: 68631 - DNA, 25 bp, E. coli
tggtagcggatcctaccacgactct

SEQ ID NO: 68632 - DNA, 25 bp, E. coli
ggatcctaccacgactctgcaggtt

SEQ ID NO: 68633 - DNA, 25 bp, E. coli
ggatggattaacatctggatggcta

SEQ ID NO: 68634 - DNA, 25 bp, E. coli
ggatggattaacttctggatggcta

SEQ ID NO: 68635 - DNA, 25 bp, E. coli
tggtagcggatcgtaccacgactct

SEQ ID NO: 68636 - DNA, 25 bp, E. coli
ggatcctaccaccactctgcaggtt

SEQ ID NO: 68637 - DNA, 25 bp, E. coli
caggaacgcctgtagcaacttgaga

SEQ ID NO: 68638 - DNA, 25 bp, E. coli
caggaacgcctgaagcaacttgaga

SEQ ID NO: 68639 - DNA, 25 bp, E. coli
tactaaaaacaaaggcgcatcaggg

SEQ ID NO: 68640 - DNA, 25 bp, E. coli
tactaaaaacaatggcgcatcaggg

SEQ ID NO: 68641 - DNA, 25 bp, E. coli
tgtacgctgcgcataaaactggcac

SEQ ID NO: 68642 - DNA, 25 bp, E. coli
tgtacgctgcgcttaaaactggcac

SEQ ID NO: 68643 - DNA, 25 bp, E. coli
gccaggaatcaaccgcgaagcgttc

SEQ ID NO: 68644 - DNA, 25 bp, E. coli
gccaggaatcaagcgcgaagcgttc

SEQ ID NO: 68645 - DNA, 25 bp, E. coli
gcagctaaacttccgaagatcccga

SEQ ID NO: 68646 - DNA, 25 bp, E. coli
gcagctaaacttgcgaagatcccga

SEQ ID NO: 68647 - DNA, 25 bp, E. coli
gaagtgttcaaatacgcgccattgg

SEQ ID NO: 68648 - DNA, 25 bp, E. coli
gaagtgttcaaaaacgcgccattgg

SEQ ID NO: 68649 - DNA, 25 bp, E. coli
gaactgcgtgagaaacaagcggctg

SEQ ID NO: 68650 - DNA, 25 bp, E. coli
gaactgcgtgagtaacaagcggctg

SEQ ID NO: 68651 - DNA, 25 bp, E. coli
gaacaaaacgactagctcaagcggg

SEQ ID NO: 68652 - DNA, 25 bp, E. coli
gaacaaaacgacaagctcaagcggg

SEQ ID NO: 68653 - DNA, 25 bp, E. coli
cgcctgccgggagtggtaatactaa

SEQ ID NO: 68654 - DNA, 25 bp, E. coli
cgcctgccgggactggtaatactaa

SEQ ID NO: 68655 - DNA, 25 bp, E. coli
cgatatcaataagtatgccgggcag

SEQ ID NO: 68656 - DNA, 25 bp, E. coli
cgatatcaataactatgccgggcag

SEQ ID NO: 68657 - DNA, 25 bp, E. coli
tcaaacctgaaggtggcgatcccgc

SEQ ID NO: 68658 - DNA, 25 bp, E. coli
tcaaacctgaagctggcgatcccgc

SEQ ID NO: 68659 - DNA, 25 bp, E. coli
caattgttcagcagagctttgaacc

SEQ ID NO: 68660 - DNA, 25 bp, E. coli
caattgttcagctgagctttgaacc

SEQ ID NO: 68661 - DNA, 25 bp, E. coli
cacaggaaaagaacgcaattgttca

SEQ ID NO: 68662 - DNA, 25 bp, E. coli
cacaggaaaagatcgcaattgttca

SEQ ID NO: 68663 - DNA, 25 bp, E. coli
atttctctggcgaaagcaatactag

SEQ ID NO: 68664 - DNA, 25 bp, E. coli
atttctctggcgtaagcaatactag

SEQ ID NO: 68665 - DNA, 25 bp, E. coli
tatttctctggcctaagcaatacta

SEQ ID NO: 68666 - DNA, 25 bp, E. coli
tatttctctggcgtaagcaatacta

SEQ ID NO: 68667 - DNA, 25 bp, E. coli
gacggcgtaccagacaggaaaagat

SEQ ID NO: 68668 - DNA, 25 bp, E. coli
gacggcgtaccacacaggaaaagat

SEQ ID NO: 68669 - DNA, 25 bp, E. coli
cgttgcccggcatcatggtgtagca

SEQ ID NO: 68670 - DNA, 25 bp, E. coli
cgttgcccggcaacatggtgtagca

SEQ ID NO: 68671 - DNA, 25 bp, E. coli
ctcgttgcccggcaacatggtgtag

SEQ ID NO: 68672 - DNA, 25 bp, E. coli
ctcgttgcccgggaacatggtgtag

SEQ ID NO: 68673 - DNA, 25 bp, E. coli
gattgatgtcttagggccggagaaa

SEQ ID NO: 68674 - DNA, 25 bp, E. coli
gattgatgtctttgggccggagaaa

SEQ ID NO: 68675 - DNA, 25 bp, E. coli
gggatgacggtctccctcgttgccc

SEQ ID NO: 68676 - DNA, 25 bp, E. coli
gggatgacggtcaccctcgttgccc

SEQ ID NO: 68677 - DNA, 25 bp, E. coli
ggagaaacgcagacggcgtaccaca

SEQ ID NO: 68678 - DNA, 25 bp, E. coli
ggtgtagcagccagccagttatttc

SEQ ID NO: 68679 - DNA, 25 bp, E. coli
ggtgtagcagcctgccagttatttc

SEQ ID NO: 68680 - DNA, 25 bp, E. coli
ggagaaacgcagtcggcgtaccaca

SEQ ID NO: 68681 - DNA, 25 bp, E. coli
aagacccgtacttataactctatcg

SEQ ID NO: 68682 - DNA, 25 bp, E. coli
aagacccgtactaataactctatcg

SEQ ID NO: 68683 - DNA, 25 bp, E. coli
ctctgtcgtagcacgttactggcac

SEQ ID NO: 68684 - DNA, 25 bp, E. coli
ctctgtcgtagctcgttactggcac

SEQ ID NO: 68685 - DNA, 25 bp, E. coli
caaaattaaatagtttgtgccgatt

SEQ ID NO: 68686 - DNA, 25 bp, E. coli
caaaattaaatactttgtgccgatt

SEQ ID NO: 68687 - DNA, 25 bp, E. coli
ctcgttactggctcgacggtggtca

SEQ ID NO: 68688 - DNA, 25 bp, E. coli
ctcgttactggcacgacggtggtca

SEQ ID NO: 68689 - DNA, 25 bp, E. coli
tagctcgttactggcacgacggtgg

SEQ ID NO: 68690 - DNA, 25 bp, E. coli
tagctcgttactcgcacgacggtgg

SEQ ID NO: 68691 - DNA, 25 bp, E. coli
tcgtagctcgttactggcacgacgg

SEQ ID NO: 68692 - DNA, 25 bp, E. coli
tcgtagctcgtttctggcacgacgg

SEQ ID NO: 68693 - DNA, 25 bp, E. coli
tctgggtaccgaaatcgacactggc

SEQ ID NO: 68694 - DNA, 25 bp, E. coli
tctgggtaccgatatcgacactggc

SEQ ID NO: 68695 - DNA, 25 bp, E. coli
gcaatcaacggttttaagacccgta

SEQ ID NO: 68696 - DNA, 25 bp, E. coli
gcaatcaacggtattaagacccgta

SEQ ID NO: 68697 - DNA, 25 bp, E. coli
gatatcgacactggcctgccgatga

SEQ ID NO: 68698 - DNA, 25 bp, E. coli
gatatcgacactcgcctgccgatga

SEQ ID NO: 68699 - DNA, 25 bp, E. coli
ggtaccgatatccacactggcctgc

SEQ ID NO: 68700 - DNA, 25 bp, E. coli
ggtaccgatatcgacactggcctgc

SEQ ID NO: 68701 - DNA, 25 bp, E. coli
taataactctatcgcttccagccat

SEQ ID NO: 68702 - DNA, 25 bp, E. coli
taataactctatggcttccagccat

SEQ ID NO: 68703 - DNA, 25 bp, E. coli
aatagcattttgagttgaggatcac

SEQ ID NO: 68704 - DNA, 25 bp, E. coli
aatagcattttgtgttgaggatcac

SEQ ID NO: 68705 - DNA, 25 bp, E. coli
caacaagggaaaatttcacagagct

SEQ ID NO: 68706 - DNA, 25 bp, E. coli
cacagagcttttcatcggcgtaggc

SEQ ID NO: 68707 - DNA, 25 bp, E. coli
cacagagcttttgatcggcgtaggc

SEQ ID NO: 68708 - DNA, 25 bp, E. coli
caacaagggaaattttcacagagct

SEQ ID NO: 68709 - DNA, 25 bp, E. coli
aaacgaataattcctgatcgccgcg

SEQ ID NO: 68710 - DNA, 25 bp, E. coli
aaacgaataattgctgatcgccgcg

SEQ ID NO: 68711 - DNA, 25 bp, E. coli
tttgatagtgcgaaagaaccctgcg

SEQ ID NO: 68712 - DNA, 25 bp, E. coli
tttgatagtgcgtaagaaccctgcg

SEQ ID NO: 68713 - DNA, 25 bp, E. coli
tgcttcgtttactgtaacgccgggt

SEQ ID NO: 68714 - DNA, 25 bp, E. coli
tgcttcgtttacagtaacgccgggt

SEQ ID NO: 68715 - DNA, 25 bp, E. coli
tcggcgtaggccacagaatgttgct

SEQ ID NO: 68716 - DNA, 25 bp, E. coli
tcggcgtaggcctcagaatgttgct

SEQ ID NO: 68717 - DNA, 25 bp, E. coli
gaaccctgcgaggaaaataagcatc

SEQ ID NO: 68718 - DNA, 25 bp, E. coli
gaaccctgcgagcaaaataagcatc

SEQ ID NO: 68719 - DNA, 25 bp, E. coli
ccctcataggcgacgaatagcattt

SEQ ID NO: 68720 - DNA, 25 bp, E. coli
ccctcataggcgtcgaatagcattt

SEQ ID NO: 68721 - DNA, 25 bp, E. coli
taaggtcagacatagacaacaaggg

SEQ ID NO: 68722 - DNA, 25 bp, E. coli
taaggtcagacaaagacaacaaggg

SEQ ID NO: 68723 - DNA, 25 bp, E. coli
gatcgccgcgataaggtcagacaaa

SEQ ID NO: 68724 - DNA, 25 bp, E. coli
gatcgccgcgattaggtcagacaaa

SEQ ID NO: 68725 - DNA, 25 bp, E. coli
caacgatgcttaatcgacaggccga

SEQ ID NO: 68726 - DNA, 25 bp, E. coli
caagagatgcatcaattattagccg

SEQ ID NO: 68727 - DNA, 25 bp, E. coli
caacgatgcttattcgacaggccga

SEQ ID NO: 68728 - DNA, 25 bp, E. coli
caagagatgcatgaattattagccg

SEQ ID NO: 68729 - DNA, 25 bp, E. coli
taaattgtggagagattcggaagct

SEQ ID NO: 68730 - DNA, 25 bp, E. coli
taaattgtggagtgattcggaagct

SEQ ID NO: 68731 - DNA, 25 bp, E. coli
tattccgatcacgaagctattgcga

SEQ ID NO: 68732 - DNA, 25 bp, E. coli
tattccgatcaccaagctattgcga

SEQ ID NO: 68733 - DNA, 25 bp, E. coli
tgtgaatgggacagagacttctcct

SEQ ID NO: 68734 - DNA, 25 bp, E. coli
tgtgaatgggactgagacttctcct

SEQ ID NO: 68735 - DNA, 25 bp, E. coli
gctattgcgatgatagaagcctcaa

SEQ ID NO: 68736 - DNA, 25 bp, E. coli
gctattgcgatgttagaagcctcaa

SEQ ID NO: 68737 - DNA, 25 bp, E. coli
gaatattaaacctgcatcagaagct

SEQ ID NO: 68738 - DNA, 25 bp, E. coli
gaatattaaaccagcatcagaagct

SEQ ID NO: 68739 - DNA, 25 bp, E. coli
gacaggccgaagagtgggcaaaaca

SEQ ID NO: 68740 - DNA, 25 bp, E. coli
gacaggccgaagtgtgggcaaaaca

SEQ ID NO: 68741 - DNA, 25 bp, E. coli
gtatttacgtacatccggcacatcg

SEQ ID NO: 68742 - DNA, 25 bp, E. coli
gtcgctcgggcgttgcaacgatgct

SEQ ID NO: 68743 - DNA, 25 bp, E. coli
gtatttacgtacttccggcacatcg

SEQ ID NO: 68744 - DNA, 25 bp, E. coli
gtcgctcgggcgatgcaacgatgct

SEQ ID NO: 68745 - DNA, 25 bp, E. coli
tcagaagcttcactcaaagattggt

SEQ ID NO: 68746 - DNA, 25 bp, E. coli
tcagaagcttcagtcaaagattggt

SEQ ID NO: 68747 - DNA, 25 bp, E. coli
catggagaacacattatcagccggg

SEQ ID NO: 68748 - DNA, 25 bp, E. coli
catggagaacactttatcagccggg

SEQ ID NO: 68749 - DNA, 25 bp, E. coli
tacgataatgcctgcgtggaaagct

SEQ ID NO: 68750 - DNA, 25 bp, E. coli
tacgataatgccagcgtggaaagct

SEQ ID NO: 68751 - DNA, 25 bp, E. coli
ttatcagccgggaaataatgcgggc

SEQ ID NO: 68752 - DNA, 25 bp, E. coli
ttatcagccgggtaataatgcgggc

SEQ ID NO: 68753 - DNA, 25 bp, E. coli
tgctgctacgattatgcctgcgtgg

SEQ ID NO: 68754 - DNA, 25 bp, E. coli
tgctgctacgataatgcctgcgtgg

SEQ ID NO: 68755 - DNA, 25 bp, E. coli
tcagccgggaaataatgcgggcaac

SEQ ID NO: 68756 - DNA, 25 bp, E. coli
cctgcgtggaaagcttctttcattc

SEQ ID NO: 68757 - DNA, 25 bp, E. coli
cctgcgtggaaaccttctttcattc

SEQ ID NO: 68758 - DNA, 25 bp, E. coli
cggtgtttaattatatcgaatgtga

SEQ ID NO: 68759 - DNA, 25 bp, E. coli
cggtgtttaattttatcgaatgtga

SEQ ID NO: 68760 - DNA, 25 bp, E. coli
ggcaacggtgttaaattatatcgaa

SEQ ID NO: 68761 - DNA, 25 bp, E. coli
ggcaacggtgtttaattatatcgaa

SEQ ID NO: 68762 - DNA, 25 bp, E. coli
taatgcctgcgtggaaagcttcttt

SEQ ID NO: 68763 - DNA, 25 bp, E. coli
tcagccgggaaaaaatgcgggcaac

SEQ ID NO: 68764 - DNA, 25 bp, E. coli
taatgcctgcgtcgaaagcttcttt

SEQ ID NO: 68765 - DNA, 25 bp, E. coli
taatgcgggcaacggtgtttaatta

SEQ ID NO: 68766 - DNA, 25 bp, E. coli
taatgcgggcaagggtgtttaatta

SEQ ID NO: 68767 - DNA, 25 bp, E. coli
gagaacactttaacagccgggaaat

SEQ ID NO: 68768 - DNA, 25 bp, E. coli
gagaacactttatcagccgggaaat

SEQ ID NO: 68769 - DNA, 25 bp, E. coli
tacgcagccgcgatggcgggatcat

SEQ ID NO: 68770 - DNA, 25 bp, E. coli
ataagcggcatcgatagcgacggct

SEQ ID NO: 68771 - DNA, 25 bp, E. coli
ataagcggcatccatagcgacggct

SEQ ID NO: 68772 - DNA, 25 bp, E. coli
tacgcagccgcgttggcgggatcat

SEQ ID NO: 68773 - DNA, 25 bp, E. coli
tatcgaactggttaaacagcagggt

SEQ ID NO: 68774 - DNA, 25 bp, E. coli
tatcgaactggtaaaacagcagggt

SEQ ID NO: 68775 - DNA, 25 bp, E. coli
tgaaacaaacactacgtcacaacgg

SEQ ID NO: 68776 - DNA, 25 bp, E. coli
tgaaacaaacacaacgtcacaacgg

SEQ ID NO: 68777 - DNA, 25 bp, E. coli
ccaatggctcgacgctgtttatcga

SEQ ID NO: 68778 - DNA, 25 bp, E. coli
ccacccagaccgaagaaaaagagcg

SEQ ID NO: 68779 - DNA, 25 bp, E. coli
ccacccagaccgtagaaaaagagcg

SEQ ID NO: 68780 - DNA, 25 bp, E. coli
ccaatggctcgaggctgtttatcga

SEQ ID NO: 68781 - DNA, 25 bp, E. coli
gcggcgctgccttccagttcggtta

SEQ ID NO: 68782 - DNA, 25 bp, E. coli
gcggcgctgcctaccagttcggtta

SEQ ID NO: 68783 - DNA, 25 bp, E. coli
gattttatctcccagttccgccttg

SEQ ID NO: 68784 - DNA, 25 bp, E. coli
gattttatctccgagttccgccttg

SEQ ID NO: 68785 - DNA, 25 bp, E. coli
gagcaaaacctgatcctgcgccatc

SEQ ID NO: 68786 - DNA, 25 bp, E. coli
gagttcgattaccacgaagttcgca

SEQ ID NO: 68787 - DNA, 25 bp, E. coli
gagaactcgcgccacgttatgctgg

SEQ ID NO: 68788 - DNA, 25 bp, E. coli
gagaactcgcgcgacgttatgctgg

SEQ ID NO: 68789 - DNA, 25 bp, E. coli
gagttcgattacgacgaagttcgca

SEQ ID NO: 68790 - DNA, 25 bp, E. coli
gagcaaaacctgttcctgcgccatc

SEQ ID NO: 68791 - DNA, 25 bp, E. coli
cagagagcttggtatgacaggtgca

SEQ ID NO: 68792 - DNA, 25 bp, E. coli
cagagagcttggaatgacaggtgca

SEQ ID NO: 68793 - DNA, 25 bp, E. coli
taaagcgcgggagttggatgtcaca

SEQ ID NO: 68794 - DNA, 25 bp, E. coli
taaagcgcgggacttggatgtcaca

SEQ ID NO: 68795 - DNA, 25 bp, E. coli
tgtgacctgcgtaaatcctggcgtt

SEQ ID NO: 68796 - DNA, 25 bp, E. coli
tgtgacctgcgttaatcctggcgtt

SEQ ID NO: 68797 - DNA, 25 bp, E. coli
tctgccgcgcaggaggaattgctaa

SEQ ID NO: 68798 - DNA, 25 bp, E. coli
tctgccgcgcagcaggaattgctaa

SEQ ID NO: 68799 - DNA, 25 bp, E. coli
gaatctcccgaatgcgttgatacaa

SEQ ID NO: 68800 - DNA, 25 bp, E. coli
gaagcacagggttccggtcagataa

SEQ ID NO: 68801 - DNA, 25 bp, E. coli
gcaaaggttttactgggagcacgca

SEQ ID NO: 68802 - DNA, 25 bp, E. coli
gaagcacagggtaccggtcagataa

SEQ ID NO: 68803 - DNA, 25 bp, E. coli
gcagagttgagcctatcgaagccat

SEQ ID NO: 68804 - DNA, 25 bp, E. coli
gaatctcccgaaagcgttgatacaa

SEQ ID NO: 68805 - DNA, 25 bp, E. coli
gcagagttgagcgtatcgaagccat

SEQ ID NO: 68806 - DNA, 25 bp, E. coli
gcaaaggttttagtgggagcacgca

SEQ ID NO: 68807 - DNA, 25 bp, E. coli
gaaagctcgaaaatccgtgtgacct

SEQ ID NO: 68808 - DNA, 25 bp, E. coli
gaaaacaagatgtatgggcgctcac

SEQ ID NO: 68809 - DNA, 25 bp, E. coli
gaaagctcgaaattccgtgtgacct

SEQ ID NO: 68810 - DNA, 25 bp, E. coli
gaaaacaagatgaatgggcgctcac

SEQ ID NO: 68811 - DNA, 25 bp, E. coli
cgatttcgtgcaagcagcgctggat

SEQ ID NO: 68812 - DNA, 25 bp, E. coli
cgatttcgtgcatgcagcgctggat

SEQ ID NO: 68813 - DNA, 25 bp, E. coli
aataataaacggcaggcgatatgca

SEQ ID NO: 68814 - DNA, 25 bp, E. coli
aataataaacgggaggcgatatgca

SEQ ID NO: 68815 - DNA, 25 bp, E. coli
acgggaggcgatatgcacaaagcat

SEQ ID NO: 68816 - DNA, 25 bp, E. coli
acgggaggcgatttgcacaaagcat

SEQ ID NO: 68817 - DNA, 25 bp, E. coli
tatccgcgtaggcacgatcactttc

SEQ ID NO: 68818 - DNA, 25 bp, E. coli
tatccgcgtagggacgatcactttc

SEQ ID NO: 68819 - DNA, 25 bp, E. coli
tgttatccgaaatccgctgaaagcc

SEQ ID NO: 68820 - DNA, 25 bp, E. coli
tgttatccgaaaaccgctgaaagcc

SEQ ID NO: 68821 - DNA, 25 bp, E. coli
tccgaaatccgcagaaagcccagcg

SEQ ID NO: 68822 - DNA, 25 bp, E. coli
tccgaaatccgctgaaagcccagcg

SEQ ID NO: 68823 - DNA, 25 bp, E. coli
cgaaatccgctgaaagcccagcggc

SEQ ID NO: 68824 - DNA, 25 bp, E. coli
cgaaatccgctgtaagcccagcggc

SEQ ID NO: 68825 - DNA, 25 bp, E. coli
cgcgtaggcacgatcactttcgtct

SEQ ID NO: 68826 - DNA, 25 bp, E. coli
cgcgtaggcacgttcactttcgtct

SEQ ID NO: 68827 - DNA, 25 bp, E. coli
cgggaggcgataagcacaaagcatc

SEQ ID NO: 68828 - DNA, 25 bp, E. coli
cgggaggcgatatgcacaaagcatc

SEQ ID NO: 68829 - DNA, 25 bp, E. coli
gataatatccgcgtaggcacgatca

SEQ ID NO: 68830 - DNA, 25 bp, E. coli
gataatatccgcctaggcacgatca

SEQ ID NO: 68831 - DNA, 25 bp, E. coli
taatatccgcgttggcacgatcact

SEQ ID NO: 68832 - DNA, 25 bp, E. coli
taatatccgcgtaggcacgatcact

SEQ ID NO: 68833 - DNA, 25 bp, E. coli
tcacgataatatccgcgtaggcacg

SEQ ID NO: 68834 - DNA, 25 bp, E. coli
tcacgataatatgcgcgtaggcacg

SEQ ID NO: 68835 - DNA, 25 bp, E. coli
tactctcctgtgtccaggcagcgaa

SEQ ID NO: 68836 - DNA, 25 bp, E. coli
tactctcctgtgaccaggcagcgaa

SEQ ID NO: 68837 - DNA, 25 bp, E. coli
cactcaatccgtcttgtcgtttcag

SEQ ID NO: 68838 - DNA, 25 bp, E. coli
agttctgcgtacactcctgtgacca

SEQ ID NO: 68839 - DNA, 25 bp, E. coli
cactcaatccgtgttgtcgtttcag

SEQ ID NO: 68840 - DNA, 25 bp, E. coli
agttctgcgtactctcctgtgacca

SEQ ID NO: 68841 - DNA, 25 bp, E. coli
tgcgaagtgaactgatttctggctc

SEQ ID NO: 68842 - DNA, 25 bp, E. coli
tgcgaagtgaacagatttctggctc

SEQ ID NO: 68843 - DNA, 25 bp, E. coli
cctgtgaccagggagcgaaaagaca

SEQ ID NO: 68844 - DNA, 25 bp, E. coli
cctgtgaccaggcagcgaaaagaca

SEQ ID NO: 68845 - DNA, 25 bp, E. coli
gcagcgaaaagagatgagtcgatga

SEQ ID NO: 68846 - DNA, 25 bp, E. coli
gcagcgaaaagacatgagtcgatga

SEQ ID NO: 68847 - DNA, 25 bp, E. coli
gaacagatttctggctcgtcactca

SEQ ID NO: 68848 - DNA, 25 bp, E. coli
gaacagatttctcgctcgtcactca

SEQ ID NO: 68849 - DNA, 25 bp, E. coli
cgtcttgtcgtttcagttctgcgta

SEQ ID NO: 68850 - DNA, 25 bp, E. coli
cgtcttgtcgttacagttctgcgta

SEQ ID NO: 68851 - DNA, 25 bp, E. coli
gatttctggctcctcactcaatccg

SEQ ID NO: 68852 - DNA, 25 bp, E. coli
gatttctggctcgtcactcaatccg

SEQ ID NO: 68853 - DNA, 25 bp, E. coli
tggctcgtcactgaatccgtcttgt

SEQ ID NO: 68854 - DNA, 25 bp, E. coli
tggctcgtcactcaatccgtcttgt

SEQ ID NO: 68855 - DNA, 25 bp, E. coli
gaccaggcagcgtaaagacatgagt

SEQ ID NO: 68856 - DNA, 25 bp, E. coli
gaccaggcagcgaaaagacatgagt

SEQ ID NO: 68857 - DNA, 25 bp, E. coli
aagagtgtccacagtttaacgccgg

SEQ ID NO: 68858 - DNA, 25 bp, E. coli
aagagtgtccactgtttaacgccgg

SEQ ID NO: 68859 - DNA, 25 bp, E. coli
caacaggaattacgctacatcgagg

SEQ ID NO: 68860 - DNA, 25 bp, E. coli
caacaggaattaggctacatcgagg

SEQ ID NO: 68861 - DNA, 25 bp, E. coli
catggtggcgcacgtgcaattagcc

SEQ ID NO: 68862 - DNA, 25 bp, E. coli
cagtcattgcaaatcatggtggcgc

SEQ ID NO: 68863 - DNA, 25 bp, E. coli
cagtcattgcaattcatggtggcgc

SEQ ID NO: 68864 - DNA, 25 bp, E. coli
catggtggcgcaggtgcaattagcc

SEQ ID NO: 68865 - DNA, 25 bp, E. coli
tacatcgaggcgttgtctgccattg

SEQ ID NO: 68866 - DNA, 25 bp, E. coli
tacatcgaggcgatgtctgccattg

SEQ ID NO: 68867 - DNA, 25 bp, E. coli
attagccgcgcgcagatgagtctgc

SEQ ID NO: 68868 - DNA, 25 bp, E. coli
attagccgcgcggagatgagtctgc

SEQ ID NO: 68869 - DNA, 25 bp, E. coli
tgcgtaatccggttcttgccgcccg

SEQ ID NO: 68870 - DNA, 25 bp, E. coli
tgcgtaatccggatcttgccgcccg

SEQ ID NO: 68871 - DNA, 25 bp, E. coli
tgccattgttgaaaccgggcagaaa

SEQ ID NO: 68872 - DNA, 25 bp, E. coli
tgccattgttgataccgggcagaaa

SEQ ID NO: 68873 - DNA, 25 bp, E. coli
tggcgggcgttactcatctgcgtaa

SEQ ID NO: 68874 - DNA, 25 bp, E. coli
tggcgggcgttagtcatctgcgtaa

SEQ ID NO: 68875 - DNA, 25 bp, E. coli
gatggtaacaccgtgaaagccggtg

SEQ ID NO: 68876 - DNA, 25 bp, E. coli
gacgcctgtgtgatggatggtaaca

SEQ ID NO: 68877 - DNA, 25 bp, E. coli
gatggtaacaccctgaaagccggtg

SEQ ID NO: 68878 - DNA, 25 bp, E. coli
gacgcctgtgtgttggatggtaaca

SEQ ID NO: 68879 - DNA, 25 bp, E. coli
cagcttcctgccttgtggaattcca

SEQ ID NO: 68880 - DNA, 25 bp, E. coli
cagcttcctgccatgtggaattcca

SEQ ID NO: 68881 - DNA, 25 bp, E. coli
tacagatgctccagctccggaggca

SEQ ID NO: 68882 - DNA, 25 bp, E. coli
tacagatgctcctgctccggaggca

SEQ ID NO: 68883 - DNA, 25 bp, E. coli
tatcagttgcttgtgcagcttcctg

SEQ ID NO: 68884 - DNA, 25 bp, E. coli
tatcagttgcttctgcagcttcctg

SEQ ID NO: 68885 - DNA, 25 bp, E. coli
tgtaggccctactgtatcacaatct

SEQ ID NO: 68886 - DNA, 25 bp, E. coli
tgtaggccctacagtatcacaatct

SEQ ID NO: 68887 - DNA, 25 bp, E. coli
tgctccggaggcattatcagttgct

SEQ ID NO: 68888 - DNA, 25 bp, E. coli
tgctccggaggctttatcagttgct

SEQ ID NO: 68889 - DNA, 25 bp, E. coli
tccagtggaactaatcgacaccccg

SEQ ID NO: 68890 - DNA, 25 bp, E. coli
ccattacggtaaaatgatgctggaa

SEQ ID NO: 68891 - DNA, 25 bp, E. coli
tccagtggaacttatcgacaccccg

SEQ ID NO: 68892 - DNA, 25 bp, E. coli
ccattacggtaatatgatgctggaa

SEQ ID NO: 68893 - DNA, 25 bp, E. coli
gacaccccgcgcagtgctacagatg

SEQ ID NO: 68894 - DNA, 25 bp, E. coli
gacaccccgcgctgtgctacagatg

SEQ ID NO: 68895 - DNA, 25 bp, E. coli
gtatcacaatctattccggcctctc

SEQ ID NO: 68896 - DNA, 25 bp, E. coli
gtatcacaatcttttccggcctctc

SEQ ID NO: 68897 - DNA, 25 bp, E. coli
ggcctctccgactctggttccagtg

SEQ ID NO: 68898 - DNA, 25 bp, E. coli
ggcgctccggaacccgccggatatt

SEQ ID NO: 68899 - DNA, 25 bp, E. coli
ggcctctccgacactggttccagtg

SEQ ID NO: 68900 - DNA, 25 bp, E. coli
ggcgctccggaagccgccggatatt

SEQ ID NO: 68901 - DNA, 25 bp, E. coli
cacttcgtcagtcgatgcgcgagaa

SEQ ID NO: 68902 - DNA, 25 bp, E. coli
cacttcgtcagtggatgcgcgagaa

SEQ ID NO: 68903 - DNA, 25 bp, E. coli
tgttttattacgctccagagagtgc

SEQ ID NO: 68904 - DNA, 25 bp, E. coli
tgttttattacggtccagagagtgc

SEQ ID NO: 68905 - DNA, 25 bp, E. coli
tgacggctgggatactcagtggcct

SEQ ID NO: 68906 - DNA, 25 bp, E. coli
tgacggctgggaaactcagtggcct

SEQ ID NO: 68907 - DNA, 25 bp, E. coli
tgcgaagaattgctggcatggcacc

SEQ ID NO: 68908 - DNA, 25 bp, E. coli
tgcgaagaattggtggcatggcacc

SEQ ID NO: 68909 - DNA, 25 bp, E. coli
tcagtggcctctaccagaagcgtca

SEQ ID NO: 68910 - DNA, 25 bp, E. coli
tcagtggcctcttccagaagcgtca

SEQ ID NO: 68911 - DNA, 25 bp, E. coli
gctggtgacggcttttcagacacag

SEQ ID NO: 68912 - DNA, 25 bp, E. coli
gctggtgacggcatttcagacacag

SEQ ID NO: 68913 - DNA, 25 bp, E. coli
gaagcgtcattaccgccgctggtga

SEQ ID NO: 68914 - DNA, 25 bp, E. coli
gaagcgtcattagcgccgctggtga

SEQ ID NO: 68915 - DNA, 25 bp, E. coli
gaaatgaagcaatacgaaccggaag

SEQ ID NO: 68916 - DNA, 25 bp, E. coli
gaacaccctttctaccgtgcactgg

SEQ ID NO: 68917 - DNA, 25 bp, E. coli
gaacaccctttcaaccgtgcactgg

SEQ ID NO: 68918 - DNA, 25 bp, E. coli
gaaatgaagcaaaacgaaccggaag

SEQ ID NO: 68919 - DNA, 25 bp, E. coli
tggcgcaatggctatcacaactgtt

SEQ ID NO: 68920 - DNA, 25 bp, E. coli
tggcgcaatggcaatcacaactgtt

SEQ ID NO: 68921 - DNA, 25 bp, E. coli
ggaatgacccatatttcacagcaag

SEQ ID NO: 68922 - DNA, 25 bp, E. coli
ggaatgacccatttttcacagcaag

SEQ ID NO: 68923 - DNA, 25 bp, E. coli
caaaatcagccaacagaaactgccc

SEQ ID NO: 68924 - DNA, 25 bp, E. coli
caaaatcagccatcagaaactgccc

SEQ ID NO: 68925 - DNA, 25 bp, E. coli
cataaagcgggcttcagtgcagagc

SEQ ID NO: 68926 - DNA, 25 bp, E. coli
cataaagcgggcatcagtgcagagc

SEQ ID NO: 68927 - DNA, 25 bp, E. coli
agaacgtgaacacgccagccaacat

SEQ ID NO: 68928 - DNA, 25 bp, E. coli
agaacgtgaacaggccagccaacat

SEQ ID NO: 68929 - DNA, 25 bp, E. coli
atagtgctgcgcgatatctcggccc

SEQ ID NO: 68930 - DNA, 25 bp, E. coli
atagtgctgcgccatatctcggccc

SEQ ID NO: 68931 - DNA, 25 bp, E. coli
acacgccgctgtcgctggcggataa

SEQ ID NO: 68932 - DNA, 25 bp, E. coli
acacgccgctgtggctggcggataa

SEQ ID NO: 68933 - DNA, 25 bp, E. coli
tctgcttcagtttccagaacgtgaa

SEQ ID NO: 68934 - DNA, 25 bp, E. coli
tctgcttcagttaccagaacgtgaa

SEQ ID NO: 68935 - DNA, 25 bp, E. coli
gccacgttacggcacgtgtttcgct

SEQ ID NO: 68936 - DNA, 25 bp, E. coli
gccacgttacgggacgtgtttcgct

SEQ ID NO: 68937 - DNA, 25 bp, E. coli
gaagataaccttgccgagctggtgt

SEQ ID NO: 68938 - DNA, 25 bp, E. coli
gaagataaccttcccgagctggtgt

SEQ ID NO: 68939 - DNA, 25 bp, E. coli
cgtgtttcgctagtggaagataacc

SEQ ID NO: 68940 - DNA, 25 bp, E. coli
cgtgtttcgctactggaagataacc

SEQ ID NO: 68941 - DNA, 25 bp, E. coli
tggcggataacgatcgcatagtgct

SEQ ID NO: 68942 - DNA, 25 bp, E. coli
tggcggataacgttcgcatagtgct

SEQ ID NO: 68943 - DNA, 25 bp, E. coli
gagctggtgttccacacgccgctgt

SEQ ID NO: 68944 - DNA, 25 bp, E. coli
gagctggtgttcgacacgccgctgt

SEQ ID NO: 68945 - DNA, 25 bp, E. coli
aatatgcgcaatccctgactgataa

SEQ ID NO: 68946 - DNA, 25 bp, E. coli
aatatgcgcaatgcctgactgataa

SEQ ID NO: 68947 - DNA, 25 bp, E. coli
tactttggcgagcatctggatggct

SEQ ID NO: 68948 - DNA, 25 bp, E. coli
tactttggcgaggatctggatggct

SEQ ID NO: 68949 - DNA, 25 bp, E. coli
tgacaattcttattcacaccctcgg

SEQ ID NO: 68950 - DNA, 25 bp, E. coli
tgacaattcttaatcacaccctcgg

SEQ ID NO: 68951 - DNA, 25 bp, E. coli
ttgaccggcccgctgactattctct

SEQ ID NO: 68952 - DNA, 25 bp, E. coli
ttgaccggcccggtgactattctct

SEQ ID NO: 68953 - DNA, 25 bp, E. coli
tctgctgctgggaaatgttccgcca

SEQ ID NO: 68954 - DNA, 25 bp, E. coli
tctgctgctgggtaatgttccgcca

SEQ ID NO: 68955 - DNA, 25 bp, E. coli
tctggatggcttagtctttacgcaa

SEQ ID NO: 68956 - DNA, 25 bp, E. coli
tctggatggctttgtctttacgcaa

SEQ ID NO: 68957 - DNA, 25 bp, E. coli
gccgattacctagctgtggctgggt

SEQ ID NO: 68958 - DNA, 25 bp, E. coli
gccgattacctacctgtggctgggt

SEQ ID NO: 68959 - DNA, 25 bp, E. coli
cgttggtactggaactgccgcaggc

SEQ ID NO: 68960 - DNA, 25 bp, E. coli
cgttggtactggtactgccgcaggc

SEQ ID NO: 68961 - DNA, 25 bp, E. coli
ctacctgtggctcggtaaagtgaaa

SEQ ID NO: 68962 - DNA, 25 bp, E. coli
ctgggtaatgttccgccacgtcatc

SEQ ID NO: 68963 - DNA, 25 bp, E. coli
ctacctgtggctgggtaaagtgaaa

SEQ ID NO: 68964 - DNA, 25 bp, E. coli
ctgggtaatgttgcgccacgtcatc

SEQ ID NO: 68965 - DNA, 25 bp, E. coli
gagtgggcaaaatatgcgcaatccc

SEQ ID NO: 68966 - DNA, 25 bp, E. coli
gagtgggcaaaaaatgcgcaatccc

SEQ ID NO: 68967 - DNA, 25 bp, E. coli
aacgagaaaatcgtcgaagcgattt

SEQ ID NO: 68968 - DNA, 25 bp, E. coli
atttcgacgacgacccgcaggcatc

SEQ ID NO: 68969 - DNA, 25 bp, E. coli
atttcgacgacgtcccgcaggcatc

SEQ ID NO: 68970 - DNA, 25 bp, E. coli
aacgagaaaatcctcgaagcgattt

SEQ ID NO: 68971 - DNA, 25 bp, E. coli
tctggaagatttggacgacgacccg

SEQ ID NO: 68972 - DNA, 25 bp, E. coli
tctggaagatttcgacgacgacccg

SEQ ID NO: 68973 - DNA, 25 bp, E. coli
gcgaaattggcgtagcactgtacga

SEQ ID NO: 68974 - DNA, 25 bp, E. coli
gatccgaaaacggttcgattcaccg

SEQ ID NO: 68975 - DNA, 25 bp, E. coli
gcgaaattggcgaagcactgtacga

SEQ ID NO: 68976 - DNA, 25 bp, E. coli
gatccgaaaacgcttcgattcaccg

SEQ ID NO: 68977 - DNA, 25 bp, E. coli
gacttaagtggagcgatagccgcga

SEQ ID NO: 68978 - DNA, 25 bp, E. coli
gacttaagtggaccgatagccgcga

SEQ ID NO: 68979 - DNA, 25 bp, E. coli
ccgatagccgcgaaattggcgaagc

SEQ ID NO: 68980 - DNA, 25 bp, E. coli
cgattcaccgatttgcatcagtgga

SEQ ID NO: 68981 - DNA, 25 bp, E. coli
ccgatagccgcgtaattggcgaagc

SEQ ID NO: 68982 - DNA, 25 bp, E. coli
cgattcaccgatatgcatcagtgga

SEQ ID NO: 68983 - DNA, 25 bp, E. coli
tgggacttaagtggaccgatagccg

SEQ ID NO: 68984 - DNA, 25 bp, E. coli
ggcgaagcactgtacgatgcgtatc

SEQ ID NO: 68985 - DNA, 25 bp, E. coli
ggcgaagcactgaacgatgcgtatc

SEQ ID NO: 68986 - DNA, 25 bp, E. coli
tgggacttaagtcgaccgatagccg

SEQ ID NO: 68987 - DNA, 25 bp, E. coli
taagtggaccgatagccgcgaaatt

SEQ ID NO: 68988 - DNA, 25 bp, E. coli
taagtggaccgaaagccgcgaaatt

SEQ ID NO: 68989 - DNA, 25 bp, E. coli
cagctgcgggcaatgcgatgcctgt

SEQ ID NO: 68990 - DNA, 25 bp, E. coli
cagctgcgggcattgcgatgcctgt

SEQ ID NO: 68991 - DNA, 25 bp, E. coli
catgtgcgcgatcgtaaagcgcgct

SEQ ID NO: 68992 - DNA, 25 bp, E. coli
catgtgcgcgatggtaaagcgcgct

SEQ ID NO: 68993 - DNA, 25 bp, E. coli
tacggcggtaatttccacaccgtcg

SEQ ID NO: 68994 - DNA, 25 bp, E. coli
tacggcggtaatatccacaccgtcg

SEQ ID NO: 68995 - DNA, 25 bp, E. coli
aaatatcgacatagaatctgccgga

SEQ ID NO: 68996 - DNA, 25 bp, E. coli
aaatatcgacattgaatctgccgga

SEQ ID NO: 68997 - DNA, 25 bp, E. coli
ttggctggacggcacgcagctgcgg

SEQ ID NO: 68998 - DNA, 25 bp, E. coli
ttggctggacgggacgcagctgcgg

SEQ ID NO: 68999 - DNA, 25 bp, E. coli
tggtcgcgtagtcgcgctcgggagt

SEQ ID NO: 69000 - DNA, 25 bp, E. coli
tgaatctgccggaccgctgttgtgc

SEQ ID NO: 69001 - DNA, 25 bp, E. coli
tgaatctgccggtccgctgttgtgc

SEQ ID NO: 69002 - DNA, 25 bp, E. coli
gcattgcgatgcgtgtattagcggt

SEQ ID NO: 69003 - DNA, 25 bp, E. coli
gcattgcgatgcctgtattagcggt

SEQ ID NO: 69004 - DNA, 25 bp, E. coli
gacattgaatctcccggaccgctgt

SEQ ID NO: 69005 - DNA, 25 bp, E. coli
gacattgaatctgccggaccgctgt

SEQ ID NO: 69006 - DNA, 25 bp, E. coli
cgcgatggtaaaccgcgctaccgcg

SEQ ID NO: 69007 - DNA, 25 bp, E. coli
cgcgatggtaaagcgcgctaccgcg

SEQ ID NO: 69008 - DNA, 25 bp, E. coli
tgacgtacggcggtaatttccacac

SEQ ID NO: 69009 - DNA, 25 bp, E. coli
tgacgtacggcgctaatttccacac

SEQ ID NO: 69010 - DNA, 25 bp, E. coli
tggtcgcgtagtggcgctcgggagt

SEQ ID NO: 69011 - DNA, 25 bp, E. coli
caactacaaagctaatggcgatggc

SEQ ID NO: 69012 - DNA, 25 bp, E. coli
caactacaaagcaaatggcgatggc

SEQ ID NO: 69013 - DNA, 25 bp, E. coli
cagtctggtgatcgtaaaggcgaaa

SEQ ID NO: 69014 - DNA, 25 bp, E. coli
cagtctggtgatggtaaaggcgaaa

SEQ ID NO: 69015 - DNA, 25 bp, E. coli
taaaggcgaaagagccgaagtttgg

SEQ ID NO: 69016 - DNA, 25 bp, E. coli
taaaaatgaaggaacaggcaactac

SEQ ID NO: 69017 - DNA, 25 bp, E. coli
taaaggcgaaagtgccgaagtttgg

SEQ ID NO: 69018 - DNA, 25 bp, E. coli
aaactctgaccgaactgattggcag

SEQ ID NO: 69019 - DNA, 25 bp, E. coli
aaactctgaccgtactgattggcag

SEQ ID NO: 69020 - DNA, 25 bp, E. coli
tatctgcaactttcactattgacgg

SEQ ID NO: 69021 - DNA, 25 bp, E. coli
tatctgcaacttacactattgacgg

SEQ ID NO: 69022 - DNA, 25 bp, E. coli
tgggcgttgtcatcaaaatatgacg

SEQ ID NO: 69023 - DNA, 25 bp, E. coli
tgggcgttgtcaacaaaatatgacg

SEQ ID NO: 69024 - DNA, 25 bp, E. coli
gctaacaatgtctatgctgctgtga

SEQ ID NO: 69025 - DNA, 25 bp, E. coli
gctggtgcttatccaaactctgacc

SEQ ID NO: 69026 - DNA, 25 bp, E. coli
gctggtgcttatgcaaactctgacc

SEQ ID NO: 69027 - DNA, 25 bp, E. coli
gctaacaatgtcaatgctgctgtga

SEQ ID NO: 69028 - DNA, 25 bp, E. coli
gacggtttctcatttgctggtgctt

SEQ ID NO: 69029 - DNA, 25 bp, E. coli
gacggtttctcaattgctggtgctt

SEQ ID NO: 69030 - DNA, 25 bp, E. coli
gcgatggccatgctttatctgcaac

SEQ ID NO: 69031 - DNA, 25 bp, E. coli
gcgatggccatggtttatctgcaac

SEQ ID NO: 69032 - DNA, 25 bp, E. coli
taaaaatgaaggtacaggcaactac

SEQ ID NO: 69033 - DNA, 25 bp, E. coli
caacgttttattctcggcagtgcca

SEQ ID NO: 69034 - DNA, 25 bp, E. coli
caacgttttattgtcggcagtgcca

SEQ ID NO: 69035 - DNA, 25 bp, E. coli
caggaattgcaggtttacgggcgaa

SEQ ID NO: 69036 - DNA, 25 bp, E. coli
caggaattgcagctttacgggcgaa

SEQ ID NO: 69037 - DNA, 25 bp, E. coli
taaatatctgctgctggagctgcct

SEQ ID NO: 69038 - DNA, 25 bp, E. coli
taaatatctgctcctggagctgcct

SEQ ID NO: 69039 - DNA, 25 bp, E. coli
tagggaatatctttgccagcgaatc

SEQ ID NO: 69040 - DNA, 25 bp, E. coli
taccgtttaagcgaccaaccagtgc

SEQ ID NO: 69041 - DNA, 25 bp, E. coli
taccgtttaagccaccaaccagtgc

SEQ ID NO: 69042 - DNA, 25 bp, E. coli
tagggaatatctatgccagcgaatc

SEQ ID NO: 69043 - DNA, 25 bp, E. coli
tgaattacccgatgttgaaaccagc

SEQ ID NO: 69044 - DNA, 25 bp, E. coli
tgaattacccgaagttgaaaccagc

SEQ ID NO: 69045 - DNA, 25 bp, E. coli
tctgcaaagtgaaggtaaaccgggc

SEQ ID NO: 69046 - DNA, 25 bp, E. coli
tctgcaaagtgatggtaaaccgggc

SEQ ID NO: 69047 - DNA, 25 bp, E. coli
gaaccgcatctccttggtgcaacca

SEQ ID NO: 69048 - DNA, 25 bp, E. coli
gaaccgcatctcgttggtgcaacca

SEQ ID NO: 69049 - DNA, 25 bp, E. coli
gattgtggcgactaaacatgcgcag

SEQ ID NO: 69050 - DNA, 25 bp, E. coli
gattgtggcgacaaaacatgcgcag

SEQ ID NO: 69051 - DNA, 25 bp, E. coli
tggccggtttcacaagagatctacc

SEQ ID NO: 69052 - DNA, 25 bp, E. coli
tggccggtttcagaagagatctacc

SEQ ID NO: 69053 - DNA, 25 bp, E. coli
gatcggctggcgacatcactgtcgc

SEQ ID NO: 69054 - DNA, 25 bp, E. coli
gatcggctggcgtcatcactgtcgc

SEQ ID NO: 69055 - DNA, 25 bp, E. coli
aataatccgcgccttagcctgctgt

SEQ ID NO: 69056 - DNA, 25 bp, E. coli
aataatccgcgcgttagcctgctgt

SEQ ID NO: 69057 - DNA, 25 bp, E. coli
cattacgacgaaaaaggcatggtgt

SEQ ID NO: 69058 - DNA, 25 bp, E. coli
tgtaccagcgtgaaaatgatgcgtg

SEQ ID NO: 69059 - DNA, 25 bp, E. coli
tgggtttcgaaggagtccagtcgca

SEQ ID NO: 69060 - DNA, 25 bp, E. coli
tgtaccagcgtgtaaatgatgcgtg

SEQ ID NO: 69061 - DNA, 25 bp, E. coli
tgggtttcgaagcagtccagtcgca

SEQ ID NO: 69062 - DNA, 25 bp, E. coli
tgaatacaccaaaggcgggttacgc

SEQ ID NO: 69063 - DNA, 25 bp, E. coli
tgaaatattttcatagccgcccgcg

SEQ ID NO: 69064 - DNA, 25 bp, E. coli
tgagcatcgcctgcatgaccgcttt

SEQ ID NO: 69065 - DNA, 25 bp, E. coli
tgagcatcgcctccatgaccgcttt

SEQ ID NO: 69066 - DNA, 25 bp, E. coli
tgaatacaccaatggcgggttacgc

SEQ ID NO: 69067 - DNA, 25 bp, E. coli
tgaaatattttcttagccgcccgcg

SEQ ID NO: 69068 - DNA, 25 bp, E. coli
gaagattgatcgacttgcaccctga

SEQ ID NO: 69069 - DNA, 25 bp, E. coli
gaagattgatcgtcttgcaccctga

SEQ ID NO: 69070 - DNA, 25 bp, E. coli
gaacgttggctcactcaggcttgtg

SEQ ID NO: 69071 - DNA, 25 bp, E. coli
gaacgttggctctctcaggcttgtg

SEQ ID NO: 69072 - DNA, 25 bp, E. coli
cattacgacgaataaggcatggtgt

SEQ ID NO: 69073 - DNA, 25 bp, E. coli
ggttttcgcgtctgccttgaacaga

SEQ ID NO: 69074 - DNA, 25 bp, E. coli
ggttttcgcgtcagccttgaacaga

SEQ ID NO: 69075 - DNA, 25 bp, E. coli
tgcccgcggtatccttgaaagtaaa

SEQ ID NO: 69076 - DNA, 25 bp, E. coli
tgcccgcggtatgcttgaaagtaaa

SEQ ID NO: 69077 - DNA, 25 bp, E. coli
tgatggcgttctttaacgtcgggcg

SEQ ID NO: 69078 - DNA, 25 bp, E. coli
tgatggcgttctataacgtcgggcg

SEQ ID NO: 69079 - DNA, 25 bp, E. coli
tgcccatttcgaacaattacgtctg

SEQ ID NO: 69080 - DNA, 25 bp, E. coli
tgcccatttcgatcaattacgtctg

SEQ ID NO: 69081 - DNA, 25 bp, E. coli
tcatggcgatccacgttgccctgct

SEQ ID NO: 69082 - DNA, 25 bp, E. coli
tcatggcgatcctcgttgccctgct

SEQ ID NO: 69083 - DNA, 25 bp, E. coli
gctggataacaacgcggcattcatt

SEQ ID NO: 69084 - DNA, 25 bp, E. coli
gctggcgcgtaaaaaactctccgaa

SEQ ID NO: 69085 - DNA, 25 bp, E. coli
gctggataacaaggcggcattcatt

SEQ ID NO: 69086 - DNA, 25 bp, E. coli
gctggcgcgtaataaactctccgaa

SEQ ID NO: 69087 - DNA, 25 bp, E. coli
gaagagctggaagagatgatccgcc

SEQ ID NO: 69088 - DNA, 25 bp, E. coli
gaagagctggaacagatgatccgcc

SEQ ID NO: 69089 - DNA, 25 bp, E. coli
ggtgaacaattaccgtctgaacgcg

SEQ ID NO: 69090 - DNA, 25 bp, E. coli
ggtcagaccaccaacaaaaagaaat

SEQ ID NO: 69091 - DNA, 25 bp, E. coli
ggtctggtgcaattaaacaacggcg

SEQ ID NO: 69092 - DNA, 25 bp, E. coli
ggtgaacaattagcgtctgaacgcg

SEQ ID NO: 69093 - DNA, 25 bp, E. coli
ggtctggtgcaaataaacaacggcg

SEQ ID NO: 69094 - DNA, 25 bp, E. coli
ggtcagaccacctacaaaaagaaat

SEQ ID NO: 69095 - DNA, 25 bp, E. coli
tggaaatcaacactcagtcgctgga

SEQ ID NO: 69096 - DNA, 25 bp, E. coli
tggaaatcaacagtcagtcgctgga

SEQ ID NO: 69097 - DNA, 25 bp, E. coli
gatccgccgtcgtgaatttggcgaa

SEQ ID NO: 69098 - DNA, 25 bp, E. coli
gatccgccgtcgagaatttggcgaa

SEQ ID NO: 69099 - DNA, 25 bp, E. coli
cagatggctcgatctggctggaagt

SEQ ID NO: 69100 - DNA, 25 bp, E. coli
cagatggctcgaactggctggaagt

SEQ ID NO: 69101 - DNA, 25 bp, E. coli
tacaccactgaagcagatggctcga

SEQ ID NO: 69102 - DNA, 25 bp, E. coli
tacaccactgaaccagatggctcga

SEQ ID NO: 69103 - DNA, 25 bp, E. coli
tatcgaccagccagtaaaatacacc

SEQ ID NO: 69104 - DNA, 25 bp, E. coli
tatcgaccagcctgtaaaatacacc

SEQ ID NO: 69105 - DNA, 25 bp, E. coli
tgataatgttccagttgggacgcgt

SEQ ID NO: 69106 - DNA, 25 bp, E. coli
tgggacgcgtgtgcaaattatcgac

SEQ ID NO: 69107 - DNA, 25 bp, E. coli
tgataatgttcctgttgggacgcgt

SEQ ID NO: 69108 - DNA, 25 bp, E. coli
tgttcctgttgggacgcgtgtgcaa

SEQ ID NO: 69109 - DNA, 25 bp, E. coli
tgggacgcgtgtccaaattatcgac

SEQ ID NO: 69110 - DNA, 25 bp, E. coli
tgttcctgttggcacgcgtgtgcaa

SEQ ID NO: 69111 - DNA, 25 bp, E. coli
tgaaccagatggctcgaactggctg

SEQ ID NO: 69112 - DNA, 25 bp, E. coli
tgaaccagatgggtcgaactggctg

SEQ ID NO: 69113 - DNA, 25 bp, E. coli
gtaaaatacacctctgaaccagatg

SEQ ID NO: 69114 - DNA, 25 bp, E. coli
gtaaaatacaccactgaaccagatg

SEQ ID NO: 69115 - DNA, 25 bp, E. coli
gtgcaaattatcgaccagccagtaa

SEQ ID NO: 69116 - DNA, 25 bp, E. coli
gtgcaaattatccaccagccagtaa

SEQ ID NO: 69117 - DNA, 25 bp, E. coli
gacgcgtgtgcaaattatcgaccag

SEQ ID NO: 69118 - DNA, 25 bp, E. coli
gaccagccagtaaaatacaccactg

SEQ ID NO: 69119 - DNA, 25 bp, E. coli
gacgcgtgtgcatattatcgaccag

SEQ ID NO: 69120 - DNA, 25 bp, E. coli
gaccagccagtataatacaccactg

SEQ ID NO: 69121 - DNA, 25 bp, E. coli
attatctttatgttcctcgcgggcc

SEQ ID NO: 69122 - DNA, 25 bp, E. coli
atctttatgatcgtcgcgggcctgg

SEQ ID NO: 69123 - DNA, 25 bp, E. coli
attatctttatgatcctcgcgggcc

SEQ ID NO: 69124 - DNA, 25 bp, E. coli
atctttatgatcctcgcgggcctgg

SEQ ID NO: 69125 - DNA, 25 bp, E. coli
tatctttatgatgctcgcgggcctg

SEQ ID NO: 69126 - DNA, 25 bp, E. coli
tatctttatgatcctcgcgggcctg

SEQ ID NO: 69127 - DNA, 25 bp, E. coli
tcgcgggcctgggaccgtatctgta

SEQ ID NO: 69128 - DNA, 25 bp, E. coli
tcgcgggcctggcaccgtatctgta

SEQ ID NO: 69129 - DNA, 25 bp, E. coli
gcctggcaccgtttctgtactttaa

SEQ ID NO: 69130 - DNA, 25 bp, E. coli
gcctggcaccgtatctgtactttaa

SEQ ID NO: 69131 - DNA, 25 bp, E. coli
gcgggcctggcagcgtatctgtact

SEQ ID NO: 69132 - DNA, 25 bp, E. coli
gcgggcctggcaccgtatctgtact

SEQ ID NO: 69133 - DNA, 25 bp, E. coli
ctttatgatcctcgcgggcctggca

SEQ ID NO: 69134 - DNA, 25 bp, E. coli
ctttatgatcctggcgggcctggca

SEQ ID NO: 69135 - DNA, 25 bp, E. coli
gattatctttatgatcctcgcgggc

SEQ ID NO: 69136 - DNA, 25 bp, E. coli
gattatctttatcatcctcgcgggc

SEQ ID NO: 69137 - DNA, 25 bp, E. coli
gggcctggcaccctatctgtacttt

SEQ ID NO: 69138 - DNA, 25 bp, E. coli
gggcctggcaccgtatctgtacttt

SEQ ID NO: 69139 - DNA, 25 bp, E. coli
tggcaccgtatctgtactttaagcg

SEQ ID NO: 69140 - DNA, 25 bp, E. coli
tggcaccgtatcagtactttaagcg

SEQ ID NO: 69141 - DNA, 25 bp, E. coli
ggcgcgattatcattatgatcctcg

SEQ ID NO: 69142 - DNA, 25 bp, E. coli
ggcgcgattatctttatgatcctcg

SEQ ID NO: 69143 - DNA, 25 bp, E. coli
cagcgtatgctgcaatggtttaagc

SEQ ID NO: 69144 - DNA, 25 bp, E. coli
cagcgtatgctggaatggtttaagc

SEQ ID NO: 69145 - DNA, 25 bp, E. coli
acgccgggcatgcattcaacgctga

SEQ ID NO: 69146 - DNA, 25 bp, E. coli
attccgcaggagagcgttgaaacca

SEQ ID NO: 69147 - DNA, 25 bp, E. coli
aatggtttaagcagtatggtgggaa

SEQ ID NO: 69148 - DNA, 25 bp, E. coli
attccgcaggagtgcgttgaaacca

SEQ ID NO: 69149 - DNA, 25 bp, E. coli
aatggtttaagctgtatggtgggaa

SEQ ID NO: 69150 - DNA, 25 bp, E. coli
acgccgggcatggattcaacgctga

SEQ ID NO: 69151 - DNA, 25 bp, E. coli
ttaagcagtatgctgggaagaagtc

SEQ ID NO: 69152 - DNA, 25 bp, E. coli
ttaagcagtatggtgggaagaagtc

SEQ ID NO: 69153 - DNA, 25 bp, E. coli
tctgcagaagatcgctggcagcgta

SEQ ID NO: 69154 - DNA, 25 bp, E. coli
tctgcagaagatggctggcagcgta

SEQ ID NO: 69155 - DNA, 25 bp, E. coli
tcatgccgcatcagcagaagatggc

SEQ ID NO: 69156 - DNA, 25 bp, E. coli
tcatgccgcatctgcagaagatggc

SEQ ID NO: 69157 - DNA, 25 bp, E. coli
gctgcgggctgcaaatgcgaaagca

SEQ ID NO: 69158 - DNA, 25 bp, E. coli
gctatcatgccgcatctgcagaaga

SEQ ID NO: 69159 - DNA, 25 bp, E. coli
gctatcatgccggatctgcagaaga

SEQ ID NO: 69160 - DNA, 25 bp, E. coli
gctgcgggctgctaatgcgaaagca

SEQ ID NO: 69161 - DNA, 25 bp, E. coli
cgggcatgcattcaacgctgattat

SEQ ID NO: 69162 - DNA, 25 bp, E. coli
cgggcatgcattgaacgctgattat

SEQ ID NO: 69163 - DNA, 25 bp, E. coli
ggagagcgttgaaaccatgcgccag

SEQ ID NO: 69164 - DNA, 25 bp, E. coli
ggagagcgttgataccatgcgccag

SEQ ID NO: 69165 - DNA, 25 bp, E. coli
cacaaaagccggtgcctgttgggtc

SEQ ID NO: 69166 - DNA, 25 bp, E. coli
cacaaaagccggagcctgttgggtc

SEQ ID NO: 69167 - DNA, 25 bp, E. coli
actcttcaaagataccagcctggtg

SEQ ID NO: 69168 - DNA, 25 bp, E. coli
actcttcaaagaaaccagcctggtg

SEQ ID NO: 69169 - DNA, 25 bp, E. coli
cctaaagggcaaaatgaagcggcag

SEQ ID NO: 69170 - DNA, 25 bp, E. coli
tcccgcctggttgggtatgtcgacg

SEQ ID NO: 69171 - DNA, 25 bp, E. coli
cctaaagggcaatatgaagcggcag

SEQ ID NO: 69172 - DNA, 25 bp, E. coli
tcccgcctggttcggtatgtcgacg

SEQ ID NO: 69173 - DNA, 25 bp, E. coli
gaagggtatgttatcgccgcgctga

SEQ ID NO: 69174 - DNA, 25 bp, E. coli
gaagggtatgttttcgccgcgctga

SEQ ID NO: 69175 - DNA, 25 bp, E. coli
gaactgggcattattgcaggctaac

SEQ ID NO: 69176 - DNA, 25 bp, E. coli
gaactgggcatttttgcaggctaac

SEQ ID NO: 69177 - DNA, 25 bp, E. coli
gattacaggcgcagcctaaagggca

SEQ ID NO: 69178 - DNA, 25 bp, E. coli
gattacaggcgctgcctaaagggca

SEQ ID NO: 69179 - DNA, 25 bp, E. coli
gggaactgatcccaccgttgctgaa

SEQ ID NO: 69180 - DNA, 25 bp, E. coli
gggaactgatccgaccgttgctgaa

SEQ ID NO: 69181 - DNA, 25 bp, E. coli
gggtcttcatcctcgaacgatttgg

SEQ ID NO: 69182 - DNA, 25 bp, E. coli
gggtcttcatccacgaacgatttgg

SEQ ID NO: 69183 - DNA, 25 bp, E. coli
ggcgggctgacggtaactttaatta

SEQ ID NO: 69184 - DNA, 25 bp, E. coli
ggcgggctgacgctaactttaatta

SEQ ID NO: 69185 - DNA, 25 bp, E. coli
taactgggttgggtcaacgcgtgcc

SEQ ID NO: 69186 - DNA, 25 bp, E. coli
taactgggttggctcaacgcgtgcc

SEQ ID NO: 69187 - DNA, 25 bp, E. coli
catttatcattcagcagcagcgtca

SEQ ID NO: 69188 - DNA, 25 bp, E. coli
catttatcattctgcagcagcgtca

SEQ ID NO: 69189 - DNA, 25 bp, E. coli
tatctcttcagggagcggatgtccg

SEQ ID NO: 69190 - DNA, 25 bp, E. coli
tatctcttcaggcagcggatgtccg

SEQ ID NO: 69191 - DNA, 25 bp, E. coli
ttttcagattaatcagacggaactg

SEQ ID NO: 69192 - DNA, 25 bp, E. coli
ttttcagattaaacagacggaactg

SEQ ID NO: 69193 - DNA, 25 bp, E. coli
tgcctttacaaataatcgccaacgg

SEQ ID NO: 69194 - DNA, 25 bp, E. coli
tgcctttacaaaaaatcgccaacgg

SEQ ID NO: 69195 - DNA, 25 bp, E. coli
ccggcgtagcggtgatgaagcattt

SEQ ID NO: 69196 - DNA, 25 bp, E. coli
ccggcgtagcggagatgaagcattt

SEQ ID NO: 69197 - DNA, 25 bp, E. coli
gcagcgtcaggaagcccttgagcaa

SEQ ID NO: 69198 - DNA, 25 bp, E. coli
gcagcgtcaggatgcccttgagcaa

SEQ ID NO: 69199 - DNA, 25 bp, E. coli
gggcgaaaggaattaatctgctgat

SEQ ID NO: 69200 - DNA, 25 bp, E. coli
gggcgaaaggaaataatctgctgat

SEQ ID NO: 69201 - DNA, 25 bp, E. coli
ggctgatgcgttaccacactggctg

SEQ ID NO: 69202 - DNA, 25 bp, E. coli
ggctgatgcgtttccacactggctg

SEQ ID NO: 69203 - DNA, 25 bp, E. coli
taattttcctgtagaaacgccctgt

SEQ ID NO: 69204 - DNA, 25 bp, E. coli
taatctgctgatcagtacattgcag

SEQ ID NO: 69205 - DNA, 25 bp, E. coli
taatctgctgatgagtacattgcag

SEQ ID NO: 69206 - DNA, 25 bp, E. coli
taattttcctgttgaaacgccctgt

SEQ ID NO: 69207 - DNA, 25 bp, E. coli
gatgttcgccttactgcacctggct

SEQ ID NO: 69208 - DNA, 25 bp, E. coli
gatgttcgcctttctgcacctggct

SEQ ID NO: 69209 - DNA, 25 bp, E. coli
ttgttctgcgtgataatagtcccgg

SEQ ID NO: 69210 - DNA, 25 bp, E. coli
ttctgcgtgttaatagtcccggcgg

SEQ ID NO: 69211 - DNA, 25 bp, E. coli
ttgttctgcgtgttaatagtcccgg

SEQ ID NO: 69212 - DNA, 25 bp, E. coli
ttctgcgtgttattagtcccggcgg

SEQ ID NO: 69213 - DNA, 25 bp, E. coli
tgttctgcgtgtaaatagtcccggc

SEQ ID NO: 69214 - DNA, 25 bp, E. coli
tgttctgcgtgttaatagtcccggc

SEQ ID NO: 69215 - DNA, 25 bp, E. coli
tgccgaaatcgaaaaaactctgacc

SEQ ID NO: 69216 - DNA, 25 bp, E. coli
tgccgaaatcgataaaactctgacc

SEQ ID NO: 69217 - DNA, 25 bp, E. coli
tctgcgtgttaatagtcccggcggc

SEQ ID NO: 69218 - DNA, 25 bp, E. coli
tctgcgtgttaaaagtcccggcggc

SEQ ID NO: 69219 - DNA, 25 bp, E. coli
gccgaaatcgaataaactctgacca

SEQ ID NO: 69220 - DNA, 25 bp, E. coli
gccgaaatcgaaaaaactctgacca

SEQ ID NO: 69221 - DNA, 25 bp, E. coli
cgagtgccgaaaacgaaaaaactct

SEQ ID NO: 69222 - DNA, 25 bp, E. coli
cgagtgccgaaatcgaaaaaactct

SEQ ID NO: 69223 - DNA, 25 bp, E. coli
gttctgcgtgttaatagtcccggcg

SEQ ID NO: 69224 - DNA, 25 bp, E. coli
gttctgcgtgtttatagtcccggcg

SEQ ID NO: 69225 - DNA, 25 bp, E. coli
gattgttctgcgtgttaatagtccc

SEQ ID NO: 69226 - DNA, 25 bp, E. coli
gattgttctgcgagttaatagtccc

SEQ ID NO: 69227 - DNA, 25 bp, E. coli
gtgccgaaatcgaaaaaactctgac

SEQ ID NO: 69228 - DNA, 25 bp, E. coli
gtgccgaaatcgtaaaaactctgac

SEQ ID NO: 69229 - DNA, 25 bp, E. coli
gagtgccgaaatggaaaaaactctg

SEQ ID NO: 69230 - DNA, 25 bp, E. coli
gagtgccgaaatcgaaaaaactctg

SEQ ID NO: 69231 - DNA, 25 bp, E. coli
tacgaggcgctggacgaaattttta

SEQ ID NO: 69232 - DNA, 25 bp, E. coli
tacgaggcgctgcacgaaattttta

SEQ ID NO: 69233 - DNA, 25 bp, E. coli
agaccgctggcaaggacttcgacag

SEQ ID NO: 69234 - DNA, 25 bp, E. coli
agaccgctggcatggacttcgacag

SEQ ID NO: 69235 - DNA, 25 bp, E. coli
ttttgacactgcagcactggccggg

SEQ ID NO: 69236 - DNA, 25 bp, E. coli
ttttgacactgctgcactggccggg

SEQ ID NO: 69237 - DNA, 25 bp, E. coli
tgtcaaaggcttcccagaccgctgg

SEQ ID NO: 69238 - DNA, 25 bp, E. coli
tgtcaaaggcttgccagaccgctgg

SEQ ID NO: 69239 - DNA, 25 bp, E. coli
gcagaacgcgccacactgaaacgta

SEQ ID NO: 69240 - DNA, 25 bp, E. coli
gcagaacgcgcctcactgaaacgta

SEQ ID NO: 69241 - DNA, 25 bp, E. coli
cgtaaaggtatttaagcgagcggct

SEQ ID NO: 69242 - DNA, 25 bp, E. coli
cgtaaaggtattaaagcgagcggct

SEQ ID NO: 69243 - DNA, 25 bp, E. coli
gatcacagctttatgatggccgccg

SEQ ID NO: 69244 - DNA, 25 bp, E. coli
gatcacagctttttgatggccgccg

SEQ ID NO: 69245 - DNA, 25 bp, E. coli
gatttaacgccaaaaccgatgcgct

SEQ ID NO: 69246 - DNA, 25 bp, E. coli
gatttaacgccataaccgatgcgct

SEQ ID NO: 69247 - DNA, 25 bp, E. coli
taacgctcaactaaccggtctgtgc

SEQ ID NO: 69248 - DNA, 25 bp, E. coli
tcaaccgctggaaacgtctgggagg

SEQ ID NO: 69249 - DNA, 25 bp, E. coli
taacgctcaacttaccggtctgtgc

SEQ ID NO: 69250 - DNA, 25 bp, E. coli
tcaaccgctggatacgtctgggagg

SEQ ID NO: 69251 - DNA, 25 bp, E. coli
gatgcgctgcttcagattgccgcca

SEQ ID NO: 69252 - DNA, 25 bp, E. coli
gatgcgctgcttgagattgccgcca

SEQ ID NO: 69253 - DNA, 25 bp, E. coli
tgatgcgtttgccaccactgacgca

SEQ ID NO: 69254 - DNA, 25 bp, E. coli
tgtaagaagtttcgtgatgttcact

SEQ ID NO: 69255 - DNA, 25 bp, E. coli
tgtaagaagtttggtgatgttcact

SEQ ID NO: 69256 - DNA, 25 bp, E. coli
tgatgttcacttagatcctgatgcg

SEQ ID NO: 69257 - DNA, 25 bp, E. coli
tgatgttcactttgatcctgatgcg

SEQ ID NO: 69258 - DNA, 25 bp, E. coli
tgagaagtgggcttcttcttttcct

SEQ ID NO: 69259 - DNA, 25 bp, E. coli
tgatgcgccattgtaagaagtttcg

SEQ ID NO: 69260 - DNA, 25 bp, E. coli
tgcgccattgtaagaagtttcgtga

SEQ ID NO: 69261 - DNA, 25 bp, E. coli
tgcgccattgtatgaagtttcgtga

SEQ ID NO: 69262 - DNA, 25 bp, E. coli
tgatgcgccattctaagaagtttcg

SEQ ID NO: 69263 - DNA, 25 bp, E. coli
tgatgcgtttgcgaccactgacgca

SEQ ID NO: 69264 - DNA, 25 bp, E. coli
tgccaccactgaggcattcatttga

SEQ ID NO: 69265 - DNA, 25 bp, E. coli
tgccgaaggtgaagcgccattgtaa

SEQ ID NO: 69266 - DNA, 25 bp, E. coli
tgccaccactgacgcattcatttga

SEQ ID NO: 69267 - DNA, 25 bp, E. coli
tgccgaaggtgatgcgccattgtaa

SEQ ID NO: 69268 - DNA, 25 bp, E. coli
cttttatgccgaaggtgatgcgcca

SEQ ID NO: 69269 - DNA, 25 bp, E. coli
cttttatgccgatggtgatgcgcca

SEQ ID NO: 69270 - DNA, 25 bp, E. coli
gatcctgatgcgattgccaccactg

SEQ ID NO: 69271 - DNA, 25 bp, E. coli
tgagaagtgggcatcttcttttcct

SEQ ID NO: 69272 - DNA, 25 bp, E. coli
ggcatcttctttaccttttatgccg

SEQ ID NO: 69273 - DNA, 25 bp, E. coli
ggcatcttcttttccttttatgccg

SEQ ID NO: 69274 - DNA, 25 bp, E. coli
gatcctgatgcgtttgccaccactg

SEQ ID NO: 69275 - DNA, 25 bp, E. coli
aattcctggtggtggcaaatgaccg

SEQ ID NO: 69276 - DNA, 25 bp, E. coli
aattcctggtggaggcaaatgaccg

SEQ ID NO: 69277 - DNA, 25 bp, E. coli
cagtgttgagctaccggttaatcca

SEQ ID NO: 69278 - DNA, 25 bp, E. coli
cagtgttgagcttccggttaatcca

SEQ ID NO: 69279 - DNA, 25 bp, E. coli
taacgagctgcggtttgaggacgcc

SEQ ID NO: 69280 - DNA, 25 bp, E. coli
acagcaaggatatgcgggtcaacta

SEQ ID NO: 69281 - DNA, 25 bp, E. coli
acagcaaggataagcgggtcaacta

SEQ ID NO: 69282 - DNA, 25 bp, E. coli
tatgcaggtcgtcgtgctgaacagc

SEQ ID NO: 69283 - DNA, 25 bp, E. coli
tatgcaggtcgtggtgctgaacagc

SEQ ID NO: 69284 - DNA, 25 bp, E. coli
gcgcattgcccgtaggaggataagt

SEQ ID NO: 69285 - DNA, 25 bp, E. coli
gccacggacaaggaagaaatctacc

SEQ ID NO: 69286 - DNA, 25 bp, E. coli
gccacggacaagcaagaaatctacc

SEQ ID NO: 69287 - DNA, 25 bp, E. coli
gcgcattgcccgaaggaggataagt

SEQ ID NO: 69288 - DNA, 25 bp, E. coli
gcacagaaaataagcggcgcgctgg

SEQ ID NO: 69289 - DNA, 25 bp, E. coli
gcacagaaaatatgcggcgcgctgg

SEQ ID NO: 69290 - DNA, 25 bp, E. coli
gaaaatcaatctaaacggcggaggc

SEQ ID NO: 69291 - DNA, 25 bp, E. coli
gaaaatcaatcttaacggcggaggc

SEQ ID NO: 69292 - DNA, 25 bp, E. coli
gatatcggccacgttactgaacgag

SEQ ID NO: 69293 - DNA, 25 bp, E. coli
gatatcggccaccttactgaacgag

SEQ ID NO: 69294 - DNA, 25 bp, E. coli
taacgagctgcgctttgaggacgcc

SEQ ID NO: 69295 - DNA, 25 bp, E. coli
gagcgacagcaatatcagtctgcgg

SEQ ID NO: 69296 - DNA, 25 bp, E. coli
gagcgacagcaaaatcagtctgcgg

SEQ ID NO: 69297 - DNA, 25 bp, E. coli
caatggcgctttgtgttctggtggc

SEQ ID NO: 69298 - DNA, 25 bp, E. coli
caatggcgctttctgttctggtggc

SEQ ID NO: 69299 - DNA, 25 bp, E. coli
catcaacacactaacgatgttcggg

SEQ ID NO: 69300 - DNA, 25 bp, E. coli
catcaacacacttacgatgttcggg

SEQ ID NO: 69301 - DNA, 25 bp, E. coli
accattgcggtagccgtggtgttgt

SEQ ID NO: 69302 - DNA, 25 bp, E. coli
accattgcggtacccgtggtgttgt

SEQ ID NO: 69303 - DNA, 25 bp, E. coli
tatcaccatcgtttcggcaatggcg

SEQ ID NO: 69304 - DNA, 25 bp, E. coli
tatcaccatcgtatcggcaatggcg

SEQ ID NO: 69305 - DNA, 25 bp, E. coli
ttaaccactacaccaacagcgtcgg

SEQ ID NO: 69306 - DNA, 25 bp, E. coli
ttaaccactacagcaacagcgtcgg

SEQ ID NO: 69307 - DNA, 25 bp, E. coli
tggtgcttgccaacgggctgctcgt

SEQ ID NO: 69308 - DNA, 25 bp, E. coli
tgatgatggaggataagctcccgcc

SEQ ID NO: 69309 - DNA, 25 bp, E. coli
tgatgatggaggttaagctcccgcc

SEQ ID NO: 69310 - DNA, 25 bp, E. coli
gctgctcgtcgaagatgcgatagtg

SEQ ID NO: 69311 - DNA, 25 bp, E. coli
gctgctcgtcgatgatgcgatagtg

SEQ ID NO: 69312 - DNA, 25 bp, E. coli
gaatatgcgagctacgctgatcccc

SEQ ID NO: 69313 - DNA, 25 bp, E. coli
gaatatgcgagcaacgctgatcccc

SEQ ID NO: 69314 - DNA, 25 bp, E. coli
ggtggcattgatacttacccctgcg

SEQ ID NO: 69315 - DNA, 25 bp, E. coli
ggtggcattgattcttacccctgcg

SEQ ID NO: 69316 - DNA, 25 bp, E. coli
tggtgcttgccatcgggctgctcgt

SEQ ID NO: 69317 - DNA, 25 bp, E. coli
taagctcccgccaaaagaagcgacg

SEQ ID NO: 69318 - DNA, 25 bp, E. coli
taagctcccgcctaaagaagcgacg

SEQ ID NO: 69319 - DNA, 25 bp, E. coli
cacggccagggctttatgattcagt

SEQ ID NO: 69320 - DNA, 25 bp, E. coli
cacggccagggcattatgattcagt

SEQ ID NO: 69321 - DNA, 25 bp, E. coli
catgccattttttctcgaacgggca

SEQ ID NO: 69322 - DNA, 25 bp, E. coli
catgccatttttactcgaacgggca

SEQ ID NO: 69323 - DNA, 25 bp, E. coli
tacgtgatggatacacggccagggc

SEQ ID NO: 69324 - DNA, 25 bp, E. coli
tacgtgatggattcacggccagggc

SEQ ID NO: 69325 - DNA, 25 bp, E. coli
tcgcttgatttccaactggaatacg

SEQ ID NO: 69326 - DNA, 25 bp, E. coli
tcgcttgatttcgaactggaatacg

SEQ ID NO: 69327 - DNA, 25 bp, E. coli
tcttgggcgcgaaaatagcgagctg

SEQ ID NO: 69328 - DNA, 25 bp, E. coli
tcttgggcgcgataatagcgagctg

SEQ ID NO: 69329 - DNA, 25 bp, E. coli
gcctcctcgcttgatttcgaactgg

SEQ ID NO: 69330 - DNA, 25 bp, E. coli
gccagggctttaagattcagtgctg

SEQ ID NO: 69331 - DNA, 25 bp, E. coli
gccatttttactggaacgggcaacg

SEQ ID NO: 69332 - DNA, 25 bp, E. coli
gcctcctcgcttcatttcgaactgg

SEQ ID NO: 69333 - DNA, 25 bp, E. coli
gccagggctttatgattcagtgctg

SEQ ID NO: 69334 - DNA, 25 bp, E. coli
gccatttttactcgaacgggcaacg

SEQ ID NO: 69335 - DNA, 25 bp, E. coli
gacaccccgcaagggacagaagtct

SEQ ID NO: 69336 - DNA, 25 bp, E. coli
gacaccccgcaacggacagaagtct

SEQ ID NO: 69337 - DNA, 25 bp, E. coli
tggcgacgcctcctcgcttgatttc

SEQ ID NO: 69338 - DNA, 25 bp, E. coli
tggattcacggcgagggctttatga

SEQ ID NO: 69339 - DNA, 25 bp, E. coli
tggcgacgcctcgtcgcttgatttc

SEQ ID NO: 69340 - DNA, 25 bp, E. coli
tggattcacggccagggctttatga

SEQ ID NO: 69341 - DNA, 25 bp, E. coli
caaacggtttcgtcagcgcatcaga

SEQ ID NO: 69342 - DNA, 25 bp, E. coli
caaacggtttcgacagcgcatcaga

SEQ ID NO: 69343 - DNA, 25 bp, E. coli
aaaggtttactcataaatgagcggc

SEQ ID NO: 69344 - DNA, 25 bp, E. coli
aaaggtttactcttaaatgagcggc

SEQ ID NO: 69345 - DNA, 25 bp, E. coli
ttattacagccaatggcggcacgcg

SEQ ID NO: 69346 - DNA, 25 bp, E. coli
ttattacagccattggcggcacgcg

SEQ ID NO: 69347 - DNA, 25 bp, E. coli
tgggtacaccgaaagcttagaagac

SEQ ID NO: 69348 - DNA, 25 bp, E. coli
tgggtacaccgatagcttagaagac

SEQ ID NO: 69349 - DNA, 25 bp, E. coli
tgcgccagatggcaacttattacag

SEQ ID NO: 69350 - DNA, 25 bp, E. coli
tgcgccagatgggaacttattacag

SEQ ID NO: 69351 - DNA, 25 bp, E. coli
tgcgcgtcccagcttgaaaaaacgt

SEQ ID NO: 69352 - DNA, 25 bp, E. coli
tgcgcgtcccaggttgaaaaaacgt

SEQ ID NO: 69353 - DNA, 25 bp, E. coli
tcagattctttataatgacgcccgt

SEQ ID NO: 69354 - DNA, 25 bp, E. coli
tcagattctttaaaatgacgcccgt

SEQ ID NO: 69355 - DNA, 25 bp, E. coli
gcattttgcgtatacctgcgccaga

SEQ ID NO: 69356 - DNA, 25 bp, E. coli
gcggcacgcgttgctaattcacgat

SEQ ID NO: 69357 - DNA, 25 bp, E. coli
gcattttgcgtaaacctgcgccaga

SEQ ID NO: 69358 - DNA, 25 bp, E. coli
gcggcacgcgttcctaattcacgat

SEQ ID NO: 69359 - DNA, 25 bp, E. coli
ggtgattttatttccacgcaaacgg

SEQ ID NO: 69360 - DNA, 25 bp, E. coli
ggtgattttattaccacgcaaacgg

SEQ ID NO: 69361 - DNA, 25 bp, E. coli
taattctctgtgtcgtgcgcgtccc

SEQ ID NO: 69362 - DNA, 25 bp, E. coli
taattctctgtgacgtgcgcgtccc

SEQ ID NO: 69363 - DNA, 25 bp, E. coli
caacgtttggagcaaaatggccgaa

SEQ ID NO: 69364 - DNA, 25 bp, E. coli
cagcagcccattgtccgaggtcgat

SEQ ID NO: 69365 - DNA, 25 bp, E. coli
caacgtttggaggaaaatggccgaa

SEQ ID NO: 69366 - DNA, 25 bp, E. coli
cagcagcccattctccgaggtcgat

SEQ ID NO: 69367 - DNA, 25 bp, E. coli
ttggagcaaaatcgccgaaacgggc

SEQ ID NO: 69368 - DNA, 25 bp, E. coli
ttggagcaaaatggccgaaacgggc

SEQ ID NO: 69369 - DNA, 25 bp, E. coli
tccgaggtcgatgagctgacaacgt

SEQ ID NO: 69370 - DNA, 25 bp, E. coli
tccgaggtcgatcagctgacaacgt

SEQ ID NO: 69371 - DNA, 25 bp, E. coli
gccgaaacgggcagatttcacccca

SEQ ID NO: 69372 - DNA, 25 bp, E. coli
gccgaaacgggctgatttcacccca

SEQ ID NO: 69373 - DNA, 25 bp, E. coli
cgcaggttgggctattcaccgtaat

SEQ ID NO: 69374 - DNA, 25 bp, E. coli
cgcaggttgggcaattcaccgtaat

SEQ ID NO: 69375 - DNA, 25 bp, E. coli
cattctccgaggacgatcagctgac

SEQ ID NO: 69376 - DNA, 25 bp, E. coli
cattctccgaggtcgatcagctgac

SEQ ID NO: 69377 - DNA, 25 bp, E. coli
gttttcccgcagcttgggcaattca

SEQ ID NO: 69378 - DNA, 25 bp, E. coli
gatcagctgacatcgtttggagcaa

SEQ ID NO: 69379 - DNA, 25 bp, E. coli
gatcagctgacaacgtttggagcaa

SEQ ID NO: 69380 - DNA, 25 bp, E. coli
gttttcccgcaggttgggcaattca

SEQ ID NO: 69381 - DNA, 25 bp, E. coli
ggattcgtttttgttcagcagccca

SEQ ID NO: 69382 - DNA, 25 bp, E. coli
ggattcgtttttcttcagcagccca

SEQ ID NO: 69383 - DNA, 25 bp, E. coli
ggcaattcaccgtaatagtttctga

SEQ ID NO: 69384 - DNA, 25 bp, E. coli
ggcaattcaccgaaatagtttctga

SEQ ID NO: 69385 - DNA, 25 bp, E. coli
taaagactcaagtaaacttatcgga

SEQ ID NO: 69386 - DNA, 25 bp, E. coli
taaagactcaagaaaacttatcgga

SEQ ID NO: 69387 - DNA, 25 bp, E. coli
acttatcggaaaaaaggaccacgca

SEQ ID NO: 69388 - DNA, 25 bp, E. coli
acttatcggaaataaggaccacgca

SEQ ID NO: 69389 - DNA, 25 bp, E. coli
ttacgggggctatcatcgccgatgg

SEQ ID NO: 69390 - DNA, 25 bp, E. coli
ttacgggggctaacatcgccgatgg

SEQ ID NO: 69391 - DNA, 25 bp, E. coli
tgaaaaaagccctcacaggggagag

SEQ ID NO: 69392 - DNA, 25 bp, E. coli
tgaaaaaagcccacacaggggagag

SEQ ID NO: 69393 - DNA, 25 bp, E. coli
tcggaaataaggaccacgcattacg

SEQ ID NO: 69394 - DNA, 25 bp, E. coli
tcggcaaatcagcttgattacgtag

SEQ ID NO: 69395 - DNA, 25 bp, E. coli
tcggcaaatcaggttgattacgtag

SEQ ID NO: 69396 - DNA, 25 bp, E. coli
tcggaaataaggtccacgcattacg

SEQ ID NO: 69397 - DNA, 25 bp, E. coli
ctgaaatgggaagctaaagactcaa

SEQ ID NO: 69398 - DNA, 25 bp, E. coli
ctgaaatgggaacctaaagactcaa

SEQ ID NO: 69399 - DNA, 25 bp, E. coli
ggaaataaggaccacgcattacggg

SEQ ID NO: 69400 - DNA, 25 bp, E. coli
ggaaataaggacgacgcattacggg

SEQ ID NO: 69401 - DNA, 25 bp, E. coli
tgggaagctaaacactcaagtaaac

SEQ ID NO: 69402 - DNA, 25 bp, E. coli
tgggaagctaaagactcaagtaaac

SEQ ID NO: 69403 - DNA, 25 bp, E. coli
taaggaccacgcattacgggggcta

SEQ ID NO: 69404 - DNA, 25 bp, E. coli
taaggaccacgctttacgggggcta

SEQ ID NO: 69405 - DNA, 25 bp, E. coli
gattcggcaaatcaggttgattacg

SEQ ID NO: 69406 - DNA, 25 bp, E. coli
gattcggcaaatgaggttgattacg

SEQ ID NO: 69407 - DNA, 25 bp, E. coli
catccactatctagctcgtaggtga

SEQ ID NO: 69408 - DNA, 25 bp, E. coli
catccactatcttgctcgtaggtga

SEQ ID NO: 69409 - DNA, 25 bp, E. coli
taccgaggacaattatcatccgcga

SEQ ID NO: 69410 - DNA, 25 bp, E. coli
taccgaggacaaatatcatccgcga

SEQ ID NO: 69411 - DNA, 25 bp, E. coli
tcgtaggtgagctgcactggcgcaa

SEQ ID NO: 69412 - DNA, 25 bp, E. coli
tcatccgcgatgacgagaagcaaca

SEQ ID NO: 69413 - DNA, 25 bp, E. coli
tcatccgcgatgtcgagaagcaaca

SEQ ID NO: 69414 - DNA, 25 bp, E. coli
tctgccaaagctagcgctatgcgcg

SEQ ID NO: 69415 - DNA, 25 bp, E. coli
tcaggcgtgttcaactaccgaggac

SEQ ID NO: 69416 - DNA, 25 bp, E. coli
tcgtaggtgagcagcactggcgcaa

SEQ ID NO: 69417 - DNA, 25 bp, E. coli
tctgccaaagcttgcgctatgcgcg

SEQ ID NO: 69418 - DNA, 25 bp, E. coli
tcaggcgtgttctactaccgaggac

SEQ ID NO: 69419 - DNA, 25 bp, E. coli
ggcgcaacgcgcattagtcctttct

SEQ ID NO: 69420 - DNA, 25 bp, E. coli
ggcgcaacgcgctttagtcctttct

SEQ ID NO: 69421 - DNA, 25 bp, E. coli
taagctatgatacaaatcaggcgtg

SEQ ID NO: 69422 - DNA, 25 bp, E. coli
taacgaaaatcaaaccgctcaggta

SEQ ID NO: 69423 - DNA, 25 bp, E. coli
taataatgtctttttcgctccgtca

SEQ ID NO: 69424 - DNA, 25 bp, E. coli
taagctatgatagaaatcaggcgtg

SEQ ID NO: 69425 - DNA, 25 bp, E. coli
taataatgtcttattcgctccgtca

SEQ ID NO: 69426 - DNA, 25 bp, E. coli
taacgaaaatcataccgctcaggta

SEQ ID NO: 69427 - DNA, 25 bp, E. coli
gagaagcaacacagcggataattgt

SEQ ID NO: 69428 - DNA, 25 bp, E. coli
gagaagcaacactgcggataattgt

SEQ ID NO: 69429 - DNA, 25 bp, E. coli
caaatcccgggtcaactgtacgccg

SEQ ID NO: 69430 - DNA, 25 bp, E. coli
caaaatgagcgcaccgaaagtggtc

SEQ ID NO: 69431 - DNA, 25 bp, E. coli
caaatcccgggtgaactgtacgccg

SEQ ID NO: 69432 - DNA, 25 bp, E. coli
caaaatgagcgctccgaaagtggtc

SEQ ID NO: 69433 - DNA, 25 bp, E. coli
ttaaagggcggaaccgtcagatgca

SEQ ID NO: 69434 - DNA, 25 bp, E. coli
ttaaagggcggatccgtcagatgca

SEQ ID NO: 69435 - DNA, 25 bp, E. coli
aaaccatcctggttggcagcgtgac

SEQ ID NO: 69436 - DNA, 25 bp, E. coli
aaaccatcctggatggcagcgtgac

SEQ ID NO: 69437 - DNA, 25 bp, E. coli
tgctgatcagagaagccatgctggc

SEQ ID NO: 69438 - DNA, 25 bp, E. coli
tgctgatcagagtagccatgctggc

SEQ ID NO: 69439 - DNA, 25 bp, E. coli
tcgcgctgcgcattcgtgaaattgg

SEQ ID NO: 69440 - DNA, 25 bp, E. coli
tcgcgctgcgcaatcgtgaaattgg

SEQ ID NO: 69441 - DNA, 25 bp, E. coli
tctgacgagagcgacgacaaaacag

SEQ ID NO: 69442 - DNA, 25 bp, E. coli
tctgacgagagccacgacaaaacag

SEQ ID NO: 69443 - DNA, 25 bp, E. coli
tctggcaactgaaacgctggcgtct

SEQ ID NO: 69444 - DNA, 25 bp, E. coli
tctggcaactgatacgctggcgtct

SEQ ID NO: 69445 - DNA, 25 bp, E. coli
gccgatgtgccgaaagcggatgtca

SEQ ID NO: 69446 - DNA, 25 bp, E. coli
gccgatgtgccgtaagcggatgtca

SEQ ID NO: 69447 - DNA, 25 bp, E. coli
cgagtctccgattaccgccatgggt

SEQ ID NO: 69448 - DNA, 25 bp, E. coli
cgagtctccgataaccgccatgggt

SEQ ID NO: 69449 - DNA, 25 bp, E. coli
cattccaatggtgggatttgacgtc

SEQ ID NO: 69450 - DNA, 25 bp, E. coli
cattccaatggtcggatttgacgtc

SEQ ID NO: 69451 - DNA, 25 bp, E. coli
caaatactggatacattgtgcacat

SEQ ID NO: 69452 - DNA, 25 bp, E. coli
caaatactggattcattgtgcacat

SEQ ID NO: 69453 - DNA, 25 bp, E. coli
agtgcaaatactggattcattgtgc

SEQ ID NO: 69454 - DNA, 25 bp, E. coli
agtgcaaatactcgattcattgtgc

SEQ ID NO: 69455 - DNA, 25 bp, E. coli
aaaaccgtcagattaagtgcaaata

SEQ ID NO: 69456 - DNA, 25 bp, E. coli
aaaaccgtcagaataagtgcaaata

SEQ ID NO: 69457 - DNA, 25 bp, E. coli
tatcgaccggattacagttgcctgg

SEQ ID NO: 69458 - DNA, 25 bp, E. coli
tatcgaccggataacagttgcctgg

SEQ ID NO: 69459 - DNA, 25 bp, E. coli
ccatacattcctccattgttctgtg

SEQ ID NO: 69460 - DNA, 25 bp, E. coli
ccatacattcctgcattgttctgtg

SEQ ID NO: 69461 - DNA, 25 bp, E. coli
gctgctgccatacattcctgcattg

SEQ ID NO: 69462 - DNA, 25 bp, E. coli
gctgctgccatagattcctgcattg

SEQ ID NO: 69463 - DNA, 25 bp, E. coli
cgtcagaataagtgcaaatactgga

SEQ ID NO: 69464 - DNA, 25 bp, E. coli
ctgttcggttgctgctgccatacat

SEQ ID NO: 69465 - DNA, 25 bp, E. coli
cgtcagaataagagcaaatactgga

SEQ ID NO: 69466 - DNA, 25 bp, E. coli
ctgttcggttgcagctgccatacat

SEQ ID NO: 69467 - DNA, 25 bp, E. coli
gataacagttgcctggaattttctg

SEQ ID NO: 69468 - DNA, 25 bp, E. coli
gataacagttgcgtggaattttctg

SEQ ID NO: 69469 - DNA, 25 bp, E. coli
ggttgctgctgccatacattcctgc

SEQ ID NO: 69470 - DNA, 25 bp, E. coli
ggttgctgctgcgatacattcctgc

SEQ ID NO: 69471 - DNA, 25 bp, E. coli
gaccggataacacttgcctggaatt

SEQ ID NO: 69472 - DNA, 25 bp, E. coli
gaccggataacagttgcctggaatt

SEQ ID NO: 69473 - DNA, 25 bp, E. coli
atcctgaacgttgtcgggctgcccg

SEQ ID NO: 69474 - DNA, 25 bp, E. coli
accggatcctgaacgttgtcgggct

SEQ ID NO: 69475 - DNA, 25 bp, E. coli
accggatcctgatcgttgtcgggct

SEQ ID NO: 69476 - DNA, 25 bp, E. coli
atcctgaacgttctcgggctgcccg

SEQ ID NO: 69477 - DNA, 25 bp, E. coli
tgaccggatcctgaacgttgtcggg

SEQ ID NO: 69478 - DNA, 25 bp, E. coli
tgaccggatcctcaacgttgtcggg

SEQ ID NO: 69479 - DNA, 25 bp, E. coli
gcgtgaccggatcctgaacgttgtc

SEQ ID NO: 69480 - DNA, 25 bp, E. coli
gcgtgaccggatgctgaacgttgtc

SEQ ID NO: 69481 - DNA, 25 bp, E. coli
cgtgaccggatcctgaacgttgtcg

SEQ ID NO: 69482 - DNA, 25 bp, E. coli
cggatcctgaacgttgtcgggctgc

SEQ ID NO: 69483 - DNA, 25 bp, E. coli
cggatcctgaaccttgtcgggctgc

SEQ ID NO: 69484 - DNA, 25 bp, E. coli
cgtgaccggatcgtgaacgttgtcg

SEQ ID NO: 69485 - DNA, 25 bp, E. coli
ggatcctgaacgttgtcgggctgcc

SEQ ID NO: 69486 - DNA, 25 bp, E. coli
ggatcctgaacgatgtcgggctgcc

SEQ ID NO: 69487 - DNA, 25 bp, E. coli
ggcgtgaccggatcctgaacgttgt

SEQ ID NO: 69488 - DNA, 25 bp, E. coli
ggcgtgaccggaacctgaacgttgt

SEQ ID NO: 69489 - DNA, 25 bp, E. coli
tggcgtgaccggatcctgaacgttg

SEQ ID NO: 69490 - DNA, 25 bp, E. coli
tggcgtgaccggttcctgaacgttg

SEQ ID NO: 69491 - DNA, 25 bp, E. coli
gaccggatcctgaacgttgtcgggc

SEQ ID NO: 69492 - DNA, 25 bp, E. coli
gaccggatcctgtacgttgtcgggc

SEQ ID NO: 69493 - DNA, 25 bp, E. coli
gatcctgaacgtagtcgggctgccc

SEQ ID NO: 69494 - DNA, 25 bp, E. coli
gatcctgaacgttgtcgggctgccc

SEQ ID NO: 69495 - DNA, 25 bp, E. coli
taaaatcgccttagtggagcagtca

SEQ ID NO: 69496 - DNA, 25 bp, E. coli
taaatacaccgtccgacagtctgtg

SEQ ID NO: 69497 - DNA, 25 bp, E. coli
taaaatcgcctttgtggagcagtca

SEQ ID NO: 69498 - DNA, 25 bp, E. coli
taaatacaccgtgcgacagtctgtg

SEQ ID NO: 69499 - DNA, 25 bp, E. coli
tccgcgaaataaaagggagcagcca

SEQ ID NO: 69500 - DNA, 25 bp, E. coli
tccgcgaaataatagggagcagcca

SEQ ID NO: 69501 - DNA, 25 bp, E. coli
gcttaaaggtaatctgacgccggcg

SEQ ID NO: 69502 - DNA, 25 bp, E. coli
gcttaaaggtaaactgacgccggcg

SEQ ID NO: 69503 - DNA, 25 bp, E. coli
gaacttgatgcctgcctttacggac

SEQ ID NO: 69504 - DNA, 25 bp, E. coli
gaaagcaccgttatatccgaagccc

SEQ ID NO: 69505 - DNA, 25 bp, E. coli
gaacttgatgccagcctttacggac

SEQ ID NO: 69506 - DNA, 25 bp, E. coli
gacgccggcgtttttacagacactt

SEQ ID NO: 69507 - DNA, 25 bp, E. coli
gacgccggcgttattacagacactt

SEQ ID NO: 69508 - DNA, 25 bp, E. coli
gaaagcaccgttttatccgaagccc

SEQ ID NO: 69509 - DNA, 25 bp, E. coli
gaaacaccggacgtggatcactgaa

SEQ ID NO: 69510 - DNA, 25 bp, E. coli
gaaacaccggacctggatcactgaa

SEQ ID NO: 69511 - DNA, 25 bp, E. coli
gataacctgctcttcaactggcgcc

SEQ ID NO: 69512 - DNA, 25 bp, E. coli
gataacctgctcatcaactggcgcc

SEQ ID NO: 69513 - DNA, 25 bp, E. coli
ggcctgctgcctaccggaaaaaata

SEQ ID NO: 69514 - DNA, 25 bp, E. coli
ggcctgctgccttccggaaaaaata

SEQ ID NO: 69515 - DNA, 25 bp, E. coli
tcaataccggaatggtggcctgctg

SEQ ID NO: 69516 - DNA, 25 bp, E. coli
tcaataccggaaaggtggcctgctg

SEQ ID NO: 69517 - DNA, 25 bp, E. coli
aatcattggcctcccctgagagcgg

SEQ ID NO: 69518 - DNA, 25 bp, E. coli
caactgaatcattggcctgccctga

SEQ ID NO: 69519 - DNA, 25 bp, E. coli
aatcattggcctgccctgagagcgg

SEQ ID NO: 69520 - DNA, 25 bp, E. coli
caaaatcccagtaaatgtaacaaca

SEQ ID NO: 69521 - DNA, 25 bp, E. coli
caactgaatcataggcctgccctga

SEQ ID NO: 69522 - DNA, 25 bp, E. coli
caaaatcccagttaatgtaacaaca

SEQ ID NO: 69523 - DNA, 25 bp, E. coli
ttgccaacaaaaacccagtaaatgt

SEQ ID NO: 69524 - DNA, 25 bp, E. coli
ttgccaacaaaatcccagtaaatgt

SEQ ID NO: 69525 - DNA, 25 bp, E. coli
attaaattcatttgcggcactccag

SEQ ID NO: 69526 - DNA, 25 bp, E. coli
attggcctgccctgagagcggaaaa

SEQ ID NO: 69527 - DNA, 25 bp, E. coli
attggcctgcccagagagcggaaaa

SEQ ID NO: 69528 - DNA, 25 bp, E. coli
attaaattcattagcggcactccag

SEQ ID NO: 69529 - DNA, 25 bp, E. coli
tgtaacaacaactgaatcattggcc

SEQ ID NO: 69530 - DNA, 25 bp, E. coli
tgtaacaacaacagaatcattggcc

SEQ ID NO: 69531 - DNA, 25 bp, E. coli
gccctgagagcggaaaagcaaaaaa

SEQ ID NO: 69532 - DNA, 25 bp, E. coli
gccctgagagcgcaaaagcaaaaaa

SEQ ID NO: 69533 - DNA, 25 bp, E. coli
cctgccctgagagcggaaaagcaaa

SEQ ID NO: 69534 - DNA, 25 bp, E. coli
cctgccctgagaccggaaaagcaaa

SEQ ID NO: 69535 - DNA, 25 bp, E. coli
gctttttgccaagaaaatcccagta

SEQ ID NO: 69536 - DNA, 25 bp, E. coli
gctttttgccaacaaaatcccagta

SEQ ID NO: 69537 - DNA, 25 bp, E. coli
gaatattaaattcattagcggcact

SEQ ID NO: 69538 - DNA, 25 bp, E. coli
gaatattaaattgattagcggcact

SEQ ID NO: 69539 - DNA, 25 bp, E. coli
agttgccatccggtaaaataacatc

SEQ ID NO: 69540 - DNA, 25 bp, E. coli
agttgccatccgctaaaataacatc

SEQ ID NO: 69541 - DNA, 25 bp, E. coli
tattaacccttcaggaacgctcaga

SEQ ID NO: 69542 - DNA, 25 bp, E. coli
tattaacccttctggaacgctcaga

SEQ ID NO: 69543 - DNA, 25 bp, E. coli
tttattaacccttcaggaacgctca

SEQ ID NO: 69544 - DNA, 25 bp, E. coli
tttattaaccctacaggaacgctca

SEQ ID NO: 69545 - DNA, 25 bp, E. coli
tgaaataccggatggcgagttgcca

SEQ ID NO: 69546 - DNA, 25 bp, E. coli
tgaaataccggaaggcgagttgcca

SEQ ID NO: 69547 - DNA, 25 bp, E. coli
tctaagcgtgaattaccggatggcg

SEQ ID NO: 69548 - DNA, 25 bp, E. coli
tctaagcgtgaaataccggatggcg

SEQ ID NO: 69549 - DNA, 25 bp, E. coli
tcccatctaagaaattaaccctttc

SEQ ID NO: 69550 - DNA, 25 bp, E. coli
tcccatctaagatattaaccctttc

SEQ ID NO: 69551 - DNA, 25 bp, E. coli
cgtgaaataccgcatggcgagttgc

SEQ ID NO: 69552 - DNA, 25 bp, E. coli
cgtgaaataccggatggcgagttgc

SEQ ID NO: 69553 - DNA, 25 bp, E. coli
ggtaaaataacatcccatctaagat

SEQ ID NO: 69554 - DNA, 25 bp, E. coli
ggtaaaataacaacccatctaagat

SEQ ID NO: 69555 - DNA, 25 bp, E. coli
ggcgagttgccaaccggtaaaataa

SEQ ID NO: 69556 - DNA, 25 bp, E. coli
ggcgagttgccatccggtaaaataa

SEQ ID NO: 69557 - DNA, 25 bp, E. coli
taagcgtgaaataccggatggcgag

SEQ ID NO: 69558 - DNA, 25 bp, E. coli
taacccttcaggaacgctcagattg

SEQ ID NO: 69559 - DNA, 25 bp, E. coli
taacccttcaggtacgctcagattg

SEQ ID NO: 69560 - DNA, 25 bp, E. coli
taagcgtgaaattccggatggcgag

SEQ ID NO: 69561 - DNA, 25 bp, E. coli
caaccgatgatgatccgcgagaaca

SEQ ID NO: 69562 - DNA, 25 bp, E. coli
caaccgatgatgttccgcgagaaca

SEQ ID NO: 69563 - DNA, 25 bp, E. coli
cacgcttgcgcatgccgtgcgggcg

SEQ ID NO: 69564 - DNA, 25 bp, E. coli
cacgcttgcgcaagccgtgcgggcg

SEQ ID NO: 69565 - DNA, 25 bp, E. coli
aggatcccacgcatgcgcaagccgt

SEQ ID NO: 69566 - DNA, 25 bp, E. coli
accgatgatgatgcgcgagaacaaa

SEQ ID NO: 69567 - DNA, 25 bp, E. coli
aggatcccacgcttgcgcaagccgt

SEQ ID NO: 69568 - DNA, 25 bp, E. coli
accgatgatgatccgcgagaacaaa

SEQ ID NO: 69569 - DNA, 25 bp, E. coli
accaaccgatgaagatccgcgagaa

SEQ ID NO: 69570 - DNA, 25 bp, E. coli
accaaccgatgatgatccgcgagaa

SEQ ID NO: 69571 - DNA, 25 bp, E. coli
aaacgctcacgaacggtgaagataa

SEQ ID NO: 69572 - DNA, 25 bp, E. coli
aaacgctcacgatcggtgaagataa

SEQ ID NO: 69573 - DNA, 25 bp, E. coli
tttgagaaaacgctcacgaacggtg

SEQ ID NO: 69574 - DNA, 25 bp, E. coli
tttgagaaaacggtcacgaacggtg

SEQ ID NO: 69575 - DNA, 25 bp, E. coli
tgagaaaacgctgacgaacggtgaa

SEQ ID NO: 69576 - DNA, 25 bp, E. coli
tgagaaaacgctcacgaacggtgaa

SEQ ID NO: 69577 - DNA, 25 bp, E. coli
gaaaacgctcacgaacggtgaagat

SEQ ID NO: 69578 - DNA, 25 bp, E. coli
gaaaacgctcaccaacggtgaagat

SEQ ID NO: 69579 - DNA, 25 bp, E. coli
cgctcacgaacggtgaagataatcc

SEQ ID NO: 69580 - DNA, 25 bp, E. coli
cgctcacgaacgctgaagataatcc

SEQ ID NO: 69581 - DNA, 25 bp, E. coli
ggatcccacgcttgcgcaagccgtg

SEQ ID NO: 69582 - DNA, 25 bp, E. coli
ggatcccacgctagcgcaagccgtg

SEQ ID NO: 69583 - DNA, 25 bp, E. coli
cacggaataaaaagtgatcgtcagg

SEQ ID NO: 69584 - DNA, 25 bp, E. coli
cacggaataaaatgtgatcgtcagg

SEQ ID NO: 69585 - DNA, 25 bp, E. coli
taaagggatggcgttgttcttgaag

SEQ ID NO: 69586 - DNA, 25 bp, E. coli
taaaatggcatagcgggatatgccg

SEQ ID NO: 69587 - DNA, 25 bp, E. coli
taaatgttttatagcaatcggttgc

SEQ ID NO: 69588 - DNA, 25 bp, E. coli
taaaatggcataccgggatatgccg

SEQ ID NO: 69589 - DNA, 25 bp, E. coli
taaagggatggccttgttcttgaag

SEQ ID NO: 69590 - DNA, 25 bp, E. coli
taaatgttttattgcaatcggttgc

SEQ ID NO: 69591 - DNA, 25 bp, E. coli
cgagcgggcgatattaggtgatttt

SEQ ID NO: 69592 - DNA, 25 bp, E. coli
cgagcgggcgattttaggtgatttt

SEQ ID NO: 69593 - DNA, 25 bp, E. coli
ctgctctgtttgttaaggaaatctc

SEQ ID NO: 69594 - DNA, 25 bp, E. coli
ctgctctgtttgataaggaaatctc

SEQ ID NO: 69595 - DNA, 25 bp, E. coli
gatatgccgcgaccgggcgatttta

SEQ ID NO: 69596 - DNA, 25 bp, E. coli
gatatgccgcgagcgggcgatttta

SEQ ID NO: 69597 - DNA, 25 bp, E. coli
tggcctgcgttcaaaaataaaatgg

SEQ ID NO: 69598 - DNA, 25 bp, E. coli
ggctatttagaatctcttcacttgc

SEQ ID NO: 69599 - DNA, 25 bp, E. coli
tggcctgcgttctaaaataaaatgg

SEQ ID NO: 69600 - DNA, 25 bp, E. coli
ggctatttagaaactcttcacttgc

SEQ ID NO: 69601 - DNA, 25 bp, E. coli
taagaggtgattatgatcacggaat

SEQ ID NO: 69602 - DNA, 25 bp, E. coli
taagaggtgattttgatcacggaat

SEQ ID NO: 69603 - DNA, 25 bp, E. coli
gatcgtcaggtttcatatatttcag

SEQ ID NO: 69604 - DNA, 25 bp, E. coli
gatcgtcaggttacatatatttcag

SEQ ID NO: 69605 - DNA, 25 bp, E. coli
cactggtgtttgtatcgtaccgtcc

SEQ ID NO: 69606 - DNA, 25 bp, E. coli
cactggtgtttgaatcgtaccgtcc

SEQ ID NO: 69607 - DNA, 25 bp, E. coli
cagtcactggtgattgtatcgtacc

SEQ ID NO: 69608 - DNA, 25 bp, E. coli
cagtcactggtgtttgtatcgtacc

SEQ ID NO: 69609 - DNA, 25 bp, E. coli
tttccgtgtgtcagcaccggcttaa

SEQ ID NO: 69610 - DNA, 25 bp, E. coli
tttccgtgtgtctgcaccggcttaa

SEQ ID NO: 69611 - DNA, 25 bp, E. coli
tgcgttttccgtctgtctgcaccgg

SEQ ID NO: 69612 - DNA, 25 bp, E. coli
tgatgtgcgttttccgtgtgtctgc

SEQ ID NO: 69613 - DNA, 25 bp, E. coli
tgcgttttccgtgtgtctgcaccgg

SEQ ID NO: 69614 - DNA, 25 bp, E. coli
tgatgtgcgtttaccgtgtgtctgc

SEQ ID NO: 69615 - DNA, 25 bp, E. coli
gactgattcgtcattcccttcgtcc

SEQ ID NO: 69616 - DNA, 25 bp, E. coli
gactgattcgtctttcccttcgtcc

SEQ ID NO: 69617 - DNA, 25 bp, E. coli
cgtaccgtccggagttgatgtgcgt

SEQ ID NO: 69618 - DNA, 25 bp, E. coli
cgtccggtgttgttgtgcgttttcc

SEQ ID NO: 69619 - DNA, 25 bp, E. coli
cttcgtcccgccagtcactggtgtt

SEQ ID NO: 69620 - DNA, 25 bp, E. coli
cgtccggtgttgatgtgcgttttcc

SEQ ID NO: 69621 - DNA, 25 bp, E. coli
cttcgtcccgcctgtcactggtgtt

SEQ ID NO: 69622 - DNA, 25 bp, E. coli
cgtaccgtccggtgttgatgtgcgt

SEQ ID NO: 69623 - DNA, 25 bp, E. coli
gtcatcatttcctgactgattcgtc

SEQ ID NO: 69624 - DNA, 25 bp, E. coli
gtgtttgtatcgaaccgtccggtgt

SEQ ID NO: 69625 - DNA, 25 bp, E. coli
gtgtttgtatcgtaccgtccggtgt

SEQ ID NO: 69626 - DNA, 25 bp, E. coli
gtcatcatttccagactgattcgtc

SEQ ID NO: 69627 - DNA, 25 bp, E. coli
aatggcaatgcatcgcgtgacacgg

SEQ ID NO: 69628 - DNA, 25 bp, E. coli
caacgtgttgaagtgcagggtgacc

SEQ ID NO: 69629 - DNA, 25 bp, E. coli
aatggcaatgcaacgcgtgacacgg

SEQ ID NO: 69630 - DNA, 25 bp, E. coli
caacgtgttgaactgcagggtgacc

SEQ ID NO: 69631 - DNA, 25 bp, E. coli
aaagcggtatcttcattgccagcag

SEQ ID NO: 69632 - DNA, 25 bp, E. coli
aacttgatgacactgacgatcgccg

SEQ ID NO: 69633 - DNA, 25 bp, E. coli
aacttgatgacagtgacgatcgccg

SEQ ID NO: 69634 - DNA, 25 bp, E. coli
aaagcggtatctacattgccagcag

SEQ ID NO: 69635 - DNA, 25 bp, E. coli
tgaaaccgtggatgaagagcgcgta

SEQ ID NO: 69636 - DNA, 25 bp, E. coli
tgaaaccgtggaagaagagcgcgta

SEQ ID NO: 69637 - DNA, 25 bp, E. coli
tgaattcaaacctgaagacgagctg

SEQ ID NO: 69638 - DNA, 25 bp, E. coli
tgaattcaaaccagaagacgagctg

SEQ ID NO: 69639 - DNA, 25 bp, E. coli
tgagcgtactgatcgtggcgaaccg

SEQ ID NO: 69640 - DNA, 25 bp, E. coli
tgagcgtactgaacgtggcgaaccg

SEQ ID NO: 69641 - DNA, 25 bp, E. coli
gaaacgacgcgttatggtcagccgt

SEQ ID NO: 69642 - DNA, 25 bp, E. coli
gaaacgacgcgtaatggtcagccgt

SEQ ID NO: 69643 - DNA, 25 bp, E. coli
ggttcgttgaaaacggcaccgtcca

SEQ ID NO: 69644 - DNA, 25 bp, E. coli
ggttcgttgaaatcggcaccgtcca

SEQ ID NO: 69645 - DNA, 25 bp, E. coli
tcaaaccgcgtctggcgagaagagt

SEQ ID NO: 69646 - DNA, 25 bp, E. coli
tcaaaccgcgtcaggcgagaagagt

SEQ ID NO: 69647 - DNA, 25 bp, E. coli
gggaaccacgtcagcggaaaatact

SEQ ID NO: 69648 - DNA, 25 bp, E. coli
gggaaccacgtctgcggaaaatact

SEQ ID NO: 69649 - DNA, 25 bp, E. coli
cggttactggtgcaaactgactcac

SEQ ID NO: 69650 - DNA, 25 bp, E. coli
cggttactggtggaaactgactcac

SEQ ID NO: 69651 - DNA, 25 bp, E. coli
tttacagaggacagagaaacggcgg

SEQ ID NO: 69652 - DNA, 25 bp, E. coli
tttacagaggactgagaaacggcgg

SEQ ID NO: 69653 - DNA, 25 bp, E. coli
tgtgaaattttgtctggcagtcgcc

SEQ ID NO: 69654 - DNA, 25 bp, E. coli
tggtcgtgaactcaacaagccggtt

SEQ ID NO: 69655 - DNA, 25 bp, E. coli
tgtgaaattttgactggcagtcgcc

SEQ ID NO: 69656 - DNA, 25 bp, E. coli
tggtcgtgaactgaacaagccggtt

SEQ ID NO: 69657 - DNA, 25 bp, E. coli
tccgtaatgcggagcaactgcgcga

SEQ ID NO: 69658 - DNA, 25 bp, E. coli
tccgtaatgcggtgcaactgcgcga

SEQ ID NO: 69659 - DNA, 25 bp, E. coli
tcgtgacgttgctgaatacatggct

SEQ ID NO: 69660 - DNA, 25 bp, E. coli
tctgcgcgaagaaaaagtgacggat

SEQ ID NO: 69661 - DNA, 25 bp, E. coli
tcgtgacgttgcagaatacatggct

SEQ ID NO: 69662 - DNA, 25 bp, E. coli
tctgcgcgaagataaagtgacggat

SEQ ID NO: 69663 - DNA, 25 bp, E. coli
gacggattgcggtggcgtactacac

SEQ ID NO: 69664 - DNA, 25 bp, E. coli
gacggattgcggaggcgtactacac

SEQ ID NO: 69665 - DNA, 25 bp, E. coli
ccgcatcgaggataagagaatcaac

SEQ ID NO: 69666 - DNA, 25 bp, E. coli
ccgcatcgaggaaaagagaatcaac

SEQ ID NO: 69667 - DNA, 25 bp, E. coli
ggcagtcgccacaacattaccgggt

SEQ ID NO: 69668 - DNA, 25 bp, E. coli
ggcagtcgccactacattaccgggt

SEQ ID NO: 69669 - DNA, 25 bp, E. coli
taaagtacgtcagcaagagtccttc

SEQ ID NO: 69670 - DNA, 25 bp, E. coli
taaagtacgtcaccaagagtccttc

SEQ ID NO: 69671 - DNA, 25 bp, E. coli
aatccgctttttcctccgggtcagg

SEQ ID NO: 69672 - DNA, 25 bp, E. coli
aatccgctttttgctccgggtcagg

SEQ ID NO: 69673 - DNA, 25 bp, E. coli
caaaaatgtacacagaactccggcc

SEQ ID NO: 69674 - DNA, 25 bp, E. coli
caaaaatgtacagagaactccggcc

SEQ ID NO: 69675 - DNA, 25 bp, E. coli
tagcgcaagcgtgtcgagaactgct

SEQ ID NO: 69676 - DNA, 25 bp, E. coli
tagcgcaagcgtctcgagaactgct

SEQ ID NO: 69677 - DNA, 25 bp, E. coli
ttgaaacctacggtgctccagaccg

SEQ ID NO: 69678 - DNA, 25 bp, E. coli
ttgaaacctacgctgctccagaccg

SEQ ID NO: 69679 - DNA, 25 bp, E. coli
tgttcgtgctgttcctgttcaccgg

SEQ ID NO: 69680 - DNA, 25 bp, E. coli
tgttcgtgctgtacctgttcaccgg

SEQ ID NO: 69681 - DNA, 25 bp, E. coli
tgttcaccggaaggctgatagacgt

SEQ ID NO: 69682 - DNA, 25 bp, E. coli
tgttcaccggaacgctgatagacgt

SEQ ID NO: 69683 - DNA, 25 bp, E. coli
tcgttggcagcgacaggtattcacg

SEQ ID NO: 69684 - DNA, 25 bp, E. coli
tccagaccgtggtgaatatttgcct

SEQ ID NO: 69685 - DNA, 25 bp, E. coli
tcgttggcagcgtcaggtattcacg

SEQ ID NO: 69686 - DNA, 25 bp, E. coli
tccagaccgtggagaatatttgcct

SEQ ID NO: 69687 - DNA, 25 bp, E. coli
tcatcctctgtcaatagcgcaagcg

SEQ ID NO: 69688 - DNA, 25 bp, E. coli
tcatcctctgtctatagcgcaagcg

SEQ ID NO: 69689 - DNA, 25 bp, E. coli
ggtattcacgtcaccattctggagt

SEQ ID NO: 69690 - DNA, 25 bp, E. coli
ggtattcacgtctccattctggagt

SEQ ID NO: 69691 - DNA, 25 bp, E. coli
gaggcattggtgtgctgttcttccg

SEQ ID NO: 69692 - DNA, 25 bp, E. coli
gaggcattggtgagctgttcttccg

SEQ ID NO: 69693 - DNA, 25 bp, E. coli
caaattattcgccaagcggtgctga

SEQ ID NO: 69694 - DNA, 25 bp, E. coli
caaattattcgcgaagcggtgctga

SEQ ID NO: 69695 - DNA, 25 bp, E. coli
tatgcagagttaccgcctgggctac

SEQ ID NO: 69696 - DNA, 25 bp, E. coli
tatgcagagttagcgcctgggctac

SEQ ID NO: 69697 - DNA, 25 bp, E. coli
tgattgttaaacgacccgtctcggc

SEQ ID NO: 69698 - DNA, 25 bp, E. coli
tgattgttaaaccacccgtctcggc

SEQ ID NO: 69699 - DNA, 25 bp, E. coli
tgactttttcactaccttccggcgg

SEQ ID NO: 69700 - DNA, 25 bp, E. coli
tgactttttcacaaccttccggcgg

SEQ ID NO: 69701 - DNA, 25 bp, E. coli
tgacaatgcaagtgacggtttacgg

SEQ ID NO: 69702 - DNA, 25 bp, E. coli
tgacaatgcaagagacggtttacgg

SEQ ID NO: 69703 - DNA, 25 bp, E. coli
tgaataatcggctcagcaagggcga

SEQ ID NO: 69704 - DNA, 25 bp, E. coli
tgaataatcggcacagcaagggcga

SEQ ID NO: 69705 - DNA, 25 bp, E. coli
tctgaatatcatgcgcgaacgcgcg

SEQ ID NO: 69706 - DNA, 25 bp, E. coli
tcagtagaagaaaagacccgcgatc

SEQ ID NO: 69707 - DNA, 25 bp, E. coli
tctgaatatcatccgcgaacgcgcg

SEQ ID NO: 69708 - DNA, 25 bp, E. coli
cctttaaccagatgtcgagcgagct

SEQ ID NO: 69709 - DNA, 25 bp, E. coli
cctttaaccagaagtcgagcgagct

SEQ ID NO: 69710 - DNA, 25 bp, E. coli
gcaggcactgcattcaccggtatta

SEQ ID NO: 69711 - DNA, 25 bp, E. coli
gcaggcactgcaatcaccggtatta

SEQ ID NO: 69712 - DNA, 25 bp, E. coli
cggtttacggcgtactgcactggca

SEQ ID NO: 69713 - DNA, 25 bp, E. coli
cggtttacggcgaactgcactggca

SEQ ID NO: 69714 - DNA, 25 bp, E. coli
tcagtagaagaatagacccgcgatc

SEQ ID NO: 69715 - DNA, 25 bp, E. coli
aaggcatacctttcataccgtggaa

SEQ ID NO: 69716 - DNA, 25 bp, E. coli
aaggcataccttacataccgtggaa

SEQ ID NO: 69717 - DNA, 25 bp, E. coli
cagtaagactgtctggacgcatcgt

SEQ ID NO: 69718 - DNA, 25 bp, E. coli
cagtaagactgtgtggacgcatcgt

SEQ ID NO: 69719 - DNA, 25 bp, E. coli
taaatttatcaaaggctggaggtgc

SEQ ID NO: 69720 - DNA, 25 bp, E. coli
tacgtgaaagtcatcgctgtggacg

SEQ ID NO: 69721 - DNA, 25 bp, E. coli
taaatttatcaatggctggaggtgc

SEQ ID NO: 69722 - DNA, 25 bp, E. coli
tagaacgacaattatccccgaggga

SEQ ID NO: 69723 - DNA, 25 bp, E. coli
tagaacgacaataatccccgaggga

SEQ ID NO: 69724 - DNA, 25 bp, E. coli
taccgtggaaattaacagcagagca

SEQ ID NO: 69725 - DNA, 25 bp, E. coli
tacgtgaaagtcttcgctgtggacg

SEQ ID NO: 69726 - DNA, 25 bp, E. coli
taccgtggaaataaacagcagagca

SEQ ID NO: 69727 - DNA, 25 bp, E. coli
tgtcaatattccgtgcctggcatgg

SEQ ID NO: 69728 - DNA, 25 bp, E. coli
tgtcaatattccctgcctggcatgg

SEQ ID NO: 69729 - DNA, 25 bp, E. coli
gctgtggacgacaattcttctctga

SEQ ID NO: 69730 - DNA, 25 bp, E. coli
gctgtggacgactattcttctctga

SEQ ID NO: 69731 - DNA, 25 bp, E. coli
gcatggatctcgtacaccttgggta

SEQ ID NO: 69732 - DNA, 25 bp, E. coli
gcacatcttgctttcgggatgagca

SEQ ID NO: 69733 - DNA, 25 bp, E. coli
gcacatcttgctatcgggatgagca

SEQ ID NO: 69734 - DNA, 25 bp, E. coli
gcatggatctcgaacaccttgggta

SEQ ID NO: 69735 - DNA, 25 bp, E. coli
gacgcatcgtcgaagagctatggat

SEQ ID NO: 69736 - DNA, 25 bp, E. coli
gacgcatcgtcgtagagctatggat

SEQ ID NO: 69737 - DNA, 25 bp, E. coli
caagaattgctggaaacccgggcta

SEQ ID NO: 69738 - DNA, 25 bp, E. coli
caagaattgctgcaaacccgggcta

SEQ ID NO: 69739 - DNA, 25 bp, E. coli
tacgctggttacaacggcaacttgc

SEQ ID NO: 69740 - DNA, 25 bp, E. coli
tacgctggttactacggcaacttgc

SEQ ID NO: 69741 - DNA, 25 bp, E. coli
tatcttaaacggtgagcgtggctct

SEQ ID NO: 69742 - DNA, 25 bp, E. coli
tatcttaaacggagagcgtggctct

SEQ ID NO: 69743 - DNA, 25 bp, E. coli
ttcaaagcctggtggaagcctgctc

SEQ ID NO: 69744 - DNA, 25 bp, E. coli
ttcaaagcctggaggaagcctgctc

SEQ ID NO: 69745 - DNA, 25 bp, E. coli
ttgagttactcatgctccatccggg

SEQ ID NO: 69746 - DNA, 25 bp, E. coli
ttgagttactcaagctccatccggg

SEQ ID NO: 69747 - DNA, 25 bp, E. coli
gactcgttgcctgaaaaaggacgcg

SEQ ID NO: 69748 - DNA, 25 bp, E. coli
gactcgttgcctcaaaaaggacgcg

SEQ ID NO: 69749 - DNA, 25 bp, E. coli
gacatttatgatgcgctaccctggc

SEQ ID NO: 69750 - DNA, 25 bp, E. coli
gaaccatctatgaatggccgcccag

SEQ ID NO: 69751 - DNA, 25 bp, E. coli
gaaccatctatgtatggccgcccag

SEQ ID NO: 69752 - DNA, 25 bp, E. coli
gacatttatgatccgctaccctggc

SEQ ID NO: 69753 - DNA, 25 bp, E. coli
cgttaaaagaggcagagagcatcgc

SEQ ID NO: 69754 - DNA, 25 bp, E. coli
cgttaaaagagggagagagcatcgc

SEQ ID NO: 69755 - DNA, 25 bp, E. coli
gatatcgttcgtctagacctgctcc

SEQ ID NO: 69756 - DNA, 25 bp, E. coli
taattattgaacatgcagaggccga

SEQ ID NO: 69757 - DNA, 25 bp, E. coli
taattattgaacttgcagaggccga

SEQ ID NO: 69758 - DNA, 25 bp, E. coli
gatatcgttcgtgtagacctgctcc

SEQ ID NO: 69759 - DNA, 25 bp, E. coli
aaattctgagctgaacatttaccag

SEQ ID NO: 69760 - DNA, 25 bp, E. coli
aactgatgcccgaaactctgacttg

SEQ ID NO: 69761 - DNA, 25 bp, E. coli
actctgacttgactattacccagca

SEQ ID NO: 69762 - DNA, 25 bp, E. coli
actctgacttgagtattacccagca

SEQ ID NO: 69763 - DNA, 25 bp, E. coli
aactcctccgtcaacgtgactcagg

SEQ ID NO: 69764 - DNA, 25 bp, E. coli
aactgatgcccgtaactctgacttg

SEQ ID NO: 69765 - DNA, 25 bp, E. coli
aaattctgagctcaacatttaccag

SEQ ID NO: 69766 - DNA, 25 bp, E. coli
aactcctccgtctacgtgactcagg

SEQ ID NO: 69767 - DNA, 25 bp, E. coli
tgatcagtggaagggcaaaaattct

SEQ ID NO: 69768 - DNA, 25 bp, E. coli
tgatcagtggaacggcaaaaattct

SEQ ID NO: 69769 - DNA, 25 bp, E. coli
tgcatctaactcctccgtcaacgtg

SEQ ID NO: 69770 - DNA, 25 bp, E. coli
tgaaatgacggttaaacagttcggt

SEQ ID NO: 69771 - DNA, 25 bp, E. coli
tgaaatgacggtaaaacagttcggt

SEQ ID NO: 69772 - DNA, 25 bp, E. coli
tgcatctaactcgtccgtcaacgtg

SEQ ID NO: 69773 - DNA, 25 bp, E. coli
cggcaaaaattctgaaatgacggtt

SEQ ID NO: 69774 - DNA, 25 bp, E. coli
cggcaaaaattcagaaatgacggtt

SEQ ID NO: 69775 - DNA, 25 bp, E. coli
tggcaacggtgctgcagttgaccag

SEQ ID NO: 69776 - DNA, 25 bp, E. coli
tggcaacggtgcagcagttgaccag

SEQ ID NO: 69777 - DNA, 25 bp, E. coli
taatagcggcccaaattctgagctg

SEQ ID NO: 69778 - DNA, 25 bp, E. coli
taatagcggccctaattctgagctg

SEQ ID NO: 69779 - DNA, 25 bp, E. coli
gatgcccgtaactctgacttgacta

SEQ ID NO: 69780 - DNA, 25 bp, E. coli
gatgcccgtaacactgacttgacta

SEQ ID NO: 69781 - DNA, 25 bp, E. coli
catccagagggcattacagtgtaca

SEQ ID NO: 69782 - DNA, 25 bp, E. coli
catccagagggctttacagtgtaca

SEQ ID NO: 69783 - DNA, 25 bp, E. coli
tacattgagaaatagaaaggccgcc

SEQ ID NO: 69784 - DNA, 25 bp, E. coli
tacattgagaaaaagaaaggccgcc

SEQ ID NO: 69785 - DNA, 25 bp, E. coli
tacggcaggcatagaagagtttcgc

SEQ ID NO: 69786 - DNA, 25 bp, E. coli
tacggcaggcattgaagagtttcgc

SEQ ID NO: 69787 - DNA, 25 bp, E. coli
tatcgtaagccggatggctcaggca

SEQ ID NO: 69788 - DNA, 25 bp, E. coli
tatcgtaagccgcatggctcaggca

SEQ ID NO: 69789 - DNA, 25 bp, E. coli
tattcggattgagctctgcggaagc

SEQ ID NO: 69790 - DNA, 25 bp, E. coli
tattcggattgacctctgcggaagc

SEQ ID NO: 69791 - DNA, 25 bp, E. coli
tttatcgccctgtagaggatgccgg

SEQ ID NO: 69792 - DNA, 25 bp, E. coli
tttatcgccctgaagaggatgccgg

SEQ ID NO: 69793 - DNA, 25 bp, E. coli
tcccgggatcaaaaacgtatgctgt

SEQ ID NO: 69794 - DNA, 25 bp, E. coli
tcccgggatcaataacgtatgctgt

SEQ ID NO: 69795 - DNA, 25 bp, E. coli
gaacatgacggtatctgcgagatcc

SEQ ID NO: 69796 - DNA, 25 bp, E. coli
gaacatgacggtttctgcgagatcc

SEQ ID NO: 69797 - DNA, 25 bp, E. coli
gatcatagagcgataccagctgcct

SEQ ID NO: 69798 - DNA, 25 bp, E. coli
tggtttatcaaacgtgcgcacagtc

SEQ ID NO: 69799 - DNA, 25 bp, E. coli
tggtttatcaaaggtgcgcacagtc

SEQ ID NO: 69800 - DNA, 25 bp, E. coli
gatcatagagcgttaccagctgcct

SEQ ID NO: 69801 - DNA, 25 bp, E. coli
gatggcaccctacaggaacatgacg

SEQ ID NO: 69802 - DNA, 25 bp, E. coli
gatggcaccctagaggaacatgacg

SEQ ID NO: 69803 - DNA, 25 bp, E. coli
cagtttcagtaaaacgtcggcaggt

SEQ ID NO: 69804 - DNA, 25 bp, E. coli
catcagtacgctgcaaaagctgctg

SEQ ID NO: 69805 - DNA, 25 bp, E. coli
cagtttcagtaatacgtcggcaggt

SEQ ID NO: 69806 - DNA, 25 bp, E. coli
catcagtacgctccaaaagctgctg

SEQ ID NO: 69807 - DNA, 25 bp, E. coli
tagaacaagatatagtcagccctgc

SEQ ID NO: 69808 - DNA, 25 bp, E. coli
tagaacaagataaagtcagccctgc

SEQ ID NO: 69809 - DNA, 25 bp, E. coli
tccgggctgactgacagtgctatca

SEQ ID NO: 69810 - DNA, 25 bp, E. coli
tccgagccggaataacctgatgagc

SEQ ID NO: 69811 - DNA, 25 bp, E. coli
tccgggctgactcacagtgctatca

SEQ ID NO: 69812 - DNA, 25 bp, E. coli
tccgagccggaaaaacctgatgagc

SEQ ID NO: 69813 - DNA, 25 bp, E. coli
gatctttgaaacgtaccagccgggc

SEQ ID NO: 69814 - DNA, 25 bp, E. coli
gatctttgaaacctaccagccgggc

SEQ ID NO: 69815 - DNA, 25 bp, E. coli
gaaaacgcttgtcggaaatccgcca

SEQ ID NO: 69816 - DNA, 25 bp, E. coli
gaaaacgcttgtgggaaatccgcca

SEQ ID NO: 69817 - DNA, 25 bp, E. coli
gtatttgccgaattatcagcgccca

SEQ ID NO: 69818 - DNA, 25 bp, E. coli
gtatttgccgaaatatcagcgccca

SEQ ID NO: 69819 - DNA, 25 bp, E. coli
tggtcaggattaccacctcgtcgcg

SEQ ID NO: 69820 - DNA, 25 bp, E. coli
tggtcaggattagcacctcgtcgcg

SEQ ID NO: 69821 - DNA, 25 bp, E. coli
taacggtaaccccaatcgcacgctg

SEQ ID NO: 69822 - DNA, 25 bp, E. coli
taacggtaacccgaatcgcacgctg

SEQ ID NO: 69823 - DNA, 25 bp, E. coli
gagccgcaggtcgtcattaatcagg

SEQ ID NO: 69824 - DNA, 25 bp, E. coli
gagccgcaggtcctcattaatcagg

SEQ ID NO: 69825 - DNA, 25 bp, E. coli
taaatgaaatcgatgctcaatgcca

SEQ ID NO: 69826 - DNA, 25 bp, E. coli
taaatgaaatcgttgctcaatgcca

SEQ ID NO: 69827 - DNA, 25 bp, E. coli
tatagccggtggtgttgcaaccgct

SEQ ID NO: 69828 - DNA, 25 bp, E. coli
tatagccggtggagttgcaaccgct

SEQ ID NO: 69829 - DNA, 25 bp, E. coli
tgtggccaaagctgttatagccggt

SEQ ID NO: 69830 - DNA, 25 bp, E. coli
tgtggccaaagcagttatagccggt

SEQ ID NO: 69831 - DNA, 25 bp, E. coli
tgagttcagagccagatctggttaa

SEQ ID NO: 69832 - DNA, 25 bp, E. coli
tgcaaccgctataggaagtctggct

SEQ ID NO: 69833 - DNA, 25 bp, E. coli
tgagttcagagcgagatctggttaa

SEQ ID NO: 69834 - DNA, 25 bp, E. coli
tgcaaccgctattggaagtctggct

SEQ ID NO: 69835 - DNA, 25 bp, E. coli
gcctgtgttagcattggctttccag

SEQ ID NO: 69836 - DNA, 25 bp, E. coli
ccagtaattcttgtcggaggagcaa

SEQ ID NO: 69837 - DNA, 25 bp, E. coli
gcctgtgttagctttggctttccag

SEQ ID NO: 69838 - DNA, 25 bp, E. coli
ccagtaattcttctcggaggagcaa

SEQ ID NO: 69839 - DNA, 25 bp, E. coli
gcgatttttcaatggatgtggccaa

SEQ ID NO: 69840 - DNA, 25 bp, E. coli
gcgatttttcaaaggatgtggccaa

SEQ ID NO: 69841 - DNA, 25 bp, E. coli
ggaaaagggaaaacatgactccatt

SEQ ID NO: 69842 - DNA, 25 bp, E. coli
ggaaaagggaaatcatgactccatt

SEQ ID NO: 69843 - DNA, 25 bp, E. coli
gaggagcaattttactgacagggat

SEQ ID NO: 69844 - DNA, 25 bp, E. coli
gatggactaaaagggcaacaggaac

SEQ ID NO: 69845 - DNA, 25 bp, E. coli
gaggagcaatttaactgacagggat

SEQ ID NO: 69846 - DNA, 25 bp, E. coli
gatggactaaaacggcaacaggaac

SEQ ID NO: 69847 - DNA, 25 bp, E. coli
caagatttccctcgtgttggcgcag

SEQ ID NO: 69848 - DNA, 25 bp, E. coli
caagatttccctggtgttggcgcag

SEQ ID NO: 69849 - DNA, 25 bp, E. coli
cataataatttagggcgcagccaag

SEQ ID NO: 69850 - DNA, 25 bp, E. coli
cataataatttacggcgcagccaag

SEQ ID NO: 69851 - DNA, 25 bp, E. coli
tacggcgcagccaagatttccctgg

SEQ ID NO: 69852 - DNA, 25 bp, E. coli
tacggcgcagcctagatttccctgg

SEQ ID NO: 69853 - DNA, 25 bp, E. coli
aaaacagtgctgtgcccttgtaact

SEQ ID NO: 69854 - DNA, 25 bp, E. coli
aaaacagtgctgagcccttgtaact

SEQ ID NO: 69855 - DNA, 25 bp, E. coli
ttccctggtgttcgcgcagtattcg

SEQ ID NO: 69856 - DNA, 25 bp, E. coli
ttccctggtgttggcgcagtattcg

SEQ ID NO: 69857 - DNA, 25 bp, E. coli
tgttggcgcagttttcgcgcacccc

SEQ ID NO: 69858 - DNA, 25 bp, E. coli
tgttggcgcagtattcgcgcacccc

SEQ ID NO: 69859 - DNA, 25 bp, E. coli
tcatcataataatttacggcgcagc

SEQ ID NO: 69860 - DNA, 25 bp, E. coli
tcatcataataaattacggcgcagc

SEQ ID NO: 69861 - DNA, 25 bp, E. coli
gctgtgcccttgaaactcatcataa

SEQ ID NO: 69862 - DNA, 25 bp, E. coli
gcagtattcgcgcaccccggtctag

SEQ ID NO: 69863 - DNA, 25 bp, E. coli
gcagtattcgcggaccccggtctag

SEQ ID NO: 69864 - DNA, 25 bp, E. coli
gctgtgcccttgtaactcatcataa

SEQ ID NO: 69865 - DNA, 25 bp, E. coli
cggcctgaaaaacagtgctgtgccc

SEQ ID NO: 69866 - DNA, 25 bp, E. coli
cggcctgaaaaagagtgctgtgccc

SEQ ID NO: 69867 - DNA, 25 bp, E. coli
ggcgcagccaagttttccctggtgt

SEQ ID NO: 69868 - DNA, 25 bp, E. coli
ggcgcagccaagatttccctggtgt

SEQ ID NO: 69869 - DNA, 25 bp, E. coli
aatttaaacacctccatcatcacca

SEQ ID NO: 69870 - DNA, 25 bp, E. coli
aatttaaacaccaccatcatcacca

SEQ ID NO: 69871 - DNA, 25 bp, E. coli
cacgcgttcaatataaacaccacca

SEQ ID NO: 69872 - DNA, 25 bp, E. coli
cacgcgttcaatttaaacaccacca

SEQ ID NO: 69873 - DNA, 25 bp, E. coli
caccaccatcatcaccatcatcctg

SEQ ID NO: 69874 - DNA, 25 bp, E. coli
caccaccatcatgaccatcatcctg

SEQ ID NO: 69875 - DNA, 25 bp, E. coli
atgacacgcgttgaatttaaacacc

SEQ ID NO: 69876 - DNA, 25 bp, E. coli
atttaaacaccaccatcatcaccat

SEQ ID NO: 69877 - DNA, 25 bp, E. coli
atttaaacaccagcatcatcaccat

SEQ ID NO: 69878 - DNA, 25 bp, E. coli
atgacacgcgttcaatttaaacacc

SEQ ID NO: 69879 - DNA, 25 bp, E. coli
tgacacgcgttctatttaaacacca

SEQ ID NO: 69880 - DNA, 25 bp, E. coli
tgacacgcgttcaatttaaacacca

SEQ ID NO: 69881 - DNA, 25 bp, E. coli
gcgttcaatttaaacaccaccatca

SEQ ID NO: 69882 - DNA, 25 bp, E. coli
gcgttcaatttatacaccaccatca

SEQ ID NO: 69883 - DNA, 25 bp, E. coli
gacacgcgttcattttaaacaccac

SEQ ID NO: 69884 - DNA, 25 bp, E. coli
gacacgcgttcaatttaaacaccac

SEQ ID NO: 69885 - DNA, 25 bp, E. coli
cgcgttcaattttaacaccaccatc

SEQ ID NO: 69886 - DNA, 25 bp, E. coli
cgcgttcaatttaaacaccaccatc

SEQ ID NO: 69887 - DNA, 25 bp, E. coli
gttcaatttaaacaccaccatcatc

SEQ ID NO: 69888 - DNA, 25 bp, E. coli
gttcaatttaaagaccaccatcatc

SEQ ID NO: 69889 - DNA, 25 bp, E. coli
tcaatttaaacagcaccatcatcac

SEQ ID NO: 69890 - DNA, 25 bp, E. coli
tcaatttaaacaccaccatcatcac

SEQ ID NO: 69891 - DNA, 25 bp, E. coli
caactggcggagttttaccgatcgc

SEQ ID NO: 69892 - DNA, 25 bp, E. coli
caactggcggagatttaccgatcgc

SEQ ID NO: 69893 - DNA, 25 bp, E. coli
cagccattgccgtgagcgttactac

SEQ ID NO: 69894 - DNA, 25 bp, E. coli
cagccattgccgagagcgttactac

SEQ ID NO: 69895 - DNA, 25 bp, E. coli
taaatactgtggatactgcgggcat

SEQ ID NO: 69896 - DNA, 25 bp, E. coli
taaatactgtggttactgcgggcat

SEQ ID NO: 69897 - DNA, 25 bp, E. coli
aaccgaatgggcgatgctgtgcagc

SEQ ID NO: 69898 - DNA, 25 bp, E. coli
aaatttcgatcttgtgggtcagcgc

SEQ ID NO: 69899 - DNA, 25 bp, E. coli
aaccgaatgggccatgctgtgcagc

SEQ ID NO: 69900 - DNA, 25 bp, E. coli
aaatttcgatctagtgggtcagcgc

SEQ ID NO: 69901 - DNA, 25 bp, E. coli
tatggttgccgaagggagaattgcc

SEQ ID NO: 69902 - DNA, 25 bp, E. coli
tagcgcgccgtctgatagaagatac

SEQ ID NO: 69903 - DNA, 25 bp, E. coli
tatggttgccgatgggagaattgcc

SEQ ID NO: 69904 - DNA, 25 bp, E. coli
tagcgcgccgtcagatagaagatac

SEQ ID NO: 69905 - DNA, 25 bp, E. coli
tgaaaaattagatcacggctggtgg

SEQ ID NO: 69906 - DNA, 25 bp, E. coli
tgaaaaattagaacacggctggtgg

SEQ ID NO: 69907 - DNA, 25 bp, E. coli
cattattgttgccatccgtcgcgat

SEQ ID NO: 69908 - DNA, 25 bp, E. coli
cattattgttgcgatccgtcgcgat

SEQ ID NO: 69909 - DNA, 25 bp, E. coli
gtttatggcggaatatgacagcggc

SEQ ID NO: 69910 - DNA, 25 bp, E. coli
gtttatggcggattatgacagcggc

SEQ ID NO: 69911 - DNA, 25 bp, E. coli
ggtcagcgcgcagtacaaatcggcg

SEQ ID NO: 69912 - DNA, 25 bp, E. coli
ggtcagcgcgcactacaaatcggcg

SEQ ID NO: 69913 - DNA, 25 bp, E. coli
aatctatgcgcaaccagctactggc

SEQ ID NO: 69914 - DNA, 25 bp, E. coli
aatctatgcgcatccagctactggc

SEQ ID NO: 69915 - DNA, 25 bp, E. coli
caatctatgcgctaccagctactgg

SEQ ID NO: 69916 - DNA, 25 bp, E. coli
caatctatgcgcaaccagctactgg

SEQ ID NO: 69917 - DNA, 25 bp, E. coli
actgcaatctatccgcaaccagcta

SEQ ID NO: 69918 - DNA, 25 bp, E. coli
atctatgcgcaaccagctactggcg

SEQ ID NO: 69919 - DNA, 25 bp, E. coli
atctatgcgcaagcagctactggcg

SEQ ID NO: 69920 - DNA, 25 bp, E. coli
actgcaatctatgcgcaaccagcta

SEQ ID NO: 69921 - DNA, 25 bp, E. coli
tatgcgcaaccacctactggcgctg

SEQ ID NO: 69922 - DNA, 25 bp, E. coli
tatgcgcaaccagctactggcgctg

SEQ ID NO: 69923 - DNA, 25 bp, E. coli
tctatgcgcaaccagctactggcgc

SEQ ID NO: 69924 - DNA, 25 bp, E. coli
tctatgcgcaacgagctactggcgc

SEQ ID NO: 69925 - DNA, 25 bp, E. coli
gcaatctatgcgcaaccagctactg

SEQ ID NO: 69926 - DNA, 25 bp, E. coli
gcaatctatgcggaaccagctactg

SEQ ID NO: 69927 - DNA, 25 bp, E. coli
ctgcaatctatgggcaaccagctac

SEQ ID NO: 69928 - DNA, 25 bp, E. coli
ctatgcgcaacctgctactggcgct

SEQ ID NO: 69929 - DNA, 25 bp, E. coli
ctgcaatctatgcgcaaccagctac

SEQ ID NO: 69930 - DNA, 25 bp, E. coli
ctatgcgcaaccagctactggcgct

SEQ ID NO: 69931 - DNA, 25 bp, E. coli
tggcggagattgaacggcatatcga

SEQ ID NO: 69932 - DNA, 25 bp, E. coli
ggcggagattgatcggcatatcgaa

SEQ ID NO: 69933 - DNA, 25 bp, E. coli
ggcggagattgaacggcatatcgaa

SEQ ID NO: 69934 - DNA, 25 bp, E. coli
tggcggagattgtacggcatatcga

SEQ ID NO: 69935 - DNA, 25 bp, E. coli
aatcaggtcgaggagagcaatcagc

SEQ ID NO: 69936 - DNA, 25 bp, E. coli
aatcaggtcgagcagagcaatcagc

SEQ ID NO: 69937 - DNA, 25 bp, E. coli
caaacggccgcctgtatggagcaat

SEQ ID NO: 69938 - DNA, 25 bp, E. coli
caaacggccgccagtatggagcaat

SEQ ID NO: 69939 - DNA, 25 bp, E. coli
tatatggtcgtaatgagatcaccgc

SEQ ID NO: 69940 - DNA, 25 bp, E. coli
tatatggtcgtattgagatcaccgc

SEQ ID NO: 69941 - DNA, 25 bp, E. coli
tttatggcgatgtctgcgggcaacg

SEQ ID NO: 69942 - DNA, 25 bp, E. coli
tttatggcgatgactgcgggcaacg

SEQ ID NO: 69943 - DNA, 25 bp, E. coli
tgttgcggcgatctacatcagcagt

SEQ ID NO: 69944 - DNA, 25 bp, E. coli
tgttgcggcgatgtacatcagcagt

SEQ ID NO: 69945 - DNA, 25 bp, E. coli
gacgttaactttgaggcctggcagc

SEQ ID NO: 69946 - DNA, 25 bp, E. coli
gacgttaactttcaggcctggcagc

SEQ ID NO: 69947 - DNA, 25 bp, E. coli
gatattgtcagtacggtgacccgcg

SEQ ID NO: 69948 - DNA, 25 bp, E. coli
gatattgtcagttcggtgacccgcg

SEQ ID NO: 69949 - DNA, 25 bp, E. coli
ggcattagcgcatactcgggcggta

SEQ ID NO: 69950 - DNA, 25 bp, E. coli
ggcattagcgcaaactcgggcggta

SEQ ID NO: 69951 - DNA, 25 bp, E. coli
tcaagtcgtacccaacagcaggcgg

SEQ ID NO: 69952 - DNA, 25 bp, E. coli
tcaagtcgtaccgaacagcaggcgg

SEQ ID NO: 69953 - DNA, 25 bp, E. coli
gagtcagtcaatggtgtccagcagg

SEQ ID NO: 69954 - DNA, 25 bp, E. coli
gagaaaagttttgcccgctggcaca

SEQ ID NO: 69955 - DNA, 25 bp, E. coli
gagaaaagttttccccgctggcaca

SEQ ID NO: 69956 - DNA, 25 bp, E. coli
gagtcagtcaatcgtgtccagcagg

SEQ ID NO: 69957 - DNA, 25 bp, E. coli
agatcccacagctttaaaagaagcg

SEQ ID NO: 69958 - DNA, 25 bp, E. coli
acgccagatccctcagcattaaaag

SEQ ID NO: 69959 - DNA, 25 bp, E. coli
agatcccacagcattaaaagaagcg

SEQ ID NO: 69960 - DNA, 25 bp, E. coli
acgccagatcccacagcattaaaag

SEQ ID NO: 69961 - DNA, 25 bp, E. coli
tatgctaacgcctgatcccacagca

SEQ ID NO: 69962 - DNA, 25 bp, E. coli
tatgctaacgccagatcccacagca

SEQ ID NO: 69963 - DNA, 25 bp, E. coli
tgattatgctaacgccagatcccac

SEQ ID NO: 69964 - DNA, 25 bp, E. coli
tgattatgctaaggccagatcccac

SEQ ID NO: 69965 - DNA, 25 bp, E. coli
tgctaacgccagatcccacagcatt

SEQ ID NO: 69966 - DNA, 25 bp, E. coli
tgaaagctaacacattgcgcctgtc

SEQ ID NO: 69967 - DNA, 25 bp, E. coli
tgctaacgccagttcccacagcatt

SEQ ID NO: 69968 - DNA, 25 bp, E. coli
tgctctgctgaatgctaacacattg

SEQ ID NO: 69969 - DNA, 25 bp, E. coli
tgctctgctgaaagctaacacattg

SEQ ID NO: 69970 - DNA, 25 bp, E. coli
tgaaagctaacagattgcgcctgtc

SEQ ID NO: 69971 - DNA, 25 bp, E. coli
gccagatcccactgcattaaaagaa

SEQ ID NO: 69972 - DNA, 25 bp, E. coli
gccagatcccacagcattaaaagaa

SEQ ID NO: 69973 - DNA, 25 bp, E. coli
ctgattatgctaacgccagatccca

SEQ ID NO: 69974 - DNA, 25 bp, E. coli
ctgattatgctatcgccagatccca

SEQ ID NO: 69975 - DNA, 25 bp, E. coli
ctgctgaaagcttacacattgcgcc

SEQ ID NO: 69976 - DNA, 25 bp, E. coli
ctaacgccagatcccacagcattaa

SEQ ID NO: 69977 - DNA, 25 bp, E. coli
ctaacgccagatgccacagcattaa

SEQ ID NO: 69978 - DNA, 25 bp, E. coli
ctgctgaaagctaacacattgcgcc

SEQ ID NO: 69979 - DNA, 25 bp, E. coli
catgaaccttttatgcaggccccgg

SEQ ID NO: 69980 - DNA, 25 bp, E. coli
cagtattccgtgactgatatcaaca

SEQ ID NO: 69981 - DNA, 25 bp, E. coli
cagtattccgtgtctgatatcaaca

SEQ ID NO: 69982 - DNA, 25 bp, E. coli
catgaaccttttttgcaggccccgg

SEQ ID NO: 69983 - DNA, 25 bp, E. coli
tatcaacgggtgaatatgggaaagg

SEQ ID NO: 69984 - DNA, 25 bp, E. coli
ttgggtatcgatgcgctatcaacgg

SEQ ID NO: 69985 - DNA, 25 bp, E. coli
tatcaacgggtgtatatgggaaagg

SEQ ID NO: 69986 - DNA, 25 bp, E. coli
tatctgtggttgctggttaaagcca

SEQ ID NO: 69987 - DNA, 25 bp, E. coli
ttgggtatcgatccgctatcaacgg

SEQ ID NO: 69988 - DNA, 25 bp, E. coli
tatctgtggttggtggttaaagcca

SEQ ID NO: 69989 - DNA, 25 bp, E. coli
tgatatcaacaggatgcccttcgga

SEQ ID NO: 69990 - DNA, 25 bp, E. coli
tgatatcaacagcatgcccttcgga

SEQ ID NO: 69991 - DNA, 25 bp, E. coli
tgcaggccccgggtttatctgtggt

SEQ ID NO: 69992 - DNA, 25 bp, E. coli
tgcaggccccggctttatctgtggt

SEQ ID NO: 69993 - DNA, 25 bp, E. coli
gcccttcggataaatgttacttttg

SEQ ID NO: 69994 - DNA, 25 bp, E. coli
gcccttcggatatatgttacttttg

SEQ ID NO: 69995 - DNA, 25 bp, E. coli
gctatgttaattctggcatgaacct

SEQ ID NO: 69996 - DNA, 25 bp, E. coli
gctatgttaattgtggcatgaacct

SEQ ID NO: 69997 - DNA, 25 bp, E. coli
gggcagaaagcagagctatgttaat

SEQ ID NO: 69998 - DNA, 25 bp, E. coli
gggcagaaagcacagctatgttaat

SEQ ID NO: 69999 - DNA, 25 bp, E. coli
tggttaaagccagtattccgtgtct

SEQ ID NO: 70000 - DNA, 25 bp, E. coli
tggttaaagccactattccgtgtct

SEQ ID NO: 70001 - DNA, 25 bp, E. coli
caacgacgttattgccgccggtcca

SEQ ID NO: 70002 - DNA, 25 bp, E. coli
caacgacgttatagccgccggtcca

SEQ ID NO: 70003 - DNA, 25 bp, E. coli
aactccgccgcgttaaccaggcaat

SEQ ID NO: 70004 - DNA, 25 bp, E. coli
aaagcaacgacgttattgccgccgg

SEQ ID NO: 70005 - DNA, 25 bp, E. coli
aaagcaacgacgatattgccgccgg

SEQ ID NO: 70006 - DNA, 25 bp, E. coli
aactccgccgcgataaccaggcaat

SEQ ID NO: 70007 - DNA, 25 bp, E. coli
tgatctgctggcagaactccgccgc

SEQ ID NO: 70008 - DNA, 25 bp, E. coli
tgatctgctggctgaactccgccgc

SEQ ID NO: 70009 - DNA, 25 bp, E. coli
tcgccgcggaaaccaacgacgttat

SEQ ID NO: 70010 - DNA, 25 bp, E. coli
tgctggcagaactccgccgcgataa

SEQ ID NO: 70011 - DNA, 25 bp, E. coli
tcgccgcggaaagcaacgacgttat

SEQ ID NO: 70012 - DNA, 25 bp, E. coli
tgctggcagaacaccgccgcgataa

SEQ ID NO: 70013 - DNA, 25 bp, E. coli
gccgcggaaagctacgacgttattg

SEQ ID NO: 70014 - DNA, 25 bp, E. coli
gccttctatgataccccgaccggat

SEQ ID NO: 70015 - DNA, 25 bp, E. coli
gccgcggaaagcaacgacgttattg

SEQ ID NO: 70016 - DNA, 25 bp, E. coli
gccttctatgattccccgaccggat

SEQ ID NO: 70017 - DNA, 25 bp, E. coli
ccgcgataaccaggcaatgcgcgta

SEQ ID NO: 70018 - DNA, 25 bp, E. coli
cgataaccaggctatgcgcgtaatc

SEQ ID NO: 70019 - DNA, 25 bp, E. coli
ccgcgataaccacgcaatgcgcgta

SEQ ID NO: 70020 - DNA, 25 bp, E. coli
cgataaccaggcaatgcgcgtaatc

SEQ ID NO: 70021 - DNA, 25 bp, E. coli
ctggcggccttctatgattccccga

SEQ ID NO: 70022 - DNA, 25 bp, E. coli
ctggcggccttcaatgattccccga

SEQ ID NO: 70023 - DNA, 25 bp, E. coli
aatctcttggtttatgttgtcgtca

SEQ ID NO: 70024 - DNA, 25 bp, E. coli
aatctcttggttaatgttgtcgtca

SEQ ID NO: 70025 - DNA, 25 bp, E. coli
caacgcatggctatttgaaaaagga

SEQ ID NO: 70026 - DNA, 25 bp, E. coli
caacgcatggctttttgaaaaagga

SEQ ID NO: 70027 - DNA, 25 bp, E. coli
catatttgtcatgtaaaccaaacag

SEQ ID NO: 70028 - DNA, 25 bp, E. coli
catatttgtcatctaaaccaaacag

SEQ ID NO: 70029 - DNA, 25 bp, E. coli
tatgttgtcgtctggctcatgccgg

SEQ ID NO: 70030 - DNA, 25 bp, E. coli
tatgttgtcgtcaggctcatgccgg

SEQ ID NO: 70031 - DNA, 25 bp, E. coli
tatatacggcagcaaaacgattttt

SEQ ID NO: 70032 - DNA, 25 bp, E. coli
tatatacggcaggaaaacgattttt

SEQ ID NO: 70033 - DNA, 25 bp, E. coli
tgaaagagcaggtttaactcgacca

SEQ ID NO: 70034 - DNA, 25 bp, E. coli
tgaaagagcaggattaactcgacca

SEQ ID NO: 70035 - DNA, 25 bp, E. coli
tctatactcgcagtgtggcgcggcg

SEQ ID NO: 70036 - DNA, 25 bp, E. coli
tcgtgagttaagcttgaaagagcag

SEQ ID NO: 70037 - DNA, 25 bp, E. coli
tctatactcgcactgtggcgcggcg

SEQ ID NO: 70038 - DNA, 25 bp, E. coli
tcgtgagttaaggttgaaagagcag

SEQ ID NO: 70039 - DNA, 25 bp, E. coli
cgtagcatggcgcaacgcatggcta

SEQ ID NO: 70040 - DNA, 25 bp, E. coli
cgtagcatggcggaacgcatggcta

SEQ ID NO: 70041 - DNA, 25 bp, E. coli
gattttttgcttaagaaatcgtgag

SEQ ID NO: 70042 - DNA, 25 bp, E. coli
gattttttgctttagaaatcgtgag

SEQ ID NO: 70043 - DNA, 25 bp, E. coli
taactcgaccattctctatactcgc

SEQ ID NO: 70044 - DNA, 25 bp, E. coli
taactcgaccatactctatactcgc

SEQ ID NO: 70045 - DNA, 25 bp, E. coli
aagtttgacgataggtgcaggcagt

SEQ ID NO: 70046 - DNA, 25 bp, E. coli
aagtttgacgattggtgcaggcagt

SEQ ID NO: 70047 - DNA, 25 bp, E. coli
caaagtttgacgtttggtgcaggca

SEQ ID NO: 70048 - DNA, 25 bp, E. coli
caaagtttgacgattggtgcaggca

SEQ ID NO: 70049 - DNA, 25 bp, E. coli
agtttgacgattggtgcaggcagta

SEQ ID NO: 70050 - DNA, 25 bp, E. coli
aggcagtagcgcacagcgactggca

SEQ ID NO: 70051 - DNA, 25 bp, E. coli
aggcagtagcgctcagcgactggca

SEQ ID NO: 70052 - DNA, 25 bp, E. coli
agtttgacgattcgtgcaggcagta

SEQ ID NO: 70053 - DNA, 25 bp, E. coli
aaagtttgacgattggtgcaggcag

SEQ ID NO: 70054 - DNA, 25 bp, E. coli
aaagtttgacgaatggtgcaggcag

SEQ ID NO: 70055 - DNA, 25 bp, E. coli
tttgacgattggtgcaggcagtagc

SEQ ID NO: 70056 - DNA, 25 bp, E. coli
ttgacgattggtgcaggcagtagcg

SEQ ID NO: 70057 - DNA, 25 bp, E. coli
ttgacgattggtccaggcagtagcg

SEQ ID NO: 70058 - DNA, 25 bp, E. coli
tttgacgattggagcaggcagtagc

SEQ ID NO: 70059 - DNA, 25 bp, E. coli
ccaaagtttgacgattggtgcaggc

SEQ ID NO: 70060 - DNA, 25 bp, E. coli
ccaaagtttgaccattggtgcaggc

SEQ ID NO: 70061 - DNA, 25 bp, E. coli
gcagtagcgcactgcgactggcaaa

SEQ ID NO: 70062 - DNA, 25 bp, E. coli
gcagtagcgcacagcgactggcaaa

SEQ ID NO: 70063 - DNA, 25 bp, E. coli
gtttgacgattgctgcaggcagtag

SEQ ID NO: 70064 - DNA, 25 bp, E. coli
gtttgacgattggtgcaggcagtag

SEQ ID NO: 70065 - DNA, 25 bp, E. coli
gtgcaggcagtagcgcacagcgact

SEQ ID NO: 70066 - DNA, 25 bp, E. coli
gtgcaggcagtaccgcacagcgact

SEQ ID NO: 70067 - DNA, 25 bp, E. coli
aagtacatgcccgtccggcgatggt

SEQ ID NO: 70068 - DNA, 25 bp, E. coli
aagtacatgcccctccggcgatggt

SEQ ID NO: 70069 - DNA, 25 bp, E. coli
tacgcgctcaggattcactggcatg

SEQ ID NO: 70070 - DNA, 25 bp, E. coli
tacgcgctcaggtttcactggcatg

SEQ ID NO: 70071 - DNA, 25 bp, E. coli
tattcgttggcgtctttcttagcag

SEQ ID NO: 70072 - DNA, 25 bp, E. coli
tattcgttggcgactttcttagcag

SEQ ID NO: 70073 - DNA, 25 bp, E. coli
ttatgccttagcgatgggtttcagc

SEQ ID NO: 70074 - DNA, 25 bp, E. coli
ttatgccttagccatgggtttcagc

SEQ ID NO: 70075 - DNA, 25 bp, E. coli
tcttaatgcgcgttgctgccgtggg

SEQ ID NO: 70076 - DNA, 25 bp, E. coli
tcttaatgcgcgatgctgccgtggg

SEQ ID NO: 70077 - DNA, 25 bp, E. coli
tcttcccgagaatctggccggtgtg

SEQ ID NO: 70078 - DNA, 25 bp, E. coli
tcttcccgagaaactggccggtgtg

SEQ ID NO: 70079 - DNA, 25 bp, E. coli
gcatcgtcgccgagatctggaatta

SEQ ID NO: 70080 - DNA, 25 bp, E. coli
gcatcgtcgccgtgatctggaatta

SEQ ID NO: 70081 - DNA, 25 bp, E. coli
gaaatcgtttgacctgacctcgacg

SEQ ID NO: 70082 - DNA, 25 bp, E. coli
gaaatcgtttgagctgacctcgacg

SEQ ID NO: 70083 - DNA, 25 bp, E. coli
ggattcttctttaccggcagcgctg

SEQ ID NO: 70084 - DNA, 25 bp, E. coli
ggattcttcttttccggcagcgctg

SEQ ID NO: 70085 - DNA, 25 bp, E. coli
taagcgcggcgaacgcaaatcgctg

SEQ ID NO: 70086 - DNA, 25 bp, E. coli
taatgtatctgagcgcagcggtagc

SEQ ID NO: 70087 - DNA, 25 bp, E. coli
taatgtatctgaccgcagcggtagc

SEQ ID NO: 70088 - DNA, 25 bp, E. coli
taagcgcggcgatcgcaaatcgctg

SEQ ID NO: 70089 - DNA, 25 bp, E. coli
atgcaatgaccggccgcgttcgtca

SEQ ID NO: 70090 - DNA, 25 bp, E. coli
atgcaatgaccgcccgcgttcgtca

SEQ ID NO: 70091 - DNA, 25 bp, E. coli
actggatgcaatcaccgcccgcgtt

SEQ ID NO: 70092 - DNA, 25 bp, E. coli
atgctgcgcttggaaaaaacggtag

SEQ ID NO: 70093 - DNA, 25 bp, E. coli
atgctgcgcttgcaaaaaacggtag

SEQ ID NO: 70094 - DNA, 25 bp, E. coli
actggatgcaatgaccgcccgcgtt

SEQ ID NO: 70095 - DNA, 25 bp, E. coli
aactggatgcaatgaccgcccgcgt

SEQ ID NO: 70096 - DNA, 25 bp, E. coli
aactggatgcaaagaccgcccgcgt

SEQ ID NO: 70097 - DNA, 25 bp, E. coli
tgcgcttgcaaaaaacggtagaaga

SEQ ID NO: 70098 - DNA, 25 bp, E. coli
tgcgcttgcaaataacggtagaaga

SEQ ID NO: 70099 - DNA, 25 bp, E. coli
gcgcttgcaaaatacggtagaagaa

SEQ ID NO: 70100 - DNA, 25 bp, E. coli
gcttgcaaaaaacggtagaagaacg

SEQ ID NO: 70101 - DNA, 25 bp, E. coli
gcgcttgcaaaaaacggtagaagaa

SEQ ID NO: 70102 - DNA, 25 bp, E. coli
gctgcgcttgcataaaacggtagaa

SEQ ID NO: 70103 - DNA, 25 bp, E. coli
gcttgcaaaaaagggtagaagaacg

SEQ ID NO: 70104 - DNA, 25 bp, E. coli
gctgcgcttgcaaaaaacggtagaa

SEQ ID NO: 70105 - DNA, 25 bp, E. coli
ctgcgcttgcaataaacggtagaag

SEQ ID NO: 70106 - DNA, 25 bp, E. coli
ctgcgcttgcaaaaaacggtagaag

SEQ ID NO: 70107 - DNA, 25 bp, E. coli
tggatgcaatgagcgcccgcgttcg

SEQ ID NO: 70108 - DNA, 25 bp, E. coli
tggatgcaatgaccgcccgcgttcg

SEQ ID NO: 70109 - DNA, 25 bp, E. coli
gatgctgcgcttccaaaaaacggta

SEQ ID NO: 70110 - DNA, 25 bp, E. coli
gatgctgcgcttgcaaaaaacggta

SEQ ID NO: 70111 - DNA, 25 bp, E. coli
catcgttgaagaacactggcatcgc

SEQ ID NO: 70112 - DNA, 25 bp, E. coli
catcgttgaagatcactggcatcgc

SEQ ID NO: 70113 - DNA, 25 bp, E. coli
agaacactggcatcgcgctggtgct

SEQ ID NO: 70114 - DNA, 25 bp, E. coli
agaacactggcaacgcgctggtgct

SEQ ID NO: 70115 - DNA, 25 bp, E. coli
aaaatcggccaaatcgcgatgggtc

SEQ ID NO: 70116 - DNA, 25 bp, E. coli
aaaatcggccaattcgcgatgggtc

SEQ ID NO: 70117 - DNA, 25 bp, E. coli
tagccgtaccactgatggttgcgcg

SEQ ID NO: 70118 - DNA, 25 bp, E. coli
tagccgtaccacagatggttgcgcg

SEQ ID NO: 70119 - DNA, 25 bp, E. coli
tttgcccgccatcgttgaagaacac

SEQ ID NO: 70120 - DNA, 25 bp, E. coli
tttgcccgccatggttgaagaacac

SEQ ID NO: 70121 - DNA, 25 bp, E. coli
tgcccgccatcgttgaagaacactg

SEQ ID NO: 70122 - DNA, 25 bp, E. coli
tgcccgccatcgatgaagaacactg

SEQ ID NO: 70123 - DNA, 25 bp, E. coli
gccaaaatagccctaccactgatgg

SEQ ID NO: 70124 - DNA, 25 bp, E. coli
gccaaaatagccgtaccactgatgg

SEQ ID NO: 70125 - DNA, 25 bp, E. coli
ccactgatggttccgcgctttatca

SEQ ID NO: 70126 - DNA, 25 bp, E. coli
ccactgatggttgcgcgctttatca

SEQ ID NO: 70127 - DNA, 25 bp, E. coli
gaaattgccaaaatagccgtaccac

SEQ ID NO: 70128 - DNA, 25 bp, E. coli
gaaattgccaaattagccgtaccac

SEQ ID NO: 70129 - DNA, 25 bp, E. coli
cgtaaaatcggcgaaatcgcgatgg

SEQ ID NO: 70130 - DNA, 25 bp, E. coli
cgtaaaatcggccaaatcgcgatgg

SEQ ID NO: 70131 - DNA, 25 bp, E. coli
ggccaaatcgcgttgggtctggtca

SEQ ID NO: 70132 - DNA, 25 bp, E. coli
ggccaaatcgcgatgggtctggtca

SEQ ID NO: 70133 - DNA, 25 bp, E. coli
aatttgcacatatgaacacgatttc

SEQ ID NO: 70134 - DNA, 25 bp, E. coli
aatttgcacataagaacacgatttc

SEQ ID NO: 70135 - DNA, 25 bp, E. coli
caacaaatttgcacatatgaacacg

SEQ ID NO: 70136 - DNA, 25 bp, E. coli
caacaaatttgctcatatgaacacg

SEQ ID NO: 70137 - DNA, 25 bp, E. coli
aggtggcatcacgggcgctcaccga

SEQ ID NO: 70138 - DNA, 25 bp, E. coli
aggtggcatcaccggcgctcaccga

SEQ ID NO: 70139 - DNA, 25 bp, E. coli
actggaaggcgcacaggtggcatca

SEQ ID NO: 70140 - DNA, 25 bp, E. coli
actggaaggcgctcaggtggcatca

SEQ ID NO: 70141 - DNA, 25 bp, E. coli
ttacgggcaaacccaacggcacgcg

SEQ ID NO: 70142 - DNA, 25 bp, E. coli
ttacgggcaaacgcaacggcacgcg

SEQ ID NO: 70143 - DNA, 25 bp, E. coli
tgacgaaccgctttcactggaaggc

SEQ ID NO: 70144 - DNA, 25 bp, E. coli
tgacgaaccgctatcactggaaggc

SEQ ID NO: 70145 - DNA, 25 bp, E. coli
gccgcgttatggcaacaaatttgca

SEQ ID NO: 70146 - DNA, 25 bp, E. coli
gccgcgttatgggaacaaatttgca

SEQ ID NO: 70147 - DNA, 25 bp, E. coli
gcacgcgccgcgatatggcaacaaa

SEQ ID NO: 70148 - DNA, 25 bp, E. coli
gcacgcgccgcgttatggcaacaaa

SEQ ID NO: 70149 - DNA, 25 bp, E. coli
cgctatcactggaaggcgctcaggt

SEQ ID NO: 70150 - DNA, 25 bp, E. coli
cgctatcactggtaggcgctcaggt

SEQ ID NO: 70151 - DNA, 25 bp, E. coli
ggttgggtactgtcgaaccgctatc

SEQ ID NO: 70152 - DNA, 25 bp, E. coli
ggttgggtactgacgaaccgctatc

SEQ ID NO: 70153 - DNA, 25 bp, E. coli
ggtactgacgaagcgctatcactgg

SEQ ID NO: 70154 - DNA, 25 bp, E. coli
ggtactgacgaaccgctatcactgg

SEQ ID NO: 70155 - DNA, 25 bp, E. coli
caaaaactgaaccttgccctgaccg

SEQ ID NO: 70156 - DNA, 25 bp, E. coli
caaaaactgaacgttgccctgaccg

SEQ ID NO: 70157 - DNA, 25 bp, E. coli
tacagcctggtgtgacatgggcgat

SEQ ID NO: 70158 - DNA, 25 bp, E. coli
tacagcctggtgagacatgggcgat

SEQ ID NO: 70159 - DNA, 25 bp, E. coli
acccgcagccgttgaattagcgcca

SEQ ID NO: 70160 - DNA, 25 bp, E. coli
acccgcagccgtagaattagcgcca

SEQ ID NO: 70161 - DNA, 25 bp, E. coli
aaatggcgagaaccctaaacaggtg

SEQ ID NO: 70162 - DNA, 25 bp, E. coli
aaatggcgagaagcctaaacaggtg

SEQ ID NO: 70163 - DNA, 25 bp, E. coli
tatcaggtaccgcaaccgatggtgg

SEQ ID NO: 70164 - DNA, 25 bp, E. coli
tatcaggtaccggaaccgatggtgg

SEQ ID NO: 70165 - DNA, 25 bp, E. coli
ttgaactggtcaccgattcacccgc

SEQ ID NO: 70166 - DNA, 25 bp, E. coli
ttgaactggtcagcgattcacccgc

SEQ ID NO: 70167 - DNA, 25 bp, E. coli
tccgcgttaagccagaatctctgcc

SEQ ID NO: 70168 - DNA, 25 bp, E. coli
tccgcgttaagcgagaatctctgcc

SEQ ID NO: 70169 - DNA, 25 bp, E. coli
tctgccagcattgattagccaatgg

SEQ ID NO: 70170 - DNA, 25 bp, E. coli
tctgccagcattcattagccaatgg

SEQ ID NO: 70171 - DNA, 25 bp, E. coli
tcagcaaaaggcaccgctgggtgcg

SEQ ID NO: 70172 - DNA, 25 bp, E. coli
tcagcaaaaggctccgctgggtgcg

SEQ ID NO: 70173 - DNA, 25 bp, E. coli
gaagtccaacttgatggtgcagcca

SEQ ID NO: 70174 - DNA, 25 bp, E. coli
gaagtccaacttcatggtgcagcca

SEQ ID NO: 70175 - DNA, 25 bp, E. coli
cgattccggcggttggattgcaaaa

SEQ ID NO: 70176 - DNA, 25 bp, E. coli
cgattccggcggatggattgcaaaa

SEQ ID NO: 70177 - DNA, 25 bp, E. coli
catccttatcggagggctggtgcta

SEQ ID NO: 70178 - DNA, 25 bp, E. coli
catccttatcggtgggctggtgcta

SEQ ID NO: 70179 - DNA, 25 bp, E. coli
catcatgggagatactggcggtgct

SEQ ID NO: 70180 - DNA, 25 bp, E. coli
catcatgggagaaactggcggtgct

SEQ ID NO: 70181 - DNA, 25 bp, E. coli
taaagactttgaagcatccgtccgg

SEQ ID NO: 70182 - DNA, 25 bp, E. coli
tatcgtttgggacatccgtttgccc

SEQ ID NO: 70183 - DNA, 25 bp, E. coli
tatcgtttgggagatccgtttgccc

SEQ ID NO: 70184 - DNA, 25 bp, E. coli
taaagactttgatgcatccgtccgg

SEQ ID NO: 70185 - DNA, 25 bp, E. coli
tattggaaagtacgctgtcggtcga

SEQ ID NO: 70186 - DNA, 25 bp, E. coli
tattggaaagtaggctgtcggtcga

SEQ ID NO: 70187 - DNA, 25 bp, E. coli
tgaagatactttccagggcctggtg

SEQ ID NO: 70188 - DNA, 25 bp, E. coli
tgctcgatagtcagacccgctggac

SEQ ID NO: 70189 - DNA, 25 bp, E. coli
tgaagatactttgcagggcctggtg

SEQ ID NO: 70190 - DNA, 25 bp, E. coli
tgctcgatagtctgacccgctggac

SEQ ID NO: 70191 - DNA, 25 bp, E. coli
ccattatgcagtatgtcgccgatga

SEQ ID NO: 70192 - DNA, 25 bp, E. coli
gcctcggtagcgtcgaagaacatca

SEQ ID NO: 70193 - DNA, 25 bp, E. coli
gcctcggtagcgacgaagaacatca

SEQ ID NO: 70194 - DNA, 25 bp, E. coli
ccattatgcagtttgtcgccgatga

SEQ ID NO: 70195 - DNA, 25 bp, E. coli
ccgcctgttgctcggagaagatcat

SEQ ID NO: 70196 - DNA, 25 bp, E. coli
ccgcctgttgctgggagaagatcat

SEQ ID NO: 70197 - DNA, 25 bp, E. coli
gatcatcgctttaatttgcccggaa

SEQ ID NO: 70198 - DNA, 25 bp, E. coli
gatcatcgcttttatttgcccggaa

SEQ ID NO: 70199 - DNA, 25 bp, E. coli
cagtaccgattgtagaagcctccgc

SEQ ID NO: 70200 - DNA, 25 bp, E. coli
cagtaccgattgaagaagcctccgc

SEQ ID NO: 70201 - DNA, 25 bp, E. coli
tactggaaagcgtacctcgatctgg

SEQ ID NO: 70202 - DNA, 25 bp, E. coli
tactggaaagcgaacctcgatctgg

SEQ ID NO: 70203 - DNA, 25 bp, E. coli
tatcgttcagaagaaggcatcgtgc

SEQ ID NO: 70204 - DNA, 25 bp, E. coli
tatcgttcagaacaaggcatcgtgc

SEQ ID NO: 70205 - DNA, 25 bp, E. coli
tgattcccaagatcaccgaagccgg

SEQ ID NO: 70206 - DNA, 25 bp, E. coli
tgattcccaagaacaccgaagccgg

SEQ ID NO: 70207 - DNA, 25 bp, E. coli
tgaactgctggatgaagacgatcgc

SEQ ID NO: 70208 - DNA, 25 bp, E. coli
tgaactgctggaagaagacgatcgc

SEQ ID NO: 70209 - DNA, 25 bp, E. coli
tcgaaaaaggcgcacgttgcaccgt

SEQ ID NO: 70210 - DNA, 25 bp, E. coli
tcgaaaaaggcggacgttgcaccgt

SEQ ID NO: 70211 - DNA, 25 bp, E. coli
gctgtctaactggatcaactccggg

SEQ ID NO: 70212 - DNA, 25 bp, E. coli
gctgtctaactgcatcaactccggg

SEQ ID NO: 70213 - DNA, 25 bp, E. coli
gaaattcgtgcacgatcgctccggt

SEQ ID NO: 70214 - DNA, 25 bp, E. coli
gaaattcgtgcaggatcgctccggt

SEQ ID NO: 70215 - DNA, 25 bp, E. coli
cgagtttgtcgatctgctgccagca

SEQ ID NO: 70216 - DNA, 25 bp, E. coli
cgagtttgtcgaactgctgccagca

SEQ ID NO: 70217 - DNA, 25 bp, E. coli
gatcacttaatgttggcgcgccagc

SEQ ID NO: 70218 - DNA, 25 bp, E. coli
gatcacttaatgatggcgcgccagc

SEQ ID NO: 70219 - DNA, 25 bp, E. coli
ggcgggcgaccaaatctacaagcaa

SEQ ID NO: 70220 - DNA, 25 bp, E. coli
ggcgggcgaccatatctacaagcaa

SEQ ID NO: 70221 - DNA, 25 bp, E. coli
tacaaaatcgtggaggatccgtctc

SEQ ID NO: 70222 - DNA, 25 bp, E. coli
tacaagcgatgaaggtcagcaacag

SEQ ID NO: 70223 - DNA, 25 bp, E. coli
tacaaaatcgtgcaggatccgtctc

SEQ ID NO: 70224 - DNA, 25 bp, E. coli
tacaagcgatgatggtcagcaacag

SEQ ID NO: 70225 - DNA, 25 bp, E. coli
taccaacagcaactgggacagaagt

SEQ ID NO: 70226 - DNA, 25 bp, E. coli
taccaacagcaagtgggacagaagt

SEQ ID NO: 70227 - DNA, 25 bp, E. coli
gcgatcaggctcctgcgcaacagta

SEQ ID NO: 70228 - DNA, 25 bp, E. coli
gctaaaaagcgaagatccgaccggc

SEQ ID NO: 70229 - DNA, 25 bp, E. coli
gctaaaaagcgatgatccgaccggc

SEQ ID NO: 70230 - DNA, 25 bp, E. coli
gcgatcaggctcgtgcgcaacagta

SEQ ID NO: 70231 - DNA, 25 bp, E. coli
gcaaatcaggataaccagcgcgacg

SEQ ID NO: 70232 - DNA, 25 bp, E. coli
gaatcactaacctggctaacgggcg

SEQ ID NO: 70233 - DNA, 25 bp, E. coli
gcaaatcaggattaccagcgcgacg

SEQ ID NO: 70234 - DNA, 25 bp, E. coli
gaatcactaaccaggctaacgggcg

SEQ ID NO: 70235 - DNA, 25 bp, E. coli
gaatgctcgcgggatgtacaagcga

SEQ ID NO: 70236 - DNA, 25 bp, E. coli
gaatgctcgcggcatgtacaagcga

SEQ ID NO: 70237 - DNA, 25 bp, E. coli
gaagccagtaccttgcagcaacgtt

SEQ ID NO: 70238 - DNA, 25 bp, E. coli
gaagccagtaccatgcagcaacgtt

SEQ ID NO: 70239 - DNA, 25 bp, E. coli
cgtaactcaaaatggcgcggtctgg

SEQ ID NO: 70240 - DNA, 25 bp, E. coli
cgtaactcaaaaaggcgcggtctgg

SEQ ID NO: 70241 - DNA, 25 bp, E. coli
tttcgaaccactcaacgcgacggca

SEQ ID NO: 70242 - DNA, 25 bp, E. coli
tttcgaaccactgaacgcgacggca

SEQ ID NO: 70243 - DNA, 25 bp, E. coli
aacgcgctccttcgtctggcaaatg

SEQ ID NO: 70244 - DNA, 25 bp, E. coli
aacgcgctccttggtctggcaaatg

SEQ ID NO: 70245 - DNA, 25 bp, E. coli
catgccatatggcttgcgggttccc

SEQ ID NO: 70246 - DNA, 25 bp, E. coli
catgccatatgggttgcgggttccc

SEQ ID NO: 70247 - DNA, 25 bp, E. coli
tgatgaaaaagcatttggagccgcg

SEQ ID NO: 70248 - DNA, 25 bp, E. coli
tgatgaaaaagcttttggagccgcg

SEQ ID NO: 70249 - DNA, 25 bp, E. coli
gcccgactacgcttctttgataaaa

SEQ ID NO: 70250 - DNA, 25 bp, E. coli
gcccgactacgcatctttgataaaa

SEQ ID NO: 70251 - DNA, 25 bp, E. coli
gaaaaaacgatcacctgtagctgaa

SEQ ID NO: 70252 - DNA, 25 bp, E. coli
gaaatacaacaacaacccatcggga

SEQ ID NO: 70253 - DNA, 25 bp, E. coli
gaaatacaacaagaacccatcggga

SEQ ID NO: 70254 - DNA, 25 bp, E. coli
gaaaaaacgatctcctgtagctgaa

SEQ ID NO: 70255 - DNA, 25 bp, E. coli
cccatcgggacaacaagagtactta

SEQ ID NO: 70256 - DNA, 25 bp, E. coli
cgaagagcattaccggatttcagga

SEQ ID NO: 70257 - DNA, 25 bp, E. coli
cccatcgggacatcaagagtactta

SEQ ID NO: 70258 - DNA, 25 bp, E. coli
cgaagagcattagcggatttcagga

SEQ ID NO: 70259 - DNA, 25 bp, E. coli
ggagccgcgaaatttaccagtgtct

SEQ ID NO: 70260 - DNA, 25 bp, E. coli
ggagccgcgaaaattaccagtgtct

SEQ ID NO: 70261 - DNA, 25 bp, E. coli
tggcttacgggaaacagaataccct

SEQ ID NO: 70262 - DNA, 25 bp, E. coli
tggcttacgggatacagaataccct

SEQ ID NO: 70263 - DNA, 25 bp, E. coli
tcaaaacagcatcagaagcccgact

SEQ ID NO: 70264 - DNA, 25 bp, E. coli
tcaaaacagcatgagaagcccgact

SEQ ID NO: 70265 - DNA, 25 bp, E. coli
aattatttctgcctgtatgctgact

SEQ ID NO: 70266 - DNA, 25 bp, E. coli
aattatttctgcgtgtatgctgact

SEQ ID NO: 70267 - DNA, 25 bp, E. coli
cagactgataaccataccggtatga

SEQ ID NO: 70268 - DNA, 25 bp, E. coli
cagactgataacgataccggtatga

SEQ ID NO: 70269 - DNA, 25 bp, E. coli
taaagacgctaatggcaacaaacag

SEQ ID NO: 70270 - DNA, 25 bp, E. coli
taaagacgctaaaggcaacaaacag

SEQ ID NO: 70271 - DNA, 25 bp, E. coli
aaagactgccgctattatttctgcc

SEQ ID NO: 70272 - DNA, 25 bp, E. coli
aaagactgccgcaattatttctgcc

SEQ ID NO: 70273 - DNA, 25 bp, E. coli
tgtgatgcacaccaatgacggacgt

SEQ ID NO: 70274 - DNA, 25 bp, E. coli
tgtgatgcacacgaatgacggacgt

SEQ ID NO: 70275 - DNA, 25 bp, E. coli
tgacggcaaacctcagactgataac

SEQ ID NO: 70276 - DNA, 25 bp, E. coli
tgacggcaaaccacagactgataac

SEQ ID NO: 70277 - DNA, 25 bp, E. coli
tccggttcgaactatgtgatgcaca

SEQ ID NO: 70278 - DNA, 25 bp, E. coli
tccggttcgaacaatgtgatgcaca

SEQ ID NO: 70279 - DNA, 25 bp, E. coli
gacgtaccatcgactctgacggcaa

SEQ ID NO: 70280 - DNA, 25 bp, E. coli
gacgtaccatcgtctctgacggcaa

SEQ ID NO: 70281 - DNA, 25 bp, E. coli
ccggtatgatttcgtataaagacgc

SEQ ID NO: 70282 - DNA, 25 bp, E. coli
ccggtatgatttggtataaagacgc

SEQ ID NO: 70283 - DNA, 25 bp, E. coli
cgtgaaagagatggtcgaactggat

SEQ ID NO: 70284 - DNA, 25 bp, E. coli
cgtgaaagagatcgtcgaactggat

SEQ ID NO: 70285 - DNA, 25 bp, E. coli
tggcaacaaacagcagatcaaccgt

SEQ ID NO: 70286 - DNA, 25 bp, E. coli
tggcaacaaacaccagatcaaccgt

SEQ ID NO: 70287 - DNA, 25 bp, E. coli
caaccaatattagcgggatgtcaca

SEQ ID NO: 70288 - DNA, 25 bp, E. coli
caaccaatattaccgggatgtcaca

SEQ ID NO: 70289 - DNA, 25 bp, E. coli
caaactatgtttaccgtgaagcgca

SEQ ID NO: 70290 - DNA, 25 bp, E. coli
caaactatgttttccgtgaagcgca

SEQ ID NO: 70291 - DNA, 25 bp, E. coli
tacaccagtgaatgcatcgagcgtt

SEQ ID NO: 70292 - DNA, 25 bp, E. coli
tacaccagtgaaagcatcgagcgtt

SEQ ID NO: 70293 - DNA, 25 bp, E. coli
taccgaccgggattggcaatatcag

SEQ ID NO: 70294 - DNA, 25 bp, E. coli
taccgaccgggaatggcaatatcag

SEQ ID NO: 70295 - DNA, 25 bp, E. coli
ttaggacacattacccaggctgtag

SEQ ID NO: 70296 - DNA, 25 bp, E. coli
ttaggacacatttcccaggctgtag

SEQ ID NO: 70297 - DNA, 25 bp, E. coli
tgaacccagcgattgagtccgatgc

SEQ ID NO: 70298 - DNA, 25 bp, E. coli
tgaacccagcgaatgagtccgatgc

SEQ ID NO: 70299 - DNA, 25 bp, E. coli
tctgctgagaaccaaccctgcggta

SEQ ID NO: 70300 - DNA, 25 bp, E. coli
tctgctgagaacgaaccctgcggta

SEQ ID NO: 70301 - DNA, 25 bp, E. coli
cctatgtgattaatgctgccggaaa

SEQ ID NO: 70302 - DNA, 25 bp, E. coli
cctatgtgattattgctgccggaaa

SEQ ID NO: 70303 - DNA, 25 bp, E. coli
ggatttcacgcatcaaccgagcggg

SEQ ID NO: 70304 - DNA, 25 bp, E. coli
ggatttcacgcaacaaccgagcggg

SEQ ID NO: 70305 - DNA, 25 bp, E. coli
tcacccgcgcggattatgtttcgaa

SEQ ID NO: 70306 - DNA, 25 bp, E. coli
tcaatgtactggatagcaaaaccgc

SEQ ID NO: 70307 - DNA, 25 bp, E. coli
tcacccgcgcggtttatgtttcgaa

SEQ ID NO: 70308 - DNA, 25 bp, E. coli
tcaatgtactggttagcaaaaccgc

SEQ ID NO: 70309 - DNA, 25 bp, E. coli
cagaacttctatccgtcgccgctgg

SEQ ID NO: 70310 - DNA, 25 bp, E. coli
cagaacttctatgcgtcgccgctgg

SEQ ID NO: 70311 - DNA, 25 bp, E. coli
taaaaagatcctgattgcctctggt

SEQ ID NO: 70312 - DNA, 25 bp, E. coli
taaaaagatcctcattgcctctggt

SEQ ID NO: 70313 - DNA, 25 bp, E. coli
aaagatcctgattgcctctggtgtg

SEQ ID NO: 70314 - DNA, 25 bp, E. coli
aaagatcctgatagcctctggtgtg

SEQ ID NO: 70315 - DNA, 25 bp, E. coli
ttgcctctggtgtgcgttatgacat

SEQ ID NO: 70316 - DNA, 25 bp, E. coli
ttgcctctggtgagcgttatgacat

SEQ ID NO: 70317 - DNA, 25 bp, E. coli
cctgattgcctcaggtgtgcgttat

SEQ ID NO: 70318 - DNA, 25 bp, E. coli
cctgattgcctctggtgtgcgttat

SEQ ID NO: 70319 - DNA, 25 bp, E. coli
gcttccgcctcgaccaggtgcagaa

SEQ ID NO: 70320 - DNA, 25 bp, E. coli
gcttccgcctcgtccaggtgcagaa

SEQ ID NO: 70321 - DNA, 25 bp, E. coli
cctcgaccaggtgcagaacttctat

SEQ ID NO: 70322 - DNA, 25 bp, E. coli
cctcgaccaggtccagaacttctat

SEQ ID NO: 70323 - DNA, 25 bp, E. coli
gattgcctctggtgtgcgttatgac

SEQ ID NO: 70324 - DNA, 25 bp, E. coli
gattgcctctggagtgcgttatgac

SEQ ID NO: 70325 - DNA, 25 bp, E. coli
ggtgcagaacttctatccgtcgccg

SEQ ID NO: 70326 - DNA, 25 bp, E. coli
ggtgcagaacttgtatccgtcgccg

SEQ ID NO: 70327 - DNA, 25 bp, E. coli
gatcctgattgcctctggtgtgcgt

SEQ ID NO: 70328 - DNA, 25 bp, E. coli
gaccaggtgcagtacttctatccgt

SEQ ID NO: 70329 - DNA, 25 bp, E. coli
gaccaggtgcagaacttctatccgt

SEQ ID NO: 70330 - DNA, 25 bp, E. coli
gatcctgattgcgtctggtgtgcgt

SEQ ID NO: 70331 - DNA, 25 bp, E. coli
caaaattggtaagtgaatcggttca

SEQ ID NO: 70332 - DNA, 25 bp, E. coli
caagaataatggtatgcggcagcga

SEQ ID NO: 70333 - DNA, 25 bp, E. coli
caaaattggtaactgaatcggttca

SEQ ID NO: 70334 - DNA, 25 bp, E. coli
caagaataatggaatgcggcagcga

SEQ ID NO: 70335 - DNA, 25 bp, E. coli
cacccgctttatgcatggttgaaga

SEQ ID NO: 70336 - DNA, 25 bp, E. coli
cacagacatgaatttggtaagacca

SEQ ID NO: 70337 - DNA, 25 bp, E. coli
cacccgctttatccatggttgaaga

SEQ ID NO: 70338 - DNA, 25 bp, E. coli
cacagacatgaaattggtaagacca

SEQ ID NO: 70339 - DNA, 25 bp, E. coli
cagtgatgcgtgagtaagtttgcaa

SEQ ID NO: 70340 - DNA, 25 bp, E. coli
cagtgatgcgtgtgtaagtttgcaa

SEQ ID NO: 70341 - DNA, 25 bp, E. coli
tgttactttagcgtcacagacatga

SEQ ID NO: 70342 - DNA, 25 bp, E. coli
tgttactttagcctcacagacatga

SEQ ID NO: 70343 - DNA, 25 bp, E. coli
gaaaccgtttgttaagctcagcctc

SEQ ID NO: 70344 - DNA, 25 bp, E. coli
gacttccgtcagttcaagaataatg

SEQ ID NO: 70345 - DNA, 25 bp, E. coli
gaaaccgtttgtaaagctcagcctc

SEQ ID NO: 70346 - DNA, 25 bp, E. coli
gacttccgtcagatcaagaataatg

SEQ ID NO: 70347 - DNA, 25 bp, E. coli
gatttcaatcaaaacctgtatggac

SEQ ID NO: 70348 - DNA, 25 bp, E. coli
gatttcaatcaatacctgtatggac

SEQ ID NO: 70349 - DNA, 25 bp, E. coli
ggtaagaccaatagacttcggcaag

SEQ ID NO: 70350 - DNA, 25 bp, E. coli
ggtaagaccaattgacttcggcaag

SEQ ID NO: 70351 - DNA, 25 bp, E. coli
tcaacccctctcaatatgtagaatg

SEQ ID NO: 70352 - DNA, 25 bp, E. coli
tcaacccctctctatatgtagaatg

SEQ ID NO: 70353 - DNA, 25 bp, E. coli
caaaatcctggctggctcagaacga

SEQ ID NO: 70354 - DNA, 25 bp, E. coli
caaagaggtcatcaatctggtatga

SEQ ID NO: 70355 - DNA, 25 bp, E. coli
caaaatcctggcaggctcagaacga

SEQ ID NO: 70356 - DNA, 25 bp, E. coli
caaagaggtcatgaatctggtatga

SEQ ID NO: 70357 - DNA, 25 bp, E. coli
tgtggccacaaattcctggctggct

SEQ ID NO: 70358 - DNA, 25 bp, E. coli
tgtatgtggccagaaaatcctggct

SEQ ID NO: 70359 - DNA, 25 bp, E. coli
tgtggccacaaaatcctggctggct

SEQ ID NO: 70360 - DNA, 25 bp, E. coli
tgtatgtggccacaaaatcctggct

SEQ ID NO: 70361 - DNA, 25 bp, E. coli
tgagcaaagaggacatcaatctggt

SEQ ID NO: 70362 - DNA, 25 bp, E. coli
tgagcaaagaggtcatcaatctggt

SEQ ID NO: 70363 - DNA, 25 bp, E. coli
tcctggctggctcagaacgaagagc

SEQ ID NO: 70364 - DNA, 25 bp, E. coli
tcctggctggctgagaacgaagagc

SEQ ID NO: 70365 - DNA, 25 bp, E. coli
gccacaaaatccaggctggctcaga

SEQ ID NO: 70366 - DNA, 25 bp, E. coli
gccacaaaatcctggctggctcaga

SEQ ID NO: 70367 - DNA, 25 bp, E. coli
gctggctcagaacgaagagcatctg

SEQ ID NO: 70368 - DNA, 25 bp, E. coli
gcatctgagcaaagaggtcatcaat

SEQ ID NO: 70369 - DNA, 25 bp, E. coli
gctggctcagaaggaagagcatctg

SEQ ID NO: 70370 - DNA, 25 bp, E. coli
gaagagcatctgagcaaagaggtca

SEQ ID NO: 70371 - DNA, 25 bp, E. coli
gaagagcatctgtgcaaagaggtca

SEQ ID NO: 70372 - DNA, 25 bp, E. coli
gcatctgagcaatgaggtcatcaat

SEQ ID NO: 70373 - DNA, 25 bp, E. coli
gaacgaagagcaactgagcaaagag

SEQ ID NO: 70374 - DNA, 25 bp, E. coli
gaacgaagagcatctgagcaaagag

SEQ ID NO: 70375 - DNA, 25 bp, E. coli
aattgaggaatctcgaggagcagca

SEQ ID NO: 70376 - DNA, 25 bp, E. coli
aattgaggaatcacgaggagcagca

SEQ ID NO: 70377 - DNA, 25 bp, E. coli
cagcgaattgagcaatcacgaggag

SEQ ID NO: 70378 - DNA, 25 bp, E. coli
cagcgaattgaggaatcacgaggag

SEQ ID NO: 70379 - DNA, 25 bp, E. coli
cagcagcgaattcaggaatcacgag

SEQ ID NO: 70380 - DNA, 25 bp, E. coli
cagcagcgaattgaggaatcacgag

SEQ ID NO: 70381 - DNA, 25 bp, E. coli
ttgaggaatcacgaggagcagcagc

SEQ ID NO: 70382 - DNA, 25 bp, E. coli
ttgaggaatcaccaggagcagcagc

SEQ ID NO: 70383 - DNA, 25 bp, E. coli
tgcagcagcgaaatgaggaatcacg

SEQ ID NO: 70384 - DNA, 25 bp, E. coli
tgcagcagcgaattgaggaatcacg

SEQ ID NO: 70385 - DNA, 25 bp, E. coli
gcgaattgaggattcacgaggagca

SEQ ID NO: 70386 - DNA, 25 bp, E. coli
gcgaattgaggaatcacgaggagca

SEQ ID NO: 70387 - DNA, 25 bp, E. coli
gcagcgaattgaggaatcacgagga

SEQ ID NO: 70388 - DNA, 25 bp, E. coli
gcagcagcgaattgaggaatcacga

SEQ ID NO: 70389 - DNA, 25 bp, E. coli
gcagcgaattgacgaatcacgagga

SEQ ID NO: 70390 - DNA, 25 bp, E. coli
gcagcagcgaatagaggaatcacga

SEQ ID NO: 70391 - DNA, 25 bp, E. coli
ggaatcacgaggagcagcagcatga

SEQ ID NO: 70392 - DNA, 25 bp, E. coli
ggaatcacgaggtgcagcagcatga

SEQ ID NO: 70393 - DNA, 25 bp, E. coli
gaggaatcacgacgagcagcagcat

SEQ ID NO: 70394 - DNA, 25 bp, E. coli
gaggaatcacgaggagcagcagcat

SEQ ID NO: 70395 - DNA, 25 bp, E. coli
gatgcagcagcgtattgaggaatca

SEQ ID NO: 70396 - DNA, 25 bp, E. coli
gatgcagcagcgaattgaggaatca

SEQ ID NO: 70397 - DNA, 25 bp, E. coli
aacgcttatagtctcgtgtcacaca

SEQ ID NO: 70398 - DNA, 25 bp, E. coli
caccctactcagcaaggatgcagtt

SEQ ID NO: 70399 - DNA, 25 bp, E. coli
caccctactcaggaaggatgcagtt

SEQ ID NO: 70400 - DNA, 25 bp, E. coli
tacatcagaggatgtgatactcact

SEQ ID NO: 70401 - DNA, 25 bp, E. coli
tacatcagaggaagtgatactcact

SEQ ID NO: 70402 - DNA, 25 bp, E. coli
aaaaagtctggaccgatagcagtgc

SEQ ID NO: 70403 - DNA, 25 bp, E. coli
aaaaagtctggagcgatagcagtgc

SEQ ID NO: 70404 - DNA, 25 bp, E. coli
aacgcttatagtgtcgtgtcacaca

SEQ ID NO: 70405 - DNA, 25 bp, E. coli
ttttcgtgaaatcagctcagcgacg

SEQ ID NO: 70406 - DNA, 25 bp, E. coli
ttttcgtgaaatgagctcagcgacg

SEQ ID NO: 70407 - DNA, 25 bp, E. coli
tgatgttatcagtacggtgccccgt

SEQ ID NO: 70408 - DNA, 25 bp, E. coli
tgatgttatcagaacggtgccccgt

SEQ ID NO: 70409 - DNA, 25 bp, E. coli
gcggattttatgctttcacctgtag

SEQ ID NO: 70410 - DNA, 25 bp, E. coli
gcggattttatggtttcacctgtag

SEQ ID NO: 70411 - DNA, 25 bp, E. coli
gcaacaaatgattgcatgagcggat

SEQ ID NO: 70412 - DNA, 25 bp, E. coli
gaagagaatggtacccacactgaaa

SEQ ID NO: 70413 - DNA, 25 bp, E. coli
gaagagaatggttcccacactgaaa

SEQ ID NO: 70414 - DNA, 25 bp, E. coli
gcaacaaatgatagcatgagcggat

SEQ ID NO: 70415 - DNA, 25 bp, E. coli
gatagcagtgccgatgtcgcaacca

SEQ ID NO: 70416 - DNA, 25 bp, E. coli
gatactcacttaacctgcgggaaaa

SEQ ID NO: 70417 - DNA, 25 bp, E. coli
gatagcagtgcccatgtcgcaacca

SEQ ID NO: 70418 - DNA, 25 bp, E. coli
gatactcacttatcctgcgggaaaa

SEQ ID NO: 70419 - DNA, 25 bp, E. coli
taaagatctgcgacagttcccgaac

SEQ ID NO: 70420 - DNA, 25 bp, E. coli
taaagatctgcgtcagttcccgaac

SEQ ID NO: 70421 - DNA, 25 bp, E. coli
tagcgacgagctccgtgacaaagtc

SEQ ID NO: 70422 - DNA, 25 bp, E. coli
tagcgacgagctgcgtgacaaagtc

SEQ ID NO: 70423 - DNA, 25 bp, E. coli
tattgcgttccccaaaggtagcgac

SEQ ID NO: 70424 - DNA, 25 bp, E. coli
tattgcgttcccgaaaggtagcgac

SEQ ID NO: 70425 - DNA, 25 bp, E. coli
tttgacgttgatgtgtgggctgcca

SEQ ID NO: 70426 - DNA, 25 bp, E. coli
tttgacgttgatctgtgggctgcca

SEQ ID NO: 70427 - DNA, 25 bp, E. coli
tgacggctactagaaaagcggcctg

SEQ ID NO: 70428 - DNA, 25 bp, E. coli
tgacggctactacaaaagcggcctg

SEQ ID NO: 70429 - DNA, 25 bp, E. coli
tctgtacttcatcaaaaccgccggt

SEQ ID NO: 70430 - DNA, 25 bp, E. coli
tctgtacttcatgaaaaccgccggt

SEQ ID NO: 70431 - DNA, 25 bp, E. coli
ccaaaaacgtcgttctggcgctggc

SEQ ID NO: 70432 - DNA, 25 bp, E. coli
ccaaaaacgtcgatctggcgctggc

SEQ ID NO: 70433 - DNA, 25 bp, E. coli
gttgaaaaccctgcgcgagaacgga

SEQ ID NO: 70434 - DNA, 25 bp, E. coli
gttgaaaaccctccgcgagaacgga

SEQ ID NO: 70435 - DNA, 25 bp, E. coli
ggatttcagtgggatcattccggca

SEQ ID NO: 70436 - DNA, 25 bp, E. coli
ggatttcagtggcatcattccggca

SEQ ID NO: 70437 - DNA, 25 bp, E. coli
ggcattaccatctccgacgagcgta

SEQ ID NO: 70438 - DNA, 25 bp, E. coli
ggcattaccatcaccgacgagcgta

SEQ ID NO: 70439 - DNA, 25 bp, E. coli
taacgcctatatcgaactgggcacc

SEQ ID NO: 70440 - DNA, 25 bp, E. coli
taacgcctatatggaactgggcacc

SEQ ID NO: 70441 - DNA, 25 bp, E. coli
cacattgcgagggacaaaagcgggt

SEQ ID NO: 70442 - DNA, 25 bp, E. coli
cacattgcgaggcacaaaagcgggt

SEQ ID NO: 70443 - DNA, 25 bp, E. coli
aaagatgttccccttcagagccagg

SEQ ID NO: 70444 - DNA, 25 bp, E. coli
aaagatgttcccgttcagagccagg

SEQ ID NO: 70445 - DNA, 25 bp, E. coli
tattgccggacatcataacgtcgtg

SEQ ID NO: 70446 - DNA, 25 bp, E. coli
tattgccggacaacataacgtcgtg

SEQ ID NO: 70447 - DNA, 25 bp, E. coli
ttttttgaccacgacctgagccgct

SEQ ID NO: 70448 - DNA, 25 bp, E. coli
ttttttgaccaccacctgagccgct

SEQ ID NO: 70449 - DNA, 25 bp, E. coli
gcaacgcttataacggcctgaccgg

SEQ ID NO: 70450 - DNA, 25 bp, E. coli
gcaacgcttatatcggcctgaccgg

SEQ ID NO: 70451 - DNA, 25 bp, E. coli
gaaaatacgatttgcgccacgctgc

SEQ ID NO: 70452 - DNA, 25 bp, E. coli
gaaaatacgattagcgccacgctgc

SEQ ID NO: 70453 - DNA, 25 bp, E. coli
cattacattggttgccggcacggcc

SEQ ID NO: 70454 - DNA, 25 bp, E. coli
cattacattggtagccggcacggcc

SEQ ID NO: 70455 - DNA, 25 bp, E. coli
tggaaaagatatcacggtcacgctg

SEQ ID NO: 70456 - DNA, 25 bp, E. coli
tggaaaagatatgacggtcacgctg

SEQ ID NO: 70457 - DNA, 25 bp, E. coli
taacaatgtaatcgcgggtcaacgc

SEQ ID NO: 70458 - DNA, 25 bp, E. coli
taattcgcaatttacaccgggagct

SEQ ID NO: 70459 - DNA, 25 bp, E. coli
taattcgcaattaacaccgggagct

SEQ ID NO: 70460 - DNA, 25 bp, E. coli
taacaatgtaatggcgggtcaacgc

SEQ ID NO: 70461 - DNA, 25 bp, E. coli
gatgtttatggagacccgttgccgg

SEQ ID NO: 70462 - DNA, 25 bp, E. coli
gatgtttatggacacccgttgccgg

SEQ ID NO: 70463 - DNA, 25 bp, E. coli
aatacaatattctggcaaacaacac

SEQ ID NO: 70464 - DNA, 25 bp, E. coli
aatacaatattcaggcaaacaacac

SEQ ID NO: 70465 - DNA, 25 bp, E. coli
caaattagatctgtatggcaaagtt

SEQ ID NO: 70466 - DNA, 25 bp, E. coli
caaattagatctctatggcaaagtt

SEQ ID NO: 70467 - DNA, 25 bp, E. coli
caggtgctgcacttgcagccgaagt

SEQ ID NO: 70468 - DNA, 25 bp, E. coli
catggacccgtctggcatttgccgg

SEQ ID NO: 70469 - DNA, 25 bp, E. coli
catgcagccgaactttataataaag

SEQ ID NO: 70470 - DNA, 25 bp, E. coli
caggtgctgcacatgcagccgaagt

SEQ ID NO: 70471 - DNA, 25 bp, E. coli
catgcagccgaagtttataataaag

SEQ ID NO: 70472 - DNA, 25 bp, E. coli
catggacccgtcaggcatttgccgg

SEQ ID NO: 70473 - DNA, 25 bp, E. coli
tacggtcaatgggaatacaatattc

SEQ ID NO: 70474 - DNA, 25 bp, E. coli
tacggtcaatggcaatacaatattc

SEQ ID NO: 70475 - DNA, 25 bp, E. coli
actggctacggtgaatgggaataca

SEQ ID NO: 70476 - DNA, 25 bp, E. coli
actggctacggtcaatgggaataca

SEQ ID NO: 70477 - DNA, 25 bp, E. coli
aaaccagtcatggacccgtctggca

SEQ ID NO: 70478 - DNA, 25 bp, E. coli
aaaccagtcatgcacccgtctggca

SEQ ID NO: 70479 - DNA, 25 bp, E. coli
ctttcgattacggacgtaattatgg

SEQ ID NO: 70480 - DNA, 25 bp, E. coli
ctttcgattacgcacgtaattatgg

SEQ ID NO: 70481 - DNA, 25 bp, E. coli
tggcaaagttgatggcctgcattat

SEQ ID NO: 70482 - DNA, 25 bp, E. coli
tggcaaagttgaaggcctgcattat

SEQ ID NO: 70483 - DNA, 25 bp, E. coli
taattcagcgaatgatggcgaccag

SEQ ID NO: 70484 - DNA, 25 bp, E. coli
taattcagcgaaagatggcgaccag

SEQ ID NO: 70485 - DNA, 25 bp, E. coli
cagactctgggcgtgactcaaggta

SEQ ID NO: 70486 - DNA, 25 bp, E. coli
cagactctgggcctgactcaaggta

SEQ ID NO: 70487 - DNA, 25 bp, E. coli
tccgcagaaggccaagacgagcaga

SEQ ID NO: 70488 - DNA, 25 bp, E. coli
tccgcagaaggcgaagacgagcaga

SEQ ID NO: 70489 - DNA, 25 bp, E. coli
tctggttaaactcatggcggaactc

SEQ ID NO: 70490 - DNA, 25 bp, E. coli
tctggttaaactgatggcggaactc

SEQ ID NO: 70491 - DNA, 25 bp, E. coli
gcctgtttaaactgcagactctggg

SEQ ID NO: 70492 - DNA, 25 bp, E. coli
gcctgtttaaacagcagactctggg

SEQ ID NO: 70493 - DNA, 25 bp, E. coli
gctaagggcttcacttctgaaatta

SEQ ID NO: 70494 - DNA, 25 bp, E. coli
cctgctgcccagtttgtaaaagaag

SEQ ID NO: 70495 - DNA, 25 bp, E. coli
cctgctgcccagattgtaaaagaag

SEQ ID NO: 70496 - DNA, 25 bp, E. coli
gctaagggcttctcttctgaaatta

SEQ ID NO: 70497 - DNA, 25 bp, E. coli
gcgccagcgcgataagcctgtttaa

SEQ ID NO: 70498 - DNA, 25 bp, E. coli
gcgccagcgcgaaaagcctgtttaa

SEQ ID NO: 70499 - DNA, 25 bp, E. coli
gaagttaccattaccgctccgaacg

SEQ ID NO: 70500 - DNA, 25 bp, E. coli
gaagttaccatttccgctccgaacg

SEQ ID NO: 70501 - DNA, 25 bp, E. coli
gaaattactgtgacttccaacggca

SEQ ID NO: 70502 - DNA, 25 bp, E. coli
gacgagcagaaaccggttgaacatc

SEQ ID NO: 70503 - DNA, 25 bp, E. coli
gaaattactgtgtcttccaacggca

SEQ ID NO: 70504 - DNA, 25 bp, E. coli
gacgagcagaaagcggttgaacatc

SEQ ID NO: 70505 - DNA, 25 bp, E. coli
gttgtgactatctccgcagaaggcg

SEQ ID NO: 70506 - DNA, 25 bp, E. coli
gttgtgactatcaccgcagaaggcg

SEQ ID NO: 70507 - DNA, 25 bp, E. coli
caactttgcagcacacgggctgacg

SEQ ID NO: 70508 - DNA, 25 bp, E. coli
caactttgcagctcacgggctgacg

SEQ ID NO: 70509 - DNA, 25 bp, E. coli
cactggaccgctacaacctgattga

SEQ ID NO: 70510 - DNA, 25 bp, E. coli
cactggaccgcttcaacctgattga

SEQ ID NO: 70511 - DNA, 25 bp, E. coli
taaacgacattctcggccatacacg

SEQ ID NO: 70512 - DNA, 25 bp, E. coli
taaacgacattcacggccatacacg

SEQ ID NO: 70513 - DNA, 25 bp, E. coli
tatcacagctttagggcagaagccg

SEQ ID NO: 70514 - DNA, 25 bp, E. coli
tatcacagcttttgggcagaagccg

SEQ ID NO: 70515 - DNA, 25 bp, E. coli
tgttacgccgagaagatcatgcatg

SEQ ID NO: 70516 - DNA, 25 bp, E. coli
tgttacgccgagtagatcatgcatg

SEQ ID NO: 70517 - DNA, 25 bp, E. coli
tgacgaagacgaacctgcacagttg

SEQ ID NO: 70518 - DNA, 25 bp, E. coli
tgacgaagacgatcctgcacagttg

SEQ ID NO: 70519 - DNA, 25 bp, E. coli
tcttctgttaatcacgacgaccacg

SEQ ID NO: 70520 - DNA, 25 bp, E. coli
tcttctgttaatgacgacgaccacg

SEQ ID NO: 70521 - DNA, 25 bp, E. coli
cgatagtaacgaccaaacggctgat

SEQ ID NO: 70522 - DNA, 25 bp, E. coli
cgtaacggctcagcaaaaggaatgc

SEQ ID NO: 70523 - DNA, 25 bp, E. coli
cgatagtaacgagcaaacggctgat

SEQ ID NO: 70524 - DNA, 25 bp, E. coli
cgtaacggctcaccaaaaggaatgc

SEQ ID NO: 70525 - DNA, 25 bp, E. coli
cattacggtggtgatagacggctgc

SEQ ID NO: 70526 - DNA, 25 bp, E. coli
cattacggtggtcatagacggctgc

SEQ ID NO: 70527 - DNA, 25 bp, E. coli
ggacattatcaatcgcggcggcggt

SEQ ID NO: 70528 - DNA, 25 bp, E. coli
ggacattatcaaacgcggcggcggt

SEQ ID NO: 70529 - DNA, 25 bp, E. coli
aatacttcatgaagggcgacaaccg

SEQ ID NO: 70530 - DNA, 25 bp, E. coli
aagcgaatctggtcggtcgggcaac

SEQ ID NO: 70531 - DNA, 25 bp, E. coli
aagcgaatctggacggtcgggcaac

SEQ ID NO: 70532 - DNA, 25 bp, E. coli
aatacttcatgatgggcgacaaccg

SEQ ID NO: 70533 - DNA, 25 bp, E. coli
cagaaaacgctgttcgaaaccggtc

SEQ ID NO: 70534 - DNA, 25 bp, E. coli
cagaaaacgctgatcgaaaccggtc

SEQ ID NO: 70535 - DNA, 25 bp, E. coli
ttcagaccttctcacgccgtaatgg

SEQ ID NO: 70536 - DNA, 25 bp, E. coli
ttcagaccttctgacgccgtaatgg

SEQ ID NO: 70537 - DNA, 25 bp, E. coli
tgatgtgacgcaccgcattctgaca

SEQ ID NO: 70538 - DNA, 25 bp, E. coli
tgatgtgacgcagcgcattctgaca

SEQ ID NO: 70539 - DNA, 25 bp, E. coli
tcgataagcaagaaggcgaatggcc

SEQ ID NO: 70540 - DNA, 25 bp, E. coli
tcgataagcaagtaggcgaatggcc

SEQ ID NO: 70541 - DNA, 25 bp, E. coli
tctggtgattgcgacactggtgacg

SEQ ID NO: 70542 - DNA, 25 bp, E. coli
tctggtgattgccacactggtgacg

SEQ ID NO: 70543 - DNA, 25 bp, E. coli
gagctgacgattcaaccgggatgca

SEQ ID NO: 70544 - DNA, 25 bp, E. coli
gagctgacgattgaaccgggatgca

SEQ ID NO: 70545 - DNA, 25 bp, E. coli
cattctgacagtgccgattgcgcag

SEQ ID NO: 70546 - DNA, 25 bp, E. coli
cattctgacagtcccgattgcgcag

SEQ ID NO: 70547 - DNA, 25 bp, E. coli
gatccggtctcataagagctgacga

SEQ ID NO: 70548 - DNA, 25 bp, E. coli
gatccggtctcaaaagagctgacga

SEQ ID NO: 70549 - DNA, 25 bp, E. coli
gatgtattaccaccagccagggcaa

SEQ ID NO: 70550 - DNA, 25 bp, E. coli
gatgtattaccagcagccagggcaa

SEQ ID NO: 70551 - DNA, 25 bp, E. coli
caaatgcagcatcttgatccgtcac

SEQ ID NO: 70552 - DNA, 25 bp, E. coli
caaatgcagcatgttgatccgtcac

SEQ ID NO: 70553 - DNA, 25 bp, E. coli
taaaggatcgatgggaagccacgag

SEQ ID NO: 70554 - DNA, 25 bp, E. coli
taaaggatcgatcggaagccacgag

SEQ ID NO: 70555 - DNA, 25 bp, E. coli
tttgcattatttagacggcggtgac

SEQ ID NO: 70556 - DNA, 25 bp, E. coli
tttgcattattttgacggcggtgac

SEQ ID NO: 70557 - DNA, 25 bp, E. coli
tgatcagcagagtgacagaagctct

SEQ ID NO: 70558 - DNA, 25 bp, E. coli
tgatcagcagagagacagaagctct

SEQ ID NO: 70559 - DNA, 25 bp, E. coli
tcttttgcgattagggaagctgcca

SEQ ID NO: 70560 - DNA, 25 bp, E. coli
tcttttgcgatttgggaagctgcca

SEQ ID NO: 70561 - DNA, 25 bp, E. coli
gccacggaaaagctgcaaatgcagc

SEQ ID NO: 70562 - DNA, 25 bp, E. coli
gccacggaaaaggtgcaaatgcagc

SEQ ID NO: 70563 - DNA, 25 bp, E. coli
gaatggcgcaacgtgatccttgaag

SEQ ID NO: 70564 - DNA, 25 bp, E. coli
gaatggcgcaacctgatccttgaag

SEQ ID NO: 70565 - DNA, 25 bp, E. coli
cgaacaactggtcctggagcgagat

SEQ ID NO: 70566 - DNA, 25 bp, E. coli
cgaacaactggtgctggagcgagat

SEQ ID NO: 70567 - DNA, 25 bp, E. coli
cttgaagagaatgcgctcggcgacc

SEQ ID NO: 70568 - DNA, 25 bp, E. coli
cttgaagagaatccgctcggcgacc

SEQ ID NO: 70569 - DNA, 25 bp, E. coli
ggaagctgccactctgcctgttcat

SEQ ID NO: 70570 - DNA, 25 bp, E. coli
ggaagctgccacactgcctgttcat

SEQ ID NO: 70571 - DNA, 25 bp, E. coli
gatgctttagactttgaatggcgca

SEQ ID NO: 70572 - DNA, 25 bp, E. coli
gatgctttagacattgaatggcgca

SEQ ID NO: 70573 - DNA, 25 bp, E. coli
cagccctcacccaggaagggagagg

SEQ ID NO: 70574 - DNA, 25 bp, E. coli
cagccctcaccctggaagggagagg

SEQ ID NO: 70575 - DNA, 25 bp, E. coli
agaacggcgcaggacatcacattgc

SEQ ID NO: 70576 - DNA, 25 bp, E. coli
agaacggcgcagcacatcacattgc

SEQ ID NO: 70577 - DNA, 25 bp, E. coli
caaccccgagttgcagattgcgtta

SEQ ID NO: 70578 - DNA, 25 bp, E. coli
caaccccgagttccagattgcgtta

SEQ ID NO: 70579 - DNA, 25 bp, E. coli
tatgcgaatccaacaataatgcttc

SEQ ID NO: 70580 - DNA, 25 bp, E. coli
tacctcaagagtagacatagtgcgc

SEQ ID NO: 70581 - DNA, 25 bp, E. coli
tacctcaagagttgacatagtgcgc

SEQ ID NO: 70582 - DNA, 25 bp, E. coli
tatgcgaatccatcaataatgcttc

SEQ ID NO: 70583 - DNA, 25 bp, E. coli
ttgtaaccacaagcagatgcaaccc

SEQ ID NO: 70584 - DNA, 25 bp, E. coli
ttaagggcgtaatgacaaattcgac

SEQ ID NO: 70585 - DNA, 25 bp, E. coli
ttaagggcgtaaagacaaattcgac

SEQ ID NO: 70586 - DNA, 25 bp, E. coli
ttgtaaccacaaccagatgcaaccc

SEQ ID NO: 70587 - DNA, 25 bp, E. coli
tgcttttaggttagcgaccgaaaat

SEQ ID NO: 70588 - DNA, 25 bp, E. coli
tgcttttaggtttgcgaccgaaaat

SEQ ID NO: 70589 - DNA, 25 bp, E. coli
gcactggtgcgaacattaaccctca

SEQ ID NO: 70590 - DNA, 25 bp, E. coli
gcactggtgcgatcattaaccctca

SEQ ID NO: 70591 - DNA, 25 bp, E. coli
gacatagtgcgcctttgcttttagg

SEQ ID NO: 70592 - DNA, 25 bp, E. coli
gacatagtgcgcgtttgcttttagg

SEQ ID NO: 70593 - DNA, 25 bp, E. coli
ggacatcacattgcgcttatgcgaa

SEQ ID NO: 70594 - DNA, 25 bp, E. coli
ggacatcacattccgcttatgcgaa

SEQ ID NO: 70595 - DNA, 25 bp, E. coli
catttcggttcggtgtttgatgcca

SEQ ID NO: 70596 - DNA, 25 bp, E. coli
catttcggttcgctgtttgatgcca

SEQ ID NO: 70597 - DNA, 25 bp, E. coli
tacaactggtgaaaacggtcgcctg

SEQ ID NO: 70598 - DNA, 25 bp, E. coli
tacaactggtgataacggtcgcctg

SEQ ID NO: 70599 - DNA, 25 bp, E. coli
tagtctcttccgttatcattggcag

SEQ ID NO: 70600 - DNA, 25 bp, E. coli
tagtctcttccgatatcattggcag

SEQ ID NO: 70601 - DNA, 25 bp, E. coli
tattcgcaccctggaaaaattcgct

SEQ ID NO: 70602 - DNA, 25 bp, E. coli
tattcgcaccctcgaaaaattcgct

SEQ ID NO: 70603 - DNA, 25 bp, E. coli
tcattggcagccatttcggttcggt

SEQ ID NO: 70604 - DNA, 25 bp, E. coli
tcattggcagccttttcggttcggt

SEQ ID NO: 70605 - DNA, 25 bp, E. coli
cctcgaaaaattcgctaaactctga

SEQ ID NO: 70606 - DNA, 25 bp, E. coli
cctcgaaaaattggctaaactctga

SEQ ID NO: 70607 - DNA, 25 bp, E. coli
ccgccgtgggcgttttacaactggt

SEQ ID NO: 70608 - DNA, 25 bp, E. coli
ccgccgtgggcgatttacaactggt

SEQ ID NO: 70609 - DNA, 25 bp, E. coli
gttataccgatgtagaaatagtctc

SEQ ID NO: 70610 - DNA, 25 bp, E. coli
gttataccgatgaagaaatagtctc

SEQ ID NO: 70611 - DNA, 25 bp, E. coli
tggtgaaaacggtcgcctggtacga

SEQ ID NO: 70612 - DNA, 25 bp, E. coli
tggtgaaaacggacgcctggtacga

SEQ ID NO: 70613 - DNA, 25 bp, E. coli
taacgagtcattaggttataccgat

SEQ ID NO: 70614 - DNA, 25 bp, E. coli
taacgagtcatttggttataccgat

SEQ ID NO: 70615 - DNA, 25 bp, E. coli
gatgccacgcaatcggaaattaccg

SEQ ID NO: 70616 - DNA, 25 bp, E. coli
gatgccacgcaaacggaaattaccg

SEQ ID NO: 70617 - DNA, 25 bp, E. coli
actctggatgaagccagaactcagg

SEQ ID NO: 70618 - DNA, 25 bp, E. coli
aaactcgccggggaaaagctcgtag

SEQ ID NO: 70619 - DNA, 25 bp, E. coli
actctggatgaacccagaactcagg

SEQ ID NO: 70620 - DNA, 25 bp, E. coli
aaactcgccgggcaaaagctcgtag

SEQ ID NO: 70621 - DNA, 25 bp, E. coli
tatcgcgaaactcgccgggcaaaag

SEQ ID NO: 70622 - DNA, 25 bp, E. coli
tatcgcgaaactggccgggcaaaag

SEQ ID NO: 70623 - DNA, 25 bp, E. coli
tgatatcgcgaaactcgccgggcaa

SEQ ID NO: 70624 - DNA, 25 bp, E. coli
tggtaagcagcaatgtaatggcatt

SEQ ID NO: 70625 - DNA, 25 bp, E. coli
tgtacaagggataaacggtaaatgg

SEQ ID NO: 70626 - DNA, 25 bp, E. coli
tgtacaagggattaacggtaaatgg

SEQ ID NO: 70627 - DNA, 25 bp, E. coli
tgatatcgcgaatctcgccgggcaa

SEQ ID NO: 70628 - DNA, 25 bp, E. coli
tggtaagcagcattgtaatggcatt

SEQ ID NO: 70629 - DNA, 25 bp, E. coli
cattgactctggatgaagccagaac

SEQ ID NO: 70630 - DNA, 25 bp, E. coli
cattgactctggttgaagccagaac

SEQ ID NO: 70631 - DNA, 25 bp, E. coli
ggaatatgtacaagggataaacggt

SEQ ID NO: 70632 - DNA, 25 bp, E. coli
ggaatatgtacatgggataaacggt

SEQ ID NO: 70633 - DNA, 25 bp, E. coli
taatggcattgactctggatgaagc

SEQ ID NO: 70634 - DNA, 25 bp, E. coli
taagcagcaatgtaatggcattgac

SEQ ID NO: 70635 - DNA, 25 bp, E. coli
taagcagcaatgaaatggcattgac

SEQ ID NO: 70636 - DNA, 25 bp, E. coli
taatggcattgagtctggatgaagc

SEQ ID NO: 70637 - DNA, 25 bp, E. coli
gatgatatcgcgaaactcgccgggc

SEQ ID NO: 70638 - DNA, 25 bp, E. coli
gatgatatcgcgtaactcgccgggc

SEQ ID NO: 70639 - DNA, 25 bp, E. coli
cagttgacagcgacagctatcagtt

SEQ ID NO: 70640 - DNA, 25 bp, E. coli
cagttgacagcgtcagctatcagtt

SEQ ID NO: 70641 - DNA, 25 bp, E. coli
tacagtgacagtagacagcgacagc

SEQ ID NO: 70642 - DNA, 25 bp, E. coli
tacagtgacagttgacagcgacagc

SEQ ID NO: 70643 - DNA, 25 bp, E. coli
agaatgaagcccctcgtctgcgtgc

SEQ ID NO: 70644 - DNA, 25 bp, E. coli
agaatgaagcccgtcgtctgcgtgc

SEQ ID NO: 70645 - DNA, 25 bp, E. coli
tatgatgtcaatttctccggtctgg

SEQ ID NO: 70646 - DNA, 25 bp, E. coli
tatgatgtcaatatctccggtctgg

SEQ ID NO: 70647 - DNA, 25 bp, E. coli
tatctccggtctcgtaagcacaacc

SEQ ID NO: 70648 - DNA, 25 bp, E. coli
tttgctgacgagaacagggactggt

SEQ ID NO: 70649 - DNA, 25 bp, E. coli
tttgctgacgagtacagggactggt

SEQ ID NO: 70650 - DNA, 25 bp, E. coli
tatctccggtctggtaagcacaacc

SEQ ID NO: 70651 - DNA, 25 bp, E. coli
tgaagcagcgtattacagtgacagt

SEQ ID NO: 70652 - DNA, 25 bp, E. coli
tgaagcagcgtaatacagtgacagt

SEQ ID NO: 70653 - DNA, 25 bp, E. coli
tctgcgtgccgaacgctggaaagcg

SEQ ID NO: 70654 - DNA, 25 bp, E. coli
tctgcgtgccgatcgctggaaagcg

SEQ ID NO: 70655 - DNA, 25 bp, E. coli
gcccggtttattcaaatgaacggct

SEQ ID NO: 70656 - DNA, 25 bp, E. coli
gcccggtttattgaaatgaacggct

SEQ ID NO: 70657 - DNA, 25 bp, E. coli
gctatcagttgctcaaggcatatga

SEQ ID NO: 70658 - DNA, 25 bp, E. coli
gctatcagttgcacaaggcatatga

SEQ ID NO: 70659 - DNA, 25 bp, E. coli
taagcacaaccaagcagaatgaagc

SEQ ID NO: 70660 - DNA, 25 bp, E. coli
taagcacaaccatgcagaatgaagc

SEQ ID NO: 70661 - DNA, 25 bp, E. coli
aataattaaaaaggatgcacacagg

SEQ ID NO: 70662 - DNA, 25 bp, E. coli
aataattaaaaacgatgcacacagg

SEQ ID NO: 70663 - DNA, 25 bp, E. coli
taaacaaaccctaaacaatgagttg

SEQ ID NO: 70664 - DNA, 25 bp, E. coli
taaacaaacccttaacaatgagttg

SEQ ID NO: 70665 - DNA, 25 bp, E. coli
acaccccggtgctgacacggaagaa

SEQ ID NO: 70666 - DNA, 25 bp, E. coli
acaccccggtgcagacacggaagaa

SEQ ID NO: 70667 - DNA, 25 bp, E. coli
tattcccgatgctttttgaagttcg

SEQ ID NO: 70668 - DNA, 25 bp, E. coli
tattcccgatgcattttgaagttcg

SEQ ID NO: 70669 - DNA, 25 bp, E. coli
tatttattaatgtatgccaggtgcg

SEQ ID NO: 70670 - DNA, 25 bp, E. coli
tatttattaatgaatgccaggtgcg

SEQ ID NO: 70671 - DNA, 25 bp, E. coli
tgcacacagggtttagcgcgtacat

SEQ ID NO: 70672 - DNA, 25 bp, E. coli
tgcacacagggtatagcgcgtacat

SEQ ID NO: 70673 - DNA, 25 bp, E. coli
tctgcgggagtgaccgggaataatt

SEQ ID NO: 70674 - DNA, 25 bp, E. coli
tctgcgggagtgtccgggaataatt

SEQ ID NO: 70675 - DNA, 25 bp, E. coli
gaagttcgcagattcgtatgtgtag

SEQ ID NO: 70676 - DNA, 25 bp, E. coli
gacacggaagaatccggacgttatg

SEQ ID NO: 70677 - DNA, 25 bp, E. coli
gaagttcgcagaatcgtatgtgtag

SEQ ID NO: 70678 - DNA, 25 bp, E. coli
gacacggaagaaaccggacgttatg

SEQ ID NO: 70679 - DNA, 25 bp, E. coli
gtattgtattatgccaacaccccgg

SEQ ID NO: 70680 - DNA, 25 bp, E. coli
gtattgtattatcccaacaccccgg

SEQ ID NO: 70681 - DNA, 25 bp, E. coli
taatgtatgccacgtgcgatgaatc

SEQ ID NO: 70682 - DNA, 25 bp, E. coli
taatgtatgccaggtgcgatgaatc

SEQ ID NO: 70683 - DNA, 25 bp, E. coli
cacagttctacatccaggaattcag

SEQ ID NO: 70684 - DNA, 25 bp, E. coli
cacagttctacaaccaggaattcag

SEQ ID NO: 70685 - DNA, 25 bp, E. coli
ttcagtgagtatattgcgccactgc

SEQ ID NO: 70686 - DNA, 25 bp, E. coli
ttcagtgagtattttgcgccactgc

SEQ ID NO: 70687 - DNA, 25 bp, E. coli
tgctgccgcagcttagcgatattga

SEQ ID NO: 70688 - DNA, 25 bp, E. coli
tgctgccgcagcatagcgatattga

SEQ ID NO: 70689 - DNA, 25 bp, E. coli
tctacatccaggaattcagtgagta

SEQ ID NO: 70690 - DNA, 25 bp, E. coli
tctacatccaggtattcagtgagta

SEQ ID NO: 70691 - DNA, 25 bp, E. coli
gctggaagaccgtcaccacacagtt

SEQ ID NO: 70692 - DNA, 25 bp, E. coli
gctggaagaccgacaccacacagtt

SEQ ID NO: 70693 - DNA, 25 bp, E. coli
gaattcagtgagtatattgcgccac

SEQ ID NO: 70694 - DNA, 25 bp, E. coli
gaattcagtgagaatattgcgccac

SEQ ID NO: 70695 - DNA, 25 bp, E. coli
gcagcatagcgaaattgaaatagcc

SEQ ID NO: 70696 - DNA, 25 bp, E. coli
gcagcatagcgatattgaaatagcc

SEQ ID NO: 70697 - DNA, 25 bp, E. coli
cgatattgaaatagcctggtatgct

SEQ ID NO: 70698 - DNA, 25 bp, E. coli
cgatattgaaattgcctggtatgct

SEQ ID NO: 70699 - DNA, 25 bp, E. coli
gtcaccacacagttctacatccagg

SEQ ID NO: 70700 - DNA, 25 bp, E. coli
gtcaccacacagatctacatccagg

SEQ ID NO: 70701 - DNA, 25 bp, E. coli
ggaagaccgtcaccacacagttcta

SEQ ID NO: 70702 - DNA, 25 bp, E. coli
ggaagaccgtcagcacacagttcta

SEQ ID NO: 70703 - DNA, 25 bp, E. coli
gagccgaatggctggaagaccgtca

SEQ ID NO: 70704 - DNA, 25 bp, E. coli
gagccgaatggcaggaagaccgtca

SEQ ID NO: 70705 - DNA, 25 bp, E. coli
tacatatacaaatgcagactactca

SEQ ID NO: 70706 - DNA, 25 bp, E. coli
tacatatacaaaagcagactactca

SEQ ID NO: 70707 - DNA, 25 bp, E. coli
tacgcaacagacacaatcaatactt

SEQ ID NO: 70708 - DNA, 25 bp, E. coli
tacccataacatacagtgtccaaac

SEQ ID NO: 70709 - DNA, 25 bp, E. coli
tacccataacattcagtgtccaaac

SEQ ID NO: 70710 - DNA, 25 bp, E. coli
tacgcaacagactcaatcaatactt

SEQ ID NO: 70711 - DNA, 25 bp, E. coli
tatctctgatcaatatgatttagcg

SEQ ID NO: 70712 - DNA, 25 bp, E. coli
tatctctgatcattatgatttagcg

SEQ ID NO: 70713 - DNA, 25 bp, E. coli
tctggagaaggatatatctctgatc

SEQ ID NO: 70714 - DNA, 25 bp, E. coli
tctggagaaggaaatatctctgatc

SEQ ID NO: 70715 - DNA, 25 bp, E. coli
gcgtgccacacgaacactacatata

SEQ ID NO: 70716 - DNA, 25 bp, E. coli
gcgtgccacacgtacactacatata

SEQ ID NO: 70717 - DNA, 25 bp, E. coli
cgaagtggccttccgataattggga

SEQ ID NO: 70718 - DNA, 25 bp, E. coli
cgaagtggccttgcgataattggga

SEQ ID NO: 70719 - DNA, 25 bp, E. coli
gatttagcgcaacaccaacttcaac

SEQ ID NO: 70720 - DNA, 25 bp, E. coli
gttcgacacaacatacgcaacagac

SEQ ID NO: 70721 - DNA, 25 bp, E. coli
gatttagcgcaagaccaacttcaac

SEQ ID NO: 70722 - DNA, 25 bp, E. coli
gttcgacacaacttacgcaacagac

SEQ ID NO: 70723 - DNA, 25 bp, E. coli
tcaacaaattaaagcgtgccacacg

SEQ ID NO: 70724 - DNA, 25 bp, E. coli
tcaacaaattaatgcgtgccacacg

SEQ ID NO: 70725 - DNA, 25 bp, E. coli
gagggaatacccttaacattcagtg

SEQ ID NO: 70726 - DNA, 25 bp, E. coli
gagggaatacccataacattcagtg

SEQ ID NO: 70727 - DNA, 25 bp, E. coli
aaccagattggtagtagttaatcat

SEQ ID NO: 70728 - DNA, 25 bp, E. coli
tatcgctaaacgttttggtgttgaa

SEQ ID NO: 70729 - DNA, 25 bp, E. coli
tatcgctaaacgatttggtgttgaa

SEQ ID NO: 70730 - DNA, 25 bp, E. coli
aaccagattggttgtagttaatcat

SEQ ID NO: 70731 - DNA, 25 bp, E. coli
tattctctcgaatccagattggttg

SEQ ID NO: 70732 - DNA, 25 bp, E. coli
tattctctcgaaaccagattggttg

SEQ ID NO: 70733 - DNA, 25 bp, E. coli
tgttgaaaaaacatctgctgggtaa

SEQ ID NO: 70734 - DNA, 25 bp, E. coli
tgttgaaaaaacttctgctgggtaa

SEQ ID NO: 70735 - DNA, 25 bp, E. coli
tggtgttgaaaaaacatctgctggg

SEQ ID NO: 70736 - DNA, 25 bp, E. coli
tggtgttgaaaatacatctgctggg

SEQ ID NO: 70737 - DNA, 25 bp, E. coli
tctttccagacacgatggcgcacgt

SEQ ID NO: 70738 - DNA, 25 bp, E. coli
tctttccagacaggatggcgcacgt

SEQ ID NO: 70739 - DNA, 25 bp, E. coli
gacacgatggcggacgtcgtatcgc

SEQ ID NO: 70740 - DNA, 25 bp, E. coli
gacacgatggcgcacgtcgtatcgc

SEQ ID NO: 70741 - DNA, 25 bp, E. coli
cattatctttcctgacacgatggcg

SEQ ID NO: 70742 - DNA, 25 bp, E. coli
cattatctttccagacacgatggcg

SEQ ID NO: 70743 - DNA, 25 bp, E. coli
gttaatcattatctttccagacacg

SEQ ID NO: 70744 - DNA, 25 bp, E. coli
gttaatcattatgtttccagacacg

SEQ ID NO: 70745 - DNA, 25 bp, E. coli
ggcgcacgtcgtttcgctaaacgtt

SEQ ID NO: 70746 - DNA, 25 bp, E. coli
ggcgcacgtcgtatcgctaaacgtt

SEQ ID NO: 70747 - DNA, 25 bp, E. coli
tggcaaagccaaaatattctctcga

SEQ ID NO: 70748 - DNA, 25 bp, E. coli
tggcaaagccaatatattctctcga

SEQ ID NO: 70749 - DNA, 25 bp, E. coli
cagttcgtcagcaagccaatcggta

SEQ ID NO: 70750 - DNA, 25 bp, E. coli
cagttcgtcagctagccaatcggta

SEQ ID NO: 70751 - DNA, 25 bp, E. coli
taaatacgctggactataccgtcgg

SEQ ID NO: 70752 - DNA, 25 bp, E. coli
taaatacgctggtctataccgtcgg

SEQ ID NO: 70753 - DNA, 25 bp, E. coli
aaatgacccggctagctatgtggag

SEQ ID NO: 70754 - DNA, 25 bp, E. coli
aaatgacccggcaagctatgtggag

SEQ ID NO: 70755 - DNA, 25 bp, E. coli
tattacctcagtgaaattccgggcg

SEQ ID NO: 70756 - DNA, 25 bp, E. coli
tattacctcagtcaaattccgggcg

SEQ ID NO: 70757 - DNA, 25 bp, E. coli
cctgaaatgcgccagaaaggtgccg

SEQ ID NO: 70758 - DNA, 25 bp, E. coli
cctgaaatgcgcgagaaaggtgccg

SEQ ID NO: 70759 - DNA, 25 bp, E. coli
gactggtacgtacggcaagcctgat

SEQ ID NO: 70760 - DNA, 25 bp, E. coli
gacagcaagctgctagaaacactca

SEQ ID NO: 70761 - DNA, 25 bp, E. coli
gacagcaagctggtagaaacactca

SEQ ID NO: 70762 - DNA, 25 bp, E. coli
gattattacaaagacaccgccacgg

SEQ ID NO: 70763 - DNA, 25 bp, E. coli
gattattacaaacacaccgccacgg

SEQ ID NO: 70764 - DNA, 25 bp, E. coli
taagtttagcgctacgctcctggcc

SEQ ID NO: 70765 - DNA, 25 bp, E. coli
taagtttagcgcaacgctcctggcc

SEQ ID NO: 70766 - DNA, 25 bp, E. coli
gagcattacattcagggcgatccgg

SEQ ID NO: 70767 - DNA, 25 bp, E. coli
gactggtacgtagggcaagcctgat

SEQ ID NO: 70768 - DNA, 25 bp, E. coli
gatctgcgtatcttggaaaccactg

SEQ ID NO: 70769 - DNA, 25 bp, E. coli
gagcattacattgagggcgatccgg

SEQ ID NO: 70770 - DNA, 25 bp, E. coli
gatctgcgtatcatggaaaccactg

SEQ ID NO: 70771 - DNA, 25 bp, E. coli
caacgctagctggaaagatgaatcg

SEQ ID NO: 70772 - DNA, 25 bp, E. coli
caacgctagctgcaaagatgaatcg

SEQ ID NO: 70773 - DNA, 25 bp, E. coli
cacacgtcatgtggcgcggtattcc

SEQ ID NO: 70774 - DNA, 25 bp, E. coli
cacacgtcatgtcgcgcggtattcc

SEQ ID NO: 70775 - DNA, 25 bp, E. coli
catcgtgtttgaccgccttggctgg

SEQ ID NO: 70776 - DNA, 25 bp, E. coli
catggattgcgcgtacgttgcctga

SEQ ID NO: 70777 - DNA, 25 bp, E. coli
catggattgcgcctacgttgcctga

SEQ ID NO: 70778 - DNA, 25 bp, E. coli
catcgtgtttgagcgccttggctgg

SEQ ID NO: 70779 - DNA, 25 bp, E. coli
tatgtgcgcccaattctggagtcgg

SEQ ID NO: 70780 - DNA, 25 bp, E. coli
tatgtgcgcccatttctggagtcgg

SEQ ID NO: 70781 - DNA, 25 bp, E. coli
tatttttgccatgaccctgtgcgtg

SEQ ID NO: 70782 - DNA, 25 bp, E. coli
tttgttacagcacgccagaaggccg

SEQ ID NO: 70783 - DNA, 25 bp, E. coli
tatttttgccatcaccctgtgcgtg

SEQ ID NO: 70784 - DNA, 25 bp, E. coli
ttttcaacgccggtaatgcgctggc

SEQ ID NO: 70785 - DNA, 25 bp, E. coli
ttttcaacgccgctaatgcgctggc

SEQ ID NO: 70786 - DNA, 25 bp, E. coli
tttgttacagcaggccagaaggccg

SEQ ID NO: 70787 - DNA, 25 bp, E. coli
cccttggatcaacggcaggaggcat

SEQ ID NO: 70788 - DNA, 25 bp, E. coli
cccttggatcaagggcaggaggcat

SEQ ID NO: 70789 - DNA, 25 bp, E. coli
gattctggtcgatgtcagcggcaac

SEQ ID NO: 70790 - DNA, 25 bp, E. coli
gattctggtcgaagtcagcggcaac

SEQ ID NO: 70791 - DNA, 25 bp, E. coli
ggatgcgaataaaagccacacgtca

SEQ ID NO: 70792 - DNA, 25 bp, E. coli
ggatgcgaataatagccacacgtca

SEQ ID NO: 70793 - DNA, 25 bp, E. coli
tacgtgaacgaggatttgagcgcgc

SEQ ID NO: 70794 - DNA, 25 bp, E. coli
tatgatcccgcagctgcaaatcgag

SEQ ID NO: 70795 - DNA, 25 bp, E. coli
tagaagatgaaacccgcactcagga

SEQ ID NO: 70796 - DNA, 25 bp, E. coli
tagaagatgaaagccgcactcagga

SEQ ID NO: 70797 - DNA, 25 bp, E. coli
tacgtgaacgagcatttgagcgcgc

SEQ ID NO: 70798 - DNA, 25 bp, E. coli
tatgatcccgcacctgcaaatcgag

SEQ ID NO: 70799 - DNA, 25 bp, E. coli
tcttgacgatatgcaccaggccttt

SEQ ID NO: 70800 - DNA, 25 bp, E. coli
tcttgacgatatccaccaggccttt

SEQ ID NO: 70801 - DNA, 25 bp, E. coli
gccgcatgatgcctaaagtcactga

SEQ ID NO: 70802 - DNA, 25 bp, E. coli
gccgcatgatgcgtaaagtcactga

SEQ ID NO: 70803 - DNA, 25 bp, E. coli
gcattactgaaaccgccagtggtcg

SEQ ID NO: 70804 - DNA, 25 bp, E. coli
gcattactgaaagcgccagtggtcg

SEQ ID NO: 70805 - DNA, 25 bp, E. coli
gaacattacaggcactggatgcggt

SEQ ID NO: 70806 - DNA, 25 bp, E. coli
gaacattacagggactggatgcggt

SEQ ID NO: 70807 - DNA, 25 bp, E. coli
gaaacgcccggactacagaacatta

SEQ ID NO: 70808 - DNA, 25 bp, E. coli
gaaacgcccggagtacagaacatta

SEQ ID NO: 70809 - DNA, 25 bp, E. coli
tggctgggcgatgaacaaaccggtt

SEQ ID NO: 70810 - DNA, 25 bp, E. coli
tggctgggcgatcaacaaaccggtt

SEQ ID NO: 70811 - DNA, 25 bp, E. coli
tggaaaatatgttcgggcagccgct

SEQ ID NO: 70812 - DNA, 25 bp, E. coli
tggaaaatatgtacgggcagccgct

SEQ ID NO: 70813 - DNA, 25 bp, E. coli
gagtattcaacaacaggcgctgccg

SEQ ID NO: 70814 - DNA, 25 bp, E. coli
gagtattcaacatcaggcgctgccg

SEQ ID NO: 70815 - DNA, 25 bp, E. coli
aacttgcccggcagttgtacaccga

SEQ ID NO: 70816 - DNA, 25 bp, E. coli
aacttgcccggctgttgtacaccga

SEQ ID NO: 70817 - DNA, 25 bp, E. coli
tacccgtactcactcaactggctgg

SEQ ID NO: 70818 - DNA, 25 bp, E. coli
tacccgtactcagtcaactggctgg

SEQ ID NO: 70819 - DNA, 25 bp, E. coli
ttaattatctgcagcaatgcggcga

SEQ ID NO: 70820 - DNA, 25 bp, E. coli
ttaattatctgctgcaatgcggcga

SEQ ID NO: 70821 - DNA, 25 bp, E. coli
ttcaaaagcatattcgcgaccgcga

SEQ ID NO: 70822 - DNA, 25 bp, E. coli
ttcaaaagcataatcgcgaccgcga

SEQ ID NO: 70823 - DNA, 25 bp, E. coli
tgagtttgacgaaccgcaacttgcc

SEQ ID NO: 70824 - DNA, 25 bp, E. coli
tgagtttgacgatccgcaacttgcc

SEQ ID NO: 70825 - DNA, 25 bp, E. coli
tgcaacctgcaaaccttacgcctgg

SEQ ID NO: 70826 - DNA, 25 bp, E. coli
tgcaacctgcaatccttacgcctgg

SEQ ID NO: 70827 - DNA, 25 bp, E. coli
ccacgcttttggttagaggcttcac

SEQ ID NO: 70828 - DNA, 25 bp, E. coli
ccacgcttttggatagaggcttcac

SEQ ID NO: 70829 - DNA, 25 bp, E. coli
gaatatggctttacggctaatgcgc

SEQ ID NO: 70830 - DNA, 25 bp, E. coli
gaatatggcttttcggctaatgcgc

SEQ ID NO: 70831 - DNA, 25 bp, E. coli
gaacgttcaccagtacaaaaggaga

SEQ ID NO: 70832 - DNA, 25 bp, E. coli
gaacgttcaccactacaaaaggaga

SEQ ID NO: 70833 - DNA, 25 bp, E. coli
gtttacgcgctttctactcggatgt

SEQ ID NO: 70834 - DNA, 25 bp, E. coli
gtttacgcgcttactactcggatgt

SEQ ID NO: 70835 - DNA, 25 bp, E. coli
ggtcgacaggatcaccacgcttttg

SEQ ID NO: 70836 - DNA, 25 bp, E. coli
ggtcgacaggatgaccacgcttttg

SEQ ID NO: 70837 - DNA, 25 bp, E. coli
tactgatgccaaaggacagtccagc

SEQ ID NO: 70838 - DNA, 25 bp, E. coli
tactgatgccaatggacagtccagc

SEQ ID NO: 70839 - DNA, 25 bp, E. coli
aaattgacgatgaaggccgcgttgc

SEQ ID NO: 70840 - DNA, 25 bp, E. coli
aaattgacgatgtaggccgcgttgc

SEQ ID NO: 70841 - DNA, 25 bp, E. coli
tattcgccatgaaggcaatgagctg

SEQ ID NO: 70842 - DNA, 25 bp, E. coli
tattcgccatgatggcaatgagctg

SEQ ID NO: 70843 - DNA, 25 bp, E. coli
tgagctggagctcgaaattcactgc

SEQ ID NO: 70844 - DNA, 25 bp, E. coli
tgagctggagctggaaattcactgc

SEQ ID NO: 70845 - DNA, 25 bp, E. coli
tccggttgaacgcatggtgaccctg

SEQ ID NO: 70846 - DNA, 25 bp, E. coli
tccggttgaacggatggtgaccctg

SEQ ID NO: 70847 - DNA, 25 bp, E. coli
tgctggactccgacaaacgctatcg

SEQ ID NO: 70848 - DNA, 25 bp, E. coli
tccgtggcgataacgaacagatccc

SEQ ID NO: 70849 - DNA, 25 bp, E. coli
tcgcggtcgcgacattaacggcgtt

SEQ ID NO: 70850 - DNA, 25 bp, E. coli
tgctggactccgtcaaacgctatcg

SEQ ID NO: 70851 - DNA, 25 bp, E. coli
tccgtggcgatatcgaacagatccc

SEQ ID NO: 70852 - DNA, 25 bp, E. coli
tcgcggtcgcgagattaacggcgtt

SEQ ID NO: 70853 - DNA, 25 bp, E. coli
gctatcgggtcaatgcgcgtcttgg

SEQ ID NO: 70854 - DNA, 25 bp, E. coli
gctatcgggtcattgcgcgtcttgg

SEQ ID NO: 70855 - DNA, 25 bp, E. coli
gcaacgatgcgctgcaaaaagtgaa

SEQ ID NO: 70856 - DNA, 25 bp, E. coli
gaagcgacgaagttttcccagtatc

SEQ ID NO: 70857 - DNA, 25 bp, E. coli
gaagcgacgaagatttcccagtatc

SEQ ID NO: 70858 - DNA, 25 bp, E. coli
gcaacgatgcgcagcaaaaagtgaa

SEQ ID NO: 70859 - DNA, 25 bp, E. coli
taaaaacgtcgaagacatttgccgt

SEQ ID NO: 70860 - DNA, 25 bp, E. coli
atcggcatgttaaacggcgtcttta

SEQ ID NO: 70861 - DNA, 25 bp, E. coli
atcggcatgttatacggcgtcttta

SEQ ID NO: 70862 - DNA, 25 bp, E. coli
agaagcaccgcgtaacggtaacgct

SEQ ID NO: 70863 - DNA, 25 bp, E. coli
agaagcaccgcgaaacggtaacgct

SEQ ID NO: 70864 - DNA, 25 bp, E. coli
aaacgtcgatgacatttgccgtagc

SEQ ID NO: 70865 - DNA, 25 bp, E. coli
aaacgtcgatgagatttgccgtagc

SEQ ID NO: 70866 - DNA, 25 bp, E. coli
tttccggataaatacgtcgatgaca

SEQ ID NO: 70867 - DNA, 25 bp, E. coli
tttccggataaaaacgtcgatgaca

SEQ ID NO: 70868 - DNA, 25 bp, E. coli
tccggataaaaaggtcgatgacatt

SEQ ID NO: 70869 - DNA, 25 bp, E. coli
tcgatgacatttcccgtagcgtact

SEQ ID NO: 70870 - DNA, 25 bp, E. coli
tgcccgtcaggctaattctgaaatc

SEQ ID NO: 70871 - DNA, 25 bp, E. coli
tcgatgacatttgccgtagcgtact

SEQ ID NO: 70872 - DNA, 25 bp, E. coli
tgcccgtcaggcaaattctgaaatc

SEQ ID NO: 70873 - DNA, 25 bp, E. coli
tccggataaaaacgtcgatgacatt

SEQ ID NO: 70874 - DNA, 25 bp, E. coli
cggcatgttaaacggcgtctttaag

SEQ ID NO: 70875 - DNA, 25 bp, E. coli
cgtcaggctaattctgaaatcaaaa

SEQ ID NO: 70876 - DNA, 25 bp, E. coli
cgtcgatgacatttgccgtagcgta

SEQ ID NO: 70877 - DNA, 25 bp, E. coli
cgtcaggctaatactgaaatcaaaa

SEQ ID NO: 70878 - DNA, 25 bp, E. coli
cgtcgatgacatatgccgtagcgta

SEQ ID NO: 70879 - DNA, 25 bp, E. coli
cggcatgttaaagggcgtctttaag

SEQ ID NO: 70880 - DNA, 25 bp, E. coli
taaaaacgtcgatgacatttgccgt

SEQ ID NO: 70881 - DNA, 25 bp, E. coli
aatattttgcgtagcgtgccatcgg

SEQ ID NO: 70882 - DNA, 25 bp, E. coli
aatattttgcgttgcgtgccatcgg

SEQ ID NO: 70883 - DNA, 25 bp, E. coli
catcggttttctccggtggcacggt

SEQ ID NO: 70884 - DNA, 25 bp, E. coli
cacggtgttactgagcgggagttca

SEQ ID NO: 70885 - DNA, 25 bp, E. coli
catcggttttctgcggtggcacggt

SEQ ID NO: 70886 - DNA, 25 bp, E. coli
cacggtgttactcagcgggagttca

SEQ ID NO: 70887 - DNA, 25 bp, E. coli
tgaatgcgtgagtataccgcccgtg

SEQ ID NO: 70888 - DNA, 25 bp, E. coli
tgaatgcgtgagaataccgcccgtg

SEQ ID NO: 70889 - DNA, 25 bp, E. coli
gcgttcggaataaggcagcctgaca

SEQ ID NO: 70890 - DNA, 25 bp, E. coli
gcgttcggaatatggcagcctgaca

SEQ ID NO: 70891 - DNA, 25 bp, E. coli
gacagagattatccagtgccgatag

SEQ ID NO: 70892 - DNA, 25 bp, E. coli
gacagagattatgcagtgccgatag

SEQ ID NO: 70893 - DNA, 25 bp, E. coli
gagctttcttaagctcgaacccgcg

SEQ ID NO: 70894 - DNA, 25 bp, E. coli
gagctttcttaacctcgaacccgcg

SEQ ID NO: 70895 - DNA, 25 bp, E. coli
cccgcgcctgcgctaagaatgaatc

SEQ ID NO: 70896 - DNA, 25 bp, E. coli
cccgcgcctgcggtaagaatgaatc

SEQ ID NO: 70897 - DNA, 25 bp, E. coli
cgtgcaggcaagtacgggcgaatta

SEQ ID NO: 70898 - DNA, 25 bp, E. coli
cgtgcaggcaagaacgggcgaatta

SEQ ID NO: 70899 - DNA, 25 bp, E. coli
tggagggtgctgcaaccattcagac

SEQ ID NO: 70900 - DNA, 25 bp, E. coli
tggagggtgctggaaccattcagac

SEQ ID NO: 70901 - DNA, 25 bp, E. coli
tcagccccgcgctagattgtagatg

SEQ ID NO: 70902 - DNA, 25 bp, E. coli
tcagccccgcgcaagattgtagatg

SEQ ID NO: 70903 - DNA, 25 bp, E. coli
caaaaacacgttgattgatgccaaa

SEQ ID NO: 70904 - DNA, 25 bp, E. coli
caaaaacacgttcattgatgccaaa

SEQ ID NO: 70905 - DNA, 25 bp, E. coli
tagagtttaacgttccgcaaacggg

SEQ ID NO: 70906 - DNA, 25 bp, E. coli
tagagtttaacgatccgcaaacggg

SEQ ID NO: 70907 - DNA, 25 bp, E. coli
aacgcgcgaatcaactgggccagcg

SEQ ID NO: 70908 - DNA, 25 bp, E. coli
aaagaatcactctgcgaacgcgcga

SEQ ID NO: 70909 - DNA, 25 bp, E. coli
aaagaaagcgttgcggccattgctg

SEQ ID NO: 70910 - DNA, 25 bp, E. coli
aacgcgcgaatctactgggccagcg

SEQ ID NO: 70911 - DNA, 25 bp, E. coli
aaagaaagcgttccggccattgctg

SEQ ID NO: 70912 - DNA, 25 bp, E. coli
aaagaatcactcagcgaacgcgcga

SEQ ID NO: 70913 - DNA, 25 bp, E. coli
tgggccagcgtcacaaaaacacgtt

SEQ ID NO: 70914 - DNA, 25 bp, E. coli
tgggccagcgtctcaaaaacacgtt

SEQ ID NO: 70915 - DNA, 25 bp, E. coli
tgaccggaaaagttgcgccgtacaa

SEQ ID NO: 70916 - DNA, 25 bp, E. coli
tgaccggaaaagatgcgccgtacaa

SEQ ID NO: 70917 - DNA, 25 bp, E. coli
tgcacagaaaatccagcaacgcgcg

SEQ ID NO: 70918 - DNA, 25 bp, E. coli
tgcacagaaaatgcagcaacgcgcg

SEQ ID NO: 70919 - DNA, 25 bp, E. coli
cgcgtaccggtaagctgtttgccat

SEQ ID NO: 70920 - DNA, 25 bp, E. coli
cgcgtaccggtatgctgtttgccat

SEQ ID NO: 70921 - DNA, 25 bp, E. coli
cgtcagcggcgattgcacagaaaat

SEQ ID NO: 70922 - DNA, 25 bp, E. coli
cgtcagcggcgaatgcacagaaaat

SEQ ID NO: 70923 - DNA, 25 bp, E. coli
ggctgctcctgctgacctgtggcgc

SEQ ID NO: 70924 - DNA, 25 bp, E. coli
ggctgctcctgcagacctgtggcgc

SEQ ID NO: 70925 - DNA, 25 bp, E. coli
aagttttcagagttgagaatgtgcc

SEQ ID NO: 70926 - DNA, 25 bp, E. coli
aatgtgccttcgggaaccgtgagac

SEQ ID NO: 70927 - DNA, 25 bp, E. coli
aatgtgccttcgcgaaccgtgagac

SEQ ID NO: 70928 - DNA, 25 bp, E. coli
aagttttcagagatgagaatgtgcc

SEQ ID NO: 70929 - DNA, 25 bp, E. coli
cacggaagttttgagagatgagaat

SEQ ID NO: 70930 - DNA, 25 bp, E. coli
cacggaagttttcagagatgagaat

SEQ ID NO: 70931 - DNA, 25 bp, E. coli
agatgagaatgtcccttcgggaacc

SEQ ID NO: 70932 - DNA, 25 bp, E. coli
agatgagaatgtgccttcgggaacc

SEQ ID NO: 70933 - DNA, 25 bp, E. coli
ttttcagagatgtgaatgtgccttc

SEQ ID NO: 70934 - DNA, 25 bp, E. coli
ttttcagagatgagaatgtgccttc

SEQ ID NO: 70935 - DNA, 25 bp, E. coli
tccacggaagttttcagagatgaga

SEQ ID NO: 70936 - DNA, 25 bp, E. coli
tccacggaagttatcagagatgaga

SEQ ID NO: 70937 - DNA, 25 bp, E. coli
tcagagatgagattgtgccttcggg

SEQ ID NO: 70938 - DNA, 25 bp, E. coli
tcagagatgagaatgtgccttcggg

SEQ ID NO: 70939 - DNA, 25 bp, E. coli
tcttgacatccacggaagttttcag

SEQ ID NO: 70940 - DNA, 25 bp, E. coli
tcttgacatccagggaagttttcag

SEQ ID NO: 70941 - DNA, 25 bp, E. coli
gacatccacggaagttttcagagat

SEQ ID NO: 70942 - DNA, 25 bp, E. coli
gacatccacggatgttttcagagat

SEQ ID NO: 70943 - DNA, 25 bp, E. coli
ggtcttgacatccacggaagttttc

SEQ ID NO: 70944 - DNA, 25 bp, E. coli
ggtcttgacatcgacggaagttttc

SEQ ID NO: 70945 - DNA, 25 bp, E. coli
gagaatgtgccttcgggaaccgtga

SEQ ID NO: 70946 - DNA, 25 bp, E. coli
gagaatgtgcctacgggaaccgtga

SEQ ID NO: 70947 - DNA, 25 bp, E. coli
aatttgtcagcatcgtgcttccccg

SEQ ID NO: 70948 - DNA, 25 bp, E. coli
aatcgtccgatttaaaaccctgcag

SEQ ID NO: 70949 - DNA, 25 bp, E. coli
aatttgtcagcaacgtgcttccccg

SEQ ID NO: 70950 - DNA, 25 bp, E. coli
aaccctgcagaaacggataatcatg

SEQ ID NO: 70951 - DNA, 25 bp, E. coli
aatcgtccgattaaaaaccctgcag

SEQ ID NO: 70952 - DNA, 25 bp, E. coli
aaccctgcagaatcggataatcatg

SEQ ID NO: 70953 - DNA, 25 bp, E. coli
taaagcgcaattagtcagcaacgtg

SEQ ID NO: 70954 - DNA, 25 bp, E. coli
taaagcgcaatttgtcagcaacgtg

SEQ ID NO: 70955 - DNA, 25 bp, E. coli
ttaactgagactcacggcaacgcca

SEQ ID NO: 70956 - DNA, 25 bp, E. coli
ttaactgagactgacggcaacgcca

SEQ ID NO: 70957 - DNA, 25 bp, E. coli
tcgttgtaacctcattaactgagac

SEQ ID NO: 70958 - DNA, 25 bp, E. coli
tcgttgtaacctgattaactgagac

SEQ ID NO: 70959 - DNA, 25 bp, E. coli
tctgcctggaatttacctgtaaccc

SEQ ID NO: 70960 - DNA, 25 bp, E. coli
tcatttcacccagtaatcgtccgat

SEQ ID NO: 70961 - DNA, 25 bp, E. coli
tcatttcacccactaatcgtccgat

SEQ ID NO: 70962 - DNA, 25 bp, E. coli
tctgcctggaatatacctgtaaccc

SEQ ID NO: 70963 - DNA, 25 bp, E. coli
gcatccggcaacataaagcgcaatt

SEQ ID NO: 70964 - DNA, 25 bp, E. coli
gcatccggcaacttaaagcgcaatt

SEQ ID NO: 70965 - DNA, 25 bp, E. coli
gataactcatattacgcagggctgt

SEQ ID NO: 70966 - DNA, 25 bp, E. coli
gataactcatataacgcagggctgt

SEQ ID NO: 70967 - DNA, 25 bp, E. coli
ggcctacaagttgaattgcaattta

SEQ ID NO: 70968 - DNA, 25 bp, E. coli
ggcctacaagttcaattgcaattta

SEQ ID NO: 70969 - DNA, 25 bp, E. coli
tatgcatggcgatctaggcatttca

SEQ ID NO: 70970 - DNA, 25 bp, E. coli
tatgcatggcgaactaggcatttca

SEQ ID NO: 70971 - DNA, 25 bp, E. coli
tattcaatgcctttcttctggtggg

SEQ ID NO: 70972 - DNA, 25 bp, E. coli
tattcaatgcctatcttctggtggg

SEQ ID NO: 70973 - DNA, 25 bp, E. coli
gcctggcgctgagaggttattcaat

SEQ ID NO: 70974 - DNA, 25 bp, E. coli
gcctggcgctgacaggttattcaat

SEQ ID NO: 70975 - DNA, 25 bp, E. coli
gctgacaggttattcaatgcctatc

SEQ ID NO: 70976 - DNA, 25 bp, E. coli
gctgacaggttaatcaatgcctatc

SEQ ID NO: 70977 - DNA, 25 bp, E. coli
gcatggcgatcttggcatttcaatg

SEQ ID NO: 70978 - DNA, 25 bp, E. coli
gcatggcgatctaggcatttcaatg

SEQ ID NO: 70979 - DNA, 25 bp, E. coli
cccgtctccggtggcgtgagcgata

SEQ ID NO: 70980 - DNA, 25 bp, E. coli
cccgtctccggtcgcgtgagcgata

SEQ ID NO: 70981 - DNA, 25 bp, E. coli
cgatctaggcatatcaatgaaaagc

SEQ ID NO: 70982 - DNA, 25 bp, E. coli
cgatctaggcatttcaatgaaaagc

SEQ ID NO: 70983 - DNA, 25 bp, E. coli
tggcctggcgctcacaggttattca

SEQ ID NO: 70984 - DNA, 25 bp, E. coli
tggcgctgacagcttattcaatgcc

SEQ ID NO: 70985 - DNA, 25 bp, E. coli
tggcgctgacaggttattcaatgcc

SEQ ID NO: 70986 - DNA, 25 bp, E. coli
tggcgatctagggatttcaatgaaa

SEQ ID NO: 70987 - DNA, 25 bp, E. coli
tggcctggcgctgacaggttattca

SEQ ID NO: 70988 - DNA, 25 bp, E. coli
ggcgttatgcatggcgatctaggca

SEQ ID NO: 70989 - DNA, 25 bp, E. coli
ggcgttatgcatcgcgatctaggca

SEQ ID NO: 70990 - DNA, 25 bp, E. coli
tggcgatctaggcatttcaatgaaa

SEQ ID NO: 70991 - DNA, 25 bp, E. coli
catccgccgcagtggtcgtcgtgcg

SEQ ID NO: 70992 - DNA, 25 bp, E. coli
cagtggtcgtcgtgcgtgtggtggt

SEQ ID NO: 70993 - DNA, 25 bp, E. coli
catccgccgcagaggtcgtcgtgcg

SEQ ID NO: 70994 - DNA, 25 bp, E. coli
cagtggtcgtcgagcgtgtggtggt

SEQ ID NO: 70995 - DNA, 25 bp, E. coli
atccgccgcagtcgtcgtcgtgcgt

SEQ ID NO: 70996 - DNA, 25 bp, E. coli
atccgccgcagtggtcgtcgtgcgt

SEQ ID NO: 70997 - DNA, 25 bp, E. coli
aaactactaccaactgcgccatccg

SEQ ID NO: 70998 - DNA, 25 bp, E. coli
aaactactaccatctgcgccatccg

SEQ ID NO: 70999 - DNA, 25 bp, E. coli
tggtggtggtcgtcggcaatgcgcc

SEQ ID NO: 71000 - DNA, 25 bp, E. coli
tggtggtggtcgacggcaatgcgcc

SEQ ID NO: 71001 - DNA, 25 bp, E. coli
gccatccgccgctgtggtcgtcgtg

SEQ ID NO: 71002 - DNA, 25 bp, E. coli
gccatccgccgcagtggtcgtcgtg

SEQ ID NO: 71003 - DNA, 25 bp, E. coli
gcgtgtggtggtggtcgtcggcaat

SEQ ID NO: 71004 - DNA, 25 bp, E. coli
gcgtgtggtggtcgtcgtcggcaat

SEQ ID NO: 71005 - DNA, 25 bp, E. coli
gcaaaactactagcaactgcgccat

SEQ ID NO: 71006 - DNA, 25 bp, E. coli
gcaaaactactaccaactgcgccat

SEQ ID NO: 71007 - DNA, 25 bp, E. coli
cgtcgtgcgtgtggtggtggtcgtc

SEQ ID NO: 71008 - DNA, 25 bp, E. coli
cgtcgtgcgtgtcgtggtggtcgtc

SEQ ID NO: 71009 - DNA, 25 bp, E. coli
ggtggtcgtcgggaatgcgccgtag

SEQ ID NO: 71010 - DNA, 25 bp, E. coli
ggtggtcgtcggcaatgcgccgtag

SEQ ID NO: 71011 - DNA, 25 bp, E. coli
tcaacgcaaaacaactaccaactgc

SEQ ID NO: 71012 - DNA, 25 bp, E. coli
tcaacgcaaaactactaccaactgc

SEQ ID NO: 71013 - DNA, 25 bp, E. coli
cacattaaagtgttccatatcctga

SEQ ID NO: 71014 - DNA, 25 bp, E. coli
cacattaaagtgatccatatcctga

SEQ ID NO: 71015 - DNA, 25 bp, E. coli
acgccaatattcacgccattcagcg

SEQ ID NO: 71016 - DNA, 25 bp, E. coli
aaagtgatccatttcctgatccagt

SEQ ID NO: 71017 - DNA, 25 bp, E. coli
aaagatgacgcctatattcacgcca

SEQ ID NO: 71018 - DNA, 25 bp, E. coli
acgccaatattctcgccattcagcg

SEQ ID NO: 71019 - DNA, 25 bp, E. coli
aaagtgatccatatcctgatccagt

SEQ ID NO: 71020 - DNA, 25 bp, E. coli
aaagatgacgccaatattcacgcca

SEQ ID NO: 71021 - DNA, 25 bp, E. coli
tagcagacagctataaagccggtgg

SEQ ID NO: 71022 - DNA, 25 bp, E. coli
tagcagacagctttaaagccggtgg

SEQ ID NO: 71023 - DNA, 25 bp, E. coli
tttggttatgcccaccgcattcagg

SEQ ID NO: 71024 - DNA, 25 bp, E. coli
tttggttatgccgaccgcattcagg

SEQ ID NO: 71025 - DNA, 25 bp, E. coli
tctgcaaacgtgatcaaagcgatcg

SEQ ID NO: 71026 - DNA, 25 bp, E. coli
tctgcaaacgtgttcaaagcgatcg

SEQ ID NO: 71027 - DNA, 25 bp, E. coli
gcggcggtcctgatagcagacagct

SEQ ID NO: 71028 - DNA, 25 bp, E. coli
gcggcggtcctgttagcagacagct

SEQ ID NO: 71029 - DNA, 25 bp, E. coli
gcggcggaaacgctggctaactttt

SEQ ID NO: 71030 - DNA, 25 bp, E. coli
gctaactttttataagatgacgcca

SEQ ID NO: 71031 - DNA, 25 bp, E. coli
gctaactttttaaaagatgacgcca

SEQ ID NO: 71032 - DNA, 25 bp, E. coli
gcggcggaaacggtggctaactttt

SEQ ID NO: 71033 - DNA, 25 bp, E. coli
ggtaactctgcatacgtgatcaaag

SEQ ID NO: 71034 - DNA, 25 bp, E. coli
ggtaactctgcaaacgtgatcaaag

SEQ ID NO: 71035 - DNA, 25 bp, E. coli
cagtctttaaggctagctatcacag

SEQ ID NO: 71036 - DNA, 25 bp, E. coli
cagtctttaagggtagctatcacag

SEQ ID NO: 71037 - DNA, 25 bp, E. coli
taccacaggtttagggagaattcct

SEQ ID NO: 71038 - DNA, 25 bp, E. coli
taccacaggttttgggagaattcct

SEQ ID NO: 71039 - DNA, 25 bp, E. coli
tatattcatcacagaaacagttcgt

SEQ ID NO: 71040 - DNA, 25 bp, E. coli
tatattcatcactgaaacagttcgt

SEQ ID NO: 71041 - DNA, 25 bp, E. coli
tcatgattaacagggagaaagggtt

SEQ ID NO: 71042 - DNA, 25 bp, E. coli
tcatgattaacacggagaaagggtt

SEQ ID NO: 71043 - DNA, 25 bp, E. coli
gaaccagacaaaaatcagggataaa

SEQ ID NO: 71044 - DNA, 25 bp, E. coli
gcaacctccagacacagttcaaaaa

SEQ ID NO: 71045 - DNA, 25 bp, E. coli
gcaacctccagagacagttcaaaaa

SEQ ID NO: 71046 - DNA, 25 bp, E. coli
gaaccagacaaatatcagggataaa

SEQ ID NO: 71047 - DNA, 25 bp, E. coli
gacagttcaaaaaagagtcagtctt

SEQ ID NO: 71048 - DNA, 25 bp, E. coli
gacagttcaaaatagagtcagtctt

SEQ ID NO: 71049 - DNA, 25 bp, E. coli
ctatcacagcgggaaaacgggcggt

SEQ ID NO: 71050 - DNA, 25 bp, E. coli
ctatcacagcggcaaaacgggcggt

SEQ ID NO: 71051 - DNA, 25 bp, E. coli
gggataaatattttaatcatggcga

SEQ ID NO: 71052 - DNA, 25 bp, E. coli
gggataaatattataatcatggcga

SEQ ID NO: 71053 - DNA, 25 bp, E. coli
ggcgaatgatttcttcatgattaac

SEQ ID NO: 71054 - DNA, 25 bp, E. coli
ggcgaatgatttgttcatgattaac

SEQ ID NO: 71055 - DNA, 25 bp, E. coli
gagaattcctggtgttcagtgagaa

SEQ ID NO: 71056 - DNA, 25 bp, E. coli
gagaattcctggagttcagtgagaa

SEQ ID NO: 71057 - DNA, 25 bp, E. coli
caatggatcttcacttgcaggcttg

SEQ ID NO: 71058 - DNA, 25 bp, E. coli
aatgcccattatatcgacaaaaaag

SEQ ID NO: 71059 - DNA, 25 bp, E. coli
caatggatcttctcttgcaggcttg

SEQ ID NO: 71060 - DNA, 25 bp, E. coli
caacacagcaatcgatcttcacttg

SEQ ID NO: 71061 - DNA, 25 bp, E. coli
cagctatagacatgatcaatgccca

SEQ ID NO: 71062 - DNA, 25 bp, E. coli
caacacagcaatggatcttcacttg

SEQ ID NO: 71063 - DNA, 25 bp, E. coli
cagcaatggatcttcacttgcaggc

SEQ ID NO: 71064 - DNA, 25 bp, E. coli
cagctatagacaagatcaatgccca

SEQ ID NO: 71065 - DNA, 25 bp, E. coli
cagcaatggatcatcacttgcaggc

SEQ ID NO: 71066 - DNA, 25 bp, E. coli
tatagacaagatgaatgcccattat

SEQ ID NO: 71067 - DNA, 25 bp, E. coli
aatgcccattatttcgacaaaaaag

SEQ ID NO: 71068 - DNA, 25 bp, E. coli
tcagcagctatacacaagatcaatg

SEQ ID NO: 71069 - DNA, 25 bp, E. coli
tcagcagctatagacaagatcaatg

SEQ ID NO: 71070 - DNA, 25 bp, E. coli
gaaaagattcaggagctatagacaa

SEQ ID NO: 71071 - DNA, 25 bp, E. coli
gaaaagattcagcagctatagacaa

SEQ ID NO: 71072 - DNA, 25 bp, E. coli
gattcagcagctttagacaagatca

SEQ ID NO: 71073 - DNA, 25 bp, E. coli
gatcaatgcccattatttcgacaaa

SEQ ID NO: 71074 - DNA, 25 bp, E. coli
gattcagcagctatagacaagatca

SEQ ID NO: 71075 - DNA, 25 bp, E. coli
gatcaatgcccaatatttcgacaaa

SEQ ID NO: 71076 - DNA, 25 bp, E. coli
tggatcttcacttgcaggcttgaac

SEQ ID NO: 71077 - DNA, 25 bp, E. coli
tggatcttcactagcaggcttgaac

SEQ ID NO: 71078 - DNA, 25 bp, E. coli
tatagacaagatcaatgcccattat

SEQ ID NO: 71079 - DNA, 25 bp, E. coli
caatgagagcgaagaagcaccgact

SEQ ID NO: 71080 - DNA, 25 bp, E. coli
caatgagagcgatgaagcaccgact

SEQ ID NO: 71081 - DNA, 25 bp, E. coli
cagggctggatcacgctaacgaaca

SEQ ID NO: 71082 - DNA, 25 bp, E. coli
cagggctggatctcgctaacgaaca

SEQ ID NO: 71083 - DNA, 25 bp, E. coli
taactggcagtctcacattggtcgt

SEQ ID NO: 71084 - DNA, 25 bp, E. coli
taaagcgtctaagggtcgtggcatc

SEQ ID NO: 71085 - DNA, 25 bp, E. coli
taaagcgtctaacggtcgtggcatc

SEQ ID NO: 71086 - DNA, 25 bp, E. coli
ttgaaagccgcaatgactcagccgc

SEQ ID NO: 71087 - DNA, 25 bp, E. coli
ttgccactggatcaactggtcgccg

SEQ ID NO: 71088 - DNA, 25 bp, E. coli
ttgaaagccgcattgactcagccgc

SEQ ID NO: 71089 - DNA, 25 bp, E. coli
ttgccactggatgaactggtcgccg

SEQ ID NO: 71090 - DNA, 25 bp, E. coli
tgatcgagcagattaacgcttccgg

SEQ ID NO: 71091 - DNA, 25 bp, E. coli
tgatcgagcagaataacgcttccgg

SEQ ID NO: 71092 - DNA, 25 bp, E. coli
cgcctgctggaatacggtgctaaca

SEQ ID NO: 71093 - DNA, 25 bp, E. coli
cgcctgctggaaaacggtgctaaca

SEQ ID NO: 71094 - DNA, 25 bp, E. coli
ggtgaaccgctgatccgcaaaggtg

SEQ ID NO: 71095 - DNA, 25 bp, E. coli
ggtgaaccgctgttccgcaaaggtg

SEQ ID NO: 71096 - DNA, 25 bp, E. coli
taatggaagagcattacccgcgtct

SEQ ID NO: 71097 - DNA, 25 bp, E. coli
taactggcagtcacacattggtcgt

SEQ ID NO: 71098 - DNA, 25 bp, E. coli
taatggaagagctttacccgcgtct

SEQ ID NO: 71099 - DNA, 25 bp, E. coli
gagcgtattaagactgccgcgacac

SEQ ID NO: 71100 - DNA, 25 bp, E. coli
gagcgtattaagtctgccgcgacac

SEQ ID NO: 71101 - DNA, 25 bp, E. coli
aagcggaagtcgatgcggtagatat

SEQ ID NO: 71102 - DNA, 25 bp, E. coli
aagcggaagtcgttgcggtagatat

SEQ ID NO: 71103 - DNA, 25 bp, E. coli
agtcgatgcggtagatatctctccc

SEQ ID NO: 71104 - DNA, 25 bp, E. coli
agtcgatgcggttgatatctctccc

SEQ ID NO: 71105 - DNA, 25 bp, E. coli
atgcggtagataactctcccgacgc

SEQ ID NO: 71106 - DNA, 25 bp, E. coli
atgcggtagatatctctcccgacgc

SEQ ID NO: 71107 - DNA, 25 bp, E. coli
agcggaagtcgatgcggtagatatc

SEQ ID NO: 71108 - DNA, 25 bp, E. coli
agcggaagtcgaagcggtagatatc

SEQ ID NO: 71109 - DNA, 25 bp, E. coli
tgcggtagatatctctcccgacgcg

SEQ ID NO: 71110 - DNA, 25 bp, E. coli
tcgatgcggtagttatctctcccga

SEQ ID NO: 71111 - DNA, 25 bp, E. coli
tcgatgcggtagatatctctcccga

SEQ ID NO: 71112 - DNA, 25 bp, E. coli
tgcggtagatatgtctcccgacgcg

SEQ ID NO: 71113 - DNA, 25 bp, E. coli
gcggaagtcgatccggtagatatct

SEQ ID NO: 71114 - DNA, 25 bp, E. coli
gcggaagtcgatgcggtagatatct

SEQ ID NO: 71115 - DNA, 25 bp, E. coli
cgatgcggtagatatctctcccgac

SEQ ID NO: 71116 - DNA, 25 bp, E. coli
cgatgcggtagaaatctctcccgac

SEQ ID NO: 71117 - DNA, 25 bp, E. coli
gtcgatgcggtagatatctctcccg

SEQ ID NO: 71118 - DNA, 25 bp, E. coli
gtcgatgcggtacatatctctcccg

SEQ ID NO: 71119 - DNA, 25 bp, E. coli
ggaagtcgatgcggtagatatctct

SEQ ID NO: 71120 - DNA, 25 bp, E. coli
ggaagtcgatgccgtagatatctct

SEQ ID NO: 71121 - DNA, 25 bp, E. coli
gatgcggtagatttctctcccgacg

SEQ ID NO: 71122 - DNA, 25 bp, E. coli
gatgcggtagatatctctcccgacg

SEQ ID NO: 71123 - DNA, 25 bp, E. coli
taaaacatgttgtgctacagcacca

SEQ ID NO: 71124 - DNA, 25 bp, E. coli
tactcgttcgcagaattgggaatca

SEQ ID NO: 71125 - DNA, 25 bp, E. coli
tactattagtagaattgatgccacc

SEQ ID NO: 71126 - DNA, 25 bp, E. coli
tactattagtagtattgatgccacc

SEQ ID NO: 71127 - DNA, 25 bp, E. coli
taaaacatgttgagctacagcacca

SEQ ID NO: 71128 - DNA, 25 bp, E. coli
tactcgttcgcacaattgggaatca

SEQ ID NO: 71129 - DNA, 25 bp, E. coli
tacagcaccagaatcagcaattaag

SEQ ID NO: 71130 - DNA, 25 bp, E. coli
tacagcaccagattcagcaattaag

SEQ ID NO: 71131 - DNA, 25 bp, E. coli
attgatgccaccttttcagctcgcg

SEQ ID NO: 71132 - DNA, 25 bp, E. coli
attgatgccaccatttcagctcgcg

SEQ ID NO: 71133 - DNA, 25 bp, E. coli
tgcttccggtctggttcgctttgaa

SEQ ID NO: 71134 - DNA, 25 bp, E. coli
tgcttccggtctcgttcgctttgaa

SEQ ID NO: 71135 - DNA, 25 bp, E. coli
tgcgaaatgtatctaatggtcaaac

SEQ ID NO: 71136 - DNA, 25 bp, E. coli
tgcgaaatgtatgtaatggtcaaac

SEQ ID NO: 71137 - DNA, 25 bp, E. coli
cctgacctgttgcagtttgcttccg

SEQ ID NO: 71138 - DNA, 25 bp, E. coli
gctcgcgccccatatgaaaatatag

SEQ ID NO: 71139 - DNA, 25 bp, E. coli
gctcgcgccccaaatgaaaatatag

SEQ ID NO: 71140 - DNA, 25 bp, E. coli
gaatgaaacttcgagacaccgtact

SEQ ID NO: 71141 - DNA, 25 bp, E. coli
gaatgaaacttccagacaccgtact

SEQ ID NO: 71142 - DNA, 25 bp, E. coli
cctgacctgttggagtttgcttccg

SEQ ID NO: 71143 - DNA, 25 bp, E. coli
taagctctaagccatccgcaaaaat

SEQ ID NO: 71144 - DNA, 25 bp, E. coli
taagctctaagcgatccgcaaaaat

SEQ ID NO: 71145 - DNA, 25 bp, E. coli
aatcacggccgagcactttcaggag

SEQ ID NO: 71146 - DNA, 25 bp, E. coli
aatcacggccgaccactttcaggag

SEQ ID NO: 71147 - DNA, 25 bp, E. coli
caagatgctgaagacgaaggaaggc

SEQ ID NO: 71148 - DNA, 25 bp, E. coli
caagatgctgaacacgaaggaaggc

SEQ ID NO: 71149 - DNA, 25 bp, E. coli
tatcgagatggaaacgggtactggc

SEQ ID NO: 71150 - DNA, 25 bp, E. coli
tattatcactagctgagccggtgcg

SEQ ID NO: 71151 - DNA, 25 bp, E. coli
tattatcactaggtgagccggtgcg

SEQ ID NO: 71152 - DNA, 25 bp, E. coli
tatcgagatggatacgggtactggc

SEQ ID NO: 71153 - DNA, 25 bp, E. coli
ttattgacgaagtggccaggtaccg

SEQ ID NO: 71154 - DNA, 25 bp, E. coli
tttaccacgggtcagagcaaacagg

SEQ ID NO: 71155 - DNA, 25 bp, E. coli
tttaccacgggtgagagcaaacagg

SEQ ID NO: 71156 - DNA, 25 bp, E. coli
ttattgacgaagaggccaggtaccg

SEQ ID NO: 71157 - DNA, 25 bp, E. coli
tgataacatccaccaggtgcagcgc

SEQ ID NO: 71158 - DNA, 25 bp, E. coli
tgataacatccagcaggtgcagcgc

SEQ ID NO: 71159 - DNA, 25 bp, E. coli
tccatcgacaagaagagcaagcgcc

SEQ ID NO: 71160 - DNA, 25 bp, E. coli
tccgtgagacgatcaaggcgcactt

SEQ ID NO: 71161 - DNA, 25 bp, E. coli
tccgtgagacgaacaaggcgcactt

SEQ ID NO: 71162 - DNA, 25 bp, E. coli
tccatcgacaagtagagcaagcgcc

SEQ ID NO: 71163 - DNA, 25 bp, E. coli
gatatttccgagatagcgctgcgcc

SEQ ID NO: 71164 - DNA, 25 bp, E. coli
gatatttccgagttagcgctgcgcc

SEQ ID NO: 71165 - DNA, 25 bp, E. coli
gatgattttcagtcacgtcgcccga

SEQ ID NO: 71166 - DNA, 25 bp, E. coli
gatgattttcagacacgtcgcccga

SEQ ID NO: 71167 - DNA, 25 bp, E. coli
caaagtgatgtaaagcgccgtggcg

SEQ ID NO: 71168 - DNA, 25 bp, E. coli
caaagtgatgtatagcgccgtggcg

SEQ ID NO: 71169 - DNA, 25 bp, E. coli
taaagagcgtacatctgccctggaa

SEQ ID NO: 71170 - DNA, 25 bp, E. coli
tacgcgtagtgaactggcagagtcc

SEQ ID NO: 71171 - DNA, 25 bp, E. coli
taaagagcgtacttctgccctggaa

SEQ ID NO: 71172 - DNA, 25 bp, E. coli
tacgcgtagtgatctggcagagtcc

SEQ ID NO: 71173 - DNA, 25 bp, E. coli
ttaccattaaagacagcggtggcgg

SEQ ID NO: 71174 - DNA, 25 bp, E. coli
ttgaaaaagcatgggccgaaggtcc

SEQ ID NO: 71175 - DNA, 25 bp, E. coli
ttgaaaaagcatcggccgaaggtcc

SEQ ID NO: 71176 - DNA, 25 bp, E. coli
ttggtagcactacgaatacaccggg

SEQ ID NO: 71177 - DNA, 25 bp, E. coli
ttaccattaaagtcagcggtggcgg

SEQ ID NO: 71178 - DNA, 25 bp, E. coli
ttggtagcactaggaatacaccggg

SEQ ID NO: 71179 - DNA, 25 bp, E. coli
gaaggtagctcttacaaacgactgg

SEQ ID NO: 71180 - DNA, 25 bp, E. coli
gaaggtagctctaacaaacgactgg

SEQ ID NO: 71181 - DNA, 25 bp, E. coli
cattgagcgacgtataaaagcccca

SEQ ID NO: 71182 - DNA, 25 bp, E. coli
cattgagcgacgaataaaagcccca

SEQ ID NO: 71183 - DNA, 25 bp, E. coli
gatacccaaggtaaggccatcgctt

SEQ ID NO: 71184 - DNA, 25 bp, E. coli
gatacccaaggttaggccatcgctt

SEQ ID NO: 71185 - DNA, 25 bp, E. coli
tggcgaatgcgaacactgcaaccgt

SEQ ID NO: 71186 - DNA, 25 bp, E. coli
tggcgaatgcgatcactgcaaccgt

SEQ ID NO: 71187 - DNA, 25 bp, E. coli
taatacaggagataaaagagcgcag

SEQ ID NO: 71188 - DNA, 25 bp, E. coli
taatacaggagaaaaaagagcgcag

SEQ ID NO: 71189 - DNA, 25 bp, E. coli
cagccaatggcataatgtatatgaa

SEQ ID NO: 71190 - DNA, 25 bp, E. coli
cagccaatggcaaaatgtatatgaa

SEQ ID NO: 71191 - DNA, 25 bp, E. coli
tacttaggccttcaggctgctaaag

SEQ ID NO: 71192 - DNA, 25 bp, E. coli
tacttaggccttgaggctgctaaag

SEQ ID NO: 71193 - DNA, 25 bp, E. coli
atgccattttgcgtaattttcagcc

SEQ ID NO: 71194 - DNA, 25 bp, E. coli
atgccattttgcctaattttcagcc

SEQ ID NO: 71195 - DNA, 25 bp, E. coli
acctgatagtgggtatggaagacaa

SEQ ID NO: 71196 - DNA, 25 bp, E. coli
acctgatagtggctatggaagacaa

SEQ ID NO: 71197 - DNA, 25 bp, E. coli
tagtgggtatggtagacaaaatgtt

SEQ ID NO: 71198 - DNA, 25 bp, E. coli
tagtgggtatggaagacaaaatgtt

SEQ ID NO: 71199 - DNA, 25 bp, E. coli
tgtatatgaattagacgactcaatg

SEQ ID NO: 71200 - DNA, 25 bp, E. coli
tgtatatgaatttgacgactcaatg

SEQ ID NO: 71201 - DNA, 25 bp, E. coli
tatgtactacttaggccttcaggct

SEQ ID NO: 71202 - DNA, 25 bp, E. coli
tatgtactactttggccttcaggct

SEQ ID NO: 71203 - DNA, 25 bp, E. coli
tgctaaaggatacctgatagtgggt

SEQ ID NO: 71204 - DNA, 25 bp, E. coli
tgacgactcaatgaatatgtactac

SEQ ID NO: 71205 - DNA, 25 bp, E. coli
tgctaaaggatagctgatagtgggt

SEQ ID NO: 71206 - DNA, 25 bp, E. coli
tgcgtaattttcagccaatggcata

SEQ ID NO: 71207 - DNA, 25 bp, E. coli
tgcgtaattttctgccaatggcata

SEQ ID NO: 71208 - DNA, 25 bp, E. coli
tgacgactcaatcaatatgtactac

SEQ ID NO: 71209 - DNA, 25 bp, E. coli
ccttcaggctgctaaaggatacctg

SEQ ID NO: 71210 - DNA, 25 bp, E. coli
ccttcaggctgcaaaaggatacctg

SEQ ID NO: 71211 - DNA, 25 bp, E. coli
taaacagtaccataacgctcgctgg

SEQ ID NO: 71212 - DNA, 25 bp, E. coli
taaacagtaccaaaacgctcgctgg

SEQ ID NO: 71213 - DNA, 25 bp, E. coli
aaataacggctcagttggtttggca

SEQ ID NO: 71214 - DNA, 25 bp, E. coli
agtaccgcaatgaactcctccctga

SEQ ID NO: 71215 - DNA, 25 bp, E. coli
aaataacggctctgttggtttggca

SEQ ID NO: 71216 - DNA, 25 bp, E. coli
agttcgaccgtcatcaacctgctga

SEQ ID NO: 71217 - DNA, 25 bp, E. coli
agttcgaccgtcttcaacctgctga

SEQ ID NO: 71218 - DNA, 25 bp, E. coli
agtaccgcaatgtactcctccctga

SEQ ID NO: 71219 - DNA, 25 bp, E. coli
aaaagcgagtaaggtcgacgatctc

SEQ ID NO: 71220 - DNA, 25 bp, E. coli
aaaagcgagtaacgtcgacgatctc

SEQ ID NO: 71221 - DNA, 25 bp, E. coli
tattgacgcagttgaaaacggcagt

SEQ ID NO: 71222 - DNA, 25 bp, E. coli
tattgacgcagtagaaaacggcagt

SEQ ID NO: 71223 - DNA, 25 bp, E. coli
gacgctaaaaggagtctcgcccaac

SEQ ID NO: 71224 - DNA, 25 bp, E. coli
gacgctaaaaggtgtctcgcccaac

SEQ ID NO: 71225 - DNA, 25 bp, E. coli
cgacgatctcgttacacagcaagag

SEQ ID NO: 71226 - DNA, 25 bp, E. coli
cgacgatctcgtaacacagcaagag

SEQ ID NO: 71227 - DNA, 25 bp, E. coli
ctcgacaagcgctagatagaacact

SEQ ID NO: 71228 - DNA, 25 bp, E. coli
ctcgacaagcgcaagatagaacact

SEQ ID NO: 71229 - DNA, 25 bp, E. coli
ggcagcaattgcaatttagtaccgc

SEQ ID NO: 71230 - DNA, 25 bp, E. coli
ggcagcaattgctatttagtaccgc

SEQ ID NO: 71231 - DNA, 25 bp, E. coli
tcaacgcattaggaaaatggcagca

SEQ ID NO: 71232 - DNA, 25 bp, E. coli
tcaacgcattagcaaaatggcagca

SEQ ID NO: 71233 - DNA, 25 bp, E. coli
caaaatcagcggttaaaaaagtgtt

SEQ ID NO: 71234 - DNA, 25 bp, E. coli
caaaatcagcggataaaaaagtgtt

SEQ ID NO: 71235 - DNA, 25 bp, E. coli
taaaaggatgactaatagcataacc

SEQ ID NO: 71236 - DNA, 25 bp, E. coli
tagcataacccaataccctaatggc

SEQ ID NO: 71237 - DNA, 25 bp, E. coli
tagcataacccattaccctaatggc

SEQ ID NO: 71238 - DNA, 25 bp, E. coli
taaaaggatgacaaatagcataacc

SEQ ID NO: 71239 - DNA, 25 bp, E. coli
accctaatggcccagtagttcaggc

SEQ ID NO: 71240 - DNA, 25 bp, E. coli
accctaatggccgagtagttcaggc

SEQ ID NO: 71241 - DNA, 25 bp, E. coli
tagaaatccgaagttatgagtcatc

SEQ ID NO: 71242 - DNA, 25 bp, E. coli
tagaaatccgaacttatgagtcatc

SEQ ID NO: 71243 - DNA, 25 bp, E. coli
tttttcacagttgcttgtgcgcgct

SEQ ID NO: 71244 - DNA, 25 bp, E. coli
tttttcacagttccttgtgcgcgct

SEQ ID NO: 71245 - DNA, 25 bp, E. coli
tgtgcgcgctatactaacgagagaa

SEQ ID NO: 71246 - DNA, 25 bp, E. coli
tgtgcgcgctattctaacgagagaa

SEQ ID NO: 71247 - DNA, 25 bp, E. coli
tagttcaggccatcaggctaattta

SEQ ID NO: 71248 - DNA, 25 bp, E. coli
tctgtaaattacctctgcattatcg

SEQ ID NO: 71249 - DNA, 25 bp, E. coli
tagttcaggccaacaggctaattta

SEQ ID NO: 71250 - DNA, 25 bp, E. coli
tctgtaaattacgtctgcattatcg

SEQ ID NO: 71251 - DNA, 25 bp, E. coli
cgagagaaaagctaaattacgtcaa

SEQ ID NO: 71252 - DNA, 25 bp, E. coli
cgagagaaaagcaaaattacgtcaa

SEQ ID NO: 71253 - DNA, 25 bp, E. coli
gagtcatctctgtgataacattgtg

SEQ ID NO: 71254 - DNA, 25 bp, E. coli
gagtcatctctgagataacattgtg

SEQ ID NO: 71255 - DNA, 25 bp, E. coli
caggttaacttatctacaggagcaa

SEQ ID NO: 71256 - DNA, 25 bp, E. coli
cataaaaactattaccgctgggtgc

SEQ ID NO: 71257 - DNA, 25 bp, E. coli
cataaaaactataaccgctgggtgc

SEQ ID NO: 71258 - DNA, 25 bp, E. coli
caggttaacttaactacaggagcaa

SEQ ID NO: 71259 - DNA, 25 bp, E. coli
tactcaggagcaggttaaaaatgcc

SEQ ID NO: 71260 - DNA, 25 bp, E. coli
tactcaggagcacgttaaaaatgcc

SEQ ID NO: 71261 - DNA, 25 bp, E. coli
tatgttgagtgcctgtgtccgtacg

SEQ ID NO: 71262 - DNA, 25 bp, E. coli
tatgttgagtgcgtgtgtccgtacg

SEQ ID NO: 71263 - DNA, 25 bp, E. coli
tgcgcagcgcaactggattatgacg

SEQ ID NO: 71264 - DNA, 25 bp, E. coli
tgcgcagcgcaagtggattatgacg

SEQ ID NO: 71265 - DNA, 25 bp, E. coli
tcagtgtgggtcttactcaggagca

SEQ ID NO: 71266 - DNA, 25 bp, E. coli
tcagtgtgggtcatactcaggagca

SEQ ID NO: 71267 - DNA, 25 bp, E. coli
gaatctgcaggcatctgatggaaaa

SEQ ID NO: 71268 - DNA, 25 bp, E. coli
gaatctgcaggcttctgatggaaaa

SEQ ID NO: 71269 - DNA, 25 bp, E. coli
ccgctgggtgcgtaacctggataaa

SEQ ID NO: 71270 - DNA, 25 bp, E. coli
ccgctgggtgcgaaacctggataaa

SEQ ID NO: 71271 - DNA, 25 bp, E. coli
cattttgaaagcaggtgcgcagcgc

SEQ ID NO: 71272 - DNA, 25 bp, E. coli
cattttgaaagctggtgcgcagcgc

SEQ ID NO: 71273 - DNA, 25 bp, E. coli
gtacggccccagtgcaacagataag

SEQ ID NO: 71274 - DNA, 25 bp, E. coli
gattatgacgcaagtgtcccctgga

SEQ ID NO: 71275 - DNA, 25 bp, E. coli
gtacggccccagagcaacagataag

SEQ ID NO: 71276 - DNA, 25 bp, E. coli
gattatgacgcatgtgtcccctgga

SEQ ID NO: 71277 - DNA, 25 bp, E. coli
cagtgtcagattattacccaatgga

SEQ ID NO: 71278 - DNA, 25 bp, E. coli
cagtgtcagatttttacccaatgga

SEQ ID NO: 71279 - DNA, 25 bp, E. coli
catgatcagtgtcagatttttaccc

SEQ ID NO: 71280 - DNA, 25 bp, E. coli
catgatcagtgtgagatttttaccc

SEQ ID NO: 71281 - DNA, 25 bp, E. coli
tttgtcagatattacgcctgtgtgc

SEQ ID NO: 71282 - DNA, 25 bp, E. coli
tttgtcagatataacgcctgtgtgc

SEQ ID NO: 71283 - DNA, 25 bp, E. coli
tttttcataacatgatcagtgtcag

SEQ ID NO: 71284 - DNA, 25 bp, E. coli
tttttcataacaagatcagtgtcag

SEQ ID NO: 71285 - DNA, 25 bp, E. coli
tgcagttttgtctgatattacgcct

SEQ ID NO: 71286 - DNA, 25 bp, E. coli
tgacaaaagcagataaaaaagttgt

SEQ ID NO: 71287 - DNA, 25 bp, E. coli
tgacaaaagcagttaaaaaagttgt

SEQ ID NO: 71288 - DNA, 25 bp, E. coli
tgcagttttgtcagatattacgcct

SEQ ID NO: 71289 - DNA, 25 bp, E. coli
gatttttacccattggaaaacgatg

SEQ ID NO: 71290 - DNA, 25 bp, E. coli
gatttttacccaatggaaaacgatg

SEQ ID NO: 71291 - DNA, 25 bp, E. coli
gaaatcgaaatggagttttgtcaga

SEQ ID NO: 71292 - DNA, 25 bp, E. coli
gaaatcgaaatgcagttttgtcaga

SEQ ID NO: 71293 - DNA, 25 bp, E. coli
ctgaaagaaatccaaatgcagtttt

SEQ ID NO: 71294 - DNA, 25 bp, E. coli
ctgaaagaaatcgaaatgcagtttt

SEQ ID NO: 71295 - DNA, 25 bp, E. coli
gtgttaatgacaaaagcagataaaa

SEQ ID NO: 71296 - DNA, 25 bp, E. coli
gtgttaatgacataagcagataaaa

SEQ ID NO: 71297 - DNA, 25 bp, E. coli
gtgtcagattttaacccaatggaaa

SEQ ID NO: 71298 - DNA, 25 bp, E. coli
gtgtcagatttttacccaatggaaa

SEQ ID NO: 71299 - DNA, 25 bp, E. coli
accgggacgccgtatattgatttca

SEQ ID NO: 71300 - DNA, 25 bp, E. coli
accgggacgccgaatattgatttca

SEQ ID NO: 71301 - DNA, 25 bp, E. coli
aaatggatggatcacagcactctga

SEQ ID NO: 71302 - DNA, 25 bp, E. coli
aaatggatggatgacagcactctga

SEQ ID NO: 71303 - DNA, 25 bp, E. coli
taccagttgtattttccaggagtcc

SEQ ID NO: 71304 - DNA, 25 bp, E. coli
taccagttgtatattccaggagtcc

SEQ ID NO: 71305 - DNA, 25 bp, E. coli
tatcaacaacgctatgcaggccaaa

SEQ ID NO: 71306 - DNA, 25 bp, E. coli
tattttacctggcaaggcggtgaac

SEQ ID NO: 71307 - DNA, 25 bp, E. coli
tatcaacaacgcaatgcaggccaaa

SEQ ID NO: 71308 - DNA, 25 bp, E. coli
tattttacctgggaaggcggtgaac

SEQ ID NO: 71309 - DNA, 25 bp, E. coli
tgaacccactctggctggcctggat

SEQ ID NO: 71310 - DNA, 25 bp, E. coli
tgaacccactctcgctggcctggat

SEQ ID NO: 71311 - DNA, 25 bp, E. coli
cattgatttttctgtgcctcccacg

SEQ ID NO: 71312 - DNA, 25 bp, E. coli
cattgatttttcagtgcctcccacg

SEQ ID NO: 71313 - DNA, 25 bp, E. coli
gatagcagccatggagcgtctgaaa

SEQ ID NO: 71314 - DNA, 25 bp, E. coli
gatagcagccatcgagcgtctgaaa

SEQ ID NO: 71315 - DNA, 25 bp, E. coli
tggtcatagtgagaacacattccgt

SEQ ID NO: 71316 - DNA, 25 bp, E. coli
tggtcatagtgacaacacattccgt

SEQ ID NO: 71317 - DNA, 25 bp, E. coli
tcaaacaatataacgcagcgtctgg

SEQ ID NO: 71318 - DNA, 25 bp, E. coli
tcaaacaatatatcgcagcgtctgg

SEQ ID NO: 71319 - DNA, 25 bp, E. coli
gagtaccgctttaccacattatgga

SEQ ID NO: 71320 - DNA, 25 bp, E. coli
gagtaccgcttttccacattatgga

SEQ ID NO: 71321 - DNA, 25 bp, E. coli
aatacaaccccttctggcagcaacg

SEQ ID NO: 71322 - DNA, 25 bp, E. coli
aatacaacccctactggcagcaacg

SEQ ID NO: 71323 - DNA, 25 bp, E. coli
caactttggctgcagtcgtggctga

SEQ ID NO: 71324 - DNA, 25 bp, E. coli
caactttggctggagtcgtggctga

SEQ ID NO: 71325 - DNA, 25 bp, E. coli
catcgggaaggtaaacgcgtgcatc

SEQ ID NO: 71326 - DNA, 25 bp, E. coli
catcgggaaggttaacgcgtgcatc

SEQ ID NO: 71327 - DNA, 25 bp, E. coli
taccagaaacgtaagcatcgggaag

SEQ ID NO: 71328 - DNA, 25 bp, E. coli
taccagaaacgttagcatcgggaag

SEQ ID NO: 71329 - DNA, 25 bp, E. coli
tgcattacgtctgggcccgggagtt

SEQ ID NO: 71330 - DNA, 25 bp, E. coli
tgcattacgtctcggcccgggagtt

SEQ ID NO: 71331 - DNA, 25 bp, E. coli
tgcggcacgcacagaatgttcatcc

SEQ ID NO: 71332 - DNA, 25 bp, E. coli
tgcggcacgcactgaatgttcatcc

SEQ ID NO: 71333 - DNA, 25 bp, E. coli
gcctgacggcattgcgggttgacct

SEQ ID NO: 71334 - DNA, 25 bp, E. coli
gcctgacggcatagcgggttgacct

SEQ ID NO: 71335 - DNA, 25 bp, E. coli
gatatcccgcttgatcaatgccctg

SEQ ID NO: 71336 - DNA, 25 bp, E. coli
gatatcccgcttcatcaatgccctg

SEQ ID NO: 71337 - DNA, 25 bp, E. coli
ggttgacctgcgtttcccggatgta

SEQ ID NO: 71338 - DNA, 25 bp, E. coli
ggttgacctgcgattcccggatgta

SEQ ID NO: 71339 - DNA, 25 bp, E. coli
tcaatgccctgaaagcccgaatcga

SEQ ID NO: 71340 - DNA, 25 bp, E. coli
tcaatgccctgatagcccgaatcga

SEQ ID NO: 71341 - DNA, 25 bp, E. coli
gatgctgctggtgaaccgggatacc

SEQ ID NO: 71342 - DNA, 25 bp, E. coli
gatgctgctggtcaaccgggatacc

SEQ ID NO: 71343 - DNA, 25 bp, E. coli
tttacgcgagccaaatcaattaacc

SEQ ID NO: 71344 - DNA, 25 bp, E. coli
ttcaatcaatcataaacagcgaagc

SEQ ID NO: 71345 - DNA, 25 bp, E. coli
tttacgcgagcctaatcaattaacc

SEQ ID NO: 71346 - DNA, 25 bp, E. coli
ttcaatcaatcaaaaacagcgaagc

SEQ ID NO: 71347 - DNA, 25 bp, E. coli
tgttcgcgcccgtatcgatgaagat

SEQ ID NO: 71348 - DNA, 25 bp, E. coli
tgttcgcgcccgaatcgatgaagat

SEQ ID NO: 71349 - DNA, 25 bp, E. coli
tgatgttcataaggccaaagacgcc

SEQ ID NO: 71350 - DNA, 25 bp, E. coli
tgatgttcataacgccaaagacgcc

SEQ ID NO: 71351 - DNA, 25 bp, E. coli
tcgcgcgtgaaatggcattgccgtt

SEQ ID NO: 71352 - DNA, 25 bp, E. coli
tcgcgcgtgaaaaggcattgccgtt

SEQ ID NO: 71353 - DNA, 25 bp, E. coli
tcgatgaagatcagaagaatcaggc

SEQ ID NO: 71354 - DNA, 25 bp, E. coli
tcgatgaagatctgaagaatcaggc

SEQ ID NO: 71355 - DNA, 25 bp, E. coli
ccaaagacgccgttgatttatttga

SEQ ID NO: 71356 - DNA, 25 bp, E. coli
ccaaagacgccgatgatttatttga

SEQ ID NO: 71357 - DNA, 25 bp, E. coli
cattgccgtttgttttacgcgagcc

SEQ ID NO: 71358 - DNA, 25 bp, E. coli
cattgccgtttgatttacgcgagcc

SEQ ID NO: 71359 - DNA, 25 bp, E. coli
gggctgaccatcactgacctggttc

SEQ ID NO: 71360 - DNA, 25 bp, E. coli
gggctgaccatctctgacctggttc

SEQ ID NO: 71361 - DNA, 25 bp, E. coli
taaccctcacaatggtcgcgcgtga

SEQ ID NO: 71362 - DNA, 25 bp, E. coli
taaccctcacaaaggtcgcgcgtga

SEQ ID NO: 71363 - DNA, 25 bp, E. coli
gacctggttcgcataaccctcacaa

SEQ ID NO: 71364 - DNA, 25 bp, E. coli
gacctggttcgcttaaccctcacaa

SEQ ID NO: 71365 - DNA, 25 bp, E. coli
taacgacacgctttacaatgaaaag

SEQ ID NO: 71366 - DNA, 25 bp, E. coli
agagcgcatacagcacatattgaac

SEQ ID NO: 71367 - DNA, 25 bp, E. coli
agagcgcatacaccacatattgaac

SEQ ID NO: 71368 - DNA, 25 bp, E. coli
taccgctgcagattacttacgccag

SEQ ID NO: 71369 - DNA, 25 bp, E. coli
taccgctgcagaatacttacgccag

SEQ ID NO: 71370 - DNA, 25 bp, E. coli
tatgtaatgaagagtggcgcacgtc

SEQ ID NO: 71371 - DNA, 25 bp, E. coli
tatgtaatgaagtgtggcgcacgtc

SEQ ID NO: 71372 - DNA, 25 bp, E. coli
tattgcaccgcacgtaaaagaagtt

SEQ ID NO: 71373 - DNA, 25 bp, E. coli
tattgcaccgcaggtaaaagaagtt

SEQ ID NO: 71374 - DNA, 25 bp, E. coli
tggttacgccagaaagcatcagcaa

SEQ ID NO: 71375 - DNA, 25 bp, E. coli
tcccgccaggaatggaagacacaaa

SEQ ID NO: 71376 - DNA, 25 bp, E. coli
tcccgccaggaaaggaagacacaaa

SEQ ID NO: 71377 - DNA, 25 bp, E. coli
gccattctcgacataacggacagcg

SEQ ID NO: 71378 - DNA, 25 bp, E. coli
gccattctcgacttaacggacagcg

SEQ ID NO: 71379 - DNA, 25 bp, E. coli
gtttaaactcacatatcccgccagg

SEQ ID NO: 71380 - DNA, 25 bp, E. coli
gtttaaactcacttatcccgccagg

SEQ ID NO: 71381 - DNA, 25 bp, E. coli
tggttacgccagtaagcatcagcaa

SEQ ID NO: 71382 - DNA, 25 bp, E. coli
ggcgcgtatttctgaccggcgtcga

SEQ ID NO: 71383 - DNA, 25 bp, E. coli
ggcgcgtatttcagaccggcgtcga

SEQ ID NO: 71384 - DNA, 25 bp, E. coli
taacgacacgctatacaatgaaaag

SEQ ID NO: 71385 - DNA, 25 bp, E. coli
gaggttcacagaaggttcgtcaata

SEQ ID NO: 71386 - DNA, 25 bp, E. coli
gaggttcacagatggttcgtcaata

SEQ ID NO: 71387 - DNA, 25 bp, E. coli
caactggatggcgtgaatttcgtca

SEQ ID NO: 71388 - DNA, 25 bp, E. coli
cactgaactttacccgtgcggcgga

SEQ ID NO: 71389 - DNA, 25 bp, E. coli
cactgaactttagccgtgcggcgga

SEQ ID NO: 71390 - DNA, 25 bp, E. coli
caactggatggcctgaatttcgtca

SEQ ID NO: 71391 - DNA, 25 bp, E. coli
aaaattcgccgtcgtgaactcgacg

SEQ ID NO: 71392 - DNA, 25 bp, E. coli
acatgaaaaagacatcaccgccgcg

SEQ ID NO: 71393 - DNA, 25 bp, E. coli
acatgaaaaagagatcaccgccgcg

SEQ ID NO: 71394 - DNA, 25 bp, E. coli
aaaattcgccgtggtgaactcgacg

SEQ ID NO: 71395 - DNA, 25 bp, E. coli
tatttcgtcgcagtggcgcaggcac

SEQ ID NO: 71396 - DNA, 25 bp, E. coli
tatttcgtcgcactggcgcaggcac

SEQ ID NO: 71397 - DNA, 25 bp, E. coli
tgccatcggcggtagtgaatttact

SEQ ID NO: 71398 - DNA, 25 bp, E. coli
tgccatcggcggaagtgaatttact

SEQ ID NO: 71399 - DNA, 25 bp, E. coli
ccgttactggtgtgggataagcgca

SEQ ID NO: 71400 - DNA, 25 bp, E. coli
gctggcaatcctggaacaagcggaa

SEQ ID NO: 71401 - DNA, 25 bp, E. coli
gctggcaatcctcgaacaagcggaa

SEQ ID NO: 71402 - DNA, 25 bp, E. coli
gaatgttttctcgaggacgcgctgg

SEQ ID NO: 71403 - DNA, 25 bp, E. coli
gaatgttttctccaggacgcgctgg

SEQ ID NO: 71404 - DNA, 25 bp, E. coli
gaaaatgccaaaatacgggcgcgga

SEQ ID NO: 71405 - DNA, 25 bp, E. coli
gaaaatgccaaattacgggcgcgga

SEQ ID NO: 71406 - DNA, 25 bp, E. coli
ccgttactggtgagggataagcgca

SEQ ID NO: 71407 - DNA, 25 bp, E. coli
gagtttaatcaccacgcaacaggag

SEQ ID NO: 71408 - DNA, 25 bp, E. coli
gagtttaatcacgacgcaacaggag

SEQ ID NO: 71409 - DNA, 25 bp, E. coli
tacttagcaaactatgtgatctcca

SEQ ID NO: 71410 - DNA, 25 bp, E. coli
tacgttgcaacattaaagcctcatt

SEQ ID NO: 71411 - DNA, 25 bp, E. coli
tactcaacgacctgccagaatcata

SEQ ID NO: 71412 - DNA, 25 bp, E. coli
tataaataggccctcccctcaagag

SEQ ID NO: 71413 - DNA, 25 bp, E. coli
tataaataggccgtcccctcaagag

SEQ ID NO: 71414 - DNA, 25 bp, E. coli
tacgttgcaacaataaagcctcatt

SEQ ID NO: 71415 - DNA, 25 bp, E. coli
taaaaccatcactcgaaaaattcag

SEQ ID NO: 71416 - DNA, 25 bp, E. coli
tacttagcaaacaatgtgatctcca

SEQ ID NO: 71417 - DNA, 25 bp, E. coli
tactcaacgaccagccagaatcata

SEQ ID NO: 71418 - DNA, 25 bp, E. coli
tagtggcataaatgttaaccatgtt

SEQ ID NO: 71419 - DNA, 25 bp, E. coli
tatgaatttacaaacaatagtggca

SEQ ID NO: 71420 - DNA, 25 bp, E. coli
tatgaatttacatacaatagtggca

SEQ ID NO: 71421 - DNA, 25 bp, E. coli
tagtggcataaaagttaaccatgtt

SEQ ID NO: 71422 - DNA, 25 bp, E. coli
tatacgggcatttattgaaatgtcc

SEQ ID NO: 71423 - DNA, 25 bp, E. coli
tatacgggcattaattgaaatgtcc

SEQ ID NO: 71424 - DNA, 25 bp, E. coli
tgccgtaaataccaatatacttagc

SEQ ID NO: 71425 - DNA, 25 bp, E. coli
tgccgtaaatacgaatatacttagc

SEQ ID NO: 71426 - DNA, 25 bp, E. coli
gaatcatactctctttatacgggca

SEQ ID NO: 71427 - DNA, 25 bp, E. coli
gaatcatactctgtttatacgggca

SEQ ID NO: 71428 - DNA, 25 bp, E. coli
ccctcaagagtatacaccatagtat

SEQ ID NO: 71429 - DNA, 25 bp, E. coli
ccctcaagagtaaacaccatagtat

SEQ ID NO: 71430 - DNA, 25 bp, E. coli
taaaaccatcacacgaaaaattcag

SEQ ID NO: 71431 - DNA, 25 bp, E. coli
aacgaattgccatactgctgcatga

SEQ ID NO: 71432 - DNA, 25 bp, E. coli
aacgaattgccaaactgctgcatga

SEQ ID NO: 71433 - DNA, 25 bp, E. coli
gaacactacatcgaagagttcgttg

SEQ ID NO: 71434 - DNA, 25 bp, E. coli
gaacactacatccaagagttcgttg

SEQ ID NO: 71435 - DNA, 25 bp, E. coli
catcgaagagttcgttggtcatctg

SEQ ID NO: 71436 - DNA, 25 bp, E. coli
catcgaagagttggttggtcatctg

SEQ ID NO: 71437 - DNA, 25 bp, E. coli
taaagataacggtcgcgtggtagtc

SEQ ID NO: 71438 - DNA, 25 bp, E. coli
taaagataacggacgcgtggtagtc

SEQ ID NO: 71439 - DNA, 25 bp, E. coli
tccaaccgaatacaaacgaattgcc

SEQ ID NO: 71440 - DNA, 25 bp, E. coli
tccaaccgaatagaaacgaattgcc

SEQ ID NO: 71441 - DNA, 25 bp, E. coli
tctcggaatcggacaactgaaatgg

SEQ ID NO: 71442 - DNA, 25 bp, E. coli
tctcggaatcggtcaactgaaatgg

SEQ ID NO: 71443 - DNA, 25 bp, E. coli
gctggctaaccgtctcggaatcgga

SEQ ID NO: 71444 - DNA, 25 bp, E. coli
gctggctaaccgactcggaatcgga

SEQ ID NO: 71445 - DNA, 25 bp, E. coli
cggacaactgaattgggaactggaa

SEQ ID NO: 71446 - DNA, 25 bp, E. coli
cggacaactgaaatgggaactggaa

SEQ ID NO: 71447 - DNA, 25 bp, E. coli
gttacctccatcgaaccgaatacaa

SEQ ID NO: 71448 - DNA, 25 bp, E. coli
gttacctccatccaaccgaatacaa

SEQ ID NO: 71449 - DNA, 25 bp, E. coli
tggtagtcgaaggtgttggcaacct

SEQ ID NO: 71450 - DNA, 25 bp, E. coli
tggtagtcgaagctgttggcaacct

SEQ ID NO: 71451 - DNA, 25 bp, E. coli
gagtgtaccaacatctacgcaccgc

SEQ ID NO: 71452 - DNA, 25 bp, E. coli
gagtgtaccaacttctacgcaccgc

SEQ ID NO: 71453 - DNA, 25 bp, E. coli
cataaaagggcggtcagtggtcacg

SEQ ID NO: 71454 - DNA, 25 bp, E. coli
caggcgttgaaatccatggcggatc

SEQ ID NO: 71455 - DNA, 25 bp, E. coli
caggcgttgaaaaccatggcggatc

SEQ ID NO: 71456 - DNA, 25 bp, E. coli
cataaaagggcgctcagtggtcacg

SEQ ID NO: 71457 - DNA, 25 bp, E. coli
taaaacgcgcaggtctgagacacag

SEQ ID NO: 71458 - DNA, 25 bp, E. coli
taaaacgcgcagctctgagacacag

SEQ ID NO: 71459 - DNA, 25 bp, E. coli
actacaaggttgactccatcaggga

SEQ ID NO: 71460 - DNA, 25 bp, E. coli
aaaacagcagcagttgtccggacct

SEQ ID NO: 71461 - DNA, 25 bp, E. coli
aaaacagcagcacttgtccggacct

SEQ ID NO: 71462 - DNA, 25 bp, E. coli
actacaaggttgtctccatcaggga

SEQ ID NO: 71463 - DNA, 25 bp, E. coli
tatgcatgctggtcacttgccgcag

SEQ ID NO: 71464 - DNA, 25 bp, E. coli
tagttttatcgcaagccagatgggc

SEQ ID NO: 71465 - DNA, 25 bp, E. coli
tatgcatgctggacacttgccgcag

SEQ ID NO: 71466 - DNA, 25 bp, E. coli
tagttttatcgctagccagatgggc

SEQ ID NO: 71467 - DNA, 25 bp, E. coli
tattgatgctcttaaaagccaggcg

SEQ ID NO: 71468 - DNA, 25 bp, E. coli
tattgatgctctaaaaagccaggcg

SEQ ID NO: 71469 - DNA, 25 bp, E. coli
tgagtaacgcatgatacccgacagg

SEQ ID NO: 71470 - DNA, 25 bp, E. coli
tgagtaacgcatcatacccgacagg

SEQ ID NO: 71471 - DNA, 25 bp, E. coli
gaaagtgtcccaagtatgccccata

SEQ ID NO: 71472 - DNA, 25 bp, E. coli
gaaagtgtcccatgtatgccccata

SEQ ID NO: 71473 - DNA, 25 bp, E. coli
ggcaaacgtgtcagagaaaacctcg

SEQ ID NO: 71474 - DNA, 25 bp, E. coli
ggcaaacgtgtctgagaaaacctcg

SEQ ID NO: 71475 - DNA, 25 bp, E. coli
tatccacagtcgagagatagccgac

SEQ ID NO: 71476 - DNA, 25 bp, E. coli
tatccacagtcgtgagatagccgac

SEQ ID NO: 71477 - DNA, 25 bp, E. coli
tgagatagccgaccatatgggcgta

SEQ ID NO: 71478 - DNA, 25 bp, E. coli
tgagatagccgagcatatgggcgta

SEQ ID NO: 71479 - DNA, 25 bp, E. coli
ccatatgggcgtatatcttggagac

SEQ ID NO: 71480 - DNA, 25 bp, E. coli
ccatatgggcgtttatcttggagac

SEQ ID NO: 71481 - DNA, 25 bp, E. coli
gcaggcgttggtggagaataatcat

SEQ ID NO: 71482 - DNA, 25 bp, E. coli
gaataatcatttgttaagcagcgac

SEQ ID NO: 71483 - DNA, 25 bp, E. coli
gaataatcatttcttaagcagcgac

SEQ ID NO: 71484 - DNA, 25 bp, E. coli
gcaggcgttggtcgagaataatcat

SEQ ID NO: 71485 - DNA, 25 bp, E. coli
gcagctaggtaacccttatatctgg

SEQ ID NO: 71486 - DNA, 25 bp, E. coli
gcagctaggtaagccttatatctgg

SEQ ID NO: 71487 - DNA, 25 bp, E. coli
tggagacggtcagtttatcgagtca

SEQ ID NO: 71488 - DNA, 25 bp, E. coli
ggcgtatatcttcgagacggtcagt

SEQ ID NO: 71489 - DNA, 25 bp, E. coli
ggcgtatatcttggagacggtcagt

SEQ ID NO: 71490 - DNA, 25 bp, E. coli
tggagacggtcactttatcgagtca

SEQ ID NO: 71491 - DNA, 25 bp, E. coli
taatcatttctttagcagcgaccat

SEQ ID NO: 71492 - DNA, 25 bp, E. coli
taatcatttcttaagcagcgaccat

SEQ ID NO: 71493 - DNA, 25 bp, E. coli
gaccattttttaggcgcgcgacgga

SEQ ID NO: 71494 - DNA, 25 bp, E. coli
gagcagcagctaggtaagccttata

SEQ ID NO: 71495 - DNA, 25 bp, E. coli
gagcagcagctacgtaagccttata

SEQ ID NO: 71496 - DNA, 25 bp, E. coli
gaccattttttacgcgcgcgacgga

SEQ ID NO: 71497 - DNA, 25 bp, E. coli
attgccgccacgtagcccggtggat

SEQ ID NO: 71498 - DNA, 25 bp, E. coli
attgccgccacgaagcccggtggat

SEQ ID NO: 71499 - DNA, 25 bp, E. coli
tagtgtttgctgacggttattgtgt

SEQ ID NO: 71500 - DNA, 25 bp, E. coli
tagtgtttgctgtcggttattgtgt

SEQ ID NO: 71501 - DNA, 25 bp, E. coli
tatcttttcgatagtgtttgctgtc

SEQ ID NO: 71502 - DNA, 25 bp, E. coli
tatcttttcgattgtgtttgctgtc

SEQ ID NO: 71503 - DNA, 25 bp, E. coli
ttgctgtcggtttttgtgtggtcgc

SEQ ID NO: 71504 - DNA, 25 bp, E. coli
ttcgatagtgttagctgtcggttat

SEQ ID NO: 71505 - DNA, 25 bp, E. coli
ttcgatagtgtttgctgtcggttat

SEQ ID NO: 71506 - DNA, 25 bp, E. coli
ttgctgtcggttattgtgtggtcgc

SEQ ID NO: 71507 - DNA, 25 bp, E. coli
tgccgccacgtaccccggtggatat

SEQ ID NO: 71508 - DNA, 25 bp, E. coli
tgccgccacgtagcccggtggatat

SEQ ID NO: 71509 - DNA, 25 bp, E. coli
tcttttcgatagagtttgctgtcgg

SEQ ID NO: 71510 - DNA, 25 bp, E. coli
tcttttcgatagtgtttgctgtcgg

SEQ ID NO: 71511 - DNA, 25 bp, E. coli
gccacgtagccccgtggatatgttt

SEQ ID NO: 71512 - DNA, 25 bp, E. coli
gccacgtagcccggtggatatgttt

SEQ ID NO: 71513 - DNA, 25 bp, E. coli
gctgacagatccgaatgcggctgtt

SEQ ID NO: 71514 - DNA, 25 bp, E. coli
gctgacagatcccaatgcggctgtt

SEQ ID NO: 71515 - DNA, 25 bp, E. coli
cgatagtgtttgctgtcggttattg

SEQ ID NO: 71516 - DNA, 25 bp, E. coli
cgatagtgtttggtgtcggttattg

SEQ ID NO: 71517 - DNA, 25 bp, E. coli
gtttgctgtcggatattgtgtggtc

SEQ ID NO: 71518 - DNA, 25 bp, E. coli
gtttgctgtcggttattgtgtggtc

SEQ ID NO: 71519 - DNA, 25 bp, E. coli
cagaaatggatatagtgaatgtcga

SEQ ID NO: 71520 - DNA, 25 bp, E. coli
cagaaatggataaagtgaatgtcga

SEQ ID NO: 71521 - DNA, 25 bp, E. coli
catttgcgcagctggtttcgcgagc

SEQ ID NO: 71522 - DNA, 25 bp, E. coli
ataaagtgaatgacgatttggcggc

SEQ ID NO: 71523 - DNA, 25 bp, E. coli
ataaagtgaatgtcgatttggcggc

SEQ ID NO: 71524 - DNA, 25 bp, E. coli
tgctgaagaatctggctaaactgga

SEQ ID NO: 71525 - DNA, 25 bp, E. coli
tgaacagcctgatcatttgcgcagc

SEQ ID NO: 71526 - DNA, 25 bp, E. coli
tgaacagcctgaacatttgcgcagc

SEQ ID NO: 71527 - DNA, 25 bp, E. coli
tcgctgaagcggttgaacgtgaaca

SEQ ID NO: 71528 - DNA, 25 bp, E. coli
tgctgaagaatcaggctaaactgga

SEQ ID NO: 71529 - DNA, 25 bp, E. coli
tcgctgaagcggatgaacgtgaaca

SEQ ID NO: 71530 - DNA, 25 bp, E. coli
gctaaactggatgaaacagaaatgg

SEQ ID NO: 71531 - DNA, 25 bp, E. coli
gctaaactggatcaaacagaaatgg

SEQ ID NO: 71532 - DNA, 25 bp, E. coli
gcggttgaacgtcaacagcctgaac

SEQ ID NO: 71533 - DNA, 25 bp, E. coli
gcggttgaacgtgaacagcctgaac

SEQ ID NO: 71534 - DNA, 25 bp, E. coli
catttgcgcagcaggtttcgcgagc

SEQ ID NO: 71535 - DNA, 25 bp, E. coli
gggtggcatttatagaacgctacaa

SEQ ID NO: 71536 - DNA, 25 bp, E. coli
gggtggcatttaaagaacgctacaa

SEQ ID NO: 71537 - DNA, 25 bp, E. coli
tgtcacgtttacgttacgagcccaa

SEQ ID NO: 71538 - DNA, 25 bp, E. coli
tgtcacgtttaccttacgagcccaa

SEQ ID NO: 71539 - DNA, 25 bp, E. coli
ggcttcggtcaaactgtcacgttta

SEQ ID NO: 71540 - DNA, 25 bp, E. coli
ggcttcggtcaatctgtcacgttta

SEQ ID NO: 71541 - DNA, 25 bp, E. coli
ctgtacgtcgatggcggcaaccttg

SEQ ID NO: 71542 - DNA, 25 bp, E. coli
ctgtacgtcgatcgcggcaaccttg

SEQ ID NO: 71543 - DNA, 25 bp, E. coli
cgaactggaaaacggacgccattgg

SEQ ID NO: 71544 - DNA, 25 bp, E. coli
actggaccggtatccgagtgacctg

SEQ ID NO: 71545 - DNA, 25 bp, E. coli
cgaactggaaaagggacgccattgg

SEQ ID NO: 71546 - DNA, 25 bp, E. coli
actggaccggtaaccgagtgacctg

SEQ ID NO: 71547 - DNA, 25 bp, E. coli
actgcgcgatacctttaccacgcgt

SEQ ID NO: 71548 - DNA, 25 bp, E. coli
actgcgcgatacgtttaccacgcgt

SEQ ID NO: 71549 - DNA, 25 bp, E. coli
tagcactggagctgtacgtcgatcg

SEQ ID NO: 71550 - DNA, 25 bp, E. coli
taccacgcgttcaggtcgcgaagta

SEQ ID NO: 71551 - DNA, 25 bp, E. coli
tagcactggagcagtacgtcgatcg

SEQ ID NO: 71552 - DNA, 25 bp, E. coli
taccacgcgttctggtcgcgaagta

SEQ ID NO: 71553 - DNA, 25 bp, E. coli
tgctacctgtttccgctggtggcag

SEQ ID NO: 71554 - DNA, 25 bp, E. coli
tgctacctgtttgcgctggtggcag

SEQ ID NO: 71555 - DNA, 25 bp, E. coli
tctggtcgcgaactagcactggagc

SEQ ID NO: 71556 - DNA, 25 bp, E. coli
tctggtcgcgaagtagcactggagc

SEQ ID NO: 71557 - DNA, 25 bp, E. coli
gcaaggcgaactggaaaacggacgc

SEQ ID NO: 71558 - DNA, 25 bp, E. coli
gcaaggcgaactcgaaaacggacgc

SEQ ID NO: 71559 - DNA, 25 bp, E. coli
ctggtggcaggccactttgatgtac

SEQ ID NO: 71560 - DNA, 25 bp, E. coli
ctggtggcaggcgactttgatgtac

SEQ ID NO: 71561 - DNA, 25 bp, E. coli
ggcaggcgactttgatgtactgcgc

SEQ ID NO: 71562 - DNA, 25 bp, E. coli
ggcaggcgacttagatgtactgcgc

SEQ ID NO: 71563 - DNA, 25 bp, E. coli
caatgttggtgtacaggctggcgat

SEQ ID NO: 71564 - DNA, 25 bp, E. coli
caatgttggtgttcaggctggcgat

SEQ ID NO: 71565 - DNA, 25 bp, E. coli
taaagggtacagtgatgcccaggca

SEQ ID NO: 71566 - DNA, 25 bp, E. coli
taaagggtacagagatgcccaggca

SEQ ID NO: 71567 - DNA, 25 bp, E. coli
tacctgaaaggtaagagtgcgtctg

SEQ ID NO: 71568 - DNA, 25 bp, E. coli
tacctgaaaggttagagtgcgtctg

SEQ ID NO: 71569 - DNA, 25 bp, E. coli
tatattcagccgcagtcccagatca

SEQ ID NO: 71570 - DNA, 25 bp, E. coli
tatattcagccggagtcccagatca

SEQ ID NO: 71571 - DNA, 25 bp, E. coli
tgaaaaactggcagcggagtcctgg

SEQ ID NO: 71572 - DNA, 25 bp, E. coli
tgaaaaactggctgcggagtcctgg

SEQ ID NO: 71573 - DNA, 25 bp, E. coli
gcattgcgcaatggactgacggtca

SEQ ID NO: 71574 - DNA, 25 bp, E. coli
gcgatcaatggatacagcaccggtt

SEQ ID NO: 71575 - DNA, 25 bp, E. coli
gcgatcaatggaaacagcaccggtt

SEQ ID NO: 71576 - DNA, 25 bp, E. coli
gcattgcgcaatcgactgacggtca

SEQ ID NO: 71577 - DNA, 25 bp, E. coli
gcacgaaagttctgctcagcggaga

SEQ ID NO: 71578 - DNA, 25 bp, E. coli
gcacgaaagttcagctcagcggaga

SEQ ID NO: 71579 - DNA, 25 bp, E. coli
ccggtttatacggaacgtggcagca

SEQ ID NO: 71580 - DNA, 25 bp, E. coli
ccggtttatacgcaacgtggcagca

SEQ ID NO: 71581 - DNA, 25 bp, E. coli
tggatccataatacacggagctggg

SEQ ID NO: 71582 - DNA, 25 bp, E. coli
tggatccataattcacggagctggg

SEQ ID NO: 71583 - DNA, 25 bp, E. coli
taatacggcactcagtcaggacgga

SEQ ID NO: 71584 - DNA, 25 bp, E. coli
taatacggcactgagtcaggacgga

SEQ ID NO: 71585 - DNA, 25 bp, E. coli
caggtgacatgggtgaaagtttgcc

SEQ ID NO: 71586 - DNA, 25 bp, E. coli
caggtgacatggctgaaagtttgcc

SEQ ID NO: 71587 - DNA, 25 bp, E. coli
ttgcctgggcgagactgcatttaac

SEQ ID NO: 71588 - DNA, 25 bp, E. coli
ttgcctgggcgacactgcatttaac

SEQ ID NO: 71589 - DNA, 25 bp, E. coli
tgcgtctgacaggaaaacaggtgac

SEQ ID NO: 71590 - DNA, 25 bp, E. coli
tgccgatccggtcaaagatattcag

SEQ ID NO: 71591 - DNA, 25 bp, E. coli
tgcgtctgacagcaaaacaggtgac

SEQ ID NO: 71592 - DNA, 25 bp, E. coli
tgccgatccggtgaaagatattcag

SEQ ID NO: 71593 - DNA, 25 bp, E. coli
tctacgctgggctggctgtactgct

SEQ ID NO: 71594 - DNA, 25 bp, E. coli
tctacgctgggcaggctgtactgct

SEQ ID NO: 71595 - DNA, 25 bp, E. coli
gaaagtttgcctccatcttgccgga

SEQ ID NO: 71596 - DNA, 25 bp, E. coli
gaaagtttgcctgcatcttgccgga

SEQ ID NO: 71597 - DNA, 25 bp, E. coli
ctctggctggtcagggcgatcaatc

SEQ ID NO: 71598 - DNA, 25 bp, E. coli
ctctggctggtctgggcgatcaatc

SEQ ID NO: 71599 - DNA, 25 bp, E. coli
ggattgttgccgtttctctggctgg

SEQ ID NO: 71600 - DNA, 25 bp, E. coli
ggtcgcactgcactgaaatttttgc

SEQ ID NO: 71601 - DNA, 25 bp, E. coli
ggtcgcactgcagtgaaatttttgc

SEQ ID NO: 71602 - DNA, 25 bp, E. coli
ggattgttgccgattctctggctgg

SEQ ID NO: 71603 - DNA, 25 bp, E. coli
tggcacgctacgcaaaacagccgtt

SEQ ID NO: 71604 - DNA, 25 bp, E. coli
tggcacgctacggaaaacagccgtt

SEQ ID NO: 71605 - DNA, 25 bp, E. coli
tcaatcacggtgcactgggtgccga

SEQ ID NO: 71606 - DNA, 25 bp, E. coli
tcaatcacggtggactgggtgccga

SEQ ID NO: 71607 - DNA, 25 bp, E. coli
cacaggaagtgctcattcgggaact

SEQ ID NO: 71608 - DNA, 25 bp, E. coli
cacaggaagtgcacattcgggaact

SEQ ID NO: 71609 - DNA, 25 bp, E. coli
catgctctgagccaggcgaaatcca

SEQ ID NO: 71610 - DNA, 25 bp, E. coli
catgctctgagcgaggcgaaatcca

SEQ ID NO: 71611 - DNA, 25 bp, E. coli
aaattggcatgctgcgggatacgcg

SEQ ID NO: 71612 - DNA, 25 bp, E. coli
aaattggcatgcagcgggatacgcg

SEQ ID NO: 71613 - DNA, 25 bp, E. coli
aacggcttcgatccgtagtgtcgga

SEQ ID NO: 71614 - DNA, 25 bp, E. coli
aacggcttcgatgcgtagtgtcgga

SEQ ID NO: 71615 - DNA, 25 bp, E. coli
tgaaccagatagtcgaccgcagaac

SEQ ID NO: 71616 - DNA, 25 bp, E. coli
tgaaccagatagacgaccgcagaac

SEQ ID NO: 71617 - DNA, 25 bp, E. coli
tgaaaaaatcctcaaccgtgcgggc

SEQ ID NO: 71618 - DNA, 25 bp, E. coli
tgaaaaaatcctgaaccgtgcgggc

SEQ ID NO: 71619 - DNA, 25 bp, E. coli
gaactaccgggtgcagaacgacggt

SEQ ID NO: 71620 - DNA, 25 bp, E. coli
gaatgctgacgaacctgaatcacgc

SEQ ID NO: 71621 - DNA, 25 bp, E. coli
gaatgctgacgatcctgaatcacgc

SEQ ID NO: 71622 - DNA, 25 bp, E. coli
gaactaccgggtccagaacgacggt

SEQ ID NO: 71623 - DNA, 25 bp, E. coli
ggtaaaaatcacgtggcagcagcga

SEQ ID NO: 71624 - DNA, 25 bp, E. coli
ggtaaaaatcacctggcagcagcga

SEQ ID NO: 71625 - DNA, 25 bp, E. coli
gatgaccggatgaacaaacttcgtg

SEQ ID NO: 71626 - DNA, 25 bp, E. coli
gatgaccggatgtacaaacttcgtg

SEQ ID NO: 71627 - DNA, 25 bp, E. coli
gatgagcacactgctcggagatcgg

SEQ ID NO: 71628 - DNA, 25 bp, E. coli
gatgagcacactcctcggagatcgg

SEQ ID NO: 71629 - DNA, 25 bp, E. coli
aagattgaaacacaggcctcgcatc

SEQ ID NO: 71630 - DNA, 25 bp, E. coli
aagattgaaacagaggcctcgcatc

SEQ ID NO: 71631 - DNA, 25 bp, E. coli
taaagattgaaagacaggcctcgca

SEQ ID NO: 71632 - DNA, 25 bp, E. coli
taaagattgaaacacaggcctcgca

SEQ ID NO: 71633 - DNA, 25 bp, E. coli
agattgaaacacaggcctcgcatca

SEQ ID NO: 71634 - DNA, 25 bp, E. coli
agattgaaacactggcctcgcatca

SEQ ID NO: 71635 - DNA, 25 bp, E. coli
aaagattgaaactcaggcctcgcat

SEQ ID NO: 71636 - DNA, 25 bp, E. coli
aaagattgaaacacaggcctcgcat

SEQ ID NO: 71637 - DNA, 25 bp, E. coli
taccaggggcgaatatttcgtcaac

SEQ ID NO: 71638 - DNA, 25 bp, E. coli
taccaggggcgattatttcgtcaac

SEQ ID NO: 71639 - DNA, 25 bp, E. coli
ttaaagattgaatcacaggcctcgc

SEQ ID NO: 71640 - DNA, 25 bp, E. coli
ttaaagattgaaacacaggcctcgc

SEQ ID NO: 71641 - DNA, 25 bp, E. coli
tttaaagattgatacacaggcctcg

SEQ ID NO: 71642 - DNA, 25 bp, E. coli
tttaaagattgaaacacaggcctcg

SEQ ID NO: 71643 - DNA, 25 bp, E. coli
tgatttaaagatagaaacacaggcc

SEQ ID NO: 71644 - DNA, 25 bp, E. coli
tgatttaaagattgaaacacaggcc

SEQ ID NO: 71645 - DNA, 25 bp, E. coli
gaagtttactgaattaaagattgaa

SEQ ID NO: 71646 - DNA, 25 bp, E. coli
gaagtttactgatttaaagattgaa

SEQ ID NO: 71647 - DNA, 25 bp, E. coli
gattgaaacacaggcctcgcatcag

SEQ ID NO: 71648 - DNA, 25 bp, E. coli
gatttaaagattcaaacacaggcct

SEQ ID NO: 71649 - DNA, 25 bp, E. coli
gattgaaacacacgcctcgcatcag

SEQ ID NO: 71650 - DNA, 25 bp, E. coli
gatttaaagattgaaacacaggcct

SEQ ID NO: 71651 - DNA, 25 bp, E. coli
caaaatttgcgaggctctttccgaa

SEQ ID NO: 71652 - DNA, 25 bp, E. coli
caaaatttgcgacgctctttccgaa

SEQ ID NO: 71653 - DNA, 25 bp, E. coli
tacatccatacactaactcacaggg

SEQ ID NO: 71654 - DNA, 25 bp, E. coli
tacatccatacagtaactcacaggg

SEQ ID NO: 71655 - DNA, 25 bp, E. coli
tagggttgatctttgttgtcactgg

SEQ ID NO: 71656 - DNA, 25 bp, E. coli
tagggttgatctatgttgtcactgg

SEQ ID NO: 71657 - DNA, 25 bp, E. coli
ttatgttttcccctcaccaacgaca

SEQ ID NO: 71658 - DNA, 25 bp, E. coli
ttatgttttcccgtcaccaacgaca

SEQ ID NO: 71659 - DNA, 25 bp, E. coli
tgttgtcactggatgtactgtacat

SEQ ID NO: 71660 - DNA, 25 bp, E. coli
tgttgtcactggttgtactgtacat

SEQ ID NO: 71661 - DNA, 25 bp, E. coli
tcataacataaatgaatgattcaca

SEQ ID NO: 71662 - DNA, 25 bp, E. coli
tcataacataaaagaatgattcaca

SEQ ID NO: 71663 - DNA, 25 bp, E. coli
gctctttccgaaaatagggttgatc

SEQ ID NO: 71664 - DNA, 25 bp, E. coli
gctctttccgaatatagggttgatc

SEQ ID NO: 71665 - DNA, 25 bp, E. coli
gaatgattcacaataacggatccgt

SEQ ID NO: 71666 - DNA, 25 bp, E. coli
gaatgattcacattaacggatccgt

SEQ ID NO: 71667 - DNA, 25 bp, E. coli
gaaaataggcaacttattcttaagg

SEQ ID NO: 71668 - DNA, 25 bp, E. coli
gaaaataggcaagttattcttaagg

SEQ ID NO: 71669 - DNA, 25 bp, E. coli
cgtcaccaacgacaaaatttgcgag

SEQ ID NO: 71670 - DNA, 25 bp, E. coli
cgtcaccaacgagaaaatttgcgag

SEQ ID NO: 71671 - DNA, 25 bp, E. coli
gatccgttaactacgaaaataggca

SEQ ID NO: 71672 - DNA, 25 bp, E. coli
gatccgttaacttcgaaaataggca

SEQ ID NO: 71673 - DNA, 25 bp, E. coli
catccggcaacccttgtcggaaccg

SEQ ID NO: 71674 - DNA, 25 bp, E. coli
catccggcaaccgttgtcggaaccg

SEQ ID NO: 71675 - DNA, 25 bp, E. coli
taaatttgatgcgaggtgaggctgc

SEQ ID NO: 71676 - DNA, 25 bp, E. coli
taaatttgatgccaggtgaggctgc

SEQ ID NO: 71677 - DNA, 25 bp, E. coli
aggcctacaagagccgagcacagaa

SEQ ID NO: 71678 - DNA, 25 bp, E. coli
aggcctacaggtgccgagcacagaa

SEQ ID NO: 71679 - DNA, 25 bp, E. coli
aggcctacaagacccgagcacagaa

SEQ ID NO: 71680 - DNA, 25 bp, E. coli
aggtcccgagcacagaaccgtagga

SEQ ID NO: 71681 - DNA, 25 bp, E. coli
acccgagcacagaaccgtaggacgg

SEQ ID NO: 71682 - DNA, 25 bp, E. coli
aggtcccgagcagagaaccgtagga

SEQ ID NO: 71683 - DNA, 25 bp, E. coli
aggcctacaggtcccgagcacagaa

SEQ ID NO: 71684 - DNA, 25 bp, E. coli
acccgagcacagtaccgtaggacgg

SEQ ID NO: 71685 - DNA, 25 bp, E. coli
tttgatgccaggtgaggctgcgttt

SEQ ID NO: 71686 - DNA, 25 bp, E. coli
tttgatgccaggagaggctgcgttt

SEQ ID NO: 71687 - DNA, 25 bp, E. coli
ttttcctcataattttgatgccagg

SEQ ID NO: 71688 - DNA, 25 bp, E. coli
ttttcctcataaatttgatgccagg

SEQ ID NO: 71689 - DNA, 25 bp, E. coli
gctgcgtttgttttgttcgttgccg

SEQ ID NO: 71690 - DNA, 25 bp, E. coli
gctgcgtttgttatgttcgttgccg

SEQ ID NO: 71691 - DNA, 25 bp, E. coli
cgttgccgctttttgcctgatgcga

SEQ ID NO: 71692 - DNA, 25 bp, E. coli
cgttgccgctttatgcctgatgcga

SEQ ID NO: 71693 - DNA, 25 bp, E. coli
gagcacagaaccctaggacggataa

SEQ ID NO: 71694 - DNA, 25 bp, E. coli
gagcacagaaccgtaggacggataa

SEQ ID NO: 71695 - DNA, 25 bp, E. coli
catgccaatgtgacgcctttttcaa

SEQ ID NO: 71696 - DNA, 25 bp, E. coli
catgccaatgtgtcgcctttttcaa

SEQ ID NO: 71697 - DNA, 25 bp, E. coli
catttcgagatattcatacggcatc

SEQ ID NO: 71698 - DNA, 25 bp, E. coli
taccgtggtgaagctaatttactcg

SEQ ID NO: 71699 - DNA, 25 bp, E. coli
taccgtggtgaacctaatttactcg

SEQ ID NO: 71700 - DNA, 25 bp, E. coli
tgtctcaggaataacttacgaagca

SEQ ID NO: 71701 - DNA, 25 bp, E. coli
tgtaaatactatggtcctgcggtga

SEQ ID NO: 71702 - DNA, 25 bp, E. coli
tgtctcaggaattacttacgaagca

SEQ ID NO: 71703 - DNA, 25 bp, E. coli
tgtaaatactatcgtcctgcggtga

SEQ ID NO: 71704 - DNA, 25 bp, E. coli
tgtgatacacagcaacatttcgaga

SEQ ID NO: 71705 - DNA, 25 bp, E. coli
tgtgatacacaggaacatttcgaga

SEQ ID NO: 71706 - DNA, 25 bp, E. coli
tctacggaaacaatataccgtggtg

SEQ ID NO: 71707 - DNA, 25 bp, E. coli
tccgattaagaacctgctcagcggg

SEQ ID NO: 71708 - DNA, 25 bp, E. coli
tctacggaaacattataccgtggtg

SEQ ID NO: 71709 - DNA, 25 bp, E. coli
tccgattaagaagctgctcagcggg

SEQ ID NO: 71710 - DNA, 25 bp, E. coli
catttcgagataatcatacggcatc

SEQ ID NO: 71711 - DNA, 25 bp, E. coli
gataaagtctttccagttccccagt

SEQ ID NO: 71712 - DNA, 25 bp, E. coli
gattgctgcgatgactacctccggg

SEQ ID NO: 71713 - DNA, 25 bp, E. coli
gattgctgcgatcactacctccggg

SEQ ID NO: 71714 - DNA, 25 bp, E. coli
gataaagtctttgcagttccccagt

SEQ ID NO: 71715 - DNA, 25 bp, E. coli
ggcaaaatgtttacacccttaaatg

SEQ ID NO: 71716 - DNA, 25 bp, E. coli
ggcaaaatgttttcacccttaaatg

SEQ ID NO: 71717 - DNA, 25 bp, E. coli
cactgcccgggacaacgcatcccga

SEQ ID NO: 71718 - DNA, 25 bp, E. coli
cacactgcccgggacaacgcatccc

SEQ ID NO: 71719 - DNA, 25 bp, E. coli
cacactgcccggcacaacgcatccc

SEQ ID NO: 71720 - DNA, 25 bp, E. coli
cactgcccgggagaacgcatcccga

SEQ ID NO: 71721 - DNA, 25 bp, E. coli
agacacactgccggggacaacgcat

SEQ ID NO: 71722 - DNA, 25 bp, E. coli
actgcccgggacaacgcatcccgac

SEQ ID NO: 71723 - DNA, 25 bp, E. coli
acactgcccgggacaacgcatcccg

SEQ ID NO: 71724 - DNA, 25 bp, E. coli
agccgaattatcgccaccatcgaac

SEQ ID NO: 71725 - DNA, 25 bp, E. coli
actgcccgggactacgcatcccgac

SEQ ID NO: 71726 - DNA, 25 bp, E. coli
agacacactgcccgggacaacgcat

SEQ ID NO: 71727 - DNA, 25 bp, E. coli
atgagccgaattatcgccaccatcg

SEQ ID NO: 71728 - DNA, 25 bp, E. coli
agccgaattatccccaccatcgaac

SEQ ID NO: 71729 - DNA, 25 bp, E. coli
atgagccgaattttcgccaccatcg

SEQ ID NO: 71730 - DNA, 25 bp, E. coli
atcgtgtcagactcactgcccggga

SEQ ID NO: 71731 - DNA, 25 bp, E. coli
atcgtgtcagacacactgcccggga

SEQ ID NO: 71732 - DNA, 25 bp, E. coli
acactgcccgggtcaacgcatcccg

SEQ ID NO: 71733 - DNA, 25 bp, E. coli
tatcgtgtcagacacactgcccggg

SEQ ID NO: 71734 - DNA, 25 bp, E. coli
tatcgtgtcagagacactgcccggg

SEQ ID NO: 71735 - DNA, 25 bp, E. coli
tgagccgaattatcgccaccatcga

SEQ ID NO: 71736 - DNA, 25 bp, E. coli
tgagccgaattaacgccaccatcga

SEQ ID NO: 71737 - DNA, 25 bp, E. coli
gagccgaattatggccaccatcgaa

SEQ ID NO: 71738 - DNA, 25 bp, E. coli
gagccgaattatcgccaccatcgaa

SEQ ID NO: 71739 - DNA, 25 bp, E. coli
ttaatcatggcgtgacagccttgcg

SEQ ID NO: 71740 - DNA, 25 bp, E. coli
ttaatcatggcgagacagccttgcg

SEQ ID NO: 71741 - DNA, 25 bp, E. coli
tgcgcgcgtggataaacccatcaac

SEQ ID NO: 71742 - DNA, 25 bp, E. coli
tcctttaccgtgcttgcgcctgggc

SEQ ID NO: 71743 - DNA, 25 bp, E. coli
tcctttaccgtggttgcgcctgggc

SEQ ID NO: 71744 - DNA, 25 bp, E. coli
tgccttagccgcaaaacagggctgg

SEQ ID NO: 71745 - DNA, 25 bp, E. coli
tgcgcgcgtggaaaaacccatcaac

SEQ ID NO: 71746 - DNA, 25 bp, E. coli
tgccttagccgctaaacagggctgg

SEQ ID NO: 71747 - DNA, 25 bp, E. coli
cctctcgggcggttatgggatatcg

SEQ ID NO: 71748 - DNA, 25 bp, E. coli
cctctcgggcggatatgggatatcg

SEQ ID NO: 71749 - DNA, 25 bp, E. coli
gaccgatttactcaaccgcatggag

SEQ ID NO: 71750 - DNA, 25 bp, E. coli
ctgctgaacgatgtcgatgcctgca

SEQ ID NO: 71751 - DNA, 25 bp, E. coli
ctgctgaacgatctcgatgcctgca

SEQ ID NO: 71752 - DNA, 25 bp, E. coli
gatatcgatgtcgtgacgcccgaag

SEQ ID NO: 71753 - DNA, 25 bp, E. coli
gatatcgatgtcctgacgcccgaag

SEQ ID NO: 71754 - DNA, 25 bp, E. coli
tggcaaattcaggagcaggctgcac

SEQ ID NO: 71755 - DNA, 25 bp, E. coli
tggcaaattcagcagcaggctgcac

SEQ ID NO: 71756 - DNA, 25 bp, E. coli
tcaagcgccatcgtgttccactggt

SEQ ID NO: 71757 - DNA, 25 bp, E. coli
tcagccgggatgaaaggcaagcacg

SEQ ID NO: 71758 - DNA, 25 bp, E. coli
tcagccgggatgtaaggcaagcacg

SEQ ID NO: 71759 - DNA, 25 bp, E. coli
tcaagcgccatcctgttccactggt

SEQ ID NO: 71760 - DNA, 25 bp, E. coli
gaccgatttactgaaccgcatggag

SEQ ID NO: 71761 - DNA, 25 bp, E. coli
catgggataacgagcagtctggaca

SEQ ID NO: 71762 - DNA, 25 bp, E. coli
catgggataacgtgcagtctggaca

SEQ ID NO: 71763 - DNA, 25 bp, E. coli
tacacgacgccttgtgtcactgacc

SEQ ID NO: 71764 - DNA, 25 bp, E. coli
tacacgacgcctagtgtcactgacc

SEQ ID NO: 71765 - DNA, 25 bp, E. coli
aaatcatcccagtccactgctcagg

SEQ ID NO: 71766 - DNA, 25 bp, E. coli
aaatcatcccagaccactgctcagg

SEQ ID NO: 71767 - DNA, 25 bp, E. coli
tattcatgggattacgagcagtctg

SEQ ID NO: 71768 - DNA, 25 bp, E. coli
tattcatgggataacgagcagtctg

SEQ ID NO: 71769 - DNA, 25 bp, E. coli
tgtgtcactgacgtcttctctcgct

SEQ ID NO: 71770 - DNA, 25 bp, E. coli
tgtgtcactgacctcttctctcgct

SEQ ID NO: 71771 - DNA, 25 bp, E. coli
tcggtgatccgcctcgtacacgacg

SEQ ID NO: 71772 - DNA, 25 bp, E. coli
tcggtgatccgcgtcgtacacgacg

SEQ ID NO: 71773 - DNA, 25 bp, E. coli
gcgccctgccagtcggtttgaaccg

SEQ ID NO: 71774 - DNA, 25 bp, E. coli
gcgccctgccagacggtttgaaccg

SEQ ID NO: 71775 - DNA, 25 bp, E. coli
cgccactgtaagcgcatgtgaggct

SEQ ID NO: 71776 - DNA, 25 bp, E. coli
cgccactgtaagggcatgtgaggct

SEQ ID NO: 71777 - DNA, 25 bp, E. coli
tggacatgcccgtctcggtgatccg

SEQ ID NO: 71778 - DNA, 25 bp, E. coli
tggacatgcccgactcggtgatccg

SEQ ID NO: 71779 - DNA, 25 bp, E. coli
taacgagcagtcaggacatgcccgt

SEQ ID NO: 71780 - DNA, 25 bp, E. coli
tcagccacagtagggcatctgatga

SEQ ID NO: 71781 - DNA, 25 bp, E. coli
taacgagcagtctggacatgcccgt

SEQ ID NO: 71782 - DNA, 25 bp, E. coli
tcagccacagtacggcatctgatga

SEQ ID NO: 71783 - DNA, 25 bp, E. coli
cagggcgttaccttgaccgtgatgt

SEQ ID NO: 71784 - DNA, 25 bp, E. coli
cagggcgttaccatgaccgtgatgt

SEQ ID NO: 71785 - DNA, 25 bp, E. coli
catctgcttcaattcgacgcgtgag

SEQ ID NO: 71786 - DNA, 25 bp, E. coli
catctgcttcaaatcgacgcgtgag

SEQ ID NO: 71787 - DNA, 25 bp, E. coli
aaagaataccttgctgattggcgct

SEQ ID NO: 71788 - DNA, 25 bp, E. coli
aaagaataccttcctgattggcgct

SEQ ID NO: 71789 - DNA, 25 bp, E. coli
tatggttcacttcctaccgcgatga

SEQ ID NO: 71790 - DNA, 25 bp, E. coli
tatggttcacttgctaccgcgatga

SEQ ID NO: 71791 - DNA, 25 bp, E. coli
tgctggtactggtgcaaaacctggt

SEQ ID NO: 71792 - DNA, 25 bp, E. coli
tgagttactacagcgacgtcgctgg

SEQ ID NO: 71793 - DNA, 25 bp, E. coli
tgagttactacaccgacgtcgctgg

SEQ ID NO: 71794 - DNA, 25 bp, E. coli
tgctggtactggagcaaaacctggt

SEQ ID NO: 71795 - DNA, 25 bp, E. coli
tctgcaaaccctcaaacggaatcgc

SEQ ID NO: 71796 - DNA, 25 bp, E. coli
tctgcaaaccctgaaacggaatcgc

SEQ ID NO: 71797 - DNA, 25 bp, E. coli
cgctatgtgttatatgataccgggc

SEQ ID NO: 71798 - DNA, 25 bp, E. coli
cgctatgtgttaaatgataccgggc

SEQ ID NO: 71799 - DNA, 25 bp, E. coli
gataccgggctgttcactgtgctgg

SEQ ID NO: 71800 - DNA, 25 bp, E. coli
gattggcgctttcctgggaacctgc

SEQ ID NO: 71801 - DNA, 25 bp, E. coli
gataccgggctgatcactgtgctgg

SEQ ID NO: 71802 - DNA, 25 bp, E. coli
gattggcgctttgctgggaacctgc

SEQ ID NO: 71803 - DNA, 25 bp, E. coli
gagcattaagaactccagcccggaa

SEQ ID NO: 71804 - DNA, 25 bp, E. coli
gagcattaagaagtccagcccggaa

SEQ ID NO: 71805 - DNA, 25 bp, E. coli
aatgaaacccgccacgatgcggcgg

SEQ ID NO: 71806 - DNA, 25 bp, E. coli
aatgaaacccgcgacgatgcggcgg

SEQ ID NO: 71807 - DNA, 25 bp, E. coli
tacagccgccgagtttggcattgaa

SEQ ID NO: 71808 - DNA, 25 bp, E. coli
tacagccgccgactttggcattgaa

SEQ ID NO: 71809 - DNA, 25 bp, E. coli
agaacatcagggtctggcgacggaa

SEQ ID NO: 71810 - DNA, 25 bp, E. coli
agaacatcagggactggcgacggaa

SEQ ID NO: 71811 - DNA, 25 bp, E. coli
aactgttcctgacgaaaccgctggg

SEQ ID NO: 71812 - DNA, 25 bp, E. coli
aaatgaggtcaatgctacagccgcc

SEQ ID NO: 71813 - DNA, 25 bp, E. coli
aaatgaggtcaaagctacagccgcc

SEQ ID NO: 71814 - DNA, 25 bp, E. coli
aactgttcctgaggaaaccgctggg

SEQ ID NO: 71815 - DNA, 25 bp, E. coli
taccacggctgacaaaaaatcactg

SEQ ID NO: 71816 - DNA, 25 bp, E. coli
taccacggctgagaaaaaatcactg

SEQ ID NO: 71817 - DNA, 25 bp, E. coli
tcatctgatgggtgaaatgccgcgt

SEQ ID NO: 71818 - DNA, 25 bp, E. coli
tcggctggccgattaacaaactttc

SEQ ID NO: 71819 - DNA, 25 bp, E. coli
tcatctgatgggagaaatgccgcgt

SEQ ID NO: 71820 - DNA, 25 bp, E. coli
tcggctggccgaataacaaactttc

SEQ ID NO: 71821 - DNA, 25 bp, E. coli
gcaggcgaagtttgttgatccgaat

SEQ ID NO: 71822 - DNA, 25 bp, E. coli
gcaggcgaagttagttgatccgaat

SEQ ID NO: 71823 - DNA, 25 bp, E. coli
ggatgaacatcgcaggcgcgtcctt

SEQ ID NO: 71824 - DNA, 25 bp, E. coli
ggatgaacatcggaggcgcgtcctt

SEQ ID NO: 71825 - DNA, 25 bp, E. coli
ggcaatggcaccagcgttatcagta

SEQ ID NO: 71826 - DNA, 25 bp, E. coli
ggcaatggcacctgcgttatcagta

SEQ ID NO: 71827 - DNA, 25 bp, E. coli
caatggtaatgggtgcgttcgcttc

SEQ ID NO: 71828 - DNA, 25 bp, E. coli
caatggtacagctcgtttctacggc

SEQ ID NO: 71829 - DNA, 25 bp, E. coli
caatggtacagcacgtttctacggc

SEQ ID NO: 71830 - DNA, 25 bp, E. coli
caatggtaatggctgcgttcgcttc

SEQ ID NO: 71831 - DNA, 25 bp, E. coli
taggtaattttgtagccaacacgac

SEQ ID NO: 71832 - DNA, 25 bp, E. coli
taggtaattttgaagccaacacgac

SEQ ID NO: 71833 - DNA, 25 bp, E. coli
ttctacttcaacaatcgccgctggc

SEQ ID NO: 71834 - DNA, 25 bp, E. coli
ttctacttcaactatcgccgctggc

SEQ ID NO: 71835 - DNA, 25 bp, E. coli
tgtttgacacccagacaacgatgac

SEQ ID NO: 71836 - DNA, 25 bp, E. coli
tgtttgacaccctgacaacgatgac

SEQ ID NO: 71837 - DNA, 25 bp, E. coli
tcagggatcctgtaaaataacggga

SEQ ID NO: 71838 - DNA, 25 bp, E. coli
tcagggatcctgaaaaataacggga

SEQ ID NO: 71839 - DNA, 25 bp, E. coli
gcggcgcgggtatcgaacagaaaat

SEQ ID NO: 71840 - DNA, 25 bp, E. coli
gcggcgcgggtaacgaacagaaaat

SEQ ID NO: 71841 - DNA, 25 bp, E. coli
gaacctcttataaaagcggcgcggg

SEQ ID NO: 71842 - DNA, 25 bp, E. coli
gaacctcttatataagcggcgcggg

SEQ ID NO: 71843 - DNA, 25 bp, E. coli
cattggtgacgctcagggaacctct

SEQ ID NO: 71844 - DNA, 25 bp, E. coli
cattggtgacgcacagggaacctct

SEQ ID NO: 71845 - DNA, 25 bp, E. coli
taacgcgtcttcaaccaacagcggc

SEQ ID NO: 71846 - DNA, 25 bp, E. coli
taacgggacttcaacaccgaaagct

SEQ ID NO: 71847 - DNA, 25 bp, E. coli
taacgcgtcttctaccaacagcggc

SEQ ID NO: 71848 - DNA, 25 bp, E. coli
taacgggacttctacaccgaaagct

SEQ ID NO: 71849 - DNA, 25 bp, E. coli
tgtccccgaaaatagagaggtttca

SEQ ID NO: 71850 - DNA, 25 bp, E. coli
tgtccccgaaaaaagagaggtttca

SEQ ID NO: 71851 - DNA, 25 bp, E. coli
taccctgggccctaagtgtatcaaa

SEQ ID NO: 71852 - DNA, 25 bp, E. coli
tagcgtctgcttggttgtccccgaa

SEQ ID NO: 71853 - DNA, 25 bp, E. coli
taccctgggcccaaagtgtatcaaa

SEQ ID NO: 71854 - DNA, 25 bp, E. coli
tagcgtctgcttcgttgtccccgaa

SEQ ID NO: 71855 - DNA, 25 bp, E. coli
tatctccggtaatatggcgtcaggc

SEQ ID NO: 71856 - DNA, 25 bp, E. coli
tatcaaaaataggaagggcgaaggc

SEQ ID NO: 71857 - DNA, 25 bp, E. coli
tatcaaaaatagcaagggcgaaggc

SEQ ID NO: 71858 - DNA, 25 bp, E. coli
tatctccggtaaaatggcgtcaggc

SEQ ID NO: 71859 - DNA, 25 bp, E. coli
gcctgacgcctgaaaaagtgaacaa

SEQ ID NO: 71860 - DNA, 25 bp, E. coli
gcctgacgcctgtaaaagtgaacaa

SEQ ID NO: 71861 - DNA, 25 bp, E. coli
gaattttccgtaaagtctgcttcag

SEQ ID NO: 71862 - DNA, 25 bp, E. coli
gaaggcaaaagcactggtagcgtct

SEQ ID NO: 71863 - DNA, 25 bp, E. coli
gaaggcaaaagctctggtagcgtct

SEQ ID NO: 71864 - DNA, 25 bp, E. coli
gaattttccgtatagtctgcttcag

SEQ ID NO: 71865 - DNA, 25 bp, E. coli
cattgttcatgcctaatggagggac

SEQ ID NO: 71866 - DNA, 25 bp, E. coli
cattgttcatgcgtaatggagggac

SEQ ID NO: 71867 - DNA, 25 bp, E. coli
gatcttcactctgtcatatctccgg

SEQ ID NO: 71868 - DNA, 25 bp, E. coli
gatcttcactctctcatatctccgg

SEQ ID NO: 71869 - DNA, 25 bp, E. coli
tggcgtcaggcttcatcatcagaaa

SEQ ID NO: 71870 - DNA, 25 bp, E. coli
tggcgtcaggctacatcatcagaaa

SEQ ID NO: 71871 - DNA, 25 bp, E. coli
cagttttctgaatgcgttactccgg

SEQ ID NO: 71872 - DNA, 25 bp, E. coli
cagttttctgaaagcgttactccgg

SEQ ID NO: 71873 - DNA, 25 bp, E. coli
taaaaatgtcatgctgtccatagaa

SEQ ID NO: 71874 - DNA, 25 bp, E. coli
taaaaatgtcatcctgtccatagaa

SEQ ID NO: 71875 - DNA, 25 bp, E. coli
tactcagcattctgtgcaggaactg

SEQ ID NO: 71876 - DNA, 25 bp, E. coli
tactcagcattcagtgcaggaactg

SEQ ID NO: 71877 - DNA, 25 bp, E. coli
tattttattcttcttcaggagggca

SEQ ID NO: 71878 - DNA, 25 bp, E. coli
tattttattcttgttcaggagggca

SEQ ID NO: 71879 - DNA, 25 bp, E. coli
tgtttatgtttattcccggcaggaa

SEQ ID NO: 71880 - DNA, 25 bp, E. coli
tgtttatgtttaatcccggcaggaa

SEQ ID NO: 71881 - DNA, 25 bp, E. coli
tgctggtacgttcttgtgtgaaaat

SEQ ID NO: 71882 - DNA, 25 bp, E. coli
tgctggtacgttgttgtgtgaaaat

SEQ ID NO: 71883 - DNA, 25 bp, E. coli
tgtccatagaattttgtactcagca

SEQ ID NO: 71884 - DNA, 25 bp, E. coli
tgtccatagaatattgtactcagca

SEQ ID NO: 71885 - DNA, 25 bp, E. coli
tcttcttcaggagggcagttttctg

SEQ ID NO: 71886 - DNA, 25 bp, E. coli
tcttcttcaggacggcagttttctg

SEQ ID NO: 71887 - DNA, 25 bp, E. coli
cctggatgatgcattttgctggtac

SEQ ID NO: 71888 - DNA, 25 bp, E. coli
ccgtacctgcaaaaccctggatgat

SEQ ID NO: 71889 - DNA, 25 bp, E. coli
cctggatgatgctttttgctggtac

SEQ ID NO: 71890 - DNA, 25 bp, E. coli
gcaggaactgtcttcttctttattt

SEQ ID NO: 71891 - DNA, 25 bp, E. coli
gcaggaactgtcatcttctttattt

SEQ ID NO: 71892 - DNA, 25 bp, E. coli
ccgtacctgcaataccctggatgat

SEQ ID NO: 71893 - DNA, 25 bp, E. coli
taaaaaactgttccagccagcctcg

SEQ ID NO: 71894 - DNA, 25 bp, E. coli
taaaaaactgttgcagccagcctcg

SEQ ID NO: 71895 - DNA, 25 bp, E. coli
taaaagccaacttgggtcacctggg

SEQ ID NO: 71896 - DNA, 25 bp, E. coli
taaaagccaactagggtcacctggg

SEQ ID NO: 71897 - DNA, 25 bp, E. coli
tatccatacctgaagatgagcggcg

SEQ ID NO: 71898 - DNA, 25 bp, E. coli
tataaaatcggactgactgccgccg

SEQ ID NO: 71899 - DNA, 25 bp, E. coli
tatccatacctgtagatgagcggcg

SEQ ID NO: 71900 - DNA, 25 bp, E. coli
tataaaatcggagtgactgccgccg

SEQ ID NO: 71901 - DNA, 25 bp, E. coli
tattgtatcacctgcatgcgcagtg

SEQ ID NO: 71902 - DNA, 25 bp, E. coli
tattgtatcaccagcatgcgcagtg

SEQ ID NO: 71903 - DNA, 25 bp, E. coli
tattttcgaatagggagcgacctcg

SEQ ID NO: 71904 - DNA, 25 bp, E. coli
tattttcgaatacggagcgacctcg

SEQ ID NO: 71905 - DNA, 25 bp, E. coli
tgatcgaaacgctcggtaccggtac

SEQ ID NO: 71906 - DNA, 25 bp, E. coli
tgatcgaaacgcacggtaccggtac

SEQ ID NO: 71907 - DNA, 25 bp, E. coli
gacgataagctgcagagtgccctga

SEQ ID NO: 71908 - DNA, 25 bp, E. coli
gacgataagctggagagtgccctga

SEQ ID NO: 71909 - DNA, 25 bp, E. coli
cgaagccctgttcatggatccgcaa

SEQ ID NO: 71910 - DNA, 25 bp, E. coli
cgaagccctgttgatggatccgcaa

SEQ ID NO: 71911 - DNA, 25 bp, E. coli
gattgtggctgaaacgacaccggag

SEQ ID NO: 71912 - DNA, 25 bp, E. coli
gattgtggctgatacgacaccggag

SEQ ID NO: 71913 - DNA, 25 bp, E. coli
gtgcaagaaaatcagcgccgcctgt

SEQ ID NO: 71914 - DNA, 25 bp, E. coli
gtgcaagaaaatgagcgccgcctgt

SEQ ID NO: 71915 - DNA, 25 bp, E. coli
acaggttggtgttgctttatggaaa

SEQ ID NO: 71916 - DNA, 25 bp, E. coli
acaggttggtgtagctttatggaaa

SEQ ID NO: 71917 - DNA, 25 bp, E. coli
tattggcgctgtagtaacgcagaaa

SEQ ID NO: 71918 - DNA, 25 bp, E. coli
tatcaaccgcaacgatgatgaatga

SEQ ID NO: 71919 - DNA, 25 bp, E. coli
tattggcgctgttgtaacgcagaaa

SEQ ID NO: 71920 - DNA, 25 bp, E. coli
tatcaaccgcaaggatgatgaatga

SEQ ID NO: 71921 - DNA, 25 bp, E. coli
taaaccctaaggtgatctatcaact

SEQ ID NO: 71922 - DNA, 25 bp, E. coli
taaggagatctatcaactggctgat

SEQ ID NO: 71923 - DNA, 25 bp, E. coli
taaggagatctaacaactggctgat

SEQ ID NO: 71924 - DNA, 25 bp, E. coli
taaaccctaaggagatctatcaact

SEQ ID NO: 71925 - DNA, 25 bp, E. coli
gcagaaattcttttcaaccgcaagg

SEQ ID NO: 71926 - DNA, 25 bp, E. coli
gcagaaattcttatcaaccgcaagg

SEQ ID NO: 71927 - DNA, 25 bp, E. coli
gcagaaaaatgagttaaaccctaag

SEQ ID NO: 71928 - DNA, 25 bp, E. coli
gcagaaaaatgacttaaaccctaag

SEQ ID NO: 71929 - DNA, 25 bp, E. coli
ggttcaatcagcgaaccgttgagga

SEQ ID NO: 71930 - DNA, 25 bp, E. coli
ggttcaatcagccaaccgttgagga

SEQ ID NO: 71931 - DNA, 25 bp, E. coli
tggtagtaaaagaggcagaaattct

SEQ ID NO: 71932 - DNA, 25 bp, E. coli
tggtagtaaaagtggcagaaattct

SEQ ID NO: 71933 - DNA, 25 bp, E. coli
taatagttggttcaatcagccaacc

SEQ ID NO: 71934 - DNA, 25 bp, E. coli
taataaggtggtagtaaaagaggca

SEQ ID NO: 71935 - DNA, 25 bp, E. coli
taatagttggttgaatcagccaacc

SEQ ID NO: 71936 - DNA, 25 bp, E. coli
taataaggtggttgtaaaagaggca

SEQ ID NO: 71937 - DNA, 25 bp, E. coli
caccgtcccgcaatacgatatgaag

SEQ ID NO: 71938 - DNA, 25 bp, E. coli
caccgtcccgcattacgatatgaag

SEQ ID NO: 71939 - DNA, 25 bp, E. coli
tatcatgttgtttggtaatgaaacc

SEQ ID NO: 71940 - DNA, 25 bp, E. coli
tatcatgttgttaggtaatgaaacc

SEQ ID NO: 71941 - DNA, 25 bp, E. coli
tgaaaccattaaaaccgaacgactc

SEQ ID NO: 71942 - DNA, 25 bp, E. coli
tgaaaccattaataccgaacgactc

SEQ ID NO: 71943 - DNA, 25 bp, E. coli
tgcgcctgaagaattacttaatcac

SEQ ID NO: 71944 - DNA, 25 bp, E. coli
tgcgcctgaagatttacttaatcac

SEQ ID NO: 71945 - DNA, 25 bp, E. coli
gcagtactacaagctgccatctggt

SEQ ID NO: 71946 - DNA, 25 bp, E. coli
gctggaaacaactcttgcgcctgaa

SEQ ID NO: 71947 - DNA, 25 bp, E. coli
gctggaaacaacacttgcgcctgaa

SEQ ID NO: 71948 - DNA, 25 bp, E. coli
gcagtactacaacctgccatctggt

SEQ ID NO: 71949 - DNA, 25 bp, E. coli
gcaaatagagttccagcaaggtcgc

SEQ ID NO: 71950 - DNA, 25 bp, E. coli
gcaaatagagttgcagcaaggtcgc

SEQ ID NO: 71951 - DNA, 25 bp, E. coli
gtgaaatactcacttcgctagcagt

SEQ ID NO: 71952 - DNA, 25 bp, E. coli
ggaccgcgcacactcgatcttgata

SEQ ID NO: 71953 - DNA, 25 bp, E. coli
gtgaaatactcagttcgctagcagt

SEQ ID NO: 71954 - DNA, 25 bp, E. coli
ggaccgcgcacagtcgatcttgata

SEQ ID NO: 71955 - DNA, 25 bp, E. coli
taatcacacacaccaaatagagttg

SEQ ID NO: 71956 - DNA, 25 bp, E. coli
taatcacacacagcaaatagagttg

SEQ ID NO: 71957 - DNA, 25 bp, E. coli
gagattgccccgcaactcgtgtttc

SEQ ID NO: 71958 - DNA, 25 bp, E. coli
gagattgccccggaactcgtgtttc

SEQ ID NO: 71959 - DNA, 25 bp, E. coli
cagaccctgagctggagctgacgga

SEQ ID NO: 71960 - DNA, 25 bp, E. coli
cagaccctgagcaggagctgacgga

SEQ ID NO: 71961 - DNA, 25 bp, E. coli
agaccctgagcacgagctgacggac

SEQ ID NO: 71962 - DNA, 25 bp, E. coli
atgtcatcgctgacggccatgacgg

SEQ ID NO: 71963 - DNA, 25 bp, E. coli
agcaggagctgacggaccggtgggt

SEQ ID NO: 71964 - DNA, 25 bp, E. coli
aggcagaccctgagcaggagctgac

SEQ ID NO: 71965 - DNA, 25 bp, E. coli
atgtcatcgctgtcggccatgacgg

SEQ ID NO: 71966 - DNA, 25 bp, E. coli
agcaggagctgagggaccggtgggt

SEQ ID NO: 71967 - DNA, 25 bp, E. coli
atcgctgacggccatgacggcctcg

SEQ ID NO: 71968 - DNA, 25 bp, E. coli
agaccctgagcaggagctgacggac

SEQ ID NO: 71969 - DNA, 25 bp, E. coli
aggcagaccctgtgcaggagctgac

SEQ ID NO: 71970 - DNA, 25 bp, E. coli
accctgagcaggagctgacggaccg

SEQ ID NO: 71971 - DNA, 25 bp, E. coli
atcgctgacggcgatgacggcctcg

SEQ ID NO: 71972 - DNA, 25 bp, E. coli
accctgagcaggtgctgacggaccg

SEQ ID NO: 71973 - DNA, 25 bp, E. coli
tgacggaccggtgggtggtggagca

SEQ ID NO: 71974 - DNA, 25 bp, E. coli
tgtcatcgctgagggccatgacggc

SEQ ID NO: 71975 - DNA, 25 bp, E. coli
tgtcatcgctgacggccatgacggc

SEQ ID NO: 71976 - DNA, 25 bp, E. coli
tgacggaccggtcggtggtggagca

SEQ ID NO: 71977 - DNA, 25 bp, E. coli
gaccctgagcagcagctgacggacc

SEQ ID NO: 71978 - DNA, 25 bp, E. coli
gatgtcatcgctgacggccatgacg

SEQ ID NO: 71979 - DNA, 25 bp, E. coli
gatgtcatcgctcacggccatgacg

SEQ ID NO: 71980 - DNA, 25 bp, E. coli
gaccctgagcaggagctgacggacc

SEQ ID NO: 71981 - DNA, 25 bp, E. coli
aagagctactgattaacggcgcgcg

SEQ ID NO: 71982 - DNA, 25 bp, E. coli
aagagctactgaataacggcgcgcg

SEQ ID NO: 71983 - DNA, 25 bp, E. coli
caaagacaagttgatggcgagccat

SEQ ID NO: 71984 - DNA, 25 bp, E. coli
caaagacaagttcatggcgagccat

SEQ ID NO: 71985 - DNA, 25 bp, E. coli
taccggcaggcagtatcgtcgggac

SEQ ID NO: 71986 - DNA, 25 bp, E. coli
taccggcaggcactatcgtcgggac

SEQ ID NO: 71987 - DNA, 25 bp, E. coli
tgttttaagaatagccacacgccaa

SEQ ID NO: 71988 - DNA, 25 bp, E. coli
tgtgattcttgaaacgccgctggcg

SEQ ID NO: 71989 - DNA, 25 bp, E. coli
tgtgattcttgatacgccgctggcg

SEQ ID NO: 71990 - DNA, 25 bp, E. coli
tgttttaagaattgccacacgccaa

SEQ ID NO: 71991 - DNA, 25 bp, E. coli
tgaactggtaccgatggtgacgcgc

SEQ ID NO: 71992 - DNA, 25 bp, E. coli
tgaagtctataacggagacgccccg

SEQ ID NO: 71993 - DNA, 25 bp, E. coli
tgaactggtacccatggtgacgcgc

SEQ ID NO: 71994 - DNA, 25 bp, E. coli
tgaatcaccacgtaactgcactgcg

SEQ ID NO: 71995 - DNA, 25 bp, E. coli
tgaagtctataagggagacgccccg

SEQ ID NO: 71996 - DNA, 25 bp, E. coli
tgaatcaccacgaaactgcactgcg

SEQ ID NO: 71997 - DNA, 25 bp, E. coli
gacagtctggatccgttaccggcag

SEQ ID NO: 71998 - DNA, 25 bp, E. coli
gacagtctggatgcgttaccggcag

SEQ ID NO: 71999 - DNA, 25 bp, E. coli
ggtgccaattggtagctacgccgag

SEQ ID NO: 72000 - DNA, 25 bp, E. coli
ggtgccaattggaagctacgccgag

SEQ ID NO: 72001 - DNA, 25 bp, E. coli
gatgccatcattcttgccgtagccg

SEQ ID NO: 72002 - DNA, 25 bp, E. coli
gatgccatcattgttgccgtagccg

SEQ ID NO: 72003 - DNA, 25 bp, E. coli
tacagttgattctggaaaacggcgc

SEQ ID NO: 72004 - DNA, 25 bp, E. coli
taaaacaggctcagttcaccgctgg

SEQ ID NO: 72005 - DNA, 25 bp, E. coli
taaaacaggctctgttcaccgctgg

SEQ ID NO: 72006 - DNA, 25 bp, E. coli
tacagttgattcaggaaaacggcgc

SEQ ID NO: 72007 - DNA, 25 bp, E. coli
attctatttcgaagaccagcaggcg

SEQ ID NO: 72008 - DNA, 25 bp, E. coli
attctatttcgatgaccagcaggcg

SEQ ID NO: 72009 - DNA, 25 bp, E. coli
tatcaagccatttctggtaggccgc

SEQ ID NO: 72010 - DNA, 25 bp, E. coli
tatcaagccattactggtaggccgc

SEQ ID NO: 72011 - DNA, 25 bp, E. coli
gcaaccggccgtgtgaaaactgaag

SEQ ID NO: 72012 - DNA, 25 bp, E. coli
gcaaccggccgtctgaaaactgaag

SEQ ID NO: 72013 - DNA, 25 bp, E. coli
cgattaccaaagtgctgacgcgcct

SEQ ID NO: 72014 - DNA, 25 bp, E. coli
cgattaccaaagagctgacgcgcct

SEQ ID NO: 72015 - DNA, 25 bp, E. coli
cattatttggtctgagcggcgacga

SEQ ID NO: 72016 - DNA, 25 bp, E. coli
ctggaaaaagaagcgcaaggcctgc

SEQ ID NO: 72017 - DNA, 25 bp, E. coli
cattatttggtcagagcggcgacga

SEQ ID NO: 72018 - DNA, 25 bp, E. coli
ctggaaaaagaaccgcaaggcctgc

SEQ ID NO: 72019 - DNA, 25 bp, E. coli
ggcggcacctgcaatgaaactgatg

SEQ ID NO: 72020 - DNA, 25 bp, E. coli
ggcggcacctgctatgaaactgatg

SEQ ID NO: 72021 - DNA, 25 bp, E. coli
taataacgtcgatgagaagctgggc

SEQ ID NO: 72022 - DNA, 25 bp, E. coli
taataacgtcgaagagaagctgggc

SEQ ID NO: 72023 - DNA, 25 bp, E. coli
gatccttaaaggcatcgacgtgctg

SEQ ID NO: 72024 - DNA, 25 bp, E. coli
gatccttaaagggatcgacgtgctg

SEQ ID NO: 72025 - DNA, 25 bp, E. coli
cactggcgaagtcgaaacgtcagac

SEQ ID NO: 72026 - DNA, 25 bp, E. coli
cactggcgaagtggaaacgtcagac

SEQ ID NO: 72027 - DNA, 25 bp, E. coli
catgcgggtctgtacggcgatattc

SEQ ID NO: 72028 - DNA, 25 bp, E. coli
catgcgggtctgaacggcgatattc

SEQ ID NO: 72029 - DNA, 25 bp, E. coli
agaccttagggcaacacgacttcag

SEQ ID NO: 72030 - DNA, 25 bp, E. coli
agaccttagggctacacgacttcag

SEQ ID NO: 72031 - DNA, 25 bp, E. coli
ttctcgactctgtaaagcacggtag

SEQ ID NO: 72032 - DNA, 25 bp, E. coli
ttagcgaagagtatggcctggcacc

SEQ ID NO: 72033 - DNA, 25 bp, E. coli
ttagcgaagagtttggcctggcacc

SEQ ID NO: 72034 - DNA, 25 bp, E. coli
ttctcgactctgaaaagcacggtag

SEQ ID NO: 72035 - DNA, 25 bp, E. coli
tgtacacgcacatgaaagcccttcg

SEQ ID NO: 72036 - DNA, 25 bp, E. coli
tgtacacgcacaagaaagcccttcg

SEQ ID NO: 72037 - DNA, 25 bp, E. coli
tctcgtcaactgcaagaacgtctgg

SEQ ID NO: 72038 - DNA, 25 bp, E. coli
tctcgtcaactggaagaacgtctgg

SEQ ID NO: 72039 - DNA, 25 bp, E. coli
gattatgatgacaggagcaccccgt

SEQ ID NO: 72040 - DNA, 25 bp, E. coli
gattatgatgactggagcaccccgt

SEQ ID NO: 72041 - DNA, 25 bp, E. coli
ggatggcacgcacgataacttgtcg

SEQ ID NO: 72042 - DNA, 25 bp, E. coli
ggatggcacgcaggataacttgtcg

SEQ ID NO: 72043 - DNA, 25 bp, E. coli
ggaattaaagcatccgaagctgcgg

SEQ ID NO: 72044 - DNA, 25 bp, E. coli
ggaattaaagcaaccgaagctgcgg

SEQ ID NO: 72045 - DNA, 25 bp, E. coli
taaaagtgaaaggtctgcctgatgc

SEQ ID NO: 72046 - DNA, 25 bp, E. coli
taaaagtgaaagctctgcctgatgc

SEQ ID NO: 72047 - DNA, 25 bp, E. coli
caagtataccatataaatagtcggc

SEQ ID NO: 72048 - DNA, 25 bp, E. coli
caagtataccatttaaatagtcggc

SEQ ID NO: 72049 - DNA, 25 bp, E. coli
catgcactgtgtttgatatgaagaa

SEQ ID NO: 72050 - DNA, 25 bp, E. coli
catgcactgtgtatgatatgaagaa

SEQ ID NO: 72051 - DNA, 25 bp, E. coli
agtcttcttacttatcctacaggcg

SEQ ID NO: 72052 - DNA, 25 bp, E. coli
agtcttcttactaatcctacaggcg

SEQ ID NO: 72053 - DNA, 25 bp, E. coli
tagtcggcataaatgaaatgtcaac

SEQ ID NO: 72054 - DNA, 25 bp, E. coli
tagtcggcataattgaaatgtcaac

SEQ ID NO: 72055 - DNA, 25 bp, E. coli
tgtagtaatacacacataaggcgtc

SEQ ID NO: 72056 - DNA, 25 bp, E. coli
tgtagtaatacagacataaggcgtc

SEQ ID NO: 72057 - DNA, 25 bp, E. coli
taaattaggcctgcaacgttcctgg

SEQ ID NO: 72058 - DNA, 25 bp, E. coli
taaattaggcctccaacgttcctgg

SEQ ID NO: 72059 - DNA, 25 bp, E. coli
cctacaggcgtatgaattgtattgc

SEQ ID NO: 72060 - DNA, 25 bp, E. coli
cctacaggcgtaagaattgtattgc

SEQ ID NO: 72061 - DNA, 25 bp, E. coli
gcaaaagccacggtttagtcctctg

SEQ ID NO: 72062 - DNA, 25 bp, E. coli
gcaaaagccacgctttagtcctctg

SEQ ID NO: 72063 - DNA, 25 bp, E. coli
gaagcatctcccatctccctgtagt

SEQ ID NO: 72064 - DNA, 25 bp, E. coli
gaagcatctcccttctccctgtagt

SEQ ID NO: 72065 - DNA, 25 bp, E. coli
cgttcctgggattatgtgcaacaca

SEQ ID NO: 72066 - DNA, 25 bp, E. coli
cgttcctgggataatgtgcaacaca

SEQ ID NO: 72067 - DNA, 25 bp, E. coli
taaggcgtcatctcattttctcaat

SEQ ID NO: 72068 - DNA, 25 bp, E. coli
taaggcgtcatcacattttctcaat

SEQ ID NO: 72069 - DNA, 25 bp, E. coli
caccgatgatgtcgctgaaggttaa

SEQ ID NO: 72070 - DNA, 25 bp, E. coli
caccgatgatgtggctgaaggttaa

SEQ ID NO: 72071 - DNA, 25 bp, E. coli
cagagcgcgttattgatggaaggtc

SEQ ID NO: 72072 - DNA, 25 bp, E. coli
cagagcgcgttaatgatggaaggtc

SEQ ID NO: 72073 - DNA, 25 bp, E. coli
taaaaatggctttttaattatgcgg

SEQ ID NO: 72074 - DNA, 25 bp, E. coli
tatgcggtttatatggtcgctctca

SEQ ID NO: 72075 - DNA, 25 bp, E. coli
tagtgttaaattctaatgagagagc

SEQ ID NO: 72076 - DNA, 25 bp, E. coli
tagtgttaaattgtaatgagagagc

SEQ ID NO: 72077 - DNA, 25 bp, E. coli
tatgcggtttatttggtcgctctca

SEQ ID NO: 72078 - DNA, 25 bp, E. coli
tatcttagcggcaataaaaatggct

SEQ ID NO: 72079 - DNA, 25 bp, E. coli
tatcttagcggctataaaaatggct

SEQ ID NO: 72080 - DNA, 25 bp, E. coli
tataggttttcagcgatgatgtcgc

SEQ ID NO: 72081 - DNA, 25 bp, E. coli
tataggttttcaccgatgatgtcgc

SEQ ID NO: 72082 - DNA, 25 bp, E. coli
tctcaattttcagagcgcgttaatg

SEQ ID NO: 72083 - DNA, 25 bp, E. coli
tctcaattttcacagcgcgttaatg

SEQ ID NO: 72084 - DNA, 25 bp, E. coli
gctgaaggttaacatattcatcaga

SEQ ID NO: 72085 - DNA, 25 bp, E. coli
gctgaaggttaagatattcatcaga

SEQ ID NO: 72086 - DNA, 25 bp, E. coli
gacacatcctttaatatcttagcgg

SEQ ID NO: 72087 - DNA, 25 bp, E. coli
gacacatccttttatatcttagcgg

SEQ ID NO: 72088 - DNA, 25 bp, E. coli
taatgagagagcaaaccagcagaaa

SEQ ID NO: 72089 - DNA, 25 bp, E. coli
taatgagagagctaaccagcagaaa

SEQ ID NO: 72090 - DNA, 25 bp, E. coli
taaaaatggcttattaattatgcgg

SEQ ID NO: 72091 - DNA, 25 bp, E. coli
tcaccgccgacagtgtgcaatggat

SEQ ID NO: 72092 - DNA, 25 bp, E. coli
tctggacgcgcaaagaagccatcgt

SEQ ID NO: 72093 - DNA, 25 bp, E. coli
tctatggcgaacaaggcaaacctgc

SEQ ID NO: 72094 - DNA, 25 bp, E. coli
tctggacgcgcatagaagccatcgt

SEQ ID NO: 72095 - DNA, 25 bp, E. coli
tctatggcgaactaggcaaacctgc

SEQ ID NO: 72096 - DNA, 25 bp, E. coli
gcctggcaaatcctcagcgtagaca

SEQ ID NO: 72097 - DNA, 25 bp, E. coli
gcctggcaaatcgtcagcgtagaca

SEQ ID NO: 72098 - DNA, 25 bp, E. coli
gctaccggagatcatctatggcgaa

SEQ ID NO: 72099 - DNA, 25 bp, E. coli
gctaccggagatgatctatggcgaa

SEQ ID NO: 72100 - DNA, 25 bp, E. coli
gaagtcggctgcgatatcgaagtga

SEQ ID NO: 72101 - DNA, 25 bp, E. coli
gcaatggatcgaatcagttaactga

SEQ ID NO: 72102 - DNA, 25 bp, E. coli
gaagtcggctgccatatcgaagtga

SEQ ID NO: 72103 - DNA, 25 bp, E. coli
gcaatggatcgattcagttaactga

SEQ ID NO: 72104 - DNA, 25 bp, E. coli
ctgccaccgggtttacgcgagcaag

SEQ ID NO: 72105 - DNA, 25 bp, E. coli
ctgccaccgggtatacgcgagcaag

SEQ ID NO: 72106 - DNA, 25 bp, E. coli
ggaaagtttcgagcttaagcgcagc

SEQ ID NO: 72107 - DNA, 25 bp, E. coli
ggacgccgtgcaacctgatcagcaa

SEQ ID NO: 72108 - DNA, 25 bp, E. coli
ggaaagtttcgaccttaagcgcagc

SEQ ID NO: 72109 - DNA, 25 bp, E. coli
ggacgccgtgcatcctgatcagcaa

SEQ ID NO: 72110 - DNA, 25 bp, E. coli
tcagcaactggatatgttctggcgc

SEQ ID NO: 72111 - DNA, 25 bp, E. coli
tcagcaactggaaatgttctggcgc

SEQ ID NO: 72112 - DNA, 25 bp, E. coli
tcaccgccgacactgtgcaatggat

SEQ ID NO: 72113 - DNA, 25 bp, E. coli
aatttggtatcgatatcattcctga

SEQ ID NO: 72114 - DNA, 25 bp, E. coli
aatttggtatcgttatcattcctga

SEQ ID NO: 72115 - DNA, 25 bp, E. coli
taaagatatagatggtggtatccct

SEQ ID NO: 72116 - DNA, 25 bp, E. coli
taaagatatagaaggtggtatccct

SEQ ID NO: 72117 - DNA, 25 bp, E. coli
tatccctctgctgatatacgagcga

SEQ ID NO: 72118 - DNA, 25 bp, E. coli
tatccctctgctcatatacgagcga

SEQ ID NO: 72119 - DNA, 25 bp, E. coli
tatagaaggtggtatccctggctat

SEQ ID NO: 72120 - DNA, 25 bp, E. coli
tatagaaggtggaatccctggctat

SEQ ID NO: 72121 - DNA, 25 bp, E. coli
tctgctgatatacgagcgaagatca

SEQ ID NO: 72122 - DNA, 25 bp, E. coli
tctgctgatataggagcgaagatca

SEQ ID NO: 72123 - DNA, 25 bp, E. coli
cgagcgaagatctgtaaagatatag

SEQ ID NO: 72124 - DNA, 25 bp, E. coli
cgagcgaagatcagtaaagatatag

SEQ ID NO: 72125 - DNA, 25 bp, E. coli
gggtagtggtaaaaatgacctggat

SEQ ID NO: 72126 - DNA, 25 bp, E. coli
gggtagtggtaataatgacctggat

SEQ ID NO: 72127 - DNA, 25 bp, E. coli
tggttaaagatggtaaaaaatttgg

SEQ ID NO: 72128 - DNA, 25 bp, E. coli
ggtaaaaatgacgtggattatccct

SEQ ID NO: 72129 - DNA, 25 bp, E. coli
ggtaaaaatgacctggattatccct

SEQ ID NO: 72130 - DNA, 25 bp, E. coli
tggttaaagatgctaaaaaatttgg

SEQ ID NO: 72131 - DNA, 25 bp, E. coli
tgattatacctttaactttatggga

SEQ ID NO: 72132 - DNA, 25 bp, E. coli
tgattataccttaaactttatggga

SEQ ID NO: 72133 - DNA, 25 bp, E. coli
gacctggattatccctctgctgata

SEQ ID NO: 72134 - DNA, 25 bp, E. coli
gacctggattatgcctctgctgata

SEQ ID NO: 72135 - DNA, 25 bp, E. coli
caaagcggttgtcactacttccacc

SEQ ID NO: 72136 - DNA, 25 bp, E. coli
caaagcggttgtgactacttccacc

SEQ ID NO: 72137 - DNA, 25 bp, E. coli
aaagactgaagaaacggaagcggct

SEQ ID NO: 72138 - DNA, 25 bp, E. coli
aaagactgaagatacggaagcggct

SEQ ID NO: 72139 - DNA, 25 bp, E. coli
taccgccggacaaaagactgaagaa

SEQ ID NO: 72140 - DNA, 25 bp, E. coli
taccgccggacataagactgaagaa

SEQ ID NO: 72141 - DNA, 25 bp, E. coli
tgaacaaagcggttgtcactacttc

SEQ ID NO: 72142 - DNA, 25 bp, E. coli
tgaacaaagcggatgtcactacttc

SEQ ID NO: 72143 - DNA, 25 bp, E. coli
gccaaatcagtttatcggtgaactg

SEQ ID NO: 72144 - DNA, 25 bp, E. coli
gccaaatcagttaatcggtgaactg

SEQ ID NO: 72145 - DNA, 25 bp, E. coli
gaagaaacggaaccggctgaaaaat

SEQ ID NO: 72146 - DNA, 25 bp, E. coli
gaagaaacggaagcggctgaaaaat

SEQ ID NO: 72147 - DNA, 25 bp, E. coli
gaactgccaaatgagttaatcggtg

SEQ ID NO: 72148 - DNA, 25 bp, E. coli
gaactgccaaatcagttaatcggtg

SEQ ID NO: 72149 - DNA, 25 bp, E. coli
cgctgggtgaactgccaaatcagtt

SEQ ID NO: 72150 - DNA, 25 bp, E. coli
cgctgggtgaacagccaaatcagtt

SEQ ID NO: 72151 - DNA, 25 bp, E. coli
gtcactacttccacctggaaagaca

SEQ ID NO: 72152 - DNA, 25 bp, E. coli
gggtggtgagctccatggtgcataa

SEQ ID NO: 72153 - DNA, 25 bp, E. coli
gggtggtgagctgcatggtgcataa

SEQ ID NO: 72154 - DNA, 25 bp, E. coli
ggttgtcactacttccacctggaaa

SEQ ID NO: 72155 - DNA, 25 bp, E. coli
ggttgtcactacatccacctggaaa

SEQ ID NO: 72156 - DNA, 25 bp, E. coli
gtcactacttcctcctggaaagaca

SEQ ID NO: 72157 - DNA, 25 bp, E. coli
caattatttgaaaaagcaggcggta

SEQ ID NO: 72158 - DNA, 25 bp, E. coli
aatgcgtaccttgctcgaccagacg

SEQ ID NO: 72159 - DNA, 25 bp, E. coli
caattatttgaataagcaggcggta

SEQ ID NO: 72160 - DNA, 25 bp, E. coli
aatgcgtaccttcctcgaccagacg

SEQ ID NO: 72161 - DNA, 25 bp, E. coli
aacatgtccggtcaaatgcgtacct

SEQ ID NO: 72162 - DNA, 25 bp, E. coli
aacatgtccggtgaaatgcgtacct

SEQ ID NO: 72163 - DNA, 25 bp, E. coli
tatgtcgcaggtctggcagttaaac

SEQ ID NO: 72164 - DNA, 25 bp, E. coli
tatgtcgcaggtgtggcagttaaac

SEQ ID NO: 72165 - DNA, 25 bp, E. coli
tatttgacgtttcacaggttcgcgg

SEQ ID NO: 72166 - DNA, 25 bp, E. coli
tatttgacgtttgacaggttcgcgg

SEQ ID NO: 72167 - DNA, 25 bp, E. coli
gcgagcgtctttagttccaccggta

SEQ ID NO: 72168 - DNA, 25 bp, E. coli
gcgagcgtcttttgttccaccggta

SEQ ID NO: 72169 - DNA, 25 bp, E. coli
gcactatacggaaaactggcgagcg

SEQ ID NO: 72170 - DNA, 25 bp, E. coli
gcactatacggataactggcgagcg

SEQ ID NO: 72171 - DNA, 25 bp, E. coli
gctacgcagcgcaggaattatttga

SEQ ID NO: 72172 - DNA, 25 bp, E. coli
gctacgcagcgctggaattatttga

SEQ ID NO: 72173 - DNA, 25 bp, E. coli
cgttaagcgtgttccggaaaccatg

SEQ ID NO: 72174 - DNA, 25 bp, E. coli
cgttaagcgtgtaccggaaaccatg

SEQ ID NO: 72175 - DNA, 25 bp, E. coli
ctggcggcggtcaggaacaaaccat

SEQ ID NO: 72176 - DNA, 25 bp, E. coli
ctggcggcggtctggaacaaaccat

SEQ ID NO: 72177 - DNA, 25 bp, E. coli
ggtaaaacgcaaactgcaccggttg

SEQ ID NO: 72178 - DNA, 25 bp, E. coli
ggtaaaacgcaatctgcaccggttg

SEQ ID NO: 72179 - DNA, 25 bp, E. coli
taaggaactactgattctaattggt

SEQ ID NO: 72180 - DNA, 25 bp, E. coli
taaggaactactcattctaattggt

SEQ ID NO: 72181 - DNA, 25 bp, E. coli
cactttttgatattagctttgccaa

SEQ ID NO: 72182 - DNA, 25 bp, E. coli
cactttttgataatagctttgccaa

SEQ ID NO: 72183 - DNA, 25 bp, E. coli
catagtatgaaactgccgctgcgct

SEQ ID NO: 72184 - DNA, 25 bp, E. coli
catagtatgaaagtgccgctgcgct

SEQ ID NO: 72185 - DNA, 25 bp, E. coli
cccgaaatccggagccttaagcact

SEQ ID NO: 72186 - DNA, 25 bp, E. coli
cccgaaatccggtgccttaagcact

SEQ ID NO: 72187 - DNA, 25 bp, E. coli
agtgagtccttaaataccatgcaaa

SEQ ID NO: 72188 - DNA, 25 bp, E. coli
agtgagtccttatataccatgcaaa

SEQ ID NO: 72189 - DNA, 25 bp, E. coli
aaatagcggtattgcaaaggaacgg

SEQ ID NO: 72190 - DNA, 25 bp, E. coli
aaatagcggtatagcaaaggaacgg

SEQ ID NO: 72191 - DNA, 25 bp, E. coli
tgccaaatcgtttttccgttaagga

SEQ ID NO: 72192 - DNA, 25 bp, E. coli
tgccaaatcgttattccgttaagga

SEQ ID NO: 72193 - DNA, 25 bp, E. coli
tcaaatcttcctaaacgcccgaaat

SEQ ID NO: 72194 - DNA, 25 bp, E. coli
cctatagtcgaaacatctgatggca

SEQ ID NO: 72195 - DNA, 25 bp, E. coli
gccgctgcgctataacaatttcaaa

SEQ ID NO: 72196 - DNA, 25 bp, E. coli
gccgctgcgctaaaacaatttcaaa

SEQ ID NO: 72197 - DNA, 25 bp, E. coli
cctatagtcgaatcatctgatggca

SEQ ID NO: 72198 - DNA, 25 bp, E. coli
gttctcttacgcaccctatagtcga

SEQ ID NO: 72199 - DNA, 25 bp, E. coli
gttctcttacgctccctatagtcga

SEQ ID NO: 72200 - DNA, 25 bp, E. coli
tcaaatcttccttaacgcccgaaat

SEQ ID NO: 72201 - DNA, 25 bp, E. coli
cacgatcccgcagtgtgatttgagg

SEQ ID NO: 72202 - DNA, 25 bp, E. coli
cacgatcccgcactgtgatttgagg

SEQ ID NO: 72203 - DNA, 25 bp, E. coli
atagccagagcaagccctgacttca

SEQ ID NO: 72204 - DNA, 25 bp, E. coli
atagccagagcatgccctgacttca

SEQ ID NO: 72205 - DNA, 25 bp, E. coli
tataagtcacgcaaaatgacaggct

SEQ ID NO: 72206 - DNA, 25 bp, E. coli
tataagtcacgctaaatgacaggct

SEQ ID NO: 72207 - DNA, 25 bp, E. coli
tgacaggctgaatcgaatcatagcc

SEQ ID NO: 72208 - DNA, 25 bp, E. coli
tgacaggctgaaacgaatcatagcc

SEQ ID NO: 72209 - DNA, 25 bp, E. coli
tcccgactattcttaatgagcttcg

SEQ ID NO: 72210 - DNA, 25 bp, E. coli
tcccgactattcataatgagcttcg

SEQ ID NO: 72211 - DNA, 25 bp, E. coli
gaatcatagccagagcatgccctga

SEQ ID NO: 72212 - DNA, 25 bp, E. coli
gaatcatagccacagcatgccctga

SEQ ID NO: 72213 - DNA, 25 bp, E. coli
gacttcaccccgctgtgtctgcttt

SEQ ID NO: 72214 - DNA, 25 bp, E. coli
gacttcaccccggtgtgtctgcttt

SEQ ID NO: 72215 - DNA, 25 bp, E. coli
ccgcagtgtgatttgaggagttttc

SEQ ID NO: 72216 - DNA, 25 bp, E. coli
cgctgtgtctgcatttcccgactat

SEQ ID NO: 72217 - DNA, 25 bp, E. coli
cgctgtgtctgcttttcccgactat

SEQ ID NO: 72218 - DNA, 25 bp, E. coli
ccgcagtgtgatatgaggagttttc

SEQ ID NO: 72219 - DNA, 25 bp, E. coli
taatgagcttcgttgcaattcacga

SEQ ID NO: 72220 - DNA, 25 bp, E. coli
taatgagcttcgatgcaattcacga

SEQ ID NO: 72221 - DNA, 25 bp, E. coli
gatgcaattcacgatcccgcagtgt

SEQ ID NO: 72222 - DNA, 25 bp, E. coli
gatgcaattcaccatcccgcagtgt

SEQ ID NO: 72223 - DNA, 25 bp, E. coli
aaccagttctggagcacggacatga

SEQ ID NO: 72224 - DNA, 25 bp, E. coli
aatatggtcgtaaatcctggctggc

SEQ ID NO: 72225 - DNA, 25 bp, E. coli
aaccagttctggtgcacggacatga

SEQ ID NO: 72226 - DNA, 25 bp, E. coli
aatatggtcgtatatcctggctggc

SEQ ID NO: 72227 - DNA, 25 bp, E. coli
taccctgtgcgtactgctgctgaac

SEQ ID NO: 72228 - DNA, 25 bp, E. coli
taccctgtgcgttctgctgctgaac

SEQ ID NO: 72229 - DNA, 25 bp, E. coli
ttgtgggccacggtattcggtacgc

SEQ ID NO: 72230 - DNA, 25 bp, E. coli
ttgtgggccacgctattcggtacgc

SEQ ID NO: 72231 - DNA, 25 bp, E. coli
tggtggcgcagatggagcacttctc

SEQ ID NO: 72232 - DNA, 25 bp, E. coli
tggtggcgcagaaggagcacttctc

SEQ ID NO: 72233 - DNA, 25 bp, E. coli
cctggctggcagaagtgattcgctt

SEQ ID NO: 72234 - DNA, 25 bp, E. coli
cctggctggcagtagtgattcgctt

SEQ ID NO: 72235 - DNA, 25 bp, E. coli
gctgctgaacattctggcgcgcgtt

SEQ ID NO: 72236 - DNA, 25 bp, E. coli
gctgctgaacatactggcgcgcgtt

SEQ ID NO: 72237 - DNA, 25 bp, E. coli
cgatgagcccgtatgcggaatggca

SEQ ID NO: 72238 - DNA, 25 bp, E. coli
cgatgagcccgtttgcggaatggca

SEQ ID NO: 72239 - DNA, 25 bp, E. coli
gatctttaagttagcgatgagcccg

SEQ ID NO: 72240 - DNA, 25 bp, E. coli
gatctttaagtttgcgatgagcccg

SEQ ID NO: 72241 - DNA, 25 bp, E. coli
gttgaaatgcaatccactgcggcgc

SEQ ID NO: 72242 - DNA, 25 bp, E. coli
gattgcccgtattgctggtgaaacc

SEQ ID NO: 72243 - DNA, 25 bp, E. coli
gattgcccgtatagctggtgaaacc

SEQ ID NO: 72244 - DNA, 25 bp, E. coli
gttgaaatgcaaaccactgcggcgc

SEQ ID NO: 72245 - DNA, 25 bp, E. coli
cacagaaaaaaggatcaggtagaag

SEQ ID NO: 72246 - DNA, 25 bp, E. coli
cacagaaaaaagcatcaggtagaag

SEQ ID NO: 72247 - DNA, 25 bp, E. coli
agcatcatgatagccgcctttaaaa

SEQ ID NO: 72248 - DNA, 25 bp, E. coli
agcatcatgatacccgcctttaaaa

SEQ ID NO: 72249 - DNA, 25 bp, E. coli
aaaagcagtgtttgtatttcaacag

SEQ ID NO: 72250 - DNA, 25 bp, E. coli
aaaagcagtgttagtatttcaacag

SEQ ID NO: 72251 - DNA, 25 bp, E. coli
tttgtcgggcatataaaagcagtgt

SEQ ID NO: 72252 - DNA, 25 bp, E. coli
tttgtcgggcatttaaaagcagtgt

SEQ ID NO: 72253 - DNA, 25 bp, E. coli
ttggtgatcgtaatgcgcttaatct

SEQ ID NO: 72254 - DNA, 25 bp, E. coli
ttatcattcagacagcggcggttct

SEQ ID NO: 72255 - DNA, 25 bp, E. coli
ttatcattcagagagcggcggttct

SEQ ID NO: 72256 - DNA, 25 bp, E. coli
ttttttgctttctccatcattatgg

SEQ ID NO: 72257 - DNA, 25 bp, E. coli
ttttttgctttcaccatcattatgg

SEQ ID NO: 72258 - DNA, 25 bp, E. coli
ttggtgatcgtattgcgcttaatct

SEQ ID NO: 72259 - DNA, 25 bp, E. coli
tgtatttcaacactctatcttatag

SEQ ID NO: 72260 - DNA, 25 bp, E. coli
tgtatttcaacagtctatcttatag

SEQ ID NO: 72261 - DNA, 25 bp, E. coli
tgtcccacagaataaagcatcaggt

SEQ ID NO: 72262 - DNA, 25 bp, E. coli
tgtcccacagaaaaaagcatcaggt

SEQ ID NO: 72263 - DNA, 25 bp, E. coli
tctttacctggttatgtgtcccaca

SEQ ID NO: 72264 - DNA, 25 bp, E. coli
tctttacctggtaatgtgtcccaca

SEQ ID NO: 72265 - DNA, 25 bp, E. coli
ggcaataatttttgtcgggcattta

SEQ ID NO: 72266 - DNA, 25 bp, E. coli
ggcaataattttagtcgggcattta

SEQ ID NO: 72267 - DNA, 25 bp, E. coli
cagaaaacaggcagatgctgctgag

SEQ ID NO: 72268 - DNA, 25 bp, E. coli
cagaaaacaggctgatgctgctgag

SEQ ID NO: 72269 - DNA, 25 bp, E. coli
tgggtgaaaccactgcgcttgctga

SEQ ID NO: 72270 - DNA, 25 bp, E. coli
tgggtgaaaccagtgcgcttgctga

SEQ ID NO: 72271 - DNA, 25 bp, E. coli
tgctgctgagcacagtctgagccga

SEQ ID NO: 72272 - DNA, 25 bp, E. coli
tgctgacactggattctgcccgttt

SEQ ID NO: 72273 - DNA, 25 bp, E. coli
tgctgctgagcagagtctgagccga

SEQ ID NO: 72274 - DNA, 25 bp, E. coli
tgctgacactggtttctgcccgttt

SEQ ID NO: 72275 - DNA, 25 bp, E. coli
tcagtcagtcttacagaaaacaggc

SEQ ID NO: 72276 - DNA, 25 bp, E. coli
tctgaagaggcaccgcgggtaaaaa

SEQ ID NO: 72277 - DNA, 25 bp, E. coli
tcagtcagtctttcagaaaacaggc

SEQ ID NO: 72278 - DNA, 25 bp, E. coli
tctgaagaggcagcgcgggtaaaaa

SEQ ID NO: 72279 - DNA, 25 bp, E. coli
cgcttgctgatttgatgtccgggaa

SEQ ID NO: 72280 - DNA, 25 bp, E. coli
cgcttgctgattagatgtccgggaa

SEQ ID NO: 72281 - DNA, 25 bp, E. coli
gattctgcccgtttttctgaagagg

SEQ ID NO: 72282 - DNA, 25 bp, E. coli
gattctgcccgtatttctgaagagg

SEQ ID NO: 72283 - DNA, 25 bp, E. coli
gatctgacagccctgctgacactgg

SEQ ID NO: 72284 - DNA, 25 bp, E. coli
taattttgccgaactgacagccgtg

SEQ ID NO: 72285 - DNA, 25 bp, E. coli
taattttgccgatctgacagccgtg

SEQ ID NO: 72286 - DNA, 25 bp, E. coli
gatctgacagccgtgctgacactgg

SEQ ID NO: 72287 - DNA, 25 bp, E. coli
gatgtccgggaaagtcagtcagtct

SEQ ID NO: 72288 - DNA, 25 bp, E. coli
gatgtccgggaatgtcagtcagtct

SEQ ID NO: 72289 - DNA, 25 bp, E. coli
caatgtcagccatgtaccagcaaga

SEQ ID NO: 72290 - DNA, 25 bp, E. coli
caatgtcagccaagtaccagcaaga

SEQ ID NO: 72291 - DNA, 25 bp, E. coli
tcctcaactgcaggaaaaaatggta

SEQ ID NO: 72292 - DNA, 25 bp, E. coli
tcctcaactgcacgaaaaaatggta

SEQ ID NO: 72293 - DNA, 25 bp, E. coli
tcacggcggatgtgattcgggaaca

SEQ ID NO: 72294 - DNA, 25 bp, E. coli
tcacggcggatgagattcgggaaca

SEQ ID NO: 72295 - DNA, 25 bp, E. coli
ccatgtaccagctagaagttccgca

SEQ ID NO: 72296 - DNA, 25 bp, E. coli
ccatgtaccagcaagaagttccgca

SEQ ID NO: 72297 - DNA, 25 bp, E. coli
gcacgctgctggaactggtagctga

SEQ ID NO: 72298 - DNA, 25 bp, E. coli
gcacgctgctggtactggtagctga

SEQ ID NO: 72299 - DNA, 25 bp, E. coli
gaaaaaatggtaaatgcagacgagc

SEQ ID NO: 72300 - DNA, 25 bp, E. coli
gaaaaaatggtatatgcagacgagc

SEQ ID NO: 72301 - DNA, 25 bp, E. coli
cgctgctggaacaggtagctgatgt

SEQ ID NO: 72302 - DNA, 25 bp, E. coli
cgctgctggaactggtagctgatgt

SEQ ID NO: 72303 - DNA, 25 bp, E. coli
gattcgggaacacttttcgcaggca

SEQ ID NO: 72304 - DNA, 25 bp, E. coli
gttttcgcaggcaatgtcagccatg

SEQ ID NO: 72305 - DNA, 25 bp, E. coli
gttttcgcaggctatgtcagccatg

SEQ ID NO: 72306 - DNA, 25 bp, E. coli
gattcgggaacagttttcgcaggca

SEQ ID NO: 72307 - DNA, 25 bp, E. coli
gtgctggaaaactatcctcaactgc

SEQ ID NO: 72308 - DNA, 25 bp, E. coli
gtgctggaaaacaatcctcaactgc

SEQ ID NO: 72309 - DNA, 25 bp, E. coli
tggcgaacagcaacacggcggatga

SEQ ID NO: 72310 - DNA, 25 bp, E. coli
tggcgaacagcatcacggcggatga

SEQ ID NO: 72311 - DNA, 25 bp, E. coli
caaaaattatatgccaccactaagg

SEQ ID NO: 72312 - DNA, 25 bp, E. coli
caaaaattatatcccaccactaagg

SEQ ID NO: 72313 - DNA, 25 bp, E. coli
ccactaaggtttataaaagcatacg

SEQ ID NO: 72314 - DNA, 25 bp, E. coli
ccactaaggtttttaaaagcatacg

SEQ ID NO: 72315 - DNA, 25 bp, E. coli
aaagcatacgttagcaggtgtcacc

SEQ ID NO: 72316 - DNA, 25 bp, E. coli
aaagcatacgtttgcaggtgtcacc

SEQ ID NO: 72317 - DNA, 25 bp, E. coli
tatggcgtaagaaaattgcaatacg

SEQ ID NO: 72318 - DNA, 25 bp, E. coli
tatggcgtaagataattgcaatacg

SEQ ID NO: 72319 - DNA, 25 bp, E. coli
tatgtattctttagtgctttcaaga

SEQ ID NO: 72320 - DNA, 25 bp, E. coli
tatgagcctcgtattatgctttttg

SEQ ID NO: 72321 - DNA, 25 bp, E. coli
tatgtattcttttgtgctttcaaga

SEQ ID NO: 72322 - DNA, 25 bp, E. coli
tatgagcctcgttttatgctttttg

SEQ ID NO: 72323 - DNA, 25 bp, E. coli
tctaaacgactataatatggaggct

SEQ ID NO: 72324 - DNA, 25 bp, E. coli
tctaaacgactaaaatatggaggct

SEQ ID NO: 72325 - DNA, 25 bp, E. coli
cgactaaaatatggaggctcttata

SEQ ID NO: 72326 - DNA, 25 bp, E. coli
cgactaaaatatcgaggctcttata

SEQ ID NO: 72327 - DNA, 25 bp, E. coli
gttgtatattcatgataatgtgacc

SEQ ID NO: 72328 - DNA, 25 bp, E. coli
gttgtatattcaagataatgtgacc

SEQ ID NO: 72329 - DNA, 25 bp, E. coli
ggaggctcttatttttatatgagcc

SEQ ID NO: 72330 - DNA, 25 bp, E. coli
ggaggctcttatatttatatgagcc

SEQ ID NO: 72331 - DNA, 25 bp, E. coli
tgtgctttcaagtttatggcgtaag

SEQ ID NO: 72332 - DNA, 25 bp, E. coli
tgtgctttcaagattatggcgtaag

SEQ ID NO: 72333 - DNA, 25 bp, E. coli
cagtttttgcatcaaggcagccagg

SEQ ID NO: 72334 - DNA, 25 bp, E. coli
cagtttttgcatgaaggcagccagg

SEQ ID NO: 72335 - DNA, 25 bp, E. coli
tatgtgatcgtcctcatcggcgctt

SEQ ID NO: 72336 - DNA, 25 bp, E. coli
tatgtgatcgtcgtcatcggcgctt

SEQ ID NO: 72337 - DNA, 25 bp, E. coli
tattgccggtgtctggtcgctgcaa

SEQ ID NO: 72338 - DNA, 25 bp, E. coli
tattgccggtgtgtggtcgctgcaa

SEQ ID NO: 72339 - DNA, 25 bp, E. coli
ttaagcaaccatgcggtagggcggc

SEQ ID NO: 72340 - DNA, 25 bp, E. coli
ttaagcaaccatccggtagggcggc

SEQ ID NO: 72341 - DNA, 25 bp, E. coli
tgttttccggttatgcctatgcgcg

SEQ ID NO: 72342 - DNA, 25 bp, E. coli
tgttttccggttttgcctatgcgcg

SEQ ID NO: 72343 - DNA, 25 bp, E. coli
tcatggacaacatgggcagcgaacg

SEQ ID NO: 72344 - DNA, 25 bp, E. coli
tctttcgtcgcggattaggcaacgg

SEQ ID NO: 72345 - DNA, 25 bp, E. coli
tcatggacaacaagggcagcgaacg

SEQ ID NO: 72346 - DNA, 25 bp, E. coli
tctttcgtcgcgcattaggcaacgg

SEQ ID NO: 72347 - DNA, 25 bp, E. coli
gctaatggaagcctcgacctgggtc

SEQ ID NO: 72348 - DNA, 25 bp, E. coli
gctaatggaagcgtcgacctgggtc

SEQ ID NO: 72349 - DNA, 25 bp, E. coli
gaacgtcgtttcgatcggcattggg

SEQ ID NO: 72350 - DNA, 25 bp, E. coli
gaaaaatatgcccataccgccgtag

SEQ ID NO: 72351 - DNA, 25 bp, E. coli
gaacgtcgtttccatcggcattggg

SEQ ID NO: 72352 - DNA, 25 bp, E. coli
gaaaaatatgccgataccgccgtag

SEQ ID NO: 72353 - DNA, 25 bp, E. coli
ggcagccaggaggagcaccttattt

SEQ ID NO: 72354 - DNA, 25 bp, E. coli
ggcagccaggagcagcaccttattt

SEQ ID NO: 72355 - DNA, 25 bp, E. coli
caaggattcggctaatctggatgac

SEQ ID NO: 72356 - DNA, 25 bp, E. coli
caaggattcggcaaatctggatgac

SEQ ID NO: 72357 - DNA, 25 bp, E. coli
ttagccacatcaggcgaggtgggcc

SEQ ID NO: 72358 - DNA, 25 bp, E. coli
ttagccacatcacgcgaggtgggcc

SEQ ID NO: 72359 - DNA, 25 bp, E. coli
tcggctaatctggatgactctgttc

SEQ ID NO: 72360 - DNA, 25 bp, E. coli
tctggatgactctgttcttagaggg

SEQ ID NO: 72361 - DNA, 25 bp, E. coli
tctggatgactcagttcttagaggg

SEQ ID NO: 72362 - DNA, 25 bp, E. coli
tcggctaatctgcatgactctgttc

SEQ ID NO: 72363 - DNA, 25 bp, E. coli
gccgcattcacctcaacgctaagga

SEQ ID NO: 72364 - DNA, 25 bp, E. coli
gccgcattcaccacaacgctaagga

SEQ ID NO: 72365 - DNA, 25 bp, E. coli
gctgttatgtgcctgcttttagcca

SEQ ID NO: 72366 - DNA, 25 bp, E. coli
gctgttatgtgcgtgcttttagcca

SEQ ID NO: 72367 - DNA, 25 bp, E. coli
gcgaggtgggccaggttattcccca

SEQ ID NO: 72368 - DNA, 25 bp, E. coli
gcgaggtgggcctggttattcccca

SEQ ID NO: 72369 - DNA, 25 bp, E. coli
gcttttagccacatcaggcgaggtg

SEQ ID NO: 72370 - DNA, 25 bp, E. coli
gcttttagccacttcaggcgaggtg

SEQ ID NO: 72371 - DNA, 25 bp, E. coli
cattcaccacaacgctaaggattct

SEQ ID NO: 72372 - DNA, 25 bp, E. coli
cattcaccacaaggctaaggattct

SEQ ID NO: 72373 - DNA, 25 bp, E. coli
gggataattaaatgggagcgattta

SEQ ID NO: 72374 - DNA, 25 bp, E. coli
gggataattaaaagggagcgattta

SEQ ID NO: 72375 - DNA, 25 bp, E. coli
gattcggctaatctggatgactctg

SEQ ID NO: 72376 - DNA, 25 bp, E. coli
gattcggctaatgtggatgactctg

SEQ ID NO: 72377 - DNA, 25 bp, E. coli
caacgccttcgataaagagtactgg

SEQ ID NO: 72378 - DNA, 25 bp, E. coli
caacgccttcgaaaaagagtactgg

SEQ ID NO: 72379 - DNA, 25 bp, E. coli
cagcggcttctcagttggttgggtc

SEQ ID NO: 72380 - DNA, 25 bp, E. coli
caaaggcatgacgactactctggta

SEQ ID NO: 72381 - DNA, 25 bp, E. coli
caaactgctactacagccactgatt

SEQ ID NO: 72382 - DNA, 25 bp, E. coli
caaactgctacttcagccactgatt

SEQ ID NO: 72383 - DNA, 25 bp, E. coli
caaaggcatgaccactactctggta

SEQ ID NO: 72384 - DNA, 25 bp, E. coli
cagcggcttctctgttggttgggtc

SEQ ID NO: 72385 - DNA, 25 bp, E. coli
tactctggtattcggcaacgccttc

SEQ ID NO: 72386 - DNA, 25 bp, E. coli
tactctggtattgggcaacgccttc

SEQ ID NO: 72387 - DNA, 25 bp, E. coli
tgctacttcagccactgatttgctg

SEQ ID NO: 72388 - DNA, 25 bp, E. coli
tgctacttcagcgactgatttgctg

SEQ ID NO: 72389 - DNA, 25 bp, E. coli
ctggttggctactagatgagatcac

SEQ ID NO: 72390 - DNA, 25 bp, E. coli
ctggttggctacaagatgagatcac

SEQ ID NO: 72391 - DNA, 25 bp, E. coli
gattttagctctggttggctacaag

SEQ ID NO: 72392 - DNA, 25 bp, E. coli
gattttagctctcgttggctacaag

SEQ ID NO: 72393 - DNA, 25 bp, E. coli
ggataccgttacgagtaccctgaat

SEQ ID NO: 72394 - DNA, 25 bp, E. coli
ggataccgttaccagtaccctgaat

SEQ ID NO: 72395 - DNA, 25 bp, E. coli
ggcagcaggcgcacaaaggcatgac

SEQ ID NO: 72396 - DNA, 25 bp, E. coli
ggcagcaggcgctcaaaggcatgac

SEQ ID NO: 72397 - DNA, 25 bp, E. coli
tcaagggcagcaggcgctcaaaggc

SEQ ID NO: 72398 - DNA, 25 bp, E. coli
tcaagggcagcacgcgctcaaaggc

SEQ ID NO: 72399 - DNA, 25 bp, E. coli
caataacggcgctgtggatctggca

SEQ ID NO: 72400 - DNA, 25 bp, E. coli
caataacggcgcagtggatctggca

SEQ ID NO: 72401 - DNA, 25 bp, E. coli
aaagcgcagttctatccggagtgga

SEQ ID NO: 72402 - DNA, 25 bp, E. coli
aaagcgcagttcaatccggagtgga

SEQ ID NO: 72403 - DNA, 25 bp, E. coli
tattctcggcgatttaaccacgggt

SEQ ID NO: 72404 - DNA, 25 bp, E. coli
tattctcggcgaattaaccacgggt

SEQ ID NO: 72405 - DNA, 25 bp, E. coli
tatctacattcccaaactggcggcg

SEQ ID NO: 72406 - DNA, 25 bp, E. coli
tatctacattccgaaactggcggcg

SEQ ID NO: 72407 - DNA, 25 bp, E. coli
tgaatgcctgcacctcgctatggcg

SEQ ID NO: 72408 - DNA, 25 bp, E. coli
tgaatgcctgcagctcgctatggcg

SEQ ID NO: 72409 - DNA, 25 bp, E. coli
tgccactctggcgttactgaaagcg

SEQ ID NO: 72410 - DNA, 25 bp, E. coli
tgccactctggccttactgaaagcg

SEQ ID NO: 72411 - DNA, 25 bp, E. coli
cgattgcagtactaaaccttggcga

SEQ ID NO: 72412 - DNA, 25 bp, E. coli
cgattgcagtacaaaaccttggcga

SEQ ID NO: 72413 - DNA, 25 bp, E. coli
gatagcttcgcctaaggccgggtga

SEQ ID NO: 72414 - DNA, 25 bp, E. coli
gatagcttcgccaaaggccgggtga

SEQ ID NO: 72415 - DNA, 25 bp, E. coli
tggagccagcccttcctgcaaatgg

SEQ ID NO: 72416 - DNA, 25 bp, E. coli
tggagccagcccatcctgcaaatgg

SEQ ID NO: 72417 - DNA, 25 bp, E. coli
gatgctgggcatttactcgctggcg

SEQ ID NO: 72418 - DNA, 25 bp, E. coli
gatgatgtttgccaacggcctgaag

SEQ ID NO: 72419 - DNA, 25 bp, E. coli
gatgctgggcatatactcgctggcg

SEQ ID NO: 72420 - DNA, 25 bp, E. coli
gatgatgtttgcgaacggcctgaag

SEQ ID NO: 72421 - DNA, 25 bp, E. coli
caatatggcggtccttgatcaaagc

SEQ ID NO: 72422 - DNA, 25 bp, E. coli
caatatggcggtgcttgatcaaagc

SEQ ID NO: 72423 - DNA, 25 bp, E. coli
taaattgccgatccacgcttccggt

SEQ ID NO: 72424 - DNA, 25 bp, E. coli
taaaagaagatcacgcccaaacgcg

SEQ ID NO: 72425 - DNA, 25 bp, E. coli
taaaagaagatctcgcccaaacgcg

SEQ ID NO: 72426 - DNA, 25 bp, E. coli
taaattgccgatgcacgcttccggt

SEQ ID NO: 72427 - DNA, 25 bp, E. coli
tatcctgcgcaaactaatggaagag

SEQ ID NO: 72428 - DNA, 25 bp, E. coli
tatcctgcgcaatctaatggaagag

SEQ ID NO: 72429 - DNA, 25 bp, E. coli
tctggcgaaacggtcaatatggcgg

SEQ ID NO: 72430 - DNA, 25 bp, E. coli
tctggcgaaacgctcaatatggcgg

SEQ ID NO: 72431 - DNA, 25 bp, E. coli
ccaatggcagtgtggcactcacgga

SEQ ID NO: 72432 - DNA, 25 bp, E. coli
ccaatggcagtgaggcactcacgga

SEQ ID NO: 72433 - DNA, 25 bp, E. coli
gcccaactgagccaagaacaggtga

SEQ ID NO: 72434 - DNA, 25 bp, E. coli
gcccaactgagcgaagaacaggtga

SEQ ID NO: 72435 - DNA, 25 bp, E. coli
gcagcgtgtattttcgatgagcacc

SEQ ID NO: 72436 - DNA, 25 bp, E. coli
gaagctgctgcagcgcaaagggtta

SEQ ID NO: 72437 - DNA, 25 bp, E. coli
gcagcgtgtattatcgatgagcacc

SEQ ID NO: 72438 - DNA, 25 bp, E. coli
gaagctgctgcaccgcaaagggtta

SEQ ID NO: 72439 - DNA, 25 bp, E. coli
gtattaccgatgaccgcgtgaccga

SEQ ID NO: 72440 - DNA, 25 bp, E. coli
gtattaccgatgtccgcgtgaccga

SEQ ID NO: 72441 - DNA, 25 bp, E. coli
taacgcgtggccagaaattactgga

SEQ ID NO: 72442 - DNA, 25 bp, E. coli
taacgcgtggcctgaaattactgga

SEQ ID NO: 72443 - DNA, 25 bp, E. coli
cagcagatgtttaacggcgtcacgc

SEQ ID NO: 72444 - DNA, 25 bp, E. coli
caccatggtttacggcattatcggc

SEQ ID NO: 72445 - DNA, 25 bp, E. coli
caccatggtttagggcattatcggc

SEQ ID NO: 72446 - DNA, 25 bp, E. coli
cagcagatgttttacggcgtcacgc

SEQ ID NO: 72447 - DNA, 25 bp, E. coli
taaagatgtggtgtcattcgccctg

SEQ ID NO: 72448 - DNA, 25 bp, E. coli
taaagatgtggtctcattcgccctg

SEQ ID NO: 72449 - DNA, 25 bp, E. coli
tgctcggtgggaatggcagcattcc

SEQ ID NO: 72450 - DNA, 25 bp, E. coli
tgacctttgtgattggcgcggcgat

SEQ ID NO: 72451 - DNA, 25 bp, E. coli
tgacctttgtgaatggcgcggcgat

SEQ ID NO: 72452 - DNA, 25 bp, E. coli
tgctcggtgggattggcagcattcc

SEQ ID NO: 72453 - DNA, 25 bp, E. coli
tcgcccggaggttgagaaagtatga

SEQ ID NO: 72454 - DNA, 25 bp, E. coli
tcgcccggaggtagagaaagtatga

SEQ ID NO: 72455 - DNA, 25 bp, E. coli
tcggcatgatcaacttcgcccacgg

SEQ ID NO: 72456 - DNA, 25 bp, E. coli
tctattaccaccatgcaggcggtga

SEQ ID NO: 72457 - DNA, 25 bp, E. coli
tatggccgggatgaaagcctttacc

SEQ ID NO: 72458 - DNA, 25 bp, E. coli
tctattaccaccttgcaggcggtga

SEQ ID NO: 72459 - DNA, 25 bp, E. coli
tcggcatgatcatcttcgcccacgg

SEQ ID NO: 72460 - DNA, 25 bp, E. coli
tatggccgggatcaaagcctttacc

SEQ ID NO: 72461 - DNA, 25 bp, E. coli
gccatgctggcggtgacgattttca

SEQ ID NO: 72462 - DNA, 25 bp, E. coli
cctacggctggagtatcgaacgggt

SEQ ID NO: 72463 - DNA, 25 bp, E. coli
cctacggctggactatcgaacgggt

SEQ ID NO: 72464 - DNA, 25 bp, E. coli
gccatgctggcgctgacgattttca

SEQ ID NO: 72465 - DNA, 25 bp, E. coli
caaaaccacggtatcaagacgctga

SEQ ID NO: 72466 - DNA, 25 bp, E. coli
caaaaccacggtttcaagacgctga

SEQ ID NO: 72467 - DNA, 25 bp, E. coli
cacggctatcgcaccatgtacagag

SEQ ID NO: 72468 - DNA, 25 bp, E. coli
cacggctatcgctccatgtacagag

SEQ ID NO: 72469 - DNA, 25 bp, E. coli
catactcgtgaacgccatcgtgcag

SEQ ID NO: 72470 - DNA, 25 bp, E. coli
catactcgtgaaggccatcgtgcag

SEQ ID NO: 72471 - DNA, 25 bp, E. coli
tgaaccaggacccatgggacgcatt

SEQ ID NO: 72472 - DNA, 25 bp, E. coli
tgacgcgcggcggaaaaacctttat

SEQ ID NO: 72473 - DNA, 25 bp, E. coli
tgaaccaggaccgatgggacgcatt

SEQ ID NO: 72474 - DNA, 25 bp, E. coli
tgacgcgcggcgcaaaaacctttat

SEQ ID NO: 72475 - DNA, 25 bp, E. coli
tcattcctgaacagtacccggtggc

SEQ ID NO: 72476 - DNA, 25 bp, E. coli
tcattcctgaactgtacccggtggc

SEQ ID NO: 72477 - DNA, 25 bp, E. coli
gaaccggtgattgataagcctggca

SEQ ID NO: 72478 - DNA, 25 bp, E. coli
gaaccggtgattcataagcctggca

SEQ ID NO: 72479 - DNA, 25 bp, E. coli
cattatcccggatgattgtgtcggc

SEQ ID NO: 72480 - DNA, 25 bp, E. coli
cattatcccggaagattgtgtcggc

SEQ ID NO: 72481 - DNA, 25 bp, E. coli
ggaattccagaattacgcccttgag

SEQ ID NO: 72482 - DNA, 25 bp, E. coli
tggcagccgcacctcaaaaaggaat

SEQ ID NO: 72483 - DNA, 25 bp, E. coli
ggaattccagaaatacgcccttgag

SEQ ID NO: 72484 - DNA, 25 bp, E. coli
tggcagccgcacgtcaaaaaggaat

SEQ ID NO: 72485 - DNA, 25 bp, E. coli
gatgtttcactggtacgcacggcta

SEQ ID NO: 72486 - DNA, 25 bp, E. coli
gatgtttcactgctacgcacggcta

SEQ ID NO: 72487 - DNA, 25 bp, E. coli
aatagctggagtcatgttaggtgct

SEQ ID NO: 72488 - DNA, 25 bp, E. coli
aatagctggagtgatgttaggtgct

SEQ ID NO: 72489 - DNA, 25 bp, E. coli
aaccaaatcctcaggatggtgttga

SEQ ID NO: 72490 - DNA, 25 bp, E. coli
aaccaaatcctctggatggtgttga

SEQ ID NO: 72491 - DNA, 25 bp, E. coli
agctggagtgatgttaggtgctgct

SEQ ID NO: 72492 - DNA, 25 bp, E. coli
agctggagtgatcttaggtgctgct

SEQ ID NO: 72493 - DNA, 25 bp, E. coli
aaatcctcaggatggtgttgatgtc

SEQ ID NO: 72494 - DNA, 25 bp, E. coli
aaatcctcaggaaggtgttgatgtc

SEQ ID NO: 72495 - DNA, 25 bp, E. coli
ttgccatacaacaggcaggaatgcc

SEQ ID NO: 72496 - DNA, 25 bp, E. coli
ttgccatacaactggcaggaatgcc

SEQ ID NO: 72497 - DNA, 25 bp, E. coli
tgccatacaactcgcaggaatgccg

SEQ ID NO: 72498 - DNA, 25 bp, E. coli
tgccatacaactggcaggaatgccg

SEQ ID NO: 72499 - DNA, 25 bp, E. coli
tcaaccaaatcctcaggatggtgtt

SEQ ID NO: 72500 - DNA, 25 bp, E. coli
ccatacaactgggaggaatgccggg

SEQ ID NO: 72501 - DNA, 25 bp, E. coli
ccaaatcctcagcatggtgttgatg

SEQ ID NO: 72502 - DNA, 25 bp, E. coli
ccaaatcctcaggatggtgttgatg

SEQ ID NO: 72503 - DNA, 25 bp, E. coli
ccatacaactggcaggaatgccggg

SEQ ID NO: 72504 - DNA, 25 bp, E. coli
gcttgccatacaactggcaggaatg

SEQ ID NO: 72505 - DNA, 25 bp, E. coli
gcttgccatacatctggcaggaatg

SEQ ID NO: 72506 - DNA, 25 bp, E. coli
gaatcaaccaaaacctcaggatggt

SEQ ID NO: 72507 - DNA, 25 bp, E. coli
gaatcaaccaaatcctcaggatggt

SEQ ID NO: 72508 - DNA, 25 bp, E. coli
tcaaccaaatccacaggatggtgtt

SEQ ID NO: 72509 - DNA, 25 bp, E. coli
aatcgccgccagttccaggcaaact

SEQ ID NO: 72510 - DNA, 25 bp, E. coli
aatcgccgccagatccaggcaaact

SEQ ID NO: 72511 - DNA, 25 bp, E. coli
tacgcgttaaatcctgccaacgcac

SEQ ID NO: 72512 - DNA, 25 bp, E. coli
tacgcgttaaatgctgccaacgcac

SEQ ID NO: 72513 - DNA, 25 bp, E. coli
tttccttctgaatagacgtacgcgt

SEQ ID NO: 72514 - DNA, 25 bp, E. coli
tttccttctgaaaagacgtacgcgt

SEQ ID NO: 72515 - DNA, 25 bp, E. coli
cctgaaaccagagagatgagacggg

SEQ ID NO: 72516 - DNA, 25 bp, E. coli
cctgaaaccagacagatgagacggg

SEQ ID NO: 72517 - DNA, 25 bp, E. coli
cccgctttgtcgatttccttctgaa

SEQ ID NO: 72518 - DNA, 25 bp, E. coli
cccgctttgtcgttttccttctgaa

SEQ ID NO: 72519 - DNA, 25 bp, E. coli
cgccttgcgctgcattctggagtaa

SEQ ID NO: 72520 - DNA, 25 bp, E. coli
cgccttgcgctggattctggagtaa

SEQ ID NO: 72521 - DNA, 25 bp, E. coli
cttgcgctgcatactggagtaatgc

SEQ ID NO: 72522 - DNA, 25 bp, E. coli
cttgcgctgcattctggagtaatgc

SEQ ID NO: 72523 - DNA, 25 bp, E. coli
gatactcctcgcgttgcgctgcatt

SEQ ID NO: 72524 - DNA, 25 bp, E. coli
gtaaccctgaaagcagagagatgag

SEQ ID NO: 72525 - DNA, 25 bp, E. coli
gtaaccctgaaaccagagagatgag

SEQ ID NO: 72526 - DNA, 25 bp, E. coli
gatactcctcgccttgcgctgcatt

SEQ ID NO: 72527 - DNA, 25 bp, E. coli
tcacatcattgacaatcgccgccag

SEQ ID NO: 72528 - DNA, 25 bp, E. coli
tcacatcattgagaatcgccgccag

SEQ ID NO: 72529 - DNA, 25 bp, E. coli
gacgtacgcgttaaatcctgccaac

SEQ ID NO: 72530 - DNA, 25 bp, E. coli
gacgtacgcgtttaatcctgccaac

SEQ ID NO: 72531 - DNA, 25 bp, E. coli
caactgtcgccagatgtgattttct

SEQ ID NO: 72532 - DNA, 25 bp, E. coli
caactgtcgccacatgtgattttct

SEQ ID NO: 72533 - DNA, 25 bp, E. coli
attgcccaactgtcgccagatgtga

SEQ ID NO: 72534 - DNA, 25 bp, E. coli
attgcccaactgacgccagatgtga

SEQ ID NO: 72535 - DNA, 25 bp, E. coli
acgcattgcccaactgtcgccagat

SEQ ID NO: 72536 - DNA, 25 bp, E. coli
acgcattgcccatctgtcgccagat

SEQ ID NO: 72537 - DNA, 25 bp, E. coli
aactgtcgccagatgtgattttctc

SEQ ID NO: 72538 - DNA, 25 bp, E. coli
aactgtcgccagttgtgattttctc

SEQ ID NO: 72539 - DNA, 25 bp, E. coli
ttgcccaactgtggccagatgtgat

SEQ ID NO: 72540 - DNA, 25 bp, E. coli
ttgcccaactgtcgccagatgtgat

SEQ ID NO: 72541 - DNA, 25 bp, E. coli
ccaactgtcgccagatgtgattttc

SEQ ID NO: 72542 - DNA, 25 bp, E. coli
ccaactgtcgcctgatgtgattttc

SEQ ID NO: 72543 - DNA, 25 bp, E. coli
gcattgcccaactgtcgccagatgt

SEQ ID NO: 72544 - DNA, 25 bp, E. coli
gcattgcccaacagtcgccagatgt

SEQ ID NO: 72545 - DNA, 25 bp, E. coli
cccaactgtcgcgagatgtgatttt

SEQ ID NO: 72546 - DNA, 25 bp, E. coli
cccaactgtcgccagatgtgatttt

SEQ ID NO: 72547 - DNA, 25 bp, E. coli
ctgtcgccagatctgattttctctt

SEQ ID NO: 72548 - DNA, 25 bp, E. coli
cattgcccaactctcgccagatgtg

SEQ ID NO: 72549 - DNA, 25 bp, E. coli
ctgtcgccagatgtgattttctctt

SEQ ID NO: 72550 - DNA, 25 bp, E. coli
cattgcccaactgtcgccagatgtg

SEQ ID NO: 72551 - DNA, 25 bp, E. coli
gtcgccagatgtgattttctctttt

SEQ ID NO: 72552 - DNA, 25 bp, E. coli
gtcgccagatgtcattttctctttt

SEQ ID NO: 72553 - DNA, 25 bp, E. coli
caatctgtagagtttgattcagacc

SEQ ID NO: 72554 - DNA, 25 bp, E. coli
caatctgtagagattgattcagacc

SEQ ID NO: 72555 - DNA, 25 bp, E. coli
tatattttcccggttatccgtgccc

SEQ ID NO: 72556 - DNA, 25 bp, E. coli
tatattttcccgcttatccgtgccc

SEQ ID NO: 72557 - DNA, 25 bp, E. coli
ttttctgtaattggagcatgtcatg

SEQ ID NO: 72558 - DNA, 25 bp, E. coli
ttcggtacaacatgagagataaacg

SEQ ID NO: 72559 - DNA, 25 bp, E. coli
ttttctgtaattcgagcatgtcatg

SEQ ID NO: 72560 - DNA, 25 bp, E. coli
ttcggtacaacaagagagataaacg

SEQ ID NO: 72561 - DNA, 25 bp, E. coli
ttcagaccttctttattttcccgct

SEQ ID NO: 72562 - DNA, 25 bp, E. coli
ttcagaccttctatattttcccgct

SEQ ID NO: 72563 - DNA, 25 bp, E. coli
tccggcatgaaaggatgagcaatct

SEQ ID NO: 72564 - DNA, 25 bp, E. coli
tccggcatgaaacgatgagcaatct

SEQ ID NO: 72565 - DNA, 25 bp, E. coli
gcatgtcatgtttccccgcgagcat

SEQ ID NO: 72566 - DNA, 25 bp, E. coli
gcatgtcatgttaccccgcgagcat

SEQ ID NO: 72567 - DNA, 25 bp, E. coli
gacaccttactatcttacaaatgta

SEQ ID NO: 72568 - DNA, 25 bp, E. coli
gacaccttactaacttacaaatgta

SEQ ID NO: 72569 - DNA, 25 bp, E. coli
cccgcgagcataaaacgcgtgaatt

SEQ ID NO: 72570 - DNA, 25 bp, E. coli
cccgcgagcatataacgcgtgaatt

SEQ ID NO: 72571 - DNA, 25 bp, E. coli
cgtgaattcgcggattcggtacaac

SEQ ID NO: 72572 - DNA, 25 bp, E. coli
cgtgaattcgcgcattcggtacaac

SEQ ID NO: 72573 - DNA, 25 bp, E. coli
tcaccgccttgtgatctttctgaca

SEQ ID NO: 72574 - DNA, 25 bp, E. coli
tcaccgccttgtcatctttctgaca

SEQ ID NO: 72575 - DNA, 25 bp, E. coli
aagtcgtatggctatggatattgcc

SEQ ID NO: 72576 - DNA, 25 bp, E. coli
gaatggttaattgtgtgtactttgg

SEQ ID NO: 72577 - DNA, 25 bp, E. coli
aagtcgtatggcaatggatattgcc

SEQ ID NO: 72578 - DNA, 25 bp, E. coli
gaatggttaattctgtgtactttgg

SEQ ID NO: 72579 - DNA, 25 bp, E. coli
tgttgatggcggtagaagatgataa

SEQ ID NO: 72580 - DNA, 25 bp, E. coli
tgttgatggcggaagaagatgataa

SEQ ID NO: 72581 - DNA, 25 bp, E. coli
taaatgttagatttcccagaataat

SEQ ID NO: 72582 - DNA, 25 bp, E. coli
taaatgttagatatcccagaataat

SEQ ID NO: 72583 - DNA, 25 bp, E. coli
ccagaataattaaaaagaaataccg

SEQ ID NO: 72584 - DNA, 25 bp, E. coli
ccagaataattataaagaaataccg

SEQ ID NO: 72585 - DNA, 25 bp, E. coli
gaagaagatgattaagtatgtgaac

SEQ ID NO: 72586 - DNA, 25 bp, E. coli
gaagaagatgataaagtatgtgaac

SEQ ID NO: 72587 - DNA, 25 bp, E. coli
cattacaaggtaaagtcgtatggct

SEQ ID NO: 72588 - DNA, 25 bp, E. coli
cattacaaggtatagtcgtatggct

SEQ ID NO: 72589 - DNA, 25 bp, E. coli
ggatattgccatttgttattgaatg

SEQ ID NO: 72590 - DNA, 25 bp, E. coli
ggatattgccatatgttattgaatg

SEQ ID NO: 72591 - DNA, 25 bp, E. coli
tgtgtactttgggtgtaaacagtta

SEQ ID NO: 72592 - DNA, 25 bp, E. coli
tgtgtactttggctgtaaacagtta

SEQ ID NO: 72593 - DNA, 25 bp, E. coli
taagtatgcagacatgttgatggcg

SEQ ID NO: 72594 - DNA, 25 bp, E. coli
taaagaaatacccaacattacaagg

SEQ ID NO: 72595 - DNA, 25 bp, E. coli
taagtatgcagagatgttgatggcg

SEQ ID NO: 72596 - DNA, 25 bp, E. coli
taaagaaataccgaacattacaagg

SEQ ID NO: 72597 - DNA, 25 bp, E. coli
aatatatcgccggtgcgccgcaggg

SEQ ID NO: 72598 - DNA, 25 bp, E. coli
aatatatcgccgctgcgccgcaggg

SEQ ID NO: 72599 - DNA, 25 bp, E. coli
aagtgccagggcgtctgccaatgag

SEQ ID NO: 72600 - DNA, 25 bp, E. coli
aaggtcagttattcaagtgccaggg

SEQ ID NO: 72601 - DNA, 25 bp, E. coli
aagtgccagggcctctgccaatgag

SEQ ID NO: 72602 - DNA, 25 bp, E. coli
aaggtcagttatacaagtgccaggg

SEQ ID NO: 72603 - DNA, 25 bp, E. coli
cagttattcaagtgccagggcctct

SEQ ID NO: 72604 - DNA, 25 bp, E. coli
cagttattcaagagccagggcctct

SEQ ID NO: 72605 - DNA, 25 bp, E. coli
tcgctccgggagaggacgatgggaa

SEQ ID NO: 72606 - DNA, 25 bp, E. coli
tgattttcctcggtccgggagtgga

SEQ ID NO: 72607 - DNA, 25 bp, E. coli
tgattttcctcgctccgggagtgga

SEQ ID NO: 72608 - DNA, 25 bp, E. coli
tgtgaaagccatctatgcagcgacg

SEQ ID NO: 72609 - DNA, 25 bp, E. coli
tgaggatgattttcctcgctccggg

SEQ ID NO: 72610 - DNA, 25 bp, E. coli
tgtgaaagccatgtatgcagcgacg

SEQ ID NO: 72611 - DNA, 25 bp, E. coli
tcgctccgggagtggacgatgggaa

SEQ ID NO: 72612 - DNA, 25 bp, E. coli
tgaggatgatttacctcgctccggg

SEQ ID NO: 72613 - DNA, 25 bp, E. coli
gccagggcctctcccaatgagtcgt

SEQ ID NO: 72614 - DNA, 25 bp, E. coli
gccagggcctctgccaatgagtcgt

SEQ ID NO: 72615 - DNA, 25 bp, E. coli
gcttcagtcggccattgtgaaagcc

SEQ ID NO: 72616 - DNA, 25 bp, E. coli
gcttcagtcggcgattgtgaaagcc

SEQ ID NO: 72617 - DNA, 25 bp, E. coli
cggccattgtgaaagccatgtatgc

SEQ ID NO: 72618 - DNA, 25 bp, E. coli
cggccattgtgatagccatgtatgc

SEQ ID NO: 72619 - DNA, 25 bp, E. coli
catgagggagtcaaaggccgttcgt

SEQ ID NO: 72620 - DNA, 25 bp, E. coli
catgagggagtctaaggccgttcgt

SEQ ID NO: 72621 - DNA, 25 bp, E. coli
aacattattaatccagcccgggcag

SEQ ID NO: 72622 - DNA, 25 bp, E. coli
aacattattaatgcagcccgggcag

SEQ ID NO: 72623 - DNA, 25 bp, E. coli
tacctgaggcgttgcgatttgcggc

SEQ ID NO: 72624 - DNA, 25 bp, E. coli
tacctgaggcgtagcgatttgcggc

SEQ ID NO: 72625 - DNA, 25 bp, E. coli
tctgtgctggcatgactcaaagcga

SEQ ID NO: 72626 - DNA, 25 bp, E. coli
tctgtgctggcaagactcaaagcga

SEQ ID NO: 72627 - DNA, 25 bp, E. coli
gcttgctgcatggagagctaccgca

SEQ ID NO: 72628 - DNA, 25 bp, E. coli
gcttgctgcatgcagagctaccgca

SEQ ID NO: 72629 - DNA, 25 bp, E. coli
gaagtccctcatgaaccgcgtaagt

SEQ ID NO: 72630 - DNA, 25 bp, E. coli
gaagtccctcatcaaccgcgtaagt

SEQ ID NO: 72631 - DNA, 25 bp, E. coli
gaacggaataatctatcgcctcgct

SEQ ID NO: 72632 - DNA, 25 bp, E. coli
gaacggaataatgtatcgcctcgct

SEQ ID NO: 72633 - DNA, 25 bp, E. coli
cccaaaaggtgttcagtggattgct

SEQ ID NO: 72634 - DNA, 25 bp, E. coli
cccaaaaggtgtacagtggattgct

SEQ ID NO: 72635 - DNA, 25 bp, E. coli
ggcaatggtcatgcttttacgcagg

SEQ ID NO: 72636 - DNA, 25 bp, E. coli
ggcaatggtcatccttttacgcagg

SEQ ID NO: 72637 - DNA, 25 bp, E. coli
tcaactggcaatagcagcgccgaag

SEQ ID NO: 72638 - DNA, 25 bp, E. coli
tcaactggcaattgcagcgccgaag

SEQ ID NO: 72639 - DNA, 25 bp, E. coli
gagctagagcttgatggaaccggaa

SEQ ID NO: 72640 - DNA, 25 bp, E. coli
gagctagagcttcatggaaccggaa

SEQ ID NO: 72641 - DNA, 25 bp, E. coli
tactccacggatcacggctttatgg

SEQ ID NO: 72642 - DNA, 25 bp, E. coli
taaaaaacgcccagctggtggcctc

SEQ ID NO: 72643 - DNA, 25 bp, E. coli
taaaaaacgccctgctggtggcctc

SEQ ID NO: 72644 - DNA, 25 bp, E. coli
tactccacggatgacggctttatgg

SEQ ID NO: 72645 - DNA, 25 bp, E. coli
agtggcttgattctcatccggtcga

SEQ ID NO: 72646 - DNA, 25 bp, E. coli
agtggcttgattgtcatccggtcga

SEQ ID NO: 72647 - DNA, 25 bp, E. coli
aactggcgctatagcatcactgacg

SEQ ID NO: 72648 - DNA, 25 bp, E. coli
aactggcgctattgcatcactgacg

SEQ ID NO: 72649 - DNA, 25 bp, E. coli
tttaccattgaagacatcgcccgaa

SEQ ID NO: 72650 - DNA, 25 bp, E. coli
tttaccattgaacacatcgcccgaa

SEQ ID NO: 72651 - DNA, 25 bp, E. coli
tcagccaggcatggaaacaggaagt

SEQ ID NO: 72652 - DNA, 25 bp, E. coli
tcagccaggcatcgaaacaggaagt

SEQ ID NO: 72653 - DNA, 25 bp, E. coli
gtggcagacgccctatcagtttaag

SEQ ID NO: 72654 - DNA, 25 bp, E. coli
ggttatcacgtctggcgaatggctg

SEQ ID NO: 72655 - DNA, 25 bp, E. coli
ggttatcacgtcaggcgaatggctg

SEQ ID NO: 72656 - DNA, 25 bp, E. coli
gtggcagacgccgtatcagtttaag

SEQ ID NO: 72657 - DNA, 25 bp, E. coli
taagcgaatgatggtccgccactgc

SEQ ID NO: 72658 - DNA, 25 bp, E. coli
taagcgaatgatcgtccgccactgc

SEQ ID NO: 72659 - DNA, 25 bp, E. coli
tcaaatccggcgatatgtgcccgaa

SEQ ID NO: 72660 - DNA, 25 bp, E. coli
taatcaggatgcagaatggctggcc

SEQ ID NO: 72661 - DNA, 25 bp, E. coli
tcaaatccggcgttatgtgcccgaa

SEQ ID NO: 72662 - DNA, 25 bp, E. coli
taatcaggatgctgaatggctggcc

SEQ ID NO: 72663 - DNA, 25 bp, E. coli
cagcagttagcgaaaacagcgggca

SEQ ID NO: 72664 - DNA, 25 bp, E. coli
cagcagttagcgtaaacagcgggca

SEQ ID NO: 72665 - DNA, 25 bp, E. coli
aaaattgtcactgccaatccggcgg

SEQ ID NO: 72666 - DNA, 25 bp, E. coli
aaaattgtcactcccaatccggcgg

SEQ ID NO: 72667 - DNA, 25 bp, E. coli
aaaatcgttcgggtgaagtcgcgct

SEQ ID NO: 72668 - DNA, 25 bp, E. coli
aaaatcgttcggctgaagtcgcgct

SEQ ID NO: 72669 - DNA, 25 bp, E. coli
tgaaagatcttcgtgcgtcacagcg

SEQ ID NO: 72670 - DNA, 25 bp, E. coli
tgaaagatcttcctgcgtcacagcg

SEQ ID NO: 72671 - DNA, 25 bp, E. coli
tctttggcctgacgttaagcgatgc

SEQ ID NO: 72672 - DNA, 25 bp, E. coli
tctatcacagtaagggcaatccgct

SEQ ID NO: 72673 - DNA, 25 bp, E. coli
tctatcacagtatgggcaatccgct

SEQ ID NO: 72674 - DNA, 25 bp, E. coli
tctttggcctgaggttaagcgatgc

SEQ ID NO: 72675 - DNA, 25 bp, E. coli
gaatatggtagtccctcaacaggcg

SEQ ID NO: 72676 - DNA, 25 bp, E. coli
gaatatggtagtgcctcaacaggcg

SEQ ID NO: 72677 - DNA, 25 bp, E. coli
cgtttgaggcgatttcactgcgggc

SEQ ID NO: 72678 - DNA, 25 bp, E. coli
cgtttgaggcgaattcactgcgggc

SEQ ID NO: 72679 - DNA, 25 bp, E. coli
cgtggccggcgcaaaataccattat

SEQ ID NO: 72680 - DNA, 25 bp, E. coli
cattctgagttctccgcagtgggca

SEQ ID NO: 72681 - DNA, 25 bp, E. coli
cgtggccggcgctaaataccattat

SEQ ID NO: 72682 - DNA, 25 bp, E. coli
cattctgagttcaccgcagtgggca

SEQ ID NO: 72683 - DNA, 25 bp, E. coli
tcaacaggcgttgctgaaacaggct

SEQ ID NO: 72684 - DNA, 25 bp, E. coli
tcaacaggcgttcctgaaacaggct

SEQ ID NO: 72685 - DNA, 25 bp, E. coli
aaccgtgagctaatacgcctttgag

SEQ ID NO: 72686 - DNA, 25 bp, E. coli
aaccgtgagctattacgcctttgag

SEQ ID NO: 72687 - DNA, 25 bp, E. coli
atatcgggcacggagcgatcctgca

SEQ ID NO: 72688 - DNA, 25 bp, E. coli
atatcgggcacgcagcgatcctgca

SEQ ID NO: 72689 - DNA, 25 bp, E. coli
actacgggcggttgatcgtgcaagc

SEQ ID NO: 72690 - DNA, 25 bp, E. coli
actacgggcggtagatcgtgcaagc

SEQ ID NO: 72691 - DNA, 25 bp, E. coli
tatcaggatcttgtcgggcgctgtc

SEQ ID NO: 72692 - DNA, 25 bp, E. coli
tatcaggatcttctcgggcgctgtc

SEQ ID NO: 72693 - DNA, 25 bp, E. coli
tgacgacgagttacactggaaacgg

SEQ ID NO: 72694 - DNA, 25 bp, E. coli
tgacgacgagtttcactggaaacgg

SEQ ID NO: 72695 - DNA, 25 bp, E. coli
tgaacagcgtgaatatggatggcgc

SEQ ID NO: 72696 - DNA, 25 bp, E. coli
tgaacagcgtgattatggatggcgc

SEQ ID NO: 72697 - DNA, 25 bp, E. coli
tcgcctcactgcgtggtgactacgg

SEQ ID NO: 72698 - DNA, 25 bp, E. coli
tcgtgcaagcggcagccaatattca

SEQ ID NO: 72699 - DNA, 25 bp, E. coli
tcgcctcactgcctggtgactacgg

SEQ ID NO: 72700 - DNA, 25 bp, E. coli
tcgtgcaagcgggagccaatattca

SEQ ID NO: 72701 - DNA, 25 bp, E. coli
ccagttgttgatcggtacgccagcc

SEQ ID NO: 72702 - DNA, 25 bp, E. coli
ccagttgttgatgggtacgccagcc

SEQ ID NO: 72703 - DNA, 25 bp, E. coli
gaaaggacgttatcaaccgtgagct

SEQ ID NO: 72704 - DNA, 25 bp, E. coli
gaaaggacgttaacaaccgtgagct

SEQ ID NO: 72705 - DNA, 25 bp, E. coli
gaggcaaatggacgaaaatcgcccc

SEQ ID NO: 72706 - DNA, 25 bp, E. coli
gaggcaaatggaggaaaatcgcccc

SEQ ID NO: 72707 - DNA, 25 bp, E. coli
atatccgttcgcgtcttggcaacat

SEQ ID NO: 72708 - DNA, 25 bp, E. coli
atatccgttcgcctcttggcaacat

SEQ ID NO: 72709 - DNA, 25 bp, E. coli
tatccgttcgcgacttggcaacatt

SEQ ID NO: 72710 - DNA, 25 bp, E. coli
tatccgttcgcgtcttggcaacatt

SEQ ID NO: 72711 - DNA, 25 bp, E. coli
tccgttcgcgtcttggcaacattat

SEQ ID NO: 72712 - DNA, 25 bp, E. coli
tccgttcgcgtcatggcaacattat

SEQ ID NO: 72713 - DNA, 25 bp, E. coli
gcggatatccgtacgcgtcttggca

SEQ ID NO: 72714 - DNA, 25 bp, E. coli
gctggcggatatccgttcgcgtctt

SEQ ID NO: 72715 - DNA, 25 bp, E. coli
gcggatatccgttcgcgtcttggca

SEQ ID NO: 72716 - DNA, 25 bp, E. coli
gctggcggatatgcgttcgcgtctt

SEQ ID NO: 72717 - DNA, 25 bp, E. coli
gaactggcggaaccgtggcagccgt

SEQ ID NO: 72718 - DNA, 25 bp, E. coli
gaactggcggaagcgtggcagccgt

SEQ ID NO: 72719 - DNA, 25 bp, E. coli
cgttcgcgtcttggcaacattatgc

SEQ ID NO: 72720 - DNA, 25 bp, E. coli
cgttcgcgtcttcgcaacattatgc

SEQ ID NO: 72721 - DNA, 25 bp, E. coli
cggatatccgttggcgtcttggcaa

SEQ ID NO: 72722 - DNA, 25 bp, E. coli
cggatatccgttcgcgtcttggcaa

SEQ ID NO: 72723 - DNA, 25 bp, E. coli
tggcggatatccgttcgcgtcttgg

SEQ ID NO: 72724 - DNA, 25 bp, E. coli
tggcggatatcccttcgcgtcttgg

SEQ ID NO: 72725 - DNA, 25 bp, E. coli
tggctggcggatttccgttcgcgtc

SEQ ID NO: 72726 - DNA, 25 bp, E. coli
ggaaccgtggcagccgtggctggcg

SEQ ID NO: 72727 - DNA, 25 bp, E. coli
ggaaccgtggcacccgtggctggcg

SEQ ID NO: 72728 - DNA, 25 bp, E. coli
tggctggcggatatccgttcgcgtc

SEQ ID NO: 72729 - DNA, 25 bp, E. coli
tatcagtatgtagatattcgtgcgg

SEQ ID NO: 72730 - DNA, 25 bp, E. coli
tatcagtatgtacatattcgtgcgg

SEQ ID NO: 72731 - DNA, 25 bp, E. coli
tgtcgatcagcaacatatcggcggc

SEQ ID NO: 72732 - DNA, 25 bp, E. coli
tgtcgatcagcatcatatcggcggc

SEQ ID NO: 72733 - DNA, 25 bp, E. coli
gccgcagattttagtcgatcagcaa

SEQ ID NO: 72734 - DNA, 25 bp, E. coli
gccgcagatttttgtcgatcagcaa

SEQ ID NO: 72735 - DNA, 25 bp, E. coli
gcggctataccgattttgctgcatg

SEQ ID NO: 72736 - DNA, 25 bp, E. coli
gcggctataccgtttttgctgcatg

SEQ ID NO: 72737 - DNA, 25 bp, E. coli
gaagatctacaacaaaaggcaggta

SEQ ID NO: 72738 - DNA, 25 bp, E. coli
gaagatctacaagaaaaggcaggta

SEQ ID NO: 72739 - DNA, 25 bp, E. coli
cccgtagaaaccctgccgcagattt

SEQ ID NO: 72740 - DNA, 25 bp, E. coli
ccgattttgctgcatgggtgaaaga

SEQ ID NO: 72741 - DNA, 25 bp, E. coli
ccgattttgctggatgggtgaaaga

SEQ ID NO: 72742 - DNA, 25 bp, E. coli
cccgtagaaaccgtgccgcagattt

SEQ ID NO: 72743 - DNA, 25 bp, E. coli
cgtgcggaagggatcactaaagaag

SEQ ID NO: 72744 - DNA, 25 bp, E. coli
cgggttgcccttactgtgtgcgtgc

SEQ ID NO: 72745 - DNA, 25 bp, E. coli
cgggttgccctttctgtgtgcgtgc

SEQ ID NO: 72746 - DNA, 25 bp, E. coli
cgtgcggaagggttcactaaagaag

SEQ ID NO: 72747 - DNA, 25 bp, E. coli
gatattcgtgcgcaagggatcacta

SEQ ID NO: 72748 - DNA, 25 bp, E. coli
gatattcgtgcggaagggatcacta

SEQ ID NO: 72749 - DNA, 25 bp, E. coli
tcagcaacatatgggcggctatacc

SEQ ID NO: 72750 - DNA, 25 bp, E. coli
tcagcaacatatcggcggctatacc

SEQ ID NO: 72751 - DNA, 25 bp, E. coli
cagtggccagatctttatgaaatat

SEQ ID NO: 72752 - DNA, 25 bp, E. coli
cagtggccagatgtttatgaaatat

SEQ ID NO: 72753 - DNA, 25 bp, E. coli
accagcgttacggaaatggtcaacg

SEQ ID NO: 72754 - DNA, 25 bp, E. coli
accagcgttacgcaaatggtcaacg

SEQ ID NO: 72755 - DNA, 25 bp, E. coli
tattagagtcgctttaaaaatgagc

SEQ ID NO: 72756 - DNA, 25 bp, E. coli
tattagagtcgcattaaaaatgagc

SEQ ID NO: 72757 - DNA, 25 bp, E. coli
ttaaccactatgcattaatgctgcg

SEQ ID NO: 72758 - DNA, 25 bp, E. coli
ttaaccactatggattaatgctgcg

SEQ ID NO: 72759 - DNA, 25 bp, E. coli
tcatgatgcctaagaaaaaccagcg

SEQ ID NO: 72760 - DNA, 25 bp, E. coli
tcatgatgcctatgaaaaaccagcg

SEQ ID NO: 72761 - DNA, 25 bp, E. coli
gaaaccctccatgcttaatataagg

SEQ ID NO: 72762 - DNA, 25 bp, E. coli
gaaaccctccatccttaatataagg

SEQ ID NO: 72763 - DNA, 25 bp, E. coli
cgctggttttatccggtacgttgca

SEQ ID NO: 72764 - DNA, 25 bp, E. coli
cgctggttttatgcggtacgttgca

SEQ ID NO: 72765 - DNA, 25 bp, E. coli
gattgaaaactcactcagtggccag

SEQ ID NO: 72766 - DNA, 25 bp, E. coli
gattgaaaactctctcagtggccag

SEQ ID NO: 72767 - DNA, 25 bp, E. coli
tggatggaaaggtgattgaaaactc

SEQ ID NO: 72768 - DNA, 25 bp, E. coli
tggatggaaaggagattgaaaactc

SEQ ID NO: 72769 - DNA, 25 bp, E. coli
taatgctgcgttttttcatgatgcc

SEQ ID NO: 72770 - DNA, 25 bp, E. coli
taatgctgcgttatttcatgatgcc

SEQ ID NO: 72771 - DNA, 25 bp, E. coli
taatgagcccgtgaactgaaaccct

SEQ ID NO: 72772 - DNA, 25 bp, E. coli
taatgagcccgtcaactgaaaccct

SEQ ID NO: 72773 - DNA, 25 bp, E. coli
catttggaaatgcaagactctctgc

SEQ ID NO: 72774 - DNA, 25 bp, E. coli
catttggaaatggaagactctctgc

SEQ ID NO: 72775 - DNA, 25 bp, E. coli
taccgggtcggtgagtattctcgcc

SEQ ID NO: 72776 - DNA, 25 bp, E. coli
taccgggtcggtcagtattctcgcc

SEQ ID NO: 72777 - DNA, 25 bp, E. coli
ttgatatcgtgacttcctggccggg

SEQ ID NO: 72778 - DNA, 25 bp, E. coli
ttgatatcgtgagttcctggccggg

SEQ ID NO: 72779 - DNA, 25 bp, E. coli
tgttagcggcgcacacgatcttcgc

SEQ ID NO: 72780 - DNA, 25 bp, E. coli
tgatgaacggcgcaattctgctggc

SEQ ID NO: 72781 - DNA, 25 bp, E. coli
tgttagcggcgctcacgatcttcgc

SEQ ID NO: 72782 - DNA, 25 bp, E. coli
tgatgaacggcggaattctgctggc

SEQ ID NO: 72783 - DNA, 25 bp, E. coli
tcaggcacatatcgtggcggatcag

SEQ ID NO: 72784 - DNA, 25 bp, E. coli
tcaggcacatatggtggcggatcag

SEQ ID NO: 72785 - DNA, 25 bp, E. coli
gaatcaatcttaaggacggctggtc

SEQ ID NO: 72786 - DNA, 25 bp, E. coli
gaatcaatcttatggacggctggtc

SEQ ID NO: 72787 - DNA, 25 bp, E. coli
cggcgctggcgcaaagtatgtttat

SEQ ID NO: 72788 - DNA, 25 bp, E. coli
cggcgctggcgctaagtatgtttat

SEQ ID NO: 72789 - DNA, 25 bp, E. coli
cggtgcgggctgttatgctacatta

SEQ ID NO: 72790 - DNA, 25 bp, E. coli
cggtgcgggctgatatgctacatta

SEQ ID NO: 72791 - DNA, 25 bp, E. coli
ggccgacccgctttattcagattca

SEQ ID NO: 72792 - DNA, 25 bp, E. coli
tggtcacggtaatgctgagtccctc

SEQ ID NO: 72793 - DNA, 25 bp, E. coli
tggtcacggtaaagctgagtccctc

SEQ ID NO: 72794 - DNA, 25 bp, E. coli
ggccgacccgctatattcagattca

SEQ ID NO: 72795 - DNA, 25 bp, E. coli
tactatgcgatcagttatgtggcga

SEQ ID NO: 72796 - DNA, 25 bp, E. coli
tactatgcgatctgttatgtggcga

SEQ ID NO: 72797 - DNA, 25 bp, E. coli
agaacttcaacccttcacctggcaa

SEQ ID NO: 72798 - DNA, 25 bp, E. coli
agaacttcaaccgttcacctggcaa

SEQ ID NO: 72799 - DNA, 25 bp, E. coli
aaataagtatgagccagtaagtgcc

SEQ ID NO: 72800 - DNA, 25 bp, E. coli
aaataagtatgacccagtaagtgcc

SEQ ID NO: 72801 - DNA, 25 bp, E. coli
tatgatgccatatccaccgaatggg

SEQ ID NO: 72802 - DNA, 25 bp, E. coli
tatgatgtttattgttaccgtcgcc

SEQ ID NO: 72803 - DNA, 25 bp, E. coli
tatgatgtttatagttaccgtcgcc

SEQ ID NO: 72804 - DNA, 25 bp, E. coli
tatgatgccataaccaccgaatggg

SEQ ID NO: 72805 - DNA, 25 bp, E. coli
tatttaattactctctgcttgccgc

SEQ ID NO: 72806 - DNA, 25 bp, E. coli
tatttaattactgtctgcttgccgc

SEQ ID NO: 72807 - DNA, 25 bp, E. coli
cctttgcttgcccactggtttagtg

SEQ ID NO: 72808 - DNA, 25 bp, E. coli
cctttgcttgccgactggtttagtg

SEQ ID NO: 72809 - DNA, 25 bp, E. coli
gcagatgatgcctgctatcgcgctt

SEQ ID NO: 72810 - DNA, 25 bp, E. coli
gcagatgatgccagctatcgcgctt

SEQ ID NO: 72811 - DNA, 25 bp, E. coli
gcgggataagcgtctgggaaaaaat

SEQ ID NO: 72812 - DNA, 25 bp, E. coli
gcgggataagcgactgggaaaaaat

SEQ ID NO: 72813 - DNA, 25 bp, E. coli
gtcgccttactggtcgcgcgggata

SEQ ID NO: 72814 - DNA, 25 bp, E. coli
gggctggtttcactggctatcaatt

SEQ ID NO: 72815 - DNA, 25 bp, E. coli
gggctggtttcagtggctatcaatt

SEQ ID NO: 72816 - DNA, 25 bp, E. coli
gtcgccttactgctcgcgcgggata

SEQ ID NO: 72817 - DNA, 25 bp, E. coli
aagatgtggtggtcacgctttctca

SEQ ID NO: 72818 - DNA, 25 bp, E. coli
aagatgtggtggacacgctttctca

SEQ ID NO: 72819 - DNA, 25 bp, E. coli
cagggcgtaatccttatccgtactt

SEQ ID NO: 72820 - DNA, 25 bp, E. coli
cagggcgtaatcgttatccgtactt

SEQ ID NO: 72821 - DNA, 25 bp, E. coli
ttctcaccagggttacgtgaagtat

SEQ ID NO: 72822 - DNA, 25 bp, E. coli
ttgctgcgatgcaggaacgtgcggg

SEQ ID NO: 72823 - DNA, 25 bp, E. coli
ttgctgcgatgctggaacgtgcggg

SEQ ID NO: 72824 - DNA, 25 bp, E. coli
ttctcaccagggatacgtgaagtat

SEQ ID NO: 72825 - DNA, 25 bp, E. coli
ccaggaagatgtcgtggtcacgctt

SEQ ID NO: 72826 - DNA, 25 bp, E. coli
gtcacgctttctcaccagggttacg

SEQ ID NO: 72827 - DNA, 25 bp, E. coli
gtcacgctttctgaccagggttacg

SEQ ID NO: 72828 - DNA, 25 bp, E. coli
ccaggaagatgtggtggtcacgctt

SEQ ID NO: 72829 - DNA, 25 bp, E. coli
gaaggtctaccacttgccggaagcc

SEQ ID NO: 72830 - DNA, 25 bp, E. coli
gaaggtctaccagttgccggaagcc

SEQ ID NO: 72831 - DNA, 25 bp, E. coli
cgaaatcaccgctaacagcgccgac

SEQ ID NO: 72832 - DNA, 25 bp, E. coli
cgaaatcaccgcaaacagcgccgac

SEQ ID NO: 72833 - DNA, 25 bp, E. coli
ggtggtcacgctatctcaccagggt

SEQ ID NO: 72834 - DNA, 25 bp, E. coli
ggtggtcacgctttctcaccagggt

SEQ ID NO: 72835 - DNA, 25 bp, E. coli
taatccttatccctacttcggaaga

SEQ ID NO: 72836 - DNA, 25 bp, E. coli
taatccttatccgtacttcggaaga

SEQ ID NO: 72837 - DNA, 25 bp, E. coli
gatgaaggtctagcagttgccggaa

SEQ ID NO: 72838 - DNA, 25 bp, E. coli
gatgaaggtctaccagttgccggaa

SEQ ID NO: 72839 - DNA, 25 bp, E. coli
aatggctgattcagaacatggcggg

SEQ ID NO: 72840 - DNA, 25 bp, E. coli
aatggctgattctgaacatggcggg

SEQ ID NO: 72841 - DNA, 25 bp, E. coli
attctgaacatgccgggactggagc

SEQ ID NO: 72842 - DNA, 25 bp, E. coli
attctgaacatggcgggactggagc

SEQ ID NO: 72843 - DNA, 25 bp, E. coli
tgattctgaacaaggcgggactgga

SEQ ID NO: 72844 - DNA, 25 bp, E. coli
tgattctgaacatggcgggactgga

SEQ ID NO: 72845 - DNA, 25 bp, E. coli
tccgggtgccggtccatctgatagt

SEQ ID NO: 72846 - DNA, 25 bp, E. coli
tccgggtgccggaccatctgatagt

SEQ ID NO: 72847 - DNA, 25 bp, E. coli
gccggaccatctcatagtcggtggc

SEQ ID NO: 72848 - DNA, 25 bp, E. coli
gccggaccatctgatagtcggtggc

SEQ ID NO: 72849 - DNA, 25 bp, E. coli
gcacgggaatgggtgattctgaaca

SEQ ID NO: 72850 - DNA, 25 bp, E. coli
gcacgggaatggctgattctgaaca

SEQ ID NO: 72851 - DNA, 25 bp, E. coli
ctgattctgaacatggcgggactgg

SEQ ID NO: 72852 - DNA, 25 bp, E. coli
ctgattctgaacttggcgggactgg

SEQ ID NO: 72853 - DNA, 25 bp, E. coli
gggaatggctgattctgaacatggc

SEQ ID NO: 72854 - DNA, 25 bp, E. coli
ggtgccggaccatctgatagtcggt

SEQ ID NO: 72855 - DNA, 25 bp, E. coli
ggtgccggaccaactgatagtcggt

SEQ ID NO: 72856 - DNA, 25 bp, E. coli
gggaatggctgaatctgaacatggc

SEQ ID NO: 72857 - DNA, 25 bp, E. coli
tggatatccgggagccggaccatct

SEQ ID NO: 72858 - DNA, 25 bp, E. coli
tggatatccgggtgccggaccatct

SEQ ID NO: 72859 - DNA, 25 bp, E. coli
tggctgattctgtacatggcgggac

SEQ ID NO: 72860 - DNA, 25 bp, E. coli
tggctgattctgaacatggcgggac

SEQ ID NO: 72861 - DNA, 25 bp, E. coli
aattccgtgaccctgatgaccgtgg

SEQ ID NO: 72862 - DNA, 25 bp, E. coli
aattccgtgaccgtgatgaccgtgg

SEQ ID NO: 72863 - DNA, 25 bp, E. coli
cactggaacgccagaaagatggtcg

SEQ ID NO: 72864 - DNA, 25 bp, E. coli
cactggaacgcctgaaagatggtcg

SEQ ID NO: 72865 - DNA, 25 bp, E. coli
taacttcagcggagaacgccgtgaa

SEQ ID NO: 72866 - DNA, 25 bp, E. coli
tatgccgggtgaagtgctgcaacac

SEQ ID NO: 72867 - DNA, 25 bp, E. coli
tatgccgggtgatgtgctgcaacac

SEQ ID NO: 72868 - DNA, 25 bp, E. coli
ttatgacgtgcatttacgcgccctg

SEQ ID NO: 72869 - DNA, 25 bp, E. coli
ttatgacgtgcaattacgcgccctg

SEQ ID NO: 72870 - DNA, 25 bp, E. coli
tgaacggtgacatgaaccaggcgct

SEQ ID NO: 72871 - DNA, 25 bp, E. coli
tgaacggtgacaagaaccaggcgct

SEQ ID NO: 72872 - DNA, 25 bp, E. coli
gaagcactggtacgtttcctggaag

SEQ ID NO: 72873 - DNA, 25 bp, E. coli
gaagcactggtaggtttcctggaag

SEQ ID NO: 72874 - DNA, 25 bp, E. coli
gaagtgcgcattcagtccagcgtga

SEQ ID NO: 72875 - DNA, 25 bp, E. coli
gaagtgcgcattgagtccagcgtga

SEQ ID NO: 72876 - DNA, 25 bp, E. coli
gacatcctgattccgaccgacgttg

SEQ ID NO: 72877 - DNA, 25 bp, E. coli
gaaaccacttttgcagatctgggcc

SEQ ID NO: 72878 - DNA, 25 bp, E. coli
gaaaccacttttccagatctgggcc

SEQ ID NO: 72879 - DNA, 25 bp, E. coli
gacatcctgattgcgaccgacgttg

SEQ ID NO: 72880 - DNA, 25 bp, E. coli
gatttctctaaacacatgcgcggcg

SEQ ID NO: 72881 - DNA, 25 bp, E. coli
gatttctctaaagacatgcgcggcg

SEQ ID NO: 72882 - DNA, 25 bp, E. coli
taacttcagcggtgaacgccgtgaa

SEQ ID NO: 72883 - DNA, 25 bp, E. coli
tagttcaggctcgaggtgctcaagg

SEQ ID NO: 72884 - DNA, 25 bp, E. coli
tagttcaggctccaggtgctcaagg

SEQ ID NO: 72885 - DNA, 25 bp, E. coli
tatgccagctatgagtcaccatggg

SEQ ID NO: 72886 - DNA, 25 bp, E. coli
tatgccagctatcagtcaccatggg

SEQ ID NO: 72887 - DNA, 25 bp, E. coli
tttagcgactcccatacactggcgg

SEQ ID NO: 72888 - DNA, 25 bp, E. coli
tttagcgactccgatacactggcgg

SEQ ID NO: 72889 - DNA, 25 bp, E. coli
tgaaaccgtgcatgggcaatcagcc

SEQ ID NO: 72890 - DNA, 25 bp, E. coli
tgaaaccgtgcaagggcaatcagcc

SEQ ID NO: 72891 - DNA, 25 bp, E. coli
tcatgaaaaccgaatcgcgctggat

SEQ ID NO: 72892 - DNA, 25 bp, E. coli
tcatgaaaaccgtatcgcgctggat

SEQ ID NO: 72893 - DNA, 25 bp, E. coli
gaaaaagccgttctgcttgccaggg

SEQ ID NO: 72894 - DNA, 25 bp, E. coli
gaaaaagccgttgtgcttgccaggg

SEQ ID NO: 72895 - DNA, 25 bp, E. coli
cattcgtttatacagtgacagccgc

SEQ ID NO: 72896 - DNA, 25 bp, E. coli
cattcgtttatagagtgacagccgc

SEQ ID NO: 72897 - DNA, 25 bp, E. coli
gatatagacgttgctcaagcctggg

SEQ ID NO: 72898 - DNA, 25 bp, E. coli
gatatcatagtgtaacccctggtcg

SEQ ID NO: 72899 - DNA, 25 bp, E. coli
gttgttcaaatgttacgccctggcg

SEQ ID NO: 72900 - DNA, 25 bp, E. coli
gatatcatagtgaaacccctggtcg

SEQ ID NO: 72901 - DNA, 25 bp, E. coli
gatatagacgttcctcaagcctggg

SEQ ID NO: 72902 - DNA, 25 bp, E. coli
gttgttcaaatgatacgccctggcg

SEQ ID NO: 72903 - DNA, 25 bp, E. coli
tcaagtttctctcagcaccgacggt

SEQ ID NO: 72904 - DNA, 25 bp, E. coli
tcaagtttctctgagcaccgacggt

SEQ ID NO: 72905 - DNA, 25 bp, E. coli
cagtcgggaactgtttacctgtata

SEQ ID NO: 72906 - DNA, 25 bp, E. coli
cagtcgggaactctttacctgtata

SEQ ID NO: 72907 - DNA, 25 bp, E. coli
aatgaattgcaatcgttaacgggct

SEQ ID NO: 72908 - DNA, 25 bp, E. coli
aatgaattgcaaacgttaacgggct

SEQ ID NO: 72909 - DNA, 25 bp, E. coli
taccaccacgtgtggctgaacctga

SEQ ID NO: 72910 - DNA, 25 bp, E. coli
taccaatcgtagtggaaaaccgatc

SEQ ID NO: 72911 - DNA, 25 bp, E. coli
taccaatcgtagaggaaaaccgatc

SEQ ID NO: 72912 - DNA, 25 bp, E. coli
tatgcaagccaccagcgcaactggt

SEQ ID NO: 72913 - DNA, 25 bp, E. coli
taccaccacgtgaggctgaacctga

SEQ ID NO: 72914 - DNA, 25 bp, E. coli
tatgcaagccacgagcgcaactggt

SEQ ID NO: 72915 - DNA, 25 bp, E. coli
tataaaaactttaccaccacgtgag

SEQ ID NO: 72916 - DNA, 25 bp, E. coli
tataaaaacttttccaccacgtgag

SEQ ID NO: 72917 - DNA, 25 bp, E. coli
ttaacgggctgcaaatatgcaagcc

SEQ ID NO: 72918 - DNA, 25 bp, E. coli
ttaacgggctgctaatatgcaagcc

SEQ ID NO: 72919 - DNA, 25 bp, E. coli
tgagcagcatatatttaaccgaaaa

SEQ ID NO: 72920 - DNA, 25 bp, E. coli
tgaacctgatttgggtgcgatctaa

SEQ ID NO: 72921 - DNA, 25 bp, E. coli
tgaacctgatttcggtgcgatctaa

SEQ ID NO: 72922 - DNA, 25 bp, E. coli
tgagcagcatatttttaaccgaaaa

SEQ ID NO: 72923 - DNA, 25 bp, E. coli
gaaaaccgatcgacagtcgggaact

SEQ ID NO: 72924 - DNA, 25 bp, E. coli
gaaaaccgatcgtcagtcgggaact

SEQ ID NO: 72925 - DNA, 25 bp, E. coli
gggcttccgttcaataccaatcgta

SEQ ID NO: 72926 - DNA, 25 bp, E. coli
gggcttccgttctataccaatcgta

SEQ ID NO: 72927 - DNA, 25 bp, E. coli
tactctgctgggtgagctggcgaaa

SEQ ID NO: 72928 - DNA, 25 bp, E. coli
tacgtttaatcgagcggctcctgct

SEQ ID NO: 72929 - DNA, 25 bp, E. coli
tacgtttaatcgtgcggctcctgct

SEQ ID NO: 72930 - DNA, 25 bp, E. coli
tactctgctgggagagctggcgaaa

SEQ ID NO: 72931 - DNA, 25 bp, E. coli
tatggcgcataaaaaacgctttgcc

SEQ ID NO: 72932 - DNA, 25 bp, E. coli
tatggcgcataataaacgctttgcc

SEQ ID NO: 72933 - DNA, 25 bp, E. coli
tgcaacatgccggtgatccactgct

SEQ ID NO: 72934 - DNA, 25 bp, E. coli
tgcaacatgccgctgatccactgct

SEQ ID NO: 72935 - DNA, 25 bp, E. coli
tgaaagatgacaacccggactggga

SEQ ID NO: 72936 - DNA, 25 bp, E. coli
tgaaagatgacatcccggactggga

SEQ ID NO: 72937 - DNA, 25 bp, E. coli
gaatgtctggatatcgcacctgctg

SEQ ID NO: 72938 - DNA, 25 bp, E. coli
gaatgtctggatttcgcacctgctg

SEQ ID NO: 72939 - DNA, 25 bp, E. coli
gcaaagacttcacgctactggcaca

SEQ ID NO: 72940 - DNA, 25 bp, E. coli
gcaaagacttcaggctactggcaca

SEQ ID NO: 72941 - DNA, 25 bp, E. coli
gactgggagtatttcgacggcgaaa

SEQ ID NO: 72942 - DNA, 25 bp, E. coli
gaacattactggactgtggccgcgc

SEQ ID NO: 72943 - DNA, 25 bp, E. coli
gactgggagtatatcgacggcgaaa

SEQ ID NO: 72944 - DNA, 25 bp, E. coli
gaacattactggtctgtggccgcgc

SEQ ID NO: 72945 - DNA, 25 bp, E. coli
ctggcagtcacataacgtcccggaa

SEQ ID NO: 72946 - DNA, 25 bp, E. coli
ctggcagtcacaaaacgtcccggaa

SEQ ID NO: 72947 - DNA, 25 bp, E. coli
ggaactggcacacgctaccgatgat

SEQ ID NO: 72948 - DNA, 25 bp, E. coli
ggaactggcacaggctaccgatgat

SEQ ID NO: 72949 - DNA, 25 bp, E. coli
cagtgcggtttttccacgctgacca

SEQ ID NO: 72950 - DNA, 25 bp, E. coli
caggatatgcgctactggctggaaa

SEQ ID NO: 72951 - DNA, 25 bp, E. coli
cagtgcggttttaccacgctgacca

SEQ ID NO: 72952 - DNA, 25 bp, E. coli
caggatatgcgcaactggctggaaa

SEQ ID NO: 72953 - DNA, 25 bp, E. coli
aactggttgaaattgagcggctgcg

SEQ ID NO: 72954 - DNA, 25 bp, E. coli
aactggttgaaaatgagcggctgcg

SEQ ID NO: 72955 - DNA, 25 bp, E. coli
tataccaaaacccaatacgaggcgc

SEQ ID NO: 72956 - DNA, 25 bp, E. coli
tataccaaaaccgaatacgaggcgc

SEQ ID NO: 72957 - DNA, 25 bp, E. coli
tgcgttaccaggagatgccgatatc

SEQ ID NO: 72958 - DNA, 25 bp, E. coli
tgcgttaccaggtgatgccgatatc

SEQ ID NO: 72959 - DNA, 25 bp, E. coli
tcatccagggaagaagattggctgc

SEQ ID NO: 72960 - DNA, 25 bp, E. coli
tcatccagggaacaagattggctgc

SEQ ID NO: 72961 - DNA, 25 bp, E. coli
gcttcccctatgtagaccggctgga

SEQ ID NO: 72962 - DNA, 25 bp, E. coli
gcttcccctatgaagaccggctgga

SEQ ID NO: 72963 - DNA, 25 bp, E. coli
gaaggactggcggtgacattagcca

SEQ ID NO: 72964 - DNA, 25 bp, E. coli
gaagattttccgtcagtacctcgct

SEQ ID NO: 72965 - DNA, 25 bp, E. coli
gaaggactggcgctgacattagcca

SEQ ID NO: 72966 - DNA, 25 bp, E. coli
gaagattttccgacagtacctcgct

SEQ ID NO: 72967 - DNA, 25 bp, E. coli
gaaaatgatttgtgcgttgacacca

SEQ ID NO: 72968 - DNA, 25 bp, E. coli
gactgaaacgctatgccgaatcgct

SEQ ID NO: 72969 - DNA, 25 bp, E. coli
gactgaaacgctttgccgaatcgct

SEQ ID NO: 72970 - DNA, 25 bp, E. coli
gaaaatgatttgagcgttgacacca

SEQ ID NO: 72971 - DNA, 25 bp, E. coli
catgtgctaaggaaacgggaatggc

SEQ ID NO: 72972 - DNA, 25 bp, E. coli
catgtgctaaggtaacgggaatggc

SEQ ID NO: 72973 - DNA, 25 bp, E. coli
ttatccccgtgcgtgaaaacatgtg

SEQ ID NO: 72974 - DNA, 25 bp, E. coli
ttatccccgtgcctgaaaacatgtg

SEQ ID NO: 72975 - DNA, 25 bp, E. coli
tctttatactttatccccgtgcctg

SEQ ID NO: 72976 - DNA, 25 bp, E. coli
tctttatactttttccccgtgcctg

SEQ ID NO: 72977 - DNA, 25 bp, E. coli
tgaaaacatgtgctaaggaaacggg

SEQ ID NO: 72978 - DNA, 25 bp, E. coli
tgaaaacatgtggtaaggaaacggg

SEQ ID NO: 72979 - DNA, 25 bp, E. coli
tgccggactggcgtataaccggaac

SEQ ID NO: 72980 - DNA, 25 bp, E. coli
tgccggactggcctataaccggaac

SEQ ID NO: 72981 - DNA, 25 bp, E. coli
gcagcagtacgagattctttatact

SEQ ID NO: 72982 - DNA, 25 bp, E. coli
gcagcagtacgacattctttatact

SEQ ID NO: 72983 - DNA, 25 bp, E. coli
ggaaacgggaatcgcaaggtccgat

SEQ ID NO: 72984 - DNA, 25 bp, E. coli
ggaaacgggaatggcaaggtccgat

SEQ ID NO: 72985 - DNA, 25 bp, E. coli
cccgtgcctgaatacatgtgctaag

SEQ ID NO: 72986 - DNA, 25 bp, E. coli
cccgtgcctgaaaacatgtgctaag

SEQ ID NO: 72987 - DNA, 25 bp, E. coli
gtggtagaggtggttacccgcaaat

SEQ ID NO: 72988 - DNA, 25 bp, E. coli
ggtagaggtggttacccgcaaattg

SEQ ID NO: 72989 - DNA, 25 bp, E. coli
gtggtagaggtgcttacccgcaaat

SEQ ID NO: 72990 - DNA, 25 bp, E. coli
ggtagaggtggtaacccgcaaattg

SEQ ID NO: 72991 - DNA, 25 bp, E. coli
tgtgctaaggaaacgggaatggcaa

SEQ ID NO: 72992 - DNA, 25 bp, E. coli
tgtgctaaggaatcgggaatggcaa

SEQ ID NO: 72993 - DNA, 25 bp, E. coli
tatgaatatgcgtcaaagccctttg

SEQ ID NO: 72994 - DNA, 25 bp, E. coli
tatgaatatgcgacaaagccctttg

SEQ ID NO: 72995 - DNA, 25 bp, E. coli
tatttaaccagcctaatgaccgatg

SEQ ID NO: 72996 - DNA, 25 bp, E. coli
tattttgcagatattccacgccggt

SEQ ID NO: 72997 - DNA, 25 bp, E. coli
tatttaaccagcgtaatgaccgatg

SEQ ID NO: 72998 - DNA, 25 bp, E. coli
tattttgcagattttccacgccggt

SEQ ID NO: 72999 - DNA, 25 bp, E. coli
tgaatttgccgcgtatgacgaccgt

SEQ ID NO: 73000 - DNA, 25 bp, E. coli
tgaatttgccgcctatgacgaccgt

SEQ ID NO: 73001 - DNA, 25 bp, E. coli
tcccgctggccgtattacaggaagt

SEQ ID NO: 73002 - DNA, 25 bp, E. coli
tcccgctggccgaattacaggaagt

SEQ ID NO: 73003 - DNA, 25 bp, E. coli
ccaaaagtggcggtgctccggctat

SEQ ID NO: 73004 - DNA, 25 bp, E. coli
ccaaaagtggcgctgctccggctat

SEQ ID NO: 73005 - DNA, 25 bp, E. coli
gaacttcatggtgcgcacggattcc

SEQ ID NO: 73006 - DNA, 25 bp, E. coli
gaacttcatggtccgcacggattcc

SEQ ID NO: 73007 - DNA, 25 bp, E. coli
cattcggagatgtcacaaaaagggc

SEQ ID NO: 73008 - DNA, 25 bp, E. coli
cattcggagatgacacaaaaagggc

SEQ ID NO: 73009 - DNA, 25 bp, E. coli
ggtaataaagccttcccggagcttg

SEQ ID NO: 73010 - DNA, 25 bp, E. coli
ggatgtacctatctcacgccaagcg

SEQ ID NO: 73011 - DNA, 25 bp, E. coli
ggatgtacctatgtcacgccaagcg

SEQ ID NO: 73012 - DNA, 25 bp, E. coli
ggtaataaagccatcccggagcttg

SEQ ID NO: 73013 - DNA, 25 bp, E. coli
taacgatgttattagtgccagcgca

SEQ ID NO: 73014 - DNA, 25 bp, E. coli
taacgatgttataagtgccagcgca

SEQ ID NO: 73015 - DNA, 25 bp, E. coli
acccaggcgttgtgcgagcgtaaga

SEQ ID NO: 73016 - DNA, 25 bp, E. coli
attacgctggaaagggatggtgatt

SEQ ID NO: 73017 - DNA, 25 bp, E. coli
acccaggcgttgagcgagcgtaaga

SEQ ID NO: 73018 - DNA, 25 bp, E. coli
attacgctggaatgggatggtgatt

SEQ ID NO: 73019 - DNA, 25 bp, E. coli
aacaggcgaagctgacccaggcgtt

SEQ ID NO: 73020 - DNA, 25 bp, E. coli
aaagcgcgtgctgaacgtgaagcgc

SEQ ID NO: 73021 - DNA, 25 bp, E. coli
aacaggcgaagcagacccaggcgtt

SEQ ID NO: 73022 - DNA, 25 bp, E. coli
aaagcgcgtgctcaacgtgaagcgc

SEQ ID NO: 73023 - DNA, 25 bp, E. coli
ttcgtcagggtgtacataccggtat

SEQ ID NO: 73024 - DNA, 25 bp, E. coli
ttcgtcagggtgaacataccggtat

SEQ ID NO: 73025 - DNA, 25 bp, E. coli
tgctgaacgtgatgcgcgcgaagcc

SEQ ID NO: 73026 - DNA, 25 bp, E. coli
tgctgaacgtgaagcgcgcgaagcc

SEQ ID NO: 73027 - DNA, 25 bp, E. coli
gcaactggatgccgcgtttcgtcag

SEQ ID NO: 73028 - DNA, 25 bp, E. coli
gcaactggatgcggcgtttcgtcag

SEQ ID NO: 73029 - DNA, 25 bp, E. coli
cgttgagcgagcctaagaaaacact

SEQ ID NO: 73030 - DNA, 25 bp, E. coli
cgttgagcgagcgtaagaaaacact

SEQ ID NO: 73031 - DNA, 25 bp, E. coli
cgaagctgacccaggcgttgagcga

SEQ ID NO: 73032 - DNA, 25 bp, E. coli
cgaagctgaccctggcgttgagcga

SEQ ID NO: 73033 - DNA, 25 bp, E. coli
gtttcgtcagggagaacataccggt

SEQ ID NO: 73034 - DNA, 25 bp, E. coli
gtttcgtcagggtgaacataccggt

SEQ ID NO: 73035 - DNA, 25 bp, E. coli
gagcgagcgtaagaaaacactggca

SEQ ID NO: 73036 - DNA, 25 bp, E. coli
gagcgagcgtaacaaaacactggca

SEQ ID NO: 73037 - DNA, 25 bp, E. coli
cagaccgacggtgaggtgatgtaca

SEQ ID NO: 73038 - DNA, 25 bp, E. coli
cagaccgacggtcaggtgatgtaca

SEQ ID NO: 73039 - DNA, 25 bp, E. coli
ttcgttcttggcataaccggtctgg

SEQ ID NO: 73040 - DNA, 25 bp, E. coli
ttcgttcttggcttaaccggtctgg

SEQ ID NO: 73041 - DNA, 25 bp, E. coli
tacaacatggactgatcctcgcggc

SEQ ID NO: 73042 - DNA, 25 bp, E. coli
tacaacatggacagatcctcgcggc

SEQ ID NO: 73043 - DNA, 25 bp, E. coli
tatccgtcgcaaactgctgtttatg

SEQ ID NO: 73044 - DNA, 25 bp, E. coli
tatccgtcgcaatctgctgtttatg

SEQ ID NO: 73045 - DNA, 25 bp, E. coli
ttggtctggaaaacatgattaacgc

SEQ ID NO: 73046 - DNA, 25 bp, E. coli
ttggtctggaaatcatgattaacgc

SEQ ID NO: 73047 - DNA, 25 bp, E. coli
gatcctcgcggctatcttattcgtt

SEQ ID NO: 73048 - DNA, 25 bp, E. coli
gattcagtaagtgagatgcgcggat

SEQ ID NO: 73049 - DNA, 25 bp, E. coli
gattcagtaagtcagatgcgcggat

SEQ ID NO: 73050 - DNA, 25 bp, E. coli
gtcgtcgccagatcctgaacatcga

SEQ ID NO: 73051 - DNA, 25 bp, E. coli
gtcgtcgccagaacctgaacatcga

SEQ ID NO: 73052 - DNA, 25 bp, E. coli
taaccggtctggatatccgtcgcaa

SEQ ID NO: 73053 - DNA, 25 bp, E. coli
taaccggtctggttatccgtcgcaa

SEQ ID NO: 73054 - DNA, 25 bp, E. coli
gagtatcggcctagcgctgctgctg

SEQ ID NO: 73055 - DNA, 25 bp, E. coli
gatcctcgcggcaatcttattcgtt

SEQ ID NO: 73056 - DNA, 25 bp, E. coli
gatgtacattctggccatcagcctc

SEQ ID NO: 73057 - DNA, 25 bp, E. coli
gagtatcggccttgcgctgctgctg

SEQ ID NO: 73058 - DNA, 25 bp, E. coli
gatgtacattctcgccatcagcctc

SEQ ID NO: 73059 - DNA, 25 bp, E. coli
aattctgcccgttgtattggctgtc

SEQ ID NO: 73060 - DNA, 25 bp, E. coli
aattctgcccgtagtattggctgtc

SEQ ID NO: 73061 - DNA, 25 bp, E. coli
atcagtgcgccggtgatgtgccatc

SEQ ID NO: 73062 - DNA, 25 bp, E. coli
atcagtgcgccgctgatgtgccatc

SEQ ID NO: 73063 - DNA, 25 bp, E. coli
tgtattggctgtgagagttgcgtca

SEQ ID NO: 73064 - DNA, 25 bp, E. coli
tgtattggctgtcagagttgcgtca

SEQ ID NO: 73065 - DNA, 25 bp, E. coli
tgaaatgcgatctctgtgaacagcg

SEQ ID NO: 73066 - DNA, 25 bp, E. coli
tgaaaacgccccttgtgttggcgct

SEQ ID NO: 73067 - DNA, 25 bp, E. coli
tgaaaacgccccatgtgttggcgct

SEQ ID NO: 73068 - DNA, 25 bp, E. coli
tgaaatgcgatcactgtgaacagcg

SEQ ID NO: 73069 - DNA, 25 bp, E. coli
gaaagagaactctggcgagtccgcc

SEQ ID NO: 73070 - DNA, 25 bp, E. coli
gaaagagaactcaggcgagtccgcc

SEQ ID NO: 73071 - DNA, 25 bp, E. coli
cgatctctgtgaacagcgggaagag

SEQ ID NO: 73072 - DNA, 25 bp, E. coli
cgatctctgtgatcagcgggaagag

SEQ ID NO: 73073 - DNA, 25 bp, E. coli
cgtgcccgtttgcaatgatcaccat

SEQ ID NO: 73074 - DNA, 25 bp, E. coli
cgtgcccgtttggaatgatcaccat

SEQ ID NO: 73075 - DNA, 25 bp, E. coli
gagtccgccagcagcgtattgttgc

SEQ ID NO: 73076 - DNA, 25 bp, E. coli
gagtccgccagctgcgtattgttgc

SEQ ID NO: 73077 - DNA, 25 bp, E. coli
gatgtgccatcagtgtgaaaacgcc

SEQ ID NO: 73078 - DNA, 25 bp, E. coli
gagttgcgtcagagcgtgcccgttt

SEQ ID NO: 73079 - DNA, 25 bp, E. coli
gagttgcgtcagtgcgtgcccgttt

SEQ ID NO: 73080 - DNA, 25 bp, E. coli
gatgtgccatcactgtgaaaacgcc

SEQ ID NO: 73081 - DNA, 25 bp, E. coli
caattgcggcaatatatccaccaga

SEQ ID NO: 73082 - DNA, 25 bp, E. coli
caattgcggcaaaatatccaccaga

SEQ ID NO: 73083 - DNA, 25 bp, E. coli
caacagcaagatccgctgaaggtgc

SEQ ID NO: 73084 - DNA, 25 bp, E. coli
caacagcaagatgcgctgaaggtgc

SEQ ID NO: 73085 - DNA, 25 bp, E. coli
caggatgattcggagccgttaagcg

SEQ ID NO: 73086 - DNA, 25 bp, E. coli
caggatgattcgcagccgttaagcg

SEQ ID NO: 73087 - DNA, 25 bp, E. coli
aaggtgcagttacccgccttgtttc

SEQ ID NO: 73088 - DNA, 25 bp, E. coli
agccgttaagcgagattcgtacccg

SEQ ID NO: 73089 - DNA, 25 bp, E. coli
agccgttaagcgtgattcgtacccg

SEQ ID NO: 73090 - DNA, 25 bp, E. coli
aaggtgcagttagccgccttgtttc

SEQ ID NO: 73091 - DNA, 25 bp, E. coli
tgtcgcgccaatcgattgtttaatt

SEQ ID NO: 73092 - DNA, 25 bp, E. coli
tgtcgcgccaatggattgtttaatt

SEQ ID NO: 73093 - DNA, 25 bp, E. coli
tgcgctgaaggtccagttagccgcc

SEQ ID NO: 73094 - DNA, 25 bp, E. coli
tgcgctgaaggtgcagttagccgcc

SEQ ID NO: 73095 - DNA, 25 bp, E. coli
ccttgtttcaggatgattcggagcc

SEQ ID NO: 73096 - DNA, 25 bp, E. coli
ccttgtttcaggttgattcggagcc

SEQ ID NO: 73097 - DNA, 25 bp, E. coli
gcgagattcgtacccgctgtgagac

SEQ ID NO: 73098 - DNA, 25 bp, E. coli
gcgagattcgtagccgctgtgagac

SEQ ID NO: 73099 - DNA, 25 bp, E. coli
gattcggagccgttaagcgagattc

SEQ ID NO: 73100 - DNA, 25 bp, E. coli
gattcggagccgataagcgagattc

SEQ ID NO: 73101 - DNA, 25 bp, E. coli
ggcaaaatatccaccagatcgaaga

SEQ ID NO: 73102 - DNA, 25 bp, E. coli
ggcaaaatatcctccagatcgaaga

SEQ ID NO: 73103 - DNA, 25 bp, E. coli
aagtccatgggccggtagaaatcaa

SEQ ID NO: 73104 - DNA, 25 bp, E. coli
caaagtaagtggtatgacgtcccgc

SEQ ID NO: 73105 - DNA, 25 bp, E. coli
caaagtaagtggaatgacgtcccgc

SEQ ID NO: 73106 - DNA, 25 bp, E. coli
tacagcgcggtgcagcgaatattgc

SEQ ID NO: 73107 - DNA, 25 bp, E. coli
tacagcgcggtggagcgaatattgc

SEQ ID NO: 73108 - DNA, 25 bp, E. coli
agtaagtggtatgacgtcccgcctg

SEQ ID NO: 73109 - DNA, 25 bp, E. coli
agtaagctgatgacgcgcctgggat

SEQ ID NO: 73110 - DNA, 25 bp, E. coli
acgctggctgcaagacagttaaacc

SEQ ID NO: 73111 - DNA, 25 bp, E. coli
agtaagctgatgtcgcgcctgggat

SEQ ID NO: 73112 - DNA, 25 bp, E. coli
agtaagtggtatcacgtcccgcctg

SEQ ID NO: 73113 - DNA, 25 bp, E. coli
aaatgacgttacagcgcggtgcagc

SEQ ID NO: 73114 - DNA, 25 bp, E. coli
aaaaaatgacgttacagcgcggtgc

SEQ ID NO: 73115 - DNA, 25 bp, E. coli
aaatgacgttactgcgcggtgcagc

SEQ ID NO: 73116 - DNA, 25 bp, E. coli
acgctggctgcatgacagttaaacc

SEQ ID NO: 73117 - DNA, 25 bp, E. coli
aacttcacaagacccgacgctggct

SEQ ID NO: 73118 - DNA, 25 bp, E. coli
aaaaaatgacgtaacagcgcggtgc

SEQ ID NO: 73119 - DNA, 25 bp, E. coli
aagtccatgggcgggtagaaatcaa

SEQ ID NO: 73120 - DNA, 25 bp, E. coli
aagagccgacgctggctgcaagaca

SEQ ID NO: 73121 - DNA, 25 bp, E. coli
aagagccgacgcaggctgcaagaca

SEQ ID NO: 73122 - DNA, 25 bp, E. coli
aacttcacaagagccgacgctggct

SEQ ID NO: 73123 - DNA, 25 bp, E. coli
tggagccgcagatgagtaagctgat

SEQ ID NO: 73124 - DNA, 25 bp, E. coli
tggagccgcagaagagtaagctgat

SEQ ID NO: 73125 - DNA, 25 bp, E. coli
catgaatgttgcagtcgatgacagg

SEQ ID NO: 73126 - DNA, 25 bp, E. coli
catctcctgatgacgcatagtcagc

SEQ ID NO: 73127 - DNA, 25 bp, E. coli
catctcctgatgtcgcatagtcagc

SEQ ID NO: 73128 - DNA, 25 bp, E. coli
catgaatgttgctgtcgatgacagg

SEQ ID NO: 73129 - DNA, 25 bp, E. coli
agttaaccaggttgcggaagtgctg

SEQ ID NO: 73130 - DNA, 25 bp, E. coli
agttaaccaggtagcggaagtgctg

SEQ ID NO: 73131 - DNA, 25 bp, E. coli
ttacaaagggagaagggcatggcga

SEQ ID NO: 73132 - DNA, 25 bp, E. coli
ttacaaagggagtagggcatggcga

SEQ ID NO: 73133 - DNA, 25 bp, E. coli
tgacgcatagtctgcccatcatgaa

SEQ ID NO: 73134 - DNA, 25 bp, E. coli
tgacgcatagtcagcccatcatgaa

SEQ ID NO: 73135 - DNA, 25 bp, E. coli
tcgatgacaggttgttacaaaggga

SEQ ID NO: 73136 - DNA, 25 bp, E. coli
tcgatgacaggtagttacaaaggga

SEQ ID NO: 73137 - DNA, 25 bp, E. coli
gcccatcatgaaagttgctgtcgat

SEQ ID NO: 73138 - DNA, 25 bp, E. coli
gcccatcatgaatgttgctgtcgat

SEQ ID NO: 73139 - DNA, 25 bp, E. coli
cgaaaaaagaagtgattaaccagcg

SEQ ID NO: 73140 - DNA, 25 bp, E. coli
cgaaaaaagaagagattaaccagcg

SEQ ID NO: 73141 - DNA, 25 bp, E. coli
gatttaagccatctcctgatgacgc

SEQ ID NO: 73142 - DNA, 25 bp, E. coli
gatttaagccatgtcctgatgacgc

SEQ ID NO: 73143 - DNA, 25 bp, E. coli
gtggaggatttatgccatctcctga

SEQ ID NO: 73144 - DNA, 25 bp, E. coli
gtggaggatttaagccatctcctga

SEQ ID NO: 73145 - DNA, 25 bp, E. coli
taaccagcgagttaaccaggttgcg

SEQ ID NO: 73146 - DNA, 25 bp, E. coli
taaccagcgagtaaaccaggttgcg

SEQ ID NO: 73147 - DNA, 25 bp, E. coli
aattattaccgggatggtcagcgcc

SEQ ID NO: 73148 - DNA, 25 bp, E. coli
aattattaccggcatggtcagcgcc

SEQ ID NO: 73149 - DNA, 25 bp, E. coli
catttaaaccggtagcagaagccgt

SEQ ID NO: 73150 - DNA, 25 bp, E. coli
catttaaaccggaagcagaagccgt

SEQ ID NO: 73151 - DNA, 25 bp, E. coli
ttaaccgggcttcctgaaaatggcg

SEQ ID NO: 73152 - DNA, 25 bp, E. coli
ttaaccgggcttgctgaaaatggcg

SEQ ID NO: 73153 - DNA, 25 bp, E. coli
ttgccaaagttaccaaagatgccgg

SEQ ID NO: 73154 - DNA, 25 bp, E. coli
ttgccaaagttagcaaagatgccgg

SEQ ID NO: 73155 - DNA, 25 bp, E. coli
tggtgaccctgaaaagcacgatgct

SEQ ID NO: 73156 - DNA, 25 bp, E. coli
tgtattctgggcgttctccaccacg

SEQ ID NO: 73157 - DNA, 25 bp, E. coli
tgtattctgggccttctccaccacg

SEQ ID NO: 73158 - DNA, 25 bp, E. coli
tggtgaccctgataagcacgatgct

SEQ ID NO: 73159 - DNA, 25 bp, E. coli
tgctgaaaacctcaaacttcccggg

SEQ ID NO: 73160 - DNA, 25 bp, E. coli
tgctgaaaacctgaaacttcccggg

SEQ ID NO: 73161 - DNA, 25 bp, E. coli
tcgtttaaaggctggcaagatcgct

SEQ ID NO: 73162 - DNA, 25 bp, E. coli
tcgtttaaaggcaggcaagatcgct

SEQ ID NO: 73163 - DNA, 25 bp, E. coli
cgtattagcaaagcgcatgggcgga

SEQ ID NO: 73164 - DNA, 25 bp, E. coli
cgtattagcaaaccgcatgggcgga

SEQ ID NO: 73165 - DNA, 25 bp, E. coli
cggtgtttcacattctcaggcggta

SEQ ID NO: 73166 - DNA, 25 bp, E. coli
cggtgtttcacaatctcaggcggta

SEQ ID NO: 73167 - DNA, 25 bp, E. coli
gttaatggcgaaaggcaagccctgg

SEQ ID NO: 73168 - DNA, 25 bp, E. coli
gttaatggcgaatggcaagccctgg

SEQ ID NO: 73169 - DNA, 25 bp, E. coli
aacgtggtcagaatttgacaggcgc

SEQ ID NO: 73170 - DNA, 25 bp, E. coli
cacagcggtattcccgctggagcgc

SEQ ID NO: 73171 - DNA, 25 bp, E. coli
cacagcggtattgccgctggagcgc

SEQ ID NO: 73172 - DNA, 25 bp, E. coli
tacggctggcgctcttctggcgtgt

SEQ ID NO: 73173 - DNA, 25 bp, E. coli
aacgtggtcagattttgacaggcgc

SEQ ID NO: 73174 - DNA, 25 bp, E. coli
tacggctggcgcacttctggcgtgt

SEQ ID NO: 73175 - DNA, 25 bp, E. coli
ttaaacacagcgctattgccgctgg

SEQ ID NO: 73176 - DNA, 25 bp, E. coli
ttaaacacagcggtattgccgctgg

SEQ ID NO: 73177 - DNA, 25 bp, E. coli
tgcccgtgcgcaacgcgtcactatg

SEQ ID NO: 73178 - DNA, 25 bp, E. coli
tgcccgtgcgcatcgcgtcactatg

SEQ ID NO: 73179 - DNA, 25 bp, E. coli
gccgctggagcgctggtggtgacat

SEQ ID NO: 73180 - DNA, 25 bp, E. coli
gccgctggagcggtggtggtgacat

SEQ ID NO: 73181 - DNA, 25 bp, E. coli
gaataccttaaatattgcctggagc

SEQ ID NO: 73182 - DNA, 25 bp, E. coli
gaataccttaaaaattgcctggagc

SEQ ID NO: 73183 - DNA, 25 bp, E. coli
gtaaaatcctcagcgcgggacgttg

SEQ ID NO: 73184 - DNA, 25 bp, E. coli
gtaaaatcctcaccgcgggacgttg

SEQ ID NO: 73185 - DNA, 25 bp, E. coli
ggaatgaacccggtgaataccttaa

SEQ ID NO: 73186 - DNA, 25 bp, E. coli
ggaatgaacccgctgaataccttaa

SEQ ID NO: 73187 - DNA, 25 bp, E. coli
gtctggaacaaacgtggtcagattt

SEQ ID NO: 73188 - DNA, 25 bp, E. coli
gtctggaacaaaggtggtcagattt

SEQ ID NO: 73189 - DNA, 25 bp, E. coli
gagaagggcggttaaatcctcaccg

SEQ ID NO: 73190 - DNA, 25 bp, E. coli
gagaagggcggtaaaatcctcaccg

SEQ ID NO: 73191 - DNA, 25 bp, E. coli
taaacgcctctgacagaaatgatgg

SEQ ID NO: 73192 - DNA, 25 bp, E. coli
taaacgcctctgtcagaaatgatgg

SEQ ID NO: 73193 - DNA, 25 bp, E. coli
tattgccggacatattaaacgcctc

SEQ ID NO: 73194 - DNA, 25 bp, E. coli
tatttctatcaacctgaggccagcg

SEQ ID NO: 73195 - DNA, 25 bp, E. coli
tattgccggacaaattaaacgcctc

SEQ ID NO: 73196 - DNA, 25 bp, E. coli
tatttctatcaagctgaggccagcg

SEQ ID NO: 73197 - DNA, 25 bp, E. coli
ttatcaggtatacaatggcgtcggg

SEQ ID NO: 73198 - DNA, 25 bp, E. coli
ttccagatggactaaagccccaggc

SEQ ID NO: 73199 - DNA, 25 bp, E. coli
ttccagatggacaaaagccccaggc

SEQ ID NO: 73200 - DNA, 25 bp, E. coli
ttatcaggtatagaatggcgtcggg

SEQ ID NO: 73201 - DNA, 25 bp, E. coli
tgattttaaacgagaacgccgcggg

SEQ ID NO: 73202 - DNA, 25 bp, E. coli
tgattttaaacgtgaacgccgcggg

SEQ ID NO: 73203 - DNA, 25 bp, E. coli
tgagcagcatcgtaaaatagcccgc

SEQ ID NO: 73204 - DNA, 25 bp, E. coli
tgagcagcatcgaaaaatagcccgc

SEQ ID NO: 73205 - DNA, 25 bp, E. coli
tctcttctttgctgggaggcaagac

SEQ ID NO: 73206 - DNA, 25 bp, E. coli
tctcttctttgcagggaggcaagac

SEQ ID NO: 73207 - DNA, 25 bp, E. coli
gaacgccgcgggtagaattatcagg

SEQ ID NO: 73208 - DNA, 25 bp, E. coli
gaacgccgcgggaagaattatcagg

SEQ ID NO: 73209 - DNA, 25 bp, E. coli
ggccagcgttcgaacccaaacaatt

SEQ ID NO: 73210 - DNA, 25 bp, E. coli
ggccagcgttcgtacccaaacaatt

SEQ ID NO: 73211 - DNA, 25 bp, E. coli
taagcattcgcgtggttccagatgg

SEQ ID NO: 73212 - DNA, 25 bp, E. coli
taagcattcgcgaggttccagatgg

SEQ ID NO: 73213 - DNA, 25 bp, E. coli
cacggttggcaacctattaactgaa

SEQ ID NO: 73214 - DNA, 25 bp, E. coli
cacggttggcaagctattaactgaa

SEQ ID NO: 73215 - DNA, 25 bp, E. coli
ctcgccacggttcgcaagctattaa

SEQ ID NO: 73216 - DNA, 25 bp, E. coli
ctcgccacggttggcaagctattaa

SEQ ID NO: 73217 - DNA, 25 bp, E. coli
atcgattgtcattccgcctgcgcca

SEQ ID NO: 73218 - DNA, 25 bp, E. coli
atcgattgtcataccgcctgcgcca

SEQ ID NO: 73219 - DNA, 25 bp, E. coli
taccgccgcgcgcttgtttgacagc

SEQ ID NO: 73220 - DNA, 25 bp, E. coli
taccgccgcgcggttgtttgacagc

SEQ ID NO: 73221 - DNA, 25 bp, E. coli
tatttcctcgccacggttggcaagc

SEQ ID NO: 73222 - DNA, 25 bp, E. coli
tatttcctcgcctcggttggcaagc

SEQ ID NO: 73223 - DNA, 25 bp, E. coli
tggtgacgccggaatcgattgtcat

SEQ ID NO: 73224 - DNA, 25 bp, E. coli
tggtgacgccggtatcgattgtcat

SEQ ID NO: 73225 - DNA, 25 bp, E. coli
gaatcgattgtctttccgcctgcgc

SEQ ID NO: 73226 - DNA, 25 bp, E. coli
gaatcgattgtcattccgcctgcgc

SEQ ID NO: 73227 - DNA, 25 bp, E. coli
cgcttacccgccatctggtgccagt

SEQ ID NO: 73228 - DNA, 25 bp, E. coli
cgcttacccgccttctggtgccagt

SEQ ID NO: 73229 - DNA, 25 bp, E. coli
ggtcgttatttcctcgccacggttg

SEQ ID NO: 73230 - DNA, 25 bp, E. coli
ggtcgttatttcgtcgccacggttg

SEQ ID NO: 73231 - DNA, 25 bp, E. coli
ggcgtttatgcgctcgttatttcct

SEQ ID NO: 73232 - DNA, 25 bp, E. coli
tggcaagctatttactgaaaaagcg

SEQ ID NO: 73233 - DNA, 25 bp, E. coli
tggcaagctattaactgaaaaagcg

SEQ ID NO: 73234 - DNA, 25 bp, E. coli
ggcgtttatgcggtcgttatttcct

SEQ ID NO: 73235 - DNA, 25 bp, E. coli
aatggcactgcggatactactcaga

SEQ ID NO: 73236 - DNA, 25 bp, E. coli
aatggcactgcgcatactactcaga

SEQ ID NO: 73237 - DNA, 25 bp, E. coli
caatggtcaggtatctggcgtgcaa

SEQ ID NO: 73238 - DNA, 25 bp, E. coli
caatggtcaggtttctggcgtgcaa

SEQ ID NO: 73239 - DNA, 25 bp, E. coli
cacgaagttgcaaaccaatggtcag

SEQ ID NO: 73240 - DNA, 25 bp, E. coli
cacgaagttgcataccaatggtcag

SEQ ID NO: 73241 - DNA, 25 bp, E. coli
aagattccgtggagactttgccaga

SEQ ID NO: 73242 - DNA, 25 bp, E. coli
aagattccgtggtgactttgccaga

SEQ ID NO: 73243 - DNA, 25 bp, E. coli
tataactgtggtatgtgcaacgtcc

SEQ ID NO: 73244 - DNA, 25 bp, E. coli
tataactgtggtttgtgcaacgtcc

SEQ ID NO: 73245 - DNA, 25 bp, E. coli
ttgccagatgtttgtgccacgaagt

SEQ ID NO: 73246 - DNA, 25 bp, E. coli
ttgccagatgttagtgccacgaagt

SEQ ID NO: 73247 - DNA, 25 bp, E. coli
tgtaccctggtacctgcgacgaaag

SEQ ID NO: 73248 - DNA, 25 bp, E. coli
tgtaccctggtagctgcgacgaaag

SEQ ID NO: 73249 - DNA, 25 bp, E. coli
tgatgctgctacaaacgtggccctg

SEQ ID NO: 73250 - DNA, 25 bp, E. coli
tgatgctgctactaacgtggccctg

SEQ ID NO: 73251 - DNA, 25 bp, E. coli
gccagacacagataccgggaacatt

SEQ ID NO: 73252 - DNA, 25 bp, E. coli
gccagacacagaaaccgggaacatt

SEQ ID NO: 73253 - DNA, 25 bp, E. coli
gattacagcgttagctaaccaggcc

SEQ ID NO: 73254 - DNA, 25 bp, E. coli
gattacagcgtttgctaaccaggcc

SEQ ID NO: 73255 - DNA, 25 bp, E. coli
gataatgctatctcggatggctcag

SEQ ID NO: 73256 - DNA, 25 bp, E. coli
gataatgctatcacggatggctcag

SEQ ID NO: 73257 - DNA, 25 bp, E. coli
caaccattgactgccagagcgcgta

SEQ ID NO: 73258 - DNA, 25 bp, E. coli
caaccattgactcccagagcgcgta

SEQ ID NO: 73259 - DNA, 25 bp, E. coli
atggacggcacccagcaaccattga

SEQ ID NO: 73260 - DNA, 25 bp, E. coli
accattgactgccagagcgcgtaaa

SEQ ID NO: 73261 - DNA, 25 bp, E. coli
atggacggcaccgagcaaccattga

SEQ ID NO: 73262 - DNA, 25 bp, E. coli
acggcaccgagctaccattgactgc

SEQ ID NO: 73263 - DNA, 25 bp, E. coli
accattgactgcgagagcgcgtaaa

SEQ ID NO: 73264 - DNA, 25 bp, E. coli
acggcaccgagcaaccattgactgc

SEQ ID NO: 73265 - DNA, 25 bp, E. coli
tagcactgtggatgcccgttccggt

SEQ ID NO: 73266 - DNA, 25 bp, E. coli
tagcactgtggaagcccgttccggt

SEQ ID NO: 73267 - DNA, 25 bp, E. coli
tgtggaagcccgttccggtctgttt

SEQ ID NO: 73268 - DNA, 25 bp, E. coli
tgtggaagcccgatccggtctgttt

SEQ ID NO: 73269 - DNA, 25 bp, E. coli
tcttagcactgtcgaagcccgttcc

SEQ ID NO: 73270 - DNA, 25 bp, E. coli
tcttagcactgtggaagcccgttcc

SEQ ID NO: 73271 - DNA, 25 bp, E. coli
gcgtcttagcactgtggaagcccgt

SEQ ID NO: 73272 - DNA, 25 bp, E. coli
gcgtcttagcacagtggaagcccgt

SEQ ID NO: 73273 - DNA, 25 bp, E. coli
gcaccgagcaaccattgactgccag

SEQ ID NO: 73274 - DNA, 25 bp, E. coli
gcaccgagcaacgattgactgccag

SEQ ID NO: 73275 - DNA, 25 bp, E. coli
cgagcgtcttagcactgtggaagcc

SEQ ID NO: 73276 - DNA, 25 bp, E. coli
cgagcgtcttaggactgtggaagcc

SEQ ID NO: 73277 - DNA, 25 bp, E. coli
gagcaaccattgtctgccagagcgc

SEQ ID NO: 73278 - DNA, 25 bp, E. coli
gagcaaccattgactgccagagcgc

SEQ ID NO: 73279 - DNA, 25 bp, E. coli
caaactgacattcctgcaaacctgg

SEQ ID NO: 73280 - DNA, 25 bp, E. coli
caaacctggagtcaagacgacttcc

SEQ ID NO: 73281 - DNA, 25 bp, E. coli
caaacctggagtgaagacgacttcc

SEQ ID NO: 73282 - DNA, 25 bp, E. coli
caaactgacattgctgcaaacctgg

SEQ ID NO: 73283 - DNA, 25 bp, E. coli
catgaagagcattaaagctggccgt

SEQ ID NO: 73284 - DNA, 25 bp, E. coli
catgaagagcataaaagctggccgt

SEQ ID NO: 73285 - DNA, 25 bp, E. coli
tactgcgatgcgaggcatgaagagc

SEQ ID NO: 73286 - DNA, 25 bp, E. coli
tactgcgatgcgtggcatgaagagc

SEQ ID NO: 73287 - DNA, 25 bp, E. coli
tgaaagattttactgcacgctactg

SEQ ID NO: 73288 - DNA, 25 bp, E. coli
tgaaagattttagtgcacgctactg

SEQ ID NO: 73289 - DNA, 25 bp, E. coli
tccgtcgggtgcaggaaaatctgat

SEQ ID NO: 73290 - DNA, 25 bp, E. coli
tccgtcgggtgctggaaaatctgat

SEQ ID NO: 73291 - DNA, 25 bp, E. coli
cttttatacgactcagtttgccggg

SEQ ID NO: 73292 - DNA, 25 bp, E. coli
ctggccgttaagagaggaactgtac

SEQ ID NO: 73293 - DNA, 25 bp, E. coli
cttttatacgacacagtttgccggg

SEQ ID NO: 73294 - DNA, 25 bp, E. coli
ctggccgttaagtgaggaactgtac

SEQ ID NO: 73295 - DNA, 25 bp, E. coli
gatttgaccgcacaagccctgaaag

SEQ ID NO: 73296 - DNA, 25 bp, E. coli
gatatgcacgcgcagtttggcgata

SEQ ID NO: 73297 - DNA, 25 bp, E. coli
gatatgcacgcggagtttggcgata

SEQ ID NO: 73298 - DNA, 25 bp, E. coli
gatttgaccgcagaagccctgaaag

SEQ ID NO: 73299 - DNA, 25 bp, E. coli
gatgccgtatactggcaaccccagc

SEQ ID NO: 73300 - DNA, 25 bp, E. coli
gatgccgtatacaggcaaccccagc

SEQ ID NO: 73301 - DNA, 25 bp, E. coli
cactcggtatctttcactatcaacg

SEQ ID NO: 73302 - DNA, 25 bp, E. coli
cagcaaaggcaactaccactcggta

SEQ ID NO: 73303 - DNA, 25 bp, E. coli
cactcggtatctatcactatcaacg

SEQ ID NO: 73304 - DNA, 25 bp, E. coli
cagcaaaggcaagtaccactcggta

SEQ ID NO: 73305 - DNA, 25 bp, E. coli
catatcgagcaggttgaaacactgt

SEQ ID NO: 73306 - DNA, 25 bp, E. coli
catatcgagcagcttgaaacactgt

SEQ ID NO: 73307 - DNA, 25 bp, E. coli
caggcgttacctcagctggttgatc

SEQ ID NO: 73308 - DNA, 25 bp, E. coli
caggcgttacctgagctggttgatc

SEQ ID NO: 73309 - DNA, 25 bp, E. coli
gccaggtgactacaccccaacggta

SEQ ID NO: 73310 - DNA, 25 bp, E. coli
gccaggtgactagaccccaacggta

SEQ ID NO: 73311 - DNA, 25 bp, E. coli
tatcaacgccactcatatcgagcag

SEQ ID NO: 73312 - DNA, 25 bp, E. coli
tatcaacgccacacatatcgagcag

SEQ ID NO: 73313 - DNA, 25 bp, E. coli
tgaaaaccaaacttaacgaactgct

SEQ ID NO: 73314 - DNA, 25 bp, E. coli
tgaaaaccaaacataacgaactgct

SEQ ID NO: 73315 - DNA, 25 bp, E. coli
gaaacactgtatgaagaactgggca

SEQ ID NO: 73316 - DNA, 25 bp, E. coli
gaactgggcaaaatcgatattgtcc

SEQ ID NO: 73317 - DNA, 25 bp, E. coli
gaactgggcaaattcgatattgtcc

SEQ ID NO: 73318 - DNA, 25 bp, E. coli
gaaacactgtatcaagaactgggca

SEQ ID NO: 73319 - DNA, 25 bp, E. coli
cgatattgtccggatggttctgtaa

SEQ ID NO: 73320 - DNA, 25 bp, E. coli
cgatattgtccgcatggttctgtaa

SEQ ID NO: 73321 - DNA, 25 bp, E. coli
tggttgaagtggtacagcgccatgc

SEQ ID NO: 73322 - DNA, 25 bp, E. coli
tggttgaagtggaacagcgccatgc

SEQ ID NO: 73323 - DNA, 25 bp, E. coli
cagcataactcattaataacataag

SEQ ID NO: 73324 - DNA, 25 bp, E. coli
cagcataactcaataataacataag

SEQ ID NO: 73325 - DNA, 25 bp, E. coli
aaatcagccccgacgattcacctgt

SEQ ID NO: 73326 - DNA, 25 bp, E. coli
aaatcagccccgtcgattcacctgt

SEQ ID NO: 73327 - DNA, 25 bp, E. coli
ttataaatgatagtcactctcaggg

SEQ ID NO: 73328 - DNA, 25 bp, E. coli
ttataaatgatactcactctcaggg

SEQ ID NO: 73329 - DNA, 25 bp, E. coli
gccatttcaagcgtgataaaactgc

SEQ ID NO: 73330 - DNA, 25 bp, E. coli
gccatttcaagcctgataaaactgc

SEQ ID NO: 73331 - DNA, 25 bp, E. coli
gcgatggcttgcaaaagtaattcat

SEQ ID NO: 73332 - DNA, 25 bp, E. coli
gcgatggcttgctaaagtaattcat

SEQ ID NO: 73333 - DNA, 25 bp, E. coli
gcaaaagtaattgattgcctgaata

SEQ ID NO: 73334 - DNA, 25 bp, E. coli
gcaaaagtaattcattgcctgaata

SEQ ID NO: 73335 - DNA, 25 bp, E. coli
gataaaactgctaaacaaatcagca

SEQ ID NO: 73336 - DNA, 25 bp, E. coli
gataaaactgcttaacaaatcagca

SEQ ID NO: 73337 - DNA, 25 bp, E. coli
gggctggacgccatttcaagcctga

SEQ ID NO: 73338 - DNA, 25 bp, E. coli
gggctggacgccttttcaagcctga

SEQ ID NO: 73339 - DNA, 25 bp, E. coli
taagagaatgcgttggcttgcaaaa

SEQ ID NO: 73340 - DNA, 25 bp, E. coli
taataacataagtgaatgcgatggc

SEQ ID NO: 73341 - DNA, 25 bp, E. coli
taagaaaaaatcagccccgacgatt

SEQ ID NO: 73342 - DNA, 25 bp, E. coli
taataacataagagaatgcgatggc

SEQ ID NO: 73343 - DNA, 25 bp, E. coli
taagagaatgcgatggcttgcaaaa

SEQ ID NO: 73344 - DNA, 25 bp, E. coli
taagaaaaaatctgccccgacgatt

SEQ ID NO: 73345 - DNA, 25 bp, E. coli
aaagttaccaggatttgcgctccgg

SEQ ID NO: 73346 - DNA, 25 bp, E. coli
aaagttaccaggttttgcgctccgg

SEQ ID NO: 73347 - DNA, 25 bp, E. coli
tataaaggcgaagccgagcggttgc

SEQ ID NO: 73348 - DNA, 25 bp, E. coli
tagaacaggcttgtgtcagcggcga

SEQ ID NO: 73349 - DNA, 25 bp, E. coli
tatcgccagcggcagtagaacaggc

SEQ ID NO: 73350 - DNA, 25 bp, E. coli
tagaacaggcttctgtcagcggcga

SEQ ID NO: 73351 - DNA, 25 bp, E. coli
tataaaggcgaacccgagcggttgc

SEQ ID NO: 73352 - DNA, 25 bp, E. coli
tatcgccagcgggagtagaacaggc

SEQ ID NO: 73353 - DNA, 25 bp, E. coli
tctttaccaccatacagacgggcag

SEQ ID NO: 73354 - DNA, 25 bp, E. coli
tctttaccaccaaacagacgggcag

SEQ ID NO: 73355 - DNA, 25 bp, E. coli
gctactgacacaacgactgctggcg

SEQ ID NO: 73356 - DNA, 25 bp, E. coli
gctactgacacatcgactgctggcg

SEQ ID NO: 73357 - DNA, 25 bp, E. coli
gaagaggcgctaatacacagccaga

SEQ ID NO: 73358 - DNA, 25 bp, E. coli
gaagaggcgctattacacagccaga

SEQ ID NO: 73359 - DNA, 25 bp, E. coli
gaaactgaaagcagtcgggcaactg

SEQ ID NO: 73360 - DNA, 25 bp, E. coli
gaaactgaaagctgtcgggcaactg

SEQ ID NO: 73361 - DNA, 25 bp, E. coli
gtggatgatatgaccggcagcctga

SEQ ID NO: 73362 - DNA, 25 bp, E. coli
gtggatgatatgtccggcagcctga

SEQ ID NO: 73363 - DNA, 25 bp, E. coli
gatgaaatgcgttaactcgcgccgc

SEQ ID NO: 73364 - DNA, 25 bp, E. coli
gaccacgcagatcgagattgcccaa

SEQ ID NO: 73365 - DNA, 25 bp, E. coli
gaccacgcagatggagattgcccaa

SEQ ID NO: 73366 - DNA, 25 bp, E. coli
gatgaaatgcgtaaactcgcgccgc

SEQ ID NO: 73367 - DNA, 25 bp, E. coli
aagagtttgatctcagcaacccgct

SEQ ID NO: 73368 - DNA, 25 bp, E. coli
aagagtttgatcacagcaacccgct

SEQ ID NO: 73369 - DNA, 25 bp, E. coli
atcagaatgcgcagggaatgcgtgt

SEQ ID NO: 73370 - DNA, 25 bp, E. coli
atcagaatgcgctgggaatgcgtgt

SEQ ID NO: 73371 - DNA, 25 bp, E. coli
aaagagtttgatctcagcaacccgc

SEQ ID NO: 73372 - DNA, 25 bp, E. coli
aaagagtttgatgtcagcaacccgc

SEQ ID NO: 73373 - DNA, 25 bp, E. coli
ttgaaagagtttgatctcagcaacc

SEQ ID NO: 73374 - DNA, 25 bp, E. coli
ttgaaagagtttcatctcagcaacc

SEQ ID NO: 73375 - DNA, 25 bp, E. coli
tgatctcagcaacccgctggtccag

SEQ ID NO: 73376 - DNA, 25 bp, E. coli
tgatctcagcaagccgctggtccag

SEQ ID NO: 73377 - DNA, 25 bp, E. coli
tcagcaacccgcaggtccaggcgaa

SEQ ID NO: 73378 - DNA, 25 bp, E. coli
tcagcaacccgctggtccaggcgaa

SEQ ID NO: 73379 - DNA, 25 bp, E. coli
gaagttgaaagactttgatctcagc

SEQ ID NO: 73380 - DNA, 25 bp, E. coli
gcaacccgctggaccaggcgaagct

SEQ ID NO: 73381 - DNA, 25 bp, E. coli
gaagttgaaagagtttgatctcagc

SEQ ID NO: 73382 - DNA, 25 bp, E. coli
gcaacccgctggtccaggcgaagct

SEQ ID NO: 73383 - DNA, 25 bp, E. coli
gaaagagtttgatctcagcaacccg

SEQ ID NO: 73384 - DNA, 25 bp, E. coli
gaaagagtttgaactcagcaacccg

SEQ ID NO: 73385 - DNA, 25 bp, E. coli
gtttgatctcagcaacccgctggtc

SEQ ID NO: 73386 - DNA, 25 bp, E. coli
gtttgatctcaggaacccgctggtc

SEQ ID NO: 73387 - DNA, 25 bp, E. coli
gagtttgatctcagcaacccgctgg

SEQ ID NO: 73388 - DNA, 25 bp, E. coli
gagtttgatctctgcaacccgctgg

SEQ ID NO: 73389 - DNA, 25 bp, E. coli
tacgctataggaaggagtgcaacaa

SEQ ID NO: 73390 - DNA, 25 bp, E. coli
tacgctataggatggagtgcaacaa

SEQ ID NO: 73391 - DNA, 25 bp, E. coli
ttttgtagcacacgaccacttcggt

SEQ ID NO: 73392 - DNA, 25 bp, E. coli
ttaaataccatttccctggcccagg

SEQ ID NO: 73393 - DNA, 25 bp, E. coli
ttaaataccattaccctggcccagg

SEQ ID NO: 73394 - DNA, 25 bp, E. coli
ttttgtagcacaggaccacttcggt

SEQ ID NO: 73395 - DNA, 25 bp, E. coli
cctggcccaggtactattaatgttg

SEQ ID NO: 73396 - DNA, 25 bp, E. coli
ccacttcggtcttgatgtaactgat

SEQ ID NO: 73397 - DNA, 25 bp, E. coli
cctggcccaggttctattaatgttg

SEQ ID NO: 73398 - DNA, 25 bp, E. coli
ccacttcggtctagatgtaactgat

SEQ ID NO: 73399 - DNA, 25 bp, E. coli
gcattaattcaactccctcgacagg

SEQ ID NO: 73400 - DNA, 25 bp, E. coli
gcattaattcaagtccctcgacagg

SEQ ID NO: 73401 - DNA, 25 bp, E. coli
gcttttagtgccacaagttccggaa

SEQ ID NO: 73402 - DNA, 25 bp, E. coli
gcttttagtgcctcaagttccggaa

SEQ ID NO: 73403 - DNA, 25 bp, E. coli
gacttcgaggactgttttaatggct

SEQ ID NO: 73404 - DNA, 25 bp, E. coli
gacttcgaggacagttttaatggct

SEQ ID NO: 73405 - DNA, 25 bp, E. coli
gataccaacctcttatcctgcaaag

SEQ ID NO: 73406 - DNA, 25 bp, E. coli
gataccaacctcatatcctgcaaag

SEQ ID NO: 73407 - DNA, 25 bp, E. coli
ggaaatggcagcaattttcatagcc

SEQ ID NO: 73408 - DNA, 25 bp, E. coli
ggaaatggcagctattttcatagcc

SEQ ID NO: 73409 - DNA, 25 bp, E. coli
ggcctaagcgatttctcagcaaaag

SEQ ID NO: 73410 - DNA, 25 bp, E. coli
ggcctaagcgatatctcagcaaaag

SEQ ID NO: 73411 - DNA, 25 bp, E. coli
caaacttgtgccggatcggtaggcc

SEQ ID NO: 73412 - DNA, 25 bp, E. coli
caaacttgtgcccgatcggtaggcc

SEQ ID NO: 73413 - DNA, 25 bp, E. coli
catccggcagttctgcaccaatgct

SEQ ID NO: 73414 - DNA, 25 bp, E. coli
catccggcagttgtgcaccaatgct

SEQ ID NO: 73415 - DNA, 25 bp, E. coli
tacaaacttgtgccggatcggtagg

SEQ ID NO: 73416 - DNA, 25 bp, E. coli
tacaaacttgtggcggatcggtagg

SEQ ID NO: 73417 - DNA, 25 bp, E. coli
atccggcagttgagcaccaatgctg

SEQ ID NO: 73418 - DNA, 25 bp, E. coli
atccggcagttgtgcaccaatgctg

SEQ ID NO: 73419 - DNA, 25 bp, E. coli
tccggcagttgtgcaccaatgctgg

SEQ ID NO: 73420 - DNA, 25 bp, E. coli
tccggcagttgtccaccaatgctgg

SEQ ID NO: 73421 - DNA, 25 bp, E. coli
ccggcagttgtggaccaatgctgga

SEQ ID NO: 73422 - DNA, 25 bp, E. coli
ccggcagttgtgcaccaatgctgga

SEQ ID NO: 73423 - DNA, 25 bp, E. coli
gcatccggcagttgtgcaccaatgc

SEQ ID NO: 73424 - DNA, 25 bp, E. coli
gcatccggcagtagtgcaccaatgc

SEQ ID NO: 73425 - DNA, 25 bp, E. coli
gcagttgtgcaccaatgctggatac

SEQ ID NO: 73426 - DNA, 25 bp, E. coli
gcagttgtgcacgaatgctggatac

SEQ ID NO: 73427 - DNA, 25 bp, E. coli
cggcagttgtgcaccaatgctggat

SEQ ID NO: 73428 - DNA, 25 bp, E. coli
ctacaaacttgtgccggatcggtag

SEQ ID NO: 73429 - DNA, 25 bp, E. coli
cggcagttgtgctccaatgctggat

SEQ ID NO: 73430 - DNA, 25 bp, E. coli
ctacaaacttgtcccggatcggtag

SEQ ID NO: 73431 - DNA, 25 bp, E. coli
ggcagttgtgcagcaatgctggata

SEQ ID NO: 73432 - DNA, 25 bp, E. coli
ggcagttgtgcaccaatgctggata

SEQ ID NO: 73433 - DNA, 25 bp, E. coli
aatcacatcgaatactgagtctacg

SEQ ID NO: 73434 - DNA, 25 bp, E. coli
aatcacatcgaaaactgagtctacg

SEQ ID NO: 73435 - DNA, 25 bp, E. coli
caacttactgaaaatgctgtctgaa

SEQ ID NO: 73436 - DNA, 25 bp, E. coli
caacttactgaatatgctgtctgaa

SEQ ID NO: 73437 - DNA, 25 bp, E. coli
cagaatttccactagtacctgatgg

SEQ ID NO: 73438 - DNA, 25 bp, E. coli
cagtgactgggctagttcagtcaaa

SEQ ID NO: 73439 - DNA, 25 bp, E. coli
cagaatttccacaagtacctgatgg

SEQ ID NO: 73440 - DNA, 25 bp, E. coli
cagtgactgggcaagttcagtcaaa

SEQ ID NO: 73441 - DNA, 25 bp, E. coli
taccagacaccggtaaggtttttga

SEQ ID NO: 73442 - DNA, 25 bp, E. coli
tacctgatggaaataccctgatctc

SEQ ID NO: 73443 - DNA, 25 bp, E. coli
taccagacaccgctaaggtttttga

SEQ ID NO: 73444 - DNA, 25 bp, E. coli
tacctgatggaattaccctgatctc

SEQ ID NO: 73445 - DNA, 25 bp, E. coli
tattgactcatttccgccaaaggct

SEQ ID NO: 73446 - DNA, 25 bp, E. coli
tattgactcattaccgccaaaggct

SEQ ID NO: 73447 - DNA, 25 bp, E. coli
ttgcagagttgcaggacaagttaac

SEQ ID NO: 73448 - DNA, 25 bp, E. coli
ttgcagagttgctggacaagttaac

SEQ ID NO: 73449 - DNA, 25 bp, E. coli
cctgatctccgtaaataataacctg

SEQ ID NO: 73450 - DNA, 25 bp, E. coli
tcctgcgataccaggcaatttaaaa

SEQ ID NO: 73451 - DNA, 25 bp, E. coli
cctgatctccgttaataataacctg

SEQ ID NO: 73452 - DNA, 25 bp, E. coli
tcctgcgatacctggcaatttaaaa

SEQ ID NO: 73453 - DNA, 25 bp, E. coli
gaactcgatttcaataaccttacag

SEQ ID NO: 73454 - DNA, 25 bp, E. coli
gaactcgatttctataaccttacag

SEQ ID NO: 73455 - DNA, 25 bp, E. coli
tattctttcgcctctttcgttttag

SEQ ID NO: 73456 - DNA, 25 bp, E. coli
tattctttcgccactttcgttttag

SEQ ID NO: 73457 - DNA, 25 bp, E. coli
tagtggcattacgtattttacccgt

SEQ ID NO: 73458 - DNA, 25 bp, E. coli
tagtggcattacctattttacccgt

SEQ ID NO: 73459 - DNA, 25 bp, E. coli
taggttggtgccttcgtagtggcat

SEQ ID NO: 73460 - DNA, 25 bp, E. coli
taggttggtgccatcgtagtggcat

SEQ ID NO: 73461 - DNA, 25 bp, E. coli
ttagtgtattctttcgcctctttcg

SEQ ID NO: 73462 - DNA, 25 bp, E. coli
ttagtgtattctatcgcctctttcg

SEQ ID NO: 73463 - DNA, 25 bp, E. coli
ttggtgccttcgtagtggcattacg

SEQ ID NO: 73464 - DNA, 25 bp, E. coli
ttggtgccttcgaagtggcattacg

SEQ ID NO: 73465 - DNA, 25 bp, E. coli
tcgttttaggttggtgccttcgtag

SEQ ID NO: 73466 - DNA, 25 bp, E. coli
tcgttttaggttcgtgccttcgtag

SEQ ID NO: 73467 - DNA, 25 bp, E. coli
gtagtggcattacgtattttacccg

SEQ ID NO: 73468 - DNA, 25 bp, E. coli
gtagtggcattaggtattttacccg

SEQ ID NO: 73469 - DNA, 25 bp, E. coli
tcgcctctttcgatttaggttggtg

SEQ ID NO: 73470 - DNA, 25 bp, E. coli
cccgtttaatggaaacttcctcatg

SEQ ID NO: 73471 - DNA, 25 bp, E. coli
tcgcctctttcgttttaggttggtg

SEQ ID NO: 73472 - DNA, 25 bp, E. coli
cccgtttaatggtaacttcctcatg

SEQ ID NO: 73473 - DNA, 25 bp, E. coli
ggtgccttcgtagtggcattacgta

SEQ ID NO: 73474 - DNA, 25 bp, E. coli
ggtgccttcgtactggcattacgta

SEQ ID NO: 73475 - DNA, 25 bp, E. coli
gagtgttttagtgtattctttcgcc

SEQ ID NO: 73476 - DNA, 25 bp, E. coli
gagtgttttagtctattctttcgcc

SEQ ID NO: 73477 - DNA, 25 bp, E. coli
aatcagcgcgcctactacgcattga

SEQ ID NO: 73478 - DNA, 25 bp, E. coli
aatcagcgcgccaactacgcattga

SEQ ID NO: 73479 - DNA, 25 bp, E. coli
aaccagccaattccgctaacaatca

SEQ ID NO: 73480 - DNA, 25 bp, E. coli
aaccagccaattgcgctaacaatca

SEQ ID NO: 73481 - DNA, 25 bp, E. coli
tacgcattgacccaatacggtaaag

SEQ ID NO: 73482 - DNA, 25 bp, E. coli
atacggtaaagaaaaccagtggcca

SEQ ID NO: 73483 - DNA, 25 bp, E. coli
atacggtaaagataaccagtggcca

SEQ ID NO: 73484 - DNA, 25 bp, E. coli
caatacggtaaacataaccagtggc

SEQ ID NO: 73485 - DNA, 25 bp, E. coli
caatacggtaaagataaccagtggc

SEQ ID NO: 73486 - DNA, 25 bp, E. coli
tacgcattgaccgaatacggtaaag

SEQ ID NO: 73487 - DNA, 25 bp, E. coli
ttttggcggcgatccagccaattcc

SEQ ID NO: 73488 - DNA, 25 bp, E. coli
ttttggcggcgaaccagccaattcc

SEQ ID NO: 73489 - DNA, 25 bp, E. coli
gcgcctactacgcattgacccaata

SEQ ID NO: 73490 - DNA, 25 bp, E. coli
gcattgacccaaaacggtaaagata

SEQ ID NO: 73491 - DNA, 25 bp, E. coli
gcgcctactacggattgacccaata

SEQ ID NO: 73492 - DNA, 25 bp, E. coli
gcattgacccaatacggtaaagata

SEQ ID NO: 73493 - DNA, 25 bp, E. coli
gacccaatacggtaaagataaccag

SEQ ID NO: 73494 - DNA, 25 bp, E. coli
gacccaatacggaaaagataaccag

SEQ ID NO: 73495 - DNA, 25 bp, E. coli
tggcggcgaaccagccaattccgct

SEQ ID NO: 73496 - DNA, 25 bp, E. coli
ggcgaaccagccaattccgctaaca

SEQ ID NO: 73497 - DNA, 25 bp, E. coli
ggcgaaccagcctattccgctaaca

SEQ ID NO: 73498 - DNA, 25 bp, E. coli
tggcggcgaacctgccaattccgct

SEQ ID NO: 73499 - DNA, 25 bp, E. coli
cacgtagtgcccagttaaatgcaga

SEQ ID NO: 73500 - DNA, 25 bp, E. coli
cacgtagtgccctgttaaatgcaga

SEQ ID NO: 73501 - DNA, 25 bp, E. coli
cagacccaggcttgttacaggccag

SEQ ID NO: 73502 - DNA, 25 bp, E. coli
cagacccaggctagttacaggccag

SEQ ID NO: 73503 - DNA, 25 bp, E. coli
taaaaaacttgtcaatgccgggcaa

SEQ ID NO: 73504 - DNA, 25 bp, E. coli
tactctgatcatactatctggcagg

SEQ ID NO: 73505 - DNA, 25 bp, E. coli
taaaaaacttgtgaatgccgggcaa

SEQ ID NO: 73506 - DNA, 25 bp, E. coli
tactctgatcattctatctggcagg

SEQ ID NO: 73507 - DNA, 25 bp, E. coli
tataaaagcatgaccacctactctg

SEQ ID NO: 73508 - DNA, 25 bp, E. coli
tataaaagcatgtccacctactctg

SEQ ID NO: 73509 - DNA, 25 bp, E. coli
tgccgggcaagttcgtacaacacgt

SEQ ID NO: 73510 - DNA, 25 bp, E. coli
tgccgggcaagtacgtacaacacgt

SEQ ID NO: 73511 - DNA, 25 bp, E. coli
ccacatacacgtatgagtcaggtta

SEQ ID NO: 73512 - DNA, 25 bp, E. coli
ccacatacacgtttgagtcaggtta

SEQ ID NO: 73513 - DNA, 25 bp, E. coli
cattggattatcagagagcgacttt

SEQ ID NO: 73514 - DNA, 25 bp, E. coli
cgtactgatcgtctcgtttaaggag

SEQ ID NO: 73515 - DNA, 25 bp, E. coli
cattggattatctgagagcgacttt

SEQ ID NO: 73516 - DNA, 25 bp, E. coli
cgtactgatcgtgtcgtttaaggag

SEQ ID NO: 73517 - DNA, 25 bp, E. coli
tggcaggatgtttacagacccaggc

SEQ ID NO: 73518 - DNA, 25 bp, E. coli
tggaaaaacgcacaccacatacacg

SEQ ID NO: 73519 - DNA, 25 bp, E. coli
tggaaaaacgcagaccacatacacg

SEQ ID NO: 73520 - DNA, 25 bp, E. coli
tggcaggatgttaacagacccaggc

SEQ ID NO: 73521 - DNA, 25 bp, E. coli
caatccttttgtcataaatgaacgg

SEQ ID NO: 73522 - DNA, 25 bp, E. coli
caatccttttgtgataaatgaacgg

SEQ ID NO: 73523 - DNA, 25 bp, E. coli
taaaccagacattacgttctacgct

SEQ ID NO: 73524 - DNA, 25 bp, E. coli
taaaccagacataacgttctacgct

SEQ ID NO: 73525 - DNA, 25 bp, E. coli
aaaacggtgaatcgttcaagcaaat

SEQ ID NO: 73526 - DNA, 25 bp, E. coli
aaaacggtgaatggttcaagcaaat

SEQ ID NO: 73527 - DNA, 25 bp, E. coli
tatctttgcatatttaaccggatga

SEQ ID NO: 73528 - DNA, 25 bp, E. coli
tatctttgcataattaaccggatga

SEQ ID NO: 73529 - DNA, 25 bp, E. coli
ttactttttaagtctgatcccagcg

SEQ ID NO: 73530 - DNA, 25 bp, E. coli
ttactttttaagactgatcccagcg

SEQ ID NO: 73531 - DNA, 25 bp, E. coli
tgaaggttcattttataaaccagac

SEQ ID NO: 73532 - DNA, 25 bp, E. coli
tgaaggttcattatataaaccagac

SEQ ID NO: 73533 - DNA, 25 bp, E. coli
gcgcaaatctgcactcttcgacaat

SEQ ID NO: 73534 - DNA, 25 bp, E. coli
gcgcaaatctgctctcttcgacaat

SEQ ID NO: 73535 - DNA, 25 bp, E. coli
gaattatgtctggatcacgggaaga

SEQ ID NO: 73536 - DNA, 25 bp, E. coli
gaattatgtctgcatcacgggaaga

SEQ ID NO: 73537 - DNA, 25 bp, E. coli
gacaatttccacttaaaccatcggt

SEQ ID NO: 73538 - DNA, 25 bp, E. coli
gacaatttccacataaaccatcggt

SEQ ID NO: 73539 - DNA, 25 bp, E. coli
gatcccagcgttccgcaaatctgct

SEQ ID NO: 73540 - DNA, 25 bp, E. coli
ggtttgagaaacacatttctgcgca

SEQ ID NO: 73541 - DNA, 25 bp, E. coli
ggtttgagaaactcatttctgcgca

SEQ ID NO: 73542 - DNA, 25 bp, E. coli
gatcccagcgttgcgcaaatctgct

SEQ ID NO: 73543 - DNA, 25 bp, E. coli
caattgaacccgacttttatgaaga

SEQ ID NO: 73544 - DNA, 25 bp, E. coli
caattgaacccgtcttttatgaaga

SEQ ID NO: 73545 - DNA, 25 bp, E. coli
tgtaatgcagtcttgaagcaggctg

SEQ ID NO: 73546 - DNA, 25 bp, E. coli
tgtaatgcagtcatgaagcaggctg

SEQ ID NO: 73547 - DNA, 25 bp, E. coli
tccgcgaagtatataaagatgatgt

SEQ ID NO: 73548 - DNA, 25 bp, E. coli
tccgcgaagtatttaaagatgatgt

SEQ ID NO: 73549 - DNA, 25 bp, E. coli
tctgtatatgtttatgcactgcttc

SEQ ID NO: 73550 - DNA, 25 bp, E. coli
tctttcttagagcttgatgatccat

SEQ ID NO: 73551 - DNA, 25 bp, E. coli
tctttcttagaggttgatgatccat

SEQ ID NO: 73552 - DNA, 25 bp, E. coli
tctgtatatgttaatgcactgcttc

SEQ ID NO: 73553 - DNA, 25 bp, E. coli
gctgtatgtcgtcagaatccctcca

SEQ ID NO: 73554 - DNA, 25 bp, E. coli
gcttcaagcctaatcagagcatgga

SEQ ID NO: 73555 - DNA, 25 bp, E. coli
gctgtatgtcgtgagaatccctcca

SEQ ID NO: 73556 - DNA, 25 bp, E. coli
gcttcaagcctattcagagcatgga

SEQ ID NO: 73557 - DNA, 25 bp, E. coli
cgcttgaggtttttgtccgcgaagt

SEQ ID NO: 73558 - DNA, 25 bp, E. coli
cgcttgaggtttatgtccgcgaagt

SEQ ID NO: 73559 - DNA, 25 bp, E. coli
ggctgttctgactccaattgcacat

SEQ ID NO: 73560 - DNA, 25 bp, E. coli
ggctgttctgacaccaattgcacat

SEQ ID NO: 73561 - DNA, 25 bp, E. coli
taagtactttaacgagctgtatgtc

SEQ ID NO: 73562 - DNA, 25 bp, E. coli
taagtactttaaggagctgtatgtc

SEQ ID NO: 73563 - DNA, 25 bp, E. coli
gatgatccatacagacgacacttta

SEQ ID NO: 73564 - DNA, 25 bp, E. coli
gatgatccatactgacgacacttta

SEQ ID NO: 73565 - DNA, 25 bp, E. coli
catttggtacagcaataggcaagcg

SEQ ID NO: 73566 - DNA, 25 bp, E. coli
catttggtacaggaataggcaagcg

SEQ ID NO: 73567 - DNA, 25 bp, E. coli
tacaggaataggcaagcgcacgatt

SEQ ID NO: 73568 - DNA, 25 bp, E. coli
tacaggaatagggaagcgcacgatt

SEQ ID NO: 73569 - DNA, 25 bp, E. coli
tacatcgtattaaattatcatggca

SEQ ID NO: 73570 - DNA, 25 bp, E. coli
tacatcgtattatattatcatggca

SEQ ID NO: 73571 - DNA, 25 bp, E. coli
agtgctccatataataaatacatcg

SEQ ID NO: 73572 - DNA, 25 bp, E. coli
agtgctccatattataaatacatcg

SEQ ID NO: 73573 - DNA, 25 bp, E. coli
aaagcagctctgtagagcagagccg

SEQ ID NO: 73574 - DNA, 25 bp, E. coli
aaagcagctctgaagagcagagccg

SEQ ID NO: 73575 - DNA, 25 bp, E. coli
tatcataaaagcagctctgaagagc

SEQ ID NO: 73576 - DNA, 25 bp, E. coli
tatcataaaagctgctctgaagagc

SEQ ID NO: 73577 - DNA, 25 bp, E. coli
tggtacaggaattggcaagcgcacg

SEQ ID NO: 73578 - DNA, 25 bp, E. coli
cgtattaaattaacatggcataaag

SEQ ID NO: 73579 - DNA, 25 bp, E. coli
cgtattaaattatcatggcataaag

SEQ ID NO: 73580 - DNA, 25 bp, E. coli
tggtacaggaataggcaagcgcacg

SEQ ID NO: 73581 - DNA, 25 bp, E. coli
taatacatttggtacaggaataggc

SEQ ID NO: 73582 - DNA, 25 bp, E. coli
taattaacctttttcataaaagcag

SEQ ID NO: 73583 - DNA, 25 bp, E. coli
taattaacctttatcataaaagcag

SEQ ID NO: 73584 - DNA, 25 bp, E. coli
taaaatatctttgactaattaacct

SEQ ID NO: 73585 - DNA, 25 bp, E. coli
taatacatttggaacaggaataggc

SEQ ID NO: 73586 - DNA, 25 bp, E. coli
taaaatatctttcactaattaacct

SEQ ID NO: 73587 - DNA, 25 bp, E. coli
caatcaacggcgcaatggacgagaa

SEQ ID NO: 73588 - DNA, 25 bp, E. coli
caatcaacggcggaatggacgagaa

SEQ ID NO: 73589 - DNA, 25 bp, E. coli
taaagcgtgcacagcatccgttcgg

SEQ ID NO: 73590 - DNA, 25 bp, E. coli
taaagcgtgcactgcatccgttcgg

SEQ ID NO: 73591 - DNA, 25 bp, E. coli
aaatagtgggtcagcaaacggatgc

SEQ ID NO: 73592 - DNA, 25 bp, E. coli
aaatagtgggtctgcaaacggatgc

SEQ ID NO: 73593 - DNA, 25 bp, E. coli
aaacggatgcgcgattaaagcgtgc

SEQ ID NO: 73594 - DNA, 25 bp, E. coli
aaacggatgcgccattaaagcgtgc

SEQ ID NO: 73595 - DNA, 25 bp, E. coli
tgcacggtcgtgttcgcaaaggcgc

SEQ ID NO: 73596 - DNA, 25 bp, E. coli
tgcacggtcgtgatcgcaaaggcgc

SEQ ID NO: 73597 - DNA, 25 bp, E. coli
cctggcggtggaattcgagattgac

SEQ ID NO: 73598 - DNA, 25 bp, E. coli
cctggcggtggatttcgagattgac

SEQ ID NO: 73599 - DNA, 25 bp, E. coli
gctgtgccgacccaatcgattctga

SEQ ID NO: 73600 - DNA, 25 bp, E. coli
gctgtgccgaccgaatcgattctga

SEQ ID NO: 73601 - DNA, 25 bp, E. coli
gaagatctcgaagctacgctccgtc

SEQ ID NO: 73602 - DNA, 25 bp, E. coli
gaagatctcgaacctacgctccgtc

SEQ ID NO: 73603 - DNA, 25 bp, E. coli
gaaaatgcgactgacgcgccattgg

SEQ ID NO: 73604 - DNA, 25 bp, E. coli
gaaaatgcgactcacgcgccattgg

SEQ ID NO: 73605 - DNA, 25 bp, E. coli
gactattctgtgctcggaagccttg

SEQ ID NO: 73606 - DNA, 25 bp, E. coli
gactattctgtggtcggaagccttg

SEQ ID NO: 73607 - DNA, 25 bp, E. coli
ggcgctttacggcatcagttatctg

SEQ ID NO: 73608 - DNA, 25 bp, E. coli
ggcgctttacgggatcagttatctg

SEQ ID NO: 73609 - DNA, 25 bp, E. coli
caagtcgcgtgttatgcaatgaaaa

SEQ ID NO: 73610 - DNA, 25 bp, E. coli
caagtcgcgtgtaatgcaatgaaaa

SEQ ID NO: 73611 - DNA, 25 bp, E. coli
caaagcagagtatgcgataagtcgc

SEQ ID NO: 73612 - DNA, 25 bp, E. coli
caaagcagagtaagcgataagtcgc

SEQ ID NO: 73613 - DNA, 25 bp, E. coli
catcgatgaatggacaggaggttat

SEQ ID NO: 73614 - DNA, 25 bp, E. coli
catcgatgaatgcacaggaggttat

SEQ ID NO: 73615 - DNA, 25 bp, E. coli
ttttggagccatggaatgatcatcg

SEQ ID NO: 73616 - DNA, 25 bp, E. coli
ttttggagccatcgaatgatcatcg

SEQ ID NO: 73617 - DNA, 25 bp, E. coli
tgggcctggcgtgggttacaacaaa

SEQ ID NO: 73618 - DNA, 25 bp, E. coli
tgggcctggcgtcggttacaacaaa

SEQ ID NO: 73619 - DNA, 25 bp, E. coli
tgttggtccctgagcatccggctaa

SEQ ID NO: 73620 - DNA, 25 bp, E. coli
tgttggtccctgtgcatccggctaa

SEQ ID NO: 73621 - DNA, 25 bp, E. coli
tttcgaatgcaaaatcccgagtcgt

SEQ ID NO: 73622 - DNA, 25 bp, E. coli
tttcgaatgcaatatcccgagtcgt

SEQ ID NO: 73623 - DNA, 25 bp, E. coli
gaacaataattgtgtgcaggcatcg

SEQ ID NO: 73624 - DNA, 25 bp, E. coli
gaacaataattgagtgcaggcatcg

SEQ ID NO: 73625 - DNA, 25 bp, E. coli
gaaaaggacatcgtgttacagcgcg

SEQ ID NO: 73626 - DNA, 25 bp, E. coli
gaaaaggacatcctgttacagcgcg

SEQ ID NO: 73627 - DNA, 25 bp, E. coli
gagttgtcgcaaataatcacggagc

SEQ ID NO: 73628 - DNA, 25 bp, E. coli
gagttgtcgcaattaatcacggagc

SEQ ID NO: 73629 - DNA, 25 bp, E. coli
gaggttatcatttctgggcctggcg

SEQ ID NO: 73630 - DNA, 25 bp, E. coli
gaggttatcattactgggcctggcg

SEQ ID NO: 73631 - DNA, 25 bp, E. coli
cactggcggctctgttggataaatc

SEQ ID NO: 73632 - DNA, 25 bp, E. coli
cactggcggctcagttggataaatc

SEQ ID NO: 73633 - DNA, 25 bp, E. coli
cataccgtggaacaagtgaaggcaa

SEQ ID NO: 73634 - DNA, 25 bp, E. coli
cattaccggtcatgcgtgggatctc

SEQ ID NO: 73635 - DNA, 25 bp, E. coli
cataccgtggaagaagtgaaggcaa

SEQ ID NO: 73636 - DNA, 25 bp, E. coli
cattaccggtcaagcgtgggatctc

SEQ ID NO: 73637 - DNA, 25 bp, E. coli
caggaagcgctttcacgtcagtggc

SEQ ID NO: 73638 - DNA, 25 bp, E. coli
caggaagcgcttacacgtcagtggc

SEQ ID NO: 73639 - DNA, 25 bp, E. coli
taccggcaatatcaaactggcgctc

SEQ ID NO: 73640 - DNA, 25 bp, E. coli
taccggcaatatgaaactggcgctc

SEQ ID NO: 73641 - DNA, 25 bp, E. coli
tatcaggctcgtttctggcaggcaa

SEQ ID NO: 73642 - DNA, 25 bp, E. coli
tatcaggctcgtatctggcaggcaa

SEQ ID NO: 73643 - DNA, 25 bp, E. coli
tgaaatgactcctcgccagtggtgg

SEQ ID NO: 73644 - DNA, 25 bp, E. coli
tgaaatgactccacgccagtggtgg

SEQ ID NO: 73645 - DNA, 25 bp, E. coli
tcgactgcaggtaaagaagcttccg

SEQ ID NO: 73646 - DNA, 25 bp, E. coli
tcgactgcaggttaagaagcttccg

SEQ ID NO: 73647 - DNA, 25 bp, E. coli
gcgtaaactgcacgaactggcggat

SEQ ID NO: 73648 - DNA, 25 bp, E. coli
gcgtaaactgcaggaactggcggat

SEQ ID NO: 73649 - DNA, 25 bp, E. coli
gaaattccgtcagcaatatcgcgag

SEQ ID NO: 73650 - DNA, 25 bp, E. coli
gaaattccgtcaccaatatcgcgag

SEQ ID NO: 73651 - DNA, 25 bp, E. coli
gatcaagcaggcgaataaagtccgt

SEQ ID NO: 73652 - DNA, 25 bp, E. coli
gatcaagcaggccaataaagtccgt

SEQ ID NO: 73653 - DNA, 25 bp, E. coli
caatttactgacgagctgcgcggca

SEQ ID NO: 73654 - DNA, 25 bp, E. coli
caatttactgaccagctgcgcggca

SEQ ID NO: 73655 - DNA, 25 bp, E. coli
catccggtcacggaatttactgacc

SEQ ID NO: 73656 - DNA, 25 bp, E. coli
catccggtcacgcaatttactgacc

SEQ ID NO: 73657 - DNA, 25 bp, E. coli
tactgaccagctccgcggcattatt

SEQ ID NO: 73658 - DNA, 25 bp, E. coli
tactgaccagctgcgcggcattatt

SEQ ID NO: 73659 - DNA, 25 bp, E. coli
agtgccagattacattcatctgccg

SEQ ID NO: 73660 - DNA, 25 bp, E. coli
agtgccagattagattcatctgccg

SEQ ID NO: 73661 - DNA, 25 bp, E. coli
acttcaatttctggggcagcaggca

SEQ ID NO: 73662 - DNA, 25 bp, E. coli
acttcaatttctcgggcagcaggca

SEQ ID NO: 73663 - DNA, 25 bp, E. coli
ttacattcatctgccgctggcgctt

SEQ ID NO: 73664 - DNA, 25 bp, E. coli
ttacattcatctcccgctggcgctt

SEQ ID NO: 73665 - DNA, 25 bp, E. coli
tctgcactgggacggcgatgttctc

SEQ ID NO: 73666 - DNA, 25 bp, E. coli
tctgcactgggagggcgatgttctc

SEQ ID NO: 73667 - DNA, 25 bp, E. coli
gccgtcaaaaactggcggcttaccg

SEQ ID NO: 73668 - DNA, 25 bp, E. coli
gccgtcaaaaacaggcggcttaccg

SEQ ID NO: 73669 - DNA, 25 bp, E. coli
gcagcaggcagatgcacactggcag

SEQ ID NO: 73670 - DNA, 25 bp, E. coli
gcagcaggcagaagcacactggcag

SEQ ID NO: 73671 - DNA, 25 bp, E. coli
gattacattcatctgccgctggcgc

SEQ ID NO: 73672 - DNA, 25 bp, E. coli
gattacattcatgtgccgctggcgc

SEQ ID NO: 73673 - DNA, 25 bp, E. coli
ggcgatccacgcccggtactaatcg

SEQ ID NO: 73674 - DNA, 25 bp, E. coli
ggcgatccacgcgcggtactaatcg

SEQ ID NO: 73675 - DNA, 25 bp, E. coli
caaacatggtgggagtactgcatta

SEQ ID NO: 73676 - DNA, 25 bp, E. coli
caaacatggtggcagtactgcatta

SEQ ID NO: 73677 - DNA, 25 bp, E. coli
taaaaattccgttgtgccgactggt

SEQ ID NO: 73678 - DNA, 25 bp, E. coli
taaaaattccgtagtgccgactggt

SEQ ID NO: 73679 - DNA, 25 bp, E. coli
agtgccgactggttttggctggtta

SEQ ID NO: 73680 - DNA, 25 bp, E. coli
agtgccgactggatttggctggtta

SEQ ID NO: 73681 - DNA, 25 bp, E. coli
ttagcgcccggcttggctccagcgg

SEQ ID NO: 73682 - DNA, 25 bp, E. coli
ttagcgcccggcatggctccagcgg

SEQ ID NO: 73683 - DNA, 25 bp, E. coli
tgaggataaaaggaatgaaatggtt

SEQ ID NO: 73684 - DNA, 25 bp, E. coli
tgaggataaaagcaatgaaatggtt

SEQ ID NO: 73685 - DNA, 25 bp, E. coli
cgtcactcacgagaaaaaatggctg

SEQ ID NO: 73686 - DNA, 25 bp, E. coli
ctccagcggttggagcgggtctgct

SEQ ID NO: 73687 - DNA, 25 bp, E. coli
cgtcactcacgacaaaaaatggctg

SEQ ID NO: 73688 - DNA, 25 bp, E. coli
ctccagcggttgcagcgggtctgct

SEQ ID NO: 73689 - DNA, 25 bp, E. coli
gattgtttatgacgtcactcacgac

SEQ ID NO: 73690 - DNA, 25 bp, E. coli
gattgtttatgaggtcactcacgac

SEQ ID NO: 73691 - DNA, 25 bp, E. coli
taagtacctgatggactatgaaaat

SEQ ID NO: 73692 - DNA, 25 bp, E. coli
taacaccctaagccacaaccgttgg

SEQ ID NO: 73693 - DNA, 25 bp, E. coli
taacaccctaaggcacaaccgttgg

SEQ ID NO: 73694 - DNA, 25 bp, E. coli
taagtacctgatcgactatgaaaat

SEQ ID NO: 73695 - DNA, 25 bp, E. coli
gagtactgcatttagtacctgatgg

SEQ ID NO: 73696 - DNA, 25 bp, E. coli
gagtactgcattaagtacctgatgg

SEQ ID NO: 73697 - DNA, 25 bp, E. coli
aatgcaccgtttcggcgtattgccg

SEQ ID NO: 73698 - DNA, 25 bp, E. coli
aatgcaccgtttgggcgtattgccg

SEQ ID NO: 73699 - DNA, 25 bp, E. coli
taaagagcctgtcaccgtctggatg

SEQ ID NO: 73700 - DNA, 25 bp, E. coli
taaagagcctgtgaccgtctggatg

SEQ ID NO: 73701 - DNA, 25 bp, E. coli
attgttagtcacatcgcccgtgccg

SEQ ID NO: 73702 - DNA, 25 bp, E. coli
attgttagtcacttcgcccgtgccg

SEQ ID NO: 73703 - DNA, 25 bp, E. coli
taccgcagtccacaatgaagagcag

SEQ ID NO: 73704 - DNA, 25 bp, E. coli
taccgcagtccagaatgaagagcag

SEQ ID NO: 73705 - DNA, 25 bp, E. coli
tccgccagccggagaacattgttag

SEQ ID NO: 73706 - DNA, 25 bp, E. coli
tccgccagccggtgaacattgttag

SEQ ID NO: 73707 - DNA, 25 bp, E. coli
tctgagccagtgtaaaaatgtccgc

SEQ ID NO: 73708 - DNA, 25 bp, E. coli
tctgagccagtgaaaaaatgtccgc

SEQ ID NO: 73709 - DNA, 25 bp, E. coli
gcttgtcgccctcgaaaacgctgaa

SEQ ID NO: 73710 - DNA, 25 bp, E. coli
gctcaattgcgggatcaggcggcat

SEQ ID NO: 73711 - DNA, 25 bp, E. coli
gctcaattgcggcatcaggcggcat

SEQ ID NO: 73712 - DNA, 25 bp, E. coli
gcttgtcgccctggaaaacgctgaa

SEQ ID NO: 73713 - DNA, 25 bp, E. coli
gaagcagacgatttgccgacgatct

SEQ ID NO: 73714 - DNA, 25 bp, E. coli
gaagcagacgatatgccgacgatct

SEQ ID NO: 73715 - DNA, 25 bp, E. coli
cctacggtcacggtctgattgagac

SEQ ID NO: 73716 - DNA, 25 bp, E. coli
cctacggtcacgctctgattgagac

SEQ ID NO: 73717 - DNA, 25 bp, E. coli
ggcgcgactgaatagcagctcgata

SEQ ID NO: 73718 - DNA, 25 bp, E. coli
ggcgcgactgaaaagcagctcgata

SEQ ID NO: 73719 - DNA, 25 bp, E. coli
cagaatggcgattacggtcgacggc

SEQ ID NO: 73720 - DNA, 25 bp, E. coli
cagaaactcgatttggtcaggaatt

SEQ ID NO: 73721 - DNA, 25 bp, E. coli
cagaatggcgataacggtcgacggc

SEQ ID NO: 73722 - DNA, 25 bp, E. coli
cacctgctgcgccatgataaacgcg

SEQ ID NO: 73723 - DNA, 25 bp, E. coli
cacctgctgcgcgatgataaacgcg

SEQ ID NO: 73724 - DNA, 25 bp, E. coli
cagaaactcgatatggtcaggaatt

SEQ ID NO: 73725 - DNA, 25 bp, E. coli
aggaattttccaggcgctgagcccc

SEQ ID NO: 73726 - DNA, 25 bp, E. coli
agcggccagtggtccagaaactcga

SEQ ID NO: 73727 - DNA, 25 bp, E. coli
agcggccagtggaccagaaactcga

SEQ ID NO: 73728 - DNA, 25 bp, E. coli
aggaattttccacgcgctgagcccc

SEQ ID NO: 73729 - DNA, 25 bp, E. coli
aaatccgctcgcgaagcagcgtgtc

SEQ ID NO: 73730 - DNA, 25 bp, E. coli
aaatccgctcgccaagcagcgtgtc

SEQ ID NO: 73731 - DNA, 25 bp, E. coli
tttttgtctatcttgccgacggcgg

SEQ ID NO: 73732 - DNA, 25 bp, E. coli
tttttgtctatcatgccgacggcgg

SEQ ID NO: 73733 - DNA, 25 bp, E. coli
tgttgacgcaactgctgatagtcag

SEQ ID NO: 73734 - DNA, 25 bp, E. coli
tgatagtcagttcgcacctgctgcg

SEQ ID NO: 73735 - DNA, 25 bp, E. coli
tgttgacgcaacagctgatagtcag

SEQ ID NO: 73736 - DNA, 25 bp, E. coli
tgatagtcagttggcacctgctgcg

SEQ ID NO: 73737 - DNA, 25 bp, E. coli
ccatacgggtcacttgttgacgcaa

SEQ ID NO: 73738 - DNA, 25 bp, E. coli
ccatacgggtcagttgttgacgcaa

SEQ ID NO: 73739 - DNA, 25 bp, E. coli
cggcgagagccgtcaggcgtttttt

SEQ ID NO: 73740 - DNA, 25 bp, E. coli
cggcgagagccgacaggcgtttttt

SEQ ID NO: 73741 - DNA, 25 bp, E. coli
caatctggctggactcttcgtatac

SEQ ID NO: 73742 - DNA, 25 bp, E. coli
caatctggctggtctcttcgtatac

SEQ ID NO: 73743 - DNA, 25 bp, E. coli
caaataattaatgagttagccgaga

SEQ ID NO: 73744 - DNA, 25 bp, E. coli
cagtccagataatatgatgtcaacg

SEQ ID NO: 73745 - DNA, 25 bp, E. coli
caaataattaatcagttagccgaga

SEQ ID NO: 73746 - DNA, 25 bp, E. coli
cagtccagataaaatgatgtcaacg

SEQ ID NO: 73747 - DNA, 25 bp, E. coli
tagccgagagataaacaacactagg

SEQ ID NO: 73748 - DNA, 25 bp, E. coli
tagccgagagattaacaacactagg

SEQ ID NO: 73749 - DNA, 25 bp, E. coli
tatagggaatgataagatcaaggca

SEQ ID NO: 73750 - DNA, 25 bp, E. coli
tatagggaatgaaaagatcaaggca

SEQ ID NO: 73751 - DNA, 25 bp, E. coli
tatctgacaaaattaacagccagcc

SEQ ID NO: 73752 - DNA, 25 bp, E. coli
tatctgacaaaaataacagccagcc

SEQ ID NO: 73753 - DNA, 25 bp, E. coli
tccttggtcgtgttaaagggcgtct

SEQ ID NO: 73754 - DNA, 25 bp, E. coli
tccttggtcgtgataaagggcgtct

SEQ ID NO: 73755 - DNA, 25 bp, E. coli
tcagaaatctatagtgaatctcgct

SEQ ID NO: 73756 - DNA, 25 bp, E. coli
gcttctaagaaaaactgttggcgaa

SEQ ID NO: 73757 - DNA, 25 bp, E. coli
gcttctaagaaatactgttggcgaa

SEQ ID NO: 73758 - DNA, 25 bp, E. coli
tcagaaatctattgtgaatctcgct

SEQ ID NO: 73759 - DNA, 25 bp, E. coli
taaccaaagaaatccaatctggctg

SEQ ID NO: 73760 - DNA, 25 bp, E. coli
taagacatcatctacgacttcaaag

SEQ ID NO: 73761 - DNA, 25 bp, E. coli
taaccaaagaaaaccaatctggctg

SEQ ID NO: 73762 - DNA, 25 bp, E. coli
taagacatcatcaacgacttcaaag

SEQ ID NO: 73763 - DNA, 25 bp, E. coli
aaccgggcgatcaatgatgcggagt

SEQ ID NO: 73764 - DNA, 25 bp, E. coli
aaccgggcgatctatgatgcggagt

SEQ ID NO: 73765 - DNA, 25 bp, E. coli
ttaaccgggcgatcaatgatgcgga

SEQ ID NO: 73766 - DNA, 25 bp, E. coli
ttaaccgggcgaacaatgatgcgga

SEQ ID NO: 73767 - DNA, 25 bp, E. coli
tctggatgagctaaaccgggcgatc

SEQ ID NO: 73768 - DNA, 25 bp, E. coli
tcgtccgctgggtgtgaggttatga

SEQ ID NO: 73769 - DNA, 25 bp, E. coli
tctctggatgaggttaaccgggcga

SEQ ID NO: 73770 - DNA, 25 bp, E. coli
tctggatgagcttaaccgggcgatc

SEQ ID NO: 73771 - DNA, 25 bp, E. coli
tctctggatgagcttaaccgggcga

SEQ ID NO: 73772 - DNA, 25 bp, E. coli
tcgtccgctgggagtgaggttatga

SEQ ID NO: 73773 - DNA, 25 bp, E. coli
gcttaaccgggccatcaatgatgcg

SEQ ID NO: 73774 - DNA, 25 bp, E. coli
gcttctctggatgagcttaaccggg

SEQ ID NO: 73775 - DNA, 25 bp, E. coli
gcggcttctctggatgagcttaacc

SEQ ID NO: 73776 - DNA, 25 bp, E. coli
gcttaaccgggcgatcaatgatgcg

SEQ ID NO: 73777 - DNA, 25 bp, E. coli
gcggcttctctgcatgagcttaacc

SEQ ID NO: 73778 - DNA, 25 bp, E. coli
gcttctctggatcagcttaaccggg

SEQ ID NO: 73779 - DNA, 25 bp, E. coli
gaattgaatatagggcggcttctct

SEQ ID NO: 73780 - DNA, 25 bp, E. coli
gaattgaatatacggcggcttctct

SEQ ID NO: 73781 - DNA, 25 bp, E. coli
cgccgtcgtccgctgggagtgaggt

SEQ ID NO: 73782 - DNA, 25 bp, E. coli
cgccgtcgtccggtgggagtgaggt

SEQ ID NO: 73783 - DNA, 25 bp, E. coli
ggatgagcttaaccgggcgatcaat

SEQ ID NO: 73784 - DNA, 25 bp, E. coli
ggatgagcttaagcgggcgatcaat

SEQ ID NO: 73785 - DNA, 25 bp, E. coli
cagttgctggactgggtttccccgt

SEQ ID NO: 73786 - DNA, 25 bp, E. coli
cagttgctggacagggtttccccgt

SEQ ID NO: 73787 - DNA, 25 bp, E. coli
ttccccgtctcagtgggcggcaata

SEQ ID NO: 73788 - DNA, 25 bp, E. coli
ttccccgtctcactgggcggcaata

SEQ ID NO: 73789 - DNA, 25 bp, E. coli
tgggaacgggctactggttcctgca

SEQ ID NO: 73790 - DNA, 25 bp, E. coli
tgggaacgggcttctggttcctgca

SEQ ID NO: 73791 - DNA, 25 bp, E. coli
tgcagttgctggacagggtttcccc

SEQ ID NO: 73792 - DNA, 25 bp, E. coli
tgcagttgctggtcagggtttcccc

SEQ ID NO: 73793 - DNA, 25 bp, E. coli
tgctggacagggattccccgtctca

SEQ ID NO: 73794 - DNA, 25 bp, E. coli
tgctggacagggtttccccgtctca

SEQ ID NO: 73795 - DNA, 25 bp, E. coli
gctactggttcctgcagttgctgga

SEQ ID NO: 73796 - DNA, 25 bp, E. coli
gctactggttccagcagttgctgga

SEQ ID NO: 73797 - DNA, 25 bp, E. coli
gaacgggctactggttcctgcagtt

SEQ ID NO: 73798 - DNA, 25 bp, E. coli
gaacgggctactcgttcctgcagtt

SEQ ID NO: 73799 - DNA, 25 bp, E. coli
ggtttccccgtcacagtgggcggca

SEQ ID NO: 73800 - DNA, 25 bp, E. coli
ggtttccccgtctcagtgggcggca

SEQ ID NO: 73801 - DNA, 25 bp, E. coli
cgggctactggttcctgcagttgct

SEQ ID NO: 73802 - DNA, 25 bp, E. coli
ctactggttcctccagttgctggac

SEQ ID NO: 73803 - DNA, 25 bp, E. coli
cgggctactggtacctgcagttgct

SEQ ID NO: 73804 - DNA, 25 bp, E. coli
ctactggttcctgcagttgctggac

SEQ ID NO: 73805 - DNA, 25 bp, E. coli
tggacagggtttgcccgtctcagtg

SEQ ID NO: 73806 - DNA, 25 bp, E. coli
tggacagggtttccccgtctcagtg

SEQ ID NO: 73807 - DNA, 25 bp, E. coli
caagtcgtgccatttgtcagccagg

SEQ ID NO: 73808 - DNA, 25 bp, E. coli
caagtcgtgccaattgtcagccagg

SEQ ID NO: 73809 - DNA, 25 bp, E. coli
caaaaattcttacagggatatgcta

SEQ ID NO: 73810 - DNA, 25 bp, E. coli
caaaaattcttagagggatatgcta

SEQ ID NO: 73811 - DNA, 25 bp, E. coli
tagagggatatggtataaatcaaaa

SEQ ID NO: 73812 - DNA, 25 bp, E. coli
tagagggatatgctataaatcaaaa

SEQ ID NO: 73813 - DNA, 25 bp, E. coli
tttaccccggatattgcagcatcgc

SEQ ID NO: 73814 - DNA, 25 bp, E. coli
tttaccccggattttgcagcatcgc

SEQ ID NO: 73815 - DNA, 25 bp, E. coli
tgtcagccaggaacgggtctttacc

SEQ ID NO: 73816 - DNA, 25 bp, E. coli
tgtcagccaggatcgggtctttacc

SEQ ID NO: 73817 - DNA, 25 bp, E. coli
tgttcaccgcttttcgtcaagtcgt

SEQ ID NO: 73818 - DNA, 25 bp, E. coli
tgttcaccgcttatcgtcaagtcgt

SEQ ID NO: 73819 - DNA, 25 bp, E. coli
tgcagcatcgcataaattcttagag

SEQ ID NO: 73820 - DNA, 25 bp, E. coli
tgcagcatcgcaaaaattcttagag

SEQ ID NO: 73821 - DNA, 25 bp, E. coli
tgccatttgtcagccaggatcgggt

SEQ ID NO: 73822 - DNA, 25 bp, E. coli
tgccatttgtcacccaggatcgggt

SEQ ID NO: 73823 - DNA, 25 bp, E. coli
gcttttcgtcaactcgtgccatttg

SEQ ID NO: 73824 - DNA, 25 bp, E. coli
gatcgggtctttaccccggatattg

SEQ ID NO: 73825 - DNA, 25 bp, E. coli
gcttttcgtcaagtcgtgccatttg

SEQ ID NO: 73826 - DNA, 25 bp, E. coli
gatcgggtcttttccccggatattg

SEQ ID NO: 73827 - DNA, 25 bp, E. coli
cccggatattgcagcatcgcaaaaa

SEQ ID NO: 73828 - DNA, 25 bp, E. coli
cccggatattgctgcatcgcaaaaa

SEQ ID NO: 73829 - DNA, 25 bp, E. coli
cataagctgacgctgcacggcggtt

SEQ ID NO: 73830 - DNA, 25 bp, E. coli
cataagctgacggtgcacggcggtt

SEQ ID NO: 73831 - DNA, 25 bp, E. coli
cattatggcgaaagcctgggaagcg

SEQ ID NO: 73832 - DNA, 25 bp, E. coli
atgaacatggcgaacagggatcggc

SEQ ID NO: 73833 - DNA, 25 bp, E. coli
aggcgtataccaccacctttgcgga

SEQ ID NO: 73834 - DNA, 25 bp, E. coli
atgaacatggcgtacagggatcggc

SEQ ID NO: 73835 - DNA, 25 bp, E. coli
aggcgtataccagcacctttgcgga

SEQ ID NO: 73836 - DNA, 25 bp, E. coli
ttcgccatacgccaccggaagtgat

SEQ ID NO: 73837 - DNA, 25 bp, E. coli
ttcgccatacgcgaccggaagtgat

SEQ ID NO: 73838 - DNA, 25 bp, E. coli
gaatgtttgcaatcgctggagcgag

SEQ ID NO: 73839 - DNA, 25 bp, E. coli
gaatgtttgcaaacgctggagcgag

SEQ ID NO: 73840 - DNA, 25 bp, E. coli
gaaaccggcgtgcacggcataaagc

SEQ ID NO: 73841 - DNA, 25 bp, E. coli
gaaaccggcgtggacggcataaagc

SEQ ID NO: 73842 - DNA, 25 bp, E. coli
cattatggcgaatgcctgggaagcg

SEQ ID NO: 73843 - DNA, 25 bp, E. coli
tggaggattacacgctcactgccgg

SEQ ID NO: 73844 - DNA, 25 bp, E. coli
tggaggattacaggctcactgccgg

SEQ ID NO: 73845 - DNA, 25 bp, E. coli
taaccgtgacggaaccatcgggcgt

SEQ ID NO: 73846 - DNA, 25 bp, E. coli
taaccgcgctaatcgctatctggcc

SEQ ID NO: 73847 - DNA, 25 bp, E. coli
tcactgccggagaaatgattcgcca

SEQ ID NO: 73848 - DNA, 25 bp, E. coli
taaccgtgacggtaccatcgggcgt

SEQ ID NO: 73849 - DNA, 25 bp, E. coli
taaccgcgctaaacgctatctggcc

SEQ ID NO: 73850 - DNA, 25 bp, E. coli
tcactgccggagtaatgattcgcca

SEQ ID NO: 73851 - DNA, 25 bp, E. coli
cagaaacgccgttgactgtaccggg

SEQ ID NO: 73852 - DNA, 25 bp, E. coli
cagaaacgccgtagactgtaccggg

SEQ ID NO: 73853 - DNA, 25 bp, E. coli
tacactggcggagtggagcaattcg

SEQ ID NO: 73854 - DNA, 25 bp, E. coli
tacactggcggactggagcaattcg

SEQ ID NO: 73855 - DNA, 25 bp, E. coli
tatcctgccgtagatggtgcgctgc

SEQ ID NO: 73856 - DNA, 25 bp, E. coli
tatcggaagagggacagaacgttac

SEQ ID NO: 73857 - DNA, 25 bp, E. coli
tatcggaagaggcacagaacgttac

SEQ ID NO: 73858 - DNA, 25 bp, E. coli
tatcctgccgtacatggtgcgctgc

SEQ ID NO: 73859 - DNA, 25 bp, E. coli
tatatggaaaaaccgctgacacgcc

SEQ ID NO: 73860 - DNA, 25 bp, E. coli
tatatggaaaaagcgctgacacgcc

SEQ ID NO: 73861 - DNA, 25 bp, E. coli
ttgatgcatcgttaagcacgcggcg

SEQ ID NO: 73862 - DNA, 25 bp, E. coli
ttgatgcatcgtaaagcacgcggcg

SEQ ID NO: 73863 - DNA, 25 bp, E. coli
tgtaccgggtgcaactgaagtcgct

SEQ ID NO: 73864 - DNA, 25 bp, E. coli
tgtaccgggtgctactgaagtcgct

SEQ ID NO: 73865 - DNA, 25 bp, E. coli
tctttaagaaatggaatccgggcgc

SEQ ID NO: 73866 - DNA, 25 bp, E. coli
tctttaagaaatcgaatccgggcgc

SEQ ID NO: 73867 - DNA, 25 bp, E. coli
gccagagttttagagcgagcgtgaa

SEQ ID NO: 73868 - DNA, 25 bp, E. coli
cctgaccggacgtgagaagcatgaa

SEQ ID NO: 73869 - DNA, 25 bp, E. coli
cctgaccggacgagagaagcatgaa

SEQ ID NO: 73870 - DNA, 25 bp, E. coli
gccagagttttacagcgagcgtgaa

SEQ ID NO: 73871 - DNA, 25 bp, E. coli
gaatatctggaggagagcaacaacc

SEQ ID NO: 73872 - DNA, 25 bp, E. coli
gaatatctggagcagagcaacaacc

SEQ ID NO: 73873 - DNA, 25 bp, E. coli
caatgtgctgatgcccttgctcaag

SEQ ID NO: 73874 - DNA, 25 bp, E. coli
caatgtgctgatccccttgctcaag

SEQ ID NO: 73875 - DNA, 25 bp, E. coli
tgttgaaagttcgtcagcactctgg

SEQ ID NO: 73876 - DNA, 25 bp, E. coli
tgttgaaagttcctcagcactctgg

SEQ ID NO: 73877 - DNA, 25 bp, E. coli
gccgcaggcagtgaagaacgtatcg

SEQ ID NO: 73878 - DNA, 25 bp, E. coli
gccgcaggcagtcaagaacgtatcg

SEQ ID NO: 73879 - DNA, 25 bp, E. coli
gctcggagtttgtaagacgcgctaa

SEQ ID NO: 73880 - DNA, 25 bp, E. coli
gctcggagtttgaaagacgcgctaa

SEQ ID NO: 73881 - DNA, 25 bp, E. coli
gatagtaagaatccccatgctcacg

SEQ ID NO: 73882 - DNA, 25 bp, E. coli
gatagtaagaatgcccatgctcacg

SEQ ID NO: 73883 - DNA, 25 bp, E. coli
ggtgtcaatgttccacgctcggagt

SEQ ID NO: 73884 - DNA, 25 bp, E. coli
ggtgtcaatgttgcacgctcggagt

SEQ ID NO: 73885 - DNA, 25 bp, E. coli
ggaaaactgatagcactgatgctga

SEQ ID NO: 73886 - DNA, 25 bp, E. coli
ggaaaactgataccactgatgctga

SEQ ID NO: 73887 - DNA, 25 bp, E. coli
tcaaacagctacgttgaagccgcag

SEQ ID NO: 73888 - DNA, 25 bp, E. coli
tcaagcagaggatgcattcagcgct

SEQ ID NO: 73889 - DNA, 25 bp, E. coli
tcaagcagaggaagcattcagcgct

SEQ ID NO: 73890 - DNA, 25 bp, E. coli
tcaaacagctaccttgaagccgcag

SEQ ID NO: 73891 - DNA, 25 bp, E. coli
gagtcacaggaacaacgagctgccg

SEQ ID NO: 73892 - DNA, 25 bp, E. coli
gagtcacaggaagaacgagctgccg

SEQ ID NO: 73893 - DNA, 25 bp, E. coli
gatccaatggcgagaatcatgggcc

SEQ ID NO: 73894 - DNA, 25 bp, E. coli
gatccaatggcgtgaatcatgggcc

SEQ ID NO: 73895 - DNA, 25 bp, E. coli
caaacagactttactatcagtgagt

SEQ ID NO: 73896 - DNA, 25 bp, E. coli
caaacagacttttctatcagtgagt

SEQ ID NO: 73897 - DNA, 25 bp, E. coli
taaagatagtgtagtatgttgcgcc

SEQ ID NO: 73898 - DNA, 25 bp, E. coli
taaagatagtgttgtatgttgcgcc

SEQ ID NO: 73899 - DNA, 25 bp, E. coli
tatgttgcgcctgaaagccaggccg

SEQ ID NO: 73900 - DNA, 25 bp, E. coli
tatgttgcgcctcaaagccaggccg

SEQ ID NO: 73901 - DNA, 25 bp, E. coli
tatcagtgagtcagatgtaagttct

SEQ ID NO: 73902 - DNA, 25 bp, E. coli
tatcagacgcctcggaaggcgacac

SEQ ID NO: 73903 - DNA, 25 bp, E. coli
tatcagtgagtctgatgtaagttct

SEQ ID NO: 73904 - DNA, 25 bp, E. coli
tatcagacgcctgggaaggcgacac

SEQ ID NO: 73905 - DNA, 25 bp, E. coli
tgttgcacaaaagcatatcagacgc

SEQ ID NO: 73906 - DNA, 25 bp, E. coli
tgttgcacaaaaccatatcagacgc

SEQ ID NO: 73907 - DNA, 25 bp, E. coli
gaaggcgacaccaaaaggaagctct

SEQ ID NO: 73908 - DNA, 25 bp, E. coli
gaaggcgacacctaaaggaagctct

SEQ ID NO: 73909 - DNA, 25 bp, E. coli
cgtcgagtcgttaacttaaggcctg

SEQ ID NO: 73910 - DNA, 25 bp, E. coli
cgtcgagtcgtttacttaaggcctg

SEQ ID NO: 73911 - DNA, 25 bp, E. coli
taagctgatgtttatcgaaacaagc

SEQ ID NO: 73912 - DNA, 25 bp, E. coli
taagttctgactgactgttgcacaa

SEQ ID NO: 73913 - DNA, 25 bp, E. coli
taaggcctgaagagttcaaacagac

SEQ ID NO: 73914 - DNA, 25 bp, E. coli
taagttctgactcactgttgcacaa

SEQ ID NO: 73915 - DNA, 25 bp, E. coli
taagctgatgttaatcgaaacaagc

SEQ ID NO: 73916 - DNA, 25 bp, E. coli
taaggcctgaagtgttcaaacagac

SEQ ID NO: 73917 - DNA, 25 bp, E. coli
taaacatgccctgcttgctcatcaa

SEQ ID NO: 73918 - DNA, 25 bp, E. coli
taaacatgccctccttgctcatcaa

SEQ ID NO: 73919 - DNA, 25 bp, E. coli
acgcggttatctcgaacgtagtggc

SEQ ID NO: 73920 - DNA, 25 bp, E. coli
acgcggttatctggaacgtagtggc

SEQ ID NO: 73921 - DNA, 25 bp, E. coli
tgttgataaacaagccctgcttgct

SEQ ID NO: 73922 - DNA, 25 bp, E. coli
tgttgataaacatgccctgcttgct

SEQ ID NO: 73923 - DNA, 25 bp, E. coli
tgttaaaggcgaagttgacgcggtt

SEQ ID NO: 73924 - DNA, 25 bp, E. coli
tgttaaaggcgatgttgacgcggtt

SEQ ID NO: 73925 - DNA, 25 bp, E. coli
tgcttgctcatctacagcgagtagt

SEQ ID NO: 73926 - DNA, 25 bp, E. coli
tgcttgctcatcaacagcgagtagt

SEQ ID NO: 73927 - DNA, 25 bp, E. coli
tcgcgtggagtgattacttaacggc

SEQ ID NO: 73928 - DNA, 25 bp, E. coli
tcgcgtggagtgtttacttaacggc

SEQ ID NO: 73929 - DNA, 25 bp, E. coli
tctggtcgagatggataacaaagca

SEQ ID NO: 73930 - DNA, 25 bp, E. coli
tcatcaacagcgtgtagtcagtggg

SEQ ID NO: 73931 - DNA, 25 bp, E. coli
tctggtcgagatcgataacaaagca

SEQ ID NO: 73932 - DNA, 25 bp, E. coli
tcatcaacagcgagtagtcagtggg

SEQ ID NO: 73933 - DNA, 25 bp, E. coli
gctgcgtgcagtagttgataaacat

SEQ ID NO: 73934 - DNA, 25 bp, E. coli
gctgcgtgcagttgttgataaacat

SEQ ID NO: 73935 - DNA, 25 bp, E. coli
gatgttgacgcgcttatctggaacg

SEQ ID NO: 73936 - DNA, 25 bp, E. coli
gagtgtttacttaacggcgtgtatg

SEQ ID NO: 73937 - DNA, 25 bp, E. coli
gatgttgacgcggttatctggaacg

SEQ ID NO: 73938 - DNA, 25 bp, E. coli
gagtgtttactttacggcgtgtatg

SEQ ID NO: 73939 - DNA, 25 bp, E. coli
cagcgtattgctggctgtatttcga

SEQ ID NO: 73940 - DNA, 25 bp, E. coli
cagcgtattgctcgctgtatttcga

SEQ ID NO: 73941 - DNA, 25 bp, E. coli
tacgcatcagcgtattgctggctgt

SEQ ID NO: 73942 - DNA, 25 bp, E. coli
tacgcatcagcgaattgctggctgt

SEQ ID NO: 73943 - DNA, 25 bp, E. coli
tgctggctgtatatcgagttataag

SEQ ID NO: 73944 - DNA, 25 bp, E. coli
tgctggctgtatttcgagttataag

SEQ ID NO: 73945 - DNA, 25 bp, E. coli
gccatacgcatctgcgtattgctgg

SEQ ID NO: 73946 - DNA, 25 bp, E. coli
gccatacgcatcagcgtattgctgg

SEQ ID NO: 73947 - DNA, 25 bp, E. coli
gctgtatttcgacttataagggcca

SEQ ID NO: 73948 - DNA, 25 bp, E. coli
gctgtatttcgagttataagggcca

SEQ ID NO: 73949 - DNA, 25 bp, E. coli
gaaggccatacggatcagcgtattg

SEQ ID NO: 73950 - DNA, 25 bp, E. coli
gcagaaggccatacgcatcagcgta

SEQ ID NO: 73951 - DNA, 25 bp, E. coli
gaaggccatacgcatcagcgtattg

SEQ ID NO: 73952 - DNA, 25 bp, E. coli
gcagaaggccattcgcatcagcgta

SEQ ID NO: 73953 - DNA, 25 bp, E. coli
cgcatcagcgtattgctggctgtat

SEQ ID NO: 73954 - DNA, 25 bp, E. coli
cgcatcagcgtaatgctggctgtat

SEQ ID NO: 73955 - DNA, 25 bp, E. coli
cgtattgctggcagtatttcgagtt

SEQ ID NO: 73956 - DNA, 25 bp, E. coli
cgtattgctggctgtatttcgagtt

SEQ ID NO: 73957 - DNA, 25 bp, E. coli
gtatttcgagttttaagggccatct

SEQ ID NO: 73958 - DNA, 25 bp, E. coli
gtatttcgagttataagggccatct

SEQ ID NO: 73959 - DNA, 25 bp, E. coli
tggcagaaggccttacgcatcagcg

SEQ ID NO: 73960 - DNA, 25 bp, E. coli
tggcagaaggccatacgcatcagcg

SEQ ID NO: 73961 - DNA, 25 bp, E. coli
caacttcaccgctatcggtcggcag

SEQ ID NO: 73962 - DNA, 25 bp, E. coli
caacttcaccgcaatcggtcggcag

SEQ ID NO: 73963 - DNA, 25 bp, E. coli
atgtcgtaaccggtgatatcaccac

SEQ ID NO: 73964 - DNA, 25 bp, E. coli
atgtcgtaaccgctgatatcaccac

SEQ ID NO: 73965 - DNA, 25 bp, E. coli
aaaacgttcgcctctccagcttggg

SEQ ID NO: 73966 - DNA, 25 bp, E. coli
aaaacgttcgccactccagcttggg

SEQ ID NO: 73967 - DNA, 25 bp, E. coli
tatcggtcggcacatccagccttat

SEQ ID NO: 73968 - DNA, 25 bp, E. coli
tatcggtcggcagatccagccttat

SEQ ID NO: 73969 - DNA, 25 bp, E. coli
tcgccactccagcttgggtaaaaga

SEQ ID NO: 73970 - DNA, 25 bp, E. coli
tcgccactccaggttgggtaaaaga

SEQ ID NO: 73971 - DNA, 25 bp, E. coli
ccactccagcttgggtaaaagatgc

SEQ ID NO: 73972 - DNA, 25 bp, E. coli
ccttatctggagcagggcaaatgct

SEQ ID NO: 73973 - DNA, 25 bp, E. coli
ccagccttatctggaggagggcaaa

SEQ ID NO: 73974 - DNA, 25 bp, E. coli
ccagccttatctcgaggagggcaaa

SEQ ID NO: 73975 - DNA, 25 bp, E. coli
ccttatctggaggagggcaaatgct

SEQ ID NO: 73976 - DNA, 25 bp, E. coli
ccactccagcttcggtaaaagatgc

SEQ ID NO: 73977 - DNA, 25 bp, E. coli
gcggcaacttcagcgctatcggtcg

SEQ ID NO: 73978 - DNA, 25 bp, E. coli
gcggcaacttcaccgctatcggtcg

SEQ ID NO: 73979 - DNA, 25 bp, E. coli
gggtaaaacgttggccactccagct

SEQ ID NO: 73980 - DNA, 25 bp, E. coli
gggtaaaacgttcgccactccagct

SEQ ID NO: 73981 - DNA, 25 bp, E. coli
gatccagccttaactggaggagggc

SEQ ID NO: 73982 - DNA, 25 bp, E. coli
gatccagccttatctggaggagggc

SEQ ID NO: 73983 - DNA, 25 bp, E. coli
cagaacgccgtaaagacagttttgg

SEQ ID NO: 73984 - DNA, 25 bp, E. coli
cagcactgaagcctataccggtcgt

SEQ ID NO: 73985 - DNA, 25 bp, E. coli
cagcactgaagcgtataccggtcgt

SEQ ID NO: 73986 - DNA, 25 bp, E. coli
cagaacgccgtatagacagttttgg

SEQ ID NO: 73987 - DNA, 25 bp, E. coli
aggatattcccgctgtgctggctgt

SEQ ID NO: 73988 - DNA, 25 bp, E. coli
atattcccggtgtgctggctgtgtt

SEQ ID NO: 73989 - DNA, 25 bp, E. coli
aggatattcccggtgtgctggctgt

SEQ ID NO: 73990 - DNA, 25 bp, E. coli
atattcccggtgagctggctgtgtt

SEQ ID NO: 73991 - DNA, 25 bp, E. coli
tattcccggtgtcctggctgtgttt

SEQ ID NO: 73992 - DNA, 25 bp, E. coli
tattcccggtgtgctggctgtgttt

SEQ ID NO: 73993 - DNA, 25 bp, E. coli
ttgcagaacgccctaaagacagttt

SEQ ID NO: 73994 - DNA, 25 bp, E. coli
ttgcagaacgccgtaaagacagttt

SEQ ID NO: 73995 - DNA, 25 bp, E. coli
tgtgtttgcagatcgccgtaaagac

SEQ ID NO: 73996 - DNA, 25 bp, E. coli
gctgtgtttgcacaacgccgtaaag

SEQ ID NO: 73997 - DNA, 25 bp, E. coli
gctgtgtttgcagaacgccgtaaag

SEQ ID NO: 73998 - DNA, 25 bp, E. coli
ctgtgtttgcagtacgccgtaaaga

SEQ ID NO: 73999 - DNA, 25 bp, E. coli
ctgtgtttgcagaacgccgtaaaga

SEQ ID NO: 74000 - DNA, 25 bp, E. coli
gatattcccggtgtgctggctgtgt

SEQ ID NO: 74001 - DNA, 25 bp, E. coli
gatattcccggtctgctggctgtgt

SEQ ID NO: 74002 - DNA, 25 bp, E. coli
ggctgtgtttgcagaacgccgtaaa

SEQ ID NO: 74003 - DNA, 25 bp, E. coli
tgtgtttgcagaacgccgtaaagac

SEQ ID NO: 74004 - DNA, 25 bp, E. coli
ggctgtgtttgctgaacgccgtaaa

SEQ ID NO: 74005 - DNA, 25 bp, E. coli
caaacccaactgaatggcggtgcac

SEQ ID NO: 74006 - DNA, 25 bp, E. coli
caaacccaactgtatggcggtgcac

SEQ ID NO: 74007 - DNA, 25 bp, E. coli
ttaccgacggcatattaaatatcgt

SEQ ID NO: 74008 - DNA, 25 bp, E. coli
ttaccgacggcaaattaaatatcgt

SEQ ID NO: 74009 - DNA, 25 bp, E. coli
taccgacggcaaattaaatatcgtc

SEQ ID NO: 74010 - DNA, 25 bp, E. coli
attaccgacggcaaattaaatatcg

SEQ ID NO: 74011 - DNA, 25 bp, E. coli
attaccgacggctaattaaatatcg

SEQ ID NO: 74012 - DNA, 25 bp, E. coli
acccaactgtatggcggtgcaccgg

SEQ ID NO: 74013 - DNA, 25 bp, E. coli
aaacccaactgtatggcggtgcacc

SEQ ID NO: 74014 - DNA, 25 bp, E. coli
aacccaactgtatggcggtgcaccg

SEQ ID NO: 74015 - DNA, 25 bp, E. coli
aaacccaactgtttggcggtgcacc

SEQ ID NO: 74016 - DNA, 25 bp, E. coli
aacccaactgtaaggcggtgcaccg

SEQ ID NO: 74017 - DNA, 25 bp, E. coli
acccaactgtatcgcggtgcaccgg

SEQ ID NO: 74018 - DNA, 25 bp, E. coli
taccgacggcaatttaaatatcgtc

SEQ ID NO: 74019 - DNA, 25 bp, E. coli
cccaactgtatgccggtgcaccggt

SEQ ID NO: 74020 - DNA, 25 bp, E. coli
cccaactgtatggcggtgcaccggt

SEQ ID NO: 74021 - DNA, 25 bp, E. coli
tcaaacccaactgtatggcggtgca

SEQ ID NO: 74022 - DNA, 25 bp, E. coli
tcaaacccaactctatggcggtgca

SEQ ID NO: 74023 - DNA, 25 bp, E. coli
aatctgctgatgttccctccgtgga

SEQ ID NO: 74024 - DNA, 25 bp, E. coli
aattgaggcagccttggtgaagcac

SEQ ID NO: 74025 - DNA, 25 bp, E. coli
aatctgctgatgatccctccgtgga

SEQ ID NO: 74026 - DNA, 25 bp, E. coli
aattgaggcagcgttggtgaagcac

SEQ ID NO: 74027 - DNA, 25 bp, E. coli
taaagaacaatctgctgatgatccc

SEQ ID NO: 74028 - DNA, 25 bp, E. coli
taaagaacaatcagctgatgatccc

SEQ ID NO: 74029 - DNA, 25 bp, E. coli
tgtatagaacataaggtgtctctgg

SEQ ID NO: 74030 - DNA, 25 bp, E. coli
tgtatagaacattaggtgtctctgg

SEQ ID NO: 74031 - DNA, 25 bp, E. coli
cctccgtggatcagattcgtgtaaa

SEQ ID NO: 74032 - DNA, 25 bp, E. coli
cctccgtggatctgattcgtgtaaa

SEQ ID NO: 74033 - DNA, 25 bp, E. coli
gcaccatttctaagagttaccctga

SEQ ID NO: 74034 - DNA, 25 bp, E. coli
gcaccatttctatgagttaccctga

SEQ ID NO: 74035 - DNA, 25 bp, E. coli
cattcagggcaattgaggcagcgtt

SEQ ID NO: 74036 - DNA, 25 bp, E. coli
cattcagggcaaatgaggcagcgtt

SEQ ID NO: 74037 - DNA, 25 bp, E. coli
gttaccctgatgatgtaattgcatg

SEQ ID NO: 74038 - DNA, 25 bp, E. coli
gttaccctgatgttgtaattgcatg

SEQ ID NO: 74039 - DNA, 25 bp, E. coli
ggattattccctggtggttgactga

SEQ ID NO: 74040 - DNA, 25 bp, E. coli
ggtgtctctggaagcattcagggca

SEQ ID NO: 74041 - DNA, 25 bp, E. coli
ggtgaagcacgaaaataatatgaag

SEQ ID NO: 74042 - DNA, 25 bp, E. coli
ggtgtctctggatgcattcagggca

SEQ ID NO: 74043 - DNA, 25 bp, E. coli
ggtgaagcacgataataatatgaag

SEQ ID NO: 74044 - DNA, 25 bp, E. coli
ggattattccctcgtggttgactga

SEQ ID NO: 74045 - DNA, 25 bp, E. coli
catatttcgacgcccctaatctggg

SEQ ID NO: 74046 - DNA, 25 bp, E. coli
catatttcgacggccctaatctggg

SEQ ID NO: 74047 - DNA, 25 bp, E. coli
cagagaggcatatttcgacgcccct

SEQ ID NO: 74048 - DNA, 25 bp, E. coli
cagagaggcataattcgacgcccct

SEQ ID NO: 74049 - DNA, 25 bp, E. coli
ttgattcaggatctctggaataatc

SEQ ID NO: 74050 - DNA, 25 bp, E. coli
ttgattcaggatgtctggaataatc

SEQ ID NO: 74051 - DNA, 25 bp, E. coli
tggtcagagagggatatttcgacgc

SEQ ID NO: 74052 - DNA, 25 bp, E. coli
tggtcagagaggcatatttcgacgc

SEQ ID NO: 74053 - DNA, 25 bp, E. coli
gagaggcatatttcgacgcccctaa

SEQ ID NO: 74054 - DNA, 25 bp, E. coli
gagaggcatattacgacgcccctaa

SEQ ID NO: 74055 - DNA, 25 bp, E. coli
cgtttgattcaggatgtctggaata

SEQ ID NO: 74056 - DNA, 25 bp, E. coli
cgtttgattcagcatgtctggaata

SEQ ID NO: 74057 - DNA, 25 bp, E. coli
gtcagagaggcatatttcgacgccc

SEQ ID NO: 74058 - DNA, 25 bp, E. coli
gtcagagaggcaaatttcgacgccc

SEQ ID NO: 74059 - DNA, 25 bp, E. coli
ggcatatttcgaggcccctaatctg

SEQ ID NO: 74060 - DNA, 25 bp, E. coli
ggcatatttcgacgcccctaatctg

SEQ ID NO: 74061 - DNA, 25 bp, E. coli
ggcgtttgattcaggatgtctggaa

SEQ ID NO: 74062 - DNA, 25 bp, E. coli
ggcgtttgattctggatgtctggaa

SEQ ID NO: 74063 - DNA, 25 bp, E. coli
tcagagaggcatttttcgacgcccc

SEQ ID NO: 74064 - DNA, 25 bp, E. coli
tcagagaggcatatttcgacgcccc

SEQ ID NO: 74065 - DNA, 25 bp, E. coli
gaggcatatttccacgcccctaatc

SEQ ID NO: 74066 - DNA, 25 bp, E. coli
gaggcatatttcgacgcccctaatc

SEQ ID NO: 74067 - DNA, 25 bp, E. coli
caaaaatatcgattccccaaaagat

SEQ ID NO: 74068 - DNA, 25 bp, E. coli
caaaaatatcgaatccccaaaagat

SEQ ID NO: 74069 - DNA, 25 bp, E. coli
aaaaacggtcctcatcagagaaccg

SEQ ID NO: 74070 - DNA, 25 bp, E. coli
aaaaacggtcctgatcagagaaccg

SEQ ID NO: 74071 - DNA, 25 bp, E. coli
tatgtcatcaaaaatatcgattccc

SEQ ID NO: 74072 - DNA, 25 bp, E. coli
tatgtcatcaaatatatcgattccc

SEQ ID NO: 74073 - DNA, 25 bp, E. coli
ttagttattcgatcaaattagcgga

SEQ ID NO: 74074 - DNA, 25 bp, E. coli
ttagttattcgaacaaattagcgga

SEQ ID NO: 74075 - DNA, 25 bp, E. coli
tcgatcaaattagcggatgaaaaat

SEQ ID NO: 74076 - DNA, 25 bp, E. coli
tcgatcaaattaccggatgaaaaat

SEQ ID NO: 74077 - DNA, 25 bp, E. coli
gctaaatcctgcatatgtcatcaaa

SEQ ID NO: 74078 - DNA, 25 bp, E. coli
gctaaatcctgcttatgtcatcaaa

SEQ ID NO: 74079 - DNA, 25 bp, E. coli
cgtcgataagtgagagctaaatcct

SEQ ID NO: 74080 - DNA, 25 bp, E. coli
cgtcgataagtgtgagctaaatcct

SEQ ID NO: 74081 - DNA, 25 bp, E. coli
gattccccaaaacatttacttaatg

SEQ ID NO: 74082 - DNA, 25 bp, E. coli
gattccccaaaagatttacttaatg

SEQ ID NO: 74083 - DNA, 25 bp, E. coli
gataagtgtgaggtaaatcctgctt

SEQ ID NO: 74084 - DNA, 25 bp, E. coli
gataagtgtgagctaaatcctgctt

SEQ ID NO: 74085 - DNA, 25 bp, E. coli
ggtcctcatcagtgaaccgtattag

SEQ ID NO: 74086 - DNA, 25 bp, E. coli
ggtcctcatcagagaaccgtattag

SEQ ID NO: 74087 - DNA, 25 bp, E. coli
gagaaccgtatttgttattcgatca

SEQ ID NO: 74088 - DNA, 25 bp, E. coli
gagaaccgtattagttattcgatca

SEQ ID NO: 74089 - DNA, 25 bp, E. coli
aatctggcacaacggtgaacagcgc

SEQ ID NO: 74090 - DNA, 25 bp, E. coli
aatctggcacaagggtgaacagcgc

SEQ ID NO: 74091 - DNA, 25 bp, E. coli
tactggaacgttatgggccacagcg

SEQ ID NO: 74092 - DNA, 25 bp, E. coli
tactggaacgttttgggccacagcg

SEQ ID NO: 74093 - DNA, 25 bp, E. coli
actggtctcggatgcggtaaacggc

SEQ ID NO: 74094 - DNA, 25 bp, E. coli
actggtctcggaagcggtaaacggc

SEQ ID NO: 74095 - DNA, 25 bp, E. coli
tataaaatggaatcagcacggcggc

SEQ ID NO: 74096 - DNA, 25 bp, E. coli
tataaaatggaaacagcacggcggc

SEQ ID NO: 74097 - DNA, 25 bp, E. coli
tgtgaaatcccctatggtctggcgc

SEQ ID NO: 74098 - DNA, 25 bp, E. coli
tgtgaaatccccaatggtctggcgc

SEQ ID NO: 74099 - DNA, 25 bp, E. coli
tcgatgaacagctctacgccctggt

SEQ ID NO: 74100 - DNA, 25 bp, E. coli
tcgatgaacagcactacgccctggt

SEQ ID NO: 74101 - DNA, 25 bp, E. coli
tctggcgattacaaggcgacggaat

SEQ ID NO: 74102 - DNA, 25 bp, E. coli
tctggcgattactaggcgacggaat

SEQ ID NO: 74103 - DNA, 25 bp, E. coli
gcgcgcgccgcaaaaaccattgtta

SEQ ID NO: 74104 - DNA, 25 bp, E. coli
gcgcgcgccgcataaaccattgtta

SEQ ID NO: 74105 - DNA, 25 bp, E. coli
gaacgaataccaggttgcaggcggt

SEQ ID NO: 74106 - DNA, 25 bp, E. coli
gaacgaataccacgttgcaggcggt

SEQ ID NO: 74107 - DNA, 25 bp, E. coli
gatacctgaatggacatccgcgcct

SEQ ID NO: 74108 - DNA, 25 bp, E. coli
gatacctgaatgcacatccgcgcct

SEQ ID NO: 74109 - DNA, 25 bp, E. coli
tggcacggaaatgtacgaacctctg

SEQ ID NO: 74110 - DNA, 25 bp, E. coli
tggcacggaaatctacgaacctctg

SEQ ID NO: 74111 - DNA, 25 bp, E. coli
aacgatactcatgcggtgctgtcga

SEQ ID NO: 74112 - DNA, 25 bp, E. coli
aatgtggtggtaaatccgaaagcgc

SEQ ID NO: 74113 - DNA, 25 bp, E. coli
aatgtggtggtatatccgaaagcgc

SEQ ID NO: 74114 - DNA, 25 bp, E. coli
cgtgttggacgatcacttgggccgc

SEQ ID NO: 74115 - DNA, 25 bp, E. coli
cgtgttggacgaacacttgggccgc

SEQ ID NO: 74116 - DNA, 25 bp, E. coli
aacgatactcatccggtgctgtcga

SEQ ID NO: 74117 - DNA, 25 bp, E. coli
ttggacgaacacatgggccgcaact

SEQ ID NO: 74118 - DNA, 25 bp, E. coli
ttggacgaacacttgggccgcaact

SEQ ID NO: 74119 - DNA, 25 bp, E. coli
tgcgattcacctgaacgatactcat

SEQ ID NO: 74120 - DNA, 25 bp, E. coli
tgcgattcacctcaacgatactcat

SEQ ID NO: 74121 - DNA, 25 bp, E. coli
cctgatggtgcaatcgctatttgcc

SEQ ID NO: 74122 - DNA, 25 bp, E. coli
cctgatggtgcattcgctatttgcc

SEQ ID NO: 74123 - DNA, 25 bp, E. coli
gctgaatgtggtggtaaatccgaaa

SEQ ID NO: 74124 - DNA, 25 bp, E. coli
gctgaatgtggtcgtaaatccgaaa

SEQ ID NO: 74125 - DNA, 25 bp, E. coli
ccgaaagcgctgttcgatgtgcaaa

SEQ ID NO: 74126 - DNA, 25 bp, E. coli
ccgaaagcgctgatcgatgtgcaaa

SEQ ID NO: 74127 - DNA, 25 bp, E. coli
ctctaacctgatggtgcaatcgcta

SEQ ID NO: 74128 - DNA, 25 bp, E. coli
ctctaacctgatcgtgcaatcgcta

SEQ ID NO: 74129 - DNA, 25 bp, E. coli
gataaaattgcgattcacctcaacg

SEQ ID NO: 74130 - DNA, 25 bp, E. coli
gataaaattgcgtttcacctcaacg

SEQ ID NO: 74131 - DNA, 25 bp, E. coli
ggtggtaaatccgaaagcgctgttc

SEQ ID NO: 74132 - DNA, 25 bp, E. coli
ggtggtaaatcccaaagcgctgttc

SEQ ID NO: 74133 - DNA, 25 bp, E. coli
aatctggagactccctttgcgctgc

SEQ ID NO: 74134 - DNA, 25 bp, E. coli
caatggtcattgaggccgctgacaa

SEQ ID NO: 74135 - DNA, 25 bp, E. coli
aatctggagactgcctttgcgctgc

SEQ ID NO: 74136 - DNA, 25 bp, E. coli
caatggtcattgtggccgctgacaa

SEQ ID NO: 74137 - DNA, 25 bp, E. coli
agcatactggcgtcctgaaaggcgg

SEQ ID NO: 74138 - DNA, 25 bp, E. coli
agcatactggcgacctgaaaggcgg

SEQ ID NO: 74139 - DNA, 25 bp, E. coli
tttgtactggaagctgaccgcacgc

SEQ ID NO: 74140 - DNA, 25 bp, E. coli
tttgtactggaacctgaccgcacgc

SEQ ID NO: 74141 - DNA, 25 bp, E. coli
tgaaaacgggcgagcttgaaaccaa

SEQ ID NO: 74142 - DNA, 25 bp, E. coli
tgaaaacgggcgtgcttgaaaccaa

SEQ ID NO: 74143 - DNA, 25 bp, E. coli
tcaccgaagtggacagggaaaactg

SEQ ID NO: 74144 - DNA, 25 bp, E. coli
gaatgcccgcacatggtggaaacca

SEQ ID NO: 74145 - DNA, 25 bp, E. coli
gaatgcccgcacttggtggaaacca

SEQ ID NO: 74146 - DNA, 25 bp, E. coli
gaaaccaactggatcagctggctga

SEQ ID NO: 74147 - DNA, 25 bp, E. coli
gaaaccaactggttcagctggctga

SEQ ID NO: 74148 - DNA, 25 bp, E. coli
gtaatcaatggtcgcgttacccagg

SEQ ID NO: 74149 - DNA, 25 bp, E. coli
gtaatcaatggtggcgttacccagg

SEQ ID NO: 74150 - DNA, 25 bp, E. coli
tggtttgaataccaacccgccaccg

SEQ ID NO: 74151 - DNA, 25 bp, E. coli
tggtttgaatacgaacccgccaccg

SEQ ID NO: 74152 - DNA, 25 bp, E. coli
tcaccgaagtggtcagggaaaactg

SEQ ID NO: 74153 - DNA, 25 bp, E. coli
gacgcctgcgtgtcagaacatcctg

SEQ ID NO: 74154 - DNA, 25 bp, E. coli
gacgcctgcgtgacagaacatcctg

SEQ ID NO: 74155 - DNA, 25 bp, E. coli
caaccgttattaaatgctgatggcc

SEQ ID NO: 74156 - DNA, 25 bp, E. coli
caaccgttattatatgctgatggcc

SEQ ID NO: 74157 - DNA, 25 bp, E. coli
catggtcacgggaaacatatattga

SEQ ID NO: 74158 - DNA, 25 bp, E. coli
catggtcacgggtaacatatattga

SEQ ID NO: 74159 - DNA, 25 bp, E. coli
agtatgtacgccgtggtgtagacca

SEQ ID NO: 74160 - DNA, 25 bp, E. coli
agtatgtacgccctggtgtagacca

SEQ ID NO: 74161 - DNA, 25 bp, E. coli
tattaaatgctgatggcccggtgaa

SEQ ID NO: 74162 - DNA, 25 bp, E. coli
tatttctctgacgaatttcaaccgt

SEQ ID NO: 74163 - DNA, 25 bp, E. coli
tattaaatgctgttggcccggtgaa

SEQ ID NO: 74164 - DNA, 25 bp, E. coli
tatttctctgaccaatttcaaccgt

SEQ ID NO: 74165 - DNA, 25 bp, E. coli
tttgaggcgaaaaagctgcgccgcg

SEQ ID NO: 74166 - DNA, 25 bp, E. coli
tttgaggcgaaatagctgcgccgcg

SEQ ID NO: 74167 - DNA, 25 bp, E. coli
tgatggcccggtcaagtatgtacgc

SEQ ID NO: 74168 - DNA, 25 bp, E. coli
tgatggcccggtgaagtatgtacgc

SEQ ID NO: 74169 - DNA, 25 bp, E. coli
cctggtgtagaccattttgaggcga

SEQ ID NO: 74170 - DNA, 25 bp, E. coli
gccgcattgctgctgttgattgaag

SEQ ID NO: 74171 - DNA, 25 bp, E. coli
cctggtgtagacgattttgaggcga

SEQ ID NO: 74172 - DNA, 25 bp, E. coli
gccgcattgctggtgttgattgaag

SEQ ID NO: 74173 - DNA, 25 bp, E. coli
gttgatcgccgcctgtcgccgcgaa

SEQ ID NO: 74174 - DNA, 25 bp, E. coli
gttgacgccagtgactatttctctg

SEQ ID NO: 74175 - DNA, 25 bp, E. coli
gttgatcgccgcgtgtcgccgcgaa

SEQ ID NO: 74176 - DNA, 25 bp, E. coli
gttgacgccagtcactatttctctg

SEQ ID NO: 74177 - DNA, 25 bp, E. coli
aacatgctttgctgcgctgggaacc

SEQ ID NO: 74178 - DNA, 25 bp, E. coli
aacatgctttgcagcgctgggaacc

SEQ ID NO: 74179 - DNA, 25 bp, E. coli
ttcaggaagccgaccggtgaatgcc

SEQ ID NO: 74180 - DNA, 25 bp, E. coli
ttcaggaagccgtccggtgaatgcc

SEQ ID NO: 74181 - DNA, 25 bp, E. coli
tgtattggctgcaagctttgcgccg

SEQ ID NO: 74182 - DNA, 25 bp, E. coli
tgtattggctgctagctttgcgccg

SEQ ID NO: 74183 - DNA, 25 bp, E. coli
tgaaccgctttgtggtggccgaacc

SEQ ID NO: 74184 - DNA, 25 bp, E. coli
tgaaggctcactcaaagacggcgaa

SEQ ID NO: 74185 - DNA, 25 bp, E. coli
tgaaggctcactgaaagacggcgaa

SEQ ID NO: 74186 - DNA, 25 bp, E. coli
tgaaccgctttgaggtggccgaacc

SEQ ID NO: 74187 - DNA, 25 bp, E. coli
tcatcactgtgacgaagccccttgc

SEQ ID NO: 74188 - DNA, 25 bp, E. coli
tcatcactgtgaggaagccccttgc

SEQ ID NO: 74189 - DNA, 25 bp, E. coli
cctgttcggacgagcataaaacgca

SEQ ID NO: 74190 - DNA, 25 bp, E. coli
cctgttcggacgtgcataaaacgca

SEQ ID NO: 74191 - DNA, 25 bp, E. coli
gaaaacgcgccaacacaacatgctt

SEQ ID NO: 74192 - DNA, 25 bp, E. coli
gaaaacgcgccatcacaacatgctt

SEQ ID NO: 74193 - DNA, 25 bp, E. coli
gatagcctgcaaggtcagatgaaag

SEQ ID NO: 74194 - DNA, 25 bp, E. coli
gatagcctgcaacgtcagatgaaag

SEQ ID NO: 74195 - DNA, 25 bp, E. coli
gatgtaatacctctctcgctgcctg

SEQ ID NO: 74196 - DNA, 25 bp, E. coli
gatgcgatccaactcaacgaaagcc

SEQ ID NO: 74197 - DNA, 25 bp, E. coli
gatgtaatacctgtctcgctgcctg

SEQ ID NO: 74198 - DNA, 25 bp, E. coli
gatgcgatccaagtcaacgaaagcc

SEQ ID NO: 74199 - DNA, 25 bp, E. coli
agcgcctatggctccggttttaccg

SEQ ID NO: 74200 - DNA, 25 bp, E. coli
agcgcctatggcaccggttttaccg

SEQ ID NO: 74201 - DNA, 25 bp, E. coli
tattacgaccgtacgcgcagcgatt

SEQ ID NO: 74202 - DNA, 25 bp, E. coli
tattacgaccgttcgcgcagcgatt

SEQ ID NO: 74203 - DNA, 25 bp, E. coli
tgatcttcccggcagaaaccatgac

SEQ ID NO: 74204 - DNA, 25 bp, E. coli
tgatcttcccgggagaaaccatgac

SEQ ID NO: 74205 - DNA, 25 bp, E. coli
tgagctgactaaagacgatggcacg

SEQ ID NO: 74206 - DNA, 25 bp, E. coli
tgagctgactaatgacgatggcacg

SEQ ID NO: 74207 - DNA, 25 bp, E. coli
tgactaccggtgtttctgccgctga

SEQ ID NO: 74208 - DNA, 25 bp, E. coli
tgactaccggtgattctgccgctga

SEQ ID NO: 74209 - DNA, 25 bp, E. coli
tgacgcgtggcggtcatactgaagc

SEQ ID NO: 74210 - DNA, 25 bp, E. coli
tgacgcgtggcgctcatactgaagc

SEQ ID NO: 74211 - DNA, 25 bp, E. coli
tcgtgactattgtagacctggtggc

SEQ ID NO: 74212 - DNA, 25 bp, E. coli
tcgtgactattgaagacctggtggc

SEQ ID NO: 74213 - DNA, 25 bp, E. coli
gcagcgattgcccatggcgcaaaac

SEQ ID NO: 74214 - DNA, 25 bp, E. coli
gcagcgattgccgatggcgcaaaac

SEQ ID NO: 74215 - DNA, 25 bp, E. coli
cgtaaacaactccatctgccaatga

SEQ ID NO: 74216 - DNA, 25 bp, E. coli
cgtaaacaactcgatctgccaatga

SEQ ID NO: 74217 - DNA, 25 bp, E. coli
tggtacgcctttggaacgtgttgaa

SEQ ID NO: 74218 - DNA, 25 bp, E. coli
tggtacgcctttcgaacgtgttgaa

SEQ ID NO: 74219 - DNA, 25 bp, E. coli
tggcataccgtcaggcacatgagcg

SEQ ID NO: 74220 - DNA, 25 bp, E. coli
tggcataccgtctggcacatgagcg

SEQ ID NO: 74221 - DNA, 25 bp, E. coli
aacgccgtggtgtttggcgcatcga

SEQ ID NO: 74222 - DNA, 25 bp, E. coli
caggcgtgcgttgaatatcatgatc

SEQ ID NO: 74223 - DNA, 25 bp, E. coli
caggcgtgcgttcaatatcatgatc

SEQ ID NO: 74224 - DNA, 25 bp, E. coli
caggtgcgctctcaagttgctcaaa

SEQ ID NO: 74225 - DNA, 25 bp, E. coli
caggtgcgctctgaagttgctcaaa

SEQ ID NO: 74226 - DNA, 25 bp, E. coli
aacgccgtggtgattggcgcatcga

SEQ ID NO: 74227 - DNA, 25 bp, E. coli
taccggcgggtaatgataacgtcaa

SEQ ID NO: 74228 - DNA, 25 bp, E. coli
taccggcgggtattgataacgtcaa

SEQ ID NO: 74229 - DNA, 25 bp, E. coli
tattgacggtaatacgattgcgcag

SEQ ID NO: 74230 - DNA, 25 bp, E. coli
tattgacggtaaaacgattgcgcag

SEQ ID NO: 74231 - DNA, 25 bp, E. coli
tgactggatcaatgaaggcgcaatt

SEQ ID NO: 74232 - DNA, 25 bp, E. coli
tgactggatcaaagaaggcgcaatt

SEQ ID NO: 74233 - DNA, 25 bp, E. coli
gctgattgaaaagacgctacaggcg

SEQ ID NO: 74234 - DNA, 25 bp, E. coli
gctgattgaaaacacgctacaggcg

SEQ ID NO: 74235 - DNA, 25 bp, E. coli
gaagaagtcgggatcgtctcccgct

SEQ ID NO: 74236 - DNA, 25 bp, E. coli
gaagaagtcgggttcgtctcccgct

SEQ ID NO: 74237 - DNA, 25 bp, E. coli
gttgctcaaaaacttcaggcgcgta

SEQ ID NO: 74238 - DNA, 25 bp, E. coli
gttgctcaaaaagttcaggcgcgta

SEQ ID NO: 74239 - DNA, 25 bp, E. coli
ggctaaacgcgcctcatacattacg

SEQ ID NO: 74240 - DNA, 25 bp, E. coli
ggctaaacgcgcgtcatacattacg

SEQ ID NO: 74241 - DNA, 25 bp, E. coli
gatgacggttgcgacgctgattgaa

SEQ ID NO: 74242 - DNA, 25 bp, E. coli
gatgacggttgccacgctgattgaa

SEQ ID NO: 74243 - DNA, 25 bp, E. coli
aagccttagccgtccaggtggcgat

SEQ ID NO: 74244 - DNA, 25 bp, E. coli
caggtggcgatgagtccatttcatc

SEQ ID NO: 74245 - DNA, 25 bp, E. coli
caggtggcgatgtgtccatttcatc

SEQ ID NO: 74246 - DNA, 25 bp, E. coli
aagccttagccgaccaggtggcgat

SEQ ID NO: 74247 - DNA, 25 bp, E. coli
tgacgacgtctaatcttaacgccgg

SEQ ID NO: 74248 - DNA, 25 bp, E. coli
tgacgacgtctattcttaacgccgg

SEQ ID NO: 74249 - DNA, 25 bp, E. coli
tcatctacatcgcttgtttaaagcg

SEQ ID NO: 74250 - DNA, 25 bp, E. coli
tctacatcggttgtttaaagcgact

SEQ ID NO: 74251 - DNA, 25 bp, E. coli
tctacatcggttctttaaagcgact

SEQ ID NO: 74252 - DNA, 25 bp, E. coli
tcatctacatcggttgtttaaagcg

SEQ ID NO: 74253 - DNA, 25 bp, E. coli
gccgtttgcgcgtatcgctggcgaa

SEQ ID NO: 74254 - DNA, 25 bp, E. coli
gccgtttgcgcgaatcgctggcgaa

SEQ ID NO: 74255 - DNA, 25 bp, E. coli
gcgctcgccgttagcgcgaatcgct

SEQ ID NO: 74256 - DNA, 25 bp, E. coli
gcgctcgccgtttgcgcgaatcgct

SEQ ID NO: 74257 - DNA, 25 bp, E. coli
cgtttgcgcgaaacgctggcgaaag

SEQ ID NO: 74258 - DNA, 25 bp, E. coli
cgtttgcgcgaatcgctggcgaaag

SEQ ID NO: 74259 - DNA, 25 bp, E. coli
cgacgtctattcataacgccggatt

SEQ ID NO: 74260 - DNA, 25 bp, E. coli
cgacgtctattcttaacgccggatt

SEQ ID NO: 74261 - DNA, 25 bp, E. coli
ggagagcgtgacgacgtctattctt

SEQ ID NO: 74262 - DNA, 25 bp, E. coli
ggagagcgtgaccacgtctattctt

SEQ ID NO: 74263 - DNA, 25 bp, E. coli
gagtccatttcaactacatcggttg

SEQ ID NO: 74264 - DNA, 25 bp, E. coli
gagtccatttcatctacatcggttg

SEQ ID NO: 74265 - DNA, 25 bp, E. coli
cagcggctggctcaagagataaata

SEQ ID NO: 74266 - DNA, 25 bp, E. coli
cagcggctggctgaagagataaata

SEQ ID NO: 74267 - DNA, 25 bp, E. coli
acgaggggctgtatgcacaaagcat

SEQ ID NO: 74268 - DNA, 25 bp, E. coli
atggtaatgaaggatcctcacgata

SEQ ID NO: 74269 - DNA, 25 bp, E. coli
aaataataaacgtggggctgtatgc

SEQ ID NO: 74270 - DNA, 25 bp, E. coli
atggtaatgaagcatcctcacgata

SEQ ID NO: 74271 - DNA, 25 bp, E. coli
aaataataaacgaggggctgtatgc

SEQ ID NO: 74272 - DNA, 25 bp, E. coli
aacgaggggctgaatgcacaaagca

SEQ ID NO: 74273 - DNA, 25 bp, E. coli
aacgaggggctgtatgcacaaagca

SEQ ID NO: 74274 - DNA, 25 bp, E. coli
aaacgaggggctctatgcacaaagc

SEQ ID NO: 74275 - DNA, 25 bp, E. coli
acgaggggctgtttgcacaaagcat

SEQ ID NO: 74276 - DNA, 25 bp, E. coli
aaacgaggggctgtatgcacaaagc

SEQ ID NO: 74277 - DNA, 25 bp, E. coli
tatccgaaatccactgaaagcacag

SEQ ID NO: 74278 - DNA, 25 bp, E. coli
tatccgaaatcctctgaaagcacag

SEQ ID NO: 74279 - DNA, 25 bp, E. coli
tggtaatgaagcatcctcacgataa

SEQ ID NO: 74280 - DNA, 25 bp, E. coli
tggtaatgaagcttcctcacgataa

SEQ ID NO: 74281 - DNA, 25 bp, E. coli
tccgggtaggcacgatcactttcgt

SEQ ID NO: 74282 - DNA, 25 bp, E. coli
tccgggtaggcaggatcactttcgt

SEQ ID NO: 74283 - DNA, 25 bp, E. coli
gataaataataaacgaggggctgta

SEQ ID NO: 74284 - DNA, 25 bp, E. coli
gataaataataatcgaggggctgta

SEQ ID NO: 74285 - DNA, 25 bp, E. coli
tcacgataatatccgggtaggcacg

SEQ ID NO: 74286 - DNA, 25 bp, E. coli
tcacgataatatgcgggtaggcacg

SEQ ID NO: 74287 - DNA, 25 bp, E. coli
caggtatcacagacctgcggctaca

SEQ ID NO: 74288 - DNA, 25 bp, E. coli
caggtatcacagtcctgcggctaca

SEQ ID NO: 74289 - DNA, 25 bp, E. coli
tatgttagtcagcacagagaacgca

SEQ ID NO: 74290 - DNA, 25 bp, E. coli
tagccagttgtttatgtcttagccc

SEQ ID NO: 74291 - DNA, 25 bp, E. coli
tagccagttgttaatgtcttagccc

SEQ ID NO: 74292 - DNA, 25 bp, E. coli
tatgttagtcaggacagagaacgca

SEQ ID NO: 74293 - DNA, 25 bp, E. coli
tatagccaaataatcaccacctgcc

SEQ ID NO: 74294 - DNA, 25 bp, E. coli
tatagccaaatattcaccacctgcc

SEQ ID NO: 74295 - DNA, 25 bp, E. coli
tgcggctacaactgtacgtcgtact

SEQ ID NO: 74296 - DNA, 25 bp, E. coli
tgcggctacaacagtacgtcgtact

SEQ ID NO: 74297 - DNA, 25 bp, E. coli
ccagtatggcaaggtagcgctacgc

SEQ ID NO: 74298 - DNA, 25 bp, E. coli
ccagtatggcaacgtagcgctacgc

SEQ ID NO: 74299 - DNA, 25 bp, E. coli
gctatcccgtttactcgacagtaaa

SEQ ID NO: 74300 - DNA, 25 bp, E. coli
gctatcccgttttctcgacagtaaa

SEQ ID NO: 74301 - DNA, 25 bp, E. coli
gacatcatcaaagattacctccggt

SEQ ID NO: 74302 - DNA, 25 bp, E. coli
gacatcatcaaacattacctccggt

SEQ ID NO: 74303 - DNA, 25 bp, E. coli
ctgagtcagaaaaggaacgaacacg

SEQ ID NO: 74304 - DNA, 25 bp, E. coli
ctgagtcagaaatggaacgaacacg

SEQ ID NO: 74305 - DNA, 25 bp, E. coli
gatctctcgcaattaccagtatggc

SEQ ID NO: 74306 - DNA, 25 bp, E. coli
gatctctcgcaaataccagtatggc

SEQ ID NO: 74307 - DNA, 25 bp, E. coli
ggatttgcagcgaccaaccttgtat

SEQ ID NO: 74308 - DNA, 25 bp, E. coli
ggatttgcagcgtccaaccttgtat

SEQ ID NO: 74309 - DNA, 25 bp, E. coli
caacgacccgaggactttatgatcc

SEQ ID NO: 74310 - DNA, 25 bp, E. coli
caacgacccgagcactttatgatcc

SEQ ID NO: 74311 - DNA, 25 bp, E. coli
ggacaacgaccccaggactttatga

SEQ ID NO: 74312 - DNA, 25 bp, E. coli
ggacaacgacccgaggactttatga

SEQ ID NO: 74313 - DNA, 25 bp, E. coli
agagtggacaacgacccgaggactt

SEQ ID NO: 74314 - DNA, 25 bp, E. coli
agagtggacaaccacccgaggactt

SEQ ID NO: 74315 - DNA, 25 bp, E. coli
tgaatatgctgacatgccaaaagag

SEQ ID NO: 74316 - DNA, 25 bp, E. coli
tgacatgccaaaagagtggacaacg

SEQ ID NO: 74317 - DNA, 25 bp, E. coli
tgacatgccaaatgagtggacaacg

SEQ ID NO: 74318 - DNA, 25 bp, E. coli
tgaatatgctgagatgccaaaagag

SEQ ID NO: 74319 - DNA, 25 bp, E. coli
tgccaaaagagtcgacaacgacccg

SEQ ID NO: 74320 - DNA, 25 bp, E. coli
tgctggtacggtttgtgaatatgct

SEQ ID NO: 74321 - DNA, 25 bp, E. coli
tgctggtacggtatgtgaatatgct

SEQ ID NO: 74322 - DNA, 25 bp, E. coli
tgctgacatgccaaaagagtggaca

SEQ ID NO: 74323 - DNA, 25 bp, E. coli
tgctgacatgcctaaagagtggaca

SEQ ID NO: 74324 - DNA, 25 bp, E. coli
tgccaaaagagtggacaacgacccg

SEQ ID NO: 74325 - DNA, 25 bp, E. coli
gaggactttatgatcctacccacgt

SEQ ID NO: 74326 - DNA, 25 bp, E. coli
gaaacttttgctcgtacggtatgtg

SEQ ID NO: 74327 - DNA, 25 bp, E. coli
gaggactttatgttcctacccacgt

SEQ ID NO: 74328 - DNA, 25 bp, E. coli
gaaacttttgctggtacggtatgtg

SEQ ID NO: 74329 - DNA, 25 bp, E. coli
cggtatgtgaatttgctgacatgcc

SEQ ID NO: 74330 - DNA, 25 bp, E. coli
cggtatgtgaatatgctgacatgcc

SEQ ID NO: 74331 - DNA, 25 bp, E. coli
tacggtgatcaacaacgaaggccgc

SEQ ID NO: 74332 - DNA, 25 bp, E. coli
tacggtgatcaagaacgaaggccgc

SEQ ID NO: 74333 - DNA, 25 bp, E. coli
gggcgtttacggtgcgcacgacaac

SEQ ID NO: 74334 - DNA, 25 bp, E. coli
cggtgcgcacgagaacgtctacttc

SEQ ID NO: 74335 - DNA, 25 bp, E. coli
cggtgcgcacgacaacgtctacttc

SEQ ID NO: 74336 - DNA, 25 bp, E. coli
gggcgtttacggagcgcacgacaac

SEQ ID NO: 74337 - DNA, 25 bp, E. coli
acggtgcgcacgtcaacgtctactt

SEQ ID NO: 74338 - DNA, 25 bp, E. coli
acggtgcgcacgacaacgtctactt

SEQ ID NO: 74339 - DNA, 25 bp, E. coli
ttacggtgcgcacgacaacgtctac

SEQ ID NO: 74340 - DNA, 25 bp, E. coli
tttacggtgcgctcgacaacgtcta

SEQ ID NO: 74341 - DNA, 25 bp, E. coli
tttacggtgcgcacgacaacgtcta

SEQ ID NO: 74342 - DNA, 25 bp, E. coli
ttacggtgcgcaggacaacgtctac

SEQ ID NO: 74343 - DNA, 25 bp, E. coli
cggtgatcaacaacgaaggccgcgc

SEQ ID NO: 74344 - DNA, 25 bp, E. coli
cggtgatcaacatcgaaggccgcgc

SEQ ID NO: 74345 - DNA, 25 bp, E. coli
gatcaacaacgaaggccgcgcccaa

SEQ ID NO: 74346 - DNA, 25 bp, E. coli
gtttacggtgcggacgacaacgtct

SEQ ID NO: 74347 - DNA, 25 bp, E. coli
gtttacggtgcgcacgacaacgtct

SEQ ID NO: 74348 - DNA, 25 bp, E. coli
gatcaacaacgatggccgcgcccaa

SEQ ID NO: 74349 - DNA, 25 bp, E. coli
ggtgatcaacaaggaaggccgcgcc

SEQ ID NO: 74350 - DNA, 25 bp, E. coli
ggtgatcaacaacgaaggccgcgcc

SEQ ID NO: 74351 - DNA, 25 bp, E. coli
ggcgtttacggtgcgcacgacaacg

SEQ ID NO: 74352 - DNA, 25 bp, E. coli
ggcgtttacggtccgcacgacaacg

SEQ ID NO: 74353 - DNA, 25 bp, E. coli
aaatgttagtcgctgcgttagcgtt

SEQ ID NO: 74354 - DNA, 25 bp, E. coli
aactgacaataacatccacggcacg

SEQ ID NO: 74355 - DNA, 25 bp, E. coli
actgacaataagttccacggcacgg

SEQ ID NO: 74356 - DNA, 25 bp, E. coli
aactgacaataagatccacggcacg

SEQ ID NO: 74357 - DNA, 25 bp, E. coli
aaatgttagtcggtgcgttagcgtt

SEQ ID NO: 74358 - DNA, 25 bp, E. coli
actgacaataagatccacggcacgg

SEQ ID NO: 74359 - DNA, 25 bp, E. coli
tctctaaaatgttagtcggtgcgtt

SEQ ID NO: 74360 - DNA, 25 bp, E. coli
tctctaaaatgtaagtcggtgcgtt

SEQ ID NO: 74361 - DNA, 25 bp, E. coli
gaaaaaataggtcatatttcaacca

SEQ ID NO: 74362 - DNA, 25 bp, E. coli
gaaaaaataggtgatatttcaacca

SEQ ID NO: 74363 - DNA, 25 bp, E. coli
ctgacaataagaaccacggcacggc

SEQ ID NO: 74364 - DNA, 25 bp, E. coli
ctgacaataagatccacggcacggc

SEQ ID NO: 74365 - DNA, 25 bp, E. coli
ggtcaaactgacaataagatccacg

SEQ ID NO: 74366 - DNA, 25 bp, E. coli
ggtcaaactgactataagatccacg

SEQ ID NO: 74367 - DNA, 25 bp, E. coli
gggctgatgtgtaggtactgacctc

SEQ ID NO: 74368 - DNA, 25 bp, E. coli
gggctgatgtgttggtactgacctc

SEQ ID NO: 74369 - DNA, 25 bp, E. coli
taaaatgttagtcggtgcgttagcg

SEQ ID NO: 74370 - DNA, 25 bp, E. coli
taatctctaaaaagttagtcggtgc

SEQ ID NO: 74371 - DNA, 25 bp, E. coli
taaaatgttagtgggtgcgttagcg

SEQ ID NO: 74372 - DNA, 25 bp, E. coli
tcaaactgacaataagatccacggc

SEQ ID NO: 74373 - DNA, 25 bp, E. coli
tcaaactgacaaaaagatccacggc

SEQ ID NO: 74374 - DNA, 25 bp, E. coli
taatctctaaaatgttagtcggtgc

SEQ ID NO: 74375 - DNA, 25 bp, E. coli
aataattgttatgtggtcggatgag

SEQ ID NO: 74376 - DNA, 25 bp, E. coli
gaatacgcccggtgataacgccgga

SEQ ID NO: 74377 - DNA, 25 bp, E. coli
aataattgttatctggtcggatgag

SEQ ID NO: 74378 - DNA, 25 bp, E. coli
gaatacgcccggagataacgccgga

SEQ ID NO: 74379 - DNA, 25 bp, E. coli
caggttacggaaatgcacatgtagg

SEQ ID NO: 74380 - DNA, 25 bp, E. coli
caggttacggaattgcacatgtagg

SEQ ID NO: 74381 - DNA, 25 bp, E. coli
agttctaatttagccgtcgccggag

SEQ ID NO: 74382 - DNA, 25 bp, E. coli
agttctaatttacccgtcgccggag

SEQ ID NO: 74383 - DNA, 25 bp, E. coli
ttttatccggcctggaggattgcac

SEQ ID NO: 74384 - DNA, 25 bp, E. coli
ttttatccggccaggaggattgcac

SEQ ID NO: 74385 - DNA, 25 bp, E. coli
tgggattcaaaaagaatacgcccgg

SEQ ID NO: 74386 - DNA, 25 bp, E. coli
tgggattcaaaatgaatacgcccgg

SEQ ID NO: 74387 - DNA, 25 bp, E. coli
tggtcggatgagatctaatttagcc

SEQ ID NO: 74388 - DNA, 25 bp, E. coli
tccgacctacgggaacacacatgta

SEQ ID NO: 74389 - DNA, 25 bp, E. coli
tccgacctacggcaacacacatgta

SEQ ID NO: 74390 - DNA, 25 bp, E. coli
ccggccaggaggtttgcacatgtag

SEQ ID NO: 74391 - DNA, 25 bp, E. coli
ccggccaggaggattgcacatgtag

SEQ ID NO: 74392 - DNA, 25 bp, E. coli
gcttgtcgcgttttatccaggttac

SEQ ID NO: 74393 - DNA, 25 bp, E. coli
gcttgtcgcgttatatccaggttac

SEQ ID NO: 74394 - DNA, 25 bp, E. coli
cgcccggtgatatcgccggatgcga

SEQ ID NO: 74395 - DNA, 25 bp, E. coli
cgcccggtgataacgccggatgcga

SEQ ID NO: 74396 - DNA, 25 bp, E. coli
tggtcggatgagttctaatttagcc

SEQ ID NO: 74397 - DNA, 25 bp, E. coli
caatgtccgggcaaaatcaggttta

SEQ ID NO: 74398 - DNA, 25 bp, E. coli
caatgtccgggctaaatcaggttta

SEQ ID NO: 74399 - DNA, 25 bp, E. coli
cagcaacatgtcaaagtcagcagcg

SEQ ID NO: 74400 - DNA, 25 bp, E. coli
cagcaacatgtctaagtcagcagcg

SEQ ID NO: 74401 - DNA, 25 bp, E. coli
cagtcctgcggtaagtggtacatca

SEQ ID NO: 74402 - DNA, 25 bp, E. coli
cagggcgttaagctcgatcaggaaa

SEQ ID NO: 74403 - DNA, 25 bp, E. coli
cagtcctgcggttagtggtacatca

SEQ ID NO: 74404 - DNA, 25 bp, E. coli
cagggcgttaaggtcgatcaggaaa

SEQ ID NO: 74405 - DNA, 25 bp, E. coli
agaatgatgcattccgctacccgca

SEQ ID NO: 74406 - DNA, 25 bp, E. coli
agaatgatgcataccgctacccgca

SEQ ID NO: 74407 - DNA, 25 bp, E. coli
aaacttcttccggaagcgggctgct

SEQ ID NO: 74408 - DNA, 25 bp, E. coli
aaacttcttccgcaagcgggctgct

SEQ ID NO: 74409 - DNA, 25 bp, E. coli
ttgaagcaggaacccaccgaaatga

SEQ ID NO: 74410 - DNA, 25 bp, E. coli
ttgaagcaggaagccaccgaaatga

SEQ ID NO: 74411 - DNA, 25 bp, E. coli
tcagaatgagaaacatgaggccggt

SEQ ID NO: 74412 - DNA, 25 bp, E. coli
tcagaatgagaatcatgaggccggt

SEQ ID NO: 74413 - DNA, 25 bp, E. coli
gctaaactcgccacgctgtcagatg

SEQ ID NO: 74414 - DNA, 25 bp, E. coli
gctaaactcgcctcgctgtcagatg

SEQ ID NO: 74415 - DNA, 25 bp, E. coli
tgagcgggcttacaaaaacttcttc

SEQ ID NO: 74416 - DNA, 25 bp, E. coli
tgagcgggcttagaaaaacttcttc

SEQ ID NO: 74417 - DNA, 25 bp, E. coli
tcagcgacagttaagccgcaaggtc

SEQ ID NO: 74418 - DNA, 25 bp, E. coli
tcagcgacagtttagccgcaaggtc

SEQ ID NO: 74419 - DNA, 25 bp, E. coli
aagtatcgattctccacgctaactt

SEQ ID NO: 74420 - DNA, 25 bp, E. coli
aagtatcgattcaccacgctaactt

SEQ ID NO: 74421 - DNA, 25 bp, E. coli
taaagtatcgatacaccacgctaac

SEQ ID NO: 74422 - DNA, 25 bp, E. coli
tatcgattcacctcgctaacttttt

SEQ ID NO: 74423 - DNA, 25 bp, E. coli
taaagtatcgattcaccacgctaac

SEQ ID NO: 74424 - DNA, 25 bp, E. coli
tatcgattcaccacgctaacttttt

SEQ ID NO: 74425 - DNA, 25 bp, E. coli
atcgattcaccacgctaactttttt

SEQ ID NO: 74426 - DNA, 25 bp, E. coli
agtatcgattcagcacgctaacttt

SEQ ID NO: 74427 - DNA, 25 bp, E. coli
agtatcgattcaccacgctaacttt

SEQ ID NO: 74428 - DNA, 25 bp, E. coli
atcgattcaccaggctaactttttt

SEQ ID NO: 74429 - DNA, 25 bp, E. coli
aaagtatcgattgaccacgctaact

SEQ ID NO: 74430 - DNA, 25 bp, E. coli
aaagtatcgattcaccacgctaact

SEQ ID NO: 74431 - DNA, 25 bp, E. coli
cggtaaagtatcgattcaccacgct

SEQ ID NO: 74432 - DNA, 25 bp, E. coli
cggtaaagtatccattcaccacgct

SEQ ID NO: 74433 - DNA, 25 bp, E. coli
gtatcgattcaccacgctaactttt

SEQ ID NO: 74434 - DNA, 25 bp, E. coli
gtatcgattcacgacgctaactttt

SEQ ID NO: 74435 - DNA, 25 bp, E. coli
gattcaccacgctaactttttttga

SEQ ID NO: 74436 - DNA, 25 bp, E. coli
gattcaccacgcaaactttttttga

SEQ ID NO: 74437 - DNA, 25 bp, E. coli
gtaaagtatcgattcaccacgctaa

SEQ ID NO: 74438 - DNA, 25 bp, E. coli
ggtaaagtatcgtttcaccacgcta

SEQ ID NO: 74439 - DNA, 25 bp, E. coli
gtaaagtatcgaatcaccacgctaa

SEQ ID NO: 74440 - DNA, 25 bp, E. coli
ggtaaagtatcgattcaccacgcta

SEQ ID NO: 74441 - DNA, 25 bp, E. coli
caattattgcagcacgggaagcccg

SEQ ID NO: 74442 - DNA, 25 bp, E. coli
caattattgcaggacgggaagcccg

SEQ ID NO: 74443 - DNA, 25 bp, E. coli
taaaatctgggaattcaacggcggc

SEQ ID NO: 74444 - DNA, 25 bp, E. coli
tactggttcagctaaggtcagcaac

SEQ ID NO: 74445 - DNA, 25 bp, E. coli
tactggttcagcaaaggtcagcaac

SEQ ID NO: 74446 - DNA, 25 bp, E. coli
taccgccgatgaccgtttgatgcag

SEQ ID NO: 74447 - DNA, 25 bp, E. coli
taccgccgatgagcgtttgatgcag

SEQ ID NO: 74448 - DNA, 25 bp, E. coli
tattcgtcaggaagaaaagcgcgcc

SEQ ID NO: 74449 - DNA, 25 bp, E. coli
tattcgtcaggatgaaaagcgcgcc

SEQ ID NO: 74450 - DNA, 25 bp, E. coli
ttgaacgacataagagcgcagccgt

SEQ ID NO: 74451 - DNA, 25 bp, E. coli
ttgaacgacatatgagcgcagccgt

SEQ ID NO: 74452 - DNA, 25 bp, E. coli
tgaaagagaaacaggcccaggctac

SEQ ID NO: 74453 - DNA, 25 bp, E. coli
tgaaagagaaactggcccaggctac

SEQ ID NO: 74454 - DNA, 25 bp, E. coli
cctattgtgattaaagcgggcgaac

SEQ ID NO: 74455 - DNA, 25 bp, E. coli
cctattgtgatttaagcgggcgaac

SEQ ID NO: 74456 - DNA, 25 bp, E. coli
gaaaaagcggctcgccttgaacgac

SEQ ID NO: 74457 - DNA, 25 bp, E. coli
gaaaaagcggctggccttgaacgac

SEQ ID NO: 74458 - DNA, 25 bp, E. coli
taacctacattcagaccgggaagca

SEQ ID NO: 74459 - DNA, 25 bp, E. coli
taaaatctgggatttcaacggcggc

SEQ ID NO: 74460 - DNA, 25 bp, E. coli
taacctacattctgaccgggaagca

SEQ ID NO: 74461 - DNA, 25 bp, E. coli
gatgtcccggtcgtaaagattacca

SEQ ID NO: 74462 - DNA, 25 bp, E. coli
gatgtcccggtcctaaagattacca

SEQ ID NO: 74463 - DNA, 25 bp, E. coli
caaatcatcgacattctagcaacca

SEQ ID NO: 74464 - DNA, 25 bp, E. coli
caaatcatcgactttctagcaacca

SEQ ID NO: 74465 - DNA, 25 bp, E. coli
tttaatcatacgcaacaaatcatcg

SEQ ID NO: 74466 - DNA, 25 bp, E. coli
tttaatcatacggaacaaatcatcg

SEQ ID NO: 74467 - DNA, 25 bp, E. coli
gccgctgttgatccgttgtttgcca

SEQ ID NO: 74468 - DNA, 25 bp, E. coli
gccgctgttgatgcgttgtttgcca

SEQ ID NO: 74469 - DNA, 25 bp, E. coli
gctgaagactctatcaacgacaaag

SEQ ID NO: 74470 - DNA, 25 bp, E. coli
gctgaagactctttcaacgacaaag

SEQ ID NO: 74471 - DNA, 25 bp, E. coli
gcaaatccatgtataaagcctttaa

SEQ ID NO: 74472 - DNA, 25 bp, E. coli
gcaaccaatttcattactcgataca

SEQ ID NO: 74473 - DNA, 25 bp, E. coli
gcaaccaatttctttactcgataca

SEQ ID NO: 74474 - DNA, 25 bp, E. coli
gcaaatccatgtttaaagcctttaa

SEQ ID NO: 74475 - DNA, 25 bp, E. coli
gacaaagttcctacctagagcgctg

SEQ ID NO: 74476 - DNA, 25 bp, E. coli
gacaaagttccttcctagagcgctg

SEQ ID NO: 74477 - DNA, 25 bp, E. coli
cgatacagtgttgatggctgaagac

SEQ ID NO: 74478 - DNA, 25 bp, E. coli
cgatacagtgttcatggctgaagac

SEQ ID NO: 74479 - DNA, 25 bp, E. coli
gttgtttgccaatgacggcgccgcg

SEQ ID NO: 74480 - DNA, 25 bp, E. coli
gttgtttgccaaagacggcgccgcg

SEQ ID NO: 74481 - DNA, 25 bp, E. coli
ggaaagtcttgctcggtgccgctgt

SEQ ID NO: 74482 - DNA, 25 bp, E. coli
ggaaagtcttgcacggtgccgctgt

SEQ ID NO: 74483 - DNA, 25 bp, E. coli
tagagcgctgttcacctggaaagtc

SEQ ID NO: 74484 - DNA, 25 bp, E. coli
tagagcgctgttgacctggaaagtc

SEQ ID NO: 74485 - DNA, 25 bp, E. coli
aattgggacggattgaaacagtggc

SEQ ID NO: 74486 - DNA, 25 bp, E. coli
aattgggacggaatgaaacagtggc

SEQ ID NO: 74487 - DNA, 25 bp, E. coli
catcgtaatagcgtcagtgcactga

SEQ ID NO: 74488 - DNA, 25 bp, E. coli
catcgtaatagcctcagtgcactga

SEQ ID NO: 74489 - DNA, 25 bp, E. coli
tttgggaagttgtaaacaacatgcg

SEQ ID NO: 74490 - DNA, 25 bp, E. coli
tttgggaagttgaaaacaacatgcg

SEQ ID NO: 74491 - DNA, 25 bp, E. coli
ttctctatgaatatctggaaccgct

SEQ ID NO: 74492 - DNA, 25 bp, E. coli
ttctctatgaatttctggaaccgct

SEQ ID NO: 74493 - DNA, 25 bp, E. coli
tgaagagcgtgctaaaaaggtcgcg

SEQ ID NO: 74494 - DNA, 25 bp, E. coli
tgaagagcgtgcaaaaaaggtcgcg

SEQ ID NO: 74495 - DNA, 25 bp, E. coli
tcagtgcactgatcaataacaatcg

SEQ ID NO: 74496 - DNA, 25 bp, E. coli
tcagtgcactgaacaataacaatcg

SEQ ID NO: 74497 - DNA, 25 bp, E. coli
gcagagttgctgcatgttcatcgta

SEQ ID NO: 74498 - DNA, 25 bp, E. coli
gcagagttgctggatgttcatcgta

SEQ ID NO: 74499 - DNA, 25 bp, E. coli
gaaaaccgacgacacccggagatat

SEQ ID NO: 74500 - DNA, 25 bp, E. coli
gaaaaccgacgagacccggagatat

SEQ ID NO: 74501 - DNA, 25 bp, E. coli
gatttttggctatacctccaggcgg

SEQ ID NO: 74502 - DNA, 25 bp, E. coli
gatttttggctaaacctccaggcgg

SEQ ID NO: 74503 - DNA, 25 bp, E. coli
ggctgaatatttcgcacgccgtgaa

SEQ ID NO: 74504 - DNA, 25 bp, E. coli
ggcgaaagtttttgataccacagtc

SEQ ID NO: 74505 - DNA, 25 bp, E. coli
ggctgaatatttggcacgccgtgaa

SEQ ID NO: 74506 - DNA, 25 bp, E. coli
ggcgaaagttttagataccacagtc

SEQ ID NO: 74507 - DNA, 25 bp, E. coli
cactaaacggcacgttggaacagag

SEQ ID NO: 74508 - DNA, 25 bp, E. coli
cactaaacggcaggttggaacagag

SEQ ID NO: 74509 - DNA, 25 bp, E. coli
aacggtacattcgaagtgatctcac

SEQ ID NO: 74510 - DNA, 25 bp, E. coli
aacggtacattccaagtgatctcac

SEQ ID NO: 74511 - DNA, 25 bp, E. coli
ttcccagctacacgcttttgcacag

SEQ ID NO: 74512 - DNA, 25 bp, E. coli
ttcccagctacaggcttttgcacag

SEQ ID NO: 74513 - DNA, 25 bp, E. coli
tgtaccggtagcctgactgacatcg

SEQ ID NO: 74514 - DNA, 25 bp, E. coli
tgtaccggtagcgtgactgacatcg

SEQ ID NO: 74515 - DNA, 25 bp, E. coli
tgacatcgccttccgctatgccggg

SEQ ID NO: 74516 - DNA, 25 bp, E. coli
tgacatcgccttgcgctatgccggg

SEQ ID NO: 74517 - DNA, 25 bp, E. coli
gcagcaacttcatgccgcctggatt

SEQ ID NO: 74518 - DNA, 25 bp, E. coli
gcagcaacttcaagccgcctggatt

SEQ ID NO: 74519 - DNA, 25 bp, E. coli
ctatgccgggcaagaaggcaccacg

SEQ ID NO: 74520 - DNA, 25 bp, E. coli
ctatgccgggcatgaaggcaccacg

SEQ ID NO: 74521 - DNA, 25 bp, E. coli
gtgatctcactaaacggcacgttgg

SEQ ID NO: 74522 - DNA, 25 bp, E. coli
gtgatctcactatacggcacgttgg

SEQ ID NO: 74523 - DNA, 25 bp, E. coli
ggcaggaagtttattcccagctaca

SEQ ID NO: 74524 - DNA, 25 bp, E. coli
tggattgcaggcagtaccggtagcc

SEQ ID NO: 74525 - DNA, 25 bp, E. coli
ggcaggaagttttttcccagctaca

SEQ ID NO: 74526 - DNA, 25 bp, E. coli
ggcaccacgctcgtgaacggtacat

SEQ ID NO: 74527 - DNA, 25 bp, E. coli
ggcaccacgctcctgaacggtacat

SEQ ID NO: 74528 - DNA, 25 bp, E. coli
tggattgcaggctgtaccggtagcc

SEQ ID NO: 74529 - DNA, 25 bp, E. coli
tacaggcacatgaacatcaggcgct

SEQ ID NO: 74530 - DNA, 25 bp, E. coli
tacaggcacatgtacatcaggcgct

SEQ ID NO: 74531 - DNA, 25 bp, E. coli
atcaggcgctggtctggtgctcacc

SEQ ID NO: 74532 - DNA, 25 bp, E. coli
atcaggcgctggactggtgctcacc

SEQ ID NO: 74533 - DNA, 25 bp, E. coli
tatgttgccagcgatcagcgagaag

SEQ ID NO: 74534 - DNA, 25 bp, E. coli
tatgttgccagccatcagcgagaag

SEQ ID NO: 74535 - DNA, 25 bp, E. coli
ttcatgcctggcacgtacccgactt

SEQ ID NO: 74536 - DNA, 25 bp, E. coli
ttcatgcctggctcgtacccgactt

SEQ ID NO: 74537 - DNA, 25 bp, E. coli
tggtgctcacctcaagaggcgctgc

SEQ ID NO: 74538 - DNA, 25 bp, E. coli
tggtgctcacctgaagaggcgctgc

SEQ ID NO: 74539 - DNA, 25 bp, E. coli
tgctgacattccattattagaggcg

SEQ ID NO: 74540 - DNA, 25 bp, E. coli
tgctgacattcctttattagaggcg

SEQ ID NO: 74541 - DNA, 25 bp, E. coli
gaaaatgattgatgttgttgccgcc

SEQ ID NO: 74542 - DNA, 25 bp, E. coli
gaaaatgattgaagttgttgccgcc

SEQ ID NO: 74543 - DNA, 25 bp, E. coli
ccagccatcagccagaagtttcggg

SEQ ID NO: 74544 - DNA, 25 bp, E. coli
ccagccatcagcgagaagtttcggg

SEQ ID NO: 74545 - DNA, 25 bp, E. coli
gacttccacgggacgttacaggcac

SEQ ID NO: 74546 - DNA, 25 bp, E. coli
gacttccacgggtcgttacaggcac

SEQ ID NO: 74547 - DNA, 25 bp, E. coli
ggattatccatcatcatgcctggca

SEQ ID NO: 74548 - DNA, 25 bp, E. coli
ggattatccatcttcatgcctggca

SEQ ID NO: 74549 - DNA, 25 bp, E. coli
tggcaaaatttttctcgcgcaacgc

SEQ ID NO: 74550 - DNA, 25 bp, E. coli
tggcaaaattttactcgcgcaacgc

SEQ ID NO: 74551 - DNA, 25 bp, E. coli
aagtgcgggccgtctttccggtgct

SEQ ID NO: 74552 - DNA, 25 bp, E. coli
aagtgcgggccgactttccggtgct

SEQ ID NO: 74553 - DNA, 25 bp, E. coli
cacaaaacaggcttggcgttattgc

SEQ ID NO: 74554 - DNA, 25 bp, E. coli
cacaaaacaggcatggcgttattgc

SEQ ID NO: 74555 - DNA, 25 bp, E. coli
taacatagccgactatgaacagaat

SEQ ID NO: 74556 - DNA, 25 bp, E. coli
aaatgatcacgcatgcgcaccagca

SEQ ID NO: 74557 - DNA, 25 bp, E. coli
aaatgatcacgcttgcgcaccagca

SEQ ID NO: 74558 - DNA, 25 bp, E. coli
tatcacagctggaatctgtaccgga

SEQ ID NO: 74559 - DNA, 25 bp, E. coli
tatcacagctggtatctgtaccgga

SEQ ID NO: 74560 - DNA, 25 bp, E. coli
ttttccgtcgactaagtgcgggccg

SEQ ID NO: 74561 - DNA, 25 bp, E. coli
ttttccgtcgacaaagtgcgggccg

SEQ ID NO: 74562 - DNA, 25 bp, E. coli
tgtaccggatctcactctctatggc

SEQ ID NO: 74563 - DNA, 25 bp, E. coli
tgtaccggatctgactctctatggc

SEQ ID NO: 74564 - DNA, 25 bp, E. coli
tccactggcggatatgatcacgctt

SEQ ID NO: 74565 - DNA, 25 bp, E. coli
tccactggcggaaatgatcacgctt

SEQ ID NO: 74566 - DNA, 25 bp, E. coli
tctatggcccactaaacaggcttgg

SEQ ID NO: 74567 - DNA, 25 bp, E. coli
tctatggcccacaaaacaggcttgg

SEQ ID NO: 74568 - DNA, 25 bp, E. coli
cgcttgcgcaccagcatggcgcaaa

SEQ ID NO: 74569 - DNA, 25 bp, E. coli
cgcttgcgcacctgcatggcgcaaa

SEQ ID NO: 74570 - DNA, 25 bp, E. coli
tggcacagaaaaaccactggcggaa

SEQ ID NO: 74571 - DNA, 25 bp, E. coli
tggcacagaaaatccactggcggaa

SEQ ID NO: 74572 - DNA, 25 bp, E. coli
taacatagccgagtatgaacagaat

SEQ ID NO: 74573 - DNA, 25 bp, E. coli
catttgctcccggtaaaccgctgga

SEQ ID NO: 74574 - DNA, 25 bp, E. coli
catttgctcccgctaaaccgctgga

SEQ ID NO: 74575 - DNA, 25 bp, E. coli
aacacgtctgccagctgggctgtgg

SEQ ID NO: 74576 - DNA, 25 bp, E. coli
aacacgtctgcctgctgggctgtgg

SEQ ID NO: 74577 - DNA, 25 bp, E. coli
tatcgatctggaaccgtttgtcacg

SEQ ID NO: 74578 - DNA, 25 bp, E. coli
tatcgatctggatccgtttgtcacg

SEQ ID NO: 74579 - DNA, 25 bp, E. coli
tttgtcacgcataccatgagcctgg

SEQ ID NO: 74580 - DNA, 25 bp, E. coli
tttgtcacgcattccatgagcctgg

SEQ ID NO: 74581 - DNA, 25 bp, E. coli
tcgaccatacctttgaatgcatcgg

SEQ ID NO: 74582 - DNA, 25 bp, E. coli
tcgaccatacctatgaatgcatcgg

SEQ ID NO: 74583 - DNA, 25 bp, E. coli
tgacgttgcacctccgaaaaaaggt

SEQ ID NO: 74584 - DNA, 25 bp, E. coli
tgaaattaatgacgccttcgacctg

SEQ ID NO: 74585 - DNA, 25 bp, E. coli
tgaaattaatgaggccttcgacctg

SEQ ID NO: 74586 - DNA, 25 bp, E. coli
tgacgttgcaccaccgaaaaaaggt

SEQ ID NO: 74587 - DNA, 25 bp, E. coli
tcccggtggttcacggtcacgaagg

SEQ ID NO: 74588 - DNA, 25 bp, E. coli
tcccggtggttctcggtcacgaagg

SEQ ID NO: 74589 - DNA, 25 bp, E. coli
gggcagccgcttaatcactacatgg

SEQ ID NO: 74590 - DNA, 25 bp, E. coli
gggcagccgctttatcactacatgg

SEQ ID NO: 74591 - DNA, 25 bp, E. coli
ggtattggcgcgctacacaacacag

SEQ ID NO: 74592 - DNA, 25 bp, E. coli
ggtattggcgcggtacacaacacag

SEQ ID NO: 74593 - DNA, 25 bp, E. coli
taacccgaatgagtacgacaaaccg

SEQ ID NO: 74594 - DNA, 25 bp, E. coli
taacccgaatgactacgacaaaccg

SEQ ID NO: 74595 - DNA, 25 bp, E. coli
aagaagttgatcaggctggcggcac

SEQ ID NO: 74596 - DNA, 25 bp, E. coli
aagaagttgatctggctggcggcac

SEQ ID NO: 74597 - DNA, 25 bp, E. coli
cacaggatgtgatgaacgagctggc

SEQ ID NO: 74598 - DNA, 25 bp, E. coli
cacaggatgtgaagaacgagctggc

SEQ ID NO: 74599 - DNA, 25 bp, E. coli
tatgtccgcgagcaactcattgtgg

SEQ ID NO: 74600 - DNA, 25 bp, E. coli
tatgtccgcgaggaactcattgtgg

SEQ ID NO: 74601 - DNA, 25 bp, E. coli
tgttgggtaccacgaaaattgcagg

SEQ ID NO: 74602 - DNA, 25 bp, E. coli
tgttgggtaccaggaaaattgcagg

SEQ ID NO: 74603 - DNA, 25 bp, E. coli
tgtggagttacaccgaaagtgttcg

SEQ ID NO: 74604 - DNA, 25 bp, E. coli
tcatccattgcactggtcagccagg

SEQ ID NO: 74605 - DNA, 25 bp, E. coli
tcatccattgcagtggtcagccagg

SEQ ID NO: 74606 - DNA, 25 bp, E. coli
tcattgtggctaccgctgatttgag

SEQ ID NO: 74607 - DNA, 25 bp, E. coli
tcattgtggctagcgctgatttgag

SEQ ID NO: 74608 - DNA, 25 bp, E. coli
gcggagcaacgataggacagcttga

SEQ ID NO: 74609 - DNA, 25 bp, E. coli
gcggagcaacgaaaggacagcttga

SEQ ID NO: 74610 - DNA, 25 bp, E. coli
gttcgctgggaagatcaggtcacca

SEQ ID NO: 74611 - DNA, 25 bp, E. coli
gttcgctgggaacatcaggtcacca

SEQ ID NO: 74612 - DNA, 25 bp, E. coli
tgtggagttacagcgaaagtgttcg

SEQ ID NO: 74613 - DNA, 25 bp, E. coli
taagacactggaacgtttgaagaag

SEQ ID NO: 74614 - DNA, 25 bp, E. coli
taagacactggatcgtttgaagaag

SEQ ID NO: 74615 - DNA, 25 bp, E. coli
gacctatgaataccaggagctggca

SEQ ID NO: 74616 - DNA, 25 bp, E. coli
gacctatgaatagcaggagctggca

SEQ ID NO: 74617 - DNA, 25 bp, E. coli
tacttctgcgatggataatgtggcc

SEQ ID NO: 74618 - DNA, 25 bp, E. coli
tacttctgcgatcgataatgtggcc

SEQ ID NO: 74619 - DNA, 25 bp, E. coli
accaactcgttgctcattaccgctg

SEQ ID NO: 74620 - DNA, 25 bp, E. coli
accaactcgttggtcattaccgctg

SEQ ID NO: 74621 - DNA, 25 bp, E. coli
acagctgcgaatggacgggaaatca

SEQ ID NO: 74622 - DNA, 25 bp, E. coli
acagctgcgaatcgacgggaaatca

SEQ ID NO: 74623 - DNA, 25 bp, E. coli
tatccggctctcagaccacttctgg

SEQ ID NO: 74624 - DNA, 25 bp, E. coli
tatccggctctctgaccacttctgg

SEQ ID NO: 74625 - DNA, 25 bp, E. coli
tgcgatggataatgtggccattacc

SEQ ID NO: 74626 - DNA, 25 bp, E. coli
tgcgatggataaagtggccattacc

SEQ ID NO: 74627 - DNA, 25 bp, E. coli
gccgatgaacagtccaactcgttgg

SEQ ID NO: 74628 - DNA, 25 bp, E. coli
gccaggagcaacagctgcgaatcga

SEQ ID NO: 74629 - DNA, 25 bp, E. coli
gccaggagcaactgctgcgaatcga

SEQ ID NO: 74630 - DNA, 25 bp, E. coli
gccgatgaacagaccaactcgttgg

SEQ ID NO: 74631 - DNA, 25 bp, E. coli
gtattgttgactccgctggccagta

SEQ ID NO: 74632 - DNA, 25 bp, E. coli
gtattgttgactgcgctggccagta

SEQ ID NO: 74633 - DNA, 25 bp, E. coli
gggaattcgcgtaagccttcttcta

SEQ ID NO: 74634 - DNA, 25 bp, E. coli
gggaattcgcgttagccttcttcta

SEQ ID NO: 74635 - DNA, 25 bp, E. coli
ggcgtattgttgtctgcgctggcca

SEQ ID NO: 74636 - DNA, 25 bp, E. coli
ggcgtattgttgactgcgctggcca

SEQ ID NO: 74637 - DNA, 25 bp, E. coli
taagccttcttcaacttctgcgatg

SEQ ID NO: 74638 - DNA, 25 bp, E. coli
taagccttcttctacttctgcgatg

SEQ ID NO: 74639 - DNA, 25 bp, E. coli
tagcgttgctaatcgtcgtctggca

SEQ ID NO: 74640 - DNA, 25 bp, E. coli
tagcgttgctaaacgtcgtctggca

SEQ ID NO: 74641 - DNA, 25 bp, E. coli
tattctgaagtgtggcttccgtgca

SEQ ID NO: 74642 - DNA, 25 bp, E. coli
tattctgaagtgaggcttccgtgca

SEQ ID NO: 74643 - DNA, 25 bp, E. coli
tgaaatcatcaacacgactctgcct

SEQ ID NO: 74644 - DNA, 25 bp, E. coli
tgaaatcatcaagacgactctgcct

SEQ ID NO: 74645 - DNA, 25 bp, E. coli
tcgttcagagaaagcagaagctgct

SEQ ID NO: 74646 - DNA, 25 bp, E. coli
tcgttcagagaatgcagaagctgct

SEQ ID NO: 74647 - DNA, 25 bp, E. coli
tcgccaggctatgttccgcaatatg

SEQ ID NO: 74648 - DNA, 25 bp, E. coli
tcgccaggctatcttccgcaatatg

SEQ ID NO: 74649 - DNA, 25 bp, E. coli
tcttgccaagacagatagcgttgct

SEQ ID NO: 74650 - DNA, 25 bp, E. coli
tctgcctaaagcgaaagagctgcgc

SEQ ID NO: 74651 - DNA, 25 bp, E. coli
tctgcctaaagccaaagagctgcgc

SEQ ID NO: 74652 - DNA, 25 bp, E. coli
tcttgccaagactgatagcgttgct

SEQ ID NO: 74653 - DNA, 25 bp, E. coli
tggcattcgcccgtactcgtgataa

SEQ ID NO: 74654 - DNA, 25 bp, E. coli
tggcattcgcccctactcgtgataa

SEQ ID NO: 74655 - DNA, 25 bp, E. coli
taagagtggtcgacaactgaaccgc

SEQ ID NO: 74656 - DNA, 25 bp, E. coli
taagagtggtcgtcaactgaaccgc

SEQ ID NO: 74657 - DNA, 25 bp, E. coli
gagccgctgatttctcttgccaaga

SEQ ID NO: 74658 - DNA, 25 bp, E. coli
gagccgtgccggaggttacactcgt

SEQ ID NO: 74659 - DNA, 25 bp, E. coli
gagccgctgattactcttgccaaga

SEQ ID NO: 74660 - DNA, 25 bp, E. coli
gagccgtgccggtggttacactcgt

SEQ ID NO: 74661 - DNA, 25 bp, E. coli
caatggatggtttcgcggtacgttt

SEQ ID NO: 74662 - DNA, 25 bp, E. coli
caatggatggttacgcggtacgttt

SEQ ID NO: 74663 - DNA, 25 bp, E. coli
tacgcggtacgtttggccgatatca

SEQ ID NO: 74664 - DNA, 25 bp, E. coli
atatcacctccggacaaccgctgcc

SEQ ID NO: 74665 - DNA, 25 bp, E. coli
acgtttggccgaaatcacctccgga

SEQ ID NO: 74666 - DNA, 25 bp, E. coli
acgtttggccgatatcacctccgga

SEQ ID NO: 74667 - DNA, 25 bp, E. coli
atatcacctccgcacaaccgctgcc

SEQ ID NO: 74668 - DNA, 25 bp, E. coli
tacgcggtacgtatggccgatatca

SEQ ID NO: 74669 - DNA, 25 bp, E. coli
ttggccgatatctcctccggacaac

SEQ ID NO: 74670 - DNA, 25 bp, E. coli
ttggccgatatcacctccggacaac

SEQ ID NO: 74671 - DNA, 25 bp, E. coli
tccgcaatggatggttacgcggtac

SEQ ID NO: 74672 - DNA, 25 bp, E. coli
tccgcaatggatcgttacgcggtac

SEQ ID NO: 74673 - DNA, 25 bp, E. coli
cgcaatggatggttacgcggtacgt

SEQ ID NO: 74674 - DNA, 25 bp, E. coli
cgcggtacgtttggccgatatcacc

SEQ ID NO: 74675 - DNA, 25 bp, E. coli
cgcggtacgtttcgccgatatcacc

SEQ ID NO: 74676 - DNA, 25 bp, E. coli
cgcaatggatggatacgcggtacgt

SEQ ID NO: 74677 - DNA, 25 bp, E. coli
gtacgtttggcccatatcacctccg

SEQ ID NO: 74678 - DNA, 25 bp, E. coli
gtacgtttggccgatatcacctccg

SEQ ID NO: 74679 - DNA, 25 bp, E. coli
gtttggccgatatcacctccggaca

SEQ ID NO: 74680 - DNA, 25 bp, E. coli
gtttggccgataacacctccggaca

SEQ ID NO: 74681 - DNA, 25 bp, E. coli
tggttacgcggttcgtttggccgat

SEQ ID NO: 74682 - DNA, 25 bp, E. coli
tggttacgcggtacgtttggccgat

SEQ ID NO: 74683 - DNA, 25 bp, E. coli
atttgcccgcgaagataaaggcccg

SEQ ID NO: 74684 - DNA, 25 bp, E. coli
atttgcccgcgatgataaaggcccg

SEQ ID NO: 74685 - DNA, 25 bp, E. coli
tagtggtcatgcaaaccgtgcgtga

SEQ ID NO: 74686 - DNA, 25 bp, E. coli
tagtggtcatgctaaccgtgcgtga

SEQ ID NO: 74687 - DNA, 25 bp, E. coli
tttttactgctcttcgtctggaccg

SEQ ID NO: 74688 - DNA, 25 bp, E. coli
tttttactgctcatcgtctggaccg

SEQ ID NO: 74689 - DNA, 25 bp, E. coli
tctggcgaccgttgaaatgccggta

SEQ ID NO: 74690 - DNA, 25 bp, E. coli
tctggcgaccgtagaaatgccggta

SEQ ID NO: 74691 - DNA, 25 bp, E. coli
gcctggtggaactggagccgaaaac

SEQ ID NO: 74692 - DNA, 25 bp, E. coli
gcctggtggaacaggagccgaaaac

SEQ ID NO: 74693 - DNA, 25 bp, E. coli
gcgtgaccagataggccagcatgtt

SEQ ID NO: 74694 - DNA, 25 bp, E. coli
gcgtgaccagattggccagcatgtt

SEQ ID NO: 74695 - DNA, 25 bp, E. coli
cgcggtctgcttgctgaaaatgaaa

SEQ ID NO: 74696 - DNA, 25 bp, E. coli
cgcggtctgcttcctgaaaatgaaa

SEQ ID NO: 74697 - DNA, 25 bp, E. coli
gttgagttcagtgcgccatcgggtc

SEQ ID NO: 74698 - DNA, 25 bp, E. coli
gtaaataaacccaccggctggctgg

SEQ ID NO: 74699 - DNA, 25 bp, E. coli
gtaaataaaccctccggctggctgg

SEQ ID NO: 74700 - DNA, 25 bp, E. coli
gttgagttcagtccgccatcgggtc

SEQ ID NO: 74701 - DNA, 25 bp, E. coli
tcacaatttggctggcgcggtctgc

SEQ ID NO: 74702 - DNA, 25 bp, E. coli
tcacaatttggcaggcgcggtctgc

SEQ ID NO: 74703 - DNA, 25 bp, E. coli
gacggctgctggcacaacagtttga

SEQ ID NO: 74704 - DNA, 25 bp, E. coli
gacggctgctgggacaacagtttga

SEQ ID NO: 74705 - DNA, 25 bp, E. coli
aagatgctggtgatttccagcacgg

SEQ ID NO: 74706 - DNA, 25 bp, E. coli
aagatgctggtgttttccagcacgg

SEQ ID NO: 74707 - DNA, 25 bp, E. coli
atcagcaggataccgaagccacggc

SEQ ID NO: 74708 - DNA, 25 bp, E. coli
agatgatcagcaggataccgaagcc

SEQ ID NO: 74709 - DNA, 25 bp, E. coli
agatgatcagcacgataccgaagcc

SEQ ID NO: 74710 - DNA, 25 bp, E. coli
atcagcaggatagcgaagccacggc

SEQ ID NO: 74711 - DNA, 25 bp, E. coli
ttgcaaaccccgctgtttgtcggtc

SEQ ID NO: 74712 - DNA, 25 bp, E. coli
ttgcaaaccccggtgtttgtcggtc

SEQ ID NO: 74713 - DNA, 25 bp, E. coli
tgttgagcggcataaaacgctggca

SEQ ID NO: 74714 - DNA, 25 bp, E. coli
tgatcagcaggataccgaagccacg

SEQ ID NO: 74715 - DNA, 25 bp, E. coli
tgttgagcggcaaaaaacgctggca

SEQ ID NO: 74716 - DNA, 25 bp, E. coli
tgagcggcaaaatacgctggcaagc

SEQ ID NO: 74717 - DNA, 25 bp, E. coli
tgatcagcaggaaaccgaagccacg

SEQ ID NO: 74718 - DNA, 25 bp, E. coli
tgagcggcaaaaaacgctggcaagc

SEQ ID NO: 74719 - DNA, 25 bp, E. coli
gcaaaccccgctgtttgtcggtcag

SEQ ID NO: 74720 - DNA, 25 bp, E. coli
gcaaaccccgctctttgtcggtcag

SEQ ID NO: 74721 - DNA, 25 bp, E. coli
gctggtgttttccagcacggatatg

SEQ ID NO: 74722 - DNA, 25 bp, E. coli
gctggtgttttcgagcacggatatg

SEQ ID NO: 74723 - DNA, 25 bp, E. coli
gatgctggtgttatccagcacggat

SEQ ID NO: 74724 - DNA, 25 bp, E. coli
gatgctggtgttttccagcacggat

SEQ ID NO: 74725 - DNA, 25 bp, E. coli
gatgatcagcagcataccgaagcca

SEQ ID NO: 74726 - DNA, 25 bp, E. coli
gatgatcagcaggataccgaagcca

SEQ ID NO: 74727 - DNA, 25 bp, E. coli
aagaagcgggccatcacgttgtcga

SEQ ID NO: 74728 - DNA, 25 bp, E. coli
aagaagcgggccttcacgttgtcga

SEQ ID NO: 74729 - DNA, 25 bp, E. coli
cacgttgtcgattaagccattgtga

SEQ ID NO: 74730 - DNA, 25 bp, E. coli
cacgttgtcgataaagccattgtga

SEQ ID NO: 74731 - DNA, 25 bp, E. coli
tacggtttctaatcgtcgcggtgaa

SEQ ID NO: 74732 - DNA, 25 bp, E. coli
tacggtttctaaacgtcgcggtgaa

SEQ ID NO: 74733 - DNA, 25 bp, E. coli
aggtatctgcgtcgatcgccagcga

SEQ ID NO: 74734 - DNA, 25 bp, E. coli
aggtatctgcgtggatcgccagcga

SEQ ID NO: 74735 - DNA, 25 bp, E. coli
agaaaaccgctaggctattcgcgct

SEQ ID NO: 74736 - DNA, 25 bp, E. coli
agaaaaccgctacgctattcgcgct

SEQ ID NO: 74737 - DNA, 25 bp, E. coli
tatcccgacccgtattgctattctt

SEQ ID NO: 74738 - DNA, 25 bp, E. coli
tatcccgacccgaattgctattctt

SEQ ID NO: 74739 - DNA, 25 bp, E. coli
tattcgcgctcaggtatctgcgtgg

SEQ ID NO: 74740 - DNA, 25 bp, E. coli
tattcgcgctcacgtatctgcgtgg

SEQ ID NO: 74741 - DNA, 25 bp, E. coli
tcgccagcgacgttgtacaagtggt

SEQ ID NO: 74742 - DNA, 25 bp, E. coli
tcgcggtgaagatgacgatacctcc

SEQ ID NO: 74743 - DNA, 25 bp, E. coli
tcgcggtgaagaagacgatacctcc

SEQ ID NO: 74744 - DNA, 25 bp, E. coli
tcgccagcgacgatgtacaagtggt

SEQ ID NO: 74745 - DNA, 25 bp, E. coli
gccattgtgaaacaaaaccgctacg

SEQ ID NO: 74746 - DNA, 25 bp, E. coli
gccattgtgaaagaaaaccgctacg

SEQ ID NO: 74747 - DNA, 25 bp, E. coli
taagcactgaatttatcccgacccg

SEQ ID NO: 74748 - DNA, 25 bp, E. coli
taagcactgaatatatcccgacccg

SEQ ID NO: 74749 - DNA, 25 bp, E. coli
caactttgcgagcacgtggtttgcg

SEQ ID NO: 74750 - DNA, 25 bp, E. coli
caactttgcgaggacgtggtttgcg

SEQ ID NO: 74751 - DNA, 25 bp, E. coli
catacttggaaccagcctgcttacg

SEQ ID NO: 74752 - DNA, 25 bp, E. coli
catacttggaacgagcctgcttacg

SEQ ID NO: 74753 - DNA, 25 bp, E. coli
tacggtctttaacgccggagcagtc

SEQ ID NO: 74754 - DNA, 25 bp, E. coli
tacatacgccacgtttttgcgggca

SEQ ID NO: 74755 - DNA, 25 bp, E. coli
tacatacgccacctttttgcgggca

SEQ ID NO: 74756 - DNA, 25 bp, E. coli
tacggtctttaaggccggagcagtc

SEQ ID NO: 74757 - DNA, 25 bp, E. coli
gaagtcacttcgtaaccgttagtca

SEQ ID NO: 74758 - DNA, 25 bp, E. coli
gaagtcacttcgaaaccgttagtca

SEQ ID NO: 74759 - DNA, 25 bp, E. coli
acggatcaggatgacggagtgctcc

SEQ ID NO: 74760 - DNA, 25 bp, E. coli
acggatcaggatcacggagtgctcc

SEQ ID NO: 74761 - DNA, 25 bp, E. coli
acggcatacttttcgcagcgcggag

SEQ ID NO: 74762 - DNA, 25 bp, E. coli
acggcatactttacgcagcgcggag

SEQ ID NO: 74763 - DNA, 25 bp, E. coli
taggacgcttcaggccatacttgga

SEQ ID NO: 74764 - DNA, 25 bp, E. coli
taggacgcttcacgccatacttgga

SEQ ID NO: 74765 - DNA, 25 bp, E. coli
tccagcgcaggcacgttgcttttcg

SEQ ID NO: 74766 - DNA, 25 bp, E. coli
tccagcgcaggctcgttgcttttcg

SEQ ID NO: 74767 - DNA, 25 bp, E. coli
gttagtcagacgaacacggcatact

SEQ ID NO: 74768 - DNA, 25 bp, E. coli
gttagtcagacgtacacggcatact

SEQ ID NO: 74769 - DNA, 25 bp, E. coli
tcaccaccgatgaaggaagtcactt

SEQ ID NO: 74770 - DNA, 25 bp, E. coli
tcaccaccgatgtaggaagtcactt

SEQ ID NO: 74771 - DNA, 25 bp, E. coli
tttgcttggcgagctctacgacgag

SEQ ID NO: 74772 - DNA, 25 bp, E. coli
tatcgtggcgatccaaatctgggag

SEQ ID NO: 74773 - DNA, 25 bp, E. coli
tttgcttggcgacctctacgacgag

SEQ ID NO: 74774 - DNA, 25 bp, E. coli
tatcgtggcgatgcaaatctgggag

SEQ ID NO: 74775 - DNA, 25 bp, E. coli
tttatatgctggcaacaggcgcggt

SEQ ID NO: 74776 - DNA, 25 bp, E. coli
tttatatgctgggaacaggcgcggt

SEQ ID NO: 74777 - DNA, 25 bp, E. coli
tgttctgggtacaggcacaacaggg

SEQ ID NO: 74778 - DNA, 25 bp, E. coli
tgttctgggtactggcacaacaggg

SEQ ID NO: 74779 - DNA, 25 bp, E. coli
tgccggcgcgctgttaatgaccctt

SEQ ID NO: 74780 - DNA, 25 bp, E. coli
tgccggcgcgctcttaatgaccctt

SEQ ID NO: 74781 - DNA, 25 bp, E. coli
gctgcgggcaatatcggttctatcg

SEQ ID NO: 74782 - DNA, 25 bp, E. coli
gctgcgggcaatttcggttctatcg

SEQ ID NO: 74783 - DNA, 25 bp, E. coli
gcgattgcgcaaatcacgcgtctga

SEQ ID NO: 74784 - DNA, 25 bp, E. coli
gcgattgcgcaattcacgcgtctga

SEQ ID NO: 74785 - DNA, 25 bp, E. coli
gactggtccggatatttgctggcga

SEQ ID NO: 74786 - DNA, 25 bp, E. coli
gactggtccggaaatttgctggcga

SEQ ID NO: 74787 - DNA, 25 bp, E. coli
gaactctttattcacccggtggcga

SEQ ID NO: 74788 - DNA, 25 bp, E. coli
gaactctttattgacccggtggcga

SEQ ID NO: 74789 - DNA, 25 bp, E. coli
ctttagcctgtatctggcgctggca

SEQ ID NO: 74790 - DNA, 25 bp, E. coli
ctttagcctgtaactggcgctggca

SEQ ID NO: 74791 - DNA, 25 bp, E. coli
ggcggcagtaccttcagcttgttta

SEQ ID NO: 74792 - DNA, 25 bp, E. coli
ggcggcagtaccatcagcttgttta

SEQ ID NO: 74793 - DNA, 25 bp, E. coli
tacacccagggcagcgtaatgatgg

SEQ ID NO: 74794 - DNA, 25 bp, E. coli
tacacccagggctgcgtaatgatgg

SEQ ID NO: 74795 - DNA, 25 bp, E. coli
taaaatcggtgtcgcaaactccctc

SEQ ID NO: 74796 - DNA, 25 bp, E. coli
taaagggaacgatttccgcgcggct

SEQ ID NO: 74797 - DNA, 25 bp, E. coli
taaagggaacgaattccgcgcggct

SEQ ID NO: 74798 - DNA, 25 bp, E. coli
taaaatcggtgtggcaaactccctc

SEQ ID NO: 74799 - DNA, 25 bp, E. coli
tgtcgctgattatgaccgtgccgcc

SEQ ID NO: 74800 - DNA, 25 bp, E. coli
tgtcgctgattaagaccgtgccgcc

SEQ ID NO: 74801 - DNA, 25 bp, E. coli
tgatggttgcacatactggctaccg

SEQ ID NO: 74802 - DNA, 25 bp, E. coli
tgatggttgcacttactggctaccg

SEQ ID NO: 74803 - DNA, 25 bp, E. coli
ccgtgacgccagtttttcagacgca

SEQ ID NO: 74804 - DNA, 25 bp, E. coli
ccgtgacgccagattttcagacgca

SEQ ID NO: 74805 - DNA, 25 bp, E. coli
gaacttaatctgatgtcggcggcca

SEQ ID NO: 74806 - DNA, 25 bp, E. coli
gaaatatgtggtatacccctgcctg

SEQ ID NO: 74807 - DNA, 25 bp, E. coli
gaaatatgtggtttacccctgcctg

SEQ ID NO: 74808 - DNA, 25 bp, E. coli
gaacttaatctgttgtcggcggcca

SEQ ID NO: 74809 - DNA, 25 bp, E. coli
gattgttattcgaccctttgccggg

SEQ ID NO: 74810 - DNA, 25 bp, E. coli
gattgttattcgtccctttgccggg

SEQ ID NO: 74811 - DNA, 25 bp, E. coli
ggttatcagccaagccgacggttca

SEQ ID NO: 74812 - DNA, 25 bp, E. coli
ggttatcagccatgccgacggttca

SEQ ID NO: 74813 - DNA, 25 bp, E. coli
tcaatgcgatggttgcaggcctggc

SEQ ID NO: 74814 - DNA, 25 bp, E. coli
tcaatgcgatggatgcaggcctggc

SEQ ID NO: 74815 - DNA, 25 bp, E. coli
taacaaaataattaccctgggtgag

SEQ ID NO: 74816 - DNA, 25 bp, E. coli
taacaaaataataaccctgggtgag

SEQ ID NO: 74817 - DNA, 25 bp, E. coli
tatgcgcggccacattgttgacaaa

SEQ ID NO: 74818 - DNA, 25 bp, E. coli
tatgcgcggccagattgttgacaaa

SEQ ID NO: 74819 - DNA, 25 bp, E. coli
tatattgcagagatgatgtagacac

SEQ ID NO: 74820 - DNA, 25 bp, E. coli
tatattgcagagttgatgtagacac

SEQ ID NO: 74821 - DNA, 25 bp, E. coli
ttagtaatcctgaaactctgcgtcg

SEQ ID NO: 74822 - DNA, 25 bp, E. coli
ttattcggtctagaaaagcaggcaa

SEQ ID NO: 74823 - DNA, 25 bp, E. coli
ttattcggtctacaaaagcaggcaa

SEQ ID NO: 74824 - DNA, 25 bp, E. coli
ttagtaatcctgtaactctgcgtcg

SEQ ID NO: 74825 - DNA, 25 bp, E. coli
tgtagacactggcaagcgtagcgca

SEQ ID NO: 74826 - DNA, 25 bp, E. coli
tgtagacactgggaagcgtagcgca

SEQ ID NO: 74827 - DNA, 25 bp, E. coli
tctcgatcaaattggctgaaaggcg

SEQ ID NO: 74828 - DNA, 25 bp, E. coli
tcggagtcttcaagcgatgagcaag

SEQ ID NO: 74829 - DNA, 25 bp, E. coli
tctgcgtcgtattagccagtgacca

SEQ ID NO: 74830 - DNA, 25 bp, E. coli
tcggagtcttcatgcgatgagcaag

SEQ ID NO: 74831 - DNA, 25 bp, E. coli
tctcgatcaaataggctgaaaggcg

SEQ ID NO: 74832 - DNA, 25 bp, E. coli
tctgcgtcgtataagccagtgacca

SEQ ID NO: 74833 - DNA, 25 bp, E. coli
gcatgcgtgtgagcctttctaacgg

SEQ ID NO: 74834 - DNA, 25 bp, E. coli
gcatgcgtgtgaccctttctaacgg

SEQ ID NO: 74835 - DNA, 25 bp, E. coli
tcaaaccgaagcgacatatgcgcgg

SEQ ID NO: 74836 - DNA, 25 bp, E. coli
tcaaaccgaagccacatatgcgcgg

SEQ ID NO: 74837 - DNA, 25 bp, E. coli
caaccatattgtccacgctgaacga

SEQ ID NO: 74838 - DNA, 25 bp, E. coli
cacctgatgccgcaagaagtctgcc

SEQ ID NO: 74839 - DNA, 25 bp, E. coli
cacctgatgccggaagaagtctgcc

SEQ ID NO: 74840 - DNA, 25 bp, E. coli
caaccatattgtgcacgctgaacga

SEQ ID NO: 74841 - DNA, 25 bp, E. coli
taggaaagagggtcaatgccaggcc

SEQ ID NO: 74842 - DNA, 25 bp, E. coli
taggaaagagggacaatgccaggcc

SEQ ID NO: 74843 - DNA, 25 bp, E. coli
ttaactggatactggatgtcgcccg

SEQ ID NO: 74844 - DNA, 25 bp, E. coli
ttaactggatacaggatgtcgcccg

SEQ ID NO: 74845 - DNA, 25 bp, E. coli
cgttgttaccgagcaaaccatggca

SEQ ID NO: 74846 - DNA, 25 bp, E. coli
cgttgttaccgaccaaaccatggca

SEQ ID NO: 74847 - DNA, 25 bp, E. coli
ctataattgggacaagacgcacggt

SEQ ID NO: 74848 - DNA, 25 bp, E. coli
ctataattgggagaagacgcacggt

SEQ ID NO: 74849 - DNA, 25 bp, E. coli
gatattcgcccgaatgacgatcgcg

SEQ ID NO: 74850 - DNA, 25 bp, E. coli
gatattcgcccgtatgacgatcgcg

SEQ ID NO: 74851 - DNA, 25 bp, E. coli
taatcgagcacatggaagacggcct

SEQ ID NO: 74852 - DNA, 25 bp, E. coli
taagatgaaggcaactccgcaggat

SEQ ID NO: 74853 - DNA, 25 bp, E. coli
tcagatgatggatgaacgctccgcg

SEQ ID NO: 74854 - DNA, 25 bp, E. coli
taagatgaaggctactccgcaggat

SEQ ID NO: 74855 - DNA, 25 bp, E. coli
tcagatgatggaagaacgctccgcg

SEQ ID NO: 74856 - DNA, 25 bp, E. coli
taatcgagcacaaggaagacggcct

SEQ ID NO: 74857 - DNA, 25 bp, E. coli
gatgttgactccgacccaggtatgg

SEQ ID NO: 74858 - DNA, 25 bp, E. coli
gatgttgactcccacccaggtatgg

SEQ ID NO: 74859 - DNA, 25 bp, E. coli
caccgtttgcagttacagggcggta

SEQ ID NO: 74860 - DNA, 25 bp, E. coli
caccgtttgcagatacagggcggta

SEQ ID NO: 74861 - DNA, 25 bp, E. coli
ctcctatcaaaaagaaccccaggtc

SEQ ID NO: 74862 - DNA, 25 bp, E. coli
ctgggcaccgttagcagttacaggg

SEQ ID NO: 74863 - DNA, 25 bp, E. coli
ctgggcaccgtttgcagttacaggg

SEQ ID NO: 74864 - DNA, 25 bp, E. coli
ctcctatcaaaatgaaccccaggtc

SEQ ID NO: 74865 - DNA, 25 bp, E. coli
acacgccgttccctggatgcaaagc

SEQ ID NO: 74866 - DNA, 25 bp, E. coli
acacgccgttccgtggatgcaaagc

SEQ ID NO: 74867 - DNA, 25 bp, E. coli
tatttgattcatcagccttacggtg

SEQ ID NO: 74868 - DNA, 25 bp, E. coli
tatttgattcatgagccttacggtg

SEQ ID NO: 74869 - DNA, 25 bp, E. coli
tgacctgtatttcattcatcagcct

SEQ ID NO: 74870 - DNA, 25 bp, E. coli
tgacctgtatttgattcatcagcct

SEQ ID NO: 74871 - DNA, 25 bp, E. coli
tcagccttacggtgatgtccacggt

SEQ ID NO: 74872 - DNA, 25 bp, E. coli
gcctcctatcaaaatgaaccccagg

SEQ ID NO: 74873 - DNA, 25 bp, E. coli
gcctcctatcaatatgaaccccagg

SEQ ID NO: 74874 - DNA, 25 bp, E. coli
cgttccgtggatgcaaagccgtggt

SEQ ID NO: 74875 - DNA, 25 bp, E. coli
cgtggatgcaaagccgtggtattca

SEQ ID NO: 74876 - DNA, 25 bp, E. coli
cgttccgtggatccaaagccgtggt

SEQ ID NO: 74877 - DNA, 25 bp, E. coli
cttacggtgatgtccacggtgcctg

SEQ ID NO: 74878 - DNA, 25 bp, E. coli
cttacggtgatgaccacggtgcctg

SEQ ID NO: 74879 - DNA, 25 bp, E. coli
cgtggatgcaaacccgtggtattca

SEQ ID NO: 74880 - DNA, 25 bp, E. coli
tcagccttacggagatgtccacggt

SEQ ID NO: 74881 - DNA, 25 bp, E. coli
catcttcgatggtgactttgagaac

SEQ ID NO: 74882 - DNA, 25 bp, E. coli
catggatatcgcaaataacgatttg

SEQ ID NO: 74883 - DNA, 25 bp, E. coli
catcttcgatggagactttgagaac

SEQ ID NO: 74884 - DNA, 25 bp, E. coli
catggatatcgctaataacgatttg

SEQ ID NO: 74885 - DNA, 25 bp, E. coli
ttgaccgcgttattgcagataaacc

SEQ ID NO: 74886 - DNA, 25 bp, E. coli
ttttttgaccgcgttattgcagata

SEQ ID NO: 74887 - DNA, 25 bp, E. coli
ttttttgaccgccttattgcagata

SEQ ID NO: 74888 - DNA, 25 bp, E. coli
ttgaccgcgttaatgcagataaacc

SEQ ID NO: 74889 - DNA, 25 bp, E. coli
tcgcaaataacgttttgcccttcgt

SEQ ID NO: 74890 - DNA, 25 bp, E. coli
tcgcaaataacgatttgcccttcgt

SEQ ID NO: 74891 - DNA, 25 bp, E. coli
ccatcttcgatgctgactttgagaa

SEQ ID NO: 74892 - DNA, 25 bp, E. coli
ccatcttcgatggtgactttgagaa

SEQ ID NO: 74893 - DNA, 25 bp, E. coli
gcttcatggataacgcaaataacga

SEQ ID NO: 74894 - DNA, 25 bp, E. coli
gcttcatggatatcgcaaataacga

SEQ ID NO: 74895 - DNA, 25 bp, E. coli
ccgcgttattgcagataaaccgata

SEQ ID NO: 74896 - DNA, 25 bp, E. coli
ccgcgttattgctgataaaccgata

SEQ ID NO: 74897 - DNA, 25 bp, E. coli
gatatcgcaaataacgatttgccct

SEQ ID NO: 74898 - DNA, 25 bp, E. coli
gatatcgcaaattacgatttgccct

SEQ ID NO: 74899 - DNA, 25 bp, E. coli
tggaaataaccaacttcgatggtga

SEQ ID NO: 74900 - DNA, 25 bp, E. coli
tggaaataaccatcttcgatggtga

SEQ ID NO: 74901 - DNA, 25 bp, E. coli
gaccgcgttattccagataaaccga

SEQ ID NO: 74902 - DNA, 25 bp, E. coli
gaccgcgttattgcagataaaccga

SEQ ID NO: 74903 - DNA, 25 bp, E. coli
tacaatctttacttcctcgacagcg

SEQ ID NO: 74904 - DNA, 25 bp, E. coli
tacaatctttacatcctcgacagcg

SEQ ID NO: 74905 - DNA, 25 bp, E. coli
taaacagccgctcgagaaaaatacg

SEQ ID NO: 74906 - DNA, 25 bp, E. coli
taaacagccgctggagaaaaatacg

SEQ ID NO: 74907 - DNA, 25 bp, E. coli
tattaagcgaaaccatcagccagag

SEQ ID NO: 74908 - DNA, 25 bp, E. coli
tattaagcgaaagcatcagccagag

SEQ ID NO: 74909 - DNA, 25 bp, E. coli
tccgtggcgtgatgctgtgcaaacc

SEQ ID NO: 74910 - DNA, 25 bp, E. coli
tcgtagtgcggtgaataacgtgccc

SEQ ID NO: 74911 - DNA, 25 bp, E. coli
tccgtggcgtgaagctgtgcaaacc

SEQ ID NO: 74912 - DNA, 25 bp, E. coli
tcgtagtgcggtcaataacgtgccc

SEQ ID NO: 74913 - DNA, 25 bp, E. coli
gcaagatgacctgtaacctgtttgg

SEQ ID NO: 74914 - DNA, 25 bp, E. coli
gcaagatgacctctaacctgtttgg

SEQ ID NO: 74915 - DNA, 25 bp, E. coli
cccggagatgagcagcgacgaaatt

SEQ ID NO: 74916 - DNA, 25 bp, E. coli
cccggagatgaggagcgacgaaatt

SEQ ID NO: 74917 - DNA, 25 bp, E. coli
cattacgctggtcaaagccagcagc

SEQ ID NO: 74918 - DNA, 25 bp, E. coli
cattacgctggtgaaagccagcagc

SEQ ID NO: 74919 - DNA, 25 bp, E. coli
taaccatcggtaatacccaggcgat

SEQ ID NO: 74920 - DNA, 25 bp, E. coli
taaccatcggtattacccaggcgat

SEQ ID NO: 74921 - DNA, 25 bp, E. coli
taacctgccgccagacattacgctg

SEQ ID NO: 74922 - DNA, 25 bp, E. coli
taacctgccgcctgacattacgctg

SEQ ID NO: 74923 - DNA, 25 bp, E. coli
gatcgtttacttgcagcatcagtgg

SEQ ID NO: 74924 - DNA, 25 bp, E. coli
gatcgtttacttccagcatcagtgg

SEQ ID NO: 74925 - DNA, 25 bp, E. coli
caggtgcagagtgatttgccgtggt

SEQ ID NO: 74926 - DNA, 25 bp, E. coli
caggtgcagagtcatttgccgtggt

SEQ ID NO: 74927 - DNA, 25 bp, E. coli
accggcggctgcaggtgcagagtga

SEQ ID NO: 74928 - DNA, 25 bp, E. coli
accggcggctgctggtgcagagtga

SEQ ID NO: 74929 - DNA, 25 bp, E. coli
aggtgcagagtgatttgccgtggtg

SEQ ID NO: 74930 - DNA, 25 bp, E. coli
agtgatttgccgtggtggctggtct

SEQ ID NO: 74931 - DNA, 25 bp, E. coli
aggtgcagagtgttttgccgtggtg

SEQ ID NO: 74932 - DNA, 25 bp, E. coli
agtgatttgccgaggtggctggtct

SEQ ID NO: 74933 - DNA, 25 bp, E. coli
tgcaggtgcagagtgatttgccgtg

SEQ ID NO: 74934 - DNA, 25 bp, E. coli
tgcaggtgcagactgatttgccgtg

SEQ ID NO: 74935 - DNA, 25 bp, E. coli
ccggcggctgcacgtgcagagtgat

SEQ ID NO: 74936 - DNA, 25 bp, E. coli
ccggcggctgcaggtgcagagtgat

SEQ ID NO: 74937 - DNA, 25 bp, E. coli
gcaggtgcagagagatttgccgtgg

SEQ ID NO: 74938 - DNA, 25 bp, E. coli
gcaggtgcagagtgatttgccgtgg

SEQ ID NO: 74939 - DNA, 25 bp, E. coli
ctgcaggtgcagtgtgatttgccgt

SEQ ID NO: 74940 - DNA, 25 bp, E. coli
ctgcaggtgcagagtgatttgccgt

SEQ ID NO: 74941 - DNA, 25 bp, E. coli
ggtgcagagtgatttgccgtggtgg

SEQ ID NO: 74942 - DNA, 25 bp, E. coli
ggtgcagagtgaattgccgtggtgg

SEQ ID NO: 74943 - DNA, 25 bp, E. coli
gaccggcggctgcaggtgcagagtg

SEQ ID NO: 74944 - DNA, 25 bp, E. coli
gaccggcggctggaggtgcagagtg

SEQ ID NO: 74945 - DNA, 25 bp, E. coli
gagtgatttgccgtggtggctggtc

SEQ ID NO: 74946 - DNA, 25 bp, E. coli
gagtgatttgccctggtggctggtc

SEQ ID NO: 74947 - DNA, 25 bp, E. coli
caggtcgtggcgctcaagaaaatgc

SEQ ID NO: 74948 - DNA, 25 bp, E. coli
caggtcgtggcggtcaagaaaatgc

SEQ ID NO: 74949 - DNA, 25 bp, E. coli
taaacggtctgaagcgggaagtgat

SEQ ID NO: 74950 - DNA, 25 bp, E. coli
taaacggtctgatgcgggaagtgat

SEQ ID NO: 74951 - DNA, 25 bp, E. coli
aacagattgctgctatccgtggcgc

SEQ ID NO: 74952 - DNA, 25 bp, E. coli
aacagattgctggtatccgtggcgc

SEQ ID NO: 74953 - DNA, 25 bp, E. coli
tgcgggaagtgaataaaggtcatct

SEQ ID NO: 74954 - DNA, 25 bp, E. coli
tccgtggcgcggaaaacggtctgat

SEQ ID NO: 74955 - DNA, 25 bp, E. coli
tgcgggaagtgattaaaggtcatct

SEQ ID NO: 74956 - DNA, 25 bp, E. coli
tccgtggcgcggtaaacggtctgat

SEQ ID NO: 74957 - DNA, 25 bp, E. coli
ccagtaagattctgggccaggtcgt

SEQ ID NO: 74958 - DNA, 25 bp, E. coli
ccagtaagattcagggccaggtcgt

SEQ ID NO: 74959 - DNA, 25 bp, E. coli
gaatgcgctgcagttttacaacaga

SEQ ID NO: 74960 - DNA, 25 bp, E. coli
gaatgcgctgcacttttacaacaga

SEQ ID NO: 74961 - DNA, 25 bp, E. coli
gaaagcgcgtgcgagtaagattcag

SEQ ID NO: 74962 - DNA, 25 bp, E. coli
gaaagcgcgtgccagtaagattcag

SEQ ID NO: 74963 - DNA, 25 bp, E. coli
gtctcatacaatccgtgataaacag

SEQ ID NO: 74964 - DNA, 25 bp, E. coli
gtctcatacaatgcgtgataaacag

SEQ ID NO: 74965 - DNA, 25 bp, E. coli
gtgataaacagaaactgaaagcgcg

SEQ ID NO: 74966 - DNA, 25 bp, E. coli
gtgataaacagatactgaaagcgcg

SEQ ID NO: 74967 - DNA, 25 bp, E. coli
tggcgctcaagataatgctcgacga

SEQ ID NO: 74968 - DNA, 25 bp, E. coli
tggcgctcaagaaaatgctcgacga

SEQ ID NO: 74969 - DNA, 25 bp, E. coli
caccgaacagttgcaacaggctgac

SEQ ID NO: 74970 - DNA, 25 bp, E. coli
caccgaacagttccaacaggctgac

SEQ ID NO: 74971 - DNA, 25 bp, E. coli
cataccttcaccgaacagttgcaac

SEQ ID NO: 74972 - DNA, 25 bp, E. coli
cataccttcacccaacagttgcaac

SEQ ID NO: 74973 - DNA, 25 bp, E. coli
accgaacagttgcaacaggctgacg

SEQ ID NO: 74974 - DNA, 25 bp, E. coli
actccataccttgaccgaacagttg

SEQ ID NO: 74975 - DNA, 25 bp, E. coli
ctccataccttcaccgaacagttgc

SEQ ID NO: 74976 - DNA, 25 bp, E. coli
ctccataccttctccgaacagttgc

SEQ ID NO: 74977 - DNA, 25 bp, E. coli
actccataccttcaccgaacagttg

SEQ ID NO: 74978 - DNA, 25 bp, E. coli
accgaacagttggaacaggctgacg

SEQ ID NO: 74979 - DNA, 25 bp, E. coli
tccataccttcaccgaacagttgca

SEQ ID NO: 74980 - DNA, 25 bp, E. coli
tcacgccgaattaacaaacccgtct

SEQ ID NO: 74981 - DNA, 25 bp, E. coli
tcacgccgaatttacaaacccgtct

SEQ ID NO: 74982 - DNA, 25 bp, E. coli
tccataccttcagcgaacagttgca

SEQ ID NO: 74983 - DNA, 25 bp, E. coli
ccataccttcaccgaacagttgcaa

SEQ ID NO: 74984 - DNA, 25 bp, E. coli
gccgaatttacatacccgtcttgat

SEQ ID NO: 74985 - DNA, 25 bp, E. coli
gccgaatttacaaacccgtcttgat

SEQ ID NO: 74986 - DNA, 25 bp, E. coli
ccataccttcacggaacagttgcaa

SEQ ID NO: 74987 - DNA, 25 bp, E. coli
ccgaacagttgcaacaggctgacgg

SEQ ID NO: 74988 - DNA, 25 bp, E. coli
ccgaacagttgctacaggctgacgg

SEQ ID NO: 74989 - DNA, 25 bp, E. coli
taaacgcttgaccgaaggccgcgta

SEQ ID NO: 74990 - DNA, 25 bp, E. coli
taaacgcttgacggaaggccgcgta

SEQ ID NO: 74991 - DNA, 25 bp, E. coli
attaaacgcttgaccgaaggccgcg

SEQ ID NO: 74992 - DNA, 25 bp, E. coli
agcgattaaacgcttgaccgaaggc

SEQ ID NO: 74993 - DNA, 25 bp, E. coli
agcgattaaacggttgaccgaaggc

SEQ ID NO: 74994 - DNA, 25 bp, E. coli
attaaacgcttgtccgaaggccgcg

SEQ ID NO: 74995 - DNA, 25 bp, E. coli
ttgagcataaaaccgcgttgctggt

SEQ ID NO: 74996 - DNA, 25 bp, E. coli
ttaaacgcttgaccgaaggccgcgt

SEQ ID NO: 74997 - DNA, 25 bp, E. coli
ttgagcataaaagcgcgttgctggt

SEQ ID NO: 74998 - DNA, 25 bp, E. coli
ttaccgcgccgatgatcttgagcat

SEQ ID NO: 74999 - DNA, 25 bp, E. coli
ttaccgcgccgaagatcttgagcat

SEQ ID NO: 75000 - DNA, 25 bp, E. coli
ttaaacgcttgagcgaaggccgcgt

SEQ ID NO: 75001 - DNA, 25 bp, E. coli
tgatcttgagcataaaaccgcgttg

SEQ ID NO: 75002 - DNA, 25 bp, E. coli
tgatcttgagcaaaaaaccgcgttg

SEQ ID NO: 75003 - DNA, 25 bp, E. coli
gcgccgatgatcatgagcataaaac

SEQ ID NO: 75004 - DNA, 25 bp, E. coli
gcgccgatgatcttgagcataaaac

SEQ ID NO: 75005 - DNA, 25 bp, E. coli
gcgattaaacgcttgaccgaaggcc

SEQ ID NO: 75006 - DNA, 25 bp, E. coli
gcgattaaacgcatgaccgaaggcc

SEQ ID NO: 75007 - DNA, 25 bp, E. coli
cgattaaacgctagaccgaaggccg

SEQ ID NO: 75008 - DNA, 25 bp, E. coli
cgattaaacgcttgaccgaaggccg

SEQ ID NO: 75009 - DNA, 25 bp, E. coli
gattaaacgcttcaccgaaggccgc

SEQ ID NO: 75010 - DNA, 25 bp, E. coli
gattaaacgcttgaccgaaggccgc

SEQ ID NO: 75011 - DNA, 25 bp, E. coli
caacagcctgtttcacgtcggggaa

SEQ ID NO: 75012 - DNA, 25 bp, E. coli
cacggtgcggctatctggctactgg

SEQ ID NO: 75013 - DNA, 25 bp, E. coli
cacggtgcggctttctggctactgg

SEQ ID NO: 75014 - DNA, 25 bp, E. coli
caacagcctgttacacgtcggggaa

SEQ ID NO: 75015 - DNA, 25 bp, E. coli
tacagatttctcacggtgcggctat

SEQ ID NO: 75016 - DNA, 25 bp, E. coli
tacagatttctctcggtgcggctat

SEQ ID NO: 75017 - DNA, 25 bp, E. coli
ttctttatcgctatcgtttcggtgc

SEQ ID NO: 75018 - DNA, 25 bp, E. coli
ttatcgctatcgattcggtgctggt

SEQ ID NO: 75019 - DNA, 25 bp, E. coli
ttatcgctatcgtttcggtgctggt

SEQ ID NO: 75020 - DNA, 25 bp, E. coli
ttctttatcgctttcgtttcggtgc

SEQ ID NO: 75021 - DNA, 25 bp, E. coli
gctacagatttcacacggtgcggct

SEQ ID NO: 75022 - DNA, 25 bp, E. coli
gctacagatttctcacggtgcggct

SEQ ID NO: 75023 - DNA, 25 bp, E. coli
gaagtgacttcagcggtgacgctga

SEQ ID NO: 75024 - DNA, 25 bp, E. coli
gaatcgctacagatttctcacggtg

SEQ ID NO: 75025 - DNA, 25 bp, E. coli
gaatcgctacagttttctcacggtg

SEQ ID NO: 75026 - DNA, 25 bp, E. coli
gaagtgacttcaccggtgacgctga

SEQ ID NO: 75027 - DNA, 25 bp, E. coli
gacttcagcggtgacgctgatcttc

SEQ ID NO: 75028 - DNA, 25 bp, E. coli
gacttcagcggtcacgctgatcttc

SEQ ID NO: 75029 - DNA, 25 bp, E. coli
gatttctcacggtgcggctatctgg

SEQ ID NO: 75030 - DNA, 25 bp, E. coli
gatttctcacggagcggctatctgg

SEQ ID NO: 75031 - DNA, 25 bp, E. coli
gggaatcgctacagatttctcacgg

SEQ ID NO: 75032 - DNA, 25 bp, E. coli
gggaatcgctactgatttctcacgg

SEQ ID NO: 75033 - DNA, 25 bp, E. coli
caaagttaaagctcaggacgtacag

SEQ ID NO: 75034 - DNA, 25 bp, E. coli
aagttcccggcaatcatctacggtg

SEQ ID NO: 75035 - DNA, 25 bp, E. coli
aagttcccggcattcatctacggtg

SEQ ID NO: 75036 - DNA, 25 bp, E. coli
caaagttaaagcacaggacgtacag

SEQ ID NO: 75037 - DNA, 25 bp, E. coli
caatcatctacgctggcaaagaagc

SEQ ID NO: 75038 - DNA, 25 bp, E. coli
caatcatctacggtggcaaagaagc

SEQ ID NO: 75039 - DNA, 25 bp, E. coli
cagaagtacgtaaagagcagggtaa

SEQ ID NO: 75040 - DNA, 25 bp, E. coli
cagaagtacgtatagagcagggtaa

SEQ ID NO: 75041 - DNA, 25 bp, E. coli
tgtttactatcaacgcagaagtacg

SEQ ID NO: 75042 - DNA, 25 bp, E. coli
tgtttactatcatcgcagaagtacg

SEQ ID NO: 75043 - DNA, 25 bp, E. coli
gcacatcgacttggttcgcgcttaa

SEQ ID NO: 75044 - DNA, 25 bp, E. coli
gaattctacagccaagttctgacca

SEQ ID NO: 75045 - DNA, 25 bp, E. coli
gaagttctgaccatcgttgttgacg

SEQ ID NO: 75046 - DNA, 25 bp, E. coli
gcacatcgacttcgttcgcgcttaa

SEQ ID NO: 75047 - DNA, 25 bp, E. coli
gaattctacagcgaagttctgacca

SEQ ID NO: 75048 - DNA, 25 bp, E. coli
gaagttctgaccttcgttgttgacg

SEQ ID NO: 75049 - DNA, 25 bp, E. coli
ctgcgtgccgctaacaagttcccgg

SEQ ID NO: 75050 - DNA, 25 bp, E. coli
ctggatcacgacaaagtcatgaaca

SEQ ID NO: 75051 - DNA, 25 bp, E. coli
ctggatcacgactaagtcatgaaca

SEQ ID NO: 75052 - DNA, 25 bp, E. coli
ctgcgtgccgcttacaagttcccgg

SEQ ID NO: 75053 - DNA, 25 bp, E. coli
ggacgtacagcgtcacccgtacaaa

SEQ ID NO: 75054 - DNA, 25 bp, E. coli
ggacgtacagcgacacccgtacaaa

SEQ ID NO: 75055 - DNA, 25 bp, E. coli
aatgtcggcaccagtcatgtcggca

SEQ ID NO: 75056 - DNA, 25 bp, E. coli
aatgtcggcacctgtcatgtcggca

SEQ ID NO: 75057 - DNA, 25 bp, E. coli
taccaggcccatcgaacgtgcagta

SEQ ID NO: 75058 - DNA, 25 bp, E. coli
taccaggcccatggaacgtgcagta

SEQ ID NO: 75059 - DNA, 25 bp, E. coli
tgattactaccggaatcggcagacc

SEQ ID NO: 75060 - DNA, 25 bp, E. coli
tgattactaccgcaatcggcagacc

SEQ ID NO: 75061 - DNA, 25 bp, E. coli
tgcaacctgcaggttgacataggct

SEQ ID NO: 75062 - DNA, 25 bp, E. coli
tgcaacctgcagcttgacataggct

SEQ ID NO: 75063 - DNA, 25 bp, E. coli
gcgagtcatcgcttcaatgtcggca

SEQ ID NO: 75064 - DNA, 25 bp, E. coli
gcgagtcatcgcatcaatgtcggca

SEQ ID NO: 75065 - DNA, 25 bp, E. coli
gcagtaccttcgatggagcgagtca

SEQ ID NO: 75066 - DNA, 25 bp, E. coli
gaaccagacttgataccagccgctt

SEQ ID NO: 75067 - DNA, 25 bp, E. coli
gcagtaccttcgttggagcgagtca

SEQ ID NO: 75068 - DNA, 25 bp, E. coli
gaattccatgatctttacgccctgc

SEQ ID NO: 75069 - DNA, 25 bp, E. coli
gaaccagacttgttaccagccgctt

SEQ ID NO: 75070 - DNA, 25 bp, E. coli
gaattccatgatgtttacgccctgc

SEQ ID NO: 75071 - DNA, 25 bp, E. coli
cgatttcctgcagctgagcgcggga

SEQ ID NO: 75072 - DNA, 25 bp, E. coli
cgatttcctgcacctgagcgcggga

SEQ ID NO: 75073 - DNA, 25 bp, E. coli
cggcagacctttatcgatggaatca

SEQ ID NO: 75074 - DNA, 25 bp, E. coli
cggcagacctttttcgatggaatca

SEQ ID NO: 75075 - DNA, 25 bp, E. coli
taacgaaagtgatagaacggtcagc

SEQ ID NO: 75076 - DNA, 25 bp, E. coli
taacgaaagtgaaagaacggtcagc

SEQ ID NO: 75077 - DNA, 25 bp, E. coli
aaccatggtggttgtgactcacgaa

SEQ ID NO: 75078 - DNA, 25 bp, E. coli
aaccatggtggtagtgactcacgaa

SEQ ID NO: 75079 - DNA, 25 bp, E. coli
catggtggtagtgactcacgaaatg

SEQ ID NO: 75080 - DNA, 25 bp, E. coli
catggtggtagtcactcacgaaatg

SEQ ID NO: 75081 - DNA, 25 bp, E. coli
actggcagaagaggggaaaaccatg

SEQ ID NO: 75082 - DNA, 25 bp, E. coli
actggcagaagacgggaaaaccatg

SEQ ID NO: 75083 - DNA, 25 bp, E. coli
aactggtaggcgaagtgttgcgtat

SEQ ID NO: 75084 - DNA, 25 bp, E. coli
aactggtaggcgtagtgttgcgtat

SEQ ID NO: 75085 - DNA, 25 bp, E. coli
tcgatcctgaacaggtaggcgaagt

SEQ ID NO: 75086 - DNA, 25 bp, E. coli
tcgatcctgaactggtaggcgaagt

SEQ ID NO: 75087 - DNA, 25 bp, E. coli
cctgaactggtaggcgaagtgttgc

SEQ ID NO: 75088 - DNA, 25 bp, E. coli
cctgaactggtacgcgaagtgttgc

SEQ ID NO: 75089 - DNA, 25 bp, E. coli
gcgaagtgttgcgtattatgcagca

SEQ ID NO: 75090 - DNA, 25 bp, E. coli
gcgtattatgcagcaactggcagaa

SEQ ID NO: 75091 - DNA, 25 bp, E. coli
gcgtattatgcaccaactggcagaa

SEQ ID NO: 75092 - DNA, 25 bp, E. coli
gcgaagtgttgcctattatgcagca

SEQ ID NO: 75093 - DNA, 25 bp, E. coli
gaagttttactgattgatgaaccta

SEQ ID NO: 75094 - DNA, 25 bp, E. coli
gaagttttactgtttgatgaaccta

SEQ ID NO: 75095 - DNA, 25 bp, E. coli
gaaaaccatggtggtagtgactcac

SEQ ID NO: 75096 - DNA, 25 bp, E. coli
gaaaaccatggtcgtagtgactcac

SEQ ID NO: 75097 - DNA, 25 bp, E. coli
cgctcgatcctgaactggtaggcga

SEQ ID NO: 75098 - DNA, 25 bp, E. coli
cgctcgatcctgtactggtaggcga

SEQ ID NO: 75099 - DNA, 25 bp, E. coli
caaatcctgttgctggatagccagg

SEQ ID NO: 75100 - DNA, 25 bp, E. coli
cagcgcgttacacgatgcgggtatc

SEQ ID NO: 75101 - DNA, 25 bp, E. coli
cagcatttcgctgaaggcatcgcaa

SEQ ID NO: 75102 - DNA, 25 bp, E. coli
cagcgcgttacaggatgcgggtatc

SEQ ID NO: 75103 - DNA, 25 bp, E. coli
caaatcctgttggtggatagccagg

SEQ ID NO: 75104 - DNA, 25 bp, E. coli
cagcatttcgctcaaggcatcgcaa

SEQ ID NO: 75105 - DNA, 25 bp, E. coli
tagccaggtgttaggcgtgccgcac

SEQ ID NO: 75106 - DNA, 25 bp, E. coli
tagccaggtgtttggcgtgccgcac

SEQ ID NO: 75107 - DNA, 25 bp, E. coli
tattcatcaggagctggatctcgac

SEQ ID NO: 75108 - DNA, 25 bp, E. coli
tattcatcaggacctggatctcgac

SEQ ID NO: 75109 - DNA, 25 bp, E. coli
tgtttgcacaaaagcacgaagccct

SEQ ID NO: 75110 - DNA, 25 bp, E. coli
tgtttgcacaaatgcacgaagccct

SEQ ID NO: 75111 - DNA, 25 bp, E. coli
tgttaacccttcctctggctggtga

SEQ ID NO: 75112 - DNA, 25 bp, E. coli
tgttaacccttcgtctggctggtga

SEQ ID NO: 75113 - DNA, 25 bp, E. coli
gcaagttttcgtgcgccctgcgtct

SEQ ID NO: 75114 - DNA, 25 bp, E. coli
gcaagttttcgtccgccctgcgtct

SEQ ID NO: 75115 - DNA, 25 bp, E. coli
cgacctgtgtgctgtttaagccgca

SEQ ID NO: 75116 - DNA, 25 bp, E. coli
cgacctgtgtgcagtttaagccgca

SEQ ID NO: 75117 - DNA, 25 bp, E. coli
taacgcgggcgaactggataccgtg

SEQ ID NO: 75118 - DNA, 25 bp, E. coli
taacgcgggcgatctggataccgtg

SEQ ID NO: 75119 - DNA, 25 bp, E. coli
gagttacatgctcatggcacgctga

SEQ ID NO: 75120 - DNA, 25 bp, E. coli
gagttacatgctgatggcacgctga

SEQ ID NO: 75121 - DNA, 25 bp, E. coli
catccctgaatatttgccatcagcg

SEQ ID NO: 75122 - DNA, 25 bp, E. coli
catccctgaataattgccatcagcg

SEQ ID NO: 75123 - DNA, 25 bp, E. coli
taaagcgcgttactcttttcagagc

SEQ ID NO: 75124 - DNA, 25 bp, E. coli
taaagcgcgttagtcttttcagagc

SEQ ID NO: 75125 - DNA, 25 bp, E. coli
ttcgatgttgttggtgattgtcagg

SEQ ID NO: 75126 - DNA, 25 bp, E. coli
tttcacttgtcgcatattaaaccag

SEQ ID NO: 75127 - DNA, 25 bp, E. coli
ttcgatgttgttcgtgattgtcagg

SEQ ID NO: 75128 - DNA, 25 bp, E. coli
tttcacttgtcggatattaaaccag

SEQ ID NO: 75129 - DNA, 25 bp, E. coli
tgcacttgtggaccgacatgctgcc

SEQ ID NO: 75130 - DNA, 25 bp, E. coli
tgcacttgtggagcgacatgctgcc

SEQ ID NO: 75131 - DNA, 25 bp, E. coli
tcactaataatacctacccctttgg

SEQ ID NO: 75132 - DNA, 25 bp, E. coli
tcactaataatagctacccctttgg

SEQ ID NO: 75133 - DNA, 25 bp, E. coli
tcttttcagagcagtttttcatccc

SEQ ID NO: 75134 - DNA, 25 bp, E. coli
tcttttcagagctgtttttcatccc

SEQ ID NO: 75135 - DNA, 25 bp, E. coli
gccatcagcgcaatcttattattgt

SEQ ID NO: 75136 - DNA, 25 bp, E. coli
gcccgtccgggtccatgttttcact

SEQ ID NO: 75137 - DNA, 25 bp, E. coli
gccatcagcgcattcttattattgt

SEQ ID NO: 75138 - DNA, 25 bp, E. coli
gcccgtccgggtgcatgttttcact

SEQ ID NO: 75139 - DNA, 25 bp, E. coli
gattgtcagggatagtaaagcgcgt

SEQ ID NO: 75140 - DNA, 25 bp, E. coli
gattgtcagggaaagtaaagcgcgt

SEQ ID NO: 75141 - DNA, 25 bp, E. coli
taacacaagcgtacacttttggtga

SEQ ID NO: 75142 - DNA, 25 bp, E. coli
taacacaagcgttcacttttggtga

SEQ ID NO: 75143 - DNA, 25 bp, E. coli
attgcgcaaaagactccgactgtcc

SEQ ID NO: 75144 - DNA, 25 bp, E. coli
attgcgcaaaagtctccgactgtcc

SEQ ID NO: 75145 - DNA, 25 bp, E. coli
aacattgcgcaaaagtctccgactg

SEQ ID NO: 75146 - DNA, 25 bp, E. coli
aacattgcgcaatagtctccgactg

SEQ ID NO: 75147 - DNA, 25 bp, E. coli
tatgcacatttgcaatcgacactgg

SEQ ID NO: 75148 - DNA, 25 bp, E. coli
tatgcacatttggaatcgacactgg

SEQ ID NO: 75149 - DNA, 25 bp, E. coli
tttttatcttcgctcaaccttacac

SEQ ID NO: 75150 - DNA, 25 bp, E. coli
tttttatcttcggtcaaccttacac

SEQ ID NO: 75151 - DNA, 25 bp, E. coli
ttgttccgggttaatatgcgactgc

SEQ ID NO: 75152 - DNA, 25 bp, E. coli
ttgttccgggtttatatgcgactgc

SEQ ID NO: 75153 - DNA, 25 bp, E. coli
tgggatttttatgttcgctcaacct

SEQ ID NO: 75154 - DNA, 25 bp, E. coli
tgcacatttgcattcgacactggac

SEQ ID NO: 75155 - DNA, 25 bp, E. coli
tgcacatttgcaatcgacactggac

SEQ ID NO: 75156 - DNA, 25 bp, E. coli
ccgggtttatatgcgactgctcaac

SEQ ID NO: 75157 - DNA, 25 bp, E. coli
ccgggtttatatccgactgctcaac

SEQ ID NO: 75158 - DNA, 25 bp, E. coli
gcggaaagcgcgctcaactgcgctt

SEQ ID NO: 75159 - DNA, 25 bp, E. coli
gcggaaagcgcggtcaactgcgctt

SEQ ID NO: 75160 - DNA, 25 bp, E. coli
gacgctccagcatatgcacatttgc

SEQ ID NO: 75161 - DNA, 25 bp, E. coli
gacgctccagcaaatgcacatttgc

SEQ ID NO: 75162 - DNA, 25 bp, E. coli
cggtcaactgcggtttctggtcacg

SEQ ID NO: 75163 - DNA, 25 bp, E. coli
cggtcaactgcgctttctggtcacg

SEQ ID NO: 75164 - DNA, 25 bp, E. coli
tgggatttttatcttcgctcaacct

SEQ ID NO: 75165 - DNA, 25 bp, E. coli
catcattattgggagcggttccgta

SEQ ID NO: 75166 - DNA, 25 bp, E. coli
catcattattggcagcggttccgta

SEQ ID NO: 75167 - DNA, 25 bp, E. coli
taccggtgaactccccaatggcgat

SEQ ID NO: 75168 - DNA, 25 bp, E. coli
taaaacctggatccaactggcgaag

SEQ ID NO: 75169 - DNA, 25 bp, E. coli
taccggtgaactgcccaatggcgat

SEQ ID NO: 75170 - DNA, 25 bp, E. coli
taaaacctggatgcaactggcgaag

SEQ ID NO: 75171 - DNA, 25 bp, E. coli
tttccggcagaaaacgacgcgttga

SEQ ID NO: 75172 - DNA, 25 bp, E. coli
tttccggcagaatacgacgcgttga

SEQ ID NO: 75173 - DNA, 25 bp, E. coli
tgcgcgggaacaagggtaaaagacc

SEQ ID NO: 75174 - DNA, 25 bp, E. coli
tgcgcgggaacatgggtaaaagacc

SEQ ID NO: 75175 - DNA, 25 bp, E. coli
gaagattggcaaacataacggaggc

SEQ ID NO: 75176 - DNA, 25 bp, E. coli
gaagattggcaatcataacggaggc

SEQ ID NO: 75177 - DNA, 25 bp, E. coli
gaaaaaagcgattgtctgcgcggga

SEQ ID NO: 75178 - DNA, 25 bp, E. coli
gaaaaaagcgatagtctgcgcggga

SEQ ID NO: 75179 - DNA, 25 bp, E. coli
gaagccttcccgttcttgcgcaatg

SEQ ID NO: 75180 - DNA, 25 bp, E. coli
gaagccttcccgatcttgcgcaatg

SEQ ID NO: 75181 - DNA, 25 bp, E. coli
cgaaaagtatgtcccgctggtcctc

SEQ ID NO: 75182 - DNA, 25 bp, E. coli
cgaaaagtatgtgccgctggtcctc

SEQ ID NO: 75183 - DNA, 25 bp, E. coli
gggtattatgcaacccgcgccggtt

SEQ ID NO: 75184 - DNA, 25 bp, E. coli
gggtattatgcatcccgcgccggtt

SEQ ID NO: 75185 - DNA, 25 bp, E. coli
taactattgaaacggctgacggtga

SEQ ID NO: 75186 - DNA, 25 bp, E. coli
taactattgaaagggctgacggtga

SEQ ID NO: 75187 - DNA, 25 bp, E. coli
taaatagtcttatttatcaaccagg

SEQ ID NO: 75188 - DNA, 25 bp, E. coli
taaatagtcttaattatcaaccagg

SEQ ID NO: 75189 - DNA, 25 bp, E. coli
tagagcggatgatttgccaaactgc

SEQ ID NO: 75190 - DNA, 25 bp, E. coli
tatgattcacggaagtaagctctct

SEQ ID NO: 75191 - DNA, 25 bp, E. coli
tagagcggatgaattgccaaactgc

SEQ ID NO: 75192 - DNA, 25 bp, E. coli
tatgattcacggtagtaagctctct

SEQ ID NO: 75193 - DNA, 25 bp, E. coli
tattccgtgaaatctgctcgcgcgc

SEQ ID NO: 75194 - DNA, 25 bp, E. coli
tattccgtgaaaactgctcgcgcgc

SEQ ID NO: 75195 - DNA, 25 bp, E. coli
tatcacgcaggtcataatgacttcc

SEQ ID NO: 75196 - DNA, 25 bp, E. coli
tatcacgcaggtgataatgacttcc

SEQ ID NO: 75197 - DNA, 25 bp, E. coli
tgctcgcgcgcacggttatatcacg

SEQ ID NO: 75198 - DNA, 25 bp, E. coli
tgctcgcgcgcagggttatatcacg

SEQ ID NO: 75199 - DNA, 25 bp, E. coli
tgcaaatcatccgtagagaagggaa

SEQ ID NO: 75200 - DNA, 25 bp, E. coli
tgcaaatcatccctagagaagggaa

SEQ ID NO: 75201 - DNA, 25 bp, E. coli
ctataatagctaagaataagtctgg

SEQ ID NO: 75202 - DNA, 25 bp, E. coli
ctataatagctatgaataagtctgg

SEQ ID NO: 75203 - DNA, 25 bp, E. coli
taagtctggtgaaattattccgtga

SEQ ID NO: 75204 - DNA, 25 bp, E. coli
tcaaccaggaatcatcttagagcgg

SEQ ID NO: 75205 - DNA, 25 bp, E. coli
taagtctggtgatattattccgtga

SEQ ID NO: 75206 - DNA, 25 bp, E. coli
tcaaccaggaatgatcttagagcgg

SEQ ID NO: 75207 - DNA, 25 bp, E. coli
taatgacttcctcttatatcgctga

SEQ ID NO: 75208 - DNA, 25 bp, E. coli
taatgacttcctgttatatcgctga

SEQ ID NO: 75209 - DNA, 25 bp, E. coli
tacgcttgcgtacctgatcattatg

SEQ ID NO: 75210 - DNA, 25 bp, E. coli
tacgcttgcgtagctgatcattatg

SEQ ID NO: 75211 - DNA, 25 bp, E. coli
atcaccgctacgcttgcgtacctga

SEQ ID NO: 75212 - DNA, 25 bp, E. coli
atcaccgctacggttgcgtacctga

SEQ ID NO: 75213 - DNA, 25 bp, E. coli
accgctgatttagggtgtcaccctg

SEQ ID NO: 75214 - DNA, 25 bp, E. coli
acgcttgcgtacctgatcattatgc

SEQ ID NO: 75215 - DNA, 25 bp, E. coli
accgctgatttacggtgtcaccctg

SEQ ID NO: 75216 - DNA, 25 bp, E. coli
acgcttgcgtacgtgatcattatgc

SEQ ID NO: 75217 - DNA, 25 bp, E. coli
tcaccgctacgcatgcgtacctgat

SEQ ID NO: 75218 - DNA, 25 bp, E. coli
tcaccgctacgcttgcgtacctgat

SEQ ID NO: 75219 - DNA, 25 bp, E. coli
gctacgcttgcgaacctgatcatta

SEQ ID NO: 75220 - DNA, 25 bp, E. coli
gctgatttacggtgtcaccctgccc

SEQ ID NO: 75221 - DNA, 25 bp, E. coli
gcttgcgtacctcatcattatgccg

SEQ ID NO: 75222 - DNA, 25 bp, E. coli
gctgatttacggagtcaccctgccc

SEQ ID NO: 75223 - DNA, 25 bp, E. coli
gcttgcgtacctgatcattatgccg

SEQ ID NO: 75224 - DNA, 25 bp, E. coli
gctacgcttgcgtacctgatcatta

SEQ ID NO: 75225 - DNA, 25 bp, E. coli
cgcttgcgtacctgatcattatgcc

SEQ ID NO: 75226 - DNA, 25 bp, E. coli
cgcttgcgtaccagatcattatgcc

SEQ ID NO: 75227 - DNA, 25 bp, E. coli
ctgatttacggtgtcaccctgcccc

SEQ ID NO: 75228 - DNA, 25 bp, E. coli
ctgatttacggtctcaccctgcccc

SEQ ID NO: 75229 - DNA, 25 bp, E. coli
ctacgcttgcgttcctgatcattat

SEQ ID NO: 75230 - DNA, 25 bp, E. coli
ctacgcttgcgtacctgatcattat

SEQ ID NO: 75231 - DNA, 25 bp, E. coli
attggtattagccttaccctggttg

SEQ ID NO: 75232 - DNA, 25 bp, E. coli
attagcgttaccgtggttgtgatga

SEQ ID NO: 75233 - DNA, 25 bp, E. coli
attggtattagcgttaccctggttg

SEQ ID NO: 75234 - DNA, 25 bp, E. coli
attagcgttaccctggttgtgatga

SEQ ID NO: 75235 - DNA, 25 bp, E. coli
tagcgttaccctcgttgtgatgatg

SEQ ID NO: 75236 - DNA, 25 bp, E. coli
tagcgttaccctggttgtgatgatg

SEQ ID NO: 75237 - DNA, 25 bp, E. coli
taccctggttgtgatgatgtatcgc

SEQ ID NO: 75238 - DNA, 25 bp, E. coli
taccctggttgtcatgatgtatcgc

SEQ ID NO: 75239 - DNA, 25 bp, E. coli
ttaccctggttgtgatgatgtatcg

SEQ ID NO: 75240 - DNA, 25 bp, E. coli
ttaccctggttgagatgatgtatcg

SEQ ID NO: 75241 - DNA, 25 bp, E. coli
gcgttaccctggatgtgatgatgta

SEQ ID NO: 75242 - DNA, 25 bp, E. coli
gcgttaccctggttgtgatgatgta

SEQ ID NO: 75243 - DNA, 25 bp, E. coli
cgttaccctggttgtgatgatgtat

SEQ ID NO: 75244 - DNA, 25 bp, E. coli
cgttaccctggtagtgatgatgtat

SEQ ID NO: 75245 - DNA, 25 bp, E. coli
gtattagcgttaccctggttgtgat

SEQ ID NO: 75246 - DNA, 25 bp, E. coli
gttaccctggttctgatgatgtatc

SEQ ID NO: 75247 - DNA, 25 bp, E. coli
gtattagcgttagcctggttgtgat

SEQ ID NO: 75248 - DNA, 25 bp, E. coli
gttaccctggttgtgatgatgtatc

SEQ ID NO: 75249 - DNA, 25 bp, E. coli
tggtattagcgttaccctggttgtg

SEQ ID NO: 75250 - DNA, 25 bp, E. coli
ggtattagcgtttccctggttgtga

SEQ ID NO: 75251 - DNA, 25 bp, E. coli
tggtattagcgtaaccctggttgtg

SEQ ID NO: 75252 - DNA, 25 bp, E. coli
ggtattagcgttaccctggttgtga

SEQ ID NO: 75253 - DNA, 25 bp, E. coli
atatgccaggcagtgatgacctgaa

SEQ ID NO: 75254 - DNA, 25 bp, E. coli
acctgaagggcaataacgtgaaata

SEQ ID NO: 75255 - DNA, 25 bp, E. coli
acctgaagggcattaacgtgaaata

SEQ ID NO: 75256 - DNA, 25 bp, E. coli
atatgccaggcactgatgacctgaa

SEQ ID NO: 75257 - DNA, 25 bp, E. coli
tatgccaggcagtgatgacctgaag

SEQ ID NO: 75258 - DNA, 25 bp, E. coli
tatgccaggcagagatgacctgaag

SEQ ID NO: 75259 - DNA, 25 bp, E. coli
tgatgacctgaagggcattaacgtg

SEQ ID NO: 75260 - DNA, 25 bp, E. coli
tgatgacctgaacggcattaacgtg

SEQ ID NO: 75261 - DNA, 25 bp, E. coli
tgatatgccaggcagtgatgacctg

SEQ ID NO: 75262 - DNA, 25 bp, E. coli
tgatatgccagggagtgatgacctg

SEQ ID NO: 75263 - DNA, 25 bp, E. coli
cctgaagggcattaacgtgaaatac

SEQ ID NO: 75264 - DNA, 25 bp, E. coli
cctgaagggcataaacgtgaaatac

SEQ ID NO: 75265 - DNA, 25 bp, E. coli
gacctgaagggcattaacgtgaaat

SEQ ID NO: 75266 - DNA, 25 bp, E. coli
gacctgaagggctttaacgtgaaat

SEQ ID NO: 75267 - DNA, 25 bp, E. coli
gatatgccaggctgtgatgacctga

SEQ ID NO: 75268 - DNA, 25 bp, E. coli
gatatgccaggcagtgatgacctga

SEQ ID NO: 75269 - DNA, 25 bp, E. coli
ggtgacgtcattgagttatgccaat

SEQ ID NO: 75270 - DNA, 25 bp, E. coli
gtgatgacctgatgggcattaacgt

SEQ ID NO: 75271 - DNA, 25 bp, E. coli
ggtgacgtcattcagttatgccaat

SEQ ID NO: 75272 - DNA, 25 bp, E. coli
gtgatgacctgaagggcattaacgt

SEQ ID NO: 75273 - DNA, 25 bp, E. coli
gatgacctgaagcgcattaacgtga

SEQ ID NO: 75274 - DNA, 25 bp, E. coli
gatgacctgaagggcattaacgtga

SEQ ID NO: 75275 - DNA, 25 bp, E. coli
caagtacctctgactctggttgcaa

SEQ ID NO: 75276 - DNA, 25 bp, E. coli
caagtacctctgtctctggttgcaa

SEQ ID NO: 75277 - DNA, 25 bp, E. coli
caatgtcagtataaacagcgatgtc

SEQ ID NO: 75278 - DNA, 25 bp, E. coli
caatgtcagtattaacagcgatgtc

SEQ ID NO: 75279 - DNA, 25 bp, E. coli
caggttgacgtatgcagtcccggaa

SEQ ID NO: 75280 - DNA, 25 bp, E. coli
caggttgacgtaagcagtcccggaa

SEQ ID NO: 75281 - DNA, 25 bp, E. coli
tacactatggttctggagaaaggga

SEQ ID NO: 75282 - DNA, 25 bp, E. coli
tacactatggttgtggagaaaggga

SEQ ID NO: 75283 - DNA, 25 bp, E. coli
tagggaaggcaataattaaagctca

SEQ ID NO: 75284 - DNA, 25 bp, E. coli
tagggaaggcaaaaattaaagctca

SEQ ID NO: 75285 - DNA, 25 bp, E. coli
tatgcagtcccgcaaatttacgtgg

SEQ ID NO: 75286 - DNA, 25 bp, E. coli
tatgcagtcccggaaatttacgtgg

SEQ ID NO: 75287 - DNA, 25 bp, E. coli
tcagtattaacagcgatgtcaattg

SEQ ID NO: 75288 - DNA, 25 bp, E. coli
tcagtattaacaccgatgtcaattg

SEQ ID NO: 75289 - DNA, 25 bp, E. coli
gctcaatacaattaacaagtacctc

SEQ ID NO: 75290 - DNA, 25 bp, E. coli
gctcaatacaataaacaagtacctc

SEQ ID NO: 75291 - DNA, 25 bp, E. coli
gaatcaggttgacgtatgcagtccc

SEQ ID NO: 75292 - DNA, 25 bp, E. coli
gaatcaggttgaggtatgcagtccc

SEQ ID NO: 75293 - DNA, 25 bp, E. coli
gactctggttgcaatgtcagtatta

SEQ ID NO: 75294 - DNA, 25 bp, E. coli
gactctggttgctatgtcagtatta

SEQ ID NO: 75295 - DNA, 25 bp, E. coli
gggccgttaatatttacactatggt

SEQ ID NO: 75296 - DNA, 25 bp, E. coli
gggccgttaataattacactatggt

SEQ ID NO: 75297 - DNA, 25 bp, E. coli
taaagatctgcattctgcgggcaat

SEQ ID NO: 75298 - DNA, 25 bp, E. coli
taaagatctgcaatctgcgggcaat

SEQ ID NO: 75299 - DNA, 25 bp, E. coli
aacaaatacgtgtagagcgtcgccg

SEQ ID NO: 75300 - DNA, 25 bp, E. coli
aacaaatacgtgaagagcgtcgccg

SEQ ID NO: 75301 - DNA, 25 bp, E. coli
tattatgcgcaatgatgccggtgtg

SEQ ID NO: 75302 - DNA, 25 bp, E. coli
tattatgcgcaaagatgccggtgtg

SEQ ID NO: 75303 - DNA, 25 bp, E. coli
tttccggcagagatgcaaacccgcg

SEQ ID NO: 75304 - DNA, 25 bp, E. coli
tttccggcagagttgcaaacccgcg

SEQ ID NO: 75305 - DNA, 25 bp, E. coli
tacttaccgaagagtgcaacctgca

SEQ ID NO: 75306 - DNA, 25 bp, E. coli
tacttaccgaagtgtgcaacctgca

SEQ ID NO: 75307 - DNA, 25 bp, E. coli
gaaattgacttttccagcgccagcg

SEQ ID NO: 75308 - DNA, 25 bp, E. coli
gaaattgactttaccagcgccagcg

SEQ ID NO: 75309 - DNA, 25 bp, E. coli
ctatgagcatccctatccggcgggc

SEQ ID NO: 75310 - DNA, 25 bp, E. coli
ctatgagcatccgtatccggcgggc

SEQ ID NO: 75311 - DNA, 25 bp, E. coli
ggatgtcattgttaccaacccgccg

SEQ ID NO: 75312 - DNA, 25 bp, E. coli
ggatgtcattgtaaccaacccgccg

SEQ ID NO: 75313 - DNA, 25 bp, E. coli
taatgatgatctgttcccggcgttg

SEQ ID NO: 75314 - DNA, 25 bp, E. coli
taacgaggccgaaggttttgccagc

SEQ ID NO: 75315 - DNA, 25 bp, E. coli
taacgaggccgatggttttgccagc

SEQ ID NO: 75316 - DNA, 25 bp, E. coli
taatgatgatctcttcccggcgttg

SEQ ID NO: 75317 - DNA, 25 bp, E. coli
gatggcacactaattggcgaaggcg

SEQ ID NO: 75318 - DNA, 25 bp, E. coli
gatggcacactatttggcgaaggcg

SEQ ID NO: 75319 - DNA, 25 bp, E. coli
cagcaatatctctgaggccgggcag

SEQ ID NO: 75320 - DNA, 25 bp, E. coli
cagcaatatctcagaggccgggcag

SEQ ID NO: 75321 - DNA, 25 bp, E. coli
tacattattccgaccagcctgggct

SEQ ID NO: 75322 - DNA, 25 bp, E. coli
tacgtcaatgaccacaaagcaggga

SEQ ID NO: 75323 - DNA, 25 bp, E. coli
tacattattccgtccagcctgggct

SEQ ID NO: 75324 - DNA, 25 bp, E. coli
agcagggttacggtcagggcaatac

SEQ ID NO: 75325 - DNA, 25 bp, E. coli
agcagggttacgctcagggcaatac

SEQ ID NO: 75326 - DNA, 25 bp, E. coli
aaagcagggaccttcactgcggacc

SEQ ID NO: 75327 - DNA, 25 bp, E. coli
aaagcagggaccatcactgcggacc

SEQ ID NO: 75328 - DNA, 25 bp, E. coli
tacgtcaatgacgacaaagcaggga

SEQ ID NO: 75329 - DNA, 25 bp, E. coli
tgcggaccggaagaacgctgagaaa

SEQ ID NO: 75330 - DNA, 25 bp, E. coli
tgcggaccggaacaacgctgagaaa

SEQ ID NO: 75331 - DNA, 25 bp, E. coli
tgaccgaagccagcggaaagacgtt

SEQ ID NO: 75332 - DNA, 25 bp, E. coli
tgaccgaagccaccggaaagacgtt

SEQ ID NO: 75333 - DNA, 25 bp, E. coli
tctcggagactggagcaacgactga

SEQ ID NO: 75334 - DNA, 25 bp, E. coli
tctcggagactgcagcaacgactga

SEQ ID NO: 75335 - DNA, 25 bp, E. coli
gctttaatgcctctgctatcccggg

SEQ ID NO: 75336 - DNA, 25 bp, E. coli
gctttaatgcctgtgctatcccggg

SEQ ID NO: 75337 - DNA, 25 bp, E. coli
gacaagatggtcagttcgcacgatg

SEQ ID NO: 75338 - DNA, 25 bp, E. coli
gacaagatggtctgttcgcacgatg

SEQ ID NO: 75339 - DNA, 25 bp, E. coli
gaaagttctgtcgactctcggagac

SEQ ID NO: 75340 - DNA, 25 bp, E. coli
gaaagttctgtccactctcggagac

SEQ ID NO: 75341 - DNA, 25 bp, E. coli
cagaaaagagatattcttgtcccgc

SEQ ID NO: 75342 - DNA, 25 bp, E. coli
cagaaaagagattttcttgtcccgc

SEQ ID NO: 75343 - DNA, 25 bp, E. coli
catggtggaagtcatcgagccgttt

SEQ ID NO: 75344 - DNA, 25 bp, E. coli
catggtggaagtgatcgagccgttt

SEQ ID NO: 75345 - DNA, 25 bp, E. coli
tacaacctgagcgatggcgcgatgg

SEQ ID NO: 75346 - DNA, 25 bp, E. coli
tacaacctgagccatggcgcgatgg

SEQ ID NO: 75347 - DNA, 25 bp, E. coli
acagggttcatcatgagtcatcaac

SEQ ID NO: 75348 - DNA, 25 bp, E. coli
acagggttcatcttgagtcatcaac

SEQ ID NO: 75349 - DNA, 25 bp, E. coli
tatccgctggaatccatgctacgca

SEQ ID NO: 75350 - DNA, 25 bp, E. coli
taccccaaggctggtaatggccggc

SEQ ID NO: 75351 - DNA, 25 bp, E. coli
tatccgctggaaaccatgctacgca

SEQ ID NO: 75352 - DNA, 25 bp, E. coli
taccccaaggctcgtaatggccggc

SEQ ID NO: 75353 - DNA, 25 bp, E. coli
tctgccatggcataacatggtggaa

SEQ ID NO: 75354 - DNA, 25 bp, E. coli
tctgccatggcaaaacatggtggaa

SEQ ID NO: 75355 - DNA, 25 bp, E. coli
gactcaaggcaccttggtcgatgcc

SEQ ID NO: 75356 - DNA, 25 bp, E. coli
gactcaaggcacgttggtcgatgcc

SEQ ID NO: 75357 - DNA, 25 bp, E. coli
gtaatggccggcgaccttatccgct

SEQ ID NO: 75358 - DNA, 25 bp, E. coli
gtaatggccggccaccttatccgct

SEQ ID NO: 75359 - DNA, 25 bp, E. coli
tggcgcgatggaagatgctctgtac

SEQ ID NO: 75360 - DNA, 25 bp, E. coli
tggcgcgatggatgatgctctgtac

SEQ ID NO: 75361 - DNA, 25 bp, E. coli
taagaaccttgaaacagcatccacg

SEQ ID NO: 75362 - DNA, 25 bp, E. coli
taagaaccttgatacagcatccacg

SEQ ID NO: 75363 - DNA, 25 bp, E. coli
aatttctcttggcacctatatcgcg

SEQ ID NO: 75364 - DNA, 25 bp, E. coli
aatttctcttgggacctatatcgcg

SEQ ID NO: 75365 - DNA, 25 bp, E. coli
cacctatatcgccttgatgatgaac

SEQ ID NO: 75366 - DNA, 25 bp, E. coli
cacctatatcgcgttgatgatgaac

SEQ ID NO: 75367 - DNA, 25 bp, E. coli
attgaaagccgatggtacgccagcc

SEQ ID NO: 75368 - DNA, 25 bp, E. coli
attgaaagccgaaggtacgccagcc

SEQ ID NO: 75369 - DNA, 25 bp, E. coli
tgctcaacaaaatagcgtcttgcgt

SEQ ID NO: 75370 - DNA, 25 bp, E. coli
tgctcaacaaaaaagcgtcttgcgt

SEQ ID NO: 75371 - DNA, 25 bp, E. coli
tgacgtgcaaatcccgggcaccatt

SEQ ID NO: 75372 - DNA, 25 bp, E. coli
tgacgtgcaaatgccgggcaccatt

SEQ ID NO: 75373 - DNA, 25 bp, E. coli
tcaggatgccaatgcacaggatctt

SEQ ID NO: 75374 - DNA, 25 bp, E. coli
tcaggatgccaaagcacaggatctt

SEQ ID NO: 75375 - DNA, 25 bp, E. coli
ccgccagatgctttttgacgtgcaa

SEQ ID NO: 75376 - DNA, 25 bp, E. coli
ccgccagatgctatttgacgtgcaa

SEQ ID NO: 75377 - DNA, 25 bp, E. coli
cgtcttgcgtgcgacctggttgtaa

SEQ ID NO: 75378 - DNA, 25 bp, E. coli
cgtcttgcgtgccacctggttgtaa

SEQ ID NO: 75379 - DNA, 25 bp, E. coli
gatattgtcggctttggcctgggct

SEQ ID NO: 75380 - DNA, 25 bp, E. coli
gatattgtcggcattggcctgggct

SEQ ID NO: 75381 - DNA, 25 bp, E. coli
ggcaccattcttcggcatatcacac

SEQ ID NO: 75382 - DNA, 25 bp, E. coli
tggcctgggctcaatccgttgctgc

SEQ ID NO: 75383 - DNA, 25 bp, E. coli
ggcaccattcttgggcatatcacac

SEQ ID NO: 75384 - DNA, 25 bp, E. coli
tggcctgggctctatccgttgctgc

SEQ ID NO: 75385 - DNA, 25 bp, E. coli
cagcctgtggctccctgtcggaaaa

SEQ ID NO: 75386 - DNA, 25 bp, E. coli
cagcctgtggctgcctgtcggaaaa

SEQ ID NO: 75387 - DNA, 25 bp, E. coli
taaagtttatgctatatcctgccgc

SEQ ID NO: 75388 - DNA, 25 bp, E. coli
taaagtttatgcaatatcctgccgc

SEQ ID NO: 75389 - DNA, 25 bp, E. coli
agttaactttacttcaccatcggag

SEQ ID NO: 75390 - DNA, 25 bp, E. coli
agttaactttacatcaccatcggag

SEQ ID NO: 75391 - DNA, 25 bp, E. coli
aaaaatacgttatatcgccgtatga

SEQ ID NO: 75392 - DNA, 25 bp, E. coli
aaaaatacgttaaatcgccgtatga

SEQ ID NO: 75393 - DNA, 25 bp, E. coli
ttacttcaccatgggagtcctgttc

SEQ ID NO: 75394 - DNA, 25 bp, E. coli
ttacttcaccatcggagtcctgttc

SEQ ID NO: 75395 - DNA, 25 bp, E. coli
tgccagctgttggttaaaagttaac

SEQ ID NO: 75396 - DNA, 25 bp, E. coli
tgccagctgttgcttaaaagttaac

SEQ ID NO: 75397 - DNA, 25 bp, E. coli
tcggagtcctgtacagcctgtggct

SEQ ID NO: 75398 - DNA, 25 bp, E. coli
tcggagtcctgttcagcctgtggct

SEQ ID NO: 75399 - DNA, 25 bp, E. coli
cctgccgcttcggtgcttctggtgt

SEQ ID NO: 75400 - DNA, 25 bp, E. coli
cctgccgcttcgctgcttctggtgt

SEQ ID NO: 75401 - DNA, 25 bp, E. coli
gcacacacaaacataaagaaaccgt

SEQ ID NO: 75402 - DNA, 25 bp, E. coli
gcacacacaaacttaaagaaaccgt

SEQ ID NO: 75403 - DNA, 25 bp, E. coli
cgccgtatgatatgtttggtgatta

SEQ ID NO: 75404 - DNA, 25 bp, E. coli
cgccgtatgataagtttggtgatta

SEQ ID NO: 75405 - DNA, 25 bp, E. coli
ggtgattaataaggcacacacaaac

SEQ ID NO: 75406 - DNA, 25 bp, E. coli
ggtgattaataacgcacacacaaac

SEQ ID NO: 75407 - DNA, 25 bp, E. coli
agatatgttttacagccgctgccgg

SEQ ID NO: 75408 - DNA, 25 bp, E. coli
agatatgttttagagccgctgccgg

SEQ ID NO: 75409 - DNA, 25 bp, E. coli
tattctccggattcagggcagatgg

SEQ ID NO: 75410 - DNA, 25 bp, E. coli
tataaaacgccatatgtagcgccgc

SEQ ID NO: 75411 - DNA, 25 bp, E. coli
tattctccggatacagggcagatgg

SEQ ID NO: 75412 - DNA, 25 bp, E. coli
tataaaacgccaaatgtagcgccgc

SEQ ID NO: 75413 - DNA, 25 bp, E. coli
tcatcaggtgggtacgacggttttc

SEQ ID NO: 75414 - DNA, 25 bp, E. coli
tcatcaggtgggaacgacggttttc

SEQ ID NO: 75415 - DNA, 25 bp, E. coli
tcagacaagccgagttacagcaagg

SEQ ID NO: 75416 - DNA, 25 bp, E. coli
tcagacaagccgtgttacagcaagg

SEQ ID NO: 75417 - DNA, 25 bp, E. coli
gaataaatgaaaatgccgggctgga

SEQ ID NO: 75418 - DNA, 25 bp, E. coli
gaacagtacagacccttcgaagtgg

SEQ ID NO: 75419 - DNA, 25 bp, E. coli
gaacagtacagagccttcgaagtgg

SEQ ID NO: 75420 - DNA, 25 bp, E. coli
gaataaatgaaattgccgggctgga

SEQ ID NO: 75421 - DNA, 25 bp, E. coli
gacagtgaagccaacgcaaaggtga

SEQ ID NO: 75422 - DNA, 25 bp, E. coli
gacagtgaagcctacgcaaaggtga

SEQ ID NO: 75423 - DNA, 25 bp, E. coli
cgaaaaccagtgagacgaatgccaa

SEQ ID NO: 75424 - DNA, 25 bp, E. coli
cgaaaaccagtgtgacgaatgccaa

SEQ ID NO: 75425 - DNA, 25 bp, E. coli
cattggtggacatactacagcagga

SEQ ID NO: 75426 - DNA, 25 bp, E. coli
cattggtggacaaactacagcagga

SEQ ID NO: 75427 - DNA, 25 bp, E. coli
gatgtaaccactgcacagattgagg

SEQ ID NO: 75428 - DNA, 25 bp, E. coli
gatgtaaccactccacagattgagg

SEQ ID NO: 75429 - DNA, 25 bp, E. coli
agccttgtcactcttctttgcggtg

SEQ ID NO: 75430 - DNA, 25 bp, E. coli
agccttgtcactgttctttgcggtg

SEQ ID NO: 75431 - DNA, 25 bp, E. coli
ttaatactaatcccctttatcggcg

SEQ ID NO: 75432 - DNA, 25 bp, E. coli
ttcatcgcgtttgcggtgaaaatgc

SEQ ID NO: 75433 - DNA, 25 bp, E. coli
ttcatcgcgtttccggtgaaaatgc

SEQ ID NO: 75434 - DNA, 25 bp, E. coli
ttaatactaatcgcctttatcggcg

SEQ ID NO: 75435 - DNA, 25 bp, E. coli
tgttattaccctcgttaatactaat

SEQ ID NO: 75436 - DNA, 25 bp, E. coli
tgttattaccctggttaatactaat

SEQ ID NO: 75437 - DNA, 25 bp, E. coli
tcgcgtttgcggtgaaaatgccggt

SEQ ID NO: 75438 - DNA, 25 bp, E. coli
tcgcgtttgcggagaaaatgccggt

SEQ ID NO: 75439 - DNA, 25 bp, E. coli
gccagccttgtcactgttctttgcg

SEQ ID NO: 75440 - DNA, 25 bp, E. coli
gccagccttgtctctgttctttgcg

SEQ ID NO: 75441 - DNA, 25 bp, E. coli
gctgccagccttctcactgttcttt

SEQ ID NO: 75442 - DNA, 25 bp, E. coli
gctgccagccttgtcactgttcttt

SEQ ID NO: 75443 - DNA, 25 bp, E. coli
gaaatggctgccagccttgtcactg

SEQ ID NO: 75444 - DNA, 25 bp, E. coli
gaaatggctgcctgccttgtcactg

SEQ ID NO: 75445 - DNA, 25 bp, E. coli
cttcttcatcgcgtttgcggtgaaa

SEQ ID NO: 75446 - DNA, 25 bp, E. coli
cttcttcatcgcctttgcggtgaaa

SEQ ID NO: 75447 - DNA, 25 bp, E. coli
tggttaatactattcccctttatcg

SEQ ID NO: 75448 - DNA, 25 bp, E. coli
tggttaatactaatcccctttatcg

SEQ ID NO: 75449 - DNA, 25 bp, E. coli
tggctgccagccatgtcactgttct

SEQ ID NO: 75450 - DNA, 25 bp, E. coli
tggctgccagccttgtcactgttct

SEQ ID NO: 75451 - DNA, 25 bp, E. coli
caacctgcgtttttgctgagccaca

SEQ ID NO: 75452 - DNA, 25 bp, E. coli
cagttcaggccaccggtcgttgaga

SEQ ID NO: 75453 - DNA, 25 bp, E. coli
cagttcaggccagcggtcgttgaga

SEQ ID NO: 75454 - DNA, 25 bp, E. coli
caaacttgacgccaacctgaaggat

SEQ ID NO: 75455 - DNA, 25 bp, E. coli
caaacttgacgcgaacctgaaggat

SEQ ID NO: 75456 - DNA, 25 bp, E. coli
caacctgcgtttatgctgagccaca

SEQ ID NO: 75457 - DNA, 25 bp, E. coli
tgacgaagatcagcatcacggcgat

SEQ ID NO: 75458 - DNA, 25 bp, E. coli
tgacgaagatcaccatcacggcgat

SEQ ID NO: 75459 - DNA, 25 bp, E. coli
gccaaccagtatgcgagctgcctga

SEQ ID NO: 75460 - DNA, 25 bp, E. coli
gccaaccagtatccgagctgcctga

SEQ ID NO: 75461 - DNA, 25 bp, E. coli
gctacagcggttccaatccatggaa

SEQ ID NO: 75462 - DNA, 25 bp, E. coli
gctacagcggttgcaatccatggaa

SEQ ID NO: 75463 - DNA, 25 bp, E. coli
tgtcgcttcgcttaaacccgttggg

SEQ ID NO: 75464 - DNA, 25 bp, E. coli
tgtcgcttcgctaaaacccgttggg

SEQ ID NO: 75465 - DNA, 25 bp, E. coli
tggcgcgcagcgtttacatgaaata

SEQ ID NO: 75466 - DNA, 25 bp, E. coli
tggctttccccacagatagcgcggg

SEQ ID NO: 75467 - DNA, 25 bp, E. coli
tggctttccccagagatagcgcggg

SEQ ID NO: 75468 - DNA, 25 bp, E. coli
tggcgcgcagcgattacatgaaata

SEQ ID NO: 75469 - DNA, 25 bp, E. coli
taaccctgagattcaacctggcgcg

SEQ ID NO: 75470 - DNA, 25 bp, E. coli
taaccctgagatacaacctggcgcg

SEQ ID NO: 75471 - DNA, 25 bp, E. coli
gatgatgatgatcacgaccacgcgg

SEQ ID NO: 75472 - DNA, 25 bp, E. coli
gatgatgatgatgacgaccacgcgg

SEQ ID NO: 75473 - DNA, 25 bp, E. coli
aatcgcacatggtcaggaacgggca

SEQ ID NO: 75474 - DNA, 25 bp, E. coli
aatcgcacatggacaggaacgggca

SEQ ID NO: 75475 - DNA, 25 bp, E. coli
catggaggcactggaagccaaagac

SEQ ID NO: 75476 - DNA, 25 bp, E. coli
catggaggcactcgaagccaaagac

SEQ ID NO: 75477 - DNA, 25 bp, E. coli
tatcagagccacgagccaggttgtg

SEQ ID NO: 75478 - DNA, 25 bp, E. coli
tattatggaccaaatgcaaccgtgt

SEQ ID NO: 75479 - DNA, 25 bp, E. coli
tattatggaccatatgcaaccgtgt

SEQ ID NO: 75480 - DNA, 25 bp, E. coli
tatcagagccaccagccaggttgtg

SEQ ID NO: 75481 - DNA, 25 bp, E. coli
tgggaatgtctcaagctgcctctgg

SEQ ID NO: 75482 - DNA, 25 bp, E. coli
tgggaatgtctctagctgcctctgg

SEQ ID NO: 75483 - DNA, 25 bp, E. coli
tcctgcgccgaccattacggtaaaa

SEQ ID NO: 75484 - DNA, 25 bp, E. coli
tcctgcgccgacgattacggtaaaa

SEQ ID NO: 75485 - DNA, 25 bp, E. coli
gctgggttgcgctaatgatcacgtt

SEQ ID NO: 75486 - DNA, 25 bp, E. coli
gctgggttgcgcaaatgatcacgtt

SEQ ID NO: 75487 - DNA, 25 bp, E. coli
gacaagcaactgcacgacatggtgg

SEQ ID NO: 75488 - DNA, 25 bp, E. coli
gaaaacactgtctttgcaatcgacg

SEQ ID NO: 75489 - DNA, 25 bp, E. coli
gacaagcaactggacgacatggtgg

SEQ ID NO: 75490 - DNA, 25 bp, E. coli
gaaaacactgtcattgcaatcgacg

SEQ ID NO: 75491 - DNA, 25 bp, E. coli
ggcaaactatgtgatggctcgcaaa

SEQ ID NO: 75492 - DNA, 25 bp, E. coli
ggcaaactatgtcatggctcgcaaa

SEQ ID NO: 75493 - DNA, 25 bp, E. coli
taatgctaatgtaacggtggcgcca

SEQ ID NO: 75494 - DNA, 25 bp, E. coli
taatgctaatgttacggtggcgcca

SEQ ID NO: 75495 - DNA, 25 bp, E. coli
cactcatggttaaggcagcactgca

SEQ ID NO: 75496 - DNA, 25 bp, E. coli
cactcatggttatggcagcactgca

SEQ ID NO: 75497 - DNA, 25 bp, E. coli
cagtctattaatagttgccgggaag

SEQ ID NO: 75498 - DNA, 25 bp, E. coli
cagtctattaattgttgccgggaag

SEQ ID NO: 75499 - DNA, 25 bp, E. coli
tagataactacgatacgggagggct

SEQ ID NO: 75500 - DNA, 25 bp, E. coli
tagataactacgttacgggagggct

SEQ ID NO: 75501 - DNA, 25 bp, E. coli
ttatcagcaatataccagccagccg

SEQ ID NO: 75502 - DNA, 25 bp, E. coli
ttatcagcaataaaccagccagccg

SEQ ID NO: 75503 - DNA, 25 bp, E. coli
tgagatccagttggatgtaacccac

SEQ ID NO: 75504 - DNA, 25 bp, E. coli
tgttgtgcaaaatagcggttagctc

SEQ ID NO: 75505 - DNA, 25 bp, E. coli
tgagatccagttcgatgtaacccac

SEQ ID NO: 75506 - DNA, 25 bp, E. coli
tgttgtgcaaaaaagcggttagctc

SEQ ID NO: 75507 - DNA, 25 bp, E. coli
tgagaatagtgtatgcggcgaccga

SEQ ID NO: 75508 - DNA, 25 bp, E. coli
tgagaatagtgtttgcggcgaccga

SEQ ID NO: 75509 - DNA, 25 bp, E. coli
ccagtgctgcaatgataccgcgaga

SEQ ID NO: 75510 - DNA, 25 bp, E. coli
ccagtgctgcaaagataccgcgaga

SEQ ID NO: 75511 - DNA, 25 bp, E. coli
cgttgtcagaagaaagttggccgca

SEQ ID NO: 75512 - DNA, 25 bp, E. coli
ccggttcccaaccatcaaggcgagt

SEQ ID NO: 75513 - DNA, 25 bp, E. coli
ccggttcccaacgatcaaggcgagt

SEQ ID NO: 75514 - DNA, 25 bp, E. coli
cgttgtcagaagtaagttggccgca

SEQ ID NO: 75515 - DNA, 25 bp, E. coli
taataccgcgccacatagcagaact

SEQ ID NO: 75516 - DNA, 25 bp, E. coli
taataccgcgcctcatagcagaact

SEQ ID NO: 75517 - DNA, 25 bp, E. coli
catcgggcagtccagtgttaacacc

SEQ ID NO: 75518 - DNA, 25 bp, E. coli
catcgggcagtcgagtgttaacacc

SEQ ID NO: 75519 - DNA, 25 bp, E. coli
catggacgtggaaaagaaatacccc

SEQ ID NO: 75520 - DNA, 25 bp, E. coli
catggacgtggataagaaatacccc

SEQ ID NO: 75521 - DNA, 25 bp, E. coli
tacgctcacgtagcgaagacatcgg

SEQ ID NO: 75522 - DNA, 25 bp, E. coli
tacgctcacgtaccgaagacatcgg

SEQ ID NO: 75523 - DNA, 25 bp, E. coli
gctttcatatggttcgctggtcgga

SEQ ID NO: 75524 - DNA, 25 bp, E. coli
gctttcatatggatcgctggtcgga

SEQ ID NO: 75525 - DNA, 25 bp, E. coli
gattattccgcacgccttcagtcag

SEQ ID NO: 75526 - DNA, 25 bp, E. coli
gattattccgcaggccttcagtcag

SEQ ID NO: 75527 - DNA, 25 bp, E. coli
tggaacttgcagaccttagggccga

SEQ ID NO: 75528 - DNA, 25 bp, E. coli
tggaacttgcagtccttagggccga

SEQ ID NO: 75529 - DNA, 25 bp, E. coli
tcagatcagcgcgaaaatcaacggg

SEQ ID NO: 75530 - DNA, 25 bp, E. coli
taatcaggcggtcggtgaaacccgt

SEQ ID NO: 75531 - DNA, 25 bp, E. coli
taacaaccagttccgtaacggcggg

SEQ ID NO: 75532 - DNA, 25 bp, E. coli
tcagatcagcgccaaaatcaacggg

SEQ ID NO: 75533 - DNA, 25 bp, E. coli
tcaattgcgacgtagcgatgccgac

SEQ ID NO: 75534 - DNA, 25 bp, E. coli
tcaattgcgacgaagcgatgccgac

SEQ ID NO: 75535 - DNA, 25 bp, E. coli
taacaaccagttgcgtaacggcggg

SEQ ID NO: 75536 - DNA, 25 bp, E. coli
taatcaggcggtgggtgaaacccgt

SEQ ID NO: 75537 - DNA, 25 bp, E. coli
gatgaccgccatatcagcagggaag

SEQ ID NO: 75538 - DNA, 25 bp, E. coli
gatgaccgccatttcagcagggaag

SEQ ID NO: 75539 - DNA, 25 bp, E. coli
tatcgcgacattatgctgccgctgc

SEQ ID NO: 75540 - DNA, 25 bp, E. coli
tatcgcgacattttgctgccgctgc

SEQ ID NO: 75541 - DNA, 25 bp, E. coli
tgcgaataccgaagctcaaggaagc

SEQ ID NO: 75542 - DNA, 25 bp, E. coli
tcgcgctgttaacgacaaaaggtaa

SEQ ID NO: 75543 - DNA, 25 bp, E. coli
tgcgaataccgatgctcaaggaagc

SEQ ID NO: 75544 - DNA, 25 bp, E. coli
tcgcgctgttaaggacaaaaggtaa

SEQ ID NO: 75545 - DNA, 25 bp, E. coli
gcggttaccgcactaatgtcactga

SEQ ID NO: 75546 - DNA, 25 bp, E. coli
gcggttaccgcagtaatgtcactga

SEQ ID NO: 75547 - DNA, 25 bp, E. coli
gcttttgcccgtgaagcgcgtaccg

SEQ ID NO: 75548 - DNA, 25 bp, E. coli
gcttttgcccgtcaagcgcgtaccg

SEQ ID NO: 75549 - DNA, 25 bp, E. coli
gaagtccgtaagctcatttggccga

SEQ ID NO: 75550 - DNA, 25 bp, E. coli
gaagtccgtaaggtcatttggccga

SEQ ID NO: 75551 - DNA, 25 bp, E. coli
gactggatggtattctggttcgcct

SEQ ID NO: 75552 - DNA, 25 bp, E. coli
gaaacattgcacaccacgctgattg

SEQ ID NO: 75553 - DNA, 25 bp, E. coli
gaaacattgcactccacgctgattg

SEQ ID NO: 75554 - DNA, 25 bp, E. coli
gactggatggtaatctggttcgcct

SEQ ID NO: 75555 - DNA, 25 bp, E. coli
cgtgcgctggccctagtaattctga

SEQ ID NO: 75556 - DNA, 25 bp, E. coli
cgtgcgctggccgtagtaattctga

SEQ ID NO: 75557 - DNA, 25 bp, E. coli
gtaattctgattgctgcagcgggtg

SEQ ID NO: 75558 - DNA, 25 bp, E. coli
gtaattctgattcctgcagcgggtg

SEQ ID NO: 75559 - DNA, 25 bp, E. coli
tggccgactcgccaggaaacattgc

SEQ ID NO: 75560 - DNA, 25 bp, E. coli
tggccgactcgcgaggaaacattgc

SEQ ID NO: 75561 - DNA, 25 bp, E. coli
aacggtctgctgcttgtgctccctg

SEQ ID NO: 75562 - DNA, 25 bp, E. coli
cacaccggagtacaagagcgtcagt

SEQ ID NO: 75563 - DNA, 25 bp, E. coli
cacacttggctaaggactgtgcgct

SEQ ID NO: 75564 - DNA, 25 bp, E. coli
cagcgccataacaacagcggtggga

SEQ ID NO: 75565 - DNA, 25 bp, E. coli
cacaccggagtagaagagcgtcagt

SEQ ID NO: 75566 - DNA, 25 bp, E. coli
cacacttggctatggactgtgcgct

SEQ ID NO: 75567 - DNA, 25 bp, E. coli
cagcgccataactacagcggtggga

SEQ ID NO: 75568 - DNA, 25 bp, E. coli
aacggtctgctggttgtgctccctg

SEQ ID NO: 75569 - DNA, 25 bp, E. coli
tatgggctgcccagctgatgcttgg

SEQ ID NO: 75570 - DNA, 25 bp, E. coli
tatgggctgccctgctgatgcttgg

SEQ ID NO: 75571 - DNA, 25 bp, E. coli
tgtcacctgggatcgaagatacgcc

SEQ ID NO: 75572 - DNA, 25 bp, E. coli
tgtcacctgggaacgaagatacgcc

SEQ ID NO: 75573 - DNA, 25 bp, E. coli
gctggtgccgctggtatcgaaaaca

SEQ ID NO: 75574 - DNA, 25 bp, E. coli
gctggtgccgctcgtatcgaaaaca

SEQ ID NO: 75575 - DNA, 25 bp, E. coli
gaaaacaggtgtcgcaatcgcgctg

SEQ ID NO: 75576 - DNA, 25 bp, E. coli
gaaagcaaatttgccgtactggcag

SEQ ID NO: 75577 - DNA, 25 bp, E. coli
gaaaacaggtgtggcaatcgcgctg

SEQ ID NO: 75578 - DNA, 25 bp, E. coli
gaaagcaaatttcccgtactggcag

SEQ ID NO: 75579 - DNA, 25 bp, E. coli
ggaatattaatcatcgcccggatcg

SEQ ID NO: 75580 - DNA, 25 bp, E. coli
ggaatattaatcttcgcccggatcg

SEQ ID NO: 75581 - DNA, 25 bp, E. coli
taagctttacccagctagggctggg

SEQ ID NO: 75582 - DNA, 25 bp, E. coli
taagctttaccctgctagggctggg

SEQ ID NO: 75583 - DNA, 25 bp, E. coli
catattgccgctacgattaagcgaa

SEQ ID NO: 75584 - DNA, 25 bp, E. coli
catattgccgcttcgattaagcgaa

SEQ ID NO: 75585 - DNA, 25 bp, E. coli
taaacagcgcctaactatgtcgata

SEQ ID NO: 75586 - DNA, 25 bp, E. coli
taaacagcgccttactatgtcgata

SEQ ID NO: 75587 - DNA, 25 bp, E. coli
taaaatactcttttagcaagcgcgt

SEQ ID NO: 75588 - DNA, 25 bp, E. coli
taaaatactcttatagcaagcgcgt

SEQ ID NO: 75589 - DNA, 25 bp, E. coli
aaataaccagattctcactcctgag

SEQ ID NO: 75590 - DNA, 25 bp, E. coli
aaataaccagatactcactcctgag

SEQ ID NO: 75591 - DNA, 25 bp, E. coli
tagcatgcgttagttaaacagcgcc

SEQ ID NO: 75592 - DNA, 25 bp, E. coli
tagcatgcgttacttaaacagcgcc

SEQ ID NO: 75593 - DNA, 25 bp, E. coli
tgctttttcggattgagtcgcttgc

SEQ ID NO: 75594 - DNA, 25 bp, E. coli
tgctttttcggaatgagtcgcttgc

SEQ ID NO: 75595 - DNA, 25 bp, E. coli
tcatgctaaatatagaacctgtctg

SEQ ID NO: 75596 - DNA, 25 bp, E. coli
tcatgctaaataaagaacctgtctg

SEQ ID NO: 75597 - DNA, 25 bp, E. coli
gaagaggttgtattgcgattcatca

SEQ ID NO: 75598 - DNA, 25 bp, E. coli
gaacctgtctgtatgatattccgac

SEQ ID NO: 75599 - DNA, 25 bp, E. coli
gaagaggttgtaatgcgattcatca

SEQ ID NO: 75600 - DNA, 25 bp, E. coli
gaacctgtctgtttgatattccgac

SEQ ID NO: 75601 - DNA, 25 bp, E. coli
gatattccgacaggttcttactctc

SEQ ID NO: 75602 - DNA, 25 bp, E. coli
gatattccgacacgttcttactctc

SEQ ID NO: 75603 - DNA, 25 bp, E. coli
gagtcgcttgcttcagcgcatattg

SEQ ID NO: 75604 - DNA, 25 bp, E. coli
gagtcgcttgctacagcgcatattg

SEQ ID NO: 75605 - DNA, 25 bp, E. coli
aatatcgtttatcagtgctgggagc

SEQ ID NO: 75606 - DNA, 25 bp, E. coli
aatatcgtttatgagtgctgggagc

SEQ ID NO: 75607 - DNA, 25 bp, E. coli
tatcgccgccaggattgcattgcgc

SEQ ID NO: 75608 - DNA, 25 bp, E. coli
tttatgccccggcttccagtgccaa

SEQ ID NO: 75609 - DNA, 25 bp, E. coli
tttatgccccgggttccagtgccaa

SEQ ID NO: 75610 - DNA, 25 bp, E. coli
tatcgccgccagcattgcattgcgc

SEQ ID NO: 75611 - DNA, 25 bp, E. coli
tgccgactggttcggtaagaactac

SEQ ID NO: 75612 - DNA, 25 bp, E. coli
tgccgactggttgggtaagaactac

SEQ ID NO: 75613 - DNA, 25 bp, E. coli
tcattacgacaaggtggcaccgtgt

SEQ ID NO: 75614 - DNA, 25 bp, E. coli
tcattacgacaacgtggcaccgtgt

SEQ ID NO: 75615 - DNA, 25 bp, E. coli
ccagtgccaataagagcgtcgggtt

SEQ ID NO: 75616 - DNA, 25 bp, E. coli
ccagtgccaatatgagcgtcgggtt

SEQ ID NO: 75617 - DNA, 25 bp, E. coli
gcgggcgcacgagtactggaaaact

SEQ ID NO: 75618 - DNA, 25 bp, E. coli
gctttgccgataagctgccgtcaga

SEQ ID NO: 75619 - DNA, 25 bp, E. coli
gcgggcgcacgactactggaaaact

SEQ ID NO: 75620 - DNA, 25 bp, E. coli
gctttgccgatatgctgccgtcaga

SEQ ID NO: 75621 - DNA, 25 bp, E. coli
gacattcagtctgaacaacctcgga

SEQ ID NO: 75622 - DNA, 25 bp, E. coli
gacattcagtctcaacaacctcgga

SEQ ID NO: 75623 - DNA, 25 bp, E. coli
cattgctcggagatgtagtcacggt

SEQ ID NO: 75624 - DNA, 25 bp, E. coli
cattgctcggagttgtagtcacggt

SEQ ID NO: 75625 - DNA, 25 bp, E. coli
gattaaagtctcgacggcagaagcc

SEQ ID NO: 75626 - DNA, 25 bp, E. coli
gattaaagtctccacggcagaagcc

SEQ ID NO: 75627 - DNA, 25 bp, E. coli
tacgcggaatttaccaacaaagagg

SEQ ID NO: 75628 - DNA, 25 bp, E. coli
aaagcgcccacggtatacgcggaat

SEQ ID NO: 75629 - DNA, 25 bp, E. coli
aaagcgcccacgctatacgcggaat

SEQ ID NO: 75630 - DNA, 25 bp, E. coli
tacgcggaattttccaacaaagagg

SEQ ID NO: 75631 - DNA, 25 bp, E. coli
tttatgtcaacgacaagcgcgcggg

SEQ ID NO: 75632 - DNA, 25 bp, E. coli
tttatgtcaacgtcaagcgcgcggg

SEQ ID NO: 75633 - DNA, 25 bp, E. coli
tgcagattgccggaacgactttgcg

SEQ ID NO: 75634 - DNA, 25 bp, E. coli
tgcagattgccgcaacgactttgcg

SEQ ID NO: 75635 - DNA, 25 bp, E. coli
tgccgctaagcaagaagcacagctg

SEQ ID NO: 75636 - DNA, 25 bp, E. coli
tgccgctaagcatgaagcacagctg

SEQ ID NO: 75637 - DNA, 25 bp, E. coli
gaagcgacttctcttgcggacctcg

SEQ ID NO: 75638 - DNA, 25 bp, E. coli
gaagcgacttctgttgcggacctcg

SEQ ID NO: 75639 - DNA, 25 bp, E. coli
gactttgcgtttatggcccgaactg

SEQ ID NO: 75640 - DNA, 25 bp, E. coli
gactttgcgtttttggcccgaactg

SEQ ID NO: 75641 - DNA, 25 bp, E. coli
gaaatcacgccaagcgatgcaagag

SEQ ID NO: 75642 - DNA, 25 bp, E. coli
gaaatcacgccatgcgatgcaagag

SEQ ID NO: 75643 - DNA, 25 bp, E. coli
cggcaggctgcttcatgatcaacaa

SEQ ID NO: 75644 - DNA, 25 bp, E. coli
cggcaggctgctacatgatcaacaa

SEQ ID NO: 75645 - DNA, 25 bp, E. coli
tggcaactgactcaacacaatgtgt

SEQ ID NO: 75646 - DNA, 25 bp, E. coli
tggcaactgactgaacacaatgtgt

SEQ ID NO: 75647 - DNA, 25 bp, E. coli
gatgccgcgcttcataaggccatga

SEQ ID NO: 75648 - DNA, 25 bp, E. coli
gatgccgcgcttgataaggccatga

SEQ ID NO: 75649 - DNA, 25 bp, E. coli
caagaaaaggaacttcggtatgcca

SEQ ID NO: 75650 - DNA, 25 bp, E. coli
caagaaaaggaagttcggtatgcca

SEQ ID NO: 75651 - DNA, 25 bp, E. coli
cagggaagccgtatatcgatagcac

SEQ ID NO: 75652 - DNA, 25 bp, E. coli
cagggaagccgtttatcgatagcac

SEQ ID NO: 75653 - DNA, 25 bp, E. coli
taccttaaccctctcactaaagtgg

SEQ ID NO: 75654 - DNA, 25 bp, E. coli
taccttaaccctgtcactaaagtgg

SEQ ID NO: 75655 - DNA, 25 bp, E. coli
tagaaaaatcgctgtgcatcggctg

SEQ ID NO: 75656 - DNA, 25 bp, E. coli
tagggtggacagttgcagccactgc

SEQ ID NO: 75657 - DNA, 25 bp, E. coli
tagggtggacagatgcagccactgc

SEQ ID NO: 75658 - DNA, 25 bp, E. coli
tagaaaaatcgcagtgcatcggctg

SEQ ID NO: 75659 - DNA, 25 bp, E. coli
tcatgtcagcacagcgaagatgctc

SEQ ID NO: 75660 - DNA, 25 bp, E. coli
tcatgacgagtcacggtgcaatggc

SEQ ID NO: 75661 - DNA, 25 bp, E. coli
tcatgacgagtctcggtgcaatggc

SEQ ID NO: 75662 - DNA, 25 bp, E. coli
tcatgtcagcactgcgaagatgctc

SEQ ID NO: 75663 - DNA, 25 bp, E. coli
gcccggaacacgcattgatctttgg

SEQ ID NO: 75664 - DNA, 25 bp, E. coli
gccgggaaaccgcatctgtatcgcc

SEQ ID NO: 75665 - DNA, 25 bp, E. coli
gccgggaaaccggatctgtatcgcc

SEQ ID NO: 75666 - DNA, 25 bp, E. coli
gcccggaacacggattgatctttgg

SEQ ID NO: 75667 - DNA, 25 bp, E. coli
gcagtatcacttatttcgccagtca

SEQ ID NO: 75668 - DNA, 25 bp, E. coli
gcagtatcacttttttcgccagtca

SEQ ID NO: 75669 - DNA, 25 bp, E. coli
taatcagatgtccttcactcgacgc

SEQ ID NO: 75670 - DNA, 25 bp, E. coli
taatcagatgtcgttcactcgacgc

SEQ ID NO: 75671 - DNA, 25 bp, E. coli
aagtgtatattgtagcgaccgggcg

SEQ ID NO: 75672 - DNA, 25 bp, E. coli
aagtgtatattgaagcgaccgggcg

SEQ ID NO: 75673 - DNA, 25 bp, E. coli
tatgtggtcaccgaaattggcggca

SEQ ID NO: 75674 - DNA, 25 bp, E. coli
tatggcaccaaacatgagcggaaca

SEQ ID NO: 75675 - DNA, 25 bp, E. coli
tatggcaccaaagatgagcggaaca

SEQ ID NO: 75676 - DNA, 25 bp, E. coli
tatgtggtcacccaaattggcggca

SEQ ID NO: 75677 - DNA, 25 bp, E. coli
tgatgaaagcactgctggagcgcgt

SEQ ID NO: 75678 - DNA, 25 bp, E. coli
tgatgaaagcacagctggagcgcgt

SEQ ID NO: 75679 - DNA, 25 bp, E. coli
tcgtgatgtatttgcgccaggtggc

SEQ ID NO: 75680 - DNA, 25 bp, E. coli
tcgtgatgtattagcgccaggtggc

SEQ ID NO: 75681 - DNA, 25 bp, E. coli
gcaaagtccaggatgtcatgtccga

SEQ ID NO: 75682 - DNA, 25 bp, E. coli
gcaaagtccaggttgtcatgtccga

SEQ ID NO: 75683 - DNA, 25 bp, E. coli
gaaattcgctccgtgtttacgaagg

SEQ ID NO: 75684 - DNA, 25 bp, E. coli
gactcttctcgtgcacgttcgcggg

SEQ ID NO: 75685 - DNA, 25 bp, E. coli
gaactggcgctagaaatgtgtcgtg

SEQ ID NO: 75686 - DNA, 25 bp, E. coli
gactcttctcgtccacgttcgcggg

SEQ ID NO: 75687 - DNA, 25 bp, E. coli
gaaattcgctccctgtttacgaagg

SEQ ID NO: 75688 - DNA, 25 bp, E. coli
gaactggcgctacaaatgtgtcgtg

SEQ ID NO: 75689 - DNA, 25 bp, E. coli
ggtcaaagttcgtaagccggactct

SEQ ID NO: 75690 - DNA, 25 bp, E. coli
ggtaagaagcgttctgccagctcca

SEQ ID NO: 75691 - DNA, 25 bp, E. coli
ggtaagaagcgtactgccagctcca

SEQ ID NO: 75692 - DNA, 25 bp, E. coli
ggtcaaagttcgaaagccggactct

SEQ ID NO: 75693 - DNA, 25 bp, E. coli
cagttccgcgcgatgttgaaaaagc

SEQ ID NO: 75694 - DNA, 25 bp, E. coli
cagttccgcgcgttgttgaaaaagc

SEQ ID NO: 75695 - DNA, 25 bp, E. coli
ttggtatgcgcgtcgaatgccgatc

SEQ ID NO: 75696 - DNA, 25 bp, E. coli
tttaccggtgcgcaaaaacgtcatc

SEQ ID NO: 75697 - DNA, 25 bp, E. coli
tttaccggtgcggaaaaacgtcatc

SEQ ID NO: 75698 - DNA, 25 bp, E. coli
ttggtatgcgcgacgaatgccgatc

SEQ ID NO: 75699 - DNA, 25 bp, E. coli
tgtgtcgggaaaacaagctgcctct

SEQ ID NO: 75700 - DNA, 25 bp, E. coli
tgtgtcgggaaatcaagctgcctct

SEQ ID NO: 75701 - DNA, 25 bp, E. coli
tcatccagggagttttgaacgtgcc

SEQ ID NO: 75702 - DNA, 25 bp, E. coli
tcatccagggagatttgaacgtgcc

SEQ ID NO: 75703 - DNA, 25 bp, E. coli
gacaaaccggtgctcatcatcggcg

SEQ ID NO: 75704 - DNA, 25 bp, E. coli
gacaaaccggtggtcatcatcggcg

SEQ ID NO: 75705 - DNA, 25 bp, E. coli
ctgcgcggcgtttaatgaaaatctg

SEQ ID NO: 75706 - DNA, 25 bp, E. coli
ctgcgcggcgttaaatgaaaatctg

SEQ ID NO: 75707 - DNA, 25 bp, E. coli
tggaacaggtttcgcatctcgcacc

SEQ ID NO: 75708 - DNA, 25 bp, E. coli
tggaacaggtttggcatctcgcacc

SEQ ID NO: 75709 - DNA, 25 bp, E. coli
ttgatgaactcgctacggcaccgat

SEQ ID NO: 75710 - DNA, 25 bp, E. coli
ttgatgaactcggtacggcaccgat

SEQ ID NO: 75711 - DNA, 25 bp, E. coli
gatctcccggcgatggtcaatgaag

SEQ ID NO: 75712 - DNA, 25 bp, E. coli
gaggcgaacagctttctcgaagtgc

SEQ ID NO: 75713 - DNA, 25 bp, E. coli
gatctcccggcgttggtcaatgaag

SEQ ID NO: 75714 - DNA, 25 bp, E. coli
gaggcgaacagcattctcgaagtgc

SEQ ID NO: 75715 - DNA, 25 bp, E. coli
caacaatctgttatattcaataggt

SEQ ID NO: 75716 - DNA, 25 bp, E. coli
caacaatctgttttattcaataggt

SEQ ID NO: 75717 - DNA, 25 bp, E. coli
catattatcgggcacattgttccag

SEQ ID NO: 75718 - DNA, 25 bp, E. coli
catattatcggggacattgttccag

SEQ ID NO: 75719 - DNA, 25 bp, E. coli
tagtcgcaggctttggtacgaaatc

SEQ ID NO: 75720 - DNA, 25 bp, E. coli
atgagtaaggagacttatcggcaac

SEQ ID NO: 75721 - DNA, 25 bp, E. coli
aggctttggtaccaaatcatggcga

SEQ ID NO: 75722 - DNA, 25 bp, E. coli
aggctttggtacgaaatcatggcga

SEQ ID NO: 75723 - DNA, 25 bp, E. coli
atgagtaaggagtcttatcggcaac

SEQ ID NO: 75724 - DNA, 25 bp, E. coli
tagtcgcaggctatggtacgaaatc

SEQ ID NO: 75725 - DNA, 25 bp, E. coli
tatgatagtcgctggctttggtacg

SEQ ID NO: 75726 - DNA, 25 bp, E. coli
taggtatgatagacgcaggctttgg

SEQ ID NO: 75727 - DNA, 25 bp, E. coli
tatgatagtcgcaggctttggtacg

SEQ ID NO: 75728 - DNA, 25 bp, E. coli
taggtatgatagtcgcaggctttgg

SEQ ID NO: 75729 - DNA, 25 bp, E. coli
ttcaataggtatcatagtcgcaggc

SEQ ID NO: 75730 - DNA, 25 bp, E. coli
ttcaataggtatgatagtcgcaggc

SEQ ID NO: 75731 - DNA, 25 bp, E. coli
cgcaggctttggaacgaaatcatgg

SEQ ID NO: 75732 - DNA, 25 bp, E. coli
cgccggtatgtttctaatatgttac

SEQ ID NO: 75733 - DNA, 25 bp, E. coli
cgccggtatgttactaatatgttac

SEQ ID NO: 75734 - DNA, 25 bp, E. coli
cgcaggctttggtacgaaatcatgg

SEQ ID NO: 75735 - DNA, 25 bp, E. coli
ggacattgttcctgacaacaatctg

SEQ ID NO: 75736 - DNA, 25 bp, E. coli
ggacattgttccagacaacaatctg

SEQ ID NO: 75737 - DNA, 25 bp, E. coli
cacaacagctatacggctcggtctg

SEQ ID NO: 75738 - DNA, 25 bp, E. coli
cacaacagctattcggctcggtctg

SEQ ID NO: 75739 - DNA, 25 bp, E. coli
taaacagtacgaacagataaacggt

SEQ ID NO: 75740 - DNA, 25 bp, E. coli
taaacagtacgatcagataaacggt

SEQ ID NO: 75741 - DNA, 25 bp, E. coli
tataatcaacctggctgtgagtagc

SEQ ID NO: 75742 - DNA, 25 bp, E. coli
tattgtgcaaattttgttaccccag

SEQ ID NO: 75743 - DNA, 25 bp, E. coli
tataatcaacctcgctgtgagtagc

SEQ ID NO: 75744 - DNA, 25 bp, E. coli
tattgtgcaaatattgttaccccag

SEQ ID NO: 75745 - DNA, 25 bp, E. coli
tgttaccccagcaacaaacaggctc

SEQ ID NO: 75746 - DNA, 25 bp, E. coli
tgttaccccagctacaaacaggctc

SEQ ID NO: 75747 - DNA, 25 bp, E. coli
tcagaccttgcccaatattctccag

SEQ ID NO: 75748 - DNA, 25 bp, E. coli
tcaggcgattcgacgttttagtaaa

SEQ ID NO: 75749 - DNA, 25 bp, E. coli
tcaggcgattcgtcgttttagtaaa

SEQ ID NO: 75750 - DNA, 25 bp, E. coli
tcagaccttgccgaatattctccag

SEQ ID NO: 75751 - DNA, 25 bp, E. coli
ccctttcatggccatggctgggacg

SEQ ID NO: 75752 - DNA, 25 bp, E. coli
ccctttcatggcgatggctgggacg

SEQ ID NO: 75753 - DNA, 25 bp, E. coli
tggctgggacggttcagaccttgcc

SEQ ID NO: 75754 - DNA, 25 bp, E. coli
tggctgggacggatcagaccttgcc

SEQ ID NO: 75755 - DNA, 25 bp, E. coli
gatgcttgttgtgcctgaaaatcag

SEQ ID NO: 75756 - DNA, 25 bp, E. coli
gagtagctatagatgccaggtccga

SEQ ID NO: 75757 - DNA, 25 bp, E. coli
gagtagctatagttgccaggtccga

SEQ ID NO: 75758 - DNA, 25 bp, E. coli
gatgcttgttgtccctgaaaatcag

SEQ ID NO: 75759 - DNA, 25 bp, E. coli
gaggaccgaaggtgctaaccgcttt

SEQ ID NO: 75760 - DNA, 25 bp, E. coli
gaggaccgaaggagctaaccgcttt

SEQ ID NO: 75761 - DNA, 25 bp, E. coli
tacttctgacaaggatcggaggacc

SEQ ID NO: 75762 - DNA, 25 bp, E. coli
tacttctgacaacgatcggaggacc

SEQ ID NO: 75763 - DNA, 25 bp, E. coli
tagacagatcgcagagataggtgcc

SEQ ID NO: 75764 - DNA, 25 bp, E. coli
tagacagatcgctgagataggtgcc

SEQ ID NO: 75765 - DNA, 25 bp, E. coli
tgataaatctggtgccggtgagcgt

SEQ ID NO: 75766 - DNA, 25 bp, E. coli
tgataaatctggagccggtgagcgt

SEQ ID NO: 75767 - DNA, 25 bp, E. coli
tgcagtgctgccttaaccatgagtg

SEQ ID NO: 75768 - DNA, 25 bp, E. coli
tgcagtgctgccataaccatgagtg

SEQ ID NO: 75769 - DNA, 25 bp, E. coli
tctcgcggtatcattgcagcactgg

SEQ ID NO: 75770 - DNA, 25 bp, E. coli
tctcgcggtatctttgcagcactgg

SEQ ID NO: 75771 - DNA, 25 bp, E. coli
gatggtaagcccacccgtatcgtag

SEQ ID NO: 75772 - DNA, 25 bp, E. coli
gatggtaagccctcccgtatcgtag

SEQ ID NO: 75773 - DNA, 25 bp, E. coli
gaatgaagccataccaaacgacgag

SEQ ID NO: 75774 - DNA, 25 bp, E. coli
gaatgaagccattccaaacgacgag

SEQ ID NO: 75775 - DNA, 25 bp, E. coli
taactcgccttgttcgttgggaacc

SEQ ID NO: 75776 - DNA, 25 bp, E. coli
taactcgccttgatcgttgggaacc

SEQ ID NO: 75777 - DNA, 25 bp, E. coli
gagtgataacacagcggccaactta

SEQ ID NO: 75778 - DNA, 25 bp, E. coli
gatccttgagagttttcgccccgaa

SEQ ID NO: 75779 - DNA, 25 bp, E. coli
gagtgataacactgcggccaactta

SEQ ID NO: 75780 - DNA, 25 bp, E. coli
gatccttgagagatttcgccccgaa

SEQ ID NO: 75781 - DNA, 25 bp, E. coli
aaatatgactctatcgacgcgggcg

SEQ ID NO: 75782 - DNA, 25 bp, E. coli
aaatatgactctttcgacgcgggcg

SEQ ID NO: 75783 - DNA, 25 bp, E. coli
aaagtggtcgagcagatcaaagccg

SEQ ID NO: 75784 - DNA, 25 bp, E. coli
aaagtggtcgaggagatcaaagccg

SEQ ID NO: 75785 - DNA, 25 bp, E. coli
ttgtcgcgggaacggcaaaagtcac

SEQ ID NO: 75786 - DNA, 25 bp, E. coli
ttgtcgcgggaagggcaaaagtcac

SEQ ID NO: 75787 - DNA, 25 bp, E. coli
tgatttgcaatgtgcagcaccgctt

SEQ ID NO: 75788 - DNA, 25 bp, E. coli
tgatttgcaatgagcagcaccgctt

SEQ ID NO: 75789 - DNA, 25 bp, E. coli
tgaaaggcgatctcaccatgctgca

SEQ ID NO: 75790 - DNA, 25 bp, E. coli
tgaaacgcatcaccgtgaaaccggg

SEQ ID NO: 75791 - DNA, 25 bp, E. coli
tgaaaggcgatcacaccatgctgca

SEQ ID NO: 75792 - DNA, 25 bp, E. coli
tgaaacgcatcagcgtgaaaccggg

SEQ ID NO: 75793 - DNA, 25 bp, E. coli
tccagttgtgatcgcaggtggctcc

SEQ ID NO: 75794 - DNA, 25 bp, E. coli
tccagttgtgatggcaggtggctcc

SEQ ID NO: 75795 - DNA, 25 bp, E. coli
tcattatgggagatcagcgcccaca

SEQ ID NO: 75796 - DNA, 25 bp, E. coli
tcattatgggagttcagcgcccaca

SEQ ID NO: 75797 - DNA, 25 bp, E. coli
gaacattattctggaaccggcaggg

SEQ ID NO: 75798 - DNA, 25 bp, E. coli
gaacattattctcgaaccggcaggg

SEQ ID NO: 75799 - DNA, 25 bp, E. coli
gatttaattgaagtgcgctccggct

SEQ ID NO: 75800 - DNA, 25 bp, E. coli
gatttaattgaactgcgctccggct

SEQ ID NO: 75801 - DNA, 25 bp, E. coli
ggcaagcggcgaatattactggaac

SEQ ID NO: 75802 - DNA, 25 bp, E. coli
ggcaagcggcgattattactggaac

SEQ ID NO: 75803 - DNA, 25 bp, E. coli
cactggtgaattggacgctggccga

SEQ ID NO: 75804 - DNA, 25 bp, E. coli
cactggtgaattcgacgctggccga

SEQ ID NO: 75805 - DNA, 25 bp, E. coli
aaaatcatcgagatgcgcagcgcac

SEQ ID NO: 75806 - DNA, 25 bp, E. coli
aaaatcatcgagttgcgcagcgcac

SEQ ID NO: 75807 - DNA, 25 bp, E. coli
tagataccggcaaggacgtgctgac

SEQ ID NO: 75808 - DNA, 25 bp, E. coli
tagataccggcatggacgtgctgac

SEQ ID NO: 75809 - DNA, 25 bp, E. coli
taggcattgaccatgcggtaccgga

SEQ ID NO: 75810 - DNA, 25 bp, E. coli
taggcattgaccttgcggtaccgga

SEQ ID NO: 75811 - DNA, 25 bp, E. coli
tattgatattctcacttccggcgcg

SEQ ID NO: 75812 - DNA, 25 bp, E. coli
tatctgccgcaggtgtttaacgacg

SEQ ID NO: 75813 - DNA, 25 bp, E. coli
tatctgccgcagctgtttaacgacg

SEQ ID NO: 75814 - DNA, 25 bp, E. coli
tattgatattctgacttccggcgcg

SEQ ID NO: 75815 - DNA, 25 bp, E. coli
tgatgactcaggtgatccgccagat

SEQ ID NO: 75816 - DNA, 25 bp, E. coli
tgatgactcaggagatccgccagat

SEQ ID NO: 75817 - DNA, 25 bp, E. coli
tcatcgacttcaacagcaaacgggc

SEQ ID NO: 75818 - DNA, 25 bp, E. coli
tcatcgacttcatcagcaaacgggc

SEQ ID NO: 75819 - DNA, 25 bp, E. coli
gcattttcggcgaggttactccgga

SEQ ID NO: 75820 - DNA, 25 bp, E. coli
gcattttcggcgtggttactccgga

SEQ ID NO: 75821 - DNA, 25 bp, E. coli
gacgaaaaagactttgcggcgcgca

SEQ ID NO: 75822 - DNA, 25 bp, E. coli
gacgaaaaagacattgcggcgcgca

SEQ ID NO: 75823 - DNA, 25 bp, E. coli
gatccggctctgaagtgacgtccta

SEQ ID NO: 75824 - DNA, 25 bp, E. coli
gatccggctctgtagtgacgtccta

SEQ ID NO: 75825 - DNA, 25 bp, E. coli
caatacgacgttttgctgacccagg

SEQ ID NO: 75826 - DNA, 25 bp, E. coli
caatacgacgttatgctgacccagg

SEQ ID NO: 75827 - DNA, 25 bp, E. coli
tacgagcaaaaccacgaaagtgcac

SEQ ID NO: 75828 - DNA, 25 bp, E. coli
tacgagcaaaacgacgaaagtgcac

SEQ ID NO: 75829 - DNA, 25 bp, E. coli
tatgctgacccaggatgacgcggta

SEQ ID NO: 75830 - DNA, 25 bp, E. coli
tatgctgacccacgatgacgcggta

SEQ ID NO: 75831 - DNA, 25 bp, E. coli
tgatcaccgacgctcgtttctctgg

SEQ ID NO: 75832 - DNA, 25 bp, E. coli
tgatcaccgacggtcgtttctctgg

SEQ ID NO: 75833 - DNA, 25 bp, E. coli
tcgataagctttgccgcaaggttcc

SEQ ID NO: 75834 - DNA, 25 bp, E. coli
tcgataagctttcccgcaaggttcc

SEQ ID NO: 75835 - DNA, 25 bp, E. coli
tcgcgatgggtggatcgactaacac

SEQ ID NO: 75836 - DNA, 25 bp, E. coli
tcgccggagatgtggtagtaattcg

SEQ ID NO: 75837 - DNA, 25 bp, E. coli
tcgccggagatgaggtagtaattcg

SEQ ID NO: 75838 - DNA, 25 bp, E. coli
tcgcgatgggtgcatcgactaacac

SEQ ID NO: 75839 - DNA, 25 bp, E. coli
tctcggcggtaaagttgtcgccgga

SEQ ID NO: 75840 - DNA, 25 bp, E. coli
tctcggcggtaatgttgtcgccgga

SEQ ID NO: 75841 - DNA, 25 bp, E. coli
gcaaacgctggaacaatacgacgtt

SEQ ID NO: 75842 - DNA, 25 bp, E. coli
gcaaacgctggatcaatacgacgtt

SEQ ID NO: 75843 - DNA, 25 bp, E. coli
gactaacaccgtacttcacctgctg

SEQ ID NO: 75844 - DNA, 25 bp, E. coli
gactaacaccgttcttcacctgctg

SEQ ID NO: 75845 - DNA, 25 bp, E. coli
gtggtagtaattcgctatgaaggcc

SEQ ID NO: 75846 - DNA, 25 bp, E. coli
gtggtagtaattggctatgaaggcc

SEQ ID NO: 75847 - DNA, 25 bp, E. coli
cagacagcgcaatagcctgatttgg

SEQ ID NO: 75848 - DNA, 25 bp, E. coli
cagacagcgcaaaagcctgatttgg

SEQ ID NO: 75849 - DNA, 25 bp, E. coli
aggcctacgccacacagcgcaatag

SEQ ID NO: 75850 - DNA, 25 bp, E. coli
aggcctacgccagacagcgcaatag

SEQ ID NO: 75851 - DNA, 25 bp, E. coli
tttggcgtgattattgtaggtcgga

SEQ ID NO: 75852 - DNA, 25 bp, E. coli
tttggcgtgatttttgtaggtcgga

SEQ ID NO: 75853 - DNA, 25 bp, E. coli
ttgctgcgcctagcttaaccgttag

SEQ ID NO: 75854 - DNA, 25 bp, E. coli
ttgctgcgcctaccttaaccgttag

SEQ ID NO: 75855 - DNA, 25 bp, E. coli
gcgacgtttgctccgcctaccttaa

SEQ ID NO: 75856 - DNA, 25 bp, E. coli
gcctgatttggcgtgatttttgtag

SEQ ID NO: 75857 - DNA, 25 bp, E. coli
gcgacgtttgctgcgcctaccttaa

SEQ ID NO: 75858 - DNA, 25 bp, E. coli
gcctgatttggcctgatttttgtag

SEQ ID NO: 75859 - DNA, 25 bp, E. coli
gcgcaatagcctcatttggcgtgat

SEQ ID NO: 75860 - DNA, 25 bp, E. coli
gctgcgcctaccttaaccgttagtt

SEQ ID NO: 75861 - DNA, 25 bp, E. coli
gcgcaatagcctgatttggcgtgat

SEQ ID NO: 75862 - DNA, 25 bp, E. coli
gctgcgcctaccataaccgttagtt

SEQ ID NO: 75863 - DNA, 25 bp, E. coli
gacagcgcaataccctgatttggcg

SEQ ID NO: 75864 - DNA, 25 bp, E. coli
gacagcgcaatagcctgatttggcg

SEQ ID NO: 75865 - DNA, 25 bp, E. coli
cgccagacagcggaatagcctgatt

SEQ ID NO: 75866 - DNA, 25 bp, E. coli
cgtttgctgcgcgtaccttaaccgt

SEQ ID NO: 75867 - DNA, 25 bp, E. coli
cgtttgctgcgcctaccttaaccgt

SEQ ID NO: 75868 - DNA, 25 bp, E. coli
cgccagacagcgcaatagcctgatt

SEQ ID NO: 75869 - DNA, 25 bp, E. coli
caatctgttactctgctaacaggga

SEQ ID NO: 75870 - DNA, 25 bp, E. coli
caatctgttactgtgctaacaggga

SEQ ID NO: 75871 - DNA, 25 bp, E. coli
atgagtcgcccggtgaagcagctta

SEQ ID NO: 75872 - DNA, 25 bp, E. coli
atgagtcgcccgctgaagcagctta

SEQ ID NO: 75873 - DNA, 25 bp, E. coli
aaacgctgccgctgaaaaaatctgc

SEQ ID NO: 75874 - DNA, 25 bp, E. coli
aaacgctgccgcagaaaaaatctgc

SEQ ID NO: 75875 - DNA, 25 bp, E. coli
ttataacccgtcaggcaagctgccg

SEQ ID NO: 75876 - DNA, 25 bp, E. coli
ttataacccgtctggcaagctgccg

SEQ ID NO: 75877 - DNA, 25 bp, E. coli
tgctaacagggattaaaaacgccgt

SEQ ID NO: 75878 - DNA, 25 bp, E. coli
tgctaacagggaataaaaacgccgt

SEQ ID NO: 75879 - DNA, 25 bp, E. coli
gcaggtgtcgcccatcaatctgtta

SEQ ID NO: 75880 - DNA, 25 bp, E. coli
gcaggtgtcgccgatcaatctgtta

SEQ ID NO: 75881 - DNA, 25 bp, E. coli
gaagcttccagtggtaccgatatca

SEQ ID NO: 75882 - DNA, 25 bp, E. coli
gaagcttccagtcgtaccgatatca

SEQ ID NO: 75883 - DNA, 25 bp, E. coli
gaaaaatcgtctggaaacgctgccg

SEQ ID NO: 75884 - DNA, 25 bp, E. coli
gaaaaatcgtctcgaaacgctgccg

SEQ ID NO: 75885 - DNA, 25 bp, E. coli
cccggtgaagcaccttaaaggcttt

SEQ ID NO: 75886 - DNA, 25 bp, E. coli
cccggtgaagcagcttaaaggcttt

SEQ ID NO: 75887 - DNA, 25 bp, E. coli
ggcagacagcaaccgtgacgtgatg

SEQ ID NO: 75888 - DNA, 25 bp, E. coli
ggcagacagcaagcgtgacgtgatg

SEQ ID NO: 75889 - DNA, 25 bp, E. coli
gatggcgcacgatgcttccagtcgt

SEQ ID NO: 75890 - DNA, 25 bp, E. coli
gatggcgcacgaagcttccagtcgt

SEQ ID NO: 75891 - DNA, 25 bp, E. coli
cacaggtcatgtacgggtatactgc

SEQ ID NO: 75892 - DNA, 25 bp, E. coli
cacaggtcatgttcgggtatactgc

SEQ ID NO: 75893 - DNA, 25 bp, E. coli
cattttttaaatcacaagcgcttga

SEQ ID NO: 75894 - DNA, 25 bp, E. coli
cattttttaaatgacaagcgcttga

SEQ ID NO: 75895 - DNA, 25 bp, E. coli
cctgatttcaatagtgcgctggcga

SEQ ID NO: 75896 - DNA, 25 bp, E. coli
cctgatttcaattgtgcgctggcga

SEQ ID NO: 75897 - DNA, 25 bp, E. coli
gcggtcaagcgccatttgtgtcatt

SEQ ID NO: 75898 - DNA, 25 bp, E. coli
gcggtcaagcgcgatttgtgtcatt

SEQ ID NO: 75899 - DNA, 25 bp, E. coli
taatgaaagtttctggcacaggtca

SEQ ID NO: 75900 - DNA, 25 bp, E. coli
taatgaaagtttgtggcacaggtca

SEQ ID NO: 75901 - DNA, 25 bp, E. coli
gacaagcgcttgttttgcgtcaaaa

SEQ ID NO: 75902 - DNA, 25 bp, E. coli
gacaagcgcttgatttgcgtcaaaa

SEQ ID NO: 75903 - DNA, 25 bp, E. coli
cgtcttttcaacgtaacttctcagg

SEQ ID NO: 75904 - DNA, 25 bp, E. coli
cgtcttttcaacctaacttctcagg

SEQ ID NO: 75905 - DNA, 25 bp, E. coli
gggaattacgcggtcaagcgccatt

SEQ ID NO: 75906 - DNA, 25 bp, E. coli
ggtatactgcttacccgtcttggtt

SEQ ID NO: 75907 - DNA, 25 bp, E. coli
gggaattacgcgctcaagcgccatt

SEQ ID NO: 75908 - DNA, 25 bp, E. coli
ggtatactgctttcccgtcttggtt

SEQ ID NO: 75909 - DNA, 25 bp, E. coli
ggctattttctctctcctgatttca

SEQ ID NO: 75910 - DNA, 25 bp, E. coli
ggctattttctcactcctgatttca

SEQ ID NO: 75911 - DNA, 25 bp, E. coli
tgcgtcaaaaacttttaccccaaag

SEQ ID NO: 75912 - DNA, 25 bp, E. coli
tgcgtcaaaaacatttaccccaaag

SEQ ID NO: 75913 - DNA, 25 bp, E. coli
caggttaccgttctgcattgccaca

SEQ ID NO: 75914 - DNA, 25 bp, E. coli
caggttaccgttgtgcattgccaca

SEQ ID NO: 75915 - DNA, 25 bp, E. coli
agttttctgactatctccgctgggc

SEQ ID NO: 75916 - DNA, 25 bp, E. coli
agttttctgactttctccgctgggc

SEQ ID NO: 75917 - DNA, 25 bp, E. coli
ttttaacgcactcgatgaggctgct

SEQ ID NO: 75918 - DNA, 25 bp, E. coli
ttttaacgcactggatgaggctgct

SEQ ID NO: 75919 - DNA, 25 bp, E. coli
ttattcgatctcagtatgccgcccg

SEQ ID NO: 75920 - DNA, 25 bp, E. coli
ttattcgatctctgtatgccgcccg

SEQ ID NO: 75921 - DNA, 25 bp, E. coli
tccgctgggctggtgaagatatgaa

SEQ ID NO: 75922 - DNA, 25 bp, E. coli
tccgctgggctgctgaagatatgaa

SEQ ID NO: 75923 - DNA, 25 bp, E. coli
cctgatggcctgcagatctgcacgt

SEQ ID NO: 75924 - DNA, 25 bp, E. coli
gccgctcggtaacaactctggaaag

SEQ ID NO: 75925 - DNA, 25 bp, E. coli
cctgatggcctggagatctgcacgt

SEQ ID NO: 75926 - DNA, 25 bp, E. coli
gccgctcggtaagaactctggaaag

SEQ ID NO: 75927 - DNA, 25 bp, E. coli
gaatatatttcacgcttctccggac

SEQ ID NO: 75928 - DNA, 25 bp, E. coli
gcactgattcagtggcgcagcggca

SEQ ID NO: 75929 - DNA, 25 bp, E. coli
gaatatatttcaggcttctccggac

SEQ ID NO: 75930 - DNA, 25 bp, E. coli
gcactgattcagaggcgcagcggca

SEQ ID NO: 75931 - DNA, 25 bp, E. coli
gaaataaactggctctcacggcgta

SEQ ID NO: 75932 - DNA, 25 bp, E. coli
gaaatgaatcttggtcggccggacc

SEQ ID NO: 75933 - DNA, 25 bp, E. coli
gaaataaactgggtctcacggcgta

SEQ ID NO: 75934 - DNA, 25 bp, E. coli
gaaatgaatcttcgtcggccggacc

SEQ ID NO: 75935 - DNA, 25 bp, E. coli
aattttaatggcgtgggaatcagca

SEQ ID NO: 75936 - DNA, 25 bp, E. coli
aattttaatggcctgggaatcagca

SEQ ID NO: 75937 - DNA, 25 bp, E. coli
cattaaataccaatttcctgggccg

SEQ ID NO: 75938 - DNA, 25 bp, E. coli
cattaaataccattttcctgggccg

SEQ ID NO: 75939 - DNA, 25 bp, E. coli
tacgataggataccggcctcttctc

SEQ ID NO: 75940 - DNA, 25 bp, E. coli
aaaaatatcctaagggctggagcgc

SEQ ID NO: 75941 - DNA, 25 bp, E. coli
aaaaatatcctatgggctggagcgc

SEQ ID NO: 75942 - DNA, 25 bp, E. coli
tacgataggatagcggcctcttctc

SEQ ID NO: 75943 - DNA, 25 bp, E. coli
tttcatagcacaagaccactttggt

SEQ ID NO: 75944 - DNA, 25 bp, E. coli
tttcatagcacatgaccactttggt

SEQ ID NO: 75945 - DNA, 25 bp, E. coli
tatttcttcaacacctacgatagga

SEQ ID NO: 75946 - DNA, 25 bp, E. coli
tatttcttcaactcctacgatagga

SEQ ID NO: 75947 - DNA, 25 bp, E. coli
cctgggccgaatactacttatggtg

SEQ ID NO: 75948 - DNA, 25 bp, E. coli
cctgggccgaattctacttatggtg

SEQ ID NO: 75949 - DNA, 25 bp, E. coli
gctggagcgctagcattcatttcat

SEQ ID NO: 75950 - DNA, 25 bp, E. coli
gctggagcgctaccattcatttcat

SEQ ID NO: 75951 - DNA, 25 bp, E. coli
gacaatacaaaacactcatccagga

SEQ ID NO: 75952 - DNA, 25 bp, E. coli
gacaatacaaaagactcatccagga

SEQ ID NO: 75953 - DNA, 25 bp, E. coli
cggcttaagcgagatctctgcaaaa

SEQ ID NO: 75954 - DNA, 25 bp, E. coli
cggcttaagcgacatctctgcaaaa

SEQ ID NO: 75955 - DNA, 25 bp, E. coli
ggcaacagtttccatagccaggaat

SEQ ID NO: 75956 - DNA, 25 bp, E. coli
ggcaacagtttcgatagccaggaat

SEQ ID NO: 75957 - DNA, 25 bp, E. coli
cataatccggcatgcattgagcaag

SEQ ID NO: 75958 - DNA, 25 bp, E. coli
cataatccggcaagcattgagcaag

SEQ ID NO: 75959 - DNA, 25 bp, E. coli
ttaacgtgctgagcggctctgacgg

SEQ ID NO: 75960 - DNA, 25 bp, E. coli
ttgatgccgacatcgcaaaacaggt

SEQ ID NO: 75961 - DNA, 25 bp, E. coli
ttgatgccgacaacgcaaaacaggt

SEQ ID NO: 75962 - DNA, 25 bp, E. coli
ttaacgtgctgaccggctctgacgg

SEQ ID NO: 75963 - DNA, 25 bp, E. coli
tggtagaacacattcgccagggcgt

SEQ ID NO: 75964 - DNA, 25 bp, E. coli
tggtagaacacaatcgccagggcgt

SEQ ID NO: 75965 - DNA, 25 bp, E. coli
tgcttattgcccctagcgctgcgga

SEQ ID NO: 75966 - DNA, 25 bp, E. coli
tgcatctggtacagagcggcgaact

SEQ ID NO: 75967 - DNA, 25 bp, E. coli
tgcttattgcccgtagcgctgcgga

SEQ ID NO: 75968 - DNA, 25 bp, E. coli
tgcatctggtactgagcggcgaact

SEQ ID NO: 75969 - DNA, 25 bp, E. coli
tcctggaagacataatgcgtagccg

SEQ ID NO: 75970 - DNA, 25 bp, E. coli
tcctggaagacaaaatgcgtagccg

SEQ ID NO: 75971 - DNA, 25 bp, E. coli
tcggcgtcccgtgctgtgatgaatt

SEQ ID NO: 75972 - DNA, 25 bp, E. coli
tcggcgtcccgtcctgtgatgaatt

SEQ ID NO: 75973 - DNA, 25 bp, E. coli
gaccggtgaacctcagccgattgaa

SEQ ID NO: 75974 - DNA, 25 bp, E. coli
gaccggtgaaccacagccgattgaa

SEQ ID NO: 75975 - DNA, 25 bp, E. coli
gatgaattcggtaatgccaacggct

SEQ ID NO: 75976 - DNA, 25 bp, E. coli
gatgaattcggttatgccaacggct

SEQ ID NO: 75977 - DNA, 25 bp, E. coli
gatgcttaccgatgaactgctgcct

SEQ ID NO: 75978 - DNA, 25 bp, E. coli
gatgcttaccgaagaactgctgcct

SEQ ID NO: 75979 - DNA, 25 bp, E. coli
tacaccgctgtgtagtgcggcaccc

SEQ ID NO: 75980 - DNA, 25 bp, E. coli
tacaccgctgtgaagtgcggcaccc

SEQ ID NO: 75981 - DNA, 25 bp, E. coli
atctaacgcccgtgccggttgcctg

SEQ ID NO: 75982 - DNA, 25 bp, E. coli
atctaacgcccatgccggttgcctg

SEQ ID NO: 75983 - DNA, 25 bp, E. coli
acgtccgagccgcttgcctgatgcg

SEQ ID NO: 75984 - DNA, 25 bp, E. coli
acgtccgagccggttgcctgatgcg

SEQ ID NO: 75985 - DNA, 25 bp, E. coli
atctaacgcccgagccggttgcctg

SEQ ID NO: 75986 - DNA, 25 bp, E. coli
aggcctacaccgctgtgaagtgctc

SEQ ID NO: 75987 - DNA, 25 bp, E. coli
atctaacgcccaagccggttgcctg

SEQ ID NO: 75988 - DNA, 25 bp, E. coli
aggcctacaccggtgtgaagtgctc

SEQ ID NO: 75989 - DNA, 25 bp, E. coli
actgccgtgaagagcggcaccccgt

SEQ ID NO: 75990 - DNA, 25 bp, E. coli
actgccgtgaagtgcggcaccccgt

SEQ ID NO: 75991 - DNA, 25 bp, E. coli
tgaagtgctccagcccgtaggttgg

SEQ ID NO: 75992 - DNA, 25 bp, E. coli
tgaagtgctccaccccgtaggttgg

SEQ ID NO: 75993 - DNA, 25 bp, E. coli
cccgtaggtcagtcaaggcggtcac

SEQ ID NO: 75994 - DNA, 25 bp, E. coli
cccgtaggtcagacaaggcggtcac

SEQ ID NO: 75995 - DNA, 25 bp, E. coli
gtcttatcagcaaacgccacatccg

SEQ ID NO: 75996 - DNA, 25 bp, E. coli
gtcttatcagcatacgccacatccg

SEQ ID NO: 75997 - DNA, 25 bp, E. coli
ggttacgccgcatccaacatctaac

SEQ ID NO: 75998 - DNA, 25 bp, E. coli
ggttacgccgcaaccaacatctaac

SEQ ID NO: 75999 - DNA, 25 bp, E. coli
tgtgaagtgctcgaccccgtaggtc

SEQ ID NO: 76000 - DNA, 25 bp, E. coli
tgtgaagtgctccaccccgtaggtc

SEQ ID NO: 76001 - DNA, 25 bp, E. coli
aaaggcgttagattccaccctacag

SEQ ID NO: 76002 - DNA, 25 bp, E. coli
aaaggcgttagaatccaccctacag

SEQ ID NO: 76003 - DNA, 25 bp, E. coli
taccgtggattattagagaaaagat

SEQ ID NO: 76004 - DNA, 25 bp, E. coli
taccgtggattaatagagaaaagat

SEQ ID NO: 76005 - DNA, 25 bp, E. coli
tataaatccatcgatatcgaatcgc

SEQ ID NO: 76006 - DNA, 25 bp, E. coli
tataaatccatccatatcgaatcgc

SEQ ID NO: 76007 - DNA, 25 bp, E. coli
tgagaaaagtgttttggtaagagcc

SEQ ID NO: 76008 - DNA, 25 bp, E. coli
tgtattggtaagtgccgggacaacc

SEQ ID NO: 76009 - DNA, 25 bp, E. coli
tgagaaaagtgtattggtaagagcc

SEQ ID NO: 76010 - DNA, 25 bp, E. coli
tgtattggtaagagccgggacaacc

SEQ ID NO: 76011 - DNA, 25 bp, E. coli
tccaccctacagtaaaaggatatgt

SEQ ID NO: 76012 - DNA, 25 bp, E. coli
tcgccaatacagattttaccgtgga

SEQ ID NO: 76013 - DNA, 25 bp, E. coli
tccaccctacagaaaaaggatatgt

SEQ ID NO: 76014 - DNA, 25 bp, E. coli
tcgccaatacagtttttaccgtgga

SEQ ID NO: 76015 - DNA, 25 bp, E. coli
taaagtggtttgctaaaaacgacat

SEQ ID NO: 76016 - DNA, 25 bp, E. coli
taaagtggtttggtaaaaacgacat

SEQ ID NO: 76017 - DNA, 25 bp, E. coli
cgaatcgctattcaatgcgtgagaa

SEQ ID NO: 76018 - DNA, 25 bp, E. coli
cgaatcgctattgaatgcgtgagaa

SEQ ID NO: 76019 - DNA, 25 bp, E. coli
gggacaacctcggtataaaaaggcg

SEQ ID NO: 76020 - DNA, 25 bp, E. coli
gggacaacctcgctataaaaaggcg

SEQ ID NO: 76021 - DNA, 25 bp, E. coli
taatgcaaaggaattaatatcgcca

SEQ ID NO: 76022 - DNA, 25 bp, E. coli
taatgcaaaggatttaatatcgcca

SEQ ID NO: 76023 - DNA, 25 bp, E. coli
tcgctccgcaagctaaacaggtaat

SEQ ID NO: 76024 - DNA, 25 bp, E. coli
tccacgcatggcagcatcagggaaa

SEQ ID NO: 76025 - DNA, 25 bp, E. coli
tcgctccgcaaggtaaacaggtaat

SEQ ID NO: 76026 - DNA, 25 bp, E. coli
tccacgcatggctgcatcagggaaa

SEQ ID NO: 76027 - DNA, 25 bp, E. coli
cctgaatggtgactggcaatttgtc

SEQ ID NO: 76028 - DNA, 25 bp, E. coli
cctgaatggtgagtggcaatttgtc

SEQ ID NO: 76029 - DNA, 25 bp, E. coli
gctgattaccacagtccacgcatgg

SEQ ID NO: 76030 - DNA, 25 bp, E. coli
gctgattaccactgtccacgcatgg

SEQ ID NO: 76031 - DNA, 25 bp, E. coli
gacacctccgcatccgatattattt

SEQ ID NO: 76032 - DNA, 25 bp, E. coli
gacacctccgcaaccgatattattt

SEQ ID NO: 76033 - DNA, 25 bp, E. coli
cgacgcactctatcgctggattaaa

SEQ ID NO: 76034 - DNA, 25 bp, E. coli
cgacgcactctaacgctggattaaa

SEQ ID NO: 76035 - DNA, 25 bp, E. coli
ctgaactaccgccactggagagcac

SEQ ID NO: 76036 - DNA, 25 bp, E. coli
ctgaactaccgcgactggagagcac

SEQ ID NO: 76037 - DNA, 25 bp, E. coli
gttaccggccatcagcgaacgagta

SEQ ID NO: 76038 - DNA, 25 bp, E. coli
gttaccggccatgagcgaacgagta

SEQ ID NO: 76039 - DNA, 25 bp, E. coli
tggcaatttgtcaggtttccggcac

SEQ ID NO: 76040 - DNA, 25 bp, E. coli
tggcaatttgtctggtttccggcac

SEQ ID NO: 76041 - DNA, 25 bp, E. coli
taattgaattgcgtgaactaccgcg

SEQ ID NO: 76042 - DNA, 25 bp, E. coli
taattgaattgcctgaactaccgcg

SEQ ID NO: 76043 - DNA, 25 bp, E. coli
gagtaacacgaatggtacagcgcga

SEQ ID NO: 76044 - DNA, 25 bp, E. coli
gagtaacacgaaaggtacagcgcga

SEQ ID NO: 76045 - DNA, 25 bp, E. coli
caaaggctgaaagtggcagatgtca

SEQ ID NO: 76046 - DNA, 25 bp, E. coli
caaaggctgaaactggcagatgtca

SEQ ID NO: 76047 - DNA, 25 bp, E. coli
acgtctcgcaaaggctgaaactggc

SEQ ID NO: 76048 - DNA, 25 bp, E. coli
acgtctcgcaaacgctgaaactggc

SEQ ID NO: 76049 - DNA, 25 bp, E. coli
tgcgtacacgattccgtgcccaatg

SEQ ID NO: 76050 - DNA, 25 bp, E. coli
tgcgtacacgataccgtgcccaatg

SEQ ID NO: 76051 - DNA, 25 bp, E. coli
tgcccaatgtatgcgttgcaacgca

SEQ ID NO: 76052 - DNA, 25 bp, E. coli
tgcccaatgtatccgttgcaacgca

SEQ ID NO: 76053 - DNA, 25 bp, E. coli
tctgaaaacgtctcgcaaaggctga

SEQ ID NO: 76054 - DNA, 25 bp, E. coli
tctgaaaacgtcacgcaaaggctga

SEQ ID NO: 76055 - DNA, 25 bp, E. coli
gaaactggcagaagtcaaaggcctg

SEQ ID NO: 76056 - DNA, 25 bp, E. coli
gaaaattcctctcaaaacgtctcgc

SEQ ID NO: 76057 - DNA, 25 bp, E. coli
gaaactggcagatgtcaaaggcctg

SEQ ID NO: 76058 - DNA, 25 bp, E. coli
gaaaattcctctgaaaacgtctcgc

SEQ ID NO: 76059 - DNA, 25 bp, E. coli
cgttgcaacgcactgaaaattcctc

SEQ ID NO: 76060 - DNA, 25 bp, E. coli
cgttgcaacgcagtgaaaattcctc

SEQ ID NO: 76061 - DNA, 25 bp, E. coli
gattccgtgccctatgtatgcgttg

SEQ ID NO: 76062 - DNA, 25 bp, E. coli
gattccgtgcccaatgtatgcgttg

SEQ ID NO: 76063 - DNA, 25 bp, E. coli
gggcatttttgcctacacgattccg

SEQ ID NO: 76064 - DNA, 25 bp, E. coli
gggcatttttgcgtacacgattccg

SEQ ID NO: 76065 - DNA, 25 bp, E. coli
ggcagatgtcaatggcctgggataa

SEQ ID NO: 76066 - DNA, 25 bp, E. coli
ggcagatgtcaaaggcctgggataa

SEQ ID NO: 76067 - DNA, 25 bp, E. coli
catttatcattacgcttgcggggat

SEQ ID NO: 76068 - DNA, 25 bp, E. coli
agtcgattccgaaaaaccatcccat

SEQ ID NO: 76069 - DNA, 25 bp, E. coli
agtcgattccgataaaccatcccat

SEQ ID NO: 76070 - DNA, 25 bp, E. coli
tacgcttgcggggatgttctttttg

SEQ ID NO: 76071 - DNA, 25 bp, E. coli
tacgcttgcgggcatgttctttttg

SEQ ID NO: 76072 - DNA, 25 bp, E. coli
tatcattacgctagcggggatgttc

SEQ ID NO: 76073 - DNA, 25 bp, E. coli
tatcattacgcttgcggggatgttc

SEQ ID NO: 76074 - DNA, 25 bp, E. coli
ttccgataaaccttcccatttatga

SEQ ID NO: 76075 - DNA, 25 bp, E. coli
ttccgataaaccatcccatttatga

SEQ ID NO: 76076 - DNA, 25 bp, E. coli
tcgattccgataaaccatcccattt

SEQ ID NO: 76077 - DNA, 25 bp, E. coli
tcgattccgatataccatcccattt

SEQ ID NO: 76078 - DNA, 25 bp, E. coli
gcttgcggggatgttctttttgcgc

SEQ ID NO: 76079 - DNA, 25 bp, E. coli
gcttgcggggatcttctttttgcgc

SEQ ID NO: 76080 - DNA, 25 bp, E. coli
cgattccgataatccatcccattta

SEQ ID NO: 76081 - DNA, 25 bp, E. coli
cgattccgataaaccatcccattta

SEQ ID NO: 76082 - DNA, 25 bp, E. coli
catttatcattaggcttgcggggat

SEQ ID NO: 76083 - DNA, 25 bp, E. coli
gattccgataaaccatcccatttat

SEQ ID NO: 76084 - DNA, 25 bp, E. coli
gattccgataaagcatcccatttat

SEQ ID NO: 76085 - DNA, 25 bp, E. coli
gtcgattccgataaaccatcccatt

SEQ ID NO: 76086 - DNA, 25 bp, E. coli
gtcgattccgattaaccatcccatt

SEQ ID NO: 76087 - DNA, 25 bp, E. coli
ggcatttatcataacgcttgcgggg

SEQ ID NO: 76088 - DNA, 25 bp, E. coli
ggcatttatcattacgcttgcgggg

SEQ ID NO: 76089 - DNA, 25 bp, E. coli
taacgatatctaatacgccgaagcg

SEQ ID NO: 76090 - DNA, 25 bp, E. coli
tacgccgaagcggacgagaaaatga

SEQ ID NO: 76091 - DNA, 25 bp, E. coli
tacgccgaagcgcacgagaaaatga

SEQ ID NO: 76092 - DNA, 25 bp, E. coli
tttttgcagcataaccgcgtcgacg

SEQ ID NO: 76093 - DNA, 25 bp, E. coli
tttttgcagcattaccgcgtcgacg

SEQ ID NO: 76094 - DNA, 25 bp, E. coli
tgaagacgaattcctggcacaacag

SEQ ID NO: 76095 - DNA, 25 bp, E. coli
tgaagacgaattgctggcacaacag

SEQ ID NO: 76096 - DNA, 25 bp, E. coli
tcatcaccgcgtggaaagaacatgc

SEQ ID NO: 76097 - DNA, 25 bp, E. coli
tcatcaccgcgtcgaaagaacatgc

SEQ ID NO: 76098 - DNA, 25 bp, E. coli
ccagatggagattgtcggcaccttt

SEQ ID NO: 76099 - DNA, 25 bp, E. coli
ccagatggagatagtcggcaccttt

SEQ ID NO: 76100 - DNA, 25 bp, E. coli
gcgtgaatcctacgtaatgccgatg

SEQ ID NO: 76101 - DNA, 25 bp, E. coli
gcacctttgacgtcggtctggacgt

SEQ ID NO: 76102 - DNA, 25 bp, E. coli
gcacctttgacgacggtctggacgt

SEQ ID NO: 76103 - DNA, 25 bp, E. coli
gcgtgaatcctaggtaatgccgatg

SEQ ID NO: 76104 - DNA, 25 bp, E. coli
cggtaacgcgtgtgaatgacaccat

SEQ ID NO: 76105 - DNA, 25 bp, E. coli
cggtaacgcgtgagaatgacaccat

SEQ ID NO: 76106 - DNA, 25 bp, E. coli
ggattttgaagtcccggtcagccgc

SEQ ID NO: 76107 - DNA, 25 bp, E. coli
ggattttgaagtgccggtcagccgc

SEQ ID NO: 76108 - DNA, 25 bp, E. coli
taattaaagagcacagccagatgga

SEQ ID NO: 76109 - DNA, 25 bp, E. coli
taacgatatctattacgccgaagcg

SEQ ID NO: 76110 - DNA, 25 bp, E. coli
taattaaagagctcagccagatgga

SEQ ID NO: 76111 - DNA, 25 bp, E. coli
caatacggtcagtctgtcatgcagt

SEQ ID NO: 76112 - DNA, 25 bp, E. coli
caatacggtcagactgtcatgcagt

SEQ ID NO: 76113 - DNA, 25 bp, E. coli
tgcaatgtagcctgtctgtcaagac

SEQ ID NO: 76114 - DNA, 25 bp, E. coli
tgcaatgtagccagtctgtcaagac

SEQ ID NO: 76115 - DNA, 25 bp, E. coli
tgcggtctgcggttttaagtgcacc

SEQ ID NO: 76116 - DNA, 25 bp, E. coli
tgcggtctgcggatttaagtgcacc

SEQ ID NO: 76117 - DNA, 25 bp, E. coli
tcatgcagtaacacccgcaatgcgg

SEQ ID NO: 76118 - DNA, 25 bp, E. coli
tcttttccgggagagaggctgtcag

SEQ ID NO: 76119 - DNA, 25 bp, E. coli
tcatgcagtaactcccgcaatgcgg

SEQ ID NO: 76120 - DNA, 25 bp, E. coli
tcttttccgggacagaggctgtcag

SEQ ID NO: 76121 - DNA, 25 bp, E. coli
gctgtcagatgagcgagccggattt

SEQ ID NO: 76122 - DNA, 25 bp, E. coli
gctgtcagatgaccgagccggattt

SEQ ID NO: 76123 - DNA, 25 bp, E. coli
cgtcaggtactggaggaagttcccc

SEQ ID NO: 76124 - DNA, 25 bp, E. coli
cgtcaggtactgcaggaagttcccc

SEQ ID NO: 76125 - DNA, 25 bp, E. coli
ctctgctgttgaggagacgatctca

SEQ ID NO: 76126 - DNA, 25 bp, E. coli
ctctgctgttgacgagacgatctca

SEQ ID NO: 76127 - DNA, 25 bp, E. coli
gatttactgtcacaggtacaccccg

SEQ ID NO: 76128 - DNA, 25 bp, E. coli
gatttactgtcagaggtacaccccg

SEQ ID NO: 76129 - DNA, 25 bp, E. coli
taagtgcaccgaaaatgcgtcatag

SEQ ID NO: 76130 - DNA, 25 bp, E. coli
taagtgcaccgataatgcgtcatag

SEQ ID NO: 76131 - DNA, 25 bp, E. coli
taatactatttgaagcgtcaggtac

SEQ ID NO: 76132 - DNA, 25 bp, E. coli
taatactatttgtagcgtcaggtac

SEQ ID NO: 76133 - DNA, 25 bp, E. coli
taaatcggtaatcgcgatcgcctac

SEQ ID NO: 76134 - DNA, 25 bp, E. coli
taaatcggtaatggcgatcgcctac

SEQ ID NO: 76135 - DNA, 25 bp, E. coli
tatatgcgtgctttcagcgcggcag

SEQ ID NO: 76136 - DNA, 25 bp, E. coli
tatatgcgtgctatcagcgcggcag

SEQ ID NO: 76137 - DNA, 25 bp, E. coli
tgttgcgaacaatgacaccttcccg

SEQ ID NO: 76138 - DNA, 25 bp, E. coli
tgttgcgaacaaagacaccttcccg

SEQ ID NO: 76139 - DNA, 25 bp, E. coli
tgcgggtctgctgctacataaaacg

SEQ ID NO: 76140 - DNA, 25 bp, E. coli
tcccggtgggcgatactctgttcag

SEQ ID NO: 76141 - DNA, 25 bp, E. coli
tgcgggtctgctcctacataaaacg

SEQ ID NO: 76142 - DNA, 25 bp, E. coli
tcccggtgggcgttactctgttcag

SEQ ID NO: 76143 - DNA, 25 bp, E. coli
gcgctgggcgctgatctcggtaaat

SEQ ID NO: 76144 - DNA, 25 bp, E. coli
gcgctgggcgctcatctcggtaaat

SEQ ID NO: 76145 - DNA, 25 bp, E. coli
gaaaagtttgctgcgtactgccgcc

SEQ ID NO: 76146 - DNA, 25 bp, E. coli
gaaaagtttgctccgtactgccgcc

SEQ ID NO: 76147 - DNA, 25 bp, E. coli
cgcctacggcgaccaatggatgaac

SEQ ID NO: 76148 - DNA, 25 bp, E. coli
cgcctacggcgagcaatggatgaac

SEQ ID NO: 76149 - DNA, 25 bp, E. coli
gattatccgttggtcattgcctgcg

SEQ ID NO: 76150 - DNA, 25 bp, E. coli
gattatccgttgctcattgcctgcg

SEQ ID NO: 76151 - DNA, 25 bp, E. coli
ggttaacaccactaacgccgatcag

SEQ ID NO: 76152 - DNA, 25 bp, E. coli
ggttaacaccacaaacgccgatcag

SEQ ID NO: 76153 - DNA, 25 bp, E. coli
gatgatgccaaaaccgtctgacgtg

SEQ ID NO: 76154 - DNA, 25 bp, E. coli
gatgatgccaaatccgtctgacgtg

SEQ ID NO: 76155 - DNA, 25 bp, E. coli
taaaggctgccaacttgacgcacag

SEQ ID NO: 76156 - DNA, 25 bp, E. coli
tacaacatgcggatgcggtgaaggc

SEQ ID NO: 76157 - DNA, 25 bp, E. coli
tacaacatgcggttgcggtgaaggc

SEQ ID NO: 76158 - DNA, 25 bp, E. coli
taaaggctgccatcttgacgcacag

SEQ ID NO: 76159 - DNA, 25 bp, E. coli
aaataaccgtctcgctgaacgcaac

SEQ ID NO: 76160 - DNA, 25 bp, E. coli
aaataaccgtctggctgaacgcaac

SEQ ID NO: 76161 - DNA, 25 bp, E. coli
ttgacgtgctggacaaaaataaccg

SEQ ID NO: 76162 - DNA, 25 bp, E. coli
ttgacgtgctggtcaaaaataaccg

SEQ ID NO: 76163 - DNA, 25 bp, E. coli
tgacgcacagatcattgccgacgcc

SEQ ID NO: 76164 - DNA, 25 bp, E. coli
tgacgcacagatgattgccgacgcc

SEQ ID NO: 76165 - DNA, 25 bp, E. coli
tctcggtgaaaatcacaaagtggcg

SEQ ID NO: 76166 - DNA, 25 bp, E. coli
tctcggtgaaaaacacaaagtggcg

SEQ ID NO: 76167 - DNA, 25 bp, E. coli
gccagactgaagtaggcgacctgca

SEQ ID NO: 76168 - DNA, 25 bp, E. coli
gccagactgaagaaggcgacctgca

SEQ ID NO: 76169 - DNA, 25 bp, E. coli
gcggcacgcccgaagatgaaaatca

SEQ ID NO: 76170 - DNA, 25 bp, E. coli
gcggcacgcccgtagatgaaaatca

SEQ ID NO: 76171 - DNA, 25 bp, E. coli
gaccagcaaaccgtgaacgatgccg

SEQ ID NO: 76172 - DNA, 25 bp, E. coli
cattacggtcatcgcgaagcgggca

SEQ ID NO: 76173 - DNA, 25 bp, E. coli
cattacggtcatggcgaagcgggca

SEQ ID NO: 76174 - DNA, 25 bp, E. coli
taatgcgcctgatagacagcgttcc

SEQ ID NO: 76175 - DNA, 25 bp, E. coli
taatgcgcctgaaagacagcgttcc

SEQ ID NO: 76176 - DNA, 25 bp, E. coli
gaccagcaaaccctgaacgatgccg

SEQ ID NO: 76177 - DNA, 25 bp, E. coli
cacagcgcgtagaggatattagccg

SEQ ID NO: 76178 - DNA, 25 bp, E. coli
cacagcgcgtagtggatattagccg

SEQ ID NO: 76179 - DNA, 25 bp, E. coli
cagacgtctggcaatatctatggca

SEQ ID NO: 76180 - DNA, 25 bp, E. coli
cagacgtctggctatatctatggca

SEQ ID NO: 76181 - DNA, 25 bp, E. coli
taactctgccatttgttgatgctga

SEQ ID NO: 76182 - DNA, 25 bp, E. coli
agtatccggcgaatatcagcgtcca

SEQ ID NO: 76183 - DNA, 25 bp, E. coli
agtatccggcgattatcagcgtcca

SEQ ID NO: 76184 - DNA, 25 bp, E. coli
tatgacgccagtttccagggagaat

SEQ ID NO: 76185 - DNA, 25 bp, E. coli
tatgacgccagtatccagggagaat

SEQ ID NO: 76186 - DNA, 25 bp, E. coli
tgatgagtcaaaacagtatccggcg

SEQ ID NO: 76187 - DNA, 25 bp, E. coli
tgaaaaaggctatgtcgttctcgct

SEQ ID NO: 76188 - DNA, 25 bp, E. coli
tgaaaaaggctaagtcgttctcgct

SEQ ID NO: 76189 - DNA, 25 bp, E. coli
tgatgagtcaaatcagtatccggcg

SEQ ID NO: 76190 - DNA, 25 bp, E. coli
tggcagttgtaacgagcagacgtct

SEQ ID NO: 76191 - DNA, 25 bp, E. coli
tggatagaagatccgacacagcgcg

SEQ ID NO: 76192 - DNA, 25 bp, E. coli
tggatagaagatgcgacacagcgcg

SEQ ID NO: 76193 - DNA, 25 bp, E. coli
tggcaaggcattggctgaaaaaggc

SEQ ID NO: 76194 - DNA, 25 bp, E. coli
tggcaaggcattcgctgaaaaaggc

SEQ ID NO: 76195 - DNA, 25 bp, E. coli
tggcagttgtaaggagcagacgtct

SEQ ID NO: 76196 - DNA, 25 bp, E. coli
taactctgccatatgttgatgctga

SEQ ID NO: 76197 - DNA, 25 bp, E. coli
tcagcgtccatccttttggcagttg

SEQ ID NO: 76198 - DNA, 25 bp, E. coli
tcagcgtccatcgttttggcagttg

SEQ ID NO: 76199 - DNA, 25 bp, E. coli
caaaacttctttcaggcgggcgcaa

SEQ ID NO: 76200 - DNA, 25 bp, E. coli
caaaacttctttgaggcgggcgcaa

SEQ ID NO: 76201 - DNA, 25 bp, E. coli
catcggctgaaaaaacgggcggctg

SEQ ID NO: 76202 - DNA, 25 bp, E. coli
catcggctgaaataacgggcggctg

SEQ ID NO: 76203 - DNA, 25 bp, E. coli
taactgggatttagtcgccgcgctg

SEQ ID NO: 76204 - DNA, 25 bp, E. coli
tatgaatccgaacgcgaactgcgct

SEQ ID NO: 76205 - DNA, 25 bp, E. coli
tatgaatccgaaggcgaactgcgct

SEQ ID NO: 76206 - DNA, 25 bp, E. coli
ttgcaggtgcgcgaaaaactggccc

SEQ ID NO: 76207 - DNA, 25 bp, E. coli
ttgcaggtgcgccaaaaactggccc

SEQ ID NO: 76208 - DNA, 25 bp, E. coli
tgcaccttgctaaaccgaatgaccg

SEQ ID NO: 76209 - DNA, 25 bp, E. coli
tgcaccttgctataccgaatgaccg

SEQ ID NO: 76210 - DNA, 25 bp, E. coli
tcaggtactcaagcccgaagtctgg

SEQ ID NO: 76211 - DNA, 25 bp, E. coli
tcaggtactcaaccccgaagtctgg

SEQ ID NO: 76212 - DNA, 25 bp, E. coli
gacttcttccagcaaggcggcgata

SEQ ID NO: 76213 - DNA, 25 bp, E. coli
gacttcttccaggaaggcggcgata

SEQ ID NO: 76214 - DNA, 25 bp, E. coli
cgtcgctgaatcaggtgcaactgca

SEQ ID NO: 76215 - DNA, 25 bp, E. coli
cgtcgctgaatctggtgcaactgca

SEQ ID NO: 76216 - DNA, 25 bp, E. coli
cgtaatctgctctaaccggtctggg

SEQ ID NO: 76217 - DNA, 25 bp, E. coli
cgtaatctgctcaaaccggtctggg

SEQ ID NO: 76218 - DNA, 25 bp, E. coli
taacctgttactagacgggctgagc

SEQ ID NO: 76219 - DNA, 25 bp, E. coli
taacctgttacttgacgggctgagc

SEQ ID NO: 76220 - DNA, 25 bp, E. coli
taactgggattttgtcgccgcgctg

SEQ ID NO: 76221 - DNA, 25 bp, E. coli
cagtattcatcaccatttcccgagg

SEQ ID NO: 76222 - DNA, 25 bp, E. coli
cagtattcatcagcatttcccgagg

SEQ ID NO: 76223 - DNA, 25 bp, E. coli
taaagatattatcacctccgggcag

SEQ ID NO: 76224 - DNA, 25 bp, E. coli
taaagatattatgacctccgggcag

SEQ ID NO: 76225 - DNA, 25 bp, E. coli
tacaggaggctgtaagtcaactggc

SEQ ID NO: 76226 - DNA, 25 bp, E. coli
tacaggaggctgaaagtcaactggc

SEQ ID NO: 76227 - DNA, 25 bp, E. coli
tatttatgccatgctatccgacagc

SEQ ID NO: 76228 - DNA, 25 bp, E. coli
tatttatgccatcctatccgacagc

SEQ ID NO: 76229 - DNA, 25 bp, E. coli
tatacttcgcataacggatactctg

SEQ ID NO: 76230 - DNA, 25 bp, E. coli
tatacttcgcattacggatactctg

SEQ ID NO: 76231 - DNA, 25 bp, E. coli
tttcccgaggaaaactgatcttggt

SEQ ID NO: 76232 - DNA, 25 bp, E. coli
tttcccgaggaatactgatcttggt

SEQ ID NO: 76233 - DNA, 25 bp, E. coli
tcttcttccggatgagctcgccgtt

SEQ ID NO: 76234 - DNA, 25 bp, E. coli
tcttcttccggaagagctcgccgtt

SEQ ID NO: 76235 - DNA, 25 bp, E. coli
tctggtgtacaacgtctcaggacat

SEQ ID NO: 76236 - DNA, 25 bp, E. coli
tctggtgtacaaggtctcaggacat

SEQ ID NO: 76237 - DNA, 25 bp, E. coli
gatactctgatcgagcaacgcggat

SEQ ID NO: 76238 - DNA, 25 bp, E. coli
gatactctgatccagcaacgcggat

SEQ ID NO: 76239 - DNA, 25 bp, E. coli
tcaactggcacaacaggagatacag

SEQ ID NO: 76240 - DNA, 25 bp, E. coli
tcaactggcacatcaggagatacag

SEQ ID NO: 76241 - DNA, 25 bp, E. coli
gatacctattcacgaaccgttaacg

SEQ ID NO: 76242 - DNA, 25 bp, E. coli
gatacctattcaggaaccgttaacg

SEQ ID NO: 76243 - DNA, 25 bp, E. coli
aatatactgagctacagcggcgctg

SEQ ID NO: 76244 - DNA, 25 bp, E. coli
aatatactgagcaacagcggcgctg

SEQ ID NO: 76245 - DNA, 25 bp, E. coli
taaaacgttgctcgacttggcgcgg

SEQ ID NO: 76246 - DNA, 25 bp, E. coli
taaaactggagaactggtgtggcgc

SEQ ID NO: 76247 - DNA, 25 bp, E. coli
taaaactggagatctggtgtggcgc

SEQ ID NO: 76248 - DNA, 25 bp, E. coli
taaaacgttgctggacttggcgcgg

SEQ ID NO: 76249 - DNA, 25 bp, E. coli
tacaggcgatgatcaaccagcgtgc

SEQ ID NO: 76250 - DNA, 25 bp, E. coli
tacaggcgatgaacaaccagcgtgc

SEQ ID NO: 76251 - DNA, 25 bp, E. coli
tataacggtgaaacgctgacgccag

SEQ ID NO: 76252 - DNA, 25 bp, E. coli
tataacggtgaatcgctgacgccag

SEQ ID NO: 76253 - DNA, 25 bp, E. coli
ttagagtatgaggagatagcgccgc

SEQ ID NO: 76254 - DNA, 25 bp, E. coli
ttagagtatgagcagatagcgccgc

SEQ ID NO: 76255 - DNA, 25 bp, E. coli
ttgaaggagaactggatcgcacgcg

SEQ ID NO: 76256 - DNA, 25 bp, E. coli
ttgaaggagaacaggatcgcacgcg

SEQ ID NO: 76257 - DNA, 25 bp, E. coli
tggtttatgcaagaattggcgccgc

SEQ ID NO: 76258 - DNA, 25 bp, E. coli
gactatttgtatggtatcgccggag

SEQ ID NO: 76259 - DNA, 25 bp, E. coli
gactatttgtatcgtatcgccggag

SEQ ID NO: 76260 - DNA, 25 bp, E. coli
gttactggcaaaataccctggcggg

SEQ ID NO: 76261 - DNA, 25 bp, E. coli
gttactggcaaattaccctggcggg

SEQ ID NO: 76262 - DNA, 25 bp, E. coli
tggtttatgcaacaattggcgccgc

SEQ ID NO: 76263 - DNA, 25 bp, E. coli
taatcgtttggtaccgccaggtgcc

SEQ ID NO: 76264 - DNA, 25 bp, E. coli
taatcgtttggttccgccaggtgcc

SEQ ID NO: 76265 - DNA, 25 bp, E. coli
agctaatatggtccaggcttttact

SEQ ID NO: 76266 - DNA, 25 bp, E. coli
agctaatatggtgcaggcttttact

SEQ ID NO: 76267 - DNA, 25 bp, E. coli
tttactgttcgtgcaaaagaggtct

SEQ ID NO: 76268 - DNA, 25 bp, E. coli
tttactgttcgtccaaaagaggtct

SEQ ID NO: 76269 - DNA, 25 bp, E. coli
tgatcggcggttggaagtttacgcc

SEQ ID NO: 76270 - DNA, 25 bp, E. coli
tgatcggcggttcgaagtttacgcc

SEQ ID NO: 76271 - DNA, 25 bp, E. coli
tctcatgagtctggttgatggaccg

SEQ ID NO: 76272 - DNA, 25 bp, E. coli
tctcatgagtctcgttgatggaccg

SEQ ID NO: 76273 - DNA, 25 bp, E. coli
ccagtaatcaaagtattctcatgag

SEQ ID NO: 76274 - DNA, 25 bp, E. coli
gccaggacgcgtgccgtattgagtt

SEQ ID NO: 76275 - DNA, 25 bp, E. coli
ccagtaatcaaactattctcatgag

SEQ ID NO: 76276 - DNA, 25 bp, E. coli
gccaggacgcgtcccgtattgagtt

SEQ ID NO: 76277 - DNA, 25 bp, E. coli
gcaggcttttactgttcgtgcaaaa

SEQ ID NO: 76278 - DNA, 25 bp, E. coli
gcaggcttttacagttcgtgcaaaa

SEQ ID NO: 76279 - DNA, 25 bp, E. coli
cgtttaagaaattgatcggcggttg

SEQ ID NO: 76280 - DNA, 25 bp, E. coli
cgtttaagaaatagatcggcggttg

SEQ ID NO: 76281 - DNA, 25 bp, E. coli
gacgcgtgccgttttgagtttcatc

SEQ ID NO: 76282 - DNA, 25 bp, E. coli
gagtctggttgaaggaccgtttaag

SEQ ID NO: 76283 - DNA, 25 bp, E. coli
gagtctggttgatggaccgtttaag

SEQ ID NO: 76284 - DNA, 25 bp, E. coli
gacgcgtgccgtattgagtttcatc

SEQ ID NO: 76285 - DNA, 25 bp, E. coli
gatggaccgtttaagaaattgatcg

SEQ ID NO: 76286 - DNA, 25 bp, E. coli
gatggaccgttttagaaattgatcg

SEQ ID NO: 76287 - DNA, 25 bp, E. coli
catattactctagcattagaggaac

SEQ ID NO: 76288 - DNA, 25 bp, E. coli
catattactctaccattagaggaac

SEQ ID NO: 76289 - DNA, 25 bp, E. coli
tattggataaaactaggacatctgt

SEQ ID NO: 76290 - DNA, 25 bp, E. coli
tattggataaaagtaggacatctgt

SEQ ID NO: 76291 - DNA, 25 bp, E. coli
tattacattagcagaagagttttcg

SEQ ID NO: 76292 - DNA, 25 bp, E. coli
tattacattagctgaagagttttcg

SEQ ID NO: 76293 - DNA, 25 bp, E. coli
tcgcaaagtcgatactcgcagtcaa

SEQ ID NO: 76294 - DNA, 25 bp, E. coli
tcgcaaagtcgaaactcgcagtcaa

SEQ ID NO: 76295 - DNA, 25 bp, E. coli
gcctctccagaccacatcgataatt

SEQ ID NO: 76296 - DNA, 25 bp, E. coli
gcctctccagacgacatcgataatt

SEQ ID NO: 76297 - DNA, 25 bp, E. coli
gctaatcattagtttcgtatgagcg

SEQ ID NO: 76298 - DNA, 25 bp, E. coli
gctaatcattagattcgtatgagcg

SEQ ID NO: 76299 - DNA, 25 bp, E. coli
gaagagttttcggatcattatgata

SEQ ID NO: 76300 - DNA, 25 bp, E. coli
gaagagttttcgcatcattatgata

SEQ ID NO: 76301 - DNA, 25 bp, E. coli
gatatctgttacttttcactccata

SEQ ID NO: 76302 - DNA, 25 bp, E. coli
gatttttgacagttgcctctccaga

SEQ ID NO: 76303 - DNA, 25 bp, E. coli
gatttttgacagatgcctctccaga

SEQ ID NO: 76304 - DNA, 25 bp, E. coli
gatactcgcagtgaacaagcaaatg

SEQ ID NO: 76305 - DNA, 25 bp, E. coli
gatatctgttacatttcactccata

SEQ ID NO: 76306 - DNA, 25 bp, E. coli
gatactcgcagtcaacaagcaaatg

SEQ ID NO: 76307 - DNA, 25 bp, E. coli
ggacatctgtttccaattactttca

SEQ ID NO: 76308 - DNA, 25 bp, E. coli
ggacatctgtttgcaattactttca

SEQ ID NO: 76309 - DNA, 25 bp, E. coli
aagcggaagcgaatctgaccgcgca

SEQ ID NO: 76310 - DNA, 25 bp, E. coli
aagcggaagcgattctgaccgcgca

SEQ ID NO: 76311 - DNA, 25 bp, E. coli
tacgggaattcagtgttagtggccg

SEQ ID NO: 76312 - DNA, 25 bp, E. coli
tacgggaattcactgttagtggccg

SEQ ID NO: 76313 - DNA, 25 bp, E. coli
agcggaagcgatactgaccgcgcag

SEQ ID NO: 76314 - DNA, 25 bp, E. coli
agaagcggaagcgattctgaccgcg

SEQ ID NO: 76315 - DNA, 25 bp, E. coli
agcggaagcgattctgaccgcgcag

SEQ ID NO: 76316 - DNA, 25 bp, E. coli
agaagcggaagccattctgaccgcg

SEQ ID NO: 76317 - DNA, 25 bp, E. coli
ttcactgttagtcgccgaagaagcg

SEQ ID NO: 76318 - DNA, 25 bp, E. coli
ttcactgttagtggccgaagaagcg

SEQ ID NO: 76319 - DNA, 25 bp, E. coli
gccgaagaagcgcaagcgattctga

SEQ ID NO: 76320 - DNA, 25 bp, E. coli
gccgaagaagcggaagcgattctga

SEQ ID NO: 76321 - DNA, 25 bp, E. coli
gaattcactgtttgtggccgaagaa

SEQ ID NO: 76322 - DNA, 25 bp, E. coli
gaattcactgttagtggccgaagaa

SEQ ID NO: 76323 - DNA, 25 bp, E. coli
cgaagaagcggaagcgattctgacc

SEQ ID NO: 76324 - DNA, 25 bp, E. coli
cgaagaagcggatgcgattctgacc

SEQ ID NO: 76325 - DNA, 25 bp, E. coli
cgggaattcactgttagtggccgaa

SEQ ID NO: 76326 - DNA, 25 bp, E. coli
cgggaattcactcttagtggccgaa

SEQ ID NO: 76327 - DNA, 25 bp, E. coli
ggaattcactgttagtggccgaaga

SEQ ID NO: 76328 - DNA, 25 bp, E. coli
ggaagcgattctcaccgcgcagggc

SEQ ID NO: 76329 - DNA, 25 bp, E. coli
ggaagcgattctgaccgcgcagggc

SEQ ID NO: 76330 - DNA, 25 bp, E. coli
ggaattcactgtaagtggccgaaga

SEQ ID NO: 76331 - DNA, 25 bp, E. coli
catgtgatgactactgatagagata

SEQ ID NO: 76332 - DNA, 25 bp, E. coli
catgtgatgacttctgatagagata

SEQ ID NO: 76333 - DNA, 25 bp, E. coli
aaatttatagcctctagtatgcgcg

SEQ ID NO: 76334 - DNA, 25 bp, E. coli
aaatttatagccactagtatgcgcg

SEQ ID NO: 76335 - DNA, 25 bp, E. coli
tagcctctagtaagcgcgaccaggt

SEQ ID NO: 76336 - DNA, 25 bp, E. coli
tagcctctagtatgcgcgaccaggt

SEQ ID NO: 76337 - DNA, 25 bp, E. coli
tatagcctctagaatgcgcgaccag

SEQ ID NO: 76338 - DNA, 25 bp, E. coli
tatagcctctagtatgcgcgaccag

SEQ ID NO: 76339 - DNA, 25 bp, E. coli
ttgttcacaactgatggcattgtaa

SEQ ID NO: 76340 - DNA, 25 bp, E. coli
ttgttcacaactcatggcattgtaa

SEQ ID NO: 76341 - DNA, 25 bp, E. coli
tcgacttctttcatgtgatgacttc

SEQ ID NO: 76342 - DNA, 25 bp, E. coli
tcgacttctttcttgtgatgacttc

SEQ ID NO: 76343 - DNA, 25 bp, E. coli
tctagtatgcgccaccaggtgcttt

SEQ ID NO: 76344 - DNA, 25 bp, E. coli
tctagtatgcgcgaccaggtgcttt

SEQ ID NO: 76345 - DNA, 25 bp, E. coli
gctttgttcacatctgatggcattg

SEQ ID NO: 76346 - DNA, 25 bp, E. coli
gcgcgaccaggtgctttgttcacaa

SEQ ID NO: 76347 - DNA, 25 bp, E. coli
gcgcgaccaggtcctttgttcacaa

SEQ ID NO: 76348 - DNA, 25 bp, E. coli
gctttgttcacaactgatggcattg

SEQ ID NO: 76349 - DNA, 25 bp, E. coli
ctgatagagatatatttatagcctc

SEQ ID NO: 76350 - DNA, 25 bp, E. coli
ctgatagagataaatttatagcctc

SEQ ID NO: 76351 - DNA, 25 bp, E. coli
gaccaggtgcttagttcacaactga

SEQ ID NO: 76352 - DNA, 25 bp, E. coli
gaccaggtgctttgttcacaactga

SEQ ID NO: 76353 - DNA, 25 bp, E. coli
caatggtaacgtatcgcaaacggca

SEQ ID NO: 76354 - DNA, 25 bp, E. coli
caatggtaacgtttcgcaaacggca

SEQ ID NO: 76355 - DNA, 25 bp, E. coli
ataacgcgcgcgtgagtattccgac

SEQ ID NO: 76356 - DNA, 25 bp, E. coli
ataacgcgcgcgagagtattccgac

SEQ ID NO: 76357 - DNA, 25 bp, E. coli
tgctgaaagaggtcaatggtaacgt

SEQ ID NO: 76358 - DNA, 25 bp, E. coli
tgctgaaagaggacaatggtaacgt

SEQ ID NO: 76359 - DNA, 25 bp, E. coli
ccaaatgaccccaagtggcgaacga

SEQ ID NO: 76360 - DNA, 25 bp, E. coli
ccaaatgacccctagtggcgaacga

SEQ ID NO: 76361 - DNA, 25 bp, E. coli
gcgggaaaagctgcggaaacataat

SEQ ID NO: 76362 - DNA, 25 bp, E. coli
gcgggaaaagctccggaaacataat

SEQ ID NO: 76363 - DNA, 25 bp, E. coli
gaaacataatgctgattgtcacgat

SEQ ID NO: 76364 - DNA, 25 bp, E. coli
gaaacataatgcagattgtcacgat

SEQ ID NO: 76365 - DNA, 25 bp, E. coli
cgtcaggtgctgtaagaggacaatg

SEQ ID NO: 76366 - DNA, 25 bp, E. coli
cgtcaggtgctgaaagaggacaatg

SEQ ID NO: 76367 - DNA, 25 bp, E. coli
cgggaaattttccatgactactgtc

SEQ ID NO: 76368 - DNA, 25 bp, E. coli
cgggaaattttcgatgactactgtc

SEQ ID NO: 76369 - DNA, 25 bp, E. coli
gtggcgaacgattgccagggtatca

SEQ ID NO: 76370 - DNA, 25 bp, E. coli
gtggcgaacgatagccagggtatca

SEQ ID NO: 76371 - DNA, 25 bp, E. coli
gatgactactgtctggcagccgtcg

SEQ ID NO: 76372 - DNA, 25 bp, E. coli
gatgactactgtgtggcagccgtcg

SEQ ID NO: 76373 - DNA, 25 bp, E. coli
gagagtattccgaccagtgagtcga

SEQ ID NO: 76374 - DNA, 25 bp, E. coli
gagagtattccgtccagtgagtcga

SEQ ID NO: 76375 - DNA, 25 bp, E. coli
accgagttaataattgcgtagcgaa

SEQ ID NO: 76376 - DNA, 25 bp, E. coli
accgagttaatatttgcgtagcgaa

SEQ ID NO: 76377 - DNA, 25 bp, E. coli
aaagcatatctttgtaaagcggagg

SEQ ID NO: 76378 - DNA, 25 bp, E. coli
aaatcgcggcaactggcgaccgagt

SEQ ID NO: 76379 - DNA, 25 bp, E. coli
aaagcggaggtaattgctggccttc

SEQ ID NO: 76380 - DNA, 25 bp, E. coli
aaagcggaggtatttgctggccttc

SEQ ID NO: 76381 - DNA, 25 bp, E. coli
aaagcatatcttagtaaagcggagg

SEQ ID NO: 76382 - DNA, 25 bp, E. coli
aaatcgcggcaagtggcgaccgagt

SEQ ID NO: 76383 - DNA, 25 bp, E. coli
tttatgcaggtgttaattagcgggc

SEQ ID NO: 76384 - DNA, 25 bp, E. coli
tttatgcaggtgataattagcgggc

SEQ ID NO: 76385 - DNA, 25 bp, E. coli
taccctggttaagcctcgggtggca

SEQ ID NO: 76386 - DNA, 25 bp, E. coli
taccctggttaaccctcgggtggca

SEQ ID NO: 76387 - DNA, 25 bp, E. coli
tcgggtggcagcttcaggtcttgta

SEQ ID NO: 76388 - DNA, 25 bp, E. coli
tcgggtggcagcatcaggtcttgta

SEQ ID NO: 76389 - DNA, 25 bp, E. coli
gccttcaggcatcggcaaatcgcgg

SEQ ID NO: 76390 - DNA, 25 bp, E. coli
gccttcaggcatgggcaaatcgcgg

SEQ ID NO: 76391 - DNA, 25 bp, E. coli
taattagcgggctattgtaccctgg

SEQ ID NO: 76392 - DNA, 25 bp, E. coli
taatccagatcattaaagggtgaat

SEQ ID NO: 76393 - DNA, 25 bp, E. coli
taatccagatcaataaagggtgaat

SEQ ID NO: 76394 - DNA, 25 bp, E. coli
taaccaggattcacaatgcaacttc

SEQ ID NO: 76395 - DNA, 25 bp, E. coli
taattagcgggcaattgtaccctgg

SEQ ID NO: 76396 - DNA, 25 bp, E. coli
taaccaggattctcaatgcaacttc

SEQ ID NO: 76397 - DNA, 25 bp, E. coli
caaataaccatgtggatgtgacctg

SEQ ID NO: 76398 - DNA, 25 bp, E. coli
caaataaccatgaggatgtgacctg

SEQ ID NO: 76399 - DNA, 25 bp, E. coli
catgaggatgtgacctggtcaccca

SEQ ID NO: 76400 - DNA, 25 bp, E. coli
catgaggatgtgtcctggtcaccca

SEQ ID NO: 76401 - DNA, 25 bp, E. coli
aggatgtgacctcgtcacccattgc

SEQ ID NO: 76402 - DNA, 25 bp, E. coli
accatgaggatgtgacctggtcacc

SEQ ID NO: 76403 - DNA, 25 bp, E. coli
aggatgtgacctggtcacccattgc

SEQ ID NO: 76404 - DNA, 25 bp, E. coli
gctgggggggacgttcatggcgctg

SEQ ID NO: 76405 - DNA, 25 bp, E. coli
accatgaggatgagacctggtcacc

SEQ ID NO: 76406 - DNA, 25 bp, E. coli
gctgggggggaccttcatggcgctg

SEQ ID NO: 76407 - DNA, 25 bp, E. coli
aaataaccatgaggatgtgacctgg

SEQ ID NO: 76408 - DNA, 25 bp, E. coli
aaataaccatgacgatgtgacctgg

SEQ ID NO: 76409 - DNA, 25 bp, E. coli
tgaggatgtgacctggtcacccatt

SEQ ID NO: 76410 - DNA, 25 bp, E. coli
tgaggatgtgacgtggtcacccatt

SEQ ID NO: 76411 - DNA, 25 bp, E. coli
ccatgaggatgtgacctggtcaccc

SEQ ID NO: 76412 - DNA, 25 bp, E. coli
ccatgaggatgtcacctggtcaccc

SEQ ID NO: 76413 - DNA, 25 bp, E. coli
ctggtcacccatagccgccggattt

SEQ ID NO: 76414 - DNA, 25 bp, E. coli
ctggtcacccattgccgccggattt

SEQ ID NO: 76415 - DNA, 25 bp, E. coli
ggcaaataaccaagaggatgtgacc

SEQ ID NO: 76416 - DNA, 25 bp, E. coli
ggcaaataaccatgaggatgtgacc

SEQ ID NO: 76417 - DNA, 25 bp, E. coli
taaccatgaggatgtgacctggtca

SEQ ID NO: 76418 - DNA, 25 bp, E. coli
taaccatgaggaagtgacctggtca

SEQ ID NO: 76419 - DNA, 25 bp, E. coli
aggacttcgccgagcactttcgtgt

SEQ ID NO: 76420 - DNA, 25 bp, E. coli
aggacttcgccgtgcactttcgtgt

SEQ ID NO: 76421 - DNA, 25 bp, E. coli
tttaacgacggcactaagggagaag

SEQ ID NO: 76422 - DNA, 25 bp, E. coli
tttaacgacggctctaagggagaag

SEQ ID NO: 76423 - DNA, 25 bp, E. coli
tgttatgccctgacttttcagggat

SEQ ID NO: 76424 - DNA, 25 bp, E. coli
tgttatgccctgtcttttcagggat

SEQ ID NO: 76425 - DNA, 25 bp, E. coli
tgcactttcgtgttatgccctgact

SEQ ID NO: 76426 - DNA, 25 bp, E. coli
tgcactttcgtgatatgccctgact

SEQ ID NO: 76427 - DNA, 25 bp, E. coli
tcgccgtgcactatcgtgttatgcc

SEQ ID NO: 76428 - DNA, 25 bp, E. coli
tcgaattaaatttaacgacggctct

SEQ ID NO: 76429 - DNA, 25 bp, E. coli
tcgccgtgcactttcgtgttatgcc

SEQ ID NO: 76430 - DNA, 25 bp, E. coli
tcgaattaaattaaacgacggctct

SEQ ID NO: 76431 - DNA, 25 bp, E. coli
gaagcgcacggtggaattaaattta

SEQ ID NO: 76432 - DNA, 25 bp, E. coli
gaagcgcacggtcgaattaaattta

SEQ ID NO: 76433 - DNA, 25 bp, E. coli
cgacggctctaacggagaaggactt

SEQ ID NO: 76434 - DNA, 25 bp, E. coli
cgacggctctaagggagaaggactt

SEQ ID NO: 76435 - DNA, 25 bp, E. coli
ggagaaggacttcgccgtgcacttt

SEQ ID NO: 76436 - DNA, 25 bp, E. coli
ggagaaggacttggccgtgcacttt

SEQ ID NO: 76437 - DNA, 25 bp, E. coli
ggctctaagggagaaggacttcgcc

SEQ ID NO: 76438 - DNA, 25 bp, E. coli
ggctctaagggacaaggacttcgcc

SEQ ID NO: 76439 - DNA, 25 bp, E. coli
taagggagaaggtcttcgccgtgca

SEQ ID NO: 76440 - DNA, 25 bp, E. coli
taagggagaaggacttcgccgtgca

SEQ ID NO: 76441 - DNA, 25 bp, E. coli
cacatcagatttcctggtgtaacga

SEQ ID NO: 76442 - DNA, 25 bp, E. coli
cacatcagatttgctggtgtaacga

SEQ ID NO: 76443 - DNA, 25 bp, E. coli
cagatttcctggagtaacgaatttt

SEQ ID NO: 76444 - DNA, 25 bp, E. coli
catcagatttcctggtgtaacgaat

SEQ ID NO: 76445 - DNA, 25 bp, E. coli
catcagatttccaggtgtaacgaat

SEQ ID NO: 76446 - DNA, 25 bp, E. coli
cagatttcctggtgtaacgaatttt

SEQ ID NO: 76447 - DNA, 25 bp, E. coli
agtgcttcttgcttaagcaagtttc

SEQ ID NO: 76448 - DNA, 25 bp, E. coli
agtgcttcttgcataagcaagtttc

SEQ ID NO: 76449 - DNA, 25 bp, E. coli
aacacatcagatatcctggtgtaac

SEQ ID NO: 76450 - DNA, 25 bp, E. coli
aacacatcagatttcctggtgtaac

SEQ ID NO: 76451 - DNA, 25 bp, E. coli
tttaagtgcttcatgcttaagcaag

SEQ ID NO: 76452 - DNA, 25 bp, E. coli
tttaagtgcttcttgcttaagcaag

SEQ ID NO: 76453 - DNA, 25 bp, E. coli
tgcttaagcaagtttcatcccgacc

SEQ ID NO: 76454 - DNA, 25 bp, E. coli
tgcttaagcaagattcatcccgacc

SEQ ID NO: 76455 - DNA, 25 bp, E. coli
gcttaagcaagtatcatcccgaccc

SEQ ID NO: 76456 - DNA, 25 bp, E. coli
gcttaagcaagtttcatcccgaccc

SEQ ID NO: 76457 - DNA, 25 bp, E. coli
cttgcttaagcatgtttcatcccga

SEQ ID NO: 76458 - DNA, 25 bp, E. coli
cttgcttaagcaagtttcatcccga

SEQ ID NO: 76459 - DNA, 25 bp, E. coli
tggtgtaacgaattttttaagtgct

SEQ ID NO: 76460 - DNA, 25 bp, E. coli
tggtgtaacgaaatttttaagtgct

SEQ ID NO: 76461 - DNA, 25 bp, E. coli
taacgaattttttaagtgcttcttg

SEQ ID NO: 76462 - DNA, 25 bp, E. coli
taacgaatttttaaagtgcttcttg

SEQ ID NO: 76463 - DNA, 25 bp, E. coli
aaatacgtggcgtaagccgtcgagc

SEQ ID NO: 76464 - DNA, 25 bp, E. coli
aaatacgtggcgaaagccgtcgagc

SEQ ID NO: 76465 - DNA, 25 bp, E. coli
tatctggagatgctggcgcttatgc

SEQ ID NO: 76466 - DNA, 25 bp, E. coli
tatctggagatggtggcgcttatgc

SEQ ID NO: 76467 - DNA, 25 bp, E. coli
ttcacctgaggaacgcgaaagccaa

SEQ ID NO: 76468 - DNA, 25 bp, E. coli
ttcacctgaggatcgcgaaagccaa

SEQ ID NO: 76469 - DNA, 25 bp, E. coli
tgatggtggacctgtttcgccgaaa

SEQ ID NO: 76470 - DNA, 25 bp, E. coli
tgcagatgacattgcccaggacact

SEQ ID NO: 76471 - DNA, 25 bp, E. coli
tgcactatcgccaaacgcgtgatgg

SEQ ID NO: 76472 - DNA, 25 bp, E. coli
tgcagatgacatagcccaggacact

SEQ ID NO: 76473 - DNA, 25 bp, E. coli
tgatggtggaccagtttcgccgaaa

SEQ ID NO: 76474 - DNA, 25 bp, E. coli
tgcactatcgcctaacgcgtgatgg

SEQ ID NO: 76475 - DNA, 25 bp, E. coli
tgaaaagctggctgacgcgcaaact

SEQ ID NO: 76476 - DNA, 25 bp, E. coli
tgaaaagctggcagacgcgcaaact

SEQ ID NO: 76477 - DNA, 25 bp, E. coli
tgctggacgggctaaacggcaaaac

SEQ ID NO: 76478 - DNA, 25 bp, E. coli
tgctggacgggcaaaacggcaaaac

SEQ ID NO: 76479 - DNA, 25 bp, E. coli
gctttatggcactcatcacggctgg

SEQ ID NO: 76480 - DNA, 25 bp, E. coli
gctttatggcacacatcacggctgg

SEQ ID NO: 76481 - DNA, 25 bp, E. coli
ccaggacactttattgcgggtaatg

SEQ ID NO: 76482 - DNA, 25 bp, E. coli
ccaggacacttttttgcgggtaatg

SEQ ID NO: 76483 - DNA, 25 bp, E. coli
gagattgcgcacaaactcggtgttt

SEQ ID NO: 76484 - DNA, 25 bp, E. coli
gagattgcgcactaactcggtgttt

SEQ ID NO: 76485 - DNA, 25 bp, E. coli
caacaggacagcgaagaaaccgaat

SEQ ID NO: 76486 - DNA, 25 bp, E. coli
aatacttccgcgcaacaggacagcg

SEQ ID NO: 76487 - DNA, 25 bp, E. coli
aatacttccgcggaacaggacagcg

SEQ ID NO: 76488 - DNA, 25 bp, E. coli
caacaggacagccaagaaaccgaat

SEQ ID NO: 76489 - DNA, 25 bp, E. coli
tgttgaaaaacagggtcagccagat

SEQ ID NO: 76490 - DNA, 25 bp, E. coli
tgttgaaaaacacggtcagccagat

SEQ ID NO: 76491 - DNA, 25 bp, E. coli
tctttacaagatccgttcctgaacg

SEQ ID NO: 76492 - DNA, 25 bp, E. coli
tctttacaagatgcgttcctgaacg

SEQ ID NO: 76493 - DNA, 25 bp, E. coli
tctcatcacagtaacaacgccggtg

SEQ ID NO: 76494 - DNA, 25 bp, E. coli
tctcatcacagttacaacgccggtg

SEQ ID NO: 76495 - DNA, 25 bp, E. coli
ccggtggcggtagcagcagtaacta

SEQ ID NO: 76496 - DNA, 25 bp, E. coli
gccagatggttttcaagcacgcgat

SEQ ID NO: 76497 - DNA, 25 bp, E. coli
gccagatggtttacaagcacgcgat

SEQ ID NO: 76498 - DNA, 25 bp, E. coli
ccggtggcggtaccagcagtaacta

SEQ ID NO: 76499 - DNA, 25 bp, E. coli
gaacgcactgcgacgggaacgtgtt

SEQ ID NO: 76500 - DNA, 25 bp, E. coli
gaacgcactgcgtcgggaacgtgtt

SEQ ID NO: 76501 - DNA, 25 bp, E. coli
gatttctactgttgtcccgtctcgc

SEQ ID NO: 76502 - DNA, 25 bp, E. coli
gatttctactgtagtcccgtctcgc

SEQ ID NO: 76503 - DNA, 25 bp, E. coli
gtctcgcccggtttctcatcacagt

SEQ ID NO: 76504 - DNA, 25 bp, E. coli
ggtagcagcgcgcagaatacttccg

SEQ ID NO: 76505 - DNA, 25 bp, E. coli
gtctcgcccggtatctcatcacagt

SEQ ID NO: 76506 - DNA, 25 bp, E. coli
ggtagcagcgcggagaatacttccg

SEQ ID NO: 76507 - DNA, 25 bp, E. coli
taacatcggcagctatgcaaagcag

SEQ ID NO: 76508 - DNA, 25 bp, E. coli
aagtggcaacacgaaagaaacgtcg

SEQ ID NO: 76509 - DNA, 25 bp, E. coli
aagtggcaacaccaaagaaacgtcg

SEQ ID NO: 76510 - DNA, 25 bp, E. coli
aaaactctgattacaacccggctgg

SEQ ID NO: 76511 - DNA, 25 bp, E. coli
aaaactctgatttcaacccggctgg

SEQ ID NO: 76512 - DNA, 25 bp, E. coli
tatgcaaagcagtgatgcagagtgc

SEQ ID NO: 76513 - DNA, 25 bp, E. coli
tatgcaaagcagagatgcagagtgc

SEQ ID NO: 76514 - DNA, 25 bp, E. coli
ttatttcgtatcacctccacggccg

SEQ ID NO: 76515 - DNA, 25 bp, E. coli
ttatttcgtatctcctccacggccg

SEQ ID NO: 76516 - DNA, 25 bp, E. coli
ttcaacccggctcgaagtggcaaca

SEQ ID NO: 76517 - DNA, 25 bp, E. coli
ttcaacccggctggaagtggcaaca

SEQ ID NO: 76518 - DNA, 25 bp, E. coli
ccagaacggtgagacaggttaagca

SEQ ID NO: 76519 - DNA, 25 bp, E. coli
ccagaacggtgacacaggttaagca

SEQ ID NO: 76520 - DNA, 25 bp, E. coli
tccacggccgccagttaagacgaac

SEQ ID NO: 76521 - DNA, 25 bp, E. coli
tccacggccgcctgttaagacgaac

SEQ ID NO: 76522 - DNA, 25 bp, E. coli
gggaacgaatcttcaccagaacggt

SEQ ID NO: 76523 - DNA, 25 bp, E. coli
taagacgaacccacaagccaaaact

SEQ ID NO: 76524 - DNA, 25 bp, E. coli
gggaacgaatctacaccagaacggt

SEQ ID NO: 76525 - DNA, 25 bp, E. coli
taagacgaaccctcaagccaaaact

SEQ ID NO: 76526 - DNA, 25 bp, E. coli
ggttaagcagcagacaacggttcat

SEQ ID NO: 76527 - DNA, 25 bp, E. coli
ggttaagcagcacacaacggttcat

SEQ ID NO: 76528 - DNA, 25 bp, E. coli
taacatcggcaggtatgcaaagcag

SEQ ID NO: 76529 - DNA, 25 bp, E. coli
aagtgacgccacgaatgatgccggg

SEQ ID NO: 76530 - DNA, 25 bp, E. coli
aagtgacgccaccaatgatgccggg

SEQ ID NO: 76531 - DNA, 25 bp, E. coli
tatgtcgaaacggacaataccggcg

SEQ ID NO: 76532 - DNA, 25 bp, E. coli
agttaactgtggaagtcgctgcccg

SEQ ID NO: 76533 - DNA, 25 bp, E. coli
agttaactgtggtagtcgctgcccg

SEQ ID NO: 76534 - DNA, 25 bp, E. coli
tagctgggaagaagcctacgacatc

SEQ ID NO: 76535 - DNA, 25 bp, E. coli
tatgtcgaaacgcacaataccggcg

SEQ ID NO: 76536 - DNA, 25 bp, E. coli
tagctgggaagatgcctacgacatc

SEQ ID NO: 76537 - DNA, 25 bp, E. coli
tattcgtccgggtacagatgccgca

SEQ ID NO: 76538 - DNA, 25 bp, E. coli
tatctgaactatggcaccggtacgc

SEQ ID NO: 76539 - DNA, 25 bp, E. coli
tatctgaactatcgcaccggtacgc

SEQ ID NO: 76540 - DNA, 25 bp, E. coli
tattcgtccgggaacagatgccgca

SEQ ID NO: 76541 - DNA, 25 bp, E. coli
ttggtaataaccctggcgaaacgcg

SEQ ID NO: 76542 - DNA, 25 bp, E. coli
ttggtaataaccgtggcgaaacgcg

SEQ ID NO: 76543 - DNA, 25 bp, E. coli
tcaggaaatgtggatcaacccgctt

SEQ ID NO: 76544 - DNA, 25 bp, E. coli
tcaggaaatgtgcatcaacccgctt

SEQ ID NO: 76545 - DNA, 25 bp, E. coli
gcgatgacaattacgacggcctgca

SEQ ID NO: 76546 - DNA, 25 bp, E. coli
gcgatgacaatttcgacggcctgca

SEQ ID NO: 76547 - DNA, 25 bp, E. coli
gaagcgattcctgaactgccaacgt

SEQ ID NO: 76548 - DNA, 25 bp, E. coli
gaagcgattcctcaactgccaacgt

SEQ ID NO: 76549 - DNA, 25 bp, E. coli
tcaaaatgatctggaactatgccgg

SEQ ID NO: 76550 - DNA, 25 bp, E. coli
tcaaaatgatctcgaactatgccgg

SEQ ID NO: 76551 - DNA, 25 bp, E. coli
aaggtattgccgctgcaatgcactt

SEQ ID NO: 76552 - DNA, 25 bp, E. coli
aaggtattgccggtgcaatgcactt

SEQ ID NO: 76553 - DNA, 25 bp, E. coli
aaacctgattgaaggtattgccgct

SEQ ID NO: 76554 - DNA, 25 bp, E. coli
aaacctgattgatggtattgccgct

SEQ ID NO: 76555 - DNA, 25 bp, E. coli
tatggtctgccacataaaaacctga

SEQ ID NO: 76556 - DNA, 25 bp, E. coli
tatggtctgccagataaaaacctga

SEQ ID NO: 76557 - DNA, 25 bp, E. coli
cctgattgaaggtattgccgctgca

SEQ ID NO: 76558 - DNA, 25 bp, E. coli
cctgattgaaggaattgccgctgca

SEQ ID NO: 76559 - DNA, 25 bp, E. coli
ctgattgaaggtattgccgctgcaa

SEQ ID NO: 76560 - DNA, 25 bp, E. coli
ctgattgaaggttttgccgctgcaa

SEQ ID NO: 76561 - DNA, 25 bp, E. coli
ctgccacataaatacctgattgaag

SEQ ID NO: 76562 - DNA, 25 bp, E. coli
ctgccacataaaaacctgattgaag

SEQ ID NO: 76563 - DNA, 25 bp, E. coli
gattgaaggtatagccgctgcaatg

SEQ ID NO: 76564 - DNA, 25 bp, E. coli
gtattgccgctggaatgcacttccg

SEQ ID NO: 76565 - DNA, 25 bp, E. coli
gtattgccgctgcaatgcacttccg

SEQ ID NO: 76566 - DNA, 25 bp, E. coli
gattgaaggtattgccgctgcaatg

SEQ ID NO: 76567 - DNA, 25 bp, E. coli
gtctgccacatataaacctgattga

SEQ ID NO: 76568 - DNA, 25 bp, E. coli
ggtctgccacataaaaacctgattg

SEQ ID NO: 76569 - DNA, 25 bp, E. coli
ggtctgccacattaaaacctgattg

SEQ ID NO: 76570 - DNA, 25 bp, E. coli
gtctgccacataaaaacctgattga

SEQ ID NO: 76571 - DNA, 25 bp, E. coli
ggaatatggtctcccacataaaaac

SEQ ID NO: 76572 - DNA, 25 bp, E. coli
ggaatatggtctgccacataaaaac

SEQ ID NO: 76573 - DNA, 25 bp, E. coli
caacttccggtgtttaatgcagtga

SEQ ID NO: 76574 - DNA, 25 bp, E. coli
aatgccattgaacctgcaagccagc

SEQ ID NO: 76575 - DNA, 25 bp, E. coli
aatacactggtgattgaacgcacgc

SEQ ID NO: 76576 - DNA, 25 bp, E. coli
aatgccattgaagctgcaagccagc

SEQ ID NO: 76577 - DNA, 25 bp, E. coli
aatacactggtgtttgaacgcacgc

SEQ ID NO: 76578 - DNA, 25 bp, E. coli
caacttccggtgattaatgcagtga

SEQ ID NO: 76579 - DNA, 25 bp, E. coli
tacaccctgaatttcgacaatgccg

SEQ ID NO: 76580 - DNA, 25 bp, E. coli
tacaccctgaatatcgacaatgccg

SEQ ID NO: 76581 - DNA, 25 bp, E. coli
agatgacgatgagatagccgcgctg

SEQ ID NO: 76582 - DNA, 25 bp, E. coli
agatgacgatgacatagccgcgctg

SEQ ID NO: 76583 - DNA, 25 bp, E. coli
aaaaccggtaaaacagtggcaggca

SEQ ID NO: 76584 - DNA, 25 bp, E. coli
aaaaccggtaaatcagtggcaggca

SEQ ID NO: 76585 - DNA, 25 bp, E. coli
tattgaactctcagttccagccgtg

SEQ ID NO: 76586 - DNA, 25 bp, E. coli
tattgaactctctgttccagccgtg

SEQ ID NO: 76587 - DNA, 25 bp, E. coli
ttgttgcagaactcgaaagtgcgca

SEQ ID NO: 76588 - DNA, 25 bp, E. coli
ttgttgcagaacacgaaagtgcgca

SEQ ID NO: 76589 - DNA, 25 bp, E. coli
tgcgcaaagacgagctatcccgcgg

SEQ ID NO: 76590 - DNA, 25 bp, E. coli
tcgataacgattcgccggaggccat

SEQ ID NO: 76591 - DNA, 25 bp, E. coli
tgcgcaaagacgtgctatcccgcgg

SEQ ID NO: 76592 - DNA, 25 bp, E. coli
tcgataacgattggccggaggccat

SEQ ID NO: 76593 - DNA, 25 bp, E. coli
gctttaagctggtgcctgaagaaca

SEQ ID NO: 76594 - DNA, 25 bp, E. coli
gctttaagctggagcctgaagaaca

SEQ ID NO: 76595 - DNA, 25 bp, E. coli
cagacactgcttggccgtctgctgg

SEQ ID NO: 76596 - DNA, 25 bp, E. coli
cagacactgcttcgccgtctgctgg

SEQ ID NO: 76597 - DNA, 25 bp, E. coli
agacactgcttgcccgtctgctgga

SEQ ID NO: 76598 - DNA, 25 bp, E. coli
agacactgcttggccgtctgctgga

SEQ ID NO: 76599 - DNA, 25 bp, E. coli
actgcttggccgtctgctggaccag

SEQ ID NO: 76600 - DNA, 25 bp, E. coli
actgcttggccgactgctggaccag

SEQ ID NO: 76601 - DNA, 25 bp, E. coli
tgcttggccgtcagctggaccagca

SEQ ID NO: 76602 - DNA, 25 bp, E. coli
tgcttggccgtctgctggaccagca

SEQ ID NO: 76603 - DNA, 25 bp, E. coli
gcagacactgcttggccgtctgctg

SEQ ID NO: 76604 - DNA, 25 bp, E. coli
gcagacactgctaggccgtctgctg

SEQ ID NO: 76605 - DNA, 25 bp, E. coli
gacactgcttggccgtctgctggac

SEQ ID NO: 76606 - DNA, 25 bp, E. coli
gacactgcttgggcgtctgctggac

SEQ ID NO: 76607 - DNA, 25 bp, E. coli
ctgcttggccgtctgctggaccagc

SEQ ID NO: 76608 - DNA, 25 bp, E. coli
ctggcagacactgcttggccgtctg

SEQ ID NO: 76609 - DNA, 25 bp, E. coli
ctggcagacactccttggccgtctg

SEQ ID NO: 76610 - DNA, 25 bp, E. coli
ctgcttggccgtgtgctggaccagc

SEQ ID NO: 76611 - DNA, 25 bp, E. coli
ggcagacactgcatggccgtctgct

SEQ ID NO: 76612 - DNA, 25 bp, E. coli
tggcagacactgcttggccgtctgc

SEQ ID NO: 76613 - DNA, 25 bp, E. coli
ggaaaaatacgtcctggtgcgtacc

SEQ ID NO: 76614 - DNA, 25 bp, E. coli
ggaaaaatacgtgctggtgcgtacc

SEQ ID NO: 76615 - DNA, 25 bp, E. coli
ggcagacactgcttggccgtctgct

SEQ ID NO: 76616 - DNA, 25 bp, E. coli
tggcagacactggttggccgtctgc

SEQ ID NO: 76617 - DNA, 25 bp, E. coli
cactttcaggtgctgaccgactgct

SEQ ID NO: 76618 - DNA, 25 bp, E. coli
cactttcaggtggtgaccgactgct

SEQ ID NO: 76619 - DNA, 25 bp, E. coli
aatcggaccgcgcaaaagacttcct

SEQ ID NO: 76620 - DNA, 25 bp, E. coli
aatcggaccgcggaaaagacttcct

SEQ ID NO: 76621 - DNA, 25 bp, E. coli
tgctcaaccgaactgaaaaaaggcg

SEQ ID NO: 76622 - DNA, 25 bp, E. coli
tgaccctggcgctggtgaaagtgct

SEQ ID NO: 76623 - DNA, 25 bp, E. coli
tgaccctggcgcaggtgaaagtgct

SEQ ID NO: 76624 - DNA, 25 bp, E. coli
tgctcaaccgaagtgaaaaaaggcg

SEQ ID NO: 76625 - DNA, 25 bp, E. coli
tcgattatcgaaaacctgaccctgg

SEQ ID NO: 76626 - DNA, 25 bp, E. coli
tcgattatcgaatacctgaccctgg

SEQ ID NO: 76627 - DNA, 25 bp, E. coli
gcagcaaggtgatatcaccgtcgat

SEQ ID NO: 76628 - DNA, 25 bp, E. coli
gcagcaaggtgaaatcaccgtcgat

SEQ ID NO: 76629 - DNA, 25 bp, E. coli
gaaatgggctttgcccgtaaagtgg

SEQ ID NO: 76630 - DNA, 25 bp, E. coli
gaaatgggctttccccgtaaagtgg

SEQ ID NO: 76631 - DNA, 25 bp, E. coli
cgtaaagtggcgaatcgggtgatct

SEQ ID NO: 76632 - DNA, 25 bp, E. coli
ggttaacgacaacaaaaccgatctg

SEQ ID NO: 76633 - DNA, 25 bp, E. coli
ggttaacgacaagaaaaccgatctg

SEQ ID NO: 76634 - DNA, 25 bp, E. coli
cgtaaagtggcgtatcgggtgatct

SEQ ID NO: 76635 - DNA, 25 bp, E. coli
tcaaaatggtatcgtcactttcagg

SEQ ID NO: 76636 - DNA, 25 bp, E. coli
tcaaaatggtatggtcactttcagg

SEQ ID NO: 76637 - DNA, 25 bp, E. coli
gaccgactgctcaaccgaagtgaaa

SEQ ID NO: 76638 - DNA, 25 bp, E. coli
gaccgactgctctaccgaagtgaaa

SEQ ID NO: 76639 - DNA, 25 bp, E. coli
caaataaacgccagaacaccttgac

SEQ ID NO: 76640 - DNA, 25 bp, E. coli
caaataaacgcctgaacaccttgac

SEQ ID NO: 76641 - DNA, 25 bp, E. coli
taaagtatagactacacccagtggg

SEQ ID NO: 76642 - DNA, 25 bp, E. coli
taaagtatagacaacacccagtggg

SEQ ID NO: 76643 - DNA, 25 bp, E. coli
tacgttatctgcatttgatacgcag

SEQ ID NO: 76644 - DNA, 25 bp, E. coli
aacacccagtggcttatgtgcgggc

SEQ ID NO: 76645 - DNA, 25 bp, E. coli
aacacccagtgggttatgtgcgggc

SEQ ID NO: 76646 - DNA, 25 bp, E. coli
tacgttatctgcttttgatacgcag

SEQ ID NO: 76647 - DNA, 25 bp, E. coli
tgcgggcgtgatgacaattacaacc

SEQ ID NO: 76648 - DNA, 25 bp, E. coli
tgcgggcgtgatcacaattacaacc

SEQ ID NO: 76649 - DNA, 25 bp, E. coli
gaatacccctcttccttatgtgtaa

SEQ ID NO: 76650 - DNA, 25 bp, E. coli
gcgccagttatgtacacactcagga

SEQ ID NO: 76651 - DNA, 25 bp, E. coli
gcgccagttatgaacacactcagga

SEQ ID NO: 76652 - DNA, 25 bp, E. coli
gaatacccctctaccttatgtgtaa

SEQ ID NO: 76653 - DNA, 25 bp, E. coli
gcaaccagtaaactacgcgccagtt

SEQ ID NO: 76654 - DNA, 25 bp, E. coli
gcaaccagtaaagtacgcgccagtt

SEQ ID NO: 76655 - DNA, 25 bp, E. coli
gactttctaatactccactcaggca

SEQ ID NO: 76656 - DNA, 25 bp, E. coli
gactttctaatagtccactcaggca

SEQ ID NO: 76657 - DNA, 25 bp, E. coli
tccggaactttcagggttgtaacag

SEQ ID NO: 76658 - DNA, 25 bp, E. coli
tccggaactttctgggttgtaacag

SEQ ID NO: 76659 - DNA, 25 bp, E. coli
gatacgcagttttttgtcaagcggg

SEQ ID NO: 76660 - DNA, 25 bp, E. coli
gatacgcagtttattgtcaagcggg

SEQ ID NO: 76661 - DNA, 25 bp, E. coli
agagccagttggtgatttttatgaa

SEQ ID NO: 76662 - DNA, 25 bp, E. coli
agagccagttggagatttttatgaa

SEQ ID NO: 76663 - DNA, 25 bp, E. coli
acaaatggaactggcacggattgcg

SEQ ID NO: 76664 - DNA, 25 bp, E. coli
acaaatggaactcgcacggattgcg

SEQ ID NO: 76665 - DNA, 25 bp, E. coli
tatgaatacaaaccggatgactggt

SEQ ID NO: 76666 - DNA, 25 bp, E. coli
tatgaatacaaagcggatgactggt

SEQ ID NO: 76667 - DNA, 25 bp, E. coli
tttatgaatacaaaccggatgactg

SEQ ID NO: 76668 - DNA, 25 bp, E. coli
tttatgaatacataccggatgactg

SEQ ID NO: 76669 - DNA, 25 bp, E. coli
tgaacaaatggatctggcacggatt

SEQ ID NO: 76670 - DNA, 25 bp, E. coli
tgaatacaaaccggatgactggtag

SEQ ID NO: 76671 - DNA, 25 bp, E. coli
tgaacaaatggaactggcacggatt

SEQ ID NO: 76672 - DNA, 25 bp, E. coli
tgaatacaaacccgatgactggtag

SEQ ID NO: 76673 - DNA, 25 bp, E. coli
gccagttggtgatttttatgaatac

SEQ ID NO: 76674 - DNA, 25 bp, E. coli
gccagttggtgaattttatgaatac

SEQ ID NO: 76675 - DNA, 25 bp, E. coli
gcagagccagttggtgatttttatg

SEQ ID NO: 76676 - DNA, 25 bp, E. coli
gcagagccagttcgtgatttttatg

SEQ ID NO: 76677 - DNA, 25 bp, E. coli
gatttttatgaatacaaaccggatg

SEQ ID NO: 76678 - DNA, 25 bp, E. coli
gatttttatgaaaacaaaccggatg

SEQ ID NO: 76679 - DNA, 25 bp, E. coli
ggaagcagagccagttggtgatttt

SEQ ID NO: 76680 - DNA, 25 bp, E. coli
ggtgatttttatgaatacaaaccgg

SEQ ID NO: 76681 - DNA, 25 bp, E. coli
ggtgatttttatcaatacaaaccgg

SEQ ID NO: 76682 - DNA, 25 bp, E. coli
ggaagcagagcctgttggtgatttt

SEQ ID NO: 76683 - DNA, 25 bp, E. coli
aacgcgcgaggatgtgtttgccgat

SEQ ID NO: 76684 - DNA, 25 bp, E. coli
aacgcgcgaggaagtgtttgccgat

SEQ ID NO: 76685 - DNA, 25 bp, E. coli
taaaaaatggtgtcgcgattggcgc

SEQ ID NO: 76686 - DNA, 25 bp, E. coli
taaaaaatggtgacgcgattggcgc

SEQ ID NO: 76687 - DNA, 25 bp, E. coli
tattaacgctggtttcctctgccaa

SEQ ID NO: 76688 - DNA, 25 bp, E. coli
tattaacgctggattcctctgccaa

SEQ ID NO: 76689 - DNA, 25 bp, E. coli
tgcaggcttgcgagcgtgaagcaat

SEQ ID NO: 76690 - DNA, 25 bp, E. coli
tgcaacacggcacagtcaaaagtat

SEQ ID NO: 76691 - DNA, 25 bp, E. coli
tgcaggcttgcgtgcgtgaagcaat

SEQ ID NO: 76692 - DNA, 25 bp, E. coli
tgcaacacggcagagtcaaaagtat

SEQ ID NO: 76693 - DNA, 25 bp, E. coli
gccaatattgcctgtggatttcatg

SEQ ID NO: 76694 - DNA, 25 bp, E. coli
ccagagcggtattcgcttgcgatcc

SEQ ID NO: 76695 - DNA, 25 bp, E. coli
ccagagcggtatacgcttgcgatcc

SEQ ID NO: 76696 - DNA, 25 bp, E. coli
gccaatattgccagtggatttcatg

SEQ ID NO: 76697 - DNA, 25 bp, E. coli
gctgtatcaaataggcgcgctggca

SEQ ID NO: 76698 - DNA, 25 bp, E. coli
gctgtatcaaattggcgcgctggca

SEQ ID NO: 76699 - DNA, 25 bp, E. coli
gaaaattgacctgaacgccgatctg

SEQ ID NO: 76700 - DNA, 25 bp, E. coli
gaaaattgacctcaacgccgatctg

SEQ ID NO: 76701 - DNA, 25 bp, E. coli
ggatttcatgcaggcgatgcgcaaa

SEQ ID NO: 76702 - DNA, 25 bp, E. coli
ggatttcatgcacgcgatgcgcaaa

SEQ ID NO: 76703 - DNA, 25 bp, E. coli
tcaaaagtatcagcggcgaatgggc

SEQ ID NO: 76704 - DNA, 25 bp, E. coli
tcaaaagtatcaccggcgaatgggc

SEQ ID NO: 76705 - DNA, 25 bp, E. coli
cagcgttcaaaacgccatgataaat

SEQ ID NO: 76706 - DNA, 25 bp, E. coli
caaacaattcaataatatcacaggt

SEQ ID NO: 76707 - DNA, 25 bp, E. coli
caaacaattcaaaaatatcacaggt

SEQ ID NO: 76708 - DNA, 25 bp, E. coli
cagcgttcaaaaggccatgataaat

SEQ ID NO: 76709 - DNA, 25 bp, E. coli
cagagcgctacttttcagcgttcaa

SEQ ID NO: 76710 - DNA, 25 bp, E. coli
cagagcgctactattcagcgttcaa

SEQ ID NO: 76711 - DNA, 25 bp, E. coli
taaaagaccggatagtctcggtgct

SEQ ID NO: 76712 - DNA, 25 bp, E. coli
taaaagaccggaaagtctcggtgct

SEQ ID NO: 76713 - DNA, 25 bp, E. coli
tagtctcggtgcataaaatcagcga

SEQ ID NO: 76714 - DNA, 25 bp, E. coli
tagtctcggtgcttaaaatcagcga

SEQ ID NO: 76715 - DNA, 25 bp, E. coli
tttacaattatcttccagggaggga

SEQ ID NO: 76716 - DNA, 25 bp, E. coli
tttacaattatcatccagggaggga

SEQ ID NO: 76717 - DNA, 25 bp, E. coli
tcttcattatttggtaaaagaccgg

SEQ ID NO: 76718 - DNA, 25 bp, E. coli
tcttcattatttcgtaaaagaccgg

SEQ ID NO: 76719 - DNA, 25 bp, E. coli
ccagggagggattattcttcattat

SEQ ID NO: 76720 - DNA, 25 bp, E. coli
ccagggagggataattcttcattat

SEQ ID NO: 76721 - DNA, 25 bp, E. coli
cgtaaatctgttattcagacaagta

SEQ ID NO: 76722 - DNA, 25 bp, E. coli
cgtaaatctgtttttcagacaagta

SEQ ID NO: 76723 - DNA, 25 bp, E. coli
gggtttactttgcagagcgctactt

SEQ ID NO: 76724 - DNA, 25 bp, E. coli
ggtgcttaaaatcagcgaacatata

SEQ ID NO: 76725 - DNA, 25 bp, E. coli
ggtgcttaaaatgagcgaacatata

SEQ ID NO: 76726 - DNA, 25 bp, E. coli
gggtttactttggagagcgctactt

SEQ ID NO: 76727 - DNA, 25 bp, E. coli
cagcgtctctggttctgctaccggc

SEQ ID NO: 76728 - DNA, 25 bp, E. coli
cagcgtctctggatctgctaccggc

SEQ ID NO: 76729 - DNA, 25 bp, E. coli
cacgccttatgacctgcgtaagctg

SEQ ID NO: 76730 - DNA, 25 bp, E. coli
cacgccttatgagctgcgtaagctg

SEQ ID NO: 76731 - DNA, 25 bp, E. coli
taccggcacgccatatgagctgcgt

SEQ ID NO: 76732 - DNA, 25 bp, E. coli
taccggcacgccttatgagctgcgt

SEQ ID NO: 76733 - DNA, 25 bp, E. coli
tgatctcattatcaacaccgtcaac

SEQ ID NO: 76734 - DNA, 25 bp, E. coli
tgatctcattatgaacaccgtcaac

SEQ ID NO: 76735 - DNA, 25 bp, E. coli
tctgctaccggctcgccttatgagc

SEQ ID NO: 76736 - DNA, 25 bp, E. coli
tctgctaccggcacgccttatgagc

SEQ ID NO: 76737 - DNA, 25 bp, E. coli
gccgctgtctgtaccggcctttacg

SEQ ID NO: 76738 - DNA, 25 bp, E. coli
gccgctgtctgttccggcctttacg

SEQ ID NO: 76739 - DNA, 25 bp, E. coli
ctggttctgctagcggcacgcctta

SEQ ID NO: 76740 - DNA, 25 bp, E. coli
cgtctctggttctgctaccggcacg

SEQ ID NO: 76741 - DNA, 25 bp, E. coli
ctggttctgctaccggcacgcctta

SEQ ID NO: 76742 - DNA, 25 bp, E. coli
cgtctctggttcagctaccggcacg

SEQ ID NO: 76743 - DNA, 25 bp, E. coli
gttctcacgccgctgtctgttccgg

SEQ ID NO: 76744 - DNA, 25 bp, E. coli
gttctcacgccggtgtctgttccgg

SEQ ID NO: 76745 - DNA, 25 bp, E. coli
tgttccggcctttacgttaattgcg

SEQ ID NO: 76746 - DNA, 25 bp, E. coli
tgttccggccttaacgttaattgcg

SEQ ID NO: 76747 - DNA, 25 bp, E. coli
tcaacaccgtcatcgtcagcctcga

SEQ ID NO: 76748 - DNA, 25 bp, E. coli
tcaacaccgtcaacgtcagcctcga

SEQ ID NO: 76749 - DNA, 25 bp, E. coli
catccaggaagtcctcgaaggcgaa

SEQ ID NO: 76750 - DNA, 25 bp, E. coli
catccaggaagtgctcgaaggcgaa

SEQ ID NO: 76751 - DNA, 25 bp, E. coli
taaagaattgatgaagcacagccgg

SEQ ID NO: 76752 - DNA, 25 bp, E. coli
taaagaattgatcaagcacagccgg

SEQ ID NO: 76753 - DNA, 25 bp, E. coli
taaaacgcgtcatatgctgctggcg

SEQ ID NO: 76754 - DNA, 25 bp, E. coli
taaaacgcgtcaaatgctgctggcg

SEQ ID NO: 76755 - DNA, 25 bp, E. coli
tgcagaaaacgaaccactggtggac

SEQ ID NO: 76756 - DNA, 25 bp, E. coli
tgcagaaaacgatccactggtggac

SEQ ID NO: 76757 - DNA, 25 bp, E. coli
gccatactgagtctgcaaaagaccg

SEQ ID NO: 76758 - DNA, 25 bp, E. coli
gccatactgagtgtgcaaaagaccg

SEQ ID NO: 76759 - DNA, 25 bp, E. coli
gaattcagcgttgatggcgcaacca

SEQ ID NO: 76760 - DNA, 25 bp, E. coli
gaattcagcgttcatggcgcaacca

SEQ ID NO: 76761 - DNA, 25 bp, E. coli
ccgacaaaaagaagaggaagctgcc

SEQ ID NO: 76762 - DNA, 25 bp, E. coli
ccgacaaaaagatgaggaagctgcc

SEQ ID NO: 76763 - DNA, 25 bp, E. coli
gattttaggcttacaactgccgggc

SEQ ID NO: 76764 - DNA, 25 bp, E. coli
gattttaggctttcaactgccgggc

SEQ ID NO: 76765 - DNA, 25 bp, E. coli
gggcgtatcagcaaaaacatccagg

SEQ ID NO: 76766 - DNA, 25 bp, E. coli
ggttaacaaccagtcgcattggcgt

SEQ ID NO: 76767 - DNA, 25 bp, E. coli
gggcgtatcagctaaaacatccagg

SEQ ID NO: 76768 - DNA, 25 bp, E. coli
ggttaacaaccactcgcattggcgt

SEQ ID NO: 76769 - DNA, 25 bp, E. coli
ggctatttaccacatgcgcgcaagg

SEQ ID NO: 76770 - DNA, 25 bp, E. coli
ggctatttaccagatgcgcgcaagg

SEQ ID NO: 76771 - DNA, 25 bp, E. coli
ttcgaaggtgaacgccataacgccc

SEQ ID NO: 76772 - DNA, 25 bp, E. coli
ttcgaaggtgaaggccataacgccc

SEQ ID NO: 76773 - DNA, 25 bp, E. coli
tgaacgccataacgccctgcacgat

SEQ ID NO: 76774 - DNA, 25 bp, E. coli
tgaacgccataaggccctgcacgat

SEQ ID NO: 76775 - DNA, 25 bp, E. coli
tgcccgtggcgttacaccaatgatc

SEQ ID NO: 76776 - DNA, 25 bp, E. coli
tgcccgtggcgtaacaccaatgatc

SEQ ID NO: 76777 - DNA, 25 bp, E. coli
tcgacgcaagaacgactattccatt

SEQ ID NO: 76778 - DNA, 25 bp, E. coli
tcgacgcaagaaggactattccatt

SEQ ID NO: 76779 - DNA, 25 bp, E. coli
tctgggactggtgatggatttcgac

SEQ ID NO: 76780 - DNA, 25 bp, E. coli
tctgggactggtcatggatttcgac

SEQ ID NO: 76781 - DNA, 25 bp, E. coli
ccaatgatcgcgttgtaagaacgat

SEQ ID NO: 76782 - DNA, 25 bp, E. coli
ccaatgatcgcgatgtaagaacgat

SEQ ID NO: 76783 - DNA, 25 bp, E. coli
cgacaacgtgattttacgccgttca

SEQ ID NO: 76784 - DNA, 25 bp, E. coli
cgacaacgtgatattacgccgttca

SEQ ID NO: 76785 - DNA, 25 bp, E. coli
ggtaacggtgcaactttcgacaacg

SEQ ID NO: 76786 - DNA, 25 bp, E. coli
ggtaacggtgcatctttcgacaacg

SEQ ID NO: 76787 - DNA, 25 bp, E. coli
ggcgttacaccaatgatcgcgatgt

SEQ ID NO: 76788 - DNA, 25 bp, E. coli
ggcgttacaccattgatcgcgatgt

SEQ ID NO: 76789 - DNA, 25 bp, E. coli
taagaacgatggatgctctgggact

SEQ ID NO: 76790 - DNA, 25 bp, E. coli
taagaacgatggttgctctgggact

SEQ ID NO: 76791 - DNA, 25 bp, E. coli
gatggatttcgacgcaagaacgact

SEQ ID NO: 76792 - DNA, 25 bp, E. coli
gatggatttcgaggcaagaacgact

SEQ ID NO: 76793 - DNA, 25 bp, E. coli
taaaataagcctggcggagatggcg

SEQ ID NO: 76794 - DNA, 25 bp, E. coli
taaaataagcctcgcggagatggcg

SEQ ID NO: 76795 - DNA, 25 bp, E. coli
tactactggtgatcctgccgtcgtg

SEQ ID NO: 76796 - DNA, 25 bp, E. coli
tactactggtgaacctgccgtcgtg

SEQ ID NO: 76797 - DNA, 25 bp, E. coli
tgatcgtgccgcagactaaaggtgg

SEQ ID NO: 76798 - DNA, 25 bp, E. coli
tgatcgtgccgctgactaaaggtgg

SEQ ID NO: 76799 - DNA, 25 bp, E. coli
tgagtacacttgaacctgctgccca

SEQ ID NO: 76800 - DNA, 25 bp, E. coli
tgagtacacttgtacctgctgccca

SEQ ID NO: 76801 - DNA, 25 bp, E. coli
gcgatcatcatgatgctgctgctaa

SEQ ID NO: 76802 - DNA, 25 bp, E. coli
gcgatcatcatgttgctgctgctaa

SEQ ID NO: 76803 - DNA, 25 bp, E. coli
gcggtggcgcactgtaagccttcga

SEQ ID NO: 76804 - DNA, 25 bp, E. coli
gcggtggcgcacagtaagccttcga

SEQ ID NO: 76805 - DNA, 25 bp, E. coli
gacagcatcatgatcgggcgcgtgc

SEQ ID NO: 76806 - DNA, 25 bp, E. coli
gacagcatcatgttcgggcgcgtgc

SEQ ID NO: 76807 - DNA, 25 bp, E. coli
gatctcggtgcaggaccgctgaaaa

SEQ ID NO: 76808 - DNA, 25 bp, E. coli
gatctcggtgcacgaccgctgaaaa

SEQ ID NO: 76809 - DNA, 25 bp, E. coli
tgggcgagtttgagatcccggaact

SEQ ID NO: 76810 - DNA, 25 bp, E. coli
tgggcgagtttgtgatcccggaact

SEQ ID NO: 76811 - DNA, 25 bp, E. coli
gatggcgcgcgcaattccaccttat

SEQ ID NO: 76812 - DNA, 25 bp, E. coli
gatggcgcgcgctattccaccttat

SEQ ID NO: 76813 - DNA, 25 bp, E. coli
gatcgatgctggtgtttatcccggc

SEQ ID NO: 76814 - DNA, 25 bp, E. coli
gatcgatgctggagtttatcccggc

SEQ ID NO: 76815 - DNA, 25 bp, E. coli
cagtctttgaaccatgcggatgtca

SEQ ID NO: 76816 - DNA, 25 bp, E. coli
cagtctttgaacgatgcggatgtca

SEQ ID NO: 76817 - DNA, 25 bp, E. coli
taaactaaaactgaagcgcgcctgg

SEQ ID NO: 76818 - DNA, 25 bp, E. coli
tacagcattaccctctggcgcgtga

SEQ ID NO: 76819 - DNA, 25 bp, E. coli
tacagcattaccgtctggcgcgtga

SEQ ID NO: 76820 - DNA, 25 bp, E. coli
taaactaaaactcaagcgcgcctgg

SEQ ID NO: 76821 - DNA, 25 bp, E. coli
aaaaatctggtcaggtgaatcccct

SEQ ID NO: 76822 - DNA, 25 bp, E. coli
aaaaatctggtctggtgaatcccct

SEQ ID NO: 76823 - DNA, 25 bp, E. coli
aacagttgcaacagcgcggtattcg

SEQ ID NO: 76824 - DNA, 25 bp, E. coli
aacagttgcaactgcgcggtattcg

SEQ ID NO: 76825 - DNA, 25 bp, E. coli
tgatgcggtaaaagccattctggcg

SEQ ID NO: 76826 - DNA, 25 bp, E. coli
tgatgcggtaaatgccattctggcg

SEQ ID NO: 76827 - DNA, 25 bp, E. coli
gaaaaatgtgtaccgctggccgatc

SEQ ID NO: 76828 - DNA, 25 bp, E. coli
gaaatgccgggcctttgcagaagaa

SEQ ID NO: 76829 - DNA, 25 bp, E. coli
gaaaaatgtgtagcgctggccgatc

SEQ ID NO: 76830 - DNA, 25 bp, E. coli
gaaatgccgggcgtttgcagaagaa

SEQ ID NO: 76831 - DNA, 25 bp, E. coli
cattctggcgcatcaccctgatgtg

SEQ ID NO: 76832 - DNA, 25 bp, E. coli
cattctggcgcaacaccctgatgtg

SEQ ID NO: 76833 - DNA, 25 bp, E. coli
gttggtaatctcaccgcaggcggca

SEQ ID NO: 76834 - DNA, 25 bp, E. coli
gttggtaatctctccgcaggcggca

SEQ ID NO: 76835 - DNA, 25 bp, E. coli
ggtgaaatccccatgcatctgctgc

SEQ ID NO: 76836 - DNA, 25 bp, E. coli
ggtgaaatccccttgcatctgctgc

SEQ ID NO: 76837 - DNA, 25 bp, E. coli
caacggttctgttggtctggcgaaa

SEQ ID NO: 76838 - DNA, 25 bp, E. coli
caacggttctgtaggtctggcgaaa

SEQ ID NO: 76839 - DNA, 25 bp, E. coli
ataaactgatcgctgccgctgaggc

SEQ ID NO: 76840 - DNA, 25 bp, E. coli
ataaactgatcggtgccgctgaggc

SEQ ID NO: 76841 - DNA, 25 bp, E. coli
tagcggcgacgcattcatcaacggt

SEQ ID NO: 76842 - DNA, 25 bp, E. coli
tagcggcgacgctttcatcaacggt

SEQ ID NO: 76843 - DNA, 25 bp, E. coli
tatcacgacgcggatgtcacggcat

SEQ ID NO: 76844 - DNA, 25 bp, E. coli
tatcacgacgcgcatgtcacggcat

SEQ ID NO: 76845 - DNA, 25 bp, E. coli
tgtagagatggatgcgacggcaatc

SEQ ID NO: 76846 - DNA, 25 bp, E. coli
tgttgccgctaatcagtccagcctg

SEQ ID NO: 76847 - DNA, 25 bp, E. coli
tgttgccgctaaacagtccagcctg

SEQ ID NO: 76848 - DNA, 25 bp, E. coli
tgtagagatggaagcgacggcaatc

SEQ ID NO: 76849 - DNA, 25 bp, E. coli
tgctgcgtgacataatcgaaaaccg

SEQ ID NO: 76850 - DNA, 25 bp, E. coli
tgctgcgtgacaaaatcgaaaaccg

SEQ ID NO: 76851 - DNA, 25 bp, E. coli
tgcgaaatctattccggccaactga

SEQ ID NO: 76852 - DNA, 25 bp, E. coli
tgcgaaatctataccggccaactga

SEQ ID NO: 76853 - DNA, 25 bp, E. coli
gcgcttctgaaaacgggcatcggta

SEQ ID NO: 76854 - DNA, 25 bp, E. coli
gcgcttctgaaatcgggcatcggta

SEQ ID NO: 76855 - DNA, 25 bp, E. coli
gctgaggcctgctttgccgaactga

SEQ ID NO: 76856 - DNA, 25 bp, E. coli
gctgaggcctgcattgccgaactga

SEQ ID NO: 76857 - DNA, 25 bp, E. coli
gaatcttaacgcagtacgtggcctg

SEQ ID NO: 76858 - DNA, 25 bp, E. coli
gaatcttaacgctgtacgtggcctg

SEQ ID NO: 76859 - DNA, 25 bp, E. coli
taaagagtgtaatgactagtcagga

SEQ ID NO: 76860 - DNA, 25 bp, E. coli
taaagagtgtaaagactagtcagga

SEQ ID NO: 76861 - DNA, 25 bp, E. coli
tagtcaggacataaccacgaggagc

SEQ ID NO: 76862 - DNA, 25 bp, E. coli
tagtcaggacattaccacgaggagc

SEQ ID NO: 76863 - DNA, 25 bp, E. coli
tacgacaatggttcctgtaaagagt

SEQ ID NO: 76864 - DNA, 25 bp, E. coli
tacgacaatggtacctgtaaagagt

SEQ ID NO: 76865 - DNA, 25 bp, E. coli
tatttttccgtagacaacagtcttg

SEQ ID NO: 76866 - DNA, 25 bp, E. coli
tatttttccgtacacaacagtcttg

SEQ ID NO: 76867 - DNA, 25 bp, E. coli
ttacaggttttttagcgcggcagga

SEQ ID NO: 76868 - DNA, 25 bp, E. coli
ttacaggtttttaagcgcggcagga

SEQ ID NO: 76869 - DNA, 25 bp, E. coli
tttatcactcgctgactgctttcag

SEQ ID NO: 76870 - DNA, 25 bp, E. coli
tttatcactcgcagactgctttcag

SEQ ID NO: 76871 - DNA, 25 bp, E. coli
tgccagaggttatggattgtcttac

SEQ ID NO: 76872 - DNA, 25 bp, E. coli
tgccagaggttaaggattgtcttac

SEQ ID NO: 76873 - DNA, 25 bp, E. coli
gaatgcggtatctgtactttatcac

SEQ ID NO: 76874 - DNA, 25 bp, E. coli
gaatgcggtatcagtactttatcac

SEQ ID NO: 76875 - DNA, 25 bp, E. coli
ggttgggccatcttgtacgacaatg

SEQ ID NO: 76876 - DNA, 25 bp, E. coli
ggttgggccatcatgtacgacaatg

SEQ ID NO: 76877 - DNA, 25 bp, E. coli
taaccacgaggagcatgaatgcggt

SEQ ID NO: 76878 - DNA, 25 bp, E. coli
taaccacgaggaccatgaatgcggt

SEQ ID NO: 76879 - DNA, 25 bp, E. coli
gatgcttagcaaaaattgccagagg

SEQ ID NO: 76880 - DNA, 25 bp, E. coli
gatgcttagcaataattgccagagg

SEQ ID NO: 76881 - DNA, 25 bp, E. coli
cagattaggcggcacgttcaacgac

SEQ ID NO: 76882 - DNA, 25 bp, E. coli
cagattaggcgggacgttcaacgac

SEQ ID NO: 76883 - DNA, 25 bp, E. coli
aaatcgccgccgatgtcatggatgc

SEQ ID NO: 76884 - DNA, 25 bp, E. coli
aaatcgccgccgttgtcatggatgc

SEQ ID NO: 76885 - DNA, 25 bp, E. coli
tattacgcttggtacgggctgcggc

SEQ ID NO: 76886 - DNA, 25 bp, E. coli
tattacgcttggaacgggctgcggc

SEQ ID NO: 76887 - DNA, 25 bp, E. coli
tgaacgcagaagtcgctccactggt

SEQ ID NO: 76888 - DNA, 25 bp, E. coli
tgaccctggcgtcattgtgatcggc

SEQ ID NO: 76889 - DNA, 25 bp, E. coli
tgaacgcagaagacgctccactggt

SEQ ID NO: 76890 - DNA, 25 bp, E. coli
tgaccctggcgtgattgtgatcggc

SEQ ID NO: 76891 - DNA, 25 bp, E. coli
gaatgcggtcatatcacgttgccag

SEQ ID NO: 76892 - DNA, 25 bp, E. coli
gaatgcggtcatttcacgttgccag

SEQ ID NO: 76893 - DNA, 25 bp, E. coli
cattgtaaaagcacagcacggcgac

SEQ ID NO: 76894 - DNA, 25 bp, E. coli
ctatcagaagctagcgacggtgccg

SEQ ID NO: 76895 - DNA, 25 bp, E. coli
cattgtaaaagctcagcacggcgac

SEQ ID NO: 76896 - DNA, 25 bp, E. coli
ctatcagaagcttgcgacggtgccg

SEQ ID NO: 76897 - DNA, 25 bp, E. coli
gattgtcaccctcgcacaacgtggt

SEQ ID NO: 76898 - DNA, 25 bp, E. coli
gattgtcaccctggcacaacgtggt

SEQ ID NO: 76899 - DNA, 25 bp, E. coli
ggtaacttgctctcttctgcggcga

SEQ ID NO: 76900 - DNA, 25 bp, E. coli
ggtaacttgctcacttctgcggcga

SEQ ID NO: 76901 - DNA, 25 bp, E. coli
tcaacgaccgatgctgacagggatc

SEQ ID NO: 76902 - DNA, 25 bp, E. coli
tcaacgaccgatcctgacagggatc

SEQ ID NO: 76903 - DNA, 25 bp, E. coli
cacagtgaggccgtgttttggcgct

SEQ ID NO: 76904 - DNA, 25 bp, E. coli
cacagtgaggccctgttttggcgct

SEQ ID NO: 76905 - DNA, 25 bp, E. coli
cagacaaactctgcgggataactca

SEQ ID NO: 76906 - DNA, 25 bp, E. coli
cagtgaggccctgttttggcgctcg

SEQ ID NO: 76907 - DNA, 25 bp, E. coli
cagacaaactctccgggataactca

SEQ ID NO: 76908 - DNA, 25 bp, E. coli
cagtgaggccctcttttggcgctcg

SEQ ID NO: 76909 - DNA, 25 bp, E. coli
taactcatcccgttgacaatcacga

SEQ ID NO: 76910 - DNA, 25 bp, E. coli
aaactctccgggataactcatcccg

SEQ ID NO: 76911 - DNA, 25 bp, E. coli
aaactctccgggttaactcatcccg

SEQ ID NO: 76912 - DNA, 25 bp, E. coli
gcttccctgcactgtgaggccctgt

SEQ ID NO: 76913 - DNA, 25 bp, E. coli
gcttccctgcacagtgaggccctgt

SEQ ID NO: 76914 - DNA, 25 bp, E. coli
ccctgcacagtgtggccctgttttg

SEQ ID NO: 76915 - DNA, 25 bp, E. coli
ccctgcacagtgaggccctgttttg

SEQ ID NO: 76916 - DNA, 25 bp, E. coli
ctgttttggcgcacgtctggtgcaa

SEQ ID NO: 76917 - DNA, 25 bp, E. coli
ctgttttggcgctcgtctggtgcaa

SEQ ID NO: 76918 - DNA, 25 bp, E. coli
gggataactcatcccgatgacaatc

SEQ ID NO: 76919 - DNA, 25 bp, E. coli
gggataactcatgccgatgacaatc

SEQ ID NO: 76920 - DNA, 25 bp, E. coli
gtgtcagacaaagtctccgggataa

SEQ ID NO: 76921 - DNA, 25 bp, E. coli
gtgtcagacaaactctccgggataa

SEQ ID NO: 76922 - DNA, 25 bp, E. coli
taactcatcccgatgacaatcacga

SEQ ID NO: 76923 - DNA, 25 bp, E. coli
gaggccctgtttaggcgctcgtctg

SEQ ID NO: 76924 - DNA, 25 bp, E. coli
gaggccctgttttggcgctcgtctg

SEQ ID NO: 76925 - DNA, 25 bp, E. coli
cagaatcagactgggtacgtgcagg

SEQ ID NO: 76926 - DNA, 25 bp, E. coli
cagaatcagactcggtacgtgcagg

SEQ ID NO: 76927 - DNA, 25 bp, E. coli
tacgtgcaggtggtcgtaatccgga

SEQ ID NO: 76928 - DNA, 25 bp, E. coli
tacgtgcaggtgctcgtaatccgga

SEQ ID NO: 76929 - DNA, 25 bp, E. coli
accctgttaaggtggctgaggcctg

SEQ ID NO: 76930 - DNA, 25 bp, E. coli
aaattcagattcgtggtggagcagc

SEQ ID NO: 76931 - DNA, 25 bp, E. coli
accctgttaaggaggctgaggcctg

SEQ ID NO: 76932 - DNA, 25 bp, E. coli
aaattcagattcctggtggagcagc

SEQ ID NO: 76933 - DNA, 25 bp, E. coli
tggtggagcagcgacagaatcagac

SEQ ID NO: 76934 - DNA, 25 bp, E. coli
tggtggagcagccacagaatcagac

SEQ ID NO: 76935 - DNA, 25 bp, E. coli
tgcaggtggtcgaaatccggatgat

SEQ ID NO: 76936 - DNA, 25 bp, E. coli
tgcaggtggtcgtaatccggatgat

SEQ ID NO: 76937 - DNA, 25 bp, E. coli
tcgtaatccggatgatgtcaaacgt

SEQ ID NO: 76938 - DNA, 25 bp, E. coli
tcagattcgtggaggagcagcgaca

SEQ ID NO: 76939 - DNA, 25 bp, E. coli
tcgtaatccggaagatgtcaaacgt

SEQ ID NO: 76940 - DNA, 25 bp, E. coli
tcagattcgtggtggagcagcgaca

SEQ ID NO: 76941 - DNA, 25 bp, E. coli
tggattgaccctcttaaggaggctg

SEQ ID NO: 76942 - DNA, 25 bp, E. coli
tggattgaccctgttaaggaggctg

SEQ ID NO: 76943 - DNA, 25 bp, E. coli
gaggctgaggccaggaaaattcaga

SEQ ID NO: 76944 - DNA, 25 bp, E. coli
gaggcctggaaatttcagattcgtg

SEQ ID NO: 76945 - DNA, 25 bp, E. coli
gaggcctggaaaattcagattcgtg

SEQ ID NO: 76946 - DNA, 25 bp, E. coli
gaggctgaggcctggaaaattcaga

SEQ ID NO: 76947 - DNA, 25 bp, E. coli
ttcgcgctttttagttcgccgcccg

SEQ ID NO: 76948 - DNA, 25 bp, E. coli
ttcgcgcttttttgttcgccgcccg

SEQ ID NO: 76949 - DNA, 25 bp, E. coli
ttcgccgcccggactttgcctgggt

SEQ ID NO: 76950 - DNA, 25 bp, E. coli
ttcgccgcccggtctttgcctgggt

SEQ ID NO: 76951 - DNA, 25 bp, E. coli
tcgccattttgattatgttggcggg

SEQ ID NO: 76952 - DNA, 25 bp, E. coli
tcgccattttgaatatgttggcggg

SEQ ID NO: 76953 - DNA, 25 bp, E. coli
tctggctattcgcacattgcccgtc

SEQ ID NO: 76954 - DNA, 25 bp, E. coli
tttgcctgggttttcgccattttga

SEQ ID NO: 76955 - DNA, 25 bp, E. coli
tttgcctgggttatcgccattttga

SEQ ID NO: 76956 - DNA, 25 bp, E. coli
tctggctattcggacattgcccgtc

SEQ ID NO: 76957 - DNA, 25 bp, E. coli
gccgcccggtctatgcctgggttat

SEQ ID NO: 76958 - DNA, 25 bp, E. coli
gccgcccggtctttgcctgggttat

SEQ ID NO: 76959 - DNA, 25 bp, E. coli
ccggtctttgcctgggttatcgcca

SEQ ID NO: 76960 - DNA, 25 bp, E. coli
ccggtctttgccagggttatcgcca

SEQ ID NO: 76961 - DNA, 25 bp, E. coli
gtctttgcctggcttatcgccattt

SEQ ID NO: 76962 - DNA, 25 bp, E. coli
gtctttgcctgggttatcgccattt

SEQ ID NO: 76963 - DNA, 25 bp, E. coli
gattctggctattcgcacattgccc

SEQ ID NO: 76964 - DNA, 25 bp, E. coli
gattctggctatacgcacattgccc

SEQ ID NO: 76965 - DNA, 25 bp, E. coli
gggattctggctattcgcacattgc

SEQ ID NO: 76966 - DNA, 25 bp, E. coli
gggattctggcttttcgcacattgc

SEQ ID NO: 76967 - DNA, 25 bp, E. coli
ggctattcgcacattgcccgtcgcg

SEQ ID NO: 76968 - DNA, 25 bp, E. coli
ggctattcgcactttgcccgtcgcg

SEQ ID NO: 76969 - DNA, 25 bp, E. coli
aatatttgccgcttcgttgttaaga

SEQ ID NO: 76970 - DNA, 25 bp, E. coli
aatatttgccgcatcgttgttaaga

SEQ ID NO: 76971 - DNA, 25 bp, E. coli
caccatgatattgatagggattgtg

SEQ ID NO: 76972 - DNA, 25 bp, E. coli
caccatgatattcatagggattgtg

SEQ ID NO: 76973 - DNA, 25 bp, E. coli
tataatttcctttttaagcccacag

SEQ ID NO: 76974 - DNA, 25 bp, E. coli
tataatttccttattaagcccacag

SEQ ID NO: 76975 - DNA, 25 bp, E. coli
tatattcccggtaatctattgtggg

SEQ ID NO: 76976 - DNA, 25 bp, E. coli
tatattcccggttatctattgtggg

SEQ ID NO: 76977 - DNA, 25 bp, E. coli
tttttaagcccagaggagagcaaca

SEQ ID NO: 76978 - DNA, 25 bp, E. coli
tttttaagcccacaggagagcaaca

SEQ ID NO: 76979 - DNA, 25 bp, E. coli
tgcagaagtaatattttcgccggat

SEQ ID NO: 76980 - DNA, 25 bp, E. coli
tgcagaagtaattttttcgccggat

SEQ ID NO: 76981 - DNA, 25 bp, E. coli
cgttgttaagataagtcctggttga

SEQ ID NO: 76982 - DNA, 25 bp, E. coli
cgttgttaagattagtcctggttga

SEQ ID NO: 76983 - DNA, 25 bp, E. coli
gtttctcacgtagtctataatttcc

SEQ ID NO: 76984 - DNA, 25 bp, E. coli
gattgtgattggtatgatccgatta

SEQ ID NO: 76985 - DNA, 25 bp, E. coli
gattgtgattggaatgatccgatta

SEQ ID NO: 76986 - DNA, 25 bp, E. coli
gtttctcacgtactctataatttcc

SEQ ID NO: 76987 - DNA, 25 bp, E. coli
tatcttttgggtaatatattcccgg

SEQ ID NO: 76988 - DNA, 25 bp, E. coli
tcagcatggcaattatttgccgctt

SEQ ID NO: 76989 - DNA, 25 bp, E. coli
tcagcatggcaaatatttgccgctt

SEQ ID NO: 76990 - DNA, 25 bp, E. coli
tatcttttgggttatatattcccgg

SEQ ID NO: 76991 - DNA, 25 bp, E. coli
ctaggtccggtacgtttgtgtggca

SEQ ID NO: 76992 - DNA, 25 bp, E. coli
ctaggtccggtaggtttgtgtggca

SEQ ID NO: 76993 - DNA, 25 bp, E. coli
acgcggcgaagttcaggctgccaaa

SEQ ID NO: 76994 - DNA, 25 bp, E. coli
agttagatggcgaactctcttctgc

SEQ ID NO: 76995 - DNA, 25 bp, E. coli
agttagatggcgtactctcttctgc

SEQ ID NO: 76996 - DNA, 25 bp, E. coli
acgcggcgaagtacaggctgccaaa

SEQ ID NO: 76997 - DNA, 25 bp, E. coli
aaagcagcagatgcgcatggcattc

SEQ ID NO: 76998 - DNA, 25 bp, E. coli
aagtggctccgggtatcaaacgtcc

SEQ ID NO: 76999 - DNA, 25 bp, E. coli
aagtggctccggctatcaaacgtcc

SEQ ID NO: 77000 - DNA, 25 bp, E. coli
aaagcagcagatccgcatggcattc

SEQ ID NO: 77001 - DNA, 25 bp, E. coli
gcgtactctcttgtgctcgtgcact

SEQ ID NO: 77002 - DNA, 25 bp, E. coli
gcgtactctcttctgctcgtgcact

SEQ ID NO: 77003 - DNA, 25 bp, E. coli
gaagttcaggctgccaaagcagcag

SEQ ID NO: 77004 - DNA, 25 bp, E. coli
gaagttcaggctcccaaagcagcag

SEQ ID NO: 77005 - DNA, 25 bp, E. coli
cccgattgaagatgtggctccggct

SEQ ID NO: 77006 - DNA, 25 bp, E. coli
cccgattgaagaagtggctccggct

SEQ ID NO: 77007 - DNA, 25 bp, E. coli
gtcgatgccggtggcgctaggtccg

SEQ ID NO: 77008 - DNA, 25 bp, E. coli
gtcgatgccggtcgcgctaggtccg

SEQ ID NO: 77009 - DNA, 25 bp, E. coli
tggccgccagttagatggcgtactc

SEQ ID NO: 77010 - DNA, 25 bp, E. coli
tggccgccagtttgatggcgtactc

SEQ ID NO: 77011 - DNA, 25 bp, E. coli
tcaaacgtccgatgtggttccagct

SEQ ID NO: 77012 - DNA, 25 bp, E. coli
tcaaacgtccgaagtggttccagct

SEQ ID NO: 77013 - DNA, 25 bp, E. coli
aattatccacttgacagagaatgct

SEQ ID NO: 77014 - DNA, 25 bp, E. coli
aattatccacttcacagagaatgct

SEQ ID NO: 77015 - DNA, 25 bp, E. coli
caggatctgcaaaaattaacaatta

SEQ ID NO: 77016 - DNA, 25 bp, E. coli
caggatctgcaataattaacaatta

SEQ ID NO: 77017 - DNA, 25 bp, E. coli
taacaattatccacttcacagagaa

SEQ ID NO: 77018 - DNA, 25 bp, E. coli
taacaattatcctcttcacagagaa

SEQ ID NO: 77019 - DNA, 25 bp, E. coli
tataattttggtgaatgttttgaca

SEQ ID NO: 77020 - DNA, 25 bp, E. coli
tataattttggtcaatgttttgaca

SEQ ID NO: 77021 - DNA, 25 bp, E. coli
taattattaacgatatgtttcgcat

SEQ ID NO: 77022 - DNA, 25 bp, E. coli
tcttctgacatattacgttactccc

SEQ ID NO: 77023 - DNA, 25 bp, E. coli
tcttctgacataatacgttactccc

SEQ ID NO: 77024 - DNA, 25 bp, E. coli
taattattaacgttatgtttcgcat

SEQ ID NO: 77025 - DNA, 25 bp, E. coli
ccattttctttaatttcttctgaca

SEQ ID NO: 77026 - DNA, 25 bp, E. coli
ccattttctttattttcttctgaca

SEQ ID NO: 77027 - DNA, 25 bp, E. coli
gaatgttttgacttgattaaatcca

SEQ ID NO: 77028 - DNA, 25 bp, E. coli
gaatgttttgacatgattaaatcca

SEQ ID NO: 77029 - DNA, 25 bp, E. coli
gacataatacgtaactccctttaat

SEQ ID NO: 77030 - DNA, 25 bp, E. coli
gacataatacgttactccctttaat

SEQ ID NO: 77031 - DNA, 25 bp, E. coli
cgatatgtttcggatttttctttaa

SEQ ID NO: 77032 - DNA, 25 bp, E. coli
cgatatgtttcgcatttttctttaa

SEQ ID NO: 77033 - DNA, 25 bp, E. coli
tggcaggatctggaataattaacaa

SEQ ID NO: 77034 - DNA, 25 bp, E. coli
tggcaggatctgcaataattaacaa

SEQ ID NO: 77035 - DNA, 25 bp, E. coli
caaagggataaattagcaaaagcgt

SEQ ID NO: 77036 - DNA, 25 bp, E. coli
caaagggataaaatagcaaaagcgt

SEQ ID NO: 77037 - DNA, 25 bp, E. coli
catgcctgcgtcagatttacaaaac

SEQ ID NO: 77038 - DNA, 25 bp, E. coli
catgcctgcgtctgatttacaaaac

SEQ ID NO: 77039 - DNA, 25 bp, E. coli
taaaggcaggtctatcatgcctgcg

SEQ ID NO: 77040 - DNA, 25 bp, E. coli
taaaggcaggtcaatcatgcctgcg

SEQ ID NO: 77041 - DNA, 25 bp, E. coli
aaaatgttattttccgatgccgcac

SEQ ID NO: 77042 - DNA, 25 bp, E. coli
aaaatgttatttaccgatgccgcac

SEQ ID NO: 77043 - DNA, 25 bp, E. coli
aaatacgtttcgttggcgagcgcaa

SEQ ID NO: 77044 - DNA, 25 bp, E. coli
aaatacgtttcgatggcgagcgcaa

SEQ ID NO: 77045 - DNA, 25 bp, E. coli
tttgccggcatcagagaagaaacga

SEQ ID NO: 77046 - DNA, 25 bp, E. coli
tttgccggcatctgagaagaaacga

SEQ ID NO: 77047 - DNA, 25 bp, E. coli
tgagcgtccctctgtaaaggcaggt

SEQ ID NO: 77048 - DNA, 25 bp, E. coli
tgagcgtccctcagtaaaggcaggt

SEQ ID NO: 77049 - DNA, 25 bp, E. coli
tgcagcagtgaaagctaaaaatggt

SEQ ID NO: 77050 - DNA, 25 bp, E. coli
tgcagcagtgaatgctaaaaatggt

SEQ ID NO: 77051 - DNA, 25 bp, E. coli
gattactgccgtaaagaagtttgag

SEQ ID NO: 77052 - DNA, 25 bp, E. coli
gattactgccgttaagaagtttgag

SEQ ID NO: 77053 - DNA, 25 bp, E. coli
tggttataaataggccagtttgccg

SEQ ID NO: 77054 - DNA, 25 bp, E. coli
tggttataaatacgccagtttgccg

SEQ ID NO: 77055 - DNA, 25 bp, E. coli
gacccgctacaatgtcagattactg

SEQ ID NO: 77056 - DNA, 25 bp, E. coli
gacccgctacaaagtcagattactg

SEQ ID NO: 77057 - DNA, 25 bp, E. coli
caatggcctgatcacgttcaacgcg

SEQ ID NO: 77058 - DNA, 25 bp, E. coli
caatggcctgatgacgttcaacgcg

SEQ ID NO: 77059 - DNA, 25 bp, E. coli
aaaggctatagccatactcagggca

SEQ ID NO: 77060 - DNA, 25 bp, E. coli
aaaggctatagcgatactcagggca

SEQ ID NO: 77061 - DNA, 25 bp, E. coli
tatctgaccagtaaatgggacggcg

SEQ ID NO: 77062 - DNA, 25 bp, E. coli
tatctgaccagttaatgggacggcg

SEQ ID NO: 77063 - DNA, 25 bp, E. coli
tataaatcggatgggcgcatcagcg

SEQ ID NO: 77064 - DNA, 25 bp, E. coli
tataaatcggatcggcgcatcagcg

SEQ ID NO: 77065 - DNA, 25 bp, E. coli
tctacgccgtgatgatgaatggtca

SEQ ID NO: 77066 - DNA, 25 bp, E. coli
tcagaacgatgcgaataagaccggc

SEQ ID NO: 77067 - DNA, 25 bp, E. coli
tcagaacgatgccaataagaccggc

SEQ ID NO: 77068 - DNA, 25 bp, E. coli
tctacgccgtgaagatgaatggtca

SEQ ID NO: 77069 - DNA, 25 bp, E. coli
ccggaggccggatgctatatcagca

SEQ ID NO: 77070 - DNA, 25 bp, E. coli
ccggaggccggaagctatatcagca

SEQ ID NO: 77071 - DNA, 25 bp, E. coli
gctatgtattgctgctaggcggcga

SEQ ID NO: 77072 - DNA, 25 bp, E. coli
gctatgtattgcagctaggcggcga

SEQ ID NO: 77073 - DNA, 25 bp, E. coli
cctgttgtggatgcggaaggcccat

SEQ ID NO: 77074 - DNA, 25 bp, E. coli
cctgttgtggatccggaaggcccat

SEQ ID NO: 77075 - DNA, 25 bp, E. coli
taagaccggcgcatatgttgacagc

SEQ ID NO: 77076 - DNA, 25 bp, E. coli
taagaccggcgcttatgttgacagc

SEQ ID NO: 77077 - DNA, 25 bp, E. coli
gatgaacgtgaatggcgatacccaa

SEQ ID NO: 77078 - DNA, 25 bp, E. coli
gatgaacgtgaaaggcgatacccaa

SEQ ID NO: 77079 - DNA, 25 bp, E. coli
attattctccgggttcaccattggt

SEQ ID NO: 77080 - DNA, 25 bp, E. coli
attattctccggcttcaccattggt

SEQ ID NO: 77081 - DNA, 25 bp, E. coli
tattctccgggtacaccattggtcg

SEQ ID NO: 77082 - DNA, 25 bp, E. coli
tattctccgggttcaccattggtcg

SEQ ID NO: 77083 - DNA, 25 bp, E. coli
ttctccgggttcaccattggtcgat

SEQ ID NO: 77084 - DNA, 25 bp, E. coli
ttctccgggttctccattggtcgat

SEQ ID NO: 77085 - DNA, 25 bp, E. coli
tccgggttcacctttggtcgatacc

SEQ ID NO: 77086 - DNA, 25 bp, E. coli
tccgggttcaccattggtcgatacc

SEQ ID NO: 77087 - DNA, 25 bp, E. coli
tgtcacagccttatccgcttgggca

SEQ ID NO: 77088 - DNA, 25 bp, E. coli
tgtcacagccttttccgcttgggca

SEQ ID NO: 77089 - DNA, 25 bp, E. coli
tctgtcacagccatttccgcttggg

SEQ ID NO: 77090 - DNA, 25 bp, E. coli
tctccgggttcagcattggtcgata

SEQ ID NO: 77091 - DNA, 25 bp, E. coli
tctccgggttcaccattggtcgata

SEQ ID NO: 77092 - DNA, 25 bp, E. coli
tctgtcacagccttttccgcttggg

SEQ ID NO: 77093 - DNA, 25 bp, E. coli
gcgtgttctgtcacagccttttccg

SEQ ID NO: 77094 - DNA, 25 bp, E. coli
gcgtgttctgtctcagccttttccg

SEQ ID NO: 77095 - DNA, 25 bp, E. coli
gctgacggcgtgttctgtcacagcc

SEQ ID NO: 77096 - DNA, 25 bp, E. coli
gctgacggcgtgatctgtcacagcc

SEQ ID NO: 77097 - DNA, 25 bp, E. coli
gacggcgtgttcagtcacagccttt

SEQ ID NO: 77098 - DNA, 25 bp, E. coli
gacggcgtgttctgtcacagccttt

SEQ ID NO: 77099 - DNA, 25 bp, E. coli
gggttcaccattggtcgatacccgt

SEQ ID NO: 77100 - DNA, 25 bp, E. coli
gggttcaccattcgtcgatacccgt

SEQ ID NO: 77101 - DNA, 25 bp, E. coli
aatgaaggaggaacacacgtcgacg

SEQ ID NO: 77102 - DNA, 25 bp, E. coli
aatgaaggaggatcacacgtcgacg

SEQ ID NO: 77103 - DNA, 25 bp, E. coli
tactggcagaaatctggctgaccga

SEQ ID NO: 77104 - DNA, 25 bp, E. coli
tacagaactgggtagctggcgcaaa

SEQ ID NO: 77105 - DNA, 25 bp, E. coli
tacagaactgggaagctggcgcaaa

SEQ ID NO: 77106 - DNA, 25 bp, E. coli
tactggcagaaaactggctgaccga

SEQ ID NO: 77107 - DNA, 25 bp, E. coli
aaaatcaaacttgccgatggtagcg

SEQ ID NO: 77108 - DNA, 25 bp, E. coli
aaaatcaaacttcccgatggtagcg

SEQ ID NO: 77109 - DNA, 25 bp, E. coli
tttgtccgtgaacaccgaactgacg

SEQ ID NO: 77110 - DNA, 25 bp, E. coli
tttgtccgtgaagaccgaactgacg

SEQ ID NO: 77111 - DNA, 25 bp, E. coli
tgttaatgagcgtacccgctgggct

SEQ ID NO: 77112 - DNA, 25 bp, E. coli
tgttaatgagcgaacccgctgggct

SEQ ID NO: 77113 - DNA, 25 bp, E. coli
ccaaatatgcaataagcgggcggta

SEQ ID NO: 77114 - DNA, 25 bp, E. coli
ccaaatatgcaaaaagcgggcggta

SEQ ID NO: 77115 - DNA, 25 bp, E. coli
gaactgacgcccattaccggttgtg

SEQ ID NO: 77116 - DNA, 25 bp, E. coli
gaactgacgccctttaccggttgtg

SEQ ID NO: 77117 - DNA, 25 bp, E. coli
gaaatttggcaattaccgctggcca

SEQ ID NO: 77118 - DNA, 25 bp, E. coli
gaaatttggcaaataccgctggcca

SEQ ID NO: 77119 - DNA, 25 bp, E. coli
ccgctgggctgggaattggcaaaat

SEQ ID NO: 77120 - DNA, 25 bp, E. coli
ccgctgggctggcaattggcaaaat

SEQ ID NO: 77121 - DNA, 25 bp, E. coli
gagtattaatgaacgccatccggga

SEQ ID NO: 77122 - DNA, 25 bp, E. coli
gagtattaatgatcgccatccggga

SEQ ID NO: 77123 - DNA, 25 bp, E. coli
agctcacgcaaaggcagttgattaa

SEQ ID NO: 77124 - DNA, 25 bp, E. coli
agctcacgcaaacgcagttgattaa

SEQ ID NO: 77125 - DNA, 25 bp, E. coli
tttgttgataagctcacgcaaacgc

SEQ ID NO: 77126 - DNA, 25 bp, E. coli
ttttgttgataacctcacgcaaacg

SEQ ID NO: 77127 - DNA, 25 bp, E. coli
ttgataagctcaggcaaacgcagtt

SEQ ID NO: 77128 - DNA, 25 bp, E. coli
ttgataagctcacgcaaacgcagtt

SEQ ID NO: 77129 - DNA, 25 bp, E. coli
tttgttgataaggtcacgcaaacgc

SEQ ID NO: 77130 - DNA, 25 bp, E. coli
ttgttgataagcacacgcaaacgca

SEQ ID NO: 77131 - DNA, 25 bp, E. coli
ttttgttgataagctcacgcaaacg

SEQ ID NO: 77132 - DNA, 25 bp, E. coli
ttgttgataagctcacgcaaacgca

SEQ ID NO: 77133 - DNA, 25 bp, E. coli
tgttgataagctgacgcaaacgcag

SEQ ID NO: 77134 - DNA, 25 bp, E. coli
tgttgataagctcacgcaaacgcag

SEQ ID NO: 77135 - DNA, 25 bp, E. coli
ctcacgcaaacggagttgattaatg

SEQ ID NO: 77136 - DNA, 25 bp, E. coli
ctcacgcaaacgcagttgattaatg

SEQ ID NO: 77137 - DNA, 25 bp, E. coli
gatttttgttgaaaagctcacgcaa

SEQ ID NO: 77138 - DNA, 25 bp, E. coli
gttgataagctcacgcaaacgcagt

SEQ ID NO: 77139 - DNA, 25 bp, E. coli
gataagctcacgcaaacgcagttga

SEQ ID NO: 77140 - DNA, 25 bp, E. coli
gttgataagctctcgcaaacgcagt

SEQ ID NO: 77141 - DNA, 25 bp, E. coli
gatttttgttgataagctcacgcaa

SEQ ID NO: 77142 - DNA, 25 bp, E. coli
gataagctcacggaaacgcagttga

SEQ ID NO: 77143 - DNA, 25 bp, E. coli
taagctcacgcatacgcagttgatt

SEQ ID NO: 77144 - DNA, 25 bp, E. coli
taagctcacgcaaacgcagttgatt

SEQ ID NO: 77145 - DNA, 25 bp, E. coli
aatatctgggcttcactgccgggcg

SEQ ID NO: 77146 - DNA, 25 bp, E. coli
aatatctgggctacactgccgggcg

SEQ ID NO: 77147 - DNA, 25 bp, E. coli
cagttcgagcataaggctgacagcc

SEQ ID NO: 77148 - DNA, 25 bp, E. coli
cagttcgagcattaggctgacagcc

SEQ ID NO: 77149 - DNA, 25 bp, E. coli
tatggtcagttccagcataaggctg

SEQ ID NO: 77150 - DNA, 25 bp, E. coli
tatggtcagttcgagcataaggctg

SEQ ID NO: 77151 - DNA, 25 bp, E. coli
ttactgattactgcgatcaccctcg

SEQ ID NO: 77152 - DNA, 25 bp, E. coli
ttactgattactccgatcaccctcg

SEQ ID NO: 77153 - DNA, 25 bp, E. coli
tgatatccgtcacgcaatcgaccgt

SEQ ID NO: 77154 - DNA, 25 bp, E. coli
tgatatccgtcaggcaatcgaccgt

SEQ ID NO: 77155 - DNA, 25 bp, E. coli
tgattactccgatcaccctcgcaaa

SEQ ID NO: 77156 - DNA, 25 bp, E. coli
tgattactccgaacaccctcgcaaa

SEQ ID NO: 77157 - DNA, 25 bp, E. coli
tccgtcaggcaatcgaccgttgcag

SEQ ID NO: 77158 - DNA, 25 bp, E. coli
tccgtcaggcaaacgaccgttgcag

SEQ ID NO: 77159 - DNA, 25 bp, E. coli
gcctgattgcaatattcaaagaagc

SEQ ID NO: 77160 - DNA, 25 bp, E. coli
gcctgattgcaaaattcaaagaagc

SEQ ID NO: 77161 - DNA, 25 bp, E. coli
gctgacagcctgattgcaaaattca

SEQ ID NO: 77162 - DNA, 25 bp, E. coli
gctgacagcctgtttgcaaaattca

SEQ ID NO: 77163 - DNA, 25 bp, E. coli
gcgctggttatggtcagttcgagca

SEQ ID NO: 77164 - DNA, 25 bp, E. coli
gcgctggttatgctcagttcgagca

SEQ ID NO: 77165 - DNA, 25 bp, E. coli
gatcaccctcgcaaacttgtcacgc

SEQ ID NO: 77166 - DNA, 25 bp, E. coli
gatcaccctcgctaacttgtcacgc

SEQ ID NO: 77167 - DNA, 25 bp, E. coli
aattgagagtgctcctgagtatggg

SEQ ID NO: 77168 - DNA, 25 bp, E. coli
aattgagagtgcacctgagtatggg

SEQ ID NO: 77169 - DNA, 25 bp, E. coli
cagagtaaaataattcagtgccaat

SEQ ID NO: 77170 - DNA, 25 bp, E. coli
cagtgccaatttgtttgacggctat

SEQ ID NO: 77171 - DNA, 25 bp, E. coli
cagtgccaatttctttgacggctat

SEQ ID NO: 77172 - DNA, 25 bp, E. coli
cagagtaaaatatttcagtgccaat

SEQ ID NO: 77173 - DNA, 25 bp, E. coli
agcgccctttatttattacacagag

SEQ ID NO: 77174 - DNA, 25 bp, E. coli
agcgccctttatatattacacagag

SEQ ID NO: 77175 - DNA, 25 bp, E. coli
tttacgttctcacgcgtggcaaggg

SEQ ID NO: 77176 - DNA, 25 bp, E. coli
tttacgttctcaggcgtggcaaggg

SEQ ID NO: 77177 - DNA, 25 bp, E. coli
tgtacagggcatgtaagcgcccttt

SEQ ID NO: 77178 - DNA, 25 bp, E. coli
tgtacagggcatctaagcgcccttt

SEQ ID NO: 77179 - DNA, 25 bp, E. coli
tcagatcattggtgaagttgcacat

SEQ ID NO: 77180 - DNA, 25 bp, E. coli
tcagatcattggagaagttgcacat

SEQ ID NO: 77181 - DNA, 25 bp, E. coli
gacggctatcacgtttcaacttcag

SEQ ID NO: 77182 - DNA, 25 bp, E. coli
tcaaacgtggtttttcaccgcccaa

SEQ ID NO: 77183 - DNA, 25 bp, E. coli
tcaaacgtggttattcaccgcccaa

SEQ ID NO: 77184 - DNA, 25 bp, E. coli
ggtgaactttactcgttttagccat

SEQ ID NO: 77185 - DNA, 25 bp, E. coli
ggtgaactttacacgttttagccat

SEQ ID NO: 77186 - DNA, 25 bp, E. coli
gagagcctcgccctgtacagggcat

SEQ ID NO: 77187 - DNA, 25 bp, E. coli
gacggctatcacctttcaacttcag

SEQ ID NO: 77188 - DNA, 25 bp, E. coli
gagagcctcgccgtgtacagggcat

SEQ ID NO: 77189 - DNA, 25 bp, E. coli
caaagcctgctgcatgatgcaatca

SEQ ID NO: 77190 - DNA, 25 bp, E. coli
cacctgaggttgttgggctgccaga

SEQ ID NO: 77191 - DNA, 25 bp, E. coli
cagacggtttttgttctcggccacg

SEQ ID NO: 77192 - DNA, 25 bp, E. coli
cagacggtttttcttctcggccacg

SEQ ID NO: 77193 - DNA, 25 bp, E. coli
caaagcctgctggatgatgcaatca

SEQ ID NO: 77194 - DNA, 25 bp, E. coli
cacctgaggttgatgggctgccaga

SEQ ID NO: 77195 - DNA, 25 bp, E. coli
taaaagtgatgccagtgatatccgg

SEQ ID NO: 77196 - DNA, 25 bp, E. coli
taaaagtgatgcgagtgatatccgg

SEQ ID NO: 77197 - DNA, 25 bp, E. coli
tagcccggtatgtaggcaaagccgt

SEQ ID NO: 77198 - DNA, 25 bp, E. coli
tagcccggtatgaaggcaaagccgt

SEQ ID NO: 77199 - DNA, 25 bp, E. coli
ttacttgaggatcaaagcgcgcgcc

SEQ ID NO: 77200 - DNA, 25 bp, E. coli
ttacttgaggatgaaagcgcgcgcc

SEQ ID NO: 77201 - DNA, 25 bp, E. coli
tgcgcagaccctcatgaaaccggag

SEQ ID NO: 77202 - DNA, 25 bp, E. coli
tgcgcagaccctgatgaaaccggag

SEQ ID NO: 77203 - DNA, 25 bp, E. coli
cctgtgccggagtcaaaggctatcc

SEQ ID NO: 77204 - DNA, 25 bp, E. coli
cctgtgccggagacaaaggctatcc

SEQ ID NO: 77205 - DNA, 25 bp, E. coli
gaaacccgcgcaattggcttcagca

SEQ ID NO: 77206 - DNA, 25 bp, E. coli
gaaacccgcgcatttggcttcagca

SEQ ID NO: 77207 - DNA, 25 bp, E. coli
gatatccgggaactcgaaacccgcg

SEQ ID NO: 77208 - DNA, 25 bp, E. coli
gatatccgggaagtcgaaacccgcg

SEQ ID NO: 77209 - DNA, 25 bp, E. coli
ggttgatacgcactggcatcgagca

SEQ ID NO: 77210 - DNA, 25 bp, E. coli
ggttgatacgcagtggcatcgagca

SEQ ID NO: 77211 - DNA, 25 bp, E. coli
tgccggggtgacattcacaaattcc

SEQ ID NO: 77212 - DNA, 25 bp, E. coli
tgccggggtgactttcacaaattcc

SEQ ID NO: 77213 - DNA, 25 bp, E. coli
tctgccggggtgtcattcacaaatt

SEQ ID NO: 77214 - DNA, 25 bp, E. coli
tctgccggggtgacattcacaaatt

SEQ ID NO: 77215 - DNA, 25 bp, E. coli
ccggggtgacattcacaaattccgc

SEQ ID NO: 77216 - DNA, 25 bp, E. coli
gccggggtgacaatcacaaattccg

SEQ ID NO: 77217 - DNA, 25 bp, E. coli
ccggggtgacatacacaaattccgc

SEQ ID NO: 77218 - DNA, 25 bp, E. coli
gccggggtgacattcacaaattccg

SEQ ID NO: 77219 - DNA, 25 bp, E. coli
gctggtctgccggggtgacattcac

SEQ ID NO: 77220 - DNA, 25 bp, E. coli
gctggtctgccgcggtgacattcac

SEQ ID NO: 77221 - DNA, 25 bp, E. coli
ctggtctgccggggtgacattcaca

SEQ ID NO: 77222 - DNA, 25 bp, E. coli
ctggtctgccggcgtgacattcaca

SEQ ID NO: 77223 - DNA, 25 bp, E. coli
ctgccggggtgagattcacaaattc

SEQ ID NO: 77224 - DNA, 25 bp, E. coli
ctgccggggtgacattcacaaattc

SEQ ID NO: 77225 - DNA, 25 bp, E. coli
gtctgccggggtcacattcacaaat

SEQ ID NO: 77226 - DNA, 25 bp, E. coli
gtctgccggggtgacattcacaaat

SEQ ID NO: 77227 - DNA, 25 bp, E. coli
gtgacattcacaaattccgctgtgt

SEQ ID NO: 77228 - DNA, 25 bp, E. coli
gggtgacattcagaaattccgctgt

SEQ ID NO: 77229 - DNA, 25 bp, E. coli
ggtgacattcactaattccgctgtg

SEQ ID NO: 77230 - DNA, 25 bp, E. coli
gggtgacattcacaaattccgctgt

SEQ ID NO: 77231 - DNA, 25 bp, E. coli
ggtgacattcacaaattccgctgtg

SEQ ID NO: 77232 - DNA, 25 bp, E. coli
gtgacattcacatattccgctgtgt

SEQ ID NO: 77233 - DNA, 25 bp, E. coli
caacgattattatgatgggtgtggc

SEQ ID NO: 77234 - DNA, 25 bp, E. coli
caacgattattaagatgggtgtggc

SEQ ID NO: 77235 - DNA, 25 bp, E. coli
cattacagcggtggtatttttagca

SEQ ID NO: 77236 - DNA, 25 bp, E. coli
cattacagcggtcgtatttttagca

SEQ ID NO: 77237 - DNA, 25 bp, E. coli
tttattggcggcaatgctgccccgg

SEQ ID NO: 77238 - DNA, 25 bp, E. coli
tttattggcggctatgctgccccgg

SEQ ID NO: 77239 - DNA, 25 bp, E. coli
tgtggcgattattgtcgtactcggc

SEQ ID NO: 77240 - DNA, 25 bp, E. coli
tgtgcagcctttgtgcaatttaagc

SEQ ID NO: 77241 - DNA, 25 bp, E. coli
tggtgataacatgcgaatcggtatt

SEQ ID NO: 77242 - DNA, 25 bp, E. coli
tggtgataacatccgaatcggtatt

SEQ ID NO: 77243 - DNA, 25 bp, E. coli
tgtgcagcctttctgcaatttaagc

SEQ ID NO: 77244 - DNA, 25 bp, E. coli
tgtggcgattatagtcgtactcggc

SEQ ID NO: 77245 - DNA, 25 bp, E. coli
tctaaaaaatagcaaaggctgcctg

SEQ ID NO: 77246 - DNA, 25 bp, E. coli
tctaaaaaataggaaaggctgcctg

SEQ ID NO: 77247 - DNA, 25 bp, E. coli
gctgccccgggagcataaagatgaa

SEQ ID NO: 77248 - DNA, 25 bp, E. coli
gctgccccgggaccataaagatgaa

SEQ ID NO: 77249 - DNA, 25 bp, E. coli
gctgggatggtgctaacgtcacctc

SEQ ID NO: 77250 - DNA, 25 bp, E. coli
gctgggatggtggtaacgtcacctc

SEQ ID NO: 77251 - DNA, 25 bp, E. coli
gtcgtactcggctctgagctgggat

SEQ ID NO: 77252 - DNA, 25 bp, E. coli
gtcgtactcggcactgagctgggat

SEQ ID NO: 77253 - DNA, 25 bp, E. coli
ggcgtattcacatccttttgattgg

SEQ ID NO: 77254 - DNA, 25 bp, E. coli
ggcgtattcacaaccttttgattgg

SEQ ID NO: 77255 - DNA, 25 bp, E. coli
cacattgattcacgtacagggagaa

SEQ ID NO: 77256 - DNA, 25 bp, E. coli
cacattgattcaggtacagggagaa

SEQ ID NO: 77257 - DNA, 25 bp, E. coli
aaaaaatatgtcatctgccacgccg

SEQ ID NO: 77258 - DNA, 25 bp, E. coli
aaaaaatatgtcttctgccacgccg

SEQ ID NO: 77259 - DNA, 25 bp, E. coli
tgttctgcggaatcctcacattgat

SEQ ID NO: 77260 - DNA, 25 bp, E. coli
tgttctgcggaaacctcacattgat

SEQ ID NO: 77261 - DNA, 25 bp, E. coli
tgcccataaagctgatgaacttccg

SEQ ID NO: 77262 - DNA, 25 bp, E. coli
tgcccataaagcagatgaacttccg

SEQ ID NO: 77263 - DNA, 25 bp, E. coli
tctttggtcatacgccagcagtgaa

SEQ ID NO: 77264 - DNA, 25 bp, E. coli
tcatcagcaggtaatctggaaccgc

SEQ ID NO: 77265 - DNA, 25 bp, E. coli
tcatcagcaggttatctggaaccgc

SEQ ID NO: 77266 - DNA, 25 bp, E. coli
tctttggtcataggccagcagtgaa

SEQ ID NO: 77267 - DNA, 25 bp, E. coli
gaaagaaatcaatggcgcggacacg

SEQ ID NO: 77268 - DNA, 25 bp, E. coli
gaaagaaatcaaaggcgcggacacg

SEQ ID NO: 77269 - DNA, 25 bp, E. coli
tggaaagccagtagatcatcagcag

SEQ ID NO: 77270 - DNA, 25 bp, E. coli
tggaaccgcgaaggaatcagcaact

SEQ ID NO: 77271 - DNA, 25 bp, E. coli
tggaaagccagttgatcatcagcag

SEQ ID NO: 77272 - DNA, 25 bp, E. coli
tggaaccgcgaacgaatcagcaact

SEQ ID NO: 77273 - DNA, 25 bp, E. coli
tcaatcactggcagcttaatggcgg

SEQ ID NO: 77274 - DNA, 25 bp, E. coli
tcaatcactggctgcttaatggcgg

SEQ ID NO: 77275 - DNA, 25 bp, E. coli
tcagcaactcacaagacgggatcgt

SEQ ID NO: 77276 - DNA, 25 bp, E. coli
tcagcaactcactagacgggatcgt

SEQ ID NO: 77277 - DNA, 25 bp, E. coli
aagtcagaccattacgcgaaagcgc

SEQ ID NO: 77278 - DNA, 25 bp, E. coli
aagtcagaccataacgcgaaagcgc

SEQ ID NO: 77279 - DNA, 25 bp, E. coli
cataacgcgaaagcgcatggcgagg

SEQ ID NO: 77280 - DNA, 25 bp, E. coli
cataacgcgaaaccgcatggcgagg

SEQ ID NO: 77281 - DNA, 25 bp, E. coli
taaattttcgtcgaccgtgcgcttc

SEQ ID NO: 77282 - DNA, 25 bp, E. coli
taaattttcgtccaccgtgcgcttc

SEQ ID NO: 77283 - DNA, 25 bp, E. coli
acgggtgaggtggagtgcgtgcgcc

SEQ ID NO: 77284 - DNA, 25 bp, E. coli
acgggtgaggtgcagtgcgtgcgcc

SEQ ID NO: 77285 - DNA, 25 bp, E. coli
attaaggagttctccacgggtgagg

SEQ ID NO: 77286 - DNA, 25 bp, E. coli
attaaggagttcaccacgggtgagg

SEQ ID NO: 77287 - DNA, 25 bp, E. coli
tagtaattaaggagttctccacggg

SEQ ID NO: 77288 - DNA, 25 bp, E. coli
tagatagcctgtcgttaaattttcg

SEQ ID NO: 77289 - DNA, 25 bp, E. coli
tagtaattaaggtgttctccacggg

SEQ ID NO: 77290 - DNA, 25 bp, E. coli
tagatagcctgtggttaaattttcg

SEQ ID NO: 77291 - DNA, 25 bp, E. coli
gcgcatccggaactgacagtttact

SEQ ID NO: 77292 - DNA, 25 bp, E. coli
gcgcatccggaagtgacagtttact

SEQ ID NO: 77293 - DNA, 25 bp, E. coli
gctaatcaacaaagctaaggttagt

SEQ ID NO: 77294 - DNA, 25 bp, E. coli
gctaatcaacaatgctaaggttagt

SEQ ID NO: 77295 - DNA, 25 bp, E. coli
cgaggtagctggatcatagatagcc

SEQ ID NO: 77296 - DNA, 25 bp, E. coli
cgaggtagctggttcatagatagcc

SEQ ID NO: 77297 - DNA, 25 bp, E. coli
cgcatggcgaggaagctggttcata

SEQ ID NO: 77298 - DNA, 25 bp, E. coli
cgcatggcgaggtagctggttcata

SEQ ID NO: 77299 - DNA, 25 bp, E. coli
caaagtgattctgctggacgagtaa

SEQ ID NO: 77300 - DNA, 25 bp, E. coli
caaagtgattctcctggacgagtaa

SEQ ID NO: 77301 - DNA, 25 bp, E. coli
tatgaccgcctcgagctacggtagc

SEQ ID NO: 77302 - DNA, 25 bp, E. coli
tatgaccgcctccagctacggtagc

SEQ ID NO: 77303 - DNA, 25 bp, E. coli
ttaaagcgcgtaacgccgaactggg

SEQ ID NO: 77304 - DNA, 25 bp, E. coli
ttaaagcgcgtatcgccgaactggg

SEQ ID NO: 77305 - DNA, 25 bp, E. coli
tgtagaagtaatcatccccgaagcg

SEQ ID NO: 77306 - DNA, 25 bp, E. coli
tgtagaagtaatgatccccgaagcg

SEQ ID NO: 77307 - DNA, 25 bp, E. coli
tccccgaagcggtgattaaagcgcg

SEQ ID NO: 77308 - DNA, 25 bp, E. coli
tcgtgaagtgaaggtcccggtagaa

SEQ ID NO: 77309 - DNA, 25 bp, E. coli
tcgtgaagtgaacgtcccggtagaa

SEQ ID NO: 77310 - DNA, 25 bp, E. coli
tccccgaagcggagattaaagcgcg

SEQ ID NO: 77311 - DNA, 25 bp, E. coli
gctggataaaccctcccgtcgtgaa

SEQ ID NO: 77312 - DNA, 25 bp, E. coli
gctggataaaccgtcccgtcgtgaa

SEQ ID NO: 77313 - DNA, 25 bp, E. coli
gcgttacaaagagagcggcagcgat

SEQ ID NO: 77314 - DNA, 25 bp, E. coli
gcgttacaaagacagcggcagcgat

SEQ ID NO: 77315 - DNA, 25 bp, E. coli
cgtgagatcttatgcctgcgcgaac

SEQ ID NO: 77316 - DNA, 25 bp, E. coli
cgtgagatcttaagcctgcgcgaac

SEQ ID NO: 77317 - DNA, 25 bp, E. coli
gttacggcattgattacgcacagcg

SEQ ID NO: 77318 - DNA, 25 bp, E. coli
gttacggcattgtttacgcacagcg

SEQ ID NO: 77319 - DNA, 25 bp, E. coli
ggcatgtccaccacccgtgatgtga

SEQ ID NO: 77320 - DNA, 25 bp, E. coli
ggcatgtccacctcccgtgatgtga

SEQ ID NO: 77321 - DNA, 25 bp, E. coli
tattaccggagatatgacagagtga

SEQ ID NO: 77322 - DNA, 25 bp, E. coli
tttctgatgatgaagcctgacgcca

SEQ ID NO: 77323 - DNA, 25 bp, E. coli
tattaccggagaaatgacagagtga

SEQ ID NO: 77324 - DNA, 25 bp, E. coli
tttttgatacacatagggcccaggg

SEQ ID NO: 77325 - DNA, 25 bp, E. coli
tttttgatacacttagggcccaggg

SEQ ID NO: 77326 - DNA, 25 bp, E. coli
tttctgatgatgtagcctgacgcca

SEQ ID NO: 77327 - DNA, 25 bp, E. coli
tgtcagtccctcgattaggcatgaa

SEQ ID NO: 77328 - DNA, 25 bp, E. coli
tgttcactttttcaggcgtcaggcc

SEQ ID NO: 77329 - DNA, 25 bp, E. coli
tgttcactttttgaggcgtcaggcc

SEQ ID NO: 77330 - DNA, 25 bp, E. coli
tgtcagtccctccattaggcatgaa

SEQ ID NO: 77331 - DNA, 25 bp, E. coli
tctgaagcagactatacggaaaatt

SEQ ID NO: 77332 - DNA, 25 bp, E. coli
tctgaagcagacaatacggaaaatt

SEQ ID NO: 77333 - DNA, 25 bp, E. coli
gaagcctgacgccatattaccggag

SEQ ID NO: 77334 - DNA, 25 bp, E. coli
gaagcctgacgcgatattaccggag

SEQ ID NO: 77335 - DNA, 25 bp, E. coli
cgtaacctcaaagtagtatgtggat

SEQ ID NO: 77336 - DNA, 25 bp, E. coli
cgtaacctcaaactagtatgtggat

SEQ ID NO: 77337 - DNA, 25 bp, E. coli
ggacaacgaagcagacgctaccagt

SEQ ID NO: 77338 - DNA, 25 bp, E. coli
ggactgaaacctgtctattttcggg

SEQ ID NO: 77339 - DNA, 25 bp, E. coli
ggactgaaacctctctattttcggg

SEQ ID NO: 77340 - DNA, 25 bp, E. coli
ggacaacgaagctgacgctaccagt

SEQ ID NO: 77341 - DNA, 25 bp, E. coli
gatcaatatcacaccctgttaaaag

SEQ ID NO: 77342 - DNA, 25 bp, E. coli
gatcaatatcactccctgttaaaag

SEQ ID NO: 77343 - DNA, 25 bp, E. coli
caattgggcaaagatttagaacgct

SEQ ID NO: 77344 - DNA, 25 bp, E. coli
caattgggcaaacatttagaacgct

SEQ ID NO: 77345 - DNA, 25 bp, E. coli
aattgaaggcgatcgcgttcagcgc

SEQ ID NO: 77346 - DNA, 25 bp, E. coli
aattgaaggcgaacgcgttcagcgc

SEQ ID NO: 77347 - DNA, 25 bp, E. coli
aaacggctgcggcttcgctcactgg

SEQ ID NO: 77348 - DNA, 25 bp, E. coli
aaacatggtgctggttcacgccgca

SEQ ID NO: 77349 - DNA, 25 bp, E. coli
aaacggctgcgggttcgctcactgg

SEQ ID NO: 77350 - DNA, 25 bp, E. coli
aaacatggtgctcgttcacgccgca

SEQ ID NO: 77351 - DNA, 25 bp, E. coli
tatcgattctgcaattgggcaaaga

SEQ ID NO: 77352 - DNA, 25 bp, E. coli
tatcgattctgctattgggcaaaga

SEQ ID NO: 77353 - DNA, 25 bp, E. coli
ttagaacgcttcaaaaacatggtgc

SEQ ID NO: 77354 - DNA, 25 bp, E. coli
ttagaacgcttctaaaacatggtgc

SEQ ID NO: 77355 - DNA, 25 bp, E. coli
gccgacttaagctatctacctctga

SEQ ID NO: 77356 - DNA, 25 bp, E. coli
gcgattaccggcgttaattgaaagt

SEQ ID NO: 77357 - DNA, 25 bp, E. coli
ccaaacttggccatgaaattgaagg

SEQ ID NO: 77358 - DNA, 25 bp, E. coli
ccaaacttggccttgaaattgaagg

SEQ ID NO: 77359 - DNA, 25 bp, E. coli
gccgacttaagcaatctacctctga

SEQ ID NO: 77360 - DNA, 25 bp, E. coli
gctcactgggcgtttaccggcgtta

SEQ ID NO: 77361 - DNA, 25 bp, E. coli
gcgattaccggccttaattgaaagt

SEQ ID NO: 77362 - DNA, 25 bp, E. coli
gctatctacctcagatgcaggaact

SEQ ID NO: 77363 - DNA, 25 bp, E. coli
gctatctacctctgatgcaggaact

SEQ ID NO: 77364 - DNA, 25 bp, E. coli
gctcactgggcgattaccggcgtta

SEQ ID NO: 77365 - DNA, 25 bp, E. coli
aacgggcatggtagaacgaattaca

SEQ ID NO: 77366 - DNA, 25 bp, E. coli
aaattggctttttcaccattggcga

SEQ ID NO: 77367 - DNA, 25 bp, E. coli
aacgggcatggttgaacgaattaca

SEQ ID NO: 77368 - DNA, 25 bp, E. coli
aaattggcttttacaccattggcga

SEQ ID NO: 77369 - DNA, 25 bp, E. coli
tgatcgctgtccttcaccgaaaaaa

SEQ ID NO: 77370 - DNA, 25 bp, E. coli
tgatcgctgtccatcaccgaaaaaa

SEQ ID NO: 77371 - DNA, 25 bp, E. coli
tcatcagttgaatgcactgcgggtt

SEQ ID NO: 77372 - DNA, 25 bp, E. coli
tcatcagttgaaagcactgcgggtt

SEQ ID NO: 77373 - DNA, 25 bp, E. coli
gcatttacctgtatgacctacgccg

SEQ ID NO: 77374 - DNA, 25 bp, E. coli
gcatttacctgtttgacctacgccg

SEQ ID NO: 77375 - DNA, 25 bp, E. coli
gaattacaggaacttcttgatcgct

SEQ ID NO: 77376 - DNA, 25 bp, E. coli
gaattacaggaagttcttgatcgct

SEQ ID NO: 77377 - DNA, 25 bp, E. coli
gaaaagattttgatcccctcatcag

SEQ ID NO: 77378 - DNA, 25 bp, E. coli
gaaaagattttgttcccctcatcag

SEQ ID NO: 77379 - DNA, 25 bp, E. coli
cgatggattggtgtgttgctgttca

SEQ ID NO: 77380 - DNA, 25 bp, E. coli
cgatggattggtctgttgctgttca

SEQ ID NO: 77381 - DNA, 25 bp, E. coli
tggatgaaatcaaggaggctcttga

SEQ ID NO: 77382 - DNA, 25 bp, E. coli
tggatgaaatcatggaggctcttga

SEQ ID NO: 77383 - DNA, 25 bp, E. coli
gaggctcttgataatcgttcgtcga

SEQ ID NO: 77384 - DNA, 25 bp, E. coli
gacctacgccgcttggatgaaatca

SEQ ID NO: 77385 - DNA, 25 bp, E. coli
gaggctcttgattatcgttcgtcga

SEQ ID NO: 77386 - DNA, 25 bp, E. coli
gacctacgccgcatggatgaaatca

SEQ ID NO: 77387 - DNA, 25 bp, E. coli
caatgagcatcgtctgggtgttcgc

SEQ ID NO: 77388 - DNA, 25 bp, E. coli
caatgagcatcgactgggtgttcgc

SEQ ID NO: 77389 - DNA, 25 bp, E. coli
caagcctttcagcaagtcgtcagcc

SEQ ID NO: 77390 - DNA, 25 bp, E. coli
caagcctttcaggaagtcgtcagcc

SEQ ID NO: 77391 - DNA, 25 bp, E. coli
cactgggcggcgttgataacatctc

SEQ ID NO: 77392 - DNA, 25 bp, E. coli
cactgggcggcgatgataacatctc

SEQ ID NO: 77393 - DNA, 25 bp, E. coli
tattcctgttgacgaagcggctgcc

SEQ ID NO: 77394 - DNA, 25 bp, E. coli
tattcctgttgaggaagcggctgcc

SEQ ID NO: 77395 - DNA, 25 bp, E. coli
tgtggcctctgcaggtaatgaccgg

SEQ ID NO: 77396 - DNA, 25 bp, E. coli
tgatcctcgagatgagcggcgtgct

SEQ ID NO: 77397 - DNA, 25 bp, E. coli
tgatcctcgagaagagcggcgtgct

SEQ ID NO: 77398 - DNA, 25 bp, E. coli
tgtggcctctgctggtaatgaccgg

SEQ ID NO: 77399 - DNA, 25 bp, E. coli
tgcctgtcatatatcgaacgctggg

SEQ ID NO: 77400 - DNA, 25 bp, E. coli
tgcctgtcatatttcgaacgctggg

SEQ ID NO: 77401 - DNA, 25 bp, E. coli
tcggcggatcgatggtcaaactgct

SEQ ID NO: 77402 - DNA, 25 bp, E. coli
tctggatcggtaccgccatttcggc

SEQ ID NO: 77403 - DNA, 25 bp, E. coli
tctggatcggtagcgccatttcggc

SEQ ID NO: 77404 - DNA, 25 bp, E. coli
tcggcggatcgaaggtcaaactgct

SEQ ID NO: 77405 - DNA, 25 bp, E. coli
gcggcccagggtcaacatgtcgaat

SEQ ID NO: 77406 - DNA, 25 bp, E. coli
gcggcccagggtgaacatgtcgaat

SEQ ID NO: 77407 - DNA, 25 bp, E. coli
ggatcgccgaccataaccattctga

SEQ ID NO: 77408 - DNA, 25 bp, E. coli
ggatcgccgaccttaaccattctga

SEQ ID NO: 77409 - DNA, 25 bp, E. coli
caagatatgaattgtgagcaggcca

SEQ ID NO: 77410 - DNA, 25 bp, E. coli
caagatatgaatagtgagcaggcca

SEQ ID NO: 77411 - DNA, 25 bp, E. coli
cacctcgcagcgtgttggcactctg

SEQ ID NO: 77412 - DNA, 25 bp, E. coli
cacctcgcagcgagttggcactctg

SEQ ID NO: 77413 - DNA, 25 bp, E. coli
tactgtgccttacacgcttggtgcg

SEQ ID NO: 77414 - DNA, 25 bp, E. coli
tactgtgccttagacgcttggtgcg

SEQ ID NO: 77415 - DNA, 25 bp, E. coli
atagccagcaccacgcagcgagttg

SEQ ID NO: 77416 - DNA, 25 bp, E. coli
atagccagcacctcgcagcgagttg

SEQ ID NO: 77417 - DNA, 25 bp, E. coli
gcgcaaagcgttgctaatcgcttcg

SEQ ID NO: 77418 - DNA, 25 bp, E. coli
gcgcaaagcgttcctaatcgcttcg

SEQ ID NO: 77419 - DNA, 25 bp, E. coli
gaaaataatactctgccttacacgc

SEQ ID NO: 77420 - DNA, 25 bp, E. coli
gaaaataatactgtgccttacacgc

SEQ ID NO: 77421 - DNA, 25 bp, E. coli
ctggaatcagcgcaaagcgttgcta

SEQ ID NO: 77422 - DNA, 25 bp, E. coli
ctggaatcagcggaaagcgttgcta

SEQ ID NO: 77423 - DNA, 25 bp, E. coli
ggcactctgctttcacaagatatga

SEQ ID NO: 77424 - DNA, 25 bp, E. coli
tggagaatcaaatagccagcacctc

SEQ ID NO: 77425 - DNA, 25 bp, E. coli
ggcactctgcttacacaagatatga

SEQ ID NO: 77426 - DNA, 25 bp, E. coli
tggagaatcaaaaagccagcacctc

SEQ ID NO: 77427 - DNA, 25 bp, E. coli
tacacgcttggtccgctggaatcag

SEQ ID NO: 77428 - DNA, 25 bp, E. coli
tacacgcttggtgcgctggaatcag

SEQ ID NO: 77429 - DNA, 25 bp, E. coli
gagttggcactcagctttcacaaga

SEQ ID NO: 77430 - DNA, 25 bp, E. coli
gagttggcactctgctttcacaaga

SEQ ID NO: 77431 - DNA, 25 bp, E. coli
cagcggtgggtaacgtattgaaaac

SEQ ID NO: 77432 - DNA, 25 bp, E. coli
cagcggtgggtatcgtattgaaaac

SEQ ID NO: 77433 - DNA, 25 bp, E. coli
aaaaggccaatgtactgcagatagc

SEQ ID NO: 77434 - DNA, 25 bp, E. coli
aaaaggccaatgaactgcagatagc

SEQ ID NO: 77435 - DNA, 25 bp, E. coli
taccgccgaggagtgaaaaggccaa

SEQ ID NO: 77436 - DNA, 25 bp, E. coli
tatcgcccggcaccaattaaaacca

SEQ ID NO: 77437 - DNA, 25 bp, E. coli
tatcgcccggcagcaattaaaacca

SEQ ID NO: 77438 - DNA, 25 bp, E. coli
taccgccgaggactgaaaaggccaa

SEQ ID NO: 77439 - DNA, 25 bp, E. coli
tattaacgactatggtggtcgcccg

SEQ ID NO: 77440 - DNA, 25 bp, E. coli
tattaacgactaaggtggtcgcccg

SEQ ID NO: 77441 - DNA, 25 bp, E. coli
ttgaaaccgtgaagctgtctccccg

SEQ ID NO: 77442 - DNA, 25 bp, E. coli
ttgaaaccgtgatgctgtctccccg

SEQ ID NO: 77443 - DNA, 25 bp, E. coli
tccccgttcagagcagacagtaaaa

SEQ ID NO: 77444 - DNA, 25 bp, E. coli
tccccgttcagaccagacagtaaaa

SEQ ID NO: 77445 - DNA, 25 bp, E. coli
tcaggctgagtagcacaccggatat

SEQ ID NO: 77446 - DNA, 25 bp, E. coli
tcaggctgagtaccacaccggatat

SEQ ID NO: 77447 - DNA, 25 bp, E. coli
tggcagccgttgctctgtgaaaaaa

SEQ ID NO: 77448 - DNA, 25 bp, E. coli
tggcagccgttggtctgtgaaaaaa

SEQ ID NO: 77449 - DNA, 25 bp, E. coli
taatctccgggaaataccgccgagg

SEQ ID NO: 77450 - DNA, 25 bp, E. coli
taatctccgggatataccgccgagg

SEQ ID NO: 77451 - DNA, 25 bp, E. coli
taattctgaacatagtcagcggtgg

SEQ ID NO: 77452 - DNA, 25 bp, E. coli
taattctgaacaaagtcagcggtgg

SEQ ID NO: 77453 - DNA, 25 bp, E. coli
caagttgcgccatatccgcgaaggt

SEQ ID NO: 77454 - DNA, 25 bp, E. coli
caagttgcgccaaatccgcgaaggt

SEQ ID NO: 77455 - DNA, 25 bp, E. coli
cagctggcgaaagcgcaatctgacc

SEQ ID NO: 77456 - DNA, 25 bp, E. coli
cagctggcgaaaccgcaatctgacc

SEQ ID NO: 77457 - DNA, 25 bp, E. coli
tacatgcaatctccgtggacacgcg

SEQ ID NO: 77458 - DNA, 25 bp, E. coli
tacatgcaatctgcgtggacacgcg

SEQ ID NO: 77459 - DNA, 25 bp, E. coli
tttctgccgaagaactcgataccgc

SEQ ID NO: 77460 - DNA, 25 bp, E. coli
tattttgaagaatccaagttgcgcc

SEQ ID NO: 77461 - DNA, 25 bp, E. coli
tattttgaagaaaccaagttgcgcc

SEQ ID NO: 77462 - DNA, 25 bp, E. coli
tttctgccgaagtactcgataccgc

SEQ ID NO: 77463 - DNA, 25 bp, E. coli
tgtcgggcaccacctgtagcattgc

SEQ ID NO: 77464 - DNA, 25 bp, E. coli
tgtcgggcaccagctgtagcattgc

SEQ ID NO: 77465 - DNA, 25 bp, E. coli
tgaatataaaagacaaccagctggt

SEQ ID NO: 77466 - DNA, 25 bp, E. coli
tgaatataaaagtcaaccagctggt

SEQ ID NO: 77467 - DNA, 25 bp, E. coli
gaacaggtttctatcaccccacagg

SEQ ID NO: 77468 - DNA, 25 bp, E. coli
gaaaccgctgtttgcccttgtcgac

SEQ ID NO: 77469 - DNA, 25 bp, E. coli
gaaagtgactcaagccttattccgg

SEQ ID NO: 77470 - DNA, 25 bp, E. coli
gaaaccgctgttagcccttgtcgac

SEQ ID NO: 77471 - DNA, 25 bp, E. coli
gaaagtgactcatgccttattccgg

SEQ ID NO: 77472 - DNA, 25 bp, E. coli
gaacaggtttctttcaccccacagg

SEQ ID NO: 77473 - DNA, 25 bp, E. coli
gataaaacgccctttcagatcgccg

SEQ ID NO: 77474 - DNA, 25 bp, E. coli
gataaaacgcccattcagatcgccg

SEQ ID NO: 77475 - DNA, 25 bp, E. coli
caacgtaaagcagtatcatgcggcg

SEQ ID NO: 77476 - DNA, 25 bp, E. coli
caacgtaaagcactatcatgcggcg

SEQ ID NO: 77477 - DNA, 25 bp, E. coli
aaacggcgctagtttacgccctgtg

SEQ ID NO: 77478 - DNA, 25 bp, E. coli
aaacggcgctagattacgccctgtg

SEQ ID NO: 77479 - DNA, 25 bp, E. coli
tcatgcggcggcacgaaaaaagggt

SEQ ID NO: 77480 - DNA, 25 bp, E. coli
tcatgcggcggctcgaaaaaagggt

SEQ ID NO: 77481 - DNA, 25 bp, E. coli
gcggctcgaaaatagggtaagcacg

SEQ ID NO: 77482 - DNA, 25 bp, E. coli
gcggctcgaaaaaagggtaagcacg

SEQ ID NO: 77483 - DNA, 25 bp, E. coli
cgccctgtgagtgcgtaagcaaact

SEQ ID NO: 77484 - DNA, 25 bp, E. coli
cgattgcgtgaaaattaaccattgc

SEQ ID NO: 77485 - DNA, 25 bp, E. coli
cgccctgtgagtccgtaagcaaact

SEQ ID NO: 77486 - DNA, 25 bp, E. coli
cgattgcgtgaatattaaccattgc

SEQ ID NO: 77487 - DNA, 25 bp, E. coli
tgttaaggtaacagacgtgtcgtac

SEQ ID NO: 77488 - DNA, 25 bp, E. coli
tgttaaggtaactgacgtgtcgtac

SEQ ID NO: 77489 - DNA, 25 bp, E. coli
taaccattgcatagtcaacgtaaag

SEQ ID NO: 77490 - DNA, 25 bp, E. coli
taaccattgcattgtcaacgtaaag

SEQ ID NO: 77491 - DNA, 25 bp, E. coli
tcaccccaatggttaatcaaaaagg

SEQ ID NO: 77492 - DNA, 25 bp, E. coli
tcaccccaatggataatcaaaaagg

SEQ ID NO: 77493 - DNA, 25 bp, E. coli
taagcaaactaggttaacgattgcg

SEQ ID NO: 77494 - DNA, 25 bp, E. coli
taagcaaactagcttaacgattgcg

SEQ ID NO: 77495 - DNA, 25 bp, E. coli
gtgtcgtacgtaatgggttccctca

SEQ ID NO: 77496 - DNA, 25 bp, E. coli
gtgtcgtacgtattgggttccctca

SEQ ID NO: 77497 - DNA, 25 bp, E. coli
caatactgggatttgaatacggccc

SEQ ID NO: 77498 - DNA, 25 bp, E. coli
aaggtttgtataccgctgacccgcg

SEQ ID NO: 77499 - DNA, 25 bp, E. coli
aaggtttgtatagcgctgacccgcg

SEQ ID NO: 77500 - DNA, 25 bp, E. coli
caatactgggatatgaatacggccc

SEQ ID NO: 77501 - DNA, 25 bp, E. coli
cagacgctggtgctaaaactcggca

SEQ ID NO: 77502 - DNA, 25 bp, E. coli
cagacgctggtggtaaaactcggca

SEQ ID NO: 77503 - DNA, 25 bp, E. coli
tacggcattgatcacgcactgcgcg

SEQ ID NO: 77504 - DNA, 25 bp, E. coli
taaacgctggatattcggtgcgccg

SEQ ID NO: 77505 - DNA, 25 bp, E. coli
taaacgctggattttcggtgcgccg

SEQ ID NO: 77506 - DNA, 25 bp, E. coli
tacggcattgatgacgcactgcgcg

SEQ ID NO: 77507 - DNA, 25 bp, E. coli
accagtgtgctaacaggcggatcgc

SEQ ID NO: 77508 - DNA, 25 bp, E. coli
accagtgtgctatcaggcggatcgc

SEQ ID NO: 77509 - DNA, 25 bp, E. coli
tatcgacaccataattgccgcgggc

SEQ ID NO: 77510 - DNA, 25 bp, E. coli
tatcgacaccattattgccgcgggc

SEQ ID NO: 77511 - DNA, 25 bp, E. coli
tccgcttgaaaaccgtaaacgctgg

SEQ ID NO: 77512 - DNA, 25 bp, E. coli
tccgcttgaaaagcgtaaacgctgg

SEQ ID NO: 77513 - DNA, 25 bp, E. coli
gccggacaccactcgcaagaaattg

SEQ ID NO: 77514 - DNA, 25 bp, E. coli
gccggacaccacacgcaagaaattg

SEQ ID NO: 77515 - DNA, 25 bp, E. coli
gttacaacagcgttgcattacgccg

SEQ ID NO: 77516 - DNA, 25 bp, E. coli
gttgaacttgttcgccagtgcgcgc

SEQ ID NO: 77517 - DNA, 25 bp, E. coli
gttgaacttgttggccagtgcgcgc

SEQ ID NO: 77518 - DNA, 25 bp, E. coli
gttacaacagcgatgcattacgccg

SEQ ID NO: 77519 - DNA, 25 bp, E. coli
atgcgataaacgtcttgtccggcct

SEQ ID NO: 77520 - DNA, 25 bp, E. coli
atgcgataaacgacttgtccggcct

SEQ ID NO: 77521 - DNA, 25 bp, E. coli
aaatagttctgaatacgcggctggc

SEQ ID NO: 77522 - DNA, 25 bp, E. coli
aaatagttctgattacgcggctggc

SEQ ID NO: 77523 - DNA, 25 bp, E. coli
tttgtatgcccatcccagcacgact

SEQ ID NO: 77524 - DNA, 25 bp, E. coli
tttgtatgcccaacccagcacgact

SEQ ID NO: 77525 - DNA, 25 bp, E. coli
tgatgactgccgtgaacgtgcattt

SEQ ID NO: 77526 - DNA, 25 bp, E. coli
tgatgactgccgagaacgtgcattt

SEQ ID NO: 77527 - DNA, 25 bp, E. coli
tcgcccgtaggcagtcattaaatag

SEQ ID NO: 77528 - DNA, 25 bp, E. coli
tcgcccgtaggctgtcattaaatag

SEQ ID NO: 77529 - DNA, 25 bp, E. coli
tccggcctacggatggcgtgagaat

SEQ ID NO: 77530 - DNA, 25 bp, E. coli
tccggcctacggttggcgtgagaat

SEQ ID NO: 77531 - DNA, 25 bp, E. coli
cctacggatggcgcgggaatttgta

SEQ ID NO: 77532 - DNA, 25 bp, E. coli
cctacggatggcccgggaatttgta

SEQ ID NO: 77533 - DNA, 25 bp, E. coli
cgagaacgtgcaatttgtatgccca

SEQ ID NO: 77534 - DNA, 25 bp, E. coli
cgagaacgtgcattttgtatgccca

SEQ ID NO: 77535 - DNA, 25 bp, E. coli
cgactgccggatgcgataaacgtct

SEQ ID NO: 77536 - DNA, 25 bp, E. coli
cgactgccggatccgataaacgtct

SEQ ID NO: 77537 - DNA, 25 bp, E. coli
tgtccggcctacttttcgcccgtag

SEQ ID NO: 77538 - DNA, 25 bp, E. coli
tgtccggcctacatttcgcccgtag

SEQ ID NO: 77539 - DNA, 25 bp, E. coli
ggcgtgagaatttgtaggtctgata

SEQ ID NO: 77540 - DNA, 25 bp, E. coli
ggcgtgagaattagtaggtctgata

SEQ ID NO: 77541 - DNA, 25 bp, E. coli
caggtattgcccttaaaatgacgga

SEQ ID NO: 77542 - DNA, 25 bp, E. coli
caggtattgcccataaaatgacgga

SEQ ID NO: 77543 - DNA, 25 bp, E. coli
taaagcgggcgaacagcaaattatc

SEQ ID NO: 77544 - DNA, 25 bp, E. coli
taaagcgggcgatcagcaaattatc

SEQ ID NO: 77545 - DNA, 25 bp, E. coli
taaaagctggataggtacttacggc

SEQ ID NO: 77546 - DNA, 25 bp, E. coli
aactgatgcagccaaaacgtgtgcg

SEQ ID NO: 77547 - DNA, 25 bp, E. coli
aactgatgcagcgaaaacgtgtgcg

SEQ ID NO: 77548 - DNA, 25 bp, E. coli
ttttggcaagttcgtatccggcgcg

SEQ ID NO: 77549 - DNA, 25 bp, E. coli
ttttggcaagttggtatccggcgcg

SEQ ID NO: 77550 - DNA, 25 bp, E. coli
tgaacggctttgtacgcgaactgaa

SEQ ID NO: 77551 - DNA, 25 bp, E. coli
tgaacggctttgaacgcgaactgaa

SEQ ID NO: 77552 - DNA, 25 bp, E. coli
tgcgcgagtccttagcggccagtaa

SEQ ID NO: 77553 - DNA, 25 bp, E. coli
tgcgcgagtcctaagcggccagtaa

SEQ ID NO: 77554 - DNA, 25 bp, E. coli
tcggaattgcactggctggacgtct

SEQ ID NO: 77555 - DNA, 25 bp, E. coli
tcggaattgcacaggctggacgtct

SEQ ID NO: 77556 - DNA, 25 bp, E. coli
gcgcggcgcgcctgtaatattgacc

SEQ ID NO: 77557 - DNA, 25 bp, E. coli
gcgcggcgcgccagtaatattgacc

SEQ ID NO: 77558 - DNA, 25 bp, E. coli
gcaatccaggtgaagggcgttaacc

SEQ ID NO: 77559 - DNA, 25 bp, E. coli
gcaatccaggtgtagggcgttaacc

SEQ ID NO: 77560 - DNA, 25 bp, E. coli
gaaagacaagagtggcgatatcgca

SEQ ID NO: 77561 - DNA, 25 bp, E. coli
gaaagacaagagaggcgatatcgca

SEQ ID NO: 77562 - DNA, 25 bp, E. coli
taaaagctggattggtacttacggc

SEQ ID NO: 77563 - DNA, 25 bp, E. coli
cagcgcgcggtaatcaatggaatga

SEQ ID NO: 77564 - DNA, 25 bp, E. coli
cagcgttggcgatttttataggtcc

SEQ ID NO: 77565 - DNA, 25 bp, E. coli
cagcgttggcgaattttataggtcc

SEQ ID NO: 77566 - DNA, 25 bp, E. coli
cagcgaacggcaaacaggtaaaagt

SEQ ID NO: 77567 - DNA, 25 bp, E. coli
caaacacgccgtagcggttaaggca

SEQ ID NO: 77568 - DNA, 25 bp, E. coli
caaacacgccgttgcggttaaggca

SEQ ID NO: 77569 - DNA, 25 bp, E. coli
cagcgaacggcatacaggtaaaagt

SEQ ID NO: 77570 - DNA, 25 bp, E. coli
cagcgcgcggtattcaatggaatga

SEQ ID NO: 77571 - DNA, 25 bp, E. coli
catcgagtttttctgtgtgcaccaa

SEQ ID NO: 77572 - DNA, 25 bp, E. coli
catcgagtttttgtgtgtgcaccaa

SEQ ID NO: 77573 - DNA, 25 bp, E. coli
aaacaactccagctcgccgagatcg

SEQ ID NO: 77574 - DNA, 25 bp, E. coli
aaacaactccaggtcgccgagatcg

SEQ ID NO: 77575 - DNA, 25 bp, E. coli
taggtccatgccgactgcgtaggcg

SEQ ID NO: 77576 - DNA, 25 bp, E. coli
taggtccatgcccactgcgtaggcg

SEQ ID NO: 77577 - DNA, 25 bp, E. coli
tgtgcaccaattgcgtgatggcctg

SEQ ID NO: 77578 - DNA, 25 bp, E. coli
tgtgcaccaattccgtgatggcctg

SEQ ID NO: 77579 - DNA, 25 bp, E. coli
gaacggcgtagagattttcaccaaa

SEQ ID NO: 77580 - DNA, 25 bp, E. coli
gaacggcgtagacattttcaccaaa

SEQ ID NO: 77581 - DNA, 25 bp, E. coli
gatcgtttttcaccagttgccagcg

SEQ ID NO: 77582 - DNA, 25 bp, E. coli
gatcgtttttcagcagttgccagcg

SEQ ID NO: 77583 - DNA, 25 bp, E. coli
gtaaaagtcctgttccagcgcgcgg

SEQ ID NO: 77584 - DNA, 25 bp, E. coli
gtaaaagtcctgatccagcgcgcgg

SEQ ID NO: 77585 - DNA, 25 bp, E. coli
cagactctgtaaggaccaaagatgg

SEQ ID NO: 77586 - DNA, 25 bp, E. coli
cagcgataatcaggcgcgtgttacc

SEQ ID NO: 77587 - DNA, 25 bp, E. coli
cagactctgtaacgaccaaagatgg

SEQ ID NO: 77588 - DNA, 25 bp, E. coli
cagcgataatcacgcgcgtgttacc

SEQ ID NO: 77589 - DNA, 25 bp, E. coli
acctcctccagtattggtggcggca

SEQ ID NO: 77590 - DNA, 25 bp, E. coli
acctcctccagttttggtggcggca

SEQ ID NO: 77591 - DNA, 25 bp, E. coli
tgtacgccgtggctttggcgcaaac

SEQ ID NO: 77592 - DNA, 25 bp, E. coli
tgtacgccgtgggtttggcgcaaac

SEQ ID NO: 77593 - DNA, 25 bp, E. coli
tcagctggcgtatcgccttaccggg

SEQ ID NO: 77594 - DNA, 25 bp, E. coli
tcagctggcgtaacgccttaccggg

SEQ ID NO: 77595 - DNA, 25 bp, E. coli
gctacattggcgttcttccaccaga

SEQ ID NO: 77596 - DNA, 25 bp, E. coli
gctacattggcgatcttccaccaga

SEQ ID NO: 77597 - DNA, 25 bp, E. coli
gactcaggatgcttttgtacgccgt

SEQ ID NO: 77598 - DNA, 25 bp, E. coli
gactcaggatgcatttgtacgccgt

SEQ ID NO: 77599 - DNA, 25 bp, E. coli
cgacaacgctggatgaggcgcttta

SEQ ID NO: 77600 - DNA, 25 bp, E. coli
cgacaacgctggttgaggcgcttta

SEQ ID NO: 77601 - DNA, 25 bp, E. coli
tggaaaaccagaatgcgacaacgct

SEQ ID NO: 77602 - DNA, 25 bp, E. coli
tggaaaaccagattgcgacaacgct

SEQ ID NO: 77603 - DNA, 25 bp, E. coli
tcactgctttttgcggcaccgatga

SEQ ID NO: 77604 - DNA, 25 bp, E. coli
tcactgctttttccggcaccgatga

SEQ ID NO: 77605 - DNA, 25 bp, E. coli
gatgattcatgctacagactctgta

SEQ ID NO: 77606 - DNA, 25 bp, E. coli
gatgattcatgcaacagactctgta

SEQ ID NO: 77607 - DNA, 25 bp, E. coli
caattggtatccctctggcgaagaa

SEQ ID NO: 77608 - DNA, 25 bp, E. coli
caattggtatccgtctggcgaagaa

SEQ ID NO: 77609 - DNA, 25 bp, E. coli
cagctatctgcatcatgacgcggga

SEQ ID NO: 77610 - DNA, 25 bp, E. coli
cagctatctgcaacatgacgcggga

SEQ ID NO: 77611 - DNA, 25 bp, E. coli
catttagtcgccaccatcggtggtg

SEQ ID NO: 77612 - DNA, 25 bp, E. coli
catttagtcgcctccatcggtggtg

SEQ ID NO: 77613 - DNA, 25 bp, E. coli
taacaacttcggtatcgccgggatg

SEQ ID NO: 77614 - DNA, 25 bp, E. coli
taacaacttcggaatcgccgggatg

SEQ ID NO: 77615 - DNA, 25 bp, E. coli
tatgtgtaaggccatgaaccgttcc

SEQ ID NO: 77616 - DNA, 25 bp, E. coli
tatgctggtgtgcaaaacccgctgt

SEQ ID NO: 77617 - DNA, 25 bp, E. coli
tatgtgtaaggcgatgaaccgttcc

SEQ ID NO: 77618 - DNA, 25 bp, E. coli
tatgctggtgtggaaaacccgctgt

SEQ ID NO: 77619 - DNA, 25 bp, E. coli
tttggtgacgccaaagccagcgtgg

SEQ ID NO: 77620 - DNA, 25 bp, E. coli
tttggtgacgcctaagccagcgtgg

SEQ ID NO: 77621 - DNA, 25 bp, E. coli
gaaatgaccgaaatgccagaactgg

SEQ ID NO: 77622 - DNA, 25 bp, E. coli
gaaacatgaaacgtctcgccagggt

SEQ ID NO: 77623 - DNA, 25 bp, E. coli
gaaatgaccgaattgccagaactgg

SEQ ID NO: 77624 - DNA, 25 bp, E. coli
gaaacatgaaacctctcgccagggt

SEQ ID NO: 77625 - DNA, 25 bp, E. coli
gatgctgaactcctactccggctgg

SEQ ID NO: 77626 - DNA, 25 bp, E. coli
gatgactttgctgataccgataccg

SEQ ID NO: 77627 - DNA, 25 bp, E. coli
gatgactttgctcataccgataccg

SEQ ID NO: 77628 - DNA, 25 bp, E. coli
gatgctgaactcgtactccggctgg

SEQ ID NO: 77629 - DNA, 25 bp, E. coli
cacccggtgtgtgcaatatacgaaa

SEQ ID NO: 77630 - DNA, 25 bp, E. coli
cacccggtgtgtccaatatacgaaa

SEQ ID NO: 77631 - DNA, 25 bp, E. coli
tatatgttctgtactctcttgcgca

SEQ ID NO: 77632 - DNA, 25 bp, E. coli
tatatgttctgttctctcttgcgca

SEQ ID NO: 77633 - DNA, 25 bp, E. coli
tgtcgccagttgacgaaccccggtc

SEQ ID NO: 77634 - DNA, 25 bp, E. coli
tgtcgccagttgtcgaaccccggtc

SEQ ID NO: 77635 - DNA, 25 bp, E. coli
tgactgagtaaccagacagttgatg

SEQ ID NO: 77636 - DNA, 25 bp, E. coli
tgactgagtaacgagacagttgatg

SEQ ID NO: 77637 - DNA, 25 bp, E. coli
gctcactgcgttcacggtctgtcca

SEQ ID NO: 77638 - DNA, 25 bp, E. coli
gcgcattttgattgttgactgagta

SEQ ID NO: 77639 - DNA, 25 bp, E. coli
gcgcattttgatagttgactgagta

SEQ ID NO: 77640 - DNA, 25 bp, E. coli
gctcactgcgttgacggtctgtcca

SEQ ID NO: 77641 - DNA, 25 bp, E. coli
gacagttgatgtccacgatttcccc

SEQ ID NO: 77642 - DNA, 25 bp, E. coli
gacagttgatgtgcacgatttcccc

SEQ ID NO: 77643 - DNA, 25 bp, E. coli
ccccggtgtgtggaatacacgaaaa

SEQ ID NO: 77644 - DNA, 25 bp, E. coli
ccccggtgtgtgcaatacacgaaaa

SEQ ID NO: 77645 - DNA, 25 bp, E. coli
ccccggtgtgtgcaatatacgaaaa

SEQ ID NO: 77646 - DNA, 25 bp, E. coli
ccccggtgtgtggaatatacgaaaa

SEQ ID NO: 77647 - DNA, 25 bp, E. coli
gataggaagtgaccagataatacat

SEQ ID NO: 77648 - DNA, 25 bp, E. coli
gataggaagtgagcagataatacat

SEQ ID NO: 77649 - DNA, 25 bp, E. coli
ggtctgtccaactggctgtcgccag

SEQ ID NO: 77650 - DNA, 25 bp, E. coli
ggtctgtccaacaggctgtcgccag

SEQ ID NO: 77651 - DNA, 25 bp, E. coli
caaattcggctatctgaggttcaga

SEQ ID NO: 77652 - DNA, 25 bp, E. coli
caaattcggctaactgaggttcaga

SEQ ID NO: 77653 - DNA, 25 bp, E. coli
tacgattgatgggagagtgtaaccg

SEQ ID NO: 77654 - DNA, 25 bp, E. coli
tacgattgatggcagagtgtaaccg

SEQ ID NO: 77655 - DNA, 25 bp, E. coli
tatacatacttatccaccgaacgca

SEQ ID NO: 77656 - DNA, 25 bp, E. coli
tatacatacttaaccaccgaacgca

SEQ ID NO: 77657 - DNA, 25 bp, E. coli
gctagtaaagtatacagccttcggg

SEQ ID NO: 77658 - DNA, 25 bp, E. coli
gcattgttaggttgccaaattcggc

SEQ ID NO: 77659 - DNA, 25 bp, E. coli
gctagtaaagtaaacagccttcggg

SEQ ID NO: 77660 - DNA, 25 bp, E. coli
gcattgttaggtagccaaattcggc

SEQ ID NO: 77661 - DNA, 25 bp, E. coli
gaaaatgattacacctcagacccat

SEQ ID NO: 77662 - DNA, 25 bp, E. coli
gaaaatgattactcctcagacccat

SEQ ID NO: 77663 - DNA, 25 bp, E. coli
cgaacgcaagcgaattgctagtaaa

SEQ ID NO: 77664 - DNA, 25 bp, E. coli
cgaacgcaagcgtattgctagtaaa

SEQ ID NO: 77665 - DNA, 25 bp, E. coli
ccccgattgggagcattgttaggta

SEQ ID NO: 77666 - DNA, 25 bp, E. coli
ccccgattgggaccattgttaggta

SEQ ID NO: 77667 - DNA, 25 bp, E. coli
gttcttacgtagctccccgattggg

SEQ ID NO: 77668 - DNA, 25 bp, E. coli
gttcttacgtaggtccccgattggg

SEQ ID NO: 77669 - DNA, 25 bp, E. coli
gaggttcagattcaacctgctgtca

SEQ ID NO: 77670 - DNA, 25 bp, E. coli
gagaccagagctccaattattttat

SEQ ID NO: 77671 - DNA, 25 bp, E. coli
gaggttcagattgaacctgctgtca

SEQ ID NO: 77672 - DNA, 25 bp, E. coli
gagaccagagctgcaattattttat

SEQ ID NO: 77673 - DNA, 25 bp, E. coli
cacgcggcgcaaagttaatcgatat

SEQ ID NO: 77674 - DNA, 25 bp, E. coli
cacaagaattaaacgcacgcggcgc

SEQ ID NO: 77675 - DNA, 25 bp, E. coli
cacgcggcgcaatgttaatcgatat

SEQ ID NO: 77676 - DNA, 25 bp, E. coli
cacaagaattaatcgcacgcggcgc

SEQ ID NO: 77677 - DNA, 25 bp, E. coli
aaattatattccactgccaggcagg

SEQ ID NO: 77678 - DNA, 25 bp, E. coli
aaattatattcctctgccaggcagg

SEQ ID NO: 77679 - DNA, 25 bp, E. coli
tattcctgaagctgatctggctcca

SEQ ID NO: 77680 - DNA, 25 bp, E. coli
tattcctgaagcagatctggctcca

SEQ ID NO: 77681 - DNA, 25 bp, E. coli
tttactcgaagaagggattgatggc

SEQ ID NO: 77682 - DNA, 25 bp, E. coli
tttactcgaagatgggattgatggc

SEQ ID NO: 77683 - DNA, 25 bp, E. coli
tgttagataagaagccgtggaacca

SEQ ID NO: 77684 - DNA, 25 bp, E. coli
tgttagataagatgccgtggaacca

SEQ ID NO: 77685 - DNA, 25 bp, E. coli
gccaggcaggtaaacgcaccagtaa

SEQ ID NO: 77686 - DNA, 25 bp, E. coli
gccaggcaggtatacgcaccagtaa

SEQ ID NO: 77687 - DNA, 25 bp, E. coli
ccttgccgttaaagcgccaggtgca

SEQ ID NO: 77688 - DNA, 25 bp, E. coli
ccttgccgttaatgcgccaggtgca

SEQ ID NO: 77689 - DNA, 25 bp, E. coli
gctttgacaaccttttcgccgcatg

SEQ ID NO: 77690 - DNA, 25 bp, E. coli
gctttgacaaccatttcgccgcatg

SEQ ID NO: 77691 - DNA, 25 bp, E. coli
cgccgcatgatggacaagaattaat

SEQ ID NO: 77692 - DNA, 25 bp, E. coli
cgccgcatgatgcacaagaattaat

SEQ ID NO: 77693 - DNA, 25 bp, E. coli
gataaattagcaccgattgccgccc

SEQ ID NO: 77694 - DNA, 25 bp, E. coli
gataaattagcagcgattgccgccc

SEQ ID NO: 77695 - DNA, 25 bp, E. coli
caagtttggtgctgtacgtacacgc

SEQ ID NO: 77696 - DNA, 25 bp, E. coli
aagagaaatttagctcccagggcga

SEQ ID NO: 77697 - DNA, 25 bp, E. coli
caagtttggtgcagtacgtacacgc

SEQ ID NO: 77698 - DNA, 25 bp, E. coli
aagagaaatttacctcccagggcga

SEQ ID NO: 77699 - DNA, 25 bp, E. coli
cagctgaactggctgtaccaaccac

SEQ ID NO: 77700 - DNA, 25 bp, E. coli
cagctgaactgggtgtaccaaccac

SEQ ID NO: 77701 - DNA, 25 bp, E. coli
cagaaggtattcagggcaccatcgc

SEQ ID NO: 77702 - DNA, 25 bp, E. coli
cagaaggtattctgggcaccatcgc

SEQ ID NO: 77703 - DNA, 25 bp, E. coli
tattaatcagtcaaaagtctcgcgg

SEQ ID NO: 77704 - DNA, 25 bp, E. coli
tattaatcagtctaaagtctcgcgg

SEQ ID NO: 77705 - DNA, 25 bp, E. coli
ttgtcgtgattcataccagccctgg

SEQ ID NO: 77706 - DNA, 25 bp, E. coli
ttgtcgtgattcttaccagccctgg

SEQ ID NO: 77707 - DNA, 25 bp, E. coli
tctcgcggatgtagaccaagtttgg

SEQ ID NO: 77708 - DNA, 25 bp, E. coli
tctcgcggatgttgaccaagtttgg

SEQ ID NO: 77709 - DNA, 25 bp, E. coli
gctggactcactgggcaaagcagaa

SEQ ID NO: 77710 - DNA, 25 bp, E. coli
gctcggctaagcaagaagaactagt

SEQ ID NO: 77711 - DNA, 25 bp, E. coli
gctcggctaagctagaagaactagt

SEQ ID NO: 77712 - DNA, 25 bp, E. coli
gctggactcactcggcaaagcagaa

SEQ ID NO: 77713 - DNA, 25 bp, E. coli
gaaatggtttacagcctgccagctg

SEQ ID NO: 77714 - DNA, 25 bp, E. coli
gaaatggtttactgcctgccagctg

SEQ ID NO: 77715 - DNA, 25 bp, E. coli
cgattttagagcagttcgaccagga

SEQ ID NO: 77716 - DNA, 25 bp, E. coli
cgattttagagctgttcgaccagga

SEQ ID NO: 77717 - DNA, 25 bp, E. coli
tttctgtcagcatcgttggcgagta

SEQ ID NO: 77718 - DNA, 25 bp, E. coli
tatttctgtcagcatcgttggcgag

SEQ ID NO: 77719 - DNA, 25 bp, E. coli
tatttctgtcaggatcgttggcgag

SEQ ID NO: 77720 - DNA, 25 bp, E. coli
ttgacgatgcgttgtctgggacatg

SEQ ID NO: 77721 - DNA, 25 bp, E. coli
tttatttctgtctgcatcgttggcg

SEQ ID NO: 77722 - DNA, 25 bp, E. coli
ttgacgatgcgtagtctgggacatg

SEQ ID NO: 77723 - DNA, 25 bp, E. coli
tttctgtcagcaacgttggcgagta

SEQ ID NO: 77724 - DNA, 25 bp, E. coli
tttatttctgtcagcatcgttggcg

SEQ ID NO: 77725 - DNA, 25 bp, E. coli
tgcgttgtctggcacatgaaaaggt

SEQ ID NO: 77726 - DNA, 25 bp, E. coli
tgcgttgtctgggacatgaaaaggt

SEQ ID NO: 77727 - DNA, 25 bp, E. coli
tctgtcagcatccttggcgagtaac

SEQ ID NO: 77728 - DNA, 25 bp, E. coli
tctgtcagcatcgttggcgagtaac

SEQ ID NO: 77729 - DNA, 25 bp, E. coli
gctttatttctgtcagcatcgttgg

SEQ ID NO: 77730 - DNA, 25 bp, E. coli
gctttatttctgacagcatcgttgg

SEQ ID NO: 77731 - DNA, 25 bp, E. coli
cgctgctttatttctgtcagcatcg

SEQ ID NO: 77732 - DNA, 25 bp, E. coli
cgatgcgttgtctgggacatgaaaa

SEQ ID NO: 77733 - DNA, 25 bp, E. coli
cgatgcgttgtcagggacatgaaaa

SEQ ID NO: 77734 - DNA, 25 bp, E. coli
cgctgctttattactgtcagcatcg

SEQ ID NO: 77735 - DNA, 25 bp, E. coli
gttgtctgggacttgaaaaggtcgc

SEQ ID NO: 77736 - DNA, 25 bp, E. coli
gttgtctgggacatgaaaaggtcgc

SEQ ID NO: 77737 - DNA, 25 bp, E. coli
gacgatgcgttgtctgggacatgaa

SEQ ID NO: 77738 - DNA, 25 bp, E. coli
gacgatgcgttgactgggacatgaa

SEQ ID NO: 77739 - DNA, 25 bp, E. coli
catcagtgtgaaggacgacaggcgc

SEQ ID NO: 77740 - DNA, 25 bp, E. coli
cataagatttactccaccgggcgct

SEQ ID NO: 77741 - DNA, 25 bp, E. coli
catattgaagtgatctccggcgcga

SEQ ID NO: 77742 - DNA, 25 bp, E. coli
catcagtgtgaacgacgacaggcgc

SEQ ID NO: 77743 - DNA, 25 bp, E. coli
cataagatttacaccaccgggcgct

SEQ ID NO: 77744 - DNA, 25 bp, E. coli
catattgaagtgttctccggcgcga

SEQ ID NO: 77745 - DNA, 25 bp, E. coli
tacggtatgaacatgcgtggccgcc

SEQ ID NO: 77746 - DNA, 25 bp, E. coli
taaagatcacgatgagcgcattgcc

SEQ ID NO: 77747 - DNA, 25 bp, E. coli
tacggtatgaacttgcgtggccgcc

SEQ ID NO: 77748 - DNA, 25 bp, E. coli
taaagatcacgaagagcgcattgcc

SEQ ID NO: 77749 - DNA, 25 bp, E. coli
agcttacattaagtgggcgccggaa

SEQ ID NO: 77750 - DNA, 25 bp, E. coli
agcttacattaactgggcgccggaa

SEQ ID NO: 77751 - DNA, 25 bp, E. coli
ttatggacggctggcaaatcacctg

SEQ ID NO: 77752 - DNA, 25 bp, E. coli
ttatggacggctcgcaaatcacctg

SEQ ID NO: 77753 - DNA, 25 bp, E. coli
tgggaaccggtaggctgaacatcga

SEQ ID NO: 77754 - DNA, 25 bp, E. coli
tgggaaccggtacgctgaacatcga

SEQ ID NO: 77755 - DNA, 25 bp, E. coli
gattcttatgaactgggctggcgct

SEQ ID NO: 77756 - DNA, 25 bp, E. coli
gattcttatgaagtgggctggcgct

SEQ ID NO: 77757 - DNA, 25 bp, E. coli
taatccccggccatgatgtcagcag

SEQ ID NO: 77758 - DNA, 25 bp, E. coli
taatccccggccttgatgtcagcag

SEQ ID NO: 77759 - DNA, 25 bp, E. coli
gagatcatagtgtctgccagccgca

SEQ ID NO: 77760 - DNA, 25 bp, E. coli
gagatcatagtgactgccagccgca

SEQ ID NO: 77761 - DNA, 25 bp, E. coli
cacattctgcgatctgacagacatt

SEQ ID NO: 77762 - DNA, 25 bp, E. coli
cacattctgcgaactgacagacatt

SEQ ID NO: 77763 - DNA, 25 bp, E. coli
atcacattctgcgaactgacagaca

SEQ ID NO: 77764 - DNA, 25 bp, E. coli
atcacattctgccaactgacagaca

SEQ ID NO: 77765 - DNA, 25 bp, E. coli
atttcatcagtctttctcctttggc

SEQ ID NO: 77766 - DNA, 25 bp, E. coli
atttcatcagtcattctcctttggc

SEQ ID NO: 77767 - DNA, 25 bp, E. coli
acattctgcgaactgacagacattt

SEQ ID NO: 77768 - DNA, 25 bp, E. coli
aaatcacattctgcgaactgacaga

SEQ ID NO: 77769 - DNA, 25 bp, E. coli
acattctgcgaagtgacagacattt

SEQ ID NO: 77770 - DNA, 25 bp, E. coli
aaatcacattctccgaactgacaga

SEQ ID NO: 77771 - DNA, 25 bp, E. coli
tgcgggggatttcatcagtcattct

SEQ ID NO: 77772 - DNA, 25 bp, E. coli
tgcgggggatttgatcagtcattct

SEQ ID NO: 77773 - DNA, 25 bp, E. coli
gcgggggatttcatcagtcattctc

SEQ ID NO: 77774 - DNA, 25 bp, E. coli
gcgggggatttcttcagtcattctc

SEQ ID NO: 77775 - DNA, 25 bp, E. coli
gatttcatcagtcattctcctttgg

SEQ ID NO: 77776 - DNA, 25 bp, E. coli
gatttcatcagtgattctcctttgg

SEQ ID NO: 77777 - DNA, 25 bp, E. coli
gggatttcatcagtcattctccttt

SEQ ID NO: 77778 - DNA, 25 bp, E. coli
gggatttcatcactcattctccttt

SEQ ID NO: 77779 - DNA, 25 bp, E. coli
ggatttcatcagtcattctcctttg

SEQ ID NO: 77780 - DNA, 25 bp, E. coli
ggatttcatcagacattctcctttg

SEQ ID NO: 77781 - DNA, 25 bp, E. coli
tcacattctgcgtactgacagacat

SEQ ID NO: 77782 - DNA, 25 bp, E. coli
tcacattctgcgaactgacagacat

SEQ ID NO: 77783 - DNA, 25 bp, E. coli
aaggcgcggcgcagtatctgctgca

SEQ ID NO: 77784 - DNA, 25 bp, E. coli
aaggcgcggcgctgtatctgctgca

SEQ ID NO: 77785 - DNA, 25 bp, E. coli
catttaaccaaccacacgctgggcg

SEQ ID NO: 77786 - DNA, 25 bp, E. coli
catttaaccaacgacacgctgggcg

SEQ ID NO: 77787 - DNA, 25 bp, E. coli
cagtatctgctggaacagggctacg

SEQ ID NO: 77788 - DNA, 25 bp, E. coli
cagtatctgctgcaacagggctacg

SEQ ID NO: 77789 - DNA, 25 bp, E. coli
tatcacggcaattgcagcaaaggcg

SEQ ID NO: 77790 - DNA, 25 bp, E. coli
tatcacggcaatagcagcaaaggcg

SEQ ID NO: 77791 - DNA, 25 bp, E. coli
tgcaacagggctacgatgtggtcta

SEQ ID NO: 77792 - DNA, 25 bp, E. coli
tgcaacagggcttcgatgtggtcta

SEQ ID NO: 77793 - DNA, 25 bp, E. coli
gcgatccacagagtttcgcaatggg

SEQ ID NO: 77794 - DNA, 25 bp, E. coli
gcggtgcaggctatccatttaacca

SEQ ID NO: 77795 - DNA, 25 bp, E. coli
gcgatccacagactttcgcaatggg

SEQ ID NO: 77796 - DNA, 25 bp, E. coli
gcggtgcaggctttccatttaacca

SEQ ID NO: 77797 - DNA, 25 bp, E. coli
gaatgtattaaccttgccgacgcgc

SEQ ID NO: 77798 - DNA, 25 bp, E. coli
gaatgtattaacgttgccgacgcgc

SEQ ID NO: 77799 - DNA, 25 bp, E. coli
ctccggtgatggagatgtgttatca

SEQ ID NO: 77800 - DNA, 25 bp, E. coli
ctccggtgatggtgatgtgttatca

SEQ ID NO: 77801 - DNA, 25 bp, E. coli
ggtgctggtcgatattcgcgatcca

SEQ ID NO: 77802 - DNA, 25 bp, E. coli
ggtgctggtcgaaattcgcgatcca

SEQ ID NO: 77803 - DNA, 25 bp, E. coli
taacgactttgagactccggtgatg

SEQ ID NO: 77804 - DNA, 25 bp, E. coli
taacgactttgacactccggtgatg

SEQ ID NO: 77805 - DNA, 25 bp, E. coli
catccccaccaggatggtacaaggg

SEQ ID NO: 77806 - DNA, 25 bp, E. coli
catccccaccagcatggtacaaggg

SEQ ID NO: 77807 - DNA, 25 bp, E. coli
actgcgcccaattctgcccgtggaa

SEQ ID NO: 77808 - DNA, 25 bp, E. coli
actgcgcccaatactgcccgtggaa

SEQ ID NO: 77809 - DNA, 25 bp, E. coli
taccgcgatgcagttaataagctac

SEQ ID NO: 77810 - DNA, 25 bp, E. coli
taccgcgatgcacttaataagctac

SEQ ID NO: 77811 - DNA, 25 bp, E. coli
ttgcgcaaaacatcgtcacctcctg

SEQ ID NO: 77812 - DNA, 25 bp, E. coli
ttgcgcaaaacaacgtcacctcctg

SEQ ID NO: 77813 - DNA, 25 bp, E. coli
tgaatacaacaagggcaccacactc

SEQ ID NO: 77814 - DNA, 25 bp, E. coli
tgaatacaacaacggcaccacactc

SEQ ID NO: 77815 - DNA, 25 bp, E. coli
ccattaataacaaaggcgcactgcc

SEQ ID NO: 77816 - DNA, 25 bp, E. coli
ccattaataacataggcgcactgcc

SEQ ID NO: 77817 - DNA, 25 bp, E. coli
gagtacggttgctcacccgatttga

SEQ ID NO: 77818 - DNA, 25 bp, E. coli
gagtacggttgcacacccgatttga

SEQ ID NO: 77819 - DNA, 25 bp, E. coli
gaaattcgctcaataccgcgatgca

SEQ ID NO: 77820 - DNA, 25 bp, E. coli
gaaattcgctcattaccgcgatgca

SEQ ID NO: 77821 - DNA, 25 bp, E. coli
gggcaccacactgaagctgggcaaa

SEQ ID NO: 77822 - DNA, 25 bp, E. coli
gggcaccacactcaagctgggcaaa

SEQ ID NO: 77823 - DNA, 25 bp, E. coli
taataagctactccagaatgaggca

SEQ ID NO: 77824 - DNA, 25 bp, E. coli
taacgaatgtgggaactgcgcccaa

SEQ ID NO: 77825 - DNA, 25 bp, E. coli
taacgaatgtggcaactgcgcccaa

SEQ ID NO: 77826 - DNA, 25 bp, E. coli
taataagctactgcagaatgaggca

SEQ ID NO: 77827 - DNA, 25 bp, E. coli
cagtgactcgtccttttatcttcct

SEQ ID NO: 77828 - DNA, 25 bp, E. coli
cagtgactcgtcgttttatcttcct

SEQ ID NO: 77829 - DNA, 25 bp, E. coli
accgctgcgtgatgcgttaaaagca

SEQ ID NO: 77830 - DNA, 25 bp, E. coli
accgctgcgtgaagcgttaaaagca

SEQ ID NO: 77831 - DNA, 25 bp, E. coli
tgaagcgttaaatgcacgtggctat

SEQ ID NO: 77832 - DNA, 25 bp, E. coli
tgaagcgttaaaagcacgtggctat

SEQ ID NO: 77833 - DNA, 25 bp, E. coli
gctgcaactactggcttaccacgtt

SEQ ID NO: 77834 - DNA, 25 bp, E. coli
gctgcaactactcgcttaccacgtt

SEQ ID NO: 77835 - DNA, 25 bp, E. coli
ctactggcttacgacgttgcgctga

SEQ ID NO: 77836 - DNA, 25 bp, E. coli
cttcagaagctatcgcgcatccgca

SEQ ID NO: 77837 - DNA, 25 bp, E. coli
ctactggcttaccacgttgcgctga

SEQ ID NO: 77838 - DNA, 25 bp, E. coli
cttcagaagctaacgcgcatccgca

SEQ ID NO: 77839 - DNA, 25 bp, E. coli
gttttgtggggaccgataacatgca

SEQ ID NO: 77840 - DNA, 25 bp, E. coli
gttttgtggggagcgataacatgca

SEQ ID NO: 77841 - DNA, 25 bp, E. coli
gtgaaccttcagtagctaacgcgca

SEQ ID NO: 77842 - DNA, 25 bp, E. coli
gtgaaccttcagaagctaacgcgca

SEQ ID NO: 77843 - DNA, 25 bp, E. coli
tggcgtggcctcgaccaaagcattc

SEQ ID NO: 77844 - DNA, 25 bp, E. coli
ggaaattggcgtggcctccaccaaa

SEQ ID NO: 77845 - DNA, 25 bp, E. coli
ggcgctgttgcctgtgactcgtcgt

SEQ ID NO: 77846 - DNA, 25 bp, E. coli
ggcgctgttgccagtgactcgtcgt

SEQ ID NO: 77847 - DNA, 25 bp, E. coli
ggaaattggcgtcgcctccaccaaa

SEQ ID NO: 77848 - DNA, 25 bp, E. coli
tggcgtggcctccaccaaagcattc

SEQ ID NO: 77849 - DNA, 25 bp, E. coli
aattattactcaagcccctggaggg

SEQ ID NO: 77850 - DNA, 25 bp, E. coli
aattattactcatgcccctggaggg

SEQ ID NO: 77851 - DNA, 25 bp, E. coli
tattcgggatgcctcagcggtgctt

SEQ ID NO: 77852 - DNA, 25 bp, E. coli
tattcgggatgcgtcagcggtgctt

SEQ ID NO: 77853 - DNA, 25 bp, E. coli
tcgcgattgaacaggcagtgcaggc

SEQ ID NO: 77854 - DNA, 25 bp, E. coli
tgcgcggcacggtgataaaaagtca

SEQ ID NO: 77855 - DNA, 25 bp, E. coli
tcgcgattgaactggcagtgcaggc

SEQ ID NO: 77856 - DNA, 25 bp, E. coli
tgccgctcgcctggaatctgtatac

SEQ ID NO: 77857 - DNA, 25 bp, E. coli
tgcgcggcacggagataaaaagtca

SEQ ID NO: 77858 - DNA, 25 bp, E. coli
tgccgctcgcctcgaatctgtatac

SEQ ID NO: 77859 - DNA, 25 bp, E. coli
tcatggtgcagccaatcagcgagct

SEQ ID NO: 77860 - DNA, 25 bp, E. coli
tcatggtgcagcgaatcagcgagct

SEQ ID NO: 77861 - DNA, 25 bp, E. coli
tcagttatcgcctgtgatgcccggc

SEQ ID NO: 77862 - DNA, 25 bp, E. coli
tcagttatcgccagtgatgcccggc

SEQ ID NO: 77863 - DNA, 25 bp, E. coli
cctgtctgttagcattgcgcggcac

SEQ ID NO: 77864 - DNA, 25 bp, E. coli
ccagtcgtgggacttcaatgcgcgt

SEQ ID NO: 77865 - DNA, 25 bp, E. coli
ccagtcgtgggagttcaatgcgcgt

SEQ ID NO: 77866 - DNA, 25 bp, E. coli
cctgtctgttaggattgcgcggcac

SEQ ID NO: 77867 - DNA, 25 bp, E. coli
gattttggcccttccgtgacagtgc

SEQ ID NO: 77868 - DNA, 25 bp, E. coli
gattttggccctaccgtgacagtgc

SEQ ID NO: 77869 - DNA, 25 bp, E. coli
ggtgcagcgacaagttcctcagcga

SEQ ID NO: 77870 - DNA, 25 bp, E. coli
ggtgcagcgacatgttcctcagcga

SEQ ID NO: 77871 - DNA, 25 bp, E. coli
caaaaactgcttactcttggcatgt

SEQ ID NO: 77872 - DNA, 25 bp, E. coli
caaaaactgctttctcttggcatgt

SEQ ID NO: 77873 - DNA, 25 bp, E. coli
tatcgaaacccgtcgtgtgagcctg

SEQ ID NO: 77874 - DNA, 25 bp, E. coli
tattagaagtggaagcggtttcctg

SEQ ID NO: 77875 - DNA, 25 bp, E. coli
tattagaagtggtagcggtttcctg

SEQ ID NO: 77876 - DNA, 25 bp, E. coli
tatcgaaacccgacgtgtgagcctg

SEQ ID NO: 77877 - DNA, 25 bp, E. coli
tcggcgaccccaatcatatcgaaac

SEQ ID NO: 77878 - DNA, 25 bp, E. coli
tcggcgaccccattcatatcgaaac

SEQ ID NO: 77879 - DNA, 25 bp, E. coli
tacgcaaaaaagatctggccttatt

SEQ ID NO: 77880 - DNA, 25 bp, E. coli
tacgcaaaaaagttctggccttatt

SEQ ID NO: 77881 - DNA, 25 bp, E. coli
tcttggcatgttacctggctcctct

SEQ ID NO: 77882 - DNA, 25 bp, E. coli
tcttttaatgtggtgcgcgtcgctc

SEQ ID NO: 77883 - DNA, 25 bp, E. coli
tcttggcatgtttcctggctcctct

SEQ ID NO: 77884 - DNA, 25 bp, E. coli
tcttttaatgtgctgcgcgtcgctc

SEQ ID NO: 77885 - DNA, 25 bp, E. coli
gcttttcccgtgtaatcagcccggc

SEQ ID NO: 77886 - DNA, 25 bp, E. coli
gcttttcccgtgaaatcagcccggc

SEQ ID NO: 77887 - DNA, 25 bp, E. coli
gcaatacactccagatactgcgtgg

SEQ ID NO: 77888 - DNA, 25 bp, E. coli
gcaatacactcctgatactgcgtgg

SEQ ID NO: 77889 - DNA, 25 bp, E. coli
cgtgtgagcctggtattacgcaaaa

SEQ ID NO: 77890 - DNA, 25 bp, E. coli
cgtgtgagcctgctattacgcaaaa

SEQ ID NO: 77891 - DNA, 25 bp, E. coli
tcagcccggcatatcgccaaaaact

SEQ ID NO: 77892 - DNA, 25 bp, E. coli
tcagcccggcatttcgccaaaaact

SEQ ID NO: 77893 - DNA, 25 bp, E. coli
caaagtgctcagttgacaggaatga

SEQ ID NO: 77894 - DNA, 25 bp, E. coli
caaagtgctcagatgacaggaatga

SEQ ID NO: 77895 - DNA, 25 bp, E. coli
caggctccggatatgctgaagtgca

SEQ ID NO: 77896 - DNA, 25 bp, E. coli
caggctccggatttgctgaagtgca

SEQ ID NO: 77897 - DNA, 25 bp, E. coli
cagtacctgtgattcaggctccgga

SEQ ID NO: 77898 - DNA, 25 bp, E. coli
cagtacctgtgaatcaggctccgga

SEQ ID NO: 77899 - DNA, 25 bp, E. coli
tactggaccagtcgctggaatctgc

SEQ ID NO: 77900 - DNA, 25 bp, E. coli
tactggaccagtggctggaatctgc

SEQ ID NO: 77901 - DNA, 25 bp, E. coli
gttgacgggaaacaatactggacca

SEQ ID NO: 77902 - DNA, 25 bp, E. coli
gttgacgggaaagaatactggacca

SEQ ID NO: 77903 - DNA, 25 bp, E. coli
acatttacagtgaaggttgacggga

SEQ ID NO: 77904 - DNA, 25 bp, E. coli
acatttacagtgtaggttgacggga

SEQ ID NO: 77905 - DNA, 25 bp, E. coli
tgtcacaatcaattccagtacctgt

SEQ ID NO: 77906 - DNA, 25 bp, E. coli
tgtcacaatcaaatccagtacctgt

SEQ ID NO: 77907 - DNA, 25 bp, E. coli
tccaagtataatgaggatgacacat

SEQ ID NO: 77908 - DNA, 25 bp, E. coli
tccaagtataatcaggatgacacat

SEQ ID NO: 77909 - DNA, 25 bp, E. coli
gcggcggattgtcctaaaggtaaaa

SEQ ID NO: 77910 - DNA, 25 bp, E. coli
gcggcggattgtgctaaaggtaaaa

SEQ ID NO: 77911 - DNA, 25 bp, E. coli
gctggaatctgcaaccgttactgca

SEQ ID NO: 77912 - DNA, 25 bp, E. coli
gctggaatctgctaccgttactgca

SEQ ID NO: 77913 - DNA, 25 bp, E. coli
cttctgttaatggaatggcggcgga

SEQ ID NO: 77914 - DNA, 25 bp, E. coli
cttctgttaatgcaatggcggcgga

SEQ ID NO: 77915 - DNA, 25 bp, E. coli
caggagttgccagtaaggtacgcca

SEQ ID NO: 77916 - DNA, 25 bp, E. coli
caggagttgccactaaggtacgcca

SEQ ID NO: 77917 - DNA, 25 bp, E. coli
tactggaagtgtctggcaacgtcac

SEQ ID NO: 77918 - DNA, 25 bp, E. coli
taacttcgaaactgaacagatgcgc

SEQ ID NO: 77919 - DNA, 25 bp, E. coli
tactggaagtgtgtggcaacgtcac

SEQ ID NO: 77920 - DNA, 25 bp, E. coli
tattcaactggcaggcgacgatgtc

SEQ ID NO: 77921 - DNA, 25 bp, E. coli
tattcaactggctggcgacgatgtc

SEQ ID NO: 77922 - DNA, 25 bp, E. coli
tgcgccaggcggtcgaaaaagcgtc

SEQ ID NO: 77923 - DNA, 25 bp, E. coli
tgcgccaggcggacgaaaaagcgtc

SEQ ID NO: 77924 - DNA, 25 bp, E. coli
gcggaacagtcgttgccaacaatga

SEQ ID NO: 77925 - DNA, 25 bp, E. coli
gcggaacagtcgatgccaacaatga

SEQ ID NO: 77926 - DNA, 25 bp, E. coli
gaaatacgcggtactttgcggcggc

SEQ ID NO: 77927 - DNA, 25 bp, E. coli
gaaacgggcgtggactttatctccg

SEQ ID NO: 77928 - DNA, 25 bp, E. coli
gaaacgggcgtgcactttatctccg

SEQ ID NO: 77929 - DNA, 25 bp, E. coli
gaaaaccatattattgcctccggct

SEQ ID NO: 77930 - DNA, 25 bp, E. coli
gaaatacgcggttctttgcggcggc

SEQ ID NO: 77931 - DNA, 25 bp, E. coli
gaaaaccatatttttgcctccggct

SEQ ID NO: 77932 - DNA, 25 bp, E. coli
cccggatgcgccagtagaagtcgaa

SEQ ID NO: 77933 - DNA, 25 bp, E. coli
cccggatgcgcctgtagaagtcgaa

SEQ ID NO: 77934 - DNA, 25 bp, E. coli
cgtgacgagctggtggaacgcatta

SEQ ID NO: 77935 - DNA, 25 bp, E. coli
cgtgacgagctgctggaacgcatta

SEQ ID NO: 77936 - DNA, 25 bp, E. coli
taacttcgaaacagaacagatgcgc

SEQ ID NO: 77937 - DNA, 25 bp, E. coli
caagtcagaatggtggaagacgagc

SEQ ID NO: 77938 - DNA, 25 bp, E. coli
caagtcagaatgctggaagacgagc

SEQ ID NO: 77939 - DNA, 25 bp, E. coli
caacccgggatcagtaaacaagtca

SEQ ID NO: 77940 - DNA, 25 bp, E. coli
cacggcaacggatgctgacgtcatt

SEQ ID NO: 77941 - DNA, 25 bp, E. coli
caacccgggatctgtaaacaagtca

SEQ ID NO: 77942 - DNA, 25 bp, E. coli
cacaaattgctgttgccgtctctaa

SEQ ID NO: 77943 - DNA, 25 bp, E. coli
cacggcaacggaagctgacgtcatt

SEQ ID NO: 77944 - DNA, 25 bp, E. coli
cacaaattgctgatgccgtctctaa

SEQ ID NO: 77945 - DNA, 25 bp, E. coli
tatccgttggtgacatataccttcg

SEQ ID NO: 77946 - DNA, 25 bp, E. coli
tatccgttggtgtcatataccttcg

SEQ ID NO: 77947 - DNA, 25 bp, E. coli
ttttttcccgaagcggcaagcacct

SEQ ID NO: 77948 - DNA, 25 bp, E. coli
ttttttcccgaaccggcaagcacct

SEQ ID NO: 77949 - DNA, 25 bp, E. coli
tgatttcattcagcgttttgcaccg

SEQ ID NO: 77950 - DNA, 25 bp, E. coli
tgatttcattcaccgttttgcaccg

SEQ ID NO: 77951 - DNA, 25 bp, E. coli
tcattgccagcatggcggtggatcc

SEQ ID NO: 77952 - DNA, 25 bp, E. coli
tcattgccagcaaggcggtggatcc

SEQ ID NO: 77953 - DNA, 25 bp, E. coli
cgtgctaccactggaatcgggctat

SEQ ID NO: 77954 - DNA, 25 bp, E. coli
cgtgctaccactcgaatcgggctat

SEQ ID NO: 77955 - DNA, 25 bp, E. coli
ggactttacacatcacaacccggga

SEQ ID NO: 77956 - DNA, 25 bp, E. coli
ggactttacacaacacaacccggga

SEQ ID NO: 77957 - DNA, 25 bp, E. coli
taacgcgtgatgtcgttgatgcggc

SEQ ID NO: 77958 - DNA, 25 bp, E. coli
taacgcgtgatgacgttgatgcggc

SEQ ID NO: 77959 - DNA, 25 bp, E. coli
cagagtttttccagccattacgcga

SEQ ID NO: 77960 - DNA, 25 bp, E. coli
cagagtttttcctgccattacgcga

SEQ ID NO: 77961 - DNA, 25 bp, E. coli
tatggagaatattccccgtgaagcc

SEQ ID NO: 77962 - DNA, 25 bp, E. coli
tatggagaatataccccgtgaagcc

SEQ ID NO: 77963 - DNA, 25 bp, E. coli
tattactgttggttgaacccgctgc

SEQ ID NO: 77964 - DNA, 25 bp, E. coli
tattgagcaaggacgttacgcggaa

SEQ ID NO: 77965 - DNA, 25 bp, E. coli
tattgagcaaggtcgttacgcggaa

SEQ ID NO: 77966 - DNA, 25 bp, E. coli
tattactgttggatgaacccgctgc

SEQ ID NO: 77967 - DNA, 25 bp, E. coli
tgtttatcacgtggccggaaggtaa

SEQ ID NO: 77968 - DNA, 25 bp, E. coli
tgtttatcacgtcgccggaaggtaa

SEQ ID NO: 77969 - DNA, 25 bp, E. coli
tacgcgaacgggtgggttatcacgc

SEQ ID NO: 77970 - DNA, 25 bp, E. coli
tacgcgaacgggagggttatcacgc

SEQ ID NO: 77971 - DNA, 25 bp, E. coli
tctctgcgccagacaacgttaatgg

SEQ ID NO: 77972 - DNA, 25 bp, E. coli
tctctgcgccagtcaacgttaatgg

SEQ ID NO: 77973 - DNA, 25 bp, E. coli
cctgcgcggcatcgaaacattgcgt

SEQ ID NO: 77974 - DNA, 25 bp, E. coli
cctgcgcggcatggaaacattgcgt

SEQ ID NO: 77975 - DNA, 25 bp, E. coli
cattactggcccatcgtcaggagga

SEQ ID NO: 77976 - DNA, 25 bp, E. coli
cattactggcccttcgtcaggagga

SEQ ID NO: 77977 - DNA, 25 bp, E. coli
ggataacgtactactggcgcgacct

SEQ ID NO: 77978 - DNA, 25 bp, E. coli
ggataacgtacttctggcgcgacct

SEQ ID NO: 77979 - DNA, 25 bp, E. coli
ggcggtggcccgtgcgttactaaat

SEQ ID NO: 77980 - DNA, 25 bp, E. coli
ggcggtggcccgagcgttactaaat

SEQ ID NO: 77981 - DNA, 25 bp, E. coli
aatacagacacgcagttccaggctg

SEQ ID NO: 77982 - DNA, 25 bp, E. coli
aatacagacacggagttccaggctg

SEQ ID NO: 77983 - DNA, 25 bp, E. coli
acccggtggcgctgtgcctctgcgt

SEQ ID NO: 77984 - DNA, 25 bp, E. coli
acccggtggcgcagtgcctctgcgt

SEQ ID NO: 77985 - DNA, 25 bp, E. coli
tttgtgagcaattcagacacgcagt

SEQ ID NO: 77986 - DNA, 25 bp, E. coli
tttgtgagcaatacagacacgcagt

SEQ ID NO: 77987 - DNA, 25 bp, E. coli
tgatttgtgagcaatacagacacgc

SEQ ID NO: 77988 - DNA, 25 bp, E. coli
tgtgagcaatactgacacgcagttc

SEQ ID NO: 77989 - DNA, 25 bp, E. coli
tgatttgtgagctatacagacacgc

SEQ ID NO: 77990 - DNA, 25 bp, E. coli
tccggcagcaatacttcattccctg

SEQ ID NO: 77991 - DNA, 25 bp, E. coli
tccggcagcaattcttcattccctg

SEQ ID NO: 77992 - DNA, 25 bp, E. coli
gctgtgcctctgcgtgcagcgccat

SEQ ID NO: 77993 - DNA, 25 bp, E. coli
gctgtgcctctgggtgcagcgccat

SEQ ID NO: 77994 - DNA, 25 bp, E. coli
gcgggaattgatttgtgagcaatac

SEQ ID NO: 77995 - DNA, 25 bp, E. coli
gcgggaattgatatgtgagcaatac

SEQ ID NO: 77996 - DNA, 25 bp, E. coli
gcaatacagacacgcagttccaggc

SEQ ID NO: 77997 - DNA, 25 bp, E. coli
gcaatacagacaggcagttccaggc

SEQ ID NO: 77998 - DNA, 25 bp, E. coli
ggcagcaatactacattccctgtcc

SEQ ID NO: 77999 - DNA, 25 bp, E. coli
tgtgagcaatacagacacgcagttc

SEQ ID NO: 78000 - DNA, 25 bp, E. coli
ggcagcaatacttcattccctgtcc

SEQ ID NO: 78001 - DNA, 25 bp, E. coli
gagcaatacagacacgcagttccag

SEQ ID NO: 78002 - DNA, 25 bp, E. coli
gagcaatacagagacgcagttccag

SEQ ID NO: 78003 - DNA, 25 bp, E. coli
agtgatttaactactgctggcgcga

SEQ ID NO: 78004 - DNA, 25 bp, E. coli
agtagctccgttaatccctggtggg

SEQ ID NO: 78005 - DNA, 25 bp, E. coli
agtgatttaacttctgctggcgcga

SEQ ID NO: 78006 - DNA, 25 bp, E. coli
agtagctccgtttatccctggtggg

SEQ ID NO: 78007 - DNA, 25 bp, E. coli
taccagtgctggatctgcaacgacc

SEQ ID NO: 78008 - DNA, 25 bp, E. coli
taccagtgctggttctgcaacgacc

SEQ ID NO: 78009 - DNA, 25 bp, E. coli
tattgagcgaaaccaaagcggctgc

SEQ ID NO: 78010 - DNA, 25 bp, E. coli
tattgagcgaaagcaaagcggctgc

SEQ ID NO: 78011 - DNA, 25 bp, E. coli
ttaccgcgggtgtatccagtgatgc

SEQ ID NO: 78012 - DNA, 25 bp, E. coli
ttaccgcgggtgaatccagtgatgc

SEQ ID NO: 78013 - DNA, 25 bp, E. coli
tgttgccgggtatgcttcagcgact

SEQ ID NO: 78014 - DNA, 25 bp, E. coli
tgttgccgggtaagcttcagcgact

SEQ ID NO: 78015 - DNA, 25 bp, E. coli
gctgtaaatgtgtactccgcgggta

SEQ ID NO: 78016 - DNA, 25 bp, E. coli
gcggctgccgcgtcatcttcaatta

SEQ ID NO: 78017 - DNA, 25 bp, E. coli
gctgtaaatgtgaactccgcgggta

SEQ ID NO: 78018 - DNA, 25 bp, E. coli
gcggctgccgcgacatcttcaatta

SEQ ID NO: 78019 - DNA, 25 bp, E. coli
cgataaagtcactgttggcggcgta

SEQ ID NO: 78020 - DNA, 25 bp, E. coli
cgataaagtcacagttggcggcgta

SEQ ID NO: 78021 - DNA, 25 bp, E. coli
tggaagccaggcatacgtagacgat

SEQ ID NO: 78022 - DNA, 25 bp, E. coli
tggaagccaggcttacgtagacgat

SEQ ID NO: 78023 - DNA, 25 bp, E. coli
gacggtgcctctctgacattcaatg

SEQ ID NO: 78024 - DNA, 25 bp, E. coli
gacggtgcctctgtgacattcaatg

SEQ ID NO: 78025 - DNA, 25 bp, E. coli
caaccttagcagtagcgtgggatga

SEQ ID NO: 78026 - DNA, 25 bp, E. coli
caaccttagcagaagcgtgggatga

SEQ ID NO: 78027 - DNA, 25 bp, E. coli
ttcaaaaattcgctgtggagcagga

SEQ ID NO: 78028 - DNA, 25 bp, E. coli
ttcaaaaattcggtgtggagcagga

SEQ ID NO: 78029 - DNA, 25 bp, E. coli
tgcaggacacggatcaccgagatgg

SEQ ID NO: 78030 - DNA, 25 bp, E. coli
tgcaggacacggttcaccgagatgg

SEQ ID NO: 78031 - DNA, 25 bp, E. coli
tgacgcaaggcgacgtgcaggacac

SEQ ID NO: 78032 - DNA, 25 bp, E. coli
tgcatgatgagctagagaagaggct

SEQ ID NO: 78033 - DNA, 25 bp, E. coli
tgcatgatgagcaagagaagaggct

SEQ ID NO: 78034 - DNA, 25 bp, E. coli
tgacgcaaggcgtcgtgcaggacac

SEQ ID NO: 78035 - DNA, 25 bp, E. coli
tcagaaaggaccttaacagacccgt

SEQ ID NO: 78036 - DNA, 25 bp, E. coli
tcagaaaggaccataacagacccgt

SEQ ID NO: 78037 - DNA, 25 bp, E. coli
gaattaccgaatcgaaagcgtagcc

SEQ ID NO: 78038 - DNA, 25 bp, E. coli
gaattaccgaatggaaagcgtagcc

SEQ ID NO: 78039 - DNA, 25 bp, E. coli
cgtagccacacgcaacaactgaaag

SEQ ID NO: 78040 - DNA, 25 bp, E. coli
cgtagccacacggaacaactgaaag

SEQ ID NO: 78041 - DNA, 25 bp, E. coli
ggatttatgtacaagaggcagccct

SEQ ID NO: 78042 - DNA, 25 bp, E. coli
gggcatcgccaagcagactgctaat

SEQ ID NO: 78043 - DNA, 25 bp, E. coli
ggatttatgtactagaggcagccct

SEQ ID NO: 78044 - DNA, 25 bp, E. coli
gggcatcgccaaccagactgctaat

SEQ ID NO: 78045 - DNA, 25 bp, E. coli
taagagacggtcaacgggtgaagaa

SEQ ID NO: 78046 - DNA, 25 bp, E. coli
taagagacggtctacgggtgaagaa

SEQ ID NO: 78047 - DNA, 25 bp, E. coli
aatggatccttaacgctgaacctgc

SEQ ID NO: 78048 - DNA, 25 bp, E. coli
aatggatccttatcgctgaacctgc

SEQ ID NO: 78049 - DNA, 25 bp, E. coli
caacagttgattgcccagggtgtac

SEQ ID NO: 78050 - DNA, 25 bp, E. coli
caacagttgattccccagggtgtac

SEQ ID NO: 78051 - DNA, 25 bp, E. coli
taaagatgaaggtttccgggacgcg

SEQ ID NO: 78052 - DNA, 25 bp, E. coli
taacatgggctttccgtatggcacg

SEQ ID NO: 78053 - DNA, 25 bp, E. coli
taaagatgaaggattccgggacgcg

SEQ ID NO: 78054 - DNA, 25 bp, E. coli
taacatgggcttaccgtatggcacg

SEQ ID NO: 78055 - DNA, 25 bp, E. coli
tatcgcttatgacgacagcccggtt

SEQ ID NO: 78056 - DNA, 25 bp, E. coli
tatcgcttatgaggacagcccggtt

SEQ ID NO: 78057 - DNA, 25 bp, E. coli
tataccagttggtgccagttccagg

SEQ ID NO: 78058 - DNA, 25 bp, E. coli
tataccagttggagccagttccagg

SEQ ID NO: 78059 - DNA, 25 bp, E. coli
tatggcctggcttcggaatttaccg

SEQ ID NO: 78060 - DNA, 25 bp, E. coli
tatggcctggctacggaatttaccg

SEQ ID NO: 78061 - DNA, 25 bp, E. coli
gaatttaccgacaactacgctgctg

SEQ ID NO: 78062 - DNA, 25 bp, E. coli
gaatttaccgactactacgctgctg

SEQ ID NO: 78063 - DNA, 25 bp, E. coli
cggttccggcagataaacgttctat

SEQ ID NO: 78064 - DNA, 25 bp, E. coli
cggttccggcagttaaacgttctat

SEQ ID NO: 78065 - DNA, 25 bp, E. coli
taaccggtcagagtgcaaatgctaa

SEQ ID NO: 78066 - DNA, 25 bp, E. coli
taaccggtcagactgcaaatgctaa

SEQ ID NO: 78067 - DNA, 25 bp, E. coli
gagcggcagcttattccttcgagtc

SEQ ID NO: 78068 - DNA, 25 bp, E. coli
gagcggcagctttttccttcgagtc

SEQ ID NO: 78069 - DNA, 25 bp, E. coli
cagcctgaccacgttacggtggaaa

SEQ ID NO: 78070 - DNA, 25 bp, E. coli
cagcctgaccaccttacggtggaaa

SEQ ID NO: 78071 - DNA, 25 bp, E. coli
taacgtggcgctcatggaagaccgc

SEQ ID NO: 78072 - DNA, 25 bp, E. coli
acggcctgggttgcgtcgccaactg

SEQ ID NO: 78073 - DNA, 25 bp, E. coli
acggcctgggttccgtcgccaactg

SEQ ID NO: 78074 - DNA, 25 bp, E. coli
tacctggcgtggaactggatgctgc

SEQ ID NO: 78075 - DNA, 25 bp, E. coli
tacctggcgtggtactggatgctgc

SEQ ID NO: 78076 - DNA, 25 bp, E. coli
ttggcacaatgtagatgagatcgtt

SEQ ID NO: 78077 - DNA, 25 bp, E. coli
ttggcacaatgttgatgagatcgtt

SEQ ID NO: 78078 - DNA, 25 bp, E. coli
tgaagaagttttacctggcgtggaa

SEQ ID NO: 78079 - DNA, 25 bp, E. coli
tgaagaagtttttcctggcgtggaa

SEQ ID NO: 78080 - DNA, 25 bp, E. coli
tgccggatattcttaacgtggcgct

SEQ ID NO: 78081 - DNA, 25 bp, E. coli
tgccggatattcataacgtggcgct

SEQ ID NO: 78082 - DNA, 25 bp, E. coli
tctgtgggctacgtggaaaagcgca

SEQ ID NO: 78083 - DNA, 25 bp, E. coli
tctgtgggctacctggaaaagcgca

SEQ ID NO: 78084 - DNA, 25 bp, E. coli
gatcgttcacgaactggcgccagag

SEQ ID NO: 78085 - DNA, 25 bp, E. coli
tggaaaagcgcaaatcggtaaaggc

SEQ ID NO: 78086 - DNA, 25 bp, E. coli
tggaaaagcgcatatcggtaaaggc

SEQ ID NO: 78087 - DNA, 25 bp, E. coli
taacgtggcgctgatggaagaccgc

SEQ ID NO: 78088 - DNA, 25 bp, E. coli
gatcgttcacgatctggcgccagag

SEQ ID NO: 78089 - DNA, 25 bp, E. coli
gatgctgccgcgttttggcacaatg

SEQ ID NO: 78090 - DNA, 25 bp, E. coli
gatgctgccgcgatttggcacaatg

SEQ ID NO: 78091 - DNA, 25 bp, E. coli
tactggataacagaccatgagctgc

SEQ ID NO: 78092 - DNA, 25 bp, E. coli
taaacatgccgtagtgttcgccctt

SEQ ID NO: 78093 - DNA, 25 bp, E. coli
tactggataacacaccatgagctgc

SEQ ID NO: 78094 - DNA, 25 bp, E. coli
taaacatgccgttgtgttcgccctt

SEQ ID NO: 78095 - DNA, 25 bp, E. coli
tatagcgtgcggtctgaccgttaaa

SEQ ID NO: 78096 - DNA, 25 bp, E. coli
tatagcgtgcggactgaccgttaaa

SEQ ID NO: 78097 - DNA, 25 bp, E. coli
ttatcgaagcaaaataagtcagacg

SEQ ID NO: 78098 - DNA, 25 bp, E. coli
ttcgccctttgaatagcaactctgg

SEQ ID NO: 78099 - DNA, 25 bp, E. coli
ttatcgaagcaatataagtcagacg

SEQ ID NO: 78100 - DNA, 25 bp, E. coli
ttcgccctttgattagcaactctgg

SEQ ID NO: 78101 - DNA, 25 bp, E. coli
tatcgataatacaggtcggttttac

SEQ ID NO: 78102 - DNA, 25 bp, E. coli
tatcgataatactggtcggttttac

SEQ ID NO: 78103 - DNA, 25 bp, E. coli
tgaacaatctggatatagcgtgcgg

SEQ ID NO: 78104 - DNA, 25 bp, E. coli
tgaacaatctggttatagcgtgcgg

SEQ ID NO: 78105 - DNA, 25 bp, E. coli
gaatgtcaacagcttaactcgtgcc

SEQ ID NO: 78106 - DNA, 25 bp, E. coli
gaatgtcaacaggttaactcgtgcc

SEQ ID NO: 78107 - DNA, 25 bp, E. coli
cggttttacataaatcgaccagaga

SEQ ID NO: 78108 - DNA, 25 bp, E. coli
cggttttacatatatcgaccagaga

SEQ ID NO: 78109 - DNA, 25 bp, E. coli
gatattactgttcatgcttctgcta

SEQ ID NO: 78110 - DNA, 25 bp, E. coli
gatattactgttgatgcttctgcta

SEQ ID NO: 78111 - DNA, 25 bp, E. coli
gagctgctacctataaaacacctga

SEQ ID NO: 78112 - DNA, 25 bp, E. coli
gagctgctacctttaaaacacctga

SEQ ID NO: 78113 - DNA, 25 bp, E. coli
caagtacattgaggaagatggcgcg

SEQ ID NO: 78114 - DNA, 25 bp, E. coli
aagccagcggtctgggttacaccga

SEQ ID NO: 78115 - DNA, 25 bp, E. coli
caagtacattgacgaagatggcgcg

SEQ ID NO: 78116 - DNA, 25 bp, E. coli
aagccagcggtcagggttacaccga

SEQ ID NO: 78117 - DNA, 25 bp, E. coli
caacgataagatccgggcgattgcc

SEQ ID NO: 78118 - DNA, 25 bp, E. coli
caacgataagatgcgggcgattgcc

SEQ ID NO: 78119 - DNA, 25 bp, E. coli
cagggctcttctcttggtgtcagca

SEQ ID NO: 78120 - DNA, 25 bp, E. coli
catgaagtgtctgtgcaatcggcaa

SEQ ID NO: 78121 - DNA, 25 bp, E. coli
cagggctcttctgttggtgtcagca

SEQ ID NO: 78122 - DNA, 25 bp, E. coli
catgaagtgtctctgcaatcggcaa

SEQ ID NO: 78123 - DNA, 25 bp, E. coli
taaacaagggcattggcacgtcagc

SEQ ID NO: 78124 - DNA, 25 bp, E. coli
taaacaagggcaatggcacgtcagc

SEQ ID NO: 78125 - DNA, 25 bp, E. coli
tacgctgggcgatgatggttccttg

SEQ ID NO: 78126 - DNA, 25 bp, E. coli
tacgctgggcgaagatggttccttg

SEQ ID NO: 78127 - DNA, 25 bp, E. coli
tatgtatccgaacctgtggcaagcc

SEQ ID NO: 78128 - DNA, 25 bp, E. coli
tatgtatccgaagctgtggcaagcc

SEQ ID NO: 78129 - DNA, 25 bp, E. coli
tgtaaaaccggctaatcagggctct

SEQ ID NO: 78130 - DNA, 25 bp, E. coli
tgtaaaaccggcaaatcagggctct

SEQ ID NO: 78131 - DNA, 25 bp, E. coli
gccattgcgccagaaatcaacgata

SEQ ID NO: 78132 - DNA, 25 bp, E. coli
gccattgcgccacaaatcaacgata

SEQ ID NO: 78133 - DNA, 25 bp, E. coli
cgatgccgggctcaacattgcgcca

SEQ ID NO: 78134 - DNA, 25 bp, E. coli
cgatgccgggctgaacattgcgcca

SEQ ID NO: 78135 - DNA, 25 bp, E. coli
catgtgcttcaacttatgcggtaga

SEQ ID NO: 78136 - DNA, 25 bp, E. coli
catgtgcttcaagttatgcggtaga

SEQ ID NO: 78137 - DNA, 25 bp, E. coli
caggtttaggaacactgacaggtac

SEQ ID NO: 78138 - DNA, 25 bp, E. coli
caggtttaggaagactgacaggtac

SEQ ID NO: 78139 - DNA, 25 bp, E. coli
tactttaataggcacagtggccttc

SEQ ID NO: 78140 - DNA, 25 bp, E. coli
tactcagtcggatcaggccttagcg

SEQ ID NO: 78141 - DNA, 25 bp, E. coli
tactttaatagggacagtggccttc

SEQ ID NO: 78142 - DNA, 25 bp, E. coli
tactcagtcggaacaggccttagcg

SEQ ID NO: 78143 - DNA, 25 bp, E. coli
tattgcggcacaaataatccctcag

SEQ ID NO: 78144 - DNA, 25 bp, E. coli
tattgcggcacatataatccctcag

SEQ ID NO: 78145 - DNA, 25 bp, E. coli
ttggtgcaaactggccgataaacgg

SEQ ID NO: 78146 - DNA, 25 bp, E. coli
ttggtgcaaactcgccgataaacgg

SEQ ID NO: 78147 - DNA, 25 bp, E. coli
tcatagccagacgtattggaggtgg

SEQ ID NO: 78148 - DNA, 25 bp, E. coli
tcatagccagacctattggaggtgg

SEQ ID NO: 78149 - DNA, 25 bp, E. coli
gaatggccgcacgtgtattagctac

SEQ ID NO: 78150 - DNA, 25 bp, E. coli
gaatggccgcacctgtattagctac

SEQ ID NO: 78151 - DNA, 25 bp, E. coli
gaaaaagtgctccagaaagtcagga

SEQ ID NO: 78152 - DNA, 25 bp, E. coli
gaaaaagtgctcgagaaagtcagga

SEQ ID NO: 78153 - DNA, 25 bp, E. coli
cctacctggcagttaatggagttaa

SEQ ID NO: 78154 - DNA, 25 bp, E. coli
cctacctggcagataatggagttaa

SEQ ID NO: 78155 - DNA, 25 bp, E. coli
ggcattacggatattcaggctactt

SEQ ID NO: 78156 - DNA, 25 bp, E. coli
ggcattacggattttcaggctactt

SEQ ID NO: 78157 - DNA, 25 bp, E. coli
catatgaagttgctgatcgctggcg

SEQ ID NO: 78158 - DNA, 25 bp, E. coli
catatgaagttggtgatcgctggcg

SEQ ID NO: 78159 - DNA, 25 bp, E. coli
aaaatgtgattcgttcggcagagcc

SEQ ID NO: 78160 - DNA, 25 bp, E. coli
aaaatgtgattccttcggcagagcc

SEQ ID NO: 78161 - DNA, 25 bp, E. coli
tatttatttggtaggtggcgcgagc

SEQ ID NO: 78162 - DNA, 25 bp, E. coli
tatttatttggttggtggcgcgagc

SEQ ID NO: 78163 - DNA, 25 bp, E. coli
tcttgaacagaatcagggctgcacg

SEQ ID NO: 78164 - DNA, 25 bp, E. coli
tcttgaacagaaacagggctgcacg

SEQ ID NO: 78165 - DNA, 25 bp, E. coli
cctccaatgtggtgaaagacggcgt

SEQ ID NO: 78166 - DNA, 25 bp, E. coli
cctccaatgtggagaaagacggcgt

SEQ ID NO: 78167 - DNA, 25 bp, E. coli
gccgggtagtagcacgtctcaaaca

SEQ ID NO: 78168 - DNA, 25 bp, E. coli
gccgggtagtaggacgtctcaaaca

SEQ ID NO: 78169 - DNA, 25 bp, E. coli
gtactagatgaagcggtagccgctg

SEQ ID NO: 78170 - DNA, 25 bp, E. coli
gtactagatgaaccggtagccgctg

SEQ ID NO: 78171 - DNA, 25 bp, E. coli
ggatggttcgcttcccagcaggtaa

SEQ ID NO: 78172 - DNA, 25 bp, E. coli
ggtaccgccaatatcgcaatcgtgg

SEQ ID NO: 78173 - DNA, 25 bp, E. coli
ggatggttcgctacccagcaggtaa

SEQ ID NO: 78174 - DNA, 25 bp, E. coli
ggtaccgccaatttcgcaatcgtgg

SEQ ID NO: 78175 - DNA, 25 bp, E. coli
ggcaccaccggcttgagcattttga

SEQ ID NO: 78176 - DNA, 25 bp, E. coli
ggcaccaccggcatgagcattttga

SEQ ID NO: 78177 - DNA, 25 bp, E. coli
tggatgaagatatccagccggtggc

SEQ ID NO: 78178 - DNA, 25 bp, E. coli
tggatgaagataaccagccggtggc

SEQ ID NO: 78179 - DNA, 25 bp, E. coli
caaaaagctgaagttgaacgccttc

SEQ ID NO: 78180 - DNA, 25 bp, E. coli
caaaaagctgaacttgaacgccttc

SEQ ID NO: 78181 - DNA, 25 bp, E. coli
ctgaataaaggataactgaagcccg

SEQ ID NO: 78182 - DNA, 25 bp, E. coli
ctgaataaaggaaaactgaagcccg

SEQ ID NO: 78183 - DNA, 25 bp, E. coli
actgaagcccgaaaacggcggctca

SEQ ID NO: 78184 - DNA, 25 bp, E. coli
actgaagcccgataacggcggctca

SEQ ID NO: 78185 - DNA, 25 bp, E. coli
tgtcacccggacttggaacatcatt

SEQ ID NO: 78186 - DNA, 25 bp, E. coli
tgtcacccggacatggaacatcatt

SEQ ID NO: 78187 - DNA, 25 bp, E. coli
tcatgattccagacgtgacgggcga

SEQ ID NO: 78188 - DNA, 25 bp, E. coli
tcatgattccagtcgtgacgggcga

SEQ ID NO: 78189 - DNA, 25 bp, E. coli
gcttccgaaggctggagttctgcca

SEQ ID NO: 78190 - DNA, 25 bp, E. coli
gcttccgaaggcaggagttctgcca

SEQ ID NO: 78191 - DNA, 25 bp, E. coli
gacgggcgagtctgagatcgtatta

SEQ ID NO: 78192 - DNA, 25 bp, E. coli
gacgggcgagtcagagatcgtatta

SEQ ID NO: 78193 - DNA, 25 bp, E. coli
ggaacatcatttacagcattccggg

SEQ ID NO: 78194 - DNA, 25 bp, E. coli
ggaacatcattttcagcattccggg

SEQ ID NO: 78195 - DNA, 25 bp, E. coli
ggcggctcagactgcaaactcagtg

SEQ ID NO: 78196 - DNA, 25 bp, E. coli
ggcggctcagacagcaaactcagtg

SEQ ID NO: 78197 - DNA, 25 bp, E. coli
gatgttattgcgtttgtcacccgga

SEQ ID NO: 78198 - DNA, 25 bp, E. coli
gatgttattgcgattgtcacccgga

SEQ ID NO: 78199 - DNA, 25 bp, E. coli
gataatttatttcaccatacccgcg

SEQ ID NO: 78200 - DNA, 25 bp, E. coli
gataatttatttgaccatacccgcg

SEQ ID NO: 78201 - DNA, 25 bp, E. coli
aagtcgatggcttcaattttggcag

SEQ ID NO: 78202 - DNA, 25 bp, E. coli
caattttggcaggttcgtggttgcc

SEQ ID NO: 78203 - DNA, 25 bp, E. coli
caattttggcagcttcgtggttgcc

SEQ ID NO: 78204 - DNA, 25 bp, E. coli
aagtcgatggctacaattttggcag

SEQ ID NO: 78205 - DNA, 25 bp, E. coli
catggattatttatgggcttattgc

SEQ ID NO: 78206 - DNA, 25 bp, E. coli
catggattatttttgggcttattgc

SEQ ID NO: 78207 - DNA, 25 bp, E. coli
tattctggcgaagtggatcatgcca

SEQ ID NO: 78208 - DNA, 25 bp, E. coli
tattctggcgaactggatcatgcca

SEQ ID NO: 78209 - DNA, 25 bp, E. coli
cgaagtggatcaagccaggtaaaga

SEQ ID NO: 78210 - DNA, 25 bp, E. coli
cgaagtggatcatgccaggtaaaga

SEQ ID NO: 78211 - DNA, 25 bp, E. coli
cgtggttgccgttattggtgcgatt

SEQ ID NO: 78212 - DNA, 25 bp, E. coli
cgtggttgccgtaattggtgcgatt

SEQ ID NO: 78213 - DNA, 25 bp, E. coli
gattctttatgactatcctgctggg

SEQ ID NO: 78214 - DNA, 25 bp, E. coli
gtgctatttatctacaggaagatta

SEQ ID NO: 78215 - DNA, 25 bp, E. coli
gattctttatgagtatcctgctggg

SEQ ID NO: 78216 - DNA, 25 bp, E. coli
gtgctatttatcaacaggaagatta

SEQ ID NO: 78217 - DNA, 25 bp, E. coli
ggctttggtaaagtcgatggcttca

SEQ ID NO: 78218 - DNA, 25 bp, E. coli
ggcttattgccgctattctggcgaa

SEQ ID NO: 78219 - DNA, 25 bp, E. coli
ggcttattgccggtattctggcgaa

SEQ ID NO: 78220 - DNA, 25 bp, E. coli
ggctttggtaaactcgatggcttca

SEQ ID NO: 78221 - DNA, 25 bp, E. coli
gatcagcacgctgtttggctttggt

SEQ ID NO: 78222 - DNA, 25 bp, E. coli
gatcagcacgctctttggctttggt

SEQ ID NO: 78223 - DNA, 25 bp, E. coli
aataaaacagcaaaatgcgggtgcg

SEQ ID NO: 78224 - DNA, 25 bp, E. coli
aataaaacagcataatgcgggtgcg

SEQ ID NO: 78225 - DNA, 25 bp, E. coli
cagtgttcattacatgctgatagcc

SEQ ID NO: 78226 - DNA, 25 bp, E. coli
cagtgttcattagatgctgatagcc

SEQ ID NO: 78227 - DNA, 25 bp, E. coli
catcagctctttctttctataagag

SEQ ID NO: 78228 - DNA, 25 bp, E. coli
catcagctctttgtttctataagag

SEQ ID NO: 78229 - DNA, 25 bp, E. coli
agcaaaatgcggctgcgttacgtag

SEQ ID NO: 78230 - DNA, 25 bp, E. coli
agcaaaatgcgggtgcgttacgtag

SEQ ID NO: 78231 - DNA, 25 bp, E. coli
aaacagcaaaatgcgggtgcgttac

SEQ ID NO: 78232 - DNA, 25 bp, E. coli
aaacagcaaaatccgggtgcgttac

SEQ ID NO: 78233 - DNA, 25 bp, E. coli
tagatgctgatagcctcacgtttca

SEQ ID NO: 78234 - DNA, 25 bp, E. coli
tagatgctgataccctcacgtttca

SEQ ID NO: 78235 - DNA, 25 bp, E. coli
ttctataagagtcaataaaacagca

SEQ ID NO: 78236 - DNA, 25 bp, E. coli
ttctataagagtgaataaaacagca

SEQ ID NO: 78237 - DNA, 25 bp, E. coli
tcattagatgctgatagcctcacgt

SEQ ID NO: 78238 - DNA, 25 bp, E. coli
tcattagatgctcatagcctcacgt

SEQ ID NO: 78239 - DNA, 25 bp, E. coli
gcctcacgtttcttcagctctttgt

SEQ ID NO: 78240 - DNA, 25 bp, E. coli
gcctcacgtttcatcagctctttgt

SEQ ID NO: 78241 - DNA, 25 bp, E. coli
gatagcctcacgtttcatcagctct

SEQ ID NO: 78242 - DNA, 25 bp, E. coli
gatagcctcacgattcatcagctct

SEQ ID NO: 78243 - DNA, 25 bp, E. coli
gatgaacagtgttcattagatgctg

SEQ ID NO: 78244 - DNA, 25 bp, E. coli
gatgaacagtgtacattagatgctg

SEQ ID NO: 78245 - DNA, 25 bp, E. coli
aagttgagcggcagccgctccagca

SEQ ID NO: 78246 - DNA, 25 bp, E. coli
aagttgagcggctgccgctccagca

SEQ ID NO: 78247 - DNA, 25 bp, E. coli
aacaccgcttcttctatatcgtggg

SEQ ID NO: 78248 - DNA, 25 bp, E. coli
aacaccgcttctactatatcgtggg

SEQ ID NO: 78249 - DNA, 25 bp, E. coli
tatcgtgggtaaacaacagcacctg

SEQ ID NO: 78250 - DNA, 25 bp, E. coli
tatcgtgggtaatcaacagcacctg

SEQ ID NO: 78251 - DNA, 25 bp, E. coli
tgaaagcagaaccagttcagtcgcc

SEQ ID NO: 78252 - DNA, 25 bp, E. coli
tgaattgtggatgggacttgatgct

SEQ ID NO: 78253 - DNA, 25 bp, E. coli
tgaaagcagaacgagttcagtcgcc

SEQ ID NO: 78254 - DNA, 25 bp, E. coli
tgaattgtggatcggacttgatgct

SEQ ID NO: 78255 - DNA, 25 bp, E. coli
tccagcgcaccatacggttcgtcga

SEQ ID NO: 78256 - DNA, 25 bp, E. coli
tccagcgcaccaaacggttcgtcga

SEQ ID NO: 78257 - DNA, 25 bp, E. coli
gccagagtttcagcagcagggtttg

SEQ ID NO: 78258 - DNA, 25 bp, E. coli
gccagagtttcaccagcagggtttg

SEQ ID NO: 78259 - DNA, 25 bp, E. coli
cgggtgaaggcgaccagcgcaccaa

SEQ ID NO: 78260 - DNA, 25 bp, E. coli
cgggtgaaggcgtccagcgcaccaa

SEQ ID NO: 78261 - DNA, 25 bp, E. coli
gttcagtcgccaaaaacaccgcttc

SEQ ID NO: 78262 - DNA, 25 bp, E. coli
gttcagtcgccataaacaccgcttc

SEQ ID NO: 78263 - DNA, 25 bp, E. coli
ggttcgtcgagttataacagctggg

SEQ ID NO: 78264 - DNA, 25 bp, E. coli
ggacttgatgctgcggctcgactct

SEQ ID NO: 78265 - DNA, 25 bp, E. coli
ggacttgatgctccggctcgactct

SEQ ID NO: 78266 - DNA, 25 bp, E. coli
ggttcgtcgagtaataacagctggg

SEQ ID NO: 78267 - DNA, 25 bp, E. coli
aacgtggatcacacgctcattggcc

SEQ ID NO: 78268 - DNA, 25 bp, E. coli
aaatcactgccttcgctgccaggtg

SEQ ID NO: 78269 - DNA, 25 bp, E. coli
aacgtggatcactcgctcattggcc

SEQ ID NO: 78270 - DNA, 25 bp, E. coli
aaatcactgcctacgctgccaggtg

SEQ ID NO: 78271 - DNA, 25 bp, E. coli
tatcgccagctttgtcgggacatcg

SEQ ID NO: 78272 - DNA, 25 bp, E. coli
tatcgccagcttagtcgggacatcg

SEQ ID NO: 78273 - DNA, 25 bp, E. coli
tattctcaaacgttcggtgaaactg

SEQ ID NO: 78274 - DNA, 25 bp, E. coli
tattctcaaacgatcggtgaaactg

SEQ ID NO: 78275 - DNA, 25 bp, E. coli
tcaggcagaaaacgctggatctatt

SEQ ID NO: 78276 - DNA, 25 bp, E. coli
tcaggcagaaaaggctggatctatt

SEQ ID NO: 78277 - DNA, 25 bp, E. coli
gctgccaggtgaaccttcgcatcag

SEQ ID NO: 78278 - DNA, 25 bp, E. coli
gctgccaggtgatccttcgcatcag

SEQ ID NO: 78279 - DNA, 25 bp, E. coli
cgccatctttatctcctttgccgga

SEQ ID NO: 78280 - DNA, 25 bp, E. coli
cgccatctttatgtcctttgccgga

SEQ ID NO: 78281 - DNA, 25 bp, E. coli
ggattcggtgttcatggcttaaccc

SEQ ID NO: 78282 - DNA, 25 bp, E. coli
ggattcggtgttgatggcttaaccc

SEQ ID NO: 78283 - DNA, 25 bp, E. coli
gtgaaactggccatagcgggcgcac

SEQ ID NO: 78284 - DNA, 25 bp, E. coli
gtgaaactggccttagcgggcgcac

SEQ ID NO: 78285 - DNA, 25 bp, E. coli
ggctgacctttggtttaattcccgt

SEQ ID NO: 78286 - DNA, 25 bp, E. coli
ggctgacctttgctttaattcccgt

SEQ ID NO: 78287 - DNA, 25 bp, E. coli
taattcccgttgcttggtcaacgtg

SEQ ID NO: 78288 - DNA, 25 bp, E. coli
taattcccgttggttggtcaacgtg

SEQ ID NO: 78289 - DNA, 25 bp, E. coli
aatgattcggttttactgttcgccg

SEQ ID NO: 78290 - DNA, 25 bp, E. coli
aatagccctgcattgtaaatggttc

SEQ ID NO: 78291 - DNA, 25 bp, E. coli
aatagccctgcaatgtaaatggttc

SEQ ID NO: 78292 - DNA, 25 bp, E. coli
aatgattcggttatactgttcgccg

SEQ ID NO: 78293 - DNA, 25 bp, E. coli
caacaggaccgcgtataaaggccaa

SEQ ID NO: 78294 - DNA, 25 bp, E. coli
caacaggaccgcctataaaggccaa

SEQ ID NO: 78295 - DNA, 25 bp, E. coli
tattgttagctgtgtcaggagatgc

SEQ ID NO: 78296 - DNA, 25 bp, E. coli
tattgttagctgagtcaggagatgc

SEQ ID NO: 78297 - DNA, 25 bp, E. coli
tgttcgccgttgtccaacaggaccg

SEQ ID NO: 78298 - DNA, 25 bp, E. coli
tgttcgccgttgaccaacaggaccg

SEQ ID NO: 78299 - DNA, 25 bp, E. coli
tccgtttccggttgcaagctcttta

SEQ ID NO: 78300 - DNA, 25 bp, E. coli
tccgtttccggtagcaagctcttta

SEQ ID NO: 78301 - DNA, 25 bp, E. coli
gcctgaaggtaaacgtttgcgtaaa

SEQ ID NO: 78302 - DNA, 25 bp, E. coli
gcctgaaggtaatcgtttgcgtaaa

SEQ ID NO: 78303 - DNA, 25 bp, E. coli
gcgtaaattcctatgtcaagacctg

SEQ ID NO: 78304 - DNA, 25 bp, E. coli
gcgtaaattcctttgtcaagacctg

SEQ ID NO: 78305 - DNA, 25 bp, E. coli
ctccaaagccttgcgtagcctgaag

SEQ ID NO: 78306 - DNA, 25 bp, E. coli
ctccaaagccttccgtagcctgaag

SEQ ID NO: 78307 - DNA, 25 bp, E. coli
tcacaaacctgaaaagaaatccgtt

SEQ ID NO: 78308 - DNA, 25 bp, E. coli
tcacaaacctgataagaaatccgtt

SEQ ID NO: 78309 - DNA, 25 bp, E. coli
gacctgttatcgcacaatgattcgg

SEQ ID NO: 78310 - DNA, 25 bp, E. coli
gacctgttatcggacaatgattcgg

SEQ ID NO: 78311 - DNA, 25 bp, E. coli
caagccgtgaagttacagtactgcg

SEQ ID NO: 78312 - DNA, 25 bp, E. coli
caagaaaccttgactgagatacgta

SEQ ID NO: 78313 - DNA, 25 bp, E. coli
caagaaaccttgtctgagatacgta

SEQ ID NO: 78314 - DNA, 25 bp, E. coli
cacaattgcaagagccagagagctt

SEQ ID NO: 78315 - DNA, 25 bp, E. coli
caagccgtgaagatacagtactgcg

SEQ ID NO: 78316 - DNA, 25 bp, E. coli
cacaattgcaagtgccagagagctt

SEQ ID NO: 78317 - DNA, 25 bp, E. coli
tacattatgtgatccagaagatggg

SEQ ID NO: 78318 - DNA, 25 bp, E. coli
tactgcgtgaaaatgagatgctcga

SEQ ID NO: 78319 - DNA, 25 bp, E. coli
tacattatgtgaaccagaagatggg

SEQ ID NO: 78320 - DNA, 25 bp, E. coli
tactgcgtgaaattgagatgctcga

SEQ ID NO: 78321 - DNA, 25 bp, E. coli
ttgttaaaacaagggcggctcatcc

SEQ ID NO: 78322 - DNA, 25 bp, E. coli
ttgttaaaacaacggcggctcatcc

SEQ ID NO: 78323 - DNA, 25 bp, E. coli
tcagactattcgtggagaagctcaa

SEQ ID NO: 78324 - DNA, 25 bp, E. coli
tcagactattcgaggagaagctcaa

SEQ ID NO: 78325 - DNA, 25 bp, E. coli
cctttgagcagggaatcaatcgcag

SEQ ID NO: 78326 - DNA, 25 bp, E. coli
cctttgagcaggcaatcaatcgcag

SEQ ID NO: 78327 - DNA, 25 bp, E. coli
ggtgtcaatacgtcctatgcaggta

SEQ ID NO: 78328 - DNA, 25 bp, E. coli
ggtgtcaatacgacctatgcaggta

SEQ ID NO: 78329 - DNA, 25 bp, E. coli
taatcatggtagtttgacaagccgt

SEQ ID NO: 78330 - DNA, 25 bp, E. coli
taatcatggtagattgacaagccgt

SEQ ID NO: 78331 - DNA, 25 bp, E. coli
gagagcttacgaacatgccctgtta

SEQ ID NO: 78332 - DNA, 25 bp, E. coli
gagagcttacgatcatgccctgtta

SEQ ID NO: 78333 - DNA, 25 bp, E. coli
aacctgccgggtagcacgaaggtat

SEQ ID NO: 78334 - DNA, 25 bp, E. coli
aacctgccgggttgcacgaaggtat

SEQ ID NO: 78335 - DNA, 25 bp, E. coli
acctgccgggttccacgaaggtatg

SEQ ID NO: 78336 - DNA, 25 bp, E. coli
acctgccgggttgcacgaaggtatg

SEQ ID NO: 78337 - DNA, 25 bp, E. coli
aaacagcaaaacgtgccgggttgca

SEQ ID NO: 78338 - DNA, 25 bp, E. coli
aaacagcaaaacctgccgggttgca

SEQ ID NO: 78339 - DNA, 25 bp, E. coli
actggaaacagcaaaacctgccggg

SEQ ID NO: 78340 - DNA, 25 bp, E. coli
actggaaacagctaaacctgccggg

SEQ ID NO: 78341 - DNA, 25 bp, E. coli
acagcaaaacctgccgggttgcacg

SEQ ID NO: 78342 - DNA, 25 bp, E. coli
acagcaaaacctcccgggttgcacg

SEQ ID NO: 78343 - DNA, 25 bp, E. coli
ccgggttgcacgtaggtatgcgctt

SEQ ID NO: 78344 - DNA, 25 bp, E. coli
ccgggttgcacgaaggtatgcgctt

SEQ ID NO: 78345 - DNA, 25 bp, E. coli
gaaacagcaaaagctgccgggttgc

SEQ ID NO: 78346 - DNA, 25 bp, E. coli
gaaacagcaaaacctgccgggttgc

SEQ ID NO: 78347 - DNA, 25 bp, E. coli
cgggttgcacgaaggtatgcgcttc

SEQ ID NO: 78348 - DNA, 25 bp, E. coli
cgggttgcacgatggtatgcgcttc

SEQ ID NO: 78349 - DNA, 25 bp, E. coli
ggttgcacgaaggtatgcgcttcgc

SEQ ID NO: 78350 - DNA, 25 bp, E. coli
ggttgcacgaagctatgcgcttcgc

SEQ ID NO: 78351 - DNA, 25 bp, E. coli
tggaaacagcaaaacctgccgggtt

SEQ ID NO: 78352 - DNA, 25 bp, E. coli
ggaaacagcaaatcctgccgggttg

SEQ ID NO: 78353 - DNA, 25 bp, E. coli
tggaaacagcaatacctgccgggtt

SEQ ID NO: 78354 - DNA, 25 bp, E. coli
ggaaacagcaaaacctgccgggttg

SEQ ID NO: 78355 - DNA, 25 bp, E. coli
aatagcaggcaacataacaattcgg

SEQ ID NO: 78356 - DNA, 25 bp, E. coli
aatagcaggcaagataacaattcgg

SEQ ID NO: 78357 - DNA, 25 bp, E. coli
catgcagtcgttcatgagaaagggt

SEQ ID NO: 78358 - DNA, 25 bp, E. coli
catgcagtcgttgatgagaaagggt

SEQ ID NO: 78359 - DNA, 25 bp, E. coli
tattaatagcaaagtcgccatgcac

SEQ ID NO: 78360 - DNA, 25 bp, E. coli
tattaatagcaatgtcgccatgcac

SEQ ID NO: 78361 - DNA, 25 bp, E. coli
tttaatatagtgtctccacatgcga

SEQ ID NO: 78362 - DNA, 25 bp, E. coli
tttaatatagtgactccacatgcga

SEQ ID NO: 78363 - DNA, 25 bp, E. coli
tggtctttcagggatccagacacgc

SEQ ID NO: 78364 - DNA, 25 bp, E. coli
tgttacagctaagggaatagcaggc

SEQ ID NO: 78365 - DNA, 25 bp, E. coli
tgttacagctaacggaatagcaggc

SEQ ID NO: 78366 - DNA, 25 bp, E. coli
ccaataatgcagcaggaagtgttac

SEQ ID NO: 78367 - DNA, 25 bp, E. coli
ccaataatgcaggaggaagtgttac

SEQ ID NO: 78368 - DNA, 25 bp, E. coli
gatttcatccgcaggctattgacag

SEQ ID NO: 78369 - DNA, 25 bp, E. coli
gatttcatccgctggctattgacag

SEQ ID NO: 78370 - DNA, 25 bp, E. coli
ggcagagtaattatcctgtgcacta

SEQ ID NO: 78371 - DNA, 25 bp, E. coli
ggctttttagcttccaatacactga

SEQ ID NO: 78372 - DNA, 25 bp, E. coli
ggcagagtaattttcctgtgcacta

SEQ ID NO: 78373 - DNA, 25 bp, E. coli
tggtctttcaggcatccagacacgc

SEQ ID NO: 78374 - DNA, 25 bp, E. coli
ggctttttagctaccaatacactga

SEQ ID NO: 78375 - DNA, 25 bp, E. coli
taatttttcacagcctctcagcatg

SEQ ID NO: 78376 - DNA, 25 bp, E. coli
taatttttcacaccctctcagcatg

SEQ ID NO: 78377 - DNA, 25 bp, E. coli
caaattggccttggcttctcaccgt

SEQ ID NO: 78378 - DNA, 25 bp, E. coli
cagaaataacaaccgcgctcttttc

SEQ ID NO: 78379 - DNA, 25 bp, E. coli
cagaaataacaagcgcgctcttttc

SEQ ID NO: 78380 - DNA, 25 bp, E. coli
caaattggccttcgcttctcaccgt

SEQ ID NO: 78381 - DNA, 25 bp, E. coli
tatcggtagcggcatgttgcccttt

SEQ ID NO: 78382 - DNA, 25 bp, E. coli
tatcggtagcgggatgttgcccttt

SEQ ID NO: 78383 - DNA, 25 bp, E. coli
ttggccttggcttctcaccgtttca

SEQ ID NO: 78384 - DNA, 25 bp, E. coli
ttggccttggctactcaccgtttca

SEQ ID NO: 78385 - DNA, 25 bp, E. coli
ccggacgtatcgctagcggcatgtt

SEQ ID NO: 78386 - DNA, 25 bp, E. coli
ccggacgtatcggtagcggcatgtt

SEQ ID NO: 78387 - DNA, 25 bp, E. coli
gcaaattggcctaggcttctcaccg

SEQ ID NO: 78388 - DNA, 25 bp, E. coli
gcaaattggccttggcttctcaccg

SEQ ID NO: 78389 - DNA, 25 bp, E. coli
ctttgccggacgaatcggtagcggc

SEQ ID NO: 78390 - DNA, 25 bp, E. coli
ctttgccggacgtatcggtagcggc

SEQ ID NO: 78391 - DNA, 25 bp, E. coli
gggatgaagcggattgttgtacagg

SEQ ID NO: 78392 - DNA, 25 bp, E. coli
gggatgaagcggtttgttgtacagg

SEQ ID NO: 78393 - DNA, 25 bp, E. coli
ggccttggcttcacaccgtttcatg

SEQ ID NO: 78394 - DNA, 25 bp, E. coli
tggcttctcaccgtttcatgccgga

SEQ ID NO: 78395 - DNA, 25 bp, E. coli
ggccttggcttctcaccgtttcatg

SEQ ID NO: 78396 - DNA, 25 bp, E. coli
tggcttctcaccctttcatgccgga

SEQ ID NO: 78397 - DNA, 25 bp, E. coli
gacgtatcggtaccggcatgttgcc

SEQ ID NO: 78398 - DNA, 25 bp, E. coli
gacgtatcggtagcggcatgttgcc

SEQ ID NO: 78399 - DNA, 25 bp, E. coli
cagcttgaagagcataaaatgggag

SEQ ID NO: 78400 - DNA, 25 bp, E. coli
cagcttgaagaggataaaatgggag

SEQ ID NO: 78401 - DNA, 25 bp, E. coli
tacggattctggaagctgaatgctg

SEQ ID NO: 78402 - DNA, 25 bp, E. coli
tacgagcagtttcgtgatttgaaat

SEQ ID NO: 78403 - DNA, 25 bp, E. coli
tacgagcagtttggtgatttgaaat

SEQ ID NO: 78404 - DNA, 25 bp, E. coli
attcaaatacagcaacagggagttc

SEQ ID NO: 78405 - DNA, 25 bp, E. coli
aaatgggagagctgttatcgattcc

SEQ ID NO: 78406 - DNA, 25 bp, E. coli
attcaaatacaggaacagggagttc

SEQ ID NO: 78407 - DNA, 25 bp, E. coli
aaatgggagagcagttatcgattcc

SEQ ID NO: 78408 - DNA, 25 bp, E. coli
tacggattctggtagctgaatgctg

SEQ ID NO: 78409 - DNA, 25 bp, E. coli
tatccatatgcttgtggagatcccg

SEQ ID NO: 78410 - DNA, 25 bp, E. coli
ttatcgattccctatccgggcagcc

SEQ ID NO: 78411 - DNA, 25 bp, E. coli
tatccatatgctagtggagatcccg

SEQ ID NO: 78412 - DNA, 25 bp, E. coli
tatctgaaagggtaaagcagtctga

SEQ ID NO: 78413 - DNA, 25 bp, E. coli
ttatcgattcccaatccgggcagcc

SEQ ID NO: 78414 - DNA, 25 bp, E. coli
tatctgaaagggaaaagcagtctga

SEQ ID NO: 78415 - DNA, 25 bp, E. coli
gatacaggattacataaagcaccag

SEQ ID NO: 78416 - DNA, 25 bp, E. coli
gatacaggattagataaagcaccag

SEQ ID NO: 78417 - DNA, 25 bp, E. coli
ggagatcccgcccaaaatgagcgta

SEQ ID NO: 78418 - DNA, 25 bp, E. coli
ggagatcccgccgaaaatgagcgta

SEQ ID NO: 78419 - DNA, 25 bp, E. coli
taagaacacggcgaagatacaggat

SEQ ID NO: 78420 - DNA, 25 bp, E. coli
taagaacacggccaagatacaggat

SEQ ID NO: 78421 - DNA, 25 bp, E. coli
cactggatgcgcgtaatcacggcta

SEQ ID NO: 78422 - DNA, 25 bp, E. coli
cacggctatacggtgctggatattc

SEQ ID NO: 78423 - DNA, 25 bp, E. coli
cacggctatacgctgctggatattc

SEQ ID NO: 78424 - DNA, 25 bp, E. coli
cactggatgcgcctaatcacggcta

SEQ ID NO: 78425 - DNA, 25 bp, E. coli
caagacgggccgaccattcgttatt

SEQ ID NO: 78426 - DNA, 25 bp, E. coli
caagacgggccgtccattcgttatt

SEQ ID NO: 78427 - DNA, 25 bp, E. coli
ttgatatggtgggtgaaccctgccc

SEQ ID NO: 78428 - DNA, 25 bp, E. coli
ttgatatggtggctgaaccctgccc

SEQ ID NO: 78429 - DNA, 25 bp, E. coli
tgaaaaatatcgttcctgattaccg

SEQ ID NO: 78430 - DNA, 25 bp, E. coli
tgaaaaatatcgatcctgattaccg

SEQ ID NO: 78431 - DNA, 25 bp, E. coli
tcctggaagtggtgagcgactgtcc

SEQ ID NO: 78432 - DNA, 25 bp, E. coli
tcctggaagtggagagcgactgtcc

SEQ ID NO: 78433 - DNA, 25 bp, E. coli
gactgtccgcagacgatcaataata

SEQ ID NO: 78434 - DNA, 25 bp, E. coli
gactgtccgcagtcgatcaataata

SEQ ID NO: 78435 - DNA, 25 bp, E. coli
cccttgaggcgaagccgcagttaaa

SEQ ID NO: 78436 - DNA, 25 bp, E. coli
cccttgaggcgatgccgcagttaaa

SEQ ID NO: 78437 - DNA, 25 bp, E. coli
gtgggtgaaccctgcccttatccgg

SEQ ID NO: 78438 - DNA, 25 bp, E. coli
gtgggtgaacccagcccttatccgg

SEQ ID NO: 78439 - DNA, 25 bp, E. coli
tggatattcagcaagacgggccgac

SEQ ID NO: 78440 - DNA, 25 bp, E. coli
tggatattcagctagacgggccgac

SEQ ID NO: 78441 - DNA, 25 bp, E. coli
tcaataatattccactggatgcgcg

SEQ ID NO: 78442 - DNA, 25 bp, E. coli
tcaataatattcgactggatgcgcg

SEQ ID NO: 78443 - DNA, 25 bp, E. coli
aaccgcaaagcgcaggaatggagca

SEQ ID NO: 78444 - DNA, 25 bp, E. coli
aagtgactccgggaggcaccagtat

SEQ ID NO: 78445 - DNA, 25 bp, E. coli
aagtgactccggcaggcaccagtat

SEQ ID NO: 78446 - DNA, 25 bp, E. coli
aaccgattaacgttcgccgttcgcg

SEQ ID NO: 78447 - DNA, 25 bp, E. coli
aaccgcaaagcggaggaatggagca

SEQ ID NO: 78448 - DNA, 25 bp, E. coli
aaccgattaacgatcgccgttcgcg

SEQ ID NO: 78449 - DNA, 25 bp, E. coli
tggtgagcaacatgcgggaaaaacc

SEQ ID NO: 78450 - DNA, 25 bp, E. coli
tgagctataaaggaacgcgctttgt

SEQ ID NO: 78451 - DNA, 25 bp, E. coli
tgagctataaagcaacgcgctttgt

SEQ ID NO: 78452 - DNA, 25 bp, E. coli
tcgtcgccgcatggtttcgttttat

SEQ ID NO: 78453 - DNA, 25 bp, E. coli
tcgtcgccgcatcgtttcgttttat

SEQ ID NO: 78454 - DNA, 25 bp, E. coli
gctatgaggcaagcttcaaaccgca

SEQ ID NO: 78455 - DNA, 25 bp, E. coli
gctatgaggcaaccttcaaaccgca

SEQ ID NO: 78456 - DNA, 25 bp, E. coli
gaatggagcagaggtttcgcctcga

SEQ ID NO: 78457 - DNA, 25 bp, E. coli
gcaagcttcaaagcgcaaagcggag

SEQ ID NO: 78458 - DNA, 25 bp, E. coli
gcaagcttcaaaccgcaaagcggag

SEQ ID NO: 78459 - DNA, 25 bp, E. coli
gaatggagcagacgtttcgcctcga

SEQ ID NO: 78460 - DNA, 25 bp, E. coli
gttcgcgccagctggaagtgactcc

SEQ ID NO: 78461 - DNA, 25 bp, E. coli
gttcgcgccagcaggaagtgactcc

SEQ ID NO: 78462 - DNA, 25 bp, E. coli
ggtacgctgagcaataaaggaacgc

SEQ ID NO: 78463 - DNA, 25 bp, E. coli
ggtacgctgagctataaaggaacgc

SEQ ID NO: 78464 - DNA, 25 bp, E. coli
tggtgagcaacaagcgggaaaaacc

SEQ ID NO: 78465 - DNA, 25 bp, E. coli
cacagtaaccgctgatcatagcaaa

SEQ ID NO: 78466 - DNA, 25 bp, E. coli
cacagtaaccgcagatcatagcaaa

SEQ ID NO: 78467 - DNA, 25 bp, E. coli
gacttttaatttgatttgaggacga

SEQ ID NO: 78468 - DNA, 25 bp, E. coli
gacttttaatttcatttgaggacga

SEQ ID NO: 78469 - DNA, 25 bp, E. coli
cctctgaaggcggaatatcagcaaa

SEQ ID NO: 78470 - DNA, 25 bp, E. coli
cctctgaaggcgcaatatcagcaaa

SEQ ID NO: 78471 - DNA, 25 bp, E. coli
cctggagttattacaacctattgac

SEQ ID NO: 78472 - DNA, 25 bp, E. coli
cctggagttatttcaacctattgac

SEQ ID NO: 78473 - DNA, 25 bp, E. coli
gaatatcagcaaattcctggagtta

SEQ ID NO: 78474 - DNA, 25 bp, E. coli
gaatatcagcaatttcctggagtta

SEQ ID NO: 78475 - DNA, 25 bp, E. coli
gcaattcacattgccgaaagcgtgt

SEQ ID NO: 78476 - DNA, 25 bp, E. coli
gcaattcacattcccgaaagcgtgt

SEQ ID NO: 78477 - DNA, 25 bp, E. coli
gaaagcgtgtccgatatcgcacaat

SEQ ID NO: 78478 - DNA, 25 bp, E. coli
gaaagcgtgtcccatatcgcacaat

SEQ ID NO: 78479 - DNA, 25 bp, E. coli
ctgatttcacagcatagatcccacg

SEQ ID NO: 78480 - DNA, 25 bp, E. coli
cattaagcacatgacagtaaccgct

SEQ ID NO: 78481 - DNA, 25 bp, E. coli
ctgatttcacaggatagatcccacg

SEQ ID NO: 78482 - DNA, 25 bp, E. coli
cattaagcacatcacagtaaccgct

SEQ ID NO: 78483 - DNA, 25 bp, E. coli
gatatcgcacaataaccgctgattt

SEQ ID NO: 78484 - DNA, 25 bp, E. coli
gatcatagcaaaccctctgaaggcg

SEQ ID NO: 78485 - DNA, 25 bp, E. coli
gatatcgcacaaaaaccgctgattt

SEQ ID NO: 78486 - DNA, 25 bp, E. coli
gatcatagcaaagcctctgaaggcg

SEQ ID NO: 78487 - DNA, 25 bp, E. coli
tactttgaaccactgacgatacagg

SEQ ID NO: 78488 - DNA, 25 bp, E. coli
tactttgaaccagtgacgatacagg

SEQ ID NO: 78489 - DNA, 25 bp, E. coli
agttagaaaacactgaggacggtgc

SEQ ID NO: 78490 - DNA, 25 bp, E. coli
acggtgcgggtctaataggctttca

SEQ ID NO: 78491 - DNA, 25 bp, E. coli
acggtgcgggtcaaataggctttca

SEQ ID NO: 78492 - DNA, 25 bp, E. coli
agttagaaaacagtgaggacggtgc

SEQ ID NO: 78493 - DNA, 25 bp, E. coli
taggctttcaactctccaatgatgg

SEQ ID NO: 78494 - DNA, 25 bp, E. coli
taggctttcaacactccaatgatgg

SEQ ID NO: 78495 - DNA, 25 bp, E. coli
ttgaagatcaatccatcgacactgg

SEQ ID NO: 78496 - DNA, 25 bp, E. coli
ttgaagatcaatgcatcgacactgg

SEQ ID NO: 78497 - DNA, 25 bp, E. coli
tccagggcgagctaggtgaattagt

SEQ ID NO: 78498 - DNA, 25 bp, E. coli
tccaatgatggttcgaatgaaatcc

SEQ ID NO: 78499 - DNA, 25 bp, E. coli
tccagggcgagcaaggtgaattagt

SEQ ID NO: 78500 - DNA, 25 bp, E. coli
tccaatgatggtacgaatgaaatcc

SEQ ID NO: 78501 - DNA, 25 bp, E. coli
gaattagtttttgaacccagtgacg

SEQ ID NO: 78502 - DNA, 25 bp, E. coli
gaattagtttttcaacccagtgacg

SEQ ID NO: 78503 - DNA, 25 bp, E. coli
gatacaggagtcaggaaccagcata

SEQ ID NO: 78504 - DNA, 25 bp, E. coli
gatacaggagtctggaaccagcata

SEQ ID NO: 78505 - DNA, 25 bp, E. coli
taatactaattgaaatagcgtccgc

SEQ ID NO: 78506 - DNA, 25 bp, E. coli
taatactaattgtaatagcgtccgc

SEQ ID NO: 78507 - DNA, 25 bp, E. coli
taagatttgactccatccagggcga

SEQ ID NO: 78508 - DNA, 25 bp, E. coli
taagatttgactgcatccagggcga

SEQ ID NO: 78509 - DNA, 25 bp, E. coli
cagtccacggtatgcaggtttacta

SEQ ID NO: 78510 - DNA, 25 bp, E. coli
catggttgtcctctagagtcgatcg

SEQ ID NO: 78511 - DNA, 25 bp, E. coli
catatctctgtgtagagcgagccag

SEQ ID NO: 78512 - DNA, 25 bp, E. coli
cagtccacggtaagcaggtttacta

SEQ ID NO: 78513 - DNA, 25 bp, E. coli
catggttgtcctgtagagtcgatcg

SEQ ID NO: 78514 - DNA, 25 bp, E. coli
catatctctgtgaagagcgagccag

SEQ ID NO: 78515 - DNA, 25 bp, E. coli
tatgagatgactcataagaacgggc

SEQ ID NO: 78516 - DNA, 25 bp, E. coli
tatgagatgactgataagaacgggc

SEQ ID NO: 78517 - DNA, 25 bp, E. coli
tagcctcgatgctttgtgaacagcc

SEQ ID NO: 78518 - DNA, 25 bp, E. coli
tagcctcgatgcattgtgaacagcc

SEQ ID NO: 78519 - DNA, 25 bp, E. coli
tgttgctcgtaatggcagtccacgg

SEQ ID NO: 78520 - DNA, 25 bp, E. coli
tgttgctcgtaaaggcagtccacgg

SEQ ID NO: 78521 - DNA, 25 bp, E. coli
gacaaatttggaagacgcgcagaga

SEQ ID NO: 78522 - DNA, 25 bp, E. coli
gacaaatttggatgacgcgcagaga

SEQ ID NO: 78523 - DNA, 25 bp, E. coli
cattaagaatgccaaacgaacggga

SEQ ID NO: 78524 - DNA, 25 bp, E. coli
cattaagaatgcgaaacgaacggga

SEQ ID NO: 78525 - DNA, 25 bp, E. coli
taaggcaacttgtggagtgggccct

SEQ ID NO: 78526 - DNA, 25 bp, E. coli
taaggcaacttgaggagtgggccct

SEQ ID NO: 78527 - DNA, 25 bp, E. coli
gagatctgaaaagaacaccggttga

SEQ ID NO: 78528 - DNA, 25 bp, E. coli
gagatctgaaaacaacaccggttga

SEQ ID NO: 78529 - DNA, 25 bp, E. coli
gagatgctcctggattacagcgatg

SEQ ID NO: 78530 - DNA, 25 bp, E. coli
gagatgctcctgcattacagcgatg

SEQ ID NO: 78531 - DNA, 25 bp, E. coli
ttttcatcgggtctgggcttctggt

SEQ ID NO: 78532 - DNA, 25 bp, E. coli
ttttcatcgggtgtgggcttctggt

SEQ ID NO: 78533 - DNA, 25 bp, E. coli
tgaaaaaactttgtccatggctggg

SEQ ID NO: 78534 - DNA, 25 bp, E. coli
tgaaaaaactttctccatggctggg

SEQ ID NO: 78535 - DNA, 25 bp, E. coli
gccgcggataatcaaattccgccgc

SEQ ID NO: 78536 - DNA, 25 bp, E. coli
gccgcggataatgaaattccgccgc

SEQ ID NO: 78537 - DNA, 25 bp, E. coli
gcgacgattcgggatgttccctgcc

SEQ ID NO: 78538 - DNA, 25 bp, E. coli
gcttttcatcgggtgtgggcttctg

SEQ ID NO: 78539 - DNA, 25 bp, E. coli
gcgacgattcggcatgttccctgcc

SEQ ID NO: 78540 - DNA, 25 bp, E. coli
gcttttcatcggctgtgggcttctg

SEQ ID NO: 78541 - DNA, 25 bp, E. coli
gatcgatggtgaaatcgtctaccag

SEQ ID NO: 78542 - DNA, 25 bp, E. coli
gattcgggatgttccctgcctgaaa

SEQ ID NO: 78543 - DNA, 25 bp, E. coli
gatcgatggtgatatcgtctaccag

SEQ ID NO: 78544 - DNA, 25 bp, E. coli
gattcgggatgtaccctgcctgaaa

SEQ ID NO: 78545 - DNA, 25 bp, E. coli
ggtgaaatcgtcaaccagaggtcaa

SEQ ID NO: 78546 - DNA, 25 bp, E. coli
gggatgttccctccctgaaaaaact

SEQ ID NO: 78547 - DNA, 25 bp, E. coli
gggatgttccctgcctgaaaaaact

SEQ ID NO: 78548 - DNA, 25 bp, E. coli
ggtgaaatcgtctaccagaggtcaa

SEQ ID NO: 78549 - DNA, 25 bp, E. coli
tgttccctgcctgaaaaaactttct

SEQ ID NO: 78550 - DNA, 25 bp, E. coli
tgttccctgcctcaaaaaactttct

SEQ ID NO: 78551 - DNA, 25 bp, E. coli
tcagcgccgcggttaatgaaattcc

SEQ ID NO: 78552 - DNA, 25 bp, E. coli
tcagcgccgcggataatgaaattcc

SEQ ID NO: 78553 - DNA, 25 bp, E. coli
taaagcgttctgctccggtggtgac

SEQ ID NO: 78554 - DNA, 25 bp, E. coli
taaagcgttctggtccggtggtgac

SEQ ID NO: 78555 - DNA, 25 bp, E. coli
accattaatcgtccgcaggtgcgca

SEQ ID NO: 78556 - DNA, 25 bp, E. coli
accattaatcgtgcgcaggtgcgca

SEQ ID NO: 78557 - DNA, 25 bp, E. coli
taccgctggcggatctggaaaaaga

SEQ ID NO: 78558 - DNA, 25 bp, E. coli
tatgaaaaatcctccgacggtatcg

SEQ ID NO: 78559 - DNA, 25 bp, E. coli
tatgaaaaatccaccgacggtatcg

SEQ ID NO: 78560 - DNA, 25 bp, E. coli
taccgctggcggttctggaaaaaga

SEQ ID NO: 78561 - DNA, 25 bp, E. coli
ttacggcggctaaaaagatgattcc

SEQ ID NO: 78562 - DNA, 25 bp, E. coli
ttacggcggctataaagatgattcc

SEQ ID NO: 78563 - DNA, 25 bp, E. coli
tgatgtgcgaccagactatcgcggc

SEQ ID NO: 78564 - DNA, 25 bp, E. coli
tgatgtgcgacctgactatcgcggc

SEQ ID NO: 78565 - DNA, 25 bp, E. coli
tgacggtaaaagagatgatccaggc

SEQ ID NO: 78566 - DNA, 25 bp, E. coli
tgacggtaaaagtgatgatccaggc

SEQ ID NO: 78567 - DNA, 25 bp, E. coli
gaagcaatgctttacgcaccggttg

SEQ ID NO: 78568 - DNA, 25 bp, E. coli
gaagcaatgcttaacgcaccggttg

SEQ ID NO: 78569 - DNA, 25 bp, E. coli
gaaatctggttcctgtgccgtcagt

SEQ ID NO: 78570 - DNA, 25 bp, E. coli
gaaatctggttcgtgtgccgtcagt

SEQ ID NO: 78571 - DNA, 25 bp, E. coli
gataatgccatcatcggtcagactg

SEQ ID NO: 78572 - DNA, 25 bp, E. coli
gataatgccatcttcggtcagactg

SEQ ID NO: 78573 - DNA, 25 bp, E. coli
gatgattccggcgtacatcacctga

SEQ ID NO: 78574 - DNA, 25 bp, E. coli
gatgattccggcctacatcacctga

SEQ ID NO: 78575 - DNA, 25 bp, E. coli
tacaagaaatttatatcgggcaggg

SEQ ID NO: 78576 - DNA, 25 bp, E. coli
tacaagaaatttttatcgggcaggg

SEQ ID NO: 78577 - DNA, 25 bp, E. coli
agtatttcgcatagccgtacccacg

SEQ ID NO: 78578 - DNA, 25 bp, E. coli
agtatttcgcattgccgtacccacg

SEQ ID NO: 78579 - DNA, 25 bp, E. coli
tattgaaataaagcatgatgcagcc

SEQ ID NO: 78580 - DNA, 25 bp, E. coli
tattgaaataaaccatgatgcagcc

SEQ ID NO: 78581 - DNA, 25 bp, E. coli
tgaaattgccagtataaccaaagcc

SEQ ID NO: 78582 - DNA, 25 bp, E. coli
tgaaattgccagaataaccaaagcc

SEQ ID NO: 78583 - DNA, 25 bp, E. coli
cctctggattctcggcggcgaaaga

SEQ ID NO: 78584 - DNA, 25 bp, E. coli
cctctggattctgggcggcgaaaga

SEQ ID NO: 78585 - DNA, 25 bp, E. coli
gaacctgattatgaacgggcctctg

SEQ ID NO: 78586 - DNA, 25 bp, E. coli
gaacctgattatcaacgggcctctg

SEQ ID NO: 78587 - DNA, 25 bp, E. coli
cgtgtttatactactcatgagcgct

SEQ ID NO: 78588 - DNA, 25 bp, E. coli
cgtgtttatacttctcatgagcgct

SEQ ID NO: 78589 - DNA, 25 bp, E. coli
gggttgcaaaataactccctgagta

SEQ ID NO: 78590 - DNA, 25 bp, E. coli
gggttgcaaaattactccctgagta

SEQ ID NO: 78591 - DNA, 25 bp, E. coli
gatgcagccaaaccaccttatttcg

SEQ ID NO: 78592 - DNA, 25 bp, E. coli
gatggcgtacgtatccaggatattg

SEQ ID NO: 78593 - DNA, 25 bp, E. coli
gagcgcttactctttaaccctgcag

SEQ ID NO: 78594 - DNA, 25 bp, E. coli
gagcgcttactcattaaccctgcag

SEQ ID NO: 78595 - DNA, 25 bp, E. coli
gatgcagccaaagcaccttatttcg

SEQ ID NO: 78596 - DNA, 25 bp, E. coli
gatggcgtacgtttccaggatattg

SEQ ID NO: 78597 - DNA, 25 bp, E. coli
aagattgtgcgaatgcggggaatct

SEQ ID NO: 78598 - DNA, 25 bp, E. coli
aatctgctgagctgtgctttcagaa

SEQ ID NO: 78599 - DNA, 25 bp, E. coli
aagattgtgcgattgcggggaatct

SEQ ID NO: 78600 - DNA, 25 bp, E. coli
aatctgctgagcagtgctttcagaa

SEQ ID NO: 78601 - DNA, 25 bp, E. coli
atctgctgagctgtgctttcagaac

SEQ ID NO: 78602 - DNA, 25 bp, E. coli
agtcaacacggtcagaatgtcccct

SEQ ID NO: 78603 - DNA, 25 bp, E. coli
agtcaacacggtgagaatgtcccct

SEQ ID NO: 78604 - DNA, 25 bp, E. coli
atctgctgagctctgctttcagaac

SEQ ID NO: 78605 - DNA, 25 bp, E. coli
tagtcaacacggacagaatgtcccc

SEQ ID NO: 78606 - DNA, 25 bp, E. coli
tagtcaacacggtcagaatgtcccc

SEQ ID NO: 78607 - DNA, 25 bp, E. coli
tttatgaagattgtgcgaatgcggg

SEQ ID NO: 78608 - DNA, 25 bp, E. coli
tttatgaagattctgcgaatgcggg

SEQ ID NO: 78609 - DNA, 25 bp, E. coli
gaatctgctgaggtgtgctttcaga

SEQ ID NO: 78610 - DNA, 25 bp, E. coli
gaatctgctgagctgtgctttcaga

SEQ ID NO: 78611 - DNA, 25 bp, E. coli
gtagtcaacacggtcagaatgtccc

SEQ ID NO: 78612 - DNA, 25 bp, E. coli
gatttatgaagaatgtgcgaatgcg

SEQ ID NO: 78613 - DNA, 25 bp, E. coli
gatttatgaagattgtgcgaatgcg

SEQ ID NO: 78614 - DNA, 25 bp, E. coli
gggaatctgctgagctgtgctttca

SEQ ID NO: 78615 - DNA, 25 bp, E. coli
gtgagatttatgaagattgtgcgaa

SEQ ID NO: 78616 - DNA, 25 bp, E. coli
gggaatctgctgtgctgtgctttca

SEQ ID NO: 78617 - DNA, 25 bp, E. coli
gtgagatttatgtagattgtgcgaa

SEQ ID NO: 78618 - DNA, 25 bp, E. coli
gtagtcaacacgctcagaatgtccc

SEQ ID NO: 78619 - DNA, 25 bp, E. coli
aatggccgacagatcccagagagca

SEQ ID NO: 78620 - DNA, 25 bp, E. coli
aatggccgacagttcccagagagca

SEQ ID NO: 78621 - DNA, 25 bp, E. coli
cttatggtgtaaccctgccctggca

SEQ ID NO: 78622 - DNA, 25 bp, E. coli
cagtggaagaacctgggaacgactc

SEQ ID NO: 78623 - DNA, 25 bp, E. coli
cagtggaagaacgtgggaacgactc

SEQ ID NO: 78624 - DNA, 25 bp, E. coli
cttatggtgtaagcctgccctggca

SEQ ID NO: 78625 - DNA, 25 bp, E. coli
aaatatctttctggccggtggtgca

SEQ ID NO: 78626 - DNA, 25 bp, E. coli
aaatatctttctcgccggtggtgca

SEQ ID NO: 78627 - DNA, 25 bp, E. coli
tttattggaacgtcggtagccggag

SEQ ID NO: 78628 - DNA, 25 bp, E. coli
tttattggaacgacggtagccggag

SEQ ID NO: 78629 - DNA, 25 bp, E. coli
ttatgacccgtcaaaaaaccagtgg

SEQ ID NO: 78630 - DNA, 25 bp, E. coli
ttatgacccgtctaaaaaccagtgg

SEQ ID NO: 78631 - DNA, 25 bp, E. coli
tcatcggtgatttttgcagaacagc

SEQ ID NO: 78632 - DNA, 25 bp, E. coli
tcatcggtgattattgcagaacagc

SEQ ID NO: 78633 - DNA, 25 bp, E. coli
ccgggagcggcagaaaagtatagca

SEQ ID NO: 78634 - DNA, 25 bp, E. coli
ccgggagcggcacaaaagtatagca

SEQ ID NO: 78635 - DNA, 25 bp, E. coli
gaacgactccatttccgggaactgc

SEQ ID NO: 78636 - DNA, 25 bp, E. coli
gaacgactccatatccgggaactgc

SEQ ID NO: 78637 - DNA, 25 bp, E. coli
tggactaagataccgcaatggccga

SEQ ID NO: 78638 - DNA, 25 bp, E. coli
tggactaagatagcgcaatggccga

SEQ ID NO: 78639 - DNA, 25 bp, E. coli
gagttatcaaaacggaattccgcgc

SEQ ID NO: 78640 - DNA, 25 bp, E. coli
gagttatcaaaagggaattccgcgc

SEQ ID NO: 78641 - DNA, 25 bp, E. coli
acacaaattattacagactgcccgc

SEQ ID NO: 78642 - DNA, 25 bp, E. coli
acacaaattatttcagactgcccgc

SEQ ID NO: 78643 - DNA, 25 bp, E. coli
tgataatgcgtgaaggccggaccac

SEQ ID NO: 78644 - DNA, 25 bp, E. coli
tgataatgcgtgtaggccggaccac

SEQ ID NO: 78645 - DNA, 25 bp, E. coli
tcgatctgataatgcgtgaaggccg

SEQ ID NO: 78646 - DNA, 25 bp, E. coli
tcgccgctaacgtgaacgagcgtgg

SEQ ID NO: 78647 - DNA, 25 bp, E. coli
tcgccgctaacgagaacgagcgtgg

SEQ ID NO: 78648 - DNA, 25 bp, E. coli
tcgatctgataaagcgtgaaggccg

SEQ ID NO: 78649 - DNA, 25 bp, E. coli
tctgataatgcgtgaaggccggacc

SEQ ID NO: 78650 - DNA, 25 bp, E. coli
tctgataatgcgagaaggccggacc

SEQ ID NO: 78651 - DNA, 25 bp, E. coli
ccaccaaacagaccggcgatgcgtg

SEQ ID NO: 78652 - DNA, 25 bp, E. coli
ccaccaaacagagcggcgatgcgtg

SEQ ID NO: 78653 - DNA, 25 bp, E. coli
cgtcgctggctgcaaggcaaaggac

SEQ ID NO: 78654 - DNA, 25 bp, E. coli
cgtggcggcgagatcgatctgataa

SEQ ID NO: 78655 - DNA, 25 bp, E. coli
cggcagccagtgagacccgcagcaa

SEQ ID NO: 78656 - DNA, 25 bp, E. coli
cgtcgctggctggaaggcaaaggac

SEQ ID NO: 78657 - DNA, 25 bp, E. coli
cggcagccagtgtgacccgcagcaa

SEQ ID NO: 78658 - DNA, 25 bp, E. coli
cgtggcggcgagttcgatctgataa

SEQ ID NO: 78659 - DNA, 25 bp, E. coli
gttaaccaccaaacagaccggcgat

SEQ ID NO: 78660 - DNA, 25 bp, E. coli
gttaaccaccaatcagaccggcgat

SEQ ID NO: 78661 - DNA, 25 bp, E. coli
gacccgcagcaaacaacacaaatta

SEQ ID NO: 78662 - DNA, 25 bp, E. coli
gacccgcagcaatcaacacaaatta

SEQ ID NO: 78663 - DNA, 25 bp, E. coli
caaacatcgtgtgcgctgatggcag

SEQ ID NO: 78664 - DNA, 25 bp, E. coli
caaacatcgtgtccgctgatggcag

SEQ ID NO: 78665 - DNA, 25 bp, E. coli
cagagtaggtggtggactccagaca

SEQ ID NO: 78666 - DNA, 25 bp, E. coli
cagagtaggtggaggactccagaca

SEQ ID NO: 78667 - DNA, 25 bp, E. coli
catcgtgtgcgctgatggcagagta

SEQ ID NO: 78668 - DNA, 25 bp, E. coli
catcgtgtgcgcagatggcagagta

SEQ ID NO: 78669 - DNA, 25 bp, E. coli
attctgcactgagaaaaattatatc

SEQ ID NO: 78670 - DNA, 25 bp, E. coli
attctgcactgacaaaaattatatc

SEQ ID NO: 78671 - DNA, 25 bp, E. coli
taggtggaggactccagacagtcaa

SEQ ID NO: 78672 - DNA, 25 bp, E. coli
taggtggaggacaccagacagtcaa

SEQ ID NO: 78673 - DNA, 25 bp, E. coli
gatagcctttatcgaggttcctgca

SEQ ID NO: 78674 - DNA, 25 bp, E. coli
gtcaaacgatagaaaaagatagcct

SEQ ID NO: 78675 - DNA, 25 bp, E. coli
gatagcctttatggaggttcctgca

SEQ ID NO: 78676 - DNA, 25 bp, E. coli
ggaggttcctgcaatgtcaaataca

SEQ ID NO: 78677 - DNA, 25 bp, E. coli
gtcaaacgatagtaaaagatagcct

SEQ ID NO: 78678 - DNA, 25 bp, E. coli
ggcaattgaattctgcactgacaaa

SEQ ID NO: 78679 - DNA, 25 bp, E. coli
ggaggttcctgctatgtcaaataca

SEQ ID NO: 78680 - DNA, 25 bp, E. coli
ggcaattgaattgtgcactgacaaa

SEQ ID NO: 78681 - DNA, 25 bp, E. coli
taaggataatcaaacatcgtgtgcg

SEQ ID NO: 78682 - DNA, 25 bp, E. coli
taaggataatcatacatcgtgtgcg

SEQ ID NO: 78683 - DNA, 25 bp, E. coli
gagtcaacggcctgggaaagatcat

SEQ ID NO: 78684 - DNA, 25 bp, E. coli
gagtcaacggccagggaaagatcat

SEQ ID NO: 78685 - DNA, 25 bp, E. coli
caatcaacgaaacgcagttcccaac

SEQ ID NO: 78686 - DNA, 25 bp, E. coli
caatcaacgaaaggcagttcccaac

SEQ ID NO: 78687 - DNA, 25 bp, E. coli
catctttccgttttcaggtgggaga

SEQ ID NO: 78688 - DNA, 25 bp, E. coli
caacaacaaaataaagatgggaggt

SEQ ID NO: 78689 - DNA, 25 bp, E. coli
caacaacaaaattaagatgggaggt

SEQ ID NO: 78690 - DNA, 25 bp, E. coli
catctttccgttatcaggtgggaga

SEQ ID NO: 78691 - DNA, 25 bp, E. coli
taaaggcccaggcagttagcaacct

SEQ ID NO: 78692 - DNA, 25 bp, E. coli
taaaggcccagggagttagcaacct

SEQ ID NO: 78693 - DNA, 25 bp, E. coli
attttcggacaatcgcgcgcgtagc

SEQ ID NO: 78694 - DNA, 25 bp, E. coli
attttcggacaaacgcgcgcgtagc

SEQ ID NO: 78695 - DNA, 25 bp, E. coli
ttttccagatttcacgtacacgcgc

SEQ ID NO: 78696 - DNA, 25 bp, E. coli
ttttccagatttgacgtacacgcgc

SEQ ID NO: 78697 - DNA, 25 bp, E. coli
tgaaacggtgggaagtggctttact

SEQ ID NO: 78698 - DNA, 25 bp, E. coli
tgaaacggtgggtagtggctttact

SEQ ID NO: 78699 - DNA, 25 bp, E. coli
ccaaagccaacaagatgggaggtga

SEQ ID NO: 78700 - DNA, 25 bp, E. coli
ccaaagccaacatgatgggaggtga

SEQ ID NO: 78701 - DNA, 25 bp, E. coli
gcagatcgctttttcccttcaggca

SEQ ID NO: 78702 - DNA, 25 bp, E. coli
gcagatcgctttatcccttcaggca

SEQ ID NO: 78703 - DNA, 25 bp, E. coli
tggccgccgacgatgcacaattgat

SEQ ID NO: 78704 - DNA, 25 bp, E. coli
tggccgccgacgttgcacaattgat

SEQ ID NO: 78705 - DNA, 25 bp, E. coli
tcagcggcaagagtggcggtcattt

SEQ ID NO: 78706 - DNA, 25 bp, E. coli
tcagcggcaagactggcggtcattt

SEQ ID NO: 78707 - DNA, 25 bp, E. coli
cacgagttggcctttagtctggaga

SEQ ID NO: 78708 - DNA, 25 bp, E. coli
cacgagttggccattagtctggaga

SEQ ID NO: 78709 - DNA, 25 bp, E. coli
cacgtattgcggcattgcaggtcaa

SEQ ID NO: 78710 - DNA, 25 bp, E. coli
cacgtattgcgggattgcaggtcaa

SEQ ID NO: 78711 - DNA, 25 bp, E. coli
tgatgagccgctaacgtttgacctg

SEQ ID NO: 78712 - DNA, 25 bp, E. coli
tgatgagccgcttacgtttgacctg

SEQ ID NO: 78713 - DNA, 25 bp, E. coli
tccagagttggttttgccgccagtt

SEQ ID NO: 78714 - DNA, 25 bp, E. coli
tcgctgcgtgataccgtatgccggg

SEQ ID NO: 78715 - DNA, 25 bp, E. coli
tccagagttggtattgccgccagtt

SEQ ID NO: 78716 - DNA, 25 bp, E. coli
tcgctgcgtgattccgtatgccggg

SEQ ID NO: 78717 - DNA, 25 bp, E. coli
tcagagcgacaagcttctccagagt

SEQ ID NO: 78718 - DNA, 25 bp, E. coli
gaaacaatacgttatcgctgcgtga

SEQ ID NO: 78719 - DNA, 25 bp, E. coli
gaaacaatacgtaatcgctgcgtga

SEQ ID NO: 78720 - DNA, 25 bp, E. coli
gaaagaagcctattgccacgagttg

SEQ ID NO: 78721 - DNA, 25 bp, E. coli
gaaagaagcctaatgccacgagttg

SEQ ID NO: 78722 - DNA, 25 bp, E. coli
tggcaagggcattatcagagcgaca

SEQ ID NO: 78723 - DNA, 25 bp, E. coli
tggcaagggcataatcagagcgaca

SEQ ID NO: 78724 - DNA, 25 bp, E. coli
tcagagcgacaaccttctccagagt

SEQ ID NO: 78725 - DNA, 25 bp, E. coli
gatgcgccaatctgttcagacggta

SEQ ID NO: 78726 - DNA, 25 bp, E. coli
gatgctgtaccaggatgatgagccg

SEQ ID NO: 78727 - DNA, 25 bp, E. coli
gatgctgtaccacgatgatgagccg

SEQ ID NO: 78728 - DNA, 25 bp, E. coli
gatgcgccaatcagttcagacggta

SEQ ID NO: 78729 - DNA, 25 bp, E. coli
catgcaggccttggttgaatacggt

SEQ ID NO: 78730 - DNA, 25 bp, E. coli
catgcaggccttcgttgaatacggt

SEQ ID NO: 78731 - DNA, 25 bp, E. coli
tatgaaagggaacagccatgactgc

SEQ ID NO: 78732 - DNA, 25 bp, E. coli
tagcgccgggtgaaagcgtaccgat

SEQ ID NO: 78733 - DNA, 25 bp, E. coli
tagcgccgggtgtaagcgtaccgat

SEQ ID NO: 78734 - DNA, 25 bp, E. coli
tatgaaagggaagagccatgactgc

SEQ ID NO: 78735 - DNA, 25 bp, E. coli
tattgtgtgctcacccggtagtggg

SEQ ID NO: 78736 - DNA, 25 bp, E. coli
tattgtgtgctctcccggtagtggg

SEQ ID NO: 78737 - DNA, 25 bp, E. coli
gaaacgggtcatagccagatcatgg

SEQ ID NO: 78738 - DNA, 25 bp, E. coli
gaaacgggtcattgccagatcatgg

SEQ ID NO: 78739 - DNA, 25 bp, E. coli
gattaggaaccaggatgttgccggc

SEQ ID NO: 78740 - DNA, 25 bp, E. coli
gattaggaaccacgatgttgccggc

SEQ ID NO: 78741 - DNA, 25 bp, E. coli
ggtattcgtcataacacccttggca

SEQ ID NO: 78742 - DNA, 25 bp, E. coli
ggtattcgtcattacacccttggca

SEQ ID NO: 78743 - DNA, 25 bp, E. coli
taacctggcagagatgatccgccgc

SEQ ID NO: 78744 - DNA, 25 bp, E. coli
taataaattaggatacatgcaggcc

SEQ ID NO: 78745 - DNA, 25 bp, E. coli
taataaattaggttacatgcaggcc

SEQ ID NO: 78746 - DNA, 25 bp, E. coli
taacctggcagacatgatccgccgc

SEQ ID NO: 78747 - DNA, 25 bp, E. coli
gatgctgccactagtcgataagcca

SEQ ID NO: 78748 - DNA, 25 bp, E. coli
gatgaaattcaggtcaccgacgcaa

SEQ ID NO: 78749 - DNA, 25 bp, E. coli
gatgctgccacttgtcgataagcca

SEQ ID NO: 78750 - DNA, 25 bp, E. coli
gatgaaattcagctcaccgacgcaa

SEQ ID NO: 78751 - DNA, 25 bp, E. coli
acgtacgcgcataatgaacgtcagc

SEQ ID NO: 78752 - DNA, 25 bp, E. coli
acgtacgcgcattatgaacgtcagc

SEQ ID NO: 78753 - DNA, 25 bp, E. coli
tcctccgtgcggctaacgatcatga

SEQ ID NO: 78754 - DNA, 25 bp, E. coli
tcctccgtgcgggtaacgatcatga

SEQ ID NO: 78755 - DNA, 25 bp, E. coli
tgcgggtaacgatcatgagaaagag

SEQ ID NO: 78756 - DNA, 25 bp, E. coli
tgcgggtaacgaacatgagaaagag

SEQ ID NO: 78757 - DNA, 25 bp, E. coli
ccgtgcgggtaacgatcatgagaaa

SEQ ID NO: 78758 - DNA, 25 bp, E. coli
ccgtgcgggtaaggatcatgagaaa

SEQ ID NO: 78759 - DNA, 25 bp, E. coli
gaataagatcctgcgtgcgggtaac

SEQ ID NO: 78760 - DNA, 25 bp, E. coli
gaataagatcctccgtgcgggtaac

SEQ ID NO: 78761 - DNA, 25 bp, E. coli
ccgattaccgatgaatttattcgtg

SEQ ID NO: 78762 - DNA, 25 bp, E. coli
ccgatgaatttaatcgtggtatggg

SEQ ID NO: 78763 - DNA, 25 bp, E. coli
ccgatgaatttattcgtggtatggg

SEQ ID NO: 78764 - DNA, 25 bp, E. coli
ccgattaccgatcaatttattcgtg

SEQ ID NO: 78765 - DNA, 25 bp, E. coli
ctccgtgcgggttacgatcatgaga

SEQ ID NO: 78766 - DNA, 25 bp, E. coli
ctccgtgcgggtaacgatcatgaga

SEQ ID NO: 78767 - DNA, 25 bp, E. coli
gtgaataagatcctccgtgcgggta

SEQ ID NO: 78768 - DNA, 25 bp, E. coli
gtgaataagatcgtccgtgcgggta

SEQ ID NO: 78769 - DNA, 25 bp, E. coli
ggaacgtacgcgcattatgaacgtc

SEQ ID NO: 78770 - DNA, 25 bp, E. coli
ggaacgtacgcggattatgaacgtc

SEQ ID NO: 78771 - DNA, 25 bp, E. coli
taagatcctccgtgcgggtaacgat

SEQ ID NO: 78772 - DNA, 25 bp, E. coli
taagatcctccgagcgggtaacgat

SEQ ID NO: 78773 - DNA, 25 bp, E. coli
aagcctggtttctaattagcaggca

SEQ ID NO: 78774 - DNA, 25 bp, E. coli
aagcctggtttcaaattagcaggca

SEQ ID NO: 78775 - DNA, 25 bp, E. coli
aattagcaggcatgctggtacttct

SEQ ID NO: 78776 - DNA, 25 bp, E. coli
aattagcaggcaagctggtacttct

SEQ ID NO: 78777 - DNA, 25 bp, E. coli
caggcaagctggaacttcttaccgc

SEQ ID NO: 78778 - DNA, 25 bp, E. coli
caggcaagctggtacttcttaccgc

SEQ ID NO: 78779 - DNA, 25 bp, E. coli
atgaatactcgctggcaacaggccg

SEQ ID NO: 78780 - DNA, 25 bp, E. coli
atgaatactcgcaggcaacaggccg

SEQ ID NO: 78781 - DNA, 25 bp, E. coli
ttcaaattagcacgcaagctggtac

SEQ ID NO: 78782 - DNA, 25 bp, E. coli
ttcaaattagcaggcaagctggtac

SEQ ID NO: 78783 - DNA, 25 bp, E. coli
tgaaaatgttgcaggctgtggcgct

SEQ ID NO: 78784 - DNA, 25 bp, E. coli
tgaaaatgttgctggctgtggcgct

SEQ ID NO: 78785 - DNA, 25 bp, E. coli
tcgctggcaacaggccgggcaaaag

SEQ ID NO: 78786 - DNA, 25 bp, E. coli
tcgctggcaacacgccgggcaaaag

SEQ ID NO: 78787 - DNA, 25 bp, E. coli
gctgtggcgctggaaccgctgttaa

SEQ ID NO: 78788 - DNA, 25 bp, E. coli
gctgtggcgctgcaaccgctgttaa

SEQ ID NO: 78789 - DNA, 25 bp, E. coli
cgctggaaccgctgttaagtcgggc

SEQ ID NO: 78790 - DNA, 25 bp, E. coli
cgctggaaccgcagttaagtcgggc

SEQ ID NO: 78791 - DNA, 25 bp, E. coli
ggtttcaaattaccaggcaagctgg

SEQ ID NO: 78792 - DNA, 25 bp, E. coli
ggtttcaaattagcaggcaagctgg

SEQ ID NO: 78793 - DNA, 25 bp, E. coli
tggaaccgctgtaaagtcgggctgc

SEQ ID NO: 78794 - DNA, 25 bp, E. coli
tggaaccgctgttaagtcgggctgc

SEQ ID NO: 78795 - DNA, 25 bp, E. coli
aggacgcgcgcttcggtggaaaagg

SEQ ID NO: 78796 - DNA, 25 bp, E. coli
aggacgcgcgctacggtggaaaagg

SEQ ID NO: 78797 - DNA, 25 bp, E. coli
acgaagagttttaccgtgagcggca

SEQ ID NO: 78798 - DNA, 25 bp, E. coli
acgaagagtttttccgtgagcggca

SEQ ID NO: 78799 - DNA, 25 bp, E. coli
tatgcctgattacgacaactatgtc

SEQ ID NO: 78800 - DNA, 25 bp, E. coli
tatgcctgattaggacaactatgtc

SEQ ID NO: 78801 - DNA, 25 bp, E. coli
ttaaccatcccgttcaaacgccgat

SEQ ID NO: 78802 - DNA, 25 bp, E. coli
ttaaccatcccgatcaaacgccgat

SEQ ID NO: 78803 - DNA, 25 bp, E. coli
tatgtcgaacatatgcgggttaacc

SEQ ID NO: 78804 - DNA, 25 bp, E. coli
tatgtcgaacatttgcgggttaacc

SEQ ID NO: 78805 - DNA, 25 bp, E. coli
tcaaacgccgatcacctacgaagag

SEQ ID NO: 78806 - DNA, 25 bp, E. coli
tcaaacgccgatgacctacgaagag

SEQ ID NO: 78807 - DNA, 25 bp, E. coli
gccgatgacctacgaagagtttttc

SEQ ID NO: 78808 - DNA, 25 bp, E. coli
gccgatgacctaggaagagtttttc

SEQ ID NO: 78809 - DNA, 25 bp, E. coli
gacaactatgtcgaacatatgcggg

SEQ ID NO: 78810 - DNA, 25 bp, E. coli
gacaactatgtccaacatatgcggg

SEQ ID NO: 78811 - DNA, 25 bp, E. coli
gaacatatgcgggttaaccatcccg

SEQ ID NO: 78812 - DNA, 25 bp, E. coli
gaaaatatttagctcaggcggcgaa

SEQ ID NO: 78813 - DNA, 25 bp, E. coli
gaacatatgcggcttaaccatcccg

SEQ ID NO: 78814 - DNA, 25 bp, E. coli
gaaaatatttaggtcaggcggcgaa

SEQ ID NO: 78815 - DNA, 25 bp, E. coli
gatgattggtatgcctgattacgac

SEQ ID NO: 78816 - DNA, 25 bp, E. coli
gatgattggtatccctgattacgac

SEQ ID NO: 78817 - DNA, 25 bp, E. coli
cactaccagtgcttgggaatatggt

SEQ ID NO: 78818 - DNA, 25 bp, E. coli
caccttggcggtgatgagattgcgt

SEQ ID NO: 78819 - DNA, 25 bp, E. coli
caccgattttgtcactacccaggcg

SEQ ID NO: 78820 - DNA, 25 bp, E. coli
caccgattttgtgactacccaggcg

SEQ ID NO: 78821 - DNA, 25 bp, E. coli
caccttggcggtcatgagattgcgt

SEQ ID NO: 78822 - DNA, 25 bp, E. coli
cactaccagtgcatgggaatatggt

SEQ ID NO: 78823 - DNA, 25 bp, E. coli
catggaaccgtaaccacatggctgg

SEQ ID NO: 78824 - DNA, 25 bp, E. coli
catggaaccgtatccacatggctgg

SEQ ID NO: 78825 - DNA, 25 bp, E. coli
agttttacccgctgcatactggaca

SEQ ID NO: 78826 - DNA, 25 bp, E. coli
agttttacccgcagcatactggaca

SEQ ID NO: 78827 - DNA, 25 bp, E. coli
tttatggccgaataaggcattcagc

SEQ ID NO: 78828 - DNA, 25 bp, E. coli
tttatggccgaaaaaggcattcagc

SEQ ID NO: 78829 - DNA, 25 bp, E. coli
gctggttattgctgacctttaagta

SEQ ID NO: 78830 - DNA, 25 bp, E. coli
gctggttattgcagacctttaagta

SEQ ID NO: 78831 - DNA, 25 bp, E. coli
ctgggacacgcggaatatattgatt

SEQ ID NO: 78832 - DNA, 25 bp, E. coli
ctgggacacgcgcaatatattgatt

SEQ ID NO: 78833 - DNA, 25 bp, E. coli
gattgcgttgcagtattccgactac

SEQ ID NO: 78834 - DNA, 25 bp, E. coli
gattgcgttgcactattccgactac

SEQ ID NO: 78835 - DNA, 25 bp, E. coli
ggaagttaagcccttctttgtgcgt

SEQ ID NO: 78836 - DNA, 25 bp, E. coli
ggaagttaagccgttctttgtgcgt

SEQ ID NO: 78837 - DNA, 25 bp, E. coli
ggcattcagccgcacctgatctaca

SEQ ID NO: 78838 - DNA, 25 bp, E. coli
ggcattcagccggacctgatctaca

SEQ ID NO: 78839 - DNA, 25 bp, E. coli
accgacgatcgcctgtacagcaagt

SEQ ID NO: 78840 - DNA, 25 bp, E. coli
accgacgatcgcgtgtacagcaagt

SEQ ID NO: 78841 - DNA, 25 bp, E. coli
tgtacagcaagtaaaccagcgaaaa

SEQ ID NO: 78842 - DNA, 25 bp, E. coli
tgtacagcaagttaaccagcgaaaa

SEQ ID NO: 78843 - DNA, 25 bp, E. coli
gcgtgtacagcaagttaaccagcga

SEQ ID NO: 78844 - DNA, 25 bp, E. coli
gcgtgtacagcatgttaaccagcga

SEQ ID NO: 78845 - DNA, 25 bp, E. coli
cgacgatcgcgtgtacagcaagtta

SEQ ID NO: 78846 - DNA, 25 bp, E. coli
cgacgatcgcgtctacagcaagtta

SEQ ID NO: 78847 - DNA, 25 bp, E. coli
ccgacgatcgcgtgtacagcaagtt

SEQ ID NO: 78848 - DNA, 25 bp, E. coli
ccgacgatcgcgagtacagcaagtt

SEQ ID NO: 78849 - DNA, 25 bp, E. coli
cgatcgcgtgtagagcaagttaacc

SEQ ID NO: 78850 - DNA, 25 bp, E. coli
cgatcgcgtgtacagcaagttaacc

SEQ ID NO: 78851 - DNA, 25 bp, E. coli
cgtgtacagcaagttaaccagcgaa

SEQ ID NO: 78852 - DNA, 25 bp, E. coli
cgtgtacagcaacttaaccagcgaa

SEQ ID NO: 78853 - DNA, 25 bp, E. coli
gtgtacagcaagttaaccagcgaaa

SEQ ID NO: 78854 - DNA, 25 bp, E. coli
gtgtacagcaagataaccagcgaaa

SEQ ID NO: 78855 - DNA, 25 bp, E. coli
tcgcgtgtacaggaagttaaccagc

SEQ ID NO: 78856 - DNA, 25 bp, E. coli
tcgcgtgtacagcaagttaaccagc

SEQ ID NO: 78857 - DNA, 25 bp, E. coli
gatcgcgtgtacagcaagttaacca

SEQ ID NO: 78858 - DNA, 25 bp, E. coli
gatcgcgtgtactgcaagttaacca

SEQ ID NO: 78859 - DNA, 25 bp, E. coli
gacgatcgcgtgtacagcaagttaa

SEQ ID NO: 78860 - DNA, 25 bp, E. coli
gacgatcgcgtgaacagcaagttaa

SEQ ID NO: 78861 - DNA, 25 bp, E. coli
caaactgctgtttctcggatcgtcc

SEQ ID NO: 78862 - DNA, 25 bp, E. coli
caaactgctgttactcggatcgtcc

SEQ ID NO: 78863 - DNA, 25 bp, E. coli
tatcacgaaatcacactggaagcgg

SEQ ID NO: 78864 - DNA, 25 bp, E. coli
tatcacgaaatctcactggaagcgg

SEQ ID NO: 78865 - DNA, 25 bp, E. coli
tttgccagcgaacgtattgaccagg

SEQ ID NO: 78866 - DNA, 25 bp, E. coli
tttgccagcgaaggtattgaccagg

SEQ ID NO: 78867 - DNA, 25 bp, E. coli
tgtcgcacattatcgtcggcacggg

SEQ ID NO: 78868 - DNA, 25 bp, E. coli
tgtgacgcgcctccatcagcttggc

SEQ ID NO: 78869 - DNA, 25 bp, E. coli
tgtgacgcgcctgcatcagcttggc

SEQ ID NO: 78870 - DNA, 25 bp, E. coli
tgtcgcacattaacgtcggcacggg

SEQ ID NO: 78871 - DNA, 25 bp, E. coli
tgagagcaacatgattcacgccgcg

SEQ ID NO: 78872 - DNA, 25 bp, E. coli
tgagagcaacatcattcacgccgcg

SEQ ID NO: 78873 - DNA, 25 bp, E. coli
ccatcgccaaagaggtgggttacaa

SEQ ID NO: 78874 - DNA, 25 bp, E. coli
ccatcgccaaagtggtgggttacaa

SEQ ID NO: 78875 - DNA, 25 bp, E. coli
gaaactggcaaatcagccgatggca

SEQ ID NO: 78876 - DNA, 25 bp, E. coli
gaaactggcaaaacagccgatggca

SEQ ID NO: 78877 - DNA, 25 bp, E. coli
cttgagaatcaacaccgctttcggg

SEQ ID NO: 78878 - DNA, 25 bp, E. coli
cttgagaatcaagaccgctttcggg

SEQ ID NO: 78879 - DNA, 25 bp, E. coli
gttgactgcactatccgcgagctgg

SEQ ID NO: 78880 - DNA, 25 bp, E. coli
gttgactgcactttccgcgagctgg

SEQ ID NO: 78881 - DNA, 25 bp, E. coli
tcagcttggctgctatcacgaaatc

SEQ ID NO: 78882 - DNA, 25 bp, E. coli
tcagcttggctggtatcacgaaatc

SEQ ID NO: 78883 - DNA, 25 bp, E. coli
aaaacgctgtggacatcgcccgaac

SEQ ID NO: 78884 - DNA, 25 bp, E. coli
aaaacgctgtggtcatcgcccgaac

SEQ ID NO: 78885 - DNA, 25 bp, E. coli
acgacctgtttgtccgtagccaggc

SEQ ID NO: 78886 - DNA, 25 bp, E. coli
acgacctgtttgaccgtagccaggc

SEQ ID NO: 78887 - DNA, 25 bp, E. coli
tggtgcaaaacggtgtggtcatcgc

SEQ ID NO: 78888 - DNA, 25 bp, E. coli
tggtcatcgccccaacaaagcgatc

SEQ ID NO: 78889 - DNA, 25 bp, E. coli
tctgcttttaacgttgcgcgtacgg

SEQ ID NO: 78890 - DNA, 25 bp, E. coli
tctgcttttaaccttgcgcgtacgg

SEQ ID NO: 78891 - DNA, 25 bp, E. coli
cgctgtggtcatggcccgaacaaag

SEQ ID NO: 78892 - DNA, 25 bp, E. coli
cgctgtggtcatcgcccgaacaaag

SEQ ID NO: 78893 - DNA, 25 bp, E. coli
cattaacgccaagcatgcgctgttg

SEQ ID NO: 78894 - DNA, 25 bp, E. coli
cattaacgccaaccatgcgctgttg

SEQ ID NO: 78895 - DNA, 25 bp, E. coli
gattgttggcaccattaacgccaac

SEQ ID NO: 78896 - DNA, 25 bp, E. coli
gattgttggcacgattaacgccaac

SEQ ID NO: 78897 - DNA, 25 bp, E. coli
gtgcaaaacgctctggtcatcgccc

SEQ ID NO: 78898 - DNA, 25 bp, E. coli
gtgcaaaacgctgtggtcatcgccc

SEQ ID NO: 78899 - DNA, 25 bp, E. coli
tggttcttctgcttttaacgttgcg

SEQ ID NO: 78900 - DNA, 25 bp, E. coli
tggtcatcgcccgaacaaagcgatc

SEQ ID NO: 78901 - DNA, 25 bp, E. coli
tggtgcaaaacgctgtggtcatcgc

SEQ ID NO: 78902 - DNA, 25 bp, E. coli
tggttcttctgcatttaacgttgcg

SEQ ID NO: 78903 - DNA, 25 bp, E. coli
taacgccaaccaagcgctgttggcg

SEQ ID NO: 78904 - DNA, 25 bp, E. coli
taacgccaaccatgcgctgttggcg

SEQ ID NO: 78905 - DNA, 25 bp, E. coli
caatggatacattgacgagggcaag

SEQ ID NO: 78906 - DNA, 25 bp, E. coli
caatggatacatagacgagggcaag

SEQ ID NO: 78907 - DNA, 25 bp, E. coli
cactgagcgatggattccgagaggc

SEQ ID NO: 78908 - DNA, 25 bp, E. coli
cacagtatcgtgttgacagaggcag

SEQ ID NO: 78909 - DNA, 25 bp, E. coli
cactgagcgatgcattccgagaggc

SEQ ID NO: 78910 - DNA, 25 bp, E. coli
cacagtatcgtgatgacagaggcag

SEQ ID NO: 78911 - DNA, 25 bp, E. coli
tatcaaggtattatatgcgcgcacg

SEQ ID NO: 78912 - DNA, 25 bp, E. coli
tatcaaggtattttatgcgcgcacg

SEQ ID NO: 78913 - DNA, 25 bp, E. coli
tgcgcgcacgaaaagcatcaggtct

SEQ ID NO: 78914 - DNA, 25 bp, E. coli
tcgcgcagcaaaatcagaggtaagg

SEQ ID NO: 78915 - DNA, 25 bp, E. coli
tgcgcgcacgaatagcatcaggtct

SEQ ID NO: 78916 - DNA, 25 bp, E. coli
tcgcgcagcaaattcagaggtaagg

SEQ ID NO: 78917 - DNA, 25 bp, E. coli
gcggcgtcagccaagttaatcagat

SEQ ID NO: 78918 - DNA, 25 bp, E. coli
gctttcatccggcacagtatcaagg

SEQ ID NO: 78919 - DNA, 25 bp, E. coli
gcggcgtcagcctagttaatcagat

SEQ ID NO: 78920 - DNA, 25 bp, E. coli
gctttcatccgggacagtatcaagg

SEQ ID NO: 78921 - DNA, 25 bp, E. coli
gacttacggctgacgaatacctgaa

SEQ ID NO: 78922 - DNA, 25 bp, E. coli
gacttacggctgtcgaatacctgaa

SEQ ID NO: 78923 - DNA, 25 bp, E. coli
tggaactggctgttgttaccgggca

SEQ ID NO: 78924 - DNA, 25 bp, E. coli
tggaactggctgatgttaccgggca

SEQ ID NO: 78925 - DNA, 25 bp, E. coli
taagtcggacaccatggcatcacag

SEQ ID NO: 78926 - DNA, 25 bp, E. coli
taagtcggacacgatggcatcacag

SEQ ID NO: 78927 - DNA, 25 bp, E. coli
caagcgtcgcaattttcagcccagg

SEQ ID NO: 78928 - DNA, 25 bp, E. coli
caagcgtcgcaaatttcagcccagg

SEQ ID NO: 78929 - DNA, 25 bp, E. coli
agattgctgccgttaacctgacgca

SEQ ID NO: 78930 - DNA, 25 bp, E. coli
agattgctgccgataacctgacgca

SEQ ID NO: 78931 - DNA, 25 bp, E. coli
tgacaagacgccctacaaagtatgg

SEQ ID NO: 78932 - DNA, 25 bp, E. coli
tgcataaagcggcacaacaagtggc

SEQ ID NO: 78933 - DNA, 25 bp, E. coli
tgacaagacgccgtacaaagtatgg

SEQ ID NO: 78934 - DNA, 25 bp, E. coli
tgcataaagcgggacaacaagtggc

SEQ ID NO: 78935 - DNA, 25 bp, E. coli
tcccgtggagcgtttgttacagcag

SEQ ID NO: 78936 - DNA, 25 bp, E. coli
tcccgtggagcgattgttacagcag

SEQ ID NO: 78937 - DNA, 25 bp, E. coli
tctggactggtacgataaatacggg

SEQ ID NO: 78938 - DNA, 25 bp, E. coli
tctggactggtaggataaatacggg

SEQ ID NO: 78939 - DNA, 25 bp, E. coli
cctttgaggaagttgcagcactgcc

SEQ ID NO: 78940 - DNA, 25 bp, E. coli
cctttgaggaagatgcagcactgcc

SEQ ID NO: 78941 - DNA, 25 bp, E. coli
gaagatgaagtattgctggcgcagc

SEQ ID NO: 78942 - DNA, 25 bp, E. coli
gaagatgaagtaatgctggcgcagc

SEQ ID NO: 78943 - DNA, 25 bp, E. coli
gttacagcagttacgcactggcgcg

SEQ ID NO: 78944 - DNA, 25 bp, E. coli
gttacagcagtttcgcactggcgcg

SEQ ID NO: 78945 - DNA, 25 bp, E. coli
ggtaagcactttgcgattctcgacg

SEQ ID NO: 78946 - DNA, 25 bp, E. coli
ggtaagcactttccgattctcgacg

SEQ ID NO: 78947 - DNA, 25 bp, E. coli
tggtataacttagcgcaaccgccgt

SEQ ID NO: 78948 - DNA, 25 bp, E. coli
tggtataacttaccgcaaccgccgt

SEQ ID NO: 78949 - DNA, 25 bp, E. coli
cagcctcagagtattgatgacacca

SEQ ID NO: 78950 - DNA, 25 bp, E. coli
cagcctcagagttttgatgacacca

SEQ ID NO: 78951 - DNA, 25 bp, E. coli
tttacattccctgtacagaactagc

SEQ ID NO: 78952 - DNA, 25 bp, E. coli
tttacattccctctacagaactagc

SEQ ID NO: 78953 - DNA, 25 bp, E. coli
tatgatcattttcggtgagtactgc

SEQ ID NO: 78954 - DNA, 25 bp, E. coli
tatgatcattttgggtgagtactgc

SEQ ID NO: 78955 - DNA, 25 bp, E. coli
tttcttaaagagagttccattcggg

SEQ ID NO: 78956 - DNA, 25 bp, E. coli
tttcttaaagagtgttccattcggg

SEQ ID NO: 78957 - DNA, 25 bp, E. coli
ttctgtgatgatagaccagcctcag

SEQ ID NO: 78958 - DNA, 25 bp, E. coli
ttctgtgatgattgaccagcctcag

SEQ ID NO: 78959 - DNA, 25 bp, E. coli
tgacaccaccgtacataacagatcg

SEQ ID NO: 78960 - DNA, 25 bp, E. coli
tgacaccaccgttcataacagatcg

SEQ ID NO: 78961 - DNA, 25 bp, E. coli
gaataaataaaaatgcggcaccgcc

SEQ ID NO: 78962 - DNA, 25 bp, E. coli
gaactagcccttctctcacagaaaa

SEQ ID NO: 78963 - DNA, 25 bp, E. coli
gaataaataaaattgcggcaccgcc

SEQ ID NO: 78964 - DNA, 25 bp, E. coli
gaactagcccttgtctcacagaaaa

SEQ ID NO: 78965 - DNA, 25 bp, E. coli
cgcgttcgatgtcactatgatcatt

SEQ ID NO: 78966 - DNA, 25 bp, E. coli
cgcgttcgatgtgactatgatcatt

SEQ ID NO: 78967 - DNA, 25 bp, E. coli
ggcaccgccagattcgcgttcgatg

SEQ ID NO: 78968 - DNA, 25 bp, E. coli
ggcaccgccagaatcgcgttcgatg

SEQ ID NO: 78969 - DNA, 25 bp, E. coli
gagtactgctttcatctaaaggctg

SEQ ID NO: 78970 - DNA, 25 bp, E. coli
gagtactgctttgatctaaaggctg

SEQ ID NO: 78971 - DNA, 25 bp, E. coli
tacgtatgtggcttctgatgcgcaa

SEQ ID NO: 78972 - DNA, 25 bp, E. coli
tacgtatgtggcatctgatgcgcaa

SEQ ID NO: 78973 - DNA, 25 bp, E. coli
tatcgccgcgggttttatcaccaca

SEQ ID NO: 78974 - DNA, 25 bp, E. coli
tatcgccgcgggatttatcaccaca

SEQ ID NO: 78975 - DNA, 25 bp, E. coli
tattgcaatgtaacggtatcggccg

SEQ ID NO: 78976 - DNA, 25 bp, E. coli
tattgcaatgtatcggtatcggccg

SEQ ID NO: 78977 - DNA, 25 bp, E. coli
tcgggcttagcatcattcaggtggg

SEQ ID NO: 78978 - DNA, 25 bp, E. coli
tcgggcttagcaacattcaggtggg

SEQ ID NO: 78979 - DNA, 25 bp, E. coli
tctcaaaacgttcgcctggttagcg

SEQ ID NO: 78980 - DNA, 25 bp, E. coli
tcatgctgacctcgtgaaggaatcc

SEQ ID NO: 78981 - DNA, 25 bp, E. coli
tcatgctgacctggtgaaggaatcc

SEQ ID NO: 78982 - DNA, 25 bp, E. coli
tctcaaaacgttggcctggttagcg

SEQ ID NO: 78983 - DNA, 25 bp, E. coli
gaaagctgatcatactcggtctgca

SEQ ID NO: 78984 - DNA, 25 bp, E. coli
gaaagctgatcaaactcggtctgca

SEQ ID NO: 78985 - DNA, 25 bp, E. coli
gaaaggagaaacactgatgagcgcc

SEQ ID NO: 78986 - DNA, 25 bp, E. coli
gaaaggagaaactctgatgagcgcc

SEQ ID NO: 78987 - DNA, 25 bp, E. coli
ggatttatgtcctacgtcgccgtat

SEQ ID NO: 78988 - DNA, 25 bp, E. coli
ggatttatgtccaacgtcgccgtat

SEQ ID NO: 78989 - DNA, 25 bp, E. coli
ggcaagaccgccgaactgatgaggt

SEQ ID NO: 78990 - DNA, 25 bp, E. coli
ggcaagaccgcccaactgatgaggt

SEQ ID NO: 78991 - DNA, 25 bp, E. coli
gatgagcgccattgattcccaactt

SEQ ID NO: 78992 - DNA, 25 bp, E. coli
gatgagcgccatagattcccaactt

SEQ ID NO: 78993 - DNA, 25 bp, E. coli
aattgaactgatttttagcgccgcc

SEQ ID NO: 78994 - DNA, 25 bp, E. coli
caaccgcagtcataatttctggccg

SEQ ID NO: 78995 - DNA, 25 bp, E. coli
aattgaactgatatttagcgccgcc

SEQ ID NO: 78996 - DNA, 25 bp, E. coli
caaccgcagtcaaaatttctggccg

SEQ ID NO: 78997 - DNA, 25 bp, E. coli
tatcgtcgggttgctgtgtatcagt

SEQ ID NO: 78998 - DNA, 25 bp, E. coli
tatcgtcagcgttcaatgaaaggca

SEQ ID NO: 78999 - DNA, 25 bp, E. coli
tatcgtcagcgtacaatgaaaggca

SEQ ID NO: 79000 - DNA, 25 bp, E. coli
tatcgtcgggttcctgtgtatcagt

SEQ ID NO: 79001 - DNA, 25 bp, E. coli
ttcgcctgatgagttggtatcgtca

SEQ ID NO: 79002 - DNA, 25 bp, E. coli
ttcgcctgatgacttggtatcgtca

SEQ ID NO: 79003 - DNA, 25 bp, E. coli
tgtgctggatatggtcattgcctgg

SEQ ID NO: 79004 - DNA, 25 bp, E. coli
tgtgctggatatcgtcattgcctgg

SEQ ID NO: 79005 - DNA, 25 bp, E. coli
tcgcagtcgcctttttattgatcgg

SEQ ID NO: 79006 - DNA, 25 bp, E. coli
tcgcagtcgcctatttattgatcgg

SEQ ID NO: 79007 - DNA, 25 bp, E. coli
tcagcttcgccagtttgttcgttaa

SEQ ID NO: 79008 - DNA, 25 bp, E. coli
tcagcttcgccactttgttcgttaa

SEQ ID NO: 79009 - DNA, 25 bp, E. coli
gtattatccggtttcctcgtcgcag

SEQ ID NO: 79010 - DNA, 25 bp, E. coli
gtattatccggtatcctcgtcgcag

SEQ ID NO: 79011 - DNA, 25 bp, E. coli
gatcggctatttgttcatccgcgca

SEQ ID NO: 79012 - DNA, 25 bp, E. coli
taacgctggtttccacactggtggg

SEQ ID NO: 79013 - DNA, 25 bp, E. coli
taacgctggtttgcacactggtggg

SEQ ID NO: 79014 - DNA, 25 bp, E. coli
gatcggctatttcttcatccgcgca

SEQ ID NO: 79015 - DNA, 25 bp, E. coli
ttttgctggcagagaagtgtcgatc

SEQ ID NO: 79016 - DNA, 25 bp, E. coli
ttttgctggcagtgaagtgtcgatc

SEQ ID NO: 79017 - DNA, 25 bp, E. coli
gctgattaatcaggcggctctggca

SEQ ID NO: 79018 - DNA, 25 bp, E. coli
gctgattaatcacgcggctctggca

SEQ ID NO: 79019 - DNA, 25 bp, E. coli
gaagaacgcacgacacggattatca

SEQ ID NO: 79020 - DNA, 25 bp, E. coli
gaagaacgcacgtcacggattatca

SEQ ID NO: 79021 - DNA, 25 bp, E. coli
gacattgatgccagcgggctttcgg

SEQ ID NO: 79022 - DNA, 25 bp, E. coli
gacattgatgcctgcgggctttcgg

SEQ ID NO: 79023 - DNA, 25 bp, E. coli
gaaaatgacattgatgccagcgggc

SEQ ID NO: 79024 - DNA, 25 bp, E. coli
gaaaatgacattcatgccagcgggc

SEQ ID NO: 79025 - DNA, 25 bp, E. coli
cgattttcgcagcaattaagatggc

SEQ ID NO: 79026 - DNA, 25 bp, E. coli
cgattttcgcaggaattaagatggc

SEQ ID NO: 79027 - DNA, 25 bp, E. coli
gttgatccttacatgcctgttgcca

SEQ ID NO: 79028 - DNA, 25 bp, E. coli
gttgatccttacttgcctgttgcca

SEQ ID NO: 79029 - DNA, 25 bp, E. coli
gggctttcggtgattgaagaacgca

SEQ ID NO: 79030 - DNA, 25 bp, E. coli
gggctttcggtgtttgaagaacgca

SEQ ID NO: 79031 - DNA, 25 bp, E. coli
ggaacaatcgcatacgctgattaat

SEQ ID NO: 79032 - DNA, 25 bp, E. coli
ggaacaatcgcaaacgctgattaat

SEQ ID NO: 79033 - DNA, 25 bp, E. coli
gacccgtgtggttgtcgtgcgctat

SEQ ID NO: 79034 - DNA, 25 bp, E. coli
gacccgtgtggtagtcgtgcgctat

SEQ ID NO: 79035 - DNA, 25 bp, E. coli
gatcgcgataactcacgacctgcgt

SEQ ID NO: 79036 - DNA, 25 bp, E. coli
gatcgcgataacacacgacctgcgt

SEQ ID NO: 79037 - DNA, 25 bp, E. coli
cagttctggcagagttcgacctgtt

SEQ ID NO: 79038 - DNA, 25 bp, E. coli
cagtgttcgacctgttaggtgcgct

SEQ ID NO: 79039 - DNA, 25 bp, E. coli
cagttctggcagtgttcgacctgtt

SEQ ID NO: 79040 - DNA, 25 bp, E. coli
cagtgttcgaccagttaggtgcgct

SEQ ID NO: 79041 - DNA, 25 bp, E. coli
agttctggcagtcttcgacctgtta

SEQ ID NO: 79042 - DNA, 25 bp, E. coli
agtgttcgacctcttaggtgcgctg

SEQ ID NO: 79043 - DNA, 25 bp, E. coli
agttctggcagtgttcgacctgtta

SEQ ID NO: 79044 - DNA, 25 bp, E. coli
agtgttcgacctgttaggtgcgctg

SEQ ID NO: 79045 - DNA, 25 bp, E. coli
ttcgacctgttaggtgcgctggtta

SEQ ID NO: 79046 - DNA, 25 bp, E. coli
ttctggcagtgttcgacctgttagg

SEQ ID NO: 79047 - DNA, 25 bp, E. coli
ttctggcagtgtacgacctgttagg

SEQ ID NO: 79048 - DNA, 25 bp, E. coli
ttcgacctgttacgtgcgctggtta

SEQ ID NO: 79049 - DNA, 25 bp, E. coli
tgttcgacctgttaggtgcgctggt

SEQ ID NO: 79050 - DNA, 25 bp, E. coli
tgttcgacctgtaaggtgcgctggt

SEQ ID NO: 79051 - DNA, 25 bp, E. coli
tctggcagtgttggacctgttaggt

SEQ ID NO: 79052 - DNA, 25 bp, E. coli
tctggcagtgttcgacctgttaggt

SEQ ID NO: 79053 - DNA, 25 bp, E. coli
gcagttctggcagtgttcgacctgt

SEQ ID NO: 79054 - DNA, 25 bp, E. coli
gcagttctggcactgttcgacctgt

SEQ ID NO: 79055 - DNA, 25 bp, E. coli
cgacctgttaggagcgctggttatc

SEQ ID NO: 79056 - DNA, 25 bp, E. coli
cgacctgttaggtgcgctggttatc

SEQ ID NO: 79057 - DNA, 25 bp, E. coli
tggcagtgttcgtcctgttaggtgc

SEQ ID NO: 79058 - DNA, 25 bp, E. coli
tggcagtgttcgacctgttaggtgc

SEQ ID NO: 79059 - DNA, 25 bp, E. coli
aatgtacccgcaggaattttctggc

SEQ ID NO: 79060 - DNA, 25 bp, E. coli
aatgtacccgcacgaattttctggc

SEQ ID NO: 79061 - DNA, 25 bp, E. coli
cacgatggaataaggcaacgcgcgc

SEQ ID NO: 79062 - DNA, 25 bp, E. coli
cacgatggaatatggcaacgcgcgc

SEQ ID NO: 79063 - DNA, 25 bp, E. coli
aaagtgctggtattgtacgccgggc

SEQ ID NO: 79064 - DNA, 25 bp, E. coli
aaagtgctggtaatgtacgccgggc

SEQ ID NO: 79065 - DNA, 25 bp, E. coli
tattctatcggtttgctcaacgcgg

SEQ ID NO: 79066 - DNA, 25 bp, E. coli
tattctatcggtatgctcaacgcgg

SEQ ID NO: 79067 - DNA, 25 bp, E. coli
ttgaatccctatttgcgcgtcggtg

SEQ ID NO: 79068 - DNA, 25 bp, E. coli
ttgaatccctatatgcgcgtcggtg

SEQ ID NO: 79069 - DNA, 25 bp, E. coli
tctcgatgcggaaggtgaaacaatg

SEQ ID NO: 79070 - DNA, 25 bp, E. coli
tctcgatgcggatggtgaaacaatg

SEQ ID NO: 79071 - DNA, 25 bp, E. coli
cctaagctgctgtttgcggatgaac

SEQ ID NO: 79072 - DNA, 25 bp, E. coli
cctaagctgctgattgcggatgaac

SEQ ID NO: 79073 - DNA, 25 bp, E. coli
gctggaagagtttacgcctggccgt

SEQ ID NO: 79074 - DNA, 25 bp, E. coli
gctggaagagttaacgcctggccgt

SEQ ID NO: 79075 - DNA, 25 bp, E. coli
gggtaatccgccaaacctgctgcga

SEQ ID NO: 79076 - DNA, 25 bp, E. coli
gggtaatccgcctaacctgctgcga

SEQ ID NO: 79077 - DNA, 25 bp, E. coli
tggcggatcggcaaccttcaatggg

SEQ ID NO: 79078 - DNA, 25 bp, E. coli
ggaaatttgtagtagcgcaccgccg

SEQ ID NO: 79079 - DNA, 25 bp, E. coli
ggaaatttgtagaagcgcaccgccg

SEQ ID NO: 79080 - DNA, 25 bp, E. coli
tggcggatcggctaccttcaatggg

SEQ ID NO: 79081 - DNA, 25 bp, E. coli
tattaggctattttggcggagttgt

SEQ ID NO: 79082 - DNA, 25 bp, E. coli
tattaggctattatggcggagttgt

SEQ ID NO: 79083 - DNA, 25 bp, E. coli
tgagttacacattccgacggttgtc

SEQ ID NO: 79084 - DNA, 25 bp, E. coli
tgagttacacataccgacggttgtc

SEQ ID NO: 79085 - DNA, 25 bp, E. coli
tgctaattcaggcagtcactgccgg

SEQ ID NO: 79086 - DNA, 25 bp, E. coli
tgctaattcagggagtcactgccgg

SEQ ID NO: 79087 - DNA, 25 bp, E. coli
tcataatccgccatctaaccaaggg

SEQ ID NO: 79088 - DNA, 25 bp, E. coli
tcataatccgccttctaaccaaggg

SEQ ID NO: 79089 - DNA, 25 bp, E. coli
gccgccgctctacgaacgtcaaaaa

SEQ ID NO: 79090 - DNA, 25 bp, E. coli
gccgccgctctaggaacgtcaaaaa

SEQ ID NO: 79091 - DNA, 25 bp, E. coli
gaaatgggcgttcctaattcaggca

SEQ ID NO: 79092 - DNA, 25 bp, E. coli
gacggttgtcattcccgattctgat

SEQ ID NO: 79093 - DNA, 25 bp, E. coli
gaacgtcaaaaagcacagtcagcat

SEQ ID NO: 79094 - DNA, 25 bp, E. coli
gaacgtcaaaaaccacagtcagcat

SEQ ID NO: 79095 - DNA, 25 bp, E. coli
gaaatgggcgttgctaattcaggca

SEQ ID NO: 79096 - DNA, 25 bp, E. coli
gacggttgtcatacccgattctgat

SEQ ID NO: 79097 - DNA, 25 bp, E. coli
cgttccgtggaattgggcgttgcta

SEQ ID NO: 79098 - DNA, 25 bp, E. coli
cgttccgtggaaatgggcgttgcta

SEQ ID NO: 79099 - DNA, 25 bp, E. coli
gggcgctcaaatatgagttacacat

SEQ ID NO: 79100 - DNA, 25 bp, E. coli
ggagttgttaaaacagccgccgctc

SEQ ID NO: 79101 - DNA, 25 bp, E. coli
gggcgctcaaatttgagttacacat

SEQ ID NO: 79102 - DNA, 25 bp, E. coli
ggagttgttaaatcagccgccgctc

SEQ ID NO: 79103 - DNA, 25 bp, E. coli
caggtttctggcaggatgatgctca

SEQ ID NO: 79104 - DNA, 25 bp, E. coli
caggtttctggctggatgatgctca

SEQ ID NO: 79105 - DNA, 25 bp, E. coli
attgagtgccacttgccggatcgcc

SEQ ID NO: 79106 - DNA, 25 bp, E. coli
atgctggatatccgcctggctatgc

SEQ ID NO: 79107 - DNA, 25 bp, E. coli
atgctggatatcggcctggctatgc

SEQ ID NO: 79108 - DNA, 25 bp, E. coli
attgagtgccacatgccggatcgcc

SEQ ID NO: 79109 - DNA, 25 bp, E. coli
aaaaagccgcttatgacgcactcac

SEQ ID NO: 79110 - DNA, 25 bp, E. coli
aaaaagccgcttttgacgcactcac

SEQ ID NO: 79111 - DNA, 25 bp, E. coli
tacctacagcatgacattaccctgg

SEQ ID NO: 79112 - DNA, 25 bp, E. coli
tacctacagcatcacattaccctgg

SEQ ID NO: 79113 - DNA, 25 bp, E. coli
tgaatacctacagcatcacattacc

SEQ ID NO: 79114 - DNA, 25 bp, E. coli
tgaatacctacaccatcacattacc

SEQ ID NO: 79115 - DNA, 25 bp, E. coli
tcgccgtgacctggataatctgcaa

SEQ ID NO: 79116 - DNA, 25 bp, E. coli
tcgccgtcgccgtgacctggataat

SEQ ID NO: 79117 - DNA, 25 bp, E. coli
tcgccgtgacctcgataatctgcaa

SEQ ID NO: 79118 - DNA, 25 bp, E. coli
tcgccgtcgccgagacctggataat

SEQ ID NO: 79119 - DNA, 25 bp, E. coli
cctggataatctgcaaaaagccgct

SEQ ID NO: 79120 - DNA, 25 bp, E. coli
cctggataatctccaaaaagccgct

SEQ ID NO: 79121 - DNA, 25 bp, E. coli
cattaccctggcctccgagcaataa

SEQ ID NO: 79122 - DNA, 25 bp, E. coli
cattaccctggcgtccgagcaataa

SEQ ID NO: 79123 - DNA, 25 bp, E. coli
gatgatgctcagctcgttgattacc

SEQ ID NO: 79124 - DNA, 25 bp, E. coli
gatgatgctcaggtcgttgattacc

SEQ ID NO: 79125 - DNA, 25 bp, E. coli
aatgtgtttcatgcttttcgggcga

SEQ ID NO: 79126 - DNA, 25 bp, E. coli
aatgtgtttcatccttttcgggcga

SEQ ID NO: 79127 - DNA, 25 bp, E. coli
cttttcgggcgaaggatatccgact

SEQ ID NO: 79128 - DNA, 25 bp, E. coli
cttttcgggcgatggatatccgact

SEQ ID NO: 79129 - DNA, 25 bp, E. coli
tacggaatggcaagtggcggttaat

SEQ ID NO: 79130 - DNA, 25 bp, E. coli
tacggaatggcatgtggcggttaat

SEQ ID NO: 79131 - DNA, 25 bp, E. coli
tttagcatggcagaaatgtgtttca

SEQ ID NO: 79132 - DNA, 25 bp, E. coli
tttagcatggcacaaatgtgtttca

SEQ ID NO: 79133 - DNA, 25 bp, E. coli
tgccattaccggatttaaccaacag

SEQ ID NO: 79134 - DNA, 25 bp, E. coli
tgccattaccggttttaaccaacag

SEQ ID NO: 79135 - DNA, 25 bp, E. coli
tcggtgggcatgaaagaaaaccccg

SEQ ID NO: 79136 - DNA, 25 bp, E. coli
tcggtgggcatgtaagaaaaccccg

SEQ ID NO: 79137 - DNA, 25 bp, E. coli
gcaagtggcggtaaatttattcagg

SEQ ID NO: 79138 - DNA, 25 bp, E. coli
gaaggatatccgacttctgtacgga

SEQ ID NO: 79139 - DNA, 25 bp, E. coli
gcaagtggcggttaatttattcagg

SEQ ID NO: 79140 - DNA, 25 bp, E. coli
gaaggatatccgtcttctgtacgga

SEQ ID NO: 79141 - DNA, 25 bp, E. coli
cttctgtacggattggcaagtggcg

SEQ ID NO: 79142 - DNA, 25 bp, E. coli
cttctgtacggaatggcaagtggcg

SEQ ID NO: 79143 - DNA, 25 bp, E. coli
gggttttctttagcatggcagaaat

SEQ ID NO: 79144 - DNA, 25 bp, E. coli
gggttttctttaccatggcagaaat

SEQ ID NO: 79145 - DNA, 25 bp, E. coli
taaccaacaggaatatcggtgggca

SEQ ID NO: 79146 - DNA, 25 bp, E. coli
taaccaacaggattatcggtgggca

SEQ ID NO: 79147 - DNA, 25 bp, E. coli
aagagaaggacgaatttctcgtaga

SEQ ID NO: 79148 - DNA, 25 bp, E. coli
aagagaaggacgtatttctcgtaga

SEQ ID NO: 79149 - DNA, 25 bp, E. coli
caatgttgcacaactggcccgggaa

SEQ ID NO: 79150 - DNA, 25 bp, E. coli
caatgttgcacatctggcccgggaa

SEQ ID NO: 79151 - DNA, 25 bp, E. coli
catatggttgaagtggcttcgaaac

SEQ ID NO: 79152 - DNA, 25 bp, E. coli
catatggttgaactggcttcgaaac

SEQ ID NO: 79153 - DNA, 25 bp, E. coli
aactggcccgggtacatggcgttga

SEQ ID NO: 79154 - DNA, 25 bp, E. coli
aactggcccgggaacatggcgttga

SEQ ID NO: 79155 - DNA, 25 bp, E. coli
acaacctgatttttaaatggctacg

SEQ ID NO: 79156 - DNA, 25 bp, E. coli
acaacctgatttataaatggctacg

SEQ ID NO: 79157 - DNA, 25 bp, E. coli
ttctcgtagaatgcctccaactatt

SEQ ID NO: 79158 - DNA, 25 bp, E. coli
ttctcgtagaatccctccaactatt

SEQ ID NO: 79159 - DNA, 25 bp, E. coli
gcttcgaaaccaaatgccaatgttg

SEQ ID NO: 79160 - DNA, 25 bp, E. coli
gcttcgaaaccatatgccaatgttg

SEQ ID NO: 79161 - DNA, 25 bp, E. coli
gaacatggcgttgataacaacctga

SEQ ID NO: 79162 - DNA, 25 bp, E. coli
gaacatggcgttcataacaacctga

SEQ ID NO: 79163 - DNA, 25 bp, E. coli
cgccggatatttactaatgaattta

SEQ ID NO: 79164 - DNA, 25 bp, E. coli
cgccggatattttctaatgaattta

SEQ ID NO: 79165 - DNA, 25 bp, E. coli
ctctggcaaagagaaggacgtattt

SEQ ID NO: 79166 - DNA, 25 bp, E. coli
ctctggcaaagacaaggacgtattt

SEQ ID NO: 79167 - DNA, 25 bp, E. coli
gatggataaacctacagactggcgc

SEQ ID NO: 79168 - DNA, 25 bp, E. coli
gatggataaaccaacagactggcgc

SEQ ID NO: 79169 - DNA, 25 bp, E. coli
agatcgcgtcttggattgactgcaa

SEQ ID NO: 79170 - DNA, 25 bp, E. coli
agatcgcgtcttcgattgactgcaa

SEQ ID NO: 79171 - DNA, 25 bp, E. coli
aaaaattttactaccgcctcatgcg

SEQ ID NO: 79172 - DNA, 25 bp, E. coli
aaaaattttacttccgcctcatgcg

SEQ ID NO: 79173 - DNA, 25 bp, E. coli
tgttggcataattaagtacgacgag

SEQ ID NO: 79174 - DNA, 25 bp, E. coli
tgttggcataataaagtacgacgag

SEQ ID NO: 79175 - DNA, 25 bp, E. coli
tgacaaatgttaaaaaagccgttgc

SEQ ID NO: 79176 - DNA, 25 bp, E. coli
tgacaaatgttataaaagccgttgc

SEQ ID NO: 79177 - DNA, 25 bp, E. coli
tcatgattgacaccggagtttacgc

SEQ ID NO: 79178 - DNA, 25 bp, E. coli
tcatgattgacagcggagtttacgc

SEQ ID NO: 79179 - DNA, 25 bp, E. coli
gccggagttttaactcgccacagag

SEQ ID NO: 79180 - DNA, 25 bp, E. coli
gccggagttttatctcgccacagag

SEQ ID NO: 79181 - DNA, 25 bp, E. coli
ctcatgcggcgaatgtgggaattgc

SEQ ID NO: 79182 - DNA, 25 bp, E. coli
ctcatgcggcgattgtgggaattgc

SEQ ID NO: 79183 - DNA, 25 bp, E. coli
gttaaattgcgagcgagatcgcgtc

SEQ ID NO: 79184 - DNA, 25 bp, E. coli
gttaaattgcgaccgagatcgcgtc

SEQ ID NO: 79185 - DNA, 25 bp, E. coli
tggcagtcactgaacaggcatctct

SEQ ID NO: 79186 - DNA, 25 bp, E. coli
tggcagtcactgtacaggcatctct

SEQ ID NO: 79187 - DNA, 25 bp, E. coli
taactggttagataaatgcaatggc

SEQ ID NO: 79188 - DNA, 25 bp, E. coli
taactggttagaaaaatgcaatggc

SEQ ID NO: 79189 - DNA, 25 bp, E. coli
gagtaaaattacatacctgcccgcc

SEQ ID NO: 79190 - DNA, 25 bp, E. coli
gagtaaaattacttacctgcccgcc

SEQ ID NO: 79191 - DNA, 25 bp, E. coli
tacaacgcgttggtcccgatgtgct

SEQ ID NO: 79192 - DNA, 25 bp, E. coli
tactgctcgatctggcgtttctggc

SEQ ID NO: 79193 - DNA, 25 bp, E. coli
tactgctcgatcaggcgtttctggc

SEQ ID NO: 79194 - DNA, 25 bp, E. coli
tacaacgcgttgctcccgatgtgct

SEQ ID NO: 79195 - DNA, 25 bp, E. coli
aactgatgtctggtttgccttcccg

SEQ ID NO: 79196 - DNA, 25 bp, E. coli
aactgatgtctgctttgccttcccg

SEQ ID NO: 79197 - DNA, 25 bp, E. coli
tacccatgtggatacgcgtggtaag

SEQ ID NO: 79198 - DNA, 25 bp, E. coli
tacccatgtggaaacgcgtggtaag

SEQ ID NO: 79199 - DNA, 25 bp, E. coli
tatagcgcctcgcatattgagatgt

SEQ ID NO: 79200 - DNA, 25 bp, E. coli
tatagcgcctcggatattgagatgt

SEQ ID NO: 79201 - DNA, 25 bp, E. coli
tgtgctggatccgaatctgacgccg

SEQ ID NO: 79202 - DNA, 25 bp, E. coli
tgtgctggatcccaatctgacgccg

SEQ ID NO: 79203 - DNA, 25 bp, E. coli
gcatcattgagataaccacgctgtc

SEQ ID NO: 79204 - DNA, 25 bp, E. coli
gcatcattgagaaaaccacgctgtc

SEQ ID NO: 79205 - DNA, 25 bp, E. coli
cgggtaaaactgcaaacggctgaca

SEQ ID NO: 79206 - DNA, 25 bp, E. coli
cgggtaaaactggaaacggctgaca

SEQ ID NO: 79207 - DNA, 25 bp, E. coli
ggataacctggaggcggcgatcaaa

SEQ ID NO: 79208 - DNA, 25 bp, E. coli
ggataacctggacgcggcgatcaaa

SEQ ID NO: 79209 - DNA, 25 bp, E. coli
ggcgatcaaaggcaaaccactaact

SEQ ID NO: 79210 - DNA, 25 bp, E. coli
ggcgatcaaagggaaaccactaact

SEQ ID NO: 79211 - DNA, 25 bp, E. coli
gatgcactcgcagacgcgttactgg

SEQ ID NO: 79212 - DNA, 25 bp, E. coli
gatgcactcgcacacgcgttactgg

SEQ ID NO: 79213 - DNA, 25 bp, E. coli
atgcctgaagcccaaagagccgcgt

SEQ ID NO: 79214 - DNA, 25 bp, E. coli
atgcctgaagccgaaagagccgcgt

SEQ ID NO: 79215 - DNA, 25 bp, E. coli
tatcgctttattgtggcggctgcgg

SEQ ID NO: 79216 - DNA, 25 bp, E. coli
tatgcactcgctgctgatagcggca

SEQ ID NO: 79217 - DNA, 25 bp, E. coli
tatgcactcgctcctgatagcggca

SEQ ID NO: 79218 - DNA, 25 bp, E. coli
tatcgctttattctggcggctgcgg

SEQ ID NO: 79219 - DNA, 25 bp, E. coli
tgagccgttacgctgcttccgagtt

SEQ ID NO: 79220 - DNA, 25 bp, E. coli
tgagccgttacggtgcttccgagtt

SEQ ID NO: 79221 - DNA, 25 bp, E. coli
tccagcacgggccatatgattattg

SEQ ID NO: 79222 - DNA, 25 bp, E. coli
tccagcacgggcgatatgattattg

SEQ ID NO: 79223 - DNA, 25 bp, E. coli
gcgatatcccgatgtttgccgttgg

SEQ ID NO: 79224 - DNA, 25 bp, E. coli
gcgatatcccgaagtttgccgttgg

SEQ ID NO: 79225 - DNA, 25 bp, E. coli
gaatttctgccgctatccagcacgg

SEQ ID NO: 79226 - DNA, 25 bp, E. coli
gaatttctgccggtatccagcacgg

SEQ ID NO: 79227 - DNA, 25 bp, E. coli
cgcgtgcgccggctcttgatgatat

SEQ ID NO: 79228 - DNA, 25 bp, E. coli
cgcgtgcgccgggtcttgatgatat

SEQ ID NO: 79229 - DNA, 25 bp, E. coli
gatagcgattaataccttcctgcaa

SEQ ID NO: 79230 - DNA, 25 bp, E. coli
gatagcgattaaaaccttcctgcaa

SEQ ID NO: 79231 - DNA, 25 bp, E. coli
gggctgttgttccacgacacgatta

SEQ ID NO: 79232 - DNA, 25 bp, E. coli
gggctgttgttcgacgacacgatta

SEQ ID NO: 79233 - DNA, 25 bp, E. coli
ggcgacacggcgaaaacctttgaag

SEQ ID NO: 79234 - DNA, 25 bp, E. coli
ggcgacacggcgtaaacctttgaag

SEQ ID NO: 79235 - DNA, 25 bp, E. coli
cagaggtggtaacgatggcgcgtga

SEQ ID NO: 79236 - DNA, 25 bp, E. coli
cagaggtggtaaggatggcgcgtga

SEQ ID NO: 79237 - DNA, 25 bp, E. coli
catgcggaagtgctcattgatgacg

SEQ ID NO: 79238 - DNA, 25 bp, E. coli
catgcggaagtggtcattgatgacg

SEQ ID NO: 79239 - DNA, 25 bp, E. coli
aaatcagaggtggtaacgatggcgc

SEQ ID NO: 79240 - DNA, 25 bp, E. coli
aaatcagaggtgctaacgatggcgc

SEQ ID NO: 79241 - DNA, 25 bp, E. coli
ttgtgcgcggtctgcctgtgccagg

SEQ ID NO: 79242 - DNA, 25 bp, E. coli
ttgtgcgcggtcagcctgtgccagg

SEQ ID NO: 79243 - DNA, 25 bp, E. coli
tgtgccaggtggacggctgggcgtg

SEQ ID NO: 79244 - DNA, 25 bp, E. coli
tgtgccaggtggtcggctgggcgtg

SEQ ID NO: 79245 - DNA, 25 bp, E. coli
tgacgcatgcggaagtgctcattga

SEQ ID NO: 79246 - DNA, 25 bp, E. coli
tgacgcatgcggtagtgctcattga

SEQ ID NO: 79247 - DNA, 25 bp, E. coli
gctgggcgtgaacatttacgaaatc

SEQ ID NO: 79248 - DNA, 25 bp, E. coli
gctcattgatgaggagcagtttgat

SEQ ID NO: 79249 - DNA, 25 bp, E. coli
gctcattgatgacgagcagtttgat

SEQ ID NO: 79250 - DNA, 25 bp, E. coli
gctgggcgtgaagatttacgaaatc

SEQ ID NO: 79251 - DNA, 25 bp, E. coli
cgaaatcagaggaggtaacgatggc

SEQ ID NO: 79252 - DNA, 25 bp, E. coli
cgaaatcagaggtggtaacgatggc

SEQ ID NO: 79253 - DNA, 25 bp, E. coli
cggaagtgctcaatgatgacgagca

SEQ ID NO: 79254 - DNA, 25 bp, E. coli
cggaagtgctcattgatgacgagca

SEQ ID NO: 79255 - DNA, 25 bp, E. coli
ggcgtgaagatttacgaaatcagag

SEQ ID NO: 79256 - DNA, 25 bp, E. coli
ggcgtgaagattaacgaaatcagag

SEQ ID NO: 79257 - DNA, 25 bp, E. coli
caaaatccggctggatgacgagcgc

SEQ ID NO: 79258 - DNA, 25 bp, E. coli
caaaatccggctcgatgacgagcgc

SEQ ID NO: 79259 - DNA, 25 bp, E. coli
agaaagactttacgctggcagcagg

SEQ ID NO: 79260 - DNA, 25 bp, E. coli
agaaagactttaggctggcagcagg

SEQ ID NO: 79261 - DNA, 25 bp, E. coli
aaaattcgcggcctgcaaagtccgg

SEQ ID NO: 79262 - DNA, 25 bp, E. coli
aaaattcgcggcgtgcaaagtccgg

SEQ ID NO: 79263 - DNA, 25 bp, E. coli
tttgaactgcgtaccgatctgtggg

SEQ ID NO: 79264 - DNA, 25 bp, E. coli
tttgaactgcgttccgatctgtggg

SEQ ID NO: 79265 - DNA, 25 bp, E. coli
tcgaaaaaatccagcgcgagcggca

SEQ ID NO: 79266 - DNA, 25 bp, E. coli
tcgaaaaaatcctgcgcgagcggca

SEQ ID NO: 79267 - DNA, 25 bp, E. coli
tctatgcccatatcgacaaggacgg

SEQ ID NO: 79268 - DNA, 25 bp, E. coli
tcagcttgtatacccgtgcgggagc

SEQ ID NO: 79269 - DNA, 25 bp, E. coli
tcagcttgtatagccgtgcgggagc

SEQ ID NO: 79270 - DNA, 25 bp, E. coli
tctatgcccataacgacaaggacgg

SEQ ID NO: 79271 - DNA, 25 bp, E. coli
gaattttacgacgaccagagcggct

SEQ ID NO: 79272 - DNA, 25 bp, E. coli
gaattttacgaccaccagagcggct

SEQ ID NO: 79273 - DNA, 25 bp, E. coli
gaaaaaagtgtcaccacgcgggact

SEQ ID NO: 79274 - DNA, 25 bp, E. coli
gacattcagttttccagcagcgata

SEQ ID NO: 79275 - DNA, 25 bp, E. coli
gacattcagtttaccagcagcgata

SEQ ID NO: 79276 - DNA, 25 bp, E. coli
gaaaaaagtgtctccacgcgggact

SEQ ID NO: 79277 - DNA, 25 bp, E. coli
ggcgataacaccacttacggcgaag

SEQ ID NO: 79278 - DNA, 25 bp, E. coli
ggcgataacacctcttacggcgaag

SEQ ID NO: 79279 - DNA, 25 bp, E. coli
caaaccctgagtgtgaagcgcaaag

SEQ ID NO: 79280 - DNA, 25 bp, E. coli
caaaccctgagtctgaagcgcaaag

SEQ ID NO: 79281 - DNA, 25 bp, E. coli
caaagagtttatagaggcggcacaa

SEQ ID NO: 79282 - DNA, 25 bp, E. coli
caaagagtttattgaggcggcacaa

SEQ ID NO: 79283 - DNA, 25 bp, E. coli
aacatcctgctgtttttcgtggcga

SEQ ID NO: 79284 - DNA, 25 bp, E. coli
aacatcctgctgattttcgtggcga

SEQ ID NO: 79285 - DNA, 25 bp, E. coli
tatggagtccggtcactactttggt

SEQ ID NO: 79286 - DNA, 25 bp, E. coli
tatggagtccggacactactttggt

SEQ ID NO: 79287 - DNA, 25 bp, E. coli
tttggtactgactcatccggtcgcg

SEQ ID NO: 79288 - DNA, 25 bp, E. coli
tttggtactgacacatccggtcgcg

SEQ ID NO: 79289 - DNA, 25 bp, E. coli
tgatgccctcgacccgaaagatcgt

SEQ ID NO: 79290 - DNA, 25 bp, E. coli
tgatgccctcgagccgaaagatcgt

SEQ ID NO: 79291 - DNA, 25 bp, E. coli
cctatgacgatagtgactgggcgat

SEQ ID NO: 79292 - DNA, 25 bp, E. coli
cctatgacgatactgactgggcgat

SEQ ID NO: 79293 - DNA, 25 bp, E. coli
cgtattgtgcgtgggcaaaccctga

SEQ ID NO: 79294 - DNA, 25 bp, E. coli
cgttttatgcattaccgtgcggcgg

SEQ ID NO: 79295 - DNA, 25 bp, E. coli
cgtattgtgcgtcggcaaaccctga

SEQ ID NO: 79296 - DNA, 25 bp, E. coli
cgttttatgcataaccgtgcggcgg

SEQ ID NO: 79297 - DNA, 25 bp, E. coli
ggtgcccagcatcatcctctttgaa

SEQ ID NO: 79298 - DNA, 25 bp, E. coli
ggtgcccagcatgatcctctttgaa

SEQ ID NO: 79299 - DNA, 25 bp, E. coli
taagtaagaaaaacagcgagacgct

SEQ ID NO: 79300 - DNA, 25 bp, E. coli
taagtaagaaaatcagcgagacgct

SEQ ID NO: 79301 - DNA, 25 bp, E. coli
aaccttgatctggaaacgctgaccg

SEQ ID NO: 79302 - DNA, 25 bp, E. coli
cactgctgccgaatatggttgcgac

SEQ ID NO: 79303 - DNA, 25 bp, E. coli
cactgctgccgattatggttgcgac

SEQ ID NO: 79304 - DNA, 25 bp, E. coli
tacttcccggtgaatgcgaacgacg

SEQ ID NO: 79305 - DNA, 25 bp, E. coli
tacttcccggtgtatgcgaacgacg

SEQ ID NO: 79306 - DNA, 25 bp, E. coli
aaagacccgtttgcgctgcgtcgtg

SEQ ID NO: 79307 - DNA, 25 bp, E. coli
aaagacccgtttccgctgcgtcgtg

SEQ ID NO: 79308 - DNA, 25 bp, E. coli
aaccttgatctgcaaacgctgaccg

SEQ ID NO: 79309 - DNA, 25 bp, E. coli
tattaccgttgagcaggctgagcgt

SEQ ID NO: 79310 - DNA, 25 bp, E. coli
tattaccgttgaccaggctgagcgt

SEQ ID NO: 79311 - DNA, 25 bp, E. coli
tgaagagctgccaccaaaagcactg

SEQ ID NO: 79312 - DNA, 25 bp, E. coli
tgagcgtctgacaaccgataaaggc

SEQ ID NO: 79313 - DNA, 25 bp, E. coli
tgagcgtctgactaccgataaaggc

SEQ ID NO: 79314 - DNA, 25 bp, E. coli
tgaagagctgcctccaaaagcactg

SEQ ID NO: 79315 - DNA, 25 bp, E. coli
cgaaatctgacgaagtgctgagcga

SEQ ID NO: 79316 - DNA, 25 bp, E. coli
cgctttatgggccagccggaattca

SEQ ID NO: 79317 - DNA, 25 bp, E. coli
cgctttatgggcgagccggaattca

SEQ ID NO: 79318 - DNA, 25 bp, E. coli
cgaaatctgacgtagtgctgagcga

SEQ ID NO: 79319 - DNA, 25 bp, E. coli
tggcggcggcgaacaaacgtgtatc

SEQ ID NO: 79320 - DNA, 25 bp, E. coli
tggcggcggcgatcaaacgtgtatc

SEQ ID NO: 79321 - DNA, 25 bp, E. coli
tcaatggtttgctgctccgcgtcgt

SEQ ID NO: 79322 - DNA, 25 bp, E. coli
tcaatggtttgcagctccgcgtcgt

SEQ ID NO: 79323 - DNA, 25 bp, E. coli
cagtcgaggttacgtttatatggct

SEQ ID NO: 79324 - DNA, 25 bp, E. coli
cagtcgaggttaggtttatatggct

SEQ ID NO: 79325 - DNA, 25 bp, E. coli
ataccctcggcagtcgaggttacgt

SEQ ID NO: 79326 - DNA, 25 bp, E. coli
agtcgaggttacctttatatggctg

SEQ ID NO: 79327 - DNA, 25 bp, E. coli
ataccctcggcactcgaggttacgt

SEQ ID NO: 79328 - DNA, 25 bp, E. coli
agtcgaggttacgtttatatggctg

SEQ ID NO: 79329 - DNA, 25 bp, E. coli
taccctcggcagtcgaggttacgtt

SEQ ID NO: 79330 - DNA, 25 bp, E. coli
taccctcggcagacgaggttacgtt

SEQ ID NO: 79331 - DNA, 25 bp, E. coli
tcggcagtcgaggttacgtttatat

SEQ ID NO: 79332 - DNA, 25 bp, E. coli
tcggcagtcgagcttacgtttatat

SEQ ID NO: 79333 - DNA, 25 bp, E. coli
gcagtcgaggtttcgtttatatggc

SEQ ID NO: 79334 - DNA, 25 bp, E. coli
gcagtcgaggttacgtttatatggc

SEQ ID NO: 79335 - DNA, 25 bp, E. coli
cgataccctcgggagtcgaggttac

SEQ ID NO: 79336 - DNA, 25 bp, E. coli
cgataccctcggcagtcgaggttac

SEQ ID NO: 79337 - DNA, 25 bp, E. coli
cggcagtcgaggatacgtttatatg

SEQ ID NO: 79338 - DNA, 25 bp, E. coli
cggcagtcgaggttacgtttatatg

SEQ ID NO: 79339 - DNA, 25 bp, E. coli
gtcgaggttacgtttatatggctgt

SEQ ID NO: 79340 - DNA, 25 bp, E. coli
gtcgaggttacgattatatggctgt

SEQ ID NO: 79341 - DNA, 25 bp, E. coli
ggcagtcgaggttacgtttatatgg

SEQ ID NO: 79342 - DNA, 25 bp, E. coli
ggcagtcgaggtaacgtttatatgg

SEQ ID NO: 79343 - DNA, 25 bp, E. coli
gataccctcggcagtcgaggttacg

SEQ ID NO: 79344 - DNA, 25 bp, E. coli
gataccctcggctgtcgaggttacg

SEQ ID NO: 79345 - DNA, 25 bp, E. coli
cacattgtgttagaaaacgataaca

SEQ ID NO: 79346 - DNA, 25 bp, E. coli
cacattgtgttacaaaacgataaca

SEQ ID NO: 79347 - DNA, 25 bp, E. coli
catggaaggttttaccaatggctca

SEQ ID NO: 79348 - DNA, 25 bp, E. coli
catggaaggtttaaccaatggctca

SEQ ID NO: 79349 - DNA, 25 bp, E. coli
cagggaaaatctagctaaagcagga

SEQ ID NO: 79350 - DNA, 25 bp, E. coli
cagggaaaatcttgctaaagcagga

SEQ ID NO: 79351 - DNA, 25 bp, E. coli
tacgcgccctcgtatcacatggaag

SEQ ID NO: 79352 - DNA, 25 bp, E. coli
tactgagagcatacagaacactaca

SEQ ID NO: 79353 - DNA, 25 bp, E. coli
taaagaaatattcgatcaagtgcga

SEQ ID NO: 79354 - DNA, 25 bp, E. coli
tactgagagcattcagaacactaca

SEQ ID NO: 79355 - DNA, 25 bp, E. coli
tacgcgccctcgaatcacatggaag

SEQ ID NO: 79356 - DNA, 25 bp, E. coli
taaagaaatattggatcaagtgcga

SEQ ID NO: 79357 - DNA, 25 bp, E. coli
tatagaaacgtcctatgataggttg

SEQ ID NO: 79358 - DNA, 25 bp, E. coli
tatagaaacgtcgtatgataggttg

SEQ ID NO: 79359 - DNA, 25 bp, E. coli
gctcaggttgccttttttaaagaaa

SEQ ID NO: 79360 - DNA, 25 bp, E. coli
gctcaggttgccatttttaaagaaa

SEQ ID NO: 79361 - DNA, 25 bp, E. coli
gaaatcacatttgagcaatacaggg

SEQ ID NO: 79362 - DNA, 25 bp, E. coli
gaaatcacatttcagcaatacaggg

SEQ ID NO: 79363 - DNA, 25 bp, E. coli
ctagccacagattatattcacattg

SEQ ID NO: 79364 - DNA, 25 bp, E. coli
ctagccacagataatattcacattg

SEQ ID NO: 79365 - DNA, 25 bp, E. coli
ggttgaaatcaagagaaatcacatt

SEQ ID NO: 79366 - DNA, 25 bp, E. coli
ggttgaaatcaacagaaatcacatt

SEQ ID NO: 79367 - DNA, 25 bp, E. coli
aacggcagcaactacgccagatggt

SEQ ID NO: 79368 - DNA, 25 bp, E. coli
acgccgccagcgactgtggatacta

SEQ ID NO: 79369 - DNA, 25 bp, E. coli
acgccgccagcgtctgtggatacta

SEQ ID NO: 79370 - DNA, 25 bp, E. coli
aactgagcagtattagcgagcaggg

SEQ ID NO: 79371 - DNA, 25 bp, E. coli
aactgagcagtaatagcgagcaggg

SEQ ID NO: 79372 - DNA, 25 bp, E. coli
aacggcagcaacaacgccagatggt

SEQ ID NO: 79373 - DNA, 25 bp, E. coli
ccagcgtctgtggatactaccgcaa

SEQ ID NO: 79374 - DNA, 25 bp, E. coli
ccagcgtctgtgcatactaccgcaa

SEQ ID NO: 79375 - DNA, 25 bp, E. coli
gacaactacagacccggctacaacg

SEQ ID NO: 79376 - DNA, 25 bp, E. coli
gcaacaacgccacatggtgctgcgc

SEQ ID NO: 79377 - DNA, 25 bp, E. coli
gcaacaacgccagatggtgctgcgc

SEQ ID NO: 79378 - DNA, 25 bp, E. coli
gacaactacagagccggctacaacg

SEQ ID NO: 79379 - DNA, 25 bp, E. coli
cgccggtggctgttccgaatgcgct

SEQ ID NO: 79380 - DNA, 25 bp, E. coli
cgccggtggctgatccgaatgcgct

SEQ ID NO: 79381 - DNA, 25 bp, E. coli
cgtctgtggatagtaccgcaaccaa

SEQ ID NO: 79382 - DNA, 25 bp, E. coli
cgtctgtggatactaccgcaaccaa

SEQ ID NO: 79383 - DNA, 25 bp, E. coli
ggaactgagcagtaatagcgagcag

SEQ ID NO: 79384 - DNA, 25 bp, E. coli
gtccacgccgcctgcgtctgtggat

SEQ ID NO: 79385 - DNA, 25 bp, E. coli
gtccacgccgccagcgtctgtggat

SEQ ID NO: 79386 - DNA, 25 bp, E. coli
gtgaccacgccggtggctgatccga

SEQ ID NO: 79387 - DNA, 25 bp, E. coli
gtgaccacgccgctggctgatccga

SEQ ID NO: 79388 - DNA, 25 bp, E. coli
ggaactgagcagaaatagcgagcag

SEQ ID NO: 79389 - DNA, 25 bp, E. coli
catctgtgcgcgatgagagtgcaga

SEQ ID NO: 79390 - DNA, 25 bp, E. coli
catctgtgcgcgttgagagtgcaga

SEQ ID NO: 79391 - DNA, 25 bp, E. coli
acataaaacatggatctgtgcgcga

SEQ ID NO: 79392 - DNA, 25 bp, E. coli
acataaaacatgcatctgtgcgcga

SEQ ID NO: 79393 - DNA, 25 bp, E. coli
tatcctgttgccaatctacaagagg

SEQ ID NO: 79394 - DNA, 25 bp, E. coli
tatctggtaaaaagtggactaaacg

SEQ ID NO: 79395 - DNA, 25 bp, E. coli
tatctggtaaaatgtggactaaacg

SEQ ID NO: 79396 - DNA, 25 bp, E. coli
tatcctgttgcctatctacaagagg

SEQ ID NO: 79397 - DNA, 25 bp, E. coli
tgcaaagcggatcccagtttttaaa

SEQ ID NO: 79398 - DNA, 25 bp, E. coli
tgcaaagcggatgccagtttttaaa

SEQ ID NO: 79399 - DNA, 25 bp, E. coli
gcttgtttgcaatgcggatgccagt

SEQ ID NO: 79400 - DNA, 25 bp, E. coli
gcttgtttgcaaagcggatgccagt

SEQ ID NO: 79401 - DNA, 25 bp, E. coli
ccgcgtattggcatgtttgcaaagc

SEQ ID NO: 79402 - DNA, 25 bp, E. coli
ccgcgtattggcttgtttgcaaagc

SEQ ID NO: 79403 - DNA, 25 bp, E. coli
gggttttgctatgctgttgccaatc

SEQ ID NO: 79404 - DNA, 25 bp, E. coli
gggttttgctatcctgttgccaatc

SEQ ID NO: 79405 - DNA, 25 bp, E. coli
tggactaaacggacaaaacagttgc

SEQ ID NO: 79406 - DNA, 25 bp, E. coli
tggactaaacggtcaaaacagttgc

SEQ ID NO: 79407 - DNA, 25 bp, E. coli
tcaaaacagttgcacataaaacatg

SEQ ID NO: 79408 - DNA, 25 bp, E. coli
tcaaaacagttggacataaaacatg

SEQ ID NO: 79409 - DNA, 25 bp, E. coli
gatgagagtgcacaaggtcgaggcc

SEQ ID NO: 79410 - DNA, 25 bp, E. coli
gatgagagtgcagaaggtcgaggcc

SEQ ID NO: 79411 - DNA, 25 bp, E. coli
aagcctattacagaaccggccacta

SEQ ID NO: 79412 - DNA, 25 bp, E. coli
aagcctattacacaaccggccacta

SEQ ID NO: 79413 - DNA, 25 bp, E. coli
cactgaagcctaatacacaaccggc

SEQ ID NO: 79414 - DNA, 25 bp, E. coli
cactgaagcctattacacaaccggc

SEQ ID NO: 79415 - DNA, 25 bp, E. coli
actgaagcctattacacaaccggcc

SEQ ID NO: 79416 - DNA, 25 bp, E. coli
actgaagcctataacacaaccggcc

SEQ ID NO: 79417 - DNA, 25 bp, E. coli
tgaagcctattagacaaccggccac

SEQ ID NO: 79418 - DNA, 25 bp, E. coli
tgaagtcactgaagcctattacaca

SEQ ID NO: 79419 - DNA, 25 bp, E. coli
tgaagcctattacacaaccggccac

SEQ ID NO: 79420 - DNA, 25 bp, E. coli
tgaagtcactgatgcctattacaca

SEQ ID NO: 79421 - DNA, 25 bp, E. coli
tcactgaagcctattacacaaccgg

SEQ ID NO: 79422 - DNA, 25 bp, E. coli
tcactgaagccttttacacaaccgg

SEQ ID NO: 79423 - DNA, 25 bp, E. coli
gaagcctattactcaaccggccact

SEQ ID NO: 79424 - DNA, 25 bp, E. coli
gaagtcactgaaccctattacacaa

SEQ ID NO: 79425 - DNA, 25 bp, E. coli
gaagtcactgaagcctattacacaa

SEQ ID NO: 79426 - DNA, 25 bp, E. coli
gaagcctattacacaaccggccact

SEQ ID NO: 79427 - DNA, 25 bp, E. coli
cctattacacaaccggccactacag

SEQ ID NO: 79428 - DNA, 25 bp, E. coli
cctattacacaagcggccactacag

SEQ ID NO: 79429 - DNA, 25 bp, E. coli
gtcactgaagccaattacacaaccg

SEQ ID NO: 79430 - DNA, 25 bp, E. coli
gtcactgaagcctattacacaaccg

SEQ ID NO: 79431 - DNA, 25 bp, E. coli
gatgaagtcactcaagcctattaca

SEQ ID NO: 79432 - DNA, 25 bp, E. coli
gatgaagtcactgaagcctattaca

SEQ ID NO: 79433 - DNA, 25 bp, E. coli
aatgagcgtctcgattactgcctgg

SEQ ID NO: 79434 - DNA, 25 bp, E. coli
aatgagcgtctccattactgcctgg

SEQ ID NO: 79435 - DNA, 25 bp, E. coli
taccgttgaacggatggactttgcc

SEQ ID NO: 79436 - DNA, 25 bp, E. coli
taccgttgaacgcatggactttgcc

SEQ ID NO: 79437 - DNA, 25 bp, E. coli
tatcaacgtatcatggaacagctcg

SEQ ID NO: 79438 - DNA, 25 bp, E. coli
tatcaacgtatcttggaacagctcg

SEQ ID NO: 79439 - DNA, 25 bp, E. coli
ttaaaccgcagctactgaccacagg

SEQ ID NO: 79440 - DNA, 25 bp, E. coli
ttaaaccgcagcaactgaccacagg

SEQ ID NO: 79441 - DNA, 25 bp, E. coli
tgatcaaagcgctggtgcttgccct

SEQ ID NO: 79442 - DNA, 25 bp, E. coli
tgatcaaagcgcaggtgcttgccct

SEQ ID NO: 79443 - DNA, 25 bp, E. coli
tcccggcgaccagtatgcagattgc

SEQ ID NO: 79444 - DNA, 25 bp, E. coli
tcgtgacggcatgttattcgggcgc

SEQ ID NO: 79445 - DNA, 25 bp, E. coli
tgcccggttattcagctgacacaac

SEQ ID NO: 79446 - DNA, 25 bp, E. coli
tcgtgacggcatcttattcgggcgc

SEQ ID NO: 79447 - DNA, 25 bp, E. coli
tgcccggttattgagctgacacaac

SEQ ID NO: 79448 - DNA, 25 bp, E. coli
tcccggcgaccactatgcagattgc

SEQ ID NO: 79449 - DNA, 25 bp, E. coli
tctggctgacaatccggtacatcgc

SEQ ID NO: 79450 - DNA, 25 bp, E. coli
tctggctgacaaaccggtacatcgc

SEQ ID NO: 79451 - DNA, 25 bp, E. coli
gatcacctctgaagaagaagccagt

SEQ ID NO: 79452 - DNA, 25 bp, E. coli
gatcacctctgatgaagaagccagt

SEQ ID NO: 79453 - DNA, 25 bp, E. coli
taatgaatgtgtgaacgctgccgac

SEQ ID NO: 79454 - DNA, 25 bp, E. coli
taatgaatgtgtcaacgctgccgac

SEQ ID NO: 79455 - DNA, 25 bp, E. coli
aattcagtctgtggccgcaacaatg

SEQ ID NO: 79456 - DNA, 25 bp, E. coli
caattcagtctgaggccgcaacaat

SEQ ID NO: 79457 - DNA, 25 bp, E. coli
aattcagtctgtcgccgcaacaatg

SEQ ID NO: 79458 - DNA, 25 bp, E. coli
caattcagtctgtggccgcaacaat

SEQ ID NO: 79459 - DNA, 25 bp, E. coli
atggcattcagttatcccttcgatg

SEQ ID NO: 79460 - DNA, 25 bp, E. coli
atggcattcagtaatcccttcgatg

SEQ ID NO: 79461 - DNA, 25 bp, E. coli
ttcagtctgtgggcgcaacaatgcg

SEQ ID NO: 79462 - DNA, 25 bp, E. coli
ttcagtctgtggccgcaacaatgcg

SEQ ID NO: 79463 - DNA, 25 bp, E. coli
tgcgcaatgcgctggggcaattcag

SEQ ID NO: 79464 - DNA, 25 bp, E. coli
tgcgcaatgcgcaggggcaattcag

SEQ ID NO: 79465 - DNA, 25 bp, E. coli
gcattcagtaatgccttcgatgatc

SEQ ID NO: 79466 - DNA, 25 bp, E. coli
gcattcagtaatcccttcgatgatc

SEQ ID NO: 79467 - DNA, 25 bp, E. coli
gcaattcagtctgtggccgcaacaa

SEQ ID NO: 79468 - DNA, 25 bp, E. coli
gcaattcagtctctggccgcaacaa

SEQ ID NO: 79469 - DNA, 25 bp, E. coli
gggcaattcagtctgtggccgcaac

SEQ ID NO: 79470 - DNA, 25 bp, E. coli
gggcaattcagtgtgtggccgcaac

SEQ ID NO: 79471 - DNA, 25 bp, E. coli
ggcaattcagtcagtggccgcaaca

SEQ ID NO: 79472 - DNA, 25 bp, E. coli
tggcattcagtattcccttcgatga

SEQ ID NO: 79473 - DNA, 25 bp, E. coli
ggcaattcagtctgtggccgcaaca

SEQ ID NO: 79474 - DNA, 25 bp, E. coli
ggcattcagtaatcccttcgatgat

SEQ ID NO: 79475 - DNA, 25 bp, E. coli
tggcattcagtaatcccttcgatga

SEQ ID NO: 79476 - DNA, 25 bp, E. coli
ggcattcagtaaacccttcgatgat

SEQ ID NO: 79477 - DNA, 25 bp, E. coli
accgcgccgatgacctggaacataa

SEQ ID NO: 79478 - DNA, 25 bp, E. coli
accgcgccgatgtcctggaacataa

SEQ ID NO: 79479 - DNA, 25 bp, E. coli
ttaccgcgccgaagacctggaacat

SEQ ID NO: 79480 - DNA, 25 bp, E. coli
ttaccgcgccgatgacctggaacat

SEQ ID NO: 79481 - DNA, 25 bp, E. coli
tgacctggaacataaaaccgcattg

SEQ ID NO: 79482 - DNA, 25 bp, E. coli
tgacctggaacaaaaaaccgcattg

SEQ ID NO: 79483 - DNA, 25 bp, E. coli
gcgccgatgacctggaacataaaac

SEQ ID NO: 79484 - DNA, 25 bp, E. coli
gcgccgatgaccaggaacataaaac

SEQ ID NO: 79485 - DNA, 25 bp, E. coli
cctggaacataaaaccgcattgctg

SEQ ID NO: 79486 - DNA, 25 bp, E. coli
cctggaacataataccgcattgctg

SEQ ID NO: 79487 - DNA, 25 bp, E. coli
gccgatgacctggaacataaaaccg

SEQ ID NO: 79488 - DNA, 25 bp, E. coli
gccgatgacctgcaacataaaaccg

SEQ ID NO: 79489 - DNA, 25 bp, E. coli
cgatgacctggatcataaaaccgca

SEQ ID NO: 79490 - DNA, 25 bp, E. coli
cgcgccgatgacctggaacataaaa

SEQ ID NO: 79491 - DNA, 25 bp, E. coli
cgatgacctggaacataaaaccgca

SEQ ID NO: 79492 - DNA, 25 bp, E. coli
cgcgccgatgacgtggaacataaaa

SEQ ID NO: 79493 - DNA, 25 bp, E. coli
tggaacataaaagcgcattgctggt

SEQ ID NO: 79494 - DNA, 25 bp, E. coli
tggaacataaaaccgcattgctggt

SEQ ID NO: 79495 - DNA, 25 bp, E. coli
gacctggaacattaaaccgcattgc

SEQ ID NO: 79496 - DNA, 25 bp, E. coli
gacctggaacataaaaccgcattgc

SEQ ID NO: 79497 - DNA, 25 bp, E. coli
gatgacctggaagataaaaccgcat

SEQ ID NO: 79498 - DNA, 25 bp, E. coli
gatgacctggaacataaaaccgcat

SEQ ID NO: 79499 - DNA, 25 bp, E. coli
caatgaaaatgtcttttctgaaact

SEQ ID NO: 79500 - DNA, 25 bp, E. coli
caatgaaaatgtgttttctgaaact

SEQ ID NO: 79501 - DNA, 25 bp, E. coli
aatcttctcatttaactaaagctgg

SEQ ID NO: 79502 - DNA, 25 bp, E. coli
aatcttctcattaaactaaagctgg

SEQ ID NO: 79503 - DNA, 25 bp, E. coli
taaactaaagctggaaaacaatgaa

SEQ ID NO: 79504 - DNA, 25 bp, E. coli
taaactaaagctcgaaaacaatgaa

SEQ ID NO: 79505 - DNA, 25 bp, E. coli
acgagttagttagttctggtgagcc

SEQ ID NO: 79506 - DNA, 25 bp, E. coli
acgagttagttacttctggtgagcc

SEQ ID NO: 79507 - DNA, 25 bp, E. coli
tagttagttctggtgagcctgacgt

SEQ ID NO: 79508 - DNA, 25 bp, E. coli
tagttagttctgctgagcctgacgt

SEQ ID NO: 79509 - DNA, 25 bp, E. coli
tgaatgcgctaatagaaatgaatag

SEQ ID NO: 79510 - DNA, 25 bp, E. coli
tgaatgcgctaaaagaaatgaatag

SEQ ID NO: 79511 - DNA, 25 bp, E. coli
tctgaaactaaaaaattatcgaata

SEQ ID NO: 79512 - DNA, 25 bp, E. coli
tctgaaactaaataattatcgaata

SEQ ID NO: 79513 - DNA, 25 bp, E. coli
cgaataaaaataatgccgatcagtt

SEQ ID NO: 79514 - DNA, 25 bp, E. coli
cgaataaaaatattgccgatcagtt

SEQ ID NO: 79515 - DNA, 25 bp, E. coli
ccgatcagttttatgaatgcgctaa

SEQ ID NO: 79516 - DNA, 25 bp, E. coli
ccgatcagttttttgaatgcgctaa

SEQ ID NO: 79517 - DNA, 25 bp, E. coli
cgtacactttaataataatcacgag

SEQ ID NO: 79518 - DNA, 25 bp, E. coli
cgtacactttaaaaataatcacgag

SEQ ID NO: 79519 - DNA, 25 bp, E. coli
taatcacgagttagttagttctggt

SEQ ID NO: 79520 - DNA, 25 bp, E. coli
taatcacgagtttgttagttctggt

SEQ ID NO: 79521 - DNA, 25 bp, E. coli
catcttccggatgacgtccgggaga

SEQ ID NO: 79522 - DNA, 25 bp, E. coli
catcttccggatcacgtccgggaga

SEQ ID NO: 79523 - DNA, 25 bp, E. coli
tacagccatcttccggatgacgtcc

SEQ ID NO: 79524 - DNA, 25 bp, E. coli
tacagccatcttgcggatgacgtcc

SEQ ID NO: 79525 - DNA, 25 bp, E. coli
atcttccggatgacgtccgggagac

SEQ ID NO: 79526 - DNA, 25 bp, E. coli
atcttccggatgtcgtccgggagac

SEQ ID NO: 79527 - DNA, 25 bp, E. coli
atgacgtccgggagacactgcagtc

SEQ ID NO: 79528 - DNA, 25 bp, E. coli
atgacgtccgggtgacactgcagtc

SEQ ID NO: 79529 - DNA, 25 bp, E. coli
agccatcttccggatgacgtccggg

SEQ ID NO: 79530 - DNA, 25 bp, E. coli
agccatcttccgcatgacgtccggg

SEQ ID NO: 79531 - DNA, 25 bp, E. coli
agcctgactgcccaggaggcactcg

SEQ ID NO: 79532 - DNA, 25 bp, E. coli
actcgcgacgctggcattatccggt

SEQ ID NO: 79533 - DNA, 25 bp, E. coli
agcctgactgccgaggaggcactcg

SEQ ID NO: 79534 - DNA, 25 bp, E. coli
actcgcgacgctcgcattatccggt

SEQ ID NO: 79535 - DNA, 25 bp, E. coli
tgactgcccaggtggcactcgcgac

SEQ ID NO: 79536 - DNA, 25 bp, E. coli
tgactgcccaggaggcactcgcgac

SEQ ID NO: 79537 - DNA, 25 bp, E. coli
tcgcgacgctgggattatccggtga

SEQ ID NO: 79538 - DNA, 25 bp, E. coli
tcgcgacgctggcattatccggtga

SEQ ID NO: 79539 - DNA, 25 bp, E. coli
cctacagccatcttccggatgacgt

SEQ ID NO: 79540 - DNA, 25 bp, E. coli
cctacagccatcatccggatgacgt

SEQ ID NO: 79541 - DNA, 25 bp, E. coli
gatgacgtccggcagacactgcagt

SEQ ID NO: 79542 - DNA, 25 bp, E. coli
gatgacgtccgggagacactgcagt

SEQ ID NO: 79543 - DNA, 25 bp, E. coli
caatcgacggcaaagataagggcga

SEQ ID NO: 79544 - DNA, 25 bp, E. coli
caatcgacggcatagataagggcga

SEQ ID NO: 79545 - DNA, 25 bp, E. coli
tagtatctggatcatcggcctgcac

SEQ ID NO: 79546 - DNA, 25 bp, E. coli
tagcctgtaacctctgcgcggtagc

SEQ ID NO: 79547 - DNA, 25 bp, E. coli
tagtatctggatgatcggcctgcac

SEQ ID NO: 79548 - DNA, 25 bp, E. coli
tagcctgtaaccactgcgcggtagc

SEQ ID NO: 79549 - DNA, 25 bp, E. coli
tatcgacgtcaagagcctgttaccg

SEQ ID NO: 79550 - DNA, 25 bp, E. coli
tatcgacgtcaacagcctgttaccg

SEQ ID NO: 79551 - DNA, 25 bp, E. coli
taggtttcggcacccaggttcgtag

SEQ ID NO: 79552 - DNA, 25 bp, E. coli
taggtttcggcagccaggttcgtag

SEQ ID NO: 79553 - DNA, 25 bp, E. coli
ccggatggcaggaatggcaatcgac

SEQ ID NO: 79554 - DNA, 25 bp, E. coli
ccggatggcaggtatggcaatcgac

SEQ ID NO: 79555 - DNA, 25 bp, E. coli
gcgaaacgcgaaagtacccggaaga

SEQ ID NO: 79556 - DNA, 25 bp, E. coli
gcgaagagcgttgcgtagcctgtaa

SEQ ID NO: 79557 - DNA, 25 bp, E. coli
gcgaagagcgttccgtagcctgtaa

SEQ ID NO: 79558 - DNA, 25 bp, E. coli
gcgaaacgcgaatgtacccggaaga

SEQ ID NO: 79559 - DNA, 25 bp, E. coli
ggtcggctgtatctcgctgcaaaaa

SEQ ID NO: 79560 - DNA, 25 bp, E. coli
ggtcggctgtatgtcgctgcaaaaa

SEQ ID NO: 79561 - DNA, 25 bp, E. coli
taagggcgaagcagagaacgaagcc

SEQ ID NO: 79562 - DNA, 25 bp, E. coli
taagggcgaagctgagaacgaagcc

SEQ ID NO: 79563 - DNA, 25 bp, E. coli
gaggatctgctgttctccggtccgg

SEQ ID NO: 79564 - DNA, 25 bp, E. coli
gaggatctgctgatctccggtccgg

SEQ ID NO: 79565 - DNA, 25 bp, E. coli
agttttccgccccacgtcgtggctg

SEQ ID NO: 79566 - DNA, 25 bp, E. coli
agttttccgcccgacgtcgtggctg

SEQ ID NO: 79567 - DNA, 25 bp, E. coli
tacgcggaaatcgtgaagaaagttt

SEQ ID NO: 79568 - DNA, 25 bp, E. coli
tacgcggaaatcctgaagaaagttt

SEQ ID NO: 79569 - DNA, 25 bp, E. coli
tttagcccatctcgcggaaagctcg

SEQ ID NO: 79570 - DNA, 25 bp, E. coli
tttagcccatctggcggaaagctcg

SEQ ID NO: 79571 - DNA, 25 bp, E. coli
ttttagctcaccagcatttagccca

SEQ ID NO: 79572 - DNA, 25 bp, E. coli
ttttagctcacctgcatttagccca

SEQ ID NO: 79573 - DNA, 25 bp, E. coli
gctatcgcgataaggatttcatcca

SEQ ID NO: 79574 - DNA, 25 bp, E. coli
gctatcgcgatatggatttcatcca

SEQ ID NO: 79575 - DNA, 25 bp, E. coli
gaaacccgcttcaggcagttttatc

SEQ ID NO: 79576 - DNA, 25 bp, E. coli
gaaacccgcttctggcagttttatc

SEQ ID NO: 79577 - DNA, 25 bp, E. coli
gacgtcgtggctggcattcatatgc

SEQ ID NO: 79578 - DNA, 25 bp, E. coli
gacgtcgtggctcgcattcatatgc

SEQ ID NO: 79579 - DNA, 25 bp, E. coli
cggaaagctcgcattccggcaattt

SEQ ID NO: 79580 - DNA, 25 bp, E. coli
ctggctgatttcctacgcggaaatc

SEQ ID NO: 79581 - DNA, 25 bp, E. coli
cggaaagctcgctttccggcaattt

SEQ ID NO: 79582 - DNA, 25 bp, E. coli
ctggctgatttcgtacgcggaaatc

SEQ ID NO: 79583 - DNA, 25 bp, E. coli
gtgactcctggtacgatttagacgc

SEQ ID NO: 79584 - DNA, 25 bp, E. coli
gtgactcctggttcgatttagacgc

SEQ ID NO: 79585 - DNA, 25 bp, E. coli
tggatgccctgcctgactcctggta

SEQ ID NO: 79586 - DNA, 25 bp, E. coli
tggatgccctgcgtgactcctggta

SEQ ID NO: 79587 - DNA, 25 bp, E. coli
tagagacgtgatcatatttacagca

SEQ ID NO: 79588 - DNA, 25 bp, E. coli
tagagacgtgatgatatttacagca

SEQ ID NO: 79589 - DNA, 25 bp, E. coli
ttttttatgacagctgccactgccg

SEQ ID NO: 79590 - DNA, 25 bp, E. coli
ttttttatgacacctgccactgccg

SEQ ID NO: 79591 - DNA, 25 bp, E. coli
ttaaggaactttctgaacaccgtca

SEQ ID NO: 79592 - DNA, 25 bp, E. coli
tcgctaccgtgaaagtgctacaaag

SEQ ID NO: 79593 - DNA, 25 bp, E. coli
tcgctaccgtgatagtgctacaaag

SEQ ID NO: 79594 - DNA, 25 bp, E. coli
tgccactgccgtcaataagttctgt

SEQ ID NO: 79595 - DNA, 25 bp, E. coli
tgccactgccgtgaataagttctgt

SEQ ID NO: 79596 - DNA, 25 bp, E. coli
ttaaggaactttgtgaacaccgtca

SEQ ID NO: 79597 - DNA, 25 bp, E. coli
tctttcagacatccagaatgccaaa

SEQ ID NO: 79598 - DNA, 25 bp, E. coli
tctttcagacatgcagaatgccaaa

SEQ ID NO: 79599 - DNA, 25 bp, E. coli
gcaggcatctttgcattcaaactaa

SEQ ID NO: 79600 - DNA, 25 bp, E. coli
gcaggcatctttccattcaaactaa

SEQ ID NO: 79601 - DNA, 25 bp, E. coli
gaacaccgtcatatttccatagaga

SEQ ID NO: 79602 - DNA, 25 bp, E. coli
gaacaccgtcatttttccatagaga

SEQ ID NO: 79603 - DNA, 25 bp, E. coli
tggtgtctttatgtgtctgcaggca

SEQ ID NO: 79604 - DNA, 25 bp, E. coli
tggaaactttatggacctggcacaa

SEQ ID NO: 79605 - DNA, 25 bp, E. coli
tggtgtctttatctgtctgcaggca

SEQ ID NO: 79606 - DNA, 25 bp, E. coli
ggcgctggctcttgaagacgctaaa

SEQ ID NO: 79607 - DNA, 25 bp, E. coli
ggcgctggctctagaagacgctaaa

SEQ ID NO: 79608 - DNA, 25 bp, E. coli
tggaaactttatcgacctggcacaa

SEQ ID NO: 79609 - DNA, 25 bp, E. coli
caccagacggatgacggcgaactgt

SEQ ID NO: 79610 - DNA, 25 bp, E. coli
caccagacggatcacggcgaactgt

SEQ ID NO: 79611 - DNA, 25 bp, E. coli
agcgacctgccgttgcgtctgcact

SEQ ID NO: 79612 - DNA, 25 bp, E. coli
aacctctccaaaagtcatttacagg

SEQ ID NO: 79613 - DNA, 25 bp, E. coli
aacctctccaaatgtcatttacagg

SEQ ID NO: 79614 - DNA, 25 bp, E. coli
agcgacctgccgatgcgtctgcact

SEQ ID NO: 79615 - DNA, 25 bp, E. coli
actaataacgccatccggcacattg

SEQ ID NO: 79616 - DNA, 25 bp, E. coli
actaataacgccttccggcacattg

SEQ ID NO: 79617 - DNA, 25 bp, E. coli
tctgacggaaacgttggggccagaa

SEQ ID NO: 79618 - DNA, 25 bp, E. coli
tctgacggaaaccttggggccagaa

SEQ ID NO: 79619 - DNA, 25 bp, E. coli
gctgccgggcttagaccgtgtattt

SEQ ID NO: 79620 - DNA, 25 bp, E. coli
gctgccgggctttgaccgtgtattt

SEQ ID NO: 79621 - DNA, 25 bp, E. coli
cgttgcgtctgcactggcagaataa

SEQ ID NO: 79622 - DNA, 25 bp, E. coli
cgttgcgtctgctctggcagaataa

SEQ ID NO: 79623 - DNA, 25 bp, E. coli
ccgtgtatttaaagtcatcaaagac

SEQ ID NO: 79624 - DNA, 25 bp, E. coli
ccgtgtatttaatgtcatcaaagac

SEQ ID NO: 79625 - DNA, 25 bp, E. coli
ctgtttattgattcctgtctgacga

SEQ ID NO: 79626 - DNA, 25 bp, E. coli
ctgtttattgatacctgtctgacga

SEQ ID NO: 79627 - DNA, 25 bp, E. coli
ggccagaaaacctctccaaaagtca

SEQ ID NO: 79628 - DNA, 25 bp, E. coli
ggcgaactgtttattgatacctgtc

SEQ ID NO: 79629 - DNA, 25 bp, E. coli
ggccagaaaaccactccaaaagtca

SEQ ID NO: 79630 - DNA, 25 bp, E. coli
ggcgaactgttttttgatacctgtc

SEQ ID NO: 79631 - DNA, 25 bp, E. coli
caattactgtcgacaaagaagggct

SEQ ID NO: 79632 - DNA, 25 bp, E. coli
caattactgtcgtcaaagaagggct

SEQ ID NO: 79633 - DNA, 25 bp, E. coli
caaggaagacataccggcactggcg

SEQ ID NO: 79634 - DNA, 25 bp, E. coli
caaggaagacattccggcactggcg

SEQ ID NO: 79635 - DNA, 25 bp, E. coli
tgtttgctctcaaccgtgatgtcgg

SEQ ID NO: 79636 - DNA, 25 bp, E. coli
tgtttgctctcatccgtgatgtcgg

SEQ ID NO: 79637 - DNA, 25 bp, E. coli
tgtattccagaaaagcggcgcggat

SEQ ID NO: 79638 - DNA, 25 bp, E. coli
tgattctgaacgaaacggcatggtt

SEQ ID NO: 79639 - DNA, 25 bp, E. coli
tgtattccagaatagcggcgcggat

SEQ ID NO: 79640 - DNA, 25 bp, E. coli
tgattctgaacgtaacggcatggtt

SEQ ID NO: 79641 - DNA, 25 bp, E. coli
cgtttattgacggtgacatgatgga

SEQ ID NO: 79642 - DNA, 25 bp, E. coli
cgtttattgacgctgacatgatgga

SEQ ID NO: 79643 - DNA, 25 bp, E. coli
gttgatccgcatgatatcccgcagg

SEQ ID NO: 79644 - DNA, 25 bp, E. coli
gttgatccgcatcatatcccgcagg

SEQ ID NO: 79645 - DNA, 25 bp, E. coli
gataaaacgctggtgcaatgcggcg

SEQ ID NO: 79646 - DNA, 25 bp, E. coli
gataaaacgctgctgcaatgcggcg

SEQ ID NO: 79647 - DNA, 25 bp, E. coli
taacgctgacttaaccggtgagaag

SEQ ID NO: 79648 - DNA, 25 bp, E. coli
taaccgatgaggtgaaacgccgtgg

SEQ ID NO: 79649 - DNA, 25 bp, E. coli
taaccgatgaggagaaacgccgtgg

SEQ ID NO: 79650 - DNA, 25 bp, E. coli
taacgctgactttaccggtgagaag

SEQ ID NO: 79651 - DNA, 25 bp, E. coli
gatggtatgcctgcagcgctgaaag

SEQ ID NO: 79652 - DNA, 25 bp, E. coli
gatggtatgcctccagcgctgaaag

SEQ ID NO: 79653 - DNA, 25 bp, E. coli
cactgacgctgagggatattaccaa

SEQ ID NO: 79654 - DNA, 25 bp, E. coli
cactgacgctgacggatattaccaa

SEQ ID NO: 79655 - DNA, 25 bp, E. coli
cataaaagacagtctggcagtggga

SEQ ID NO: 79656 - DNA, 25 bp, E. coli
cataaaagacagactggcagtggga

SEQ ID NO: 79657 - DNA, 25 bp, E. coli
cagtctggcagtcggactaaatgca

SEQ ID NO: 79658 - DNA, 25 bp, E. coli
cagtctggcagtgggactaaatgca

SEQ ID NO: 79659 - DNA, 25 bp, E. coli
taaatgcactgacgctgacggatat

SEQ ID NO: 79660 - DNA, 25 bp, E. coli
taaatgcactgaggctgacggatat

SEQ ID NO: 79661 - DNA, 25 bp, E. coli
attaccaaaaatgcaacgtatggcg

SEQ ID NO: 79662 - DNA, 25 bp, E. coli
attaccaaaaatccaacgtatggcg

SEQ ID NO: 79663 - DNA, 25 bp, E. coli
aaaagacagtctcgcagtgggacta

SEQ ID NO: 79664 - DNA, 25 bp, E. coli
aaaagacagtctggcagtgggacta

SEQ ID NO: 79665 - DNA, 25 bp, E. coli
ttccaggccatataagacagtctgg

SEQ ID NO: 79666 - DNA, 25 bp, E. coli
ttccaggccataaaagacagtctgg

SEQ ID NO: 79667 - DNA, 25 bp, E. coli
tgcactgacgctcacggatattacc

SEQ ID NO: 79668 - DNA, 25 bp, E. coli
tgcactgacgctgacggatattacc

SEQ ID NO: 79669 - DNA, 25 bp, E. coli
tctggcagtgggactaaatgcactg

SEQ ID NO: 79670 - DNA, 25 bp, E. coli
tctggcagtgggtctaaatgcactg

SEQ ID NO: 79671 - DNA, 25 bp, E. coli
gtgggactaaatccactgacgctga

SEQ ID NO: 79672 - DNA, 25 bp, E. coli
gtgggactaaatgcactgacgctga

SEQ ID NO: 79673 - DNA, 25 bp, E. coli
gacggatattacgaaaaatgcaacg

SEQ ID NO: 79674 - DNA, 25 bp, E. coli
gacggatattaccaaaaatgcaacg

SEQ ID NO: 79675 - DNA, 25 bp, E. coli
agcgactgacactgttgaatcccga

SEQ ID NO: 79676 - DNA, 25 bp, E. coli
agcgactgacacagttgaatcccga

SEQ ID NO: 79677 - DNA, 25 bp, E. coli
aaaactgctcgagagccaggtgctg

SEQ ID NO: 79678 - DNA, 25 bp, E. coli
aaaactgctcgacagccaggtgctg

SEQ ID NO: 79679 - DNA, 25 bp, E. coli
tatgcggaggaagcaatgcagatcc

SEQ ID NO: 79680 - DNA, 25 bp, E. coli
tatgcggaggaaccaatgcagatcc

SEQ ID NO: 79681 - DNA, 25 bp, E. coli
tcagttgatggttctgacgccgccc

SEQ ID NO: 79682 - DNA, 25 bp, E. coli
tcagttgatggtactgacgccgccc

SEQ ID NO: 79683 - DNA, 25 bp, E. coli
gacaaatcctctttaccactgaaga

SEQ ID NO: 79684 - DNA, 25 bp, E. coli
gacaaatcctctataccactgaaga

SEQ ID NO: 79685 - DNA, 25 bp, E. coli
gttatagccgcctaatcctgctcga

SEQ ID NO: 79686 - DNA, 25 bp, E. coli
gttatagccgccaaatcctgctcga

SEQ ID NO: 79687 - DNA, 25 bp, E. coli
tggcgactcgcctggagattaatgc

SEQ ID NO: 79688 - DNA, 25 bp, E. coli
tggcgactcgccaggagattaatgc

SEQ ID NO: 79689 - DNA, 25 bp, E. coli
taagcaatctgcaacgacaaatcct

SEQ ID NO: 79690 - DNA, 25 bp, E. coli
taagcaatctgctacgacaaatcct

SEQ ID NO: 79691 - DNA, 25 bp, E. coli
gagaactccgactgttcgacggtaa

SEQ ID NO: 79692 - DNA, 25 bp, E. coli
gatgacgacgatctgcatttaagca

SEQ ID NO: 79693 - DNA, 25 bp, E. coli
gacgctggtactcgcagatgacgac

SEQ ID NO: 79694 - DNA, 25 bp, E. coli
gacgctggtactggcagatgacgac

SEQ ID NO: 79695 - DNA, 25 bp, E. coli
gagaactccgacagttcgacggtaa

SEQ ID NO: 79696 - DNA, 25 bp, E. coli
gatgacgacgatgtgcatttaagca

SEQ ID NO: 79697 - DNA, 25 bp, E. coli
tagtcggtcagcgttcatcacaggg

SEQ ID NO: 79698 - DNA, 25 bp, E. coli
tatggatatggagccgacctgttca

SEQ ID NO: 79699 - DNA, 25 bp, E. coli
tatggatatggacccgacctgttca

SEQ ID NO: 79700 - DNA, 25 bp, E. coli
tagtcggtcagccttcatcacaggg

SEQ ID NO: 79701 - DNA, 25 bp, E. coli
tcatcacagggtaggcaaggcgata

SEQ ID NO: 79702 - DNA, 25 bp, E. coli
tcatcacagggttggcaaggcgata

SEQ ID NO: 79703 - DNA, 25 bp, E. coli
gccgccaggcaagaatgtcagctgt

SEQ ID NO: 79704 - DNA, 25 bp, E. coli
gccgccaggcaacaatgtcagctgt

SEQ ID NO: 79705 - DNA, 25 bp, E. coli
cgttcgcgccgatcgtggttcatta

SEQ ID NO: 79706 - DNA, 25 bp, E. coli
cgttcgcgccgaacgtggttcatta

SEQ ID NO: 79707 - DNA, 25 bp, E. coli
gtcgttccagaaccatcacggtggt

SEQ ID NO: 79708 - DNA, 25 bp, E. coli
ggtgtgattattggcgacgtgccct

SEQ ID NO: 79709 - DNA, 25 bp, E. coli
ggtgtgattattcgcgacgtgccct

SEQ ID NO: 79710 - DNA, 25 bp, E. coli
gtcgttccagaagcatcacggtggt

SEQ ID NO: 79711 - DNA, 25 bp, E. coli
tggtcgatgaacaaccgcaaggtat

SEQ ID NO: 79712 - DNA, 25 bp, E. coli
ggcaaatgcccgtggtaacagtgca

SEQ ID NO: 79713 - DNA, 25 bp, E. coli
ggcaaatgcccgaggtaacagtgca

SEQ ID NO: 79714 - DNA, 25 bp, E. coli
ggcaatgtctgggagaacccgacct

SEQ ID NO: 79715 - DNA, 25 bp, E. coli
ggcaatgtctggcagaacccgacct

SEQ ID NO: 79716 - DNA, 25 bp, E. coli
tggtcgatgaactaccgcaaggtat

SEQ ID NO: 79717 - DNA, 25 bp, E. coli
gacccgctttgtaatgccgcaacga

SEQ ID NO: 79718 - DNA, 25 bp, E. coli
gacccgctttgttatgccgcaacga

SEQ ID NO: 79719 - DNA, 25 bp, E. coli
aacgttgctctgtgtgtgataaacc

SEQ ID NO: 79720 - DNA, 25 bp, E. coli
cagcgagaagatcgaatatatcccc

SEQ ID NO: 79721 - DNA, 25 bp, E. coli
cagcgagaagatggaatatatcccc

SEQ ID NO: 79722 - DNA, 25 bp, E. coli
acctttttattcttgatgatgtcag

SEQ ID NO: 79723 - DNA, 25 bp, E. coli
acctttttattcatgatgatgtcag

SEQ ID NO: 79724 - DNA, 25 bp, E. coli
tatatccccgactgggtcgtggtta

SEQ ID NO: 79725 - DNA, 25 bp, E. coli
aacgttgctctgagtgtgataaacc

SEQ ID NO: 79726 - DNA, 25 bp, E. coli
tatatccccgacagggtcgtggtta

SEQ ID NO: 79727 - DNA, 25 bp, E. coli
ttgatgatgtcagcgagaagatgga

SEQ ID NO: 79728 - DNA, 25 bp, E. coli
ttgatgatgtcaccgagaagatgga

SEQ ID NO: 79729 - DNA, 25 bp, E. coli
tgttgaagaattttcccgcctgctg

SEQ ID NO: 79730 - DNA, 25 bp, E. coli
tgttgaagaattatcccgcctgctg

SEQ ID NO: 79731 - DNA, 25 bp, E. coli
gctctgagtgtgttaaaccttttta

SEQ ID NO: 79732 - DNA, 25 bp, E. coli
gctgaagaacgtagctctgagtgtg

SEQ ID NO: 79733 - DNA, 25 bp, E. coli
gctctgagtgtgataaaccttttta

SEQ ID NO: 79734 - DNA, 25 bp, E. coli
gctgaagaacgttgctctgagtgtg

SEQ ID NO: 79735 - DNA, 25 bp, E. coli
gaattatcccgcctgctgaagaacg

SEQ ID NO: 79736 - DNA, 25 bp, E. coli
gaagatggaataaatccccgactgg

SEQ ID NO: 79737 - DNA, 25 bp, E. coli
gaagatggaatatatccccgactgg

SEQ ID NO: 79738 - DNA, 25 bp, E. coli
gaattatcccgcgtgctgaagaacg

SEQ ID NO: 79739 - DNA, 25 bp, E. coli
gatggaatatatccccgactgggtc

SEQ ID NO: 79740 - DNA, 25 bp, E. coli
gatggaatatatgcccgactgggtc

SEQ ID NO: 79741 - DNA, 25 bp, E. coli
catgctcggtgacgttgcgccgtta

SEQ ID NO: 79742 - DNA, 25 bp, E. coli
catgctcggtgaggttgcgccgtta

SEQ ID NO: 79743 - DNA, 25 bp, E. coli
tacgataaatatgcgcgccttgctg

SEQ ID NO: 79744 - DNA, 25 bp, E. coli
tacgataaatatccgcgccttgctg

SEQ ID NO: 79745 - DNA, 25 bp, E. coli
tatcatcgttgagggtatctacagc

SEQ ID NO: 79746 - DNA, 25 bp, E. coli
tatcatcgttgacggtatctacagc

SEQ ID NO: 79747 - DNA, 25 bp, E. coli
tgtatgacggtcagcaaaaactggg

SEQ ID NO: 79748 - DNA, 25 bp, E. coli
tgtatgacggtctgcaaaaactggg

SEQ ID NO: 79749 - DNA, 25 bp, E. coli
gctaaagatctgcaacggcgcatgg

SEQ ID NO: 79750 - DNA, 25 bp, E. coli
gctaaagatctggaacggcgcatgg

SEQ ID NO: 79751 - DNA, 25 bp, E. coli
gacagccacgccagtatttatgacg

SEQ ID NO: 79752 - DNA, 25 bp, E. coli
gacagccacgcctgtatttatgacg

SEQ ID NO: 79753 - DNA, 25 bp, E. coli
ccgcacctggcgttagagaaagaga

SEQ ID NO: 79754 - DNA, 25 bp, E. coli
ccgcacctggcgatagagaaagaga

SEQ ID NO: 79755 - DNA, 25 bp, E. coli
tggcgagcgcctccaatttagtgac

SEQ ID NO: 79756 - DNA, 25 bp, E. coli
tggcgagcgcctgcaatttagtgac

SEQ ID NO: 79757 - DNA, 25 bp, E. coli
taacgccgtggtcttactggatgcc

SEQ ID NO: 79758 - DNA, 25 bp, E. coli
taacgccgtggtgttactggatgcc

SEQ ID NO: 79759 - DNA, 25 bp, E. coli
tcacagtcgtgagcaaatcgatgcc

SEQ ID NO: 79760 - DNA, 25 bp, E. coli
tcacagtcgtgaccaaatcgatgcc

SEQ ID NO: 79761 - DNA, 25 bp, E. coli
gatgaagtgtataccgccaccgaag

SEQ ID NO: 79762 - DNA, 25 bp, E. coli
gatgaagtgtattccgccaccgaag

SEQ ID NO: 79763 - DNA, 25 bp, E. coli
tacgccgccgcgaacttcagcgaag

SEQ ID NO: 79764 - DNA, 25 bp, E. coli
aggatccgcgcaccagtacaccggg

SEQ ID NO: 79765 - DNA, 25 bp, E. coli
accggactgtttgccaaaagcggtg

SEQ ID NO: 79766 - DNA, 25 bp, E. coli
accggactgtttcccaaaagcggtg

SEQ ID NO: 79767 - DNA, 25 bp, E. coli
aggatccgcgcagcagtacaccggg

SEQ ID NO: 79768 - DNA, 25 bp, E. coli
tacgccgccgcgtacttcagcgaag

SEQ ID NO: 79769 - DNA, 25 bp, E. coli
tagacgccgccactaaaaccggact

SEQ ID NO: 79770 - DNA, 25 bp, E. coli
tagacgccgccagtaaaaccggact

SEQ ID NO: 79771 - DNA, 25 bp, E. coli
tgattatggctagttcgccttcgtt

SEQ ID NO: 79772 - DNA, 25 bp, E. coli
tgattatggctacttcgccttcgtt

SEQ ID NO: 79773 - DNA, 25 bp, E. coli
tgcctgccggttttgaaaaattgac

SEQ ID NO: 79774 - DNA, 25 bp, E. coli
tgcctgccggttatgaaaaattgac

SEQ ID NO: 79775 - DNA, 25 bp, E. coli
gccgccagtaaaaccggactgtttg

SEQ ID NO: 79776 - DNA, 25 bp, E. coli
gccgccagtaaatccggactgtttg

SEQ ID NO: 79777 - DNA, 25 bp, E. coli
ccgcgaacttcagcgaaggtcacta

SEQ ID NO: 79778 - DNA, 25 bp, E. coli
cgctgcctgccgcttttgaaaaatt

SEQ ID NO: 79779 - DNA, 25 bp, E. coli
cgctgcctgccggttttgaaaaatt

SEQ ID NO: 79780 - DNA, 25 bp, E. coli
ccgcgaacttcaccgaaggtcacta

SEQ ID NO: 79781 - DNA, 25 bp, E. coli
ggtggcaaacgtcacgctgcctgcc

SEQ ID NO: 79782 - DNA, 25 bp, E. coli
ggtggcaaacgtgacgctgcctgcc

SEQ ID NO: 79783 - DNA, 25 bp, E. coli
tggctacttcgccttcgtttatgac

SEQ ID NO: 79784 - DNA, 25 bp, E. coli
tggctacttcgcgttcgtttatgac

SEQ ID NO: 79785 - DNA, 25 bp, E. coli
caatgcaggccgtctccggtattcg

SEQ ID NO: 79786 - DNA, 25 bp, E. coli
caatgcaggccgactccggtattcg

SEQ ID NO: 79787 - DNA, 25 bp, E. coli
tacattcgtaactacaccggtctgg

SEQ ID NO: 79788 - DNA, 25 bp, E. coli
tacattcgtaacaacaccggtctgg

SEQ ID NO: 79789 - DNA, 25 bp, E. coli
atactgggatccgtatgcacgcggg

SEQ ID NO: 79790 - DNA, 25 bp, E. coli
atactgggatccctatgcacgcggg

SEQ ID NO: 79791 - DNA, 25 bp, E. coli
tttaacatccattgtctggactggg

SEQ ID NO: 79792 - DNA, 25 bp, E. coli
tttaacatccatagtctggactggg

SEQ ID NO: 79793 - DNA, 25 bp, E. coli
tcttgctggtctggcggttggcttc

SEQ ID NO: 79794 - DNA, 25 bp, E. coli
tcttgctggtctcgcggttggcttc

SEQ ID NO: 79795 - DNA, 25 bp, E. coli
gcttcgctgtaaaatgactacggga

SEQ ID NO: 79796 - DNA, 25 bp, E. coli
gcttcgctgtaatatgactacggga

SEQ ID NO: 79797 - DNA, 25 bp, E. coli
gcggtgcggtggcaaacaatttcct

SEQ ID NO: 79798 - DNA, 25 bp, E. coli
gcggtgcggtgggaaacaatttcct

SEQ ID NO: 79799 - DNA, 25 bp, E. coli
gcagaaatctgccaacatctcaaac

SEQ ID NO: 79800 - DNA, 25 bp, E. coli
gcagaaatctgcgaacatctcaaac

SEQ ID NO: 79801 - DNA, 25 bp, E. coli
gactccggtattcgtctgcacgcgc

SEQ ID NO: 79802 - DNA, 25 bp, E. coli
gaacatctcaaacgcgatggcatgg

SEQ ID NO: 79803 - DNA, 25 bp, E. coli
gaacatctcaaaggcgatggcatgg

SEQ ID NO: 79804 - DNA, 25 bp, E. coli
gactccggtattggtctgcacgcgc

SEQ ID NO: 79805 - DNA, 25 bp, E. coli
cgcgatggcatggaagagtacattc

SEQ ID NO: 79806 - DNA, 25 bp, E. coli
cgcgatggcatgcaagagtacattc

SEQ ID NO: 79807 - DNA, 25 bp, E. coli
cagtgcaatcggtcgtctgccgaaa

SEQ ID NO: 79808 - DNA, 25 bp, E. coli
cagtgcaatcggacgtctgccgaaa

SEQ ID NO: 79809 - DNA, 25 bp, E. coli
taaaattactcaaacccgcagtgca

SEQ ID NO: 79810 - DNA, 25 bp, E. coli
taaaattactcatacccgcagtgca

SEQ ID NO: 79811 - DNA, 25 bp, E. coli
tgatcaacgcggattccttcatggt

SEQ ID NO: 79812 - DNA, 25 bp, E. coli
tgatcaacgcggtttccttcatggt

SEQ ID NO: 79813 - DNA, 25 bp, E. coli
tgctattcgcggtatgatcaacgcg

SEQ ID NO: 79814 - DNA, 25 bp, E. coli
tgctattcgcggaatgatcaacgcg

SEQ ID NO: 79815 - DNA, 25 bp, E. coli
tctgccgaaacacaaggcaacgctg

SEQ ID NO: 79816 - DNA, 25 bp, E. coli
tctgccgaaacagaaggcaacgctg

SEQ ID NO: 79817 - DNA, 25 bp, E. coli
ccttcatggttaaagttgaggagta

SEQ ID NO: 79818 - DNA, 25 bp, E. coli
ccttcatggttatagttgaggagta

SEQ ID NO: 79819 - DNA, 25 bp, E. coli
cctgggtctgcgtcgtattggtcac

SEQ ID NO: 79820 - DNA, 25 bp, E. coli
cctgggtctgcgacgtattggtcac

SEQ ID NO: 79821 - DNA, 25 bp, E. coli
gcaacgctgcttggcctgggtctgc

SEQ ID NO: 79822 - DNA, 25 bp, E. coli
gcaacgctgcttcgcctgggtctgc

SEQ ID NO: 79823 - DNA, 25 bp, E. coli
cgtattggtcactccgtagagcgcg

SEQ ID NO: 79824 - DNA, 25 bp, E. coli
cgtattggtcacaccgtagagcgcg

SEQ ID NO: 79825 - DNA, 25 bp, E. coli
tcacaccgtagagcgcgaggatact

SEQ ID NO: 79826 - DNA, 25 bp, E. coli
tcacaccgtagaccgcgaggatact

SEQ ID NO: 79827 - DNA, 25 bp, E. coli
gaggatactcctcctattcgcggta

SEQ ID NO: 79828 - DNA, 25 bp, E. coli
gaggatactcctgctattcgcggta

SEQ ID NO: 79829 - DNA, 25 bp, E. coli
caaaagatatctacgtggtgccgac

SEQ ID NO: 79830 - DNA, 25 bp, E. coli
caaaagatatcttcgtggtgccgac

SEQ ID NO: 79831 - DNA, 25 bp, E. coli
tagcgggcaggtcatcatcggcaat

SEQ ID NO: 79832 - DNA, 25 bp, E. coli
taactatcgttaagaccgcagccgc

SEQ ID NO: 79833 - DNA, 25 bp, E. coli
aaagggtttgcctcacgcgttgcgc

SEQ ID NO: 79834 - DNA, 25 bp, E. coli
aaagggtttgccacacgcgttgcgc

SEQ ID NO: 79835 - DNA, 25 bp, E. coli
tagcgggcaggtgatcatcggcaat

SEQ ID NO: 79836 - DNA, 25 bp, E. coli
tgggatggctacaaaatgcgctacg

SEQ ID NO: 79837 - DNA, 25 bp, E. coli
tgggatggctactaaatgcgctacg

SEQ ID NO: 79838 - DNA, 25 bp, E. coli
tgcaactgatcatgccgggcgaagt

SEQ ID NO: 79839 - DNA, 25 bp, E. coli
tgcaactgatcaagccgggcgaagt

SEQ ID NO: 79840 - DNA, 25 bp, E. coli
gaagtgctgcaccatttaacccgac

SEQ ID NO: 79841 - DNA, 25 bp, E. coli
gaagtgctgcacgatttaacccgac

SEQ ID NO: 79842 - DNA, 25 bp, E. coli
gattttatcctgtccccgcagtggc

SEQ ID NO: 79843 - DNA, 25 bp, E. coli
gataacaatcaaaatagccgcgagc

SEQ ID NO: 79844 - DNA, 25 bp, E. coli
gataacaatcaatatagccgcgagc

SEQ ID NO: 79845 - DNA, 25 bp, E. coli
gattttatcctgaccccgcagtggc

SEQ ID NO: 79846 - DNA, 25 bp, E. coli
ggaattatcaggagatccgcccgct

SEQ ID NO: 79847 - DNA, 25 bp, E. coli
ggaattatcaggtgatccgcccgct

SEQ ID NO: 79848 - DNA, 25 bp, E. coli
taactatcgttatgaccgcagccgc

SEQ ID NO: 79849 - DNA, 25 bp, E. coli
gagtcatcgtcaaaatcagtcggcg

SEQ ID NO: 79850 - DNA, 25 bp, E. coli
gagtcatcgtcataatcagtcggcg

SEQ ID NO: 79851 - DNA, 25 bp, E. coli
caccggaagatgagagcaaggcacg

SEQ ID NO: 79852 - DNA, 25 bp, E. coli
caccggaagatgtgagcaaggcacg

SEQ ID NO: 79853 - DNA, 25 bp, E. coli
catctgagcgtgtcgagtactccag

SEQ ID NO: 79854 - DNA, 25 bp, E. coli
catctgagcgtgacgagtactccag

SEQ ID NO: 79855 - DNA, 25 bp, E. coli
tactccagtgaacaaacagaacatc

SEQ ID NO: 79856 - DNA, 25 bp, E. coli
tactccagtgaagaaacagaacatc

SEQ ID NO: 79857 - DNA, 25 bp, E. coli
taaaagccgtcttgaggccatcaga

SEQ ID NO: 79858 - DNA, 25 bp, E. coli
taaaagccgtctagaggccatcaga

SEQ ID NO: 79859 - DNA, 25 bp, E. coli
aaagtctggcggttatcacatcggg

SEQ ID NO: 79860 - DNA, 25 bp, E. coli
aaaatggctggcattctggctgggt

SEQ ID NO: 79861 - DNA, 25 bp, E. coli
aaaatggctggctttctggctgggt

SEQ ID NO: 79862 - DNA, 25 bp, E. coli
aaagtctggcggatatcacatcggg

SEQ ID NO: 79863 - DNA, 25 bp, E. coli
tatcacgtagaatccagtgcgctgg

SEQ ID NO: 79864 - DNA, 25 bp, E. coli
tatcacgtagaaaccagtgcgctgg

SEQ ID NO: 79865 - DNA, 25 bp, E. coli
gccagcatggaggaatcagccgata

SEQ ID NO: 79866 - DNA, 25 bp, E. coli
gccgtatcttaatgcggatcgcgga

SEQ ID NO: 79867 - DNA, 25 bp, E. coli
gccagcatggagcaatcagccgata

SEQ ID NO: 79868 - DNA, 25 bp, E. coli
gccgtatcttaaagcggatcgcgga

SEQ ID NO: 79869 - DNA, 25 bp, E. coli
gcagatttacgggtattcaccggaa

SEQ ID NO: 79870 - DNA, 25 bp, E. coli
gcagatttacggctattcaccggaa

SEQ ID NO: 79871 - DNA, 25 bp, E. coli
gaaaaaattatgattgccaggctgc

SEQ ID NO: 79872 - DNA, 25 bp, E. coli
gaaaaaattatgtttgccaggctgc

SEQ ID NO: 79873 - DNA, 25 bp, E. coli
aatcagcatgttactggcgcagcgc

SEQ ID NO: 79874 - DNA, 25 bp, E. coli
aatcagcatgtttctggcgcagcgc

SEQ ID NO: 79875 - DNA, 25 bp, E. coli
catgactatgcccagctgcaggaca

SEQ ID NO: 79876 - DNA, 25 bp, E. coli
catgactatgccgagctgcaggaca

SEQ ID NO: 79877 - DNA, 25 bp, E. coli
aactgttaatagaacaaccgcgccg

SEQ ID NO: 79878 - DNA, 25 bp, E. coli
aactgttaatagtacaaccgcgccg

SEQ ID NO: 79879 - DNA, 25 bp, E. coli
tgaaaaccaaatgtccggcgctatg

SEQ ID NO: 79880 - DNA, 25 bp, E. coli
tgaaaaccaaatctccggcgctatg

SEQ ID NO: 79881 - DNA, 25 bp, E. coli
tgcaacaacactggcaaaccgagcg

SEQ ID NO: 79882 - DNA, 25 bp, E. coli
tgcaacaacactcgcaaaccgagcg

SEQ ID NO: 79883 - DNA, 25 bp, E. coli
tgagattgattccagagcgccctac

SEQ ID NO: 79884 - DNA, 25 bp, E. coli
tgagattgattcgagagcgccctac

SEQ ID NO: 79885 - DNA, 25 bp, E. coli
tcgaagattggctataacggcacaa

SEQ ID NO: 79886 - DNA, 25 bp, E. coli
tcgaagattggcaataacggcacaa

SEQ ID NO: 79887 - DNA, 25 bp, E. coli
tctacgcaaggtacagcgactggcg

SEQ ID NO: 79888 - DNA, 25 bp, E. coli
tctacgcaaggttcagcgactggcg

SEQ ID NO: 79889 - DNA, 25 bp, E. coli
gattatgtactggttctcgctgcga

SEQ ID NO: 79890 - DNA, 25 bp, E. coli
gattatgtactgcttctcgctgcga

SEQ ID NO: 79891 - DNA, 25 bp, E. coli
ggttgccatcgtttctgaccgccga

SEQ ID NO: 79892 - DNA, 25 bp, E. coli
ggttgccatcgtatctgaccgccga

SEQ ID NO: 79893 - DNA, 25 bp, E. coli
gacctggtgaaaacgctgcaacaac

SEQ ID NO: 79894 - DNA, 25 bp, E. coli
gacctggtgaaatcgctgcaacaac

SEQ ID NO: 79895 - DNA, 25 bp, E. coli
aatttcctaattgcagtatctgatg

SEQ ID NO: 79896 - DNA, 25 bp, E. coli
aatttcctaattccagtatctgatg

SEQ ID NO: 79897 - DNA, 25 bp, E. coli
aatctatgccaataacgcgtctaag

SEQ ID NO: 79898 - DNA, 25 bp, E. coli
aatctatgccaaaaacgcgtctaag

SEQ ID NO: 79899 - DNA, 25 bp, E. coli
catgacatatactgaaaaccaggtt

SEQ ID NO: 79900 - DNA, 25 bp, E. coli
catgacatatacagaaaaccaggtt

SEQ ID NO: 79901 - DNA, 25 bp, E. coli
tatctgatgcatctgtaactcattg

SEQ ID NO: 79902 - DNA, 25 bp, E. coli
tatctgatgcatgtgtaactcattg

SEQ ID NO: 79903 - DNA, 25 bp, E. coli
tgtcgaaattgaatcgtgacggctc

SEQ ID NO: 79904 - DNA, 25 bp, E. coli
tgtcgaaattgattcgtgacggctc

SEQ ID NO: 79905 - DNA, 25 bp, E. coli
ccaggttataacctcagtgtcgaaa

SEQ ID NO: 79906 - DNA, 25 bp, E. coli
ccaggttataacgtcagtgtcgaaa

SEQ ID NO: 79907 - DNA, 25 bp, E. coli
gaaaatcccctgctatcaatctatg

SEQ ID NO: 79908 - DNA, 25 bp, E. coli
gacggctctttcactttatagttga

SEQ ID NO: 79909 - DNA, 25 bp, E. coli
gaaaatcccctggtatcaatctatg

SEQ ID NO: 79910 - DNA, 25 bp, E. coli
gacggctctttctctttatagttga

SEQ ID NO: 79911 - DNA, 25 bp, E. coli
cgcgtctaagaatgcagtcgattta

SEQ ID NO: 79912 - DNA, 25 bp, E. coli
cgcgtctaagaaagcagtcgattta

SEQ ID NO: 79913 - DNA, 25 bp, E. coli
gatattttccatgaacatgacatat

SEQ ID NO: 79914 - DNA, 25 bp, E. coli
gatattttccatcaacatgacatat

SEQ ID NO: 79915 - DNA, 25 bp, E. coli
tcactttatagtagaggatattacg

SEQ ID NO: 79916 - DNA, 25 bp, E. coli
tcactttatagttgaggatattacg

SEQ ID NO: 79917 - DNA, 25 bp, E. coli
aatccccggtttttctgacaagcag

SEQ ID NO: 79918 - DNA, 25 bp, E. coli
aatccccggtttatctgacaagcag

SEQ ID NO: 79919 - DNA, 25 bp, E. coli
caagatatcgttgttggtgacctgg

SEQ ID NO: 79920 - DNA, 25 bp, E. coli
caagatatcgttcttggtgacctgg

SEQ ID NO: 79921 - DNA, 25 bp, E. coli
tactggattacagtgcaggcacgcc

SEQ ID NO: 79922 - DNA, 25 bp, E. coli
tactggattacactgcaggcacgcc

SEQ ID NO: 79923 - DNA, 25 bp, E. coli
tatgtcgcctgaagtcagttccggg

SEQ ID NO: 79924 - DNA, 25 bp, E. coli
tatgtcgcctgatgtcagttccggg

SEQ ID NO: 79925 - DNA, 25 bp, E. coli
tgacgctcccattaacgcctggatg

SEQ ID NO: 79926 - DNA, 25 bp, E. coli
tgacgctcccataaacgcctggatg

SEQ ID NO: 79927 - DNA, 25 bp, E. coli
tccgcaatttacagtccgatgaagg

SEQ ID NO: 79928 - DNA, 25 bp, E. coli
tccgcaatttactgtccgatgaagg

SEQ ID NO: 79929 - DNA, 25 bp, E. coli
gccttatgagagtacgtgccgcagt

SEQ ID NO: 79930 - DNA, 25 bp, E. coli
gccttatgagagaacgtgccgcagt

SEQ ID NO: 79931 - DNA, 25 bp, E. coli
gcattgttagcagccattggtgacg

SEQ ID NO: 79932 - DNA, 25 bp, E. coli
gcattgttagcacccattggtgacg

SEQ ID NO: 79933 - DNA, 25 bp, E. coli
ggtagtgcaagttcgatatctccgc

SEQ ID NO: 79934 - DNA, 25 bp, E. coli
ggtagtgcaagtacgatatctccgc

SEQ ID NO: 79935 - DNA, 25 bp, E. coli
ggaaaagctcgattagacggcagaa

SEQ ID NO: 79936 - DNA, 25 bp, E. coli
ggaaaagctcgaatagacggcagaa

SEQ ID NO: 79937 - DNA, 25 bp, E. coli
gaggttatctccactttactggccg

SEQ ID NO: 79938 - DNA, 25 bp, E. coli
gaggttatctcctctttactggccg

SEQ ID NO: 79939 - DNA, 25 bp, E. coli
cagcatcctgcaacccgtctttttc

SEQ ID NO: 79940 - DNA, 25 bp, E. coli
cagcatcctgcatcccgtctttttc

SEQ ID NO: 79941 - DNA, 25 bp, E. coli
aacagcatcctgcatcccgtctttt

SEQ ID NO: 79942 - DNA, 25 bp, E. coli
acagcatcctgcatcccgtcttttt

SEQ ID NO: 79943 - DNA, 25 bp, E. coli
acagcatcctgcttcccgtcttttt

SEQ ID NO: 79944 - DNA, 25 bp, E. coli
aacagcatcctggatcccgtctttt

SEQ ID NO: 79945 - DNA, 25 bp, E. coli
tattcaccaacagcatcctgcatcc

SEQ ID NO: 79946 - DNA, 25 bp, E. coli
tattcaccaacaccatcctgcatcc

SEQ ID NO: 79947 - DNA, 25 bp, E. coli
ttcaccaacagcatcctgcatcccg

SEQ ID NO: 79948 - DNA, 25 bp, E. coli
ttcaccaacagcttcctgcatcccg

SEQ ID NO: 79949 - DNA, 25 bp, E. coli
tcccggtgtgttggccgtgtttgct

SEQ ID NO: 79950 - DNA, 25 bp, E. coli
tcccggtgtgttcgccgtgtttgct

SEQ ID NO: 79951 - DNA, 25 bp, E. coli
ttggccgtgtttgctgaacgtcgta

SEQ ID NO: 79952 - DNA, 25 bp, E. coli
ttggccgtgtttcctgaacgtcgta

SEQ ID NO: 79953 - DNA, 25 bp, E. coli
tcaccaacagcatcctgcatcccgt

SEQ ID NO: 79954 - DNA, 25 bp, E. coli
gcgtattcaccatcagcatcctgca

SEQ ID NO: 79955 - DNA, 25 bp, E. coli
gcgtattcaccaacagcatcctgca

SEQ ID NO: 79956 - DNA, 25 bp, E. coli
cgtattcaccaacagcatcctgcat

SEQ ID NO: 79957 - DNA, 25 bp, E. coli
cgtattcaccaagagcatcctgcat

SEQ ID NO: 79958 - DNA, 25 bp, E. coli
gtattcaccaactgcatcctgcatc

SEQ ID NO: 79959 - DNA, 25 bp, E. coli
gtattcaccaacagcatcctgcatc

SEQ ID NO: 79960 - DNA, 25 bp, E. coli
tcaccaacagcaacctgcatcccgt

SEQ ID NO: 79961 - DNA, 25 bp, E. coli
agttatgtcaataatgccgaggcaa

SEQ ID NO: 79962 - DNA, 25 bp, E. coli
agttatgtcaattatgccgaggcaa

SEQ ID NO: 79963 - DNA, 25 bp, E. coli
tatgtcaattatgccgaggcaaaat

SEQ ID NO: 79964 - DNA, 25 bp, E. coli
tatgtcaattatcccgaggcaaaat

SEQ ID NO: 79965 - DNA, 25 bp, E. coli
tgtacagcattattgagccgtattg

SEQ ID NO: 79966 - DNA, 25 bp, E. coli
tgtacagcattaatgagccgtattg

SEQ ID NO: 79967 - DNA, 25 bp, E. coli
tgagttatgtcaattatgccgaggc

SEQ ID NO: 79968 - DNA, 25 bp, E. coli
tgagttatgtcatttatgccgaggc

SEQ ID NO: 79969 - DNA, 25 bp, E. coli
ccattgtacagctttaatgagccgt

SEQ ID NO: 79970 - DNA, 25 bp, E. coli
gccattgtacaggattaatgagccg

SEQ ID NO: 79971 - DNA, 25 bp, E. coli
gccattgtacagcattaatgagccg

SEQ ID NO: 79972 - DNA, 25 bp, E. coli
ccattgtacagcattaatgagccgt

SEQ ID NO: 79973 - DNA, 25 bp, E. coli
gcattgagttatctcaattatgccg

SEQ ID NO: 79974 - DNA, 25 bp, E. coli
gcattgagttatgtcaattatgccg

SEQ ID NO: 79975 - DNA, 25 bp, E. coli
cattgtacagcattaatgagccgta

SEQ ID NO: 79976 - DNA, 25 bp, E. coli
cattgtacagcaataatgagccgta

SEQ ID NO: 79977 - DNA, 25 bp, E. coli
gttatgtcaattttgccgaggcaaa

SEQ ID NO: 79978 - DNA, 25 bp, E. coli
gttatgtcaattatgccgaggcaaa

SEQ ID NO: 79979 - DNA, 25 bp, E. coli
gggccattgtactgcattaatgagc

SEQ ID NO: 79980 - DNA, 25 bp, E. coli
gggccattgtacagcattaatgagc

SEQ ID NO: 79981 - DNA, 25 bp, E. coli
gagttatgtcaaatatgccgaggca

SEQ ID NO: 79982 - DNA, 25 bp, E. coli
gagttatgtcaattatgccgaggca

SEQ ID NO: 79983 - DNA, 25 bp, E. coli
atacctgcccgcaagcgtggcctgg

SEQ ID NO: 79984 - DNA, 25 bp, E. coli
atacctgcccgctagcgtggcctgg

SEQ ID NO: 79985 - DNA, 25 bp, E. coli
agaaattcctcgacgtggcgatgcg

SEQ ID NO: 79986 - DNA, 25 bp, E. coli
agaaattcctcgtcgtggcgatgcg

SEQ ID NO: 79987 - DNA, 25 bp, E. coli
ttgagtcatacctgcccgcaagcgt

SEQ ID NO: 79988 - DNA, 25 bp, E. coli
ttgagtcataccagcccgcaagcgt

SEQ ID NO: 79989 - DNA, 25 bp, E. coli
ttcctcgacaagaaattcctcgacg

SEQ ID NO: 79990 - DNA, 25 bp, E. coli
ttcctcgacaagtaattcctcgacg

SEQ ID NO: 79991 - DNA, 25 bp, E. coli
gcgtgaatgttttgagtcatacctg

SEQ ID NO: 79992 - DNA, 25 bp, E. coli
gcgactggttcgactttgatgcagt

SEQ ID NO: 79993 - DNA, 25 bp, E. coli
gcgactggttcgtctttgatgcagt

SEQ ID NO: 79994 - DNA, 25 bp, E. coli
gcgtgaatgtttagagtcatacctg

SEQ ID NO: 79995 - DNA, 25 bp, E. coli
gaatgttttgagtcatacctgcccg

SEQ ID NO: 79996 - DNA, 25 bp, E. coli
gaatgttttgagacatacctgcccg

SEQ ID NO: 79997 - DNA, 25 bp, E. coli
gacaagaaattcctcgacgtggcga

SEQ ID NO: 79998 - DNA, 25 bp, E. coli
gacaagaaattcgtcgacgtggcga

SEQ ID NO: 79999 - DNA, 25 bp, E. coli
cgactttgatgctgtgaaagataac

SEQ ID NO: 80000 - DNA, 25 bp, E. coli
cgactttgatgcagtgaaagataac

SEQ ID NO: 80001 - DNA, 25 bp, E. coli
ctggttcgacttagatgcagtgaaa

SEQ ID NO: 80002 - DNA, 25 bp, E. coli
ctggttcgactttgatgcagtgaaa

SEQ ID NO: 80003 - DNA, 25 bp, E. coli
gttttgagtcatacctgcccgcaag

SEQ ID NO: 80004 - DNA, 25 bp, E. coli
gttttgagtcattcctgcccgcaag

SEQ ID NO: 80005 - DNA, 25 bp, E. coli
aatgacgcgtgatgtggacggccaa

SEQ ID NO: 80006 - DNA, 25 bp, E. coli
aatgacgcgtgaagtggacggccaa

SEQ ID NO: 80007 - DNA, 25 bp, E. coli
cagtcagtgatctacagcctgttga

SEQ ID NO: 80008 - DNA, 25 bp, E. coli
cagtcagtgatcaacagcctgttga

SEQ ID NO: 80009 - DNA, 25 bp, E. coli
tacgacatatggtaatagctacctg

SEQ ID NO: 80010 - DNA, 25 bp, E. coli
tacgacatatggaaatagctacctg

SEQ ID NO: 80011 - DNA, 25 bp, E. coli
tacctgtgtggtttcgctggataac

SEQ ID NO: 80012 - DNA, 25 bp, E. coli
tacctgtgtggtatcgctggataac

SEQ ID NO: 80013 - DNA, 25 bp, E. coli
tatttactctggacgaatgacgcgt

SEQ ID NO: 80014 - DNA, 25 bp, E. coli
tatttactctggtcgaatgacgcgt

SEQ ID NO: 80015 - DNA, 25 bp, E. coli
tgcctgataaaatacacgaatctag

SEQ ID NO: 80016 - DNA, 25 bp, E. coli
tgcctgataaaaaacacgaatctag

SEQ ID NO: 80017 - DNA, 25 bp, E. coli
ttgaataaaacgctggatgtctccc

SEQ ID NO: 80018 - DNA, 25 bp, E. coli
ttgaataaaacggtggatgtctccc

SEQ ID NO: 80019 - DNA, 25 bp, E. coli
cctgtaactagtccattacgacata

SEQ ID NO: 80020 - DNA, 25 bp, E. coli
gacggccaacagacgcagtcagtga

SEQ ID NO: 80021 - DNA, 25 bp, E. coli
gacggccaacagtcgcagtcagtga

SEQ ID NO: 80022 - DNA, 25 bp, E. coli
cctgtaactagtgcattacgacata

SEQ ID NO: 80023 - DNA, 25 bp, E. coli
gatttattcgcaagtaaaatgcctg

SEQ ID NO: 80024 - DNA, 25 bp, E. coli
gatttattcgcatgtaaaatgcctg

SEQ ID NO: 80025 - DNA, 25 bp, E. coli
ggaacctgcatgtttttcctgtaac

SEQ ID NO: 80026 - DNA, 25 bp, E. coli
ggaacctgcatgattttcctgtaac

SEQ ID NO: 80027 - DNA, 25 bp, E. coli
aatttcttgaccttccccttgctgg

SEQ ID NO: 80028 - DNA, 25 bp, E. coli
aatttcttgaccatccccttgctgg

SEQ ID NO: 80029 - DNA, 25 bp, E. coli
cagtcaaaactgtcttaaaggagtg

SEQ ID NO: 80030 - DNA, 25 bp, E. coli
cagtcaaaactgacttaaaggagtg

SEQ ID NO: 80031 - DNA, 25 bp, E. coli
tagcacccgcaagttaactacagga

SEQ ID NO: 80032 - DNA, 25 bp, E. coli
tagatgcgggaggtaattcctcacc

SEQ ID NO: 80033 - DNA, 25 bp, E. coli
tagatgcgggagctaattcctcacc

SEQ ID NO: 80034 - DNA, 25 bp, E. coli
tagcacccgcaacttaactacagga

SEQ ID NO: 80035 - DNA, 25 bp, E. coli
gcatcctgattttacttagcacccg

SEQ ID NO: 80036 - DNA, 25 bp, E. coli
gcatcctgatttaacttagcacccg

SEQ ID NO: 80037 - DNA, 25 bp, E. coli
cggtgccgatttacaggcatcctga

SEQ ID NO: 80038 - DNA, 25 bp, E. coli
cggtgccgattttcaggcatcctga

SEQ ID NO: 80039 - DNA, 25 bp, E. coli
ggtaattcctcagcccggtgccgat

SEQ ID NO: 80040 - DNA, 25 bp, E. coli
gttaactcctttttatagatgcggg

SEQ ID NO: 80041 - DNA, 25 bp, E. coli
ggtaattcctcaccccggtgccgat

SEQ ID NO: 80042 - DNA, 25 bp, E. coli
gttaactcctttatatagatgcggg

SEQ ID NO: 80043 - DNA, 25 bp, E. coli
ggtttaacctttttcacagccagtc

SEQ ID NO: 80044 - DNA, 25 bp, E. coli
ggtttaacctttatcacagccagtc

SEQ ID NO: 80045 - DNA, 25 bp, E. coli
taatcctgatgcaaatcgagccgat

SEQ ID NO: 80046 - DNA, 25 bp, E. coli
taatcctgatgctaatcgagccgat

SEQ ID NO: 80047 - DNA, 25 bp, E. coli
gagataaatgtcaaatcctgatgca

SEQ ID NO: 80048 - DNA, 25 bp, E. coli
gagataaatgtctaatcctgatgca

SEQ ID NO: 80049 - DNA, 25 bp, E. coli
caatcatggttttcgcagttattgc

SEQ ID NO: 80050 - DNA, 25 bp, E. coli
caattggctggcagtttgccagtta

SEQ ID NO: 80051 - DNA, 25 bp, E. coli
caatcatggtttacgcagttattgc

SEQ ID NO: 80052 - DNA, 25 bp, E. coli
caattggctggctgtttgccagtta

SEQ ID NO: 80053 - DNA, 25 bp, E. coli
ttctcaatcatgctttacgcagtta

SEQ ID NO: 80054 - DNA, 25 bp, E. coli
ttctcaatcatggtttacgcagtta

SEQ ID NO: 80055 - DNA, 25 bp, E. coli
tggtgggtgtgggaattggctggct

SEQ ID NO: 80056 - DNA, 25 bp, E. coli
tgccagttatcaacatgcgcagcaa

SEQ ID NO: 80057 - DNA, 25 bp, E. coli
tgccagttatcatcatgcgcagcaa

SEQ ID NO: 80058 - DNA, 25 bp, E. coli
ccagttatcaacatgcgcagcaaaa

SEQ ID NO: 80059 - DNA, 25 bp, E. coli
ccagttatcaacttgcgcagcaaaa

SEQ ID NO: 80060 - DNA, 25 bp, E. coli
gcgcagcaaaaagccgagcaattag

SEQ ID NO: 80061 - DNA, 25 bp, E. coli
gcgcagcaaaaacccgagcaattag

SEQ ID NO: 80062 - DNA, 25 bp, E. coli
gctgtttgccagttatcaacatgcg

SEQ ID NO: 80063 - DNA, 25 bp, E. coli
gctgtttgccagatatcaacatgcg

SEQ ID NO: 80064 - DNA, 25 bp, E. coli
gtttgccagttatcaacatgcgcag

SEQ ID NO: 80065 - DNA, 25 bp, E. coli
gatttctcaatcatggtttacgcag

SEQ ID NO: 80066 - DNA, 25 bp, E. coli
gtttgccagttaacaacatgcgcag

SEQ ID NO: 80067 - DNA, 25 bp, E. coli
gatttctcaatcttggtttacgcag

SEQ ID NO: 80068 - DNA, 25 bp, E. coli
ggctggctgtttgccagttatcaac

SEQ ID NO: 80069 - DNA, 25 bp, E. coli
tggtgggtgtggcaattggctggct

SEQ ID NO: 80070 - DNA, 25 bp, E. coli
ggctggctgtttcccagttatcaac

SEQ ID NO: 80071 - DNA, 25 bp, E. coli
caaaattgccatttacttgcattgg

SEQ ID NO: 80072 - DNA, 25 bp, E. coli
caaaattgccatatacttgcattgg

SEQ ID NO: 80073 - DNA, 25 bp, E. coli
cagaaaaaaggtgtcgaggtgccac

SEQ ID NO: 80074 - DNA, 25 bp, E. coli
cagaaaaaaggtctcgaggtgccac

SEQ ID NO: 80075 - DNA, 25 bp, E. coli
tacgtgagttttacgccgatgtcat

SEQ ID NO: 80076 - DNA, 25 bp, E. coli
taaagattccggattaatgctgcat

SEQ ID NO: 80077 - DNA, 25 bp, E. coli
taaagattccggtttaatgctgcat

SEQ ID NO: 80078 - DNA, 25 bp, E. coli
taccctaccccgaatctgtgtttct

SEQ ID NO: 80079 - DNA, 25 bp, E. coli
taccctaccccgtatctgtgtttct

SEQ ID NO: 80080 - DNA, 25 bp, E. coli
tacgtgagtttttcgccgatgtcat

SEQ ID NO: 80081 - DNA, 25 bp, E. coli
tatttataaaatgccgcttccactg

SEQ ID NO: 80082 - DNA, 25 bp, E. coli
tatttataaaatcccgcttccactg

SEQ ID NO: 80083 - DNA, 25 bp, E. coli
tgggaagcgcagttctcatgcacta

SEQ ID NO: 80084 - DNA, 25 bp, E. coli
tgggaagcgcagatctcatgcacta

SEQ ID NO: 80085 - DNA, 25 bp, E. coli
tctggaagctgctaaagaacgtatt

SEQ ID NO: 80086 - DNA, 25 bp, E. coli
tctggaagctgcaaaagaacgtatt

SEQ ID NO: 80087 - DNA, 25 bp, E. coli
gatagcatgccggagaaaaccgctg

SEQ ID NO: 80088 - DNA, 25 bp, E. coli
gatagcatgccgcagaaaaccgctg

SEQ ID NO: 80089 - DNA, 25 bp, E. coli
ggtatgctaaccttcaacagctctg

SEQ ID NO: 80090 - DNA, 25 bp, E. coli
ggtatgctaaccatcaacagctctg

SEQ ID NO: 80091 - DNA, 25 bp, E. coli
taactatgttcactcattacgtgag

SEQ ID NO: 80092 - DNA, 25 bp, E. coli
taactatgttcagtcattacgtgag

SEQ ID NO: 80093 - DNA, 25 bp, E. coli
tacagatggcttgaccaaagcaacg

SEQ ID NO: 80094 - DNA, 25 bp, E. coli
tacagatggcttcaccaaagcaacg

SEQ ID NO: 80095 - DNA, 25 bp, E. coli
ttatgaatctcagcggcaaagccgt

SEQ ID NO: 80096 - DNA, 25 bp, E. coli
ttatgaatctcaccggcaaagccgt

SEQ ID NO: 80097 - DNA, 25 bp, E. coli
tcggaatcggtcatccgggcgataa

SEQ ID NO: 80098 - DNA, 25 bp, E. coli
tcggaatcggtcttccgggcgataa

SEQ ID NO: 80099 - DNA, 25 bp, E. coli
gcgacataatgcaggtgcctggttc

SEQ ID NO: 80100 - DNA, 25 bp, E. coli
gcgacataatgctggtgcctggttc

SEQ ID NO: 80101 - DNA, 25 bp, E. coli
gaagatgtccgcctgttagtcccga

SEQ ID NO: 80102 - DNA, 25 bp, E. coli
gaaccgattgcacgcctttaaagcg

SEQ ID NO: 80103 - DNA, 25 bp, E. coli
gaaccgattgcaggcctttaaagcg

SEQ ID NO: 80104 - DNA, 25 bp, E. coli
gaagcggcgcgttgtactgaaatgt

SEQ ID NO: 80105 - DNA, 25 bp, E. coli
gaagatgtccgcgtgttagtcccga

SEQ ID NO: 80106 - DNA, 25 bp, E. coli
gaagcggcgcgtagtactgaaatgt

SEQ ID NO: 80107 - DNA, 25 bp, E. coli
gattaaattgattgtcggcctggcg

SEQ ID NO: 80108 - DNA, 25 bp, E. coli
gattaaattgatagtcggcctggcg

SEQ ID NO: 80109 - DNA, 25 bp, E. coli
ggttcgttgactaactggcagagcg

SEQ ID NO: 80110 - DNA, 25 bp, E. coli
ggttcgttgacttactggcagagcg

SEQ ID NO: 80111 - DNA, 25 bp, E. coli
tggtggcccacgtcgaactggatct

SEQ ID NO: 80112 - DNA, 25 bp, E. coli
tggtggcccacgacgaactggatct

SEQ ID NO: 80113 - DNA, 25 bp, E. coli
taatccggacgaaattctggtggcc

SEQ ID NO: 80114 - DNA, 25 bp, E. coli
taatccggacgatattctggtggcc

SEQ ID NO: 80115 - DNA, 25 bp, E. coli
caatatttgaatgaacagcgctgga

SEQ ID NO: 80116 - DNA, 25 bp, E. coli
caatatttgaatcaacagcgctgga

SEQ ID NO: 80117 - DNA, 25 bp, E. coli
catttggcgcggtgaaagagcaatc

SEQ ID NO: 80118 - DNA, 25 bp, E. coli
catttggcgcggagaaagagcaatc

SEQ ID NO: 80119 - DNA, 25 bp, E. coli
taaagcggttgctaccagcgtgatg

SEQ ID NO: 80120 - DNA, 25 bp, E. coli
taaagcggttgcaaccagcgtgatg

SEQ ID NO: 80121 - DNA, 25 bp, E. coli
tttgactactatcgcatgccgcgcg

SEQ ID NO: 80122 - DNA, 25 bp, E. coli
tttgactactatggcatgccgcgcg

SEQ ID NO: 80123 - DNA, 25 bp, E. coli
tttacctgcctaaagaccgtggcga

SEQ ID NO: 80124 - DNA, 25 bp, E. coli
tttacctgcctatagaccgtggcga

SEQ ID NO: 80125 - DNA, 25 bp, E. coli
tgggataaaacgatcgccgagagcc

SEQ ID NO: 80126 - DNA, 25 bp, E. coli
tgggataaaacgttcgccgagagcc

SEQ ID NO: 80127 - DNA, 25 bp, E. coli
gaatatgccgctcttgagctacgcc

SEQ ID NO: 80128 - DNA, 25 bp, E. coli
gaatatgccgctgttgagctacgcc

SEQ ID NO: 80129 - DNA, 25 bp, E. coli
taatgtcgataggaacggcaaggtc

SEQ ID NO: 80130 - DNA, 25 bp, E. coli
taatgtcgatagcaacggcaaggtc

SEQ ID NO: 80131 - DNA, 25 bp, E. coli
gacctgtacgattacgtggccggaa

SEQ ID NO: 80132 - DNA, 25 bp, E. coli
gaggtagatcgctaccgtatcgggc

SEQ ID NO: 80133 - DNA, 25 bp, E. coli
gaggtagatcgcaaccgtatcgggc

SEQ ID NO: 80134 - DNA, 25 bp, E. coli
gacctgtacgataacgtggccggaa

SEQ ID NO: 80135 - DNA, 25 bp, E. coli
gagagccagaaagtcgatcaccgta

SEQ ID NO: 80136 - DNA, 25 bp, E. coli
gagagccagaaactcgatcaccgta

SEQ ID NO: 80137 - DNA, 25 bp, E. coli
cactgtggcttggcgcgaatctgca

SEQ ID NO: 80138 - DNA, 25 bp, E. coli
cactgtggcttgccgcgaatctgca

SEQ ID NO: 80139 - DNA, 25 bp, E. coli
tacgcactgtggcttggcgcgaatc

SEQ ID NO: 80140 - DNA, 25 bp, E. coli
agtgctttacgcactgtggcttggc

SEQ ID NO: 80141 - DNA, 25 bp, E. coli
agtgctttacgctctgtggcttggc

SEQ ID NO: 80142 - DNA, 25 bp, E. coli
acgcactgtggcttggcgcgaatct

SEQ ID NO: 80143 - DNA, 25 bp, E. coli
acgcactgtggcatggcgcgaatct

SEQ ID NO: 80144 - DNA, 25 bp, E. coli
tacgcactgtgggttggcgcgaatc

SEQ ID NO: 80145 - DNA, 25 bp, E. coli
tttacgcactgtcgcttggcgcgaa

SEQ ID NO: 80146 - DNA, 25 bp, E. coli
tttacgcactgtggcttggcgcgaa

SEQ ID NO: 80147 - DNA, 25 bp, E. coli
tgctttacgcactgtggcttggcgc

SEQ ID NO: 80148 - DNA, 25 bp, E. coli
tgctttacgcacagtggcttggcgc

SEQ ID NO: 80149 - DNA, 25 bp, E. coli
gctttacgcactgtggcttggcgcg

SEQ ID NO: 80150 - DNA, 25 bp, E. coli
gctttacgcactctggcttggcgcg

SEQ ID NO: 80151 - DNA, 25 bp, E. coli
gcactgtggcttcgcgcgaatctgc

SEQ ID NO: 80152 - DNA, 25 bp, E. coli
gcactgtggcttggcgcgaatctgc

SEQ ID NO: 80153 - DNA, 25 bp, E. coli
cgcactgtggctaggcgcgaatctg

SEQ ID NO: 80154 - DNA, 25 bp, E. coli
cgcactgtggcttggcgcgaatctg

SEQ ID NO: 80155 - DNA, 25 bp, E. coli
ctttacgcactgtggcttggcgcga

SEQ ID NO: 80156 - DNA, 25 bp, E. coli
ctttacgcactgaggcttggcgcga

SEQ ID NO: 80157 - DNA, 25 bp, E. coli
gtggcttggcgcgaatctgcaggcc

SEQ ID NO: 80158 - DNA, 25 bp, E. coli
gtggcttggcgccaatctgcaggcc

SEQ ID NO: 80159 - DNA, 25 bp, E. coli
caaacacggtgaagaatgggtcgac

SEQ ID NO: 80160 - DNA, 25 bp, E. coli
caaacacggtgatgaatgggtcgac

SEQ ID NO: 80161 - DNA, 25 bp, E. coli
catcccacgtatttcggcactggaa

SEQ ID NO: 80162 - DNA, 25 bp, E. coli
catcccacgtatatcggcactggaa

SEQ ID NO: 80163 - DNA, 25 bp, E. coli
aaaccgtacgcgtgcaagtcgccga

SEQ ID NO: 80164 - DNA, 25 bp, E. coli
aaaccgtacgcgagcaagtcgccga

SEQ ID NO: 80165 - DNA, 25 bp, E. coli
tgcctgtattactaggcgcctcact

SEQ ID NO: 80166 - DNA, 25 bp, E. coli
tgccaactatcttcccgacgaaggg

SEQ ID NO: 80167 - DNA, 25 bp, E. coli
tgcctgtattacaaggcgcctcact

SEQ ID NO: 80168 - DNA, 25 bp, E. coli
tgccaactatctacccgacgaaggg

SEQ ID NO: 80169 - DNA, 25 bp, E. coli
tccgattctgctgctggatgaaccc

SEQ ID NO: 80170 - DNA, 25 bp, E. coli
tccgattctgctcctggatgaaccc

SEQ ID NO: 80171 - DNA, 25 bp, E. coli
tcttccatgacgtaaccgtacgcga

SEQ ID NO: 80172 - DNA, 25 bp, E. coli
tcttccatgacgaaaccgtacgcga

SEQ ID NO: 80173 - DNA, 25 bp, E. coli
gcgtgtcaacatggcgcgcggtttt

SEQ ID NO: 80174 - DNA, 25 bp, E. coli
gcgtgtcaacatcgcgcgcggtttt

SEQ ID NO: 80175 - DNA, 25 bp, E. coli
cggccatcgtcgctatcttccatga

SEQ ID NO: 80176 - DNA, 25 bp, E. coli
cggccatcgtcggtatcttccatga

SEQ ID NO: 80177 - DNA, 25 bp, E. coli
ggttttatcgtcgactatccgattc

SEQ ID NO: 80178 - DNA, 25 bp, E. coli
ggttttatcgtccactatccgattc

SEQ ID NO: 80179 - DNA, 25 bp, E. coli
gatgaatgggtccacctggtcaccg

SEQ ID NO: 80180 - DNA, 25 bp, E. coli
gatgaatgggtcgacctggtcaccg

SEQ ID NO: 80181 - DNA, 25 bp, E. coli
caacggatgtggtgcatgtgcagcc

SEQ ID NO: 80182 - DNA, 25 bp, E. coli
caacggatgtggagcatgtgcagcc

SEQ ID NO: 80183 - DNA, 25 bp, E. coli
atactcactggtcgctggcgcaaag

SEQ ID NO: 80184 - DNA, 25 bp, E. coli
atactcactggtggctggcgcaaag

SEQ ID NO: 80185 - DNA, 25 bp, E. coli
tatcagtcagttcaatgccgccgct

SEQ ID NO: 80186 - DNA, 25 bp, E. coli
tatcagtcagttgaatgccgccgct

SEQ ID NO: 80187 - DNA, 25 bp, E. coli
tgtccggtatcagccataactgcgg

SEQ ID NO: 80188 - DNA, 25 bp, E. coli
tgtccggtatcacccataactgcgg

SEQ ID NO: 80189 - DNA, 25 bp, E. coli
ccagggcctgggatttgcagttcac

SEQ ID NO: 80190 - DNA, 25 bp, E. coli
ccagggcctgggttttgcagttcac

SEQ ID NO: 80191 - DNA, 25 bp, E. coli
gaaaacaacattgtgcaacgcggcg

SEQ ID NO: 80192 - DNA, 25 bp, E. coli
gaaaacaacattctgcaacgcggcg

SEQ ID NO: 80193 - DNA, 25 bp, E. coli
cgctgtcaggatagctgtgagccaa

SEQ ID NO: 80194 - DNA, 25 bp, E. coli
cgctgtcaggattgctgtgagccaa

SEQ ID NO: 80195 - DNA, 25 bp, E. coli
cgccctggtccgctgatgaatctca

SEQ ID NO: 80196 - DNA, 25 bp, E. coli
cgccctggtccggtgatgaatctca

SEQ ID NO: 80197 - DNA, 25 bp, E. coli
gtgaagattgatccatcccgtcggg

SEQ ID NO: 80198 - DNA, 25 bp, E. coli
gtgaagattgatgcatcccgtcggg

SEQ ID NO: 80199 - DNA, 25 bp, E. coli
ggcgcaaagccagtaacggtatccg

SEQ ID NO: 80200 - DNA, 25 bp, E. coli
ggcgcaaagccactaacggtatccg

SEQ ID NO: 80201 - DNA, 25 bp, E. coli
tcaaaaataacgtgtgcagcttctg

SEQ ID NO: 80202 - DNA, 25 bp, E. coli
tcaaaaataacgagtgcagcttctg

SEQ ID NO: 80203 - DNA, 25 bp, E. coli
cattcctcatggatgggccgtttat

SEQ ID NO: 80204 - DNA, 25 bp, E. coli
catgtaagtcatcttgttcctttta

SEQ ID NO: 80205 - DNA, 25 bp, E. coli
cattcctcatggttgggccgtttat

SEQ ID NO: 80206 - DNA, 25 bp, E. coli
catgtaagtcatgttgttcctttta

SEQ ID NO: 80207 - DNA, 25 bp, E. coli
tatccaggcagattttttaactgac

SEQ ID NO: 80208 - DNA, 25 bp, E. coli
aacaatgcgtttagccgccgttaat

SEQ ID NO: 80209 - DNA, 25 bp, E. coli
aacaatgcgttttgccgccgttaat

SEQ ID NO: 80210 - DNA, 25 bp, E. coli
taccttcgttatttccaggcagatt

SEQ ID NO: 80211 - DNA, 25 bp, E. coli
tatccaggcagaatttttaactgac

SEQ ID NO: 80212 - DNA, 25 bp, E. coli
taccttcgttatatccaggcagatt

SEQ ID NO: 80213 - DNA, 25 bp, E. coli
tatttaaccgcgcactccgctgtta

SEQ ID NO: 80214 - DNA, 25 bp, E. coli
tatttccccgctctaccttcgttat

SEQ ID NO: 80215 - DNA, 25 bp, E. coli
tatttaaccgcggactccgctgtta

SEQ ID NO: 80216 - DNA, 25 bp, E. coli
tatttccccgctgtaccttcgttat

SEQ ID NO: 80217 - DNA, 25 bp, E. coli
ttcacggcccatacctcatggatgg

SEQ ID NO: 80218 - DNA, 25 bp, E. coli
ttcacggcccattcctcatggatgg

SEQ ID NO: 80219 - DNA, 25 bp, E. coli
gccgccgttaatatcatgtaagtca

SEQ ID NO: 80220 - DNA, 25 bp, E. coli
gccgccgttaatttcatgtaagtca

SEQ ID NO: 80221 - DNA, 25 bp, E. coli
cgctgttaaccgcaggatatgcatc

SEQ ID NO: 80222 - DNA, 25 bp, E. coli
cgctgttaaccggaggatatgcatc

SEQ ID NO: 80223 - DNA, 25 bp, E. coli
taactgactttcgtttgaaaactgg

SEQ ID NO: 80224 - DNA, 25 bp, E. coli
taactgactttcctttgaaaactgg

SEQ ID NO: 80225 - DNA, 25 bp, E. coli
cactttcacagaacataacggcact

SEQ ID NO: 80226 - DNA, 25 bp, E. coli
cactttcacagatcataacggcact

SEQ ID NO: 80227 - DNA, 25 bp, E. coli
aacataacggcagttcgctgtcgga

SEQ ID NO: 80228 - DNA, 25 bp, E. coli
aacataacggcacttcgctgtcgga

SEQ ID NO: 80229 - DNA, 25 bp, E. coli
ttcgtaatgtgtataacaaggaata

SEQ ID NO: 80230 - DNA, 25 bp, E. coli
ttcgtaatgtgtttaacaaggaata

SEQ ID NO: 80231 - DNA, 25 bp, E. coli
tttatcctgactgatgtttatcctg

SEQ ID NO: 80232 - DNA, 25 bp, E. coli
ttttataaattattccctgcgtgaa

SEQ ID NO: 80233 - DNA, 25 bp, E. coli
tttatcctgactcatgtttatcctg

SEQ ID NO: 80234 - DNA, 25 bp, E. coli
ttttataaattaatccctgcgtgaa

SEQ ID NO: 80235 - DNA, 25 bp, E. coli
tgtttatcctgtatggctgcgaaat

SEQ ID NO: 80236 - DNA, 25 bp, E. coli
tgtttgggattatcaaagcggcaga

SEQ ID NO: 80237 - DNA, 25 bp, E. coli
tgtttatcctgtttggctgcgaaat

SEQ ID NO: 80238 - DNA, 25 bp, E. coli
tgtttgggattaacaaagcggcaga

SEQ ID NO: 80239 - DNA, 25 bp, E. coli
cgctgtcggatgcttttgctgtttg

SEQ ID NO: 80240 - DNA, 25 bp, E. coli
cgctgtcggatggttttgctgtttg

SEQ ID NO: 80241 - DNA, 25 bp, E. coli
cggttaccttctgcactttcacaga

SEQ ID NO: 80242 - DNA, 25 bp, E. coli
ctgtttggctgcgaaataaatataa

SEQ ID NO: 80243 - DNA, 25 bp, E. coli
cggttaccttctccactttcacaga

SEQ ID NO: 80244 - DNA, 25 bp, E. coli
ctgtttggctgccaaataaatataa

SEQ ID NO: 80245 - DNA, 25 bp, E. coli
taatctatccctttatacgcaatac

SEQ ID NO: 80246 - DNA, 25 bp, E. coli
taatctatccctatatacgcaatac

SEQ ID NO: 80247 - DNA, 25 bp, E. coli
agtaagccgtttcgcattggcgaat

SEQ ID NO: 80248 - DNA, 25 bp, E. coli
agtaagccgtttggcattggcgaat

SEQ ID NO: 80249 - DNA, 25 bp, E. coli
tattcgtcgcttactgcgcacggcg

SEQ ID NO: 80250 - DNA, 25 bp, E. coli
tttccgcacgcagcgaagagagcga

SEQ ID NO: 80251 - DNA, 25 bp, E. coli
tattcgtcgctttctgcgcacggcg

SEQ ID NO: 80252 - DNA, 25 bp, E. coli
tttccgcacgcaccgaagagagcga

SEQ ID NO: 80253 - DNA, 25 bp, E. coli
tgaagatgaacaggctattcgtcgc

SEQ ID NO: 80254 - DNA, 25 bp, E. coli
tgaagatgaacacgctattcgtcgc

SEQ ID NO: 80255 - DNA, 25 bp, E. coli
cgcggtgccggtcattgtgctttcc

SEQ ID NO: 80256 - DNA, 25 bp, E. coli
cgaaacgctgcatcgcggcttgctg

SEQ ID NO: 80257 - DNA, 25 bp, E. coli
cgtaagccagatttgattattctcg

SEQ ID NO: 80258 - DNA, 25 bp, E. coli
cgcggtgccggtgattgtgctttcc

SEQ ID NO: 80259 - DNA, 25 bp, E. coli
cgtaagccagatatgattattctcg

SEQ ID NO: 80260 - DNA, 25 bp, E. coli
cgaaacgctgcaacgcggcttgctg

SEQ ID NO: 80261 - DNA, 25 bp, E. coli
cattggcgaattgcaggcccgtctg

SEQ ID NO: 80262 - DNA, 25 bp, E. coli
ctggatgccggaccggatgattatc

SEQ ID NO: 80263 - DNA, 25 bp, E. coli
ctggatgccggagcggatgattatc

SEQ ID NO: 80264 - DNA, 25 bp, E. coli
cattggcgaattccaggcccgtctg

SEQ ID NO: 80265 - DNA, 25 bp, E. coli
gattgagtttatgcgcgacctgcgc

SEQ ID NO: 80266 - DNA, 25 bp, E. coli
gattgagtttatccgcgacctgcgc

SEQ ID NO: 80267 - DNA, 25 bp, E. coli
gatgttaccgtccatttagccgccc

SEQ ID NO: 80268 - DNA, 25 bp, E. coli
gatgttaccgtcgatttagccgccc

SEQ ID NO: 80269 - DNA, 25 bp, E. coli
tacttaaggcgttacaaatgatatt

SEQ ID NO: 80270 - DNA, 25 bp, E. coli
tacttaaggcgtaacaaatgatatt

SEQ ID NO: 80271 - DNA, 25 bp, E. coli
tatttatcggctaactgaacttctc

SEQ ID NO: 80272 - DNA, 25 bp, E. coli
tattatcttcgatacattcaccaga

SEQ ID NO: 80273 - DNA, 25 bp, E. coli
tattatcttcgaaacattcaccaga

SEQ ID NO: 80274 - DNA, 25 bp, E. coli
tatttatcggcttactgaacttctc

SEQ ID NO: 80275 - DNA, 25 bp, E. coli
tctcctttaggaagttttcactccc

SEQ ID NO: 80276 - DNA, 25 bp, E. coli
tctcctttaggatgttttcactccc

SEQ ID NO: 80277 - DNA, 25 bp, E. coli
tcttcgatacatacaccagacttat

SEQ ID NO: 80278 - DNA, 25 bp, E. coli
tcttcgatacattcaccagacttat

SEQ ID NO: 80279 - DNA, 25 bp, E. coli
tcagaggaattatttgattaaggtt

SEQ ID NO: 80280 - DNA, 25 bp, E. coli
tcagaggaattaattgattaaggtt

SEQ ID NO: 80281 - DNA, 25 bp, E. coli
ccagacttattaacatttcagagga

SEQ ID NO: 80282 - DNA, 25 bp, E. coli
ccagacttattatcatttcagagga

SEQ ID NO: 80283 - DNA, 25 bp, E. coli
gaataacgtatagcaaattaaaagt

SEQ ID NO: 80284 - DNA, 25 bp, E. coli
gaataacgtataccaaattaaaagt

SEQ ID NO: 80285 - DNA, 25 bp, E. coli
ccgcgcagaataacgtatagcaaat

SEQ ID NO: 80286 - DNA, 25 bp, E. coli
ccgcgcagaatatcgtatagcaaat

SEQ ID NO: 80287 - DNA, 25 bp, E. coli
ggctaactgaacatctcctttagga

SEQ ID NO: 80288 - DNA, 25 bp, E. coli
ggctaactgaacttctcctttagga

SEQ ID NO: 80289 - DNA, 25 bp, E. coli
ggcgtaacaaatcatatttatcggc

SEQ ID NO: 80290 - DNA, 25 bp, E. coli
ggcgtaacaaatgatatttatcggc

SEQ ID NO: 80291 - DNA, 25 bp, E. coli
cacaagcacgtatttttgtcgcaaa

SEQ ID NO: 80292 - DNA, 25 bp, E. coli
cacaagcacgtaattttgtcgcaaa

SEQ ID NO: 80293 - DNA, 25 bp, E. coli
tatctctattccctagcgattcgct

SEQ ID NO: 80294 - DNA, 25 bp, E. coli
tatctctattccgtagcgattcgct

SEQ ID NO: 80295 - DNA, 25 bp, E. coli
cacttatttaaagataagacgtcct

SEQ ID NO: 80296 - DNA, 25 bp, E. coli
cacttatttaaacataagacgtcct

SEQ ID NO: 80297 - DNA, 25 bp, E. coli
ttataacaacttacacaagcacgta

SEQ ID NO: 80298 - DNA, 25 bp, E. coli
ttttaatcataagagcggcttatgg

SEQ ID NO: 80299 - DNA, 25 bp, E. coli
ttataacaactttcacaagcacgta

SEQ ID NO: 80300 - DNA, 25 bp, E. coli
ttttaatcataacagcggcttatgg

SEQ ID NO: 80301 - DNA, 25 bp, E. coli
tcagagtgcaaatttcacaaccact

SEQ ID NO: 80302 - DNA, 25 bp, E. coli
tcagagtgcaaaattcacaaccact

SEQ ID NO: 80303 - DNA, 25 bp, E. coli
gcgattcgctacgacttatttaaag

SEQ ID NO: 80304 - DNA, 25 bp, E. coli
gcgattcgctaccacttatttaaag

SEQ ID NO: 80305 - DNA, 25 bp, E. coli
gacacatttttaactcatcgcgttt

SEQ ID NO: 80306 - DNA, 25 bp, E. coli
gacacatttttatctcatcgcgttt

SEQ ID NO: 80307 - DNA, 25 bp, E. coli
taaccactcctcctgttatctctat

SEQ ID NO: 80308 - DNA, 25 bp, E. coli
taagacgtccttttcagagtgcaaa

SEQ ID NO: 80309 - DNA, 25 bp, E. coli
taaccactcctcgtgttatctctat

SEQ ID NO: 80310 - DNA, 25 bp, E. coli
taagacgtccttatcagagtgcaaa

SEQ ID NO: 80311 - DNA, 25 bp, E. coli
gagcggcttatggataattattgga

SEQ ID NO: 80312 - DNA, 25 bp, E. coli
gagcggcttatgcataattattgga

SEQ ID NO: 80313 - DNA, 25 bp, E. coli
aagcggcctgctggataattatagg

SEQ ID NO: 80314 - DNA, 25 bp, E. coli
aagcggcctgctcgataattatagg

SEQ ID NO: 80315 - DNA, 25 bp, E. coli
cagagtctaaggcagagtatcgaca

SEQ ID NO: 80316 - DNA, 25 bp, E. coli
cagagtctaagggagagtatcgaca

SEQ ID NO: 80317 - DNA, 25 bp, E. coli
tagggcaaggttaaaagatgacact

SEQ ID NO: 80318 - DNA, 25 bp, E. coli
tagggcaaggtttaaagatgacact

SEQ ID NO: 80319 - DNA, 25 bp, E. coli
tcatgttacgcctgaatcggagaat

SEQ ID NO: 80320 - DNA, 25 bp, E. coli
tcggagaatgcgaattataagacat

SEQ ID NO: 80321 - DNA, 25 bp, E. coli
tcatgttacgccagaatcggagaat

SEQ ID NO: 80322 - DNA, 25 bp, E. coli
tcggagaatgcgtattataagacat

SEQ ID NO: 80323 - DNA, 25 bp, E. coli
gccagtttcaaattcagagtctaag

SEQ ID NO: 80324 - DNA, 25 bp, E. coli
gccagtttcaaaatcagagtctaag

SEQ ID NO: 80325 - DNA, 25 bp, E. coli
gacacttttcgtgacatttttcgaa

SEQ ID NO: 80326 - DNA, 25 bp, E. coli
gacacttttcgtcacatttttcgaa

SEQ ID NO: 80327 - DNA, 25 bp, E. coli
gacgagttattcatatccaacggaa

SEQ ID NO: 80328 - DNA, 25 bp, E. coli
gattcatttcatttctatcggcatg

SEQ ID NO: 80329 - DNA, 25 bp, E. coli
gattcatttcatatctatcggcatg

SEQ ID NO: 80330 - DNA, 25 bp, E. coli
taatatgatagatcaaagcggcctg

SEQ ID NO: 80331 - DNA, 25 bp, E. coli
taatatgatagaacaaagcggcctg

SEQ ID NO: 80332 - DNA, 25 bp, E. coli
gagtatcgacaaaagtctcgaggat

SEQ ID NO: 80333 - DNA, 25 bp, E. coli
gagtatcgacaatagtctcgaggat

SEQ ID NO: 80334 - DNA, 25 bp, E. coli
gacgagttattcttatccaacggaa

SEQ ID NO: 80335 - DNA, 25 bp, E. coli
agcgagccccgccacgtgatgatgc

SEQ ID NO: 80336 - DNA, 25 bp, E. coli
agcgagccccgcgacgtgatgatgc

SEQ ID NO: 80337 - DNA, 25 bp, E. coli
tagcgacacgctcaattctctgggc

SEQ ID NO: 80338 - DNA, 25 bp, E. coli
tagcgacacgctgaattctctgggc

SEQ ID NO: 80339 - DNA, 25 bp, E. coli
ttctctgggcgtttttgtctgggca

SEQ ID NO: 80340 - DNA, 25 bp, E. coli
ttctctgggcgtatttgtctgggca

SEQ ID NO: 80341 - DNA, 25 bp, E. coli
tgatgcgccaggacgatagcgacac

SEQ ID NO: 80342 - DNA, 25 bp, E. coli
tgatgcgccaggtcgatagcgacac

SEQ ID NO: 80343 - DNA, 25 bp, E. coli
tgatgatgcgccaggacgatagcga

SEQ ID NO: 80344 - DNA, 25 bp, E. coli
tgatgatgcgcctggacgatagcga

SEQ ID NO: 80345 - DNA, 25 bp, E. coli
tctccagcgcgacgggcatatccaa

SEQ ID NO: 80346 - DNA, 25 bp, E. coli
tctccagcgcgaggggcatatccaa

SEQ ID NO: 80347 - DNA, 25 bp, E. coli
gccaggacgataccgacacgctgaa

SEQ ID NO: 80348 - DNA, 25 bp, E. coli
gccaggacgatagcgacacgctgaa

SEQ ID NO: 80349 - DNA, 25 bp, E. coli
gctgaattctctcggcgtttttgtc

SEQ ID NO: 80350 - DNA, 25 bp, E. coli
gctgaattctctgggcgtttttgtc

SEQ ID NO: 80351 - DNA, 25 bp, E. coli
gacacgctgaatactctgggcgttt

SEQ ID NO: 80352 - DNA, 25 bp, E. coli
gacacgctgaattctctgggcgttt

SEQ ID NO: 80353 - DNA, 25 bp, E. coli
ggacgatagcgacacgctgaattct

SEQ ID NO: 80354 - DNA, 25 bp, E. coli
gggaaatatttcaccagcgcgaggg

SEQ ID NO: 80355 - DNA, 25 bp, E. coli
gggaaatatttctccagcgcgaggg

SEQ ID NO: 80356 - DNA, 25 bp, E. coli
ggacgatagcgagacgctgaattct

SEQ ID NO: 80357 - DNA, 25 bp, E. coli
taccgccgggatgatgagtttatga

SEQ ID NO: 80358 - DNA, 25 bp, E. coli
taccgccgggatcatgagtttatga

SEQ ID NO: 80359 - DNA, 25 bp, E. coli
tctcagggcaaaagaaccggactcg

SEQ ID NO: 80360 - DNA, 25 bp, E. coli
tctcagggcaaatgaaccggactcg

SEQ ID NO: 80361 - DNA, 25 bp, E. coli
tgaaacaccgtgaaatacgggcggc

SEQ ID NO: 80362 - DNA, 25 bp, E. coli
tgaaacaccgtgtaatacgggcggc

SEQ ID NO: 80363 - DNA, 25 bp, E. coli
tgacgagttcgttgatgagggaacc

SEQ ID NO: 80364 - DNA, 25 bp, E. coli
tgacgagttcgtagatgagggaacc

SEQ ID NO: 80365 - DNA, 25 bp, E. coli
tcccgggctcagtgcattactgctg

SEQ ID NO: 80366 - DNA, 25 bp, E. coli
tcccgggctcagagcattactgctg

SEQ ID NO: 80367 - DNA, 25 bp, E. coli
cctgggaggcgacactgcatattga

SEQ ID NO: 80368 - DNA, 25 bp, E. coli
cctgggaggcgagactgcatattga

SEQ ID NO: 80369 - DNA, 25 bp, E. coli
gcctgctgttgctgtttacctgaca

SEQ ID NO: 80370 - DNA, 25 bp, E. coli
gcctgctgttgcagtttacctgaca

SEQ ID NO: 80371 - DNA, 25 bp, E. coli
gcagttctgtctgccctgaaagaaa

SEQ ID NO: 80372 - DNA, 25 bp, E. coli
gcagttctgtctcccctgaaagaaa

SEQ ID NO: 80373 - DNA, 25 bp, E. coli
gaaaaaattcttgctgcgctggagg

SEQ ID NO: 80374 - DNA, 25 bp, E. coli
gacagatgcgtcagctgctgacgag

SEQ ID NO: 80375 - DNA, 25 bp, E. coli
gacagatgcgtctgctgctgacgag

SEQ ID NO: 80376 - DNA, 25 bp, E. coli
gaaaaaattcttcctgcgctggagg

SEQ ID NO: 80377 - DNA, 25 bp, E. coli
ggatcggcagatgtcctgtggaaaa

SEQ ID NO: 80378 - DNA, 25 bp, E. coli
ggatcggcagatctcctgtggaaaa

SEQ ID NO: 80379 - DNA, 25 bp, E. coli
aataaagcgcgtatctttgacgctg

SEQ ID NO: 80380 - DNA, 25 bp, E. coli
aataaagcgcgtttctttgacgctg

SEQ ID NO: 80381 - DNA, 25 bp, E. coli
tatcgggtcacctgttttcagtaaa

SEQ ID NO: 80382 - DNA, 25 bp, E. coli
tatcgggtcaccagttttcagtaaa

SEQ ID NO: 80383 - DNA, 25 bp, E. coli
aggaagtgcttaacgggtcacctgt

SEQ ID NO: 80384 - DNA, 25 bp, E. coli
aggaagtgcttatcgggtcacctgt

SEQ ID NO: 80385 - DNA, 25 bp, E. coli
tagaggaagtgcttatcgggtcacc

SEQ ID NO: 80386 - DNA, 25 bp, E. coli
tagaggaagtgcatatcgggtcacc

SEQ ID NO: 80387 - DNA, 25 bp, E. coli
ttctttgacgctctaacggtaacac

SEQ ID NO: 80388 - DNA, 25 bp, E. coli
ttctttgacgctgtaacggtaacac

SEQ ID NO: 80389 - DNA, 25 bp, E. coli
ttttactttcccagatgtgcgcccc

SEQ ID NO: 80390 - DNA, 25 bp, E. coli
ttttactttccctgatgtgcgcccc

SEQ ID NO: 80391 - DNA, 25 bp, E. coli
gcgcgtttctttgacgctgtaacgg

SEQ ID NO: 80392 - DNA, 25 bp, E. coli
gcgcgtttctttcacgctgtaacgg

SEQ ID NO: 80393 - DNA, 25 bp, E. coli
ccccattgtagacgaagtgcttatc

SEQ ID NO: 80394 - DNA, 25 bp, E. coli
ccccattgtagaggaagtgcttatc

SEQ ID NO: 80395 - DNA, 25 bp, E. coli
cctgttttcagtaaataaagcgcgt

SEQ ID NO: 80396 - DNA, 25 bp, E. coli
cctgttttcagttaataaagcgcgt

SEQ ID NO: 80397 - DNA, 25 bp, E. coli
taccttttttactttccctgatgtg

SEQ ID NO: 80398 - DNA, 25 bp, E. coli
taccttttttacattccctgatgtg

SEQ ID NO: 80399 - DNA, 25 bp, E. coli
gatgtgcgcccccattgtagaggaa

SEQ ID NO: 80400 - DNA, 25 bp, E. coli
gatgtgcgccccgattgtagaggaa

SEQ ID NO: 80401 - DNA, 25 bp, E. coli
aagaacaccaaagcacggttgcggg

SEQ ID NO: 80402 - DNA, 25 bp, E. coli
aagaacaccaaaccacggttgcggg

SEQ ID NO: 80403 - DNA, 25 bp, E. coli
caacagagctgtaagcatcgggcca

SEQ ID NO: 80404 - DNA, 25 bp, E. coli
caacagagctgttagcatcgggcca

SEQ ID NO: 80405 - DNA, 25 bp, E. coli
caaagcgcgatgtagagaagctgct

SEQ ID NO: 80406 - DNA, 25 bp, E. coli
caaagcgcgatgaagagaagctgct

SEQ ID NO: 80407 - DNA, 25 bp, E. coli
cagtgcggatgtcttgtggaccctt

SEQ ID NO: 80408 - DNA, 25 bp, E. coli
catcgggccattcaggttcatgaac

SEQ ID NO: 80409 - DNA, 25 bp, E. coli
cagtgcggatgtgttgtggaccctt

SEQ ID NO: 80410 - DNA, 25 bp, E. coli
catcgggccattgaggttcatgaac

SEQ ID NO: 80411 - DNA, 25 bp, E. coli
taacagacacgaacagctccgagaa

SEQ ID NO: 80412 - DNA, 25 bp, E. coli
taacagacacgatcagctccgagaa

SEQ ID NO: 80413 - DNA, 25 bp, E. coli
agaatctgttgccagcctcgagcgt

SEQ ID NO: 80414 - DNA, 25 bp, E. coli
agaatctgttgcgagcctcgagcgt

SEQ ID NO: 80415 - DNA, 25 bp, E. coli
tcagtatgttctccggtgtgcgaac

SEQ ID NO: 80416 - DNA, 25 bp, E. coli
tcatcacactggagcagccaaagcg

SEQ ID NO: 80417 - DNA, 25 bp, E. coli
tcatcacactggtgcagccaaagcg

SEQ ID NO: 80418 - DNA, 25 bp, E. coli
tcagtatgttctgcggtgtgcgaac

SEQ ID NO: 80419 - DNA, 25 bp, E. coli
cctcgagcgtgaagaaaagaacacc

SEQ ID NO: 80420 - DNA, 25 bp, E. coli
cctcgagcgtgatgaaaagaacacc

SEQ ID NO: 80421 - DNA, 25 bp, E. coli
cgttatcctgtgcttgcagtgcgga

SEQ ID NO: 80422 - DNA, 25 bp, E. coli
cgttatcctgtggttgcagtgcgga

SEQ ID NO: 80423 - DNA, 25 bp, E. coli
caatatttccgttccactaggccgg

SEQ ID NO: 80424 - DNA, 25 bp, E. coli
caagcgcagcgaaatacagggtaac

SEQ ID NO: 80425 - DNA, 25 bp, E. coli
caagcgcagcgatatacagggtaac

SEQ ID NO: 80426 - DNA, 25 bp, E. coli
caatatttccgtaccactaggccgg

SEQ ID NO: 80427 - DNA, 25 bp, E. coli
caatgcccgcgtggtgaataacggc

SEQ ID NO: 80428 - DNA, 25 bp, E. coli
caatgcccgcgtcgtgaataacggc

SEQ ID NO: 80429 - DNA, 25 bp, E. coli
caggtaaacagaacacggtatcggc

SEQ ID NO: 80430 - DNA, 25 bp, E. coli
caggtaaacagatcacggtatcggc

SEQ ID NO: 80431 - DNA, 25 bp, E. coli
tacagtgtccaggaaggctacgcca

SEQ ID NO: 80432 - DNA, 25 bp, E. coli
tacagtgtccagcaaggctacgcca

SEQ ID NO: 80433 - DNA, 25 bp, E. coli
tatcgttggtgaagaaggacagctc

SEQ ID NO: 80434 - DNA, 25 bp, E. coli
tatcgttggtgatgaaggacagctc

SEQ ID NO: 80435 - DNA, 25 bp, E. coli
tataaccgttatgacaagcgcagcg

SEQ ID NO: 80436 - DNA, 25 bp, E. coli
tataaccgttatcacaagcgcagcg

SEQ ID NO: 80437 - DNA, 25 bp, E. coli
tcgcggcggcgtcatagttcatagc

SEQ ID NO: 80438 - DNA, 25 bp, E. coli
tcgcggcggcgtgatagttcatagc

SEQ ID NO: 80439 - DNA, 25 bp, E. coli
taacgttggctaacagggtgggtcc

SEQ ID NO: 80440 - DNA, 25 bp, E. coli
taatgacgctgcatcgttccgcggg

SEQ ID NO: 80441 - DNA, 25 bp, E. coli
taacgttggctatcagggtgggtcc

SEQ ID NO: 80442 - DNA, 25 bp, E. coli
taacgcgatcgtgccttatgccatg

SEQ ID NO: 80443 - DNA, 25 bp, E. coli
taatgacgctgcttcgttccgcggg

SEQ ID NO: 80444 - DNA, 25 bp, E. coli
taacgcgatcgtcccttatgccatg

SEQ ID NO: 80445 - DNA, 25 bp, E. coli
taaatttcggcaccgtcagcgactc

SEQ ID NO: 80446 - DNA, 25 bp, E. coli
taaagcgcagctcgatgccatccac

SEQ ID NO: 80447 - DNA, 25 bp, E. coli
taaatttcggcagcgtcagcgactc

SEQ ID NO: 80448 - DNA, 25 bp, E. coli
taaagcgcagctggatgccatccac

SEQ ID NO: 80449 - DNA, 25 bp, E. coli
tatcgtcacgctcaatagagccggt

SEQ ID NO: 80450 - DNA, 25 bp, E. coli
tatcgtcacgctgaatagagccggt

SEQ ID NO: 80451 - DNA, 25 bp, E. coli
ttgtgacgtccaggcacgacaagct

SEQ ID NO: 80452 - DNA, 25 bp, E. coli
ttgtgacgtccacgcacgacaagct

SEQ ID NO: 80453 - DNA, 25 bp, E. coli
tgttcccgtcgtaaaacaggttcag

SEQ ID NO: 80454 - DNA, 25 bp, E. coli
tgttcccgtcgttaaacaggttcag

SEQ ID NO: 80455 - DNA, 25 bp, E. coli
ccattgatggtctgcttcgcgtagc

SEQ ID NO: 80456 - DNA, 25 bp, E. coli
gccgccgcgatacttctcatatttg

SEQ ID NO: 80457 - DNA, 25 bp, E. coli
gccgccgcgatagttctcatatttg

SEQ ID NO: 80458 - DNA, 25 bp, E. coli
ccattgatggtcagcttcgcgtagc

SEQ ID NO: 80459 - DNA, 25 bp, E. coli
gcagcaattcagtaccaccaatgga

SEQ ID NO: 80460 - DNA, 25 bp, E. coli
gcagcaattcagaaccaccaatgga

SEQ ID NO: 80461 - DNA, 25 bp, E. coli
cgttgcggtgcggttccatcaggtc

SEQ ID NO: 80462 - DNA, 25 bp, E. coli
cgttgcggtgcgcttccatcaggtc

SEQ ID NO: 80463 - DNA, 25 bp, E. coli
gataaggtccacatcatagagcacc

SEQ ID NO: 80464 - DNA, 25 bp, E. coli
tggaaaattctgtgtccagcgcact

SEQ ID NO: 80465 - DNA, 25 bp, E. coli
tggaaaattctgagtccagcgcact

SEQ ID NO: 80466 - DNA, 25 bp, E. coli
gataaggtccacttcatagagcacc

SEQ ID NO: 80467 - DNA, 25 bp, E. coli
caactggcaagaccagagcaacgac

SEQ ID NO: 80468 - DNA, 25 bp, E. coli
caactggcaagagcagagcaacgac

SEQ ID NO: 80469 - DNA, 25 bp, E. coli
ttagcgtttaaacccgaaccggatg

SEQ ID NO: 80470 - DNA, 25 bp, E. coli
ttagcgtttaaagccgaaccggatg

SEQ ID NO: 80471 - DNA, 25 bp, E. coli
tatccgtaaaactgttgctgccgaa

SEQ ID NO: 80472 - DNA, 25 bp, E. coli
tatccgtaaaacagttgctgccgaa

SEQ ID NO: 80473 - DNA, 25 bp, E. coli
tttttgctggcgcaaatgctgggct

SEQ ID NO: 80474 - DNA, 25 bp, E. coli
tttttgctggcggaaatgctgggct

SEQ ID NO: 80475 - DNA, 25 bp, E. coli
tgttggcgcagacaaaaaacggtac

SEQ ID NO: 80476 - DNA, 25 bp, E. coli
tgttggcgcagagaaaaaacggtac

SEQ ID NO: 80477 - DNA, 25 bp, E. coli
tcagtgcggtgatgtggccttgcca

SEQ ID NO: 80478 - DNA, 25 bp, E. coli
tcagtgcggtgaagtggccttgcca

SEQ ID NO: 80479 - DNA, 25 bp, E. coli
gctgcgctatctcatggctcttggg

SEQ ID NO: 80480 - DNA, 25 bp, E. coli
gctgcgctatctgatggctcttggg

SEQ ID NO: 80481 - DNA, 25 bp, E. coli
gaatttgtcgctggccatattgccg

SEQ ID NO: 80482 - DNA, 25 bp, E. coli
gaatttgtcgctcgccatattgccg

SEQ ID NO: 80483 - DNA, 25 bp, E. coli
cgaagggcagaatgggcaaacgcca

SEQ ID NO: 80484 - DNA, 25 bp, E. coli
cgaagggcagaaagggcaaacgcca

SEQ ID NO: 80485 - DNA, 25 bp, E. coli
tcacccaggtggagcgtttcactct

SEQ ID NO: 80486 - DNA, 25 bp, E. coli
tcacccaggtggtgcgtttcactct

SEQ ID NO: 80487 - DNA, 25 bp, E. coli
gagcgacgctgattgatgggcaaac

SEQ ID NO: 80488 - DNA, 25 bp, E. coli
gagcgacgctgaatgatgggcaaac

SEQ ID NO: 80489 - DNA, 25 bp, E. coli
caatgatgcgggtaagttaatctcc

SEQ ID NO: 80490 - DNA, 25 bp, E. coli
caatattcgtttgggctatgcggaa

SEQ ID NO: 80491 - DNA, 25 bp, E. coli
caatattcgtttcggctatgcggaa

SEQ ID NO: 80492 - DNA, 25 bp, E. coli
caatgatgcgggaaagttaatctcc

SEQ ID NO: 80493 - DNA, 25 bp, E. coli
catctgattattgtggcgaccgaag

SEQ ID NO: 80494 - DNA, 25 bp, E. coli
catctgattattctggcgaccgaag

SEQ ID NO: 80495 - DNA, 25 bp, E. coli
tacgctggcgcagagctagtgacct

SEQ ID NO: 80496 - DNA, 25 bp, E. coli
tacagcaggcgtatgcccataaacc

SEQ ID NO: 80497 - DNA, 25 bp, E. coli
tacagcaggcgtttgcccataaacc

SEQ ID NO: 80498 - DNA, 25 bp, E. coli
acaacttactgataggcgcggcggc

SEQ ID NO: 80499 - DNA, 25 bp, E. coli
acaacttactgaaaggcgcggcggc

SEQ ID NO: 80500 - DNA, 25 bp, E. coli
tatgacaaaggccttccggcgctga

SEQ ID NO: 80501 - DNA, 25 bp, E. coli
tacgctggcgcacagctagtgacct

SEQ ID NO: 80502 - DNA, 25 bp, E. coli
tatgacaaaggcgttccggcgctga

SEQ ID NO: 80503 - DNA, 25 bp, E. coli
tgtcggatatcagcgagtttagccc

SEQ ID NO: 80504 - DNA, 25 bp, E. coli
tgtcggatatcaccgagtttagccc

SEQ ID NO: 80505 - DNA, 25 bp, E. coli
tcttgacctcaatcagtggccggtg

SEQ ID NO: 80506 - DNA, 25 bp, E. coli
tcttgacctcaaacagtggccggtg

SEQ ID NO: 80507 - DNA, 25 bp, E. coli
gctgaaaccgttgattgatgccgat

SEQ ID NO: 80508 - DNA, 25 bp, E. coli
gctgaaaccgttcattgatgccgat

SEQ ID NO: 80509 - DNA, 25 bp, E. coli
gaagttagcctgcaaccgtatggcg

SEQ ID NO: 80510 - DNA, 25 bp, E. coli
gaagttagcctggaaccgtatggcg

SEQ ID NO: 80511 - DNA, 25 bp, E. coli
caatgaaacaactaattaaccttgt

SEQ ID NO: 80512 - DNA, 25 bp, E. coli
caatgaaacaacaaattaaccttgt

SEQ ID NO: 80513 - DNA, 25 bp, E. coli
cagcctgtcatttagcgtgacttat

SEQ ID NO: 80514 - DNA, 25 bp, E. coli
cacactgcgggaacgtgaattgcat

SEQ ID NO: 80515 - DNA, 25 bp, E. coli
cagcctgtcattaagcgtgacttat

SEQ ID NO: 80516 - DNA, 25 bp, E. coli
cacactgcgggatcgtgaattgcat

SEQ ID NO: 80517 - DNA, 25 bp, E. coli
catgctctggctatgattcgattca

SEQ ID NO: 80518 - DNA, 25 bp, E. coli
catgctctggctttgattcgattca

SEQ ID NO: 80519 - DNA, 25 bp, E. coli
tagtcgggaaaaccagacacagcgg

SEQ ID NO: 80520 - DNA, 25 bp, E. coli
tagtcgggaaaagcagacacagcgg

SEQ ID NO: 80521 - DNA, 25 bp, E. coli
tgaagtcagggcatgctctggctat

SEQ ID NO: 80522 - DNA, 25 bp, E. coli
tgaagtcagggcttgctctggctat

SEQ ID NO: 80523 - DNA, 25 bp, E. coli
tcgtgaattgcatcgaagctcatta

SEQ ID NO: 80524 - DNA, 25 bp, E. coli
tcgtgaattgcaacgaagctcatta

SEQ ID NO: 80525 - DNA, 25 bp, E. coli
gaagctcattaacaatagtcgggaa

SEQ ID NO: 80526 - DNA, 25 bp, E. coli
gaagctcattaagaatagtcgggaa

SEQ ID NO: 80527 - DNA, 25 bp, E. coli
gaaaactcctcatatcacactgcgg

SEQ ID NO: 80528 - DNA, 25 bp, E. coli
gaaaactcctcaaatcacactgcgg

SEQ ID NO: 80529 - DNA, 25 bp, E. coli
cgattcagcctgtcatttagcgtga

SEQ ID NO: 80530 - DNA, 25 bp, E. coli
cgattcagcctgacatttagcgtga

SEQ ID NO: 80531 - DNA, 25 bp, E. coli
ggctatgattcgtttcagcctgtca

SEQ ID NO: 80532 - DNA, 25 bp, E. coli
ggctatgattcgattcagcctgtca

SEQ ID NO: 80533 - DNA, 25 bp, E. coli
cagctggtggcgaaaccggaagtaa

SEQ ID NO: 80534 - DNA, 25 bp, E. coli
cagctggtggcgtaaccggaagtaa

SEQ ID NO: 80535 - DNA, 25 bp, E. coli
cagcaccgatccaggcgggaattat

SEQ ID NO: 80536 - DNA, 25 bp, E. coli
cagcaccgatcctggcgggaattat

SEQ ID NO: 80537 - DNA, 25 bp, E. coli
attgtcagctggtggcgtaaccgga

SEQ ID NO: 80538 - DNA, 25 bp, E. coli
attgtcagctggaggcgtaaccgga

SEQ ID NO: 80539 - DNA, 25 bp, E. coli
attttctggcaccacctggcagcac

SEQ ID NO: 80540 - DNA, 25 bp, E. coli
attttctggcacgacctggcagcac

SEQ ID NO: 80541 - DNA, 25 bp, E. coli
tattaccgcagccattgtcagctgg

SEQ ID NO: 80542 - DNA, 25 bp, E. coli
tattaccgcagcgattgtcagctgg

SEQ ID NO: 80543 - DNA, 25 bp, E. coli
ttgtcagctggtcgcgtaaccggaa

SEQ ID NO: 80544 - DNA, 25 bp, E. coli
ttgtcagctggtggcgtaaccggaa

SEQ ID NO: 80545 - DNA, 25 bp, E. coli
cgcagtttgccaagattttctggca

SEQ ID NO: 80546 - DNA, 25 bp, E. coli
cgattgtcagctcgtggcgtaaccg

SEQ ID NO: 80547 - DNA, 25 bp, E. coli
cgcagtttgccatgattttctggca

SEQ ID NO: 80548 - DNA, 25 bp, E. coli
cgattgtcagctggtggcgtaaccg

SEQ ID NO: 80549 - DNA, 25 bp, E. coli
tggcagcaccgatcctggcgggaat

SEQ ID NO: 80550 - DNA, 25 bp, E. coli
tggcagcaccgaacctggcgggaat

SEQ ID NO: 80551 - DNA, 25 bp, E. coli
tcagctggtggcgtaaccggaagta

SEQ ID NO: 80552 - DNA, 25 bp, E. coli
tcagctggtggcctaaccggaagta

SEQ ID NO: 80553 - DNA, 25 bp, E. coli
gatcctggcgggaattattaccgca

SEQ ID NO: 80554 - DNA, 25 bp, E. coli
gatcctggcgggtattattaccgca

SEQ ID NO: 80555 - DNA, 25 bp, E. coli
acggcttgattatcgcctatctcaa

SEQ ID NO: 80556 - DNA, 25 bp, E. coli
acggcttgattaacgcctatctcaa

SEQ ID NO: 80557 - DNA, 25 bp, E. coli
tagtagcagcgacgttattgcagtc

SEQ ID NO: 80558 - DNA, 25 bp, E. coli
tagtagcagcgaggttattgcagtc

SEQ ID NO: 80559 - DNA, 25 bp, E. coli
tttgcccaaggctttattgcgctgg

SEQ ID NO: 80560 - DNA, 25 bp, E. coli
tttgcccaaggcattattgcgctgg

SEQ ID NO: 80561 - DNA, 25 bp, E. coli
tgatcaacggctagattatcgccta

SEQ ID NO: 80562 - DNA, 25 bp, E. coli
tgacctttccgctggtcgccaggtg

SEQ ID NO: 80563 - DNA, 25 bp, E. coli
tgtttgtctgggagttatggaacaa

SEQ ID NO: 80564 - DNA, 25 bp, E. coli
tgacctttccgcaggtcgccaggtg

SEQ ID NO: 80565 - DNA, 25 bp, E. coli
tgtttgtctgggtgttatggaacaa

SEQ ID NO: 80566 - DNA, 25 bp, E. coli
tgatcaacggcttgattatcgccta

SEQ ID NO: 80567 - DNA, 25 bp, E. coli
gctcggtacgatgattatcgtctac

SEQ ID NO: 80568 - DNA, 25 bp, E. coli
gctcggtacgatcattatcgtctac

SEQ ID NO: 80569 - DNA, 25 bp, E. coli
gcggcagtagtagcagcgacgttat

SEQ ID NO: 80570 - DNA, 25 bp, E. coli
gcggcagtagtaccagcgacgttat

SEQ ID NO: 80571 - DNA, 25 bp, E. coli
tccggttttgacagtggtttctcca

SEQ ID NO: 80572 - DNA, 25 bp, E. coli
tccggttttgactgtggtttctcca

SEQ ID NO: 80573 - DNA, 25 bp, E. coli
ggtttctccacttttgcccaaggct

SEQ ID NO: 80574 - DNA, 25 bp, E. coli
ggtttctccactattgcccaaggct

SEQ ID NO: 80575 - DNA, 25 bp, E. coli
gatgattatcgtctacggcattaac

SEQ ID NO: 80576 - DNA, 25 bp, E. coli
gatgattatcgtgtacggcattaac

SEQ ID NO: 80577 - DNA, 25 bp, E. coli
taaaacgttccctgacactggcggg

SEQ ID NO: 80578 - DNA, 25 bp, E. coli
taaaacgttcccagacactggcggg

SEQ ID NO: 80579 - DNA, 25 bp, E. coli
atttgatcaaatcgcccgacagggc

SEQ ID NO: 80580 - DNA, 25 bp, E. coli
atttgatcaaatggcccgacagggc

SEQ ID NO: 80581 - DNA, 25 bp, E. coli
ttttggcagtctgaccgcctggctg

SEQ ID NO: 80582 - DNA, 25 bp, E. coli
ttttggcagtctcaccgcctggctg

SEQ ID NO: 80583 - DNA, 25 bp, E. coli
tcgtaatccagaacgtcaatgcggg

SEQ ID NO: 80584 - DNA, 25 bp, E. coli
tcgtaatccagatcgtcaatgcggg

SEQ ID NO: 80585 - DNA, 25 bp, E. coli
cctggctgcggttgctgagaaatac

SEQ ID NO: 80586 - DNA, 25 bp, E. coli
cctggctgcggtagctgagaaatac

SEQ ID NO: 80587 - DNA, 25 bp, E. coli
gcaagttctgctcttatctggccgg

SEQ ID NO: 80588 - DNA, 25 bp, E. coli
gcaagttctgctgttatctggccgg

SEQ ID NO: 80589 - DNA, 25 bp, E. coli
ggttcgtccgactgcaatcacttca

SEQ ID NO: 80590 - DNA, 25 bp, E. coli
ggttcgtccgacagcaatcacttca

SEQ ID NO: 80591 - DNA, 25 bp, E. coli
tgtgtggcagcaccagcgtcgtaat

SEQ ID NO: 80592 - DNA, 25 bp, E. coli
ggaaacaaatccgtcgatcacagcg

SEQ ID NO: 80593 - DNA, 25 bp, E. coli
ggaaacaaatccctcgatcacagcg

SEQ ID NO: 80594 - DNA, 25 bp, E. coli
tgtgtggcagcagcagcgtcgtaat

SEQ ID NO: 80595 - DNA, 25 bp, E. coli
tcacagcgagataacgttcaggcat

SEQ ID NO: 80596 - DNA, 25 bp, E. coli
tcacagcgagattacgttcaggcat

SEQ ID NO: 80597 - DNA, 25 bp, E. coli
gatgcacattctcccctggttcagg

SEQ ID NO: 80598 - DNA, 25 bp, E. coli
gatgcacattctgccctggttcagg

SEQ ID NO: 80599 - DNA, 25 bp, E. coli
caaaagcggcaggttgcccatcagt

SEQ ID NO: 80600 - DNA, 25 bp, E. coli
caaaagcggcagcttgcccatcagt

SEQ ID NO: 80601 - DNA, 25 bp, E. coli
taactacggcgacgctatcgatctc

SEQ ID NO: 80602 - DNA, 25 bp, E. coli
taactacggcgaggctatcgatctc

SEQ ID NO: 80603 - DNA, 25 bp, E. coli
taaaccgcccgtagatgacgacatt

SEQ ID NO: 80604 - DNA, 25 bp, E. coli
taaaccgcccgttgatgacgacatt

SEQ ID NO: 80605 - DNA, 25 bp, E. coli
agtttgaagatattcgcggcgtcgc

SEQ ID NO: 80606 - DNA, 25 bp, E. coli
agtttgaagataatcgcggcgtcgc

SEQ ID NO: 80607 - DNA, 25 bp, E. coli
aaatgaccttctgcccgcattaggg

SEQ ID NO: 80608 - DNA, 25 bp, E. coli
aaatgaccttctccccgcattaggg

SEQ ID NO: 80609 - DNA, 25 bp, E. coli
tatcgccaaatacttcagcgtggtg

SEQ ID NO: 80610 - DNA, 25 bp, E. coli
tattacctggattggtaacggcgca

SEQ ID NO: 80611 - DNA, 25 bp, E. coli
tattacctggataggtaacggcgca

SEQ ID NO: 80612 - DNA, 25 bp, E. coli
tatcgccaaatagttcagcgtggtg

SEQ ID NO: 80613 - DNA, 25 bp, E. coli
ttaacctacggatataactacggcg

SEQ ID NO: 80614 - DNA, 25 bp, E. coli
ttaacctacggaaataactacggcg

SEQ ID NO: 80615 - DNA, 25 bp, E. coli
gcgccgctgctcgaagccttagata

SEQ ID NO: 80616 - DNA, 25 bp, E. coli
gcattagggcttccgcatagcgaaa

SEQ ID NO: 80617 - DNA, 25 bp, E. coli
gcattagggcttgcgcatagcgaaa

SEQ ID NO: 80618 - DNA, 25 bp, E. coli
gcgccgctgctccaagccttagata

SEQ ID NO: 80619 - DNA, 25 bp, E. coli
cattccggcagaagaacaggtacgt

SEQ ID NO: 80620 - DNA, 25 bp, E. coli
cattccggcagatgaacaggtacgt

SEQ ID NO: 80621 - DNA, 25 bp, E. coli
cagtcgctcaagttccagataggta

SEQ ID NO: 80622 - DNA, 25 bp, E. coli
cagtcgctcaagatccagataggta

SEQ ID NO: 80623 - DNA, 25 bp, E. coli
taaaaagcatccatcaccacctggc

SEQ ID NO: 80624 - DNA, 25 bp, E. coli
taaaaagcatccttcaccacctggc

SEQ ID NO: 80625 - DNA, 25 bp, E. coli
tatcttcagtgatgccctggtcctg

SEQ ID NO: 80626 - DNA, 25 bp, E. coli
tatcttcagtgaagccctggtcctg

SEQ ID NO: 80627 - DNA, 25 bp, E. coli
tgtgtcaataacttggaccgccccg

SEQ ID NO: 80628 - DNA, 25 bp, E. coli
tgtgtcaataacatggaccgccccg

SEQ ID NO: 80629 - DNA, 25 bp, E. coli
tgacggctacatggtttggcatcgc

SEQ ID NO: 80630 - DNA, 25 bp, E. coli
tgacggctacatcgtttggcatcgc

SEQ ID NO: 80631 - DNA, 25 bp, E. coli
tgcggatcagaatgccgaacggctc

SEQ ID NO: 80632 - DNA, 25 bp, E. coli
tgcggatcagaaagccgaacggctc

SEQ ID NO: 80633 - DNA, 25 bp, E. coli
gaaatcccgctgcaggtttgggcca

SEQ ID NO: 80634 - DNA, 25 bp, E. coli
gaaatcccgctggaggtttgggcca

SEQ ID NO: 80635 - DNA, 25 bp, E. coli
cccaggcgagataaggcaggaaact

SEQ ID NO: 80636 - DNA, 25 bp, E. coli
cccaggcgagattaggcaggaaact

SEQ ID NO: 80637 - DNA, 25 bp, E. coli
cgggccgctggtatgcagattgata

SEQ ID NO: 80638 - DNA, 25 bp, E. coli
cgggccgctggtttgcagattgata

SEQ ID NO: 80639 - DNA, 25 bp, E. coli
ggattccacaagatacgcagcggca

SEQ ID NO: 80640 - DNA, 25 bp, E. coli
ggtctgccaccagtcaataatgcgg

SEQ ID NO: 80641 - DNA, 25 bp, E. coli
ggtctgccaccactcaataatgcgg

SEQ ID NO: 80642 - DNA, 25 bp, E. coli
ggattccacaagttacgcagcggca

SEQ ID NO: 80643 - DNA, 25 bp, E. coli
cagcgatgaccggattaacaccgat

SEQ ID NO: 80644 - DNA, 25 bp, E. coli
cagcgatgaccgcattaacaccgat

SEQ ID NO: 80645 - DNA, 25 bp, E. coli
tactggcaggatttacaggccatca

SEQ ID NO: 80646 - DNA, 25 bp, E. coli
tactggcaggatatacaggccatca

SEQ ID NO: 80647 - DNA, 25 bp, E. coli
acgaaaatacggcagaacctggcat

SEQ ID NO: 80648 - DNA, 25 bp, E. coli
acgaaaatacgggagaacctggcat

SEQ ID NO: 80649 - DNA, 25 bp, E. coli
tgaccgcattaacaccgattactgg

SEQ ID NO: 80650 - DNA, 25 bp, E. coli
tgaccgcattaagaccgattactgg

SEQ ID NO: 80651 - DNA, 25 bp, E. coli
tgaatacccaacgaaaatacgggag

SEQ ID NO: 80652 - DNA, 25 bp, E. coli
tgaatacccaaccaaaatacgggag

SEQ ID NO: 80653 - DNA, 25 bp, E. coli
gcaccaccagcgatgaccgcattaa

SEQ ID NO: 80654 - DNA, 25 bp, E. coli
gcaccaccagcgttgaccgcattaa

SEQ ID NO: 80655 - DNA, 25 bp, E. coli
gaaaatacgggagaacctggcatta

SEQ ID NO: 80656 - DNA, 25 bp, E. coli
gaaaatacgggacaacctggcatta

SEQ ID NO: 80657 - DNA, 25 bp, E. coli
ctggcaggattttcaggccatcacg

SEQ ID NO: 80658 - DNA, 25 bp, E. coli
ctggcaggatttacaggccatcacg

SEQ ID NO: 80659 - DNA, 25 bp, E. coli
cattaacaccgattactggcaggat

SEQ ID NO: 80660 - DNA, 25 bp, E. coli
cattaacaccgaatactggcaggat

SEQ ID NO: 80661 - DNA, 25 bp, E. coli
ggcattaccccttctctccaggcac

SEQ ID NO: 80662 - DNA, 25 bp, E. coli
ggcattacccctactctccaggcac

SEQ ID NO: 80663 - DNA, 25 bp, E. coli
tacgggagaaccaggcattacccct

SEQ ID NO: 80664 - DNA, 25 bp, E. coli
tacgggagaacctggcattacccct

SEQ ID NO: 80665 - DNA, 25 bp, E. coli
atctcccaggagaaagcgcgtaccg

SEQ ID NO: 80666 - DNA, 25 bp, E. coli
atctcccaggagtaagcgcgtaccg

SEQ ID NO: 80667 - DNA, 25 bp, E. coli
tatgaagagatggtgaacaacggac

SEQ ID NO: 80668 - DNA, 25 bp, E. coli
tatgaagagatgctgaacaacggac

SEQ ID NO: 80669 - DNA, 25 bp, E. coli
tttaaccggagcacaggatgcgcag

SEQ ID NO: 80670 - DNA, 25 bp, E. coli
ttccattgctgttgccgatgacggc

SEQ ID NO: 80671 - DNA, 25 bp, E. coli
tttaaccggagctcaggatgcgcag

SEQ ID NO: 80672 - DNA, 25 bp, E. coli
ttccattgctgtagccgatgacggc

SEQ ID NO: 80673 - DNA, 25 bp, E. coli
ttattgccgcaggtcaggaagaggc

SEQ ID NO: 80674 - DNA, 25 bp, E. coli
ttattgccgcagctcaggaagaggc

SEQ ID NO: 80675 - DNA, 25 bp, E. coli
gcgtcgtgaaactaagggctatgaa

SEQ ID NO: 80676 - DNA, 25 bp, E. coli
gcgtcgtgaaacaaagggctatgaa

SEQ ID NO: 80677 - DNA, 25 bp, E. coli
gcaaattattggtgccgtgggcgtt

SEQ ID NO: 80678 - DNA, 25 bp, E. coli
gcaaattattggagccgtgggcgtt

SEQ ID NO: 80679 - DNA, 25 bp, E. coli
gaacaacggacgaaccgcgttcgtg

SEQ ID NO: 80680 - DNA, 25 bp, E. coli
gaacaacggacgtaccgcgttcgtg

SEQ ID NO: 80681 - DNA, 25 bp, E. coli
cggtcatctgctggcgttaagtcgc

SEQ ID NO: 80682 - DNA, 25 bp, E. coli
cattcttagccaccaaatggcgagt

SEQ ID NO: 80683 - DNA, 25 bp, E. coli
cattcttagccagcaaatggcgagt

SEQ ID NO: 80684 - DNA, 25 bp, E. coli
cggtcatctgctcgcgttaagtcgc

SEQ ID NO: 80685 - DNA, 25 bp, E. coli
taagtcgcatggacgattgcgcgcc

SEQ ID NO: 80686 - DNA, 25 bp, E. coli
taagtcgcatggtcgattgcgcgcc

SEQ ID NO: 80687 - DNA, 25 bp, E. coli
caggcgatgcaggagtttaccggta

SEQ ID NO: 80688 - DNA, 25 bp, E. coli
caggcgatgcagcagtttaccggta

SEQ ID NO: 80689 - DNA, 25 bp, E. coli
tacgttctggctctacactgcgctg

SEQ ID NO: 80690 - DNA, 25 bp, E. coli
aaaatggcgggcattacgaccacag

SEQ ID NO: 80691 - DNA, 25 bp, E. coli
aaaatggcgggctttacgaccacag

SEQ ID NO: 80692 - DNA, 25 bp, E. coli
tacgttctggctgtacactgcgctg

SEQ ID NO: 80693 - DNA, 25 bp, E. coli
tatgctgcgcgatacgtcggaaaaa

SEQ ID NO: 80694 - DNA, 25 bp, E. coli
tatgctgcgcgaaacgtcggaaaaa

SEQ ID NO: 80695 - DNA, 25 bp, E. coli
tattgccggttatgcgatgagcgcc

SEQ ID NO: 80696 - DNA, 25 bp, E. coli
tattgccggttaagcgatgagcgcc

SEQ ID NO: 80697 - DNA, 25 bp, E. coli
tgtttaagatcaaccgtaacgtccg

SEQ ID NO: 80698 - DNA, 25 bp, E. coli
tgtttaagatcatccgtaacgtccg

SEQ ID NO: 80699 - DNA, 25 bp, E. coli
tgcttgatagcattggcgctgccgg

SEQ ID NO: 80700 - DNA, 25 bp, E. coli
tgcttgatagcaatggcgctgccgg

SEQ ID NO: 80701 - DNA, 25 bp, E. coli
tcgaatatgattttcggcgcgacct

SEQ ID NO: 80702 - DNA, 25 bp, E. coli
tgcgaccagcgttgagatgttaatc

SEQ ID NO: 80703 - DNA, 25 bp, E. coli
tgcgaccagcgtagagatgttaatc

SEQ ID NO: 80704 - DNA, 25 bp, E. coli
tcgaatatgattatcggcgcgacct

SEQ ID NO: 80705 - DNA, 25 bp, E. coli
gaaatggcaagtgaaaacgttcgcg

SEQ ID NO: 80706 - DNA, 25 bp, E. coli
gaaatggcaagtcaaaacgttcgcg

SEQ ID NO: 80707 - DNA, 25 bp, E. coli
taacggtacggcatccagtggcttg

SEQ ID NO: 80708 - DNA, 25 bp, E. coli
taacggtacggcttccagtggcttg

SEQ ID NO: 80709 - DNA, 25 bp, E. coli
cacagcatgagctagaaagagcgcc

SEQ ID NO: 80710 - DNA, 25 bp, E. coli
cacagcatgagcaagaaagagcgcc

SEQ ID NO: 80711 - DNA, 25 bp, E. coli
catcattttcatggaacggcccgaa

SEQ ID NO: 80712 - DNA, 25 bp, E. coli
catcattttcatcgaacggcccgaa

SEQ ID NO: 80713 - DNA, 25 bp, E. coli
cattaacccttaactggacccggcg

SEQ ID NO: 80714 - DNA, 25 bp, E. coli
catgaactggtgtacgaagacggcg

SEQ ID NO: 80715 - DNA, 25 bp, E. coli
catgaactggtgaacgaagacggcg

SEQ ID NO: 80716 - DNA, 25 bp, E. coli
cattaacccttatctggacccggcg

SEQ ID NO: 80717 - DNA, 25 bp, E. coli
taaatctgagctcataaacccgcgc

SEQ ID NO: 80718 - DNA, 25 bp, E. coli
taaatctgagctgataaacccgcgc

SEQ ID NO: 80719 - DNA, 25 bp, E. coli
tatgccaccgatgacgttaagccag

SEQ ID NO: 80720 - DNA, 25 bp, E. coli
tatgccaccgatcacgttaagccag

SEQ ID NO: 80721 - DNA, 25 bp, E. coli
tgatgcataaacgtgagcagcgccg

SEQ ID NO: 80722 - DNA, 25 bp, E. coli
tgatgcataaacctgagcagcgccg

SEQ ID NO: 80723 - DNA, 25 bp, E. coli
tcgtaaggcgatccacaaagccggg

SEQ ID NO: 80724 - DNA, 25 bp, E. coli
tcgtaaggcgatgcacaaagccggg

SEQ ID NO: 80725 - DNA, 25 bp, E. coli
gaacggctggagcatatacgcgaca

SEQ ID NO: 80726 - DNA, 25 bp, E. coli
gaacggctggaggatatacgcgaca

SEQ ID NO: 80727 - DNA, 25 bp, E. coli
gcaggcctgcgtttcttctatcgga

SEQ ID NO: 80728 - DNA, 25 bp, E. coli
gcaggcctgcgtatcttctatcgga

SEQ ID NO: 80729 - DNA, 25 bp, E. coli
taagtttgccatccgtgaagaccgc

SEQ ID NO: 80730 - DNA, 25 bp, E. coli
taagtttgccatgcgtgaagaccgc

SEQ ID NO: 80731 - DNA, 25 bp, E. coli
taccgtaaaacaagctttttgcctg

SEQ ID NO: 80732 - DNA, 25 bp, E. coli
taccgtaaaacatgctttttgcctg

SEQ ID NO: 80733 - DNA, 25 bp, E. coli
tatctaaggagctttaaggctgtga

SEQ ID NO: 80734 - DNA, 25 bp, E. coli
tatctaaggagcattaaggctgtga

SEQ ID NO: 80735 - DNA, 25 bp, E. coli
tcgctttcagcgtataacagcatgt

SEQ ID NO: 80736 - DNA, 25 bp, E. coli
tcgctttcagcgaataacagcatgt

SEQ ID NO: 80737 - DNA, 25 bp, E. coli
tctgtgcgacacaggcttaagggtt

SEQ ID NO: 80738 - DNA, 25 bp, E. coli
tctgtgcgacactggcttaagggtt

SEQ ID NO: 80739 - DNA, 25 bp, E. coli
gcagcgttcagatataagaaaaccc

SEQ ID NO: 80740 - DNA, 25 bp, E. coli
gcagcgttcagaaataagaaaaccc

SEQ ID NO: 80741 - DNA, 25 bp, E. coli
gaaaacccttaagtctgtgcgacac

SEQ ID NO: 80742 - DNA, 25 bp, E. coli
gaaaacccttaactctgtgcgacac

SEQ ID NO: 80743 - DNA, 25 bp, E. coli
gataggtaaaaatgtgcagcgttca

SEQ ID NO: 80744 - DNA, 25 bp, E. coli
gataggtaaaaaagtgcagcgttca

SEQ ID NO: 80745 - DNA, 25 bp, E. coli
gattatcagttctacccagcaaacg

SEQ ID NO: 80746 - DNA, 25 bp, E. coli
gattatcagttcaacccagcaaacg

SEQ ID NO: 80747 - DNA, 25 bp, E. coli
ggcacgctaagaattaggtatctca

SEQ ID NO: 80748 - DNA, 25 bp, E. coli
ggcacgctaagatttaggtatctca

SEQ ID NO: 80749 - DNA, 25 bp, E. coli
taataagcatagaccctgatgtgtg

SEQ ID NO: 80750 - DNA, 25 bp, E. coli
taataagcatagtccctgatgtgtg

SEQ ID NO: 80751 - DNA, 25 bp, E. coli
gatgtgtgggtttacaggcacgcta

SEQ ID NO: 80752 - DNA, 25 bp, E. coli
gatgtgtgggttaacaggcacgcta

SEQ ID NO: 80753 - DNA, 25 bp, E. coli
taaacgaaatcaaagcgggtatcgc

SEQ ID NO: 80754 - DNA, 25 bp, E. coli
tacatgggtgcaatgcgtctgaccg

SEQ ID NO: 80755 - DNA, 25 bp, E. coli
taaacgaaatcatagcgggtatcgc

SEQ ID NO: 80756 - DNA, 25 bp, E. coli
tacatgggtgcattgcgtctgaccg

SEQ ID NO: 80757 - DNA, 25 bp, E. coli
tatggtacagctagaccgttacagc

SEQ ID NO: 80758 - DNA, 25 bp, E. coli
tatcgaaaacatgaagcgtccgttc

SEQ ID NO: 80759 - DNA, 25 bp, E. coli
tatggtacagcttgaccgttacagc

SEQ ID NO: 80760 - DNA, 25 bp, E. coli
tatcggcggtgagggttcctacatg

SEQ ID NO: 80761 - DNA, 25 bp, E. coli
tatcggcggtgacggttcctacatg

SEQ ID NO: 80762 - DNA, 25 bp, E. coli
tatcggtttcttcactgcgctgagc

SEQ ID NO: 80763 - DNA, 25 bp, E. coli
tatcgaaaacatcaagcgtccgttc

SEQ ID NO: 80764 - DNA, 25 bp, E. coli
tatcggtttcttgactgcgctgagc

SEQ ID NO: 80765 - DNA, 25 bp, E. coli
gactggctggactgcgcgaaaaaac

SEQ ID NO: 80766 - DNA, 25 bp, E. coli
gcaccgttgtagtagcgatcgaccg

SEQ ID NO: 80767 - DNA, 25 bp, E. coli
gactggctggacagcgcgaaaaaac

SEQ ID NO: 80768 - DNA, 25 bp, E. coli
gcaccgttgtagaagcgatcgaccg

SEQ ID NO: 80769 - DNA, 25 bp, E. coli
gaaaggtaaaaaacacgcgatcgtg

SEQ ID NO: 80770 - DNA, 25 bp, E. coli
gaaaggtaaaaatcacgcgatcgtg

SEQ ID NO: 80771 - DNA, 25 bp, E. coli
cgcgccgtggctttcgaaaacctga

SEQ ID NO: 80772 - DNA, 25 bp, E. coli
cgcgccgtggctatcgaaaacctga

SEQ ID NO: 80773 - DNA, 25 bp, E. coli
gacgaactggcgcatttcatcgaga

SEQ ID NO: 80774 - DNA, 25 bp, E. coli
gacgaactggcggatttcatcgaga

SEQ ID NO: 80775 - DNA, 25 bp, E. coli
taccagtaaataccattctggtgtc

SEQ ID NO: 80776 - DNA, 25 bp, E. coli
taccagtaaatagcattctggtgtc

SEQ ID NO: 80777 - DNA, 25 bp, E. coli
actggtaacggccttgtgcgtactg

SEQ ID NO: 80778 - DNA, 25 bp, E. coli
actggtaacggcgttgtgcgtactg

SEQ ID NO: 80779 - DNA, 25 bp, E. coli
aacgtggtgtaccagtaaataccat

SEQ ID NO: 80780 - DNA, 25 bp, E. coli
aacgtggtgtacgagtaaataccat

SEQ ID NO: 80781 - DNA, 25 bp, E. coli
tctgtcgataaaggtggtgtaccag

SEQ ID NO: 80782 - DNA, 25 bp, E. coli
tctggtgtctgcactggtaacggcg

SEQ ID NO: 80783 - DNA, 25 bp, E. coli
tctgtcgataaacgtggtgtaccag

SEQ ID NO: 80784 - DNA, 25 bp, E. coli
tctggtgtctgctctggtaacggcg

SEQ ID NO: 80785 - DNA, 25 bp, E. coli
cattctggtgtctgcactggtaacg

SEQ ID NO: 80786 - DNA, 25 bp, E. coli
cgtggtgtaccagtaaataccattc

SEQ ID NO: 80787 - DNA, 25 bp, E. coli
cgataaacgtggagtaccagtaaat

SEQ ID NO: 80788 - DNA, 25 bp, E. coli
cattctggtgtcagcactggtaacg

SEQ ID NO: 80789 - DNA, 25 bp, E. coli
cgtggtgtaccactaaataccattc

SEQ ID NO: 80790 - DNA, 25 bp, E. coli
cgataaacgtggtgtaccagtaaat

SEQ ID NO: 80791 - DNA, 25 bp, E. coli
ggtgtaccagtaaataccattctgg

SEQ ID NO: 80792 - DNA, 25 bp, E. coli
gtctgtcgataatcgtggtgtacca

SEQ ID NO: 80793 - DNA, 25 bp, E. coli
gtctgtcgataaacgtggtgtacca

SEQ ID NO: 80794 - DNA, 25 bp, E. coli
ggtgtaccagtatataccattctgg

SEQ ID NO: 80795 - DNA, 25 bp, E. coli
tgtcgataaacgtggtgtaccagta

SEQ ID NO: 80796 - DNA, 25 bp, E. coli
tgtcgataaacgaggtgtaccagta

SEQ ID NO: 80797 - DNA, 25 bp, E. coli
tacagaaggctgtgggcataattga

SEQ ID NO: 80798 - DNA, 25 bp, E. coli
tatcgggaaaagcttacagaaggct

SEQ ID NO: 80799 - DNA, 25 bp, E. coli
tatcgggaaaaggttacagaaggct

SEQ ID NO: 80800 - DNA, 25 bp, E. coli
tacagaaggctgagggcataattga

SEQ ID NO: 80801 - DNA, 25 bp, E. coli
aaatctcgcccggaatgttgtgacg

SEQ ID NO: 80802 - DNA, 25 bp, E. coli
aaatctcgcccgcaatgttgtgacg

SEQ ID NO: 80803 - DNA, 25 bp, E. coli
tgttgtgacgatgacgcgatgatca

SEQ ID NO: 80804 - DNA, 25 bp, E. coli
tgttgtgacgatcacgcgatgatca

SEQ ID NO: 80805 - DNA, 25 bp, E. coli
tcatgaagatgtgacctggtcgtcc

SEQ ID NO: 80806 - DNA, 25 bp, E. coli
tcatgaagatgtcacctggtcgtcc

SEQ ID NO: 80807 - DNA, 25 bp, E. coli
cgatgatcatttgcgggtgcatggc

SEQ ID NO: 80808 - DNA, 25 bp, E. coli
cgatgatcatttccgggtgcatggc

SEQ ID NO: 80809 - DNA, 25 bp, E. coli
cgtctgaaaaagtacaacagcgatt

SEQ ID NO: 80810 - DNA, 25 bp, E. coli
cgtgggcggctattaatcatgaaga

SEQ ID NO: 80811 - DNA, 25 bp, E. coli
cgtctgaaaaagaacaacagcgatt

SEQ ID NO: 80812 - DNA, 25 bp, E. coli
cgtgggcggctaataatcatgaaga

SEQ ID NO: 80813 - DNA, 25 bp, E. coli
ggtgcatggcccgtctgaaaaagaa

SEQ ID NO: 80814 - DNA, 25 bp, E. coli
ggtgcatggcccctctgaaaaagaa

SEQ ID NO: 80815 - DNA, 25 bp, E. coli
tggtcgtccattgccgccggtttta

SEQ ID NO: 80816 - DNA, 25 bp, E. coli
tggtcgtccattcccgccggtttta

SEQ ID NO: 80817 - DNA, 25 bp, E. coli
taatggcattagatatccggttaga

SEQ ID NO: 80818 - DNA, 25 bp, E. coli
taatggcattagttatccggttaga

SEQ ID NO: 80819 - DNA, 25 bp, E. coli
catgtggtctcatgcccaaaggaag

SEQ ID NO: 80820 - DNA, 25 bp, E. coli
catgtggtctcaagcccaaaggaag

SEQ ID NO: 80821 - DNA, 25 bp, E. coli
taacaaaacattaacaccaactggc

SEQ ID NO: 80822 - DNA, 25 bp, E. coli
taacaaaacatttacaccaactggc

SEQ ID NO: 80823 - DNA, 25 bp, E. coli
taggcacaggatagatttgtcgcaa

SEQ ID NO: 80824 - DNA, 25 bp, E. coli
taggcacaggattgatttgtcgcaa

SEQ ID NO: 80825 - DNA, 25 bp, E. coli
tattcactaacatatagctggtgga

SEQ ID NO: 80826 - DNA, 25 bp, E. coli
tattcactaacaaatagctggtgga

SEQ ID NO: 80827 - DNA, 25 bp, E. coli
tgatctcgacgatatggctgcacct

SEQ ID NO: 80828 - DNA, 25 bp, E. coli
tgatctcgacgaaatggctgcacct

SEQ ID NO: 80829 - DNA, 25 bp, E. coli
tcgcaatgattgtcacgattccgct

SEQ ID NO: 80830 - DNA, 25 bp, E. coli
tcgcaatgattgacacgattccgct

SEQ ID NO: 80831 - DNA, 25 bp, E. coli
cccaaaggaagactgaggcgagtca

SEQ ID NO: 80832 - DNA, 25 bp, E. coli
cccaaaggaagagtgaggcgagtca

SEQ ID NO: 80833 - DNA, 25 bp, E. coli
cgattccgcttgtcgctgcgtaagg

SEQ ID NO: 80834 - DNA, 25 bp, E. coli
cgattccgcttgacgctgcgtaagg

SEQ ID NO: 80835 - DNA, 25 bp, E. coli
ggctgcacctaaatcgtgatgaaaa

SEQ ID NO: 80836 - DNA, 25 bp, E. coli
ggctgcacctaattcgtgatgaaaa

SEQ ID NO: 80837 - DNA, 25 bp, E. coli
taatcgtgctcagattacgtgactg

SEQ ID NO: 80838 - DNA, 25 bp, E. coli
taatcgtgctcacattacgtgactg

SEQ ID NO: 80839 - DNA, 25 bp, E. coli
gagtcagtcgcgtaatgcttaggca

SEQ ID NO: 80840 - DNA, 25 bp, E. coli
gagtcagtcgcgaaatgcttaggca

SEQ ID NO: 80841 - DNA, 25 bp, E. coli
cagggaatgccggtaacggtgcaat

SEQ ID NO: 80842 - DNA, 25 bp, E. coli
cagggaatgccgctaacggtgcaat

SEQ ID NO: 80843 - DNA, 25 bp, E. coli
accgtctcgctgacgcgtccggtgt

SEQ ID NO: 80844 - DNA, 25 bp, E. coli
accgtctcgctgtcgcgtccggtgt

SEQ ID NO: 80845 - DNA, 25 bp, E. coli
tataccgatggtggtccgaacaaac

SEQ ID NO: 80846 - DNA, 25 bp, E. coli
tataccgatggtcgtccgaacaaac

SEQ ID NO: 80847 - DNA, 25 bp, E. coli
tagagccaggcagggtgcttaatga

SEQ ID NO: 80848 - DNA, 25 bp, E. coli
tagagccaggcacggtgcttaatga

SEQ ID NO: 80849 - DNA, 25 bp, E. coli
tttgcaggattccacgctggtcgct

SEQ ID NO: 80850 - DNA, 25 bp, E. coli
tttgcaggattcgacgctggtcgct

SEQ ID NO: 80851 - DNA, 25 bp, E. coli
tccgaacaaaccctatcacgggcag

SEQ ID NO: 80852 - DNA, 25 bp, E. coli
tccgaacaaaccgtatcacgggcag

SEQ ID NO: 80853 - DNA, 25 bp, E. coli
gctggtcgctccgtctgatggcacg

SEQ ID NO: 80854 - DNA, 25 bp, E. coli
gctggtcgctccctctgatggcacg

SEQ ID NO: 80855 - DNA, 25 bp, E. coli
cggagctgaattagcaggattcgac

SEQ ID NO: 80856 - DNA, 25 bp, E. coli
cggagctgaatttgcaggattcgac

SEQ ID NO: 80857 - DNA, 25 bp, E. coli
cggtaacggtgctattcggtgacga

SEQ ID NO: 80858 - DNA, 25 bp, E. coli
cggtaacggtgcaattcggtgacga

SEQ ID NO: 80859 - DNA, 25 bp, E. coli
ggtatttaccgtgtcgctgacgcgt

SEQ ID NO: 80860 - DNA, 25 bp, E. coli
ggtggcacggtaattaccgtctcgc

SEQ ID NO: 80861 - DNA, 25 bp, E. coli
ggtatttaccgtctcgctgacgcgt

SEQ ID NO: 80862 - DNA, 25 bp, E. coli
ggtggcacggtatttaccgtctcgc

SEQ ID NO: 80863 - DNA, 25 bp, E. coli
tagctgatggtctgagcgcaggcca

SEQ ID NO: 80864 - DNA, 25 bp, E. coli
tagctgatggtcagagcgcaggcca

SEQ ID NO: 80865 - DNA, 25 bp, E. coli
accttcctgggctacgacgttgacg

SEQ ID NO: 80866 - DNA, 25 bp, E. coli
accttcctgggcaacgacgttgacg

SEQ ID NO: 80867 - DNA, 25 bp, E. coli
tagccatggctgtcttcggtgcaac

SEQ ID NO: 80868 - DNA, 25 bp, E. coli
tagccatggctgacttcggtgcaac

SEQ ID NO: 80869 - DNA, 25 bp, E. coli
tattgatgccgagcgtagccatggc

SEQ ID NO: 80870 - DNA, 25 bp, E. coli
tattgatgccgaccgtagccatggc

SEQ ID NO: 80871 - DNA, 25 bp, E. coli
tgggaaaccgtgttaccagcagcga

SEQ ID NO: 80872 - DNA, 25 bp, E. coli
tgggaaaccgtgataccagcagcga

SEQ ID NO: 80873 - DNA, 25 bp, E. coli
tcagggtgaagttaccgatcagacc

SEQ ID NO: 80874 - DNA, 25 bp, E. coli
tcagggtgaagtaaccgatcagacc

SEQ ID NO: 80875 - DNA, 25 bp, E. coli
ccaactggtgcagatcaggcaatca

SEQ ID NO: 80876 - DNA, 25 bp, E. coli
ccaactggtgcacatcaggcaatca

SEQ ID NO: 80877 - DNA, 25 bp, E. coli
gctgctgccactgccggtaaaatta

SEQ ID NO: 80878 - DNA, 25 bp, E. coli
gctgctgccactcccggtaaaatta

SEQ ID NO: 80879 - DNA, 25 bp, E. coli
cgggtctgacccagaaagttggcga

SEQ ID NO: 80880 - DNA, 25 bp, E. coli
cgggtctgaccctgaaagttggcga

SEQ ID NO: 80881 - DNA, 25 bp, E. coli
taacccagtaactctggctggcgcg

SEQ ID NO: 80882 - DNA, 25 bp, E. coli
taacccagtaacactggctggcgcg

SEQ ID NO: 80883 - DNA, 25 bp, E. coli
gacgttgacgcttgcacgggtgtta

SEQ ID NO: 80884 - DNA, 25 bp, E. coli
gacgttgacgctagcacgggtgtta

SEQ ID NO: 80885 - DNA, 25 bp, E. coli
caacgctggcgggaataatggcgta

SEQ ID NO: 80886 - DNA, 25 bp, E. coli
caattttatcgggaacgctggcggg

SEQ ID NO: 80887 - DNA, 25 bp, E. coli
caacgctggcggcaataatggcgta

SEQ ID NO: 80888 - DNA, 25 bp, E. coli
caattttatcggcaacgctggcggg

SEQ ID NO: 80889 - DNA, 25 bp, E. coli
caccttcgctattgttatcgaccaa

SEQ ID NO: 80890 - DNA, 25 bp, E. coli
caccttcgctatagttatcgaccaa

SEQ ID NO: 80891 - DNA, 25 bp, E. coli
taccacatcaaatcatcaggcactt

SEQ ID NO: 80892 - DNA, 25 bp, E. coli
taccacatcaaaacatcaggcactt

SEQ ID NO: 80893 - DNA, 25 bp, E. coli
ttattttcttcttccgccgcccgag

SEQ ID NO: 80894 - DNA, 25 bp, E. coli
ttattttcttctaccgccgcccgag

SEQ ID NO: 80895 - DNA, 25 bp, E. coli
tgtttatcacgctcaagctgtgcct

SEQ ID NO: 80896 - DNA, 25 bp, E. coli
tgtttatcacgcacaagctgtgcct

SEQ ID NO: 80897 - DNA, 25 bp, E. coli
tcaggcactttgtagtcggcatacg

SEQ ID NO: 80898 - DNA, 25 bp, E. coli
tcaggcactttgaagtcggcatacg

SEQ ID NO: 80899 - DNA, 25 bp, E. coli
gccagacgaccaataatcaactgcg

SEQ ID NO: 80900 - DNA, 25 bp, E. coli
gccagacgaccattaatcaactgcg

SEQ ID NO: 80901 - DNA, 25 bp, E. coli
gctttatattctatcgccaacgccg

SEQ ID NO: 80902 - DNA, 25 bp, E. coli
gctttatattctttcgccaacgccg

SEQ ID NO: 80903 - DNA, 25 bp, E. coli
gaataatggcgtattcaccttcgct

SEQ ID NO: 80904 - DNA, 25 bp, E. coli
gaataatggcgttttcaccttcgct

SEQ ID NO: 80905 - DNA, 25 bp, E. coli
gttaaaaccaatttcgccattggca

SEQ ID NO: 80906 - DNA, 25 bp, E. coli
gttaaaaccaatatcgccattggca

SEQ ID NO: 80907 - DNA, 25 bp, E. coli
aagacctggctaacgatggctaccg

SEQ ID NO: 80908 - DNA, 25 bp, E. coli
aagacctggctatcgatggctaccg

SEQ ID NO: 80909 - DNA, 25 bp, E. coli
cagactccgggcaaagtgttcaaag

SEQ ID NO: 80910 - DNA, 25 bp, E. coli
cagactccgggctaagtgttcaaag

SEQ ID NO: 80911 - DNA, 25 bp, E. coli
taaagctggcgtagaagctggccgt

SEQ ID NO: 80912 - DNA, 25 bp, E. coli
taaagctggcgttgaagctggccgt

SEQ ID NO: 80913 - DNA, 25 bp, E. coli
taccgtgctattcaggtgaccaccg

SEQ ID NO: 80914 - DNA, 25 bp, E. coli
taccgtgctattgaggtgaccaccg

SEQ ID NO: 80915 - DNA, 25 bp, E. coli
ttcagagccttgtcgtagtacgcgt

SEQ ID NO: 80916 - DNA, 25 bp, E. coli
ttcagagccttgacgtagtacgcgt

SEQ ID NO: 80917 - DNA, 25 bp, E. coli
tctgtgggaattccgcctggctgaa

SEQ ID NO: 80918 - DNA, 25 bp, E. coli
tctgtgggaattgcgcctggctgaa

SEQ ID NO: 80919 - DNA, 25 bp, E. coli
gaagacggcgttactatcccagtaa

SEQ ID NO: 80920 - DNA, 25 bp, E. coli
gaagacggcgtttctatcccagtaa

SEQ ID NO: 80921 - DNA, 25 bp, E. coli
gatcgttaaaccagctgtgaaggcg

SEQ ID NO: 80922 - DNA, 25 bp, E. coli
gatcgttaaacctgctgtgaaggcg

SEQ ID NO: 80923 - DNA, 25 bp, E. coli
ggtatgacccgtttcttcacagaag

SEQ ID NO: 80924 - DNA, 25 bp, E. coli
ggtatgacccgtatcttcacagaag

SEQ ID NO: 80925 - DNA, 25 bp, E. coli
taatcgaagttgtagcaaaccgcgt

SEQ ID NO: 80926 - DNA, 25 bp, E. coli
taatcgaagttgaagcaaaccgcgt

SEQ ID NO: 80927 - DNA, 25 bp, E. coli
taaccgtgtgacgaagcctgaagct

SEQ ID NO: 80928 - DNA, 25 bp, E. coli
taaccgtgtgaccaagcctgaagct

SEQ ID NO: 80929 - DNA, 25 bp, E. coli
aagaaatttgaattcgccgatgcgg

SEQ ID NO: 80930 - DNA, 25 bp, E. coli
aagaaatttgaaatcgccgatgcgg

SEQ ID NO: 80931 - DNA, 25 bp, E. coli
tgcggctgcccgacgaaaacggtta

SEQ ID NO: 80932 - DNA, 25 bp, E. coli
tgcggctgcccgtcgaaaacggtta

SEQ ID NO: 80933 - DNA, 25 bp, E. coli
ataacgaaccgccaatgccgtggcc

SEQ ID NO: 80934 - DNA, 25 bp, E. coli
ataacgaaccgcgaatgccgtggcc

SEQ ID NO: 80935 - DNA, 25 bp, E. coli
aaagtctttcatcgcatttgccctg

SEQ ID NO: 80936 - DNA, 25 bp, E. coli
aaagtctttcatggcatttgccctg

SEQ ID NO: 80937 - DNA, 25 bp, E. coli
tctaccagggtggaaaagcgatgcg

SEQ ID NO: 80938 - DNA, 25 bp, E. coli
tctaccagggtgcaaaagcgatgcg

SEQ ID NO: 80939 - DNA, 25 bp, E. coli
gctgcaaaaatatacccgtctggaa

SEQ ID NO: 80940 - DNA, 25 bp, E. coli
gctgcaaaaataaacccgtctggaa

SEQ ID NO: 80941 - DNA, 25 bp, E. coli
gaataattccccagatattgcaagg

SEQ ID NO: 80942 - DNA, 25 bp, E. coli
gaataattcccctgatattgcaagg

SEQ ID NO: 80943 - DNA, 25 bp, E. coli
ccggaggtggttgctttgctgcaaa

SEQ ID NO: 80944 - DNA, 25 bp, E. coli
cgactacgatctgtgcatcaccgag

SEQ ID NO: 80945 - DNA, 25 bp, E. coli
ccggaggtggttcctttgctgcaaa

SEQ ID NO: 80946 - DNA, 25 bp, E. coli
cgactacgatctctgcatcaccgag

SEQ ID NO: 80947 - DNA, 25 bp, E. coli
ctgggacagcggagagaagaaattt

SEQ ID NO: 80948 - DNA, 25 bp, E. coli
ctgggacagcggtgagaagaaattt

SEQ ID NO: 80949 - DNA, 25 bp, E. coli
gggcgctcaataatcccaacctgag

SEQ ID NO: 80950 - DNA, 25 bp, E. coli
gggcgctcaatattcccaacctgag

SEQ ID NO: 80951 - DNA, 25 bp, E. coli
aaagatgataaatggtcagtaccgc

SEQ ID NO: 80952 - DNA, 25 bp, E. coli
aaagatgataaaaggtcagtaccgc

SEQ ID NO: 80953 - DNA, 25 bp, E. coli
tgatcaaaaaatagtcggtcaggcc

SEQ ID NO: 80954 - DNA, 25 bp, E. coli
tgatcaaaaaattgtcggtcaggcc

SEQ ID NO: 80955 - DNA, 25 bp, E. coli
gcgcatcagtttacgctgccaataa

SEQ ID NO: 80956 - DNA, 25 bp, E. coli
gcgcatcagttttcgctgccaataa

SEQ ID NO: 80957 - DNA, 25 bp, E. coli
gccaataatgaatccagcaagtcgg

SEQ ID NO: 80958 - DNA, 25 bp, E. coli
gccaataatgaaaccagcaagtcgg

SEQ ID NO: 80959 - DNA, 25 bp, E. coli
gcaagtcggtcactttcccaaagtg

SEQ ID NO: 80960 - DNA, 25 bp, E. coli
gcaagtcggtcagtttcccaaagtg

SEQ ID NO: 80961 - DNA, 25 bp, E. coli
gaattgccgcgaccgtaaaacgtga

SEQ ID NO: 80962 - DNA, 25 bp, E. coli
gaattgccgcgagcgtaaaacgtga

SEQ ID NO: 80963 - DNA, 25 bp, E. coli
gcaaagcgggaatggcggaatatca

SEQ ID NO: 80964 - DNA, 25 bp, E. coli
gcaaagcgggaaaggcggaatatca

SEQ ID NO: 80965 - DNA, 25 bp, E. coli
cgtggtaaaagtgccgatattcatt

SEQ ID NO: 80966 - DNA, 25 bp, E. coli
cgtggtaaaagtcccgatattcatt

SEQ ID NO: 80967 - DNA, 25 bp, E. coli
gatattcattacgaggtcagcgtgg

SEQ ID NO: 80968 - DNA, 25 bp, E. coli
gataaatggtcactaccgctaaccg

SEQ ID NO: 80969 - DNA, 25 bp, E. coli
gataaatggtcagtaccgctaaccg

SEQ ID NO: 80970 - DNA, 25 bp, E. coli
gatattcattaccaggtcagcgtgg

SEQ ID NO: 80971 - DNA, 25 bp, E. coli
tcagcgtggactgcaaagcgggaat

SEQ ID NO: 80972 - DNA, 25 bp, E. coli
tcagcgtggactccaaagcgggaat

SEQ ID NO: 80973 - DNA, 25 bp, E. coli
gttactgcttttccacggtgtcggg

SEQ ID NO: 80974 - DNA, 25 bp, E. coli
caggaagcgttaatcagtgccggtg

SEQ ID NO: 80975 - DNA, 25 bp, E. coli
gttactgcttttgcacggtgtcggg

SEQ ID NO: 80976 - DNA, 25 bp, E. coli
caggaagcgttattcagtgccggtg

SEQ ID NO: 80977 - DNA, 25 bp, E. coli
tttattgaaacgctgcgctactggc

SEQ ID NO: 80978 - DNA, 25 bp, E. coli
ttacggaagataatcgccaggcgcg

SEQ ID NO: 80979 - DNA, 25 bp, E. coli
ttaacggacgctttgcgagcctgcc

SEQ ID NO: 80980 - DNA, 25 bp, E. coli
ttaacggacgctatgcgagcctgcc

SEQ ID NO: 80981 - DNA, 25 bp, E. coli
tttattgaaacggtgcgctactggc

SEQ ID NO: 80982 - DNA, 25 bp, E. coli
ttacggaagatattcgccaggcgcg

SEQ ID NO: 80983 - DNA, 25 bp, E. coli
tcatggcggtgaagatccggttatc

SEQ ID NO: 80984 - DNA, 25 bp, E. coli
tcatggcggtgatgatccggttatc

SEQ ID NO: 80985 - DNA, 25 bp, E. coli
gaccattttgttgttcaaagcccgg

SEQ ID NO: 80986 - DNA, 25 bp, E. coli
gaccattttgttcttcaaagcccgg

SEQ ID NO: 80987 - DNA, 25 bp, E. coli
cggtttctctcatggcgcgattatg

SEQ ID NO: 80988 - DNA, 25 bp, E. coli
cggtttctctcaaggcgcgattatg

SEQ ID NO: 80989 - DNA, 25 bp, E. coli
taaggagttcgcgatgaaacatgac

SEQ ID NO: 80990 - DNA, 25 bp, E. coli
taaggagttcgccatgaaacatgac

SEQ ID NO: 80991 - DNA, 25 bp, E. coli
gagagcattaaacccgaaccgggcc

SEQ ID NO: 80992 - DNA, 25 bp, E. coli
gaggatttaggccatgcgatcgaca

SEQ ID NO: 80993 - DNA, 25 bp, E. coli
gagagcattaaagccgaaccgggcc

SEQ ID NO: 80994 - DNA, 25 bp, E. coli
gaggatttaggcgatgcgatcgaca

SEQ ID NO: 80995 - DNA, 25 bp, E. coli
caaaattgagtgatgccgcaccggc

SEQ ID NO: 80996 - DNA, 25 bp, E. coli
caaaattgagtgttgccgcaccggc

SEQ ID NO: 80997 - DNA, 25 bp, E. coli
cactggcgcggtctcatgtccagaa

SEQ ID NO: 80998 - DNA, 25 bp, E. coli
cactggcgcggtgtcatgtccagaa

SEQ ID NO: 80999 - DNA, 25 bp, E. coli
catggcgcgcctgtttataagattt

SEQ ID NO: 81000 - DNA, 25 bp, E. coli
catggcgcgcctctttataagattt

SEQ ID NO: 81001 - DNA, 25 bp, E. coli
tacagatcatcccttaccttgtgag

SEQ ID NO: 81002 - DNA, 25 bp, E. coli
tacagatcatccgttaccttgtgag

SEQ ID NO: 81003 - DNA, 25 bp, E. coli
agccttgtgctgctactggatttca

SEQ ID NO: 81004 - DNA, 25 bp, E. coli
agccttgtgctggtactggatttca

SEQ ID NO: 81005 - DNA, 25 bp, E. coli
tcctggatgaaataaggacccggct

SEQ ID NO: 81006 - DNA, 25 bp, E. coli
tcgtttaccaaccacactggcgcgg

SEQ ID NO: 81007 - DNA, 25 bp, E. coli
tcctggatgaaaaaaggacccggct

SEQ ID NO: 81008 - DNA, 25 bp, E. coli
tcgtttaccaacgacactggcgcgg

SEQ ID NO: 81009 - DNA, 25 bp, E. coli
tcatggtaagggagaagtcagcaca

SEQ ID NO: 81010 - DNA, 25 bp, E. coli
tcatggtaagggtgaagtcagcaca

SEQ ID NO: 81011 - DNA, 25 bp, E. coli
gaagtggtgaaaaactccagaagcg

SEQ ID NO: 81012 - DNA, 25 bp, E. coli
gaagtggtgaaatactccagaagcg

SEQ ID NO: 81013 - DNA, 25 bp, E. coli
ccggcgacaggctcaggtggtttaa

SEQ ID NO: 81014 - DNA, 25 bp, E. coli
ccggcgacaggcacaggtggtttaa

SEQ ID NO: 81015 - DNA, 25 bp, E. coli
cgattacggatgtgatggctgcgca

SEQ ID NO: 81016 - DNA, 25 bp, E. coli
cgattacggatgagatggctgcgca

SEQ ID NO: 81017 - DNA, 25 bp, E. coli
cagtatgatgaatcgctgacggcgc

SEQ ID NO: 81018 - DNA, 25 bp, E. coli
cagatactgtggaggatacgcagcc

SEQ ID NO: 81019 - DNA, 25 bp, E. coli
cagtatgatgaaacgctgacggcgc

SEQ ID NO: 81020 - DNA, 25 bp, E. coli
cagatactgtggtggatacgcagcc

SEQ ID NO: 81021 - DNA, 25 bp, E. coli
tacctgccgctgtcgaaagagacgc

SEQ ID NO: 81022 - DNA, 25 bp, E. coli
tacctgccgctgacgaaagagacgc

SEQ ID NO: 81023 - DNA, 25 bp, E. coli
tgatgatcgacaatctctgccgccg

SEQ ID NO: 81024 - DNA, 25 bp, E. coli
tgatgatcgacattctctgccgccg

SEQ ID NO: 81025 - DNA, 25 bp, E. coli
tcgacgaagcgcttaccctgattgg

SEQ ID NO: 81026 - DNA, 25 bp, E. coli
tcgacgaagcgcataccctgattgg

SEQ ID NO: 81027 - DNA, 25 bp, E. coli
tcagaatgtatgagccagcaggcag

SEQ ID NO: 81028 - DNA, 25 bp, E. coli
gaaactggcccgtctggataacgtg

SEQ ID NO: 81029 - DNA, 25 bp, E. coli
gaaactggcccgactggataacgtg

SEQ ID NO: 81030 - DNA, 25 bp, E. coli
cattattctgcgtggtctgtcggcg

SEQ ID NO: 81031 - DNA, 25 bp, E. coli
cattattctgcgaggtctgtcggcg

SEQ ID NO: 81032 - DNA, 25 bp, E. coli
gattgtcgaacacgcggatgacccg

SEQ ID NO: 81033 - DNA, 25 bp, E. coli
gattgtcgaacaggcggatgacccg

SEQ ID NO: 81034 - DNA, 25 bp, E. coli
gatatcatgacccttgacctgggcg

SEQ ID NO: 81035 - DNA, 25 bp, E. coli
gatatcatgaccgttgacctgggcg

SEQ ID NO: 81036 - DNA, 25 bp, E. coli
tcagaatgtatgtgccagcaggcag

SEQ ID NO: 81037 - DNA, 25 bp, E. coli
gagttccaggagtaacacaccgttt

SEQ ID NO: 81038 - DNA, 25 bp, E. coli
gagttccaggagaaacacaccgttt

SEQ ID NO: 81039 - DNA, 25 bp, E. coli
taacacctgaactgcgtcaactggc

SEQ ID NO: 81040 - DNA, 25 bp, E. coli
aggacacccgatcgatacccaacga

SEQ ID NO: 81041 - DNA, 25 bp, E. coli
aggacacccgatggatacccaacga

SEQ ID NO: 81042 - DNA, 25 bp, E. coli
aacttatgacatggaaggacacccg

SEQ ID NO: 81043 - DNA, 25 bp, E. coli
aacttatgacatcgaaggacacccg

SEQ ID NO: 81044 - DNA, 25 bp, E. coli
ttattggccaggacataaaccaggc

SEQ ID NO: 81045 - DNA, 25 bp, E. coli
ttttttcgatcacggcgatgcccag

SEQ ID NO: 81046 - DNA, 25 bp, E. coli
ttttttcgatcagggcgatgcccag

SEQ ID NO: 81047 - DNA, 25 bp, E. coli
ttattggccaggtcataaaccaggc

SEQ ID NO: 81048 - DNA, 25 bp, E. coli
tgaaagttcacgtcagtaaatggct

SEQ ID NO: 81049 - DNA, 25 bp, E. coli
tgacaacggaatccgcgcagtcagt

SEQ ID NO: 81050 - DNA, 25 bp, E. coli
tgaaagttcacgacagtaaatggct

SEQ ID NO: 81051 - DNA, 25 bp, E. coli
tgacaacggaatgcgcgcagtcagt

SEQ ID NO: 81052 - DNA, 25 bp, E. coli
gaagcgccacgaaaactgacaacgg

SEQ ID NO: 81053 - DNA, 25 bp, E. coli
gaagcgccacgataactgacaacgg

SEQ ID NO: 81054 - DNA, 25 bp, E. coli
cgccagagatgaggctaacacctga

SEQ ID NO: 81055 - DNA, 25 bp, E. coli
cgccagagatgacgctaacacctga

SEQ ID NO: 81056 - DNA, 25 bp, E. coli
ggcgatgcccaggacttaatggtct

SEQ ID NO: 81057 - DNA, 25 bp, E. coli
ggcgatgcccagcacttaatggtct

SEQ ID NO: 81058 - DNA, 25 bp, E. coli
taatttgattcagtacaacagccag

SEQ ID NO: 81059 - DNA, 25 bp, E. coli
taatttgattcactacaacagccag

SEQ ID NO: 81060 - DNA, 25 bp, E. coli
taacacctgaacagcgtcaactggc

SEQ ID NO: 81061 - DNA, 25 bp, E. coli
caaaatggcgctatagggatcaccc

SEQ ID NO: 81062 - DNA, 25 bp, E. coli
caaaatggcgctttagggatcaccc

SEQ ID NO: 81063 - DNA, 25 bp, E. coli
aaatccatgttaagggcaccagccg

SEQ ID NO: 81064 - DNA, 25 bp, E. coli
aaatccatgttatgggcaccagccg

SEQ ID NO: 81065 - DNA, 25 bp, E. coli
tatgactacactgtcgcgcgtggac

SEQ ID NO: 81066 - DNA, 25 bp, E. coli
tatgactacactctcgcgcgtggac

SEQ ID NO: 81067 - DNA, 25 bp, E. coli
tatcggctaaagtggaacaggtccc

SEQ ID NO: 81068 - DNA, 25 bp, E. coli
tatcggctaaagaggaacaggtccc

SEQ ID NO: 81069 - DNA, 25 bp, E. coli
tattttaatgtctccaacggcggca

SEQ ID NO: 81070 - DNA, 25 bp, E. coli
tattttaatgtcaccaacggcggca

SEQ ID NO: 81071 - DNA, 25 bp, E. coli
tatctcgacagtagggcgcagtaca

SEQ ID NO: 81072 - DNA, 25 bp, E. coli
tatctcgacagttgggcgcagtaca

SEQ ID NO: 81073 - DNA, 25 bp, E. coli
ttctgcaactggcaggcgatgtcgc

SEQ ID NO: 81074 - DNA, 25 bp, E. coli
ttctgcaactgggaggcgatgtcgc

SEQ ID NO: 81075 - DNA, 25 bp, E. coli
tcagcgcaaagattaccggcagtgg

SEQ ID NO: 81076 - DNA, 25 bp, E. coli
cgacttggcgtataaacctggctga

SEQ ID NO: 81077 - DNA, 25 bp, E. coli
cgacttggcgtaaaaacctggctga

SEQ ID NO: 81078 - DNA, 25 bp, E. coli
cattcagcagcctgaagggtcagac

SEQ ID NO: 81079 - DNA, 25 bp, E. coli
cattcagcagccagaagggtcagac

SEQ ID NO: 81080 - DNA, 25 bp, E. coli
tggataatgacctgcgaccggaggc

SEQ ID NO: 81081 - DNA, 25 bp, E. coli
tggataatgaccagcgaccggaggc

SEQ ID NO: 81082 - DNA, 25 bp, E. coli
tcagcgcaaagaataccggcagtgg

SEQ ID NO: 81083 - DNA, 25 bp, E. coli
caaagagctgttccttgcgggcgaa

SEQ ID NO: 81084 - DNA, 25 bp, E. coli
caaacttgaccgagatatccgcgac

SEQ ID NO: 81085 - DNA, 25 bp, E. coli
caaagagctgttgcttgcgggcgaa

SEQ ID NO: 81086 - DNA, 25 bp, E. coli
caaacttgaccgtgatatccgcgac

SEQ ID NO: 81087 - DNA, 25 bp, E. coli
taaaattcaggcgaacatggacccg

SEQ ID NO: 81088 - DNA, 25 bp, E. coli
taaaattcaggccaacatggacccg

SEQ ID NO: 81089 - DNA, 25 bp, E. coli
tatccgcctgaaagatccgctgaag

SEQ ID NO: 81090 - DNA, 25 bp, E. coli
tatccgcctgaatgatccgctgaag

SEQ ID NO: 81091 - DNA, 25 bp, E. coli
tgaagatctggctcagcagctgcgt

SEQ ID NO: 81092 - DNA, 25 bp, E. coli
tgaagatctggcacagcagctgcgt

SEQ ID NO: 81093 - DNA, 25 bp, E. coli
cctgatggttatggacgccgcaaaa

SEQ ID NO: 81094 - DNA, 25 bp, E. coli
cctgatggttatcgacgccgcaaaa

SEQ ID NO: 81095 - DNA, 25 bp, E. coli
cgtaagaacgaaagccaactggcgc

SEQ ID NO: 81096 - DNA, 25 bp, E. coli
cgtaagaacgaatgccaactggcgc

SEQ ID NO: 81097 - DNA, 25 bp, E. coli
cgttgaagaagcctatccgggcgat

SEQ ID NO: 81098 - DNA, 25 bp, E. coli
cgttgaagaagcgtatccgggcgat

SEQ ID NO: 81099 - DNA, 25 bp, E. coli
ctgatggaagtttcccgtctgcgcg

SEQ ID NO: 81100 - DNA, 25 bp, E. coli
ctgatggaagttacccgtctgcgcg

SEQ ID NO: 81101 - DNA, 25 bp, E. coli
gatacccgtaccctagaagcgagcg

SEQ ID NO: 81102 - DNA, 25 bp, E. coli
gatacctatcgtaccctgacggcgg

SEQ ID NO: 81103 - DNA, 25 bp, E. coli
gatacccgtaccgtagaagcgagcg

SEQ ID NO: 81104 - DNA, 25 bp, E. coli
gatacctatcgttccctgacggcgg

SEQ ID NO: 81105 - DNA, 25 bp, E. coli
cagatatctgcttggcctgacggca

SEQ ID NO: 81106 - DNA, 25 bp, E. coli
cagatatctgctaggcctgacggca

SEQ ID NO: 81107 - DNA, 25 bp, E. coli
tattacgggctacagggagtatcca

SEQ ID NO: 81108 - DNA, 25 bp, E. coli
tattacgggctagagggagtatcca

SEQ ID NO: 81109 - DNA, 25 bp, E. coli
tacaccggactgtattgctgaagca

SEQ ID NO: 81110 - DNA, 25 bp, E. coli
tacaccggactgaattgctgaagca

SEQ ID NO: 81111 - DNA, 25 bp, E. coli
tagctatacgtgtagtcggacccga

SEQ ID NO: 81112 - DNA, 25 bp, E. coli
tagctatacgtgaagtcggacccga

SEQ ID NO: 81113 - DNA, 25 bp, E. coli
tacctgctgcgcaggaaatatcccg

SEQ ID NO: 81114 - DNA, 25 bp, E. coli
tatgcagggcgtgttcacagagagc

SEQ ID NO: 81115 - DNA, 25 bp, E. coli
tatgtcagtctgcaataagccccgt

SEQ ID NO: 81116 - DNA, 25 bp, E. coli
tatgcagggcgtcttcacagagagc

SEQ ID NO: 81117 - DNA, 25 bp, E. coli
tatgtcagtctggaataagccccgt

SEQ ID NO: 81118 - DNA, 25 bp, E. coli
tacctgctgcgctggaaatatcccg

SEQ ID NO: 81119 - DNA, 25 bp, E. coli
tcagaatgtgggataaacgtcagcg

SEQ ID NO: 81120 - DNA, 25 bp, E. coli
tctgtattatcctccgacgagaagg

SEQ ID NO: 81121 - DNA, 25 bp, E. coli
tctgtattatccaccgacgagaagg

SEQ ID NO: 81122 - DNA, 25 bp, E. coli
gacactggtgtgctttgtgcgccaa

SEQ ID NO: 81123 - DNA, 25 bp, E. coli
gacactggtgtggtttgtgcgccaa

SEQ ID NO: 81124 - DNA, 25 bp, E. coli
tcagaatgtgggttaaacgtcagcg

SEQ ID NO: 81125 - DNA, 25 bp, E. coli
tcaacgaagaagacctgggtacgcc

SEQ ID NO: 81126 - DNA, 25 bp, E. coli
tcaacgaagaagtcctgggtacgcc

SEQ ID NO: 81127 - DNA, 25 bp, E. coli
gaatattaaacggtgtcgggttccg

SEQ ID NO: 81128 - DNA, 25 bp, E. coli
gaatattaaacgctgtcgggttccg

SEQ ID NO: 81129 - DNA, 25 bp, E. coli
taaagtcatcatagccagggcctgg

SEQ ID NO: 81130 - DNA, 25 bp, E. coli
taaagtcatcattgccagggcctgg

SEQ ID NO: 81131 - DNA, 25 bp, E. coli
tatttccaaacacaccggatgctgc

SEQ ID NO: 81132 - DNA, 25 bp, E. coli
tatttccaaacagaccggatgctgc

SEQ ID NO: 81133 - DNA, 25 bp, E. coli
ttctcgacaatcaaaagcgcctgga

SEQ ID NO: 81134 - DNA, 25 bp, E. coli
ttctcgacaatctaaagcgcctgga

SEQ ID NO: 81135 - DNA, 25 bp, E. coli
tgtacagcaaggaattgggccagct

SEQ ID NO: 81136 - DNA, 25 bp, E. coli
tgtacagcaaggtattgggccagct

SEQ ID NO: 81137 - DNA, 25 bp, E. coli
tgagaagcgaaacacaccagaaggc

SEQ ID NO: 81138 - DNA, 25 bp, E. coli
tgagaagcgaaagacaccagaaggc

SEQ ID NO: 81139 - DNA, 25 bp, E. coli
gaaggtgtgctctccatcaacgacg

SEQ ID NO: 81140 - DNA, 25 bp, E. coli
gaaggtgtgctcaccatcaacgacg

SEQ ID NO: 81141 - DNA, 25 bp, E. coli
gaacaaatcgcgtggttgcaacgta

SEQ ID NO: 81142 - DNA, 25 bp, E. coli
gaacaaatcgcgaggttgcaacgta

SEQ ID NO: 81143 - DNA, 25 bp, E. coli
ggatctttaccatcttcaccaggga

SEQ ID NO: 81144 - DNA, 25 bp, E. coli
ggatctttaccaacttcaccaggga

SEQ ID NO: 81145 - DNA, 25 bp, E. coli
gacgcgccagcgataatagatcttg

SEQ ID NO: 81146 - DNA, 25 bp, E. coli
gacgcgccagcgttaatagatcttg

SEQ ID NO: 81147 - DNA, 25 bp, E. coli
gatgtgcatcccttatcggaacggc

SEQ ID NO: 81148 - DNA, 25 bp, E. coli
gatgtgcatcccatatcggaacggc

SEQ ID NO: 81149 - DNA, 25 bp, E. coli
aatcagtatgatgacaagtcgcatc

SEQ ID NO: 81150 - DNA, 25 bp, E. coli
aagtcgcatcattacccttctcctt

SEQ ID NO: 81151 - DNA, 25 bp, E. coli
aatcagtatgatcacaagtcgcatc

SEQ ID NO: 81152 - DNA, 25 bp, E. coli
aggattgctcctcccctgagactga

SEQ ID NO: 81153 - DNA, 25 bp, E. coli
aggattgctcctgccctgagactga

SEQ ID NO: 81154 - DNA, 25 bp, E. coli
aagtcgcatcataacccttctcctt

SEQ ID NO: 81155 - DNA, 25 bp, E. coli
tgacctaatttagtgagtaagggta

SEQ ID NO: 81156 - DNA, 25 bp, E. coli
tgacctaatttactgagtaagggta

SEQ ID NO: 81157 - DNA, 25 bp, E. coli
tcccctgagactgactgttaataag

SEQ ID NO: 81158 - DNA, 25 bp, E. coli
tcccctgagactcactgttaataag

SEQ ID NO: 81159 - DNA, 25 bp, E. coli
gactgactgttaataagcgctgaaa

SEQ ID NO: 81160 - DNA, 25 bp, E. coli
cttatgagtaacagtacaatcagta

SEQ ID NO: 81161 - DNA, 25 bp, E. coli
cttatgagtaactgtacaatcagta

SEQ ID NO: 81162 - DNA, 25 bp, E. coli
gattctttgacctaatttagtgagt

SEQ ID NO: 81163 - DNA, 25 bp, E. coli
gattctttgaccaaatttagtgagt

SEQ ID NO: 81164 - DNA, 25 bp, E. coli
ggtaagggaggaatgctcctcccct

SEQ ID NO: 81165 - DNA, 25 bp, E. coli
ggtaagggaggattgctcctcccct

SEQ ID NO: 81166 - DNA, 25 bp, E. coli
taagcgctgaaacttatgagtaaca

SEQ ID NO: 81167 - DNA, 25 bp, E. coli
taagcgctgaaagttatgagtaaca

SEQ ID NO: 81168 - DNA, 25 bp, E. coli
gactgactgttattaagcgctgaaa

SEQ ID NO: 81169 - DNA, 25 bp, E. coli
gatgacaagtcggatcataaccctt

SEQ ID NO: 81170 - DNA, 25 bp, E. coli
gatgacaagtcgcatcataaccctt

SEQ ID NO: 81171 - DNA, 25 bp, E. coli
agctcaacaggacaaagactgggcg

SEQ ID NO: 81172 - DNA, 25 bp, E. coli
agctcaacaggagaaagactgggcg

SEQ ID NO: 81173 - DNA, 25 bp, E. coli
tatgacctgtttcttcaggcagctc

SEQ ID NO: 81174 - DNA, 25 bp, E. coli
tagcccgaacgtggcgctattgccg

SEQ ID NO: 81175 - DNA, 25 bp, E. coli
tatgacctgtttgttcaggcagctc

SEQ ID NO: 81176 - DNA, 25 bp, E. coli
tagcccgaacgtcgcgctattgccg

SEQ ID NO: 81177 - DNA, 25 bp, E. coli
tgttcaggcagctcaacaggagaaa

SEQ ID NO: 81178 - DNA, 25 bp, E. coli
tccttcgcatttccagaacgcgaat

SEQ ID NO: 81179 - DNA, 25 bp, E. coli
tgttcaggcagcacaacaggagaaa

SEQ ID NO: 81180 - DNA, 25 bp, E. coli
tgtttgttcagggagctcaacagga

SEQ ID NO: 81181 - DNA, 25 bp, E. coli
tgtttgttcaggcagctcaacagga

SEQ ID NO: 81182 - DNA, 25 bp, E. coli
tccttcgcatttgcagaacgcgaat

SEQ ID NO: 81183 - DNA, 25 bp, E. coli
tcaggcagctcaacaggagaaagac

SEQ ID NO: 81184 - DNA, 25 bp, E. coli
tcaggcagctcatcaggagaaagac

SEQ ID NO: 81185 - DNA, 25 bp, E. coli
gctattgccgcttatttctattccg

SEQ ID NO: 81186 - DNA, 25 bp, E. coli
gctattgccgctaatttctattccg

SEQ ID NO: 81187 - DNA, 25 bp, E. coli
cgcatttgcagatcgcgaattgatg

SEQ ID NO: 81188 - DNA, 25 bp, E. coli
cgcatttgcagaacgcgaattgatg

SEQ ID NO: 81189 - DNA, 25 bp, E. coli
cgaacgtggcgctattgccgcttat

SEQ ID NO: 81190 - DNA, 25 bp, E. coli
cgaacgtggcgcaattgccgcttat

SEQ ID NO: 81191 - DNA, 25 bp, E. coli
cgcttatttctaatccggaactgga

SEQ ID NO: 81192 - DNA, 25 bp, E. coli
cgcttatttctattccggaactgga

SEQ ID NO: 81193 - DNA, 25 bp, E. coli
taaacaggccaaagacagtacggtg

SEQ ID NO: 81194 - DNA, 25 bp, E. coli
tacggtgcaacaagccaatgacagt

SEQ ID NO: 81195 - DNA, 25 bp, E. coli
tacggtgcaacatgccaatgacagt

SEQ ID NO: 81196 - DNA, 25 bp, E. coli
taaacaggccaatgacagtacggtg

SEQ ID NO: 81197 - DNA, 25 bp, E. coli
taaacaagccaacaacagtaccgag

SEQ ID NO: 81198 - DNA, 25 bp, E. coli
tacctggaacacctcaaataccggg

SEQ ID NO: 81199 - DNA, 25 bp, E. coli
tacctggaacacgtcaaataccggg

SEQ ID NO: 81200 - DNA, 25 bp, E. coli
tgttaaaaccgaccaactgcagcag

SEQ ID NO: 81201 - DNA, 25 bp, E. coli
tgtattcgggactaaaagcttgcca

SEQ ID NO: 81202 - DNA, 25 bp, E. coli
tgttaaaaccgagcaactgcagcag

SEQ ID NO: 81203 - DNA, 25 bp, E. coli
tgtattcgggacaaaaagcttgcca

SEQ ID NO: 81204 - DNA, 25 bp, E. coli
tcctgaaataagtagtagcgtcctg

SEQ ID NO: 81205 - DNA, 25 bp, E. coli
tcctgaaataagaagtagcgtcctg

SEQ ID NO: 81206 - DNA, 25 bp, E. coli
gctattcctgaagatgcaacgggtc

SEQ ID NO: 81207 - DNA, 25 bp, E. coli
gctattcctgaacatgcaacgggtc

SEQ ID NO: 81208 - DNA, 25 bp, E. coli
gaaattattgaaagcgcctctcctg

SEQ ID NO: 81209 - DNA, 25 bp, E. coli
gaaatgccaagttctccggtacgat

SEQ ID NO: 81210 - DNA, 25 bp, E. coli
gaaatgccaagtactccggtacgat

SEQ ID NO: 81211 - DNA, 25 bp, E. coli
gaaattattgaatgcgcctctcctg

SEQ ID NO: 81212 - DNA, 25 bp, E. coli
taatctgacccctaatgagagctgg

SEQ ID NO: 81213 - DNA, 25 bp, E. coli
taatctgaccccaaatgagagctgg

SEQ ID NO: 81214 - DNA, 25 bp, E. coli
taaacaagccaagaacagtaccgag

SEQ ID NO: 81215 - DNA, 25 bp, E. coli
aagtatatgtccgtattgtatgggc

SEQ ID NO: 81216 - DNA, 25 bp, E. coli
caatagagtatgtagtatatgtccg

SEQ ID NO: 81217 - DNA, 25 bp, E. coli
aagtatatgtccctattgtatgggc

SEQ ID NO: 81218 - DNA, 25 bp, E. coli
caatagagtatgaagtatatgtccg

SEQ ID NO: 81219 - DNA, 25 bp, E. coli
catggatggaaaaattacaatagag

SEQ ID NO: 81220 - DNA, 25 bp, E. coli
catggatggaaatattacaatagag

SEQ ID NO: 81221 - DNA, 25 bp, E. coli
taaatgaagttgatcgcatggatgg

SEQ ID NO: 81222 - DNA, 25 bp, E. coli
taaatgaagttgttcgcatggatgg

SEQ ID NO: 81223 - DNA, 25 bp, E. coli
tatgtccgtattctatgggcagaga

SEQ ID NO: 81224 - DNA, 25 bp, E. coli
tatgggcagagatggcaaaaacacg

SEQ ID NO: 81225 - DNA, 25 bp, E. coli
tatgtccgtattgtatgggcagaga

SEQ ID NO: 81226 - DNA, 25 bp, E. coli
tatgggcagagaaggcaaaaacacg

SEQ ID NO: 81227 - DNA, 25 bp, E. coli
tttacagataaaagaagttgttcgc

SEQ ID NO: 81228 - DNA, 25 bp, E. coli
tttacagataaatgaagttgttcgc

SEQ ID NO: 81229 - DNA, 25 bp, E. coli
tgttcgcatggaaggaaatattaca

SEQ ID NO: 81230 - DNA, 25 bp, E. coli
tgttcgcatggatggaaatattaca

SEQ ID NO: 81231 - DNA, 25 bp, E. coli
tccgtattgtatgggcagagaaggc

SEQ ID NO: 81232 - DNA, 25 bp, E. coli
tccgtattgtatcggcagagaaggc

SEQ ID NO: 81233 - DNA, 25 bp, E. coli
cgatttctgtgaaaaatattttgaa

SEQ ID NO: 81234 - DNA, 25 bp, E. coli
cgatttctgtgataaatattttgaa

SEQ ID NO: 81235 - DNA, 25 bp, E. coli
tggccaaaaacgatttctgtgataa

SEQ ID NO: 81236 - DNA, 25 bp, E. coli
tggccaaaaacgttttctgtgataa

SEQ ID NO: 81237 - DNA, 25 bp, E. coli
catcaattaaaagtgatgaagaatg

SEQ ID NO: 81238 - DNA, 25 bp, E. coli
catcaattaaaactgatgaagaatg

SEQ ID NO: 81239 - DNA, 25 bp, E. coli
tgccgtcggaggctaacgtcagaaa

SEQ ID NO: 81240 - DNA, 25 bp, E. coli
tgccgtcggagggtaacgtcagaaa

SEQ ID NO: 81241 - DNA, 25 bp, E. coli
tgaagcctgccgacggaggctaacg

SEQ ID NO: 81242 - DNA, 25 bp, E. coli
tgaagcctgccgtcggaggctaacg

SEQ ID NO: 81243 - DNA, 25 bp, E. coli
tcggaggctaacctcagaaaagaga

SEQ ID NO: 81244 - DNA, 25 bp, E. coli
tcggaggctaacgtcagaaaagaga

SEQ ID NO: 81245 - DNA, 25 bp, E. coli
gaaaagagagcaaatacatcaatta

SEQ ID NO: 81246 - DNA, 25 bp, E. coli
gaaaagagagcatatacatcaatta

SEQ ID NO: 81247 - DNA, 25 bp, E. coli
gcctgccgtcggaggctaacgtcag

SEQ ID NO: 81248 - DNA, 25 bp, E. coli
ccgtcggaggcttacgtcagaaaag

SEQ ID NO: 81249 - DNA, 25 bp, E. coli
gcctgccgtcggtggctaacgtcag

SEQ ID NO: 81250 - DNA, 25 bp, E. coli
ccgtcggaggctaacgtcagaaaag

SEQ ID NO: 81251 - DNA, 25 bp, E. coli
cgtcagaaaagagagcatatacatc

SEQ ID NO: 81252 - DNA, 25 bp, E. coli
cgtcagaaaagacagcatatacatc

SEQ ID NO: 81253 - DNA, 25 bp, E. coli
taacgtcagaaatgagagcatatac

SEQ ID NO: 81254 - DNA, 25 bp, E. coli
taacgtcagaaaagagagcatatac

SEQ ID NO: 81255 - DNA, 25 bp, E. coli
gaggctaacgtcagaaaagagagca

SEQ ID NO: 81256 - DNA, 25 bp, E. coli
gaggctaacgtctgaaaagagagca

SEQ ID NO: 81257 - DNA, 25 bp, E. coli
gagcatatacatcaattaaaagtga

SEQ ID NO: 81258 - DNA, 25 bp, E. coli
gagcatatacatgaattaaaagtga

SEQ ID NO: 81259 - DNA, 25 bp, E. coli
taccttcaggaatagcggtaccagc

SEQ ID NO: 81260 - DNA, 25 bp, E. coli
aggaaccggcaaaaaccatctggcg

SEQ ID NO: 81261 - DNA, 25 bp, E. coli
aggaaccggcaataaccatctggcg

SEQ ID NO: 81262 - DNA, 25 bp, E. coli
tatgtcggcgatgaaagataccttc

SEQ ID NO: 81263 - DNA, 25 bp, E. coli
taccttcaggaaaagcggtaccagc

SEQ ID NO: 81264 - DNA, 25 bp, E. coli
tatgtcggcgatcaaagataccttc

SEQ ID NO: 81265 - DNA, 25 bp, E. coli
tcaactgggatacctaccgtagccg

SEQ ID NO: 81266 - DNA, 25 bp, E. coli
tcaactgggatagctaccgtagccg

SEQ ID NO: 81267 - DNA, 25 bp, E. coli
gaatgcgttaagcaaagcgcgccag

SEQ ID NO: 81268 - DNA, 25 bp, E. coli
gaatgcgttaaggaaagcgcgccag

SEQ ID NO: 81269 - DNA, 25 bp, E. coli
cgcgccagtatgtcgaagagtttga

SEQ ID NO: 81270 - DNA, 25 bp, E. coli
cgcgccagtatgacgaagagtttga

SEQ ID NO: 81271 - DNA, 25 bp, E. coli
ctctcgaacgtgtaaatcgggcgat

SEQ ID NO: 81272 - DNA, 25 bp, E. coli
ctctcgaacgtgaaaatcgggcgat

SEQ ID NO: 81273 - DNA, 25 bp, E. coli
cggtaccagcgatgaacaactgctt

SEQ ID NO: 81274 - DNA, 25 bp, E. coli
cggtaccagcgaagaacaactgctt

SEQ ID NO: 81275 - DNA, 25 bp, E. coli
gatggaccgtatgcgcctgggtaac

SEQ ID NO: 81276 - DNA, 25 bp, E. coli
gatgaccaagttgctgggcgaacgc

SEQ ID NO: 81277 - DNA, 25 bp, E. coli
gatggaccgtatccgcctgggtaac

SEQ ID NO: 81278 - DNA, 25 bp, E. coli
gagctgctgctacgcggtaaatccg

SEQ ID NO: 81279 - DNA, 25 bp, E. coli
gagctgctgctaggcggtaaatccg

SEQ ID NO: 81280 - DNA, 25 bp, E. coli
gatgaccaagttcctgggcgaacgc

SEQ ID NO: 81281 - DNA, 25 bp, E. coli
tactcacagcgtttggcggcagggc

SEQ ID NO: 81282 - DNA, 25 bp, E. coli
tactcacagcgtatggcggcagggc

SEQ ID NO: 81283 - DNA, 25 bp, E. coli
aggcccggcatctggaagcgttcct

SEQ ID NO: 81284 - DNA, 25 bp, E. coli
aggcccggcatcaggaagcgttcct

SEQ ID NO: 81285 - DNA, 25 bp, E. coli
actcacagcgtaaggcggcagggct

SEQ ID NO: 81286 - DNA, 25 bp, E. coli
actcacagcgtatggcggcagggct

SEQ ID NO: 81287 - DNA, 25 bp, E. coli
ccggcatctggaagcgttcctggca

SEQ ID NO: 81288 - DNA, 25 bp, E. coli
gcccggcatctggaagcgttcctgg

SEQ ID NO: 81289 - DNA, 25 bp, E. coli
gcccggcatctgcaagcgttcctgg

SEQ ID NO: 81290 - DNA, 25 bp, E. coli
ccggcatctggatgcgttcctggca

SEQ ID NO: 81291 - DNA, 25 bp, E. coli
cccggcatctggaagcgttcctggc

SEQ ID NO: 81292 - DNA, 25 bp, E. coli
cccggcatctggtagcgttcctggc

SEQ ID NO: 81293 - DNA, 25 bp, E. coli
cggcatctggaagcgttcctggcag

SEQ ID NO: 81294 - DNA, 25 bp, E. coli
cgggtactcacaccgtatggcggca

SEQ ID NO: 81295 - DNA, 25 bp, E. coli
cgggtactcacagcgtatggcggca

SEQ ID NO: 81296 - DNA, 25 bp, E. coli
ctcacagcgtatcgcggcagggctg

SEQ ID NO: 81297 - DNA, 25 bp, E. coli
cggcatctggaaccgttcctggcag

SEQ ID NO: 81298 - DNA, 25 bp, E. coli
ctcacagcgtatggcggcagggctg

SEQ ID NO: 81299 - DNA, 25 bp, E. coli
ggcatctggaagcgttcctggcaga

SEQ ID NO: 81300 - DNA, 25 bp, E. coli
ggcatctggaagggttcctggcaga

SEQ ID NO: 81301 - DNA, 25 bp, E. coli
ggcccggcatctcgaagcgttcctg

SEQ ID NO: 81302 - DNA, 25 bp, E. coli
ggcccggcatctggaagcgttcctg

SEQ ID NO: 81303 - DNA, 25 bp, E. coli
tacttcattctcctctcaacgggcg

SEQ ID NO: 81304 - DNA, 25 bp, E. coli
tacatgaaacgttttggcaagcgac

SEQ ID NO: 81305 - DNA, 25 bp, E. coli
taaagtgatgtaactcaccgctgcc

SEQ ID NO: 81306 - DNA, 25 bp, E. coli
tacatgaaacgtattggcaagcgac

SEQ ID NO: 81307 - DNA, 25 bp, E. coli
taaagtgatgtatctcaccgctgcc

SEQ ID NO: 81308 - DNA, 25 bp, E. coli
tacttcattctcgtctcaacgggcg

SEQ ID NO: 81309 - DNA, 25 bp, E. coli
aaaatacttgatctcactgccgcgg

SEQ ID NO: 81310 - DNA, 25 bp, E. coli
aaaatacttgatgtcactgccgcgg

SEQ ID NO: 81311 - DNA, 25 bp, E. coli
tatatgcaaatagttcacgcgtcgg

SEQ ID NO: 81312 - DNA, 25 bp, E. coli
tatatgcaaatacttcacgcgtcgg

SEQ ID NO: 81313 - DNA, 25 bp, E. coli
gcagatgaactgtaagcccgtccta

SEQ ID NO: 81314 - DNA, 25 bp, E. coli
gcagatgaactgaaagcccgtccta

SEQ ID NO: 81315 - DNA, 25 bp, E. coli
gaaatgattggtttcgctgccggtc

SEQ ID NO: 81316 - DNA, 25 bp, E. coli
gaaatgattggtatcgctgccggtc

SEQ ID NO: 81317 - DNA, 25 bp, E. coli
gaaaaaataggctctgcgacaacgt

SEQ ID NO: 81318 - DNA, 25 bp, E. coli
gaaaaaataggcactgcgacaacgt

SEQ ID NO: 81319 - DNA, 25 bp, E. coli
tggcaaggcactccgataaacaagg

SEQ ID NO: 81320 - DNA, 25 bp, E. coli
tggcaaggcactgcgataaacaagg

SEQ ID NO: 81321 - DNA, 25 bp, E. coli
ggaatgtgtttttacgccagcgtac

SEQ ID NO: 81322 - DNA, 25 bp, E. coli
ggaatgtgttttaacgccagcgtac

SEQ ID NO: 81323 - DNA, 25 bp, E. coli
gatgtgggcggcgaataatctctac

SEQ ID NO: 81324 - DNA, 25 bp, E. coli
gatgtgggcggccaataatctctac

SEQ ID NO: 81325 - DNA, 25 bp, E. coli
actgcgttgattgcgtgtaaaggga

SEQ ID NO: 81326 - DNA, 25 bp, E. coli
actgcgttgattccgtgtaaaggga

SEQ ID NO: 81327 - DNA, 25 bp, E. coli
tatcctgttatcagtagggtagatg

SEQ ID NO: 81328 - DNA, 25 bp, E. coli
tatcctgttatctgtagggtagatg

SEQ ID NO: 81329 - DNA, 25 bp, E. coli
tagatgtagttgatatcagtcgacg

SEQ ID NO: 81330 - DNA, 25 bp, E. coli
tagatgtagttgttatcagtcgacg

SEQ ID NO: 81331 - DNA, 25 bp, E. coli
tatatttgtgaaaccggtcacctga

SEQ ID NO: 81332 - DNA, 25 bp, E. coli
tatatttgtgaatccggtcacctga

SEQ ID NO: 81333 - DNA, 25 bp, E. coli
tgtgcaaggacattcggcaaacggt

SEQ ID NO: 81334 - DNA, 25 bp, E. coli
tgtgcaaggacaatcggcaaacggt

SEQ ID NO: 81335 - DNA, 25 bp, E. coli
tgctgaaacggatttaagaaaccgg

SEQ ID NO: 81336 - DNA, 25 bp, E. coli
tgctgaaacggaattaagaaaccgg

SEQ ID NO: 81337 - DNA, 25 bp, E. coli
tcggcaaacggtgcagtacactgcg

SEQ ID NO: 81338 - DNA, 25 bp, E. coli
tcggcaaacggtccagtacactgcg

SEQ ID NO: 81339 - DNA, 25 bp, E. coli
tcagtcgacgtgacggaaaaatgcc

SEQ ID NO: 81340 - DNA, 25 bp, E. coli
tcagtcgacgtgtcggaaaaatgcc

SEQ ID NO: 81341 - DNA, 25 bp, E. coli
gaaaccggtttcacaaaatcatgaa

SEQ ID NO: 81342 - DNA, 25 bp, E. coli
gaaaccggtttctcaaaatcatgaa

SEQ ID NO: 81343 - DNA, 25 bp, E. coli
gtcacctgaatatttttcccgccga

SEQ ID NO: 81344 - DNA, 25 bp, E. coli
gtcacctgaataattttcccgccga

SEQ ID NO: 81345 - DNA, 25 bp, E. coli
ggaaaaatgccgatgctgaaacgga

SEQ ID NO: 81346 - DNA, 25 bp, E. coli
ggaaaaatgccgttgctgaaacgga

SEQ ID NO: 81347 - DNA, 25 bp, E. coli
agctccgtgccagagagtgacgcat

SEQ ID NO: 81348 - DNA, 25 bp, E. coli
acctctggcctctggatggcggaga

SEQ ID NO: 81349 - DNA, 25 bp, E. coli
acctctggcctcaggatggcggaga

SEQ ID NO: 81350 - DNA, 25 bp, E. coli
accccaggcgaaggacgctggcgtt

SEQ ID NO: 81351 - DNA, 25 bp, E. coli
agctccgtgccacagagtgacgcat

SEQ ID NO: 81352 - DNA, 25 bp, E. coli
accccaggcgaacgacgctggcgtt

SEQ ID NO: 81353 - DNA, 25 bp, E. coli
acaccttcagcctggtgcgcggcga

SEQ ID NO: 81354 - DNA, 25 bp, E. coli
acaccttcagccaggtgcgcggcga

SEQ ID NO: 81355 - DNA, 25 bp, E. coli
tatcgtgaatgccagcacctgggcg

SEQ ID NO: 81356 - DNA, 25 bp, E. coli
tatcgtgaatgcgagcacctgggcg

SEQ ID NO: 81357 - DNA, 25 bp, E. coli
gcgggtgaactatcgtgaatgccag

SEQ ID NO: 81358 - DNA, 25 bp, E. coli
gcgggtgaactaacgtgaatgccag

SEQ ID NO: 81359 - DNA, 25 bp, E. coli
gacgtttgttcgttgccgtagcggc

SEQ ID NO: 81360 - DNA, 25 bp, E. coli
gacgtttgttcgatgccgtagcggc

SEQ ID NO: 81361 - DNA, 25 bp, E. coli
ccgctggcatcgacgtgtggacgtt

SEQ ID NO: 81362 - DNA, 25 bp, E. coli
ccgctggcatcgtcgtgtggacgtt

SEQ ID NO: 81363 - DNA, 25 bp, E. coli
ctctggaggcactcgcagctccgtg

SEQ ID NO: 81364 - DNA, 25 bp, E. coli
ctctggaggcacacgcagctccgtg

SEQ ID NO: 81365 - DNA, 25 bp, E. coli
cgtgtctggcagaacacctctggcc

SEQ ID NO: 81366 - DNA, 25 bp, E. coli
cgtgtctggcagtacacctctggcc

SEQ ID NO: 81367 - DNA, 25 bp, E. coli
ggcgggaataactcaatggcaaaaa

SEQ ID NO: 81368 - DNA, 25 bp, E. coli
ggcgggaataacacaatggcaaaaa

SEQ ID NO: 81369 - DNA, 25 bp, E. coli
aataataatattaggcgcaggttta

SEQ ID NO: 81370 - DNA, 25 bp, E. coli
aataataatatttggcgcaggttta

SEQ ID NO: 81371 - DNA, 25 bp, E. coli
actagatgctgttttgttacttaaa

SEQ ID NO: 81372 - DNA, 25 bp, E. coli
actagatgctgtattgttacttaaa

SEQ ID NO: 81373 - DNA, 25 bp, E. coli
tagcgccatacttgatgctgttttg

SEQ ID NO: 81374 - DNA, 25 bp, E. coli
tagcgccatactagatgctgttttg

SEQ ID NO: 81375 - DNA, 25 bp, E. coli
tatttggcgcagctttaataataaa

SEQ ID NO: 81376 - DNA, 25 bp, E. coli
tatttggcgcaggtttaataataaa

SEQ ID NO: 81377 - DNA, 25 bp, E. coli
tgaatagcgccaaactagatgctgt

SEQ ID NO: 81378 - DNA, 25 bp, E. coli
tgaatagcgccatactagatgctgt

SEQ ID NO: 81379 - DNA, 25 bp, E. coli
tcgtgttttataattgcgttaagaa

SEQ ID NO: 81380 - DNA, 25 bp, E. coli
tcgtgttttatatttgcgttaagaa

SEQ ID NO: 81381 - DNA, 25 bp, E. coli
gcgcaggtttaaaaataaattaatc

SEQ ID NO: 81382 - DNA, 25 bp, E. coli
gcgcaggtttaataataaattaatc

SEQ ID NO: 81383 - DNA, 25 bp, E. coli
gccatactagatcctgttttgttac

SEQ ID NO: 81384 - DNA, 25 bp, E. coli
gccatactagatgctgttttgttac

SEQ ID NO: 81385 - DNA, 25 bp, E. coli
gaaattaaacctgccaaataataat

SEQ ID NO: 81386 - DNA, 25 bp, E. coli
gaaattaaacctcccaaataataat

SEQ ID NO: 81387 - DNA, 25 bp, E. coli
gttacttaaatgatgtaatttcgtg

SEQ ID NO: 81388 - DNA, 25 bp, E. coli
gttacttaaatgttgtaatttcgtg

SEQ ID NO: 81389 - DNA, 25 bp, E. coli
tgcgttaagaaattaaacctgccaa

SEQ ID NO: 81390 - DNA, 25 bp, E. coli
tgcgttaagaaaataaacctgccaa

SEQ ID NO: 81391 - DNA, 25 bp, E. coli
tacggcaagatcagtatcctggcgg

SEQ ID NO: 81392 - DNA, 25 bp, E. coli
taaattggctgactgtaccgcgcag

SEQ ID NO: 81393 - DNA, 25 bp, E. coli
taaattggctgagtgtaccgcgcag

SEQ ID NO: 81394 - DNA, 25 bp, E. coli
tacggcaagatctgtatcctggcgg

SEQ ID NO: 81395 - DNA, 25 bp, E. coli
acgccgcgatggtcagatctataac

SEQ ID NO: 81396 - DNA, 25 bp, E. coli
acgccgcgatggacagatctataac

SEQ ID NO: 81397 - DNA, 25 bp, E. coli
ttggctgactgtaccgcgcaggatc

SEQ ID NO: 81398 - DNA, 25 bp, E. coli
ttggctgactgttccgcgcaggatc

SEQ ID NO: 81399 - DNA, 25 bp, E. coli
tgtatcctggcgcatgctgactccg

SEQ ID NO: 81400 - DNA, 25 bp, E. coli
tgtatcctggcggatgctgactccg

SEQ ID NO: 81401 - DNA, 25 bp, E. coli
tgtaatcttacaagccgaccagtcg

SEQ ID NO: 81402 - DNA, 25 bp, E. coli
tgtaatcttacatgccgaccagtcg

SEQ ID NO: 81403 - DNA, 25 bp, E. coli
tcgttacggcaagatctgtatcctg

SEQ ID NO: 81404 - DNA, 25 bp, E. coli
tcgttacggcaacatctgtatcctg

SEQ ID NO: 81405 - DNA, 25 bp, E. coli
cgcaaaacgcgtcgatgtaatctta

SEQ ID NO: 81406 - DNA, 25 bp, E. coli
cgcaaaacgcgtggatgtaatctta

SEQ ID NO: 81407 - DNA, 25 bp, E. coli
cgtacgccgcgaaggtcagatctat

SEQ ID NO: 81408 - DNA, 25 bp, E. coli
cgtacgccgcgatggtcagatctat

SEQ ID NO: 81409 - DNA, 25 bp, E. coli
ggcgttgcctggtaaattggctgac

SEQ ID NO: 81410 - DNA, 25 bp, E. coli
tggcggatgctgactccgatggtct

SEQ ID NO: 81411 - DNA, 25 bp, E. coli
ggcgttgcctggaaaattggctgac

SEQ ID NO: 81412 - DNA, 25 bp, E. coli
tggcggatgctgtctccgatggtct

SEQ ID NO: 81413 - DNA, 25 bp, E. coli
agccttactggcctcagcagcactg

SEQ ID NO: 81414 - DNA, 25 bp, E. coli
agccttactggcgtcagcagcactg

SEQ ID NO: 81415 - DNA, 25 bp, E. coli
tgaaaaaactgcacccggccatgaa

SEQ ID NO: 81416 - DNA, 25 bp, E. coli
tgaaaaaactgctcccggccatgaa

SEQ ID NO: 81417 - DNA, 25 bp, E. coli
tcattgctgaaataactgctcccgg

SEQ ID NO: 81418 - DNA, 25 bp, E. coli
tcattgctgaaaaaactgctcccgg

SEQ ID NO: 81419 - DNA, 25 bp, E. coli
gcatatccggaaaccactggaggcg

SEQ ID NO: 81420 - DNA, 25 bp, E. coli
gcatatccggaatccactggaggcg

SEQ ID NO: 81421 - DNA, 25 bp, E. coli
gaaggcaaaagtcgcggtctgctca

SEQ ID NO: 81422 - DNA, 25 bp, E. coli
gaaggcaaaagtggcggtctgctca

SEQ ID NO: 81423 - DNA, 25 bp, E. coli
gaaagaagcctttctggcgtcagca

SEQ ID NO: 81424 - DNA, 25 bp, E. coli
gaaagaagccttactggcgtcagca

SEQ ID NO: 81425 - DNA, 25 bp, E. coli
gaaaaatgtacggtgatggtggtat

SEQ ID NO: 81426 - DNA, 25 bp, E. coli
gaaaaatgtacgctgatggtggtat

SEQ ID NO: 81427 - DNA, 25 bp, E. coli
cccacgggcagcagaaagaagcctt

SEQ ID NO: 81428 - DNA, 25 bp, E. coli
cccacgggcagctgaaagaagcctt

SEQ ID NO: 81429 - DNA, 25 bp, E. coli
ctgaaacaaacaggggaagaaggca

SEQ ID NO: 81430 - DNA, 25 bp, E. coli
ctgaaacaaacacgggaagaaggca

SEQ ID NO: 81431 - DNA, 25 bp, E. coli
tacagggaaaaatgtacggtgatgg

SEQ ID NO: 81432 - DNA, 25 bp, E. coli
tacagggaaaaaagtacggtgatgg

SEQ ID NO: 81433 - DNA, 25 bp, E. coli
gatgatctggctgacgggctaccgt

SEQ ID NO: 81434 - DNA, 25 bp, E. coli
gatgatctggctcacgggctaccgt

SEQ ID NO: 81435 - DNA, 25 bp, E. coli
caagtgcggcaagaacaatcggtgg

SEQ ID NO: 81436 - DNA, 25 bp, E. coli
caatcggtggaaaggctgcgtaagc

SEQ ID NO: 81437 - DNA, 25 bp, E. coli
caagtgcggcaacaacaatcggtgg

SEQ ID NO: 81438 - DNA, 25 bp, E. coli
caatcggtggaatggctgcgtaagc

SEQ ID NO: 81439 - DNA, 25 bp, E. coli
tattcgccgctttcgtcagggtgag

SEQ ID NO: 81440 - DNA, 25 bp, E. coli
tattcgccgcttacgtcagggtgag

SEQ ID NO: 81441 - DNA, 25 bp, E. coli
tcgggcagtcggaaacagaagtcgc

SEQ ID NO: 81442 - DNA, 25 bp, E. coli
tcgggcagtcggtaacagaagtcgc

SEQ ID NO: 81443 - DNA, 25 bp, E. coli
gaatcgatgagaactggcacgccat

SEQ ID NO: 81444 - DNA, 25 bp, E. coli
gaagtactgaatcacctgttcgcga

SEQ ID NO: 81445 - DNA, 25 bp, E. coli
gaagtactgaatgacctgttcgcga

SEQ ID NO: 81446 - DNA, 25 bp, E. coli
gaagatttcgatggctattaccgcc

SEQ ID NO: 81447 - DNA, 25 bp, E. coli
gaatcgatgagatctggcacgccat

SEQ ID NO: 81448 - DNA, 25 bp, E. coli
gaagatttcgatcgctattaccgcc

SEQ ID NO: 81449 - DNA, 25 bp, E. coli
cattgcccggcatatgtacgagagt

SEQ ID NO: 81450 - DNA, 25 bp, E. coli
cattgcccggcaaatgtacgagagt

SEQ ID NO: 81451 - DNA, 25 bp, E. coli
gataaaacccgcttgaatgacctgg

SEQ ID NO: 81452 - DNA, 25 bp, E. coli
gtaaatacgacgaatggcagccacg

SEQ ID NO: 81453 - DNA, 25 bp, E. coli
gataaaacccgcatgaatgacctgg

SEQ ID NO: 81454 - DNA, 25 bp, E. coli
ggttattgcggtcgatcccagcagc

SEQ ID NO: 81455 - DNA, 25 bp, E. coli
gtaaatacgacgtatggcagccacg

SEQ ID NO: 81456 - DNA, 25 bp, E. coli
ggttattgcggtggatcccagcagc

SEQ ID NO: 81457 - DNA, 25 bp, E. coli
cacacagagtgacgatgagggactt

SEQ ID NO: 81458 - DNA, 25 bp, E. coli
cacctgatggaccatttgaggcgct

SEQ ID NO: 81459 - DNA, 25 bp, E. coli
cacacagagtgaggatgagggactt

SEQ ID NO: 81460 - DNA, 25 bp, E. coli
cacctgatggacgatttgaggcgct

SEQ ID NO: 81461 - DNA, 25 bp, E. coli
ttcagttacgatgcgctggaccggc

SEQ ID NO: 81462 - DNA, 25 bp, E. coli
tttttatcagaaatagtgtcccggg

SEQ ID NO: 81463 - DNA, 25 bp, E. coli
tttttatcagaattagtgtcccggg

SEQ ID NO: 81464 - DNA, 25 bp, E. coli
ttcagttacgatccgctggaccggc

SEQ ID NO: 81465 - DNA, 25 bp, E. coli
tgaccctatgggattattgcagact

SEQ ID NO: 81466 - DNA, 25 bp, E. coli
tgaccctatgggtttattgcagact

SEQ ID NO: 81467 - DNA, 25 bp, E. coli
tcccacaggtacagatagagttgct

SEQ ID NO: 81468 - DNA, 25 bp, E. coli
tcccacaggtactgatagagttgct

SEQ ID NO: 81469 - DNA, 25 bp, E. coli
gcatcatgtgtatcagccgtaccgt

SEQ ID NO: 81470 - DNA, 25 bp, E. coli
gcttacagctacctgatgacggact

SEQ ID NO: 81471 - DNA, 25 bp, E. coli
gcttacagctacgtgatgacggact

SEQ ID NO: 81472 - DNA, 25 bp, E. coli
gcatcatgtgtaacagccgtaccgt

SEQ ID NO: 81473 - DNA, 25 bp, E. coli
gaagcattttatgtcgcaacacctg

SEQ ID NO: 81474 - DNA, 25 bp, E. coli
gaagcattttatctcgcaacacctg

SEQ ID NO: 81475 - DNA, 25 bp, E. coli
ggcagccacagcctcttcagttacg

SEQ ID NO: 81476 - DNA, 25 bp, E. coli
ggcagccacagcgtcttcagttacg

SEQ ID NO: 81477 - DNA, 25 bp, E. coli
tggcagcatgagtcgaaacacgcat

SEQ ID NO: 81478 - DNA, 25 bp, E. coli
tggcagcatgagacgaaacacgcat

SEQ ID NO: 81479 - DNA, 25 bp, E. coli
aaccgtcaatggttatggatcagca

SEQ ID NO: 81480 - DNA, 25 bp, E. coli
caaccccattgttatatctgaaagg

SEQ ID NO: 81481 - DNA, 25 bp, E. coli
caaccccattgtaatatctgaaagg

SEQ ID NO: 81482 - DNA, 25 bp, E. coli
tacaaaaccaggactctgtaacgtt

SEQ ID NO: 81483 - DNA, 25 bp, E. coli
tacaaaaccaggtctctgtaacgtt

SEQ ID NO: 81484 - DNA, 25 bp, E. coli
aaccgtcaatggatatggatcagca

SEQ ID NO: 81485 - DNA, 25 bp, E. coli
ttccggcacgcaatgtcggcaagcc

SEQ ID NO: 81486 - DNA, 25 bp, E. coli
ttccggcacgcattgtcggcaagcc

SEQ ID NO: 81487 - DNA, 25 bp, E. coli
tcggcaagccggatagcgataaacc

SEQ ID NO: 81488 - DNA, 25 bp, E. coli
tcggcaagccggttagcgataaacc

SEQ ID NO: 81489 - DNA, 25 bp, E. coli
gccgccgacccgcaaatgattgctt

SEQ ID NO: 81490 - DNA, 25 bp, E. coli
gccgccgacccggaaatgattgctt

SEQ ID NO: 81491 - DNA, 25 bp, E. coli
gcgctggctattattctacaaaacc

SEQ ID NO: 81492 - DNA, 25 bp, E. coli
gcgctggctatttttctacaaaacc

SEQ ID NO: 81493 - DNA, 25 bp, E. coli
gaaaggttttcaagctttgcaggcg

SEQ ID NO: 81494 - DNA, 25 bp, E. coli
gaaaggttttcatgctttgcaggcg

SEQ ID NO: 81495 - DNA, 25 bp, E. coli
cgacccggaaatcattgcttctgcg

SEQ ID NO: 81496 - DNA, 25 bp, E. coli
cgacccggaaatgattgcttctgcg

SEQ ID NO: 81497 - DNA, 25 bp, E. coli
ggatagcgataatccgtcaatggat

SEQ ID NO: 81498 - DNA, 25 bp, E. coli
ggatagcgataaaccgtcaatggat

SEQ ID NO: 81499 - DNA, 25 bp, E. coli
taacgttccaggttgatatacaccc

SEQ ID NO: 81500 - DNA, 25 bp, E. coli
taacgttccaggatgatatacaccc

SEQ ID NO: 81501 - DNA, 25 bp, E. coli
catcatggatgcacttaatagcggg

SEQ ID NO: 81502 - DNA, 25 bp, E. coli
catcatggatgctcttaatagcggg

SEQ ID NO: 81503 - DNA, 25 bp, E. coli
taccggatttccagttagcgttcaa

SEQ ID NO: 81504 - DNA, 25 bp, E. coli
taccggatttcctgttagcgttcaa

SEQ ID NO: 81505 - DNA, 25 bp, E. coli
gccattaaaaaaggcagtgcaaccg

SEQ ID NO: 81506 - DNA, 25 bp, E. coli
gccattaaaaaacgcagtgcaaccg

SEQ ID NO: 81507 - DNA, 25 bp, E. coli
gcagttaagaatccgcaggcctcta

SEQ ID NO: 81508 - DNA, 25 bp, E. coli
gaactctatcggtggcaaactggcg

SEQ ID NO: 81509 - DNA, 25 bp, E. coli
gaactctatcggaggcaaactggcg

SEQ ID NO: 81510 - DNA, 25 bp, E. coli
gcagttaagaatgcgcaggcctcta

SEQ ID NO: 81511 - DNA, 25 bp, E. coli
gacagcaatcgagcttggtggcccg

SEQ ID NO: 81512 - DNA, 25 bp, E. coli
gacagcaatcgaccttggtggcccg

SEQ ID NO: 81513 - DNA, 25 bp, E. coli
ccattccgtcgtttatggtcggcgc

SEQ ID NO: 81514 - DNA, 25 bp, E. coli
ccattccgtcgtatatggtcggcgc

SEQ ID NO: 81515 - DNA, 25 bp, E. coli
gatttcacgcatcgtgccgacctta

SEQ ID NO: 81516 - DNA, 25 bp, E. coli
gatttcacgcatggtgccgacctta

SEQ ID NO: 81517 - DNA, 25 bp, E. coli
gtcatgctggcgatgtactacgtca

SEQ ID NO: 81518 - DNA, 25 bp, E. coli
ggtgaactcccggagcatgtgatgt

SEQ ID NO: 81519 - DNA, 25 bp, E. coli
ggtgaactcccgcagcatgtgatgt

SEQ ID NO: 81520 - DNA, 25 bp, E. coli
gtcatgctggcgttgtactacgtca

SEQ ID NO: 81521 - DNA, 25 bp, E. coli
taattatgggcggtgtgatcctcgc

SEQ ID NO: 81522 - DNA, 25 bp, E. coli
taattatgggcgctgtgatcctcgc

SEQ ID NO: 81523 - DNA, 25 bp, E. coli
aaatgcaaattagaagtagatcaca

SEQ ID NO: 81524 - DNA, 25 bp, E. coli
aaatgcaaattacaagtagatcaca

SEQ ID NO: 81525 - DNA, 25 bp, E. coli
tatctcaatacaataaatcaagtta

SEQ ID NO: 81526 - DNA, 25 bp, E. coli
tagaagtagatctcaattatctcaa

SEQ ID NO: 81527 - DNA, 25 bp, E. coli
tatctcaatacattaaatcaagtta

SEQ ID NO: 81528 - DNA, 25 bp, E. coli
tagaagtagatcacaattatctcaa

SEQ ID NO: 81529 - DNA, 25 bp, E. coli
tttaacactcatcacattagttgac

SEQ ID NO: 81530 - DNA, 25 bp, E. coli
tttaacactcatgacattagttgac

SEQ ID NO: 81531 - DNA, 25 bp, E. coli
tgaaatgcattttctcatggctaaa

SEQ ID NO: 81532 - DNA, 25 bp, E. coli
tgaattgcagtgtaattcgacttaa

SEQ ID NO: 81533 - DNA, 25 bp, E. coli
tgaaatgcatttactcatggctaaa

SEQ ID NO: 81534 - DNA, 25 bp, E. coli
tgaattgcagtgaaattcgacttaa

SEQ ID NO: 81535 - DNA, 25 bp, E. coli
tcgacttaaatcatatgaaatgcat

SEQ ID NO: 81536 - DNA, 25 bp, E. coli
tcgacttaaatcttatgaaatgcat

SEQ ID NO: 81537 - DNA, 25 bp, E. coli
ccacgtcacaaaaatgcaaattaga

SEQ ID NO: 81538 - DNA, 25 bp, E. coli
ccacgtcacaaatatgcaaattaga

SEQ ID NO: 81539 - DNA, 25 bp, E. coli
gcatttactcatggctaaaaccacg

SEQ ID NO: 81540 - DNA, 25 bp, E. coli
gcatttactcatcgctaaaaccacg

SEQ ID NO: 81541 - DNA, 25 bp, E. coli
gacattagttgacataacacactga

SEQ ID NO: 81542 - DNA, 25 bp, E. coli
gacattagttgagataacacactga

SEQ ID NO: 81543 - DNA, 25 bp, E. coli
ggctaaaaccacgtcacaaaaatgc

SEQ ID NO: 81544 - DNA, 25 bp, E. coli
ggctaaaaccacctcacaaaaatgc

SEQ ID NO: 81545 - DNA, 25 bp, E. coli
cagaaattgcgccagtaccaggaca

SEQ ID NO: 81546 - DNA, 25 bp, E. coli
cagaaattgcgcgagtaccaggaca

SEQ ID NO: 81547 - DNA, 25 bp, E. coli
tttaccatcgtcatcttagcccgga

SEQ ID NO: 81548 - DNA, 25 bp, E. coli
tttaccatcgtcttcttagcccgga

SEQ ID NO: 81549 - DNA, 25 bp, E. coli
tgattatcatgatcgtcgcggcgca

SEQ ID NO: 81550 - DNA, 25 bp, E. coli
tgattatcatgaacgtcgcggcgca

SEQ ID NO: 81551 - DNA, 25 bp, E. coli
tgcttgacgatcagcgccgtatgat

SEQ ID NO: 81552 - DNA, 25 bp, E. coli
tgcttgacgatctgcgccgtatgat

SEQ ID NO: 81553 - DNA, 25 bp, E. coli
tccgcgatcggccattaaaacgaat

SEQ ID NO: 81554 - DNA, 25 bp, E. coli
tccagttatggaaaaaccgaagcgc

SEQ ID NO: 81555 - DNA, 25 bp, E. coli
tccagttatggataaaccgaagcgc

SEQ ID NO: 81556 - DNA, 25 bp, E. coli
tccgcgatcggcgattaaaacgaat

SEQ ID NO: 81557 - DNA, 25 bp, E. coli
tctggaccagccctaaagaacgatc

SEQ ID NO: 81558 - DNA, 25 bp, E. coli
tctgcgcagcatattgccgatgaag

SEQ ID NO: 81559 - DNA, 25 bp, E. coli
tctggaccagccgtaaagaacgatc

SEQ ID NO: 81560 - DNA, 25 bp, E. coli
tctgcgcagcattttgccgatgaag

SEQ ID NO: 81561 - DNA, 25 bp, E. coli
gccgtatgatgactccgcagaaatt

SEQ ID NO: 81562 - DNA, 25 bp, E. coli
gccgtatgatgagtccgcagaaatt

SEQ ID NO: 81563 - DNA, 25 bp, E. coli
gaaggatttcacaactccgggtgtc

SEQ ID NO: 81564 - DNA, 25 bp, E. coli
gaaggatttcactactccgggtgtc

SEQ ID NO: 81565 - DNA, 25 bp, E. coli
ggtagcgagctaaacggtgaactgc

SEQ ID NO: 81566 - DNA, 25 bp, E. coli
ggtagcgagctatacggtgaactgc

SEQ ID NO: 81567 - DNA, 25 bp, E. coli
aatgttgcactggtgtcattcgcgc

SEQ ID NO: 81568 - DNA, 25 bp, E. coli
aatgttgcactgctgtcattcgcgc

SEQ ID NO: 81569 - DNA, 25 bp, E. coli
aacgtgacttactgcacccggtacg

SEQ ID NO: 81570 - DNA, 25 bp, E. coli
aacgtgacttacagcacccggtacg

SEQ ID NO: 81571 - DNA, 25 bp, E. coli
tgcttacccattgcggcgtcagcgg

SEQ ID NO: 81572 - DNA, 25 bp, E. coli
tgcttacccattccggcgtcagcgg

SEQ ID NO: 81573 - DNA, 25 bp, E. coli
tccgcgcagggaaagggcttatttc

SEQ ID NO: 81574 - DNA, 25 bp, E. coli
tccgcgcagggatagggcttatttc

SEQ ID NO: 81575 - DNA, 25 bp, E. coli
tgccgaaagccggtggcgatctctt

SEQ ID NO: 81576 - DNA, 25 bp, E. coli
tgccgaaagccgctggcgatctctt

SEQ ID NO: 81577 - DNA, 25 bp, E. coli
tcatttgctgagattaatcaggccg

SEQ ID NO: 81578 - DNA, 25 bp, E. coli
tcatttgctgagtttaatcaggccg

SEQ ID NO: 81579 - DNA, 25 bp, E. coli
cgacaaaccgctgggtaacgccatt

SEQ ID NO: 81580 - DNA, 25 bp, E. coli
cgacaaaccgctcggtaacgccatt

SEQ ID NO: 81581 - DNA, 25 bp, E. coli
gtacgcaccctgctgccggatatgg

SEQ ID NO: 81582 - DNA, 25 bp, E. coli
gtacgcaccctggtgccggatatgg

SEQ ID NO: 81583 - DNA, 25 bp, E. coli
ggttatcacgccgacatcaaggagc

SEQ ID NO: 81584 - DNA, 25 bp, E. coli
ggttatcacgcccacatcaaggagc

SEQ ID NO: 81585 - DNA, 25 bp, E. coli
taacgccattttgtcctcggatcgc

SEQ ID NO: 81586 - DNA, 25 bp, E. coli
taacgccattttctcctcggatcgc

SEQ ID NO: 81587 - DNA, 25 bp, E. coli
taatcaggccgtagccagtttgccg

SEQ ID NO: 81588 - DNA, 25 bp, E. coli
taatcaggccgttgccagtttgccg

SEQ ID NO: 81589 - DNA, 25 bp, E. coli
agtttgtcggcgctgtgtctatcga

SEQ ID NO: 81590 - DNA, 25 bp, E. coli
agtttgtcggcggtgtgtctatcga

SEQ ID NO: 81591 - DNA, 25 bp, E. coli
tgtctatcgattcgcttaaagccgc

SEQ ID NO: 81592 - DNA, 25 bp, E. coli
tgtcggcgctgtgtctatcgattcg

SEQ ID NO: 81593 - DNA, 25 bp, E. coli
tgtcggcgctgtctctatcgattcg

SEQ ID NO: 81594 - DNA, 25 bp, E. coli
tgtctatcgattggcttaaagccgc

SEQ ID NO: 81595 - DNA, 25 bp, E. coli
tgcaggttggtacaccggatgaaat

SEQ ID NO: 81596 - DNA, 25 bp, E. coli
tgcaggttggtagaccggatgaaat

SEQ ID NO: 81597 - DNA, 25 bp, E. coli
tgcccgtcgtactccgaacggctta

SEQ ID NO: 81598 - DNA, 25 bp, E. coli
tgcccgtcgtacaccgaacggctta

SEQ ID NO: 81599 - DNA, 25 bp, E. coli
gcgctgtgtctaacgattcgcttaa

SEQ ID NO: 81600 - DNA, 25 bp, E. coli
gcgctgtgtctatcgattcgcttaa

SEQ ID NO: 81601 - DNA, 25 bp, E. coli
ccgtggcgtcgatattagccaggtg

SEQ ID NO: 81602 - DNA, 25 bp, E. coli
ccgtggcgtcgaaattagccaggtg

SEQ ID NO: 81603 - DNA, 25 bp, E. coli
cgatattagccaggtgttcagtgcg

SEQ ID NO: 81604 - DNA, 25 bp, E. coli
cgatattagccacgtgttcagtgcg

SEQ ID NO: 81605 - DNA, 25 bp, E. coli
gatattgcccgtggtacaccgaacg

SEQ ID NO: 81606 - DNA, 25 bp, E. coli
gatattgcccgtcgtacaccgaacg

SEQ ID NO: 81607 - DNA, 25 bp, E. coli
gtcgtacaccgaacggcttaattcg

SEQ ID NO: 81608 - DNA, 25 bp, E. coli
gtcgtacaccgatcggcttaattcg

SEQ ID NO: 81609 - DNA, 25 bp, E. coli
ggcgtcgatattagccaggtgttca

SEQ ID NO: 81610 - DNA, 25 bp, E. coli
ggcgtcgatatttgccaggtgttca

SEQ ID NO: 81611 - DNA, 25 bp, E. coli
caagaatggcaaaaggacaagagat

SEQ ID NO: 81612 - DNA, 25 bp, E. coli
caagaatggcaataggacaagagat

SEQ ID NO: 81613 - DNA, 25 bp, E. coli
cacagccaattgcagttctttttaa

SEQ ID NO: 81614 - DNA, 25 bp, E. coli
cacagccaattggagttctttttaa

SEQ ID NO: 81615 - DNA, 25 bp, E. coli
caacatttacaacaaggctgcctga

SEQ ID NO: 81616 - DNA, 25 bp, E. coli
caacatttacaagaaggctgcctga

SEQ ID NO: 81617 - DNA, 25 bp, E. coli
tatggcgctccatctaattacttac

SEQ ID NO: 81618 - DNA, 25 bp, E. coli
tatggcgctccaactaattacttac

SEQ ID NO: 81619 - DNA, 25 bp, E. coli
ttttaaaacaatcggtgcgtgggct

SEQ ID NO: 81620 - DNA, 25 bp, E. coli
ttttaaaacaatgggtgcgtgggct

SEQ ID NO: 81621 - DNA, 25 bp, E. coli
gctgttttatgcttcgccgctgacg

SEQ ID NO: 81622 - DNA, 25 bp, E. coli
gctgttttatgcatcgccgctgacg

SEQ ID NO: 81623 - DNA, 25 bp, E. coli
gacaagagatggtgatggacccgac

SEQ ID NO: 81624 - DNA, 25 bp, E. coli
gacaagagatggagatggacccgac

SEQ ID NO: 81625 - DNA, 25 bp, E. coli
ctgacgacactgtcgcaagaatggc

SEQ ID NO: 81626 - DNA, 25 bp, E. coli
ctgacgacactgacgcaagaatggc

SEQ ID NO: 81627 - DNA, 25 bp, E. coli
gatttgtgattttcgcgctaacgca

SEQ ID NO: 81628 - DNA, 25 bp, E. coli
gatttgtgatttacgcgctaacgca

SEQ ID NO: 81629 - DNA, 25 bp, E. coli
tggacccgacaaacgatgaattcat

SEQ ID NO: 81630 - DNA, 25 bp, E. coli
tggacccgacaatcgatgaattcat

SEQ ID NO: 81631 - DNA, 25 bp, E. coli
taacgcaaattcagtaaaaccacag

SEQ ID NO: 81632 - DNA, 25 bp, E. coli
taacgcaaattctgtaaaaccacag

SEQ ID NO: 81633 - DNA, 25 bp, E. coli
caacccgatctttcgctgttacgtg

SEQ ID NO: 81634 - DNA, 25 bp, E. coli
caacccgatcttacgctgttacgtg

SEQ ID NO: 81635 - DNA, 25 bp, E. coli
cgaacaacccgatctttcgctgtta

SEQ ID NO: 81636 - DNA, 25 bp, E. coli
cattactcttatttgtcgaacaacc

SEQ ID NO: 81637 - DNA, 25 bp, E. coli
cattactcttatatgtcgaacaacc

SEQ ID NO: 81638 - DNA, 25 bp, E. coli
cgaacaacccgaactttcgctgtta

SEQ ID NO: 81639 - DNA, 25 bp, E. coli
catcattactcttatttgtcgaaca

SEQ ID NO: 81640 - DNA, 25 bp, E. coli
catcattactctaatttgtcgaaca

SEQ ID NO: 81641 - DNA, 25 bp, E. coli
tactcttatttgacgaacaacccga

SEQ ID NO: 81642 - DNA, 25 bp, E. coli
tactcttatttgtcgaacaacccga

SEQ ID NO: 81643 - DNA, 25 bp, E. coli
aacaacccgatctttcgctgttacg

SEQ ID NO: 81644 - DNA, 25 bp, E. coli
aacaacccgatcattcgctgttacg

SEQ ID NO: 81645 - DNA, 25 bp, E. coli
ttactcttatttctcgaacaacccg

SEQ ID NO: 81646 - DNA, 25 bp, E. coli
ttactcttatttgtcgaacaacccg

SEQ ID NO: 81647 - DNA, 25 bp, E. coli
tcttatttgtcgtacaacccgatct

SEQ ID NO: 81648 - DNA, 25 bp, E. coli
tcttatttgtcgaacaacccgatct

SEQ ID NO: 81649 - DNA, 25 bp, E. coli
ccatcattactcttatttgtcgaac

SEQ ID NO: 81650 - DNA, 25 bp, E. coli
ccatcattactcatatttgtcgaac

SEQ ID NO: 81651 - DNA, 25 bp, E. coli
cttatttgtcgatcaacccgatctt

SEQ ID NO: 81652 - DNA, 25 bp, E. coli
cttatttgtcgaacaacccgatctt

SEQ ID NO: 81653 - DNA, 25 bp, E. coli
gtcgaacaacccgatctttcgctgt

SEQ ID NO: 81654 - DNA, 25 bp, E. coli
gtcgaacaaccccatctttcgctgt

SEQ ID NO: 81655 - DNA, 25 bp, E. coli
catcatcgcatttgccagacgcgat

SEQ ID NO: 81656 - DNA, 25 bp, E. coli
catcatcgcattagccagacgcgat

SEQ ID NO: 81657 - DNA, 25 bp, E. coli
catcgcattagccagacgcgatgat

SEQ ID NO: 81658 - DNA, 25 bp, E. coli
catcgcattagcgagacgcgatgat

SEQ ID NO: 81659 - DNA, 25 bp, E. coli
taacatcatcgctttagccagacgc

SEQ ID NO: 81660 - DNA, 25 bp, E. coli
acatcatcgcattagccagacgcga

SEQ ID NO: 81661 - DNA, 25 bp, E. coli
acatcatcgcataagccagacgcga

SEQ ID NO: 81662 - DNA, 25 bp, E. coli
aacatcatcgcaatagccagacgcg

SEQ ID NO: 81663 - DNA, 25 bp, E. coli
aacatcatcgcattagccagacgcg

SEQ ID NO: 81664 - DNA, 25 bp, E. coli
tattaacatcatggcattagccaga

SEQ ID NO: 81665 - DNA, 25 bp, E. coli
tattaacatcatcgcattagccaga

SEQ ID NO: 81666 - DNA, 25 bp, E. coli
ttaacatcatcgcattagccagacg

SEQ ID NO: 81667 - DNA, 25 bp, E. coli
ttaacatcatcggattagccagacg

SEQ ID NO: 81668 - DNA, 25 bp, E. coli
ttattaacatcaacgcattagccag

SEQ ID NO: 81669 - DNA, 25 bp, E. coli
ttattaacatcatcgcattagccag

SEQ ID NO: 81670 - DNA, 25 bp, E. coli
tgttattaacatgatcgcattagcc

SEQ ID NO: 81671 - DNA, 25 bp, E. coli
tgttattaacatcatcgcattagcc

SEQ ID NO: 81672 - DNA, 25 bp, E. coli
tcgcattagccagacgcgatgatgt

SEQ ID NO: 81673 - DNA, 25 bp, E. coli
tcgcattagccacacgcgatgatgt

SEQ ID NO: 81674 - DNA, 25 bp, E. coli
cgcattagccagtcgcgatgatgtt

SEQ ID NO: 81675 - DNA, 25 bp, E. coli
cgcattagccagacgcgatgatgtt

SEQ ID NO: 81676 - DNA, 25 bp, E. coli
taacatcatcgcattagccagacgc

SEQ ID NO: 81677 - DNA, 25 bp, E. coli
catgctggtgatgaatgacggcttc

SEQ ID NO: 81678 - DNA, 25 bp, E. coli
catgctggtgatcaatgacggcttc

SEQ ID NO: 81679 - DNA, 25 bp, E. coli
taccgatggtggtaaaagacgcagt

SEQ ID NO: 81680 - DNA, 25 bp, E. coli
taccgatggtggaaaaagacgcagt

SEQ ID NO: 81681 - DNA, 25 bp, E. coli
tatggaaatgcactgtgacaggacg

SEQ ID NO: 81682 - DNA, 25 bp, E. coli
tatggaaatgcagtgtgacaggacg

SEQ ID NO: 81683 - DNA, 25 bp, E. coli
tatacccactgccagaacgggcaga

SEQ ID NO: 81684 - DNA, 25 bp, E. coli
tatacccactgcgagaacgggcaga

SEQ ID NO: 81685 - DNA, 25 bp, E. coli
tccagaggccagcagtctatatccg

SEQ ID NO: 81686 - DNA, 25 bp, E. coli
tccagaggccaggagtctatatccg

SEQ ID NO: 81687 - DNA, 25 bp, E. coli
gcttatgaattgttccgtcccggag

SEQ ID NO: 81688 - DNA, 25 bp, E. coli
gcttatgaattgatccgtcccggag

SEQ ID NO: 81689 - DNA, 25 bp, E. coli
gcagttatacccagaatccgaccgg

SEQ ID NO: 81690 - DNA, 25 bp, E. coli
gcagttataccctgaatccgaccgg

SEQ ID NO: 81691 - DNA, 25 bp, E. coli
ccggtgccacgagggattatgacat

SEQ ID NO: 81692 - DNA, 25 bp, E. coli
ccggtgccacgacggattatgacat

SEQ ID NO: 81693 - DNA, 25 bp, E. coli
ggtccgccgcaggtgatatttcgca

SEQ ID NO: 81694 - DNA, 25 bp, E. coli
ggtccgccgcagctgatatttcgca

SEQ ID NO: 81695 - DNA, 25 bp, E. coli
tggagccagttcaaccttcagagag

SEQ ID NO: 81696 - DNA, 25 bp, E. coli
tggagccagttctaccttcagagag

SEQ ID NO: 81697 - DNA, 25 bp, E. coli
tcaatgtgccacgaccggtttatgg

SEQ ID NO: 81698 - DNA, 25 bp, E. coli
tcaatgtgccaccaccggtttatgg

SEQ ID NO: 81699 - DNA, 25 bp, E. coli
aattttcagccgatcactagaagcg

SEQ ID NO: 81700 - DNA, 25 bp, E. coli
aattttcagccgttcactagaagcg

SEQ ID NO: 81701 - DNA, 25 bp, E. coli
cactacagttgggatggcgtaactc

SEQ ID NO: 81702 - DNA, 25 bp, E. coli
cactacagttggcatggcgtaactc

SEQ ID NO: 81703 - DNA, 25 bp, E. coli
taaaagaacctaagactgcagactc

SEQ ID NO: 81704 - DNA, 25 bp, E. coli
taaaagaacctatgactgcagactc

SEQ ID NO: 81705 - DNA, 25 bp, E. coli
tatgctgggcgtttcgtccctgaca

SEQ ID NO: 81706 - DNA, 25 bp, E. coli
tatgttaggaaggataccgcctgaa

SEQ ID NO: 81707 - DNA, 25 bp, E. coli
tatgctgggcgtatcgtccctgaca

SEQ ID NO: 81708 - DNA, 25 bp, E. coli
tatgttaggaagcataccgcctgaa

SEQ ID NO: 81709 - DNA, 25 bp, E. coli
tattcatagggtaggattcagtcgc

SEQ ID NO: 81710 - DNA, 25 bp, E. coli
tattcatagggttggattcagtcgc

SEQ ID NO: 81711 - DNA, 25 bp, E. coli
tgtatcaggttggtcagcgtaccaa

SEQ ID NO: 81712 - DNA, 25 bp, E. coli
tgtatcaggttgctcagcgtaccaa

SEQ ID NO: 81713 - DNA, 25 bp, E. coli
gaagcgaacttattatctcccctga

SEQ ID NO: 81714 - DNA, 25 bp, E. coli
gaagcgaacttaatatctcccctga

SEQ ID NO: 81715 - DNA, 25 bp, E. coli
cattcgaaaaataggccgctgctca

SEQ ID NO: 81716 - DNA, 25 bp, E. coli
cattcgaaaaattggccgctgctca

SEQ ID NO: 81717 - DNA, 25 bp, E. coli
ggtgcatatcaacgcaatgtcaggg

SEQ ID NO: 81718 - DNA, 25 bp, E. coli
ggtgcatatcaaggcaatgtcaggg

SEQ ID NO: 81719 - DNA, 25 bp, E. coli
taagcgagctcctcaggcaagagtg

SEQ ID NO: 81720 - DNA, 25 bp, E. coli
taagcgagctccacaggcaagagtg

SEQ ID NO: 81721 - DNA, 25 bp, E. coli
catggagaacgccaactctacggaa

SEQ ID NO: 81722 - DNA, 25 bp, E. coli
catggagaacgcgaactctacggaa

SEQ ID NO: 81723 - DNA, 25 bp, E. coli
tactatgagcccaatccaacacggg

SEQ ID NO: 81724 - DNA, 25 bp, E. coli
tactatgagccctatccaacacggg

SEQ ID NO: 81725 - DNA, 25 bp, E. coli
tagaaggcatgaatacgaccgcgcg

SEQ ID NO: 81726 - DNA, 25 bp, E. coli
tagaaggcatgattacgaccgcgcg

SEQ ID NO: 81727 - DNA, 25 bp, E. coli
tgttcgttactgtagacggcgctga

SEQ ID NO: 81728 - DNA, 25 bp, E. coli
tgtgccagactgtaagtacccggtt

SEQ ID NO: 81729 - DNA, 25 bp, E. coli
tgtgccagactgaaagtacccggtt

SEQ ID NO: 81730 - DNA, 25 bp, E. coli
tgttcgttactgaagacggcgctga

SEQ ID NO: 81731 - DNA, 25 bp, E. coli
tctgcgtaaagatcgccgcggtgac

SEQ ID NO: 81732 - DNA, 25 bp, E. coli
tctgcgtaaagaacgccgcggtgac

SEQ ID NO: 81733 - DNA, 25 bp, E. coli
gaactatattttagtgaccggcggg

SEQ ID NO: 81734 - DNA, 25 bp, E. coli
gaactatatttttgtgaccggcggg

SEQ ID NO: 81735 - DNA, 25 bp, E. coli
ctctctgggtaaaggcattgccgca

SEQ ID NO: 81736 - DNA, 25 bp, E. coli
ctctctgggtaatggcattgccgca

SEQ ID NO: 81737 - DNA, 25 bp, E. coli
gattacgctcgccatgttgccaaca

SEQ ID NO: 81738 - DNA, 25 bp, E. coli
gattacgctcgcgatgttgccaaca

SEQ ID NO: 81739 - DNA, 25 bp, E. coli
tggcagcgtctgctgaagtcaaaac

SEQ ID NO: 81740 - DNA, 25 bp, E. coli
tggcagcgtctggtgaagtcaaaac

SEQ ID NO: 81741 - DNA, 25 bp, E. coli
tcacaagatgttgaaacgcgcggcg

SEQ ID NO: 81742 - DNA, 25 bp, E. coli
tcacaagatgttcaaacgcgcggcg

SEQ ID NO: 81743 - DNA, 25 bp, E. coli
cagcatccggcggagattattgccg

SEQ ID NO: 81744 - DNA, 25 bp, E. coli
cagcatccggcgcagattattgccg

SEQ ID NO: 81745 - DNA, 25 bp, E. coli
cagccgccctggtttgggccatttc

SEQ ID NO: 81746 - DNA, 25 bp, E. coli
cttaacggcaaaccccgcattttcg

SEQ ID NO: 81747 - DNA, 25 bp, E. coli
cagccgccctggattgggccatttc

SEQ ID NO: 81748 - DNA, 25 bp, E. coli
cttaacggcaaagcccgcattttcg

SEQ ID NO: 81749 - DNA, 25 bp, E. coli
agatccgttttttattccgctggcg

SEQ ID NO: 81750 - DNA, 25 bp, E. coli
agatccgtttttaattccgctggcg

SEQ ID NO: 81751 - DNA, 25 bp, E. coli
ttgttgcctggcgagccgccctggt

SEQ ID NO: 81752 - DNA, 25 bp, E. coli
ttgttgcctggccagccgccctggt

SEQ ID NO: 81753 - DNA, 25 bp, E. coli
ttttaattccgctggcgggcataac

SEQ ID NO: 81754 - DNA, 25 bp, E. coli
ttttaattccgcaggcgggcataac

SEQ ID NO: 81755 - DNA, 25 bp, E. coli
gctgcaaagggtgccgggcatcgcg

SEQ ID NO: 81756 - DNA, 25 bp, E. coli
gctgcaaagggtcccgggcatcgcg

SEQ ID NO: 81757 - DNA, 25 bp, E. coli
ccgcattttcgccagtggcagtgcg

SEQ ID NO: 81758 - DNA, 25 bp, E. coli
ccgcattttcgcgagtggcagtgcg

SEQ ID NO: 81759 - DNA, 25 bp, E. coli
ctggcgggcataacacgagacaacc

SEQ ID NO: 81760 - DNA, 25 bp, E. coli
ctggcgggcatatcacgagacaacc

SEQ ID NO: 81761 - DNA, 25 bp, E. coli
gattattgccgggttaacaggatat

SEQ ID NO: 81762 - DNA, 25 bp, E. coli
gattattgccggcttaacaggatat

SEQ ID NO: 81763 - DNA, 25 bp, E. coli
taatttcagccgataatgtgcaggg

SEQ ID NO: 81764 - DNA, 25 bp, E. coli
taatttcagccgttaatgtgcaggg

SEQ ID NO: 81765 - DNA, 25 bp, E. coli
taaaccttccgattctctggcgtgg

SEQ ID NO: 81766 - DNA, 25 bp, E. coli
taaaccttccgaatctctggcgtgg

SEQ ID NO: 81767 - DNA, 25 bp, E. coli
tttttatccgtagcccgtgcagaga

SEQ ID NO: 81768 - DNA, 25 bp, E. coli
tttttatccgtaccccgtgcagaga

SEQ ID NO: 81769 - DNA, 25 bp, E. coli
tgaaacccgcgcattaagtacaggc

SEQ ID NO: 81770 - DNA, 25 bp, E. coli
tgaaacccgcgctttaagtacaggc

SEQ ID NO: 81771 - DNA, 25 bp, E. coli
tctggaactgcctcaggacgacgat

SEQ ID NO: 81772 - DNA, 25 bp, E. coli
tctggaactgccacaggacgacgat

SEQ ID NO: 81773 - DNA, 25 bp, E. coli
gccttaacgatgcagagggcgcaaa

SEQ ID NO: 81774 - DNA, 25 bp, E. coli
gccttaacgatggagagggcgcaaa

SEQ ID NO: 81775 - DNA, 25 bp, E. coli
gaaacaggtgttggcaccagaccgg

SEQ ID NO: 81776 - DNA, 25 bp, E. coli
gaacggtgattagatctggcgcgac

SEQ ID NO: 81777 - DNA, 25 bp, E. coli
gaaacaggtgttcgcaccagaccgg

SEQ ID NO: 81778 - DNA, 25 bp, E. coli
gaacggtgattacatctggcgcgac

SEQ ID NO: 81779 - DNA, 25 bp, E. coli
tggacatcctttcatggctgacggg

SEQ ID NO: 81780 - DNA, 25 bp, E. coli
tggacatcctttgatggctgacggg

SEQ ID NO: 81781 - DNA, 25 bp, E. coli
tcagaaggtgaagaacgcgaacggt

SEQ ID NO: 81782 - DNA, 25 bp, E. coli
tcagaaggtgaacaacgcgaacggt

SEQ ID NO: 81783 - DNA, 25 bp, E. coli
gagattggcgactccttcacggaaa

SEQ ID NO: 81784 - DNA, 25 bp, E. coli
gacccgctgatccacctgaaatttg

SEQ ID NO: 81785 - DNA, 25 bp, E. coli
gagattggcgacaccttcacggaaa

SEQ ID NO: 81786 - DNA, 25 bp, E. coli
gacccgctgatcgacctgaaatttg

SEQ ID NO: 81787 - DNA, 25 bp, E. coli
aatcacgatagcagccgatggaaca

SEQ ID NO: 81788 - DNA, 25 bp, E. coli
aatcacgatagctgccgatggaaca

SEQ ID NO: 81789 - DNA, 25 bp, E. coli
cacgatagctgcggatggaacaatc

SEQ ID NO: 81790 - DNA, 25 bp, E. coli
cacgatagctgccgatggaacaatc

SEQ ID NO: 81791 - DNA, 25 bp, E. coli
atcacgatagctgccgatggaacaa

SEQ ID NO: 81792 - DNA, 25 bp, E. coli
acgatagctgcccatggaacaatct

SEQ ID NO: 81793 - DNA, 25 bp, E. coli
acgatagctgccgatggaacaatct

SEQ ID NO: 81794 - DNA, 25 bp, E. coli
atcacgatagctcccgatggaacaa

SEQ ID NO: 81795 - DNA, 25 bp, E. coli
aaatcacgataggtgccgatggaac

SEQ ID NO: 81796 - DNA, 25 bp, E. coli
aaatcacgatagctgccgatggaac

SEQ ID NO: 81797 - DNA, 25 bp, E. coli
tcacgatagctgccgatggaacaat

SEQ ID NO: 81798 - DNA, 25 bp, E. coli
gaaatcacgatagctgccgatggaa

SEQ ID NO: 81799 - DNA, 25 bp, E. coli
gaaatcacgatacctgccgatggaa

SEQ ID NO: 81800 - DNA, 25 bp, E. coli
cgatagctgccgttggaacaatctc

SEQ ID NO: 81801 - DNA, 25 bp, E. coli
cgatagctgccgatggaacaatctc

SEQ ID NO: 81802 - DNA, 25 bp, E. coli
gatagctgccgaaggaacaatctcg

SEQ ID NO: 81803 - DNA, 25 bp, E. coli
gatagctgccgatggaacaatctcg

SEQ ID NO: 81804 - DNA, 25 bp, E. coli
ggaaatcacgattgctgccgatgga

SEQ ID NO: 81805 - DNA, 25 bp, E. coli
ggaaatcacgatagctgccgatgga

SEQ ID NO: 81806 - DNA, 25 bp, E. coli
tcacgatagctggcgatggaacaat

SEQ ID NO: 81807 - DNA, 25 bp, E. coli
attatgaaaactgaaggcctgaaac

SEQ ID NO: 81808 - DNA, 25 bp, E. coli
atgaaaactgaaggcctgaaacagg

SEQ ID NO: 81809 - DNA, 25 bp, E. coli
attatgaaaactcaaggcctgaaac

SEQ ID NO: 81810 - DNA, 25 bp, E. coli
atgaaaactgaacgcctgaaacagg

SEQ ID NO: 81811 - DNA, 25 bp, E. coli
aaaactgaaggcgtgaaacaggcgc

SEQ ID NO: 81812 - DNA, 25 bp, E. coli
aaactgaaggcctgaaacaggcgct

SEQ ID NO: 81813 - DNA, 25 bp, E. coli
aaactgaaggccagaaacaggcgct

SEQ ID NO: 81814 - DNA, 25 bp, E. coli
aactgaaggcctcaaacaggcgctg

SEQ ID NO: 81815 - DNA, 25 bp, E. coli
aactgaaggcctgaaacaggcgctg

SEQ ID NO: 81816 - DNA, 25 bp, E. coli
aaaactgaaggcctgaaacaggcgc

SEQ ID NO: 81817 - DNA, 25 bp, E. coli
tatgaaaactgatggcctgaaacag

SEQ ID NO: 81818 - DNA, 25 bp, E. coli
tatgaaaactgaaggcctgaaacag

SEQ ID NO: 81819 - DNA, 25 bp, E. coli
tattatgaaaactgaaggcctgaaa

SEQ ID NO: 81820 - DNA, 25 bp, E. coli
tattatgaaaacagaaggcctgaaa

SEQ ID NO: 81821 - DNA, 25 bp, E. coli
ttgaccgcgacctggcggggtctat

SEQ ID NO: 81822 - DNA, 25 bp, E. coli
ttgaccgcgaccaggcggggtctat

SEQ ID NO: 81823 - DNA, 25 bp, E. coli
ttatgaaaactgtaggcctgaaaca

SEQ ID NO: 81824 - DNA, 25 bp, E. coli
ttatgaaaactgaaggcctgaaaca

SEQ ID NO: 81825 - DNA, 25 bp, E. coli
tgaaggcctgaatcaggcgctgaac

SEQ ID NO: 81826 - DNA, 25 bp, E. coli
tgaaggcctgaaacaggcgctgaac

SEQ ID NO: 81827 - DNA, 25 bp, E. coli
ccaggcggggtctatggagctgaaa

SEQ ID NO: 81828 - DNA, 25 bp, E. coli
ccaggcggggtcaatggagctgaaa

SEQ ID NO: 81829 - DNA, 25 bp, E. coli
tacaagtcattagccgtaggcctga

SEQ ID NO: 81830 - DNA, 25 bp, E. coli
tacaagtcattacccgtaggcctga

SEQ ID NO: 81831 - DNA, 25 bp, E. coli
agggatcacgatccagaacagcgct

SEQ ID NO: 81832 - DNA, 25 bp, E. coli
agggatcacgatgcagaacagcgct

SEQ ID NO: 81833 - DNA, 25 bp, E. coli
acatcactgtgcctggtagtatcca

SEQ ID NO: 81834 - DNA, 25 bp, E. coli
aaagatgcttaagggatcacgatgc

SEQ ID NO: 81835 - DNA, 25 bp, E. coli
aaagatgcttaacggatcacgatgc

SEQ ID NO: 81836 - DNA, 25 bp, E. coli
acatcactgtgcgtggtagtatcca

SEQ ID NO: 81837 - DNA, 25 bp, E. coli
tatccacggcgaagtaagcataaaa

SEQ ID NO: 81838 - DNA, 25 bp, E. coli
tagacaagagctcgcaagtgaaccc

SEQ ID NO: 81839 - DNA, 25 bp, E. coli
tatccacggcgatgtaagcataaaa

SEQ ID NO: 81840 - DNA, 25 bp, E. coli
tagacaagagctggcaagtgaaccc

SEQ ID NO: 81841 - DNA, 25 bp, E. coli
ttaaaggttccttcgcgagccacta

SEQ ID NO: 81842 - DNA, 25 bp, E. coli
ttaaaggttcctacgcgagccacta

SEQ ID NO: 81843 - DNA, 25 bp, E. coli
tcgcgagccacttcgtagacaagag

SEQ ID NO: 81844 - DNA, 25 bp, E. coli
tcgcgagccactacgtagacaagag

SEQ ID NO: 81845 - DNA, 25 bp, E. coli
gcgtaacaaagatatgcaggaaatc

SEQ ID NO: 81846 - DNA, 25 bp, E. coli
gcgtaacaaagaaatgcaggaaatc

SEQ ID NO: 81847 - DNA, 25 bp, E. coli
cgcagcgcatcacgcgtaacaaaga

SEQ ID NO: 81848 - DNA, 25 bp, E. coli
cgcagcgcatcaggcgtaacaaaga

SEQ ID NO: 81849 - DNA, 25 bp, E. coli
taaaaactgcccgtgacactaagac

SEQ ID NO: 81850 - DNA, 25 bp, E. coli
taaaaactgcccctgacactaagac

SEQ ID NO: 81851 - DNA, 25 bp, E. coli
taaagacgcgatattttcaccgtgc

SEQ ID NO: 81852 - DNA, 25 bp, E. coli
taaagacgcgattttttcaccgtgc

SEQ ID NO: 81853 - DNA, 25 bp, E. coli
accgtccgacagctattgccagaga

SEQ ID NO: 81854 - DNA, 25 bp, E. coli
accgtccgacaggtattgccagaga

SEQ ID NO: 81855 - DNA, 25 bp, E. coli
ttcatacgccgatgccgagaaggat
